United States Patent 7,691,997 (FUNCTIONAL AND HYPERFUNCTIONAL SIRNA) - sequence listing, part 16

SEQ ID NO: 627502 - RNA, 19 nt, Homo sapiens
cugcugcucugguuuaaga

SEQ ID NO: 627503 - RNA, 19 nt, Homo sapiens
gggcugaaguugacugcau

SEQ ID NO: 627504 - RNA, 19 nt, Homo sapiens
ggacuccucgucaucagaa

SEQ ID NO: 627505 - RNA, 19 nt, Homo sapiens
gggaucaagcuguuucuga

SEQ ID NO: 627506 - RNA, 19 nt, Homo sapiens
ggaagccacaggacuuaga

SEQ ID NO: 627507 - RNA, 19 nt, Homo sapiens
cagaggcccuggacaacug

SEQ ID NO: 627508 - RNA, 19 nt, Homo sapiens
gaaguccucacgacguuug

SEQ ID NO: 627509 - RNA, 19 nt, Homo sapiens
uggcugugcuggacuuuau

SEQ ID NO: 627510 - RNA, 19 nt, Homo sapiens
gauugcagccucugugaug

SEQ ID NO: 627511 - RNA, 19 nt, Homo sapiens
gggagcacaugcagcuguu

SEQ ID NO: 627512 - RNA, 19 nt, Homo sapiens
gacuuggacugcaguuugu

SEQ ID NO: 627513 - RNA, 19 nt, Homo sapiens
gucuagcucuugcugcuuu

SEQ ID NO: 627514 - RNA, 19 nt, Homo sapiens
ucuguggauuugccaauuu

SEQ ID NO: 627515 - RNA, 19 nt, Homo sapiens
cagcucaucugcuccuaca

SEQ ID NO: 627516 - RNA, 19 nt, Homo sapiens
uggccugccuccuggauuu

SEQ ID NO: 627517 - RNA, 19 nt, Homo sapiens
gaagguggucgccaacauc

SEQ ID NO: 627518 - RNA, 19 nt, Homo sapiens
gaaguccacguugucauga

SEQ ID NO: 627519 - RNA, 19 nt, Homo sapiens
gcacagugaggacagaaca

SEQ ID NO: 627520 - RNA, 19 nt, Homo sapiens
gagggaggaaggagugaaa

SEQ ID NO: 627521 - RNA, 19 nt, Homo sapiens
gcaugucccucuugaacac

SEQ ID NO: 627522 - RNA, 19 nt, Homo sapiens
ggagguuacgccaccauug

SEQ ID NO: 627523 - RNA, 19 nt, Homo sapiens
cagaacagaaccaggauuc

SEQ ID NO: 627524 - RNA, 19 nt, Homo sapiens
uggcagggauccucuacau

SEQ ID NO: 627525 - RNA, 19 nt, Homo sapiens
gaaggccagcucccuagga

SEQ ID NO: 627526 - RNA, 19 nt, Homo sapiens
ugucauauccguucucuac

SEQ ID NO: 627527 - RNA, 19 nt, Homo sapiens
gccuguagccuucuugaug

SEQ ID NO: 627528 - RNA, 19 nt, Homo sapiens
gaggacagaacaugcuugu

SEQ ID NO: 627529 - RNA, 19 nt, Homo sapiens
cagcaguagcuuugagauu

SEQ ID NO: 627530 - RNA, 19 nt, Homo sapiens
uaucaagaccucuccaagu

SEQ ID NO: 627531 - RNA, 19 nt, Homo sapiens
gcucaucugcuccuacauc

SEQ ID NO: 627532 - RNA, 19 nt, Homo sapiens
ugaagguggucgccaacau

SEQ ID NO: 627533 - RNA, 19 nt, Homo sapiens
gacaugacacucucugaag

SEQ ID NO: 627534 - RNA, 19 nt, Homo sapiens
ugggugauccugaagauug

SEQ ID NO: 627535 - RNA, 19 nt, Homo sapiens
gacugcaugucccucuuga

SEQ ID NO: 627536 - RNA, 19 nt, Homo sapiens
cgacuucucccagauagug

SEQ ID NO: 627537 - RNA, 19 nt, Homo sapiens
cugaaguccucacgacguu

SEQ ID NO: 627538 - RNA, 19 nt, Homo sapiens
ucucugaaguccacguugu

SEQ ID NO: 627539 - RNA, 19 nt, Homo sapiens
agacaugacacucucugaa

SEQ ID NO: 627540 - RNA, 19 nt, Homo sapiens
gcuggucaaggaugucuuu

SEQ ID NO: 627541 - RNA, 19 nt, Homo sapiens
gaagccacaggacuuagau

SEQ ID NO: 627542 - RNA, 19 nt, Homo sapiens
gcaguggaucuccgucaga

SEQ ID NO: 627543 - RNA, 19 nt, Homo sapiens
gagcacaugcagcuguuuc

SEQ ID NO: 627544 - RNA, 19 nt, Homo sapiens
ggaggaaggagugaaacug

SEQ ID NO: 627545 - RNA, 19 nt, Homo sapiens
ugaaguccacguugucaug

SEQ ID NO: 627546 - RNA, 19 nt, Homo sapiens
gcucugcacugggcucucu

SEQ ID NO: 627547 - RNA, 19 nt, Homo sapiens
gcaacaggaagcaguggau

SEQ ID NO: 627548 - RNA, 19 nt, Homo sapiens
cuauggagaugcucagaac

SEQ ID NO: 627549 - RNA, 19 nt, Homo sapiens
gugccuacaucuccuuugg

SEQ ID NO: 627550 - RNA, 19 nt, Homo sapiens
acaugacacucucugaagu

SEQ ID NO: 627551 - RNA, 19 nt, Homo sapiens
cuacuuggcagacaugaca

SEQ ID NO: 627552 - RNA, 19 nt, Homo sapiens
cugagcaacugguguccuu

SEQ ID NO: 627553 - RNA, 19 nt, Homo sapiens
ggaucgaugccaccucguu

SEQ ID NO: 627554 - RNA, 19 nt, Homo sapiens
aacagaaccaggauucauu

SEQ ID NO: 627555 - RNA, 19 nt, Homo sapiens
ucauauccguucucuacca

SEQ ID NO: 627556 - RNA, 19 nt, Homo sapiens
cagggaagccacaggacuu

SEQ ID NO: 627557 - RNA, 19 nt, Homo sapiens
ccaaagcugaggagguuuc

SEQ ID NO: 627558 - RNA, 19 nt, Homo sapiens
acagaaccaggauucauug

SEQ ID NO: 627559 - RNA, 19 nt, Homo sapiens
cagcagcaguagcuuugag

SEQ ID NO: 627560 - RNA, 19 nt, Homo sapiens
ucaagcuguuucugaacga

SEQ ID NO: 627561 - RNA, 19 nt, Homo sapiens
ucugggacauggagaacga

SEQ ID NO: 627562 - RNA, 19 nt, Homo sapiens
gaggaguccaaguuuagga

SEQ ID NO: 627563 - RNA, 19 nt, Homo sapiens
cagguucugcccaucauug

SEQ ID NO: 627564 - RNA, 19 nt, Homo sapiens
ugucuuugccuuucagguu

SEQ ID NO: 627565 - RNA, 19 nt, Homo sapiens
gcacaugcagcuguuucga

SEQ ID NO: 627566 - RNA, 19 nt, Homo sapiens
ccucagcagcaguagcuuu

SEQ ID NO: 627567 - RNA, 19 nt, Homo sapiens
ugggagacaugguggacau

SEQ ID NO: 627568 - RNA, 19 nt, Homo sapiens
gagguuacgccaccauugc

SEQ ID NO: 627569 - RNA, 19 nt, Homo sapiens
ugcagugggugauccugaa

SEQ ID NO: 627570 - RNA, 19 nt, Homo sapiens
caggauucauugcguucga

SEQ ID NO: 627571 - RNA, 19 nt, Homo sapiens
cgccugcugcucugguuua

SEQ ID NO: 627572 - RNA, 19 nt, Homo sapiens
gagaugcucagaaccucau

SEQ ID NO: 627573 - RNA, 19 nt, Homo sapiens
ggccaagggucuggagaac

SEQ ID NO: 627574 - RNA, 19 nt, Homo sapiens
gaaauggacuugaaauuga

SEQ ID NO: 627575 - RNA, 19 nt, Homo sapiens
gaagagaaguuucguuaca

SEQ ID NO: 627576 - RNA, 19 nt, Homo sapiens
gaucaagccuauucucgua

SEQ ID NO: 627577 - RNA, 19 nt, Homo sapiens
uuccauagcucuucaaaua

SEQ ID NO: 627578 - RNA, 19 nt, Homo sapiens
gugcagagcugucagaaga

SEQ ID NO: 627579 - RNA, 19 nt, Homo sapiens
gaaaucauccauugugaaa

SEQ ID NO: 627580 - RNA, 19 nt, Homo sapiens
caaaggagcuauugcuugu

SEQ ID NO: 627581 - RNA, 19 nt, Homo sapiens
ccaaggaaaucauccauug

SEQ ID NO: 627582 - RNA, 19 nt, Homo sapiens
gcacguaauucaagugaug

SEQ ID NO: 627583 - RNA, 19 nt, Homo sapiens
gaccagaccuccaagcuau

SEQ ID NO: 627584 - RNA, 19 nt, Homo sapiens
ggaaauggacuugaaauug

SEQ ID NO: 627585 - RNA, 19 nt, Homo sapiens
ucaaaugcaucaaagcuuu

SEQ ID NO: 627586 - RNA, 19 nt, Homo sapiens
gcacuuaucagcaugaaga

SEQ ID NO: 627587 - RNA, 19 nt, Homo sapiens
gguuaaaucucccaaggaa

SEQ ID NO: 627588 - RNA, 19 nt, Homo sapiens
gcacuuggaaauaaagaua

SEQ ID NO: 627589 - RNA, 19 nt, Homo sapiens
ucugagagguaguuaauuu

SEQ ID NO: 627590 - RNA, 19 nt, Homo sapiens
gcacagcauugcagcaguu

SEQ ID NO: 627591 - RNA, 19 nt, Homo sapiens
gaacgagugauuaguacua

SEQ ID NO: 627592 - RNA, 19 nt, Homo sapiens
gcauuuggcauaggaauua

SEQ ID NO: 627593 - RNA, 19 nt, Homo sapiens
ggcaauauguugaugauuc

SEQ ID NO: 627594 - RNA, 19 nt, Homo sapiens
ggaaacgugucgucuggaa

SEQ ID NO: 627595 - RNA, 19 nt, Homo sapiens
gaagagaaagcaucauaau

SEQ ID NO: 627596 - RNA, 19 nt, Homo sapiens
ggaugaaacugcugucaca

SEQ ID NO: 627597 - RNA, 19 nt, Homo sapiens
ccagauauaguaaagguua

SEQ ID NO: 627598 - RNA, 19 nt, Homo sapiens
ccaggaaaguggagaauuc

SEQ ID NO: 627599 - RNA, 19 nt, Homo sapiens
ucaaauagcacuuggaaau

SEQ ID NO: 627600 - RNA, 19 nt, Homo sapiens
cgacaagccaaucuucuua

SEQ ID NO: 627601 - RNA, 19 nt, Homo sapiens
uuacuacgcuaaagaagaa

SEQ ID NO: 627602 - RNA, 19 nt, Homo sapiens
caaauagcacuuggaaaua

SEQ ID NO: 627603 - RNA, 19 nt, Homo sapiens
ggauguacuuuaccuucua

SEQ ID NO: 627604 - RNA, 19 nt, Homo sapiens
acacagauguagcacguaa

SEQ ID NO: 627605 - RNA, 19 nt, Homo sapiens
ugaagaaaguggugcaguu

SEQ ID NO: 627606 - RNA, 19 nt, Homo sapiens
guaaauggaccuacuaaca

SEQ ID NO: 627607 - RNA, 19 nt, Homo sapiens
gaaguuucguuacaugugu

SEQ ID NO: 627608 - RNA, 19 nt, Homo sapiens
caagagaaucugaucaauu

SEQ ID NO: 627609 - RNA, 19 nt, Homo sapiens
aaagagcaauauuccagua

SEQ ID NO: 627610 - RNA, 19 nt, Homo sapiens
ggaagaggauauauuuaac

SEQ ID NO: 627611 - RNA, 19 nt, Homo sapiens
gaacgccuaugaagaugau

SEQ ID NO: 627612 - RNA, 19 nt, Homo sapiens
caacaauaccuuccucuau

SEQ ID NO: 627613 - RNA, 19 nt, Homo sapiens
agagagaucuagaagagaa

SEQ ID NO: 627614 - RNA, 19 nt, Homo sapiens
ugauagguauguaggauuu

SEQ ID NO: 627615 - RNA, 19 nt, Homo sapiens
ccaccuaggacgagaaaua

SEQ ID NO: 627616 - RNA, 19 nt, Homo sapiens
aaauggaccuacuaacaaa

SEQ ID NO: 627617 - RNA, 19 nt, Homo sapiens
gguaguagcuguggauaca

SEQ ID NO: 627618 - RNA, 19 nt, Homo sapiens
gcaagagaaucugaucaau

SEQ ID NO: 627619 - RNA, 19 nt, Homo sapiens
gagcaauauuccaguaaau

SEQ ID NO: 627620 - RNA, 19 nt, Homo sapiens
cggaagaggauauauuuaa

SEQ ID NO: 627621 - RNA, 19 nt, Homo sapiens
agagauaacauccaacuaa

SEQ ID NO: 627622 - RNA, 19 nt, Homo sapiens
gcaagaagccggcaagcau

SEQ ID NO: 627623 - RNA, 19 nt, Homo sapiens
cagaagagaaagcaucaua

SEQ ID NO: 627624 - RNA, 19 nt, Homo sapiens
uaaauggaccuacuaacaa

SEQ ID NO: 627625 - RNA, 19 nt, Homo sapiens
cggaagagaaguuucguua

SEQ ID NO: 627626 - RNA, 19 nt, Homo sapiens
ugaagauggugcuguuauu

SEQ ID NO: 627627 - RNA, 19 nt, Homo sapiens
gauguacuuuaccuucuaa

SEQ ID NO: 627628 - RNA, 19 nt, Homo sapiens
gaauguggccguguucaaa

SEQ ID NO: 627629 - RNA, 19 nt, Homo sapiens
ccagugggcugagcaagaa

SEQ ID NO: 627630 - RNA, 19 nt, Homo sapiens
gaagaaaguggugcaguug

SEQ ID NO: 627631 - RNA, 19 nt, Homo sapiens
ugagauauguacacaguca

SEQ ID NO: 627632 - RNA, 19 nt, Homo sapiens
gaagauggugcuguuauug

SEQ ID NO: 627633 - RNA, 19 nt, Homo sapiens
gcaagcauccagaagagaa

SEQ ID NO: 627634 - RNA, 19 nt, Homo sapiens
gcagagcugucagaagaug

SEQ ID NO: 627635 - RNA, 19 nt, Homo sapiens
ggaguggaacgagugauua

SEQ ID NO: 627636 - RNA, 19 nt, Homo sapiens
acagaucgaugacuacaau

SEQ ID NO: 627637 - RNA, 19 nt, Homo sapiens
gagauaacauccaacuaac

SEQ ID NO: 627638 - RNA, 19 nt, Homo sapiens
agaacaaucugcaugaauc

SEQ ID NO: 627639 - RNA, 19 nt, Homo sapiens
acucggaucuccuagcuuu

SEQ ID NO: 627640 - RNA, 19 nt, Homo sapiens
ccucguggcucccuaugaa

SEQ ID NO: 627641 - RNA, 19 nt, Homo sapiens
ccaaucuucuuaagggaaa

SEQ ID NO: 627642 - RNA, 19 nt, Homo sapiens
uaguagcuguggauacaua

SEQ ID NO: 627643 - RNA, 19 nt, Homo sapiens
acacagucauucuuacuau

SEQ ID NO: 627644 - RNA, 19 nt, Homo sapiens
gagaauaauaugucugaug

SEQ ID NO: 627645 - RNA, 19 nt, Homo sapiens
ggaaaucauccauugugaa

SEQ ID NO: 627646 - RNA, 19 nt, Homo sapiens
ccagaagaaacuuauguaa

SEQ ID NO: 627647 - RNA, 19 nt, Homo sapiens
caagguuccugggcuauau

SEQ ID NO: 627648 - RNA, 19 nt, Homo sapiens
ccucuuugccugagaauaa

SEQ ID NO: 627649 - RNA, 19 nt, Homo sapiens
gaacaaucugcaugaauca

SEQ ID NO: 627650 - RNA, 19 nt, Homo sapiens
caaaacaugucaaaaguca

SEQ ID NO: 627651 - RNA, 19 nt, Homo sapiens
gggauaaagugaagauggu

SEQ ID NO: 627652 - RNA, 19 nt, Homo sapiens
gagcuuuucugaaguguuu

SEQ ID NO: 627653 - RNA, 19 nt, Homo sapiens
aaauagcucugaaggcaau

SEQ ID NO: 627654 - RNA, 19 nt, Homo sapiens
guuagcagcauuuggcaua

SEQ ID NO: 627655 - RNA, 19 nt, Homo sapiens
aagcuacgcugggcaauau

SEQ ID NO: 627656 - RNA, 19 nt, Homo sapiens
guauaaagggcagguagua

SEQ ID NO: 627657 - RNA, 19 nt, Homo sapiens
uaucaaagaagcuucagaa

SEQ ID NO: 627658 - RNA, 19 nt, Homo sapiens
gauggugcuguuauuguua

SEQ ID NO: 627659 - RNA, 19 nt, Homo sapiens
uugaacagaucgaugacua

SEQ ID NO: 627660 - RNA, 19 nt, Homo sapiens
guacuaaaggguuaaaucu

SEQ ID NO: 627661 - RNA, 19 nt, Homo sapiens
ccaauaauccagauauagu

SEQ ID NO: 627662 - RNA, 19 nt, Homo sapiens
ggaccaguuuggaaaugga

SEQ ID NO: 627663 - RNA, 19 nt, Homo sapiens
gcaguuggccuaucuuaac

SEQ ID NO: 627664 - RNA, 19 nt, Homo sapiens
gcggaagaggauauauuua

SEQ ID NO: 627665 - RNA, 19 nt, Homo sapiens
gguuacagaucaaacucaa

SEQ ID NO: 627666 - RNA, 19 nt, Homo sapiens
gaacagaucgaugacuaca

SEQ ID NO: 627667 - RNA, 19 nt, Homo sapiens
acaauaccuuccucuauca

SEQ ID NO: 627668 - RNA, 19 nt, Homo sapiens
ggacucggaucuccuagcu

SEQ ID NO: 627669 - RNA, 19 nt, Homo sapiens
ggaauugugcaagccauaa

SEQ ID NO: 627670 - RNA, 19 nt, Homo sapiens
agagcaauauuccaguaaa

SEQ ID NO: 627671 - RNA, 19 nt, Homo sapiens
guggaacgagugauuagua

SEQ ID NO: 627672 - RNA, 19 nt, Homo sapiens
cuaugaagaugauguugau

SEQ ID NO: 627673 - RNA, 19 nt, Homo sapiens
aacaauaccuuccucuauc

SEQ ID NO: 627674 - RNA, 19 nt, Homo sapiens
gaaauggacuugaaauuga

SEQ ID NO: 627675 - RNA, 19 nt, Homo sapiens
gaagagaaguuucguuaca

SEQ ID NO: 627676 - RNA, 19 nt, Homo sapiens
gaucaagccuauucucgua

SEQ ID NO: 627677 - RNA, 19 nt, Homo sapiens
uuccauagcucuucaaaua

SEQ ID NO: 627678 - RNA, 19 nt, Homo sapiens
gugcagagcugucagaaga

SEQ ID NO: 627679 - RNA, 19 nt, Homo sapiens
gaaaucauccauugugaaa

SEQ ID NO: 627680 - RNA, 19 nt, Homo sapiens
caaaggagcuauugcuugu

SEQ ID NO: 627681 - RNA, 19 nt, Homo sapiens
ccaaggaaaucauccauug

SEQ ID NO: 627682 - RNA, 19 nt, Homo sapiens
gcacguaauucaagugaug

SEQ ID NO: 627683 - RNA, 19 nt, Homo sapiens
gaccagaccuccaagcuau

SEQ ID NO: 627684 - RNA, 19 nt, Homo sapiens
ggaaauggacuugaaauug

SEQ ID NO: 627685 - RNA, 19 nt, Homo sapiens
ucaaaugcaucaaagcuuu

SEQ ID NO: 627686 - RNA, 19 nt, Homo sapiens
gcacuuaucagcaugaaga

SEQ ID NO: 627687 - RNA, 19 nt, Homo sapiens
gguuaaaucucccaaggaa

SEQ ID NO: 627688 - RNA, 19 nt, Homo sapiens
gcacuuggaaauaaagaua

SEQ ID NO: 627689 - RNA, 19 nt, Homo sapiens
ucugagagguaguuaauuu

SEQ ID NO: 627690 - RNA, 19 nt, Homo sapiens
gcacagcauugcagcaguu

SEQ ID NO: 627691 - RNA, 19 nt, Homo sapiens
gaacgagugauuaguacua

SEQ ID NO: 627692 - RNA, 19 nt, Homo sapiens
gcauuuggcauaggaauua

SEQ ID NO: 627693 - RNA, 19 nt, Homo sapiens
ggcaauauguugaugauuc

SEQ ID NO: 627694 - RNA, 19 nt, Homo sapiens
ggaaacgugucgucuggaa

SEQ ID NO: 627695 - RNA, 19 nt, Homo sapiens
gaagagaaagcaucauaau

SEQ ID NO: 627696 - RNA, 19 nt, Homo sapiens
ggaugaaacugcugucaca

SEQ ID NO: 627697 - RNA, 19 nt, Homo sapiens
ccagauauaguaaagguua

SEQ ID NO: 627698 - RNA, 19 nt, Homo sapiens
ccaggaaaguggagaauuc

SEQ ID NO: 627699 - RNA, 19 nt, Homo sapiens
ucaaauagcacuuggaaau

SEQ ID NO: 627700 - RNA, 19 nt, Homo sapiens
cgacaagccaaucuucuua

SEQ ID NO: 627701 - RNA, 19 nt, Homo sapiens
uuacuacgcuaaagaagaa

SEQ ID NO: 627702 - RNA, 19 nt, Homo sapiens
caaauagcacuuggaaaua

SEQ ID NO: 627703 - RNA, 19 nt, Homo sapiens
ggauguacuuuaccuucua

SEQ ID NO: 627704 - RNA, 19 nt, Homo sapiens
acacagauguagcacguaa

SEQ ID NO: 627705 - RNA, 19 nt, Homo sapiens
ugaagaaaguggugcaguu

SEQ ID NO: 627706 - RNA, 19 nt, Homo sapiens
guaaauggaccuacuaaca

SEQ ID NO: 627707 - RNA, 19 nt, Homo sapiens
gaaguuucguuacaugugu

SEQ ID NO: 627708 - RNA, 19 nt, Homo sapiens
caagagaaucugaucaauu

SEQ ID NO: 627709 - RNA, 19 nt, Homo sapiens
aaagagcaauauuccagua

SEQ ID NO: 627710 - RNA, 19 nt, Homo sapiens
ggaagaggauauauuuaac

SEQ ID NO: 627711 - RNA, 19 nt, Homo sapiens
gaacgccuaugaagaugau

SEQ ID NO: 627712 - RNA, 19 nt, Homo sapiens
caacaauaccuuccucuau

SEQ ID NO: 627713 - RNA, 19 nt, Homo sapiens
agagagaucuagaagagaa

SEQ ID NO: 627714 - RNA, 19 nt, Homo sapiens
ugauagguauguaggauuu

SEQ ID NO: 627715 - RNA, 19 nt, Homo sapiens
ccaccuaggacgagaaaua

SEQ ID NO: 627716 - RNA, 19 nt, Homo sapiens
aaauggaccuacuaacaaa

SEQ ID NO: 627717 - RNA, 19 nt, Homo sapiens
gguaguagcuguggauaca

SEQ ID NO: 627718 - RNA, 19 nt, Homo sapiens
gcaagagaaucugaucaau

SEQ ID NO: 627719 - RNA, 19 nt, Homo sapiens
gagcaauauuccaguaaau

SEQ ID NO: 627720 - RNA, 19 nt, Homo sapiens
cggaagaggauauauuuaa

SEQ ID NO: 627721 - RNA, 19 nt, Homo sapiens
agagauaacauccaacuaa

SEQ ID NO: 627722 - RNA, 19 nt, Homo sapiens
gcaagaagccggcaagcau

SEQ ID NO: 627723 - RNA, 19 nt, Homo sapiens
cagaagagaaagcaucaua

SEQ ID NO: 627724 - RNA, 19 nt, Homo sapiens
uaaauggaccuacuaacaa

SEQ ID NO: 627725 - RNA, 19 nt, Homo sapiens
cggaagagaaguuucguua

SEQ ID NO: 627726 - RNA, 19 nt, Homo sapiens
ugaagauggugcuguuauu

SEQ ID NO: 627727 - RNA, 19 nt, Homo sapiens
gauguacuuuaccuucuaa

SEQ ID NO: 627728 - RNA, 19 nt, Homo sapiens
gaauguggccguguucaaa

SEQ ID NO: 627729 - RNA, 19 nt, Homo sapiens
ccagugggcugagcaagaa

SEQ ID NO: 627730 - RNA, 19 nt, Homo sapiens
gaagaaaguggugcaguug

SEQ ID NO: 627731 - RNA, 19 nt, Homo sapiens
ugagauauguacacaguca

SEQ ID NO: 627732 - RNA, 19 nt, Homo sapiens
gaagauggugcuguuauug

SEQ ID NO: 627733 - RNA, 19 nt, Homo sapiens
gcaagcauccagaagagaa

SEQ ID NO: 627734 - RNA, 19 nt, Homo sapiens
gcagagcugucagaagaug

SEQ ID NO: 627735 - RNA, 19 nt, Homo sapiens
ggaguggaacgagugauua

SEQ ID NO: 627736 - RNA, 19 nt, Homo sapiens
acagaucgaugacuacaau

SEQ ID NO: 627737 - RNA, 19 nt, Homo sapiens
gagauaacauccaacuaac

SEQ ID NO: 627738 - RNA, 19 nt, Homo sapiens
agaacaaucugcaugaauc

SEQ ID NO: 627739 - RNA, 19 nt, Homo sapiens
acucggaucuccuagcuuu

SEQ ID NO: 627740 - RNA, 19 nt, Homo sapiens
ccucguggcucccuaugaa

SEQ ID NO: 627741 - RNA, 19 nt, Homo sapiens
ccaaucuucuuaagggaaa

SEQ ID NO: 627742 - RNA, 19 nt, Homo sapiens
uaguagcuguggauacaua

SEQ ID NO: 627743 - RNA, 19 nt, Homo sapiens
acacagucauucuuacuau

SEQ ID NO: 627744 - RNA, 19 nt, Homo sapiens
gagaauaauaugucugaug

SEQ ID NO: 627745 - RNA, 19 nt, Homo sapiens
ggaaaucauccauugugaa

SEQ ID NO: 627746 - RNA, 19 nt, Homo sapiens
ccagaagaaacuuauguaa

SEQ ID NO: 627747 - RNA, 19 nt, Homo sapiens
caagguuccugggcuauau

SEQ ID NO: 627748 - RNA, 19 nt, Homo sapiens
ccucuuugccugagaauaa

SEQ ID NO: 627749 - RNA, 19 nt, Homo sapiens
gaacaaucugcaugaauca

SEQ ID NO: 627750 - RNA, 19 nt, Homo sapiens
caaaacaugucaaaaguca

SEQ ID NO: 627751 - RNA, 19 nt, Homo sapiens
gggauaaagugaagauggu

SEQ ID NO: 627752 - RNA, 19 nt, Homo sapiens
gagcuuuucugaaguguuu

SEQ ID NO: 627753 - RNA, 19 nt, Homo sapiens
aaauagcucugaaggcaau

SEQ ID NO: 627754 - RNA, 19 nt, Homo sapiens
guuagcagcauuuggcaua

SEQ ID NO: 627755 - RNA, 19 nt, Homo sapiens
aagcuacgcugggcaauau

SEQ ID NO: 627756 - RNA, 19 nt, Homo sapiens
guauaaagggcagguagua

SEQ ID NO: 627757 - RNA, 19 nt, Homo sapiens
uaucaaagaagcuucagaa

SEQ ID NO: 627758 - RNA, 19 nt, Homo sapiens
gauggugcuguuauuguua

SEQ ID NO: 627759 - RNA, 19 nt, Homo sapiens
uugaacagaucgaugacua

SEQ ID NO: 627760 - RNA, 19 nt, Homo sapiens
guacuaaaggguuaaaucu

SEQ ID NO: 627761 - RNA, 19 nt, Homo sapiens
ccaauaauccagauauagu

SEQ ID NO: 627762 - RNA, 19 nt, Homo sapiens
ggaccaguuuggaaaugga

SEQ ID NO: 627763 - RNA, 19 nt, Homo sapiens
gcaguuggccuaucuuaac

SEQ ID NO: 627764 - RNA, 19 nt, Homo sapiens
gcggaagaggauauauuua

SEQ ID NO: 627765 - RNA, 19 nt, Homo sapiens
gguuacagaucaaacucaa

SEQ ID NO: 627766 - RNA, 19 nt, Homo sapiens
gaacagaucgaugacuaca

SEQ ID NO: 627767 - RNA, 19 nt, Homo sapiens
acaauaccuuccucuauca

SEQ ID NO: 627768 - RNA, 19 nt, Homo sapiens
ggacucggaucuccuagcu

SEQ ID NO: 627769 - RNA, 19 nt, Homo sapiens
ggaauugugcaagccauaa

SEQ ID NO: 627770 - RNA, 19 nt, Homo sapiens
agagcaauauuccaguaaa

SEQ ID NO: 627771 - RNA, 19 nt, Homo sapiens
guggaacgagugauuagua

SEQ ID NO: 627772 - RNA, 19 nt, Homo sapiens
cuaugaagaugauguugau

SEQ ID NO: 627773 - RNA, 19 nt, Homo sapiens
aacaauaccuuccucuauc

SEQ ID NO: 627774 - RNA, 19 nt, Homo sapiens
gaaauggacuugaaauuga

SEQ ID NO: 627775 - RNA, 19 nt, Homo sapiens
gaagagaaguuucguuaca

SEQ ID NO: 627776 - RNA, 19 nt, Homo sapiens
gaucaagccuauucucgua

SEQ ID NO: 627777 - RNA, 19 nt, Homo sapiens
uuccauagcucuucaaaua

SEQ ID NO: 627778 - RNA, 19 nt, Homo sapiens
cuaagaaccucugaaauuu

SEQ ID NO: 627779 - RNA, 19 nt, Homo sapiens
gugcagagcugucagaaga

SEQ ID NO: 627780 - RNA, 19 nt, Homo sapiens
gaaaucauccauugugaaa

SEQ ID NO: 627781 - RNA, 19 nt, Homo sapiens
caaaggagcuauugcuugu

SEQ ID NO: 627782 - RNA, 19 nt, Homo sapiens
ccaaggaaaucauccauug

SEQ ID NO: 627783 - RNA, 19 nt, Homo sapiens
gcacguaauucaagugaug

SEQ ID NO: 627784 - RNA, 19 nt, Homo sapiens
gaccagaccuccaagcuau

SEQ ID NO: 627785 - RNA, 19 nt, Homo sapiens
ggaaauggacuugaaauug

SEQ ID NO: 627786 - RNA, 19 nt, Homo sapiens
ucaaaugcaucaaagcuuu

SEQ ID NO: 627787 - RNA, 19 nt, Homo sapiens
gcacuuaucagcaugaaga

SEQ ID NO: 627788 - RNA, 19 nt, Homo sapiens
gguuaaaucucccaaggaa

SEQ ID NO: 627789 - RNA, 19 nt, Homo sapiens
gcacuuggaaauaaagaua

SEQ ID NO: 627790 - RNA, 19 nt, Homo sapiens
gcacagcauugcagcaguu

SEQ ID NO: 627791 - RNA, 19 nt, Homo sapiens
gaacgagugauuaguacua

SEQ ID NO: 627792 - RNA, 19 nt, Homo sapiens
gcauuuggcauaggaauua

SEQ ID NO: 627793 - RNA, 19 nt, Homo sapiens
ggaaacgugucgucuggaa

SEQ ID NO: 627794 - RNA, 19 nt, Homo sapiens
ggcaauauguugaugauuc

SEQ ID NO: 627795 - RNA, 19 nt, Homo sapiens
gaagagaaagcaucauaau

SEQ ID NO: 627796 - RNA, 19 nt, Homo sapiens
ggaugaaacugcugucaca

SEQ ID NO: 627797 - RNA, 19 nt, Homo sapiens
ccagauauaguaaagguua

SEQ ID NO: 627798 - RNA, 19 nt, Homo sapiens
ucaacaggguaguuaauuu

SEQ ID NO: 627799 - RNA, 19 nt, Homo sapiens
ccaggaaaguggagaauuc

SEQ ID NO: 627800 - RNA, 19 nt, Homo sapiens
ucaaauagcacuuggaaau

SEQ ID NO: 627801 - RNA, 19 nt, Homo sapiens
cgacaagccaaucuucuua

SEQ ID NO: 627802 - RNA, 19 nt, Homo sapiens
uuacuacgcuaaagaagaa

SEQ ID NO: 627803 - RNA, 19 nt, Homo sapiens
caaauagcacuuggaaaua

SEQ ID NO: 627804 - RNA, 19 nt, Homo sapiens
ggauguacuuuaccuucua

SEQ ID NO: 627805 - RNA, 19 nt, Homo sapiens
acacagauguagcacguaa

SEQ ID NO: 627806 - RNA, 19 nt, Homo sapiens
ugaagaaaguggugcaguu

SEQ ID NO: 627807 - RNA, 19 nt, Homo sapiens
guaaauggaccuacuaaca

SEQ ID NO: 627808 - RNA, 19 nt, Homo sapiens
gaaguuucguuacaugugu

SEQ ID NO: 627809 - RNA, 19 nt, Homo sapiens
ucuaagaaccucugaaauu

SEQ ID NO: 627810 - RNA, 19 nt, Homo sapiens
caagagaaucugaucaauu

SEQ ID NO: 627811 - RNA, 19 nt, Homo sapiens
aaagagcaauauuccagua

SEQ ID NO: 627812 - RNA, 19 nt, Homo sapiens
ggaagaggauauauuuaac

SEQ ID NO: 627813 - RNA, 19 nt, Homo sapiens
gaacgccuaugaagaugau

SEQ ID NO: 627814 - RNA, 19 nt, Homo sapiens
caacaauaccuuccucuau

SEQ ID NO: 627815 - RNA, 19 nt, Homo sapiens
agagagaucuagaagagaa

SEQ ID NO: 627816 - RNA, 19 nt, Homo sapiens
ugauagguauguaggauuu

SEQ ID NO: 627817 - RNA, 19 nt, Homo sapiens
ccaccuaggacgagaaaua

SEQ ID NO: 627818 - RNA, 19 nt, Homo sapiens
aaauggaccuacuaacaaa

SEQ ID NO: 627819 - RNA, 19 nt, Homo sapiens
gguaguagcuguggauaca

SEQ ID NO: 627820 - RNA, 19 nt, Homo sapiens
gcaagagaaucugaucaau

SEQ ID NO: 627821 - RNA, 19 nt, Homo sapiens
gagcaauauuccaguaaau

SEQ ID NO: 627822 - RNA, 19 nt, Homo sapiens
cggaagaggauauauuuaa

SEQ ID NO: 627823 - RNA, 19 nt, Homo sapiens
agagauaacauccaacuaa

SEQ ID NO: 627824 - RNA, 19 nt, Homo sapiens
gcaagaagccggcaagcau

SEQ ID NO: 627825 - RNA, 19 nt, Homo sapiens
cagaagagaaagcaucaua

SEQ ID NO: 627826 - RNA, 19 nt, Homo sapiens
uaaauggaccuacuaacaa

SEQ ID NO: 627827 - RNA, 19 nt, Homo sapiens
cggaagagaaguuucguua

SEQ ID NO: 627828 - RNA, 19 nt, Homo sapiens
aagaaccucugaaauuuga

SEQ ID NO: 627829 - RNA, 19 nt, Homo sapiens
ugaagauggugcuguuauu

SEQ ID NO: 627830 - RNA, 19 nt, Homo sapiens
gauguacuuuaccuucuaa

SEQ ID NO: 627831 - RNA, 19 nt, Homo sapiens
caacaggguaguuaauuug

SEQ ID NO: 627832 - RNA, 19 nt, Homo sapiens
gaauguggccguguucaaa

SEQ ID NO: 627833 - RNA, 19 nt, Homo sapiens
ccagugggcugagcaagaa

SEQ ID NO: 627834 - RNA, 19 nt, Homo sapiens
gaagaaaguggugcaguug

SEQ ID NO: 627835 - RNA, 19 nt, Homo sapiens
gcaagcauccagaagagaa

SEQ ID NO: 627836 - RNA, 19 nt, Homo sapiens
ugagauauguacacaguca

SEQ ID NO: 627837 - RNA, 19 nt, Homo sapiens
gcagagcugucagaagaug

SEQ ID NO: 627838 - RNA, 19 nt, Homo sapiens
ggaguggaacgagugauua

SEQ ID NO: 627839 - RNA, 19 nt, Homo sapiens
acagaucgaugacuacaau

SEQ ID NO: 627840 - RNA, 19 nt, Homo sapiens
gaagauggugcuguuauug

SEQ ID NO: 627841 - RNA, 19 nt, Homo sapiens
gagauaacauccaacuaac

SEQ ID NO: 627842 - RNA, 19 nt, Homo sapiens
agaacaaucugcaugaauc

SEQ ID NO: 627843 - RNA, 19 nt, Homo sapiens
acucggaucuccuagcuuu

SEQ ID NO: 627844 - RNA, 19 nt, Homo sapiens
ccucguggcucccuaugaa

SEQ ID NO: 627845 - RNA, 19 nt, Homo sapiens
ccaaucuucuuaagggaaa

SEQ ID NO: 627846 - RNA, 19 nt, Homo sapiens
uaguagcuguggauacaua

SEQ ID NO: 627847 - RNA, 19 nt, Homo sapiens
gagaauaauaugucugaug

SEQ ID NO: 627848 - RNA, 19 nt, Homo sapiens
ggaaaucauccauugugaa

SEQ ID NO: 627849 - RNA, 19 nt, Homo sapiens
acacagucauucuuacuau

SEQ ID NO: 627850 - RNA, 19 nt, Homo sapiens
ccagaagaaacuuauguaa

SEQ ID NO: 627851 - RNA, 19 nt, Homo sapiens
caagguuccugggcuauau

SEQ ID NO: 627852 - RNA, 19 nt, Homo sapiens
ccucuuugccugagaauaa

SEQ ID NO: 627853 - RNA, 19 nt, Homo sapiens
gaacaaucugcaugaauca

SEQ ID NO: 627854 - RNA, 19 nt, Homo sapiens
caaaacaugucaaaaguca

SEQ ID NO: 627855 - RNA, 19 nt, Homo sapiens
gagcuuuucugaaguguuu

SEQ ID NO: 627856 - RNA, 19 nt, Homo sapiens
gggauaaagugaagauggu

SEQ ID NO: 627857 - RNA, 19 nt, Homo sapiens
gcaaucggcuccgcucaag

SEQ ID NO: 627858 - RNA, 19 nt, Homo sapiens
aaauagcucugaaggcaau

SEQ ID NO: 627859 - RNA, 19 nt, Homo sapiens
guuagcagcauuuggcaua

SEQ ID NO: 627860 - RNA, 19 nt, Homo sapiens
aagcuacgcugggcaauau

SEQ ID NO: 627861 - RNA, 19 nt, Homo sapiens
guauaaagggcagguagua

SEQ ID NO: 627862 - RNA, 19 nt, Homo sapiens
uaucaaagaagcuucagaa

SEQ ID NO: 627863 - RNA, 19 nt, Homo sapiens
uugaacagaucgaugacua

SEQ ID NO: 627864 - RNA, 19 nt, Homo sapiens
gauggugcuguuauuguua

SEQ ID NO: 627865 - RNA, 19 nt, Homo sapiens
guacuaaaggguuaaaucu

SEQ ID NO: 627866 - RNA, 19 nt, Homo sapiens
ccaauaauccagauauagu

SEQ ID NO: 627867 - RNA, 19 nt, Homo sapiens
ggaccaguuuggaaaugga

SEQ ID NO: 627868 - RNA, 19 nt, Homo sapiens
gcaguuggccuaucuuaac

SEQ ID NO: 627869 - RNA, 19 nt, Homo sapiens
gcggaagaggauauauuua

SEQ ID NO: 627870 - RNA, 19 nt, Homo sapiens
gguuacagaucaaacucaa

SEQ ID NO: 627871 - RNA, 19 nt, Homo sapiens
gaacagaucgaugacuaca

SEQ ID NO: 627872 - RNA, 19 nt, Homo sapiens
acaauaccuuccucuauca

SEQ ID NO: 627873 - RNA, 19 nt, Homo sapiens
ggacucggaucuccuagcu

SEQ ID NO: 627874 - RNA, 19 nt, Homo sapiens
gcaagaagcuguccaaagg

SEQ ID NO: 627875 - RNA, 19 nt, Homo sapiens
ggacuuagacaaggaauuu

SEQ ID NO: 627876 - RNA, 19 nt, Homo sapiens
ggacauggacuuagacaag

SEQ ID NO: 627877 - RNA, 19 nt, Homo sapiens
agaaagaccuggaugacau

SEQ ID NO: 627878 - RNA, 19 nt, Homo sapiens
gcgcugagcucaugaucca

SEQ ID NO: 627879 - RNA, 19 nt, Homo sapiens
gcuaacaaccgcuuugaga

SEQ ID NO: 627880 - RNA, 19 nt, Homo sapiens
ccaaaggcaccaagaaaga

SEQ ID NO: 627881 - RNA, 19 nt, Homo sapiens
gcgccuguaucaugacuga

SEQ ID NO: 627882 - RNA, 19 nt, Homo sapiens
gccaucgucuucuuugcua

SEQ ID NO: 627883 - RNA, 19 nt, Homo sapiens
caagcugacccacaauaaa

SEQ ID NO: 627884 - RNA, 19 nt, Homo sapiens
gccucuggcucgaugguua

SEQ ID NO: 627885 - RNA, 19 nt, Homo sapiens
aaacaggcaucacccucaa

SEQ ID NO: 627886 - RNA, 19 nt, Homo sapiens
ccaagaaagaccuggauga

SEQ ID NO: 627887 - RNA, 19 nt, Homo sapiens
gggaggugcugggcaagaa

SEQ ID NO: 627888 - RNA, 19 nt, Homo sapiens
gguacuaugccuuugauga

SEQ ID NO: 627889 - RNA, 19 nt, Homo sapiens
gagguacuaugccuuugau

SEQ ID NO: 627890 - RNA, 19 nt, Homo sapiens
ccaagcugacccacaauaa

SEQ ID NO: 627891 - RNA, 19 nt, Homo sapiens
cgagagguacuaugccuuu

SEQ ID NO: 627892 - RNA, 19 nt, Homo sapiens
ccgccaagcugacccacaa

SEQ ID NO: 627893 - RNA, 19 nt, Homo sapiens
gacaauaaaguugcucuga

SEQ ID NO: 627894 - RNA, 19 nt, Homo sapiens
cgcccacgcugacaauaaa

SEQ ID NO: 627895 - RNA, 19 nt, Homo sapiens
uaacaaccgcuuugagaca

SEQ ID NO: 627896 - RNA, 19 nt, Homo sapiens
uuaaacgggucuucaaggu

SEQ ID NO: 627897 - RNA, 19 nt, Homo sapiens
gccaagcugacccacaaua

SEQ ID NO: 627898 - RNA, 19 nt, Homo sapiens
gcugagcucaugauccaaa

SEQ ID NO: 627899 - RNA, 19 nt, Homo sapiens
guccaaaggcaccaagaaa

SEQ ID NO: 627900 - RNA, 19 nt, Homo sapiens
uaucugagcuucggugacu

SEQ ID NO: 627901 - RNA, 19 nt, Homo sapiens
gcucccugguggacaauau

SEQ ID NO: 627902 - RNA, 19 nt, Homo sapiens
gagagguacuaugccuuug

SEQ ID NO: 627903 - RNA, 19 nt, Homo sapiens
ucaaggugguagaggaaau

SEQ ID NO: 627904 - RNA, 19 nt, Homo sapiens
ggaacacgacccuuaucga

SEQ ID NO: 627905 - RNA, 19 nt, Homo sapiens
guacuaugccuuugaugag

SEQ ID NO: 627906 - RNA, 19 nt, Homo sapiens
gcagccaucgucuucuuug

SEQ ID NO: 627907 - RNA, 19 nt, Homo sapiens
gaauuucuccaggacuuga

SEQ ID NO: 627908 - RNA, 19 nt, Homo sapiens
gguggacaauauucagcaa

SEQ ID NO: 627909 - RNA, 19 nt, Homo sapiens
gugcgguucuuccugaauc

SEQ ID NO: 627910 - RNA, 19 nt, Homo sapiens
gagcugccggagacaguuu

SEQ ID NO: 627911 - RNA, 19 nt, Homo sapiens
ggaccucguggagaaguuu

SEQ ID NO: 627912 - RNA, 19 nt, Homo sapiens
gcacugcucuccggggaaa

SEQ ID NO: 627913 - RNA, 19 nt, Homo sapiens
uggacaauauucagcaaca

SEQ ID NO: 627914 - RNA, 19 nt, Homo sapiens
ggcaagaagcuguccaaag

SEQ ID NO: 627915 - RNA, 19 nt, Homo sapiens
aggaauuucuccaggacuu

SEQ ID NO: 627916 - RNA, 19 nt, Homo sapiens
acucacagauggaugacau

SEQ ID NO: 627917 - RNA, 19 nt, Homo sapiens
gcuucgccaugaccaguga

SEQ ID NO: 627918 - RNA, 19 nt, Homo sapiens
cuucugcgcugagcucaug

SEQ ID NO: 627919 - RNA, 19 nt, Homo sapiens
caagaaagaccuggaugac

SEQ ID NO: 627920 - RNA, 19 nt, Homo sapiens
ggcaggcacuacucaucga

SEQ ID NO: 627921 - RNA, 19 nt, Homo sapiens
aagcugacccacaauaaag

SEQ ID NO: 627922 - RNA, 19 nt, Homo sapiens
ggaauuucuccaggacuug

SEQ ID NO: 627923 - RNA, 19 nt, Homo sapiens
uaucgacgaggacguguau

SEQ ID NO: 627924 - RNA, 19 nt, Homo sapiens
ccacgcugacaauaaaguu

SEQ ID NO: 627925 - RNA, 19 nt, Homo sapiens
ccgcccacgcugacaauaa

SEQ ID NO: 627926 - RNA, 19 nt, Homo sapiens
ggacaauauucagcaacac

SEQ ID NO: 627927 - RNA, 19 nt, Homo sapiens
uuguggaccucguggagaa

SEQ ID NO: 627928 - RNA, 19 nt, Homo sapiens
ccuuggagccgucgacuca

SEQ ID NO: 627929 - RNA, 19 nt, Homo sapiens
caauauucagcaacacuuc

SEQ ID NO: 627930 - RNA, 19 nt, Homo sapiens
gaaggagcucaaggugcua

SEQ ID NO: 627931 - RNA, 19 nt, Homo sapiens
acauggacuuagacaagga

SEQ ID NO: 627932 - RNA, 19 nt, Homo sapiens
aacacuuccuccucucuga

SEQ ID NO: 627933 - RNA, 19 nt, Homo sapiens
caaggugguagaggaaaug

SEQ ID NO: 627934 - RNA, 19 nt, Homo sapiens
gcuaugaccucaacucuaa

SEQ ID NO: 627935 - RNA, 19 nt, Homo sapiens
ggacagagcuagaaucagu

SEQ ID NO: 627936 - RNA, 19 nt, Homo sapiens
gaaaauaccugcacgauga

SEQ ID NO: 627937 - RNA, 19 nt, Homo sapiens
caagaugccugaucagaaa

SEQ ID NO: 627938 - RNA, 19 nt, Homo sapiens
gaaagcggcugccuccauu

SEQ ID NO: 627939 - RNA, 19 nt, Homo sapiens
gaauguggcuuccaaucaa

SEQ ID NO: 627940 - RNA, 19 nt, Homo sapiens
gagcgcaucucaauggaaa

SEQ ID NO: 627941 - RNA, 19 nt, Homo sapiens
ggccugagcugcuucacua

SEQ ID NO: 627942 - RNA, 19 nt, Homo sapiens
gaucagaaaccaaccauga

SEQ ID NO: 627943 - RNA, 19 nt, Homo sapiens
gaggauugcugccagagaa

SEQ ID NO: 627944 - RNA, 19 nt, Homo sapiens
cuacgucagucccguguua

SEQ ID NO: 627945 - RNA, 19 nt, Homo sapiens
gcuuacaucuggaaucuga

SEQ ID NO: 627946 - RNA, 19 nt, Homo sapiens
gcacaucauugucuucaca

SEQ ID NO: 627947 - RNA, 19 nt, Homo sapiens
ggacauugcacccaacuau

SEQ ID NO: 627948 - RNA, 19 nt, Homo sapiens
gauggcagaugcacauguu

SEQ ID NO: 627949 - RNA, 19 nt, Homo sapiens
uuagggagcucuugacaga

SEQ ID NO: 627950 - RNA, 19 nt, Homo sapiens
cagcaaggauccagacgaa

SEQ ID NO: 627951 - RNA, 19 nt, Homo sapiens
ggugagggccuucuuaaga

SEQ ID NO: 627952 - RNA, 19 nt, Homo sapiens
ucuggcagcuggcaugaua

SEQ ID NO: 627953 - RNA, 19 nt, Homo sapiens
agacaaaggcuguuagaga

SEQ ID NO: 627954 - RNA, 19 nt, Homo sapiens
aauggcagcugacccuaua

SEQ ID NO: 627955 - RNA, 19 nt, Homo sapiens
ugaagacccuggagcaugu

SEQ ID NO: 627956 - RNA, 19 nt, Homo sapiens
ggauggaccuggagauguc

SEQ ID NO: 627957 - RNA, 19 nt, Homo sapiens
ugagcuaguugguugaauu

SEQ ID NO: 627958 - RNA, 19 nt, Homo sapiens
ugagggccuucuuaagaua

SEQ ID NO: 627959 - RNA, 19 nt, Homo sapiens
ccaaguacccgcagcaaug

SEQ ID NO: 627960 - RNA, 19 nt, Homo sapiens
gagcuaguugguugaauuu

SEQ ID NO: 627961 - RNA, 19 nt, Homo sapiens
gcaaggauccagacgaagu

SEQ ID NO: 627962 - RNA, 19 nt, Homo sapiens
gugagggccuucuuaagau

SEQ ID NO: 627963 - RNA, 19 nt, Homo sapiens
caucuacaccgucaccaua

SEQ ID NO: 627964 - RNA, 19 nt, Homo sapiens
caacaagcacuaucagauc

SEQ ID NO: 627965 - RNA, 19 nt, Homo sapiens
cagacgaaguggaaacaga

SEQ ID NO: 627966 - RNA, 19 nt, Homo sapiens
gagcucaaccucauguaga

SEQ ID NO: 627967 - RNA, 19 nt, Homo sapiens
ccaagaugccugaucagaa

SEQ ID NO: 627968 - RNA, 19 nt, Homo sapiens
ggagcauugugaccacuga

SEQ ID NO: 627969 - RNA, 19 nt, Homo sapiens
gacauugcacccaacuaua

SEQ ID NO: 627970 - RNA, 19 nt, Homo sapiens
gagggugagggccuucuua

SEQ ID NO: 627971 - RNA, 19 nt, Homo sapiens
ggaagggacagagcuagaa

SEQ ID NO: 627972 - RNA, 19 nt, Homo sapiens
gcagauggcagaugcacau

SEQ ID NO: 627973 - RNA, 19 nt, Homo sapiens
gaaaccaaccaugaaugaa

SEQ ID NO: 627974 - RNA, 19 nt, Homo sapiens
agggagcucuugacagaaa

SEQ ID NO: 627975 - RNA, 19 nt, Homo sapiens
ggaggaagggacagagcua

SEQ ID NO: 627976 - RNA, 19 nt, Homo sapiens
cagagugggucaccaacga

SEQ ID NO: 627977 - RNA, 19 nt, Homo sapiens
gcagguggaggcuguguug

SEQ ID NO: 627978 - RNA, 19 nt, Homo sapiens
agaaaccaaccaugaauga

SEQ ID NO: 627979 - RNA, 19 nt, Homo sapiens
acauauaaguugagaaggu

SEQ ID NO: 627980 - RNA, 19 nt, Homo sapiens
ccacauauaaguugagaag

SEQ ID NO: 627981 - RNA, 19 nt, Homo sapiens
ggaaggaggagcagaucug

SEQ ID NO: 627982 - RNA, 19 nt, Homo sapiens
gagagugccaugaguggaa

SEQ ID NO: 627983 - RNA, 19 nt, Homo sapiens
gcagugacagucuccauca

SEQ ID NO: 627984 - RNA, 19 nt, Homo sapiens
ggacgcaugccuuucuaug

SEQ ID NO: 627985 - RNA, 19 nt, Homo sapiens
cauaggagcuguggaugag

SEQ ID NO: 627986 - RNA, 19 nt, Homo sapiens
caacggaggccaacacaac

SEQ ID NO: 627987 - RNA, 19 nt, Homo sapiens
gaagggacagagcuagaau

SEQ ID NO: 627988 - RNA, 19 nt, Homo sapiens
gcaucucaauggaaacauc

SEQ ID NO: 627989 - RNA, 19 nt, Homo sapiens
acuacaugcuggaaguaua

SEQ ID NO: 627990 - RNA, 19 nt, Homo sapiens
gagguccuguggaauguca

SEQ ID NO: 627991 - RNA, 19 nt, Homo sapiens
cagcaauggcaccugaaua

SEQ ID NO: 627992 - RNA, 19 nt, Homo sapiens
cauuauccauucccaagau

SEQ ID NO: 627993 - RNA, 19 nt, Homo sapiens
agcaauggcaccugaauaa

SEQ ID NO: 627994 - RNA, 19 nt, Homo sapiens
aacaagcacuaucagauca

SEQ ID NO: 627995 - RNA, 19 nt, Homo sapiens
ucaacaagcacuaucagau

SEQ ID NO: 627996 - RNA, 19 nt, Homo sapiens
gccaggagcgcaucucaau

SEQ ID NO: 627997 - RNA, 19 nt, Homo sapiens
caacgacaacugcaacuac

SEQ ID NO: 627998 - RNA, 19 nt, Homo sapiens
ugacucuucucucaaccuu

SEQ ID NO: 627999 - RNA, 19 nt, Homo sapiens
ucagaaaccaaccaugaau

SEQ ID NO: 628000 - RNA, 19 nt, Homo sapiens
caagcacuaucagaucaau

SEQ ID NO: 628001 - RNA, 19 nt, Homo sapiens
ggcugugacucuucucuca

SEQ ID NO: 628002 - RNA, 19 nt, Homo sapiens
gcucuucuuucccaaaauu

SEQ ID NO: 628003 - RNA, 19 nt, Homo sapiens
caccaccucugaccuccuu

SEQ ID NO: 628004 - RNA, 19 nt, Homo sapiens
cuacaugcuggaaguauau

SEQ ID NO: 628005 - RNA, 19 nt, Homo sapiens
guuagagagugccaugagu

SEQ ID NO: 628006 - RNA, 19 nt, Homo sapiens
gaucccaacggcuucaaug

SEQ ID NO: 628007 - RNA, 19 nt, Homo sapiens
ucacagccacccgguauga

SEQ ID NO: 628008 - RNA, 19 nt, Homo sapiens
ccauaggagcuguggauga

SEQ ID NO: 628009 - RNA, 19 nt, Homo sapiens
gggacaggcucuucuuucc

SEQ ID NO: 628010 - RNA, 19 nt, Homo sapiens
cuucuggacuguuuacuac

SEQ ID NO: 628011 - RNA, 19 nt, Homo sapiens
cagccaagaucuggacauc

SEQ ID NO: 628012 - RNA, 19 nt, Homo sapiens
ccuggaggcucgugaaugc

SEQ ID NO: 628013 - RNA, 19 nt, Homo sapiens
ggagccgcaucgcagguau

SEQ ID NO: 628014 - RNA, 19 nt, Homo sapiens
ugagaaggugccugccaua

SEQ ID NO: 628015 - RNA, 19 nt, Homo sapiens
gacaucagggacagacaaa

SEQ ID NO: 628016 - RNA, 19 nt, Homo sapiens
cagaaaccaaccaugaaug

SEQ ID NO: 628017 - RNA, 19 nt, Homo sapiens
caggagcgcaucucaaugg

SEQ ID NO: 628018 - RNA, 19 nt, Homo sapiens
gaggaucgccgugcagagu

SEQ ID NO: 628019 - RNA, 19 nt, Homo sapiens
gcagcaauggcaccugaau

SEQ ID NO: 628020 - RNA, 19 nt, Homo sapiens
gggucugccuccagccaaa

SEQ ID NO: 628021 - RNA, 19 nt, Homo sapiens
ggagcucaaccucauguag

SEQ ID NO: 628022 - RNA, 19 nt, Homo sapiens
ugacguccagcacaucauu

SEQ ID NO: 628023 - RNA, 19 nt, Homo sapiens
gcaccuggaaagccuggaa

SEQ ID NO: 628024 - RNA, 19 nt, Homo sapiens
gcacauguuggaggagaga

SEQ ID NO: 628025 - RNA, 19 nt, Homo sapiens
gagaaggugccugccauag

SEQ ID NO: 628026 - RNA, 19 nt, Homo sapiens
ggaggauugcugccagaga

SEQ ID NO: 628027 - RNA, 19 nt, Homo sapiens
gcaguucugaugcuuacau

SEQ ID NO: 628028 - RNA, 19 nt, Homo sapiens
agucaacacuacucacagu

SEQ ID NO: 628029 - RNA, 19 nt, Homo sapiens
ggagugcaguagacaucag

SEQ ID NO: 628030 - RNA, 19 nt, Homo sapiens
gagggacgcaugccuuucu

SEQ ID NO: 628031 - RNA, 19 nt, Homo sapiens
acuaucagaucaaugacau

SEQ ID NO: 628032 - RNA, 19 nt, Homo sapiens
uguguuggcugggcaugaa

SEQ ID NO: 628033 - RNA, 19 nt, Homo sapiens
uauuugagccagaggaaug

SEQ ID NO: 628034 - RNA, 19 nt, Homo sapiens
ggaagaagcugauggaauu

SEQ ID NO: 628035 - RNA, 19 nt, Homo sapiens
guaaagagauuguggcuau

SEQ ID NO: 628036 - RNA, 19 nt, Homo sapiens
caacauaugucacugaaau

SEQ ID NO: 628037 - RNA, 19 nt, Homo sapiens
uaagacaccucaagaaaga

SEQ ID NO: 628038 - RNA, 19 nt, Homo sapiens
gaagaugagcaaaggauua

SEQ ID NO: 628039 - RNA, 19 nt, Homo sapiens
gaacagaucucaccccaaa

SEQ ID NO: 628040 - RNA, 19 nt, Homo sapiens
gguaagggcuuccagcaaa

SEQ ID NO: 628041 - RNA, 19 nt, Homo sapiens
gaggagaacugccaaguca

SEQ ID NO: 628042 - RNA, 19 nt, Homo sapiens
ccaaauaucuacuugacuu

SEQ ID NO: 628043 - RNA, 19 nt, Homo sapiens
ugaauguccugcagaaaua

SEQ ID NO: 628044 - RNA, 19 nt, Homo sapiens
gaagagaacaagcuuuaaa

SEQ ID NO: 628045 - RNA, 19 nt, Homo sapiens
caaaggauguucguauaaa

SEQ ID NO: 628046 - RNA, 19 nt, Homo sapiens
ggaaacgcaugcugaguga

SEQ ID NO: 628047 - RNA, 19 nt, Homo sapiens
guaacuacccaucaacuua

SEQ ID NO: 628048 - RNA, 19 nt, Homo sapiens
cgacuugccuccagaagaa

SEQ ID NO: 628049 - RNA, 19 nt, Homo sapiens
gaacauccaugccuuuacu

SEQ ID NO: 628050 - RNA, 19 nt, Homo sapiens
aagaugcgcuugaauugua

SEQ ID NO: 628051 - RNA, 19 nt, Homo sapiens
gaaccaaaguccugcagau

SEQ ID NO: 628052 - RNA, 19 nt, Homo sapiens
ggaagugccacauggauaa

SEQ ID NO: 628053 - RNA, 19 nt, Homo sapiens
gagcaaaggauuaaacaga

SEQ ID NO: 628054 - RNA, 19 nt, Homo sapiens
agacuuggcugcuuaccua

SEQ ID NO: 628055 - RNA, 19 nt, Homo sapiens
gaaguuccaguguauagua

SEQ ID NO: 628056 - RNA, 19 nt, Homo sapiens
gaacugccaagucagauuu

SEQ ID NO: 628057 - RNA, 19 nt, Homo sapiens
gaaauaggaaacagucauu

SEQ ID NO: 628058 - RNA, 19 nt, Homo sapiens
gcagucauuuggagcgaua

SEQ ID NO: 628059 - RNA, 19 nt, Homo sapiens
caacuugugugcuauaucu

SEQ ID NO: 628060 - RNA, 19 nt, Homo sapiens
gcaaagaggacaugagcaa

SEQ ID NO: 628061 - RNA, 19 nt, Homo sapiens
aaggaugcuucaacuauua

SEQ ID NO: 628062 - RNA, 19 nt, Homo sapiens
guguucaccuguauaauuu

SEQ ID NO: 628063 - RNA, 19 nt, Homo sapiens
ccaaacauguuaaaguugu

SEQ ID NO: 628064 - RNA, 19 nt, Homo sapiens
gguaagacaccucaagaaa

SEQ ID NO: 628065 - RNA, 19 nt, Homo sapiens
ccaaaguccugcagauguu

SEQ ID NO: 628066 - RNA, 19 nt, Homo sapiens
caugauagcccauugagaa

SEQ ID NO: 628067 - RNA, 19 nt, Homo sapiens
aguaauagcuggugaucuu

SEQ ID NO: 628068 - RNA, 19 nt, Homo sapiens
aagcaggcguuucacaaua

SEQ ID NO: 628069 - RNA, 19 nt, Homo sapiens
ugggaaagcugaagaagug

SEQ ID NO: 628070 - RNA, 19 nt, Homo sapiens
uaauagcuauggacuguug

SEQ ID NO: 628071 - RNA, 19 nt, Homo sapiens
aaacagaggcccacagcua

SEQ ID NO: 628072 - RNA, 19 nt, Homo sapiens
gaacaugauagcccauuga

SEQ ID NO: 628073 - RNA, 19 nt, Homo sapiens
gaacauuugcacuuuguga

SEQ ID NO: 628074 - RNA, 19 nt, Homo sapiens
ggagaugucugugcuugga

SEQ ID NO: 628075 - RNA, 19 nt, Homo sapiens
gggagauugugaaauauau

SEQ ID NO: 628076 - RNA, 19 nt, Homo sapiens
gaacuagugcagucauuug

SEQ ID NO: 628077 - RNA, 19 nt, Homo sapiens
gauuuaccauggccucuuu

SEQ ID NO: 628078 - RNA, 19 nt, Homo sapiens
cggcaagucuuugaucuuu

SEQ ID NO: 628079 - RNA, 19 nt, Homo sapiens
uauguaagcucccucugaa

SEQ ID NO: 628080 - RNA, 19 nt, Homo sapiens
aagaagagaacaagcuuua

SEQ ID NO: 628081 - RNA, 19 nt, Homo sapiens
ccacuuggaucauuaaggu

SEQ ID NO: 628082 - RNA, 19 nt, Homo sapiens
gaguuccacugccagauuu

SEQ ID NO: 628083 - RNA, 19 nt, Homo sapiens
gagaacauccaugccuuua

SEQ ID NO: 628084 - RNA, 19 nt, Homo sapiens
gcgcuugaauuguauagga

SEQ ID NO: 628085 - RNA, 19 nt, Homo sapiens
ggaagcaggucucguacag

SEQ ID NO: 628086 - RNA, 19 nt, Homo sapiens
uaacuacccaucaacuuaa

SEQ ID NO: 628087 - RNA, 19 nt, Homo sapiens
ucaggaacauuugcacuuu

SEQ ID NO: 628088 - RNA, 19 nt, Homo sapiens
ugacagaucucaggaacau

SEQ ID NO: 628089 - RNA, 19 nt, Homo sapiens
agaagcaaauccagagaaa

SEQ ID NO: 628090 - RNA, 19 nt, Homo sapiens
ggaagugugcagucuguaa

SEQ ID NO: 628091 - RNA, 19 nt, Homo sapiens
gaaagcacccuaauugacu

SEQ ID NO: 628092 - RNA, 19 nt, Homo sapiens
gaucuauccaaacauguua

SEQ ID NO: 628093 - RNA, 19 nt, Homo sapiens
gaagauggcguauguaagc

SEQ ID NO: 628094 - RNA, 19 nt, Homo sapiens
gcaagucuuugaucuuucu

SEQ ID NO: 628095 - RNA, 19 nt, Homo sapiens
gaggaagugugcagucugu

SEQ ID NO: 628096 - RNA, 19 nt, Homo sapiens
gcuauggacuguuggauac

SEQ ID NO: 628097 - RNA, 19 nt, Homo sapiens
ugauggagauuucccaaga

SEQ ID NO: 628098 - RNA, 19 nt, Homo sapiens
aagcaaauccagagaaauu

SEQ ID NO: 628099 - RNA, 19 nt, Homo sapiens
gaagaagagaacaagcuuu

SEQ ID NO: 628100 - RNA, 19 nt, Homo sapiens
gaagugugcagucuguaaa

SEQ ID NO: 628101 - RNA, 19 nt, Homo sapiens
auagaaagcacccuaauug

SEQ ID NO: 628102 - RNA, 19 nt, Homo sapiens
gaaagccgucagaacuaua

SEQ ID NO: 628103 - RNA, 19 nt, Homo sapiens
cgacaaagcaagacucugu

SEQ ID NO: 628104 - RNA, 19 nt, Homo sapiens
gaaucaggccaacauggua

SEQ ID NO: 628105 - RNA, 19 nt, Homo sapiens
ccaacccuccguuucauua

SEQ ID NO: 628106 - RNA, 19 nt, Homo sapiens
gauagcccauugagaagga

SEQ ID NO: 628107 - RNA, 19 nt, Homo sapiens
gcugauggaauucauauau

SEQ ID NO: 628108 - RNA, 19 nt, Homo sapiens
gauccugugucaaguggaa

SEQ ID NO: 628109 - RNA, 19 nt, Homo sapiens
gcaagcaggcguuucacaa

SEQ ID NO: 628110 - RNA, 19 nt, Homo sapiens
cgaaugguacuuacaggua

SEQ ID NO: 628111 - RNA, 19 nt, Homo sapiens
gagaagcugaggaacuuaa

SEQ ID NO: 628112 - RNA, 19 nt, Homo sapiens
gaaauggagcacucuaaca

SEQ ID NO: 628113 - RNA, 19 nt, Homo sapiens
gcagaaccacucaauuuua

SEQ ID NO: 628114 - RNA, 19 nt, Homo sapiens
ggacaguuguacagcuaga

SEQ ID NO: 628115 - RNA, 19 nt, Homo sapiens
ucaaaggauguucguauaa

SEQ ID NO: 628116 - RNA, 19 nt, Homo sapiens
ggagaacauccaugccuuu

SEQ ID NO: 628117 - RNA, 19 nt, Homo sapiens
gaugaugguuauauugaag

SEQ ID NO: 628118 - RNA, 19 nt, Homo sapiens
guuccaguguauaguauuu

SEQ ID NO: 628119 - RNA, 19 nt, Homo sapiens
ggagaacugccaagucaga

SEQ ID NO: 628120 - RNA, 19 nt, Homo sapiens
ucucuucucuuuacauuca

SEQ ID NO: 628121 - RNA, 19 nt, Homo sapiens
acaagacuaugaaggauuc

SEQ ID NO: 628122 - RNA, 19 nt, Homo sapiens
agagaucuauccaaacaug

SEQ ID NO: 628123 - RNA, 19 nt, Homo sapiens
cugaugaaccuguuucuaa

SEQ ID NO: 628124 - RNA, 19 nt, Homo sapiens
gggaagugccacauggaua

SEQ ID NO: 628125 - RNA, 19 nt, Homo sapiens
cugcagaaauauaacugua

SEQ ID NO: 628126 - RNA, 19 nt, Homo sapiens
gaagcugauggaauucaua

SEQ ID NO: 628127 - RNA, 19 nt, Homo sapiens
gacaugagcaagcguauca

SEQ ID NO: 628128 - RNA, 19 nt, Homo sapiens
acgaagcgcuggaggagaa

SEQ ID NO: 628129 - RNA, 19 nt, Homo sapiens
guacauagaccgccuacag

SEQ ID NO: 628130 - RNA, 19 nt, Homo sapiens
uaaaguuguuugugaugga

SEQ ID NO: 628131 - RNA, 19 nt, Homo sapiens
gaaacccuugcuuguauuu

SEQ ID NO: 628132 - RNA, 19 nt, Homo sapiens
cagaaccacucaauuuuaa

SEQ ID NO: 628133 - RNA, 19 nt, Homo sapiens
gagcaagcguaucacaucu

SEQ ID NO: 628134 - RNA, 19 nt, Homo sapiens
gaaauuaaguggagaccaa

SEQ ID NO: 628135 - RNA, 19 nt, Homo sapiens
gacaugacaccaacuauua

SEQ ID NO: 628136 - RNA, 19 nt, Homo sapiens
caaaguaccuugaacucuu

SEQ ID NO: 628137 - RNA, 19 nt, Homo sapiens
gaaacuagcagacagagaa

SEQ ID NO: 628138 - RNA, 19 nt, Homo sapiens
ugaauuaggugacuuagau

SEQ ID NO: 628139 - RNA, 19 nt, Homo sapiens
ccacgauucucccaaagua

SEQ ID NO: 628140 - RNA, 19 nt, Homo sapiens
gaagacauacugcuugauu

SEQ ID NO: 628141 - RNA, 19 nt, Homo sapiens
gaagagagaaccauugaau

SEQ ID NO: 628142 - RNA, 19 nt, Homo sapiens
gcacaacggcuaaugaaga

SEQ ID NO: 628143 - RNA, 19 nt, Homo sapiens
gcagacagauguugaagag

SEQ ID NO: 628144 - RNA, 19 nt, Homo sapiens
aaaguaccuugaacucuua

SEQ ID NO: 628145 - RNA, 19 nt, Homo sapiens
gcacagguuucucuaguag

SEQ ID NO: 628146 - RNA, 19 nt, Homo sapiens
ggacaugacaccaacuauu

SEQ ID NO: 628147 - RNA, 19 nt, Homo sapiens
agagagaaccauugaauuu

SEQ ID NO: 628148 - RNA, 19 nt, Homo sapiens
gagcacagguuucucuagu

SEQ ID NO: 628149 - RNA, 19 nt, Homo sapiens
gagagcagccgaacaacaa

SEQ ID NO: 628150 - RNA, 19 nt, Homo sapiens
ggaagaaaauggaaaagga

SEQ ID NO: 628151 - RNA, 19 nt, Homo sapiens
gaagcacaacggcuaauga

SEQ ID NO: 628152 - RNA, 19 nt, Homo sapiens
ggaaauuugcgugaccuua

SEQ ID NO: 628153 - RNA, 19 nt, Homo sapiens
cacaacggcuaaugaagaa

SEQ ID NO: 628154 - RNA, 19 nt, Homo sapiens
aaagagagcagccgaacaa

SEQ ID NO: 628155 - RNA, 19 nt, Homo sapiens
uagcaacaguauucucauu

SEQ ID NO: 628156 - RNA, 19 nt, Homo sapiens
acaguauucucauuccuaa

SEQ ID NO: 628157 - RNA, 19 nt, Homo sapiens
ggaagaagaagaagaugca

SEQ ID NO: 628158 - RNA, 19 nt, Homo sapiens
gaauuaggugacuuagaua

SEQ ID NO: 628159 - RNA, 19 nt, Homo sapiens
gacaccaacuauuaggaaa

SEQ ID NO: 628160 - RNA, 19 nt, Homo sapiens
aagaagacauacugcuuga

SEQ ID NO: 628161 - RNA, 19 nt, Homo sapiens
gaaauuugcgugaccuuac

SEQ ID NO: 628162 - RNA, 19 nt, Homo sapiens
gaagaaggaacaaaacaaa

SEQ ID NO: 628163 - RNA, 19 nt, Homo sapiens
ggcagaggacggaaauuaa

SEQ ID NO: 628164 - RNA, 19 nt, Homo sapiens
uggcagaggacggaaauua

SEQ ID NO: 628165 - RNA, 19 nt, Homo sapiens
gaacaacaaaggaagaaaa

SEQ ID NO: 628166 - RNA, 19 nt, Homo sapiens
gcagaaacuagcagacaga

SEQ ID NO: 628167 - RNA, 19 nt, Homo sapiens
aagacauacugcuugauuu

SEQ ID NO: 628168 - RNA, 19 nt, Homo sapiens
guggagaccaaauaacuuu

SEQ ID NO: 628169 - RNA, 19 nt, Homo sapiens
gcagaggacggaaauuaag

SEQ ID NO: 628170 - RNA, 19 nt, Homo sapiens
acaccacgauucucccaaa

SEQ ID NO: 628171 - RNA, 19 nt, Homo sapiens
cacaagaucugccuuuuau

SEQ ID NO: 628172 - RNA, 19 nt, Homo sapiens
caagcaacauuuguaugga

SEQ ID NO: 628173 - RNA, 19 nt, Homo sapiens
uaagaagagagaaccauug

SEQ ID NO: 628174 - RNA, 19 nt, Homo sapiens
ccaagcaacauuuguaugg

SEQ ID NO: 628175 - RNA, 19 nt, Homo sapiens
gaaugggaauguggcaaca

SEQ ID NO: 628176 - RNA, 19 nt, Homo sapiens
uuaaguggagaccaaauaa

SEQ ID NO: 628177 - RNA, 19 nt, Homo sapiens
gaaagcacgcagccuccaa

SEQ ID NO: 628178 - RNA, 19 nt, Homo sapiens
cggcuuguauaaccugaaa

SEQ ID NO: 628179 - RNA, 19 nt, Homo sapiens
gauuauucaucaguuccua

SEQ ID NO: 628180 - RNA, 19 nt, Homo sapiens
gcaacaguauucucauucc

SEQ ID NO: 628181 - RNA, 19 nt, Homo sapiens
guaccugccuagcaacagu

SEQ ID NO: 628182 - RNA, 19 nt, Homo sapiens
gaacucuuagugauugaga

SEQ ID NO: 628183 - RNA, 19 nt, Homo sapiens
cuugaacucuuagugauug

SEQ ID NO: 628184 - RNA, 19 nt, Homo sapiens
ggaaaacucagaaaauugu

SEQ ID NO: 628185 - RNA, 19 nt, Homo sapiens
gaugcacccaccaguguaa

SEQ ID NO: 628186 - RNA, 19 nt, Homo sapiens
ccagcaacuuagagcguuu

SEQ ID NO: 628187 - RNA, 19 nt, Homo sapiens
aagaagagagaaccauuga

SEQ ID NO: 628188 - RNA, 19 nt, Homo sapiens
gaaccugacuauuuuaagg

SEQ ID NO: 628189 - RNA, 19 nt, Homo sapiens
guauucucauuccuaaaga

SEQ ID NO: 628190 - RNA, 19 nt, Homo sapiens
gcaacauuuguauggauuu

SEQ ID NO: 628191 - RNA, 19 nt, Homo sapiens
cuacacaagaucugccuuu

SEQ ID NO: 628192 - RNA, 19 nt, Homo sapiens
ugacaccaacuauuaggaa

SEQ ID NO: 628193 - RNA, 19 nt, Homo sapiens
caucacccaguuucgguua

SEQ ID NO: 628194 - RNA, 19 nt, Homo sapiens
uaucaugccaguaggagaa

SEQ ID NO: 628195 - RNA, 19 nt, Homo sapiens
gcacccaccaguguaaaga

SEQ ID NO: 628196 - RNA, 19 nt, Homo sapiens
caaaauuggugugaaacuu

SEQ ID NO: 628197 - RNA, 19 nt, Homo sapiens
gaagaaaauggaaaaggaa

SEQ ID NO: 628198 - RNA, 19 nt, Homo sapiens
caacuggaaccugacuauu

SEQ ID NO: 628199 - RNA, 19 nt, Homo sapiens
ucacccaguuucgguuauu

SEQ ID NO: 628200 - RNA, 19 nt, Homo sapiens
ggaagcacaacggcuaaug

SEQ ID NO: 628201 - RNA, 19 nt, Homo sapiens
cagaugggagcacagguuu

SEQ ID NO: 628202 - RNA, 19 nt, Homo sapiens
aacuggaaccugacuauuu

SEQ ID NO: 628203 - RNA, 19 nt, Homo sapiens
uaacuuugccaacuacagu

SEQ ID NO: 628204 - RNA, 19 nt, Homo sapiens
ccauggccaucacccaguu

SEQ ID NO: 628205 - RNA, 19 nt, Homo sapiens
aagcaacauuuguauggau

SEQ ID NO: 628206 - RNA, 19 nt, Homo sapiens
ccagaugggagcacagguu

SEQ ID NO: 628207 - RNA, 19 nt, Homo sapiens
gagagaaccauugaauuuu

SEQ ID NO: 628208 - RNA, 19 nt, Homo sapiens
gaacaacuggaaccugacu

SEQ ID NO: 628209 - RNA, 19 nt, Homo sapiens
aaauaacuuugccaacuac

SEQ ID NO: 628210 - RNA, 19 nt, Homo sapiens
uuaagaagacauacugcuu

SEQ ID NO: 628211 - RNA, 19 nt, Homo sapiens
guauccagcuccagcaacu

SEQ ID NO: 628212 - RNA, 19 nt, Homo sapiens
caaugcaugggaagaagaa

SEQ ID NO: 628213 - RNA, 19 nt, Homo sapiens
aagagagaaccauugaauu

SEQ ID NO: 628214 - RNA, 19 nt, Homo sapiens
uuaagaagagagaaccauu

SEQ ID NO: 628215 - RNA, 19 nt, Homo sapiens
cuaagcagacagauguuga

SEQ ID NO: 628216 - RNA, 19 nt, Homo sapiens
aagcacaacggcuaaugaa

SEQ ID NO: 628217 - RNA, 19 nt, Homo sapiens
agagaaccauugaauuuug

SEQ ID NO: 628218 - RNA, 19 nt, Homo sapiens
uaagcagacagauguugaa

SEQ ID NO: 628219 - RNA, 19 nt, Homo sapiens
aaacuagcagacagagaaa

SEQ ID NO: 628220 - RNA, 19 nt, Homo sapiens
caagaucugccuuuuauuc

SEQ ID NO: 628221 - RNA, 19 nt, Homo sapiens
ccaggcgucggcuuguaua

SEQ ID NO: 628222 - RNA, 19 nt, Homo sapiens
caacaaaggaagaaaaugg

SEQ ID NO: 628223 - RNA, 19 nt, Homo sapiens
acuggaaccugacuauuuu

SEQ ID NO: 628224 - RNA, 19 nt, Homo sapiens
cacccaguuucgguuauuu

SEQ ID NO: 628225 - RNA, 19 nt, Homo sapiens
agcacagguuucucuagua

SEQ ID NO: 628226 - RNA, 19 nt, Homo sapiens
gaugggagcacagguuucu

SEQ ID NO: 628227 - RNA, 19 nt, Homo sapiens
gacccaggcgugcagcauu

SEQ ID NO: 628228 - RNA, 19 nt, Homo sapiens
gaaggagggaaugggaaug

SEQ ID NO: 628229 - RNA, 19 nt, Homo sapiens
cgaaggagggaaugggaau

SEQ ID NO: 628230 - RNA, 19 nt, Homo sapiens
aaagaucgaaggagggaau

SEQ ID NO: 628231 - RNA, 19 nt, Homo sapiens
uaccuugaacucuuaguga

SEQ ID NO: 628232 - RNA, 19 nt, Homo sapiens
caacccaagcaacauuugu

SEQ ID NO: 628233 - RNA, 19 nt, Homo sapiens
caacaguauucucauuccu

SEQ ID NO: 628234 - RNA, 19 nt, Homo sapiens
gcagaggacugguuuguuu

SEQ ID NO: 628235 - RNA, 19 nt, Homo sapiens
gagaauaccuguuuagugu

SEQ ID NO: 628236 - RNA, 19 nt, Homo sapiens
aaacaaaguuccagagcua

SEQ ID NO: 628237 - RNA, 19 nt, Homo sapiens
gaaaugaggaguuugaguu

SEQ ID NO: 628238 - RNA, 19 nt, Homo sapiens
gcauaaacccuuugaaguu

SEQ ID NO: 628239 - RNA, 19 nt, Homo sapiens
gaauaccuguuuaguguug

SEQ ID NO: 628240 - RNA, 19 nt, Homo sapiens
gcaggagccuuucuggauu

SEQ ID NO: 628241 - RNA, 19 nt, Homo sapiens
ucuccuaucuuuagugaaa

SEQ ID NO: 628242 - RNA, 19 nt, Homo sapiens
gauuaaagccugugguuuc

SEQ ID NO: 628243 - RNA, 19 nt, Homo sapiens
gaagauaugaagaugaugu

SEQ ID NO: 628244 - RNA, 19 nt, Homo sapiens
cauaaacccuuugaaguuc

SEQ ID NO: 628245 - RNA, 19 nt, Homo sapiens
uaauguagccugccucuau

SEQ ID NO: 628246 - RNA, 19 nt, Homo sapiens
ggauguggcuauggaaaga

SEQ ID NO: 628247 - RNA, 19 nt, Homo sapiens
uuacuuggauggcuuaaca

SEQ ID NO: 628248 - RNA, 19 nt, Homo sapiens
caucuccuaucuuuaguga

SEQ ID NO: 628249 - RNA, 19 nt, Homo sapiens
caggagccuuucuggauuu

SEQ ID NO: 628250 - RNA, 19 nt, Homo sapiens
ugccucaucuccuaucuuu

SEQ ID NO: 628251 - RNA, 19 nt, Homo sapiens
aaaugaggaguuugaguua

SEQ ID NO: 628252 - RNA, 19 nt, Homo sapiens
gaagcaccaccuaucauau

SEQ ID NO: 628253 - RNA, 19 nt, Homo sapiens
agaagcaccaccuaucaua

SEQ ID NO: 628254 - RNA, 19 nt, Homo sapiens
gagccuuucuggauuugga

SEQ ID NO: 628255 - RNA, 19 nt, Homo sapiens
gagcucauucgacaguuaa

SEQ ID NO: 628256 - RNA, 19 nt, Homo sapiens
agagcucauucgacaguua

SEQ ID NO: 628257 - RNA, 19 nt, Homo sapiens
uagccugccucuauuuguu

SEQ ID NO: 628258 - RNA, 19 nt, Homo sapiens
uuauuugccucaucuccua

SEQ ID NO: 628259 - RNA, 19 nt, Homo sapiens
caugaaaugaggaguuuga

SEQ ID NO: 628260 - RNA, 19 nt, Homo sapiens
ggauuuggauguggcuaug

SEQ ID NO: 628261 - RNA, 19 nt, Homo sapiens
aggaagauaugaagaugau

SEQ ID NO: 628262 - RNA, 19 nt, Homo sapiens
acaguuaaagccauuguuu

SEQ ID NO: 628263 - RNA, 19 nt, Homo sapiens
ggauuaaagccugugguuu

SEQ ID NO: 628264 - RNA, 19 nt, Homo sapiens
ccacagaagcaccaccuau

SEQ ID NO: 628265 - RNA, 19 nt, Homo sapiens
aauguagccugccucuauu

SEQ ID NO: 628266 - RNA, 19 nt, Homo sapiens
aaaugcauauggcuuguca

SEQ ID NO: 628267 - RNA, 19 nt, Homo sapiens
ggcauaaacccuuugaagu

SEQ ID NO: 628268 - RNA, 19 nt, Homo sapiens
ccucaucuccuaucuuuag

SEQ ID NO: 628269 - RNA, 19 nt, Homo sapiens
guaugauuaugcugggaaa

SEQ ID NO: 628270 - RNA, 19 nt, Homo sapiens
auuccacaguguaugauua

SEQ ID NO: 628271 - RNA, 19 nt, Homo sapiens
ugcaugaaaugaggaguuu

SEQ ID NO: 628272 - RNA, 19 nt, Homo sapiens
gggauuaaagccugugguu

SEQ ID NO: 628273 - RNA, 19 nt, Homo sapiens
aaacugaccuccgauucca

SEQ ID NO: 628274 - RNA, 19 nt, Homo sapiens
ggacucugggcgucaugua

SEQ ID NO: 628275 - RNA, 19 nt, Homo sapiens
aagcaccaccuaucauauu

SEQ ID NO: 628276 - RNA, 19 nt, Homo sapiens
ccugaucgcccucuacaug

SEQ ID NO: 628277 - RNA, 19 nt, Homo sapiens
gcaccaccuaucauauuug

SEQ ID NO: 628278 - RNA, 19 nt, Homo sapiens
agcaccaccuaucauauuu

SEQ ID NO: 628279 - RNA, 19 nt, Homo sapiens
acacaggcuuguuaauguc

SEQ ID NO: 628280 - RNA, 19 nt, Homo sapiens
cccuggagguucuggauga

SEQ ID NO: 628281 - RNA, 19 nt, Homo sapiens
uuggauggcuuaacauuuu

SEQ ID NO: 628282 - RNA, 19 nt, Homo sapiens
gaccaucuacugccugauc

SEQ ID NO: 628283 - RNA, 19 nt, Homo sapiens
agagaauaccuguuuagug

SEQ ID NO: 628284 - RNA, 19 nt, Homo sapiens
gcuauggaaagaacacaga

SEQ ID NO: 628285 - RNA, 19 nt, Homo sapiens
acagaagcaccaccuauca

SEQ ID NO: 628286 - RNA, 19 nt, Homo sapiens
ugaaaugcauauggcuugu

SEQ ID NO: 628287 - RNA, 19 nt, Homo sapiens
gaagaugauguuuugguuu

SEQ ID NO: 628288 - RNA, 19 nt, Homo sapiens
acuggugucuguuuuguua

SEQ ID NO: 628289 - RNA, 19 nt, Homo sapiens
auaggaagauaugaagaug

SEQ ID NO: 628290 - RNA, 19 nt, Homo sapiens
gggcuucggaggccuauag

SEQ ID NO: 628291 - RNA, 19 nt, Homo sapiens
cuauagcccgcagggauua

SEQ ID NO: 628292 - RNA, 19 nt, Homo sapiens
gggacuugagguugcauuu

SEQ ID NO: 628293 - RNA, 19 nt, Homo sapiens
gugcaugaaaugaggaguu

SEQ ID NO: 628294 - RNA, 19 nt, Homo sapiens
aagccaaggucaugugcau

SEQ ID NO: 628295 - RNA, 19 nt, Homo sapiens
ugaagaugauguuuugguu

SEQ ID NO: 628296 - RNA, 19 nt, Homo sapiens
uugggcagguaauuucaaa

SEQ ID NO: 628297 - RNA, 19 nt, Homo sapiens
ccuauagcccgcagggauu

SEQ ID NO: 628298 - RNA, 19 nt, Homo sapiens
ugccugaccaaaugcuuua

SEQ ID NO: 628299 - RNA, 19 nt, Homo sapiens
caaaguuccagagcuacaa

SEQ ID NO: 628300 - RNA, 19 nt, Homo sapiens
gggcagguaauuucaaagg

SEQ ID NO: 628301 - RNA, 19 nt, Homo sapiens
ugauuucccuggagguucu

SEQ ID NO: 628302 - RNA, 19 nt, Homo sapiens
uguuugugcuccugauuuc

SEQ ID NO: 628303 - RNA, 19 nt, Homo sapiens
ccgauuccacaguguauga

SEQ ID NO: 628304 - RNA, 19 nt, Homo sapiens
uggcauaaacccuuugaag

SEQ ID NO: 628305 - RNA, 19 nt, Homo sapiens
ucagagcucauucgacagu

SEQ ID NO: 628306 - RNA, 19 nt, Homo sapiens
aagaugauguuuugguuug

SEQ ID NO: 628307 - RNA, 19 nt, Homo sapiens
uuaguggcuucacgcagaa

SEQ ID NO: 628308 - RNA, 19 nt, Homo sapiens
guguuugugcuccugauuu

SEQ ID NO: 628309 - RNA, 19 nt, Homo sapiens
cacagaagcaccaccuauc

SEQ ID NO: 628310 - RNA, 19 nt, Homo sapiens
cuaaacugaccuccgauuc

SEQ ID NO: 628311 - RNA, 19 nt, Homo sapiens
cacagaagccaaggucaug

SEQ ID NO: 628312 - RNA, 19 nt, Homo sapiens
caccaccuaucauauuugc

SEQ ID NO: 628313 - RNA, 19 nt, Homo sapiens
uuccagagcuacaaaaguu

SEQ ID NO: 628314 - RNA, 19 nt, Homo sapiens
gaacgagacugcacggauu

SEQ ID NO: 628315 - RNA, 19 nt, Homo sapiens
ggagugaaauuuccuaaga

SEQ ID NO: 628316 - RNA, 19 nt, Homo sapiens
ggaagagccaccugcaaga

SEQ ID NO: 628317 - RNA, 19 nt, Homo sapiens
gagugaaauuuccuaagau

SEQ ID NO: 628318 - RNA, 19 nt, Homo sapiens
ccaaucggacugccaaauu

SEQ ID NO: 628319 - RNA, 19 nt, Homo sapiens
gagacugcacggauuguuu

SEQ ID NO: 628320 - RNA, 19 nt, Homo sapiens
gaagagccaccugcaagau

SEQ ID NO: 628321 - RNA, 19 nt, Homo sapiens
gaaaauggcagacaaacca

SEQ ID NO: 628322 - RNA, 19 nt, Homo sapiens
gucgugauguggaggaaga

SEQ ID NO: 628323 - RNA, 19 nt, Homo sapiens
agaacacccugccgaccaa

SEQ ID NO: 628324 - RNA, 19 nt, Homo sapiens
gaggaagagccaccugcaa

SEQ ID NO: 628325 - RNA, 19 nt, Homo sapiens
agugaaauuuccuaagauc

SEQ ID NO: 628326 - RNA, 19 nt, Homo sapiens
gcacggauuguuuuaagaa

SEQ ID NO: 628327 - RNA, 19 nt, Homo sapiens
gcggagugaaauuuccuaa

SEQ ID NO: 628328 - RNA, 19 nt, Homo sapiens
gaacacccugccgaccaaa

SEQ ID NO: 628329 - RNA, 19 nt, Homo sapiens
uuaagaaaauggcagacaa

SEQ ID NO: 628330 - RNA, 19 nt, Homo sapiens
ggacaacaaugaaaugaua

SEQ ID NO: 628331 - RNA, 19 nt, Homo sapiens
ccauagaucuuuagaagua

SEQ ID NO: 628332 - RNA, 19 nt, Homo sapiens
gcaauggagugcauaaauu

SEQ ID NO: 628333 - RNA, 19 nt, Homo sapiens
gaaaugaucgguacagaaa

SEQ ID NO: 628334 - RNA, 19 nt, Homo sapiens
gaaacacucuucaccuauu

SEQ ID NO: 628335 - RNA, 19 nt, Homo sapiens
caaagacacuccacaagaa

SEQ ID NO: 628336 - RNA, 19 nt, Homo sapiens
ggaaacaucuggacaggau

SEQ ID NO: 628337 - RNA, 19 nt, Homo sapiens
guuaguagcuaugcauuua

SEQ ID NO: 628338 - RNA, 19 nt, Homo sapiens
gaaccugugucuacugaaa

SEQ ID NO: 628339 - RNA, 19 nt, Homo sapiens
ggacaggauucuagccuaa

SEQ ID NO: 628340 - RNA, 19 nt, Homo sapiens
gaaaguugaugaauaaguc

SEQ ID NO: 628341 - RNA, 19 nt, Homo sapiens
gcaaguagcaguuacaaga

SEQ ID NO: 628342 - RNA, 19 nt, Homo sapiens
gaacauaucaguugcaaag

SEQ ID NO: 628343 - RNA, 19 nt, Homo sapiens
ugacuuaucugagaaugua

SEQ ID NO: 628344 - RNA, 19 nt, Homo sapiens
agaaaugacugucccaauu

SEQ ID NO: 628345 - RNA, 19 nt, Homo sapiens
guuaaagggucgacuauau

SEQ ID NO: 628346 - RNA, 19 nt, Homo sapiens
gaacagcaauccuauaagc

SEQ ID NO: 628347 - RNA, 19 nt, Homo sapiens
acaaggaggucuacacgua

SEQ ID NO: 628348 - RNA, 19 nt, Homo sapiens
gcacaacaccagccuauga

SEQ ID NO: 628349 - RNA, 19 nt, Homo sapiens
gaaguugaaccaucuguaa

SEQ ID NO: 628350 - RNA, 19 nt, Homo sapiens
ggaaagcaguagauaaagu

SEQ ID NO: 628351 - RNA, 19 nt, Homo sapiens
gaagcauacugcaaauuau

SEQ ID NO: 628352 - RNA, 19 nt, Homo sapiens
ggucgacuauauuguauuu

SEQ ID NO: 628353 - RNA, 19 nt, Homo sapiens
gaaagcaauugcaggguau

SEQ ID NO: 628354 - RNA, 19 nt, Homo sapiens
gcaaugagcaaauagaaga

SEQ ID NO: 628355 - RNA, 19 nt, Homo sapiens
gcaaacuucugguacauca

SEQ ID NO: 628356 - RNA, 19 nt, Homo sapiens
ccuaaucccuguguuguua

SEQ ID NO: 628357 - RNA, 19 nt, Homo sapiens
gcaaaguuccuaaugugua

SEQ ID NO: 628358 - RNA, 19 nt, Homo sapiens
gaaaugacugucccaauug

SEQ ID NO: 628359 - RNA, 19 nt, Homo sapiens
gaaaggagaaccagaaagu

SEQ ID NO: 628360 - RNA, 19 nt, Homo sapiens
gaagaaagugagaagcaua

SEQ ID NO: 628361 - RNA, 19 nt, Homo sapiens
caauggagugcauaaauua

SEQ ID NO: 628362 - RNA, 19 nt, Homo sapiens
caggaguucucauuugaua

SEQ ID NO: 628363 - RNA, 19 nt, Homo sapiens
gaaaaucgguggcaaaauc

SEQ ID NO: 628364 - RNA, 19 nt, Homo sapiens
ggaaugugcaucuuuacua

SEQ ID NO: 628365 - RNA, 19 nt, Homo sapiens
gaaagcaguagauaaaguu

SEQ ID NO: 628366 - RNA, 19 nt, Homo sapiens
gaagagaaacugggaaaga

SEQ ID NO: 628367 - RNA, 19 nt, Homo sapiens
caaaguuccuaauguguau

SEQ ID NO: 628368 - RNA, 19 nt, Homo sapiens
gaaagcaaaguaaguguug

SEQ ID NO: 628369 - RNA, 19 nt, Homo sapiens
gaaagaaugacccagagaa

SEQ ID NO: 628370 - RNA, 19 nt, Homo sapiens
gaacagauucagaagcauu

SEQ ID NO: 628371 - RNA, 19 nt, Homo sapiens
gaaugugcaucuuuacuag

SEQ ID NO: 628372 - RNA, 19 nt, Homo sapiens
gaagacagacaagaaauug

SEQ ID NO: 628373 - RNA, 19 nt, Homo sapiens
guucucagcuaccuauaaa

SEQ ID NO: 628374 - RNA, 19 nt, Homo sapiens
guaccaaccuguaucuugu

SEQ ID NO: 628375 - RNA, 19 nt, Homo sapiens
uaaagccuauguagacaaa

SEQ ID NO: 628376 - RNA, 19 nt, Homo sapiens
ugagguagugcauauauua

SEQ ID NO: 628377 - RNA, 19 nt, Homo sapiens
uaacauucauccucagcua

SEQ ID NO: 628378 - RNA, 19 nt, Homo sapiens
caacaccagccuaugaaua

SEQ ID NO: 628379 - RNA, 19 nt, Homo sapiens
gcagagaacgagaaaguga

SEQ ID NO: 628380 - RNA, 19 nt, Homo sapiens
agaagcauacugcaaauua

SEQ ID NO: 628381 - RNA, 19 nt, Homo sapiens
gaugauugcuccagugauc

SEQ ID NO: 628382 - RNA, 19 nt, Homo sapiens
gcaaaacccugucucuauu

SEQ ID NO: 628383 - RNA, 19 nt, Homo sapiens
gguaauacuucgucaucaa

SEQ ID NO: 628384 - RNA, 19 nt, Homo sapiens
uaacaugaguacaccaguu

SEQ ID NO: 628385 - RNA, 19 nt, Homo sapiens
gaaguaguuuugccuauaa

SEQ ID NO: 628386 - RNA, 19 nt, Homo sapiens
caagggauaugcauuagca

SEQ ID NO: 628387 - RNA, 19 nt, Homo sapiens
gaccaaaucuaguuauaac

SEQ ID NO: 628388 - RNA, 19 nt, Homo sapiens
auaaagauaucaccaagga

SEQ ID NO: 628389 - RNA, 19 nt, Homo sapiens
aaacggaagucuguaagaa

SEQ ID NO: 628390 - RNA, 19 nt, Homo sapiens
gcaauccauuuaacauuca

SEQ ID NO: 628391 - RNA, 19 nt, Homo sapiens
aaacaaaccagcaaguuga

SEQ ID NO: 628392 - RNA, 19 nt, Homo sapiens
gaaaggaggcaaucucagu

SEQ ID NO: 628393 - RNA, 19 nt, Homo sapiens
caacaaagacacuccacaa

SEQ ID NO: 628394 - RNA, 19 nt, Homo sapiens
uagagucagugguuaauga

SEQ ID NO: 628395 - RNA, 19 nt, Homo sapiens
guagcuagauuuggucauu

SEQ ID NO: 628396 - RNA, 19 nt, Homo sapiens
caacaagucaacuacauug

SEQ ID NO: 628397 - RNA, 19 nt, Homo sapiens
aguaagaguucaucauuug

SEQ ID NO: 628398 - RNA, 19 nt, Homo sapiens
aaacacacauugaacagau

SEQ ID NO: 628399 - RNA, 19 nt, Homo sapiens
guauuuaguuucacucugu

SEQ ID NO: 628400 - RNA, 19 nt, Homo sapiens
ggaccaaaucuaguuauaa

SEQ ID NO: 628401 - RNA, 19 nt, Homo sapiens
aaucagagguaaagacaga

SEQ ID NO: 628402 - RNA, 19 nt, Homo sapiens
caagucaacuacauugcuu

SEQ ID NO: 628403 - RNA, 19 nt, Homo sapiens
caaacaaaccagcaaguug

SEQ ID NO: 628404 - RNA, 19 nt, Homo sapiens
gagcagagaacgagaaagu

SEQ ID NO: 628405 - RNA, 19 nt, Homo sapiens
cuucugaucuugcggauga

SEQ ID NO: 628406 - RNA, 19 nt, Homo sapiens
aaacagaggagcuuauaga

SEQ ID NO: 628407 - RNA, 19 nt, Homo sapiens
gaauguagagucagugguu

SEQ ID NO: 628408 - RNA, 19 nt, Homo sapiens
gcaaugacaacuccuacaa

SEQ ID NO: 628409 - RNA, 19 nt, Homo sapiens
gaagucuccuuucuguuuc

SEQ ID NO: 628410 - RNA, 19 nt, Homo sapiens
ucaaggacauuaucaggau

SEQ ID NO: 628411 - RNA, 19 nt, Homo sapiens
aagccuauguagacaaaua

SEQ ID NO: 628412 - RNA, 19 nt, Homo sapiens
cuacuaaaguggcaaaucu

SEQ ID NO: 628413 - RNA, 19 nt, Homo sapiens
caacuacauugcuucacaa

SEQ ID NO: 628414 - RNA, 19 nt, Homo sapiens
ggaaaugaucgguacagaa

SEQ ID NO: 628415 - RNA, 19 nt, Homo sapiens
gaaauaauugcaacaugug

SEQ ID NO: 628416 - RNA, 19 nt, Homo sapiens
cauuuauucugucagguua

SEQ ID NO: 628417 - RNA, 19 nt, Homo sapiens
cauguaccauuaacugaaa

SEQ ID NO: 628418 - RNA, 19 nt, Homo sapiens
gcuaauugcuugaaaaguu

SEQ ID NO: 628419 - RNA, 19 nt, Homo sapiens
guagacaguaguaacauuu

SEQ ID NO: 628420 - RNA, 19 nt, Homo sapiens
uuacuaggacuguguuaua

SEQ ID NO: 628421 - RNA, 19 nt, Homo sapiens
gcuagagaguggacguaaa

SEQ ID NO: 628422 - RNA, 19 nt, Homo sapiens
caaaagaucucagccaaga

SEQ ID NO: 628423 - RNA, 19 nt, Homo sapiens
caccaucuccuaagaauga

SEQ ID NO: 628424 - RNA, 19 nt, Homo sapiens
aagagaaacugggaaagaa

SEQ ID NO: 628425 - RNA, 19 nt, Homo sapiens
gugacacacuguucugaaa

SEQ ID NO: 628426 - RNA, 19 nt, Homo sapiens
uauggagugugauucauuu

SEQ ID NO: 628427 - RNA, 19 nt, Homo sapiens
uguugaaacugaagaugua

SEQ ID NO: 628428 - RNA, 19 nt, Homo sapiens
gguaaagacagauguaugu

SEQ ID NO: 628429 - RNA, 19 nt, Homo sapiens
cauaucaguugcaaaguuc

SEQ ID NO: 628430 - RNA, 19 nt, Homo sapiens
ggucaagacuguugucauc

SEQ ID NO: 628431 - RNA, 19 nt, Homo sapiens
gcaauguccuggcuguaga

SEQ ID NO: 628432 - RNA, 19 nt, Homo sapiens
uaacaacaguggcaaagag

SEQ ID NO: 628433 - RNA, 19 nt, Homo sapiens
ggucaaugcugcuguguac

SEQ ID NO: 628434 - RNA, 19 nt, Homo sapiens
ggacuccacccuuuagcua

SEQ ID NO: 628435 - RNA, 19 nt, Homo sapiens
gaccaucggcuucuucuau

SEQ ID NO: 628436 - RNA, 19 nt, Homo sapiens
gaacggccacccacugaug

SEQ ID NO: 628437 - RNA, 19 nt, Homo sapiens
gagaacggccacccacuga

SEQ ID NO: 628438 - RNA, 19 nt, Homo sapiens
gcgagucuguccacuauac

SEQ ID NO: 628439 - RNA, 19 nt, Homo sapiens
ccgcgagucuguccacuau

SEQ ID NO: 628440 - RNA, 19 nt, Homo sapiens
ccaacucacuggucaaugc

SEQ ID NO: 628441 - RNA, 19 nt, Homo sapiens
gcucagccgcuccuauuug

SEQ ID NO: 628442 - RNA, 19 nt, Homo sapiens
ccaucggcuucuucuauaa

SEQ ID NO: 628443 - RNA, 19 nt, Homo sapiens
caagacuguugucaucauc

SEQ ID NO: 628444 - RNA, 19 nt, Homo sapiens
accaucggcuucuucuaua

SEQ ID NO: 628445 - RNA, 19 nt, Homo sapiens
ucaagacuguugucaucau

SEQ ID NO: 628446 - RNA, 19 nt, Homo sapiens
guacgcggcaagcaacaaa

SEQ ID NO: 628447 - RNA, 19 nt, Homo sapiens
ccgcacagcccgacuuuca

SEQ ID NO: 628448 - RNA, 19 nt, Homo sapiens
guacugcuccuggaugguu

SEQ ID NO: 628449 - RNA, 19 nt, Homo sapiens
cagcccgacuuucacuuga

SEQ ID NO: 628450 - RNA, 19 nt, Homo sapiens
uagcagccaucgccuccaa

SEQ ID NO: 628451 - RNA, 19 nt, Homo sapiens
ugccagcacucgcaucaug

SEQ ID NO: 628452 - RNA, 19 nt, Homo sapiens
gcacagcccgacuuucacu

SEQ ID NO: 628453 - RNA, 19 nt, Homo sapiens
gccuaccucuuccucaugu

SEQ ID NO: 628454 - RNA, 19 nt, Homo sapiens
ccaaucugcuggucauagc

SEQ ID NO: 628455 - RNA, 19 nt, Homo sapiens
uugccgagaugcugagaug

SEQ ID NO: 628456 - RNA, 19 nt, Homo sapiens
gcuguguacacccgcauuu

SEQ ID NO: 628457 - RNA, 19 nt, Homo sapiens
caucaugcuucccgagaac

SEQ ID NO: 628458 - RNA, 19 nt, Homo sapiens
ugucgagccugcuugucuu

SEQ ID NO: 628459 - RNA, 19 nt, Homo sapiens
uguguacucuugccgagau

SEQ ID NO: 628460 - RNA, 19 nt, Homo sapiens
gcugugaguccugcaaugu

SEQ ID NO: 628461 - RNA, 19 nt, Homo sapiens
augcugcuguguacucuug

SEQ ID NO: 628462 - RNA, 19 nt, Homo sapiens
cugcucagccgcuccuauu

SEQ ID NO: 628463 - RNA, 19 nt, Homo sapiens
ggaauuagcuuaugagauu

SEQ ID NO: 628464 - RNA, 19 nt, Homo sapiens
gaaggaaggucuuacauau

SEQ ID NO: 628465 - RNA, 19 nt, Homo sapiens
gcgacaagcuggacaaaua

SEQ ID NO: 628466 - RNA, 19 nt, Homo sapiens
agaaggagauugccauuua

SEQ ID NO: 628467 - RNA, 19 nt, Homo sapiens
gggaagaccuugaaucuga

SEQ ID NO: 628468 - RNA, 19 nt, Homo sapiens
ugaaauagcuggcaaagug

SEQ ID NO: 628469 - RNA, 19 nt, Homo sapiens
gaauacgacuucaguguuu

SEQ ID NO: 628470 - RNA, 19 nt, Homo sapiens
ucaaauggcucaaggauga

SEQ ID NO: 628471 - RNA, 19 nt, Homo sapiens
cagaagagcucgagcguuu

SEQ ID NO: 628472 - RNA, 19 nt, Homo sapiens
gcaucaacaucaagaauaa

SEQ ID NO: 628473 - RNA, 19 nt, Homo sapiens
gaagggaagucuuaugugu

SEQ ID NO: 628474 - RNA, 19 nt, Homo sapiens
ugacaaagcuacuggcauu

SEQ ID NO: 628475 - RNA, 19 nt, Homo sapiens
gaagugauuugguucaaga

SEQ ID NO: 628476 - RNA, 19 nt, Homo sapiens
gaacuggugucacaaagau

SEQ ID NO: 628477 - RNA, 19 nt, Homo sapiens
gcaaggacccgcucaugua

SEQ ID NO: 628478 - RNA, 19 nt, Homo sapiens
gaugccagcuaccgauuua

SEQ ID NO: 628479 - RNA, 19 nt, Homo sapiens
ucacaaagaugcuaagauc

SEQ ID NO: 628480 - RNA, 19 nt, Homo sapiens
gcuggaaggucccgaaauu

SEQ ID NO: 628481 - RNA, 19 nt, Homo sapiens
gaaguaggaacgaauaauu

SEQ ID NO: 628482 - RNA, 19 nt, Homo sapiens
caaaguguaugaugauaug

SEQ ID NO: 628483 - RNA, 19 nt, Homo sapiens
gauaguugaucacacauug

SEQ ID NO: 628484 - RNA, 19 nt, Homo sapiens
ggaagaaugugaaguucga

SEQ ID NO: 628485 - RNA, 19 nt, Homo sapiens
gcacuucgacguccaguuu

SEQ ID NO: 628486 - RNA, 19 nt, Homo sapiens
gaccaguccuaccguaaua

SEQ ID NO: 628487 - RNA, 19 nt, Homo sapiens
ggaagaggcugaguuucaa

SEQ ID NO: 628488 - RNA, 19 nt, Homo sapiens
gaaggagauugccauuuau

SEQ ID NO: 628489 - RNA, 19 nt, Homo sapiens
ggaccgaugugaaguagga

SEQ ID NO: 628490 - RNA, 19 nt, Homo sapiens
cgacuucaguguuucauga

SEQ ID NO: 628491 - RNA, 19 nt, Homo sapiens
uaaagaauccggauaagga

SEQ ID NO: 628492 - RNA, 19 nt, Homo sapiens
gcaaacaccaagaaagaaa

SEQ ID NO: 628493 - RNA, 19 nt, Homo sapiens
ggaaacaaggcccucauuu

SEQ ID NO: 628494 - RNA, 19 nt, Homo sapiens
caaagcuacuggcauuauu

SEQ ID NO: 628495 - RNA, 19 nt, Homo sapiens
gaucuagcaucucugaaau

SEQ ID NO: 628496 - RNA, 19 nt, Homo sapiens
gcagauucaugaugggaaa

SEQ ID NO: 628497 - RNA, 19 nt, Homo sapiens
ggauuacgcuccucaacug

SEQ ID NO: 628498 - RNA, 19 nt, Homo sapiens
aaagauggcagucugauuu

SEQ ID NO: 628499 - RNA, 19 nt, Homo sapiens
caaggaugaugcucuguau

SEQ ID NO: 628500 - RNA, 19 nt, Homo sapiens
ccacaagacugaacaacgu

SEQ ID NO: 628501 - RNA, 19 nt, Homo sapiens
ccaggaaucagacgucaua

SEQ ID NO: 628502 - RNA, 19 nt, Homo sapiens
ggaauacgacuucaguguu

SEQ ID NO: 628503 - RNA, 19 nt, Homo sapiens
ggaccacggugaauacaag

SEQ ID NO: 628504 - RNA, 19 nt, Homo sapiens
gaagagcucgagcguuuga

SEQ ID NO: 628505 - RNA, 19 nt, Homo sapiens
acuccaagcuguacuuaaa

SEQ ID NO: 628506 - RNA, 19 nt, Homo sapiens
ggaaugcugugugcuuguu

SEQ ID NO: 628507 - RNA, 19 nt, Homo sapiens
aggaaggucuuacauauuc

SEQ ID NO: 628508 - RNA, 19 nt, Homo sapiens
gguaccugcuggacgaaua

SEQ ID NO: 628509 - RNA, 19 nt, Homo sapiens
gaaaucggaauuagcuuau

SEQ ID NO: 628510 - RNA, 19 nt, Homo sapiens
ugaaaucggaauuagcuua

SEQ ID NO: 628511 - RNA, 19 nt, Homo sapiens
acgaggagauuucagauga

SEQ ID NO: 628512 - RNA, 19 nt, Homo sapiens
gaacagggcaacaucuauc

SEQ ID NO: 628513 - RNA, 19 nt, Homo sapiens
ugaaggaaggucuuacaua

SEQ ID NO: 628514 - RNA, 19 nt, Homo sapiens
gaucaacagggcagacuuu

SEQ ID NO: 628515 - RNA, 19 nt, Homo sapiens
ggagagacacacauuugaa

SEQ ID NO: 628516 - RNA, 19 nt, Homo sapiens
gcugugugcuuguuccaaa

SEQ ID NO: 628517 - RNA, 19 nt, Homo sapiens
gaaacaaggcccucauuuu

SEQ ID NO: 628518 - RNA, 19 nt, Homo sapiens
gaccuacacugugcagauu

SEQ ID NO: 628519 - RNA, 19 nt, Homo sapiens
ggugauggaucgauuuagu

SEQ ID NO: 628520 - RNA, 19 nt, Homo sapiens
cgagauaugccguguuuga

SEQ ID NO: 628521 - RNA, 19 nt, Homo sapiens
gcgaugacuugcuguugaa

SEQ ID NO: 628522 - RNA, 19 nt, Homo sapiens
ggaaaguacaggauugaga

SEQ ID NO: 628523 - RNA, 19 nt, Homo sapiens
gggagaggaugucugugaa

SEQ ID NO: 628524 - RNA, 19 nt, Homo sapiens
ugaagcauuugcagaauuc

SEQ ID NO: 628525 - RNA, 19 nt, Homo sapiens
ucccaaaguugucaaagaa

SEQ ID NO: 628526 - RNA, 19 nt, Homo sapiens
gagaugcauucaagacugu

SEQ ID NO: 628527 - RNA, 19 nt, Homo sapiens
cgagauacacagaauuaaa

SEQ ID NO: 628528 - RNA, 19 nt, Homo sapiens
guuacaagccguucauuug

SEQ ID NO: 628529 - RNA, 19 nt, Homo sapiens
gcaaaguguaugaugauau

SEQ ID NO: 628530 - RNA, 19 nt, Homo sapiens
gaggagauuucagaugaug

SEQ ID NO: 628531 - RNA, 19 nt, Homo sapiens
gcagcccuguuucuggaua

SEQ ID NO: 628532 - RNA, 19 nt, Homo sapiens
ggcaaaguguaugaugaua

SEQ ID NO: 628533 - RNA, 19 nt, Homo sapiens
ggaugaugcucuguaugaa

SEQ ID NO: 628534 - RNA, 19 nt, Homo sapiens
ucaagacugugcuggaaga

SEQ ID NO: 628535 - RNA, 19 nt, Homo sapiens
caacagccagccguuauuu

SEQ ID NO: 628536 - RNA, 19 nt, Homo sapiens
ggaaucagacgucauaaaa

SEQ ID NO: 628537 - RNA, 19 nt, Homo sapiens
gaugaagcauuugcagaau

SEQ ID NO: 628538 - RNA, 19 nt, Homo sapiens
ccagugagcauaugagaau

SEQ ID NO: 628539 - RNA, 19 nt, Homo sapiens
aaacggagacacugccuaa

SEQ ID NO: 628540 - RNA, 19 nt, Homo sapiens
gagaucagcagaaacuaug

SEQ ID NO: 628541 - RNA, 19 nt, Homo sapiens
cccgagauaugccguguuu

SEQ ID NO: 628542 - RNA, 19 nt, Homo sapiens
ugacagaggccaagaugug

SEQ ID NO: 628543 - RNA, 19 nt, Homo sapiens
gcuggaagaggcugaguuu

SEQ ID NO: 628544 - RNA, 19 nt, Homo sapiens
gagcacuuaucaccagaug

SEQ ID NO: 628545 - RNA, 19 nt, Homo sapiens
aaucggaauuagcuuauga

SEQ ID NO: 628546 - RNA, 19 nt, Homo sapiens
ggacuuacuccgugucugu

SEQ ID NO: 628547 - RNA, 19 nt, Homo sapiens
gcaaguacagcaucaacau

SEQ ID NO: 628548 - RNA, 19 nt, Homo sapiens
cagacgaaaugaaagugaa

SEQ ID NO: 628549 - RNA, 19 nt, Homo sapiens
gaugaugcucuguaugaaa

SEQ ID NO: 628550 - RNA, 19 nt, Homo sapiens
gccagcuaccgauuuauua

SEQ ID NO: 628551 - RNA, 19 nt, Homo sapiens
ccacaauuccucugaaauc

SEQ ID NO: 628552 - RNA, 19 nt, Homo sapiens
caguacaucuuccgaguca

SEQ ID NO: 628553 - RNA, 19 nt, Homo sapiens
ggacaaauacgccauucag

SEQ ID NO: 628554 - RNA, 19 nt, Homo sapiens
gaaggaccacggugaauac

SEQ ID NO: 628555 - RNA, 19 nt, Homo sapiens
auggaucgauuuaguauug

SEQ ID NO: 628556 - RNA, 19 nt, Homo sapiens
ccaaguggacgaagauguu

SEQ ID NO: 628557 - RNA, 19 nt, Homo sapiens
aagcauguguuaccugguu

SEQ ID NO: 628558 - RNA, 19 nt, Homo sapiens
ugugugggcugauaguuga

SEQ ID NO: 628559 - RNA, 19 nt, Homo sapiens
gaggcugaguuucaaagga

SEQ ID NO: 628560 - RNA, 19 nt, Homo sapiens
gaugagagguuuaaaaucg

SEQ ID NO: 628561 - RNA, 19 nt, Homo sapiens
gaggaugucugugaaacuc

SEQ ID NO: 628562 - RNA, 19 nt, Homo sapiens
gaguagagucugugggaaa

SEQ ID NO: 628563 - RNA, 19 nt, Homo sapiens
ggaaagaaaucguguguuu

SEQ ID NO: 628564 - RNA, 19 nt, Homo sapiens
caucaucucuuccaucuuu

SEQ ID NO: 628565 - RNA, 19 nt, Homo sapiens
gaaaggaaaugcaccaaca

SEQ ID NO: 628566 - RNA, 19 nt, Homo sapiens
ucaaagagauggugcuaaa

SEQ ID NO: 628567 - RNA, 19 nt, Homo sapiens
gaaggaagaggauuuauug

SEQ ID NO: 628568 - RNA, 19 nt, Homo sapiens
ggaguaaucucaacaacga

SEQ ID NO: 628569 - RNA, 19 nt, Homo sapiens
gagcuucucugcugcuuaa

SEQ ID NO: 628570 - RNA, 19 nt, Homo sapiens
caacaacgaguuaccaaua

SEQ ID NO: 628571 - RNA, 19 nt, Homo sapiens
gagacugggugauuuauau

SEQ ID NO: 628572 - RNA, 19 nt, Homo sapiens
uaacuugcauuacauguug

SEQ ID NO: 628573 - RNA, 19 nt, Homo sapiens
gcaaugggcuggcuugucu

SEQ ID NO: 628574 - RNA, 19 nt, Homo sapiens
ucacaauucucauguauuc

SEQ ID NO: 628575 - RNA, 19 nt, Homo sapiens
gcagggacaucaucucuuc

SEQ ID NO: 628576 - RNA, 19 nt, Homo sapiens
gcaauguuccagauuauuu

SEQ ID NO: 628577 - RNA, 19 nt, Homo sapiens
ccacacacauuaucauugu

SEQ ID NO: 628578 - RNA, 19 nt, Homo sapiens
ggacaccucaggagcuuua

SEQ ID NO: 628579 - RNA, 19 nt, Homo sapiens
gcgaaugucaccauauaua

SEQ ID NO: 628580 - RNA, 19 nt, Homo sapiens
aauccuaggugcuacuuua

SEQ ID NO: 628581 - RNA, 19 nt, Homo sapiens
gaauuugcauggcuugaga

SEQ ID NO: 628582 - RNA, 19 nt, Homo sapiens
gugcucagcuaaauauuug

SEQ ID NO: 628583 - RNA, 19 nt, Homo sapiens
ggauuaccauucagcauga

SEQ ID NO: 628584 - RNA, 19 nt, Homo sapiens
aagaauagcugacgugaag

SEQ ID NO: 628585 - RNA, 19 nt, Homo sapiens
gaaaauggagccaauuaua

SEQ ID NO: 628586 - RNA, 19 nt, Homo sapiens
acacucagcugcuucuuug

SEQ ID NO: 628587 - RNA, 19 nt, Homo sapiens
uaaaggaaguggaaauugg

SEQ ID NO: 628588 - RNA, 19 nt, Homo sapiens
ucaguuugguugagauaua

SEQ ID NO: 628589 - RNA, 19 nt, Homo sapiens
gcaggcacuucacacagua

SEQ ID NO: 628590 - RNA, 19 nt, Homo sapiens
ccuaggugcuacuuuauaa

SEQ ID NO: 628591 - RNA, 19 nt, Homo sapiens
gcaaggacagcaucaaaga

SEQ ID NO: 628592 - RNA, 19 nt, Homo sapiens
gaacacagacccaaaccau

SEQ ID NO: 628593 - RNA, 19 nt, Homo sapiens
uacaaagacuggaaacuau

SEQ ID NO: 628594 - RNA, 19 nt, Homo sapiens
aaucaaaguuucagcaaug

SEQ ID NO: 628595 - RNA, 19 nt, Homo sapiens
ucauagcacuggucacauu

SEQ ID NO: 628596 - RNA, 19 nt, Homo sapiens
ggagugugguuccaagaga

SEQ ID NO: 628597 - RNA, 19 nt, Homo sapiens
uagcucagcccauuucuuu

SEQ ID NO: 628598 - RNA, 19 nt, Homo sapiens
gaaccaagaauucaacaag

SEQ ID NO: 628599 - RNA, 19 nt, Homo sapiens
gagcaaggcuuuucucugu

SEQ ID NO: 628600 - RNA, 19 nt, Homo sapiens
cacauugccuuaccuaaau

SEQ ID NO: 628601 - RNA, 19 nt, Homo sapiens
gauguuguuugcugucuga

SEQ ID NO: 628602 - RNA, 19 nt, Homo sapiens
cuacaaagacuggaaacua

SEQ ID NO: 628603 - RNA, 19 nt, Homo sapiens
aaccauaccacacacauua

SEQ ID NO: 628604 - RNA, 19 nt, Homo sapiens
gagaagucacucacuauug

SEQ ID NO: 628605 - RNA, 19 nt, Homo sapiens
guacagggcgcacaaguca

SEQ ID NO: 628606 - RNA, 19 nt, Homo sapiens
cgaaugucaccauauauaa

SEQ ID NO: 628607 - RNA, 19 nt, Homo sapiens
gacaucaucucuuccaucu

SEQ ID NO: 628608 - RNA, 19 nt, Homo sapiens
gcccucaguuugcaguaua

SEQ ID NO: 628609 - RNA, 19 nt, Homo sapiens
gaaagaaaucguguguuug

SEQ ID NO: 628610 - RNA, 19 nt, Homo sapiens
ggauugguauuacucacaa

SEQ ID NO: 628611 - RNA, 19 nt, Homo sapiens
ucacauugccuuaccuaaa

SEQ ID NO: 628612 - RNA, 19 nt, Homo sapiens
gaaacagccagaucucaug

SEQ ID NO: 628613 - RNA, 19 nt, Homo sapiens
uccaagagauccaucaaga

SEQ ID NO: 628614 - RNA, 19 nt, Homo sapiens
cagcaccucuugagugguu

SEQ ID NO: 628615 - RNA, 19 nt, Homo sapiens
ccauugaccucuacaacug

SEQ ID NO: 628616 - RNA, 19 nt, Homo sapiens
ggagggaccuacaaagacu

SEQ ID NO: 628617 - RNA, 19 nt, Homo sapiens
gaaaaugaggcuuuaauug

SEQ ID NO: 628618 - RNA, 19 nt, Homo sapiens
caagagauccaucaagaca

SEQ ID NO: 628619 - RNA, 19 nt, Homo sapiens
gaucuuagcaauucucaca

SEQ ID NO: 628620 - RNA, 19 nt, Homo sapiens
ggccauucuugcauugaua

SEQ ID NO: 628621 - RNA, 19 nt, Homo sapiens
ucaaacuacugccauuuca

SEQ ID NO: 628622 - RNA, 19 nt, Homo sapiens
uagcugacgugaaggaaga

SEQ ID NO: 628623 - RNA, 19 nt, Homo sapiens
ugaaauaaaggaaguggaa

SEQ ID NO: 628624 - RNA, 19 nt, Homo sapiens
gcucagcccauuucuuuau

SEQ ID NO: 628625 - RNA, 19 nt, Homo sapiens
guaucaaacuacugccauu

SEQ ID NO: 628626 - RNA, 19 nt, Homo sapiens
agaagucccacauucaaua

SEQ ID NO: 628627 - RNA, 19 nt, Homo sapiens
ugucagaagucccacauuc

SEQ ID NO: 628628 - RNA, 19 nt, Homo sapiens
gaccuucacugucguaugc

SEQ ID NO: 628629 - RNA, 19 nt, Homo sapiens
caacaaccguaaacugaac

SEQ ID NO: 628630 - RNA, 19 nt, Homo sapiens
agacuggaaacuauucuua

SEQ ID NO: 628631 - RNA, 19 nt, Homo sapiens
uaacuugcucugcuuguuu

SEQ ID NO: 628632 - RNA, 19 nt, Homo sapiens
gaaauaaaggaaguggaaa

SEQ ID NO: 628633 - RNA, 19 nt, Homo sapiens
gcaaggcuuuucucuguuu

SEQ ID NO: 628634 - RNA, 19 nt, Homo sapiens
uacuugcucuugauugaua

SEQ ID NO: 628635 - RNA, 19 nt, Homo sapiens
guaauucagguaccacgua

SEQ ID NO: 628636 - RNA, 19 nt, Homo sapiens
cucaggagcuuuacucaug

SEQ ID NO: 628637 - RNA, 19 nt, Homo sapiens
guaaggaguguuucugaga

SEQ ID NO: 628638 - RNA, 19 nt, Homo sapiens
uugauaaugugaugacuga

SEQ ID NO: 628639 - RNA, 19 nt, Homo sapiens
aauacuugcucuugauuga

SEQ ID NO: 628640 - RNA, 19 nt, Homo sapiens
augcgaaugucaccauaua

SEQ ID NO: 628641 - RNA, 19 nt, Homo sapiens
cagcagcaaaguuuaguaa

SEQ ID NO: 628642 - RNA, 19 nt, Homo sapiens
uuaauuggcucacaguucu

SEQ ID NO: 628643 - RNA, 19 nt, Homo sapiens
ugaagaguaucaccaacug

SEQ ID NO: 628644 - RNA, 19 nt, Homo sapiens
guuaggccauucuugcauu

SEQ ID NO: 628645 - RNA, 19 nt, Homo sapiens
uagcgagggugguaaagug

SEQ ID NO: 628646 - RNA, 19 nt, Homo sapiens
agagauccaucaagacaau

SEQ ID NO: 628647 - RNA, 19 nt, Homo sapiens
ugaaggaagaggauuuauu

SEQ ID NO: 628648 - RNA, 19 nt, Homo sapiens
ggagccaauuauaguguga

SEQ ID NO: 628649 - RNA, 19 nt, Homo sapiens
gcauccuguuuguaucaua

SEQ ID NO: 628650 - RNA, 19 nt, Homo sapiens
gagaggugccacacugaaa

SEQ ID NO: 628651 - RNA, 19 nt, Homo sapiens
gagaaggcacaccguaaga

SEQ ID NO: 628652 - RNA, 19 nt, Homo sapiens
ccagugcucagcuaaauau

SEQ ID NO: 628653 - RNA, 19 nt, Homo sapiens
cuucucugcugcuuaaauu

SEQ ID NO: 628654 - RNA, 19 nt, Homo sapiens
guuacaccguggauuggua

SEQ ID NO: 628655 - RNA, 19 nt, Homo sapiens
uaccaauacuugcucuuga

SEQ ID NO: 628656 - RNA, 19 nt, Homo sapiens
gcaggaacacagacccaaa

SEQ ID NO: 628657 - RNA, 19 nt, Homo sapiens
ggucauccuuguuuucuaa

SEQ ID NO: 628658 - RNA, 19 nt, Homo sapiens
gaauagcugacgugaagga

SEQ ID NO: 628659 - RNA, 19 nt, Homo sapiens
uugagugguuuaagaauug

SEQ ID NO: 628660 - RNA, 19 nt, Homo sapiens
ucucacaauucucauguau

SEQ ID NO: 628661 - RNA, 19 nt, Homo sapiens
uaauucagguaccacguau

SEQ ID NO: 628662 - RNA, 19 nt, Homo sapiens
aaccaagaauucaacaaga

SEQ ID NO: 628663 - RNA, 19 nt, Homo sapiens
ggaaagaaaucguguguuu

SEQ ID NO: 628664 - RNA, 19 nt, Homo sapiens
ccaaugagguugagauaua

SEQ ID NO: 628665 - RNA, 19 nt, Homo sapiens
gaaggaagaggauuuauug

SEQ ID NO: 628666 - RNA, 19 nt, Homo sapiens
gaggcuggcuguuguauuu

SEQ ID NO: 628667 - RNA, 19 nt, Homo sapiens
ggaguaaucucaacaacga

SEQ ID NO: 628668 - RNA, 19 nt, Homo sapiens
agaaagaacucaaguacaa

SEQ ID NO: 628669 - RNA, 19 nt, Homo sapiens
gugaggagcaggaauauua

SEQ ID NO: 628670 - RNA, 19 nt, Homo sapiens
caacaacgaguuaccaaua

SEQ ID NO: 628671 - RNA, 19 nt, Homo sapiens
gcagaaaguugaggaagaa

SEQ ID NO: 628672 - RNA, 19 nt, Homo sapiens
cuauaaagcuguaagagaa

SEQ ID NO: 628673 - RNA, 19 nt, Homo sapiens
aaaggucccugaauucuaa

SEQ ID NO: 628674 - RNA, 19 nt, Homo sapiens
ggcuauaccuuaugcauuu

SEQ ID NO: 628675 - RNA, 19 nt, Homo sapiens
gcaaugggcuggcuugucu

SEQ ID NO: 628676 - RNA, 19 nt, Homo sapiens
agaaaggccucuaguuuga

SEQ ID NO: 628677 - RNA, 19 nt, Homo sapiens
ucacaauucucauguauuc

SEQ ID NO: 628678 - RNA, 19 nt, Homo sapiens
gaacgacgccaaggugaua

SEQ ID NO: 628679 - RNA, 19 nt, Homo sapiens
caucugaguuugaagcuuu

SEQ ID NO: 628680 - RNA, 19 nt, Homo sapiens
ccagaaaggccucuaguuu

SEQ ID NO: 628681 - RNA, 19 nt, Homo sapiens
gcaauguuccagauuauuu

SEQ ID NO: 628682 - RNA, 19 nt, Homo sapiens
gcacuuuguucaccagauu

SEQ ID NO: 628683 - RNA, 19 nt, Homo sapiens
cauagcaucuacugcauaa

SEQ ID NO: 628684 - RNA, 19 nt, Homo sapiens
gcgaaugucaccauauaua

SEQ ID NO: 628685 - RNA, 19 nt, Homo sapiens
gaagaaagaacucaaguac

SEQ ID NO: 628686 - RNA, 19 nt, Homo sapiens
ggaagaaagaacucaagua

SEQ ID NO: 628687 - RNA, 19 nt, Homo sapiens
gaaaccaacauacgaaaga

SEQ ID NO: 628688 - RNA, 19 nt, Homo sapiens
gaauuugcauggcuugaga

SEQ ID NO: 628689 - RNA, 19 nt, Homo sapiens
gcuaaucaauguccugguu

SEQ ID NO: 628690 - RNA, 19 nt, Homo sapiens
aagaauagcugacgugaag

SEQ ID NO: 628691 - RNA, 19 nt, Homo sapiens
gaaaauggagccaauuaua

SEQ ID NO: 628692 - RNA, 19 nt, Homo sapiens
uaaaggaaguggaaauugg

SEQ ID NO: 628693 - RNA, 19 nt, Homo sapiens
uaaauguggcuauaccuua

SEQ ID NO: 628694 - RNA, 19 nt, Homo sapiens
gaaaguugaggaagaaaga

SEQ ID NO: 628695 - RNA, 19 nt, Homo sapiens
agacauagcuaaaccuuac

SEQ ID NO: 628696 - RNA, 19 nt, Homo sapiens
aaucaaaguuucagcaaug

SEQ ID NO: 628697 - RNA, 19 nt, Homo sapiens
ccucagaucacucacaaua

SEQ ID NO: 628698 - RNA, 19 nt, Homo sapiens
ccaaggugauacuuauuga

SEQ ID NO: 628699 - RNA, 19 nt, Homo sapiens
gaaccaagaauucaacaag

SEQ ID NO: 628700 - RNA, 19 nt, Homo sapiens
gagcaaggcuuuucucugu

SEQ ID NO: 628701 - RNA, 19 nt, Homo sapiens
cagaaaggccucuaguuug

SEQ ID NO: 628702 - RNA, 19 nt, Homo sapiens
ucagaucacucacaauaag

SEQ ID NO: 628703 - RNA, 19 nt, Homo sapiens
gcucuaugaugcuuauguu

SEQ ID NO: 628704 - RNA, 19 nt, Homo sapiens
ggcagaaaguugaggaaga

SEQ ID NO: 628705 - RNA, 19 nt, Homo sapiens
guacagggcgcacaaguca

SEQ ID NO: 628706 - RNA, 19 nt, Homo sapiens
cgaaugucaccauauauaa

SEQ ID NO: 628707 - RNA, 19 nt, Homo sapiens
gaaagaaaucguguguuug

SEQ ID NO: 628708 - RNA, 19 nt, Homo sapiens
ggauugguauuacucacaa

SEQ ID NO: 628709 - RNA, 19 nt, Homo sapiens
gcuauaccuuaugcauuua

SEQ ID NO: 628710 - RNA, 19 nt, Homo sapiens
gcuaaaccuuacaagacua

SEQ ID NO: 628711 - RNA, 19 nt, Homo sapiens
cagcaccucuugagugguu

SEQ ID NO: 628712 - RNA, 19 nt, Homo sapiens
ccauugaccucuacaacug

SEQ ID NO: 628713 - RNA, 19 nt, Homo sapiens
gaaaaugaggcuuuaauug

SEQ ID NO: 628714 - RNA, 19 nt, Homo sapiens
gcuauaaagcuguaagaga

SEQ ID NO: 628715 - RNA, 19 nt, Homo sapiens
gaucuuagcaauucucaca

SEQ ID NO: 628716 - RNA, 19 nt, Homo sapiens
ggugauacuuauugagaug

SEQ ID NO: 628717 - RNA, 19 nt, Homo sapiens
uagcugacgugaaggaaga

SEQ ID NO: 628718 - RNA, 19 nt, Homo sapiens
ugaaauaaaggaaguggaa

SEQ ID NO: 628719 - RNA, 19 nt, Homo sapiens
ugcaguauguaguguauuu

SEQ ID NO: 628720 - RNA, 19 nt, Homo sapiens
uagcaucuacugcauaauu

SEQ ID NO: 628721 - RNA, 19 nt, Homo sapiens
agaagucccacauucaaua

SEQ ID NO: 628722 - RNA, 19 nt, Homo sapiens
ugucagaagucccacauuc

SEQ ID NO: 628723 - RNA, 19 nt, Homo sapiens
gaccuucacugucguaugc

SEQ ID NO: 628724 - RNA, 19 nt, Homo sapiens
aaauguggcuauaccuuau

SEQ ID NO: 628725 - RNA, 19 nt, Homo sapiens
uaacuugcucugcuuguuu

SEQ ID NO: 628726 - RNA, 19 nt, Homo sapiens
gaaauaaaggaaguggaaa

SEQ ID NO: 628727 - RNA, 19 nt, Homo sapiens
gcaaggcuuuucucuguuu

SEQ ID NO: 628728 - RNA, 19 nt, Homo sapiens
uacuugcucuugauugaua

SEQ ID NO: 628729 - RNA, 19 nt, Homo sapiens
gcacgugagguaccaaaug

SEQ ID NO: 628730 - RNA, 19 nt, Homo sapiens
gauggaaagcucuaugaug

SEQ ID NO: 628731 - RNA, 19 nt, Homo sapiens
uugauaaugugaugacuga

SEQ ID NO: 628732 - RNA, 19 nt, Homo sapiens
aauacuugcucuugauuga

SEQ ID NO: 628733 - RNA, 19 nt, Homo sapiens
aaaggcaucugaguuugaa

SEQ ID NO: 628734 - RNA, 19 nt, Homo sapiens
augcgaaugucaccauaua

SEQ ID NO: 628735 - RNA, 19 nt, Homo sapiens
cagcagcaaaguuuaguaa

SEQ ID NO: 628736 - RNA, 19 nt, Homo sapiens
ugaagaguaucaccaacug

SEQ ID NO: 628737 - RNA, 19 nt, Homo sapiens
aauaaaaggucccugaauu

SEQ ID NO: 628738 - RNA, 19 nt, Homo sapiens
ccacggaacuacaaaucca

SEQ ID NO: 628739 - RNA, 19 nt, Homo sapiens
ggagagacauagcuaaacc

SEQ ID NO: 628740 - RNA, 19 nt, Homo sapiens
ugaaggaagaggauuuauu

SEQ ID NO: 628741 - RNA, 19 nt, Homo sapiens
ggagccaauuauaguguga

SEQ ID NO: 628742 - RNA, 19 nt, Homo sapiens
aauagugccugcugugaug

SEQ ID NO: 628743 - RNA, 19 nt, Homo sapiens
ggaaugauggaaagcucua

SEQ ID NO: 628744 - RNA, 19 nt, Homo sapiens
gagacauagcuaaaccuua

SEQ ID NO: 628745 - RNA, 19 nt, Homo sapiens
uaaucaauguccugguuau

SEQ ID NO: 628746 - RNA, 19 nt, Homo sapiens
gagaaggcacaccguaaga

SEQ ID NO: 628747 - RNA, 19 nt, Homo sapiens
gcaauagugccugcuguga

SEQ ID NO: 628748 - RNA, 19 nt, Homo sapiens
gugaaacugugggcagaaa

SEQ ID NO: 628749 - RNA, 19 nt, Homo sapiens
guuacaccguggauuggua

SEQ ID NO: 628750 - RNA, 19 nt, Homo sapiens
uaccaauacuugcucuuga

SEQ ID NO: 628751 - RNA, 19 nt, Homo sapiens
gaacuacaaauccaguaca

SEQ ID NO: 628752 - RNA, 19 nt, Homo sapiens
gaauagcugacgugaagga

SEQ ID NO: 628753 - RNA, 19 nt, Homo sapiens
uugagugguuuaagaauug

SEQ ID NO: 628754 - RNA, 19 nt, Homo sapiens
ucucacaauucucauguau

SEQ ID NO: 628755 - RNA, 19 nt, Homo sapiens
uaugcuaccuggagaagau

SEQ ID NO: 628756 - RNA, 19 nt, Homo sapiens
cuacaaauccaguacagau

SEQ ID NO: 628757 - RNA, 19 nt, Homo sapiens
aaccaagaauucaacaaga

SEQ ID NO: 628758 - RNA, 19 nt, Homo sapiens
caaugagguugagauauag

SEQ ID NO: 628759 - RNA, 19 nt, Homo sapiens
gguauuacucacaaacaaa

SEQ ID NO: 628760 - RNA, 19 nt, Homo sapiens
gugcaaaggcaucugaguu

SEQ ID NO: 628761 - RNA, 19 nt, Homo sapiens
ggaaaaugaggcuuuaauu

SEQ ID NO: 628762 - RNA, 19 nt, Homo sapiens
caagcaaaauucccagaaa

SEQ ID NO: 628763 - RNA, 19 nt, Homo sapiens
ggaaagaaaucguguguuu

SEQ ID NO: 628764 - RNA, 19 nt, Homo sapiens
caucaucucuuccaucuuu

SEQ ID NO: 628765 - RNA, 19 nt, Homo sapiens
gaaaggaaaugcaccaaca

SEQ ID NO: 628766 - RNA, 19 nt, Homo sapiens
ucaaagagauggugcuaaa

SEQ ID NO: 628767 - RNA, 19 nt, Homo sapiens
gaaggaagaggauuuauug

SEQ ID NO: 628768 - RNA, 19 nt, Homo sapiens
ggaguaaucucaacaacga

SEQ ID NO: 628769 - RNA, 19 nt, Homo sapiens
gagcuucucugcugcuuaa

SEQ ID NO: 628770 - RNA, 19 nt, Homo sapiens
caacaacgaguuaccaaua

SEQ ID NO: 628771 - RNA, 19 nt, Homo sapiens
gagacugggugauuuauau

SEQ ID NO: 628772 - RNA, 19 nt, Homo sapiens
uaacuugcauuacauguug

SEQ ID NO: 628773 - RNA, 19 nt, Homo sapiens
gcaaugggcuggcuugucu

SEQ ID NO: 628774 - RNA, 19 nt, Homo sapiens
ucacaauucucauguauuc

SEQ ID NO: 628775 - RNA, 19 nt, Homo sapiens
gcagggacaucaucucuuc

SEQ ID NO: 628776 - RNA, 19 nt, Homo sapiens
gcaauguuccagauuauuu

SEQ ID NO: 628777 - RNA, 19 nt, Homo sapiens
ccacacacauuaucauugu

SEQ ID NO: 628778 - RNA, 19 nt, Homo sapiens
ggacaccucaggagcuuua

SEQ ID NO: 628779 - RNA, 19 nt, Homo sapiens
gcgaaugucaccauauaua

SEQ ID NO: 628780 - RNA, 19 nt, Homo sapiens
aauccuaggugcuacuuua

SEQ ID NO: 628781 - RNA, 19 nt, Homo sapiens
gaauuugcauggcuugaga

SEQ ID NO: 628782 - RNA, 19 nt, Homo sapiens
gugcucagcuaaauauuug

SEQ ID NO: 628783 - RNA, 19 nt, Homo sapiens
ggauuaccauucagcauga

SEQ ID NO: 628784 - RNA, 19 nt, Homo sapiens
aagaauagcugacgugaag

SEQ ID NO: 628785 - RNA, 19 nt, Homo sapiens
gaaaauggagccaauuaua

SEQ ID NO: 628786 - RNA, 19 nt, Homo sapiens
acacucagcugcuucuuug

SEQ ID NO: 628787 - RNA, 19 nt, Homo sapiens
uaaaggaaguggaaauugg

SEQ ID NO: 628788 - RNA, 19 nt, Homo sapiens
ucaguuugguugagauaua

SEQ ID NO: 628789 - RNA, 19 nt, Homo sapiens
gcaggcacuucacacagua

SEQ ID NO: 628790 - RNA, 19 nt, Homo sapiens
ccuaggugcuacuuuauaa

SEQ ID NO: 628791 - RNA, 19 nt, Homo sapiens
gcaaggacagcaucaaaga

SEQ ID NO: 628792 - RNA, 19 nt, Homo sapiens
gaacacagacccaaaccau

SEQ ID NO: 628793 - RNA, 19 nt, Homo sapiens
uacaaagacuggaaacuau

SEQ ID NO: 628794 - RNA, 19 nt, Homo sapiens
aaucaaaguuucagcaaug

SEQ ID NO: 628795 - RNA, 19 nt, Homo sapiens
ucauagcacuggucacauu

SEQ ID NO: 628796 - RNA, 19 nt, Homo sapiens
ggagugugguuccaagaga

SEQ ID NO: 628797 - RNA, 19 nt, Homo sapiens
uagcucagcccauuucuuu

SEQ ID NO: 628798 - RNA, 19 nt, Homo sapiens
gaaccaagaauucaacaag

SEQ ID NO: 628799 - RNA, 19 nt, Homo sapiens
gagcaaggcuuuucucugu

SEQ ID NO: 628800 - RNA, 19 nt, Homo sapiens
cacauugccuuaccuaaau

SEQ ID NO: 628801 - RNA, 19 nt, Homo sapiens
gauguuguuugcugucuga

SEQ ID NO: 628802 - RNA, 19 nt, Homo sapiens
cuacaaagacuggaaacua

SEQ ID NO: 628803 - RNA, 19 nt, Homo sapiens
aaccauaccacacacauua

SEQ ID NO: 628804 - RNA, 19 nt, Homo sapiens
gagaagucacucacuauug

SEQ ID NO: 628805 - RNA, 19 nt, Homo sapiens
gaugguauacuauggugua

SEQ ID NO: 628806 - RNA, 19 nt, Homo sapiens
guacagggcgcacaaguca

SEQ ID NO: 628807 - RNA, 19 nt, Homo sapiens
cgaaugucaccauauauaa

SEQ ID NO: 628808 - RNA, 19 nt, Homo sapiens
gacaucaucucuuccaucu

SEQ ID NO: 628809 - RNA, 19 nt, Homo sapiens
gcccucaguuugcaguaua

SEQ ID NO: 628810 - RNA, 19 nt, Homo sapiens
gcaauacuuucaacaucau

SEQ ID NO: 628811 - RNA, 19 nt, Homo sapiens
gauucaaagucuaaugaga

SEQ ID NO: 628812 - RNA, 19 nt, Homo sapiens
gaaagaaaucguguguuug

SEQ ID NO: 628813 - RNA, 19 nt, Homo sapiens
ggauugguauuacucacaa

SEQ ID NO: 628814 - RNA, 19 nt, Homo sapiens
ucacauugccuuaccuaaa

SEQ ID NO: 628815 - RNA, 19 nt, Homo sapiens
gaaacagccagaucucaug

SEQ ID NO: 628816 - RNA, 19 nt, Homo sapiens
uccaagagauccaucaaga

SEQ ID NO: 628817 - RNA, 19 nt, Homo sapiens
cagcaccucuugagugguu

SEQ ID NO: 628818 - RNA, 19 nt, Homo sapiens
ccauugaccucuacaacug

SEQ ID NO: 628819 - RNA, 19 nt, Homo sapiens
ggagggaccuacaaagacu

SEQ ID NO: 628820 - RNA, 19 nt, Homo sapiens
gaaaaugaggcuuuaauug

SEQ ID NO: 628821 - RNA, 19 nt, Homo sapiens
caagagauccaucaagaca

SEQ ID NO: 628822 - RNA, 19 nt, Homo sapiens
uaaauguugucgagugguu

SEQ ID NO: 628823 - RNA, 19 nt, Homo sapiens
gaucuuagcaauucucaca

SEQ ID NO: 628824 - RNA, 19 nt, Homo sapiens
ggccauucuugcauugaua

SEQ ID NO: 628825 - RNA, 19 nt, Homo sapiens
ucaaacuacugccauuuca

SEQ ID NO: 628826 - RNA, 19 nt, Homo sapiens
uagcugacgugaaggaaga

SEQ ID NO: 628827 - RNA, 19 nt, Homo sapiens
ugaaauaaaggaaguggaa

SEQ ID NO: 628828 - RNA, 19 nt, Homo sapiens
gcucagcccauuucuuuau

SEQ ID NO: 628829 - RNA, 19 nt, Homo sapiens
guaucaaacuacugccauu

SEQ ID NO: 628830 - RNA, 19 nt, Homo sapiens
gaccuucacugucguaugc

SEQ ID NO: 628831 - RNA, 19 nt, Homo sapiens
gagaggcuuugugauggua

SEQ ID NO: 628832 - RNA, 19 nt, Homo sapiens
agaagucccacauucaaua

SEQ ID NO: 628833 - RNA, 19 nt, Homo sapiens
ugucagaagucccacauuc

SEQ ID NO: 628834 - RNA, 19 nt, Homo sapiens
caacaaccguaaacugaac

SEQ ID NO: 628835 - RNA, 19 nt, Homo sapiens
agacuggaaacuauucuua

SEQ ID NO: 628836 - RNA, 19 nt, Homo sapiens
uaacuugcucugcuuguuu

SEQ ID NO: 628837 - RNA, 19 nt, Homo sapiens
gaaauaaaggaaguggaaa

SEQ ID NO: 628838 - RNA, 19 nt, Homo sapiens
gcaaggcuuuucucuguuu

SEQ ID NO: 628839 - RNA, 19 nt, Homo sapiens
gguauacuaugguguacau

SEQ ID NO: 628840 - RNA, 19 nt, Homo sapiens
gcuuugugaugguauacua

SEQ ID NO: 628841 - RNA, 19 nt, Homo sapiens
cuaaugagaggcuuuguga

SEQ ID NO: 628842 - RNA, 19 nt, Homo sapiens
uacuugcucuugauugaua

SEQ ID NO: 628843 - RNA, 19 nt, Homo sapiens
guaauucagguaccacgua

SEQ ID NO: 628844 - RNA, 19 nt, Homo sapiens
cucaggagcuuuacucaug

SEQ ID NO: 628845 - RNA, 19 nt, Homo sapiens
guaaggaguguuucugaga

SEQ ID NO: 628846 - RNA, 19 nt, Homo sapiens
uugauaaugugaugacuga

SEQ ID NO: 628847 - RNA, 19 nt, Homo sapiens
aauacuugcucuugauuga

SEQ ID NO: 628848 - RNA, 19 nt, Homo sapiens
augcgaaugucaccauaua

SEQ ID NO: 628849 - RNA, 19 nt, Homo sapiens
cagcagcaaaguuuaguaa

SEQ ID NO: 628850 - RNA, 19 nt, Homo sapiens
uuaauuggcucacaguucu

SEQ ID NO: 628851 - RNA, 19 nt, Homo sapiens
guuaggccauucuugcauu

SEQ ID NO: 628852 - RNA, 19 nt, Homo sapiens
uagcgagggugguaaagug

SEQ ID NO: 628853 - RNA, 19 nt, Homo sapiens
agagauccaucaagacaau

SEQ ID NO: 628854 - RNA, 19 nt, Homo sapiens
ugaaggaagaggauuuauu

SEQ ID NO: 628855 - RNA, 19 nt, Homo sapiens
ggagccaauuauaguguga

SEQ ID NO: 628856 - RNA, 19 nt, Homo sapiens
ugaagaguaucaccaacug

SEQ ID NO: 628857 - RNA, 19 nt, Homo sapiens
gcauccuguuuguaucaua

SEQ ID NO: 628858 - RNA, 19 nt, Homo sapiens
gagaggugccacacugaaa

SEQ ID NO: 628859 - RNA, 19 nt, Homo sapiens
gagaaggcacaccguaaga

SEQ ID NO: 628860 - RNA, 19 nt, Homo sapiens
gaggcuuugugaugguaua

SEQ ID NO: 628861 - RNA, 19 nt, Homo sapiens
ccagugcucagcuaaauau

SEQ ID NO: 628862 - RNA, 19 nt, Homo sapiens
uaccaauacuugcucuuga

SEQ ID NO: 628863 - RNA, 19 nt, Homo sapiens
gaaaugagcugcaauaaca

SEQ ID NO: 628864 - RNA, 19 nt, Homo sapiens
gaaauuaagucucacugaa

SEQ ID NO: 628865 - RNA, 19 nt, Homo sapiens
ggaaguagauagugaaguu

SEQ ID NO: 628866 - RNA, 19 nt, Homo sapiens
gcaaaucucuggaaaauaa

SEQ ID NO: 628867 - RNA, 19 nt, Homo sapiens
aaacaguccugaugaguua

SEQ ID NO: 628868 - RNA, 19 nt, Homo sapiens
gaucacaccucgauugcua

SEQ ID NO: 628869 - RNA, 19 nt, Homo sapiens
ggaaugaaccugucucuga

SEQ ID NO: 628870 - RNA, 19 nt, Homo sapiens
aaacagacguggcagagua

SEQ ID NO: 628871 - RNA, 19 nt, Homo sapiens
gaaugaaccugucucugaa

SEQ ID NO: 628872 - RNA, 19 nt, Homo sapiens
gaaguugaauuuccacgaa

SEQ ID NO: 628873 - RNA, 19 nt, Homo sapiens
gcaaagagugaacuauaua

SEQ ID NO: 628874 - RNA, 19 nt, Homo sapiens
aagcggaacugaagacaua

SEQ ID NO: 628875 - RNA, 19 nt, Homo sapiens
gaucucaaaucaccuaaug

SEQ ID NO: 628876 - RNA, 19 nt, Homo sapiens
agacggauaucaagcauuu

SEQ ID NO: 628877 - RNA, 19 nt, Homo sapiens
gaauacacauccugaagau

SEQ ID NO: 628878 - RNA, 19 nt, Homo sapiens
ggaauugagugccaucaug

SEQ ID NO: 628879 - RNA, 19 nt, Homo sapiens
gaagaccgcuuggcagaga

SEQ ID NO: 628880 - RNA, 19 nt, Homo sapiens
ggaaaggagugccucacaa

SEQ ID NO: 628881 - RNA, 19 nt, Homo sapiens
gaaaggagugccucacaaa

SEQ ID NO: 628882 - RNA, 19 nt, Homo sapiens
gaagaucacaccucgauug

SEQ ID NO: 628883 - RNA, 19 nt, Homo sapiens
gagagacaauaauuucuug

SEQ ID NO: 628884 - RNA, 19 nt, Homo sapiens
ggcagacacucaugcauuu

SEQ ID NO: 628885 - RNA, 19 nt, Homo sapiens
gcaaguggaaugaauuauu

SEQ ID NO: 628886 - RNA, 19 nt, Homo sapiens
gaacugaagacauaaagau

SEQ ID NO: 628887 - RNA, 19 nt, Homo sapiens
caggagagaucccuuacaa

SEQ ID NO: 628888 - RNA, 19 nt, Homo sapiens
gaacagaaugagacggaua

SEQ ID NO: 628889 - RNA, 19 nt, Homo sapiens
ucaauggacuacaagauga

SEQ ID NO: 628890 - RNA, 19 nt, Homo sapiens
gcagggaucuauuuuauug

SEQ ID NO: 628891 - RNA, 19 nt, Homo sapiens
gaacaugagacuucgcaaa

SEQ ID NO: 628892 - RNA, 19 nt, Homo sapiens
acaagaaacuuacuucaag

SEQ ID NO: 628893 - RNA, 19 nt, Homo sapiens
ggagagaucccuuacaaag

SEQ ID NO: 628894 - RNA, 19 nt, Homo sapiens
gaagaucucgugacuauac

SEQ ID NO: 628895 - RNA, 19 nt, Homo sapiens
cugaagaucucgugacuau

SEQ ID NO: 628896 - RNA, 19 nt, Homo sapiens
gagccgauaucgaagcaaa

SEQ ID NO: 628897 - RNA, 19 nt, Homo sapiens
ggaauacugugcccaugga

SEQ ID NO: 628898 - RNA, 19 nt, Homo sapiens
ccagucauauucaaccuuu

SEQ ID NO: 628899 - RNA, 19 nt, Homo sapiens
aaacaaggccucugcagaa

SEQ ID NO: 628900 - RNA, 19 nt, Homo sapiens
ugagauagagagacaauaa

SEQ ID NO: 628901 - RNA, 19 nt, Homo sapiens
cgccagagauucccauuga

SEQ ID NO: 628902 - RNA, 19 nt, Homo sapiens
ggaauacacauccugaaga

SEQ ID NO: 628903 - RNA, 19 nt, Homo sapiens
ggauauucgugaacacuau

SEQ ID NO: 628904 - RNA, 19 nt, Homo sapiens
ucucaggacuuugguuaua

SEQ ID NO: 628905 - RNA, 19 nt, Homo sapiens
gggagaaggagcucauuaa

SEQ ID NO: 628906 - RNA, 19 nt, Homo sapiens
gaaggcauauuccacugau

SEQ ID NO: 628907 - RNA, 19 nt, Homo sapiens
gaauggcagggaucuauuu

SEQ ID NO: 628908 - RNA, 19 nt, Homo sapiens
agagaucccuuacaaagau

SEQ ID NO: 628909 - RNA, 19 nt, Homo sapiens
guagauucuucagccauua

SEQ ID NO: 628910 - RNA, 19 nt, Homo sapiens
guaccaagaugucauuugc

SEQ ID NO: 628911 - RNA, 19 nt, Homo sapiens
gaagcacccuaacaucauc

SEQ ID NO: 628912 - RNA, 19 nt, Homo sapiens
gaaagugagagaacagaau

SEQ ID NO: 628913 - RNA, 19 nt, Homo sapiens
ugacuauacuggcauuuca

SEQ ID NO: 628914 - RNA, 19 nt, Homo sapiens
ccaagucaccagcacauaa

SEQ ID NO: 628915 - RNA, 19 nt, Homo sapiens
ccaauacccuucucuucau

SEQ ID NO: 628916 - RNA, 19 nt, Homo sapiens
ugaaggaacuuguauacac

SEQ ID NO: 628917 - RNA, 19 nt, Homo sapiens
cggaagagguggccaucaa

SEQ ID NO: 628918 - RNA, 19 nt, Homo sapiens
gcccugaccuuuccaaguc

SEQ ID NO: 628919 - RNA, 19 nt, Homo sapiens
gagagaucccuuacaaaga

SEQ ID NO: 628920 - RNA, 19 nt, Homo sapiens
ggacuuugguuauacucau

SEQ ID NO: 628921 - RNA, 19 nt, Homo sapiens
ggagcccucucuuaaguca

SEQ ID NO: 628922 - RNA, 19 nt, Homo sapiens
cuagaaaugagcugcaaua

SEQ ID NO: 628923 - RNA, 19 nt, Homo sapiens
ggaggaacguggcuaugag

SEQ ID NO: 628924 - RNA, 19 nt, Homo sapiens
gaagagguggccaucaaga

SEQ ID NO: 628925 - RNA, 19 nt, Homo sapiens
uauaugagauagagagaca

SEQ ID NO: 628926 - RNA, 19 nt, Homo sapiens
caaacaguccugaugaguu

SEQ ID NO: 628927 - RNA, 19 nt, Homo sapiens
gaugaagaacugauucgaa

SEQ ID NO: 628928 - RNA, 19 nt, Homo sapiens
cuaaggaacucagugacaa

SEQ ID NO: 628929 - RNA, 19 nt, Homo sapiens
caucucaggacuuugguua

SEQ ID NO: 628930 - RNA, 19 nt, Homo sapiens
ccacaguuaggaccaauaa

SEQ ID NO: 628931 - RNA, 19 nt, Homo sapiens
gggaggagcccugaccuuu

SEQ ID NO: 628932 - RNA, 19 nt, Homo sapiens
acucaugcauuuagacauu

SEQ ID NO: 628933 - RNA, 19 nt, Homo sapiens
ggaaguugaagcacccuaa

SEQ ID NO: 628934 - RNA, 19 nt, Homo sapiens
ugcaaagagugaacuauau

SEQ ID NO: 628935 - RNA, 19 nt, Homo sapiens
cugaugaguuagcugauaa

SEQ ID NO: 628936 - RNA, 19 nt, Homo sapiens
gaauuucucugugucugau

SEQ ID NO: 628937 - RNA, 19 nt, Homo sapiens
ugacaggagagaucccuua

SEQ ID NO: 628938 - RNA, 19 nt, Homo sapiens
cggaugggcucucugacaa

SEQ ID NO: 628939 - RNA, 19 nt, Homo sapiens
gaauuuccacgaagacaga

SEQ ID NO: 628940 - RNA, 19 nt, Homo sapiens
gcagaggcagccauaguga

SEQ ID NO: 628941 - RNA, 19 nt, Homo sapiens
ggaauugcaaguggaauga

SEQ ID NO: 628942 - RNA, 19 nt, Homo sapiens
guauacaccgguuagauga

SEQ ID NO: 628943 - RNA, 19 nt, Homo sapiens
gacauugccucugcagaug

SEQ ID NO: 628944 - RNA, 19 nt, Homo sapiens
gcagacacucaugcauuua

SEQ ID NO: 628945 - RNA, 19 nt, Homo sapiens
ccacuugcccugauggauu

SEQ ID NO: 628946 - RNA, 19 nt, Homo sapiens
guagacugguccacaggaa

SEQ ID NO: 628947 - RNA, 19 nt, Homo sapiens
aggcauauuccacugauua

SEQ ID NO: 628948 - RNA, 19 nt, Homo sapiens
gcuuaaggccuguauggaa

SEQ ID NO: 628949 - RNA, 19 nt, Homo sapiens
ugaauauucuagcuacugu

SEQ ID NO: 628950 - RNA, 19 nt, Homo sapiens
caugagacuucgcaaaucu

SEQ ID NO: 628951 - RNA, 19 nt, Homo sapiens
gcacgauggccaacuuuca

SEQ ID NO: 628952 - RNA, 19 nt, Homo sapiens
gacugugacucuucagaug

SEQ ID NO: 628953 - RNA, 19 nt, Homo sapiens
ccugaugaguuagcugaua

SEQ ID NO: 628954 - RNA, 19 nt, Homo sapiens
gagaugacuccucagaaga

SEQ ID NO: 628955 - RNA, 19 nt, Homo sapiens
gcagaagaguggagaugac

SEQ ID NO: 628956 - RNA, 19 nt, Homo sapiens
caccaucccagacucaaua

SEQ ID NO: 628957 - RNA, 19 nt, Homo sapiens
cugcaaagagugaacuaua

SEQ ID NO: 628958 - RNA, 19 nt, Homo sapiens
gaccaaacggccagacuug

SEQ ID NO: 628959 - RNA, 19 nt, Homo sapiens
ccaaugccauggagaaacu

SEQ ID NO: 628960 - RNA, 19 nt, Homo sapiens
ucaagaaagugagagaaca

SEQ ID NO: 628961 - RNA, 19 nt, Homo sapiens
ggccagacuuguugagauc

SEQ ID NO: 628962 - RNA, 19 nt, Homo sapiens
ggagaaggagcucauuaag

SEQ ID NO: 628963 - RNA, 19 nt, Homo sapiens
gagcagcgcuggaggauuu

SEQ ID NO: 628964 - RNA, 19 nt, Homo sapiens
gcaagcagcuauuacagaa

SEQ ID NO: 628965 - RNA, 19 nt, Homo sapiens
gcaacuaccuccaaacuca

SEQ ID NO: 628966 - RNA, 19 nt, Homo sapiens
ggaauguugucaaguguaa

SEQ ID NO: 628967 - RNA, 19 nt, Homo sapiens
ggucuggaaugaugaauuu

SEQ ID NO: 628968 - RNA, 19 nt, Homo sapiens
ggucgcagcuucaaucuau

SEQ ID NO: 628969 - RNA, 19 nt, Homo sapiens
gaacucaucugggaccauu

SEQ ID NO: 628970 - RNA, 19 nt, Homo sapiens
cagaagacauucagcauga

SEQ ID NO: 628971 - RNA, 19 nt, Homo sapiens
caagaggucuggaaugaug

SEQ ID NO: 628972 - RNA, 19 nt, Homo sapiens
ucaaauuccuccaugauga

SEQ ID NO: 628973 - RNA, 19 nt, Homo sapiens
ggaauucuagccacagaua

SEQ ID NO: 628974 - RNA, 19 nt, Homo sapiens
gcacagauucaguuuaaug

SEQ ID NO: 628975 - RNA, 19 nt, Homo sapiens
uugcacagauucaguuuaa

SEQ ID NO: 628976 - RNA, 19 nt, Homo sapiens
gcugauuccuagcaucuuu

SEQ ID NO: 628977 - RNA, 19 nt, Homo sapiens
ggauguggaugcagagaau

SEQ ID NO: 628978 - RNA, 19 nt, Homo sapiens
guucguccaugcuauauug

SEQ ID NO: 628979 - RNA, 19 nt, Homo sapiens
ccaggaauguugucaagug

SEQ ID NO: 628980 - RNA, 19 nt, Homo sapiens
cauuugauguccagaauug

SEQ ID NO: 628981 - RNA, 19 nt, Homo sapiens
cagcauguuugaugagauu

SEQ ID NO: 628982 - RNA, 19 nt, Homo sapiens
ugacaggccuagaguggaa

SEQ ID NO: 628983 - RNA, 19 nt, Homo sapiens
ggaauaauaguggguuaaa

SEQ ID NO: 628984 - RNA, 19 nt, Homo sapiens
ggaugcagagaaucaaaua

SEQ ID NO: 628985 - RNA, 19 nt, Homo sapiens
gagccaggauuguguucaa

SEQ ID NO: 628986 - RNA, 19 nt, Homo sapiens
gacauaugcuuuuccauuu

SEQ ID NO: 628987 - RNA, 19 nt, Homo sapiens
gaagugagaccuguuuaca

SEQ ID NO: 628988 - RNA, 19 nt, Homo sapiens
uaaagacaaguguauggua

SEQ ID NO: 628989 - RNA, 19 nt, Homo sapiens
ccaggauucugcucuguau

SEQ ID NO: 628990 - RNA, 19 nt, Homo sapiens
cuucuugguucucagcuua

SEQ ID NO: 628991 - RNA, 19 nt, Homo sapiens
ucaaugaguuuguggacau

SEQ ID NO: 628992 - RNA, 19 nt, Homo sapiens
gaucugcccaggaauguug

SEQ ID NO: 628993 - RNA, 19 nt, Homo sapiens
gaggagcccagaagacauu

SEQ ID NO: 628994 - RNA, 19 nt, Homo sapiens
ggaccauugagaacuauaa

SEQ ID NO: 628995 - RNA, 19 nt, Homo sapiens
aagcagcuauuacagaaau

SEQ ID NO: 628996 - RNA, 19 nt, Homo sapiens
ugugaagacugaaguguuc

SEQ ID NO: 628997 - RNA, 19 nt, Homo sapiens
cgacugcucuuccaaagcu

SEQ ID NO: 628998 - RNA, 19 nt, Homo sapiens
ggcccaacgugcuguggua

SEQ ID NO: 628999 - RNA, 19 nt, Homo sapiens
gcauacaguggaagacgua

SEQ ID NO: 629000 - RNA, 19 nt, Homo sapiens
gagaucucccuaccucuaa

SEQ ID NO: 629001 - RNA, 19 nt, Homo sapiens
ugaaagauacccugaccuu

SEQ ID NO: 629002 - RNA, 19 nt, Homo sapiens
ucaagagcauucugcauac

SEQ ID NO: 629003 - RNA, 19 nt, Homo sapiens
accaagaggucuggaauga

SEQ ID NO: 629004 - RNA, 19 nt, Homo sapiens
ggaccaaggccaccacagu

SEQ ID NO: 629005 - RNA, 19 nt, Homo sapiens
aaagaagugagaccuguuu

SEQ ID NO: 629006 - RNA, 19 nt, Homo sapiens
uggaggauuugcacagauu

SEQ ID NO: 629007 - RNA, 19 nt, Homo sapiens
ggaacuccagcauguuuga

SEQ ID NO: 629008 - RNA, 19 nt, Homo sapiens
gaccuucccuauguuuaug

SEQ ID NO: 629009 - RNA, 19 nt, Homo sapiens
gacaggagcagcccuucuu

SEQ ID NO: 629010 - RNA, 19 nt, Homo sapiens
gcccaggaauguugucaag

SEQ ID NO: 629011 - RNA, 19 nt, Homo sapiens
gcuggaggauuugcacaga

SEQ ID NO: 629012 - RNA, 19 nt, Homo sapiens
gaaauugagcggcauucca

SEQ ID NO: 629013 - RNA, 19 nt, Homo sapiens
agugggaacuucuaucugu

SEQ ID NO: 629014 - RNA, 19 nt, Homo sapiens
guuuagagacauaugcuuu

SEQ ID NO: 629015 - RNA, 19 nt, Homo sapiens
uuguggacauugaaagaua

SEQ ID NO: 629016 - RNA, 19 nt, Homo sapiens
uucaagagcauucugcaua

SEQ ID NO: 629017 - RNA, 19 nt, Homo sapiens
caucugggaccauugagaa

SEQ ID NO: 629018 - RNA, 19 nt, Homo sapiens
gaagacauucagcaugaca

SEQ ID NO: 629019 - RNA, 19 nt, Homo sapiens
acccugaccuucccuaugu

SEQ ID NO: 629020 - RNA, 19 nt, Homo sapiens
caggaauucuagccacaga

SEQ ID NO: 629021 - RNA, 19 nt, Homo sapiens
ccaacgugcugugguaaca

SEQ ID NO: 629022 - RNA, 19 nt, Homo sapiens
caaguuugcauuucuccuu

SEQ ID NO: 629023 - RNA, 19 nt, Homo sapiens
ggucaaauuccuccaugau

SEQ ID NO: 629024 - RNA, 19 nt, Homo sapiens
gggcacuucuucaccaucu

SEQ ID NO: 629025 - RNA, 19 nt, Homo sapiens
caagagcauucugcauaca

SEQ ID NO: 629026 - RNA, 19 nt, Homo sapiens
ugagaccuguuuacaacug

SEQ ID NO: 629027 - RNA, 19 nt, Homo sapiens
caggaauguugucaagugu

SEQ ID NO: 629028 - RNA, 19 nt, Homo sapiens
gacagugagugggaacuuc

SEQ ID NO: 629029 - RNA, 19 nt, Homo sapiens
gggaauaauaguggguuaa

SEQ ID NO: 629030 - RNA, 19 nt, Homo sapiens
aaacucaggaccagacaga

SEQ ID NO: 629031 - RNA, 19 nt, Homo sapiens
cugcauggccuucuugguu

SEQ ID NO: 629032 - RNA, 19 nt, Homo sapiens
agacguagaccuggccuuu

SEQ ID NO: 629033 - RNA, 19 nt, Homo sapiens
gauuugcacagauucaguu

SEQ ID NO: 629034 - RNA, 19 nt, Homo sapiens
guaccaagaggucuggaau

SEQ ID NO: 629035 - RNA, 19 nt, Homo sapiens
agugagaccuguuuacaac

SEQ ID NO: 629036 - RNA, 19 nt, Homo sapiens
aaguuugcauuucuccuuu

SEQ ID NO: 629037 - RNA, 19 nt, Homo sapiens
ucucagcaagcagcuauua

SEQ ID NO: 629038 - RNA, 19 nt, Homo sapiens
ccaucguguuggucaaauu

SEQ ID NO: 629039 - RNA, 19 nt, Homo sapiens
gaccgacugcucuuccaaa

SEQ ID NO: 629040 - RNA, 19 nt, Homo sapiens
caacugccgagccaggauu

SEQ ID NO: 629041 - RNA, 19 nt, Homo sapiens
cauguuugaugagauuaga

SEQ ID NO: 629042 - RNA, 19 nt, Homo sapiens
uaaagaagugagaccuguu

SEQ ID NO: 629043 - RNA, 19 nt, Homo sapiens
cugggaccauugagaacua

SEQ ID NO: 629044 - RNA, 19 nt, Homo sapiens
cagucuaccuggaccuguu

SEQ ID NO: 629045 - RNA, 19 nt, Homo sapiens
ccaaggccaccacagucua

SEQ ID NO: 629046 - RNA, 19 nt, Homo sapiens
cuaaguccaucguguuggu

SEQ ID NO: 629047 - RNA, 19 nt, Homo sapiens
guagaccuggccuuucuga

SEQ ID NO: 629048 - RNA, 19 nt, Homo sapiens
ucagcaagcagcuauuaca

SEQ ID NO: 629049 - RNA, 19 nt, Homo sapiens
gugagucugcugauuccua

SEQ ID NO: 629050 - RNA, 19 nt, Homo sapiens
ugaccuucccuauguuuau

SEQ ID NO: 629051 - RNA, 19 nt, Homo sapiens
uagcuaaguccaucguguu

SEQ ID NO: 629052 - RNA, 19 nt, Homo sapiens
acuccagcauguuugauga

SEQ ID NO: 629053 - RNA, 19 nt, Homo sapiens
ggucggguguggugguucu

SEQ ID NO: 629054 - RNA, 19 nt, Homo sapiens
caucucagcaagcagcuau

SEQ ID NO: 629055 - RNA, 19 nt, Homo sapiens
uaucagcaacuaccuccaa

SEQ ID NO: 629056 - RNA, 19 nt, Homo sapiens
agacauucagcaugacaaa

SEQ ID NO: 629057 - RNA, 19 nt, Homo sapiens
uauauuggauguggaugca

SEQ ID NO: 629058 - RNA, 19 nt, Homo sapiens
gaccuguucguccaugcua

SEQ ID NO: 629059 - RNA, 19 nt, Homo sapiens
aagaagugagaccuguuua

SEQ ID NO: 629060 - RNA, 19 nt, Homo sapiens
cccgauaucaucaucaaug

SEQ ID NO: 629061 - RNA, 19 nt, Homo sapiens
uugaugagauuagagagau

SEQ ID NO: 629062 - RNA, 19 nt, Homo sapiens
uucaaucuaucagcaacua

SEQ ID NO: 629063 - RNA, 19 nt, Homo sapiens
gaaacuggcuguacaauau

SEQ ID NO: 629064 - RNA, 19 nt, Homo sapiens
gagauugucuguacugaua

SEQ ID NO: 629065 - RNA, 19 nt, Homo sapiens
gaucagaacuuacaaacca

SEQ ID NO: 629066 - RNA, 19 nt, Homo sapiens
gaugugaccugcucucaaa

SEQ ID NO: 629067 - RNA, 19 nt, Homo sapiens
ggaggacagucguuucuuu

SEQ ID NO: 629068 - RNA, 19 nt, Homo sapiens
ggaggagaaucgcucuuaa

SEQ ID NO: 629069 - RNA, 19 nt, Homo sapiens
ccacggagaugcugaggaa

SEQ ID NO: 629070 - RNA, 19 nt, Homo sapiens
ggacugcaguggaucagaa

SEQ ID NO: 629071 - RNA, 19 nt, Homo sapiens
cagcagcguuggcuuguuu

SEQ ID NO: 629072 - RNA, 19 nt, Homo sapiens
caaggaggcucucaacucu

SEQ ID NO: 629073 - RNA, 19 nt, Homo sapiens
uauacgaacuccuggauga

SEQ ID NO: 629074 - RNA, 19 nt, Homo sapiens
gaacuuacaaaccaaacuu

SEQ ID NO: 629075 - RNA, 19 nt, Homo sapiens
gguaccaacucuccgauga

SEQ ID NO: 629076 - RNA, 19 nt, Homo sapiens
cucaagagcuuccuuccua

SEQ ID NO: 629077 - RNA, 19 nt, Homo sapiens
gcaauguggcucugguaua

SEQ ID NO: 629078 - RNA, 19 nt, Homo sapiens
guacugauagcaucuaaug

SEQ ID NO: 629079 - RNA, 19 nt, Homo sapiens
gcuggacuauggcuaugua

SEQ ID NO: 629080 - RNA, 19 nt, Homo sapiens
gaggagaaucgcucuuaaa

SEQ ID NO: 629081 - RNA, 19 nt, Homo sapiens
gcaaggaggcucucaacuc

SEQ ID NO: 629082 - RNA, 19 nt, Homo sapiens
ggagagauucggcucaaga

SEQ ID NO: 629083 - RNA, 19 nt, Homo sapiens
cggagaugcugaggaauuu

SEQ ID NO: 629084 - RNA, 19 nt, Homo sapiens
cagcgacgccuaugucauu

SEQ ID NO: 629085 - RNA, 19 nt, Homo sapiens
gaaggaagcaaucuacaac

SEQ ID NO: 629086 - RNA, 19 nt, Homo sapiens
uaucuaaaguugcgaugug

SEQ ID NO: 629087 - RNA, 19 nt, Homo sapiens
caauguggcucugguauac

SEQ ID NO: 629088 - RNA, 19 nt, Homo sapiens
ggccaugauuucccaauuc

SEQ ID NO: 629089 - RNA, 19 nt, Homo sapiens
gcccagccuuucuguggua

SEQ ID NO: 629090 - RNA, 19 nt, Homo sapiens
gggacccgcucaucuacaa

SEQ ID NO: 629091 - RNA, 19 nt, Homo sapiens
gagagauugucuguacuga

SEQ ID NO: 629092 - RNA, 19 nt, Homo sapiens
uggaugaagugcuggacua

SEQ ID NO: 629093 - RNA, 19 nt, Homo sapiens
uagaacugcucuccagguu

SEQ ID NO: 629094 - RNA, 19 nt, Homo sapiens
acacagcggccucuauuug

SEQ ID NO: 629095 - RNA, 19 nt, Homo sapiens
ccauggccgucauuucauu

SEQ ID NO: 629096 - RNA, 19 nt, Homo sapiens
ugcaguggaucagaacuua

SEQ ID NO: 629097 - RNA, 19 nt, Homo sapiens
ucucaacucucaggccuuu

SEQ ID NO: 629098 - RNA, 19 nt, Homo sapiens
agaaacuggcuguacaaua

SEQ ID NO: 629099 - RNA, 19 nt, Homo sapiens
gcaaugggcccagccuuuc

SEQ ID NO: 629100 - RNA, 19 nt, Homo sapiens
gagccaagcccucaauguc

SEQ ID NO: 629101 - RNA, 19 nt, Homo sapiens
gcauuggcuugacggaaga

SEQ ID NO: 629102 - RNA, 19 nt, Homo sapiens
gcucugagaugcgcauugg

SEQ ID NO: 629103 - RNA, 19 nt, Homo sapiens
ccagaacggccaugauuuc

SEQ ID NO: 629104 - RNA, 19 nt, Homo sapiens
gucgagagauugucuguac

SEQ ID NO: 629105 - RNA, 19 nt, Homo sapiens
gacuauggcuauguacaga

SEQ ID NO: 629106 - RNA, 19 nt, Homo sapiens
agacacagcggccucuauu

SEQ ID NO: 629107 - RNA, 19 nt, Homo sapiens
caccauggccgucauuuca

SEQ ID NO: 629108 - RNA, 19 nt, Homo sapiens
ggcaaugggcccagccuuu

SEQ ID NO: 629109 - RNA, 19 nt, Homo sapiens
cugugaaucuggacgaauu

SEQ ID NO: 629110 - RNA, 19 nt, Homo sapiens
ccacccuucugggcgauua

SEQ ID NO: 629111 - RNA, 19 nt, Homo sapiens
aggaagcaaucuacaacuu

SEQ ID NO: 629112 - RNA, 19 nt, Homo sapiens
gcacacgcguucuuuuguu

SEQ ID NO: 629113 - RNA, 19 nt, Homo sapiens
gaaggacugcaguggauca

SEQ ID NO: 629114 - RNA, 19 nt, Homo sapiens
gacuuucgccgucuucuug

SEQ ID NO: 629115 - RNA, 19 nt, Homo sapiens
gaccaucucccgcaaugug

SEQ ID NO: 629116 - RNA, 19 nt, Homo sapiens
gaauccgggucgaugaagu

SEQ ID NO: 629117 - RNA, 19 nt, Homo sapiens
gagaugcgcauuggcuuga

SEQ ID NO: 629118 - RNA, 19 nt, Homo sapiens
ugaaggaagcaaucuacaa

SEQ ID NO: 629119 - RNA, 19 nt, Homo sapiens
cggaggagaaucgcucuua

SEQ ID NO: 629120 - RNA, 19 nt, Homo sapiens
gcucaucuacaaagacuuc

SEQ ID NO: 629121 - RNA, 19 nt, Homo sapiens
gccaugauuucccaauucu

SEQ ID NO: 629122 - RNA, 19 nt, Homo sapiens
uggauguggucgagagauu

SEQ ID NO: 629123 - RNA, 19 nt, Homo sapiens
gagaugcugaggaauuuca

SEQ ID NO: 629124 - RNA, 19 nt, Homo sapiens
ggucacaacuucagaaaac

SEQ ID NO: 629125 - RNA, 19 nt, Homo sapiens
cugagaaacuggcuguaca

SEQ ID NO: 629126 - RNA, 19 nt, Homo sapiens
gccuuucugugguaucuga

SEQ ID NO: 629127 - RNA, 19 nt, Homo sapiens
aggaggcucucaacucuca

SEQ ID NO: 629128 - RNA, 19 nt, Homo sapiens
caugauuucccaauucuuc

SEQ ID NO: 629129 - RNA, 19 nt, Homo sapiens
ggacuauggcuauguacag

SEQ ID NO: 629130 - RNA, 19 nt, Homo sapiens
ucauuucauucacaucaga

SEQ ID NO: 629131 - RNA, 19 nt, Homo sapiens
cggccaugauuucccaauu

SEQ ID NO: 629132 - RNA, 19 nt, Homo sapiens
aggaaggacugcaguggau

SEQ ID NO: 629133 - RNA, 19 nt, Homo sapiens
ccacagcgacgccuauguc

SEQ ID NO: 629134 - RNA, 19 nt, Homo sapiens
ggauguggccgagcucuuc

SEQ ID NO: 629135 - RNA, 19 nt, Homo sapiens
ucccaauucuucauucugu

SEQ ID NO: 629136 - RNA, 19 nt, Homo sapiens
aaaagaaagugacaugaag

SEQ ID NO: 629137 - RNA, 19 nt, Homo sapiens
ggagaaucgcucuuaaagg

SEQ ID NO: 629138 - RNA, 19 nt, Homo sapiens
gaccagagccaaaagaaug

SEQ ID NO: 629139 - RNA, 19 nt, Homo sapiens
gacacagcggccucuauuu

SEQ ID NO: 629140 - RNA, 19 nt, Homo sapiens
ggucgaugaagucucguuu

SEQ ID NO: 629141 - RNA, 19 nt, Homo sapiens
ggaugugcagggagagauu

SEQ ID NO: 629142 - RNA, 19 nt, Homo sapiens
uacaacuuccuuccgcuua

SEQ ID NO: 629143 - RNA, 19 nt, Homo sapiens
uggcuugacggaagaguuu

SEQ ID NO: 629144 - RNA, 19 nt, Homo sapiens
gagaaacuggcuguacaau

SEQ ID NO: 629145 - RNA, 19 nt, Homo sapiens
gaaucuggacgaauuugag

SEQ ID NO: 629146 - RNA, 19 nt, Homo sapiens
acugauagcaucuaaugga

SEQ ID NO: 629147 - RNA, 19 nt, Homo sapiens
augaagugcuggacuaugg

SEQ ID NO: 629148 - RNA, 19 nt, Homo sapiens
ugacaugaaggaagcaauc

SEQ ID NO: 629149 - RNA, 19 nt, Homo sapiens
ugagaaacuggcuguacaa

SEQ ID NO: 629150 - RNA, 19 nt, Homo sapiens
gugaugcgguaccaacucu

SEQ ID NO: 629151 - RNA, 19 nt, Homo sapiens
ggccgucauuucauucaca

SEQ ID NO: 629152 - RNA, 19 nt, Homo sapiens
ggaugaagugcuggacuau

SEQ ID NO: 629153 - RNA, 19 nt, Homo sapiens
ggauguggucgagagauug

SEQ ID NO: 629154 - RNA, 19 nt, Homo sapiens
gguauacgaacuccuggau

SEQ ID NO: 629155 - RNA, 19 nt, Homo sapiens
gagguuaugggccaggaau

SEQ ID NO: 629156 - RNA, 19 nt, Homo sapiens
cugauagcaucuaauggau

SEQ ID NO: 629157 - RNA, 19 nt, Homo sapiens
cgagagauugucuguacug

SEQ ID NO: 629158 - RNA, 19 nt, Homo sapiens
gauguggucgagagauugu

SEQ ID NO: 629159 - RNA, 19 nt, Homo sapiens
acaacuuccuuccgcuuag

SEQ ID NO: 629160 - RNA, 19 nt, Homo sapiens
cgucauuucauucacauca

SEQ ID NO: 629161 - RNA, 19 nt, Homo sapiens
ucagaacuuacaaaccaaa

SEQ ID NO: 629162 - RNA, 19 nt, Homo sapiens
acggagaugcugaggaauu

SEQ ID NO: 629163 - RNA, 19 nt, Homo sapiens
gggcauagcucuaaucuaa

SEQ ID NO: 629164 - RNA, 19 nt, Homo sapiens
gaaagauccuguucuauaa

SEQ ID NO: 629165 - RNA, 19 nt, Homo sapiens
ggagaacccucaccuaaua

SEQ ID NO: 629166 - RNA, 19 nt, Homo sapiens
gcaaauaacucaagacuca

SEQ ID NO: 629167 - RNA, 19 nt, Homo sapiens
gaagaaggcaccaauguua

SEQ ID NO: 629168 - RNA, 19 nt, Homo sapiens
ggaaagauccuguucuaua

SEQ ID NO: 629169 - RNA, 19 nt, Homo sapiens
gcauagcucuaaucuaaua

SEQ ID NO: 629170 - RNA, 19 nt, Homo sapiens
gaagagaagugucaauauc

SEQ ID NO: 629171 - RNA, 19 nt, Homo sapiens
cgauaugacuucagaauuu

SEQ ID NO: 629172 - RNA, 19 nt, Homo sapiens
gaaagaauccgacaacuuc

SEQ ID NO: 629173 - RNA, 19 nt, Homo sapiens
uagcauagauugucaaaug

SEQ ID NO: 629174 - RNA, 19 nt, Homo sapiens
gaacggauaagaaucuaua

SEQ ID NO: 629175 - RNA, 19 nt, Homo sapiens
caacaagauuuccacaauu

SEQ ID NO: 629176 - RNA, 19 nt, Homo sapiens
cuaaugaccucaccugaaa

SEQ ID NO: 629177 - RNA, 19 nt, Homo sapiens
gaacggugaguacuucuua

SEQ ID NO: 629178 - RNA, 19 nt, Homo sapiens
caagaaaccuauaacuuca

SEQ ID NO: 629179 - RNA, 19 nt, Homo sapiens
acaaagagguugaggaaga

SEQ ID NO: 629180 - RNA, 19 nt, Homo sapiens
gaccuaaggauaugcauua

SEQ ID NO: 629181 - RNA, 19 nt, Homo sapiens
ggaauaaagggacaaauau

SEQ ID NO: 629182 - RNA, 19 nt, Homo sapiens
caggauauauuguucguuu

SEQ ID NO: 629183 - RNA, 19 nt, Homo sapiens
gaacugauggcucuauuug

SEQ ID NO: 629184 - RNA, 19 nt, Homo sapiens
ggauaagaaucuauaguuc

SEQ ID NO: 629185 - RNA, 19 nt, Homo sapiens
ggaagucaguguacaagau

SEQ ID NO: 629186 - RNA, 19 nt, Homo sapiens
gaaugggauuggcaaguaa

SEQ ID NO: 629187 - RNA, 19 nt, Homo sapiens
gcacaaaacuaauccuuga

SEQ ID NO: 629188 - RNA, 19 nt, Homo sapiens
gaaacagauucauggagaa

SEQ ID NO: 629189 - RNA, 19 nt, Homo sapiens
aagauaagcugguggaaga

SEQ ID NO: 629190 - RNA, 19 nt, Homo sapiens
ggaaagauuacucuacuga

SEQ ID NO: 629191 - RNA, 19 nt, Homo sapiens
ugaauuaugugucccaguu

SEQ ID NO: 629192 - RNA, 19 nt, Homo sapiens
ggaagucacucacagaaac

SEQ ID NO: 629193 - RNA, 19 nt, Homo sapiens
agucuuggcugaacguuua

SEQ ID NO: 629194 - RNA, 19 nt, Homo sapiens
ucagacaacauucuucuua

SEQ ID NO: 629195 - RNA, 19 nt, Homo sapiens
ucaacaagauuuccacaau

SEQ ID NO: 629196 - RNA, 19 nt, Homo sapiens
cuucagaauuuauggguua

SEQ ID NO: 629197 - RNA, 19 nt, Homo sapiens
ggaaagaauccgacaacuu

SEQ ID NO: 629198 - RNA, 19 nt, Homo sapiens
guucagagcuccauuccau

SEQ ID NO: 629199 - RNA, 19 nt, Homo sapiens
gcugaacguuuaccauuga

SEQ ID NO: 629200 - RNA, 19 nt, Homo sapiens
gcaggucugguuuauauaa

SEQ ID NO: 629201 - RNA, 19 nt, Homo sapiens
ccugaugucuggagaauug

SEQ ID NO: 629202 - RNA, 19 nt, Homo sapiens
cagacaacauucuucuuaa

SEQ ID NO: 629203 - RNA, 19 nt, Homo sapiens
uuugagaacuugaccuaua

SEQ ID NO: 629204 - RNA, 19 nt, Homo sapiens
caaagagguugaggaagaa

SEQ ID NO: 629205 - RNA, 19 nt, Homo sapiens
ggaagaaggcaccaauguu

SEQ ID NO: 629206 - RNA, 19 nt, Homo sapiens
gagcuugaccuaaggauau

SEQ ID NO: 629207 - RNA, 19 nt, Homo sapiens
gcaccacacuguucagagu

SEQ ID NO: 629208 - RNA, 19 nt, Homo sapiens
gaaaucauacugugaccuu

SEQ ID NO: 629209 - RNA, 19 nt, Homo sapiens
ggaagagaagugucaauau

SEQ ID NO: 629210 - RNA, 19 nt, Homo sapiens
ucaaggaaaugucagugaa

SEQ ID NO: 629211 - RNA, 19 nt, Homo sapiens
uaacauugcuguccuugag

SEQ ID NO: 629212 - RNA, 19 nt, Homo sapiens
agaaugggauuggcaagua

SEQ ID NO: 629213 - RNA, 19 nt, Homo sapiens
ggacaaagauacaguuccu

SEQ ID NO: 629214 - RNA, 19 nt, Homo sapiens
ggaucaaggagaccuguua

SEQ ID NO: 629215 - RNA, 19 nt, Homo sapiens
aaacaaagagguugaggaa

SEQ ID NO: 629216 - RNA, 19 nt, Homo sapiens
ccaguggccuugguccuua

SEQ ID NO: 629217 - RNA, 19 nt, Homo sapiens
acacagacauuaagaagag

SEQ ID NO: 629218 - RNA, 19 nt, Homo sapiens
gaacccucaccuaauaaua

SEQ ID NO: 629219 - RNA, 19 nt, Homo sapiens
acucaagacucacaagaaa

SEQ ID NO: 629220 - RNA, 19 nt, Homo sapiens
ccacacacuuuguaagaau

SEQ ID NO: 629221 - RNA, 19 nt, Homo sapiens
aaucugagcucccuuugga

SEQ ID NO: 629222 - RNA, 19 nt, Homo sapiens
ucacauaauuccagucaca

SEQ ID NO: 629223 - RNA, 19 nt, Homo sapiens
ccacaauucuucugucaag

SEQ ID NO: 629224 - RNA, 19 nt, Homo sapiens
cagaggcuauggaacuuaa

SEQ ID NO: 629225 - RNA, 19 nt, Homo sapiens
guacuaaaggcacuagaaa

SEQ ID NO: 629226 - RNA, 19 nt, Homo sapiens
gaggguggauucucucugu

SEQ ID NO: 629227 - RNA, 19 nt, Homo sapiens
caacuugauccacauguaa

SEQ ID NO: 629228 - RNA, 19 nt, Homo sapiens
gaagucaguguacaagauu

SEQ ID NO: 629229 - RNA, 19 nt, Homo sapiens
gaagggaaacagauucaug

SEQ ID NO: 629230 - RNA, 19 nt, Homo sapiens
gcauagauugucaaaugua

SEQ ID NO: 629231 - RNA, 19 nt, Homo sapiens
uugcaggucugguuuauau

SEQ ID NO: 629232 - RNA, 19 nt, Homo sapiens
gcacagucauuagcacaga

SEQ ID NO: 629233 - RNA, 19 nt, Homo sapiens
acaagaaaccuauaacuuc

SEQ ID NO: 629234 - RNA, 19 nt, Homo sapiens
uaaacaaccuucccaaagc

SEQ ID NO: 629235 - RNA, 19 nt, Homo sapiens
ucaguauucugccaucauu

SEQ ID NO: 629236 - RNA, 19 nt, Homo sapiens
gaacaggagacuugagcuu

SEQ ID NO: 629237 - RNA, 19 nt, Homo sapiens
ggucaugugcuacuugaaa

SEQ ID NO: 629238 - RNA, 19 nt, Homo sapiens
ccucgaugcugauucauau

SEQ ID NO: 629239 - RNA, 19 nt, Homo sapiens
ccgaggacuucaagacuuu

SEQ ID NO: 629240 - RNA, 19 nt, Homo sapiens
gaauaaagggacaaauauc

SEQ ID NO: 629241 - RNA, 19 nt, Homo sapiens
gagcagcauccugucauua

SEQ ID NO: 629242 - RNA, 19 nt, Homo sapiens
gcagugccacccacgauuu

SEQ ID NO: 629243 - RNA, 19 nt, Homo sapiens
gaaagauuacucuacugaa

SEQ ID NO: 629244 - RNA, 19 nt, Homo sapiens
ugacagguguuccuaccaa

SEQ ID NO: 629245 - RNA, 19 nt, Homo sapiens
gcauuaaccacucuacaga

SEQ ID NO: 629246 - RNA, 19 nt, Homo sapiens
ccaggcagcuucugacucu

SEQ ID NO: 629247 - RNA, 19 nt, Homo sapiens
uugagaacuugaccuauaa

SEQ ID NO: 629248 - RNA, 19 nt, Homo sapiens
uaacuaccuuuaucuccuu

SEQ ID NO: 629249 - RNA, 19 nt, Homo sapiens
gcagcauccugucauuaau

SEQ ID NO: 629250 - RNA, 19 nt, Homo sapiens
guaauuggcaaauaacuca

SEQ ID NO: 629251 - RNA, 19 nt, Homo sapiens
caaguucccugagccaaau

SEQ ID NO: 629252 - RNA, 19 nt, Homo sapiens
ucaguaggauugaaacauc

SEQ ID NO: 629253 - RNA, 19 nt, Homo sapiens
caagcuuacuacagugaaa

SEQ ID NO: 629254 - RNA, 19 nt, Homo sapiens
ugacaucccugacccuuac

SEQ ID NO: 629255 - RNA, 19 nt, Homo sapiens
ggccaggaguucgauauga

SEQ ID NO: 629256 - RNA, 19 nt, Homo sapiens
gauucucucugucuuggaa

SEQ ID NO: 629257 - RNA, 19 nt, Homo sapiens
aggaauaaagggacaaaua

SEQ ID NO: 629258 - RNA, 19 nt, Homo sapiens
gguggacgaugccaaguuc

SEQ ID NO: 629259 - RNA, 19 nt, Homo sapiens
uuacuacagugaaagaaug

SEQ ID NO: 629260 - RNA, 19 nt, Homo sapiens
aacaagauuuccacaauuc

SEQ ID NO: 629261 - RNA, 19 nt, Homo sapiens
acaggagacuugagcuuga

SEQ ID NO: 629262 - RNA, 19 nt, Homo sapiens
ccaaguaugcugggacuaa

SEQ ID NO: 629263 - RNA, 19 nt, Homo sapiens
ggacaagccuucaguggua

SEQ ID NO: 629264 - RNA, 19 nt, Homo sapiens
ccacaucucugaagaaguu

SEQ ID NO: 629265 - RNA, 19 nt, Homo sapiens
ugaaagaacugcaaauugu

SEQ ID NO: 629266 - RNA, 19 nt, Homo sapiens
caacauugcuggacauuuc

SEQ ID NO: 629267 - RNA, 19 nt, Homo sapiens
agacagagcugcaccaugu

SEQ ID NO: 629268 - RNA, 19 nt, Homo sapiens
acagugagcugaugaguga

SEQ ID NO: 629269 - RNA, 19 nt, Homo sapiens
gaauuaagauggaguugca

SEQ ID NO: 629270 - RNA, 19 nt, Homo sapiens
ugaaggagcugcuguccaa

SEQ ID NO: 629271 - RNA, 19 nt, Homo sapiens
guaccaaggucaagcagaa

SEQ ID NO: 629272 - RNA, 19 nt, Homo sapiens
gacaaacgcuuccagcaau

SEQ ID NO: 629273 - RNA, 19 nt, Homo sapiens
ccacgagacuuuaccagaa

SEQ ID NO: 629274 - RNA, 19 nt, Homo sapiens
gaagguagcagccgucugu

SEQ ID NO: 629275 - RNA, 19 nt, Homo sapiens
caagagcccugaccucauc

SEQ ID NO: 629276 - RNA, 19 nt, Homo sapiens
gagggaacauuugaaagaa

SEQ ID NO: 629277 - RNA, 19 nt, Homo sapiens
gcacccuacugcccuuuaa

SEQ ID NO: 629278 - RNA, 19 nt, Homo sapiens
agacagaggaugaggcuua

SEQ ID NO: 629279 - RNA, 19 nt, Homo sapiens
gcaggacacucugauggaa

SEQ ID NO: 629280 - RNA, 19 nt, Homo sapiens
aaagggauguuucugauca

SEQ ID NO: 629281 - RNA, 19 nt, Homo sapiens
ccagagggaucgaaaugga

SEQ ID NO: 629282 - RNA, 19 nt, Homo sapiens
gaucguaggcaauuagaga

SEQ ID NO: 629283 - RNA, 19 nt, Homo sapiens
gaugagggaacauuugaaa

SEQ ID NO: 629284 - RNA, 19 nt, Homo sapiens
gaagagcggcugcaagaca

SEQ ID NO: 629285 - RNA, 19 nt, Homo sapiens
gaccagaaguacaucuuuc

SEQ ID NO: 629286 - RNA, 19 nt, Homo sapiens
gugcggagcagauguguaa

SEQ ID NO: 629287 - RNA, 19 nt, Homo sapiens
gaucaugacccgccucuuc

SEQ ID NO: 629288 - RNA, 19 nt, Homo sapiens
ccacggaacuggcauuacu

SEQ ID NO: 629289 - RNA, 19 nt, Homo sapiens
gagagaaggucgggcuguu

SEQ ID NO: 629290 - RNA, 19 nt, Homo sapiens
ugacagauguacugguguu

SEQ ID NO: 629291 - RNA, 19 nt, Homo sapiens
uggaagagcuacacuugga

SEQ ID NO: 629292 - RNA, 19 nt, Homo sapiens
cagagggccuuguccuuga

SEQ ID NO: 629293 - RNA, 19 nt, Homo sapiens
gaccuauacugaccucuuc

SEQ ID NO: 629294 - RNA, 19 nt, Homo sapiens
aaagucaacugcacguguu

SEQ ID NO: 629295 - RNA, 19 nt, Homo sapiens
ggaccagaaguacaucuuu

SEQ ID NO: 629296 - RNA, 19 nt, Homo sapiens
gagcaucacagccaaggaa

SEQ ID NO: 629297 - RNA, 19 nt, Homo sapiens
uaagagaucguaggcaauu

SEQ ID NO: 629298 - RNA, 19 nt, Homo sapiens
gcugcagaaucuaaucgua

SEQ ID NO: 629299 - RNA, 19 nt, Homo sapiens
caauucauccggaaaguga

SEQ ID NO: 629300 - RNA, 19 nt, Homo sapiens
gcaaggccuuaaagcucua

SEQ ID NO: 629301 - RNA, 19 nt, Homo sapiens
gaucgaagccuccuaucuc

SEQ ID NO: 629302 - RNA, 19 nt, Homo sapiens
uuacugcuguucucccuuu

SEQ ID NO: 629303 - RNA, 19 nt, Homo sapiens
uggaagcccugggagauaa

SEQ ID NO: 629304 - RNA, 19 nt, Homo sapiens
ugagggaacauuugaaaga

SEQ ID NO: 629305 - RNA, 19 nt, Homo sapiens
ggacuccaauuugccaaug

SEQ ID NO: 629306 - RNA, 19 nt, Homo sapiens
uuaggccgcucgaaagaaa

SEQ ID NO: 629307 - RNA, 19 nt, Homo sapiens
gcuguacgcccgagacaaa

SEQ ID NO: 629308 - RNA, 19 nt, Homo sapiens
ccuacugcccuuuaaauaa

SEQ ID NO: 629309 - RNA, 19 nt, Homo sapiens
ggacgaggguauuuaucag

SEQ ID NO: 629310 - RNA, 19 nt, Homo sapiens
cacaaccgcuguaaagaca

SEQ ID NO: 629311 - RNA, 19 nt, Homo sapiens
gaaagaacugcaaauuguc

SEQ ID NO: 629312 - RNA, 19 nt, Homo sapiens
caaucucuauggacuucua

SEQ ID NO: 629313 - RNA, 19 nt, Homo sapiens
gaacacuacugggguauau

SEQ ID NO: 629314 - RNA, 19 nt, Homo sapiens
gcacugaccgccuggaucu

SEQ ID NO: 629315 - RNA, 19 nt, Homo sapiens
cuucaaagaugugcuagug

SEQ ID NO: 629316 - RNA, 19 nt, Homo sapiens
gaaaccucagcgugaauuu

SEQ ID NO: 629317 - RNA, 19 nt, Homo sapiens
ggaguggaacugcucuuga

SEQ ID NO: 629318 - RNA, 19 nt, Homo sapiens
guauuuaucagcuggagaa

SEQ ID NO: 629319 - RNA, 19 nt, Homo sapiens
gcacggggaugcuggaaga

SEQ ID NO: 629320 - RNA, 19 nt, Homo sapiens
gaugagugacuuugagaug

SEQ ID NO: 629321 - RNA, 19 nt, Homo sapiens
ggaccagaauguuuuguug

SEQ ID NO: 629322 - RNA, 19 nt, Homo sapiens
ccgaagagcggcugcaaga

SEQ ID NO: 629323 - RNA, 19 nt, Homo sapiens
gcgaugcccuguacuugag

SEQ ID NO: 629324 - RNA, 19 nt, Homo sapiens
gcuuaccugcggcgaauua

SEQ ID NO: 629325 - RNA, 19 nt, Homo sapiens
acaaacgcuuccagcaauu

SEQ ID NO: 629326 - RNA, 19 nt, Homo sapiens
gcuggaagagcuacacuug

SEQ ID NO: 629327 - RNA, 19 nt, Homo sapiens
caacugcacguguuuuaua

SEQ ID NO: 629328 - RNA, 19 nt, Homo sapiens
gaaagcuacaccacagaug

SEQ ID NO: 629329 - RNA, 19 nt, Homo sapiens
gcccuguacuugaguuuca

SEQ ID NO: 629330 - RNA, 19 nt, Homo sapiens
gaugcccgcuauaccaaug

SEQ ID NO: 629331 - RNA, 19 nt, Homo sapiens
gggaacauuugaaagaacu

SEQ ID NO: 629332 - RNA, 19 nt, Homo sapiens
ugagugacuuugagaugga

SEQ ID NO: 629333 - RNA, 19 nt, Homo sapiens
ggaccuauacugaccucuu

SEQ ID NO: 629334 - RNA, 19 nt, Homo sapiens
ggaucuaccugucacuacu

SEQ ID NO: 629335 - RNA, 19 nt, Homo sapiens
gaguggaacugcucuugac

SEQ ID NO: 629336 - RNA, 19 nt, Homo sapiens
ugaggacacugaagaucau

SEQ ID NO: 629337 - RNA, 19 nt, Homo sapiens
gcaguccguuucucuucga

SEQ ID NO: 629338 - RNA, 19 nt, Homo sapiens
ugcccaaccugcaauguga

SEQ ID NO: 629339 - RNA, 19 nt, Homo sapiens
gcccugaccucaucuucca

SEQ ID NO: 629340 - RNA, 19 nt, Homo sapiens
ccacagggaccagaauguu

SEQ ID NO: 629341 - RNA, 19 nt, Homo sapiens
cacgagacuuuaccagaau

SEQ ID NO: 629342 - RNA, 19 nt, Homo sapiens
aaauggaaaucagcugaga

SEQ ID NO: 629343 - RNA, 19 nt, Homo sapiens
agauggaguugcagcagaa

SEQ ID NO: 629344 - RNA, 19 nt, Homo sapiens
agacaaacgcuuccagcaa

SEQ ID NO: 629345 - RNA, 19 nt, Homo sapiens
ggacuuugcagcugacucu

SEQ ID NO: 629346 - RNA, 19 nt, Homo sapiens
gcugaugagugacuuugag

SEQ ID NO: 629347 - RNA, 19 nt, Homo sapiens
guucuaggguggguuggaa

SEQ ID NO: 629348 - RNA, 19 nt, Homo sapiens
ucaccaccauuucaguuuc

SEQ ID NO: 629349 - RNA, 19 nt, Homo sapiens
ugguaucgcugcagaaucu

SEQ ID NO: 629350 - RNA, 19 nt, Homo sapiens
cagaaguacaucuuuccua

SEQ ID NO: 629351 - RNA, 19 nt, Homo sapiens
cagauguacugguguuucu

SEQ ID NO: 629352 - RNA, 19 nt, Homo sapiens
caucaccaaguacccguua

SEQ ID NO: 629353 - RNA, 19 nt, Homo sapiens
gagcucagugacauccaua

SEQ ID NO: 629354 - RNA, 19 nt, Homo sapiens
aaaaggaggugaugaagca

SEQ ID NO: 629355 - RNA, 19 nt, Homo sapiens
aagagguaaucuacaguga

SEQ ID NO: 629356 - RNA, 19 nt, Homo sapiens
gcauccugcuggugacuca

SEQ ID NO: 629357 - RNA, 19 nt, Homo sapiens
ugacgaagagguaaucuac

SEQ ID NO: 629358 - RNA, 19 nt, Homo sapiens
ccguuucucuucgaaguaa

SEQ ID NO: 629359 - RNA, 19 nt, Homo sapiens
ucaagcagaagcaacagaa

SEQ ID NO: 629360 - RNA, 19 nt, Homo sapiens
aagagaucguaggcaauua

SEQ ID NO: 629361 - RNA, 19 nt, Homo sapiens
uccuggaguugauggaaua

SEQ ID NO: 629362 - RNA, 19 nt, Homo sapiens
gacaagccuucagugguau

SEQ ID NO: 629363 - RNA, 19 nt, Homo sapiens
ggaagaaacuugcuaaaga

SEQ ID NO: 629364 - RNA, 19 nt, Homo sapiens
caugaaagcugguuugaaa

SEQ ID NO: 629365 - RNA, 19 nt, Homo sapiens
aaacagaucuccaacuaaa

SEQ ID NO: 629366 - RNA, 19 nt, Homo sapiens
gagauaauauggagacauu

SEQ ID NO: 629367 - RNA, 19 nt, Homo sapiens
caaacuacaugaagacuuu

SEQ ID NO: 629368 - RNA, 19 nt, Homo sapiens
gaagaacgacugaaauauu

SEQ ID NO: 629369 - RNA, 19 nt, Homo sapiens
gaagcuaaguuccaucuug

SEQ ID NO: 629370 - RNA, 19 nt, Homo sapiens
gagcgaaagugauggaauu

SEQ ID NO: 629371 - RNA, 19 nt, Homo sapiens
uaagcucucugcugaaaua

SEQ ID NO: 629372 - RNA, 19 nt, Homo sapiens
gauaagcucucugcugaaa

SEQ ID NO: 629373 - RNA, 19 nt, Homo sapiens
uaaauacagugacucauug

SEQ ID NO: 629374 - RNA, 19 nt, Homo sapiens
gagaugagcagcccaauau

SEQ ID NO: 629375 - RNA, 19 nt, Homo sapiens
ggacacaguuucucaugau

SEQ ID NO: 629376 - RNA, 19 nt, Homo sapiens
aaagaugggugccaguuaa

SEQ ID NO: 629377 - RNA, 19 nt, Homo sapiens
cuaaagacauggauucaga

SEQ ID NO: 629378 - RNA, 19 nt, Homo sapiens
gaacuggaaagcucuaauu

SEQ ID NO: 629379 - RNA, 19 nt, Homo sapiens
gaagaaacuugcuaaagac

SEQ ID NO: 629380 - RNA, 19 nt, Homo sapiens
gcggacagcugaagccaaa

SEQ ID NO: 629381 - RNA, 19 nt, Homo sapiens
cgaaagugauggaauugaa

SEQ ID NO: 629382 - RNA, 19 nt, Homo sapiens
gcuaaagacucggcauaaa

SEQ ID NO: 629383 - RNA, 19 nt, Homo sapiens
gaccauggcucccuuugga

SEQ ID NO: 629384 - RNA, 19 nt, Homo sapiens
ucaauucacuucacauuag

SEQ ID NO: 629385 - RNA, 19 nt, Homo sapiens
gaaauugugguuuggguuu

SEQ ID NO: 629386 - RNA, 19 nt, Homo sapiens
gcucucugcugaaauagaa

SEQ ID NO: 629387 - RNA, 19 nt, Homo sapiens
gacauuaguucaucugauc

SEQ ID NO: 629388 - RNA, 19 nt, Homo sapiens
gaacaugaggcuacguuug

SEQ ID NO: 629389 - RNA, 19 nt, Homo sapiens
agaaggaaauugugguuug

SEQ ID NO: 629390 - RNA, 19 nt, Homo sapiens
caaagaugggugccaguua

SEQ ID NO: 629391 - RNA, 19 nt, Homo sapiens
gaauugaacagcuggaaga

SEQ ID NO: 629392 - RNA, 19 nt, Homo sapiens
uccaauggcuccuuucuga

SEQ ID NO: 629393 - RNA, 19 nt, Homo sapiens
cauauuuaaugcccaguuu

SEQ ID NO: 629394 - RNA, 19 nt, Homo sapiens
ggagaugagcagcccaaua

SEQ ID NO: 629395 - RNA, 19 nt, Homo sapiens
ggaagaacgacugaaauau

SEQ ID NO: 629396 - RNA, 19 nt, Homo sapiens
gaagccaaauuagugcaaa

SEQ ID NO: 629397 - RNA, 19 nt, Homo sapiens
uagagaguguuaaguguga

SEQ ID NO: 629398 - RNA, 19 nt, Homo sapiens
ccagcaaacuacaugaaga

SEQ ID NO: 629399 - RNA, 19 nt, Homo sapiens
ggacagcugaagccaaauu

SEQ ID NO: 629400 - RNA, 19 nt, Homo sapiens
agacauggauucagaagag

SEQ ID NO: 629401 - RNA, 19 nt, Homo sapiens
uggaagaacgacugaaaua

SEQ ID NO: 629402 - RNA, 19 nt, Homo sapiens
caacuaaagacauggauuc

SEQ ID NO: 629403 - RNA, 19 nt, Homo sapiens
gagauuaaauacagugacu

SEQ ID NO: 629404 - RNA, 19 nt, Homo sapiens
gaaggaaauugugguuugg

SEQ ID NO: 629405 - RNA, 19 nt, Homo sapiens
aagcuaaguuccaucuuga

SEQ ID NO: 629406 - RNA, 19 nt, Homo sapiens
aaucugagguucccaguag

SEQ ID NO: 629407 - RNA, 19 nt, Homo sapiens
ugaguggcauccagaaaga

SEQ ID NO: 629408 - RNA, 19 nt, Homo sapiens
uaagugugauuuggagaaa

SEQ ID NO: 629409 - RNA, 19 nt, Homo sapiens
gcaagucaagagaaugaaa

SEQ ID NO: 629410 - RNA, 19 nt, Homo sapiens
gaaacuggcuaaaauuaag

SEQ ID NO: 629411 - RNA, 19 nt, Homo sapiens
cuagaauccugaagcuuug

SEQ ID NO: 629412 - RNA, 19 nt, Homo sapiens
cagaagagaaggaaauugu

SEQ ID NO: 629413 - RNA, 19 nt, Homo sapiens
uaccgaauacucauugaua

SEQ ID NO: 629414 - RNA, 19 nt, Homo sapiens
uuucugaccugcuuucaug

SEQ ID NO: 629415 - RNA, 19 nt, Homo sapiens
uguucaggaugcauauuua

SEQ ID NO: 629416 - RNA, 19 nt, Homo sapiens
gaaagagcuggaucuggaa

SEQ ID NO: 629417 - RNA, 19 nt, Homo sapiens
cagcaagucaagagaauga

SEQ ID NO: 629418 - RNA, 19 nt, Homo sapiens
uaacuagaauccugaagcu

SEQ ID NO: 629419 - RNA, 19 nt, Homo sapiens
ggacuccgaaacaacagua

SEQ ID NO: 629420 - RNA, 19 nt, Homo sapiens
ccagaaagagauuaaauac

SEQ ID NO: 629421 - RNA, 19 nt, Homo sapiens
gaaagcugguuugaaaauu

SEQ ID NO: 629422 - RNA, 19 nt, Homo sapiens
gcuggaagaacgacugaaa

SEQ ID NO: 629423 - RNA, 19 nt, Homo sapiens
aaucuagacuugcaguaug

SEQ ID NO: 629424 - RNA, 19 nt, Homo sapiens
gacagcugaagccaaauua

SEQ ID NO: 629425 - RNA, 19 nt, Homo sapiens
uaggagauguggugcuguu

SEQ ID NO: 629426 - RNA, 19 nt, Homo sapiens
uaaguuccaucuugaucga

SEQ ID NO: 629427 - RNA, 19 nt, Homo sapiens
gaccugcuuucauguuuua

SEQ ID NO: 629428 - RNA, 19 nt, Homo sapiens
gagauguggugcuguuguc

SEQ ID NO: 629429 - RNA, 19 nt, Homo sapiens
gaaacaacaguaggagaug

SEQ ID NO: 629430 - RNA, 19 nt, Homo sapiens
ccucagaucacuuuaagau

SEQ ID NO: 629431 - RNA, 19 nt, Homo sapiens
gaccugagcgaaagugaug

SEQ ID NO: 629432 - RNA, 19 nt, Homo sapiens
gcagcccaauaugcaauuu

SEQ ID NO: 629433 - RNA, 19 nt, Homo sapiens
cgaaacaacaguaggagau

SEQ ID NO: 629434 - RNA, 19 nt, Homo sapiens
gagaaggaaauugugguuu

SEQ ID NO: 629435 - RNA, 19 nt, Homo sapiens
gauuaaauacagugacuca

SEQ ID NO: 629436 - RNA, 19 nt, Homo sapiens
acuggaaagcucuaauuua

SEQ ID NO: 629437 - RNA, 19 nt, Homo sapiens
uaguucaucugaucauuuc

SEQ ID NO: 629438 - RNA, 19 nt, Homo sapiens
acuagaauccugaagcuuu

SEQ ID NO: 629439 - RNA, 19 nt, Homo sapiens
ggaaacuggcuaaaauuaa

SEQ ID NO: 629440 - RNA, 19 nt, Homo sapiens
gcaaacuacaugaagacuu

SEQ ID NO: 629441 - RNA, 19 nt, Homo sapiens
cccaauaugcaauuuguuu

SEQ ID NO: 629442 - RNA, 19 nt, Homo sapiens
aaacaacaguaggagaugu

SEQ ID NO: 629443 - RNA, 19 nt, Homo sapiens
acagaucuccaacuaaaga

SEQ ID NO: 629444 - RNA, 19 nt, Homo sapiens
ggaacaugaggcuacguuu

SEQ ID NO: 629445 - RNA, 19 nt, Homo sapiens
gaauacucauugauaagcu

SEQ ID NO: 629446 - RNA, 19 nt, Homo sapiens
accgaauacucauugauaa

SEQ ID NO: 629447 - RNA, 19 nt, Homo sapiens
gaggcuacguuuggagaga

SEQ ID NO: 629448 - RNA, 19 nt, Homo sapiens
ucaggaugcauauuuaaug

SEQ ID NO: 629449 - RNA, 19 nt, Homo sapiens
guucaggaugcauauuuaa

SEQ ID NO: 629450 - RNA, 19 nt, Homo sapiens
gaaucugagguucccagua

SEQ ID NO: 629451 - RNA, 19 nt, Homo sapiens
aaacagagcgaaggaaucu

SEQ ID NO: 629452 - RNA, 19 nt, Homo sapiens
ccaucuugaucgaguagaa

SEQ ID NO: 629453 - RNA, 19 nt, Homo sapiens
agagcuggaucuggaaauu

SEQ ID NO: 629454 - RNA, 19 nt, Homo sapiens
cacauuagcaacaaagaug

SEQ ID NO: 629455 - RNA, 19 nt, Homo sapiens
ucagugaaguugagcaaaa

SEQ ID NO: 629456 - RNA, 19 nt, Homo sapiens
gaaugaaagagcuggaucu

SEQ ID NO: 629457 - RNA, 19 nt, Homo sapiens
gagguucccaguagcaaug

SEQ ID NO: 629458 - RNA, 19 nt, Homo sapiens
gcauccagaaagagauuaa

SEQ ID NO: 629459 - RNA, 19 nt, Homo sapiens
gcaugaaagcugguuugaa

SEQ ID NO: 629460 - RNA, 19 nt, Homo sapiens
agacuuuaccaccagauaa

SEQ ID NO: 629461 - RNA, 19 nt, Homo sapiens
cucgagaaauguguuguuu

SEQ ID NO: 629462 - RNA, 19 nt, Homo sapiens
gcuccuuucugaccugcuu

SEQ ID NO: 629463 - RNA, 19 nt, Homo sapiens
gaacauacuuuaucaccuu

SEQ ID NO: 629464 - RNA, 19 nt, Homo sapiens
uaaagcaccucaauucauu

SEQ ID NO: 629465 - RNA, 19 nt, Homo sapiens
guacauugcucaccacuug

SEQ ID NO: 629466 - RNA, 19 nt, Homo sapiens
gaacuacacagcaagcuua

SEQ ID NO: 629467 - RNA, 19 nt, Homo sapiens
gcacagaaaugcuugaagu

SEQ ID NO: 629468 - RNA, 19 nt, Homo sapiens
ccaaguauuugcaccuuua

SEQ ID NO: 629469 - RNA, 19 nt, Homo sapiens
gaaagauuaucaagugcua

SEQ ID NO: 629470 - RNA, 19 nt, Homo sapiens
gagacuuccuguaauauuu

SEQ ID NO: 629471 - RNA, 19 nt, Homo sapiens
gaagaaagcaagaacaaga

SEQ ID NO: 629472 - RNA, 19 nt, Homo sapiens
guacagaaaguauccaaua

SEQ ID NO: 629473 - RNA, 19 nt, Homo sapiens
gcuaggaacuuuucaaaua

SEQ ID NO: 629474 - RNA, 19 nt, Homo sapiens
uaagcuaucugaagacauu

SEQ ID NO: 629475 - RNA, 19 nt, Homo sapiens
gcauggagcucacaauaca

SEQ ID NO: 629476 - RNA, 19 nt, Homo sapiens
caagaaauaucaagaagag

SEQ ID NO: 629477 - RNA, 19 nt, Homo sapiens
gcaaauuacagcaauauga

SEQ ID NO: 629478 - RNA, 19 nt, Homo sapiens
caacauaucacaaggagaa

SEQ ID NO: 629479 - RNA, 19 nt, Homo sapiens
gaaacagcuucuagauuug

SEQ ID NO: 629480 - RNA, 19 nt, Homo sapiens
ugaagauggugauagguua

SEQ ID NO: 629481 - RNA, 19 nt, Homo sapiens
acagcaagcuuaaaucauu

SEQ ID NO: 629482 - RNA, 19 nt, Homo sapiens
gcaauaugauuagcaagaa

SEQ ID NO: 629483 - RNA, 19 nt, Homo sapiens
uaauggaacucgccuauca

SEQ ID NO: 629484 - RNA, 19 nt, Homo sapiens
uaacagagaagaaguaugu

SEQ ID NO: 629485 - RNA, 19 nt, Homo sapiens
gcaagaacaagaaauauca

SEQ ID NO: 629486 - RNA, 19 nt, Homo sapiens
gcagcaaauuacagcaaua

SEQ ID NO: 629487 - RNA, 19 nt, Homo sapiens
cagaaaugcuugaaguuau

SEQ ID NO: 629488 - RNA, 19 nt, Homo sapiens
ggugaggugugcaauauga

SEQ ID NO: 629489 - RNA, 19 nt, Homo sapiens
uuaaauagcuccaucuucu

SEQ ID NO: 629490 - RNA, 19 nt, Homo sapiens
ggcagaagcugauuguaug

SEQ ID NO: 629491 - RNA, 19 nt, Homo sapiens
ggaaagagacucaguuguc

SEQ ID NO: 629492 - RNA, 19 nt, Homo sapiens
cuaaugaccucagaaauuc

SEQ ID NO: 629493 - RNA, 19 nt, Homo sapiens
gaaaucuaaugaccucaga

SEQ ID NO: 629494 - RNA, 19 nt, Homo sapiens
gaacucgccuaucagacuu

SEQ ID NO: 629495 - RNA, 19 nt, Homo sapiens
ucaaugugcuguucaacuu

SEQ ID NO: 629496 - RNA, 19 nt, Homo sapiens
caacaaauagcagcaaauu

SEQ ID NO: 629497 - RNA, 19 nt, Homo sapiens
aaucuuaccuacaaacuga

SEQ ID NO: 629498 - RNA, 19 nt, Homo sapiens
aagaagagguuccagucua

SEQ ID NO: 629499 - RNA, 19 nt, Homo sapiens
gcaaaacagugauggauga

SEQ ID NO: 629500 - RNA, 19 nt, Homo sapiens
gugagucugugaagaaauu

SEQ ID NO: 629501 - RNA, 19 nt, Homo sapiens
gauaaaugugccagaguua

SEQ ID NO: 629502 - RNA, 19 nt, Homo sapiens
caucaguucuguccucuug

SEQ ID NO: 629503 - RNA, 19 nt, Homo sapiens
uaaagagacuuggaauugu

SEQ ID NO: 629504 - RNA, 19 nt, Homo sapiens
guacgaggcuuuguuuaag

SEQ ID NO: 629505 - RNA, 19 nt, Homo sapiens
cauaauuacucccuuaaag

SEQ ID NO: 629506 - RNA, 19 nt, Homo sapiens
cuaaagagacuuggaauug

SEQ ID NO: 629507 - RNA, 19 nt, Homo sapiens
gaauauccaucaccaucug

SEQ ID NO: 629508 - RNA, 19 nt, Homo sapiens
agaaagcuaugucuugaau

SEQ ID NO: 629509 - RNA, 19 nt, Homo sapiens
aaauagcuccaucuucuua

SEQ ID NO: 629510 - RNA, 19 nt, Homo sapiens
gaaaaugcccuaaaggaaa

SEQ ID NO: 629511 - RNA, 19 nt, Homo sapiens
uagaagugcuccagaaaca

SEQ ID NO: 629512 - RNA, 19 nt, Homo sapiens
ccagcaguuuggaaucuua

SEQ ID NO: 629513 - RNA, 19 nt, Homo sapiens
ucugggagcuauauacauu

SEQ ID NO: 629514 - RNA, 19 nt, Homo sapiens
uuucaaauauggacgauga

SEQ ID NO: 629515 - RNA, 19 nt, Homo sapiens
gagucaggguagagaauuu

SEQ ID NO: 629516 - RNA, 19 nt, Homo sapiens
uggcauaauuacucccuua

SEQ ID NO: 629517 - RNA, 19 nt, Homo sapiens
gaggacauaucuacugaag

SEQ ID NO: 629518 - RNA, 19 nt, Homo sapiens
gaagauuauuccugauucu

SEQ ID NO: 629519 - RNA, 19 nt, Homo sapiens
caacuaaagagacuuggaa

SEQ ID NO: 629520 - RNA, 19 nt, Homo sapiens
gaacuucuggaaagauuau

SEQ ID NO: 629521 - RNA, 19 nt, Homo sapiens
ccacaugccguaucaguga

SEQ ID NO: 629522 - RNA, 19 nt, Homo sapiens
gaggugugcaauaugauua

SEQ ID NO: 629523 - RNA, 19 nt, Homo sapiens
gaucagacugguacuagaa

SEQ ID NO: 629524 - RNA, 19 nt, Homo sapiens
cagcauggagcucacaaua

SEQ ID NO: 629525 - RNA, 19 nt, Homo sapiens
acagaaaugcuugaaguua

SEQ ID NO: 629526 - RNA, 19 nt, Homo sapiens
ggagacuuccuguaauauu

SEQ ID NO: 629527 - RNA, 19 nt, Homo sapiens
caguacaucuuggaaguuu

SEQ ID NO: 629528 - RNA, 19 nt, Homo sapiens
guacugcaccaacuaaaga

SEQ ID NO: 629529 - RNA, 19 nt, Homo sapiens
cuggaaagauuaucaagug

SEQ ID NO: 629530 - RNA, 19 nt, Homo sapiens
gaaaggugaacuucuggaa

SEQ ID NO: 629531 - RNA, 19 nt, Homo sapiens
ucuaaugaccucagaaauu

SEQ ID NO: 629532 - RNA, 19 nt, Homo sapiens
uuaaacaguugcaggaguu

SEQ ID NO: 629533 - RNA, 19 nt, Homo sapiens
cguaucaaccggugaauuu

SEQ ID NO: 629534 - RNA, 19 nt, Homo sapiens
gcaagaaguacagugaauu

SEQ ID NO: 629535 - RNA, 19 nt, Homo sapiens
aaagagacuuggaauugug

SEQ ID NO: 629536 - RNA, 19 nt, Homo sapiens
gugaacuucuggaaagauu

SEQ ID NO: 629537 - RNA, 19 nt, Homo sapiens
cauaacacugugaagauua

SEQ ID NO: 629538 - RNA, 19 nt, Homo sapiens
ucauaacacugugaagauu

SEQ ID NO: 629539 - RNA, 19 nt, Homo sapiens
acaaauagcagcaaauuac

SEQ ID NO: 629540 - RNA, 19 nt, Homo sapiens
acacugaccuggaaaauga

SEQ ID NO: 629541 - RNA, 19 nt, Homo sapiens
cugcugaaguauauccuua

SEQ ID NO: 629542 - RNA, 19 nt, Homo sapiens
ugaaaucucucagcaugga

SEQ ID NO: 629543 - RNA, 19 nt, Homo sapiens
ccaguuggcugcuauucau

SEQ ID NO: 629544 - RNA, 19 nt, Homo sapiens
gaauaucuuccauuuguuc

SEQ ID NO: 629545 - RNA, 19 nt, Homo sapiens
caaguaaagcaccucaauu

SEQ ID NO: 629546 - RNA, 19 nt, Homo sapiens
agaagagguuccagucuau

SEQ ID NO: 629547 - RNA, 19 nt, Homo sapiens
agauaaaugugccagaguu

SEQ ID NO: 629548 - RNA, 19 nt, Homo sapiens
gaaauucauaacacuguga

SEQ ID NO: 629549 - RNA, 19 nt, Homo sapiens
guaaagcaccucaauucau

SEQ ID NO: 629550 - RNA, 19 nt, Homo sapiens
gaaauaucaagaagagguu

SEQ ID NO: 629551 - RNA, 19 nt, Homo sapiens
gcaccuuuaucugaagaaa

SEQ ID NO: 629552 - RNA, 19 nt, Homo sapiens
acauugaccugcugaaauc

SEQ ID NO: 629553 - RNA, 19 nt, Homo sapiens
gcacagaaaggugaacuuc

SEQ ID NO: 629554 - RNA, 19 nt, Homo sapiens
caaacuggaaguacagaaa

SEQ ID NO: 629555 - RNA, 19 nt, Homo sapiens
gaaagcuaugucuugaaua

SEQ ID NO: 629556 - RNA, 19 nt, Homo sapiens
caagaaguacagugaauuc

SEQ ID NO: 629557 - RNA, 19 nt, Homo sapiens
gcaacaaccaguagugauc

SEQ ID NO: 629558 - RNA, 19 nt, Homo sapiens
gaaagccagccuaacauag

SEQ ID NO: 629559 - RNA, 19 nt, Homo sapiens
gaaagcaagaacaagaaau

SEQ ID NO: 629560 - RNA, 19 nt, Homo sapiens
ugaagauuauuccugauuc

SEQ ID NO: 629561 - RNA, 19 nt, Homo sapiens
aaggagauacuacagauuu

SEQ ID NO: 629562 - RNA, 19 nt, Homo sapiens
aaacaucuacugucccauu

SEQ ID NO: 629563 - RNA, 19 nt, Homo sapiens
gaacuuagcuuggccuauu

SEQ ID NO: 629564 - RNA, 19 nt, Homo sapiens
caagcaggguuauguauua

SEQ ID NO: 629565 - RNA, 19 nt, Homo sapiens
gagcauaucuguguauuug

SEQ ID NO: 629566 - RNA, 19 nt, Homo sapiens
ugaaauggaugacacagaa

SEQ ID NO: 629567 - RNA, 19 nt, Homo sapiens
acaguagucugacguauuu

SEQ ID NO: 629568 - RNA, 19 nt, Homo sapiens
guauuaagcucuauugaag

SEQ ID NO: 629569 - RNA, 19 nt, Homo sapiens
ucacuugccuucaguaaug

SEQ ID NO: 629570 - RNA, 19 nt, Homo sapiens
ucugauggcuuuguaaaua

SEQ ID NO: 629571 - RNA, 19 nt, Homo sapiens
guaaugcacuaaagcagaa

SEQ ID NO: 629572 - RNA, 19 nt, Homo sapiens
ggaccuuuccugagauuua

SEQ ID NO: 629573 - RNA, 19 nt, Homo sapiens
uaagggauguguuagaguu

SEQ ID NO: 629574 - RNA, 19 nt, Homo sapiens
gaguggcaguugaguauuu

SEQ ID NO: 629575 - RNA, 19 nt, Homo sapiens
aaauguaugucucugagua

SEQ ID NO: 629576 - RNA, 19 nt, Homo sapiens
gaacccaucuuuugaaaug

SEQ ID NO: 629577 - RNA, 19 nt, Homo sapiens
ugagaugguuugaugguuu

SEQ ID NO: 629578 - RNA, 19 nt, Homo sapiens
uaucagauguguugaauac

SEQ ID NO: 629579 - RNA, 19 nt, Homo sapiens
gcauaucuguguauuugga

SEQ ID NO: 629580 - RNA, 19 nt, Homo sapiens
uuacuuaagugccauguug

SEQ ID NO: 629581 - RNA, 19 nt, Homo sapiens
guggaaacguugcuucuga

SEQ ID NO: 629582 - RNA, 19 nt, Homo sapiens
auaaacaccuucuuaagug

SEQ ID NO: 629583 - RNA, 19 nt, Homo sapiens
guaaugagcugagaaaaga

SEQ ID NO: 629584 - RNA, 19 nt, Homo sapiens
gagcagauuuacccaguca

SEQ ID NO: 629585 - RNA, 19 nt, Homo sapiens
gcaagugacugcaguuuug

SEQ ID NO: 629586 - RNA, 19 nt, Homo sapiens
gcccugagguacagaagaa

SEQ ID NO: 629587 - RNA, 19 nt, Homo sapiens
ggacugcgccuucuacgau

SEQ ID NO: 629588 - RNA, 19 nt, Homo sapiens
gaguaggacuuggaccuuu

SEQ ID NO: 629589 - RNA, 19 nt, Homo sapiens
gagaugguuugaugguuug

SEQ ID NO: 629590 - RNA, 19 nt, Homo sapiens
cuucaaaugucacagacua

SEQ ID NO: 629591 - RNA, 19 nt, Homo sapiens
gaacacugaucaagaaaau

SEQ ID NO: 629592 - RNA, 19 nt, Homo sapiens
aaacccaagucaccaugua

SEQ ID NO: 629593 - RNA, 19 nt, Homo sapiens
aggacuagaucaucaauug

SEQ ID NO: 629594 - RNA, 19 nt, Homo sapiens
ggaccuguuucuaucucua

SEQ ID NO: 629595 - RNA, 19 nt, Homo sapiens
ccagaagggcaaauuguuu

SEQ ID NO: 629596 - RNA, 19 nt, Homo sapiens
guauauacccucucagugu

SEQ ID NO: 629597 - RNA, 19 nt, Homo sapiens
ugaauacuguccagaagug

SEQ ID NO: 629598 - RNA, 19 nt, Homo sapiens
ugacagaugcagaaacaaa

SEQ ID NO: 629599 - RNA, 19 nt, Homo sapiens
ggaaucagcuaguuuucaa

SEQ ID NO: 629600 - RNA, 19 nt, Homo sapiens
gaaaccagggaaaauauua

SEQ ID NO: 629601 - RNA, 19 nt, Homo sapiens
cuaaaccuguuauuucugu

SEQ ID NO: 629602 - RNA, 19 nt, Homo sapiens
gguuauaguugcuaauucu

SEQ ID NO: 629603 - RNA, 19 nt, Homo sapiens
gguuauguauuaagcucua

SEQ ID NO: 629604 - RNA, 19 nt, Homo sapiens
agacaggcaucuauuugga

SEQ ID NO: 629605 - RNA, 19 nt, Homo sapiens
caaagcgagguuaagguua

SEQ ID NO: 629606 - RNA, 19 nt, Homo sapiens
acacagaacauccugaaga

SEQ ID NO: 629607 - RNA, 19 nt, Homo sapiens
aaacaagcaggguuaugua

SEQ ID NO: 629608 - RNA, 19 nt, Homo sapiens
caaacaagcaggguuaugu

SEQ ID NO: 629609 - RNA, 19 nt, Homo sapiens
ucagauguguugaauacug

SEQ ID NO: 629610 - RNA, 19 nt, Homo sapiens
guuagacucuugggaauca

SEQ ID NO: 629611 - RNA, 19 nt, Homo sapiens
guaaauauuugggauccau

SEQ ID NO: 629612 - RNA, 19 nt, Homo sapiens
gggaguccagccugaaaua

SEQ ID NO: 629613 - RNA, 19 nt, Homo sapiens
ggacuagaucaucaauuga

SEQ ID NO: 629614 - RNA, 19 nt, Homo sapiens
aaagcgagguuaagguuag

SEQ ID NO: 629615 - RNA, 19 nt, Homo sapiens
cccaaugguggauuuauua

SEQ ID NO: 629616 - RNA, 19 nt, Homo sapiens
cacagaacauccugaagau

SEQ ID NO: 629617 - RNA, 19 nt, Homo sapiens
gaccuuuccugagauuuau

SEQ ID NO: 629618 - RNA, 19 nt, Homo sapiens
gcuucagacugcuucauga

SEQ ID NO: 629619 - RNA, 19 nt, Homo sapiens
uaagugccauguugaugau

SEQ ID NO: 629620 - RNA, 19 nt, Homo sapiens
auaccagacucgcugcaua

SEQ ID NO: 629621 - RNA, 19 nt, Homo sapiens
uaaagcagaacacgaacuu

SEQ ID NO: 629622 - RNA, 19 nt, Homo sapiens
gguuaagguuagacucuug

SEQ ID NO: 629623 - RNA, 19 nt, Homo sapiens
ugcaugagaugguuugaug

SEQ ID NO: 629624 - RNA, 19 nt, Homo sapiens
caauagcgucaucauauau

SEQ ID NO: 629625 - RNA, 19 nt, Homo sapiens
gacuagaucaucaauugaa

SEQ ID NO: 629626 - RNA, 19 nt, Homo sapiens
guacaguagucugacguau

SEQ ID NO: 629627 - RNA, 19 nt, Homo sapiens
cuagguaguuccaaauagu

SEQ ID NO: 629628 - RNA, 19 nt, Homo sapiens
ucaauguaaugcacuaaag

SEQ ID NO: 629629 - RNA, 19 nt, Homo sapiens
gugagccauuuguuucuuu

SEQ ID NO: 629630 - RNA, 19 nt, Homo sapiens
ucccagaacuccuuguaau

SEQ ID NO: 629631 - RNA, 19 nt, Homo sapiens
guggaggacuagaucauca

SEQ ID NO: 629632 - RNA, 19 nt, Homo sapiens
gaucccagaacuccuugua

SEQ ID NO: 629633 - RNA, 19 nt, Homo sapiens
gaaguugggaucagacagu

SEQ ID NO: 629634 - RNA, 19 nt, Homo sapiens
gcagaaggaaaacuaauaa

SEQ ID NO: 629635 - RNA, 19 nt, Homo sapiens
uugaugguuugcugcauua

SEQ ID NO: 629636 - RNA, 19 nt, Homo sapiens
aaacuugucuauguaccuu

SEQ ID NO: 629637 - RNA, 19 nt, Homo sapiens
gcaucuauuuggaccuguu

SEQ ID NO: 629638 - RNA, 19 nt, Homo sapiens
cagcuaguuuucaaucuua

SEQ ID NO: 629639 - RNA, 19 nt, Homo sapiens
ccaagugacagaugcagaa

SEQ ID NO: 629640 - RNA, 19 nt, Homo sapiens
uaauaaacgagaugcagaa

SEQ ID NO: 629641 - RNA, 19 nt, Homo sapiens
cuaaucauccugugaaagu

SEQ ID NO: 629642 - RNA, 19 nt, Homo sapiens
gcagauuuacccagucaau

SEQ ID NO: 629643 - RNA, 19 nt, Homo sapiens
guacagaagaagaaguaug

SEQ ID NO: 629644 - RNA, 19 nt, Homo sapiens
aagcaggguuauguauuaa

SEQ ID NO: 629645 - RNA, 19 nt, Homo sapiens
gaucaucaauugaaaaugc

SEQ ID NO: 629646 - RNA, 19 nt, Homo sapiens
gagaaaagacagagcauau

SEQ ID NO: 629647 - RNA, 19 nt, Homo sapiens
ccucuuggccguccauuau

SEQ ID NO: 629648 - RNA, 19 nt, Homo sapiens
gagaaucaguuuugaccuu

SEQ ID NO: 629649 - RNA, 19 nt, Homo sapiens
ggauuucucuguuuucugu

SEQ ID NO: 629650 - RNA, 19 nt, Homo sapiens
gaccgguucuaacgaguuc

SEQ ID NO: 629651 - RNA, 19 nt, Homo sapiens
ccgcuggugauuaaaguua

SEQ ID NO: 629652 - RNA, 19 nt, Homo sapiens
ugaggagguuaaucuacaa

SEQ ID NO: 629653 - RNA, 19 nt, Homo sapiens
guuuugaccuugaugauuu

SEQ ID NO: 629654 - RNA, 19 nt, Homo sapiens
gcaggguuauguauuaagc

SEQ ID NO: 629655 - RNA, 19 nt, Homo sapiens
guugggaucagacaguuaa

SEQ ID NO: 629656 - RNA, 19 nt, Homo sapiens
cagauguguugaauacugu

SEQ ID NO: 629657 - RNA, 19 nt, Homo sapiens
acaaagcgagguuaagguu

SEQ ID NO: 629658 - RNA, 19 nt, Homo sapiens
ugcaugauuugaacacuga

SEQ ID NO: 629659 - RNA, 19 nt, Homo sapiens
cugauggcuuuguaaauau

SEQ ID NO: 629660 - RNA, 19 nt, Homo sapiens
guccagaagugaaugugau

SEQ ID NO: 629661 - RNA, 19 nt, Homo sapiens
acucuaaaccuguuauuuc

SEQ ID NO: 629662 - RNA, 19 nt, Homo sapiens
ugaacaguuugagcucuuu

SEQ ID NO: 629663 - RNA, 19 nt, Homo sapiens
caaaugggacugucaauua

SEQ ID NO: 629664 - RNA, 19 nt, Homo sapiens
gacccaagcucuuucauuu

SEQ ID NO: 629665 - RNA, 19 nt, Homo sapiens
ccagaacucuccuauauau

SEQ ID NO: 629666 - RNA, 19 nt, Homo sapiens
gaagacaucuguuaaagac

SEQ ID NO: 629667 - RNA, 19 nt, Homo sapiens
aaagaaugauggugagaua

SEQ ID NO: 629668 - RNA, 19 nt, Homo sapiens
gaagaacggcuacccauug

SEQ ID NO: 629669 - RNA, 19 nt, Homo sapiens
gacgaacccuggaggauaa

SEQ ID NO: 629670 - RNA, 19 nt, Homo sapiens
ucaaggagguucaucaaga

SEQ ID NO: 629671 - RNA, 19 nt, Homo sapiens
aaagaaggauguacuguau

SEQ ID NO: 629672 - RNA, 19 nt, Homo sapiens
caaagcggguugguuauuu

SEQ ID NO: 629673 - RNA, 19 nt, Homo sapiens
guacggauagagaguauua

SEQ ID NO: 629674 - RNA, 19 nt, Homo sapiens
ggauagagaguauuaaaug

SEQ ID NO: 629675 - RNA, 19 nt, Homo sapiens
gugcaaagcggguugguua

SEQ ID NO: 629676 - RNA, 19 nt, Homo sapiens
gagaagacaucuguuaaag

SEQ ID NO: 629677 - RNA, 19 nt, Homo sapiens
ucaacaaccucgugacuug

SEQ ID NO: 629678 - RNA, 19 nt, Homo sapiens
caaggagguucaucaagaa

SEQ ID NO: 629679 - RNA, 19 nt, Homo sapiens
gaaaguaguccagcaaaga

SEQ ID NO: 629680 - RNA, 19 nt, Homo sapiens
ggagaagacaucuguuaaa

SEQ ID NO: 629681 - RNA, 19 nt, Homo sapiens
caaagaaggauguacugua

SEQ ID NO: 629682 - RNA, 19 nt, Homo sapiens
agagggaacuacaggauaa

SEQ ID NO: 629683 - RNA, 19 nt, Homo sapiens
gaacgaauugcauuggaaa

SEQ ID NO: 629684 - RNA, 19 nt, Homo sapiens
gaagaaggccauucaaacu

SEQ ID NO: 629685 - RNA, 19 nt, Homo sapiens
gaacagcgcgaguacuaug

SEQ ID NO: 629686 - RNA, 19 nt, Homo sapiens
gaauggacgaugaggauaa

SEQ ID NO: 629687 - RNA, 19 nt, Homo sapiens
uuacauugcccugaaauua

SEQ ID NO: 629688 - RNA, 19 nt, Homo sapiens
agaaggauguacuguauuc

SEQ ID NO: 629689 - RNA, 19 nt, Homo sapiens
aaaugggacugucaauuau

SEQ ID NO: 629690 - RNA, 19 nt, Homo sapiens
gagcagcgcagaacagaug

SEQ ID NO: 629691 - RNA, 19 nt, Homo sapiens
uuccagaacucuccuauau

SEQ ID NO: 629692 - RNA, 19 nt, Homo sapiens
gagagggaacuacaggaua

SEQ ID NO: 629693 - RNA, 19 nt, Homo sapiens
gcaaagcggguugguuauu

SEQ ID NO: 629694 - RNA, 19 nt, Homo sapiens
gaacuucuucaccaaauca

SEQ ID NO: 629695 - RNA, 19 nt, Homo sapiens
gcaucaggcuucccuuauc

SEQ ID NO: 629696 - RNA, 19 nt, Homo sapiens
ggaagaacggcuacccauu

SEQ ID NO: 629697 - RNA, 19 nt, Homo sapiens
aaucaaagcuuuccauucc

SEQ ID NO: 629698 - RNA, 19 nt, Homo sapiens
uaccaagucaggauuguua

SEQ ID NO: 629699 - RNA, 19 nt, Homo sapiens
caaugaagccuuaccaaag

SEQ ID NO: 629700 - RNA, 19 nt, Homo sapiens
ccaacuacuugucauagau

SEQ ID NO: 629701 - RNA, 19 nt, Homo sapiens
gaacccaacuacuugucau

SEQ ID NO: 629702 - RNA, 19 nt, Homo sapiens
ucaaacugcuauccgcaaa

SEQ ID NO: 629703 - RNA, 19 nt, Homo sapiens
cgacgaacccuggaggaua

SEQ ID NO: 629704 - RNA, 19 nt, Homo sapiens
cauagaagaggccaugaaa

SEQ ID NO: 629705 - RNA, 19 nt, Homo sapiens
ugaguucugugcugcguuu

SEQ ID NO: 629706 - RNA, 19 nt, Homo sapiens
cccaagcucuuucauuuca

SEQ ID NO: 629707 - RNA, 19 nt, Homo sapiens
gguucagauuccauauuua

SEQ ID NO: 629708 - RNA, 19 nt, Homo sapiens
cagaagaaggccauucaaa

SEQ ID NO: 629709 - RNA, 19 nt, Homo sapiens
gcagaaaguaguccagcaa

SEQ ID NO: 629710 - RNA, 19 nt, Homo sapiens
ucaaugaagccuuaccaaa

SEQ ID NO: 629711 - RNA, 19 nt, Homo sapiens
uacuaucaaugaagccuua

SEQ ID NO: 629712 - RNA, 19 nt, Homo sapiens
caaaucaaagcuuuccauu

SEQ ID NO: 629713 - RNA, 19 nt, Homo sapiens
gaggauaaacagcaggaaa

SEQ ID NO: 629714 - RNA, 19 nt, Homo sapiens
uaaccaggauguaacuagu

SEQ ID NO: 629715 - RNA, 19 nt, Homo sapiens
aagaacagcgcgaguacua

SEQ ID NO: 629716 - RNA, 19 nt, Homo sapiens
agguucagauuccauauuu

SEQ ID NO: 629717 - RNA, 19 nt, Homo sapiens
uggcucggcugaacaguga

SEQ ID NO: 629718 - RNA, 19 nt, Homo sapiens
ccuuggaucugaauaaagu

SEQ ID NO: 629719 - RNA, 19 nt, Homo sapiens
cagcaacucccaaggauuc

SEQ ID NO: 629720 - RNA, 19 nt, Homo sapiens
ggauguaacuagugaugac

SEQ ID NO: 629721 - RNA, 19 nt, Homo sapiens
agacaucuguuaaagacau

SEQ ID NO: 629722 - RNA, 19 nt, Homo sapiens
uacauugcccugaaauuaa

SEQ ID NO: 629723 - RNA, 19 nt, Homo sapiens
agaacgaauugcauuggaa

SEQ ID NO: 629724 - RNA, 19 nt, Homo sapiens
caaagcccauucguaggaa

SEQ ID NO: 629725 - RNA, 19 nt, Homo sapiens
ucaaagcccauucguagga

SEQ ID NO: 629726 - RNA, 19 nt, Homo sapiens
cagaagaacagcgcgagua

SEQ ID NO: 629727 - RNA, 19 nt, Homo sapiens
ucaaaagaauggacgauga

SEQ ID NO: 629728 - RNA, 19 nt, Homo sapiens
gaaugauggugagauacga

SEQ ID NO: 629729 - RNA, 19 nt, Homo sapiens
ggacgugucugaggaucca

SEQ ID NO: 629730 - RNA, 19 nt, Homo sapiens
ccaaaugggacugucaauu

SEQ ID NO: 629731 - RNA, 19 nt, Homo sapiens
acauugcccugaaauuaau

SEQ ID NO: 629732 - RNA, 19 nt, Homo sapiens
gaggauaacagaagaacag

SEQ ID NO: 629733 - RNA, 19 nt, Homo sapiens
ccgagacgcugcaccagau

SEQ ID NO: 629734 - RNA, 19 nt, Homo sapiens
ggaucugaauaaagucuuc

SEQ ID NO: 629735 - RNA, 19 nt, Homo sapiens
ggagagggaacuacaggau

SEQ ID NO: 629736 - RNA, 19 nt, Homo sapiens
gcaaagaaggauguacugu

SEQ ID NO: 629737 - RNA, 19 nt, Homo sapiens
aaaguaguccagcaaagaa

SEQ ID NO: 629738 - RNA, 19 nt, Homo sapiens
cauagauguuugacugugu

SEQ ID NO: 629739 - RNA, 19 nt, Homo sapiens
gcuuagugaugcugacugu

SEQ ID NO: 629740 - RNA, 19 nt, Homo sapiens
cuacuugucauagauguuu

SEQ ID NO: 629741 - RNA, 19 nt, Homo sapiens
gcucaaggagguucaucaa

SEQ ID NO: 629742 - RNA, 19 nt, Homo sapiens
uaccaaaggacgugucuga

SEQ ID NO: 629743 - RNA, 19 nt, Homo sapiens
uaacuagugaugacaaaca

SEQ ID NO: 629744 - RNA, 19 nt, Homo sapiens
ucucaaagcaagaccaaga

SEQ ID NO: 629745 - RNA, 19 nt, Homo sapiens
agacauggcugaccuuccu

SEQ ID NO: 629746 - RNA, 19 nt, Homo sapiens
gcauccagcaccuuaugaa

SEQ ID NO: 629747 - RNA, 19 nt, Homo sapiens
caacuacuugucauagaug

SEQ ID NO: 629748 - RNA, 19 nt, Homo sapiens
gauggugagauacgauuug

SEQ ID NO: 629749 - RNA, 19 nt, Homo sapiens
ucaagaacgaauugcauug

SEQ ID NO: 629750 - RNA, 19 nt, Homo sapiens
uggagaagacaucuguuaa

SEQ ID NO: 629751 - RNA, 19 nt, Homo sapiens
augggacugucaauuauuu

SEQ ID NO: 629752 - RNA, 19 nt, Homo sapiens
cugccucgcuuuaugaugu

SEQ ID NO: 629753 - RNA, 19 nt, Homo sapiens
aguacuaugucaaucaguu

SEQ ID NO: 629754 - RNA, 19 nt, Homo sapiens
gcgaguacuaugucaauca

SEQ ID NO: 629755 - RNA, 19 nt, Homo sapiens
gaaaaccaagcuacagaaa

SEQ ID NO: 629756 - RNA, 19 nt, Homo sapiens
gcaagaccaagauccagau

SEQ ID NO: 629757 - RNA, 19 nt, Homo sapiens
uguaacuagugaugacaaa

SEQ ID NO: 629758 - RNA, 19 nt, Homo sapiens
cuaagguucagauuccaua

SEQ ID NO: 629759 - RNA, 19 nt, Homo sapiens
cugagucacugccggcaaa

SEQ ID NO: 629760 - RNA, 19 nt, Homo sapiens
gcaggcagcuuuuccuaag

SEQ ID NO: 629761 - RNA, 19 nt, Homo sapiens
caugaaaccgcauccaaca

SEQ ID NO: 629762 - RNA, 19 nt, Homo sapiens
agaaaguaguccagcaaag

SEQ ID NO: 629763 - RNA, 19 nt, Homo sapiens
gaaaccaacucucuuaaga

SEQ ID NO: 629764 - RNA, 19 nt, Homo sapiens
ggacggaugugauaugaaa

SEQ ID NO: 629765 - RNA, 19 nt, Homo sapiens
gaagggaagucauucuaaa

SEQ ID NO: 629766 - RNA, 19 nt, Homo sapiens
guuagaagaucgaaucaua

SEQ ID NO: 629767 - RNA, 19 nt, Homo sapiens
guagaacacugacuuacua

SEQ ID NO: 629768 - RNA, 19 nt, Homo sapiens
caacaacaaccaagaauaa

SEQ ID NO: 629769 - RNA, 19 nt, Homo sapiens
ggauagccauguucucaua

SEQ ID NO: 629770 - RNA, 19 nt, Homo sapiens
cagaguagccuccaucuua

SEQ ID NO: 629771 - RNA, 19 nt, Homo sapiens
gaaagacagugacauuaca

SEQ ID NO: 629772 - RNA, 19 nt, Homo sapiens
gaagagaugaugaugauga

SEQ ID NO: 629773 - RNA, 19 nt, Homo sapiens
ggaauuugaugaguuugua

SEQ ID NO: 629774 - RNA, 19 nt, Homo sapiens
ccagaagaguggaaaguaa

SEQ ID NO: 629775 - RNA, 19 nt, Homo sapiens
guaaaggacacuugaguuu

SEQ ID NO: 629776 - RNA, 19 nt, Homo sapiens
cgccacaucugguuuauaa

SEQ ID NO: 629777 - RNA, 19 nt, Homo sapiens
uaaaggaggacuacauuaa

SEQ ID NO: 629778 - RNA, 19 nt, Homo sapiens
caauagggauuucugaaga

SEQ ID NO: 629779 - RNA, 19 nt, Homo sapiens
ugagaaagguguagaagau

SEQ ID NO: 629780 - RNA, 19 nt, Homo sapiens
gggcaaagcugaccaugca

SEQ ID NO: 629781 - RNA, 19 nt, Homo sapiens
ggaaagagcaacccgaaga

SEQ ID NO: 629782 - RNA, 19 nt, Homo sapiens
ucacaauguuccuccuuua

SEQ ID NO: 629783 - RNA, 19 nt, Homo sapiens
uggaugagcuacaggauaa

SEQ ID NO: 629784 - RNA, 19 nt, Homo sapiens
gcuaagguguuccaaguau

SEQ ID NO: 629785 - RNA, 19 nt, Homo sapiens
gaucugagacuaaaguuug

SEQ ID NO: 629786 - RNA, 19 nt, Homo sapiens
cagcagcaauggcuuguuu

SEQ ID NO: 629787 - RNA, 19 nt, Homo sapiens
gaaagguaaugaaggugaa

SEQ ID NO: 629788 - RNA, 19 nt, Homo sapiens
gauauuggauucugacaag

SEQ ID NO: 629789 - RNA, 19 nt, Homo sapiens
uuacaaacaugaggaauga

SEQ ID NO: 629790 - RNA, 19 nt, Homo sapiens
uaauaucacuggcuucaga

SEQ ID NO: 629791 - RNA, 19 nt, Homo sapiens
ccagguuggugaaacaaua

SEQ ID NO: 629792 - RNA, 19 nt, Homo sapiens
ggcagaagcaggccauuua

SEQ ID NO: 629793 - RNA, 19 nt, Homo sapiens
gcaugacaguggagaauau

SEQ ID NO: 629794 - RNA, 19 nt, Homo sapiens
caaccugaaucccagagua

SEQ ID NO: 629795 - RNA, 19 nt, Homo sapiens
cuacauccuugaccugaua

SEQ ID NO: 629796 - RNA, 19 nt, Homo sapiens
gugaagagaugaugaugau

SEQ ID NO: 629797 - RNA, 19 nt, Homo sapiens
ggaaacaccugcagcucau

SEQ ID NO: 629798 - RNA, 19 nt, Homo sapiens
gcaggagucuaggaaguuu

SEQ ID NO: 629799 - RNA, 19 nt, Homo sapiens
guagaagaguaggcacuua

SEQ ID NO: 629800 - RNA, 19 nt, Homo sapiens
caagguggcuaguguaaag

SEQ ID NO: 629801 - RNA, 19 nt, Homo sapiens
ggcaguaacauauuugaua

SEQ ID NO: 629802 - RNA, 19 nt, Homo sapiens
agaagaaugugaagaugaa

SEQ ID NO: 629803 - RNA, 19 nt, Homo sapiens
gggcgaaacugcuggugaa

SEQ ID NO: 629804 - RNA, 19 nt, Homo sapiens
ggaagggaagucauucuaa

SEQ ID NO: 629805 - RNA, 19 nt, Homo sapiens
uaaugaaggugaaacugaa

SEQ ID NO: 629806 - RNA, 19 nt, Homo sapiens
gaaaugaaagguaaugaag

SEQ ID NO: 629807 - RNA, 19 nt, Homo sapiens
ccucaucggugucuucauu

SEQ ID NO: 629808 - RNA, 19 nt, Homo sapiens
caaguuaagggacacguua

SEQ ID NO: 629809 - RNA, 19 nt, Homo sapiens
ucaauugcgucauguaaau

SEQ ID NO: 629810 - RNA, 19 nt, Homo sapiens
ggagaagaaugugaagaug

SEQ ID NO: 629811 - RNA, 19 nt, Homo sapiens
gaagcaacacugagcauga

SEQ ID NO: 629812 - RNA, 19 nt, Homo sapiens
ccuaggaccucugauauga

SEQ ID NO: 629813 - RNA, 19 nt, Homo sapiens
gcaaacgucuugacuucuc

SEQ ID NO: 629814 - RNA, 19 nt, Homo sapiens
ggaagucauucuaaagagu

SEQ ID NO: 629815 - RNA, 19 nt, Homo sapiens
aggacuacauuaacucuua

SEQ ID NO: 629816 - RNA, 19 nt, Homo sapiens
gaaguuacuguaucucuug

SEQ ID NO: 629817 - RNA, 19 nt, Homo sapiens
ggacuacauuaacucuuau

SEQ ID NO: 629818 - RNA, 19 nt, Homo sapiens
guaaugaaggugaaacuga

SEQ ID NO: 629819 - RNA, 19 nt, Homo sapiens
gagaagaaugugaagauga

SEQ ID NO: 629820 - RNA, 19 nt, Homo sapiens
ccaaggagcgucauggaaa

SEQ ID NO: 629821 - RNA, 19 nt, Homo sapiens
agaagauggugaaaugaaa

SEQ ID NO: 629822 - RNA, 19 nt, Homo sapiens
uaaaguuuguccuuggaaa

SEQ ID NO: 629823 - RNA, 19 nt, Homo sapiens
uuugugaucucuucaauug

SEQ ID NO: 629824 - RNA, 19 nt, Homo sapiens
caaccacucucaagggaau

SEQ ID NO: 629825 - RNA, 19 nt, Homo sapiens
gaaacaagccaugcgauca

SEQ ID NO: 629826 - RNA, 19 nt, Homo sapiens
ggccaaagcagaaagcaaa

SEQ ID NO: 629827 - RNA, 19 nt, Homo sapiens
aagcaaacgucuugacuuc

SEQ ID NO: 629828 - RNA, 19 nt, Homo sapiens
aaaccuagcuccgaaaugg

SEQ ID NO: 629829 - RNA, 19 nt, Homo sapiens
gcagcagucucuucucauc

SEQ ID NO: 629830 - RNA, 19 nt, Homo sapiens
gggcagcagucucuucuca

SEQ ID NO: 629831 - RNA, 19 nt, Homo sapiens
gaaugugaucugagacuaa

SEQ ID NO: 629832 - RNA, 19 nt, Homo sapiens
aaucauauccuguccugua

SEQ ID NO: 629833 - RNA, 19 nt, Homo sapiens
cgcagaagauggugaaaug

SEQ ID NO: 629834 - RNA, 19 nt, Homo sapiens
gcagaaagcaaaccagaag

SEQ ID NO: 629835 - RNA, 19 nt, Homo sapiens
agaagaccaugcagaaguu

SEQ ID NO: 629836 - RNA, 19 nt, Homo sapiens
gguagaagcaaacgucuug

SEQ ID NO: 629837 - RNA, 19 nt, Homo sapiens
ucaagcagacaaauaguaa

SEQ ID NO: 629838 - RNA, 19 nt, Homo sapiens
gauuauaaagcaagacuga

SEQ ID NO: 629839 - RNA, 19 nt, Homo sapiens
cacugcaucuggauauaua

SEQ ID NO: 629840 - RNA, 19 nt, Homo sapiens
ccaaacacacgcugcaauu

SEQ ID NO: 629841 - RNA, 19 nt, Homo sapiens
caaugaaggugaagaugag

SEQ ID NO: 629842 - RNA, 19 nt, Homo sapiens
caaaacagccccagccaua

SEQ ID NO: 629843 - RNA, 19 nt, Homo sapiens
gaagcaaacgucuugacuu

SEQ ID NO: 629844 - RNA, 19 nt, Homo sapiens
ccaacaacaaccaagaaua

SEQ ID NO: 629845 - RNA, 19 nt, Homo sapiens
ccaggauucucauucuuug

SEQ ID NO: 629846 - RNA, 19 nt, Homo sapiens
caauguuccuccuuuacuu

SEQ ID NO: 629847 - RNA, 19 nt, Homo sapiens
gaaggcaggagucuaggaa

SEQ ID NO: 629848 - RNA, 19 nt, Homo sapiens
gacauuacagcaaccuaua

SEQ ID NO: 629849 - RNA, 19 nt, Homo sapiens
aaugagaggccuucuguaa

SEQ ID NO: 629850 - RNA, 19 nt, Homo sapiens
caagaaugcauaacacaau

SEQ ID NO: 629851 - RNA, 19 nt, Homo sapiens
ccaaagugcugggauuaca

SEQ ID NO: 629852 - RNA, 19 nt, Homo sapiens
guaaauggagaaugaacaa

SEQ ID NO: 629853 - RNA, 19 nt, Homo sapiens
cgaaacugcuggugaaggu

SEQ ID NO: 629854 - RNA, 19 nt, Homo sapiens
cacaugagguagaagcaaa

SEQ ID NO: 629855 - RNA, 19 nt, Homo sapiens
gugaaagacagugacauua

SEQ ID NO: 629856 - RNA, 19 nt, Homo sapiens
gggaaaaggugaaguauac

SEQ ID NO: 629857 - RNA, 19 nt, Homo sapiens
uguaaucacuguagcuuca

SEQ ID NO: 629858 - RNA, 19 nt, Homo sapiens
gcagcaggcacaucaauuc

SEQ ID NO: 629859 - RNA, 19 nt, Homo sapiens
gaaacugaaacacaaggaa

SEQ ID NO: 629860 - RNA, 19 nt, Homo sapiens
ugaccuaggaccucugaua

SEQ ID NO: 629861 - RNA, 19 nt, Homo sapiens
caaugggcauggaucagaa

SEQ ID NO: 629862 - RNA, 19 nt, Homo sapiens
caacauucucuuugucauu

SEQ ID NO: 629863 - RNA, 19 nt, Homo sapiens
ggaagaauaucaguuagua

SEQ ID NO: 629864 - RNA, 19 nt, Homo sapiens
gcaaagacauuccaucaug

SEQ ID NO: 629865 - RNA, 19 nt, Homo sapiens
ggaauuaaguucaaacgaa

SEQ ID NO: 629866 - RNA, 19 nt, Homo sapiens
ggaaauaccuguggaacaa

SEQ ID NO: 629867 - RNA, 19 nt, Homo sapiens
ccaagaagaugaagaaaga

SEQ ID NO: 629868 - RNA, 19 nt, Homo sapiens
gaaagauucugaagacaau

SEQ ID NO: 629869 - RNA, 19 nt, Homo sapiens
ggagugaccuuccuauuuc

SEQ ID NO: 629870 - RNA, 19 nt, Homo sapiens
caagagaguuggcaaauca

SEQ ID NO: 629871 - RNA, 19 nt, Homo sapiens
gauaaauggugcuuaaaug

SEQ ID NO: 629872 - RNA, 19 nt, Homo sapiens
uaaguaggcuggauaaaug

SEQ ID NO: 629873 - RNA, 19 nt, Homo sapiens
aaacuaaucuggguuguaa

SEQ ID NO: 629874 - RNA, 19 nt, Homo sapiens
cagacaagcuucauuuaaa

SEQ ID NO: 629875 - RNA, 19 nt, Homo sapiens
caaggaagaauaucaguua

SEQ ID NO: 629876 - RNA, 19 nt, Homo sapiens
caaacuagaucucaccaaa

SEQ ID NO: 629877 - RNA, 19 nt, Homo sapiens
gaguucaccugucuuuaua

SEQ ID NO: 629878 - RNA, 19 nt, Homo sapiens
ugauaagacugaagagaua

SEQ ID NO: 629879 - RNA, 19 nt, Homo sapiens
uaacagaaauacaggagaa

SEQ ID NO: 629880 - RNA, 19 nt, Homo sapiens
gaaaucacccugaaagguu

SEQ ID NO: 629881 - RNA, 19 nt, Homo sapiens
gaccagcgcuccuugauca

SEQ ID NO: 629882 - RNA, 19 nt, Homo sapiens
ggaaaugaauggagaaacu

SEQ ID NO: 629883 - RNA, 19 nt, Homo sapiens
gugcuuaaaugguaaugua

SEQ ID NO: 629884 - RNA, 19 nt, Homo sapiens
guaaagcauuuggucaaua

SEQ ID NO: 629885 - RNA, 19 nt, Homo sapiens
ggagauugauuccaaagug

SEQ ID NO: 629886 - RNA, 19 nt, Homo sapiens
gggaagacauucuccuuug

SEQ ID NO: 629887 - RNA, 19 nt, Homo sapiens
gaagauguaguauguuuga

SEQ ID NO: 629888 - RNA, 19 nt, Homo sapiens
auacaaagcucuccaccaa

SEQ ID NO: 629889 - RNA, 19 nt, Homo sapiens
gaaggcgcuuucucuaauu

SEQ ID NO: 629890 - RNA, 19 nt, Homo sapiens
uaaggugauucaugcuuua

SEQ ID NO: 629891 - RNA, 19 nt, Homo sapiens
gagauugauuccaaaguga

SEQ ID NO: 629892 - RNA, 19 nt, Homo sapiens
gcgaggagauugauuccaa

SEQ ID NO: 629893 - RNA, 19 nt, Homo sapiens
ugacaugaauucuccuaaa

SEQ ID NO: 629894 - RNA, 19 nt, Homo sapiens
agaaugauguuuggcaaua

SEQ ID NO: 629895 - RNA, 19 nt, Homo sapiens
caggagaaauggcaugauu

SEQ ID NO: 629896 - RNA, 19 nt, Homo sapiens
uguauaagguggcuccaua

SEQ ID NO: 629897 - RNA, 19 nt, Homo sapiens
gaagcggaguuucaguaaa

SEQ ID NO: 629898 - RNA, 19 nt, Homo sapiens
ucaccaaacuuaagcaugu

SEQ ID NO: 629899 - RNA, 19 nt, Homo sapiens
gacaugaauucuccuaaau

SEQ ID NO: 629900 - RNA, 19 nt, Homo sapiens
cagcagcacuggcccauau

SEQ ID NO: 629901 - RNA, 19 nt, Homo sapiens
guacuccacuucuuccuau

SEQ ID NO: 629902 - RNA, 19 nt, Homo sapiens
aaauggugcuuaaauggua

SEQ ID NO: 629903 - RNA, 19 nt, Homo sapiens
uggaagauguaguauguuu

SEQ ID NO: 629904 - RNA, 19 nt, Homo sapiens
gggauuugcugaucaagug

SEQ ID NO: 629905 - RNA, 19 nt, Homo sapiens
gaaaguaacagugagauag

SEQ ID NO: 629906 - RNA, 19 nt, Homo sapiens
gaaagcaaaccgaggagaa

SEQ ID NO: 629907 - RNA, 19 nt, Homo sapiens
gauguaguauguuugaugu

SEQ ID NO: 629908 - RNA, 19 nt, Homo sapiens
ucaaaagugucccuuaaua

SEQ ID NO: 629909 - RNA, 19 nt, Homo sapiens
agaaauagaugcuccuaag

SEQ ID NO: 629910 - RNA, 19 nt, Homo sapiens
guaccuaccgcaucaguaa

SEQ ID NO: 629911 - RNA, 19 nt, Homo sapiens
uggagcaucuggcuauuaa

SEQ ID NO: 629912 - RNA, 19 nt, Homo sapiens
cuagaucucaccaaacuua

SEQ ID NO: 629913 - RNA, 19 nt, Homo sapiens
gaagaaaguaacagugaga

SEQ ID NO: 629914 - RNA, 19 nt, Homo sapiens
gagaaaagccccaaacuga

SEQ ID NO: 629915 - RNA, 19 nt, Homo sapiens
gaaaugaauggagaaacua

SEQ ID NO: 629916 - RNA, 19 nt, Homo sapiens
guaauguacuccacuucuu

SEQ ID NO: 629917 - RNA, 19 nt, Homo sapiens
ccaagucccugucucuuuc

SEQ ID NO: 629918 - RNA, 19 nt, Homo sapiens
gauguuggauaugggauuu

SEQ ID NO: 629919 - RNA, 19 nt, Homo sapiens
ucaaagaccacauacagaa

SEQ ID NO: 629920 - RNA, 19 nt, Homo sapiens
ccuauuauuugucuacuga

SEQ ID NO: 629921 - RNA, 19 nt, Homo sapiens
gccaagaaauacaugaaau

SEQ ID NO: 629922 - RNA, 19 nt, Homo sapiens
caaaucaaguaagcaaaga

SEQ ID NO: 629923 - RNA, 19 nt, Homo sapiens
ugagauagagcaggaaaua

SEQ ID NO: 629924 - RNA, 19 nt, Homo sapiens
ggauaaauggugcuuaaau

SEQ ID NO: 629925 - RNA, 19 nt, Homo sapiens
ucaccugucuuuauacuca

SEQ ID NO: 629926 - RNA, 19 nt, Homo sapiens
gaguuucaguaaagcauuu

SEQ ID NO: 629927 - RNA, 19 nt, Homo sapiens
ggagaaauggcaugauuca

SEQ ID NO: 629928 - RNA, 19 nt, Homo sapiens
uggagaaacuagagagaaa

SEQ ID NO: 629929 - RNA, 19 nt, Homo sapiens
guaaguaggcuggauaaau

SEQ ID NO: 629930 - RNA, 19 nt, Homo sapiens
gaauaucaguuaguacaag

SEQ ID NO: 629931 - RNA, 19 nt, Homo sapiens
gaaugauguuuggcaauau

SEQ ID NO: 629932 - RNA, 19 nt, Homo sapiens
uaacagaucccaaaacaaa

SEQ ID NO: 629933 - RNA, 19 nt, Homo sapiens
acacagacaagcuucauuu

SEQ ID NO: 629934 - RNA, 19 nt, Homo sapiens
ggacggaaacagaagauuc

SEQ ID NO: 629935 - RNA, 19 nt, Homo sapiens
acaaagcucuccaccaaag

SEQ ID NO: 629936 - RNA, 19 nt, Homo sapiens
gauaugggauuugcugauc

SEQ ID NO: 629937 - RNA, 19 nt, Homo sapiens
gaccagauguuggauaugg

SEQ ID NO: 629938 - RNA, 19 nt, Homo sapiens
cauacagaauggcaaacua

SEQ ID NO: 629939 - RNA, 19 nt, Homo sapiens
gcaaagacuucagugacau

SEQ ID NO: 629940 - RNA, 19 nt, Homo sapiens
gcacaggcacggacaggaa

SEQ ID NO: 629941 - RNA, 19 nt, Homo sapiens
guccuucccugaaauaaau

SEQ ID NO: 629942 - RNA, 19 nt, Homo sapiens
aauaaaagcuuccagcaaa

SEQ ID NO: 629943 - RNA, 19 nt, Homo sapiens
cuggauaaauggugcuuaa

SEQ ID NO: 629944 - RNA, 19 nt, Homo sapiens
uggauuaccuauacuuaug

SEQ ID NO: 629945 - RNA, 19 nt, Homo sapiens
gcucuagacuuggaagaug

SEQ ID NO: 629946 - RNA, 19 nt, Homo sapiens
cccaggagcugucccagaa

SEQ ID NO: 629947 - RNA, 19 nt, Homo sapiens
ugaggagccuucugaggaa

SEQ ID NO: 629948 - RNA, 19 nt, Homo sapiens
gaauucuccuaaauccaaa

SEQ ID NO: 629949 - RNA, 19 nt, Homo sapiens
aaggaaagcuggguguuug

SEQ ID NO: 629950 - RNA, 19 nt, Homo sapiens
uugcagugcucaauugaaa

SEQ ID NO: 629951 - RNA, 19 nt, Homo sapiens
ugagguugauuugguuaua

SEQ ID NO: 629952 - RNA, 19 nt, Homo sapiens
caggagcugucccagaauu

SEQ ID NO: 629953 - RNA, 19 nt, Homo sapiens
caucaaggacgcacuauca

SEQ ID NO: 629954 - RNA, 19 nt, Homo sapiens
agagauagcagaagaggaa

SEQ ID NO: 629955 - RNA, 19 nt, Homo sapiens
cagugaagcugccagugaa

SEQ ID NO: 629956 - RNA, 19 nt, Homo sapiens
aagaauggauuuccucauc

SEQ ID NO: 629957 - RNA, 19 nt, Homo sapiens
cugaagagauagcagaaga

SEQ ID NO: 629958 - RNA, 19 nt, Homo sapiens
gcaaaucaaguaagcaaag

SEQ ID NO: 629959 - RNA, 19 nt, Homo sapiens
gaagaaauagaugcuccua

SEQ ID NO: 629960 - RNA, 19 nt, Homo sapiens
gaaagaggagccaucucaa

SEQ ID NO: 629961 - RNA, 19 nt, Homo sapiens
ggaaucagacaccgcaaug

SEQ ID NO: 629962 - RNA, 19 nt, Homo sapiens
cuuggaagauguaguaugu

SEQ ID NO: 629963 - RNA, 19 nt, Homo sapiens
gagaagcaauggagaauaa

SEQ ID NO: 629964 - RNA, 19 nt, Homo sapiens
gaggaagcguguugucuua

SEQ ID NO: 629965 - RNA, 19 nt, Homo sapiens
ggaaaggacucuugauucu

SEQ ID NO: 629966 - RNA, 19 nt, Homo sapiens
ccaaggugcugcagaagua

SEQ ID NO: 629967 - RNA, 19 nt, Homo sapiens
ggaaguacaucucuaccaa

SEQ ID NO: 629968 - RNA, 19 nt, Homo sapiens
gcacagaauguuauccuua

SEQ ID NO: 629969 - RNA, 19 nt, Homo sapiens
ggaaagagauucgagaagu

SEQ ID NO: 629970 - RNA, 19 nt, Homo sapiens
gaaagagauucgagaagug

SEQ ID NO: 629971 - RNA, 19 nt, Homo sapiens
ccagaucacugaauucaug

SEQ ID NO: 629972 - RNA, 19 nt, Homo sapiens
ccaaggagcuuuccaagac

SEQ ID NO: 629973 - RNA, 19 nt, Homo sapiens
gcaaacugguggaguacuu

SEQ ID NO: 629974 - RNA, 19 nt, Homo sapiens
gcauauugcuuggauucua

SEQ ID NO: 629975 - RNA, 19 nt, Homo sapiens
gaaaccucgugucuacuaa

SEQ ID NO: 629976 - RNA, 19 nt, Homo sapiens
caagagagguggcuuugag

SEQ ID NO: 629977 - RNA, 19 nt, Homo sapiens
gagcagguguuucuguaug

SEQ ID NO: 629978 - RNA, 19 nt, Homo sapiens
ggugaaaccucgugucuac

SEQ ID NO: 629979 - RNA, 19 nt, Homo sapiens
uguggaauguguuguauuu

SEQ ID NO: 629980 - RNA, 19 nt, Homo sapiens
aaaggacucuugauucuuc

SEQ ID NO: 629981 - RNA, 19 nt, Homo sapiens
gcagggaccucuugcuucu

SEQ ID NO: 629982 - RNA, 19 nt, Homo sapiens
gcuuugcuguaaauacuua

SEQ ID NO: 629983 - RNA, 19 nt, Homo sapiens
guuggacuguuguucaaua

SEQ ID NO: 629984 - RNA, 19 nt, Homo sapiens
acaagaaacuagccagaug

SEQ ID NO: 629985 - RNA, 19 nt, Homo sapiens
gaaauccacguaaccuuug

SEQ ID NO: 629986 - RNA, 19 nt, Homo sapiens
caaaaugcccuucuuaaaa

SEQ ID NO: 629987 - RNA, 19 nt, Homo sapiens
ucaggaggcuuagcauauu

SEQ ID NO: 629988 - RNA, 19 nt, Homo sapiens
gaagaaacgcaggaacauu

SEQ ID NO: 629989 - RNA, 19 nt, Homo sapiens
ggacuguuguucaauaaac

SEQ ID NO: 629990 - RNA, 19 nt, Homo sapiens
gcaagguguggaaguauuu

SEQ ID NO: 629991 - RNA, 19 nt, Homo sapiens
cuuaagaccuccaccaugu

SEQ ID NO: 629992 - RNA, 19 nt, Homo sapiens
ggaagcguguugucuuaca

SEQ ID NO: 629993 - RNA, 19 nt, Homo sapiens
ccaagggccugcuggacaa

SEQ ID NO: 629994 - RNA, 19 nt, Homo sapiens
gggcagccaugucgccauu

SEQ ID NO: 629995 - RNA, 19 nt, Homo sapiens
ccacguaaccuuugcuuuc

SEQ ID NO: 629996 - RNA, 19 nt, Homo sapiens
guuccuuccuucacagaua

SEQ ID NO: 629997 - RNA, 19 nt, Homo sapiens
gaacaccacgcucaacauc

SEQ ID NO: 629998 - RNA, 19 nt, Homo sapiens
gccgcaaacugguggagua

SEQ ID NO: 629999 - RNA, 19 nt, Homo sapiens
ccaaggccaucccugagaa

SEQ ID NO: 630000 - RNA, 19 nt, Homo sapiens
gaucacugaauucauguuu

SEQ ID NO: 630001 - RNA, 19 nt, Homo sapiens
ggagguggagguugcagua

SEQ ID NO: 630002 - RNA, 19 nt, Homo sapiens
caacaaccaccaccucaug

SEQ ID NO: 630003 - RNA, 19 nt, Homo sapiens
ucacgcgagugcucuauga

SEQ ID NO: 630004 - RNA, 19 nt, Homo sapiens
gcuccauucuguagcauug

SEQ ID NO: 630005 - RNA, 19 nt, Homo sapiens
ggcgguggcuccugucuau

SEQ ID NO: 630006 - RNA, 19 nt, Homo sapiens
ggagaagcaauggagaaua

SEQ ID NO: 630007 - RNA, 19 nt, Homo sapiens
gcaagcagcacagaauguu

SEQ ID NO: 630008 - RNA, 19 nt, Homo sapiens
ggaacuaccugccuuucac

SEQ ID NO: 630009 - RNA, 19 nt, Homo sapiens
caacauguagaacugcuuu

SEQ ID NO: 630010 - RNA, 19 nt, Homo sapiens
cgaguugcuuucagucauu

SEQ ID NO: 630011 - RNA, 19 nt, Homo sapiens
guccggagguuaugucuuc

SEQ ID NO: 630012 - RNA, 19 nt, Homo sapiens
ucacugaauucauguuuac

SEQ ID NO: 630013 - RNA, 19 nt, Homo sapiens
ucaauaaaccagagcaaug

SEQ ID NO: 630014 - RNA, 19 nt, Homo sapiens
agagcaagguguggaagua

SEQ ID NO: 630015 - RNA, 19 nt, Homo sapiens
gaccauccacugucuuuga

SEQ ID NO: 630016 - RNA, 19 nt, Homo sapiens
cguaaccuuugcuuucuuu

SEQ ID NO: 630017 - RNA, 19 nt, Homo sapiens
acaccacgcucaacaucaa

SEQ ID NO: 630018 - RNA, 19 nt, Homo sapiens
agaaauccacguaaccuuu

SEQ ID NO: 630019 - RNA, 19 nt, Homo sapiens
gaaaggacucuugauucuu

SEQ ID NO: 630020 - RNA, 19 nt, Homo sapiens
caagcagcacagaauguua

SEQ ID NO: 630021 - RNA, 19 nt, Homo sapiens
ugaaaccucgugucuacua

SEQ ID NO: 630022 - RNA, 19 nt, Homo sapiens
ggcgguuucuuuggcauua

SEQ ID NO: 630023 - RNA, 19 nt, Homo sapiens
ccuaccaccuggagaagaa

SEQ ID NO: 630024 - RNA, 19 nt, Homo sapiens
gcagccaugucgccauugu

SEQ ID NO: 630025 - RNA, 19 nt, Homo sapiens
gaaaccccgucucuacuaa

SEQ ID NO: 630026 - RNA, 19 nt, Homo sapiens
uggaggagcugagcaacuu

SEQ ID NO: 630027 - RNA, 19 nt, Homo sapiens
ucacucacguggaaaugug

SEQ ID NO: 630028 - RNA, 19 nt, Homo sapiens
ucaagcagguggccgagau

SEQ ID NO: 630029 - RNA, 19 nt, Homo sapiens
caggaggcuuagcauauug

SEQ ID NO: 630030 - RNA, 19 nt, Homo sapiens
ggacgucgcagugcacaug

SEQ ID NO: 630031 - RNA, 19 nt, Homo sapiens
gaaggugcuuggccucaac

SEQ ID NO: 630032 - RNA, 19 nt, Homo sapiens
aaaggaagcacgggagaaa

SEQ ID NO: 630033 - RNA, 19 nt, Homo sapiens
acucuugauucuucucuuu

SEQ ID NO: 630034 - RNA, 19 nt, Homo sapiens
gcagcccauuggaugcuuu

SEQ ID NO: 630035 - RNA, 19 nt, Homo sapiens
acgagcagguguuucugua

SEQ ID NO: 630036 - RNA, 19 nt, Homo sapiens
cuguaaaguuggacuguug

SEQ ID NO: 630037 - RNA, 19 nt, Homo sapiens
gcuguaaaguuggacuguu

SEQ ID NO: 630038 - RNA, 19 nt, Homo sapiens
gaacgguugccccuuauuu

SEQ ID NO: 630039 - RNA, 19 nt, Homo sapiens
gcgaguugcuuucagucau

SEQ ID NO: 630040 - RNA, 19 nt, Homo sapiens
uugcggaguugguccuuaa

SEQ ID NO: 630041 - RNA, 19 nt, Homo sapiens
ccugcugccugccgaaauu

SEQ ID NO: 630042 - RNA, 19 nt, Homo sapiens
ucaaggugcugcugaagac

SEQ ID NO: 630043 - RNA, 19 nt, Homo sapiens
gagaaauccacguaaccuu

SEQ ID NO: 630044 - RNA, 19 nt, Homo sapiens
guccugagccgguuuaagu

SEQ ID NO: 630045 - RNA, 19 nt, Homo sapiens
cggaaaggacucuugauuc

SEQ ID NO: 630046 - RNA, 19 nt, Homo sapiens
gaucaucaugugugacuuc

SEQ ID NO: 630047 - RNA, 19 nt, Homo sapiens
aagaaacgcaggaacauuc

SEQ ID NO: 630048 - RNA, 19 nt, Homo sapiens
ugaagccgcugcugcacau

SEQ ID NO: 630049 - RNA, 19 nt, Homo sapiens
uguacaugcucuaugagaa

SEQ ID NO: 630050 - RNA, 19 nt, Homo sapiens
ggaggagugagaaucagaa

SEQ ID NO: 630051 - RNA, 19 nt, Homo sapiens
ucccggcucugucuucauu

SEQ ID NO: 630052 - RNA, 19 nt, Homo sapiens
cacagaauguuauccuuac

SEQ ID NO: 630053 - RNA, 19 nt, Homo sapiens
uuucacggcugcugacuuc

SEQ ID NO: 630054 - RNA, 19 nt, Homo sapiens
ccggaaaggacucuugauu

SEQ ID NO: 630055 - RNA, 19 nt, Homo sapiens
ccaaaaugcccuucuuaaa

SEQ ID NO: 630056 - RNA, 19 nt, Homo sapiens
cugggaggguuuagaagaa

SEQ ID NO: 630057 - RNA, 19 nt, Homo sapiens
ggacgagcccaccuucaag

SEQ ID NO: 630058 - RNA, 19 nt, Homo sapiens
cgaggaagcguguugucuu

SEQ ID NO: 630059 - RNA, 19 nt, Homo sapiens
gagcaacacggagcagaug

SEQ ID NO: 630060 - RNA, 19 nt, Homo sapiens
cauauugcuuggauucuac

SEQ ID NO: 630061 - RNA, 19 nt, Homo sapiens
uagaagaaacgcaggaaca

SEQ ID NO: 630062 - RNA, 19 nt, Homo sapiens
aaagagauucgagaaguga

SEQ ID NO: 630063 - RNA, 19 nt, Homo sapiens
gaagagaccugggaaauua

SEQ ID NO: 630064 - RNA, 19 nt, Homo sapiens
gagaagagguugcugauua

SEQ ID NO: 630065 - RNA, 19 nt, Homo sapiens
ggauugaugugaacacuuu

SEQ ID NO: 630066 - RNA, 19 nt, Homo sapiens
cuacaucaauggcucuuua

SEQ ID NO: 630067 - RNA, 19 nt, Homo sapiens
aaauggacgugacuucuua

SEQ ID NO: 630068 - RNA, 19 nt, Homo sapiens
ggacgugacuucuuauugg

SEQ ID NO: 630069 - RNA, 19 nt, Homo sapiens
caucaauggcucuuuauua

SEQ ID NO: 630070 - RNA, 19 nt, Homo sapiens
caacuguggugguauaugu

SEQ ID NO: 630071 - RNA, 19 nt, Homo sapiens
gagcagggauucuggaaag

SEQ ID NO: 630072 - RNA, 19 nt, Homo sapiens
gccacccucuuccaaauua

SEQ ID NO: 630073 - RNA, 19 nt, Homo sapiens
gcacauagucuuuguaagg

SEQ ID NO: 630074 - RNA, 19 nt, Homo sapiens
ggcaaugucuucucuaaca

SEQ ID NO: 630075 - RNA, 19 nt, Homo sapiens
agaagagguugcugauuaa

SEQ ID NO: 630076 - RNA, 19 nt, Homo sapiens
uaucaauacuucuggcuuu

SEQ ID NO: 630077 - RNA, 19 nt, Homo sapiens
gcacugaggaguuaucaau

SEQ ID NO: 630078 - RNA, 19 nt, Homo sapiens
agacaaauguauaggaaga

SEQ ID NO: 630079 - RNA, 19 nt, Homo sapiens
uaaugugucucuacagcua

SEQ ID NO: 630080 - RNA, 19 nt, Homo sapiens
ucaccuaccucgaugcauu

SEQ ID NO: 630081 - RNA, 19 nt, Homo sapiens
uaagggagcuauguggaaa

SEQ ID NO: 630082 - RNA, 19 nt, Homo sapiens
ugauguggcuccuuccuuu

SEQ ID NO: 630083 - RNA, 19 nt, Homo sapiens
ccacugagccguaagacaa

SEQ ID NO: 630084 - RNA, 19 nt, Homo sapiens
ccaucaagcugcugguaaa

SEQ ID NO: 630085 - RNA, 19 nt, Homo sapiens
gaaauggacgugacuucuu

SEQ ID NO: 630086 - RNA, 19 nt, Homo sapiens
gcaaugucuucucuaacaa

SEQ ID NO: 630087 - RNA, 19 nt, Homo sapiens
ugaaaccucugccugaugu

SEQ ID NO: 630088 - RNA, 19 nt, Homo sapiens
gaggaguuaucaauacuuc

SEQ ID NO: 630089 - RNA, 19 nt, Homo sapiens
uuaaguuucuugcggagua

SEQ ID NO: 630090 - RNA, 19 nt, Homo sapiens
acagcuaccuuaccacuga

SEQ ID NO: 630091 - RNA, 19 nt, Homo sapiens
ucaagcugcugguaaaugu

SEQ ID NO: 630092 - RNA, 19 nt, Homo sapiens
gaccugggcuccaucaucu

SEQ ID NO: 630093 - RNA, 19 nt, Homo sapiens
gcuccucucugccgccuuu

SEQ ID NO: 630094 - RNA, 19 nt, Homo sapiens
uggaugcacugaggaguua

SEQ ID NO: 630095 - RNA, 19 nt, Homo sapiens
gagaagagaccugggaaau

SEQ ID NO: 630096 - RNA, 19 nt, Homo sapiens
gaaagugggacucugaagu

SEQ ID NO: 630097 - RNA, 19 nt, Homo sapiens
ccaaagggcugugaguaag

SEQ ID NO: 630098 - RNA, 19 nt, Homo sapiens
gugggacucugaaguguau

SEQ ID NO: 630099 - RNA, 19 nt, Homo sapiens
caauacuucuggcuuuaug

SEQ ID NO: 630100 - RNA, 19 nt, Homo sapiens
uguaagggauugaugugaa

SEQ ID NO: 630101 - RNA, 19 nt, Homo sapiens
gcagggcaaugucuucucu

SEQ ID NO: 630102 - RNA, 19 nt, Homo sapiens
cagcacauagucuuuguaa

SEQ ID NO: 630103 - RNA, 19 nt, Homo sapiens
caucaucugugacaucaag

SEQ ID NO: 630104 - RNA, 19 nt, Homo sapiens
gacacuuucuuuccauguu

SEQ ID NO: 630105 - RNA, 19 nt, Homo sapiens
ugagagcucuuaaauuuug

SEQ ID NO: 630106 - RNA, 19 nt, Homo sapiens
ccaaggagaagcagacaug

SEQ ID NO: 630107 - RNA, 19 nt, Homo sapiens
caccagaucccaaggagaa

SEQ ID NO: 630108 - RNA, 19 nt, Homo sapiens
ggagacaucaauucgcuau

SEQ ID NO: 630109 - RNA, 19 nt, Homo sapiens
ugugugcccugaucuugua

SEQ ID NO: 630110 - RNA, 19 nt, Homo sapiens
guaagggagcuauguggaa

SEQ ID NO: 630111 - RNA, 19 nt, Homo sapiens
guaagacaaauguauagga

SEQ ID NO: 630112 - RNA, 19 nt, Homo sapiens
gaagagguugcugauuaaa

SEQ ID NO: 630113 - RNA, 19 nt, Homo sapiens
gucaaacccucuucaaagg

SEQ ID NO: 630114 - RNA, 19 nt, Homo sapiens
gaccugggaaauuaaguuu

SEQ ID NO: 630115 - RNA, 19 nt, Homo sapiens
gccguaagacaaauguaua

SEQ ID NO: 630116 - RNA, 19 nt, Homo sapiens
ucaaaggaggaacagauaa

SEQ ID NO: 630117 - RNA, 19 nt, Homo sapiens
ucccaacuguggugguaua

SEQ ID NO: 630118 - RNA, 19 nt, Homo sapiens
gaauacugccagcaugaga

SEQ ID NO: 630119 - RNA, 19 nt, Homo sapiens
agucaugccucccaacugu

SEQ ID NO: 630120 - RNA, 19 nt, Homo sapiens
ggaguuaucaauacuucug

SEQ ID NO: 630121 - RNA, 19 nt, Homo sapiens
cgagggagagccacacuug

SEQ ID NO: 630122 - RNA, 19 nt, Homo sapiens
ccucuuuguugaugucauu

SEQ ID NO: 630123 - RNA, 19 nt, Homo sapiens
caaaggaggaacagauaag

SEQ ID NO: 630124 - RNA, 19 nt, Homo sapiens
guaagggauugaugugaac

SEQ ID NO: 630125 - RNA, 19 nt, Homo sapiens
ggaagaagcaaagucuaca

SEQ ID NO: 630126 - RNA, 19 nt, Homo sapiens
aucaauggcucuuuauuag

SEQ ID NO: 630127 - RNA, 19 nt, Homo sapiens
ggagaagagguugcugauu

SEQ ID NO: 630128 - RNA, 19 nt, Homo sapiens
agaagagaccugggaaauu

SEQ ID NO: 630129 - RNA, 19 nt, Homo sapiens
gcaaagucuacagcacaua

SEQ ID NO: 630130 - RNA, 19 nt, Homo sapiens
ucucuacccuuccaaccaa

SEQ ID NO: 630131 - RNA, 19 nt, Homo sapiens
gagcugggccgacagaaac

SEQ ID NO: 630132 - RNA, 19 nt, Homo sapiens
ccaacaccauccucaaguc

SEQ ID NO: 630133 - RNA, 19 nt, Homo sapiens
cgugcuuucuuuccucuuu

SEQ ID NO: 630134 - RNA, 19 nt, Homo sapiens
caaagucuacagcacauag

SEQ ID NO: 630135 - RNA, 19 nt, Homo sapiens
gcacuuaaaggugucuuca

SEQ ID NO: 630136 - RNA, 19 nt, Homo sapiens
ggaccugggcuccaucauc

SEQ ID NO: 630137 - RNA, 19 nt, Homo sapiens
gaugugcgcgugcuuucuu

SEQ ID NO: 630138 - RNA, 19 nt, Homo sapiens
aggagaagcagacauguga

SEQ ID NO: 630139 - RNA, 19 nt, Homo sapiens
ugucaaacccucuucaaag

SEQ ID NO: 630140 - RNA, 19 nt, Homo sapiens
uagacgaggaggacuauga

SEQ ID NO: 630141 - RNA, 19 nt, Homo sapiens
agggcaaugucuucucuaa

SEQ ID NO: 630142 - RNA, 19 nt, Homo sapiens
aaagugggacucugaagug

SEQ ID NO: 630143 - RNA, 19 nt, Homo sapiens
acuuaaaggugucuucauc

SEQ ID NO: 630144 - RNA, 19 nt, Homo sapiens
gagaagcagacaugugaca

SEQ ID NO: 630145 - RNA, 19 nt, Homo sapiens
uggcgugacuacaucaaug

SEQ ID NO: 630146 - RNA, 19 nt, Homo sapiens
ucucugagcucaccuaccu

SEQ ID NO: 630147 - RNA, 19 nt, Homo sapiens
caggguggauggagaagag

SEQ ID NO: 630148 - RNA, 19 nt, Homo sapiens
uauucccucuucucacuuu

SEQ ID NO: 630149 - RNA, 19 nt, Homo sapiens
caucacagacucccucaag

SEQ ID NO: 630150 - RNA, 19 nt, Homo sapiens
ccacuugagcgccaguuug

SEQ ID NO: 630151 - RNA, 19 nt, Homo sapiens
uaacaagcaggacccacuu

SEQ ID NO: 630152 - RNA, 19 nt, Homo sapiens
ccucccaacugugguggua

SEQ ID NO: 630153 - RNA, 19 nt, Homo sapiens
guggaaagugggacucuga

SEQ ID NO: 630154 - RNA, 19 nt, Homo sapiens
ccuauucccucuucucacu

SEQ ID NO: 630155 - RNA, 19 nt, Homo sapiens
gaccuauucccucuucuca

SEQ ID NO: 630156 - RNA, 19 nt, Homo sapiens
ucaauggcucuuuauuaga

SEQ ID NO: 630157 - RNA, 19 nt, Homo sapiens
gagaugugcgcgugcuuuc

SEQ ID NO: 630158 - RNA, 19 nt, Homo sapiens
uuucuuuccucuuuguuga

SEQ ID NO: 630159 - RNA, 19 nt, Homo sapiens
gccaucaagcugcugguaa

SEQ ID NO: 630160 - RNA, 19 nt, Homo sapiens
acacuuucuuuccauguuc

SEQ ID NO: 630161 - RNA, 19 nt, Homo sapiens
ucacagacucccucaagca

SEQ ID NO: 630162 - RNA, 19 nt, Homo sapiens
gggacucugaaguguauuu

SEQ ID NO: 630163 - RNA, 19 nt, Homo sapiens
gaagagaccugggaaauua

SEQ ID NO: 630164 - RNA, 19 nt, Homo sapiens
gagaagagguugcugauua

SEQ ID NO: 630165 - RNA, 19 nt, Homo sapiens
gacacagacuuuaugauua

SEQ ID NO: 630166 - RNA, 19 nt, Homo sapiens
ggauugaugugaacacuuu

SEQ ID NO: 630167 - RNA, 19 nt, Homo sapiens
cuacaucaauggcucuuua

SEQ ID NO: 630168 - RNA, 19 nt, Homo sapiens
caucauagguguaagugaa

SEQ ID NO: 630169 - RNA, 19 nt, Homo sapiens
aaauggacgugacuucuua

SEQ ID NO: 630170 - RNA, 19 nt, Homo sapiens
ggacgugacuucuuauugg

SEQ ID NO: 630171 - RNA, 19 nt, Homo sapiens
caucaauggcucuuuauua

SEQ ID NO: 630172 - RNA, 19 nt, Homo sapiens
caacuguggugguauaugu

SEQ ID NO: 630173 - RNA, 19 nt, Homo sapiens
gagcagggauucuggaaag

SEQ ID NO: 630174 - RNA, 19 nt, Homo sapiens
gccacccucuuccaaauua

SEQ ID NO: 630175 - RNA, 19 nt, Homo sapiens
gcacuaaggaguuaucaau

SEQ ID NO: 630176 - RNA, 19 nt, Homo sapiens
gcacauagucuuuguaagg

SEQ ID NO: 630177 - RNA, 19 nt, Homo sapiens
ggcaaugucuucucuaaca

SEQ ID NO: 630178 - RNA, 19 nt, Homo sapiens
agaagagguugcugauuaa

SEQ ID NO: 630179 - RNA, 19 nt, Homo sapiens
uaucaauacuucuggcuuu

SEQ ID NO: 630180 - RNA, 19 nt, Homo sapiens
agacaaauguauaggaaga

SEQ ID NO: 630181 - RNA, 19 nt, Homo sapiens
uaaugugucucuacagcua

SEQ ID NO: 630182 - RNA, 19 nt, Homo sapiens
ucaccuaccucgaugcauu

SEQ ID NO: 630183 - RNA, 19 nt, Homo sapiens
uaagggagcuauguggaaa

SEQ ID NO: 630184 - RNA, 19 nt, Homo sapiens
ugauguggcuccuuccuuu

SEQ ID NO: 630185 - RNA, 19 nt, Homo sapiens
ccacugagccguaagacaa

SEQ ID NO: 630186 - RNA, 19 nt, Homo sapiens
ccaucaagcugcugguaaa

SEQ ID NO: 630187 - RNA, 19 nt, Homo sapiens
gaaauggacgugacuucuu

SEQ ID NO: 630188 - RNA, 19 nt, Homo sapiens
agacacagacuuuaugauu

SEQ ID NO: 630189 - RNA, 19 nt, Homo sapiens
gcaaugucuucucuaacaa

SEQ ID NO: 630190 - RNA, 19 nt, Homo sapiens
ugaaaccucugccugaugu

SEQ ID NO: 630191 - RNA, 19 nt, Homo sapiens
gaaaguggaagugguauuc

SEQ ID NO: 630192 - RNA, 19 nt, Homo sapiens
acagcuaccuuaccacuga

SEQ ID NO: 630193 - RNA, 19 nt, Homo sapiens
uuaaguuucuugcggagua

SEQ ID NO: 630194 - RNA, 19 nt, Homo sapiens
ucaagcugcugguaaaugu

SEQ ID NO: 630195 - RNA, 19 nt, Homo sapiens
gaccugggcuccaucaucu

SEQ ID NO: 630196 - RNA, 19 nt, Homo sapiens
gcuccucucugccgccuuu

SEQ ID NO: 630197 - RNA, 19 nt, Homo sapiens
uaguccagcugguacaaua

SEQ ID NO: 630198 - RNA, 19 nt, Homo sapiens
aaagaaaguggaaguggua

SEQ ID NO: 630199 - RNA, 19 nt, Homo sapiens
gagaagagaccugggaaau

SEQ ID NO: 630200 - RNA, 19 nt, Homo sapiens
gaaagugggacucugaagu

SEQ ID NO: 630201 - RNA, 19 nt, Homo sapiens
ccaaagggcugugaguaag

SEQ ID NO: 630202 - RNA, 19 nt, Homo sapiens
gccaggaggucuagaacug

SEQ ID NO: 630203 - RNA, 19 nt, Homo sapiens
gugggacucugaaguguau

SEQ ID NO: 630204 - RNA, 19 nt, Homo sapiens
caauacuucuggcuuuaug

SEQ ID NO: 630205 - RNA, 19 nt, Homo sapiens
uguaagggauugaugugaa

SEQ ID NO: 630206 - RNA, 19 nt, Homo sapiens
gcagggcaaugucuucucu

SEQ ID NO: 630207 - RNA, 19 nt, Homo sapiens
cagcacauagucuuuguaa

SEQ ID NO: 630208 - RNA, 19 nt, Homo sapiens
caucaucugugacaucaag

SEQ ID NO: 630209 - RNA, 19 nt, Homo sapiens
gacacuuucuuuccauguu

SEQ ID NO: 630210 - RNA, 19 nt, Homo sapiens
ugagagcucuuaaauuuug

SEQ ID NO: 630211 - RNA, 19 nt, Homo sapiens
uggaugcacuaaggaguua

SEQ ID NO: 630212 - RNA, 19 nt, Homo sapiens
ccaaggagaagcagacaug

SEQ ID NO: 630213 - RNA, 19 nt, Homo sapiens
caccagaucccaaggagaa

SEQ ID NO: 630214 - RNA, 19 nt, Homo sapiens
ggagacaucaauucgcuau

SEQ ID NO: 630215 - RNA, 19 nt, Homo sapiens
ugugugcccugaucuugua

SEQ ID NO: 630216 - RNA, 19 nt, Homo sapiens
guaagggagcuauguggaa

SEQ ID NO: 630217 - RNA, 19 nt, Homo sapiens
guaagacaaauguauagga

SEQ ID NO: 630218 - RNA, 19 nt, Homo sapiens
gaagagguugcugauuaaa

SEQ ID NO: 630219 - RNA, 19 nt, Homo sapiens
gucaaacccucuucaaagg

SEQ ID NO: 630220 - RNA, 19 nt, Homo sapiens
gaccugggaaauuaaguuu

SEQ ID NO: 630221 - RNA, 19 nt, Homo sapiens
gccguaagacaaauguaua

SEQ ID NO: 630222 - RNA, 19 nt, Homo sapiens
ucaaaggaggaacagauaa

SEQ ID NO: 630223 - RNA, 19 nt, Homo sapiens
agggaggcauguugaauga

SEQ ID NO: 630224 - RNA, 19 nt, Homo sapiens
gcugggacaugcacugagu

SEQ ID NO: 630225 - RNA, 19 nt, Homo sapiens
ucccaacuguggugguaua

SEQ ID NO: 630226 - RNA, 19 nt, Homo sapiens
gaauacugccagcaugaga

SEQ ID NO: 630227 - RNA, 19 nt, Homo sapiens
ggucuagaacuggagcuua

SEQ ID NO: 630228 - RNA, 19 nt, Homo sapiens
gaaugagccaggaggucua

SEQ ID NO: 630229 - RNA, 19 nt, Homo sapiens
agguguaagugaaguaauu

SEQ ID NO: 630230 - RNA, 19 nt, Homo sapiens
agucaugccucccaacugu

SEQ ID NO: 630231 - RNA, 19 nt, Homo sapiens
ggaguuaucaauacuucug

SEQ ID NO: 630232 - RNA, 19 nt, Homo sapiens
acuaaggaguuaucaauac

SEQ ID NO: 630233 - RNA, 19 nt, Homo sapiens
cgagggagagccacacuug

SEQ ID NO: 630234 - RNA, 19 nt, Homo sapiens
ccucuuuguugaugucauu

SEQ ID NO: 630235 - RNA, 19 nt, Homo sapiens
caaaggaggaacagauaag

SEQ ID NO: 630236 - RNA, 19 nt, Homo sapiens
guaagggauugaugugaac

SEQ ID NO: 630237 - RNA, 19 nt, Homo sapiens
ggaagaagcaaagucuaca

SEQ ID NO: 630238 - RNA, 19 nt, Homo sapiens
aucaauggcucuuuauuag

SEQ ID NO: 630239 - RNA, 19 nt, Homo sapiens
ccagacacagacuuuauga

SEQ ID NO: 630240 - RNA, 19 nt, Homo sapiens
ggagaagagguugcugauu

SEQ ID NO: 630241 - RNA, 19 nt, Homo sapiens
gcaaagucuacagcacaua

SEQ ID NO: 630242 - RNA, 19 nt, Homo sapiens
ucucuacccuuccaaccaa

SEQ ID NO: 630243 - RNA, 19 nt, Homo sapiens
gagcugggccgacagaaac

SEQ ID NO: 630244 - RNA, 19 nt, Homo sapiens
ccaacaccauccucaaguc

SEQ ID NO: 630245 - RNA, 19 nt, Homo sapiens
agaagagaccugggaaauu

SEQ ID NO: 630246 - RNA, 19 nt, Homo sapiens
cgugcuuucuuuccucuuu

SEQ ID NO: 630247 - RNA, 19 nt, Homo sapiens
guaagugaaguaauuccuu

SEQ ID NO: 630248 - RNA, 19 nt, Homo sapiens
gaugugcgcgugcuuucuu

SEQ ID NO: 630249 - RNA, 19 nt, Homo sapiens
caaagucuacagcacauag

SEQ ID NO: 630250 - RNA, 19 nt, Homo sapiens
gcacuuaaaggugucuuca

SEQ ID NO: 630251 - RNA, 19 nt, Homo sapiens
ggaccugggcuccaucauc

SEQ ID NO: 630252 - RNA, 19 nt, Homo sapiens
aggagaagcagacauguga

SEQ ID NO: 630253 - RNA, 19 nt, Homo sapiens
ugucaaacccucuucaaag

SEQ ID NO: 630254 - RNA, 19 nt, Homo sapiens
cuaaggaguuaucaauacu

SEQ ID NO: 630255 - RNA, 19 nt, Homo sapiens
cacuaaggaguuaucaaua

SEQ ID NO: 630256 - RNA, 19 nt, Homo sapiens
uagacgaggaggacuauga

SEQ ID NO: 630257 - RNA, 19 nt, Homo sapiens
agggcaaugucuucucuaa

SEQ ID NO: 630258 - RNA, 19 nt, Homo sapiens
gucuagaacuggagcuuag

SEQ ID NO: 630259 - RNA, 19 nt, Homo sapiens
aaagugggacucugaagug

SEQ ID NO: 630260 - RNA, 19 nt, Homo sapiens
acuuaaaggugucuucauc

SEQ ID NO: 630261 - RNA, 19 nt, Homo sapiens
gagaagcagacaugugaca

SEQ ID NO: 630262 - RNA, 19 nt, Homo sapiens
gcucagcccucagcagaac

SEQ ID NO: 630263 - RNA, 19 nt, Homo sapiens
gaauagaacccucaaauaa

SEQ ID NO: 630264 - RNA, 19 nt, Homo sapiens
ggaaaugccuccugggaua

SEQ ID NO: 630265 - RNA, 19 nt, Homo sapiens
ggauuuaacuggagaauau

SEQ ID NO: 630266 - RNA, 19 nt, Homo sapiens
gcaaauacuucuauaggaa

SEQ ID NO: 630267 - RNA, 19 nt, Homo sapiens
gaaggaggaugccuaauca

SEQ ID NO: 630268 - RNA, 19 nt, Homo sapiens
gcaugacucuuaacaauga

SEQ ID NO: 630269 - RNA, 19 nt, Homo sapiens
acacaagccugguauuaua

SEQ ID NO: 630270 - RNA, 19 nt, Homo sapiens
gaaaugaggagucacaauu

SEQ ID NO: 630271 - RNA, 19 nt, Homo sapiens
ggaagaccauguuucuaaa

SEQ ID NO: 630272 - RNA, 19 nt, Homo sapiens
gcauagaggauuucugaua

SEQ ID NO: 630273 - RNA, 19 nt, Homo sapiens
gauagcaggaggcuuauua

SEQ ID NO: 630274 - RNA, 19 nt, Homo sapiens
cagcaaauauuccacacua

SEQ ID NO: 630275 - RNA, 19 nt, Homo sapiens
gcauguggcucauauuuag

SEQ ID NO: 630276 - RNA, 19 nt, Homo sapiens
cauuacagguuuagguuua

SEQ ID NO: 630277 - RNA, 19 nt, Homo sapiens
ugauauaucugucuggaaa

SEQ ID NO: 630278 - RNA, 19 nt, Homo sapiens
ggugauagcaggaggcuua

SEQ ID NO: 630279 - RNA, 19 nt, Homo sapiens
caaagggaauuagccauuu

SEQ ID NO: 630280 - RNA, 19 nt, Homo sapiens
gauguuaacgucaaaguuu

SEQ ID NO: 630281 - RNA, 19 nt, Homo sapiens
caacccgccuuaaccauaa

SEQ ID NO: 630282 - RNA, 19 nt, Homo sapiens
gagcagaaaugccaccaau

SEQ ID NO: 630283 - RNA, 19 nt, Homo sapiens
cagggaaacuuaugucuug

SEQ ID NO: 630284 - RNA, 19 nt, Homo sapiens
ccucuaagcucucucaguu

SEQ ID NO: 630285 - RNA, 19 nt, Homo sapiens
gagcaaaucuaaacauucg

SEQ ID NO: 630286 - RNA, 19 nt, Homo sapiens
cauagaggauuucugauau

SEQ ID NO: 630287 - RNA, 19 nt, Homo sapiens
gagcaaugguucacaagga

SEQ ID NO: 630288 - RNA, 19 nt, Homo sapiens
gaaaacaucugggaauuug

SEQ ID NO: 630289 - RNA, 19 nt, Homo sapiens
gaaagaauccaugcuauag

SEQ ID NO: 630290 - RNA, 19 nt, Homo sapiens
ggagguuacuguuaugaau

SEQ ID NO: 630291 - RNA, 19 nt, Homo sapiens
aaacuuaugucuuggugaa

SEQ ID NO: 630292 - RNA, 19 nt, Homo sapiens
gaggauuucugauauaucu

SEQ ID NO: 630293 - RNA, 19 nt, Homo sapiens
ccaaagcugucaccguauu

SEQ ID NO: 630294 - RNA, 19 nt, Homo sapiens
gagaauagaacccucaaau

SEQ ID NO: 630295 - RNA, 19 nt, Homo sapiens
uaacaagaaucacaucucu

SEQ ID NO: 630296 - RNA, 19 nt, Homo sapiens
ggaagauguuaacgucaaa

SEQ ID NO: 630297 - RNA, 19 nt, Homo sapiens
gcagguaaauugguggauu

SEQ ID NO: 630298 - RNA, 19 nt, Homo sapiens
ggagaggaguccauagauc

SEQ ID NO: 630299 - RNA, 19 nt, Homo sapiens
gcaacccgccuuaaccaua

SEQ ID NO: 630300 - RNA, 19 nt, Homo sapiens
gagauuaugcauagaaaga

SEQ ID NO: 630301 - RNA, 19 nt, Homo sapiens
aaacaggccuugugcucaa

SEQ ID NO: 630302 - RNA, 19 nt, Homo sapiens
ccaaucaaaccacuucuaa

SEQ ID NO: 630303 - RNA, 19 nt, Homo sapiens
ggcaaauacuucuauagga

SEQ ID NO: 630304 - RNA, 19 nt, Homo sapiens
gggauucauuacagguuua

SEQ ID NO: 630305 - RNA, 19 nt, Homo sapiens
gcaggaggcuuauuaugcu

SEQ ID NO: 630306 - RNA, 19 nt, Homo sapiens
gugccaauaucauagguaa

SEQ ID NO: 630307 - RNA, 19 nt, Homo sapiens
cagauucacuguuauacug

SEQ ID NO: 630308 - RNA, 19 nt, Homo sapiens
agaauagaacccucaaaua

SEQ ID NO: 630309 - RNA, 19 nt, Homo sapiens
gaggaugccuaaucauaca

SEQ ID NO: 630310 - RNA, 19 nt, Homo sapiens
ccacauacuuacccacaug

SEQ ID NO: 630311 - RNA, 19 nt, Homo sapiens
aaugaggagucacaauuaa

SEQ ID NO: 630312 - RNA, 19 nt, Homo sapiens
gaguguaaccucagaaaga

SEQ ID NO: 630313 - RNA, 19 nt, Homo sapiens
gagacuuccugcugccuuu

SEQ ID NO: 630314 - RNA, 19 nt, Homo sapiens
aaaugaggagucacaauua

SEQ ID NO: 630315 - RNA, 19 nt, Homo sapiens
gcaaucguagguauaguuu

SEQ ID NO: 630316 - RNA, 19 nt, Homo sapiens
gagguuacuguuaugaaua

SEQ ID NO: 630317 - RNA, 19 nt, Homo sapiens
ugagucacauccauugauu

SEQ ID NO: 630318 - RNA, 19 nt, Homo sapiens
uagaaagaauccaugcuau

SEQ ID NO: 630319 - RNA, 19 nt, Homo sapiens
cuacacaagccugguauua

SEQ ID NO: 630320 - RNA, 19 nt, Homo sapiens
uaaguucauuggcuccuuu

SEQ ID NO: 630321 - RNA, 19 nt, Homo sapiens
auacagaggcauauucuuu

SEQ ID NO: 630322 - RNA, 19 nt, Homo sapiens
auucagcacuuucccauuu

SEQ ID NO: 630323 - RNA, 19 nt, Homo sapiens
agaaauagaggcacuguau

SEQ ID NO: 630324 - RNA, 19 nt, Homo sapiens
gcacuguuagacuugauua

SEQ ID NO: 630325 - RNA, 19 nt, Homo sapiens
acacacauacucccacaua

SEQ ID NO: 630326 - RNA, 19 nt, Homo sapiens
agaaagaauccaugcuaua

SEQ ID NO: 630327 - RNA, 19 nt, Homo sapiens
ggacuacacaagccuggua

SEQ ID NO: 630328 - RNA, 19 nt, Homo sapiens
uggaagaccauguuucuaa

SEQ ID NO: 630329 - RNA, 19 nt, Homo sapiens
guguuggccuccuuuagua

SEQ ID NO: 630330 - RNA, 19 nt, Homo sapiens
aaauagaggcacuguauga

SEQ ID NO: 630331 - RNA, 19 nt, Homo sapiens
gaaaugccuccugggauaa

SEQ ID NO: 630332 - RNA, 19 nt, Homo sapiens
aaagagcaaugguucacaa

SEQ ID NO: 630333 - RNA, 19 nt, Homo sapiens
uuaaaucugagcacuguua

SEQ ID NO: 630334 - RNA, 19 nt, Homo sapiens
gagaggaguccauagauca

SEQ ID NO: 630335 - RNA, 19 nt, Homo sapiens
caacacauagugguaauug

SEQ ID NO: 630336 - RNA, 19 nt, Homo sapiens
guagaaggaggaugccuaa

SEQ ID NO: 630337 - RNA, 19 nt, Homo sapiens
acaagaaucacaucucuga

SEQ ID NO: 630338 - RNA, 19 nt, Homo sapiens
ccaaggaauugaugaguac

SEQ ID NO: 630339 - RNA, 19 nt, Homo sapiens
uguaugacuugcaaucgua

SEQ ID NO: 630340 - RNA, 19 nt, Homo sapiens
uaacuaagccaggaaacuu

SEQ ID NO: 630341 - RNA, 19 nt, Homo sapiens
aagauaagcacauggguaa

SEQ ID NO: 630342 - RNA, 19 nt, Homo sapiens
gcagaaaugccaccaaugc

SEQ ID NO: 630343 - RNA, 19 nt, Homo sapiens
gcucauauuuaggaagcua

SEQ ID NO: 630344 - RNA, 19 nt, Homo sapiens
gaaauagaggcacuguaug

SEQ ID NO: 630345 - RNA, 19 nt, Homo sapiens
cugcaugacucuuaacaau

SEQ ID NO: 630346 - RNA, 19 nt, Homo sapiens
ucaaaugcacagaguguaa

SEQ ID NO: 630347 - RNA, 19 nt, Homo sapiens
gcaguguucucuuugaaac

SEQ ID NO: 630348 - RNA, 19 nt, Homo sapiens
gucauuauguuccuagguu

SEQ ID NO: 630349 - RNA, 19 nt, Homo sapiens
aaacgaagaaaucaacuug

SEQ ID NO: 630350 - RNA, 19 nt, Homo sapiens
ggaagcgacccauggcaaa

SEQ ID NO: 630351 - RNA, 19 nt, Homo sapiens
uuaagcauguggcucauau

SEQ ID NO: 630352 - RNA, 19 nt, Homo sapiens
aauccaugcuauagguuua

SEQ ID NO: 630353 - RNA, 19 nt, Homo sapiens
cgucaaaguuucaaaugca

SEQ ID NO: 630354 - RNA, 19 nt, Homo sapiens
gcagaagaccagagaaucu

SEQ ID NO: 630355 - RNA, 19 nt, Homo sapiens
aagcauagaggauuucuga

SEQ ID NO: 630356 - RNA, 19 nt, Homo sapiens
uagaggcacuguaugacuu

SEQ ID NO: 630357 - RNA, 19 nt, Homo sapiens
cuaguuggcaggauuguaa

SEQ ID NO: 630358 - RNA, 19 nt, Homo sapiens
cauuaaaucugagcacugu

SEQ ID NO: 630359 - RNA, 19 nt, Homo sapiens
cggaagauguuaacgucaa

SEQ ID NO: 630360 - RNA, 19 nt, Homo sapiens
uggcaaugcuaucaacuau

SEQ ID NO: 630361 - RNA, 19 nt, Homo sapiens
gcccuccucuugcagguaa

SEQ ID NO: 630362 - RNA, 19 nt, Homo sapiens
uaauuggagguuacuguua

SEQ ID NO: 630363 - RNA, 19 nt, Homo sapiens
gaaacaagccgcauuccaa

SEQ ID NO: 630364 - RNA, 19 nt, Homo sapiens
gcaacaagccaaagucaug

SEQ ID NO: 630365 - RNA, 19 nt, Homo sapiens
gaaagaacccuagggaaca

SEQ ID NO: 630366 - RNA, 19 nt, Homo sapiens
gcacauacaagaaacauac

SEQ ID NO: 630367 - RNA, 19 nt, Homo sapiens
ccagagcucuaccacaaga

SEQ ID NO: 630368 - RNA, 19 nt, Homo sapiens
agacagugauggaaauaga

SEQ ID NO: 630369 - RNA, 19 nt, Homo sapiens
ggaacauccucaagagcaa

SEQ ID NO: 630370 - RNA, 19 nt, Homo sapiens
gcacuggcaugaaauacag

SEQ ID NO: 630371 - RNA, 19 nt, Homo sapiens
gagugaagauggcaagaag

SEQ ID NO: 630372 - RNA, 19 nt, Homo sapiens
gccgaaagcacaucauuga

SEQ ID NO: 630373 - RNA, 19 nt, Homo sapiens
ugucaucacuaccaagauu

SEQ ID NO: 630374 - RNA, 19 nt, Homo sapiens
ggaguuggaucagucacuu

SEQ ID NO: 630375 - RNA, 19 nt, Homo sapiens
gggagaagguggagaugca

SEQ ID NO: 630376 - RNA, 19 nt, Homo sapiens
ugccagagcucuaccacaa

SEQ ID NO: 630377 - RNA, 19 nt, Homo sapiens
ccgaggcacuggcaugaaa

SEQ ID NO: 630378 - RNA, 19 nt, Homo sapiens
cagaggaugugcugacugu

SEQ ID NO: 630379 - RNA, 19 nt, Homo sapiens
ccacaagauuggaguugga

SEQ ID NO: 630380 - RNA, 19 nt, Homo sapiens
caagcuaugucaucacuac

SEQ ID NO: 630381 - RNA, 19 nt, Homo sapiens
gcagacagugauggaaaua

SEQ ID NO: 630382 - RNA, 19 nt, Homo sapiens
guaccugggucacauuugg

SEQ ID NO: 630383 - RNA, 19 nt, Homo sapiens
uagacgggcuccugggaaa

SEQ ID NO: 630384 - RNA, 19 nt, Homo sapiens
ucuaggcccuucuugcaaa

SEQ ID NO: 630385 - RNA, 19 nt, Homo sapiens
uggaggagaucaagcuaug

SEQ ID NO: 630386 - RNA, 19 nt, Homo sapiens
ggacaaagugcagagugaa

SEQ ID NO: 630387 - RNA, 19 nt, Homo sapiens
gugcggagcaguugauaga

SEQ ID NO: 630388 - RNA, 19 nt, Homo sapiens
caagaagcaacaagccaaa

SEQ ID NO: 630389 - RNA, 19 nt, Homo sapiens
gaggcacuggcaugaaaua

SEQ ID NO: 630390 - RNA, 19 nt, Homo sapiens
gaacauccucaagagcaaa

SEQ ID NO: 630391 - RNA, 19 nt, Homo sapiens
gcaggaaaggcugaaagaa

SEQ ID NO: 630392 - RNA, 19 nt, Homo sapiens
guagugauacgcaugaaca

SEQ ID NO: 630393 - RNA, 19 nt, Homo sapiens
ccuguggucucauuacuag

SEQ ID NO: 630394 - RNA, 19 nt, Homo sapiens
gcuaugucaucacuaccaa

SEQ ID NO: 630395 - RNA, 19 nt, Homo sapiens
gagaucaagcuaugucauc

SEQ ID NO: 630396 - RNA, 19 nt, Homo sapiens
aaacccagcacauacaaga

SEQ ID NO: 630397 - RNA, 19 nt, Homo sapiens
ugggauacguggacauugu

SEQ ID NO: 630398 - RNA, 19 nt, Homo sapiens
gaagcaacaagccaaaguc

SEQ ID NO: 630399 - RNA, 19 nt, Homo sapiens
gaggaugugcugacuguag

SEQ ID NO: 630400 - RNA, 19 nt, Homo sapiens
caagauuggaguuggauca

SEQ ID NO: 630401 - RNA, 19 nt, Homo sapiens
gcaguggggucgagagaga

SEQ ID NO: 630402 - RNA, 19 nt, Homo sapiens
uuggaucagucacuuggua

SEQ ID NO: 630403 - RNA, 19 nt, Homo sapiens
gcggagcaguugauagaac

SEQ ID NO: 630404 - RNA, 19 nt, Homo sapiens
ccaaagucauggaccuucu

SEQ ID NO: 630405 - RNA, 19 nt, Homo sapiens
aggacaaagugcagaguga

SEQ ID NO: 630406 - RNA, 19 nt, Homo sapiens
gagauugugcgagccauga

SEQ ID NO: 630407 - RNA, 19 nt, Homo sapiens
acaagccgcauuccaagaa

SEQ ID NO: 630408 - RNA, 19 nt, Homo sapiens
cuucggguauccugucuug

SEQ ID NO: 630409 - RNA, 19 nt, Homo sapiens
uagggaacauccucaagag

SEQ ID NO: 630410 - RNA, 19 nt, Homo sapiens
cuagggaacauccucaaga

SEQ ID NO: 630411 - RNA, 19 nt, Homo sapiens
cggagcaguugauagaaca

SEQ ID NO: 630412 - RNA, 19 nt, Homo sapiens
gaggagaucaagcuauguc

SEQ ID NO: 630413 - RNA, 19 nt, Homo sapiens
aaagaacccuagggaacau

SEQ ID NO: 630414 - RNA, 19 nt, Homo sapiens
ugaacaaagccauauccuu

SEQ ID NO: 630415 - RNA, 19 nt, Homo sapiens
cacauuugguucucagauc

SEQ ID NO: 630416 - RNA, 19 nt, Homo sapiens
caggaaaggcugaaagaac

SEQ ID NO: 630417 - RNA, 19 nt, Homo sapiens
ccuaugagcaugguguaaa

SEQ ID NO: 630418 - RNA, 19 nt, Homo sapiens
cgaguagugauacgcauga

SEQ ID NO: 630419 - RNA, 19 nt, Homo sapiens
ccucuagccuguggucuca

SEQ ID NO: 630420 - RNA, 19 nt, Homo sapiens
gagcucuaccacaagauug

SEQ ID NO: 630421 - RNA, 19 nt, Homo sapiens
gugauacgcaugaacaaag

SEQ ID NO: 630422 - RNA, 19 nt, Homo sapiens
gaguagugauacgcaugaa

SEQ ID NO: 630423 - RNA, 19 nt, Homo sapiens
ccgcagacagugauggaaa

SEQ ID NO: 630424 - RNA, 19 nt, Homo sapiens
ucuagccuguggucucauu

SEQ ID NO: 630425 - RNA, 19 nt, Homo sapiens
gacuguagccuaugagcau

SEQ ID NO: 630426 - RNA, 19 nt, Homo sapiens
ucugauuccuccagugugu

SEQ ID NO: 630427 - RNA, 19 nt, Homo sapiens
gaaguguacgcagcaggaa

SEQ ID NO: 630428 - RNA, 19 nt, Homo sapiens
cguggugucuccgcaguga

SEQ ID NO: 630429 - RNA, 19 nt, Homo sapiens
caaagugcagagugaagau

SEQ ID NO: 630430 - RNA, 19 nt, Homo sapiens
accaguggcucaaggacaa

SEQ ID NO: 630431 - RNA, 19 nt, Homo sapiens
agaucaagcuaugucauca

SEQ ID NO: 630432 - RNA, 19 nt, Homo sapiens
gugaagauggcaagaagca

SEQ ID NO: 630433 - RNA, 19 nt, Homo sapiens
aagcggagcaccaucuguu

SEQ ID NO: 630434 - RNA, 19 nt, Homo sapiens
gcugggauacguggacauu

SEQ ID NO: 630435 - RNA, 19 nt, Homo sapiens
uacaagaaacauacagugu

SEQ ID NO: 630436 - RNA, 19 nt, Homo sapiens
cgcagacagugauggaaau

SEQ ID NO: 630437 - RNA, 19 nt, Homo sapiens
gggcgagucccagauacuu

SEQ ID NO: 630438 - RNA, 19 nt, Homo sapiens
cuagguaccugggucacau

SEQ ID NO: 630439 - RNA, 19 nt, Homo sapiens
caagccgcauuccaagaag

SEQ ID NO: 630440 - RNA, 19 nt, Homo sapiens
caugaaauacaggaaccua

SEQ ID NO: 630441 - RNA, 19 nt, Homo sapiens
caaagucauggaccuucuu

SEQ ID NO: 630442 - RNA, 19 nt, Homo sapiens
ggagaucaagcuaugucau

SEQ ID NO: 630443 - RNA, 19 nt, Homo sapiens
acaggaaccuagggaaguc

SEQ ID NO: 630444 - RNA, 19 nt, Homo sapiens
gcggagcaccaucuguuuc

SEQ ID NO: 630445 - RNA, 19 nt, Homo sapiens
acaaagugcagagugaaga

SEQ ID NO: 630446 - RNA, 19 nt, Homo sapiens
ugugcugacuguagccuau

SEQ ID NO: 630447 - RNA, 19 nt, Homo sapiens
ugcgagccaugaccuaugu

SEQ ID NO: 630448 - RNA, 19 nt, Homo sapiens
auugagggcuugcgaggau

SEQ ID NO: 630449 - RNA, 19 nt, Homo sapiens
uaugucaucacuaccaaga

SEQ ID NO: 630450 - RNA, 19 nt, Homo sapiens
gcaugaacaaagccauauc

SEQ ID NO: 630451 - RNA, 19 nt, Homo sapiens
caacgagucccggcuucga

SEQ ID NO: 630452 - RNA, 19 nt, Homo sapiens
gacaaagugcagagugaag

SEQ ID NO: 630453 - RNA, 19 nt, Homo sapiens
gagaagagcuugauauuca

SEQ ID NO: 630454 - RNA, 19 nt, Homo sapiens
caaagaacauuuagccuua

SEQ ID NO: 630455 - RNA, 19 nt, Homo sapiens
gaacuucggucgucgcaaa

SEQ ID NO: 630456 - RNA, 19 nt, Homo sapiens
gcaagguaauuguaguuua

SEQ ID NO: 630457 - RNA, 19 nt, Homo sapiens
ggaggaaacuggccuucua

SEQ ID NO: 630458 - RNA, 19 nt, Homo sapiens
caacuagucugacauuguu

SEQ ID NO: 630459 - RNA, 19 nt, Homo sapiens
gaacauacaugacccuuuu

SEQ ID NO: 630460 - RNA, 19 nt, Homo sapiens
gcccuucagucucaaauua

SEQ ID NO: 630461 - RNA, 19 nt, Homo sapiens
ggaagcaucccacucauuu

SEQ ID NO: 630462 - RNA, 19 nt, Homo sapiens
uuacagcccuggaugguua

SEQ ID NO: 630463 - RNA, 19 nt, Homo sapiens
cagcauguauguuucuaua

SEQ ID NO: 630464 - RNA, 19 nt, Homo sapiens
gaauaugcccuacugguuu

SEQ ID NO: 630465 - RNA, 19 nt, Homo sapiens
ccaaacagcggguuacuuu

SEQ ID NO: 630466 - RNA, 19 nt, Homo sapiens
cugcugagcuguauuuaaa

SEQ ID NO: 630467 - RNA, 19 nt, Homo sapiens
gauucuaacugcaaagauu

SEQ ID NO: 630468 - RNA, 19 nt, Homo sapiens
guagucagguauuguuauu

SEQ ID NO: 630469 - RNA, 19 nt, Homo sapiens
uaacaggacugaaauuggu

SEQ ID NO: 630470 - RNA, 19 nt, Homo sapiens
gaucacagauacuuacaag

SEQ ID NO: 630471 - RNA, 19 nt, Homo sapiens
gaauaccgaugacagaaca

SEQ ID NO: 630472 - RNA, 19 nt, Homo sapiens
gguaggagcugguuuccau

SEQ ID NO: 630473 - RNA, 19 nt, Homo sapiens
caagguaauuguaguuuag

SEQ ID NO: 630474 - RNA, 19 nt, Homo sapiens
uauaauggcuuucaaugca

SEQ ID NO: 630475 - RNA, 19 nt, Homo sapiens
cuggguggcucauguguua

SEQ ID NO: 630476 - RNA, 19 nt, Homo sapiens
ggacugaaauugguagaag

SEQ ID NO: 630477 - RNA, 19 nt, Homo sapiens
aaacgaaguaucaguagua

SEQ ID NO: 630478 - RNA, 19 nt, Homo sapiens
caucgucucugauauguca

SEQ ID NO: 630479 - RNA, 19 nt, Homo sapiens
ugacauuguuggcaguuaa

SEQ ID NO: 630480 - RNA, 19 nt, Homo sapiens
gcacaggaguauaaaauau

SEQ ID NO: 630481 - RNA, 19 nt, Homo sapiens
gagcaucaaaccagaauug

SEQ ID NO: 630482 - RNA, 19 nt, Homo sapiens
uaaauaccguguccaaucu

SEQ ID NO: 630483 - RNA, 19 nt, Homo sapiens
agaccaagcuuucuucagu

SEQ ID NO: 630484 - RNA, 19 nt, Homo sapiens
gauaauacugccucugauu

SEQ ID NO: 630485 - RNA, 19 nt, Homo sapiens
guaaccauguagucaggua

SEQ ID NO: 630486 - RNA, 19 nt, Homo sapiens
ccuugaaucugccgacuuu

SEQ ID NO: 630487 - RNA, 19 nt, Homo sapiens
gaccaagcuuucuucaguu

SEQ ID NO: 630488 - RNA, 19 nt, Homo sapiens
acacaagggaucacagaua

SEQ ID NO: 630489 - RNA, 19 nt, Homo sapiens
gauuauugcuuggguuaga

SEQ ID NO: 630490 - RNA, 19 nt, Homo sapiens
cagaacacccgacgugauu

SEQ ID NO: 630491 - RNA, 19 nt, Homo sapiens
gcacuggcgacuucuuaaa

SEQ ID NO: 630492 - RNA, 19 nt, Homo sapiens
ggaauuugcugagaaaaga

SEQ ID NO: 630493 - RNA, 19 nt, Homo sapiens
uaaauuuacugaccaaagc

SEQ ID NO: 630494 - RNA, 19 nt, Homo sapiens
guuagaauaugcccuacug

SEQ ID NO: 630495 - RNA, 19 nt, Homo sapiens
gaagagggaguacccaaag

SEQ ID NO: 630496 - RNA, 19 nt, Homo sapiens
gaagaaacacaagggauca

SEQ ID NO: 630497 - RNA, 19 nt, Homo sapiens
ggagaagagcuugauauuc

SEQ ID NO: 630498 - RNA, 19 nt, Homo sapiens
ucagugcacaggaguauaa

SEQ ID NO: 630499 - RNA, 19 nt, Homo sapiens
ccacaacuagucugacauu

SEQ ID NO: 630500 - RNA, 19 nt, Homo sapiens
gccaugcccuacagauuau

SEQ ID NO: 630501 - RNA, 19 nt, Homo sapiens
ucguuacucuuucagauuu

SEQ ID NO: 630502 - RNA, 19 nt, Homo sapiens
uaacugcaaagauugguuu

SEQ ID NO: 630503 - RNA, 19 nt, Homo sapiens
gaggaaucguuacucuuuc

SEQ ID NO: 630504 - RNA, 19 nt, Homo sapiens
ggacauugccgucgauggu

SEQ ID NO: 630505 - RNA, 19 nt, Homo sapiens
ucguaguccugcugaguua

SEQ ID NO: 630506 - RNA, 19 nt, Homo sapiens
cagauuauugcuuggguua

SEQ ID NO: 630507 - RNA, 19 nt, Homo sapiens
gaacauuuagccuuauugg

SEQ ID NO: 630508 - RNA, 19 nt, Homo sapiens
ucacugcugagcuguauuu

SEQ ID NO: 630509 - RNA, 19 nt, Homo sapiens
uuucuggccuuguuauuug

SEQ ID NO: 630510 - RNA, 19 nt, Homo sapiens
guuacaggaugaaggauca

SEQ ID NO: 630511 - RNA, 19 nt, Homo sapiens
uugguggacuccuaaagua

SEQ ID NO: 630512 - RNA, 19 nt, Homo sapiens
cacaagggaucacagauac

SEQ ID NO: 630513 - RNA, 19 nt, Homo sapiens
gcaauucggugggccaaac

SEQ ID NO: 630514 - RNA, 19 nt, Homo sapiens
guacaaaugaaucuguguu

SEQ ID NO: 630515 - RNA, 19 nt, Homo sapiens
ggaacauacaugacccuuu

SEQ ID NO: 630516 - RNA, 19 nt, Homo sapiens
gccagcaguucugacauuu

SEQ ID NO: 630517 - RNA, 19 nt, Homo sapiens
ggacauucuagcaagguaa

SEQ ID NO: 630518 - RNA, 19 nt, Homo sapiens
gcagguaggagcugguuuc

SEQ ID NO: 630519 - RNA, 19 nt, Homo sapiens
gacugaaauugguagaaga

SEQ ID NO: 630520 - RNA, 19 nt, Homo sapiens
cgaaguaucaguaguaaaa

SEQ ID NO: 630521 - RNA, 19 nt, Homo sapiens
uaauggcuuucaaugcaaa

SEQ ID NO: 630522 - RNA, 19 nt, Homo sapiens
ugaguuaugcuuuacauca

SEQ ID NO: 630523 - RNA, 19 nt, Homo sapiens
ccugcugaguuaugcuuua

SEQ ID NO: 630524 - RNA, 19 nt, Homo sapiens
gguuggugguucuuucuug

SEQ ID NO: 630525 - RNA, 19 nt, Homo sapiens
aaaccagaauugucgaaca

SEQ ID NO: 630526 - RNA, 19 nt, Homo sapiens
uuaaauaccguguccaauc

SEQ ID NO: 630527 - RNA, 19 nt, Homo sapiens
agccaugcccuacagauua

SEQ ID NO: 630528 - RNA, 19 nt, Homo sapiens
gacucuucaugaucuauuu

SEQ ID NO: 630529 - RNA, 19 nt, Homo sapiens
cuaggacucuucaugaucu

SEQ ID NO: 630530 - RNA, 19 nt, Homo sapiens
uugaugcggucuacguuaa

SEQ ID NO: 630531 - RNA, 19 nt, Homo sapiens
agucagguauuguuauuag

SEQ ID NO: 630532 - RNA, 19 nt, Homo sapiens
gguugggcguuaacuaugu

SEQ ID NO: 630533 - RNA, 19 nt, Homo sapiens
uguggaauuugcugagaaa

SEQ ID NO: 630534 - RNA, 19 nt, Homo sapiens
uaucacugcugagcuguau

SEQ ID NO: 630535 - RNA, 19 nt, Homo sapiens
gcaguagucacggguggua

SEQ ID NO: 630536 - RNA, 19 nt, Homo sapiens
uacuuaaggucaggaaauu

SEQ ID NO: 630537 - RNA, 19 nt, Homo sapiens
aauaugcccuacugguuug

SEQ ID NO: 630538 - RNA, 19 nt, Homo sapiens
caagggaucacagauacuu

SEQ ID NO: 630539 - RNA, 19 nt, Homo sapiens
gaacuaagcagcauuuugc

SEQ ID NO: 630540 - RNA, 19 nt, Homo sapiens
ggacucuucaugaucuauu

SEQ ID NO: 630541 - RNA, 19 nt, Homo sapiens
gaugcggucuacguuaaga

SEQ ID NO: 630542 - RNA, 19 nt, Homo sapiens
acuccgggcugcaguaaga

SEQ ID NO: 630543 - RNA, 19 nt, Homo sapiens
gaucaucuucguggaaaug

SEQ ID NO: 630544 - RNA, 19 nt, Homo sapiens
guagauccccucacaguaa

SEQ ID NO: 630545 - RNA, 19 nt, Homo sapiens
gcugaguuaugcuuuacau

SEQ ID NO: 630546 - RNA, 19 nt, Homo sapiens
cuacuacucuuucuuuacg

SEQ ID NO: 630547 - RNA, 19 nt, Homo sapiens
aaacacaagggaucacaga

SEQ ID NO: 630548 - RNA, 19 nt, Homo sapiens
auacuaggacucuucauga

SEQ ID NO: 630549 - RNA, 19 nt, Homo sapiens
caacuuuucuggccuuguu

SEQ ID NO: 630550 - RNA, 19 nt, Homo sapiens
uaaggucaggaaauucuaa

SEQ ID NO: 630551 - RNA, 19 nt, Homo sapiens
ucaaugcaaagguuaguga

SEQ ID NO: 630552 - RNA, 19 nt, Homo sapiens
agaauaugcccuacugguu

SEQ ID NO: 630553 - RNA, 19 nt, Homo sapiens
ugagauaguucacuguuua

SEQ ID NO: 630554 - RNA, 19 nt, Homo sapiens
caauaagacuuccuaacaa

SEQ ID NO: 630555 - RNA, 19 nt, Homo sapiens
uaaaugaucucugcaaaca

SEQ ID NO: 630556 - RNA, 19 nt, Homo sapiens
caagugaguucaagaaucu

SEQ ID NO: 630557 - RNA, 19 nt, Homo sapiens
uaaccaagauuaccugagu

SEQ ID NO: 630558 - RNA, 19 nt, Homo sapiens
ccacaacucuauuuucaua

SEQ ID NO: 630559 - RNA, 19 nt, Homo sapiens
acacacagagguuuauaua

SEQ ID NO: 630560 - RNA, 19 nt, Homo sapiens
gaacacacagagguuuaua

SEQ ID NO: 630561 - RNA, 19 nt, Homo sapiens
ucaauaagacuuccuaaca

SEQ ID NO: 630562 - RNA, 19 nt, Homo sapiens
caucuuauauccuguugga

SEQ ID NO: 630563 - RNA, 19 nt, Homo sapiens
gcuauuccuucuacacauu

SEQ ID NO: 630564 - RNA, 19 nt, Homo sapiens
gaagagaguguggugcuuu

SEQ ID NO: 630565 - RNA, 19 nt, Homo sapiens
uuauaaccauggcaucaua

SEQ ID NO: 630566 - RNA, 19 nt, Homo sapiens
uaaaugggccagauauaau

SEQ ID NO: 630567 - RNA, 19 nt, Homo sapiens
ccaagugaguucaagaauc

SEQ ID NO: 630568 - RNA, 19 nt, Homo sapiens
uauguuacgucaaagaaga

SEQ ID NO: 630569 - RNA, 19 nt, Homo sapiens
uuaaaugggccagauauaa

SEQ ID NO: 630570 - RNA, 19 nt, Homo sapiens
uuuaugguguggcucauua

SEQ ID NO: 630571 - RNA, 19 nt, Homo sapiens
aaccauggcaucauauaua

SEQ ID NO: 630572 - RNA, 19 nt, Homo sapiens
ccacuugccauacuucauu

SEQ ID NO: 630573 - RNA, 19 nt, Homo sapiens
uaaaaccaauccagaauga

SEQ ID NO: 630574 - RNA, 19 nt, Homo sapiens
guaccuacuucugugauug

SEQ ID NO: 630575 - RNA, 19 nt, Homo sapiens
gagauaguucacuguuuaa

SEQ ID NO: 630576 - RNA, 19 nt, Homo sapiens
gaauuguaccuacuucugu

SEQ ID NO: 630577 - RNA, 19 nt, Homo sapiens
ggugaacuucuuacaauau

SEQ ID NO: 630578 - RNA, 19 nt, Homo sapiens
ccgccuggcucaccuucua

SEQ ID NO: 630579 - RNA, 19 nt, Homo sapiens
cuggugaacuucuuacaau

SEQ ID NO: 630580 - RNA, 19 nt, Homo sapiens
caagauuaccugaguccaa

SEQ ID NO: 630581 - RNA, 19 nt, Homo sapiens
gagaggugauuguagaaaa

SEQ ID NO: 630582 - RNA, 19 nt, Homo sapiens
ggaauuguaccuacuucug

SEQ ID NO: 630583 - RNA, 19 nt, Homo sapiens
aaugaucucugcaaacaag

SEQ ID NO: 630584 - RNA, 19 nt, Homo sapiens
uggugaacuucuuacaaua

SEQ ID NO: 630585 - RNA, 19 nt, Homo sapiens
acauuugccuugcuugaga

SEQ ID NO: 630586 - RNA, 19 nt, Homo sapiens
ccagacauuugccuugcuu

SEQ ID NO: 630587 - RNA, 19 nt, Homo sapiens
ggagaggugauuguagaaa

SEQ ID NO: 630588 - RNA, 19 nt, Homo sapiens
ggcaucauauauaccuuug

SEQ ID NO: 630589 - RNA, 19 nt, Homo sapiens
guauucagaagacacuuaa

SEQ ID NO: 630590 - RNA, 19 nt, Homo sapiens
ggugguugguucuagcuau

SEQ ID NO: 630591 - RNA, 19 nt, Homo sapiens
cacuugccauacuucauua

SEQ ID NO: 630592 - RNA, 19 nt, Homo sapiens
acagagaucacucgcuauu

SEQ ID NO: 630593 - RNA, 19 nt, Homo sapiens
guucacuguuuaauuggaa

SEQ ID NO: 630594 - RNA, 19 nt, Homo sapiens
aaaugggccagauauaauu

SEQ ID NO: 630595 - RNA, 19 nt, Homo sapiens
cuauugccaugguacguuu

SEQ ID NO: 630596 - RNA, 19 nt, Homo sapiens
uccagaauaaccaagauua

SEQ ID NO: 630597 - RNA, 19 nt, Homo sapiens
gauuaaaugaucucugcaa

SEQ ID NO: 630598 - RNA, 19 nt, Homo sapiens
gugguugguucuagcuauu

SEQ ID NO: 630599 - RNA, 19 nt, Homo sapiens
ggaacacacagagguuuau

SEQ ID NO: 630600 - RNA, 19 nt, Homo sapiens
uaaccauggcaucauauau

SEQ ID NO: 630601 - RNA, 19 nt, Homo sapiens
ccuaacaaauacaaugucu

SEQ ID NO: 630602 - RNA, 19 nt, Homo sapiens
cuuauauccuguuggaguu

SEQ ID NO: 630603 - RNA, 19 nt, Homo sapiens
ugguguggcucauuacuca

SEQ ID NO: 630604 - RNA, 19 nt, Homo sapiens
cauauguuacgucaaagaa

SEQ ID NO: 630605 - RNA, 19 nt, Homo sapiens
auggagaggugauuguaga

SEQ ID NO: 630606 - RNA, 19 nt, Homo sapiens
uugagauaguucacuguuu

SEQ ID NO: 630607 - RNA, 19 nt, Homo sapiens
gcuggugaacuucuuacaa

SEQ ID NO: 630608 - RNA, 19 nt, Homo sapiens
aaaccaauccagaaugaag

SEQ ID NO: 630609 - RNA, 19 nt, Homo sapiens
cacacagagguuuauauaa

SEQ ID NO: 630610 - RNA, 19 nt, Homo sapiens
agagaucacucgcuauucc

SEQ ID NO: 630611 - RNA, 19 nt, Homo sapiens
ugaagagaguguggugcuu

SEQ ID NO: 630612 - RNA, 19 nt, Homo sapiens
aaaggaacacacagagguu

SEQ ID NO: 630613 - RNA, 19 nt, Homo sapiens
gaacuucuuacaauauacg

SEQ ID NO: 630614 - RNA, 19 nt, Homo sapiens
agacauuugccuugcuuga

SEQ ID NO: 630615 - RNA, 19 nt, Homo sapiens
aggaacacacagagguuua

SEQ ID NO: 630616 - RNA, 19 nt, Homo sapiens
caaugucucuuuugacuac

SEQ ID NO: 630617 - RNA, 19 nt, Homo sapiens
gauuaccugaguccaaguu

SEQ ID NO: 630618 - RNA, 19 nt, Homo sapiens
uguaccuacuucugugauu

SEQ ID NO: 630619 - RNA, 19 nt, Homo sapiens
ucauggagaggugauugua

SEQ ID NO: 630620 - RNA, 19 nt, Homo sapiens
gcuauugccaugguacguu

SEQ ID NO: 630621 - RNA, 19 nt, Homo sapiens
guauaaaaccaauccagaa

SEQ ID NO: 630622 - RNA, 19 nt, Homo sapiens
guccaagugaguucaagaa

SEQ ID NO: 630623 - RNA, 19 nt, Homo sapiens
ccagaauaaccaagauuac

SEQ ID NO: 630624 - RNA, 19 nt, Homo sapiens
aguauucagaagacacuua

SEQ ID NO: 630625 - RNA, 19 nt, Homo sapiens
auaaccauggcaucauaua

SEQ ID NO: 630626 - RNA, 19 nt, Homo sapiens
gcacaucacuguagaauuu

SEQ ID NO: 630627 - RNA, 19 nt, Homo sapiens
guagguagauuccauauua

SEQ ID NO: 630628 - RNA, 19 nt, Homo sapiens
ggaauaagauccugugauu

SEQ ID NO: 630629 - RNA, 19 nt, Homo sapiens
gaacguggcagguuuauaa

SEQ ID NO: 630630 - RNA, 19 nt, Homo sapiens
guagaaaucuugaguaauc

SEQ ID NO: 630631 - RNA, 19 nt, Homo sapiens
gcacauugaucuucacuug

SEQ ID NO: 630632 - RNA, 19 nt, Homo sapiens
gaacaacguuucuauaguc

SEQ ID NO: 630633 - RNA, 19 nt, Homo sapiens
guagaaagaucgacugcua

SEQ ID NO: 630634 - RNA, 19 nt, Homo sapiens
gaaacuauggucuacauua

SEQ ID NO: 630635 - RNA, 19 nt, Homo sapiens
uaauauagcucucuuaugg

SEQ ID NO: 630636 - RNA, 19 nt, Homo sapiens
gucaguagcuggaaagaua

SEQ ID NO: 630637 - RNA, 19 nt, Homo sapiens
gaggaacacugaacuaguu

SEQ ID NO: 630638 - RNA, 19 nt, Homo sapiens
caaauugucuccacaugaa

SEQ ID NO: 630639 - RNA, 19 nt, Homo sapiens
caacugaacuguaucuugu

SEQ ID NO: 630640 - RNA, 19 nt, Homo sapiens
caaaggagcucauuaccau

SEQ ID NO: 630641 - RNA, 19 nt, Homo sapiens
gcacagaacaccagaaaga

SEQ ID NO: 630642 - RNA, 19 nt, Homo sapiens
guaccuauguucucuguuu

SEQ ID NO: 630643 - RNA, 19 nt, Homo sapiens
caaggaauguguagaaaga

SEQ ID NO: 630644 - RNA, 19 nt, Homo sapiens
gcaccaagauggcagcaaa

SEQ ID NO: 630645 - RNA, 19 nt, Homo sapiens
caagauggcugaggagaaa

SEQ ID NO: 630646 - RNA, 19 nt, Homo sapiens
gcuaggaucugcaguaugu

SEQ ID NO: 630647 - RNA, 19 nt, Homo sapiens
guaauuugcugcuaauaga

SEQ ID NO: 630648 - RNA, 19 nt, Homo sapiens
gaaaacggcucauuccuuu

SEQ ID NO: 630649 - RNA, 19 nt, Homo sapiens
gaucuaugcugaauaaaca

SEQ ID NO: 630650 - RNA, 19 nt, Homo sapiens
cagaaaugcugcuuccaua

SEQ ID NO: 630651 - RNA, 19 nt, Homo sapiens
gaucuucacuugcugcauu

SEQ ID NO: 630652 - RNA, 19 nt, Homo sapiens
guagacauguguucauauu

SEQ ID NO: 630653 - RNA, 19 nt, Homo sapiens
aaacggagaucgauacuuc

SEQ ID NO: 630654 - RNA, 19 nt, Homo sapiens
gcacaaggcaugcugacua

SEQ ID NO: 630655 - RNA, 19 nt, Homo sapiens
gaaagaguguuggugugua

SEQ ID NO: 630656 - RNA, 19 nt, Homo sapiens
cagcagguguaaucacuua

SEQ ID NO: 630657 - RNA, 19 nt, Homo sapiens
gcacgguucuuucuucuuc

SEQ ID NO: 630658 - RNA, 19 nt, Homo sapiens
caaucuacaucuaguauga

SEQ ID NO: 630659 - RNA, 19 nt, Homo sapiens
gagcaucccuggguuaaug

SEQ ID NO: 630660 - RNA, 19 nt, Homo sapiens
caauaucguucuucugauu

SEQ ID NO: 630661 - RNA, 19 nt, Homo sapiens
gaugguaauuugcugcuaa

SEQ ID NO: 630662 - RNA, 19 nt, Homo sapiens
ccaggaauguauuggauaa

SEQ ID NO: 630663 - RNA, 19 nt, Homo sapiens
cagagaaccugcuggugua

SEQ ID NO: 630664 - RNA, 19 nt, Homo sapiens
ggcauuaacuauauugcua

SEQ ID NO: 630665 - RNA, 19 nt, Homo sapiens
agggauaucucaugaaauu

SEQ ID NO: 630666 - RNA, 19 nt, Homo sapiens
ggaacacaauccagaaugu

SEQ ID NO: 630667 - RNA, 19 nt, Homo sapiens
gggauaaggcgcagagaua

SEQ ID NO: 630668 - RNA, 19 nt, Homo sapiens
acacacauguuucuugauu

SEQ ID NO: 630669 - RNA, 19 nt, Homo sapiens
gaugauggccucccagaaa

SEQ ID NO: 630670 - RNA, 19 nt, Homo sapiens
gggauaauguuuccgauuc

SEQ ID NO: 630671 - RNA, 19 nt, Homo sapiens
gaugauuucuugcuagaug

SEQ ID NO: 630672 - RNA, 19 nt, Homo sapiens
gagcagguccucaccgaua

SEQ ID NO: 630673 - RNA, 19 nt, Homo sapiens
ggaaggagagaguuaugua

SEQ ID NO: 630674 - RNA, 19 nt, Homo sapiens
caaaguagcauaaaucagu

SEQ ID NO: 630675 - RNA, 19 nt, Homo sapiens
gaagaaggccaagaaaguu

SEQ ID NO: 630676 - RNA, 19 nt, Homo sapiens
guuguuagaugcugaaaug

SEQ ID NO: 630677 - RNA, 19 nt, Homo sapiens
gaacaucagcugucaguag

SEQ ID NO: 630678 - RNA, 19 nt, Homo sapiens
ugaaagaccuagaugauac

SEQ ID NO: 630679 - RNA, 19 nt, Homo sapiens
ccauagagcccuucaagaa

SEQ ID NO: 630680 - RNA, 19 nt, Homo sapiens
ggagaucgauacuucaaag

SEQ ID NO: 630681 - RNA, 19 nt, Homo sapiens
ugucagagauguacucaga

SEQ ID NO: 630682 - RNA, 19 nt, Homo sapiens
gcacuguggucaucacugu

SEQ ID NO: 630683 - RNA, 19 nt, Homo sapiens
ucacaauccuauucagaaa

SEQ ID NO: 630684 - RNA, 19 nt, Homo sapiens
acacugaacuaguuggaaa

SEQ ID NO: 630685 - RNA, 19 nt, Homo sapiens
gaagcugggugacuuugga

SEQ ID NO: 630686 - RNA, 19 nt, Homo sapiens
gaaguuccguuaccaggau

SEQ ID NO: 630687 - RNA, 19 nt, Homo sapiens
cuaccaagauccugaaugu

SEQ ID NO: 630688 - RNA, 19 nt, Homo sapiens
ggaaagauaaagaagcauu

SEQ ID NO: 630689 - RNA, 19 nt, Homo sapiens
ggacuuuccuucuccauac

SEQ ID NO: 630690 - RNA, 19 nt, Homo sapiens
gcagcucgauggaugagaa

SEQ ID NO: 630691 - RNA, 19 nt, Homo sapiens
ggauaucucaugaaauuug

SEQ ID NO: 630692 - RNA, 19 nt, Homo sapiens
cgauguagaucagcgauuu

SEQ ID NO: 630693 - RNA, 19 nt, Homo sapiens
gcaaagagcacaugaucca

SEQ ID NO: 630694 - RNA, 19 nt, Homo sapiens
ucaaagggauuguguaugc

SEQ ID NO: 630695 - RNA, 19 nt, Homo sapiens
aaucaucucuguagacaug

SEQ ID NO: 630696 - RNA, 19 nt, Homo sapiens
aauaaacaguggaauguga

SEQ ID NO: 630697 - RNA, 19 nt, Homo sapiens
agagggauaucucaugaaa

SEQ ID NO: 630698 - RNA, 19 nt, Homo sapiens
gaauuugagugaucuaugc

SEQ ID NO: 630699 - RNA, 19 nt, Homo sapiens
gugcauggcucaggccuuu

SEQ ID NO: 630700 - RNA, 19 nt, Homo sapiens
gaugacacguggugauugu

SEQ ID NO: 630701 - RNA, 19 nt, Homo sapiens
gcagguguaaucacuuaua

SEQ ID NO: 630702 - RNA, 19 nt, Homo sapiens
gagugaagcaucccaauau

SEQ ID NO: 630703 - RNA, 19 nt, Homo sapiens
agccagugcuuucuaauuu

SEQ ID NO: 630704 - RNA, 19 nt, Homo sapiens
gaagggcagcucagaagaa

SEQ ID NO: 630705 - RNA, 19 nt, Homo sapiens
gaugaaagaccuagaugau

SEQ ID NO: 630706 - RNA, 19 nt, Homo sapiens
uggcagaacugaaaguguu

SEQ ID NO: 630707 - RNA, 19 nt, Homo sapiens
uaaaucaucucuguagaca

SEQ ID NO: 630708 - RNA, 19 nt, Homo sapiens
gaaaugcugcuuccauauc

SEQ ID NO: 630709 - RNA, 19 nt, Homo sapiens
gaucugcaguauguaauau

SEQ ID NO: 630710 - RNA, 19 nt, Homo sapiens
aguccuagcuuaacccuuu

SEQ ID NO: 630711 - RNA, 19 nt, Homo sapiens
ccaccgcucuugauaagga

SEQ ID NO: 630712 - RNA, 19 nt, Homo sapiens
gaccaccgcucuugauaag

SEQ ID NO: 630713 - RNA, 19 nt, Homo sapiens
cagaaugaagugucuauuu

SEQ ID NO: 630714 - RNA, 19 nt, Homo sapiens
aagcaaaugucgaggcaaa

SEQ ID NO: 630715 - RNA, 19 nt, Homo sapiens
acggaaagcugucaggauu

SEQ ID NO: 630716 - RNA, 19 nt, Homo sapiens
uaccguagcccucaucuaa

SEQ ID NO: 630717 - RNA, 19 nt, Homo sapiens
agugaucuaugcugaauaa

SEQ ID NO: 630718 - RNA, 19 nt, Homo sapiens
guggcagguuuauaacuua

SEQ ID NO: 630719 - RNA, 19 nt, Homo sapiens
gaucagggucuuuggacua

SEQ ID NO: 630720 - RNA, 19 nt, Homo sapiens
gaccacggguuuaccauca

SEQ ID NO: 630721 - RNA, 19 nt, Homo sapiens
ccagugggaugcuguacaa

SEQ ID NO: 630722 - RNA, 19 nt, Homo sapiens
uaaagucggaagaacaaua

SEQ ID NO: 630723 - RNA, 19 nt, Homo sapiens
ggaaugcaaucuuucuaac

SEQ ID NO: 630724 - RNA, 19 nt, Homo sapiens
ucaaauguauucccaaggu

SEQ ID NO: 630725 - RNA, 19 nt, Homo sapiens
gcuggaauuucaaacagaa

SEQ ID NO: 630726 - RNA, 19 nt, Homo sapiens
gaacaaagcuuuauuaugc

SEQ ID NO: 630727 - RNA, 19 nt, Homo sapiens
gaaagaauaugaacugaga

SEQ ID NO: 630728 - RNA, 19 nt, Homo sapiens
gcaaaggaaugauguguuu

SEQ ID NO: 630729 - RNA, 19 nt, Homo sapiens
gcaaacagcugggcgcuua

SEQ ID NO: 630730 - RNA, 19 nt, Homo sapiens
gaaguggucuugauugauu

SEQ ID NO: 630731 - RNA, 19 nt, Homo sapiens
ccacagaaauauucccuua

SEQ ID NO: 630732 - RNA, 19 nt, Homo sapiens
gaaugcauguccaaauaua

SEQ ID NO: 630733 - RNA, 19 nt, Homo sapiens
gaaagggucuacucagcua

SEQ ID NO: 630734 - RNA, 19 nt, Homo sapiens
ccaauaaacuauccagaaa

SEQ ID NO: 630735 - RNA, 19 nt, Homo sapiens
gaagugagguucuuauuuu

SEQ ID NO: 630736 - RNA, 19 nt, Homo sapiens
gaaaacagaugacuuguga

SEQ ID NO: 630737 - RNA, 19 nt, Homo sapiens
gcccagaacccuaaauuua

SEQ ID NO: 630738 - RNA, 19 nt, Homo sapiens
ggauuucauuugcauguua

SEQ ID NO: 630739 - RNA, 19 nt, Homo sapiens
gaaacgaaaugaagaugau

SEQ ID NO: 630740 - RNA, 19 nt, Homo sapiens
ucaaacagaugcccugaaa

SEQ ID NO: 630741 - RNA, 19 nt, Homo sapiens
ccaaacaguuccucuuauu

SEQ ID NO: 630742 - RNA, 19 nt, Homo sapiens
ggagguacaugaagaacuu

SEQ ID NO: 630743 - RNA, 19 nt, Homo sapiens
ccaaauacuuccaacuaaa

SEQ ID NO: 630744 - RNA, 19 nt, Homo sapiens
aagaaugcauguccaaaua

SEQ ID NO: 630745 - RNA, 19 nt, Homo sapiens
uuagacaucuucagaauga

SEQ ID NO: 630746 - RNA, 19 nt, Homo sapiens
ggaaaucacuguaaaaugu

SEQ ID NO: 630747 - RNA, 19 nt, Homo sapiens
ccagaacccuaaauuuauu

SEQ ID NO: 630748 - RNA, 19 nt, Homo sapiens
gaagaguucuguugugaag

SEQ ID NO: 630749 - RNA, 19 nt, Homo sapiens
gaaguuaauuaccagaaug

SEQ ID NO: 630750 - RNA, 19 nt, Homo sapiens
aggaagagcugaaucacua

SEQ ID NO: 630751 - RNA, 19 nt, Homo sapiens
acagacaucucccaaauug

SEQ ID NO: 630752 - RNA, 19 nt, Homo sapiens
ggaagugagguucuuauuu

SEQ ID NO: 630753 - RNA, 19 nt, Homo sapiens
agacucugauguugaauua

SEQ ID NO: 630754 - RNA, 19 nt, Homo sapiens
gaacuuaccaaacucuuga

SEQ ID NO: 630755 - RNA, 19 nt, Homo sapiens
gaagauaaagucacagaga

SEQ ID NO: 630756 - RNA, 19 nt, Homo sapiens
gaggagagaucaguacaga

SEQ ID NO: 630757 - RNA, 19 nt, Homo sapiens
ccauaccucuucaccuuua

SEQ ID NO: 630758 - RNA, 19 nt, Homo sapiens
gaaaauuagugcuguguuu

SEQ ID NO: 630759 - RNA, 19 nt, Homo sapiens
caaaccaacuggaaugaau

SEQ ID NO: 630760 - RNA, 19 nt, Homo sapiens
gaaaacuucuuacuccaua

SEQ ID NO: 630761 - RNA, 19 nt, Homo sapiens
ccucuugacuugaccauaa

SEQ ID NO: 630762 - RNA, 19 nt, Homo sapiens
ugaagacucugauguugaa

SEQ ID NO: 630763 - RNA, 19 nt, Homo sapiens
ugauaagucugccaauaaa

SEQ ID NO: 630764 - RNA, 19 nt, Homo sapiens
uaaagcauuuggaagauga

SEQ ID NO: 630765 - RNA, 19 nt, Homo sapiens
gaauaugaacugagaaaug

SEQ ID NO: 630766 - RNA, 19 nt, Homo sapiens
ggaccaggacucugaagua

SEQ ID NO: 630767 - RNA, 19 nt, Homo sapiens
gagggaaaguggaagaguu

SEQ ID NO: 630768 - RNA, 19 nt, Homo sapiens
caugucagauggaaguaua

SEQ ID NO: 630769 - RNA, 19 nt, Homo sapiens
ucagaagaaugcuguuauu

SEQ ID NO: 630770 - RNA, 19 nt, Homo sapiens
acagaaauauucccuuaga

SEQ ID NO: 630771 - RNA, 19 nt, Homo sapiens
gaugauauuccacaaacua

SEQ ID NO: 630772 - RNA, 19 nt, Homo sapiens
guagagaacugaguauagu

SEQ ID NO: 630773 - RNA, 19 nt, Homo sapiens
ugacauaucugagguucuu

SEQ ID NO: 630774 - RNA, 19 nt, Homo sapiens
caaguucaguguaacaguu

SEQ ID NO: 630775 - RNA, 19 nt, Homo sapiens
aaaugaagaugaugagguu

SEQ ID NO: 630776 - RNA, 19 nt, Homo sapiens
gaaccuacaauacuuccua

SEQ ID NO: 630777 - RNA, 19 nt, Homo sapiens
gaagaaugcauguccaaau

SEQ ID NO: 630778 - RNA, 19 nt, Homo sapiens
gcuaacaaccucaccauga

SEQ ID NO: 630779 - RNA, 19 nt, Homo sapiens
ggucauuccucauaagugu

SEQ ID NO: 630780 - RNA, 19 nt, Homo sapiens
gaggacaaauaauuggauu

SEQ ID NO: 630781 - RNA, 19 nt, Homo sapiens
cuccauaccuuguucgaua

SEQ ID NO: 630782 - RNA, 19 nt, Homo sapiens
caucuucaauggauaguga

SEQ ID NO: 630783 - RNA, 19 nt, Homo sapiens
guuaauugcuuaucugcuu

SEQ ID NO: 630784 - RNA, 19 nt, Homo sapiens
gagcuuuucuguucuguua

SEQ ID NO: 630785 - RNA, 19 nt, Homo sapiens
gaaaacaccaccacuagua

SEQ ID NO: 630786 - RNA, 19 nt, Homo sapiens
ccaauacccagauaaauga

SEQ ID NO: 630787 - RNA, 19 nt, Homo sapiens
ccagaaauagcaaguguaa

SEQ ID NO: 630788 - RNA, 19 nt, Homo sapiens
agagguagcuuuggaguga

SEQ ID NO: 630789 - RNA, 19 nt, Homo sapiens
aguaacaaaucguggaaua

SEQ ID NO: 630790 - RNA, 19 nt, Homo sapiens
gcagugauauaguucuuag

SEQ ID NO: 630791 - RNA, 19 nt, Homo sapiens
ggaugacacugaaauacau

SEQ ID NO: 630792 - RNA, 19 nt, Homo sapiens
uagugaagguugcaaauug

SEQ ID NO: 630793 - RNA, 19 nt, Homo sapiens
cuaacaaccucaccaugaa

SEQ ID NO: 630794 - RNA, 19 nt, Homo sapiens
auaguaaccuuagaccuua

SEQ ID NO: 630795 - RNA, 19 nt, Homo sapiens
gaacacgaacucuuucuag

SEQ ID NO: 630796 - RNA, 19 nt, Homo sapiens
cagaaaugauugcagaaga

SEQ ID NO: 630797 - RNA, 19 nt, Homo sapiens
uuacagacaucucccaaau

SEQ ID NO: 630798 - RNA, 19 nt, Homo sapiens
caacaaaccaacuggaaug

SEQ ID NO: 630799 - RNA, 19 nt, Homo sapiens
gaaaaucuguggagccuau

SEQ ID NO: 630800 - RNA, 19 nt, Homo sapiens
gugaaguggucuugauuga

SEQ ID NO: 630801 - RNA, 19 nt, Homo sapiens
ccagauaaacugacuguug

SEQ ID NO: 630802 - RNA, 19 nt, Homo sapiens
ccaaacuucugaacacgaa

SEQ ID NO: 630803 - RNA, 19 nt, Homo sapiens
ccucagcaauuccucagua

SEQ ID NO: 630804 - RNA, 19 nt, Homo sapiens
caagaacuguaugaaagaa

SEQ ID NO: 630805 - RNA, 19 nt, Homo sapiens
gaauguuacugagcacuug

SEQ ID NO: 630806 - RNA, 19 nt, Homo sapiens
ucacagagaguauugaaga

SEQ ID NO: 630807 - RNA, 19 nt, Homo sapiens
ccaaaugugaugcuuguaa

SEQ ID NO: 630808 - RNA, 19 nt, Homo sapiens
gucaacauaugaacugaaa

SEQ ID NO: 630809 - RNA, 19 nt, Homo sapiens
gcaaaccugugagugauuc

SEQ ID NO: 630810 - RNA, 19 nt, Homo sapiens
gacaccauguuaacacgua

SEQ ID NO: 630811 - RNA, 19 nt, Homo sapiens
ggaaacgaaaugaagauga

SEQ ID NO: 630812 - RNA, 19 nt, Homo sapiens
cuacaauacuuccuaaugg

SEQ ID NO: 630813 - RNA, 19 nt, Homo sapiens
gauaaagucacagagagua

SEQ ID NO: 630814 - RNA, 19 nt, Homo sapiens
gacaugaaguuaauuacca

SEQ ID NO: 630815 - RNA, 19 nt, Homo sapiens
cgauauggaggacaaauaa

SEQ ID NO: 630816 - RNA, 19 nt, Homo sapiens
caaacaguuccucuuauuu

SEQ ID NO: 630817 - RNA, 19 nt, Homo sapiens
gcacuugaagcuuuccuuu

SEQ ID NO: 630818 - RNA, 19 nt, Homo sapiens
uacagaaaccacagaaaua

SEQ ID NO: 630819 - RNA, 19 nt, Homo sapiens
gcaccaaacugugaaugca

SEQ ID NO: 630820 - RNA, 19 nt, Homo sapiens
ggagucagaaccagauaaa

SEQ ID NO: 630821 - RNA, 19 nt, Homo sapiens
gaagaggacggaagaaguc

SEQ ID NO: 630822 - RNA, 19 nt, Homo sapiens
gaaucacuaugccuuaaag

SEQ ID NO: 630823 - RNA, 19 nt, Homo sapiens
ugagauggcagaaaugauu

SEQ ID NO: 630824 - RNA, 19 nt, Homo sapiens
cagcaaauauuuccauggu

SEQ ID NO: 630825 - RNA, 19 nt, Homo sapiens
ucuguaaccugcuuuguau

SEQ ID NO: 630826 - RNA, 19 nt, Homo sapiens
ggucuuaucugaaagguaa

SEQ ID NO: 630827 - RNA, 19 nt, Homo sapiens
ggaagacugugaccuguuu

SEQ ID NO: 630828 - RNA, 19 nt, Homo sapiens
gagaaacucuugcaugaga

SEQ ID NO: 630829 - RNA, 19 nt, Homo sapiens
aaacaggacuucacuaaga

SEQ ID NO: 630830 - RNA, 19 nt, Homo sapiens
caaaggaagucaaacagaa

SEQ ID NO: 630831 - RNA, 19 nt, Homo sapiens
acaauuagcuucuggcaaa

SEQ ID NO: 630832 - RNA, 19 nt, Homo sapiens
aaacaaggcugccaugugu

SEQ ID NO: 630833 - RNA, 19 nt, Homo sapiens
gagaugaaguccaaaggaa

SEQ ID NO: 630834 - RNA, 19 nt, Homo sapiens
gcaagacccuguguaagaa

SEQ ID NO: 630835 - RNA, 19 nt, Homo sapiens
ggacauuaaucccagugua

SEQ ID NO: 630836 - RNA, 19 nt, Homo sapiens
guaccgggcucaacuauuc

SEQ ID NO: 630837 - RNA, 19 nt, Homo sapiens
gauaugaaccugacaguau

SEQ ID NO: 630838 - RNA, 19 nt, Homo sapiens
caaaaggucuuaucugaaa

SEQ ID NO: 630839 - RNA, 19 nt, Homo sapiens
gaugggaucuguggucaaa

SEQ ID NO: 630840 - RNA, 19 nt, Homo sapiens
cgacuaaccuucugucucu

SEQ ID NO: 630841 - RNA, 19 nt, Homo sapiens
gagaggaucuacuggaauc

SEQ ID NO: 630842 - RNA, 19 nt, Homo sapiens
ggcagagaaugacuaagua

SEQ ID NO: 630843 - RNA, 19 nt, Homo sapiens
gaacucaacaagucucuga

SEQ ID NO: 630844 - RNA, 19 nt, Homo sapiens
agaauccucuggacauuaa

SEQ ID NO: 630845 - RNA, 19 nt, Homo sapiens
gcuacucgcugcagcauau

SEQ ID NO: 630846 - RNA, 19 nt, Homo sapiens
gcaagaaggagaucuggaa

SEQ ID NO: 630847 - RNA, 19 nt, Homo sapiens
gagaccaccuccauagcua

SEQ ID NO: 630848 - RNA, 19 nt, Homo sapiens
guuaauagcucuggugauc

SEQ ID NO: 630849 - RNA, 19 nt, Homo sapiens
guaagccacugaugcagaa

SEQ ID NO: 630850 - RNA, 19 nt, Homo sapiens
uaucacauguggaucguaa

SEQ ID NO: 630851 - RNA, 19 nt, Homo sapiens
caacaguucucagaccaaa

SEQ ID NO: 630852 - RNA, 19 nt, Homo sapiens
ggagagcacagacaagauu

SEQ ID NO: 630853 - RNA, 19 nt, Homo sapiens
gagaacagcaacacaguga

SEQ ID NO: 630854 - RNA, 19 nt, Homo sapiens
gaggcagacuucccuaaga

SEQ ID NO: 630855 - RNA, 19 nt, Homo sapiens
ggaaucaacaguucucaga

SEQ ID NO: 630856 - RNA, 19 nt, Homo sapiens
ggaugugucuacugaacaa

SEQ ID NO: 630857 - RNA, 19 nt, Homo sapiens
aggagaaacucuugcauga

SEQ ID NO: 630858 - RNA, 19 nt, Homo sapiens
gggcuuacaucuacaccaa

SEQ ID NO: 630859 - RNA, 19 nt, Homo sapiens
cauccugccucaccacuuu

SEQ ID NO: 630860 - RNA, 19 nt, Homo sapiens
gcagugggcaccaagauga

SEQ ID NO: 630861 - RNA, 19 nt, Homo sapiens
gcuccagauucuccaauaa

SEQ ID NO: 630862 - RNA, 19 nt, Homo sapiens
gggcucaacuauucauaug

SEQ ID NO: 630863 - RNA, 19 nt, Homo sapiens
ggauggagccacugaguug

SEQ ID NO: 630864 - RNA, 19 nt, Homo sapiens
gagcaccucugggagugua

SEQ ID NO: 630865 - RNA, 19 nt, Homo sapiens
uaagaauccucuggacauu

SEQ ID NO: 630866 - RNA, 19 nt, Homo sapiens
cgagucaccucucugguau

SEQ ID NO: 630867 - RNA, 19 nt, Homo sapiens
caacucuccuucaccaaug

SEQ ID NO: 630868 - RNA, 19 nt, Homo sapiens
gggauggaaucaacaguuc

SEQ ID NO: 630869 - RNA, 19 nt, Homo sapiens
uaugggaccuugagucaug

SEQ ID NO: 630870 - RNA, 19 nt, Homo sapiens
cagagggacuccuggaaga

SEQ ID NO: 630871 - RNA, 19 nt, Homo sapiens
acaaacaggacuucacuaa

SEQ ID NO: 630872 - RNA, 19 nt, Homo sapiens
gccaaaaggucuuaucuga

SEQ ID NO: 630873 - RNA, 19 nt, Homo sapiens
ggaggaagaccuggacuga

SEQ ID NO: 630874 - RNA, 19 nt, Homo sapiens
gcccaauggugaacgauau

SEQ ID NO: 630875 - RNA, 19 nt, Homo sapiens
ggauucugaugccauggua

SEQ ID NO: 630876 - RNA, 19 nt, Homo sapiens
gcauuccagugucagauga

SEQ ID NO: 630877 - RNA, 19 nt, Homo sapiens
guaacugccucccuuuagu

SEQ ID NO: 630878 - RNA, 19 nt, Homo sapiens
caguacauauccagccaua

SEQ ID NO: 630879 - RNA, 19 nt, Homo sapiens
gcucaacuauucauauggu

SEQ ID NO: 630880 - RNA, 19 nt, Homo sapiens
gcugugugcugcuguacaa

SEQ ID NO: 630881 - RNA, 19 nt, Homo sapiens
gcuuguagccuuugcacua

SEQ ID NO: 630882 - RNA, 19 nt, Homo sapiens
ccacuucuuucccuguuga

SEQ ID NO: 630883 - RNA, 19 nt, Homo sapiens
caucuuagguugccaugag

SEQ ID NO: 630884 - RNA, 19 nt, Homo sapiens
gaaaucacucggcccaaug

SEQ ID NO: 630885 - RNA, 19 nt, Homo sapiens
ugcagaggcugaggaguua

SEQ ID NO: 630886 - RNA, 19 nt, Homo sapiens
gaaccaacccaaccuggau

SEQ ID NO: 630887 - RNA, 19 nt, Homo sapiens
gcuuacaucuacaccaaga

SEQ ID NO: 630888 - RNA, 19 nt, Homo sapiens
gcagacagcugaggaacac

SEQ ID NO: 630889 - RNA, 19 nt, Homo sapiens
ggccucaucugaccuuugu

SEQ ID NO: 630890 - RNA, 19 nt, Homo sapiens
gggcagauccgucauuucu

SEQ ID NO: 630891 - RNA, 19 nt, Homo sapiens
uaagaacuuugagaugcua

SEQ ID NO: 630892 - RNA, 19 nt, Homo sapiens
ccaugugucuggugcaaga

SEQ ID NO: 630893 - RNA, 19 nt, Homo sapiens
aaacccagcugccuucucu

SEQ ID NO: 630894 - RNA, 19 nt, Homo sapiens
gcccuggaccugcuugaua

SEQ ID NO: 630895 - RNA, 19 nt, Homo sapiens
ggaagcugcuggagaccau

SEQ ID NO: 630896 - RNA, 19 nt, Homo sapiens
gaaacucuugcaugagaaa

SEQ ID NO: 630897 - RNA, 19 nt, Homo sapiens
gcauucaccugagcuguca

SEQ ID NO: 630898 - RNA, 19 nt, Homo sapiens
ggugcaagacccuguguaa

SEQ ID NO: 630899 - RNA, 19 nt, Homo sapiens
cuccauagcuacugcaaga

SEQ ID NO: 630900 - RNA, 19 nt, Homo sapiens
aaaacuaccuucugacuug

SEQ ID NO: 630901 - RNA, 19 nt, Homo sapiens
gcgcgagauuuaugaggaa

SEQ ID NO: 630902 - RNA, 19 nt, Homo sapiens
gcaacgauguguucuaccu

SEQ ID NO: 630903 - RNA, 19 nt, Homo sapiens
cugaggaugugucuacuga

SEQ ID NO: 630904 - RNA, 19 nt, Homo sapiens
ggagaugaaguccaaagga

SEQ ID NO: 630905 - RNA, 19 nt, Homo sapiens
ucuuuaugcuucagaguaa

SEQ ID NO: 630906 - RNA, 19 nt, Homo sapiens
ucacggaccuuuacuaccu

SEQ ID NO: 630907 - RNA, 19 nt, Homo sapiens
gaggaugugucuacugaac

SEQ ID NO: 630908 - RNA, 19 nt, Homo sapiens
caguguagacuuccucuuu

SEQ ID NO: 630909 - RNA, 19 nt, Homo sapiens
caucugaccuuugugaucu

SEQ ID NO: 630910 - RNA, 19 nt, Homo sapiens
uugaggagcugaaggugaa

SEQ ID NO: 630911 - RNA, 19 nt, Homo sapiens
guacauauccagccauacu

SEQ ID NO: 630912 - RNA, 19 nt, Homo sapiens
ccuguugacuuugcuguuu

SEQ ID NO: 630913 - RNA, 19 nt, Homo sapiens
gcaacucuccuucaccaau

SEQ ID NO: 630914 - RNA, 19 nt, Homo sapiens
guguagacuuccucuuuga

SEQ ID NO: 630915 - RNA, 19 nt, Homo sapiens
gacacccucucaaaccaaa

SEQ ID NO: 630916 - RNA, 19 nt, Homo sapiens
caaaagcgguucugcaaca

SEQ ID NO: 630917 - RNA, 19 nt, Homo sapiens
gauucuugcuucuccaaau

SEQ ID NO: 630918 - RNA, 19 nt, Homo sapiens
gugaugagcugcgcuuugg

SEQ ID NO: 630919 - RNA, 19 nt, Homo sapiens
guagacuuccucuuugauu

SEQ ID NO: 630920 - RNA, 19 nt, Homo sapiens
gcccugagcuccucuucca

SEQ ID NO: 630921 - RNA, 19 nt, Homo sapiens
uagacuuccucuuugauug

SEQ ID NO: 630922 - RNA, 19 nt, Homo sapiens
aggcagacuucccuaagaa

SEQ ID NO: 630923 - RNA, 19 nt, Homo sapiens
ccaaaggaagucaaacaga

SEQ ID NO: 630924 - RNA, 19 nt, Homo sapiens
ggaccaaguguuccaguuc

SEQ ID NO: 630925 - RNA, 19 nt, Homo sapiens
guaagaacuuugagaugcu

SEQ ID NO: 630926 - RNA, 19 nt, Homo sapiens
gaagaaaucuauucguuug

SEQ ID NO: 630927 - RNA, 19 nt, Homo sapiens
ccaaauagcugugggcuuu

SEQ ID NO: 630928 - RNA, 19 nt, Homo sapiens
ggaagaugcuaugaaauuu

SEQ ID NO: 630929 - RNA, 19 nt, Homo sapiens
caacaagugucacggcaua

SEQ ID NO: 630930 - RNA, 19 nt, Homo sapiens
cagcaaagaucauucaaga

SEQ ID NO: 630931 - RNA, 19 nt, Homo sapiens
gauacucgauuugaaguua

SEQ ID NO: 630932 - RNA, 19 nt, Homo sapiens
gcaaagaucauucaagaug

SEQ ID NO: 630933 - RNA, 19 nt, Homo sapiens
gaggcaacauuaaacauuu

SEQ ID NO: 630934 - RNA, 19 nt, Homo sapiens
gaauugcucugaugaauac

SEQ ID NO: 630935 - RNA, 19 nt, Homo sapiens
gauaagccauucuguagug

SEQ ID NO: 630936 - RNA, 19 nt, Homo sapiens
ggaaacuacuguaagaugu

SEQ ID NO: 630937 - RNA, 19 nt, Homo sapiens
guagugaaguuugcaaauu

SEQ ID NO: 630938 - RNA, 19 nt, Homo sapiens
gcccucagcugaaaugauu

SEQ ID NO: 630939 - RNA, 19 nt, Homo sapiens
gguggugugucuucaguua

SEQ ID NO: 630940 - RNA, 19 nt, Homo sapiens
agacaaugcucaagaguau

SEQ ID NO: 630941 - RNA, 19 nt, Homo sapiens
acaggaagaugcuaugaaa

SEQ ID NO: 630942 - RNA, 19 nt, Homo sapiens
gcacuguaaccaucuauuu

SEQ ID NO: 630943 - RNA, 19 nt, Homo sapiens
aaucaugcuugucaucuua

SEQ ID NO: 630944 - RNA, 19 nt, Homo sapiens
gcuaugaaauuuccaucuu

SEQ ID NO: 630945 - RNA, 19 nt, Homo sapiens
aaacuaagcgaguccauaa

SEQ ID NO: 630946 - RNA, 19 nt, Homo sapiens
caaguugcuuuaacccaua

SEQ ID NO: 630947 - RNA, 19 nt, Homo sapiens
gaacaaucccagcaaguug

SEQ ID NO: 630948 - RNA, 19 nt, Homo sapiens
gaucacaacucgcuuugag

SEQ ID NO: 630949 - RNA, 19 nt, Homo sapiens
gguaacaccucugccguuu

SEQ ID NO: 630950 - RNA, 19 nt, Homo sapiens
uaaaggagacugugcgauu

SEQ ID NO: 630951 - RNA, 19 nt, Homo sapiens
gcacaaacugcucgaaaga

SEQ ID NO: 630952 - RNA, 19 nt, Homo sapiens
caaacugcauaucauaaga

SEQ ID NO: 630953 - RNA, 19 nt, Homo sapiens
uaaccagugugaugucauu

SEQ ID NO: 630954 - RNA, 19 nt, Homo sapiens
caagugugaugguuguaaa

SEQ ID NO: 630955 - RNA, 19 nt, Homo sapiens
gagacacucuuugagguaa

SEQ ID NO: 630956 - RNA, 19 nt, Homo sapiens
gaaugacugucuuccacaa

SEQ ID NO: 630957 - RNA, 19 nt, Homo sapiens
ucaacuaagugcaguaugu

SEQ ID NO: 630958 - RNA, 19 nt, Homo sapiens
gaauuccuauccuagcaaa

SEQ ID NO: 630959 - RNA, 19 nt, Homo sapiens
gauacaacaccaguuauaa

SEQ ID NO: 630960 - RNA, 19 nt, Homo sapiens
caugucaaauggaacuaua

SEQ ID NO: 630961 - RNA, 19 nt, Homo sapiens
gaaugcugauacucgauuu

SEQ ID NO: 630962 - RNA, 19 nt, Homo sapiens
ccaaaagcauuucaacuaa

SEQ ID NO: 630963 - RNA, 19 nt, Homo sapiens
ugugggagcuauugcuaua

SEQ ID NO: 630964 - RNA, 19 nt, Homo sapiens
acagauacaacaccaguua

SEQ ID NO: 630965 - RNA, 19 nt, Homo sapiens
ccaguugugugguugcuuu

SEQ ID NO: 630966 - RNA, 19 nt, Homo sapiens
gcaguuugcugagguguuc

SEQ ID NO: 630967 - RNA, 19 nt, Homo sapiens
ccucagcaaucccucagua

SEQ ID NO: 630968 - RNA, 19 nt, Homo sapiens
ugauugagacuacaaauga

SEQ ID NO: 630969 - RNA, 19 nt, Homo sapiens
caacucgcuuugagaauuc

SEQ ID NO: 630970 - RNA, 19 nt, Homo sapiens
gaacuguugugagaacugu

SEQ ID NO: 630971 - RNA, 19 nt, Homo sapiens
gagaauuccuauccuagca

SEQ ID NO: 630972 - RNA, 19 nt, Homo sapiens
uaaagaagaaccagacaau

SEQ ID NO: 630973 - RNA, 19 nt, Homo sapiens
ucacagacauccccaaauu

SEQ ID NO: 630974 - RNA, 19 nt, Homo sapiens
gaaaugauugagacuacaa

SEQ ID NO: 630975 - RNA, 19 nt, Homo sapiens
guccagguuucaugucaua

SEQ ID NO: 630976 - RNA, 19 nt, Homo sapiens
uauaguagcucugguccuu

SEQ ID NO: 630977 - RNA, 19 nt, Homo sapiens
acaacucgcuuugagaauu

SEQ ID NO: 630978 - RNA, 19 nt, Homo sapiens
gaagaugcuaugaaauuuc

SEQ ID NO: 630979 - RNA, 19 nt, Homo sapiens
gaaaguacacaggaagaug

SEQ ID NO: 630980 - RNA, 19 nt, Homo sapiens
gaguuaagacuguuacuuc

SEQ ID NO: 630981 - RNA, 19 nt, Homo sapiens
ccaaguguguugcuuccuu

SEQ ID NO: 630982 - RNA, 19 nt, Homo sapiens
gaacccaggcuuucagcuu

SEQ ID NO: 630983 - RNA, 19 nt, Homo sapiens
ggcaaugugugacuacugu

SEQ ID NO: 630984 - RNA, 19 nt, Homo sapiens
ggaacuauauacagcuucu

SEQ ID NO: 630985 - RNA, 19 nt, Homo sapiens
gcaguugaacccaggcuuu

SEQ ID NO: 630986 - RNA, 19 nt, Homo sapiens
uaaacgacaggguaaacua

SEQ ID NO: 630987 - RNA, 19 nt, Homo sapiens
uagugaaguuugcaaauuc

SEQ ID NO: 630988 - RNA, 19 nt, Homo sapiens
aaauaaaguuguggcaaug

SEQ ID NO: 630989 - RNA, 19 nt, Homo sapiens
aaagauuucugcagccaau

SEQ ID NO: 630990 - RNA, 19 nt, Homo sapiens
gggccaaacugcauaucau

SEQ ID NO: 630991 - RNA, 19 nt, Homo sapiens
aggaagaugcuaugaaauu

SEQ ID NO: 630992 - RNA, 19 nt, Homo sapiens
uaaagaggcagcaaagauc

SEQ ID NO: 630993 - RNA, 19 nt, Homo sapiens
gggaaacuacuguaagaug

SEQ ID NO: 630994 - RNA, 19 nt, Homo sapiens
cuacaaaugauucaggaaa

SEQ ID NO: 630995 - RNA, 19 nt, Homo sapiens
ucacaacucgcuuugagaa

SEQ ID NO: 630996 - RNA, 19 nt, Homo sapiens
ggccaaacugcauaucaua

SEQ ID NO: 630997 - RNA, 19 nt, Homo sapiens
gaaaauugguggugugucu

SEQ ID NO: 630998 - RNA, 19 nt, Homo sapiens
aaacgacaggguaaacuaa

SEQ ID NO: 630999 - RNA, 19 nt, Homo sapiens
gaagauuguauguccaaau

SEQ ID NO: 631000 - RNA, 19 nt, Homo sapiens
acaaacugcucgaaagaca

SEQ ID NO: 631001 - RNA, 19 nt, Homo sapiens
gcaggagcuucuggacaaa

SEQ ID NO: 631002 - RNA, 19 nt, Homo sapiens
cgaggcaacauuaaacauu

SEQ ID NO: 631003 - RNA, 19 nt, Homo sapiens
guugauaagccauucugua

SEQ ID NO: 631004 - RNA, 19 nt, Homo sapiens
gcccaccgaugcugcaaga

SEQ ID NO: 631005 - RNA, 19 nt, Homo sapiens
cuaaagaggcagcaaagau

SEQ ID NO: 631006 - RNA, 19 nt, Homo sapiens
gaaacuacuguaagaugug

SEQ ID NO: 631007 - RNA, 19 nt, Homo sapiens
gccauucuguagugaaguu

SEQ ID NO: 631008 - RNA, 19 nt, Homo sapiens
caacuauccauuaccaaga

SEQ ID NO: 631009 - RNA, 19 nt, Homo sapiens
gauugagacuacaaaugau

SEQ ID NO: 631010 - RNA, 19 nt, Homo sapiens
caaucaugcuugucaucuu

SEQ ID NO: 631011 - RNA, 19 nt, Homo sapiens
gccaaacugcauaucauaa

SEQ ID NO: 631012 - RNA, 19 nt, Homo sapiens
ccaguuauaaccaguguga

SEQ ID NO: 631013 - RNA, 19 nt, Homo sapiens
agauacaacaccaguuaua

SEQ ID NO: 631014 - RNA, 19 nt, Homo sapiens
cagacaaugcucaagagua

SEQ ID NO: 631015 - RNA, 19 nt, Homo sapiens
uaaacuaagcgaguccaua

SEQ ID NO: 631016 - RNA, 19 nt, Homo sapiens
agaauugcucugaugaaua

SEQ ID NO: 631017 - RNA, 19 nt, Homo sapiens
ggucagcagugucaauagg

SEQ ID NO: 631018 - RNA, 19 nt, Homo sapiens
guuaaugagagaccuauug

SEQ ID NO: 631019 - RNA, 19 nt, Homo sapiens
gggcaaguuagaagaguuu

SEQ ID NO: 631020 - RNA, 19 nt, Homo sapiens
aaaggagacugugcgauuc

SEQ ID NO: 631021 - RNA, 19 nt, Homo sapiens
aagaauugcucugaugaau

SEQ ID NO: 631022 - RNA, 19 nt, Homo sapiens
aacccaggcuuucagcuuu

SEQ ID NO: 631023 - RNA, 19 nt, Homo sapiens
guacacaggaagaugcuau

SEQ ID NO: 631024 - RNA, 19 nt, Homo sapiens
caagaauugcucugaugaa

SEQ ID NO: 631025 - RNA, 19 nt, Homo sapiens
cagcaaucccucaguauca

SEQ ID NO: 631026 - RNA, 19 nt, Homo sapiens
gcauguaucuguagaaaua

SEQ ID NO: 631027 - RNA, 19 nt, Homo sapiens
gaagaaaucuauucguuug

SEQ ID NO: 631028 - RNA, 19 nt, Homo sapiens
ugaaagagguguccaacua

SEQ ID NO: 631029 - RNA, 19 nt, Homo sapiens
ggaauacaguguguuguua

SEQ ID NO: 631030 - RNA, 19 nt, Homo sapiens
ggacuauccuguaauugua

SEQ ID NO: 631031 - RNA, 19 nt, Homo sapiens
gcacauagcaaguacuuaa

SEQ ID NO: 631032 - RNA, 19 nt, Homo sapiens
gcaaauggccuagcacaua

SEQ ID NO: 631033 - RNA, 19 nt, Homo sapiens
gcaacaaagucacauaaau

SEQ ID NO: 631034 - RNA, 19 nt, Homo sapiens
ugaaggauuuggcauauuu

SEQ ID NO: 631035 - RNA, 19 nt, Homo sapiens
caaaugacaugugggaauu

SEQ ID NO: 631036 - RNA, 19 nt, Homo sapiens
gcacaaacugcucgaagua

SEQ ID NO: 631037 - RNA, 19 nt, Homo sapiens
acaguuaucuugaaagcua

SEQ ID NO: 631038 - RNA, 19 nt, Homo sapiens
gguggugugucuucaguua

SEQ ID NO: 631039 - RNA, 19 nt, Homo sapiens
agacaaugcucaagaguau

SEQ ID NO: 631040 - RNA, 19 nt, Homo sapiens
acaaacugcucgaaguaua

SEQ ID NO: 631041 - RNA, 19 nt, Homo sapiens
uuaaaucucuucagcaugu

SEQ ID NO: 631042 - RNA, 19 nt, Homo sapiens
caaauggccuagcacauag

SEQ ID NO: 631043 - RNA, 19 nt, Homo sapiens
caacaaagucacauaaauc

SEQ ID NO: 631044 - RNA, 19 nt, Homo sapiens
caaacugcauaucauaaga

SEQ ID NO: 631045 - RNA, 19 nt, Homo sapiens
gagacacucuuugagguaa

SEQ ID NO: 631046 - RNA, 19 nt, Homo sapiens
gaauacaguguguuguuaa

SEQ ID NO: 631047 - RNA, 19 nt, Homo sapiens
cacccaccauuuaaauuua

SEQ ID NO: 631048 - RNA, 19 nt, Homo sapiens
guagacacccaccauuuaa

SEQ ID NO: 631049 - RNA, 19 nt, Homo sapiens
gaaagagguguccaacuau

SEQ ID NO: 631050 - RNA, 19 nt, Homo sapiens
aguaagagcuugcuuuuaa

SEQ ID NO: 631051 - RNA, 19 nt, Homo sapiens
cagcauguaucuguagaaa

SEQ ID NO: 631052 - RNA, 19 nt, Homo sapiens
uaaagaagaaccagacaau

SEQ ID NO: 631053 - RNA, 19 nt, Homo sapiens
gugacuugguguuagaaua

SEQ ID NO: 631054 - RNA, 19 nt, Homo sapiens
caaacugcucgaaguauaa

SEQ ID NO: 631055 - RNA, 19 nt, Homo sapiens
cuugaaagcuauuggguau

SEQ ID NO: 631056 - RNA, 19 nt, Homo sapiens
acacggagaccuugaaaga

SEQ ID NO: 631057 - RNA, 19 nt, Homo sapiens
uguagacacccaccauuua

SEQ ID NO: 631058 - RNA, 19 nt, Homo sapiens
gagaccacauugccucgaa

SEQ ID NO: 631059 - RNA, 19 nt, Homo sapiens
ccaaguguguugcuuccuu

SEQ ID NO: 631060 - RNA, 19 nt, Homo sapiens
gaacccaggcuuucagcuu

SEQ ID NO: 631061 - RNA, 19 nt, Homo sapiens
gcaguugaacccaggcuuu

SEQ ID NO: 631062 - RNA, 19 nt, Homo sapiens
gagacaguguuagcaaaug

SEQ ID NO: 631063 - RNA, 19 nt, Homo sapiens
cagcaacaaagucacauaa

SEQ ID NO: 631064 - RNA, 19 nt, Homo sapiens
gggccaaacugcauaucau

SEQ ID NO: 631065 - RNA, 19 nt, Homo sapiens
ggccaaacugcauaucaua

SEQ ID NO: 631066 - RNA, 19 nt, Homo sapiens
gaaaauugguggugugucu

SEQ ID NO: 631067 - RNA, 19 nt, Homo sapiens
cuccauuucucaucaguaa

SEQ ID NO: 631068 - RNA, 19 nt, Homo sapiens
acacccaccauuuaaauuu

SEQ ID NO: 631069 - RNA, 19 nt, Homo sapiens
gcaggagcuucuggacaaa

SEQ ID NO: 631070 - RNA, 19 nt, Homo sapiens
aauauugccuaaaccaguu

SEQ ID NO: 631071 - RNA, 19 nt, Homo sapiens
gguguccaacuauccauua

SEQ ID NO: 631072 - RNA, 19 nt, Homo sapiens
ggcuagauguuuaacuuuc

SEQ ID NO: 631073 - RNA, 19 nt, Homo sapiens
gccaaacugcauaucauaa

SEQ ID NO: 631074 - RNA, 19 nt, Homo sapiens
caacuauccauuaccaaga

SEQ ID NO: 631075 - RNA, 19 nt, Homo sapiens
cgggcuagauguuuaacuu

SEQ ID NO: 631076 - RNA, 19 nt, Homo sapiens
uacaguguguuguuaauag

SEQ ID NO: 631077 - RNA, 19 nt, Homo sapiens
guuaaugagagaccuauug

SEQ ID NO: 631078 - RNA, 19 nt, Homo sapiens
cagacaaugcucaagagua

SEQ ID NO: 631079 - RNA, 19 nt, Homo sapiens
ucauuuaucucugugacuu

SEQ ID NO: 631080 - RNA, 19 nt, Homo sapiens
aauuguggcucugucauuu

SEQ ID NO: 631081 - RNA, 19 nt, Homo sapiens
uaaaucuuucccugacuua

SEQ ID NO: 631082 - RNA, 19 nt, Homo sapiens
ugacuugguguuagaauau

SEQ ID NO: 631083 - RNA, 19 nt, Homo sapiens
aaagagguguccaacuauc

SEQ ID NO: 631084 - RNA, 19 nt, Homo sapiens
aacccaggcuuucagcuuu

SEQ ID NO: 631085 - RNA, 19 nt, Homo sapiens
gcuagauguuuaacuuucu

SEQ ID NO: 631086 - RNA, 19 nt, Homo sapiens
cuauuucugugguagugua

SEQ ID NO: 631087 - RNA, 19 nt, Homo sapiens
augcuuagaugcagagaga

SEQ ID NO: 631088 - RNA, 19 nt, Homo sapiens
uuccagcuguugcuauuaa

SEQ ID NO: 631089 - RNA, 19 nt, Homo sapiens
gggcuagauguuuaacuuu

SEQ ID NO: 631090 - RNA, 19 nt, Homo sapiens
guaagagcuugcuuuuaaa

SEQ ID NO: 631091 - RNA, 19 nt, Homo sapiens
agcaggagcuucuggacaa

SEQ ID NO: 631092 - RNA, 19 nt, Homo sapiens
ugagacacucuuugaggua

SEQ ID NO: 631093 - RNA, 19 nt, Homo sapiens
guuagcaaauggccuagca

SEQ ID NO: 631094 - RNA, 19 nt, Homo sapiens
auaaaucuuucccugacuu

SEQ ID NO: 631095 - RNA, 19 nt, Homo sapiens
ccaguuuucuaucacuuua

SEQ ID NO: 631096 - RNA, 19 nt, Homo sapiens
gacuugguguuagaauauu

SEQ ID NO: 631097 - RNA, 19 nt, Homo sapiens
ugaggaauacaguguguug

SEQ ID NO: 631098 - RNA, 19 nt, Homo sapiens
gguaguguaauuugaggaa

SEQ ID NO: 631099 - RNA, 19 nt, Homo sapiens
ucccugacuuaguacauuu

SEQ ID NO: 631100 - RNA, 19 nt, Homo sapiens
gacacccaccauuuaaauu

SEQ ID NO: 631101 - RNA, 19 nt, Homo sapiens
uaaaucucuucagcaugua

SEQ ID NO: 631102 - RNA, 19 nt, Homo sapiens
ugacuucgggcuagauguu

SEQ ID NO: 631103 - RNA, 19 nt, Homo sapiens
ugacuuaguacauuugaag

SEQ ID NO: 631104 - RNA, 19 nt, Homo sapiens
agacacccaccauuuaaau

SEQ ID NO: 631105 - RNA, 19 nt, Homo sapiens
acaaaugacaugugggaau

SEQ ID NO: 631106 - RNA, 19 nt, Homo sapiens
cuuuaaaucucuucagcau

SEQ ID NO: 631107 - RNA, 19 nt, Homo sapiens
gaucuacucagcucuucug

SEQ ID NO: 631108 - RNA, 19 nt, Homo sapiens
gagcuucuggacaaaauua

SEQ ID NO: 631109 - RNA, 19 nt, Homo sapiens
gcucaagaguauggaugug

SEQ ID NO: 631110 - RNA, 19 nt, Homo sapiens
agacaguguuagcaaaugg

SEQ ID NO: 631111 - RNA, 19 nt, Homo sapiens
aacuauccauuaccaagaa

SEQ ID NO: 631112 - RNA, 19 nt, Homo sapiens
uccuaggacuuuaaugaga

SEQ ID NO: 631113 - RNA, 19 nt, Homo sapiens
guaauuugaggaauacagu

SEQ ID NO: 631114 - RNA, 19 nt, Homo sapiens
gauggugaauguggcaaag

SEQ ID NO: 631115 - RNA, 19 nt, Homo sapiens
ccucgaaggcgauugugaa

SEQ ID NO: 631116 - RNA, 19 nt, Homo sapiens
ccaaacugcauaucauaag

SEQ ID NO: 631117 - RNA, 19 nt, Homo sapiens
agaaaucuauucguuugag

SEQ ID NO: 631118 - RNA, 19 nt, Homo sapiens
cuuccuaggacuuuaauga

SEQ ID NO: 631119 - RNA, 19 nt, Homo sapiens
uuucugugguaguguaauu

SEQ ID NO: 631120 - RNA, 19 nt, Homo sapiens
aaacagcaacaaagucaca

SEQ ID NO: 631121 - RNA, 19 nt, Homo sapiens
acaauaaugcuuagaugca

SEQ ID NO: 631122 - RNA, 19 nt, Homo sapiens
ugugggaauugcaggacua

SEQ ID NO: 631123 - RNA, 19 nt, Homo sapiens
guccaacuauccauuacca

SEQ ID NO: 631124 - RNA, 19 nt, Homo sapiens
acuucgggcuagauguuua

SEQ ID NO: 631125 - RNA, 19 nt, Homo sapiens
gagcuugcuuuuaaauugu

SEQ ID NO: 631126 - RNA, 19 nt, Homo sapiens
ggaaauaucuccauuguuc

SEQ ID NO: 631127 - RNA, 19 nt, Homo sapiens
gaaaacaacuggaaucuua

SEQ ID NO: 631128 - RNA, 19 nt, Homo sapiens
gcaaauccuuccaagaauu

SEQ ID NO: 631129 - RNA, 19 nt, Homo sapiens
gcaggagacuuauuucaga

SEQ ID NO: 631130 - RNA, 19 nt, Homo sapiens
gaauguggcaggagacuua

SEQ ID NO: 631131 - RNA, 19 nt, Homo sapiens
gaccaagacuggaguaaga

SEQ ID NO: 631132 - RNA, 19 nt, Homo sapiens
gguauaagcucugugaaug

SEQ ID NO: 631133 - RNA, 19 nt, Homo sapiens
gaaaggaagaauaaggaua

SEQ ID NO: 631134 - RNA, 19 nt, Homo sapiens
ugaacagacuccugcuuua

SEQ ID NO: 631135 - RNA, 19 nt, Homo sapiens
acagacuccugcuuuauua

SEQ ID NO: 631136 - RNA, 19 nt, Homo sapiens
ccaguggccuuacuucgua

SEQ ID NO: 631137 - RNA, 19 nt, Homo sapiens
agcaauagcugaucaaaga

SEQ ID NO: 631138 - RNA, 19 nt, Homo sapiens
uaagguaaaugcaggaaug

SEQ ID NO: 631139 - RNA, 19 nt, Homo sapiens
uauacaaccuccuucaauu

SEQ ID NO: 631140 - RNA, 19 nt, Homo sapiens
ggaagaugaugaugaugau

SEQ ID NO: 631141 - RNA, 19 nt, Homo sapiens
ggaagaauaaggauauguu

SEQ ID NO: 631142 - RNA, 19 nt, Homo sapiens
ucauccagcuuguccuuua

SEQ ID NO: 631143 - RNA, 19 nt, Homo sapiens
caacuagucucauggacau

SEQ ID NO: 631144 - RNA, 19 nt, Homo sapiens
gcuauuauguacucuuuca

SEQ ID NO: 631145 - RNA, 19 nt, Homo sapiens
acagacagcuuaucaacga

SEQ ID NO: 631146 - RNA, 19 nt, Homo sapiens
ggacauagaaacaaaugga

SEQ ID NO: 631147 - RNA, 19 nt, Homo sapiens
gaacagacuccugcuuuau

SEQ ID NO: 631148 - RNA, 19 nt, Homo sapiens
gaauuugcaacucaucaua

SEQ ID NO: 631149 - RNA, 19 nt, Homo sapiens
gauuagaguugacugaaca

SEQ ID NO: 631150 - RNA, 19 nt, Homo sapiens
aggaucagcucaccucuuu

SEQ ID NO: 631151 - RNA, 19 nt, Homo sapiens
ggacauaggggauucauuu

SEQ ID NO: 631152 - RNA, 19 nt, Homo sapiens
gaaggaaauaucuccauug

SEQ ID NO: 631153 - RNA, 19 nt, Homo sapiens
gaagcugaaaggaagaaua

SEQ ID NO: 631154 - RNA, 19 nt, Homo sapiens
aagcaaauccuuccaagaa

SEQ ID NO: 631155 - RNA, 19 nt, Homo sapiens
uggcagaaauuaagaagga

SEQ ID NO: 631156 - RNA, 19 nt, Homo sapiens
ggagacuuauuucagaaug

SEQ ID NO: 631157 - RNA, 19 nt, Homo sapiens
cagcuucauuucccaguaa

SEQ ID NO: 631158 - RNA, 19 nt, Homo sapiens
gaagaggacauagaaacaa

SEQ ID NO: 631159 - RNA, 19 nt, Homo sapiens
cuacaaagaaggcuaaugu

SEQ ID NO: 631160 - RNA, 19 nt, Homo sapiens
aaacacacgaagcauaaua

SEQ ID NO: 631161 - RNA, 19 nt, Homo sapiens
gugcuauuauguacucuuu

SEQ ID NO: 631162 - RNA, 19 nt, Homo sapiens
agaaggaaauaucuccauu

SEQ ID NO: 631163 - RNA, 19 nt, Homo sapiens
gaccaggaaucaccuucaa

SEQ ID NO: 631164 - RNA, 19 nt, Homo sapiens
caacaacaacuuacuaaac

SEQ ID NO: 631165 - RNA, 19 nt, Homo sapiens
ccaguagaaucaagcaaau

SEQ ID NO: 631166 - RNA, 19 nt, Homo sapiens
ggaaauauaagugagacaa

SEQ ID NO: 631167 - RNA, 19 nt, Homo sapiens
ugaugaugauguuguguuu

SEQ ID NO: 631168 - RNA, 19 nt, Homo sapiens
aagaggacauagaaacaaa

SEQ ID NO: 631169 - RNA, 19 nt, Homo sapiens
aaggaaauaucuccauugu

SEQ ID NO: 631170 - RNA, 19 nt, Homo sapiens
ccaccugccuuucuuccuu

SEQ ID NO: 631171 - RNA, 19 nt, Homo sapiens
ggaauggguaauaguggua

SEQ ID NO: 631172 - RNA, 19 nt, Homo sapiens
gaugauguuguguuuauug

SEQ ID NO: 631173 - RNA, 19 nt, Homo sapiens
caaagaaggcuaaugucau

SEQ ID NO: 631174 - RNA, 19 nt, Homo sapiens
ucucauaaacguacucaaa

SEQ ID NO: 631175 - RNA, 19 nt, Homo sapiens
gcaggaauggguaauagug

SEQ ID NO: 631176 - RNA, 19 nt, Homo sapiens
aagcugaaaggaagaauaa

SEQ ID NO: 631177 - RNA, 19 nt, Homo sapiens
ggacagacagcuuaucaac

SEQ ID NO: 631178 - RNA, 19 nt, Homo sapiens
agaauugacucugaaauac

SEQ ID NO: 631179 - RNA, 19 nt, Homo sapiens
uguauaacaugaagcugaa

SEQ ID NO: 631180 - RNA, 19 nt, Homo sapiens
uaagugcuauuauguacuc

SEQ ID NO: 631181 - RNA, 19 nt, Homo sapiens
gcagaaauuaagaaggaaa

SEQ ID NO: 631182 - RNA, 19 nt, Homo sapiens
agaagggacagacagcuua

SEQ ID NO: 631183 - RNA, 19 nt, Homo sapiens
caggagacuuauuucagaa

SEQ ID NO: 631184 - RNA, 19 nt, Homo sapiens
cuucauauuugcaucauca

SEQ ID NO: 631185 - RNA, 19 nt, Homo sapiens
gaacucaccaguggaagau

SEQ ID NO: 631186 - RNA, 19 nt, Homo sapiens
caaaacacacgaagcauaa

SEQ ID NO: 631187 - RNA, 19 nt, Homo sapiens
gaauugacucugaaauaca

SEQ ID NO: 631188 - RNA, 19 nt, Homo sapiens
gaaucaccuucaagccuau

SEQ ID NO: 631189 - RNA, 19 nt, Homo sapiens
caauagcugaucaaagaaa

SEQ ID NO: 631190 - RNA, 19 nt, Homo sapiens
uauguacucuuucaucuac

SEQ ID NO: 631191 - RNA, 19 nt, Homo sapiens
ugguaucacuacagaauug

SEQ ID NO: 631192 - RNA, 19 nt, Homo sapiens
ggaacucaccaguggaaga

SEQ ID NO: 631193 - RNA, 19 nt, Homo sapiens
cacguguucuggauguaua

SEQ ID NO: 631194 - RNA, 19 nt, Homo sapiens
gaaauaucuccauuguuca

SEQ ID NO: 631195 - RNA, 19 nt, Homo sapiens
gaagggacagacagcuuau

SEQ ID NO: 631196 - RNA, 19 nt, Homo sapiens
ugaaaagccucaaggaaau

SEQ ID NO: 631197 - RNA, 19 nt, Homo sapiens
auacaaccuccuucaauuu

SEQ ID NO: 631198 - RNA, 19 nt, Homo sapiens
ggauuagaguugacugaac

SEQ ID NO: 631199 - RNA, 19 nt, Homo sapiens
acaaagaaggcuaauguca

SEQ ID NO: 631200 - RNA, 19 nt, Homo sapiens
gaauggagaauuugcaacu

SEQ ID NO: 631201 - RNA, 19 nt, Homo sapiens
uguuagaacuaucuuaugg

SEQ ID NO: 631202 - RNA, 19 nt, Homo sapiens
cuugggagaugucgcuaaa

SEQ ID NO: 631203 - RNA, 19 nt, Homo sapiens
gcaauagcugaucaaagaa

SEQ ID NO: 631204 - RNA, 19 nt, Homo sapiens
uaguacaucuuguuugucu

SEQ ID NO: 631205 - RNA, 19 nt, Homo sapiens
caacuuacuaaaccagcua

SEQ ID NO: 631206 - RNA, 19 nt, Homo sapiens
ccaacaacaacuuacuaaa

SEQ ID NO: 631207 - RNA, 19 nt, Homo sapiens
gaugaagaggacauagaaa

SEQ ID NO: 631208 - RNA, 19 nt, Homo sapiens
gaugaugauguuguguuua

SEQ ID NO: 631209 - RNA, 19 nt, Homo sapiens
aggcuaacagugauaauuu

SEQ ID NO: 631210 - RNA, 19 nt, Homo sapiens
gaggacauagaaacaaaug

SEQ ID NO: 631211 - RNA, 19 nt, Homo sapiens
ugaugaagaggacauagaa

SEQ ID NO: 631212 - RNA, 19 nt, Homo sapiens
gauuuggcaucucagaaag

SEQ ID NO: 631213 - RNA, 19 nt, Homo sapiens
uguaauuccuccuucuuca

SEQ ID NO: 631214 - RNA, 19 nt, Homo sapiens
ugaugaugaugaugauguu

SEQ ID NO: 631215 - RNA, 19 nt, Homo sapiens
gcccaacaacaacuuacua

SEQ ID NO: 631216 - RNA, 19 nt, Homo sapiens
uggaagaugaugaugauga

SEQ ID NO: 631217 - RNA, 19 nt, Homo sapiens
caguagaucuaggaacuca

SEQ ID NO: 631218 - RNA, 19 nt, Homo sapiens
gucaguagaucuaggaacu

SEQ ID NO: 631219 - RNA, 19 nt, Homo sapiens
uuucuuccuucucucauaa

SEQ ID NO: 631220 - RNA, 19 nt, Homo sapiens
uaaaugcaggaauggguaa

SEQ ID NO: 631221 - RNA, 19 nt, Homo sapiens
aaauggaggagcagagaaa

SEQ ID NO: 631222 - RNA, 19 nt, Homo sapiens
cagaaaggaaauauaagug

SEQ ID NO: 631223 - RNA, 19 nt, Homo sapiens
caaccuccuucaauuucug

SEQ ID NO: 631224 - RNA, 19 nt, Homo sapiens
ucagcuucauuucccagua

SEQ ID NO: 631225 - RNA, 19 nt, Homo sapiens
gagaauuugcaacucauca

SEQ ID NO: 631226 - RNA, 19 nt, Homo sapiens
gcaaauaggucacugaaug

SEQ ID NO: 631227 - RNA, 19 nt, Homo sapiens
gaacacagauuuaagugaa

SEQ ID NO: 631228 - RNA, 19 nt, Homo sapiens
agagaaaucuugcacaaua

SEQ ID NO: 631229 - RNA, 19 nt, Homo sapiens
ccaagaaggugaugaugua

SEQ ID NO: 631230 - RNA, 19 nt, Homo sapiens
ggagauaaacagccaaaua

SEQ ID NO: 631231 - RNA, 19 nt, Homo sapiens
gaaagagcccgaugaagaa

SEQ ID NO: 631232 - RNA, 19 nt, Homo sapiens
gcacaauacugagaaagaa

SEQ ID NO: 631233 - RNA, 19 nt, Homo sapiens
gaaacccugucucuacuaa

SEQ ID NO: 631234 - RNA, 19 nt, Homo sapiens
ccaguaguaucaaacaaua

SEQ ID NO: 631235 - RNA, 19 nt, Homo sapiens
gaaggacuguguggacaua

SEQ ID NO: 631236 - RNA, 19 nt, Homo sapiens
gagguuaucacccagauua

SEQ ID NO: 631237 - RNA, 19 nt, Homo sapiens
ccaaauauaucagcaucua

SEQ ID NO: 631238 - RNA, 19 nt, Homo sapiens
gagaggaaaugcucgagaa

SEQ ID NO: 631239 - RNA, 19 nt, Homo sapiens
gcucaugccuguaaucuca

SEQ ID NO: 631240 - RNA, 19 nt, Homo sapiens
agaaauagcuaccaaugga

SEQ ID NO: 631241 - RNA, 19 nt, Homo sapiens
cgagaaacauggaauaauc

SEQ ID NO: 631242 - RNA, 19 nt, Homo sapiens
gagccaagaucaagccauu

SEQ ID NO: 631243 - RNA, 19 nt, Homo sapiens
ugaaagagcccgaugaaga

SEQ ID NO: 631244 - RNA, 19 nt, Homo sapiens
guagaaacccuuaaagaug

SEQ ID NO: 631245 - RNA, 19 nt, Homo sapiens
caaggacucucuagcagaa

SEQ ID NO: 631246 - RNA, 19 nt, Homo sapiens
gagaggcacuguaugacaa

SEQ ID NO: 631247 - RNA, 19 nt, Homo sapiens
gcaauagccuagagaacga

SEQ ID NO: 631248 - RNA, 19 nt, Homo sapiens
gguaaagucuacugacaga

SEQ ID NO: 631249 - RNA, 19 nt, Homo sapiens
aaagaagacuguaccaugu

SEQ ID NO: 631250 - RNA, 19 nt, Homo sapiens
gcucuacugcuuuaaguua

SEQ ID NO: 631251 - RNA, 19 nt, Homo sapiens
ccagaaagcagagaagaua

SEQ ID NO: 631252 - RNA, 19 nt, Homo sapiens
agaauuagaugaagguguu

SEQ ID NO: 631253 - RNA, 19 nt, Homo sapiens
uagaaacccuuaaagaugu

SEQ ID NO: 631254 - RNA, 19 nt, Homo sapiens
guucaaagccaaauucuug

SEQ ID NO: 631255 - RNA, 19 nt, Homo sapiens
gaaauccucugaagacacu

SEQ ID NO: 631256 - RNA, 19 nt, Homo sapiens
uagcagaaguugaagagaa

SEQ ID NO: 631257 - RNA, 19 nt, Homo sapiens
gagauaaacagccaaauag

SEQ ID NO: 631258 - RNA, 19 nt, Homo sapiens
gaucuugaaccgauacuuu

SEQ ID NO: 631259 - RNA, 19 nt, Homo sapiens
gccgggagaucgacuguuu

SEQ ID NO: 631260 - RNA, 19 nt, Homo sapiens
gcauagugaugacacaguu

SEQ ID NO: 631261 - RNA, 19 nt, Homo sapiens
uaaaugcccucaagucuac

SEQ ID NO: 631262 - RNA, 19 nt, Homo sapiens
ugagagcauuccaguagua

SEQ ID NO: 631263 - RNA, 19 nt, Homo sapiens
ucucguagauccagaagaa

SEQ ID NO: 631264 - RNA, 19 nt, Homo sapiens
ggaucucauuguugauaua

SEQ ID NO: 631265 - RNA, 19 nt, Homo sapiens
gagcaguucucucccugaa

SEQ ID NO: 631266 - RNA, 19 nt, Homo sapiens
auaggucacugaaugauaa

SEQ ID NO: 631267 - RNA, 19 nt, Homo sapiens
cauuauaaccuguauggua

SEQ ID NO: 631268 - RNA, 19 nt, Homo sapiens
gaagacaaagaacaagaaa

SEQ ID NO: 631269 - RNA, 19 nt, Homo sapiens
gaagcgacagguccaagua

SEQ ID NO: 631270 - RNA, 19 nt, Homo sapiens
ggaaagcuuuagacagcaa

SEQ ID NO: 631271 - RNA, 19 nt, Homo sapiens
uaacguaucagaacacaga

SEQ ID NO: 631272 - RNA, 19 nt, Homo sapiens
gcacagggcauaguuuaga

SEQ ID NO: 631273 - RNA, 19 nt, Homo sapiens
caggugcucuacugcuuua

SEQ ID NO: 631274 - RNA, 19 nt, Homo sapiens
ggugugagaugucagaaca

SEQ ID NO: 631275 - RNA, 19 nt, Homo sapiens
gaaaugcucgagaaacaug

SEQ ID NO: 631276 - RNA, 19 nt, Homo sapiens
caaauaggucacugaauga

SEQ ID NO: 631277 - RNA, 19 nt, Homo sapiens
ccaaauagcauucuuagac

SEQ ID NO: 631278 - RNA, 19 nt, Homo sapiens
caauguaaguagaauguuc

SEQ ID NO: 631279 - RNA, 19 nt, Homo sapiens
cgaagaagagggugaagaa

SEQ ID NO: 631280 - RNA, 19 nt, Homo sapiens
ugacacaguuuaucaugau

SEQ ID NO: 631281 - RNA, 19 nt, Homo sapiens
caaauagcauucuuagacu

SEQ ID NO: 631282 - RNA, 19 nt, Homo sapiens
gacuguuacuuguagauuu

SEQ ID NO: 631283 - RNA, 19 nt, Homo sapiens
gcacuucaauccagaaagc

SEQ ID NO: 631284 - RNA, 19 nt, Homo sapiens
uaaagucuacugacagaaa

SEQ ID NO: 631285 - RNA, 19 nt, Homo sapiens
ggucaugggugcaccagau

SEQ ID NO: 631286 - RNA, 19 nt, Homo sapiens
gcauuuacuauuugccuua

SEQ ID NO: 631287 - RNA, 19 nt, Homo sapiens
gaagagagccagggcacuu

SEQ ID NO: 631288 - RNA, 19 nt, Homo sapiens
aaugaacccuuagauauga

SEQ ID NO: 631289 - RNA, 19 nt, Homo sapiens
agaagagggugaagaaaca

SEQ ID NO: 631290 - RNA, 19 nt, Homo sapiens
acaaguaaaugucugaaag

SEQ ID NO: 631291 - RNA, 19 nt, Homo sapiens
guuauagacuguuacuugu

SEQ ID NO: 631292 - RNA, 19 nt, Homo sapiens
ggcugguggugaagaauua

SEQ ID NO: 631293 - RNA, 19 nt, Homo sapiens
gaagagcagguaaagucua

SEQ ID NO: 631294 - RNA, 19 nt, Homo sapiens
ggaaaucaaggacucucua

SEQ ID NO: 631295 - RNA, 19 nt, Homo sapiens
caguguacguucuaauuga

SEQ ID NO: 631296 - RNA, 19 nt, Homo sapiens
gcaguucucucccugaaaa

SEQ ID NO: 631297 - RNA, 19 nt, Homo sapiens
ggaagugauauaugucaaa

SEQ ID NO: 631298 - RNA, 19 nt, Homo sapiens
ggaugacaccguucaauca

SEQ ID NO: 631299 - RNA, 19 nt, Homo sapiens
gggcauaguuuagagaaag

SEQ ID NO: 631300 - RNA, 19 nt, Homo sapiens
gagaaaucuugcacaauac

SEQ ID NO: 631301 - RNA, 19 nt, Homo sapiens
gaaacacaucggcuucuga

SEQ ID NO: 631302 - RNA, 19 nt, Homo sapiens
gaaggggucucguaacaug

SEQ ID NO: 631303 - RNA, 19 nt, Homo sapiens
ugacaccguucaaucauca

SEQ ID NO: 631304 - RNA, 19 nt, Homo sapiens
caaaaugaacccuuagaua

SEQ ID NO: 631305 - RNA, 19 nt, Homo sapiens
ccagugaaguggaggugaa

SEQ ID NO: 631306 - RNA, 19 nt, Homo sapiens
gauaaacagccaaauagca

SEQ ID NO: 631307 - RNA, 19 nt, Homo sapiens
gagcauuccaguaguauca

SEQ ID NO: 631308 - RNA, 19 nt, Homo sapiens
gauggagacacauuagauu

SEQ ID NO: 631309 - RNA, 19 nt, Homo sapiens
caaguacaguagacacuca

SEQ ID NO: 631310 - RNA, 19 nt, Homo sapiens
agaaaccaaucaagacaga

SEQ ID NO: 631311 - RNA, 19 nt, Homo sapiens
gaagaagagggugaagaaa

SEQ ID NO: 631312 - RNA, 19 nt, Homo sapiens
gaauaccgaggaccagaaa

SEQ ID NO: 631313 - RNA, 19 nt, Homo sapiens
gagacaagcacagggcaua

SEQ ID NO: 631314 - RNA, 19 nt, Homo sapiens
gcauuccaguaguaucaaa

SEQ ID NO: 631315 - RNA, 19 nt, Homo sapiens
gcacaggaagucucagugu

SEQ ID NO: 631316 - RNA, 19 nt, Homo sapiens
agaaggugaugauguacaa

SEQ ID NO: 631317 - RNA, 19 nt, Homo sapiens
gacgagaaaccaaucaaga

SEQ ID NO: 631318 - RNA, 19 nt, Homo sapiens
guagggaucacaacgaaga

SEQ ID NO: 631319 - RNA, 19 nt, Homo sapiens
uauaagaaggcuaugguuu

SEQ ID NO: 631320 - RNA, 19 nt, Homo sapiens
ugaccaaauagcauucuua

SEQ ID NO: 631321 - RNA, 19 nt, Homo sapiens
uagaggcauuuacuauuug

SEQ ID NO: 631322 - RNA, 19 nt, Homo sapiens
acuuguagauuuccaugua

SEQ ID NO: 631323 - RNA, 19 nt, Homo sapiens
uauagacuguuacuuguag

SEQ ID NO: 631324 - RNA, 19 nt, Homo sapiens
acagagaggugugagaugu

SEQ ID NO: 631325 - RNA, 19 nt, Homo sapiens
ggaagaagagcagguaaag

SEQ ID NO: 631326 - RNA, 19 nt, Homo sapiens
gcaaagagaugagcuuauu

SEQ ID NO: 631327 - RNA, 19 nt, Homo sapiens
gaacagcacuggacaagau

SEQ ID NO: 631328 - RNA, 19 nt, Homo sapiens
gcagagagaugccaauaga

SEQ ID NO: 631329 - RNA, 19 nt, Homo sapiens
guacaaugguggauuauau

SEQ ID NO: 631330 - RNA, 19 nt, Homo sapiens
caucaagacuuucaucauu

SEQ ID NO: 631331 - RNA, 19 nt, Homo sapiens
gaagggccauuagauguaa

SEQ ID NO: 631332 - RNA, 19 nt, Homo sapiens
gaaacauggcuuaguuaua

SEQ ID NO: 631333 - RNA, 19 nt, Homo sapiens
gauagaucaucaagacuuu

SEQ ID NO: 631334 - RNA, 19 nt, Homo sapiens
gaagcuacaacgagaguua

SEQ ID NO: 631335 - RNA, 19 nt, Homo sapiens
gaaaguugaagaugaauug

SEQ ID NO: 631336 - RNA, 19 nt, Homo sapiens
ggacagguucugagauaua

SEQ ID NO: 631337 - RNA, 19 nt, Homo sapiens
gaaaggagagcuaccauca

SEQ ID NO: 631338 - RNA, 19 nt, Homo sapiens
gguaugauauguucaagga

SEQ ID NO: 631339 - RNA, 19 nt, Homo sapiens
gaacuggaacgacaacaaa

SEQ ID NO: 631340 - RNA, 19 nt, Homo sapiens
gaagaugaagcuuugagua

SEQ ID NO: 631341 - RNA, 19 nt, Homo sapiens
ugagaaaguugaagaugaa

SEQ ID NO: 631342 - RNA, 19 nt, Homo sapiens
ggagacacuucuuuggaaa

SEQ ID NO: 631343 - RNA, 19 nt, Homo sapiens
ggagagcuaccaucacuaa

SEQ ID NO: 631344 - RNA, 19 nt, Homo sapiens
agagaaacauggcuuaguu

SEQ ID NO: 631345 - RNA, 19 nt, Homo sapiens
gaaggaagaacuacuguca

SEQ ID NO: 631346 - RNA, 19 nt, Homo sapiens
gaagaacaauuugaucuac

SEQ ID NO: 631347 - RNA, 19 nt, Homo sapiens
gagaaacauggcuuaguua

SEQ ID NO: 631348 - RNA, 19 nt, Homo sapiens
ggacaccagcagcuuaaua

SEQ ID NO: 631349 - RNA, 19 nt, Homo sapiens
ucacagguaugauauguuc

SEQ ID NO: 631350 - RNA, 19 nt, Homo sapiens
agaaguggcuggaagauuc

SEQ ID NO: 631351 - RNA, 19 nt, Homo sapiens
gaaaagaacaccugugaaa

SEQ ID NO: 631352 - RNA, 19 nt, Homo sapiens
gacagguucugagauauaa

SEQ ID NO: 631353 - RNA, 19 nt, Homo sapiens
cagaaaugcuccaggaaug

SEQ ID NO: 631354 - RNA, 19 nt, Homo sapiens
gaggaugcauuguccauuc

SEQ ID NO: 631355 - RNA, 19 nt, Homo sapiens
gauggaagaacuuaaagaa

SEQ ID NO: 631356 - RNA, 19 nt, Homo sapiens
ugaguggccucuacuuuga

SEQ ID NO: 631357 - RNA, 19 nt, Homo sapiens
ggagaagggccauuagaug

SEQ ID NO: 631358 - RNA, 19 nt, Homo sapiens
gagaagggccauuagaugu

SEQ ID NO: 631359 - RNA, 19 nt, Homo sapiens
ccaagcggcuggagaagau

SEQ ID NO: 631360 - RNA, 19 nt, Homo sapiens
ggacaagauugaggagaug

SEQ ID NO: 631361 - RNA, 19 nt, Homo sapiens
ggaagcugcucaggucuug

SEQ ID NO: 631362 - RNA, 19 nt, Homo sapiens
ggauaucuaugaccuuaag

SEQ ID NO: 631363 - RNA, 19 nt, Homo sapiens
aaagaacaccugugaaaga

SEQ ID NO: 631364 - RNA, 19 nt, Homo sapiens
cgggauaucuaugaccuua

SEQ ID NO: 631365 - RNA, 19 nt, Homo sapiens
ucucugagguggaugauau

SEQ ID NO: 631366 - RNA, 19 nt, Homo sapiens
gaugaagcuuugaguaaca

SEQ ID NO: 631367 - RNA, 19 nt, Homo sapiens
ugagaaugcugagaaaguu

SEQ ID NO: 631368 - RNA, 19 nt, Homo sapiens
uuaagugaauugcgggaua

SEQ ID NO: 631369 - RNA, 19 nt, Homo sapiens
ugaguaacauugccagaga

SEQ ID NO: 631370 - RNA, 19 nt, Homo sapiens
gaauacauugccugccuua

SEQ ID NO: 631371 - RNA, 19 nt, Homo sapiens
uuagaaaggcagaaacaua

SEQ ID NO: 631372 - RNA, 19 nt, Homo sapiens
guucaaggauagaucauca

SEQ ID NO: 631373 - RNA, 19 nt, Homo sapiens
ggcagaagcaagagauaua

SEQ ID NO: 631374 - RNA, 19 nt, Homo sapiens
gcagaauggcucagacuug

SEQ ID NO: 631375 - RNA, 19 nt, Homo sapiens
gauccagacacuucauuaa

SEQ ID NO: 631376 - RNA, 19 nt, Homo sapiens
ggauagaucaucaagacuu

SEQ ID NO: 631377 - RNA, 19 nt, Homo sapiens
gguuuccaaugcacaguua

SEQ ID NO: 631378 - RNA, 19 nt, Homo sapiens
cugagaaaguugaagauga

SEQ ID NO: 631379 - RNA, 19 nt, Homo sapiens
agggacagguucugagaua

SEQ ID NO: 631380 - RNA, 19 nt, Homo sapiens
uagaaaggcagaaacauau

SEQ ID NO: 631381 - RNA, 19 nt, Homo sapiens
aggaacagauggcagaauu

SEQ ID NO: 631382 - RNA, 19 nt, Homo sapiens
gagaaacuauagcagucuu

SEQ ID NO: 631383 - RNA, 19 nt, Homo sapiens
gcagaacaggauauaacua

SEQ ID NO: 631384 - RNA, 19 nt, Homo sapiens
aaagaaggccugcggcaaa

SEQ ID NO: 631385 - RNA, 19 nt, Homo sapiens
gaaaggcagaaacauaugu

SEQ ID NO: 631386 - RNA, 19 nt, Homo sapiens
aaagagaugagcuuauuga

SEQ ID NO: 631387 - RNA, 19 nt, Homo sapiens
gagaagaacaauuugaucu

SEQ ID NO: 631388 - RNA, 19 nt, Homo sapiens
cgaugacacugcaagcauu

SEQ ID NO: 631389 - RNA, 19 nt, Homo sapiens
aaauagacaccaugacaaa

SEQ ID NO: 631390 - RNA, 19 nt, Homo sapiens
gacaaacaguaugcugaaa

SEQ ID NO: 631391 - RNA, 19 nt, Homo sapiens
gagaagaugaaggccaaua

SEQ ID NO: 631392 - RNA, 19 nt, Homo sapiens
caacgagaguuacgaacag

SEQ ID NO: 631393 - RNA, 19 nt, Homo sapiens
aagaugaagcuuugaguaa

SEQ ID NO: 631394 - RNA, 19 nt, Homo sapiens
ggaacagauggcagaauuu

SEQ ID NO: 631395 - RNA, 19 nt, Homo sapiens
ccgaagcaguccaggguuu

SEQ ID NO: 631396 - RNA, 19 nt, Homo sapiens
gugacccucuggcaacaua

SEQ ID NO: 631397 - RNA, 19 nt, Homo sapiens
acacaaaccccuuuuagua

SEQ ID NO: 631398 - RNA, 19 nt, Homo sapiens
gcagaaacauauguguagu

SEQ ID NO: 631399 - RNA, 19 nt, Homo sapiens
gaagggagagugugguauc

SEQ ID NO: 631400 - RNA, 19 nt, Homo sapiens
gacagggccucuccuacug

SEQ ID NO: 631401 - RNA, 19 nt, Homo sapiens
cuucuucccuguacaguga

SEQ ID NO: 631402 - RNA, 19 nt, Homo sapiens
aaacagccaccuuuguauu

SEQ ID NO: 631403 - RNA, 19 nt, Homo sapiens
gaugccaauagacaaauua

SEQ ID NO: 631404 - RNA, 19 nt, Homo sapiens
gaaaauagacaccaugaca

SEQ ID NO: 631405 - RNA, 19 nt, Homo sapiens
uaagugaauugcgggauau

SEQ ID NO: 631406 - RNA, 19 nt, Homo sapiens
uaauagauccagacacuuc

SEQ ID NO: 631407 - RNA, 19 nt, Homo sapiens
uaucugccgcugauuauuu

SEQ ID NO: 631408 - RNA, 19 nt, Homo sapiens
caagcauugugucuucuga

SEQ ID NO: 631409 - RNA, 19 nt, Homo sapiens
gcaagagauauacgcauga

SEQ ID NO: 631410 - RNA, 19 nt, Homo sapiens
caucugaaugcaguuauua

SEQ ID NO: 631411 - RNA, 19 nt, Homo sapiens
ggucuucugauucucauaa

SEQ ID NO: 631412 - RNA, 19 nt, Homo sapiens
gcucagacuugcaguucau

SEQ ID NO: 631413 - RNA, 19 nt, Homo sapiens
gaacagauggcagaauuuu

SEQ ID NO: 631414 - RNA, 19 nt, Homo sapiens
caauuugaucuaccaagua

SEQ ID NO: 631415 - RNA, 19 nt, Homo sapiens
gcuuaaagaacuaaaggaa

SEQ ID NO: 631416 - RNA, 19 nt, Homo sapiens
uacagucacucucauggaa

SEQ ID NO: 631417 - RNA, 19 nt, Homo sapiens
gggagagaaacauggcuua

SEQ ID NO: 631418 - RNA, 19 nt, Homo sapiens
agaaacauauguguagugu

SEQ ID NO: 631419 - RNA, 19 nt, Homo sapiens
ugcagaagaugaagcuuug

SEQ ID NO: 631420 - RNA, 19 nt, Homo sapiens
ugagguggaugauaucagu

SEQ ID NO: 631421 - RNA, 19 nt, Homo sapiens
ggcagucacagguaugaua

SEQ ID NO: 631422 - RNA, 19 nt, Homo sapiens
uaaaacagccaccuuugua

SEQ ID NO: 631423 - RNA, 19 nt, Homo sapiens
guacucucuucauuccuuu

SEQ ID NO: 631424 - RNA, 19 nt, Homo sapiens
gcagucacagguaugauau

SEQ ID NO: 631425 - RNA, 19 nt, Homo sapiens
uaacuaccuuggagcaaag

SEQ ID NO: 631426 - RNA, 19 nt, Homo sapiens
gagaugagcuuauugagaa

SEQ ID NO: 631427 - RNA, 19 nt, Homo sapiens
gcaaagagaugagcuuauu

SEQ ID NO: 631428 - RNA, 19 nt, Homo sapiens
gaacagcacuggacaagau

SEQ ID NO: 631429 - RNA, 19 nt, Homo sapiens
gcagagagaugccaauaga

SEQ ID NO: 631430 - RNA, 19 nt, Homo sapiens
gaaugaaaccucaaacaaa

SEQ ID NO: 631431 - RNA, 19 nt, Homo sapiens
caaaagacauuuacccuua

SEQ ID NO: 631432 - RNA, 19 nt, Homo sapiens
cuacaugaaugaacacuuu

SEQ ID NO: 631433 - RNA, 19 nt, Homo sapiens
gaaugaacacuuuggauuu

SEQ ID NO: 631434 - RNA, 19 nt, Homo sapiens
gaagggccauuagauguaa

SEQ ID NO: 631435 - RNA, 19 nt, Homo sapiens
gaaacauggcuuaguuaua

SEQ ID NO: 631436 - RNA, 19 nt, Homo sapiens
ugagaaacauggcuuaguu

SEQ ID NO: 631437 - RNA, 19 nt, Homo sapiens
gaagcuacaacgagaguua

SEQ ID NO: 631438 - RNA, 19 nt, Homo sapiens
gaaaguugaagaugaauug

SEQ ID NO: 631439 - RNA, 19 nt, Homo sapiens
ggacagguucugagauaua

SEQ ID NO: 631440 - RNA, 19 nt, Homo sapiens
gaacuggaacgacaacaaa

SEQ ID NO: 631441 - RNA, 19 nt, Homo sapiens
gaaaggagagcuaccauca

SEQ ID NO: 631442 - RNA, 19 nt, Homo sapiens
gaagaugaagcuuugagua

SEQ ID NO: 631443 - RNA, 19 nt, Homo sapiens
ggaaugaaaccucaaacaa

SEQ ID NO: 631444 - RNA, 19 nt, Homo sapiens
ggacagacagcaauucuau

SEQ ID NO: 631445 - RNA, 19 nt, Homo sapiens
ugagaaaguugaagaugaa

SEQ ID NO: 631446 - RNA, 19 nt, Homo sapiens
ggagagcuaccaucacuaa

SEQ ID NO: 631447 - RNA, 19 nt, Homo sapiens
gaaggaagaacuacuguca

SEQ ID NO: 631448 - RNA, 19 nt, Homo sapiens
gaagaacaauuugaucuac

SEQ ID NO: 631449 - RNA, 19 nt, Homo sapiens
gagaaacauggcuuaguua

SEQ ID NO: 631450 - RNA, 19 nt, Homo sapiens
ggacaccagcagcuuaaua

SEQ ID NO: 631451 - RNA, 19 nt, Homo sapiens
gaaaagaacaccugugaaa

SEQ ID NO: 631452 - RNA, 19 nt, Homo sapiens
caacugugcuguaccuugu

SEQ ID NO: 631453 - RNA, 19 nt, Homo sapiens
gaaucuacaugaaugaaca

SEQ ID NO: 631454 - RNA, 19 nt, Homo sapiens
gacagguucugagauauaa

SEQ ID NO: 631455 - RNA, 19 nt, Homo sapiens
cagaaaugcuccaggaaug

SEQ ID NO: 631456 - RNA, 19 nt, Homo sapiens
gauggaagaacuuaaagaa

SEQ ID NO: 631457 - RNA, 19 nt, Homo sapiens
ggagaagggccauuagaug

SEQ ID NO: 631458 - RNA, 19 nt, Homo sapiens
gagaagggccauuagaugu

SEQ ID NO: 631459 - RNA, 19 nt, Homo sapiens
guagaaucauguuuacuca

SEQ ID NO: 631460 - RNA, 19 nt, Homo sapiens
ccaagcggcuggagaagau

SEQ ID NO: 631461 - RNA, 19 nt, Homo sapiens
ggacaagauugaggagaug

SEQ ID NO: 631462 - RNA, 19 nt, Homo sapiens
ggaagcugcucaggucuug

SEQ ID NO: 631463 - RNA, 19 nt, Homo sapiens
gaugaagcuuugaguaaca

SEQ ID NO: 631464 - RNA, 19 nt, Homo sapiens
aaagaacaccugugaaaga

SEQ ID NO: 631465 - RNA, 19 nt, Homo sapiens
ugagaaugcugagaaaguu

SEQ ID NO: 631466 - RNA, 19 nt, Homo sapiens
ugaguaacauugccagaga

SEQ ID NO: 631467 - RNA, 19 nt, Homo sapiens
gcaauucagacuucaguga

SEQ ID NO: 631468 - RNA, 19 nt, Homo sapiens
uuagaaaggcagaaacaua

SEQ ID NO: 631469 - RNA, 19 nt, Homo sapiens
ggcagaagcaagagauaua

SEQ ID NO: 631470 - RNA, 19 nt, Homo sapiens
gcagaauggcucagacuug

SEQ ID NO: 631471 - RNA, 19 nt, Homo sapiens
gauccagacacuucauuaa

SEQ ID NO: 631472 - RNA, 19 nt, Homo sapiens
gggaaguccaggccuaaua

SEQ ID NO: 631473 - RNA, 19 nt, Homo sapiens
gguuuccaaugcacaguua

SEQ ID NO: 631474 - RNA, 19 nt, Homo sapiens
ugaaugaacacuuuggauu

SEQ ID NO: 631475 - RNA, 19 nt, Homo sapiens
cugagaaaguugaagauga

SEQ ID NO: 631476 - RNA, 19 nt, Homo sapiens
agggacagguucugagaua

SEQ ID NO: 631477 - RNA, 19 nt, Homo sapiens
uagaaaggcagaaacauau

SEQ ID NO: 631478 - RNA, 19 nt, Homo sapiens
aggaacagauggcagaauu

SEQ ID NO: 631479 - RNA, 19 nt, Homo sapiens
gaaccaguccaugcuguuu

SEQ ID NO: 631480 - RNA, 19 nt, Homo sapiens
gcagaacaggauauaacua

SEQ ID NO: 631481 - RNA, 19 nt, Homo sapiens
aaagaaggccugcggcaaa

SEQ ID NO: 631482 - RNA, 19 nt, Homo sapiens
gaaaggcagaaacauaugu

SEQ ID NO: 631483 - RNA, 19 nt, Homo sapiens
aaagagaugagcuuauuga

SEQ ID NO: 631484 - RNA, 19 nt, Homo sapiens
gagaagaacaauuugaucu

SEQ ID NO: 631485 - RNA, 19 nt, Homo sapiens
gacaaacaguaugcugaaa

SEQ ID NO: 631486 - RNA, 19 nt, Homo sapiens
gcuuauuuguggaaugaaa

SEQ ID NO: 631487 - RNA, 19 nt, Homo sapiens
ugcuguaccuuguaaagua

SEQ ID NO: 631488 - RNA, 19 nt, Homo sapiens
agacagcaauucuaugagu

SEQ ID NO: 631489 - RNA, 19 nt, Homo sapiens
gagaagaugaaggccaaua

SEQ ID NO: 631490 - RNA, 19 nt, Homo sapiens
aagaugaagcuuugaguaa

SEQ ID NO: 631491 - RNA, 19 nt, Homo sapiens
caacgagaguuacgaacag

SEQ ID NO: 631492 - RNA, 19 nt, Homo sapiens
ggaacagauggcagaauuu

SEQ ID NO: 631493 - RNA, 19 nt, Homo sapiens
gugaauugcgggaaucuuu

SEQ ID NO: 631494 - RNA, 19 nt, Homo sapiens
gccugcagauucuauuaaa

SEQ ID NO: 631495 - RNA, 19 nt, Homo sapiens
aaugaaaccucaaacaaac

SEQ ID NO: 631496 - RNA, 19 nt, Homo sapiens
acacaaaccccuuuuagua

SEQ ID NO: 631497 - RNA, 19 nt, Homo sapiens
gcagaaacauauguguagu

SEQ ID NO: 631498 - RNA, 19 nt, Homo sapiens
gcgggaaucuuugucugaa

SEQ ID NO: 631499 - RNA, 19 nt, Homo sapiens
gcuguaccuuguaaaguau

SEQ ID NO: 631500 - RNA, 19 nt, Homo sapiens
acagacagcaauucuauga

SEQ ID NO: 631501 - RNA, 19 nt, Homo sapiens
aaacagccaccuuuguauu

SEQ ID NO: 631502 - RNA, 19 nt, Homo sapiens
gaugccaauagacaaauua

SEQ ID NO: 631503 - RNA, 19 nt, Homo sapiens
gaaggggucuagauguaaa

SEQ ID NO: 631504 - RNA, 19 nt, Homo sapiens
gcaagagauauacgcauga

SEQ ID NO: 631505 - RNA, 19 nt, Homo sapiens
gggaaucuuugucugaagu

SEQ ID NO: 631506 - RNA, 19 nt, Homo sapiens
uaauagauccagacacuuc

SEQ ID NO: 631507 - RNA, 19 nt, Homo sapiens
gcucagacuugcaguucau

SEQ ID NO: 631508 - RNA, 19 nt, Homo sapiens
gaacagauggcagaauuuu

SEQ ID NO: 631509 - RNA, 19 nt, Homo sapiens
caauuugaucuaccaagua

SEQ ID NO: 631510 - RNA, 19 nt, Homo sapiens
agaaacauauguguagugu

SEQ ID NO: 631511 - RNA, 19 nt, Homo sapiens
ugcagaagaugaagcuuug

SEQ ID NO: 631512 - RNA, 19 nt, Homo sapiens
uaaaacagccaccuuugua

SEQ ID NO: 631513 - RNA, 19 nt, Homo sapiens
uaacuaccuuggagcaaag

SEQ ID NO: 631514 - RNA, 19 nt, Homo sapiens
cuuaauagauccagacacu

SEQ ID NO: 631515 - RNA, 19 nt, Homo sapiens
ggaguuagaaaggcagaaa

SEQ ID NO: 631516 - RNA, 19 nt, Homo sapiens
uagacacacucaaggaugu

SEQ ID NO: 631517 - RNA, 19 nt, Homo sapiens
ugacaaacaguaugcugaa

SEQ ID NO: 631518 - RNA, 19 nt, Homo sapiens
aguaagaguuggguccuuu

SEQ ID NO: 631519 - RNA, 19 nt, Homo sapiens
gaaaugcuccaggaaugau

SEQ ID NO: 631520 - RNA, 19 nt, Homo sapiens
aggaagaacuacugucaca

SEQ ID NO: 631521 - RNA, 19 nt, Homo sapiens
agaagggccauuagaugua

SEQ ID NO: 631522 - RNA, 19 nt, Homo sapiens
gauauacgcaugagagaac

SEQ ID NO: 631523 - RNA, 19 nt, Homo sapiens
acaauuugaucuaccaagu

SEQ ID NO: 631524 - RNA, 19 nt, Homo sapiens
agaccuucaucucgaaauu

SEQ ID NO: 631525 - RNA, 19 nt, Homo sapiens
gaggaggaacgacagaaau

SEQ ID NO: 631526 - RNA, 19 nt, Homo sapiens
ggacauugccuucuuguua

SEQ ID NO: 631527 - RNA, 19 nt, Homo sapiens
cagcaaagguucuggaaua

SEQ ID NO: 631528 - RNA, 19 nt, Homo sapiens
ggaaagagauggauaucac

SEQ ID NO: 631529 - RNA, 19 nt, Homo sapiens
caaagguucuggaauaaca

SEQ ID NO: 631530 - RNA, 19 nt, Homo sapiens
ccaacuaacucgcuucaau

SEQ ID NO: 631531 - RNA, 19 nt, Homo sapiens
ccacuucccuuccucagaa

SEQ ID NO: 631532 - RNA, 19 nt, Homo sapiens
ccaaacuacuguaaaggaa

SEQ ID NO: 631533 - RNA, 19 nt, Homo sapiens
gaacacagggcccaaaugg

SEQ ID NO: 631534 - RNA, 19 nt, Homo sapiens
ccaauuaguguccuuauga

SEQ ID NO: 631535 - RNA, 19 nt, Homo sapiens
agagguaccuggcauauac

SEQ ID NO: 631536 - RNA, 19 nt, Homo sapiens
aaccuucccugaugucuaa

SEQ ID NO: 631537 - RNA, 19 nt, Homo sapiens
uugaggagcugcuagaaga

SEQ ID NO: 631538 - RNA, 19 nt, Homo sapiens
gaacuugucuccgaguacu

SEQ ID NO: 631539 - RNA, 19 nt, Homo sapiens
agagagaaccgcaccauug

SEQ ID NO: 631540 - RNA, 19 nt, Homo sapiens
gacauugccuucuuguuac

SEQ ID NO: 631541 - RNA, 19 nt, Homo sapiens
cuaacucgcuucaaucucu

SEQ ID NO: 631542 - RNA, 19 nt, Homo sapiens
uuaguguccuuaugauuga

SEQ ID NO: 631543 - RNA, 19 nt, Homo sapiens
ccuccugugucccguauaa

SEQ ID NO: 631544 - RNA, 19 nt, Homo sapiens
uucagaaccuuaucaauca

SEQ ID NO: 631545 - RNA, 19 nt, Homo sapiens
caauuaguguccuuaugau

SEQ ID NO: 631546 - RNA, 19 nt, Homo sapiens
ggaguaugaggguaugauu

SEQ ID NO: 631547 - RNA, 19 nt, Homo sapiens
agagauggauaucacacaa

SEQ ID NO: 631548 - RNA, 19 nt, Homo sapiens
caacuaacucgcuucaauc

SEQ ID NO: 631549 - RNA, 19 nt, Homo sapiens
gaaagagauggauaucaca

SEQ ID NO: 631550 - RNA, 19 nt, Homo sapiens
gccauuauucagaaccuua

SEQ ID NO: 631551 - RNA, 19 nt, Homo sapiens
ggaaagggaaucucuucuc

SEQ ID NO: 631552 - RNA, 19 nt, Homo sapiens
ucggaaggcuaaauuucuu

SEQ ID NO: 631553 - RNA, 19 nt, Homo sapiens
gcauucggaaggcuaaauu

SEQ ID NO: 631554 - RNA, 19 nt, Homo sapiens
gcucuggcauggcacuuca

SEQ ID NO: 631555 - RNA, 19 nt, Homo sapiens
gaccaaaccgaggacuaua

SEQ ID NO: 631556 - RNA, 19 nt, Homo sapiens
gagagaaccgcaccauugg

SEQ ID NO: 631557 - RNA, 19 nt, Homo sapiens
ccaaucacgccauuauuca

SEQ ID NO: 631558 - RNA, 19 nt, Homo sapiens
ggagauuccucaaaaccuu

SEQ ID NO: 631559 - RNA, 19 nt, Homo sapiens
caaggaguaugaggguaug

SEQ ID NO: 631560 - RNA, 19 nt, Homo sapiens
ccuccacccuuuccaaauc

SEQ ID NO: 631561 - RNA, 19 nt, Homo sapiens
agcaaagguucuggaauaa

SEQ ID NO: 631562 - RNA, 19 nt, Homo sapiens
cgaggacuauaccaacuag

SEQ ID NO: 631563 - RNA, 19 nt, Homo sapiens
guaccuggcauauacagau

SEQ ID NO: 631564 - RNA, 19 nt, Homo sapiens
gaguaugaggguaugauug

SEQ ID NO: 631565 - RNA, 19 nt, Homo sapiens
ggaacacagggcccaaaug

SEQ ID NO: 631566 - RNA, 19 nt, Homo sapiens
gaaccuuaucaaucaguug

SEQ ID NO: 631567 - RNA, 19 nt, Homo sapiens
aguguucccuccacccuuu

SEQ ID NO: 631568 - RNA, 19 nt, Homo sapiens
guccuccucaguauucuua

SEQ ID NO: 631569 - RNA, 19 nt, Homo sapiens
aaacuacuguaaaggaacu

SEQ ID NO: 631570 - RNA, 19 nt, Homo sapiens
uggaggaguucauggaaag

SEQ ID NO: 631571 - RNA, 19 nt, Homo sapiens
guuacugccucuuccucaa

SEQ ID NO: 631572 - RNA, 19 nt, Homo sapiens
gccaucaucuccaacuaac

SEQ ID NO: 631573 - RNA, 19 nt, Homo sapiens
uaugauugcugagucuugu

SEQ ID NO: 631574 - RNA, 19 nt, Homo sapiens
ugaggcaaaugggaguauu

SEQ ID NO: 631575 - RNA, 19 nt, Homo sapiens
aaaccgaggacuauaccaa

SEQ ID NO: 631576 - RNA, 19 nt, Homo sapiens
cagagguaccuggcauaua

SEQ ID NO: 631577 - RNA, 19 nt, Homo sapiens
ccugugucccguauaagua

SEQ ID NO: 631578 - RNA, 19 nt, Homo sapiens
ggcauucacugcgguacau

SEQ ID NO: 631579 - RNA, 19 nt, Homo sapiens
auucagaaccuuaucaauc

SEQ ID NO: 631580 - RNA, 19 nt, Homo sapiens
cccaaucacgccauuauuc

SEQ ID NO: 631581 - RNA, 19 nt, Homo sapiens
gcacuucauccuuggacau

SEQ ID NO: 631582 - RNA, 19 nt, Homo sapiens
acaaggaguaugaggguau

SEQ ID NO: 631583 - RNA, 19 nt, Homo sapiens
guacuacgcgauggucuca

SEQ ID NO: 631584 - RNA, 19 nt, Homo sapiens
caucaucuccaacuaacuc

SEQ ID NO: 631585 - RNA, 19 nt, Homo sapiens
caugggcacccuagagaga

SEQ ID NO: 631586 - RNA, 19 nt, Homo sapiens
gaggagcugcuagaagaau

SEQ ID NO: 631587 - RNA, 19 nt, Homo sapiens
caagggacacaggauccua

SEQ ID NO: 631588 - RNA, 19 nt, Homo sapiens
ucuaacgcuuggaaagaga

SEQ ID NO: 631589 - RNA, 19 nt, Homo sapiens
agaccaaaccgaggacuau

SEQ ID NO: 631590 - RNA, 19 nt, Homo sapiens
ugaagcccuugaccagugu

SEQ ID NO: 631591 - RNA, 19 nt, Homo sapiens
ccggagaacccgacaagca

SEQ ID NO: 631592 - RNA, 19 nt, Homo sapiens
aaacccaaccaaccacuuc

SEQ ID NO: 631593 - RNA, 19 nt, Homo sapiens
ccgccaucaucuccaacua

SEQ ID NO: 631594 - RNA, 19 nt, Homo sapiens
gcuuuccucucagaccaaa

SEQ ID NO: 631595 - RNA, 19 nt, Homo sapiens
ggguaugauugcugagucu

SEQ ID NO: 631596 - RNA, 19 nt, Homo sapiens
auuaguguccuuaugauug

SEQ ID NO: 631597 - RNA, 19 nt, Homo sapiens
uccaauuaguguccuuaug

SEQ ID NO: 631598 - RNA, 19 nt, Homo sapiens
aggaacuugucuccgagua

SEQ ID NO: 631599 - RNA, 19 nt, Homo sapiens
ccuuggacauugccuucuu

SEQ ID NO: 631600 - RNA, 19 nt, Homo sapiens
gcaaagguucuggaauaac

SEQ ID NO: 631601 - RNA, 19 nt, Homo sapiens
agauggauaucacacaacu

SEQ ID NO: 631602 - RNA, 19 nt, Homo sapiens
gcuuggaaagagauggaua

SEQ ID NO: 631603 - RNA, 19 nt, Homo sapiens
cgccaucaucuccaacuaa

SEQ ID NO: 631604 - RNA, 19 nt, Homo sapiens
uuaccgccaucaucuccaa

SEQ ID NO: 631605 - RNA, 19 nt, Homo sapiens
guaugauugcugagucuug

SEQ ID NO: 631606 - RNA, 19 nt, Homo sapiens
gcccuccugugucccguau

SEQ ID NO: 631607 - RNA, 19 nt, Homo sapiens
aaucacgccauuauucaga

SEQ ID NO: 631608 - RNA, 19 nt, Homo sapiens
auacagauccugggcuuuc

SEQ ID NO: 631609 - RNA, 19 nt, Homo sapiens
cccaaacuacuguaaagga

SEQ ID NO: 631610 - RNA, 19 nt, Homo sapiens
ccuccucaguauucuuaga

SEQ ID NO: 631611 - RNA, 19 nt, Homo sapiens
aaaccuucccugaugucua

SEQ ID NO: 631612 - RNA, 19 nt, Homo sapiens
ccgaggacuauaccaacua

SEQ ID NO: 631613 - RNA, 19 nt, Homo sapiens
agaaccuuaucaaucaguu

SEQ ID NO: 631614 - RNA, 19 nt, Homo sapiens
acuacgcgauggucucaau

SEQ ID NO: 631615 - RNA, 19 nt, Homo sapiens
ugcgguacaugcuggaguu

SEQ ID NO: 631616 - RNA, 19 nt, Homo sapiens
uuacugccucuuccucaaa

SEQ ID NO: 631617 - RNA, 19 nt, Homo sapiens
auccugggcuuuccucuca

SEQ ID NO: 631618 - RNA, 19 nt, Homo sapiens
uagagagaaccgcaccauu

SEQ ID NO: 631619 - RNA, 19 nt, Homo sapiens
auggauaucacacaacuug

SEQ ID NO: 631620 - RNA, 19 nt, Homo sapiens
gaacaaagcaacacaauua

SEQ ID NO: 631621 - RNA, 19 nt, Homo sapiens
agaaacaacugccaaauaa

SEQ ID NO: 631622 - RNA, 19 nt, Homo sapiens
gaaaagaccuuccggaauu

SEQ ID NO: 631623 - RNA, 19 nt, Homo sapiens
gaaccaagcacuaccagua

SEQ ID NO: 631624 - RNA, 19 nt, Homo sapiens
gaaacucagcucuauguua

SEQ ID NO: 631625 - RNA, 19 nt, Homo sapiens
uaacugggaugcagagaaa

SEQ ID NO: 631626 - RNA, 19 nt, Homo sapiens
aaacucagcucuauguuau

SEQ ID NO: 631627 - RNA, 19 nt, Homo sapiens
ggaagugauuacuccuuua

SEQ ID NO: 631628 - RNA, 19 nt, Homo sapiens
gcaacacaauuauucacua

SEQ ID NO: 631629 - RNA, 19 nt, Homo sapiens
gaaaacaacugguacuuug

SEQ ID NO: 631630 - RNA, 19 nt, Homo sapiens
ggauuucgauugcaucauu

SEQ ID NO: 631631 - RNA, 19 nt, Homo sapiens
cagaacgccucauuuaauu

SEQ ID NO: 631632 - RNA, 19 nt, Homo sapiens
ugaaauggcuaguggaaug

SEQ ID NO: 631633 - RNA, 19 nt, Homo sapiens
guuccagccucuucaaaua

SEQ ID NO: 631634 - RNA, 19 nt, Homo sapiens
ccagugaugugggaaguua

SEQ ID NO: 631635 - RNA, 19 nt, Homo sapiens
cagugaagauguguaaaua

SEQ ID NO: 631636 - RNA, 19 nt, Homo sapiens
cagaaacaacugccaaaua

SEQ ID NO: 631637 - RNA, 19 nt, Homo sapiens
uaagggaaauacacagauu

SEQ ID NO: 631638 - RNA, 19 nt, Homo sapiens
ggacacugauguggaauau

SEQ ID NO: 631639 - RNA, 19 nt, Homo sapiens
ucaauagucucuccucgaa

SEQ ID NO: 631640 - RNA, 19 nt, Homo sapiens
gcagagaaagccaaauuug

SEQ ID NO: 631641 - RNA, 19 nt, Homo sapiens
caaagcaacacaauuauuc

SEQ ID NO: 631642 - RNA, 19 nt, Homo sapiens
acaaacaugucauaguuga

SEQ ID NO: 631643 - RNA, 19 nt, Homo sapiens
gcaagccuauagucauuga

SEQ ID NO: 631644 - RNA, 19 nt, Homo sapiens
gaacggaaacggauucuac

SEQ ID NO: 631645 - RNA, 19 nt, Homo sapiens
aggagaagcucacgaauca

SEQ ID NO: 631646 - RNA, 19 nt, Homo sapiens
aaacugacauuccuaacau

SEQ ID NO: 631647 - RNA, 19 nt, Homo sapiens
gauguggaauaucuagaaa

SEQ ID NO: 631648 - RNA, 19 nt, Homo sapiens
gaaacaacugccaaauaaa

SEQ ID NO: 631649 - RNA, 19 nt, Homo sapiens
gugaagauguguaaauaag

SEQ ID NO: 631650 - RNA, 19 nt, Homo sapiens
caagaucauucacacaugu

SEQ ID NO: 631651 - RNA, 19 nt, Homo sapiens
uaugugaccuguucuuaga

SEQ ID NO: 631652 - RNA, 19 nt, Homo sapiens
accaguaucuccauccuua

SEQ ID NO: 631653 - RNA, 19 nt, Homo sapiens
gaaagccaaauuugugaaa

SEQ ID NO: 631654 - RNA, 19 nt, Homo sapiens
gauuucgauugcaucauua

SEQ ID NO: 631655 - RNA, 19 nt, Homo sapiens
aaacaacaaucuccagaca

SEQ ID NO: 631656 - RNA, 19 nt, Homo sapiens
gcaagacaaucaccaucug

SEQ ID NO: 631657 - RNA, 19 nt, Homo sapiens
gagaaagccaaauuuguga

SEQ ID NO: 631658 - RNA, 19 nt, Homo sapiens
cuacucccaucaauccuua

SEQ ID NO: 631659 - RNA, 19 nt, Homo sapiens
ggaaagggguggacuccua

SEQ ID NO: 631660 - RNA, 19 nt, Homo sapiens
gaacuccuuugaugugauc

SEQ ID NO: 631661 - RNA, 19 nt, Homo sapiens
caugaugacucuucuuauc

SEQ ID NO: 631662 - RNA, 19 nt, Homo sapiens
gcaggucucuguuuugaaa

SEQ ID NO: 631663 - RNA, 19 nt, Homo sapiens
ggaacaaagcaacacaauu

SEQ ID NO: 631664 - RNA, 19 nt, Homo sapiens
gcagugaagauguguaaau

SEQ ID NO: 631665 - RNA, 19 nt, Homo sapiens
ugaacucaaugcaugauga

SEQ ID NO: 631666 - RNA, 19 nt, Homo sapiens
acucagaacgccucauuua

SEQ ID NO: 631667 - RNA, 19 nt, Homo sapiens
acacugauguggaauaucu

SEQ ID NO: 631668 - RNA, 19 nt, Homo sapiens
gacaaucaccaucugaauu

SEQ ID NO: 631669 - RNA, 19 nt, Homo sapiens
gcacauccacuguaguaug

SEQ ID NO: 631670 - RNA, 19 nt, Homo sapiens
agaccugccuuaucaauca

SEQ ID NO: 631671 - RNA, 19 nt, Homo sapiens
caacaucaagucaauuuca

SEQ ID NO: 631672 - RNA, 19 nt, Homo sapiens
acacagauuuacaaacaug

SEQ ID NO: 631673 - RNA, 19 nt, Homo sapiens
ucagaacgccucauuuaau

SEQ ID NO: 631674 - RNA, 19 nt, Homo sapiens
ggaauuaugacaacauuac

SEQ ID NO: 631675 - RNA, 19 nt, Homo sapiens
cucaagaccugccuuauca

SEQ ID NO: 631676 - RNA, 19 nt, Homo sapiens
ucaagucaauuucaagaca

SEQ ID NO: 631677 - RNA, 19 nt, Homo sapiens
gauguuaucucauuauccu

SEQ ID NO: 631678 - RNA, 19 nt, Homo sapiens
uggaagugauuacuccuuu

SEQ ID NO: 631679 - RNA, 19 nt, Homo sapiens
uuacagaauuugcaaaguc

SEQ ID NO: 631680 - RNA, 19 nt, Homo sapiens
ggaaucagaaagaagcaaa

SEQ ID NO: 631681 - RNA, 19 nt, Homo sapiens
acaacaacaucaagucaau

SEQ ID NO: 631682 - RNA, 19 nt, Homo sapiens
ucacaucgaacuccuuuga

SEQ ID NO: 631683 - RNA, 19 nt, Homo sapiens
uaucacacuugcaaaugaa

SEQ ID NO: 631684 - RNA, 19 nt, Homo sapiens
ccaagaucauucacacaug

SEQ ID NO: 631685 - RNA, 19 nt, Homo sapiens
gcaauucuuggaagugauu

SEQ ID NO: 631686 - RNA, 19 nt, Homo sapiens
cagggacacugauguggaa

SEQ ID NO: 631687 - RNA, 19 nt, Homo sapiens
ccacaccaaugcaacuguu

SEQ ID NO: 631688 - RNA, 19 nt, Homo sapiens
uuccacaucuagaguauuu

SEQ ID NO: 631689 - RNA, 19 nt, Homo sapiens
cugcagcucuuguuauuca

SEQ ID NO: 631690 - RNA, 19 nt, Homo sapiens
gcgcaugagacaccaaauu

SEQ ID NO: 631691 - RNA, 19 nt, Homo sapiens
gaacgccucauuuaauucu

SEQ ID NO: 631692 - RNA, 19 nt, Homo sapiens
cagaagcccuguucauggu

SEQ ID NO: 631693 - RNA, 19 nt, Homo sapiens
gaugugggaaguuaccuuu

SEQ ID NO: 631694 - RNA, 19 nt, Homo sapiens
uuaucacacuugcaaauga

SEQ ID NO: 631695 - RNA, 19 nt, Homo sapiens
caagauucauuggugauuc

SEQ ID NO: 631696 - RNA, 19 nt, Homo sapiens
cauugaaacucagcucuau

SEQ ID NO: 631697 - RNA, 19 nt, Homo sapiens
agagaaagccaaauuugug

SEQ ID NO: 631698 - RNA, 19 nt, Homo sapiens
ucuauaagcgagacaguuu

SEQ ID NO: 631699 - RNA, 19 nt, Homo sapiens
aauugugacuguaaacuga

SEQ ID NO: 631700 - RNA, 19 nt, Homo sapiens
gaggauguguacgcaguga

SEQ ID NO: 631701 - RNA, 19 nt, Homo sapiens
ccagcguccuguaauuuau

SEQ ID NO: 631702 - RNA, 19 nt, Homo sapiens
gaggagaagcucacgaauc

SEQ ID NO: 631703 - RNA, 19 nt, Homo sapiens
caaacugacauuccuaaca

SEQ ID NO: 631704 - RNA, 19 nt, Homo sapiens
uaaccaaacugacauuccu

SEQ ID NO: 631705 - RNA, 19 nt, Homo sapiens
ggauucuacucccaucaau

SEQ ID NO: 631706 - RNA, 19 nt, Homo sapiens
gagacaguuuugcaaauaa

SEQ ID NO: 631707 - RNA, 19 nt, Homo sapiens
cgagacaguuuugcaaaua

SEQ ID NO: 631708 - RNA, 19 nt, Homo sapiens
uuacucaaguguauaacug

SEQ ID NO: 631709 - RNA, 19 nt, Homo sapiens
cagagaaagccaaauuugu

SEQ ID NO: 631710 - RNA, 19 nt, Homo sapiens
gaagugauuacuccuuuac

SEQ ID NO: 631711 - RNA, 19 nt, Homo sapiens
gcgaggagaagcucacgaa

SEQ ID NO: 631712 - RNA, 19 nt, Homo sapiens
acucagcucuauguuauug

SEQ ID NO: 631713 - RNA, 19 nt, Homo sapiens
caagucaauuucaagacau

SEQ ID NO: 631714 - RNA, 19 nt, Homo sapiens
cuccugauguuaucucauu

SEQ ID NO: 631715 - RNA, 19 nt, Homo sapiens
acaaucaccaucugaauuc

SEQ ID NO: 631716 - RNA, 19 nt, Homo sapiens
guacagggacacugaugug

SEQ ID NO: 631717 - RNA, 19 nt, Homo sapiens
ccggaauuaugacaacauu

SEQ ID NO: 631718 - RNA, 19 nt, Homo sapiens
ucgauugcaucauuacaga

SEQ ID NO: 631719 - RNA, 19 nt, Homo sapiens
acaacaaucuccagacacu

SEQ ID NO: 631720 - RNA, 19 nt, Homo sapiens
cagaagagcugcacauuug

SEQ ID NO: 631721 - RNA, 19 nt, Homo sapiens
gcagagagaucgaaaucca

SEQ ID NO: 631722 - RNA, 19 nt, Homo sapiens
ccaaacugcucaggcauaa

SEQ ID NO: 631723 - RNA, 19 nt, Homo sapiens
guaugucuguguauguaua

SEQ ID NO: 631724 - RNA, 19 nt, Homo sapiens
acaaggagcugcagaagag

SEQ ID NO: 631725 - RNA, 19 nt, Homo sapiens
gccagaaggugauggagaa

SEQ ID NO: 631726 - RNA, 19 nt, Homo sapiens
gaacagccacgaucaugga

SEQ ID NO: 631727 - RNA, 19 nt, Homo sapiens
gcauuggagugcuuugcua

SEQ ID NO: 631728 - RNA, 19 nt, Homo sapiens
guacuuggcucgggagaag

SEQ ID NO: 631729 - RNA, 19 nt, Homo sapiens
guuggcagaugcucuaaug

SEQ ID NO: 631730 - RNA, 19 nt, Homo sapiens
ggaguuggcagaugcucua

SEQ ID NO: 631731 - RNA, 19 nt, Homo sapiens
ccuccuccuuuguuuaaua

SEQ ID NO: 631732 - RNA, 19 nt, Homo sapiens
gaacccacccuuugagagu

SEQ ID NO: 631733 - RNA, 19 nt, Homo sapiens
cuucacaauugaugacuuu

SEQ ID NO: 631734 - RNA, 19 nt, Homo sapiens
acuguucccuuaucuguuu

SEQ ID NO: 631735 - RNA, 19 nt, Homo sapiens
guggaucuguggugcauug

SEQ ID NO: 631736 - RNA, 19 nt, Homo sapiens
acgcggcacuucacaauug

SEQ ID NO: 631737 - RNA, 19 nt, Homo sapiens
agaaggugauggagaauag

SEQ ID NO: 631738 - RNA, 19 nt, Homo sapiens
ugggacacccgacaucuua

SEQ ID NO: 631739 - RNA, 19 nt, Homo sapiens
ccucugcccuucaaucugu

SEQ ID NO: 631740 - RNA, 19 nt, Homo sapiens
cagaugcucuaauguacug

SEQ ID NO: 631741 - RNA, 19 nt, Homo sapiens
uggcagaugcucuaaugua

SEQ ID NO: 631742 - RNA, 19 nt, Homo sapiens
ggcagaugcucuaauguac

SEQ ID NO: 631743 - RNA, 19 nt, Homo sapiens
ccacgaucauggaggaguu

SEQ ID NO: 631744 - RNA, 19 nt, Homo sapiens
ucaagguccucuucaaguc

SEQ ID NO: 631745 - RNA, 19 nt, Homo sapiens
uaacuguucccuuaucugu

SEQ ID NO: 631746 - RNA, 19 nt, Homo sapiens
caagggagagcugaagauu

SEQ ID NO: 631747 - RNA, 19 nt, Homo sapiens
gcgcagagagaucgaaauc

SEQ ID NO: 631748 - RNA, 19 nt, Homo sapiens
gcggggagcucuacaagga

SEQ ID NO: 631749 - RNA, 19 nt, Homo sapiens
aucccuaacuguucccuua

SEQ ID NO: 631750 - RNA, 19 nt, Homo sapiens
ucaagucccagauagagaa

SEQ ID NO: 631751 - RNA, 19 nt, Homo sapiens
agggagagcugaagauugc

SEQ ID NO: 631752 - RNA, 19 nt, Homo sapiens
uaacgcggcacuucacaau

SEQ ID NO: 631753 - RNA, 19 nt, Homo sapiens
guguuuguaugucugugua

SEQ ID NO: 631754 - RNA, 19 nt, Homo sapiens
guacugccaugggaagaag

SEQ ID NO: 631755 - RNA, 19 nt, Homo sapiens
caucugcacuuguccucau

SEQ ID NO: 631756 - RNA, 19 nt, Homo sapiens
ucacaauugaugacuuuga

SEQ ID NO: 631757 - RNA, 19 nt, Homo sapiens
cagaaggugauggagaaua

SEQ ID NO: 631758 - RNA, 19 nt, Homo sapiens
gcgaacagccacgaucaug

SEQ ID NO: 631759 - RNA, 19 nt, Homo sapiens
uuggagugcuuugcuauga

SEQ ID NO: 631760 - RNA, 19 nt, Homo sapiens
ggauggcccagaaggagaa

SEQ ID NO: 631761 - RNA, 19 nt, Homo sapiens
uaccuccuccuuuguuuaa

SEQ ID NO: 631762 - RNA, 19 nt, Homo sapiens
gauggucccugucauucac

SEQ ID NO: 631763 - RNA, 19 nt, Homo sapiens
caucacacaacgagaccua

SEQ ID NO: 631764 - RNA, 19 nt, Homo sapiens
cugcgucucuacaacuauu

SEQ ID NO: 631765 - RNA, 19 nt, Homo sapiens
caucagcugcgcagagaga

SEQ ID NO: 631766 - RNA, 19 nt, Homo sapiens
cacaauugaugacuuugag

SEQ ID NO: 631767 - RNA, 19 nt, Homo sapiens
gcucaagguccucuucaag

SEQ ID NO: 631768 - RNA, 19 nt, Homo sapiens
ccucuucaagucccagaua

SEQ ID NO: 631769 - RNA, 19 nt, Homo sapiens
cuccuccuuuguuuaauaa

SEQ ID NO: 631770 - RNA, 19 nt, Homo sapiens
cuaccuccuccuuuguuua

SEQ ID NO: 631771 - RNA, 19 nt, Homo sapiens
gggaacccacccuuugaga

SEQ ID NO: 631772 - RNA, 19 nt, Homo sapiens
auugaugacuuugagauug

SEQ ID NO: 631773 - RNA, 19 nt, Homo sapiens
caauugaugacuuugagau

SEQ ID NO: 631774 - RNA, 19 nt, Homo sapiens
ucuaccuccuccuuuguuu

SEQ ID NO: 631775 - RNA, 19 nt, Homo sapiens
uuguaugucuguguaugua

SEQ ID NO: 631776 - RNA, 19 nt, Homo sapiens
gaagagcugcacauuugac

SEQ ID NO: 631777 - RNA, 19 nt, Homo sapiens
uaaggauggcccagaagga

SEQ ID NO: 631778 - RNA, 19 nt, Homo sapiens
acaaugagaagguggaucu

SEQ ID NO: 631779 - RNA, 19 nt, Homo sapiens
ccaacauccugcgucucua

SEQ ID NO: 631780 - RNA, 19 nt, Homo sapiens
gcacuucacaauugaugac

SEQ ID NO: 631781 - RNA, 19 nt, Homo sapiens
caucuuaacgcggcacuuc

SEQ ID NO: 631782 - RNA, 19 nt, Homo sapiens
caacauccugcgucucuac

SEQ ID NO: 631783 - RNA, 19 nt, Homo sapiens
ccugauggucccugucauu

SEQ ID NO: 631784 - RNA, 19 nt, Homo sapiens
cagcgaacagccacgauca

SEQ ID NO: 631785 - RNA, 19 nt, Homo sapiens
ccuaacuguucccuuaucu

SEQ ID NO: 631786 - RNA, 19 nt, Homo sapiens
ucacucgggugcguguguu

SEQ ID NO: 631787 - RNA, 19 nt, Homo sapiens
uccaaacugcucaggcaua

SEQ ID NO: 631788 - RNA, 19 nt, Homo sapiens
gaggaggaagacaaugugu

SEQ ID NO: 631789 - RNA, 19 nt, Homo sapiens
ccagcgaguccuccggaaa

SEQ ID NO: 631790 - RNA, 19 nt, Homo sapiens
gggacacccgacaucuuaa

SEQ ID NO: 631791 - RNA, 19 nt, Homo sapiens
gaaggagggcguggagcau

SEQ ID NO: 631792 - RNA, 19 nt, Homo sapiens
ggacacccgacaucuuaac

SEQ ID NO: 631793 - RNA, 19 nt, Homo sapiens
gcagaugcucuaauguacu

SEQ ID NO: 631794 - RNA, 19 nt, Homo sapiens
guacacugcuuagaaauua

SEQ ID NO: 631795 - RNA, 19 nt, Homo sapiens
guacucaucuuugaacuua

SEQ ID NO: 631796 - RNA, 19 nt, Homo sapiens
gcacuuccaccauguauua

SEQ ID NO: 631797 - RNA, 19 nt, Homo sapiens
gcacauggaacaaauuaua

SEQ ID NO: 631798 - RNA, 19 nt, Homo sapiens
ggaauacacuggcccauau

SEQ ID NO: 631799 - RNA, 19 nt, Homo sapiens
gaauaugguuggcauuaaa

SEQ ID NO: 631800 - RNA, 19 nt, Homo sapiens
gaagcuaacacuugaauuu

SEQ ID NO: 631801 - RNA, 19 nt, Homo sapiens
gaagagguucugauaauuu

SEQ ID NO: 631802 - RNA, 19 nt, Homo sapiens
gguuaaagguugcauuauu

SEQ ID NO: 631803 - RNA, 19 nt, Homo sapiens
gaacagauguggaauacac

SEQ ID NO: 631804 - RNA, 19 nt, Homo sapiens
ggaagagguucugauaauu

SEQ ID NO: 631805 - RNA, 19 nt, Homo sapiens
gaccaggcauuucuuauau

SEQ ID NO: 631806 - RNA, 19 nt, Homo sapiens
cuacuacugugccauaaua

SEQ ID NO: 631807 - RNA, 19 nt, Homo sapiens
ggaccaggcauuucuuaua

SEQ ID NO: 631808 - RNA, 19 nt, Homo sapiens
caagaaacagcaguaauua

SEQ ID NO: 631809 - RNA, 19 nt, Homo sapiens
cugaagcuaugccuuauua

SEQ ID NO: 631810 - RNA, 19 nt, Homo sapiens
caucauugcuacugucuuu

SEQ ID NO: 631811 - RNA, 19 nt, Homo sapiens
gaacguguccaacauagaa

SEQ ID NO: 631812 - RNA, 19 nt, Homo sapiens
ucaaggauaugcuguauuc

SEQ ID NO: 631813 - RNA, 19 nt, Homo sapiens
ucacuggucugucaagaaa

SEQ ID NO: 631814 - RNA, 19 nt, Homo sapiens
aaaguacacugcuuagaaa

SEQ ID NO: 631815 - RNA, 19 nt, Homo sapiens
uuacagcacucacaaagaa

SEQ ID NO: 631816 - RNA, 19 nt, Homo sapiens
ucaaccagcuuaucucuga

SEQ ID NO: 631817 - RNA, 19 nt, Homo sapiens
uuaaguugcugcugcuuua

SEQ ID NO: 631818 - RNA, 19 nt, Homo sapiens
gaacgcagaugaucagacu

SEQ ID NO: 631819 - RNA, 19 nt, Homo sapiens
guaagggccuguugccaaa

SEQ ID NO: 631820 - RNA, 19 nt, Homo sapiens
aaagaaagcacugguguua

SEQ ID NO: 631821 - RNA, 19 nt, Homo sapiens
ccaggcauuucuuauauaa

SEQ ID NO: 631822 - RNA, 19 nt, Homo sapiens
gcagauucaugaaaguaaa

SEQ ID NO: 631823 - RNA, 19 nt, Homo sapiens
gagcacauggaacaaauua

SEQ ID NO: 631824 - RNA, 19 nt, Homo sapiens
ugauggaccuggaauauau

SEQ ID NO: 631825 - RNA, 19 nt, Homo sapiens
gaagcaauuugucucauca

SEQ ID NO: 631826 - RNA, 19 nt, Homo sapiens
caguuuauguggagaauuu

SEQ ID NO: 631827 - RNA, 19 nt, Homo sapiens
gagaaugaacaucugaaua

SEQ ID NO: 631828 - RNA, 19 nt, Homo sapiens
gcccauauuucaaccuuaa

SEQ ID NO: 631829 - RNA, 19 nt, Homo sapiens
ucaagaaacagcaguaauu

SEQ ID NO: 631830 - RNA, 19 nt, Homo sapiens
ucagaagaaucaggaauuu

SEQ ID NO: 631831 - RNA, 19 nt, Homo sapiens
ucacuucuuugucucauuu

SEQ ID NO: 631832 - RNA, 19 nt, Homo sapiens
caaaugggaugaaaguaag

SEQ ID NO: 631833 - RNA, 19 nt, Homo sapiens
gaaagccagucuuccacuu

SEQ ID NO: 631834 - RNA, 19 nt, Homo sapiens
caaugaaggugauaacagu

SEQ ID NO: 631835 - RNA, 19 nt, Homo sapiens
acacuaagguauugauaga

SEQ ID NO: 631836 - RNA, 19 nt, Homo sapiens
cauaauagaggaugugauu

SEQ ID NO: 631837 - RNA, 19 nt, Homo sapiens
ucaaaugggaugaaaguaa

SEQ ID NO: 631838 - RNA, 19 nt, Homo sapiens
ugauauaacuccugugcaa

SEQ ID NO: 631839 - RNA, 19 nt, Homo sapiens
guacgaaaccgccagaaga

SEQ ID NO: 631840 - RNA, 19 nt, Homo sapiens
uggaagagguucugauaau

SEQ ID NO: 631841 - RNA, 19 nt, Homo sapiens
ggaaauaucacuggucugu

SEQ ID NO: 631842 - RNA, 19 nt, Homo sapiens
ugaugaagcuaacacuuga

SEQ ID NO: 631843 - RNA, 19 nt, Homo sapiens
aaauaucacuggucuguca

SEQ ID NO: 631844 - RNA, 19 nt, Homo sapiens
gaagcuaugccuuauuaug

SEQ ID NO: 631845 - RNA, 19 nt, Homo sapiens
ucgauuaccucuacaacuu

SEQ ID NO: 631846 - RNA, 19 nt, Homo sapiens
gagcucaaaugggaugaaa

SEQ ID NO: 631847 - RNA, 19 nt, Homo sapiens
gagacaggcuggaguaaac

SEQ ID NO: 631848 - RNA, 19 nt, Homo sapiens
agaaguauauggcccuuga

SEQ ID NO: 631849 - RNA, 19 nt, Homo sapiens
gcaccagcauggacuacuu

SEQ ID NO: 631850 - RNA, 19 nt, Homo sapiens
gccaaaguuucauugcuaa

SEQ ID NO: 631851 - RNA, 19 nt, Homo sapiens
gaacuuaauccgagaagca

SEQ ID NO: 631852 - RNA, 19 nt, Homo sapiens
gaaagaaagcacugguguu

SEQ ID NO: 631853 - RNA, 19 nt, Homo sapiens
guaugaggcuuucaaggau

SEQ ID NO: 631854 - RNA, 19 nt, Homo sapiens
gccaaauaauucagaagaa

SEQ ID NO: 631855 - RNA, 19 nt, Homo sapiens
caauuugucucaucaacau

SEQ ID NO: 631856 - RNA, 19 nt, Homo sapiens
caaaugaagaggaaauguu

SEQ ID NO: 631857 - RNA, 19 nt, Homo sapiens
ugaauaugguuggcauuaa

SEQ ID NO: 631858 - RNA, 19 nt, Homo sapiens
ccaggcaccuucuguggaa

SEQ ID NO: 631859 - RNA, 19 nt, Homo sapiens
uauaugaucugcuucuaca

SEQ ID NO: 631860 - RNA, 19 nt, Homo sapiens
gcuugccgcuguauuuaaa

SEQ ID NO: 631861 - RNA, 19 nt, Homo sapiens
gcgaguggcucacguagag

SEQ ID NO: 631862 - RNA, 19 nt, Homo sapiens
acaaggacauagauaccua

SEQ ID NO: 631863 - RNA, 19 nt, Homo sapiens
gaaguacaaccagagcaua

SEQ ID NO: 631864 - RNA, 19 nt, Homo sapiens
uguauccacuugcccuuua

SEQ ID NO: 631865 - RNA, 19 nt, Homo sapiens
gaagauggugacagacaaa

SEQ ID NO: 631866 - RNA, 19 nt, Homo sapiens
uuaauacacuccuaucauc

SEQ ID NO: 631867 - RNA, 19 nt, Homo sapiens
ugugugcccucacuagaua

SEQ ID NO: 631868 - RNA, 19 nt, Homo sapiens
ccaaggcucgugacacuaa

SEQ ID NO: 631869 - RNA, 19 nt, Homo sapiens
ggccuuuccucauuuaguu

SEQ ID NO: 631870 - RNA, 19 nt, Homo sapiens
uggaauauaugaucugcuu

SEQ ID NO: 631871 - RNA, 19 nt, Homo sapiens
gaggaacguguccaacaua

SEQ ID NO: 631872 - RNA, 19 nt, Homo sapiens
uugcuacacuucagaauga

SEQ ID NO: 631873 - RNA, 19 nt, Homo sapiens
gcucagcgcagguuugcua

SEQ ID NO: 631874 - RNA, 19 nt, Homo sapiens
cauggaagagguucugaua

SEQ ID NO: 631875 - RNA, 19 nt, Homo sapiens
caaggaaucccacacuuca

SEQ ID NO: 631876 - RNA, 19 nt, Homo sapiens
ggacgguacugagauaucu

SEQ ID NO: 631877 - RNA, 19 nt, Homo sapiens
uaucaucaguuccugcuau

SEQ ID NO: 631878 - RNA, 19 nt, Homo sapiens
ggaaacuuacguuggauga

SEQ ID NO: 631879 - RNA, 19 nt, Homo sapiens
cagcuuaucucugaaacug

SEQ ID NO: 631880 - RNA, 19 nt, Homo sapiens
ggaaacggcaggaugaagu

SEQ ID NO: 631881 - RNA, 19 nt, Homo sapiens
ggaagcaauacauccagua

SEQ ID NO: 631882 - RNA, 19 nt, Homo sapiens
uauuaugcauccacaugua

SEQ ID NO: 631883 - RNA, 19 nt, Homo sapiens
gaaacuuaaccauacagaa

SEQ ID NO: 631884 - RNA, 19 nt, Homo sapiens
gaaacggcaggaugaaguu

SEQ ID NO: 631885 - RNA, 19 nt, Homo sapiens
gaaugaacaucugaauaac

SEQ ID NO: 631886 - RNA, 19 nt, Homo sapiens
gauuaccucuacaacuuug

SEQ ID NO: 631887 - RNA, 19 nt, Homo sapiens
gaauauuacccuugugcuu

SEQ ID NO: 631888 - RNA, 19 nt, Homo sapiens
uagguuaaagguugcauua

SEQ ID NO: 631889 - RNA, 19 nt, Homo sapiens
uaugaggcuuucaaggaua

SEQ ID NO: 631890 - RNA, 19 nt, Homo sapiens
uaaauuccaggacauggua

SEQ ID NO: 631891 - RNA, 19 nt, Homo sapiens
acacagaugaugaagcuaa

SEQ ID NO: 631892 - RNA, 19 nt, Homo sapiens
caccaaaacuuucuacuau

SEQ ID NO: 631893 - RNA, 19 nt, Homo sapiens
gcagaaagccagucuucca

SEQ ID NO: 631894 - RNA, 19 nt, Homo sapiens
uaacacagcugacagaaag

SEQ ID NO: 631895 - RNA, 19 nt, Homo sapiens
gcaagaaucuguuccuagu

SEQ ID NO: 631896 - RNA, 19 nt, Homo sapiens
gagcugggcggaucaguua

SEQ ID NO: 631897 - RNA, 19 nt, Homo sapiens
ggaaagacccagaaaguca

SEQ ID NO: 631898 - RNA, 19 nt, Homo sapiens
gguuucaucugcccuauuu

SEQ ID NO: 631899 - RNA, 19 nt, Homo sapiens
ggauggaccuugcacucua

SEQ ID NO: 631900 - RNA, 19 nt, Homo sapiens
gaauacaagggccgaguua

SEQ ID NO: 631901 - RNA, 19 nt, Homo sapiens
caaggagucucaucuaucu

SEQ ID NO: 631902 - RNA, 19 nt, Homo sapiens
acaauggacuucuggcuuu

SEQ ID NO: 631903 - RNA, 19 nt, Homo sapiens
gugaaggguuccugaguaa

SEQ ID NO: 631904 - RNA, 19 nt, Homo sapiens
gagggaaggccaaggauuu

SEQ ID NO: 631905 - RNA, 19 nt, Homo sapiens
gcuagugaacgucuacuua

SEQ ID NO: 631906 - RNA, 19 nt, Homo sapiens
ugaaaugcaugugaggaua

SEQ ID NO: 631907 - RNA, 19 nt, Homo sapiens
gcagagagcacuggacuau

SEQ ID NO: 631908 - RNA, 19 nt, Homo sapiens
gcaggggucugguauaaaa

SEQ ID NO: 631909 - RNA, 19 nt, Homo sapiens
gcagaggcauagcuauugu

SEQ ID NO: 631910 - RNA, 19 nt, Homo sapiens
ucagagcccucaucacuuc

SEQ ID NO: 631911 - RNA, 19 nt, Homo sapiens
gagcgggcaugaacacaga

SEQ ID NO: 631912 - RNA, 19 nt, Homo sapiens
gccaaggagucucaucuau

SEQ ID NO: 631913 - RNA, 19 nt, Homo sapiens
gaacgucuacuuaucucaa

SEQ ID NO: 631914 - RNA, 19 nt, Homo sapiens
ggaggacagugauucagau

SEQ ID NO: 631915 - RNA, 19 nt, Homo sapiens
guccagagcaucuucagua

SEQ ID NO: 631916 - RNA, 19 nt, Homo sapiens
uaucucaaguucuaugcua

SEQ ID NO: 631917 - RNA, 19 nt, Homo sapiens
ggacagugauucagaugac

SEQ ID NO: 631918 - RNA, 19 nt, Homo sapiens
gaaaugcaugugaggauau

SEQ ID NO: 631919 - RNA, 19 nt, Homo sapiens
guaggcauguagagcaauu

SEQ ID NO: 631920 - RNA, 19 nt, Homo sapiens
ugugaaggguuccugagua

SEQ ID NO: 631921 - RNA, 19 nt, Homo sapiens
uccaauaccugcuucaugu

SEQ ID NO: 631922 - RNA, 19 nt, Homo sapiens
gcaauacccacgcaagaau

SEQ ID NO: 631923 - RNA, 19 nt, Homo sapiens
cagagcaucuucaguagca

SEQ ID NO: 631924 - RNA, 19 nt, Homo sapiens
agagagcacuggacuaugg

SEQ ID NO: 631925 - RNA, 19 nt, Homo sapiens
gggcagaggcauagcuauu

SEQ ID NO: 631926 - RNA, 19 nt, Homo sapiens
gguaagcuguaggcaugua

SEQ ID NO: 631927 - RNA, 19 nt, Homo sapiens
gaagaccagcugugaauac

SEQ ID NO: 631928 - RNA, 19 nt, Homo sapiens
gcggaucaguuaccaucaa

SEQ ID NO: 631929 - RNA, 19 nt, Homo sapiens
gaugugaugauaaaccaaa

SEQ ID NO: 631930 - RNA, 19 nt, Homo sapiens
gguugggucuuacacaaau

SEQ ID NO: 631931 - RNA, 19 nt, Homo sapiens
gaaaagggccguugaaagg

SEQ ID NO: 631932 - RNA, 19 nt, Homo sapiens
aaaugcaugugaggauaua

SEQ ID NO: 631933 - RNA, 19 nt, Homo sapiens
gugaauacgugagccucua

SEQ ID NO: 631934 - RNA, 19 nt, Homo sapiens
gaaagucacccugaauguc

SEQ ID NO: 631935 - RNA, 19 nt, Homo sapiens
ccacuugcuuccuuuccaa

SEQ ID NO: 631936 - RNA, 19 nt, Homo sapiens
guaacacagcugacagaaa

SEQ ID NO: 631937 - RNA, 19 nt, Homo sapiens
gaucaguuaccaucaagug

SEQ ID NO: 631938 - RNA, 19 nt, Homo sapiens
gaaacgccuuugcccugau

SEQ ID NO: 631939 - RNA, 19 nt, Homo sapiens
caaugccacuugcuuccuu

SEQ ID NO: 631940 - RNA, 19 nt, Homo sapiens
ggagggaaggccaaggauu

SEQ ID NO: 631941 - RNA, 19 nt, Homo sapiens
ggcuggaucuggaacaugu

SEQ ID NO: 631942 - RNA, 19 nt, Homo sapiens
caauguuccugccugacaa

SEQ ID NO: 631943 - RNA, 19 nt, Homo sapiens
caucaaggcagaauacaag

SEQ ID NO: 631944 - RNA, 19 nt, Homo sapiens
ggcaauuuaucuugaugug

SEQ ID NO: 631945 - RNA, 19 nt, Homo sapiens
gauggaccuugcacucuag

SEQ ID NO: 631946 - RNA, 19 nt, Homo sapiens
cagaguguuucuuccaugu

SEQ ID NO: 631947 - RNA, 19 nt, Homo sapiens
gcaaggucccuccaguuca

SEQ ID NO: 631948 - RNA, 19 nt, Homo sapiens
ugccaguucuuccaaauuc

SEQ ID NO: 631949 - RNA, 19 nt, Homo sapiens
cagaaagucacccugaaug

SEQ ID NO: 631950 - RNA, 19 nt, Homo sapiens
guucuaugcuaaaggcaau

SEQ ID NO: 631951 - RNA, 19 nt, Homo sapiens
gagcagccaaugccugaga

SEQ ID NO: 631952 - RNA, 19 nt, Homo sapiens
ccaaauucguaaccagagu

SEQ ID NO: 631953 - RNA, 19 nt, Homo sapiens
ggaucuggaacauguggua

SEQ ID NO: 631954 - RNA, 19 nt, Homo sapiens
gcaauuuaucuugauguga

SEQ ID NO: 631955 - RNA, 19 nt, Homo sapiens
uaucugcugauguccaaua

SEQ ID NO: 631956 - RNA, 19 nt, Homo sapiens
ggcaaggucccuccaguuc

SEQ ID NO: 631957 - RNA, 19 nt, Homo sapiens
ggagcugggcggaucaguu

SEQ ID NO: 631958 - RNA, 19 nt, Homo sapiens
ccaaacuuauuagcaagau

SEQ ID NO: 631959 - RNA, 19 nt, Homo sapiens
cuagugaacgucuacuuau

SEQ ID NO: 631960 - RNA, 19 nt, Homo sapiens
gaguguuucuuccaugucu

SEQ ID NO: 631961 - RNA, 19 nt, Homo sapiens
ccaaggagucucaucuauc

SEQ ID NO: 631962 - RNA, 19 nt, Homo sapiens
guaagcagcgugucuccau

SEQ ID NO: 631963 - RNA, 19 nt, Homo sapiens
caauggacuucuggcuuug

SEQ ID NO: 631964 - RNA, 19 nt, Homo sapiens
gggcaaggucccuccaguu

SEQ ID NO: 631965 - RNA, 19 nt, Homo sapiens
ccagaaagucacccugaau

SEQ ID NO: 631966 - RNA, 19 nt, Homo sapiens
gaaagugacagcggagucu

SEQ ID NO: 631967 - RNA, 19 nt, Homo sapiens
guugggucuuacacaaaua

SEQ ID NO: 631968 - RNA, 19 nt, Homo sapiens
caaauucguaaccagaguu

SEQ ID NO: 631969 - RNA, 19 nt, Homo sapiens
gugaauacgagccaucaug

SEQ ID NO: 631970 - RNA, 19 nt, Homo sapiens
caugugaggauauaucugu

SEQ ID NO: 631971 - RNA, 19 nt, Homo sapiens
ggcagaggcauagcuauug

SEQ ID NO: 631972 - RNA, 19 nt, Homo sapiens
gaaggguuccugaguaagc

SEQ ID NO: 631973 - RNA, 19 nt, Homo sapiens
gauggaggacagugauuca

SEQ ID NO: 631974 - RNA, 19 nt, Homo sapiens
gaauguccacagugaauac

SEQ ID NO: 631975 - RNA, 19 nt, Homo sapiens
ggagguaacacagcugaca

SEQ ID NO: 631976 - RNA, 19 nt, Homo sapiens
ggucuuacacaaauagaag

SEQ ID NO: 631977 - RNA, 19 nt, Homo sapiens
caaggucccuccaguucac

SEQ ID NO: 631978 - RNA, 19 nt, Homo sapiens
gauccucccagaaguaaag

SEQ ID NO: 631979 - RNA, 19 nt, Homo sapiens
uagugaacgucuacuuauc

SEQ ID NO: 631980 - RNA, 19 nt, Homo sapiens
ugaauguccacagugaaua

SEQ ID NO: 631981 - RNA, 19 nt, Homo sapiens
cccagaaagucacccugaa

SEQ ID NO: 631982 - RNA, 19 nt, Homo sapiens
gggaaagacccagaaaguc

SEQ ID NO: 631983 - RNA, 19 nt, Homo sapiens
ucucagagcccucaucacu

SEQ ID NO: 631984 - RNA, 19 nt, Homo sapiens
ugaagaccagcugugaaua

SEQ ID NO: 631985 - RNA, 19 nt, Homo sapiens
ggaccuugcacucuagaag

SEQ ID NO: 631986 - RNA, 19 nt, Homo sapiens
gaaggcucuugcucugagu

SEQ ID NO: 631987 - RNA, 19 nt, Homo sapiens
aagcaggggucugguauaa

SEQ ID NO: 631988 - RNA, 19 nt, Homo sapiens
ucuaucugcugauguccaa

SEQ ID NO: 631989 - RNA, 19 nt, Homo sapiens
gaaggccaaggauuucaca

SEQ ID NO: 631990 - RNA, 19 nt, Homo sapiens
gugcccacuuccugaaaug

SEQ ID NO: 631991 - RNA, 19 nt, Homo sapiens
ucccagaaguaaagguaga

SEQ ID NO: 631992 - RNA, 19 nt, Homo sapiens
agaaagucacccugaaugu

SEQ ID NO: 631993 - RNA, 19 nt, Homo sapiens
acgcaagaaucuguuccua

SEQ ID NO: 631994 - RNA, 19 nt, Homo sapiens
gaacaagcauguggaguuu

SEQ ID NO: 631995 - RNA, 19 nt, Homo sapiens
caaaguggcucauaucaug

SEQ ID NO: 631996 - RNA, 19 nt, Homo sapiens
ccaagaaccuacauuaaga

SEQ ID NO: 631997 - RNA, 19 nt, Homo sapiens
ggaaauagaagugaaauug

SEQ ID NO: 631998 - RNA, 19 nt, Homo sapiens
ggaacaaaguggcucauau

SEQ ID NO: 631999 - RNA, 19 nt, Homo sapiens
ggaaggaggucaagcaucu

SEQ ID NO: 632000 - RNA, 19 nt, Homo sapiens
cgaagaacuuucauaauuc

SEQ ID NO: 632001 - RNA, 19 nt, Homo sapiens
gggcagggcuuuaggaugu

SEQ ID NO: 632002 - RNA, 19 nt, Homo sapiens
gcaaaccgaugaucuaaac

SEQ ID NO: 632003 - RNA, 19 nt, Homo sapiens
aaacauuacucugggauuu

SEQ ID NO: 632004 - RNA, 19 nt, Homo sapiens
gaaccuacauuaagaaacg

SEQ ID NO: 632005 - RNA, 19 nt, Homo sapiens
gaacaaaguggcucauauc

SEQ ID NO: 632006 - RNA, 19 nt, Homo sapiens
uguaugggcucuaugagua

SEQ ID NO: 632007 - RNA, 19 nt, Homo sapiens
cgaaagcugcauuuaauaa

SEQ ID NO: 632008 - RNA, 19 nt, Homo sapiens
ccucugcacuuccaccuua

SEQ ID NO: 632009 - RNA, 19 nt, Homo sapiens
gaucuaaaccaaccacuug

SEQ ID NO: 632010 - RNA, 19 nt, Homo sapiens
guuaucaucuuacugcaaa

SEQ ID NO: 632011 - RNA, 19 nt, Homo sapiens
gagcucaagucugaaguuu

SEQ ID NO: 632012 - RNA, 19 nt, Homo sapiens
caucuucggccgauauuua

SEQ ID NO: 632013 - RNA, 19 nt, Homo sapiens
caucagcacucccuacaug

SEQ ID NO: 632014 - RNA, 19 nt, Homo sapiens
ccaagaagcuccgggugaa

SEQ ID NO: 632015 - RNA, 19 nt, Homo sapiens
ggucaaauccguccuguuc

SEQ ID NO: 632016 - RNA, 19 nt, Homo sapiens
gauuagggauugccacuuc

SEQ ID NO: 632017 - RNA, 19 nt, Homo sapiens
ccaagaagcccaccacuag

SEQ ID NO: 632018 - RNA, 19 nt, Homo sapiens
gauaagcugcggaagauga

SEQ ID NO: 632019 - RNA, 19 nt, Homo sapiens
ucucaggccuuucgaagaa

SEQ ID NO: 632020 - RNA, 19 nt, Homo sapiens
ugacacggauaucaccuuu

SEQ ID NO: 632021 - RNA, 19 nt, Homo sapiens
gcgaaagcugcauuuaaua

SEQ ID NO: 632022 - RNA, 19 nt, Homo sapiens
ggaaagcccgugucucugu

SEQ ID NO: 632023 - RNA, 19 nt, Homo sapiens
gagaaacggcgcugggauu

SEQ ID NO: 632024 - RNA, 19 nt, Homo sapiens
caacagcuagcaccaagaa

SEQ ID NO: 632025 - RNA, 19 nt, Homo sapiens
gcucugaggugcuuaugag

SEQ ID NO: 632026 - RNA, 19 nt, Homo sapiens
ugaccuuccuggaguauga

SEQ ID NO: 632027 - RNA, 19 nt, Homo sapiens
uaaaggucauucacuggaa

SEQ ID NO: 632028 - RNA, 19 nt, Homo sapiens
caaccucagucucccuuug

SEQ ID NO: 632029 - RNA, 19 nt, Homo sapiens
caugaaagcccaguucuga

SEQ ID NO: 632030 - RNA, 19 nt, Homo sapiens
ucaaugccgucaucaaaca

SEQ ID NO: 632031 - RNA, 19 nt, Homo sapiens
caugcucucuacauccuua

SEQ ID NO: 632032 - RNA, 19 nt, Homo sapiens
ggaaugugcagcugucaga

SEQ ID NO: 632033 - RNA, 19 nt, Homo sapiens
gcgcugggauuagggauug

SEQ ID NO: 632034 - RNA, 19 nt, Homo sapiens
gaugagaacaagaguuaau

SEQ ID NO: 632035 - RNA, 19 nt, Homo sapiens
guaaaaggguuaucaucuu

SEQ ID NO: 632036 - RNA, 19 nt, Homo sapiens
gaacaacagcuagcaccaa

SEQ ID NO: 632037 - RNA, 19 nt, Homo sapiens
guucaaaggucagcaaguc

SEQ ID NO: 632038 - RNA, 19 nt, Homo sapiens
ggccaagaaccuacauuaa

SEQ ID NO: 632039 - RNA, 19 nt, Homo sapiens
gauggggacugcggaauua

SEQ ID NO: 632040 - RNA, 19 nt, Homo sapiens
uagaaaaucugauccuuug

SEQ ID NO: 632041 - RNA, 19 nt, Homo sapiens
cuacagagaccuuggacaa

SEQ ID NO: 632042 - RNA, 19 nt, Homo sapiens
cggcuuugcugcccugaaa

SEQ ID NO: 632043 - RNA, 19 nt, Homo sapiens
ugucugcgcuggauacaau

SEQ ID NO: 632044 - RNA, 19 nt, Homo sapiens
agcgaaagcugcauuuaau

SEQ ID NO: 632045 - RNA, 19 nt, Homo sapiens
cugcugggcuguuuguauu

SEQ ID NO: 632046 - RNA, 19 nt, Homo sapiens
guugauggguuuccuuauc

SEQ ID NO: 632047 - RNA, 19 nt, Homo sapiens
caaguuccguuccaacaag

SEQ ID NO: 632048 - RNA, 19 nt, Homo sapiens
gcucaagucugaaguuucc

SEQ ID NO: 632049 - RNA, 19 nt, Homo sapiens
gccaagaaccuacauuaag

SEQ ID NO: 632050 - RNA, 19 nt, Homo sapiens
gggcaaaccgaugaucuaa

SEQ ID NO: 632051 - RNA, 19 nt, Homo sapiens
gcagagcugugggcugugu

SEQ ID NO: 632052 - RNA, 19 nt, Homo sapiens
uugaugagaacaagaguua

SEQ ID NO: 632053 - RNA, 19 nt, Homo sapiens
gcuucgacauuaccaaguu

SEQ ID NO: 632054 - RNA, 19 nt, Homo sapiens
guacaaggagggccaguuc

SEQ ID NO: 632055 - RNA, 19 nt, Homo sapiens
uaagaaacgcauucagaug

SEQ ID NO: 632056 - RNA, 19 nt, Homo sapiens
ucaccuggauuuaccuguu

SEQ ID NO: 632057 - RNA, 19 nt, Homo sapiens
gaaagcccaguucugaaga

SEQ ID NO: 632058 - RNA, 19 nt, Homo sapiens
cggccaagaaccuacauua

SEQ ID NO: 632059 - RNA, 19 nt, Homo sapiens
gcuaccacaucguguacaa

SEQ ID NO: 632060 - RNA, 19 nt, Homo sapiens
aggcugaugucaacaguga

SEQ ID NO: 632061 - RNA, 19 nt, Homo sapiens
caagaaccuacauuaagaa

SEQ ID NO: 632062 - RNA, 19 nt, Homo sapiens
uggauaagcugcggaagau

SEQ ID NO: 632063 - RNA, 19 nt, Homo sapiens
caccuggauuuaccuguuu

SEQ ID NO: 632064 - RNA, 19 nt, Homo sapiens
aagcugcccucacuacaga

SEQ ID NO: 632065 - RNA, 19 nt, Homo sapiens
ucagaugcaucagccguuu

SEQ ID NO: 632066 - RNA, 19 nt, Homo sapiens
ucaaaacccucaaggaaga

SEQ ID NO: 632067 - RNA, 19 nt, Homo sapiens
ggagagagucaucguccuu

SEQ ID NO: 632068 - RNA, 19 nt, Homo sapiens
ggauuuauggucugaugaa

SEQ ID NO: 632069 - RNA, 19 nt, Homo sapiens
gacaauccacguugcuauu

SEQ ID NO: 632070 - RNA, 19 nt, Homo sapiens
cggccgauauuuaaacaug

SEQ ID NO: 632071 - RNA, 19 nt, Homo sapiens
caucauaacuggggagaaa

SEQ ID NO: 632072 - RNA, 19 nt, Homo sapiens
agaaacggcgcugggauua

SEQ ID NO: 632073 - RNA, 19 nt, Homo sapiens
cguguggacuucuacaaug

SEQ ID NO: 632074 - RNA, 19 nt, Homo sapiens
ggagaaaugcgagacaauc

SEQ ID NO: 632075 - RNA, 19 nt, Homo sapiens
gagccagagaguauuauga

SEQ ID NO: 632076 - RNA, 19 nt, Homo sapiens
ggaguacgaccggagguuu

SEQ ID NO: 632077 - RNA, 19 nt, Homo sapiens
caaaaccccuuccuugugu

SEQ ID NO: 632078 - RNA, 19 nt, Homo sapiens
gcuuugcugcccugaaaua

SEQ ID NO: 632079 - RNA, 19 nt, Homo sapiens
gcccaacgccuacaugauc

SEQ ID NO: 632080 - RNA, 19 nt, Homo sapiens
gggacccucuucacauuca

SEQ ID NO: 632081 - RNA, 19 nt, Homo sapiens
aagcggaguugcugucaau

SEQ ID NO: 632082 - RNA, 19 nt, Homo sapiens
ucgcucagcuguccaugga

SEQ ID NO: 632083 - RNA, 19 nt, Homo sapiens
ccuuauugcugacuccauu

SEQ ID NO: 632084 - RNA, 19 nt, Homo sapiens
gcugggcuguuuguauuga

SEQ ID NO: 632085 - RNA, 19 nt, Homo sapiens
uaauuaugcuucccaucau

SEQ ID NO: 632086 - RNA, 19 nt, Homo sapiens
cuagaugagucucuucaag

SEQ ID NO: 632087 - RNA, 19 nt, Homo sapiens
agaacaagcauguggaguu

SEQ ID NO: 632088 - RNA, 19 nt, Homo sapiens
cuacuucagugcacacaca

SEQ ID NO: 632089 - RNA, 19 nt, Homo sapiens
gcuuuaggauguucuggau

SEQ ID NO: 632090 - RNA, 19 nt, Homo sapiens
gaucagggcagggcuuuag

SEQ ID NO: 632091 - RNA, 19 nt, Homo sapiens
ccaccuagaugagucucuu

SEQ ID NO: 632092 - RNA, 19 nt, Homo sapiens
gcuauugucugcgcuggau

SEQ ID NO: 632093 - RNA, 19 nt, Homo sapiens
cuggagaccuacaggaaga

SEQ ID NO: 632094 - RNA, 19 nt, Homo sapiens
gaacaagcauguggaguuu

SEQ ID NO: 632095 - RNA, 19 nt, Homo sapiens
caaaguggcucauaucaug

SEQ ID NO: 632096 - RNA, 19 nt, Homo sapiens
ggaaauagaagugaaauug

SEQ ID NO: 632097 - RNA, 19 nt, Homo sapiens
ggaacaaaguggcucauau

SEQ ID NO: 632098 - RNA, 19 nt, Homo sapiens
ggaaggaggucaagcaucu

SEQ ID NO: 632099 - RNA, 19 nt, Homo sapiens
cgaagaacuuucauaauuc

SEQ ID NO: 632100 - RNA, 19 nt, Homo sapiens
gggcagggcuuuaggaugu

SEQ ID NO: 632101 - RNA, 19 nt, Homo sapiens
gcaaaccgaugaucuaaac

SEQ ID NO: 632102 - RNA, 19 nt, Homo sapiens
aaacauuacucugggauuu

SEQ ID NO: 632103 - RNA, 19 nt, Homo sapiens
gaacaaaguggcucauauc

SEQ ID NO: 632104 - RNA, 19 nt, Homo sapiens
uguaugggcucuaugagua

SEQ ID NO: 632105 - RNA, 19 nt, Homo sapiens
cgaaagcugcauuuaauaa

SEQ ID NO: 632106 - RNA, 19 nt, Homo sapiens
ccucugcacuuccaccuua

SEQ ID NO: 632107 - RNA, 19 nt, Homo sapiens
gaucuaaaccaaccacuug

SEQ ID NO: 632108 - RNA, 19 nt, Homo sapiens
guuaucaucuuacugcaaa

SEQ ID NO: 632109 - RNA, 19 nt, Homo sapiens
gagcucaagucugaaguuu

SEQ ID NO: 632110 - RNA, 19 nt, Homo sapiens
caucuucggccgauauuua

SEQ ID NO: 632111 - RNA, 19 nt, Homo sapiens
caucagcacucccuacaug

SEQ ID NO: 632112 - RNA, 19 nt, Homo sapiens
ccaagaagcuccgggugaa

SEQ ID NO: 632113 - RNA, 19 nt, Homo sapiens
ggucaaauccguccuguuc

SEQ ID NO: 632114 - RNA, 19 nt, Homo sapiens
gauuagggauugccacuuc

SEQ ID NO: 632115 - RNA, 19 nt, Homo sapiens
ccaagaagcccaccacuag

SEQ ID NO: 632116 - RNA, 19 nt, Homo sapiens
gauaagcugcggaagauga

SEQ ID NO: 632117 - RNA, 19 nt, Homo sapiens
ucucaggccuuucgaagaa

SEQ ID NO: 632118 - RNA, 19 nt, Homo sapiens
ugacacggauaucaccuuu

SEQ ID NO: 632119 - RNA, 19 nt, Homo sapiens
gcgaaagcugcauuuaaua

SEQ ID NO: 632120 - RNA, 19 nt, Homo sapiens
ggaaagcccgugucucugu

SEQ ID NO: 632121 - RNA, 19 nt, Homo sapiens
gagaaacggcgcugggauu

SEQ ID NO: 632122 - RNA, 19 nt, Homo sapiens
caacagcuagcaccaagaa

SEQ ID NO: 632123 - RNA, 19 nt, Homo sapiens
gcucugaggugcuuaugag

SEQ ID NO: 632124 - RNA, 19 nt, Homo sapiens
ugaccuuccuggaguauga

SEQ ID NO: 632125 - RNA, 19 nt, Homo sapiens
uaaaggucauucacuggaa

SEQ ID NO: 632126 - RNA, 19 nt, Homo sapiens
caaccucagucucccuuug

SEQ ID NO: 632127 - RNA, 19 nt, Homo sapiens
caugaaagcccaguucuga

SEQ ID NO: 632128 - RNA, 19 nt, Homo sapiens
ucaaugccgucaucaaaca

SEQ ID NO: 632129 - RNA, 19 nt, Homo sapiens
caugcucucuacauccuua

SEQ ID NO: 632130 - RNA, 19 nt, Homo sapiens
ggaaugugcagcugucaga

SEQ ID NO: 632131 - RNA, 19 nt, Homo sapiens
gcgcugggauuagggauug

SEQ ID NO: 632132 - RNA, 19 nt, Homo sapiens
gaugagaacaagaguuaau

SEQ ID NO: 632133 - RNA, 19 nt, Homo sapiens
guaaaaggguuaucaucuu

SEQ ID NO: 632134 - RNA, 19 nt, Homo sapiens
gaacaacagcuagcaccaa

SEQ ID NO: 632135 - RNA, 19 nt, Homo sapiens
guucaaaggucagcaaguc

SEQ ID NO: 632136 - RNA, 19 nt, Homo sapiens
gauggggacugcggaauua

SEQ ID NO: 632137 - RNA, 19 nt, Homo sapiens
uagaaaaucugauccuuug

SEQ ID NO: 632138 - RNA, 19 nt, Homo sapiens
cuacagagaccuuggacaa

SEQ ID NO: 632139 - RNA, 19 nt, Homo sapiens
cggcuuugcugcccugaaa

SEQ ID NO: 632140 - RNA, 19 nt, Homo sapiens
ugucugcgcuggauacaau

SEQ ID NO: 632141 - RNA, 19 nt, Homo sapiens
agcgaaagcugcauuuaau

SEQ ID NO: 632142 - RNA, 19 nt, Homo sapiens
cugcugggcuguuuguauu

SEQ ID NO: 632143 - RNA, 19 nt, Homo sapiens
guugauggguuuccuuauc

SEQ ID NO: 632144 - RNA, 19 nt, Homo sapiens
caaguuccguuccaacaag

SEQ ID NO: 632145 - RNA, 19 nt, Homo sapiens
gcucaagucugaaguuucc

SEQ ID NO: 632146 - RNA, 19 nt, Homo sapiens
gggcaaaccgaugaucuaa

SEQ ID NO: 632147 - RNA, 19 nt, Homo sapiens
gcagagcugugggcugugu

SEQ ID NO: 632148 - RNA, 19 nt, Homo sapiens
uugaugagaacaagaguua

SEQ ID NO: 632149 - RNA, 19 nt, Homo sapiens
gcuucgacauuaccaaguu

SEQ ID NO: 632150 - RNA, 19 nt, Homo sapiens
guacaaggagggccaguuc

SEQ ID NO: 632151 - RNA, 19 nt, Homo sapiens
ucaccuggauuuaccuguu

SEQ ID NO: 632152 - RNA, 19 nt, Homo sapiens
gaaagcccaguucugaaga

SEQ ID NO: 632153 - RNA, 19 nt, Homo sapiens
gcuaccacaucguguacaa

SEQ ID NO: 632154 - RNA, 19 nt, Homo sapiens
aggcugaugucaacaguga

SEQ ID NO: 632155 - RNA, 19 nt, Homo sapiens
uggauaagcugcggaagau

SEQ ID NO: 632156 - RNA, 19 nt, Homo sapiens
caccuggauuuaccuguuu

SEQ ID NO: 632157 - RNA, 19 nt, Homo sapiens
aagcugcccucacuacaga

SEQ ID NO: 632158 - RNA, 19 nt, Homo sapiens
ucaaaacccucaaggaaga

SEQ ID NO: 632159 - RNA, 19 nt, Homo sapiens
ggagagagucaucguccuu

SEQ ID NO: 632160 - RNA, 19 nt, Homo sapiens
ggauuuauggucugaugaa

SEQ ID NO: 632161 - RNA, 19 nt, Homo sapiens
gacaauccacguugcuauu

SEQ ID NO: 632162 - RNA, 19 nt, Homo sapiens
cggccgauauuuaaacaug

SEQ ID NO: 632163 - RNA, 19 nt, Homo sapiens
caucauaacuggggagaaa

SEQ ID NO: 632164 - RNA, 19 nt, Homo sapiens
agaaacggcgcugggauua

SEQ ID NO: 632165 - RNA, 19 nt, Homo sapiens
cguguggacuucuacaaug

SEQ ID NO: 632166 - RNA, 19 nt, Homo sapiens
ggagaaaugcgagacaauc

SEQ ID NO: 632167 - RNA, 19 nt, Homo sapiens
ggaguacgaccggagguuu

SEQ ID NO: 632168 - RNA, 19 nt, Homo sapiens
ggccaagagaguauuauga

SEQ ID NO: 632169 - RNA, 19 nt, Homo sapiens
caaaaccccuuccuugugu

SEQ ID NO: 632170 - RNA, 19 nt, Homo sapiens
gcuuugcugcccugaaaua

SEQ ID NO: 632171 - RNA, 19 nt, Homo sapiens
gcccaacgccuacaugauc

SEQ ID NO: 632172 - RNA, 19 nt, Homo sapiens
gggacccucuucacauuca

SEQ ID NO: 632173 - RNA, 19 nt, Homo sapiens
aagcggaguugcugucaau

SEQ ID NO: 632174 - RNA, 19 nt, Homo sapiens
ucgcucagcuguccaugga

SEQ ID NO: 632175 - RNA, 19 nt, Homo sapiens
ccuuauugcugacuccauu

SEQ ID NO: 632176 - RNA, 19 nt, Homo sapiens
gcugggcuguuuguauuga

SEQ ID NO: 632177 - RNA, 19 nt, Homo sapiens
uaauuaugcuucccaucau

SEQ ID NO: 632178 - RNA, 19 nt, Homo sapiens
cuagaugagucucuucaag

SEQ ID NO: 632179 - RNA, 19 nt, Homo sapiens
agaacaagcauguggaguu

SEQ ID NO: 632180 - RNA, 19 nt, Homo sapiens
cuacuucagugcacacaca

SEQ ID NO: 632181 - RNA, 19 nt, Homo sapiens
gcuuuaggauguucuggau

SEQ ID NO: 632182 - RNA, 19 nt, Homo sapiens
gaucagggcagggcuuuag

SEQ ID NO: 632183 - RNA, 19 nt, Homo sapiens
ccaccuagaugagucucuu

SEQ ID NO: 632184 - RNA, 19 nt, Homo sapiens
gcuauugucugcgcuggau

SEQ ID NO: 632185 - RNA, 19 nt, Homo sapiens
cuggagaccuacaggaaga

SEQ ID NO: 632186 - RNA, 19 nt, Homo sapiens
ggguugauggguuuccuua

SEQ ID NO: 632187 - RNA, 19 nt, Homo sapiens
ucugggagcuucgaagaug

SEQ ID NO: 632188 - RNA, 19 nt, Homo sapiens
gcugaugucaacagugaaa

SEQ ID NO: 632189 - RNA, 19 nt, Homo sapiens
acacggauaucaccuuugc

SEQ ID NO: 632190 - RNA, 19 nt, Homo sapiens
ucagugcacacacaaggua

SEQ ID NO: 632191 - RNA, 19 nt, Homo sapiens
cugcaaagccacaagauca

SEQ ID NO: 632192 - RNA, 19 nt, Homo sapiens
caauaccgcaucugucuca

SEQ ID NO: 632193 - RNA, 19 nt, Homo sapiens
acaaggagggccaguucua

SEQ ID NO: 632194 - RNA, 19 nt, Homo sapiens
ggaccaagcuaaauuugua

SEQ ID NO: 632195 - RNA, 19 nt, Homo sapiens
gcacacacauacacagaua

SEQ ID NO: 632196 - RNA, 19 nt, Homo sapiens
ucacaggucuugccuuuaa

SEQ ID NO: 632197 - RNA, 19 nt, Homo sapiens
gaagauggacugcggauga

SEQ ID NO: 632198 - RNA, 19 nt, Homo sapiens
gagaaacucuucagcgaau

SEQ ID NO: 632199 - RNA, 19 nt, Homo sapiens
ccacguagguacuguguga

SEQ ID NO: 632200 - RNA, 19 nt, Homo sapiens
gguacaugaugcuggauua

SEQ ID NO: 632201 - RNA, 19 nt, Homo sapiens
uuaagaagguuauggaaga

SEQ ID NO: 632202 - RNA, 19 nt, Homo sapiens
cggaagaccuuauggauuc

SEQ ID NO: 632203 - RNA, 19 nt, Homo sapiens
gcgaauccuucuaguacua

SEQ ID NO: 632204 - RNA, 19 nt, Homo sapiens
uaccaccucucaaccauua

SEQ ID NO: 632205 - RNA, 19 nt, Homo sapiens
caagggaaaccaugaguaa

SEQ ID NO: 632206 - RNA, 19 nt, Homo sapiens
ggaagacagugcagagcaa

SEQ ID NO: 632207 - RNA, 19 nt, Homo sapiens
guagugaagucaaacuguu

SEQ ID NO: 632208 - RNA, 19 nt, Homo sapiens
gaaauucucaguagugaca

SEQ ID NO: 632209 - RNA, 19 nt, Homo sapiens
gaagucaaacuguuauuca

SEQ ID NO: 632210 - RNA, 19 nt, Homo sapiens
ggucuugccuuuaaauuac

SEQ ID NO: 632211 - RNA, 19 nt, Homo sapiens
gggaaauucucaguaguga

SEQ ID NO: 632212 - RNA, 19 nt, Homo sapiens
gaccaacccaguucuguuu

SEQ ID NO: 632213 - RNA, 19 nt, Homo sapiens
ucucacaggucuugccuuu

SEQ ID NO: 632214 - RNA, 19 nt, Homo sapiens
cagagauguuuaaugcaua

SEQ ID NO: 632215 - RNA, 19 nt, Homo sapiens
gacagucaacucuagguua

SEQ ID NO: 632216 - RNA, 19 nt, Homo sapiens
gcucuuggcucuggugguu

SEQ ID NO: 632217 - RNA, 19 nt, Homo sapiens
gaaauaaauggcagugcuu

SEQ ID NO: 632218 - RNA, 19 nt, Homo sapiens
acccagcgcuuuggaaaua

SEQ ID NO: 632219 - RNA, 19 nt, Homo sapiens
gauacacacacacaaauau

SEQ ID NO: 632220 - RNA, 19 nt, Homo sapiens
uguuacagccuuucgauua

SEQ ID NO: 632221 - RNA, 19 nt, Homo sapiens
ucagagauguuuaaugcau

SEQ ID NO: 632222 - RNA, 19 nt, Homo sapiens
guuacagccuuucgauuau

SEQ ID NO: 632223 - RNA, 19 nt, Homo sapiens
guaauuauugggaagauug

SEQ ID NO: 632224 - RNA, 19 nt, Homo sapiens
uaaggaacauggcgaaggu

SEQ ID NO: 632225 - RNA, 19 nt, Homo sapiens
gguaggccuugguacauga

SEQ ID NO: 632226 - RNA, 19 nt, Homo sapiens
uaagaagguuauggaagaa

SEQ ID NO: 632227 - RNA, 19 nt, Homo sapiens
aaacuguuauucagagaug

SEQ ID NO: 632228 - RNA, 19 nt, Homo sapiens
aaagacagaaacaccaaua

SEQ ID NO: 632229 - RNA, 19 nt, Homo sapiens
gagcaagggaagagagaaa

SEQ ID NO: 632230 - RNA, 19 nt, Homo sapiens
ggagaagagcugccaggaa

SEQ ID NO: 632231 - RNA, 19 nt, Homo sapiens
ggacugcggaugaggaaga

SEQ ID NO: 632232 - RNA, 19 nt, Homo sapiens
acaagcaguucaaggaaga

SEQ ID NO: 632233 - RNA, 19 nt, Homo sapiens
gacagaaacaccaauagug

SEQ ID NO: 632234 - RNA, 19 nt, Homo sapiens
gcaggggccucaauuaaug

SEQ ID NO: 632235 - RNA, 19 nt, Homo sapiens
gcggucagcuccacacagu

SEQ ID NO: 632236 - RNA, 19 nt, Homo sapiens
guagucagucuucuagauu

SEQ ID NO: 632237 - RNA, 19 nt, Homo sapiens
cuaagucucugaguucuuc

SEQ ID NO: 632238 - RNA, 19 nt, Homo sapiens
gagcugccaggaaguguuu

SEQ ID NO: 632239 - RNA, 19 nt, Homo sapiens
gcugugggcuccucugucu

SEQ ID NO: 632240 - RNA, 19 nt, Homo sapiens
aaagggaccaagcuaaauu

SEQ ID NO: 632241 - RNA, 19 nt, Homo sapiens
uggauuaccucucuuaaaa

SEQ ID NO: 632242 - RNA, 19 nt, Homo sapiens
uugggaagauugccuugua

SEQ ID NO: 632243 - RNA, 19 nt, Homo sapiens
ucuguugggugaacuggua

SEQ ID NO: 632244 - RNA, 19 nt, Homo sapiens
uuaaagggaccaagcuaaa

SEQ ID NO: 632245 - RNA, 19 nt, Homo sapiens
caagcuaaauuuguauugg

SEQ ID NO: 632246 - RNA, 19 nt, Homo sapiens
gggaggagaacaagcaguu

SEQ ID NO: 632247 - RNA, 19 nt, Homo sapiens
gaagagcugccaggaagug

SEQ ID NO: 632248 - RNA, 19 nt, Homo sapiens
auucagagauguuuaaugc

SEQ ID NO: 632249 - RNA, 19 nt, Homo sapiens
ucagaagcccaaaggaauu

SEQ ID NO: 632250 - RNA, 19 nt, Homo sapiens
gaugcuggauuaccucucu

SEQ ID NO: 632251 - RNA, 19 nt, Homo sapiens
gagguagcaugcacaggau

SEQ ID NO: 632252 - RNA, 19 nt, Homo sapiens
ggaagaccuuauggauuca

SEQ ID NO: 632253 - RNA, 19 nt, Homo sapiens
cagcgaauccuucuaguac

SEQ ID NO: 632254 - RNA, 19 nt, Homo sapiens
gcagcacgagcucaaauuc

SEQ ID NO: 632255 - RNA, 19 nt, Homo sapiens
ccagcgcuuuggaaauaaa

SEQ ID NO: 632256 - RNA, 19 nt, Homo sapiens
gaugguaaauuggauuggu

SEQ ID NO: 632257 - RNA, 19 nt, Homo sapiens
cuuuaucguugguguaauu

SEQ ID NO: 632258 - RNA, 19 nt, Homo sapiens
uguauugguucauguagug

SEQ ID NO: 632259 - RNA, 19 nt, Homo sapiens
guacucgucauaagugaga

SEQ ID NO: 632260 - RNA, 19 nt, Homo sapiens
gauuaccucucuuaaaaug

SEQ ID NO: 632261 - RNA, 19 nt, Homo sapiens
caugaguaaugccacaaug

SEQ ID NO: 632262 - RNA, 19 nt, Homo sapiens
gggaaaccaugaguaaugc

SEQ ID NO: 632263 - RNA, 19 nt, Homo sapiens
acagauacacacacacaaa

SEQ ID NO: 632264 - RNA, 19 nt, Homo sapiens
auacacagauacacacaca

SEQ ID NO: 632265 - RNA, 19 nt, Homo sapiens
agaagguuauggaagaaug

SEQ ID NO: 632266 - RNA, 19 nt, Homo sapiens
aaauggcagugcuuuguuc

SEQ ID NO: 632267 - RNA, 19 nt, Homo sapiens
agauacacacacacaaaua

SEQ ID NO: 632268 - RNA, 19 nt, Homo sapiens
ugcacaggaugguaaauug

SEQ ID NO: 632269 - RNA, 19 nt, Homo sapiens
acaccgaaguuaagaaggu

SEQ ID NO: 632270 - RNA, 19 nt, Homo sapiens
guucuuauaccaccucuca

SEQ ID NO: 632271 - RNA, 19 nt, Homo sapiens
uagucagucuucuagauug

SEQ ID NO: 632272 - RNA, 19 nt, Homo sapiens
ucaaacuguuauucagaga

SEQ ID NO: 632273 - RNA, 19 nt, Homo sapiens
uagugaagucaaacuguua

SEQ ID NO: 632274 - RNA, 19 nt, Homo sapiens
uaaauggcagugcuuuguu

SEQ ID NO: 632275 - RNA, 19 nt, Homo sapiens
gcaguucaaggaagaagau

SEQ ID NO: 632276 - RNA, 19 nt, Homo sapiens
ggagucaggacaaauggau

SEQ ID NO: 632277 - RNA, 19 nt, Homo sapiens
gcacuguggcagcaucaga

SEQ ID NO: 632278 - RNA, 19 nt, Homo sapiens
ggucagcuccacacaguag

SEQ ID NO: 632279 - RNA, 19 nt, Homo sapiens
ggaugacaccgaaguuaag

SEQ ID NO: 632280 - RNA, 19 nt, Homo sapiens
ucucugaguucuucuuugg

SEQ ID NO: 632281 - RNA, 19 nt, Homo sapiens
caacagcggaaucaucgau

SEQ ID NO: 632282 - RNA, 19 nt, Homo sapiens
ucagcgaauccuucuagua

SEQ ID NO: 632283 - RNA, 19 nt, Homo sapiens
uuauugggaugcuggagaa

SEQ ID NO: 632284 - RNA, 19 nt, Homo sapiens
ucgauuaugaucccaauga

SEQ ID NO: 632285 - RNA, 19 nt, Homo sapiens
uaaagggaccaagcuaaau

SEQ ID NO: 632286 - RNA, 19 nt, Homo sapiens
gucagaagcccaaaggaau

SEQ ID NO: 632287 - RNA, 19 nt, Homo sapiens
ugacaucucacaggucuug

SEQ ID NO: 632288 - RNA, 19 nt, Homo sapiens
gcacaggaugguaaauugg

SEQ ID NO: 632289 - RNA, 19 nt, Homo sapiens
aaugauaaaccacaugaug

SEQ ID NO: 632290 - RNA, 19 nt, Homo sapiens
acagucaacucuagguuac

SEQ ID NO: 632291 - RNA, 19 nt, Homo sapiens
uggagagucuggucaugug

SEQ ID NO: 632292 - RNA, 19 nt, Homo sapiens
gaagguuauggaagaaugu

SEQ ID NO: 632293 - RNA, 19 nt, Homo sapiens
gggccucaauuaauguauc

SEQ ID NO: 632294 - RNA, 19 nt, Homo sapiens
gcuguuaccucuugaaaua

SEQ ID NO: 632295 - RNA, 19 nt, Homo sapiens
ccugagagaugaaggcuua

SEQ ID NO: 632296 - RNA, 19 nt, Homo sapiens
caaggaaacuaauggaaga

SEQ ID NO: 632297 - RNA, 19 nt, Homo sapiens
cuggacagguuguauauua

SEQ ID NO: 632298 - RNA, 19 nt, Homo sapiens
guaauaucauggcagaauu

SEQ ID NO: 632299 - RNA, 19 nt, Homo sapiens
ggaaauucaucuuguagag

SEQ ID NO: 632300 - RNA, 19 nt, Homo sapiens
ucagaaagguagcacauuc

SEQ ID NO: 632301 - RNA, 19 nt, Homo sapiens
gcccaacaguggaauuauu

SEQ ID NO: 632302 - RNA, 19 nt, Homo sapiens
ugaggcaguuguugaauga

SEQ ID NO: 632303 - RNA, 19 nt, Homo sapiens
gcagagugcuguuucuuuu

SEQ ID NO: 632304 - RNA, 19 nt, Homo sapiens
gagaaaugaugaagcuauc

SEQ ID NO: 632305 - RNA, 19 nt, Homo sapiens
cacauugaguccuuuauga

SEQ ID NO: 632306 - RNA, 19 nt, Homo sapiens
ggagaaaugaugaagcuau

SEQ ID NO: 632307 - RNA, 19 nt, Homo sapiens
ggaaaugccaagagguauu

SEQ ID NO: 632308 - RNA, 19 nt, Homo sapiens
gaaacaaggaaacuaaugg

SEQ ID NO: 632309 - RNA, 19 nt, Homo sapiens
cccaugguauuuaacauaa

SEQ ID NO: 632310 - RNA, 19 nt, Homo sapiens
gcacauugaguccuuuaug

SEQ ID NO: 632311 - RNA, 19 nt, Homo sapiens
uagggaaauucaucuugua

SEQ ID NO: 632312 - RNA, 19 nt, Homo sapiens
caggaaaugccaagaggua

SEQ ID NO: 632313 - RNA, 19 nt, Homo sapiens
gaauuguucuuuguuugug

SEQ ID NO: 632314 - RNA, 19 nt, Homo sapiens
aaaguguguuucaaaguga

SEQ ID NO: 632315 - RNA, 19 nt, Homo sapiens
gguagcacauucggauaaa

SEQ ID NO: 632316 - RNA, 19 nt, Homo sapiens
ggaucaaccucaacugcau

SEQ ID NO: 632317 - RNA, 19 nt, Homo sapiens
gaaaugccaagagguauuc

SEQ ID NO: 632318 - RNA, 19 nt, Homo sapiens
caagaauuguucagagucu

SEQ ID NO: 632319 - RNA, 19 nt, Homo sapiens
gaaacuaauggaagagugu

SEQ ID NO: 632320 - RNA, 19 nt, Homo sapiens
acaauccugucccauggua

SEQ ID NO: 632321 - RNA, 19 nt, Homo sapiens
gguuguauauuaccagauc

SEQ ID NO: 632322 - RNA, 19 nt, Homo sapiens
gaaauggugccucuuacag

SEQ ID NO: 632323 - RNA, 19 nt, Homo sapiens
ggaaauggugccucuuaca

SEQ ID NO: 632324 - RNA, 19 nt, Homo sapiens
cagagucuuguaaauguua

SEQ ID NO: 632325 - RNA, 19 nt, Homo sapiens
cuagggaaauucaucuugu

SEQ ID NO: 632326 - RNA, 19 nt, Homo sapiens
cuacagcccuuugacuaug

SEQ ID NO: 632327 - RNA, 19 nt, Homo sapiens
acagauucuugcucgauaa

SEQ ID NO: 632328 - RNA, 19 nt, Homo sapiens
gugaggcaguuguugaaug

SEQ ID NO: 632329 - RNA, 19 nt, Homo sapiens
ugccuuuaaugaucucuua

SEQ ID NO: 632330 - RNA, 19 nt, Homo sapiens
cuacuggacagguuguaua

SEQ ID NO: 632331 - RNA, 19 nt, Homo sapiens
aaugaucucuuacgguuag

SEQ ID NO: 632332 - RNA, 19 nt, Homo sapiens
aaaccuggaucaaccucaa

SEQ ID NO: 632333 - RNA, 19 nt, Homo sapiens
aacagauucuugcucgaua

SEQ ID NO: 632334 - RNA, 19 nt, Homo sapiens
guucagagucuuguaaaug

SEQ ID NO: 632335 - RNA, 19 nt, Homo sapiens
gcuuaaggcucagaaaggu

SEQ ID NO: 632336 - RNA, 19 nt, Homo sapiens
cgaaacaaggaaacuaaug

SEQ ID NO: 632337 - RNA, 19 nt, Homo sapiens
gggaaauggugccucuuac

SEQ ID NO: 632338 - RNA, 19 nt, Homo sapiens
gcuacagcccuuugacuau

SEQ ID NO: 632339 - RNA, 19 nt, Homo sapiens
ugacuaugauccgaaugaa

SEQ ID NO: 632340 - RNA, 19 nt, Homo sapiens
caacugcauccuucagaga

SEQ ID NO: 632341 - RNA, 19 nt, Homo sapiens
gaugaagcuaucagaagaa

SEQ ID NO: 632342 - RNA, 19 nt, Homo sapiens
ccugucccaugguauuuaa

SEQ ID NO: 632343 - RNA, 19 nt, Homo sapiens
gcaguuguugaaugaguuu

SEQ ID NO: 632344 - RNA, 19 nt, Homo sapiens
ucagagucuuguaaauguu

SEQ ID NO: 632345 - RNA, 19 nt, Homo sapiens
cauugaguccuuuaugaaa

SEQ ID NO: 632346 - RNA, 19 nt, Homo sapiens
gaaauucaucuuguagagu

SEQ ID NO: 632347 - RNA, 19 nt, Homo sapiens
ccucuuccuucacuucuug

SEQ ID NO: 632348 - RNA, 19 nt, Homo sapiens
gaagcuaucagaagaaaau

SEQ ID NO: 632349 - RNA, 19 nt, Homo sapiens
ggcaguuguugaaugaguu

SEQ ID NO: 632350 - RNA, 19 nt, Homo sapiens
uucagagucuuguaaaugu

SEQ ID NO: 632351 - RNA, 19 nt, Homo sapiens
gaucucuuacgguuagaaa

SEQ ID NO: 632352 - RNA, 19 nt, Homo sapiens
aaacaaggaaacuaaugga

SEQ ID NO: 632353 - RNA, 19 nt, Homo sapiens
ggcuuugccuuuaaugauc

SEQ ID NO: 632354 - RNA, 19 nt, Homo sapiens
gggaaauucaucuuguaga

SEQ ID NO: 632355 - RNA, 19 nt, Homo sapiens
caccaguccucuuccuuca

SEQ ID NO: 632356 - RNA, 19 nt, Homo sapiens
guaaugcuacagcccuuug

SEQ ID NO: 632357 - RNA, 19 nt, Homo sapiens
uguuaccucuugaaauaug

SEQ ID NO: 632358 - RNA, 19 nt, Homo sapiens
aaaaguguguuucaaagug

SEQ ID NO: 632359 - RNA, 19 nt, Homo sapiens
ggaagaguguaaaagacuu

SEQ ID NO: 632360 - RNA, 19 nt, Homo sapiens
aaacacuucagauauggaa

SEQ ID NO: 632361 - RNA, 19 nt, Homo sapiens
uaacagauucuugcucgau

SEQ ID NO: 632362 - RNA, 19 nt, Homo sapiens
cugcauccuucagagauaa

SEQ ID NO: 632363 - RNA, 19 nt, Homo sapiens
uaaaagacuucagggagaa

SEQ ID NO: 632364 - RNA, 19 nt, Homo sapiens
guauauuaccagaucauca

SEQ ID NO: 632365 - RNA, 19 nt, Homo sapiens
ccauuucauugguaguaug

SEQ ID NO: 632366 - RNA, 19 nt, Homo sapiens
gaaaagaguaaacacaagu

SEQ ID NO: 632367 - RNA, 19 nt, Homo sapiens
caaccucaacugcauccuu

SEQ ID NO: 632368 - RNA, 19 nt, Homo sapiens
cuucacagauguagucacu

SEQ ID NO: 632369 - RNA, 19 nt, Homo sapiens
ugaaugcaucuaagcaaga

SEQ ID NO: 632370 - RNA, 19 nt, Homo sapiens
ucccaugguauuuaacaua

SEQ ID NO: 632371 - RNA, 19 nt, Homo sapiens
ggggaaauggugccucuua

SEQ ID NO: 632372 - RNA, 19 nt, Homo sapiens
uacagcccuuugacuauga

SEQ ID NO: 632373 - RNA, 19 nt, Homo sapiens
uuugaaaugcccaaugaaa

SEQ ID NO: 632374 - RNA, 19 nt, Homo sapiens
ccaguccucuuccuucacu

SEQ ID NO: 632375 - RNA, 19 nt, Homo sapiens
gcucagaaagguagcacau

SEQ ID NO: 632376 - RNA, 19 nt, Homo sapiens
ccucgccgguacuguguga

SEQ ID NO: 632377 - RNA, 19 nt, Homo sapiens
uaaugaucucuuacgguua

SEQ ID NO: 632378 - RNA, 19 nt, Homo sapiens
guguguacagcgucauaua

SEQ ID NO: 632379 - RNA, 19 nt, Homo sapiens
acugcauccuucagagaua

SEQ ID NO: 632380 - RNA, 19 nt, Homo sapiens
gacuaugauccgaaugaaa

SEQ ID NO: 632381 - RNA, 19 nt, Homo sapiens
cccaacaguggaauuauug

SEQ ID NO: 632382 - RNA, 19 nt, Homo sapiens
uugcuaaucccacucauuc

SEQ ID NO: 632383 - RNA, 19 nt, Homo sapiens
acauugaguccuuuaugaa

SEQ ID NO: 632384 - RNA, 19 nt, Homo sapiens
uaccagaucaucacuagca

SEQ ID NO: 632385 - RNA, 19 nt, Homo sapiens
gcaugcagagugcuguuuc

SEQ ID NO: 632386 - RNA, 19 nt, Homo sapiens
uucauuggauucuuucuag

SEQ ID NO: 632387 - RNA, 19 nt, Homo sapiens
guuaccucuugaaauauga

SEQ ID NO: 632388 - RNA, 19 nt, Homo sapiens
augaagcuaucagaagaaa

SEQ ID NO: 632389 - RNA, 19 nt, Homo sapiens
uguaauaucauggcagaau

SEQ ID NO: 632390 - RNA, 19 nt, Homo sapiens
aaacuaauggaagagugua

SEQ ID NO: 632391 - RNA, 19 nt, Homo sapiens
cagauucuugcucgauaaa

SEQ ID NO: 632392 - RNA, 19 nt, Homo sapiens
cagaucaucacuagcagau

SEQ ID NO: 632393 - RNA, 19 nt, Homo sapiens
ccaacaguggaauuauuga

SEQ ID NO: 632394 - RNA, 19 nt, Homo sapiens
gaaaccagcugucccagaa

SEQ ID NO: 632395 - RNA, 19 nt, Homo sapiens
caacaagacugcaaaugga

SEQ ID NO: 632396 - RNA, 19 nt, Homo sapiens
cagccaagcuugcacauga

SEQ ID NO: 632397 - RNA, 19 nt, Homo sapiens
gcagggacauuucuaguag

SEQ ID NO: 632398 - RNA, 19 nt, Homo sapiens
caaagucucucuccuuaca

SEQ ID NO: 632399 - RNA, 19 nt, Homo sapiens
gggaugagauggaggaaug

SEQ ID NO: 632400 - RNA, 19 nt, Homo sapiens
gaagagagcaagugagugu

SEQ ID NO: 632401 - RNA, 19 nt, Homo sapiens
gaagggaggugggcugaga

SEQ ID NO: 632402 - RNA, 19 nt, Homo sapiens
gauuagaguugguugcaaa

SEQ ID NO: 632403 - RNA, 19 nt, Homo sapiens
ggugggagauuacgucuau

SEQ ID NO: 632404 - RNA, 19 nt, Homo sapiens
ggaaggcucugacccaucu

SEQ ID NO: 632405 - RNA, 19 nt, Homo sapiens
caagagcccuagauuguag

SEQ ID NO: 632406 - RNA, 19 nt, Homo sapiens
agacaccgaucaacagaaa

SEQ ID NO: 632407 - RNA, 19 nt, Homo sapiens
gcuaagaacagacaaacuu

SEQ ID NO: 632408 - RNA, 19 nt, Homo sapiens
agaagggccugacuuguga

SEQ ID NO: 632409 - RNA, 19 nt, Homo sapiens
gcaagagcccuagauugua

SEQ ID NO: 632410 - RNA, 19 nt, Homo sapiens
cucaaagucucucuccuua

SEQ ID NO: 632411 - RNA, 19 nt, Homo sapiens
gaaugagacagauaucuug

SEQ ID NO: 632412 - RNA, 19 nt, Homo sapiens
gagauuacgucuauuuuga

SEQ ID NO: 632413 - RNA, 19 nt, Homo sapiens
ggagugaggagugaauuaa

SEQ ID NO: 632414 - RNA, 19 nt, Homo sapiens
ccacagaccgguauauuca

SEQ ID NO: 632415 - RNA, 19 nt, Homo sapiens
gugggaaccuagccuguuu

SEQ ID NO: 632416 - RNA, 19 nt, Homo sapiens
gcaggaacuuggcccaugu

SEQ ID NO: 632417 - RNA, 19 nt, Homo sapiens
ggaggugggcugagaggua

SEQ ID NO: 632418 - RNA, 19 nt, Homo sapiens
acacuaagccaaacccuaa

SEQ ID NO: 632419 - RNA, 19 nt, Homo sapiens
gcaaauaccaagcugagau

SEQ ID NO: 632420 - RNA, 19 nt, Homo sapiens
gcugcugccucccgagaua

SEQ ID NO: 632421 - RNA, 19 nt, Homo sapiens
gggaagaguaaacagauaa

SEQ ID NO: 632422 - RNA, 19 nt, Homo sapiens
cagacaaacuuuccugcuu

SEQ ID NO: 632423 - RNA, 19 nt, Homo sapiens
cagaggccaugcuauuuga

SEQ ID NO: 632424 - RNA, 19 nt, Homo sapiens
cagcaauccuuaccugguu

SEQ ID NO: 632425 - RNA, 19 nt, Homo sapiens
ugagaacucuuccagcaau

SEQ ID NO: 632426 - RNA, 19 nt, Homo sapiens
cggcagagcccaacgacua

SEQ ID NO: 632427 - RNA, 19 nt, Homo sapiens
ccaagcuacuggcuaagaa

SEQ ID NO: 632428 - RNA, 19 nt, Homo sapiens
gaagcagacagcaaacuga

SEQ ID NO: 632429 - RNA, 19 nt, Homo sapiens
guagagggagaaucugaua

SEQ ID NO: 632430 - RNA, 19 nt, Homo sapiens
gcaacuaucgucaaagauc

SEQ ID NO: 632431 - RNA, 19 nt, Homo sapiens
ccaaaccucccuucccuuu

SEQ ID NO: 632432 - RNA, 19 nt, Homo sapiens
uggcaacuaucgucaaaga

SEQ ID NO: 632433 - RNA, 19 nt, Homo sapiens
gaucauuucuguggguuca

SEQ ID NO: 632434 - RNA, 19 nt, Homo sapiens
gugugacccucuugaauga

SEQ ID NO: 632435 - RNA, 19 nt, Homo sapiens
gaaacgggccuaugagacu

SEQ ID NO: 632436 - RNA, 19 nt, Homo sapiens
uguccggacuuuccuaauu

SEQ ID NO: 632437 - RNA, 19 nt, Homo sapiens
guuaccaccucgagacuug

SEQ ID NO: 632438 - RNA, 19 nt, Homo sapiens
ucggcaauuugaaucauua

SEQ ID NO: 632439 - RNA, 19 nt, Homo sapiens
cagcagcgccaucaacuga

SEQ ID NO: 632440 - RNA, 19 nt, Homo sapiens
guccggacuuuccuaauug

SEQ ID NO: 632441 - RNA, 19 nt, Homo sapiens
gggagugaggagugaauua

SEQ ID NO: 632442 - RNA, 19 nt, Homo sapiens
gaaacuaaacccagcugau

SEQ ID NO: 632443 - RNA, 19 nt, Homo sapiens
caacuaucgucaaagaucu

SEQ ID NO: 632444 - RNA, 19 nt, Homo sapiens
caaugccaaugccaucaaa

SEQ ID NO: 632445 - RNA, 19 nt, Homo sapiens
gacaaacuuuccugcuuca

SEQ ID NO: 632446 - RNA, 19 nt, Homo sapiens
gcucaaagucucucuccuu

SEQ ID NO: 632447 - RNA, 19 nt, Homo sapiens
cgagauaucacucuguuuc

SEQ ID NO: 632448 - RNA, 19 nt, Homo sapiens
gauuguagcagcuccauuc

SEQ ID NO: 632449 - RNA, 19 nt, Homo sapiens
cgaagggagugaggaguga

SEQ ID NO: 632450 - RNA, 19 nt, Homo sapiens
ggaaccagcagaagaugga

SEQ ID NO: 632451 - RNA, 19 nt, Homo sapiens
ccagugagacucccucgaa

SEQ ID NO: 632452 - RNA, 19 nt, Homo sapiens
gcucugacccaucuggaaa

SEQ ID NO: 632453 - RNA, 19 nt, Homo sapiens
ugaaacaggucuacauucc

SEQ ID NO: 632454 - RNA, 19 nt, Homo sapiens
uaaggaagagagcaaguga

SEQ ID NO: 632455 - RNA, 19 nt, Homo sapiens
gaauuaaggaagagagcaa

SEQ ID NO: 632456 - RNA, 19 nt, Homo sapiens
ccaauccugugguguuugu

SEQ ID NO: 632457 - RNA, 19 nt, Homo sapiens
aaacuaaacccagcugaug

SEQ ID NO: 632458 - RNA, 19 nt, Homo sapiens
aaacgggccuaugagacua

SEQ ID NO: 632459 - RNA, 19 nt, Homo sapiens
cagaagggccugacuugug

SEQ ID NO: 632460 - RNA, 19 nt, Homo sapiens
gccaaacccuaaccagauc

SEQ ID NO: 632461 - RNA, 19 nt, Homo sapiens
caugugcagggaccuauua

SEQ ID NO: 632462 - RNA, 19 nt, Homo sapiens
gcauaguccaguuuuauua

SEQ ID NO: 632463 - RNA, 19 nt, Homo sapiens
gagggagaaucugauaauc

SEQ ID NO: 632464 - RNA, 19 nt, Homo sapiens
aaccucggauucuguaauu

SEQ ID NO: 632465 - RNA, 19 nt, Homo sapiens
cuaagaacagacaaacuuu

SEQ ID NO: 632466 - RNA, 19 nt, Homo sapiens
gcuacuggcuaagaacaga

SEQ ID NO: 632467 - RNA, 19 nt, Homo sapiens
ccuguuggaucuacuggaa

SEQ ID NO: 632468 - RNA, 19 nt, Homo sapiens
aggaggcccuagagaagua

SEQ ID NO: 632469 - RNA, 19 nt, Homo sapiens
aggcaaagguugucugucu

SEQ ID NO: 632470 - RNA, 19 nt, Homo sapiens
ugaaugagacagauaucuu

SEQ ID NO: 632471 - RNA, 19 nt, Homo sapiens
guaaugccagggaguuuga

SEQ ID NO: 632472 - RNA, 19 nt, Homo sapiens
caagacaccgaucaacaga

SEQ ID NO: 632473 - RNA, 19 nt, Homo sapiens
ucaacaagacugcaaaugg

SEQ ID NO: 632474 - RNA, 19 nt, Homo sapiens
gcagaucgaccaguuucuu

SEQ ID NO: 632475 - RNA, 19 nt, Homo sapiens
gaucagggcgagauuagag

SEQ ID NO: 632476 - RNA, 19 nt, Homo sapiens
agacacuucucgcugauca

SEQ ID NO: 632477 - RNA, 19 nt, Homo sapiens
gaaauguggaggcaaaggu

SEQ ID NO: 632478 - RNA, 19 nt, Homo sapiens
ccuggcaacuaucgucaaa

SEQ ID NO: 632479 - RNA, 19 nt, Homo sapiens
caaacuuuccugcuucaga

SEQ ID NO: 632480 - RNA, 19 nt, Homo sapiens
ccacggagccacacucaag

SEQ ID NO: 632481 - RNA, 19 nt, Homo sapiens
gggccugacuugugagagu

SEQ ID NO: 632482 - RNA, 19 nt, Homo sapiens
ccaccuacacuaagccaaa

SEQ ID NO: 632483 - RNA, 19 nt, Homo sapiens
ucagaggccaugcuauuug

SEQ ID NO: 632484 - RNA, 19 nt, Homo sapiens
uagaguugguugcaaauac

SEQ ID NO: 632485 - RNA, 19 nt, Homo sapiens
gcagugugacccucuugaa

SEQ ID NO: 632486 - RNA, 19 nt, Homo sapiens
ggcaaagguugucugucuu

SEQ ID NO: 632487 - RNA, 19 nt, Homo sapiens
ccaagacuccauugaagau

SEQ ID NO: 632488 - RNA, 19 nt, Homo sapiens
agcagaagauggagaugaa

SEQ ID NO: 632489 - RNA, 19 nt, Homo sapiens
gcagcgccaucaacugaag

SEQ ID NO: 632490 - RNA, 19 nt, Homo sapiens
gccaagcgucagaaacuaa

SEQ ID NO: 632491 - RNA, 19 nt, Homo sapiens
caacagggccaagcuacug

SEQ ID NO: 632492 - RNA, 19 nt, Homo sapiens
gcagacagcaaacugaaac

SEQ ID NO: 632493 - RNA, 19 nt, Homo sapiens
ugcaagagcccuagauugu

SEQ ID NO: 632494 - RNA, 19 nt, Homo sapiens
uaugugcaaugaccuauuu

SEQ ID NO: 632495 - RNA, 19 nt, Homo sapiens
gaacgacucgggaauguca

SEQ ID NO: 632496 - RNA, 19 nt, Homo sapiens
gguaaacccauuccaacua

SEQ ID NO: 632497 - RNA, 19 nt, Homo sapiens
ggaaugucaucuccaucuu

SEQ ID NO: 632498 - RNA, 19 nt, Homo sapiens
guaaacccauuccaacuac

SEQ ID NO: 632499 - RNA, 19 nt, Homo sapiens
gaggacuugugaucagaaa

SEQ ID NO: 632500 - RNA, 19 nt, Homo sapiens
guccugagcccgugucauu

SEQ ID NO: 632501 - RNA, 19 nt, Homo sapiens
cccgauguauggaaauaaa

SEQ ID NO: 632502 - RNA, 19 nt, Homo sapiens
uaagguaaacccauuccaa

SEQ ID NO: 632503 - RNA, 19 nt, Homo sapiens
caucuucacccuucagaga

SEQ ID NO: 632504 - RNA, 19 nt, Homo sapiens
ucagagagcaguccuuucu

SEQ ID NO: 632505 - RNA, 19 nt, Homo sapiens
caagaacgacucgggaaug

SEQ ID NO: 632506 - RNA, 19 nt, Homo sapiens
gaaugucaucuccaucuuc

SEQ ID NO: 632507 - RNA, 19 nt, Homo sapiens
uacccgauguauggaaaua

SEQ ID NO: 632508 - RNA, 19 nt, Homo sapiens
aaugucaucuccaucuuca

SEQ ID NO: 632509 - RNA, 19 nt, Homo sapiens
gcugugcucuccccuguuu

SEQ ID NO: 632510 - RNA, 19 nt, Homo sapiens
gggaaugucaucuccaucu

SEQ ID NO: 632511 - RNA, 19 nt, Homo sapiens
ggaccauaaacucaacuug

SEQ ID NO: 632512 - RNA, 19 nt, Homo sapiens
aagaacgacucgggaaugu

SEQ ID NO: 632513 - RNA, 19 nt, Homo sapiens
guugaggacuugugaucag

SEQ ID NO: 632514 - RNA, 19 nt, Homo sapiens
acacuuaucccagacacaa

SEQ ID NO: 632515 - RNA, 19 nt, Homo sapiens
ccaagaacgacucgggaau

SEQ ID NO: 632516 - RNA, 19 nt, Homo sapiens
caauugguuuguacucacu

SEQ ID NO: 632517 - RNA, 19 nt, Homo sapiens
gugcaaugaccuauuuaag

SEQ ID NO: 632518 - RNA, 19 nt, Homo sapiens
cuucagagagcaguccuuu

SEQ ID NO: 632519 - RNA, 19 nt, Homo sapiens
ggacagagcuccaccucaa

SEQ ID NO: 632520 - RNA, 19 nt, Homo sapiens
gaagaggccuggaaugaga

SEQ ID NO: 632521 - RNA, 19 nt, Homo sapiens
gaaggcagcucagcaguuu

SEQ ID NO: 632522 - RNA, 19 nt, Homo sapiens
gauggcagcuuaaagaguu

SEQ ID NO: 632523 - RNA, 19 nt, Homo sapiens
aagcagaacucacagauga

SEQ ID NO: 632524 - RNA, 19 nt, Homo sapiens
gaaacacccugaccuucuu

SEQ ID NO: 632525 - RNA, 19 nt, Homo sapiens
ggaaguggaugaugaugau

SEQ ID NO: 632526 - RNA, 19 nt, Homo sapiens
ccagucaacucaaaucuga

SEQ ID NO: 632527 - RNA, 19 nt, Homo sapiens
ggaccuggcucagauaaau

SEQ ID NO: 632528 - RNA, 19 nt, Homo sapiens
agaagaacaucaagaagaa

SEQ ID NO: 632529 - RNA, 19 nt, Homo sapiens
gacauugacuccgauagua

SEQ ID NO: 632530 - RNA, 19 nt, Homo sapiens
gaagaaagacaaggacaaa

SEQ ID NO: 632531 - RNA, 19 nt, Homo sapiens
gaacaaagacgaggagauc

SEQ ID NO: 632532 - RNA, 19 nt, Homo sapiens
caaggcagcuucugaugau

SEQ ID NO: 632533 - RNA, 19 nt, Homo sapiens
gaugauggcagcuuaaaga

SEQ ID NO: 632534 - RNA, 19 nt, Homo sapiens
ggaaggagaagaaggagaa

SEQ ID NO: 632535 - RNA, 19 nt, Homo sapiens
gcauguaccgccaagguua

SEQ ID NO: 632536 - RNA, 19 nt, Homo sapiens
gggaugagauuguggagau

SEQ ID NO: 632537 - RNA, 19 nt, Homo sapiens
ugacggagacuaacgcaua

SEQ ID NO: 632538 - RNA, 19 nt, Homo sapiens
cagcaaaccacaccacuuu

SEQ ID NO: 632539 - RNA, 19 nt, Homo sapiens
ccagaaggcugcguaccua

SEQ ID NO: 632540 - RNA, 19 nt, Homo sapiens
uaugugcaaugaccuauuu

SEQ ID NO: 632541 - RNA, 19 nt, Homo sapiens
gaacgacucgggaauguca

SEQ ID NO: 632542 - RNA, 19 nt, Homo sapiens
gaacaucgagcuggcguuu

SEQ ID NO: 632543 - RNA, 19 nt, Homo sapiens
aaagaggaguuucugaaga

SEQ ID NO: 632544 - RNA, 19 nt, Homo sapiens
gagcagauccggaacaaag

SEQ ID NO: 632545 - RNA, 19 nt, Homo sapiens
ggaaugagacggagaaggu

SEQ ID NO: 632546 - RNA, 19 nt, Homo sapiens
gguaaacccauuccaacua

SEQ ID NO: 632547 - RNA, 19 nt, Homo sapiens
gcacgacccucucgacaac

SEQ ID NO: 632548 - RNA, 19 nt, Homo sapiens
agacacgccuggaguuuga

SEQ ID NO: 632549 - RNA, 19 nt, Homo sapiens
gaagaagccaacaaagaga

SEQ ID NO: 632550 - RNA, 19 nt, Homo sapiens
ugaacgaauugaugaagaa

SEQ ID NO: 632551 - RNA, 19 nt, Homo sapiens
ugagacagacccauucuaa

SEQ ID NO: 632552 - RNA, 19 nt, Homo sapiens
aggaagacaugaacgaauu

SEQ ID NO: 632553 - RNA, 19 nt, Homo sapiens
ucacucugcuccaugauga

SEQ ID NO: 632554 - RNA, 19 nt, Homo sapiens
cagcucagcaguuuaguaa

SEQ ID NO: 632555 - RNA, 19 nt, Homo sapiens
ggaaugucaucuccaucuu

SEQ ID NO: 632556 - RNA, 19 nt, Homo sapiens
gaaagacaaggacaaagau

SEQ ID NO: 632557 - RNA, 19 nt, Homo sapiens
gcuagaagaagccaacaaa

SEQ ID NO: 632558 - RNA, 19 nt, Homo sapiens
gcgaguggcggcugaagua

SEQ ID NO: 632559 - RNA, 19 nt, Homo sapiens
gcagauggagguuauggaa

SEQ ID NO: 632560 - RNA, 19 nt, Homo sapiens
cagaagaacaucaagaaga

SEQ ID NO: 632561 - RNA, 19 nt, Homo sapiens
caaaccagcaggaaccuaa

SEQ ID NO: 632562 - RNA, 19 nt, Homo sapiens
gauaaaugaucuccaagcu

SEQ ID NO: 632563 - RNA, 19 nt, Homo sapiens
gaaaacagaagaacagauu

SEQ ID NO: 632564 - RNA, 19 nt, Homo sapiens
gauggagagugaugagaau

SEQ ID NO: 632565 - RNA, 19 nt, Homo sapiens
aggaugagauggagaguga

SEQ ID NO: 632566 - RNA, 19 nt, Homo sapiens
gaacaucaagaagaacaaa

SEQ ID NO: 632567 - RNA, 19 nt, Homo sapiens
guaaacccauuccaacuac

SEQ ID NO: 632568 - RNA, 19 nt, Homo sapiens
ugaaaggacgcaagugaaa

SEQ ID NO: 632569 - RNA, 19 nt, Homo sapiens
uagaagaagccaacaaaga

SEQ ID NO: 632570 - RNA, 19 nt, Homo sapiens
agaagcagauggagguuau

SEQ ID NO: 632571 - RNA, 19 nt, Homo sapiens
gaccaggccucccaucagu

SEQ ID NO: 632572 - RNA, 19 nt, Homo sapiens
ugcaggaguuggaaagaua

SEQ ID NO: 632573 - RNA, 19 nt, Homo sapiens
cagaaggccugcugguuca

SEQ ID NO: 632574 - RNA, 19 nt, Homo sapiens
cagaagaggccuggaauga

SEQ ID NO: 632575 - RNA, 19 nt, Homo sapiens
gaacccagccacccagaau

SEQ ID NO: 632576 - RNA, 19 nt, Homo sapiens
gaggacuugugaucagaaa

SEQ ID NO: 632577 - RNA, 19 nt, Homo sapiens
ggaaacacccugaccuucu

SEQ ID NO: 632578 - RNA, 19 nt, Homo sapiens
gacaugaacgaauugauga

SEQ ID NO: 632579 - RNA, 19 nt, Homo sapiens
caauggagguggagaucga

SEQ ID NO: 632580 - RNA, 19 nt, Homo sapiens
gcagagcuccaggacauuu

SEQ ID NO: 632581 - RNA, 19 nt, Homo sapiens
acaucgagcuggcguuuga

SEQ ID NO: 632582 - RNA, 19 nt, Homo sapiens
gagaucgacugguggagau

SEQ ID NO: 632583 - RNA, 19 nt, Homo sapiens
gcagaacucacagaugauu

SEQ ID NO: 632584 - RNA, 19 nt, Homo sapiens
ggacauggugacaaaguau

SEQ ID NO: 632585 - RNA, 19 nt, Homo sapiens
gaccuaaaguuggcauuca

SEQ ID NO: 632586 - RNA, 19 nt, Homo sapiens
ggaggaagaucaggaagac

SEQ ID NO: 632587 - RNA, 19 nt, Homo sapiens
gcagcuagaggaagaguau

SEQ ID NO: 632588 - RNA, 19 nt, Homo sapiens
ugcagcagcucaagaagaa

SEQ ID NO: 632589 - RNA, 19 nt, Homo sapiens
ccugcugucuuucuacuuu

SEQ ID NO: 632590 - RNA, 19 nt, Homo sapiens
ggaagaguaugaggacaag

SEQ ID NO: 632591 - RNA, 19 nt, Homo sapiens
guacagaagaacaucaaga

SEQ ID NO: 632592 - RNA, 19 nt, Homo sapiens
ucaaggaucaggaagaaga

SEQ ID NO: 632593 - RNA, 19 nt, Homo sapiens
agauggagguuauggaaau

SEQ ID NO: 632594 - RNA, 19 nt, Homo sapiens
agaaggagaugaaggaacu

SEQ ID NO: 632595 - RNA, 19 nt, Homo sapiens
agaaagacaaggacaaaga

SEQ ID NO: 632596 - RNA, 19 nt, Homo sapiens
ggagacacgccuggaguuu

SEQ ID NO: 632597 - RNA, 19 nt, Homo sapiens
ccaacuggguagaguacaa

SEQ ID NO: 632598 - RNA, 19 nt, Homo sapiens
gcaccugacugacauugac

SEQ ID NO: 632599 - RNA, 19 nt, Homo sapiens
cagaagaaguuaaaacaga

SEQ ID NO: 632600 - RNA, 19 nt, Homo sapiens
gaacaagaggcagcuggaa

SEQ ID NO: 632601 - RNA, 19 nt, Homo sapiens
gcucagcaguuuaguaagc

SEQ ID NO: 632602 - RNA, 19 nt, Homo sapiens
cauucaacgucuucuacua

SEQ ID NO: 632603 - RNA, 19 nt, Homo sapiens
ggagauuaaugggcacaau

SEQ ID NO: 632604 - RNA, 19 nt, Homo sapiens
gaucgacugguggagauua

SEQ ID NO: 632605 - RNA, 19 nt, Homo sapiens
guccugagcccgugucauu

SEQ ID NO: 632606 - RNA, 19 nt, Homo sapiens
agaggagguuugacaguga

SEQ ID NO: 632607 - RNA, 19 nt, Homo sapiens
gcuuggaucuggagaagag

SEQ ID NO: 632608 - RNA, 19 nt, Homo sapiens
gcaccaacuggguagagua

SEQ ID NO: 632609 - RNA, 19 nt, Homo sapiens
gggacaggcccgaaacuga

SEQ ID NO: 632610 - RNA, 19 nt, Homo sapiens
gcuaagcacucauaauccu

SEQ ID NO: 632611 - RNA, 19 nt, Homo sapiens
ccaaggcagcuucugauga

SEQ ID NO: 632612 - RNA, 19 nt, Homo sapiens
gaaagcacggaaagcaaug

SEQ ID NO: 632613 - RNA, 19 nt, Homo sapiens
gaacagccccaccaucauu

SEQ ID NO: 632614 - RNA, 19 nt, Homo sapiens
agaaggugaugcacauguu

SEQ ID NO: 632615 - RNA, 19 nt, Homo sapiens
ggaugaggaugacguugag

SEQ ID NO: 632616 - RNA, 19 nt, Homo sapiens
gcgauacucccacaguuau

SEQ ID NO: 632617 - RNA, 19 nt, Homo sapiens
ggaagacaugaacgaauug

SEQ ID NO: 632618 - RNA, 19 nt, Homo sapiens
gagauugcccagcucaaga

SEQ ID NO: 632619 - RNA, 19 nt, Homo sapiens
ggacagaaguuuagaguag

SEQ ID NO: 632620 - RNA, 19 nt, Homo sapiens
caagaagacuguaccuaaa

SEQ ID NO: 632621 - RNA, 19 nt, Homo sapiens
caaaucagguucauuaaag

SEQ ID NO: 632622 - RNA, 19 nt, Homo sapiens
ucucagagguggccaauaa

SEQ ID NO: 632623 - RNA, 19 nt, Homo sapiens
gcaguagucucuaaagcaa

SEQ ID NO: 632624 - RNA, 19 nt, Homo sapiens
gaacccagccucccaagaa

SEQ ID NO: 632625 - RNA, 19 nt, Homo sapiens
caaugccucuucccucuua

SEQ ID NO: 632626 - RNA, 19 nt, Homo sapiens
ccaagaagacuguaccuaa

SEQ ID NO: 632627 - RNA, 19 nt, Homo sapiens
uaaagaagcggaagcagaa

SEQ ID NO: 632628 - RNA, 19 nt, Homo sapiens
gaagagaagacaucuaagu

SEQ ID NO: 632629 - RNA, 19 nt, Homo sapiens
ccaaagcuccuccuaagaa

SEQ ID NO: 632630 - RNA, 19 nt, Homo sapiens
gaaccagaagccaaagaua

SEQ ID NO: 632631 - RNA, 19 nt, Homo sapiens
uaagaaagcuaagaagaag

SEQ ID NO: 632632 - RNA, 19 nt, Homo sapiens
gcggacaacuccuuugaug

SEQ ID NO: 632633 - RNA, 19 nt, Homo sapiens
caaagaaccagaagccaaa

SEQ ID NO: 632634 - RNA, 19 nt, Homo sapiens
caagagcucugauucugau

SEQ ID NO: 632635 - RNA, 19 nt, Homo sapiens
caacaguucuucuucugau

SEQ ID NO: 632636 - RNA, 19 nt, Homo sapiens
gaagaagccacagaaggua

SEQ ID NO: 632637 - RNA, 19 nt, Homo sapiens
caagaaggcuguggagaag

SEQ ID NO: 632638 - RNA, 19 nt, Homo sapiens
ccaaagauaacaccuguga

SEQ ID NO: 632639 - RNA, 19 nt, Homo sapiens
ggacagcagcucugauuca

SEQ ID NO: 632640 - RNA, 19 nt, Homo sapiens
ccaagaaggcuguggagaa

SEQ ID NO: 632641 - RNA, 19 nt, Homo sapiens
caaauggaccaguggcuaa

SEQ ID NO: 632642 - RNA, 19 nt, Homo sapiens
gugaaaguccucauacuga

SEQ ID NO: 632643 - RNA, 19 nt, Homo sapiens
gcaaguccuuucggcauga

SEQ ID NO: 632644 - RNA, 19 nt, Homo sapiens
ccaaaucagguucauuaaa

SEQ ID NO: 632645 - RNA, 19 nt, Homo sapiens
cuaaggcaguagucucuaa

SEQ ID NO: 632646 - RNA, 19 nt, Homo sapiens
cuaagaaagcuaagaagaa

SEQ ID NO: 632647 - RNA, 19 nt, Homo sapiens
gcuaagaaagcuaagaaga

SEQ ID NO: 632648 - RNA, 19 nt, Homo sapiens
ugagguggauucacgaguu

SEQ ID NO: 632649 - RNA, 19 nt, Homo sapiens
caucuaagucugcaguuaa

SEQ ID NO: 632650 - RNA, 19 nt, Homo sapiens
gccaagagcucugauucug

SEQ ID NO: 632651 - RNA, 19 nt, Homo sapiens
gagaguagcagcagugaag

SEQ ID NO: 632652 - RNA, 19 nt, Homo sapiens
gaaaguuacaggcaaaugg

SEQ ID NO: 632653 - RNA, 19 nt, Homo sapiens
guccaggucaauucuauua

SEQ ID NO: 632654 - RNA, 19 nt, Homo sapiens
ccaauaaguucgccaaagc

SEQ ID NO: 632655 - RNA, 19 nt, Homo sapiens
gcagugaggaggaggaaga

SEQ ID NO: 632656 - RNA, 19 nt, Homo sapiens
gcaaagaaagcagcagaga

SEQ ID NO: 632657 - RNA, 19 nt, Homo sapiens
gagguggauucacgaguug

SEQ ID NO: 632658 - RNA, 19 nt, Homo sapiens
gccagccucugcaaagaaa

SEQ ID NO: 632659 - RNA, 19 nt, Homo sapiens
uaaaccaccuccagcaaag

SEQ ID NO: 632660 - RNA, 19 nt, Homo sapiens
gccaaagcaucagagagua

SEQ ID NO: 632661 - RNA, 19 nt, Homo sapiens
ccaaucagguuuugaaguu

SEQ ID NO: 632662 - RNA, 19 nt, Homo sapiens
gaggagaagacaaagaaga

SEQ ID NO: 632663 - RNA, 19 nt, Homo sapiens
gaagacagcagugaugagu

SEQ ID NO: 632664 - RNA, 19 nt, Homo sapiens
aaccaggucccuacaguua

SEQ ID NO: 632665 - RNA, 19 nt, Homo sapiens
caacgguagugacgcguau

SEQ ID NO: 632666 - RNA, 19 nt, Homo sapiens
uaaaccaggucccuacagu

SEQ ID NO: 632667 - RNA, 19 nt, Homo sapiens
gaggaugagccaccaaaga

SEQ ID NO: 632668 - RNA, 19 nt, Homo sapiens
gcucugauucugauucuga

SEQ ID NO: 632669 - RNA, 19 nt, Homo sapiens
ggucccagagcgaaaguua

SEQ ID NO: 632670 - RNA, 19 nt, Homo sapiens
ggcaagggcucuccaagac

SEQ ID NO: 632671 - RNA, 19 nt, Homo sapiens
gcagugaugagucugauuc

SEQ ID NO: 632672 - RNA, 19 nt, Homo sapiens
aaagaaggcugcuguaccu

SEQ ID NO: 632673 - RNA, 19 nt, Homo sapiens
uuccaaaucagguucauua

SEQ ID NO: 632674 - RNA, 19 nt, Homo sapiens
gcaacaguucuucuucuga

SEQ ID NO: 632675 - RNA, 19 nt, Homo sapiens
aggaagagaagacaucuaa

SEQ ID NO: 632676 - RNA, 19 nt, Homo sapiens
ucaagggccuccagcaaag

SEQ ID NO: 632677 - RNA, 19 nt, Homo sapiens
gaugaggacagaaguuuag

SEQ ID NO: 632678 - RNA, 19 nt, Homo sapiens
ccaggucaauucuauuaag

SEQ ID NO: 632679 - RNA, 19 nt, Homo sapiens
gggcaagggcucuccaaga

SEQ ID NO: 632680 - RNA, 19 nt, Homo sapiens
caaggcgacugccaaagca

SEQ ID NO: 632681 - RNA, 19 nt, Homo sapiens
ugacagcucugaggaugau

SEQ ID NO: 632682 - RNA, 19 nt, Homo sapiens
caaagcuccuccuaagaag

SEQ ID NO: 632683 - RNA, 19 nt, Homo sapiens
aaagauaacaccugugaca

SEQ ID NO: 632684 - RNA, 19 nt, Homo sapiens
aaccagaagccaaagauaa

SEQ ID NO: 632685 - RNA, 19 nt, Homo sapiens
agaaugaggcugccaagga

SEQ ID NO: 632686 - RNA, 19 nt, Homo sapiens
gaacagugaggaggaggaa

SEQ ID NO: 632687 - RNA, 19 nt, Homo sapiens
acaucuaagucugcaguua

SEQ ID NO: 632688 - RNA, 19 nt, Homo sapiens
ggaggaaauugagguggau

SEQ ID NO: 632689 - RNA, 19 nt, Homo sapiens
gugaggaggagaagacaaa

SEQ ID NO: 632690 - RNA, 19 nt, Homo sapiens
aguuaaagcucagacuaaa

SEQ ID NO: 632691 - RNA, 19 nt, Homo sapiens
ucagggaggaggaaauuga

SEQ ID NO: 632692 - RNA, 19 nt, Homo sapiens
gcacugacugcccagaaug

SEQ ID NO: 632693 - RNA, 19 nt, Homo sapiens
caguuaaagcucagacuaa

SEQ ID NO: 632694 - RNA, 19 nt, Homo sapiens
gagcgagccaaucagguuu

SEQ ID NO: 632695 - RNA, 19 nt, Homo sapiens
ggucagggaggaggaaauu

SEQ ID NO: 632696 - RNA, 19 nt, Homo sapiens
agugguaguuuccaaauca

SEQ ID NO: 632697 - RNA, 19 nt, Homo sapiens
cagcaacaguucuucuucu

SEQ ID NO: 632698 - RNA, 19 nt, Homo sapiens
agucugcaguuaagaagaa

SEQ ID NO: 632699 - RNA, 19 nt, Homo sapiens
ugaugagucugauucaagu

SEQ ID NO: 632700 - RNA, 19 nt, Homo sapiens
gagcucugauucugauucu

SEQ ID NO: 632701 - RNA, 19 nt, Homo sapiens
gccaauaaguucgccaaag

SEQ ID NO: 632702 - RNA, 19 nt, Homo sapiens
gcgauaaccaacucucaga

SEQ ID NO: 632703 - RNA, 19 nt, Homo sapiens
ggaggaagaagaaaagaaa

SEQ ID NO: 632704 - RNA, 19 nt, Homo sapiens
ggaagaguucuagcaguga

SEQ ID NO: 632705 - RNA, 19 nt, Homo sapiens
ggaaauugagguggauuca

SEQ ID NO: 632706 - RNA, 19 nt, Homo sapiens
gcagcaacaguucuucuuc

SEQ ID NO: 632707 - RNA, 19 nt, Homo sapiens
uuaagaagaagccacagaa

SEQ ID NO: 632708 - RNA, 19 nt, Homo sapiens
ucaaauaagccagcuguca

SEQ ID NO: 632709 - RNA, 19 nt, Homo sapiens
cuaaaccaccuccagcaaa

SEQ ID NO: 632710 - RNA, 19 nt, Homo sapiens
gcagugaagacagcaguga

SEQ ID NO: 632711 - RNA, 19 nt, Homo sapiens
ccaagagcucugauucuga

SEQ ID NO: 632712 - RNA, 19 nt, Homo sapiens
gaggacagaaguuuagagu

SEQ ID NO: 632713 - RNA, 19 nt, Homo sapiens
gcagugguaguuuccaaau

SEQ ID NO: 632714 - RNA, 19 nt, Homo sapiens
gagagcagcaacaguucuu

SEQ ID NO: 632715 - RNA, 19 nt, Homo sapiens
caguagcagugaugacuca

SEQ ID NO: 632716 - RNA, 19 nt, Homo sapiens
gcaaagaaggcugcuguac

SEQ ID NO: 632717 - RNA, 19 nt, Homo sapiens
ggaggaggaggaaguucaa

SEQ ID NO: 632718 - RNA, 19 nt, Homo sapiens
ugaugaggacagaaguuua

SEQ ID NO: 632719 - RNA, 19 nt, Homo sapiens
gaaaugaacagcagcuuua

SEQ ID NO: 632720 - RNA, 19 nt, Homo sapiens
ggaugaaccugaugaguuu

SEQ ID NO: 632721 - RNA, 19 nt, Homo sapiens
gaaguucccucaauaccua

SEQ ID NO: 632722 - RNA, 19 nt, Homo sapiens
gagcgaggcugccaaguuu

SEQ ID NO: 632723 - RNA, 19 nt, Homo sapiens
gaaggaauguuuguuugua

SEQ ID NO: 632724 - RNA, 19 nt, Homo sapiens
gacuauaccuuuccuauga

SEQ ID NO: 632725 - RNA, 19 nt, Homo sapiens
gcaacaagcugccaagcaa

SEQ ID NO: 632726 - RNA, 19 nt, Homo sapiens
ggacguggcuucaaauagu

SEQ ID NO: 632727 - RNA, 19 nt, Homo sapiens
gaggaaggcugaacaagga

SEQ ID NO: 632728 - RNA, 19 nt, Homo sapiens
cagcaaugaucuuuacaua

SEQ ID NO: 632729 - RNA, 19 nt, Homo sapiens
gaaccaaguccuacaauga

SEQ ID NO: 632730 - RNA, 19 nt, Homo sapiens
ugucauaucuuuagacuug

SEQ ID NO: 632731 - RNA, 19 nt, Homo sapiens
gaggauuggugaugaaauu

SEQ ID NO: 632732 - RNA, 19 nt, Homo sapiens
ucaaauaguucucaugguu

SEQ ID NO: 632733 - RNA, 19 nt, Homo sapiens
gagacuggauuuggauuua

SEQ ID NO: 632734 - RNA, 19 nt, Homo sapiens
gcaaugaucuuuacauagc

SEQ ID NO: 632735 - RNA, 19 nt, Homo sapiens
gaagcauucucgagcuaua

SEQ ID NO: 632736 - RNA, 19 nt, Homo sapiens
gcaaguucauucacacaaa

SEQ ID NO: 632737 - RNA, 19 nt, Homo sapiens
gagauggccuauacugaaa

SEQ ID NO: 632738 - RNA, 19 nt, Homo sapiens
ccaaagugauccagaagaa

SEQ ID NO: 632739 - RNA, 19 nt, Homo sapiens
caacacaggagcaagauuu

SEQ ID NO: 632740 - RNA, 19 nt, Homo sapiens
gaccggaucuuggcaguaa

SEQ ID NO: 632741 - RNA, 19 nt, Homo sapiens
ggagagguguggaaagaug

SEQ ID NO: 632742 - RNA, 19 nt, Homo sapiens
ggauuuggauuuaggauuc

SEQ ID NO: 632743 - RNA, 19 nt, Homo sapiens
ucugaaaucucuacacauu

SEQ ID NO: 632744 - RNA, 19 nt, Homo sapiens
ccgaggagcuggacaguga

SEQ ID NO: 632745 - RNA, 19 nt, Homo sapiens
gaaaacaacaucuugguua

SEQ ID NO: 632746 - RNA, 19 nt, Homo sapiens
caaaucccauucagacauu

SEQ ID NO: 632747 - RNA, 19 nt, Homo sapiens
ggagauggccuauacugaa

SEQ ID NO: 632748 - RNA, 19 nt, Homo sapiens
gaaagccagguuauacaua

SEQ ID NO: 632749 - RNA, 19 nt, Homo sapiens
ggaaagacagccagaauag

SEQ ID NO: 632750 - RNA, 19 nt, Homo sapiens
gcaccugucucucguuuua

SEQ ID NO: 632751 - RNA, 19 nt, Homo sapiens
gcgaaggaauguuuguuug

SEQ ID NO: 632752 - RNA, 19 nt, Homo sapiens
gcaagagaccuaugauuca

SEQ ID NO: 632753 - RNA, 19 nt, Homo sapiens
caaauaguucucaugguua

SEQ ID NO: 632754 - RNA, 19 nt, Homo sapiens
ggaagagugugaagaugau

SEQ ID NO: 632755 - RNA, 19 nt, Homo sapiens
acaaggaccugcgacauuu

SEQ ID NO: 632756 - RNA, 19 nt, Homo sapiens
caagagcgaaggaauguuu

SEQ ID NO: 632757 - RNA, 19 nt, Homo sapiens
gaaagaaggggaucucaua

SEQ ID NO: 632758 - RNA, 19 nt, Homo sapiens
caucugagcccacuacuau

SEQ ID NO: 632759 - RNA, 19 nt, Homo sapiens
acacacacaugcucaaguu

SEQ ID NO: 632760 - RNA, 19 nt, Homo sapiens
gcggagagguguggaaaga

SEQ ID NO: 632761 - RNA, 19 nt, Homo sapiens
uaaugacacuguuucuuug

SEQ ID NO: 632762 - RNA, 19 nt, Homo sapiens
ggaugacguuccugaaaug

SEQ ID NO: 632763 - RNA, 19 nt, Homo sapiens
cuaaugacacuguuucuuu

SEQ ID NO: 632764 - RNA, 19 nt, Homo sapiens
cagcagaccauaagggaua

SEQ ID NO: 632765 - RNA, 19 nt, Homo sapiens
cagcggacguggcuucaaa

SEQ ID NO: 632766 - RNA, 19 nt, Homo sapiens
caaagucaauggcaugaag

SEQ ID NO: 632767 - RNA, 19 nt, Homo sapiens
ggaauaccaccaaaccaaa

SEQ ID NO: 632768 - RNA, 19 nt, Homo sapiens
gaagcgggaaacacaguua

SEQ ID NO: 632769 - RNA, 19 nt, Homo sapiens
gaugaggauuggugaugaa

SEQ ID NO: 632770 - RNA, 19 nt, Homo sapiens
gagguuauccauugccuuu

SEQ ID NO: 632771 - RNA, 19 nt, Homo sapiens
gggaugaaccugaugaguu

SEQ ID NO: 632772 - RNA, 19 nt, Homo sapiens
aauguccgauuccagauua

SEQ ID NO: 632773 - RNA, 19 nt, Homo sapiens
aaagacagccagaauaguu

SEQ ID NO: 632774 - RNA, 19 nt, Homo sapiens
aagcaggaaucucaauuug

SEQ ID NO: 632775 - RNA, 19 nt, Homo sapiens
gacaaggaauaccaccaaa

SEQ ID NO: 632776 - RNA, 19 nt, Homo sapiens
ccagcuagccacaguagua

SEQ ID NO: 632777 - RNA, 19 nt, Homo sapiens
uuacauagcuuaguguucu

SEQ ID NO: 632778 - RNA, 19 nt, Homo sapiens
gagggaaacaugugacuau

SEQ ID NO: 632779 - RNA, 19 nt, Homo sapiens
gggcaccugucucucguuu

SEQ ID NO: 632780 - RNA, 19 nt, Homo sapiens
gaggaggccgagaguauaa

SEQ ID NO: 632781 - RNA, 19 nt, Homo sapiens
ggacgccaguaauuggaaa

SEQ ID NO: 632782 - RNA, 19 nt, Homo sapiens
gcuggacagugaacuagaa

SEQ ID NO: 632783 - RNA, 19 nt, Homo sapiens
ggcaagagaccuaugauuc

SEQ ID NO: 632784 - RNA, 19 nt, Homo sapiens
acgaaacccuucugaguug

SEQ ID NO: 632785 - RNA, 19 nt, Homo sapiens
ggaagacacaauaugagaa

SEQ ID NO: 632786 - RNA, 19 nt, Homo sapiens
guucugaaaucucuacaca

SEQ ID NO: 632787 - RNA, 19 nt, Homo sapiens
gcuauagaacugauuaaga

SEQ ID NO: 632788 - RNA, 19 nt, Homo sapiens
gaucuuggcaguaaaugga

SEQ ID NO: 632789 - RNA, 19 nt, Homo sapiens
ggagcgaggcugccaaguu

SEQ ID NO: 632790 - RNA, 19 nt, Homo sapiens
ggcccaagcuccagaucaa

SEQ ID NO: 632791 - RNA, 19 nt, Homo sapiens
gaucucauaguggaaguua

SEQ ID NO: 632792 - RNA, 19 nt, Homo sapiens
gggaugugauuguaagugu

SEQ ID NO: 632793 - RNA, 19 nt, Homo sapiens
caacaggaagacacaauau

SEQ ID NO: 632794 - RNA, 19 nt, Homo sapiens
ccuaugaaggaaacuauua

SEQ ID NO: 632795 - RNA, 19 nt, Homo sapiens
ggaaacaugugacuauacc

SEQ ID NO: 632796 - RNA, 19 nt, Homo sapiens
ccaaagagugaaacagauu

SEQ ID NO: 632797 - RNA, 19 nt, Homo sapiens
acauagaguuccuuuguca

SEQ ID NO: 632798 - RNA, 19 nt, Homo sapiens
cagagaagauugccaccau

SEQ ID NO: 632799 - RNA, 19 nt, Homo sapiens
caaggaagcgggaaacaca

SEQ ID NO: 632800 - RNA, 19 nt, Homo sapiens
ucucagaaguucccucaau

SEQ ID NO: 632801 - RNA, 19 nt, Homo sapiens
gagcacacucuccaagaaa

SEQ ID NO: 632802 - RNA, 19 nt, Homo sapiens
ggaagucggcaccuaugaa

SEQ ID NO: 632803 - RNA, 19 nt, Homo sapiens
guagacagcaaugaucuuu

SEQ ID NO: 632804 - RNA, 19 nt, Homo sapiens
ccuauucaccagugucuua

SEQ ID NO: 632805 - RNA, 19 nt, Homo sapiens
caaagcaggaaucucaauu

SEQ ID NO: 632806 - RNA, 19 nt, Homo sapiens
gaagcaggcacgaccuuug

SEQ ID NO: 632807 - RNA, 19 nt, Homo sapiens
gggaaccuauuuauauugg

SEQ ID NO: 632808 - RNA, 19 nt, Homo sapiens
gaauaguucucagcacagu

SEQ ID NO: 632809 - RNA, 19 nt, Homo sapiens
cucagaaguucccucaaua

SEQ ID NO: 632810 - RNA, 19 nt, Homo sapiens
agacagcaaugaucuuuac

SEQ ID NO: 632811 - RNA, 19 nt, Homo sapiens
ggaugggacgccaguaauu

SEQ ID NO: 632812 - RNA, 19 nt, Homo sapiens
ccugaggucuggagaugaa

SEQ ID NO: 632813 - RNA, 19 nt, Homo sapiens
cgaaccaaguccuacaaug

SEQ ID NO: 632814 - RNA, 19 nt, Homo sapiens
aaagccagguuauacauag

SEQ ID NO: 632815 - RNA, 19 nt, Homo sapiens
ccacuacuaucaaacaaac

SEQ ID NO: 632816 - RNA, 19 nt, Homo sapiens
aaguuucucucuccuguuu

SEQ ID NO: 632817 - RNA, 19 nt, Homo sapiens
gaggucuggagaugaauua

SEQ ID NO: 632818 - RNA, 19 nt, Homo sapiens
uuauauuggucacaucgua

SEQ ID NO: 632819 - RNA, 19 nt, Homo sapiens
gcaaagugcuuacugugua

SEQ ID NO: 632820 - RNA, 19 nt, Homo sapiens
gauuggaacugacauaauu

SEQ ID NO: 632821 - RNA, 19 nt, Homo sapiens
guaaauggauauaggauug

SEQ ID NO: 632822 - RNA, 19 nt, Homo sapiens
uaugagaacuaccguguua

SEQ ID NO: 632823 - RNA, 19 nt, Homo sapiens
gaaguuauguggguauuug

SEQ ID NO: 632824 - RNA, 19 nt, Homo sapiens
gaacugacauaauuagucu

SEQ ID NO: 632825 - RNA, 19 nt, Homo sapiens
aaagaaggaugccacagua

SEQ ID NO: 632826 - RNA, 19 nt, Homo sapiens
guucuugauugccuuauua

SEQ ID NO: 632827 - RNA, 19 nt, Homo sapiens
gcaaaugaccagaaauuau

SEQ ID NO: 632828 - RNA, 19 nt, Homo sapiens
ggauauaggauugaaguua

SEQ ID NO: 632829 - RNA, 19 nt, Homo sapiens
gaccuauucuaaccacuua

SEQ ID NO: 632830 - RNA, 19 nt, Homo sapiens
cuaaaucuguguucaaaga

SEQ ID NO: 632831 - RNA, 19 nt, Homo sapiens
caaggacguucuuaagauu

SEQ ID NO: 632832 - RNA, 19 nt, Homo sapiens
guacgggcuugguaucaua

SEQ ID NO: 632833 - RNA, 19 nt, Homo sapiens
gaaggaugccacaguagua

SEQ ID NO: 632834 - RNA, 19 nt, Homo sapiens
gagcaucaaucaauauaag

SEQ ID NO: 632835 - RNA, 19 nt, Homo sapiens
ggacccaccugacccacua

SEQ ID NO: 632836 - RNA, 19 nt, Homo sapiens
gaaacuaaaucuguguuca

SEQ ID NO: 632837 - RNA, 19 nt, Homo sapiens
ccaaggacguucuuaagau

SEQ ID NO: 632838 - RNA, 19 nt, Homo sapiens
ugaagcaaaugaccagaaa

SEQ ID NO: 632839 - RNA, 19 nt, Homo sapiens
gcagaauucagcaauauga

SEQ ID NO: 632840 - RNA, 19 nt, Homo sapiens
gcaacaccauagaauauag

SEQ ID NO: 632841 - RNA, 19 nt, Homo sapiens
guagaacccaagcaaauaa

SEQ ID NO: 632842 - RNA, 19 nt, Homo sapiens
cagcuagacuugcauuuca

SEQ ID NO: 632843 - RNA, 19 nt, Homo sapiens
gagcuaacauccuggucaa

SEQ ID NO: 632844 - RNA, 19 nt, Homo sapiens
ucugagagguaaauggaua

SEQ ID NO: 632845 - RNA, 19 nt, Homo sapiens
gcacuauaguaucacuuga

SEQ ID NO: 632846 - RNA, 19 nt, Homo sapiens
gaagauuggaagcuuauau

SEQ ID NO: 632847 - RNA, 19 nt, Homo sapiens
gguguucucuggaccuauu

SEQ ID NO: 632848 - RNA, 19 nt, Homo sapiens
guacuguucggcugaauuu

SEQ ID NO: 632849 - RNA, 19 nt, Homo sapiens
gacaggguguggcagaauu

SEQ ID NO: 632850 - RNA, 19 nt, Homo sapiens
cacaacaaacucaguauuu

SEQ ID NO: 632851 - RNA, 19 nt, Homo sapiens
ccagucauguaaauugauu

SEQ ID NO: 632852 - RNA, 19 nt, Homo sapiens
gauuuggcuuuacuuacua

SEQ ID NO: 632853 - RNA, 19 nt, Homo sapiens
gaauucagcaauaugagaa

SEQ ID NO: 632854 - RNA, 19 nt, Homo sapiens
gagacugugaagauaauua

SEQ ID NO: 632855 - RNA, 19 nt, Homo sapiens
gaaggagauucgauuucug

SEQ ID NO: 632856 - RNA, 19 nt, Homo sapiens
ggaagccuggaauucauua

SEQ ID NO: 632857 - RNA, 19 nt, Homo sapiens
gccacaagcagauuaauug

SEQ ID NO: 632858 - RNA, 19 nt, Homo sapiens
gauagccacaagcagauua

SEQ ID NO: 632859 - RNA, 19 nt, Homo sapiens
gaacaacugcgagcacuuc

SEQ ID NO: 632860 - RNA, 19 nt, Homo sapiens
ccaugugugugugaaauaa

SEQ ID NO: 632861 - RNA, 19 nt, Homo sapiens
gauuggaagcuuauauuga

SEQ ID NO: 632862 - RNA, 19 nt, Homo sapiens
gaagaccccucauuaaaag

SEQ ID NO: 632863 - RNA, 19 nt, Homo sapiens
guacuuuaaugaugaagca

SEQ ID NO: 632864 - RNA, 19 nt, Homo sapiens
cggcugaauuugaagauug

SEQ ID NO: 632865 - RNA, 19 nt, Homo sapiens
acaaagggaggaacaguuu

SEQ ID NO: 632866 - RNA, 19 nt, Homo sapiens
gguggugucuuuacuacug

SEQ ID NO: 632867 - RNA, 19 nt, Homo sapiens
ugaaggagauucgauuucu

SEQ ID NO: 632868 - RNA, 19 nt, Homo sapiens
acaccagacugagagauaa

SEQ ID NO: 632869 - RNA, 19 nt, Homo sapiens
ggagguggugucuuuacua

SEQ ID NO: 632870 - RNA, 19 nt, Homo sapiens
agacuugcauuucagguau

SEQ ID NO: 632871 - RNA, 19 nt, Homo sapiens
gaaaccagccccuaaaaug

SEQ ID NO: 632872 - RNA, 19 nt, Homo sapiens
ucaggcaguucagauuuaa

SEQ ID NO: 632873 - RNA, 19 nt, Homo sapiens
aagcaaaugaccagaaauu

SEQ ID NO: 632874 - RNA, 19 nt, Homo sapiens
ggcaaauaguacuuuaaug

SEQ ID NO: 632875 - RNA, 19 nt, Homo sapiens
guggcagaauucagcaaua

SEQ ID NO: 632876 - RNA, 19 nt, Homo sapiens
acacuacccuuccugcaau

SEQ ID NO: 632877 - RNA, 19 nt, Homo sapiens
ggaacugacauaauuaguc

SEQ ID NO: 632878 - RNA, 19 nt, Homo sapiens
aaaccacugucugaaacua

SEQ ID NO: 632879 - RNA, 19 nt, Homo sapiens
agccuggaauucauuauuu

SEQ ID NO: 632880 - RNA, 19 nt, Homo sapiens
cucaggcaguucagauuua

SEQ ID NO: 632881 - RNA, 19 nt, Homo sapiens
gagguggugucuuuacuac

SEQ ID NO: 632882 - RNA, 19 nt, Homo sapiens
gugagacugugaagauaau

SEQ ID NO: 632883 - RNA, 19 nt, Homo sapiens
ugacuuacuucauuaaagc

SEQ ID NO: 632884 - RNA, 19 nt, Homo sapiens
uaagauuggaacugacaua

SEQ ID NO: 632885 - RNA, 19 nt, Homo sapiens
gccaaggacguucuuaaga

SEQ ID NO: 632886 - RNA, 19 nt, Homo sapiens
ggcaacaccauagaauaua

SEQ ID NO: 632887 - RNA, 19 nt, Homo sapiens
uuaaaagccuucagauuug

SEQ ID NO: 632888 - RNA, 19 nt, Homo sapiens
cuguagaggugaauguaaa

SEQ ID NO: 632889 - RNA, 19 nt, Homo sapiens
uauuauccauccauaccua

SEQ ID NO: 632890 - RNA, 19 nt, Homo sapiens
gcgagcacuucgugaccua

SEQ ID NO: 632891 - RNA, 19 nt, Homo sapiens
cuaacauccuggucaauca

SEQ ID NO: 632892 - RNA, 19 nt, Homo sapiens
ccacaacaaacucaguauu

SEQ ID NO: 632893 - RNA, 19 nt, Homo sapiens
caaguagaacccaagcaaa

SEQ ID NO: 632894 - RNA, 19 nt, Homo sapiens
guagauagucacauauaca

SEQ ID NO: 632895 - RNA, 19 nt, Homo sapiens
gucauuaugugaaaccaau

SEQ ID NO: 632896 - RNA, 19 nt, Homo sapiens
uggcagaauucagcaauau

SEQ ID NO: 632897 - RNA, 19 nt, Homo sapiens
ggauuggcgucuauagucu

SEQ ID NO: 632898 - RNA, 19 nt, Homo sapiens
agaagguggucuccaacaa

SEQ ID NO: 632899 - RNA, 19 nt, Homo sapiens
caacuucacgcucuuuagu

SEQ ID NO: 632900 - RNA, 19 nt, Homo sapiens
ccacuaauuugcccacaac

SEQ ID NO: 632901 - RNA, 19 nt, Homo sapiens
gacaaagggaggaacaguu

SEQ ID NO: 632902 - RNA, 19 nt, Homo sapiens
ugauuuggcuuuacuuacu

SEQ ID NO: 632903 - RNA, 19 nt, Homo sapiens
gaaucacgcaaagugcuua

SEQ ID NO: 632904 - RNA, 19 nt, Homo sapiens
gaagguggucuccaacaag

SEQ ID NO: 632905 - RNA, 19 nt, Homo sapiens
aggaauaguugaaggagau

SEQ ID NO: 632906 - RNA, 19 nt, Homo sapiens
ggaccuauucuaaccacuu

SEQ ID NO: 632907 - RNA, 19 nt, Homo sapiens
gguaaauggauauaggauu

SEQ ID NO: 632908 - RNA, 19 nt, Homo sapiens
gucuugacuuacuucauua

SEQ ID NO: 632909 - RNA, 19 nt, Homo sapiens
gaagccacagcuagacuug

SEQ ID NO: 632910 - RNA, 19 nt, Homo sapiens
uuugaagauuggaagcuua

SEQ ID NO: 632911 - RNA, 19 nt, Homo sapiens
uauauuacccuuguaggaa

SEQ ID NO: 632912 - RNA, 19 nt, Homo sapiens
guauauuacccuuguagga

SEQ ID NO: 632913 - RNA, 19 nt, Homo sapiens
gcaaccacuaugagaacua

SEQ ID NO: 632914 - RNA, 19 nt, Homo sapiens
uaggugugguccauuaaug

SEQ ID NO: 632915 - RNA, 19 nt, Homo sapiens
uggcuuuacuuacuaggaa

SEQ ID NO: 632916 - RNA, 19 nt, Homo sapiens
uguguaagcccaagaacaa

SEQ ID NO: 632917 - RNA, 19 nt, Homo sapiens
uggcaacaccauagaauau

SEQ ID NO: 632918 - RNA, 19 nt, Homo sapiens
cacuguggcuacuuuaaau

SEQ ID NO: 632919 - RNA, 19 nt, Homo sapiens
gcaaagagauggagagaga

SEQ ID NO: 632920 - RNA, 19 nt, Homo sapiens
gaaaucauaucgaguguga

SEQ ID NO: 632921 - RNA, 19 nt, Homo sapiens
gaacgacucuaauuaauag

SEQ ID NO: 632922 - RNA, 19 nt, Homo sapiens
ggagugaauucucguguua

SEQ ID NO: 632923 - RNA, 19 nt, Homo sapiens
gaaaugaggagauaaacua

SEQ ID NO: 632924 - RNA, 19 nt, Homo sapiens
gaggagaggugauaaugaa

SEQ ID NO: 632925 - RNA, 19 nt, Homo sapiens
gaaacacgcuucuccaaca

SEQ ID NO: 632926 - RNA, 19 nt, Homo sapiens
ggacugcgauuuaagaugu

SEQ ID NO: 632927 - RNA, 19 nt, Homo sapiens
aaagguaaauggucagaua

SEQ ID NO: 632928 - RNA, 19 nt, Homo sapiens
gauaagccauguuucugua

SEQ ID NO: 632929 - RNA, 19 nt, Homo sapiens
gcacagguucugauuauuu

SEQ ID NO: 632930 - RNA, 19 nt, Homo sapiens
ggacaaaggccuucaguuc

SEQ ID NO: 632931 - RNA, 19 nt, Homo sapiens
ugaaggcugugguuaauaa

SEQ ID NO: 632932 - RNA, 19 nt, Homo sapiens
gaacacggcugaaaauuau

SEQ ID NO: 632933 - RNA, 19 nt, Homo sapiens
ggaacgacucuaauuaaua

SEQ ID NO: 632934 - RNA, 19 nt, Homo sapiens
ggaaagaaaggaagaaaga

SEQ ID NO: 632935 - RNA, 19 nt, Homo sapiens
ggaaauguaauguggauaa

SEQ ID NO: 632936 - RNA, 19 nt, Homo sapiens
uuaaaugccuccuauagaa

SEQ ID NO: 632937 - RNA, 19 nt, Homo sapiens
ggaaaagccuguccgauuu

SEQ ID NO: 632938 - RNA, 19 nt, Homo sapiens
gaacaaggagucacagcua

SEQ ID NO: 632939 - RNA, 19 nt, Homo sapiens
ccucaugucugguauauau

SEQ ID NO: 632940 - RNA, 19 nt, Homo sapiens
gaagugggaguuacauuaa

SEQ ID NO: 632941 - RNA, 19 nt, Homo sapiens
gaggauuaaugacauauug

SEQ ID NO: 632942 - RNA, 19 nt, Homo sapiens
cauguagguugauuucuua

SEQ ID NO: 632943 - RNA, 19 nt, Homo sapiens
uuaauaggcuuucugugua

SEQ ID NO: 632944 - RNA, 19 nt, Homo sapiens
gcauguagguugauuucuu

SEQ ID NO: 632945 - RNA, 19 nt, Homo sapiens
gaacucugcuguuuagaag

SEQ ID NO: 632946 - RNA, 19 nt, Homo sapiens
gaaugugagugguaaguau

SEQ ID NO: 632947 - RNA, 19 nt, Homo sapiens
gagauucccugcaggagaa

SEQ ID NO: 632948 - RNA, 19 nt, Homo sapiens
ggaaaggguuugcuucuac

SEQ ID NO: 632949 - RNA, 19 nt, Homo sapiens
guggccagguuuauuauua

SEQ ID NO: 632950 - RNA, 19 nt, Homo sapiens
gagaggugauaaugaauga

SEQ ID NO: 632951 - RNA, 19 nt, Homo sapiens
gagcauauguccuugucuu

SEQ ID NO: 632952 - RNA, 19 nt, Homo sapiens
gaauguaucuccuugaaaa

SEQ ID NO: 632953 - RNA, 19 nt, Homo sapiens
gaacccagcuuacauuuug

SEQ ID NO: 632954 - RNA, 19 nt, Homo sapiens
gcagaagaaauguucguua

SEQ ID NO: 632955 - RNA, 19 nt, Homo sapiens
uaaacaaagugcuaaagga

SEQ ID NO: 632956 - RNA, 19 nt, Homo sapiens
uaacuaaacuccacauggu

SEQ ID NO: 632957 - RNA, 19 nt, Homo sapiens
caaacucagugaccuacua

SEQ ID NO: 632958 - RNA, 19 nt, Homo sapiens
ggaggaaauucucgguaaa

SEQ ID NO: 632959 - RNA, 19 nt, Homo sapiens
gcagcugucucauauacaa

SEQ ID NO: 632960 - RNA, 19 nt, Homo sapiens
ggaagccacucacgcauuc

SEQ ID NO: 632961 - RNA, 19 nt, Homo sapiens
cuuaacagaugacuucuuu

SEQ ID NO: 632962 - RNA, 19 nt, Homo sapiens
guaaacacuuaacagauga

SEQ ID NO: 632963 - RNA, 19 nt, Homo sapiens
ggaaacaucaggaacgaaa

SEQ ID NO: 632964 - RNA, 19 nt, Homo sapiens
guuuggaaaugcagaaaua

SEQ ID NO: 632965 - RNA, 19 nt, Homo sapiens
gauuugcacuuuacaaugu

SEQ ID NO: 632966 - RNA, 19 nt, Homo sapiens
gugcacagguucugauuau

SEQ ID NO: 632967 - RNA, 19 nt, Homo sapiens
gaaaguggccagguuuauu

SEQ ID NO: 632968 - RNA, 19 nt, Homo sapiens
gggaacagguggugaaagu

SEQ ID NO: 632969 - RNA, 19 nt, Homo sapiens
gaaugcugcuugucaccua

SEQ ID NO: 632970 - RNA, 19 nt, Homo sapiens
gaccauuucgucauauuua

SEQ ID NO: 632971 - RNA, 19 nt, Homo sapiens
gaagauaagccauguuucu

SEQ ID NO: 632972 - RNA, 19 nt, Homo sapiens
gcagauuaaccuaccaaua

SEQ ID NO: 632973 - RNA, 19 nt, Homo sapiens
cagaauagcuuucgaugac

SEQ ID NO: 632974 - RNA, 19 nt, Homo sapiens
ggagaucaaugggcaauuc

SEQ ID NO: 632975 - RNA, 19 nt, Homo sapiens
gaccuaggcuacuuucgaa

SEQ ID NO: 632976 - RNA, 19 nt, Homo sapiens
aaaguggccagguuuauua

SEQ ID NO: 632977 - RNA, 19 nt, Homo sapiens
ccacgacaauuucuuacuu

SEQ ID NO: 632978 - RNA, 19 nt, Homo sapiens
ucaaagggcucagcacgaa

SEQ ID NO: 632979 - RNA, 19 nt, Homo sapiens
gcacuucgcacuugagaga

SEQ ID NO: 632980 - RNA, 19 nt, Homo sapiens
uagaugaaaugaggagaua

SEQ ID NO: 632981 - RNA, 19 nt, Homo sapiens
ucaaucgccucuuagauga

SEQ ID NO: 632982 - RNA, 19 nt, Homo sapiens
ggaaaugcagaaauaacua

SEQ ID NO: 632983 - RNA, 19 nt, Homo sapiens
gcaauauacucaguucuca

SEQ ID NO: 632984 - RNA, 19 nt, Homo sapiens
guagguugauuucuuaugu

SEQ ID NO: 632985 - RNA, 19 nt, Homo sapiens
gagcagagugccaaauauu

SEQ ID NO: 632986 - RNA, 19 nt, Homo sapiens
ggugaacucugcuguuuag

SEQ ID NO: 632987 - RNA, 19 nt, Homo sapiens
guuaagaauucccuguaaa

SEQ ID NO: 632988 - RNA, 19 nt, Homo sapiens
ggacauuuauuaagguuac

SEQ ID NO: 632989 - RNA, 19 nt, Homo sapiens
gcaguuaaggauugcuuua

SEQ ID NO: 632990 - RNA, 19 nt, Homo sapiens
caggauaccuaaucugaau

SEQ ID NO: 632991 - RNA, 19 nt, Homo sapiens
uuaccucccuacuuucuua

SEQ ID NO: 632992 - RNA, 19 nt, Homo sapiens
uguaaacacuuaacagaug

SEQ ID NO: 632993 - RNA, 19 nt, Homo sapiens
gaugaccccuuucugauua

SEQ ID NO: 632994 - RNA, 19 nt, Homo sapiens
acaggaaagugaagggaua

SEQ ID NO: 632995 - RNA, 19 nt, Homo sapiens
gcacuuaauggaaagguaa

SEQ ID NO: 632996 - RNA, 19 nt, Homo sapiens
ugacacgacuucuguuuca

SEQ ID NO: 632997 - RNA, 19 nt, Homo sapiens
ccacgcagcacuucaauga

SEQ ID NO: 632998 - RNA, 19 nt, Homo sapiens
gaugaaaugaggagauaaa

SEQ ID NO: 632999 - RNA, 19 nt, Homo sapiens
ggaaagguuuggaaaugca

SEQ ID NO: 633000 - RNA, 19 nt, Homo sapiens
gaaaggguuugcuucuaca

SEQ ID NO: 633001 - RNA, 19 nt, Homo sapiens
ggauggaauuucacaggaa

SEQ ID NO: 633002 - RNA, 19 nt, Homo sapiens
caggugaacucugcuguuu

SEQ ID NO: 633003 - RNA, 19 nt, Homo sapiens
gacaucaccuccaccauca

SEQ ID NO: 633004 - RNA, 19 nt, Homo sapiens
ucacuggaauucaacuauu

SEQ ID NO: 633005 - RNA, 19 nt, Homo sapiens
gaacagguggugaaagugu

SEQ ID NO: 633006 - RNA, 19 nt, Homo sapiens
ggaaaugaaggagauauug

SEQ ID NO: 633007 - RNA, 19 nt, Homo sapiens
gaacggauaccugcugcua

SEQ ID NO: 633008 - RNA, 19 nt, Homo sapiens
gcaugucuguuuacacuuc

SEQ ID NO: 633009 - RNA, 19 nt, Homo sapiens
ggucuuccuucccggcuua

SEQ ID NO: 633010 - RNA, 19 nt, Homo sapiens
cggaggaaauucucgguaa

SEQ ID NO: 633011 - RNA, 19 nt, Homo sapiens
gaaggcuggugcaaagaga

SEQ ID NO: 633012 - RNA, 19 nt, Homo sapiens
ucagugaaguugaaucuca

SEQ ID NO: 633013 - RNA, 19 nt, Homo sapiens
gaagaaauguucguuaccu

SEQ ID NO: 633014 - RNA, 19 nt, Homo sapiens
cagaagauaagccauguuu

SEQ ID NO: 633015 - RNA, 19 nt, Homo sapiens
gcgaguccgucuucaguga

SEQ ID NO: 633016 - RNA, 19 nt, Homo sapiens
cuccuuagcuucuggcuuu

SEQ ID NO: 633017 - RNA, 19 nt, Homo sapiens
gaaagaaaggaagaaagaa

SEQ ID NO: 633018 - RNA, 19 nt, Homo sapiens
agaagugggaguuacauua

SEQ ID NO: 633019 - RNA, 19 nt, Homo sapiens
gaaauuccaugccgaagaa

SEQ ID NO: 633020 - RNA, 19 nt, Homo sapiens
ggaagaaggaccacuuuaa

SEQ ID NO: 633021 - RNA, 19 nt, Homo sapiens
caucuugcauuacaacaua

SEQ ID NO: 633022 - RNA, 19 nt, Homo sapiens
gaacuaccacgaaaccuuu

SEQ ID NO: 633023 - RNA, 19 nt, Homo sapiens
gagaauaaagcacccagua

SEQ ID NO: 633024 - RNA, 19 nt, Homo sapiens
gaaggaccacuuuaagaaa

SEQ ID NO: 633025 - RNA, 19 nt, Homo sapiens
gcagcacggugucaucuug

SEQ ID NO: 633026 - RNA, 19 nt, Homo sapiens
gaagaaaaccugaauccua

SEQ ID NO: 633027 - RNA, 19 nt, Homo sapiens
gaagaaggaccacuuuaag

SEQ ID NO: 633028 - RNA, 19 nt, Homo sapiens
ucagagaacugugugaaga

SEQ ID NO: 633029 - RNA, 19 nt, Homo sapiens
ccgaagacauucuaggaaa

SEQ ID NO: 633030 - RNA, 19 nt, Homo sapiens
ggacuuccaugauaaucug

SEQ ID NO: 633031 - RNA, 19 nt, Homo sapiens
caaccuggauggugacaug

SEQ ID NO: 633032 - RNA, 19 nt, Homo sapiens
gcaauaacacugccacugu

SEQ ID NO: 633033 - RNA, 19 nt, Homo sapiens
gagauccaacccuuuauuu

SEQ ID NO: 633034 - RNA, 19 nt, Homo sapiens
gaauaaagcacccaguaag

SEQ ID NO: 633035 - RNA, 19 nt, Homo sapiens
gcaaguagaagaagagaag

SEQ ID NO: 633036 - RNA, 19 nt, Homo sapiens
gaaauucuaccaguucaga

SEQ ID NO: 633037 - RNA, 19 nt, Homo sapiens
guguagaagugaugccuuu

SEQ ID NO: 633038 - RNA, 19 nt, Homo sapiens
uuacagaacucaccacacu

SEQ ID NO: 633039 - RNA, 19 nt, Homo sapiens
ggugucaucuugcauuaca

SEQ ID NO: 633040 - RNA, 19 nt, Homo sapiens
aagaaaaccugaauccuaa

SEQ ID NO: 633041 - RNA, 19 nt, Homo sapiens
caaccugcccgaagacauu

SEQ ID NO: 633042 - RNA, 19 nt, Homo sapiens
gguggaugaugcugaagaa

SEQ ID NO: 633043 - RNA, 19 nt, Homo sapiens
agaaggaccacuuuaagaa

SEQ ID NO: 633044 - RNA, 19 nt, Homo sapiens
gucaacacaugggcaauaa

SEQ ID NO: 633045 - RNA, 19 nt, Homo sapiens
ugaagacaguggagacuca

SEQ ID NO: 633046 - RNA, 19 nt, Homo sapiens
ugagugaagucuccaucaa

SEQ ID NO: 633047 - RNA, 19 nt, Homo sapiens
ggauugacucuaucacuga

SEQ ID NO: 633048 - RNA, 19 nt, Homo sapiens
caacacaugggcaauaaca

SEQ ID NO: 633049 - RNA, 19 nt, Homo sapiens
ccgagagccuggacaguau

SEQ ID NO: 633050 - RNA, 19 nt, Homo sapiens
ggccagcgaggagauauua

SEQ ID NO: 633051 - RNA, 19 nt, Homo sapiens
gauugacucuaucacugaa

SEQ ID NO: 633052 - RNA, 19 nt, Homo sapiens
gccagcaccuccacaguca

SEQ ID NO: 633053 - RNA, 19 nt, Homo sapiens
agaauaaagcacccaguaa

SEQ ID NO: 633054 - RNA, 19 nt, Homo sapiens
ugaagaaccugacaaaaca

SEQ ID NO: 633055 - RNA, 19 nt, Homo sapiens
ugagcgagauggaagugaa

SEQ ID NO: 633056 - RNA, 19 nt, Homo sapiens
gcucacaucaccaaaguuc

SEQ ID NO: 633057 - RNA, 19 nt, Homo sapiens
guccuaagccuucuccaaa

SEQ ID NO: 633058 - RNA, 19 nt, Homo sapiens
caaacccaccuguguagaa

SEQ ID NO: 633059 - RNA, 19 nt, Homo sapiens
ccgcagaccacccauacua

SEQ ID NO: 633060 - RNA, 19 nt, Homo sapiens
aaacagauggauccucuug

SEQ ID NO: 633061 - RNA, 19 nt, Homo sapiens
agagaacugugugaagaaa

SEQ ID NO: 633062 - RNA, 19 nt, Homo sapiens
uaaagcacccaguaaguuc

SEQ ID NO: 633063 - RNA, 19 nt, Homo sapiens
gcuaucacacccugcagua

SEQ ID NO: 633064 - RNA, 19 nt, Homo sapiens
gaacucaccacacucaaaa

SEQ ID NO: 633065 - RNA, 19 nt, Homo sapiens
ccacuucccguacccguuu

SEQ ID NO: 633066 - RNA, 19 nt, Homo sapiens
caaugaacacucacccaaa

SEQ ID NO: 633067 - RNA, 19 nt, Homo sapiens
gaaugcggaguggcaguua

SEQ ID NO: 633068 - RNA, 19 nt, Homo sapiens
gagguaaagaugaugaaau

SEQ ID NO: 633069 - RNA, 19 nt, Homo sapiens
gcaacaacgacgucaagug

SEQ ID NO: 633070 - RNA, 19 nt, Homo sapiens
gcuacucagccaucccuua

SEQ ID NO: 633071 - RNA, 19 nt, Homo sapiens
ccgagagcaucgagaucua

SEQ ID NO: 633072 - RNA, 19 nt, Homo sapiens
agacccaccucccaggauu

SEQ ID NO: 633073 - RNA, 19 nt, Homo sapiens
acagguggaugaugcugaa

SEQ ID NO: 633074 - RNA, 19 nt, Homo sapiens
acugagauccaacccuuua

SEQ ID NO: 633075 - RNA, 19 nt, Homo sapiens
gagugcaaguagaagaaga

SEQ ID NO: 633076 - RNA, 19 nt, Homo sapiens
gcacuacaccucgcagcaa

SEQ ID NO: 633077 - RNA, 19 nt, Homo sapiens
cagaaggccucggugaaca

SEQ ID NO: 633078 - RNA, 19 nt, Homo sapiens
gagcaacaacgacgucaag

SEQ ID NO: 633079 - RNA, 19 nt, Homo sapiens
aagaaggaccacuuuaaga

SEQ ID NO: 633080 - RNA, 19 nt, Homo sapiens
gaguggcaguuauaucaag

SEQ ID NO: 633081 - RNA, 19 nt, Homo sapiens
gcagaccacccauacuaca

SEQ ID NO: 633082 - RNA, 19 nt, Homo sapiens
ggaugaugcugaagaaccu

SEQ ID NO: 633083 - RNA, 19 nt, Homo sapiens
acccagaacuaccacgaaa

SEQ ID NO: 633084 - RNA, 19 nt, Homo sapiens
cggaguggcaguuauauca

SEQ ID NO: 633085 - RNA, 19 nt, Homo sapiens
gagcaucgagaucuacauc

SEQ ID NO: 633086 - RNA, 19 nt, Homo sapiens
ccacggaggacaggaagaa

SEQ ID NO: 633087 - RNA, 19 nt, Homo sapiens
gauccggagucauaguuac

SEQ ID NO: 633088 - RNA, 19 nt, Homo sapiens
gcagguuccacaagaugaa

SEQ ID NO: 633089 - RNA, 19 nt, Homo sapiens
cccgggagguuuaccagaa

SEQ ID NO: 633090 - RNA, 19 nt, Homo sapiens
cugcaguuguccauagaaa

SEQ ID NO: 633091 - RNA, 19 nt, Homo sapiens
aaaacaaccugcccgaaga

SEQ ID NO: 633092 - RNA, 19 nt, Homo sapiens
gcauucagggcucaggaaa

SEQ ID NO: 633093 - RNA, 19 nt, Homo sapiens
gcaaacgcagcaagagcaa

SEQ ID NO: 633094 - RNA, 19 nt, Homo sapiens
guaaagaugaugaaauucc

SEQ ID NO: 633095 - RNA, 19 nt, Homo sapiens
ugagauccaacccuuuauu

SEQ ID NO: 633096 - RNA, 19 nt, Homo sapiens
caguuaaaggccaauaauu

SEQ ID NO: 633097 - RNA, 19 nt, Homo sapiens
ucucauggcccagaaauuc

SEQ ID NO: 633098 - RNA, 19 nt, Homo sapiens
gggagugcaaguagaagaa

SEQ ID NO: 633099 - RNA, 19 nt, Homo sapiens
caggaagaaggaccacuuu

SEQ ID NO: 633100 - RNA, 19 nt, Homo sapiens
acggugucaucuugcauua

SEQ ID NO: 633101 - RNA, 19 nt, Homo sapiens
ggaguggcaguuauaucaa

SEQ ID NO: 633102 - RNA, 19 nt, Homo sapiens
ugaaauuccaugccgaaga

SEQ ID NO: 633103 - RNA, 19 nt, Homo sapiens
guagaagugaugccuuuag

SEQ ID NO: 633104 - RNA, 19 nt, Homo sapiens
gcccgaagacauucuagga

SEQ ID NO: 633105 - RNA, 19 nt, Homo sapiens
uagaagugaugccuuuagg

SEQ ID NO: 633106 - RNA, 19 nt, Homo sapiens
cagagaacugugugaagaa

SEQ ID NO: 633107 - RNA, 19 nt, Homo sapiens
cgaagacauucuaggaaaa

SEQ ID NO: 633108 - RNA, 19 nt, Homo sapiens
auaaagcacccaguaaguu

SEQ ID NO: 633109 - RNA, 19 nt, Homo sapiens
aaugaacacucacccaaac

SEQ ID NO: 633110 - RNA, 19 nt, Homo sapiens
uggaaucuauagaggacaa

SEQ ID NO: 633111 - RNA, 19 nt, Homo sapiens
aaacccaccuguguagaag

SEQ ID NO: 633112 - RNA, 19 nt, Homo sapiens
gauccaacccuuuauuuuc

SEQ ID NO: 633113 - RNA, 19 nt, Homo sapiens
acagauggauccucuugac

SEQ ID NO: 633114 - RNA, 19 nt, Homo sapiens
ucaguuaaaggccaauaau

SEQ ID NO: 633115 - RNA, 19 nt, Homo sapiens
aaucuccaaugaacacuca

SEQ ID NO: 633116 - RNA, 19 nt, Homo sapiens
cgagucgugucagcaagaa

SEQ ID NO: 633117 - RNA, 19 nt, Homo sapiens
ucugacagccgccaucgaa

SEQ ID NO: 633118 - RNA, 19 nt, Homo sapiens
aggaagaaggaccacuuua

SEQ ID NO: 633119 - RNA, 19 nt, Homo sapiens
ccaagcaccugaccuauga

SEQ ID NO: 633120 - RNA, 19 nt, Homo sapiens
ucaagaacauccucacaga

SEQ ID NO: 633121 - RNA, 19 nt, Homo sapiens
gaggaagcauucaagaaca

SEQ ID NO: 633122 - RNA, 19 nt, Homo sapiens
guacgacuaccuauucaaa

SEQ ID NO: 633123 - RNA, 19 nt, Homo sapiens
uaacguagaggaagcauuc

SEQ ID NO: 633124 - RNA, 19 nt, Homo sapiens
ggaacaacgugguggacau

SEQ ID NO: 633125 - RNA, 19 nt, Homo sapiens
cgaguacgacuaccuauuc

SEQ ID NO: 633126 - RNA, 19 nt, Homo sapiens
gaguacgacuaccuauuca

SEQ ID NO: 633127 - RNA, 19 nt, Homo sapiens
gaacauccucacagagauc

SEQ ID NO: 633128 - RNA, 19 nt, Homo sapiens
gacagaagcccaacaagcu

SEQ ID NO: 633129 - RNA, 19 nt, Homo sapiens
cgacgaguacgacuaccua

SEQ ID NO: 633130 - RNA, 19 nt, Homo sapiens
aagaacauccucacagaga

SEQ ID NO: 633131 - RNA, 19 nt, Homo sapiens
ggacgacgaguacgacuac

SEQ ID NO: 633132 - RNA, 19 nt, Homo sapiens
guagaggaagcauucaaga

SEQ ID NO: 633133 - RNA, 19 nt, Homo sapiens
gaacaacgugguggacauc

SEQ ID NO: 633134 - RNA, 19 nt, Homo sapiens
ggauuccacuaacguagag

SEQ ID NO: 633135 - RNA, 19 nt, Homo sapiens
uagaggaagcauucaagaa

SEQ ID NO: 633136 - RNA, 19 nt, Homo sapiens
gcaccugaccuaugagaac

SEQ ID NO: 633137 - RNA, 19 nt, Homo sapiens
gccaagcaccugaccuaug

SEQ ID NO: 633138 - RNA, 19 nt, Homo sapiens
gaucuaccgcaucguguca

SEQ ID NO: 633139 - RNA, 19 nt, Homo sapiens
acgacuaccuauucaaagu

SEQ ID NO: 633140 - RNA, 19 nt, Homo sapiens
cagcaacaucgucaucaug

SEQ ID NO: 633141 - RNA, 19 nt, Homo sapiens
agaacauccucacagagau

SEQ ID NO: 633142 - RNA, 19 nt, Homo sapiens
ccgcaucgugucacagaaa

SEQ ID NO: 633143 - RNA, 19 nt, Homo sapiens
agaggaagcauucaagaac

SEQ ID NO: 633144 - RNA, 19 nt, Homo sapiens
gcaacaucgucaucaugcu

SEQ ID NO: 633145 - RNA, 19 nt, Homo sapiens
ccacgcagacagcaacauc

SEQ ID NO: 633146 - RNA, 19 nt, Homo sapiens
gggacgacgaguacgacua

SEQ ID NO: 633147 - RNA, 19 nt, Homo sapiens
cgacuaccuauucaaagug

SEQ ID NO: 633148 - RNA, 19 nt, Homo sapiens
ucgccaagcaccugaccua

SEQ ID NO: 633149 - RNA, 19 nt, Homo sapiens
acagcaacaucgucaucau

SEQ ID NO: 633150 - RNA, 19 nt, Homo sapiens
uguacgacaucgccaagca

SEQ ID NO: 633151 - RNA, 19 nt, Homo sapiens
gagcaagaguugagcuuua

SEQ ID NO: 633152 - RNA, 19 nt, Homo sapiens
gaagcucucuguuuauaaa

SEQ ID NO: 633153 - RNA, 19 nt, Homo sapiens
caaagacucugauaagaug

SEQ ID NO: 633154 - RNA, 19 nt, Homo sapiens
caaaggagucggagaaaua

SEQ ID NO: 633155 - RNA, 19 nt, Homo sapiens
gaucagagaugcugcaaag

SEQ ID NO: 633156 - RNA, 19 nt, Homo sapiens
ugucaaagauugccuguuu

SEQ ID NO: 633157 - RNA, 19 nt, Homo sapiens
gcagguacaucaguucuuu

SEQ ID NO: 633158 - RNA, 19 nt, Homo sapiens
cagcaugucugaagucaaa

SEQ ID NO: 633159 - RNA, 19 nt, Homo sapiens
caacaagucucugaaugaa

SEQ ID NO: 633160 - RNA, 19 nt, Homo sapiens
cuaaguauuuggugguuua

SEQ ID NO: 633161 - RNA, 19 nt, Homo sapiens
cuacguggaugacaccuua

SEQ ID NO: 633162 - RNA, 19 nt, Homo sapiens
ggugacagcuucuacauca

SEQ ID NO: 633163 - RNA, 19 nt, Homo sapiens
cgagagagguucaguguca

SEQ ID NO: 633164 - RNA, 19 nt, Homo sapiens
ugaaggagcucaaggaaca

SEQ ID NO: 633165 - RNA, 19 nt, Homo sapiens
gcacucagaucuuggcaau

SEQ ID NO: 633166 - RNA, 19 nt, Homo sapiens
gguccaggcucauaacaaa

SEQ ID NO: 633167 - RNA, 19 nt, Homo sapiens
gacaauagcgccacaaaga

SEQ ID NO: 633168 - RNA, 19 nt, Homo sapiens
gaaagacaguggcaucagu

SEQ ID NO: 633169 - RNA, 19 nt, Homo sapiens
ucaaugcuguccuuuguuu

SEQ ID NO: 633170 - RNA, 19 nt, Homo sapiens
gaaggugacuuuggcauuc

SEQ ID NO: 633171 - RNA, 19 nt, Homo sapiens
caucugugcuuauuacuug

SEQ ID NO: 633172 - RNA, 19 nt, Homo sapiens
aaacggaaguuguagaguu

SEQ ID NO: 633173 - RNA, 19 nt, Homo sapiens
gaagcuugcuccaguagug

SEQ ID NO: 633174 - RNA, 19 nt, Homo sapiens
gaaagucgccauccacaau

SEQ ID NO: 633175 - RNA, 19 nt, Homo sapiens
cugauaagaugcugaguuu

SEQ ID NO: 633176 - RNA, 19 nt, Homo sapiens
uaacaaacggaacuugaua

SEQ ID NO: 633177 - RNA, 19 nt, Homo sapiens
gcauugcacuggacaacaa

SEQ ID NO: 633178 - RNA, 19 nt, Homo sapiens
gauuguaguuuagccauaa

SEQ ID NO: 633179 - RNA, 19 nt, Homo sapiens
uaaaggagaucacagaaaa

SEQ ID NO: 633180 - RNA, 19 nt, Homo sapiens
ugaaggagaugcuggugaa

SEQ ID NO: 633181 - RNA, 19 nt, Homo sapiens
gacaacaagucucugaaug

SEQ ID NO: 633182 - RNA, 19 nt, Homo sapiens
gccaagaaauccugugaug

SEQ ID NO: 633183 - RNA, 19 nt, Homo sapiens
caaccucaguggacagaaa

SEQ ID NO: 633184 - RNA, 19 nt, Homo sapiens
gcaaaggagucggagaaau

SEQ ID NO: 633185 - RNA, 19 nt, Homo sapiens
gcacuucugaggcuagaua

SEQ ID NO: 633186 - RNA, 19 nt, Homo sapiens
acaagucucugaaugaaug

SEQ ID NO: 633187 - RNA, 19 nt, Homo sapiens
ucaaggcgcuccucaaugg

SEQ ID NO: 633188 - RNA, 19 nt, Homo sapiens
gaagagguacagugagaaa

SEQ ID NO: 633189 - RNA, 19 nt, Homo sapiens
ccaaggagacugacuucua

SEQ ID NO: 633190 - RNA, 19 nt, Homo sapiens
agacucggcugaaggauga

SEQ ID NO: 633191 - RNA, 19 nt, Homo sapiens
gguaggggcuguuuucuaa

SEQ ID NO: 633192 - RNA, 19 nt, Homo sapiens
uaagcuaugcguccuguua

SEQ ID NO: 633193 - RNA, 19 nt, Homo sapiens
ggaagucuauguggagaug

SEQ ID NO: 633194 - RNA, 19 nt, Homo sapiens
gaacaagacaguggaggaa

SEQ ID NO: 633195 - RNA, 19 nt, Homo sapiens
caaggagacugacuucuac

SEQ ID NO: 633196 - RNA, 19 nt, Homo sapiens
aagagaaccuuucggauca

SEQ ID NO: 633197 - RNA, 19 nt, Homo sapiens
cagaagcaccuccuuugua

SEQ ID NO: 633198 - RNA, 19 nt, Homo sapiens
cagagaugcugcaaagaga

SEQ ID NO: 633199 - RNA, 19 nt, Homo sapiens
ugucugaagucaaagauga

SEQ ID NO: 633200 - RNA, 19 nt, Homo sapiens
ggacgagaaugcccagaag

SEQ ID NO: 633201 - RNA, 19 nt, Homo sapiens
cuucaucagugcaauguuu

SEQ ID NO: 633202 - RNA, 19 nt, Homo sapiens
gcauauuugucacuaaagu

SEQ ID NO: 633203 - RNA, 19 nt, Homo sapiens
ggagcccugucaagcauuu

SEQ ID NO: 633204 - RNA, 19 nt, Homo sapiens
gcagauucccagcaaauau

SEQ ID NO: 633205 - RNA, 19 nt, Homo sapiens
gaccucagccuccacauug

SEQ ID NO: 633206 - RNA, 19 nt, Homo sapiens
gagguucagugucacauuc

SEQ ID NO: 633207 - RNA, 19 nt, Homo sapiens
cggaagagguacagugaga

SEQ ID NO: 633208 - RNA, 19 nt, Homo sapiens
gugaggagguggccaagga

SEQ ID NO: 633209 - RNA, 19 nt, Homo sapiens
caauaaaggagaucacaga

SEQ ID NO: 633210 - RNA, 19 nt, Homo sapiens
caagaaauccugugaugag

SEQ ID NO: 633211 - RNA, 19 nt, Homo sapiens
gcaagcagaagaaugaugu

SEQ ID NO: 633212 - RNA, 19 nt, Homo sapiens
agaagcaccuccuuuguag

SEQ ID NO: 633213 - RNA, 19 nt, Homo sapiens
ggacaacaagucucugaau

SEQ ID NO: 633214 - RNA, 19 nt, Homo sapiens
agacuauucucaagguauu

SEQ ID NO: 633215 - RNA, 19 nt, Homo sapiens
ccucaaugcuguccuuugu

SEQ ID NO: 633216 - RNA, 19 nt, Homo sapiens
gacauugaauugagagcuu

SEQ ID NO: 633217 - RNA, 19 nt, Homo sapiens
cagcagaaccagugccuuu

SEQ ID NO: 633218 - RNA, 19 nt, Homo sapiens
ggaggaaacacaagcacaa

SEQ ID NO: 633219 - RNA, 19 nt, Homo sapiens
caacgggucauccgagauu

SEQ ID NO: 633220 - RNA, 19 nt, Homo sapiens
ggaaggugacuuuggcauu

SEQ ID NO: 633221 - RNA, 19 nt, Homo sapiens
gaggagcccugucaagcau

SEQ ID NO: 633222 - RNA, 19 nt, Homo sapiens
uggcauauuugucacuaaa

SEQ ID NO: 633223 - RNA, 19 nt, Homo sapiens
gagugggacugagauggua

SEQ ID NO: 633224 - RNA, 19 nt, Homo sapiens
agauaugucuggcugaaga

SEQ ID NO: 633225 - RNA, 19 nt, Homo sapiens
gcaucagucuggagaaugg

SEQ ID NO: 633226 - RNA, 19 nt, Homo sapiens
caggguaauucuuaaacuu

SEQ ID NO: 633227 - RNA, 19 nt, Homo sapiens
aggagaugcuggugaauga

SEQ ID NO: 633228 - RNA, 19 nt, Homo sapiens
uggcagauguggagcaaga

SEQ ID NO: 633229 - RNA, 19 nt, Homo sapiens
ggccacugcugcccuuuga

SEQ ID NO: 633230 - RNA, 19 nt, Homo sapiens
ucaaagacacggugacaau

SEQ ID NO: 633231 - RNA, 19 nt, Homo sapiens
guagacuauucucaaggua

SEQ ID NO: 633232 - RNA, 19 nt, Homo sapiens
gcucagacaaacuaugaaa

SEQ ID NO: 633233 - RNA, 19 nt, Homo sapiens
guacugggcucuguguaag

SEQ ID NO: 633234 - RNA, 19 nt, Homo sapiens
gcuaugcguccuguuaaua

SEQ ID NO: 633235 - RNA, 19 nt, Homo sapiens
ggugguuuauguuuacuug

SEQ ID NO: 633236 - RNA, 19 nt, Homo sapiens
gagaagcggccauuucgau

SEQ ID NO: 633237 - RNA, 19 nt, Homo sapiens
ugacuccauuccacucuuu

SEQ ID NO: 633238 - RNA, 19 nt, Homo sapiens
caagauauccgcggagugu

SEQ ID NO: 633239 - RNA, 19 nt, Homo sapiens
cuacuacccugaaggagau

SEQ ID NO: 633240 - RNA, 19 nt, Homo sapiens
ucacgccgcugcacaucaa

SEQ ID NO: 633241 - RNA, 19 nt, Homo sapiens
gcacggccuuugacaagag

SEQ ID NO: 633242 - RNA, 19 nt, Homo sapiens
acacggccauggacaaguu

SEQ ID NO: 633243 - RNA, 19 nt, Homo sapiens
ucggaucacucguuuacaa

SEQ ID NO: 633244 - RNA, 19 nt, Homo sapiens
gcacccaccuuucuuuagc

SEQ ID NO: 633245 - RNA, 19 nt, Homo sapiens
gaaccaggacccagaagca

SEQ ID NO: 633246 - RNA, 19 nt, Homo sapiens
ucugaggccuguccugauu

SEQ ID NO: 633247 - RNA, 19 nt, Homo sapiens
ggagaugccaacaagaaga

SEQ ID NO: 633248 - RNA, 19 nt, Homo sapiens
ggaacuugauacagcacaa

SEQ ID NO: 633249 - RNA, 19 nt, Homo sapiens
gcaggguaauucuuaaacu

SEQ ID NO: 633250 - RNA, 19 nt, Homo sapiens
ugaaugagaagguggagaa

SEQ ID NO: 633251 - RNA, 19 nt, Homo sapiens
gaugggagaucucaaguuu

SEQ ID NO: 633252 - RNA, 19 nt, Homo sapiens
gcugugacauagauauuua

SEQ ID NO: 633253 - RNA, 19 nt, Homo sapiens
guuaagaccugcaauaauc

SEQ ID NO: 633254 - RNA, 19 nt, Homo sapiens
gaugaugccuauccagaaa

SEQ ID NO: 633255 - RNA, 19 nt, Homo sapiens
gaguuuguguguauuugua

SEQ ID NO: 633256 - RNA, 19 nt, Homo sapiens
caacagagcuacagaaaag

SEQ ID NO: 633257 - RNA, 19 nt, Homo sapiens
gaucuauguugauaaggaa

SEQ ID NO: 633258 - RNA, 19 nt, Homo sapiens
ugagaagacuguuaaagca

SEQ ID NO: 633259 - RNA, 19 nt, Homo sapiens
cuucagaguuuguguguau

SEQ ID NO: 633260 - RNA, 19 nt, Homo sapiens
cuucaauccucuagacuuu

SEQ ID NO: 633261 - RNA, 19 nt, Homo sapiens
agaagacuguuaaagcaaa

SEQ ID NO: 633262 - RNA, 19 nt, Homo sapiens
ugacugagaagacuguuaa

SEQ ID NO: 633263 - RNA, 19 nt, Homo sapiens
ugggagaucucaaguuuca

SEQ ID NO: 633264 - RNA, 19 nt, Homo sapiens
gcacccgugugguugcuaa

SEQ ID NO: 633265 - RNA, 19 nt, Homo sapiens
gcagucuccuucaagcauu

SEQ ID NO: 633266 - RNA, 19 nt, Homo sapiens
gaggagagagagcuugaaa

SEQ ID NO: 633267 - RNA, 19 nt, Homo sapiens
ugaugccuauccagaaaua

SEQ ID NO: 633268 - RNA, 19 nt, Homo sapiens
ccaccagccuuaccuaaag

SEQ ID NO: 633269 - RNA, 19 nt, Homo sapiens
ucuuagugcuucagaguuu

SEQ ID NO: 633270 - RNA, 19 nt, Homo sapiens
acucugaucuauguugaua

SEQ ID NO: 633271 - RNA, 19 nt, Homo sapiens
uggcuacucugaucuaugu

SEQ ID NO: 633272 - RNA, 19 nt, Homo sapiens
gaauggcuacucugaucua

SEQ ID NO: 633273 - RNA, 19 nt, Homo sapiens
gcuguuaagaccugcaaua

SEQ ID NO: 633274 - RNA, 19 nt, Homo sapiens
gaccugcaauaauccagaa

SEQ ID NO: 633275 - RNA, 19 nt, Homo sapiens
gucuggaccuucaaucaaa

SEQ ID NO: 633276 - RNA, 19 nt, Homo sapiens
gagaagacuguuaaagcaa

SEQ ID NO: 633277 - RNA, 19 nt, Homo sapiens
ugaucuauguugauaagga

SEQ ID NO: 633278 - RNA, 19 nt, Homo sapiens
uaaagcauucuucaacaga

SEQ ID NO: 633279 - RNA, 19 nt, Homo sapiens
cuacucugaucuauguuga

SEQ ID NO: 633280 - RNA, 19 nt, Homo sapiens
uaccuaaagcuacuagaaa

SEQ ID NO: 633281 - RNA, 19 nt, Homo sapiens
ccaugggaauccaaucugu

SEQ ID NO: 633282 - RNA, 19 nt, Homo sapiens
aaagaugacugagaagacu

SEQ ID NO: 633283 - RNA, 19 nt, Homo sapiens
gaagacuguuaaagcaaaa

SEQ ID NO: 633284 - RNA, 19 nt, Homo sapiens
cagaguuuguguguauuug

SEQ ID NO: 633285 - RNA, 19 nt, Homo sapiens
uggagugccucucaugauc

SEQ ID NO: 633286 - RNA, 19 nt, Homo sapiens
gaugaaugcggcuguuaag

SEQ ID NO: 633287 - RNA, 19 nt, Homo sapiens
cagaugaaugcggcuguua

SEQ ID NO: 633288 - RNA, 19 nt, Homo sapiens
ggagaucucaaguuucaac

SEQ ID NO: 633289 - RNA, 19 nt, Homo sapiens
ucagaguuuguguguauuu

SEQ ID NO: 633290 - RNA, 19 nt, Homo sapiens
ggagagagagcuugaaaag

SEQ ID NO: 633291 - RNA, 19 nt, Homo sapiens
ucugaucuauguugauaag

SEQ ID NO: 633292 - RNA, 19 nt, Homo sapiens
ucagaugaaugcggcuguu

SEQ ID NO: 633293 - RNA, 19 nt, Homo sapiens
ucaaucaaagccuuagaug

SEQ ID NO: 633294 - RNA, 19 nt, Homo sapiens
guugaauugccaccuguuu

SEQ ID NO: 633295 - RNA, 19 nt, Homo sapiens
ugccucagaugaugccuau

SEQ ID NO: 633296 - RNA, 19 nt, Homo sapiens
uuaccuaaagcuacuagaa

SEQ ID NO: 633297 - RNA, 19 nt, Homo sapiens
ccaccuguuugcugugaca

SEQ ID NO: 633298 - RNA, 19 nt, Homo sapiens
guuccugccucagaugaug

SEQ ID NO: 633299 - RNA, 19 nt, Homo sapiens
agaugaaugcggcuguuaa

SEQ ID NO: 633300 - RNA, 19 nt, Homo sapiens
gcuacucugaucuauguug

SEQ ID NO: 633301 - RNA, 19 nt, Homo sapiens
auaaagcauucuucaacag

SEQ ID NO: 633302 - RNA, 19 nt, Homo sapiens
cugcaauaauccagaaugg

SEQ ID NO: 633303 - RNA, 19 nt, Homo sapiens
ugaaugcggcuguuaagac

SEQ ID NO: 633304 - RNA, 19 nt, Homo sapiens
ccuguuugcugugacauag

SEQ ID NO: 633305 - RNA, 19 nt, Homo sapiens
cuguuaagaccugcaauaa

SEQ ID NO: 633306 - RNA, 19 nt, Homo sapiens
accuaaagcuacuagaaag

SEQ ID NO: 633307 - RNA, 19 nt, Homo sapiens
gaguggagugccucucaug

SEQ ID NO: 633308 - RNA, 19 nt, Homo sapiens
gccugaagagcaccagauu

SEQ ID NO: 633309 - RNA, 19 nt, Homo sapiens
uaaggaaaauggagaacca

SEQ ID NO: 633310 - RNA, 19 nt, Homo sapiens
cgaagguccucucugauga

SEQ ID NO: 633311 - RNA, 19 nt, Homo sapiens
agacaguggcggcuuauua

SEQ ID NO: 633312 - RNA, 19 nt, Homo sapiens
gcugaaggcccgaauggua

SEQ ID NO: 633313 - RNA, 19 nt, Homo sapiens
gcaccaggccauagaaaga

SEQ ID NO: 633314 - RNA, 19 nt, Homo sapiens
ugucagagcucuucauguc

SEQ ID NO: 633315 - RNA, 19 nt, Homo sapiens
gcccuggcaucuuaauaaa

SEQ ID NO: 633316 - RNA, 19 nt, Homo sapiens
guaaugcuccucccuacuu

SEQ ID NO: 633317 - RNA, 19 nt, Homo sapiens
gguccucucugaugacaug

SEQ ID NO: 633318 - RNA, 19 nt, Homo sapiens
gcucacuccucuacuugaa

SEQ ID NO: 633319 - RNA, 19 nt, Homo sapiens
gacaguggcggcuuauuau

SEQ ID NO: 633320 - RNA, 19 nt, Homo sapiens
uggagacaguggcggcuua

SEQ ID NO: 633321 - RNA, 19 nt, Homo sapiens
ggggagagcuuuugugaca

SEQ ID NO: 633322 - RNA, 19 nt, Homo sapiens
ucccgaagguccucucuga

SEQ ID NO: 633323 - RNA, 19 nt, Homo sapiens
ggaggacgacuucaaagag

SEQ ID NO: 633324 - RNA, 19 nt, Homo sapiens
gcuggaggacgacuucaaa

SEQ ID NO: 633325 - RNA, 19 nt, Homo sapiens
ggccuuggcuccuugaacu

SEQ ID NO: 633326 - RNA, 19 nt, Homo sapiens
gagcucacuccucuacuug

SEQ ID NO: 633327 - RNA, 19 nt, Homo sapiens
gauacugacaccaccuuug

SEQ ID NO: 633328 - RNA, 19 nt, Homo sapiens
gaaccccaauccucaaaau

SEQ ID NO: 633329 - RNA, 19 nt, Homo sapiens
ccgaagguccucucugaug

SEQ ID NO: 633330 - RNA, 19 nt, Homo sapiens
caguggcggcuuauuauga

SEQ ID NO: 633331 - RNA, 19 nt, Homo sapiens
cugaaggcccgaaugguaa

SEQ ID NO: 633332 - RNA, 19 nt, Homo sapiens
cgcccuggcaucuuaauaa

SEQ ID NO: 633333 - RNA, 19 nt, Homo sapiens
cugucgcccuggcaucuua

SEQ ID NO: 633334 - RNA, 19 nt, Homo sapiens
ggacguggacaggugaugu

SEQ ID NO: 633335 - RNA, 19 nt, Homo sapiens
uaaugcuccucccuacuuc

SEQ ID NO: 633336 - RNA, 19 nt, Homo sapiens
gaagcugaaggcccgaaug

SEQ ID NO: 633337 - RNA, 19 nt, Homo sapiens
ucucugaugacaugaagaa

SEQ ID NO: 633338 - RNA, 19 nt, Homo sapiens
gacaaggucaugagauggu

SEQ ID NO: 633339 - RNA, 19 nt, Homo sapiens
ucacuccucuacuugaaaa

SEQ ID NO: 633340 - RNA, 19 nt, Homo sapiens
ugccaacucugccucucuu

SEQ ID NO: 633341 - RNA, 19 nt, Homo sapiens
cagcaccaggccauagaaa

SEQ ID NO: 633342 - RNA, 19 nt, Homo sapiens
cugaugacaugaagaagcu

SEQ ID NO: 633343 - RNA, 19 nt, Homo sapiens
acaaggucaugagaugguu

SEQ ID NO: 633344 - RNA, 19 nt, Homo sapiens
ggagacaguggcggcuuau

SEQ ID NO: 633345 - RNA, 19 nt, Homo sapiens
uggaggacgacuucaaaga

SEQ ID NO: 633346 - RNA, 19 nt, Homo sapiens
gaaaccagcucaacaauug

SEQ ID NO: 633347 - RNA, 19 nt, Homo sapiens
cagaagagcucauauauau

SEQ ID NO: 633348 - RNA, 19 nt, Homo sapiens
gagaagauguccuuugaaa

SEQ ID NO: 633349 - RNA, 19 nt, Homo sapiens
gcacaaagaggcaaacuaa

SEQ ID NO: 633350 - RNA, 19 nt, Homo sapiens
gaaggaauaugaaguagau

SEQ ID NO: 633351 - RNA, 19 nt, Homo sapiens
gaagauaaagggacaagua

SEQ ID NO: 633352 - RNA, 19 nt, Homo sapiens
ggaaugagcaacacaaauu

SEQ ID NO: 633353 - RNA, 19 nt, Homo sapiens
ggagagagaacgacuagua

SEQ ID NO: 633354 - RNA, 19 nt, Homo sapiens
aaacacagcuuucuuaguc

SEQ ID NO: 633355 - RNA, 19 nt, Homo sapiens
aaacgaaccuugcuacaga

SEQ ID NO: 633356 - RNA, 19 nt, Homo sapiens
ucagaagcgucaacaguua

SEQ ID NO: 633357 - RNA, 19 nt, Homo sapiens
uaggaaacaugaaggaaua

SEQ ID NO: 633358 - RNA, 19 nt, Homo sapiens
cagagaagauguccuuuga

SEQ ID NO: 633359 - RNA, 19 nt, Homo sapiens
ucacugacuuuguuaauga

SEQ ID NO: 633360 - RNA, 19 nt, Homo sapiens
gacaaguacugaauuaguu

SEQ ID NO: 633361 - RNA, 19 nt, Homo sapiens
gaagacaguaucuauauug

SEQ ID NO: 633362 - RNA, 19 nt, Homo sapiens
ggaagaaacugcuuaucca

SEQ ID NO: 633363 - RNA, 19 nt, Homo sapiens
gacaguaucuauauuggaa

SEQ ID NO: 633364 - RNA, 19 nt, Homo sapiens
gcuaguugcugaacaagaa

SEQ ID NO: 633365 - RNA, 19 nt, Homo sapiens
ggaugaauuuagacagaua

SEQ ID NO: 633366 - RNA, 19 nt, Homo sapiens
aaagauaccaccaagaaua

SEQ ID NO: 633367 - RNA, 19 nt, Homo sapiens
cauaugaccugaaagaugu

SEQ ID NO: 633368 - RNA, 19 nt, Homo sapiens
caaagaugcuaaagagaga

SEQ ID NO: 633369 - RNA, 19 nt, Homo sapiens
ggucagauauagaaauguu

SEQ ID NO: 633370 - RNA, 19 nt, Homo sapiens
ucagaaagauacaugaaga

SEQ ID NO: 633371 - RNA, 19 nt, Homo sapiens
guuaagugguagucaguua

SEQ ID NO: 633372 - RNA, 19 nt, Homo sapiens
gaaagauacaugaagauga

SEQ ID NO: 633373 - RNA, 19 nt, Homo sapiens
ucaagaaguugucauuguu

SEQ ID NO: 633374 - RNA, 19 nt, Homo sapiens
gcucuucacugacuuuguu

SEQ ID NO: 633375 - RNA, 19 nt, Homo sapiens
guaguggucucaauaagug

SEQ ID NO: 633376 - RNA, 19 nt, Homo sapiens
agagagaacuggagagaga

SEQ ID NO: 633377 - RNA, 19 nt, Homo sapiens
ccaguucacuuuaaagaau

SEQ ID NO: 633378 - RNA, 19 nt, Homo sapiens
gaagauguccuuugaaacu

SEQ ID NO: 633379 - RNA, 19 nt, Homo sapiens
gcagauagagcaaggagaa

SEQ ID NO: 633380 - RNA, 19 nt, Homo sapiens
ugggaaagauuguauguug

SEQ ID NO: 633381 - RNA, 19 nt, Homo sapiens
gggcaugauuguagagaaa

SEQ ID NO: 633382 - RNA, 19 nt, Homo sapiens
gaaugagcaacacaaauuu

SEQ ID NO: 633383 - RNA, 19 nt, Homo sapiens
ugaaguagauaaugaugga

SEQ ID NO: 633384 - RNA, 19 nt, Homo sapiens
gaaacaugaaggaauauga

SEQ ID NO: 633385 - RNA, 19 nt, Homo sapiens
cccagaauguucaucuuua

SEQ ID NO: 633386 - RNA, 19 nt, Homo sapiens
gauuguauguugaggcaaa

SEQ ID NO: 633387 - RNA, 19 nt, Homo sapiens
cgaagacaguaucuauauu

SEQ ID NO: 633388 - RNA, 19 nt, Homo sapiens
gacagauaauucaaaggua

SEQ ID NO: 633389 - RNA, 19 nt, Homo sapiens
cuauaaggauggaugaauu

SEQ ID NO: 633390 - RNA, 19 nt, Homo sapiens
gggaaagauuguauguuga

SEQ ID NO: 633391 - RNA, 19 nt, Homo sapiens
gagagagaacgacuaguaa

SEQ ID NO: 633392 - RNA, 19 nt, Homo sapiens
gaacagauuagaauauugg

SEQ ID NO: 633393 - RNA, 19 nt, Homo sapiens
ggaaaccagcucaacaauu

SEQ ID NO: 633394 - RNA, 19 nt, Homo sapiens
caagucaaauucuaaugug

SEQ ID NO: 633395 - RNA, 19 nt, Homo sapiens
ccauguaccagcuuaguua

SEQ ID NO: 633396 - RNA, 19 nt, Homo sapiens
gaagucagaagagcucaua

SEQ ID NO: 633397 - RNA, 19 nt, Homo sapiens
ucaguuaaauccacuuuca

SEQ ID NO: 633398 - RNA, 19 nt, Homo sapiens
caagucagauucucccaau

SEQ ID NO: 633399 - RNA, 19 nt, Homo sapiens
gcacaauucagauucagaa

SEQ ID NO: 633400 - RNA, 19 nt, Homo sapiens
gaggcaaacuaacaaguca

SEQ ID NO: 633401 - RNA, 19 nt, Homo sapiens
guaccagcuuaguuauaua

SEQ ID NO: 633402 - RNA, 19 nt, Homo sapiens
gaaaagaucaccuuaagug

SEQ ID NO: 633403 - RNA, 19 nt, Homo sapiens
auugaaagauggagucuaa

SEQ ID NO: 633404 - RNA, 19 nt, Homo sapiens
uugagaaguuggaugaaua

SEQ ID NO: 633405 - RNA, 19 nt, Homo sapiens
gcacagaguucagaagacu

SEQ ID NO: 633406 - RNA, 19 nt, Homo sapiens
ucagaagagcucauauaua

SEQ ID NO: 633407 - RNA, 19 nt, Homo sapiens
ggacaaguacugaauuagu

SEQ ID NO: 633408 - RNA, 19 nt, Homo sapiens
acaugaaacuuaccuaauc

SEQ ID NO: 633409 - RNA, 19 nt, Homo sapiens
cagauucucccaauguaua

SEQ ID NO: 633410 - RNA, 19 nt, Homo sapiens
aaacgucaguucaguagug

SEQ ID NO: 633411 - RNA, 19 nt, Homo sapiens
gaggaaaccagcucaacaa

SEQ ID NO: 633412 - RNA, 19 nt, Homo sapiens
caugaaggaauaugaagua

SEQ ID NO: 633413 - RNA, 19 nt, Homo sapiens
uuaaagauaccaccaagaa

SEQ ID NO: 633414 - RNA, 19 nt, Homo sapiens
ucaguuacauggcaaguca

SEQ ID NO: 633415 - RNA, 19 nt, Homo sapiens
gcagagaagauguccuuug

SEQ ID NO: 633416 - RNA, 19 nt, Homo sapiens
caaagaggcaaacuaacaa

SEQ ID NO: 633417 - RNA, 19 nt, Homo sapiens
gaagaaauuggaaaucaag

SEQ ID NO: 633418 - RNA, 19 nt, Homo sapiens
aaggauggaugaauuuaga

SEQ ID NO: 633419 - RNA, 19 nt, Homo sapiens
aaauuaagcaggcuaaaga

SEQ ID NO: 633420 - RNA, 19 nt, Homo sapiens
agggacaaguacugaauua

SEQ ID NO: 633421 - RNA, 19 nt, Homo sapiens
caaacuaagagaacagauu

SEQ ID NO: 633422 - RNA, 19 nt, Homo sapiens
gaaacuuaccuaaucuuca

SEQ ID NO: 633423 - RNA, 19 nt, Homo sapiens
uggccaaguuuguuucuuu

SEQ ID NO: 633424 - RNA, 19 nt, Homo sapiens
ugacagugauucaucuugu

SEQ ID NO: 633425 - RNA, 19 nt, Homo sapiens
cuauuuacauccacaguau

SEQ ID NO: 633426 - RNA, 19 nt, Homo sapiens
gaaauuggaaaucaagaag

SEQ ID NO: 633427 - RNA, 19 nt, Homo sapiens
ggagaaagcagccaaaaug

SEQ ID NO: 633428 - RNA, 19 nt, Homo sapiens
gacuugagcaaaugguuua

SEQ ID NO: 633429 - RNA, 19 nt, Homo sapiens
uaagaguugugcuuuaugg

SEQ ID NO: 633430 - RNA, 19 nt, Homo sapiens
ugaguuucuuguaagguua

SEQ ID NO: 633431 - RNA, 19 nt, Homo sapiens
ucuaagaguugugcuuuau

SEQ ID NO: 633432 - RNA, 19 nt, Homo sapiens
ggcuuguucugguguauuu

SEQ ID NO: 633433 - RNA, 19 nt, Homo sapiens
guauaaggcaccuacagaa

SEQ ID NO: 633434 - RNA, 19 nt, Homo sapiens
gauaaagggacaaguacug

SEQ ID NO: 633435 - RNA, 19 nt, Homo sapiens
caacaguuagucagaaaga

SEQ ID NO: 633436 - RNA, 19 nt, Homo sapiens
aaagauacccgaagacagu

SEQ ID NO: 633437 - RNA, 19 nt, Homo sapiens
gaaacugcuuauccagcuu

SEQ ID NO: 633438 - RNA, 19 nt, Homo sapiens
ccagaauguucaucuuuag

SEQ ID NO: 633439 - RNA, 19 nt, Homo sapiens
gaaauguugaauucuguga

SEQ ID NO: 633440 - RNA, 19 nt, Homo sapiens
acaaagaggcaaacuaaca

SEQ ID NO: 633441 - RNA, 19 nt, Homo sapiens
aaagguagaggcacaaaga

SEQ ID NO: 633442 - RNA, 19 nt, Homo sapiens
uguaccagcuuaguuauau

SEQ ID NO: 633443 - RNA, 19 nt, Homo sapiens
gaucaguucaucaauaagu

SEQ ID NO: 633444 - RNA, 19 nt, Homo sapiens
acacaguggugaucccuau

SEQ ID NO: 633445 - RNA, 19 nt, Homo sapiens
guucugguguauuugauug

SEQ ID NO: 633446 - RNA, 19 nt, Homo sapiens
ggacagaaauugaagauuc

SEQ ID NO: 633447 - RNA, 19 nt, Homo sapiens
gaaaggcguuggacagaaa

SEQ ID NO: 633448 - RNA, 19 nt, Homo sapiens
gaacuuccauccagaccaa

SEQ ID NO: 633449 - RNA, 19 nt, Homo sapiens
ccacugcccugcuggagua

SEQ ID NO: 633450 - RNA, 19 nt, Homo sapiens
gaaaggcgccuaccucaag

SEQ ID NO: 633451 - RNA, 19 nt, Homo sapiens
ggacagugacggcgaguuu

SEQ ID NO: 633452 - RNA, 19 nt, Homo sapiens
gaacagagcgcaggacauc

SEQ ID NO: 633453 - RNA, 19 nt, Homo sapiens
ggacguggccuaugccuau

SEQ ID NO: 633454 - RNA, 19 nt, Homo sapiens
ggaaaggcguuggacagaa

SEQ ID NO: 633455 - RNA, 19 nt, Homo sapiens
ugaagauucccacacauua

SEQ ID NO: 633456 - RNA, 19 nt, Homo sapiens
gcagcguacuucuggcuuu

SEQ ID NO: 633457 - RNA, 19 nt, Homo sapiens
ccaaugagcugcggaaggu

SEQ ID NO: 633458 - RNA, 19 nt, Homo sapiens
gcugggugcuggauucuga

SEQ ID NO: 633459 - RNA, 19 nt, Homo sapiens
gcaagucucagaaggauca

SEQ ID NO: 633460 - RNA, 19 nt, Homo sapiens
gcgccuaccucaaggacaa

SEQ ID NO: 633461 - RNA, 19 nt, Homo sapiens
ccucagcccuugacaggaa

SEQ ID NO: 633462 - RNA, 19 nt, Homo sapiens
gacagaacguccucuugug

SEQ ID NO: 633463 - RNA, 19 nt, Homo sapiens
ggcuggaacucaagucuga

SEQ ID NO: 633464 - RNA, 19 nt, Homo sapiens
gaacguccucuuguguaua

SEQ ID NO: 633465 - RNA, 19 nt, Homo sapiens
cugaggagcuggccaagug

SEQ ID NO: 633466 - RNA, 19 nt, Homo sapiens
gaagauucccacacauuag

SEQ ID NO: 633467 - RNA, 19 nt, Homo sapiens
ggaaggugcuggugaugcu

SEQ ID NO: 633468 - RNA, 19 nt, Homo sapiens
gggcaagucucagaaggau

SEQ ID NO: 633469 - RNA, 19 nt, Homo sapiens
ugcggaagcucaaguacaa

SEQ ID NO: 633470 - RNA, 19 nt, Homo sapiens
aacguccucuuguguauaa

SEQ ID NO: 633471 - RNA, 19 nt, Homo sapiens
cagaacguccucuugugua

SEQ ID NO: 633472 - RNA, 19 nt, Homo sapiens
guccucuuguguauaauaa

SEQ ID NO: 633473 - RNA, 19 nt, Homo sapiens
agaacguccucuuguguau

SEQ ID NO: 633474 - RNA, 19 nt, Homo sapiens
gcaugcggaagcucaagua

SEQ ID NO: 633475 - RNA, 19 nt, Homo sapiens
gcccuucucucugacgaaa

SEQ ID NO: 633476 - RNA, 19 nt, Homo sapiens
ggacuugcugggucgcuuu

SEQ ID NO: 633477 - RNA, 19 nt, Homo sapiens
ugccaaguccuucgccuua

SEQ ID NO: 633478 - RNA, 19 nt, Homo sapiens
agaagcugcuccacaucaa

SEQ ID NO: 633479 - RNA, 19 nt, Homo sapiens
acaagugccuggaguuggu

SEQ ID NO: 633480 - RNA, 19 nt, Homo sapiens
uaaugaaccgccuggaaga

SEQ ID NO: 633481 - RNA, 19 nt, Homo sapiens
gcaggaccuuggccacucu

SEQ ID NO: 633482 - RNA, 19 nt, Homo sapiens
ggucacccuugaggacaaa

SEQ ID NO: 633483 - RNA, 19 nt, Homo sapiens
gacagaaauugaagauucc

SEQ ID NO: 633484 - RNA, 19 nt, Homo sapiens
aauugaagauucccacaca

SEQ ID NO: 633485 - RNA, 19 nt, Homo sapiens
ggaguugguggagcacuuu

SEQ ID NO: 633486 - RNA, 19 nt, Homo sapiens
ucucggagccacuaaugaa

SEQ ID NO: 633487 - RNA, 19 nt, Homo sapiens
ggaacucaagucugaaugg

SEQ ID NO: 633488 - RNA, 19 nt, Homo sapiens
cagaagcugcuccacauca

SEQ ID NO: 633489 - RNA, 19 nt, Homo sapiens
uccagaagcugcuccacau

SEQ ID NO: 633490 - RNA, 19 nt, Homo sapiens
ugaaccgccuggaagacaa

SEQ ID NO: 633491 - RNA, 19 nt, Homo sapiens
gcgaguuucugcccguaag

SEQ ID NO: 633492 - RNA, 19 nt, Homo sapiens
ccuucucucugacgaaaga

SEQ ID NO: 633493 - RNA, 19 nt, Homo sapiens
ccucuuguguauaauaaac

SEQ ID NO: 633494 - RNA, 19 nt, Homo sapiens
cguccuccacccugaauuu

SEQ ID NO: 633495 - RNA, 19 nt, Homo sapiens
agaccaagaggaucaguuc

SEQ ID NO: 633496 - RNA, 19 nt, Homo sapiens
ccaaguccuucgccuuacu

SEQ ID NO: 633497 - RNA, 19 nt, Homo sapiens
ucuucagccugguacauga

SEQ ID NO: 633498 - RNA, 19 nt, Homo sapiens
ggcguuggacagaaauuga

SEQ ID NO: 633499 - RNA, 19 nt, Homo sapiens
uugaagauucccacacauu

SEQ ID NO: 633500 - RNA, 19 nt, Homo sapiens
agacaagugccuggaguug

SEQ ID NO: 633501 - RNA, 19 nt, Homo sapiens
cguccucuuguguauaaua

SEQ ID NO: 633502 - RNA, 19 nt, Homo sapiens
gcguuggacagaaauugaa

SEQ ID NO: 633503 - RNA, 19 nt, Homo sapiens
acagaacguccucuugugu

SEQ ID NO: 633504 - RNA, 19 nt, Homo sapiens
uucaacagccgaagaagga

SEQ ID NO: 633505 - RNA, 19 nt, Homo sapiens
ccaccuccagggucuaaga

SEQ ID NO: 633506 - RNA, 19 nt, Homo sapiens
gagguggccacgcaguaug

SEQ ID NO: 633507 - RNA, 19 nt, Homo sapiens
guccuucgccuuacucaag

SEQ ID NO: 633508 - RNA, 19 nt, Homo sapiens
gcucuuggacguggccuau

SEQ ID NO: 633509 - RNA, 19 nt, Homo sapiens
ggacagaccuggguuguua

SEQ ID NO: 633510 - RNA, 19 nt, Homo sapiens
ggacagaaauugaagauuc

SEQ ID NO: 633511 - RNA, 19 nt, Homo sapiens
gaacaucugucauaaaugg

SEQ ID NO: 633512 - RNA, 19 nt, Homo sapiens
ggcagaaccugacuaaaua

SEQ ID NO: 633513 - RNA, 19 nt, Homo sapiens
gcacuugucugucugcuuu

SEQ ID NO: 633514 - RNA, 19 nt, Homo sapiens
gaaauaggaucaccagugu

SEQ ID NO: 633515 - RNA, 19 nt, Homo sapiens
gcaacaagcuuucuaccuu

SEQ ID NO: 633516 - RNA, 19 nt, Homo sapiens
gaaaggcguuggacagaaa

SEQ ID NO: 633517 - RNA, 19 nt, Homo sapiens
gauaaaggcuugcucauac

SEQ ID NO: 633518 - RNA, 19 nt, Homo sapiens
cuccaaaucucaugaaaua

SEQ ID NO: 633519 - RNA, 19 nt, Homo sapiens
gaaacccugucucuacuaa

SEQ ID NO: 633520 - RNA, 19 nt, Homo sapiens
gcacgugccuccugagaga

SEQ ID NO: 633521 - RNA, 19 nt, Homo sapiens
ggaacuggcugcccaaaca

SEQ ID NO: 633522 - RNA, 19 nt, Homo sapiens
gaacuuccauccagaccaa

SEQ ID NO: 633523 - RNA, 19 nt, Homo sapiens
ccacugcccugcuggagua

SEQ ID NO: 633524 - RNA, 19 nt, Homo sapiens
gcaggcagguggaguccua

SEQ ID NO: 633525 - RNA, 19 nt, Homo sapiens
gcaaccaucaccacaauuu

SEQ ID NO: 633526 - RNA, 19 nt, Homo sapiens
gaaaggcgccuaccucaag

SEQ ID NO: 633527 - RNA, 19 nt, Homo sapiens
ggacagugacggcgaguuu

SEQ ID NO: 633528 - RNA, 19 nt, Homo sapiens
gaacagagcgcaggacauc

SEQ ID NO: 633529 - RNA, 19 nt, Homo sapiens
ggaaaggcguuggacagaa

SEQ ID NO: 633530 - RNA, 19 nt, Homo sapiens
cauggcagcucaccuggua

SEQ ID NO: 633531 - RNA, 19 nt, Homo sapiens
cauaggaacaucugucaua

SEQ ID NO: 633532 - RNA, 19 nt, Homo sapiens
ggaaguguuuggaucauag

SEQ ID NO: 633533 - RNA, 19 nt, Homo sapiens
gcaaaacccugucucuauu

SEQ ID NO: 633534 - RNA, 19 nt, Homo sapiens
gaacugugagccaaauaaa

SEQ ID NO: 633535 - RNA, 19 nt, Homo sapiens
gaucaccaguguuggagaa

SEQ ID NO: 633536 - RNA, 19 nt, Homo sapiens
gagguaggaggaucacuua

SEQ ID NO: 633537 - RNA, 19 nt, Homo sapiens
ugaagauucccacacauua

SEQ ID NO: 633538 - RNA, 19 nt, Homo sapiens
cauacaggaugcccacuuu

SEQ ID NO: 633539 - RNA, 19 nt, Homo sapiens
gcagcguacuucuggcuuu

SEQ ID NO: 633540 - RNA, 19 nt, Homo sapiens
ugacaugccugcuccuugu

SEQ ID NO: 633541 - RNA, 19 nt, Homo sapiens
aggaacaucugucauaaau

SEQ ID NO: 633542 - RNA, 19 nt, Homo sapiens
gaacagagaguaggacagu

SEQ ID NO: 633543 - RNA, 19 nt, Homo sapiens
caccacaauuugcacauuu

SEQ ID NO: 633544 - RNA, 19 nt, Homo sapiens
gccauacacuucacccauu

SEQ ID NO: 633545 - RNA, 19 nt, Homo sapiens
gcagaacugugagccaaau

SEQ ID NO: 633546 - RNA, 19 nt, Homo sapiens
caccuucugucaugaguaa

SEQ ID NO: 633547 - RNA, 19 nt, Homo sapiens
ccauacacuucacccauuu

SEQ ID NO: 633548 - RNA, 19 nt, Homo sapiens
gaagcugauuggagauuca

SEQ ID NO: 633549 - RNA, 19 nt, Homo sapiens
gcaagucucagaaggauca

SEQ ID NO: 633550 - RNA, 19 nt, Homo sapiens
caaaucucaugaaauagga

SEQ ID NO: 633551 - RNA, 19 nt, Homo sapiens
ggaauguauuuauccuuuc

SEQ ID NO: 633552 - RNA, 19 nt, Homo sapiens
gcgccuaccucaaggacaa

SEQ ID NO: 633553 - RNA, 19 nt, Homo sapiens
ccucagcccuugacaggaa

SEQ ID NO: 633554 - RNA, 19 nt, Homo sapiens
caaucaagcagcaauggua

SEQ ID NO: 633555 - RNA, 19 nt, Homo sapiens
ucagccaccucacccauuu

SEQ ID NO: 633556 - RNA, 19 nt, Homo sapiens
ugagugaguucuugcucua

SEQ ID NO: 633557 - RNA, 19 nt, Homo sapiens
gacagaacguccucuugug

SEQ ID NO: 633558 - RNA, 19 nt, Homo sapiens
ggcuggaacucaagucuga

SEQ ID NO: 633559 - RNA, 19 nt, Homo sapiens
gaacguccucuuguguaua

SEQ ID NO: 633560 - RNA, 19 nt, Homo sapiens
guguguguguguauauaua

SEQ ID NO: 633561 - RNA, 19 nt, Homo sapiens
uaugugaucuugcuaaacu

SEQ ID NO: 633562 - RNA, 19 nt, Homo sapiens
gauuggagauucagugcau

SEQ ID NO: 633563 - RNA, 19 nt, Homo sapiens
cugaggagcuggccaagug

SEQ ID NO: 633564 - RNA, 19 nt, Homo sapiens
gaagauucccacacauuag

SEQ ID NO: 633565 - RNA, 19 nt, Homo sapiens
cacauugauuguuagcaua

SEQ ID NO: 633566 - RNA, 19 nt, Homo sapiens
gugguguagugcuuaauuu

SEQ ID NO: 633567 - RNA, 19 nt, Homo sapiens
gaggagaagaucccacuug

SEQ ID NO: 633568 - RNA, 19 nt, Homo sapiens
ccaggaggcugagguagga

SEQ ID NO: 633569 - RNA, 19 nt, Homo sapiens
gguggaggcugcagugagu

SEQ ID NO: 633570 - RNA, 19 nt, Homo sapiens
ggugggaucacgccuguaa

SEQ ID NO: 633571 - RNA, 19 nt, Homo sapiens
uggcagaaccugacuaaau

SEQ ID NO: 633572 - RNA, 19 nt, Homo sapiens
ugacuggcuucauuuacuu

SEQ ID NO: 633573 - RNA, 19 nt, Homo sapiens
gcagugaguuaagauugug

SEQ ID NO: 633574 - RNA, 19 nt, Homo sapiens
ucaguugucucacacuuag

SEQ ID NO: 633575 - RNA, 19 nt, Homo sapiens
gggcaagucucagaaggau

SEQ ID NO: 633576 - RNA, 19 nt, Homo sapiens
cugagaagccagaagauaa

SEQ ID NO: 633577 - RNA, 19 nt, Homo sapiens
gaacuccugcccuaucugu

SEQ ID NO: 633578 - RNA, 19 nt, Homo sapiens
guaggaggaucacuuaagc

SEQ ID NO: 633579 - RNA, 19 nt, Homo sapiens
ggaagcugauuggagauuc

SEQ ID NO: 633580 - RNA, 19 nt, Homo sapiens
cagguggaguccuagaauu

SEQ ID NO: 633581 - RNA, 19 nt, Homo sapiens
ugagaagccagaagauaaa

SEQ ID NO: 633582 - RNA, 19 nt, Homo sapiens
auaggaacaucugucauaa

SEQ ID NO: 633583 - RNA, 19 nt, Homo sapiens
uuuagucucuuugcagaua

SEQ ID NO: 633584 - RNA, 19 nt, Homo sapiens
gaagucaagccugcaguga

SEQ ID NO: 633585 - RNA, 19 nt, Homo sapiens
caaacuccaucguugucuu

SEQ ID NO: 633586 - RNA, 19 nt, Homo sapiens
caugagugcuuauucacau

SEQ ID NO: 633587 - RNA, 19 nt, Homo sapiens
ugcggaagcucaaguacaa

SEQ ID NO: 633588 - RNA, 19 nt, Homo sapiens
aagcagcaaugguacuuau

SEQ ID NO: 633589 - RNA, 19 nt, Homo sapiens
cucauauacugaugugaua

SEQ ID NO: 633590 - RNA, 19 nt, Homo sapiens
ccuguaaucccagcacuua

SEQ ID NO: 633591 - RNA, 19 nt, Homo sapiens
gcacacccagccuguaguu

SEQ ID NO: 633592 - RNA, 19 nt, Homo sapiens
ucuagucacugcucugaug

SEQ ID NO: 633593 - RNA, 19 nt, Homo sapiens
aacguccucuuguguauaa

SEQ ID NO: 633594 - RNA, 19 nt, Homo sapiens
gguuuggaaucacuugcua

SEQ ID NO: 633595 - RNA, 19 nt, Homo sapiens
agauaaaggcuugcucaua

SEQ ID NO: 633596 - RNA, 19 nt, Homo sapiens
gaguucuugcucuauauua

SEQ ID NO: 633597 - RNA, 19 nt, Homo sapiens
guuuauccauucauccauu

SEQ ID NO: 633598 - RNA, 19 nt, Homo sapiens
gcauauagaaaugggauug

SEQ ID NO: 633599 - RNA, 19 nt, Homo sapiens
acacguauauacacacaca

SEQ ID NO: 633600 - RNA, 19 nt, Homo sapiens
gagccaagcagaugucagu

SEQ ID NO: 633601 - RNA, 19 nt, Homo sapiens
agugaguucuugcucuaua

SEQ ID NO: 633602 - RNA, 19 nt, Homo sapiens
acacauugauuguuagcau

SEQ ID NO: 633603 - RNA, 19 nt, Homo sapiens
agaccaaccuggccaacau

SEQ ID NO: 633604 - RNA, 19 nt, Homo sapiens
cagaacguccucuugugua

SEQ ID NO: 633605 - RNA, 19 nt, Homo sapiens
gaucuugagcccaggaguu

SEQ ID NO: 633606 - RNA, 19 nt, Homo sapiens
uggguugccuccagccaua

SEQ ID NO: 633607 - RNA, 19 nt, Homo sapiens
ggaggcaacaagcuuucua

SEQ ID NO: 633608 - RNA, 19 nt, Homo sapiens
gagcaucuacucccuacau

SEQ ID NO: 633609 - RNA, 19 nt, Homo sapiens
gcaaacaucuuauuucuca

SEQ ID NO: 633610 - RNA, 19 nt, Homo sapiens
ggaaggaagugugcauuua

SEQ ID NO: 633611 - RNA, 19 nt, Homo sapiens
gaaauugcauguucagaug

SEQ ID NO: 633612 - RNA, 19 nt, Homo sapiens
gaaccuaugacacuucuua

SEQ ID NO: 633613 - RNA, 19 nt, Homo sapiens
gcagagaugcuaaacuaua

SEQ ID NO: 633614 - RNA, 19 nt, Homo sapiens
gaaagcagccuuauuagag

SEQ ID NO: 633615 - RNA, 19 nt, Homo sapiens
guaaaaguaugcacuguua

SEQ ID NO: 633616 - RNA, 19 nt, Homo sapiens
aguaugcacuguuagauua

SEQ ID NO: 633617 - RNA, 19 nt, Homo sapiens
gaauaguucuuguucauac

SEQ ID NO: 633618 - RNA, 19 nt, Homo sapiens
gauaugcaccuguacagua

SEQ ID NO: 633619 - RNA, 19 nt, Homo sapiens
gaucaggacucugucuuug

SEQ ID NO: 633620 - RNA, 19 nt, Homo sapiens
uaaauugcauggagagguu

SEQ ID NO: 633621 - RNA, 19 nt, Homo sapiens
cacaggaaguguucaguaa

SEQ ID NO: 633622 - RNA, 19 nt, Homo sapiens
gggagugucugguauuguu

SEQ ID NO: 633623 - RNA, 19 nt, Homo sapiens
gaaggaagugugcauuuau

SEQ ID NO: 633624 - RNA, 19 nt, Homo sapiens
cagagaugcuaaacuauau

SEQ ID NO: 633625 - RNA, 19 nt, Homo sapiens
gguagaauuuggcgucuug

SEQ ID NO: 633626 - RNA, 19 nt, Homo sapiens
gcagguguccgauguagaa

SEQ ID NO: 633627 - RNA, 19 nt, Homo sapiens
gauaaccacugccgaaugc

SEQ ID NO: 633628 - RNA, 19 nt, Homo sapiens
ugcgaaagcagccuuauua

SEQ ID NO: 633629 - RNA, 19 nt, Homo sapiens
gaacugugaugaggcugaa

SEQ ID NO: 633630 - RNA, 19 nt, Homo sapiens
ugaugaggcugaaaucgaa

SEQ ID NO: 633631 - RNA, 19 nt, Homo sapiens
ccauuucacuucuuuguca

SEQ ID NO: 633632 - RNA, 19 nt, Homo sapiens
gaaggcagcuguggcuuac

SEQ ID NO: 633633 - RNA, 19 nt, Homo sapiens
ucacuggcgcuguagauua

SEQ ID NO: 633634 - RNA, 19 nt, Homo sapiens
gaauuuggcgucuugauag

SEQ ID NO: 633635 - RNA, 19 nt, Homo sapiens
ucaggacucugucuuuguu

SEQ ID NO: 633636 - RNA, 19 nt, Homo sapiens
uacaagaggcugacacuuu

SEQ ID NO: 633637 - RNA, 19 nt, Homo sapiens
uuaaacaugucgaccaguu

SEQ ID NO: 633638 - RNA, 19 nt, Homo sapiens
gcagauccgugaggaggaa

SEQ ID NO: 633639 - RNA, 19 nt, Homo sapiens
uacagaaggugguagagaa

SEQ ID NO: 633640 - RNA, 19 nt, Homo sapiens
ugauaacgcggauagauuu

SEQ ID NO: 633641 - RNA, 19 nt, Homo sapiens
gcuuagccuuguucuguuu

SEQ ID NO: 633642 - RNA, 19 nt, Homo sapiens
cgaugacacuguuggaaga

SEQ ID NO: 633643 - RNA, 19 nt, Homo sapiens
cgaaggcagcuguggcuua

SEQ ID NO: 633644 - RNA, 19 nt, Homo sapiens
uuacucaacuuuacaaugc

SEQ ID NO: 633645 - RNA, 19 nt, Homo sapiens
gggaugcccagaucaaauu

SEQ ID NO: 633646 - RNA, 19 nt, Homo sapiens
caacuucugaugcugaauu

SEQ ID NO: 633647 - RNA, 19 nt, Homo sapiens
cgaaagcagccuuauuaga

SEQ ID NO: 633648 - RNA, 19 nt, Homo sapiens
cauacugaguguucuaaau

SEQ ID NO: 633649 - RNA, 19 nt, Homo sapiens
aaggaagugugcauuuauu

SEQ ID NO: 633650 - RNA, 19 nt, Homo sapiens
gaucacagcuacuuuucuu

SEQ ID NO: 633651 - RNA, 19 nt, Homo sapiens
gcacacuaaugagguccua

SEQ ID NO: 633652 - RNA, 19 nt, Homo sapiens
gaucaaauuucugaacacu

SEQ ID NO: 633653 - RNA, 19 nt, Homo sapiens
auaugcaccuguacaguaa

SEQ ID NO: 633654 - RNA, 19 nt, Homo sapiens
gcauggagagguugauaug

SEQ ID NO: 633655 - RNA, 19 nt, Homo sapiens
ggaagugugcauuuauuag

SEQ ID NO: 633656 - RNA, 19 nt, Homo sapiens
ucacaggaaguguucagua

SEQ ID NO: 633657 - RNA, 19 nt, Homo sapiens
aaugugaaauugcauguuc

SEQ ID NO: 633658 - RNA, 19 nt, Homo sapiens
agaauuuggcgucuugaua

SEQ ID NO: 633659 - RNA, 19 nt, Homo sapiens
ggagcuguguaaaccaguu

SEQ ID NO: 633660 - RNA, 19 nt, Homo sapiens
ggccugaguauucauguaa

SEQ ID NO: 633661 - RNA, 19 nt, Homo sapiens
ggccauugauaaagauaau

SEQ ID NO: 633662 - RNA, 19 nt, Homo sapiens
uaucagaacccgggagaaa

SEQ ID NO: 633663 - RNA, 19 nt, Homo sapiens
acaagaggcugacacuuuu

SEQ ID NO: 633664 - RNA, 19 nt, Homo sapiens
ccuaugacacuucuuauuc

SEQ ID NO: 633665 - RNA, 19 nt, Homo sapiens
caucauggacaucauaauc

SEQ ID NO: 633666 - RNA, 19 nt, Homo sapiens
gaaguguucaguaaaagua

SEQ ID NO: 633667 - RNA, 19 nt, Homo sapiens
cagcuuuagugcagaccua

SEQ ID NO: 633668 - RNA, 19 nt, Homo sapiens
ggcuggagcacacuaauga

SEQ ID NO: 633669 - RNA, 19 nt, Homo sapiens
aaauggcgaugacacuguu

SEQ ID NO: 633670 - RNA, 19 nt, Homo sapiens
gcaguuacggagcugugua

SEQ ID NO: 633671 - RNA, 19 nt, Homo sapiens
ucgaccaguuuaauugaaa

SEQ ID NO: 633672 - RNA, 19 nt, Homo sapiens
gaguccauaugguacaaga

SEQ ID NO: 633673 - RNA, 19 nt, Homo sapiens
ggccacccuucugcaguua

SEQ ID NO: 633674 - RNA, 19 nt, Homo sapiens
guuauucgcauccuuaagu

SEQ ID NO: 633675 - RNA, 19 nt, Homo sapiens
ggagaggaaaccuuugauc

SEQ ID NO: 633676 - RNA, 19 nt, Homo sapiens
gguggaccgugcaagaugu

SEQ ID NO: 633677 - RNA, 19 nt, Homo sapiens
ccauaaauuguuccagauu

SEQ ID NO: 633678 - RNA, 19 nt, Homo sapiens
caggaaguguucaguaaaa

SEQ ID NO: 633679 - RNA, 19 nt, Homo sapiens
agagcucacuggcgcugua

SEQ ID NO: 633680 - RNA, 19 nt, Homo sapiens
ccaggucuccuaccgaaug

SEQ ID NO: 633681 - RNA, 19 nt, Homo sapiens
gcaccuguacaguaauuca

SEQ ID NO: 633682 - RNA, 19 nt, Homo sapiens
gcagagaagggcgagauca

SEQ ID NO: 633683 - RNA, 19 nt, Homo sapiens
gaagugugcauuuauuagc

SEQ ID NO: 633684 - RNA, 19 nt, Homo sapiens
aggaagugugcauuuauua

SEQ ID NO: 633685 - RNA, 19 nt, Homo sapiens
ucugaguaguaaaggcuua

SEQ ID NO: 633686 - RNA, 19 nt, Homo sapiens
gaugugucucugaguagua

SEQ ID NO: 633687 - RNA, 19 nt, Homo sapiens
guuauucagccucuuguug

SEQ ID NO: 633688 - RNA, 19 nt, Homo sapiens
uugcaccucuuccuagcua

SEQ ID NO: 633689 - RNA, 19 nt, Homo sapiens
gcgaaccuaugacacuucu

SEQ ID NO: 633690 - RNA, 19 nt, Homo sapiens
ggaagaaaaugcgaaagca

SEQ ID NO: 633691 - RNA, 19 nt, Homo sapiens
gagugcaccuacggacuga

SEQ ID NO: 633692 - RNA, 19 nt, Homo sapiens
ggaugugaacucccagaga

SEQ ID NO: 633693 - RNA, 19 nt, Homo sapiens
accaguuucucauugcaua

SEQ ID NO: 633694 - RNA, 19 nt, Homo sapiens
ggacucugucuuuguuaau

SEQ ID NO: 633695 - RNA, 19 nt, Homo sapiens
gugggagugucugguauug

SEQ ID NO: 633696 - RNA, 19 nt, Homo sapiens
gcgaaagcagccuuauuag

SEQ ID NO: 633697 - RNA, 19 nt, Homo sapiens
caucauaaucaguugugaa

SEQ ID NO: 633698 - RNA, 19 nt, Homo sapiens
gugaugaggcugaaaucga

SEQ ID NO: 633699 - RNA, 19 nt, Homo sapiens
acugaguguucuaaauuug

SEQ ID NO: 633700 - RNA, 19 nt, Homo sapiens
gucgaccaguuuaauugaa

SEQ ID NO: 633701 - RNA, 19 nt, Homo sapiens
caugucgaccaguuuaauu

SEQ ID NO: 633702 - RNA, 19 nt, Homo sapiens
uggaaggaagugugcauuu

SEQ ID NO: 633703 - RNA, 19 nt, Homo sapiens
ggacaucauaaucaguugu

SEQ ID NO: 633704 - RNA, 19 nt, Homo sapiens
gagaucaggacucugucuu

SEQ ID NO: 633705 - RNA, 19 nt, Homo sapiens
ggaugcccagaucaaauuu

SEQ ID NO: 633706 - RNA, 19 nt, Homo sapiens
aggacucugucuuuguuaa

SEQ ID NO: 633707 - RNA, 19 nt, Homo sapiens
uuauucagccucuuguuga

SEQ ID NO: 633708 - RNA, 19 nt, Homo sapiens
ccagagaugccagcagaga

SEQ ID NO: 633709 - RNA, 19 nt, Homo sapiens
gcaagaagcugcggaggaa

SEQ ID NO: 633710 - RNA, 19 nt, Homo sapiens
gaucaaagggcuagaguuc

SEQ ID NO: 633711 - RNA, 19 nt, Homo sapiens
gugggcagcugcuucagua

SEQ ID NO: 633712 - RNA, 19 nt, Homo sapiens
ggaggaaguuacagaugug

SEQ ID NO: 633713 - RNA, 19 nt, Homo sapiens
ucaaagggcuagaguucuc

SEQ ID NO: 633714 - RNA, 19 nt, Homo sapiens
cggaggaaguuacagaugu

SEQ ID NO: 633715 - RNA, 19 nt, Homo sapiens
aagcagcgccuaagcaaga

SEQ ID NO: 633716 - RNA, 19 nt, Homo sapiens
gcaagaagcagcgccuaag

SEQ ID NO: 633717 - RNA, 19 nt, Homo sapiens
acacccagacccuaucuuu

SEQ ID NO: 633718 - RNA, 19 nt, Homo sapiens
ggcaagaagcagcgccuaa

SEQ ID NO: 633719 - RNA, 19 nt, Homo sapiens
acccagacccuaucuuuga

SEQ ID NO: 633720 - RNA, 19 nt, Homo sapiens
gaagcugcggaggaaguua

SEQ ID NO: 633721 - RNA, 19 nt, Homo sapiens
gaacacccagacccuaucu

SEQ ID NO: 633722 - RNA, 19 nt, Homo sapiens
ccagcacuaucuccacauc

SEQ ID NO: 633723 - RNA, 19 nt, Homo sapiens
agaagcagcgccuaagcaa

SEQ ID NO: 633724 - RNA, 19 nt, Homo sapiens
gagaucaaagggcuagagu

SEQ ID NO: 633725 - RNA, 19 nt, Homo sapiens
ccgagggcauggugugcaa

SEQ ID NO: 633726 - RNA, 19 nt, Homo sapiens
ugguggaccucaucgaaca

SEQ ID NO: 633727 - RNA, 19 nt, Homo sapiens
gcggaggaaguuacagaug

SEQ ID NO: 633728 - RNA, 19 nt, Homo sapiens
cuacgacccaggcuucaug

SEQ ID NO: 633729 - RNA, 19 nt, Homo sapiens
gaacucacuugaugggauu

SEQ ID NO: 633730 - RNA, 19 nt, Homo sapiens
gaagggagagcucgugaga

SEQ ID NO: 633731 - RNA, 19 nt, Homo sapiens
uugaugggauuauucguua

SEQ ID NO: 633732 - RNA, 19 nt, Homo sapiens
gacuggaacucacuugaug

SEQ ID NO: 633733 - RNA, 19 nt, Homo sapiens
gagacacacuucccagauc

SEQ ID NO: 633734 - RNA, 19 nt, Homo sapiens
gcacuaccacaggaaauaa

SEQ ID NO: 633735 - RNA, 19 nt, Homo sapiens
agggagagcucgugagaug

SEQ ID NO: 633736 - RNA, 19 nt, Homo sapiens
ugucaacccucuccacuuc

SEQ ID NO: 633737 - RNA, 19 nt, Homo sapiens
gaagaaguuuccgcuggau

SEQ ID NO: 633738 - RNA, 19 nt, Homo sapiens
gaucugggcgaccacguuu

SEQ ID NO: 633739 - RNA, 19 nt, Homo sapiens
cccuagcucuguagacuaa

SEQ ID NO: 633740 - RNA, 19 nt, Homo sapiens
gccaacagacuauguggaa

SEQ ID NO: 633741 - RNA, 19 nt, Homo sapiens
agacacacuucccagauca

SEQ ID NO: 633742 - RNA, 19 nt, Homo sapiens
gaugggauuauucguuaaa

SEQ ID NO: 633743 - RNA, 19 nt, Homo sapiens
ggacuggaacucacuugau

SEQ ID NO: 633744 - RNA, 19 nt, Homo sapiens
ggagacacacuucccagau

SEQ ID NO: 633745 - RNA, 19 nt, Homo sapiens
caagugauccugcgauagg

SEQ ID NO: 633746 - RNA, 19 nt, Homo sapiens
ccggguggcuucuucaauc

SEQ ID NO: 633747 - RNA, 19 nt, Homo sapiens
uacauccgcuuuaaagaca

SEQ ID NO: 633748 - RNA, 19 nt, Homo sapiens
gaaccugacauggccauuc

SEQ ID NO: 633749 - RNA, 19 nt, Homo sapiens
gcucuacauccgcuuuaaa

SEQ ID NO: 633750 - RNA, 19 nt, Homo sapiens
cagcggagccagauucauc

SEQ ID NO: 633751 - RNA, 19 nt, Homo sapiens
caggaggaccgcuaugaga

SEQ ID NO: 633752 - RNA, 19 nt, Homo sapiens
agcaagugauccugcgaua

SEQ ID NO: 633753 - RNA, 19 nt, Homo sapiens
gguuuuaagugacaaagaa

SEQ ID NO: 633754 - RNA, 19 nt, Homo sapiens
gggauuauucguuaaaugc

SEQ ID NO: 633755 - RNA, 19 nt, Homo sapiens
gggacaggguuuuaaguga

SEQ ID NO: 633756 - RNA, 19 nt, Homo sapiens
ugagugauccggaggagau

SEQ ID NO: 633757 - RNA, 19 nt, Homo sapiens
ggaaccaccgcuuaaaucg

SEQ ID NO: 633758 - RNA, 19 nt, Homo sapiens
gcgcucuacauccgcuuua

SEQ ID NO: 633759 - RNA, 19 nt, Homo sapiens
ugaugggauuauucguuaa

SEQ ID NO: 633760 - RNA, 19 nt, Homo sapiens
cgugagaugggaagaaguu

SEQ ID NO: 633761 - RNA, 19 nt, Homo sapiens
gcaggaggaccgcuaugag

SEQ ID NO: 633762 - RNA, 19 nt, Homo sapiens
ccacccaccucgcuuucuc

SEQ ID NO: 633763 - RNA, 19 nt, Homo sapiens
gcagccaacagacuaugug

SEQ ID NO: 633764 - RNA, 19 nt, Homo sapiens
ccucugcaccaaagaaguu

SEQ ID NO: 633765 - RNA, 19 nt, Homo sapiens
ugggauuauucguuaaaug

SEQ ID NO: 633766 - RNA, 19 nt, Homo sapiens
ucacuugaugggauuauuc

SEQ ID NO: 633767 - RNA, 19 nt, Homo sapiens
uaaaucggacuggaacuca

SEQ ID NO: 633768 - RNA, 19 nt, Homo sapiens
aauaaaacgcgcuguaaaa

SEQ ID NO: 633769 - RNA, 19 nt, Homo sapiens
ggcccuagcucuguagacu

SEQ ID NO: 633770 - RNA, 19 nt, Homo sapiens
ggaucugggcgaccacguu

SEQ ID NO: 633771 - RNA, 19 nt, Homo sapiens
gcaagugauccugcgauag

SEQ ID NO: 633772 - RNA, 19 nt, Homo sapiens
ggcuuaccauagcaaguga

SEQ ID NO: 633773 - RNA, 19 nt, Homo sapiens
ucaacccucuccacuucug

SEQ ID NO: 633774 - RNA, 19 nt, Homo sapiens
agaaguuuccgcuggauuc

SEQ ID NO: 633775 - RNA, 19 nt, Homo sapiens
cauccgcuuuaaagacaga

SEQ ID NO: 633776 - RNA, 19 nt, Homo sapiens
ggaggaccgcuaugagaac

SEQ ID NO: 633777 - RNA, 19 nt, Homo sapiens
uaauaaaacgcgcuguaaa

SEQ ID NO: 633778 - RNA, 19 nt, Homo sapiens
cuacauccgcuuuaaagac

SEQ ID NO: 633779 - RNA, 19 nt, Homo sapiens
uggaaccaccgcuuaaauc

SEQ ID NO: 633780 - RNA, 19 nt, Homo sapiens
gagagguccugccagauaa

SEQ ID NO: 633781 - RNA, 19 nt, Homo sapiens
ccaagaacaugaaggacuu

SEQ ID NO: 633782 - RNA, 19 nt, Homo sapiens
cgagagguccugccagaua

SEQ ID NO: 633783 - RNA, 19 nt, Homo sapiens
ggaaggugguggacgaugu

SEQ ID NO: 633784 - RNA, 19 nt, Homo sapiens
ccaaggaccuggcucucuu

SEQ ID NO: 633785 - RNA, 19 nt, Homo sapiens
gagaaacccgucaacauca

SEQ ID NO: 633786 - RNA, 19 nt, Homo sapiens
ggaccuggcucucuuuacg

SEQ ID NO: 633787 - RNA, 19 nt, Homo sapiens
caacacaugugaggaguac

SEQ ID NO: 633788 - RNA, 19 nt, Homo sapiens
gagccuggaugcagaaguc

SEQ ID NO: 633789 - RNA, 19 nt, Homo sapiens
gauguacucacgcuggaua

SEQ ID NO: 633790 - RNA, 19 nt, Homo sapiens
ggcgcgagcucaagcaguu

SEQ ID NO: 633791 - RNA, 19 nt, Homo sapiens
aguacaagcuuagguggua

SEQ ID NO: 633792 - RNA, 19 nt, Homo sapiens
ucaagaagcacgcguacug

SEQ ID NO: 633793 - RNA, 19 nt, Homo sapiens
agagaaacccgucaacauc

SEQ ID NO: 633794 - RNA, 19 nt, Homo sapiens
gccgggaucuggagugagu

SEQ ID NO: 633795 - RNA, 19 nt, Homo sapiens
cagagaaacccgucaacau

SEQ ID NO: 633796 - RNA, 19 nt, Homo sapiens
guacaagcuuaggugguau

SEQ ID NO: 633797 - RNA, 19 nt, Homo sapiens
gguccaagaacaugaagga

SEQ ID NO: 633798 - RNA, 19 nt, Homo sapiens
caucuauggcuccaagaaa

SEQ ID NO: 633799 - RNA, 19 nt, Homo sapiens
caauucggcugcucagacu

SEQ ID NO: 633800 - RNA, 19 nt, Homo sapiens
augcagaagucgcacaaga

SEQ ID NO: 633801 - RNA, 19 nt, Homo sapiens
gcaucuauggcuccaagaa

SEQ ID NO: 633802 - RNA, 19 nt, Homo sapiens
cauuagcgccuugucaauu

SEQ ID NO: 633803 - RNA, 19 nt, Homo sapiens
ucccucaaguacaagcuua

SEQ ID NO: 633804 - RNA, 19 nt, Homo sapiens
ugugaggguugguugaguu

SEQ ID NO: 633805 - RNA, 19 nt, Homo sapiens
gaaggugguggacgaugug

SEQ ID NO: 633806 - RNA, 19 nt, Homo sapiens
ccugagcucucccguguac

SEQ ID NO: 633807 - RNA, 19 nt, Homo sapiens
caaggaccuggcucucuuu

SEQ ID NO: 633808 - RNA, 19 nt, Homo sapiens
gccaggacaacacauguga

SEQ ID NO: 633809 - RNA, 19 nt, Homo sapiens
gcauuagcgccuugucaau

SEQ ID NO: 633810 - RNA, 19 nt, Homo sapiens
ggaugcagaagucgcacaa

SEQ ID NO: 633811 - RNA, 19 nt, Homo sapiens
uuccugggcuggcucaaga

SEQ ID NO: 633812 - RNA, 19 nt, Homo sapiens
auuagcgccuugucaauuc

SEQ ID NO: 633813 - RNA, 19 nt, Homo sapiens
agaccuuccuccacaccaa

SEQ ID NO: 633814 - RNA, 19 nt, Homo sapiens
uugguugaguugccuagaa

SEQ ID NO: 633815 - RNA, 19 nt, Homo sapiens
ggccauaacagcucugacu

SEQ ID NO: 633816 - RNA, 19 nt, Homo sapiens
caggaucccacgcuucuca

SEQ ID NO: 633817 - RNA, 19 nt, Homo sapiens
ccagagaaacccgucaaca

SEQ ID NO: 633818 - RNA, 19 nt, Homo sapiens
ccacgugaggccaccuuug

SEQ ID NO: 633819 - RNA, 19 nt, Homo sapiens
aagccgggaucuggaguga

SEQ ID NO: 633820 - RNA, 19 nt, Homo sapiens
gcucucccguguacucaac

SEQ ID NO: 633821 - RNA, 19 nt, Homo sapiens
gaaacccggcaccguguac

SEQ ID NO: 633822 - RNA, 19 nt, Homo sapiens
ggacaugguuguucacauu

SEQ ID NO: 633823 - RNA, 19 nt, Homo sapiens
gaaaggaaguucauacagu

SEQ ID NO: 633824 - RNA, 19 nt, Homo sapiens
gagagaagcuacuaaagga

SEQ ID NO: 633825 - RNA, 19 nt, Homo sapiens
gaagaauaccuacguuaua

SEQ ID NO: 633826 - RNA, 19 nt, Homo sapiens
gcaaagaggucuaucaacu

SEQ ID NO: 633827 - RNA, 19 nt, Homo sapiens
gaauguuucugcaugauuu

SEQ ID NO: 633828 - RNA, 19 nt, Homo sapiens
gagcugccguuccuaauaa

SEQ ID NO: 633829 - RNA, 19 nt, Homo sapiens
ggacggacuuuccuauaaa

SEQ ID NO: 633830 - RNA, 19 nt, Homo sapiens
uaagagggcugcuauuaga

SEQ ID NO: 633831 - RNA, 19 nt, Homo sapiens
gauaagagggcugcuauua

SEQ ID NO: 633832 - RNA, 19 nt, Homo sapiens
gugaagagaucaucccuaa

SEQ ID NO: 633833 - RNA, 19 nt, Homo sapiens
aaugagaacugcugugaua

SEQ ID NO: 633834 - RNA, 19 nt, Homo sapiens
ccacuaacuuucucacuaa

SEQ ID NO: 633835 - RNA, 19 nt, Homo sapiens
gggacggacuuuccuauaa

SEQ ID NO: 633836 - RNA, 19 nt, Homo sapiens
gaggagaacuuugauggaa

SEQ ID NO: 633837 - RNA, 19 nt, Homo sapiens
gcaagagcauguacaaaca

SEQ ID NO: 633838 - RNA, 19 nt, Homo sapiens
ggaauagcauggagucaga

SEQ ID NO: 633839 - RNA, 19 nt, Homo sapiens
gaaacccgcuggaaauauc

SEQ ID NO: 633840 - RNA, 19 nt, Homo sapiens
gaccagggcuuugcaauuc

SEQ ID NO: 633841 - RNA, 19 nt, Homo sapiens
gaaauaucacuuugaggua

SEQ ID NO: 633842 - RNA, 19 nt, Homo sapiens
caaagaaacccgcuggaaa

SEQ ID NO: 633843 - RNA, 19 nt, Homo sapiens
gaacauauacuguguccau

SEQ ID NO: 633844 - RNA, 19 nt, Homo sapiens
guacaaacaugcucagaac

SEQ ID NO: 633845 - RNA, 19 nt, Homo sapiens
gaaggagggauauguggua

SEQ ID NO: 633846 - RNA, 19 nt, Homo sapiens
gagguggaguucccuauug

SEQ ID NO: 633847 - RNA, 19 nt, Homo sapiens
aaaggaaguucauacaguu

SEQ ID NO: 633848 - RNA, 19 nt, Homo sapiens
gcaaagaagagguggaguu

SEQ ID NO: 633849 - RNA, 19 nt, Homo sapiens
cuucuguacuguuaacuua

SEQ ID NO: 633850 - RNA, 19 nt, Homo sapiens
caaacaugcucagaacuug

SEQ ID NO: 633851 - RNA, 19 nt, Homo sapiens
ucucagacaugacuucuau

SEQ ID NO: 633852 - RNA, 19 nt, Homo sapiens
ggagcugccguuccuaaua

SEQ ID NO: 633853 - RNA, 19 nt, Homo sapiens
agagacacauuacaccuaa

SEQ ID NO: 633854 - RNA, 19 nt, Homo sapiens
gguccaggcucucaagaug

SEQ ID NO: 633855 - RNA, 19 nt, Homo sapiens
gcucugggcugcuauaugc

SEQ ID NO: 633856 - RNA, 19 nt, Homo sapiens
gaacuuccuucuguacugu

SEQ ID NO: 633857 - RNA, 19 nt, Homo sapiens
gcucagugccguggaaaua

SEQ ID NO: 633858 - RNA, 19 nt, Homo sapiens
gagaagcuacuaaaggauu

SEQ ID NO: 633859 - RNA, 19 nt, Homo sapiens
aaagaggucuaucaacugu

SEQ ID NO: 633860 - RNA, 19 nt, Homo sapiens
gaagagaucaucccuaagc

SEQ ID NO: 633861 - RNA, 19 nt, Homo sapiens
aaagagcaaugcagagaug

SEQ ID NO: 633862 - RNA, 19 nt, Homo sapiens
ggaguucccuauugcauac

SEQ ID NO: 633863 - RNA, 19 nt, Homo sapiens
ccuaauaauuccagguuug

SEQ ID NO: 633864 - RNA, 19 nt, Homo sapiens
ggacuugaauuggaugcuu

SEQ ID NO: 633865 - RNA, 19 nt, Homo sapiens
acccaaagguagaugauaa

SEQ ID NO: 633866 - RNA, 19 nt, Homo sapiens
gguagugagagacacauua

SEQ ID NO: 633867 - RNA, 19 nt, Homo sapiens
aaagaaacccgcuggaaau

SEQ ID NO: 633868 - RNA, 19 nt, Homo sapiens
ggagagaagcuacuaaagg

SEQ ID NO: 633869 - RNA, 19 nt, Homo sapiens
gcaauucguggcauccuuu

SEQ ID NO: 633870 - RNA, 19 nt, Homo sapiens
gagagacacauuacaccua

SEQ ID NO: 633871 - RNA, 19 nt, Homo sapiens
guagagcacuugauuucag

SEQ ID NO: 633872 - RNA, 19 nt, Homo sapiens
cccaacaacugauugaaug

SEQ ID NO: 633873 - RNA, 19 nt, Homo sapiens
ugacgaugguucaauggaa

SEQ ID NO: 633874 - RNA, 19 nt, Homo sapiens
gagauuucguccaacaugu

SEQ ID NO: 633875 - RNA, 19 nt, Homo sapiens
ggucaaagcaauuauuucu

SEQ ID NO: 633876 - RNA, 19 nt, Homo sapiens
ggagagugaaggagggaua

SEQ ID NO: 633877 - RNA, 19 nt, Homo sapiens
gaacuuugagacacacuau

SEQ ID NO: 633878 - RNA, 19 nt, Homo sapiens
cuaugggacugaacuuuga

SEQ ID NO: 633879 - RNA, 19 nt, Homo sapiens
gaugagaaguccccagaaa

SEQ ID NO: 633880 - RNA, 19 nt, Homo sapiens
uagaagaauaccuacguua

SEQ ID NO: 633881 - RNA, 19 nt, Homo sapiens
ucucaaagccaguacugua

SEQ ID NO: 633882 - RNA, 19 nt, Homo sapiens
ggagggauaugugguagag

SEQ ID NO: 633883 - RNA, 19 nt, Homo sapiens
caaagaggcggucaaagca

SEQ ID NO: 633884 - RNA, 19 nt, Homo sapiens
gcugguagcuuuuccauuc

SEQ ID NO: 633885 - RNA, 19 nt, Homo sapiens
aaagguagaugauaaugcu

SEQ ID NO: 633886 - RNA, 19 nt, Homo sapiens
caaagccaguacuguagga

SEQ ID NO: 633887 - RNA, 19 nt, Homo sapiens
gauaugugguagagcacuu

SEQ ID NO: 633888 - RNA, 19 nt, Homo sapiens
gugcuuagaagaauaccua

SEQ ID NO: 633889 - RNA, 19 nt, Homo sapiens
cauuacaccuaaccaacaa

SEQ ID NO: 633890 - RNA, 19 nt, Homo sapiens
gcggucaaagcaauuauuu

SEQ ID NO: 633891 - RNA, 19 nt, Homo sapiens
agaagaagcgagagccuuu

SEQ ID NO: 633892 - RNA, 19 nt, Homo sapiens
uccacuaacuuucucacua

SEQ ID NO: 633893 - RNA, 19 nt, Homo sapiens
ggugaaugcugcuuguucu

SEQ ID NO: 633894 - RNA, 19 nt, Homo sapiens
auaaugcucuucagugcuu

SEQ ID NO: 633895 - RNA, 19 nt, Homo sapiens
caacugauugaauggguaa

SEQ ID NO: 633896 - RNA, 19 nt, Homo sapiens
ggugcaagcugaccucaac

SEQ ID NO: 633897 - RNA, 19 nt, Homo sapiens
cauauacuguguccaugug

SEQ ID NO: 633898 - RNA, 19 nt, Homo sapiens
caaagaagagguggaguuc

SEQ ID NO: 633899 - RNA, 19 nt, Homo sapiens
gaagcgagagccuuucaca

SEQ ID NO: 633900 - RNA, 19 nt, Homo sapiens
cagcaaagaggucuaucaa

SEQ ID NO: 633901 - RNA, 19 nt, Homo sapiens
agccaguacuguaggaaua

SEQ ID NO: 633902 - RNA, 19 nt, Homo sapiens
uaacguggaggagaacuuu

SEQ ID NO: 633903 - RNA, 19 nt, Homo sapiens
aagaggagccugaaacugu

SEQ ID NO: 633904 - RNA, 19 nt, Homo sapiens
caaagaggucuaucaacug

SEQ ID NO: 633905 - RNA, 19 nt, Homo sapiens
ucagacaugacuucuauug

SEQ ID NO: 633906 - RNA, 19 nt, Homo sapiens
guggaugccuggcucuguu

SEQ ID NO: 633907 - RNA, 19 nt, Homo sapiens
uagcauggagucagaggua

SEQ ID NO: 633908 - RNA, 19 nt, Homo sapiens
cuucccaaaugucuucaua

SEQ ID NO: 633909 - RNA, 19 nt, Homo sapiens
ggaccaagaggcagugcuu

SEQ ID NO: 633910 - RNA, 19 nt, Homo sapiens
aaacuuucuuucagguuga

SEQ ID NO: 633911 - RNA, 19 nt, Homo sapiens
ccucuacuuugcagauauu

SEQ ID NO: 633912 - RNA, 19 nt, Homo sapiens
caggagagaagcuacuaaa

SEQ ID NO: 633913 - RNA, 19 nt, Homo sapiens
agaggagccugaaacuguu

SEQ ID NO: 633914 - RNA, 19 nt, Homo sapiens
uaagugagaaugagaacug

SEQ ID NO: 633915 - RNA, 19 nt, Homo sapiens
agaagaauaccuacguuau

SEQ ID NO: 633916 - RNA, 19 nt, Homo sapiens
ccaaguacgacaucucaga

SEQ ID NO: 633917 - RNA, 19 nt, Homo sapiens
ggugauucaugagaagauu

SEQ ID NO: 633918 - RNA, 19 nt, Homo sapiens
gugugacucugaccacuug

SEQ ID NO: 633919 - RNA, 19 nt, Homo sapiens
gcaggagagaagcuacuaa

SEQ ID NO: 633920 - RNA, 19 nt, Homo sapiens
ggaggagaacuuugaugga

SEQ ID NO: 633921 - RNA, 19 nt, Homo sapiens
agaggucuaucaacuguuc

SEQ ID NO: 633922 - RNA, 19 nt, Homo sapiens
gaaaccauguucuugcuua

SEQ ID NO: 633923 - RNA, 19 nt, Homo sapiens
gaaagaaugccgaagaguu

SEQ ID NO: 633924 - RNA, 19 nt, Homo sapiens
gaguuuaaguuugcaguua

SEQ ID NO: 633925 - RNA, 19 nt, Homo sapiens
ugaaggagcuggaggaucu

SEQ ID NO: 633926 - RNA, 19 nt, Homo sapiens
ucaaugugcuggugaauag

SEQ ID NO: 633927 - RNA, 19 nt, Homo sapiens
gugaauagaccgaauauca

SEQ ID NO: 633928 - RNA, 19 nt, Homo sapiens
ccaagggaguuuaaguuug

SEQ ID NO: 633929 - RNA, 19 nt, Homo sapiens
guauauauccuccagcauu

SEQ ID NO: 633930 - RNA, 19 nt, Homo sapiens
gacgagaacggacagauuu

SEQ ID NO: 633931 - RNA, 19 nt, Homo sapiens
ggacgagaacggacagauu

SEQ ID NO: 633932 - RNA, 19 nt, Homo sapiens
gucacaaucugaagaauca

SEQ ID NO: 633933 - RNA, 19 nt, Homo sapiens
caagggaguuuaaguuugc

SEQ ID NO: 633934 - RNA, 19 nt, Homo sapiens
cuucuuagguuguuaguca

SEQ ID NO: 633935 - RNA, 19 nt, Homo sapiens
guucaagccucccaugauc

SEQ ID NO: 633936 - RNA, 19 nt, Homo sapiens
ggaccaggccucagacugu

SEQ ID NO: 633937 - RNA, 19 nt, Homo sapiens
ccuguuagauugccaguuc

SEQ ID NO: 633938 - RNA, 19 nt, Homo sapiens
gccaagggaguuuaaguuu

SEQ ID NO: 633939 - RNA, 19 nt, Homo sapiens
gaguguguguguuguguau

SEQ ID NO: 633940 - RNA, 19 nt, Homo sapiens
gaugggaauauacagauuu

SEQ ID NO: 633941 - RNA, 19 nt, Homo sapiens
gcacuggauccucggcaua

SEQ ID NO: 633942 - RNA, 19 nt, Homo sapiens
ggccucagacugugaagua

SEQ ID NO: 633943 - RNA, 19 nt, Homo sapiens
aaaccauguucuugcuuaa

SEQ ID NO: 633944 - RNA, 19 nt, Homo sapiens
gucauuaguuugugugugu

SEQ ID NO: 633945 - RNA, 19 nt, Homo sapiens
gguuguuagucauuaguuu

SEQ ID NO: 633946 - RNA, 19 nt, Homo sapiens
uauauauccuccagcauuc

SEQ ID NO: 633947 - RNA, 19 nt, Homo sapiens
ccaagccacugaugggaau

SEQ ID NO: 633948 - RNA, 19 nt, Homo sapiens
cagaaagaaugccgaagag

SEQ ID NO: 633949 - RNA, 19 nt, Homo sapiens
ucagaaagaaugccgaaga

SEQ ID NO: 633950 - RNA, 19 nt, Homo sapiens
aaagaaugccgaagaguuc

SEQ ID NO: 633951 - RNA, 19 nt, Homo sapiens
ccggagcuguucagaaaga

SEQ ID NO: 633952 - RNA, 19 nt, Homo sapiens
ggaauauacagauuuaggu

SEQ ID NO: 633953 - RNA, 19 nt, Homo sapiens
auccggagcuguucagaaa

SEQ ID NO: 633954 - RNA, 19 nt, Homo sapiens
guucuugcuuaagccauua

SEQ ID NO: 633955 - RNA, 19 nt, Homo sapiens
ccacggaaaccauguucuu

SEQ ID NO: 633956 - RNA, 19 nt, Homo sapiens
ucgcugaccugcugacaca

SEQ ID NO: 633957 - RNA, 19 nt, Homo sapiens
gcaugcgaguggugaagga

SEQ ID NO: 633958 - RNA, 19 nt, Homo sapiens
gaaccuguccagcgaugau

SEQ ID NO: 633959 - RNA, 19 nt, Homo sapiens
ugaugggaauauacagauu

SEQ ID NO: 633960 - RNA, 19 nt, Homo sapiens
guccagcgaugaugccaau

SEQ ID NO: 633961 - RNA, 19 nt, Homo sapiens
caaauucacaaccaagauc

SEQ ID NO: 633962 - RNA, 19 nt, Homo sapiens
ccuccuaacucauguucug

SEQ ID NO: 633963 - RNA, 19 nt, Homo sapiens
gagcuguucagaaagaaug

SEQ ID NO: 633964 - RNA, 19 nt, Homo sapiens
cuuagguuguuagucauua

SEQ ID NO: 633965 - RNA, 19 nt, Homo sapiens
ccucagacugugaaguaua

SEQ ID NO: 633966 - RNA, 19 nt, Homo sapiens
ggaugagucacaaucugaa

SEQ ID NO: 633967 - RNA, 19 nt, Homo sapiens
ccacugaugggaauauaca

SEQ ID NO: 633968 - RNA, 19 nt, Homo sapiens
cucagacugugaaguauau

SEQ ID NO: 633969 - RNA, 19 nt, Homo sapiens
aaacuuccauccugaaaau

SEQ ID NO: 633970 - RNA, 19 nt, Homo sapiens
gggaauauacagauuuagg

SEQ ID NO: 633971 - RNA, 19 nt, Homo sapiens
cagauuugccugcccauca

SEQ ID NO: 633972 - RNA, 19 nt, Homo sapiens
ucaaacuuccauccugaaa

SEQ ID NO: 633973 - RNA, 19 nt, Homo sapiens
ggaguuuaaguuugcaguu

SEQ ID NO: 633974 - RNA, 19 nt, Homo sapiens
ggaaaccauguucuugcuu

SEQ ID NO: 633975 - RNA, 19 nt, Homo sapiens
gagccaagggaguuuaagu

SEQ ID NO: 633976 - RNA, 19 nt, Homo sapiens
ggacucacucccagguuca

SEQ ID NO: 633977 - RNA, 19 nt, Homo sapiens
guuagucauuaguuugugu

SEQ ID NO: 633978 - RNA, 19 nt, Homo sapiens
ccacggaugagucacaauc

SEQ ID NO: 633979 - RNA, 19 nt, Homo sapiens
ccagagccaagggaguuua

SEQ ID NO: 633980 - RNA, 19 nt, Homo sapiens
cggaugagucacaaucuga

SEQ ID NO: 633981 - RNA, 19 nt, Homo sapiens
ccacuugccauccuguuag

SEQ ID NO: 633982 - RNA, 19 nt, Homo sapiens
ugagucacaaucugaagaa

SEQ ID NO: 633983 - RNA, 19 nt, Homo sapiens
cagcgaugaugccaauguc

SEQ ID NO: 633984 - RNA, 19 nt, Homo sapiens
ugaucaaauucacaaccaa

SEQ ID NO: 633985 - RNA, 19 nt, Homo sapiens
gacccucugugcacuggau

SEQ ID NO: 633986 - RNA, 19 nt, Homo sapiens
gcuggugaauagaccgaau

SEQ ID NO: 633987 - RNA, 19 nt, Homo sapiens
gcaguuacaggccaguucu

SEQ ID NO: 633988 - RNA, 19 nt, Homo sapiens
guuguuagucauuaguuug

SEQ ID NO: 633989 - RNA, 19 nt, Homo sapiens
agaguucacccuccgauuc

SEQ ID NO: 633990 - RNA, 19 nt, Homo sapiens
ucaagccucccaugaucaa

SEQ ID NO: 633991 - RNA, 19 nt, Homo sapiens
cuccagcucuccaucuuag

SEQ ID NO: 633992 - RNA, 19 nt, Homo sapiens
guuuaaguuugcaguuaca

SEQ ID NO: 633993 - RNA, 19 nt, Homo sapiens
ugaauagaccgaauaucag

SEQ ID NO: 633994 - RNA, 19 nt, Homo sapiens
cacaaucugaagaaucaaa

SEQ ID NO: 633995 - RNA, 19 nt, Homo sapiens
gagcuggaggaucuucaga

SEQ ID NO: 633996 - RNA, 19 nt, Homo sapiens
cagagccaagggaguuuaa

SEQ ID NO: 633997 - RNA, 19 nt, Homo sapiens
gagucacaaucugaagaau

SEQ ID NO: 633998 - RNA, 19 nt, Homo sapiens
ucaaauucacaaccaagau

SEQ ID NO: 633999 - RNA, 19 nt, Homo sapiens
ucccacacccuuuacauuc

SEQ ID NO: 634000 - RNA, 19 nt, Homo sapiens
guguguguguuguguaugg

SEQ ID NO: 634001 - RNA, 19 nt, Homo sapiens
cggaaaccauguucuugcu

SEQ ID NO: 634002 - RNA, 19 nt, Homo sapiens
ccagcgaugaugccaaugu

SEQ ID NO: 634003 - RNA, 19 nt, Homo sapiens
agccucccaugaucaaauu

SEQ ID NO: 634004 - RNA, 19 nt, Homo sapiens
gaaaccagcuucccuauuc

SEQ ID NO: 634005 - RNA, 19 nt, Homo sapiens
caacauaccucccuuggaa

SEQ ID NO: 634006 - RNA, 19 nt, Homo sapiens
gagagaagcuuugauuuca

SEQ ID NO: 634007 - RNA, 19 nt, Homo sapiens
gaacaaauaagcaaacugu

SEQ ID NO: 634008 - RNA, 19 nt, Homo sapiens
gaaacuggcuacaauacau

SEQ ID NO: 634009 - RNA, 19 nt, Homo sapiens
caaagaaacacagauagua

SEQ ID NO: 634010 - RNA, 19 nt, Homo sapiens
gaaaccagcucuuggaaaa

SEQ ID NO: 634011 - RNA, 19 nt, Homo sapiens
uaacuaugcuccugaagau

SEQ ID NO: 634012 - RNA, 19 nt, Homo sapiens
gcccauaucccacccuuua

SEQ ID NO: 634013 - RNA, 19 nt, Homo sapiens
aaauggcaaugaucucuua

SEQ ID NO: 634014 - RNA, 19 nt, Homo sapiens
cagagugggucccuucuuu

SEQ ID NO: 634015 - RNA, 19 nt, Homo sapiens
gaguagaagucaaggauuc

SEQ ID NO: 634016 - RNA, 19 nt, Homo sapiens
caugauaguuuccauaaca

SEQ ID NO: 634017 - RNA, 19 nt, Homo sapiens
ggauuaccauuguacuaaa

SEQ ID NO: 634018 - RNA, 19 nt, Homo sapiens
ccagaagacuuugauauag

SEQ ID NO: 634019 - RNA, 19 nt, Homo sapiens
agagacagccuaacaauga

SEQ ID NO: 634020 - RNA, 19 nt, Homo sapiens
ggaaagcgcgagcgaguug

SEQ ID NO: 634021 - RNA, 19 nt, Homo sapiens
ccaccaguaucccuaauga

SEQ ID NO: 634022 - RNA, 19 nt, Homo sapiens
caaggauucugguucuuau

SEQ ID NO: 634023 - RNA, 19 nt, Homo sapiens
uaacagagacagccuaaca

SEQ ID NO: 634024 - RNA, 19 nt, Homo sapiens
guaggagguuaaauacuga

SEQ ID NO: 634025 - RNA, 19 nt, Homo sapiens
ggaaauuucacacagcauu

SEQ ID NO: 634026 - RNA, 19 nt, Homo sapiens
gcagggaaaugugaaaugg

SEQ ID NO: 634027 - RNA, 19 nt, Homo sapiens
gaaauacucaagcccaaga

SEQ ID NO: 634028 - RNA, 19 nt, Homo sapiens
gcaaagaaacacagauagu

SEQ ID NO: 634029 - RNA, 19 nt, Homo sapiens
uauaaggauuccaccagua

SEQ ID NO: 634030 - RNA, 19 nt, Homo sapiens
ccaagggaguucaugauca

SEQ ID NO: 634031 - RNA, 19 nt, Homo sapiens
guuaaauacugaccuaagu

SEQ ID NO: 634032 - RNA, 19 nt, Homo sapiens
gugcaaagaaacacagaua

SEQ ID NO: 634033 - RNA, 19 nt, Homo sapiens
cagaagacuuugauauagu

SEQ ID NO: 634034 - RNA, 19 nt, Homo sapiens
gcagagacuugggaugugu

SEQ ID NO: 634035 - RNA, 19 nt, Homo sapiens
gagcaaaucagagacagaa

SEQ ID NO: 634036 - RNA, 19 nt, Homo sapiens
gaccagagagcaaaucaga

SEQ ID NO: 634037 - RNA, 19 nt, Homo sapiens
ccuagaggcugccaaaaua

SEQ ID NO: 634038 - RNA, 19 nt, Homo sapiens
gcuaugaaauacagugaca

SEQ ID NO: 634039 - RNA, 19 nt, Homo sapiens
ggaaaccagcucuuggaaa

SEQ ID NO: 634040 - RNA, 19 nt, Homo sapiens
caagggaguucaugaucau

SEQ ID NO: 634041 - RNA, 19 nt, Homo sapiens
uaacugucauucugcuuug

SEQ ID NO: 634042 - RNA, 19 nt, Homo sapiens
gcuacaauacauagaagua

SEQ ID NO: 634043 - RNA, 19 nt, Homo sapiens
gaaacacagauaguaguaa

SEQ ID NO: 634044 - RNA, 19 nt, Homo sapiens
gccacucgcccuuauuaua

SEQ ID NO: 634045 - RNA, 19 nt, Homo sapiens
agacagcaguggucauuuc

SEQ ID NO: 634046 - RNA, 19 nt, Homo sapiens
gaagcgccaucaagagaca

SEQ ID NO: 634047 - RNA, 19 nt, Homo sapiens
uguaggagguuaaauacug

SEQ ID NO: 634048 - RNA, 19 nt, Homo sapiens
ccagagagcaaaucagaga

SEQ ID NO: 634049 - RNA, 19 nt, Homo sapiens
ccauaucccacccuuuaua

SEQ ID NO: 634050 - RNA, 19 nt, Homo sapiens
caagacagcaguggucauu

SEQ ID NO: 634051 - RNA, 19 nt, Homo sapiens
ucaaggauucugguucuua

SEQ ID NO: 634052 - RNA, 19 nt, Homo sapiens
ggacuaaccaugggcaguu

SEQ ID NO: 634053 - RNA, 19 nt, Homo sapiens
gaagaagcgccaucaagag

SEQ ID NO: 634054 - RNA, 19 nt, Homo sapiens
agaagaagcgccaucaaga

SEQ ID NO: 634055 - RNA, 19 nt, Homo sapiens
caccuugugugcaaagaaa

SEQ ID NO: 634056 - RNA, 19 nt, Homo sapiens
uccagaagacuuugauaua

SEQ ID NO: 634057 - RNA, 19 nt, Homo sapiens
gaaggcaugcccuaacugu

SEQ ID NO: 634058 - RNA, 19 nt, Homo sapiens
gaugaguuguauuuaaugg

SEQ ID NO: 634059 - RNA, 19 nt, Homo sapiens
uagagcaccuuagggaauu

SEQ ID NO: 634060 - RNA, 19 nt, Homo sapiens
gauucugguucuuauucua

SEQ ID NO: 634061 - RNA, 19 nt, Homo sapiens
gcagucaguuacucagaca

SEQ ID NO: 634062 - RNA, 19 nt, Homo sapiens
guaacuaugcuccugaaga

SEQ ID NO: 634063 - RNA, 19 nt, Homo sapiens
ugagagaagcuuugauuuc

SEQ ID NO: 634064 - RNA, 19 nt, Homo sapiens
uaugagagaagcuuugauu

SEQ ID NO: 634065 - RNA, 19 nt, Homo sapiens
caaagucugauguuuacaa

SEQ ID NO: 634066 - RNA, 19 nt, Homo sapiens
acaaauggccucuuucuac

SEQ ID NO: 634067 - RNA, 19 nt, Homo sapiens
gagacagccuaacaaugau

SEQ ID NO: 634068 - RNA, 19 nt, Homo sapiens
caaccacaauggccacauc

SEQ ID NO: 634069 - RNA, 19 nt, Homo sapiens
gaagaaggcaugcccuaac

SEQ ID NO: 634070 - RNA, 19 nt, Homo sapiens
gccuaacaaugaugaguug

SEQ ID NO: 634071 - RNA, 19 nt, Homo sapiens
cuuaucaccugagucauuu

SEQ ID NO: 634072 - RNA, 19 nt, Homo sapiens
cgacaaggcacggcugaaa

SEQ ID NO: 634073 - RNA, 19 nt, Homo sapiens
gaaguagugaggaaagugu

SEQ ID NO: 634074 - RNA, 19 nt, Homo sapiens
guugggagauucaccuugu

SEQ ID NO: 634075 - RNA, 19 nt, Homo sapiens
gaaauggcaaugaucucuu

SEQ ID NO: 634076 - RNA, 19 nt, Homo sapiens
ugaaauacagugacagugu

SEQ ID NO: 634077 - RNA, 19 nt, Homo sapiens
cauaucccacccuuuauaa

SEQ ID NO: 634078 - RNA, 19 nt, Homo sapiens
ucccaaagucugauguuua

SEQ ID NO: 634079 - RNA, 19 nt, Homo sapiens
gacaaauggccucuuucua

SEQ ID NO: 634080 - RNA, 19 nt, Homo sapiens
ucaccugagucauuucaug

SEQ ID NO: 634081 - RNA, 19 nt, Homo sapiens
cuuauuagcaggaguagaa

SEQ ID NO: 634082 - RNA, 19 nt, Homo sapiens
gcuuugauuucaccaacaa

SEQ ID NO: 634083 - RNA, 19 nt, Homo sapiens
gaucauccaagaccagaga

SEQ ID NO: 634084 - RNA, 19 nt, Homo sapiens
auacugggaugucugucua

SEQ ID NO: 634085 - RNA, 19 nt, Homo sapiens
gaucaccaccaccacuaaa

SEQ ID NO: 634086 - RNA, 19 nt, Homo sapiens
ucagaacccugggcggaaa

SEQ ID NO: 634087 - RNA, 19 nt, Homo sapiens
caucugaacacacuacaau

SEQ ID NO: 634088 - RNA, 19 nt, Homo sapiens
acauagaaguagugaggaa

SEQ ID NO: 634089 - RNA, 19 nt, Homo sapiens
aaacuggcuacaauacaua

SEQ ID NO: 634090 - RNA, 19 nt, Homo sapiens
agaaacacagauaguagua

SEQ ID NO: 634091 - RNA, 19 nt, Homo sapiens
gacuaaccaugggcaguuu

SEQ ID NO: 634092 - RNA, 19 nt, Homo sapiens
gcaguggucauuucagcaa

SEQ ID NO: 634093 - RNA, 19 nt, Homo sapiens
ugguaaaguucaguuguuu

SEQ ID NO: 634094 - RNA, 19 nt, Homo sapiens
gcaaugguaaaguucaguu

SEQ ID NO: 634095 - RNA, 19 nt, Homo sapiens
ggaguagaagucaaggauu

SEQ ID NO: 634096 - RNA, 19 nt, Homo sapiens
gcaaacuguaggagguuaa

SEQ ID NO: 634097 - RNA, 19 nt, Homo sapiens
uaugugcgcuucaucuaca

SEQ ID NO: 634098 - RNA, 19 nt, Homo sapiens
cccaaagucugauguuuac

SEQ ID NO: 634099 - RNA, 19 nt, Homo sapiens
ggaaaauccagaagacuuu

SEQ ID NO: 634100 - RNA, 19 nt, Homo sapiens
gagaauccgaggcagaaga

SEQ ID NO: 634101 - RNA, 19 nt, Homo sapiens
uaaauacugaccuaaguuc

SEQ ID NO: 634102 - RNA, 19 nt, Homo sapiens
acaaauaagcaaacuguag

SEQ ID NO: 634103 - RNA, 19 nt, Homo sapiens
aaagaaacacagauaguag

SEQ ID NO: 634104 - RNA, 19 nt, Homo sapiens
gaacaacccugucuucacu

SEQ ID NO: 634105 - RNA, 19 nt, Homo sapiens
cgaccaagcucgugaacaa

SEQ ID NO: 634106 - RNA, 19 nt, Homo sapiens
acaagaagcuccggaauuc

SEQ ID NO: 634107 - RNA, 19 nt, Homo sapiens
gcagaauccugacaaccaa

SEQ ID NO: 634108 - RNA, 19 nt, Homo sapiens
gcucuaaucaucuuuaugu

SEQ ID NO: 634109 - RNA, 19 nt, Homo sapiens
caaucgcuaucaaccguua

SEQ ID NO: 634110 - RNA, 19 nt, Homo sapiens
gcugggagaucuuaacgau

SEQ ID NO: 634111 - RNA, 19 nt, Homo sapiens
caaugagaauuuccgaaga

SEQ ID NO: 634112 - RNA, 19 nt, Homo sapiens
ugaagaugauccugaugaa

SEQ ID NO: 634113 - RNA, 19 nt, Homo sapiens
ucuacgggcuccucaauga

SEQ ID NO: 634114 - RNA, 19 nt, Homo sapiens
gaucugagccaguuacagu

SEQ ID NO: 634115 - RNA, 19 nt, Homo sapiens
ccacaagucugucuuuagc

SEQ ID NO: 634116 - RNA, 19 nt, Homo sapiens
gagaauuuccgaagagaau

SEQ ID NO: 634117 - RNA, 19 nt, Homo sapiens
aacccugucuucacuguua

SEQ ID NO: 634118 - RNA, 19 nt, Homo sapiens
gaagaugauccugaugaaa

SEQ ID NO: 634119 - RNA, 19 nt, Homo sapiens
caccacaagucugucuuua

SEQ ID NO: 634120 - RNA, 19 nt, Homo sapiens
ggagauggcaggcaagauc

SEQ ID NO: 634121 - RNA, 19 nt, Homo sapiens
gugaggaucuggaccaaag

SEQ ID NO: 634122 - RNA, 19 nt, Homo sapiens
gaacaagaagcuccggaau

SEQ ID NO: 634123 - RNA, 19 nt, Homo sapiens
gcccaccacugcugacuau

SEQ ID NO: 634124 - RNA, 19 nt, Homo sapiens
caccaucguuguagaccua

SEQ ID NO: 634125 - RNA, 19 nt, Homo sapiens
ugaaauggcugugugaaaa

SEQ ID NO: 634126 - RNA, 19 nt, Homo sapiens
guaccaaugauuaccauga

SEQ ID NO: 634127 - RNA, 19 nt, Homo sapiens
cuaccaguaccaaugauua

SEQ ID NO: 634128 - RNA, 19 nt, Homo sapiens
acaccugcaucuucaacua

SEQ ID NO: 634129 - RNA, 19 nt, Homo sapiens
gcaacuccauggucauuuu

SEQ ID NO: 634130 - RNA, 19 nt, Homo sapiens
caacuggcuuuaucuugca

SEQ ID NO: 634131 - RNA, 19 nt, Homo sapiens
gggugacucuguccauuuc

SEQ ID NO: 634132 - RNA, 19 nt, Homo sapiens
gggugacucuguccauuuc

SEQ ID NO: 634133 - RNA, 19 nt, Homo sapiens
aagaugauccugaugaaau

SEQ ID NO: 634134 - RNA, 19 nt, Homo sapiens
ucacuaccaguaccaauga

SEQ ID NO: 634135 - RNA, 19 nt, Homo sapiens
ugacaacccugagcucucu

SEQ ID NO: 634136 - RNA, 19 nt, Homo sapiens
gcggcacccuaucauauuc

SEQ ID NO: 634137 - RNA, 19 nt, Homo sapiens
ccucaacgcugugaucuac

SEQ ID NO: 634138 - RNA, 19 nt, Homo sapiens
ggaauucuggcaacaucuu

SEQ ID NO: 634139 - RNA, 19 nt, Homo sapiens
ggaccuggcugcugauccu

SEQ ID NO: 634140 - RNA, 19 nt, Homo sapiens
gagaauacuggaccaucuu

SEQ ID NO: 634141 - RNA, 19 nt, Homo sapiens
gcaauuuucuaaccauguu

SEQ ID NO: 634142 - RNA, 19 nt, Homo sapiens
gguuaucaccaucguugua

SEQ ID NO: 634143 - RNA, 19 nt, Homo sapiens
gaauacccaccggcucuaa

SEQ ID NO: 634144 - RNA, 19 nt, Homo sapiens
cgaugaauguccggaaugu

SEQ ID NO: 634145 - RNA, 19 nt, Homo sapiens
ggaccaucuuccaugcuau

SEQ ID NO: 634146 - RNA, 19 nt, Homo sapiens
gaucuucagugugcgcaau

SEQ ID NO: 634147 - RNA, 19 nt, Homo sapiens
agaugauccugaugaaaug

SEQ ID NO: 634148 - RNA, 19 nt, Homo sapiens
gcccaucacuggccaccau

SEQ ID NO: 634149 - RNA, 19 nt, Homo sapiens
gaucuacgggcuccucaau

SEQ ID NO: 634150 - RNA, 19 nt, Homo sapiens
uaaccauguuugugaucuu

SEQ ID NO: 634151 - RNA, 19 nt, Homo sapiens
ggucaucaccuggaucaug

SEQ ID NO: 634152 - RNA, 19 nt, Homo sapiens
gccugacucuguucauuuc

SEQ ID NO: 634153 - RNA, 19 nt, Homo sapiens
uuucaagccugacucuguu

SEQ ID NO: 634154 - RNA, 19 nt, Homo sapiens
gguuguugauguugaagau

SEQ ID NO: 634155 - RNA, 19 nt, Homo sapiens
ucccuggccucaucaguga

SEQ ID NO: 634156 - RNA, 19 nt, Homo sapiens
ucuugcagccuacuucaua

SEQ ID NO: 634157 - RNA, 19 nt, Homo sapiens
ugucgugguuguugauguu

SEQ ID NO: 634158 - RNA, 19 nt, Homo sapiens
ucagugauauucgugagau

SEQ ID NO: 634159 - RNA, 19 nt, Homo sapiens
agagaauacuggaccaucu

SEQ ID NO: 634160 - RNA, 19 nt, Homo sapiens
ucaacgugcucacugucuu

SEQ ID NO: 634161 - RNA, 19 nt, Homo sapiens
ccaaugauuaccaugaugu

SEQ ID NO: 634162 - RNA, 19 nt, Homo sapiens
uaccaaugauuaccaugau

SEQ ID NO: 634163 - RNA, 19 nt, Homo sapiens
ccaccacaagucugucuuu

SEQ ID NO: 634164 - RNA, 19 nt, Homo sapiens
gcuaugcggcacccuauca

SEQ ID NO: 634165 - RNA, 19 nt, Homo sapiens
cuucauagccuacuucaac

SEQ ID NO: 634166 - RNA, 19 nt, Homo sapiens
ccacuaccagccacccuaa

SEQ ID NO: 634167 - RNA, 19 nt, Homo sapiens
ccaagucugccacugucua

SEQ ID NO: 634168 - RNA, 19 nt, Homo sapiens
aacaagaagcuccggaauu

SEQ ID NO: 634169 - RNA, 19 nt, Homo sapiens
gaggaaaccccgaugaaug

SEQ ID NO: 634170 - RNA, 19 nt, Homo sapiens
aaugagaauuuccgaagag

SEQ ID NO: 634171 - RNA, 19 nt, Homo sapiens
caacgugcucacugucuug

SEQ ID NO: 634172 - RNA, 19 nt, Homo sapiens
uuucuaaccauguuuguga

SEQ ID NO: 634173 - RNA, 19 nt, Homo sapiens
gcaucuaccuggucaucac

SEQ ID NO: 634174 - RNA, 19 nt, Homo sapiens
guggucggcuccaucuuca

SEQ ID NO: 634175 - RNA, 19 nt, Homo sapiens
uuguugauguugaagauga

SEQ ID NO: 634176 - RNA, 19 nt, Homo sapiens
aagccugacucuguucauu

SEQ ID NO: 634177 - RNA, 19 nt, Homo sapiens
caccggcucuaaucaucuu

SEQ ID NO: 634178 - RNA, 19 nt, Homo sapiens
acgaacggaucuucagugu

SEQ ID NO: 634179 - RNA, 19 nt, Homo sapiens
gccacagccuccaguacga

SEQ ID NO: 634180 - RNA, 19 nt, Homo sapiens
caucuacccauacccuuug

SEQ ID NO: 634181 - RNA, 19 nt, Homo sapiens
gugacucuguccauuucaa

SEQ ID NO: 634182 - RNA, 19 nt, Homo sapiens
gugacucuguccauuucaa

SEQ ID NO: 634183 - RNA, 19 nt, Homo sapiens
gcgcaauaccugcaucuac

SEQ ID NO: 634184 - RNA, 19 nt, Homo sapiens
ccaguuacagugccagaug

SEQ ID NO: 634185 - RNA, 19 nt, Homo sapiens
gaugaaauggcugugugaa

SEQ ID NO: 634186 - RNA, 19 nt, Homo sapiens
gacagugaccucccugagu

SEQ ID NO: 634187 - RNA, 19 nt, Homo sapiens
ggcagaauccugacaacca

SEQ ID NO: 634188 - RNA, 19 nt, Homo sapiens
gcaccuacaccugcaucuu

SEQ ID NO: 634189 - RNA, 19 nt, Homo sapiens
ccaucuacccauacccuuu

SEQ ID NO: 634190 - RNA, 19 nt, Homo sapiens
ccggaauucuggcaacauc

SEQ ID NO: 634191 - RNA, 19 nt, Homo sapiens
caccaucgcugaccuuccu

SEQ ID NO: 634192 - RNA, 19 nt, Homo sapiens
uaucgcaaaucugccucua

SEQ ID NO: 634193 - RNA, 19 nt, Homo sapiens
gaauuuccgaagagaauac

SEQ ID NO: 634194 - RNA, 19 nt, Homo sapiens
gagguucgcaauuuucuaa

SEQ ID NO: 634195 - RNA, 19 nt, Homo sapiens
caccuacaccugcaucuuc

SEQ ID NO: 634196 - RNA, 19 nt, Homo sapiens
cggcucuaaucaucuuuau

SEQ ID NO: 634197 - RNA, 19 nt, Homo sapiens
uugaagaugauccugauga

SEQ ID NO: 634198 - RNA, 19 nt, Homo sapiens
gaccaucuuccaugcuaug

SEQ ID NO: 634199 - RNA, 19 nt, Homo sapiens
gaagagaauacuggaccau

SEQ ID NO: 634200 - RNA, 19 nt, Homo sapiens
cuaucaacgugcucacugu

SEQ ID NO: 634201 - RNA, 19 nt, Homo sapiens
ugacgaagaacaagaagcu

SEQ ID NO: 634202 - RNA, 19 nt, Homo sapiens
caugaugucgugguuguug

SEQ ID NO: 634203 - RNA, 19 nt, Homo sapiens
cuccaagucugccuucagu

SEQ ID NO: 634204 - RNA, 19 nt, Homo sapiens
gaagccaccuugacacuuu

SEQ ID NO: 634205 - RNA, 19 nt, Homo sapiens
ggacauagagacaggauga

SEQ ID NO: 634206 - RNA, 19 nt, Homo sapiens
ucgaggagauccacaaauu

SEQ ID NO: 634207 - RNA, 19 nt, Homo sapiens
gauguucccucuacagaug

SEQ ID NO: 634208 - RNA, 19 nt, Homo sapiens
gagacaggaugaagacaug

SEQ ID NO: 634209 - RNA, 19 nt, Homo sapiens
gacaaugcaugcccucguu

SEQ ID NO: 634210 - RNA, 19 nt, Homo sapiens
acaccugcaugaacacuuu

SEQ ID NO: 634211 - RNA, 19 nt, Homo sapiens
agagauggcuuuugugaaa

SEQ ID NO: 634212 - RNA, 19 nt, Homo sapiens
ccaguucuguagaguuuau

SEQ ID NO: 634213 - RNA, 19 nt, Homo sapiens
gaaccuacaccugcaugaa

SEQ ID NO: 634214 - RNA, 19 nt, Homo sapiens
gaggagauccacaaauucu

SEQ ID NO: 634215 - RNA, 19 nt, Homo sapiens
ccacagugcugcccuucca

SEQ ID NO: 634216 - RNA, 19 nt, Homo sapiens
gaugaugcccuccucaagu

SEQ ID NO: 634217 - RNA, 19 nt, Homo sapiens
ugaucuaucugguggugaa

SEQ ID NO: 634218 - RNA, 19 nt, Homo sapiens
uaaccagccucagcagugu

SEQ ID NO: 634219 - RNA, 19 nt, Homo sapiens
ucaaagggcggacauagag

SEQ ID NO: 634220 - RNA, 19 nt, Homo sapiens
gggcaugagagucagguuu

SEQ ID NO: 634221 - RNA, 19 nt, Homo sapiens
uuccaguucuguagaguuu

SEQ ID NO: 634222 - RNA, 19 nt, Homo sapiens
uaauggacagugaugauga

SEQ ID NO: 634223 - RNA, 19 nt, Homo sapiens
gggagaaggugggugacau

SEQ ID NO: 634224 - RNA, 19 nt, Homo sapiens
cagugugcauagaccauuu

SEQ ID NO: 634225 - RNA, 19 nt, Homo sapiens
cauagagacaggaugaaga

SEQ ID NO: 634226 - RNA, 19 nt, Homo sapiens
ggacugagaaaugccugaa

SEQ ID NO: 634227 - RNA, 19 nt, Homo sapiens
ucuguagaguuuauuguca

SEQ ID NO: 634228 - RNA, 19 nt, Homo sapiens
ggagaaggugggugacauc

SEQ ID NO: 634229 - RNA, 19 nt, Homo sapiens
gccagaagccaccuugaca

SEQ ID NO: 634230 - RNA, 19 nt, Homo sapiens
ggacugauggguguaacug

SEQ ID NO: 634231 - RNA, 19 nt, Homo sapiens
ccgagcaccuguccauugg

SEQ ID NO: 634232 - RNA, 19 nt, Homo sapiens
gcagugugcauagaccauu

SEQ ID NO: 634233 - RNA, 19 nt, Homo sapiens
ccucagcagugugcauaga

SEQ ID NO: 634234 - RNA, 19 nt, Homo sapiens
cgacuacugcacauccaaa

SEQ ID NO: 634235 - RNA, 19 nt, Homo sapiens
ccucaagucccaacacauc

SEQ ID NO: 634236 - RNA, 19 nt, Homo sapiens
gcaaccgggaggaggugua

SEQ ID NO: 634237 - RNA, 19 nt, Homo sapiens
ggaaccuacaccugcauga

SEQ ID NO: 634238 - RNA, 19 nt, Homo sapiens
gggagaacguccucaucac

SEQ ID NO: 634239 - RNA, 19 nt, Homo sapiens
cgaggagauccacaaauuc

SEQ ID NO: 634240 - RNA, 19 nt, Homo sapiens
caaagggcggacauagaga

SEQ ID NO: 634241 - RNA, 19 nt, Homo sapiens
acaaugcaugcccucguua

SEQ ID NO: 634242 - RNA, 19 nt, Homo sapiens
ggcaugagagucagguuuc

SEQ ID NO: 634243 - RNA, 19 nt, Homo sapiens
cgggagaacguccucauca

SEQ ID NO: 634244 - RNA, 19 nt, Homo sapiens
gagaaggugggugacauca

SEQ ID NO: 634245 - RNA, 19 nt, Homo sapiens
ugcaugcccucguuaucuu

SEQ ID NO: 634246 - RNA, 19 nt, Homo sapiens
gauguuccagggcaugaga

SEQ ID NO: 634247 - RNA, 19 nt, Homo sapiens
ugcuggagcugcagaaugg

SEQ ID NO: 634248 - RNA, 19 nt, Homo sapiens
cuguagaguuuauugucaa

SEQ ID NO: 634249 - RNA, 19 nt, Homo sapiens
gaggagccacggaguuugg

SEQ ID NO: 634250 - RNA, 19 nt, Homo sapiens
gugauguucccucuacaga

SEQ ID NO: 634251 - RNA, 19 nt, Homo sapiens
caaugcaugcccucguuau

SEQ ID NO: 634252 - RNA, 19 nt, Homo sapiens
gaccuuugcacaggacuga

SEQ ID NO: 634253 - RNA, 19 nt, Homo sapiens
gagauguuccagggcauga

SEQ ID NO: 634254 - RNA, 19 nt, Homo sapiens
gcugcagaauggccacauc

SEQ ID NO: 634255 - RNA, 19 nt, Homo sapiens
uugaacggcaggaaugaaa

SEQ ID NO: 634256 - RNA, 19 nt, Homo sapiens
aggcugcacucgaggagau

SEQ ID NO: 634257 - RNA, 19 nt, Homo sapiens
aauggacagugaugaugau

SEQ ID NO: 634258 - RNA, 19 nt, Homo sapiens
gaacaucucuucuuucaga

SEQ ID NO: 634259 - RNA, 19 nt, Homo sapiens
gagcaaagguuccuguaaa

SEQ ID NO: 634260 - RNA, 19 nt, Homo sapiens
gaaggacucuccauucuau

SEQ ID NO: 634261 - RNA, 19 nt, Homo sapiens
ggaaauaacagcucugaaa

SEQ ID NO: 634262 - RNA, 19 nt, Homo sapiens
gcccagagcucuugaauca

SEQ ID NO: 634263 - RNA, 19 nt, Homo sapiens
gaagucagcuguccuccaa

SEQ ID NO: 634264 - RNA, 19 nt, Homo sapiens
gcagaagaguucacagaaa

SEQ ID NO: 634265 - RNA, 19 nt, Homo sapiens
ggagaagccuggaagaaug

SEQ ID NO: 634266 - RNA, 19 nt, Homo sapiens
gaagccagcuacaucauga

SEQ ID NO: 634267 - RNA, 19 nt, Homo sapiens
ccaagaggcuaaagauuug

SEQ ID NO: 634268 - RNA, 19 nt, Homo sapiens
ggaagaauguaucccaaga

SEQ ID NO: 634269 - RNA, 19 nt, Homo sapiens
cauagacccucuucaguuu

SEQ ID NO: 634270 - RNA, 19 nt, Homo sapiens
gaugaaagaucccaagaag

SEQ ID NO: 634271 - RNA, 19 nt, Homo sapiens
caaagguuccuguaaauuu

SEQ ID NO: 634272 - RNA, 19 nt, Homo sapiens
ugagauaucuaggagaaua

SEQ ID NO: 634273 - RNA, 19 nt, Homo sapiens
guacuacagugaggaauuu

SEQ ID NO: 634274 - RNA, 19 nt, Homo sapiens
ucugaaaccugagaauuua

SEQ ID NO: 634275 - RNA, 19 nt, Homo sapiens
cacaguagauccaaacaaa

SEQ ID NO: 634276 - RNA, 19 nt, Homo sapiens
ccaaggacuucucacagua

SEQ ID NO: 634277 - RNA, 19 nt, Homo sapiens
ccagagcucuugaaucaga

SEQ ID NO: 634278 - RNA, 19 nt, Homo sapiens
gaauggaggagaacuguuu

SEQ ID NO: 634279 - RNA, 19 nt, Homo sapiens
gcugagauaucuaggagaa

SEQ ID NO: 634280 - RNA, 19 nt, Homo sapiens
cagaagaguucacagaaau

SEQ ID NO: 634281 - RNA, 19 nt, Homo sapiens
gaccgaaguuugacgugua

SEQ ID NO: 634282 - RNA, 19 nt, Homo sapiens
gaaaacaaguacuauguga

SEQ ID NO: 634283 - RNA, 19 nt, Homo sapiens
ggaaucugccuccuaauga

SEQ ID NO: 634284 - RNA, 19 nt, Homo sapiens
ggagugcaaugaugaagga

SEQ ID NO: 634285 - RNA, 19 nt, Homo sapiens
gaacuggagcuuauggaaa

SEQ ID NO: 634286 - RNA, 19 nt, Homo sapiens
acacugugcuucauauuug

SEQ ID NO: 634287 - RNA, 19 nt, Homo sapiens
ggaaagcuguaugccauga

SEQ ID NO: 634288 - RNA, 19 nt, Homo sapiens
gaaauggaucccacuuauu

SEQ ID NO: 634289 - RNA, 19 nt, Homo sapiens
agaaauggaucccacuuau

SEQ ID NO: 634290 - RNA, 19 nt, Homo sapiens
gaauacauggcaccagaua

SEQ ID NO: 634291 - RNA, 19 nt, Homo sapiens
guacaugucucucuguuuu

SEQ ID NO: 634292 - RNA, 19 nt, Homo sapiens
gaguuuggguguucuaaug

SEQ ID NO: 634293 - RNA, 19 nt, Homo sapiens
uaaagcauuugcacuguau

SEQ ID NO: 634294 - RNA, 19 nt, Homo sapiens
agcaugaggugcagauuua

SEQ ID NO: 634295 - RNA, 19 nt, Homo sapiens
uaaacacugugcuucauau

SEQ ID NO: 634296 - RNA, 19 nt, Homo sapiens
gauuugagcugcuuguaag

SEQ ID NO: 634297 - RNA, 19 nt, Homo sapiens
uaaccaagcuuugcaaguc

SEQ ID NO: 634298 - RNA, 19 nt, Homo sapiens
ucgaacaucuccacaaguu

SEQ ID NO: 634299 - RNA, 19 nt, Homo sapiens
caaguacuaugugaugaaa

SEQ ID NO: 634300 - RNA, 19 nt, Homo sapiens
gcucuuuccuggcaauuug

SEQ ID NO: 634301 - RNA, 19 nt, Homo sapiens
ggcauauacuuauuucuug

SEQ ID NO: 634302 - RNA, 19 nt, Homo sapiens
gaugauaccuuuugcuuug

SEQ ID NO: 634303 - RNA, 19 nt, Homo sapiens
ccacaugcaugaucuugga

SEQ ID NO: 634304 - RNA, 19 nt, Homo sapiens
gagcaucuccuuucacugu

SEQ ID NO: 634305 - RNA, 19 nt, Homo sapiens
aaagagagcguuucacaga

SEQ ID NO: 634306 - RNA, 19 nt, Homo sapiens
cagaugaaaucaaagaaca

SEQ ID NO: 634307 - RNA, 19 nt, Homo sapiens
ugagaugcaugcuaagcua

SEQ ID NO: 634308 - RNA, 19 nt, Homo sapiens
cagagaauguuacugugaa

SEQ ID NO: 634309 - RNA, 19 nt, Homo sapiens
cgagaugaauuagauguga

SEQ ID NO: 634310 - RNA, 19 nt, Homo sapiens
gcuuguaagucacagguuu

SEQ ID NO: 634311 - RNA, 19 nt, Homo sapiens
gcaaagguuccuguaaauu

SEQ ID NO: 634312 - RNA, 19 nt, Homo sapiens
gaauguuacugugaauaga

SEQ ID NO: 634313 - RNA, 19 nt, Homo sapiens
ccuaggaacuggagcuuau

SEQ ID NO: 634314 - RNA, 19 nt, Homo sapiens
gagcaugaggugcagauuu

SEQ ID NO: 634315 - RNA, 19 nt, Homo sapiens
gaaaccaaacuucaucuca

SEQ ID NO: 634316 - RNA, 19 nt, Homo sapiens
gagcacauauuacucuuuu

SEQ ID NO: 634317 - RNA, 19 nt, Homo sapiens
caaaagcacuggacagaga

SEQ ID NO: 634318 - RNA, 19 nt, Homo sapiens
gaaucugccuccuaaugau

SEQ ID NO: 634319 - RNA, 19 nt, Homo sapiens
agaacuguuugacgcauua

SEQ ID NO: 634320 - RNA, 19 nt, Homo sapiens
gcucaaaaguucugaauuc

SEQ ID NO: 634321 - RNA, 19 nt, Homo sapiens
gcuaagcuauguguauguu

SEQ ID NO: 634322 - RNA, 19 nt, Homo sapiens
uuacgaaccuagcaugaug

SEQ ID NO: 634323 - RNA, 19 nt, Homo sapiens
cccaagaggcuaaagauuu

SEQ ID NO: 634324 - RNA, 19 nt, Homo sapiens
ugauggaacuucugaaugg

SEQ ID NO: 634325 - RNA, 19 nt, Homo sapiens
ugaaagaucccaagaagag

SEQ ID NO: 634326 - RNA, 19 nt, Homo sapiens
gagaaggugggaauagaaa

SEQ ID NO: 634327 - RNA, 19 nt, Homo sapiens
uauaaaugguggugaacuu

SEQ ID NO: 634328 - RNA, 19 nt, Homo sapiens
gaaauaacagcucugaaac

SEQ ID NO: 634329 - RNA, 19 nt, Homo sapiens
gaugaaggacucuccauuc

SEQ ID NO: 634330 - RNA, 19 nt, Homo sapiens
uuaaagcauuugcacugua

SEQ ID NO: 634331 - RNA, 19 nt, Homo sapiens
gaucugaaaccugagaauu

SEQ ID NO: 634332 - RNA, 19 nt, Homo sapiens
gagaacuguuugacgcauu

SEQ ID NO: 634333 - RNA, 19 nt, Homo sapiens
cagaaauggaucccacuua

SEQ ID NO: 634334 - RNA, 19 nt, Homo sapiens
aaacaaguacuaugugaug

SEQ ID NO: 634335 - RNA, 19 nt, Homo sapiens
gcugcggacugcuaauuug

SEQ ID NO: 634336 - RNA, 19 nt, Homo sapiens
ccagcuacaucaugaggaa

SEQ ID NO: 634337 - RNA, 19 nt, Homo sapiens
ugaguaacuuugcagaaga

SEQ ID NO: 634338 - RNA, 19 nt, Homo sapiens
gacaggacaugcugagaag

SEQ ID NO: 634339 - RNA, 19 nt, Homo sapiens
aaugagugcuuuagcgaaa

SEQ ID NO: 634340 - RNA, 19 nt, Homo sapiens
gugcauaccugugugaaag

SEQ ID NO: 634341 - RNA, 19 nt, Homo sapiens
uaaagccaccggauaauca

SEQ ID NO: 634342 - RNA, 19 nt, Homo sapiens
aaauggaucccacuuauuc

SEQ ID NO: 634343 - RNA, 19 nt, Homo sapiens
aaccaaacuucaucucauu

SEQ ID NO: 634344 - RNA, 19 nt, Homo sapiens
aaaccaaacuucaucucau

SEQ ID NO: 634345 - RNA, 19 nt, Homo sapiens
ccuaugacuuguuuggaaa

SEQ ID NO: 634346 - RNA, 19 nt, Homo sapiens
ggccagagcgggaaagaga

SEQ ID NO: 634347 - RNA, 19 nt, Homo sapiens
gaaggacaccccaauauug

SEQ ID NO: 634348 - RNA, 19 nt, Homo sapiens
aaagcuguaugccaugaaa

SEQ ID NO: 634349 - RNA, 19 nt, Homo sapiens
gauuuauguuggagagauu

SEQ ID NO: 634350 - RNA, 19 nt, Homo sapiens
auacugugaugauaccuuu

SEQ ID NO: 634351 - RNA, 19 nt, Homo sapiens
uuaauuagggcuagauuug

SEQ ID NO: 634352 - RNA, 19 nt, Homo sapiens
gcacagggaucugaaaccu

SEQ ID NO: 634353 - RNA, 19 nt, Homo sapiens
acuaugaccuagauuugaa

SEQ ID NO: 634354 - RNA, 19 nt, Homo sapiens
uaaugcagcugucauagac

SEQ ID NO: 634355 - RNA, 19 nt, Homo sapiens
cuccuguagucauauauua

SEQ ID NO: 634356 - RNA, 19 nt, Homo sapiens
ggaacuggagcuuauggaa

SEQ ID NO: 634357 - RNA, 19 nt, Homo sapiens
gagaauguuacugugaaua

SEQ ID NO: 634358 - RNA, 19 nt, Homo sapiens
ggacaaggcuuucuccuau

SEQ ID NO: 634359 - RNA, 19 nt, Homo sapiens
gaaaguccgugaagucugu

SEQ ID NO: 634360 - RNA, 19 nt, Homo sapiens
caaagccacuguagagaaa

SEQ ID NO: 634361 - RNA, 19 nt, Homo sapiens
gaagaacucgccuuucaaa

SEQ ID NO: 634362 - RNA, 19 nt, Homo sapiens
cagaagaacucgccuuuca

SEQ ID NO: 634363 - RNA, 19 nt, Homo sapiens
ucauuuaggugacacuaua

SEQ ID NO: 634364 - RNA, 19 nt, Homo sapiens
gcacacagaucaguucauc

SEQ ID NO: 634365 - RNA, 19 nt, Homo sapiens
gcacugacuuccaggugaa

SEQ ID NO: 634366 - RNA, 19 nt, Homo sapiens
gacaaggcuuucuccuaua

SEQ ID NO: 634367 - RNA, 19 nt, Homo sapiens
gcaaagccacuguagagaa

SEQ ID NO: 634368 - RNA, 19 nt, Homo sapiens
aggagaagaugcgcaguua

SEQ ID NO: 634369 - RNA, 19 nt, Homo sapiens
ccucacagaugguggcaaa

SEQ ID NO: 634370 - RNA, 19 nt, Homo sapiens
gccaauaaaggaagaauau

SEQ ID NO: 634371 - RNA, 19 nt, Homo sapiens
caaaagacauucgagauug

SEQ ID NO: 634372 - RNA, 19 nt, Homo sapiens
acaaggcuuucuccuauau

SEQ ID NO: 634373 - RNA, 19 nt, Homo sapiens
uaggugacacuauagaaua

SEQ ID NO: 634374 - RNA, 19 nt, Homo sapiens
gugaagaugcggugaagaa

SEQ ID NO: 634375 - RNA, 19 nt, Homo sapiens
gaaugcacgugugugaaga

SEQ ID NO: 634376 - RNA, 19 nt, Homo sapiens
cauucgagauugaacugua

SEQ ID NO: 634377 - RNA, 19 nt, Homo sapiens
auacaaggacagccaauaa

SEQ ID NO: 634378 - RNA, 19 nt, Homo sapiens
ggagggaggaggaggagaa

SEQ ID NO: 634379 - RNA, 19 nt, Homo sapiens
gcaacaggauggaauucag

SEQ ID NO: 634380 - RNA, 19 nt, Homo sapiens
gcaaaagacauucgagauu

SEQ ID NO: 634381 - RNA, 19 nt, Homo sapiens
ggaaugcacgugugugaag

SEQ ID NO: 634382 - RNA, 19 nt, Homo sapiens
ggacuuaggcuggcaaugc

SEQ ID NO: 634383 - RNA, 19 nt, Homo sapiens
cuacagaaccaacauugug

SEQ ID NO: 634384 - RNA, 19 nt, Homo sapiens
gaugcgcaguuaccucaug

SEQ ID NO: 634385 - RNA, 19 nt, Homo sapiens
gaggagaagaugcgcaguu

SEQ ID NO: 634386 - RNA, 19 nt, Homo sapiens
acacuccauuucccaguuu

SEQ ID NO: 634387 - RNA, 19 nt, Homo sapiens
gcacucagccagaagaacu

SEQ ID NO: 634388 - RNA, 19 nt, Homo sapiens
ccauuucacugccggacuu

SEQ ID NO: 634389 - RNA, 19 nt, Homo sapiens
ugaaggcgaugggccgaaa

SEQ ID NO: 634390 - RNA, 19 nt, Homo sapiens
cgacggccauuaccaaucg

SEQ ID NO: 634391 - RNA, 19 nt, Homo sapiens
ggaggaagccagccuacgu

SEQ ID NO: 634392 - RNA, 19 nt, Homo sapiens
gaaggcaaagccacuguag

SEQ ID NO: 634393 - RNA, 19 nt, Homo sapiens
gccagaagaacucgccuuu

SEQ ID NO: 634394 - RNA, 19 nt, Homo sapiens
ccaucacccuccaacuuug

SEQ ID NO: 634395 - RNA, 19 nt, Homo sapiens
gacagccaauaaaggaaga

SEQ ID NO: 634396 - RNA, 19 nt, Homo sapiens
gcagcuucccggucaggua

SEQ ID NO: 634397 - RNA, 19 nt, Homo sapiens
gacaaccacuacagaacca

SEQ ID NO: 634398 - RNA, 19 nt, Homo sapiens
gggaggaggaggagaagau

SEQ ID NO: 634399 - RNA, 19 nt, Homo sapiens
uacaaggacagccaauaaa

SEQ ID NO: 634400 - RNA, 19 nt, Homo sapiens
gccacaaucccacugaaug

SEQ ID NO: 634401 - RNA, 19 nt, Homo sapiens
gggcaccaugaacaaguua

SEQ ID NO: 634402 - RNA, 19 nt, Homo sapiens
uauacaaggacagccaaua

SEQ ID NO: 634403 - RNA, 19 nt, Homo sapiens
aaggacagccaauaaagga

SEQ ID NO: 634404 - RNA, 19 nt, Homo sapiens
aaaagacauucgagauuga

SEQ ID NO: 634405 - RNA, 19 nt, Homo sapiens
gcacaagcggacaccuuca

SEQ ID NO: 634406 - RNA, 19 nt, Homo sapiens
caaggacagccaauaaagg

SEQ ID NO: 634407 - RNA, 19 nt, Homo sapiens
ccacugaaugcccuugguu

SEQ ID NO: 634408 - RNA, 19 nt, Homo sapiens
ccacuacagaaccaacauu

SEQ ID NO: 634409 - RNA, 19 nt, Homo sapiens
ccucaacacccucucaaca

SEQ ID NO: 634410 - RNA, 19 nt, Homo sapiens
gccaccaccugccacaaca

SEQ ID NO: 634411 - RNA, 19 nt, Homo sapiens
gccauuaccaaucgcgaaa

SEQ ID NO: 634412 - RNA, 19 nt, Homo sapiens
uccaucacccuccaacuuu

SEQ ID NO: 634413 - RNA, 19 nt, Homo sapiens
cacacuccauuucccaguu

SEQ ID NO: 634414 - RNA, 19 nt, Homo sapiens
uacagaaccaacauuguga

SEQ ID NO: 634415 - RNA, 19 nt, Homo sapiens
ggcacaaccucuccccuaa

SEQ ID NO: 634416 - RNA, 19 nt, Homo sapiens
gggcacaagcggacaccuu

SEQ ID NO: 634417 - RNA, 19 nt, Homo sapiens
gaucauuuaggugacacua

SEQ ID NO: 634418 - RNA, 19 nt, Homo sapiens
acaaggacagccaauaaag

SEQ ID NO: 634419 - RNA, 19 nt, Homo sapiens
ggaggaggaggagaagaug

SEQ ID NO: 634420 - RNA, 19 nt, Homo sapiens
uggacaaggcuuucuccua

SEQ ID NO: 634421 - RNA, 19 nt, Homo sapiens
gagaagaugcgcaguuacc

SEQ ID NO: 634422 - RNA, 19 nt, Homo sapiens
gcuguacucaccuccauca

SEQ ID NO: 634423 - RNA, 19 nt, Homo sapiens
gaaaacagcgacgggagaa

SEQ ID NO: 634424 - RNA, 19 nt, Homo sapiens
gcaaccuggacaaggcuuu

SEQ ID NO: 634425 - RNA, 19 nt, Homo sapiens
aagaugcggugaagaagcu

SEQ ID NO: 634426 - RNA, 19 nt, Homo sapiens
guucacugccaaugcugua

SEQ ID NO: 634427 - RNA, 19 nt, Homo sapiens
ggccgaaaguccgugaagu

SEQ ID NO: 634428 - RNA, 19 nt, Homo sapiens
cgggcaccaugaacaaguu

SEQ ID NO: 634429 - RNA, 19 nt, Homo sapiens
ggaagggcacgugcagcuu

SEQ ID NO: 634430 - RNA, 19 nt, Homo sapiens
gcaucacacccucacagau

SEQ ID NO: 634431 - RNA, 19 nt, Homo sapiens
ccacaaucccacugaaugc

SEQ ID NO: 634432 - RNA, 19 nt, Homo sapiens
gccgaaaguccgugaaguc

SEQ ID NO: 634433 - RNA, 19 nt, Homo sapiens
aggcaaagccacuguagag

SEQ ID NO: 634434 - RNA, 19 nt, Homo sapiens
agaagaacucgccuuucaa

SEQ ID NO: 634435 - RNA, 19 nt, Homo sapiens
ucccagcacucagccagaa

SEQ ID NO: 634436 - RNA, 19 nt, Homo sapiens
gcugugggcugugcuuuug

SEQ ID NO: 634437 - RNA, 19 nt, Homo sapiens
gcagagaacuuccagaaag

SEQ ID NO: 634438 - RNA, 19 nt, Homo sapiens
caacaccaaucuucucuuu

SEQ ID NO: 634439 - RNA, 19 nt, Homo sapiens
ccaagaagaucgaccugua

SEQ ID NO: 634440 - RNA, 19 nt, Homo sapiens
gagaauguguucauggaaa

SEQ ID NO: 634441 - RNA, 19 nt, Homo sapiens
ggagggugaugcauuaauu

SEQ ID NO: 634442 - RNA, 19 nt, Homo sapiens
gcaacaagaugaucaugau

SEQ ID NO: 634443 - RNA, 19 nt, Homo sapiens
gagauggacugcgagguua

SEQ ID NO: 634444 - RNA, 19 nt, Homo sapiens
gaugagagguacauagaug

SEQ ID NO: 634445 - RNA, 19 nt, Homo sapiens
ggacagaggcccuggagaa

SEQ ID NO: 634446 - RNA, 19 nt, Homo sapiens
gcacagcucuucacaccau

SEQ ID NO: 634447 - RNA, 19 nt, Homo sapiens
gagagcagcugcgucauga

SEQ ID NO: 634448 - RNA, 19 nt, Homo sapiens
guacauagaugaggugaca

SEQ ID NO: 634449 - RNA, 19 nt, Homo sapiens
gcacaaacacacacacuau

SEQ ID NO: 634450 - RNA, 19 nt, Homo sapiens
gauggaaacuggacucaca

SEQ ID NO: 634451 - RNA, 19 nt, Homo sapiens
acaagaagguguucaagga

SEQ ID NO: 634452 - RNA, 19 nt, Homo sapiens
agaacaaggucaacuauuc

SEQ ID NO: 634453 - RNA, 19 nt, Homo sapiens
caacaaaggcuacuauuuu

SEQ ID NO: 634454 - RNA, 19 nt, Homo sapiens
cgaaggagacccugguaua

SEQ ID NO: 634455 - RNA, 19 nt, Homo sapiens
ccaccugccucuaaucuga

SEQ ID NO: 634456 - RNA, 19 nt, Homo sapiens
gaacaaggucaacuauuca

SEQ ID NO: 634457 - RNA, 19 nt, Homo sapiens
gacaucacccuuugccuua

SEQ ID NO: 634458 - RNA, 19 nt, Homo sapiens
gcacccaaaucacaucuca

SEQ ID NO: 634459 - RNA, 19 nt, Homo sapiens
ugaaacagacccaguacua

SEQ ID NO: 634460 - RNA, 19 nt, Homo sapiens
gguuaacaaugaggacuua

SEQ ID NO: 634461 - RNA, 19 nt, Homo sapiens
gcugaggacuggacagaga

SEQ ID NO: 634462 - RNA, 19 nt, Homo sapiens
ccaaagacauggucaucau

SEQ ID NO: 634463 - RNA, 19 nt, Homo sapiens
gaagacaucguguacuaug

SEQ ID NO: 634464 - RNA, 19 nt, Homo sapiens
gaaggagacccugguauau

SEQ ID NO: 634465 - RNA, 19 nt, Homo sapiens
aaggugagauggccaguuu

SEQ ID NO: 634466 - RNA, 19 nt, Homo sapiens
uuauugagcucauggagaa

SEQ ID NO: 634467 - RNA, 19 nt, Homo sapiens
gacccaaacuucaagaaca

SEQ ID NO: 634468 - RNA, 19 nt, Homo sapiens
acaccaaucuucucuuugu

SEQ ID NO: 634469 - RNA, 19 nt, Homo sapiens
uacaaaggcuccacuguca

SEQ ID NO: 634470 - RNA, 19 nt, Homo sapiens
aggaagacaucguguacua

SEQ ID NO: 634471 - RNA, 19 nt, Homo sapiens
guagucaggugcucaaugg

SEQ ID NO: 634472 - RNA, 19 nt, Homo sapiens
cugcagaacuccaacauca

SEQ ID NO: 634473 - RNA, 19 nt, Homo sapiens
gagcagcugcgucaugaaa

SEQ ID NO: 634474 - RNA, 19 nt, Homo sapiens
gcauugacguggcucugaa

SEQ ID NO: 634475 - RNA, 19 nt, Homo sapiens
caacacacaggaauaucua

SEQ ID NO: 634476 - RNA, 19 nt, Homo sapiens
ccaacaaaggcuacuauuu

SEQ ID NO: 634477 - RNA, 19 nt, Homo sapiens
gaugaugacuaugugaaug

SEQ ID NO: 634478 - RNA, 19 nt, Homo sapiens
cagaggcccuggagaaugu

SEQ ID NO: 634479 - RNA, 19 nt, Homo sapiens
gcguguaacuguaguguag

SEQ ID NO: 634480 - RNA, 19 nt, Homo sapiens
gagggugaugcauuaauua

SEQ ID NO: 634481 - RNA, 19 nt, Homo sapiens
aaacuggacucacauucga

SEQ ID NO: 634482 - RNA, 19 nt, Homo sapiens
ccucccagcuuaaauccua

SEQ ID NO: 634483 - RNA, 19 nt, Homo sapiens
uacaauaacuccuucuaca

SEQ ID NO: 634484 - RNA, 19 nt, Homo sapiens
caucuugaauggaaacaug

SEQ ID NO: 634485 - RNA, 19 nt, Homo sapiens
gggcgugcguguaacugua

SEQ ID NO: 634486 - RNA, 19 nt, Homo sapiens
caccagacaucacccuuug

SEQ ID NO: 634487 - RNA, 19 nt, Homo sapiens
gcucaccaccugccucuaa

SEQ ID NO: 634488 - RNA, 19 nt, Homo sapiens
caacaccgaguuccugaaa

SEQ ID NO: 634489 - RNA, 19 nt, Homo sapiens
gcuauguguuugccauuga

SEQ ID NO: 634490 - RNA, 19 nt, Homo sapiens
ucacaccgcugcaguggau

SEQ ID NO: 634491 - RNA, 19 nt, Homo sapiens
gaacacacacacacacaca

SEQ ID NO: 634492 - RNA, 19 nt, Homo sapiens
ucauguugcuugucgcuuu

SEQ ID NO: 634493 - RNA, 19 nt, Homo sapiens
ggacugcgagguuaacaau

SEQ ID NO: 634494 - RNA, 19 nt, Homo sapiens
gcagcugcgucaugaaaca

SEQ ID NO: 634495 - RNA, 19 nt, Homo sapiens
cgcuggagcuggagaauga

SEQ ID NO: 634496 - RNA, 19 nt, Homo sapiens
acaagaugaucaugauguu

SEQ ID NO: 634497 - RNA, 19 nt, Homo sapiens
ggugcucaauggagaauau

SEQ ID NO: 634498 - RNA, 19 nt, Homo sapiens
ggacucacauucgacauac

SEQ ID NO: 634499 - RNA, 19 nt, Homo sapiens
cgacagaagauaccucaga

SEQ ID NO: 634500 - RNA, 19 nt, Homo sapiens
gcacaucugcuucgacuac

SEQ ID NO: 634501 - RNA, 19 nt, Homo sapiens
gcgcagagacugaccaaca

SEQ ID NO: 634502 - RNA, 19 nt, Homo sapiens
accaggaucucaacacgua

SEQ ID NO: 634503 - RNA, 19 nt, Homo sapiens
acacaggaauaucuagaug

SEQ ID NO: 634504 - RNA, 19 nt, Homo sapiens
ucaagaacaaggucaacua

SEQ ID NO: 634505 - RNA, 19 nt, Homo sapiens
uaaaauaucguguguguga

SEQ ID NO: 634506 - RNA, 19 nt, Homo sapiens
auauacaccuggaacauug

SEQ ID NO: 634507 - RNA, 19 nt, Homo sapiens
aggaauaucuagauguguu

SEQ ID NO: 634508 - RNA, 19 nt, Homo sapiens
caagaacaaggucaacuau

SEQ ID NO: 634509 - RNA, 19 nt, Homo sapiens
gcucaauggagaauauaaa

SEQ ID NO: 634510 - RNA, 19 nt, Homo sapiens
cggaggagaggccgaguua

SEQ ID NO: 634511 - RNA, 19 nt, Homo sapiens
gcucuucacaccauucauu

SEQ ID NO: 634512 - RNA, 19 nt, Homo sapiens
gccugugccucccagcuua

SEQ ID NO: 634513 - RNA, 19 nt, Homo sapiens
cuacggacaucuacaaagg

SEQ ID NO: 634514 - RNA, 19 nt, Homo sapiens
gauaccaguucagacacua

SEQ ID NO: 634515 - RNA, 19 nt, Homo sapiens
acaggaauaucuagaugug

SEQ ID NO: 634516 - RNA, 19 nt, Homo sapiens
gcaucaacacacaggaaua

SEQ ID NO: 634517 - RNA, 19 nt, Homo sapiens
ccaaugugcgcaacaagaa

SEQ ID NO: 634518 - RNA, 19 nt, Homo sapiens
gaacauugaggauggaaac

SEQ ID NO: 634519 - RNA, 19 nt, Homo sapiens
acugcgagguuaacaauga

SEQ ID NO: 634520 - RNA, 19 nt, Homo sapiens
gcgucaagcuggaccuaga

SEQ ID NO: 634521 - RNA, 19 nt, Homo sapiens
gaaguacaauuggccaaac

SEQ ID NO: 634522 - RNA, 19 nt, Homo sapiens
cagcagcuccgugagauuu

SEQ ID NO: 634523 - RNA, 19 nt, Homo sapiens
gguaaacgccuccuacaac

SEQ ID NO: 634524 - RNA, 19 nt, Homo sapiens
ucagaacguuggucaaguc

SEQ ID NO: 634525 - RNA, 19 nt, Homo sapiens
acaagcagaucagaacguu

SEQ ID NO: 634526 - RNA, 19 nt, Homo sapiens
caagaagguguucaaggaa

SEQ ID NO: 634527 - RNA, 19 nt, Homo sapiens
gaugugaguggcaguguga

SEQ ID NO: 634528 - RNA, 19 nt, Homo sapiens
ugugugugauuccuuguaa

SEQ ID NO: 634529 - RNA, 19 nt, Homo sapiens
gcaaggggauauagugaug

SEQ ID NO: 634530 - RNA, 19 nt, Homo sapiens
ggacugggcacagcucuuc

SEQ ID NO: 634531 - RNA, 19 nt, Homo sapiens
gaaacuggacucacauucg

SEQ ID NO: 634532 - RNA, 19 nt, Homo sapiens
ggugagauggccaguuuga

SEQ ID NO: 634533 - RNA, 19 nt, Homo sapiens
ggaggaagacaucguguac

SEQ ID NO: 634534 - RNA, 19 nt, Homo sapiens
gaucagaacguuggucaag

SEQ ID NO: 634535 - RNA, 19 nt, Homo sapiens
gcaacaagggccacaagca

SEQ ID NO: 634536 - RNA, 19 nt, Homo sapiens
augcggagcuagaggauga

SEQ ID NO: 634537 - RNA, 19 nt, Homo sapiens
gaaagaaauugaagaacug

SEQ ID NO: 634538 - RNA, 19 nt, Homo sapiens
gagcaacaguggaaucaaa

SEQ ID NO: 634539 - RNA, 19 nt, Homo sapiens
cgaauugguugcaucauaa

SEQ ID NO: 634540 - RNA, 19 nt, Homo sapiens
agaaguagaugucggagaa

SEQ ID NO: 634541 - RNA, 19 nt, Homo sapiens
gauacagucuacagcagua

SEQ ID NO: 634542 - RNA, 19 nt, Homo sapiens
guacuccacugcacgcuaa

SEQ ID NO: 634543 - RNA, 19 nt, Homo sapiens
cuaauucuaugguuucuga

SEQ ID NO: 634544 - RNA, 19 nt, Homo sapiens
caucauaacugcuagaaaa

SEQ ID NO: 634545 - RNA, 19 nt, Homo sapiens
ugaagagacuggagcagaa

SEQ ID NO: 634546 - RNA, 19 nt, Homo sapiens
caacaguggaaucaaauaa

SEQ ID NO: 634547 - RNA, 19 nt, Homo sapiens
aaagaaagcgaaagagaaa

SEQ ID NO: 634548 - RNA, 19 nt, Homo sapiens
gaacugaaacaagagcuaa

SEQ ID NO: 634549 - RNA, 19 nt, Homo sapiens
ccugaaaccugcaaagaug

SEQ ID NO: 634550 - RNA, 19 nt, Homo sapiens
ucgaauugguugcaucaua

SEQ ID NO: 634551 - RNA, 19 nt, Homo sapiens
uugaagaacugaaacaaga

SEQ ID NO: 634552 - RNA, 19 nt, Homo sapiens
gcaauggucaugugugcua

SEQ ID NO: 634553 - RNA, 19 nt, Homo sapiens
ugaaucauguuccucuuga

SEQ ID NO: 634554 - RNA, 19 nt, Homo sapiens
agaggcagaucaaaucauu

SEQ ID NO: 634555 - RNA, 19 nt, Homo sapiens
gaaagggaagggaguaugu

SEQ ID NO: 634556 - RNA, 19 nt, Homo sapiens
aguauuaucucaagcaaug

SEQ ID NO: 634557 - RNA, 19 nt, Homo sapiens
guccuccgcuucaugauuu

SEQ ID NO: 634558 - RNA, 19 nt, Homo sapiens
ucaguggccuggugaauca

SEQ ID NO: 634559 - RNA, 19 nt, Homo sapiens
gcaacaguggaaucaaaua

SEQ ID NO: 634560 - RNA, 19 nt, Homo sapiens
agccugaucuucacacuaa

SEQ ID NO: 634561 - RNA, 19 nt, Homo sapiens
ggucaugugugcuaguuca

SEQ ID NO: 634562 - RNA, 19 nt, Homo sapiens
ugaugcagauucuuuguau

SEQ ID NO: 634563 - RNA, 19 nt, Homo sapiens
gcacgcuaauucuaugguu

SEQ ID NO: 634564 - RNA, 19 nt, Homo sapiens
ggaguauuaucucaagcaa

SEQ ID NO: 634565 - RNA, 19 nt, Homo sapiens
augcuaaacugaagaaaga

SEQ ID NO: 634566 - RNA, 19 nt, Homo sapiens
gaucuucacacuaaugaug

SEQ ID NO: 634567 - RNA, 19 nt, Homo sapiens
gagcugaauccuaagaaga

SEQ ID NO: 634568 - RNA, 19 nt, Homo sapiens
gaaaagaaagcgaaagaga

SEQ ID NO: 634569 - RNA, 19 nt, Homo sapiens
gaaucauguuccucuugaa

SEQ ID NO: 634570 - RNA, 19 nt, Homo sapiens
guguguggcuacauacaaa

SEQ ID NO: 634571 - RNA, 19 nt, Homo sapiens
ggagcugaauccuaagaag

SEQ ID NO: 634572 - RNA, 19 nt, Homo sapiens
ccacugcacgcuaauucua

SEQ ID NO: 634573 - RNA, 19 nt, Homo sapiens
uaaugaugcuguucugaag

SEQ ID NO: 634574 - RNA, 19 nt, Homo sapiens
gaaacaagagcuaauucag

SEQ ID NO: 634575 - RNA, 19 nt, Homo sapiens
uaucuuaagcagcaaguuu

SEQ ID NO: 634576 - RNA, 19 nt, Homo sapiens
gcagaggcagaucaaauca

SEQ ID NO: 634577 - RNA, 19 nt, Homo sapiens
gcuaaacugaagaaagaaa

SEQ ID NO: 634578 - RNA, 19 nt, Homo sapiens
ggcaaauaaugaugcuguu

SEQ ID NO: 634579 - RNA, 19 nt, Homo sapiens
caacuuugagggaagagaa

SEQ ID NO: 634580 - RNA, 19 nt, Homo sapiens
gagacagaauuacuuuuga

SEQ ID NO: 634581 - RNA, 19 nt, Homo sapiens
guuccuggagacagaauua

SEQ ID NO: 634582 - RNA, 19 nt, Homo sapiens
guaccaaagaacagauaaa

SEQ ID NO: 634583 - RNA, 19 nt, Homo sapiens
gugcagaggcagaucaaau

SEQ ID NO: 634584 - RNA, 19 nt, Homo sapiens
caaauaaugaugcuguucu

SEQ ID NO: 634585 - RNA, 19 nt, Homo sapiens
guagaugucggagaaauag

SEQ ID NO: 634586 - RNA, 19 nt, Homo sapiens
gcaaauaaugaugcuguuc

SEQ ID NO: 634587 - RNA, 19 nt, Homo sapiens
gaaaaugugauacagucua

SEQ ID NO: 634588 - RNA, 19 nt, Homo sapiens
augaguguguggcuacaua

SEQ ID NO: 634589 - RNA, 19 nt, Homo sapiens
ggagacagaauuacuuuug

SEQ ID NO: 634590 - RNA, 19 nt, Homo sapiens
gaaauugaagaacugaaac

SEQ ID NO: 634591 - RNA, 19 nt, Homo sapiens
ccaaaagacauuagagaaa

SEQ ID NO: 634592 - RNA, 19 nt, Homo sapiens
gaugcagauucuuuguaug

SEQ ID NO: 634593 - RNA, 19 nt, Homo sapiens
gaaaagaaaggagagaaga

SEQ ID NO: 634594 - RNA, 19 nt, Homo sapiens
aaauaaugaugcuguucug

SEQ ID NO: 634595 - RNA, 19 nt, Homo sapiens
cacgcuaauucuaugguuu

SEQ ID NO: 634596 - RNA, 19 nt, Homo sapiens
gaaguagaugucggagaaa

SEQ ID NO: 634597 - RNA, 19 nt, Homo sapiens
cguaucuucugguaccaaa

SEQ ID NO: 634598 - RNA, 19 nt, Homo sapiens
caaaauggagugaagcaaa

SEQ ID NO: 634599 - RNA, 19 nt, Homo sapiens
gacauuagagaaaaccuua

SEQ ID NO: 634600 - RNA, 19 nt, Homo sapiens
aaagaugaggggaguauua

SEQ ID NO: 634601 - RNA, 19 nt, Homo sapiens
ggugaaucauguuccucuu

SEQ ID NO: 634602 - RNA, 19 nt, Homo sapiens
ggugaaagggaagggagua

SEQ ID NO: 634603 - RNA, 19 nt, Homo sapiens
gagcuaauucaggcagaaa

SEQ ID NO: 634604 - RNA, 19 nt, Homo sapiens
aaggagagaagaaggagaa

SEQ ID NO: 634605 - RNA, 19 nt, Homo sapiens
gcaaucaauagcuggaagu

SEQ ID NO: 634606 - RNA, 19 nt, Homo sapiens
agaaaggagagaagaagga

SEQ ID NO: 634607 - RNA, 19 nt, Homo sapiens
gguccuccgcuucaugauu

SEQ ID NO: 634608 - RNA, 19 nt, Homo sapiens
auaaugaugcuguucugaa

SEQ ID NO: 634609 - RNA, 19 nt, Homo sapiens
ggauggugauuuuacuuug

SEQ ID NO: 634610 - RNA, 19 nt, Homo sapiens
gguaccaaagaacagauaa

SEQ ID NO: 634611 - RNA, 19 nt, Homo sapiens
gaagagacuggagcagaag

SEQ ID NO: 634612 - RNA, 19 nt, Homo sapiens
aaaauggagugaagcaaau

SEQ ID NO: 634613 - RNA, 19 nt, Homo sapiens
aaagggaagggaguaugua

SEQ ID NO: 634614 - RNA, 19 nt, Homo sapiens
guauguggaagaaguagau

SEQ ID NO: 634615 - RNA, 19 nt, Homo sapiens
gcaucauaacugcuagaaa

SEQ ID NO: 634616 - RNA, 19 nt, Homo sapiens
gguugcaucauaacugcua

SEQ ID NO: 634617 - RNA, 19 nt, Homo sapiens
ccgucuggaucuucgaauu

SEQ ID NO: 634618 - RNA, 19 nt, Homo sapiens
ugccgacucuaagccaaua

SEQ ID NO: 634619 - RNA, 19 nt, Homo sapiens
ugugcuaguucaccagaga

SEQ ID NO: 634620 - RNA, 19 nt, Homo sapiens
gugaaucauguuccucuug

SEQ ID NO: 634621 - RNA, 19 nt, Homo sapiens
cuaagccaauagauguuuc

SEQ ID NO: 634622 - RNA, 19 nt, Homo sapiens
aaagaaaggagagaagaag

SEQ ID NO: 634623 - RNA, 19 nt, Homo sapiens
ugaaaaugcuaaacugaag

SEQ ID NO: 634624 - RNA, 19 nt, Homo sapiens
aaauggagugaagcaaaua

SEQ ID NO: 634625 - RNA, 19 nt, Homo sapiens
gggaguauguagggcucaa

SEQ ID NO: 634626 - RNA, 19 nt, Homo sapiens
aguagaugucggagaaaua

SEQ ID NO: 634627 - RNA, 19 nt, Homo sapiens
cgucuggaucuucgaauug

SEQ ID NO: 634628 - RNA, 19 nt, Homo sapiens
ccaaagaacagauaaaagg

SEQ ID NO: 634629 - RNA, 19 nt, Homo sapiens
gagggaagagaagaaacuu

SEQ ID NO: 634630 - RNA, 19 nt, Homo sapiens
ggagaaauagccccaagga

SEQ ID NO: 634631 - RNA, 19 nt, Homo sapiens
ggaagugccgacucuaagc

SEQ ID NO: 634632 - RNA, 19 nt, Homo sapiens
aaaagaaagcgaaagagaa

SEQ ID NO: 634633 - RNA, 19 nt, Homo sapiens
gcugaauccuaagaagaag

SEQ ID NO: 634634 - RNA, 19 nt, Homo sapiens
gaagggugcagaggcagau

SEQ ID NO: 634635 - RNA, 19 nt, Homo sapiens
gggaguauuaucucaagca

SEQ ID NO: 634636 - RNA, 19 nt, Homo sapiens
aaguagaugucggagaaau

SEQ ID NO: 634637 - RNA, 19 nt, Homo sapiens
ggagauagauauauguaga

SEQ ID NO: 634638 - RNA, 19 nt, Homo sapiens
gcaagaagcggaagaaaug

SEQ ID NO: 634639 - RNA, 19 nt, Homo sapiens
ggaauuaaauggacaaagg

SEQ ID NO: 634640 - RNA, 19 nt, Homo sapiens
ggacacagccagugaggua

SEQ ID NO: 634641 - RNA, 19 nt, Homo sapiens
ggagaagaguccagugcua

SEQ ID NO: 634642 - RNA, 19 nt, Homo sapiens
agacaugccuggauuaguu

SEQ ID NO: 634643 - RNA, 19 nt, Homo sapiens
gaacagugccgcagccaaa

SEQ ID NO: 634644 - RNA, 19 nt, Homo sapiens
gggcggagccuguauauau

SEQ ID NO: 634645 - RNA, 19 nt, Homo sapiens
ggagaaaggccaagccaaa

SEQ ID NO: 634646 - RNA, 19 nt, Homo sapiens
gcgaguacaucuacaucua

SEQ ID NO: 634647 - RNA, 19 nt, Homo sapiens
gaguuggguuugcuuauuu

SEQ ID NO: 634648 - RNA, 19 nt, Homo sapiens
ggaaaucagcauugaauau

SEQ ID NO: 634649 - RNA, 19 nt, Homo sapiens
ggagauaguuugacugaac

SEQ ID NO: 634650 - RNA, 19 nt, Homo sapiens
ggaaugguccguuugugua

SEQ ID NO: 634651 - RNA, 19 nt, Homo sapiens
ggaguuggguuugcuuauu

SEQ ID NO: 634652 - RNA, 19 nt, Homo sapiens
gaaaucagcauugaauaug

SEQ ID NO: 634653 - RNA, 19 nt, Homo sapiens
gagcgucggugaagcaaga

SEQ ID NO: 634654 - RNA, 19 nt, Homo sapiens
ggacagauuuaugcagcua

SEQ ID NO: 634655 - RNA, 19 nt, Homo sapiens
ccacccaccucgucuacua

SEQ ID NO: 634656 - RNA, 19 nt, Homo sapiens
gccaagcacugcagagcua

SEQ ID NO: 634657 - RNA, 19 nt, Homo sapiens
ggaagacaugccuggauua

SEQ ID NO: 634658 - RNA, 19 nt, Homo sapiens
gaaaguuugcacuggauuu

SEQ ID NO: 634659 - RNA, 19 nt, Homo sapiens
cuacacggcuuccauaucu

SEQ ID NO: 634660 - RNA, 19 nt, Homo sapiens
cuacaucuauggcaacaug

SEQ ID NO: 634661 - RNA, 19 nt, Homo sapiens
aaucggagcucagcaagaa

SEQ ID NO: 634662 - RNA, 19 nt, Homo sapiens
ccgaagaccuggccagugu

SEQ ID NO: 634663 - RNA, 19 nt, Homo sapiens
cagcaguucuguagcaaga

SEQ ID NO: 634664 - RNA, 19 nt, Homo sapiens
gugcugcgcuagucccuuu

SEQ ID NO: 634665 - RNA, 19 nt, Homo sapiens
cgaugacgguuucuacuau

SEQ ID NO: 634666 - RNA, 19 nt, Homo sapiens
ggaugucauuacuguguuu

SEQ ID NO: 634667 - RNA, 19 nt, Homo sapiens
gagcuacacggcuuccaua

SEQ ID NO: 634668 - RNA, 19 nt, Homo sapiens
gaagagcucagccaaccuu

SEQ ID NO: 634669 - RNA, 19 nt, Homo sapiens
gacaagcgcagaaugagaa

SEQ ID NO: 634670 - RNA, 19 nt, Homo sapiens
gaacacugcagccgacuuc

SEQ ID NO: 634671 - RNA, 19 nt, Homo sapiens
gaguacaucuacaucuaug

SEQ ID NO: 634672 - RNA, 19 nt, Homo sapiens
aagagcagcuucccugaga

SEQ ID NO: 634673 - RNA, 19 nt, Homo sapiens
cagaaacacuggcuuacca

SEQ ID NO: 634674 - RNA, 19 nt, Homo sapiens
gaaagcugcaggaaacgaa

SEQ ID NO: 634675 - RNA, 19 nt, Homo sapiens
cgaaagcggaguuggguuu

SEQ ID NO: 634676 - RNA, 19 nt, Homo sapiens
uggaagacaugccuggauu

SEQ ID NO: 634677 - RNA, 19 nt, Homo sapiens
gaaaggccaagccaaagug

SEQ ID NO: 634678 - RNA, 19 nt, Homo sapiens
ccaaggccgugcuggagaa

SEQ ID NO: 634679 - RNA, 19 nt, Homo sapiens
gaugacgguuucuacuaug

SEQ ID NO: 634680 - RNA, 19 nt, Homo sapiens
gcaagcccuuccagagaga

SEQ ID NO: 634681 - RNA, 19 nt, Homo sapiens
gaacugcagcugagacaag

SEQ ID NO: 634682 - RNA, 19 nt, Homo sapiens
ccucagaaacacuggcuua

SEQ ID NO: 634683 - RNA, 19 nt, Homo sapiens
gcaacagcaucagggagaa

SEQ ID NO: 634684 - RNA, 19 nt, Homo sapiens
caaccuacccgugauucua

SEQ ID NO: 634685 - RNA, 19 nt, Homo sapiens
ggacaaccuacccgugauu

SEQ ID NO: 634686 - RNA, 19 nt, Homo sapiens
uuucauacauucccuguuc

SEQ ID NO: 634687 - RNA, 19 nt, Homo sapiens
ucaaagagccuuggugaag

SEQ ID NO: 634688 - RNA, 19 nt, Homo sapiens
ugagacaagcgcagaauga

SEQ ID NO: 634689 - RNA, 19 nt, Homo sapiens
ggagaaaaggacagauuua

SEQ ID NO: 634690 - RNA, 19 nt, Homo sapiens
gagugugucuuugcauguu

SEQ ID NO: 634691 - RNA, 19 nt, Homo sapiens
ggcggagccuguauauaug

SEQ ID NO: 634692 - RNA, 19 nt, Homo sapiens
ccacagugcugcgcuaguc

SEQ ID NO: 634693 - RNA, 19 nt, Homo sapiens
agauggagauagauauaug

SEQ ID NO: 634694 - RNA, 19 nt, Homo sapiens
cuagauggagauagauaua

SEQ ID NO: 634695 - RNA, 19 nt, Homo sapiens
gcagccgacuucucagcaa

SEQ ID NO: 634696 - RNA, 19 nt, Homo sapiens
gaagacaugccuggauuag

SEQ ID NO: 634697 - RNA, 19 nt, Homo sapiens
gagacugccuggaagacau

SEQ ID NO: 634698 - RNA, 19 nt, Homo sapiens
ugacagcgaugaggagauc

SEQ ID NO: 634699 - RNA, 19 nt, Homo sapiens
ggaggaugcggacaaccua

SEQ ID NO: 634700 - RNA, 19 nt, Homo sapiens
gcaguaccauggagcaacu

SEQ ID NO: 634701 - RNA, 19 nt, Homo sapiens
gcuuggaaaucagcauuga

SEQ ID NO: 634702 - RNA, 19 nt, Homo sapiens
ggacuugcuccuuccagaa

SEQ ID NO: 634703 - RNA, 19 nt, Homo sapiens
gagcgugugucggaugaug

SEQ ID NO: 634704 - RNA, 19 nt, Homo sapiens
caaugagaauccagaagca

SEQ ID NO: 634705 - RNA, 19 nt, Homo sapiens
cagcuucccugagacagaa

SEQ ID NO: 634706 - RNA, 19 nt, Homo sapiens
gaaggucagagcuaaaugg

SEQ ID NO: 634707 - RNA, 19 nt, Homo sapiens
gcagggaaggcucagaaug

SEQ ID NO: 634708 - RNA, 19 nt, Homo sapiens
ggaggaggaggaagaggaa

SEQ ID NO: 634709 - RNA, 19 nt, Homo sapiens
gagccaggauccaggucuu

SEQ ID NO: 634710 - RNA, 19 nt, Homo sapiens
gugcacugcuggccaagga

SEQ ID NO: 634711 - RNA, 19 nt, Homo sapiens
gcagcuauuuucauacauu

SEQ ID NO: 634712 - RNA, 19 nt, Homo sapiens
acagauuuaugcagcuauu

SEQ ID NO: 634713 - RNA, 19 nt, Homo sapiens
gcauggacgaugacgguuu

SEQ ID NO: 634714 - RNA, 19 nt, Homo sapiens
cgacuucucagcaacaaug

SEQ ID NO: 634715 - RNA, 19 nt, Homo sapiens
ggaccagcuuggaguugug

SEQ ID NO: 634716 - RNA, 19 nt, Homo sapiens
gaucuuuguggcucuguuu

SEQ ID NO: 634717 - RNA, 19 nt, Homo sapiens
gcccagcaggcgccaaaua

SEQ ID NO: 634718 - RNA, 19 nt, Homo sapiens
gcagcgcugugccauccuu

SEQ ID NO: 634719 - RNA, 19 nt, Homo sapiens
cauggacgaugacgguuuc

SEQ ID NO: 634720 - RNA, 19 nt, Homo sapiens
gggaugucauuacuguguu

SEQ ID NO: 634721 - RNA, 19 nt, Homo sapiens
ggagagccacagagaagga

SEQ ID NO: 634722 - RNA, 19 nt, Homo sapiens
gaaaaggacagauuuaugc

SEQ ID NO: 634723 - RNA, 19 nt, Homo sapiens
ggacgaugacgguuucuac

SEQ ID NO: 634724 - RNA, 19 nt, Homo sapiens
gggaaugguccguuugugu

SEQ ID NO: 634725 - RNA, 19 nt, Homo sapiens
ggaugccgauggcuucuac

SEQ ID NO: 634726 - RNA, 19 nt, Homo sapiens
ggacagccagcacaucuac

SEQ ID NO: 634727 - RNA, 19 nt, Homo sapiens
uucaagaacugaggucuga

SEQ ID NO: 634728 - RNA, 19 nt, Homo sapiens
ggugggagauaguuugacu

SEQ ID NO: 634729 - RNA, 19 nt, Homo sapiens
cagugaguauguaacuuga

SEQ ID NO: 634730 - RNA, 19 nt, Homo sapiens
gcgaugaggagaucuugga

SEQ ID NO: 634731 - RNA, 19 nt, Homo sapiens
ggccuggucccuuccaauu

SEQ ID NO: 634732 - RNA, 19 nt, Homo sapiens
ccagagggaacaugaagga

SEQ ID NO: 634733 - RNA, 19 nt, Homo sapiens
cccgaaagcugcaggaaac

SEQ ID NO: 634734 - RNA, 19 nt, Homo sapiens
gaaagcggaguuggguuug

SEQ ID NO: 634735 - RNA, 19 nt, Homo sapiens
ggaaaguuugcacuggauu

SEQ ID NO: 634736 - RNA, 19 nt, Homo sapiens
gaugggcucugggaagaag

SEQ ID NO: 634737 - RNA, 19 nt, Homo sapiens
gcagaagccuggauuaaug

SEQ ID NO: 634738 - RNA, 19 nt, Homo sapiens
ccacccagcuccaucagua

SEQ ID NO: 634739 - RNA, 19 nt, Homo sapiens
gcaagcuacucuacuuuga

SEQ ID NO: 634740 - RNA, 19 nt, Homo sapiens
gcauaaggcugcaggaaag

SEQ ID NO: 634741 - RNA, 19 nt, Homo sapiens
caagaagaauguuggugaa

SEQ ID NO: 634742 - RNA, 19 nt, Homo sapiens
agaaggaacuggcucauuc

SEQ ID NO: 634743 - RNA, 19 nt, Homo sapiens
ggaacugaauguccuacuu

SEQ ID NO: 634744 - RNA, 19 nt, Homo sapiens
ccuuguggcuggauaauaa

SEQ ID NO: 634745 - RNA, 19 nt, Homo sapiens
gaugguaaauuucagaucu

SEQ ID NO: 634746 - RNA, 19 nt, Homo sapiens
gcacaggucggaugguaaa

SEQ ID NO: 634747 - RNA, 19 nt, Homo sapiens
ccucuuugcugcugcauaa

SEQ ID NO: 634748 - RNA, 19 nt, Homo sapiens
caggucggaugguaaauuu

SEQ ID NO: 634749 - RNA, 19 nt, Homo sapiens
gucauucgguugcugcuua

SEQ ID NO: 634750 - RNA, 19 nt, Homo sapiens
gaaaguuccugugguugug

SEQ ID NO: 634751 - RNA, 19 nt, Homo sapiens
gcugagcaguugcagauug

SEQ ID NO: 634752 - RNA, 19 nt, Homo sapiens
gguacaaguucccaugcua

SEQ ID NO: 634753 - RNA, 19 nt, Homo sapiens
gaacugaauguccuacuuc

SEQ ID NO: 634754 - RNA, 19 nt, Homo sapiens
gcagauugaauauagcuuu

SEQ ID NO: 634755 - RNA, 19 nt, Homo sapiens
uuucagaucuuugccuaua

SEQ ID NO: 634756 - RNA, 19 nt, Homo sapiens
caaccuagcugggcagucu

SEQ ID NO: 634757 - RNA, 19 nt, Homo sapiens
gaggagcucuaccuuaguc

SEQ ID NO: 634758 - RNA, 19 nt, Homo sapiens
gcggcaagcuacucuacuu

SEQ ID NO: 634759 - RNA, 19 nt, Homo sapiens
gugcacaggucggauggua

SEQ ID NO: 634760 - RNA, 19 nt, Homo sapiens
ucugcgagcuggccaguuu

SEQ ID NO: 634761 - RNA, 19 nt, Homo sapiens
cacauucucuguucuaagu

SEQ ID NO: 634762 - RNA, 19 nt, Homo sapiens
ccaggaagcugcggagcaa

SEQ ID NO: 634763 - RNA, 19 nt, Homo sapiens
gaacggcagcgagcgagua

SEQ ID NO: 634764 - RNA, 19 nt, Homo sapiens
caugcaucauuaccaaaua

SEQ ID NO: 634765 - RNA, 19 nt, Homo sapiens
cuaugagccucgccacuuu

SEQ ID NO: 634766 - RNA, 19 nt, Homo sapiens
uggaggagcucuaccuuag

SEQ ID NO: 634767 - RNA, 19 nt, Homo sapiens
gaguaaauguugccuuggu

SEQ ID NO: 634768 - RNA, 19 nt, Homo sapiens
gcagcgagcgaguaaaugu

SEQ ID NO: 634769 - RNA, 19 nt, Homo sapiens
ucagaucuuugccuauaga

SEQ ID NO: 634770 - RNA, 19 nt, Homo sapiens
guaaauguugccuugguuu

SEQ ID NO: 634771 - RNA, 19 nt, Homo sapiens
gagaagaugggacucuguu

SEQ ID NO: 634772 - RNA, 19 nt, Homo sapiens
gcaaggcccauuuucaaua

SEQ ID NO: 634773 - RNA, 19 nt, Homo sapiens
gaagaugggacucuguuac

SEQ ID NO: 634774 - RNA, 19 nt, Homo sapiens
uguggaagaucaaagacaa

SEQ ID NO: 634775 - RNA, 19 nt, Homo sapiens
ggaaggaguggcagagauc

SEQ ID NO: 634776 - RNA, 19 nt, Homo sapiens
gcaguugcagauugaauau

SEQ ID NO: 634777 - RNA, 19 nt, Homo sapiens
caacuuacacagaguacug

SEQ ID NO: 634778 - RNA, 19 nt, Homo sapiens
ggcauaaggcugcaggaaa

SEQ ID NO: 634779 - RNA, 19 nt, Homo sapiens
guacaaguucccaugcuau

SEQ ID NO: 634780 - RNA, 19 nt, Homo sapiens
gcccagcgacuguggcuaa

SEQ ID NO: 634781 - RNA, 19 nt, Homo sapiens
gagccucgccacuuuccua

SEQ ID NO: 634782 - RNA, 19 nt, Homo sapiens
gaagaauguuggugaaaag

SEQ ID NO: 634783 - RNA, 19 nt, Homo sapiens
ggaguggcagagaucauuu

SEQ ID NO: 634784 - RNA, 19 nt, Homo sapiens
cauccucaaugucuucuuc

SEQ ID NO: 634785 - RNA, 19 nt, Homo sapiens
ugcuagccaugcaucauua

SEQ ID NO: 634786 - RNA, 19 nt, Homo sapiens
cagauugaauauagcuuuc

SEQ ID NO: 634787 - RNA, 19 nt, Homo sapiens
caaagacaacccacugauc

SEQ ID NO: 634788 - RNA, 19 nt, Homo sapiens
ggucggaugguaaauuuca

SEQ ID NO: 634789 - RNA, 19 nt, Homo sapiens
gcuacaguguccagaucaa

SEQ ID NO: 634790 - RNA, 19 nt, Homo sapiens
cuugccagcucaugucauu

SEQ ID NO: 634791 - RNA, 19 nt, Homo sapiens
ggacauucaccgccagauc

SEQ ID NO: 634792 - RNA, 19 nt, Homo sapiens
caacuuggccaccuaugag

SEQ ID NO: 634793 - RNA, 19 nt, Homo sapiens
ugacuuagcuggggaugaa

SEQ ID NO: 634794 - RNA, 19 nt, Homo sapiens
gggacaaggagaagugcua

SEQ ID NO: 634795 - RNA, 19 nt, Homo sapiens
uuccugugguugugaguua

SEQ ID NO: 634796 - RNA, 19 nt, Homo sapiens
cugagcaguugcagauuga

SEQ ID NO: 634797 - RNA, 19 nt, Homo sapiens
uggagagccucaugcuaga

SEQ ID NO: 634798 - RNA, 19 nt, Homo sapiens
aagagaggaucgcccaauc

SEQ ID NO: 634799 - RNA, 19 nt, Homo sapiens
caugcuaugugcagaacga

SEQ ID NO: 634800 - RNA, 19 nt, Homo sapiens
caaguucccaugcuaugug

SEQ ID NO: 634801 - RNA, 19 nt, Homo sapiens
ggcaagcuacucuacuuug

SEQ ID NO: 634802 - RNA, 19 nt, Homo sapiens
gcaugagagcggcaagcua

SEQ ID NO: 634803 - RNA, 19 nt, Homo sapiens
agcgugagcuggaggagaa

SEQ ID NO: 634804 - RNA, 19 nt, Homo sapiens
guaaauuucagaucuuugc

SEQ ID NO: 634805 - RNA, 19 nt, Homo sapiens
ucauucgguugcugcuuaa

SEQ ID NO: 634806 - RNA, 19 nt, Homo sapiens
ggacaguggcaaccugaag

SEQ ID NO: 634807 - RNA, 19 nt, Homo sapiens
ucaacuuggccaccuauga

SEQ ID NO: 634808 - RNA, 19 nt, Homo sapiens
gacaguggcaaccugaaga

SEQ ID NO: 634809 - RNA, 19 nt, Homo sapiens
caucgcagccuaccagaag

SEQ ID NO: 634810 - RNA, 19 nt, Homo sapiens
ggugcugcccgaccacuuu

SEQ ID NO: 634811 - RNA, 19 nt, Homo sapiens
cggaaggaguggcagagau

SEQ ID NO: 634812 - RNA, 19 nt, Homo sapiens
uugaauggguccacagcuu

SEQ ID NO: 634813 - RNA, 19 nt, Homo sapiens
agaagaugggacucuguua

SEQ ID NO: 634814 - RNA, 19 nt, Homo sapiens
caaccucacccgccucauc

SEQ ID NO: 634815 - RNA, 19 nt, Homo sapiens
ugaaaguuaugaggugauc

SEQ ID NO: 634816 - RNA, 19 nt, Homo sapiens
caucguguaugacuuagcu

SEQ ID NO: 634817 - RNA, 19 nt, Homo sapiens
ccuacgaggucugcaugaa

SEQ ID NO: 634818 - RNA, 19 nt, Homo sapiens
ggacauugaggcacugaac

SEQ ID NO: 634819 - RNA, 19 nt, Homo sapiens
ggagaagaugggacucugu

SEQ ID NO: 634820 - RNA, 19 nt, Homo sapiens
ccaacgcgguggugugcau

SEQ ID NO: 634821 - RNA, 19 nt, Homo sapiens
gugcacauucucuguucua

SEQ ID NO: 634822 - RNA, 19 nt, Homo sapiens
aguugcagauugaauauag

SEQ ID NO: 634823 - RNA, 19 nt, Homo sapiens
ugcuggagcugcuggagaa

SEQ ID NO: 634824 - RNA, 19 nt, Homo sapiens
aguaaauguugccuugguu

SEQ ID NO: 634825 - RNA, 19 nt, Homo sapiens
gagcaguugcagauugaau

SEQ ID NO: 634826 - RNA, 19 nt, Homo sapiens
uucaauaccugcucaacca

SEQ ID NO: 634827 - RNA, 19 nt, Homo sapiens
cagaaggaacuggcucauu

SEQ ID NO: 634828 - RNA, 19 nt, Homo sapiens
gaaggaguggcagagauca

SEQ ID NO: 634829 - RNA, 19 nt, Homo sapiens
ucaaggagcacgucuucca

SEQ ID NO: 634830 - RNA, 19 nt, Homo sapiens
agaagaauguuggugaaaa

SEQ ID NO: 634831 - RNA, 19 nt, Homo sapiens
gcacauucucuguucuaag

SEQ ID NO: 634832 - RNA, 19 nt, Homo sapiens
gccuauagagggaaaguuc

SEQ ID NO: 634833 - RNA, 19 nt, Homo sapiens
caugcagaagccuggauua

SEQ ID NO: 634834 - RNA, 19 nt, Homo sapiens
cgagagaucuuccccaacu

SEQ ID NO: 634835 - RNA, 19 nt, Homo sapiens
gggcauaaggcugcaggaa

SEQ ID NO: 634836 - RNA, 19 nt, Homo sapiens
ucaaagacaacccacugau

SEQ ID NO: 634837 - RNA, 19 nt, Homo sapiens
gaacagggccuucuacaug

SEQ ID NO: 634838 - RNA, 19 nt, Homo sapiens
caucauggauuccuucaaa

SEQ ID NO: 634839 - RNA, 19 nt, Homo sapiens
gaagauguuuggcacgaaa

SEQ ID NO: 634840 - RNA, 19 nt, Homo sapiens
gagcaucgauggcgagaau

SEQ ID NO: 634841 - RNA, 19 nt, Homo sapiens
gcaccgaguucaugcaaga

SEQ ID NO: 634842 - RNA, 19 nt, Homo sapiens
gaaagaccuucuacuccaa

SEQ ID NO: 634843 - RNA, 19 nt, Homo sapiens
gcaagacucccguguguca

SEQ ID NO: 634844 - RNA, 19 nt, Homo sapiens
caucgaagcucagaacaag

SEQ ID NO: 634845 - RNA, 19 nt, Homo sapiens
gagcgagacuaugagaaga

SEQ ID NO: 634846 - RNA, 19 nt, Homo sapiens
gaggagcaccugaagaaau

SEQ ID NO: 634847 - RNA, 19 nt, Homo sapiens
gugggaagguccuggaaga

SEQ ID NO: 634848 - RNA, 19 nt, Homo sapiens
gagccggcaucauggauuc

SEQ ID NO: 634849 - RNA, 19 nt, Homo sapiens
cggcaagacucccgugugu

SEQ ID NO: 634850 - RNA, 19 nt, Homo sapiens
gaagauuacaggcgagauc

SEQ ID NO: 634851 - RNA, 19 nt, Homo sapiens
cggaggaguuuguguguag

SEQ ID NO: 634852 - RNA, 19 nt, Homo sapiens
gggcaaggacuucaaugug

SEQ ID NO: 634853 - RNA, 19 nt, Homo sapiens
cauggauuccuucaaagua

SEQ ID NO: 634854 - RNA, 19 nt, Homo sapiens
caccuccagugccacaaua

SEQ ID NO: 634855 - RNA, 19 nt, Homo sapiens
ugccuucucucauguguga

SEQ ID NO: 634856 - RNA, 19 nt, Homo sapiens
agaucaaccuggaaggaaa

SEQ ID NO: 634857 - RNA, 19 nt, Homo sapiens
gcgagacuaugagaagaug

SEQ ID NO: 634858 - RNA, 19 nt, Homo sapiens
gcggguagccucacacaca

SEQ ID NO: 634859 - RNA, 19 nt, Homo sapiens
cgaaaugccauggcuguga

SEQ ID NO: 634860 - RNA, 19 nt, Homo sapiens
gagacuaugagaagauguu

SEQ ID NO: 634861 - RNA, 19 nt, Homo sapiens
ggguagggcuggcaauggu

SEQ ID NO: 634862 - RNA, 19 nt, Homo sapiens
ggaacagggccuucuacau

SEQ ID NO: 634863 - RNA, 19 nt, Homo sapiens
gaaugcggguagccucaca

SEQ ID NO: 634864 - RNA, 19 nt, Homo sapiens
aggagcaccugaagaaauc

SEQ ID NO: 634865 - RNA, 19 nt, Homo sapiens
gaucaugcacgcccugaag

SEQ ID NO: 634866 - RNA, 19 nt, Homo sapiens
gcugugacuucaagaucga

SEQ ID NO: 634867 - RNA, 19 nt, Homo sapiens
gcuaugacgugcgcuaugc

SEQ ID NO: 634868 - RNA, 19 nt, Homo sapiens
gcagagccgcaccuccauu

SEQ ID NO: 634869 - RNA, 19 nt, Homo sapiens
gaugaggagcaccugaaga

SEQ ID NO: 634870 - RNA, 19 nt, Homo sapiens
gugccacaauaaaccugua

SEQ ID NO: 634871 - RNA, 19 nt, Homo sapiens
ggagccggcaucauggauu

SEQ ID NO: 634872 - RNA, 19 nt, Homo sapiens
gcaagagccaugccuucuc

SEQ ID NO: 634873 - RNA, 19 nt, Homo sapiens
gauuacaggcgagaucaug

SEQ ID NO: 634874 - RNA, 19 nt, Homo sapiens
ccaagugcaagaagaagau

SEQ ID NO: 634875 - RNA, 19 nt, Homo sapiens
guaccacccggaggaguuu

SEQ ID NO: 634876 - RNA, 19 nt, Homo sapiens
gagccgcaccuccauugug

SEQ ID NO: 634877 - RNA, 19 nt, Homo sapiens
cagagccgcaccuccauug

SEQ ID NO: 634878 - RNA, 19 nt, Homo sapiens
cagaucaaccuggaaggaa

SEQ ID NO: 634879 - RNA, 19 nt, Homo sapiens
ugugcgauaugucagauca

SEQ ID NO: 634880 - RNA, 19 nt, Homo sapiens
ccauggcugugacuucaag

SEQ ID NO: 634881 - RNA, 19 nt, Homo sapiens
cgagcgagacuaugagaag

SEQ ID NO: 634882 - RNA, 19 nt, Homo sapiens
ccggaggaguuugugugua

SEQ ID NO: 634883 - RNA, 19 nt, Homo sapiens
ugccauggcugugacuuca

SEQ ID NO: 634884 - RNA, 19 nt, Homo sapiens
gaucaaccuggaaggaaag

SEQ ID NO: 634885 - RNA, 19 nt, Homo sapiens
augaggagcaccugaagaa

SEQ ID NO: 634886 - RNA, 19 nt, Homo sapiens
gccaagugcaagaagaaga

SEQ ID NO: 634887 - RNA, 19 nt, Homo sapiens
gugccaagugcaagaagaa

SEQ ID NO: 634888 - RNA, 19 nt, Homo sapiens
cagcgucucccucaacaag

SEQ ID NO: 634889 - RNA, 19 nt, Homo sapiens
agaagauguuuggcacgaa

SEQ ID NO: 634890 - RNA, 19 nt, Homo sapiens
ucgaagcucagaacaagau

SEQ ID NO: 634891 - RNA, 19 nt, Homo sapiens
ggaagugccugcugauugu

SEQ ID NO: 634892 - RNA, 19 nt, Homo sapiens
caacaaaggucccucaaac

SEQ ID NO: 634893 - RNA, 19 nt, Homo sapiens
caauaacucucuacaggaa

SEQ ID NO: 634894 - RNA, 19 nt, Homo sapiens
ccacuuggcugaccagguu

SEQ ID NO: 634895 - RNA, 19 nt, Homo sapiens
gaacagcagcagugccaua

SEQ ID NO: 634896 - RNA, 19 nt, Homo sapiens
gaccaggcauucacagaaa

SEQ ID NO: 634897 - RNA, 19 nt, Homo sapiens
ccaagucucuuccuccuau

SEQ ID NO: 634898 - RNA, 19 nt, Homo sapiens
gaaccacccuuggaucaug

SEQ ID NO: 634899 - RNA, 19 nt, Homo sapiens
gaaugaccaucaccgaguu

SEQ ID NO: 634900 - RNA, 19 nt, Homo sapiens
ggagaaauucgcccucaaa

SEQ ID NO: 634901 - RNA, 19 nt, Homo sapiens
gaagaacgccaucaucgau

SEQ ID NO: 634902 - RNA, 19 nt, Homo sapiens
gaaauucgcccucaaaaug

SEQ ID NO: 634903 - RNA, 19 nt, Homo sapiens
gaagugaagaugcucauuc

SEQ ID NO: 634904 - RNA, 19 nt, Homo sapiens
gaaagagaagcauccgaaa

SEQ ID NO: 634905 - RNA, 19 nt, Homo sapiens
gguaucaucuucucauuuu

SEQ ID NO: 634906 - RNA, 19 nt, Homo sapiens
gaaugggccaguaugaauu

SEQ ID NO: 634907 - RNA, 19 nt, Homo sapiens
gacaagcaauaacucucua

SEQ ID NO: 634908 - RNA, 19 nt, Homo sapiens
ggacgguggagaacucuuu

SEQ ID NO: 634909 - RNA, 19 nt, Homo sapiens
auaacucucuacaggaaua

SEQ ID NO: 634910 - RNA, 19 nt, Homo sapiens
ugacaaguccugugacaug

SEQ ID NO: 634911 - RNA, 19 nt, Homo sapiens
gcaccaugcuguccaacuc

SEQ ID NO: 634912 - RNA, 19 nt, Homo sapiens
acgagcagaucaagauaaa

SEQ ID NO: 634913 - RNA, 19 nt, Homo sapiens
ccacaaugcgcguugacua

SEQ ID NO: 634914 - RNA, 19 nt, Homo sapiens
caagaggacccaggagaaa

SEQ ID NO: 634915 - RNA, 19 nt, Homo sapiens
ccagaauggucagaaguau

SEQ ID NO: 634916 - RNA, 19 nt, Homo sapiens
uaucacagcaacauugaaa

SEQ ID NO: 634917 - RNA, 19 nt, Homo sapiens
gggcaucaacggcaaaguu

SEQ ID NO: 634918 - RNA, 19 nt, Homo sapiens
cuauguggcuccagaagug

SEQ ID NO: 634919 - RNA, 19 nt, Homo sapiens
uccaguaucugcauucaau

SEQ ID NO: 634920 - RNA, 19 nt, Homo sapiens
cgaaugggccaguaugaau

SEQ ID NO: 634921 - RNA, 19 nt, Homo sapiens
guuauacaccguacuaugu

SEQ ID NO: 634922 - RNA, 19 nt, Homo sapiens
gcccaacgccauccugaaa

SEQ ID NO: 634923 - RNA, 19 nt, Homo sapiens
ggacaagcaauaacucucu

SEQ ID NO: 634924 - RNA, 19 nt, Homo sapiens
gaccacuccuuguuauaca

SEQ ID NO: 634925 - RNA, 19 nt, Homo sapiens
gagcccacccagagaauga

SEQ ID NO: 634926 - RNA, 19 nt, Homo sapiens
gacaaguccugugacaugu

SEQ ID NO: 634927 - RNA, 19 nt, Homo sapiens
gccugcagaucaagaagaa

SEQ ID NO: 634928 - RNA, 19 nt, Homo sapiens
ugauugucauggaauguuu

SEQ ID NO: 634929 - RNA, 19 nt, Homo sapiens
gcagaccggacccagguuu

SEQ ID NO: 634930 - RNA, 19 nt, Homo sapiens
ggcaucaacggcaaaguuu

SEQ ID NO: 634931 - RNA, 19 nt, Homo sapiens
ccaccagccacaacucuuu

SEQ ID NO: 634932 - RNA, 19 nt, Homo sapiens
cauccgaaaucaugaagag

SEQ ID NO: 634933 - RNA, 19 nt, Homo sapiens
caagaagaacgccaucauc

SEQ ID NO: 634934 - RNA, 19 nt, Homo sapiens
agaagcauccgaaaucaug

SEQ ID NO: 634935 - RNA, 19 nt, Homo sapiens
gaucaugcaaucaacaaag

SEQ ID NO: 634936 - RNA, 19 nt, Homo sapiens
ucaccgaguuuaugaacca

SEQ ID NO: 634937 - RNA, 19 nt, Homo sapiens
agaauggucagaaguauca

SEQ ID NO: 634938 - RNA, 19 nt, Homo sapiens
agagaagcauccgaaauca

SEQ ID NO: 634939 - RNA, 19 nt, Homo sapiens
aagagaagcauccgaaauc

SEQ ID NO: 634940 - RNA, 19 nt, Homo sapiens
gaccaucaccgaguuuaug

SEQ ID NO: 634941 - RNA, 19 nt, Homo sapiens
ccaacccucugcugcugaa

SEQ ID NO: 634942 - RNA, 19 nt, Homo sapiens
ccagagaaguaugacaagu

SEQ ID NO: 634943 - RNA, 19 nt, Homo sapiens
acucagugcuguuucuuag

SEQ ID NO: 634944 - RNA, 19 nt, Homo sapiens
uaugacaaguccugugaca

SEQ ID NO: 634945 - RNA, 19 nt, Homo sapiens
gaagcauccgaaaucauga

SEQ ID NO: 634946 - RNA, 19 nt, Homo sapiens
aaagagaagcauccgaaau

SEQ ID NO: 634947 - RNA, 19 nt, Homo sapiens
guacggaucguggaugugu

SEQ ID NO: 634948 - RNA, 19 nt, Homo sapiens
cacgggaggacaagcaaua

SEQ ID NO: 634949 - RNA, 19 nt, Homo sapiens
ucuaaugggaccuuaaaga

SEQ ID NO: 634950 - RNA, 19 nt, Homo sapiens
gaauuucccaacccagaau

SEQ ID NO: 634951 - RNA, 19 nt, Homo sapiens
gugaggccauccaguaucu

SEQ ID NO: 634952 - RNA, 19 nt, Homo sapiens
ucaacaaaggucccucaaa

SEQ ID NO: 634953 - RNA, 19 nt, Homo sapiens
gacgguggagaacucuuua

SEQ ID NO: 634954 - RNA, 19 nt, Homo sapiens
uaucugcauucaaucaaca

SEQ ID NO: 634955 - RNA, 19 nt, Homo sapiens
acaagaggacccaggagaa

SEQ ID NO: 634956 - RNA, 19 nt, Homo sapiens
gaggaagugccugcugauu

SEQ ID NO: 634957 - RNA, 19 nt, Homo sapiens
agaggacccaggagaaauu

SEQ ID NO: 634958 - RNA, 19 nt, Homo sapiens
cagaggaagugaagaugcu

SEQ ID NO: 634959 - RNA, 19 nt, Homo sapiens
uaucagaggaagugaagau

SEQ ID NO: 634960 - RNA, 19 nt, Homo sapiens
gaaaccaccagccacaacu

SEQ ID NO: 634961 - RNA, 19 nt, Homo sapiens
ccaacgccauccugaaacu

SEQ ID NO: 634962 - RNA, 19 nt, Homo sapiens
ggcauucacagaaagagaa

SEQ ID NO: 634963 - RNA, 19 nt, Homo sapiens
aaacgaagagacagaacug

SEQ ID NO: 634964 - RNA, 19 nt, Homo sapiens
ccagugccuuggccacaau

SEQ ID NO: 634965 - RNA, 19 nt, Homo sapiens
ccacuaaccagcccgucuu

SEQ ID NO: 634966 - RNA, 19 nt, Homo sapiens
ggaagugaagaugcucauu

SEQ ID NO: 634967 - RNA, 19 nt, Homo sapiens
uaauucaccaugucacaga

SEQ ID NO: 634968 - RNA, 19 nt, Homo sapiens
gagaccaggcauucacaga

SEQ ID NO: 634969 - RNA, 19 nt, Homo sapiens
cuacgagcagaucaagaua

SEQ ID NO: 634970 - RNA, 19 nt, Homo sapiens
caucugguaucaucuucuc

SEQ ID NO: 634971 - RNA, 19 nt, Homo sapiens
cccagaauggucagaagua

SEQ ID NO: 634972 - RNA, 19 nt, Homo sapiens
guccagagaaguaugacaa

SEQ ID NO: 634973 - RNA, 19 nt, Homo sapiens
ggaaaccaccagccacaac

SEQ ID NO: 634974 - RNA, 19 nt, Homo sapiens
ucggugaggccauccagua

SEQ ID NO: 634975 - RNA, 19 nt, Homo sapiens
caaugcgcguugacuacga

SEQ ID NO: 634976 - RNA, 19 nt, Homo sapiens
ucuucuggcucucucugua

SEQ ID NO: 634977 - RNA, 19 nt, Homo sapiens
ucucuaaugggaccuuaaa

SEQ ID NO: 634978 - RNA, 19 nt, Homo sapiens
ggaucaugcaaucaacaaa

SEQ ID NO: 634979 - RNA, 19 nt, Homo sapiens
ccacggccuugccaucucu

SEQ ID NO: 634980 - RNA, 19 nt, Homo sapiens
aggaagugccugcugauug

SEQ ID NO: 634981 - RNA, 19 nt, Homo sapiens
ccugaaacucacugacuuu

SEQ ID NO: 634982 - RNA, 19 nt, Homo sapiens
gagaagcauccgaaaucau

SEQ ID NO: 634983 - RNA, 19 nt, Homo sapiens
agaccaggcauucacagaa

SEQ ID NO: 634984 - RNA, 19 nt, Homo sapiens
agaaguaucagaggaagug

SEQ ID NO: 634985 - RNA, 19 nt, Homo sapiens
gaagacucgcauccgaaug

SEQ ID NO: 634986 - RNA, 19 nt, Homo sapiens
gucccugggugucaucaug

SEQ ID NO: 634987 - RNA, 19 nt, Homo sapiens
ucaagaagaacgccaucau

SEQ ID NO: 634988 - RNA, 19 nt, Homo sapiens
uaaccagcccgucuucucu

SEQ ID NO: 634989 - RNA, 19 nt, Homo sapiens
gcauccgaaugggccagua

SEQ ID NO: 634990 - RNA, 19 nt, Homo sapiens
cagagaaguaugacaaguc

SEQ ID NO: 634991 - RNA, 19 nt, Homo sapiens
ggaagugccugcugauugu

SEQ ID NO: 634992 - RNA, 19 nt, Homo sapiens
caacaaaggucccucaaac

SEQ ID NO: 634993 - RNA, 19 nt, Homo sapiens
caauaacucucuacaggaa

SEQ ID NO: 634994 - RNA, 19 nt, Homo sapiens
gaccaggcauucacagaaa

SEQ ID NO: 634995 - RNA, 19 nt, Homo sapiens
gaaccacccuuggaucaug

SEQ ID NO: 634996 - RNA, 19 nt, Homo sapiens
gaaugaccaucaccgaguu

SEQ ID NO: 634997 - RNA, 19 nt, Homo sapiens
ggagaaauucgcccucaaa

SEQ ID NO: 634998 - RNA, 19 nt, Homo sapiens
gaagaacgccaucaucgau

SEQ ID NO: 634999 - RNA, 19 nt, Homo sapiens
gaaauucgcccucaaaaug

SEQ ID NO: 635000 - RNA, 19 nt, Homo sapiens
gaagugaagaugcucauuc

SEQ ID NO: 635001 - RNA, 19 nt, Homo sapiens
gaaagagaagcauccgaaa

SEQ ID NO: 635002 - RNA, 19 nt, Homo sapiens
gaaugggccaguaugaauu

SEQ ID NO: 635003 - RNA, 19 nt, Homo sapiens
gacaagcaauaacucucua

SEQ ID NO: 635004 - RNA, 19 nt, Homo sapiens
ggacgguggagaacucuuu

SEQ ID NO: 635005 - RNA, 19 nt, Homo sapiens
auaacucucuacaggaaua

SEQ ID NO: 635006 - RNA, 19 nt, Homo sapiens
ugacaaguccugugacaug

SEQ ID NO: 635007 - RNA, 19 nt, Homo sapiens
gcaccaugcuguccaacuc

SEQ ID NO: 635008 - RNA, 19 nt, Homo sapiens
acgagcagaucaagauaaa

SEQ ID NO: 635009 - RNA, 19 nt, Homo sapiens
ccacaaugcgcguugacua

SEQ ID NO: 635010 - RNA, 19 nt, Homo sapiens
caagaggacccaggagaaa

SEQ ID NO: 635011 - RNA, 19 nt, Homo sapiens
ccagaauggucagaaguau

SEQ ID NO: 635012 - RNA, 19 nt, Homo sapiens
uaucacagcaacauugaaa

SEQ ID NO: 635013 - RNA, 19 nt, Homo sapiens
gggcaucaacggcaaaguu

SEQ ID NO: 635014 - RNA, 19 nt, Homo sapiens
cuauguggcuccagaagug

SEQ ID NO: 635015 - RNA, 19 nt, Homo sapiens
uccaguaucugcauucaau

SEQ ID NO: 635016 - RNA, 19 nt, Homo sapiens
cgaaugggccaguaugaau

SEQ ID NO: 635017 - RNA, 19 nt, Homo sapiens
guuauacaccguacuaugu

SEQ ID NO: 635018 - RNA, 19 nt, Homo sapiens
gcccaacgccauccugaaa

SEQ ID NO: 635019 - RNA, 19 nt, Homo sapiens
ggacaagcaauaacucucu

SEQ ID NO: 635020 - RNA, 19 nt, Homo sapiens
gaccacuccuuguuauaca

SEQ ID NO: 635021 - RNA, 19 nt, Homo sapiens
gagcccacccagagaauga

SEQ ID NO: 635022 - RNA, 19 nt, Homo sapiens
gacaaguccugugacaugu

SEQ ID NO: 635023 - RNA, 19 nt, Homo sapiens
gccugcagaucaagaagaa

SEQ ID NO: 635024 - RNA, 19 nt, Homo sapiens
ugauugucauggaauguuu

SEQ ID NO: 635025 - RNA, 19 nt, Homo sapiens
ggcaucaacggcaaaguuu

SEQ ID NO: 635026 - RNA, 19 nt, Homo sapiens
ccaccagccacaacucuuu

SEQ ID NO: 635027 - RNA, 19 nt, Homo sapiens
cauccgaaaucaugaagag

SEQ ID NO: 635028 - RNA, 19 nt, Homo sapiens
caagaagaacgccaucauc

SEQ ID NO: 635029 - RNA, 19 nt, Homo sapiens
agaagcauccgaaaucaug

SEQ ID NO: 635030 - RNA, 19 nt, Homo sapiens
gaucaugcaaucaacaaag

SEQ ID NO: 635031 - RNA, 19 nt, Homo sapiens
ucaccgaguuuaugaacca

SEQ ID NO: 635032 - RNA, 19 nt, Homo sapiens
agaauggucagaaguauca

SEQ ID NO: 635033 - RNA, 19 nt, Homo sapiens
agagaagcauccgaaauca

SEQ ID NO: 635034 - RNA, 19 nt, Homo sapiens
aagagaagcauccgaaauc

SEQ ID NO: 635035 - RNA, 19 nt, Homo sapiens
gaccaucaccgaguuuaug

SEQ ID NO: 635036 - RNA, 19 nt, Homo sapiens
ccaacccucugcugcugaa

SEQ ID NO: 635037 - RNA, 19 nt, Homo sapiens
ccagagaaguaugacaagu

SEQ ID NO: 635038 - RNA, 19 nt, Homo sapiens
uaugacaaguccugugaca

SEQ ID NO: 635039 - RNA, 19 nt, Homo sapiens
gaagcauccgaaaucauga

SEQ ID NO: 635040 - RNA, 19 nt, Homo sapiens
aaagagaagcauccgaaau

SEQ ID NO: 635041 - RNA, 19 nt, Homo sapiens
guacggaucguggaugugu

SEQ ID NO: 635042 - RNA, 19 nt, Homo sapiens
cacgggaggacaagcaaua

SEQ ID NO: 635043 - RNA, 19 nt, Homo sapiens
gaauuucccaacccagaau

SEQ ID NO: 635044 - RNA, 19 nt, Homo sapiens
gugaggccauccaguaucu

SEQ ID NO: 635045 - RNA, 19 nt, Homo sapiens
ucaacaaaggucccucaaa

SEQ ID NO: 635046 - RNA, 19 nt, Homo sapiens
gacgguggagaacucuuua

SEQ ID NO: 635047 - RNA, 19 nt, Homo sapiens
ggugggaggaugucaagga

SEQ ID NO: 635048 - RNA, 19 nt, Homo sapiens
ggugucaucauguacauuc

SEQ ID NO: 635049 - RNA, 19 nt, Homo sapiens
acaagaggacccaggagaa

SEQ ID NO: 635050 - RNA, 19 nt, Homo sapiens
uaucugcauucaaucaaca

SEQ ID NO: 635051 - RNA, 19 nt, Homo sapiens
gaggaagugccugcugauu

SEQ ID NO: 635052 - RNA, 19 nt, Homo sapiens
cagaggaagugaagaugcu

SEQ ID NO: 635053 - RNA, 19 nt, Homo sapiens
uaucagaggaagugaagau

SEQ ID NO: 635054 - RNA, 19 nt, Homo sapiens
gaaaccaccagccacaacu

SEQ ID NO: 635055 - RNA, 19 nt, Homo sapiens
ccaacgccauccugaaacu

SEQ ID NO: 635056 - RNA, 19 nt, Homo sapiens
ggcauucacagaaagagaa

SEQ ID NO: 635057 - RNA, 19 nt, Homo sapiens
agaggacccaggagaaauu

SEQ ID NO: 635058 - RNA, 19 nt, Homo sapiens
aaacgaagagacagaacug

SEQ ID NO: 635059 - RNA, 19 nt, Homo sapiens
ccagugccuuggccacaau

SEQ ID NO: 635060 - RNA, 19 nt, Homo sapiens
uaauucaccaugucacaga

SEQ ID NO: 635061 - RNA, 19 nt, Homo sapiens
ggaagugaagaugcucauu

SEQ ID NO: 635062 - RNA, 19 nt, Homo sapiens
gagaccaggcauucacaga

SEQ ID NO: 635063 - RNA, 19 nt, Homo sapiens
cuacgagcagaucaagaua

SEQ ID NO: 635064 - RNA, 19 nt, Homo sapiens
cccagaauggucagaagua

SEQ ID NO: 635065 - RNA, 19 nt, Homo sapiens
guccagagaaguaugacaa

SEQ ID NO: 635066 - RNA, 19 nt, Homo sapiens
ggaaaccaccagccacaac

SEQ ID NO: 635067 - RNA, 19 nt, Homo sapiens
ucggugaggccauccagua

SEQ ID NO: 635068 - RNA, 19 nt, Homo sapiens
caaugcgcguugacuacga

SEQ ID NO: 635069 - RNA, 19 nt, Homo sapiens
ggaucaugcaaucaacaaa

SEQ ID NO: 635070 - RNA, 19 nt, Homo sapiens
ccacggccuugccaucucu

SEQ ID NO: 635071 - RNA, 19 nt, Homo sapiens
ccugaaacucacugacuuu

SEQ ID NO: 635072 - RNA, 19 nt, Homo sapiens
gagaagcauccgaaaucau

SEQ ID NO: 635073 - RNA, 19 nt, Homo sapiens
agaccaggcauucacagaa

SEQ ID NO: 635074 - RNA, 19 nt, Homo sapiens
aggaagugccugcugauug

SEQ ID NO: 635075 - RNA, 19 nt, Homo sapiens
ucaagaagaacgccaucau

SEQ ID NO: 635076 - RNA, 19 nt, Homo sapiens
agaaguaucagaggaagug

SEQ ID NO: 635077 - RNA, 19 nt, Homo sapiens
gaagacucgcauccgaaug

SEQ ID NO: 635078 - RNA, 19 nt, Homo sapiens
gucccugggugucaucaug

SEQ ID NO: 635079 - RNA, 19 nt, Homo sapiens
gcauccgaaugggccagua

SEQ ID NO: 635080 - RNA, 19 nt, Homo sapiens
cagagaaguaugacaaguc

SEQ ID NO: 635081 - RNA, 19 nt, Homo sapiens
gaggacaagcaauaacucu

SEQ ID NO: 635082 - RNA, 19 nt, Homo sapiens
ugaauuucccaacccagaa

SEQ ID NO: 635083 - RNA, 19 nt, Homo sapiens
aaugggccaguaugaauuu

SEQ ID NO: 635084 - RNA, 19 nt, Homo sapiens
ugaagacucgcauccgaau

SEQ ID NO: 635085 - RNA, 19 nt, Homo sapiens
uuugaccacuccuuguuau

SEQ ID NO: 635086 - RNA, 19 nt, Homo sapiens
ggaggaagugccugcugau

SEQ ID NO: 635087 - RNA, 19 nt, Homo sapiens
cauccaguaucugcauuca

SEQ ID NO: 635088 - RNA, 19 nt, Homo sapiens
gccauccaguaucugcauu

SEQ ID NO: 635089 - RNA, 19 nt, Homo sapiens
ggaggacaagcaauaacuc

SEQ ID NO: 635090 - RNA, 19 nt, Homo sapiens
gggaggacaagcaauaacu

SEQ ID NO: 635091 - RNA, 19 nt, Homo sapiens
caagaaacauaccucaaua

SEQ ID NO: 635092 - RNA, 19 nt, Homo sapiens
ugagauagcucugcagaua

SEQ ID NO: 635093 - RNA, 19 nt, Homo sapiens
ccagugagauuaugauuug

SEQ ID NO: 635094 - RNA, 19 nt, Homo sapiens
gauguuaucagacucauua

SEQ ID NO: 635095 - RNA, 19 nt, Homo sapiens
gggagaagauaaucaagaa

SEQ ID NO: 635096 - RNA, 19 nt, Homo sapiens
cagaaauccugaacuauga

SEQ ID NO: 635097 - RNA, 19 nt, Homo sapiens
gggaacaccagaauauuua

SEQ ID NO: 635098 - RNA, 19 nt, Homo sapiens
gaggauagcagcaugguuu

SEQ ID NO: 635099 - RNA, 19 nt, Homo sapiens
gcauauauguuguuaacuc

SEQ ID NO: 635100 - RNA, 19 nt, Homo sapiens
ugaguuggcugaaaugguu

SEQ ID NO: 635101 - RNA, 19 nt, Homo sapiens
gaauaacauuguacaccuu

SEQ ID NO: 635102 - RNA, 19 nt, Homo sapiens
acaaauacuugaaggaguu

SEQ ID NO: 635103 - RNA, 19 nt, Homo sapiens
guuguuaacucacacauca

SEQ ID NO: 635104 - RNA, 19 nt, Homo sapiens
gauuuaaagccacagaaua

SEQ ID NO: 635105 - RNA, 19 nt, Homo sapiens
gagaagacaaagagaauau

SEQ ID NO: 635106 - RNA, 19 nt, Homo sapiens
gcuagcauguuaugauuuc

SEQ ID NO: 635107 - RNA, 19 nt, Homo sapiens
ggaauaauuuagggaagug

SEQ ID NO: 635108 - RNA, 19 nt, Homo sapiens
ccagaaauccugaacuaug

SEQ ID NO: 635109 - RNA, 19 nt, Homo sapiens
ccacagaauauauuacuga

SEQ ID NO: 635110 - RNA, 19 nt, Homo sapiens
gggaaguguuuuaauguua

SEQ ID NO: 635111 - RNA, 19 nt, Homo sapiens
aauggaaccuguggugaua

SEQ ID NO: 635112 - RNA, 19 nt, Homo sapiens
cauuguacaccuugauuua

SEQ ID NO: 635113 - RNA, 19 nt, Homo sapiens
gaaggaguuuauuaucuac

SEQ ID NO: 635114 - RNA, 19 nt, Homo sapiens
gagauuugauugccgaagu

SEQ ID NO: 635115 - RNA, 19 nt, Homo sapiens
gagauagcucugcagauaa

SEQ ID NO: 635116 - RNA, 19 nt, Homo sapiens
ucuaaauccuccuguaaug

SEQ ID NO: 635117 - RNA, 19 nt, Homo sapiens
agauaugccuuucucauuc

SEQ ID NO: 635118 - RNA, 19 nt, Homo sapiens
cgagauugcugugcuugaa

SEQ ID NO: 635119 - RNA, 19 nt, Homo sapiens
agacaagacuucuaaaucc

SEQ ID NO: 635120 - RNA, 19 nt, Homo sapiens
gaagaagaggacaggauug

SEQ ID NO: 635121 - RNA, 19 nt, Homo sapiens
ccaagaauaugcugcaaaa

SEQ ID NO: 635122 - RNA, 19 nt, Homo sapiens
cauuuggacugaauuugaa

SEQ ID NO: 635123 - RNA, 19 nt, Homo sapiens
gccacagacuuuauucaga

SEQ ID NO: 635124 - RNA, 19 nt, Homo sapiens
cuccagaaauccugaacua

SEQ ID NO: 635125 - RNA, 19 nt, Homo sapiens
ucaagaaacauaccucaau

SEQ ID NO: 635126 - RNA, 19 nt, Homo sapiens
gcaacagauauguggaaua

SEQ ID NO: 635127 - RNA, 19 nt, Homo sapiens
uuucacagcuggccacaga

SEQ ID NO: 635128 - RNA, 19 nt, Homo sapiens
gaacuaugaucccauuacc

SEQ ID NO: 635129 - RNA, 19 nt, Homo sapiens
gaauauuuagcuccagaaa

SEQ ID NO: 635130 - RNA, 19 nt, Homo sapiens
gaacuuguuucagauuugc

SEQ ID NO: 635131 - RNA, 19 nt, Homo sapiens
gauaugccuuucucauucu

SEQ ID NO: 635132 - RNA, 19 nt, Homo sapiens
aacuacaacuccucaaauu

SEQ ID NO: 635133 - RNA, 19 nt, Homo sapiens
gaaccuguggugauagaga

SEQ ID NO: 635134 - RNA, 19 nt, Homo sapiens
gagaagauaaucaagaaac

SEQ ID NO: 635135 - RNA, 19 nt, Homo sapiens
caugggaacaccagaauau

SEQ ID NO: 635136 - RNA, 19 nt, Homo sapiens
uaacuacaacuccucaaau

SEQ ID NO: 635137 - RNA, 19 nt, Homo sapiens
ugacucauuuggacugaau

SEQ ID NO: 635138 - RNA, 19 nt, Homo sapiens
caaaagauuucguuucgau

SEQ ID NO: 635139 - RNA, 19 nt, Homo sapiens
cagcagagauaugccuuuc

SEQ ID NO: 635140 - RNA, 19 nt, Homo sapiens
acucacacaucaccauuug

SEQ ID NO: 635141 - RNA, 19 nt, Homo sapiens
gugguuagacaauguauau

SEQ ID NO: 635142 - RNA, 19 nt, Homo sapiens
gcccuugucuggaaaagua

SEQ ID NO: 635143 - RNA, 19 nt, Homo sapiens
gaagcagaccugggaauca

SEQ ID NO: 635144 - RNA, 19 nt, Homo sapiens
guagauuauucggaagaaa

SEQ ID NO: 635145 - RNA, 19 nt, Homo sapiens
ccugaacuaugaucccauu

SEQ ID NO: 635146 - RNA, 19 nt, Homo sapiens
gggcaugcgugugaacuuc

SEQ ID NO: 635147 - RNA, 19 nt, Homo sapiens
aaauagggcaugcguguga

SEQ ID NO: 635148 - RNA, 19 nt, Homo sapiens
cgucggcccuugucuggaa

SEQ ID NO: 635149 - RNA, 19 nt, Homo sapiens
gagaagaagaggacaggau

SEQ ID NO: 635150 - RNA, 19 nt, Homo sapiens
aaagauuucguuucgauga

SEQ ID NO: 635151 - RNA, 19 nt, Homo sapiens
ggagaagauaaucaagaaa

SEQ ID NO: 635152 - RNA, 19 nt, Homo sapiens
uaaauccuccuguaaugga

SEQ ID NO: 635153 - RNA, 19 nt, Homo sapiens
agauuugauugccgaagua

SEQ ID NO: 635154 - RNA, 19 nt, Homo sapiens
gguuagacaauguauauca

SEQ ID NO: 635155 - RNA, 19 nt, Homo sapiens
gggaaucaccuaacauguc

SEQ ID NO: 635156 - RNA, 19 nt, Homo sapiens
ugggaacaccagaauauuu

SEQ ID NO: 635157 - RNA, 19 nt, Homo sapiens
uaccugaguuggcugaaau

SEQ ID NO: 635158 - RNA, 19 nt, Homo sapiens
agaagaagaggacaggauu

SEQ ID NO: 635159 - RNA, 19 nt, Homo sapiens
ucauuuggacugaauuuga

SEQ ID NO: 635160 - RNA, 19 nt, Homo sapiens
guaagguccucugaagaca

SEQ ID NO: 635161 - RNA, 19 nt, Homo sapiens
aggagucacuucacgagaa

SEQ ID NO: 635162 - RNA, 19 nt, Homo sapiens
uuugauugccgaaguauuu

SEQ ID NO: 635163 - RNA, 19 nt, Homo sapiens
agauugcugugcuugaauu

SEQ ID NO: 635164 - RNA, 19 nt, Homo sapiens
agauagcucugcagauaag

SEQ ID NO: 635165 - RNA, 19 nt, Homo sapiens
gugagauuaugauuuguag

SEQ ID NO: 635166 - RNA, 19 nt, Homo sapiens
cuacagcagugggacuuug

SEQ ID NO: 635167 - RNA, 19 nt, Homo sapiens
uugcuagcauguuaugauu

SEQ ID NO: 635168 - RNA, 19 nt, Homo sapiens
aaacucaggaucauucugu

SEQ ID NO: 635169 - RNA, 19 nt, Homo sapiens
caugaggucuaugaaaaua

SEQ ID NO: 635170 - RNA, 19 nt, Homo sapiens
cagcaugguuuccaaaaga

SEQ ID NO: 635171 - RNA, 19 nt, Homo sapiens
uagagaagacaaagagaau

SEQ ID NO: 635172 - RNA, 19 nt, Homo sapiens
uaacucacacaucaccauu

SEQ ID NO: 635173 - RNA, 19 nt, Homo sapiens
ggaguuuauuaucuacauc

SEQ ID NO: 635174 - RNA, 19 nt, Homo sapiens
auaagugacuaaagaagca

SEQ ID NO: 635175 - RNA, 19 nt, Homo sapiens
gagauuaugauuuguagcu

SEQ ID NO: 635176 - RNA, 19 nt, Homo sapiens
gacaagacuucuaaauccu

SEQ ID NO: 635177 - RNA, 19 nt, Homo sapiens
cgugugaacuucgggaaau

SEQ ID NO: 635178 - RNA, 19 nt, Homo sapiens
gauugucgggcagaaauuu

SEQ ID NO: 635179 - RNA, 19 nt, Homo sapiens
cuccucaaauuccaauaaa

SEQ ID NO: 635180 - RNA, 19 nt, Homo sapiens
ucuguaagguccucugaag

SEQ ID NO: 635181 - RNA, 19 nt, Homo sapiens
gauagagaagacaaagaga

SEQ ID NO: 635182 - RNA, 19 nt, Homo sapiens
aagacaagacuucuaaauc

SEQ ID NO: 635183 - RNA, 19 nt, Homo sapiens
ucgaggaggagauuugauu

SEQ ID NO: 635184 - RNA, 19 nt, Homo sapiens
cuacaucagaauaacauug

SEQ ID NO: 635185 - RNA, 19 nt, Homo sapiens
cuaacuacaacuccucaaa

SEQ ID NO: 635186 - RNA, 19 nt, Homo sapiens
cagcaacagauauguggaa

SEQ ID NO: 635187 - RNA, 19 nt, Homo sapiens
gaaauccugaacuaugauc

SEQ ID NO: 635188 - RNA, 19 nt, Homo sapiens
guuaucagacucauuaaac

SEQ ID NO: 635189 - RNA, 19 nt, Homo sapiens
gaagacaaagagaauaucc

SEQ ID NO: 635190 - RNA, 19 nt, Homo sapiens
acuuacaucuaaagagcua

SEQ ID NO: 635191 - RNA, 19 nt, Homo sapiens
gaagaagccuuuaaagaaa

SEQ ID NO: 635192 - RNA, 19 nt, Homo sapiens
gaagagcuccgagaaauua

SEQ ID NO: 635193 - RNA, 19 nt, Homo sapiens
ggaaguggauaaccaguau

SEQ ID NO: 635194 - RNA, 19 nt, Homo sapiens
gcauuggaguguuaacaua

SEQ ID NO: 635195 - RNA, 19 nt, Homo sapiens
gaauuuaucuacugagcaa

SEQ ID NO: 635196 - RNA, 19 nt, Homo sapiens
gaucuuaguucuggaauau

SEQ ID NO: 635197 - RNA, 19 nt, Homo sapiens
ccaguaaaguccaauuaaa

SEQ ID NO: 635198 - RNA, 19 nt, Homo sapiens
gagaagaagccuuuaaaga

SEQ ID NO: 635199 - RNA, 19 nt, Homo sapiens
cuguaaaucucuugcauua

SEQ ID NO: 635200 - RNA, 19 nt, Homo sapiens
uaagaaaccugaagaucga

SEQ ID NO: 635201 - RNA, 19 nt, Homo sapiens
agaagaagccuuuaaagaa

SEQ ID NO: 635202 - RNA, 19 nt, Homo sapiens
ggauggaaauaauucauga

SEQ ID NO: 635203 - RNA, 19 nt, Homo sapiens
gaggaagaauuugauguuu

SEQ ID NO: 635204 - RNA, 19 nt, Homo sapiens
uaagagaggugguaauuuu

SEQ ID NO: 635205 - RNA, 19 nt, Homo sapiens
ugagcaauauuucccuuua

SEQ ID NO: 635206 - RNA, 19 nt, Homo sapiens
uaacauaugucaugcuuac

SEQ ID NO: 635207 - RNA, 19 nt, Homo sapiens
acagauauguggagcauug

SEQ ID NO: 635208 - RNA, 19 nt, Homo sapiens
gacaauccuugggucauua

SEQ ID NO: 635209 - RNA, 19 nt, Homo sapiens
ugagauugcuguacuugaa

SEQ ID NO: 635210 - RNA, 19 nt, Homo sapiens
gugaagagcuccgagaaau

SEQ ID NO: 635211 - RNA, 19 nt, Homo sapiens
gagagagagugucuucaug

SEQ ID NO: 635212 - RNA, 19 nt, Homo sapiens
ggguuuaggugucagcuuu

SEQ ID NO: 635213 - RNA, 19 nt, Homo sapiens
uuuagaagguguucacuuu

SEQ ID NO: 635214 - RNA, 19 nt, Homo sapiens
ugucaaauuuguggaguua

SEQ ID NO: 635215 - RNA, 19 nt, Homo sapiens
aggaauaucaccuuucuua

SEQ ID NO: 635216 - RNA, 19 nt, Homo sapiens
gugaaaagaugcuacuaua

SEQ ID NO: 635217 - RNA, 19 nt, Homo sapiens
gcaaaugcccuccaagaag

SEQ ID NO: 635218 - RNA, 19 nt, Homo sapiens
cugcaaaguucaugagaaa

SEQ ID NO: 635219 - RNA, 19 nt, Homo sapiens
ggaagaauuugauguuuug

SEQ ID NO: 635220 - RNA, 19 nt, Homo sapiens
guggagcauuggaguguua

SEQ ID NO: 635221 - RNA, 19 nt, Homo sapiens
gauuugaagccucagaaua

SEQ ID NO: 635222 - RNA, 19 nt, Homo sapiens
gcucagugcauuaaauauu

SEQ ID NO: 635223 - RNA, 19 nt, Homo sapiens
gaccaguaaaguccaauua

SEQ ID NO: 635224 - RNA, 19 nt, Homo sapiens
gaauauugaagaacaguga

SEQ ID NO: 635225 - RNA, 19 nt, Homo sapiens
caaugucacuaguaagaga

SEQ ID NO: 635226 - RNA, 19 nt, Homo sapiens
caacagauauguggagcau

SEQ ID NO: 635227 - RNA, 19 nt, Homo sapiens
gagacugcaucagaaauga

SEQ ID NO: 635228 - RNA, 19 nt, Homo sapiens
agacuuaugcgacagauuu

SEQ ID NO: 635229 - RNA, 19 nt, Homo sapiens
gaaauuauucuggguuuag

SEQ ID NO: 635230 - RNA, 19 nt, Homo sapiens
guuacccguuucaauguua

SEQ ID NO: 635231 - RNA, 19 nt, Homo sapiens
uuacaggaauaucaccuuu

SEQ ID NO: 635232 - RNA, 19 nt, Homo sapiens
guuaacauaugucaugcuu

SEQ ID NO: 635233 - RNA, 19 nt, Homo sapiens
auauguggcuccugaaauu

SEQ ID NO: 635234 - RNA, 19 nt, Homo sapiens
gaauauguggcuccugaaa

SEQ ID NO: 635235 - RNA, 19 nt, Homo sapiens
agacagagaagaagccuuu

SEQ ID NO: 635236 - RNA, 19 nt, Homo sapiens
uaucagcccucaagcuaug

SEQ ID NO: 635237 - RNA, 19 nt, Homo sapiens
gcagagagagagagagaga

SEQ ID NO: 635238 - RNA, 19 nt, Homo sapiens
acaagaaauuccaggagaa

SEQ ID NO: 635239 - RNA, 19 nt, Homo sapiens
gaaccuuugcuacaagaaa

SEQ ID NO: 635240 - RNA, 19 nt, Homo sapiens
ugaggaaccuuugcuacaa

SEQ ID NO: 635241 - RNA, 19 nt, Homo sapiens
ggaaaaggcacuagaagaa

SEQ ID NO: 635242 - RNA, 19 nt, Homo sapiens
ugaaaucuuugaccagugu

SEQ ID NO: 635243 - RNA, 19 nt, Homo sapiens
gagcaauauuucccuuuag

SEQ ID NO: 635244 - RNA, 19 nt, Homo sapiens
ugagucggcuguugauuuc

SEQ ID NO: 635245 - RNA, 19 nt, Homo sapiens
gaauaucaccuuucuuagg

SEQ ID NO: 635246 - RNA, 19 nt, Homo sapiens
ccgaauaccuuaaaguaac

SEQ ID NO: 635247 - RNA, 19 nt, Homo sapiens
ugauuaggauugaacaguu

SEQ ID NO: 635248 - RNA, 19 nt, Homo sapiens
gagcagagagagagagaga

SEQ ID NO: 635249 - RNA, 19 nt, Homo sapiens
gcugcaaaguucaugagaa

SEQ ID NO: 635250 - RNA, 19 nt, Homo sapiens
cagagaagaagccuuuaaa

SEQ ID NO: 635251 - RNA, 19 nt, Homo sapiens
ugaacaccaugaucccuuu

SEQ ID NO: 635252 - RNA, 19 nt, Homo sapiens
gaaauuugcaguggugaga

SEQ ID NO: 635253 - RNA, 19 nt, Homo sapiens
cuaauuauccuuacacaca

SEQ ID NO: 635254 - RNA, 19 nt, Homo sapiens
guaguuacuucauauacuc

SEQ ID NO: 635255 - RNA, 19 nt, Homo sapiens
acaguucaguuguaucuau

SEQ ID NO: 635256 - RNA, 19 nt, Homo sapiens
gcaauauuucccuuuagaa

SEQ ID NO: 635257 - RNA, 19 nt, Homo sapiens
ucaacacucugguuaccuu

SEQ ID NO: 635258 - RNA, 19 nt, Homo sapiens
caggagaauuuaucuacug

SEQ ID NO: 635259 - RNA, 19 nt, Homo sapiens
acacagagcaguauucaag

SEQ ID NO: 635260 - RNA, 19 nt, Homo sapiens
ucucacagaugaauuuaag

SEQ ID NO: 635261 - RNA, 19 nt, Homo sapiens
gggagauguuggcaccuuu

SEQ ID NO: 635262 - RNA, 19 nt, Homo sapiens
gaagccagauuuuaaaagu

SEQ ID NO: 635263 - RNA, 19 nt, Homo sapiens
gauuucaucaggacacuuu

SEQ ID NO: 635264 - RNA, 19 nt, Homo sapiens
agacaauccuugggucauu

SEQ ID NO: 635265 - RNA, 19 nt, Homo sapiens
guaagagaggugguaauuu

SEQ ID NO: 635266 - RNA, 19 nt, Homo sapiens
gauguuggcaccuuugaau

SEQ ID NO: 635267 - RNA, 19 nt, Homo sapiens
gcaaaaggccauuuccaaa

SEQ ID NO: 635268 - RNA, 19 nt, Homo sapiens
gccgaauaccuuaaaguaa

SEQ ID NO: 635269 - RNA, 19 nt, Homo sapiens
ugaacuagcacaagacaau

SEQ ID NO: 635270 - RNA, 19 nt, Homo sapiens
ugucaugcuuacaggaaua

SEQ ID NO: 635271 - RNA, 19 nt, Homo sapiens
uauagugacuugauuuggu

SEQ ID NO: 635272 - RNA, 19 nt, Homo sapiens
guguaucuauaucugcaua

SEQ ID NO: 635273 - RNA, 19 nt, Homo sapiens
ugaauucuacauccuguuu

SEQ ID NO: 635274 - RNA, 19 nt, Homo sapiens
gaggaaccuuugcuacaag

SEQ ID NO: 635275 - RNA, 19 nt, Homo sapiens
aauauucuguugacaagug

SEQ ID NO: 635276 - RNA, 19 nt, Homo sapiens
gaagaaaaggccaagauug

SEQ ID NO: 635277 - RNA, 19 nt, Homo sapiens
auccuugggucauuaauuu

SEQ ID NO: 635278 - RNA, 19 nt, Homo sapiens
gaaugagaauuuguguaca

SEQ ID NO: 635279 - RNA, 19 nt, Homo sapiens
uaaguuauucugaggaaga

SEQ ID NO: 635280 - RNA, 19 nt, Homo sapiens
cuaguaacauaucagugaa

SEQ ID NO: 635281 - RNA, 19 nt, Homo sapiens
acaguuacccguuucaaug

SEQ ID NO: 635282 - RNA, 19 nt, Homo sapiens
ugaggaagaauuugauguu

SEQ ID NO: 635283 - RNA, 19 nt, Homo sapiens
ucagaaaugaucuuaguuc

SEQ ID NO: 635284 - RNA, 19 nt, Homo sapiens
acacucacaugcaucuguu

SEQ ID NO: 635285 - RNA, 19 nt, Homo sapiens
cugaaauuauucuggguuu

SEQ ID NO: 635286 - RNA, 19 nt, Homo sapiens
gcugaagaaugucuaaagc

SEQ ID NO: 635287 - RNA, 19 nt, Homo sapiens
cuauaagcauggcaacaga

SEQ ID NO: 635288 - RNA, 19 nt, Homo sapiens
gcuuuauagugacuugauu

SEQ ID NO: 635289 - RNA, 19 nt, Homo sapiens
uuaugagacugcaucagaa

SEQ ID NO: 635290 - RNA, 19 nt, Homo sapiens
ucaggacacuuuuaguuaa

SEQ ID NO: 635291 - RNA, 19 nt, Homo sapiens
gcagagaucccuucuauga

SEQ ID NO: 635292 - RNA, 19 nt, Homo sapiens
ggaauucaguuucuaauag

SEQ ID NO: 635293 - RNA, 19 nt, Homo sapiens
gaaagaaauucaacaugga

SEQ ID NO: 635294 - RNA, 19 nt, Homo sapiens
ggagaaggccuaaauaaga

SEQ ID NO: 635295 - RNA, 19 nt, Homo sapiens
gaagauugaucgcaugaug

SEQ ID NO: 635296 - RNA, 19 nt, Homo sapiens
cagcagagaucccuucuau

SEQ ID NO: 635297 - RNA, 19 nt, Homo sapiens
gaagaccucucauuagaag

SEQ ID NO: 635298 - RNA, 19 nt, Homo sapiens
ggaaucaucccguuggaaa

SEQ ID NO: 635299 - RNA, 19 nt, Homo sapiens
gggaguggcucaagaugga

SEQ ID NO: 635300 - RNA, 19 nt, Homo sapiens
uugagaggcugaaauauga

SEQ ID NO: 635301 - RNA, 19 nt, Homo sapiens
gaaagccacuguuuuauag

SEQ ID NO: 635302 - RNA, 19 nt, Homo sapiens
gacgggagccucauucgua

SEQ ID NO: 635303 - RNA, 19 nt, Homo sapiens
cugaagaccucucauuaga

SEQ ID NO: 635304 - RNA, 19 nt, Homo sapiens
gaacgagccauuuaagauc

SEQ ID NO: 635305 - RNA, 19 nt, Homo sapiens
cagaagacgucgcccaguu

SEQ ID NO: 635306 - RNA, 19 nt, Homo sapiens
gcugaaauaugaaauugca

SEQ ID NO: 635307 - RNA, 19 nt, Homo sapiens
gaauuuguaugagagcauu

SEQ ID NO: 635308 - RNA, 19 nt, Homo sapiens
gagaaggccuaaauaagac

SEQ ID NO: 635309 - RNA, 19 nt, Homo sapiens
uaaaggagaaggccuaaau

SEQ ID NO: 635310 - RNA, 19 nt, Homo sapiens
ggaacuuauugaugacauu

SEQ ID NO: 635311 - RNA, 19 nt, Homo sapiens
gggaauucaguuucuaaua

SEQ ID NO: 635312 - RNA, 19 nt, Homo sapiens
gugaaagggaugaauuuaa

SEQ ID NO: 635313 - RNA, 19 nt, Homo sapiens
uaaauaagaccgucauugg

SEQ ID NO: 635314 - RNA, 19 nt, Homo sapiens
gaaaaugaccugcuacaga

SEQ ID NO: 635315 - RNA, 19 nt, Homo sapiens
guauuaaccguucuagaaa

SEQ ID NO: 635316 - RNA, 19 nt, Homo sapiens
cugaggagcugcugaggaa

SEQ ID NO: 635317 - RNA, 19 nt, Homo sapiens
uaacugccucuauuacuuu

SEQ ID NO: 635318 - RNA, 19 nt, Homo sapiens
gauggaggcuuucgcuucu

SEQ ID NO: 635319 - RNA, 19 nt, Homo sapiens
ggugaaagggaugaauuua

SEQ ID NO: 635320 - RNA, 19 nt, Homo sapiens
agagaucccuucuaugaca

SEQ ID NO: 635321 - RNA, 19 nt, Homo sapiens
gccugaagaccucucauua

SEQ ID NO: 635322 - RNA, 19 nt, Homo sapiens
uugcagaggugaugacaga

SEQ ID NO: 635323 - RNA, 19 nt, Homo sapiens
gcauuaagaacgagccauu

SEQ ID NO: 635324 - RNA, 19 nt, Homo sapiens
gaaggaggaguggaugaaa

SEQ ID NO: 635325 - RNA, 19 nt, Homo sapiens
gggaggcgcagaagauuga

SEQ ID NO: 635326 - RNA, 19 nt, Homo sapiens
acauugagaggcugaaaua

SEQ ID NO: 635327 - RNA, 19 nt, Homo sapiens
cuagaaagccacuguuuua

SEQ ID NO: 635328 - RNA, 19 nt, Homo sapiens
ccgauaacugccucuauua

SEQ ID NO: 635329 - RNA, 19 nt, Homo sapiens
gaggagcugcugaggaauu

SEQ ID NO: 635330 - RNA, 19 nt, Homo sapiens
aaaggagaaggccuaaaua

SEQ ID NO: 635331 - RNA, 19 nt, Homo sapiens
gaacuuauugaugacauug

SEQ ID NO: 635332 - RNA, 19 nt, Homo sapiens
ucgcccaguuccuuuauaa

SEQ ID NO: 635333 - RNA, 19 nt, Homo sapiens
ggaagaaagaaauucaaca

SEQ ID NO: 635334 - RNA, 19 nt, Homo sapiens
aguauuaaccguucuagaa

SEQ ID NO: 635335 - RNA, 19 nt, Homo sapiens
ucagaggaacaaacagaua

SEQ ID NO: 635336 - RNA, 19 nt, Homo sapiens
aaggagaaggccuaaauaa

SEQ ID NO: 635337 - RNA, 19 nt, Homo sapiens
aaagggaauucaguuucua

SEQ ID NO: 635338 - RNA, 19 nt, Homo sapiens
auaacugccucuauuacuu

SEQ ID NO: 635339 - RNA, 19 nt, Homo sapiens
gcagaggugaugacagaga

SEQ ID NO: 635340 - RNA, 19 nt, Homo sapiens
gcgcauguccagaagcauu

SEQ ID NO: 635341 - RNA, 19 nt, Homo sapiens
gcaacgaggaaacgaagga

SEQ ID NO: 635342 - RNA, 19 nt, Homo sapiens
gggugaaagggaugaauuu

SEQ ID NO: 635343 - RNA, 19 nt, Homo sapiens
gcaaaacgacucagaggaa

SEQ ID NO: 635344 - RNA, 19 nt, Homo sapiens
gaaauugcagaggugauga

SEQ ID NO: 635345 - RNA, 19 nt, Homo sapiens
uguaugagagcauuaagaa

SEQ ID NO: 635346 - RNA, 19 nt, Homo sapiens
accgauaacugccucuauu

SEQ ID NO: 635347 - RNA, 19 nt, Homo sapiens
gguucauccugaccgauaa

SEQ ID NO: 635348 - RNA, 19 nt, Homo sapiens
auuaagaacgagccauuua

SEQ ID NO: 635349 - RNA, 19 nt, Homo sapiens
gagaaggaggaguggauga

SEQ ID NO: 635350 - RNA, 19 nt, Homo sapiens
acaaagggcaggucaucaa

SEQ ID NO: 635351 - RNA, 19 nt, Homo sapiens
agaacgagccauuuaagau

SEQ ID NO: 635352 - RNA, 19 nt, Homo sapiens
gagaggcugaaauaugaaa

SEQ ID NO: 635353 - RNA, 19 nt, Homo sapiens
gaggcugaaauaugaaauu

SEQ ID NO: 635354 - RNA, 19 nt, Homo sapiens
cgacucagaggaacaaaca

SEQ ID NO: 635355 - RNA, 19 nt, Homo sapiens
gcagacacgggacggauuc

SEQ ID NO: 635356 - RNA, 19 nt, Homo sapiens
ggcucaagauggaugaaga

SEQ ID NO: 635357 - RNA, 19 nt, Homo sapiens
cugaggaauuuguaugaga

SEQ ID NO: 635358 - RNA, 19 nt, Homo sapiens
gcuaaaagacccagguaaa

SEQ ID NO: 635359 - RNA, 19 nt, Homo sapiens
gauaacugccucuauuacu

SEQ ID NO: 635360 - RNA, 19 nt, Homo sapiens
uaagaacgagccauuuaag

SEQ ID NO: 635361 - RNA, 19 nt, Homo sapiens
uugcugaucucaaccuugu

SEQ ID NO: 635362 - RNA, 19 nt, Homo sapiens
gggacuaccugggugaaag

SEQ ID NO: 635363 - RNA, 19 nt, Homo sapiens
cuaaauaagaccgucauug

SEQ ID NO: 635364 - RNA, 19 nt, Homo sapiens
ugaagaccucucauuagaa

SEQ ID NO: 635365 - RNA, 19 nt, Homo sapiens
cagaggugaugacagagau

SEQ ID NO: 635366 - RNA, 19 nt, Homo sapiens
cgugcuacgugcugucauu

SEQ ID NO: 635367 - RNA, 19 nt, Homo sapiens
aggcugaaauaugaaauug

SEQ ID NO: 635368 - RNA, 19 nt, Homo sapiens
aaggaggaguggaugaaau

SEQ ID NO: 635369 - RNA, 19 nt, Homo sapiens
gaugacagagaucgacaau

SEQ ID NO: 635370 - RNA, 19 nt, Homo sapiens
ucccuucuaugacauguug

SEQ ID NO: 635371 - RNA, 19 nt, Homo sapiens
acagauagccaugggaaga

SEQ ID NO: 635372 - RNA, 19 nt, Homo sapiens
cuacaaucccagccacaaa

SEQ ID NO: 635373 - RNA, 19 nt, Homo sapiens
cagaggaacaaacagauag

SEQ ID NO: 635374 - RNA, 19 nt, Homo sapiens
ccacaaagggcaggucauc

SEQ ID NO: 635375 - RNA, 19 nt, Homo sapiens
agauagccaugggaagaaa

SEQ ID NO: 635376 - RNA, 19 nt, Homo sapiens
gagcugcugaggaauuugu

SEQ ID NO: 635377 - RNA, 19 nt, Homo sapiens
cagaagauugaucgcauga

SEQ ID NO: 635378 - RNA, 19 nt, Homo sapiens
uauuaaccguucuagaaag

SEQ ID NO: 635379 - RNA, 19 nt, Homo sapiens
gagaucccuucuaugacau

SEQ ID NO: 635380 - RNA, 19 nt, Homo sapiens
aggagcugcugaggaauuu

SEQ ID NO: 635381 - RNA, 19 nt, Homo sapiens
agaaagccacuguuuuaua

SEQ ID NO: 635382 - RNA, 19 nt, Homo sapiens
guaccguggcccagacuga

SEQ ID NO: 635383 - RNA, 19 nt, Homo sapiens
ugaaauugcagaggugaug

SEQ ID NO: 635384 - RNA, 19 nt, Homo sapiens
gugguggcgugccugaaga

SEQ ID NO: 635385 - RNA, 19 nt, Homo sapiens
gccaguaucagcagagauc

SEQ ID NO: 635386 - RNA, 19 nt, Homo sapiens
ccugaagaccucucauuag

SEQ ID NO: 635387 - RNA, 19 nt, Homo sapiens
aauagaaaaugaccugcua

SEQ ID NO: 635388 - RNA, 19 nt, Homo sapiens
gcaaaacaggaaaggaaaa

SEQ ID NO: 635389 - RNA, 19 nt, Homo sapiens
aagaacgagccauuuaaga

SEQ ID NO: 635390 - RNA, 19 nt, Homo sapiens
gcugaggaauuuguaugag

SEQ ID NO: 635391 - RNA, 19 nt, Homo sapiens
gaaaugagcccuucaagau

SEQ ID NO: 635392 - RNA, 19 nt, Homo sapiens
ggaagaaguucaacaugga

SEQ ID NO: 635393 - RNA, 19 nt, Homo sapiens
ggauggagcuggagaacau

SEQ ID NO: 635394 - RNA, 19 nt, Homo sapiens
ggauuucagucaagaagaa

SEQ ID NO: 635395 - RNA, 19 nt, Homo sapiens
gaacugcuuugaacuuuac

SEQ ID NO: 635396 - RNA, 19 nt, Homo sapiens
cgaacugcuuugaacuuua

SEQ ID NO: 635397 - RNA, 19 nt, Homo sapiens
caacaccagucuccacaau

SEQ ID NO: 635398 - RNA, 19 nt, Homo sapiens
caacugccucuacuacuuu

SEQ ID NO: 635399 - RNA, 19 nt, Homo sapiens
gaacacacccgaggagauc

SEQ ID NO: 635400 - RNA, 19 nt, Homo sapiens
uggcagugcuccaugcuuu

SEQ ID NO: 635401 - RNA, 19 nt, Homo sapiens
ggaggacggcguuuaugaa

SEQ ID NO: 635402 - RNA, 19 nt, Homo sapiens
gcaaugggcaggaagaagu

SEQ ID NO: 635403 - RNA, 19 nt, Homo sapiens
aaaccgaacugcuuugaac

SEQ ID NO: 635404 - RNA, 19 nt, Homo sapiens
aaugagcccuucaagauuc

SEQ ID NO: 635405 - RNA, 19 nt, Homo sapiens
ccgaacugcuuugaacuuu

SEQ ID NO: 635406 - RNA, 19 nt, Homo sapiens
acaacugccucuacuacuu

SEQ ID NO: 635407 - RNA, 19 nt, Homo sapiens
cgaaaugagcccuucaaga

SEQ ID NO: 635408 - RNA, 19 nt, Homo sapiens
gcaggaagaaguucaacau

SEQ ID NO: 635409 - RNA, 19 nt, Homo sapiens
gaaaccgaacugcuuugaa

SEQ ID NO: 635410 - RNA, 19 nt, Homo sapiens
ggaaaccgaacugcuuuga

SEQ ID NO: 635411 - RNA, 19 nt, Homo sapiens
ccacagacacgugcuaugu

SEQ ID NO: 635412 - RNA, 19 nt, Homo sapiens
gagaaggacgaguggauca

SEQ ID NO: 635413 - RNA, 19 nt, Homo sapiens
aaaugagcccuucaagauu

SEQ ID NO: 635414 - RNA, 19 nt, Homo sapiens
gcucaucaaagccugcaaa

SEQ ID NO: 635415 - RNA, 19 nt, Homo sapiens
gcugguuuauccucacaga

SEQ ID NO: 635416 - RNA, 19 nt, Homo sapiens
ggagaggcccagaaaauug

SEQ ID NO: 635417 - RNA, 19 nt, Homo sapiens
gccgagugguggagggaaa

SEQ ID NO: 635418 - RNA, 19 nt, Homo sapiens
ggagagggaagaacugaac

SEQ ID NO: 635419 - RNA, 19 nt, Homo sapiens
gguuuauccucacagacaa

SEQ ID NO: 635420 - RNA, 19 nt, Homo sapiens
ccacgcaggaggagaagga

SEQ ID NO: 635421 - RNA, 19 nt, Homo sapiens
acagacaacugccucuacu

SEQ ID NO: 635422 - RNA, 19 nt, Homo sapiens
gccaaugagggcaguaaga

SEQ ID NO: 635423 - RNA, 19 nt, Homo sapiens
cauggaggacggcguuuau

SEQ ID NO: 635424 - RNA, 19 nt, Homo sapiens
uacgacagcauccgaaaug

SEQ ID NO: 635425 - RNA, 19 nt, Homo sapiens
guacgacagcauccgaaau

SEQ ID NO: 635426 - RNA, 19 nt, Homo sapiens
guccuucgccgucaucaug

SEQ ID NO: 635427 - RNA, 19 nt, Homo sapiens
gaaggacgaguggaucaag

SEQ ID NO: 635428 - RNA, 19 nt, Homo sapiens
ccggaaaccgaacugcuuu

SEQ ID NO: 635429 - RNA, 19 nt, Homo sapiens
uuguggaucugcaugaguu

SEQ ID NO: 635430 - RNA, 19 nt, Homo sapiens
ccauggaggacggcguuua

SEQ ID NO: 635431 - RNA, 19 nt, Homo sapiens
caucaaagccugcaaaacu

SEQ ID NO: 635432 - RNA, 19 nt, Homo sapiens
uggaggacggcguuuauga

SEQ ID NO: 635433 - RNA, 19 nt, Homo sapiens
caaugggcaggaagaaguu

SEQ ID NO: 635434 - RNA, 19 nt, Homo sapiens
aagcggauuucagucaaga

SEQ ID NO: 635435 - RNA, 19 nt, Homo sapiens
gaggacggcguuuaugaac

SEQ ID NO: 635436 - RNA, 19 nt, Homo sapiens
aaauugaccggaugaugga

SEQ ID NO: 635437 - RNA, 19 nt, Homo sapiens
gaaaauugaccggaugaug

SEQ ID NO: 635438 - RNA, 19 nt, Homo sapiens
caguuucuauggagcuuuc

SEQ ID NO: 635439 - RNA, 19 nt, Homo sapiens
gaaccuggcagugcuccau

SEQ ID NO: 635440 - RNA, 19 nt, Homo sapiens
gcgcugguuuauccucaca

SEQ ID NO: 635441 - RNA, 19 nt, Homo sapiens
gcccucaggcaguuucuau

SEQ ID NO: 635442 - RNA, 19 nt, Homo sapiens
gcaacggaaccggaagaug

SEQ ID NO: 635443 - RNA, 19 nt, Homo sapiens
agacaacugccucuacuac

SEQ ID NO: 635444 - RNA, 19 nt, Homo sapiens
ucacagacaacugccucua

SEQ ID NO: 635445 - RNA, 19 nt, Homo sapiens
acaccagucuccacaaucc

SEQ ID NO: 635446 - RNA, 19 nt, Homo sapiens
caggaagaaguucaacaug

SEQ ID NO: 635447 - RNA, 19 nt, Homo sapiens
gagaggcccagaaaauuga

SEQ ID NO: 635448 - RNA, 19 nt, Homo sapiens
cagacaacugccucuacua

SEQ ID NO: 635449 - RNA, 19 nt, Homo sapiens
cgugcuaugugcuguccuu

SEQ ID NO: 635450 - RNA, 19 nt, Homo sapiens
gaaaugagcccuucaagau

SEQ ID NO: 635451 - RNA, 19 nt, Homo sapiens
ggaagaaguucaacaugga

SEQ ID NO: 635452 - RNA, 19 nt, Homo sapiens
ggauggagcuggagaacau

SEQ ID NO: 635453 - RNA, 19 nt, Homo sapiens
ggauuucagucaagaagaa

SEQ ID NO: 635454 - RNA, 19 nt, Homo sapiens
gaacugcuuugaacuuuac

SEQ ID NO: 635455 - RNA, 19 nt, Homo sapiens
cgaacugcuuugaacuuua

SEQ ID NO: 635456 - RNA, 19 nt, Homo sapiens
caacaccagucuccacaau

SEQ ID NO: 635457 - RNA, 19 nt, Homo sapiens
caacugccucuacuacuuu

SEQ ID NO: 635458 - RNA, 19 nt, Homo sapiens
gaacacacccgaggagauc

SEQ ID NO: 635459 - RNA, 19 nt, Homo sapiens
uggcagugcuccaugcuuu

SEQ ID NO: 635460 - RNA, 19 nt, Homo sapiens
gcaaugggcaggaagaagu

SEQ ID NO: 635461 - RNA, 19 nt, Homo sapiens
aaaccgaacugcuuugaac

SEQ ID NO: 635462 - RNA, 19 nt, Homo sapiens
aaugagcccuucaagauuc

SEQ ID NO: 635463 - RNA, 19 nt, Homo sapiens
ccgaacugcuuugaacuuu

SEQ ID NO: 635464 - RNA, 19 nt, Homo sapiens
acaacugccucuacuacuu

SEQ ID NO: 635465 - RNA, 19 nt, Homo sapiens
cgaaaugagcccuucaaga

SEQ ID NO: 635466 - RNA, 19 nt, Homo sapiens
gcaggaagaaguucaacau

SEQ ID NO: 635467 - RNA, 19 nt, Homo sapiens
gaaaccgaacugcuuugaa

SEQ ID NO: 635468 - RNA, 19 nt, Homo sapiens
ggaaaccgaacugcuuuga

SEQ ID NO: 635469 - RNA, 19 nt, Homo sapiens
ccacagacacgugcuaugu

SEQ ID NO: 635470 - RNA, 19 nt, Homo sapiens
gagaaggacgaguggauca

SEQ ID NO: 635471 - RNA, 19 nt, Homo sapiens
aaaugagcccuucaagauu

SEQ ID NO: 635472 - RNA, 19 nt, Homo sapiens
gcucaucaaagccugcaaa

SEQ ID NO: 635473 - RNA, 19 nt, Homo sapiens
gcugguuuauccucacaga

SEQ ID NO: 635474 - RNA, 19 nt, Homo sapiens
ggagaggcccagaaaauug

SEQ ID NO: 635475 - RNA, 19 nt, Homo sapiens
gccgagugguggagggaaa

SEQ ID NO: 635476 - RNA, 19 nt, Homo sapiens
ggagagggaagaacugaac

SEQ ID NO: 635477 - RNA, 19 nt, Homo sapiens
gguuuauccucacagacaa

SEQ ID NO: 635478 - RNA, 19 nt, Homo sapiens
ccacgcaggaggagaagga

SEQ ID NO: 635479 - RNA, 19 nt, Homo sapiens
gccaaugagggcaguaaga

SEQ ID NO: 635480 - RNA, 19 nt, Homo sapiens
acagacaacugccucuacu

SEQ ID NO: 635481 - RNA, 19 nt, Homo sapiens
uacgacagcauccgaaaug

SEQ ID NO: 635482 - RNA, 19 nt, Homo sapiens
guacgacagcauccgaaau

SEQ ID NO: 635483 - RNA, 19 nt, Homo sapiens
guccuucgccgucaucaug

SEQ ID NO: 635484 - RNA, 19 nt, Homo sapiens
gaaggacgaguggaucaag

SEQ ID NO: 635485 - RNA, 19 nt, Homo sapiens
ccggaaaccgaacugcuuu

SEQ ID NO: 635486 - RNA, 19 nt, Homo sapiens
uuguggaucugcaugaguu

SEQ ID NO: 635487 - RNA, 19 nt, Homo sapiens
caaugggcaggaagaaguu

SEQ ID NO: 635488 - RNA, 19 nt, Homo sapiens
caucaaagccugcaaaacu

SEQ ID NO: 635489 - RNA, 19 nt, Homo sapiens
aagcggauuucagucaaga

SEQ ID NO: 635490 - RNA, 19 nt, Homo sapiens
aaauugaccggaugaugga

SEQ ID NO: 635491 - RNA, 19 nt, Homo sapiens
gaaaauugaccggaugaug

SEQ ID NO: 635492 - RNA, 19 nt, Homo sapiens
caguuucuauggagcuuuc

SEQ ID NO: 635493 - RNA, 19 nt, Homo sapiens
gaaccuggcagugcuccau

SEQ ID NO: 635494 - RNA, 19 nt, Homo sapiens
gcgcugguuuauccucaca

SEQ ID NO: 635495 - RNA, 19 nt, Homo sapiens
gcccucaggcaguuucuau

SEQ ID NO: 635496 - RNA, 19 nt, Homo sapiens
gcaacggaaccggaagaug

SEQ ID NO: 635497 - RNA, 19 nt, Homo sapiens
agacaacugccucuacuac

SEQ ID NO: 635498 - RNA, 19 nt, Homo sapiens
ucacagacaacugccucua

SEQ ID NO: 635499 - RNA, 19 nt, Homo sapiens
acaccagucuccacaaucc

SEQ ID NO: 635500 - RNA, 19 nt, Homo sapiens
caggaagaaguucaacaug

SEQ ID NO: 635501 - RNA, 19 nt, Homo sapiens
gagaggcccagaaaauuga

SEQ ID NO: 635502 - RNA, 19 nt, Homo sapiens
cagacaacugccucuacua

SEQ ID NO: 635503 - RNA, 19 nt, Homo sapiens
cgugcuaugugcuguccuu

SEQ ID NO: 635504 - RNA, 19 nt, Homo sapiens
ggacagagguuccggauaa

SEQ ID NO: 635505 - RNA, 19 nt, Homo sapiens
gaagagaagccacauacua

SEQ ID NO: 635506 - RNA, 19 nt, Homo sapiens
ggacuacucuggaugcauu

SEQ ID NO: 635507 - RNA, 19 nt, Homo sapiens
cgagaaggcuggcuauuga

SEQ ID NO: 635508 - RNA, 19 nt, Homo sapiens
cggauaaccuguuucauuu

SEQ ID NO: 635509 - RNA, 19 nt, Homo sapiens
ggagagagaugaguuuaau

SEQ ID NO: 635510 - RNA, 19 nt, Homo sapiens
gaacacuugugaagacauu

SEQ ID NO: 635511 - RNA, 19 nt, Homo sapiens
gaagaacacuugugaagac

SEQ ID NO: 635512 - RNA, 19 nt, Homo sapiens
caacugccuuuacuacuuu

SEQ ID NO: 635513 - RNA, 19 nt, Homo sapiens
ccaaggaacugcagcaaau

SEQ ID NO: 635514 - RNA, 19 nt, Homo sapiens
gcgagcaucucuggaaaua

SEQ ID NO: 635515 - RNA, 19 nt, Homo sapiens
gagggaagaugggccuuua

SEQ ID NO: 635516 - RNA, 19 nt, Homo sapiens
ggaaucaucccuuuagaga

SEQ ID NO: 635517 - RNA, 19 nt, Homo sapiens
gagaagccacauacuauaa

SEQ ID NO: 635518 - RNA, 19 nt, Homo sapiens
gacaauaaagaccaaguua

SEQ ID NO: 635519 - RNA, 19 nt, Homo sapiens
gcaaauaaacuccaacucu

SEQ ID NO: 635520 - RNA, 19 nt, Homo sapiens
gaagagacgcugguucauu

SEQ ID NO: 635521 - RNA, 19 nt, Homo sapiens
gguaaagacuuggaagaga

SEQ ID NO: 635522 - RNA, 19 nt, Homo sapiens
agaaaugacugaaaguugu

SEQ ID NO: 635523 - RNA, 19 nt, Homo sapiens
agaacgaccuccugaagaa

SEQ ID NO: 635524 - RNA, 19 nt, Homo sapiens
gugaagacauugcccaguu

SEQ ID NO: 635525 - RNA, 19 nt, Homo sapiens
gauccuaccuggagggaau

SEQ ID NO: 635526 - RNA, 19 nt, Homo sapiens
ggucaguauuagucuauuu

SEQ ID NO: 635527 - RNA, 19 nt, Homo sapiens
gagaugaguuuaauaucca

SEQ ID NO: 635528 - RNA, 19 nt, Homo sapiens
gcgaagggcucaacaagac

SEQ ID NO: 635529 - RNA, 19 nt, Homo sapiens
aaucaucccuuuagagaau

SEQ ID NO: 635530 - RNA, 19 nt, Homo sapiens
gcagaaguagcuaaugaaa

SEQ ID NO: 635531 - RNA, 19 nt, Homo sapiens
gagcaucucuggaaauagc

SEQ ID NO: 635532 - RNA, 19 nt, Homo sapiens
gagaaggaggaguggauua

SEQ ID NO: 635533 - RNA, 19 nt, Homo sapiens
ugaguucacugaucuuaau

SEQ ID NO: 635534 - RNA, 19 nt, Homo sapiens
gucaagaacuggagaacau

SEQ ID NO: 635535 - RNA, 19 nt, Homo sapiens
cggcuccucugauccuuua

SEQ ID NO: 635536 - RNA, 19 nt, Homo sapiens
gaagccacauacuauaaag

SEQ ID NO: 635537 - RNA, 19 nt, Homo sapiens
aagagacgcugguucauuc

SEQ ID NO: 635538 - RNA, 19 nt, Homo sapiens
agacauugcccaguucuua

SEQ ID NO: 635539 - RNA, 19 nt, Homo sapiens
gcagaggaacaaacaggua

SEQ ID NO: 635540 - RNA, 19 nt, Homo sapiens
gaagaucgaccggaugaug

SEQ ID NO: 635541 - RNA, 19 nt, Homo sapiens
gcccaguucuuauauaaag

SEQ ID NO: 635542 - RNA, 19 nt, Homo sapiens
gaaaugacugaaaguuguu

SEQ ID NO: 635543 - RNA, 19 nt, Homo sapiens
uaacuggacuacucuggau

SEQ ID NO: 635544 - RNA, 19 nt, Homo sapiens
ugacuggacgcuuacguua

SEQ ID NO: 635545 - RNA, 19 nt, Homo sapiens
agagcugacuggacgcuua

SEQ ID NO: 635546 - RNA, 19 nt, Homo sapiens
gcaccugggucaguauuag

SEQ ID NO: 635547 - RNA, 19 nt, Homo sapiens
ccggauaaccuguuucauu

SEQ ID NO: 635548 - RNA, 19 nt, Homo sapiens
acaacugccuuuacuacuu

SEQ ID NO: 635549 - RNA, 19 nt, Homo sapiens
gagaacgaccuccugaaga

SEQ ID NO: 635550 - RNA, 19 nt, Homo sapiens
ggauccaguucuuaauaga

SEQ ID NO: 635551 - RNA, 19 nt, Homo sapiens
gggauccaguucuuaauag

SEQ ID NO: 635552 - RNA, 19 nt, Homo sapiens
cuucaaacccugcaccaua

SEQ ID NO: 635553 - RNA, 19 nt, Homo sapiens
gagagagaugaguuuaaua

SEQ ID NO: 635554 - RNA, 19 nt, Homo sapiens
uucaaacccugcaccauaa

SEQ ID NO: 635555 - RNA, 19 nt, Homo sapiens
gcagccuccuggccaguuu

SEQ ID NO: 635556 - RNA, 19 nt, Homo sapiens
acuggacgcuuacguuauu

SEQ ID NO: 635557 - RNA, 19 nt, Homo sapiens
gaauggcuuuaggcacuuu

SEQ ID NO: 635558 - RNA, 19 nt, Homo sapiens
gauaaccuguuucauuuug

SEQ ID NO: 635559 - RNA, 19 nt, Homo sapiens
gaacugcagcaaauaaacu

SEQ ID NO: 635560 - RNA, 19 nt, Homo sapiens
ggaagguuaucgggacaga

SEQ ID NO: 635561 - RNA, 19 nt, Homo sapiens
aagagaagccacauacuau

SEQ ID NO: 635562 - RNA, 19 nt, Homo sapiens
ugaccucacucacacuuuc

SEQ ID NO: 635563 - RNA, 19 nt, Homo sapiens
gaacaccagucugcacaac

SEQ ID NO: 635564 - RNA, 19 nt, Homo sapiens
cagaagaucgaccggauga

SEQ ID NO: 635565 - RNA, 19 nt, Homo sapiens
ccagguucuucaugcauuu

SEQ ID NO: 635566 - RNA, 19 nt, Homo sapiens
caaggaacugcagcaaaua

SEQ ID NO: 635567 - RNA, 19 nt, Homo sapiens
ucagagguguaaauaaucu

SEQ ID NO: 635568 - RNA, 19 nt, Homo sapiens
agagaagccacauacuaua

SEQ ID NO: 635569 - RNA, 19 nt, Homo sapiens
ggagguggcaggguaaaga

SEQ ID NO: 635570 - RNA, 19 nt, Homo sapiens
gggaaugaccucacucaca

SEQ ID NO: 635571 - RNA, 19 nt, Homo sapiens
ggaauggcuuuaggcacuu

SEQ ID NO: 635572 - RNA, 19 nt, Homo sapiens
gcugguucauucugacuga

SEQ ID NO: 635573 - RNA, 19 nt, Homo sapiens
gggagagagaugaguuuaa

SEQ ID NO: 635574 - RNA, 19 nt, Homo sapiens
gcugaaggaugagauagca

SEQ ID NO: 635575 - RNA, 19 nt, Homo sapiens
aaacccugcaccauaaaua

SEQ ID NO: 635576 - RNA, 19 nt, Homo sapiens
acagcuacguucccaguga

SEQ ID NO: 635577 - RNA, 19 nt, Homo sapiens
ugaagacauugcccaguuc

SEQ ID NO: 635578 - RNA, 19 nt, Homo sapiens
aaacugcuuugagcuuuau

SEQ ID NO: 635579 - RNA, 19 nt, Homo sapiens
ucaaagauaagcccacugu

SEQ ID NO: 635580 - RNA, 19 nt, Homo sapiens
uugcccaguucuuauauaa

SEQ ID NO: 635581 - RNA, 19 nt, Homo sapiens
gaaucaucccuuuagagaa

SEQ ID NO: 635582 - RNA, 19 nt, Homo sapiens
agacgcugguucauucuga

SEQ ID NO: 635583 - RNA, 19 nt, Homo sapiens
gcacaaccccaaugucaaa

SEQ ID NO: 635584 - RNA, 19 nt, Homo sapiens
gugcaauaauggcguguuc

SEQ ID NO: 635585 - RNA, 19 nt, Homo sapiens
agaggcaccugggucagua

SEQ ID NO: 635586 - RNA, 19 nt, Homo sapiens
gccugguucucaaguguuu

SEQ ID NO: 635587 - RNA, 19 nt, Homo sapiens
ggaggacgacagcuacguu

SEQ ID NO: 635588 - RNA, 19 nt, Homo sapiens
gagagaacguagggcuguu

SEQ ID NO: 635589 - RNA, 19 nt, Homo sapiens
ugacugacaacugccuuua

SEQ ID NO: 635590 - RNA, 19 nt, Homo sapiens
gcccagcgauauugucagu

SEQ ID NO: 635591 - RNA, 19 nt, Homo sapiens
ggaugagauagcagaagua

SEQ ID NO: 635592 - RNA, 19 nt, Homo sapiens
gccaacuguuuaccucuug

SEQ ID NO: 635593 - RNA, 19 nt, Homo sapiens
caguuucucugcucagugu

SEQ ID NO: 635594 - RNA, 19 nt, Homo sapiens
ucacagggcagagcucuug

SEQ ID NO: 635595 - RNA, 19 nt, Homo sapiens
gaguggauuaagugcauua

SEQ ID NO: 635596 - RNA, 19 nt, Homo sapiens
agaaggaggaguggauuaa

SEQ ID NO: 635597 - RNA, 19 nt, Homo sapiens
ggagaaggaggaguggauu

SEQ ID NO: 635598 - RNA, 19 nt, Homo sapiens
cgacaauaaagaccaaguu

SEQ ID NO: 635599 - RNA, 19 nt, Homo sapiens
aagaaaugacugaaaguug

SEQ ID NO: 635600 - RNA, 19 nt, Homo sapiens
gcuaaauaccuaauaacca

SEQ ID NO: 635601 - RNA, 19 nt, Homo sapiens
gaaggaugagauagcagaa

SEQ ID NO: 635602 - RNA, 19 nt, Homo sapiens
ugagauagcagaaguagcu

SEQ ID NO: 635603 - RNA, 19 nt, Homo sapiens
agacagccaucggcgacua

SEQ ID NO: 635604 - RNA, 19 nt, Homo sapiens
ggacagagguuccggauaa

SEQ ID NO: 635605 - RNA, 19 nt, Homo sapiens
gaagagaagccacauacua

SEQ ID NO: 635606 - RNA, 19 nt, Homo sapiens
ggacuacucuggaugcauu

SEQ ID NO: 635607 - RNA, 19 nt, Homo sapiens
cgagaaggcuggcuauuga

SEQ ID NO: 635608 - RNA, 19 nt, Homo sapiens
cggauaaccuguuucauuu

SEQ ID NO: 635609 - RNA, 19 nt, Homo sapiens
ggagagagaugaguuuaau

SEQ ID NO: 635610 - RNA, 19 nt, Homo sapiens
gaacacuugugaagacauu

SEQ ID NO: 635611 - RNA, 19 nt, Homo sapiens
gaagaacacuugugaagac

SEQ ID NO: 635612 - RNA, 19 nt, Homo sapiens
caacugccuuuacuacuuu

SEQ ID NO: 635613 - RNA, 19 nt, Homo sapiens
ccaaggaacugcagcaaau

SEQ ID NO: 635614 - RNA, 19 nt, Homo sapiens
gcgagcaucucuggaaaua

SEQ ID NO: 635615 - RNA, 19 nt, Homo sapiens
gagggaagaugggccuuua

SEQ ID NO: 635616 - RNA, 19 nt, Homo sapiens
ggaaucaucccuuuagaga

SEQ ID NO: 635617 - RNA, 19 nt, Homo sapiens
gagaagccacauacuauaa

SEQ ID NO: 635618 - RNA, 19 nt, Homo sapiens
gacaauaaagaccaaguua

SEQ ID NO: 635619 - RNA, 19 nt, Homo sapiens
gcaaauaaacuccaacucu

SEQ ID NO: 635620 - RNA, 19 nt, Homo sapiens
gaagagacgcugguucauu

SEQ ID NO: 635621 - RNA, 19 nt, Homo sapiens
gguaaagacuuggaagaga

SEQ ID NO: 635622 - RNA, 19 nt, Homo sapiens
agaaaugacugaaaguugu

SEQ ID NO: 635623 - RNA, 19 nt, Homo sapiens
agaacgaccuccugaagaa

SEQ ID NO: 635624 - RNA, 19 nt, Homo sapiens
gugaagacauugcccaguu

SEQ ID NO: 635625 - RNA, 19 nt, Homo sapiens
gauccuaccuggagggaau

SEQ ID NO: 635626 - RNA, 19 nt, Homo sapiens
ggucaguauuagucuauuu

SEQ ID NO: 635627 - RNA, 19 nt, Homo sapiens
gagaugaguuuaauaucca

SEQ ID NO: 635628 - RNA, 19 nt, Homo sapiens
gcgaagggcucaacaagac

SEQ ID NO: 635629 - RNA, 19 nt, Homo sapiens
aaucaucccuuuagagaau

SEQ ID NO: 635630 - RNA, 19 nt, Homo sapiens
gcagaaguagcuaaugaaa

SEQ ID NO: 635631 - RNA, 19 nt, Homo sapiens
gagcaucucuggaaauagc

SEQ ID NO: 635632 - RNA, 19 nt, Homo sapiens
gagaaggaggaguggauua

SEQ ID NO: 635633 - RNA, 19 nt, Homo sapiens
ugaguucacugaucuuaau

SEQ ID NO: 635634 - RNA, 19 nt, Homo sapiens
gucaagaacuggagaacau

SEQ ID NO: 635635 - RNA, 19 nt, Homo sapiens
cggcuccucugauccuuua

SEQ ID NO: 635636 - RNA, 19 nt, Homo sapiens
gaagccacauacuauaaag

SEQ ID NO: 635637 - RNA, 19 nt, Homo sapiens
aagagacgcugguucauuc

SEQ ID NO: 635638 - RNA, 19 nt, Homo sapiens
agacauugcccaguucuua

SEQ ID NO: 635639 - RNA, 19 nt, Homo sapiens
gcagaggaacaaacaggua

SEQ ID NO: 635640 - RNA, 19 nt, Homo sapiens
gaagaucgaccggaugaug

SEQ ID NO: 635641 - RNA, 19 nt, Homo sapiens
gcccaguucuuauauaaag

SEQ ID NO: 635642 - RNA, 19 nt, Homo sapiens
gaaaugacugaaaguuguu

SEQ ID NO: 635643 - RNA, 19 nt, Homo sapiens
uaacuggacuacucuggau

SEQ ID NO: 635644 - RNA, 19 nt, Homo sapiens
ugacuggacgcuuacguua

SEQ ID NO: 635645 - RNA, 19 nt, Homo sapiens
agagcugacuggacgcuua

SEQ ID NO: 635646 - RNA, 19 nt, Homo sapiens
gcaccugggucaguauuag

SEQ ID NO: 635647 - RNA, 19 nt, Homo sapiens
ccggauaaccuguuucauu

SEQ ID NO: 635648 - RNA, 19 nt, Homo sapiens
acaacugccuuuacuacuu

SEQ ID NO: 635649 - RNA, 19 nt, Homo sapiens
gagaacgaccuccugaaga

SEQ ID NO: 635650 - RNA, 19 nt, Homo sapiens
ggauccaguucuuaauaga

SEQ ID NO: 635651 - RNA, 19 nt, Homo sapiens
gggauccaguucuuaauag

SEQ ID NO: 635652 - RNA, 19 nt, Homo sapiens
cuucaaacccugcaccaua

SEQ ID NO: 635653 - RNA, 19 nt, Homo sapiens
gagagagaugaguuuaaua

SEQ ID NO: 635654 - RNA, 19 nt, Homo sapiens
uucaaacccugcaccauaa

SEQ ID NO: 635655 - RNA, 19 nt, Homo sapiens
gcagccuccuggccaguuu

SEQ ID NO: 635656 - RNA, 19 nt, Homo sapiens
acuggacgcuuacguuauu

SEQ ID NO: 635657 - RNA, 19 nt, Homo sapiens
gaauggcuuuaggcacuuu

SEQ ID NO: 635658 - RNA, 19 nt, Homo sapiens
gauaaccuguuucauuuug

SEQ ID NO: 635659 - RNA, 19 nt, Homo sapiens
gaacugcagcaaauaaacu

SEQ ID NO: 635660 - RNA, 19 nt, Homo sapiens
ggaagguuaucgggacaga

SEQ ID NO: 635661 - RNA, 19 nt, Homo sapiens
aagagaagccacauacuau

SEQ ID NO: 635662 - RNA, 19 nt, Homo sapiens
ugaccucacucacacuuuc

SEQ ID NO: 635663 - RNA, 19 nt, Homo sapiens
gaacaccagucugcacaac

SEQ ID NO: 635664 - RNA, 19 nt, Homo sapiens
cagaagaucgaccggauga

SEQ ID NO: 635665 - RNA, 19 nt, Homo sapiens
ccagguucuucaugcauuu

SEQ ID NO: 635666 - RNA, 19 nt, Homo sapiens
caaggaacugcagcaaaua

SEQ ID NO: 635667 - RNA, 19 nt, Homo sapiens
ucagagguguaaauaaucu

SEQ ID NO: 635668 - RNA, 19 nt, Homo sapiens
agagaagccacauacuaua

SEQ ID NO: 635669 - RNA, 19 nt, Homo sapiens
gggaaugaccucacucaca

SEQ ID NO: 635670 - RNA, 19 nt, Homo sapiens
ggaauggcuuuaggcacuu

SEQ ID NO: 635671 - RNA, 19 nt, Homo sapiens
gcugguucauucugacuga

SEQ ID NO: 635672 - RNA, 19 nt, Homo sapiens
gggagagagaugaguuuaa

SEQ ID NO: 635673 - RNA, 19 nt, Homo sapiens
gcugaaggaugagauagca

SEQ ID NO: 635674 - RNA, 19 nt, Homo sapiens
aaacccugcaccauaaaua

SEQ ID NO: 635675 - RNA, 19 nt, Homo sapiens
acagcuacguucccaguga

SEQ ID NO: 635676 - RNA, 19 nt, Homo sapiens
ugaagacauugcccaguuc

SEQ ID NO: 635677 - RNA, 19 nt, Homo sapiens
aaacugcuuugagcuuuau

SEQ ID NO: 635678 - RNA, 19 nt, Homo sapiens
ucaaagauaagcccacugu

SEQ ID NO: 635679 - RNA, 19 nt, Homo sapiens
uugcccaguucuuauauaa

SEQ ID NO: 635680 - RNA, 19 nt, Homo sapiens
gaaucaucccuuuagagaa

SEQ ID NO: 635681 - RNA, 19 nt, Homo sapiens
agacgcugguucauucuga

SEQ ID NO: 635682 - RNA, 19 nt, Homo sapiens
gcacaaccccaaugucaaa

SEQ ID NO: 635683 - RNA, 19 nt, Homo sapiens
gugcaauaauggcguguuc

SEQ ID NO: 635684 - RNA, 19 nt, Homo sapiens
agaggcaccugggucagua

SEQ ID NO: 635685 - RNA, 19 nt, Homo sapiens
gccugguucucaaguguuu

SEQ ID NO: 635686 - RNA, 19 nt, Homo sapiens
ggaggacgacagcuacguu

SEQ ID NO: 635687 - RNA, 19 nt, Homo sapiens
gagagaacguagggcuguu

SEQ ID NO: 635688 - RNA, 19 nt, Homo sapiens
ugacugacaacugccuuua

SEQ ID NO: 635689 - RNA, 19 nt, Homo sapiens
gcccagcgauauugucagu

SEQ ID NO: 635690 - RNA, 19 nt, Homo sapiens
ggaugagauagcagaagua

SEQ ID NO: 635691 - RNA, 19 nt, Homo sapiens
gccaacuguuuaccucuug

SEQ ID NO: 635692 - RNA, 19 nt, Homo sapiens
caguuucucugcucagugu

SEQ ID NO: 635693 - RNA, 19 nt, Homo sapiens
ucacagggcagagcucuug

SEQ ID NO: 635694 - RNA, 19 nt, Homo sapiens
gaguggauuaagugcauua

SEQ ID NO: 635695 - RNA, 19 nt, Homo sapiens
agaaggaggaguggauuaa

SEQ ID NO: 635696 - RNA, 19 nt, Homo sapiens
ggagaaggaggaguggauu

SEQ ID NO: 635697 - RNA, 19 nt, Homo sapiens
cgacaauaaagaccaaguu

SEQ ID NO: 635698 - RNA, 19 nt, Homo sapiens
aagaaaugacugaaaguug

SEQ ID NO: 635699 - RNA, 19 nt, Homo sapiens
gcuaaauaccuaauaacca

SEQ ID NO: 635700 - RNA, 19 nt, Homo sapiens
gaaggaugagauagcagaa

SEQ ID NO: 635701 - RNA, 19 nt, Homo sapiens
ugagauagcagaaguagcu

SEQ ID NO: 635702 - RNA, 19 nt, Homo sapiens
agacagccaucggcgacua

SEQ ID NO: 635703 - RNA, 19 nt, Homo sapiens
ccacauacuauaaagaucu

SEQ ID NO: 635704 - RNA, 19 nt, Homo sapiens
ggacaaagcaacaauaauu

SEQ ID NO: 635705 - RNA, 19 nt, Homo sapiens
cgacacagauuccaccaaa

SEQ ID NO: 635706 - RNA, 19 nt, Homo sapiens
caaaguagcgaaaucagua

SEQ ID NO: 635707 - RNA, 19 nt, Homo sapiens
gaaguuaucccuugcucua

SEQ ID NO: 635708 - RNA, 19 nt, Homo sapiens
cugcaaugcugaaauguua

SEQ ID NO: 635709 - RNA, 19 nt, Homo sapiens
gcugaaauguuaugcaaau

SEQ ID NO: 635710 - RNA, 19 nt, Homo sapiens
gcaagucuguggauucuag

SEQ ID NO: 635711 - RNA, 19 nt, Homo sapiens
caacaucagaucaauauga

SEQ ID NO: 635712 - RNA, 19 nt, Homo sapiens
gaggaagaauuuauuaugg

SEQ ID NO: 635713 - RNA, 19 nt, Homo sapiens
gauuaccgcucaugcuaaa

SEQ ID NO: 635714 - RNA, 19 nt, Homo sapiens
ccagcaagauggaaaguug

SEQ ID NO: 635715 - RNA, 19 nt, Homo sapiens
ucacagagguccacucagu

SEQ ID NO: 635716 - RNA, 19 nt, Homo sapiens
aaacugcaaugcugaaaug

SEQ ID NO: 635717 - RNA, 19 nt, Homo sapiens
ggaacaagcacaagccauu

SEQ ID NO: 635718 - RNA, 19 nt, Homo sapiens
gcacaggcaugcucucuac

SEQ ID NO: 635719 - RNA, 19 nt, Homo sapiens
ggaggaagaauuuauuaug

SEQ ID NO: 635720 - RNA, 19 nt, Homo sapiens
gaacaagcacaagccauuu

SEQ ID NO: 635721 - RNA, 19 nt, Homo sapiens
caggcaugcucucuacuua

SEQ ID NO: 635722 - RNA, 19 nt, Homo sapiens
gaucccauguacaguauga

SEQ ID NO: 635723 - RNA, 19 nt, Homo sapiens
gaccacagaugcaagcaau

SEQ ID NO: 635724 - RNA, 19 nt, Homo sapiens
caugcucucuacuuaauaa

SEQ ID NO: 635725 - RNA, 19 nt, Homo sapiens
guagcgaaaucaguacuaa

SEQ ID NO: 635726 - RNA, 19 nt, Homo sapiens
guaaagaucccauguacag

SEQ ID NO: 635727 - RNA, 19 nt, Homo sapiens
uaauccggaugguguguua

SEQ ID NO: 635728 - RNA, 19 nt, Homo sapiens
ucagauaccugugcagaau

SEQ ID NO: 635729 - RNA, 19 nt, Homo sapiens
gcaaucaaguagaagucaa

SEQ ID NO: 635730 - RNA, 19 nt, Homo sapiens
agaagugucuggucaagau

SEQ ID NO: 635731 - RNA, 19 nt, Homo sapiens
gagcaagucuguggauucu

SEQ ID NO: 635732 - RNA, 19 nt, Homo sapiens
ggcaugcucucuacuuaau

SEQ ID NO: 635733 - RNA, 19 nt, Homo sapiens
gugcagaauuucgaauaaa

SEQ ID NO: 635734 - RNA, 19 nt, Homo sapiens
guacuaagagcaagucugu

SEQ ID NO: 635735 - RNA, 19 nt, Homo sapiens
aaagaucccauguacagua

SEQ ID NO: 635736 - RNA, 19 nt, Homo sapiens
ccauuagaccugauaaauu

SEQ ID NO: 635737 - RNA, 19 nt, Homo sapiens
uaugggaguuuccaaguau

SEQ ID NO: 635738 - RNA, 19 nt, Homo sapiens
ugacauugccaacuuaaga

SEQ ID NO: 635739 - RNA, 19 nt, Homo sapiens
ccuauuacacagugaguua

SEQ ID NO: 635740 - RNA, 19 nt, Homo sapiens
agauaccugugcagaauuu

SEQ ID NO: 635741 - RNA, 19 nt, Homo sapiens
caaccacaauuccuagagu

SEQ ID NO: 635742 - RNA, 19 nt, Homo sapiens
caagccauuugcaagguuu

SEQ ID NO: 635743 - RNA, 19 nt, Homo sapiens
gacaaagcaacaauaauuc

SEQ ID NO: 635744 - RNA, 19 nt, Homo sapiens
aguagcaguucccaaagua

SEQ ID NO: 635745 - RNA, 19 nt, Homo sapiens
ccacagaugcaagcaauga

SEQ ID NO: 635746 - RNA, 19 nt, Homo sapiens
caggacaaagcaacaauaa

SEQ ID NO: 635747 - RNA, 19 nt, Homo sapiens
aaaggacugucaauauaca

SEQ ID NO: 635748 - RNA, 19 nt, Homo sapiens
ccacaauuccuagaguuaa

SEQ ID NO: 635749 - RNA, 19 nt, Homo sapiens
gaagugucuggucaagaua

SEQ ID NO: 635750 - RNA, 19 nt, Homo sapiens
uuaugggaguuuccaagua

SEQ ID NO: 635751 - RNA, 19 nt, Homo sapiens
caacuuaagacacacaaag

SEQ ID NO: 635752 - RNA, 19 nt, Homo sapiens
gauucaugcuggucuggaa

SEQ ID NO: 635753 - RNA, 19 nt, Homo sapiens
gaagacgagaugucacaga

SEQ ID NO: 635754 - RNA, 19 nt, Homo sapiens
ugugcagaauuucgaauaa

SEQ ID NO: 635755 - RNA, 19 nt, Homo sapiens
gcaacaauaauucagauac

SEQ ID NO: 635756 - RNA, 19 nt, Homo sapiens
caaagcagauuuucagaag

SEQ ID NO: 635757 - RNA, 19 nt, Homo sapiens
gcaaugcugaaauguuaug

SEQ ID NO: 635758 - RNA, 19 nt, Homo sapiens
ccggaggaagaauuuauua

SEQ ID NO: 635759 - RNA, 19 nt, Homo sapiens
gccauuagaccugauaaau

SEQ ID NO: 635760 - RNA, 19 nt, Homo sapiens
uaaaggacugucaauauac

SEQ ID NO: 635761 - RNA, 19 nt, Homo sapiens
gaagaaaauggauugugua

SEQ ID NO: 635762 - RNA, 19 nt, Homo sapiens
cgacacaguaguagcaguu

SEQ ID NO: 635763 - RNA, 19 nt, Homo sapiens
caacaauaauucagauacc

SEQ ID NO: 635764 - RNA, 19 nt, Homo sapiens
ucaggacaaagcaacaaua

SEQ ID NO: 635765 - RNA, 19 nt, Homo sapiens
ugaagaaaauggauugugu

SEQ ID NO: 635766 - RNA, 19 nt, Homo sapiens
aagauuaccgcucaugcua

SEQ ID NO: 635767 - RNA, 19 nt, Homo sapiens
ucacgaagacgagauguca

SEQ ID NO: 635768 - RNA, 19 nt, Homo sapiens
gagggaagacugaggacau

SEQ ID NO: 635769 - RNA, 19 nt, Homo sapiens
ugaauccugcaaucaagua

SEQ ID NO: 635770 - RNA, 19 nt, Homo sapiens
guaucaacaucagaucaau

SEQ ID NO: 635771 - RNA, 19 nt, Homo sapiens
gcauaaaaguaucaacauc

SEQ ID NO: 635772 - RNA, 19 nt, Homo sapiens
aagaucccauguacaguau

SEQ ID NO: 635773 - RNA, 19 nt, Homo sapiens
uauguaaagaucccaugua

SEQ ID NO: 635774 - RNA, 19 nt, Homo sapiens
agacacacaaagcagauuu

SEQ ID NO: 635775 - RNA, 19 nt, Homo sapiens
gcaugcucucuacuuaaua

SEQ ID NO: 635776 - RNA, 19 nt, Homo sapiens
aguaguagcaguucccaaa

SEQ ID NO: 635777 - RNA, 19 nt, Homo sapiens
gaggggaucuucucuggau

SEQ ID NO: 635778 - RNA, 19 nt, Homo sapiens
ugacaaacacacacugaag

SEQ ID NO: 635779 - RNA, 19 nt, Homo sapiens
agugguggcuucccaguca

SEQ ID NO: 635780 - RNA, 19 nt, Homo sapiens
guauuaacaucugagaaac

SEQ ID NO: 635781 - RNA, 19 nt, Homo sapiens
aaacgacacaguaguagca

SEQ ID NO: 635782 - RNA, 19 nt, Homo sapiens
aaagcuuacuggcucugaa

SEQ ID NO: 635783 - RNA, 19 nt, Homo sapiens
gaugguguguuacgaugac

SEQ ID NO: 635784 - RNA, 19 nt, Homo sapiens
gcucucuacuuaauaaucc

SEQ ID NO: 635785 - RNA, 19 nt, Homo sapiens
cacaauuccuagaguuaag

SEQ ID NO: 635786 - RNA, 19 nt, Homo sapiens
uaguagcaguucccaaagu

SEQ ID NO: 635787 - RNA, 19 nt, Homo sapiens
aaccacaauuccuagaguu

SEQ ID NO: 635788 - RNA, 19 nt, Homo sapiens
caaacugcaaugcugaaau

SEQ ID NO: 635789 - RNA, 19 nt, Homo sapiens
cugaaggccugagggaaga

SEQ ID NO: 635790 - RNA, 19 nt, Homo sapiens
augcugaaauguuaugcaa

SEQ ID NO: 635791 - RNA, 19 nt, Homo sapiens
ccugaauccugcaaucaag

SEQ ID NO: 635792 - RNA, 19 nt, Homo sapiens
acaagccauuugcaagguu

SEQ ID NO: 635793 - RNA, 19 nt, Homo sapiens
caucugagaaacccugaau

SEQ ID NO: 635794 - RNA, 19 nt, Homo sapiens
ccaaaguagcgaaaucagu

SEQ ID NO: 635795 - RNA, 19 nt, Homo sapiens
aguuaacucucaaugaagu

SEQ ID NO: 635796 - RNA, 19 nt, Homo sapiens
caacagccuggaacaagca

SEQ ID NO: 635797 - RNA, 19 nt, Homo sapiens
uaagacacacaaagcagau

SEQ ID NO: 635798 - RNA, 19 nt, Homo sapiens
gcuuuugacucuguauuaa

SEQ ID NO: 635799 - RNA, 19 nt, Homo sapiens
uggccagccucgacacaga

SEQ ID NO: 635800 - RNA, 19 nt, Homo sapiens
gaaacucuccgagggaaaa

SEQ ID NO: 635801 - RNA, 19 nt, Homo sapiens
ucccauguacaguaugaua

SEQ ID NO: 635802 - RNA, 19 nt, Homo sapiens
uaagagcaagucuguggau

SEQ ID NO: 635803 - RNA, 19 nt, Homo sapiens
aguuaucccuugcucuaga

SEQ ID NO: 635804 - RNA, 19 nt, Homo sapiens
ggacaaagcaacaauaauu

SEQ ID NO: 635805 - RNA, 19 nt, Homo sapiens
cgacacagauuccaccaaa

SEQ ID NO: 635806 - RNA, 19 nt, Homo sapiens
caaaguagcgaaaucagua

SEQ ID NO: 635807 - RNA, 19 nt, Homo sapiens
gaaguuaucccuugcucua

SEQ ID NO: 635808 - RNA, 19 nt, Homo sapiens
cugcaaugcugaaauguua

SEQ ID NO: 635809 - RNA, 19 nt, Homo sapiens
gcugaaauguuaugcaaau

SEQ ID NO: 635810 - RNA, 19 nt, Homo sapiens
gcaagucuguggauucuag

SEQ ID NO: 635811 - RNA, 19 nt, Homo sapiens
caacaucagaucaauauga

SEQ ID NO: 635812 - RNA, 19 nt, Homo sapiens
gaggaagaauuuauuaugg

SEQ ID NO: 635813 - RNA, 19 nt, Homo sapiens
gauuaccgcucaugcuaaa

SEQ ID NO: 635814 - RNA, 19 nt, Homo sapiens
ccagcaagauggaaaguug

SEQ ID NO: 635815 - RNA, 19 nt, Homo sapiens
ucacagagguccacucagu

SEQ ID NO: 635816 - RNA, 19 nt, Homo sapiens
aaacugcaaugcugaaaug

SEQ ID NO: 635817 - RNA, 19 nt, Homo sapiens
ggaggaagaauuuauuaug

SEQ ID NO: 635818 - RNA, 19 nt, Homo sapiens
gaacaagcacaagccauuu

SEQ ID NO: 635819 - RNA, 19 nt, Homo sapiens
gaucccauguacaguauga

SEQ ID NO: 635820 - RNA, 19 nt, Homo sapiens
guagcgaaaucaguacuaa

SEQ ID NO: 635821 - RNA, 19 nt, Homo sapiens
guaaagaucccauguacag

SEQ ID NO: 635822 - RNA, 19 nt, Homo sapiens
ucagauaccugugcagaau

SEQ ID NO: 635823 - RNA, 19 nt, Homo sapiens
gcaaucaaguagaagucaa

SEQ ID NO: 635824 - RNA, 19 nt, Homo sapiens
agaagugucuggucaagau

SEQ ID NO: 635825 - RNA, 19 nt, Homo sapiens
gagcaagucuguggauucu

SEQ ID NO: 635826 - RNA, 19 nt, Homo sapiens
gugcagaauuucgaauaaa

SEQ ID NO: 635827 - RNA, 19 nt, Homo sapiens
guacuaagagcaagucugu

SEQ ID NO: 635828 - RNA, 19 nt, Homo sapiens
aaagaucccauguacagua

SEQ ID NO: 635829 - RNA, 19 nt, Homo sapiens
ccauuagaccugauaaauu

SEQ ID NO: 635830 - RNA, 19 nt, Homo sapiens
uaugggaguuuccaaguau

SEQ ID NO: 635831 - RNA, 19 nt, Homo sapiens
ugacauugccaacuuaaga

SEQ ID NO: 635832 - RNA, 19 nt, Homo sapiens
ccuauuacacagugaguua

SEQ ID NO: 635833 - RNA, 19 nt, Homo sapiens
agauaccugugcagaauuu

SEQ ID NO: 635834 - RNA, 19 nt, Homo sapiens
caaccacaauuccuagagu

SEQ ID NO: 635835 - RNA, 19 nt, Homo sapiens
caagccauuugcaagguuu

SEQ ID NO: 635836 - RNA, 19 nt, Homo sapiens
gacaaagcaacaauaauuc

SEQ ID NO: 635837 - RNA, 19 nt, Homo sapiens
aguagcaguucccaaagua

SEQ ID NO: 635838 - RNA, 19 nt, Homo sapiens
caggacaaagcaacaauaa

SEQ ID NO: 635839 - RNA, 19 nt, Homo sapiens
ugaacaagcacaagccauu

SEQ ID NO: 635840 - RNA, 19 nt, Homo sapiens
aaaggacugucaauauaca

SEQ ID NO: 635841 - RNA, 19 nt, Homo sapiens
ccacaauuccuagaguuaa

SEQ ID NO: 635842 - RNA, 19 nt, Homo sapiens
gaagugucuggucaagaua

SEQ ID NO: 635843 - RNA, 19 nt, Homo sapiens
uuaugggaguuuccaagua

SEQ ID NO: 635844 - RNA, 19 nt, Homo sapiens
caacuuaagacacacaaag

SEQ ID NO: 635845 - RNA, 19 nt, Homo sapiens
gauucaugcuggucuggaa

SEQ ID NO: 635846 - RNA, 19 nt, Homo sapiens
gaagacgagaugucacaga

SEQ ID NO: 635847 - RNA, 19 nt, Homo sapiens
ugugcagaauuucgaauaa

SEQ ID NO: 635848 - RNA, 19 nt, Homo sapiens
gcaacaauaauucagauac

SEQ ID NO: 635849 - RNA, 19 nt, Homo sapiens
caaagcagauuuucagaag

SEQ ID NO: 635850 - RNA, 19 nt, Homo sapiens
gcaaugcugaaauguuaug

SEQ ID NO: 635851 - RNA, 19 nt, Homo sapiens
caucagaucaauaugaaca

SEQ ID NO: 635852 - RNA, 19 nt, Homo sapiens
ccggaggaagaauuuauua

SEQ ID NO: 635853 - RNA, 19 nt, Homo sapiens
gccauuagaccugauaaau

SEQ ID NO: 635854 - RNA, 19 nt, Homo sapiens
uaaaggacugucaauauac

SEQ ID NO: 635855 - RNA, 19 nt, Homo sapiens
cgacacaguaguagcaguu

SEQ ID NO: 635856 - RNA, 19 nt, Homo sapiens
gaagaaaauggauugugua

SEQ ID NO: 635857 - RNA, 19 nt, Homo sapiens
caacaauaauucagauacc

SEQ ID NO: 635858 - RNA, 19 nt, Homo sapiens
ucaggacaaagcaacaaua

SEQ ID NO: 635859 - RNA, 19 nt, Homo sapiens
ugaagaaaauggauugugu

SEQ ID NO: 635860 - RNA, 19 nt, Homo sapiens
aagauuaccgcucaugcua

SEQ ID NO: 635861 - RNA, 19 nt, Homo sapiens
ucacgaagacgagauguca

SEQ ID NO: 635862 - RNA, 19 nt, Homo sapiens
gagggaagacugaggacau

SEQ ID NO: 635863 - RNA, 19 nt, Homo sapiens
ugaauccugcaaucaagua

SEQ ID NO: 635864 - RNA, 19 nt, Homo sapiens
guaucaacaucagaucaau

SEQ ID NO: 635865 - RNA, 19 nt, Homo sapiens
gcauaaaaguaucaacauc

SEQ ID NO: 635866 - RNA, 19 nt, Homo sapiens
aagaucccauguacaguau

SEQ ID NO: 635867 - RNA, 19 nt, Homo sapiens
uauguaaagaucccaugua

SEQ ID NO: 635868 - RNA, 19 nt, Homo sapiens
agacacacaaagcagauuu

SEQ ID NO: 635869 - RNA, 19 nt, Homo sapiens
gaggggaucuucucuggau

SEQ ID NO: 635870 - RNA, 19 nt, Homo sapiens
ugacaaacacacacugaag

SEQ ID NO: 635871 - RNA, 19 nt, Homo sapiens
aguaguagcaguucccaaa

SEQ ID NO: 635872 - RNA, 19 nt, Homo sapiens
agugguggcuucccaguca

SEQ ID NO: 635873 - RNA, 19 nt, Homo sapiens
guauuaacaucugagaaac

SEQ ID NO: 635874 - RNA, 19 nt, Homo sapiens
aaacgacacaguaguagca

SEQ ID NO: 635875 - RNA, 19 nt, Homo sapiens
uaguagcaguucccaaagu

SEQ ID NO: 635876 - RNA, 19 nt, Homo sapiens
cacaauuccuagaguuaag

SEQ ID NO: 635877 - RNA, 19 nt, Homo sapiens
aaccacaauuccuagaguu

SEQ ID NO: 635878 - RNA, 19 nt, Homo sapiens
caaacugcaaugcugaaau

SEQ ID NO: 635879 - RNA, 19 nt, Homo sapiens
cugaaggccugagggaaga

SEQ ID NO: 635880 - RNA, 19 nt, Homo sapiens
augcugaaauguuaugcaa

SEQ ID NO: 635881 - RNA, 19 nt, Homo sapiens
ccugaauccugcaaucaag

SEQ ID NO: 635882 - RNA, 19 nt, Homo sapiens
acaagccauuugcaagguu

SEQ ID NO: 635883 - RNA, 19 nt, Homo sapiens
ccaaaguagcgaaaucagu

SEQ ID NO: 635884 - RNA, 19 nt, Homo sapiens
caucugagaaacccugaau

SEQ ID NO: 635885 - RNA, 19 nt, Homo sapiens
agaucaauaugaacaagca

SEQ ID NO: 635886 - RNA, 19 nt, Homo sapiens
aguuaacucucaaugaagu

SEQ ID NO: 635887 - RNA, 19 nt, Homo sapiens
uggccagccucgacacaga

SEQ ID NO: 635888 - RNA, 19 nt, Homo sapiens
uaagacacacaaagcagau

SEQ ID NO: 635889 - RNA, 19 nt, Homo sapiens
gcuuuugacucuguauuaa

SEQ ID NO: 635890 - RNA, 19 nt, Homo sapiens
ucagaucaauaugaacaag

SEQ ID NO: 635891 - RNA, 19 nt, Homo sapiens
gaaacucuccgagggaaaa

SEQ ID NO: 635892 - RNA, 19 nt, Homo sapiens
ucccauguacaguaugaua

SEQ ID NO: 635893 - RNA, 19 nt, Homo sapiens
aguuaucccuugcucuaga

SEQ ID NO: 635894 - RNA, 19 nt, Homo sapiens
uaagagcaagucuguggau

SEQ ID NO: 635895 - RNA, 19 nt, Homo sapiens
aagagcaagucuguggauu

SEQ ID NO: 635896 - RNA, 19 nt, Homo sapiens
uggcuucccagucauggua

SEQ ID NO: 635897 - RNA, 19 nt, Homo sapiens
gugacaaacacacacugaa

SEQ ID NO: 635898 - RNA, 19 nt, Homo sapiens
guuaucccuugcucuagau

SEQ ID NO: 635899 - RNA, 19 nt, Homo sapiens
caaagcaacaauaauucag

SEQ ID NO: 635900 - RNA, 19 nt, Homo sapiens
agcgaaaucaguacuaaga

SEQ ID NO: 635901 - RNA, 19 nt, Homo sapiens
aaguucagcuguuuucaaa

SEQ ID NO: 635902 - RNA, 19 nt, Homo sapiens
ucaauaugaacaagcacaa

SEQ ID NO: 635903 - RNA, 19 nt, Homo sapiens
cggaggaagaauuuauuau

SEQ ID NO: 635904 - RNA, 19 nt, Homo sapiens
ggaggagccuguuccagaa

SEQ ID NO: 635905 - RNA, 19 nt, Homo sapiens
gagaacagcaaccagaguu

SEQ ID NO: 635906 - RNA, 19 nt, Homo sapiens
aagcgcaucugcccaaaug

SEQ ID NO: 635907 - RNA, 19 nt, Homo sapiens
gaacagcaaccagaguuuc

SEQ ID NO: 635908 - RNA, 19 nt, Homo sapiens
aagcuuacccugucuuuga

SEQ ID NO: 635909 - RNA, 19 nt, Homo sapiens
gcaaccagaguuuccauuc

SEQ ID NO: 635910 - RNA, 19 nt, Homo sapiens
ggcgacacuucccuucgua

SEQ ID NO: 635911 - RNA, 19 nt, Homo sapiens
ugcuggaucuuaaugauga

SEQ ID NO: 635912 - RNA, 19 nt, Homo sapiens
caaccagaguuuccauucg

SEQ ID NO: 635913 - RNA, 19 nt, Homo sapiens
acacuucccuucguaucuu

SEQ ID NO: 635914 - RNA, 19 nt, Homo sapiens
gggcgacacuucccuucgu

SEQ ID NO: 635915 - RNA, 19 nt, Homo sapiens
ucgagaagguccggagaug

SEQ ID NO: 635916 - RNA, 19 nt, Homo sapiens
cgaagcuuacccugucuuu

SEQ ID NO: 635917 - RNA, 19 nt, Homo sapiens
gaagcuuacccugucuuug

SEQ ID NO: 635918 - RNA, 19 nt, Homo sapiens
ucaagcgcaucugcccaaa

SEQ ID NO: 635919 - RNA, 19 nt, Homo sapiens
uuaaugaugagaacagcaa

SEQ ID NO: 635920 - RNA, 19 nt, Homo sapiens
agaacagcaaccagaguuu

SEQ ID NO: 635921 - RNA, 19 nt, Homo sapiens
ccugcuggaucuuaaugau

SEQ ID NO: 635922 - RNA, 19 nt, Homo sapiens
ggaucuuaaugaugagaac

SEQ ID NO: 635923 - RNA, 19 nt, Homo sapiens
gaggagcgcucaugucuuu

SEQ ID NO: 635924 - RNA, 19 nt, Homo sapiens
gaaaucugcauguugaauu

SEQ ID NO: 635925 - RNA, 19 nt, Homo sapiens
gagaguccgucuagauuuc

SEQ ID NO: 635926 - RNA, 19 nt, Homo sapiens
ggaaaugggagaagaagug

SEQ ID NO: 635927 - RNA, 19 nt, Homo sapiens
gaacuugaacggagacugu

SEQ ID NO: 635928 - RNA, 19 nt, Homo sapiens
ucaagagccugcacacaug

SEQ ID NO: 635929 - RNA, 19 nt, Homo sapiens
ccgagaaccuaauggcuuu

SEQ ID NO: 635930 - RNA, 19 nt, Homo sapiens
gcagagaguccgucuagau

SEQ ID NO: 635931 - RNA, 19 nt, Homo sapiens
gcacacacaucugcacaca

SEQ ID NO: 635932 - RNA, 19 nt, Homo sapiens
ggaaguugcugaugaaccu

SEQ ID NO: 635933 - RNA, 19 nt, Homo sapiens
ccucggaaguugcugauga

SEQ ID NO: 635934 - RNA, 19 nt, Homo sapiens
ccuaauggcuuuccuucug

SEQ ID NO: 635935 - RNA, 19 nt, Homo sapiens
gaaaugggcaacagugagu

SEQ ID NO: 635936 - RNA, 19 nt, Homo sapiens
uuugaaaucugcauguuga

SEQ ID NO: 635937 - RNA, 19 nt, Homo sapiens
cagcaucccugccucuugu

SEQ ID NO: 635938 - RNA, 19 nt, Homo sapiens
ggcccugccucuauuuauu

SEQ ID NO: 635939 - RNA, 19 nt, Homo sapiens
acacgcagcuuuguucuca

SEQ ID NO: 635940 - RNA, 19 nt, Homo sapiens
cauguugaauugaacuuug

SEQ ID NO: 635941 - RNA, 19 nt, Homo sapiens
ucagguuacuugaacuuga

SEQ ID NO: 635942 - RNA, 19 nt, Homo sapiens
cuaauggcuuuccuucuga

SEQ ID NO: 635943 - RNA, 19 nt, Homo sapiens
aacagugagugaagacaua

SEQ ID NO: 635944 - RNA, 19 nt, Homo sapiens
gcacacacgcagcuuuguu

SEQ ID NO: 635945 - RNA, 19 nt, Homo sapiens
gggcaacagugagugaaga

SEQ ID NO: 635946 - RNA, 19 nt, Homo sapiens
aaaucugcauguugaauug

SEQ ID NO: 635947 - RNA, 19 nt, Homo sapiens
ccaaggacgacaucaagaa

SEQ ID NO: 635948 - RNA, 19 nt, Homo sapiens
acacgucccugaggauauu

SEQ ID NO: 635949 - RNA, 19 nt, Homo sapiens
cagguuacuugaacuugaa

SEQ ID NO: 635950 - RNA, 19 nt, Homo sapiens
cagagaguccgucuagauu

SEQ ID NO: 635951 - RNA, 19 nt, Homo sapiens
gagagcgugccucagguua

SEQ ID NO: 635952 - RNA, 19 nt, Homo sapiens
ggacagcagcaccaacuca

SEQ ID NO: 635953 - RNA, 19 nt, Homo sapiens
gaaaacagcaaccagaguu

SEQ ID NO: 635954 - RNA, 19 nt, Homo sapiens
caauuccucucuccuucuu

SEQ ID NO: 635955 - RNA, 19 nt, Homo sapiens
gggcagagaguccgucuag

SEQ ID NO: 635956 - RNA, 19 nt, Homo sapiens
ugacagacagcaaggagaa

SEQ ID NO: 635957 - RNA, 19 nt, Homo sapiens
uaaguggguuccugugaca

SEQ ID NO: 635958 - RNA, 19 nt, Homo sapiens
gaagaggagcgcucauguc

SEQ ID NO: 635959 - RNA, 19 nt, Homo sapiens
gagaagaggagcgcucaug

SEQ ID NO: 635960 - RNA, 19 nt, Homo sapiens
cuggaaggcuggcguagga

SEQ ID NO: 635961 - RNA, 19 nt, Homo sapiens
caaccagaguuccgugucu

SEQ ID NO: 635962 - RNA, 19 nt, Homo sapiens
gaaccuaauggcuuuccuu

SEQ ID NO: 635963 - RNA, 19 nt, Homo sapiens
ccuguaggcugcuguugga

SEQ ID NO: 635964 - RNA, 19 nt, Homo sapiens
gugcggaaaugggagaaga

SEQ ID NO: 635965 - RNA, 19 nt, Homo sapiens
ccucucuccuucuugaauu

SEQ ID NO: 635966 - RNA, 19 nt, Homo sapiens
gaauuugagguucugacaa

SEQ ID NO: 635967 - RNA, 19 nt, Homo sapiens
ugacacgucccugaggaua

SEQ ID NO: 635968 - RNA, 19 nt, Homo sapiens
ggacuggguagagacauug

SEQ ID NO: 635969 - RNA, 19 nt, Homo sapiens
uggcaccugugucuacuug

SEQ ID NO: 635970 - RNA, 19 nt, Homo sapiens
caagagccugcacacauga

SEQ ID NO: 635971 - RNA, 19 nt, Homo sapiens
ucgagaaagugcggaaaug

SEQ ID NO: 635972 - RNA, 19 nt, Homo sapiens
ccagcaagaauuugagguu

SEQ ID NO: 635973 - RNA, 19 nt, Homo sapiens
gagcgugccucagguuacu

SEQ ID NO: 635974 - RNA, 19 nt, Homo sapiens
gcaccugugucuacuugcu

SEQ ID NO: 635975 - RNA, 19 nt, Homo sapiens
agagaguccgucuagauuu

SEQ ID NO: 635976 - RNA, 19 nt, Homo sapiens
gucaagagccugcacacau

SEQ ID NO: 635977 - RNA, 19 nt, Homo sapiens
gcauguugaauugaacuuu

SEQ ID NO: 635978 - RNA, 19 nt, Homo sapiens
cagcagcccgagaaccuaa

SEQ ID NO: 635979 - RNA, 19 nt, Homo sapiens
gaaagaaaagucaaaaucg

SEQ ID NO: 635980 - RNA, 19 nt, Homo sapiens
caacagugagugaagacau

SEQ ID NO: 635981 - RNA, 19 nt, Homo sapiens
gcccugccucuauuuauug

SEQ ID NO: 635982 - RNA, 19 nt, Homo sapiens
gcgcuucuguguggaccaa

SEQ ID NO: 635983 - RNA, 19 nt, Homo sapiens
gacagcagcaccaacucaa

SEQ ID NO: 635984 - RNA, 19 nt, Homo sapiens
ugacgucuaucagcuuaag

SEQ ID NO: 635985 - RNA, 19 nt, Homo sapiens
gaaggcuggcguaggacuu

SEQ ID NO: 635986 - RNA, 19 nt, Homo sapiens
caaggacgacaucaagaag

SEQ ID NO: 635987 - RNA, 19 nt, Homo sapiens
ggccaaggacgacaucaag

SEQ ID NO: 635988 - RNA, 19 nt, Homo sapiens
gcgagaagagagagaugug

SEQ ID NO: 635989 - RNA, 19 nt, Homo sapiens
caccaaggaagaaccaguu

SEQ ID NO: 635990 - RNA, 19 nt, Homo sapiens
gcuuuguucucaccucuac

SEQ ID NO: 635991 - RNA, 19 nt, Homo sapiens
gacagcaaggagaaagaaa

SEQ ID NO: 635992 - RNA, 19 nt, Homo sapiens
ggagaaagaaaagucaaaa

SEQ ID NO: 635993 - RNA, 19 nt, Homo sapiens
uuccgugucugacgucuau

SEQ ID NO: 635994 - RNA, 19 nt, Homo sapiens
gccaaggacgacaucaaga

SEQ ID NO: 635995 - RNA, 19 nt, Homo sapiens
aauuugagguucugacaac

SEQ ID NO: 635996 - RNA, 19 nt, Homo sapiens
agaagaagugggugacugu

SEQ ID NO: 635997 - RNA, 19 nt, Homo sapiens
uagagacacaggucguuga

SEQ ID NO: 635998 - RNA, 19 nt, Homo sapiens
agugagugaagacauauuu

SEQ ID NO: 635999 - RNA, 19 nt, Homo sapiens
gagggaagggaagggcuuu

SEQ ID NO: 636000 - RNA, 19 nt, Homo sapiens
ggaggacuggguagagaca

SEQ ID NO: 636001 - RNA, 19 nt, Homo sapiens
cacaggucguugaggaaga

SEQ ID NO: 636002 - RNA, 19 nt, Homo sapiens
cagcacacaccuccgacuu

SEQ ID NO: 636003 - RNA, 19 nt, Homo sapiens
gacacgucccugaggauau

SEQ ID NO: 636004 - RNA, 19 nt, Homo sapiens
gggccaaggacgacaucaa

SEQ ID NO: 636005 - RNA, 19 nt, Homo sapiens
ccacacaagggcagagagu

SEQ ID NO: 636006 - RNA, 19 nt, Homo sapiens
aagaggagcgcucaugucu

SEQ ID NO: 636007 - RNA, 19 nt, Homo sapiens
ggucguugaggaagaggaa

SEQ ID NO: 636008 - RNA, 19 nt, Homo sapiens
aggacuggguagagacauu

SEQ ID NO: 636009 - RNA, 19 nt, Homo sapiens
gacacaggucguugaggaa

SEQ ID NO: 636010 - RNA, 19 nt, Homo sapiens
agacagcaaggagaaagaa

SEQ ID NO: 636011 - RNA, 19 nt, Homo sapiens
gaaaucugcauguugaauu

SEQ ID NO: 636012 - RNA, 19 nt, Homo sapiens
gagaguccgucuagauuuc

SEQ ID NO: 636013 - RNA, 19 nt, Homo sapiens
ggaaaugggagaagaagug

SEQ ID NO: 636014 - RNA, 19 nt, Homo sapiens
gaacuugaacggagacugu

SEQ ID NO: 636015 - RNA, 19 nt, Homo sapiens
ccgagaaccuaauggcuuu

SEQ ID NO: 636016 - RNA, 19 nt, Homo sapiens
gcagagaguccgucuagau

SEQ ID NO: 636017 - RNA, 19 nt, Homo sapiens
gcacacacaucugcacaca

SEQ ID NO: 636018 - RNA, 19 nt, Homo sapiens
ggaaguugcugaugaaccu

SEQ ID NO: 636019 - RNA, 19 nt, Homo sapiens
ccucggaaguugcugauga

SEQ ID NO: 636020 - RNA, 19 nt, Homo sapiens
ccuaauggcuuuccuucug

SEQ ID NO: 636021 - RNA, 19 nt, Homo sapiens
gaaaugggcaacagugagu

SEQ ID NO: 636022 - RNA, 19 nt, Homo sapiens
uuugaaaucugcauguuga

SEQ ID NO: 636023 - RNA, 19 nt, Homo sapiens
cagcaucccugccucuugu

SEQ ID NO: 636024 - RNA, 19 nt, Homo sapiens
acacgcagcuuuguucuca

SEQ ID NO: 636025 - RNA, 19 nt, Homo sapiens
cauguugaauugaacuuug

SEQ ID NO: 636026 - RNA, 19 nt, Homo sapiens
ucagguuacuugaacuuga

SEQ ID NO: 636027 - RNA, 19 nt, Homo sapiens
cuaauggcuuuccuucuga

SEQ ID NO: 636028 - RNA, 19 nt, Homo sapiens
aacagugagugaagacaua

SEQ ID NO: 636029 - RNA, 19 nt, Homo sapiens
gcacacacgcagcuuuguu

SEQ ID NO: 636030 - RNA, 19 nt, Homo sapiens
gggcaacagugagugaaga

SEQ ID NO: 636031 - RNA, 19 nt, Homo sapiens
aaaucugcauguugaauug

SEQ ID NO: 636032 - RNA, 19 nt, Homo sapiens
cagguuacuugaacuugaa

SEQ ID NO: 636033 - RNA, 19 nt, Homo sapiens
ccaaggacgacaucaagaa

SEQ ID NO: 636034 - RNA, 19 nt, Homo sapiens
acacgucccugaggauauu

SEQ ID NO: 636035 - RNA, 19 nt, Homo sapiens
cagagaguccgucuagauu

SEQ ID NO: 636036 - RNA, 19 nt, Homo sapiens
gagagcgugccucagguua

SEQ ID NO: 636037 - RNA, 19 nt, Homo sapiens
ggacagcagcaccaacuca

SEQ ID NO: 636038 - RNA, 19 nt, Homo sapiens
gaaaacagcaaccagaguu

SEQ ID NO: 636039 - RNA, 19 nt, Homo sapiens
caauuccucucuccuucuu

SEQ ID NO: 636040 - RNA, 19 nt, Homo sapiens
gggcagagaguccgucuag

SEQ ID NO: 636041 - RNA, 19 nt, Homo sapiens
ugacagacagcaaggagaa

SEQ ID NO: 636042 - RNA, 19 nt, Homo sapiens
uaaguggguuccugugaca

SEQ ID NO: 636043 - RNA, 19 nt, Homo sapiens
caaccagaguuccgugucu

SEQ ID NO: 636044 - RNA, 19 nt, Homo sapiens
gaaccuaauggcuuuccuu

SEQ ID NO: 636045 - RNA, 19 nt, Homo sapiens
ccuguaggcugcuguugga

SEQ ID NO: 636046 - RNA, 19 nt, Homo sapiens
gugcggaaaugggagaaga

SEQ ID NO: 636047 - RNA, 19 nt, Homo sapiens
ccucucuccuucuugaauu

SEQ ID NO: 636048 - RNA, 19 nt, Homo sapiens
gaauuugagguucugacaa

SEQ ID NO: 636049 - RNA, 19 nt, Homo sapiens
ggacuggguagagacauug

SEQ ID NO: 636050 - RNA, 19 nt, Homo sapiens
ucgagaaagugcggaaaug

SEQ ID NO: 636051 - RNA, 19 nt, Homo sapiens
ugacacgucccugaggaua

SEQ ID NO: 636052 - RNA, 19 nt, Homo sapiens
ccagcaagaauuugagguu

SEQ ID NO: 636053 - RNA, 19 nt, Homo sapiens
gagcgugccucagguuacu

SEQ ID NO: 636054 - RNA, 19 nt, Homo sapiens
agagaguccgucuagauuu

SEQ ID NO: 636055 - RNA, 19 nt, Homo sapiens
gcauguugaauugaacuuu

SEQ ID NO: 636056 - RNA, 19 nt, Homo sapiens
cagcagcccgagaaccuaa

SEQ ID NO: 636057 - RNA, 19 nt, Homo sapiens
gaaagaaaagucaaaaucg

SEQ ID NO: 636058 - RNA, 19 nt, Homo sapiens
caacagugagugaagacau

SEQ ID NO: 636059 - RNA, 19 nt, Homo sapiens
cuccuacccucaccuucua

SEQ ID NO: 636060 - RNA, 19 nt, Homo sapiens
gacagcagcaccaacucaa

SEQ ID NO: 636061 - RNA, 19 nt, Homo sapiens
ugacgucuaucagcuuaag

SEQ ID NO: 636062 - RNA, 19 nt, Homo sapiens
caaggacgacaucaagaag

SEQ ID NO: 636063 - RNA, 19 nt, Homo sapiens
ggccaaggacgacaucaag

SEQ ID NO: 636064 - RNA, 19 nt, Homo sapiens
ggagaaagaaaagucaaaa

SEQ ID NO: 636065 - RNA, 19 nt, Homo sapiens
gcuuuguucucaccucuac

SEQ ID NO: 636066 - RNA, 19 nt, Homo sapiens
uuccgugucugacgucuau

SEQ ID NO: 636067 - RNA, 19 nt, Homo sapiens
gacagcaaggagaaagaaa

SEQ ID NO: 636068 - RNA, 19 nt, Homo sapiens
agaagaagugggugacugu

SEQ ID NO: 636069 - RNA, 19 nt, Homo sapiens
aauuugagguucugacaac

SEQ ID NO: 636070 - RNA, 19 nt, Homo sapiens
gccaaggacgacaucaaga

SEQ ID NO: 636071 - RNA, 19 nt, Homo sapiens
agugagugaagacauauuu

SEQ ID NO: 636072 - RNA, 19 nt, Homo sapiens
gagggaagggaagggcuuu

SEQ ID NO: 636073 - RNA, 19 nt, Homo sapiens
ggaggacuggguagagaca

SEQ ID NO: 636074 - RNA, 19 nt, Homo sapiens
cagcacacaccuccgacuu

SEQ ID NO: 636075 - RNA, 19 nt, Homo sapiens
gggccaaggacgacaucaa

SEQ ID NO: 636076 - RNA, 19 nt, Homo sapiens
gacacgucccugaggauau

SEQ ID NO: 636077 - RNA, 19 nt, Homo sapiens
ccacacaagggcagagagu

SEQ ID NO: 636078 - RNA, 19 nt, Homo sapiens
agacagcaaggagaaagaa

SEQ ID NO: 636079 - RNA, 19 nt, Homo sapiens
aggacuggguagagacauu

SEQ ID NO: 636080 - RNA, 19 nt, Homo sapiens
gaagggagcaucauuguua

SEQ ID NO: 636081 - RNA, 19 nt, Homo sapiens
ggagagaguucauauguuu

SEQ ID NO: 636082 - RNA, 19 nt, Homo sapiens
gcagcaagcucuuacagua

SEQ ID NO: 636083 - RNA, 19 nt, Homo sapiens
caacagcauuguaaagaua

SEQ ID NO: 636084 - RNA, 19 nt, Homo sapiens
ggacacacccauuauguua

SEQ ID NO: 636085 - RNA, 19 nt, Homo sapiens
gcagaugaccgucuuguua

SEQ ID NO: 636086 - RNA, 19 nt, Homo sapiens
gaacagaaguggaaacaac

SEQ ID NO: 636087 - RNA, 19 nt, Homo sapiens
gaaauucagcccaaacaua

SEQ ID NO: 636088 - RNA, 19 nt, Homo sapiens
gaccagaguugcacacuuu

SEQ ID NO: 636089 - RNA, 19 nt, Homo sapiens
gaacagaggaccagaguug

SEQ ID NO: 636090 - RNA, 19 nt, Homo sapiens
gagcuagucuguauugcua

SEQ ID NO: 636091 - RNA, 19 nt, Homo sapiens
gaacucauacgaagaauug

SEQ ID NO: 636092 - RNA, 19 nt, Homo sapiens
gaaacaacuugcugaacuu

SEQ ID NO: 636093 - RNA, 19 nt, Homo sapiens
ggaaacaacuugcugaacu

SEQ ID NO: 636094 - RNA, 19 nt, Homo sapiens
gugaugacaugcuuauuaa

SEQ ID NO: 636095 - RNA, 19 nt, Homo sapiens
gaacuugccauuaguaaau

SEQ ID NO: 636096 - RNA, 19 nt, Homo sapiens
ggacaauacagaacucaua

SEQ ID NO: 636097 - RNA, 19 nt, Homo sapiens
gggagaugcugaaauuaaa

SEQ ID NO: 636098 - RNA, 19 nt, Homo sapiens
gaguuuaugugcagcauuu

SEQ ID NO: 636099 - RNA, 19 nt, Homo sapiens
gaacuuacuuacccaguca

SEQ ID NO: 636100 - RNA, 19 nt, Homo sapiens
cuagagcucuuaauuagaa

SEQ ID NO: 636101 - RNA, 19 nt, Homo sapiens
gauauugacacaacagaua

SEQ ID NO: 636102 - RNA, 19 nt, Homo sapiens
uaaagauggugaaagauug

SEQ ID NO: 636103 - RNA, 19 nt, Homo sapiens
gaaauauacccucagacua

SEQ ID NO: 636104 - RNA, 19 nt, Homo sapiens
gguaggcgauugcuucauu

SEQ ID NO: 636105 - RNA, 19 nt, Homo sapiens
ggacaagccauaccucauu

SEQ ID NO: 636106 - RNA, 19 nt, Homo sapiens
ggagucagaucuguaaaug

SEQ ID NO: 636107 - RNA, 19 nt, Homo sapiens
aaacagacaugggcuuuga

SEQ ID NO: 636108 - RNA, 19 nt, Homo sapiens
gcauuuaaaucacuguguu

SEQ ID NO: 636109 - RNA, 19 nt, Homo sapiens
ggaaacacaugcugaucug

SEQ ID NO: 636110 - RNA, 19 nt, Homo sapiens
ggaaacacaugagggaguu

SEQ ID NO: 636111 - RNA, 19 nt, Homo sapiens
gacaagccauaccucauuu

SEQ ID NO: 636112 - RNA, 19 nt, Homo sapiens
ggagaaauagucaccauug

SEQ ID NO: 636113 - RNA, 19 nt, Homo sapiens
gcaacagcauuguaaagau

SEQ ID NO: 636114 - RNA, 19 nt, Homo sapiens
gauaugggcaguugugaaa

SEQ ID NO: 636115 - RNA, 19 nt, Homo sapiens
uaaaggauaugggcaguug

SEQ ID NO: 636116 - RNA, 19 nt, Homo sapiens
ggaugccaauggaaagaua

SEQ ID NO: 636117 - RNA, 19 nt, Homo sapiens
ccacacagccaacaaagaa

SEQ ID NO: 636118 - RNA, 19 nt, Homo sapiens
gccuagagcucuuaauuag

SEQ ID NO: 636119 - RNA, 19 nt, Homo sapiens
aaugggagaugcugaaauu

SEQ ID NO: 636120 - RNA, 19 nt, Homo sapiens
ccacagugcuuuggacuau

SEQ ID NO: 636121 - RNA, 19 nt, Homo sapiens
gagagcaacagcauuguaa

SEQ ID NO: 636122 - RNA, 19 nt, Homo sapiens
ccacgauucuucagaguau

SEQ ID NO: 636123 - RNA, 19 nt, Homo sapiens
gauggaacaguacguauuu

SEQ ID NO: 636124 - RNA, 19 nt, Homo sapiens
agagaaaugucauggaaga

SEQ ID NO: 636125 - RNA, 19 nt, Homo sapiens
agagagaaaugucauggaa

SEQ ID NO: 636126 - RNA, 19 nt, Homo sapiens
gaagauggcauugaagaug

SEQ ID NO: 636127 - RNA, 19 nt, Homo sapiens
uaugggcaguugugaaaua

SEQ ID NO: 636128 - RNA, 19 nt, Homo sapiens
guacguauuuggcauucaa

SEQ ID NO: 636129 - RNA, 19 nt, Homo sapiens
gaagauggaacaguacgua

SEQ ID NO: 636130 - RNA, 19 nt, Homo sapiens
gcggaugacaugcagauua

SEQ ID NO: 636131 - RNA, 19 nt, Homo sapiens
gagcaucauuguuaagcuu

SEQ ID NO: 636132 - RNA, 19 nt, Homo sapiens
ggugaagacauuugaagua

SEQ ID NO: 636133 - RNA, 19 nt, Homo sapiens
gcacaaugcccacaucauc

SEQ ID NO: 636134 - RNA, 19 nt, Homo sapiens
uaucacagguucagaagau

SEQ ID NO: 636135 - RNA, 19 nt, Homo sapiens
gugaagacauuugaaguau

SEQ ID NO: 636136 - RNA, 19 nt, Homo sapiens
ggagagcuagucuguauug

SEQ ID NO: 636137 - RNA, 19 nt, Homo sapiens
cuaagagggucaaacaaug

SEQ ID NO: 636138 - RNA, 19 nt, Homo sapiens
aaauauacccucagacuau

SEQ ID NO: 636139 - RNA, 19 nt, Homo sapiens
ccaaagauaacaaucaguu

SEQ ID NO: 636140 - RNA, 19 nt, Homo sapiens
gaaaugcuaauauggugaa

SEQ ID NO: 636141 - RNA, 19 nt, Homo sapiens
gcuauucccugcugguuuc

SEQ ID NO: 636142 - RNA, 19 nt, Homo sapiens
gaagaaugggugaaggaaa

SEQ ID NO: 636143 - RNA, 19 nt, Homo sapiens
ggucaaacaaugucgcuuu

SEQ ID NO: 636144 - RNA, 19 nt, Homo sapiens
ggaaggacaugcccaaaau

SEQ ID NO: 636145 - RNA, 19 nt, Homo sapiens
gaaggacacacccauuaug

SEQ ID NO: 636146 - RNA, 19 nt, Homo sapiens
cagauuagaguguucaauu

SEQ ID NO: 636147 - RNA, 19 nt, Homo sapiens
ggaccagaguugcacacuu

SEQ ID NO: 636148 - RNA, 19 nt, Homo sapiens
gaauugcauugauuacuac

SEQ ID NO: 636149 - RNA, 19 nt, Homo sapiens
gaaggaaacacaugcugau

SEQ ID NO: 636150 - RNA, 19 nt, Homo sapiens
cuggagagcuagucuguau

SEQ ID NO: 636151 - RNA, 19 nt, Homo sapiens
gccaauggaaagauaauuu

SEQ ID NO: 636152 - RNA, 19 nt, Homo sapiens
uggcaagucuuuacaaugg

SEQ ID NO: 636153 - RNA, 19 nt, Homo sapiens
cagaugaccgucuuguuaa

SEQ ID NO: 636154 - RNA, 19 nt, Homo sapiens
uagaagauauugacacaac

SEQ ID NO: 636155 - RNA, 19 nt, Homo sapiens
cgaacuagaaguagauuug

SEQ ID NO: 636156 - RNA, 19 nt, Homo sapiens
guaggcgauugcuucauuu

SEQ ID NO: 636157 - RNA, 19 nt, Homo sapiens
caaugucgcuuugggcuau

SEQ ID NO: 636158 - RNA, 19 nt, Homo sapiens
uguucgagcugcaaaguuu

SEQ ID NO: 636159 - RNA, 19 nt, Homo sapiens
gccaaacaauacccacuug

SEQ ID NO: 636160 - RNA, 19 nt, Homo sapiens
gaagcagagucagaacaga

SEQ ID NO: 636161 - RNA, 19 nt, Homo sapiens
gaacaucauuagcuauucc

SEQ ID NO: 636162 - RNA, 19 nt, Homo sapiens
gcaauaagagagagcaaca

SEQ ID NO: 636163 - RNA, 19 nt, Homo sapiens
gggcaguugugaaauauac

SEQ ID NO: 636164 - RNA, 19 nt, Homo sapiens
aaagcuaacugcuagaucu

SEQ ID NO: 636165 - RNA, 19 nt, Homo sapiens
gacaggagcggaugacaug

SEQ ID NO: 636166 - RNA, 19 nt, Homo sapiens
ggaauuagaagauauugac

SEQ ID NO: 636167 - RNA, 19 nt, Homo sapiens
gaggagaaauagucaccau

SEQ ID NO: 636168 - RNA, 19 nt, Homo sapiens
gagaaaggcgugaauugca

SEQ ID NO: 636169 - RNA, 19 nt, Homo sapiens
agugaugacaugcuuauua

SEQ ID NO: 636170 - RNA, 19 nt, Homo sapiens
agacacuggugaagacauu

SEQ ID NO: 636171 - RNA, 19 nt, Homo sapiens
aaauucagcccaaacauau

SEQ ID NO: 636172 - RNA, 19 nt, Homo sapiens
uucagaagauggaacagua

SEQ ID NO: 636173 - RNA, 19 nt, Homo sapiens
acacacccauuauguuaug

SEQ ID NO: 636174 - RNA, 19 nt, Homo sapiens
ugacacaacagauaucaau

SEQ ID NO: 636175 - RNA, 19 nt, Homo sapiens
uuucagcccucaagaucua

SEQ ID NO: 636176 - RNA, 19 nt, Homo sapiens
ggcgauugcuucauuuaca

SEQ ID NO: 636177 - RNA, 19 nt, Homo sapiens
ggcgugaauugcauugauu

SEQ ID NO: 636178 - RNA, 19 nt, Homo sapiens
gaaaggcgugaauugcauu

SEQ ID NO: 636179 - RNA, 19 nt, Homo sapiens
cugaguagccgguaacaaa

SEQ ID NO: 636180 - RNA, 19 nt, Homo sapiens
gcauugagcuccacuguau

SEQ ID NO: 636181 - RNA, 19 nt, Homo sapiens
gaagguaccugcagagcuu

SEQ ID NO: 636182 - RNA, 19 nt, Homo sapiens
ggaagacacagcaaagaua

SEQ ID NO: 636183 - RNA, 19 nt, Homo sapiens
gaaagaaggagcagauaga

SEQ ID NO: 636184 - RNA, 19 nt, Homo sapiens
gcaaugguacugugucuuu

SEQ ID NO: 636185 - RNA, 19 nt, Homo sapiens
ugacaaaucccgaaagcua

SEQ ID NO: 636186 - RNA, 19 nt, Homo sapiens
ggagaguaauccauacaga

SEQ ID NO: 636187 - RNA, 19 nt, Homo sapiens
gaagaggaaacaaguauca

SEQ ID NO: 636188 - RNA, 19 nt, Homo sapiens
agacuaaacuacucucgaa

SEQ ID NO: 636189 - RNA, 19 nt, Homo sapiens
gaagacacagcaaagauau

SEQ ID NO: 636190 - RNA, 19 nt, Homo sapiens
uaucaaagcugcucguucu

SEQ ID NO: 636191 - RNA, 19 nt, Homo sapiens
uggcaaagauucucuguca

SEQ ID NO: 636192 - RNA, 19 nt, Homo sapiens
gaaagcuaccacauucuaa

SEQ ID NO: 636193 - RNA, 19 nt, Homo sapiens
ugaaggcccugcuagagaa

SEQ ID NO: 636194 - RNA, 19 nt, Homo sapiens
uaacaaagaagcuuaugug

SEQ ID NO: 636195 - RNA, 19 nt, Homo sapiens
gcuaugacccgcaggcuaa

SEQ ID NO: 636196 - RNA, 19 nt, Homo sapiens
gcaaagauucucugucauc

SEQ ID NO: 636197 - RNA, 19 nt, Homo sapiens
uagagaggcugggcuauga

SEQ ID NO: 636198 - RNA, 19 nt, Homo sapiens
cugcagagcuuauuugucu

SEQ ID NO: 636199 - RNA, 19 nt, Homo sapiens
ggaaacaaguaucaaagcu

SEQ ID NO: 636200 - RNA, 19 nt, Homo sapiens
caaugguacugugucuuua

SEQ ID NO: 636201 - RNA, 19 nt, Homo sapiens
ucgauggccuggagaguaa

SEQ ID NO: 636202 - RNA, 19 nt, Homo sapiens
ggcuacagcuucagaaaca

SEQ ID NO: 636203 - RNA, 19 nt, Homo sapiens
cgaaagcuaccacauucua

SEQ ID NO: 636204 - RNA, 19 nt, Homo sapiens
gagaguaauccauacagaa

SEQ ID NO: 636205 - RNA, 19 nt, Homo sapiens
gggaaugggugacguuguc

SEQ ID NO: 636206 - RNA, 19 nt, Homo sapiens
gacauccgguuucuccauu

SEQ ID NO: 636207 - RNA, 19 nt, Homo sapiens
uuaaagaagucucggaucu

SEQ ID NO: 636208 - RNA, 19 nt, Homo sapiens
ggaaagaaggagcagauag

SEQ ID NO: 636209 - RNA, 19 nt, Homo sapiens
aagaucaccuguagggaaa

SEQ ID NO: 636210 - RNA, 19 nt, Homo sapiens
gaagacaccuggcuuuugg

SEQ ID NO: 636211 - RNA, 19 nt, Homo sapiens
gaaguucugucgcauugac

SEQ ID NO: 636212 - RNA, 19 nt, Homo sapiens
cccgaaagcuaccacauuc

SEQ ID NO: 636213 - RNA, 19 nt, Homo sapiens
gaagaaaccccgagaaugg

SEQ ID NO: 636214 - RNA, 19 nt, Homo sapiens
ggagcuccguccucagaga

SEQ ID NO: 636215 - RNA, 19 nt, Homo sapiens
aagacaaacuucagaccaa

SEQ ID NO: 636216 - RNA, 19 nt, Homo sapiens
gaggaagaggaaacaagua

SEQ ID NO: 636217 - RNA, 19 nt, Homo sapiens
agaagucucggaucucuaa

SEQ ID NO: 636218 - RNA, 19 nt, Homo sapiens
ggaagaggaaggucaugga

SEQ ID NO: 636219 - RNA, 19 nt, Homo sapiens
ccacaucuaugacaaucag

SEQ ID NO: 636220 - RNA, 19 nt, Homo sapiens
gaagaggaaggucauggau

SEQ ID NO: 636221 - RNA, 19 nt, Homo sapiens
uaacacggcuugaguuccu

SEQ ID NO: 636222 - RNA, 19 nt, Homo sapiens
gaucaccuguagggaaaug

SEQ ID NO: 636223 - RNA, 19 nt, Homo sapiens
gguacugugucuuuaugga

SEQ ID NO: 636224 - RNA, 19 nt, Homo sapiens
gauaugccaggcugacauu

SEQ ID NO: 636225 - RNA, 19 nt, Homo sapiens
gaggaaacaaguaucaaag

SEQ ID NO: 636226 - RNA, 19 nt, Homo sapiens
aaagaagucucggaucucu

SEQ ID NO: 636227 - RNA, 19 nt, Homo sapiens
cggcaagccuggugaagag

SEQ ID NO: 636228 - RNA, 19 nt, Homo sapiens
agucagaacccuuacaaug

SEQ ID NO: 636229 - RNA, 19 nt, Homo sapiens
cuaaacuacucucgaacug

SEQ ID NO: 636230 - RNA, 19 nt, Homo sapiens
gggaagacacagcaaagau

SEQ ID NO: 636231 - RNA, 19 nt, Homo sapiens
gggaaagaaggagcagaua

SEQ ID NO: 636232 - RNA, 19 nt, Homo sapiens
gugaaggcccugcuagaga

SEQ ID NO: 636233 - RNA, 19 nt, Homo sapiens
ggacacagcaaugguacug

SEQ ID NO: 636234 - RNA, 19 nt, Homo sapiens
ucauguggcugcccuugau

SEQ ID NO: 636235 - RNA, 19 nt, Homo sapiens
caagaaagacaaacuucag

SEQ ID NO: 636236 - RNA, 19 nt, Homo sapiens
ccaagaaagacaaacuuca

SEQ ID NO: 636237 - RNA, 19 nt, Homo sapiens
uuaaagaggaaagcgauuu

SEQ ID NO: 636238 - RNA, 19 nt, Homo sapiens
guaccugcagagcuuauuu

SEQ ID NO: 636239 - RNA, 19 nt, Homo sapiens
gcugaagaucuuugacuug

SEQ ID NO: 636240 - RNA, 19 nt, Homo sapiens
gaguaacacggcuugaguu

SEQ ID NO: 636241 - RNA, 19 nt, Homo sapiens
uugauuggguaacaaagaa

SEQ ID NO: 636242 - RNA, 19 nt, Homo sapiens
aaagcuaccacauucuaaa

SEQ ID NO: 636243 - RNA, 19 nt, Homo sapiens
ggaagugguccagaaguuc

SEQ ID NO: 636244 - RNA, 19 nt, Homo sapiens
agucucggaucucuaagaa

SEQ ID NO: 636245 - RNA, 19 nt, Homo sapiens
guaacaaagaagcuuaugu

SEQ ID NO: 636246 - RNA, 19 nt, Homo sapiens
agaggaaacaaguaucaaa

SEQ ID NO: 636247 - RNA, 19 nt, Homo sapiens
ggaguccagcuaugaagga

SEQ ID NO: 636248 - RNA, 19 nt, Homo sapiens
ggacauccgguuucuccau

SEQ ID NO: 636249 - RNA, 19 nt, Homo sapiens
uguggaggcuguggacauu

SEQ ID NO: 636250 - RNA, 19 nt, Homo sapiens
ucaaagcugcucguucuga

SEQ ID NO: 636251 - RNA, 19 nt, Homo sapiens
caagccuggugaagaggaa

SEQ ID NO: 636252 - RNA, 19 nt, Homo sapiens
ggaggugaaggcccugcua

SEQ ID NO: 636253 - RNA, 19 nt, Homo sapiens
acaaugccgucauccaucu

SEQ ID NO: 636254 - RNA, 19 nt, Homo sapiens
gcggcucgauguuaugagu

SEQ ID NO: 636255 - RNA, 19 nt, Homo sapiens
gauuguggcagcucugaau

SEQ ID NO: 636256 - RNA, 19 nt, Homo sapiens
aagcuuaugugcgagauca

SEQ ID NO: 636257 - RNA, 19 nt, Homo sapiens
cagccaagcacuuugacuu

SEQ ID NO: 636258 - RNA, 19 nt, Homo sapiens
ggaagaggaaacaaguauc

SEQ ID NO: 636259 - RNA, 19 nt, Homo sapiens
aaacuucagaccaagagaa

SEQ ID NO: 636260 - RNA, 19 nt, Homo sapiens
uuuggacccuacagacuaa

SEQ ID NO: 636261 - RNA, 19 nt, Homo sapiens
guuuggacccuacagacua

SEQ ID NO: 636262 - RNA, 19 nt, Homo sapiens
gcaguuuggacccuacaga

SEQ ID NO: 636263 - RNA, 19 nt, Homo sapiens
cgagggcugagaagaguuu

SEQ ID NO: 636264 - RNA, 19 nt, Homo sapiens
gcugcugcuugcugaagaa

SEQ ID NO: 636265 - RNA, 19 nt, Homo sapiens
gugcauggccuucaguucu

SEQ ID NO: 636266 - RNA, 19 nt, Homo sapiens
cagcaaugguacugugucu

SEQ ID NO: 636267 - RNA, 19 nt, Homo sapiens
gcauugacaaaucccgaaa

SEQ ID NO: 636268 - RNA, 19 nt, Homo sapiens
cuucagaccaagagaaaga

SEQ ID NO: 636269 - RNA, 19 nt, Homo sapiens
uuaugagucagaacccuua

SEQ ID NO: 636270 - RNA, 19 nt, Homo sapiens
gacccuacagacuaaacua

SEQ ID NO: 636271 - RNA, 19 nt, Homo sapiens
cgaguaacacggcuugagu

SEQ ID NO: 636272 - RNA, 19 nt, Homo sapiens
cacgagggcugagaagagu

SEQ ID NO: 636273 - RNA, 19 nt, Homo sapiens
gaaccgcuggcuccacauc

SEQ ID NO: 636274 - RNA, 19 nt, Homo sapiens
ugaggaagaggaaacaagu

SEQ ID NO: 636275 - RNA, 19 nt, Homo sapiens
cuccagggccuccucguaa

SEQ ID NO: 636276 - RNA, 19 nt, Homo sapiens
agccaaagccaaagcagaa

SEQ ID NO: 636277 - RNA, 19 nt, Homo sapiens
gacaaacuucagaccaaga

SEQ ID NO: 636278 - RNA, 19 nt, Homo sapiens
ugagucagaacccuuacaa

SEQ ID NO: 636279 - RNA, 19 nt, Homo sapiens
ggcauugagcuccacugua

SEQ ID NO: 636280 - RNA, 19 nt, Homo sapiens
gaacuaaacccuuccuuuc

SEQ ID NO: 636281 - RNA, 19 nt, Homo sapiens
caagguauuuccagaacua

SEQ ID NO: 636282 - RNA, 19 nt, Homo sapiens
ggaggaagaucugguguug

SEQ ID NO: 636283 - RNA, 19 nt, Homo sapiens
ugaugaagaugaagaacua

SEQ ID NO: 636284 - RNA, 19 nt, Homo sapiens
cagaugagcugugcgauga

SEQ ID NO: 636285 - RNA, 19 nt, Homo sapiens
ggaguaagucguaggagua

SEQ ID NO: 636286 - RNA, 19 nt, Homo sapiens
ggacgggaauaagaucuuu

SEQ ID NO: 636287 - RNA, 19 nt, Homo sapiens
ggaguccacugauuucuca

SEQ ID NO: 636288 - RNA, 19 nt, Homo sapiens
gaagcgaggugguaauugc

SEQ ID NO: 636289 - RNA, 19 nt, Homo sapiens
ccacugauuucucaucuuc

SEQ ID NO: 636290 - RNA, 19 nt, Homo sapiens
ggacaagugcacugaacua

SEQ ID NO: 636291 - RNA, 19 nt, Homo sapiens
gaacaugcaccucaaucug

SEQ ID NO: 636292 - RNA, 19 nt, Homo sapiens
caagugcacugaacuacuc

SEQ ID NO: 636293 - RNA, 19 nt, Homo sapiens
ucuguggacuuguauauau

SEQ ID NO: 636294 - RNA, 19 nt, Homo sapiens
ggucugugcuccaaaugug

SEQ ID NO: 636295 - RNA, 19 nt, Homo sapiens
gaucagguccuacucaaag

SEQ ID NO: 636296 - RNA, 19 nt, Homo sapiens
ccagggaguccacugauuu

SEQ ID NO: 636297 - RNA, 19 nt, Homo sapiens
ugaagucuguguuuguguu

SEQ ID NO: 636298 - RNA, 19 nt, Homo sapiens
gggaggagcaggucaacuu

SEQ ID NO: 636299 - RNA, 19 nt, Homo sapiens
gcucugcgauguaucuauc

SEQ ID NO: 636300 - RNA, 19 nt, Homo sapiens
ucucaaggaugcgcucuuu

SEQ ID NO: 636301 - RNA, 19 nt, Homo sapiens
ccaacucccucuuccuaug

SEQ ID NO: 636302 - RNA, 19 nt, Homo sapiens
gggaauaagaucuuucugu

SEQ ID NO: 636303 - RNA, 19 nt, Homo sapiens
caaggaugcgcucuuuauu

SEQ ID NO: 636304 - RNA, 19 nt, Homo sapiens
ucaaggaugcgcucuuuau

SEQ ID NO: 636305 - RNA, 19 nt, Homo sapiens
ucgaggagguggcccugua

SEQ ID NO: 636306 - RNA, 19 nt, Homo sapiens
ggccagcucugcgauguau

SEQ ID NO: 636307 - RNA, 19 nt, Homo sapiens
ugaggaugaugaagaugaa

SEQ ID NO: 636308 - RNA, 19 nt, Homo sapiens
gaugagcugugcgaugaug

SEQ ID NO: 636309 - RNA, 19 nt, Homo sapiens
ccaccacacuuacugucuu

SEQ ID NO: 636310 - RNA, 19 nt, Homo sapiens
caaugacuuuggcccauau

SEQ ID NO: 636311 - RNA, 19 nt, Homo sapiens
caagaggcauuugcagcuu

SEQ ID NO: 636312 - RNA, 19 nt, Homo sapiens
ccacagaaacacuggguau

SEQ ID NO: 636313 - RNA, 19 nt, Homo sapiens
cacuuacugucuuccuuua

SEQ ID NO: 636314 - RNA, 19 nt, Homo sapiens
ggccaacucccucuuccua

SEQ ID NO: 636315 - RNA, 19 nt, Homo sapiens
ggugaccagugcccucuug

SEQ ID NO: 636316 - RNA, 19 nt, Homo sapiens
cagcugcagugguacaugu

SEQ ID NO: 636317 - RNA, 19 nt, Homo sapiens
ugaagcaccaucugacuga

SEQ ID NO: 636318 - RNA, 19 nt, Homo sapiens
ucaaaggcaugaccuccau

SEQ ID NO: 636319 - RNA, 19 nt, Homo sapiens
aaggaugcgcucuuuauuu

SEQ ID NO: 636320 - RNA, 19 nt, Homo sapiens
caggucaacuucugugagu

SEQ ID NO: 636321 - RNA, 19 nt, Homo sapiens
cauggcugcugcugacauu

SEQ ID NO: 636322 - RNA, 19 nt, Homo sapiens
ucaggugguuguagucugu

SEQ ID NO: 636323 - RNA, 19 nt, Homo sapiens
agaacuaaacccuuccuuu

SEQ ID NO: 636324 - RNA, 19 nt, Homo sapiens
gaauaaggagcacgaugca

SEQ ID NO: 636325 - RNA, 19 nt, Homo sapiens
ggaggaagaggaggaggaa

SEQ ID NO: 636326 - RNA, 19 nt, Homo sapiens
ccaucucgcugcccagugu

SEQ ID NO: 636327 - RNA, 19 nt, Homo sapiens
guaagucguaggaguacaa

SEQ ID NO: 636328 - RNA, 19 nt, Homo sapiens
ggaugaugaagaugaagaa

SEQ ID NO: 636329 - RNA, 19 nt, Homo sapiens
gugaggaugaugaagauga

SEQ ID NO: 636330 - RNA, 19 nt, Homo sapiens
ugacugagcacaugaagac

SEQ ID NO: 636331 - RNA, 19 nt, Homo sapiens
gaagucuguguuuguguug

SEQ ID NO: 636332 - RNA, 19 nt, Homo sapiens
ggaaggggaaccacaguuu

SEQ ID NO: 636333 - RNA, 19 nt, Homo sapiens
ggaagaggaggaggaagau

SEQ ID NO: 636334 - RNA, 19 nt, Homo sapiens
ggagacaaggagggaguaa

SEQ ID NO: 636335 - RNA, 19 nt, Homo sapiens
ugaacauccugcagucaca

SEQ ID NO: 636336 - RNA, 19 nt, Homo sapiens
acacuuacugucuuccuuu

SEQ ID NO: 636337 - RNA, 19 nt, Homo sapiens
ggaggagcaggucaacuuc

SEQ ID NO: 636338 - RNA, 19 nt, Homo sapiens
aggaagaucugguguugac

SEQ ID NO: 636339 - RNA, 19 nt, Homo sapiens
gugaagcgaggugguaauu

SEQ ID NO: 636340 - RNA, 19 nt, Homo sapiens
agacaaggagggaguaagu

SEQ ID NO: 636341 - RNA, 19 nt, Homo sapiens
guggagacaaggccuuuga

SEQ ID NO: 636342 - RNA, 19 nt, Homo sapiens
ccugaagucuguguuugug

SEQ ID NO: 636343 - RNA, 19 nt, Homo sapiens
ugaucucccaccacacuua

SEQ ID NO: 636344 - RNA, 19 nt, Homo sapiens
ucugugaguccuccaauga

SEQ ID NO: 636345 - RNA, 19 nt, Homo sapiens
cacagaaacacuggguaua

SEQ ID NO: 636346 - RNA, 19 nt, Homo sapiens
cccagggaguccacugauu

SEQ ID NO: 636347 - RNA, 19 nt, Homo sapiens
ggccauccuugccguccaa

SEQ ID NO: 636348 - RNA, 19 nt, Homo sapiens
gaggagguggcccuguauu

SEQ ID NO: 636349 - RNA, 19 nt, Homo sapiens
gcuaccaccaccaucacua

SEQ ID NO: 636350 - RNA, 19 nt, Homo sapiens
aaggagggaguaagucgua

SEQ ID NO: 636351 - RNA, 19 nt, Homo sapiens
ccucugauggguacacuga

SEQ ID NO: 636352 - RNA, 19 nt, Homo sapiens
uuaucucuguggacuugua

SEQ ID NO: 636353 - RNA, 19 nt, Homo sapiens
cuuacugucuuccuuuauc

SEQ ID NO: 636354 - RNA, 19 nt, Homo sapiens
gacccaggcgccuuugaga

SEQ ID NO: 636355 - RNA, 19 nt, Homo sapiens
guuguagucugugccugaa

SEQ ID NO: 636356 - RNA, 19 nt, Homo sapiens
ugucuuccuuuaucucugu

SEQ ID NO: 636357 - RNA, 19 nt, Homo sapiens
caccacacuuacugucuuc

SEQ ID NO: 636358 - RNA, 19 nt, Homo sapiens
gaccgcuccuucccuugga

SEQ ID NO: 636359 - RNA, 19 nt, Homo sapiens
cagaaacacuggguauacg

SEQ ID NO: 636360 - RNA, 19 nt, Homo sapiens
ccgcccuccuccuuucuuu

SEQ ID NO: 636361 - RNA, 19 nt, Homo sapiens
cuguggacuuguauauauu

SEQ ID NO: 636362 - RNA, 19 nt, Homo sapiens
cuuuaucucuguggacuug

SEQ ID NO: 636363 - RNA, 19 nt, Homo sapiens
gcgccaagaaguucaugug

SEQ ID NO: 636364 - RNA, 19 nt, Homo sapiens
gguguugaccugugaggau

SEQ ID NO: 636365 - RNA, 19 nt, Homo sapiens
gagggaguaagucguagga

SEQ ID NO: 636366 - RNA, 19 nt, Homo sapiens
agaguagauugcacaugga

SEQ ID NO: 636367 - RNA, 19 nt, Homo sapiens
ccaucugacugagcacaug

SEQ ID NO: 636368 - RNA, 19 nt, Homo sapiens
ccugugaggaugaugaaga

SEQ ID NO: 636369 - RNA, 19 nt, Homo sapiens
aggaagaggaggaggaaga

SEQ ID NO: 636370 - RNA, 19 nt, Homo sapiens
cagcagcagcaacuacuuc

SEQ ID NO: 636371 - RNA, 19 nt, Homo sapiens
guggacaagugcacugaac

SEQ ID NO: 636372 - RNA, 19 nt, Homo sapiens
ucguaggaguacaagguuu

SEQ ID NO: 636373 - RNA, 19 nt, Homo sapiens
uguagucugugccugaagu

SEQ ID NO: 636374 - RNA, 19 nt, Homo sapiens
cacacuuacugucuuccuu

SEQ ID NO: 636375 - RNA, 19 nt, Homo sapiens
gaccugugaggaugaugaa

SEQ ID NO: 636376 - RNA, 19 nt, Homo sapiens
ucugauggguacacugaag

SEQ ID NO: 636377 - RNA, 19 nt, Homo sapiens
uuacugucuuccuuuaucu

SEQ ID NO: 636378 - RNA, 19 nt, Homo sapiens
gaggaagaucugguguuga

SEQ ID NO: 636379 - RNA, 19 nt, Homo sapiens
ucagcuaccaccaccauca

SEQ ID NO: 636380 - RNA, 19 nt, Homo sapiens
gaagaaaccugguccauuc

SEQ ID NO: 636381 - RNA, 19 nt, Homo sapiens
gaacuuguauaguguguuu

SEQ ID NO: 636382 - RNA, 19 nt, Homo sapiens
gaauagcauugcacgauua

SEQ ID NO: 636383 - RNA, 19 nt, Homo sapiens
gaacugaaggccauucuua

SEQ ID NO: 636384 - RNA, 19 nt, Homo sapiens
uaacaggagucgaaccuua

SEQ ID NO: 636385 - RNA, 19 nt, Homo sapiens
cuaaagacguuccugaaua

SEQ ID NO: 636386 - RNA, 19 nt, Homo sapiens
gaauucagccuucaguuua

SEQ ID NO: 636387 - RNA, 19 nt, Homo sapiens
gaacauguauugcauugau

SEQ ID NO: 636388 - RNA, 19 nt, Homo sapiens
ccaagaaccuguuaguauu

SEQ ID NO: 636389 - RNA, 19 nt, Homo sapiens
gauaagcagugaaacauug

SEQ ID NO: 636390 - RNA, 19 nt, Homo sapiens
gaaaggugguugaaauguu

SEQ ID NO: 636391 - RNA, 19 nt, Homo sapiens
guagaaaggugguugaaau

SEQ ID NO: 636392 - RNA, 19 nt, Homo sapiens
gagauaugauggauucuuu

SEQ ID NO: 636393 - RNA, 19 nt, Homo sapiens
gaagaaggucuguaaauga

SEQ ID NO: 636394 - RNA, 19 nt, Homo sapiens
gcacugaaaugcagaguag

SEQ ID NO: 636395 - RNA, 19 nt, Homo sapiens
aagggaagcucaauuagua

SEQ ID NO: 636396 - RNA, 19 nt, Homo sapiens
agacauaccugcucaucua

SEQ ID NO: 636397 - RNA, 19 nt, Homo sapiens
caaagaacauggucugaug

SEQ ID NO: 636398 - RNA, 19 nt, Homo sapiens
gaagaucgaccacuuauca

SEQ ID NO: 636399 - RNA, 19 nt, Homo sapiens
gaagccaccuugacuguga

SEQ ID NO: 636400 - RNA, 19 nt, Homo sapiens
caucacaaaucaugucuuu

SEQ ID NO: 636401 - RNA, 19 nt, Homo sapiens
ggagccaguuauuaauuua

SEQ ID NO: 636402 - RNA, 19 nt, Homo sapiens
uaaagacguuccugaauau

SEQ ID NO: 636403 - RNA, 19 nt, Homo sapiens
caaaugugguucaguuauu

SEQ ID NO: 636404 - RNA, 19 nt, Homo sapiens
ccacacaacugucguacaa

SEQ ID NO: 636405 - RNA, 19 nt, Homo sapiens
gaggagauaugauggauuc

SEQ ID NO: 636406 - RNA, 19 nt, Homo sapiens
ggaauagcauugcacgauu

SEQ ID NO: 636407 - RNA, 19 nt, Homo sapiens
ccaagaauauaacugauug

SEQ ID NO: 636408 - RNA, 19 nt, Homo sapiens
gaacauggucugaugcaaa

SEQ ID NO: 636409 - RNA, 19 nt, Homo sapiens
ugauugcacuuuccgauua

SEQ ID NO: 636410 - RNA, 19 nt, Homo sapiens
caggaaggcugacagauga

SEQ ID NO: 636411 - RNA, 19 nt, Homo sapiens
caaggugaaugcacaauau

SEQ ID NO: 636412 - RNA, 19 nt, Homo sapiens
gcucuuugcugaugagaaa

SEQ ID NO: 636413 - RNA, 19 nt, Homo sapiens
gacuagugguuaacauuua

SEQ ID NO: 636414 - RNA, 19 nt, Homo sapiens
ggauggagccaguuauuaa

SEQ ID NO: 636415 - RNA, 19 nt, Homo sapiens
gaagagguuugcagagaug

SEQ ID NO: 636416 - RNA, 19 nt, Homo sapiens
cgaagaaggucuguaaaug

SEQ ID NO: 636417 - RNA, 19 nt, Homo sapiens
gauggugccuauagucuuu

SEQ ID NO: 636418 - RNA, 19 nt, Homo sapiens
ggagugaucauguuuaaga

SEQ ID NO: 636419 - RNA, 19 nt, Homo sapiens
gaaaugggcuaauaaugcu

SEQ ID NO: 636420 - RNA, 19 nt, Homo sapiens
ugaguuaagugcaagcaua

SEQ ID NO: 636421 - RNA, 19 nt, Homo sapiens
ggaccaccauuuaaagcua

SEQ ID NO: 636422 - RNA, 19 nt, Homo sapiens
guaaacccaugaauuugaa

SEQ ID NO: 636423 - RNA, 19 nt, Homo sapiens
caagaaccuguuaguauua

SEQ ID NO: 636424 - RNA, 19 nt, Homo sapiens
gcacuuggguagcagaguu

SEQ ID NO: 636425 - RNA, 19 nt, Homo sapiens
agaagugccuauuacauuu

SEQ ID NO: 636426 - RNA, 19 nt, Homo sapiens
gaacuuagucuuugagaag

SEQ ID NO: 636427 - RNA, 19 nt, Homo sapiens
ggauuuagcauugagguua

SEQ ID NO: 636428 - RNA, 19 nt, Homo sapiens
agaguaaacccaugaauuu

SEQ ID NO: 636429 - RNA, 19 nt, Homo sapiens
gauaauaccaugccgaguu

SEQ ID NO: 636430 - RNA, 19 nt, Homo sapiens
guggaaaccugaugaacuu

SEQ ID NO: 636431 - RNA, 19 nt, Homo sapiens
gcagggaacuggccaggau

SEQ ID NO: 636432 - RNA, 19 nt, Homo sapiens
aaaggugguugaaauguuu

SEQ ID NO: 636433 - RNA, 19 nt, Homo sapiens
ccaugcaauucgcuuauua

SEQ ID NO: 636434 - RNA, 19 nt, Homo sapiens
gaucgaccacuuaucaaua

SEQ ID NO: 636435 - RNA, 19 nt, Homo sapiens
ggucagcccuuuucuauuu

SEQ ID NO: 636436 - RNA, 19 nt, Homo sapiens
gauaacagcaaacuaguug

SEQ ID NO: 636437 - RNA, 19 nt, Homo sapiens
acucuucguucgauuauua

SEQ ID NO: 636438 - RNA, 19 nt, Homo sapiens
ggacugugguuaauuugau

SEQ ID NO: 636439 - RNA, 19 nt, Homo sapiens
cgaguuaccuggucacugu

SEQ ID NO: 636440 - RNA, 19 nt, Homo sapiens
ucaaggaucccaaauaaug

SEQ ID NO: 636441 - RNA, 19 nt, Homo sapiens
gcaacauucugaagagguu

SEQ ID NO: 636442 - RNA, 19 nt, Homo sapiens
cacagugccuugaacauuu

SEQ ID NO: 636443 - RNA, 19 nt, Homo sapiens
ggaauucgauccaucaaaa

SEQ ID NO: 636444 - RNA, 19 nt, Homo sapiens
gaaaugugugccuucaaua

SEQ ID NO: 636445 - RNA, 19 nt, Homo sapiens
caacucauccuauuggaaa

SEQ ID NO: 636446 - RNA, 19 nt, Homo sapiens
ugagaaaccucuucaggau

SEQ ID NO: 636447 - RNA, 19 nt, Homo sapiens
guucauagcaugcaaauca

SEQ ID NO: 636448 - RNA, 19 nt, Homo sapiens
gaaguuucguguugaagga

SEQ ID NO: 636449 - RNA, 19 nt, Homo sapiens
auaauaccaugccgaguua

SEQ ID NO: 636450 - RNA, 19 nt, Homo sapiens
ugacauggcuucagguaca

SEQ ID NO: 636451 - RNA, 19 nt, Homo sapiens
cgggaagguuuaauguuua

SEQ ID NO: 636452 - RNA, 19 nt, Homo sapiens
ucgggaagguuuaauguuu

SEQ ID NO: 636453 - RNA, 19 nt, Homo sapiens
gcauugagguuauuaagac

SEQ ID NO: 636454 - RNA, 19 nt, Homo sapiens
uaggauggauuuagcauug

SEQ ID NO: 636455 - RNA, 19 nt, Homo sapiens
auacaucucugcaggguuu

SEQ ID NO: 636456 - RNA, 19 nt, Homo sapiens
gacaguaugugguucguau

SEQ ID NO: 636457 - RNA, 19 nt, Homo sapiens
aaggaaaucugauguggaa

SEQ ID NO: 636458 - RNA, 19 nt, Homo sapiens
agaaaccucuucaggauau

SEQ ID NO: 636459 - RNA, 19 nt, Homo sapiens
uaauaaugcuggcaaagug

SEQ ID NO: 636460 - RNA, 19 nt, Homo sapiens
gaaauagugcaguuugcua

SEQ ID NO: 636461 - RNA, 19 nt, Homo sapiens
gaacgugucaagucgcuaa

SEQ ID NO: 636462 - RNA, 19 nt, Homo sapiens
uaucauaucuguucucaac

SEQ ID NO: 636463 - RNA, 19 nt, Homo sapiens
uaaggcaggucugucauuu

SEQ ID NO: 636464 - RNA, 19 nt, Homo sapiens
gcaaauuguccacuuaaug

SEQ ID NO: 636465 - RNA, 19 nt, Homo sapiens
aaacaucugccuacgauaa

SEQ ID NO: 636466 - RNA, 19 nt, Homo sapiens
ggagaagucugugaaugau

SEQ ID NO: 636467 - RNA, 19 nt, Homo sapiens
agucgaaccuuauguuuga

SEQ ID NO: 636468 - RNA, 19 nt, Homo sapiens
guaucucacuguaccuaua

SEQ ID NO: 636469 - RNA, 19 nt, Homo sapiens
ggaagaaaccugguccauu

SEQ ID NO: 636470 - RNA, 19 nt, Homo sapiens
ccaaggaagcaauauuuaa

SEQ ID NO: 636471 - RNA, 19 nt, Homo sapiens
caacacagcuaaaauggaa

SEQ ID NO: 636472 - RNA, 19 nt, Homo sapiens
ggagaaaugugugccuuca

SEQ ID NO: 636473 - RNA, 19 nt, Homo sapiens
gcuaauaacaggagucgaa

SEQ ID NO: 636474 - RNA, 19 nt, Homo sapiens
ggcccucccuucaucuuua

SEQ ID NO: 636475 - RNA, 19 nt, Homo sapiens
gcucgaagaaggucuguaa

SEQ ID NO: 636476 - RNA, 19 nt, Homo sapiens
ucucagaaguucguguuua

SEQ ID NO: 636477 - RNA, 19 nt, Homo sapiens
ggaccgcucucuucuugau

SEQ ID NO: 636478 - RNA, 19 nt, Homo sapiens
gaugauccauguccaguag

SEQ ID NO: 636479 - RNA, 19 nt, Homo sapiens
gaaauucuaguugaggaua

SEQ ID NO: 636480 - RNA, 19 nt, Homo sapiens
cagcagagccgauccaaga

SEQ ID NO: 636481 - RNA, 19 nt, Homo sapiens
ccauaggucuugcuuuguu

SEQ ID NO: 636482 - RNA, 19 nt, Homo sapiens
ccaagggcgugcagcagua

SEQ ID NO: 636483 - RNA, 19 nt, Homo sapiens
ggacuugguuccucuuguc

SEQ ID NO: 636484 - RNA, 19 nt, Homo sapiens
ucaacgagaucaccaagca

SEQ ID NO: 636485 - RNA, 19 nt, Homo sapiens
gcacagcuacuaccugaag

SEQ ID NO: 636486 - RNA, 19 nt, Homo sapiens
gaacugaggggcaaucuga

SEQ ID NO: 636487 - RNA, 19 nt, Homo sapiens
ggaggccucugcugccaau

SEQ ID NO: 636488 - RNA, 19 nt, Homo sapiens
gcaagcacgagcaguguga

SEQ ID NO: 636489 - RNA, 19 nt, Homo sapiens
guacuuuggcugcuacuuc

SEQ ID NO: 636490 - RNA, 19 nt, Homo sapiens
gcuacugggugacguuucu

SEQ ID NO: 636491 - RNA, 19 nt, Homo sapiens
cauaggucuugcuuuguug

SEQ ID NO: 636492 - RNA, 19 nt, Homo sapiens
ccaaugggucggacaacaa

SEQ ID NO: 636493 - RNA, 19 nt, Homo sapiens
gguguccucuuccaucuac

SEQ ID NO: 636494 - RNA, 19 nt, Homo sapiens
ggugguacuuuggcugcua

SEQ ID NO: 636495 - RNA, 19 nt, Homo sapiens
gccggugucugcuguucuu

SEQ ID NO: 636496 - RNA, 19 nt, Homo sapiens
gccaaugggucggacaaca

SEQ ID NO: 636497 - RNA, 19 nt, Homo sapiens
ucaaccaguucuccaccuu

SEQ ID NO: 636498 - RNA, 19 nt, Homo sapiens
ccugccagcuggugacaug

SEQ ID NO: 636499 - RNA, 19 nt, Homo sapiens
aauccauccuggccaaguu

SEQ ID NO: 636500 - RNA, 19 nt, Homo sapiens
ccaguucuccaccuucuuc

SEQ ID NO: 636501 - RNA, 19 nt, Homo sapiens
ccgagucccuguauucacu

SEQ ID NO: 636502 - RNA, 19 nt, Homo sapiens
gccuggcccucugggauuu

SEQ ID NO: 636503 - RNA, 19 nt, Homo sapiens
cccauccucuucacaguca

SEQ ID NO: 636504 - RNA, 19 nt, Homo sapiens
ggugaugaccuaccagaac

SEQ ID NO: 636505 - RNA, 19 nt, Homo sapiens
ggcagaggcuacagaucca

SEQ ID NO: 636506 - RNA, 19 nt, Homo sapiens
ccccauaggucuugcuuug

SEQ ID NO: 636507 - RNA, 19 nt, Homo sapiens
ccacaagcccagggaguca

SEQ ID NO: 636508 - RNA, 19 nt, Homo sapiens
cgcauguggugguacuuug

SEQ ID NO: 636509 - RNA, 19 nt, Homo sapiens
acccuggacucaugcauca

SEQ ID NO: 636510 - RNA, 19 nt, Homo sapiens
ccucacagcugaaacuuua

SEQ ID NO: 636511 - RNA, 19 nt, Homo sapiens
gaacaucugaggaaacuaa

SEQ ID NO: 636512 - RNA, 19 nt, Homo sapiens
ggagacagguggaaaccaa

SEQ ID NO: 636513 - RNA, 19 nt, Homo sapiens
ugaaagaaauacacaccua

SEQ ID NO: 636514 - RNA, 19 nt, Homo sapiens
caaagaacaucugaggaaa

SEQ ID NO: 636515 - RNA, 19 nt, Homo sapiens
ggaaauuggauaugaaaga

SEQ ID NO: 636516 - RNA, 19 nt, Homo sapiens
ucaagaaacuaaggaagaa

SEQ ID NO: 636517 - RNA, 19 nt, Homo sapiens
gcagaggacuacuacagau

SEQ ID NO: 636518 - RNA, 19 nt, Homo sapiens
ccaaagaacaucugaggaa

SEQ ID NO: 636519 - RNA, 19 nt, Homo sapiens
ggaugauaaucucaagaaa

SEQ ID NO: 636520 - RNA, 19 nt, Homo sapiens
gaggaagaccgccaaagaa

SEQ ID NO: 636521 - RNA, 19 nt, Homo sapiens
agaugaaggugacaacaaa

SEQ ID NO: 636522 - RNA, 19 nt, Homo sapiens
gaaacuaagcaugaaagaa

SEQ ID NO: 636523 - RNA, 19 nt, Homo sapiens
aaaccaaaguucgagcuaa

SEQ ID NO: 636524 - RNA, 19 nt, Homo sapiens
caacucaacaacauucuau

SEQ ID NO: 636525 - RNA, 19 nt, Homo sapiens
gaagaccgccaaagaacau

SEQ ID NO: 636526 - RNA, 19 nt, Homo sapiens
gaaaccaaaguucgagcua

SEQ ID NO: 636527 - RNA, 19 nt, Homo sapiens
auacacaccuacauggaaa

SEQ ID NO: 636528 - RNA, 19 nt, Homo sapiens
gcuaaaauccguaagauga

SEQ ID NO: 636529 - RNA, 19 nt, Homo sapiens
aaccaaaguucgagcuaaa

SEQ ID NO: 636530 - RNA, 19 nt, Homo sapiens
ggacuacuacagaugcaaa

SEQ ID NO: 636531 - RNA, 19 nt, Homo sapiens
aaacuaagcaugaaagaac

SEQ ID NO: 636532 - RNA, 19 nt, Homo sapiens
ugaggaaacuaagcaugaa

SEQ ID NO: 636533 - RNA, 19 nt, Homo sapiens
gcacucugcuuggguuauc

SEQ ID NO: 636534 - RNA, 19 nt, Homo sapiens
ggaaacuaagcaugaaaga

SEQ ID NO: 636535 - RNA, 19 nt, Homo sapiens
ggaagaccgccaaagaaca

SEQ ID NO: 636536 - RNA, 19 nt, Homo sapiens
ugguggaaguccuugguua

SEQ ID NO: 636537 - RNA, 19 nt, Homo sapiens
ggaugauaaucucaagaca

SEQ ID NO: 636538 - RNA, 19 nt, Homo sapiens
ggaugauaaucucaagaca

SEQ ID NO: 636539 - RNA, 19 nt, Homo sapiens
agaggaagaccgccaaaga

SEQ ID NO: 636540 - RNA, 19 nt, Homo sapiens
agaaauacacaccuacaug

SEQ ID NO: 636541 - RNA, 19 nt, Homo sapiens
agacaucuuuacuuuaugg

SEQ ID NO: 636542 - RNA, 19 nt, Homo sapiens
gggacugacuuugguggaa

SEQ ID NO: 636543 - RNA, 19 nt, Homo sapiens
gaggaaacuaagcaugaaa

SEQ ID NO: 636544 - RNA, 19 nt, Homo sapiens
guagacaggaaggaauuaa

SEQ ID NO: 636545 - RNA, 19 nt, Homo sapiens
gaugauaaucucaagaaac

SEQ ID NO: 636546 - RNA, 19 nt, Homo sapiens
cugcuuggguuaucaauac

SEQ ID NO: 636547 - RNA, 19 nt, Homo sapiens
ucacagcugaaacuuuaaa

SEQ ID NO: 636548 - RNA, 19 nt, Homo sapiens
ggcagaggacuacuacaga

SEQ ID NO: 636549 - RNA, 19 nt, Homo sapiens
aagaacaucugaggaaacu

SEQ ID NO: 636550 - RNA, 19 nt, Homo sapiens
guuauaaauuugccaucuc

SEQ ID NO: 636551 - RNA, 19 nt, Homo sapiens
gggcagaggacuacuacag

SEQ ID NO: 636552 - RNA, 19 nt, Homo sapiens
cugaggaaacuaagcauga

SEQ ID NO: 636553 - RNA, 19 nt, Homo sapiens
gagcuaaaauccguaagau

SEQ ID NO: 636554 - RNA, 19 nt, Homo sapiens
gcugagcggaggcuguaaa

SEQ ID NO: 636555 - RNA, 19 nt, Homo sapiens
gguuacuuaucauuacugu

SEQ ID NO: 636556 - RNA, 19 nt, Homo sapiens
uaucauuacuguguuucug

SEQ ID NO: 636557 - RNA, 19 nt, Homo sapiens
ccaacucaacaacauucua

SEQ ID NO: 636558 - RNA, 19 nt, Homo sapiens
aaagaaauacacaccuaca

SEQ ID NO: 636559 - RNA, 19 nt, Homo sapiens
gaggacuacuacagaugca

SEQ ID NO: 636560 - RNA, 19 nt, Homo sapiens
gagacagguggaaaccaaa

SEQ ID NO: 636561 - RNA, 19 nt, Homo sapiens
uagacaggaaggaauuaaa

SEQ ID NO: 636562 - RNA, 19 nt, Homo sapiens
cggagugucugcucuaucc

SEQ ID NO: 636563 - RNA, 19 nt, Homo sapiens
gguggaaaccaaaguucga

SEQ ID NO: 636564 - RNA, 19 nt, Homo sapiens
cucaagaaacuaaggaaga

SEQ ID NO: 636565 - RNA, 19 nt, Homo sapiens
aguccuugguuacuuauca

SEQ ID NO: 636566 - RNA, 19 nt, Homo sapiens
ccuugguuacuuaucauua

SEQ ID NO: 636567 - RNA, 19 nt, Homo sapiens
aauacacaccuacauggaa

SEQ ID NO: 636568 - RNA, 19 nt, Homo sapiens
aaauacacaccuacaugga

SEQ ID NO: 636569 - RNA, 19 nt, Homo sapiens
ggugucagaggcagaggaa

SEQ ID NO: 636570 - RNA, 19 nt, Homo sapiens
caucugaggaaacuaagca

SEQ ID NO: 636571 - RNA, 19 nt, Homo sapiens
aagaugaaggugacaacaa

SEQ ID NO: 636572 - RNA, 19 nt, Homo sapiens
ccucagcggaugauaaucu

SEQ ID NO: 636573 - RNA, 19 nt, Homo sapiens
ccucagcggaugauaaucu

SEQ ID NO: 636574 - RNA, 19 nt, Homo sapiens
ccucagcggaugauaaucu

SEQ ID NO: 636575 - RNA, 19 nt, Homo sapiens
ccagccaccuccuccaacu

SEQ ID NO: 636576 - RNA, 19 nt, Homo sapiens
cguagacaggaaggaauua

SEQ ID NO: 636577 - RNA, 19 nt, Homo sapiens
gaacuucucuacuccugua

SEQ ID NO: 636578 - RNA, 19 nt, Homo sapiens
gcagagcacugaaguacau

SEQ ID NO: 636579 - RNA, 19 nt, Homo sapiens
ugacaugguuuggcuauuu

SEQ ID NO: 636580 - RNA, 19 nt, Homo sapiens
guggagaacugcugguauu

SEQ ID NO: 636581 - RNA, 19 nt, Homo sapiens
gcucauguuuccauaauac

SEQ ID NO: 636582 - RNA, 19 nt, Homo sapiens
ugcuauauguuacccauua

SEQ ID NO: 636583 - RNA, 19 nt, Homo sapiens
uauguugguuuccuuguuu

SEQ ID NO: 636584 - RNA, 19 nt, Homo sapiens
aaagauugcuacuucuaug

SEQ ID NO: 636585 - RNA, 19 nt, Homo sapiens
aucaauaacuugcgagaaa

SEQ ID NO: 636586 - RNA, 19 nt, Homo sapiens
ggaauagugauaggaguuu

SEQ ID NO: 636587 - RNA, 19 nt, Homo sapiens
gggaccaccuuguuuaugg

SEQ ID NO: 636588 - RNA, 19 nt, Homo sapiens
ucagaucgguggagaacug

SEQ ID NO: 636589 - RNA, 19 nt, Homo sapiens
cagcucauguuuccauaau

SEQ ID NO: 636590 - RNA, 19 nt, Homo sapiens
gauucaccaucaugccaua

SEQ ID NO: 636591 - RNA, 19 nt, Homo sapiens
gccaugauaauuuccauuu

SEQ ID NO: 636592 - RNA, 19 nt, Homo sapiens
cacaauauuuggcaaucuu

SEQ ID NO: 636593 - RNA, 19 nt, Homo sapiens
guaauccguuaauauaugg

SEQ ID NO: 636594 - RNA, 19 nt, Homo sapiens
ugccaaaacuuuaggaaua

SEQ ID NO: 636595 - RNA, 19 nt, Homo sapiens
gagaacugcugguauuuug

SEQ ID NO: 636596 - RNA, 19 nt, Homo sapiens
gauugcuacuucuauguug

SEQ ID NO: 636597 - RNA, 19 nt, Homo sapiens
ggauccauauucaucacaa

SEQ ID NO: 636598 - RNA, 19 nt, Homo sapiens
cacauguaauccguuaaua

SEQ ID NO: 636599 - RNA, 19 nt, Homo sapiens
agagggcuaugacaucuug

SEQ ID NO: 636600 - RNA, 19 nt, Homo sapiens
gucggucccuggagcauuu

SEQ ID NO: 636601 - RNA, 19 nt, Homo sapiens
ggccuaugcagauggaaua

SEQ ID NO: 636602 - RNA, 19 nt, Homo sapiens
ccacauguaauccguuaau

SEQ ID NO: 636603 - RNA, 19 nt, Homo sapiens
caguggccauugauagauu

SEQ ID NO: 636604 - RNA, 19 nt, Homo sapiens
gggcuuacauuuugcaaga

SEQ ID NO: 636605 - RNA, 19 nt, Homo sapiens
gcaggauccauauucauca

SEQ ID NO: 636606 - RNA, 19 nt, Homo sapiens
cuccacauguaauccguua

SEQ ID NO: 636607 - RNA, 19 nt, Homo sapiens
gauccauauucaucacaau

SEQ ID NO: 636608 - RNA, 19 nt, Homo sapiens
uaugacaucuugguugcuu

SEQ ID NO: 636609 - RNA, 19 nt, Homo sapiens
ccaugauaauuuccauuuc

SEQ ID NO: 636610 - RNA, 19 nt, Homo sapiens
gcucaugccaucaauaacu

SEQ ID NO: 636611 - RNA, 19 nt, Homo sapiens
uuucuucuaucccugguuu

SEQ ID NO: 636612 - RNA, 19 nt, Homo sapiens
ucagaggccuaugcagaug

SEQ ID NO: 636613 - RNA, 19 nt, Homo sapiens
gcucaguggccauugauag

SEQ ID NO: 636614 - RNA, 19 nt, Homo sapiens
ucaccaucaugccauauag

SEQ ID NO: 636615 - RNA, 19 nt, Homo sapiens
ucacacaccaaccaacuuc

SEQ ID NO: 636616 - RNA, 19 nt, Homo sapiens
gacaugguuuggcuauuuu

SEQ ID NO: 636617 - RNA, 19 nt, Homo sapiens
caugauaauuuccauuucc

SEQ ID NO: 636618 - RNA, 19 nt, Homo sapiens
ucaagugaagaaagacaaa

SEQ ID NO: 636619 - RNA, 19 nt, Homo sapiens
ggcaggauccauauucauc

SEQ ID NO: 636620 - RNA, 19 nt, Homo sapiens
gcacugaaguacauuuugc

SEQ ID NO: 636621 - RNA, 19 nt, Homo sapiens
gaauagugauaggaguuuu

SEQ ID NO: 636622 - RNA, 19 nt, Homo sapiens
guuuauggcagguuucuuc

SEQ ID NO: 636623 - RNA, 19 nt, Homo sapiens
gcuauauguuacccauuac

SEQ ID NO: 636624 - RNA, 19 nt, Homo sapiens
cugauuuccuccugggauu

SEQ ID NO: 636625 - RNA, 19 nt, Homo sapiens
uuauguugguuuccuuguu

SEQ ID NO: 636626 - RNA, 19 nt, Homo sapiens
ucacaauauuuggcaaucu

SEQ ID NO: 636627 - RNA, 19 nt, Homo sapiens
uauggcagguuucuucacu

SEQ ID NO: 636628 - RNA, 19 nt, Homo sapiens
ggagaacugcugguauuuu

SEQ ID NO: 636629 - RNA, 19 nt, Homo sapiens
ucaauaacuugcgagaaaa

SEQ ID NO: 636630 - RNA, 19 nt, Homo sapiens
cucaugccaucaauaacuu

SEQ ID NO: 636631 - RNA, 19 nt, Homo sapiens
uccaguuccugcccaguga

SEQ ID NO: 636632 - RNA, 19 nt, Homo sapiens
caaucuugccaugauaauu

SEQ ID NO: 636633 - RNA, 19 nt, Homo sapiens
caaccaacuuccucauccu

SEQ ID NO: 636634 - RNA, 19 nt, Homo sapiens
cuccugggauucaccauca

SEQ ID NO: 636635 - RNA, 19 nt, Homo sapiens
augcucaugccaucaauaa

SEQ ID NO: 636636 - RNA, 19 nt, Homo sapiens
gggcuaugacaucuugguu

SEQ ID NO: 636637 - RNA, 19 nt, Homo sapiens
cuuagcauaacauccauuu

SEQ ID NO: 636638 - RNA, 19 nt, Homo sapiens
uauaugguuucuucuaucc

SEQ ID NO: 636639 - RNA, 19 nt, Homo sapiens
gguggagaacugcugguau

SEQ ID NO: 636640 - RNA, 19 nt, Homo sapiens
guagauugcuggccuguug

SEQ ID NO: 636641 - RNA, 19 nt, Homo sapiens
gauuacaucuucucuaugg

SEQ ID NO: 636642 - RNA, 19 nt, Homo sapiens
gaaugugacucugcaaugu

SEQ ID NO: 636643 - RNA, 19 nt, Homo sapiens
gaaacugaccucugugaga

SEQ ID NO: 636644 - RNA, 19 nt, Homo sapiens
caucugggccuuuguauga

SEQ ID NO: 636645 - RNA, 19 nt, Homo sapiens
caacgaccauggagagaug

SEQ ID NO: 636646 - RNA, 19 nt, Homo sapiens
guacagaacaccaaaguag

SEQ ID NO: 636647 - RNA, 19 nt, Homo sapiens
gauuacagguggugacuuc

SEQ ID NO: 636648 - RNA, 19 nt, Homo sapiens
agaagagaaucaagaagaa

SEQ ID NO: 636649 - RNA, 19 nt, Homo sapiens
agaaguacauguucauugu

SEQ ID NO: 636650 - RNA, 19 nt, Homo sapiens
gaucuuggcucaucguaac

SEQ ID NO: 636651 - RNA, 19 nt, Homo sapiens
ggacagggagccaucauuc

SEQ ID NO: 636652 - RNA, 19 nt, Homo sapiens
ggagagaaacccaaacauc

SEQ ID NO: 636653 - RNA, 19 nt, Homo sapiens
agagcgagaucauggagua

SEQ ID NO: 636654 - RNA, 19 nt, Homo sapiens
gaagagaaucaagaagaaa

SEQ ID NO: 636655 - RNA, 19 nt, Homo sapiens
gcagcucgccuaccucuga

SEQ ID NO: 636656 - RNA, 19 nt, Homo sapiens
gggcugggcuuuugaauug

SEQ ID NO: 636657 - RNA, 19 nt, Homo sapiens
gcaaccacuugaccuacuu

SEQ ID NO: 636658 - RNA, 19 nt, Homo sapiens
aaacugaccucugugagau

SEQ ID NO: 636659 - RNA, 19 nt, Homo sapiens
ggagugcaguggugugauc

SEQ ID NO: 636660 - RNA, 19 nt, Homo sapiens
ggacaugugcgagcucaaa

SEQ ID NO: 636661 - RNA, 19 nt, Homo sapiens
aaaaucagcuguuguaauc

SEQ ID NO: 636662 - RNA, 19 nt, Homo sapiens
uagaagagaaucaagaaga

SEQ ID NO: 636663 - RNA, 19 nt, Homo sapiens
gaauuuggaaacuguagaa

SEQ ID NO: 636664 - RNA, 19 nt, Homo sapiens
ggagucagcguucaaucuu

SEQ ID NO: 636665 - RNA, 19 nt, Homo sapiens
gguuaauucuguccaacaa

SEQ ID NO: 636666 - RNA, 19 nt, Homo sapiens
ccaucaaggugcacaugaa

SEQ ID NO: 636667 - RNA, 19 nt, Homo sapiens
uagagaauuuggaaacugu

SEQ ID NO: 636668 - RNA, 19 nt, Homo sapiens
guagagaauuuggaaacug

SEQ ID NO: 636669 - RNA, 19 nt, Homo sapiens
ggugucugcuguaaauguu

SEQ ID NO: 636670 - RNA, 19 nt, Homo sapiens
gagcagccuccacuacaaa

SEQ ID NO: 636671 - RNA, 19 nt, Homo sapiens
ccuggugucugcuguaaau

SEQ ID NO: 636672 - RNA, 19 nt, Homo sapiens
agucgaaacugaccucugu

SEQ ID NO: 636673 - RNA, 19 nt, Homo sapiens
ccgacaugcugggagauua

SEQ ID NO: 636674 - RNA, 19 nt, Homo sapiens
gguggugacuuccaagagu

SEQ ID NO: 636675 - RNA, 19 nt, Homo sapiens
ggugugaucuuggcucauc

SEQ ID NO: 636676 - RNA, 19 nt, Homo sapiens
gaggccuggucucuccuua

SEQ ID NO: 636677 - RNA, 19 nt, Homo sapiens
ccgaguagcugggauuaca

SEQ ID NO: 636678 - RNA, 19 nt, Homo sapiens
gagucagcguucaaucuug

SEQ ID NO: 636679 - RNA, 19 nt, Homo sapiens
cauucagucugguauguga

SEQ ID NO: 636680 - RNA, 19 nt, Homo sapiens
gccugacacucuccuaaga

SEQ ID NO: 636681 - RNA, 19 nt, Homo sapiens
caucaucaccuccuuccaa

SEQ ID NO: 636682 - RNA, 19 nt, Homo sapiens
gagaaggucuuggggauug

SEQ ID NO: 636683 - RNA, 19 nt, Homo sapiens
cuaugucccuggcuaccua

SEQ ID NO: 636684 - RNA, 19 nt, Homo sapiens
ggcaagaacuguggaccau

SEQ ID NO: 636685 - RNA, 19 nt, Homo sapiens
gugcaguggugugaucuug

SEQ ID NO: 636686 - RNA, 19 nt, Homo sapiens
ucaccugccuuuccuggau

SEQ ID NO: 636687 - RNA, 19 nt, Homo sapiens
uggaaacuguagaagagaa

SEQ ID NO: 636688 - RNA, 19 nt, Homo sapiens
gaagaugggaaggauguuc

SEQ ID NO: 636689 - RNA, 19 nt, Homo sapiens
ccucuagccuccucugcuu

SEQ ID NO: 636690 - RNA, 19 nt, Homo sapiens
aaacacacacggguagauu

SEQ ID NO: 636691 - RNA, 19 nt, Homo sapiens
cauguucauuguagagaau

SEQ ID NO: 636692 - RNA, 19 nt, Homo sapiens
gguacagaacaccaaagua

SEQ ID NO: 636693 - RNA, 19 nt, Homo sapiens
ugguggauguggacaacua

SEQ ID NO: 636694 - RNA, 19 nt, Homo sapiens
ccacuugaccuacuuugca

SEQ ID NO: 636695 - RNA, 19 nt, Homo sapiens
ccaauucuuuugucuuuug

SEQ ID NO: 636696 - RNA, 19 nt, Homo sapiens
caucuuggcugugcauagg

SEQ ID NO: 636697 - RNA, 19 nt, Homo sapiens
ccucgggacuacaccauca

SEQ ID NO: 636698 - RNA, 19 nt, Homo sapiens
ggaaacuguagaagagaau

SEQ ID NO: 636699 - RNA, 19 nt, Homo sapiens
agaaauguggcuccaguug

SEQ ID NO: 636700 - RNA, 19 nt, Homo sapiens
uuaauucuguccaacaaac

SEQ ID NO: 636701 - RNA, 19 nt, Homo sapiens
uguagaagagaaucaagaa

SEQ ID NO: 636702 - RNA, 19 nt, Homo sapiens
uuuggaaacuguagaagag

SEQ ID NO: 636703 - RNA, 19 nt, Homo sapiens
caacauucagucugguaug

SEQ ID NO: 636704 - RNA, 19 nt, Homo sapiens
uguaaauguuugucuacug

SEQ ID NO: 636705 - RNA, 19 nt, Homo sapiens
gccaggccuuggaucuuga

SEQ ID NO: 636706 - RNA, 19 nt, Homo sapiens
aagaaguacauguucauug

SEQ ID NO: 636707 - RNA, 19 nt, Homo sapiens
gaugggaaggauguucuuu

SEQ ID NO: 636708 - RNA, 19 nt, Homo sapiens
ggccugccuugucaccauu

SEQ ID NO: 636709 - RNA, 19 nt, Homo sapiens
gagaccgucaggagagaaa

SEQ ID NO: 636710 - RNA, 19 nt, Homo sapiens
gaccuccucuggugacacu

SEQ ID NO: 636711 - RNA, 19 nt, Homo sapiens
ugucugcuguaaauguuug

SEQ ID NO: 636712 - RNA, 19 nt, Homo sapiens
aaauguggcuccaguugcu

SEQ ID NO: 636713 - RNA, 19 nt, Homo sapiens
gaagaaugugacucugcaa

SEQ ID NO: 636714 - RNA, 19 nt, Homo sapiens
ugcagagccuggagucgaa

SEQ ID NO: 636715 - RNA, 19 nt, Homo sapiens
caugguuaauucuguccaa

SEQ ID NO: 636716 - RNA, 19 nt, Homo sapiens
uuccaaggcuuccucaucu

SEQ ID NO: 636717 - RNA, 19 nt, Homo sapiens
ucaccaaccugggccucuu

SEQ ID NO: 636718 - RNA, 19 nt, Homo sapiens
guggagcccucagaacauc

SEQ ID NO: 636719 - RNA, 19 nt, Homo sapiens
gcaggagucagcguucaau

SEQ ID NO: 636720 - RNA, 19 nt, Homo sapiens
ccaaggcuuccucaucuuc

SEQ ID NO: 636721 - RNA, 19 nt, Homo sapiens
gucccuggcuaccuacuca

SEQ ID NO: 636722 - RNA, 19 nt, Homo sapiens
caggagagaaacccaaaca

SEQ ID NO: 636723 - RNA, 19 nt, Homo sapiens
gggacagggagccaucauu

SEQ ID NO: 636724 - RNA, 19 nt, Homo sapiens
gccaacauucagucuggua

SEQ ID NO: 636725 - RNA, 19 nt, Homo sapiens
ugccucagccucccgagua

SEQ ID NO: 636726 - RNA, 19 nt, Homo sapiens
cagcggaaccagacacaca

SEQ ID NO: 636727 - RNA, 19 nt, Homo sapiens
caaccacuugaccuacuuu

SEQ ID NO: 636728 - RNA, 19 nt, Homo sapiens
agaaugugacucugcaaug

SEQ ID NO: 636729 - RNA, 19 nt, Homo sapiens
cagcuacagccgaagaaug

SEQ ID NO: 636730 - RNA, 19 nt, Homo sapiens
gcgagaucauggaguacuc

SEQ ID NO: 636731 - RNA, 19 nt, Homo sapiens
gagaauuuggaaacuguag

SEQ ID NO: 636732 - RNA, 19 nt, Homo sapiens
acauguucauuguagagaa

SEQ ID NO: 636733 - RNA, 19 nt, Homo sapiens
ugggaauccuggaagacuu

SEQ ID NO: 636734 - RNA, 19 nt, Homo sapiens
gggccacagggaagacuuu

SEQ ID NO: 636735 - RNA, 19 nt, Homo sapiens
ggaaaccucgggacuacac

SEQ ID NO: 636736 - RNA, 19 nt, Homo sapiens
gugagaccgucaggagaga

SEQ ID NO: 636737 - RNA, 19 nt, Homo sapiens
cuacagccgaagaauguga

SEQ ID NO: 636738 - RNA, 19 nt, Homo sapiens
ggugguagggacacagaug

SEQ ID NO: 636739 - RNA, 19 nt, Homo sapiens
caccagaccugcgcaucuc

SEQ ID NO: 636740 - RNA, 19 nt, Homo sapiens
gagaaacagcuuuaucgua

SEQ ID NO: 636741 - RNA, 19 nt, Homo sapiens
gaaacagcuuuaucguaga

SEQ ID NO: 636742 - RNA, 19 nt, Homo sapiens
gaacagguggcccgauuau

SEQ ID NO: 636743 - RNA, 19 nt, Homo sapiens
gagcaucagcuucuucuug

SEQ ID NO: 636744 - RNA, 19 nt, Homo sapiens
caacaugucugaugauacc

SEQ ID NO: 636745 - RNA, 19 nt, Homo sapiens
cacaacaugucugaugaua

SEQ ID NO: 636746 - RNA, 19 nt, Homo sapiens
ucaaagaauuccgcaugaa

SEQ ID NO: 636747 - RNA, 19 nt, Homo sapiens
cagaaagccugcaucuaca

SEQ ID NO: 636748 - RNA, 19 nt, Homo sapiens
gcaucccuaucuacaguuu

SEQ ID NO: 636749 - RNA, 19 nt, Homo sapiens
ggaagcaucccuaucuaca

SEQ ID NO: 636750 - RNA, 19 nt, Homo sapiens
aagaacagguggcccgauu

SEQ ID NO: 636751 - RNA, 19 nt, Homo sapiens
gaucaaccuggcagucuuu

SEQ ID NO: 636752 - RNA, 19 nt, Homo sapiens
gaauuccgcaugaacauca

SEQ ID NO: 636753 - RNA, 19 nt, Homo sapiens
gcuacuacuuugucaucaa

SEQ ID NO: 636754 - RNA, 19 nt, Homo sapiens
gcaccuuccuuaagaacag

SEQ ID NO: 636755 - RNA, 19 nt, Homo sapiens
ccggaagcaucccuaucua

SEQ ID NO: 636756 - RNA, 19 nt, Homo sapiens
ggaucugcaugcacaaucu

SEQ ID NO: 636757 - RNA, 19 nt, Homo sapiens
aaacagcuuuaucguagag

SEQ ID NO: 636758 - RNA, 19 nt, Homo sapiens
ccauguguuucuccaaugu

SEQ ID NO: 636759 - RNA, 19 nt, Homo sapiens
gcaauuguccauguguuuc

SEQ ID NO: 636760 - RNA, 19 nt, Homo sapiens
aagcaucccuaucuacagu

SEQ ID NO: 636761 - RNA, 19 nt, Homo sapiens
ccaccuccaucuacaugau

SEQ ID NO: 636762 - RNA, 19 nt, Homo sapiens
guccauguguuucuccaau

SEQ ID NO: 636763 - RNA, 19 nt, Homo sapiens
caaagaauuccgcaugaac

SEQ ID NO: 636764 - RNA, 19 nt, Homo sapiens
uccacaacaugucugauga

SEQ ID NO: 636765 - RNA, 19 nt, Homo sapiens
ucagcaccuuccuuaagaa

SEQ ID NO: 636766 - RNA, 19 nt, Homo sapiens
ggcuucagcaccuuccuua

SEQ ID NO: 636767 - RNA, 19 nt, Homo sapiens
ggacugggugcagcagaaa

SEQ ID NO: 636768 - RNA, 19 nt, Homo sapiens
ucaacgagcugaugaaaac

SEQ ID NO: 636769 - RNA, 19 nt, Homo sapiens
cagcauggaccgguucuug

SEQ ID NO: 636770 - RNA, 19 nt, Homo sapiens
uucagcaccuuccuuaaga

SEQ ID NO: 636771 - RNA, 19 nt, Homo sapiens
gcagagcaucagcuucuuc

SEQ ID NO: 636772 - RNA, 19 nt, Homo sapiens
aaagaauuccgcaugaaca

SEQ ID NO: 636773 - RNA, 19 nt, Homo sapiens
ggugagaaacagcuuuauc

SEQ ID NO: 636774 - RNA, 19 nt, Homo sapiens
ugaucaaccuggcagucuu

SEQ ID NO: 636775 - RNA, 19 nt, Homo sapiens
caacugcugccuggauguu

SEQ ID NO: 636776 - RNA, 19 nt, Homo sapiens
agaacagguggcccgauua

SEQ ID NO: 636777 - RNA, 19 nt, Homo sapiens
ugcaguuccuggugagaaa

SEQ ID NO: 636778 - RNA, 19 nt, Homo sapiens
aucaaagaauuccgcauga

SEQ ID NO: 636779 - RNA, 19 nt, Homo sapiens
gugagaaacagcuuuaucg

SEQ ID NO: 636780 - RNA, 19 nt, Homo sapiens
ggaccggaagcaucccuau

SEQ ID NO: 636781 - RNA, 19 nt, Homo sapiens
gcugccaccuccaucuaca

SEQ ID NO: 636782 - RNA, 19 nt, Homo sapiens
ggugucaacgagcugauga

SEQ ID NO: 636783 - RNA, 19 nt, Homo sapiens
gaagcaucccuaucuacag

SEQ ID NO: 636784 - RNA, 19 nt, Homo sapiens
caucagcuucuucuugcaa

SEQ ID NO: 636785 - RNA, 19 nt, Homo sapiens
gguggagugccuuuacuuc

SEQ ID NO: 636786 - RNA, 19 nt, Homo sapiens
ucagcuucuucuugcaauu

SEQ ID NO: 636787 - RNA, 19 nt, Homo sapiens
acagguggcccgauuaugc

SEQ ID NO: 636788 - RNA, 19 nt, Homo sapiens
cagcuucuucuugcaauug

SEQ ID NO: 636789 - RNA, 19 nt, Homo sapiens
gcagagccaagcagagcau

SEQ ID NO: 636790 - RNA, 19 nt, Homo sapiens
cuggugagaaacagcuuua

SEQ ID NO: 636791 - RNA, 19 nt, Homo sapiens
ccacaacaugucugaugau

SEQ ID NO: 636792 - RNA, 19 nt, Homo sapiens
gcaauaaccaagccucuuu

SEQ ID NO: 636793 - RNA, 19 nt, Homo sapiens
gaucuacuccugccuaauu

SEQ ID NO: 636794 - RNA, 19 nt, Homo sapiens
ggaaacgggcuaauucuug

SEQ ID NO: 636795 - RNA, 19 nt, Homo sapiens
ucauugugcuccacuguua

SEQ ID NO: 636796 - RNA, 19 nt, Homo sapiens
uaaccaagccucuuuccua

SEQ ID NO: 636797 - RNA, 19 nt, Homo sapiens
gcacaagaacccaaaccua

SEQ ID NO: 636798 - RNA, 19 nt, Homo sapiens
uugcugacauuucugauua

SEQ ID NO: 636799 - RNA, 19 nt, Homo sapiens
ccuugucgcuugagaauuu

SEQ ID NO: 636800 - RNA, 19 nt, Homo sapiens
gcaucaguguggaucguua

SEQ ID NO: 636801 - RNA, 19 nt, Homo sapiens
agagauaaaugaccgaaga

SEQ ID NO: 636802 - RNA, 19 nt, Homo sapiens
ggauauaucaucucaguuc

SEQ ID NO: 636803 - RNA, 19 nt, Homo sapiens
gcuaauucuugcuccauuu

SEQ ID NO: 636804 - RNA, 19 nt, Homo sapiens
gaagacuguuugagacaau

SEQ ID NO: 636805 - RNA, 19 nt, Homo sapiens
uaggauaaccaguguauuu

SEQ ID NO: 636806 - RNA, 19 nt, Homo sapiens
gaacaugagcaguggcauu

SEQ ID NO: 636807 - RNA, 19 nt, Homo sapiens
ccaagccucuuuccuacaa

SEQ ID NO: 636808 - RNA, 19 nt, Homo sapiens
ccaacucuguccuucuuaa

SEQ ID NO: 636809 - RNA, 19 nt, Homo sapiens
caaccuggcuugcaguaag

SEQ ID NO: 636810 - RNA, 19 nt, Homo sapiens
ggaucguuaucuugcaaua

SEQ ID NO: 636811 - RNA, 19 nt, Homo sapiens
gcuccacuguuacaucauu

SEQ ID NO: 636812 - RNA, 19 nt, Homo sapiens
gacagugguuauuguguug

SEQ ID NO: 636813 - RNA, 19 nt, Homo sapiens
gauggcauaugcugaucuu

SEQ ID NO: 636814 - RNA, 19 nt, Homo sapiens
ugacauuucugauuauugc

SEQ ID NO: 636815 - RNA, 19 nt, Homo sapiens
agacagugguuauuguguu

SEQ ID NO: 636816 - RNA, 19 nt, Homo sapiens
ggaagcacaagaacccaaa

SEQ ID NO: 636817 - RNA, 19 nt, Homo sapiens
guaugugugugaaggauca

SEQ ID NO: 636818 - RNA, 19 nt, Homo sapiens
gucaugagguagauucuuc

SEQ ID NO: 636819 - RNA, 19 nt, Homo sapiens
gaauggaggauccugaaca

SEQ ID NO: 636820 - RNA, 19 nt, Homo sapiens
gcugacauuucugauuauu

SEQ ID NO: 636821 - RNA, 19 nt, Homo sapiens
guagauucuuccagagaga

SEQ ID NO: 636822 - RNA, 19 nt, Homo sapiens
ggaggauccugaacaugag

SEQ ID NO: 636823 - RNA, 19 nt, Homo sapiens
ucauuaacuugccggguuu

SEQ ID NO: 636824 - RNA, 19 nt, Homo sapiens
gugcuccacuguuacauca

SEQ ID NO: 636825 - RNA, 19 nt, Homo sapiens
uggaggauccugaacauga

SEQ ID NO: 636826 - RNA, 19 nt, Homo sapiens
acaguuaucuuugccuuuc

SEQ ID NO: 636827 - RNA, 19 nt, Homo sapiens
ccacuguuacaucauuaua

SEQ ID NO: 636828 - RNA, 19 nt, Homo sapiens
cgaagacuguuugagacaa

SEQ ID NO: 636829 - RNA, 19 nt, Homo sapiens
gauauaucaucucaguucu

SEQ ID NO: 636830 - RNA, 19 nt, Homo sapiens
caagaacccaaaccuagga

SEQ ID NO: 636831 - RNA, 19 nt, Homo sapiens
acaccaaagagauaaauga

SEQ ID NO: 636832 - RNA, 19 nt, Homo sapiens
uuacuggcuuuauuguuug

SEQ ID NO: 636833 - RNA, 19 nt, Homo sapiens
cuaggaaacgggcuaauuc

SEQ ID NO: 636834 - RNA, 19 nt, Homo sapiens
uggcuuuauuguuugcuua

SEQ ID NO: 636835 - RNA, 19 nt, Homo sapiens
gcuauuucauucagacgau

SEQ ID NO: 636836 - RNA, 19 nt, Homo sapiens
caugagcaguggcauugug

SEQ ID NO: 636837 - RNA, 19 nt, Homo sapiens
ggauaaccaguguauuuua

SEQ ID NO: 636838 - RNA, 19 nt, Homo sapiens
ggcuaauucuugcuccauu

SEQ ID NO: 636839 - RNA, 19 nt, Homo sapiens
gcacaccaaagagauaaau

SEQ ID NO: 636840 - RNA, 19 nt, Homo sapiens
ucauucagacgauggcaua

SEQ ID NO: 636841 - RNA, 19 nt, Homo sapiens
gaacccaaaccuaggaaac

SEQ ID NO: 636842 - RNA, 19 nt, Homo sapiens
uggcuugcaguaaguaaua

SEQ ID NO: 636843 - RNA, 19 nt, Homo sapiens
ucagcacaccaaagagaua

SEQ ID NO: 636844 - RNA, 19 nt, Homo sapiens
gcucaccagugccuauuuu

SEQ ID NO: 636845 - RNA, 19 nt, Homo sapiens
gagcaguggcauugugaau

SEQ ID NO: 636846 - RNA, 19 nt, Homo sapiens
cgucacuccugcccacuug

SEQ ID NO: 636847 - RNA, 19 nt, Homo sapiens
uggcaugucuugcuugcau

SEQ ID NO: 636848 - RNA, 19 nt, Homo sapiens
uaucuuugccuuucauugu

SEQ ID NO: 636849 - RNA, 19 nt, Homo sapiens
gcuugagaauuugcauuau

SEQ ID NO: 636850 - RNA, 19 nt, Homo sapiens
caguguggaucguuaucuu

SEQ ID NO: 636851 - RNA, 19 nt, Homo sapiens
guccacgagucauuaacuu

SEQ ID NO: 636852 - RNA, 19 nt, Homo sapiens
ggaucaggaagcacaagaa

SEQ ID NO: 636853 - RNA, 19 nt, Homo sapiens
guuauuguguugcugacau

SEQ ID NO: 636854 - RNA, 19 nt, Homo sapiens
cgcuugagaauuugcauua

SEQ ID NO: 636855 - RNA, 19 nt, Homo sapiens
acuaccagcuauuucauuc

SEQ ID NO: 636856 - RNA, 19 nt, Homo sapiens
uaauauacagccucuccaa

SEQ ID NO: 636857 - RNA, 19 nt, Homo sapiens
acucuguccuucuuaacaa

SEQ ID NO: 636858 - RNA, 19 nt, Homo sapiens
agaaagcucccgggucuug

SEQ ID NO: 636859 - RNA, 19 nt, Homo sapiens
cagcacaccaaagagauaa

SEQ ID NO: 636860 - RNA, 19 nt, Homo sapiens
ucgagacagugguuauugu

SEQ ID NO: 636861 - RNA, 19 nt, Homo sapiens
guuagcugcuugguuccua

SEQ ID NO: 636862 - RNA, 19 nt, Homo sapiens
guggaucguuaucuugcaa

SEQ ID NO: 636863 - RNA, 19 nt, Homo sapiens
uuggauauaucaucucagu

SEQ ID NO: 636864 - RNA, 19 nt, Homo sapiens
uauacuaccagcuauuuca

SEQ ID NO: 636865 - RNA, 19 nt, Homo sapiens
gccgucagcacaccaaaga

SEQ ID NO: 636866 - RNA, 19 nt, Homo sapiens
ucaccuacuuccacauuuu

SEQ ID NO: 636867 - RNA, 19 nt, Homo sapiens
uggaucuacuccugccuaa

SEQ ID NO: 636868 - RNA, 19 nt, Homo sapiens
ccuaggaaacgggcuaauu

SEQ ID NO: 636869 - RNA, 19 nt, Homo sapiens
gcucccgggucuuggacaa

SEQ ID NO: 636870 - RNA, 19 nt, Homo sapiens
cgucagcacaccaaagaga

SEQ ID NO: 636871 - RNA, 19 nt, Homo sapiens
ucuauggcaugucuugcuu

SEQ ID NO: 636872 - RNA, 19 nt, Homo sapiens
aauggaggauccugaacau

SEQ ID NO: 636873 - RNA, 19 nt, Homo sapiens
gaaggaucaggaagcacaa

SEQ ID NO: 636874 - RNA, 19 nt, Homo sapiens
gacgauggcauaugcugau

SEQ ID NO: 636875 - RNA, 19 nt, Homo sapiens
ucauuauacuaccagcuau

SEQ ID NO: 636876 - RNA, 19 nt, Homo sapiens
gaucaggaagcacaagaac

SEQ ID NO: 636877 - RNA, 19 nt, Homo sapiens
gagcccgauucccuaguca

SEQ ID NO: 636878 - RNA, 19 nt, Homo sapiens
gagacagugguuauugugu

SEQ ID NO: 636879 - RNA, 19 nt, Homo sapiens
ggcauaugcugaucuuuuc

SEQ ID NO: 636880 - RNA, 19 nt, Homo sapiens
cuccacuguuacaucauua

SEQ ID NO: 636881 - RNA, 19 nt, Homo sapiens
uuauuguguugcugacauu

SEQ ID NO: 636882 - RNA, 19 nt, Homo sapiens
cgagacagugguuauugug

SEQ ID NO: 636883 - RNA, 19 nt, Homo sapiens
caauaaccaagccucuuuc

SEQ ID NO: 636884 - RNA, 19 nt, Homo sapiens
gguguccacgagucauuaa

SEQ ID NO: 636885 - RNA, 19 nt, Homo sapiens
cuaauucuugcuccauuug

SEQ ID NO: 636886 - RNA, 19 nt, Homo sapiens
ccaacaagguccaggaaca

SEQ ID NO: 636887 - RNA, 19 nt, Homo sapiens
uccaggaacacuauaauua

SEQ ID NO: 636888 - RNA, 19 nt, Homo sapiens
ccaggaacacuauaauuau

SEQ ID NO: 636889 - RNA, 19 nt, Homo sapiens
ccacuguccugccucucua

SEQ ID NO: 636890 - RNA, 19 nt, Homo sapiens
gugaccaucuucuccauca

SEQ ID NO: 636891 - RNA, 19 nt, Homo sapiens
gcucucggccucugucuuc

SEQ ID NO: 636892 - RNA, 19 nt, Homo sapiens
gcauccuccuucuggacua

SEQ ID NO: 636893 - RNA, 19 nt, Homo sapiens
uugccaaggucaagcugua

SEQ ID NO: 636894 - RNA, 19 nt, Homo sapiens
ugacgccugugcagugguu

SEQ ID NO: 636895 - RNA, 19 nt, Homo sapiens
cauccucuguugcgccauu

SEQ ID NO: 636896 - RNA, 19 nt, Homo sapiens
ccaaggagacgcuggaaac

SEQ ID NO: 636897 - RNA, 19 nt, Homo sapiens
caagagcugccgcaugcuu

SEQ ID NO: 636898 - RNA, 19 nt, Homo sapiens
caagguccaggaacacuau

SEQ ID NO: 636899 - RNA, 19 nt, Homo sapiens
ucaagacggucaccaucgu

SEQ ID NO: 636900 - RNA, 19 nt, Homo sapiens
gggcaacacgguggucuga

SEQ ID NO: 636901 - RNA, 19 nt, Homo sapiens
guccaggaacacuauaauu

SEQ ID NO: 636902 - RNA, 19 nt, Homo sapiens
gcaaguuccacucggcaau

SEQ ID NO: 636903 - RNA, 19 nt, Homo sapiens
gaccaucuucuccaucauc

SEQ ID NO: 636904 - RNA, 19 nt, Homo sapiens
gacggucaccaucgugcua

SEQ ID NO: 636905 - RNA, 19 nt, Homo sapiens
gguccaggaacacuauaau

SEQ ID NO: 636906 - RNA, 19 nt, Homo sapiens
gcucaagccacgcugacau

SEQ ID NO: 636907 - RNA, 19 nt, Homo sapiens
gugcuaggcgucuuuaucg

SEQ ID NO: 636908 - RNA, 19 nt, Homo sapiens
caaguuccacucggcaaug

SEQ ID NO: 636909 - RNA, 19 nt, Homo sapiens
gcaagaauauccuaaaugu

SEQ ID NO: 636910 - RNA, 19 nt, Homo sapiens
ggauaugagugacugaaua

SEQ ID NO: 636911 - RNA, 19 nt, Homo sapiens
gaagcacagucccuaauuu

SEQ ID NO: 636912 - RNA, 19 nt, Homo sapiens
gcaagaagaagaagaguaa

SEQ ID NO: 636913 - RNA, 19 nt, Homo sapiens
gaaagguuauuaugcacua

SEQ ID NO: 636914 - RNA, 19 nt, Homo sapiens
gagaagaaaccaauagaaa

SEQ ID NO: 636915 - RNA, 19 nt, Homo sapiens
gacaaacacuguauucguu

SEQ ID NO: 636916 - RNA, 19 nt, Homo sapiens
ggaauuacuucaaucaaca

SEQ ID NO: 636917 - RNA, 19 nt, Homo sapiens
gagcaaacuugaacucuca

SEQ ID NO: 636918 - RNA, 19 nt, Homo sapiens
acacggugauuucauguua

SEQ ID NO: 636919 - RNA, 19 nt, Homo sapiens
ucucaaaccuagauguaua

SEQ ID NO: 636920 - RNA, 19 nt, Homo sapiens
gaagaaaccaauagaaaca

SEQ ID NO: 636921 - RNA, 19 nt, Homo sapiens
ugacagagcuuugauaguc

SEQ ID NO: 636922 - RNA, 19 nt, Homo sapiens
ucucgugucugcuuuguua

SEQ ID NO: 636923 - RNA, 19 nt, Homo sapiens
gaagaagacauggauauga

SEQ ID NO: 636924 - RNA, 19 nt, Homo sapiens
cagcaggcauggauuguuu

SEQ ID NO: 636925 - RNA, 19 nt, Homo sapiens
gaagaagaguaaagauaag

SEQ ID NO: 636926 - RNA, 19 nt, Homo sapiens
auacagcucugaguuauaa

SEQ ID NO: 636927 - RNA, 19 nt, Homo sapiens
gaaagagaacgaucaacaa

SEQ ID NO: 636928 - RNA, 19 nt, Homo sapiens
cauaagauguuugggaauu

SEQ ID NO: 636929 - RNA, 19 nt, Homo sapiens
aaagggaacuggugauuca

SEQ ID NO: 636930 - RNA, 19 nt, Homo sapiens
ggauaccucuaguaaagaa

SEQ ID NO: 636931 - RNA, 19 nt, Homo sapiens
gagucuaucuuaaaggaaa

SEQ ID NO: 636932 - RNA, 19 nt, Homo sapiens
guaggcaacuguuuucuua

SEQ ID NO: 636933 - RNA, 19 nt, Homo sapiens
ccuaauuucugcugcuaua

SEQ ID NO: 636934 - RNA, 19 nt, Homo sapiens
caugauggaucuacuuaug

SEQ ID NO: 636935 - RNA, 19 nt, Homo sapiens
aaaggaauguucuguggaa

SEQ ID NO: 636936 - RNA, 19 nt, Homo sapiens
gaagagaagaaaccaauag

SEQ ID NO: 636937 - RNA, 19 nt, Homo sapiens
gaaagaaguagggaugaaa

SEQ ID NO: 636938 - RNA, 19 nt, Homo sapiens
cuaagagaauccaaaguga

SEQ ID NO: 636939 - RNA, 19 nt, Homo sapiens
uuacagaaguuucaagcuu

SEQ ID NO: 636940 - RNA, 19 nt, Homo sapiens
gguacgagguaaccaauuc

SEQ ID NO: 636941 - RNA, 19 nt, Homo sapiens
guauacagcucugaguuau

SEQ ID NO: 636942 - RNA, 19 nt, Homo sapiens
ggauuaugaugaagaggaa

SEQ ID NO: 636943 - RNA, 19 nt, Homo sapiens
caacaagcaagaagaagaa

SEQ ID NO: 636944 - RNA, 19 nt, Homo sapiens
gcaaaguaggcaacuguuu

SEQ ID NO: 636945 - RNA, 19 nt, Homo sapiens
cuacaucagugaaagcuau

SEQ ID NO: 636946 - RNA, 19 nt, Homo sapiens
gcacugauugcauguuauu

SEQ ID NO: 636947 - RNA, 19 nt, Homo sapiens
gguuauaaagcuccuguua

SEQ ID NO: 636948 - RNA, 19 nt, Homo sapiens
gaaguagggaugaaagaga

SEQ ID NO: 636949 - RNA, 19 nt, Homo sapiens
agugaaagcuaucuaccua

SEQ ID NO: 636950 - RNA, 19 nt, Homo sapiens
gaaacagguuccccuaaaa

SEQ ID NO: 636951 - RNA, 19 nt, Homo sapiens
gaucaacaagcaagaagaa

SEQ ID NO: 636952 - RNA, 19 nt, Homo sapiens
gagagacgacgacgaagaa

SEQ ID NO: 636953 - RNA, 19 nt, Homo sapiens
ccauguugauguacaguuu

SEQ ID NO: 636954 - RNA, 19 nt, Homo sapiens
gauuguuuaugucguauga

SEQ ID NO: 636955 - RNA, 19 nt, Homo sapiens
gacugaauauugccucuga

SEQ ID NO: 636956 - RNA, 19 nt, Homo sapiens
gaaaucggauaccucuagu

SEQ ID NO: 636957 - RNA, 19 nt, Homo sapiens
gaucccaaguugaaucaug

SEQ ID NO: 636958 - RNA, 19 nt, Homo sapiens
uguaggaaaugcacugauu

SEQ ID NO: 636959 - RNA, 19 nt, Homo sapiens
gcaucagugucauuccuuu

SEQ ID NO: 636960 - RNA, 19 nt, Homo sapiens
gcagugaguaaauagcaua

SEQ ID NO: 636961 - RNA, 19 nt, Homo sapiens
agacggcggucacauucua

SEQ ID NO: 636962 - RNA, 19 nt, Homo sapiens
gcuaaagcuuugucucugu

SEQ ID NO: 636963 - RNA, 19 nt, Homo sapiens
gauccagacucagcaguug

SEQ ID NO: 636964 - RNA, 19 nt, Homo sapiens
cuuauggucuuguuuguug

SEQ ID NO: 636965 - RNA, 19 nt, Homo sapiens
aggcauggauuguuuaugu

SEQ ID NO: 636966 - RNA, 19 nt, Homo sapiens
ucggauaccucuaguaaag

SEQ ID NO: 636967 - RNA, 19 nt, Homo sapiens
caaacacuguauucguuga

SEQ ID NO: 636968 - RNA, 19 nt, Homo sapiens
ggucaaggagcacaucaaa

SEQ ID NO: 636969 - RNA, 19 nt, Homo sapiens
ugaaagcuaucuaccuauc

SEQ ID NO: 636970 - RNA, 19 nt, Homo sapiens
agagagugauaaagaugua

SEQ ID NO: 636971 - RNA, 19 nt, Homo sapiens
gaagaguaaagauaaggaa

SEQ ID NO: 636972 - RNA, 19 nt, Homo sapiens
ggagaagaagaaagauaaa

SEQ ID NO: 636973 - RNA, 19 nt, Homo sapiens
gcacagcaucugacaaaca

SEQ ID NO: 636974 - RNA, 19 nt, Homo sapiens
ggucuuguuuguugacaug

SEQ ID NO: 636975 - RNA, 19 nt, Homo sapiens
guaaccaauucuugucaug

SEQ ID NO: 636976 - RNA, 19 nt, Homo sapiens
uuauaaagcuccuguuacu

SEQ ID NO: 636977 - RNA, 19 nt, Homo sapiens
uaauccaggugacuaaugu

SEQ ID NO: 636978 - RNA, 19 nt, Homo sapiens
gaagaagaagaguaaagau

SEQ ID NO: 636979 - RNA, 19 nt, Homo sapiens
agagaacgaucaacaagca

SEQ ID NO: 636980 - RNA, 19 nt, Homo sapiens
gguaugacagugagaaaga

SEQ ID NO: 636981 - RNA, 19 nt, Homo sapiens
ugaaagagaacgaucaaca

SEQ ID NO: 636982 - RNA, 19 nt, Homo sapiens
aagaaggcauucaagauca

SEQ ID NO: 636983 - RNA, 19 nt, Homo sapiens
uauccugagucuaucuuaa

SEQ ID NO: 636984 - RNA, 19 nt, Homo sapiens
guaauagagccauguagga

SEQ ID NO: 636985 - RNA, 19 nt, Homo sapiens
gagggaguccaacuguaua

SEQ ID NO: 636986 - RNA, 19 nt, Homo sapiens
agacacaggcggucaagaa

SEQ ID NO: 636987 - RNA, 19 nt, Homo sapiens
gcacagucccuaauuucug

SEQ ID NO: 636988 - RNA, 19 nt, Homo sapiens
gaaagaagacaaagaaaag

SEQ ID NO: 636989 - RNA, 19 nt, Homo sapiens
aaucggauaccucuaguaa

SEQ ID NO: 636990 - RNA, 19 nt, Homo sapiens
acggugauuucauguuaua

SEQ ID NO: 636991 - RNA, 19 nt, Homo sapiens
cuaccuauccugagucuau

SEQ ID NO: 636992 - RNA, 19 nt, Homo sapiens
uugauucauugccguaaua

SEQ ID NO: 636993 - RNA, 19 nt, Homo sapiens
gaacgaucaacaagcaaga

SEQ ID NO: 636994 - RNA, 19 nt, Homo sapiens
agaaagaaguagggaugaa

SEQ ID NO: 636995 - RNA, 19 nt, Homo sapiens
gaagaagaaagauaaagac

SEQ ID NO: 636996 - RNA, 19 nt, Homo sapiens
cuauagaaccagauaagaa

SEQ ID NO: 636997 - RNA, 19 nt, Homo sapiens
caaguugaaucauguagcu

SEQ ID NO: 636998 - RNA, 19 nt, Homo sapiens
ggccuagcguccuggaauu

SEQ ID NO: 636999 - RNA, 19 nt, Homo sapiens
cuaaagcuuugucucuguu

SEQ ID NO: 637000 - RNA, 19 nt, Homo sapiens
gcuccuguuacucauauua

SEQ ID NO: 637001 - RNA, 19 nt, Homo sapiens
gcucugaguuauaaauggu

SEQ ID NO: 637002 - RNA, 19 nt, Homo sapiens
uguauacagcucugaguua

SEQ ID NO: 637003 - RNA, 19 nt, Homo sapiens
uaagagaauccaaagugaa

SEQ ID NO: 637004 - RNA, 19 nt, Homo sapiens
gaaaaggaccgggaaagaa

SEQ ID NO: 637005 - RNA, 19 nt, Homo sapiens
gagcagaugcggacucucu

SEQ ID NO: 637006 - RNA, 19 nt, Homo sapiens
gaugaaagagaacgaucaa

SEQ ID NO: 637007 - RNA, 19 nt, Homo sapiens
aaagaaggcauucaagauc

SEQ ID NO: 637008 - RNA, 19 nt, Homo sapiens
caacaugauggaucuacuu

SEQ ID NO: 637009 - RNA, 19 nt, Homo sapiens
ccaaggagcacccauauga

SEQ ID NO: 637010 - RNA, 19 nt, Homo sapiens
gaaccgccaucccaauuuc

SEQ ID NO: 637011 - RNA, 19 nt, Homo sapiens
caucagccuucuuuacuuu

SEQ ID NO: 637012 - RNA, 19 nt, Homo sapiens
gaagacacuuuccggcaau

SEQ ID NO: 637013 - RNA, 19 nt, Homo sapiens
gauacaaccaucaaugaga

SEQ ID NO: 637014 - RNA, 19 nt, Homo sapiens
gggcucugcugguuaagga

SEQ ID NO: 637015 - RNA, 19 nt, Homo sapiens
ccaucagccuucuuuacuu

SEQ ID NO: 637016 - RNA, 19 nt, Homo sapiens
uaggggagcuuaacaagaa

SEQ ID NO: 637017 - RNA, 19 nt, Homo sapiens
auacaaccaucaaugagau

SEQ ID NO: 637018 - RNA, 19 nt, Homo sapiens
gaccaucucccuccacuac

SEQ ID NO: 637019 - RNA, 19 nt, Homo sapiens
gcuccuucccacuccauua

SEQ ID NO: 637020 - RNA, 19 nt, Homo sapiens
gaaggauacaaccaucaau

SEQ ID NO: 637021 - RNA, 19 nt, Homo sapiens
gagaaggauacaaccauca

SEQ ID NO: 637022 - RNA, 19 nt, Homo sapiens
gagccucugauuuccaauu

SEQ ID NO: 637023 - RNA, 19 nt, Homo sapiens
caagaaccgccaucccaau

SEQ ID NO: 637024 - RNA, 19 nt, Homo sapiens
ggauacaaccaucaaugag

SEQ ID NO: 637025 - RNA, 19 nt, Homo sapiens
gaggacacggugacugguu

SEQ ID NO: 637026 - RNA, 19 nt, Homo sapiens
aggacacggugacugguuu

SEQ ID NO: 637027 - RNA, 19 nt, Homo sapiens
aagaaccgccaucccaauu

SEQ ID NO: 637028 - RNA, 19 nt, Homo sapiens
gcaucauccucaucaacca

SEQ ID NO: 637029 - RNA, 19 nt, Homo sapiens
acagugucauuguugaugu

SEQ ID NO: 637030 - RNA, 19 nt, Homo sapiens
ugagaucgaagacacuuuc

SEQ ID NO: 637031 - RNA, 19 nt, Homo sapiens
aggauacaaccaucaauga

SEQ ID NO: 637032 - RNA, 19 nt, Homo sapiens
gucauauucuugcuucucu

SEQ ID NO: 637033 - RNA, 19 nt, Homo sapiens
agaaccgccaucccaauuu

SEQ ID NO: 637034 - RNA, 19 nt, Homo sapiens
cagugucauuguugauguu

SEQ ID NO: 637035 - RNA, 19 nt, Homo sapiens
gccaucagccuucuuuacu

SEQ ID NO: 637036 - RNA, 19 nt, Homo sapiens
aaccaucaaugagaucgaa

SEQ ID NO: 637037 - RNA, 19 nt, Homo sapiens
agaaggauacaaccaucaa

SEQ ID NO: 637038 - RNA, 19 nt, Homo sapiens
ucuaaaccgggaugacauu

SEQ ID NO: 637039 - RNA, 19 nt, Homo sapiens
aaggauacaaccaucaaug

SEQ ID NO: 637040 - RNA, 19 nt, Homo sapiens
gacacuuuccggcaauuuc

SEQ ID NO: 637041 - RNA, 19 nt, Homo sapiens
aaacauaccugugugauaa

SEQ ID NO: 637042 - RNA, 19 nt, Homo sapiens
gcacucaaaugguagguuu

SEQ ID NO: 637043 - RNA, 19 nt, Homo sapiens
gagaagcacuacugaaaga

SEQ ID NO: 637044 - RNA, 19 nt, Homo sapiens
gugaauggcuuguugauug

SEQ ID NO: 637045 - RNA, 19 nt, Homo sapiens
gaggagaccugcaucaaga

SEQ ID NO: 637046 - RNA, 19 nt, Homo sapiens
gaugauuccuuauuuggua

SEQ ID NO: 637047 - RNA, 19 nt, Homo sapiens
gaaaauggcuccaaagguu

SEQ ID NO: 637048 - RNA, 19 nt, Homo sapiens
gaaaguaugcgcugucauu

SEQ ID NO: 637049 - RNA, 19 nt, Homo sapiens
ggaauaagaacaagagauu

SEQ ID NO: 637050 - RNA, 19 nt, Homo sapiens
gaacggagaucugcaacau

SEQ ID NO: 637051 - RNA, 19 nt, Homo sapiens
gaacaugugccugucguua

SEQ ID NO: 637052 - RNA, 19 nt, Homo sapiens
guccauaguugaucuaauu

SEQ ID NO: 637053 - RNA, 19 nt, Homo sapiens
gacauaaucuuggguaaug

SEQ ID NO: 637054 - RNA, 19 nt, Homo sapiens
ccacguggcugaaaguaug

SEQ ID NO: 637055 - RNA, 19 nt, Homo sapiens
gagcucggcuucucauaau

SEQ ID NO: 637056 - RNA, 19 nt, Homo sapiens
gggauaauauuccagauag

SEQ ID NO: 637057 - RNA, 19 nt, Homo sapiens
caaauuggcauaacaugaa

SEQ ID NO: 637058 - RNA, 19 nt, Homo sapiens
gaauggaaauugcuauguc

SEQ ID NO: 637059 - RNA, 19 nt, Homo sapiens
gcagaauaaucaaauccaa

SEQ ID NO: 637060 - RNA, 19 nt, Homo sapiens
uaucaacggugaagaugaa

SEQ ID NO: 637061 - RNA, 19 nt, Homo sapiens
ucaucaaugugcagaauaa

SEQ ID NO: 637062 - RNA, 19 nt, Homo sapiens
guaaaagagucaucaguuu

SEQ ID NO: 637063 - RNA, 19 nt, Homo sapiens
aaagggaagucuugagguu

SEQ ID NO: 637064 - RNA, 19 nt, Homo sapiens
uaauuaaacucggguacaa

SEQ ID NO: 637065 - RNA, 19 nt, Homo sapiens
aguaugcgcugucauuuga

SEQ ID NO: 637066 - RNA, 19 nt, Homo sapiens
gaagcacuacugaaagauu

SEQ ID NO: 637067 - RNA, 19 nt, Homo sapiens
uaaacauaccugugugaua

SEQ ID NO: 637068 - RNA, 19 nt, Homo sapiens
acggagaucugcaacauau

SEQ ID NO: 637069 - RNA, 19 nt, Homo sapiens
guaaaacacuucacacuag

SEQ ID NO: 637070 - RNA, 19 nt, Homo sapiens
gauauggccagcugcgaua

SEQ ID NO: 637071 - RNA, 19 nt, Homo sapiens
caaaagacaguguugaaua

SEQ ID NO: 637072 - RNA, 19 nt, Homo sapiens
uuagaggugugaauuaugu

SEQ ID NO: 637073 - RNA, 19 nt, Homo sapiens
gaacaagagauugaaauac

SEQ ID NO: 637074 - RNA, 19 nt, Homo sapiens
gagcaagccaauucacuga

SEQ ID NO: 637075 - RNA, 19 nt, Homo sapiens
cagcacccauagucuuuaa

SEQ ID NO: 637076 - RNA, 19 nt, Homo sapiens
gauuagguaacuagucaua

SEQ ID NO: 637077 - RNA, 19 nt, Homo sapiens
ggauaauauuccagauaga

SEQ ID NO: 637078 - RNA, 19 nt, Homo sapiens
gguacaaauuggcauaaca

SEQ ID NO: 637079 - RNA, 19 nt, Homo sapiens
uaaacucggguacaaauug

SEQ ID NO: 637080 - RNA, 19 nt, Homo sapiens
ugaauaaacauaccugugu

SEQ ID NO: 637081 - RNA, 19 nt, Homo sapiens
ggaaauugcuaugucuuuu

SEQ ID NO: 637082 - RNA, 19 nt, Homo sapiens
gaaaaccuauggaacuaga

SEQ ID NO: 637083 - RNA, 19 nt, Homo sapiens
cauauacacugaagaugag

SEQ ID NO: 637084 - RNA, 19 nt, Homo sapiens
aaccaucgcuagccaguga

SEQ ID NO: 637085 - RNA, 19 nt, Homo sapiens
gaaauguauaccaccaauu

SEQ ID NO: 637086 - RNA, 19 nt, Homo sapiens
acacuucacacuagaauug

SEQ ID NO: 637087 - RNA, 19 nt, Homo sapiens
uggauuagguaacuaguca

SEQ ID NO: 637088 - RNA, 19 nt, Homo sapiens
ugacgaccguuaccuuuua

SEQ ID NO: 637089 - RNA, 19 nt, Homo sapiens
uaccuccaaugcagaauaa

SEQ ID NO: 637090 - RNA, 19 nt, Homo sapiens
agagucaucaguuuguuua

SEQ ID NO: 637091 - RNA, 19 nt, Homo sapiens
ggaaggaucacggagcuau

SEQ ID NO: 637092 - RNA, 19 nt, Homo sapiens
acaugugccugucguuauu

SEQ ID NO: 637093 - RNA, 19 nt, Homo sapiens
aaacugauuucaugguagu

SEQ ID NO: 637094 - RNA, 19 nt, Homo sapiens
guauucaacccuaaguaaa

SEQ ID NO: 637095 - RNA, 19 nt, Homo sapiens
ucaaugugcagaauaauca

SEQ ID NO: 637096 - RNA, 19 nt, Homo sapiens
aagcacuacugaaagauug

SEQ ID NO: 637097 - RNA, 19 nt, Homo sapiens
gagagcgggucacgaugau

SEQ ID NO: 637098 - RNA, 19 nt, Homo sapiens
gaauaagaacaagagauug

SEQ ID NO: 637099 - RNA, 19 nt, Homo sapiens
ggagaagcacuacugaaag

SEQ ID NO: 637100 - RNA, 19 nt, Homo sapiens
acauauacacugaagauga

SEQ ID NO: 637101 - RNA, 19 nt, Homo sapiens
aaacuuucauugccaucaa

SEQ ID NO: 637102 - RNA, 19 nt, Homo sapiens
ucaccuggaugaacaugug

SEQ ID NO: 637103 - RNA, 19 nt, Homo sapiens
guacaaauuggcauaacau

SEQ ID NO: 637104 - RNA, 19 nt, Homo sapiens
agaaauguauaccaccaau

SEQ ID NO: 637105 - RNA, 19 nt, Homo sapiens
cuccaaagguuaaaugaag

SEQ ID NO: 637106 - RNA, 19 nt, Homo sapiens
ccagauagaaauauugauc

SEQ ID NO: 637107 - RNA, 19 nt, Homo sapiens
gaaauauugaucccuugga

SEQ ID NO: 637108 - RNA, 19 nt, Homo sapiens
gaaggaucacggagcuauu

SEQ ID NO: 637109 - RNA, 19 nt, Homo sapiens
guauaccaccaauuuagaa

SEQ ID NO: 637110 - RNA, 19 nt, Homo sapiens
gaaacuuaacagaauggaa

SEQ ID NO: 637111 - RNA, 19 nt, Homo sapiens
uaucaaauucuccucaaug

SEQ ID NO: 637112 - RNA, 19 nt, Homo sapiens
ugaugucccuccacucuca

SEQ ID NO: 637113 - RNA, 19 nt, Homo sapiens
gaugaugucccuccacucu

SEQ ID NO: 637114 - RNA, 19 nt, Homo sapiens
uuucuaagguugugcuaau

SEQ ID NO: 637115 - RNA, 19 nt, Homo sapiens
aggagaagcacuacugaaa

SEQ ID NO: 637116 - RNA, 19 nt, Homo sapiens
cgagagcgggucacgauga

SEQ ID NO: 637117 - RNA, 19 nt, Homo sapiens
ccucaggacuacauucagu

SEQ ID NO: 637118 - RNA, 19 nt, Homo sapiens
acaaauuggcauaacauga

SEQ ID NO: 637119 - RNA, 19 nt, Homo sapiens
gacauacguccauaguuga

SEQ ID NO: 637120 - RNA, 19 nt, Homo sapiens
caaaugguagguuuagcuu

SEQ ID NO: 637121 - RNA, 19 nt, Homo sapiens
ccagaugguucuuuucuug

SEQ ID NO: 637122 - RNA, 19 nt, Homo sapiens
cagaagggaagcuagcaaa

SEQ ID NO: 637123 - RNA, 19 nt, Homo sapiens
guuuaugacucagugcaaa

SEQ ID NO: 637124 - RNA, 19 nt, Homo sapiens
guccgugaauggcuuguug

SEQ ID NO: 637125 - RNA, 19 nt, Homo sapiens
uguauucaacccuaaguaa

SEQ ID NO: 637126 - RNA, 19 nt, Homo sapiens
aaaccuuacggaaaucuuu

SEQ ID NO: 637127 - RNA, 19 nt, Homo sapiens
guauaccagaauagacuua

SEQ ID NO: 637128 - RNA, 19 nt, Homo sapiens
ugcaguaccugugucguuu

SEQ ID NO: 637129 - RNA, 19 nt, Homo sapiens
cauaguugaucuaauugag

SEQ ID NO: 637130 - RNA, 19 nt, Homo sapiens
gagcgggucacgaugaugu

SEQ ID NO: 637131 - RNA, 19 nt, Homo sapiens
ccacgggagucauguugca

SEQ ID NO: 637132 - RNA, 19 nt, Homo sapiens
auacugugccuuuagauga

SEQ ID NO: 637133 - RNA, 19 nt, Homo sapiens
gccaggagcaagccaauuc

SEQ ID NO: 637134 - RNA, 19 nt, Homo sapiens
gcuagccagugacuuugga

SEQ ID NO: 637135 - RNA, 19 nt, Homo sapiens
gugaauugacauaaucuug

SEQ ID NO: 637136 - RNA, 19 nt, Homo sapiens
gcccaguccuuugcugcua

SEQ ID NO: 637137 - RNA, 19 nt, Homo sapiens
ccaaugcagaauaaucaaa

SEQ ID NO: 637138 - RNA, 19 nt, Homo sapiens
ggacuacauucaguauacu

SEQ ID NO: 637139 - RNA, 19 nt, Homo sapiens
gauaucaacggugaagaug

SEQ ID NO: 637140 - RNA, 19 nt, Homo sapiens
ggcauaacaugaaaaccua

SEQ ID NO: 637141 - RNA, 19 nt, Homo sapiens
uaacaaaccugcacuuaua

SEQ ID NO: 637142 - RNA, 19 nt, Homo sapiens
ggaaagacauccauaaaga

SEQ ID NO: 637143 - RNA, 19 nt, Homo sapiens
caaagaagguuaccaagaa

SEQ ID NO: 637144 - RNA, 19 nt, Homo sapiens
ggaguaaucuguguacaaa

SEQ ID NO: 637145 - RNA, 19 nt, Homo sapiens
ugucuuggcuuucauguua

SEQ ID NO: 637146 - RNA, 19 nt, Homo sapiens
ggacagcacuaucaucaga

SEQ ID NO: 637147 - RNA, 19 nt, Homo sapiens
ccaaguugauuuaguguuu

SEQ ID NO: 637148 - RNA, 19 nt, Homo sapiens
caagaagccuuuccuguag

SEQ ID NO: 637149 - RNA, 19 nt, Homo sapiens
cagagagggugacaagaua

SEQ ID NO: 637150 - RNA, 19 nt, Homo sapiens
ccaagaagccuuuccugua

SEQ ID NO: 637151 - RNA, 19 nt, Homo sapiens
aaagaagagugccacauuu

SEQ ID NO: 637152 - RNA, 19 nt, Homo sapiens
gaaauaacaagucgaugaa

SEQ ID NO: 637153 - RNA, 19 nt, Homo sapiens
gaagagugccacauuuauu

SEQ ID NO: 637154 - RNA, 19 nt, Homo sapiens
gaaagacauccauaaagaa

SEQ ID NO: 637155 - RNA, 19 nt, Homo sapiens
ggacaucucuuugaauuuu

SEQ ID NO: 637156 - RNA, 19 nt, Homo sapiens
acaagucgaugaacuauuc

SEQ ID NO: 637157 - RNA, 19 nt, Homo sapiens
ccaguuaccuccccaaaua

SEQ ID NO: 637158 - RNA, 19 nt, Homo sapiens
uaaagaagagugccacauu

SEQ ID NO: 637159 - RNA, 19 nt, Homo sapiens
ggaaaagggucuugggaaa

SEQ ID NO: 637160 - RNA, 19 nt, Homo sapiens
gcccuucccuucuugguuu

SEQ ID NO: 637161 - RNA, 19 nt, Homo sapiens
gaagaucauauacgugaaa

SEQ ID NO: 637162 - RNA, 19 nt, Homo sapiens
ugaguuauauguucacugu

SEQ ID NO: 637163 - RNA, 19 nt, Homo sapiens
gagauagcauugugaacug

SEQ ID NO: 637164 - RNA, 19 nt, Homo sapiens
guagugagauagcauugug

SEQ ID NO: 637165 - RNA, 19 nt, Homo sapiens
aaggugaucuugagaguga

SEQ ID NO: 637166 - RNA, 19 nt, Homo sapiens
gggagaaauugacagauca

SEQ ID NO: 637167 - RNA, 19 nt, Homo sapiens
cuaacacacuccaagauau

SEQ ID NO: 637168 - RNA, 19 nt, Homo sapiens
gagagggugcuauccauuu

SEQ ID NO: 637169 - RNA, 19 nt, Homo sapiens
gaacugguaugagcaggau

SEQ ID NO: 637170 - RNA, 19 nt, Homo sapiens
guaacaaaccugcacuuau

SEQ ID NO: 637171 - RNA, 19 nt, Homo sapiens
auaccugggugauuacaua

SEQ ID NO: 637172 - RNA, 19 nt, Homo sapiens
ucacaagacagaacuggua

SEQ ID NO: 637173 - RNA, 19 nt, Homo sapiens
aaacaaagaagguuaccaa

SEQ ID NO: 637174 - RNA, 19 nt, Homo sapiens
aagaagagugccacauuua

SEQ ID NO: 637175 - RNA, 19 nt, Homo sapiens
cuacuuaacacucaucauu

SEQ ID NO: 637176 - RNA, 19 nt, Homo sapiens
ggcauuuauugcugaguua

SEQ ID NO: 637177 - RNA, 19 nt, Homo sapiens
agaaauaacaagucgauga

SEQ ID NO: 637178 - RNA, 19 nt, Homo sapiens
gauaccaaguugauuuagu

SEQ ID NO: 637179 - RNA, 19 nt, Homo sapiens
gcacuauacagauucgaaa

SEQ ID NO: 637180 - RNA, 19 nt, Homo sapiens
aguaaucuguguacaaaga

SEQ ID NO: 637181 - RNA, 19 nt, Homo sapiens
gagacagugggaaauauuu

SEQ ID NO: 637182 - RNA, 19 nt, Homo sapiens
gugacaagauagagagcua

SEQ ID NO: 637183 - RNA, 19 nt, Homo sapiens
gaagguccugcuauuacua

SEQ ID NO: 637184 - RNA, 19 nt, Homo sapiens
agaaugagccuacgcugaa

SEQ ID NO: 637185 - RNA, 19 nt, Homo sapiens
caagacagaacugguauga

SEQ ID NO: 637186 - RNA, 19 nt, Homo sapiens
ccuaacacacuccaagaua

SEQ ID NO: 637187 - RNA, 19 nt, Homo sapiens
aaaagggucuugggaaaua

SEQ ID NO: 637188 - RNA, 19 nt, Homo sapiens
gcacuuauacccaugaacu

SEQ ID NO: 637189 - RNA, 19 nt, Homo sapiens
gaaauacagagcggagauu

SEQ ID NO: 637190 - RNA, 19 nt, Homo sapiens
gcagcuaucuggucaaccu

SEQ ID NO: 637191 - RNA, 19 nt, Homo sapiens
ccaaugaaaggcccuauuc

SEQ ID NO: 637192 - RNA, 19 nt, Homo sapiens
aagagugccacauuuauuu

SEQ ID NO: 637193 - RNA, 19 nt, Homo sapiens
cugaagauccgaaacacua

SEQ ID NO: 637194 - RNA, 19 nt, Homo sapiens
ggugucugcuuucuccauu

SEQ ID NO: 637195 - RNA, 19 nt, Homo sapiens
gggaaagacauccauaaag

SEQ ID NO: 637196 - RNA, 19 nt, Homo sapiens
agacagugggaaauauuua

SEQ ID NO: 637197 - RNA, 19 nt, Homo sapiens
ggggacaucucuuugaauu

SEQ ID NO: 637198 - RNA, 19 nt, Homo sapiens
gcugcuggcucugguuauu

SEQ ID NO: 637199 - RNA, 19 nt, Homo sapiens
uaacacacuccaagauaug

SEQ ID NO: 637200 - RNA, 19 nt, Homo sapiens
ccauaaagaagcaauaaag

SEQ ID NO: 637201 - RNA, 19 nt, Homo sapiens
gugugaagguccugcuauu

SEQ ID NO: 637202 - RNA, 19 nt, Homo sapiens
auaccaaguugauuuagug

SEQ ID NO: 637203 - RNA, 19 nt, Homo sapiens
acaaagaagguuaccaaga

SEQ ID NO: 637204 - RNA, 19 nt, Homo sapiens
uaaaagcuauggugagaug

SEQ ID NO: 637205 - RNA, 19 nt, Homo sapiens
gguaugagcaggauuucug

SEQ ID NO: 637206 - RNA, 19 nt, Homo sapiens
guagccuucuguaggaauu

SEQ ID NO: 637207 - RNA, 19 nt, Homo sapiens
gugagacagugggaaauau

SEQ ID NO: 637208 - RNA, 19 nt, Homo sapiens
ucauaagacuuugggauag

SEQ ID NO: 637209 - RNA, 19 nt, Homo sapiens
uuaaacguaugcaugugaa

SEQ ID NO: 637210 - RNA, 19 nt, Homo sapiens
cggauaccaaguugauuua

SEQ ID NO: 637211 - RNA, 19 nt, Homo sapiens
gguccacggucuguucuug

SEQ ID NO: 637212 - RNA, 19 nt, Homo sapiens
ccuguagccuucuguagga

SEQ ID NO: 637213 - RNA, 19 nt, Homo sapiens
gcuauccauuucucauguu

SEQ ID NO: 637214 - RNA, 19 nt, Homo sapiens
ugaaaucuguaucuguagu

SEQ ID NO: 637215 - RNA, 19 nt, Homo sapiens
agacauccauaaagaagca

SEQ ID NO: 637216 - RNA, 19 nt, Homo sapiens
gggcagagaaaccuaagug

SEQ ID NO: 637217 - RNA, 19 nt, Homo sapiens
uuaccucugucuuggcuuu

SEQ ID NO: 637218 - RNA, 19 nt, Homo sapiens
ucuccugggucaaguuauu

SEQ ID NO: 637219 - RNA, 19 nt, Homo sapiens
aaacggauaccaaguugau

SEQ ID NO: 637220 - RNA, 19 nt, Homo sapiens
uaaaacggauaccaaguug

SEQ ID NO: 637221 - RNA, 19 nt, Homo sapiens
aaagaagguuaccaagaag

SEQ ID NO: 637222 - RNA, 19 nt, Homo sapiens
ucagagagggugacaagau

SEQ ID NO: 637223 - RNA, 19 nt, Homo sapiens
uaacaagucgaugaacuau

SEQ ID NO: 637224 - RNA, 19 nt, Homo sapiens
ugggagaaauugacagauc

SEQ ID NO: 637225 - RNA, 19 nt, Homo sapiens
ggucuccugggucaaguua

SEQ ID NO: 637226 - RNA, 19 nt, Homo sapiens
uguaacaaaccugcacuua

SEQ ID NO: 637227 - RNA, 19 nt, Homo sapiens
acauagagagggagaagaa

SEQ ID NO: 637228 - RNA, 19 nt, Homo sapiens
gaaaucuguaucuguagug

SEQ ID NO: 637229 - RNA, 19 nt, Homo sapiens
accaucacaugaccacaua

SEQ ID NO: 637230 - RNA, 19 nt, Homo sapiens
gaaugagccuacgcugaag

SEQ ID NO: 637231 - RNA, 19 nt, Homo sapiens
cucauaagacuuugggaua

SEQ ID NO: 637232 - RNA, 19 nt, Homo sapiens
gcuguugcaugggcuaaug

SEQ ID NO: 637233 - RNA, 19 nt, Homo sapiens
ggacauagagagggagaag

SEQ ID NO: 637234 - RNA, 19 nt, Homo sapiens
uucuaaagcuggcauggaa

SEQ ID NO: 637235 - RNA, 19 nt, Homo sapiens
cauuauccuugcuaugaug

SEQ ID NO: 637236 - RNA, 19 nt, Homo sapiens
gagagggugacaagauaga

SEQ ID NO: 637237 - RNA, 19 nt, Homo sapiens
ugggaaagacauccauaaa

SEQ ID NO: 637238 - RNA, 19 nt, Homo sapiens
ggacauacaggugcacucu

SEQ ID NO: 637239 - RNA, 19 nt, Homo sapiens
ugagacagugggaaauauu

SEQ ID NO: 637240 - RNA, 19 nt, Homo sapiens
uauaaaagcuauggugaga

SEQ ID NO: 637241 - RNA, 19 nt, Homo sapiens
gcacagaucuuaacauuca

SEQ ID NO: 637242 - RNA, 19 nt, Homo sapiens
gguaagagcuuuaaucaga

SEQ ID NO: 637243 - RNA, 19 nt, Homo sapiens
ggaaagaagucucucaaau

SEQ ID NO: 637244 - RNA, 19 nt, Homo sapiens
aaucagagcucacaucuuu

SEQ ID NO: 637245 - RNA, 19 nt, Homo sapiens
ggacaugaauucuuuacaa

SEQ ID NO: 637246 - RNA, 19 nt, Homo sapiens
ggagagaggccuuccuuua

SEQ ID NO: 637247 - RNA, 19 nt, Homo sapiens
gcucaaaucugcaaacuca

SEQ ID NO: 637248 - RNA, 19 nt, Homo sapiens
gagggaaucuguagaaaug

SEQ ID NO: 637249 - RNA, 19 nt, Homo sapiens
gaaagaagucucucaaaug

SEQ ID NO: 637250 - RNA, 19 nt, Homo sapiens
gguaagugcuuuaguuuga

SEQ ID NO: 637251 - RNA, 19 nt, Homo sapiens
gggaaaggcuucagucaga

SEQ ID NO: 637252 - RNA, 19 nt, Homo sapiens
gagagaaaccuuauaaaug

SEQ ID NO: 637253 - RNA, 19 nt, Homo sapiens
ugaaugagacacagaauua

SEQ ID NO: 637254 - RNA, 19 nt, Homo sapiens
gaauugugcuuggcucaua

SEQ ID NO: 637255 - RNA, 19 nt, Homo sapiens
gagagaggccuuccuuuaa

SEQ ID NO: 637256 - RNA, 19 nt, Homo sapiens
guuaggacaugaauucuuu

SEQ ID NO: 637257 - RNA, 19 nt, Homo sapiens
ggagagaggccuuacauau

SEQ ID NO: 637258 - RNA, 19 nt, Homo sapiens
gagauaaaguucauagcaa

SEQ ID NO: 637259 - RNA, 19 nt, Homo sapiens
gauggcaacucuucacaaa

SEQ ID NO: 637260 - RNA, 19 nt, Homo sapiens
ggagagaaaccauuuaaau

SEQ ID NO: 637261 - RNA, 19 nt, Homo sapiens
ggagagaaaccauauaaau

SEQ ID NO: 637262 - RNA, 19 nt, Homo sapiens
ggagagaaaccauauaaau

SEQ ID NO: 637263 - RNA, 19 nt, Homo sapiens
ggagagaaaccuuauaaau

SEQ ID NO: 637264 - RNA, 19 nt, Homo sapiens
aaugauagcuccagucuug

SEQ ID NO: 637265 - RNA, 19 nt, Homo sapiens
gagagaaacccuacaaaug

SEQ ID NO: 637266 - RNA, 19 nt, Homo sapiens
uagcacagaucuuaacauu

SEQ ID NO: 637267 - RNA, 19 nt, Homo sapiens
gagaaggacaccaguuaua

SEQ ID NO: 637268 - RNA, 19 nt, Homo sapiens
gagagaaaccauauaaaug

SEQ ID NO: 637269 - RNA, 19 nt, Homo sapiens
gagagaaaccauauaaaug

SEQ ID NO: 637270 - RNA, 19 nt, Homo sapiens
ccaccaugaugauaauaua

SEQ ID NO: 637271 - RNA, 19 nt, Homo sapiens
gaucaguguuuauaucaga

SEQ ID NO: 637272 - RNA, 19 nt, Homo sapiens
gcaaguagccuuaauaacg

SEQ ID NO: 637273 - RNA, 19 nt, Homo sapiens
cuacaaaugugaagagugu

SEQ ID NO: 637274 - RNA, 19 nt, Homo sapiens
gagaaacccuacaaaugug

SEQ ID NO: 637275 - RNA, 19 nt, Homo sapiens
gagaaacccuauagaugug

SEQ ID NO: 637276 - RNA, 19 nt, Homo sapiens
gagagaaacccuauagaug

SEQ ID NO: 637277 - RNA, 19 nt, Homo sapiens
gguaaagguuucagucaga

SEQ ID NO: 637278 - RNA, 19 nt, Homo sapiens
aguuagagcucacaucuuu

SEQ ID NO: 637279 - RNA, 19 nt, Homo sapiens
gcuuuaaucuucauaguca

SEQ ID NO: 637280 - RNA, 19 nt, Homo sapiens
uaacauucauugcagaguu

SEQ ID NO: 637281 - RNA, 19 nt, Homo sapiens
gagagaggccuuacauaug

SEQ ID NO: 637282 - RNA, 19 nt, Homo sapiens
gagaaaccauauaaaugug

SEQ ID NO: 637283 - RNA, 19 nt, Homo sapiens
ggagagaaacccuacaaau

SEQ ID NO: 637284 - RNA, 19 nt, Homo sapiens
gagaaaccauauaaaugug

SEQ ID NO: 637285 - RNA, 19 nt, Homo sapiens
ggagagaaacccuauagau

SEQ ID NO: 637286 - RNA, 19 nt, Homo sapiens
ggaaguccaugcugaugau

SEQ ID NO: 637287 - RNA, 19 nt, Homo sapiens
uguaagggcuucagucaga

SEQ ID NO: 637288 - RNA, 19 nt, Homo sapiens
agagaggccuuacauaugu

SEQ ID NO: 637289 - RNA, 19 nt, Homo sapiens
ccaaagagguaagcauuca

SEQ ID NO: 637290 - RNA, 19 nt, Homo sapiens
gagaugugaugcuggagaa

SEQ ID NO: 637291 - RNA, 19 nt, Homo sapiens
aaagaagucucucaaaugc

SEQ ID NO: 637292 - RNA, 19 nt, Homo sapiens
gggaaagaauucaguugga

SEQ ID NO: 637293 - RNA, 19 nt, Homo sapiens
caaauuagccagaagucaa

SEQ ID NO: 637294 - RNA, 19 nt, Homo sapiens
ggucacaucucaucuacca

SEQ ID NO: 637295 - RNA, 19 nt, Homo sapiens
guucauagcaauagugauu

SEQ ID NO: 637296 - RNA, 19 nt, Homo sapiens
aaugugacccugcaauuua

SEQ ID NO: 637297 - RNA, 19 nt, Homo sapiens
caaguagccuuaauaacgu

SEQ ID NO: 637298 - RNA, 19 nt, Homo sapiens
ucaaguccaucagauaauu

SEQ ID NO: 637299 - RNA, 19 nt, Homo sapiens
auacaaaugugaagugugu

SEQ ID NO: 637300 - RNA, 19 nt, Homo sapiens
auacaaaugugaugagugu

SEQ ID NO: 637301 - RNA, 19 nt, Homo sapiens
gggagaaacccuauacaug

SEQ ID NO: 637302 - RNA, 19 nt, Homo sapiens
guaaagauacccuaaaggu

SEQ ID NO: 637303 - RNA, 19 nt, Homo sapiens
cuucaaaccagauaugaua

SEQ ID NO: 637304 - RNA, 19 nt, Homo sapiens
agagaaacccuacaaaugu

SEQ ID NO: 637305 - RNA, 19 nt, Homo sapiens
caagacuccacgauaaaua

SEQ ID NO: 637306 - RNA, 19 nt, Homo sapiens
gcaaaucaagagacacauu

SEQ ID NO: 637307 - RNA, 19 nt, Homo sapiens
gaagaaaagcuuuggauga

SEQ ID NO: 637308 - RNA, 19 nt, Homo sapiens
guaagcagacucagaugaa

SEQ ID NO: 637309 - RNA, 19 nt, Homo sapiens
gaucauuccaguaucauug

SEQ ID NO: 637310 - RNA, 19 nt, Homo sapiens
auacugccauccauacuaa

SEQ ID NO: 637311 - RNA, 19 nt, Homo sapiens
gcccagcaauuacugaaga

SEQ ID NO: 637312 - RNA, 19 nt, Homo sapiens
gagaaaccuuauaaaugug

SEQ ID NO: 637313 - RNA, 19 nt, Homo sapiens
acacagaauuaucagagaa

SEQ ID NO: 637314 - RNA, 19 nt, Homo sapiens
ucacaaagcaggauuaagg

SEQ ID NO: 637315 - RNA, 19 nt, Homo sapiens
ucaguuguguacaguauga

SEQ ID NO: 637316 - RNA, 19 nt, Homo sapiens
caucaguuguguacaguau

SEQ ID NO: 637317 - RNA, 19 nt, Homo sapiens
caucucaucuaccaucaga

SEQ ID NO: 637318 - RNA, 19 nt, Homo sapiens
agucagaggucacaucuca

SEQ ID NO: 637319 - RNA, 19 nt, Homo sapiens
aauuggagcuugaaucuuc

SEQ ID NO: 637320 - RNA, 19 nt, Homo sapiens
gagaggccuuccuuuaaca

SEQ ID NO: 637321 - RNA, 19 nt, Homo sapiens
ucucucaaaugcuguguuu

SEQ ID NO: 637322 - RNA, 19 nt, Homo sapiens
uaugugaugucuguuguaa

SEQ ID NO: 637323 - RNA, 19 nt, Homo sapiens
ggauugugguaaacgcuuu

SEQ ID NO: 637324 - RNA, 19 nt, Homo sapiens
gagcuuucaugcuggcaaa

SEQ ID NO: 637325 - RNA, 19 nt, Homo sapiens
gaggucaaaucuucaaguc

SEQ ID NO: 637326 - RNA, 19 nt, Homo sapiens
uaagcagacucagaugaaa

SEQ ID NO: 637327 - RNA, 19 nt, Homo sapiens
caaaucaagagacacauug

SEQ ID NO: 637328 - RNA, 19 nt, Homo sapiens
aacuagagcuucaaagaau

SEQ ID NO: 637329 - RNA, 19 nt, Homo sapiens
aaacuagagcuucaaagaa

SEQ ID NO: 637330 - RNA, 19 nt, Homo sapiens
gaucuuaacauucauugca

SEQ ID NO: 637331 - RNA, 19 nt, Homo sapiens
agagaaacccuauagaugu

SEQ ID NO: 637332 - RNA, 19 nt, Homo sapiens
gacacagaauuaucagaga

SEQ ID NO: 637333 - RNA, 19 nt, Homo sapiens
ugaggaaugugggaaagaa

SEQ ID NO: 637334 - RNA, 19 nt, Homo sapiens
gagcuuuaaucuucauagu

SEQ ID NO: 637335 - RNA, 19 nt, Homo sapiens
guuccgaauucuuggagua

SEQ ID NO: 637336 - RNA, 19 nt, Homo sapiens
aguuugagcuuuaaucuuc

SEQ ID NO: 637337 - RNA, 19 nt, Homo sapiens
gggcuucacucagagauca

SEQ ID NO: 637338 - RNA, 19 nt, Homo sapiens
gcacaaaagagauaaaguu

SEQ ID NO: 637339 - RNA, 19 nt, Homo sapiens
cacgauaaauauugaagga

SEQ ID NO: 637340 - RNA, 19 nt, Homo sapiens
gugcuuggcucauaauagg

SEQ ID NO: 637341 - RNA, 19 nt, Homo sapiens
ggaaagugcuacacauuua

SEQ ID NO: 637342 - RNA, 19 nt, Homo sapiens
gaagaaggccuaugagaug

SEQ ID NO: 637343 - RNA, 19 nt, Homo sapiens
gagacaagguccugggaua

SEQ ID NO: 637344 - RNA, 19 nt, Homo sapiens
gcaaugggcuggacaucau

SEQ ID NO: 637345 - RNA, 19 nt, Homo sapiens
caaauaaaguccuaaugca

SEQ ID NO: 637346 - RNA, 19 nt, Homo sapiens
gaaagugcuacacauuuaa

SEQ ID NO: 637347 - RNA, 19 nt, Homo sapiens
ggccauagaugccaugcuu

SEQ ID NO: 637348 - RNA, 19 nt, Homo sapiens
gggaaagugcuacacauuu

SEQ ID NO: 637349 - RNA, 19 nt, Homo sapiens
ugacauggcgcaacucuau

SEQ ID NO: 637350 - RNA, 19 nt, Homo sapiens
acaagguccugggauauuu

SEQ ID NO: 637351 - RNA, 19 nt, Homo sapiens
gauccuagacuaccucugu

SEQ ID NO: 637352 - RNA, 19 nt, Homo sapiens
gaacuucaccacgaucuuc

SEQ ID NO: 637353 - RNA, 19 nt, Homo sapiens
gaaggccuaugagauguca

SEQ ID NO: 637354 - RNA, 19 nt, Homo sapiens
ccaaauaaaguccuaaugc

SEQ ID NO: 637355 - RNA, 19 nt, Homo sapiens
gacaagguccugggauauu

SEQ ID NO: 637356 - RNA, 19 nt, Homo sapiens
uaccagaccuuuguuucuu

SEQ ID NO: 637357 - RNA, 19 nt, Homo sapiens
cagaagaaggccuaugaga

SEQ ID NO: 637358 - RNA, 19 nt, Homo sapiens
gcagcaggaggaauaucua

SEQ ID NO: 637359 - RNA, 19 nt, Homo sapiens
auaaaguccuaaugcauca

SEQ ID NO: 637360 - RNA, 19 nt, Homo sapiens
agaagaaggccuaugagau

SEQ ID NO: 637361 - RNA, 19 nt, Homo sapiens
gcccugacauccuggacau

SEQ ID NO: 637362 - RNA, 19 nt, Homo sapiens
ccugcuaccuugucacaca

SEQ ID NO: 637363 - RNA, 19 nt, Homo sapiens
aagaaggccuaugagaugu

SEQ ID NO: 637364 - RNA, 19 nt, Homo sapiens
gaugggaaagugcuacaca

SEQ ID NO: 637365 - RNA, 19 nt, Homo sapiens
cccuggacaucuucuuuga

SEQ ID NO: 637366 - RNA, 19 nt, Homo sapiens
cugagagggugcgcuacua

SEQ ID NO: 637367 - RNA, 19 nt, Homo sapiens
cgauugcaguucagcaucu

SEQ ID NO: 637368 - RNA, 19 nt, Homo sapiens
gcuaccagaccuuuguuuc

SEQ ID NO: 637369 - RNA, 19 nt, Homo sapiens
gcagaagaaggccuaugag

SEQ ID NO: 637370 - RNA, 19 nt, Homo sapiens
gcugucacccugugcaaca

SEQ ID NO: 637371 - RNA, 19 nt, Homo sapiens
gcccuggacaucuucuuug

SEQ ID NO: 637372 - RNA, 19 nt, Homo sapiens
ggcccuggacaucuucuuu

SEQ ID NO: 637373 - RNA, 19 nt, Homo sapiens
ugggaaagugcuacacauu

SEQ ID NO: 637374 - RNA, 19 nt, Homo sapiens
ccaccgcaccugcuaccuu

SEQ ID NO: 637375 - RNA, 19 nt, Homo sapiens
agagcugcuuggugacauu

SEQ ID NO: 637376 - RNA, 19 nt, Homo sapiens
ggacgugcagcaggaggaa

SEQ ID NO: 637377 - RNA, 19 nt, Homo sapiens
aaaguccuaaugcaucaaa

SEQ ID NO: 637378 - RNA, 19 nt, Homo sapiens
agacaagguccugggauau

SEQ ID NO: 637379 - RNA, 19 nt, Homo sapiens
gagagggugcgcuacuaca

SEQ ID NO: 637380 - RNA, 19 nt, Homo sapiens
gaggaauaucuaccugugu

SEQ ID NO: 637381 - RNA, 19 nt, Homo sapiens
ggcacucccuggaugacau

SEQ ID NO: 637382 - RNA, 19 nt, Homo sapiens
ugugagguguuccgagaca

SEQ ID NO: 637383 - RNA, 19 nt, Homo sapiens
agcagaagaaggccuauga

SEQ ID NO: 637384 - RNA, 19 nt, Homo sapiens
aggccuacaucgcggagaa

SEQ ID NO: 637385 - RNA, 19 nt, Homo sapiens
ggcaaugggcuggacauca

SEQ ID NO: 637386 - RNA, 19 nt, Homo sapiens
ggaaagugcuacacauuua

SEQ ID NO: 637387 - RNA, 19 nt, Homo sapiens
gaagaaggccuaugagaug

SEQ ID NO: 637388 - RNA, 19 nt, Homo sapiens
gagacaagguccugggaua

SEQ ID NO: 637389 - RNA, 19 nt, Homo sapiens
gcaaugggcuggacaucau

SEQ ID NO: 637390 - RNA, 19 nt, Homo sapiens
caaauaaaguccuaaugca

SEQ ID NO: 637391 - RNA, 19 nt, Homo sapiens
gaaagugcuacacauuuaa

SEQ ID NO: 637392 - RNA, 19 nt, Homo sapiens
ggccauagaugccaugcuu

SEQ ID NO: 637393 - RNA, 19 nt, Homo sapiens
gggaaagugcuacacauuu

SEQ ID NO: 637394 - RNA, 19 nt, Homo sapiens
ugacauggcgcaacucuau

SEQ ID NO: 637395 - RNA, 19 nt, Homo sapiens
acaagguccugggauauuu

SEQ ID NO: 637396 - RNA, 19 nt, Homo sapiens
gauccuagacuaccucugu

SEQ ID NO: 637397 - RNA, 19 nt, Homo sapiens
gaacuucaccacgaucuuc

SEQ ID NO: 637398 - RNA, 19 nt, Homo sapiens
gaaggccuaugagauguca

SEQ ID NO: 637399 - RNA, 19 nt, Homo sapiens
ccaaauaaaguccuaaugc

SEQ ID NO: 637400 - RNA, 19 nt, Homo sapiens
gacaagguccugggauauu

SEQ ID NO: 637401 - RNA, 19 nt, Homo sapiens
uaccagaccuuuguuucuu

SEQ ID NO: 637402 - RNA, 19 nt, Homo sapiens
cagaagaaggccuaugaga

SEQ ID NO: 637403 - RNA, 19 nt, Homo sapiens
gcagcaggaggaauaucua

SEQ ID NO: 637404 - RNA, 19 nt, Homo sapiens
auaaaguccuaaugcauca

SEQ ID NO: 637405 - RNA, 19 nt, Homo sapiens
agaagaaggccuaugagau

SEQ ID NO: 637406 - RNA, 19 nt, Homo sapiens
gcccugacauccuggacau

SEQ ID NO: 637407 - RNA, 19 nt, Homo sapiens
ccugcuaccuugucacaca

SEQ ID NO: 637408 - RNA, 19 nt, Homo sapiens
aagaaggccuaugagaugu

SEQ ID NO: 637409 - RNA, 19 nt, Homo sapiens
gaugggaaagugcuacaca

SEQ ID NO: 637410 - RNA, 19 nt, Homo sapiens
cccuggacaucuucuuuga

SEQ ID NO: 637411 - RNA, 19 nt, Homo sapiens
cugagagggugcgcuacua

SEQ ID NO: 637412 - RNA, 19 nt, Homo sapiens
cgauugcaguucagcaucu

SEQ ID NO: 637413 - RNA, 19 nt, Homo sapiens
gcuaccagaccuuuguuuc

SEQ ID NO: 637414 - RNA, 19 nt, Homo sapiens
gcagaagaaggccuaugag

SEQ ID NO: 637415 - RNA, 19 nt, Homo sapiens
gcugucacccugugcaaca

SEQ ID NO: 637416 - RNA, 19 nt, Homo sapiens
gcccuggacaucuucuuug

SEQ ID NO: 637417 - RNA, 19 nt, Homo sapiens
ggcccuggacaucuucuuu

SEQ ID NO: 637418 - RNA, 19 nt, Homo sapiens
ugggaaagugcuacacauu

SEQ ID NO: 637419 - RNA, 19 nt, Homo sapiens
ccaccgcaccugcuaccuu

SEQ ID NO: 637420 - RNA, 19 nt, Homo sapiens
agagcugcuuggugacauu

SEQ ID NO: 637421 - RNA, 19 nt, Homo sapiens
ggacgugcagcaggaggaa

SEQ ID NO: 637422 - RNA, 19 nt, Homo sapiens
aaaguccuaaugcaucaaa

SEQ ID NO: 637423 - RNA, 19 nt, Homo sapiens
agacaagguccugggauau

SEQ ID NO: 637424 - RNA, 19 nt, Homo sapiens
gagagggugcgcuacuaca

SEQ ID NO: 637425 - RNA, 19 nt, Homo sapiens
gaggaauaucuaccugugu

SEQ ID NO: 637426 - RNA, 19 nt, Homo sapiens
ggcacucccuggaugacau

SEQ ID NO: 637427 - RNA, 19 nt, Homo sapiens
ugugagguguuccgagaca

SEQ ID NO: 637428 - RNA, 19 nt, Homo sapiens
agcagaagaaggccuauga

SEQ ID NO: 637429 - RNA, 19 nt, Homo sapiens
aggccuacaucgcggagaa

SEQ ID NO: 637430 - RNA, 19 nt, Homo sapiens
ggcaaugggcuggacauca

SEQ ID NO: 637431 - RNA, 19 nt, Homo sapiens
ggaaagugcuacacauuua

SEQ ID NO: 637432 - RNA, 19 nt, Homo sapiens
gaagaaggccuaugagaug

SEQ ID NO: 637433 - RNA, 19 nt, Homo sapiens
gagacaagguccugggaua

SEQ ID NO: 637434 - RNA, 19 nt, Homo sapiens
gcaaugggcuggacaucau

SEQ ID NO: 637435 - RNA, 19 nt, Homo sapiens
caaauaaaguccuaaugca

SEQ ID NO: 637436 - RNA, 19 nt, Homo sapiens
gaaagugcuacacauuuaa

SEQ ID NO: 637437 - RNA, 19 nt, Homo sapiens
ggccauagaugccaugcuu

SEQ ID NO: 637438 - RNA, 19 nt, Homo sapiens
gggaaagugcuacacauuu

SEQ ID NO: 637439 - RNA, 19 nt, Homo sapiens
ugacauggcgcaacucuau

SEQ ID NO: 637440 - RNA, 19 nt, Homo sapiens
acaagguccugggauauuu

SEQ ID NO: 637441 - RNA, 19 nt, Homo sapiens
gauccuagacuaccucugu

SEQ ID NO: 637442 - RNA, 19 nt, Homo sapiens
gaacuucaccacgaucuuc

SEQ ID NO: 637443 - RNA, 19 nt, Homo sapiens
gaaggccuaugagauguca

SEQ ID NO: 637444 - RNA, 19 nt, Homo sapiens
ccaaauaaaguccuaaugc

SEQ ID NO: 637445 - RNA, 19 nt, Homo sapiens
gacaagguccugggauauu

SEQ ID NO: 637446 - RNA, 19 nt, Homo sapiens
uaccagaccuuuguuucuu

SEQ ID NO: 637447 - RNA, 19 nt, Homo sapiens
cagaagaaggccuaugaga

SEQ ID NO: 637448 - RNA, 19 nt, Homo sapiens
gcagcaggaggaauaucua

SEQ ID NO: 637449 - RNA, 19 nt, Homo sapiens
auaaaguccuaaugcauca

SEQ ID NO: 637450 - RNA, 19 nt, Homo sapiens
agaagaaggccuaugagau

SEQ ID NO: 637451 - RNA, 19 nt, Homo sapiens
gcccugacauccuggacau

SEQ ID NO: 637452 - RNA, 19 nt, Homo sapiens
ccugcuaccuugucacaca

SEQ ID NO: 637453 - RNA, 19 nt, Homo sapiens
aagaaggccuaugagaugu

SEQ ID NO: 637454 - RNA, 19 nt, Homo sapiens
gaugggaaagugcuacaca

SEQ ID NO: 637455 - RNA, 19 nt, Homo sapiens
cccuggacaucuucuuuga

SEQ ID NO: 637456 - RNA, 19 nt, Homo sapiens
cugagagggugcgcuacua

SEQ ID NO: 637457 - RNA, 19 nt, Homo sapiens
cgauugcaguucagcaucu

SEQ ID NO: 637458 - RNA, 19 nt, Homo sapiens
gcuaccagaccuuuguuuc

SEQ ID NO: 637459 - RNA, 19 nt, Homo sapiens
gcagaagaaggccuaugag

SEQ ID NO: 637460 - RNA, 19 nt, Homo sapiens
gcugucacccugugcaaca

SEQ ID NO: 637461 - RNA, 19 nt, Homo sapiens
gcccuggacaucuucuuug

SEQ ID NO: 637462 - RNA, 19 nt, Homo sapiens
ggcccuggacaucuucuuu

SEQ ID NO: 637463 - RNA, 19 nt, Homo sapiens
ugggaaagugcuacacauu

SEQ ID NO: 637464 - RNA, 19 nt, Homo sapiens
ccaccgcaccugcuaccuu

SEQ ID NO: 637465 - RNA, 19 nt, Homo sapiens
agagcugcuuggugacauu

SEQ ID NO: 637466 - RNA, 19 nt, Homo sapiens
ggacgugcagcaggaggaa

SEQ ID NO: 637467 - RNA, 19 nt, Homo sapiens
aaaguccuaaugcaucaaa

SEQ ID NO: 637468 - RNA, 19 nt, Homo sapiens
agacaagguccugggauau

SEQ ID NO: 637469 - RNA, 19 nt, Homo sapiens
gagagggugcgcuacuaca

SEQ ID NO: 637470 - RNA, 19 nt, Homo sapiens
gaggaauaucuaccugugu

SEQ ID NO: 637471 - RNA, 19 nt, Homo sapiens
ggcacucccuggaugacau

SEQ ID NO: 637472 - RNA, 19 nt, Homo sapiens
ugugagguguuccgagaca

SEQ ID NO: 637473 - RNA, 19 nt, Homo sapiens
agcagaagaaggccuauga

SEQ ID NO: 637474 - RNA, 19 nt, Homo sapiens
aggccuacaucgcggagaa

SEQ ID NO: 637475 - RNA, 19 nt, Homo sapiens
ggcaaugggcuggacauca

SEQ ID NO: 637476 - RNA, 19 nt, Homo sapiens
gaagaacagugaacaaaua

SEQ ID NO: 637477 - RNA, 19 nt, Homo sapiens
gaagaucgaugaagauuau

SEQ ID NO: 637478 - RNA, 19 nt, Homo sapiens
gaagaaaugugugcacuuu

SEQ ID NO: 637479 - RNA, 19 nt, Homo sapiens
gaaacaagcuccaacaagu

SEQ ID NO: 637480 - RNA, 19 nt, Homo sapiens
gaauugggcuuguugauau

SEQ ID NO: 637481 - RNA, 19 nt, Homo sapiens
ggagaagaguuugauaaua

SEQ ID NO: 637482 - RNA, 19 nt, Homo sapiens
caacaagucuuucgagaau

SEQ ID NO: 637483 - RNA, 19 nt, Homo sapiens
ggagaaaccuaacucauca

SEQ ID NO: 637484 - RNA, 19 nt, Homo sapiens
gagaagaguuugauaauac

SEQ ID NO: 637485 - RNA, 19 nt, Homo sapiens
gaacgaguauuucuuugau

SEQ ID NO: 637486 - RNA, 19 nt, Homo sapiens
gagagacccuuuaagagaa

SEQ ID NO: 637487 - RNA, 19 nt, Homo sapiens
gcaggaaacggacgaauuu

SEQ ID NO: 637488 - RNA, 19 nt, Homo sapiens
ggagagacccuuuaagaga

SEQ ID NO: 637489 - RNA, 19 nt, Homo sapiens
ggaggucugugcuguauug

SEQ ID NO: 637490 - RNA, 19 nt, Homo sapiens
ggaagcaucguuucuauga

SEQ ID NO: 637491 - RNA, 19 nt, Homo sapiens
ggaagaaacugugggacuu

SEQ ID NO: 637492 - RNA, 19 nt, Homo sapiens
gcagaaacgccaagagaaa

SEQ ID NO: 637493 - RNA, 19 nt, Homo sapiens
gcaugugacuaguuacaaa

SEQ ID NO: 637494 - RNA, 19 nt, Homo sapiens
gagaugcuauacaaugaaa

SEQ ID NO: 637495 - RNA, 19 nt, Homo sapiens
guauggaacugauagaugu

SEQ ID NO: 637496 - RNA, 19 nt, Homo sapiens
guccagaucuuccgaauca

SEQ ID NO: 637497 - RNA, 19 nt, Homo sapiens
gaagagcaccaaagagcua

SEQ ID NO: 637498 - RNA, 19 nt, Homo sapiens
gaacaguuuagcuuaagua

SEQ ID NO: 637499 - RNA, 19 nt, Homo sapiens
ccaaauaaauggaaguucu

SEQ ID NO: 637500 - RNA, 19 nt, Homo sapiens
aagaagagauugaaaugga

SEQ ID NO: 637501 - RNA, 19 nt, Homo sapiens
acaagucuuucgagaauaa

SEQ ID NO: 637502 - RNA, 19 nt, Homo sapiens
caguaucccugcaucauuu

SEQ ID NO: 637503 - RNA, 19 nt, Homo sapiens
caugaacaguuuagcuuaa

SEQ ID NO: 637504 - RNA, 19 nt, Homo sapiens
gcagauaagccuagugaug

SEQ ID NO: 637505 - RNA, 19 nt, Homo sapiens
aauaaugccugugaacuaa

SEQ ID NO: 637506 - RNA, 19 nt, Homo sapiens
ccagaucccucaaagugaa

SEQ ID NO: 637507 - RNA, 19 nt, Homo sapiens
gcaugaacaguuuagcuua

SEQ ID NO: 637508 - RNA, 19 nt, Homo sapiens
caaugacaaccgccaauua

SEQ ID NO: 637509 - RNA, 19 nt, Homo sapiens
ggaaggcucugucggaaac

SEQ ID NO: 637510 - RNA, 19 nt, Homo sapiens
gaaaccagcaugugacuag

SEQ ID NO: 637511 - RNA, 19 nt, Homo sapiens
gguugaagaucgaugaaga

SEQ ID NO: 637512 - RNA, 19 nt, Homo sapiens
gagcagaaacgccaagaga

SEQ ID NO: 637513 - RNA, 19 nt, Homo sapiens
ggacgaauuuggacaacuc

SEQ ID NO: 637514 - RNA, 19 nt, Homo sapiens
gaaggagaagaguuugaua

SEQ ID NO: 637515 - RNA, 19 nt, Homo sapiens
gcgagaaggagaagaguuu

SEQ ID NO: 637516 - RNA, 19 nt, Homo sapiens
ccucugagccuuccuacua

SEQ ID NO: 637517 - RNA, 19 nt, Homo sapiens
acuauaaucugaacgagaa

SEQ ID NO: 637518 - RNA, 19 nt, Homo sapiens
uaauaaugccugugaacua

SEQ ID NO: 637519 - RNA, 19 nt, Homo sapiens
gauggaaaaucacuuguuu

SEQ ID NO: 637520 - RNA, 19 nt, Homo sapiens
gaagcaucguuucuaugaa

SEQ ID NO: 637521 - RNA, 19 nt, Homo sapiens
ugaacgagaacgaguauuu

SEQ ID NO: 637522 - RNA, 19 nt, Homo sapiens
gaggccaucugcauaugaa

SEQ ID NO: 637523 - RNA, 19 nt, Homo sapiens
caucguuucuaugaacuua

SEQ ID NO: 637524 - RNA, 19 nt, Homo sapiens
gcuaccaaguucaccagua

SEQ ID NO: 637525 - RNA, 19 nt, Homo sapiens
cgacaggccugcagucucu

SEQ ID NO: 637526 - RNA, 19 nt, Homo sapiens
ugauagauguggcuguuga

SEQ ID NO: 637527 - RNA, 19 nt, Homo sapiens
ggaaacggacgaauuugga

SEQ ID NO: 637528 - RNA, 19 nt, Homo sapiens
ggaagugugcgacgacuau

SEQ ID NO: 637529 - RNA, 19 nt, Homo sapiens
caucaguaccauccucuua

SEQ ID NO: 637530 - RNA, 19 nt, Homo sapiens
agacacagccucauucuca

SEQ ID NO: 637531 - RNA, 19 nt, Homo sapiens
ggacuccgccgacgauaau

SEQ ID NO: 637532 - RNA, 19 nt, Homo sapiens
gccaagagaaagcaauuaa

SEQ ID NO: 637533 - RNA, 19 nt, Homo sapiens
cuaccaaguucaccaguau

SEQ ID NO: 637534 - RNA, 19 nt, Homo sapiens
aagaacaaaugaacgaaga

SEQ ID NO: 637535 - RNA, 19 nt, Homo sapiens
gacagaagagcaccaaaga

SEQ ID NO: 637536 - RNA, 19 nt, Homo sapiens
ggaaacaagcuccaacaag

SEQ ID NO: 637537 - RNA, 19 nt, Homo sapiens
ugaagaugcuaccaaguuc

SEQ ID NO: 637538 - RNA, 19 nt, Homo sapiens
gaaccagagucagggaugu

SEQ ID NO: 637539 - RNA, 19 nt, Homo sapiens
uggagaugcuauacaauga

SEQ ID NO: 637540 - RNA, 19 nt, Homo sapiens
gaugggagagacccuuuaa

SEQ ID NO: 637541 - RNA, 19 nt, Homo sapiens
ggacagaagagcaccaaag

SEQ ID NO: 637542 - RNA, 19 nt, Homo sapiens
ugaauugggcuuguugaua

SEQ ID NO: 637543 - RNA, 19 nt, Homo sapiens
caaaugaacgaagaacuga

SEQ ID NO: 637544 - RNA, 19 nt, Homo sapiens
gaacgagaacgaguauuuc

SEQ ID NO: 637545 - RNA, 19 nt, Homo sapiens
ggauauugcuucaguugac

SEQ ID NO: 637546 - RNA, 19 nt, Homo sapiens
cgaugaagauuauuguucu

SEQ ID NO: 637547 - RNA, 19 nt, Homo sapiens
gaauuuggacaacucaaug

SEQ ID NO: 637548 - RNA, 19 nt, Homo sapiens
caucgugucuauccuguuc

SEQ ID NO: 637549 - RNA, 19 nt, Homo sapiens
ccagagggauauugcuuca

SEQ ID NO: 637550 - RNA, 19 nt, Homo sapiens
aaaggacaguagucaagaa

SEQ ID NO: 637551 - RNA, 19 nt, Homo sapiens
agcagaaacuguucccuuu

SEQ ID NO: 637552 - RNA, 19 nt, Homo sapiens
ugaagaagagauugaaaug

SEQ ID NO: 637553 - RNA, 19 nt, Homo sapiens
gagaguccgccaacacaaa

SEQ ID NO: 637554 - RNA, 19 nt, Homo sapiens
gaagaaacugugggacuug

SEQ ID NO: 637555 - RNA, 19 nt, Homo sapiens
ucaguaccauccucuuaga

SEQ ID NO: 637556 - RNA, 19 nt, Homo sapiens
agaagagauugaaauggaa

SEQ ID NO: 637557 - RNA, 19 nt, Homo sapiens
caugaccacuguuggcuau

SEQ ID NO: 637558 - RNA, 19 nt, Homo sapiens
ccaggagaguuaagaucaa

SEQ ID NO: 637559 - RNA, 19 nt, Homo sapiens
gagaggccaucugcauaug

SEQ ID NO: 637560 - RNA, 19 nt, Homo sapiens
ccaagagaaagcaauuaaa

SEQ ID NO: 637561 - RNA, 19 nt, Homo sapiens
accagcaugugacuaguua

SEQ ID NO: 637562 - RNA, 19 nt, Homo sapiens
gaagggugcaagauggaaa

SEQ ID NO: 637563 - RNA, 19 nt, Homo sapiens
ugaagaucgaugaagauua

SEQ ID NO: 637564 - RNA, 19 nt, Homo sapiens
acaaugaaaucaccaagac

SEQ ID NO: 637565 - RNA, 19 nt, Homo sapiens
ucaaaggcccacugaaugu

SEQ ID NO: 637566 - RNA, 19 nt, Homo sapiens
ucaagaagggugcaagaug

SEQ ID NO: 637567 - RNA, 19 nt, Homo sapiens
ccaacaagucuuucgagaa

SEQ ID NO: 637568 - RNA, 19 nt, Homo sapiens
gagaaggagaagaguuuga

SEQ ID NO: 637569 - RNA, 19 nt, Homo sapiens
ggaagaaaugugugcacuu

SEQ ID NO: 637570 - RNA, 19 nt, Homo sapiens
ucacagagacagagagauc

SEQ ID NO: 637571 - RNA, 19 nt, Homo sapiens
gaagaagagauugaaaugg

SEQ ID NO: 637572 - RNA, 19 nt, Homo sapiens
ggagaugcuauacaaugaa

SEQ ID NO: 637573 - RNA, 19 nt, Homo sapiens
acaagagcgugcugcaguu

SEQ ID NO: 637574 - RNA, 19 nt, Homo sapiens
ggauugaugagaucuacuu

SEQ ID NO: 637575 - RNA, 19 nt, Homo sapiens
ccgggaaacuccauaugau

SEQ ID NO: 637576 - RNA, 19 nt, Homo sapiens
ggagagggauucuuccaaa

SEQ ID NO: 637577 - RNA, 19 nt, Homo sapiens
caucauggcuuugaaguuu

SEQ ID NO: 637578 - RNA, 19 nt, Homo sapiens
ccaaaucgaugcugcugua

SEQ ID NO: 637579 - RNA, 19 nt, Homo sapiens
aggcguaucuugacaaaua

SEQ ID NO: 637580 - RNA, 19 nt, Homo sapiens
ccaaaggccuucaaaucaa

SEQ ID NO: 637581 - RNA, 19 nt, Homo sapiens
ggaugcagcuuacgaagug

SEQ ID NO: 637582 - RNA, 19 nt, Homo sapiens
gcacugauguacccaacuu

SEQ ID NO: 637583 - RNA, 19 nt, Homo sapiens
cgaugcugcuguagaauua

SEQ ID NO: 637584 - RNA, 19 nt, Homo sapiens
caaugaacgugaucaagaa

SEQ ID NO: 637585 - RNA, 19 nt, Homo sapiens
caaaggccuucaaaucaaa

SEQ ID NO: 637586 - RNA, 19 nt, Homo sapiens
gaaggaagaugugguuagu

SEQ ID NO: 637587 - RNA, 19 nt, Homo sapiens
gaauuucaauccacauuag

SEQ ID NO: 637588 - RNA, 19 nt, Homo sapiens
ugaaagggauccaggcauu

SEQ ID NO: 637589 - RNA, 19 nt, Homo sapiens
gcaaugaggaugacuacaa

SEQ ID NO: 637590 - RNA, 19 nt, Homo sapiens
caaagaauacugaagaaga

SEQ ID NO: 637591 - RNA, 19 nt, Homo sapiens
guacaagaaucccuaugga

SEQ ID NO: 637592 - RNA, 19 nt, Homo sapiens
gcaguuagacaccauuauu

SEQ ID NO: 637593 - RNA, 19 nt, Homo sapiens
ggacaaagcaguggagaug

SEQ ID NO: 637594 - RNA, 19 nt, Homo sapiens
gaagcagauugauccguuu

SEQ ID NO: 637595 - RNA, 19 nt, Homo sapiens
gaaagggauccaggcauua

SEQ ID NO: 637596 - RNA, 19 nt, Homo sapiens
gggaggagauacacauuuc

SEQ ID NO: 637597 - RNA, 19 nt, Homo sapiens
uaaagaaggacaccagauu

SEQ ID NO: 637598 - RNA, 19 nt, Homo sapiens
ggaauucggcccagcacua

SEQ ID NO: 637599 - RNA, 19 nt, Homo sapiens
agaagcggauauuaugaua

SEQ ID NO: 637600 - RNA, 19 nt, Homo sapiens
gcacaggcguaucuugaca

SEQ ID NO: 637601 - RNA, 19 nt, Homo sapiens
gaagacuagugguggauuc

SEQ ID NO: 637602 - RNA, 19 nt, Homo sapiens
gggcacugcuuacuucuuc

SEQ ID NO: 637603 - RNA, 19 nt, Homo sapiens
auacggaccucggaaagua

SEQ ID NO: 637604 - RNA, 19 nt, Homo sapiens
ccaagucaccgggaaguua

SEQ ID NO: 637605 - RNA, 19 nt, Homo sapiens
cuggauugguugcuaaaua

SEQ ID NO: 637606 - RNA, 19 nt, Homo sapiens
uuccugauguggccaauua

SEQ ID NO: 637607 - RNA, 19 nt, Homo sapiens
ggacuaaagcagaauguag

SEQ ID NO: 637608 - RNA, 19 nt, Homo sapiens
ugauguacccaacuuauaa

SEQ ID NO: 637609 - RNA, 19 nt, Homo sapiens
cagaauaaacucaggagaa

SEQ ID NO: 637610 - RNA, 19 nt, Homo sapiens
aaucgaugcugcuguagaa

SEQ ID NO: 637611 - RNA, 19 nt, Homo sapiens
ggagaagcggauauuauga

SEQ ID NO: 637612 - RNA, 19 nt, Homo sapiens
ggaccuggaggaacaacua

SEQ ID NO: 637613 - RNA, 19 nt, Homo sapiens
agauugauccguuugauuu

SEQ ID NO: 637614 - RNA, 19 nt, Homo sapiens
caaggcacgugcagcaaau

SEQ ID NO: 637615 - RNA, 19 nt, Homo sapiens
caaugaggaugacuacaag

SEQ ID NO: 637616 - RNA, 19 nt, Homo sapiens
gacucuagcccaugcauuu

SEQ ID NO: 637617 - RNA, 19 nt, Homo sapiens
uaaaagacaucacaacaca

SEQ ID NO: 637618 - RNA, 19 nt, Homo sapiens
ggccaucauuuguuauaau

SEQ ID NO: 637619 - RNA, 19 nt, Homo sapiens
gcagauugauccguuugau

SEQ ID NO: 637620 - RNA, 19 nt, Homo sapiens
gccucuaacuggaucuuaa

SEQ ID NO: 637621 - RNA, 19 nt, Homo sapiens
agaauaaacucaggagaag

SEQ ID NO: 637622 - RNA, 19 nt, Homo sapiens
acaagaggauuccaaaugc

SEQ ID NO: 637623 - RNA, 19 nt, Homo sapiens
gagaagcggauauuaugau

SEQ ID NO: 637624 - RNA, 19 nt, Homo sapiens
gaaauccaaaucaacacaa

SEQ ID NO: 637625 - RNA, 19 nt, Homo sapiens
uggcuacauuuacuucuuu

SEQ ID NO: 637626 - RNA, 19 nt, Homo sapiens
gagaugaauacuacagcua

SEQ ID NO: 637627 - RNA, 19 nt, Homo sapiens
gagauacacauuucgacaa

SEQ ID NO: 637628 - RNA, 19 nt, Homo sapiens
auacacaccuuccaugagu

SEQ ID NO: 637629 - RNA, 19 nt, Homo sapiens
acaaugaacgugaucaaga

SEQ ID NO: 637630 - RNA, 19 nt, Homo sapiens
cuaauauacugaagcagau

SEQ ID NO: 637631 - RNA, 19 nt, Homo sapiens
cuuaaggacuaaagcagaa

SEQ ID NO: 637632 - RNA, 19 nt, Homo sapiens
aggaagaugugguuagugu

SEQ ID NO: 637633 - RNA, 19 nt, Homo sapiens
caagaggauuccaaaugca

SEQ ID NO: 637634 - RNA, 19 nt, Homo sapiens
ccaauguggaugcagcuua

SEQ ID NO: 637635 - RNA, 19 nt, Homo sapiens
gagagggauucuuccaaag

SEQ ID NO: 637636 - RNA, 19 nt, Homo sapiens
acacagagaaggaagaugu

SEQ ID NO: 637637 - RNA, 19 nt, Homo sapiens
ccugagaaguggacuaugg

SEQ ID NO: 637638 - RNA, 19 nt, Homo sapiens
caggagaagcggauauuau

SEQ ID NO: 637639 - RNA, 19 nt, Homo sapiens
aaagaaggacaccagauug

SEQ ID NO: 637640 - RNA, 19 nt, Homo sapiens
gauaacaagaggauuccaa

SEQ ID NO: 637641 - RNA, 19 nt, Homo sapiens
uggauugguugcuaaauag

SEQ ID NO: 637642 - RNA, 19 nt, Homo sapiens
gcacgugcagcaaauagau

SEQ ID NO: 637643 - RNA, 19 nt, Homo sapiens
ggagacggcagguucacuu

SEQ ID NO: 637644 - RNA, 19 nt, Homo sapiens
gacuccagcucauccuuug

SEQ ID NO: 637645 - RNA, 19 nt, Homo sapiens
caucuggccuugcugucuu

SEQ ID NO: 637646 - RNA, 19 nt, Homo sapiens
cguugcugcucaugaauuu

SEQ ID NO: 637647 - RNA, 19 nt, Homo sapiens
caguuagacaccauuauuu

SEQ ID NO: 637648 - RNA, 19 nt, Homo sapiens
ccagauuggugagaugguu

SEQ ID NO: 637649 - RNA, 19 nt, Homo sapiens
gagaaggaagaugugguua

SEQ ID NO: 637650 - RNA, 19 nt, Homo sapiens
ccaaagaugaugugaaagg

SEQ ID NO: 637651 - RNA, 19 nt, Homo sapiens
gcuguggaguuccugaugu

SEQ ID NO: 637652 - RNA, 19 nt, Homo sapiens
uccaaaggccuucaaauca

SEQ ID NO: 637653 - RNA, 19 nt, Homo sapiens
caauguggaugcagcuuac

SEQ ID NO: 637654 - RNA, 19 nt, Homo sapiens
gaauucggcccagcacuau

SEQ ID NO: 637655 - RNA, 19 nt, Homo sapiens
agauacacauuucgacaau

SEQ ID NO: 637656 - RNA, 19 nt, Homo sapiens
gaagcaauuccaugauaag

SEQ ID NO: 637657 - RNA, 19 nt, Homo sapiens
aggaguaaauggccaaauc

SEQ ID NO: 637658 - RNA, 19 nt, Homo sapiens
gaagaauuuucaggaguaa

SEQ ID NO: 637659 - RNA, 19 nt, Homo sapiens
cagcuacgacgaaaggaaa

SEQ ID NO: 637660 - RNA, 19 nt, Homo sapiens
uaccguugcugcucaugaa

SEQ ID NO: 637661 - RNA, 19 nt, Homo sapiens
uccaugauaaggaagauua

SEQ ID NO: 637662 - RNA, 19 nt, Homo sapiens
aacuggaucuuaaggacua

SEQ ID NO: 637663 - RNA, 19 nt, Homo sapiens
ggaaaaggaaaauggaaaa

SEQ ID NO: 637664 - RNA, 19 nt, Homo sapiens
aaauacacaccuuccauga

SEQ ID NO: 637665 - RNA, 19 nt, Homo sapiens
ggccaauuaucgccucuuc

SEQ ID NO: 637666 - RNA, 19 nt, Homo sapiens
caagcaaugaggaugacua

SEQ ID NO: 637667 - RNA, 19 nt, Homo sapiens
uccaaagaauacugaagaa

SEQ ID NO: 637668 - RNA, 19 nt, Homo sapiens
ugugggagaugaauacuac

SEQ ID NO: 637669 - RNA, 19 nt, Homo sapiens
ccaaggcacgugcagcaaa

SEQ ID NO: 637670 - RNA, 19 nt, Homo sapiens
ccccaaagaugaugugaaa

SEQ ID NO: 637671 - RNA, 19 nt, Homo sapiens
acaggcguaucuugacaaa

SEQ ID NO: 637672 - RNA, 19 nt, Homo sapiens
caucauuuggccaucauuu

SEQ ID NO: 637673 - RNA, 19 nt, Homo sapiens
gccuucaaaucaaauuaga

SEQ ID NO: 637674 - RNA, 19 nt, Homo sapiens
ggagcuacaagcguucuuu

SEQ ID NO: 637675 - RNA, 19 nt, Homo sapiens
agaagaauuuucaggagua

SEQ ID NO: 637676 - RNA, 19 nt, Homo sapiens
aaaagacgcuuccaaguua

SEQ ID NO: 637677 - RNA, 19 nt, Homo sapiens
ugagaaaccuuaccacugu

SEQ ID NO: 637678 - RNA, 19 nt, Homo sapiens
ggacggcuguggauggaaa

SEQ ID NO: 637679 - RNA, 19 nt, Homo sapiens
ggagagagaccgaggaguu

SEQ ID NO: 637680 - RNA, 19 nt, Homo sapiens
acaaagaguucccaucuca

SEQ ID NO: 637681 - RNA, 19 nt, Homo sapiens
agaaggaucucggccaauu

SEQ ID NO: 637682 - RNA, 19 nt, Homo sapiens
gaccuggacuuuauucucu

SEQ ID NO: 637683 - RNA, 19 nt, Homo sapiens
cagaggagcccaagccaaa

SEQ ID NO: 637684 - RNA, 19 nt, Homo sapiens
gaaggaucucggccaauuu

SEQ ID NO: 637685 - RNA, 19 nt, Homo sapiens
gacccacacugccagaaga

SEQ ID NO: 637686 - RNA, 19 nt, Homo sapiens
gagaagacacugcgucaag

SEQ ID NO: 637687 - RNA, 19 nt, Homo sapiens
ggacuuuauucucuccaau

SEQ ID NO: 637688 - RNA, 19 nt, Homo sapiens
uuacucgccuugcugauug

SEQ ID NO: 637689 - RNA, 19 nt, Homo sapiens
caccucgccuuacacauga

SEQ ID NO: 637690 - RNA, 19 nt, Homo sapiens
ggcaaaaccuacacaaaga

SEQ ID NO: 637691 - RNA, 19 nt, Homo sapiens
ccaccucgccuuacacaug

SEQ ID NO: 637692 - RNA, 19 nt, Homo sapiens
ggucaucagcgucagcaaa

SEQ ID NO: 637693 - RNA, 19 nt, Homo sapiens
gaccaggcacuaccguaaa

SEQ ID NO: 637694 - RNA, 19 nt, Homo sapiens
ugaccaggcacuaccguaa

SEQ ID NO: 637695 - RNA, 19 nt, Homo sapiens
gaggagcccaagccaaaga

SEQ ID NO: 637696 - RNA, 19 nt, Homo sapiens
acacaaagaguucccaucu

SEQ ID NO: 637697 - RNA, 19 nt, Homo sapiens
aaagacgcuuccaaguuau

SEQ ID NO: 637698 - RNA, 19 nt, Homo sapiens
ccgaggaguucaacgaucu

SEQ ID NO: 637699 - RNA, 19 nt, Homo sapiens
gagagagaccgaggaguuc

SEQ ID NO: 637700 - RNA, 19 nt, Homo sapiens
ccuugcugauugucuauuu

SEQ ID NO: 637701 - RNA, 19 nt, Homo sapiens
gaagacacugcgucaagca

SEQ ID NO: 637702 - RNA, 19 nt, Homo sapiens
gacuuuauucucuccaauu

SEQ ID NO: 637703 - RNA, 19 nt, Homo sapiens
ggaccuggacuuuauucuc

SEQ ID NO: 637704 - RNA, 19 nt, Homo sapiens
acgcgcugcucccaucuuu

SEQ ID NO: 637705 - RNA, 19 nt, Homo sapiens
aaaccuacacaaagaguuc

SEQ ID NO: 637706 - RNA, 19 nt, Homo sapiens
cauccuuccugcccgauca

SEQ ID NO: 637707 - RNA, 19 nt, Homo sapiens
caaagaguucccaucucaa

SEQ ID NO: 637708 - RNA, 19 nt, Homo sapiens
ucgccuugcugauugucua

SEQ ID NO: 637709 - RNA, 19 nt, Homo sapiens
uccuggaccuggacuuuau

SEQ ID NO: 637710 - RNA, 19 nt, Homo sapiens
gcgcugcucccaucuuucu

SEQ ID NO: 637711 - RNA, 19 nt, Homo sapiens
acgcuuccaaguuauauuu

SEQ ID NO: 637712 - RNA, 19 nt, Homo sapiens
gaacccacacaggugagaa

SEQ ID NO: 637713 - RNA, 19 nt, Homo sapiens
aaagaguucccaucucaag

SEQ ID NO: 637714 - RNA, 19 nt, Homo sapiens
cagaauuggacccggugua

SEQ ID NO: 637715 - RNA, 19 nt, Homo sapiens
caaccuggcggacaucaac

SEQ ID NO: 637716 - RNA, 19 nt, Homo sapiens
ggagaagacacugcgucaa

SEQ ID NO: 637717 - RNA, 19 nt, Homo sapiens
cacaaagaguucccaucuc

SEQ ID NO: 637718 - RNA, 19 nt, Homo sapiens
aaggaucucggccaauuug

SEQ ID NO: 637719 - RNA, 19 nt, Homo sapiens
gagagaccgaggaguucaa

SEQ ID NO: 637720 - RNA, 19 nt, Homo sapiens
cggaccaccucgccuuaca

SEQ ID NO: 637721 - RNA, 19 nt, Homo sapiens
gaauuggacccgguguaca

SEQ ID NO: 637722 - RNA, 19 nt, Homo sapiens
acuuuauucucuccaauuc

SEQ ID NO: 637723 - RNA, 19 nt, Homo sapiens
gcacgugccccaagaucaa

SEQ ID NO: 637724 - RNA, 19 nt, Homo sapiens
gcuccugcggccagaauug

SEQ ID NO: 637725 - RNA, 19 nt, Homo sapiens
gaccgaggaguucaacgau

SEQ ID NO: 637726 - RNA, 19 nt, Homo sapiens
ucccaucuuucuccacguu

SEQ ID NO: 637727 - RNA, 19 nt, Homo sapiens
uaagcaagguguagauuua

SEQ ID NO: 637728 - RNA, 19 nt, Homo sapiens
gcacugcacuucuucguuu

SEQ ID NO: 637729 - RNA, 19 nt, Homo sapiens
acaaauaggugucaucaaa

SEQ ID NO: 637730 - RNA, 19 nt, Homo sapiens
gaaaggauauuugucgaaa

SEQ ID NO: 637731 - RNA, 19 nt, Homo sapiens
gaagugaaccgcaagaaga

SEQ ID NO: 637732 - RNA, 19 nt, Homo sapiens
gaagagagggagaauagaa

SEQ ID NO: 637733 - RNA, 19 nt, Homo sapiens
cguaacaccuccauuugua

SEQ ID NO: 637734 - RNA, 19 nt, Homo sapiens
caagaaccauuuccaaaca

SEQ ID NO: 637735 - RNA, 19 nt, Homo sapiens
gaauagaagcccaagacua

SEQ ID NO: 637736 - RNA, 19 nt, Homo sapiens
ugaaagcccaccuuaauuu

SEQ ID NO: 637737 - RNA, 19 nt, Homo sapiens
aauagaagcccaagacuaa

SEQ ID NO: 637738 - RNA, 19 nt, Homo sapiens
acaaguacccaauguauuu

SEQ ID NO: 637739 - RNA, 19 nt, Homo sapiens
guucaucaauugucuguau

SEQ ID NO: 637740 - RNA, 19 nt, Homo sapiens
gcucagaauuucacacugu

SEQ ID NO: 637741 - RNA, 19 nt, Homo sapiens
gggcaggccuuguucugaa

SEQ ID NO: 637742 - RNA, 19 nt, Homo sapiens
ccaacgaaauggauaaaca

SEQ ID NO: 637743 - RNA, 19 nt, Homo sapiens
gagccuugcuuuagagaau

SEQ ID NO: 637744 - RNA, 19 nt, Homo sapiens
uaccaaaucucuuccuuuc

SEQ ID NO: 637745 - RNA, 19 nt, Homo sapiens
cugaguuucuugugcauua

SEQ ID NO: 637746 - RNA, 19 nt, Homo sapiens
ccaaaacacuggcaucuga

SEQ ID NO: 637747 - RNA, 19 nt, Homo sapiens
agacuggauugacuuguuu

SEQ ID NO: 637748 - RNA, 19 nt, Homo sapiens
uacgcaagcuguaagguaa

SEQ ID NO: 637749 - RNA, 19 nt, Homo sapiens
gguaucauauaugggauuu

SEQ ID NO: 637750 - RNA, 19 nt, Homo sapiens
caucugaguaggaauauga

SEQ ID NO: 637751 - RNA, 19 nt, Homo sapiens
ucaauugucuguauaucuc

SEQ ID NO: 637752 - RNA, 19 nt, Homo sapiens
gaggucaugguaucauaua

SEQ ID NO: 637753 - RNA, 19 nt, Homo sapiens
ugacaaguacccaauguau

SEQ ID NO: 637754 - RNA, 19 nt, Homo sapiens
cauggaauguuguuguguu

SEQ ID NO: 637755 - RNA, 19 nt, Homo sapiens
caacgaaauggauaaacaa

SEQ ID NO: 637756 - RNA, 19 nt, Homo sapiens
gaugcacucaugacaagua

SEQ ID NO: 637757 - RNA, 19 nt, Homo sapiens
gaaaacaaggucuacaaaa

SEQ ID NO: 637758 - RNA, 19 nt, Homo sapiens
cuguguaaaucaucaagua

SEQ ID NO: 637759 - RNA, 19 nt, Homo sapiens
uaacaccuccauuuguauu

SEQ ID NO: 637760 - RNA, 19 nt, Homo sapiens
aaucguaacaccuccauuu

SEQ ID NO: 637761 - RNA, 19 nt, Homo sapiens
gacaaguacccaauguauu

SEQ ID NO: 637762 - RNA, 19 nt, Homo sapiens
agugugaucuuuacugaug

SEQ ID NO: 637763 - RNA, 19 nt, Homo sapiens
gcauuuauguagaguugca

SEQ ID NO: 637764 - RNA, 19 nt, Homo sapiens
uagacuggauugacuuguu

SEQ ID NO: 637765 - RNA, 19 nt, Homo sapiens
acaacaaugucuuccacaa

SEQ ID NO: 637766 - RNA, 19 nt, Homo sapiens
gagaauagaagcccaagac

SEQ ID NO: 637767 - RNA, 19 nt, Homo sapiens
caugacaaguacccaaugu

SEQ ID NO: 637768 - RNA, 19 nt, Homo sapiens
ugacagggcaggccuuguu

SEQ ID NO: 637769 - RNA, 19 nt, Homo sapiens
aaauuaccaucuacucaug

SEQ ID NO: 637770 - RNA, 19 nt, Homo sapiens
cauucugacucaagugaaa

SEQ ID NO: 637771 - RNA, 19 nt, Homo sapiens
ugaacuguuucgcuucuga

SEQ ID NO: 637772 - RNA, 19 nt, Homo sapiens
cuaagaagguguugguacu

SEQ ID NO: 637773 - RNA, 19 nt, Homo sapiens
uggcauuuauguagaguug

SEQ ID NO: 637774 - RNA, 19 nt, Homo sapiens
cugcaucuguggcauuuau

SEQ ID NO: 637775 - RNA, 19 nt, Homo sapiens
ucugaaagcccaccuuaau

SEQ ID NO: 637776 - RNA, 19 nt, Homo sapiens
gauaagcaagguguagauu

SEQ ID NO: 637777 - RNA, 19 nt, Homo sapiens
gaugaauggugcuauuuug

SEQ ID NO: 637778 - RNA, 19 nt, Homo sapiens
gagcgaaugcuaccagagu

SEQ ID NO: 637779 - RNA, 19 nt, Homo sapiens
ccuaguaguuuauguucau

SEQ ID NO: 637780 - RNA, 19 nt, Homo sapiens
ggaagugaaccgcaagaag

SEQ ID NO: 637781 - RNA, 19 nt, Homo sapiens
gucaagaaccauuuccaaa

SEQ ID NO: 637782 - RNA, 19 nt, Homo sapiens
uguaacagugugaucuuua

SEQ ID NO: 637783 - RNA, 19 nt, Homo sapiens
gaaagcccaccuuaauuuu

SEQ ID NO: 637784 - RNA, 19 nt, Homo sapiens
ggaauguuguuguguuagc

SEQ ID NO: 637785 - RNA, 19 nt, Homo sapiens
cauguacucuuuugaugua

SEQ ID NO: 637786 - RNA, 19 nt, Homo sapiens
cacugugaauccacguuua

SEQ ID NO: 637787 - RNA, 19 nt, Homo sapiens
ggucaugguaucauauaug

SEQ ID NO: 637788 - RNA, 19 nt, Homo sapiens
guacucuguuucccugaau

SEQ ID NO: 637789 - RNA, 19 nt, Homo sapiens
gguacucuguuucccugaa

SEQ ID NO: 637790 - RNA, 19 nt, Homo sapiens
uagcucugauggaguuauu

SEQ ID NO: 637791 - RNA, 19 nt, Homo sapiens
ggacugaagagagggagaa

SEQ ID NO: 637792 - RNA, 19 nt, Homo sapiens
ggucagucaagaaccauuu

SEQ ID NO: 637793 - RNA, 19 nt, Homo sapiens
gaauguuguucucuagacu

SEQ ID NO: 637794 - RNA, 19 nt, Homo sapiens
gugaaaacgcucagaauuu

SEQ ID NO: 637795 - RNA, 19 nt, Homo sapiens
caaucugucuuucuagcau

SEQ ID NO: 637796 - RNA, 19 nt, Homo sapiens
auggaauguuguuguguua

SEQ ID NO: 637797 - RNA, 19 nt, Homo sapiens
ggaaaacaaggucuacaaa

SEQ ID NO: 637798 - RNA, 19 nt, Homo sapiens
ccucaguguuguagguuga

SEQ ID NO: 637799 - RNA, 19 nt, Homo sapiens
cugagacacugaugaaugg

SEQ ID NO: 637800 - RNA, 19 nt, Homo sapiens
uguaacaaaccuaguaguu

SEQ ID NO: 637801 - RNA, 19 nt, Homo sapiens
ggacucugagccuugcuuu

SEQ ID NO: 637802 - RNA, 19 nt, Homo sapiens
gucaugguaucauauaugg

SEQ ID NO: 637803 - RNA, 19 nt, Homo sapiens
uguguuagccagucugaaa

SEQ ID NO: 637804 - RNA, 19 nt, Homo sapiens
gagucucucucucccuuuc

SEQ ID NO: 637805 - RNA, 19 nt, Homo sapiens
agauguaacaaaccuagua

SEQ ID NO: 637806 - RNA, 19 nt, Homo sapiens
cugaaagcccaccuuaauu

SEQ ID NO: 637807 - RNA, 19 nt, Homo sapiens
gaagguguugguacucugu

SEQ ID NO: 637808 - RNA, 19 nt, Homo sapiens
ucaagaaccauuuccaaac

SEQ ID NO: 637809 - RNA, 19 nt, Homo sapiens
uggcaucugaguaggaaua

SEQ ID NO: 637810 - RNA, 19 nt, Homo sapiens
aaacacuggcaucugagua

SEQ ID NO: 637811 - RNA, 19 nt, Homo sapiens
aagaaccauuuccaaacaa

SEQ ID NO: 637812 - RNA, 19 nt, Homo sapiens
gccuugcuuuagagaauuu

SEQ ID NO: 637813 - RNA, 19 nt, Homo sapiens
guaacaccuccauuuguau

SEQ ID NO: 637814 - RNA, 19 nt, Homo sapiens
auaaauacgcaagcuguaa

SEQ ID NO: 637815 - RNA, 19 nt, Homo sapiens
cugaagagagggagaauag

SEQ ID NO: 637816 - RNA, 19 nt, Homo sapiens
caucuguggcauuuaugua

SEQ ID NO: 637817 - RNA, 19 nt, Homo sapiens
uagaagcccaagacuaaga

SEQ ID NO: 637818 - RNA, 19 nt, Homo sapiens
ugaaaggauauuugucgaa

SEQ ID NO: 637819 - RNA, 19 nt, Homo sapiens
uuacuuaccaaaucucuuc

SEQ ID NO: 637820 - RNA, 19 nt, Homo sapiens
acugaugaauggugcuauu

SEQ ID NO: 637821 - RNA, 19 nt, Homo sapiens
acacagcucccgacugcuu

SEQ ID NO: 637822 - RNA, 19 nt, Homo sapiens
gaaugcuaccagaguguga

SEQ ID NO: 637823 - RNA, 19 nt, Homo sapiens
ccugagacacugaugaaug

SEQ ID NO: 637824 - RNA, 19 nt, Homo sapiens
caucaauugucuguauauc

SEQ ID NO: 637825 - RNA, 19 nt, Homo sapiens
ccgguccacuccugccuuu

SEQ ID NO: 637826 - RNA, 19 nt, Homo sapiens
aacaaugucuuccacaacu

SEQ ID NO: 637827 - RNA, 19 nt, Homo sapiens
uaacaaaggccacaauuua

SEQ ID NO: 637828 - RNA, 19 nt, Homo sapiens
caaauaggaugguugcuua

SEQ ID NO: 637829 - RNA, 19 nt, Homo sapiens
gaacagaaaguaacaaaga

SEQ ID NO: 637830 - RNA, 19 nt, Homo sapiens
aggaagaacuguuguauuu

SEQ ID NO: 637831 - RNA, 19 nt, Homo sapiens
ggucacggcuauucucaua

SEQ ID NO: 637832 - RNA, 19 nt, Homo sapiens
caaagaaccuaucgugaug

SEQ ID NO: 637833 - RNA, 19 nt, Homo sapiens
aaacccggcugaugaaaua

SEQ ID NO: 637834 - RNA, 19 nt, Homo sapiens
caaaggauacugacuguaa

SEQ ID NO: 637835 - RNA, 19 nt, Homo sapiens
gaagagggcugugaagauc

SEQ ID NO: 637836 - RNA, 19 nt, Homo sapiens
ucagaaaugucuuccuuaa

SEQ ID NO: 637837 - RNA, 19 nt, Homo sapiens
ggucagaucuauuggaaau

SEQ ID NO: 637838 - RNA, 19 nt, Homo sapiens
ucacaaagaccaauuagaa

SEQ ID NO: 637839 - RNA, 19 nt, Homo sapiens
gaacacauaacacuacuga

SEQ ID NO: 637840 - RNA, 19 nt, Homo sapiens
gaugguugcuuaugaauuc

SEQ ID NO: 637841 - RNA, 19 nt, Homo sapiens
ugaauaauauggcacugua

SEQ ID NO: 637842 - RNA, 19 nt, Homo sapiens
ucacggcuauucucauaua

SEQ ID NO: 637843 - RNA, 19 nt, Homo sapiens
gcacugcugcuuauaaauu

SEQ ID NO: 637844 - RNA, 19 nt, Homo sapiens
cagcuugguuguccuguua

SEQ ID NO: 637845 - RNA, 19 nt, Homo sapiens
gcaacucacuccucagaga

SEQ ID NO: 637846 - RNA, 19 nt, Homo sapiens
ugaagaggcuugcagaaga

SEQ ID NO: 637847 - RNA, 19 nt, Homo sapiens
gaucaagcuuucuguguau

SEQ ID NO: 637848 - RNA, 19 nt, Homo sapiens
gaaugugcuugauaagauu

SEQ ID NO: 637849 - RNA, 19 nt, Homo sapiens
agaaaugucuuccuuaagu

SEQ ID NO: 637850 - RNA, 19 nt, Homo sapiens
uaaaauagcuucugcaaca

SEQ ID NO: 637851 - RNA, 19 nt, Homo sapiens
gggcacugcugcuuauaaa

SEQ ID NO: 637852 - RNA, 19 nt, Homo sapiens
caacaagggaaguuaaauu

SEQ ID NO: 637853 - RNA, 19 nt, Homo sapiens
gaaaugucuuccuuaagug

SEQ ID NO: 637854 - RNA, 19 nt, Homo sapiens
ucaccaauguuguuccuaa

SEQ ID NO: 637855 - RNA, 19 nt, Homo sapiens
caucagaaaugucuuccuu

SEQ ID NO: 637856 - RNA, 19 nt, Homo sapiens
guugagcuuugcuaaauaa

SEQ ID NO: 637857 - RNA, 19 nt, Homo sapiens
gagaaauguuugccuuaug

SEQ ID NO: 637858 - RNA, 19 nt, Homo sapiens
auucacaccuugaguauaa

SEQ ID NO: 637859 - RNA, 19 nt, Homo sapiens
ugaucaagcuuucugugua

SEQ ID NO: 637860 - RNA, 19 nt, Homo sapiens
gaauaugaucucuuuggua

SEQ ID NO: 637861 - RNA, 19 nt, Homo sapiens
uaucaaguguggcauuauu

SEQ ID NO: 637862 - RNA, 19 nt, Homo sapiens
gccaguuccucuuugauaa

SEQ ID NO: 637863 - RNA, 19 nt, Homo sapiens
gaaaaggucagaucuauug

SEQ ID NO: 637864 - RNA, 19 nt, Homo sapiens
gaccagcuauuacaacugu

SEQ ID NO: 637865 - RNA, 19 nt, Homo sapiens
cagagaacauucagcgauu

SEQ ID NO: 637866 - RNA, 19 nt, Homo sapiens
gcacaugacauacauacga

SEQ ID NO: 637867 - RNA, 19 nt, Homo sapiens
gaaguugagcuuugcuaaa

SEQ ID NO: 637868 - RNA, 19 nt, Homo sapiens
ucagaucuauuggaaauga

SEQ ID NO: 637869 - RNA, 19 nt, Homo sapiens
gaugggcacugcugcuuau

SEQ ID NO: 637870 - RNA, 19 nt, Homo sapiens
cugagaaugugcuugauaa

SEQ ID NO: 637871 - RNA, 19 nt, Homo sapiens
ggaauaugaucucuuuggu

SEQ ID NO: 637872 - RNA, 19 nt, Homo sapiens
gaagaggcuugcagaagag

SEQ ID NO: 637873 - RNA, 19 nt, Homo sapiens
agaaugugcuugauaagau

SEQ ID NO: 637874 - RNA, 19 nt, Homo sapiens
gacagaagccauaaaggaa

SEQ ID NO: 637875 - RNA, 19 nt, Homo sapiens
gauaggcacaccaugcaua

SEQ ID NO: 637876 - RNA, 19 nt, Homo sapiens
cuugagcgaucuaauguuu

SEQ ID NO: 637877 - RNA, 19 nt, Homo sapiens
uaacugagaaugugcuuga

SEQ ID NO: 637878 - RNA, 19 nt, Homo sapiens
gagagaaaccgcauucaca

SEQ ID NO: 637879 - RNA, 19 nt, Homo sapiens
agaaauguuugccuuaugu

SEQ ID NO: 637880 - RNA, 19 nt, Homo sapiens
ggaagagggcugugaagau

SEQ ID NO: 637881 - RNA, 19 nt, Homo sapiens
ugacugagagugaaagaaa

SEQ ID NO: 637882 - RNA, 19 nt, Homo sapiens
ccgauguccuuaugaauga

SEQ ID NO: 637883 - RNA, 19 nt, Homo sapiens
gagaacaaacuaauuccaa

SEQ ID NO: 637884 - RNA, 19 nt, Homo sapiens
ccaccuaucuauauauucu

SEQ ID NO: 637885 - RNA, 19 nt, Homo sapiens
ucuaucagcugcacuacuu

SEQ ID NO: 637886 - RNA, 19 nt, Homo sapiens
ugacaugccugaugauaac

SEQ ID NO: 637887 - RNA, 19 nt, Homo sapiens
gcugcuacuuggaauauga

SEQ ID NO: 637888 - RNA, 19 nt, Homo sapiens
aaacgccuauucccauaaa

SEQ ID NO: 637889 - RNA, 19 nt, Homo sapiens
cgaguuaccuguagucaac

SEQ ID NO: 637890 - RNA, 19 nt, Homo sapiens
ggaaguugagcuuugcuaa

SEQ ID NO: 637891 - RNA, 19 nt, Homo sapiens
ccaaagaaccuaucgugau

SEQ ID NO: 637892 - RNA, 19 nt, Homo sapiens
caagggaaguuaaauuuug

SEQ ID NO: 637893 - RNA, 19 nt, Homo sapiens
guauaaaacuugcagagaa

SEQ ID NO: 637894 - RNA, 19 nt, Homo sapiens
gaauucacaccuugaguau

SEQ ID NO: 637895 - RNA, 19 nt, Homo sapiens
caacucggcccagauauug

SEQ ID NO: 637896 - RNA, 19 nt, Homo sapiens
cuuggaauaugaucucuuu

SEQ ID NO: 637897 - RNA, 19 nt, Homo sapiens
gaagcuauuuccaaagaac

SEQ ID NO: 637898 - RNA, 19 nt, Homo sapiens
gaaauguuugccuuaugua

SEQ ID NO: 637899 - RNA, 19 nt, Homo sapiens
gagaaaccgcauucacaaa

SEQ ID NO: 637900 - RNA, 19 nt, Homo sapiens
ggaaaugacagcccgauac

SEQ ID NO: 637901 - RNA, 19 nt, Homo sapiens
acacauaacacuacugaau

SEQ ID NO: 637902 - RNA, 19 nt, Homo sapiens
ugaauucacaccuugagua

SEQ ID NO: 637903 - RNA, 19 nt, Homo sapiens
gagaaugugcuugauaaga

SEQ ID NO: 637904 - RNA, 19 nt, Homo sapiens
gaauucugguagcacauga

SEQ ID NO: 637905 - RNA, 19 nt, Homo sapiens
cagcugcacuacuugagaa

SEQ ID NO: 637906 - RNA, 19 nt, Homo sapiens
auacagaaguaccuauuuc

SEQ ID NO: 637907 - RNA, 19 nt, Homo sapiens
ccuaagcaauggcuaacuu

SEQ ID NO: 637908 - RNA, 19 nt, Homo sapiens
uaaaggaagaacuguugua

SEQ ID NO: 637909 - RNA, 19 nt, Homo sapiens
cauaaaggaagaacuguug

SEQ ID NO: 637910 - RNA, 19 nt, Homo sapiens
cagaagccauaaaggaaga

SEQ ID NO: 637911 - RNA, 19 nt, Homo sapiens
ggagacagaagccauaaag

SEQ ID NO: 637912 - RNA, 19 nt, Homo sapiens
ggaaugagccaggagaaca

SEQ ID NO: 637913 - RNA, 19 nt, Homo sapiens
gaaaguaacaaagaggaau

SEQ ID NO: 637914 - RNA, 19 nt, Homo sapiens
uaacaccaccuucagauag

SEQ ID NO: 637915 - RNA, 19 nt, Homo sapiens
gauauugacaugccugaug

SEQ ID NO: 637916 - RNA, 19 nt, Homo sapiens
gggcaccauuucagauuau

SEQ ID NO: 637917 - RNA, 19 nt, Homo sapiens
gaagagacuggcguccaua

SEQ ID NO: 637918 - RNA, 19 nt, Homo sapiens
ccauugcaauucauuuaug

SEQ ID NO: 637919 - RNA, 19 nt, Homo sapiens
gagaaggcagcgcguugua

SEQ ID NO: 637920 - RNA, 19 nt, Homo sapiens
gcuccuggccuuugacuga

SEQ ID NO: 637921 - RNA, 19 nt, Homo sapiens
gagacuggcguccauauca

SEQ ID NO: 637922 - RNA, 19 nt, Homo sapiens
agacagaagccauaaagga

SEQ ID NO: 637923 - RNA, 19 nt, Homo sapiens
ucaauuaaaucaggagaca

SEQ ID NO: 637924 - RNA, 19 nt, Homo sapiens
gaaccuaucgugaugaaaa

SEQ ID NO: 637925 - RNA, 19 nt, Homo sapiens
gcuuauguaucugaagaaa

SEQ ID NO: 637926 - RNA, 19 nt, Homo sapiens
gagaccagcuauuacaacu

SEQ ID NO: 637927 - RNA, 19 nt, Homo sapiens
gaacacaagugcuuauaaa

SEQ ID NO: 637928 - RNA, 19 nt, Homo sapiens
gcacugaaacaaaugauua

SEQ ID NO: 637929 - RNA, 19 nt, Homo sapiens
gcagagauguaauccuuaa

SEQ ID NO: 637930 - RNA, 19 nt, Homo sapiens
guaagugccuaucagaaua

SEQ ID NO: 637931 - RNA, 19 nt, Homo sapiens
aaacaacacuggaagcuuu

SEQ ID NO: 637932 - RNA, 19 nt, Homo sapiens
caaauaaccugcaauaacu

SEQ ID NO: 637933 - RNA, 19 nt, Homo sapiens
ugacaucacugaauuugaa

SEQ ID NO: 637934 - RNA, 19 nt, Homo sapiens
ggaauacucugaagauagu

SEQ ID NO: 637935 - RNA, 19 nt, Homo sapiens
gagggaaggugaauuugaa

SEQ ID NO: 637936 - RNA, 19 nt, Homo sapiens
uaaacuggcuuaacagaga

SEQ ID NO: 637937 - RNA, 19 nt, Homo sapiens
gauagacugugguuuaaga

SEQ ID NO: 637938 - RNA, 19 nt, Homo sapiens
ggaauucuaugaaacaaca

SEQ ID NO: 637939 - RNA, 19 nt, Homo sapiens
ugaaagaugcuaagaauga

SEQ ID NO: 637940 - RNA, 19 nt, Homo sapiens
ggagugcagucacaagaaa

SEQ ID NO: 637941 - RNA, 19 nt, Homo sapiens
gcuuuaaucuccagaagaa

SEQ ID NO: 637942 - RNA, 19 nt, Homo sapiens
gaauagauauaagcagcua

SEQ ID NO: 637943 - RNA, 19 nt, Homo sapiens
gcaaugacgaauuuaguaa

SEQ ID NO: 637944 - RNA, 19 nt, Homo sapiens
ucacaaauaaccugcaaua

SEQ ID NO: 637945 - RNA, 19 nt, Homo sapiens
gugcagagauguaauccuu

SEQ ID NO: 637946 - RNA, 19 nt, Homo sapiens
gcaauaacuugaaaugcau

SEQ ID NO: 637947 - RNA, 19 nt, Homo sapiens
gaacauuccuuuucucaug

SEQ ID NO: 637948 - RNA, 19 nt, Homo sapiens
gcauuaagcaguuuccaaa

SEQ ID NO: 637949 - RNA, 19 nt, Homo sapiens
gaucaacugguuuguguuu

SEQ ID NO: 637950 - RNA, 19 nt, Homo sapiens
caaccaggcuguagucagu

SEQ ID NO: 637951 - RNA, 19 nt, Homo sapiens
gaaagaugcuaagaaugau

SEQ ID NO: 637952 - RNA, 19 nt, Homo sapiens
uaagagaacacauugaaga

SEQ ID NO: 637953 - RNA, 19 nt, Homo sapiens
cagagaauguggugguaaa

SEQ ID NO: 637954 - RNA, 19 nt, Homo sapiens
gguacacaguuauuagaaa

SEQ ID NO: 637955 - RNA, 19 nt, Homo sapiens
aaugauagacugugguuua

SEQ ID NO: 637956 - RNA, 19 nt, Homo sapiens
gaacagucacuucacauca

SEQ ID NO: 637957 - RNA, 19 nt, Homo sapiens
uuaaagcacucuaugaaca

SEQ ID NO: 637958 - RNA, 19 nt, Homo sapiens
acacaaagcuuggaaaauu

SEQ ID NO: 637959 - RNA, 19 nt, Homo sapiens
aagcagcuauugaccuaua

SEQ ID NO: 637960 - RNA, 19 nt, Homo sapiens
gaauauggaaagcuucaaa

SEQ ID NO: 637961 - RNA, 19 nt, Homo sapiens
aaaagaagaugacccaaaa

SEQ ID NO: 637962 - RNA, 19 nt, Homo sapiens
caacagugcagagauguaa

SEQ ID NO: 637963 - RNA, 19 nt, Homo sapiens
uaaauggaccaaccaacua

SEQ ID NO: 637964 - RNA, 19 nt, Homo sapiens
gauauacugcacuagauaa

SEQ ID NO: 637965 - RNA, 19 nt, Homo sapiens
cuaaggaguuaaacauaga

SEQ ID NO: 637966 - RNA, 19 nt, Homo sapiens
cauaagagaacacauugaa

SEQ ID NO: 637967 - RNA, 19 nt, Homo sapiens
ggaccaaccaacuaaauuc

SEQ ID NO: 637968 - RNA, 19 nt, Homo sapiens
gauuuaugcuguauugaca

SEQ ID NO: 637969 - RNA, 19 nt, Homo sapiens
auaagcagcuauugaccua

SEQ ID NO: 637970 - RNA, 19 nt, Homo sapiens
agacgaaaccccauaauua

SEQ ID NO: 637971 - RNA, 19 nt, Homo sapiens
aaacagugcagcucagaaa

SEQ ID NO: 637972 - RNA, 19 nt, Homo sapiens
guacuauaauuccaaagca

SEQ ID NO: 637973 - RNA, 19 nt, Homo sapiens
gcaggaauucuaugaaaca

SEQ ID NO: 637974 - RNA, 19 nt, Homo sapiens
gcagucacaagaaauuauu

SEQ ID NO: 637975 - RNA, 19 nt, Homo sapiens
guuucaagccggcaaauaa

SEQ ID NO: 637976 - RNA, 19 nt, Homo sapiens
auacugcacuagauaaaug

SEQ ID NO: 637977 - RNA, 19 nt, Homo sapiens
cugcaggaauucuaugaaa

SEQ ID NO: 637978 - RNA, 19 nt, Homo sapiens
cagugcagcucagaaauug

SEQ ID NO: 637979 - RNA, 19 nt, Homo sapiens
gugcagcucagaaauugua

SEQ ID NO: 637980 - RNA, 19 nt, Homo sapiens
agacgaaccacuugcuuaa

SEQ ID NO: 637981 - RNA, 19 nt, Homo sapiens
gaacgagaggaauauggaa

SEQ ID NO: 637982 - RNA, 19 nt, Homo sapiens
gacugugguuuaagacaaa

SEQ ID NO: 637983 - RNA, 19 nt, Homo sapiens
ccaacuaaauucucucaac

SEQ ID NO: 637984 - RNA, 19 nt, Homo sapiens
gaacuggaucaucagaaga

SEQ ID NO: 637985 - RNA, 19 nt, Homo sapiens
ucuaaggaguuaaacauag

SEQ ID NO: 637986 - RNA, 19 nt, Homo sapiens
gugccuaucagaauaauga

SEQ ID NO: 637987 - RNA, 19 nt, Homo sapiens
gauauaagcagcuauugac

SEQ ID NO: 637988 - RNA, 19 nt, Homo sapiens
ccauaauuauaguggcaua

SEQ ID NO: 637989 - RNA, 19 nt, Homo sapiens
acaaauaaccugcaauaac

SEQ ID NO: 637990 - RNA, 19 nt, Homo sapiens
caacaugaccagagagaag

SEQ ID NO: 637991 - RNA, 19 nt, Homo sapiens
ccagacugaugauggagaa

SEQ ID NO: 637992 - RNA, 19 nt, Homo sapiens
agaggaauauggaaagcuu

SEQ ID NO: 637993 - RNA, 19 nt, Homo sapiens
cacaaagcuuggaaaauua

SEQ ID NO: 637994 - RNA, 19 nt, Homo sapiens
cgauauacugcacuagaua

SEQ ID NO: 637995 - RNA, 19 nt, Homo sapiens
caucagaacacaagugcuu

SEQ ID NO: 637996 - RNA, 19 nt, Homo sapiens
ccagaaaugaugaauagau

SEQ ID NO: 637997 - RNA, 19 nt, Homo sapiens
acacgcuacuguugguuaa

SEQ ID NO: 637998 - RNA, 19 nt, Homo sapiens
gcaacagugcagagaugua

SEQ ID NO: 637999 - RNA, 19 nt, Homo sapiens
gcauauuggauaacacuau

SEQ ID NO: 638000 - RNA, 19 nt, Homo sapiens
agaauaaugacaucacuga

SEQ ID NO: 638001 - RNA, 19 nt, Homo sapiens
ccacugauuaugggaguua

SEQ ID NO: 638002 - RNA, 19 nt, Homo sapiens
gaaacaacacuggaagcuu

SEQ ID NO: 638003 - RNA, 19 nt, Homo sapiens
uggauuuacugcaggaauu

SEQ ID NO: 638004 - RNA, 19 nt, Homo sapiens
cuucuaaacagauggauuu

SEQ ID NO: 638005 - RNA, 19 nt, Homo sapiens
ugacauggaggaugauuuc

SEQ ID NO: 638006 - RNA, 19 nt, Homo sapiens
uaacagagaacaagcuuuu

SEQ ID NO: 638007 - RNA, 19 nt, Homo sapiens
ccaaccaacuaaauucucu

SEQ ID NO: 638008 - RNA, 19 nt, Homo sapiens
ugaacuggaucaucagaag

SEQ ID NO: 638009 - RNA, 19 nt, Homo sapiens
gaagagcuuuugcgaaaca

SEQ ID NO: 638010 - RNA, 19 nt, Homo sapiens
uaagugccuaucagaauaa

SEQ ID NO: 638011 - RNA, 19 nt, Homo sapiens
gacacgcuacuguugguua

SEQ ID NO: 638012 - RNA, 19 nt, Homo sapiens
cuaaacguacaacaucaua

SEQ ID NO: 638013 - RNA, 19 nt, Homo sapiens
aaacuacugucgguugaug

SEQ ID NO: 638014 - RNA, 19 nt, Homo sapiens
uuccagaaaugaugaauag

SEQ ID NO: 638015 - RNA, 19 nt, Homo sapiens
cgaaacaucagaacacaag

SEQ ID NO: 638016 - RNA, 19 nt, Homo sapiens
gaacacauugaagagcuuu

SEQ ID NO: 638017 - RNA, 19 nt, Homo sapiens
gaauaaugacaucacugaa

SEQ ID NO: 638018 - RNA, 19 nt, Homo sapiens
agacugugguuuaagacaa

SEQ ID NO: 638019 - RNA, 19 nt, Homo sapiens
ggacuacgaccuggaauac

SEQ ID NO: 638020 - RNA, 19 nt, Homo sapiens
aaacuggcuuaacagagaa

SEQ ID NO: 638021 - RNA, 19 nt, Homo sapiens
acaaaucacagcaacauca

SEQ ID NO: 638022 - RNA, 19 nt, Homo sapiens
gaauuuaguaagugccuau

SEQ ID NO: 638023 - RNA, 19 nt, Homo sapiens
gauuaugggaguuaucaga

SEQ ID NO: 638024 - RNA, 19 nt, Homo sapiens
ggaggacuacgaccuggaa

SEQ ID NO: 638025 - RNA, 19 nt, Homo sapiens
ugggauuuaugcuguauug

SEQ ID NO: 638026 - RNA, 19 nt, Homo sapiens
ggaguuaucagagaaugug

SEQ ID NO: 638027 - RNA, 19 nt, Homo sapiens
gaaagaacauguuaccuua

SEQ ID NO: 638028 - RNA, 19 nt, Homo sapiens
gaugacaacuuuacuguuu

SEQ ID NO: 638029 - RNA, 19 nt, Homo sapiens
guaccgauauggccaauua

SEQ ID NO: 638030 - RNA, 19 nt, Homo sapiens
ggacagggcugacaucaag

SEQ ID NO: 638031 - RNA, 19 nt, Homo sapiens
gacauaaaccugaguguua

SEQ ID NO: 638032 - RNA, 19 nt, Homo sapiens
uaaccaagauguuucagaa

SEQ ID NO: 638033 - RNA, 19 nt, Homo sapiens
caacagacauaauauugug

SEQ ID NO: 638034 - RNA, 19 nt, Homo sapiens
gaaacugugucacccuaaa

SEQ ID NO: 638035 - RNA, 19 nt, Homo sapiens
gcaaaccaaacguuacuua

SEQ ID NO: 638036 - RNA, 19 nt, Homo sapiens
gggcugacaucaagcagua

SEQ ID NO: 638037 - RNA, 19 nt, Homo sapiens
gaaaguggcaagcugguaa

SEQ ID NO: 638038 - RNA, 19 nt, Homo sapiens
ggcaauugcuuucugauau

SEQ ID NO: 638039 - RNA, 19 nt, Homo sapiens
gaagauuaaugcagguguu

SEQ ID NO: 638040 - RNA, 19 nt, Homo sapiens
aaaucuaccucucuuguuu

SEQ ID NO: 638041 - RNA, 19 nt, Homo sapiens
gcaaaucacuggguucuac

SEQ ID NO: 638042 - RNA, 19 nt, Homo sapiens
uaaugcagguguuauagaa

SEQ ID NO: 638043 - RNA, 19 nt, Homo sapiens
gcuugcagcuuacaucuga

SEQ ID NO: 638044 - RNA, 19 nt, Homo sapiens
uggaagaacugaugaagug

SEQ ID NO: 638045 - RNA, 19 nt, Homo sapiens
gaaagcuacucaacagaca

SEQ ID NO: 638046 - RNA, 19 nt, Homo sapiens
gcaaagaaagaagacauaa

SEQ ID NO: 638047 - RNA, 19 nt, Homo sapiens
gcaauugcuuucugauauc

SEQ ID NO: 638048 - RNA, 19 nt, Homo sapiens
gacauaauauuguguuugg

SEQ ID NO: 638049 - RNA, 19 nt, Homo sapiens
cuacucaacagacauaaua

SEQ ID NO: 638050 - RNA, 19 nt, Homo sapiens
guaaagcguuagcccagaa

SEQ ID NO: 638051 - RNA, 19 nt, Homo sapiens
ugaagugucagaucauaua

SEQ ID NO: 638052 - RNA, 19 nt, Homo sapiens
gauuaaugcagguguuaua

SEQ ID NO: 638053 - RNA, 19 nt, Homo sapiens
caagauguuucagaagauu

SEQ ID NO: 638054 - RNA, 19 nt, Homo sapiens
gaagauucaggauuugauu

SEQ ID NO: 638055 - RNA, 19 nt, Homo sapiens
gacccaaauugaucagauu

SEQ ID NO: 638056 - RNA, 19 nt, Homo sapiens
ugaaagaacauguuaccuu

SEQ ID NO: 638057 - RNA, 19 nt, Homo sapiens
gaaaacaacgugucaaaau

SEQ ID NO: 638058 - RNA, 19 nt, Homo sapiens
uucagaagauucaggauuu

SEQ ID NO: 638059 - RNA, 19 nt, Homo sapiens
acacauggacugaguuuga

SEQ ID NO: 638060 - RNA, 19 nt, Homo sapiens
ccaaggccaggcuuuguua

SEQ ID NO: 638061 - RNA, 19 nt, Homo sapiens
cuaccucucuuguuuggaa

SEQ ID NO: 638062 - RNA, 19 nt, Homo sapiens
acaagaacgucaacagcaa

SEQ ID NO: 638063 - RNA, 19 nt, Homo sapiens
gaacauguuaccuuaccuu

SEQ ID NO: 638064 - RNA, 19 nt, Homo sapiens
gacaagcaguuugaagaga

SEQ ID NO: 638065 - RNA, 19 nt, Homo sapiens
uuacuuagacugcaagcua

SEQ ID NO: 638066 - RNA, 19 nt, Homo sapiens
uauagaagccagaagagaa

SEQ ID NO: 638067 - RNA, 19 nt, Homo sapiens
gcacugcaaagaaagaaga

SEQ ID NO: 638068 - RNA, 19 nt, Homo sapiens
uuagaaagcuacucaacag

SEQ ID NO: 638069 - RNA, 19 nt, Homo sapiens
ucaagcagguaccgauaug

SEQ ID NO: 638070 - RNA, 19 nt, Homo sapiens
ggaagagacagaaaacaua

SEQ ID NO: 638071 - RNA, 19 nt, Homo sapiens
acucacagcccaucgauuu

SEQ ID NO: 638072 - RNA, 19 nt, Homo sapiens
gaagguggcaauugcuuuc

SEQ ID NO: 638073 - RNA, 19 nt, Homo sapiens
ggaagguggcaauugcuuu

SEQ ID NO: 638074 - RNA, 19 nt, Homo sapiens
ccaagauguuucagaagau

SEQ ID NO: 638075 - RNA, 19 nt, Homo sapiens
gaagagacagaaaacauaa

SEQ ID NO: 638076 - RNA, 19 nt, Homo sapiens
gugaaaaucuggaggaaga

SEQ ID NO: 638077 - RNA, 19 nt, Homo sapiens
gguggcaauugcuuucuga

SEQ ID NO: 638078 - RNA, 19 nt, Homo sapiens
aaaccaaacguuacuuaga

SEQ ID NO: 638079 - RNA, 19 nt, Homo sapiens
acaauuagacuuucaagca

SEQ ID NO: 638080 - RNA, 19 nt, Homo sapiens
caaaucccaucuccucgau

SEQ ID NO: 638081 - RNA, 19 nt, Homo sapiens
gauuacacauggacugagu

SEQ ID NO: 638082 - RNA, 19 nt, Homo sapiens
aaacagccacagccucuuu

SEQ ID NO: 638083 - RNA, 19 nt, Homo sapiens
caacuuuacuguuuucaga

SEQ ID NO: 638084 - RNA, 19 nt, Homo sapiens
gaccagaaaugugcagucu

SEQ ID NO: 638085 - RNA, 19 nt, Homo sapiens
cugcauugcugggauguuu

SEQ ID NO: 638086 - RNA, 19 nt, Homo sapiens
ggacaagcaguuugaagag

SEQ ID NO: 638087 - RNA, 19 nt, Homo sapiens
aaacaucccuguguaaagc

SEQ ID NO: 638088 - RNA, 19 nt, Homo sapiens
cauguuaccuuaccuuuug

SEQ ID NO: 638089 - RNA, 19 nt, Homo sapiens
gguggaagguggcaauugc

SEQ ID NO: 638090 - RNA, 19 nt, Homo sapiens
caagcaguuugaagagaga

SEQ ID NO: 638091 - RNA, 19 nt, Homo sapiens
uaaagacgcccugguguuc

SEQ ID NO: 638092 - RNA, 19 nt, Homo sapiens
ggaaaguggcaagcuggua

SEQ ID NO: 638093 - RNA, 19 nt, Homo sapiens
gguauacgauguggaaguc

SEQ ID NO: 638094 - RNA, 19 nt, Homo sapiens
accaagauguuucagaaga

SEQ ID NO: 638095 - RNA, 19 nt, Homo sapiens
auuaaugguuugcauguga

SEQ ID NO: 638096 - RNA, 19 nt, Homo sapiens
uaacaucaccgagaagauc

SEQ ID NO: 638097 - RNA, 19 nt, Homo sapiens
ucagaagauucaggauuug

SEQ ID NO: 638098 - RNA, 19 nt, Homo sapiens
caauugcuuucugauauca

SEQ ID NO: 638099 - RNA, 19 nt, Homo sapiens
cagaagagaaacuguguca

SEQ ID NO: 638100 - RNA, 19 nt, Homo sapiens
aaaccugaguguuagaaag

SEQ ID NO: 638101 - RNA, 19 nt, Homo sapiens
cagucugugucuauuauug

SEQ ID NO: 638102 - RNA, 19 nt, Homo sapiens
gcaaccucaucaccuggaa

SEQ ID NO: 638103 - RNA, 19 nt, Homo sapiens
gguucuaccugcagcugaa

SEQ ID NO: 638104 - RNA, 19 nt, Homo sapiens
acauaaaccugaguguuag

SEQ ID NO: 638105 - RNA, 19 nt, Homo sapiens
ucagauuguuugucuccuu

SEQ ID NO: 638106 - RNA, 19 nt, Homo sapiens
cauuauaccaacugagaaa

SEQ ID NO: 638107 - RNA, 19 nt, Homo sapiens
uaaaaugcauacugagaga

SEQ ID NO: 638108 - RNA, 19 nt, Homo sapiens
ugacccaaauugaucagau

SEQ ID NO: 638109 - RNA, 19 nt, Homo sapiens
gugcagucugugucuauua

SEQ ID NO: 638110 - RNA, 19 nt, Homo sapiens
cguggucaaugcugucuug

SEQ ID NO: 638111 - RNA, 19 nt, Homo sapiens
ccgauauggccaauuaauu

SEQ ID NO: 638112 - RNA, 19 nt, Homo sapiens
gcaguggacaagcaguuug

SEQ ID NO: 638113 - RNA, 19 nt, Homo sapiens
aagaacugaugaaguguca

SEQ ID NO: 638114 - RNA, 19 nt, Homo sapiens
ucuccucgauuaugugaug

SEQ ID NO: 638115 - RNA, 19 nt, Homo sapiens
ggacagcuugguauacgau

SEQ ID NO: 638116 - RNA, 19 nt, Homo sapiens
ucacagcccaucgauuuga

SEQ ID NO: 638117 - RNA, 19 nt, Homo sapiens
uuaaugguuugcaugugaa

SEQ ID NO: 638118 - RNA, 19 nt, Homo sapiens
gccagcaaguuuuguuuaa

SEQ ID NO: 638119 - RNA, 19 nt, Homo sapiens
gacaucaagcaguacauug

SEQ ID NO: 638120 - RNA, 19 nt, Homo sapiens
uauacgauguggaagucaa

SEQ ID NO: 638121 - RNA, 19 nt, Homo sapiens
uggcaauugcuuucugaua

SEQ ID NO: 638122 - RNA, 19 nt, Homo sapiens
caaaccaaacguuacuuag

SEQ ID NO: 638123 - RNA, 19 nt, Homo sapiens
gcagccaucuucaaaaucu

SEQ ID NO: 638124 - RNA, 19 nt, Homo sapiens
guuagaaagcuacucaaca

SEQ ID NO: 638125 - RNA, 19 nt, Homo sapiens
gauuaugugaugacaacuu

SEQ ID NO: 638126 - RNA, 19 nt, Homo sapiens
uacauuauaccaacugaga

SEQ ID NO: 638127 - RNA, 19 nt, Homo sapiens
gaacugacaucucugauuu

SEQ ID NO: 638128 - RNA, 19 nt, Homo sapiens
gaacacagauggugcgaua

SEQ ID NO: 638129 - RNA, 19 nt, Homo sapiens
gagcacagcuuaugaaaga

SEQ ID NO: 638130 - RNA, 19 nt, Homo sapiens
ccaaagaucugcuuacaaa

SEQ ID NO: 638131 - RNA, 19 nt, Homo sapiens
gacaaagacucauacaaua

SEQ ID NO: 638132 - RNA, 19 nt, Homo sapiens
gauaccaucuccaauaaua

SEQ ID NO: 638133 - RNA, 19 nt, Homo sapiens
gcagagagaucagauuaaa

SEQ ID NO: 638134 - RNA, 19 nt, Homo sapiens
caaauaagccacauaguaa

SEQ ID NO: 638135 - RNA, 19 nt, Homo sapiens
gcaagaaacuucacugaca

SEQ ID NO: 638136 - RNA, 19 nt, Homo sapiens
gagaggagcugcugaaaca

SEQ ID NO: 638137 - RNA, 19 nt, Homo sapiens
ccaaacagcuccaacgaaa

SEQ ID NO: 638138 - RNA, 19 nt, Homo sapiens
cagcagggaugauucuuua

SEQ ID NO: 638139 - RNA, 19 nt, Homo sapiens
ggaagaagcugcaguucau

SEQ ID NO: 638140 - RNA, 19 nt, Homo sapiens
uuagaaaccuugacuauga

SEQ ID NO: 638141 - RNA, 19 nt, Homo sapiens
gaaagagaauccacagaug

SEQ ID NO: 638142 - RNA, 19 nt, Homo sapiens
ugacaucucugauuuguga

SEQ ID NO: 638143 - RNA, 19 nt, Homo sapiens
ggacaaagacucauacaau

SEQ ID NO: 638144 - RNA, 19 nt, Homo sapiens
gcuaauugcugccagagua

SEQ ID NO: 638145 - RNA, 19 nt, Homo sapiens
caaagacacugauggaaug

SEQ ID NO: 638146 - RNA, 19 nt, Homo sapiens
gagcagagagaucagauua

SEQ ID NO: 638147 - RNA, 19 nt, Homo sapiens
gcucauaucgcaaagguua

SEQ ID NO: 638148 - RNA, 19 nt, Homo sapiens
gcaccuagauuggauagaa

SEQ ID NO: 638149 - RNA, 19 nt, Homo sapiens
gagguuauuucuccaguuu

SEQ ID NO: 638150 - RNA, 19 nt, Homo sapiens
caaagagagucuacaguau

SEQ ID NO: 638151 - RNA, 19 nt, Homo sapiens
acagagaguucuuguguaa

SEQ ID NO: 638152 - RNA, 19 nt, Homo sapiens
uaucauggauuucagauug

SEQ ID NO: 638153 - RNA, 19 nt, Homo sapiens
ccaaggcuaucauggauuu

SEQ ID NO: 638154 - RNA, 19 nt, Homo sapiens
ccaaagaaaugcauuagca

SEQ ID NO: 638155 - RNA, 19 nt, Homo sapiens
ccaaagagagucuacagua

SEQ ID NO: 638156 - RNA, 19 nt, Homo sapiens
gaaauuauuccaacuagug

SEQ ID NO: 638157 - RNA, 19 nt, Homo sapiens
gaagacccgucauuagaug

SEQ ID NO: 638158 - RNA, 19 nt, Homo sapiens
gagagaggaugaagaaagu

SEQ ID NO: 638159 - RNA, 19 nt, Homo sapiens
gaacauuugcugccguaua

SEQ ID NO: 638160 - RNA, 19 nt, Homo sapiens
caacauaguggauuuguga

SEQ ID NO: 638161 - RNA, 19 nt, Homo sapiens
gcaggcacauaaauuugua

SEQ ID NO: 638162 - RNA, 19 nt, Homo sapiens
caaggucgauuaagugaug

SEQ ID NO: 638163 - RNA, 19 nt, Homo sapiens
ggacagagaguucuugugu

SEQ ID NO: 638164 - RNA, 19 nt, Homo sapiens
acaaauaagccacauagua

SEQ ID NO: 638165 - RNA, 19 nt, Homo sapiens
gcacauaaauuuguagaac

SEQ ID NO: 638166 - RNA, 19 nt, Homo sapiens
ggagcaggcacauaaauuu

SEQ ID NO: 638167 - RNA, 19 nt, Homo sapiens
gcagguugcuuccaaagau

SEQ ID NO: 638168 - RNA, 19 nt, Homo sapiens
cuagaauucuucagcauaa

SEQ ID NO: 638169 - RNA, 19 nt, Homo sapiens
gaagagagaucugcgaaac

SEQ ID NO: 638170 - RNA, 19 nt, Homo sapiens
gaaaggagggaaggauaua

SEQ ID NO: 638171 - RNA, 19 nt, Homo sapiens
gaacagcacgugccauuca

SEQ ID NO: 638172 - RNA, 19 nt, Homo sapiens
gaaaugcacagaacacaga

SEQ ID NO: 638173 - RNA, 19 nt, Homo sapiens
cauaguaagucaaagaaga

SEQ ID NO: 638174 - RNA, 19 nt, Homo sapiens
gaacuuaugccauguuuac

SEQ ID NO: 638175 - RNA, 19 nt, Homo sapiens
ucgcaaagguuaagaugaa

SEQ ID NO: 638176 - RNA, 19 nt, Homo sapiens
uuaaagcgauuucuucaug

SEQ ID NO: 638177 - RNA, 19 nt, Homo sapiens
ccaaaggcauguacgaaug

SEQ ID NO: 638178 - RNA, 19 nt, Homo sapiens
gaaagaggauccggaacug

SEQ ID NO: 638179 - RNA, 19 nt, Homo sapiens
gaagggaaaugcacagaac

SEQ ID NO: 638180 - RNA, 19 nt, Homo sapiens
ugaaucaacuggugcagaa

SEQ ID NO: 638181 - RNA, 19 nt, Homo sapiens
gcaaagacacugauggaau

SEQ ID NO: 638182 - RNA, 19 nt, Homo sapiens
gaagggaccaaguauauuc

SEQ ID NO: 638183 - RNA, 19 nt, Homo sapiens
agaaguaacucuuagcaau

SEQ ID NO: 638184 - RNA, 19 nt, Homo sapiens
gcaaugugcaaggaaauua

SEQ ID NO: 638185 - RNA, 19 nt, Homo sapiens
gaagcaacccugcauugaa

SEQ ID NO: 638186 - RNA, 19 nt, Homo sapiens
ucacugacaucacacgauu

SEQ ID NO: 638187 - RNA, 19 nt, Homo sapiens
gcaaauaggcaacuucaag

SEQ ID NO: 638188 - RNA, 19 nt, Homo sapiens
guacaugauuucccuagug

SEQ ID NO: 638189 - RNA, 19 nt, Homo sapiens
gaaugguagugucuagaaa

SEQ ID NO: 638190 - RNA, 19 nt, Homo sapiens
guagaaauccguagcauag

SEQ ID NO: 638191 - RNA, 19 nt, Homo sapiens
caacugaaaucugcacaau

SEQ ID NO: 638192 - RNA, 19 nt, Homo sapiens
gaaucagucuucccacuca

SEQ ID NO: 638193 - RNA, 19 nt, Homo sapiens
gcaauuugauucguucaga

SEQ ID NO: 638194 - RNA, 19 nt, Homo sapiens
uccaagagaugaugacaaa

SEQ ID NO: 638195 - RNA, 19 nt, Homo sapiens
guacucaccuccaagagau

SEQ ID NO: 638196 - RNA, 19 nt, Homo sapiens
gagaagguguaaugcauca

SEQ ID NO: 638197 - RNA, 19 nt, Homo sapiens
gccaagaccugaagauagu

SEQ ID NO: 638198 - RNA, 19 nt, Homo sapiens
gguagugacuccacccauu

SEQ ID NO: 638199 - RNA, 19 nt, Homo sapiens
aaacccagaugacuucuug

SEQ ID NO: 638200 - RNA, 19 nt, Homo sapiens
gaauccaccuuugacaauu

SEQ ID NO: 638201 - RNA, 19 nt, Homo sapiens
aaacuucacugacaucaca

SEQ ID NO: 638202 - RNA, 19 nt, Homo sapiens
gcaguacggcaguuuagua

SEQ ID NO: 638203 - RNA, 19 nt, Homo sapiens
agagauaccuuguaguuag

SEQ ID NO: 638204 - RNA, 19 nt, Homo sapiens
gcgauuucuucauguauuu

SEQ ID NO: 638205 - RNA, 19 nt, Homo sapiens
caauggaaguugucaggaa

SEQ ID NO: 638206 - RNA, 19 nt, Homo sapiens
uuggagaggugaagaagua

SEQ ID NO: 638207 - RNA, 19 nt, Homo sapiens
gguauaaaccugugagaga

SEQ ID NO: 638208 - RNA, 19 nt, Homo sapiens
guacggcaguuuaguauac

SEQ ID NO: 638209 - RNA, 19 nt, Homo sapiens
ggguggaccugucaagauu

SEQ ID NO: 638210 - RNA, 19 nt, Homo sapiens
guagaacguuauuucaguu

SEQ ID NO: 638211 - RNA, 19 nt, Homo sapiens
gcuaacacaucaggauaaa

SEQ ID NO: 638212 - RNA, 19 nt, Homo sapiens
agaaaugcauuagcaauug

SEQ ID NO: 638213 - RNA, 19 nt, Homo sapiens
cagcaaagccagcucauau

SEQ ID NO: 638214 - RNA, 19 nt, Homo sapiens
caagaagggaccaaguaua

SEQ ID NO: 638215 - RNA, 19 nt, Homo sapiens
cguauaacaugacugugua

SEQ ID NO: 638216 - RNA, 19 nt, Homo sapiens
gagauaccuuguaguuaga

SEQ ID NO: 638217 - RNA, 19 nt, Homo sapiens
uaagugauguucuaaagag

SEQ ID NO: 638218 - RNA, 19 nt, Homo sapiens
gaaucagagucuuuguuga

SEQ ID NO: 638219 - RNA, 19 nt, Homo sapiens
gagcaauucuuaggauaau

SEQ ID NO: 638220 - RNA, 19 nt, Homo sapiens
gacagagaguucuugugua

SEQ ID NO: 638221 - RNA, 19 nt, Homo sapiens
gaaacaaauaagccacaua

SEQ ID NO: 638222 - RNA, 19 nt, Homo sapiens
ucagucaucuucaguacuu

SEQ ID NO: 638223 - RNA, 19 nt, Homo sapiens
ugacaucgacccaguugua

SEQ ID NO: 638224 - RNA, 19 nt, Homo sapiens
aacauuugcugccguauaa

SEQ ID NO: 638225 - RNA, 19 nt, Homo sapiens
gaucagaugaggaaauaga

SEQ ID NO: 638226 - RNA, 19 nt, Homo sapiens
gagagauaccuuguaguua

SEQ ID NO: 638227 - RNA, 19 nt, Homo sapiens
ggaagcagcucuuaucaaa

SEQ ID NO: 638228 - RNA, 19 nt, Homo sapiens
ggacauuacuaaagaguua

SEQ ID NO: 638229 - RNA, 19 nt, Homo sapiens
gcagaaagauuuggagaua

SEQ ID NO: 638230 - RNA, 19 nt, Homo sapiens
caacagaaauugacagaaa

SEQ ID NO: 638231 - RNA, 19 nt, Homo sapiens
gaaagaaagucacaguauu

SEQ ID NO: 638232 - RNA, 19 nt, Homo sapiens
gaacagcuauugaaagaga

SEQ ID NO: 638233 - RNA, 19 nt, Homo sapiens
ggaaauagcagaacucaaa

SEQ ID NO: 638234 - RNA, 19 nt, Homo sapiens
gggcaagacuggagaguua

SEQ ID NO: 638235 - RNA, 19 nt, Homo sapiens
gaacuuaaggagcauauua

SEQ ID NO: 638236 - RNA, 19 nt, Homo sapiens
ggacuuuggugauauaauu

SEQ ID NO: 638237 - RNA, 19 nt, Homo sapiens
gggagaaagucauguauuu

SEQ ID NO: 638238 - RNA, 19 nt, Homo sapiens
ggagauagcaucaucagua

SEQ ID NO: 638239 - RNA, 19 nt, Homo sapiens
gcaaacagcucagaaggaa

SEQ ID NO: 638240 - RNA, 19 nt, Homo sapiens
gagacaaucuagcacuuua

SEQ ID NO: 638241 - RNA, 19 nt, Homo sapiens
cgaaauagaugcacuaagu

SEQ ID NO: 638242 - RNA, 19 nt, Homo sapiens
ggaaguggaagcagaauua

SEQ ID NO: 638243 - RNA, 19 nt, Homo sapiens
gaaugagguucaacguuua

SEQ ID NO: 638244 - RNA, 19 nt, Homo sapiens
gaacaaaccgauucagaaa

SEQ ID NO: 638245 - RNA, 19 nt, Homo sapiens
gaagacaaucugaaacuua

SEQ ID NO: 638246 - RNA, 19 nt, Homo sapiens
ggccagauaucaaacuuua

SEQ ID NO: 638247 - RNA, 19 nt, Homo sapiens
gagugaaucuucugaauug

SEQ ID NO: 638248 - RNA, 19 nt, Homo sapiens
caagguggcucuggaguua

SEQ ID NO: 638249 - RNA, 19 nt, Homo sapiens
guagaaaucagccaucuua

SEQ ID NO: 638250 - RNA, 19 nt, Homo sapiens
gaaaguaguggccaagaua

SEQ ID NO: 638251 - RNA, 19 nt, Homo sapiens
gagauagcaucaucaguaa

SEQ ID NO: 638252 - RNA, 19 nt, Homo sapiens
gacaagaaaugcuggauga

SEQ ID NO: 638253 - RNA, 19 nt, Homo sapiens
ggaaauggaugaguuuaga

SEQ ID NO: 638254 - RNA, 19 nt, Homo sapiens
gaaccgaagucaggaaauu

SEQ ID NO: 638255 - RNA, 19 nt, Homo sapiens
gaaggagaauuuagaacuu

SEQ ID NO: 638256 - RNA, 19 nt, Homo sapiens
gaggagcuuucuagaauaa

SEQ ID NO: 638257 - RNA, 19 nt, Homo sapiens
aaagagaagucauuacuga

SEQ ID NO: 638258 - RNA, 19 nt, Homo sapiens
guacugaucuagaagagaa

SEQ ID NO: 638259 - RNA, 19 nt, Homo sapiens
gcaauuaugcuuucucuga

SEQ ID NO: 638260 - RNA, 19 nt, Homo sapiens
ccucagagcuagaaagaaa

SEQ ID NO: 638261 - RNA, 19 nt, Homo sapiens
gcaaguaagucugaaguau

SEQ ID NO: 638262 - RNA, 19 nt, Homo sapiens
gaacugaggaaagucauua

SEQ ID NO: 638263 - RNA, 19 nt, Homo sapiens
agaaugagguucaacguuu

SEQ ID NO: 638264 - RNA, 19 nt, Homo sapiens
gaacaagaacucaaucaga

SEQ ID NO: 638265 - RNA, 19 nt, Homo sapiens
gaaaggaaacagaauauca

SEQ ID NO: 638266 - RNA, 19 nt, Homo sapiens
gaaaaucacuacaggaaaa

SEQ ID NO: 638267 - RNA, 19 nt, Homo sapiens
ggaggagcuuucuagaaua

SEQ ID NO: 638268 - RNA, 19 nt, Homo sapiens
gaaauaaaccgacucucaa

SEQ ID NO: 638269 - RNA, 19 nt, Homo sapiens
gaacccagcuuuguguuau

SEQ ID NO: 638270 - RNA, 19 nt, Homo sapiens
gaagcagaauuaccugauu

SEQ ID NO: 638271 - RNA, 19 nt, Homo sapiens
acaggaacgugacaaguua

SEQ ID NO: 638272 - RNA, 19 nt, Homo sapiens
ggaagaagcaaacaaguau

SEQ ID NO: 638273 - RNA, 19 nt, Homo sapiens
gaaguggcccuaaaugauu

SEQ ID NO: 638274 - RNA, 19 nt, Homo sapiens
gaagaaguguucagacuac

SEQ ID NO: 638275 - RNA, 19 nt, Homo sapiens
gaaaucagccaucuuaaag

SEQ ID NO: 638276 - RNA, 19 nt, Homo sapiens
gaauguaguuuccaagcaa

SEQ ID NO: 638277 - RNA, 19 nt, Homo sapiens
ucagaaaugucagacuuua

SEQ ID NO: 638278 - RNA, 19 nt, Homo sapiens
cuaaacagauugaucaguu

SEQ ID NO: 638279 - RNA, 19 nt, Homo sapiens
gcaacuacuucagucuuua

SEQ ID NO: 638280 - RNA, 19 nt, Homo sapiens
caaaggauaugcugaugga

SEQ ID NO: 638281 - RNA, 19 nt, Homo sapiens
ggagaagacaguuguguuu

SEQ ID NO: 638282 - RNA, 19 nt, Homo sapiens
guucagagccuuaauauag

SEQ ID NO: 638283 - RNA, 19 nt, Homo sapiens
agaguuagauguacagaaa

SEQ ID NO: 638284 - RNA, 19 nt, Homo sapiens
gaacuucagaugucacuuu

SEQ ID NO: 638285 - RNA, 19 nt, Homo sapiens
gaagcaaagugauacuaug

SEQ ID NO: 638286 - RNA, 19 nt, Homo sapiens
gaacaagaacagcuaaaug

SEQ ID NO: 638287 - RNA, 19 nt, Homo sapiens
uggaacaacuugaggauaa

SEQ ID NO: 638288 - RNA, 19 nt, Homo sapiens
caccaaagcuuucuguuca

SEQ ID NO: 638289 - RNA, 19 nt, Homo sapiens
gaaugaaaccaaacucaaa

SEQ ID NO: 638290 - RNA, 19 nt, Homo sapiens
uaaauauucucaggccuua

SEQ ID NO: 638291 - RNA, 19 nt, Homo sapiens
aagagaagcugaaguuaga

SEQ ID NO: 638292 - RNA, 19 nt, Homo sapiens
ggagagagaccaagucaug

SEQ ID NO: 638293 - RNA, 19 nt, Homo sapiens
gccaagauauguuuagaga

SEQ ID NO: 638294 - RNA, 19 nt, Homo sapiens
gaaagagaagcugaaguua

SEQ ID NO: 638295 - RNA, 19 nt, Homo sapiens
gcagaaacuugaggacaaa

SEQ ID NO: 638296 - RNA, 19 nt, Homo sapiens
uaaaccgacucucaaauga

SEQ ID NO: 638297 - RNA, 19 nt, Homo sapiens
gacauggacuuuggugaua

SEQ ID NO: 638298 - RNA, 19 nt, Homo sapiens
gcagcuguaccucuuauua

SEQ ID NO: 638299 - RNA, 19 nt, Homo sapiens
caagaacaguugaauguag

SEQ ID NO: 638300 - RNA, 19 nt, Homo sapiens
ggagaaggcucuugcuuuu

SEQ ID NO: 638301 - RNA, 19 nt, Homo sapiens
gcuggaacaugagcauuua

SEQ ID NO: 638302 - RNA, 19 nt, Homo sapiens
gggaggagauggagcaguu

SEQ ID NO: 638303 - RNA, 19 nt, Homo sapiens
gguaaacuaacucagauua

SEQ ID NO: 638304 - RNA, 19 nt, Homo sapiens
caaaugcaccagaaaguuu

SEQ ID NO: 638305 - RNA, 19 nt, Homo sapiens
gaaaagguauuugcuguuu

SEQ ID NO: 638306 - RNA, 19 nt, Homo sapiens
gacaggacauucaaacaga

SEQ ID NO: 638307 - RNA, 19 nt, Homo sapiens
gaacuagcaucugagguau

SEQ ID NO: 638308 - RNA, 19 nt, Homo sapiens
cauuagagcugagaaagaa

SEQ ID NO: 638309 - RNA, 19 nt, Homo sapiens
gaagacaguuguguuucaa

SEQ ID NO: 638310 - RNA, 19 nt, Homo sapiens
gaaggaaauggaugaguuu

SEQ ID NO: 638311 - RNA, 19 nt, Homo sapiens
gcaaagugauacuaugaca

SEQ ID NO: 638312 - RNA, 19 nt, Homo sapiens
ggaagaaugugaaaacuug

SEQ ID NO: 638313 - RNA, 19 nt, Homo sapiens
ugagaaaccucuucauugg

SEQ ID NO: 638314 - RNA, 19 nt, Homo sapiens
caucaagacuuacagaaca

SEQ ID NO: 638315 - RNA, 19 nt, Homo sapiens
gauucagcaucaagacuua

SEQ ID NO: 638316 - RNA, 19 nt, Homo sapiens
ucaagcagcuaaaggagaa

SEQ ID NO: 638317 - RNA, 19 nt, Homo sapiens
uuacugaacuagcaucuga

SEQ ID NO: 638318 - RNA, 19 nt, Homo sapiens
uaaagaaacuaaggacguu

SEQ ID NO: 638319 - RNA, 19 nt, Homo sapiens
uagcugagauagaagaauu

SEQ ID NO: 638320 - RNA, 19 nt, Homo sapiens
uagagaggcuaaacuaaga

SEQ ID NO: 638321 - RNA, 19 nt, Homo sapiens
ggacagacagaaucaagaa

SEQ ID NO: 638322 - RNA, 19 nt, Homo sapiens
gacaaagaauuucguucaa

SEQ ID NO: 638323 - RNA, 19 nt, Homo sapiens
caacuacuuucuuccaaug

SEQ ID NO: 638324 - RNA, 19 nt, Homo sapiens
ggaagaaguguucagacua

SEQ ID NO: 638325 - RNA, 19 nt, Homo sapiens
cgaaaucaacuucaacaaa

SEQ ID NO: 638326 - RNA, 19 nt, Homo sapiens
aacagaauaucaagcguua

SEQ ID NO: 638327 - RNA, 19 nt, Homo sapiens
ggacagauauguaaaguuc

SEQ ID NO: 638328 - RNA, 19 nt, Homo sapiens
gcacugagcugugggauca

SEQ ID NO: 638329 - RNA, 19 nt, Homo sapiens
ggaacaggcuuacgccaaa

SEQ ID NO: 638330 - RNA, 19 nt, Homo sapiens
uuaaacagcuggagaauag

SEQ ID NO: 638331 - RNA, 19 nt, Homo sapiens
caagagaccugccaaggau

SEQ ID NO: 638332 - RNA, 19 nt, Homo sapiens
gcaugaagguggcugcaaa

SEQ ID NO: 638333 - RNA, 19 nt, Homo sapiens
gaaccucaguguccgugua

SEQ ID NO: 638334 - RNA, 19 nt, Homo sapiens
ugaaggaugucuaugagaa

SEQ ID NO: 638335 - RNA, 19 nt, Homo sapiens
gaagguggcugcaaaugcu

SEQ ID NO: 638336 - RNA, 19 nt, Homo sapiens
ugaagagccucccucagaa

SEQ ID NO: 638337 - RNA, 19 nt, Homo sapiens
gaacgacucccacguccuu

SEQ ID NO: 638338 - RNA, 19 nt, Homo sapiens
ggagucacauggccgaaga

SEQ ID NO: 638339 - RNA, 19 nt, Homo sapiens
caacaguccuucguacaga

SEQ ID NO: 638340 - RNA, 19 nt, Homo sapiens
gaaagaacgcaccgaagug

SEQ ID NO: 638341 - RNA, 19 nt, Homo sapiens
ggagguggugcccauaaua

SEQ ID NO: 638342 - RNA, 19 nt, Homo sapiens
gcaagaagaacaagacagu

SEQ ID NO: 638343 - RNA, 19 nt, Homo sapiens
uuauagagcugcacaaguc

SEQ ID NO: 638344 - RNA, 19 nt, Homo sapiens
gaaagucgaguccuuagca

SEQ ID NO: 638345 - RNA, 19 nt, Homo sapiens
gagaauaguaagcguaaau

SEQ ID NO: 638346 - RNA, 19 nt, Homo sapiens
gauccugaguccaaauuca

SEQ ID NO: 638347 - RNA, 19 nt, Homo sapiens
gaagaacgcagucgugaac

SEQ ID NO: 638348 - RNA, 19 nt, Homo sapiens
gaacggcuagaccaggaua

SEQ ID NO: 638349 - RNA, 19 nt, Homo sapiens
ggaguuugaugaggauuuc

SEQ ID NO: 638350 - RNA, 19 nt, Homo sapiens
gcugaaagucgaguccuua

SEQ ID NO: 638351 - RNA, 19 nt, Homo sapiens
aauuggaagugcagaagua

SEQ ID NO: 638352 - RNA, 19 nt, Homo sapiens
gcaccaagcgcuggccuuu

SEQ ID NO: 638353 - RNA, 19 nt, Homo sapiens
ggaggugaaugacuuugca

SEQ ID NO: 638354 - RNA, 19 nt, Homo sapiens
aaaugaaggaugucuauga

SEQ ID NO: 638355 - RNA, 19 nt, Homo sapiens
ucgauaagcuccaagacau

SEQ ID NO: 638356 - RNA, 19 nt, Homo sapiens
agaccaagcccacuucuau

SEQ ID NO: 638357 - RNA, 19 nt, Homo sapiens
ccaaggagagcucugaaga

SEQ ID NO: 638358 - RNA, 19 nt, Homo sapiens
gauauucgauaagcuccaa

SEQ ID NO: 638359 - RNA, 19 nt, Homo sapiens
aaacagcuggagaauagua

SEQ ID NO: 638360 - RNA, 19 nt, Homo sapiens
uaccaucguuccaccauug

SEQ ID NO: 638361 - RNA, 19 nt, Homo sapiens
gcugaaacccugagcaaca

SEQ ID NO: 638362 - RNA, 19 nt, Homo sapiens
ccauugauguacauacuca

SEQ ID NO: 638363 - RNA, 19 nt, Homo sapiens
gagccucccucagaagaga

SEQ ID NO: 638364 - RNA, 19 nt, Homo sapiens
ccaagagaccugccaagga

SEQ ID NO: 638365 - RNA, 19 nt, Homo sapiens
gaacgcagucgugaacuuc

SEQ ID NO: 638366 - RNA, 19 nt, Homo sapiens
ggaagaacgcagucgugaa

SEQ ID NO: 638367 - RNA, 19 nt, Homo sapiens
gaaaaugaaggaugucuau

SEQ ID NO: 638368 - RNA, 19 nt, Homo sapiens
caaguacucacaagagaug

SEQ ID NO: 638369 - RNA, 19 nt, Homo sapiens
ugaaagaacgcaccgaagu

SEQ ID NO: 638370 - RNA, 19 nt, Homo sapiens
ggagaauaguaagcguaaa

SEQ ID NO: 638371 - RNA, 19 nt, Homo sapiens
cgacucccacguccuuaua

SEQ ID NO: 638372 - RNA, 19 nt, Homo sapiens
gaccaagcccacuucuauu

SEQ ID NO: 638373 - RNA, 19 nt, Homo sapiens
cgagggcacuaucucuaug

SEQ ID NO: 638374 - RNA, 19 nt, Homo sapiens
ccauuuacacggaguuuga

SEQ ID NO: 638375 - RNA, 19 nt, Homo sapiens
gaaauuggaagugcagaag

SEQ ID NO: 638376 - RNA, 19 nt, Homo sapiens
gaaacccugagcaacauug

SEQ ID NO: 638377 - RNA, 19 nt, Homo sapiens
ucacauggccgaagaaagc

SEQ ID NO: 638378 - RNA, 19 nt, Homo sapiens
acauugaacggcugaaauu

SEQ ID NO: 638379 - RNA, 19 nt, Homo sapiens
caacauugaacggcugaaa

SEQ ID NO: 638380 - RNA, 19 nt, Homo sapiens
gggaagcccuaaagaaaau

SEQ ID NO: 638381 - RNA, 19 nt, Homo sapiens
aaacgaauaugcggcucaa

SEQ ID NO: 638382 - RNA, 19 nt, Homo sapiens
gcuggaaaauggcuuuaaa

SEQ ID NO: 638383 - RNA, 19 nt, Homo sapiens
gagucacgcucaauugaac

SEQ ID NO: 638384 - RNA, 19 nt, Homo sapiens
uggaagugcagaaguauga

SEQ ID NO: 638385 - RNA, 19 nt, Homo sapiens
ggagaaggccaagcagcaa

SEQ ID NO: 638386 - RNA, 19 nt, Homo sapiens
gaagagccucccucagaag

SEQ ID NO: 638387 - RNA, 19 nt, Homo sapiens
uugaacggcugaaauugga

SEQ ID NO: 638388 - RNA, 19 nt, Homo sapiens
gcgagggcacuaucucuau

SEQ ID NO: 638389 - RNA, 19 nt, Homo sapiens
ccagacagcagcagcaaca

SEQ ID NO: 638390 - RNA, 19 nt, Homo sapiens
gagguggugcccauaauag

SEQ ID NO: 638391 - RNA, 19 nt, Homo sapiens
gaacaggcuuacgccaaac

SEQ ID NO: 638392 - RNA, 19 nt, Homo sapiens
caucacaggacaccaagga

SEQ ID NO: 638393 - RNA, 19 nt, Homo sapiens
uccaggaggugaaugacuu

SEQ ID NO: 638394 - RNA, 19 nt, Homo sapiens
gaaggaugucuaugagaag

SEQ ID NO: 638395 - RNA, 19 nt, Homo sapiens
gcaacaguccuucguacag

SEQ ID NO: 638396 - RNA, 19 nt, Homo sapiens
ggccaucuaccacuuugaa

SEQ ID NO: 638397 - RNA, 19 nt, Homo sapiens
gggagcugguggcugagaa

SEQ ID NO: 638398 - RNA, 19 nt, Homo sapiens
gcgcaucacaggacaccaa

SEQ ID NO: 638399 - RNA, 19 nt, Homo sapiens
agaacgcagucgugaacuu

SEQ ID NO: 638400 - RNA, 19 nt, Homo sapiens
gagaccaagcccacuucua

SEQ ID NO: 638401 - RNA, 19 nt, Homo sapiens
gcuuuaaacagcuggagaa

SEQ ID NO: 638402 - RNA, 19 nt, Homo sapiens
gcugagaccuguguaaccu

SEQ ID NO: 638403 - RNA, 19 nt, Homo sapiens
aaugaaggaugucuaugag

SEQ ID NO: 638404 - RNA, 19 nt, Homo sapiens
gagcugcacaagucagguu

SEQ ID NO: 638405 - RNA, 19 nt, Homo sapiens
guacucacaagagaugaaa

SEQ ID NO: 638406 - RNA, 19 nt, Homo sapiens
aaagucgaguccuuagcaa

SEQ ID NO: 638407 - RNA, 19 nt, Homo sapiens
auguaaaguucgugaaaga

SEQ ID NO: 638408 - RNA, 19 nt, Homo sapiens
gaccaaguacucacaagag

SEQ ID NO: 638409 - RNA, 19 nt, Homo sapiens
cgagucacgcucaauugaa

SEQ ID NO: 638410 - RNA, 19 nt, Homo sapiens
ccagcaacaguccuucgua

SEQ ID NO: 638411 - RNA, 19 nt, Homo sapiens
accaagcccacuucuauuu

SEQ ID NO: 638412 - RNA, 19 nt, Homo sapiens
acagauauguaaaguucgu

SEQ ID NO: 638413 - RNA, 19 nt, Homo sapiens
ggcgggagcagcauggauu

SEQ ID NO: 638414 - RNA, 19 nt, Homo sapiens
uggagaauaguaagcguaa

SEQ ID NO: 638415 - RNA, 19 nt, Homo sapiens
caccauugauguacauacu

SEQ ID NO: 638416 - RNA, 19 nt, Homo sapiens
gcugucggcugcugcuucu

SEQ ID NO: 638417 - RNA, 19 nt, Homo sapiens
gcuacgugcccaccuccua

SEQ ID NO: 638418 - RNA, 19 nt, Homo sapiens
aaggaugucuaugagaaga

SEQ ID NO: 638419 - RNA, 19 nt, Homo sapiens
cgaauaugcggcucaacug

SEQ ID NO: 638420 - RNA, 19 nt, Homo sapiens
gaaacaggagaggaagaug

SEQ ID NO: 638421 - RNA, 19 nt, Homo sapiens
ccgagucacgcucaauuga

SEQ ID NO: 638422 - RNA, 19 nt, Homo sapiens
gacuucagccagcccauga

SEQ ID NO: 638423 - RNA, 19 nt, Homo sapiens
uauguaaaguucgugaaag

SEQ ID NO: 638424 - RNA, 19 nt, Homo sapiens
accaaguacucacaagaga

SEQ ID NO: 638425 - RNA, 19 nt, Homo sapiens
ccaaggcugauguggagaa

SEQ ID NO: 638426 - RNA, 19 nt, Homo sapiens
ugaccaaguacucacaaga

SEQ ID NO: 638427 - RNA, 19 nt, Homo sapiens
gcaggaagcuggaaaggaa

SEQ ID NO: 638428 - RNA, 19 nt, Homo sapiens
gaaagaaccuggagcaaag

SEQ ID NO: 638429 - RNA, 19 nt, Homo sapiens
aaagauggauccaaaguaa

SEQ ID NO: 638430 - RNA, 19 nt, Homo sapiens
gggcaaagauggauccaaa

SEQ ID NO: 638431 - RNA, 19 nt, Homo sapiens
gaaccuggagcaaagauua

SEQ ID NO: 638432 - RNA, 19 nt, Homo sapiens
gaagcuguguguaagauug

SEQ ID NO: 638433 - RNA, 19 nt, Homo sapiens
uaagauugauucagcauuc

SEQ ID NO: 638434 - RNA, 19 nt, Homo sapiens
aaugaaacauggauaguug

SEQ ID NO: 638435 - RNA, 19 nt, Homo sapiens
gauccaaaguaacuaaaca

SEQ ID NO: 638436 - RNA, 19 nt, Homo sapiens
aaacaucugcuaagaaaga

SEQ ID NO: 638437 - RNA, 19 nt, Homo sapiens
caaagauggauccaaagua

SEQ ID NO: 638438 - RNA, 19 nt, Homo sapiens
gagggagaaugaauuguca

SEQ ID NO: 638439 - RNA, 19 nt, Homo sapiens
ggaagguacugcaccaucu

SEQ ID NO: 638440 - RNA, 19 nt, Homo sapiens
guaccuagguuuuauguga

SEQ ID NO: 638441 - RNA, 19 nt, Homo sapiens
gcaaagauggauccaaagu

SEQ ID NO: 638442 - RNA, 19 nt, Homo sapiens
uaacgagggagaaugaauu

SEQ ID NO: 638443 - RNA, 19 nt, Homo sapiens
gaauacagagggcaaagau

SEQ ID NO: 638444 - RNA, 19 nt, Homo sapiens
ucaccgacauagucauuau

SEQ ID NO: 638445 - RNA, 19 nt, Homo sapiens
gcaauaaucaguggugcuu

SEQ ID NO: 638446 - RNA, 19 nt, Homo sapiens
gcugacuauuugugguuua

SEQ ID NO: 638447 - RNA, 19 nt, Homo sapiens
uccaugcacuugcuuuaaa

SEQ ID NO: 638448 - RNA, 19 nt, Homo sapiens
gaaaccugcuccaccaaaa

SEQ ID NO: 638449 - RNA, 19 nt, Homo sapiens
agaaagaaccuggagcaaa

SEQ ID NO: 638450 - RNA, 19 nt, Homo sapiens
guuccaguccguugcuuua

SEQ ID NO: 638451 - RNA, 19 nt, Homo sapiens
ggccaccugcugacuauuu

SEQ ID NO: 638452 - RNA, 19 nt, Homo sapiens
ccaguccguugcuuuacuu

SEQ ID NO: 638453 - RNA, 19 nt, Homo sapiens
gacauuuuaucgucucaua

SEQ ID NO: 638454 - RNA, 19 nt, Homo sapiens
gccaccugcugacuauuug

SEQ ID NO: 638455 - RNA, 19 nt, Homo sapiens
ucauuaugccgaagagaaa

SEQ ID NO: 638456 - RNA, 19 nt, Homo sapiens
cgaaaccugcuccaccaaa

SEQ ID NO: 638457 - RNA, 19 nt, Homo sapiens
guggccaccugcugacuau

SEQ ID NO: 638458 - RNA, 19 nt, Homo sapiens
uauuggaagcuguguguaa

SEQ ID NO: 638459 - RNA, 19 nt, Homo sapiens
agauaacgagggagaauga

SEQ ID NO: 638460 - RNA, 19 nt, Homo sapiens
ggaagcuguguguaagauu

SEQ ID NO: 638461 - RNA, 19 nt, Homo sapiens
gguacugcaccaucugaaa

SEQ ID NO: 638462 - RNA, 19 nt, Homo sapiens
aaauuuaguccugugcaua

SEQ ID NO: 638463 - RNA, 19 nt, Homo sapiens
uacaucauccucaaguaaa

SEQ ID NO: 638464 - RNA, 19 nt, Homo sapiens
uaaacaggagcccacaaga

SEQ ID NO: 638465 - RNA, 19 nt, Homo sapiens
guaagauugauucagcauu

SEQ ID NO: 638466 - RNA, 19 nt, Homo sapiens
guagauaacgagggagaau

SEQ ID NO: 638467 - RNA, 19 nt, Homo sapiens
gaagcuggaaaggaaggua

SEQ ID NO: 638468 - RNA, 19 nt, Homo sapiens
ucuacuaguuggcauacga

SEQ ID NO: 638469 - RNA, 19 nt, Homo sapiens
gaagguacugcaccaucug

SEQ ID NO: 638470 - RNA, 19 nt, Homo sapiens
gucauuaugccgaagagaa

SEQ ID NO: 638471 - RNA, 19 nt, Homo sapiens
cugacuauuugugguuuaa

SEQ ID NO: 638472 - RNA, 19 nt, Homo sapiens
aauaaucaguggugcuuuu

SEQ ID NO: 638473 - RNA, 19 nt, Homo sapiens
gugcuaaagggaagaagga

SEQ ID NO: 638474 - RNA, 19 nt, Homo sapiens
cgagggagaaugaauuguc

SEQ ID NO: 638475 - RNA, 19 nt, Homo sapiens
gaaaauggugaaacuaaag

SEQ ID NO: 638476 - RNA, 19 nt, Homo sapiens
aaucaguggugcuuuugua

SEQ ID NO: 638477 - RNA, 19 nt, Homo sapiens
uggaagcuguguguaagau

SEQ ID NO: 638478 - RNA, 19 nt, Homo sapiens
uuuacaucauccucaagua

SEQ ID NO: 638479 - RNA, 19 nt, Homo sapiens
uggugaaacuaaagcugaa

SEQ ID NO: 638480 - RNA, 19 nt, Homo sapiens
ggaagaaggaggaaaagca

SEQ ID NO: 638481 - RNA, 19 nt, Homo sapiens
guacugcaccaucugaaaa

SEQ ID NO: 638482 - RNA, 19 nt, Homo sapiens
cuaaacaggagcccacaag

SEQ ID NO: 638483 - RNA, 19 nt, Homo sapiens
cgucucauagucaugcuuu

SEQ ID NO: 638484 - RNA, 19 nt, Homo sapiens
gauaacgagggagaaugaa

SEQ ID NO: 638485 - RNA, 19 nt, Homo sapiens
uuaguccugugcauacugu

SEQ ID NO: 638486 - RNA, 19 nt, Homo sapiens
aaacaggagcccacaagac

SEQ ID NO: 638487 - RNA, 19 nt, Homo sapiens
gcaggaagcuggaaaggaa

SEQ ID NO: 638488 - RNA, 19 nt, Homo sapiens
gaaagaaccuggagcaaag

SEQ ID NO: 638489 - RNA, 19 nt, Homo sapiens
aaagauggauccaaaguaa

SEQ ID NO: 638490 - RNA, 19 nt, Homo sapiens
gggcaaagauggauccaaa

SEQ ID NO: 638491 - RNA, 19 nt, Homo sapiens
gaaccuggagcaaagauua

SEQ ID NO: 638492 - RNA, 19 nt, Homo sapiens
gaagcuguguguaagauug

SEQ ID NO: 638493 - RNA, 19 nt, Homo sapiens
uaagauugauucagcauuc

SEQ ID NO: 638494 - RNA, 19 nt, Homo sapiens
aaugaaacauggauaguug

SEQ ID NO: 638495 - RNA, 19 nt, Homo sapiens
ggaaaggaaggcacagaaa

SEQ ID NO: 638496 - RNA, 19 nt, Homo sapiens
gauccaaaguaacuaaaca

SEQ ID NO: 638497 - RNA, 19 nt, Homo sapiens
aaacaucugcuaagaaaga

SEQ ID NO: 638498 - RNA, 19 nt, Homo sapiens
caaagauggauccaaagua

SEQ ID NO: 638499 - RNA, 19 nt, Homo sapiens
gagggagaaugaauuguca

SEQ ID NO: 638500 - RNA, 19 nt, Homo sapiens
guaccuagguuuuauguga

SEQ ID NO: 638501 - RNA, 19 nt, Homo sapiens
gcaaagauggauccaaagu

SEQ ID NO: 638502 - RNA, 19 nt, Homo sapiens
uaacgagggagaaugaauu

SEQ ID NO: 638503 - RNA, 19 nt, Homo sapiens
gaauacagagggcaaagau

SEQ ID NO: 638504 - RNA, 19 nt, Homo sapiens
ucaccgacauagucauuau

SEQ ID NO: 638505 - RNA, 19 nt, Homo sapiens
gcaauaaucaguggugcuu

SEQ ID NO: 638506 - RNA, 19 nt, Homo sapiens
gcugacuauuugugguuua

SEQ ID NO: 638507 - RNA, 19 nt, Homo sapiens
uccaugcacuugcuuuaaa

SEQ ID NO: 638508 - RNA, 19 nt, Homo sapiens
gaaaccugcuccaccaaaa

SEQ ID NO: 638509 - RNA, 19 nt, Homo sapiens
agaaagaaccuggagcaaa

SEQ ID NO: 638510 - RNA, 19 nt, Homo sapiens
gaaaggaaggcacagaaaa

SEQ ID NO: 638511 - RNA, 19 nt, Homo sapiens
guuccaguccguugcuuua

SEQ ID NO: 638512 - RNA, 19 nt, Homo sapiens
ggccaccugcugacuauuu

SEQ ID NO: 638513 - RNA, 19 nt, Homo sapiens
ccaguccguugcuuuacuu

SEQ ID NO: 638514 - RNA, 19 nt, Homo sapiens
gacauuuuaucgucucaua

SEQ ID NO: 638515 - RNA, 19 nt, Homo sapiens
gccaccugcugacuauuug

SEQ ID NO: 638516 - RNA, 19 nt, Homo sapiens
ucauuaugccgaagagaaa

SEQ ID NO: 638517 - RNA, 19 nt, Homo sapiens
cgaaaccugcuccaccaaa

SEQ ID NO: 638518 - RNA, 19 nt, Homo sapiens
guggccaccugcugacuau

SEQ ID NO: 638519 - RNA, 19 nt, Homo sapiens
uauuggaagcuguguguaa

SEQ ID NO: 638520 - RNA, 19 nt, Homo sapiens
agauaacgagggagaauga

SEQ ID NO: 638521 - RNA, 19 nt, Homo sapiens
ggaaggcacagaaaacuga

SEQ ID NO: 638522 - RNA, 19 nt, Homo sapiens
ggaagcuguguguaagauu

SEQ ID NO: 638523 - RNA, 19 nt, Homo sapiens
aaauuuaguccugugcaua

SEQ ID NO: 638524 - RNA, 19 nt, Homo sapiens
uacaucauccucaaguaaa

SEQ ID NO: 638525 - RNA, 19 nt, Homo sapiens
uaaacaggagcccacaaga

SEQ ID NO: 638526 - RNA, 19 nt, Homo sapiens
guaagauugauucagcauu

SEQ ID NO: 638527 - RNA, 19 nt, Homo sapiens
guagauaacgagggagaau

SEQ ID NO: 638528 - RNA, 19 nt, Homo sapiens
ucuacuaguuggcauacga

SEQ ID NO: 638529 - RNA, 19 nt, Homo sapiens
gucauuaugccgaagagaa

SEQ ID NO: 638530 - RNA, 19 nt, Homo sapiens
cugacuauuugugguuuaa

SEQ ID NO: 638531 - RNA, 19 nt, Homo sapiens
aauaaucaguggugcuuuu

SEQ ID NO: 638532 - RNA, 19 nt, Homo sapiens
gugcuaaagggaagaagga

SEQ ID NO: 638533 - RNA, 19 nt, Homo sapiens
cgagggagaaugaauuguc

SEQ ID NO: 638534 - RNA, 19 nt, Homo sapiens
aaucaguggugcuuuugua

SEQ ID NO: 638535 - RNA, 19 nt, Homo sapiens
uggaagcuguguguaagau

SEQ ID NO: 638536 - RNA, 19 nt, Homo sapiens
uuuacaucauccucaagua

SEQ ID NO: 638537 - RNA, 19 nt, Homo sapiens
ggaagaaggaggaaaagca

SEQ ID NO: 638538 - RNA, 19 nt, Homo sapiens
cgucucauagucaugcuuu

SEQ ID NO: 638539 - RNA, 19 nt, Homo sapiens
cuaaacaggagcccacaag

SEQ ID NO: 638540 - RNA, 19 nt, Homo sapiens
gauaacgagggagaaugaa

SEQ ID NO: 638541 - RNA, 19 nt, Homo sapiens
uggaaaggaaggcacagaa

SEQ ID NO: 638542 - RNA, 19 nt, Homo sapiens
uuaguccugugcauacugu

SEQ ID NO: 638543 - RNA, 19 nt, Homo sapiens
aaacaggagcccacaagac

SEQ ID NO: 638544 - RNA, 19 nt, Homo sapiens
ggagugggauuccuacuuu

SEQ ID NO: 638545 - RNA, 19 nt, Homo sapiens
ggaaaugguugugaaguuu

SEQ ID NO: 638546 - RNA, 19 nt, Homo sapiens
gcauaaagacaaacuguua

SEQ ID NO: 638547 - RNA, 19 nt, Homo sapiens
guugugaaguuuccuauua

SEQ ID NO: 638548 - RNA, 19 nt, Homo sapiens
gcgaggagaucauucagua

SEQ ID NO: 638549 - RNA, 19 nt, Homo sapiens
ugagagugcugaagagaua

SEQ ID NO: 638550 - RNA, 19 nt, Homo sapiens
gagaauauguuacugaucu

SEQ ID NO: 638551 - RNA, 19 nt, Homo sapiens
cuaagaaggucaccauuga

SEQ ID NO: 638552 - RNA, 19 nt, Homo sapiens
gccagaaacugcuaaagaa

SEQ ID NO: 638553 - RNA, 19 nt, Homo sapiens
gaacuuaaacucuuaccaa

SEQ ID NO: 638554 - RNA, 19 nt, Homo sapiens
cgacacgccucucgacuuu

SEQ ID NO: 638555 - RNA, 19 nt, Homo sapiens
gaaaucaggcgaccaucua

SEQ ID NO: 638556 - RNA, 19 nt, Homo sapiens
ggaagauccuggaagaaga

SEQ ID NO: 638557 - RNA, 19 nt, Homo sapiens
gcaccaaagcaaauaauaa

SEQ ID NO: 638558 - RNA, 19 nt, Homo sapiens
cgaaaucuuugaacacauu

SEQ ID NO: 638559 - RNA, 19 nt, Homo sapiens
gagauacgagaauauguua

SEQ ID NO: 638560 - RNA, 19 nt, Homo sapiens
ucaaauagggauugguuua

SEQ ID NO: 638561 - RNA, 19 nt, Homo sapiens
gaagaaagggagaaacaga

SEQ ID NO: 638562 - RNA, 19 nt, Homo sapiens
cagacuagaugagacaaua

SEQ ID NO: 638563 - RNA, 19 nt, Homo sapiens
ggagaaggcuaucaagcau

SEQ ID NO: 638564 - RNA, 19 nt, Homo sapiens
gaacagcaacuccguaaag

SEQ ID NO: 638565 - RNA, 19 nt, Homo sapiens
agaaggcuaucaagcauaa

SEQ ID NO: 638566 - RNA, 19 nt, Homo sapiens
ugggaaagauguggaauuu

SEQ ID NO: 638567 - RNA, 19 nt, Homo sapiens
ugacagaacuaguauucga

SEQ ID NO: 638568 - RNA, 19 nt, Homo sapiens
agcacaagcucaucaauaa

SEQ ID NO: 638569 - RNA, 19 nt, Homo sapiens
gcaacuccguaaagaagaa

SEQ ID NO: 638570 - RNA, 19 nt, Homo sapiens
gaagagauacgagaauaug

SEQ ID NO: 638571 - RNA, 19 nt, Homo sapiens
gagaacagcaacuccguaa

SEQ ID NO: 638572 - RNA, 19 nt, Homo sapiens
ccagggaaaugaaggcaaa

SEQ ID NO: 638573 - RNA, 19 nt, Homo sapiens
cagauuacuuugccaguga

SEQ ID NO: 638574 - RNA, 19 nt, Homo sapiens
cagcgugacucaaacaaga

SEQ ID NO: 638575 - RNA, 19 nt, Homo sapiens
ucucagaacuuaaacucuu

SEQ ID NO: 638576 - RNA, 19 nt, Homo sapiens
uaucauagcagacuagaug

SEQ ID NO: 638577 - RNA, 19 nt, Homo sapiens
ugacacgacugcagagguu

SEQ ID NO: 638578 - RNA, 19 nt, Homo sapiens
gagugggauuccuacuuua

SEQ ID NO: 638579 - RNA, 19 nt, Homo sapiens
ggagacagcaccaaagcaa

SEQ ID NO: 638580 - RNA, 19 nt, Homo sapiens
gaauugaaguaguagaaac

SEQ ID NO: 638581 - RNA, 19 nt, Homo sapiens
gaagagccuuugggaguuc

SEQ ID NO: 638582 - RNA, 19 nt, Homo sapiens
caaauuggauagaucuucu

SEQ ID NO: 638583 - RNA, 19 nt, Homo sapiens
gaagauccuggaagaagaa

SEQ ID NO: 638584 - RNA, 19 nt, Homo sapiens
caaauagggauugguuuaa

SEQ ID NO: 638585 - RNA, 19 nt, Homo sapiens
cugaagagauacgagaaua

SEQ ID NO: 638586 - RNA, 19 nt, Homo sapiens
gggauugguuuaaaugauc

SEQ ID NO: 638587 - RNA, 19 nt, Homo sapiens
agacaucagucaagaaucu

SEQ ID NO: 638588 - RNA, 19 nt, Homo sapiens
gaaggacccaagucauuga

SEQ ID NO: 638589 - RNA, 19 nt, Homo sapiens
ggagaucauucaguacguu

SEQ ID NO: 638590 - RNA, 19 nt, Homo sapiens
gcaaagaagggguuaauga

SEQ ID NO: 638591 - RNA, 19 nt, Homo sapiens
ugaaguaguagaaaccuaa

SEQ ID NO: 638592 - RNA, 19 nt, Homo sapiens
ggauuccuacuuuauguaa

SEQ ID NO: 638593 - RNA, 19 nt, Homo sapiens
gagaggaggagcugagaga

SEQ ID NO: 638594 - RNA, 19 nt, Homo sapiens
aaauucagguuuccaaagu

SEQ ID NO: 638595 - RNA, 19 nt, Homo sapiens
aaagaaugaucaggaguug

SEQ ID NO: 638596 - RNA, 19 nt, Homo sapiens
ggaauugaaguaguagaaa

SEQ ID NO: 638597 - RNA, 19 nt, Homo sapiens
cuacugguccuuuggaauu

SEQ ID NO: 638598 - RNA, 19 nt, Homo sapiens
ugaagagccuuugggaguu

SEQ ID NO: 638599 - RNA, 19 nt, Homo sapiens
gagaaggcuaucaagcaua

SEQ ID NO: 638600 - RNA, 19 nt, Homo sapiens
ugucaggaguggagaauuc

SEQ ID NO: 638601 - RNA, 19 nt, Homo sapiens
gguguguacucaugaggaa

SEQ ID NO: 638602 - RNA, 19 nt, Homo sapiens
aagcacaagcucaucaaua

SEQ ID NO: 638603 - RNA, 19 nt, Homo sapiens
guaaagaagaagacaaagu

SEQ ID NO: 638604 - RNA, 19 nt, Homo sapiens
caaugguuguccaaacuug

SEQ ID NO: 638605 - RNA, 19 nt, Homo sapiens
gcagaaaucaggcgaccau

SEQ ID NO: 638606 - RNA, 19 nt, Homo sapiens
gaaguaguagaaaccuaaa

SEQ ID NO: 638607 - RNA, 19 nt, Homo sapiens
gauuuggacuagaguucaa

SEQ ID NO: 638608 - RNA, 19 nt, Homo sapiens
ccagaaacugcuaaagaaa

SEQ ID NO: 638609 - RNA, 19 nt, Homo sapiens
caauaacugucugaucugu

SEQ ID NO: 638610 - RNA, 19 nt, Homo sapiens
gcuaucuacugguccuuug

SEQ ID NO: 638611 - RNA, 19 nt, Homo sapiens
aggaaaugguugugaaguu

SEQ ID NO: 638612 - RNA, 19 nt, Homo sapiens
aaaauucacuagcagagua

SEQ ID NO: 638613 - RNA, 19 nt, Homo sapiens
aaaggucaauucauagaag

SEQ ID NO: 638614 - RNA, 19 nt, Homo sapiens
caauugagagugcugaaga

SEQ ID NO: 638615 - RNA, 19 nt, Homo sapiens
cucagaacuuaaacucuua

SEQ ID NO: 638616 - RNA, 19 nt, Homo sapiens
gguuaaugaagcagaauaa

SEQ ID NO: 638617 - RNA, 19 nt, Homo sapiens
gagggcagauccugguaca

SEQ ID NO: 638618 - RNA, 19 nt, Homo sapiens
ggaucaagaauuucaggaa

SEQ ID NO: 638619 - RNA, 19 nt, Homo sapiens
ggugcagccucacagaaga

SEQ ID NO: 638620 - RNA, 19 nt, Homo sapiens
gcucaggcccuugcuuauu

SEQ ID NO: 638621 - RNA, 19 nt, Homo sapiens
gcacucugguguguacuca

SEQ ID NO: 638622 - RNA, 19 nt, Homo sapiens
gcgucaggcuugaauaucu

SEQ ID NO: 638623 - RNA, 19 nt, Homo sapiens
cagaggacgacuuuggaua

SEQ ID NO: 638624 - RNA, 19 nt, Homo sapiens
ccacagaggacgacuuugg

SEQ ID NO: 638625 - RNA, 19 nt, Homo sapiens
ugguaaaucccaacaugua

SEQ ID NO: 638626 - RNA, 19 nt, Homo sapiens
ggaaagguggacaucucua

SEQ ID NO: 638627 - RNA, 19 nt, Homo sapiens
ccagacaucagucaagaau

SEQ ID NO: 638628 - RNA, 19 nt, Homo sapiens
cgaaggacccaagucauug

SEQ ID NO: 638629 - RNA, 19 nt, Homo sapiens
gaaagguggacaucucuac

SEQ ID NO: 638630 - RNA, 19 nt, Homo sapiens
gaguggagaauucuggaaa

SEQ ID NO: 638631 - RNA, 19 nt, Homo sapiens
gcuaaagaaacucauguca

SEQ ID NO: 638632 - RNA, 19 nt, Homo sapiens
gucgaaaucuuugaacaca

SEQ ID NO: 638633 - RNA, 19 nt, Homo sapiens
gcaauuuaaggagcaguuu

SEQ ID NO: 638634 - RNA, 19 nt, Homo sapiens
ucgaaggacccaagucauu

SEQ ID NO: 638635 - RNA, 19 nt, Homo sapiens
cuuuggaauugaaguagua

SEQ ID NO: 638636 - RNA, 19 nt, Homo sapiens
aaaggaacuauacagcaua

SEQ ID NO: 638637 - RNA, 19 nt, Homo sapiens
ucugguaaaucccaacaug

SEQ ID NO: 638638 - RNA, 19 nt, Homo sapiens
gaaccagccacugaccaaa

SEQ ID NO: 638639 - RNA, 19 nt, Homo sapiens
ugaugagucagauuacuuu

SEQ ID NO: 638640 - RNA, 19 nt, Homo sapiens
caaacaagagccagaaacu

SEQ ID NO: 638641 - RNA, 19 nt, Homo sapiens
guacucaugaggaacaaga

SEQ ID NO: 638642 - RNA, 19 nt, Homo sapiens
gacagcaccaaagcaaaua

SEQ ID NO: 638643 - RNA, 19 nt, Homo sapiens
gagaucauucaguacguuu

SEQ ID NO: 638644 - RNA, 19 nt, Homo sapiens
gaucagcucuuccuaccaa

SEQ ID NO: 638645 - RNA, 19 nt, Homo sapiens
gaacagugcaacccugaaa

SEQ ID NO: 638646 - RNA, 19 nt, Homo sapiens
aaacaaagaugaugaugac

SEQ ID NO: 638647 - RNA, 19 nt, Homo sapiens
gcaagagccuuuguuugug

SEQ ID NO: 638648 - RNA, 19 nt, Homo sapiens
gcauugauguggcucaugu

SEQ ID NO: 638649 - RNA, 19 nt, Homo sapiens
cauaaacgauaucaagcuu

SEQ ID NO: 638650 - RNA, 19 nt, Homo sapiens
gucuuaagauggauuauug

SEQ ID NO: 638651 - RNA, 19 nt, Homo sapiens
agacugcuguuuaggaauu

SEQ ID NO: 638652 - RNA, 19 nt, Homo sapiens
caaagaugaugaugacucu

SEQ ID NO: 638653 - RNA, 19 nt, Homo sapiens
caaaagagguuuccaggau

SEQ ID NO: 638654 - RNA, 19 nt, Homo sapiens
ugauguggcucauguuuca

SEQ ID NO: 638655 - RNA, 19 nt, Homo sapiens
aaacuugacauucagauga

SEQ ID NO: 638656 - RNA, 19 nt, Homo sapiens
caauagugaugaggaagaa

SEQ ID NO: 638657 - RNA, 19 nt, Homo sapiens
uaaacgauaucaagcuuac

SEQ ID NO: 638658 - RNA, 19 nt, Homo sapiens
ugaggagucuuaagaugga

SEQ ID NO: 638659 - RNA, 19 nt, Homo sapiens
gauaucaagcuuacacuuc

SEQ ID NO: 638660 - RNA, 19 nt, Homo sapiens
ggaugcagauuaggucaug

SEQ ID NO: 638661 - RNA, 19 nt, Homo sapiens
agaaugaggagucuuaaga

SEQ ID NO: 638662 - RNA, 19 nt, Homo sapiens
caaccucgaucagggagaa

SEQ ID NO: 638663 - RNA, 19 nt, Homo sapiens
uaaacuuggucaguguuaa

SEQ ID NO: 638664 - RNA, 19 nt, Homo sapiens
uggcgucgcucaaauguag

SEQ ID NO: 638665 - RNA, 19 nt, Homo sapiens
gacauucagaugauuguuu

SEQ ID NO: 638666 - RNA, 19 nt, Homo sapiens
gaaugaggagucuuaagau

SEQ ID NO: 638667 - RNA, 19 nt, Homo sapiens
caucauaaacgauaucaag

SEQ ID NO: 638668 - RNA, 19 nt, Homo sapiens
ggaaucugcaacauuaaga

SEQ ID NO: 638669 - RNA, 19 nt, Homo sapiens
ggagucuuaagauggauua

SEQ ID NO: 638670 - RNA, 19 nt, Homo sapiens
agagaaaacuugacauuca

SEQ ID NO: 638671 - RNA, 19 nt, Homo sapiens
caaagcaaagcucaugaga

SEQ ID NO: 638672 - RNA, 19 nt, Homo sapiens
agaugaugaugacucuaua

SEQ ID NO: 638673 - RNA, 19 nt, Homo sapiens
gaggaagaagacagaguuu

SEQ ID NO: 638674 - RNA, 19 nt, Homo sapiens
gguggcaaguccuuuaugg

SEQ ID NO: 638675 - RNA, 19 nt, Homo sapiens
aaugaggagucuuaagaug

SEQ ID NO: 638676 - RNA, 19 nt, Homo sapiens
ugcaagagccuuuguuugu

SEQ ID NO: 638677 - RNA, 19 nt, Homo sapiens
gaaucugcaacauuaagaa

SEQ ID NO: 638678 - RNA, 19 nt, Homo sapiens
aaacgugauucuacuguac

SEQ ID NO: 638679 - RNA, 19 nt, Homo sapiens
aaacucguccuguugagaa

SEQ ID NO: 638680 - RNA, 19 nt, Homo sapiens
gaaacucguccuguugaga

SEQ ID NO: 638681 - RNA, 19 nt, Homo sapiens
gugauucuacuguacauug

SEQ ID NO: 638682 - RNA, 19 nt, Homo sapiens
guggagccaucccagaaug

SEQ ID NO: 638683 - RNA, 19 nt, Homo sapiens
caugcaagagccuuuguuu

SEQ ID NO: 638684 - RNA, 19 nt, Homo sapiens
auaucaagcuuacacuuca

SEQ ID NO: 638685 - RNA, 19 nt, Homo sapiens
ggagagaaaacuugacauu

SEQ ID NO: 638686 - RNA, 19 nt, Homo sapiens
aggggaaucugcaacauua

SEQ ID NO: 638687 - RNA, 19 nt, Homo sapiens
ugaggaagaagacagaguu

SEQ ID NO: 638688 - RNA, 19 nt, Homo sapiens
cuuggucaguguuaauaaa

SEQ ID NO: 638689 - RNA, 19 nt, Homo sapiens
cccagaaugaggagucuua

SEQ ID NO: 638690 - RNA, 19 nt, Homo sapiens
cacuucauauggaguuaaa

SEQ ID NO: 638691 - RNA, 19 nt, Homo sapiens
gggagaagacaaagcaaag

SEQ ID NO: 638692 - RNA, 19 nt, Homo sapiens
gacaaagcaaagcucauga

SEQ ID NO: 638693 - RNA, 19 nt, Homo sapiens
agacaaagcaaagcucaug

SEQ ID NO: 638694 - RNA, 19 nt, Homo sapiens
ccacaccucaggcaguuga

SEQ ID NO: 638695 - RNA, 19 nt, Homo sapiens
uuaaacuuggucaguguua

SEQ ID NO: 638696 - RNA, 19 nt, Homo sapiens
gcaggccuuuaccggcauu

SEQ ID NO: 638697 - RNA, 19 nt, Homo sapiens
ucaauagugaugaggaaga

SEQ ID NO: 638698 - RNA, 19 nt, Homo sapiens
aagcuuacacuucauaugg

SEQ ID NO: 638699 - RNA, 19 nt, Homo sapiens
aagaugaugaugacucuau

SEQ ID NO: 638700 - RNA, 19 nt, Homo sapiens
aaacuuggucaguguuaau

SEQ ID NO: 638701 - RNA, 19 nt, Homo sapiens
ucuacuguacauugcauua

SEQ ID NO: 638702 - RNA, 19 nt, Homo sapiens
aacagucuccuuccacaaa

SEQ ID NO: 638703 - RNA, 19 nt, Homo sapiens
gagaagacaaagcaaagcu

SEQ ID NO: 638704 - RNA, 19 nt, Homo sapiens
ccugaaacucguccuguug

SEQ ID NO: 638705 - RNA, 19 nt, Homo sapiens
ucagggagaagacaaagca

SEQ ID NO: 638706 - RNA, 19 nt, Homo sapiens
gggaaucugcaacauuaag

SEQ ID NO: 638707 - RNA, 19 nt, Homo sapiens
gaugaugaugacucuauag

SEQ ID NO: 638708 - RNA, 19 nt, Homo sapiens
acuguacauugcauuauuc

SEQ ID NO: 638709 - RNA, 19 nt, Homo sapiens
uaaagccuguggaaaacaa

SEQ ID NO: 638710 - RNA, 19 nt, Homo sapiens
caagcuuacacuucauaug

SEQ ID NO: 638711 - RNA, 19 nt, Homo sapiens
gauagacaucauaaacgau

SEQ ID NO: 638712 - RNA, 19 nt, Homo sapiens
gagaaaacuugacauucag

SEQ ID NO: 638713 - RNA, 19 nt, Homo sapiens
guuuccaggaugcagauua

SEQ ID NO: 638714 - RNA, 19 nt, Homo sapiens
ccagaaugaggagucuuaa

SEQ ID NO: 638715 - RNA, 19 nt, Homo sapiens
uagcugauuuucucaauag

SEQ ID NO: 638716 - RNA, 19 nt, Homo sapiens
aaaacgugauucuacugua

SEQ ID NO: 638717 - RNA, 19 nt, Homo sapiens
cccugaaacucguccuguu

SEQ ID NO: 638718 - RNA, 19 nt, Homo sapiens
ugaugacucuauagcugau

SEQ ID NO: 638719 - RNA, 19 nt, Homo sapiens
cugaaacucguccuguuga

SEQ ID NO: 638720 - RNA, 19 nt, Homo sapiens
ggacuaacucgcuuaauuu

SEQ ID NO: 638721 - RNA, 19 nt, Homo sapiens
ccaagaggcuggagcugua

SEQ ID NO: 638722 - RNA, 19 nt, Homo sapiens
gaacaauuccuucacagaa

SEQ ID NO: 638723 - RNA, 19 nt, Homo sapiens
gaaaagagcagcugacgua

SEQ ID NO: 638724 - RNA, 19 nt, Homo sapiens
gcagauguucuaccaguua

SEQ ID NO: 638725 - RNA, 19 nt, Homo sapiens
ggcaucaucuccaccauuu

SEQ ID NO: 638726 - RNA, 19 nt, Homo sapiens
gaagaucauucaccgcaau

SEQ ID NO: 638727 - RNA, 19 nt, Homo sapiens
ggaauuguccuuauuaaac

SEQ ID NO: 638728 - RNA, 19 nt, Homo sapiens
ggucuugcuucccuucaua

SEQ ID NO: 638729 - RNA, 19 nt, Homo sapiens
caaggacucugucuacauc

SEQ ID NO: 638730 - RNA, 19 nt, Homo sapiens
ggaggagagucugcacuaa

SEQ ID NO: 638731 - RNA, 19 nt, Homo sapiens
uggacuaacucgcuuaauu

SEQ ID NO: 638732 - RNA, 19 nt, Homo sapiens
gagcuagagucccagcaaa

SEQ ID NO: 638733 - RNA, 19 nt, Homo sapiens
aaacccagaugccaagauu

SEQ ID NO: 638734 - RNA, 19 nt, Homo sapiens
gaagcaggcggcaagcaua

SEQ ID NO: 638735 - RNA, 19 nt, Homo sapiens
gagggaacccggaacaauu

SEQ ID NO: 638736 - RNA, 19 nt, Homo sapiens
ugaggaagcuguuugacau

SEQ ID NO: 638737 - RNA, 19 nt, Homo sapiens
gcaaguacaagcucaagga

SEQ ID NO: 638738 - RNA, 19 nt, Homo sapiens
gaacgaggcggcagaaagg

SEQ ID NO: 638739 - RNA, 19 nt, Homo sapiens
ggagauccuuggcaucauc

SEQ ID NO: 638740 - RNA, 19 nt, Homo sapiens
gagaauuccugcacagaac

SEQ ID NO: 638741 - RNA, 19 nt, Homo sapiens
gaagacauccagccagcuu

SEQ ID NO: 638742 - RNA, 19 nt, Homo sapiens
gaaggcgucucccggaucu

SEQ ID NO: 638743 - RNA, 19 nt, Homo sapiens
gcaaagcgcagcaccuaca

SEQ ID NO: 638744 - RNA, 19 nt, Homo sapiens
uggaagaguugcagaagau

SEQ ID NO: 638745 - RNA, 19 nt, Homo sapiens
cgaauccguuguggaauga

SEQ ID NO: 638746 - RNA, 19 nt, Homo sapiens
cgaaauggagacagagauu

SEQ ID NO: 638747 - RNA, 19 nt, Homo sapiens
gggaagacgaggaggauga

SEQ ID NO: 638748 - RNA, 19 nt, Homo sapiens
aagagcagcugacguacga

SEQ ID NO: 638749 - RNA, 19 nt, Homo sapiens
gaauuguccuuauuaaacc

SEQ ID NO: 638750 - RNA, 19 nt, Homo sapiens
guggaagaguugcagaaga

SEQ ID NO: 638751 - RNA, 19 nt, Homo sapiens
ccgaauccguuguggaaug

SEQ ID NO: 638752 - RNA, 19 nt, Homo sapiens
uuuaucaaguccucgauuu

SEQ ID NO: 638753 - RNA, 19 nt, Homo sapiens
ggcgaggccuuugggagua

SEQ ID NO: 638754 - RNA, 19 nt, Homo sapiens
acuccgaggucacauuuga

SEQ ID NO: 638755 - RNA, 19 nt, Homo sapiens
gcuuggcucucaugacugu

SEQ ID NO: 638756 - RNA, 19 nt, Homo sapiens
gaaauggagacagagauuc

SEQ ID NO: 638757 - RNA, 19 nt, Homo sapiens
gaagaguugcagaagauca

SEQ ID NO: 638758 - RNA, 19 nt, Homo sapiens
acccagaugccaagauuua

SEQ ID NO: 638759 - RNA, 19 nt, Homo sapiens
gccaaccgcuucaguacca

SEQ ID NO: 638760 - RNA, 19 nt, Homo sapiens
ugccaucuuugucaacuuu

SEQ ID NO: 638761 - RNA, 19 nt, Homo sapiens
ccaguuaugcgacuugaau

SEQ ID NO: 638762 - RNA, 19 nt, Homo sapiens
gcucaaggacucugucuac

SEQ ID NO: 638763 - RNA, 19 nt, Homo sapiens
cgggaaggcuacaacaauc

SEQ ID NO: 638764 - RNA, 19 nt, Homo sapiens
ccacuccgaggucacauuu

SEQ ID NO: 638765 - RNA, 19 nt, Homo sapiens
cuaagaugcugccgacucu

SEQ ID NO: 638766 - RNA, 19 nt, Homo sapiens
cuggaauuguccuuauuaa

SEQ ID NO: 638767 - RNA, 19 nt, Homo sapiens
ccucuggaauuguccuuau

SEQ ID NO: 638768 - RNA, 19 nt, Homo sapiens
cagauguucuaccaguuau

SEQ ID NO: 638769 - RNA, 19 nt, Homo sapiens
gcgcagcaccuacaacuac

SEQ ID NO: 638770 - RNA, 19 nt, Homo sapiens
ggauucgauuuggguauga

SEQ ID NO: 638771 - RNA, 19 nt, Homo sapiens
guacuuggcugugcauacg

SEQ ID NO: 638772 - RNA, 19 nt, Homo sapiens
ucuggaauuguccuuauua

SEQ ID NO: 638773 - RNA, 19 nt, Homo sapiens
ggaugucugacuuccagua

SEQ ID NO: 638774 - RNA, 19 nt, Homo sapiens
ccagccagcuugucaccau

SEQ ID NO: 638775 - RNA, 19 nt, Homo sapiens
ggaagcaggcggcaagcau

SEQ ID NO: 638776 - RNA, 19 nt, Homo sapiens
ggacaucccaaagguauac

SEQ ID NO: 638777 - RNA, 19 nt, Homo sapiens
ugucugacuuccaguacuu

SEQ ID NO: 638778 - RNA, 19 nt, Homo sapiens
ggaguacuuuguggaacga

SEQ ID NO: 638779 - RNA, 19 nt, Homo sapiens
ugacuguggugguggagau

SEQ ID NO: 638780 - RNA, 19 nt, Homo sapiens
ccaaugccucucaggauga

SEQ ID NO: 638781 - RNA, 19 nt, Homo sapiens
acaauuccuucacagaaca

SEQ ID NO: 638782 - RNA, 19 nt, Homo sapiens
cgacuugaauguggaagag

SEQ ID NO: 638783 - RNA, 19 nt, Homo sapiens
acuggugucuggccuaaug

SEQ ID NO: 638784 - RNA, 19 nt, Homo sapiens
gauucuggacuacguguga

SEQ ID NO: 638785 - RNA, 19 nt, Homo sapiens
ggcagauguucuaccaguu

SEQ ID NO: 638786 - RNA, 19 nt, Homo sapiens
caccaugcaugaccugaag

SEQ ID NO: 638787 - RNA, 19 nt, Homo sapiens
aagcaaagcgcagcaccua

SEQ ID NO: 638788 - RNA, 19 nt, Homo sapiens
caucuccaccauuuacaaa

SEQ ID NO: 638789 - RNA, 19 nt, Homo sapiens
ggacucugucuacaucuuc

SEQ ID NO: 638790 - RNA, 19 nt, Homo sapiens
ucgcuuggcucucaugacu

SEQ ID NO: 638791 - RNA, 19 nt, Homo sapiens
ggaggaggaggacuucaag

SEQ ID NO: 638792 - RNA, 19 nt, Homo sapiens
cagaugccaagauuuauca

SEQ ID NO: 638793 - RNA, 19 nt, Homo sapiens
gcaucaucuccaccauuua

SEQ ID NO: 638794 - RNA, 19 nt, Homo sapiens
aaaacgaaauggagacaga

SEQ ID NO: 638795 - RNA, 19 nt, Homo sapiens
caucaucuccaccauuuac

SEQ ID NO: 638796 - RNA, 19 nt, Homo sapiens
agagaauuccugcacagaa

SEQ ID NO: 638797 - RNA, 19 nt, Homo sapiens
uggcgcagccuauggauuc

SEQ ID NO: 638798 - RNA, 19 nt, Homo sapiens
ggaugagaccaguaaaugc

SEQ ID NO: 638799 - RNA, 19 nt, Homo sapiens
cagccuauggauucgauuu

SEQ ID NO: 638800 - RNA, 19 nt, Homo sapiens
gaggagagucugcacuaac

SEQ ID NO: 638801 - RNA, 19 nt, Homo sapiens
cgacggcagugaaaacgaa

SEQ ID NO: 638802 - RNA, 19 nt, Homo sapiens
gagcucagggacaccaugu

SEQ ID NO: 638803 - RNA, 19 nt, Homo sapiens
caaagcgcagcaccuacaa

SEQ ID NO: 638804 - RNA, 19 nt, Homo sapiens
aauccguuguggaaugaaa

SEQ ID NO: 638805 - RNA, 19 nt, Homo sapiens
ccagaugccaagauuuauc

SEQ ID NO: 638806 - RNA, 19 nt, Homo sapiens
gguggacuaacucgcuuaa

SEQ ID NO: 638807 - RNA, 19 nt, Homo sapiens
uggaggagagucugcacua

SEQ ID NO: 638808 - RNA, 19 nt, Homo sapiens
caggaugagaccaguaaau

SEQ ID NO: 638809 - RNA, 19 nt, Homo sapiens
cagaccauccgcuccaaga

SEQ ID NO: 638810 - RNA, 19 nt, Homo sapiens
acuugaauguggaagaguu

SEQ ID NO: 638811 - RNA, 19 nt, Homo sapiens
ccuaucggcagauguucua

SEQ ID NO: 638812 - RNA, 19 nt, Homo sapiens
ucaaggacucugucuacau

SEQ ID NO: 638813 - RNA, 19 nt, Homo sapiens
ccgggaaggcuacaacaau

SEQ ID NO: 638814 - RNA, 19 nt, Homo sapiens
ugagggaacccggaacaau

SEQ ID NO: 638815 - RNA, 19 nt, Homo sapiens
aaaccagcuuccagcaagu

SEQ ID NO: 638816 - RNA, 19 nt, Homo sapiens
guggaaugaaacacgguua

SEQ ID NO: 638817 - RNA, 19 nt, Homo sapiens
ggacacggcggucguuuuc

SEQ ID NO: 638818 - RNA, 19 nt, Homo sapiens
augccaagauuuaucaagu

SEQ ID NO: 638819 - RNA, 19 nt, Homo sapiens
uggauucgauuuggguaug

SEQ ID NO: 638820 - RNA, 19 nt, Homo sapiens
ggacauaucucaaagaaga

SEQ ID NO: 638821 - RNA, 19 nt, Homo sapiens
ggaaauggcuggacucaga

SEQ ID NO: 638822 - RNA, 19 nt, Homo sapiens
ggaaagaaauggaccaguu

SEQ ID NO: 638823 - RNA, 19 nt, Homo sapiens
caaagaagaugaacaaaca

SEQ ID NO: 638824 - RNA, 19 nt, Homo sapiens
gaaagaaauggaccaguua

SEQ ID NO: 638825 - RNA, 19 nt, Homo sapiens
gaugaacucugccauagaa

SEQ ID NO: 638826 - RNA, 19 nt, Homo sapiens
gcaguggagucaccuauuu

SEQ ID NO: 638827 - RNA, 19 nt, Homo sapiens
gaaguguaguugcagcuua

SEQ ID NO: 638828 - RNA, 19 nt, Homo sapiens
ucaaaugugugccacuuua

SEQ ID NO: 638829 - RNA, 19 nt, Homo sapiens
caacagcugucuccucaaa

SEQ ID NO: 638830 - RNA, 19 nt, Homo sapiens
gaagagaaacuccuggaaa

SEQ ID NO: 638831 - RNA, 19 nt, Homo sapiens
cuaguacgcuggaagauuu

SEQ ID NO: 638832 - RNA, 19 nt, Homo sapiens
ucacagauguugcauugaa

SEQ ID NO: 638833 - RNA, 19 nt, Homo sapiens
gaaacagaauggucucuuc

SEQ ID NO: 638834 - RNA, 19 nt, Homo sapiens
gaacaccaguugauuaaac

SEQ ID NO: 638835 - RNA, 19 nt, Homo sapiens
cuagagagcuuggauaaga

SEQ ID NO: 638836 - RNA, 19 nt, Homo sapiens
gcagguagauuuaauagac

SEQ ID NO: 638837 - RNA, 19 nt, Homo sapiens
gaagguguuugcuccauga

SEQ ID NO: 638838 - RNA, 19 nt, Homo sapiens
gcuccuggcuguccucuuu

SEQ ID NO: 638839 - RNA, 19 nt, Homo sapiens
gggaauaugagcacaauaa

SEQ ID NO: 638840 - RNA, 19 nt, Homo sapiens
gggcaaugcugacgaugaa

SEQ ID NO: 638841 - RNA, 19 nt, Homo sapiens
ugccagaguuugauauaua

SEQ ID NO: 638842 - RNA, 19 nt, Homo sapiens
ccaaacagguggugaagca

SEQ ID NO: 638843 - RNA, 19 nt, Homo sapiens
gaaucgcacucuccauuuc

SEQ ID NO: 638844 - RNA, 19 nt, Homo sapiens
ucuccugucuucuaaauaa

SEQ ID NO: 638845 - RNA, 19 nt, Homo sapiens
gagcaaggaaggagaugua

SEQ ID NO: 638846 - RNA, 19 nt, Homo sapiens
gauguugcauugaaguuug

SEQ ID NO: 638847 - RNA, 19 nt, Homo sapiens
gaagcaauuugaacacagu

SEQ ID NO: 638848 - RNA, 19 nt, Homo sapiens
ugauuaaacucucagaugu

SEQ ID NO: 638849 - RNA, 19 nt, Homo sapiens
gcauccagcuccagaagau

SEQ ID NO: 638850 - RNA, 19 nt, Homo sapiens
ugaagaguaugaugacaga

SEQ ID NO: 638851 - RNA, 19 nt, Homo sapiens
aagagaaacuccuggaaau

SEQ ID NO: 638852 - RNA, 19 nt, Homo sapiens
ggagaacgucuuuaugaga

SEQ ID NO: 638853 - RNA, 19 nt, Homo sapiens
uagaggagcccacugauga

SEQ ID NO: 638854 - RNA, 19 nt, Homo sapiens
ggucaagcauaacaacgaa

SEQ ID NO: 638855 - RNA, 19 nt, Homo sapiens
ggaagggcaugaugaacuc

SEQ ID NO: 638856 - RNA, 19 nt, Homo sapiens
ucagagaguuggagugcuu

SEQ ID NO: 638857 - RNA, 19 nt, Homo sapiens
auuaagagguuacugcaaa

SEQ ID NO: 638858 - RNA, 19 nt, Homo sapiens
gcacuguaguuuguguaaa

SEQ ID NO: 638859 - RNA, 19 nt, Homo sapiens
acacaugaagccagucuua

SEQ ID NO: 638860 - RNA, 19 nt, Homo sapiens
gcuggaagauuuuaaaaga

SEQ ID NO: 638861 - RNA, 19 nt, Homo sapiens
gugcauaccuggccaucau

SEQ ID NO: 638862 - RNA, 19 nt, Homo sapiens
gaaguuugaacaccaguug

SEQ ID NO: 638863 - RNA, 19 nt, Homo sapiens
uuucacagauguugcauug

SEQ ID NO: 638864 - RNA, 19 nt, Homo sapiens
gaauccaucucuucaugca

SEQ ID NO: 638865 - RNA, 19 nt, Homo sapiens
aaucgaagcuguggagaug

SEQ ID NO: 638866 - RNA, 19 nt, Homo sapiens
uaccagguccaauuuguua

SEQ ID NO: 638867 - RNA, 19 nt, Homo sapiens
aaacuaccagguccaauuu

SEQ ID NO: 638868 - RNA, 19 nt, Homo sapiens
gucaaaggcuauuucacuu

SEQ ID NO: 638869 - RNA, 19 nt, Homo sapiens
ccaggcaaaucucaacaga

SEQ ID NO: 638870 - RNA, 19 nt, Homo sapiens
gaauaugagcacaauaauc

SEQ ID NO: 638871 - RNA, 19 nt, Homo sapiens
cccagcaggucaagcauaa

SEQ ID NO: 638872 - RNA, 19 nt, Homo sapiens
ccuggaaucuucaguucaa

SEQ ID NO: 638873 - RNA, 19 nt, Homo sapiens
ccuccacccuguuaacaaa

SEQ ID NO: 638874 - RNA, 19 nt, Homo sapiens
gcagacaaacagaauggaa

SEQ ID NO: 638875 - RNA, 19 nt, Homo sapiens
ucacaggccuucacucacu

SEQ ID NO: 638876 - RNA, 19 nt, Homo sapiens
aaucaccucucccagugua

SEQ ID NO: 638877 - RNA, 19 nt, Homo sapiens
cccuggagcucauuucuga

SEQ ID NO: 638878 - RNA, 19 nt, Homo sapiens
gauggaagggcaugaugaa

SEQ ID NO: 638879 - RNA, 19 nt, Homo sapiens
ccugagcacuguaguuugu

SEQ ID NO: 638880 - RNA, 19 nt, Homo sapiens
ggaauaugagcacaauaau

SEQ ID NO: 638881 - RNA, 19 nt, Homo sapiens
ccaguuacaggcucucuaa

SEQ ID NO: 638882 - RNA, 19 nt, Homo sapiens
cgacuggauuaagagguua

SEQ ID NO: 638883 - RNA, 19 nt, Homo sapiens
ggaagagaaacuccuggaa

SEQ ID NO: 638884 - RNA, 19 nt, Homo sapiens
gcagaaaaccccuucagaa

SEQ ID NO: 638885 - RNA, 19 nt, Homo sapiens
ccuguuaucuuguggaaag

SEQ ID NO: 638886 - RNA, 19 nt, Homo sapiens
gccagaguuugauauauag

SEQ ID NO: 638887 - RNA, 19 nt, Homo sapiens
gggaaggcuuuaccaccaa

SEQ ID NO: 638888 - RNA, 19 nt, Homo sapiens
gaagccagucuuaggagaa

SEQ ID NO: 638889 - RNA, 19 nt, Homo sapiens
ucagaagccuuguggaaac

SEQ ID NO: 638890 - RNA, 19 nt, Homo sapiens
cuccaugacugcagacaaa

SEQ ID NO: 638891 - RNA, 19 nt, Homo sapiens
ggaaggcuuuaccaccaau

SEQ ID NO: 638892 - RNA, 19 nt, Homo sapiens
uaucaaaugugugccacuu

SEQ ID NO: 638893 - RNA, 19 nt, Homo sapiens
ugaccugacugagaucuau

SEQ ID NO: 638894 - RNA, 19 nt, Homo sapiens
gauguaccaacagagauua

SEQ ID NO: 638895 - RNA, 19 nt, Homo sapiens
caugaugaacucugccaua

SEQ ID NO: 638896 - RNA, 19 nt, Homo sapiens
ccaaugagaggauucaagu

SEQ ID NO: 638897 - RNA, 19 nt, Homo sapiens
ugauucuccugucuucuaa

SEQ ID NO: 638898 - RNA, 19 nt, Homo sapiens
gugauucuccugucuucua

SEQ ID NO: 638899 - RNA, 19 nt, Homo sapiens
gaugggcaaugcugacgau

SEQ ID NO: 638900 - RNA, 19 nt, Homo sapiens
gaauggaacagucuauacu

SEQ ID NO: 638901 - RNA, 19 nt, Homo sapiens
acaauugagucaggaauca

SEQ ID NO: 638902 - RNA, 19 nt, Homo sapiens
gcacugaccauggacaauc

SEQ ID NO: 638903 - RNA, 19 nt, Homo sapiens
ugacgaagcaauuugaaca

SEQ ID NO: 638904 - RNA, 19 nt, Homo sapiens
ucucaaagaagaugaacaa

SEQ ID NO: 638905 - RNA, 19 nt, Homo sapiens
gauuggacauaucucaaag

SEQ ID NO: 638906 - RNA, 19 nt, Homo sapiens
ggaacagucuauacuugcu

SEQ ID NO: 638907 - RNA, 19 nt, Homo sapiens
uuuaaugucugaugaagag

SEQ ID NO: 638908 - RNA, 19 nt, Homo sapiens
gcaaggaaggagauguaga

SEQ ID NO: 638909 - RNA, 19 nt, Homo sapiens
ccacugagggcaugaucaa

SEQ ID NO: 638910 - RNA, 19 nt, Homo sapiens
aggcaaaucucaacagacu

SEQ ID NO: 638911 - RNA, 19 nt, Homo sapiens
uggcagcacugaccaugga

SEQ ID NO: 638912 - RNA, 19 nt, Homo sapiens
ccgacuggauuaagagguu

SEQ ID NO: 638913 - RNA, 19 nt, Homo sapiens
gaagaugaacaaacagacu

SEQ ID NO: 638914 - RNA, 19 nt, Homo sapiens
gaacacaugaagccagucu

SEQ ID NO: 638915 - RNA, 19 nt, Homo sapiens
caaggaaggagauguagag

SEQ ID NO: 638916 - RNA, 19 nt, Homo sapiens
cagaauggaacagucuaua

SEQ ID NO: 638917 - RNA, 19 nt, Homo sapiens
gcagucaaaggcuauuuca

SEQ ID NO: 638918 - RNA, 19 nt, Homo sapiens
ugaaucgcacucuccauuu

SEQ ID NO: 638919 - RNA, 19 nt, Homo sapiens
caggcagucuguuccaaug

SEQ ID NO: 638920 - RNA, 19 nt, Homo sapiens
gaauaaagcuccugagaau

SEQ ID NO: 638921 - RNA, 19 nt, Homo sapiens
gcaaagaacuagaauacuu

SEQ ID NO: 638922 - RNA, 19 nt, Homo sapiens
ggaauuaacucuaccaaau

SEQ ID NO: 638923 - RNA, 19 nt, Homo sapiens
gaagagauauugccuacaa

SEQ ID NO: 638924 - RNA, 19 nt, Homo sapiens
ggccuaaccuuuauucaua

SEQ ID NO: 638925 - RNA, 19 nt, Homo sapiens
caacuugucucucaucuau

SEQ ID NO: 638926 - RNA, 19 nt, Homo sapiens
uaacauagcagcugaacua

SEQ ID NO: 638927 - RNA, 19 nt, Homo sapiens
gcaaggauuucacuuucua

SEQ ID NO: 638928 - RNA, 19 nt, Homo sapiens
guggauaccuuacuuacua

SEQ ID NO: 638929 - RNA, 19 nt, Homo sapiens
gauguuacuucugcuauua

SEQ ID NO: 638930 - RNA, 19 nt, Homo sapiens
gaacagaauccugaagaua

SEQ ID NO: 638931 - RNA, 19 nt, Homo sapiens
gaucaagccuuuaugaaca

SEQ ID NO: 638932 - RNA, 19 nt, Homo sapiens
ggaccaaggugacauggaa

SEQ ID NO: 638933 - RNA, 19 nt, Homo sapiens
gaacagaugggugaucaua

SEQ ID NO: 638934 - RNA, 19 nt, Homo sapiens
gagacaugcucuuauugua

SEQ ID NO: 638935 - RNA, 19 nt, Homo sapiens
gcaaagaguuacuaugaag

SEQ ID NO: 638936 - RNA, 19 nt, Homo sapiens
ucucagggcuuauuauuug

SEQ ID NO: 638937 - RNA, 19 nt, Homo sapiens
gcaauccacuauuaucaga

SEQ ID NO: 638938 - RNA, 19 nt, Homo sapiens
gguggaaucuucuguugaa

SEQ ID NO: 638939 - RNA, 19 nt, Homo sapiens
gaaggcaccucagaagaga

SEQ ID NO: 638940 - RNA, 19 nt, Homo sapiens
cagcugaacuauauauuuc

SEQ ID NO: 638941 - RNA, 19 nt, Homo sapiens
gcuuguagauuccucauug

SEQ ID NO: 638942 - RNA, 19 nt, Homo sapiens
acagaugggugaucauaaa

SEQ ID NO: 638943 - RNA, 19 nt, Homo sapiens
gagaggcaucuuuaucuua

SEQ ID NO: 638944 - RNA, 19 nt, Homo sapiens
gcagcugaacuauauauuu

SEQ ID NO: 638945 - RNA, 19 nt, Homo sapiens
guugauugcugcgcauuua

SEQ ID NO: 638946 - RNA, 19 nt, Homo sapiens
caaguuaucagcugaagaa

SEQ ID NO: 638947 - RNA, 19 nt, Homo sapiens
gcauggaaaucauaagaca

SEQ ID NO: 638948 - RNA, 19 nt, Homo sapiens
ggaagucaguucacaaggu

SEQ ID NO: 638949 - RNA, 19 nt, Homo sapiens
gaaaggcauacaacuauau

SEQ ID NO: 638950 - RNA, 19 nt, Homo sapiens
agaaaggcauacaacuaua

SEQ ID NO: 638951 - RNA, 19 nt, Homo sapiens
gaccaagagucagcaaauu

SEQ ID NO: 638952 - RNA, 19 nt, Homo sapiens
guauaggccuaaccuuuau

SEQ ID NO: 638953 - RNA, 19 nt, Homo sapiens
gagauauggcaaagaguua

SEQ ID NO: 638954 - RNA, 19 nt, Homo sapiens
gcagcuggcuagagauaug

SEQ ID NO: 638955 - RNA, 19 nt, Homo sapiens
gaaucgagcccaaguuugu

SEQ ID NO: 638956 - RNA, 19 nt, Homo sapiens
gauacaaccuugcaguagu

SEQ ID NO: 638957 - RNA, 19 nt, Homo sapiens
gaagaaggcaccucagaag

SEQ ID NO: 638958 - RNA, 19 nt, Homo sapiens
ggaagaaacaccugagcaa

SEQ ID NO: 638959 - RNA, 19 nt, Homo sapiens
uaaaguaucgagagacaaa

SEQ ID NO: 638960 - RNA, 19 nt, Homo sapiens
ggagcgagcugcugaaagc

SEQ ID NO: 638961 - RNA, 19 nt, Homo sapiens
gaauguuaccugcacuaua

SEQ ID NO: 638962 - RNA, 19 nt, Homo sapiens
ggcaaagaguuacuaugaa

SEQ ID NO: 638963 - RNA, 19 nt, Homo sapiens
ugacaacacuaguagaaca

SEQ ID NO: 638964 - RNA, 19 nt, Homo sapiens
gagaauaaagcuccugaga

SEQ ID NO: 638965 - RNA, 19 nt, Homo sapiens
uaucagagcagugggaaua

SEQ ID NO: 638966 - RNA, 19 nt, Homo sapiens
uguauaggccuaaccuuua

SEQ ID NO: 638967 - RNA, 19 nt, Homo sapiens
cagaaaggcauacaacuau

SEQ ID NO: 638968 - RNA, 19 nt, Homo sapiens
ucagaaaggcauacaacua

SEQ ID NO: 638969 - RNA, 19 nt, Homo sapiens
guccggaacucaucgacua

SEQ ID NO: 638970 - RNA, 19 nt, Homo sapiens
gguagaggguauagaacuu

SEQ ID NO: 638971 - RNA, 19 nt, Homo sapiens
gaaccucucuauagcuucu

SEQ ID NO: 638972 - RNA, 19 nt, Homo sapiens
gcucuuguuugcucugaaa

SEQ ID NO: 638973 - RNA, 19 nt, Homo sapiens
ggauguuggugaauauaau

SEQ ID NO: 638974 - RNA, 19 nt, Homo sapiens
guacaucucaacauucuug

SEQ ID NO: 638975 - RNA, 19 nt, Homo sapiens
agaaaugucucuggaacaa

SEQ ID NO: 638976 - RNA, 19 nt, Homo sapiens
gaaaaggccucggaguaaa

SEQ ID NO: 638977 - RNA, 19 nt, Homo sapiens
ggucuuugcuuccaugcuu

SEQ ID NO: 638978 - RNA, 19 nt, Homo sapiens
gacaugcucuuauuguaca

SEQ ID NO: 638979 - RNA, 19 nt, Homo sapiens
ggagagaggcaucuuuauc

SEQ ID NO: 638980 - RNA, 19 nt, Homo sapiens
gaugcaaggauuucacuuu

SEQ ID NO: 638981 - RNA, 19 nt, Homo sapiens
cauaauugaugaagcuuuc

SEQ ID NO: 638982 - RNA, 19 nt, Homo sapiens
ccaguuagacuuacgaaga

SEQ ID NO: 638983 - RNA, 19 nt, Homo sapiens
gcucuuaaauaugaaccua

SEQ ID NO: 638984 - RNA, 19 nt, Homo sapiens
gaacaagacaauauuaagc

SEQ ID NO: 638985 - RNA, 19 nt, Homo sapiens
ccaagaaaaugaugaaaga

SEQ ID NO: 638986 - RNA, 19 nt, Homo sapiens
uaccaaaucccaagacaaa

SEQ ID NO: 638987 - RNA, 19 nt, Homo sapiens
guacagggcuuuuccuuuc

SEQ ID NO: 638988 - RNA, 19 nt, Homo sapiens
ggagacaugcucuuauugu

SEQ ID NO: 638989 - RNA, 19 nt, Homo sapiens
gcauuuguaucugguaguu

SEQ ID NO: 638990 - RNA, 19 nt, Homo sapiens
agaggcaucuuuaucuuau

SEQ ID NO: 638991 - RNA, 19 nt, Homo sapiens
gcccaaguuuguuugauau

SEQ ID NO: 638992 - RNA, 19 nt, Homo sapiens
ggagaccuauaccuagaug

SEQ ID NO: 638993 - RNA, 19 nt, Homo sapiens
uggcaaagaguuacuauga

SEQ ID NO: 638994 - RNA, 19 nt, Homo sapiens
aaaugucucuggaacaaga

SEQ ID NO: 638995 - RNA, 19 nt, Homo sapiens
gaagaggcgauauugaugu

SEQ ID NO: 638996 - RNA, 19 nt, Homo sapiens
gaauuaacucuaccaaauc

SEQ ID NO: 638997 - RNA, 19 nt, Homo sapiens
gagagaggcaucuuuaucu

SEQ ID NO: 638998 - RNA, 19 nt, Homo sapiens
ccauuuggaugcaaggauu

SEQ ID NO: 638999 - RNA, 19 nt, Homo sapiens
caacauucuugaaccacuu

SEQ ID NO: 639000 - RNA, 19 nt, Homo sapiens
gaaguuccaucaucaucag

SEQ ID NO: 639001 - RNA, 19 nt, Homo sapiens
caucaggaauuaacucuac

SEQ ID NO: 639002 - RNA, 19 nt, Homo sapiens
ggaacaagacaauauuaag

SEQ ID NO: 639003 - RNA, 19 nt, Homo sapiens
guaaacaugucaggguuca

SEQ ID NO: 639004 - RNA, 19 nt, Homo sapiens
agaaaagucuucaggaaaa

SEQ ID NO: 639005 - RNA, 19 nt, Homo sapiens
ucaagaggcugaguugcuu

SEQ ID NO: 639006 - RNA, 19 nt, Homo sapiens
gaugacugguggaaucuuc

SEQ ID NO: 639007 - RNA, 19 nt, Homo sapiens
gaagauaugggagaccuau

SEQ ID NO: 639008 - RNA, 19 nt, Homo sapiens
aauguuaccugcacuauac

SEQ ID NO: 639009 - RNA, 19 nt, Homo sapiens
cuagagauauggcaaagag

SEQ ID NO: 639010 - RNA, 19 nt, Homo sapiens
acagaauccugaagauaug

SEQ ID NO: 639011 - RNA, 19 nt, Homo sapiens
caacacuaguagaacagaa

SEQ ID NO: 639012 - RNA, 19 nt, Homo sapiens
gagccauucucuacucuag

SEQ ID NO: 639013 - RNA, 19 nt, Homo sapiens
gagaaaaggccucggagua

SEQ ID NO: 639014 - RNA, 19 nt, Homo sapiens
gagagaaugaagaugauga

SEQ ID NO: 639015 - RNA, 19 nt, Homo sapiens
ccaaaucccaagacaaaga

SEQ ID NO: 639016 - RNA, 19 nt, Homo sapiens
agaauuaccuaacaaacag

SEQ ID NO: 639017 - RNA, 19 nt, Homo sapiens
ggaccagugucuucugucu

SEQ ID NO: 639018 - RNA, 19 nt, Homo sapiens
uaaucgauaccucaguuua

SEQ ID NO: 639019 - RNA, 19 nt, Homo sapiens
ugacgaaccucucuauagc

SEQ ID NO: 639020 - RNA, 19 nt, Homo sapiens
cugcaaagcuggauaaaua

SEQ ID NO: 639021 - RNA, 19 nt, Homo sapiens
gcacauuuauggaaguuua

SEQ ID NO: 639022 - RNA, 19 nt, Homo sapiens
gauuauaucucugguguua

SEQ ID NO: 639023 - RNA, 19 nt, Homo sapiens
ccacaaugcuggaucauaa

SEQ ID NO: 639024 - RNA, 19 nt, Homo sapiens
ugaaagagauugagaaugu

SEQ ID NO: 639025 - RNA, 19 nt, Homo sapiens
ggagugagauauaaacauu

SEQ ID NO: 639026 - RNA, 19 nt, Homo sapiens
gagaaacguuuggauaaua

SEQ ID NO: 639027 - RNA, 19 nt, Homo sapiens
gguacaagcucgagguaua

SEQ ID NO: 639028 - RNA, 19 nt, Homo sapiens
uaacacaaaugaccacaaa

SEQ ID NO: 639029 - RNA, 19 nt, Homo sapiens
gcauauugcaugaguauua

SEQ ID NO: 639030 - RNA, 19 nt, Homo sapiens
gguauaauguugagagaaa

SEQ ID NO: 639031 - RNA, 19 nt, Homo sapiens
acuaguaucugccuuauuu

SEQ ID NO: 639032 - RNA, 19 nt, Homo sapiens
auggauagcuucuguguua

SEQ ID NO: 639033 - RNA, 19 nt, Homo sapiens
ugaaggaacugucaauaau

SEQ ID NO: 639034 - RNA, 19 nt, Homo sapiens
caacaacaaugaugagcaa

SEQ ID NO: 639035 - RNA, 19 nt, Homo sapiens
gccauaaugucuucuauau

SEQ ID NO: 639036 - RNA, 19 nt, Homo sapiens
gaaggaaggacuuaaauag

SEQ ID NO: 639037 - RNA, 19 nt, Homo sapiens
agaguuagcuccaaucgaa

SEQ ID NO: 639038 - RNA, 19 nt, Homo sapiens
gaagguggcaguucucauu

SEQ ID NO: 639039 - RNA, 19 nt, Homo sapiens
cagaaaagcugccuuauau

SEQ ID NO: 639040 - RNA, 19 nt, Homo sapiens
ucgauggacugaacaauuu

SEQ ID NO: 639041 - RNA, 19 nt, Homo sapiens
ucaaagaggccaugaaaga

SEQ ID NO: 639042 - RNA, 19 nt, Homo sapiens
ggcaauaauucaagugauu

SEQ ID NO: 639043 - RNA, 19 nt, Homo sapiens
gaccacaaacuaaaucaua

SEQ ID NO: 639044 - RNA, 19 nt, Homo sapiens
caaaugaccacaaacuaaa

SEQ ID NO: 639045 - RNA, 19 nt, Homo sapiens
gcaugaguauuaccaagaa

SEQ ID NO: 639046 - RNA, 19 nt, Homo sapiens
gaaggaacugucaauaauu

SEQ ID NO: 639047 - RNA, 19 nt, Homo sapiens
guaaucgguuauaccuuua

SEQ ID NO: 639048 - RNA, 19 nt, Homo sapiens
uagcuucuguguuaugaua

SEQ ID NO: 639049 - RNA, 19 nt, Homo sapiens
gcucaacgguacagauuau

SEQ ID NO: 639050 - RNA, 19 nt, Homo sapiens
gaaagagauugagaauguu

SEQ ID NO: 639051 - RNA, 19 nt, Homo sapiens
caacaaugaugagcaauag

SEQ ID NO: 639052 - RNA, 19 nt, Homo sapiens
ucauaugacuguucucuga

SEQ ID NO: 639053 - RNA, 19 nt, Homo sapiens
gguuaacccuugugugaaa

SEQ ID NO: 639054 - RNA, 19 nt, Homo sapiens
uguaaucgguuauaccuuu

SEQ ID NO: 639055 - RNA, 19 nt, Homo sapiens
gccaacacauaucucuuua

SEQ ID NO: 639056 - RNA, 19 nt, Homo sapiens
ccaaggauuuagauauuga

SEQ ID NO: 639057 - RNA, 19 nt, Homo sapiens
caacguaucucccggaaaa

SEQ ID NO: 639058 - RNA, 19 nt, Homo sapiens
ggaaggacuuaaauagcuu

SEQ ID NO: 639059 - RNA, 19 nt, Homo sapiens
ggaagccacuacuuaagau

SEQ ID NO: 639060 - RNA, 19 nt, Homo sapiens
ucacuaugcuggauauaau

SEQ ID NO: 639061 - RNA, 19 nt, Homo sapiens
guacaucgauggacugaac

SEQ ID NO: 639062 - RNA, 19 nt, Homo sapiens
ccaugaacaucuuccaauu

SEQ ID NO: 639063 - RNA, 19 nt, Homo sapiens
gaaaauggauagcuucugu

SEQ ID NO: 639064 - RNA, 19 nt, Homo sapiens
uggaagaagucacagcuuu

SEQ ID NO: 639065 - RNA, 19 nt, Homo sapiens
guggaacaauuuagaaaga

SEQ ID NO: 639066 - RNA, 19 nt, Homo sapiens
uuacggauguggagaaaug

SEQ ID NO: 639067 - RNA, 19 nt, Homo sapiens
gauagcuucuguguuauga

SEQ ID NO: 639068 - RNA, 19 nt, Homo sapiens
acaaaugaccacaaacuaa

SEQ ID NO: 639069 - RNA, 19 nt, Homo sapiens
ucagggcuuuguccaguua

SEQ ID NO: 639070 - RNA, 19 nt, Homo sapiens
agaaugaucuauggaagaa

SEQ ID NO: 639071 - RNA, 19 nt, Homo sapiens
caacucuucuccaaggauu

SEQ ID NO: 639072 - RNA, 19 nt, Homo sapiens
gcgcugauauuauaauguc

SEQ ID NO: 639073 - RNA, 19 nt, Homo sapiens
ggaagaaaacccaauagua

SEQ ID NO: 639074 - RNA, 19 nt, Homo sapiens
gugauuaucuuguucaaac

SEQ ID NO: 639075 - RNA, 19 nt, Homo sapiens
gagaagaugaugaccuuug

SEQ ID NO: 639076 - RNA, 19 nt, Homo sapiens
ggaacaauuuagaaagauc

SEQ ID NO: 639077 - RNA, 19 nt, Homo sapiens
aaaaugaccggaacuauua

SEQ ID NO: 639078 - RNA, 19 nt, Homo sapiens
gaaaaugaccggaacuauu

SEQ ID NO: 639079 - RNA, 19 nt, Homo sapiens
ccguuuaucuucauuguau

SEQ ID NO: 639080 - RNA, 19 nt, Homo sapiens
caguaaagccgaacaguau

SEQ ID NO: 639081 - RNA, 19 nt, Homo sapiens
ccaagguuguguguuuaua

SEQ ID NO: 639082 - RNA, 19 nt, Homo sapiens
aacaauaggucauaugauc

SEQ ID NO: 639083 - RNA, 19 nt, Homo sapiens
ccaguuaucuucauaugac

SEQ ID NO: 639084 - RNA, 19 nt, Homo sapiens
gugaacagcacuuuuauua

SEQ ID NO: 639085 - RNA, 19 nt, Homo sapiens
ugaucaggcuguacacaaa

SEQ ID NO: 639086 - RNA, 19 nt, Homo sapiens
ccuauaaacagugaacuua

SEQ ID NO: 639087 - RNA, 19 nt, Homo sapiens
uaugagaaacguuuggaua

SEQ ID NO: 639088 - RNA, 19 nt, Homo sapiens
ucucugguguuaauuacua

SEQ ID NO: 639089 - RNA, 19 nt, Homo sapiens
cuagaaaucacaaccauau

SEQ ID NO: 639090 - RNA, 19 nt, Homo sapiens
gauggaagguggcaguucu

SEQ ID NO: 639091 - RNA, 19 nt, Homo sapiens
ugagaaacguuuggauaau

SEQ ID NO: 639092 - RNA, 19 nt, Homo sapiens
gggaagccacuacuuaaga

SEQ ID NO: 639093 - RNA, 19 nt, Homo sapiens
ggaagaggaagaugucugu

SEQ ID NO: 639094 - RNA, 19 nt, Homo sapiens
guacaagcucgagguauaa

SEQ ID NO: 639095 - RNA, 19 nt, Homo sapiens
gcacugaugccauaauguc

SEQ ID NO: 639096 - RNA, 19 nt, Homo sapiens
uuuccaagguuguguguuu

SEQ ID NO: 639097 - RNA, 19 nt, Homo sapiens
gacaugauauaaaggaucu

SEQ ID NO: 639098 - RNA, 19 nt, Homo sapiens
agaaggaaggacuuaaaua

SEQ ID NO: 639099 - RNA, 19 nt, Homo sapiens
acaagucaauuccucauca

SEQ ID NO: 639100 - RNA, 19 nt, Homo sapiens
gaugaugaccuuuggaaca

SEQ ID NO: 639101 - RNA, 19 nt, Homo sapiens
gcugacaguggaacaauuu

SEQ ID NO: 639102 - RNA, 19 nt, Homo sapiens
uggcaguucucauuccuuu

SEQ ID NO: 639103 - RNA, 19 nt, Homo sapiens
cuccaaggauuuagauauu

SEQ ID NO: 639104 - RNA, 19 nt, Homo sapiens
gagguauaauguugagaga

SEQ ID NO: 639105 - RNA, 19 nt, Homo sapiens
gaagaaaacccaauaguac

SEQ ID NO: 639106 - RNA, 19 nt, Homo sapiens
cuaccgggauuaccuaugu

SEQ ID NO: 639107 - RNA, 19 nt, Homo sapiens
aaagaaggaaggacuuaaa

SEQ ID NO: 639108 - RNA, 19 nt, Homo sapiens
agaaaucacaaccauauug

SEQ ID NO: 639109 - RNA, 19 nt, Homo sapiens
gaaaagaaggaaggacuua

SEQ ID NO: 639110 - RNA, 19 nt, Homo sapiens
uuacaucacuaaacaaagg

SEQ ID NO: 639111 - RNA, 19 nt, Homo sapiens
caugaacaucuuccaauuu

SEQ ID NO: 639112 - RNA, 19 nt, Homo sapiens
ggaagaagucacagcuuuc

SEQ ID NO: 639113 - RNA, 19 nt, Homo sapiens
gaaaugaaggaacugucaa

SEQ ID NO: 639114 - RNA, 19 nt, Homo sapiens
ccaaggagcgucaguacau

SEQ ID NO: 639115 - RNA, 19 nt, Homo sapiens
uuacagagugggacuauau

SEQ ID NO: 639116 - RNA, 19 nt, Homo sapiens
ugaacagacuggcacacaa

SEQ ID NO: 639117 - RNA, 19 nt, Homo sapiens
uuucaggagugagauauaa

SEQ ID NO: 639118 - RNA, 19 nt, Homo sapiens
gcaugagugucagggcuuu

SEQ ID NO: 639119 - RNA, 19 nt, Homo sapiens
gugcacugaugccauaaug

SEQ ID NO: 639120 - RNA, 19 nt, Homo sapiens
gaagaggucugguuuauuu

SEQ ID NO: 639121 - RNA, 19 nt, Homo sapiens
gaaagaagcugaugugguu

SEQ ID NO: 639122 - RNA, 19 nt, Homo sapiens
ucaaagagccucacaguua

SEQ ID NO: 639123 - RNA, 19 nt, Homo sapiens
gaacuagccuuauuucuca

SEQ ID NO: 639124 - RNA, 19 nt, Homo sapiens
gcacagacauucuacuuug

SEQ ID NO: 639125 - RNA, 19 nt, Homo sapiens
gaacauuucuagggaauaa

SEQ ID NO: 639126 - RNA, 19 nt, Homo sapiens
ggucagaucuggaggcaua

SEQ ID NO: 639127 - RNA, 19 nt, Homo sapiens
uaagauaccuugaugaaga

SEQ ID NO: 639128 - RNA, 19 nt, Homo sapiens
gaacuuaguccaccaaauu

SEQ ID NO: 639129 - RNA, 19 nt, Homo sapiens
gaugauaacuucaacauag

SEQ ID NO: 639130 - RNA, 19 nt, Homo sapiens
gaucugggcugaagaauuc

SEQ ID NO: 639131 - RNA, 19 nt, Homo sapiens
gcagugaauugcacagaua

SEQ ID NO: 639132 - RNA, 19 nt, Homo sapiens
ggaagacgcugcagugaau

SEQ ID NO: 639133 - RNA, 19 nt, Homo sapiens
ccacagaacuagccuuauu

SEQ ID NO: 639134 - RNA, 19 nt, Homo sapiens
uaagacugcugcugaauuu

SEQ ID NO: 639135 - RNA, 19 nt, Homo sapiens
gagaagaggucugguuuau

SEQ ID NO: 639136 - RNA, 19 nt, Homo sapiens
gaaaugaaacuucucuuug

SEQ ID NO: 639137 - RNA, 19 nt, Homo sapiens
ggacacaucuggcuugaca

SEQ ID NO: 639138 - RNA, 19 nt, Homo sapiens
gagaugaaaugcaauggaa

SEQ ID NO: 639139 - RNA, 19 nt, Homo sapiens
ggagugaccugcucagaug

SEQ ID NO: 639140 - RNA, 19 nt, Homo sapiens
gaacacacccaucaucuga

SEQ ID NO: 639141 - RNA, 19 nt, Homo sapiens
gaauauguguucuggaaga

SEQ ID NO: 639142 - RNA, 19 nt, Homo sapiens
aaucaacccugcaucuuua

SEQ ID NO: 639143 - RNA, 19 nt, Homo sapiens
gggaauauguguucuggaa

SEQ ID NO: 639144 - RNA, 19 nt, Homo sapiens
gaucaugcaucugucauuu

SEQ ID NO: 639145 - RNA, 19 nt, Homo sapiens
ggaaaugaaacuucucuuu

SEQ ID NO: 639146 - RNA, 19 nt, Homo sapiens
gaacuaauuucugugucua

SEQ ID NO: 639147 - RNA, 19 nt, Homo sapiens
gcuaaaaccuacucacuua

SEQ ID NO: 639148 - RNA, 19 nt, Homo sapiens
cagcagggauguuggagua

SEQ ID NO: 639149 - RNA, 19 nt, Homo sapiens
gaagcggucucugugauuu

SEQ ID NO: 639150 - RNA, 19 nt, Homo sapiens
ggaguagucugcucaagau

SEQ ID NO: 639151 - RNA, 19 nt, Homo sapiens
ggacagaucugggcugaag

SEQ ID NO: 639152 - RNA, 19 nt, Homo sapiens
ggaacgguguguaauaaug

SEQ ID NO: 639153 - RNA, 19 nt, Homo sapiens
cuacguaucugcuacuuug

SEQ ID NO: 639154 - RNA, 19 nt, Homo sapiens
ggaccgauauggcucaaug

SEQ ID NO: 639155 - RNA, 19 nt, Homo sapiens
gcaaguggccucuguaauc

SEQ ID NO: 639156 - RNA, 19 nt, Homo sapiens
gaacagugugugaugauaa

SEQ ID NO: 639157 - RNA, 19 nt, Homo sapiens
gaguucagccuuuaagaua

SEQ ID NO: 639158 - RNA, 19 nt, Homo sapiens
cauagaagaugcccauguu

SEQ ID NO: 639159 - RNA, 19 nt, Homo sapiens
ggaacagugugugaugaua

SEQ ID NO: 639160 - RNA, 19 nt, Homo sapiens
uaagaggccugugauuauu

SEQ ID NO: 639161 - RNA, 19 nt, Homo sapiens
gaucuggaccuaaugaauu

SEQ ID NO: 639162 - RNA, 19 nt, Homo sapiens
gcauuauucuucuugacua

SEQ ID NO: 639163 - RNA, 19 nt, Homo sapiens
ggaaaagaaucccgcauuu

SEQ ID NO: 639164 - RNA, 19 nt, Homo sapiens
gaaaugcaauggaaaagaa

SEQ ID NO: 639165 - RNA, 19 nt, Homo sapiens
ggagaaggcucuggaccaa

SEQ ID NO: 639166 - RNA, 19 nt, Homo sapiens
gcacaauguuauuaccuau

SEQ ID NO: 639167 - RNA, 19 nt, Homo sapiens
gaauggugcuacuugaaga

SEQ ID NO: 639168 - RNA, 19 nt, Homo sapiens
caacugggauguccaacug

SEQ ID NO: 639169 - RNA, 19 nt, Homo sapiens
ggacaagaaugacugaaaa

SEQ ID NO: 639170 - RNA, 19 nt, Homo sapiens
gaggagaccuggaucacau

SEQ ID NO: 639171 - RNA, 19 nt, Homo sapiens
caaaacaucuuaucaagug

SEQ ID NO: 639172 - RNA, 19 nt, Homo sapiens
uaacuguacucaccaacaa

SEQ ID NO: 639173 - RNA, 19 nt, Homo sapiens
gcauuuggauggaucaugu

SEQ ID NO: 639174 - RNA, 19 nt, Homo sapiens
ccagugaguucagccuuua

SEQ ID NO: 639175 - RNA, 19 nt, Homo sapiens
ucacuuagcaugaauccua

SEQ ID NO: 639176 - RNA, 19 nt, Homo sapiens
agaggaauauuaugacuug

SEQ ID NO: 639177 - RNA, 19 nt, Homo sapiens
caugggagauuguccugua

SEQ ID NO: 639178 - RNA, 19 nt, Homo sapiens
gcaaagggaaugagucuuc

SEQ ID NO: 639179 - RNA, 19 nt, Homo sapiens
ucaggaagauuagaaguga

SEQ ID NO: 639180 - RNA, 19 nt, Homo sapiens
gggaaugagucagcucuuu

SEQ ID NO: 639181 - RNA, 19 nt, Homo sapiens
augaagaccuggacuauug

SEQ ID NO: 639182 - RNA, 19 nt, Homo sapiens
caaaugaacacacccauca

SEQ ID NO: 639183 - RNA, 19 nt, Homo sapiens
ucaaugaagugaagugcaa

SEQ ID NO: 639184 - RNA, 19 nt, Homo sapiens
cgauauggcucaaugaagu

SEQ ID NO: 639185 - RNA, 19 nt, Homo sapiens
ggacuuaccugugaucacu

SEQ ID NO: 639186 - RNA, 19 nt, Homo sapiens
ggaaagcauuauugcaauc

SEQ ID NO: 639187 - RNA, 19 nt, Homo sapiens
caaagagccucacaguuac

SEQ ID NO: 639188 - RNA, 19 nt, Homo sapiens
caacuucgccugguaaaug

SEQ ID NO: 639189 - RNA, 19 nt, Homo sapiens
uaacggaaaugaaacuucu

SEQ ID NO: 639190 - RNA, 19 nt, Homo sapiens
acacauggcuguuucuaag

SEQ ID NO: 639191 - RNA, 19 nt, Homo sapiens
gggaaagcauuauugcaau

SEQ ID NO: 639192 - RNA, 19 nt, Homo sapiens
gcucagauggauccaauuu

SEQ ID NO: 639193 - RNA, 19 nt, Homo sapiens
ggauggaucauguuucuug

SEQ ID NO: 639194 - RNA, 19 nt, Homo sapiens
gaaauucaccucucucacu

SEQ ID NO: 639195 - RNA, 19 nt, Homo sapiens
aaagaaccaugcagaggaa

SEQ ID NO: 639196 - RNA, 19 nt, Homo sapiens
ugaggaugcuggagugauu

SEQ ID NO: 639197 - RNA, 19 nt, Homo sapiens
gaacugcaaacaucaagga

SEQ ID NO: 639198 - RNA, 19 nt, Homo sapiens
ucaccucucucacugacua

SEQ ID NO: 639199 - RNA, 19 nt, Homo sapiens
aagcauaacugugaucaug

SEQ ID NO: 639200 - RNA, 19 nt, Homo sapiens
gacugcugcugaauuuaua

SEQ ID NO: 639201 - RNA, 19 nt, Homo sapiens
cuauaauccucauguugua

SEQ ID NO: 639202 - RNA, 19 nt, Homo sapiens
caagauaagacuucaggaa

SEQ ID NO: 639203 - RNA, 19 nt, Homo sapiens
gcucagaauucaugucucu

SEQ ID NO: 639204 - RNA, 19 nt, Homo sapiens
gagcaaguggccucuguaa

SEQ ID NO: 639205 - RNA, 19 nt, Homo sapiens
aaaugaaacuucucuuugg

SEQ ID NO: 639206 - RNA, 19 nt, Homo sapiens
ggaaaugagucagcucucu

SEQ ID NO: 639207 - RNA, 19 nt, Homo sapiens
gcaagaguagcaugucuga

SEQ ID NO: 639208 - RNA, 19 nt, Homo sapiens
cagcuuaaauguggaguug

SEQ ID NO: 639209 - RNA, 19 nt, Homo sapiens
ggaaagcauaguaacugua

SEQ ID NO: 639210 - RNA, 19 nt, Homo sapiens
ggaaugagucagcucuuug

SEQ ID NO: 639211 - RNA, 19 nt, Homo sapiens
auacaaauccacagaacua

SEQ ID NO: 639212 - RNA, 19 nt, Homo sapiens
cagacauucuacuuugaua

SEQ ID NO: 639213 - RNA, 19 nt, Homo sapiens
gaauugcacagauauuuca

SEQ ID NO: 639214 - RNA, 19 nt, Homo sapiens
gcuguggccugcauagaga

SEQ ID NO: 639215 - RNA, 19 nt, Homo sapiens
gaugacggcugggacaguu

SEQ ID NO: 639216 - RNA, 19 nt, Homo sapiens
gggaaagcauaguaacugu

SEQ ID NO: 639217 - RNA, 19 nt, Homo sapiens
ucagaauggugcuacuuga

SEQ ID NO: 639218 - RNA, 19 nt, Homo sapiens
uagggaggccuuuagcuua

SEQ ID NO: 639219 - RNA, 19 nt, Homo sapiens
gaagcuuagaugcauauaa

SEQ ID NO: 639220 - RNA, 19 nt, Homo sapiens
gaaacuggagugagaauua

SEQ ID NO: 639221 - RNA, 19 nt, Homo sapiens
gauccaagcuaauaugaga

SEQ ID NO: 639222 - RNA, 19 nt, Homo sapiens
cuccagagcuccagaaaua

SEQ ID NO: 639223 - RNA, 19 nt, Homo sapiens
caacagcaaugaugauaau

SEQ ID NO: 639224 - RNA, 19 nt, Homo sapiens
gaacaagaucaucaccuua

SEQ ID NO: 639225 - RNA, 19 nt, Homo sapiens
caaagagcauccagaguga

SEQ ID NO: 639226 - RNA, 19 nt, Homo sapiens
ucacagagaacuacaagua

SEQ ID NO: 639227 - RNA, 19 nt, Homo sapiens
gaacuacaaguaugaagaa

SEQ ID NO: 639228 - RNA, 19 nt, Homo sapiens
gaaaagcaguccugagaaa

SEQ ID NO: 639229 - RNA, 19 nt, Homo sapiens
ucaaggaccucaaagugaa

SEQ ID NO: 639230 - RNA, 19 nt, Homo sapiens
gaucaucaccuuaucuuau

SEQ ID NO: 639231 - RNA, 19 nt, Homo sapiens
caacaugggccaggauaua

SEQ ID NO: 639232 - RNA, 19 nt, Homo sapiens
aaaggcagauccaagcuaa

SEQ ID NO: 639233 - RNA, 19 nt, Homo sapiens
gcaggaguaugucaugaau

SEQ ID NO: 639234 - RNA, 19 nt, Homo sapiens
uauccaagcaucacgauua

SEQ ID NO: 639235 - RNA, 19 nt, Homo sapiens
ggacacagcguucaucaca

SEQ ID NO: 639236 - RNA, 19 nt, Homo sapiens
caacauguccucccaguuc

SEQ ID NO: 639237 - RNA, 19 nt, Homo sapiens
gcaacaaguuuaaggacau

SEQ ID NO: 639238 - RNA, 19 nt, Homo sapiens
gaaccagccacucuccaua

SEQ ID NO: 639239 - RNA, 19 nt, Homo sapiens
cuacaaguaugaagaagga

SEQ ID NO: 639240 - RNA, 19 nt, Homo sapiens
ccaaagaggagcagaguug

SEQ ID NO: 639241 - RNA, 19 nt, Homo sapiens
ggaauaagaagaaggauac

SEQ ID NO: 639242 - RNA, 19 nt, Homo sapiens
ggagugagaauuacacaga

SEQ ID NO: 639243 - RNA, 19 nt, Homo sapiens
ugaacaagaucaucaccuu

SEQ ID NO: 639244 - RNA, 19 nt, Homo sapiens
gugcaagucucccugaaau

SEQ ID NO: 639245 - RNA, 19 nt, Homo sapiens
gcagaaagucuuccuugga

SEQ ID NO: 639246 - RNA, 19 nt, Homo sapiens
gcauacaccuucccuucga

SEQ ID NO: 639247 - RNA, 19 nt, Homo sapiens
cgaguucuguuggcaauuu

SEQ ID NO: 639248 - RNA, 19 nt, Homo sapiens
gaaguggaccugaacuaug

SEQ ID NO: 639249 - RNA, 19 nt, Homo sapiens
ugaggaugcugucuacuug

SEQ ID NO: 639250 - RNA, 19 nt, Homo sapiens
gcaagucucccugaaauuc

SEQ ID NO: 639251 - RNA, 19 nt, Homo sapiens
gauggaaaccugaucauag

SEQ ID NO: 639252 - RNA, 19 nt, Homo sapiens
ggucuuugcugccgucaug

SEQ ID NO: 639253 - RNA, 19 nt, Homo sapiens
caacaaguuuaaggacauu

SEQ ID NO: 639254 - RNA, 19 nt, Homo sapiens
acagagaacuacaaguaug

SEQ ID NO: 639255 - RNA, 19 nt, Homo sapiens
aaguggaccugaacuauga

SEQ ID NO: 639256 - RNA, 19 nt, Homo sapiens
gaaccugagugcccagucu

SEQ ID NO: 639257 - RNA, 19 nt, Homo sapiens
gaagcaacaaguuuaagga

SEQ ID NO: 639258 - RNA, 19 nt, Homo sapiens
ugucagagccaucaaagaa

SEQ ID NO: 639259 - RNA, 19 nt, Homo sapiens
gggaauaagaagaaggaua

SEQ ID NO: 639260 - RNA, 19 nt, Homo sapiens
aauggaaacuggagugaga

SEQ ID NO: 639261 - RNA, 19 nt, Homo sapiens
gggccaggauauaugcuuu

SEQ ID NO: 639262 - RNA, 19 nt, Homo sapiens
gggcaaugcugggucuuug

SEQ ID NO: 639263 - RNA, 19 nt, Homo sapiens
acaggaauguuuauguaga

SEQ ID NO: 639264 - RNA, 19 nt, Homo sapiens
gagcagccguugugaacca

SEQ ID NO: 639265 - RNA, 19 nt, Homo sapiens
ccaagcaucacgauuaaug

SEQ ID NO: 639266 - RNA, 19 nt, Homo sapiens
gagaaguggaccugaacua

SEQ ID NO: 639267 - RNA, 19 nt, Homo sapiens
caucaaagaaggagaagug

SEQ ID NO: 639268 - RNA, 19 nt, Homo sapiens
cacacucucuccuaaagaa

SEQ ID NO: 639269 - RNA, 19 nt, Homo sapiens
caacaucaucuucgugguu

SEQ ID NO: 639270 - RNA, 19 nt, Homo sapiens
gcacagugaugaggugucu

SEQ ID NO: 639271 - RNA, 19 nt, Homo sapiens
gccugaagcugcuagacaa

SEQ ID NO: 639272 - RNA, 19 nt, Homo sapiens
gcagauccaagcuaauaug

SEQ ID NO: 639273 - RNA, 19 nt, Homo sapiens
ccagugauguggugcaagu

SEQ ID NO: 639274 - RNA, 19 nt, Homo sapiens
gacaacacaggcaggauuu

SEQ ID NO: 639275 - RNA, 19 nt, Homo sapiens
ucaagaaacagcagaaagu

SEQ ID NO: 639276 - RNA, 19 nt, Homo sapiens
cuaaagaagcaaagaccua

SEQ ID NO: 639277 - RNA, 19 nt, Homo sapiens
ggaaaccugaucauagaug

SEQ ID NO: 639278 - RNA, 19 nt, Homo sapiens
ugagaagcaacaaguuuaa

SEQ ID NO: 639279 - RNA, 19 nt, Homo sapiens
ucaucacacucucuccuaa

SEQ ID NO: 639280 - RNA, 19 nt, Homo sapiens
ggagcagaguugcaaccuu

SEQ ID NO: 639281 - RNA, 19 nt, Homo sapiens
uaugagaagcaacaaguuu

SEQ ID NO: 639282 - RNA, 19 nt, Homo sapiens
gagaaaagcaguccugaga

SEQ ID NO: 639283 - RNA, 19 nt, Homo sapiens
aaacugaggaugcugucua

SEQ ID NO: 639284 - RNA, 19 nt, Homo sapiens
gaacuggauccgcccaugu

SEQ ID NO: 639285 - RNA, 19 nt, Homo sapiens
cauuaaggguuacaggaau

SEQ ID NO: 639286 - RNA, 19 nt, Homo sapiens
gcuaauaugagaagcaaca

SEQ ID NO: 639287 - RNA, 19 nt, Homo sapiens
auggaaaccugaucauaga

SEQ ID NO: 639288 - RNA, 19 nt, Homo sapiens
caaaggcagauccaagcua

SEQ ID NO: 639289 - RNA, 19 nt, Homo sapiens
guucaaggaccucaaagug

SEQ ID NO: 639290 - RNA, 19 nt, Homo sapiens
gaacuaugacacgcccuuu

SEQ ID NO: 639291 - RNA, 19 nt, Homo sapiens
ugacaacacaggcaggauu

SEQ ID NO: 639292 - RNA, 19 nt, Homo sapiens
gcaucacgauuaauguucu

SEQ ID NO: 639293 - RNA, 19 nt, Homo sapiens
gagaggcagguguuucuga

SEQ ID NO: 639294 - RNA, 19 nt, Homo sapiens
cagagaacuacaaguauga

SEQ ID NO: 639295 - RNA, 19 nt, Homo sapiens
ccaugucccuggaacuaug

SEQ ID NO: 639296 - RNA, 19 nt, Homo sapiens
ugaaggcucugcagaagcu

SEQ ID NO: 639297 - RNA, 19 nt, Homo sapiens
agaggcagguguuucugaa

SEQ ID NO: 639298 - RNA, 19 nt, Homo sapiens
aggcagauccaagcuaaua

SEQ ID NO: 639299 - RNA, 19 nt, Homo sapiens
caucacgauuaauguucua

SEQ ID NO: 639300 - RNA, 19 nt, Homo sapiens
aaggagaaguggaccugaa

SEQ ID NO: 639301 - RNA, 19 nt, Homo sapiens
gccgucaugugcacaguga

SEQ ID NO: 639302 - RNA, 19 nt, Homo sapiens
caacgcgccagacguguga

SEQ ID NO: 639303 - RNA, 19 nt, Homo sapiens
ccagagcuccagaaauaau

SEQ ID NO: 639304 - RNA, 19 nt, Homo sapiens
gaaacagcagaaagucuuc

SEQ ID NO: 639305 - RNA, 19 nt, Homo sapiens
agaaacagcagaaagucuu

SEQ ID NO: 639306 - RNA, 19 nt, Homo sapiens
gcgccagacgugugaguuu

SEQ ID NO: 639307 - RNA, 19 nt, Homo sapiens
acaccaagcaagcaucauu

SEQ ID NO: 639308 - RNA, 19 nt, Homo sapiens
caacaccaagcaagcauca

SEQ ID NO: 639309 - RNA, 19 nt, Homo sapiens
ucaacagcaaugaugauaa

SEQ ID NO: 639310 - RNA, 19 nt, Homo sapiens
ucagugcccugggugaaga

SEQ ID NO: 639311 - RNA, 19 nt, Homo sapiens
gcccaugucccuggaacua

SEQ ID NO: 639312 - RNA, 19 nt, Homo sapiens
ggaaacuggagugagaauu

SEQ ID NO: 639313 - RNA, 19 nt, Homo sapiens
ccuucaaccucacccugua

SEQ ID NO: 639314 - RNA, 19 nt, Homo sapiens
augagaagcaacaaguuua

SEQ ID NO: 639315 - RNA, 19 nt, Homo sapiens
aagcuaauaugagaagcaa

SEQ ID NO: 639316 - RNA, 19 nt, Homo sapiens
ucauagacaucugccugaa

SEQ ID NO: 639317 - RNA, 19 nt, Homo sapiens
acacagcguucaucacacu

SEQ ID NO: 639318 - RNA, 19 nt, Homo sapiens
aaacuggagugagaauuac

SEQ ID NO: 639319 - RNA, 19 nt, Homo sapiens
cacgauuaauguucuagga

SEQ ID NO: 639320 - RNA, 19 nt, Homo sapiens
gagcguagcuagcuuauuu

SEQ ID NO: 639321 - RNA, 19 nt, Homo sapiens
gaagucauguucuaaauug

SEQ ID NO: 639322 - RNA, 19 nt, Homo sapiens
gaaauacugugucucauga

SEQ ID NO: 639323 - RNA, 19 nt, Homo sapiens
ccaaagcccucaaauugua

SEQ ID NO: 639324 - RNA, 19 nt, Homo sapiens
ccacauggauugauuguau

SEQ ID NO: 639325 - RNA, 19 nt, Homo sapiens
ggaaagugaucgcaacuau

SEQ ID NO: 639326 - RNA, 19 nt, Homo sapiens
gaaagacucccuuccauga

SEQ ID NO: 639327 - RNA, 19 nt, Homo sapiens
aaagugaucgcaacuauua

SEQ ID NO: 639328 - RNA, 19 nt, Homo sapiens
caccacaccuggcuaauuu

SEQ ID NO: 639329 - RNA, 19 nt, Homo sapiens
caagaaagcaguccgauga

SEQ ID NO: 639330 - RNA, 19 nt, Homo sapiens
gauugggacuguuugauuu

SEQ ID NO: 639331 - RNA, 19 nt, Homo sapiens
gaacuacuuugcaaacauc

SEQ ID NO: 639332 - RNA, 19 nt, Homo sapiens
gaaccaaggagcacucaaa

SEQ ID NO: 639333 - RNA, 19 nt, Homo sapiens
caaaauaacccgaccuuua

SEQ ID NO: 639334 - RNA, 19 nt, Homo sapiens
guaaaugacucagauuauc

SEQ ID NO: 639335 - RNA, 19 nt, Homo sapiens
gaacagcaguguaaaugac

SEQ ID NO: 639336 - RNA, 19 nt, Homo sapiens
uaaaauaccuucacaagug

SEQ ID NO: 639337 - RNA, 19 nt, Homo sapiens
ggauugaagcuuugaaauu

SEQ ID NO: 639338 - RNA, 19 nt, Homo sapiens
ucaacaaccugaacuacuu

SEQ ID NO: 639339 - RNA, 19 nt, Homo sapiens
gaggaguacuuucugaaga

SEQ ID NO: 639340 - RNA, 19 nt, Homo sapiens
gaucucugguguucucuuu

SEQ ID NO: 639341 - RNA, 19 nt, Homo sapiens
gcugggagcuggcuucugu

SEQ ID NO: 639342 - RNA, 19 nt, Homo sapiens
gagaauguacguuugcuuu

SEQ ID NO: 639343 - RNA, 19 nt, Homo sapiens
cauaauagguccucuuguc

SEQ ID NO: 639344 - RNA, 19 nt, Homo sapiens
gaugaggaguacuuucuga

SEQ ID NO: 639345 - RNA, 19 nt, Homo sapiens
ccacgagucuugcccuuga

SEQ ID NO: 639346 - RNA, 19 nt, Homo sapiens
gaggagagaauguacguuu

SEQ ID NO: 639347 - RNA, 19 nt, Homo sapiens
gguaugcucugcugaggaa

SEQ ID NO: 639348 - RNA, 19 nt, Homo sapiens
auauguaucugcuuccuua

SEQ ID NO: 639349 - RNA, 19 nt, Homo sapiens
aaacaugagugaaauugga

SEQ ID NO: 639350 - RNA, 19 nt, Homo sapiens
guagcuagcuuauuuccau

SEQ ID NO: 639351 - RNA, 19 nt, Homo sapiens
ccaaggagcacucaaauag

SEQ ID NO: 639352 - RNA, 19 nt, Homo sapiens
ccagcuggcuucagugauu

SEQ ID NO: 639353 - RNA, 19 nt, Homo sapiens
gaagggcccaauagacaua

SEQ ID NO: 639354 - RNA, 19 nt, Homo sapiens
gguaagcuauagcauaugu

SEQ ID NO: 639355 - RNA, 19 nt, Homo sapiens
gacauaaacaugagugaaa

SEQ ID NO: 639356 - RNA, 19 nt, Homo sapiens
ggagccacauggauugauu

SEQ ID NO: 639357 - RNA, 19 nt, Homo sapiens
aaccauaccugcccugaaa

SEQ ID NO: 639358 - RNA, 19 nt, Homo sapiens
gugugaaauugucauguua

SEQ ID NO: 639359 - RNA, 19 nt, Homo sapiens
aaccaaagcccucaaauug

SEQ ID NO: 639360 - RNA, 19 nt, Homo sapiens
gaacaccuaccucuucaug

SEQ ID NO: 639361 - RNA, 19 nt, Homo sapiens
caugaaggaucacagaguu

SEQ ID NO: 639362 - RNA, 19 nt, Homo sapiens
gaucgcaacuauuauggau

SEQ ID NO: 639363 - RNA, 19 nt, Homo sapiens
ugggaaaugucauaguuaa

SEQ ID NO: 639364 - RNA, 19 nt, Homo sapiens
caccaggccucgaauauca

SEQ ID NO: 639365 - RNA, 19 nt, Homo sapiens
ccaaagugcugggauuaug

SEQ ID NO: 639366 - RNA, 19 nt, Homo sapiens
ccgguaagcuauagcauau

SEQ ID NO: 639367 - RNA, 19 nt, Homo sapiens
gcgggaggcugcuguuaga

SEQ ID NO: 639368 - RNA, 19 nt, Homo sapiens
caagagaacagaaauacug

SEQ ID NO: 639369 - RNA, 19 nt, Homo sapiens
gaaagugaucgcaacuauu

SEQ ID NO: 639370 - RNA, 19 nt, Homo sapiens
ccaauagacauaaacauga

SEQ ID NO: 639371 - RNA, 19 nt, Homo sapiens
aaugugaccuugugcauau

SEQ ID NO: 639372 - RNA, 19 nt, Homo sapiens
gaucuuguuugaagcucua

SEQ ID NO: 639373 - RNA, 19 nt, Homo sapiens
gcuuaacaguggaacaauu

SEQ ID NO: 639374 - RNA, 19 nt, Homo sapiens
aaacaggaaccaaauguga

SEQ ID NO: 639375 - RNA, 19 nt, Homo sapiens
gcugugaguugcuuucaau

SEQ ID NO: 639376 - RNA, 19 nt, Homo sapiens
gaacauuacacacagaagu

SEQ ID NO: 639377 - RNA, 19 nt, Homo sapiens
ccgaauugcugucacuuug

SEQ ID NO: 639378 - RNA, 19 nt, Homo sapiens
ccacagggcagcugcguuu

SEQ ID NO: 639379 - RNA, 19 nt, Homo sapiens
uagcuuauuuccaucacua

SEQ ID NO: 639380 - RNA, 19 nt, Homo sapiens
cacagaaguucauuugguu

SEQ ID NO: 639381 - RNA, 19 nt, Homo sapiens
aaugucaucucccgaauug

SEQ ID NO: 639382 - RNA, 19 nt, Homo sapiens
gaauguacguuugcuuuac

SEQ ID NO: 639383 - RNA, 19 nt, Homo sapiens
ggauugggacuguuugauu

SEQ ID NO: 639384 - RNA, 19 nt, Homo sapiens
gaaaccuuccugcaaacua

SEQ ID NO: 639385 - RNA, 19 nt, Homo sapiens
ggccacaguuucugaacaa

SEQ ID NO: 639386 - RNA, 19 nt, Homo sapiens
ggaacagcaguguaaauga

SEQ ID NO: 639387 - RNA, 19 nt, Homo sapiens
gaacugagggagugagcuu

SEQ ID NO: 639388 - RNA, 19 nt, Homo sapiens
gaugucauuuggaaggauu

SEQ ID NO: 639389 - RNA, 19 nt, Homo sapiens
ugacucagauuauccucuu

SEQ ID NO: 639390 - RNA, 19 nt, Homo sapiens
acacagaaguucauuuggu

SEQ ID NO: 639391 - RNA, 19 nt, Homo sapiens
aaaccaaagcccucaaauu

SEQ ID NO: 639392 - RNA, 19 nt, Homo sapiens
gaaagcaguccgaugagau

SEQ ID NO: 639393 - RNA, 19 nt, Homo sapiens
gcaaugaaagacuuggauu

SEQ ID NO: 639394 - RNA, 19 nt, Homo sapiens
caugaacucuucuccaaag

SEQ ID NO: 639395 - RNA, 19 nt, Homo sapiens
ccugcaaacuacaacauuu

SEQ ID NO: 639396 - RNA, 19 nt, Homo sapiens
agugaaaccuuccugcaaa

SEQ ID NO: 639397 - RNA, 19 nt, Homo sapiens
gugcauauagcaauaaaga

SEQ ID NO: 639398 - RNA, 19 nt, Homo sapiens
caacauuaguaacugauac

SEQ ID NO: 639399 - RNA, 19 nt, Homo sapiens
ucacauacgacgccuugua

SEQ ID NO: 639400 - RNA, 19 nt, Homo sapiens
ccaaagacccaaccaucaa

SEQ ID NO: 639401 - RNA, 19 nt, Homo sapiens
gcaagaauacucauuuuga

SEQ ID NO: 639402 - RNA, 19 nt, Homo sapiens
gucaggcgaucuuguuuga

SEQ ID NO: 639403 - RNA, 19 nt, Homo sapiens
uggcucaggugaacgagua

SEQ ID NO: 639404 - RNA, 19 nt, Homo sapiens
gcaggagccacauggauug

SEQ ID NO: 639405 - RNA, 19 nt, Homo sapiens
caagugaacauuacacaca

SEQ ID NO: 639406 - RNA, 19 nt, Homo sapiens
gaauuugugccucuuuguu

SEQ ID NO: 639407 - RNA, 19 nt, Homo sapiens
guagaucacauaccggaaa

SEQ ID NO: 639408 - RNA, 19 nt, Homo sapiens
cagauuauccucuugacuu

SEQ ID NO: 639409 - RNA, 19 nt, Homo sapiens
guguaaaugacucagauua

SEQ ID NO: 639410 - RNA, 19 nt, Homo sapiens
ugaguugcuuucaauguga

SEQ ID NO: 639411 - RNA, 19 nt, Homo sapiens
gugaguugcuuucaaugug

SEQ ID NO: 639412 - RNA, 19 nt, Homo sapiens
gcucuuaucggcucauaug

SEQ ID NO: 639413 - RNA, 19 nt, Homo sapiens
acaccuaccucuucaugau

SEQ ID NO: 639414 - RNA, 19 nt, Homo sapiens
gaaauuggaauggauuaca

SEQ ID NO: 639415 - RNA, 19 nt, Homo sapiens
caauagacauaaacaugag

SEQ ID NO: 639416 - RNA, 19 nt, Homo sapiens
ggauauagggcaugucaca

SEQ ID NO: 639417 - RNA, 19 nt, Homo sapiens
aaaugcaguugaagaaugu

SEQ ID NO: 639418 - RNA, 19 nt, Homo sapiens
cagcaagagaacagaaaua

SEQ ID NO: 639419 - RNA, 19 nt, Homo sapiens
caacaaccugaacuacuuu

SEQ ID NO: 639420 - RNA, 19 nt, Homo sapiens
ggucaugucuguuguauuu

SEQ ID NO: 639421 - RNA, 19 nt, Homo sapiens
ggaaguugcugaucaguug

SEQ ID NO: 639422 - RNA, 19 nt, Homo sapiens
ccacuucucuacuccauua

SEQ ID NO: 639423 - RNA, 19 nt, Homo sapiens
caugagaacuccagaauga

SEQ ID NO: 639424 - RNA, 19 nt, Homo sapiens
ggacaagucugaaacaaag

SEQ ID NO: 639425 - RNA, 19 nt, Homo sapiens
guaggaagcucaggacuuu

SEQ ID NO: 639426 - RNA, 19 nt, Homo sapiens
gaaggaaacuaguaagauc

SEQ ID NO: 639427 - RNA, 19 nt, Homo sapiens
gcuaaucucugauaaugaa

SEQ ID NO: 639428 - RNA, 19 nt, Homo sapiens
ccauagaucuccuugcuaa

SEQ ID NO: 639429 - RNA, 19 nt, Homo sapiens
uaacaggaaugugucuuua

SEQ ID NO: 639430 - RNA, 19 nt, Homo sapiens
gaaauuugaagaccagaua

SEQ ID NO: 639431 - RNA, 19 nt, Homo sapiens
ugaaauaccugaugaagag

SEQ ID NO: 639432 - RNA, 19 nt, Homo sapiens
uaaaguugcuuacagauuc

SEQ ID NO: 639433 - RNA, 19 nt, Homo sapiens
gaaagaguaucagaccaaa

SEQ ID NO: 639434 - RNA, 19 nt, Homo sapiens
gcucugugcugaaauuuga

SEQ ID NO: 639435 - RNA, 19 nt, Homo sapiens
gcacaggaguggcccagaa

SEQ ID NO: 639436 - RNA, 19 nt, Homo sapiens
ugagggagauggauuaaug

SEQ ID NO: 639437 - RNA, 19 nt, Homo sapiens
uaagggaggucuucaggaa

SEQ ID NO: 639438 - RNA, 19 nt, Homo sapiens
gaauugcucugugcugaaa

SEQ ID NO: 639439 - RNA, 19 nt, Homo sapiens
cagcauccauggcucauuu

SEQ ID NO: 639440 - RNA, 19 nt, Homo sapiens
gaugugaaauaccugauga

SEQ ID NO: 639441 - RNA, 19 nt, Homo sapiens
ggaguuugcucugaauuug

SEQ ID NO: 639442 - RNA, 19 nt, Homo sapiens
ggaauggcuuucuuuagga

SEQ ID NO: 639443 - RNA, 19 nt, Homo sapiens
ccaguaaucuagaagaaga

SEQ ID NO: 639444 - RNA, 19 nt, Homo sapiens
cuagagugguuacauuuaa

SEQ ID NO: 639445 - RNA, 19 nt, Homo sapiens
gaaucugucuaccuucauu

SEQ ID NO: 639446 - RNA, 19 nt, Homo sapiens
gguaauggguuguagauac

SEQ ID NO: 639447 - RNA, 19 nt, Homo sapiens
ucaguaaugugauuucaga

SEQ ID NO: 639448 - RNA, 19 nt, Homo sapiens
gaaagaggagcguaagaug

SEQ ID NO: 639449 - RNA, 19 nt, Homo sapiens
acaggaaugugucuuuaaa

SEQ ID NO: 639450 - RNA, 19 nt, Homo sapiens
acucuuaccuguugucauu

SEQ ID NO: 639451 - RNA, 19 nt, Homo sapiens
ggaguaauaucccacaacu

SEQ ID NO: 639452 - RNA, 19 nt, Homo sapiens
uaauuuggguucuugaguu

SEQ ID NO: 639453 - RNA, 19 nt, Homo sapiens
gagaguauccuucuggaau

SEQ ID NO: 639454 - RNA, 19 nt, Homo sapiens
gcuagagugguuacauuua

SEQ ID NO: 639455 - RNA, 19 nt, Homo sapiens
ggccugcgcuuaccggaaa

SEQ ID NO: 639456 - RNA, 19 nt, Homo sapiens
gaccagauaaugaaacuga

SEQ ID NO: 639457 - RNA, 19 nt, Homo sapiens
gcuuacagauucucguuug

SEQ ID NO: 639458 - RNA, 19 nt, Homo sapiens
caaaugagaagggagagua

SEQ ID NO: 639459 - RNA, 19 nt, Homo sapiens
gaagaagagaugaggaaga

SEQ ID NO: 639460 - RNA, 19 nt, Homo sapiens
gacauuugcuuuccucaca

SEQ ID NO: 639461 - RNA, 19 nt, Homo sapiens
uuacugugcugacugugua

SEQ ID NO: 639462 - RNA, 19 nt, Homo sapiens
ucagaagcaugaagaggaa

SEQ ID NO: 639463 - RNA, 19 nt, Homo sapiens
gagaauagccagguuaucu

SEQ ID NO: 639464 - RNA, 19 nt, Homo sapiens
ucacauaugcaucaucuga

SEQ ID NO: 639465 - RNA, 19 nt, Homo sapiens
cagguuugcugucacauau

SEQ ID NO: 639466 - RNA, 19 nt, Homo sapiens
ggaaagaggagcguaagau

SEQ ID NO: 639467 - RNA, 19 nt, Homo sapiens
ugacaggaauggcuuucuu

SEQ ID NO: 639468 - RNA, 19 nt, Homo sapiens
auacuuggcaguucaauuu

SEQ ID NO: 639469 - RNA, 19 nt, Homo sapiens
uuaagucuguguuccauug

SEQ ID NO: 639470 - RNA, 19 nt, Homo sapiens
gcauugagcagaaagacuu

SEQ ID NO: 639471 - RNA, 19 nt, Homo sapiens
guaacaggaaugugucuuu

SEQ ID NO: 639472 - RNA, 19 nt, Homo sapiens
guaccuaccaucugcauug

SEQ ID NO: 639473 - RNA, 19 nt, Homo sapiens
gacauguacucccaggauu

SEQ ID NO: 639474 - RNA, 19 nt, Homo sapiens
acauaugcaucaucugaaa

SEQ ID NO: 639475 - RNA, 19 nt, Homo sapiens
auauaacucuuaccuguug

SEQ ID NO: 639476 - RNA, 19 nt, Homo sapiens
ggccaguaaucuagaagaa

SEQ ID NO: 639477 - RNA, 19 nt, Homo sapiens
gaauggcuuucuuuaggau

SEQ ID NO: 639478 - RNA, 19 nt, Homo sapiens
caggagugguucucuguga

SEQ ID NO: 639479 - RNA, 19 nt, Homo sapiens
aagaagagaugaggaagau

SEQ ID NO: 639480 - RNA, 19 nt, Homo sapiens
ugcaucaucugaaaucauu

SEQ ID NO: 639481 - RNA, 19 nt, Homo sapiens
ccagaguggugcuuacugu

SEQ ID NO: 639482 - RNA, 19 nt, Homo sapiens
cagaagaggaacaugaauu

SEQ ID NO: 639483 - RNA, 19 nt, Homo sapiens
ggacauguacucccaggau

SEQ ID NO: 639484 - RNA, 19 nt, Homo sapiens
ugaauuucguaguuccaua

SEQ ID NO: 639485 - RNA, 19 nt, Homo sapiens
guaauggguuguagauacu

SEQ ID NO: 639486 - RNA, 19 nt, Homo sapiens
cuuuaaagcuagucauuuc

SEQ ID NO: 639487 - RNA, 19 nt, Homo sapiens
aagcuagagugguuacauu

SEQ ID NO: 639488 - RNA, 19 nt, Homo sapiens
gcaugaagaggaagggauu

SEQ ID NO: 639489 - RNA, 19 nt, Homo sapiens
uuucguaguuccauagauu

SEQ ID NO: 639490 - RNA, 19 nt, Homo sapiens
acaguuauauugccaugga

SEQ ID NO: 639491 - RNA, 19 nt, Homo sapiens
ugaggaagauccgagaaau

SEQ ID NO: 639492 - RNA, 19 nt, Homo sapiens
cagguuaucugugaagugu

SEQ ID NO: 639493 - RNA, 19 nt, Homo sapiens
uaaucaggcaguaagauaa

SEQ ID NO: 639494 - RNA, 19 nt, Homo sapiens
uuaaucaggcaguaagaua

SEQ ID NO: 639495 - RNA, 19 nt, Homo sapiens
cuucucuacuccauuauuu

SEQ ID NO: 639496 - RNA, 19 nt, Homo sapiens
gaaugaggauguggacucu

SEQ ID NO: 639497 - RNA, 19 nt, Homo sapiens
gaagaggaagggauugaca

SEQ ID NO: 639498 - RNA, 19 nt, Homo sapiens
cugcagcacuuguggagaa

SEQ ID NO: 639499 - RNA, 19 nt, Homo sapiens
acuacaguauggacaauuu

SEQ ID NO: 639500 - RNA, 19 nt, Homo sapiens
aaagaggagcguaagauga

SEQ ID NO: 639501 - RNA, 19 nt, Homo sapiens
agcguaagaugaaagagua

SEQ ID NO: 639502 - RNA, 19 nt, Homo sapiens
gaauagccagguuaucugu

SEQ ID NO: 639503 - RNA, 19 nt, Homo sapiens
uugcuaaucucugauaaug

SEQ ID NO: 639504 - RNA, 19 nt, Homo sapiens
cagcugggccuuacauuca

SEQ ID NO: 639505 - RNA, 19 nt, Homo sapiens
aaaaugguguucuuaggua

SEQ ID NO: 639506 - RNA, 19 nt, Homo sapiens
uuaaauaucaggacaaguc

SEQ ID NO: 639507 - RNA, 19 nt, Homo sapiens
acaggaauggcuuucuuua

SEQ ID NO: 639508 - RNA, 19 nt, Homo sapiens
gacaggaauggcuuucuuu

SEQ ID NO: 639509 - RNA, 19 nt, Homo sapiens
caaguauuauaagcuggua

SEQ ID NO: 639510 - RNA, 19 nt, Homo sapiens
gaaacuaguaagaucagau

SEQ ID NO: 639511 - RNA, 19 nt, Homo sapiens
ggaaacuaguaagaucaga

SEQ ID NO: 639512 - RNA, 19 nt, Homo sapiens
gaagcagaaugaggaugug

SEQ ID NO: 639513 - RNA, 19 nt, Homo sapiens
gauuuuggcuauaugguaa

SEQ ID NO: 639514 - RNA, 19 nt, Homo sapiens
cuucuggaaucaauacuug

SEQ ID NO: 639515 - RNA, 19 nt, Homo sapiens
cuucugcggugcaauguug

SEQ ID NO: 639516 - RNA, 19 nt, Homo sapiens
aagaggagcguaagaugaa

SEQ ID NO: 639517 - RNA, 19 nt, Homo sapiens
cgacuucucagguuucuuc

SEQ ID NO: 639518 - RNA, 19 nt, Homo sapiens
gaggacagcauugaugaug

SEQ ID NO: 639519 - RNA, 19 nt, Homo sapiens
ugaaagaguaucagaccaa

SEQ ID NO: 639520 - RNA, 19 nt, Homo sapiens
ggacauacauggcagaaau

SEQ ID NO: 639521 - RNA, 19 nt, Homo sapiens
ggacaaaccacgcaaagaa

SEQ ID NO: 639522 - RNA, 19 nt, Homo sapiens
uaacagugguuguguggua

SEQ ID NO: 639523 - RNA, 19 nt, Homo sapiens
gaauaacugugcuugaaga

SEQ ID NO: 639524 - RNA, 19 nt, Homo sapiens
gcauguaacucgcuuaaag

SEQ ID NO: 639525 - RNA, 19 nt, Homo sapiens
uaacugugcuugaagaaga

SEQ ID NO: 639526 - RNA, 19 nt, Homo sapiens
gcagaaauuuaagcaauga

SEQ ID NO: 639527 - RNA, 19 nt, Homo sapiens
gggaauaacugugcuugaa

SEQ ID NO: 639528 - RNA, 19 nt, Homo sapiens
gguaagauauaggugauuu

SEQ ID NO: 639529 - RNA, 19 nt, Homo sapiens
gacaauguggcacuuaaua

SEQ ID NO: 639530 - RNA, 19 nt, Homo sapiens
guaagaaacaaacugauga

SEQ ID NO: 639531 - RNA, 19 nt, Homo sapiens
cagaugagcuagaagagau

SEQ ID NO: 639532 - RNA, 19 nt, Homo sapiens
aaagaaagguuggcucguu

SEQ ID NO: 639533 - RNA, 19 nt, Homo sapiens
gcaaugaggagaugauaca

SEQ ID NO: 639534 - RNA, 19 nt, Homo sapiens
gaagaaaauucccaacaug

SEQ ID NO: 639535 - RNA, 19 nt, Homo sapiens
gugguugugugguaagaua

SEQ ID NO: 639536 - RNA, 19 nt, Homo sapiens
caauguggcacuuaauaaa

SEQ ID NO: 639537 - RNA, 19 nt, Homo sapiens
caugagcccuacacauuug

SEQ ID NO: 639538 - RNA, 19 nt, Homo sapiens
gaagaaaacugucaaucag

SEQ ID NO: 639539 - RNA, 19 nt, Homo sapiens
ucuacaaguuucccucuuu

SEQ ID NO: 639540 - RNA, 19 nt, Homo sapiens
ggcagaaauuuaagcaaug

SEQ ID NO: 639541 - RNA, 19 nt, Homo sapiens
gacaaaccacgcaaagaaa

SEQ ID NO: 639542 - RNA, 19 nt, Homo sapiens
gucaugagcccuacacauu

SEQ ID NO: 639543 - RNA, 19 nt, Homo sapiens
ccaccuggacuuucuguuu

SEQ ID NO: 639544 - RNA, 19 nt, Homo sapiens
guccuuauccuauuuaaug

SEQ ID NO: 639545 - RNA, 19 nt, Homo sapiens
uggcagaaauuuaagcaau

SEQ ID NO: 639546 - RNA, 19 nt, Homo sapiens
gcaugaaagauguacauau

SEQ ID NO: 639547 - RNA, 19 nt, Homo sapiens
caccuggacuuucuguuug

SEQ ID NO: 639548 - RNA, 19 nt, Homo sapiens
gaggagaggacgacuagga

SEQ ID NO: 639549 - RNA, 19 nt, Homo sapiens
gaagagaugaaaagaguaa

SEQ ID NO: 639550 - RNA, 19 nt, Homo sapiens
caaagaaaaugaagaagag

SEQ ID NO: 639551 - RNA, 19 nt, Homo sapiens
ggacuuucuguuugcauuu

SEQ ID NO: 639552 - RNA, 19 nt, Homo sapiens
ggcagcagaugagcuagaa

SEQ ID NO: 639553 - RNA, 19 nt, Homo sapiens
gcaaagaaaaugaagaaga

SEQ ID NO: 639554 - RNA, 19 nt, Homo sapiens
acaauguggcacuuaauaa

SEQ ID NO: 639555 - RNA, 19 nt, Homo sapiens
gagagggaaagcagaagaa

SEQ ID NO: 639556 - RNA, 19 nt, Homo sapiens
cuacacauuugcaugaaag

SEQ ID NO: 639557 - RNA, 19 nt, Homo sapiens
cuacaaguuucccucuuuc

SEQ ID NO: 639558 - RNA, 19 nt, Homo sapiens
uaacgacaauguggcacuu

SEQ ID NO: 639559 - RNA, 19 nt, Homo sapiens
ucaugagcccuacacauuu

SEQ ID NO: 639560 - RNA, 19 nt, Homo sapiens
gcuauaguauugccauugc

SEQ ID NO: 639561 - RNA, 19 nt, Homo sapiens
gcagaugagcuagaagaga

SEQ ID NO: 639562 - RNA, 19 nt, Homo sapiens
ggaauaacugugcuugaag

SEQ ID NO: 639563 - RNA, 19 nt, Homo sapiens
cagcuuauaacgacaaugu

SEQ ID NO: 639564 - RNA, 19 nt, Homo sapiens
cagcagaugagcuagaaga

SEQ ID NO: 639565 - RNA, 19 nt, Homo sapiens
cauacauggcagaaauuua

SEQ ID NO: 639566 - RNA, 19 nt, Homo sapiens
acgacaauguggcacuuaa

SEQ ID NO: 639567 - RNA, 19 nt, Homo sapiens
uuaauguguucggccuuua

SEQ ID NO: 639568 - RNA, 19 nt, Homo sapiens
uagaagagaugaaaagagu

SEQ ID NO: 639569 - RNA, 19 nt, Homo sapiens
gcccuacacauuugcauga

SEQ ID NO: 639570 - RNA, 19 nt, Homo sapiens
gaugauacaggcagcagau

SEQ ID NO: 639571 - RNA, 19 nt, Homo sapiens
guucggccuuuaauucugu

SEQ ID NO: 639572 - RNA, 19 nt, Homo sapiens
agaguaagaaacaaacuga

SEQ ID NO: 639573 - RNA, 19 nt, Homo sapiens
gacauacauggcagaaauu

SEQ ID NO: 639574 - RNA, 19 nt, Homo sapiens
gugguaagauauaggugau

SEQ ID NO: 639575 - RNA, 19 nt, Homo sapiens
guccaccaucucccuauua

SEQ ID NO: 639576 - RNA, 19 nt, Homo sapiens
ccuacacauuugcaugaaa

SEQ ID NO: 639577 - RNA, 19 nt, Homo sapiens
uagcauguaacucgcuuaa

SEQ ID NO: 639578 - RNA, 19 nt, Homo sapiens
acaaacugaugauaaugca

SEQ ID NO: 639579 - RNA, 19 nt, Homo sapiens
gguugugugguaagauaua

SEQ ID NO: 639580 - RNA, 19 nt, Homo sapiens
gaagggaauaacugugcuu

SEQ ID NO: 639581 - RNA, 19 nt, Homo sapiens
uaauguguucggccuuuaa

SEQ ID NO: 639582 - RNA, 19 nt, Homo sapiens
caaguuucccucuuucagu

SEQ ID NO: 639583 - RNA, 19 nt, Homo sapiens
ccuaaaaucuacaaguuuc

SEQ ID NO: 639584 - RNA, 19 nt, Homo sapiens
acaggcagcagaugagcua

SEQ ID NO: 639585 - RNA, 19 nt, Homo sapiens
ggcacuuaauaaauacuug

SEQ ID NO: 639586 - RNA, 19 nt, Homo sapiens
uuuaauguguucggccuuu

SEQ ID NO: 639587 - RNA, 19 nt, Homo sapiens
ugauacaggcagcagauga

SEQ ID NO: 639588 - RNA, 19 nt, Homo sapiens
uggacuuucuguuugcauu

SEQ ID NO: 639589 - RNA, 19 nt, Homo sapiens
cgagagggaaagcagaaga

SEQ ID NO: 639590 - RNA, 19 nt, Homo sapiens
ugaagaaaacugucaauca

SEQ ID NO: 639591 - RNA, 19 nt, Homo sapiens
gagggaaagcagaagaagu

SEQ ID NO: 639592 - RNA, 19 nt, Homo sapiens
cgacaauguggcacuuaau

SEQ ID NO: 639593 - RNA, 19 nt, Homo sapiens
aguaagaaacaaacugaug

SEQ ID NO: 639594 - RNA, 19 nt, Homo sapiens
gauacaggcagcagaugag

SEQ ID NO: 639595 - RNA, 19 nt, Homo sapiens
cacauuugcaugaaagaug

SEQ ID NO: 639596 - RNA, 19 nt, Homo sapiens
cauguaacucgcuuaaagu

SEQ ID NO: 639597 - RNA, 19 nt, Homo sapiens
ccugagcuccugccugaga

SEQ ID NO: 639598 - RNA, 19 nt, Homo sapiens
uguguucggccuuuaauuc

SEQ ID NO: 639599 - RNA, 19 nt, Homo sapiens
gucaaucagcuuauaacga

SEQ ID NO: 639600 - RNA, 19 nt, Homo sapiens
agaagaaaauucccaacau

SEQ ID NO: 639601 - RNA, 19 nt, Homo sapiens
ugagcuagaagagaugaaa

SEQ ID NO: 639602 - RNA, 19 nt, Homo sapiens
gaugagcuagaagagauga

SEQ ID NO: 639603 - RNA, 19 nt, Homo sapiens
agggaaagcagaagaaguc

SEQ ID NO: 639604 - RNA, 19 nt, Homo sapiens
aacagugguugugugguaa

SEQ ID NO: 639605 - RNA, 19 nt, Homo sapiens
caaaggcauaacagugguu

SEQ ID NO: 639606 - RNA, 19 nt, Homo sapiens
ccccuaaaaucuacaaguu

SEQ ID NO: 639607 - RNA, 19 nt, Homo sapiens
uguccaccaucucccuauu

SEQ ID NO: 639608 - RNA, 19 nt, Homo sapiens
aagcaaugaggagaugaua

SEQ ID NO: 639609 - RNA, 19 nt, Homo sapiens
uuuaagcaaugaggagaug

SEQ ID NO: 639610 - RNA, 19 nt, Homo sapiens
acauacauggcagaaauuu

SEQ ID NO: 639611 - RNA, 19 nt, Homo sapiens
gcucaaagcucaucaaaug

SEQ ID NO: 639612 - RNA, 19 nt, Homo sapiens
caaaugugcuucagagauu

SEQ ID NO: 639613 - RNA, 19 nt, Homo sapiens
gaagugggcucaguacaaa

SEQ ID NO: 639614 - RNA, 19 nt, Homo sapiens
ggauacuccuucucucuua

SEQ ID NO: 639615 - RNA, 19 nt, Homo sapiens
gcaacuacauccacaugaa

SEQ ID NO: 639616 - RNA, 19 nt, Homo sapiens
acacugagcuccuuucaug

SEQ ID NO: 639617 - RNA, 19 nt, Homo sapiens
ggaaccuucuggcauauuu

SEQ ID NO: 639618 - RNA, 19 nt, Homo sapiens
caacaaaugggaauaagaa

SEQ ID NO: 639619 - RNA, 19 nt, Homo sapiens
gaacuuguuugcuucuuuc

SEQ ID NO: 639620 - RNA, 19 nt, Homo sapiens
ccaagaggccugacaauga

SEQ ID NO: 639621 - RNA, 19 nt, Homo sapiens
ggacaacaaaugggaauaa

SEQ ID NO: 639622 - RNA, 19 nt, Homo sapiens
aggcugagcugcggaaaua

SEQ ID NO: 639623 - RNA, 19 nt, Homo sapiens
ucaagcuucucauuucuaa

SEQ ID NO: 639624 - RNA, 19 nt, Homo sapiens
ggacuuggcagacgauaga

SEQ ID NO: 639625 - RNA, 19 nt, Homo sapiens
ggaagugggcucaguacaa

SEQ ID NO: 639626 - RNA, 19 nt, Homo sapiens
ggccuucccugugcuauuu

SEQ ID NO: 639627 - RNA, 19 nt, Homo sapiens
cacaugaacuuguuugcuu

SEQ ID NO: 639628 - RNA, 19 nt, Homo sapiens
caagaggccugacaaugag

SEQ ID NO: 639629 - RNA, 19 nt, Homo sapiens
ggaagagagugagaucuag

SEQ ID NO: 639630 - RNA, 19 nt, Homo sapiens
uggaggagauucuggaaga

SEQ ID NO: 639631 - RNA, 19 nt, Homo sapiens
gguccucauuccuuuauug

SEQ ID NO: 639632 - RNA, 19 nt, Homo sapiens
acccugcccuucauacuua

SEQ ID NO: 639633 - RNA, 19 nt, Homo sapiens
ugaacuuguuugcuucuuu

SEQ ID NO: 639634 - RNA, 19 nt, Homo sapiens
uccagguucucuugcauua

SEQ ID NO: 639635 - RNA, 19 nt, Homo sapiens
gagaacgccacggauauuu

SEQ ID NO: 639636 - RNA, 19 nt, Homo sapiens
ggaagggccuacagacacu

SEQ ID NO: 639637 - RNA, 19 nt, Homo sapiens
caaacaggcaugucugaga

SEQ ID NO: 639638 - RNA, 19 nt, Homo sapiens
gauacuccuucucucuuau

SEQ ID NO: 639639 - RNA, 19 nt, Homo sapiens
caaccuugcagcugaugua

SEQ ID NO: 639640 - RNA, 19 nt, Homo sapiens
aaaugugcuucagagauua

SEQ ID NO: 639641 - RNA, 19 nt, Homo sapiens
cugcagcccucacuuaaca

SEQ ID NO: 639642 - RNA, 19 nt, Homo sapiens
gacaacaaaugggaauaag

SEQ ID NO: 639643 - RNA, 19 nt, Homo sapiens
acagggugcuggacaacaa

SEQ ID NO: 639644 - RNA, 19 nt, Homo sapiens
gaacgccacggauauuugg

SEQ ID NO: 639645 - RNA, 19 nt, Homo sapiens
ggacuuccgguuccuagga

SEQ ID NO: 639646 - RNA, 19 nt, Homo sapiens
ucaaagcucaucaaaugug

SEQ ID NO: 639647 - RNA, 19 nt, Homo sapiens
uggaagagagugagaucua

SEQ ID NO: 639648 - RNA, 19 nt, Homo sapiens
aagaaaaucugguggauca

SEQ ID NO: 639649 - RNA, 19 nt, Homo sapiens
auagagaacgccacggaua

SEQ ID NO: 639650 - RNA, 19 nt, Homo sapiens
acuuauggcugcugguuga

SEQ ID NO: 639651 - RNA, 19 nt, Homo sapiens
aagcugcagcccucacuua

SEQ ID NO: 639652 - RNA, 19 nt, Homo sapiens
gcaaaacuuauacgacuuu

SEQ ID NO: 639653 - RNA, 19 nt, Homo sapiens
ucaaaugugcuucagagau

SEQ ID NO: 639654 - RNA, 19 nt, Homo sapiens
ccaacaccauggaggagau

SEQ ID NO: 639655 - RNA, 19 nt, Homo sapiens
gaaaaugucccaagaagcu

SEQ ID NO: 639656 - RNA, 19 nt, Homo sapiens
ccucuucucuuucaucacu

SEQ ID NO: 639657 - RNA, 19 nt, Homo sapiens
guguaacagucaauuucuu

SEQ ID NO: 639658 - RNA, 19 nt, Homo sapiens
cccaugaugcucuguguaa

SEQ ID NO: 639659 - RNA, 19 nt, Homo sapiens
ugauguacaccgugggaua

SEQ ID NO: 639660 - RNA, 19 nt, Homo sapiens
uagagaacgccacggauau

SEQ ID NO: 639661 - RNA, 19 nt, Homo sapiens
gacccaugaugcucugugu

SEQ ID NO: 639662 - RNA, 19 nt, Homo sapiens
cagguucucuugcauuacu

SEQ ID NO: 639663 - RNA, 19 nt, Homo sapiens
uguccuaccugucagagau

SEQ ID NO: 639664 - RNA, 19 nt, Homo sapiens
guaacgggacauuugauca

SEQ ID NO: 639665 - RNA, 19 nt, Homo sapiens
aaucaacacugguccucau

SEQ ID NO: 639666 - RNA, 19 nt, Homo sapiens
gugcacaccuggagaacac

SEQ ID NO: 639667 - RNA, 19 nt, Homo sapiens
ugagaacccuggcuguacu

SEQ ID NO: 639668 - RNA, 19 nt, Homo sapiens
cacaggaagugcucucucu

SEQ ID NO: 639669 - RNA, 19 nt, Homo sapiens
gggauacuccuucucucuu

SEQ ID NO: 639670 - RNA, 19 nt, Homo sapiens
gaggagauucuggaagaga

SEQ ID NO: 639671 - RNA, 19 nt, Homo sapiens
gaggaaacgacucggaagu

SEQ ID NO: 639672 - RNA, 19 nt, Homo sapiens
caacacugguccucauucc

SEQ ID NO: 639673 - RNA, 19 nt, Homo sapiens
ucucauuucuaagcucaaa

SEQ ID NO: 639674 - RNA, 19 nt, Homo sapiens
ucucuugcauuacuuugug

SEQ ID NO: 639675 - RNA, 19 nt, Homo sapiens
guggauguccuaccuguca

SEQ ID NO: 639676 - RNA, 19 nt, Homo sapiens
caaguugaaggauuugcaa

SEQ ID NO: 639677 - RNA, 19 nt, Homo sapiens
gugcuucagagauuauaaa

SEQ ID NO: 639678 - RNA, 19 nt, Homo sapiens
gcccagauaccugcuguug

SEQ ID NO: 639679 - RNA, 19 nt, Homo sapiens
ugugggugccaauuacuua

SEQ ID NO: 639680 - RNA, 19 nt, Homo sapiens
gcgcaacuacauccacaug

SEQ ID NO: 639681 - RNA, 19 nt, Homo sapiens
gcucucacccuccucuugu

SEQ ID NO: 639682 - RNA, 19 nt, Homo sapiens
ugaaggauuugcaaaacuu

SEQ ID NO: 639683 - RNA, 19 nt, Homo sapiens
acacugguccucauuccuu

SEQ ID NO: 639684 - RNA, 19 nt, Homo sapiens
gcucaucaaaugugcuuca

SEQ ID NO: 639685 - RNA, 19 nt, Homo sapiens
gagagacuuacucaaggaa

SEQ ID NO: 639686 - RNA, 19 nt, Homo sapiens
uggcuguacuggugaagga

SEQ ID NO: 639687 - RNA, 19 nt, Homo sapiens
ggaggagauucuggaagag

SEQ ID NO: 639688 - RNA, 19 nt, Homo sapiens
gaaggauuugcaaaacuua

SEQ ID NO: 639689 - RNA, 19 nt, Homo sapiens
ccucauucuucuccuggaa

SEQ ID NO: 639690 - RNA, 19 nt, Homo sapiens
cuuguuugcuucuuucauc

SEQ ID NO: 639691 - RNA, 19 nt, Homo sapiens
cguuaugccuugcugucaa

SEQ ID NO: 639692 - RNA, 19 nt, Homo sapiens
ggacauuugaucaguacgu

SEQ ID NO: 639693 - RNA, 19 nt, Homo sapiens
aacagucaauuucuucauc

SEQ ID NO: 639694 - RNA, 19 nt, Homo sapiens
gcaggaugacuccgaaugc

SEQ ID NO: 639695 - RNA, 19 nt, Homo sapiens
agagaacgccacggauauu

SEQ ID NO: 639696 - RNA, 19 nt, Homo sapiens
cacugguccucauuccuuu

SEQ ID NO: 639697 - RNA, 19 nt, Homo sapiens
guaacagucaauuucuuca

SEQ ID NO: 639698 - RNA, 19 nt, Homo sapiens
ccugagaacccuggcugua

SEQ ID NO: 639699 - RNA, 19 nt, Homo sapiens
uguguuggccucauucuuc

SEQ ID NO: 639700 - RNA, 19 nt, Homo sapiens
gcaguaugguuuugccaau

SEQ ID NO: 639701 - RNA, 19 nt, Homo sapiens
ucucaagcuucucauuucu

SEQ ID NO: 639702 - RNA, 19 nt, Homo sapiens
acagucaauuucuucaucu

SEQ ID NO: 639703 - RNA, 19 nt, Homo sapiens
acaacaaaugggaauaaga

SEQ ID NO: 639704 - RNA, 19 nt, Homo sapiens
ucauucuucuccuggaaau

SEQ ID NO: 639705 - RNA, 19 nt, Homo sapiens
gggugccaauuacuuaugg

SEQ ID NO: 639706 - RNA, 19 nt, Homo sapiens
caacuacauccacaugaac

SEQ ID NO: 639707 - RNA, 19 nt, Homo sapiens
acgggacauuugaucagua

SEQ ID NO: 639708 - RNA, 19 nt, Homo sapiens
caggaagggccuacagaca

SEQ ID NO: 639709 - RNA, 19 nt, Homo sapiens
gaagcugcagcccucacuu

SEQ ID NO: 639710 - RNA, 19 nt, Homo sapiens
agauggcgcugagaagcuu

SEQ ID NO: 639711 - RNA, 19 nt, Homo sapiens
gauguaauguugucacuaa

SEQ ID NO: 639712 - RNA, 19 nt, Homo sapiens
ggcaggcgcuucucaauuu

SEQ ID NO: 639713 - RNA, 19 nt, Homo sapiens
ggacaagguucuggaaaga

SEQ ID NO: 639714 - RNA, 19 nt, Homo sapiens
cacagugccuuuacagauu

SEQ ID NO: 639715 - RNA, 19 nt, Homo sapiens
ugacuuagaaccugcuaua

SEQ ID NO: 639716 - RNA, 19 nt, Homo sapiens
ggauuacuguucugguuau

SEQ ID NO: 639717 - RNA, 19 nt, Homo sapiens
ccagagugcuauaaucuag

SEQ ID NO: 639718 - RNA, 19 nt, Homo sapiens
caaaacugcuguucaagaa

SEQ ID NO: 639719 - RNA, 19 nt, Homo sapiens
uaccuacuguuaucucuaa

SEQ ID NO: 639720 - RNA, 19 nt, Homo sapiens
ggaaauauugguggaagaa

SEQ ID NO: 639721 - RNA, 19 nt, Homo sapiens
uaggaaacgugccuuuguu

SEQ ID NO: 639722 - RNA, 19 nt, Homo sapiens
gugcuauaaucuagaugua

SEQ ID NO: 639723 - RNA, 19 nt, Homo sapiens
aauaugcacuccaaauuag

SEQ ID NO: 639724 - RNA, 19 nt, Homo sapiens
gggauuacuguucugguua

SEQ ID NO: 639725 - RNA, 19 nt, Homo sapiens
cagccaaguugaagaggaa

SEQ ID NO: 639726 - RNA, 19 nt, Homo sapiens
gcaggcgcuucucaauuug

SEQ ID NO: 639727 - RNA, 19 nt, Homo sapiens
acaagguucuggaaagaga

SEQ ID NO: 639728 - RNA, 19 nt, Homo sapiens
cguaugggcugaugaagag

SEQ ID NO: 639729 - RNA, 19 nt, Homo sapiens
acagugccuuuacagauuu

SEQ ID NO: 639730 - RNA, 19 nt, Homo sapiens
cugguuaucuucaucauca

SEQ ID NO: 639731 - RNA, 19 nt, Homo sapiens
guggaagaauugcaagaug

SEQ ID NO: 639732 - RNA, 19 nt, Homo sapiens
uggaagaauugcaagaugu

SEQ ID NO: 639733 - RNA, 19 nt, Homo sapiens
gaguuaacguggacaaggu

SEQ ID NO: 639734 - RNA, 19 nt, Homo sapiens
aagcuuaccuacuguuauc

SEQ ID NO: 639735 - RNA, 19 nt, Homo sapiens
gaaacgagcgcagccaagu

SEQ ID NO: 639736 - RNA, 19 nt, Homo sapiens
ggaagaauugcaagaugug

SEQ ID NO: 639737 - RNA, 19 nt, Homo sapiens
gaagcucucugaguuagac

SEQ ID NO: 639738 - RNA, 19 nt, Homo sapiens
guggacauaaugcgaguua

SEQ ID NO: 639739 - RNA, 19 nt, Homo sapiens
uagaugaggugguggacau

SEQ ID NO: 639740 - RNA, 19 nt, Homo sapiens
aaacugcuguucaagaaac

SEQ ID NO: 639741 - RNA, 19 nt, Homo sapiens
ccaaguugaagaggaaaua

SEQ ID NO: 639742 - RNA, 19 nt, Homo sapiens
ucaagcuuaccuacuguua

SEQ ID NO: 639743 - RNA, 19 nt, Homo sapiens
uuacuguucugguuaucuu

SEQ ID NO: 639744 - RNA, 19 nt, Homo sapiens
ggacauaaugcgaguuaac

SEQ ID NO: 639745 - RNA, 19 nt, Homo sapiens
uggguugucucuucaugaa

SEQ ID NO: 639746 - RNA, 19 nt, Homo sapiens
cgggauuacuguucugguu

SEQ ID NO: 639747 - RNA, 19 nt, Homo sapiens
guuccagagugcuauaauc

SEQ ID NO: 639748 - RNA, 19 nt, Homo sapiens
gaugaggugguggacauaa

SEQ ID NO: 639749 - RNA, 19 nt, Homo sapiens
gaagaaccagcggaacuca

SEQ ID NO: 639750 - RNA, 19 nt, Homo sapiens
agaaccagcggaacucaaa

SEQ ID NO: 639751 - RNA, 19 nt, Homo sapiens
uaucaagcuuaccuacugu

SEQ ID NO: 639752 - RNA, 19 nt, Homo sapiens
gaaauauugguggaagaau

SEQ ID NO: 639753 - RNA, 19 nt, Homo sapiens
gcaggcaggcgcuucucaa

SEQ ID NO: 639754 - RNA, 19 nt, Homo sapiens
agagugcuauaaucuagau

SEQ ID NO: 639755 - RNA, 19 nt, Homo sapiens
uggacaagguucuggaaag

SEQ ID NO: 639756 - RNA, 19 nt, Homo sapiens
uaaguuccagagugcuaua

SEQ ID NO: 639757 - RNA, 19 nt, Homo sapiens
cuuuacagauuuacguaug

SEQ ID NO: 639758 - RNA, 19 nt, Homo sapiens
cagugccuuuacagauuua

SEQ ID NO: 639759 - RNA, 19 nt, Homo sapiens
caagcuuaccuacuguuau

SEQ ID NO: 639760 - RNA, 19 nt, Homo sapiens
aauauugguggaagaauug

SEQ ID NO: 639761 - RNA, 19 nt, Homo sapiens
cuaggaaacgugccuuugu

SEQ ID NO: 639762 - RNA, 19 nt, Homo sapiens
gcagacacaaaaucaagua

SEQ ID NO: 639763 - RNA, 19 nt, Homo sapiens
gacacaaaaucaaguagau

SEQ ID NO: 639764 - RNA, 19 nt, Homo sapiens
aaacgagcgcagccaaguu

SEQ ID NO: 639765 - RNA, 19 nt, Homo sapiens
uuacguaugggcugaugaa

SEQ ID NO: 639766 - RNA, 19 nt, Homo sapiens
agacuucagcagacacaaa

SEQ ID NO: 639767 - RNA, 19 nt, Homo sapiens
uggcaguaaucgaagacuu

SEQ ID NO: 639768 - RNA, 19 nt, Homo sapiens
acucaaaacugcuguucaa

SEQ ID NO: 639769 - RNA, 19 nt, Homo sapiens
caaguugaagaggaaauau

SEQ ID NO: 639770 - RNA, 19 nt, Homo sapiens
gagcgcagccaaguugaag

SEQ ID NO: 639771 - RNA, 19 nt, Homo sapiens
gguggaagaauugcaagau

SEQ ID NO: 639772 - RNA, 19 nt, Homo sapiens
aguugaagaggaaauauug

SEQ ID NO: 639773 - RNA, 19 nt, Homo sapiens
ugaggugguggacauaaug

SEQ ID NO: 639774 - RNA, 19 nt, Homo sapiens
gagcagacauuaccuguua

SEQ ID NO: 639775 - RNA, 19 nt, Homo sapiens
cgacuuauaugaugaguuu

SEQ ID NO: 639776 - RNA, 19 nt, Homo sapiens
ggaagaagcugggagaguu

SEQ ID NO: 639777 - RNA, 19 nt, Homo sapiens
gaagauguacucagagaua

SEQ ID NO: 639778 - RNA, 19 nt, Homo sapiens
ucacagaacccauuauuaa

SEQ ID NO: 639779 - RNA, 19 nt, Homo sapiens
gauggagccuuacuacuuu

SEQ ID NO: 639780 - RNA, 19 nt, Homo sapiens
caucauggauaccgacuua

SEQ ID NO: 639781 - RNA, 19 nt, Homo sapiens
gcaacuggguucugauuga

SEQ ID NO: 639782 - RNA, 19 nt, Homo sapiens
gaggaagacucccagauau

SEQ ID NO: 639783 - RNA, 19 nt, Homo sapiens
gaugagaaccugauccuuu

SEQ ID NO: 639784 - RNA, 19 nt, Homo sapiens
ugaggucaauggauuaaua

SEQ ID NO: 639785 - RNA, 19 nt, Homo sapiens
acucagagcucaucagaaa

SEQ ID NO: 639786 - RNA, 19 nt, Homo sapiens
gaccauaguucaagaggaa

SEQ ID NO: 639787 - RNA, 19 nt, Homo sapiens
uaagauggcuugggaguug

SEQ ID NO: 639788 - RNA, 19 nt, Homo sapiens
caagguggcugacccaguu

SEQ ID NO: 639789 - RNA, 19 nt, Homo sapiens
ugaagaugaugaugaauug

SEQ ID NO: 639790 - RNA, 19 nt, Homo sapiens
gaaguuucguggaguuuau

SEQ ID NO: 639791 - RNA, 19 nt, Homo sapiens
ggccagagcacuuugauuu

SEQ ID NO: 639792 - RNA, 19 nt, Homo sapiens
ccucagagcugcccaagau

SEQ ID NO: 639793 - RNA, 19 nt, Homo sapiens
uggcggaucugauggauaa

SEQ ID NO: 639794 - RNA, 19 nt, Homo sapiens
caacugaugcuuauuacaa

SEQ ID NO: 639795 - RNA, 19 nt, Homo sapiens
gaccaaagaucuugaugag

SEQ ID NO: 639796 - RNA, 19 nt, Homo sapiens
ggaagggccucagugaaga

SEQ ID NO: 639797 - RNA, 19 nt, Homo sapiens
cagaggacauagagaauga

SEQ ID NO: 639798 - RNA, 19 nt, Homo sapiens
gcauaucccuucuccaaag

SEQ ID NO: 639799 - RNA, 19 nt, Homo sapiens
ucagaaaugugacccuuug

SEQ ID NO: 639800 - RNA, 19 nt, Homo sapiens
caagaucugugcuauacug

SEQ ID NO: 639801 - RNA, 19 nt, Homo sapiens
cgacgacgaugacguagga

SEQ ID NO: 639802 - RNA, 19 nt, Homo sapiens
ugaugaagaugaugaugaa

SEQ ID NO: 639803 - RNA, 19 nt, Homo sapiens
gauaccgacuuauaugaug

SEQ ID NO: 639804 - RNA, 19 nt, Homo sapiens
gaaacauccucccucaagu

SEQ ID NO: 639805 - RNA, 19 nt, Homo sapiens
ggaaacauccucccucaag

SEQ ID NO: 639806 - RNA, 19 nt, Homo sapiens
ugaggaagacucccagaua

SEQ ID NO: 639807 - RNA, 19 nt, Homo sapiens
ggacaagccuuuucucugu

SEQ ID NO: 639808 - RNA, 19 nt, Homo sapiens
gaucuaugccgacaccuuu

SEQ ID NO: 639809 - RNA, 19 nt, Homo sapiens
gaacagacucacccggaaa

SEQ ID NO: 639810 - RNA, 19 nt, Homo sapiens
gaaguucaauaccacaucu

SEQ ID NO: 639811 - RNA, 19 nt, Homo sapiens
gcgccaagcccaagauuga

SEQ ID NO: 639812 - RNA, 19 nt, Homo sapiens
gagcucaucagaaauguga

SEQ ID NO: 639813 - RNA, 19 nt, Homo sapiens
gcugaaacgccuaauaaga

SEQ ID NO: 639814 - RNA, 19 nt, Homo sapiens
gaucugugcuauacugaca

SEQ ID NO: 639815 - RNA, 19 nt, Homo sapiens
ggcccuaucuuugggauuu

SEQ ID NO: 639816 - RNA, 19 nt, Homo sapiens
ccaacauucugguggauga

SEQ ID NO: 639817 - RNA, 19 nt, Homo sapiens
caacuggguucugauugaa

SEQ ID NO: 639818 - RNA, 19 nt, Homo sapiens
uggaugaggucaauggauu

SEQ ID NO: 639819 - RNA, 19 nt, Homo sapiens
ggcgagagcaucauggaua

SEQ ID NO: 639820 - RNA, 19 nt, Homo sapiens
uugaugagauggaugauga

SEQ ID NO: 639821 - RNA, 19 nt, Homo sapiens
agaaugaggugguccagau

SEQ ID NO: 639822 - RNA, 19 nt, Homo sapiens
gaagcugccuccaacugau

SEQ ID NO: 639823 - RNA, 19 nt, Homo sapiens
ugacguggccuucguguug

SEQ ID NO: 639824 - RNA, 19 nt, Homo sapiens
ggaugaggucaauggauua

SEQ ID NO: 639825 - RNA, 19 nt, Homo sapiens
uguaugagauggauuucuu

SEQ ID NO: 639826 - RNA, 19 nt, Homo sapiens
guagagagaccaaagaucu

SEQ ID NO: 639827 - RNA, 19 nt, Homo sapiens
gugaagacagcaaccauaa

SEQ ID NO: 639828 - RNA, 19 nt, Homo sapiens
cagcauaucccuucuccaa

SEQ ID NO: 639829 - RNA, 19 nt, Homo sapiens
ucuuggagccucuuuauaa

SEQ ID NO: 639830 - RNA, 19 nt, Homo sapiens
gucaauggauuaauaagca

SEQ ID NO: 639831 - RNA, 19 nt, Homo sapiens
ggaagccgccugccuuuua

SEQ ID NO: 639832 - RNA, 19 nt, Homo sapiens
aggauguugugcucaauua

SEQ ID NO: 639833 - RNA, 19 nt, Homo sapiens
cugaaacgccuaauaagaa

SEQ ID NO: 639834 - RNA, 19 nt, Homo sapiens
augaugaguuugggaauua

SEQ ID NO: 639835 - RNA, 19 nt, Homo sapiens
gcauccaccugacgaagga

SEQ ID NO: 639836 - RNA, 19 nt, Homo sapiens
ggaggagucuggcgagcau

SEQ ID NO: 639837 - RNA, 19 nt, Homo sapiens
ggaucucuguggccaggua

SEQ ID NO: 639838 - RNA, 19 nt, Homo sapiens
gcacgugacucaggaugca

SEQ ID NO: 639839 - RNA, 19 nt, Homo sapiens
ccucugugaugaauugauu

SEQ ID NO: 639840 - RNA, 19 nt, Homo sapiens
cagcaucguucaagguuuc

SEQ ID NO: 639841 - RNA, 19 nt, Homo sapiens
cggaagauguacucagaga

SEQ ID NO: 639842 - RNA, 19 nt, Homo sapiens
accaagaaauucacucuga

SEQ ID NO: 639843 - RNA, 19 nt, Homo sapiens
cguaggagaucaugacgau

SEQ ID NO: 639844 - RNA, 19 nt, Homo sapiens
ugacgacgacgaugacgua

SEQ ID NO: 639845 - RNA, 19 nt, Homo sapiens
ucagcaaauucuucgauga

SEQ ID NO: 639846 - RNA, 19 nt, Homo sapiens
guaggaagggccucaguga

SEQ ID NO: 639847 - RNA, 19 nt, Homo sapiens
agacugaucuccggacuca

SEQ ID NO: 639848 - RNA, 19 nt, Homo sapiens
gcauguauuccacugauga

SEQ ID NO: 639849 - RNA, 19 nt, Homo sapiens
gaggucaauggauuaauaa

SEQ ID NO: 639850 - RNA, 19 nt, Homo sapiens
gaaaucagaaagcgcuaug

SEQ ID NO: 639851 - RNA, 19 nt, Homo sapiens
ccaagaaauucacucugau

SEQ ID NO: 639852 - RNA, 19 nt, Homo sapiens
gcaagugaacagaacauuc

SEQ ID NO: 639853 - RNA, 19 nt, Homo sapiens
guacagcacagaugaugga

SEQ ID NO: 639854 - RNA, 19 nt, Homo sapiens
ggacaugugugugcagcau

SEQ ID NO: 639855 - RNA, 19 nt, Homo sapiens
caugugaauuucucugaug

SEQ ID NO: 639856 - RNA, 19 nt, Homo sapiens
caaaagcacuccugugaca

SEQ ID NO: 639857 - RNA, 19 nt, Homo sapiens
ucauggauaccgacuuaua

SEQ ID NO: 639858 - RNA, 19 nt, Homo sapiens
ugauggagccuuacuacuu

SEQ ID NO: 639859 - RNA, 19 nt, Homo sapiens
ugaaacgccuaauaagaag

SEQ ID NO: 639860 - RNA, 19 nt, Homo sapiens
uaccacaucuguuaucaag

SEQ ID NO: 639861 - RNA, 19 nt, Homo sapiens
uucaauaccacaucuguua

SEQ ID NO: 639862 - RNA, 19 nt, Homo sapiens
gcuggcaacuggguucuga

SEQ ID NO: 639863 - RNA, 19 nt, Homo sapiens
gaacuacacccuggaggau

SEQ ID NO: 639864 - RNA, 19 nt, Homo sapiens
acacagagcggcugaucaa

SEQ ID NO: 639865 - RNA, 19 nt, Homo sapiens
gaccaagaucugugcuaua

SEQ ID NO: 639866 - RNA, 19 nt, Homo sapiens
ugaccaagaucugugcuau

SEQ ID NO: 639867 - RNA, 19 nt, Homo sapiens
gagcaucagcaaauucuuc

SEQ ID NO: 639868 - RNA, 19 nt, Homo sapiens
gauugcgucucugcaguuu

SEQ ID NO: 639869 - RNA, 19 nt, Homo sapiens
acuagcagcucccagagaa

SEQ ID NO: 639870 - RNA, 19 nt, Homo sapiens
ccaagaauuugcuaaaaga

SEQ ID NO: 639871 - RNA, 19 nt, Homo sapiens
uaacucagagcucaucaga

SEQ ID NO: 639872 - RNA, 19 nt, Homo sapiens
gaagccgccugccuuuuaa

SEQ ID NO: 639873 - RNA, 19 nt, Homo sapiens
gauccucgcccagguugua

SEQ ID NO: 639874 - RNA, 19 nt, Homo sapiens
ccaagagccucaaaucuaa

SEQ ID NO: 639875 - RNA, 19 nt, Homo sapiens
gcaaccagcuggaguacaa

SEQ ID NO: 639876 - RNA, 19 nt, Homo sapiens
gggaggaccugaacaagaa

SEQ ID NO: 639877 - RNA, 19 nt, Homo sapiens
gcacacggcuuggcuggua

SEQ ID NO: 639878 - RNA, 19 nt, Homo sapiens
ggaaaccaccgcucuuuaa

SEQ ID NO: 639879 - RNA, 19 nt, Homo sapiens
gaaaaucccucaagacaga

SEQ ID NO: 639880 - RNA, 19 nt, Homo sapiens
gcaguacgauggcaaagug

SEQ ID NO: 639881 - RNA, 19 nt, Homo sapiens
gaaacauccugcugucaga

SEQ ID NO: 639882 - RNA, 19 nt, Homo sapiens
gagaugugcgugucaaaua

SEQ ID NO: 639883 - RNA, 19 nt, Homo sapiens
cuaaggagcugcagaucaa

SEQ ID NO: 639884 - RNA, 19 nt, Homo sapiens
ccaccgcucuuuaacauga

SEQ ID NO: 639885 - RNA, 19 nt, Homo sapiens
gaacuauacuacccucaca

SEQ ID NO: 639886 - RNA, 19 nt, Homo sapiens
gcaaggaacagcugaagga

SEQ ID NO: 639887 - RNA, 19 nt, Homo sapiens
ggcaagacaucaucaagga

SEQ ID NO: 639888 - RNA, 19 nt, Homo sapiens
gaggugcgguucuuacaga

SEQ ID NO: 639889 - RNA, 19 nt, Homo sapiens
gggaagcaguccaaugaga

SEQ ID NO: 639890 - RNA, 19 nt, Homo sapiens
cuacaaacuucgcaaggaa

SEQ ID NO: 639891 - RNA, 19 nt, Homo sapiens
ucaagaagauguccuacag

SEQ ID NO: 639892 - RNA, 19 nt, Homo sapiens
uggcugagcucuucuucaa

SEQ ID NO: 639893 - RNA, 19 nt, Homo sapiens
agaaugagaggccaccuua

SEQ ID NO: 639894 - RNA, 19 nt, Homo sapiens
cgacuccugucuucagaaa

SEQ ID NO: 639895 - RNA, 19 nt, Homo sapiens
cgagcuggcugaacggaaa

SEQ ID NO: 639896 - RNA, 19 nt, Homo sapiens
gaagcaguccaaugagaaa

SEQ ID NO: 639897 - RNA, 19 nt, Homo sapiens
ggaagcaguccaaugagaa

SEQ ID NO: 639898 - RNA, 19 nt, Homo sapiens
gaagcggaccuacaaacuu

SEQ ID NO: 639899 - RNA, 19 nt, Homo sapiens
gcucugacaaccuauauga

SEQ ID NO: 639900 - RNA, 19 nt, Homo sapiens
gacauacuauauucagaga

SEQ ID NO: 639901 - RNA, 19 nt, Homo sapiens
aagggugggucuagacaua

SEQ ID NO: 639902 - RNA, 19 nt, Homo sapiens
gcccaaagcucagcacaag

SEQ ID NO: 639903 - RNA, 19 nt, Homo sapiens
ggucuagacauacuauauu

SEQ ID NO: 639904 - RNA, 19 nt, Homo sapiens
cccaagagccucaaaucua

SEQ ID NO: 639905 - RNA, 19 nt, Homo sapiens
uuaagcggcucaaggaaga

SEQ ID NO: 639906 - RNA, 19 nt, Homo sapiens
gcacagaagcggaccuaca

SEQ ID NO: 639907 - RNA, 19 nt, Homo sapiens
ugaagaagauccuguucca

SEQ ID NO: 639908 - RNA, 19 nt, Homo sapiens
aaucagaaauccggaauuc

SEQ ID NO: 639909 - RNA, 19 nt, Homo sapiens
uaacaugaaugcgaugagu

SEQ ID NO: 639910 - RNA, 19 nt, Homo sapiens
gaaauggcaagacaucauc

SEQ ID NO: 639911 - RNA, 19 nt, Homo sapiens
gugggaagcaguccaauga

SEQ ID NO: 639912 - RNA, 19 nt, Homo sapiens
gcacaagagccuccuuaag

SEQ ID NO: 639913 - RNA, 19 nt, Homo sapiens
acaagaagcagacccagaa

SEQ ID NO: 639914 - RNA, 19 nt, Homo sapiens
agaagauccuguuccaaga

SEQ ID NO: 639915 - RNA, 19 nt, Homo sapiens
cggcuuggcugguaaugga

SEQ ID NO: 639916 - RNA, 19 nt, Homo sapiens
caaugguucuucccacuuc

SEQ ID NO: 639917 - RNA, 19 nt, Homo sapiens
guagagaucgcagcuguga

SEQ ID NO: 639918 - RNA, 19 nt, Homo sapiens
cuucaaggaugacccagaa

SEQ ID NO: 639919 - RNA, 19 nt, Homo sapiens
aagcggaccuacaaacuuc

SEQ ID NO: 639920 - RNA, 19 nt, Homo sapiens
ugugaaggcuggaaacauc

SEQ ID NO: 639921 - RNA, 19 nt, Homo sapiens
ucaaggaggugcgguucuu

SEQ ID NO: 639922 - RNA, 19 nt, Homo sapiens
cugacaaccuauaugauga

SEQ ID NO: 639923 - RNA, 19 nt, Homo sapiens
ggaggaagaaggcccugaa

SEQ ID NO: 639924 - RNA, 19 nt, Homo sapiens
uaucugcacucccacaaca

SEQ ID NO: 639925 - RNA, 19 nt, Homo sapiens
cagcacaagagccuccuua

SEQ ID NO: 639926 - RNA, 19 nt, Homo sapiens
ugaccagccucgagaguag

SEQ ID NO: 639927 - RNA, 19 nt, Homo sapiens
cggaaaccaccgcucuuua

SEQ ID NO: 639928 - RNA, 19 nt, Homo sapiens
aaugagaaauggcaagaca

SEQ ID NO: 639929 - RNA, 19 nt, Homo sapiens
agaugugcgugucaaauau

SEQ ID NO: 639930 - RNA, 19 nt, Homo sapiens
ccucagaccuccucaucuc

SEQ ID NO: 639931 - RNA, 19 nt, Homo sapiens
gaucuuggcggagcaguau

SEQ ID NO: 639932 - RNA, 19 nt, Homo sapiens
ucucacagcuccauuaucc

SEQ ID NO: 639933 - RNA, 19 nt, Homo sapiens
acacuggucugaguacuuc

SEQ ID NO: 639934 - RNA, 19 nt, Homo sapiens
ucugaguacuuccggaauu

SEQ ID NO: 639935 - RNA, 19 nt, Homo sapiens
gcugucagagccaggguua

SEQ ID NO: 639936 - RNA, 19 nt, Homo sapiens
cauacuauauucagagaac

SEQ ID NO: 639937 - RNA, 19 nt, Homo sapiens
gucuagacauacuauauuc

SEQ ID NO: 639938 - RNA, 19 nt, Homo sapiens
gaugugcgugucaaauauu

SEQ ID NO: 639939 - RNA, 19 nt, Homo sapiens
gcaguggcagugagaaugu

SEQ ID NO: 639940 - RNA, 19 nt, Homo sapiens
ccuacaaacuucgcaagga

SEQ ID NO: 639941 - RNA, 19 nt, Homo sapiens
cacagaagcggaccuacaa

SEQ ID NO: 639942 - RNA, 19 nt, Homo sapiens
gggcgaaagccgaggaaga

SEQ ID NO: 639943 - RNA, 19 nt, Homo sapiens
cugaguacuuccggaauuu

SEQ ID NO: 639944 - RNA, 19 nt, Homo sapiens
uauaccacauugcacagaa

SEQ ID NO: 639945 - RNA, 19 nt, Homo sapiens
caaggaggugcgguucuua

SEQ ID NO: 639946 - RNA, 19 nt, Homo sapiens
gcaguccaaugagaaaugg

SEQ ID NO: 639947 - RNA, 19 nt, Homo sapiens
cuuuggagccguauacuuu

SEQ ID NO: 639948 - RNA, 19 nt, Homo sapiens
cagugucgcuucccacauc

SEQ ID NO: 639949 - RNA, 19 nt, Homo sapiens
cacaagagccuccuuaagc

SEQ ID NO: 639950 - RNA, 19 nt, Homo sapiens
agacggagcugggcaacca

SEQ ID NO: 639951 - RNA, 19 nt, Homo sapiens
gaaaccaccgcucuuuaac

SEQ ID NO: 639952 - RNA, 19 nt, Homo sapiens
ggagaugugcgugucaaau

SEQ ID NO: 639953 - RNA, 19 nt, Homo sapiens
guucuucccacuucuauuc

SEQ ID NO: 639954 - RNA, 19 nt, Homo sapiens
ccaaagcucagcacaagag

SEQ ID NO: 639955 - RNA, 19 nt, Homo sapiens
ggaagaggaggaggaggaa

SEQ ID NO: 639956 - RNA, 19 nt, Homo sapiens
gaagaagauccuguuccaa

SEQ ID NO: 639957 - RNA, 19 nt, Homo sapiens
cagagguucuccugaagca

SEQ ID NO: 639958 - RNA, 19 nt, Homo sapiens
gaggucagauuagguuguc

SEQ ID NO: 639959 - RNA, 19 nt, Homo sapiens
uaccagagcaagaucaaga

SEQ ID NO: 639960 - RNA, 19 nt, Homo sapiens
caacaagcggcgugagcaa

SEQ ID NO: 639961 - RNA, 19 nt, Homo sapiens
gaagauccuguuccaagag

SEQ ID NO: 639962 - RNA, 19 nt, Homo sapiens
aaccaccgcucuuuaacau

SEQ ID NO: 639963 - RNA, 19 nt, Homo sapiens
cgugucaaauauucaucua

SEQ ID NO: 639964 - RNA, 19 nt, Homo sapiens
gauccagacucggcaguac

SEQ ID NO: 639965 - RNA, 19 nt, Homo sapiens
guacaagcgcaagauguug

SEQ ID NO: 639966 - RNA, 19 nt, Homo sapiens
uagcagaugccucagacaa

SEQ ID NO: 639967 - RNA, 19 nt, Homo sapiens
gagaaugagaggccaccuu

SEQ ID NO: 639968 - RNA, 19 nt, Homo sapiens
agaagcagacccagaagga

SEQ ID NO: 639969 - RNA, 19 nt, Homo sapiens
gagcagcugagcggcuaua

SEQ ID NO: 639970 - RNA, 19 nt, Homo sapiens
ccacuuccaccaccucuuc

SEQ ID NO: 639971 - RNA, 19 nt, Homo sapiens
ucucugaccuccgggaaau

SEQ ID NO: 639972 - RNA, 19 nt, Homo sapiens
ccacauugcacagaacgaa

SEQ ID NO: 639973 - RNA, 19 nt, Homo sapiens
gggucuagacauacuauau

SEQ ID NO: 639974 - RNA, 19 nt, Homo sapiens
guacagagcuuucaguuaa

SEQ ID NO: 639975 - RNA, 19 nt, Homo sapiens
agagauggcuuguuuauuu

SEQ ID NO: 639976 - RNA, 19 nt, Homo sapiens
aagaaggucuggaauauua

SEQ ID NO: 639977 - RNA, 19 nt, Homo sapiens
gaaagcaccuacaacauga

SEQ ID NO: 639978 - RNA, 19 nt, Homo sapiens
gcacguggaugauuagaaa

SEQ ID NO: 639979 - RNA, 19 nt, Homo sapiens
ggaagaaggucuggaauau

SEQ ID NO: 639980 - RNA, 19 nt, Homo sapiens
gaacaagaaugaacaccaa

SEQ ID NO: 639981 - RNA, 19 nt, Homo sapiens
gagguacaguucuuuaaua

SEQ ID NO: 639982 - RNA, 19 nt, Homo sapiens
gaacaccaaugauguaaag

SEQ ID NO: 639983 - RNA, 19 nt, Homo sapiens
gacauaaacucuugacaga

SEQ ID NO: 639984 - RNA, 19 nt, Homo sapiens
gcaacuuucucaagcauuu

SEQ ID NO: 639985 - RNA, 19 nt, Homo sapiens
gagcugcaauggugacaua

SEQ ID NO: 639986 - RNA, 19 nt, Homo sapiens
ccauuucaguugcuaauua

SEQ ID NO: 639987 - RNA, 19 nt, Homo sapiens
guaaaggcccugcuugaua

SEQ ID NO: 639988 - RNA, 19 nt, Homo sapiens
cuaaagagcuggauaagag

SEQ ID NO: 639989 - RNA, 19 nt, Homo sapiens
gaccaaaucuuccaagcuu

SEQ ID NO: 639990 - RNA, 19 nt, Homo sapiens
gcagaugauucucaacaaa

SEQ ID NO: 639991 - RNA, 19 nt, Homo sapiens
gcaguuugauggcuaauau

SEQ ID NO: 639992 - RNA, 19 nt, Homo sapiens
gacaggagcugcagaaagu

SEQ ID NO: 639993 - RNA, 19 nt, Homo sapiens
gaacugaagaggaagauga

SEQ ID NO: 639994 - RNA, 19 nt, Homo sapiens
ggaaagcaccuacaacaug

SEQ ID NO: 639995 - RNA, 19 nt, Homo sapiens
cgacgggucuugcauguga

SEQ ID NO: 639996 - RNA, 19 nt, Homo sapiens
gcauuaucauuucugcuua

SEQ ID NO: 639997 - RNA, 19 nt, Homo sapiens
ggaaagagcaaaggaagaa

SEQ ID NO: 639998 - RNA, 19 nt, Homo sapiens
caccagcacugaagaauau

SEQ ID NO: 639999 - RNA, 19 nt, Homo sapiens
gcuggcacguggaugauua

SEQ ID NO: 640000 - RNA, 19 nt, Homo sapiens
ggaagaagguaaaacaaaa

SEQ ID NO: 640001 - RNA, 19 nt, Homo sapiens
agacaaaccugugggcuuu

SEQ ID NO: 640002 - RNA, 19 nt, Homo sapiens
gacauuuggucuaaagaaa

SEQ ID NO: 640003 - RNA, 19 nt, Homo sapiens
ucucaaagcugcugcacaa

SEQ ID NO: 640004 - RNA, 19 nt, Homo sapiens
gaaaguaagauagcacuga

SEQ ID NO: 640005 - RNA, 19 nt, Homo sapiens
ccaauuacuuccacucaga

SEQ ID NO: 640006 - RNA, 19 nt, Homo sapiens
gcacaagcucaucuucaua

SEQ ID NO: 640007 - RNA, 19 nt, Homo sapiens
guacucaucucuuggucaa

SEQ ID NO: 640008 - RNA, 19 nt, Homo sapiens
cucagaagcuuuaacguuu

SEQ ID NO: 640009 - RNA, 19 nt, Homo sapiens
cgacugggauuauauacau

SEQ ID NO: 640010 - RNA, 19 nt, Homo sapiens
ucaaguagauuccaguauc

SEQ ID NO: 640011 - RNA, 19 nt, Homo sapiens
uaaugucacuaccgacuuu

SEQ ID NO: 640012 - RNA, 19 nt, Homo sapiens
gcaccuacaacaugaguuu

SEQ ID NO: 640013 - RNA, 19 nt, Homo sapiens
uaaaggcccugcuugauac

SEQ ID NO: 640014 - RNA, 19 nt, Homo sapiens
caaguagauuccaguauca

SEQ ID NO: 640015 - RNA, 19 nt, Homo sapiens
gcucugaacuuuaauucca

SEQ ID NO: 640016 - RNA, 19 nt, Homo sapiens
gagauggcuuguuuauuuc

SEQ ID NO: 640017 - RNA, 19 nt, Homo sapiens
gaagaaggucuggaauauu

SEQ ID NO: 640018 - RNA, 19 nt, Homo sapiens
guaccacugcuuuguauuu

SEQ ID NO: 640019 - RNA, 19 nt, Homo sapiens
caucaugguucucccaaga

SEQ ID NO: 640020 - RNA, 19 nt, Homo sapiens
gaaugaacaccaaugaugu

SEQ ID NO: 640021 - RNA, 19 nt, Homo sapiens
ggcaaauacauucucauua

SEQ ID NO: 640022 - RNA, 19 nt, Homo sapiens
cuaggagucuugccucauu

SEQ ID NO: 640023 - RNA, 19 nt, Homo sapiens
ggaccaaccugcgacuuca

SEQ ID NO: 640024 - RNA, 19 nt, Homo sapiens
ccucacauguggagccaua

SEQ ID NO: 640025 - RNA, 19 nt, Homo sapiens
uacaggaacugaagaggaa

SEQ ID NO: 640026 - RNA, 19 nt, Homo sapiens
gggaagaggcugacauugu

SEQ ID NO: 640027 - RNA, 19 nt, Homo sapiens
caucagcgaucacaugaag

SEQ ID NO: 640028 - RNA, 19 nt, Homo sapiens
gaagaauauccacaucuga

SEQ ID NO: 640029 - RNA, 19 nt, Homo sapiens
gaugaguucuggugguuuc

SEQ ID NO: 640030 - RNA, 19 nt, Homo sapiens
caagaaugaacaccaauga

SEQ ID NO: 640031 - RNA, 19 nt, Homo sapiens
uaagauagcacugagagaa

SEQ ID NO: 640032 - RNA, 19 nt, Homo sapiens
gaggagguacaguucuuua

SEQ ID NO: 640033 - RNA, 19 nt, Homo sapiens
ccacugcuuuguauuuguu

SEQ ID NO: 640034 - RNA, 19 nt, Homo sapiens
ggaaugaccgacugggauu

SEQ ID NO: 640035 - RNA, 19 nt, Homo sapiens
aaagagggaacaagaauga

SEQ ID NO: 640036 - RNA, 19 nt, Homo sapiens
ccacaguccuaguauuugu

SEQ ID NO: 640037 - RNA, 19 nt, Homo sapiens
ugaagaauauccacaucug

SEQ ID NO: 640038 - RNA, 19 nt, Homo sapiens
gguacauucuuguggauau

SEQ ID NO: 640039 - RNA, 19 nt, Homo sapiens
cuagauaaauacuguguag

SEQ ID NO: 640040 - RNA, 19 nt, Homo sapiens
ggaacaccaucuuuucuuu

SEQ ID NO: 640041 - RNA, 19 nt, Homo sapiens
caaagcugcugcacaaacu

SEQ ID NO: 640042 - RNA, 19 nt, Homo sapiens
ggcaacaacuaagaacuga

SEQ ID NO: 640043 - RNA, 19 nt, Homo sapiens
gaaggucuggaauauuaaa

SEQ ID NO: 640044 - RNA, 19 nt, Homo sapiens
guaacgagugguacuguuu

SEQ ID NO: 640045 - RNA, 19 nt, Homo sapiens
cagaagcuuuaacguuuga

SEQ ID NO: 640046 - RNA, 19 nt, Homo sapiens
gagucuugccucauuauaa

SEQ ID NO: 640047 - RNA, 19 nt, Homo sapiens
gauuaucaccauucucauu

SEQ ID NO: 640048 - RNA, 19 nt, Homo sapiens
uugagaagagugccaauua

SEQ ID NO: 640049 - RNA, 19 nt, Homo sapiens
cgucuacccuguacauguu

SEQ ID NO: 640050 - RNA, 19 nt, Homo sapiens
uaauggaagugaaagcaau

SEQ ID NO: 640051 - RNA, 19 nt, Homo sapiens
ggagguacaguucuuuaau

SEQ ID NO: 640052 - RNA, 19 nt, Homo sapiens
ccucaacccuaucagcauu

SEQ ID NO: 640053 - RNA, 19 nt, Homo sapiens
agaggaagaugaaggagau

SEQ ID NO: 640054 - RNA, 19 nt, Homo sapiens
guacauucuuguggauauu

SEQ ID NO: 640055 - RNA, 19 nt, Homo sapiens
ucagaagcuuuaacguuug

SEQ ID NO: 640056 - RNA, 19 nt, Homo sapiens
gagcagaugauucucaaca

SEQ ID NO: 640057 - RNA, 19 nt, Homo sapiens
cauaucaacuaauggaagu

SEQ ID NO: 640058 - RNA, 19 nt, Homo sapiens
caccuaccauaucaacuaa

SEQ ID NO: 640059 - RNA, 19 nt, Homo sapiens
uaggagucuugccucauua

SEQ ID NO: 640060 - RNA, 19 nt, Homo sapiens
caacuggcccacaaguauu

SEQ ID NO: 640061 - RNA, 19 nt, Homo sapiens
gauuaaucauucagccuau

SEQ ID NO: 640062 - RNA, 19 nt, Homo sapiens
uaucauuucugcuuacuac

SEQ ID NO: 640063 - RNA, 19 nt, Homo sapiens
ucauucugcuugccacuuu

SEQ ID NO: 640064 - RNA, 19 nt, Homo sapiens
cgagagauggcuuguuuau

SEQ ID NO: 640065 - RNA, 19 nt, Homo sapiens
gggauugauugguauaugg

SEQ ID NO: 640066 - RNA, 19 nt, Homo sapiens
gguaacgagugguacuguu

SEQ ID NO: 640067 - RNA, 19 nt, Homo sapiens
gcaacaacuugaacuuuug

SEQ ID NO: 640068 - RNA, 19 nt, Homo sapiens
ggcaacaacuugaacuuuu

SEQ ID NO: 640069 - RNA, 19 nt, Homo sapiens
auggaaaucuugcaguaaa

SEQ ID NO: 640070 - RNA, 19 nt, Homo sapiens
auauggaaaucuugcagua

SEQ ID NO: 640071 - RNA, 19 nt, Homo sapiens
gaacaguuucuuccaugug

SEQ ID NO: 640072 - RNA, 19 nt, Homo sapiens
uggaugaaguacagaaguu

SEQ ID NO: 640073 - RNA, 19 nt, Homo sapiens
cuacagugauggaugaagu

SEQ ID NO: 640074 - RNA, 19 nt, Homo sapiens
gaugaaagguucugccauu

SEQ ID NO: 640075 - RNA, 19 nt, Homo sapiens
gguaggagcuguaaucaau

SEQ ID NO: 640076 - RNA, 19 nt, Homo sapiens
gaaagguucugccauuaca

SEQ ID NO: 640077 - RNA, 19 nt, Homo sapiens
gcaugauucuccaguauau

SEQ ID NO: 640078 - RNA, 19 nt, Homo sapiens
ggagucauagugaacaaua

SEQ ID NO: 640079 - RNA, 19 nt, Homo sapiens
uagaaaagauggcguguuu

SEQ ID NO: 640080 - RNA, 19 nt, Homo sapiens
gauggcguguuucuuuauu

SEQ ID NO: 640081 - RNA, 19 nt, Homo sapiens
caauaaaggcgagaugaaa

SEQ ID NO: 640082 - RNA, 19 nt, Homo sapiens
cgaaagucauaccguagaa

SEQ ID NO: 640083 - RNA, 19 nt, Homo sapiens
aaaggagugugcagacuug

SEQ ID NO: 640084 - RNA, 19 nt, Homo sapiens
gaacaauaaaggcgagaug

SEQ ID NO: 640085 - RNA, 19 nt, Homo sapiens
gagucauagugaacaauaa

SEQ ID NO: 640086 - RNA, 19 nt, Homo sapiens
gcaaaccagagcucagaaa

SEQ ID NO: 640087 - RNA, 19 nt, Homo sapiens
uaggagcuguaaucaauug

SEQ ID NO: 640088 - RNA, 19 nt, Homo sapiens
gcaaaggagugugcagacu

SEQ ID NO: 640089 - RNA, 19 nt, Homo sapiens
gaagauaaugcaggaguca

SEQ ID NO: 640090 - RNA, 19 nt, Homo sapiens
gaaagucauaccguagaaa

SEQ ID NO: 640091 - RNA, 19 nt, Homo sapiens
ugacaacacaggagccaaa

SEQ ID NO: 640092 - RNA, 19 nt, Homo sapiens
caaaggagugugcagacuu

SEQ ID NO: 640093 - RNA, 19 nt, Homo sapiens
augaaagguucugccauua

SEQ ID NO: 640094 - RNA, 19 nt, Homo sapiens
agauaaugcaggagucaua

SEQ ID NO: 640095 - RNA, 19 nt, Homo sapiens
guaaucaauugugcugaca

SEQ ID NO: 640096 - RNA, 19 nt, Homo sapiens
gauggccacagucaagaaa

SEQ ID NO: 640097 - RNA, 19 nt, Homo sapiens
uuacaggaccaguagcaaa

SEQ ID NO: 640098 - RNA, 19 nt, Homo sapiens
acaauaaaggcgagaugaa

SEQ ID NO: 640099 - RNA, 19 nt, Homo sapiens
uggcagcauugcaugauuc

SEQ ID NO: 640100 - RNA, 19 nt, Homo sapiens
uugcaugauucuccaguau

SEQ ID NO: 640101 - RNA, 19 nt, Homo sapiens
gauaaugcaggagucauag

SEQ ID NO: 640102 - RNA, 19 nt, Homo sapiens
guaggagcuguaaucaauu

SEQ ID NO: 640103 - RNA, 19 nt, Homo sapiens
ggugauggccacagucaag

SEQ ID NO: 640104 - RNA, 19 nt, Homo sapiens
caggagucauagugaacaa

SEQ ID NO: 640105 - RNA, 19 nt, Homo sapiens
gcaguggucauucgacaac

SEQ ID NO: 640106 - RNA, 19 nt, Homo sapiens
gguccucuggugcgaaauu

SEQ ID NO: 640107 - RNA, 19 nt, Homo sapiens
caggaccaguagcaaagga

SEQ ID NO: 640108 - RNA, 19 nt, Homo sapiens
gcaggagucauagugaaca

SEQ ID NO: 640109 - RNA, 19 nt, Homo sapiens
uaaugcaggagucauagug

SEQ ID NO: 640110 - RNA, 19 nt, Homo sapiens
ggagcuguaaucaauugug

SEQ ID NO: 640111 - RNA, 19 nt, Homo sapiens
ugaaagguucugccauuac

SEQ ID NO: 640112 - RNA, 19 nt, Homo sapiens
gccauuacaggaccaguag

SEQ ID NO: 640113 - RNA, 19 nt, Homo sapiens
caagggacggcugaacaga

SEQ ID NO: 640114 - RNA, 19 nt, Homo sapiens
aauaaaggcgagaugaaag

SEQ ID NO: 640115 - RNA, 19 nt, Homo sapiens
cggauuuccuugggucuuc

SEQ ID NO: 640116 - RNA, 19 nt, Homo sapiens
gcguguuucuuuauuuuga

SEQ ID NO: 640117 - RNA, 19 nt, Homo sapiens
ggaagaagccugagagaga

SEQ ID NO: 640118 - RNA, 19 nt, Homo sapiens
gaagaagccugagagagaa

SEQ ID NO: 640119 - RNA, 19 nt, Homo sapiens
gccgauagauggaaugaaa

SEQ ID NO: 640120 - RNA, 19 nt, Homo sapiens
ggaagaagccaagaaauuc

SEQ ID NO: 640121 - RNA, 19 nt, Homo sapiens
gggaagaagccaagaaauu

SEQ ID NO: 640122 - RNA, 19 nt, Homo sapiens
ggagaagccagaucuguuu

SEQ ID NO: 640123 - RNA, 19 nt, Homo sapiens
gaacugcacugaacuuucc

SEQ ID NO: 640124 - RNA, 19 nt, Homo sapiens
gaacuuuccuccgugauca

SEQ ID NO: 640125 - RNA, 19 nt, Homo sapiens
agaagaugcuguccagauu

SEQ ID NO: 640126 - RNA, 19 nt, Homo sapiens
gaagaugcuguccagauuu

SEQ ID NO: 640127 - RNA, 19 nt, Homo sapiens
ccacugaacugcacugaac

SEQ ID NO: 640128 - RNA, 19 nt, Homo sapiens
gaaauucuggcaccacuuc

SEQ ID NO: 640129 - RNA, 19 nt, Homo sapiens
gagaagaugcuguccagau

SEQ ID NO: 640130 - RNA, 19 nt, Homo sapiens
cagaacaaccuuugcuuug

SEQ ID NO: 640131 - RNA, 19 nt, Homo sapiens
gaaugaaaauggagaaauc

SEQ ID NO: 640132 - RNA, 19 nt, Homo sapiens
gaagacggagcaugaagau

SEQ ID NO: 640133 - RNA, 19 nt, Homo sapiens
ugaggaagcugaggagaag

SEQ ID NO: 640134 - RNA, 19 nt, Homo sapiens
gaaaugcgggucuguucau

SEQ ID NO: 640135 - RNA, 19 nt, Homo sapiens
ucagaacaaccuuugcuuu

SEQ ID NO: 640136 - RNA, 19 nt, Homo sapiens
aagaugcuguccagauuug

SEQ ID NO: 640137 - RNA, 19 nt, Homo sapiens
gaagccagaucuguuuguc

SEQ ID NO: 640138 - RNA, 19 nt, Homo sapiens
acgaugcacuugccacuga

SEQ ID NO: 640139 - RNA, 19 nt, Homo sapiens
ggaaaugcgggucuguuca

SEQ ID NO: 640140 - RNA, 19 nt, Homo sapiens
caucaaaagccaugaagua

SEQ ID NO: 640141 - RNA, 19 nt, Homo sapiens
gcgcagcacucccauaccu

SEQ ID NO: 640142 - RNA, 19 nt, Homo sapiens
caaaagccaugaaguacau

SEQ ID NO: 640143 - RNA, 19 nt, Homo sapiens
cccaggaguuucagcuuga

SEQ ID NO: 640144 - RNA, 19 nt, Homo sapiens
gggaaaugcgggucuguuc

SEQ ID NO: 640145 - RNA, 19 nt, Homo sapiens
gacggagcaugaagaugga

SEQ ID NO: 640146 - RNA, 19 nt, Homo sapiens
agaacaaccuuugcuuugg

SEQ ID NO: 640147 - RNA, 19 nt, Homo sapiens
ggccagaggcagagagaga

SEQ ID NO: 640148 - RNA, 19 nt, Homo sapiens
gaggagaagccagaucugu

SEQ ID NO: 640149 - RNA, 19 nt, Homo sapiens
gagaagccagaucuguuug

SEQ ID NO: 640150 - RNA, 19 nt, Homo sapiens
ggucaucuugcccaucaaa

SEQ ID NO: 640151 - RNA, 19 nt, Homo sapiens
uggcaccacuucauguuca

SEQ ID NO: 640152 - RNA, 19 nt, Homo sapiens
ugaagacggagcaugaaga

SEQ ID NO: 640153 - RNA, 19 nt, Homo sapiens
gcaggacagugcccuucag

SEQ ID NO: 640154 - RNA, 19 nt, Homo sapiens
caaccuuugcuuugggaaa

SEQ ID NO: 640155 - RNA, 19 nt, Homo sapiens
cuccugcucucacuguuug

SEQ ID NO: 640156 - RNA, 19 nt, Homo sapiens
gcagugccacaccuuguag

SEQ ID NO: 640157 - RNA, 19 nt, Homo sapiens
ccagggacucagauaguga

SEQ ID NO: 640158 - RNA, 19 nt, Homo sapiens
uuuggcagguucuggaaga

SEQ ID NO: 640159 - RNA, 19 nt, Homo sapiens
cccuucagccagacuauaa

SEQ ID NO: 640160 - RNA, 19 nt, Homo sapiens
ucgggaagaagccaagaaa

SEQ ID NO: 640161 - RNA, 19 nt, Homo sapiens
ggugaagacggagcaugaa

SEQ ID NO: 640162 - RNA, 19 nt, Homo sapiens
cgaugcacuugccacugaa

SEQ ID NO: 640163 - RNA, 19 nt, Homo sapiens
ccacacauguuuccacuua

SEQ ID NO: 640164 - RNA, 19 nt, Homo sapiens
ggagagagacccagagaug

SEQ ID NO: 640165 - RNA, 19 nt, Homo sapiens
cgagacagaugaacacuuc

SEQ ID NO: 640166 - RNA, 19 nt, Homo sapiens
gaacaggaagcgugaaauc

SEQ ID NO: 640167 - RNA, 19 nt, Homo sapiens
gggacgcgcucuaaauaau

SEQ ID NO: 640168 - RNA, 19 nt, Homo sapiens
ggagggugguccugccauu

SEQ ID NO: 640169 - RNA, 19 nt, Homo sapiens
gacgcgcucuaaauaauug

SEQ ID NO: 640170 - RNA, 19 nt, Homo sapiens
ggacgcgcucuaaauaauu

SEQ ID NO: 640171 - RNA, 19 nt, Homo sapiens
acacauguuuccacuuaau

SEQ ID NO: 640172 - RNA, 19 nt, Homo sapiens
aaagggaccucagggcuau

SEQ ID NO: 640173 - RNA, 19 nt, Homo sapiens
agacagagacagagagaga

SEQ ID NO: 640174 - RNA, 19 nt, Homo sapiens
cgaagugaccugccugguu

SEQ ID NO: 640175 - RNA, 19 nt, Homo sapiens
gaggugaacgggcagaaug

SEQ ID NO: 640176 - RNA, 19 nt, Homo sapiens
cgccacagauggacuggaa

SEQ ID NO: 640177 - RNA, 19 nt, Homo sapiens
cugaaaggaauuuguguuu

SEQ ID NO: 640178 - RNA, 19 nt, Homo sapiens
gaugugagagagagucaga

SEQ ID NO: 640179 - RNA, 19 nt, Homo sapiens
gagagacccagagauguga

SEQ ID NO: 640180 - RNA, 19 nt, Homo sapiens
agagagagacagagagaga

SEQ ID NO: 640181 - RNA, 19 nt, Homo sapiens
acacagagagagacagaga

SEQ ID NO: 640182 - RNA, 19 nt, Homo sapiens
agagagagacacagagaga

SEQ ID NO: 640183 - RNA, 19 nt, Homo sapiens
agacagagagagagagaga

SEQ ID NO: 640184 - RNA, 19 nt, Homo sapiens
caaccugcauagugacaag

SEQ ID NO: 640185 - RNA, 19 nt, Homo sapiens
ugagagagagucagagaca

SEQ ID NO: 640186 - RNA, 19 nt, Homo sapiens
gagagagacccagagaugu

SEQ ID NO: 640187 - RNA, 19 nt, Homo sapiens
acaggaagcgugaaaucuu

SEQ ID NO: 640188 - RNA, 19 nt, Homo sapiens
ugacugaaaggaauuugug

SEQ ID NO: 640189 - RNA, 19 nt, Homo sapiens
cuccgaagcuggcaagaag

SEQ ID NO: 640190 - RNA, 19 nt, Homo sapiens
cgacaaggacacugaggau

SEQ ID NO: 640191 - RNA, 19 nt, Homo sapiens
gccaguacauccgcucugu

SEQ ID NO: 640192 - RNA, 19 nt, Homo sapiens
uugggacgcgcucuaaaua

SEQ ID NO: 640193 - RNA, 19 nt, Homo sapiens
cacauguuuccacuuaaua

SEQ ID NO: 640194 - RNA, 19 nt, Homo sapiens
ccucagggcuauggguuca

SEQ ID NO: 640195 - RNA, 19 nt, Homo sapiens
cacacauguuuccacuuaa

SEQ ID NO: 640196 - RNA, 19 nt, Homo sapiens
guccugccauugcccagaa

SEQ ID NO: 640197 - RNA, 19 nt, Homo sapiens
gaaaucuucagcaacuucu

SEQ ID NO: 640198 - RNA, 19 nt, Homo sapiens
acagagagagacagagaga

SEQ ID NO: 640199 - RNA, 19 nt, Homo sapiens
agagagagagacacagaga

SEQ ID NO: 640200 - RNA, 19 nt, Homo sapiens
agagagagagagacacaga

SEQ ID NO: 640201 - RNA, 19 nt, Homo sapiens
agagagagagagagagaga

SEQ ID NO: 640202 - RNA, 19 nt, Homo sapiens
acagagagagagagagaga

SEQ ID NO: 640203 - RNA, 19 nt, Homo sapiens
ccacagauggacuggaaca

SEQ ID NO: 640204 - RNA, 19 nt, Homo sapiens
agagagacacagagagaga

SEQ ID NO: 640205 - RNA, 19 nt, Homo sapiens
agagagagucagagacaga

SEQ ID NO: 640206 - RNA, 19 nt, Homo sapiens
agagagacccagagaugug

SEQ ID NO: 640207 - RNA, 19 nt, Homo sapiens
gcaauaaaacaaaccuuuc

SEQ ID NO: 640208 - RNA, 19 nt, Homo sapiens
agacacagagagagacaga

SEQ ID NO: 640209 - RNA, 19 nt, Homo sapiens
agucagagacagagacaga

SEQ ID NO: 640210 - RNA, 19 nt, Homo sapiens
ggaacaggaagcgugaaau

SEQ ID NO: 640211 - RNA, 19 nt, Homo sapiens
cgucacccgucaccaaugg

SEQ ID NO: 640212 - RNA, 19 nt, Homo sapiens
ucagagacagagacagaga

SEQ ID NO: 640213 - RNA, 19 nt, Homo sapiens
ugggacgcgcucuaaauaa

SEQ ID NO: 640214 - RNA, 19 nt, Homo sapiens
ggccuguggcagcaagaua

SEQ ID NO: 640215 - RNA, 19 nt, Homo sapiens
gcagugccuggaagcaaga

SEQ ID NO: 640216 - RNA, 19 nt, Homo sapiens
ccugcugacugaaaggaau

SEQ ID NO: 640217 - RNA, 19 nt, Homo sapiens
gcuccgaagcuggcaagaa

SEQ ID NO: 640218 - RNA, 19 nt, Homo sapiens
cccaggaccggcucauuga

SEQ ID NO: 640219 - RNA, 19 nt, Homo sapiens
gagaugugagagagaguca

SEQ ID NO: 640220 - RNA, 19 nt, Homo sapiens
uaaagaagauggcauuguu

SEQ ID NO: 640221 - RNA, 19 nt, Homo sapiens
ggagaaagccacuaaggua

SEQ ID NO: 640222 - RNA, 19 nt, Homo sapiens
gaaacaaagugagaauuga

SEQ ID NO: 640223 - RNA, 19 nt, Homo sapiens
gaugaacagcugcuuauua

SEQ ID NO: 640224 - RNA, 19 nt, Homo sapiens
gacagaggaugauauuaaa

SEQ ID NO: 640225 - RNA, 19 nt, Homo sapiens
gaaucaaggugaagaggaa

SEQ ID NO: 640226 - RNA, 19 nt, Homo sapiens
gaggaaacaacaagaauuu

SEQ ID NO: 640227 - RNA, 19 nt, Homo sapiens
ugacagaggaugauauuaa

SEQ ID NO: 640228 - RNA, 19 nt, Homo sapiens
gcaaugaggacacagauau

SEQ ID NO: 640229 - RNA, 19 nt, Homo sapiens
gaugguaucacuaguguuu

SEQ ID NO: 640230 - RNA, 19 nt, Homo sapiens
ggacaaccauauugcaauc

SEQ ID NO: 640231 - RNA, 19 nt, Homo sapiens
gaacagcugccaccaacaa

SEQ ID NO: 640232 - RNA, 19 nt, Homo sapiens
gaagaggaaacaacaagaa

SEQ ID NO: 640233 - RNA, 19 nt, Homo sapiens
gaacagcugcuuauuacug

SEQ ID NO: 640234 - RNA, 19 nt, Homo sapiens
ggacacagauauuccaaaa

SEQ ID NO: 640235 - RNA, 19 nt, Homo sapiens
gugaaugucuuaaugaaag

SEQ ID NO: 640236 - RNA, 19 nt, Homo sapiens
gaaagccacuaagguacaa

SEQ ID NO: 640237 - RNA, 19 nt, Homo sapiens
gaacugacagaggaugaua

SEQ ID NO: 640238 - RNA, 19 nt, Homo sapiens
ggucagggcccuaaauaug

SEQ ID NO: 640239 - RNA, 19 nt, Homo sapiens
caaagcugguugugaaugu

SEQ ID NO: 640240 - RNA, 19 nt, Homo sapiens
caaucaaccuguuaagcuu

SEQ ID NO: 640241 - RNA, 19 nt, Homo sapiens
cgaaacaaagugagaauug

SEQ ID NO: 640242 - RNA, 19 nt, Homo sapiens
ucagggcccuaaauaugua

SEQ ID NO: 640243 - RNA, 19 nt, Homo sapiens
gacacaaccuucuuggaau

SEQ ID NO: 640244 - RNA, 19 nt, Homo sapiens
gcauggauuugacaacugu

SEQ ID NO: 640245 - RNA, 19 nt, Homo sapiens
gccagagacugucaauguu

SEQ ID NO: 640246 - RNA, 19 nt, Homo sapiens
gaucuacagcuccuggaua

SEQ ID NO: 640247 - RNA, 19 nt, Homo sapiens
ucacuaguguuuccauugu

SEQ ID NO: 640248 - RNA, 19 nt, Homo sapiens
ccaaaaggcuauauggauu

SEQ ID NO: 640249 - RNA, 19 nt, Homo sapiens
gcugugggauuagaagaaa

SEQ ID NO: 640250 - RNA, 19 nt, Homo sapiens
agaaagaagugaaccaacu

SEQ ID NO: 640251 - RNA, 19 nt, Homo sapiens
guuaagcuuuauuccauga

SEQ ID NO: 640252 - RNA, 19 nt, Homo sapiens
gagcauggauuugacaacu

SEQ ID NO: 640253 - RNA, 19 nt, Homo sapiens
agacacaaccuucuuggaa

SEQ ID NO: 640254 - RNA, 19 nt, Homo sapiens
gguugugaaugucuuaaug

SEQ ID NO: 640255 - RNA, 19 nt, Homo sapiens
cagaugguaucacuagugu

SEQ ID NO: 640256 - RNA, 19 nt, Homo sapiens
ccagagacugucaauguuu

SEQ ID NO: 640257 - RNA, 19 nt, Homo sapiens
cuacagcuccuggauaauu

SEQ ID NO: 640258 - RNA, 19 nt, Homo sapiens
gcagaaagaagugaaccaa

SEQ ID NO: 640259 - RNA, 19 nt, Homo sapiens
gcauucaaucaaccuguua

SEQ ID NO: 640260 - RNA, 19 nt, Homo sapiens
gcauuguuccacuucguua

SEQ ID NO: 640261 - RNA, 19 nt, Homo sapiens
cagaggaugauauuaaaga

SEQ ID NO: 640262 - RNA, 19 nt, Homo sapiens
caaccuucuuggaaucuga

SEQ ID NO: 640263 - RNA, 19 nt, Homo sapiens
gaagcaaugaggacacaga

SEQ ID NO: 640264 - RNA, 19 nt, Homo sapiens
ugacaacuguuuacgaaaa

SEQ ID NO: 640265 - RNA, 19 nt, Homo sapiens
cagagacugucaauguuuc

SEQ ID NO: 640266 - RNA, 19 nt, Homo sapiens
gaagaggcagaaagaagug

SEQ ID NO: 640267 - RNA, 19 nt, Homo sapiens
ggaaucugacugugaugaa

SEQ ID NO: 640268 - RNA, 19 nt, Homo sapiens
gaaagaagugaaccaacuc

SEQ ID NO: 640269 - RNA, 19 nt, Homo sapiens
uuugacaacuguuuacgaa

SEQ ID NO: 640270 - RNA, 19 nt, Homo sapiens
uaaugaaagugaugagcau

SEQ ID NO: 640271 - RNA, 19 nt, Homo sapiens
caaccauauugcaaucaga

SEQ ID NO: 640272 - RNA, 19 nt, Homo sapiens
caaacgaguaguuggcaaa

SEQ ID NO: 640273 - RNA, 19 nt, Homo sapiens
gaaugacuucaaacgagua

SEQ ID NO: 640274 - RNA, 19 nt, Homo sapiens
ucagaauguuaacagugua

SEQ ID NO: 640275 - RNA, 19 nt, Homo sapiens
gugaugagcauggauuuga

SEQ ID NO: 640276 - RNA, 19 nt, Homo sapiens
acuaguguuuccauuguaa

SEQ ID NO: 640277 - RNA, 19 nt, Homo sapiens
ggcauucaaucaaccuguu

SEQ ID NO: 640278 - RNA, 19 nt, Homo sapiens
cagaucgucuucuccuuca

SEQ ID NO: 640279 - RNA, 19 nt, Homo sapiens
acacaaccuucuuggaauc

SEQ ID NO: 640280 - RNA, 19 nt, Homo sapiens
augaacagcugcuuauuac

SEQ ID NO: 640281 - RNA, 19 nt, Homo sapiens
ugaaagugaugagcaugga

SEQ ID NO: 640282 - RNA, 19 nt, Homo sapiens
caaugaggacacagauauu

SEQ ID NO: 640283 - RNA, 19 nt, Homo sapiens
aaaugacccuggaagcaau

SEQ ID NO: 640284 - RNA, 19 nt, Homo sapiens
auuguaaucuugacacaug

SEQ ID NO: 640285 - RNA, 19 nt, Homo sapiens
cgccagagacugucaaugu

SEQ ID NO: 640286 - RNA, 19 nt, Homo sapiens
cagcugccaccaacaauau

SEQ ID NO: 640287 - RNA, 19 nt, Homo sapiens
gggccauguuugaggauug

SEQ ID NO: 640288 - RNA, 19 nt, Homo sapiens
gagagggugugggccaugu

SEQ ID NO: 640289 - RNA, 19 nt, Homo sapiens
uaucacuaguguuuccauu

SEQ ID NO: 640290 - RNA, 19 nt, Homo sapiens
cuggauaauugcuugauuc

SEQ ID NO: 640291 - RNA, 19 nt, Homo sapiens
uacagcuccuggauaauug

SEQ ID NO: 640292 - RNA, 19 nt, Homo sapiens
ccaguccaggcaacaaaua

SEQ ID NO: 640293 - RNA, 19 nt, Homo sapiens
guuccacuucguuauguua

SEQ ID NO: 640294 - RNA, 19 nt, Homo sapiens
ugaagaggcagaaagaagu

SEQ ID NO: 640295 - RNA, 19 nt, Homo sapiens
gugaugaacagcugcuuau

SEQ ID NO: 640296 - RNA, 19 nt, Homo sapiens
gaaucugacugugaugaac

SEQ ID NO: 640297 - RNA, 19 nt, Homo sapiens
guucagaugguaucacuag

SEQ ID NO: 640298 - RNA, 19 nt, Homo sapiens
gagggugugggccauguuu

SEQ ID NO: 640299 - RNA, 19 nt, Homo sapiens
ugacuucaaacgaguaguu

SEQ ID NO: 640300 - RNA, 19 nt, Homo sapiens
agaggaaacaacaagaauu

SEQ ID NO: 640301 - RNA, 19 nt, Homo sapiens
cuauauuuguucagucgaa

SEQ ID NO: 640302 - RNA, 19 nt, Homo sapiens
acacuggacaaccauauug

SEQ ID NO: 640303 - RNA, 19 nt, Homo sapiens
cagaugcugugggauuaga

SEQ ID NO: 640304 - RNA, 19 nt, Homo sapiens
aucuacagcuccuggauaa

SEQ ID NO: 640305 - RNA, 19 nt, Homo sapiens
cuguuaagcuuuauuccau

SEQ ID NO: 640306 - RNA, 19 nt, Homo sapiens
gcuuauuacuguggcauuc

SEQ ID NO: 640307 - RNA, 19 nt, Homo sapiens
aaagugaugagcauggauu

SEQ ID NO: 640308 - RNA, 19 nt, Homo sapiens
guugugaaugucuuaauga

SEQ ID NO: 640309 - RNA, 19 nt, Homo sapiens
aaaucaagcagcacuuaga

SEQ ID NO: 640310 - RNA, 19 nt, Homo sapiens
cacuaguguuuccauugua

SEQ ID NO: 640311 - RNA, 19 nt, Homo sapiens
ccuggauaauugcuugauu

SEQ ID NO: 640312 - RNA, 19 nt, Homo sapiens
cauauugcaaucagaucua

SEQ ID NO: 640313 - RNA, 19 nt, Homo sapiens
uaucagcaacaccuacauu

SEQ ID NO: 640314 - RNA, 19 nt, Homo sapiens
cagaauguuaacaguguaa

SEQ ID NO: 640315 - RNA, 19 nt, Homo sapiens
gacacuggacaaccauauu

SEQ ID NO: 640316 - RNA, 19 nt, Homo sapiens
guccaggcaacaaauauga

SEQ ID NO: 640317 - RNA, 19 nt, Homo sapiens
aaauuucaagggccagaua

SEQ ID NO: 640318 - RNA, 19 nt, Homo sapiens
caaagugagaauugaucaa

SEQ ID NO: 640319 - RNA, 19 nt, Homo sapiens
aggcaacaaauaugaauga

SEQ ID NO: 640320 - RNA, 19 nt, Homo sapiens
ggacuacgcucucugaauu

SEQ ID NO: 640321 - RNA, 19 nt, Homo sapiens
gaacauaacacuucagauu

SEQ ID NO: 640322 - RNA, 19 nt, Homo sapiens
gaagauggauucuggugua

SEQ ID NO: 640323 - RNA, 19 nt, Homo sapiens
ggaaauaacaucacaagaa

SEQ ID NO: 640324 - RNA, 19 nt, Homo sapiens
ccaaggaacucuccaacua

SEQ ID NO: 640325 - RNA, 19 nt, Homo sapiens
gaaaucaccuucagcuguu

SEQ ID NO: 640326 - RNA, 19 nt, Homo sapiens
ucaaguggcuagcggauua

SEQ ID NO: 640327 - RNA, 19 nt, Homo sapiens
ggaaauaaaugcguacaug

SEQ ID NO: 640328 - RNA, 19 nt, Homo sapiens
gaauguacuugcuuggaua

SEQ ID NO: 640329 - RNA, 19 nt, Homo sapiens
ggacagcugugaucgagaa

SEQ ID NO: 640330 - RNA, 19 nt, Homo sapiens
gauggauucugguguauuu

SEQ ID NO: 640331 - RNA, 19 nt, Homo sapiens
caagagaugucacagaguu

SEQ ID NO: 640332 - RNA, 19 nt, Homo sapiens
gaaaugaugacaauaguug

SEQ ID NO: 640333 - RNA, 19 nt, Homo sapiens
gggaaaggauaagagauua

SEQ ID NO: 640334 - RNA, 19 nt, Homo sapiens
cagaauaaaugagccaaua

SEQ ID NO: 640335 - RNA, 19 nt, Homo sapiens
uggaggaacuugccacuua

SEQ ID NO: 640336 - RNA, 19 nt, Homo sapiens
gaacagaacacaaucaaag

SEQ ID NO: 640337 - RNA, 19 nt, Homo sapiens
gagaguggcugagaaagaa

SEQ ID NO: 640338 - RNA, 19 nt, Homo sapiens
ccaagaaggugucccgauu

SEQ ID NO: 640339 - RNA, 19 nt, Homo sapiens
gcggaauccuccuguauaa

SEQ ID NO: 640340 - RNA, 19 nt, Homo sapiens
gaaauacguuuggaacaga

SEQ ID NO: 640341 - RNA, 19 nt, Homo sapiens
ggaggaacuugccacuuaa

SEQ ID NO: 640342 - RNA, 19 nt, Homo sapiens
gaaggagcaucugguguaa

SEQ ID NO: 640343 - RNA, 19 nt, Homo sapiens
ggagcuuucucaccauaua

SEQ ID NO: 640344 - RNA, 19 nt, Homo sapiens
caaagggauucaaauguga

SEQ ID NO: 640345 - RNA, 19 nt, Homo sapiens
ccaaagggauucaaaugug

SEQ ID NO: 640346 - RNA, 19 nt, Homo sapiens
cgaaagguauuccaagaga

SEQ ID NO: 640347 - RNA, 19 nt, Homo sapiens
uaaaugagccaauauguca

SEQ ID NO: 640348 - RNA, 19 nt, Homo sapiens
gaacggcuauacgugcaua

SEQ ID NO: 640349 - RNA, 19 nt, Homo sapiens
gaacuugccacuuaaagga

SEQ ID NO: 640350 - RNA, 19 nt, Homo sapiens
aaucagagcuucagcaaca

SEQ ID NO: 640351 - RNA, 19 nt, Homo sapiens
ucaaagcaguccacucuga

SEQ ID NO: 640352 - RNA, 19 nt, Homo sapiens
gaaauggcagauaaacuuu

SEQ ID NO: 640353 - RNA, 19 nt, Homo sapiens
gaauuacgaagacagauuu

SEQ ID NO: 640354 - RNA, 19 nt, Homo sapiens
gaauggagcucaguguauc

SEQ ID NO: 640355 - RNA, 19 nt, Homo sapiens
ggagggagcauuugaagga

SEQ ID NO: 640356 - RNA, 19 nt, Homo sapiens
ugaauucacuuguccucua

SEQ ID NO: 640357 - RNA, 19 nt, Homo sapiens
gaagaggaggaucuguuua

SEQ ID NO: 640358 - RNA, 19 nt, Homo sapiens
caagaaggugucccgauua

SEQ ID NO: 640359 - RNA, 19 nt, Homo sapiens
caacguugaugauugugaa

SEQ ID NO: 640360 - RNA, 19 nt, Homo sapiens
ugacggaaaugaugacaau

SEQ ID NO: 640361 - RNA, 19 nt, Homo sapiens
gcaagaaauuccguuguuc

SEQ ID NO: 640362 - RNA, 19 nt, Homo sapiens
gaauucacuuguccucuau

SEQ ID NO: 640363 - RNA, 19 nt, Homo sapiens
gaucagcuguauugaagau

SEQ ID NO: 640364 - RNA, 19 nt, Homo sapiens
cuagagagacugcguuuaa

SEQ ID NO: 640365 - RNA, 19 nt, Homo sapiens
gagacuggauuuaaaugga

SEQ ID NO: 640366 - RNA, 19 nt, Homo sapiens
gaauaaaugagccaauaug

SEQ ID NO: 640367 - RNA, 19 nt, Homo sapiens
gaagauaaugacugugaaa

SEQ ID NO: 640368 - RNA, 19 nt, Homo sapiens
ggauuaaagucucuucgau

SEQ ID NO: 640369 - RNA, 19 nt, Homo sapiens
gagcaucugguguaaauga

SEQ ID NO: 640370 - RNA, 19 nt, Homo sapiens
gaaggaaccacaguagauu

SEQ ID NO: 640371 - RNA, 19 nt, Homo sapiens
ccuuacagcuccuauuauu

SEQ ID NO: 640372 - RNA, 19 nt, Homo sapiens
cagaucagcuguauugaag

SEQ ID NO: 640373 - RNA, 19 nt, Homo sapiens
gaauaagauuagcaccauu

SEQ ID NO: 640374 - RNA, 19 nt, Homo sapiens
gaaggugcuuucaaugauc

SEQ ID NO: 640375 - RNA, 19 nt, Homo sapiens
ccgagagacuggauuuaaa

SEQ ID NO: 640376 - RNA, 19 nt, Homo sapiens
cuccucaccuuaauucuua

SEQ ID NO: 640377 - RNA, 19 nt, Homo sapiens
gagccaauaugucaguguu

SEQ ID NO: 640378 - RNA, 19 nt, Homo sapiens
gauucaaagugcauccuaa

SEQ ID NO: 640379 - RNA, 19 nt, Homo sapiens
aaugauggcacauguaaua

SEQ ID NO: 640380 - RNA, 19 nt, Homo sapiens
gaaacuuccucaauuacgu

SEQ ID NO: 640381 - RNA, 19 nt, Homo sapiens
ggaagccacaggaaucuuu

SEQ ID NO: 640382 - RNA, 19 nt, Homo sapiens
gcagaguugcgucucaaua

SEQ ID NO: 640383 - RNA, 19 nt, Homo sapiens
caacauuacuagacuuucu

SEQ ID NO: 640384 - RNA, 19 nt, Homo sapiens
gcagcaagcuaaagaaagc

SEQ ID NO: 640385 - RNA, 19 nt, Homo sapiens
ggaaggagaagaagaugga

SEQ ID NO: 640386 - RNA, 19 nt, Homo sapiens
gauggcacauguaauagug

SEQ ID NO: 640387 - RNA, 19 nt, Homo sapiens
gaucuggcuugcccugaaa

SEQ ID NO: 640388 - RNA, 19 nt, Homo sapiens
uacagaagauuaucgauca

SEQ ID NO: 640389 - RNA, 19 nt, Homo sapiens
cggauuaucuccauaccaa

SEQ ID NO: 640390 - RNA, 19 nt, Homo sapiens
ccagagaccaucacagaaa

SEQ ID NO: 640391 - RNA, 19 nt, Homo sapiens
ggaaaagguuguauacuuc

SEQ ID NO: 640392 - RNA, 19 nt, Homo sapiens
acagugagcugcaggacuu

SEQ ID NO: 640393 - RNA, 19 nt, Homo sapiens
ccaacccucuuuacuguga

SEQ ID NO: 640394 - RNA, 19 nt, Homo sapiens
ggaaauccuagaugucaaa

SEQ ID NO: 640395 - RNA, 19 nt, Homo sapiens
ugaaggagcaucuggugua

SEQ ID NO: 640396 - RNA, 19 nt, Homo sapiens
aaccauaugccuaaacuua

SEQ ID NO: 640397 - RNA, 19 nt, Homo sapiens
gagacugcguuuaaacaga

SEQ ID NO: 640398 - RNA, 19 nt, Homo sapiens
gcagcucugucuuuggaaa

SEQ ID NO: 640399 - RNA, 19 nt, Homo sapiens
cuggagaaauggcagauaa

SEQ ID NO: 640400 - RNA, 19 nt, Homo sapiens
gaaagguauuccaagagau

SEQ ID NO: 640401 - RNA, 19 nt, Homo sapiens
gaagccacaggaaucuuua

SEQ ID NO: 640402 - RNA, 19 nt, Homo sapiens
uuacagcuccuauuauuga

SEQ ID NO: 640403 - RNA, 19 nt, Homo sapiens
agacuuaaguaacaacaga

SEQ ID NO: 640404 - RNA, 19 nt, Homo sapiens
ggaacucuccaacuacaaa

SEQ ID NO: 640405 - RNA, 19 nt, Homo sapiens
gccgaaagguauuccaaga

SEQ ID NO: 640406 - RNA, 19 nt, Homo sapiens
ggagaguggcugagaaaga

SEQ ID NO: 640407 - RNA, 19 nt, Homo sapiens
uugauacucuccauucuuu

SEQ ID NO: 640408 - RNA, 19 nt, Homo sapiens
gaguugcgucucaauaaua

SEQ ID NO: 640409 - RNA, 19 nt, Homo sapiens
ggaacuacuugccuuggau

SEQ ID NO: 640410 - RNA, 19 nt, Homo sapiens
gagcagcaagcuaaagaaa

SEQ ID NO: 640411 - RNA, 19 nt, Homo sapiens
uauuugugcugauggauuu

SEQ ID NO: 640412 - RNA, 19 nt, Homo sapiens
agaaauggcagauaaacuu

SEQ ID NO: 640413 - RNA, 19 nt, Homo sapiens
aagauuagcaccauugaaa

SEQ ID NO: 640414 - RNA, 19 nt, Homo sapiens
gauuaaagucucuucgauu

SEQ ID NO: 640415 - RNA, 19 nt, Homo sapiens
gcaaucgaauaaccugugu

SEQ ID NO: 640416 - RNA, 19 nt, Homo sapiens
ggaucuggcuugcccugaa

SEQ ID NO: 640417 - RNA, 19 nt, Homo sapiens
aaacagaaaucaccuucag

SEQ ID NO: 640418 - RNA, 19 nt, Homo sapiens
gaaggugucccgauuagag

SEQ ID NO: 640419 - RNA, 19 nt, Homo sapiens
aaucaucacuaacuuguca

SEQ ID NO: 640420 - RNA, 19 nt, Homo sapiens
gcagauaccuuuaaguuug

SEQ ID NO: 640421 - RNA, 19 nt, Homo sapiens
gagcagacuuucuaacaua

SEQ ID NO: 640422 - RNA, 19 nt, Homo sapiens
gaacugcucuugcugaaau

SEQ ID NO: 640423 - RNA, 19 nt, Homo sapiens
ccucuucgcucgcuuauua

SEQ ID NO: 640424 - RNA, 19 nt, Homo sapiens
ggaauaugauuauggcuuu

SEQ ID NO: 640425 - RNA, 19 nt, Homo sapiens
cagaguaacuucacauaaa

SEQ ID NO: 640426 - RNA, 19 nt, Homo sapiens
gaggauaccuuaaagugaa

SEQ ID NO: 640427 - RNA, 19 nt, Homo sapiens
gagcauguccuucacuuua

SEQ ID NO: 640428 - RNA, 19 nt, Homo sapiens
gaauagauacugugaacua

SEQ ID NO: 640429 - RNA, 19 nt, Homo sapiens
gaguaucuccugcuuauua

SEQ ID NO: 640430 - RNA, 19 nt, Homo sapiens
ccagaugacucggauaaua

SEQ ID NO: 640431 - RNA, 19 nt, Homo sapiens
ccagagaugucauaaguga

SEQ ID NO: 640432 - RNA, 19 nt, Homo sapiens
ggagcaacuugaauagaua

SEQ ID NO: 640433 - RNA, 19 nt, Homo sapiens
ggaguugaaugaugaagaa

SEQ ID NO: 640434 - RNA, 19 nt, Homo sapiens
gauaauagcgugucagaga

SEQ ID NO: 640435 - RNA, 19 nt, Homo sapiens
gcucauaacuuaccaagag

SEQ ID NO: 640436 - RNA, 19 nt, Homo sapiens
gaucaacgcgacuguauuu

SEQ ID NO: 640437 - RNA, 19 nt, Homo sapiens
uaucugcacuaucuacuua

SEQ ID NO: 640438 - RNA, 19 nt, Homo sapiens
gaacagaaguuuaauuacc

SEQ ID NO: 640439 - RNA, 19 nt, Homo sapiens
ugacagaccaggagaauaa

SEQ ID NO: 640440 - RNA, 19 nt, Homo sapiens
ccaagaggcuaauacuaaa

SEQ ID NO: 640441 - RNA, 19 nt, Homo sapiens
agaagcagcucuaaaucua

SEQ ID NO: 640442 - RNA, 19 nt, Homo sapiens
ggagaaaacuggaggaaaa

SEQ ID NO: 640443 - RNA, 19 nt, Homo sapiens
uaaauaagccugggaauau

SEQ ID NO: 640444 - RNA, 19 nt, Homo sapiens
gcacagagcauaagucuac

SEQ ID NO: 640445 - RNA, 19 nt, Homo sapiens
gcaacaaucugaugaacuc

SEQ ID NO: 640446 - RNA, 19 nt, Homo sapiens
gcucugguauugcucauaa

SEQ ID NO: 640447 - RNA, 19 nt, Homo sapiens
uggaaagccucaaaucuaa

SEQ ID NO: 640448 - RNA, 19 nt, Homo sapiens
agccuuaggucuucaauua

SEQ ID NO: 640449 - RNA, 19 nt, Homo sapiens
uaacaugacuucuucuaca

SEQ ID NO: 640450 - RNA, 19 nt, Homo sapiens
cccagcagcuuccuaguua

SEQ ID NO: 640451 - RNA, 19 nt, Homo sapiens
gggagagcauuaaggauuu

SEQ ID NO: 640452 - RNA, 19 nt, Homo sapiens
cagauaaccugggugauuu

SEQ ID NO: 640453 - RNA, 19 nt, Homo sapiens
gaugucaugugaggaaaua

SEQ ID NO: 640454 - RNA, 19 nt, Homo sapiens
ggacuaggccuaaguagau

SEQ ID NO: 640455 - RNA, 19 nt, Homo sapiens
gauauuggaugaggaaguu

SEQ ID NO: 640456 - RNA, 19 nt, Homo sapiens
gaaaccaaguguccucugu

SEQ ID NO: 640457 - RNA, 19 nt, Homo sapiens
gcccagagaugucauaagu

SEQ ID NO: 640458 - RNA, 19 nt, Homo sapiens
caagacauuugcucaguga

SEQ ID NO: 640459 - RNA, 19 nt, Homo sapiens
acaacaacaucucaaguaa

SEQ ID NO: 640460 - RNA, 19 nt, Homo sapiens
gcagauaaccugggugauu

SEQ ID NO: 640461 - RNA, 19 nt, Homo sapiens
gagcuaaccuuuccuuugc

SEQ ID NO: 640462 - RNA, 19 nt, Homo sapiens
ggaaaugaaccuagaaaca

SEQ ID NO: 640463 - RNA, 19 nt, Homo sapiens
gagaucaagucacucuuug

SEQ ID NO: 640464 - RNA, 19 nt, Homo sapiens
gacuaugccucuaagaauu

SEQ ID NO: 640465 - RNA, 19 nt, Homo sapiens
ccaaucagaugccagaaau

SEQ ID NO: 640466 - RNA, 19 nt, Homo sapiens
ggaagagauuaccaaaguu

SEQ ID NO: 640467 - RNA, 19 nt, Homo sapiens
ggaaauaugugagcaacuc

SEQ ID NO: 640468 - RNA, 19 nt, Homo sapiens
uguguagacuucugaauaa

SEQ ID NO: 640469 - RNA, 19 nt, Homo sapiens
ggaaacguguguucugcaa

SEQ ID NO: 640470 - RNA, 19 nt, Homo sapiens
ugaggaaguuagaacauuu

SEQ ID NO: 640471 - RNA, 19 nt, Homo sapiens
ccaggcaaccacuuaauua

SEQ ID NO: 640472 - RNA, 19 nt, Homo sapiens
gaucacagcaggaaauaug

SEQ ID NO: 640473 - RNA, 19 nt, Homo sapiens
cagagagccuggaugaauu

SEQ ID NO: 640474 - RNA, 19 nt, Homo sapiens
ugguauugcucauaacuua

SEQ ID NO: 640475 - RNA, 19 nt, Homo sapiens
cauuaaugcugcugaauau

SEQ ID NO: 640476 - RNA, 19 nt, Homo sapiens
gcagagaggaaacaacaaa

SEQ ID NO: 640477 - RNA, 19 nt, Homo sapiens
gggcaaauguaccagaaga

SEQ ID NO: 640478 - RNA, 19 nt, Homo sapiens
gagaacugcucuugcugaa

SEQ ID NO: 640479 - RNA, 19 nt, Homo sapiens
gagugcagauaaacaauug

SEQ ID NO: 640480 - RNA, 19 nt, Homo sapiens
caacauccaucaguucaug

SEQ ID NO: 640481 - RNA, 19 nt, Homo sapiens
uuacucagcucugguauug

SEQ ID NO: 640482 - RNA, 19 nt, Homo sapiens
guauuuaaccuucagauug

SEQ ID NO: 640483 - RNA, 19 nt, Homo sapiens
cuuguaaccugacuucuaa

SEQ ID NO: 640484 - RNA, 19 nt, Homo sapiens
ccuaagaacuugacaaugc

SEQ ID NO: 640485 - RNA, 19 nt, Homo sapiens
caacuugaauagauacugu

SEQ ID NO: 640486 - RNA, 19 nt, Homo sapiens
gggugucacugcuucauuu

SEQ ID NO: 640487 - RNA, 19 nt, Homo sapiens
caagaugggugccuuaaaa

SEQ ID NO: 640488 - RNA, 19 nt, Homo sapiens
gagccgaaguuuccacaga

SEQ ID NO: 640489 - RNA, 19 nt, Homo sapiens
ugaaggaaauguuaaaggu

SEQ ID NO: 640490 - RNA, 19 nt, Homo sapiens
cuaguaggauguucucauu

SEQ ID NO: 640491 - RNA, 19 nt, Homo sapiens
ggucuucaauuaacaaagu

SEQ ID NO: 640492 - RNA, 19 nt, Homo sapiens
ugagauguaugcaguaugu

SEQ ID NO: 640493 - RNA, 19 nt, Homo sapiens
ccaaacagaucccuuuaac

SEQ ID NO: 640494 - RNA, 19 nt, Homo sapiens
gaggaaaccuaugcagaug

SEQ ID NO: 640495 - RNA, 19 nt, Homo sapiens
gaagagauuaccaaaguuc

SEQ ID NO: 640496 - RNA, 19 nt, Homo sapiens
caguagagcuagaagauca

SEQ ID NO: 640497 - RNA, 19 nt, Homo sapiens
aaaauaagcuucugccuau

SEQ ID NO: 640498 - RNA, 19 nt, Homo sapiens
uaacaaaguaggaaguuga

SEQ ID NO: 640499 - RNA, 19 nt, Homo sapiens
ccuguuauccuguguauuu

SEQ ID NO: 640500 - RNA, 19 nt, Homo sapiens
caucagagaucaagucacu

SEQ ID NO: 640501 - RNA, 19 nt, Homo sapiens
gaauuuagaagccaugaau

SEQ ID NO: 640502 - RNA, 19 nt, Homo sapiens
ccaaauguaugccucagau

SEQ ID NO: 640503 - RNA, 19 nt, Homo sapiens
gaaaugaaccuagaaacag

SEQ ID NO: 640504 - RNA, 19 nt, Homo sapiens
uaacuauggucucuuucaa

SEQ ID NO: 640505 - RNA, 19 nt, Homo sapiens
ggcaaccacuuaauuaaca

SEQ ID NO: 640506 - RNA, 19 nt, Homo sapiens
gaaagccucaaaucuaaga

SEQ ID NO: 640507 - RNA, 19 nt, Homo sapiens
uaacacagccuuaggucuu

SEQ ID NO: 640508 - RNA, 19 nt, Homo sapiens
gcagaugccugugaugagu

SEQ ID NO: 640509 - RNA, 19 nt, Homo sapiens
acugguagauuugauguua

SEQ ID NO: 640510 - RNA, 19 nt, Homo sapiens
aaaugaaccuagaaacaga

SEQ ID NO: 640511 - RNA, 19 nt, Homo sapiens
gaaggaaauguuaaagguu

SEQ ID NO: 640512 - RNA, 19 nt, Homo sapiens
uaacuuaccaagaggcuaa

SEQ ID NO: 640513 - RNA, 19 nt, Homo sapiens
ggaggauaccuuaaaguga

SEQ ID NO: 640514 - RNA, 19 nt, Homo sapiens
guagacuucugaauaagau

SEQ ID NO: 640515 - RNA, 19 nt, Homo sapiens
ggaagcauagaaagaauga

SEQ ID NO: 640516 - RNA, 19 nt, Homo sapiens
gugaguacaugaacaagau

SEQ ID NO: 640517 - RNA, 19 nt, Homo sapiens
aggaagagauuaccaaagu

SEQ ID NO: 640518 - RNA, 19 nt, Homo sapiens
gaaggugccaguugcuauu

SEQ ID NO: 640519 - RNA, 19 nt, Homo sapiens
uggcuuugcuggaguauga

SEQ ID NO: 640520 - RNA, 19 nt, Homo sapiens
ggcuagagcuucuguauuu

SEQ ID NO: 640521 - RNA, 19 nt, Homo sapiens
gcaacuaacuaaccacauu

SEQ ID NO: 640522 - RNA, 19 nt, Homo sapiens
gcgcuaagcugcaacgaaa

SEQ ID NO: 640523 - RNA, 19 nt, Homo sapiens
caacauuugugucacugua

SEQ ID NO: 640524 - RNA, 19 nt, Homo sapiens
agucggagcucaccuguuu

SEQ ID NO: 640525 - RNA, 19 nt, Homo sapiens
gaacaacuuggaagaucua

SEQ ID NO: 640526 - RNA, 19 nt, Homo sapiens
gaucucgccuggaaacaga

SEQ ID NO: 640527 - RNA, 19 nt, Homo sapiens
ggucuucccuacuacaaug

SEQ ID NO: 640528 - RNA, 19 nt, Homo sapiens
ggaacaacuuggaagaucu

SEQ ID NO: 640529 - RNA, 19 nt, Homo sapiens
caacuaacuaaccacauuu

SEQ ID NO: 640530 - RNA, 19 nt, Homo sapiens
agucuuacuuugccauuaa

SEQ ID NO: 640531 - RNA, 19 nt, Homo sapiens
gcuuugagcaacuaacuaa

SEQ ID NO: 640532 - RNA, 19 nt, Homo sapiens
ccacgugccuuaggaauac

SEQ ID NO: 640533 - RNA, 19 nt, Homo sapiens
ccaccacccugacagacuu

SEQ ID NO: 640534 - RNA, 19 nt, Homo sapiens
uaaguuggcuagagcuucu

SEQ ID NO: 640535 - RNA, 19 nt, Homo sapiens
ugaagcagcucgcgcaaaa

SEQ ID NO: 640536 - RNA, 19 nt, Homo sapiens
uuuaggaucucgccuggaa

SEQ ID NO: 640537 - RNA, 19 nt, Homo sapiens
guucaggcgcaaccucuua

SEQ ID NO: 640538 - RNA, 19 nt, Homo sapiens
aaauagaggcuuugagcaa

SEQ ID NO: 640539 - RNA, 19 nt, Homo sapiens
gcacaugcgcugccucaag

SEQ ID NO: 640540 - RNA, 19 nt, Homo sapiens
gcaaggacgguagcaucua

SEQ ID NO: 640541 - RNA, 19 nt, Homo sapiens
cacaugcgcugccucaagu

SEQ ID NO: 640542 - RNA, 19 nt, Homo sapiens
aaacgacucuuaccaaccu

SEQ ID NO: 640543 - RNA, 19 nt, Homo sapiens
gcucgggacuugguuuauc

SEQ ID NO: 640544 - RNA, 19 nt, Homo sapiens
gagcuucuguauuuucaaa

SEQ ID NO: 640545 - RNA, 19 nt, Homo sapiens
gccacgugccuuaggaaua

SEQ ID NO: 640546 - RNA, 19 nt, Homo sapiens
uuaguugaauuccaagugu

SEQ ID NO: 640547 - RNA, 19 nt, Homo sapiens
cuacaacgcugcgcuaagc

SEQ ID NO: 640548 - RNA, 19 nt, Homo sapiens
gcaaggaagacuacuacag

SEQ ID NO: 640549 - RNA, 19 nt, Homo sapiens
uaguugaauuccaagugua

SEQ ID NO: 640550 - RNA, 19 nt, Homo sapiens
gcucgcaggcuucggagaa

SEQ ID NO: 640551 - RNA, 19 nt, Homo sapiens
gcgcucgggacuugguuua

SEQ ID NO: 640552 - RNA, 19 nt, Homo sapiens
uaauuuaaguuggcuagag

SEQ ID NO: 640553 - RNA, 19 nt, Homo sapiens
uuaccaaccuuuucuaaug

SEQ ID NO: 640554 - RNA, 19 nt, Homo sapiens
ccacucugcuccuccucuu

SEQ ID NO: 640555 - RNA, 19 nt, Homo sapiens
agaucuaccugcaacacaa

SEQ ID NO: 640556 - RNA, 19 nt, Homo sapiens
uagcaucuacugcaaggaa

SEQ ID NO: 640557 - RNA, 19 nt, Homo sapiens
ggacaagcaguggcacaug

SEQ ID NO: 640558 - RNA, 19 nt, Homo sapiens
cgaggaacaacuuggaaga

SEQ ID NO: 640559 - RNA, 19 nt, Homo sapiens
cacaaacgacucuuaccaa

SEQ ID NO: 640560 - RNA, 19 nt, Homo sapiens
gcaccacguguaacaagau

SEQ ID NO: 640561 - RNA, 19 nt, Homo sapiens
uuuaucaccucaacugcuu

SEQ ID NO: 640562 - RNA, 19 nt, Homo sapiens
uagaggcuuugagcaacua

SEQ ID NO: 640563 - RNA, 19 nt, Homo sapiens
uucggaccaugaagucuua

SEQ ID NO: 640564 - RNA, 19 nt, Homo sapiens
ggcgaccacuucggcauga

SEQ ID NO: 640565 - RNA, 19 nt, Homo sapiens
gaguuugcgcccuugcuuu

SEQ ID NO: 640566 - RNA, 19 nt, Homo sapiens
gccgaccucuguccuaguc

SEQ ID NO: 640567 - RNA, 19 nt, Homo sapiens
gaggaacaacuuggaagau

SEQ ID NO: 640568 - RNA, 19 nt, Homo sapiens
ucacaaacgacucuuacca

SEQ ID NO: 640569 - RNA, 19 nt, Homo sapiens
uacuuuggaugacuuguuc

SEQ ID NO: 640570 - RNA, 19 nt, Homo sapiens
aggaacaacuuggaagauc

SEQ ID NO: 640571 - RNA, 19 nt, Homo sapiens
ugaaggacagccuggucua

SEQ ID NO: 640572 - RNA, 19 nt, Homo sapiens
gaucucggaccgcuacuac

SEQ ID NO: 640573 - RNA, 19 nt, Homo sapiens
caccacguguaacaagaug

SEQ ID NO: 640574 - RNA, 19 nt, Homo sapiens
gaccgaggaacaacuugga

SEQ ID NO: 640575 - RNA, 19 nt, Homo sapiens
gaagaucuaccugcaacac

SEQ ID NO: 640576 - RNA, 19 nt, Homo sapiens
caacuuggaagaucuaccu

SEQ ID NO: 640577 - RNA, 19 nt, Homo sapiens
gaaggacagccuggucuac

SEQ ID NO: 640578 - RNA, 19 nt, Homo sapiens
ugccuuaggaauacuguuu

SEQ ID NO: 640579 - RNA, 19 nt, Homo sapiens
aagacugccacgugccuua

SEQ ID NO: 640580 - RNA, 19 nt, Homo sapiens
uaccaaccuuuucuaauga

SEQ ID NO: 640581 - RNA, 19 nt, Homo sapiens
ccuuaggaauacuguuuua

SEQ ID NO: 640582 - RNA, 19 nt, Homo sapiens
acaauggcgugggcacugu

SEQ ID NO: 640583 - RNA, 19 nt, Homo sapiens
gaaagaagcagggauauau

SEQ ID NO: 640584 - RNA, 19 nt, Homo sapiens
ggacugcccuuucucaaug

SEQ ID NO: 640585 - RNA, 19 nt, Homo sapiens
ggaagaaggagccaaauug

SEQ ID NO: 640586 - RNA, 19 nt, Homo sapiens
ggaagguacucaucuugaa

SEQ ID NO: 640587 - RNA, 19 nt, Homo sapiens
gaagaaggagccaaauuga

SEQ ID NO: 640588 - RNA, 19 nt, Homo sapiens
caccagaaccacaucauua

SEQ ID NO: 640589 - RNA, 19 nt, Homo sapiens
ggagucagcaucuaccuaa

SEQ ID NO: 640590 - RNA, 19 nt, Homo sapiens
ggaacuguaucccacaaug

SEQ ID NO: 640591 - RNA, 19 nt, Homo sapiens
ccacuagcuuugcauacua

SEQ ID NO: 640592 - RNA, 19 nt, Homo sapiens
caagagcaccagaaguaua

SEQ ID NO: 640593 - RNA, 19 nt, Homo sapiens
gaaggagccaaauugagua

SEQ ID NO: 640594 - RNA, 19 nt, Homo sapiens
caaauugaguauggaggua

SEQ ID NO: 640595 - RNA, 19 nt, Homo sapiens
gaacuguaucccacaauga

SEQ ID NO: 640596 - RNA, 19 nt, Homo sapiens
ggaccugccugccaagcuu

SEQ ID NO: 640597 - RNA, 19 nt, Homo sapiens
ucagaaagaagcagggaua

SEQ ID NO: 640598 - RNA, 19 nt, Homo sapiens
caucuaccaucgugacuga

SEQ ID NO: 640599 - RNA, 19 nt, Homo sapiens
aacaagagcaccagaagua

SEQ ID NO: 640600 - RNA, 19 nt, Homo sapiens
ggagccaaauugaguaugg

SEQ ID NO: 640601 - RNA, 19 nt, Homo sapiens
ggguccaccucccuuuaua

SEQ ID NO: 640602 - RNA, 19 nt, Homo sapiens
caacagcaccuucccaucu

SEQ ID NO: 640603 - RNA, 19 nt, Homo sapiens
gaaauggugacccaagugu

SEQ ID NO: 640604 - RNA, 19 nt, Homo sapiens
gcaccuugauuggcuaugu

SEQ ID NO: 640605 - RNA, 19 nt, Homo sapiens
ucaacugcaucuuccugua

SEQ ID NO: 640606 - RNA, 19 nt, Homo sapiens
gggccagucugcagaagga

SEQ ID NO: 640607 - RNA, 19 nt, Homo sapiens
gggaagaaggagccaaauu

SEQ ID NO: 640608 - RNA, 19 nt, Homo sapiens
gaaacagacgcgacagcaa

SEQ ID NO: 640609 - RNA, 19 nt, Homo sapiens
gcccaauggccuuuaauga

SEQ ID NO: 640610 - RNA, 19 nt, Homo sapiens
acaacacccugcagaacuu

SEQ ID NO: 640611 - RNA, 19 nt, Homo sapiens
ccaugccucucuucaucua

SEQ ID NO: 640612 - RNA, 19 nt, Homo sapiens
caacugcaucuuccuguau

SEQ ID NO: 640613 - RNA, 19 nt, Homo sapiens
gcaacaagagcaccagaag

SEQ ID NO: 640614 - RNA, 19 nt, Homo sapiens
agaaagaagcagggauaua

SEQ ID NO: 640615 - RNA, 19 nt, Homo sapiens
ccagaaccacaucauuaaa

SEQ ID NO: 640616 - RNA, 19 nt, Homo sapiens
ggaaauggugacccaagug

SEQ ID NO: 640617 - RNA, 19 nt, Homo sapiens
ccugauggcuucucacaac

SEQ ID NO: 640618 - RNA, 19 nt, Homo sapiens
agaaggagccaaauugagu

SEQ ID NO: 640619 - RNA, 19 nt, Homo sapiens
aacagcaccuucccaucua

SEQ ID NO: 640620 - RNA, 19 nt, Homo sapiens
caaggaggaggaagaggaa

SEQ ID NO: 640621 - RNA, 19 nt, Homo sapiens
acuaugggcuggucaugga

SEQ ID NO: 640622 - RNA, 19 nt, Homo sapiens
ucaacugcaugacacugaa

SEQ ID NO: 640623 - RNA, 19 nt, Homo sapiens
gguccaccucccuuuauaa

SEQ ID NO: 640624 - RNA, 19 nt, Homo sapiens
cuugugggcuuccuuguca

SEQ ID NO: 640625 - RNA, 19 nt, Homo sapiens
gagccaaauugaguaugga

SEQ ID NO: 640626 - RNA, 19 nt, Homo sapiens
uggaguggaugcccauuca

SEQ ID NO: 640627 - RNA, 19 nt, Homo sapiens
cugcagggcuuuggaguca

SEQ ID NO: 640628 - RNA, 19 nt, Homo sapiens
gcaucucccucaacugcau

SEQ ID NO: 640629 - RNA, 19 nt, Homo sapiens
ccaccagaaccacaucauu

SEQ ID NO: 640630 - RNA, 19 nt, Homo sapiens
ggaggaggaagaggaaaug

SEQ ID NO: 640631 - RNA, 19 nt, Homo sapiens
caacaagagcaccagaagu

SEQ ID NO: 640632 - RNA, 19 nt, Homo sapiens
ggagaagcugcaagggaaa

SEQ ID NO: 640633 - RNA, 19 nt, Homo sapiens
gaugccaaccucagcaaga

SEQ ID NO: 640634 - RNA, 19 nt, Homo sapiens
ugagggcccugcagagagu

SEQ ID NO: 640635 - RNA, 19 nt, Homo sapiens
gccggaagguacucaucuu

SEQ ID NO: 640636 - RNA, 19 nt, Homo sapiens
aacugcaucuuccuguaua

SEQ ID NO: 640637 - RNA, 19 nt, Homo sapiens
ccacaucauuaaaagguuu

SEQ ID NO: 640638 - RNA, 19 nt, Homo sapiens
ccaccucccuuuauaaacc

SEQ ID NO: 640639 - RNA, 19 nt, Homo sapiens
guccaccucccuuuauaaa

SEQ ID NO: 640640 - RNA, 19 nt, Homo sapiens
aagagcaccagaaguauau

SEQ ID NO: 640641 - RNA, 19 nt, Homo sapiens
gcagacaggcaugggaaug

SEQ ID NO: 640642 - RNA, 19 nt, Homo sapiens
uaauccaggugaucuuugg

SEQ ID NO: 640643 - RNA, 19 nt, Homo sapiens
gcgggaagaaggagccaaa

SEQ ID NO: 640644 - RNA, 19 nt, Homo sapiens
gcuggcaucucccucaacu

SEQ ID NO: 640645 - RNA, 19 nt, Homo sapiens
aauggacucugaggacuga

SEQ ID NO: 640646 - RNA, 19 nt, Homo sapiens
ggacucugaggacugagaa

SEQ ID NO: 640647 - RNA, 19 nt, Homo sapiens
gaaaagggagggacagauc

SEQ ID NO: 640648 - RNA, 19 nt, Homo sapiens
gccacuagcuuugcauacu

SEQ ID NO: 640649 - RNA, 19 nt, Homo sapiens
gaagguacucaucuugaac

SEQ ID NO: 640650 - RNA, 19 nt, Homo sapiens
gggacugcccuuucucaau

SEQ ID NO: 640651 - RNA, 19 nt, Homo sapiens
cggaagguacucaucuuga

SEQ ID NO: 640652 - RNA, 19 nt, Homo sapiens
accagaaccacaucauuaa

SEQ ID NO: 640653 - RNA, 19 nt, Homo sapiens
gcaucugcauccugcucaa

SEQ ID NO: 640654 - RNA, 19 nt, Homo sapiens
gcaccgauggcuggaucua

SEQ ID NO: 640655 - RNA, 19 nt, Homo sapiens
ccucagcacaagagaagaa

SEQ ID NO: 640656 - RNA, 19 nt, Homo sapiens
cuccaugccucucuucauc

SEQ ID NO: 640657 - RNA, 19 nt, Homo sapiens
gcaggcaggcagacagaca

SEQ ID NO: 640658 - RNA, 19 nt, Homo sapiens
cacuagcuuugcauacuau

SEQ ID NO: 640659 - RNA, 19 nt, Homo sapiens
gcaugacugccgagcucua

SEQ ID NO: 640660 - RNA, 19 nt, Homo sapiens
gagucagcaucuaccuaau

SEQ ID NO: 640661 - RNA, 19 nt, Homo sapiens
acuccugguucuucauuga

SEQ ID NO: 640662 - RNA, 19 nt, Homo sapiens
accgauggcuggaucuaug

SEQ ID NO: 640663 - RNA, 19 nt, Homo sapiens
gggcuuccuugucaucaac

SEQ ID NO: 640664 - RNA, 19 nt, Homo sapiens
gcuuuggagucagcaucua

SEQ ID NO: 640665 - RNA, 19 nt, Homo sapiens
gagcugaccaugggcaaag

SEQ ID NO: 640666 - RNA, 19 nt, Homo sapiens
caucuacuccugguucuuc

SEQ ID NO: 640667 - RNA, 19 nt, Homo sapiens
gcacccaacuuccccaucu

SEQ ID NO: 640668 - RNA, 19 nt, Homo sapiens
cagcacaagagaagaaugg

SEQ ID NO: 640669 - RNA, 19 nt, Homo sapiens
gaguggaugcccauucaca

SEQ ID NO: 640670 - RNA, 19 nt, Homo sapiens
aaagaagcagggauauauc

SEQ ID NO: 640671 - RNA, 19 nt, Homo sapiens
ccuaauccaggugaucuuu

SEQ ID NO: 640672 - RNA, 19 nt, Homo sapiens
aggaaauggugacccaagu

SEQ ID NO: 640673 - RNA, 19 nt, Homo sapiens
ggacugcccuuucucaaug

SEQ ID NO: 640674 - RNA, 19 nt, Homo sapiens
ggaagaaggagccaaauug

SEQ ID NO: 640675 - RNA, 19 nt, Homo sapiens
ggaagguacucaucuugaa

SEQ ID NO: 640676 - RNA, 19 nt, Homo sapiens
gaagaaggagccaaauuga

SEQ ID NO: 640677 - RNA, 19 nt, Homo sapiens
caccagaaccacaucauua

SEQ ID NO: 640678 - RNA, 19 nt, Homo sapiens
ggagucagcaucuaccuaa

SEQ ID NO: 640679 - RNA, 19 nt, Homo sapiens
ggaacuguaucccacaaug

SEQ ID NO: 640680 - RNA, 19 nt, Homo sapiens
ccacuagcuuugcauacua

SEQ ID NO: 640681 - RNA, 19 nt, Homo sapiens
caagagcaccagaaguaua

SEQ ID NO: 640682 - RNA, 19 nt, Homo sapiens
gaaggagccaaauugagua

SEQ ID NO: 640683 - RNA, 19 nt, Homo sapiens
caaauugaguauggaggua

SEQ ID NO: 640684 - RNA, 19 nt, Homo sapiens
gaacuguaucccacaauga

SEQ ID NO: 640685 - RNA, 19 nt, Homo sapiens
ggaccugccugccaagcuu

SEQ ID NO: 640686 - RNA, 19 nt, Homo sapiens
caucuaccaucgugacuga

SEQ ID NO: 640687 - RNA, 19 nt, Homo sapiens
aacaagagcaccagaagua

SEQ ID NO: 640688 - RNA, 19 nt, Homo sapiens
ggagccaaauugaguaugg

SEQ ID NO: 640689 - RNA, 19 nt, Homo sapiens
ggguccaccucccuuuaua

SEQ ID NO: 640690 - RNA, 19 nt, Homo sapiens
caacagcaccuucccaucu

SEQ ID NO: 640691 - RNA, 19 nt, Homo sapiens
gaaauggugacccaagugu

SEQ ID NO: 640692 - RNA, 19 nt, Homo sapiens
gcaccuugauuggcuaugu

SEQ ID NO: 640693 - RNA, 19 nt, Homo sapiens
ucaacugcaucuuccugua

SEQ ID NO: 640694 - RNA, 19 nt, Homo sapiens
gggccagucugcagaagga

SEQ ID NO: 640695 - RNA, 19 nt, Homo sapiens
gggaagaaggagccaaauu

SEQ ID NO: 640696 - RNA, 19 nt, Homo sapiens
gaaacagacgcgacagcaa

SEQ ID NO: 640697 - RNA, 19 nt, Homo sapiens
acaacacccugcagaacuu

SEQ ID NO: 640698 - RNA, 19 nt, Homo sapiens
gcccaauggccuuuaauga

SEQ ID NO: 640699 - RNA, 19 nt, Homo sapiens
ccaugccucucuucaucua

SEQ ID NO: 640700 - RNA, 19 nt, Homo sapiens
caacugcaucuuccuguau

SEQ ID NO: 640701 - RNA, 19 nt, Homo sapiens
gcaacaagagcaccagaag

SEQ ID NO: 640702 - RNA, 19 nt, Homo sapiens
ccagaaccacaucauuaaa

SEQ ID NO: 640703 - RNA, 19 nt, Homo sapiens
ggaaauggugacccaagug

SEQ ID NO: 640704 - RNA, 19 nt, Homo sapiens
ccugauggcuucucacaac

SEQ ID NO: 640705 - RNA, 19 nt, Homo sapiens
agaaggagccaaauugagu

SEQ ID NO: 640706 - RNA, 19 nt, Homo sapiens
aacagcaccuucccaucua

SEQ ID NO: 640707 - RNA, 19 nt, Homo sapiens
caaggaggaggaagaggaa

SEQ ID NO: 640708 - RNA, 19 nt, Homo sapiens
acuaugggcuggucaugga

SEQ ID NO: 640709 - RNA, 19 nt, Homo sapiens
ucaacugcaugacacugaa

SEQ ID NO: 640710 - RNA, 19 nt, Homo sapiens
gguccaccucccuuuauaa

SEQ ID NO: 640711 - RNA, 19 nt, Homo sapiens
cuugugggcuuccuuguca

SEQ ID NO: 640712 - RNA, 19 nt, Homo sapiens
gagccaaauugaguaugga

SEQ ID NO: 640713 - RNA, 19 nt, Homo sapiens
uggaguggaugcccauuca

SEQ ID NO: 640714 - RNA, 19 nt, Homo sapiens
cugcagggcuuuggaguca

SEQ ID NO: 640715 - RNA, 19 nt, Homo sapiens
gcaucucccucaacugcau

SEQ ID NO: 640716 - RNA, 19 nt, Homo sapiens
ccaccagaaccacaucauu

SEQ ID NO: 640717 - RNA, 19 nt, Homo sapiens
ggaggaggaagaggaaaug

SEQ ID NO: 640718 - RNA, 19 nt, Homo sapiens
gaugccaaccucagcaaga

SEQ ID NO: 640719 - RNA, 19 nt, Homo sapiens
caacaagagcaccagaagu

SEQ ID NO: 640720 - RNA, 19 nt, Homo sapiens
ggagaagcugcaagggaaa

SEQ ID NO: 640721 - RNA, 19 nt, Homo sapiens
ugagggcccugcagagagu

SEQ ID NO: 640722 - RNA, 19 nt, Homo sapiens
gccggaagguacucaucuu

SEQ ID NO: 640723 - RNA, 19 nt, Homo sapiens
ggagagcaggaaagggaaa

SEQ ID NO: 640724 - RNA, 19 nt, Homo sapiens
aacugcaucuuccuguaua

SEQ ID NO: 640725 - RNA, 19 nt, Homo sapiens
ccacaucauuaaaagguuu

SEQ ID NO: 640726 - RNA, 19 nt, Homo sapiens
ccaccucccuuuauaaacc

SEQ ID NO: 640727 - RNA, 19 nt, Homo sapiens
guccaccucccuuuauaaa

SEQ ID NO: 640728 - RNA, 19 nt, Homo sapiens
aagagcaccagaaguauau

SEQ ID NO: 640729 - RNA, 19 nt, Homo sapiens
gcagacaggcaugggaaug

SEQ ID NO: 640730 - RNA, 19 nt, Homo sapiens
uaauccaggugaucuuugg

SEQ ID NO: 640731 - RNA, 19 nt, Homo sapiens
gcgggaagaaggagccaaa

SEQ ID NO: 640732 - RNA, 19 nt, Homo sapiens
gcuggcaucucccucaacu

SEQ ID NO: 640733 - RNA, 19 nt, Homo sapiens
aauggacucugaggacuga

SEQ ID NO: 640734 - RNA, 19 nt, Homo sapiens
ggacucugaggacugagaa

SEQ ID NO: 640735 - RNA, 19 nt, Homo sapiens
gaaaagggagggacagauc

SEQ ID NO: 640736 - RNA, 19 nt, Homo sapiens
gccacuagcuuugcauacu

SEQ ID NO: 640737 - RNA, 19 nt, Homo sapiens
gaagguacucaucuugaac

SEQ ID NO: 640738 - RNA, 19 nt, Homo sapiens
gggacugcccuuucucaau

SEQ ID NO: 640739 - RNA, 19 nt, Homo sapiens
cggaagguacucaucuuga

SEQ ID NO: 640740 - RNA, 19 nt, Homo sapiens
accagaaccacaucauuaa

SEQ ID NO: 640741 - RNA, 19 nt, Homo sapiens
gcaucugcauccugcucaa

SEQ ID NO: 640742 - RNA, 19 nt, Homo sapiens
gcaccgauggcuggaucua

SEQ ID NO: 640743 - RNA, 19 nt, Homo sapiens
ccucagcacaagagaagaa

SEQ ID NO: 640744 - RNA, 19 nt, Homo sapiens
cuccaugccucucuucauc

SEQ ID NO: 640745 - RNA, 19 nt, Homo sapiens
cacuagcuuugcauacuau

SEQ ID NO: 640746 - RNA, 19 nt, Homo sapiens
gcaggcaggcagacagaca

SEQ ID NO: 640747 - RNA, 19 nt, Homo sapiens
accgauggcuggaucuaug

SEQ ID NO: 640748 - RNA, 19 nt, Homo sapiens
gcaugacugccgagcucua

SEQ ID NO: 640749 - RNA, 19 nt, Homo sapiens
gagucagcaucuaccuaau

SEQ ID NO: 640750 - RNA, 19 nt, Homo sapiens
acuccugguucuucauuga

SEQ ID NO: 640751 - RNA, 19 nt, Homo sapiens
gggcuuccuugucaucaac

SEQ ID NO: 640752 - RNA, 19 nt, Homo sapiens
gcuuuggagucagcaucua

SEQ ID NO: 640753 - RNA, 19 nt, Homo sapiens
gagcugaccaugggcaaag

SEQ ID NO: 640754 - RNA, 19 nt, Homo sapiens
caucuacuccugguucuuc

SEQ ID NO: 640755 - RNA, 19 nt, Homo sapiens
gcacccaacuuccccaucu

SEQ ID NO: 640756 - RNA, 19 nt, Homo sapiens
cagcacaagagaagaaugg

SEQ ID NO: 640757 - RNA, 19 nt, Homo sapiens
gaguggaugcccauucaca

SEQ ID NO: 640758 - RNA, 19 nt, Homo sapiens
ccuaauccaggugaucuuu

SEQ ID NO: 640759 - RNA, 19 nt, Homo sapiens
aggaaauggugacccaagu

SEQ ID NO: 640760 - RNA, 19 nt, Homo sapiens
ggacugcccuuucucaaug

SEQ ID NO: 640761 - RNA, 19 nt, Homo sapiens
ggaagaaggagccaaauug

SEQ ID NO: 640762 - RNA, 19 nt, Homo sapiens
ggaagguacucaucuugaa

SEQ ID NO: 640763 - RNA, 19 nt, Homo sapiens
gaagaaggagccaaauuga

SEQ ID NO: 640764 - RNA, 19 nt, Homo sapiens
caccagaaccacaucauua

SEQ ID NO: 640765 - RNA, 19 nt, Homo sapiens
ggagucagcaucuaccuaa

SEQ ID NO: 640766 - RNA, 19 nt, Homo sapiens
ggaacuguaucccacaaug

SEQ ID NO: 640767 - RNA, 19 nt, Homo sapiens
ccacuagcuuugcauacua

SEQ ID NO: 640768 - RNA, 19 nt, Homo sapiens
caagagcaccagaaguaua

SEQ ID NO: 640769 - RNA, 19 nt, Homo sapiens
gaaggagccaaauugagua

SEQ ID NO: 640770 - RNA, 19 nt, Homo sapiens
caaauugaguauggaggua

SEQ ID NO: 640771 - RNA, 19 nt, Homo sapiens
gaacuguaucccacaauga

SEQ ID NO: 640772 - RNA, 19 nt, Homo sapiens
ggaccugccugccaagcuu

SEQ ID NO: 640773 - RNA, 19 nt, Homo sapiens
caucuaccaucgugacuga

SEQ ID NO: 640774 - RNA, 19 nt, Homo sapiens
aacaagagcaccagaagua

SEQ ID NO: 640775 - RNA, 19 nt, Homo sapiens
ggagccaaauugaguaugg

SEQ ID NO: 640776 - RNA, 19 nt, Homo sapiens
ggguccaccucccuuuaua

SEQ ID NO: 640777 - RNA, 19 nt, Homo sapiens
caacagcaccuucccaucu

SEQ ID NO: 640778 - RNA, 19 nt, Homo sapiens
gaaauggugacccaagugu

SEQ ID NO: 640779 - RNA, 19 nt, Homo sapiens
gcaccuugauuggcuaugu

SEQ ID NO: 640780 - RNA, 19 nt, Homo sapiens
ucaacugcaucuuccugua

SEQ ID NO: 640781 - RNA, 19 nt, Homo sapiens
gggccagucugcagaagga

SEQ ID NO: 640782 - RNA, 19 nt, Homo sapiens
gggaagaaggagccaaauu

SEQ ID NO: 640783 - RNA, 19 nt, Homo sapiens
gaaacagacgcgacagcaa

SEQ ID NO: 640784 - RNA, 19 nt, Homo sapiens
acaacacccugcagaacuu

SEQ ID NO: 640785 - RNA, 19 nt, Homo sapiens
gcccaauggccuuuaauga

SEQ ID NO: 640786 - RNA, 19 nt, Homo sapiens
caacugcaucuuccuguau

SEQ ID NO: 640787 - RNA, 19 nt, Homo sapiens
gcaacaagagcaccagaag

SEQ ID NO: 640788 - RNA, 19 nt, Homo sapiens
ccagaaccacaucauuaaa

SEQ ID NO: 640789 - RNA, 19 nt, Homo sapiens
ggaaauggugacccaagug

SEQ ID NO: 640790 - RNA, 19 nt, Homo sapiens
ccugauggcuucucacaac

SEQ ID NO: 640791 - RNA, 19 nt, Homo sapiens
agaaggagccaaauugagu

SEQ ID NO: 640792 - RNA, 19 nt, Homo sapiens
aacagcaccuucccaucua

SEQ ID NO: 640793 - RNA, 19 nt, Homo sapiens
caaggaggaggaagaggaa

SEQ ID NO: 640794 - RNA, 19 nt, Homo sapiens
acuaugggcuggucaugga

SEQ ID NO: 640795 - RNA, 19 nt, Homo sapiens
ucaacugcaugacacugaa

SEQ ID NO: 640796 - RNA, 19 nt, Homo sapiens
gguccaccucccuuuauaa

SEQ ID NO: 640797 - RNA, 19 nt, Homo sapiens
cuugugggcuuccuuguca

SEQ ID NO: 640798 - RNA, 19 nt, Homo sapiens
gagccaaauugaguaugga

SEQ ID NO: 640799 - RNA, 19 nt, Homo sapiens
uggaguggaugcccauuca

SEQ ID NO: 640800 - RNA, 19 nt, Homo sapiens
cugcagggcuuuggaguca

SEQ ID NO: 640801 - RNA, 19 nt, Homo sapiens
gcaucucccucaacugcau

SEQ ID NO: 640802 - RNA, 19 nt, Homo sapiens
ccaccagaaccacaucauu

SEQ ID NO: 640803 - RNA, 19 nt, Homo sapiens
ggaggaggaagaggaaaug

SEQ ID NO: 640804 - RNA, 19 nt, Homo sapiens
caacaagagcaccagaagu

SEQ ID NO: 640805 - RNA, 19 nt, Homo sapiens
gaugccaaccucagcaaga

SEQ ID NO: 640806 - RNA, 19 nt, Homo sapiens
ggagaagcugcaagggaaa

SEQ ID NO: 640807 - RNA, 19 nt, Homo sapiens
ugagggcccugcagagagu

SEQ ID NO: 640808 - RNA, 19 nt, Homo sapiens
gccggaagguacucaucuu

SEQ ID NO: 640809 - RNA, 19 nt, Homo sapiens
ggagagcaggaaagggaaa

SEQ ID NO: 640810 - RNA, 19 nt, Homo sapiens
aacugcaucuuccuguaua

SEQ ID NO: 640811 - RNA, 19 nt, Homo sapiens
ccacaucauuaaaagguuu

SEQ ID NO: 640812 - RNA, 19 nt, Homo sapiens
ccaccucccuuuauaaacc

SEQ ID NO: 640813 - RNA, 19 nt, Homo sapiens
guccaccucccuuuauaaa

SEQ ID NO: 640814 - RNA, 19 nt, Homo sapiens
aagagcaccagaaguauau

SEQ ID NO: 640815 - RNA, 19 nt, Homo sapiens
uaauccaggugaucuuugg

SEQ ID NO: 640816 - RNA, 19 nt, Homo sapiens
gcgggaagaaggagccaaa

SEQ ID NO: 640817 - RNA, 19 nt, Homo sapiens
gcuggcaucucccucaacu

SEQ ID NO: 640818 - RNA, 19 nt, Homo sapiens
aauggacucugaggacuga

SEQ ID NO: 640819 - RNA, 19 nt, Homo sapiens
ggacucugaggacugagaa

SEQ ID NO: 640820 - RNA, 19 nt, Homo sapiens
gaaaagggagggacagauc

SEQ ID NO: 640821 - RNA, 19 nt, Homo sapiens
gccacuagcuuugcauacu

SEQ ID NO: 640822 - RNA, 19 nt, Homo sapiens
gaagguacucaucuugaac

SEQ ID NO: 640823 - RNA, 19 nt, Homo sapiens
gggacugcccuuucucaau

SEQ ID NO: 640824 - RNA, 19 nt, Homo sapiens
cggaagguacucaucuuga

SEQ ID NO: 640825 - RNA, 19 nt, Homo sapiens
accagaaccacaucauuaa

SEQ ID NO: 640826 - RNA, 19 nt, Homo sapiens
gcaccgauggcuggaucua

SEQ ID NO: 640827 - RNA, 19 nt, Homo sapiens
acaaugauccgcgcuguca

SEQ ID NO: 640828 - RNA, 19 nt, Homo sapiens
gcaucugcauccugcucaa

SEQ ID NO: 640829 - RNA, 19 nt, Homo sapiens
ccucagcacaagagaagaa

SEQ ID NO: 640830 - RNA, 19 nt, Homo sapiens
cacuagcuuugcauacuau

SEQ ID NO: 640831 - RNA, 19 nt, Homo sapiens
gcaggcaggcagacagaca

SEQ ID NO: 640832 - RNA, 19 nt, Homo sapiens
gagucagcaucuaccuaau

SEQ ID NO: 640833 - RNA, 19 nt, Homo sapiens
accgauggcuggaucuaug

SEQ ID NO: 640834 - RNA, 19 nt, Homo sapiens
acuccugguucuucauuga

SEQ ID NO: 640835 - RNA, 19 nt, Homo sapiens
gggcuuccuugucaucaac

SEQ ID NO: 640836 - RNA, 19 nt, Homo sapiens
gcuuuggagucagcaucua

SEQ ID NO: 640837 - RNA, 19 nt, Homo sapiens
gagcugaccaugggcaaag

SEQ ID NO: 640838 - RNA, 19 nt, Homo sapiens
caucuacuccugguucuuc

SEQ ID NO: 640839 - RNA, 19 nt, Homo sapiens
gcacccaacuuccccaucu

SEQ ID NO: 640840 - RNA, 19 nt, Homo sapiens
cagcacaagagaagaaugg

SEQ ID NO: 640841 - RNA, 19 nt, Homo sapiens
gaguggaugcccauucaca

SEQ ID NO: 640842 - RNA, 19 nt, Homo sapiens
ccuaauccaggugaucuuu

SEQ ID NO: 640843 - RNA, 19 nt, Homo sapiens
aggaaauggugacccaagu

SEQ ID NO: 640844 - RNA, 19 nt, Homo sapiens
gaaagaagcagggauauau

SEQ ID NO: 640845 - RNA, 19 nt, Homo sapiens
ggacugcccuuucucaaug

SEQ ID NO: 640846 - RNA, 19 nt, Homo sapiens
ggaagaaggagccaaauug

SEQ ID NO: 640847 - RNA, 19 nt, Homo sapiens
ggaagguacucaucuugaa

SEQ ID NO: 640848 - RNA, 19 nt, Homo sapiens
gaagaaggagccaaauuga

SEQ ID NO: 640849 - RNA, 19 nt, Homo sapiens
caccagaaccacaucauua

SEQ ID NO: 640850 - RNA, 19 nt, Homo sapiens
ggagucagcaucuaccuaa

SEQ ID NO: 640851 - RNA, 19 nt, Homo sapiens
ggaacuguaucccacaaug

SEQ ID NO: 640852 - RNA, 19 nt, Homo sapiens
ccacuagcuuugcauacua

SEQ ID NO: 640853 - RNA, 19 nt, Homo sapiens
caagagcaccagaaguaua

SEQ ID NO: 640854 - RNA, 19 nt, Homo sapiens
gaaggagccaaauugagua

SEQ ID NO: 640855 - RNA, 19 nt, Homo sapiens
caaauugaguauggaggua

SEQ ID NO: 640856 - RNA, 19 nt, Homo sapiens
gaacuguaucccacaauga

SEQ ID NO: 640857 - RNA, 19 nt, Homo sapiens
ggaccugccugccaagcuu

SEQ ID NO: 640858 - RNA, 19 nt, Homo sapiens
ucagaaagaagcagggaua

SEQ ID NO: 640859 - RNA, 19 nt, Homo sapiens
caucuaccaucgugacuga

SEQ ID NO: 640860 - RNA, 19 nt, Homo sapiens
aacaagagcaccagaagua

SEQ ID NO: 640861 - RNA, 19 nt, Homo sapiens
ggagccaaauugaguaugg

SEQ ID NO: 640862 - RNA, 19 nt, Homo sapiens
ggguccaccucccuuuaua

SEQ ID NO: 640863 - RNA, 19 nt, Homo sapiens
caacagcaccuucccaucu

SEQ ID NO: 640864 - RNA, 19 nt, Homo sapiens
gaaauggugacccaagugu

SEQ ID NO: 640865 - RNA, 19 nt, Homo sapiens
gcaccuugauuggcuaugu

SEQ ID NO: 640866 - RNA, 19 nt, Homo sapiens
ucaacugcaucuuccugua

SEQ ID NO: 640867 - RNA, 19 nt, Homo sapiens
gggccagucugcagaagga

SEQ ID NO: 640868 - RNA, 19 nt, Homo sapiens
gggaagaaggagccaaauu

SEQ ID NO: 640869 - RNA, 19 nt, Homo sapiens
gaaacagacgcgacagcaa

SEQ ID NO: 640870 - RNA, 19 nt, Homo sapiens
gcccaauggccuuuaauga

SEQ ID NO: 640871 - RNA, 19 nt, Homo sapiens
acaacacccugcagaacuu

SEQ ID NO: 640872 - RNA, 19 nt, Homo sapiens
caacugcaucuuccuguau

SEQ ID NO: 640873 - RNA, 19 nt, Homo sapiens
gcaacaagagcaccagaag

SEQ ID NO: 640874 - RNA, 19 nt, Homo sapiens
agaaagaagcagggauaua

SEQ ID NO: 640875 - RNA, 19 nt, Homo sapiens
ccagaaccacaucauuaaa

SEQ ID NO: 640876 - RNA, 19 nt, Homo sapiens
ggaaauggugacccaagug

SEQ ID NO: 640877 - RNA, 19 nt, Homo sapiens
ccugauggcuucucacaac

SEQ ID NO: 640878 - RNA, 19 nt, Homo sapiens
agaaggagccaaauugagu

SEQ ID NO: 640879 - RNA, 19 nt, Homo sapiens
aacagcaccuucccaucua

SEQ ID NO: 640880 - RNA, 19 nt, Homo sapiens
caaggaggaggaagaggaa

SEQ ID NO: 640881 - RNA, 19 nt, Homo sapiens
acuaugggcuggucaugga

SEQ ID NO: 640882 - RNA, 19 nt, Homo sapiens
ucaacugcaugacacugaa

SEQ ID NO: 640883 - RNA, 19 nt, Homo sapiens
gguccaccucccuuuauaa

SEQ ID NO: 640884 - RNA, 19 nt, Homo sapiens
cuugugggcuuccuuguca

SEQ ID NO: 640885 - RNA, 19 nt, Homo sapiens
gagccaaauugaguaugga

SEQ ID NO: 640886 - RNA, 19 nt, Homo sapiens
uggaguggaugcccauuca

SEQ ID NO: 640887 - RNA, 19 nt, Homo sapiens
cugcagggcuuuggaguca

SEQ ID NO: 640888 - RNA, 19 nt, Homo sapiens
gcaucucccucaacugcau

SEQ ID NO: 640889 - RNA, 19 nt, Homo sapiens
ccaccagaaccacaucauu

SEQ ID NO: 640890 - RNA, 19 nt, Homo sapiens
ggaggaggaagaggaaaug

SEQ ID NO: 640891 - RNA, 19 nt, Homo sapiens
caacaagagcaccagaagu

SEQ ID NO: 640892 - RNA, 19 nt, Homo sapiens
ggagaagcugcaagggaaa

SEQ ID NO: 640893 - RNA, 19 nt, Homo sapiens
ugagggcccugcagagagu

SEQ ID NO: 640894 - RNA, 19 nt, Homo sapiens
gaugccaaccucagcaaga

SEQ ID NO: 640895 - RNA, 19 nt, Homo sapiens
gccggaagguacucaucuu

SEQ ID NO: 640896 - RNA, 19 nt, Homo sapiens
aacugcaucuuccuguaua

SEQ ID NO: 640897 - RNA, 19 nt, Homo sapiens
ccacaucauuaaaagguuu

SEQ ID NO: 640898 - RNA, 19 nt, Homo sapiens
ccaccucccuuuauaaacc

SEQ ID NO: 640899 - RNA, 19 nt, Homo sapiens
guccaccucccuuuauaaa

SEQ ID NO: 640900 - RNA, 19 nt, Homo sapiens
aagagcaccagaaguauau

SEQ ID NO: 640901 - RNA, 19 nt, Homo sapiens
uaauccaggugaucuuugg

SEQ ID NO: 640902 - RNA, 19 nt, Homo sapiens
gcgggaagaaggagccaaa

SEQ ID NO: 640903 - RNA, 19 nt, Homo sapiens
gcuggcaucucccucaacu

SEQ ID NO: 640904 - RNA, 19 nt, Homo sapiens
aauggacucugaggacuga

SEQ ID NO: 640905 - RNA, 19 nt, Homo sapiens
ggacucugaggacugagaa

SEQ ID NO: 640906 - RNA, 19 nt, Homo sapiens
gaaaagggagggacagauc

SEQ ID NO: 640907 - RNA, 19 nt, Homo sapiens
gccacuagcuuugcauacu

SEQ ID NO: 640908 - RNA, 19 nt, Homo sapiens
gaagguacucaucuugaac

SEQ ID NO: 640909 - RNA, 19 nt, Homo sapiens
gggacugcccuuucucaau

SEQ ID NO: 640910 - RNA, 19 nt, Homo sapiens
cggaagguacucaucuuga

SEQ ID NO: 640911 - RNA, 19 nt, Homo sapiens
accagaaccacaucauuaa

SEQ ID NO: 640912 - RNA, 19 nt, Homo sapiens
acaaugauccgcgcuguca

SEQ ID NO: 640913 - RNA, 19 nt, Homo sapiens
gcaucugcauccugcucaa

SEQ ID NO: 640914 - RNA, 19 nt, Homo sapiens
gcaccgauggcuggaucua

SEQ ID NO: 640915 - RNA, 19 nt, Homo sapiens
ccucagcacaagagaagaa

SEQ ID NO: 640916 - RNA, 19 nt, Homo sapiens
gcaggcaggcagacagaca

SEQ ID NO: 640917 - RNA, 19 nt, Homo sapiens
cacuagcuuugcauacuau

SEQ ID NO: 640918 - RNA, 19 nt, Homo sapiens
accgauggcuggaucuaug

SEQ ID NO: 640919 - RNA, 19 nt, Homo sapiens
gagucagcaucuaccuaau

SEQ ID NO: 640920 - RNA, 19 nt, Homo sapiens
acuccugguucuucauuga

SEQ ID NO: 640921 - RNA, 19 nt, Homo sapiens
gggcuuccuugucaucaac

SEQ ID NO: 640922 - RNA, 19 nt, Homo sapiens
gcuuuggagucagcaucua

SEQ ID NO: 640923 - RNA, 19 nt, Homo sapiens
gagcugaccaugggcaaag

SEQ ID NO: 640924 - RNA, 19 nt, Homo sapiens
caucuacuccugguucuuc

SEQ ID NO: 640925 - RNA, 19 nt, Homo sapiens
gcacccaacuuccccaucu

SEQ ID NO: 640926 - RNA, 19 nt, Homo sapiens
cagcacaagagaagaaugg

SEQ ID NO: 640927 - RNA, 19 nt, Homo sapiens
gaguggaugcccauucaca

SEQ ID NO: 640928 - RNA, 19 nt, Homo sapiens
aaagaagcagggauauauc

SEQ ID NO: 640929 - RNA, 19 nt, Homo sapiens
ccuaauccaggugaucuuu

SEQ ID NO: 640930 - RNA, 19 nt, Homo sapiens
aggaaauggugacccaagu

SEQ ID NO: 640931 - RNA, 19 nt, Homo sapiens
ggacugcccuuucucaaug

SEQ ID NO: 640932 - RNA, 19 nt, Homo sapiens
ggaagaaggagccaaauug

SEQ ID NO: 640933 - RNA, 19 nt, Homo sapiens
ggaagguacucaucuugaa

SEQ ID NO: 640934 - RNA, 19 nt, Homo sapiens
gaagaaggagccaaauuga

SEQ ID NO: 640935 - RNA, 19 nt, Homo sapiens
caccagaaccacaucauua

SEQ ID NO: 640936 - RNA, 19 nt, Homo sapiens
ggagucagcaucuaccuaa

SEQ ID NO: 640937 - RNA, 19 nt, Homo sapiens
ggaacuguaucccacaaug

SEQ ID NO: 640938 - RNA, 19 nt, Homo sapiens
ccacuagcuuugcauacua

SEQ ID NO: 640939 - RNA, 19 nt, Homo sapiens
caagagcaccagaaguaua

SEQ ID NO: 640940 - RNA, 19 nt, Homo sapiens
gaaggagccaaauugagua

SEQ ID NO: 640941 - RNA, 19 nt, Homo sapiens
caaauugaguauggaggua

SEQ ID NO: 640942 - RNA, 19 nt, Homo sapiens
gaacuguaucccacaauga

SEQ ID NO: 640943 - RNA, 19 nt, Homo sapiens
ggaccugccugccaagcuu

SEQ ID NO: 640944 - RNA, 19 nt, Homo sapiens
caucuaccaucgugacuga

SEQ ID NO: 640945 - RNA, 19 nt, Homo sapiens
aacaagagcaccagaagua

SEQ ID NO: 640946 - RNA, 19 nt, Homo sapiens
ggagccaaauugaguaugg

SEQ ID NO: 640947 - RNA, 19 nt, Homo sapiens
ggguccaccucccuuuaua

SEQ ID NO: 640948 - RNA, 19 nt, Homo sapiens
caacagcaccuucccaucu

SEQ ID NO: 640949 - RNA, 19 nt, Homo sapiens
gaaauggugacccaagugu

SEQ ID NO: 640950 - RNA, 19 nt, Homo sapiens
gcaccuugauuggcuaugu

SEQ ID NO: 640951 - RNA, 19 nt, Homo sapiens
ucaacugcaucuuccugua

SEQ ID NO: 640952 - RNA, 19 nt, Homo sapiens
gggccagucugcagaagga

SEQ ID NO: 640953 - RNA, 19 nt, Homo sapiens
gggaagaaggagccaaauu

SEQ ID NO: 640954 - RNA, 19 nt, Homo sapiens
gaaacagacgcgacagcaa

SEQ ID NO: 640955 - RNA, 19 nt, Homo sapiens
acaacacccugcagaacuu

SEQ ID NO: 640956 - RNA, 19 nt, Homo sapiens
gcccaauggccuuuaauga

SEQ ID NO: 640957 - RNA, 19 nt, Homo sapiens
ccaugccucucuucaucua

SEQ ID NO: 640958 - RNA, 19 nt, Homo sapiens
caacugcaucuuccuguau

SEQ ID NO: 640959 - RNA, 19 nt, Homo sapiens
gcaacaagagcaccagaag

SEQ ID NO: 640960 - RNA, 19 nt, Homo sapiens
ccagaaccacaucauuaaa

SEQ ID NO: 640961 - RNA, 19 nt, Homo sapiens
ggaaauggugacccaagug

SEQ ID NO: 640962 - RNA, 19 nt, Homo sapiens
ccugauggcuucucacaac

SEQ ID NO: 640963 - RNA, 19 nt, Homo sapiens
agaaggagccaaauugagu

SEQ ID NO: 640964 - RNA, 19 nt, Homo sapiens
aacagcaccuucccaucua

SEQ ID NO: 640965 - RNA, 19 nt, Homo sapiens
caaggaggaggaagaggaa

SEQ ID NO: 640966 - RNA, 19 nt, Homo sapiens
acuaugggcuggucaugga

SEQ ID NO: 640967 - RNA, 19 nt, Homo sapiens
ucaacugcaugacacugaa

SEQ ID NO: 640968 - RNA, 19 nt, Homo sapiens
gguccaccucccuuuauaa

SEQ ID NO: 640969 - RNA, 19 nt, Homo sapiens
cuugugggcuuccuuguca

SEQ ID NO: 640970 - RNA, 19 nt, Homo sapiens
gagccaaauugaguaugga

SEQ ID NO: 640971 - RNA, 19 nt, Homo sapiens
uggaguggaugcccauuca

SEQ ID NO: 640972 - RNA, 19 nt, Homo sapiens
cugcagggcuuuggaguca

SEQ ID NO: 640973 - RNA, 19 nt, Homo sapiens
gcaucucccucaacugcau

SEQ ID NO: 640974 - RNA, 19 nt, Homo sapiens
ccaccagaaccacaucauu

SEQ ID NO: 640975 - RNA, 19 nt, Homo sapiens
ggaggaggaagaggaaaug

SEQ ID NO: 640976 - RNA, 19 nt, Homo sapiens
caacaagagcaccagaagu

SEQ ID NO: 640977 - RNA, 19 nt, Homo sapiens
gaugccaaccucagcaaga

SEQ ID NO: 640978 - RNA, 19 nt, Homo sapiens
ggagaagcugcaagggaaa

SEQ ID NO: 640979 - RNA, 19 nt, Homo sapiens
ugagggcccugcagagagu

SEQ ID NO: 640980 - RNA, 19 nt, Homo sapiens
gccggaagguacucaucuu

SEQ ID NO: 640981 - RNA, 19 nt, Homo sapiens
ggagagcaggaaagggaaa

SEQ ID NO: 640982 - RNA, 19 nt, Homo sapiens
aacugcaucuuccuguaua

SEQ ID NO: 640983 - RNA, 19 nt, Homo sapiens
ccacaucauuaaaagguuu

SEQ ID NO: 640984 - RNA, 19 nt, Homo sapiens
ccaccucccuuuauaaacc

SEQ ID NO: 640985 - RNA, 19 nt, Homo sapiens
guccaccucccuuuauaaa

SEQ ID NO: 640986 - RNA, 19 nt, Homo sapiens
aagagcaccagaaguauau

SEQ ID NO: 640987 - RNA, 19 nt, Homo sapiens
gcagacaggcaugggaaug

SEQ ID NO: 640988 - RNA, 19 nt, Homo sapiens
uaauccaggugaucuuugg

SEQ ID NO: 640989 - RNA, 19 nt, Homo sapiens
gcgggaagaaggagccaaa

SEQ ID NO: 640990 - RNA, 19 nt, Homo sapiens
gcuggcaucucccucaacu

SEQ ID NO: 640991 - RNA, 19 nt, Homo sapiens
aauggacucugaggacuga

SEQ ID NO: 640992 - RNA, 19 nt, Homo sapiens
ggacucugaggacugagaa

SEQ ID NO: 640993 - RNA, 19 nt, Homo sapiens
gaaaagggagggacagauc

SEQ ID NO: 640994 - RNA, 19 nt, Homo sapiens
gccacuagcuuugcauacu

SEQ ID NO: 640995 - RNA, 19 nt, Homo sapiens
gaagguacucaucuugaac

SEQ ID NO: 640996 - RNA, 19 nt, Homo sapiens
gggacugcccuuucucaau

SEQ ID NO: 640997 - RNA, 19 nt, Homo sapiens
cggaagguacucaucuuga

SEQ ID NO: 640998 - RNA, 19 nt, Homo sapiens
accagaaccacaucauuaa

SEQ ID NO: 640999 - RNA, 19 nt, Homo sapiens
gcaccgauggcuggaucua

SEQ ID NO: 641000 - RNA, 19 nt, Homo sapiens
gcaucugcauccugcucaa

SEQ ID NO: 641001 - RNA, 19 nt, Homo sapiens
ccucagcacaagagaagaa

SEQ ID NO: 641002 - RNA, 19 nt, Homo sapiens
cuccaugccucucuucauc

SEQ ID NO: 641003 - RNA, 19 nt, Homo sapiens
cacuagcuuugcauacuau

SEQ ID NO: 641004 - RNA, 19 nt, Homo sapiens
gcaggcaggcagacagaca

SEQ ID NO: 641005 - RNA, 19 nt, Homo sapiens
gcaugacugccgagcucua

SEQ ID NO: 641006 - RNA, 19 nt, Homo sapiens
accgauggcuggaucuaug

SEQ ID NO: 641007 - RNA, 19 nt, Homo sapiens
gagucagcaucuaccuaau

SEQ ID NO: 641008 - RNA, 19 nt, Homo sapiens
acuccugguucuucauuga

SEQ ID NO: 641009 - RNA, 19 nt, Homo sapiens
gggcuuccuugucaucaac

SEQ ID NO: 641010 - RNA, 19 nt, Homo sapiens
gcuuuggagucagcaucua

SEQ ID NO: 641011 - RNA, 19 nt, Homo sapiens
gagcugaccaugggcaaag

SEQ ID NO: 641012 - RNA, 19 nt, Homo sapiens
caucuacuccugguucuuc

SEQ ID NO: 641013 - RNA, 19 nt, Homo sapiens
gcacccaacuuccccaucu

SEQ ID NO: 641014 - RNA, 19 nt, Homo sapiens
cagcacaagagaagaaugg

SEQ ID NO: 641015 - RNA, 19 nt, Homo sapiens
gaguggaugcccauucaca

SEQ ID NO: 641016 - RNA, 19 nt, Homo sapiens
ccuaauccaggugaucuuu

SEQ ID NO: 641017 - RNA, 19 nt, Homo sapiens
aggaaauggugacccaagu

SEQ ID NO: 641018 - RNA, 19 nt, Homo sapiens
uaacauaagugguuccuaa

SEQ ID NO: 641019 - RNA, 19 nt, Homo sapiens
gaaauccgaguaccuauua

SEQ ID NO: 641020 - RNA, 19 nt, Homo sapiens
gaacaaagcaagaaucugu

SEQ ID NO: 641021 - RNA, 19 nt, Homo sapiens
agagaggucuggauucuua

SEQ ID NO: 641022 - RNA, 19 nt, Homo sapiens
ggaaagcucugccaacauc

SEQ ID NO: 641023 - RNA, 19 nt, Homo sapiens
gcacacaggagguagaaua

SEQ ID NO: 641024 - RNA, 19 nt, Homo sapiens
gcaagaaucugugugaauc

SEQ ID NO: 641025 - RNA, 19 nt, Homo sapiens
caagaaagaccauauuaga

SEQ ID NO: 641026 - RNA, 19 nt, Homo sapiens
gaaagaccauauuagaauc

SEQ ID NO: 641027 - RNA, 19 nt, Homo sapiens
caacaucuacagacaauuu

SEQ ID NO: 641028 - RNA, 19 nt, Homo sapiens
gaauggaaaugcaugugaa

SEQ ID NO: 641029 - RNA, 19 nt, Homo sapiens
gagagaggaugguuuggaa

SEQ ID NO: 641030 - RNA, 19 nt, Homo sapiens
gagaaugcauagacgauga

SEQ ID NO: 641031 - RNA, 19 nt, Homo sapiens
ccacuaaguuauuugugua

SEQ ID NO: 641032 - RNA, 19 nt, Homo sapiens
gaaggguucuugucauugu

SEQ ID NO: 641033 - RNA, 19 nt, Homo sapiens
gggaaggguucuugucauu

SEQ ID NO: 641034 - RNA, 19 nt, Homo sapiens
ggaaaugcaugugaaaucu

SEQ ID NO: 641035 - RNA, 19 nt, Homo sapiens
ugacagagacugcgacaaa

SEQ ID NO: 641036 - RNA, 19 nt, Homo sapiens
gaagaaaaguaaccaaaug

SEQ ID NO: 641037 - RNA, 19 nt, Homo sapiens
gaaggaaaccauguauauu

SEQ ID NO: 641038 - RNA, 19 nt, Homo sapiens
cgaugaaacagaagaaaua

SEQ ID NO: 641039 - RNA, 19 nt, Homo sapiens
cgaaggaaaccauguauau

SEQ ID NO: 641040 - RNA, 19 nt, Homo sapiens
gcauggagauaaaugugaa

SEQ ID NO: 641041 - RNA, 19 nt, Homo sapiens
cauagacgaugaaacagaa

SEQ ID NO: 641042 - RNA, 19 nt, Homo sapiens
cagagggacuuguguaugu

SEQ ID NO: 641043 - RNA, 19 nt, Homo sapiens
ccauguauauucaccacua

SEQ ID NO: 641044 - RNA, 19 nt, Homo sapiens
cggaagaugugacugcaaa

SEQ ID NO: 641045 - RNA, 19 nt, Homo sapiens
ccaacuaacugugacuuga

SEQ ID NO: 641046 - RNA, 19 nt, Homo sapiens
cacaagaaagaccauauua

SEQ ID NO: 641047 - RNA, 19 nt, Homo sapiens
ugaguuauauggcuauuag

SEQ ID NO: 641048 - RNA, 19 nt, Homo sapiens
ggucauggacaguguaauu

SEQ ID NO: 641049 - RNA, 19 nt, Homo sapiens
aaccaaaugugcaagaauu

SEQ ID NO: 641050 - RNA, 19 nt, Homo sapiens
ugaaucagcagauggcaua

SEQ ID NO: 641051 - RNA, 19 nt, Homo sapiens
uaacaugacggaagaacaa

SEQ ID NO: 641052 - RNA, 19 nt, Homo sapiens
ggacuuguguaugguaaau

SEQ ID NO: 641053 - RNA, 19 nt, Homo sapiens
ggaauggaaaugcauguga

SEQ ID NO: 641054 - RNA, 19 nt, Homo sapiens
caacauccgcggaagugua

SEQ ID NO: 641055 - RNA, 19 nt, Homo sapiens
uaacagagggacuugugua

SEQ ID NO: 641056 - RNA, 19 nt, Homo sapiens
cacaggagguagaauauca

SEQ ID NO: 641057 - RNA, 19 nt, Homo sapiens
ccgcggaaguguaacauga

SEQ ID NO: 641058 - RNA, 19 nt, Homo sapiens
ggacaccugugaaugugau

SEQ ID NO: 641059 - RNA, 19 nt, Homo sapiens
ggcaacaucuacagacaau

SEQ ID NO: 641060 - RNA, 19 nt, Homo sapiens
ccgaguaccuauuagaaau

SEQ ID NO: 641061 - RNA, 19 nt, Homo sapiens
gaguaccuauuagaaauga

SEQ ID NO: 641062 - RNA, 19 nt, Homo sapiens
gaagaacaaagcaagaauc

SEQ ID NO: 641063 - RNA, 19 nt, Homo sapiens
gaggagagcaucaggaagu

SEQ ID NO: 641064 - RNA, 19 nt, Homo sapiens
uguguacucucacuuuaaa

SEQ ID NO: 641065 - RNA, 19 nt, Homo sapiens
gcuauuagaaauccacauu

SEQ ID NO: 641066 - RNA, 19 nt, Homo sapiens
guaaccaaaugugcaagaa

SEQ ID NO: 641067 - RNA, 19 nt, Homo sapiens
cauaagugguuccuaacga

SEQ ID NO: 641068 - RNA, 19 nt, Homo sapiens
ggagguagaauaucagagu

SEQ ID NO: 641069 - RNA, 19 nt, Homo sapiens
ggagauaaaugugaauucc

SEQ ID NO: 641070 - RNA, 19 nt, Homo sapiens
gcauagacgaugaaacaga

SEQ ID NO: 641071 - RNA, 19 nt, Homo sapiens
caagacaucaucugcucua

SEQ ID NO: 641072 - RNA, 19 nt, Homo sapiens
gccacuaaguuauuugugu

SEQ ID NO: 641073 - RNA, 19 nt, Homo sapiens
gcgaaggaaaccauguaua

SEQ ID NO: 641074 - RNA, 19 nt, Homo sapiens
ggaguucugugacugugau

SEQ ID NO: 641075 - RNA, 19 nt, Homo sapiens
gaugaucgccgcugugaag

SEQ ID NO: 641076 - RNA, 19 nt, Homo sapiens
gaagguaugcugcagacau

SEQ ID NO: 641077 - RNA, 19 nt, Homo sapiens
ggaagaacaaagcaagaau

SEQ ID NO: 641078 - RNA, 19 nt, Homo sapiens
gaaagcaagcgaagaugca

SEQ ID NO: 641079 - RNA, 19 nt, Homo sapiens
gaauuccagugcgauauca

SEQ ID NO: 641080 - RNA, 19 nt, Homo sapiens
ggcaaaaucugcaguaaca

SEQ ID NO: 641081 - RNA, 19 nt, Homo sapiens
aagguaugcugcagacauu

SEQ ID NO: 641082 - RNA, 19 nt, Homo sapiens
gguaugggaagaaguguga

SEQ ID NO: 641083 - RNA, 19 nt, Homo sapiens
guaagugugauaauucaga

SEQ ID NO: 641084 - RNA, 19 nt, Homo sapiens
aaggaaaccauguauauuc

SEQ ID NO: 641085 - RNA, 19 nt, Homo sapiens
ugagagaggucuggauucu

SEQ ID NO: 641086 - RNA, 19 nt, Homo sapiens
ugggauggauggaauggaa

SEQ ID NO: 641087 - RNA, 19 nt, Homo sapiens
guugucagcuguuccucaa

SEQ ID NO: 641088 - RNA, 19 nt, Homo sapiens
aggaaaccauguauauuca

SEQ ID NO: 641089 - RNA, 19 nt, Homo sapiens
ccgauauucugaugacuuc

SEQ ID NO: 641090 - RNA, 19 nt, Homo sapiens
gggaaguguuacuguggaa

SEQ ID NO: 641091 - RNA, 19 nt, Homo sapiens
gguguaagugugauaauuc

SEQ ID NO: 641092 - RNA, 19 nt, Homo sapiens
acugagaaacauugaguua

SEQ ID NO: 641093 - RNA, 19 nt, Homo sapiens
acauauaaaugcgaaggaa

SEQ ID NO: 641094 - RNA, 19 nt, Homo sapiens
guguaagugugauaauuca

SEQ ID NO: 641095 - RNA, 19 nt, Homo sapiens
caugagagaggucuggauu

SEQ ID NO: 641096 - RNA, 19 nt, Homo sapiens
ccuuaacaauuacaugaga

SEQ ID NO: 641097 - RNA, 19 nt, Homo sapiens
gcucagaauauccuuaaca

SEQ ID NO: 641098 - RNA, 19 nt, Homo sapiens
uacagggaauggaauaugu

SEQ ID NO: 641099 - RNA, 19 nt, Homo sapiens
aaagcaagaaucuguguga

SEQ ID NO: 641100 - RNA, 19 nt, Homo sapiens
gcagguguaagugugauaa

SEQ ID NO: 641101 - RNA, 19 nt, Homo sapiens
uuuguguacucucacuuua

SEQ ID NO: 641102 - RNA, 19 nt, Homo sapiens
acacaagaaagaccauauu

SEQ ID NO: 641103 - RNA, 19 nt, Homo sapiens
gaggucuggauucuuauuu

SEQ ID NO: 641104 - RNA, 19 nt, Homo sapiens
guacagggaauggaauaug

SEQ ID NO: 641105 - RNA, 19 nt, Homo sapiens
gaggccaugggaaguguua

SEQ ID NO: 641106 - RNA, 19 nt, Homo sapiens
gacaagcacacaggaggua

SEQ ID NO: 641107 - RNA, 19 nt, Homo sapiens
cucagaauauccuuaacaa

SEQ ID NO: 641108 - RNA, 19 nt, Homo sapiens
ggaaggguucuugucauug

SEQ ID NO: 641109 - RNA, 19 nt, Homo sapiens
uaaaugugaauguggcaaa

SEQ ID NO: 641110 - RNA, 19 nt, Homo sapiens
gugcaagaauucacaagac

SEQ ID NO: 641111 - RNA, 19 nt, Homo sapiens
gaaacauugaguuauaugg

SEQ ID NO: 641112 - RNA, 19 nt, Homo sapiens
gaaaugcaugugaaaucug

SEQ ID NO: 641113 - RNA, 19 nt, Homo sapiens
gaauauguagcuguggaaa

SEQ ID NO: 641114 - RNA, 19 nt, Homo sapiens
ggaauauguagcuguggaa

SEQ ID NO: 641115 - RNA, 19 nt, Homo sapiens
ugugggaagugcauuuguu

SEQ ID NO: 641116 - RNA, 19 nt, Homo sapiens
uaaacucaccaaagaagau

SEQ ID NO: 641117 - RNA, 19 nt, Homo sapiens
gaaauccacauucuuacac

SEQ ID NO: 641118 - RNA, 19 nt, Homo sapiens
gaaaccaacuccucauuua

SEQ ID NO: 641119 - RNA, 19 nt, Homo sapiens
gcagagagcucaaagaaug

SEQ ID NO: 641120 - RNA, 19 nt, Homo sapiens
ucagauagcucaagugauu

SEQ ID NO: 641121 - RNA, 19 nt, Homo sapiens
ccaggaagaucaagaagua

SEQ ID NO: 641122 - RNA, 19 nt, Homo sapiens
gaacaggaauacaggagaa

SEQ ID NO: 641123 - RNA, 19 nt, Homo sapiens
agagaagucuaaacaguua

SEQ ID NO: 641124 - RNA, 19 nt, Homo sapiens
gaagagaucccuccuauac

SEQ ID NO: 641125 - RNA, 19 nt, Homo sapiens
gaaguaaagagaagucuaa

SEQ ID NO: 641126 - RNA, 19 nt, Homo sapiens
gcagaaacaaagacaaaua

SEQ ID NO: 641127 - RNA, 19 nt, Homo sapiens
ggaaaggaguagaaguaaa

SEQ ID NO: 641128 - RNA, 19 nt, Homo sapiens
gaauuucucuugucaaugg

SEQ ID NO: 641129 - RNA, 19 nt, Homo sapiens
gaauuaaaguccuccaugu

SEQ ID NO: 641130 - RNA, 19 nt, Homo sapiens
gcaaggaguaccauagaua

SEQ ID NO: 641131 - RNA, 19 nt, Homo sapiens
gcuaaugaaucuccuuuau

SEQ ID NO: 641132 - RNA, 19 nt, Homo sapiens
gaagaaaguuaaagaccau

SEQ ID NO: 641133 - RNA, 19 nt, Homo sapiens
gacgagaguuucgcuguua

SEQ ID NO: 641134 - RNA, 19 nt, Homo sapiens
cagaagagaucccuccuau

SEQ ID NO: 641135 - RNA, 19 nt, Homo sapiens
gaacuuucguugucuuugu

SEQ ID NO: 641136 - RNA, 19 nt, Homo sapiens
aguaagagcucacacagaa

SEQ ID NO: 641137 - RNA, 19 nt, Homo sapiens
gaagaaagucaaagcagaa

SEQ ID NO: 641138 - RNA, 19 nt, Homo sapiens
gaguagagaaugugauaua

SEQ ID NO: 641139 - RNA, 19 nt, Homo sapiens
ccauaaaucuaacagcaaa

SEQ ID NO: 641140 - RNA, 19 nt, Homo sapiens
gaaaucaacucagaaacca

SEQ ID NO: 641141 - RNA, 19 nt, Homo sapiens
guaaagagaagucuaaaca

SEQ ID NO: 641142 - RNA, 19 nt, Homo sapiens
ucacaguucuucauaacaa

SEQ ID NO: 641143 - RNA, 19 nt, Homo sapiens
gaaaggaguagaaguaaag

SEQ ID NO: 641144 - RNA, 19 nt, Homo sapiens
gguaucaaguggugaaaga

SEQ ID NO: 641145 - RNA, 19 nt, Homo sapiens
ucugcaaucuggauaauuu

SEQ ID NO: 641146 - RNA, 19 nt, Homo sapiens
ucagagaaguccaguuaga

SEQ ID NO: 641147 - RNA, 19 nt, Homo sapiens
aaucagagaaguccaguua

SEQ ID NO: 641148 - RNA, 19 nt, Homo sapiens
gaagaggaccaaggcguua

SEQ ID NO: 641149 - RNA, 19 nt, Homo sapiens
uggaacagaugaagacaaa

SEQ ID NO: 641150 - RNA, 19 nt, Homo sapiens
aaagagaagucuaaacagu

SEQ ID NO: 641151 - RNA, 19 nt, Homo sapiens
gcaagaagagugcaucuag

SEQ ID NO: 641152 - RNA, 19 nt, Homo sapiens
ucacagaguugucaaggau

SEQ ID NO: 641153 - RNA, 19 nt, Homo sapiens
ggaguaagagcaaagagaa

SEQ ID NO: 641154 - RNA, 19 nt, Homo sapiens
ggaccaaggcguuaucgaa

SEQ ID NO: 641155 - RNA, 19 nt, Homo sapiens
aaacuuacuuccauucugu

SEQ ID NO: 641156 - RNA, 19 nt, Homo sapiens
caaucaaccugcuggaaga

SEQ ID NO: 641157 - RNA, 19 nt, Homo sapiens
ucaaauaacagcagggaaa

SEQ ID NO: 641158 - RNA, 19 nt, Homo sapiens
ggaguaccauagauacaga

SEQ ID NO: 641159 - RNA, 19 nt, Homo sapiens
caggaaaggaguagaagua

SEQ ID NO: 641160 - RNA, 19 nt, Homo sapiens
gucaagaaguuguaagaga

SEQ ID NO: 641161 - RNA, 19 nt, Homo sapiens
aguaaucucuggucaagaa

SEQ ID NO: 641162 - RNA, 19 nt, Homo sapiens
ugagagacuugcuaaugaa

SEQ ID NO: 641163 - RNA, 19 nt, Homo sapiens
gcaaagagaaaucaaagag

SEQ ID NO: 641164 - RNA, 19 nt, Homo sapiens
caaguaaucucuggucaag

SEQ ID NO: 641165 - RNA, 19 nt, Homo sapiens
gaaagucaaagcagaaaca

SEQ ID NO: 641166 - RNA, 19 nt, Homo sapiens
aggaugaggucaaggagua

SEQ ID NO: 641167 - RNA, 19 nt, Homo sapiens
gaaaaggcauaaaucauca

SEQ ID NO: 641168 - RNA, 19 nt, Homo sapiens
ggaugagugaguuauauaa

SEQ ID NO: 641169 - RNA, 19 nt, Homo sapiens
gcagucugauucuaaagga

SEQ ID NO: 641170 - RNA, 19 nt, Homo sapiens
gaaaagggccaaaucuaaa

SEQ ID NO: 641171 - RNA, 19 nt, Homo sapiens
gagagagacaucagaagaa

SEQ ID NO: 641172 - RNA, 19 nt, Homo sapiens
gagaaguccaguuagagua

SEQ ID NO: 641173 - RNA, 19 nt, Homo sapiens
aaagcagucugauucuaaa

SEQ ID NO: 641174 - RNA, 19 nt, Homo sapiens
uaacagaucacaggaaugu

SEQ ID NO: 641175 - RNA, 19 nt, Homo sapiens
gaaguccaguuagaguaaa

SEQ ID NO: 641176 - RNA, 19 nt, Homo sapiens
uuaaaguccuccauguuga

SEQ ID NO: 641177 - RNA, 19 nt, Homo sapiens
gaaaagcagucugauucua

SEQ ID NO: 641178 - RNA, 19 nt, Homo sapiens
guaaaggaagggaucauga

SEQ ID NO: 641179 - RNA, 19 nt, Homo sapiens
agagagacaucagaagaaa

SEQ ID NO: 641180 - RNA, 19 nt, Homo sapiens
gaaaaggagaagaaaguua

SEQ ID NO: 641181 - RNA, 19 nt, Homo sapiens
ggaaagagaguguaaucca

SEQ ID NO: 641182 - RNA, 19 nt, Homo sapiens
gggaucaguuguccuuguu

SEQ ID NO: 641183 - RNA, 19 nt, Homo sapiens
uuaauaaacucgacaugag

SEQ ID NO: 641184 - RNA, 19 nt, Homo sapiens
uugagagacuugcuaauga

SEQ ID NO: 641185 - RNA, 19 nt, Homo sapiens
gcggaugagugaguuauau

SEQ ID NO: 641186 - RNA, 19 nt, Homo sapiens
gaucaggaaaggaguagaa

SEQ ID NO: 641187 - RNA, 19 nt, Homo sapiens
gcauaaaucaucaucaucu

SEQ ID NO: 641188 - RNA, 19 nt, Homo sapiens
cgaaaccaacuccucauuu

SEQ ID NO: 641189 - RNA, 19 nt, Homo sapiens
gaaucuccuuuauguuguu

SEQ ID NO: 641190 - RNA, 19 nt, Homo sapiens
gaucaaagucccuucucaa

SEQ ID NO: 641191 - RNA, 19 nt, Homo sapiens
caaagaguaaugagcauga

SEQ ID NO: 641192 - RNA, 19 nt, Homo sapiens
agagugaguugaaugaaau

SEQ ID NO: 641193 - RNA, 19 nt, Homo sapiens
caagaagagugcaucuagu

SEQ ID NO: 641194 - RNA, 19 nt, Homo sapiens
acagaguugucaaggauuu

SEQ ID NO: 641195 - RNA, 19 nt, Homo sapiens
gcaaucuggauaauuugua

SEQ ID NO: 641196 - RNA, 19 nt, Homo sapiens
gagacuugcuaaugaaucu

SEQ ID NO: 641197 - RNA, 19 nt, Homo sapiens
gaagcaaggaguaccauag

SEQ ID NO: 641198 - RNA, 19 nt, Homo sapiens
aauaacagaucacaggaau

SEQ ID NO: 641199 - RNA, 19 nt, Homo sapiens
aagagugaguugaaugaaa

SEQ ID NO: 641200 - RNA, 19 nt, Homo sapiens
ggauaagagugaguugaau

SEQ ID NO: 641201 - RNA, 19 nt, Homo sapiens
ucaagaaaaugaccaugua

SEQ ID NO: 641202 - RNA, 19 nt, Homo sapiens
gaucaagaaguaaagauag

SEQ ID NO: 641203 - RNA, 19 nt, Homo sapiens
caagaacccaugacagaga

SEQ ID NO: 641204 - RNA, 19 nt, Homo sapiens
uauaauagcagaacaagag

SEQ ID NO: 641205 - RNA, 19 nt, Homo sapiens
cuaaagguaaacacaguua

SEQ ID NO: 641206 - RNA, 19 nt, Homo sapiens
caguuagaaucaaagagua

SEQ ID NO: 641207 - RNA, 19 nt, Homo sapiens
gauaagagugaguugaaug

SEQ ID NO: 641208 - RNA, 19 nt, Homo sapiens
gggauaagagugaguugaa

SEQ ID NO: 641209 - RNA, 19 nt, Homo sapiens
gaguagaaguaaagagaag

SEQ ID NO: 641210 - RNA, 19 nt, Homo sapiens
gagcaaagagaaaucaaag

SEQ ID NO: 641211 - RNA, 19 nt, Homo sapiens
agagacaucagaagaaauu

SEQ ID NO: 641212 - RNA, 19 nt, Homo sapiens
acagaaaccaagagaguaa

SEQ ID NO: 641213 - RNA, 19 nt, Homo sapiens
aaagauaggaggagaagga

SEQ ID NO: 641214 - RNA, 19 nt, Homo sapiens
uaaaggaagggaucaugaa

SEQ ID NO: 641215 - RNA, 19 nt, Homo sapiens
uggauaauuuguacugcua

SEQ ID NO: 641216 - RNA, 19 nt, Homo sapiens
ggauuucauugaguugauu

SEQ ID NO: 641217 - RNA, 19 nt, Homo sapiens
gguucacaguucuucauaa

SEQ ID NO: 641218 - RNA, 19 nt, Homo sapiens
ggaagaucauccaguguuu

SEQ ID NO: 641219 - RNA, 19 nt, Homo sapiens
gaagagaccaauauuccua

SEQ ID NO: 641220 - RNA, 19 nt, Homo sapiens
gagaagguguuacggaaau

SEQ ID NO: 641221 - RNA, 19 nt, Homo sapiens
aaagagagaugacagcaau

SEQ ID NO: 641222 - RNA, 19 nt, Homo sapiens
ggaaaucggccuacaagau

SEQ ID NO: 641223 - RNA, 19 nt, Homo sapiens
gcaagauccucugcuucua

SEQ ID NO: 641224 - RNA, 19 nt, Homo sapiens
gaagaaggaauuugaacug

SEQ ID NO: 641225 - RNA, 19 nt, Homo sapiens
gcaaguacagcaacgagaa

SEQ ID NO: 641226 - RNA, 19 nt, Homo sapiens
uaaagaucaucaagaagga

SEQ ID NO: 641227 - RNA, 19 nt, Homo sapiens
gcaaguggagaagguguua

SEQ ID NO: 641228 - RNA, 19 nt, Homo sapiens
ggacaucauugccuugaac

SEQ ID NO: 641229 - RNA, 19 nt, Homo sapiens
ucaagauuaucgagguuaa

SEQ ID NO: 641230 - RNA, 19 nt, Homo sapiens
gcgcauguaugacgugaca

SEQ ID NO: 641231 - RNA, 19 nt, Homo sapiens
ccaagcacgucauggaugu

SEQ ID NO: 641232 - RNA, 19 nt, Homo sapiens
gagccuggaugaaaucuac

SEQ ID NO: 641233 - RNA, 19 nt, Homo sapiens
gcauggaggacgucaagaa

SEQ ID NO: 641234 - RNA, 19 nt, Homo sapiens
ggagaaggacgacaaggau

SEQ ID NO: 641235 - RNA, 19 nt, Homo sapiens
guauggagaugaucaacgu

SEQ ID NO: 641236 - RNA, 19 nt, Homo sapiens
ccaaggugcuguucaucug

SEQ ID NO: 641237 - RNA, 19 nt, Homo sapiens
gggaagaucauccaguguu

SEQ ID NO: 641238 - RNA, 19 nt, Homo sapiens
ccgagaaccugcaggacuu

SEQ ID NO: 641239 - RNA, 19 nt, Homo sapiens
ccaacuuccuggaccacua

SEQ ID NO: 641240 - RNA, 19 nt, Homo sapiens
ugacugacguggcugagau

SEQ ID NO: 641241 - RNA, 19 nt, Homo sapiens
ggagaagguguuacggaaa

SEQ ID NO: 641242 - RNA, 19 nt, Homo sapiens
cgagaguacuuccgcuuca

SEQ ID NO: 641243 - RNA, 19 nt, Homo sapiens
ucaagcagacccaccguaa

SEQ ID NO: 641244 - RNA, 19 nt, Homo sapiens
aagaaggaauuugaacuga

SEQ ID NO: 641245 - RNA, 19 nt, Homo sapiens
ugacguggcugagaucaag

SEQ ID NO: 641246 - RNA, 19 nt, Homo sapiens
caagauccucugcuucuau

SEQ ID NO: 641247 - RNA, 19 nt, Homo sapiens
gggacaagcugcgcaugau

SEQ ID NO: 641248 - RNA, 19 nt, Homo sapiens
agaaacgcauccuggaguu

SEQ ID NO: 641249 - RNA, 19 nt, Homo sapiens
gaagaucauccaguguuug

SEQ ID NO: 641250 - RNA, 19 nt, Homo sapiens
agcuaaagaucaucaagaa

SEQ ID NO: 641251 - RNA, 19 nt, Homo sapiens
ggaccucagucggcuuaau

SEQ ID NO: 641252 - RNA, 19 nt, Homo sapiens
ggaggugcacuucguggaa

SEQ ID NO: 641253 - RNA, 19 nt, Homo sapiens
gagcaaggccaagcuguca

SEQ ID NO: 641254 - RNA, 19 nt, Homo sapiens
cgccagagccuuccucaug

SEQ ID NO: 641255 - RNA, 19 nt, Homo sapiens
ucgagagccuggaugaaau

SEQ ID NO: 641256 - RNA, 19 nt, Homo sapiens
uuaaucagaguguggcaua

SEQ ID NO: 641257 - RNA, 19 nt, Homo sapiens
uaucaagauuaucgagguu

SEQ ID NO: 641258 - RNA, 19 nt, Homo sapiens
gggagucagugcugcagau

SEQ ID NO: 641259 - RNA, 19 nt, Homo sapiens
aggcagugcuggaggaaga

SEQ ID NO: 641260 - RNA, 19 nt, Homo sapiens
cacagaagaguccauauca

SEQ ID NO: 641261 - RNA, 19 nt, Homo sapiens
gaucauccaguguuugaag

SEQ ID NO: 641262 - RNA, 19 nt, Homo sapiens
cauggaggacgucaagaaa

SEQ ID NO: 641263 - RNA, 19 nt, Homo sapiens
cagcuaaagaucaucaaga

SEQ ID NO: 641264 - RNA, 19 nt, Homo sapiens
gaccauccgggacaucauu

SEQ ID NO: 641265 - RNA, 19 nt, Homo sapiens
cugcagagaucgugaagac

SEQ ID NO: 641266 - RNA, 19 nt, Homo sapiens
agaagcaaguggagaaggu

SEQ ID NO: 641267 - RNA, 19 nt, Homo sapiens
ucgacgagguggacaagau

SEQ ID NO: 641268 - RNA, 19 nt, Homo sapiens
gagcagcuaaagaucauca

SEQ ID NO: 641269 - RNA, 19 nt, Homo sapiens
gucgagagccuggaugaaa

SEQ ID NO: 641270 - RNA, 19 nt, Homo sapiens
aggagaagcuggccauugc

SEQ ID NO: 641271 - RNA, 19 nt, Homo sapiens
gcugaagaaggaauuugaa

SEQ ID NO: 641272 - RNA, 19 nt, Homo sapiens
gcacuucguggaacacuac

SEQ ID NO: 641273 - RNA, 19 nt, Homo sapiens
ccguggagcgcauguauga

SEQ ID NO: 641274 - RNA, 19 nt, Homo sapiens
uaugucggcgucuuucuaa

SEQ ID NO: 641275 - RNA, 19 nt, Homo sapiens
ggcaagauccucugcuucu

SEQ ID NO: 641276 - RNA, 19 nt, Homo sapiens
gggacaucauugccuugaa

SEQ ID NO: 641277 - RNA, 19 nt, Homo sapiens
gcaaggccaagcugucauc

SEQ ID NO: 641278 - RNA, 19 nt, Homo sapiens
gagaccguauggagaugau

SEQ ID NO: 641279 - RNA, 19 nt, Homo sapiens
aagauccucugcuucuaug

SEQ ID NO: 641280 - RNA, 19 nt, Homo sapiens
ugguugagcugcugagaag

SEQ ID NO: 641281 - RNA, 19 nt, Homo sapiens
agucagugcugcagaugau

SEQ ID NO: 641282 - RNA, 19 nt, Homo sapiens
ggacaagcugcgcaugauc

SEQ ID NO: 641283 - RNA, 19 nt, Homo sapiens
uaaagagagaugacagcaa

SEQ ID NO: 641284 - RNA, 19 nt, Homo sapiens
uagacuggcucacguccau

SEQ ID NO: 641285 - RNA, 19 nt, Homo sapiens
gaccucagucggcuuaauc

SEQ ID NO: 641286 - RNA, 19 nt, Homo sapiens
gaacacuaccgggagaucu

SEQ ID NO: 641287 - RNA, 19 nt, Homo sapiens
agagagaugacagcaauga

SEQ ID NO: 641288 - RNA, 19 nt, Homo sapiens
aagaucauccaguguuuga

SEQ ID NO: 641289 - RNA, 19 nt, Homo sapiens
ggagguagagaacguuguc

SEQ ID NO: 641290 - RNA, 19 nt, Homo sapiens
acacagaagaguccauauc

SEQ ID NO: 641291 - RNA, 19 nt, Homo sapiens
ggaguucauugccguuagc

SEQ ID NO: 641292 - RNA, 19 nt, Homo sapiens
ccagagccuuccucaugca

SEQ ID NO: 641293 - RNA, 19 nt, Homo sapiens
gugcugacgcugcucauca

SEQ ID NO: 641294 - RNA, 19 nt, Homo sapiens
cagagcagaaugccaacuu

SEQ ID NO: 641295 - RNA, 19 nt, Homo sapiens
caggagcagcuaaagauca

SEQ ID NO: 641296 - RNA, 19 nt, Homo sapiens
gcaggagcagcuaaagauc

SEQ ID NO: 641297 - RNA, 19 nt, Homo sapiens
gcagacccaccguaaguac

SEQ ID NO: 641298 - RNA, 19 nt, Homo sapiens
aagcagacccaccguaagu

SEQ ID NO: 641299 - RNA, 19 nt, Homo sapiens
gaguguggcauagaagcua

SEQ ID NO: 641300 - RNA, 19 nt, Homo sapiens
cagccgagaacaagaagga

SEQ ID NO: 641301 - RNA, 19 nt, Homo sapiens
ugccaagggugacaaggau

SEQ ID NO: 641302 - RNA, 19 nt, Homo sapiens
agagcagaaugccaacuuc

SEQ ID NO: 641303 - RNA, 19 nt, Homo sapiens
caaugucacccgcaacuac

SEQ ID NO: 641304 - RNA, 19 nt, Homo sapiens
gcacgucauggauguugug

SEQ ID NO: 641305 - RNA, 19 nt, Homo sapiens
caagauuaucgagguuaaa

SEQ ID NO: 641306 - RNA, 19 nt, Homo sapiens
cgucaugggacacagaaga

SEQ ID NO: 641307 - RNA, 19 nt, Homo sapiens
caggagaagcuggccauug

SEQ ID NO: 641308 - RNA, 19 nt, Homo sapiens
gaaacgcauccuggaguuc

SEQ ID NO: 641309 - RNA, 19 nt, Homo sapiens
ucaaggagaagaccauugc

SEQ ID NO: 641310 - RNA, 19 nt, Homo sapiens
gacgauccccgauguguuu

SEQ ID NO: 641311 - RNA, 19 nt, Homo sapiens
gaccguauggagaugauca

SEQ ID NO: 641312 - RNA, 19 nt, Homo sapiens
gcgagaccguauggagaug

SEQ ID NO: 641313 - RNA, 19 nt, Homo sapiens
gaucgucaugggacacaga

SEQ ID NO: 641314 - RNA, 19 nt, Homo sapiens
cgaccuggcagccuucauc

SEQ ID NO: 641315 - RNA, 19 nt, Homo sapiens
uguccaaggugcuguucau

SEQ ID NO: 641316 - RNA, 19 nt, Homo sapiens
aagagaccaauauuccuaa

SEQ ID NO: 641317 - RNA, 19 nt, Homo sapiens
acagaagaguccauaucag

SEQ ID NO: 641318 - RNA, 19 nt, Homo sapiens
gaacugagguggugaagaa

SEQ ID NO: 641319 - RNA, 19 nt, Homo sapiens
gggacaagaagaagaauua

SEQ ID NO: 641320 - RNA, 19 nt, Homo sapiens
caaggucacuaagccauua

SEQ ID NO: 641321 - RNA, 19 nt, Homo sapiens
ugacuuugcuaucaacuuu

SEQ ID NO: 641322 - RNA, 19 nt, Homo sapiens
ucaaguuccugguguauga

SEQ ID NO: 641323 - RNA, 19 nt, Homo sapiens
acaaggaucuguucagcaa

SEQ ID NO: 641324 - RNA, 19 nt, Homo sapiens
gugcacaccuuccuggauu

SEQ ID NO: 641325 - RNA, 19 nt, Homo sapiens
ccuacaagcuggacaacaa

SEQ ID NO: 641326 - RNA, 19 nt, Homo sapiens
ccaaguaucgggacaagaa

SEQ ID NO: 641327 - RNA, 19 nt, Homo sapiens
ucaccgaccucucaaguuc

SEQ ID NO: 641328 - RNA, 19 nt, Homo sapiens
cagcaagucugacccuuuc

SEQ ID NO: 641329 - RNA, 19 nt, Homo sapiens
gggcaaugcugacuucucu

SEQ ID NO: 641330 - RNA, 19 nt, Homo sapiens
gcaaugcugacuucucuga

SEQ ID NO: 641331 - RNA, 19 nt, Homo sapiens
cgaggugucccaugacuuu

SEQ ID NO: 641332 - RNA, 19 nt, Homo sapiens
ugacuucacugccuccaau

SEQ ID NO: 641333 - RNA, 19 nt, Homo sapiens
gaucguggccgaggaggua

SEQ ID NO: 641334 - RNA, 19 nt, Homo sapiens
ggaaaauccugaaugugaa

SEQ ID NO: 641335 - RNA, 19 nt, Homo sapiens
ggcaggugguggaguacua

SEQ ID NO: 641336 - RNA, 19 nt, Homo sapiens
cagcuggucuggagaacug

SEQ ID NO: 641337 - RNA, 19 nt, Homo sapiens
ccaacgaggaccaaaguga

SEQ ID NO: 641338 - RNA, 19 nt, Homo sapiens
gauguucaccgaccucuca

SEQ ID NO: 641339 - RNA, 19 nt, Homo sapiens
gaucagcuggucuggagaa

SEQ ID NO: 641340 - RNA, 19 nt, Homo sapiens
cacggcaggugguggagua

SEQ ID NO: 641341 - RNA, 19 nt, Homo sapiens
gcaaguccaccaucacgau

SEQ ID NO: 641342 - RNA, 19 nt, Homo sapiens
gacuuucuagccauuaaua

SEQ ID NO: 641343 - RNA, 19 nt, Homo sapiens
gaggagguaucaggcacaa

SEQ ID NO: 641344 - RNA, 19 nt, Homo sapiens
gggugauccugacuuucua

SEQ ID NO: 641345 - RNA, 19 nt, Homo sapiens
gcaucugccaggacuauga

SEQ ID NO: 641346 - RNA, 19 nt, Homo sapiens
caacgaggaccaaagugau

SEQ ID NO: 641347 - RNA, 19 nt, Homo sapiens
ggagguaucaggcacaaac

SEQ ID NO: 641348 - RNA, 19 nt, Homo sapiens
gcuccuaucucuccaaacc

SEQ ID NO: 641349 - RNA, 19 nt, Homo sapiens
gcuucacgguggccauuga

SEQ ID NO: 641350 - RNA, 19 nt, Homo sapiens
gcgggcaaguccaccauca

SEQ ID NO: 641351 - RNA, 19 nt, Homo sapiens
ucccaugacuuugcuauca

SEQ ID NO: 641352 - RNA, 19 nt, Homo sapiens
gugcuucgcuccuguucca

SEQ ID NO: 641353 - RNA, 19 nt, Homo sapiens
ggagaacugagguggugaa

SEQ ID NO: 641354 - RNA, 19 nt, Homo sapiens
gaccaacgaggaccaaagu

SEQ ID NO: 641355 - RNA, 19 nt, Homo sapiens
gcugagacucgcacugcua

SEQ ID NO: 641356 - RNA, 19 nt, Homo sapiens
agaagaagaauuacaagag

SEQ ID NO: 641357 - RNA, 19 nt, Homo sapiens
cuaugcagcugugauguuc

SEQ ID NO: 641358 - RNA, 19 nt, Homo sapiens
ucauggaaaucuauaagac

SEQ ID NO: 641359 - RNA, 19 nt, Homo sapiens
ggugcuggcccuugaguau

SEQ ID NO: 641360 - RNA, 19 nt, Homo sapiens
cacaaaccaaggucacuaa

SEQ ID NO: 641361 - RNA, 19 nt, Homo sapiens
ugcuggcccuugaguauuu

SEQ ID NO: 641362 - RNA, 19 nt, Homo sapiens
ucacaaaccaaggucacua

SEQ ID NO: 641363 - RNA, 19 nt, Homo sapiens
ugcucaagcucuacucuga

SEQ ID NO: 641364 - RNA, 19 nt, Homo sapiens
ggacuaugacagugauaag

SEQ ID NO: 641365 - RNA, 19 nt, Homo sapiens
ccaggacuaugacagugau

SEQ ID NO: 641366 - RNA, 19 nt, Homo sapiens
gacaagaagaagaauuaca

SEQ ID NO: 641367 - RNA, 19 nt, Homo sapiens
ucacuaagccauuauugcu

SEQ ID NO: 641368 - RNA, 19 nt, Homo sapiens
cuugggugauccugacuuu

SEQ ID NO: 641369 - RNA, 19 nt, Homo sapiens
ccaaugccuccaccucuug

SEQ ID NO: 641370 - RNA, 19 nt, Homo sapiens
cggaaaauccugaauguga

SEQ ID NO: 641371 - RNA, 19 nt, Homo sapiens
guucccagcuuuuggcuuu

SEQ ID NO: 641372 - RNA, 19 nt, Homo sapiens
cuuccuggauuacaucaug

SEQ ID NO: 641373 - RNA, 19 nt, Homo sapiens
ggucacuaagccauuauug

SEQ ID NO: 641374 - RNA, 19 nt, Homo sapiens
auaaagagaacugcuccua

SEQ ID NO: 641375 - RNA, 19 nt, Homo sapiens
cucaagcucuacucugaug

SEQ ID NO: 641376 - RNA, 19 nt, Homo sapiens
ugacuccagugaccaaugc

SEQ ID NO: 641377 - RNA, 19 nt, Homo sapiens
ugcacaccuuccuggauua

SEQ ID NO: 641378 - RNA, 19 nt, Homo sapiens
caagaagaagaauuacaag

SEQ ID NO: 641379 - RNA, 19 nt, Homo sapiens
gucugacccuuucauggaa

SEQ ID NO: 641380 - RNA, 19 nt, Homo sapiens
aaggaucuguucagcaagu

SEQ ID NO: 641381 - RNA, 19 nt, Homo sapiens
aaacgacuaugugcaacuc

SEQ ID NO: 641382 - RNA, 19 nt, Homo sapiens
cugacuuucuagccauuaa

SEQ ID NO: 641383 - RNA, 19 nt, Homo sapiens
ccaaggucacuaagccauu

SEQ ID NO: 641384 - RNA, 19 nt, Homo sapiens
cccaugacuuugcuaucaa

SEQ ID NO: 641385 - RNA, 19 nt, Homo sapiens
gcaagucugacccuuucau

SEQ ID NO: 641386 - RNA, 19 nt, Homo sapiens
uaucaggcacaaacgacua

SEQ ID NO: 641387 - RNA, 19 nt, Homo sapiens
gcgugcugcucaagcucua

SEQ ID NO: 641388 - RNA, 19 nt, Homo sapiens
cgugggcaaugcugacuuc

SEQ ID NO: 641389 - RNA, 19 nt, Homo sapiens
cccgacagcccaaccacua

SEQ ID NO: 641390 - RNA, 19 nt, Homo sapiens
acaccuuccuggauuacau

SEQ ID NO: 641391 - RNA, 19 nt, Homo sapiens
gcacuuuccaggagaugca

SEQ ID NO: 641392 - RNA, 19 nt, Homo sapiens
cugagguggugaagaacaa

SEQ ID NO: 641393 - RNA, 19 nt, Homo sapiens
caagucugacccuuucaug

SEQ ID NO: 641394 - RNA, 19 nt, Homo sapiens
gagccuacaagcuggacaa

SEQ ID NO: 641395 - RNA, 19 nt, Homo sapiens
gccugcagcccgagacauu

SEQ ID NO: 641396 - RNA, 19 nt, Homo sapiens
gcccauguccaucaucauc

SEQ ID NO: 641397 - RNA, 19 nt, Homo sapiens
ggacaagaagaagaauuac

SEQ ID NO: 641398 - RNA, 19 nt, Homo sapiens
gggacacacucaccaaacc

SEQ ID NO: 641399 - RNA, 19 nt, Homo sapiens
gguggguccugcuccuauc

SEQ ID NO: 641400 - RNA, 19 nt, Homo sapiens
aaugcugacuucucugaca

SEQ ID NO: 641401 - RNA, 19 nt, Homo sapiens
acuucgaggugucccauga

SEQ ID NO: 641402 - RNA, 19 nt, Homo sapiens
gccaggacuaugacaguga

SEQ ID NO: 641403 - RNA, 19 nt, Homo sapiens
agucugacccuuucaugga

SEQ ID NO: 641404 - RNA, 19 nt, Homo sapiens
gcaccuugggccagauugu

SEQ ID NO: 641405 - RNA, 19 nt, Homo sapiens
gcugaagaaugggaagacu

SEQ ID NO: 641406 - RNA, 19 nt, Homo sapiens
cgaguucaccagcacuuuc

SEQ ID NO: 641407 - RNA, 19 nt, Homo sapiens
caacuuagcccugaaauuu

SEQ ID NO: 641408 - RNA, 19 nt, Homo sapiens
ggacacagcaggucaggaa

SEQ ID NO: 641409 - RNA, 19 nt, Homo sapiens
gcgagaagaucaagguuca

SEQ ID NO: 641410 - RNA, 19 nt, Homo sapiens
gugcuuggcuugccgauug

SEQ ID NO: 641411 - RNA, 19 nt, Homo sapiens
acaggaagcuaacaguaaa

SEQ ID NO: 641412 - RNA, 19 nt, Homo sapiens
ccaggugcccuccaacuua

SEQ ID NO: 641413 - RNA, 19 nt, Homo sapiens
aaagcauggucgagcauua

SEQ ID NO: 641414 - RNA, 19 nt, Homo sapiens
gcugacaccugcuuguuuc

SEQ ID NO: 641415 - RNA, 19 nt, Homo sapiens
guugaaaccaaacgauaua

SEQ ID NO: 641416 - RNA, 19 nt, Homo sapiens
agaaaucccugcuguaucg

SEQ ID NO: 641417 - RNA, 19 nt, Homo sapiens
ccacaggaagcuaacagua

SEQ ID NO: 641418 - RNA, 19 nt, Homo sapiens
aaauguggauccaagaaug

SEQ ID NO: 641419 - RNA, 19 nt, Homo sapiens
ccagaaaucccugcuguau

SEQ ID NO: 641420 - RNA, 19 nt, Homo sapiens
gggagaagaccguggaaau

SEQ ID NO: 641421 - RNA, 19 nt, Homo sapiens
gcauuacuaccgcaacgua

SEQ ID NO: 641422 - RNA, 19 nt, Homo sapiens
ggaaaucgagggcgagaag

SEQ ID NO: 641423 - RNA, 19 nt, Homo sapiens
ggagaagaccguggaaauc

SEQ ID NO: 641424 - RNA, 19 nt, Homo sapiens
cacaggaagcuaacaguaa

SEQ ID NO: 641425 - RNA, 19 nt, Homo sapiens
cagcaggucaggaacguuu

SEQ ID NO: 641426 - RNA, 19 nt, Homo sapiens
ucuaugacgucaccaagau

SEQ ID NO: 641427 - RNA, 19 nt, Homo sapiens
gcccugaaauuugcugaug

SEQ ID NO: 641428 - RNA, 19 nt, Homo sapiens
acaccugcuuguuuccaua

SEQ ID NO: 641429 - RNA, 19 nt, Homo sapiens
gccagaacguggagucgau

SEQ ID NO: 641430 - RNA, 19 nt, Homo sapiens
ccaaagagagccagaacgu

SEQ ID NO: 641431 - RNA, 19 nt, Homo sapiens
gagaagaccguggaaaucg

SEQ ID NO: 641432 - RNA, 19 nt, Homo sapiens
caggugcccuccaacuuag

SEQ ID NO: 641433 - RNA, 19 nt, Homo sapiens
gaagcuaacaguaaaacuu

SEQ ID NO: 641434 - RNA, 19 nt, Homo sapiens
ggaccaguacgugcagauu

SEQ ID NO: 641435 - RNA, 19 nt, Homo sapiens
gcacacacacacgcacaga

SEQ ID NO: 641436 - RNA, 19 nt, Homo sapiens
ccaacuuagcccugaaauu

SEQ ID NO: 641437 - RNA, 19 nt, Homo sapiens
agaagaccguggaaaucga

SEQ ID NO: 641438 - RNA, 19 nt, Homo sapiens
gaccaguacgugcagauuc

SEQ ID NO: 641439 - RNA, 19 nt, Homo sapiens
ucaccaaccucaaaaugug

SEQ ID NO: 641440 - RNA, 19 nt, Homo sapiens
gaaaucgagggcgagaaga

SEQ ID NO: 641441 - RNA, 19 nt, Homo sapiens
aaacuuccuguccuuguug

SEQ ID NO: 641442 - RNA, 19 nt, Homo sapiens
ugacaucuuucaccaaccu

SEQ ID NO: 641443 - RNA, 19 nt, Homo sapiens
uaugacgucaccaagauga

SEQ ID NO: 641444 - RNA, 19 nt, Homo sapiens
gcauggucgagcauuacua

SEQ ID NO: 641445 - RNA, 19 nt, Homo sapiens
gacaccugcuuguuuccau

SEQ ID NO: 641446 - RNA, 19 nt, Homo sapiens
gcaagaccugccugaccuu

SEQ ID NO: 641447 - RNA, 19 nt, Homo sapiens
gaacguuuccgcaaaagca

SEQ ID NO: 641448 - RNA, 19 nt, Homo sapiens
cagaaaucccugcuguauc

SEQ ID NO: 641449 - RNA, 19 nt, Homo sapiens
cagaacguggagucgauuu

SEQ ID NO: 641450 - RNA, 19 nt, Homo sapiens
cguggacguucucuuugug

SEQ ID NO: 641451 - RNA, 19 nt, Homo sapiens
ccaggaaacuugaauguua

SEQ ID NO: 641452 - RNA, 19 nt, Homo sapiens
gggaagaccuccuuaacua

SEQ ID NO: 641453 - RNA, 19 nt, Homo sapiens
gaaaguugcugcugaaauc

SEQ ID NO: 641454 - RNA, 19 nt, Homo sapiens
gagcauaugcgaacaauaa

SEQ ID NO: 641455 - RNA, 19 nt, Homo sapiens
gggcagaaauagugaagua

SEQ ID NO: 641456 - RNA, 19 nt, Homo sapiens
gaaggcagauauuguaaac

SEQ ID NO: 641457 - RNA, 19 nt, Homo sapiens
gggaaacaguacaaacaaa

SEQ ID NO: 641458 - RNA, 19 nt, Homo sapiens
gguauacuguggugaagaa

SEQ ID NO: 641459 - RNA, 19 nt, Homo sapiens
aggcagauauuguaaacua

SEQ ID NO: 641460 - RNA, 19 nt, Homo sapiens
gaaguacccggaagaagaa

SEQ ID NO: 641461 - RNA, 19 nt, Homo sapiens
gaauguuacccuucaaauu

SEQ ID NO: 641462 - RNA, 19 nt, Homo sapiens
gaacagucacagcguauug

SEQ ID NO: 641463 - RNA, 19 nt, Homo sapiens
ggugaaggcagauauugua

SEQ ID NO: 641464 - RNA, 19 nt, Homo sapiens
ggauaacauugccaggaaa

SEQ ID NO: 641465 - RNA, 19 nt, Homo sapiens
ugaaguacccggaagaaga

SEQ ID NO: 641466 - RNA, 19 nt, Homo sapiens
gggaucaaauuaaacaaag

SEQ ID NO: 641467 - RNA, 19 nt, Homo sapiens
caacauaccaccucuacuc

SEQ ID NO: 641468 - RNA, 19 nt, Homo sapiens
gaguagaaucuguucagua

SEQ ID NO: 641469 - RNA, 19 nt, Homo sapiens
guacaaacaaacuauagga

SEQ ID NO: 641470 - RNA, 19 nt, Homo sapiens
ucaagaaacuuuugggaaa

SEQ ID NO: 641471 - RNA, 19 nt, Homo sapiens
ggaguccucuugguauaug

SEQ ID NO: 641472 - RNA, 19 nt, Homo sapiens
cauaccaccucuacucaga

SEQ ID NO: 641473 - RNA, 19 nt, Homo sapiens
gcaguucagugagcgcauu

SEQ ID NO: 641474 - RNA, 19 nt, Homo sapiens
cuauaggacuggauuucuu

SEQ ID NO: 641475 - RNA, 19 nt, Homo sapiens
gaggcaaaauguuggauaa

SEQ ID NO: 641476 - RNA, 19 nt, Homo sapiens
caaacuauaggacuggauu

SEQ ID NO: 641477 - RNA, 19 nt, Homo sapiens
aguagaaucuguucaguac

SEQ ID NO: 641478 - RNA, 19 nt, Homo sapiens
gaaagugagcgaggaguca

SEQ ID NO: 641479 - RNA, 19 nt, Homo sapiens
ggaaacaguacaaacaaac

SEQ ID NO: 641480 - RNA, 19 nt, Homo sapiens
aggauaacauugccaggaa

SEQ ID NO: 641481 - RNA, 19 nt, Homo sapiens
gccacugguugccuuggua

SEQ ID NO: 641482 - RNA, 19 nt, Homo sapiens
uauaggagggcagacaaua

SEQ ID NO: 641483 - RNA, 19 nt, Homo sapiens
gauauaggagggcagacaa

SEQ ID NO: 641484 - RNA, 19 nt, Homo sapiens
gcuuugagaauuuagaaga

SEQ ID NO: 641485 - RNA, 19 nt, Homo sapiens
caggaaacuugaauguuac

SEQ ID NO: 641486 - RNA, 19 nt, Homo sapiens
gaaacaguacaaacaaacu

SEQ ID NO: 641487 - RNA, 19 nt, Homo sapiens
gcagacaauaggaggcaaa

SEQ ID NO: 641488 - RNA, 19 nt, Homo sapiens
uaacauugccaggaaacuu

SEQ ID NO: 641489 - RNA, 19 nt, Homo sapiens
uauaggacuggauuucuuu

SEQ ID NO: 641490 - RNA, 19 nt, Homo sapiens
caaccaggaaccuauguca

SEQ ID NO: 641491 - RNA, 19 nt, Homo sapiens
agggaguccucuugguaua

SEQ ID NO: 641492 - RNA, 19 nt, Homo sapiens
acagggaguccucuuggua

SEQ ID NO: 641493 - RNA, 19 nt, Homo sapiens
cuucaaauuugggauauag

SEQ ID NO: 641494 - RNA, 19 nt, Homo sapiens
gugaaggcagauauuguaa

SEQ ID NO: 641495 - RNA, 19 nt, Homo sapiens
ggaagaccuccuuaacuac

SEQ ID NO: 641496 - RNA, 19 nt, Homo sapiens
ugucagggcagaaauagug

SEQ ID NO: 641497 - RNA, 19 nt, Homo sapiens
auacuguggugaagaaagu

SEQ ID NO: 641498 - RNA, 19 nt, Homo sapiens
uuagaagauugguauacug

SEQ ID NO: 641499 - RNA, 19 nt, Homo sapiens
ugaaggcagauauuguaaa

SEQ ID NO: 641500 - RNA, 19 nt, Homo sapiens
acuguuaacccuccuagaa

SEQ ID NO: 641501 - RNA, 19 nt, Homo sapiens
gacaauaggaggcaaaaug

SEQ ID NO: 641502 - RNA, 19 nt, Homo sapiens
ggcaaaauguuggauaaau

SEQ ID NO: 641503 - RNA, 19 nt, Homo sapiens
ucaaauuugggauauagga

SEQ ID NO: 641504 - RNA, 19 nt, Homo sapiens
uccuugggaucaaauuaaa

SEQ ID NO: 641505 - RNA, 19 nt, Homo sapiens
gagcgaggagucagaaacu

SEQ ID NO: 641506 - RNA, 19 nt, Homo sapiens
uagaagauugguauacugu

SEQ ID NO: 641507 - RNA, 19 nt, Homo sapiens
ggauauaggagggcagaca

SEQ ID NO: 641508 - RNA, 19 nt, Homo sapiens
ggaucaaauuaaacaaagc

SEQ ID NO: 641509 - RNA, 19 nt, Homo sapiens
ccuaugucaaggacuguua

SEQ ID NO: 641510 - RNA, 19 nt, Homo sapiens
ggagcauaugcgaacaaua

SEQ ID NO: 641511 - RNA, 19 nt, Homo sapiens
aaacuauaggacuggauuu

SEQ ID NO: 641512 - RNA, 19 nt, Homo sapiens
caaagcagaaauagaacag

SEQ ID NO: 641513 - RNA, 19 nt, Homo sapiens
cagggaguccucuugguau

SEQ ID NO: 641514 - RNA, 19 nt, Homo sapiens
gguggugaaggcagauauu

SEQ ID NO: 641515 - RNA, 19 nt, Homo sapiens
uaugugugcaguucaguga

SEQ ID NO: 641516 - RNA, 19 nt, Homo sapiens
gccaggaccggcaacugaa

SEQ ID NO: 641517 - RNA, 19 nt, Homo sapiens
agaaaguugcugcugaaau

SEQ ID NO: 641518 - RNA, 19 nt, Homo sapiens
ccaggaccggcaacugaaa

SEQ ID NO: 641519 - RNA, 19 nt, Homo sapiens
ccuucaaauuugggauaua

SEQ ID NO: 641520 - RNA, 19 nt, Homo sapiens
gccaggaaacuugaauguu

SEQ ID NO: 641521 - RNA, 19 nt, Homo sapiens
auguuacccuucaaauuug

SEQ ID NO: 641522 - RNA, 19 nt, Homo sapiens
gagcacagggaguccucuu

SEQ ID NO: 641523 - RNA, 19 nt, Homo sapiens
ggaagaagaaaaucaacau

SEQ ID NO: 641524 - RNA, 19 nt, Homo sapiens
gggaguccucuugguauau

SEQ ID NO: 641525 - RNA, 19 nt, Homo sapiens
ugggaaacaguacaaacaa

SEQ ID NO: 641526 - RNA, 19 nt, Homo sapiens
ggauugaccuugaauuuaa

SEQ ID NO: 641527 - RNA, 19 nt, Homo sapiens
ggaaguagcuuugaacuag

SEQ ID NO: 641528 - RNA, 19 nt, Homo sapiens
caagagagaugaugccaaa

SEQ ID NO: 641529 - RNA, 19 nt, Homo sapiens
aaacaugaauccugugaua

SEQ ID NO: 641530 - RNA, 19 nt, Homo sapiens
gcacccacuucuaaauuua

SEQ ID NO: 641531 - RNA, 19 nt, Homo sapiens
gcagacacaucagcuguua

SEQ ID NO: 641532 - RNA, 19 nt, Homo sapiens
gggcauaggugaucguaaa

SEQ ID NO: 641533 - RNA, 19 nt, Homo sapiens
gagcagaucuuggaaugaa

SEQ ID NO: 641534 - RNA, 19 nt, Homo sapiens
cagaagaaguuacaaauag

SEQ ID NO: 641535 - RNA, 19 nt, Homo sapiens
gcagaagaaguuacaaaua

SEQ ID NO: 641536 - RNA, 19 nt, Homo sapiens
gcaaugcuucuaucaaaua

SEQ ID NO: 641537 - RNA, 19 nt, Homo sapiens
gcagaaauuugaaugacaa

SEQ ID NO: 641538 - RNA, 19 nt, Homo sapiens
caucagcuguuaaccauuu

SEQ ID NO: 641539 - RNA, 19 nt, Homo sapiens
gagagaugaugccaaauau

SEQ ID NO: 641540 - RNA, 19 nt, Homo sapiens
uuaccgaccugaauguuua

SEQ ID NO: 641541 - RNA, 19 nt, Homo sapiens
gaucaauccucgaagaaug

SEQ ID NO: 641542 - RNA, 19 nt, Homo sapiens
gagaugaugccaaauauau

SEQ ID NO: 641543 - RNA, 19 nt, Homo sapiens
gcuccuugauaaaguauua

SEQ ID NO: 641544 - RNA, 19 nt, Homo sapiens
gcauaaagcaauugugaaa

SEQ ID NO: 641545 - RNA, 19 nt, Homo sapiens
uuucucagcugccauaaua

SEQ ID NO: 641546 - RNA, 19 nt, Homo sapiens
gaauuuaaccauccucaaa

SEQ ID NO: 641547 - RNA, 19 nt, Homo sapiens
gaaaauggcugguuugucu

SEQ ID NO: 641548 - RNA, 19 nt, Homo sapiens
aggaauguaucacaacuua

SEQ ID NO: 641549 - RNA, 19 nt, Homo sapiens
gacaugaccuuucccuaga

SEQ ID NO: 641550 - RNA, 19 nt, Homo sapiens
gagagcaaauuauggaaau

SEQ ID NO: 641551 - RNA, 19 nt, Homo sapiens
gcgaauagugccugaauuu

SEQ ID NO: 641552 - RNA, 19 nt, Homo sapiens
caugaaacauuacaggaaa

SEQ ID NO: 641553 - RNA, 19 nt, Homo sapiens
gaaacaugcuagugauauc

SEQ ID NO: 641554 - RNA, 19 nt, Homo sapiens
gcuagagaaucaaguuuau

SEQ ID NO: 641555 - RNA, 19 nt, Homo sapiens
gguuuggccucuaucguua

SEQ ID NO: 641556 - RNA, 19 nt, Homo sapiens
caucuauucugccugauuu

SEQ ID NO: 641557 - RNA, 19 nt, Homo sapiens
cuaauuaggucucauccuu

SEQ ID NO: 641558 - RNA, 19 nt, Homo sapiens
ugucaaaucuaguuuccua

SEQ ID NO: 641559 - RNA, 19 nt, Homo sapiens
aggcauccaugaaacauua

SEQ ID NO: 641560 - RNA, 19 nt, Homo sapiens
gcggauacuuugcuuauuc

SEQ ID NO: 641561 - RNA, 19 nt, Homo sapiens
cagggaagucucucuauua

SEQ ID NO: 641562 - RNA, 19 nt, Homo sapiens
gaagaaaggcagaagaagu

SEQ ID NO: 641563 - RNA, 19 nt, Homo sapiens
caacugcuuuccuggauug

SEQ ID NO: 641564 - RNA, 19 nt, Homo sapiens
ccacaggaauguaucacaa

SEQ ID NO: 641565 - RNA, 19 nt, Homo sapiens
ggaagucucucuauuacac

SEQ ID NO: 641566 - RNA, 19 nt, Homo sapiens
gaaccugccugcccuuucu

SEQ ID NO: 641567 - RNA, 19 nt, Homo sapiens
ccgagagcaugaagaauaa

SEQ ID NO: 641568 - RNA, 19 nt, Homo sapiens
aauuaggucucauccuuua

SEQ ID NO: 641569 - RNA, 19 nt, Homo sapiens
aaacugacaggcacuauaa

SEQ ID NO: 641570 - RNA, 19 nt, Homo sapiens
gaauagugccugaauuugu

SEQ ID NO: 641571 - RNA, 19 nt, Homo sapiens
ugacagagguuuugaaaug

SEQ ID NO: 641572 - RNA, 19 nt, Homo sapiens
cacagaaacuauaugcaaa

SEQ ID NO: 641573 - RNA, 19 nt, Homo sapiens
gcuguacuguaauuucuuu

SEQ ID NO: 641574 - RNA, 19 nt, Homo sapiens
gaaaguuauguaccaagua

SEQ ID NO: 641575 - RNA, 19 nt, Homo sapiens
ggaaagauuuuguccagaa

SEQ ID NO: 641576 - RNA, 19 nt, Homo sapiens
cagcugaggguguauuaua

SEQ ID NO: 641577 - RNA, 19 nt, Homo sapiens
ccaaacccguauuuauuga

SEQ ID NO: 641578 - RNA, 19 nt, Homo sapiens
aaagcaaucuggucugaau

SEQ ID NO: 641579 - RNA, 19 nt, Homo sapiens
gaguucgaauagaaaguua

SEQ ID NO: 641580 - RNA, 19 nt, Homo sapiens
gcaagaguucgaauagaaa

SEQ ID NO: 641581 - RNA, 19 nt, Homo sapiens
uaaaucugccugcaacuuu

SEQ ID NO: 641582 - RNA, 19 nt, Homo sapiens
ugacauacuuggagagcaa

SEQ ID NO: 641583 - RNA, 19 nt, Homo sapiens
ugacaacuacauucaagua

SEQ ID NO: 641584 - RNA, 19 nt, Homo sapiens
agagagaugaugccaaaua

SEQ ID NO: 641585 - RNA, 19 nt, Homo sapiens
gcaauugugaaauacagua

SEQ ID NO: 641586 - RNA, 19 nt, Homo sapiens
ugaaugagccguauacaag

SEQ ID NO: 641587 - RNA, 19 nt, Homo sapiens
ugcaagaguucgaauagaa

SEQ ID NO: 641588 - RNA, 19 nt, Homo sapiens
aauagugccugaauuuguu

SEQ ID NO: 641589 - RNA, 19 nt, Homo sapiens
gcaacugcuuuccuggauu

SEQ ID NO: 641590 - RNA, 19 nt, Homo sapiens
gaaguagcuuugaacuagu

SEQ ID NO: 641591 - RNA, 19 nt, Homo sapiens
gccaaacccguauuuauug

SEQ ID NO: 641592 - RNA, 19 nt, Homo sapiens
caugaauccugugauauug

SEQ ID NO: 641593 - RNA, 19 nt, Homo sapiens
ggagagcaaauuauggaaa

SEQ ID NO: 641594 - RNA, 19 nt, Homo sapiens
ggaaguaguaauugcaaga

SEQ ID NO: 641595 - RNA, 19 nt, Homo sapiens
gaaaugggcauaggugauc

SEQ ID NO: 641596 - RNA, 19 nt, Homo sapiens
uaaguguugugaaacugua

SEQ ID NO: 641597 - RNA, 19 nt, Homo sapiens
ccgcacagcuccgagguuu

SEQ ID NO: 641598 - RNA, 19 nt, Homo sapiens
gugcugaacuggcugaagu

SEQ ID NO: 641599 - RNA, 19 nt, Homo sapiens
gaccacagcaucaaagaau

SEQ ID NO: 641600 - RNA, 19 nt, Homo sapiens
gcugaaacaugcuagugau

SEQ ID NO: 641601 - RNA, 19 nt, Homo sapiens
guccuaggcuggaauguuc

SEQ ID NO: 641602 - RNA, 19 nt, Homo sapiens
caggaagcauaaagcaauu

SEQ ID NO: 641603 - RNA, 19 nt, Homo sapiens
guaucugguuaaugacaua

SEQ ID NO: 641604 - RNA, 19 nt, Homo sapiens
gaaaagaagauggcagaua

SEQ ID NO: 641605 - RNA, 19 nt, Homo sapiens
cauaaacgaagcucucaaa

SEQ ID NO: 641606 - RNA, 19 nt, Homo sapiens
gauuauccaugggugauga

SEQ ID NO: 641607 - RNA, 19 nt, Homo sapiens
cguggacucuucuauguug

SEQ ID NO: 641608 - RNA, 19 nt, Homo sapiens
caucaggcguggacucuuc

SEQ ID NO: 641609 - RNA, 19 nt, Homo sapiens
acagggaagucucucuauu

SEQ ID NO: 641610 - RNA, 19 nt, Homo sapiens
gcccaaggcauccaugaaa

SEQ ID NO: 641611 - RNA, 19 nt, Homo sapiens
gggacuggcugaaccaaag

SEQ ID NO: 641612 - RNA, 19 nt, Homo sapiens
gacauuucccugugacuuu

SEQ ID NO: 641613 - RNA, 19 nt, Homo sapiens
acucuucuauguugacuuu

SEQ ID NO: 641614 - RNA, 19 nt, Homo sapiens
cccgagagcaugaagaaua

SEQ ID NO: 641615 - RNA, 19 nt, Homo sapiens
cagaaacuauaugcaaaga

SEQ ID NO: 641616 - RNA, 19 nt, Homo sapiens
ggcguggacucuucuaugu

SEQ ID NO: 641617 - RNA, 19 nt, Homo sapiens
gaugaugccaaauauaugu

SEQ ID NO: 641618 - RNA, 19 nt, Homo sapiens
gaauguaucacaacuuaac

SEQ ID NO: 641619 - RNA, 19 nt, Homo sapiens
acacagaaacuauaugcaa

SEQ ID NO: 641620 - RNA, 19 nt, Homo sapiens
uucuuuagcuguacuguaa

SEQ ID NO: 641621 - RNA, 19 nt, Homo sapiens
uggcaucucuacaauacuu

SEQ ID NO: 641622 - RNA, 19 nt, Homo sapiens
caaaucuaguuuccuaugg

SEQ ID NO: 641623 - RNA, 19 nt, Homo sapiens
gacaggcacuauaauuucu

SEQ ID NO: 641624 - RNA, 19 nt, Homo sapiens
gccugaauuuguucucuuu

SEQ ID NO: 641625 - RNA, 19 nt, Homo sapiens
cauaggugaucguaaaaua

SEQ ID NO: 641626 - RNA, 19 nt, Homo sapiens
ggauugaccuugaauuuaa

SEQ ID NO: 641627 - RNA, 19 nt, Homo sapiens
ggaaguagcuuugaacuag

SEQ ID NO: 641628 - RNA, 19 nt, Homo sapiens
caagagagaugaugccaaa

SEQ ID NO: 641629 - RNA, 19 nt, Homo sapiens
aaacaugaauccugugaua

SEQ ID NO: 641630 - RNA, 19 nt, Homo sapiens
gcacccacuucuaaauuua

SEQ ID NO: 641631 - RNA, 19 nt, Homo sapiens
gcagacacaucagcuguua

SEQ ID NO: 641632 - RNA, 19 nt, Homo sapiens
gggcauaggugaucguaaa

SEQ ID NO: 641633 - RNA, 19 nt, Homo sapiens
gagcagaucuuggaaugaa

SEQ ID NO: 641634 - RNA, 19 nt, Homo sapiens
cagaagaaguuacaaauag

SEQ ID NO: 641635 - RNA, 19 nt, Homo sapiens
gcagaagaaguuacaaaua

SEQ ID NO: 641636 - RNA, 19 nt, Homo sapiens
gcaaugcuucuaucaaaua

SEQ ID NO: 641637 - RNA, 19 nt, Homo sapiens
gcagaaauuugaaugacaa

SEQ ID NO: 641638 - RNA, 19 nt, Homo sapiens
caucagcuguuaaccauuu

SEQ ID NO: 641639 - RNA, 19 nt, Homo sapiens
gagagaugaugccaaauau

SEQ ID NO: 641640 - RNA, 19 nt, Homo sapiens
uuaccgaccugaauguuua

SEQ ID NO: 641641 - RNA, 19 nt, Homo sapiens
gaucaauccucgaagaaug

SEQ ID NO: 641642 - RNA, 19 nt, Homo sapiens
gagaugaugccaaauauau

SEQ ID NO: 641643 - RNA, 19 nt, Homo sapiens
gcuccuugauaaaguauua

SEQ ID NO: 641644 - RNA, 19 nt, Homo sapiens
gcauaaagcaauugugaaa

SEQ ID NO: 641645 - RNA, 19 nt, Homo sapiens
uuucucagcugccauaaua

SEQ ID NO: 641646 - RNA, 19 nt, Homo sapiens
gaauuuaaccauccucaaa

SEQ ID NO: 641647 - RNA, 19 nt, Homo sapiens
gaaaauggcugguuugucu

SEQ ID NO: 641648 - RNA, 19 nt, Homo sapiens
aggaauguaucacaacuua

SEQ ID NO: 641649 - RNA, 19 nt, Homo sapiens
gacaugaccuuucccuaga

SEQ ID NO: 641650 - RNA, 19 nt, Homo sapiens
gagagcaaauuauggaaau

SEQ ID NO: 641651 - RNA, 19 nt, Homo sapiens
gcgaauagugccugaauuu

SEQ ID NO: 641652 - RNA, 19 nt, Homo sapiens
caugaaacauuacaggaaa

SEQ ID NO: 641653 - RNA, 19 nt, Homo sapiens
gaaacaugcuagugauauc

SEQ ID NO: 641654 - RNA, 19 nt, Homo sapiens
gcuagagaaucaaguuuau

SEQ ID NO: 641655 - RNA, 19 nt, Homo sapiens
gguuuggccucuaucguua

SEQ ID NO: 641656 - RNA, 19 nt, Homo sapiens
caucuauucugccugauuu

SEQ ID NO: 641657 - RNA, 19 nt, Homo sapiens
cuaauuaggucucauccuu

SEQ ID NO: 641658 - RNA, 19 nt, Homo sapiens
ugucaaaucuaguuuccua

SEQ ID NO: 641659 - RNA, 19 nt, Homo sapiens
aggcauccaugaaacauua

SEQ ID NO: 641660 - RNA, 19 nt, Homo sapiens
gcggauacuuugcuuauuc

SEQ ID NO: 641661 - RNA, 19 nt, Homo sapiens
cagggaagucucucuauua

SEQ ID NO: 641662 - RNA, 19 nt, Homo sapiens
gaagaaaggcagaagaagu

SEQ ID NO: 641663 - RNA, 19 nt, Homo sapiens
caacugcuuuccuggauug

SEQ ID NO: 641664 - RNA, 19 nt, Homo sapiens
ccacaggaauguaucacaa

SEQ ID NO: 641665 - RNA, 19 nt, Homo sapiens
ggaagucucucuauuacac

SEQ ID NO: 641666 - RNA, 19 nt, Homo sapiens
gaaccugccugcccuuucu

SEQ ID NO: 641667 - RNA, 19 nt, Homo sapiens
ccgagagcaugaagaauaa

SEQ ID NO: 641668 - RNA, 19 nt, Homo sapiens
aauuaggucucauccuuua

SEQ ID NO: 641669 - RNA, 19 nt, Homo sapiens
aaacugacaggcacuauaa

SEQ ID NO: 641670 - RNA, 19 nt, Homo sapiens
gaauagugccugaauuugu

SEQ ID NO: 641671 - RNA, 19 nt, Homo sapiens
caacuacauucaaguaagu

SEQ ID NO: 641672 - RNA, 19 nt, Homo sapiens
ugacagagguuuugaaaug

SEQ ID NO: 641673 - RNA, 19 nt, Homo sapiens
cacagaaacuauaugcaaa

SEQ ID NO: 641674 - RNA, 19 nt, Homo sapiens
gcuguacuguaauuucuuu

SEQ ID NO: 641675 - RNA, 19 nt, Homo sapiens
gaaaguuauguaccaagua

SEQ ID NO: 641676 - RNA, 19 nt, Homo sapiens
ggaaagauuuuguccagaa

SEQ ID NO: 641677 - RNA, 19 nt, Homo sapiens
cagcugaggguguauuaua

SEQ ID NO: 641678 - RNA, 19 nt, Homo sapiens
ccaaacccguauuuauuga

SEQ ID NO: 641679 - RNA, 19 nt, Homo sapiens
aaagcaaucuggucugaau

SEQ ID NO: 641680 - RNA, 19 nt, Homo sapiens
gaguucgaauagaaaguua

SEQ ID NO: 641681 - RNA, 19 nt, Homo sapiens
gcaagaguucgaauagaaa

SEQ ID NO: 641682 - RNA, 19 nt, Homo sapiens
uaaaucugccugcaacuuu

SEQ ID NO: 641683 - RNA, 19 nt, Homo sapiens
ugacauacuuggagagcaa

SEQ ID NO: 641684 - RNA, 19 nt, Homo sapiens
ucaccaagcccuaucacua

SEQ ID NO: 641685 - RNA, 19 nt, Homo sapiens
ugacaacuacauucaagua

SEQ ID NO: 641686 - RNA, 19 nt, Homo sapiens
agagagaugaugccaaaua

SEQ ID NO: 641687 - RNA, 19 nt, Homo sapiens
gcaauugugaaauacagua

SEQ ID NO: 641688 - RNA, 19 nt, Homo sapiens
ugaaugagccguauacaag

SEQ ID NO: 641689 - RNA, 19 nt, Homo sapiens
ugcaagaguucgaauagaa

SEQ ID NO: 641690 - RNA, 19 nt, Homo sapiens
aauagugccugaauuuguu

SEQ ID NO: 641691 - RNA, 19 nt, Homo sapiens
gcaacugcuuuccuggauu

SEQ ID NO: 641692 - RNA, 19 nt, Homo sapiens
gaaguagcuuugaacuagu

SEQ ID NO: 641693 - RNA, 19 nt, Homo sapiens
gccaaacccguauuuauug

SEQ ID NO: 641694 - RNA, 19 nt, Homo sapiens
caugaauccugugauauug

SEQ ID NO: 641695 - RNA, 19 nt, Homo sapiens
ggagagcaaauuauggaaa

SEQ ID NO: 641696 - RNA, 19 nt, Homo sapiens
ggaaguaguaauugcaaga

SEQ ID NO: 641697 - RNA, 19 nt, Homo sapiens
gaaaugggcauaggugauc

SEQ ID NO: 641698 - RNA, 19 nt, Homo sapiens
uaaguguugugaaacugua

SEQ ID NO: 641699 - RNA, 19 nt, Homo sapiens
ccgcacagcuccgagguuu

SEQ ID NO: 641700 - RNA, 19 nt, Homo sapiens
gugcugaacuggcugaagu

SEQ ID NO: 641701 - RNA, 19 nt, Homo sapiens
gaccacagcaucaaagaau

SEQ ID NO: 641702 - RNA, 19 nt, Homo sapiens
gcugaaacaugcuagugau

SEQ ID NO: 641703 - RNA, 19 nt, Homo sapiens
guccuaggcuggaauguuc

SEQ ID NO: 641704 - RNA, 19 nt, Homo sapiens
caggaagcauaaagcaauu

SEQ ID NO: 641705 - RNA, 19 nt, Homo sapiens
guaucugguuaaugacaua

SEQ ID NO: 641706 - RNA, 19 nt, Homo sapiens
gaaaagaagauggcagaua

SEQ ID NO: 641707 - RNA, 19 nt, Homo sapiens
cauaaacgaagcucucaaa

SEQ ID NO: 641708 - RNA, 19 nt, Homo sapiens
gauuauccaugggugauga

SEQ ID NO: 641709 - RNA, 19 nt, Homo sapiens
cguggacucuucuauguug

SEQ ID NO: 641710 - RNA, 19 nt, Homo sapiens
caucaggcguggacucuuc

SEQ ID NO: 641711 - RNA, 19 nt, Homo sapiens
acagggaagucucucuauu

SEQ ID NO: 641712 - RNA, 19 nt, Homo sapiens
gcccaaggcauccaugaaa

SEQ ID NO: 641713 - RNA, 19 nt, Homo sapiens
gggacuggcugaaccaaag

SEQ ID NO: 641714 - RNA, 19 nt, Homo sapiens
gacauuucccugugacuuu

SEQ ID NO: 641715 - RNA, 19 nt, Homo sapiens
acucuucuauguugacuuu

SEQ ID NO: 641716 - RNA, 19 nt, Homo sapiens
cccgagagcaugaagaaua

SEQ ID NO: 641717 - RNA, 19 nt, Homo sapiens
cagaaacuauaugcaaaga

SEQ ID NO: 641718 - RNA, 19 nt, Homo sapiens
ggcguggacucuucuaugu

SEQ ID NO: 641719 - RNA, 19 nt, Homo sapiens
gaugaugccaaauauaugu

SEQ ID NO: 641720 - RNA, 19 nt, Homo sapiens
uggcaucucuacaauacuu

SEQ ID NO: 641721 - RNA, 19 nt, Homo sapiens
gaauguaucacaacuuaac

SEQ ID NO: 641722 - RNA, 19 nt, Homo sapiens
acacagaaacuauaugcaa

SEQ ID NO: 641723 - RNA, 19 nt, Homo sapiens
uucuuuagcuguacuguaa

SEQ ID NO: 641724 - RNA, 19 nt, Homo sapiens
caaaucuaguuuccuaugg

SEQ ID NO: 641725 - RNA, 19 nt, Homo sapiens
gacaggcacuauaauuucu

SEQ ID NO: 641726 - RNA, 19 nt, Homo sapiens
gggaagaguucacuuauga

SEQ ID NO: 641727 - RNA, 19 nt, Homo sapiens
gaaaugaccaagacuuuaa

SEQ ID NO: 641728 - RNA, 19 nt, Homo sapiens
gaggauaggucagaucauu

SEQ ID NO: 641729 - RNA, 19 nt, Homo sapiens
gagaagagaauuagcguuu

SEQ ID NO: 641730 - RNA, 19 nt, Homo sapiens
uugcagagcuaauaaauga

SEQ ID NO: 641731 - RNA, 19 nt, Homo sapiens
ggaggaauauauuuacuca

SEQ ID NO: 641732 - RNA, 19 nt, Homo sapiens
gcaggugucuacagaagaa

SEQ ID NO: 641733 - RNA, 19 nt, Homo sapiens
ucacaaagcuuccagaacu

SEQ ID NO: 641734 - RNA, 19 nt, Homo sapiens
uacaauagguguggaauuu

SEQ ID NO: 641735 - RNA, 19 nt, Homo sapiens
ggaggguucuugaagcuuu

SEQ ID NO: 641736 - RNA, 19 nt, Homo sapiens
guaacaagauugacauaag

SEQ ID NO: 641737 - RNA, 19 nt, Homo sapiens
ggaaguggauggacauuuu

SEQ ID NO: 641738 - RNA, 19 nt, Homo sapiens
gcacugugaugaaacacuu

SEQ ID NO: 641739 - RNA, 19 nt, Homo sapiens
gauuguugaugcauucuaa

SEQ ID NO: 641740 - RNA, 19 nt, Homo sapiens
gcaggaaaaucaucacuuu

SEQ ID NO: 641741 - RNA, 19 nt, Homo sapiens
ugaaagagccugagagcuu

SEQ ID NO: 641742 - RNA, 19 nt, Homo sapiens
uaaaguaauucuccuugga

SEQ ID NO: 641743 - RNA, 19 nt, Homo sapiens
uaaaugaaaugaccaagac

SEQ ID NO: 641744 - RNA, 19 nt, Homo sapiens
gcagagcuaauaaaugaaa

SEQ ID NO: 641745 - RNA, 19 nt, Homo sapiens
ggaagcgguucgaagaguu

SEQ ID NO: 641746 - RNA, 19 nt, Homo sapiens
uuaaguaacuggaagaaag

SEQ ID NO: 641747 - RNA, 19 nt, Homo sapiens
gauuaacaauggcaggaaa

SEQ ID NO: 641748 - RNA, 19 nt, Homo sapiens
gagugcaucuucucaacaa

SEQ ID NO: 641749 - RNA, 19 nt, Homo sapiens
gaagagaauuagcguuugc

SEQ ID NO: 641750 - RNA, 19 nt, Homo sapiens
guaaguugcagagcuaaua

SEQ ID NO: 641751 - RNA, 19 nt, Homo sapiens
cuaaccaacucacacauau

SEQ ID NO: 641752 - RNA, 19 nt, Homo sapiens
uagcucaucuugcuguuga

SEQ ID NO: 641753 - RNA, 19 nt, Homo sapiens
ggauaggucagaucauuug

SEQ ID NO: 641754 - RNA, 19 nt, Homo sapiens
ugaaaugaccaagacuuua

SEQ ID NO: 641755 - RNA, 19 nt, Homo sapiens
uauguaaguugcagagcua

SEQ ID NO: 641756 - RNA, 19 nt, Homo sapiens
guaaugagccuggcacugu

SEQ ID NO: 641757 - RNA, 19 nt, Homo sapiens
caacggcgacuauccuuau

SEQ ID NO: 641758 - RNA, 19 nt, Homo sapiens
gcuguugauuguuagauug

SEQ ID NO: 641759 - RNA, 19 nt, Homo sapiens
gggauggagaagagaauua

SEQ ID NO: 641760 - RNA, 19 nt, Homo sapiens
uaacaagauugacauaagc

SEQ ID NO: 641761 - RNA, 19 nt, Homo sapiens
guaacuggaagaaagaauu

SEQ ID NO: 641762 - RNA, 19 nt, Homo sapiens
acaguugucuaauaacguu

SEQ ID NO: 641763 - RNA, 19 nt, Homo sapiens
acucaauaauggcaccuua

SEQ ID NO: 641764 - RNA, 19 nt, Homo sapiens
uaaccaacucacacauaua

SEQ ID NO: 641765 - RNA, 19 nt, Homo sapiens
gauucuggguaacaagauu

SEQ ID NO: 641766 - RNA, 19 nt, Homo sapiens
ccugagagcuuuccuuuug

SEQ ID NO: 641767 - RNA, 19 nt, Homo sapiens
ucugacugcugccugcuua

SEQ ID NO: 641768 - RNA, 19 nt, Homo sapiens
uaacaguugucuaauaacg

SEQ ID NO: 641769 - RNA, 19 nt, Homo sapiens
cagucaaucuucaccgaaa

SEQ ID NO: 641770 - RNA, 19 nt, Homo sapiens
guugggaagaguucacuua

SEQ ID NO: 641771 - RNA, 19 nt, Homo sapiens
guugaugcauucuaaccaa

SEQ ID NO: 641772 - RNA, 19 nt, Homo sapiens
ugaggaagcgguucgaaga

SEQ ID NO: 641773 - RNA, 19 nt, Homo sapiens
caaaagaugccacaaaugu

SEQ ID NO: 641774 - RNA, 19 nt, Homo sapiens
gguaacaagauugacauaa

SEQ ID NO: 641775 - RNA, 19 nt, Homo sapiens
gagcuuuccuuuugugauu

SEQ ID NO: 641776 - RNA, 19 nt, Homo sapiens
uaaguugcagagcuaauaa

SEQ ID NO: 641777 - RNA, 19 nt, Homo sapiens
acucacacauauacacaaa

SEQ ID NO: 641778 - RNA, 19 nt, Homo sapiens
guuagauuguugaugcauu

SEQ ID NO: 641779 - RNA, 19 nt, Homo sapiens
ggcagcagccuuugaggaa

SEQ ID NO: 641780 - RNA, 19 nt, Homo sapiens
uaaguaacuggaagaaaga

SEQ ID NO: 641781 - RNA, 19 nt, Homo sapiens
acaaagcuuccagaacuua

SEQ ID NO: 641782 - RNA, 19 nt, Homo sapiens
gaagggacacauccacucu

SEQ ID NO: 641783 - RNA, 19 nt, Homo sapiens
caaagcuuccagaacuuaa

SEQ ID NO: 641784 - RNA, 19 nt, Homo sapiens
cacaaagcuuccagaacuu

SEQ ID NO: 641785 - RNA, 19 nt, Homo sapiens
guugauuguuagauuguug

SEQ ID NO: 641786 - RNA, 19 nt, Homo sapiens
gcucuuccauacaauaggu

SEQ ID NO: 641787 - RNA, 19 nt, Homo sapiens
ccuuggagaugguggaguu

SEQ ID NO: 641788 - RNA, 19 nt, Homo sapiens
agaagagaauuagcguuug

SEQ ID NO: 641789 - RNA, 19 nt, Homo sapiens
uuagauuguugaugcauuc

SEQ ID NO: 641790 - RNA, 19 nt, Homo sapiens
uaacuggaagaaagaauuc

SEQ ID NO: 641791 - RNA, 19 nt, Homo sapiens
uuccagaacuuaaguaacu

SEQ ID NO: 641792 - RNA, 19 nt, Homo sapiens
gcccaagccuagcucaucu

SEQ ID NO: 641793 - RNA, 19 nt, Homo sapiens
cgacuauccuuauuuugaa

SEQ ID NO: 641794 - RNA, 19 nt, Homo sapiens
acccagcucuuccauacaa

SEQ ID NO: 641795 - RNA, 19 nt, Homo sapiens
gcaguguaucaucuacuaa

SEQ ID NO: 641796 - RNA, 19 nt, Homo sapiens
gcagcaguguaucaucuac

SEQ ID NO: 641797 - RNA, 19 nt, Homo sapiens
caacucacacauauacaca

SEQ ID NO: 641798 - RNA, 19 nt, Homo sapiens
ucuaaccaacucacacaua

SEQ ID NO: 641799 - RNA, 19 nt, Homo sapiens
gauacccagcucuuccaua

SEQ ID NO: 641800 - RNA, 19 nt, Homo sapiens
ugggaagaguucacuuaug

SEQ ID NO: 641801 - RNA, 19 nt, Homo sapiens
aaauguggcagcagccuuu

SEQ ID NO: 641802 - RNA, 19 nt, Homo sapiens
ugaaacaagugcaaaagau

SEQ ID NO: 641803 - RNA, 19 nt, Homo sapiens
auacccagcucuuccauac

SEQ ID NO: 641804 - RNA, 19 nt, Homo sapiens
agcaguguaucaucuacua

SEQ ID NO: 641805 - RNA, 19 nt, Homo sapiens
ucaucuugcuguugauugu

SEQ ID NO: 641806 - RNA, 19 nt, Homo sapiens
cagacacagucaaucuuca

SEQ ID NO: 641807 - RNA, 19 nt, Homo sapiens
gagccuggcacugugauga

SEQ ID NO: 641808 - RNA, 19 nt, Homo sapiens
acugcugccugcuuacuuu

SEQ ID NO: 641809 - RNA, 19 nt, Homo sapiens
gaagcgguucgaagaguuc

SEQ ID NO: 641810 - RNA, 19 nt, Homo sapiens
ggacaacggcgacuauccu

SEQ ID NO: 641811 - RNA, 19 nt, Homo sapiens
cggcaggugucuacagaag

SEQ ID NO: 641812 - RNA, 19 nt, Homo sapiens
uagugucgaugauucacaa

SEQ ID NO: 641813 - RNA, 19 nt, Homo sapiens
ccagcucuuccauacaaua

SEQ ID NO: 641814 - RNA, 19 nt, Homo sapiens
ucaauaauggcaccuuaca

SEQ ID NO: 641815 - RNA, 19 nt, Homo sapiens
agggacacauccacucuug

SEQ ID NO: 641816 - RNA, 19 nt, Homo sapiens
ggauggagaagagaauuag

SEQ ID NO: 641817 - RNA, 19 nt, Homo sapiens
gacagacacagucaaucuu

SEQ ID NO: 641818 - RNA, 19 nt, Homo sapiens
agacagacacagucaaucu

SEQ ID NO: 641819 - RNA, 19 nt, Homo sapiens
ucacuuaugaacagauaug

SEQ ID NO: 641820 - RNA, 19 nt, Homo sapiens
gaacggcaggugucuacag

SEQ ID NO: 641821 - RNA, 19 nt, Homo sapiens
ggguaacaagauugacaua

SEQ ID NO: 641822 - RNA, 19 nt, Homo sapiens
gagcucccgggucgucuuu

SEQ ID NO: 641823 - RNA, 19 nt, Homo sapiens
ucagacagacacagucaau

SEQ ID NO: 641824 - RNA, 19 nt, Homo sapiens
gaaacaagugcaaaagaug

SEQ ID NO: 641825 - RNA, 19 nt, Homo sapiens
gcgacuauccuuauuuuga

SEQ ID NO: 641826 - RNA, 19 nt, Homo sapiens
guccagggcugaucaaaga

SEQ ID NO: 641827 - RNA, 19 nt, Homo sapiens
gcagagugaucccaucuca

SEQ ID NO: 641828 - RNA, 19 nt, Homo sapiens
gcaguggccucagccuuaa

SEQ ID NO: 641829 - RNA, 19 nt, Homo sapiens
ggccucagccuuaaacuuu

SEQ ID NO: 641830 - RNA, 19 nt, Homo sapiens
ccagguaccaccauuguaa

SEQ ID NO: 641831 - RNA, 19 nt, Homo sapiens
gggcaucuguuauccugaa

SEQ ID NO: 641832 - RNA, 19 nt, Homo sapiens
cagauggacuggagcaaga

SEQ ID NO: 641833 - RNA, 19 nt, Homo sapiens
guaccaccauuguaaggaa

SEQ ID NO: 641834 - RNA, 19 nt, Homo sapiens
gagcugaauucccaagaca

SEQ ID NO: 641835 - RNA, 19 nt, Homo sapiens
ggcaguggccucagccuua

SEQ ID NO: 641836 - RNA, 19 nt, Homo sapiens
ccucggcucuguaccauga

SEQ ID NO: 641837 - RNA, 19 nt, Homo sapiens
uagggaaggugaauguguu

SEQ ID NO: 641838 - RNA, 19 nt, Homo sapiens
agagagggcccaccagaaa

SEQ ID NO: 641839 - RNA, 19 nt, Homo sapiens
cugaaucaauguacaaauc

SEQ ID NO: 641840 - RNA, 19 nt, Homo sapiens
uucaagaaaugcagaguga

SEQ ID NO: 641841 - RNA, 19 nt, Homo sapiens
caagaaaugcagagugauc

SEQ ID NO: 641842 - RNA, 19 nt, Homo sapiens
uguuaagagugcaguauug

SEQ ID NO: 641843 - RNA, 19 nt, Homo sapiens
gcgaaaacguggagaagga

SEQ ID NO: 641844 - RNA, 19 nt, Homo sapiens
gcugaucaaagaacucuga

SEQ ID NO: 641845 - RNA, 19 nt, Homo sapiens
guucuucccugacuuuagg

SEQ ID NO: 641846 - RNA, 19 nt, Homo sapiens
gaaucaauguacaaaucag

SEQ ID NO: 641847 - RNA, 19 nt, Homo sapiens
gaaggagaacagucgugaa

SEQ ID NO: 641848 - RNA, 19 nt, Homo sapiens
uaacaugauuuuccugguu

SEQ ID NO: 641849 - RNA, 19 nt, Homo sapiens
ccagaaacgcagcagcaaa

SEQ ID NO: 641850 - RNA, 19 nt, Homo sapiens
ccugugcccuucaccaaug

SEQ ID NO: 641851 - RNA, 19 nt, Homo sapiens
ggagcugaauucccaagac

SEQ ID NO: 641852 - RNA, 19 nt, Homo sapiens
aaaacgaacucuucagcaa

SEQ ID NO: 641853 - RNA, 19 nt, Homo sapiens
cauccuagacuucaacauc

SEQ ID NO: 641854 - RNA, 19 nt, Homo sapiens
ugagauccgccuccaguga

SEQ ID NO: 641855 - RNA, 19 nt, Homo sapiens
ugcagagucuagaggaauu

SEQ ID NO: 641856 - RNA, 19 nt, Homo sapiens
gcagagucuagaggaauuu

SEQ ID NO: 641857 - RNA, 19 nt, Homo sapiens
gcacgagggauuggucugu

SEQ ID NO: 641858 - RNA, 19 nt, Homo sapiens
ugagccagguaccaccauu

SEQ ID NO: 641859 - RNA, 19 nt, Homo sapiens
gcaaguugggccaguacau

SEQ ID NO: 641860 - RNA, 19 nt, Homo sapiens
cagaaacgcagcagcaaac

SEQ ID NO: 641861 - RNA, 19 nt, Homo sapiens
ggcccaggaucgcauugug

SEQ ID NO: 641862 - RNA, 19 nt, Homo sapiens
uaccaccauuguaaggaaa

SEQ ID NO: 641863 - RNA, 19 nt, Homo sapiens
gggagauacagaaggagaa

SEQ ID NO: 641864 - RNA, 19 nt, Homo sapiens
gagccagguaccaccauug

SEQ ID NO: 641865 - RNA, 19 nt, Homo sapiens
gauggacuggagcaagaaa

SEQ ID NO: 641866 - RNA, 19 nt, Homo sapiens
cggacgagcagcugcagaa

SEQ ID NO: 641867 - RNA, 19 nt, Homo sapiens
uauguucuucccugacuuu

SEQ ID NO: 641868 - RNA, 19 nt, Homo sapiens
caaguugggccaguacauc

SEQ ID NO: 641869 - RNA, 19 nt, Homo sapiens
gccagguaccaccauugua

SEQ ID NO: 641870 - RNA, 19 nt, Homo sapiens
gaaaucacccucuccuuua

SEQ ID NO: 641871 - RNA, 19 nt, Homo sapiens
ggagaagucccaucaauuu

SEQ ID NO: 641872 - RNA, 19 nt, Homo sapiens
gaaaggugaucucuauaug

SEQ ID NO: 641873 - RNA, 19 nt, Homo sapiens
gaaccgugcuggccuuauu

SEQ ID NO: 641874 - RNA, 19 nt, Homo sapiens
ggacugccaugcucaacua

SEQ ID NO: 641875 - RNA, 19 nt, Homo sapiens
gaaagccacucagaagaaa

SEQ ID NO: 641876 - RNA, 19 nt, Homo sapiens
gaagagcggccacaagaaa

SEQ ID NO: 641877 - RNA, 19 nt, Homo sapiens
ggaaaccacuacuacaaug

SEQ ID NO: 641878 - RNA, 19 nt, Homo sapiens
gaaaaucuauggcgaaguu

SEQ ID NO: 641879 - RNA, 19 nt, Homo sapiens
ucucugggcucuauuauga

SEQ ID NO: 641880 - RNA, 19 nt, Homo sapiens
gagcagcagugaugaaauc

SEQ ID NO: 641881 - RNA, 19 nt, Homo sapiens
gagaacaaccccaauauua

SEQ ID NO: 641882 - RNA, 19 nt, Homo sapiens
ggcagaagcucaaugacaa

SEQ ID NO: 641883 - RNA, 19 nt, Homo sapiens
ggacaaaggacgccucuuc

SEQ ID NO: 641884 - RNA, 19 nt, Homo sapiens
ccagauggcuucauucucu

SEQ ID NO: 641885 - RNA, 19 nt, Homo sapiens
gaugaagacuuuguugaau

SEQ ID NO: 641886 - RNA, 19 nt, Homo sapiens
cugcagagccucauguuua

SEQ ID NO: 641887 - RNA, 19 nt, Homo sapiens
ccagaaaugucuacuacug

SEQ ID NO: 641888 - RNA, 19 nt, Homo sapiens
ggaaaccagugcaaugauc

SEQ ID NO: 641889 - RNA, 19 nt, Homo sapiens
aaacgggaaucaugacuga

SEQ ID NO: 641890 - RNA, 19 nt, Homo sapiens
gcuacgaccugucucagaa

SEQ ID NO: 641891 - RNA, 19 nt, Homo sapiens
acaaggacagggaguauua

SEQ ID NO: 641892 - RNA, 19 nt, Homo sapiens
cgacagugcuccaggacuu

SEQ ID NO: 641893 - RNA, 19 nt, Homo sapiens
gaaaguggacaccaaagug

SEQ ID NO: 641894 - RNA, 19 nt, Homo sapiens
ugaaaucacccucuccuuu

SEQ ID NO: 641895 - RNA, 19 nt, Homo sapiens
cuucauggcuuacuuguuc

SEQ ID NO: 641896 - RNA, 19 nt, Homo sapiens
ucacucagguuaucaaugg

SEQ ID NO: 641897 - RNA, 19 nt, Homo sapiens
gauggcagaucagguacua

SEQ ID NO: 641898 - RNA, 19 nt, Homo sapiens
gaacauggcggcugagaac

SEQ ID NO: 641899 - RNA, 19 nt, Homo sapiens
gacaauaguaacacucaua

SEQ ID NO: 641900 - RNA, 19 nt, Homo sapiens
cagaucagguacuauauca

SEQ ID NO: 641901 - RNA, 19 nt, Homo sapiens
cgagauggcagaucaggua

SEQ ID NO: 641902 - RNA, 19 nt, Homo sapiens
ggacgacuucuucuaugua

SEQ ID NO: 641903 - RNA, 19 nt, Homo sapiens
ggaaacggucccaauguga

SEQ ID NO: 641904 - RNA, 19 nt, Homo sapiens
gaacaaccccaauauuaaa

SEQ ID NO: 641905 - RNA, 19 nt, Homo sapiens
gugucaagcucaugguuaa

SEQ ID NO: 641906 - RNA, 19 nt, Homo sapiens
gacaacgccuggcaugaug

SEQ ID NO: 641907 - RNA, 19 nt, Homo sapiens
aaaucacccucuccuuuaa

SEQ ID NO: 641908 - RNA, 19 nt, Homo sapiens
uugugaagcuugacuguaa

SEQ ID NO: 641909 - RNA, 19 nt, Homo sapiens
caagugagucuguaauguu

SEQ ID NO: 641910 - RNA, 19 nt, Homo sapiens
uggcuuacuuguuccauaa

SEQ ID NO: 641911 - RNA, 19 nt, Homo sapiens
cgaugcaucucucucuaaa

SEQ ID NO: 641912 - RNA, 19 nt, Homo sapiens
ugaagacuuuguugaaugu

SEQ ID NO: 641913 - RNA, 19 nt, Homo sapiens
gcgaaguuguguuuaagug

SEQ ID NO: 641914 - RNA, 19 nt, Homo sapiens
uuugaaaggugaucucuau

SEQ ID NO: 641915 - RNA, 19 nt, Homo sapiens
gguggucccucucuucguu

SEQ ID NO: 641916 - RNA, 19 nt, Homo sapiens
uagcaucaguggacuugaa

SEQ ID NO: 641917 - RNA, 19 nt, Homo sapiens
ccaauggccugauccucuu

SEQ ID NO: 641918 - RNA, 19 nt, Homo sapiens
gaucgagcguggcugugaa

SEQ ID NO: 641919 - RNA, 19 nt, Homo sapiens
aagugagucuguaauguuu

SEQ ID NO: 641920 - RNA, 19 nt, Homo sapiens
ccaagugagucuguaaugu

SEQ ID NO: 641921 - RNA, 19 nt, Homo sapiens
ccgcaggccuggaaacuuc

SEQ ID NO: 641922 - RNA, 19 nt, Homo sapiens
aggagaauguggccacuuu

SEQ ID NO: 641923 - RNA, 19 nt, Homo sapiens
guggugggcuuauccucua

SEQ ID NO: 641924 - RNA, 19 nt, Homo sapiens
ugcagagccucauguuuaa

SEQ ID NO: 641925 - RNA, 19 nt, Homo sapiens
ugaaagccacucagaagaa

SEQ ID NO: 641926 - RNA, 19 nt, Homo sapiens
gcacgcucaugaaggagaa

SEQ ID NO: 641927 - RNA, 19 nt, Homo sapiens
caccagaaaugucuacuac

SEQ ID NO: 641928 - RNA, 19 nt, Homo sapiens
gcucuauuaugaugguuug

SEQ ID NO: 641929 - RNA, 19 nt, Homo sapiens
ugaaaggugaucucuauau

SEQ ID NO: 641930 - RNA, 19 nt, Homo sapiens
gguuaucaauggugccaaa

SEQ ID NO: 641931 - RNA, 19 nt, Homo sapiens
gggaagaaccugcgaaagg

SEQ ID NO: 641932 - RNA, 19 nt, Homo sapiens
guaggaggaagcccaagua

SEQ ID NO: 641933 - RNA, 19 nt, Homo sapiens
caaccuggcucugaaggau

SEQ ID NO: 641934 - RNA, 19 nt, Homo sapiens
ccacgccuaugaaucuuug

SEQ ID NO: 641935 - RNA, 19 nt, Homo sapiens
caaaggacgccucuuccaa

SEQ ID NO: 641936 - RNA, 19 nt, Homo sapiens
uaacacucauagccugaaa

SEQ ID NO: 641937 - RNA, 19 nt, Homo sapiens
gacaaccaguggcacaaug

SEQ ID NO: 641938 - RNA, 19 nt, Homo sapiens
gaccagagaccuuguaugc

SEQ ID NO: 641939 - RNA, 19 nt, Homo sapiens
gaucagguacuauaucagu

SEQ ID NO: 641940 - RNA, 19 nt, Homo sapiens
ucagcgagauggcagauca

SEQ ID NO: 641941 - RNA, 19 nt, Homo sapiens
gaacugcuggaacuaugaa

SEQ ID NO: 641942 - RNA, 19 nt, Homo sapiens
cagaacugcuggaacuaug

SEQ ID NO: 641943 - RNA, 19 nt, Homo sapiens
gcauucagccaacaucaga

SEQ ID NO: 641944 - RNA, 19 nt, Homo sapiens
ggagagaaccccuguaaau

SEQ ID NO: 641945 - RNA, 19 nt, Homo sapiens
uggcagagaugcagaaugc

SEQ ID NO: 641946 - RNA, 19 nt, Homo sapiens
uggcagaucagguacuaua

SEQ ID NO: 641947 - RNA, 19 nt, Homo sapiens
gugcccugcuguaucauaa

SEQ ID NO: 641948 - RNA, 19 nt, Homo sapiens
gcaucuugauccuccugua

SEQ ID NO: 641949 - RNA, 19 nt, Homo sapiens
ucuaugaccucuuauucug

SEQ ID NO: 641950 - RNA, 19 nt, Homo sapiens
gaaacggucccaaugugau

SEQ ID NO: 641951 - RNA, 19 nt, Homo sapiens
caauaguggugauggcaau

SEQ ID NO: 641952 - RNA, 19 nt, Homo sapiens
uuaauggccuucucuacau

SEQ ID NO: 641953 - RNA, 19 nt, Homo sapiens
ggagccagaagaauacaaa

SEQ ID NO: 641954 - RNA, 19 nt, Homo sapiens
ggaacuacaucagcaacuc

SEQ ID NO: 641955 - RNA, 19 nt, Homo sapiens
ccaacucucugggcucuau

SEQ ID NO: 641956 - RNA, 19 nt, Homo sapiens
caacacagacgaccuccau

SEQ ID NO: 641957 - RNA, 19 nt, Homo sapiens
cggaaacggucccaaugug

SEQ ID NO: 641958 - RNA, 19 nt, Homo sapiens
ccagaagaauacaaaagua

SEQ ID NO: 641959 - RNA, 19 nt, Homo sapiens
ugucagaacugcuggaacu

SEQ ID NO: 641960 - RNA, 19 nt, Homo sapiens
gcaguuaaccaucuucaac

SEQ ID NO: 641961 - RNA, 19 nt, Homo sapiens
cuggagggcuugaggaaug

SEQ ID NO: 641962 - RNA, 19 nt, Homo sapiens
gggcagaagcucaaugaca

SEQ ID NO: 641963 - RNA, 19 nt, Homo sapiens
gcggucuccuuggucauua

SEQ ID NO: 641964 - RNA, 19 nt, Homo sapiens
gauguguccuuccgcuuca

SEQ ID NO: 641965 - RNA, 19 nt, Homo sapiens
ugaugaagacuuuguugaa

SEQ ID NO: 641966 - RNA, 19 nt, Homo sapiens
caagcucaugguuaacuua

SEQ ID NO: 641967 - RNA, 19 nt, Homo sapiens
cagaagaaagccaaugaug

SEQ ID NO: 641968 - RNA, 19 nt, Homo sapiens
gacgacuucuucuauguag

SEQ ID NO: 641969 - RNA, 19 nt, Homo sapiens
gcugggagacagaagguuu

SEQ ID NO: 641970 - RNA, 19 nt, Homo sapiens
ggagaagucccaucaauuu

SEQ ID NO: 641971 - RNA, 19 nt, Homo sapiens
gaauaaccgugaucucaaa

SEQ ID NO: 641972 - RNA, 19 nt, Homo sapiens
cugaagagcccacuaauua

SEQ ID NO: 641973 - RNA, 19 nt, Homo sapiens
gaagagcggccacaagaaa

SEQ ID NO: 641974 - RNA, 19 nt, Homo sapiens
gaugauggcuuggugauau

SEQ ID NO: 641975 - RNA, 19 nt, Homo sapiens
ggaaaccacuacuacaaug

SEQ ID NO: 641976 - RNA, 19 nt, Homo sapiens
ggaggacccuggcauucua

SEQ ID NO: 641977 - RNA, 19 nt, Homo sapiens
gggaaaccuuugacucuaa

SEQ ID NO: 641978 - RNA, 19 nt, Homo sapiens
gcauauugcuucccucuuc

SEQ ID NO: 641979 - RNA, 19 nt, Homo sapiens
ggacuacuaccacaucuuu

SEQ ID NO: 641980 - RNA, 19 nt, Homo sapiens
ucucugggcucuauuauga

SEQ ID NO: 641981 - RNA, 19 nt, Homo sapiens
gagaacaaccccaauauua

SEQ ID NO: 641982 - RNA, 19 nt, Homo sapiens
gaguacaggaggugaauua

SEQ ID NO: 641983 - RNA, 19 nt, Homo sapiens
ggacaaaggacgccucuuc

SEQ ID NO: 641984 - RNA, 19 nt, Homo sapiens
guauggaguucuucuaaug

SEQ ID NO: 641985 - RNA, 19 nt, Homo sapiens
gaugaagacuuuguugaau

SEQ ID NO: 641986 - RNA, 19 nt, Homo sapiens
ccagaaaugucuacuacug

SEQ ID NO: 641987 - RNA, 19 nt, Homo sapiens
uacaggaggugaauuaguu

SEQ ID NO: 641988 - RNA, 19 nt, Homo sapiens
acaaggacagggaguauua

SEQ ID NO: 641989 - RNA, 19 nt, Homo sapiens
guagaagacccuuuagcua

SEQ ID NO: 641990 - RNA, 19 nt, Homo sapiens
cgacagugcuccaggacuu

SEQ ID NO: 641991 - RNA, 19 nt, Homo sapiens
cuucauggcuuacuuguuc

SEQ ID NO: 641992 - RNA, 19 nt, Homo sapiens
gaacauggcggcugagaac

SEQ ID NO: 641993 - RNA, 19 nt, Homo sapiens
gggauaaacucaccugaac

SEQ ID NO: 641994 - RNA, 19 nt, Homo sapiens
gaacaaccccaauauuaaa

SEQ ID NO: 641995 - RNA, 19 nt, Homo sapiens
cuucgaagguggcuacaaa

SEQ ID NO: 641996 - RNA, 19 nt, Homo sapiens
uugugaagcuugacuguaa

SEQ ID NO: 641997 - RNA, 19 nt, Homo sapiens
caagugagucuguaauguu

SEQ ID NO: 641998 - RNA, 19 nt, Homo sapiens
uggcuuacuuguuccauaa

SEQ ID NO: 641999 - RNA, 19 nt, Homo sapiens
cgaugcaucucucucuaaa

SEQ ID NO: 642000 - RNA, 19 nt, Homo sapiens
ugaagacuuuguugaaugu

SEQ ID NO: 642001 - RNA, 19 nt, Homo sapiens
aaacugaagagcccacuaa

SEQ ID NO: 642002 - RNA, 19 nt, Homo sapiens
uaacaaagucuccgaaacu

SEQ ID NO: 642003 - RNA, 19 nt, Homo sapiens
cuacugaugaugaagauuu

SEQ ID NO: 642004 - RNA, 19 nt, Homo sapiens
aagugagucuguaauguuu

SEQ ID NO: 642005 - RNA, 19 nt, Homo sapiens
ccaagugagucuguaaugu

SEQ ID NO: 642006 - RNA, 19 nt, Homo sapiens
ccgcaggccuggaaacuuc

SEQ ID NO: 642007 - RNA, 19 nt, Homo sapiens
guggugggcuuauccucua

SEQ ID NO: 642008 - RNA, 19 nt, Homo sapiens
gacccuggcauucuaaauu

SEQ ID NO: 642009 - RNA, 19 nt, Homo sapiens
gcacgcucaugaaggagaa

SEQ ID NO: 642010 - RNA, 19 nt, Homo sapiens
uccaaggacuuuagaccua

SEQ ID NO: 642011 - RNA, 19 nt, Homo sapiens
caccagaaaugucuacuac

SEQ ID NO: 642012 - RNA, 19 nt, Homo sapiens
gcucuauuaugaugguuug

SEQ ID NO: 642013 - RNA, 19 nt, Homo sapiens
ccacgccuaugaaucuuug

SEQ ID NO: 642014 - RNA, 19 nt, Homo sapiens
caaaggacgccucuuccaa

SEQ ID NO: 642015 - RNA, 19 nt, Homo sapiens
gaacugcuggaacuaugaa

SEQ ID NO: 642016 - RNA, 19 nt, Homo sapiens
cagaacugcuggaacuaug

SEQ ID NO: 642017 - RNA, 19 nt, Homo sapiens
gaagagcccacuaauuacu

SEQ ID NO: 642018 - RNA, 19 nt, Homo sapiens
cuagacagcaccaaacuga

SEQ ID NO: 642019 - RNA, 19 nt, Homo sapiens
uuaguuaucccucuucuug

SEQ ID NO: 642020 - RNA, 19 nt, Homo sapiens
gcauucagccaacaucaga

SEQ ID NO: 642021 - RNA, 19 nt, Homo sapiens
ggagagaaccccuguaaau

SEQ ID NO: 642022 - RNA, 19 nt, Homo sapiens
gugcccugcuguaucauaa

SEQ ID NO: 642023 - RNA, 19 nt, Homo sapiens
gcaucuugauccuccugua

SEQ ID NO: 642024 - RNA, 19 nt, Homo sapiens
aacaaagucuccgaaacua

SEQ ID NO: 642025 - RNA, 19 nt, Homo sapiens
ugaauuaguuaucccucuu

SEQ ID NO: 642026 - RNA, 19 nt, Homo sapiens
ggaacuacaucagcaacuc

SEQ ID NO: 642027 - RNA, 19 nt, Homo sapiens
ccaacucucugggcucuau

SEQ ID NO: 642028 - RNA, 19 nt, Homo sapiens
caaagucuccgaaacuagu

SEQ ID NO: 642029 - RNA, 19 nt, Homo sapiens
aaagauucccuguccauga

SEQ ID NO: 642030 - RNA, 19 nt, Homo sapiens
aguuaucccucuucuugua

SEQ ID NO: 642031 - RNA, 19 nt, Homo sapiens
caacacagacgaccuccau

SEQ ID NO: 642032 - RNA, 19 nt, Homo sapiens
gcagcaagcaucacucagu

SEQ ID NO: 642033 - RNA, 19 nt, Homo sapiens
ucaaacuccuuggauguug

SEQ ID NO: 642034 - RNA, 19 nt, Homo sapiens
ugucagaacugcuggaacu

SEQ ID NO: 642035 - RNA, 19 nt, Homo sapiens
gcaguuaaccaucuucaac

SEQ ID NO: 642036 - RNA, 19 nt, Homo sapiens
ugaugaagacuuuguugaa

SEQ ID NO: 642037 - RNA, 19 nt, Homo sapiens
acccuggcauucuaaauuu

SEQ ID NO: 642038 - RNA, 19 nt, Homo sapiens
ggagugugcgguuaaguca

SEQ ID NO: 642039 - RNA, 19 nt, Homo sapiens
gcugggagacagaagguuu

SEQ ID NO: 642040 - RNA, 19 nt, Homo sapiens
gcgaugcaucucucucuaa

SEQ ID NO: 642041 - RNA, 19 nt, Homo sapiens
gaaaugggguauauaacca

SEQ ID NO: 642042 - RNA, 19 nt, Homo sapiens
ggaaaccuuugacucuaac

SEQ ID NO: 642043 - RNA, 19 nt, Homo sapiens
cguaggagguuugcuauac

SEQ ID NO: 642044 - RNA, 19 nt, Homo sapiens
uaugaugguuugaaaguac

SEQ ID NO: 642045 - RNA, 19 nt, Homo sapiens
uaauguuugugaagcuuga

SEQ ID NO: 642046 - RNA, 19 nt, Homo sapiens
ucauaaagcacacacuuag

SEQ ID NO: 642047 - RNA, 19 nt, Homo sapiens
cuccuuggauguugggaua

SEQ ID NO: 642048 - RNA, 19 nt, Homo sapiens
ucgaagagcggccacaaga

SEQ ID NO: 642049 - RNA, 19 nt, Homo sapiens
ggaauccaaggacuuuaga

SEQ ID NO: 642050 - RNA, 19 nt, Homo sapiens
gaugaugaagacuuuguug

SEQ ID NO: 642051 - RNA, 19 nt, Homo sapiens
caaauagccauugguggaa

SEQ ID NO: 642052 - RNA, 19 nt, Homo sapiens
cuccuucucuuccuucauu

SEQ ID NO: 642053 - RNA, 19 nt, Homo sapiens
gcaacggcacgcucaugaa

SEQ ID NO: 642054 - RNA, 19 nt, Homo sapiens
ugaauaaccgugaucucaa

SEQ ID NO: 642055 - RNA, 19 nt, Homo sapiens
cuacuacaauggcgacuac

SEQ ID NO: 642056 - RNA, 19 nt, Homo sapiens
gaaaugucuacuacuguca

SEQ ID NO: 642057 - RNA, 19 nt, Homo sapiens
caacuccucgcuucacuuc

SEQ ID NO: 642058 - RNA, 19 nt, Homo sapiens
aaauuggaguugucuucaa

SEQ ID NO: 642059 - RNA, 19 nt, Homo sapiens
gugagucuguaauguuugu

SEQ ID NO: 642060 - RNA, 19 nt, Homo sapiens
aaauagccauugguggaaa

SEQ ID NO: 642061 - RNA, 19 nt, Homo sapiens
aaacugcccaucuguagug

SEQ ID NO: 642062 - RNA, 19 nt, Homo sapiens
gcaacucuuccuccugcua

SEQ ID NO: 642063 - RNA, 19 nt, Homo sapiens
uaaaggacacacacacaca

SEQ ID NO: 642064 - RNA, 19 nt, Homo sapiens
uuauugagaccaccaaaga

SEQ ID NO: 642065 - RNA, 19 nt, Homo sapiens
ggaggugaauuaguuaucc

SEQ ID NO: 642066 - RNA, 19 nt, Homo sapiens
guacaggaggugaauuagu

SEQ ID NO: 642067 - RNA, 19 nt, Homo sapiens
ccacaacccguaagaaucg

SEQ ID NO: 642068 - RNA, 19 nt, Homo sapiens
gaggagagaaccccuguaa

SEQ ID NO: 642069 - RNA, 19 nt, Homo sapiens
ucaaacugcccaucuguag

SEQ ID NO: 642070 - RNA, 19 nt, Homo sapiens
gaacacgcuuucacaguua

SEQ ID NO: 642071 - RNA, 19 nt, Homo sapiens
gaaguacaauuguggauuu

SEQ ID NO: 642072 - RNA, 19 nt, Homo sapiens
gaaagugguucuaugauga

SEQ ID NO: 642073 - RNA, 19 nt, Homo sapiens
gagcuucucugaugugaua

SEQ ID NO: 642074 - RNA, 19 nt, Homo sapiens
ccagauaacugacuagaaa

SEQ ID NO: 642075 - RNA, 19 nt, Homo sapiens
ucacaaacaugaccagaua

SEQ ID NO: 642076 - RNA, 19 nt, Homo sapiens
ggaaaucccugguuuaagu

SEQ ID NO: 642077 - RNA, 19 nt, Homo sapiens
gaaaggagauccaggucuu

SEQ ID NO: 642078 - RNA, 19 nt, Homo sapiens
gacaauaacuccagugaug

SEQ ID NO: 642079 - RNA, 19 nt, Homo sapiens
gaauuugccuuccucauga

SEQ ID NO: 642080 - RNA, 19 nt, Homo sapiens
ggucaagauuucaggauua

SEQ ID NO: 642081 - RNA, 19 nt, Homo sapiens
gagaguaagccuuguguua

SEQ ID NO: 642082 - RNA, 19 nt, Homo sapiens
cagaacacguccagaauuu

SEQ ID NO: 642083 - RNA, 19 nt, Homo sapiens
aaacugaggucaagauuuc

SEQ ID NO: 642084 - RNA, 19 nt, Homo sapiens
gcucauaucaauccuauaa

SEQ ID NO: 642085 - RNA, 19 nt, Homo sapiens
ggacaaggcuaugcucuuc

SEQ ID NO: 642086 - RNA, 19 nt, Homo sapiens
gaaaggagaaccuggagaa

SEQ ID NO: 642087 - RNA, 19 nt, Homo sapiens
uaugauggcuccacuggua

SEQ ID NO: 642088 - RNA, 19 nt, Homo sapiens
gccaggagcuucucugaug

SEQ ID NO: 642089 - RNA, 19 nt, Homo sapiens
caccacacauggcuaauuu

SEQ ID NO: 642090 - RNA, 19 nt, Homo sapiens
gccauugucuccuugagua

SEQ ID NO: 642091 - RNA, 19 nt, Homo sapiens
gauaaaugccucaugaaga

SEQ ID NO: 642092 - RNA, 19 nt, Homo sapiens
caucacaccuggucaacuu

SEQ ID NO: 642093 - RNA, 19 nt, Homo sapiens
gaaauuaccagaguuguuc

SEQ ID NO: 642094 - RNA, 19 nt, Homo sapiens
ugucuaaggucacacagua

SEQ ID NO: 642095 - RNA, 19 nt, Homo sapiens
agacauagcuggaaaauuc

SEQ ID NO: 642096 - RNA, 19 nt, Homo sapiens
gaggaauucugaagccauu

SEQ ID NO: 642097 - RNA, 19 nt, Homo sapiens
ccauaucuacccagaauua

SEQ ID NO: 642098 - RNA, 19 nt, Homo sapiens
gagaaggugccuauguaua

SEQ ID NO: 642099 - RNA, 19 nt, Homo sapiens
guaauguccuucuuuaucu

SEQ ID NO: 642100 - RNA, 19 nt, Homo sapiens
gaaauaggagaguggauga

SEQ ID NO: 642101 - RNA, 19 nt, Homo sapiens
ucaggaggaugaaauauuc

SEQ ID NO: 642102 - RNA, 19 nt, Homo sapiens
gaagcucucuuucccagau

SEQ ID NO: 642103 - RNA, 19 nt, Homo sapiens
gcugggagcuguucuacug

SEQ ID NO: 642104 - RNA, 19 nt, Homo sapiens
gacaaugacuccaccuuca

SEQ ID NO: 642105 - RNA, 19 nt, Homo sapiens
gaaacugaggucaagauuu

SEQ ID NO: 642106 - RNA, 19 nt, Homo sapiens
ccugagagccauugaauuu

SEQ ID NO: 642107 - RNA, 19 nt, Homo sapiens
caacaugcccauucgcuuu

SEQ ID NO: 642108 - RNA, 19 nt, Homo sapiens
guuguucugucuuuagaua

SEQ ID NO: 642109 - RNA, 19 nt, Homo sapiens
gacugggccuccugaauuu

SEQ ID NO: 642110 - RNA, 19 nt, Homo sapiens
ccacugaaguuagggauga

SEQ ID NO: 642111 - RNA, 19 nt, Homo sapiens
uggagaaggugccuaugua

SEQ ID NO: 642112 - RNA, 19 nt, Homo sapiens
ccaauucucuuuaguucug

SEQ ID NO: 642113 - RNA, 19 nt, Homo sapiens
caguauaguucuaggguuu

SEQ ID NO: 642114 - RNA, 19 nt, Homo sapiens
gagagaaacugaggucaag

SEQ ID NO: 642115 - RNA, 19 nt, Homo sapiens
agacaggguuucaccauau

SEQ ID NO: 642116 - RNA, 19 nt, Homo sapiens
ggagauccaggucuuauug

SEQ ID NO: 642117 - RNA, 19 nt, Homo sapiens
gcacagggaacaagcauuc

SEQ ID NO: 642118 - RNA, 19 nt, Homo sapiens
gaaagaaguaguugacagu

SEQ ID NO: 642119 - RNA, 19 nt, Homo sapiens
gcuaugcucuucaccuaug

SEQ ID NO: 642120 - RNA, 19 nt, Homo sapiens
caacagaggccugagagaa

SEQ ID NO: 642121 - RNA, 19 nt, Homo sapiens
agaacacgcuuucacaguu

SEQ ID NO: 642122 - RNA, 19 nt, Homo sapiens
caacagaaaacccaaaaua

SEQ ID NO: 642123 - RNA, 19 nt, Homo sapiens
gaaaucccugguuuaagua

SEQ ID NO: 642124 - RNA, 19 nt, Homo sapiens
uuaccaagaucuucuacaa

SEQ ID NO: 642125 - RNA, 19 nt, Homo sapiens
gcagauccuugauaaaugc

SEQ ID NO: 642126 - RNA, 19 nt, Homo sapiens
gaaggacuacuacucaaug

SEQ ID NO: 642127 - RNA, 19 nt, Homo sapiens
gaguaagccuuguguuagu

SEQ ID NO: 642128 - RNA, 19 nt, Homo sapiens
ugacagugcuagaaaucaa

SEQ ID NO: 642129 - RNA, 19 nt, Homo sapiens
ggaaggagagcguaaugga

SEQ ID NO: 642130 - RNA, 19 nt, Homo sapiens
ggaguucaguggugugauc

SEQ ID NO: 642131 - RNA, 19 nt, Homo sapiens
gggacacuguuaucagaaa

SEQ ID NO: 642132 - RNA, 19 nt, Homo sapiens
gguaguugauggugguaaa

SEQ ID NO: 642133 - RNA, 19 nt, Homo sapiens
gugcuuccgucaccucuaa

SEQ ID NO: 642134 - RNA, 19 nt, Homo sapiens
ucacuagacugugcccuuu

SEQ ID NO: 642135 - RNA, 19 nt, Homo sapiens
uaaauuccacugcaacauu

SEQ ID NO: 642136 - RNA, 19 nt, Homo sapiens
gagcuguucuacugcuauu

SEQ ID NO: 642137 - RNA, 19 nt, Homo sapiens
uaacauacgcacucaacuu

SEQ ID NO: 642138 - RNA, 19 nt, Homo sapiens
gauuaaugguccugugaug

SEQ ID NO: 642139 - RNA, 19 nt, Homo sapiens
aauaauaccuguccacaac

SEQ ID NO: 642140 - RNA, 19 nt, Homo sapiens
gaugaagaggugagaguaa

SEQ ID NO: 642141 - RNA, 19 nt, Homo sapiens
cuugauaaaugccucauga

SEQ ID NO: 642142 - RNA, 19 nt, Homo sapiens
agaguuaagugaaugucua

SEQ ID NO: 642143 - RNA, 19 nt, Homo sapiens
gcauguaguuggguauaau

SEQ ID NO: 642144 - RNA, 19 nt, Homo sapiens
caagauuucaggauuaaug

SEQ ID NO: 642145 - RNA, 19 nt, Homo sapiens
ugagaaagauagauaugag

SEQ ID NO: 642146 - RNA, 19 nt, Homo sapiens
gacaggguuucaccauauu

SEQ ID NO: 642147 - RNA, 19 nt, Homo sapiens
ccuccugaauuuauuauug

SEQ ID NO: 642148 - RNA, 19 nt, Homo sapiens
ccaaagugcugggauuaca

SEQ ID NO: 642149 - RNA, 19 nt, Homo sapiens
ccacugcgcccagcuaauu

SEQ ID NO: 642150 - RNA, 19 nt, Homo sapiens
gucaagauuucaggauuaa

SEQ ID NO: 642151 - RNA, 19 nt, Homo sapiens
ggacacuguuaucagaaau

SEQ ID NO: 642152 - RNA, 19 nt, Homo sapiens
ccaaagugcugggauuaca

SEQ ID NO: 642153 - RNA, 19 nt, Homo sapiens
ccagagcuguggacuuugu

SEQ ID NO: 642154 - RNA, 19 nt, Homo sapiens
acccagagcuguggacuuu

SEQ ID NO: 642155 - RNA, 19 nt, Homo sapiens
ccacaucacagucuauaug

SEQ ID NO: 642156 - RNA, 19 nt, Homo sapiens
cccauucgcuuuaccaaga

SEQ ID NO: 642157 - RNA, 19 nt, Homo sapiens
gggcaggguuauuccuuug

SEQ ID NO: 642158 - RNA, 19 nt, Homo sapiens
ccacaacaaacucuuaaug

SEQ ID NO: 642159 - RNA, 19 nt, Homo sapiens
gaguuguucugucuuuaga

SEQ ID NO: 642160 - RNA, 19 nt, Homo sapiens
gaaagauagauaugagguu

SEQ ID NO: 642161 - RNA, 19 nt, Homo sapiens
ucacaggcuuucuucucua

SEQ ID NO: 642162 - RNA, 19 nt, Homo sapiens
agagagacauagcuggaaa

SEQ ID NO: 642163 - RNA, 19 nt, Homo sapiens
agacugggccuccugaauu

SEQ ID NO: 642164 - RNA, 19 nt, Homo sapiens
gaugaaguccugucuugga

SEQ ID NO: 642165 - RNA, 19 nt, Homo sapiens
ggagaaggugccuauguau

SEQ ID NO: 642166 - RNA, 19 nt, Homo sapiens
caacugaucaccacuaacu

SEQ ID NO: 642167 - RNA, 19 nt, Homo sapiens
gcuaaagucuggcuaugcu

SEQ ID NO: 642168 - RNA, 19 nt, Homo sapiens
aagacaggguuucaccaua

SEQ ID NO: 642169 - RNA, 19 nt, Homo sapiens
caccaugccaggcuaauuu

SEQ ID NO: 642170 - RNA, 19 nt, Homo sapiens
ggucagggcuucuuacuua

SEQ ID NO: 642171 - RNA, 19 nt, Homo sapiens
gcaagaauguccaugauga

SEQ ID NO: 642172 - RNA, 19 nt, Homo sapiens
gaggagaccuuggaacuua

SEQ ID NO: 642173 - RNA, 19 nt, Homo sapiens
gcagaaacgucgagaaaga

SEQ ID NO: 642174 - RNA, 19 nt, Homo sapiens
gagaagcgguggccucuuu

SEQ ID NO: 642175 - RNA, 19 nt, Homo sapiens
gagaguaaguugcuuguug

SEQ ID NO: 642176 - RNA, 19 nt, Homo sapiens
gcaagagaaugaccaguga

SEQ ID NO: 642177 - RNA, 19 nt, Homo sapiens
gaaauaacauucccuuugc

SEQ ID NO: 642178 - RNA, 19 nt, Homo sapiens
gaauagagccuucuuugau

SEQ ID NO: 642179 - RNA, 19 nt, Homo sapiens
gaaggaugcugccgagaug

SEQ ID NO: 642180 - RNA, 19 nt, Homo sapiens
gaucagaacccaugggaaa

SEQ ID NO: 642181 - RNA, 19 nt, Homo sapiens
uaucgggacucaaagcuua

SEQ ID NO: 642182 - RNA, 19 nt, Homo sapiens
uagcaaaucugagaauuga

SEQ ID NO: 642183 - RNA, 19 nt, Homo sapiens
aagaauagcugugugauug

SEQ ID NO: 642184 - RNA, 19 nt, Homo sapiens
cauaacagauggaagcaaa

SEQ ID NO: 642185 - RNA, 19 nt, Homo sapiens
ccucaaagcuaaucugaau

SEQ ID NO: 642186 - RNA, 19 nt, Homo sapiens
caaaggagaguucagaauu

SEQ ID NO: 642187 - RNA, 19 nt, Homo sapiens
gaucagaguucaucauguc

SEQ ID NO: 642188 - RNA, 19 nt, Homo sapiens
gcaaaucugagaauugaaa

SEQ ID NO: 642189 - RNA, 19 nt, Homo sapiens
gagcagaaacgucgagaaa

SEQ ID NO: 642190 - RNA, 19 nt, Homo sapiens
aagagaagcucauaagugu

SEQ ID NO: 642191 - RNA, 19 nt, Homo sapiens
gaagaucauuggaaacuac

SEQ ID NO: 642192 - RNA, 19 nt, Homo sapiens
ggaaaaggcugcuucguau

SEQ ID NO: 642193 - RNA, 19 nt, Homo sapiens
gcauuugccuucugagaga

SEQ ID NO: 642194 - RNA, 19 nt, Homo sapiens
cuaagaugcuggugaagaa

SEQ ID NO: 642195 - RNA, 19 nt, Homo sapiens
ucacuuuacucuucauuug

SEQ ID NO: 642196 - RNA, 19 nt, Homo sapiens
ugaaagcacugcaaauaag

SEQ ID NO: 642197 - RNA, 19 nt, Homo sapiens
ucaaggccauggagaguaa

SEQ ID NO: 642198 - RNA, 19 nt, Homo sapiens
ggagauagagcaugugaug

SEQ ID NO: 642199 - RNA, 19 nt, Homo sapiens
ccagggagcugaaacucaa

SEQ ID NO: 642200 - RNA, 19 nt, Homo sapiens
ggucauuaggugaauauua

SEQ ID NO: 642201 - RNA, 19 nt, Homo sapiens
gaauagcugugugauugaa

SEQ ID NO: 642202 - RNA, 19 nt, Homo sapiens
ggaagaucauuggaaacua

SEQ ID NO: 642203 - RNA, 19 nt, Homo sapiens
agaggaagaucauuggaaa

SEQ ID NO: 642204 - RNA, 19 nt, Homo sapiens
gagcagaaacgacaggaaa

SEQ ID NO: 642205 - RNA, 19 nt, Homo sapiens
aagcuaaucugaauucugu

SEQ ID NO: 642206 - RNA, 19 nt, Homo sapiens
gaagaauagcugugugauu

SEQ ID NO: 642207 - RNA, 19 nt, Homo sapiens
cauacaccaugucacuuua

SEQ ID NO: 642208 - RNA, 19 nt, Homo sapiens
ccagugaccuugcuuccuu

SEQ ID NO: 642209 - RNA, 19 nt, Homo sapiens
gaaacuacauccuauaacc

SEQ ID NO: 642210 - RNA, 19 nt, Homo sapiens
aaagagaaauccagcaaca

SEQ ID NO: 642211 - RNA, 19 nt, Homo sapiens
gcacucacauuccauaucg

SEQ ID NO: 642212 - RNA, 19 nt, Homo sapiens
gagauaacacuacugcauu

SEQ ID NO: 642213 - RNA, 19 nt, Homo sapiens
acacuaaugugcaguuguu

SEQ ID NO: 642214 - RNA, 19 nt, Homo sapiens
ugacacuucucaagauuug

SEQ ID NO: 642215 - RNA, 19 nt, Homo sapiens
caagagaagcucauaagug

SEQ ID NO: 642216 - RNA, 19 nt, Homo sapiens
ugaaggagauagagcaugu

SEQ ID NO: 642217 - RNA, 19 nt, Homo sapiens
gaaaugcauggguaaggua

SEQ ID NO: 642218 - RNA, 19 nt, Homo sapiens
gaacaauagggcagaauca

SEQ ID NO: 642219 - RNA, 19 nt, Homo sapiens
gaaagcacugcaaauaaga

SEQ ID NO: 642220 - RNA, 19 nt, Homo sapiens
ggauauaagagaccauuga

SEQ ID NO: 642221 - RNA, 19 nt, Homo sapiens
gaaacucaagcaucuuauu

SEQ ID NO: 642222 - RNA, 19 nt, Homo sapiens
aaaggagaguucagaauuc

SEQ ID NO: 642223 - RNA, 19 nt, Homo sapiens
guugggagcaauagaaaua

SEQ ID NO: 642224 - RNA, 19 nt, Homo sapiens
ggaaauugcagagcagaaa

SEQ ID NO: 642225 - RNA, 19 nt, Homo sapiens
gaacaaaccaagggucaau

SEQ ID NO: 642226 - RNA, 19 nt, Homo sapiens
gaucccagaaucaacaaua

SEQ ID NO: 642227 - RNA, 19 nt, Homo sapiens
uaguaacccuucuuucuga

SEQ ID NO: 642228 - RNA, 19 nt, Homo sapiens
gagggaaggagcuguauug

SEQ ID NO: 642229 - RNA, 19 nt, Homo sapiens
gcagaaacgacaggaaauu

SEQ ID NO: 642230 - RNA, 19 nt, Homo sapiens
ccaagaccuucaccuuuga

SEQ ID NO: 642231 - RNA, 19 nt, Homo sapiens
cccaagaccuucaccuuug

SEQ ID NO: 642232 - RNA, 19 nt, Homo sapiens
ucaggaagguggcgacuca

SEQ ID NO: 642233 - RNA, 19 nt, Homo sapiens
agacagagaccaagaacuu

SEQ ID NO: 642234 - RNA, 19 nt, Homo sapiens
agaaauaacauucccuuug

SEQ ID NO: 642235 - RNA, 19 nt, Homo sapiens
gcagaucaaccaacuuaau

SEQ ID NO: 642236 - RNA, 19 nt, Homo sapiens
ccaaagggacggcccauga

SEQ ID NO: 642237 - RNA, 19 nt, Homo sapiens
ucaggugggccuugaguua

SEQ ID NO: 642238 - RNA, 19 nt, Homo sapiens
gagaagcucauaagugugu

SEQ ID NO: 642239 - RNA, 19 nt, Homo sapiens
gagauucagagcuucauuu

SEQ ID NO: 642240 - RNA, 19 nt, Homo sapiens
ccaugucacuuuacucuuc

SEQ ID NO: 642241 - RNA, 19 nt, Homo sapiens
uuagggaaauagcuucuuu

SEQ ID NO: 642242 - RNA, 19 nt, Homo sapiens
gcaggaugaagaugagaua

SEQ ID NO: 642243 - RNA, 19 nt, Homo sapiens
gaacuuaaagagacauaca

SEQ ID NO: 642244 - RNA, 19 nt, Homo sapiens
ccacauuuccucaaagcua

SEQ ID NO: 642245 - RNA, 19 nt, Homo sapiens
guggaaagcaagagaauga

SEQ ID NO: 642246 - RNA, 19 nt, Homo sapiens
ggacaaacugggacaggaa

SEQ ID NO: 642247 - RNA, 19 nt, Homo sapiens
gaaacaggagguacuaagu

SEQ ID NO: 642248 - RNA, 19 nt, Homo sapiens
cagaauucccauuuacaua

SEQ ID NO: 642249 - RNA, 19 nt, Homo sapiens
aauagagccuucuuugaug

SEQ ID NO: 642250 - RNA, 19 nt, Homo sapiens
ugucaucucugcucuagug

SEQ ID NO: 642251 - RNA, 19 nt, Homo sapiens
ggaaugccaagcaguuuga

SEQ ID NO: 642252 - RNA, 19 nt, Homo sapiens
cacauuuccucaaagcuaa

SEQ ID NO: 642253 - RNA, 19 nt, Homo sapiens
gucauuaggugaauauuac

SEQ ID NO: 642254 - RNA, 19 nt, Homo sapiens
gauagagcaugugaugaau

SEQ ID NO: 642255 - RNA, 19 nt, Homo sapiens
uaacucauuugaccauauc

SEQ ID NO: 642256 - RNA, 19 nt, Homo sapiens
auaggugccuguucuugua

SEQ ID NO: 642257 - RNA, 19 nt, Homo sapiens
gcacugcaaauaagaaauc

SEQ ID NO: 642258 - RNA, 19 nt, Homo sapiens
uagagcaugugaugaaugu

SEQ ID NO: 642259 - RNA, 19 nt, Homo sapiens
cagaguucaucaugucaaa

SEQ ID NO: 642260 - RNA, 19 nt, Homo sapiens
gcccaagaccuucaccuuu

SEQ ID NO: 642261 - RNA, 19 nt, Homo sapiens
gugaauguguccauaugug

SEQ ID NO: 642262 - RNA, 19 nt, Homo sapiens
guucagaauucccauuuac

SEQ ID NO: 642263 - RNA, 19 nt, Homo sapiens
gcagggaagacauaacaga

SEQ ID NO: 642264 - RNA, 19 nt, Homo sapiens
uagagcagacucagaauga

SEQ ID NO: 642265 - RNA, 19 nt, Homo sapiens
gauggaaagucgagaugag

SEQ ID NO: 642266 - RNA, 19 nt, Homo sapiens
uuaccaggcuccuccaaga

SEQ ID NO: 642267 - RNA, 19 nt, Homo sapiens
ccaagagugugaaggagau

SEQ ID NO: 642268 - RNA, 19 nt, Homo sapiens
ggccuugaguuauauuuua

SEQ ID NO: 642269 - RNA, 19 nt, Homo sapiens
ccauacaccaugucacuuu

SEQ ID NO: 642270 - RNA, 19 nt, Homo sapiens
caaagaagauucaguaaca

SEQ ID NO: 642271 - RNA, 19 nt, Homo sapiens
gcagaagaccaguuaauua

SEQ ID NO: 642272 - RNA, 19 nt, Homo sapiens
gagaaaccaucacagauuu

SEQ ID NO: 642273 - RNA, 19 nt, Homo sapiens
ggaccgauguuccauaauu

SEQ ID NO: 642274 - RNA, 19 nt, Homo sapiens
cagacaaacugaucaauuu

SEQ ID NO: 642275 - RNA, 19 nt, Homo sapiens
gaagaccaguuaauuaaga

SEQ ID NO: 642276 - RNA, 19 nt, Homo sapiens
gcaaacaguggaaauaaua

SEQ ID NO: 642277 - RNA, 19 nt, Homo sapiens
ucucagagcuggucaguuu

SEQ ID NO: 642278 - RNA, 19 nt, Homo sapiens
caaauugcaugaaauguga

SEQ ID NO: 642279 - RNA, 19 nt, Homo sapiens
cagcagacaucaugaguaa

SEQ ID NO: 642280 - RNA, 19 nt, Homo sapiens
gcucagaaaugcucaaaug

SEQ ID NO: 642281 - RNA, 19 nt, Homo sapiens
gcuccucucucaagauuua

SEQ ID NO: 642282 - RNA, 19 nt, Homo sapiens
ucagaaugcuacucaaaua

SEQ ID NO: 642283 - RNA, 19 nt, Homo sapiens
aaacgaagaugaaacaguu

SEQ ID NO: 642284 - RNA, 19 nt, Homo sapiens
gauacaaaguggaauaaga

SEQ ID NO: 642285 - RNA, 19 nt, Homo sapiens
gaagugcaaugaaucuuau

SEQ ID NO: 642286 - RNA, 19 nt, Homo sapiens
gggaacauuuagaaaguua

SEQ ID NO: 642287 - RNA, 19 nt, Homo sapiens
gaaugaaucugcaguuucu

SEQ ID NO: 642288 - RNA, 19 nt, Homo sapiens
ccucaccgauggagaauua

SEQ ID NO: 642289 - RNA, 19 nt, Homo sapiens
gaaauuaccaguauaccuu

SEQ ID NO: 642290 - RNA, 19 nt, Homo sapiens
gaagagaaaccaucacaga

SEQ ID NO: 642291 - RNA, 19 nt, Homo sapiens
aaacagcacuggugaccua

SEQ ID NO: 642292 - RNA, 19 nt, Homo sapiens
uaaagaacaugguggauuc

SEQ ID NO: 642293 - RNA, 19 nt, Homo sapiens
ggaagugcaaugaaucuua

SEQ ID NO: 642294 - RNA, 19 nt, Homo sapiens
gcagccaaauuaacaauga

SEQ ID NO: 642295 - RNA, 19 nt, Homo sapiens
gcuguagccugaaauguaa

SEQ ID NO: 642296 - RNA, 19 nt, Homo sapiens
gcuguucacuggauaauga

SEQ ID NO: 642297 - RNA, 19 nt, Homo sapiens
gguguuagaugaauuugaa

SEQ ID NO: 642298 - RNA, 19 nt, Homo sapiens
ccugaaauguaaacuguua

SEQ ID NO: 642299 - RNA, 19 nt, Homo sapiens
gaagccagguuuacauuca

SEQ ID NO: 642300 - RNA, 19 nt, Homo sapiens
gaugaaugauagccaagua

SEQ ID NO: 642301 - RNA, 19 nt, Homo sapiens
gaaugaugauggaaacuau

SEQ ID NO: 642302 - RNA, 19 nt, Homo sapiens
gcaaauuuguugucaaugg

SEQ ID NO: 642303 - RNA, 19 nt, Homo sapiens
gaagcuagaguguguguaa

SEQ ID NO: 642304 - RNA, 19 nt, Homo sapiens
gggacaagguguuagauga

SEQ ID NO: 642305 - RNA, 19 nt, Homo sapiens
cagaagaccaguuaauuaa

SEQ ID NO: 642306 - RNA, 19 nt, Homo sapiens
gcacaacaguuaugcuauc

SEQ ID NO: 642307 - RNA, 19 nt, Homo sapiens
gauauuccauggaucagaa

SEQ ID NO: 642308 - RNA, 19 nt, Homo sapiens
ggaggugccugcuucaaug

SEQ ID NO: 642309 - RNA, 19 nt, Homo sapiens
gcugaauacuguucuacua

SEQ ID NO: 642310 - RNA, 19 nt, Homo sapiens
gaauuccgcuccucucuca

SEQ ID NO: 642311 - RNA, 19 nt, Homo sapiens
gaagggaguggacuacuuu

SEQ ID NO: 642312 - RNA, 19 nt, Homo sapiens
gaaggaauaaugacuguga

SEQ ID NO: 642313 - RNA, 19 nt, Homo sapiens
gaagauauuccauggauca

SEQ ID NO: 642314 - RNA, 19 nt, Homo sapiens
cgagaagucuguuccuuau

SEQ ID NO: 642315 - RNA, 19 nt, Homo sapiens
uaacaauccugcugaauac

SEQ ID NO: 642316 - RNA, 19 nt, Homo sapiens
gccauuaucagaccauuua

SEQ ID NO: 642317 - RNA, 19 nt, Homo sapiens
aagcaaccuucuaaucuua

SEQ ID NO: 642318 - RNA, 19 nt, Homo sapiens
caagcaaccuucuaaucuu

SEQ ID NO: 642319 - RNA, 19 nt, Homo sapiens
cagauugccuugugccuaa

SEQ ID NO: 642320 - RNA, 19 nt, Homo sapiens
guacaugaaugaucuggau

SEQ ID NO: 642321 - RNA, 19 nt, Homo sapiens
gcagaucacaguagauuga

SEQ ID NO: 642322 - RNA, 19 nt, Homo sapiens
gaggaucacugugcuaaug

SEQ ID NO: 642323 - RNA, 19 nt, Homo sapiens
aaaggaagcuagagugugu

SEQ ID NO: 642324 - RNA, 19 nt, Homo sapiens
agaugcaggucuagauuua

SEQ ID NO: 642325 - RNA, 19 nt, Homo sapiens
gaacaugguggauucuuau

SEQ ID NO: 642326 - RNA, 19 nt, Homo sapiens
caucacagauuucaguaau

SEQ ID NO: 642327 - RNA, 19 nt, Homo sapiens
uagcaagccugccaucuau

SEQ ID NO: 642328 - RNA, 19 nt, Homo sapiens
gaacuugcauuagugaaag

SEQ ID NO: 642329 - RNA, 19 nt, Homo sapiens
cagcagagacggauauuug

SEQ ID NO: 642330 - RNA, 19 nt, Homo sapiens
cuaacaauccugcugaaua

SEQ ID NO: 642331 - RNA, 19 nt, Homo sapiens
ugugauuucuccacuguua

SEQ ID NO: 642332 - RNA, 19 nt, Homo sapiens
caacaguuaugcuauccuu

SEQ ID NO: 642333 - RNA, 19 nt, Homo sapiens
caacagauacaaugagaug

SEQ ID NO: 642334 - RNA, 19 nt, Homo sapiens
ggagcugaauaucgacuuu

SEQ ID NO: 642335 - RNA, 19 nt, Homo sapiens
ccagauagcccagauaaug

SEQ ID NO: 642336 - RNA, 19 nt, Homo sapiens
gaaguuagggcugaugaaa

SEQ ID NO: 642337 - RNA, 19 nt, Homo sapiens
ugucugcgauuacaaguuu

SEQ ID NO: 642338 - RNA, 19 nt, Homo sapiens
gaugaugacaagaacguua

SEQ ID NO: 642339 - RNA, 19 nt, Homo sapiens
gguggauucuuauauguga

SEQ ID NO: 642340 - RNA, 19 nt, Homo sapiens
gaaaugugaagccagguuu

SEQ ID NO: 642341 - RNA, 19 nt, Homo sapiens
cuucagaaauuaccaguau

SEQ ID NO: 642342 - RNA, 19 nt, Homo sapiens
gaugguaccugugggaguu

SEQ ID NO: 642343 - RNA, 19 nt, Homo sapiens
ucucuaaugucgauacaaa

SEQ ID NO: 642344 - RNA, 19 nt, Homo sapiens
gaaagugaagaaugugauu

SEQ ID NO: 642345 - RNA, 19 nt, Homo sapiens
ggagagcaccacugaagaa

SEQ ID NO: 642346 - RNA, 19 nt, Homo sapiens
gaucuagggaguccaaauu

SEQ ID NO: 642347 - RNA, 19 nt, Homo sapiens
gugaagauauuccauggau

SEQ ID NO: 642348 - RNA, 19 nt, Homo sapiens
gggcuaaaguauuuccuau

SEQ ID NO: 642349 - RNA, 19 nt, Homo sapiens
ggacagaaaggaagcuaga

SEQ ID NO: 642350 - RNA, 19 nt, Homo sapiens
gcagcaaauuaucuaucua

SEQ ID NO: 642351 - RNA, 19 nt, Homo sapiens
auaaaugaguccacugaaa

SEQ ID NO: 642352 - RNA, 19 nt, Homo sapiens
aaucugcaguuucuaauga

SEQ ID NO: 642353 - RNA, 19 nt, Homo sapiens
gguguuaugguccagauua

SEQ ID NO: 642354 - RNA, 19 nt, Homo sapiens
gaacaaguccaaugagcau

SEQ ID NO: 642355 - RNA, 19 nt, Homo sapiens
ggacaagguguuagaugaa

SEQ ID NO: 642356 - RNA, 19 nt, Homo sapiens
gcaaccuucuaaucuuaaa

SEQ ID NO: 642357 - RNA, 19 nt, Homo sapiens
gugaaugaaucugcaguuu

SEQ ID NO: 642358 - RNA, 19 nt, Homo sapiens
ucauggaacucaucuuuua

SEQ ID NO: 642359 - RNA, 19 nt, Homo sapiens
caguauaccuugccaguag

SEQ ID NO: 642360 - RNA, 19 nt, Homo sapiens
uugcagacuucagaaauua

SEQ ID NO: 642361 - RNA, 19 nt, Homo sapiens
ggaaacuccuugggcuaaa

SEQ ID NO: 642362 - RNA, 19 nt, Homo sapiens
gcugagaucuccacuagac

SEQ ID NO: 642363 - RNA, 19 nt, Homo sapiens
ggaacuugcauuagugaaa

SEQ ID NO: 642364 - RNA, 19 nt, Homo sapiens
agaagucuguuccuuauca

SEQ ID NO: 642365 - RNA, 19 nt, Homo sapiens
ugaaagccaugaacaaguc

SEQ ID NO: 642366 - RNA, 19 nt, Homo sapiens
gccaguaguucaagguuug

SEQ ID NO: 642367 - RNA, 19 nt, Homo sapiens
guaaagaacaugguggauu

SEQ ID NO: 642368 - RNA, 19 nt, Homo sapiens
ggaauguggugagcaacuu

SEQ ID NO: 642369 - RNA, 19 nt, Homo sapiens
gcuggucaguuuggaauuu

SEQ ID NO: 642370 - RNA, 19 nt, Homo sapiens
caaagaagauucaguaaca

SEQ ID NO: 642371 - RNA, 19 nt, Homo sapiens
gcagaagaccaguuaauua

SEQ ID NO: 642372 - RNA, 19 nt, Homo sapiens
cagacaaacugaucaauuu

SEQ ID NO: 642373 - RNA, 19 nt, Homo sapiens
gaagaccaguuaauuaaga

SEQ ID NO: 642374 - RNA, 19 nt, Homo sapiens
gcaaacaguggaaauaaua

SEQ ID NO: 642375 - RNA, 19 nt, Homo sapiens
ucucagagcuggucaguuu

SEQ ID NO: 642376 - RNA, 19 nt, Homo sapiens
caaauugcaugaaauguga

SEQ ID NO: 642377 - RNA, 19 nt, Homo sapiens
cagcagacaucaugaguaa

SEQ ID NO: 642378 - RNA, 19 nt, Homo sapiens
ucagaaugcuacucaaaua

SEQ ID NO: 642379 - RNA, 19 nt, Homo sapiens
aaacgaagaugaaacaguu

SEQ ID NO: 642380 - RNA, 19 nt, Homo sapiens
gauacaaaguggaauaaga

SEQ ID NO: 642381 - RNA, 19 nt, Homo sapiens
gggaacauuuagaaaguua

SEQ ID NO: 642382 - RNA, 19 nt, Homo sapiens
gaaugaaucugcaguuucu

SEQ ID NO: 642383 - RNA, 19 nt, Homo sapiens
ccucaccgauggagaauua

SEQ ID NO: 642384 - RNA, 19 nt, Homo sapiens
aaacagcacuggugaccua

SEQ ID NO: 642385 - RNA, 19 nt, Homo sapiens
gcuaaugaaugguaaguau

SEQ ID NO: 642386 - RNA, 19 nt, Homo sapiens
gcuguagccugaaauguaa

SEQ ID NO: 642387 - RNA, 19 nt, Homo sapiens
gcuguucacuggauaauga

SEQ ID NO: 642388 - RNA, 19 nt, Homo sapiens
gguguuagaugaauuugaa

SEQ ID NO: 642389 - RNA, 19 nt, Homo sapiens
ccugaaauguaaacuguua

SEQ ID NO: 642390 - RNA, 19 nt, Homo sapiens
gaagccagguuuacauuca

SEQ ID NO: 642391 - RNA, 19 nt, Homo sapiens
gaugaaugauagccaagua

SEQ ID NO: 642392 - RNA, 19 nt, Homo sapiens
gaagcuagaguguguguaa

SEQ ID NO: 642393 - RNA, 19 nt, Homo sapiens
cagaagaccaguuaauuaa

SEQ ID NO: 642394 - RNA, 19 nt, Homo sapiens
gaagggaguggacuacuuu

SEQ ID NO: 642395 - RNA, 19 nt, Homo sapiens
gaaggaauaaugacuguga

SEQ ID NO: 642396 - RNA, 19 nt, Homo sapiens
cgagaagucuguuccuuau

SEQ ID NO: 642397 - RNA, 19 nt, Homo sapiens
gccauuaucagaccauuua

SEQ ID NO: 642398 - RNA, 19 nt, Homo sapiens
aagcaaccuucuaaucuua

SEQ ID NO: 642399 - RNA, 19 nt, Homo sapiens
caagcaaccuucuaaucuu

SEQ ID NO: 642400 - RNA, 19 nt, Homo sapiens
cagauugccuugugccuaa

SEQ ID NO: 642401 - RNA, 19 nt, Homo sapiens
gaggaucacugugcuaaug

SEQ ID NO: 642402 - RNA, 19 nt, Homo sapiens
aaaggaagcuagagugugu

SEQ ID NO: 642403 - RNA, 19 nt, Homo sapiens
agaugcaggucuagauuua

SEQ ID NO: 642404 - RNA, 19 nt, Homo sapiens
cagguugauuucauaguua

SEQ ID NO: 642405 - RNA, 19 nt, Homo sapiens
uagcaagccugccaucuau

SEQ ID NO: 642406 - RNA, 19 nt, Homo sapiens
gaacuugcauuagugaaag

SEQ ID NO: 642407 - RNA, 19 nt, Homo sapiens
aaacagagcauacugaauc

SEQ ID NO: 642408 - RNA, 19 nt, Homo sapiens
ugugauuucuccacuguua

SEQ ID NO: 642409 - RNA, 19 nt, Homo sapiens
ccagauagcccagauaaug

SEQ ID NO: 642410 - RNA, 19 nt, Homo sapiens
gaaguuagggcugaugaaa

SEQ ID NO: 642411 - RNA, 19 nt, Homo sapiens
ugucugcgauuacaaguuu

SEQ ID NO: 642412 - RNA, 19 nt, Homo sapiens
gaaaugugaagccagguuu

SEQ ID NO: 642413 - RNA, 19 nt, Homo sapiens
ucucuaaugucgauacaaa

SEQ ID NO: 642414 - RNA, 19 nt, Homo sapiens
gaaagugaagaaugugauu

SEQ ID NO: 642415 - RNA, 19 nt, Homo sapiens
ggagagcaccacugaagaa

SEQ ID NO: 642416 - RNA, 19 nt, Homo sapiens
gaucuagggaguccaaauu

SEQ ID NO: 642417 - RNA, 19 nt, Homo sapiens
ggacagaaaggaagcuaga

SEQ ID NO: 642418 - RNA, 19 nt, Homo sapiens
gcagcaaauuaucuaucua

SEQ ID NO: 642419 - RNA, 19 nt, Homo sapiens
auaaaugaguccacugaaa

SEQ ID NO: 642420 - RNA, 19 nt, Homo sapiens
aaucugcaguuucuaauga

SEQ ID NO: 642421 - RNA, 19 nt, Homo sapiens
gcaaccuucuaaucuuaaa

SEQ ID NO: 642422 - RNA, 19 nt, Homo sapiens
gugaaugaaucugcaguuu

SEQ ID NO: 642423 - RNA, 19 nt, Homo sapiens
ggacaagguguuagaugaa

SEQ ID NO: 642424 - RNA, 19 nt, Homo sapiens
agaagucuguuccuuauca

SEQ ID NO: 642425 - RNA, 19 nt, Homo sapiens
gcugagaucuccacuagac

SEQ ID NO: 642426 - RNA, 19 nt, Homo sapiens
ggaacuugcauuagugaaa

SEQ ID NO: 642427 - RNA, 19 nt, Homo sapiens
gcuggucaguuuggaauuu

SEQ ID NO: 642428 - RNA, 19 nt, Homo sapiens
caaaaugacuuuccugcaa

SEQ ID NO: 642429 - RNA, 19 nt, Homo sapiens
guagcaagccugccaucua

SEQ ID NO: 642430 - RNA, 19 nt, Homo sapiens
ugagguggcuccaguaugg

SEQ ID NO: 642431 - RNA, 19 nt, Homo sapiens
gaggaaagcaagucagaau

SEQ ID NO: 642432 - RNA, 19 nt, Homo sapiens
gguuuaaacaagucucuua

SEQ ID NO: 642433 - RNA, 19 nt, Homo sapiens
uggacaagguguuagauga

SEQ ID NO: 642434 - RNA, 19 nt, Homo sapiens
aaaggaacuugcauuagug

SEQ ID NO: 642435 - RNA, 19 nt, Homo sapiens
gcagaugcaggucuagauu

SEQ ID NO: 642436 - RNA, 19 nt, Homo sapiens
agaacuauauaccagauga

SEQ ID NO: 642437 - RNA, 19 nt, Homo sapiens
aaacucagcaaccaaugua

SEQ ID NO: 642438 - RNA, 19 nt, Homo sapiens
cuaauuggaaguugacuaa

SEQ ID NO: 642439 - RNA, 19 nt, Homo sapiens
gagcaccacugaagaaucc

SEQ ID NO: 642440 - RNA, 19 nt, Homo sapiens
gaauucagagaaacaaaug

SEQ ID NO: 642441 - RNA, 19 nt, Homo sapiens
guggaaaccuggcuugucu

SEQ ID NO: 642442 - RNA, 19 nt, Homo sapiens
acagguugauuucauaguu

SEQ ID NO: 642443 - RNA, 19 nt, Homo sapiens
uguuauacauggacagaaa

SEQ ID NO: 642444 - RNA, 19 nt, Homo sapiens
ccgagaagucuguuccuua

SEQ ID NO: 642445 - RNA, 19 nt, Homo sapiens
gacccaagcaaccuucuaa

SEQ ID NO: 642446 - RNA, 19 nt, Homo sapiens
gacaagguguuagaugaau

SEQ ID NO: 642447 - RNA, 19 nt, Homo sapiens
gcagcagacaucaugagua

SEQ ID NO: 642448 - RNA, 19 nt, Homo sapiens
caagguguuagaugaauuu

SEQ ID NO: 642449 - RNA, 19 nt, Homo sapiens
gaggagagcaccacugaag

SEQ ID NO: 642450 - RNA, 19 nt, Homo sapiens
ggagagaagaaauguggaa

SEQ ID NO: 642451 - RNA, 19 nt, Homo sapiens
uaaacaagucucuuaagug

SEQ ID NO: 642452 - RNA, 19 nt, Homo sapiens
gcuccaaauugcaugaaau

SEQ ID NO: 642453 - RNA, 19 nt, Homo sapiens
ggaguggacuacuuuuaaa

SEQ ID NO: 642454 - RNA, 19 nt, Homo sapiens
gcacuacagaauuccuuaa

SEQ ID NO: 642455 - RNA, 19 nt, Homo sapiens
ugaagguuaugaacaugaa

SEQ ID NO: 642456 - RNA, 19 nt, Homo sapiens
ugacggaaguauagguaga

SEQ ID NO: 642457 - RNA, 19 nt, Homo sapiens
gaugacggaaguauaggua

SEQ ID NO: 642458 - RNA, 19 nt, Homo sapiens
guauaaaugaguccacuga

SEQ ID NO: 642459 - RNA, 19 nt, Homo sapiens
cagauagcccagauaauga

SEQ ID NO: 642460 - RNA, 19 nt, Homo sapiens
ccaagcaaccuucuaaucu

SEQ ID NO: 642461 - RNA, 19 nt, Homo sapiens
guagucaaguuccaucagu

SEQ ID NO: 642462 - RNA, 19 nt, Homo sapiens
acacaccagcagcaaauua

SEQ ID NO: 642463 - RNA, 19 nt, Homo sapiens
aaaaucagcucuccuagga

SEQ ID NO: 642464 - RNA, 19 nt, Homo sapiens
uguccuacuucaucugaua

SEQ ID NO: 642465 - RNA, 19 nt, Homo sapiens
gaagaggaucacugugcua

SEQ ID NO: 642466 - RNA, 19 nt, Homo sapiens
gcaagccugccaucuauca

SEQ ID NO: 642467 - RNA, 19 nt, Homo sapiens
cagcacuggugaccuaaug

SEQ ID NO: 642468 - RNA, 19 nt, Homo sapiens
gaauuacgaugagaagacu

SEQ ID NO: 642469 - RNA, 19 nt, Homo sapiens
ccaaauugcaugaaaugug

SEQ ID NO: 642470 - RNA, 19 nt, Homo sapiens
caaagaagauucaguaaca

SEQ ID NO: 642471 - RNA, 19 nt, Homo sapiens
gcagaagaccaguuaauua

SEQ ID NO: 642472 - RNA, 19 nt, Homo sapiens
gagaaaccaucacagauuu

SEQ ID NO: 642473 - RNA, 19 nt, Homo sapiens
ggaccgauguuccauaauu

SEQ ID NO: 642474 - RNA, 19 nt, Homo sapiens
cagacaaacugaucaauuu

SEQ ID NO: 642475 - RNA, 19 nt, Homo sapiens
gaagaccaguuaauuaaga

SEQ ID NO: 642476 - RNA, 19 nt, Homo sapiens
gcaaacaguggaaauaaua

SEQ ID NO: 642477 - RNA, 19 nt, Homo sapiens
ucucagagcuggucaguuu

SEQ ID NO: 642478 - RNA, 19 nt, Homo sapiens
caaauugcaugaaauguga

SEQ ID NO: 642479 - RNA, 19 nt, Homo sapiens
cagcagacaucaugaguaa

SEQ ID NO: 642480 - RNA, 19 nt, Homo sapiens
ucagaaugcuacucaaaua

SEQ ID NO: 642481 - RNA, 19 nt, Homo sapiens
aaacgaagaugaaacaguu

SEQ ID NO: 642482 - RNA, 19 nt, Homo sapiens
gauacaaaguggaauaaga

SEQ ID NO: 642483 - RNA, 19 nt, Homo sapiens
gaagugcaaugaaucuuau

SEQ ID NO: 642484 - RNA, 19 nt, Homo sapiens
gggaacauuuagaaaguua

SEQ ID NO: 642485 - RNA, 19 nt, Homo sapiens
gaaugaaucugcaguuucu

SEQ ID NO: 642486 - RNA, 19 nt, Homo sapiens
ccucaccgauggagaauua

SEQ ID NO: 642487 - RNA, 19 nt, Homo sapiens
gaaauuaccaguauaccuu

SEQ ID NO: 642488 - RNA, 19 nt, Homo sapiens
gaagagaaaccaucacaga

SEQ ID NO: 642489 - RNA, 19 nt, Homo sapiens
aaacagcacuggugaccua

SEQ ID NO: 642490 - RNA, 19 nt, Homo sapiens
uaaagaacaugguggauuc

SEQ ID NO: 642491 - RNA, 19 nt, Homo sapiens
ggaagugcaaugaaucuua

SEQ ID NO: 642492 - RNA, 19 nt, Homo sapiens
gcagccaaauuaacaauga

SEQ ID NO: 642493 - RNA, 19 nt, Homo sapiens
gcuguagccugaaauguaa

SEQ ID NO: 642494 - RNA, 19 nt, Homo sapiens
gcuguucacuggauaauga

SEQ ID NO: 642495 - RNA, 19 nt, Homo sapiens
gguguuagaugaauuugaa

SEQ ID NO: 642496 - RNA, 19 nt, Homo sapiens
ccugaaauguaaacuguua

SEQ ID NO: 642497 - RNA, 19 nt, Homo sapiens
gaagccagguuuacauuca

SEQ ID NO: 642498 - RNA, 19 nt, Homo sapiens
gaugaaugauagccaagua

SEQ ID NO: 642499 - RNA, 19 nt, Homo sapiens
gaaugaugauggaaacuau

SEQ ID NO: 642500 - RNA, 19 nt, Homo sapiens
gcaaauuuguugucaaugg

SEQ ID NO: 642501 - RNA, 19 nt, Homo sapiens
gaagcuagaguguguguaa

SEQ ID NO: 642502 - RNA, 19 nt, Homo sapiens
cagaagaccaguuaauuaa

SEQ ID NO: 642503 - RNA, 19 nt, Homo sapiens
gcacaacaguuaugcuauc

SEQ ID NO: 642504 - RNA, 19 nt, Homo sapiens
gauauuccauggaucagaa

SEQ ID NO: 642505 - RNA, 19 nt, Homo sapiens
ggaggugccugcuucaaug

SEQ ID NO: 642506 - RNA, 19 nt, Homo sapiens
gaagggaguggacuacuuu

SEQ ID NO: 642507 - RNA, 19 nt, Homo sapiens
gaaggaauaaugacuguga

SEQ ID NO: 642508 - RNA, 19 nt, Homo sapiens
gaagauauuccauggauca

SEQ ID NO: 642509 - RNA, 19 nt, Homo sapiens
cgagaagucuguuccuuau

SEQ ID NO: 642510 - RNA, 19 nt, Homo sapiens
gccauuaucagaccauuua

SEQ ID NO: 642511 - RNA, 19 nt, Homo sapiens
aagcaaccuucuaaucuua

SEQ ID NO: 642512 - RNA, 19 nt, Homo sapiens
caagcaaccuucuaaucuu

SEQ ID NO: 642513 - RNA, 19 nt, Homo sapiens
cagauugccuugugccuaa

SEQ ID NO: 642514 - RNA, 19 nt, Homo sapiens
gcagaucacaguagauuga

SEQ ID NO: 642515 - RNA, 19 nt, Homo sapiens
gaggaucacugugcuaaug

SEQ ID NO: 642516 - RNA, 19 nt, Homo sapiens
aaaggaagcuagagugugu

SEQ ID NO: 642517 - RNA, 19 nt, Homo sapiens
agaugcaggucuagauuua

SEQ ID NO: 642518 - RNA, 19 nt, Homo sapiens
gaacaugguggauucuuau

SEQ ID NO: 642519 - RNA, 19 nt, Homo sapiens
caucacagauuucaguaau

SEQ ID NO: 642520 - RNA, 19 nt, Homo sapiens
uagcaagccugccaucuau

SEQ ID NO: 642521 - RNA, 19 nt, Homo sapiens
gaacuugcauuagugaaag

SEQ ID NO: 642522 - RNA, 19 nt, Homo sapiens
cagcagagacggauauuug

SEQ ID NO: 642523 - RNA, 19 nt, Homo sapiens
aaacagagcauacugaauc

SEQ ID NO: 642524 - RNA, 19 nt, Homo sapiens
ugugauuucuccacuguua

SEQ ID NO: 642525 - RNA, 19 nt, Homo sapiens
caacaguuaugcuauccuu

SEQ ID NO: 642526 - RNA, 19 nt, Homo sapiens
caacagauacaaugagaug

SEQ ID NO: 642527 - RNA, 19 nt, Homo sapiens
ggagcugaauaucgacuuu

SEQ ID NO: 642528 - RNA, 19 nt, Homo sapiens
ccagauagcccagauaaug

SEQ ID NO: 642529 - RNA, 19 nt, Homo sapiens
gaaguuagggcugaugaaa

SEQ ID NO: 642530 - RNA, 19 nt, Homo sapiens
ugucugcgauuacaaguuu

SEQ ID NO: 642531 - RNA, 19 nt, Homo sapiens
gaugaugacaagaacguua

SEQ ID NO: 642532 - RNA, 19 nt, Homo sapiens
gguggauucuuauauguga

SEQ ID NO: 642533 - RNA, 19 nt, Homo sapiens
gaaaugugaagccagguuu

SEQ ID NO: 642534 - RNA, 19 nt, Homo sapiens
cuucagaaauuaccaguau

SEQ ID NO: 642535 - RNA, 19 nt, Homo sapiens
ucucuaaugucgauacaaa

SEQ ID NO: 642536 - RNA, 19 nt, Homo sapiens
gaaagugaagaaugugauu

SEQ ID NO: 642537 - RNA, 19 nt, Homo sapiens
ggagagcaccacugaagaa

SEQ ID NO: 642538 - RNA, 19 nt, Homo sapiens
gaucuagggaguccaaauu

SEQ ID NO: 642539 - RNA, 19 nt, Homo sapiens
gugaagauauuccauggau

SEQ ID NO: 642540 - RNA, 19 nt, Homo sapiens
gggcuaaaguauuuccuau

SEQ ID NO: 642541 - RNA, 19 nt, Homo sapiens
ggacagaaaggaagcuaga

SEQ ID NO: 642542 - RNA, 19 nt, Homo sapiens
gcagcaaauuaucuaucua

SEQ ID NO: 642543 - RNA, 19 nt, Homo sapiens
auaaaugaguccacugaaa

SEQ ID NO: 642544 - RNA, 19 nt, Homo sapiens
aaucugcaguuucuaauga

SEQ ID NO: 642545 - RNA, 19 nt, Homo sapiens
gguguuaugguccagauua

SEQ ID NO: 642546 - RNA, 19 nt, Homo sapiens
gaacaaguccaaugagcau

SEQ ID NO: 642547 - RNA, 19 nt, Homo sapiens
gcaaccuucuaaucuuaaa

SEQ ID NO: 642548 - RNA, 19 nt, Homo sapiens
ggacaagguguuagaugaa

SEQ ID NO: 642549 - RNA, 19 nt, Homo sapiens
gugaaugaaucugcaguuu

SEQ ID NO: 642550 - RNA, 19 nt, Homo sapiens
ucauggaacucaucuuuua

SEQ ID NO: 642551 - RNA, 19 nt, Homo sapiens
caguauaccuugccaguag

SEQ ID NO: 642552 - RNA, 19 nt, Homo sapiens
uugcagacuucagaaauua

SEQ ID NO: 642553 - RNA, 19 nt, Homo sapiens
ggaaacuccuugggcuaaa

SEQ ID NO: 642554 - RNA, 19 nt, Homo sapiens
gcugagaucuccacuagac

SEQ ID NO: 642555 - RNA, 19 nt, Homo sapiens
agaagucuguuccuuauca

SEQ ID NO: 642556 - RNA, 19 nt, Homo sapiens
ggaacuugcauuagugaaa

SEQ ID NO: 642557 - RNA, 19 nt, Homo sapiens
ugaaagccaugaacaaguc

SEQ ID NO: 642558 - RNA, 19 nt, Homo sapiens
gccaguaguucaagguuug

SEQ ID NO: 642559 - RNA, 19 nt, Homo sapiens
guaaagaacaugguggauu

SEQ ID NO: 642560 - RNA, 19 nt, Homo sapiens
ggaauguggugagcaacuu

SEQ ID NO: 642561 - RNA, 19 nt, Homo sapiens
gcuggucaguuuggaauuu

SEQ ID NO: 642562 - RNA, 19 nt, Homo sapiens
caaaaugacuuuccugcaa

SEQ ID NO: 642563 - RNA, 19 nt, Homo sapiens
guagcaagccugccaucua

SEQ ID NO: 642564 - RNA, 19 nt, Homo sapiens
uagcaagggugucguaagu

SEQ ID NO: 642565 - RNA, 19 nt, Homo sapiens
cagagaacauggauuccuu

SEQ ID NO: 642566 - RNA, 19 nt, Homo sapiens
caugguggauucuuauaug

SEQ ID NO: 642567 - RNA, 19 nt, Homo sapiens
ugagguggcuccaguaugg

SEQ ID NO: 642568 - RNA, 19 nt, Homo sapiens
gaggaaagcaagucagaau

SEQ ID NO: 642569 - RNA, 19 nt, Homo sapiens
ccauggagacuauaacaaa

SEQ ID NO: 642570 - RNA, 19 nt, Homo sapiens
gaacagcacugauacauuu

SEQ ID NO: 642571 - RNA, 19 nt, Homo sapiens
caauuuaacuccaggcuua

SEQ ID NO: 642572 - RNA, 19 nt, Homo sapiens
uaaaugagggccaguauua

SEQ ID NO: 642573 - RNA, 19 nt, Homo sapiens
gaagauacugucucuaaua

SEQ ID NO: 642574 - RNA, 19 nt, Homo sapiens
gcaaaugaugcuaguauua

SEQ ID NO: 642575 - RNA, 19 nt, Homo sapiens
gaagguggaccaucauaua

SEQ ID NO: 642576 - RNA, 19 nt, Homo sapiens
gaaaugaccacaauauaug

SEQ ID NO: 642577 - RNA, 19 nt, Homo sapiens
gcauacaacuucuuacaga

SEQ ID NO: 642578 - RNA, 19 nt, Homo sapiens
ggaaaugaccacaauauau

SEQ ID NO: 642579 - RNA, 19 nt, Homo sapiens
gcgagugucuugaaguaua

SEQ ID NO: 642580 - RNA, 19 nt, Homo sapiens
ugacaugacugauaacaga

SEQ ID NO: 642581 - RNA, 19 nt, Homo sapiens
gaggaugacuugauacuuc

SEQ ID NO: 642582 - RNA, 19 nt, Homo sapiens
gcagucaucuuaucaaucu

SEQ ID NO: 642583 - RNA, 19 nt, Homo sapiens
gauacugucucuaauaugu

SEQ ID NO: 642584 - RNA, 19 nt, Homo sapiens
guagacacacugauauuua

SEQ ID NO: 642585 - RNA, 19 nt, Homo sapiens
ggagggaacaucuuaauga

SEQ ID NO: 642586 - RNA, 19 nt, Homo sapiens
gcaaacaucuggaaaaguu

SEQ ID NO: 642587 - RNA, 19 nt, Homo sapiens
gcuaaagucuggcugaaug

SEQ ID NO: 642588 - RNA, 19 nt, Homo sapiens
guaagagguuuggcaauuu

SEQ ID NO: 642589 - RNA, 19 nt, Homo sapiens
gaaccugucaugugaaauu

SEQ ID NO: 642590 - RNA, 19 nt, Homo sapiens
gcccugaacuauucuguuu

SEQ ID NO: 642591 - RNA, 19 nt, Homo sapiens
uaacuguccugaagauauu

SEQ ID NO: 642592 - RNA, 19 nt, Homo sapiens
ggacaccacugcuaaaguc

SEQ ID NO: 642593 - RNA, 19 nt, Homo sapiens
gagggaacaucuuaaugaa

SEQ ID NO: 642594 - RNA, 19 nt, Homo sapiens
ggaaugugcucaaacuauc

SEQ ID NO: 642595 - RNA, 19 nt, Homo sapiens
gcuauuaacuguccugaag

SEQ ID NO: 642596 - RNA, 19 nt, Homo sapiens
aacaggagcuuuacagaaa

SEQ ID NO: 642597 - RNA, 19 nt, Homo sapiens
agugaaugcuguagauuua

SEQ ID NO: 642598 - RNA, 19 nt, Homo sapiens
guggaaagcuauuaacugu

SEQ ID NO: 642599 - RNA, 19 nt, Homo sapiens
ggucaaauguugggacuug

SEQ ID NO: 642600 - RNA, 19 nt, Homo sapiens
caaugaagguggaccauca

SEQ ID NO: 642601 - RNA, 19 nt, Homo sapiens
ucuagaaccugucauguga

SEQ ID NO: 642602 - RNA, 19 nt, Homo sapiens
ggccggaguugauccauuu

SEQ ID NO: 642603 - RNA, 19 nt, Homo sapiens
gcaugaagacuguguaaga

SEQ ID NO: 642604 - RNA, 19 nt, Homo sapiens
caagggcuguuacucauau

SEQ ID NO: 642605 - RNA, 19 nt, Homo sapiens
guaagugaaugcuguagau

SEQ ID NO: 642606 - RNA, 19 nt, Homo sapiens
auucuucgguugucaauua

SEQ ID NO: 642607 - RNA, 19 nt, Homo sapiens
cauuugacaugacugauaa

SEQ ID NO: 642608 - RNA, 19 nt, Homo sapiens
agacaagacuguuaaacug

SEQ ID NO: 642609 - RNA, 19 nt, Homo sapiens
ggaaguaguacaagaccua

SEQ ID NO: 642610 - RNA, 19 nt, Homo sapiens
aaaagaggcugucacauuu

SEQ ID NO: 642611 - RNA, 19 nt, Homo sapiens
uaaugaaccugguacuaga

SEQ ID NO: 642612 - RNA, 19 nt, Homo sapiens
gaagggaaagaauuugauu

SEQ ID NO: 642613 - RNA, 19 nt, Homo sapiens
ggagaaagucgaagccuau

SEQ ID NO: 642614 - RNA, 19 nt, Homo sapiens
caagcaaacccuacacaaa

SEQ ID NO: 642615 - RNA, 19 nt, Homo sapiens
ccgaucagcugcaucuaaa

SEQ ID NO: 642616 - RNA, 19 nt, Homo sapiens
cugaagaaaucaaggcuuu

SEQ ID NO: 642617 - RNA, 19 nt, Homo sapiens
ggaagagggacggauauuu

SEQ ID NO: 642618 - RNA, 19 nt, Homo sapiens
gaaguuaacugaggaugac

SEQ ID NO: 642619 - RNA, 19 nt, Homo sapiens
gaauagugccuaccgauca

SEQ ID NO: 642620 - RNA, 19 nt, Homo sapiens
gccuaucaguggaguguua

SEQ ID NO: 642621 - RNA, 19 nt, Homo sapiens
acaauuagccaagucuuua

SEQ ID NO: 642622 - RNA, 19 nt, Homo sapiens
gcccaauguuugucacuaa

SEQ ID NO: 642623 - RNA, 19 nt, Homo sapiens
uguaagagguuuggcaauu

SEQ ID NO: 642624 - RNA, 19 nt, Homo sapiens
guggaaggcuggaagaugu

SEQ ID NO: 642625 - RNA, 19 nt, Homo sapiens
uuuaucaggugguuacaua

SEQ ID NO: 642626 - RNA, 19 nt, Homo sapiens
gacaagggcuguuacucau

SEQ ID NO: 642627 - RNA, 19 nt, Homo sapiens
gaauacgguggauuaagua

SEQ ID NO: 642628 - RNA, 19 nt, Homo sapiens
gggaaagaauuugauuaug

SEQ ID NO: 642629 - RNA, 19 nt, Homo sapiens
agaauacgguggauuaagu

SEQ ID NO: 642630 - RNA, 19 nt, Homo sapiens
aagagaauacgguggauua

SEQ ID NO: 642631 - RNA, 19 nt, Homo sapiens
gaagagggacggauauuuu

SEQ ID NO: 642632 - RNA, 19 nt, Homo sapiens
gcaauaagaacauucacau

SEQ ID NO: 642633 - RNA, 19 nt, Homo sapiens
gaaguagacauaauaggau

SEQ ID NO: 642634 - RNA, 19 nt, Homo sapiens
gaagggaaagcccaauguu

SEQ ID NO: 642635 - RNA, 19 nt, Homo sapiens
gaugucccaugcaauagaa

SEQ ID NO: 642636 - RNA, 19 nt, Homo sapiens
ucacugaugucccaugcaa

SEQ ID NO: 642637 - RNA, 19 nt, Homo sapiens
agcaaacccuacacaaaua

SEQ ID NO: 642638 - RNA, 19 nt, Homo sapiens
guaccagguucugcaagua

SEQ ID NO: 642639 - RNA, 19 nt, Homo sapiens
ggaucaaguagcuaaauuu

SEQ ID NO: 642640 - RNA, 19 nt, Homo sapiens
gguggaccaucauauaaau

SEQ ID NO: 642641 - RNA, 19 nt, Homo sapiens
acgcaaccauugauucuaa

SEQ ID NO: 642642 - RNA, 19 nt, Homo sapiens
gaagaugugagaggacuuu

SEQ ID NO: 642643 - RNA, 19 nt, Homo sapiens
caaugacaaugacaucuuc

SEQ ID NO: 642644 - RNA, 19 nt, Homo sapiens
cauaaagaccauaacauug

SEQ ID NO: 642645 - RNA, 19 nt, Homo sapiens
ucaaucuucugaacccuaa

SEQ ID NO: 642646 - RNA, 19 nt, Homo sapiens
gaauuucuuuccugugcaa

SEQ ID NO: 642647 - RNA, 19 nt, Homo sapiens
gaauuuggaacauguugaa

SEQ ID NO: 642648 - RNA, 19 nt, Homo sapiens
uaacuucuccaccuucauu

SEQ ID NO: 642649 - RNA, 19 nt, Homo sapiens
cugagaaucuggaaacaug

SEQ ID NO: 642650 - RNA, 19 nt, Homo sapiens
uagaaccugucaugugaaa

SEQ ID NO: 642651 - RNA, 19 nt, Homo sapiens
cugcugaacugugagauuu

SEQ ID NO: 642652 - RNA, 19 nt, Homo sapiens
gaagagaagaaguuaacug

SEQ ID NO: 642653 - RNA, 19 nt, Homo sapiens
gcgagugauggcauuauua

SEQ ID NO: 642654 - RNA, 19 nt, Homo sapiens
ccaguauuaucucugcuuu

SEQ ID NO: 642655 - RNA, 19 nt, Homo sapiens
aauaguagacacacugaua

SEQ ID NO: 642656 - RNA, 19 nt, Homo sapiens
gaaggaacuuaauggaacu

SEQ ID NO: 642657 - RNA, 19 nt, Homo sapiens
ccaaugccacuuuauauuc

SEQ ID NO: 642658 - RNA, 19 nt, Homo sapiens
gacauaauaggaugaauca

SEQ ID NO: 642659 - RNA, 19 nt, Homo sapiens
gggaaugugcucaaacuau

SEQ ID NO: 642660 - RNA, 19 nt, Homo sapiens
uggcgagugucuugaagua

SEQ ID NO: 642661 - RNA, 19 nt, Homo sapiens
uaagcaagaguacaucaaa

SEQ ID NO: 642662 - RNA, 19 nt, Homo sapiens
caguucagcagucaucuua

SEQ ID NO: 642663 - RNA, 19 nt, Homo sapiens
gcaaacccuacacaaauau

SEQ ID NO: 642664 - RNA, 19 nt, Homo sapiens
aaacaggagcuuuacagaa

SEQ ID NO: 642665 - RNA, 19 nt, Homo sapiens
aaugacaagugcaugauga

SEQ ID NO: 642666 - RNA, 19 nt, Homo sapiens
caugacugauaacagauaa

SEQ ID NO: 642667 - RNA, 19 nt, Homo sapiens
caucuuaucaaucuucuga

SEQ ID NO: 642668 - RNA, 19 nt, Homo sapiens
ugaguggccauuccaauuu

SEQ ID NO: 642669 - RNA, 19 nt, Homo sapiens
cacaaaaggucaaauguug

SEQ ID NO: 642670 - RNA, 19 nt, Homo sapiens
ccucauugcucccauauua

SEQ ID NO: 642671 - RNA, 19 nt, Homo sapiens
gaauaucuguggccuauga

SEQ ID NO: 642672 - RNA, 19 nt, Homo sapiens
ggaaagagaccaucccaau

SEQ ID NO: 642673 - RNA, 19 nt, Homo sapiens
caacguggauucuuucauc

SEQ ID NO: 642674 - RNA, 19 nt, Homo sapiens
gggagagccuaguuucuuu

SEQ ID NO: 642675 - RNA, 19 nt, Homo sapiens
gggaauaucuguggccuau

SEQ ID NO: 642676 - RNA, 19 nt, Homo sapiens
gguguuaucccuguauuua

SEQ ID NO: 642677 - RNA, 19 nt, Homo sapiens
ggagaggccuucuuuccau

SEQ ID NO: 642678 - RNA, 19 nt, Homo sapiens
gaaagagaccaucccaaug

SEQ ID NO: 642679 - RNA, 19 nt, Homo sapiens
ggaagauccuggaccuaga

SEQ ID NO: 642680 - RNA, 19 nt, Homo sapiens
gcucacggguauuaaagaa

SEQ ID NO: 642681 - RNA, 19 nt, Homo sapiens
ggacaguuccguucuugaa

SEQ ID NO: 642682 - RNA, 19 nt, Homo sapiens
uaugaucaguguuggagua

SEQ ID NO: 642683 - RNA, 19 nt, Homo sapiens
uaagagggacuacccauga

SEQ ID NO: 642684 - RNA, 19 nt, Homo sapiens
gaaguugggaagugagaaa

SEQ ID NO: 642685 - RNA, 19 nt, Homo sapiens
gagaggccuucuuuccauu

SEQ ID NO: 642686 - RNA, 19 nt, Homo sapiens
uggcugaggcgaugcauua

SEQ ID NO: 642687 - RNA, 19 nt, Homo sapiens
ugacagugcucgaucucuu

SEQ ID NO: 642688 - RNA, 19 nt, Homo sapiens
cagaauauguuugcugcuu

SEQ ID NO: 642689 - RNA, 19 nt, Homo sapiens
gaacuccucgguccagaga

SEQ ID NO: 642690 - RNA, 19 nt, Homo sapiens
agaauauguuugcugcuuu

SEQ ID NO: 642691 - RNA, 19 nt, Homo sapiens
gggugcaucucaucugcua

SEQ ID NO: 642692 - RNA, 19 nt, Homo sapiens
uaugagaccugcauugaac

SEQ ID NO: 642693 - RNA, 19 nt, Homo sapiens
cagcuucuuugguuucuau

SEQ ID NO: 642694 - RNA, 19 nt, Homo sapiens
uuaaagaacuccgcguugu

SEQ ID NO: 642695 - RNA, 19 nt, Homo sapiens
ccaccucauugcucccaua

SEQ ID NO: 642696 - RNA, 19 nt, Homo sapiens
gaauauguuugcugcuuuu

SEQ ID NO: 642697 - RNA, 19 nt, Homo sapiens
ccucauguccucucauuug

SEQ ID NO: 642698 - RNA, 19 nt, Homo sapiens
ccaccacgaugacuuguac

SEQ ID NO: 642699 - RNA, 19 nt, Homo sapiens
ggccgaaguugggaaguga

SEQ ID NO: 642700 - RNA, 19 nt, Homo sapiens
uaaagaacuccgcguuguu

SEQ ID NO: 642701 - RNA, 19 nt, Homo sapiens
uguuaucccuguauuuaug

SEQ ID NO: 642702 - RNA, 19 nt, Homo sapiens
auagugagguguccaaugg

SEQ ID NO: 642703 - RNA, 19 nt, Homo sapiens
uggaggagcaacugguuua

SEQ ID NO: 642704 - RNA, 19 nt, Homo sapiens
ccaccuccaugcggucuaa

SEQ ID NO: 642705 - RNA, 19 nt, Homo sapiens
caguccagcuucuuugguu

SEQ ID NO: 642706 - RNA, 19 nt, Homo sapiens
gcaccuagggcgcaaugga

SEQ ID NO: 642707 - RNA, 19 nt, Homo sapiens
gcuccuccaugaaugacaa

SEQ ID NO: 642708 - RNA, 19 nt, Homo sapiens
ccacagaugggacaguaug

SEQ ID NO: 642709 - RNA, 19 nt, Homo sapiens
ggccaggaauucuccaucu

SEQ ID NO: 642710 - RNA, 19 nt, Homo sapiens
ucacggguauuaaagaacu

SEQ ID NO: 642711 - RNA, 19 nt, Homo sapiens
ccaggccacucaggacauu

SEQ ID NO: 642712 - RNA, 19 nt, Homo sapiens
ggaagugagaaaccauguu

SEQ ID NO: 642713 - RNA, 19 nt, Homo sapiens
gcuccgugcugucccuuuc

SEQ ID NO: 642714 - RNA, 19 nt, Homo sapiens
gagagccuaguuucuuuga

SEQ ID NO: 642715 - RNA, 19 nt, Homo sapiens
ggagagccuaguuucuuug

SEQ ID NO: 642716 - RNA, 19 nt, Homo sapiens
gcagaugucaggcuuuggu

SEQ ID NO: 642717 - RNA, 19 nt, Homo sapiens
aaagagaccaucccaaugc

SEQ ID NO: 642718 - RNA, 19 nt, Homo sapiens
gaucacaacguggauucuu

SEQ ID NO: 642719 - RNA, 19 nt, Homo sapiens
cugaggcgaugcauuagga

SEQ ID NO: 642720 - RNA, 19 nt, Homo sapiens
aggagcaacugguuuaucu

SEQ ID NO: 642721 - RNA, 19 nt, Homo sapiens
ccucuccucuccacagaug

SEQ ID NO: 642722 - RNA, 19 nt, Homo sapiens
gauggaggagcaacugguu

SEQ ID NO: 642723 - RNA, 19 nt, Homo sapiens
gaugacuuguaccucaaug

SEQ ID NO: 642724 - RNA, 19 nt, Homo sapiens
caccguggguuccagacuu

SEQ ID NO: 642725 - RNA, 19 nt, Homo sapiens
caugcggucuaaccucuau

SEQ ID NO: 642726 - RNA, 19 nt, Homo sapiens
gagacacggacuacuugaa

SEQ ID NO: 642727 - RNA, 19 nt, Homo sapiens
ggagacacggacuacuuga

SEQ ID NO: 642728 - RNA, 19 nt, Homo sapiens
ccaaccguacccuuuauga

SEQ ID NO: 642729 - RNA, 19 nt, Homo sapiens
ggaauacaucaaugagaca

SEQ ID NO: 642730 - RNA, 19 nt, Homo sapiens
gaagauccuggaccuagag

SEQ ID NO: 642731 - RNA, 19 nt, Homo sapiens
aaccguacccuuuaugaga

SEQ ID NO: 642732 - RNA, 19 nt, Homo sapiens
acaguuccguucuugaagu

SEQ ID NO: 642733 - RNA, 19 nt, Homo sapiens
cuccguaucuggcuguaug

SEQ ID NO: 642734 - RNA, 19 nt, Homo sapiens
caguauggcggaagaacuu

SEQ ID NO: 642735 - RNA, 19 nt, Homo sapiens
cuccacagaugggacagua

SEQ ID NO: 642736 - RNA, 19 nt, Homo sapiens
uuaacuaccuuugaauagg

SEQ ID NO: 642737 - RNA, 19 nt, Homo sapiens
gacaucagcccucccaacu

SEQ ID NO: 642738 - RNA, 19 nt, Homo sapiens
gccaggaauucuccaucug

SEQ ID NO: 642739 - RNA, 19 nt, Homo sapiens
acuccaaccguacccuuua

SEQ ID NO: 642740 - RNA, 19 nt, Homo sapiens
gguguccaauggccgguau

SEQ ID NO: 642741 - RNA, 19 nt, Homo sapiens
ggagauggaggagcaacug

SEQ ID NO: 642742 - RNA, 19 nt, Homo sapiens
gaugaugguguuauuacuc

SEQ ID NO: 642743 - RNA, 19 nt, Homo sapiens
ccaucccaaugccacagua

SEQ ID NO: 642744 - RNA, 19 nt, Homo sapiens
gcagcuuccuggcccugau

SEQ ID NO: 642745 - RNA, 19 nt, Homo sapiens
ucacaacguggauucuuuc

SEQ ID NO: 642746 - RNA, 19 nt, Homo sapiens
gcugcucacggguauuaaa

SEQ ID NO: 642747 - RNA, 19 nt, Homo sapiens
uccgccaccugcuggaaua

SEQ ID NO: 642748 - RNA, 19 nt, Homo sapiens
ggcgaugcauuaggaagau

SEQ ID NO: 642749 - RNA, 19 nt, Homo sapiens
uagguguuaucccuguauu

SEQ ID NO: 642750 - RNA, 19 nt, Homo sapiens
gagacuuggccucccagaa

SEQ ID NO: 642751 - RNA, 19 nt, Homo sapiens
gagacgggguuuuaguaga

SEQ ID NO: 642752 - RNA, 19 nt, Homo sapiens
ccugaugaugguguuauua

SEQ ID NO: 642753 - RNA, 19 nt, Homo sapiens
gggcucugcuuucugucau

SEQ ID NO: 642754 - RNA, 19 nt, Homo sapiens
ccuagggcgcaauggaaua

SEQ ID NO: 642755 - RNA, 19 nt, Homo sapiens
ccucugcuccuccaugaau

SEQ ID NO: 642756 - RNA, 19 nt, Homo sapiens
ggaggagcaacugguuuau

SEQ ID NO: 642757 - RNA, 19 nt, Homo sapiens
aucacaacguggauucuuu

SEQ ID NO: 642758 - RNA, 19 nt, Homo sapiens
gaugaucacaacguggauu

SEQ ID NO: 642759 - RNA, 19 nt, Homo sapiens
cugcugcucacggguauua

SEQ ID NO: 642760 - RNA, 19 nt, Homo sapiens
cuucuuugguuucuaugau

SEQ ID NO: 642761 - RNA, 19 nt, Homo sapiens
aauagguguuaucccugua

SEQ ID NO: 642762 - RNA, 19 nt, Homo sapiens
caccuagggcgcaauggaa

SEQ ID NO: 642763 - RNA, 19 nt, Homo sapiens
agacuuggccucccagaac

SEQ ID NO: 642764 - RNA, 19 nt, Homo sapiens
ucauugcucccauauuauc

SEQ ID NO: 642765 - RNA, 19 nt, Homo sapiens
gauccuggaccuagagaac

SEQ ID NO: 642766 - RNA, 19 nt, Homo sapiens
ucuaaccucuaucggaucu

SEQ ID NO: 642767 - RNA, 19 nt, Homo sapiens
agacacggacuacuugaag

SEQ ID NO: 642768 - RNA, 19 nt, Homo sapiens
ugggagagccuaguuucuu

SEQ ID NO: 642769 - RNA, 19 nt, Homo sapiens
ugguuuaucugcgggauuc

SEQ ID NO: 642770 - RNA, 19 nt, Homo sapiens
ccucauugcucccauauua

SEQ ID NO: 642771 - RNA, 19 nt, Homo sapiens
gaauaucuguggccuauga

SEQ ID NO: 642772 - RNA, 19 nt, Homo sapiens
ggaaagagaccaucccaau

SEQ ID NO: 642773 - RNA, 19 nt, Homo sapiens
caacguggauucuuucauc

SEQ ID NO: 642774 - RNA, 19 nt, Homo sapiens
gggagagccuaguuucuuu

SEQ ID NO: 642775 - RNA, 19 nt, Homo sapiens
gggaauaucuguggccuau

SEQ ID NO: 642776 - RNA, 19 nt, Homo sapiens
gguguuaucccuguauuua

SEQ ID NO: 642777 - RNA, 19 nt, Homo sapiens
gaaagagaccaucccaaug

SEQ ID NO: 642778 - RNA, 19 nt, Homo sapiens
aaaguuccauuuccucaaa

SEQ ID NO: 642779 - RNA, 19 nt, Homo sapiens
ggacaguuccguucuugaa

SEQ ID NO: 642780 - RNA, 19 nt, Homo sapiens
uaugaucaguguuggagua

SEQ ID NO: 642781 - RNA, 19 nt, Homo sapiens
uaagagggacuacccauga

SEQ ID NO: 642782 - RNA, 19 nt, Homo sapiens
gcacuacacgcacuucaga

SEQ ID NO: 642783 - RNA, 19 nt, Homo sapiens
gaaguugggaagugagaaa

SEQ ID NO: 642784 - RNA, 19 nt, Homo sapiens
ugacagugcucgaucucuu

SEQ ID NO: 642785 - RNA, 19 nt, Homo sapiens
gaacuccucgguccagaga

SEQ ID NO: 642786 - RNA, 19 nt, Homo sapiens
gggugcaucucaucugcua

SEQ ID NO: 642787 - RNA, 19 nt, Homo sapiens
uacacgcacuucagaauga

SEQ ID NO: 642788 - RNA, 19 nt, Homo sapiens
uaugagaccugcauugaac

SEQ ID NO: 642789 - RNA, 19 nt, Homo sapiens
cagcuucuuugguuucuau

SEQ ID NO: 642790 - RNA, 19 nt, Homo sapiens
ccaccucauugcucccaua

SEQ ID NO: 642791 - RNA, 19 nt, Homo sapiens
ccucauguccucucauuug

SEQ ID NO: 642792 - RNA, 19 nt, Homo sapiens
ccaccacgaugacuuguac

SEQ ID NO: 642793 - RNA, 19 nt, Homo sapiens
ggccgaaguugggaaguga

SEQ ID NO: 642794 - RNA, 19 nt, Homo sapiens
uguuaucccuguauuuaug

SEQ ID NO: 642795 - RNA, 19 nt, Homo sapiens
auagugagguguccaaugg

SEQ ID NO: 642796 - RNA, 19 nt, Homo sapiens
uggaggagcaacugguuua

SEQ ID NO: 642797 - RNA, 19 nt, Homo sapiens
ccaccuccaugcggucuaa

SEQ ID NO: 642798 - RNA, 19 nt, Homo sapiens
caguccagcuucuuugguu

SEQ ID NO: 642799 - RNA, 19 nt, Homo sapiens
gcuccuccaugaaugacaa

SEQ ID NO: 642800 - RNA, 19 nt, Homo sapiens
ccacagaugggacaguaug

SEQ ID NO: 642801 - RNA, 19 nt, Homo sapiens
ggccaggaauucuccaucu

SEQ ID NO: 642802 - RNA, 19 nt, Homo sapiens
ccaggccacucaggacauu

SEQ ID NO: 642803 - RNA, 19 nt, Homo sapiens
ggaagugagaaaccauguu

SEQ ID NO: 642804 - RNA, 19 nt, Homo sapiens
gcuccgugcugucccuuuc

SEQ ID NO: 642805 - RNA, 19 nt, Homo sapiens
gagagccuaguuucuuuga

SEQ ID NO: 642806 - RNA, 19 nt, Homo sapiens
ggagagccuaguuucuuug

SEQ ID NO: 642807 - RNA, 19 nt, Homo sapiens
gcagaugucaggcuuuggu

SEQ ID NO: 642808 - RNA, 19 nt, Homo sapiens
aaagagaccaucccaaugc

SEQ ID NO: 642809 - RNA, 19 nt, Homo sapiens
gaucacaacguggauucuu

SEQ ID NO: 642810 - RNA, 19 nt, Homo sapiens
aggagcaacugguuuaucu

SEQ ID NO: 642811 - RNA, 19 nt, Homo sapiens
ccucuccucuccacagaug

SEQ ID NO: 642812 - RNA, 19 nt, Homo sapiens
gauggaggagcaacugguu

SEQ ID NO: 642813 - RNA, 19 nt, Homo sapiens
gaugacuuguaccucaaug

SEQ ID NO: 642814 - RNA, 19 nt, Homo sapiens
caugcggucuaaccucuau

SEQ ID NO: 642815 - RNA, 19 nt, Homo sapiens
gagacacggacuacuugaa

SEQ ID NO: 642816 - RNA, 19 nt, Homo sapiens
ggagacacggacuacuuga

SEQ ID NO: 642817 - RNA, 19 nt, Homo sapiens
ccaaccguacccuuuauga

SEQ ID NO: 642818 - RNA, 19 nt, Homo sapiens
ggaauacaucaaugagaca

SEQ ID NO: 642819 - RNA, 19 nt, Homo sapiens
aaccguacccuuuaugaga

SEQ ID NO: 642820 - RNA, 19 nt, Homo sapiens
acaguuccguucuugaagu

SEQ ID NO: 642821 - RNA, 19 nt, Homo sapiens
cuccguaucuggcuguaug

SEQ ID NO: 642822 - RNA, 19 nt, Homo sapiens
caguauggcggaagaacuu

SEQ ID NO: 642823 - RNA, 19 nt, Homo sapiens
cuccacagaugggacagua

SEQ ID NO: 642824 - RNA, 19 nt, Homo sapiens
uuaacuaccuuugaauagg

SEQ ID NO: 642825 - RNA, 19 nt, Homo sapiens
gacaucagcccucccaacu

SEQ ID NO: 642826 - RNA, 19 nt, Homo sapiens
gccaggaauucuccaucug

SEQ ID NO: 642827 - RNA, 19 nt, Homo sapiens
gaguagggcaggagaaacu

SEQ ID NO: 642828 - RNA, 19 nt, Homo sapiens
acuccaaccguacccuuua

SEQ ID NO: 642829 - RNA, 19 nt, Homo sapiens
gguguccaauggccgguau

SEQ ID NO: 642830 - RNA, 19 nt, Homo sapiens
ggagauggaggagcaacug

SEQ ID NO: 642831 - RNA, 19 nt, Homo sapiens
gaugaugguguuauuacuc

SEQ ID NO: 642832 - RNA, 19 nt, Homo sapiens
ccaucccaaugccacagua

SEQ ID NO: 642833 - RNA, 19 nt, Homo sapiens
gcagcuuccuggcccugau

SEQ ID NO: 642834 - RNA, 19 nt, Homo sapiens
ucacaacguggauucuuuc

SEQ ID NO: 642835 - RNA, 19 nt, Homo sapiens
uccgccaccugcuggaaua

SEQ ID NO: 642836 - RNA, 19 nt, Homo sapiens
uaaaguuccauuuccucaa

SEQ ID NO: 642837 - RNA, 19 nt, Homo sapiens
uagguguuaucccuguauu

SEQ ID NO: 642838 - RNA, 19 nt, Homo sapiens
uagaguagggcaggagaaa

SEQ ID NO: 642839 - RNA, 19 nt, Homo sapiens
gagacuuggccucccagaa

SEQ ID NO: 642840 - RNA, 19 nt, Homo sapiens
gagacgggguuuuaguaga

SEQ ID NO: 642841 - RNA, 19 nt, Homo sapiens
ccugaugaugguguuauua

SEQ ID NO: 642842 - RNA, 19 nt, Homo sapiens
cuacacgcacuucagaaug

SEQ ID NO: 642843 - RNA, 19 nt, Homo sapiens
gggcucugcuuucugucau

SEQ ID NO: 642844 - RNA, 19 nt, Homo sapiens
ccucugcuccuccaugaau

SEQ ID NO: 642845 - RNA, 19 nt, Homo sapiens
ggaggagcaacugguuuau

SEQ ID NO: 642846 - RNA, 19 nt, Homo sapiens
aucacaacguggauucuuu

SEQ ID NO: 642847 - RNA, 19 nt, Homo sapiens
gaugaucacaacguggauu

SEQ ID NO: 642848 - RNA, 19 nt, Homo sapiens
cuucuuugguuucuaugau

SEQ ID NO: 642849 - RNA, 19 nt, Homo sapiens
aauagguguuaucccugua

SEQ ID NO: 642850 - RNA, 19 nt, Homo sapiens
agacuuggccucccagaac

SEQ ID NO: 642851 - RNA, 19 nt, Homo sapiens
ucauugcucccauauuauc

SEQ ID NO: 642852 - RNA, 19 nt, Homo sapiens
ucuaaccucuaucggaucu

SEQ ID NO: 642853 - RNA, 19 nt, Homo sapiens
agacacggacuacuugaag

SEQ ID NO: 642854 - RNA, 19 nt, Homo sapiens
ugggagagccuaguuucuu

SEQ ID NO: 642855 - RNA, 19 nt, Homo sapiens
cugcuggaauacaucaaug

SEQ ID NO: 642856 - RNA, 19 nt, Homo sapiens
ugguuuaucugcgggauuc

SEQ ID NO: 642857 - RNA, 19 nt, Homo sapiens
gaggagcaacugguuuauc

SEQ ID NO: 642858 - RNA, 19 nt, Homo sapiens
agaccguccuggagaugga

SEQ ID NO: 642859 - RNA, 19 nt, Homo sapiens
gacagugcucgaucucuuc

SEQ ID NO: 642860 - RNA, 19 nt, Homo sapiens
ggcaagaacugcuucaauu

SEQ ID NO: 642861 - RNA, 19 nt, Homo sapiens
gaaagaagccagccuguag

SEQ ID NO: 642862 - RNA, 19 nt, Homo sapiens
ggaaagagaccaucccaau

SEQ ID NO: 642863 - RNA, 19 nt, Homo sapiens
caacguggauucuuucauc

SEQ ID NO: 642864 - RNA, 19 nt, Homo sapiens
gaacugcuucaauuccuua

SEQ ID NO: 642865 - RNA, 19 nt, Homo sapiens
agagagaggugacaacaga

SEQ ID NO: 642866 - RNA, 19 nt, Homo sapiens
ggagaggccuucuuuccau

SEQ ID NO: 642867 - RNA, 19 nt, Homo sapiens
gaaagagaccaucccaaug

SEQ ID NO: 642868 - RNA, 19 nt, Homo sapiens
ggaagauccuggaccuaga

SEQ ID NO: 642869 - RNA, 19 nt, Homo sapiens
gcucacggguauuaaagaa

SEQ ID NO: 642870 - RNA, 19 nt, Homo sapiens
gcaagaacugcuucaauuc

SEQ ID NO: 642871 - RNA, 19 nt, Homo sapiens
aaagagcaaugaacaaugg

SEQ ID NO: 642872 - RNA, 19 nt, Homo sapiens
ccagaucucucucucucuu

SEQ ID NO: 642873 - RNA, 19 nt, Homo sapiens
gaacaauggaaacuucaga

SEQ ID NO: 642874 - RNA, 19 nt, Homo sapiens
cggcgucaaucaucgauaa

SEQ ID NO: 642875 - RNA, 19 nt, Homo sapiens
gagaggccuucuuuccauu

SEQ ID NO: 642876 - RNA, 19 nt, Homo sapiens
uggcugaggcgaugcauua

SEQ ID NO: 642877 - RNA, 19 nt, Homo sapiens
gaauguaggaccagcauca

SEQ ID NO: 642878 - RNA, 19 nt, Homo sapiens
ugacagugcucgaucucuu

SEQ ID NO: 642879 - RNA, 19 nt, Homo sapiens
agaucucucucucucuuua

SEQ ID NO: 642880 - RNA, 19 nt, Homo sapiens
cagaauauguuugcugcuu

SEQ ID NO: 642881 - RNA, 19 nt, Homo sapiens
gggcugagcugugcacucu

SEQ ID NO: 642882 - RNA, 19 nt, Homo sapiens
cgucaaucaucgauaagaa

SEQ ID NO: 642883 - RNA, 19 nt, Homo sapiens
gggugcaucucaucugcua

SEQ ID NO: 642884 - RNA, 19 nt, Homo sapiens
agaauauguuugcugcuuu

SEQ ID NO: 642885 - RNA, 19 nt, Homo sapiens
uaacaaaugcaaccaccaa

SEQ ID NO: 642886 - RNA, 19 nt, Homo sapiens
cagcuucuuugguuucuau

SEQ ID NO: 642887 - RNA, 19 nt, Homo sapiens
uuaaagaacuccgcguugu

SEQ ID NO: 642888 - RNA, 19 nt, Homo sapiens
gagcaaugaacaauggaaa

SEQ ID NO: 642889 - RNA, 19 nt, Homo sapiens
gaaaccggacccacuaauc

SEQ ID NO: 642890 - RNA, 19 nt, Homo sapiens
gaauauguuugcugcuuuu

SEQ ID NO: 642891 - RNA, 19 nt, Homo sapiens
ccaaagagcaaugaacaau

SEQ ID NO: 642892 - RNA, 19 nt, Homo sapiens
aaugaacaauggaaacuuc

SEQ ID NO: 642893 - RNA, 19 nt, Homo sapiens
caaagagcaaugaacaaug

SEQ ID NO: 642894 - RNA, 19 nt, Homo sapiens
ccaccacgaugacuuguac

SEQ ID NO: 642895 - RNA, 19 nt, Homo sapiens
uaaagaacuccgcguuguu

SEQ ID NO: 642896 - RNA, 19 nt, Homo sapiens
ccaccuccaugcggucuaa

SEQ ID NO: 642897 - RNA, 19 nt, Homo sapiens
gggcaagaacugcuucaau

SEQ ID NO: 642898 - RNA, 19 nt, Homo sapiens
acagaaaccggacccacua

SEQ ID NO: 642899 - RNA, 19 nt, Homo sapiens
ggagggaagcacugucaug

SEQ ID NO: 642900 - RNA, 19 nt, Homo sapiens
gcaccuagggcgcaaugga

SEQ ID NO: 642901 - RNA, 19 nt, Homo sapiens
caguccagcuucuuugguu

SEQ ID NO: 642902 - RNA, 19 nt, Homo sapiens
ccacagaugggacaguaug

SEQ ID NO: 642903 - RNA, 19 nt, Homo sapiens
acugugagcugcagauaag

SEQ ID NO: 642904 - RNA, 19 nt, Homo sapiens
gaccauguaccgcguuaug

SEQ ID NO: 642905 - RNA, 19 nt, Homo sapiens
ggccaggaauucuccaucu

SEQ ID NO: 642906 - RNA, 19 nt, Homo sapiens
ucacggguauuaaagaacu

SEQ ID NO: 642907 - RNA, 19 nt, Homo sapiens
gagggaagcacugucaugu

SEQ ID NO: 642908 - RNA, 19 nt, Homo sapiens
gcugagcugugcacucucu

SEQ ID NO: 642909 - RNA, 19 nt, Homo sapiens
aaagagaccaucccaaugc

SEQ ID NO: 642910 - RNA, 19 nt, Homo sapiens
gaucacaacguggauucuu

SEQ ID NO: 642911 - RNA, 19 nt, Homo sapiens
cugaggcgaugcauuagga

SEQ ID NO: 642912 - RNA, 19 nt, Homo sapiens
gcaaugaacaauggaaacu

SEQ ID NO: 642913 - RNA, 19 nt, Homo sapiens
ggugagaggcugucaucug

SEQ ID NO: 642914 - RNA, 19 nt, Homo sapiens
ccucuccucuccacagaug

SEQ ID NO: 642915 - RNA, 19 nt, Homo sapiens
caccguggguuccagacuu

SEQ ID NO: 642916 - RNA, 19 nt, Homo sapiens
agaaagaagccagccugua

SEQ ID NO: 642917 - RNA, 19 nt, Homo sapiens
gaugacuuguaccucaaug

SEQ ID NO: 642918 - RNA, 19 nt, Homo sapiens
caugcggucuaaccucuau

SEQ ID NO: 642919 - RNA, 19 nt, Homo sapiens
gagacacggacuacuugaa

SEQ ID NO: 642920 - RNA, 19 nt, Homo sapiens
ggagacacggacuacuuga

SEQ ID NO: 642921 - RNA, 19 nt, Homo sapiens
cugcuucaauuccuuaaca

SEQ ID NO: 642922 - RNA, 19 nt, Homo sapiens
caccaaagagcaaugaaca

SEQ ID NO: 642923 - RNA, 19 nt, Homo sapiens
gcuaucagccaccaaagag

SEQ ID NO: 642924 - RNA, 19 nt, Homo sapiens
gaccggaucgaaucucuca

SEQ ID NO: 642925 - RNA, 19 nt, Homo sapiens
cccaaccagugccagcaua

SEQ ID NO: 642926 - RNA, 19 nt, Homo sapiens
gggccucaguagccucuug

SEQ ID NO: 642927 - RNA, 19 nt, Homo sapiens
gggcuucacaggaggcaaa

SEQ ID NO: 642928 - RNA, 19 nt, Homo sapiens
ggaauacaucaaugagaca

SEQ ID NO: 642929 - RNA, 19 nt, Homo sapiens
gagcugcagauaaggcuau

SEQ ID NO: 642930 - RNA, 19 nt, Homo sapiens
ccaccagucugagcugcuu

SEQ ID NO: 642931 - RNA, 19 nt, Homo sapiens
gaagauccuggaccuagag

SEQ ID NO: 642932 - RNA, 19 nt, Homo sapiens
ucaauuccuuaacaaaugc

SEQ ID NO: 642933 - RNA, 19 nt, Homo sapiens
gacugugagcugcagauaa

SEQ ID NO: 642934 - RNA, 19 nt, Homo sapiens
cagaaaccggacccacuaa

SEQ ID NO: 642935 - RNA, 19 nt, Homo sapiens
gagcugugcacucucuuag

SEQ ID NO: 642936 - RNA, 19 nt, Homo sapiens
caguauggcggaagaacuu

SEQ ID NO: 642937 - RNA, 19 nt, Homo sapiens
cuccacagaugggacagua

SEQ ID NO: 642938 - RNA, 19 nt, Homo sapiens
gaagagcugcagccagaac

SEQ ID NO: 642939 - RNA, 19 nt, Homo sapiens
gccaggaauucuccaucug

SEQ ID NO: 642940 - RNA, 19 nt, Homo sapiens
cgacugugagcugcagaua

SEQ ID NO: 642941 - RNA, 19 nt, Homo sapiens
ugagcugugcacucucuua

SEQ ID NO: 642942 - RNA, 19 nt, Homo sapiens
ggagauggaggagcaacug

SEQ ID NO: 642943 - RNA, 19 nt, Homo sapiens
gaugaugguguuauuacuc

SEQ ID NO: 642944 - RNA, 19 nt, Homo sapiens
ccaucccaaugccacagua

SEQ ID NO: 642945 - RNA, 19 nt, Homo sapiens
gcagcuuccuggcccugau

SEQ ID NO: 642946 - RNA, 19 nt, Homo sapiens
ucacaacguggauucuuuc

SEQ ID NO: 642947 - RNA, 19 nt, Homo sapiens
gcugcucacggguauuaaa

SEQ ID NO: 642948 - RNA, 19 nt, Homo sapiens
ggcgaugcauuaggaagau

SEQ ID NO: 642949 - RNA, 19 nt, Homo sapiens
uccgccaccugcuggaaua

SEQ ID NO: 642950 - RNA, 19 nt, Homo sapiens
ccugaugaugguguuauua

SEQ ID NO: 642951 - RNA, 19 nt, Homo sapiens
gggcucugcuuucugucau

SEQ ID NO: 642952 - RNA, 19 nt, Homo sapiens
gcuucaauuccuuaacaaa

SEQ ID NO: 642953 - RNA, 19 nt, Homo sapiens
agaacugcuucaauuccuu

SEQ ID NO: 642954 - RNA, 19 nt, Homo sapiens
ccuagggcgcaauggaaua

SEQ ID NO: 642955 - RNA, 19 nt, Homo sapiens
cagcagacccaugcagugu

SEQ ID NO: 642956 - RNA, 19 nt, Homo sapiens
aggcgcaucugcagcacuu

SEQ ID NO: 642957 - RNA, 19 nt, Homo sapiens
cugcugcucacggguauua

SEQ ID NO: 642958 - RNA, 19 nt, Homo sapiens
aucacaacguggauucuuu

SEQ ID NO: 642959 - RNA, 19 nt, Homo sapiens
gaugaucacaacguggauu

SEQ ID NO: 642960 - RNA, 19 nt, Homo sapiens
gaauuuggcuggaaacuug

SEQ ID NO: 642961 - RNA, 19 nt, Homo sapiens
gcacaaagauauugcuaga

SEQ ID NO: 642962 - RNA, 19 nt, Homo sapiens
ccuauuggcuguuacauua

SEQ ID NO: 642963 - RNA, 19 nt, Homo sapiens
aaagaugccuguguuauua

SEQ ID NO: 642964 - RNA, 19 nt, Homo sapiens
agagaaagcugaagacaaa

SEQ ID NO: 642965 - RNA, 19 nt, Homo sapiens
ggaaagcgcccaucugaaa

SEQ ID NO: 642966 - RNA, 19 nt, Homo sapiens
aaauaaaccucuucccaua

SEQ ID NO: 642967 - RNA, 19 nt, Homo sapiens
ggucauuguucucuucuua

SEQ ID NO: 642968 - RNA, 19 nt, Homo sapiens
ggucacaccagauguauua

SEQ ID NO: 642969 - RNA, 19 nt, Homo sapiens
caacuauacuucuuugcua

SEQ ID NO: 642970 - RNA, 19 nt, Homo sapiens
ggaagaauuuggcuggaaa

SEQ ID NO: 642971 - RNA, 19 nt, Homo sapiens
ggaaugguagcuaugauua

SEQ ID NO: 642972 - RNA, 19 nt, Homo sapiens
gcacaauucuguacuuugg

SEQ ID NO: 642973 - RNA, 19 nt, Homo sapiens
ggacacugguugccauauu

SEQ ID NO: 642974 - RNA, 19 nt, Homo sapiens
ccgaaaagcuucaaacaua

SEQ ID NO: 642975 - RNA, 19 nt, Homo sapiens
gcauuuguauugugauuug

SEQ ID NO: 642976 - RNA, 19 nt, Homo sapiens
gaaacaccguaauucuaaa

SEQ ID NO: 642977 - RNA, 19 nt, Homo sapiens
gcugacuucuuuauaauga

SEQ ID NO: 642978 - RNA, 19 nt, Homo sapiens
cuucuuaucuggaauggua

SEQ ID NO: 642979 - RNA, 19 nt, Homo sapiens
cgaggaagaugauaagauc

SEQ ID NO: 642980 - RNA, 19 nt, Homo sapiens
aaucaguucuuccuuauga

SEQ ID NO: 642981 - RNA, 19 nt, Homo sapiens
aaacauaccauacagagaa

SEQ ID NO: 642982 - RNA, 19 nt, Homo sapiens
uguauuugcugacuucuuu

SEQ ID NO: 642983 - RNA, 19 nt, Homo sapiens
cuucaaacauacccauaua

SEQ ID NO: 642984 - RNA, 19 nt, Homo sapiens
guuauuaccuguucugaag

SEQ ID NO: 642985 - RNA, 19 nt, Homo sapiens
ugaauucccuggucauugu

SEQ ID NO: 642986 - RNA, 19 nt, Homo sapiens
gugcaaggccgaaauagaa

SEQ ID NO: 642987 - RNA, 19 nt, Homo sapiens
cagaauuauuggccuagua

SEQ ID NO: 642988 - RNA, 19 nt, Homo sapiens
gaaggagaccuguaagcuu

SEQ ID NO: 642989 - RNA, 19 nt, Homo sapiens
ggacacugcacaaagauau

SEQ ID NO: 642990 - RNA, 19 nt, Homo sapiens
ggugaagguugacugaaga

SEQ ID NO: 642991 - RNA, 19 nt, Homo sapiens
gacacugguugccauauug

SEQ ID NO: 642992 - RNA, 19 nt, Homo sapiens
gccuauacuuacucuguua

SEQ ID NO: 642993 - RNA, 19 nt, Homo sapiens
gaauacacagcguuugauu

SEQ ID NO: 642994 - RNA, 19 nt, Homo sapiens
ccuguaagcuuguuuguac

SEQ ID NO: 642995 - RNA, 19 nt, Homo sapiens
acaauuggcuucuuugcau

SEQ ID NO: 642996 - RNA, 19 nt, Homo sapiens
gaaaagggaugcugcuauc

SEQ ID NO: 642997 - RNA, 19 nt, Homo sapiens
auucagugguuuagcauua

SEQ ID NO: 642998 - RNA, 19 nt, Homo sapiens
caagcacaauucuguacuu

SEQ ID NO: 642999 - RNA, 19 nt, Homo sapiens
gugcagaggauuaucauug

SEQ ID NO: 643000 - RNA, 19 nt, Homo sapiens
guuuauuggugcauacuuu

SEQ ID NO: 643001 - RNA, 19 nt, Homo sapiens
gaacagcaagcacaauucu

SEQ ID NO: 643002 - RNA, 19 nt, Homo sapiens
caacuuuucuucauucuga

SEQ ID NO: 643003 - RNA, 19 nt, Homo sapiens
gauuguauuugcugacuuc

SEQ ID NO: 643004 - RNA, 19 nt, Homo sapiens
ggaagaugcccaggaagaa

SEQ ID NO: 643005 - RNA, 19 nt, Homo sapiens
gguuuagcauuaugaauuc

SEQ ID NO: 643006 - RNA, 19 nt, Homo sapiens
gaucugucuucaacacuau

SEQ ID NO: 643007 - RNA, 19 nt, Homo sapiens
gggaacagcaagcacaauu

SEQ ID NO: 643008 - RNA, 19 nt, Homo sapiens
acgaagcccuugccuggua

SEQ ID NO: 643009 - RNA, 19 nt, Homo sapiens
gauuuccuauuggcuguua

SEQ ID NO: 643010 - RNA, 19 nt, Homo sapiens
uuacauguuuggcuuccua

SEQ ID NO: 643011 - RNA, 19 nt, Homo sapiens
cccuuuggcugcaucuuua

SEQ ID NO: 643012 - RNA, 19 nt, Homo sapiens
ucaaacauacccauauaga

SEQ ID NO: 643013 - RNA, 19 nt, Homo sapiens
gaaacuuguucauggugau

SEQ ID NO: 643014 - RNA, 19 nt, Homo sapiens
guccaugggagcaagauua

SEQ ID NO: 643015 - RNA, 19 nt, Homo sapiens
gaaagcugaagacaaacaa

SEQ ID NO: 643016 - RNA, 19 nt, Homo sapiens
aggaacaauuggcuucuuu

SEQ ID NO: 643017 - RNA, 19 nt, Homo sapiens
ccaccuaugugcagaggau

SEQ ID NO: 643018 - RNA, 19 nt, Homo sapiens
gcccuugccugguauuauc

SEQ ID NO: 643019 - RNA, 19 nt, Homo sapiens
gcccuuugguucugcauau

SEQ ID NO: 643020 - RNA, 19 nt, Homo sapiens
gcugccagauucuauaagu

SEQ ID NO: 643021 - RNA, 19 nt, Homo sapiens
uauauuccguccuccaaga

SEQ ID NO: 643022 - RNA, 19 nt, Homo sapiens
gaagaugcccaggaagaau

SEQ ID NO: 643023 - RNA, 19 nt, Homo sapiens
auaagaaggagaccuguaa

SEQ ID NO: 643024 - RNA, 19 nt, Homo sapiens
cugaagaaguccagugugu

SEQ ID NO: 643025 - RNA, 19 nt, Homo sapiens
gaagguugacugaagaagu

SEQ ID NO: 643026 - RNA, 19 nt, Homo sapiens
acaauucuguacuuugguu

SEQ ID NO: 643027 - RNA, 19 nt, Homo sapiens
gaaggaaagcgcccaucug

SEQ ID NO: 643028 - RNA, 19 nt, Homo sapiens
uaucuggaaugguagcuau

SEQ ID NO: 643029 - RNA, 19 nt, Homo sapiens
ccaugaaagagauacauuu

SEQ ID NO: 643030 - RNA, 19 nt, Homo sapiens
cauguuuggcuuccuauuu

SEQ ID NO: 643031 - RNA, 19 nt, Homo sapiens
cgagugcaaggccgaaaua

SEQ ID NO: 643032 - RNA, 19 nt, Homo sapiens
gaaugguagcuaugauuau

SEQ ID NO: 643033 - RNA, 19 nt, Homo sapiens
aaggaaagcgcccaucuga

SEQ ID NO: 643034 - RNA, 19 nt, Homo sapiens
agaauuauuggccuaguaa

SEQ ID NO: 643035 - RNA, 19 nt, Homo sapiens
aagcacaauucuguacuuu

SEQ ID NO: 643036 - RNA, 19 nt, Homo sapiens
aagcaacuauacuucuuug

SEQ ID NO: 643037 - RNA, 19 nt, Homo sapiens
ugacguuuauuggugcaua

SEQ ID NO: 643038 - RNA, 19 nt, Homo sapiens
gcgucuagaugggacuaua

SEQ ID NO: 643039 - RNA, 19 nt, Homo sapiens
gcaaaagaugccuguguua

SEQ ID NO: 643040 - RNA, 19 nt, Homo sapiens
gaaccuucaccauauaagu

SEQ ID NO: 643041 - RNA, 19 nt, Homo sapiens
gugacugccuugaguuuua

SEQ ID NO: 643042 - RNA, 19 nt, Homo sapiens
aguccaguguguccaguua

SEQ ID NO: 643043 - RNA, 19 nt, Homo sapiens
ggaacagcaagcacaauuc

SEQ ID NO: 643044 - RNA, 19 nt, Homo sapiens
uacggacacugcacaaaga

SEQ ID NO: 643045 - RNA, 19 nt, Homo sapiens
aaugguagcuaugauuaug

SEQ ID NO: 643046 - RNA, 19 nt, Homo sapiens
caaacauacccauauagau

SEQ ID NO: 643047 - RNA, 19 nt, Homo sapiens
auaaaccucuucccauaca

SEQ ID NO: 643048 - RNA, 19 nt, Homo sapiens
ggaacaauuggcuucuuug

SEQ ID NO: 643049 - RNA, 19 nt, Homo sapiens
uggcuuuacugcaguuuau

SEQ ID NO: 643050 - RNA, 19 nt, Homo sapiens
cagauucuauaaguccuuu

SEQ ID NO: 643051 - RNA, 19 nt, Homo sapiens
gcuaucagucuuucuagga

SEQ ID NO: 643052 - RNA, 19 nt, Homo sapiens
gauauauuccguccuccaa

SEQ ID NO: 643053 - RNA, 19 nt, Homo sapiens
uacggaagaugcccaggaa

SEQ ID NO: 643054 - RNA, 19 nt, Homo sapiens
guucucuucuuaucuggaa

SEQ ID NO: 643055 - RNA, 19 nt, Homo sapiens
cagacuugauucaguggaa

SEQ ID NO: 643056 - RNA, 19 nt, Homo sapiens
auaaucagauggacucuac

SEQ ID NO: 643057 - RNA, 19 nt, Homo sapiens
agaucugucuucaacacua

SEQ ID NO: 643058 - RNA, 19 nt, Homo sapiens
ggugagaaguggaaaacaa

SEQ ID NO: 643059 - RNA, 19 nt, Homo sapiens
gauggacucuacggaagau

SEQ ID NO: 643060 - RNA, 19 nt, Homo sapiens
gaugggagguuucaauaaa

SEQ ID NO: 643061 - RNA, 19 nt, Homo sapiens
caucuuggcucucaccuuu

SEQ ID NO: 643062 - RNA, 19 nt, Homo sapiens
gagaaaggcucagcuugga

SEQ ID NO: 643063 - RNA, 19 nt, Homo sapiens
cgcaugaccuucugucuuu

SEQ ID NO: 643064 - RNA, 19 nt, Homo sapiens
ccaacaaacugaaggagau

SEQ ID NO: 643065 - RNA, 19 nt, Homo sapiens
cuacacaagugaauuauac

SEQ ID NO: 643066 - RNA, 19 nt, Homo sapiens
ggaagaauuuggagucaac

SEQ ID NO: 643067 - RNA, 19 nt, Homo sapiens
gcggguggcugucuucaau

SEQ ID NO: 643068 - RNA, 19 nt, Homo sapiens
gcagggaccucaacuacac

SEQ ID NO: 643069 - RNA, 19 nt, Homo sapiens
caauaaacagcgauaagaa

SEQ ID NO: 643070 - RNA, 19 nt, Homo sapiens
ccaaguacaccgcaaguga

SEQ ID NO: 643071 - RNA, 19 nt, Homo sapiens
gcaccgucaucuugaaugu

SEQ ID NO: 643072 - RNA, 19 nt, Homo sapiens
aaucagcccuugccagaga

SEQ ID NO: 643073 - RNA, 19 nt, Homo sapiens
gaaggaagagggagaaagg

SEQ ID NO: 643074 - RNA, 19 nt, Homo sapiens
uggaggagcucaaacucaa

SEQ ID NO: 643075 - RNA, 19 nt, Homo sapiens
ccucuacacaagugaauua

SEQ ID NO: 643076 - RNA, 19 nt, Homo sapiens
cauggcagguauacugauu

SEQ ID NO: 643077 - RNA, 19 nt, Homo sapiens
ccaggcaccuuaggaguau

SEQ ID NO: 643078 - RNA, 19 nt, Homo sapiens
gaccucaacuacacugauc

SEQ ID NO: 643079 - RNA, 19 nt, Homo sapiens
cgacagcacucggguacug

SEQ ID NO: 643080 - RNA, 19 nt, Homo sapiens
gcaccaaggacuccauugu

SEQ ID NO: 643081 - RNA, 19 nt, Homo sapiens
ucaauaaacagcgauaaga

SEQ ID NO: 643082 - RNA, 19 nt, Homo sapiens
cgaaggcccugaagauacu

SEQ ID NO: 643083 - RNA, 19 nt, Homo sapiens
gagcagggaccucaacuac

SEQ ID NO: 643084 - RNA, 19 nt, Homo sapiens
caacauggccaaccacaac

SEQ ID NO: 643085 - RNA, 19 nt, Homo sapiens
guuccugcauguagccaua

SEQ ID NO: 643086 - RNA, 19 nt, Homo sapiens
accaaggacuccauuguga

SEQ ID NO: 643087 - RNA, 19 nt, Homo sapiens
gggcaaagaagccaaagca

SEQ ID NO: 643088 - RNA, 19 nt, Homo sapiens
gccaggcaccuuaggagua

SEQ ID NO: 643089 - RNA, 19 nt, Homo sapiens
gcacucggguacugcuaca

SEQ ID NO: 643090 - RNA, 19 nt, Homo sapiens
aaacagcgauaagaacucu

SEQ ID NO: 643091 - RNA, 19 nt, Homo sapiens
ggagauggcccagucuauc

SEQ ID NO: 643092 - RNA, 19 nt, Homo sapiens
ucagcugccucuuccucua

SEQ ID NO: 643093 - RNA, 19 nt, Homo sapiens
cuauggguguggaagaauu

SEQ ID NO: 643094 - RNA, 19 nt, Homo sapiens
uuuggcaucucaggcauua

SEQ ID NO: 643095 - RNA, 19 nt, Homo sapiens
caucaccauccucuccuua

SEQ ID NO: 643096 - RNA, 19 nt, Homo sapiens
ggugugcaacuccaacaaa

SEQ ID NO: 643097 - RNA, 19 nt, Homo sapiens
ccaaaugggaagccugaga

SEQ ID NO: 643098 - RNA, 19 nt, Homo sapiens
ggcuauggguguggaagaa

SEQ ID NO: 643099 - RNA, 19 nt, Homo sapiens
caagaaggaagagggagaa

SEQ ID NO: 643100 - RNA, 19 nt, Homo sapiens
caucuugaauguggaaugg

SEQ ID NO: 643101 - RNA, 19 nt, Homo sapiens
ggcguuggcugcaguuaac

SEQ ID NO: 643102 - RNA, 19 nt, Homo sapiens
cuacaccuuuggccaguuc

SEQ ID NO: 643103 - RNA, 19 nt, Homo sapiens
ugagcaccgucaucuugaa

SEQ ID NO: 643104 - RNA, 19 nt, Homo sapiens
ccugagcaccgucaucuug

SEQ ID NO: 643105 - RNA, 19 nt, Homo sapiens
ggcccagucuaucuucaug

SEQ ID NO: 643106 - RNA, 19 nt, Homo sapiens
ugaugggagguuucaauaa

SEQ ID NO: 643107 - RNA, 19 nt, Homo sapiens
ugccagagacuaucgaaga

SEQ ID NO: 643108 - RNA, 19 nt, Homo sapiens
guggaagaauuuggaguca

SEQ ID NO: 643109 - RNA, 19 nt, Homo sapiens
ucccuggccugguuugcua

SEQ ID NO: 643110 - RNA, 19 nt, Homo sapiens
caccgcaagugaccuguuc

SEQ ID NO: 643111 - RNA, 19 nt, Homo sapiens
gcaacuccaacaaacugaa

SEQ ID NO: 643112 - RNA, 19 nt, Homo sapiens
caaggacuccauugugaca

SEQ ID NO: 643113 - RNA, 19 nt, Homo sapiens
cagccaaguucaucaccau

SEQ ID NO: 643114 - RNA, 19 nt, Homo sapiens
cuucuugccucccacacuu

SEQ ID NO: 643115 - RNA, 19 nt, Homo sapiens
aaacagguaugggcguaag

SEQ ID NO: 643116 - RNA, 19 nt, Homo sapiens
ccucgaaggcccugaagau

SEQ ID NO: 643117 - RNA, 19 nt, Homo sapiens
ggguacugcuacaccuuug

SEQ ID NO: 643118 - RNA, 19 nt, Homo sapiens
acagcgauaagaacucuaa

SEQ ID NO: 643119 - RNA, 19 nt, Homo sapiens
agccaucccugcccuuguu

SEQ ID NO: 643120 - RNA, 19 nt, Homo sapiens
ucaccauccucuccuuaag

SEQ ID NO: 643121 - RNA, 19 nt, Homo sapiens
ggguggcugucuucaaugg

SEQ ID NO: 643122 - RNA, 19 nt, Homo sapiens
gagcaccgucaucuugaau

SEQ ID NO: 643123 - RNA, 19 nt, Homo sapiens
ccccugagguccccugaua

SEQ ID NO: 643124 - RNA, 19 nt, Homo sapiens
gauccuagccaggcaccuu

SEQ ID NO: 643125 - RNA, 19 nt, Homo sapiens
aauaucaucuacgggauca

SEQ ID NO: 643126 - RNA, 19 nt, Homo sapiens
ucaauggcaagaaggaaga

SEQ ID NO: 643127 - RNA, 19 nt, Homo sapiens
ugguuggucuugucuggaa

SEQ ID NO: 643128 - RNA, 19 nt, Homo sapiens
ggaccucaacuacacugau

SEQ ID NO: 643129 - RNA, 19 nt, Homo sapiens
ggucuuccgcuuccugugu

SEQ ID NO: 643130 - RNA, 19 nt, Homo sapiens
caacaaacugaaggagaug

SEQ ID NO: 643131 - RNA, 19 nt, Homo sapiens
gugcaacuccaacaaacug

SEQ ID NO: 643132 - RNA, 19 nt, Homo sapiens
gcaggagccagagguggaa

SEQ ID NO: 643133 - RNA, 19 nt, Homo sapiens
caccaaggacuccauugug

SEQ ID NO: 643134 - RNA, 19 nt, Homo sapiens
gccagagacuaucgaagac

SEQ ID NO: 643135 - RNA, 19 nt, Homo sapiens
gaccgugaggacaguauug

SEQ ID NO: 643136 - RNA, 19 nt, Homo sapiens
ucgaagaccuggaaaacug

SEQ ID NO: 643137 - RNA, 19 nt, Homo sapiens
gacuaucgaagaccuggaa

SEQ ID NO: 643138 - RNA, 19 nt, Homo sapiens
ugccugagacccugaauca

SEQ ID NO: 643139 - RNA, 19 nt, Homo sapiens
augccagccugcccaauga

SEQ ID NO: 643140 - RNA, 19 nt, Homo sapiens
gucaucaggcaaacaggua

SEQ ID NO: 643141 - RNA, 19 nt, Homo sapiens
gcaugaccuucugucuuuc

SEQ ID NO: 643142 - RNA, 19 nt, Homo sapiens
ggugaaggugucuccauca

SEQ ID NO: 643143 - RNA, 19 nt, Homo sapiens
cagguaugggcguaaguaa

SEQ ID NO: 643144 - RNA, 19 nt, Homo sapiens
gauuggagggcucgugcuu

SEQ ID NO: 643145 - RNA, 19 nt, Homo sapiens
acagguaugggcguaagua

SEQ ID NO: 643146 - RNA, 19 nt, Homo sapiens
gagucaaccucuacauccu

SEQ ID NO: 643147 - RNA, 19 nt, Homo sapiens
ccagugccaugaccuucuc

SEQ ID NO: 643148 - RNA, 19 nt, Homo sapiens
ccgcaugaccuucugucuu

SEQ ID NO: 643149 - RNA, 19 nt, Homo sapiens
ugacagagugggacuuggu

SEQ ID NO: 643150 - RNA, 19 nt, Homo sapiens
caaacagguaugggcguaa

SEQ ID NO: 643151 - RNA, 19 nt, Homo sapiens
ucuuggcucucaccuuugu

SEQ ID NO: 643152 - RNA, 19 nt, Homo sapiens
cuucauggcagguauacug

SEQ ID NO: 643153 - RNA, 19 nt, Homo sapiens
gaacuuagaccaacuuuaa

SEQ ID NO: 643154 - RNA, 19 nt, Homo sapiens
gaacaaguuucccuuuauu

SEQ ID NO: 643155 - RNA, 19 nt, Homo sapiens
ggaauugcguaaagggaua

SEQ ID NO: 643156 - RNA, 19 nt, Homo sapiens
gaacaguuaccuggaaaua

SEQ ID NO: 643157 - RNA, 19 nt, Homo sapiens
ccaaggauuuauugacauu

SEQ ID NO: 643158 - RNA, 19 nt, Homo sapiens
ugaacaaguuucccuuuau

SEQ ID NO: 643159 - RNA, 19 nt, Homo sapiens
aaugguaacuuggacuuua

SEQ ID NO: 643160 - RNA, 19 nt, Homo sapiens
caacaagccagauauagau

SEQ ID NO: 643161 - RNA, 19 nt, Homo sapiens
ggaacugggccuugacaaa

SEQ ID NO: 643162 - RNA, 19 nt, Homo sapiens
uugaacaaguuucccuuua

SEQ ID NO: 643163 - RNA, 19 nt, Homo sapiens
ggacaaagcaggaccucau

SEQ ID NO: 643164 - RNA, 19 nt, Homo sapiens
gaacugggccuugacaaag

SEQ ID NO: 643165 - RNA, 19 nt, Homo sapiens
gacaaagcaggaccucaua

SEQ ID NO: 643166 - RNA, 19 nt, Homo sapiens
gcaugcagacgguuaaaug

SEQ ID NO: 643167 - RNA, 19 nt, Homo sapiens
aaagggaaaugaguuugaa

SEQ ID NO: 643168 - RNA, 19 nt, Homo sapiens
uuauugacauugcuacuug

SEQ ID NO: 643169 - RNA, 19 nt, Homo sapiens
ucaacaagccagauauaga

SEQ ID NO: 643170 - RNA, 19 nt, Homo sapiens
gugaacaguuaccuggaaa

SEQ ID NO: 643171 - RNA, 19 nt, Homo sapiens
ggaacuuagaccaacuuua

SEQ ID NO: 643172 - RNA, 19 nt, Homo sapiens
agacagaugaggaguuuga

SEQ ID NO: 643173 - RNA, 19 nt, Homo sapiens
ccagucaguucgcugcuau

SEQ ID NO: 643174 - RNA, 19 nt, Homo sapiens
acaguuaccuggaaauacu

SEQ ID NO: 643175 - RNA, 19 nt, Homo sapiens
ugcagacgguuaaaugauu

SEQ ID NO: 643176 - RNA, 19 nt, Homo sapiens
cuggaaauacugaugauaa

SEQ ID NO: 643177 - RNA, 19 nt, Homo sapiens
acaaguuucccuuuauuga

SEQ ID NO: 643178 - RNA, 19 nt, Homo sapiens
gguaacauacuucaacaag

SEQ ID NO: 643179 - RNA, 19 nt, Homo sapiens
acuugagugugaacaguua

SEQ ID NO: 643180 - RNA, 19 nt, Homo sapiens
cggaggaacugggccuuga

SEQ ID NO: 643181 - RNA, 19 nt, Homo sapiens
agcaggaccucauaaggaa

SEQ ID NO: 643182 - RNA, 19 nt, Homo sapiens
ggaaauacugaugauaaca

SEQ ID NO: 643183 - RNA, 19 nt, Homo sapiens
ugugaacaguuaccuggaa

SEQ ID NO: 643184 - RNA, 19 nt, Homo sapiens
gaugcucgcuggguaacau

SEQ ID NO: 643185 - RNA, 19 nt, Homo sapiens
gguaacuuggacuuuaaua

SEQ ID NO: 643186 - RNA, 19 nt, Homo sapiens
aagcaggaccucauaagga

SEQ ID NO: 643187 - RNA, 19 nt, Homo sapiens
caaagcaggaccucauaag

SEQ ID NO: 643188 - RNA, 19 nt, Homo sapiens
gaccucauaaggaaaucua

SEQ ID NO: 643189 - RNA, 19 nt, Homo sapiens
guaaugguaacuuggacuu

SEQ ID NO: 643190 - RNA, 19 nt, Homo sapiens
acaaagcaggaccucauaa

SEQ ID NO: 643191 - RNA, 19 nt, Homo sapiens
uagucuaguucgaauccua

SEQ ID NO: 643192 - RNA, 19 nt, Homo sapiens
ugaguaccaagccauguaa

SEQ ID NO: 643193 - RNA, 19 nt, Homo sapiens
ggauuuauugacauugcua

SEQ ID NO: 643194 - RNA, 19 nt, Homo sapiens
uauagaugccugggaauug

SEQ ID NO: 643195 - RNA, 19 nt, Homo sapiens
gaccaacuuuaaaugaacu

SEQ ID NO: 643196 - RNA, 19 nt, Homo sapiens
cuucaacaagccagauaua

SEQ ID NO: 643197 - RNA, 19 nt, Homo sapiens
augguaacuuggacuuuaa

SEQ ID NO: 643198 - RNA, 19 nt, Homo sapiens
uggaaauacugaugauaac

SEQ ID NO: 643199 - RNA, 19 nt, Homo sapiens
uaugucauccaggaacuua

SEQ ID NO: 643200 - RNA, 19 nt, Homo sapiens
caugcagacgguuaaauga

SEQ ID NO: 643201 - RNA, 19 nt, Homo sapiens
gaauugcguaaagggauaa

SEQ ID NO: 643202 - RNA, 19 nt, Homo sapiens
cauugcuacuugaguguga

SEQ ID NO: 643203 - RNA, 19 nt, Homo sapiens
cgccguggcuauccaguca

SEQ ID NO: 643204 - RNA, 19 nt, Homo sapiens
agaccaacuuuaaaugaac

SEQ ID NO: 643205 - RNA, 19 nt, Homo sapiens
gcaggaccucauaaggaaa

SEQ ID NO: 643206 - RNA, 19 nt, Homo sapiens
aaguuucccuuuauugagu

SEQ ID NO: 643207 - RNA, 19 nt, Homo sapiens
caaguuucccuuuauugag

SEQ ID NO: 643208 - RNA, 19 nt, Homo sapiens
gggccuugacaaaguguaa

SEQ ID NO: 643209 - RNA, 19 nt, Homo sapiens
cuacuugagugugaacagu

SEQ ID NO: 643210 - RNA, 19 nt, Homo sapiens
uauugacauugcuacuuga

SEQ ID NO: 643211 - RNA, 19 nt, Homo sapiens
cgaauccuagagguuguua

SEQ ID NO: 643212 - RNA, 19 nt, Homo sapiens
cauguaaugguaacuugga

SEQ ID NO: 643213 - RNA, 19 nt, Homo sapiens
uggguaacauacuucaaca

SEQ ID NO: 643214 - RNA, 19 nt, Homo sapiens
gaaaucuaccccuauguca

SEQ ID NO: 643215 - RNA, 19 nt, Homo sapiens
uguuaccuaugauaugguu

SEQ ID NO: 643216 - RNA, 19 nt, Homo sapiens
gaggaacugggccuugaca

SEQ ID NO: 643217 - RNA, 19 nt, Homo sapiens
ccaggaacuuagaccaacu

SEQ ID NO: 643218 - RNA, 19 nt, Homo sapiens
gcguaaagggauaaacaca

SEQ ID NO: 643219 - RNA, 19 nt, Homo sapiens
ccacauacauucacuauuu

SEQ ID NO: 643220 - RNA, 19 nt, Homo sapiens
gcuauaaccucaaugauaa

SEQ ID NO: 643221 - RNA, 19 nt, Homo sapiens
guacuuacauuacguguuu

SEQ ID NO: 643222 - RNA, 19 nt, Homo sapiens
cugcagagcuugacauuua

SEQ ID NO: 643223 - RNA, 19 nt, Homo sapiens
caaaggaucugaauacuuc

SEQ ID NO: 643224 - RNA, 19 nt, Homo sapiens
caaauaaaccucucaauga

SEQ ID NO: 643225 - RNA, 19 nt, Homo sapiens
ggacugcucugcucaacua

SEQ ID NO: 643226 - RNA, 19 nt, Homo sapiens
gaaagugaaugauggagaa

SEQ ID NO: 643227 - RNA, 19 nt, Homo sapiens
caaauggccucaucuuauu

SEQ ID NO: 643228 - RNA, 19 nt, Homo sapiens
gaucuuaaauggacacuug

SEQ ID NO: 643229 - RNA, 19 nt, Homo sapiens
ggacacuuguauagaaaua

SEQ ID NO: 643230 - RNA, 19 nt, Homo sapiens
cgacauauaucuuuagcaa

SEQ ID NO: 643231 - RNA, 19 nt, Homo sapiens
ggauggaaaugacuuuauu

SEQ ID NO: 643232 - RNA, 19 nt, Homo sapiens
gaacuugcauuugaaacaa

SEQ ID NO: 643233 - RNA, 19 nt, Homo sapiens
ggacaaaucacguauaagu

SEQ ID NO: 643234 - RNA, 19 nt, Homo sapiens
gcaaagauauccggcaaau

SEQ ID NO: 643235 - RNA, 19 nt, Homo sapiens
ggaccuggaugaugaguug

SEQ ID NO: 643236 - RNA, 19 nt, Homo sapiens
ggaauggacugaugcuuca

SEQ ID NO: 643237 - RNA, 19 nt, Homo sapiens
ugaaaggugugaauuagaa

SEQ ID NO: 643238 - RNA, 19 nt, Homo sapiens
guacuacaauggcuugaaa

SEQ ID NO: 643239 - RNA, 19 nt, Homo sapiens
gaacgacgguaucuuucuu

SEQ ID NO: 643240 - RNA, 19 nt, Homo sapiens
gaacuuagaccucaagagu

SEQ ID NO: 643241 - RNA, 19 nt, Homo sapiens
gaugggagcauguuuauga

SEQ ID NO: 643242 - RNA, 19 nt, Homo sapiens
gcgaaaagcuccaacaaaa

SEQ ID NO: 643243 - RNA, 19 nt, Homo sapiens
aaaggaagcucaaauaaac

SEQ ID NO: 643244 - RNA, 19 nt, Homo sapiens
gugagaauguugcaacuuu

SEQ ID NO: 643245 - RNA, 19 nt, Homo sapiens
caaaggaagcucaaauaaa

SEQ ID NO: 643246 - RNA, 19 nt, Homo sapiens
aagcagcagugaugaaaua

SEQ ID NO: 643247 - RNA, 19 nt, Homo sapiens
gacaucagagcaacaauua

SEQ ID NO: 643248 - RNA, 19 nt, Homo sapiens
gcaugaauaagaaccauua

SEQ ID NO: 643249 - RNA, 19 nt, Homo sapiens
caucagauaugcuggaaga

SEQ ID NO: 643250 - RNA, 19 nt, Homo sapiens
gagcaacaauuauuucagu

SEQ ID NO: 643251 - RNA, 19 nt, Homo sapiens
guggacaaaucacguauaa

SEQ ID NO: 643252 - RNA, 19 nt, Homo sapiens
ggacucauguuccaaucaa

SEQ ID NO: 643253 - RNA, 19 nt, Homo sapiens
gguuggaacuugcauuuga

SEQ ID NO: 643254 - RNA, 19 nt, Homo sapiens
gggacgacauauaucuuua

SEQ ID NO: 643255 - RNA, 19 nt, Homo sapiens
gccaauaaauucccuaaca

SEQ ID NO: 643256 - RNA, 19 nt, Homo sapiens
guaugaaaggugugaauua

SEQ ID NO: 643257 - RNA, 19 nt, Homo sapiens
guuaaaggguacuuacauu

SEQ ID NO: 643258 - RNA, 19 nt, Homo sapiens
gacgguaucuuucuucugu

SEQ ID NO: 643259 - RNA, 19 nt, Homo sapiens
guaucaggauuaacuguaa

SEQ ID NO: 643260 - RNA, 19 nt, Homo sapiens
ccaaauggccucaucuuau

SEQ ID NO: 643261 - RNA, 19 nt, Homo sapiens
gcacgcuuauuauguuauu

SEQ ID NO: 643262 - RNA, 19 nt, Homo sapiens
gcuugaaaguucugaauau

SEQ ID NO: 643263 - RNA, 19 nt, Homo sapiens
uacaauggcuugaaaguuc

SEQ ID NO: 643264 - RNA, 19 nt, Homo sapiens
ugagaauguugcaacuuua

SEQ ID NO: 643265 - RNA, 19 nt, Homo sapiens
cugcaaaccuuuaagaguu

SEQ ID NO: 643266 - RNA, 19 nt, Homo sapiens
cauaauaauuggcgggaaa

SEQ ID NO: 643267 - RNA, 19 nt, Homo sapiens
caagcaaccauaauaauug

SEQ ID NO: 643268 - RNA, 19 nt, Homo sapiens
guggacagcuggccaguga

SEQ ID NO: 643269 - RNA, 19 nt, Homo sapiens
gaaauaccauguaguucgu

SEQ ID NO: 643270 - RNA, 19 nt, Homo sapiens
ccucaagagugacuuauau

SEQ ID NO: 643271 - RNA, 19 nt, Homo sapiens
caucagagcaacaauuauu

SEQ ID NO: 643272 - RNA, 19 nt, Homo sapiens
caaaggugguggacaaauc

SEQ ID NO: 643273 - RNA, 19 nt, Homo sapiens
uagcaaaggugguggacaa

SEQ ID NO: 643274 - RNA, 19 nt, Homo sapiens
aaauaaagcuggccuuguc

SEQ ID NO: 643275 - RNA, 19 nt, Homo sapiens
aagaauauauugccacguu

SEQ ID NO: 643276 - RNA, 19 nt, Homo sapiens
gcagggacaugacgguguu

SEQ ID NO: 643277 - RNA, 19 nt, Homo sapiens
ccaagcaaccauaauaauu

SEQ ID NO: 643278 - RNA, 19 nt, Homo sapiens
ucagaaagaagcuguauug

SEQ ID NO: 643279 - RNA, 19 nt, Homo sapiens
ucaaaggaagcucaaauaa

SEQ ID NO: 643280 - RNA, 19 nt, Homo sapiens
uaaaagcccuguugaagaa

SEQ ID NO: 643281 - RNA, 19 nt, Homo sapiens
aaagaaaacuggcuccaua

SEQ ID NO: 643282 - RNA, 19 nt, Homo sapiens
ggacgagagucgaaacuac

SEQ ID NO: 643283 - RNA, 19 nt, Homo sapiens
ugacaucgccauugaagaa

SEQ ID NO: 643284 - RNA, 19 nt, Homo sapiens
ggcuauaaccucaaugaua

SEQ ID NO: 643285 - RNA, 19 nt, Homo sapiens
gugauuugcuucauugaga

SEQ ID NO: 643286 - RNA, 19 nt, Homo sapiens
aaauauaucucugcucuuc

SEQ ID NO: 643287 - RNA, 19 nt, Homo sapiens
gaaacuacaucaguaacuc

SEQ ID NO: 643288 - RNA, 19 nt, Homo sapiens
ucaaauaaaccucucaaug

SEQ ID NO: 643289 - RNA, 19 nt, Homo sapiens
gagcagugguuggaacuug

SEQ ID NO: 643290 - RNA, 19 nt, Homo sapiens
caucaaggcacaacacaaa

SEQ ID NO: 643291 - RNA, 19 nt, Homo sapiens
acaaguaucucaugcucuu

SEQ ID NO: 643292 - RNA, 19 nt, Homo sapiens
gauggagaaugguaucaug

SEQ ID NO: 643293 - RNA, 19 nt, Homo sapiens
ugauaaagguggacuucuu

SEQ ID NO: 643294 - RNA, 19 nt, Homo sapiens
aaaugaaccuuuccuuauc

SEQ ID NO: 643295 - RNA, 19 nt, Homo sapiens
auacucacauucccacaua

SEQ ID NO: 643296 - RNA, 19 nt, Homo sapiens
ugaaauauaaggcacguuu

SEQ ID NO: 643297 - RNA, 19 nt, Homo sapiens
ccaauaaauucccuaacau

SEQ ID NO: 643298 - RNA, 19 nt, Homo sapiens
ccacgacccuggcuacuag

SEQ ID NO: 643299 - RNA, 19 nt, Homo sapiens
uaacuguaauuccagcaaa

SEQ ID NO: 643300 - RNA, 19 nt, Homo sapiens
gaaccuuuccuuaucaaau

SEQ ID NO: 643301 - RNA, 19 nt, Homo sapiens
ccacagcaauccaucagau

SEQ ID NO: 643302 - RNA, 19 nt, Homo sapiens
ucuaugccauguacaagua

SEQ ID NO: 643303 - RNA, 19 nt, Homo sapiens
ccacugccaugcaaucaga

SEQ ID NO: 643304 - RNA, 19 nt, Homo sapiens
caugcacgcuuauuauguu

SEQ ID NO: 643305 - RNA, 19 nt, Homo sapiens
agucgaaacuacaucagua

SEQ ID NO: 643306 - RNA, 19 nt, Homo sapiens
caagaggacucauguucca

SEQ ID NO: 643307 - RNA, 19 nt, Homo sapiens
gugcuaaccucaucaaagg

SEQ ID NO: 643308 - RNA, 19 nt, Homo sapiens
gcaaaggucccgagacucu

SEQ ID NO: 643309 - RNA, 19 nt, Homo sapiens
aaagauauccggcaaaugg

SEQ ID NO: 643310 - RNA, 19 nt, Homo sapiens
aggaagauauguaugaaug

SEQ ID NO: 643311 - RNA, 19 nt, Homo sapiens
gaagacuuguguaggaaca

SEQ ID NO: 643312 - RNA, 19 nt, Homo sapiens
aauggacacuuguauagaa

SEQ ID NO: 643313 - RNA, 19 nt, Homo sapiens
uaaauggacacuuguauag

SEQ ID NO: 643314 - RNA, 19 nt, Homo sapiens
cuguaaagauugacacaaa

SEQ ID NO: 643315 - RNA, 19 nt, Homo sapiens
gaagaaagugaaugaugga

SEQ ID NO: 643316 - RNA, 19 nt, Homo sapiens
gcuacacgcaagaagauua

SEQ ID NO: 643317 - RNA, 19 nt, Homo sapiens
caaagcagcagugaugaaa

SEQ ID NO: 643318 - RNA, 19 nt, Homo sapiens
cuaaggaagauauguauga

SEQ ID NO: 643319 - RNA, 19 nt, Homo sapiens
ccacauacauucacuauuu

SEQ ID NO: 643320 - RNA, 19 nt, Homo sapiens
gaucuuaaauggacacuug

SEQ ID NO: 643321 - RNA, 19 nt, Homo sapiens
acacaaagcuaaauggauu

SEQ ID NO: 643322 - RNA, 19 nt, Homo sapiens
ggacacuuguauagaaaua

SEQ ID NO: 643323 - RNA, 19 nt, Homo sapiens
cgacauauaucuuuagcaa

SEQ ID NO: 643324 - RNA, 19 nt, Homo sapiens
gaacuugcauuugaaacaa

SEQ ID NO: 643325 - RNA, 19 nt, Homo sapiens
ggacaaaucacguauaagu

SEQ ID NO: 643326 - RNA, 19 nt, Homo sapiens
ugaaaggugugaauuagaa

SEQ ID NO: 643327 - RNA, 19 nt, Homo sapiens
guacuacaauggcuugaaa

SEQ ID NO: 643328 - RNA, 19 nt, Homo sapiens
gcgaaaagcuccaacaaaa

SEQ ID NO: 643329 - RNA, 19 nt, Homo sapiens
gaggagcuuuaaacaauuu

SEQ ID NO: 643330 - RNA, 19 nt, Homo sapiens
gacaucagagcaacaauua

SEQ ID NO: 643331 - RNA, 19 nt, Homo sapiens
gcaugaauaagaaccauua

SEQ ID NO: 643332 - RNA, 19 nt, Homo sapiens
caucagauaugcuggaaga

SEQ ID NO: 643333 - RNA, 19 nt, Homo sapiens
gagcaacaauuauuucagu

SEQ ID NO: 643334 - RNA, 19 nt, Homo sapiens
guggacaaaucacguauaa

SEQ ID NO: 643335 - RNA, 19 nt, Homo sapiens
ggauuuaccuaguggauuc

SEQ ID NO: 643336 - RNA, 19 nt, Homo sapiens
gguuggaacuugcauuuga

SEQ ID NO: 643337 - RNA, 19 nt, Homo sapiens
gggacgacauauaucuuua

SEQ ID NO: 643338 - RNA, 19 nt, Homo sapiens
ggaggagcuuuaaacaauu

SEQ ID NO: 643339 - RNA, 19 nt, Homo sapiens
gccaauaaauucccuaaca

SEQ ID NO: 643340 - RNA, 19 nt, Homo sapiens
guaugaaaggugugaauua

SEQ ID NO: 643341 - RNA, 19 nt, Homo sapiens
gcacgcuuauuauguuauu

SEQ ID NO: 643342 - RNA, 19 nt, Homo sapiens
gcuugaaaguucugaauau

SEQ ID NO: 643343 - RNA, 19 nt, Homo sapiens
uacaauggcuugaaaguuc

SEQ ID NO: 643344 - RNA, 19 nt, Homo sapiens
ggaugucugucauguagaa

SEQ ID NO: 643345 - RNA, 19 nt, Homo sapiens
cugcaaaccuuuaagaguu

SEQ ID NO: 643346 - RNA, 19 nt, Homo sapiens
cauaauaauuggcgggaaa

SEQ ID NO: 643347 - RNA, 19 nt, Homo sapiens
caagcaaccauaauaauug

SEQ ID NO: 643348 - RNA, 19 nt, Homo sapiens
guggacagcuggccaguga

SEQ ID NO: 643349 - RNA, 19 nt, Homo sapiens
gaaauaccauguaguucgu

SEQ ID NO: 643350 - RNA, 19 nt, Homo sapiens
caucagagcaacaauuauu

SEQ ID NO: 643351 - RNA, 19 nt, Homo sapiens
caaaggugguggacaaauc

SEQ ID NO: 643352 - RNA, 19 nt, Homo sapiens
uagcaaaggugguggacaa

SEQ ID NO: 643353 - RNA, 19 nt, Homo sapiens
ccaagcaaccauaauaauu

SEQ ID NO: 643354 - RNA, 19 nt, Homo sapiens
ggacgagagucgaaacuac

SEQ ID NO: 643355 - RNA, 19 nt, Homo sapiens
ugacaucgccauugaagaa

SEQ ID NO: 643356 - RNA, 19 nt, Homo sapiens
gugauuugcuucauugaga

SEQ ID NO: 643357 - RNA, 19 nt, Homo sapiens
aaauauaucucugcucuuc

SEQ ID NO: 643358 - RNA, 19 nt, Homo sapiens
gaaacuacaucaguaacuc

SEQ ID NO: 643359 - RNA, 19 nt, Homo sapiens
aggaggagcuuuaaacaau

SEQ ID NO: 643360 - RNA, 19 nt, Homo sapiens
gagcagugguuggaacuug

SEQ ID NO: 643361 - RNA, 19 nt, Homo sapiens
caucaaggcacaacacaaa

SEQ ID NO: 643362 - RNA, 19 nt, Homo sapiens
acaaguaucucaugcucuu

SEQ ID NO: 643363 - RNA, 19 nt, Homo sapiens
ucagaaagaagccguauug

SEQ ID NO: 643364 - RNA, 19 nt, Homo sapiens
aaaugaaccuuuccuuauc

SEQ ID NO: 643365 - RNA, 19 nt, Homo sapiens
auacucacauucccacaua

SEQ ID NO: 643366 - RNA, 19 nt, Homo sapiens
ugaaauauaaggcacguuu

SEQ ID NO: 643367 - RNA, 19 nt, Homo sapiens
ccaauaaauucccuaacau

SEQ ID NO: 643368 - RNA, 19 nt, Homo sapiens
ccacgacccuggcuacuag

SEQ ID NO: 643369 - RNA, 19 nt, Homo sapiens
gaaccuuuccuuaucaaau

SEQ ID NO: 643370 - RNA, 19 nt, Homo sapiens
ccacagcaauccaucagau

SEQ ID NO: 643371 - RNA, 19 nt, Homo sapiens
ucuaugccauguacaagua

SEQ ID NO: 643372 - RNA, 19 nt, Homo sapiens
ccacugccaugcaaucaga

SEQ ID NO: 643373 - RNA, 19 nt, Homo sapiens
caugcacgcuuauuauguu

SEQ ID NO: 643374 - RNA, 19 nt, Homo sapiens
agucgaaacuacaucagua

SEQ ID NO: 643375 - RNA, 19 nt, Homo sapiens
aggaagauauguaugaaug

SEQ ID NO: 643376 - RNA, 19 nt, Homo sapiens
gaagacuuguguaggaaca

SEQ ID NO: 643377 - RNA, 19 nt, Homo sapiens
aauggacacuuguauagaa

SEQ ID NO: 643378 - RNA, 19 nt, Homo sapiens
uaaauggacacuuguauag

SEQ ID NO: 643379 - RNA, 19 nt, Homo sapiens
cuaaggaagauauguauga

SEQ ID NO: 643380 - RNA, 19 nt, Homo sapiens
uagccaagcaaccauaaua

SEQ ID NO: 643381 - RNA, 19 nt, Homo sapiens
auaaguggccuccuaauga

SEQ ID NO: 643382 - RNA, 19 nt, Homo sapiens
guggaugucugucauguag

SEQ ID NO: 643383 - RNA, 19 nt, Homo sapiens
uaugaaaggugugaauuag

SEQ ID NO: 643384 - RNA, 19 nt, Homo sapiens
gcacacaaagcuaaaugga

SEQ ID NO: 643385 - RNA, 19 nt, Homo sapiens
ccaagguauugaugacaaa

SEQ ID NO: 643386 - RNA, 19 nt, Homo sapiens
gccaagguauugaugacaa

SEQ ID NO: 643387 - RNA, 19 nt, Homo sapiens
gugcauacaguagcaaaua

SEQ ID NO: 643388 - RNA, 19 nt, Homo sapiens
ugagaagucaguccaauug

SEQ ID NO: 643389 - RNA, 19 nt, Homo sapiens
gagacugguuggugaagug

SEQ ID NO: 643390 - RNA, 19 nt, Homo sapiens
gcauacaguagcaaauauu

SEQ ID NO: 643391 - RNA, 19 nt, Homo sapiens
uuacucugcuugucuuuau

SEQ ID NO: 643392 - RNA, 19 nt, Homo sapiens
auauacugcugcaugaaua

SEQ ID NO: 643393 - RNA, 19 nt, Homo sapiens
gaaaggugugaauuagaaa

SEQ ID NO: 643394 - RNA, 19 nt, Homo sapiens
ccuaaugaccgacccagua

SEQ ID NO: 643395 - RNA, 19 nt, Homo sapiens
gaaccuggagcccuggaaa

SEQ ID NO: 643396 - RNA, 19 nt, Homo sapiens
ggaacuugcauuugaaaca

SEQ ID NO: 643397 - RNA, 19 nt, Homo sapiens
guacagaaaccgggaugaa

SEQ ID NO: 643398 - RNA, 19 nt, Homo sapiens
gcagcaagcaucauucagu

SEQ ID NO: 643399 - RNA, 19 nt, Homo sapiens
gauauacugcugcaugaau

SEQ ID NO: 643400 - RNA, 19 nt, Homo sapiens
ggcgucagcucacaaucuu

SEQ ID NO: 643401 - RNA, 19 nt, Homo sapiens
ugugauaagugacguuuua

SEQ ID NO: 643402 - RNA, 19 nt, Homo sapiens
ucucugcucuucagccauu

SEQ ID NO: 643403 - RNA, 19 nt, Homo sapiens
gcgaugaugaggacauuga

SEQ ID NO: 643404 - RNA, 19 nt, Homo sapiens
gaagauccaaacgugcaua

SEQ ID NO: 643405 - RNA, 19 nt, Homo sapiens
cgaaguggccucccuaguc

SEQ ID NO: 643406 - RNA, 19 nt, Homo sapiens
ggugugaauuagaaaguca

SEQ ID NO: 643407 - RNA, 19 nt, Homo sapiens
ugacaucagagcaacaauu

SEQ ID NO: 643408 - RNA, 19 nt, Homo sapiens
guuggaacuugcauuugaa

SEQ ID NO: 643409 - RNA, 19 nt, Homo sapiens
cagcucacaaucuucaaua

SEQ ID NO: 643410 - RNA, 19 nt, Homo sapiens
gagaagacuguccgaagga

SEQ ID NO: 643411 - RNA, 19 nt, Homo sapiens
caauagccaagcaaccaua

SEQ ID NO: 643412 - RNA, 19 nt, Homo sapiens
ugaagaauccaaugcaauc

SEQ ID NO: 643413 - RNA, 19 nt, Homo sapiens
ucacauucccacauacauu

SEQ ID NO: 643414 - RNA, 19 nt, Homo sapiens
uacaaagacucagcuacuu

SEQ ID NO: 643415 - RNA, 19 nt, Homo sapiens
aaaagaagcuaccuaugau

SEQ ID NO: 643416 - RNA, 19 nt, Homo sapiens
aaugaaccuuuccuuauca

SEQ ID NO: 643417 - RNA, 19 nt, Homo sapiens
gccguucgauucccacuuc

SEQ ID NO: 643418 - RNA, 19 nt, Homo sapiens
uuugaagacuuguguagga

SEQ ID NO: 643419 - RNA, 19 nt, Homo sapiens
gcaaugaguucuucugcua

SEQ ID NO: 643420 - RNA, 19 nt, Homo sapiens
ucaaggacguggucuauaa

SEQ ID NO: 643421 - RNA, 19 nt, Homo sapiens
gcaagaauauguucagcaa

SEQ ID NO: 643422 - RNA, 19 nt, Homo sapiens
acaaagacaaggaguauua

SEQ ID NO: 643423 - RNA, 19 nt, Homo sapiens
gaacaaagacaaggaguau

SEQ ID NO: 643424 - RNA, 19 nt, Homo sapiens
caaggaguauuaugucuga

SEQ ID NO: 643425 - RNA, 19 nt, Homo sapiens
gagcagcacugaugagauc

SEQ ID NO: 643426 - RNA, 19 nt, Homo sapiens
aaaggcaaaugcagauaua

SEQ ID NO: 643427 - RNA, 19 nt, Homo sapiens
gcccuggguugauuuauuu

SEQ ID NO: 643428 - RNA, 19 nt, Homo sapiens
guacauccacuacguguuu

SEQ ID NO: 643429 - RNA, 19 nt, Homo sapiens
gaugacuucuucuacauug

SEQ ID NO: 643430 - RNA, 19 nt, Homo sapiens
gcaaggcauuguccacaga

SEQ ID NO: 643431 - RNA, 19 nt, Homo sapiens
gaaaggcaaaugcagauau

SEQ ID NO: 643432 - RNA, 19 nt, Homo sapiens
gaagagggagcaaggcauu

SEQ ID NO: 643433 - RNA, 19 nt, Homo sapiens
ucacagcccuggguugauu

SEQ ID NO: 643434 - RNA, 19 nt, Homo sapiens
gaaacuacaucaguaacuc

SEQ ID NO: 643435 - RNA, 19 nt, Homo sapiens
ggcacaagcucaaugacaa

SEQ ID NO: 643436 - RNA, 19 nt, Homo sapiens
cggcugcgcuucacgcuuu

SEQ ID NO: 643437 - RNA, 19 nt, Homo sapiens
ccaaugggcugcugcucuu

SEQ ID NO: 643438 - RNA, 19 nt, Homo sapiens
gcuacacgcaggaggauua

SEQ ID NO: 643439 - RNA, 19 nt, Homo sapiens
gaaggccuguucugugugu

SEQ ID NO: 643440 - RNA, 19 nt, Homo sapiens
gcuacgaccugucacacaa

SEQ ID NO: 643441 - RNA, 19 nt, Homo sapiens
gcaggaaacuuugauaacg

SEQ ID NO: 643442 - RNA, 19 nt, Homo sapiens
gggaauggcccguccuuga

SEQ ID NO: 643443 - RNA, 19 nt, Homo sapiens
caaaggcaaugaguucuuc

SEQ ID NO: 643444 - RNA, 19 nt, Homo sapiens
gaccagagccgaaacuaca

SEQ ID NO: 643445 - RNA, 19 nt, Homo sapiens
cggcucaccugacguuaaa

SEQ ID NO: 643446 - RNA, 19 nt, Homo sapiens
agacaaauacucuagauuc

SEQ ID NO: 643447 - RNA, 19 nt, Homo sapiens
ggucugagcaagaauaugu

SEQ ID NO: 643448 - RNA, 19 nt, Homo sapiens
ugagugggcucguguucaa

SEQ ID NO: 643449 - RNA, 19 nt, Homo sapiens
gcugggcucugaugacuuc

SEQ ID NO: 643450 - RNA, 19 nt, Homo sapiens
guaaacaaacugcauuauc

SEQ ID NO: 643451 - RNA, 19 nt, Homo sapiens
ggcaaaugcagauauauau

SEQ ID NO: 643452 - RNA, 19 nt, Homo sapiens
ggaggagaguuaauauugc

SEQ ID NO: 643453 - RNA, 19 nt, Homo sapiens
guggugcgcuucacucgaa

SEQ ID NO: 643454 - RNA, 19 nt, Homo sapiens
cggaaggccuguucugugu

SEQ ID NO: 643455 - RNA, 19 nt, Homo sapiens
ugaagaucaugcugccuaa

SEQ ID NO: 643456 - RNA, 19 nt, Homo sapiens
ggaaaggcaaaugcagaua

SEQ ID NO: 643457 - RNA, 19 nt, Homo sapiens
ccaagaagaacaaagacaa

SEQ ID NO: 643458 - RNA, 19 nt, Homo sapiens
caggaaacuuugauaacga

SEQ ID NO: 643459 - RNA, 19 nt, Homo sapiens
ggaaccgcuucaucuguga

SEQ ID NO: 643460 - RNA, 19 nt, Homo sapiens
gagcccaacgccauaguaa

SEQ ID NO: 643461 - RNA, 19 nt, Homo sapiens
ggaauggcccguccuugau

SEQ ID NO: 643462 - RNA, 19 nt, Homo sapiens
gggcgguggugaaagagaa

SEQ ID NO: 643463 - RNA, 19 nt, Homo sapiens
cagacaaaccagucaauga

SEQ ID NO: 643464 - RNA, 19 nt, Homo sapiens
agaugaagcucacugucaa

SEQ ID NO: 643465 - RNA, 19 nt, Homo sapiens
gauuggacacgcuauggua

SEQ ID NO: 643466 - RNA, 19 nt, Homo sapiens
ccacugcucguccuguuaa

SEQ ID NO: 643467 - RNA, 19 nt, Homo sapiens
ucuacgccauguauaagua

SEQ ID NO: 643468 - RNA, 19 nt, Homo sapiens
gacguuaaacagcgaagua

SEQ ID NO: 643469 - RNA, 19 nt, Homo sapiens
gacacgcuaugguaaacaa

SEQ ID NO: 643470 - RNA, 19 nt, Homo sapiens
caaaugugucugagucuug

SEQ ID NO: 643471 - RNA, 19 nt, Homo sapiens
gcaaggccaagaagaacaa

SEQ ID NO: 643472 - RNA, 19 nt, Homo sapiens
ccagcaaggccaagaagaa

SEQ ID NO: 643473 - RNA, 19 nt, Homo sapiens
uggaggagaguuaauauug

SEQ ID NO: 643474 - RNA, 19 nt, Homo sapiens
guacccggcaggaaacuuu

SEQ ID NO: 643475 - RNA, 19 nt, Homo sapiens
gcucugaugacuucuucua

SEQ ID NO: 643476 - RNA, 19 nt, Homo sapiens
gcucacagcccuggguuga

SEQ ID NO: 643477 - RNA, 19 nt, Homo sapiens
agccgaaacuacaucagua

SEQ ID NO: 643478 - RNA, 19 nt, Homo sapiens
cgacgagcccaacgccaua

SEQ ID NO: 643479 - RNA, 19 nt, Homo sapiens
cugaugggcuucuucuguu

SEQ ID NO: 643480 - RNA, 19 nt, Homo sapiens
gcacaagcucaaugacaau

SEQ ID NO: 643481 - RNA, 19 nt, Homo sapiens
aggcaaaugcagauauaua

SEQ ID NO: 643482 - RNA, 19 nt, Homo sapiens
gcaccacccagaacacaga

SEQ ID NO: 643483 - RNA, 19 nt, Homo sapiens
ggcgauugcuagacagaga

SEQ ID NO: 643484 - RNA, 19 nt, Homo sapiens
gaauggcccguccuugaug

SEQ ID NO: 643485 - RNA, 19 nt, Homo sapiens
gacguggucuauaagaaca

SEQ ID NO: 643486 - RNA, 19 nt, Homo sapiens
gacaaauacucuagauucc

SEQ ID NO: 643487 - RNA, 19 nt, Homo sapiens
acagacaaauacucuagau

SEQ ID NO: 643488 - RNA, 19 nt, Homo sapiens
cauaguaagcgacggcaaa

SEQ ID NO: 643489 - RNA, 19 nt, Homo sapiens
ggggagcgcucaucaccua

SEQ ID NO: 643490 - RNA, 19 nt, Homo sapiens
ggacggccaccucuaucuu

SEQ ID NO: 643491 - RNA, 19 nt, Homo sapiens
gggcucugaugacuucuuc

SEQ ID NO: 643492 - RNA, 19 nt, Homo sapiens
cagaugaagcucacuguca

SEQ ID NO: 643493 - RNA, 19 nt, Homo sapiens
cgggaccucuucauagaug

SEQ ID NO: 643494 - RNA, 19 nt, Homo sapiens
ggacagcaccacccagaac

SEQ ID NO: 643495 - RNA, 19 nt, Homo sapiens
cggcaggaaacuuugauaa

SEQ ID NO: 643496 - RNA, 19 nt, Homo sapiens
gugcacacgcucaagauug

SEQ ID NO: 643497 - RNA, 19 nt, Homo sapiens
gggcaacggcaaugacuuc

SEQ ID NO: 643498 - RNA, 19 nt, Homo sapiens
ggacguggucuauaagaac

SEQ ID NO: 643499 - RNA, 19 nt, Homo sapiens
caaagacaaggaguauuau

SEQ ID NO: 643500 - RNA, 19 nt, Homo sapiens
gguggccucugcugagugu

SEQ ID NO: 643501 - RNA, 19 nt, Homo sapiens
gggaaaggcaaaugcagau

SEQ ID NO: 643502 - RNA, 19 nt, Homo sapiens
gccgaaacuacaucaguaa

SEQ ID NO: 643503 - RNA, 19 nt, Homo sapiens
gcacggacgacauuaccau

SEQ ID NO: 643504 - RNA, 19 nt, Homo sapiens
gggaccacauacaucuuug

SEQ ID NO: 643505 - RNA, 19 nt, Homo sapiens
cccgaaaccucgaucucaa

SEQ ID NO: 643506 - RNA, 19 nt, Homo sapiens
gcaacgcaacggccugaug

SEQ ID NO: 643507 - RNA, 19 nt, Homo sapiens
ucugaugacuucuucuaca

SEQ ID NO: 643508 - RNA, 19 nt, Homo sapiens
agaacaaagacaaggagua

SEQ ID NO: 643509 - RNA, 19 nt, Homo sapiens
gagccgaaacuacaucagu

SEQ ID NO: 643510 - RNA, 19 nt, Homo sapiens
ggcccaaccucaggacaga

SEQ ID NO: 643511 - RNA, 19 nt, Homo sapiens
ccacccagaacacagauga

SEQ ID NO: 643512 - RNA, 19 nt, Homo sapiens
gaugugcaccagccaacaa

SEQ ID NO: 643513 - RNA, 19 nt, Homo sapiens
ucacgcagcacuccaaugg

SEQ ID NO: 643514 - RNA, 19 nt, Homo sapiens
gcacacggaggcagaggau

SEQ ID NO: 643515 - RNA, 19 nt, Homo sapiens
guaggguccuuacuguucu

SEQ ID NO: 643516 - RNA, 19 nt, Homo sapiens
cugcucguccuguuaauuu

SEQ ID NO: 643517 - RNA, 19 nt, Homo sapiens
caagaagaacaaagacaag

SEQ ID NO: 643518 - RNA, 19 nt, Homo sapiens
cagcugaccaucuucaaca

SEQ ID NO: 643519 - RNA, 19 nt, Homo sapiens
gcaaugaguucuucugcua

SEQ ID NO: 643520 - RNA, 19 nt, Homo sapiens
ucaaggacguggucuauaa

SEQ ID NO: 643521 - RNA, 19 nt, Homo sapiens
gcaagaauauguucagcaa

SEQ ID NO: 643522 - RNA, 19 nt, Homo sapiens
acaaagacaaggaguauua

SEQ ID NO: 643523 - RNA, 19 nt, Homo sapiens
gaacaaagacaaggaguau

SEQ ID NO: 643524 - RNA, 19 nt, Homo sapiens
caaggaguauuaugucuga

SEQ ID NO: 643525 - RNA, 19 nt, Homo sapiens
gagcagcacugaugagauc

SEQ ID NO: 643526 - RNA, 19 nt, Homo sapiens
aaaggcaaaugcagauaua

SEQ ID NO: 643527 - RNA, 19 nt, Homo sapiens
gcccuggguugauuuauuu

SEQ ID NO: 643528 - RNA, 19 nt, Homo sapiens
guacauccacuacguguuu

SEQ ID NO: 643529 - RNA, 19 nt, Homo sapiens
gaugacuucuucuacauug

SEQ ID NO: 643530 - RNA, 19 nt, Homo sapiens
gcaaggcauuguccacaga

SEQ ID NO: 643531 - RNA, 19 nt, Homo sapiens
gaaaggcaaaugcagauau

SEQ ID NO: 643532 - RNA, 19 nt, Homo sapiens
gaagagggagcaaggcauu

SEQ ID NO: 643533 - RNA, 19 nt, Homo sapiens
ucacagcccuggguugauu

SEQ ID NO: 643534 - RNA, 19 nt, Homo sapiens
gaaacuacaucaguaacuc

SEQ ID NO: 643535 - RNA, 19 nt, Homo sapiens
ggcacaagcucaaugacaa

SEQ ID NO: 643536 - RNA, 19 nt, Homo sapiens
cggcugcgcuucacgcuuu

SEQ ID NO: 643537 - RNA, 19 nt, Homo sapiens
ccaaugggcugcugcucuu

SEQ ID NO: 643538 - RNA, 19 nt, Homo sapiens
gcuacacgcaggaggauua

SEQ ID NO: 643539 - RNA, 19 nt, Homo sapiens
gaaggccuguucugugugu

SEQ ID NO: 643540 - RNA, 19 nt, Homo sapiens
gcuacgaccugucacacaa

SEQ ID NO: 643541 - RNA, 19 nt, Homo sapiens
gggaauggcccguccuuga

SEQ ID NO: 643542 - RNA, 19 nt, Homo sapiens
caaaggcaaugaguucuuc

SEQ ID NO: 643543 - RNA, 19 nt, Homo sapiens
gaccagagccgaaacuaca

SEQ ID NO: 643544 - RNA, 19 nt, Homo sapiens
cggcucaccugacguuaaa

SEQ ID NO: 643545 - RNA, 19 nt, Homo sapiens
agacaaauacucuagauuc

SEQ ID NO: 643546 - RNA, 19 nt, Homo sapiens
ggucugagcaagaauaugu

SEQ ID NO: 643547 - RNA, 19 nt, Homo sapiens
ugagugggcucguguucaa

SEQ ID NO: 643548 - RNA, 19 nt, Homo sapiens
gcugggcucugaugacuuc

SEQ ID NO: 643549 - RNA, 19 nt, Homo sapiens
ggcaaaugcagauauauau

SEQ ID NO: 643550 - RNA, 19 nt, Homo sapiens
ggaggagaguuaauauugc

SEQ ID NO: 643551 - RNA, 19 nt, Homo sapiens
guggugcgcuucacucgaa

SEQ ID NO: 643552 - RNA, 19 nt, Homo sapiens
cggaaggccuguucugugu

SEQ ID NO: 643553 - RNA, 19 nt, Homo sapiens
ugaagaucaugcugccuaa

SEQ ID NO: 643554 - RNA, 19 nt, Homo sapiens
ggaaaggcaaaugcagaua

SEQ ID NO: 643555 - RNA, 19 nt, Homo sapiens
ccaagaagaacaaagacaa

SEQ ID NO: 643556 - RNA, 19 nt, Homo sapiens
ggaaccgcuucaucuguga

SEQ ID NO: 643557 - RNA, 19 nt, Homo sapiens
gagcccaacgccauaguaa

SEQ ID NO: 643558 - RNA, 19 nt, Homo sapiens
ggaauggcccguccuugau

SEQ ID NO: 643559 - RNA, 19 nt, Homo sapiens
gggcgguggugaaagagaa

SEQ ID NO: 643560 - RNA, 19 nt, Homo sapiens
cagacaaaccagucaauga

SEQ ID NO: 643561 - RNA, 19 nt, Homo sapiens
agaugaagcucacugucaa

SEQ ID NO: 643562 - RNA, 19 nt, Homo sapiens
ccacugcucguccuguuaa

SEQ ID NO: 643563 - RNA, 19 nt, Homo sapiens
ucuacgccauguauaagua

SEQ ID NO: 643564 - RNA, 19 nt, Homo sapiens
caaaugugucugagucuug

SEQ ID NO: 643565 - RNA, 19 nt, Homo sapiens
gcaaggccaagaagaacaa

SEQ ID NO: 643566 - RNA, 19 nt, Homo sapiens
ccagcaaggccaagaagaa

SEQ ID NO: 643567 - RNA, 19 nt, Homo sapiens
uggaggagaguuaauauug

SEQ ID NO: 643568 - RNA, 19 nt, Homo sapiens
gcucugaugacuucuucua

SEQ ID NO: 643569 - RNA, 19 nt, Homo sapiens
gcucacagcccuggguuga

SEQ ID NO: 643570 - RNA, 19 nt, Homo sapiens
agccgaaacuacaucagua

SEQ ID NO: 643571 - RNA, 19 nt, Homo sapiens
cgacgagcccaacgccaua

SEQ ID NO: 643572 - RNA, 19 nt, Homo sapiens
cugaugggcuucuucuguu

SEQ ID NO: 643573 - RNA, 19 nt, Homo sapiens
gcacaagcucaaugacaau

SEQ ID NO: 643574 - RNA, 19 nt, Homo sapiens
aggcaaaugcagauauaua

SEQ ID NO: 643575 - RNA, 19 nt, Homo sapiens
gcaccacccagaacacaga

SEQ ID NO: 643576 - RNA, 19 nt, Homo sapiens
gaauggcccguccuugaug

SEQ ID NO: 643577 - RNA, 19 nt, Homo sapiens
gacguggucuauaagaaca

SEQ ID NO: 643578 - RNA, 19 nt, Homo sapiens
gacaaauacucuagauucc

SEQ ID NO: 643579 - RNA, 19 nt, Homo sapiens
acagacaaauacucuagau

SEQ ID NO: 643580 - RNA, 19 nt, Homo sapiens
cauaguaagcgacggcaaa

SEQ ID NO: 643581 - RNA, 19 nt, Homo sapiens
ggggagcgcucaucaccua

SEQ ID NO: 643582 - RNA, 19 nt, Homo sapiens
ggacggccaccucuaucuu

SEQ ID NO: 643583 - RNA, 19 nt, Homo sapiens
gggcucugaugacuucuuc

SEQ ID NO: 643584 - RNA, 19 nt, Homo sapiens
cagaugaagcucacuguca

SEQ ID NO: 643585 - RNA, 19 nt, Homo sapiens
cgggaccucuucauagaug

SEQ ID NO: 643586 - RNA, 19 nt, Homo sapiens
ggacagcaccacccagaac

SEQ ID NO: 643587 - RNA, 19 nt, Homo sapiens
gugcacacgcucaagauug

SEQ ID NO: 643588 - RNA, 19 nt, Homo sapiens
gggcaacggcaaugacuuc

SEQ ID NO: 643589 - RNA, 19 nt, Homo sapiens
ggacguggucuauaagaac

SEQ ID NO: 643590 - RNA, 19 nt, Homo sapiens
caaagacaaggaguauuau

SEQ ID NO: 643591 - RNA, 19 nt, Homo sapiens
gguggccucugcugagugu

SEQ ID NO: 643592 - RNA, 19 nt, Homo sapiens
gggaaaggcaaaugcagau

SEQ ID NO: 643593 - RNA, 19 nt, Homo sapiens
gccgaaacuacaucaguaa

SEQ ID NO: 643594 - RNA, 19 nt, Homo sapiens
gcaacgcaacggccugaug

SEQ ID NO: 643595 - RNA, 19 nt, Homo sapiens
gcacggacgacauuaccau

SEQ ID NO: 643596 - RNA, 19 nt, Homo sapiens
gggaccacauacaucuuug

SEQ ID NO: 643597 - RNA, 19 nt, Homo sapiens
cccgaaaccucgaucucaa

SEQ ID NO: 643598 - RNA, 19 nt, Homo sapiens
ucugaugacuucuucuaca

SEQ ID NO: 643599 - RNA, 19 nt, Homo sapiens
agaacaaagacaaggagua

SEQ ID NO: 643600 - RNA, 19 nt, Homo sapiens
gagccgaaacuacaucagu

SEQ ID NO: 643601 - RNA, 19 nt, Homo sapiens
ggcccaaccucaggacaga

SEQ ID NO: 643602 - RNA, 19 nt, Homo sapiens
ccacccagaacacagauga

SEQ ID NO: 643603 - RNA, 19 nt, Homo sapiens
ucacgcagcacuccaaugg

SEQ ID NO: 643604 - RNA, 19 nt, Homo sapiens
gcacacggaggcagaggau

SEQ ID NO: 643605 - RNA, 19 nt, Homo sapiens
cugcucguccuguuaauuu

SEQ ID NO: 643606 - RNA, 19 nt, Homo sapiens
caaccugucccucaagucu

SEQ ID NO: 643607 - RNA, 19 nt, Homo sapiens
caagaagaacaaagacaag

SEQ ID NO: 643608 - RNA, 19 nt, Homo sapiens
cagcugaccaucuucaaca

SEQ ID NO: 643609 - RNA, 19 nt, Homo sapiens
ggcccugucugcaaugauc

SEQ ID NO: 643610 - RNA, 19 nt, Homo sapiens
guggugcccuccaacuuca

SEQ ID NO: 643611 - RNA, 19 nt, Homo sapiens
gggcacaagcucaaugaca

SEQ ID NO: 643612 - RNA, 19 nt, Homo sapiens
ugcgggaccucuucauaga

SEQ ID NO: 643613 - RNA, 19 nt, Homo sapiens
gacuucaaauuggaacuau

SEQ ID NO: 643614 - RNA, 19 nt, Homo sapiens
guaccgcaaucgugaugag

SEQ ID NO: 643615 - RNA, 19 nt, Homo sapiens
gcaccucuucuuccaguuc

SEQ ID NO: 643616 - RNA, 19 nt, Homo sapiens
acaaaugugucugagucuu

SEQ ID NO: 643617 - RNA, 19 nt, Homo sapiens
uguccggccucuacuacaa

SEQ ID NO: 643618 - RNA, 19 nt, Homo sapiens
gcugagcaccgucaaguac

SEQ ID NO: 643619 - RNA, 19 nt, Homo sapiens
acaaagacaaggaguauua

SEQ ID NO: 643620 - RNA, 19 nt, Homo sapiens
gaacaaagacaaggaguau

SEQ ID NO: 643621 - RNA, 19 nt, Homo sapiens
caaggaguauuaugucuga

SEQ ID NO: 643622 - RNA, 19 nt, Homo sapiens
aaaggcaaaugcagauaua

SEQ ID NO: 643623 - RNA, 19 nt, Homo sapiens
gcccuggguugauuuauuu

SEQ ID NO: 643624 - RNA, 19 nt, Homo sapiens
gcaaggcauuguccacaga

SEQ ID NO: 643625 - RNA, 19 nt, Homo sapiens
gaaaggcaaaugcagauau

SEQ ID NO: 643626 - RNA, 19 nt, Homo sapiens
gaagagggagcaaggcauu

SEQ ID NO: 643627 - RNA, 19 nt, Homo sapiens
ucacagcccuggguugauu

SEQ ID NO: 643628 - RNA, 19 nt, Homo sapiens
gaaacuacaucaguaacuc

SEQ ID NO: 643629 - RNA, 19 nt, Homo sapiens
gaaggccuguucugugugu

SEQ ID NO: 643630 - RNA, 19 nt, Homo sapiens
gcaggaaacuuugauaacg

SEQ ID NO: 643631 - RNA, 19 nt, Homo sapiens
gaccagagccgaaacuaca

SEQ ID NO: 643632 - RNA, 19 nt, Homo sapiens
agacaaauacucuagauuc

SEQ ID NO: 643633 - RNA, 19 nt, Homo sapiens
ggcaaaugcagauauauau

SEQ ID NO: 643634 - RNA, 19 nt, Homo sapiens
ggaggagaguuaauauugc

SEQ ID NO: 643635 - RNA, 19 nt, Homo sapiens
guggugcgcuucacucgaa

SEQ ID NO: 643636 - RNA, 19 nt, Homo sapiens
cggaaggccuguucugugu

SEQ ID NO: 643637 - RNA, 19 nt, Homo sapiens
ggaaaggcaaaugcagaua

SEQ ID NO: 643638 - RNA, 19 nt, Homo sapiens
ccaagaagaacaaagacaa

SEQ ID NO: 643639 - RNA, 19 nt, Homo sapiens
caggaaacuuugauaacga

SEQ ID NO: 643640 - RNA, 19 nt, Homo sapiens
gagcccaacgccauaguaa

SEQ ID NO: 643641 - RNA, 19 nt, Homo sapiens
gggcgguggugaaagagaa

SEQ ID NO: 643642 - RNA, 19 nt, Homo sapiens
ccacugcucguccuguuaa

SEQ ID NO: 643643 - RNA, 19 nt, Homo sapiens
ucuacgccauguauaagua

SEQ ID NO: 643644 - RNA, 19 nt, Homo sapiens
caaaugugucugagucuug

SEQ ID NO: 643645 - RNA, 19 nt, Homo sapiens
gcaaggccaagaagaacaa

SEQ ID NO: 643646 - RNA, 19 nt, Homo sapiens
ccagcaaggccaagaagaa

SEQ ID NO: 643647 - RNA, 19 nt, Homo sapiens
uggaggagaguuaauauug

SEQ ID NO: 643648 - RNA, 19 nt, Homo sapiens
guacccggcaggaaacuuu

SEQ ID NO: 643649 - RNA, 19 nt, Homo sapiens
gcucacagcccuggguuga

SEQ ID NO: 643650 - RNA, 19 nt, Homo sapiens
agccgaaacuacaucagua

SEQ ID NO: 643651 - RNA, 19 nt, Homo sapiens
cgacgagcccaacgccaua

SEQ ID NO: 643652 - RNA, 19 nt, Homo sapiens
aggcaaaugcagauauaua

SEQ ID NO: 643653 - RNA, 19 nt, Homo sapiens
gcaccacccagaacacaga

SEQ ID NO: 643654 - RNA, 19 nt, Homo sapiens
ggcgauugcuagacagaga

SEQ ID NO: 643655 - RNA, 19 nt, Homo sapiens
gacaaauacucuagauucc

SEQ ID NO: 643656 - RNA, 19 nt, Homo sapiens
acagacaaauacucuagau

SEQ ID NO: 643657 - RNA, 19 nt, Homo sapiens
cauaguaagcgacggcaaa

SEQ ID NO: 643658 - RNA, 19 nt, Homo sapiens
ggggagcgcucaucaccua

SEQ ID NO: 643659 - RNA, 19 nt, Homo sapiens
ggcgggauccaguugauuu

SEQ ID NO: 643660 - RNA, 19 nt, Homo sapiens
ggacagcaccacccagaac

SEQ ID NO: 643661 - RNA, 19 nt, Homo sapiens
cggcaggaaacuuugauaa

SEQ ID NO: 643662 - RNA, 19 nt, Homo sapiens
caaagacaaggaguauuau

SEQ ID NO: 643663 - RNA, 19 nt, Homo sapiens
gguggccucugcugagugu

SEQ ID NO: 643664 - RNA, 19 nt, Homo sapiens
gggaaaggcaaaugcagau

SEQ ID NO: 643665 - RNA, 19 nt, Homo sapiens
gccgaaacuacaucaguaa

SEQ ID NO: 643666 - RNA, 19 nt, Homo sapiens
gggaccacauacaucuuug

SEQ ID NO: 643667 - RNA, 19 nt, Homo sapiens
gcacggacgacauuaccau

SEQ ID NO: 643668 - RNA, 19 nt, Homo sapiens
agaacaaagacaaggagua

SEQ ID NO: 643669 - RNA, 19 nt, Homo sapiens
gagccgaaacuacaucagu

SEQ ID NO: 643670 - RNA, 19 nt, Homo sapiens
ggcccaaccucaggacaga

SEQ ID NO: 643671 - RNA, 19 nt, Homo sapiens
ccacccagaacacagauga

SEQ ID NO: 643672 - RNA, 19 nt, Homo sapiens
cugcucguccuguuaauuu

SEQ ID NO: 643673 - RNA, 19 nt, Homo sapiens
caagaagaacaaagacaag

SEQ ID NO: 643674 - RNA, 19 nt, Homo sapiens
cagcugaccaucuucaaca

SEQ ID NO: 643675 - RNA, 19 nt, Homo sapiens
cuaccggcuuggucgagua

SEQ ID NO: 643676 - RNA, 19 nt, Homo sapiens
guaccgcaaucgugaugag

SEQ ID NO: 643677 - RNA, 19 nt, Homo sapiens
acaaaugugucugagucuu

SEQ ID NO: 643678 - RNA, 19 nt, Homo sapiens
uguccggccucuacuacaa

SEQ ID NO: 643679 - RNA, 19 nt, Homo sapiens
ccacccuccuucccuacuu

SEQ ID NO: 643680 - RNA, 19 nt, Homo sapiens
ccucaggcuucucuuacga

SEQ ID NO: 643681 - RNA, 19 nt, Homo sapiens
guaacucggcccagagcaa

SEQ ID NO: 643682 - RNA, 19 nt, Homo sapiens
gccgccagcugaccaucuu

SEQ ID NO: 643683 - RNA, 19 nt, Homo sapiens
ccggcuuggucgaguagua

SEQ ID NO: 643684 - RNA, 19 nt, Homo sapiens
ccaccaccauggccacuac

SEQ ID NO: 643685 - RNA, 19 nt, Homo sapiens
aagacaaggaguauuaugu

SEQ ID NO: 643686 - RNA, 19 nt, Homo sapiens
ggaccagagccgaaacuac

SEQ ID NO: 643687 - RNA, 19 nt, Homo sapiens
gcaugguggugggcauugu

SEQ ID NO: 643688 - RNA, 19 nt, Homo sapiens
aggcuugggcccugguuua

SEQ ID NO: 643689 - RNA, 19 nt, Homo sapiens
guccacugcucguccuguu

SEQ ID NO: 643690 - RNA, 19 nt, Homo sapiens
augaguggcugcucgacaa

SEQ ID NO: 643691 - RNA, 19 nt, Homo sapiens
cagacaaauacucuagauu

SEQ ID NO: 643692 - RNA, 19 nt, Homo sapiens
uuacagacaaauacucuag

SEQ ID NO: 643693 - RNA, 19 nt, Homo sapiens
cgggaccacauacaucuuu

SEQ ID NO: 643694 - RNA, 19 nt, Homo sapiens
agcccuggguugauuuauu

SEQ ID NO: 643695 - RNA, 19 nt, Homo sapiens
aaagacaaggaguauuaug

SEQ ID NO: 643696 - RNA, 19 nt, Homo sapiens
agaagaacaaagacaagga

SEQ ID NO: 643697 - RNA, 19 nt, Homo sapiens
ccacggacgacgaggacuu

SEQ ID NO: 643698 - RNA, 19 nt, Homo sapiens
cggacgacauuaccaucga

SEQ ID NO: 643699 - RNA, 19 nt, Homo sapiens
cgggcgacgugcauugaug

SEQ ID NO: 643700 - RNA, 19 nt, Homo sapiens
ccuccuucccuacuucuuu

SEQ ID NO: 643701 - RNA, 19 nt, Homo sapiens
ccuccugccuuccuucucu

SEQ ID NO: 643702 - RNA, 19 nt, Homo sapiens
uaacucggcccagagcaau

SEQ ID NO: 643703 - RNA, 19 nt, Homo sapiens
guacuggaggagaguuaau

SEQ ID NO: 643704 - RNA, 19 nt, Homo sapiens
cuacuacaaugggcucaag

SEQ ID NO: 643705 - RNA, 19 nt, Homo sapiens
gacggaaggccuguucugu

SEQ ID NO: 643706 - RNA, 19 nt, Homo sapiens
gacagcaccacccagaaca

SEQ ID NO: 643707 - RNA, 19 nt, Homo sapiens
gccuggcgauugcuagaca

SEQ ID NO: 643708 - RNA, 19 nt, Homo sapiens
cgagcccaacgccauagua

SEQ ID NO: 643709 - RNA, 19 nt, Homo sapiens
cuagugaacucaagcugua

SEQ ID NO: 643710 - RNA, 19 nt, Homo sapiens
cagaaccacugccuacaaa

SEQ ID NO: 643711 - RNA, 19 nt, Homo sapiens
ccacuuggcuuuggaugaa

SEQ ID NO: 643712 - RNA, 19 nt, Homo sapiens
gggagccgaugccuaguga

SEQ ID NO: 643713 - RNA, 19 nt, Homo sapiens
gugauucucugaggaaaga

SEQ ID NO: 643714 - RNA, 19 nt, Homo sapiens
cgucguggccugcuccuua

SEQ ID NO: 643715 - RNA, 19 nt, Homo sapiens
gcaucgaccacuuggcuuu

SEQ ID NO: 643716 - RNA, 19 nt, Homo sapiens
gggccaaucucaaagucau

SEQ ID NO: 643717 - RNA, 19 nt, Homo sapiens
ugagcuggcugcccaaucu

SEQ ID NO: 643718 - RNA, 19 nt, Homo sapiens
guucgucacccgcaggaua

SEQ ID NO: 643719 - RNA, 19 nt, Homo sapiens
ucgaggaagugaagaaugg

SEQ ID NO: 643720 - RNA, 19 nt, Homo sapiens
cacccaggcuugauuugga

SEQ ID NO: 643721 - RNA, 19 nt, Homo sapiens
gucguggccugcuccuuaa

SEQ ID NO: 643722 - RNA, 19 nt, Homo sapiens
gccaagggaaggugugauu

SEQ ID NO: 643723 - RNA, 19 nt, Homo sapiens
gccaaacaguagagaugga

SEQ ID NO: 643724 - RNA, 19 nt, Homo sapiens
ccagaaccacugccuacaa

SEQ ID NO: 643725 - RNA, 19 nt, Homo sapiens
gcaaaccgugcccugguau

SEQ ID NO: 643726 - RNA, 19 nt, Homo sapiens
aggcagaguuugugucuac

SEQ ID NO: 643727 - RNA, 19 nt, Homo sapiens
ccaaaaguaugguaauucu

SEQ ID NO: 643728 - RNA, 19 nt, Homo sapiens
ggaaggugugauucucuga

SEQ ID NO: 643729 - RNA, 19 nt, Homo sapiens
gcaacaaggacuucuucca

SEQ ID NO: 643730 - RNA, 19 nt, Homo sapiens
aacucaagcuguagccaaa

SEQ ID NO: 643731 - RNA, 19 nt, Homo sapiens
ccgagggacucugcaacaa

SEQ ID NO: 643732 - RNA, 19 nt, Homo sapiens
ggugugauucucugaggaa

SEQ ID NO: 643733 - RNA, 19 nt, Homo sapiens
agcaaaccgugcccuggua

SEQ ID NO: 643734 - RNA, 19 nt, Homo sapiens
ccugaagaacugugugauu

SEQ ID NO: 643735 - RNA, 19 nt, Homo sapiens
acacacccaggcuugauuu

SEQ ID NO: 643736 - RNA, 19 nt, Homo sapiens
gacacacccaggcuugauu

SEQ ID NO: 643737 - RNA, 19 nt, Homo sapiens
ggcuuuggaugaaaucaag

SEQ ID NO: 643738 - RNA, 19 nt, Homo sapiens
caagggaaggugugauucu

SEQ ID NO: 643739 - RNA, 19 nt, Homo sapiens
aaaccgugcccugguauug

SEQ ID NO: 643740 - RNA, 19 nt, Homo sapiens
uccagaagaugaaggaaac

SEQ ID NO: 643741 - RNA, 19 nt, Homo sapiens
aaagucaucagcaccaugu

SEQ ID NO: 643742 - RNA, 19 nt, Homo sapiens
uagccaaacaguagagaug

SEQ ID NO: 643743 - RNA, 19 nt, Homo sapiens
gccgaugccuagugaacuc

SEQ ID NO: 643744 - RNA, 19 nt, Homo sapiens
caaccgagggacucugcaa

SEQ ID NO: 643745 - RNA, 19 nt, Homo sapiens
cauucgguguccagagauu

SEQ ID NO: 643746 - RNA, 19 nt, Homo sapiens
ggaugugacgagcccagaa

SEQ ID NO: 643747 - RNA, 19 nt, Homo sapiens
accauucgguguccagaga

SEQ ID NO: 643748 - RNA, 19 nt, Homo sapiens
gagccaagggaagguguga

SEQ ID NO: 643749 - RNA, 19 nt, Homo sapiens
caaaccgugcccugguauu

SEQ ID NO: 643750 - RNA, 19 nt, Homo sapiens
cuugcuggcuggccugaga

SEQ ID NO: 643751 - RNA, 19 nt, Homo sapiens
gaaccacugccuacaaacc

SEQ ID NO: 643752 - RNA, 19 nt, Homo sapiens
gaacagaaccugggaaauu

SEQ ID NO: 643753 - RNA, 19 nt, Homo sapiens
gauugaagcuuuagugaaa

SEQ ID NO: 643754 - RNA, 19 nt, Homo sapiens
gggcaaagcugacuucaug

SEQ ID NO: 643755 - RNA, 19 nt, Homo sapiens
guacaggauugaagcuuua

SEQ ID NO: 643756 - RNA, 19 nt, Homo sapiens
gcagauagcaccgguauuu

SEQ ID NO: 643757 - RNA, 19 nt, Homo sapiens
uugaugagcuuaagguaua

SEQ ID NO: 643758 - RNA, 19 nt, Homo sapiens
gcaaacagcgcaaggaguu

SEQ ID NO: 643759 - RNA, 19 nt, Homo sapiens
gaauugacuuggaggagaa

SEQ ID NO: 643760 - RNA, 19 nt, Homo sapiens
caacaagcgugucgccuau

SEQ ID NO: 643761 - RNA, 19 nt, Homo sapiens
gcaaugagaacgaugaguu

SEQ ID NO: 643762 - RNA, 19 nt, Homo sapiens
ccaaagaggagaagaagaa

SEQ ID NO: 643763 - RNA, 19 nt, Homo sapiens
gaagaagaaacccaagauu

SEQ ID NO: 643764 - RNA, 19 nt, Homo sapiens
caccucagcucgaguacua

SEQ ID NO: 643765 - RNA, 19 nt, Homo sapiens
gcccagagguggcuucuuc

SEQ ID NO: 643766 - RNA, 19 nt, Homo sapiens
acacauggcuacaauaucu

SEQ ID NO: 643767 - RNA, 19 nt, Homo sapiens
acaaguggcucaucaucaa

SEQ ID NO: 643768 - RNA, 19 nt, Homo sapiens
agaagaaacccaagauuga

SEQ ID NO: 643769 - RNA, 19 nt, Homo sapiens
gaaguggaccucccagaga

SEQ ID NO: 643770 - RNA, 19 nt, Homo sapiens
gcacagcauucccgacauc

SEQ ID NO: 643771 - RNA, 19 nt, Homo sapiens
cagaugagguggucuugga

SEQ ID NO: 643772 - RNA, 19 nt, Homo sapiens
ucaagaaacuggagaccau

SEQ ID NO: 643773 - RNA, 19 nt, Homo sapiens
ggagcaacuucgacaacaa

SEQ ID NO: 643774 - RNA, 19 nt, Homo sapiens
gcugcacacuuucaacuug

SEQ ID NO: 643775 - RNA, 19 nt, Homo sapiens
ugaaaucuaugaccaggau

SEQ ID NO: 643776 - RNA, 19 nt, Homo sapiens
gaagaaacccaagauugau

SEQ ID NO: 643777 - RNA, 19 nt, Homo sapiens
ccacuuggcuccucucacu

SEQ ID NO: 643778 - RNA, 19 nt, Homo sapiens
gagaacagaaccugggaaa

SEQ ID NO: 643779 - RNA, 19 nt, Homo sapiens
gaaccugggaaauugauga

SEQ ID NO: 643780 - RNA, 19 nt, Homo sapiens
ggacgacgacuucuucaca

SEQ ID NO: 643781 - RNA, 19 nt, Homo sapiens
caaguacuuugccuccauu

SEQ ID NO: 643782 - RNA, 19 nt, Homo sapiens
agaagaagaagaagaagaa

SEQ ID NO: 643783 - RNA, 19 nt, Homo sapiens
gauccacaauuauaagaag

SEQ ID NO: 643784 - RNA, 19 nt, Homo sapiens
ccaaggaccugcucuucuc

SEQ ID NO: 643785 - RNA, 19 nt, Homo sapiens
gcucccagaucaugaggaa

SEQ ID NO: 643786 - RNA, 19 nt, Homo sapiens
ccacacauggcuacaauau

SEQ ID NO: 643787 - RNA, 19 nt, Homo sapiens
ggaaguccuuugacaucga

SEQ ID NO: 643788 - RNA, 19 nt, Homo sapiens
caacaucuccagguucuga

SEQ ID NO: 643789 - RNA, 19 nt, Homo sapiens
gagaagaagaagaagaaga

SEQ ID NO: 643790 - RNA, 19 nt, Homo sapiens
ggaggacgacgacuucuuc

SEQ ID NO: 643791 - RNA, 19 nt, Homo sapiens
agaaggagaagaagaagaa

SEQ ID NO: 643792 - RNA, 19 nt, Homo sapiens
ucaacacccucgucaagug

SEQ ID NO: 643793 - RNA, 19 nt, Homo sapiens
gaaauuaaccaaggaccau

SEQ ID NO: 643794 - RNA, 19 nt, Homo sapiens
caaugagaacgaugaguuu

SEQ ID NO: 643795 - RNA, 19 nt, Homo sapiens
ccaucgagcuggaccugaa

SEQ ID NO: 643796 - RNA, 19 nt, Homo sapiens
caagaaggaguccauguuc

SEQ ID NO: 643797 - RNA, 19 nt, Homo sapiens
ccaagaaggaguccauguu

SEQ ID NO: 643798 - RNA, 19 nt, Homo sapiens
gcaaugaccccaucaaugu

SEQ ID NO: 643799 - RNA, 19 nt, Homo sapiens
aacagaaccugggaaauug

SEQ ID NO: 643800 - RNA, 19 nt, Homo sapiens
ucaguggcuuggacucuuu

SEQ ID NO: 643801 - RNA, 19 nt, Homo sapiens
aggacuggcugcacacuuu

SEQ ID NO: 643802 - RNA, 19 nt, Homo sapiens
aagaagaaacccaagauug

SEQ ID NO: 643803 - RNA, 19 nt, Homo sapiens
gagaagaagaaacccaaga

SEQ ID NO: 643804 - RNA, 19 nt, Homo sapiens
cgucccugauccacaauua

SEQ ID NO: 643805 - RNA, 19 nt, Homo sapiens
gcccaucauugucauugaa

SEQ ID NO: 643806 - RNA, 19 nt, Homo sapiens
ggauugaagcuuuagugaa

SEQ ID NO: 643807 - RNA, 19 nt, Homo sapiens
gcagcucaacccugucuuu

SEQ ID NO: 643808 - RNA, 19 nt, Homo sapiens
acacagacguccacuacca

SEQ ID NO: 643809 - RNA, 19 nt, Homo sapiens
ggagaaguccagugacauc

SEQ ID NO: 643810 - RNA, 19 nt, Homo sapiens
acaccaacaucuccagguu

SEQ ID NO: 643811 - RNA, 19 nt, Homo sapiens
ggacgauccgcccaucauu

SEQ ID NO: 643812 - RNA, 19 nt, Homo sapiens
ggacgccucuggacaucuc

SEQ ID NO: 643813 - RNA, 19 nt, Homo sapiens
caagauugaugagcuuaag

SEQ ID NO: 643814 - RNA, 19 nt, Homo sapiens
gaguggaggugcuguucug

SEQ ID NO: 643815 - RNA, 19 nt, Homo sapiens
gccagaacuuccugcagaa

SEQ ID NO: 643816 - RNA, 19 nt, Homo sapiens
gagcuggaguccgaguuug

SEQ ID NO: 643817 - RNA, 19 nt, Homo sapiens
gggagguuguggugacuau

SEQ ID NO: 643818 - RNA, 19 nt, Homo sapiens
cagaggaggcagagaagaa

SEQ ID NO: 643819 - RNA, 19 nt, Homo sapiens
cagcagaggaggcagagaa

SEQ ID NO: 643820 - RNA, 19 nt, Homo sapiens
gaugaccgauacucaggau

SEQ ID NO: 643821 - RNA, 19 nt, Homo sapiens
ccaaguacuuugccuccau

SEQ ID NO: 643822 - RNA, 19 nt, Homo sapiens
ggacagugcaggccaaggu

SEQ ID NO: 643823 - RNA, 19 nt, Homo sapiens
caacuggcgcuaccuguuc

SEQ ID NO: 643824 - RNA, 19 nt, Homo sapiens
caaugaagggcaaggagaa

SEQ ID NO: 643825 - RNA, 19 nt, Homo sapiens
caccagagccacagacuca

SEQ ID NO: 643826 - RNA, 19 nt, Homo sapiens
ugacgguggcuguguauga

SEQ ID NO: 643827 - RNA, 19 nt, Homo sapiens
agaacuacaucuccaagca

SEQ ID NO: 643828 - RNA, 19 nt, Homo sapiens
agcgagagcucccagauca

SEQ ID NO: 643829 - RNA, 19 nt, Homo sapiens
gauagcaccgguauuugau

SEQ ID NO: 643830 - RNA, 19 nt, Homo sapiens
aguacaggauugaagcuuu

SEQ ID NO: 643831 - RNA, 19 nt, Homo sapiens
gcgcaaagacagccaagca

SEQ ID NO: 643832 - RNA, 19 nt, Homo sapiens
gggacgagaccgaguacaa

SEQ ID NO: 643833 - RNA, 19 nt, Homo sapiens
aagaggagaagaagaagaa

SEQ ID NO: 643834 - RNA, 19 nt, Homo sapiens
agagguacccaucaagaaa

SEQ ID NO: 643835 - RNA, 19 nt, Homo sapiens
ccugggaaauugaugacuu

SEQ ID NO: 643836 - RNA, 19 nt, Homo sapiens
gcacccugcugacaucaac

SEQ ID NO: 643837 - RNA, 19 nt, Homo sapiens
ucgacaaccuggagcucua

SEQ ID NO: 643838 - RNA, 19 nt, Homo sapiens
agauagcaccgguauuuga

SEQ ID NO: 643839 - RNA, 19 nt, Homo sapiens
aggcugagcugcauuuacu

SEQ ID NO: 643840 - RNA, 19 nt, Homo sapiens
aagaaggccugaacgacau

SEQ ID NO: 643841 - RNA, 19 nt, Homo sapiens
gagaaggagaagaagaaga

SEQ ID NO: 643842 - RNA, 19 nt, Homo sapiens
gaggagaaggagaagaaga

SEQ ID NO: 643843 - RNA, 19 nt, Homo sapiens
ccagagguacccaucaaga

SEQ ID NO: 643844 - RNA, 19 nt, Homo sapiens
ggccuucggucgcuacaca

SEQ ID NO: 643845 - RNA, 19 nt, Homo sapiens
ucccugauccacaauuaua

SEQ ID NO: 643846 - RNA, 19 nt, Homo sapiens
cgacagcagcggacucuca

SEQ ID NO: 643847 - RNA, 19 nt, Homo sapiens
ggguuucuguuggcuguuu

SEQ ID NO: 643848 - RNA, 19 nt, Homo sapiens
guacaaguggcucaucauc

SEQ ID NO: 643849 - RNA, 19 nt, Homo sapiens
cuggcuaccuggucaagaa

SEQ ID NO: 643850 - RNA, 19 nt, Homo sapiens
acacgagcuucaucugguu

SEQ ID NO: 643851 - RNA, 19 nt, Homo sapiens
cucggaagcccaagaagua

SEQ ID NO: 643852 - RNA, 19 nt, Homo sapiens
gcaagagguuaaagaagua

SEQ ID NO: 643853 - RNA, 19 nt, Homo sapiens
ccagaaacaucgaaacaaa

SEQ ID NO: 643854 - RNA, 19 nt, Homo sapiens
uagaugaccuccuggcuua

SEQ ID NO: 643855 - RNA, 19 nt, Homo sapiens
gggaugagcuagaaauuca

SEQ ID NO: 643856 - RNA, 19 nt, Homo sapiens
ggucaacuauucugcauga

SEQ ID NO: 643857 - RNA, 19 nt, Homo sapiens
gaaggugcauuuccaguca

SEQ ID NO: 643858 - RNA, 19 nt, Homo sapiens
uaagaaagaaggugcauuu

SEQ ID NO: 643859 - RNA, 19 nt, Homo sapiens
ucaccaaccugcucaugua

SEQ ID NO: 643860 - RNA, 19 nt, Homo sapiens
gggaguuacuuaccaauga

SEQ ID NO: 643861 - RNA, 19 nt, Homo sapiens
aaacuuggcuggcucucua

SEQ ID NO: 643862 - RNA, 19 nt, Homo sapiens
guucugcccuggauucuaa

SEQ ID NO: 643863 - RNA, 19 nt, Homo sapiens
gaaaggcaacuauucagaa

SEQ ID NO: 643864 - RNA, 19 nt, Homo sapiens
caaauaagcacauccacuu

SEQ ID NO: 643865 - RNA, 19 nt, Homo sapiens
gcacagccguccugguaug

SEQ ID NO: 643866 - RNA, 19 nt, Homo sapiens
ggcaagagguuaaagaagu

SEQ ID NO: 643867 - RNA, 19 nt, Homo sapiens
caacacgucugcaccuuca

SEQ ID NO: 643868 - RNA, 19 nt, Homo sapiens
gcucagauuugcucauuag

SEQ ID NO: 643869 - RNA, 19 nt, Homo sapiens
auucuaagcugaagguuaa

SEQ ID NO: 643870 - RNA, 19 nt, Homo sapiens
aaaggcaacuauucagaaa

SEQ ID NO: 643871 - RNA, 19 nt, Homo sapiens
gcagugcaguugugaaagu

SEQ ID NO: 643872 - RNA, 19 nt, Homo sapiens
ggucugagaguccuaauga

SEQ ID NO: 643873 - RNA, 19 nt, Homo sapiens
caacuauucugcaugaaag

SEQ ID NO: 643874 - RNA, 19 nt, Homo sapiens
gggcagagcuacagagcau

SEQ ID NO: 643875 - RNA, 19 nt, Homo sapiens
gauggaagccucucagugu

SEQ ID NO: 643876 - RNA, 19 nt, Homo sapiens
uaaguaacauggcaacaca

SEQ ID NO: 643877 - RNA, 19 nt, Homo sapiens
gaauugagaaagugacuga

SEQ ID NO: 643878 - RNA, 19 nt, Homo sapiens
gagcagugcaguugugaaa

SEQ ID NO: 643879 - RNA, 19 nt, Homo sapiens
agaaauggauccacaugug

SEQ ID NO: 643880 - RNA, 19 nt, Homo sapiens
gaaagacacgcugcagaaa

SEQ ID NO: 643881 - RNA, 19 nt, Homo sapiens
ccagaucaagcuacucuua

SEQ ID NO: 643882 - RNA, 19 nt, Homo sapiens
ggccaagaguucugccuuu

SEQ ID NO: 643883 - RNA, 19 nt, Homo sapiens
gcucuugguuucagcuuug

SEQ ID NO: 643884 - RNA, 19 nt, Homo sapiens
ccaaugaguccaccaauca

SEQ ID NO: 643885 - RNA, 19 nt, Homo sapiens
gaaauggauccacaugugu

SEQ ID NO: 643886 - RNA, 19 nt, Homo sapiens
cagcauccaucgucgaguu

SEQ ID NO: 643887 - RNA, 19 nt, Homo sapiens
ggaaauuaaucggguugga

SEQ ID NO: 643888 - RNA, 19 nt, Homo sapiens
gcacauccacuuugaguac

SEQ ID NO: 643889 - RNA, 19 nt, Homo sapiens
gaggcccugugcucuauaa

SEQ ID NO: 643890 - RNA, 19 nt, Homo sapiens
gaaagcagcaccagcaacu

SEQ ID NO: 643891 - RNA, 19 nt, Homo sapiens
ggagaagccgcucuuguuc

SEQ ID NO: 643892 - RNA, 19 nt, Homo sapiens
aagacacgcugcagaaaug

SEQ ID NO: 643893 - RNA, 19 nt, Homo sapiens
ugaaagacacgcugcagaa

SEQ ID NO: 643894 - RNA, 19 nt, Homo sapiens
gccaagcccucacagacuu

SEQ ID NO: 643895 - RNA, 19 nt, Homo sapiens
caagcuacucuuagaaauu

SEQ ID NO: 643896 - RNA, 19 nt, Homo sapiens
ucagagagcucagagaaac

SEQ ID NO: 643897 - RNA, 19 nt, Homo sapiens
ccacacaggccaagaguuc

SEQ ID NO: 643898 - RNA, 19 nt, Homo sapiens
gauucuaagcugaagguua

SEQ ID NO: 643899 - RNA, 19 nt, Homo sapiens
ggcuggcucucuaguauga

SEQ ID NO: 643900 - RNA, 19 nt, Homo sapiens
gggccgagaucgagcacaa

SEQ ID NO: 643901 - RNA, 19 nt, Homo sapiens
ccacugagcaugacaagca

SEQ ID NO: 643902 - RNA, 19 nt, Homo sapiens
aagccagacuccagaauug

SEQ ID NO: 643903 - RNA, 19 nt, Homo sapiens
gcaacaggaugcccucaac

SEQ ID NO: 643904 - RNA, 19 nt, Homo sapiens
guagcggccucuccaugaa

SEQ ID NO: 643905 - RNA, 19 nt, Homo sapiens
ccagaaaggcaacuauuca

SEQ ID NO: 643906 - RNA, 19 nt, Homo sapiens
aagcugcacucaguucuuu

SEQ ID NO: 643907 - RNA, 19 nt, Homo sapiens
gcagagcuacagagcauug

SEQ ID NO: 643908 - RNA, 19 nt, Homo sapiens
gcaacuccccuucaaauaa

SEQ ID NO: 643909 - RNA, 19 nt, Homo sapiens
ggauccacauguguaauga

SEQ ID NO: 643910 - RNA, 19 nt, Homo sapiens
cagcuggauucuucuaguu

SEQ ID NO: 643911 - RNA, 19 nt, Homo sapiens
ccaaguggcaagagguuaa

SEQ ID NO: 643912 - RNA, 19 nt, Homo sapiens
aagcuacucuuagaaauuc

SEQ ID NO: 643913 - RNA, 19 nt, Homo sapiens
gcugaagguuaaacuagau

SEQ ID NO: 643914 - RNA, 19 nt, Homo sapiens
caucagcccuuguguacag

SEQ ID NO: 643915 - RNA, 19 nt, Homo sapiens
auaagcacauccacuuuga

SEQ ID NO: 643916 - RNA, 19 nt, Homo sapiens
gaucaagcuacucuuagaa

SEQ ID NO: 643917 - RNA, 19 nt, Homo sapiens
gcagcagugucacauccaa

SEQ ID NO: 643918 - RNA, 19 nt, Homo sapiens
gcacucaguucuuuucaug

SEQ ID NO: 643919 - RNA, 19 nt, Homo sapiens
gccaagaguucugccuuug

SEQ ID NO: 643920 - RNA, 19 nt, Homo sapiens
ugaagggucucgcgggaau

SEQ ID NO: 643921 - RNA, 19 nt, Homo sapiens
gcagaaauggauccacaug

SEQ ID NO: 643922 - RNA, 19 nt, Homo sapiens
gaucugcguuaccucaaca

SEQ ID NO: 643923 - RNA, 19 nt, Homo sapiens
ucaagcuacucuuagaaau

SEQ ID NO: 643924 - RNA, 19 nt, Homo sapiens
caagccagacuccagaauu

SEQ ID NO: 643925 - RNA, 19 nt, Homo sapiens
ugccaaaggugacauuaca

SEQ ID NO: 643926 - RNA, 19 nt, Homo sapiens
acucaucacugcccaagga

SEQ ID NO: 643927 - RNA, 19 nt, Homo sapiens
gguuucagcuuugcaggaa

SEQ ID NO: 643928 - RNA, 19 nt, Homo sapiens
gauaugaugcagcaacugu

SEQ ID NO: 643929 - RNA, 19 nt, Homo sapiens
gguaucaaggcucagauuu

SEQ ID NO: 643930 - RNA, 19 nt, Homo sapiens
guuccuggcuccuuguuca

SEQ ID NO: 643931 - RNA, 19 nt, Homo sapiens
uaaaucaaccagaaacauc

SEQ ID NO: 643932 - RNA, 19 nt, Homo sapiens
cagaucagguuuggacuuc

SEQ ID NO: 643933 - RNA, 19 nt, Homo sapiens
cgcugcagcugcuuuauga

SEQ ID NO: 643934 - RNA, 19 nt, Homo sapiens
cagcugggaugugcuaugu

SEQ ID NO: 643935 - RNA, 19 nt, Homo sapiens
agaucaagcuacucuuaga

SEQ ID NO: 643936 - RNA, 19 nt, Homo sapiens
guaucaaggcucagauuug

SEQ ID NO: 643937 - RNA, 19 nt, Homo sapiens
cuguaugguucaaguagua

SEQ ID NO: 643938 - RNA, 19 nt, Homo sapiens
ggaguuacuuaccaaugag

SEQ ID NO: 643939 - RNA, 19 nt, Homo sapiens
ccacauguguaaugaagac

SEQ ID NO: 643940 - RNA, 19 nt, Homo sapiens
gaucagguuuggacuucuc

SEQ ID NO: 643941 - RNA, 19 nt, Homo sapiens
caagaguucugccuuugac

SEQ ID NO: 643942 - RNA, 19 nt, Homo sapiens
gaaggacugcugccagauc

SEQ ID NO: 643943 - RNA, 19 nt, Homo sapiens
uaucaaggcucagauuugc

SEQ ID NO: 643944 - RNA, 19 nt, Homo sapiens
gcaacuauucagaaacuuc

SEQ ID NO: 643945 - RNA, 19 nt, Homo sapiens
ucuuagaaauuccggagaa

SEQ ID NO: 643946 - RNA, 19 nt, Homo sapiens
gcaccuucauuauucaaac

SEQ ID NO: 643947 - RNA, 19 nt, Homo sapiens
cgucugcaccuucauuauu

SEQ ID NO: 643948 - RNA, 19 nt, Homo sapiens
aguaguagcugccuaugag

SEQ ID NO: 643949 - RNA, 19 nt, Homo sapiens
cugcacagccguccuggua

SEQ ID NO: 643950 - RNA, 19 nt, Homo sapiens
uggagaagccgcucuuguu

SEQ ID NO: 643951 - RNA, 19 nt, Homo sapiens
gcccugugcucuauaaugc

SEQ ID NO: 643952 - RNA, 19 nt, Homo sapiens
gagcaaaucucuucuguuu

SEQ ID NO: 643953 - RNA, 19 nt, Homo sapiens
gcaaaucucuucuguuuag

SEQ ID NO: 643954 - RNA, 19 nt, Homo sapiens
gaaacuccaugaagacuuu

SEQ ID NO: 643955 - RNA, 19 nt, Homo sapiens
ccagaaguguuucaaauuu

SEQ ID NO: 643956 - RNA, 19 nt, Homo sapiens
ccacaugccuagacuuaua

SEQ ID NO: 643957 - RNA, 19 nt, Homo sapiens
gcacugaccauacugcuua

SEQ ID NO: 643958 - RNA, 19 nt, Homo sapiens
ccacauagccugaggguaa

SEQ ID NO: 643959 - RNA, 19 nt, Homo sapiens
gaaagacgccaauguaguu

SEQ ID NO: 643960 - RNA, 19 nt, Homo sapiens
gaauagcucuaacuccaaa

SEQ ID NO: 643961 - RNA, 19 nt, Homo sapiens
gggagaagggcaacuauua

SEQ ID NO: 643962 - RNA, 19 nt, Homo sapiens
gacaggagcugacucaugu

SEQ ID NO: 643963 - RNA, 19 nt, Homo sapiens
gaagaggcccuguguagaa

SEQ ID NO: 643964 - RNA, 19 nt, Homo sapiens
cauaaccaguugagucuua

SEQ ID NO: 643965 - RNA, 19 nt, Homo sapiens
caacuggucuccugugaug

SEQ ID NO: 643966 - RNA, 19 nt, Homo sapiens
ccauacugcuuacgucuua

SEQ ID NO: 643967 - RNA, 19 nt, Homo sapiens
gagcaaaugucuauugaac

SEQ ID NO: 643968 - RNA, 19 nt, Homo sapiens
ggaaggaguuucgcagcua

SEQ ID NO: 643969 - RNA, 19 nt, Homo sapiens
ggacugcgcugcuauagcu

SEQ ID NO: 643970 - RNA, 19 nt, Homo sapiens
uuacugagccucuccauuu

SEQ ID NO: 643971 - RNA, 19 nt, Homo sapiens
agacagagcugguucuaag

SEQ ID NO: 643972 - RNA, 19 nt, Homo sapiens
cgcaagaaccguuguaaua

SEQ ID NO: 643973 - RNA, 19 nt, Homo sapiens
gaagggcaacuauuauuau

SEQ ID NO: 643974 - RNA, 19 nt, Homo sapiens
gaugagcgguaucuuugaa

SEQ ID NO: 643975 - RNA, 19 nt, Homo sapiens
gagaagggcaacuauuauu

SEQ ID NO: 643976 - RNA, 19 nt, Homo sapiens
gagcugguucuaagauuua

SEQ ID NO: 643977 - RNA, 19 nt, Homo sapiens
gcaaaugucuauugaacac

SEQ ID NO: 643978 - RNA, 19 nt, Homo sapiens
uguaugcauugccuaauua

SEQ ID NO: 643979 - RNA, 19 nt, Homo sapiens
cagaauagcaagcagagua

SEQ ID NO: 643980 - RNA, 19 nt, Homo sapiens
gagcauugguauucagaug

SEQ ID NO: 643981 - RNA, 19 nt, Homo sapiens
caaaguuguaucacuguua

SEQ ID NO: 643982 - RNA, 19 nt, Homo sapiens
cgggauggcuggaggauga

SEQ ID NO: 643983 - RNA, 19 nt, Homo sapiens
gcaagaaccguuguaauag

SEQ ID NO: 643984 - RNA, 19 nt, Homo sapiens
caugguuugugguaacuua

SEQ ID NO: 643985 - RNA, 19 nt, Homo sapiens
gauauguucucaagccaau

SEQ ID NO: 643986 - RNA, 19 nt, Homo sapiens
ggagaagggcaacuauuau

SEQ ID NO: 643987 - RNA, 19 nt, Homo sapiens
aaauccaugucuucaguua

SEQ ID NO: 643988 - RNA, 19 nt, Homo sapiens
ugucugagcugccgcaaga

SEQ ID NO: 643989 - RNA, 19 nt, Homo sapiens
agagaaagacgccaaugua

SEQ ID NO: 643990 - RNA, 19 nt, Homo sapiens
gaagauaagcuccacaaac

SEQ ID NO: 643991 - RNA, 19 nt, Homo sapiens
gaagcaugguuugugguaa

SEQ ID NO: 643992 - RNA, 19 nt, Homo sapiens
gaaccagaaguguuucaaa

SEQ ID NO: 643993 - RNA, 19 nt, Homo sapiens
ucacagaggugguaaaaug

SEQ ID NO: 643994 - RNA, 19 nt, Homo sapiens
agaagggcaacuauuauua

SEQ ID NO: 643995 - RNA, 19 nt, Homo sapiens
gcaagcagaguaucauuca

SEQ ID NO: 643996 - RNA, 19 nt, Homo sapiens
ggacgggagcugaauauca

SEQ ID NO: 643997 - RNA, 19 nt, Homo sapiens
gaacaugggagaaauugag

SEQ ID NO: 643998 - RNA, 19 nt, Homo sapiens
gaacaagaggaacagcaaa

SEQ ID NO: 643999 - RNA, 19 nt, Homo sapiens
acacggaugcggucaauaa

SEQ ID NO: 644000 - RNA, 19 nt, Homo sapiens
gugcuucucuuguuucugu

SEQ ID NO: 644001 - RNA, 19 nt, Homo sapiens
caaagucuaucucugaaac

SEQ ID NO: 644002 - RNA, 19 nt, Homo sapiens
ugagugacguguuugauca

SEQ ID NO: 644003 - RNA, 19 nt, Homo sapiens
ggacuugggagaccucuug

SEQ ID NO: 644004 - RNA, 19 nt, Homo sapiens
gaaaauccaugucuucagu

SEQ ID NO: 644005 - RNA, 19 nt, Homo sapiens
gaaccguuguaauagcauu

SEQ ID NO: 644006 - RNA, 19 nt, Homo sapiens
uuagaagacugcaguuuca

SEQ ID NO: 644007 - RNA, 19 nt, Homo sapiens
ccaguugagucuuauuuca

SEQ ID NO: 644008 - RNA, 19 nt, Homo sapiens
aucauuggcuuuccuauuu

SEQ ID NO: 644009 - RNA, 19 nt, Homo sapiens
ugccuagacuuauauacua

SEQ ID NO: 644010 - RNA, 19 nt, Homo sapiens
ugugccaccuucuuaguua

SEQ ID NO: 644011 - RNA, 19 nt, Homo sapiens
uggcaggccugguaucuug

SEQ ID NO: 644012 - RNA, 19 nt, Homo sapiens
guacagaagacccugagaa

SEQ ID NO: 644013 - RNA, 19 nt, Homo sapiens
guguaugcauugccuaauu

SEQ ID NO: 644014 - RNA, 19 nt, Homo sapiens
cacaauaucugagacacuu

SEQ ID NO: 644015 - RNA, 19 nt, Homo sapiens
gcuguggacucaacgaugu

SEQ ID NO: 644016 - RNA, 19 nt, Homo sapiens
gagaaagacgccaauguag

SEQ ID NO: 644017 - RNA, 19 nt, Homo sapiens
ccaaggacccagagcauga

SEQ ID NO: 644018 - RNA, 19 nt, Homo sapiens
ggcaaagucuaucucugaa

SEQ ID NO: 644019 - RNA, 19 nt, Homo sapiens
ugacuccaaucgcuucaaa

SEQ ID NO: 644020 - RNA, 19 nt, Homo sapiens
gguacaaccuguggaagga

SEQ ID NO: 644021 - RNA, 19 nt, Homo sapiens
ccaauguaguugugguuga

SEQ ID NO: 644022 - RNA, 19 nt, Homo sapiens
uuugaucacuagcagaaua

SEQ ID NO: 644023 - RNA, 19 nt, Homo sapiens
ggcaugccuuucagaguuu

SEQ ID NO: 644024 - RNA, 19 nt, Homo sapiens
ggaacaagaggaacagcaa

SEQ ID NO: 644025 - RNA, 19 nt, Homo sapiens
gcaggcaacuucgugaaag

SEQ ID NO: 644026 - RNA, 19 nt, Homo sapiens
aaccagaaguguuucaaau

SEQ ID NO: 644027 - RNA, 19 nt, Homo sapiens
cagauuuccuggaggcaaa

SEQ ID NO: 644028 - RNA, 19 nt, Homo sapiens
agggacggcuggaagauaa

SEQ ID NO: 644029 - RNA, 19 nt, Homo sapiens
caagaacaugggagaaauu

SEQ ID NO: 644030 - RNA, 19 nt, Homo sapiens
gagagaaagacgccaaugu

SEQ ID NO: 644031 - RNA, 19 nt, Homo sapiens
agacugcaguuucaacaug

SEQ ID NO: 644032 - RNA, 19 nt, Homo sapiens
gaguaucccuuauccaaaa

SEQ ID NO: 644033 - RNA, 19 nt, Homo sapiens
ccaauugugugcuucucuu

SEQ ID NO: 644034 - RNA, 19 nt, Homo sapiens
cugaagacauaaccaguug

SEQ ID NO: 644035 - RNA, 19 nt, Homo sapiens
gagcaccaaguccagauuu

SEQ ID NO: 644036 - RNA, 19 nt, Homo sapiens
gaaacccagcggaaacuga

SEQ ID NO: 644037 - RNA, 19 nt, Homo sapiens
gacgaugagcgguaucuuu

SEQ ID NO: 644038 - RNA, 19 nt, Homo sapiens
agagcugguucuaagauuu

SEQ ID NO: 644039 - RNA, 19 nt, Homo sapiens
gccaccuucuuaguuauua

SEQ ID NO: 644040 - RNA, 19 nt, Homo sapiens
ggcuuuaagugguuucuau

SEQ ID NO: 644041 - RNA, 19 nt, Homo sapiens
gaugguguauguguauaug

SEQ ID NO: 644042 - RNA, 19 nt, Homo sapiens
gacugcaguuucaacauga

SEQ ID NO: 644043 - RNA, 19 nt, Homo sapiens
gaagacugcaguuucaaca

SEQ ID NO: 644044 - RNA, 19 nt, Homo sapiens
gacccgagccuaaacacaa

SEQ ID NO: 644045 - RNA, 19 nt, Homo sapiens
ggacauuguuuuaaucugu

SEQ ID NO: 644046 - RNA, 19 nt, Homo sapiens
uauauagagccauccauaa

SEQ ID NO: 644047 - RNA, 19 nt, Homo sapiens
gcaaagucuaucucugaaa

SEQ ID NO: 644048 - RNA, 19 nt, Homo sapiens
ccaaagcuacacagacuga

SEQ ID NO: 644049 - RNA, 19 nt, Homo sapiens
aaauugagcccaccuuuua

SEQ ID NO: 644050 - RNA, 19 nt, Homo sapiens
caagaaccguuguaauagc

SEQ ID NO: 644051 - RNA, 19 nt, Homo sapiens
cggaugcggucaauaauac

SEQ ID NO: 644052 - RNA, 19 nt, Homo sapiens
ggaauugaguggccaagua

SEQ ID NO: 644053 - RNA, 19 nt, Homo sapiens
gcucauaacugacaagaug

SEQ ID NO: 644054 - RNA, 19 nt, Homo sapiens
caauaaagguacaauguug

SEQ ID NO: 644055 - RNA, 19 nt, Homo sapiens
ucaaggacaugaagacuaa

SEQ ID NO: 644056 - RNA, 19 nt, Homo sapiens
gaaccacuccucacagaua

SEQ ID NO: 644057 - RNA, 19 nt, Homo sapiens
ccacagagcugaaauccau

SEQ ID NO: 644058 - RNA, 19 nt, Homo sapiens
agacugagcugcacccuuu

SEQ ID NO: 644059 - RNA, 19 nt, Homo sapiens
ggaauaaggucaaggacau

SEQ ID NO: 644060 - RNA, 19 nt, Homo sapiens
ggccagcccuugacauuaa

SEQ ID NO: 644061 - RNA, 19 nt, Homo sapiens
gauaggcucucucaucuuc

SEQ ID NO: 644062 - RNA, 19 nt, Homo sapiens
gaaggacacugcacagauc

SEQ ID NO: 644063 - RNA, 19 nt, Homo sapiens
gcaauucaauaaagaggaa

SEQ ID NO: 644064 - RNA, 19 nt, Homo sapiens
caagcaggaugacaaguuu

SEQ ID NO: 644065 - RNA, 19 nt, Homo sapiens
ccucacagauaaggaauaa

SEQ ID NO: 644066 - RNA, 19 nt, Homo sapiens
ugaaauccaugacgaucuu

SEQ ID NO: 644067 - RNA, 19 nt, Homo sapiens
gcaguuuccugacaugcuu

SEQ ID NO: 644068 - RNA, 19 nt, Homo sapiens
gaaguggugucagcagaga

SEQ ID NO: 644069 - RNA, 19 nt, Homo sapiens
gaugagcugugugugguuu

SEQ ID NO: 644070 - RNA, 19 nt, Homo sapiens
caaugaguuugacuuggua

SEQ ID NO: 644071 - RNA, 19 nt, Homo sapiens
gcuccaugcuggucucuga

SEQ ID NO: 644072 - RNA, 19 nt, Homo sapiens
ccgcaagugugaacaagaa

SEQ ID NO: 644073 - RNA, 19 nt, Homo sapiens
gagaggagaacuucaagga

SEQ ID NO: 644074 - RNA, 19 nt, Homo sapiens
gcauuucuuuggccacuga

SEQ ID NO: 644075 - RNA, 19 nt, Homo sapiens
gcuggucucugauguuuag

SEQ ID NO: 644076 - RNA, 19 nt, Homo sapiens
caucuuggguuggaauuga

SEQ ID NO: 644077 - RNA, 19 nt, Homo sapiens
gcuuucaccuguauuuguu

SEQ ID NO: 644078 - RNA, 19 nt, Homo sapiens
gcauggagacgaagaagga

SEQ ID NO: 644079 - RNA, 19 nt, Homo sapiens
gagaugcuguuacgcagau

SEQ ID NO: 644080 - RNA, 19 nt, Homo sapiens
gaauugaguggccaaguau

SEQ ID NO: 644081 - RNA, 19 nt, Homo sapiens
gagcugcacccuuucuuug

SEQ ID NO: 644082 - RNA, 19 nt, Homo sapiens
ggacagccuucaugaacag

SEQ ID NO: 644083 - RNA, 19 nt, Homo sapiens
gcagcugaaucugaccaua

SEQ ID NO: 644084 - RNA, 19 nt, Homo sapiens
ccaauaaagguacaauguu

SEQ ID NO: 644085 - RNA, 19 nt, Homo sapiens
gaccauuccuucaaaucug

SEQ ID NO: 644086 - RNA, 19 nt, Homo sapiens
ucaccuguauuuguucuuu

SEQ ID NO: 644087 - RNA, 19 nt, Homo sapiens
ggacaugaagacuaaggaa

SEQ ID NO: 644088 - RNA, 19 nt, Homo sapiens
cauguuugcugaccacuuc

SEQ ID NO: 644089 - RNA, 19 nt, Homo sapiens
cuaguagcccucaccuuua

SEQ ID NO: 644090 - RNA, 19 nt, Homo sapiens
uaguagcccucaccuuuau

SEQ ID NO: 644091 - RNA, 19 nt, Homo sapiens
ggucucugauguuuaggaa

SEQ ID NO: 644092 - RNA, 19 nt, Homo sapiens
gaaccagcaugagguagca

SEQ ID NO: 644093 - RNA, 19 nt, Homo sapiens
gggacagccuucaugaaca

SEQ ID NO: 644094 - RNA, 19 nt, Homo sapiens
ccgauaggcucucucaucu

SEQ ID NO: 644095 - RNA, 19 nt, Homo sapiens
gaucuauccugacgcuaag

SEQ ID NO: 644096 - RNA, 19 nt, Homo sapiens
acagacacaugccaagaug

SEQ ID NO: 644097 - RNA, 19 nt, Homo sapiens
ccaagcaggaugacaaguu

SEQ ID NO: 644098 - RNA, 19 nt, Homo sapiens
ucaauaaagaggaagcaaa

SEQ ID NO: 644099 - RNA, 19 nt, Homo sapiens
gauaaggaauaaggucaag

SEQ ID NO: 644100 - RNA, 19 nt, Homo sapiens
gcugugauucauuccaaua

SEQ ID NO: 644101 - RNA, 19 nt, Homo sapiens
cuaaggaaacaucaucuga

SEQ ID NO: 644102 - RNA, 19 nt, Homo sapiens
gacaugaagacuaaggaaa

SEQ ID NO: 644103 - RNA, 19 nt, Homo sapiens
agacucaaguggccacguu

SEQ ID NO: 644104 - RNA, 19 nt, Homo sapiens
ugaaagggaaggugaagga

SEQ ID NO: 644105 - RNA, 19 nt, Homo sapiens
gugauucauuccaauaaag

SEQ ID NO: 644106 - RNA, 19 nt, Homo sapiens
uaaggaauaaggucaagga

SEQ ID NO: 644107 - RNA, 19 nt, Homo sapiens
ggaacuugaaccagcauga

SEQ ID NO: 644108 - RNA, 19 nt, Homo sapiens
caauggcaguuuccugaca

SEQ ID NO: 644109 - RNA, 19 nt, Homo sapiens
ccagaagcccuauugcaau

SEQ ID NO: 644110 - RNA, 19 nt, Homo sapiens
caaauuccaggccuaguuc

SEQ ID NO: 644111 - RNA, 19 nt, Homo sapiens
gcccagauccugagauugg

SEQ ID NO: 644112 - RNA, 19 nt, Homo sapiens
ugaggaagcggccaagaau

SEQ ID NO: 644113 - RNA, 19 nt, Homo sapiens
caugaagacuaaggaaaca

SEQ ID NO: 644114 - RNA, 19 nt, Homo sapiens
aaccacuccucacagauaa

SEQ ID NO: 644115 - RNA, 19 nt, Homo sapiens
ucacuguguucuuccucua

SEQ ID NO: 644116 - RNA, 19 nt, Homo sapiens
ucucugauguuuaggaagu

SEQ ID NO: 644117 - RNA, 19 nt, Homo sapiens
gcaagugugaacaagaaga

SEQ ID NO: 644118 - RNA, 19 nt, Homo sapiens
gcugcacccuuucuuugga

SEQ ID NO: 644119 - RNA, 19 nt, Homo sapiens
gaguuugacuugguaugug

SEQ ID NO: 644120 - RNA, 19 nt, Homo sapiens
caauaaagaggaagcaaac

SEQ ID NO: 644121 - RNA, 19 nt, Homo sapiens
gaagacuaaggaaacauca

SEQ ID NO: 644122 - RNA, 19 nt, Homo sapiens
ucacagauaaggaauaagg

SEQ ID NO: 644123 - RNA, 19 nt, Homo sapiens
caucaugucggccuucuuc

SEQ ID NO: 644124 - RNA, 19 nt, Homo sapiens
cugaaccacuccucacaga

SEQ ID NO: 644125 - RNA, 19 nt, Homo sapiens
cgcgguggcugaugaugaa

SEQ ID NO: 644126 - RNA, 19 nt, Homo sapiens
cggcugugcugcaucuuuc

SEQ ID NO: 644127 - RNA, 19 nt, Homo sapiens
ucaaugacacagacacaug

SEQ ID NO: 644128 - RNA, 19 nt, Homo sapiens
gaagcaauucaauaaagag

SEQ ID NO: 644129 - RNA, 19 nt, Homo sapiens
acguugagccugagaauga

SEQ ID NO: 644130 - RNA, 19 nt, Homo sapiens
caucuccuauaucuggauu

SEQ ID NO: 644131 - RNA, 19 nt, Homo sapiens
gcugaucaucuucggcuuu

SEQ ID NO: 644132 - RNA, 19 nt, Homo sapiens
ggacacugcacagaucaug

SEQ ID NO: 644133 - RNA, 19 nt, Homo sapiens
uauguggcauggagacgaa

SEQ ID NO: 644134 - RNA, 19 nt, Homo sapiens
acaaauuccaggccuaguu

SEQ ID NO: 644135 - RNA, 19 nt, Homo sapiens
gccagcccuugacauuaaa

SEQ ID NO: 644136 - RNA, 19 nt, Homo sapiens
gaagcggccaagaauguca

SEQ ID NO: 644137 - RNA, 19 nt, Homo sapiens
gucaaggacaugaagacua

SEQ ID NO: 644138 - RNA, 19 nt, Homo sapiens
uagcaggacauccacauuc

SEQ ID NO: 644139 - RNA, 19 nt, Homo sapiens
guauuuguucuuucgcuuu

SEQ ID NO: 644140 - RNA, 19 nt, Homo sapiens
cccagaagcccuauugcaa

SEQ ID NO: 644141 - RNA, 19 nt, Homo sapiens
caggagaggagaacuucaa

SEQ ID NO: 644142 - RNA, 19 nt, Homo sapiens
caggccagcccuugacauu

SEQ ID NO: 644143 - RNA, 19 nt, Homo sapiens
gauuccaggccacaaauuc

SEQ ID NO: 644144 - RNA, 19 nt, Homo sapiens
ugagggcuguccacaccaa

SEQ ID NO: 644145 - RNA, 19 nt, Homo sapiens
gaauaaggucaaggacaug

SEQ ID NO: 644146 - RNA, 19 nt, Homo sapiens
uaccgucaguuacaccuau

SEQ ID NO: 644147 - RNA, 19 nt, Homo sapiens
uauuuguucuuucgcuuug

SEQ ID NO: 644148 - RNA, 19 nt, Homo sapiens
cugcacagaucauguucau

SEQ ID NO: 644149 - RNA, 19 nt, Homo sapiens
acaccaagcaggaugacaa

SEQ ID NO: 644150 - RNA, 19 nt, Homo sapiens
gaacuugaaccagcaugag

SEQ ID NO: 644151 - RNA, 19 nt, Homo sapiens
gauucuaccauccaguuug

SEQ ID NO: 644152 - RNA, 19 nt, Homo sapiens
ggacuuagcuucagcaaug

SEQ ID NO: 644153 - RNA, 19 nt, Homo sapiens
ggaauuaacuuguccucua

SEQ ID NO: 644154 - RNA, 19 nt, Homo sapiens
gguaagcccuuuccaauuu

SEQ ID NO: 644155 - RNA, 19 nt, Homo sapiens
gaauuaacuuguccucuaa

SEQ ID NO: 644156 - RNA, 19 nt, Homo sapiens
ggaaacaaaugugaaguug

SEQ ID NO: 644157 - RNA, 19 nt, Homo sapiens
cuaaacaccuccuuggaua

SEQ ID NO: 644158 - RNA, 19 nt, Homo sapiens
ggaaugcccuggaucuguu

SEQ ID NO: 644159 - RNA, 19 nt, Homo sapiens
acacucagcucaugccuaa

SEQ ID NO: 644160 - RNA, 19 nt, Homo sapiens
ucuaagagcuggaccauca

SEQ ID NO: 644161 - RNA, 19 nt, Homo sapiens
gaacagaacacaagguaag

SEQ ID NO: 644162 - RNA, 19 nt, Homo sapiens
gcucaugccuaaccuaugu

SEQ ID NO: 644163 - RNA, 19 nt, Homo sapiens
ugaaauaggugacuuuggu

SEQ ID NO: 644164 - RNA, 19 nt, Homo sapiens
ccaaaucagugcccucaga

SEQ ID NO: 644165 - RNA, 19 nt, Homo sapiens
cgauacaacugauccagaa

SEQ ID NO: 644166 - RNA, 19 nt, Homo sapiens
gagcagcacauacuucuga

SEQ ID NO: 644167 - RNA, 19 nt, Homo sapiens
gagagaagauucaguucag

SEQ ID NO: 644168 - RNA, 19 nt, Homo sapiens
ggguaugucuuggaauuaa

SEQ ID NO: 644169 - RNA, 19 nt, Homo sapiens
ugacgcagcucaucuuugg

SEQ ID NO: 644170 - RNA, 19 nt, Homo sapiens
guuaggaucuuggguaugu

SEQ ID NO: 644171 - RNA, 19 nt, Homo sapiens
ccagagcccugccucaugu

SEQ ID NO: 644172 - RNA, 19 nt, Homo sapiens
ggagaggaaacaaauguga

SEQ ID NO: 644173 - RNA, 19 nt, Homo sapiens
ucccaucccugaagaauga

SEQ ID NO: 644174 - RNA, 19 nt, Homo sapiens
gguagugacuggcauacau

SEQ ID NO: 644175 - RNA, 19 nt, Homo sapiens
ggguauggcucucuugauc

SEQ ID NO: 644176 - RNA, 19 nt, Homo sapiens
ggucuuggguggccugaug

SEQ ID NO: 644177 - RNA, 19 nt, Homo sapiens
gcacauacuucugauugag

SEQ ID NO: 644178 - RNA, 19 nt, Homo sapiens
uaucuucugugucugguuu

SEQ ID NO: 644179 - RNA, 19 nt, Homo sapiens
ggaaggugacccugauuau

SEQ ID NO: 644180 - RNA, 19 nt, Homo sapiens
guaagcccuuuccaauuug

SEQ ID NO: 644181 - RNA, 19 nt, Homo sapiens
gguccuggcugaaauaggu

SEQ ID NO: 644182 - RNA, 19 nt, Homo sapiens
cagaacagaacacaaggua

SEQ ID NO: 644183 - RNA, 19 nt, Homo sapiens
uggcauacauggcucaguu

SEQ ID NO: 644184 - RNA, 19 nt, Homo sapiens
gaaggacaccacacaguca

SEQ ID NO: 644185 - RNA, 19 nt, Homo sapiens
aagauucaguucagccuaa

SEQ ID NO: 644186 - RNA, 19 nt, Homo sapiens
gcuuacugcucuucuucua

SEQ ID NO: 644187 - RNA, 19 nt, Homo sapiens
gggaauauccugagaacag

SEQ ID NO: 644188 - RNA, 19 nt, Homo sapiens
gagacgcagccuugugaua

SEQ ID NO: 644189 - RNA, 19 nt, Homo sapiens
cagcacauacuucugauug

SEQ ID NO: 644190 - RNA, 19 nt, Homo sapiens
caaccugagugcugcugaa

SEQ ID NO: 644191 - RNA, 19 nt, Homo sapiens
gggaaaggguagaggucuu

SEQ ID NO: 644192 - RNA, 19 nt, Homo sapiens
caguucagccuaaaucaaa

SEQ ID NO: 644193 - RNA, 19 nt, Homo sapiens
gagaggaaacaaaugugaa

SEQ ID NO: 644194 - RNA, 19 nt, Homo sapiens
cugauuaucuucugugucu

SEQ ID NO: 644195 - RNA, 19 nt, Homo sapiens
gaggauggacgaggcgaua

SEQ ID NO: 644196 - RNA, 19 nt, Homo sapiens
ggguuaggaucuuggguau

SEQ ID NO: 644197 - RNA, 19 nt, Homo sapiens
gaccagccuugcuuaugga

SEQ ID NO: 644198 - RNA, 19 nt, Homo sapiens
gaaggugacccugauuauc

SEQ ID NO: 644199 - RNA, 19 nt, Homo sapiens
ggacgaggcgauacaacug

SEQ ID NO: 644200 - RNA, 19 nt, Homo sapiens
cuacauggcccugcgcuuu

SEQ ID NO: 644201 - RNA, 19 nt, Homo sapiens
uguguucacuucaaagaug

SEQ ID NO: 644202 - RNA, 19 nt, Homo sapiens
acagagagaagauucaguu

SEQ ID NO: 644203 - RNA, 19 nt, Homo sapiens
gacgcagccuugugauaug

SEQ ID NO: 644204 - RNA, 19 nt, Homo sapiens
cggaaggugacccugauua

SEQ ID NO: 644205 - RNA, 19 nt, Homo sapiens
gggugaagaaccacacuuu

SEQ ID NO: 644206 - RNA, 19 nt, Homo sapiens
ggaaaggagguuuguucug

SEQ ID NO: 644207 - RNA, 19 nt, Homo sapiens
agaccagccuugcuuaugg

SEQ ID NO: 644208 - RNA, 19 nt, Homo sapiens
ccucagagaaggaaacaga

SEQ ID NO: 644209 - RNA, 19 nt, Homo sapiens
ggaaggaaaggagguuugu

SEQ ID NO: 644210 - RNA, 19 nt, Homo sapiens
ugaaaaugcuguggauaaa

SEQ ID NO: 644211 - RNA, 19 nt, Homo sapiens
gaagaaccacacuuucaac

SEQ ID NO: 644212 - RNA, 19 nt, Homo sapiens
aaacuuccaccuuguguuc

SEQ ID NO: 644213 - RNA, 19 nt, Homo sapiens
auacauggcucaguuuguc

SEQ ID NO: 644214 - RNA, 19 nt, Homo sapiens
ccagauacagcuauugauc

SEQ ID NO: 644215 - RNA, 19 nt, Homo sapiens
gcaguggcuugggugaaga

SEQ ID NO: 644216 - RNA, 19 nt, Homo sapiens
gcauacauggcucaguuug

SEQ ID NO: 644217 - RNA, 19 nt, Homo sapiens
gcccuacacucagcucaug

SEQ ID NO: 644218 - RNA, 19 nt, Homo sapiens
uuggguaugucuuggaauu

SEQ ID NO: 644219 - RNA, 19 nt, Homo sapiens
ggaggcaggacaccacaau

SEQ ID NO: 644220 - RNA, 19 nt, Homo sapiens
uggguggccugauguguau

SEQ ID NO: 644221 - RNA, 19 nt, Homo sapiens
ggucauacagagagaagau

SEQ ID NO: 644222 - RNA, 19 nt, Homo sapiens
ggaaccaccaucugagaca

SEQ ID NO: 644223 - RNA, 19 nt, Homo sapiens
gcuguguguucucaacuuc

SEQ ID NO: 644224 - RNA, 19 nt, Homo sapiens
agacgcagccuugugauau

SEQ ID NO: 644225 - RNA, 19 nt, Homo sapiens
gaaggaaaggagguuuguu

SEQ ID NO: 644226 - RNA, 19 nt, Homo sapiens
caccuuguguucacuucaa

SEQ ID NO: 644227 - RNA, 19 nt, Homo sapiens
ggaguccccugcccucaaa

SEQ ID NO: 644228 - RNA, 19 nt, Homo sapiens
guauggcucucuugaucuc

SEQ ID NO: 644229 - RNA, 19 nt, Homo sapiens
guucaugggugggcuccuu

SEQ ID NO: 644230 - RNA, 19 nt, Homo sapiens
ccaggcagguggaugaaaa

SEQ ID NO: 644231 - RNA, 19 nt, Homo sapiens
aaucagugcccucagagaa

SEQ ID NO: 644232 - RNA, 19 nt, Homo sapiens
gcugcugccuuuaccaucu

SEQ ID NO: 644233 - RNA, 19 nt, Homo sapiens
agccaccgcuucaaugaga

SEQ ID NO: 644234 - RNA, 19 nt, Homo sapiens
gggaaggaaaggagguuug

SEQ ID NO: 644235 - RNA, 19 nt, Homo sapiens
gggaaugcccuggaucugu

SEQ ID NO: 644236 - RNA, 19 nt, Homo sapiens
gaaaaugcuguggauaaaa

SEQ ID NO: 644237 - RNA, 19 nt, Homo sapiens
aaacaccuccuuggauaug

SEQ ID NO: 644238 - RNA, 19 nt, Homo sapiens
ggccuggacgucuaucuga

SEQ ID NO: 644239 - RNA, 19 nt, Homo sapiens
uuacugcucuucuucuacu

SEQ ID NO: 644240 - RNA, 19 nt, Homo sapiens
gcacugcgccuggcuuacu

SEQ ID NO: 644241 - RNA, 19 nt, Homo sapiens
gugaaguuguggacucuac

SEQ ID NO: 644242 - RNA, 19 nt, Homo sapiens
uaaacaccuccuuggauau

SEQ ID NO: 644243 - RNA, 19 nt, Homo sapiens
ccuaaacaccuccuuggau

SEQ ID NO: 644244 - RNA, 19 nt, Homo sapiens
gucaauaggcggaaacucu

SEQ ID NO: 644245 - RNA, 19 nt, Homo sapiens
gacgaggcgauacaacuga

SEQ ID NO: 644246 - RNA, 19 nt, Homo sapiens
gggacucgccuacgguuuc

SEQ ID NO: 644247 - RNA, 19 nt, Homo sapiens
ucacccuacugacagaaug

SEQ ID NO: 644248 - RNA, 19 nt, Homo sapiens
uggcgcagcugcuccucuu

SEQ ID NO: 644249 - RNA, 19 nt, Homo sapiens
aaggaaaggagguuuguuc

SEQ ID NO: 644250 - RNA, 19 nt, Homo sapiens
ggugaagaaccacacuuuc

SEQ ID NO: 644251 - RNA, 19 nt, Homo sapiens
aaaaugcuguggauaaaag

SEQ ID NO: 644252 - RNA, 19 nt, Homo sapiens
ggaaauguaucuguacuuu

SEQ ID NO: 644253 - RNA, 19 nt, Homo sapiens
guaaagagcuacagaacau

SEQ ID NO: 644254 - RNA, 19 nt, Homo sapiens
gcaagucuguccuuucuga

SEQ ID NO: 644255 - RNA, 19 nt, Homo sapiens
ucacuucucuucagacuug

SEQ ID NO: 644256 - RNA, 19 nt, Homo sapiens
ggaagaagaaccaggauga

SEQ ID NO: 644257 - RNA, 19 nt, Homo sapiens
uaacuuggcucacuucucu

SEQ ID NO: 644258 - RNA, 19 nt, Homo sapiens
gaagaaccaggaugacuuu

SEQ ID NO: 644259 - RNA, 19 nt, Homo sapiens
gacaugaggccuucaguaa

SEQ ID NO: 644260 - RNA, 19 nt, Homo sapiens
ccacagaauugcuuuccuu

SEQ ID NO: 644261 - RNA, 19 nt, Homo sapiens
gugcagagccacagaauug

SEQ ID NO: 644262 - RNA, 19 nt, Homo sapiens
ggaaguugaugaagaggau

SEQ ID NO: 644263 - RNA, 19 nt, Homo sapiens
gaaccaggaugacuuugag

SEQ ID NO: 644264 - RNA, 19 nt, Homo sapiens
caugaggccuucaguaaag

SEQ ID NO: 644265 - RNA, 19 nt, Homo sapiens
ccacuugcauuuggaagaa

SEQ ID NO: 644266 - RNA, 19 nt, Homo sapiens
guaugaaugugucaguguu

SEQ ID NO: 644267 - RNA, 19 nt, Homo sapiens
cagaaaacgucauauaaga

SEQ ID NO: 644268 - RNA, 19 nt, Homo sapiens
ugaagaggaugaguaugaa

SEQ ID NO: 644269 - RNA, 19 nt, Homo sapiens
gaaauguaucuguacuuug

SEQ ID NO: 644270 - RNA, 19 nt, Homo sapiens
gcaaccuccuggccacuug

SEQ ID NO: 644271 - RNA, 19 nt, Homo sapiens
gugcguaucuggcgucagu

SEQ ID NO: 644272 - RNA, 19 nt, Homo sapiens
caaggaccauuuaugacau

SEQ ID NO: 644273 - RNA, 19 nt, Homo sapiens
ggccaugaauccacugugu

SEQ ID NO: 644274 - RNA, 19 nt, Homo sapiens
cauccuugaccuucauuua

SEQ ID NO: 644275 - RNA, 19 nt, Homo sapiens
acucaaggaccauuuauga

SEQ ID NO: 644276 - RNA, 19 nt, Homo sapiens
cacaggaugucaagcaugu

SEQ ID NO: 644277 - RNA, 19 nt, Homo sapiens
gagcauccuugaccuucau

SEQ ID NO: 644278 - RNA, 19 nt, Homo sapiens
ugacaugaggccuucagua

SEQ ID NO: 644279 - RNA, 19 nt, Homo sapiens
gaagugcagagccacagaa

SEQ ID NO: 644280 - RNA, 19 nt, Homo sapiens
ggagcauccuugaccuuca

SEQ ID NO: 644281 - RNA, 19 nt, Homo sapiens
ucaaggaccauuuaugaca

SEQ ID NO: 644282 - RNA, 19 nt, Homo sapiens
ggccuucaguaaagagcua

SEQ ID NO: 644283 - RNA, 19 nt, Homo sapiens
ucaacuguguggccuggaa

SEQ ID NO: 644284 - RNA, 19 nt, Homo sapiens
ucugggaaguugaugaaga

SEQ ID NO: 644285 - RNA, 19 nt, Homo sapiens
ggaugacuuugagugugua

SEQ ID NO: 644286 - RNA, 19 nt, Homo sapiens
ugacagcccacuugcauca

SEQ ID NO: 644287 - RNA, 19 nt, Homo sapiens
aaaaugaggucaagucagu

SEQ ID NO: 644288 - RNA, 19 nt, Homo sapiens
gaagaggaugaguaugaau

SEQ ID NO: 644289 - RNA, 19 nt, Homo sapiens
ccacgucuuuggacagagu

SEQ ID NO: 644290 - RNA, 19 nt, Homo sapiens
guguggagcuuggccuuug

SEQ ID NO: 644291 - RNA, 19 nt, Homo sapiens
ggucugggaaguugaugaa

SEQ ID NO: 644292 - RNA, 19 nt, Homo sapiens
gcuuugaugcuaccacuug

SEQ ID NO: 644293 - RNA, 19 nt, Homo sapiens
gagcuaccacgucuuugga

SEQ ID NO: 644294 - RNA, 19 nt, Homo sapiens
cugcaagucuguccuuucu

SEQ ID NO: 644295 - RNA, 19 nt, Homo sapiens
gaggaugaguaugaaugug

SEQ ID NO: 644296 - RNA, 19 nt, Homo sapiens
augaagaggaugaguauga

SEQ ID NO: 644297 - RNA, 19 nt, Homo sapiens
agaagaaccaggaugacuu

SEQ ID NO: 644298 - RNA, 19 nt, Homo sapiens
cccaggaugucaacugugu

SEQ ID NO: 644299 - RNA, 19 nt, Homo sapiens
gcuaugaugacacagugaa

SEQ ID NO: 644300 - RNA, 19 nt, Homo sapiens
gaaugugucaguguucuca

SEQ ID NO: 644301 - RNA, 19 nt, Homo sapiens
ugaugaagaggaugaguau

SEQ ID NO: 644302 - RNA, 19 nt, Homo sapiens
gcucacuucucuucagacu

SEQ ID NO: 644303 - RNA, 19 nt, Homo sapiens
uaucuggcgucaguaucua

SEQ ID NO: 644304 - RNA, 19 nt, Homo sapiens
ucaguaaagagcuacagaa

SEQ ID NO: 644305 - RNA, 19 nt, Homo sapiens
aguuggaaauguaucugua

SEQ ID NO: 644306 - RNA, 19 nt, Homo sapiens
gaagaggaugacuggguau

SEQ ID NO: 644307 - RNA, 19 nt, Homo sapiens
acaugaggccuucaguaaa

SEQ ID NO: 644308 - RNA, 19 nt, Homo sapiens
aaggaccauuuaugacauu

SEQ ID NO: 644309 - RNA, 19 nt, Homo sapiens
gaggaugacuggguaugcu

SEQ ID NO: 644310 - RNA, 19 nt, Homo sapiens
cauuuaacuuggcucacuu

SEQ ID NO: 644311 - RNA, 19 nt, Homo sapiens
gcuaccacuugcauuugga

SEQ ID NO: 644312 - RNA, 19 nt, Homo sapiens
guaucuaccaggcaaugaa

SEQ ID NO: 644313 - RNA, 19 nt, Homo sapiens
gaucugcaagucuguccuu

SEQ ID NO: 644314 - RNA, 19 nt, Homo sapiens
gaccauuuaugacauugcu

SEQ ID NO: 644315 - RNA, 19 nt, Homo sapiens
ggaugucaagcaugugguu

SEQ ID NO: 644316 - RNA, 19 nt, Homo sapiens
aggaugacuuugagugugu

SEQ ID NO: 644317 - RNA, 19 nt, Homo sapiens
ccacuugcagccgagauaa

SEQ ID NO: 644318 - RNA, 19 nt, Homo sapiens
ucauuuaacuuggcucacu

SEQ ID NO: 644319 - RNA, 19 nt, Homo sapiens
uaccacgucuuuggacaga

SEQ ID NO: 644320 - RNA, 19 nt, Homo sapiens
guuugggucugggaaguug

SEQ ID NO: 644321 - RNA, 19 nt, Homo sapiens
aguaaugacuccccagaaa

SEQ ID NO: 644322 - RNA, 19 nt, Homo sapiens
ccacucaaggaccauuuau

SEQ ID NO: 644323 - RNA, 19 nt, Homo sapiens
acacacaggaugucaagca

SEQ ID NO: 644324 - RNA, 19 nt, Homo sapiens
ccacacacaggaugucaag

SEQ ID NO: 644325 - RNA, 19 nt, Homo sapiens
gccacuugcagccgagaua

SEQ ID NO: 644326 - RNA, 19 nt, Homo sapiens
agaaccaggaugacuuuga

SEQ ID NO: 644327 - RNA, 19 nt, Homo sapiens
uggcucacuucucuucaga

SEQ ID NO: 644328 - RNA, 19 nt, Homo sapiens
ucugccagcuuugaugcua

SEQ ID NO: 644329 - RNA, 19 nt, Homo sapiens
gggagguggccuucuggaa

SEQ ID NO: 644330 - RNA, 19 nt, Homo sapiens
gaagcuguaccgggaggaa

SEQ ID NO: 644331 - RNA, 19 nt, Homo sapiens
ccaggaugacuuugagugu

SEQ ID NO: 644332 - RNA, 19 nt, Homo sapiens
guaaugacuccccagaaaa

SEQ ID NO: 644333 - RNA, 19 nt, Homo sapiens
gcauuuggaagaagaacca

SEQ ID NO: 644334 - RNA, 19 nt, Homo sapiens
gaagaagaaccaggaugac

SEQ ID NO: 644335 - RNA, 19 nt, Homo sapiens
gaccccaguuggaaaugua

SEQ ID NO: 644336 - RNA, 19 nt, Homo sapiens
ugccagcuaugaugacaca

SEQ ID NO: 644337 - RNA, 19 nt, Homo sapiens
aagaggaugaguaugaaug

SEQ ID NO: 644338 - RNA, 19 nt, Homo sapiens
gaaaacgucauauaagacu

SEQ ID NO: 644339 - RNA, 19 nt, Homo sapiens
gaugucaagcaugugguuu

SEQ ID NO: 644340 - RNA, 19 nt, Homo sapiens
gcucagaccuguaugaaua

SEQ ID NO: 644341 - RNA, 19 nt, Homo sapiens
ggacugcucuaucauuaua

SEQ ID NO: 644342 - RNA, 19 nt, Homo sapiens
cuaaagcccuugugaagua

SEQ ID NO: 644343 - RNA, 19 nt, Homo sapiens
gcacagagguagcaaaugg

SEQ ID NO: 644344 - RNA, 19 nt, Homo sapiens
caagagaccuuuggaugaa

SEQ ID NO: 644345 - RNA, 19 nt, Homo sapiens
ccaaacagcugcagagaca

SEQ ID NO: 644346 - RNA, 19 nt, Homo sapiens
gaaaggaagcucaauccaa

SEQ ID NO: 644347 - RNA, 19 nt, Homo sapiens
cagacgacauuaucaauug

SEQ ID NO: 644348 - RNA, 19 nt, Homo sapiens
acaagagacugcagaaaga

SEQ ID NO: 644349 - RNA, 19 nt, Homo sapiens
ugaaguaucuggaacaucu

SEQ ID NO: 644350 - RNA, 19 nt, Homo sapiens
gacauuaucaauugccuua

SEQ ID NO: 644351 - RNA, 19 nt, Homo sapiens
ugaccaggcucuaugaaug

SEQ ID NO: 644352 - RNA, 19 nt, Homo sapiens
ugaccaggcucuaugaaug

SEQ ID NO: 644353 - RNA, 19 nt, Homo sapiens
ccacuuagcugugcuguac

SEQ ID NO: 644354 - RNA, 19 nt, Homo sapiens
gcagcaggcgggauuuaua

SEQ ID NO: 644355 - RNA, 19 nt, Homo sapiens
acagaggucuacuuugaaa

SEQ ID NO: 644356 - RNA, 19 nt, Homo sapiens
ugcaaacgcuuccucauga

SEQ ID NO: 644357 - RNA, 19 nt, Homo sapiens
gaagauggccaagugcaaa

SEQ ID NO: 644358 - RNA, 19 nt, Homo sapiens
uggaacaucuugugauaga

SEQ ID NO: 644359 - RNA, 19 nt, Homo sapiens
ucuggaacaucuugugaua

SEQ ID NO: 644360 - RNA, 19 nt, Homo sapiens
gaacuagugugggccuaug

SEQ ID NO: 644361 - RNA, 19 nt, Homo sapiens
cgacacagccuugcucaaa

SEQ ID NO: 644362 - RNA, 19 nt, Homo sapiens
ggaaugaccaggcucuaug

SEQ ID NO: 644363 - RNA, 19 nt, Homo sapiens
augaauacaucguggauuu

SEQ ID NO: 644364 - RNA, 19 nt, Homo sapiens
cuacaggacuuugaaggaa

SEQ ID NO: 644365 - RNA, 19 nt, Homo sapiens
aagaugaaguugaaaggaa

SEQ ID NO: 644366 - RNA, 19 nt, Homo sapiens
acgauaagaugaaguugaa

SEQ ID NO: 644367 - RNA, 19 nt, Homo sapiens
acagaaacauacaagaguu

SEQ ID NO: 644368 - RNA, 19 nt, Homo sapiens
gaacagcagaagaacaguu

SEQ ID NO: 644369 - RNA, 19 nt, Homo sapiens
caaggagcgcgucaacaua

SEQ ID NO: 644370 - RNA, 19 nt, Homo sapiens
ucaagaagcccgugaacga

SEQ ID NO: 644371 - RNA, 19 nt, Homo sapiens
ggacaugaagagcagauga

SEQ ID NO: 644372 - RNA, 19 nt, Homo sapiens
gacaagagacugcagaaag

SEQ ID NO: 644373 - RNA, 19 nt, Homo sapiens
gaacaucuugugauagaca

SEQ ID NO: 644374 - RNA, 19 nt, Homo sapiens
gaaugaccaggcucuauga

SEQ ID NO: 644375 - RNA, 19 nt, Homo sapiens
uuggacugcucuaucauua

SEQ ID NO: 644376 - RNA, 19 nt, Homo sapiens
cagccuugcucaaacugua

SEQ ID NO: 644377 - RNA, 19 nt, Homo sapiens
agaagaggcuuugguuuua

SEQ ID NO: 644378 - RNA, 19 nt, Homo sapiens
gaacgagaacccugugagu

SEQ ID NO: 644379 - RNA, 19 nt, Homo sapiens
acaaauacaggaucuucua

SEQ ID NO: 644380 - RNA, 19 nt, Homo sapiens
guagaaguuugcaucaucu

SEQ ID NO: 644381 - RNA, 19 nt, Homo sapiens
caauccaacucucagacaa

SEQ ID NO: 644382 - RNA, 19 nt, Homo sapiens
gcacuuggacugcucuauc

SEQ ID NO: 644383 - RNA, 19 nt, Homo sapiens
uaaucuacaccuacgauaa

SEQ ID NO: 644384 - RNA, 19 nt, Homo sapiens
guagaagaggcuuugguuu

SEQ ID NO: 644385 - RNA, 19 nt, Homo sapiens
uuacaucuugguuccauua

SEQ ID NO: 644386 - RNA, 19 nt, Homo sapiens
gaucguugccacaaguaaa

SEQ ID NO: 644387 - RNA, 19 nt, Homo sapiens
ggcgggauuuauacaguuu

SEQ ID NO: 644388 - RNA, 19 nt, Homo sapiens
cagguaauguacagaagga

SEQ ID NO: 644389 - RNA, 19 nt, Homo sapiens
aguacaucauccacaauua

SEQ ID NO: 644390 - RNA, 19 nt, Homo sapiens
ccagacgacauuaucaauu

SEQ ID NO: 644391 - RNA, 19 nt, Homo sapiens
aggagaagauggccaagug

SEQ ID NO: 644392 - RNA, 19 nt, Homo sapiens
gcagccacguuugcacuga

SEQ ID NO: 644393 - RNA, 19 nt, Homo sapiens
gauaagaugaaguugaaag

SEQ ID NO: 644394 - RNA, 19 nt, Homo sapiens
gcaaacgcuuccucaugag

SEQ ID NO: 644395 - RNA, 19 nt, Homo sapiens
ggacggccacuuccugugu

SEQ ID NO: 644396 - RNA, 19 nt, Homo sapiens
uguagaaguuugcaucauc

SEQ ID NO: 644397 - RNA, 19 nt, Homo sapiens
aaacagaaacauacaagag

SEQ ID NO: 644398 - RNA, 19 nt, Homo sapiens
gggugcagaucgucaagga

SEQ ID NO: 644399 - RNA, 19 nt, Homo sapiens
acacgcugcuggccaucua

SEQ ID NO: 644400 - RNA, 19 nt, Homo sapiens
gugcaaacgcuuccucaug

SEQ ID NO: 644401 - RNA, 19 nt, Homo sapiens
gguaauguacagaaggauu

SEQ ID NO: 644402 - RNA, 19 nt, Homo sapiens
cuaugaauguacauggaaa

SEQ ID NO: 644403 - RNA, 19 nt, Homo sapiens
caugagaaggcgcugcaua

SEQ ID NO: 644404 - RNA, 19 nt, Homo sapiens
guaauguacagaaggauuc

SEQ ID NO: 644405 - RNA, 19 nt, Homo sapiens
cacguucacugccaccaaa

SEQ ID NO: 644406 - RNA, 19 nt, Homo sapiens
gagccuguguuuguuagau

SEQ ID NO: 644407 - RNA, 19 nt, Homo sapiens
gaucagccaguagacauga

SEQ ID NO: 644408 - RNA, 19 nt, Homo sapiens
gaagaacaguuuuaaucca

SEQ ID NO: 644409 - RNA, 19 nt, Homo sapiens
gacagaggucuacuuugaa

SEQ ID NO: 644410 - RNA, 19 nt, Homo sapiens
cauaguaauccaagacaga

SEQ ID NO: 644411 - RNA, 19 nt, Homo sapiens
aaacaaauacaggaucuuc

SEQ ID NO: 644412 - RNA, 19 nt, Homo sapiens
guacaucauccacaauuac

SEQ ID NO: 644413 - RNA, 19 nt, Homo sapiens
gaccaggcucuaugaaugu

SEQ ID NO: 644414 - RNA, 19 nt, Homo sapiens
gaccaggcucuaugaaugu

SEQ ID NO: 644415 - RNA, 19 nt, Homo sapiens
ggccagguccgaaaacuua

SEQ ID NO: 644416 - RNA, 19 nt, Homo sapiens
caagagacugcagaaagaa

SEQ ID NO: 644417 - RNA, 19 nt, Homo sapiens
uggaugaacagcagaagaa

SEQ ID NO: 644418 - RNA, 19 nt, Homo sapiens
cugauuggguccugcagaa

SEQ ID NO: 644419 - RNA, 19 nt, Homo sapiens
cacuuggacugcucuauca

SEQ ID NO: 644420 - RNA, 19 nt, Homo sapiens
gggagcugaucucucucua

SEQ ID NO: 644421 - RNA, 19 nt, Homo sapiens
ggacgaagggagacaucug

SEQ ID NO: 644422 - RNA, 19 nt, Homo sapiens
ugaccaccaugcucugugu

SEQ ID NO: 644423 - RNA, 19 nt, Homo sapiens
uaaagcccuugugaaguau

SEQ ID NO: 644424 - RNA, 19 nt, Homo sapiens
caguagacaugaugagcau

SEQ ID NO: 644425 - RNA, 19 nt, Homo sapiens
acaaggagcgcgucaacau

SEQ ID NO: 644426 - RNA, 19 nt, Homo sapiens
gacacagccuugcucaaac

SEQ ID NO: 644427 - RNA, 19 nt, Homo sapiens
cagcacagagguagcaaau

SEQ ID NO: 644428 - RNA, 19 nt, Homo sapiens
cagagacacuugggcuuca

SEQ ID NO: 644429 - RNA, 19 nt, Homo sapiens
ggucggagaaugugauugg

SEQ ID NO: 644430 - RNA, 19 nt, Homo sapiens
caguacaucauccacaauu

SEQ ID NO: 644431 - RNA, 19 nt, Homo sapiens
ggaagcugggcgagcauga

SEQ ID NO: 644432 - RNA, 19 nt, Homo sapiens
aauacaggaucuucuagca

SEQ ID NO: 644433 - RNA, 19 nt, Homo sapiens
caaauacaggaucuucuag

SEQ ID NO: 644434 - RNA, 19 nt, Homo sapiens
acaggacuuugaaggaaga

SEQ ID NO: 644435 - RNA, 19 nt, Homo sapiens
ggagggccauauccuacag

SEQ ID NO: 644436 - RNA, 19 nt, Homo sapiens
ggauagggagacaggaguu

SEQ ID NO: 644437 - RNA, 19 nt, Homo sapiens
guacauaguaauccaagac

SEQ ID NO: 644438 - RNA, 19 nt, Homo sapiens
ccagguacauaguaaucca

SEQ ID NO: 644439 - RNA, 19 nt, Homo sapiens
ccgccacgccaccgaauuu

SEQ ID NO: 644440 - RNA, 19 nt, Homo sapiens
ggaccgagcucaccaacug

SEQ ID NO: 644441 - RNA, 19 nt, Homo sapiens
acacagcacucgcucuuaa

SEQ ID NO: 644442 - RNA, 19 nt, Homo sapiens
gcaagacgcaguaccuguu

SEQ ID NO: 644443 - RNA, 19 nt, Homo sapiens
gcacacagcacucgcucuu

SEQ ID NO: 644444 - RNA, 19 nt, Homo sapiens
ccaggaaguucuacuacau

SEQ ID NO: 644445 - RNA, 19 nt, Homo sapiens
acaugcagcuguacgacua

SEQ ID NO: 644446 - RNA, 19 nt, Homo sapiens
gcguggagguggaugaaga

SEQ ID NO: 644447 - RNA, 19 nt, Homo sapiens
ggaaagcgugcucgaagga

SEQ ID NO: 644448 - RNA, 19 nt, Homo sapiens
gcuacaaccuguccuucau

SEQ ID NO: 644449 - RNA, 19 nt, Homo sapiens
cguacaaccuggccaacaa

SEQ ID NO: 644450 - RNA, 19 nt, Homo sapiens
gcuucaugcucaucuugua

SEQ ID NO: 644451 - RNA, 19 nt, Homo sapiens
gaagggcgacgacgugauc

SEQ ID NO: 644452 - RNA, 19 nt, Homo sapiens
aaacagagcagggauguag

SEQ ID NO: 644453 - RNA, 19 nt, Homo sapiens
cagcagcgcuaccaguaca

SEQ ID NO: 644454 - RNA, 19 nt, Homo sapiens
gugugucccucaccaacua

SEQ ID NO: 644455 - RNA, 19 nt, Homo sapiens
ucaacgaccuggacaugca

SEQ ID NO: 644456 - RNA, 19 nt, Homo sapiens
gcugcacgcuacaggaguu

SEQ ID NO: 644457 - RNA, 19 nt, Homo sapiens
ucgcugcgcuucgacauga

SEQ ID NO: 644458 - RNA, 19 nt, Homo sapiens
ggacguucaaccucaaguu

SEQ ID NO: 644459 - RNA, 19 nt, Homo sapiens
ccgacgaccuguaccuguu

SEQ ID NO: 644460 - RNA, 19 nt, Homo sapiens
ugagccacaucauugagaa

SEQ ID NO: 644461 - RNA, 19 nt, Homo sapiens
gguccugcuucaugcuuug

SEQ ID NO: 644462 - RNA, 19 nt, Homo sapiens
gcucaacgaccuggacaug

SEQ ID NO: 644463 - RNA, 19 nt, Homo sapiens
gcacgcccaggaaguucua

SEQ ID NO: 644464 - RNA, 19 nt, Homo sapiens
agaagaagugcaccugcua

SEQ ID NO: 644465 - RNA, 19 nt, Homo sapiens
ggagugagaccagcuucug

SEQ ID NO: 644466 - RNA, 19 nt, Homo sapiens
aggaaguucuacuacauca

SEQ ID NO: 644467 - RNA, 19 nt, Homo sapiens
acugaagguuugcgcaaga

SEQ ID NO: 644468 - RNA, 19 nt, Homo sapiens
ccgcgagacuuggcucuuc

SEQ ID NO: 644469 - RNA, 19 nt, Homo sapiens
gacguucaaccucaaguuc

SEQ ID NO: 644470 - RNA, 19 nt, Homo sapiens
caagacgcaguaccuguuc

SEQ ID NO: 644471 - RNA, 19 nt, Homo sapiens
gagacgaggacagcggaaa

SEQ ID NO: 644472 - RNA, 19 nt, Homo sapiens
gaaagcgugcucgaaggau

SEQ ID NO: 644473 - RNA, 19 nt, Homo sapiens
cccaggaaguucuacuaca

SEQ ID NO: 644474 - RNA, 19 nt, Homo sapiens
caucuguagcucccucaaa

SEQ ID NO: 644475 - RNA, 19 nt, Homo sapiens
gcuccaggccaucccauag

SEQ ID NO: 644476 - RNA, 19 nt, Homo sapiens
cuccuggccuccuuggauu

SEQ ID NO: 644477 - RNA, 19 nt, Homo sapiens
gcaucgaggagcucaacga

SEQ ID NO: 644478 - RNA, 19 nt, Homo sapiens
cuacaucacccugcuacga

SEQ ID NO: 644479 - RNA, 19 nt, Homo sapiens
ggaggccaaagcugauguu

SEQ ID NO: 644480 - RNA, 19 nt, Homo sapiens
ccagcucacccaucuguag

SEQ ID NO: 644481 - RNA, 19 nt, Homo sapiens
gcucgaaggaugccauggu

SEQ ID NO: 644482 - RNA, 19 nt, Homo sapiens
gccacaucauugagaagug

SEQ ID NO: 644483 - RNA, 19 nt, Homo sapiens
ggagugugucccucaccaa

SEQ ID NO: 644484 - RNA, 19 nt, Homo sapiens
cgacagguccacccaagac

SEQ ID NO: 644485 - RNA, 19 nt, Homo sapiens
caaaucaguucgagaauua

SEQ ID NO: 644486 - RNA, 19 nt, Homo sapiens
gaaaggauuugauguauuc

SEQ ID NO: 644487 - RNA, 19 nt, Homo sapiens
gaacugccauuccaaagaa

SEQ ID NO: 644488 - RNA, 19 nt, Homo sapiens
guacauguauuucuccaua

SEQ ID NO: 644489 - RNA, 19 nt, Homo sapiens
ggagagaaauugcugcauu

SEQ ID NO: 644490 - RNA, 19 nt, Homo sapiens
gacaauauguuccgauuug

SEQ ID NO: 644491 - RNA, 19 nt, Homo sapiens
cagcaaacauucggauuua

SEQ ID NO: 644492 - RNA, 19 nt, Homo sapiens
gguaucaccuuacauggua

SEQ ID NO: 644493 - RNA, 19 nt, Homo sapiens
gcagagcaauauuaaaugu

SEQ ID NO: 644494 - RNA, 19 nt, Homo sapiens
ugaagaagaugguagaaau

SEQ ID NO: 644495 - RNA, 19 nt, Homo sapiens
cagagugucuucaaauaaa

SEQ ID NO: 644496 - RNA, 19 nt, Homo sapiens
gcacauuauugacacguuu

SEQ ID NO: 644497 - RNA, 19 nt, Homo sapiens
gcacaacucaagugaaauu

SEQ ID NO: 644498 - RNA, 19 nt, Homo sapiens
guacuacaauagauggaua

SEQ ID NO: 644499 - RNA, 19 nt, Homo sapiens
uauaggagauggcaauuug

SEQ ID NO: 644500 - RNA, 19 nt, Homo sapiens
caacaucaaggauauauga

SEQ ID NO: 644501 - RNA, 19 nt, Homo sapiens
aguauuaccuguacaauug

SEQ ID NO: 644502 - RNA, 19 nt, Homo sapiens
gaacauuuauggaaucaac

SEQ ID NO: 644503 - RNA, 19 nt, Homo sapiens
acacuuaccugaagcaguu

SEQ ID NO: 644504 - RNA, 19 nt, Homo sapiens
gcacuggauuugauggaaa

SEQ ID NO: 644505 - RNA, 19 nt, Homo sapiens
gacagguggugguuguuua

SEQ ID NO: 644506 - RNA, 19 nt, Homo sapiens
aagcacaacucaagugaaa

SEQ ID NO: 644507 - RNA, 19 nt, Homo sapiens
gcuagaauguuaaacuuca

SEQ ID NO: 644508 - RNA, 19 nt, Homo sapiens
caucaaggauauaugaaga

SEQ ID NO: 644509 - RNA, 19 nt, Homo sapiens
gcuauuguguggagagaaa

SEQ ID NO: 644510 - RNA, 19 nt, Homo sapiens
cgaaaggauuugauguauu

SEQ ID NO: 644511 - RNA, 19 nt, Homo sapiens
uuacaaagacuucagguuu

SEQ ID NO: 644512 - RNA, 19 nt, Homo sapiens
agagaacaaugaagcuaua

SEQ ID NO: 644513 - RNA, 19 nt, Homo sapiens
gucagagugucuucaaaua

SEQ ID NO: 644514 - RNA, 19 nt, Homo sapiens
uaagugcagagcaauauua

SEQ ID NO: 644515 - RNA, 19 nt, Homo sapiens
agaauuacguagaagauga

SEQ ID NO: 644516 - RNA, 19 nt, Homo sapiens
ggaguuauacacguuguua

SEQ ID NO: 644517 - RNA, 19 nt, Homo sapiens
uaaauguacuggugacuag

SEQ ID NO: 644518 - RNA, 19 nt, Homo sapiens
cguagaagaugaugacaau

SEQ ID NO: 644519 - RNA, 19 nt, Homo sapiens
gaacuuauucgugcuauca

SEQ ID NO: 644520 - RNA, 19 nt, Homo sapiens
gcauuucuguuucuuaagu

SEQ ID NO: 644521 - RNA, 19 nt, Homo sapiens
gaaauugaaguagucgaua

SEQ ID NO: 644522 - RNA, 19 nt, Homo sapiens
caagugaaauugaaguagu

SEQ ID NO: 644523 - RNA, 19 nt, Homo sapiens
ggacuaguacuacaauaga

SEQ ID NO: 644524 - RNA, 19 nt, Homo sapiens
ucaaaucaguucgagaauu

SEQ ID NO: 644525 - RNA, 19 nt, Homo sapiens
acgguaaacugacugauuu

SEQ ID NO: 644526 - RNA, 19 nt, Homo sapiens
cauaagaaguugagaucga

SEQ ID NO: 644527 - RNA, 19 nt, Homo sapiens
aagcagaguugccgaauca

SEQ ID NO: 644528 - RNA, 19 nt, Homo sapiens
gaugguagaaaucaacuuu

SEQ ID NO: 644529 - RNA, 19 nt, Homo sapiens
gcaaacauucggauuuaug

SEQ ID NO: 644530 - RNA, 19 nt, Homo sapiens
cagaguugccgaaucaaua

SEQ ID NO: 644531 - RNA, 19 nt, Homo sapiens
gagcacauucuuguaauuu

SEQ ID NO: 644532 - RNA, 19 nt, Homo sapiens
ucaaggaguuauacacguu

SEQ ID NO: 644533 - RNA, 19 nt, Homo sapiens
ggaaucaacacuucuguag

SEQ ID NO: 644534 - RNA, 19 nt, Homo sapiens
cuuaagugaugguacauuu

SEQ ID NO: 644535 - RNA, 19 nt, Homo sapiens
gaugaaaggcuacaaagag

SEQ ID NO: 644536 - RNA, 19 nt, Homo sapiens
caauugaaccagauaaaga

SEQ ID NO: 644537 - RNA, 19 nt, Homo sapiens
gugcagagcaauauuaaau

SEQ ID NO: 644538 - RNA, 19 nt, Homo sapiens
gcaccacccugcucacaag

SEQ ID NO: 644539 - RNA, 19 nt, Homo sapiens
caaugaagcuauacagacu

SEQ ID NO: 644540 - RNA, 19 nt, Homo sapiens
agaagaaacagaagagaaa

SEQ ID NO: 644541 - RNA, 19 nt, Homo sapiens
gaaguagucgauaaucaga

SEQ ID NO: 644542 - RNA, 19 nt, Homo sapiens
cuagaacucugacaucauc

SEQ ID NO: 644543 - RNA, 19 nt, Homo sapiens
caaagccgccuacucauuc

SEQ ID NO: 644544 - RNA, 19 nt, Homo sapiens
aaacuggucggguucauaa

SEQ ID NO: 644545 - RNA, 19 nt, Homo sapiens
gugggacacuuuagacuug

SEQ ID NO: 644546 - RNA, 19 nt, Homo sapiens
aaaguucaguuucuucuca

SEQ ID NO: 644547 - RNA, 19 nt, Homo sapiens
gucaguggauugcuucaaa

SEQ ID NO: 644548 - RNA, 19 nt, Homo sapiens
ccgaagugcucaaggaguu

SEQ ID NO: 644549 - RNA, 19 nt, Homo sapiens
gggcauugauaguuugaau

SEQ ID NO: 644550 - RNA, 19 nt, Homo sapiens
ucagcaacaucaaggauau

SEQ ID NO: 644551 - RNA, 19 nt, Homo sapiens
cugcauuucuguuucuuaa

SEQ ID NO: 644552 - RNA, 19 nt, Homo sapiens
gaaaaucuuugcuauugug

SEQ ID NO: 644553 - RNA, 19 nt, Homo sapiens
ggacuaaguagaaguuaca

SEQ ID NO: 644554 - RNA, 19 nt, Homo sapiens
ugaaaagguuggacuagua

SEQ ID NO: 644555 - RNA, 19 nt, Homo sapiens
cauccuggcuaaaucgaaa

SEQ ID NO: 644556 - RNA, 19 nt, Homo sapiens
ccucaaagccgccuacuca

SEQ ID NO: 644557 - RNA, 19 nt, Homo sapiens
uaucaaaucaguucgagaa

SEQ ID NO: 644558 - RNA, 19 nt, Homo sapiens
uaagugccaucccagcaaa

SEQ ID NO: 644559 - RNA, 19 nt, Homo sapiens
gaacucugacaucaucauu

SEQ ID NO: 644560 - RNA, 19 nt, Homo sapiens
caaacauucggauuuauga

SEQ ID NO: 644561 - RNA, 19 nt, Homo sapiens
gaagucauaacaucucaug

SEQ ID NO: 644562 - RNA, 19 nt, Homo sapiens
cagaaaagaugacaaaagu

SEQ ID NO: 644563 - RNA, 19 nt, Homo sapiens
aaucaacacuuaccugaag

SEQ ID NO: 644564 - RNA, 19 nt, Homo sapiens
gaagaagaugguagaaauc

SEQ ID NO: 644565 - RNA, 19 nt, Homo sapiens
agaagaugaugacaauaug

SEQ ID NO: 644566 - RNA, 19 nt, Homo sapiens
ucacugugcucucugaaag

SEQ ID NO: 644567 - RNA, 19 nt, Homo sapiens
acucugacaucaucauuug

SEQ ID NO: 644568 - RNA, 19 nt, Homo sapiens
ucacuugaguagaaauaug

SEQ ID NO: 644569 - RNA, 19 nt, Homo sapiens
gaaaauugguagaagugaa

SEQ ID NO: 644570 - RNA, 19 nt, Homo sapiens
ccagcaaacauucggauuu

SEQ ID NO: 644571 - RNA, 19 nt, Homo sapiens
ucagagugucuucaaauaa

SEQ ID NO: 644572 - RNA, 19 nt, Homo sapiens
gaaaccccaucucuacuaa

SEQ ID NO: 644573 - RNA, 19 nt, Homo sapiens
ggaugaaaggcuacaaaga

SEQ ID NO: 644574 - RNA, 19 nt, Homo sapiens
ucgaaaggauuugauguau

SEQ ID NO: 644575 - RNA, 19 nt, Homo sapiens
ugacugauuuccugagcuu

SEQ ID NO: 644576 - RNA, 19 nt, Homo sapiens
auacagacuuccagauguu

SEQ ID NO: 644577 - RNA, 19 nt, Homo sapiens
gguggugguuguuuaagug

SEQ ID NO: 644578 - RNA, 19 nt, Homo sapiens
gaacaaugaagcuauacag

SEQ ID NO: 644579 - RNA, 19 nt, Homo sapiens
gaagaugaugacaauaugu

SEQ ID NO: 644580 - RNA, 19 nt, Homo sapiens
gugcaaaguucaguuucuu

SEQ ID NO: 644581 - RNA, 19 nt, Homo sapiens
ucaaagccgccuacucauu

SEQ ID NO: 644582 - RNA, 19 nt, Homo sapiens
acacacaaccgguaccaaa

SEQ ID NO: 644583 - RNA, 19 nt, Homo sapiens
gcaggagaaucgcuugaac

SEQ ID NO: 644584 - RNA, 19 nt, Homo sapiens
guucgagaauuaaucaaca

SEQ ID NO: 644585 - RNA, 19 nt, Homo sapiens
ggaggcaccugcacuguua

SEQ ID NO: 644586 - RNA, 19 nt, Homo sapiens
gaggauagccgucacuuua

SEQ ID NO: 644587 - RNA, 19 nt, Homo sapiens
gaaauucccuauacaacaa

SEQ ID NO: 644588 - RNA, 19 nt, Homo sapiens
ggaggaaggugagccauua

SEQ ID NO: 644589 - RNA, 19 nt, Homo sapiens
gaaggaugcuggcgaguau

SEQ ID NO: 644590 - RNA, 19 nt, Homo sapiens
gaagguuucccaagacuua

SEQ ID NO: 644591 - RNA, 19 nt, Homo sapiens
ggaaccagcuccugacaga

SEQ ID NO: 644592 - RNA, 19 nt, Homo sapiens
gagucaaguuuacaaguua

SEQ ID NO: 644593 - RNA, 19 nt, Homo sapiens
ggaccaaaccaauguuaua

SEQ ID NO: 644594 - RNA, 19 nt, Homo sapiens
ggagucaaguuuacaaguu

SEQ ID NO: 644595 - RNA, 19 nt, Homo sapiens
guaaauugcuggugcacuu

SEQ ID NO: 644596 - RNA, 19 nt, Homo sapiens
ggcaagagcucuccaucaa

SEQ ID NO: 644597 - RNA, 19 nt, Homo sapiens
ccagcuagcucucacauau

SEQ ID NO: 644598 - RNA, 19 nt, Homo sapiens
ugacagaaauucccuauac

SEQ ID NO: 644599 - RNA, 19 nt, Homo sapiens
guacgugucuccaaagugu

SEQ ID NO: 644600 - RNA, 19 nt, Homo sapiens
ucucauauguggcaucuuu

SEQ ID NO: 644601 - RNA, 19 nt, Homo sapiens
gaacuuuccucauuaccau

SEQ ID NO: 644602 - RNA, 19 nt, Homo sapiens
gcaggaauguacuggugua

SEQ ID NO: 644603 - RNA, 19 nt, Homo sapiens
caauggaaaccuucaguua

SEQ ID NO: 644604 - RNA, 19 nt, Homo sapiens
ggacugaaauugcucacau

SEQ ID NO: 644605 - RNA, 19 nt, Homo sapiens
gagcaaagacuaaucuaau

SEQ ID NO: 644606 - RNA, 19 nt, Homo sapiens
caaacacugaugagaauua

SEQ ID NO: 644607 - RNA, 19 nt, Homo sapiens
gagcuggacucagaagauu

SEQ ID NO: 644608 - RNA, 19 nt, Homo sapiens
gcaaagacuaaucuaauug

SEQ ID NO: 644609 - RNA, 19 nt, Homo sapiens
cagaaaggaccacuguuua

SEQ ID NO: 644610 - RNA, 19 nt, Homo sapiens
uaagguacgugucuccaaa

SEQ ID NO: 644611 - RNA, 19 nt, Homo sapiens
ugaaauugcucacauugau

SEQ ID NO: 644612 - RNA, 19 nt, Homo sapiens
gaugagaauuacuauggaa

SEQ ID NO: 644613 - RNA, 19 nt, Homo sapiens
caacacugauauagaaugu

SEQ ID NO: 644614 - RNA, 19 nt, Homo sapiens
uaaagucucuggagucaag

SEQ ID NO: 644615 - RNA, 19 nt, Homo sapiens
gaaaggaccacuguuuaga

SEQ ID NO: 644616 - RNA, 19 nt, Homo sapiens
gauuauuucucucuccaaa

SEQ ID NO: 644617 - RNA, 19 nt, Homo sapiens
gauggaggaugcaggaaug

SEQ ID NO: 644618 - RNA, 19 nt, Homo sapiens
gagaauuacuauggaaguu

SEQ ID NO: 644619 - RNA, 19 nt, Homo sapiens
ggaauguggugaccuaguc

SEQ ID NO: 644620 - RNA, 19 nt, Homo sapiens
ccaagcaaguggauuaauc

SEQ ID NO: 644621 - RNA, 19 nt, Homo sapiens
gauauagaauguagcaucu

SEQ ID NO: 644622 - RNA, 19 nt, Homo sapiens
gaccaaaccaauguuauaa

SEQ ID NO: 644623 - RNA, 19 nt, Homo sapiens
ggaagagacaggaguguau

SEQ ID NO: 644624 - RNA, 19 nt, Homo sapiens
caagagcucuccaucaacu

SEQ ID NO: 644625 - RNA, 19 nt, Homo sapiens
gagagacacucgccuuucu

SEQ ID NO: 644626 - RNA, 19 nt, Homo sapiens
ucagaaaggaccacuguuu

SEQ ID NO: 644627 - RNA, 19 nt, Homo sapiens
ugacuaagcucagcauugg

SEQ ID NO: 644628 - RNA, 19 nt, Homo sapiens
acuaaugccucuuggcuaa

SEQ ID NO: 644629 - RNA, 19 nt, Homo sapiens
uauagaauguagcaucuug

SEQ ID NO: 644630 - RNA, 19 nt, Homo sapiens
gaaguguggucgugucuac

SEQ ID NO: 644631 - RNA, 19 nt, Homo sapiens
ggcaggugcuucagagaaa

SEQ ID NO: 644632 - RNA, 19 nt, Homo sapiens
caggaaguccagaucauua

SEQ ID NO: 644633 - RNA, 19 nt, Homo sapiens
gaauggcuccugucuacaa

SEQ ID NO: 644634 - RNA, 19 nt, Homo sapiens
uaaagauccuggagaugga

SEQ ID NO: 644635 - RNA, 19 nt, Homo sapiens
gaagaaugacuacaaagag

SEQ ID NO: 644636 - RNA, 19 nt, Homo sapiens
gaauuacuauggaaguuac

SEQ ID NO: 644637 - RNA, 19 nt, Homo sapiens
ucacggugcugccuucaga

SEQ ID NO: 644638 - RNA, 19 nt, Homo sapiens
ccaaauggcaggcaucuca

SEQ ID NO: 644639 - RNA, 19 nt, Homo sapiens
aagaaugacuacaaagaga

SEQ ID NO: 644640 - RNA, 19 nt, Homo sapiens
agaaguaacaguucagaaa

SEQ ID NO: 644641 - RNA, 19 nt, Homo sapiens
cuacagacuuuguccugaa

SEQ ID NO: 644642 - RNA, 19 nt, Homo sapiens
ggagauggaccaaaccaau

SEQ ID NO: 644643 - RNA, 19 nt, Homo sapiens
ccugaagaaugacuacaaa

SEQ ID NO: 644644 - RNA, 19 nt, Homo sapiens
ccaagccacugagauuauu

SEQ ID NO: 644645 - RNA, 19 nt, Homo sapiens
ccagagagaaguaacaguu

SEQ ID NO: 644646 - RNA, 19 nt, Homo sapiens
gcagcugggugccuccuau

SEQ ID NO: 644647 - RNA, 19 nt, Homo sapiens
gaaguaacaguucagaaag

SEQ ID NO: 644648 - RNA, 19 nt, Homo sapiens
gaagaugaaggcaacugaa

SEQ ID NO: 644649 - RNA, 19 nt, Homo sapiens
acacugauauagaauguag

SEQ ID NO: 644650 - RNA, 19 nt, Homo sapiens
cuccaacacugauauagaa

SEQ ID NO: 644651 - RNA, 19 nt, Homo sapiens
gacagaaauucccuauaca

SEQ ID NO: 644652 - RNA, 19 nt, Homo sapiens
gaaggcgccuacagaugug

SEQ ID NO: 644653 - RNA, 19 nt, Homo sapiens
ggaagaugaaggcaacuga

SEQ ID NO: 644654 - RNA, 19 nt, Homo sapiens
guuuagagcugaagguuac

SEQ ID NO: 644655 - RNA, 19 nt, Homo sapiens
acucagaagauuucaguua

SEQ ID NO: 644656 - RNA, 19 nt, Homo sapiens
acacucgccuuucucugua

SEQ ID NO: 644657 - RNA, 19 nt, Homo sapiens
ggaugaaggcgccuacaga

SEQ ID NO: 644658 - RNA, 19 nt, Homo sapiens
cugagaagguuucccaaga

SEQ ID NO: 644659 - RNA, 19 nt, Homo sapiens
caacuccaacacugauaua

SEQ ID NO: 644660 - RNA, 19 nt, Homo sapiens
ugaagaaugacuacaaaga

SEQ ID NO: 644661 - RNA, 19 nt, Homo sapiens
gaaauugcucacauugaug

SEQ ID NO: 644662 - RNA, 19 nt, Homo sapiens
uuauuucucucuccaaaga

SEQ ID NO: 644663 - RNA, 19 nt, Homo sapiens
gcucagcauuggccagaga

SEQ ID NO: 644664 - RNA, 19 nt, Homo sapiens
aaaguguacuggaccgaaa

SEQ ID NO: 644665 - RNA, 19 nt, Homo sapiens
acacaaggcuggagaaaau

SEQ ID NO: 644666 - RNA, 19 nt, Homo sapiens
gaaaguccccugucuguga

SEQ ID NO: 644667 - RNA, 19 nt, Homo sapiens
gacugaaauugcucacauu

SEQ ID NO: 644668 - RNA, 19 nt, Homo sapiens
aguagaaguuuaugacaga

SEQ ID NO: 644669 - RNA, 19 nt, Homo sapiens
gaaguagaaguuuaugaca

SEQ ID NO: 644670 - RNA, 19 nt, Homo sapiens
guaucagugugaaguagaa

SEQ ID NO: 644671 - RNA, 19 nt, Homo sapiens
ggacucagaagauuucagu

SEQ ID NO: 644672 - RNA, 19 nt, Homo sapiens
agacacagcccgaguuugu

SEQ ID NO: 644673 - RNA, 19 nt, Homo sapiens
ugaaggcgccuacagaugu

SEQ ID NO: 644674 - RNA, 19 nt, Homo sapiens
acacugaugagaauuacua

SEQ ID NO: 644675 - RNA, 19 nt, Homo sapiens
cuaacagaauugaaacuca

SEQ ID NO: 644676 - RNA, 19 nt, Homo sapiens
gagauggaccaaaccaaug

SEQ ID NO: 644677 - RNA, 19 nt, Homo sapiens
agugugaaguagaaguuua

SEQ ID NO: 644678 - RNA, 19 nt, Homo sapiens
ucacagacaguggcacaua

SEQ ID NO: 644679 - RNA, 19 nt, Homo sapiens
agaaagcagucaccagaca

SEQ ID NO: 644680 - RNA, 19 nt, Homo sapiens
ugccuucucuuacgcagua

SEQ ID NO: 644681 - RNA, 19 nt, Homo sapiens
cacccaagcaaguggauua

SEQ ID NO: 644682 - RNA, 19 nt, Homo sapiens
uggcaggcaucucauaugu

SEQ ID NO: 644683 - RNA, 19 nt, Homo sapiens
ggaaguaagguacgugucu

SEQ ID NO: 644684 - RNA, 19 nt, Homo sapiens
ggcuaaagauccuggagau

SEQ ID NO: 644685 - RNA, 19 nt, Homo sapiens
gaaggcagcuccaagaaga

SEQ ID NO: 644686 - RNA, 19 nt, Homo sapiens
gcaagccucagacaaauaa

SEQ ID NO: 644687 - RNA, 19 nt, Homo sapiens
gggcgugucuccugucaaa

SEQ ID NO: 644688 - RNA, 19 nt, Homo sapiens
gaggaagcaugaacucaau

SEQ ID NO: 644689 - RNA, 19 nt, Homo sapiens
gggagccgauguccaguuu

SEQ ID NO: 644690 - RNA, 19 nt, Homo sapiens
ccugcaagcuggccucuaa

SEQ ID NO: 644691 - RNA, 19 nt, Homo sapiens
ggagagcccugcguucugu

SEQ ID NO: 644692 - RNA, 19 nt, Homo sapiens
gucauggccucaucaguuu

SEQ ID NO: 644693 - RNA, 19 nt, Homo sapiens
gcgcugcucccaaagauuu

SEQ ID NO: 644694 - RNA, 19 nt, Homo sapiens
ggaggaagcaugaacucaa

SEQ ID NO: 644695 - RNA, 19 nt, Homo sapiens
gaguugaggcccuaacaaa

SEQ ID NO: 644696 - RNA, 19 nt, Homo sapiens
guugaggcccuaacaaauu

SEQ ID NO: 644697 - RNA, 19 nt, Homo sapiens
ccaaggcccugcucaagag

SEQ ID NO: 644698 - RNA, 19 nt, Homo sapiens
uugaggcccuaacaaauuu

SEQ ID NO: 644699 - RNA, 19 nt, Homo sapiens
gagacaggacccacagaaa

SEQ ID NO: 644700 - RNA, 19 nt, Homo sapiens
guucugcucuugcccuuca

SEQ ID NO: 644701 - RNA, 19 nt, Homo sapiens
gguuugcccugaagauugu

SEQ ID NO: 644702 - RNA, 19 nt, Homo sapiens
ccguggagauggugaguga

SEQ ID NO: 644703 - RNA, 19 nt, Homo sapiens
gcccuucauugacuccuuu

SEQ ID NO: 644704 - RNA, 19 nt, Homo sapiens
ugaagauugugcccaccua

SEQ ID NO: 644705 - RNA, 19 nt, Homo sapiens
guggacggcugaaggugaa

SEQ ID NO: 644706 - RNA, 19 nt, Homo sapiens
ggagauggugagugaaguu

SEQ ID NO: 644707 - RNA, 19 nt, Homo sapiens
ugucauggccucaucaguu

SEQ ID NO: 644708 - RNA, 19 nt, Homo sapiens
gacaggacccacagaaaca

SEQ ID NO: 644709 - RNA, 19 nt, Homo sapiens
aaugugguguuuacaaugu

SEQ ID NO: 644710 - RNA, 19 nt, Homo sapiens
uggagaagcucaagaucag

SEQ ID NO: 644711 - RNA, 19 nt, Homo sapiens
ggaaggcagcuccaagaag

SEQ ID NO: 644712 - RNA, 19 nt, Homo sapiens
gauggugagugaaguugag

SEQ ID NO: 644713 - RNA, 19 nt, Homo sapiens
gagccgauguccaguuucg

SEQ ID NO: 644714 - RNA, 19 nt, Homo sapiens
gggaaggcagcuccaagaa

SEQ ID NO: 644715 - RNA, 19 nt, Homo sapiens
gcagucgagcuucggcuuu

SEQ ID NO: 644716 - RNA, 19 nt, Homo sapiens
caagaucagcgaccagcuu

SEQ ID NO: 644717 - RNA, 19 nt, Homo sapiens
ccacagaaacagccugaca

SEQ ID NO: 644718 - RNA, 19 nt, Homo sapiens
gcuacugacugcucuacag

SEQ ID NO: 644719 - RNA, 19 nt, Homo sapiens
gcaagcuggccucuaagga

SEQ ID NO: 644720 - RNA, 19 nt, Homo sapiens
ccaaagauuucugacucau

SEQ ID NO: 644721 - RNA, 19 nt, Homo sapiens
ggugaugacugugaaagac

SEQ ID NO: 644722 - RNA, 19 nt, Homo sapiens
gaagggcgaccuggcuaug

SEQ ID NO: 644723 - RNA, 19 nt, Homo sapiens
ggaagcaugaacucaaugg

SEQ ID NO: 644724 - RNA, 19 nt, Homo sapiens
cccaaagauuucugacuca

SEQ ID NO: 644725 - RNA, 19 nt, Homo sapiens
cagcagacaccguggagau

SEQ ID NO: 644726 - RNA, 19 nt, Homo sapiens
uggcaugguucugcucuug

SEQ ID NO: 644727 - RNA, 19 nt, Homo sapiens
gaagggaaggcagcuccaa

SEQ ID NO: 644728 - RNA, 19 nt, Homo sapiens
gcauguggcccaggcucua

SEQ ID NO: 644729 - RNA, 19 nt, Homo sapiens
uucauugacuccuuucaga

SEQ ID NO: 644730 - RNA, 19 nt, Homo sapiens
aggaggagguguucaucug

SEQ ID NO: 644731 - RNA, 19 nt, Homo sapiens
gaccaaggcccugcucaag

SEQ ID NO: 644732 - RNA, 19 nt, Homo sapiens
ggacacgagccuucaacgu

SEQ ID NO: 644733 - RNA, 19 nt, Homo sapiens
ggauugggcaugggaagga

SEQ ID NO: 644734 - RNA, 19 nt, Homo sapiens
gagaguugaggcccuaaca

SEQ ID NO: 644735 - RNA, 19 nt, Homo sapiens
gagauggugagugaaguug

SEQ ID NO: 644736 - RNA, 19 nt, Homo sapiens
gaucagcgaccagcuucug

SEQ ID NO: 644737 - RNA, 19 nt, Homo sapiens
uugcaagccucagacaaau

SEQ ID NO: 644738 - RNA, 19 nt, Homo sapiens
cagcugguuugguccuugu

SEQ ID NO: 644739 - RNA, 19 nt, Homo sapiens
ccucagggccuugaaguag

SEQ ID NO: 644740 - RNA, 19 nt, Homo sapiens
ccuacgagcggaugauugu

SEQ ID NO: 644741 - RNA, 19 nt, Homo sapiens
caaagauuucugacucauc

SEQ ID NO: 644742 - RNA, 19 nt, Homo sapiens
agacaggacccacagaaac

SEQ ID NO: 644743 - RNA, 19 nt, Homo sapiens
agagacaggacccacagaa

SEQ ID NO: 644744 - RNA, 19 nt, Homo sapiens
ugucggugaugacugugaa

SEQ ID NO: 644745 - RNA, 19 nt, Homo sapiens
gacaaauaaaugugguguu

SEQ ID NO: 644746 - RNA, 19 nt, Homo sapiens
cagucgagcuucggcuuuc

SEQ ID NO: 644747 - RNA, 19 nt, Homo sapiens
cagccaagagcccaugaau

SEQ ID NO: 644748 - RNA, 19 nt, Homo sapiens
ucagggccuugaaguagca

SEQ ID NO: 644749 - RNA, 19 nt, Homo sapiens
ugaccaaggcccugcucaa

SEQ ID NO: 644750 - RNA, 19 nt, Homo sapiens
gauauuugcuuccuaagaa

SEQ ID NO: 644751 - RNA, 19 nt, Homo sapiens
gaaggucccuguaauuguu

SEQ ID NO: 644752 - RNA, 19 nt, Homo sapiens
ucaaggaacugauuucuga

SEQ ID NO: 644753 - RNA, 19 nt, Homo sapiens
aaacugcugucucuaauuu

SEQ ID NO: 644754 - RNA, 19 nt, Homo sapiens
gaacucaacgcaucuguuu

SEQ ID NO: 644755 - RNA, 19 nt, Homo sapiens
gaacaguuauuagguuuga

SEQ ID NO: 644756 - RNA, 19 nt, Homo sapiens
ggaugacgcugacgugauu

SEQ ID NO: 644757 - RNA, 19 nt, Homo sapiens
ggaaacaaagcaucugaua

SEQ ID NO: 644758 - RNA, 19 nt, Homo sapiens
gggccaaccucuucuauga

SEQ ID NO: 644759 - RNA, 19 nt, Homo sapiens
gaagagcagccuuguguuu

SEQ ID NO: 644760 - RNA, 19 nt, Homo sapiens
ucacgaagcucaugguaga

SEQ ID NO: 644761 - RNA, 19 nt, Homo sapiens
cgugauugcuucagacuua

SEQ ID NO: 644762 - RNA, 19 nt, Homo sapiens
gaaacaaagcaucugauaa

SEQ ID NO: 644763 - RNA, 19 nt, Homo sapiens
ggaccuugcucuucucuau

SEQ ID NO: 644764 - RNA, 19 nt, Homo sapiens
aaagaacgcuggugcagaa

SEQ ID NO: 644765 - RNA, 19 nt, Homo sapiens
ccagauauuugcuuccuaa

SEQ ID NO: 644766 - RNA, 19 nt, Homo sapiens
uuaagcagcugacauaaga

SEQ ID NO: 644767 - RNA, 19 nt, Homo sapiens
gcucauaccuguuauacca

SEQ ID NO: 644768 - RNA, 19 nt, Homo sapiens
gcugauaaauauugacuga

SEQ ID NO: 644769 - RNA, 19 nt, Homo sapiens
guagguuucuugucaguuu

SEQ ID NO: 644770 - RNA, 19 nt, Homo sapiens
gaagcucucugcacaggaa

SEQ ID NO: 644771 - RNA, 19 nt, Homo sapiens
ggaguacgcugaagaaggu

SEQ ID NO: 644772 - RNA, 19 nt, Homo sapiens
aaaggaagcuguagguuuc

SEQ ID NO: 644773 - RNA, 19 nt, Homo sapiens
uaugggaguugcuaaauuu

SEQ ID NO: 644774 - RNA, 19 nt, Homo sapiens
gaaaccaguugccaucuuc

SEQ ID NO: 644775 - RNA, 19 nt, Homo sapiens
ucagugagaucauuuacuu

SEQ ID NO: 644776 - RNA, 19 nt, Homo sapiens
ggauucaucucaucucaug

SEQ ID NO: 644777 - RNA, 19 nt, Homo sapiens
gugaacagcuggccauaga

SEQ ID NO: 644778 - RNA, 19 nt, Homo sapiens
caaaggaagcuguagguuu

SEQ ID NO: 644779 - RNA, 19 nt, Homo sapiens
gaccauggcuguaguaaaa

SEQ ID NO: 644780 - RNA, 19 nt, Homo sapiens
gggaacaguuauuagguuu

SEQ ID NO: 644781 - RNA, 19 nt, Homo sapiens
ggagaaggucccuguaauu

SEQ ID NO: 644782 - RNA, 19 nt, Homo sapiens
ggaauaaacgcugcuggua

SEQ ID NO: 644783 - RNA, 19 nt, Homo sapiens
gaauugggcccuguuguuu

SEQ ID NO: 644784 - RNA, 19 nt, Homo sapiens
ucacagggaacaguuauua

SEQ ID NO: 644785 - RNA, 19 nt, Homo sapiens
gaauaaacgcugcugguau

SEQ ID NO: 644786 - RNA, 19 nt, Homo sapiens
caucucaucucauggaaug

SEQ ID NO: 644787 - RNA, 19 nt, Homo sapiens
uaaagccaaugucagguuu

SEQ ID NO: 644788 - RNA, 19 nt, Homo sapiens
gagaaggucccuguaauug

SEQ ID NO: 644789 - RNA, 19 nt, Homo sapiens
ccaaaggcaucaccauugu

SEQ ID NO: 644790 - RNA, 19 nt, Homo sapiens
gcugaaggccucugaaaga

SEQ ID NO: 644791 - RNA, 19 nt, Homo sapiens
ggaggcugauaaaggguua

SEQ ID NO: 644792 - RNA, 19 nt, Homo sapiens
aauaaacgcugcugguaug

SEQ ID NO: 644793 - RNA, 19 nt, Homo sapiens
gcaauucaaggaacugauu

SEQ ID NO: 644794 - RNA, 19 nt, Homo sapiens
guuuagaccuggauugaau

SEQ ID NO: 644795 - RNA, 19 nt, Homo sapiens
aaacacccgucuccugauu

SEQ ID NO: 644796 - RNA, 19 nt, Homo sapiens
cagcagccuuuaauucuug

SEQ ID NO: 644797 - RNA, 19 nt, Homo sapiens
gaggagaaggucccuguaa

SEQ ID NO: 644798 - RNA, 19 nt, Homo sapiens
gaaaaucccuaugcuauca

SEQ ID NO: 644799 - RNA, 19 nt, Homo sapiens
ccaaacugcugucucuaau

SEQ ID NO: 644800 - RNA, 19 nt, Homo sapiens
gaacgcuggugcagaacga

SEQ ID NO: 644801 - RNA, 19 nt, Homo sapiens
ucaggucaguuaacuaaug

SEQ ID NO: 644802 - RNA, 19 nt, Homo sapiens
gagcaaagugucagugaga

SEQ ID NO: 644803 - RNA, 19 nt, Homo sapiens
gaaccagccagcagccuuu

SEQ ID NO: 644804 - RNA, 19 nt, Homo sapiens
gccaaccucuucuaugaug

SEQ ID NO: 644805 - RNA, 19 nt, Homo sapiens
ccaacagccuggcaucuuc

SEQ ID NO: 644806 - RNA, 19 nt, Homo sapiens
uaacuggcguguagcacaa

SEQ ID NO: 644807 - RNA, 19 nt, Homo sapiens
ggaaugaaagggccaagug

SEQ ID NO: 644808 - RNA, 19 nt, Homo sapiens
ccacuaucauggccuuuga

SEQ ID NO: 644809 - RNA, 19 nt, Homo sapiens
uagcaaaacuccaggaaaa

SEQ ID NO: 644810 - RNA, 19 nt, Homo sapiens
uguagucucuccucucauu

SEQ ID NO: 644811 - RNA, 19 nt, Homo sapiens
guuauuagguuugaagcaa

SEQ ID NO: 644812 - RNA, 19 nt, Homo sapiens
ccucgugccugucuccuuu

SEQ ID NO: 644813 - RNA, 19 nt, Homo sapiens
ggaaugaccgggaccaagu

SEQ ID NO: 644814 - RNA, 19 nt, Homo sapiens
ggaauauugccaagucuau

SEQ ID NO: 644815 - RNA, 19 nt, Homo sapiens
caggucaguuaacuaauga

SEQ ID NO: 644816 - RNA, 19 nt, Homo sapiens
gagcugggacuucuuagug

SEQ ID NO: 644817 - RNA, 19 nt, Homo sapiens
ggacuucuggcaucacuug

SEQ ID NO: 644818 - RNA, 19 nt, Homo sapiens
ggacuagagaggcuuguga

SEQ ID NO: 644819 - RNA, 19 nt, Homo sapiens
cagcagaagugggugcauu

SEQ ID NO: 644820 - RNA, 19 nt, Homo sapiens
agaccaagauucuguacau

SEQ ID NO: 644821 - RNA, 19 nt, Homo sapiens
gccaaaggcaucaccauug

SEQ ID NO: 644822 - RNA, 19 nt, Homo sapiens
gagcagccuuguguuuaga

SEQ ID NO: 644823 - RNA, 19 nt, Homo sapiens
aagauacucaggucaguua

SEQ ID NO: 644824 - RNA, 19 nt, Homo sapiens
uugcauaacuggcguguag

SEQ ID NO: 644825 - RNA, 19 nt, Homo sapiens
caaguguuccuguucauug

SEQ ID NO: 644826 - RNA, 19 nt, Homo sapiens
ggagucaugugcuuugaac

SEQ ID NO: 644827 - RNA, 19 nt, Homo sapiens
uaguuaagcagcugacaua

SEQ ID NO: 644828 - RNA, 19 nt, Homo sapiens
aagaugagcagccaccaua

SEQ ID NO: 644829 - RNA, 19 nt, Homo sapiens
uggcaucacuugaguuauc

SEQ ID NO: 644830 - RNA, 19 nt, Homo sapiens
gaaaagagaggaaacaaag

SEQ ID NO: 644831 - RNA, 19 nt, Homo sapiens
ccagcagccuuuaauucuu

SEQ ID NO: 644832 - RNA, 19 nt, Homo sapiens
aagcaguguuugauuauuc

SEQ ID NO: 644833 - RNA, 19 nt, Homo sapiens
gcuacuguucuuugaauaa

SEQ ID NO: 644834 - RNA, 19 nt, Homo sapiens
gugccugucuccuuugcua

SEQ ID NO: 644835 - RNA, 19 nt, Homo sapiens
gugcaucaguggccugguu

SEQ ID NO: 644836 - RNA, 19 nt, Homo sapiens
aaugcucucuggaggguua

SEQ ID NO: 644837 - RNA, 19 nt, Homo sapiens
ucaguggcguccucauuug

SEQ ID NO: 644838 - RNA, 19 nt, Homo sapiens
gaggaaacaaagcaucuga

SEQ ID NO: 644839 - RNA, 19 nt, Homo sapiens
gcagugagggacagagcua

SEQ ID NO: 644840 - RNA, 19 nt, Homo sapiens
gcuaaauuuggccuucuua

SEQ ID NO: 644841 - RNA, 19 nt, Homo sapiens
gaaacucuuugggcugugu

SEQ ID NO: 644842 - RNA, 19 nt, Homo sapiens
ucuaugaugugcaauucaa

SEQ ID NO: 644843 - RNA, 19 nt, Homo sapiens
ucagcucccugcucuguug

SEQ ID NO: 644844 - RNA, 19 nt, Homo sapiens
acacuagugggcagaaaua

SEQ ID NO: 644845 - RNA, 19 nt, Homo sapiens
gggaguggauaaagccaau

SEQ ID NO: 644846 - RNA, 19 nt, Homo sapiens
uagagaggcuugugaacag

SEQ ID NO: 644847 - RNA, 19 nt, Homo sapiens
ucucuccucucauugcuuu

SEQ ID NO: 644848 - RNA, 19 nt, Homo sapiens
gaaugaaagggccaagugu

SEQ ID NO: 644849 - RNA, 19 nt, Homo sapiens
agacugaggccacuaaaca

SEQ ID NO: 644850 - RNA, 19 nt, Homo sapiens
ggaagagccucaucuaagg

SEQ ID NO: 644851 - RNA, 19 nt, Homo sapiens
acagugaggucccagauuu

SEQ ID NO: 644852 - RNA, 19 nt, Homo sapiens
caauacagcuuaccguaca

SEQ ID NO: 644853 - RNA, 19 nt, Homo sapiens
gcucaaggccaaucugaaa

SEQ ID NO: 644854 - RNA, 19 nt, Homo sapiens
gcacagcugccuccaguug

SEQ ID NO: 644855 - RNA, 19 nt, Homo sapiens
gaucuaggcucagaggaau

SEQ ID NO: 644856 - RNA, 19 nt, Homo sapiens
ccaccaaccugcaccuuuc

SEQ ID NO: 644857 - RNA, 19 nt, Homo sapiens
gcaggagcgugcagucaug

SEQ ID NO: 644858 - RNA, 19 nt, Homo sapiens
gcaccuggcuguggcugaa

SEQ ID NO: 644859 - RNA, 19 nt, Homo sapiens
ucagaggaaucacaacuuc

SEQ ID NO: 644860 - RNA, 19 nt, Homo sapiens
ccuagauccuggcugguua

SEQ ID NO: 644861 - RNA, 19 nt, Homo sapiens
gcacucccaauacagcuua

SEQ ID NO: 644862 - RNA, 19 nt, Homo sapiens
ggagaaggaccagauaugu

SEQ ID NO: 644863 - RNA, 19 nt, Homo sapiens
ggaagcaacgggaaucugu

SEQ ID NO: 644864 - RNA, 19 nt, Homo sapiens
aagcagaaguggcggaaga

SEQ ID NO: 644865 - RNA, 19 nt, Homo sapiens
gauaugugacuuccucuau

SEQ ID NO: 644866 - RNA, 19 nt, Homo sapiens
aaaccucgauuccauuauc

SEQ ID NO: 644867 - RNA, 19 nt, Homo sapiens
agaaggaccagauauguga

SEQ ID NO: 644868 - RNA, 19 nt, Homo sapiens
gcaagucccugugcuacca

SEQ ID NO: 644869 - RNA, 19 nt, Homo sapiens
gagaaggaccagauaugug

SEQ ID NO: 644870 - RNA, 19 nt, Homo sapiens
gcaauuacguacggcucaa

SEQ ID NO: 644871 - RNA, 19 nt, Homo sapiens
ucagugagcuggccuucca

SEQ ID NO: 644872 - RNA, 19 nt, Homo sapiens
ccaccgugcugccacucua

SEQ ID NO: 644873 - RNA, 19 nt, Homo sapiens
gcgaccaccuauacccauu

SEQ ID NO: 644874 - RNA, 19 nt, Homo sapiens
caagugaggaagacacaga

SEQ ID NO: 644875 - RNA, 19 nt, Homo sapiens
gaggagaaggaccagauau

SEQ ID NO: 644876 - RNA, 19 nt, Homo sapiens
gcaugggcgugcacugcuu

SEQ ID NO: 644877 - RNA, 19 nt, Homo sapiens
ggaagaaaggggaguguuu

SEQ ID NO: 644878 - RNA, 19 nt, Homo sapiens
acaugaagcagaaacacua

SEQ ID NO: 644879 - RNA, 19 nt, Homo sapiens
uaggaagagccucaucuaa

SEQ ID NO: 644880 - RNA, 19 nt, Homo sapiens
gcgagaagcggagauggaa

SEQ ID NO: 644881 - RNA, 19 nt, Homo sapiens
agaggccugugcccaagua

SEQ ID NO: 644882 - RNA, 19 nt, Homo sapiens
caaaaccucgauuccauua

SEQ ID NO: 644883 - RNA, 19 nt, Homo sapiens
gaagaaaggggaguguuuu

SEQ ID NO: 644884 - RNA, 19 nt, Homo sapiens
gaaccuuccaggccuuuca

SEQ ID NO: 644885 - RNA, 19 nt, Homo sapiens
aggaggccaucgagacuuu

SEQ ID NO: 644886 - RNA, 19 nt, Homo sapiens
ugagcgggcacucccaaua

SEQ ID NO: 644887 - RNA, 19 nt, Homo sapiens
gcagaaguggcggaagaaa

SEQ ID NO: 644888 - RNA, 19 nt, Homo sapiens
uaugugacuuccucuaugg

SEQ ID NO: 644889 - RNA, 19 nt, Homo sapiens
cuaggaagagccucaucua

SEQ ID NO: 644890 - RNA, 19 nt, Homo sapiens
ugaggagaaggaccagaua

SEQ ID NO: 644891 - RNA, 19 nt, Homo sapiens
cguacaggcuuuggacaug

SEQ ID NO: 644892 - RNA, 19 nt, Homo sapiens
gaggaaucacaacuucuga

SEQ ID NO: 644893 - RNA, 19 nt, Homo sapiens
gagcgggcacucccaauac

SEQ ID NO: 644894 - RNA, 19 nt, Homo sapiens
ccauuaucauuuacugcaa

SEQ ID NO: 644895 - RNA, 19 nt, Homo sapiens
cgagagcugcgcagacaug

SEQ ID NO: 644896 - RNA, 19 nt, Homo sapiens
ugagucggcuguccuuggu

SEQ ID NO: 644897 - RNA, 19 nt, Homo sapiens
aggaagagccucaucuaag

SEQ ID NO: 644898 - RNA, 19 nt, Homo sapiens
ucgagacuuugcugugcua

SEQ ID NO: 644899 - RNA, 19 nt, Homo sapiens
ggaggaggccaucgagacu

SEQ ID NO: 644900 - RNA, 19 nt, Homo sapiens
ggcucaacaugaagcagaa

SEQ ID NO: 644901 - RNA, 19 nt, Homo sapiens
acguacggcucaacaugaa

SEQ ID NO: 644902 - RNA, 19 nt, Homo sapiens
ggcuguagcaguugaggaa

SEQ ID NO: 644903 - RNA, 19 nt, Homo sapiens
gccgcuacuuugaggaaga

SEQ ID NO: 644904 - RNA, 19 nt, Homo sapiens
auaugugacuuccucuaug

SEQ ID NO: 644905 - RNA, 19 nt, Homo sapiens
ggaccagauaugugacuuc

SEQ ID NO: 644906 - RNA, 19 nt, Homo sapiens
ggagucuuguuuccugaac

SEQ ID NO: 644907 - RNA, 19 nt, Homo sapiens
ugcauacacucgggcauga

SEQ ID NO: 644908 - RNA, 19 nt, Homo sapiens
ucccagcgcugcucuacag

SEQ ID NO: 644909 - RNA, 19 nt, Homo sapiens
gugccacagucacaaccaa

SEQ ID NO: 644910 - RNA, 19 nt, Homo sapiens
agaaguggcggaagaaagg

SEQ ID NO: 644911 - RNA, 19 nt, Homo sapiens
gcaagcaggcauggaagca

SEQ ID NO: 644912 - RNA, 19 nt, Homo sapiens
gcucagaggaaucacaacu

SEQ ID NO: 644913 - RNA, 19 nt, Homo sapiens
gcugcgacauccgccaguu

SEQ ID NO: 644914 - RNA, 19 nt, Homo sapiens
ugaucuaggcucagaggaa

SEQ ID NO: 644915 - RNA, 19 nt, Homo sapiens
ucagggcaguuggcagaga

SEQ ID NO: 644916 - RNA, 19 nt, Homo sapiens
ccacagucacaaccaagga

SEQ ID NO: 644917 - RNA, 19 nt, Homo sapiens
uuacguacggcucaacaug

SEQ ID NO: 644918 - RNA, 19 nt, Homo sapiens
ccucgauuccauuaucauu

SEQ ID NO: 644919 - RNA, 19 nt, Homo sapiens
caaggcaaacguuuucaaa

SEQ ID NO: 644920 - RNA, 19 nt, Homo sapiens
acucgggcaugaccaggaa

SEQ ID NO: 644921 - RNA, 19 nt, Homo sapiens
gaacucagguggagaauaa

SEQ ID NO: 644922 - RNA, 19 nt, Homo sapiens
uaaauaagcugguagacua

SEQ ID NO: 644923 - RNA, 19 nt, Homo sapiens
caacaaggguaauuacuuu

SEQ ID NO: 644924 - RNA, 19 nt, Homo sapiens
gaauuugucucccuucuug

SEQ ID NO: 644925 - RNA, 19 nt, Homo sapiens
uaauggaucuguaaacuug

SEQ ID NO: 644926 - RNA, 19 nt, Homo sapiens
gauaugugcccaagaauuu

SEQ ID NO: 644927 - RNA, 19 nt, Homo sapiens
gaaaugaaauggaguuuug

SEQ ID NO: 644928 - RNA, 19 nt, Homo sapiens
gagguuggcuucuucauca

SEQ ID NO: 644929 - RNA, 19 nt, Homo sapiens
gaaauccgaccuucgauga

SEQ ID NO: 644930 - RNA, 19 nt, Homo sapiens
gcaaggagguuggcuucuu

SEQ ID NO: 644931 - RNA, 19 nt, Homo sapiens
caaaguggauccauacucu

SEQ ID NO: 644932 - RNA, 19 nt, Homo sapiens
ggaggaggaggcacaguua

SEQ ID NO: 644933 - RNA, 19 nt, Homo sapiens
ggaagcuguugccaaguuu

SEQ ID NO: 644934 - RNA, 19 nt, Homo sapiens
gguaauuaguugaugcaaa

SEQ ID NO: 644935 - RNA, 19 nt, Homo sapiens
caaauuccaucuccagaca

SEQ ID NO: 644936 - RNA, 19 nt, Homo sapiens
uaacucugaugcuugaauu

SEQ ID NO: 644937 - RNA, 19 nt, Homo sapiens
gaaaugcaguaacucugau

SEQ ID NO: 644938 - RNA, 19 nt, Homo sapiens
caagaaagagggcaaggaa

SEQ ID NO: 644939 - RNA, 19 nt, Homo sapiens
gaaaggauucuaauaacuc

SEQ ID NO: 644940 - RNA, 19 nt, Homo sapiens
aagcagaucuuccuuagag

SEQ ID NO: 644941 - RNA, 19 nt, Homo sapiens
gagacaacaaggguaauua

SEQ ID NO: 644942 - RNA, 19 nt, Homo sapiens
gcaugaggaugacguucaa

SEQ ID NO: 644943 - RNA, 19 nt, Homo sapiens
caagaggagugguuuaagg

SEQ ID NO: 644944 - RNA, 19 nt, Homo sapiens
ggagauguuuugaagauuu

SEQ ID NO: 644945 - RNA, 19 nt, Homo sapiens
ggaugacguucaacacuuc

SEQ ID NO: 644946 - RNA, 19 nt, Homo sapiens
caaggagguuggcuucuuc

SEQ ID NO: 644947 - RNA, 19 nt, Homo sapiens
aaggauaugugcccaagaa

SEQ ID NO: 644948 - RNA, 19 nt, Homo sapiens
gcacaaaguggauccauac

SEQ ID NO: 644949 - RNA, 19 nt, Homo sapiens
ggauaugugcccaagaauu

SEQ ID NO: 644950 - RNA, 19 nt, Homo sapiens
caguaacucugaugcuuga

SEQ ID NO: 644951 - RNA, 19 nt, Homo sapiens
gaaguuuccaucccuaaau

SEQ ID NO: 644952 - RNA, 19 nt, Homo sapiens
ccaagaauuucauagacau

SEQ ID NO: 644953 - RNA, 19 nt, Homo sapiens
gagcugcccacaagaaaga

SEQ ID NO: 644954 - RNA, 19 nt, Homo sapiens
gcagggcugacuaggguua

SEQ ID NO: 644955 - RNA, 19 nt, Homo sapiens
aaguuuccaucccuaaaua

SEQ ID NO: 644956 - RNA, 19 nt, Homo sapiens
gaucuuccuuagagacaga

SEQ ID NO: 644957 - RNA, 19 nt, Homo sapiens
uggaagcuguugccaaguu

SEQ ID NO: 644958 - RNA, 19 nt, Homo sapiens
ggaggaggcacaguuaaug

SEQ ID NO: 644959 - RNA, 19 nt, Homo sapiens
ugaaaugcaguaacucuga

SEQ ID NO: 644960 - RNA, 19 nt, Homo sapiens
guggauccauacucugaaa

SEQ ID NO: 644961 - RNA, 19 nt, Homo sapiens
guuaauggaucuguaaacu

SEQ ID NO: 644962 - RNA, 19 nt, Homo sapiens
gagaaguuuccaucccuaa

SEQ ID NO: 644963 - RNA, 19 nt, Homo sapiens
gacauccaguuucccaaau

SEQ ID NO: 644964 - RNA, 19 nt, Homo sapiens
uuucauagacauccaguuu

SEQ ID NO: 644965 - RNA, 19 nt, Homo sapiens
cuaauaacucggugucaaa

SEQ ID NO: 644966 - RNA, 19 nt, Homo sapiens
ucuaauaacucggugucaa

SEQ ID NO: 644967 - RNA, 19 nt, Homo sapiens
gaggaggaggcacaguuaa

SEQ ID NO: 644968 - RNA, 19 nt, Homo sapiens
ggaacucagguggagaaua

SEQ ID NO: 644969 - RNA, 19 nt, Homo sapiens
gcccaagaauuucauagac

SEQ ID NO: 644970 - RNA, 19 nt, Homo sapiens
gccaagacauaaacucaac

SEQ ID NO: 644971 - RNA, 19 nt, Homo sapiens
acauacaucuaucuacauc

SEQ ID NO: 644972 - RNA, 19 nt, Homo sapiens
gcacccaugacccgauaaa

SEQ ID NO: 644973 - RNA, 19 nt, Homo sapiens
ggagaagaaauccgaccuu

SEQ ID NO: 644974 - RNA, 19 nt, Homo sapiens
ucuguggacugagaaguuu

SEQ ID NO: 644975 - RNA, 19 nt, Homo sapiens
caaggguaauuacuuucug

SEQ ID NO: 644976 - RNA, 19 nt, Homo sapiens
auacaucuaucuacaucug

SEQ ID NO: 644977 - RNA, 19 nt, Homo sapiens
agccacagccuccgcaaua

SEQ ID NO: 644978 - RNA, 19 nt, Homo sapiens
gggaggaggaggcacaguu

SEQ ID NO: 644979 - RNA, 19 nt, Homo sapiens
acaccaggcagagaacuua

SEQ ID NO: 644980 - RNA, 19 nt, Homo sapiens
cccaagaauuucauagaca

SEQ ID NO: 644981 - RNA, 19 nt, Homo sapiens
gaggaugaacugagcuuuc

SEQ ID NO: 644982 - RNA, 19 nt, Homo sapiens
uggcacccaugacccgaua

SEQ ID NO: 644983 - RNA, 19 nt, Homo sapiens
uugaggcccuggaggauga

SEQ ID NO: 644984 - RNA, 19 nt, Homo sapiens
gccacagccuccgcaauau

SEQ ID NO: 644985 - RNA, 19 nt, Homo sapiens
ggauccauacucugaaaug

SEQ ID NO: 644986 - RNA, 19 nt, Homo sapiens
agacagaacccgagaagac

SEQ ID NO: 644987 - RNA, 19 nt, Homo sapiens
acaacaaggguaauuacuu

SEQ ID NO: 644988 - RNA, 19 nt, Homo sapiens
guaaacuugcacccucuuu

SEQ ID NO: 644989 - RNA, 19 nt, Homo sapiens
aaacuugcacccucuuuca

SEQ ID NO: 644990 - RNA, 19 nt, Homo sapiens
aggaugacguucaacacuu

SEQ ID NO: 644991 - RNA, 19 nt, Homo sapiens
ggagguuggcuucuucauc

SEQ ID NO: 644992 - RNA, 19 nt, Homo sapiens
ggacuccaugacuauauau

SEQ ID NO: 644993 - RNA, 19 nt, Homo sapiens
accggaagcugucggauca

SEQ ID NO: 644994 - RNA, 19 nt, Homo sapiens
cgagacaacaaggguaauu

SEQ ID NO: 644995 - RNA, 19 nt, Homo sapiens
ccacagccuccgcaauaug

SEQ ID NO: 644996 - RNA, 19 nt, Homo sapiens
ccagacagaagcagaucuu

SEQ ID NO: 644997 - RNA, 19 nt, Homo sapiens
gauccauacucugaaaugc

SEQ ID NO: 644998 - RNA, 19 nt, Homo sapiens
agcacaaaguggauccaua

SEQ ID NO: 644999 - RNA, 19 nt, Homo sapiens
acucugaaaugcaguaacu

SEQ ID NO: 645000 - RNA, 19 nt, Homo sapiens
ccaguuucccaaaugguuu

SEQ ID NO: 645001 - RNA, 19 nt, Homo sapiens
agacauccaguuucccaaa

SEQ ID NO: 645002 - RNA, 19 nt, Homo sapiens
gcuguugccaaguuugauu

SEQ ID NO: 645003 - RNA, 19 nt, Homo sapiens
gaggaggcacaguuaaugg

SEQ ID NO: 645004 - RNA, 19 nt, Homo sapiens
cuccaugacuauauauaca

SEQ ID NO: 645005 - RNA, 19 nt, Homo sapiens
ggaggcacaguuaauggau

SEQ ID NO: 645006 - RNA, 19 nt, Homo sapiens
gaggaugacguucaacacu

SEQ ID NO: 645007 - RNA, 19 nt, Homo sapiens
ucauagacauccaguuucc

SEQ ID NO: 645008 - RNA, 19 nt, Homo sapiens
gggaaaugaaauggaguuu

SEQ ID NO: 645009 - RNA, 19 nt, Homo sapiens
acucagguggagaauaaua

SEQ ID NO: 645010 - RNA, 19 nt, Homo sapiens
gucaaagccaagacauaaa

SEQ ID NO: 645011 - RNA, 19 nt, Homo sapiens
gucuggagcugcccacaag

SEQ ID NO: 645012 - RNA, 19 nt, Homo sapiens
gaagcuguugccaaguuug

SEQ ID NO: 645013 - RNA, 19 nt, Homo sapiens
ugcaguaacucugaugcuu

SEQ ID NO: 645014 - RNA, 19 nt, Homo sapiens
guaacucugaugcuugaau

SEQ ID NO: 645015 - RNA, 19 nt, Homo sapiens
ucaaagccaagacauaaac

SEQ ID NO: 645016 - RNA, 19 nt, Homo sapiens
ggcagagaacuuacucaug

SEQ ID NO: 645017 - RNA, 19 nt, Homo sapiens
cauccaguuucccaaaugg

SEQ ID NO: 645018 - RNA, 19 nt, Homo sapiens
acauccaguuucccaaaug

SEQ ID NO: 645019 - RNA, 19 nt, Homo sapiens
gaaggauaugugcccaaga

SEQ ID NO: 645020 - RNA, 19 nt, Homo sapiens
agaaagagggcaaggaaaa

SEQ ID NO: 645021 - RNA, 19 nt, Homo sapiens
gaacauugcugaagaacug

SEQ ID NO: 645022 - RNA, 19 nt, Homo sapiens
caagacagaugauuacuau

SEQ ID NO: 645023 - RNA, 19 nt, Homo sapiens
gaagaauuccugagugaaa

SEQ ID NO: 645024 - RNA, 19 nt, Homo sapiens
gaacacauuuucauuggua

SEQ ID NO: 645025 - RNA, 19 nt, Homo sapiens
gauaauugguccaguuuua

SEQ ID NO: 645026 - RNA, 19 nt, Homo sapiens
ggaggaagcacaauuugaa

SEQ ID NO: 645027 - RNA, 19 nt, Homo sapiens
gagcuauucuugaaguuug

SEQ ID NO: 645028 - RNA, 19 nt, Homo sapiens
guucagacccuguauuaaa

SEQ ID NO: 645029 - RNA, 19 nt, Homo sapiens
uagaagaauuccugaguga

SEQ ID NO: 645030 - RNA, 19 nt, Homo sapiens
cuuuguagcuucauuauug

SEQ ID NO: 645031 - RNA, 19 nt, Homo sapiens
gcaguauaguccaugauau

SEQ ID NO: 645032 - RNA, 19 nt, Homo sapiens
gauacauacuuggcaaauu

SEQ ID NO: 645033 - RNA, 19 nt, Homo sapiens
gguuuguucuuucauguuu

SEQ ID NO: 645034 - RNA, 19 nt, Homo sapiens
gaauucuucugguuuguuc

SEQ ID NO: 645035 - RNA, 19 nt, Homo sapiens
caugauaucuaaggaguug

SEQ ID NO: 645036 - RNA, 19 nt, Homo sapiens
ucagaggacugcaaaucaa

SEQ ID NO: 645037 - RNA, 19 nt, Homo sapiens
ggaggcaugcagagaguua

SEQ ID NO: 645038 - RNA, 19 nt, Homo sapiens
gacccuguauuaaagcuuu

SEQ ID NO: 645039 - RNA, 19 nt, Homo sapiens
aaaguuggaacgcauauaa

SEQ ID NO: 645040 - RNA, 19 nt, Homo sapiens
ucaagauccuacaguaaga

SEQ ID NO: 645041 - RNA, 19 nt, Homo sapiens
aaugaagacuacacagaaa

SEQ ID NO: 645042 - RNA, 19 nt, Homo sapiens
uauucaagauccuacagua

SEQ ID NO: 645043 - RNA, 19 nt, Homo sapiens
uaaugaagacuacacagaa

SEQ ID NO: 645044 - RNA, 19 nt, Homo sapiens
gauaguuugugauaauugg

SEQ ID NO: 645045 - RNA, 19 nt, Homo sapiens
cuaaggaguuggcaagcuu

SEQ ID NO: 645046 - RNA, 19 nt, Homo sapiens
ggauuuguguggaucagau

SEQ ID NO: 645047 - RNA, 19 nt, Homo sapiens
uaacaagacagaugauuac

SEQ ID NO: 645048 - RNA, 19 nt, Homo sapiens
uuagagagguuaacaagac

SEQ ID NO: 645049 - RNA, 19 nt, Homo sapiens
ggcaguauaguccaugaua

SEQ ID NO: 645050 - RNA, 19 nt, Homo sapiens
cacagacaguguagaagaa

SEQ ID NO: 645051 - RNA, 19 nt, Homo sapiens
gauccuacaguaagaguga

SEQ ID NO: 645052 - RNA, 19 nt, Homo sapiens
gaggaagcacaauuugaaa

SEQ ID NO: 645053 - RNA, 19 nt, Homo sapiens
guauuacccagcuuucuuu

SEQ ID NO: 645054 - RNA, 19 nt, Homo sapiens
ugcaggagcuauucuugaa

SEQ ID NO: 645055 - RNA, 19 nt, Homo sapiens
ucaggaggaagcacaauuu

SEQ ID NO: 645056 - RNA, 19 nt, Homo sapiens
uggaucagauacauacuug

SEQ ID NO: 645057 - RNA, 19 nt, Homo sapiens
ggaguuggcaagcuuaaca

SEQ ID NO: 645058 - RNA, 19 nt, Homo sapiens
gugauaaacccaaacuguu

SEQ ID NO: 645059 - RNA, 19 nt, Homo sapiens
caguaagagugaaacauuc

SEQ ID NO: 645060 - RNA, 19 nt, Homo sapiens
acaguaagagugaaacauu

SEQ ID NO: 645061 - RNA, 19 nt, Homo sapiens
gacugcaaaucaaguaugu

SEQ ID NO: 645062 - RNA, 19 nt, Homo sapiens
gaggacugcaaaucaagua

SEQ ID NO: 645063 - RNA, 19 nt, Homo sapiens
gauaaacccaaacuguuca

SEQ ID NO: 645064 - RNA, 19 nt, Homo sapiens
ggagcuauucuugaaguuu

SEQ ID NO: 645065 - RNA, 19 nt, Homo sapiens
gagguuaacaagacagaug

SEQ ID NO: 645066 - RNA, 19 nt, Homo sapiens
acgaacaacagauuucuaa

SEQ ID NO: 645067 - RNA, 19 nt, Homo sapiens
ggacugcaaaucaaguaug

SEQ ID NO: 645068 - RNA, 19 nt, Homo sapiens
caggagcuauucuugaagu

SEQ ID NO: 645069 - RNA, 19 nt, Homo sapiens
aaugacagcagacuacaaa

SEQ ID NO: 645070 - RNA, 19 nt, Homo sapiens
ugugauaauugguccaguu

SEQ ID NO: 645071 - RNA, 19 nt, Homo sapiens
acagacuugcgguuaauua

SEQ ID NO: 645072 - RNA, 19 nt, Homo sapiens
cagacaguguagaagaauu

SEQ ID NO: 645073 - RNA, 19 nt, Homo sapiens
gaagcacaauuugaaacca

SEQ ID NO: 645074 - RNA, 19 nt, Homo sapiens
cagacuacaaagcaaauaa

SEQ ID NO: 645075 - RNA, 19 nt, Homo sapiens
gcagacuacaaagcaaaua

SEQ ID NO: 645076 - RNA, 19 nt, Homo sapiens
caugugcugugugcucuuu

SEQ ID NO: 645077 - RNA, 19 nt, Homo sapiens
gaucuucucggacaguuca

SEQ ID NO: 645078 - RNA, 19 nt, Homo sapiens
ggaacgcauauaaaucuug

SEQ ID NO: 645079 - RNA, 19 nt, Homo sapiens
ugauaaacccaaacuguuc

SEQ ID NO: 645080 - RNA, 19 nt, Homo sapiens
ucuugaaguuuguggauga

SEQ ID NO: 645081 - RNA, 19 nt, Homo sapiens
ugguucagacccuguauua

SEQ ID NO: 645082 - RNA, 19 nt, Homo sapiens
agauuugcguuaaugaaga

SEQ ID NO: 645083 - RNA, 19 nt, Homo sapiens
gaaugacagcagacuacaa

SEQ ID NO: 645084 - RNA, 19 nt, Homo sapiens
gugauaauugguccaguuu

SEQ ID NO: 645085 - RNA, 19 nt, Homo sapiens
gacuugcgguuaauuaugc

SEQ ID NO: 645086 - RNA, 19 nt, Homo sapiens
aagcacaauuugaaaccaa

SEQ ID NO: 645087 - RNA, 19 nt, Homo sapiens
ggaauucuucugguuuguu

SEQ ID NO: 645088 - RNA, 19 nt, Homo sapiens
ugauuacuaugccucaugu

SEQ ID NO: 645089 - RNA, 19 nt, Homo sapiens
acaagacagaugauuacua

SEQ ID NO: 645090 - RNA, 19 nt, Homo sapiens
gcgguuaauuaugcaaaug

SEQ ID NO: 645091 - RNA, 19 nt, Homo sapiens
ccuccugcauuuguugaua

SEQ ID NO: 645092 - RNA, 19 nt, Homo sapiens
gcugaagaacugagcauuc

SEQ ID NO: 645093 - RNA, 19 nt, Homo sapiens
uugcagcucuugugaucuu

SEQ ID NO: 645094 - RNA, 19 nt, Homo sapiens
gacagcagacuacaaagca

SEQ ID NO: 645095 - RNA, 19 nt, Homo sapiens
uguccauccuccugcauuu

SEQ ID NO: 645096 - RNA, 19 nt, Homo sapiens
guauaguccaugauaucua

SEQ ID NO: 645097 - RNA, 19 nt, Homo sapiens
uaggagugauaaacccaaa

SEQ ID NO: 645098 - RNA, 19 nt, Homo sapiens
aauauuacagcaccuagaa

SEQ ID NO: 645099 - RNA, 19 nt, Homo sapiens
ugggaacauugcugaagaa

SEQ ID NO: 645100 - RNA, 19 nt, Homo sapiens
cagcagacuacaaagcaaa

SEQ ID NO: 645101 - RNA, 19 nt, Homo sapiens
uuaaugaagacuacacaga

SEQ ID NO: 645102 - RNA, 19 nt, Homo sapiens
gacuacaaagcaaauaaga

SEQ ID NO: 645103 - RNA, 19 nt, Homo sapiens
cuugaggcauuaaauaucu

SEQ ID NO: 645104 - RNA, 19 nt, Homo sapiens
aagguucccucaaguccaa

SEQ ID NO: 645105 - RNA, 19 nt, Homo sapiens
agacagaugauuacuaugc

SEQ ID NO: 645106 - RNA, 19 nt, Homo sapiens
uacagcaccuagaaaauaa

SEQ ID NO: 645107 - RNA, 19 nt, Homo sapiens
ugaaauauuacagcaccua

SEQ ID NO: 645108 - RNA, 19 nt, Homo sapiens
aaaccuuucuagggauuug

SEQ ID NO: 645109 - RNA, 19 nt, Homo sapiens
gaguuaggcuuuucuagca

SEQ ID NO: 645110 - RNA, 19 nt, Homo sapiens
cgaacaacagauuucuaaa

SEQ ID NO: 645111 - RNA, 19 nt, Homo sapiens
caaauggaacacagacagu

SEQ ID NO: 645112 - RNA, 19 nt, Homo sapiens
ucccucaaguccaagcuuu

SEQ ID NO: 645113 - RNA, 19 nt, Homo sapiens
gauuuguguggaucagaua

SEQ ID NO: 645114 - RNA, 19 nt, Homo sapiens
uagagagguuaacaagaca

SEQ ID NO: 645115 - RNA, 19 nt, Homo sapiens
gcagagaguuaggcuuuuc

SEQ ID NO: 645116 - RNA, 19 nt, Homo sapiens
uuacagcaccuagaaaaua

SEQ ID NO: 645117 - RNA, 19 nt, Homo sapiens
guucagaggacugcaaauc

SEQ ID NO: 645118 - RNA, 19 nt, Homo sapiens
uuggaauucuucugguuug

SEQ ID NO: 645119 - RNA, 19 nt, Homo sapiens
ggaaugacagcagacuaca

SEQ ID NO: 645120 - RNA, 19 nt, Homo sapiens
caggaggaagcacaauuug

SEQ ID NO: 645121 - RNA, 19 nt, Homo sapiens
gcagaaggcuuucaugaga

SEQ ID NO: 645122 - RNA, 19 nt, Homo sapiens
gaaaggugaugagcaaaua

SEQ ID NO: 645123 - RNA, 19 nt, Homo sapiens
uaaaggaacuucuagacuu

SEQ ID NO: 645124 - RNA, 19 nt, Homo sapiens
gcaaauaaaggaacuucua

SEQ ID NO: 645125 - RNA, 19 nt, Homo sapiens
agaguuagaugccuuauug

SEQ ID NO: 645126 - RNA, 19 nt, Homo sapiens
uuacugaccuucugcuuaa

SEQ ID NO: 645127 - RNA, 19 nt, Homo sapiens
gagaggaaaggguaaauuu

SEQ ID NO: 645128 - RNA, 19 nt, Homo sapiens
cuacucauaucuucucuaa

SEQ ID NO: 645129 - RNA, 19 nt, Homo sapiens
ggacaacuuugaguacuga

SEQ ID NO: 645130 - RNA, 19 nt, Homo sapiens
ugacuaggcugauaaucuu

SEQ ID NO: 645131 - RNA, 19 nt, Homo sapiens
ggaaucaugauaccacuuu

SEQ ID NO: 645132 - RNA, 19 nt, Homo sapiens
gcacuuggaguuagaucua

SEQ ID NO: 645133 - RNA, 19 nt, Homo sapiens
uuacaugacuaggcugaua

SEQ ID NO: 645134 - RNA, 19 nt, Homo sapiens
gcucauggcucaccugacu

SEQ ID NO: 645135 - RNA, 19 nt, Homo sapiens
ucaggacagugaugaauau

SEQ ID NO: 645136 - RNA, 19 nt, Homo sapiens
ggaagaguuagaugccuua

SEQ ID NO: 645137 - RNA, 19 nt, Homo sapiens
guaggacaauggaagaguu

SEQ ID NO: 645138 - RNA, 19 nt, Homo sapiens
ugucaaccuugcuucaaua

SEQ ID NO: 645139 - RNA, 19 nt, Homo sapiens
ggacagugaugaauauucc

SEQ ID NO: 645140 - RNA, 19 nt, Homo sapiens
uacaaucacugcuguggaa

SEQ ID NO: 645141 - RNA, 19 nt, Homo sapiens
ccacuguaaugccaacuga

SEQ ID NO: 645142 - RNA, 19 nt, Homo sapiens
aauaagcucuucccacugu

SEQ ID NO: 645143 - RNA, 19 nt, Homo sapiens
gcgcagcucguguauacua

SEQ ID NO: 645144 - RNA, 19 nt, Homo sapiens
cuucggagauccuuucuau

SEQ ID NO: 645145 - RNA, 19 nt, Homo sapiens
gaagccauauugccgaaag

SEQ ID NO: 645146 - RNA, 19 nt, Homo sapiens
ggaaaggugaugagcaaau

SEQ ID NO: 645147 - RNA, 19 nt, Homo sapiens
gaucagcauuccagaaagg

SEQ ID NO: 645148 - RNA, 19 nt, Homo sapiens
ucacugcuguggaaucaug

SEQ ID NO: 645149 - RNA, 19 nt, Homo sapiens
aaggaaaggugaugagcaa

SEQ ID NO: 645150 - RNA, 19 nt, Homo sapiens
cagaaggcuuucaugagaa

SEQ ID NO: 645151 - RNA, 19 nt, Homo sapiens
gcaucuuccuucaguguau

SEQ ID NO: 645152 - RNA, 19 nt, Homo sapiens
uuucuuagguuucuccauu

SEQ ID NO: 645153 - RNA, 19 nt, Homo sapiens
uccaggagcucaaugucua

SEQ ID NO: 645154 - RNA, 19 nt, Homo sapiens
aagaagcacuuaccagaca

SEQ ID NO: 645155 - RNA, 19 nt, Homo sapiens
ggccaagguugcagugaga

SEQ ID NO: 645156 - RNA, 19 nt, Homo sapiens
guuacugaccuucugcuua

SEQ ID NO: 645157 - RNA, 19 nt, Homo sapiens
cggcgcagcucguguauac

SEQ ID NO: 645158 - RNA, 19 nt, Homo sapiens
ggagaggaaaggguaaauu

SEQ ID NO: 645159 - RNA, 19 nt, Homo sapiens
agaaugacaagaccuauug

SEQ ID NO: 645160 - RNA, 19 nt, Homo sapiens
caacgacuaccaccaacuu

SEQ ID NO: 645161 - RNA, 19 nt, Homo sapiens
agugauggcccuacucaua

SEQ ID NO: 645162 - RNA, 19 nt, Homo sapiens
caaauaaaggaacuucuag

SEQ ID NO: 645163 - RNA, 19 nt, Homo sapiens
gcccaucacuggccguugu

SEQ ID NO: 645164 - RNA, 19 nt, Homo sapiens
ccagagugcuuuguuugug

SEQ ID NO: 645165 - RNA, 19 nt, Homo sapiens
cauggcauccugagcauuu

SEQ ID NO: 645166 - RNA, 19 nt, Homo sapiens
ggagcucaaugucuacagu

SEQ ID NO: 645167 - RNA, 19 nt, Homo sapiens
gagacuaaccuugaugaga

SEQ ID NO: 645168 - RNA, 19 nt, Homo sapiens
gauuuuaacuggacaacuu

SEQ ID NO: 645169 - RNA, 19 nt, Homo sapiens
uuaggcuucuauacaguua

SEQ ID NO: 645170 - RNA, 19 nt, Homo sapiens
ucggagauccuuucuauuc

SEQ ID NO: 645171 - RNA, 19 nt, Homo sapiens
ggacaauggaagaguuaga

SEQ ID NO: 645172 - RNA, 19 nt, Homo sapiens
gugaugagcaaauaaagga

SEQ ID NO: 645173 - RNA, 19 nt, Homo sapiens
uccauagccucuucagauu

SEQ ID NO: 645174 - RNA, 19 nt, Homo sapiens
ucuacuggcuccuucuuug

SEQ ID NO: 645175 - RNA, 19 nt, Homo sapiens
gugcagaaggcuuucauga

SEQ ID NO: 645176 - RNA, 19 nt, Homo sapiens
ggagauccuuucuauucag

SEQ ID NO: 645177 - RNA, 19 nt, Homo sapiens
gaacuucuagacuuuacau

SEQ ID NO: 645178 - RNA, 19 nt, Homo sapiens
caagugugguggcugcaau

SEQ ID NO: 645179 - RNA, 19 nt, Homo sapiens
gaaggugauccaugcucua

SEQ ID NO: 645180 - RNA, 19 nt, Homo sapiens
ucucgucccucuacagaug

SEQ ID NO: 645181 - RNA, 19 nt, Homo sapiens
gaucuagguccuucuaucu

SEQ ID NO: 645182 - RNA, 19 nt, Homo sapiens
cacccagagugcuuuguuu

SEQ ID NO: 645183 - RNA, 19 nt, Homo sapiens
cauauugccgaaaggauuu

SEQ ID NO: 645184 - RNA, 19 nt, Homo sapiens
agaaggacaagaagccaua

SEQ ID NO: 645185 - RNA, 19 nt, Homo sapiens
gcuccagucccuucuuuga

SEQ ID NO: 645186 - RNA, 19 nt, Homo sapiens
ucugugagcuccauuacca

SEQ ID NO: 645187 - RNA, 19 nt, Homo sapiens
ccauauugccgaaaggauu

SEQ ID NO: 645188 - RNA, 19 nt, Homo sapiens
ggaguggcuuggccuacug

SEQ ID NO: 645189 - RNA, 19 nt, Homo sapiens
cggagauccuuucuauuca

SEQ ID NO: 645190 - RNA, 19 nt, Homo sapiens
gugauggcccuacucauau

SEQ ID NO: 645191 - RNA, 19 nt, Homo sapiens
gauguaggacaauggaaga

SEQ ID NO: 645192 - RNA, 19 nt, Homo sapiens
cucuucagauuccuuauaa

SEQ ID NO: 645193 - RNA, 19 nt, Homo sapiens
ucagggagcagaaugacaa

SEQ ID NO: 645194 - RNA, 19 nt, Homo sapiens
gcacccagagcacuucuuc

SEQ ID NO: 645195 - RNA, 19 nt, Homo sapiens
ugucuguacucauugcaaa

SEQ ID NO: 645196 - RNA, 19 nt, Homo sapiens
gcucguguauacuaccaau

SEQ ID NO: 645197 - RNA, 19 nt, Homo sapiens
guggcucacugucuuacaa

SEQ ID NO: 645198 - RNA, 19 nt, Homo sapiens
gcacaugccaaagcuguuc

SEQ ID NO: 645199 - RNA, 19 nt, Homo sapiens
ggacaagaagccauauugc

SEQ ID NO: 645200 - RNA, 19 nt, Homo sapiens
gaaucaccaccaccuucua

SEQ ID NO: 645201 - RNA, 19 nt, Homo sapiens
ggcuugugguuucaauaaa

SEQ ID NO: 645202 - RNA, 19 nt, Homo sapiens
uuugaguacugacaucauu

SEQ ID NO: 645203 - RNA, 19 nt, Homo sapiens
cauaucuucucuaauuugg

SEQ ID NO: 645204 - RNA, 19 nt, Homo sapiens
cagcugcucaguuggauga

SEQ ID NO: 645205 - RNA, 19 nt, Homo sapiens
aaucacugcuguggaauca

SEQ ID NO: 645206 - RNA, 19 nt, Homo sapiens
gagcaaauaaaggaacuuc

SEQ ID NO: 645207 - RNA, 19 nt, Homo sapiens
ggaucagcauuccagaaag

SEQ ID NO: 645208 - RNA, 19 nt, Homo sapiens
uaggacaauggaagaguua

SEQ ID NO: 645209 - RNA, 19 nt, Homo sapiens
ccucuucagauuccuuaua

SEQ ID NO: 645210 - RNA, 19 nt, Homo sapiens
cagaaugacaagaccuauu

SEQ ID NO: 645211 - RNA, 19 nt, Homo sapiens
cagacaagcaggaucacaa

SEQ ID NO: 645212 - RNA, 19 nt, Homo sapiens
ggaaucaccaccaccuucu

SEQ ID NO: 645213 - RNA, 19 nt, Homo sapiens
caagaccuauugucaaccu

SEQ ID NO: 645214 - RNA, 19 nt, Homo sapiens
gcaaucgcccaguguugga

SEQ ID NO: 645215 - RNA, 19 nt, Homo sapiens
uggcuccagucccuucuuu

SEQ ID NO: 645216 - RNA, 19 nt, Homo sapiens
guacucauugcaaagaaga

SEQ ID NO: 645217 - RNA, 19 nt, Homo sapiens
uggcuugugguuucaauaa

SEQ ID NO: 645218 - RNA, 19 nt, Homo sapiens
guuccauccugagcacuuu

SEQ ID NO: 645219 - RNA, 19 nt, Homo sapiens
aaucaccaccaccuucuaa

SEQ ID NO: 645220 - RNA, 19 nt, Homo sapiens
cauaauucaugccaacacu

SEQ ID NO: 645221 - RNA, 19 nt, Homo sapiens
guacuuugcuuccuaauuu

SEQ ID NO: 645222 - RNA, 19 nt, Homo sapiens
gauguucugucauucauua

SEQ ID NO: 645223 - RNA, 19 nt, Homo sapiens
gcuaaugacuggcaaugua

SEQ ID NO: 645224 - RNA, 19 nt, Homo sapiens
gaagaaagacuggaaacua

SEQ ID NO: 645225 - RNA, 19 nt, Homo sapiens
ggaugaagaucuuucuaaa

SEQ ID NO: 645226 - RNA, 19 nt, Homo sapiens
ggagagaagugggauauau

SEQ ID NO: 645227 - RNA, 19 nt, Homo sapiens
uaagaagcuuugugugaua

SEQ ID NO: 645228 - RNA, 19 nt, Homo sapiens
gaaaugauacuguagacaa

SEQ ID NO: 645229 - RNA, 19 nt, Homo sapiens
gaaagacacuugcagaaaa

SEQ ID NO: 645230 - RNA, 19 nt, Homo sapiens
gaaagucuaccuucuaaau

SEQ ID NO: 645231 - RNA, 19 nt, Homo sapiens
cuaagcaaaugcaagguua

SEQ ID NO: 645232 - RNA, 19 nt, Homo sapiens
caaaauagauguucuguca

SEQ ID NO: 645233 - RNA, 19 nt, Homo sapiens
cacaugagcuuuaguuugu

SEQ ID NO: 645234 - RNA, 19 nt, Homo sapiens
ggucagaagugcuaaaucu

SEQ ID NO: 645235 - RNA, 19 nt, Homo sapiens
ggaaagacacuugcagaaa

SEQ ID NO: 645236 - RNA, 19 nt, Homo sapiens
gcaaauugaaguaagcuuu

SEQ ID NO: 645237 - RNA, 19 nt, Homo sapiens
agaagaaucugauggugaa

SEQ ID NO: 645238 - RNA, 19 nt, Homo sapiens
uaaacacacugcauacaau

SEQ ID NO: 645239 - RNA, 19 nt, Homo sapiens
gaaauaggaaagacacuug

SEQ ID NO: 645240 - RNA, 19 nt, Homo sapiens
acagugagcuuucccaugu

SEQ ID NO: 645241 - RNA, 19 nt, Homo sapiens
guacagugcaugaagcaua

SEQ ID NO: 645242 - RNA, 19 nt, Homo sapiens
gguccugcaucuauauuaa

SEQ ID NO: 645243 - RNA, 19 nt, Homo sapiens
gaagaaagaacaggauaug

SEQ ID NO: 645244 - RNA, 19 nt, Homo sapiens
ccaaauacauccuguccau

SEQ ID NO: 645245 - RNA, 19 nt, Homo sapiens
gaacauuugccucaagaug

SEQ ID NO: 645246 - RNA, 19 nt, Homo sapiens
gaaauucccuaugcuaagg

SEQ ID NO: 645247 - RNA, 19 nt, Homo sapiens
gcugaucucucaaaauaua

SEQ ID NO: 645248 - RNA, 19 nt, Homo sapiens
gagaggaacagaaagagaa

SEQ ID NO: 645249 - RNA, 19 nt, Homo sapiens
aaauaaagccugugaguca

SEQ ID NO: 645250 - RNA, 19 nt, Homo sapiens
ggagacauugugaauuuaa

SEQ ID NO: 645251 - RNA, 19 nt, Homo sapiens
ggaugaggaugaagaucuu

SEQ ID NO: 645252 - RNA, 19 nt, Homo sapiens
cugauacgguugcuugaua

SEQ ID NO: 645253 - RNA, 19 nt, Homo sapiens
ggaaguugaagauaaagaa

SEQ ID NO: 645254 - RNA, 19 nt, Homo sapiens
gcaaaugcaagguuauaau

SEQ ID NO: 645255 - RNA, 19 nt, Homo sapiens
caagguaaguauaucaaag

SEQ ID NO: 645256 - RNA, 19 nt, Homo sapiens
gagagaagugggauauauu

SEQ ID NO: 645257 - RNA, 19 nt, Homo sapiens
aagaaagacuggaaacuag

SEQ ID NO: 645258 - RNA, 19 nt, Homo sapiens
auacagcuguguuuauuug

SEQ ID NO: 645259 - RNA, 19 nt, Homo sapiens
ggaugaagaugacgcugau

SEQ ID NO: 645260 - RNA, 19 nt, Homo sapiens
gaagaucagaguguaauau

SEQ ID NO: 645261 - RNA, 19 nt, Homo sapiens
guaagcagccaacuguaaa

SEQ ID NO: 645262 - RNA, 19 nt, Homo sapiens
gaaagacuggaaacuaguu

SEQ ID NO: 645263 - RNA, 19 nt, Homo sapiens
ggaaauguaaacuuugcua

SEQ ID NO: 645264 - RNA, 19 nt, Homo sapiens
gcuaauaguaguuuacaga

SEQ ID NO: 645265 - RNA, 19 nt, Homo sapiens
gugauauucuuccaaaugu

SEQ ID NO: 645266 - RNA, 19 nt, Homo sapiens
caacugaggccaagaugau

SEQ ID NO: 645267 - RNA, 19 nt, Homo sapiens
gauucuacauguuaccauu

SEQ ID NO: 645268 - RNA, 19 nt, Homo sapiens
uugaaagucuaccuucuaa

SEQ ID NO: 645269 - RNA, 19 nt, Homo sapiens
auggagacauugugaauuu

SEQ ID NO: 645270 - RNA, 19 nt, Homo sapiens
gccauaaugucccaaaaua

SEQ ID NO: 645271 - RNA, 19 nt, Homo sapiens
gccagaagaucagagugua

SEQ ID NO: 645272 - RNA, 19 nt, Homo sapiens
gcuuauugcugcaugaugu

SEQ ID NO: 645273 - RNA, 19 nt, Homo sapiens
gcuaagacaggauuaccua

SEQ ID NO: 645274 - RNA, 19 nt, Homo sapiens
gaucagaguguaauaugug

SEQ ID NO: 645275 - RNA, 19 nt, Homo sapiens
gaauugggccagaagauca

SEQ ID NO: 645276 - RNA, 19 nt, Homo sapiens
gcagccaacuguaaauguc

SEQ ID NO: 645277 - RNA, 19 nt, Homo sapiens
uaacagaugucagagugau

SEQ ID NO: 645278 - RNA, 19 nt, Homo sapiens
gaacuuugggcauggaaga

SEQ ID NO: 645279 - RNA, 19 nt, Homo sapiens
guuaugggauauugauuuc

SEQ ID NO: 645280 - RNA, 19 nt, Homo sapiens
caugagcuuuaguuuguuu

SEQ ID NO: 645281 - RNA, 19 nt, Homo sapiens
ugauacgguugcuugauaa

SEQ ID NO: 645282 - RNA, 19 nt, Homo sapiens
ggaaacuaguuggaaacaa

SEQ ID NO: 645283 - RNA, 19 nt, Homo sapiens
aagucuaccuucuaaauug

SEQ ID NO: 645284 - RNA, 19 nt, Homo sapiens
gcaagguaaguauaucaaa

SEQ ID NO: 645285 - RNA, 19 nt, Homo sapiens
cagcuguguuuauuuguga

SEQ ID NO: 645286 - RNA, 19 nt, Homo sapiens
caagaucucguuccaguuc

SEQ ID NO: 645287 - RNA, 19 nt, Homo sapiens
gcuagaagaaccagcugua

SEQ ID NO: 645288 - RNA, 19 nt, Homo sapiens
agaaucugauggugaauau

SEQ ID NO: 645289 - RNA, 19 nt, Homo sapiens
gaaagagaagaaucugaug

SEQ ID NO: 645290 - RNA, 19 nt, Homo sapiens
gaaaagagccgaggccuau

SEQ ID NO: 645291 - RNA, 19 nt, Homo sapiens
guaaauaaagccugugagu

SEQ ID NO: 645292 - RNA, 19 nt, Homo sapiens
uaauugugccucagacuuu

SEQ ID NO: 645293 - RNA, 19 nt, Homo sapiens
gaagcuuugugugauauuc

SEQ ID NO: 645294 - RNA, 19 nt, Homo sapiens
uuauguagguugcacaaga

SEQ ID NO: 645295 - RNA, 19 nt, Homo sapiens
uuaagaagcuuugugugau

SEQ ID NO: 645296 - RNA, 19 nt, Homo sapiens
aaauacauccuguccauug

SEQ ID NO: 645297 - RNA, 19 nt, Homo sapiens
acaaccauuugcuucauuu

SEQ ID NO: 645298 - RNA, 19 nt, Homo sapiens
agaaccagcuguaaucgau

SEQ ID NO: 645299 - RNA, 19 nt, Homo sapiens
uuaacaguauuuccaguga

SEQ ID NO: 645300 - RNA, 19 nt, Homo sapiens
gugaacauuugccucaaga

SEQ ID NO: 645301 - RNA, 19 nt, Homo sapiens
gugaagaagaagauaguaa

SEQ ID NO: 645302 - RNA, 19 nt, Homo sapiens
acgcugaucucucaaaaua

SEQ ID NO: 645303 - RNA, 19 nt, Homo sapiens
uggugaauaugaugaguuu

SEQ ID NO: 645304 - RNA, 19 nt, Homo sapiens
aagcuguacuaguucauuu

SEQ ID NO: 645305 - RNA, 19 nt, Homo sapiens
uauguagguugcacaagaa

SEQ ID NO: 645306 - RNA, 19 nt, Homo sapiens
ucacaugagcuuuaguuug

SEQ ID NO: 645307 - RNA, 19 nt, Homo sapiens
agagaagugggauauauuu

SEQ ID NO: 645308 - RNA, 19 nt, Homo sapiens
gcaugccuuucauugcuuu

SEQ ID NO: 645309 - RNA, 19 nt, Homo sapiens
acaaaugaaugcuuauugc

SEQ ID NO: 645310 - RNA, 19 nt, Homo sapiens
gccucaagauguuaacuau

SEQ ID NO: 645311 - RNA, 19 nt, Homo sapiens
ugugugauauucuuccaaa

SEQ ID NO: 645312 - RNA, 19 nt, Homo sapiens
gcacugaaauaggaaagac

SEQ ID NO: 645313 - RNA, 19 nt, Homo sapiens
uaaguuagaugaggaugag

SEQ ID NO: 645314 - RNA, 19 nt, Homo sapiens
aagaagaggaugaggauga

SEQ ID NO: 645315 - RNA, 19 nt, Homo sapiens
uaaagaaucagagggagaa

SEQ ID NO: 645316 - RNA, 19 nt, Homo sapiens
ggucacaugagcuuuaguu

SEQ ID NO: 645317 - RNA, 19 nt, Homo sapiens
cgaggccuauuuagugcua

SEQ ID NO: 645318 - RNA, 19 nt, Homo sapiens
ccaaauguaguuaccaaau

SEQ ID NO: 645319 - RNA, 19 nt, Homo sapiens
aaagagccgaggccuauuu

SEQ ID NO: 645320 - RNA, 19 nt, Homo sapiens
uacgguugcuugauaaaga

SEQ ID NO: 645321 - RNA, 19 nt, Homo sapiens
gcagcaaauuggcuuauua

SEQ ID NO: 645322 - RNA, 19 nt, Homo sapiens
ggacaggucagaauaauaa

SEQ ID NO: 645323 - RNA, 19 nt, Homo sapiens
gaaauaaacccuucaacug

SEQ ID NO: 645324 - RNA, 19 nt, Homo sapiens
ccaaagauauccauagugu

SEQ ID NO: 645325 - RNA, 19 nt, Homo sapiens
caccauagcucuacuuguu

SEQ ID NO: 645326 - RNA, 19 nt, Homo sapiens
guaaugcaccacauaguua

SEQ ID NO: 645327 - RNA, 19 nt, Homo sapiens
gcaaauuggcuuauuaaug

SEQ ID NO: 645328 - RNA, 19 nt, Homo sapiens
gcaaggacaggucagaaua

SEQ ID NO: 645329 - RNA, 19 nt, Homo sapiens
gagcggauguugucaugaa

SEQ ID NO: 645330 - RNA, 19 nt, Homo sapiens
gagauaacaucacuuacug

SEQ ID NO: 645331 - RNA, 19 nt, Homo sapiens
ccauagcucuacuuguuua

SEQ ID NO: 645332 - RNA, 19 nt, Homo sapiens
gcaacaaacugggaucuag

SEQ ID NO: 645333 - RNA, 19 nt, Homo sapiens
ccacacaguuccagagcua

SEQ ID NO: 645334 - RNA, 19 nt, Homo sapiens
guccagaccuaauaacauu

SEQ ID NO: 645335 - RNA, 19 nt, Homo sapiens
ggagccaucuugucuggaa

SEQ ID NO: 645336 - RNA, 19 nt, Homo sapiens
gagaacagugucaccuuua

SEQ ID NO: 645337 - RNA, 19 nt, Homo sapiens
uaacuucgacuucaagauu

SEQ ID NO: 645338 - RNA, 19 nt, Homo sapiens
caauggagcaucaaugaaa

SEQ ID NO: 645339 - RNA, 19 nt, Homo sapiens
caacugagauaacaucacu

SEQ ID NO: 645340 - RNA, 19 nt, Homo sapiens
aaauaaacccuucaacuga

SEQ ID NO: 645341 - RNA, 19 nt, Homo sapiens
cuggaaaccuggaaauaaa

SEQ ID NO: 645342 - RNA, 19 nt, Homo sapiens
ugagaacagugucaccuuu

SEQ ID NO: 645343 - RNA, 19 nt, Homo sapiens
gacaaaugcugaauaacuc

SEQ ID NO: 645344 - RNA, 19 nt, Homo sapiens
uacgacaaaugcugaauaa

SEQ ID NO: 645345 - RNA, 19 nt, Homo sapiens
aaacugggaucuagugcaa

SEQ ID NO: 645346 - RNA, 19 nt, Homo sapiens
ggaaauaaacccuucaacu

SEQ ID NO: 645347 - RNA, 19 nt, Homo sapiens
gagagcggauguugucaug

SEQ ID NO: 645348 - RNA, 19 nt, Homo sapiens
uuccaaagcuuuacauuuc

SEQ ID NO: 645349 - RNA, 19 nt, Homo sapiens
cacaacauuuccuaaacua

SEQ ID NO: 645350 - RNA, 19 nt, Homo sapiens
gaaacuagaaauguccuaa

SEQ ID NO: 645351 - RNA, 19 nt, Homo sapiens
ccaccuggcucuacugcuu

SEQ ID NO: 645352 - RNA, 19 nt, Homo sapiens
caaggacaggucagaauaa

SEQ ID NO: 645353 - RNA, 19 nt, Homo sapiens
ugaccaggcugcagcaaau

SEQ ID NO: 645354 - RNA, 19 nt, Homo sapiens
gauccuggcagucaccaua

SEQ ID NO: 645355 - RNA, 19 nt, Homo sapiens
cagcaaauuggcuuauuaa

SEQ ID NO: 645356 - RNA, 19 nt, Homo sapiens
aaagauauccauagugugu

SEQ ID NO: 645357 - RNA, 19 nt, Homo sapiens
aaauaacaauggagcauca

SEQ ID NO: 645358 - RNA, 19 nt, Homo sapiens
ggaagaauugaaucucuga

SEQ ID NO: 645359 - RNA, 19 nt, Homo sapiens
ccacaacauuuccuaaacu

SEQ ID NO: 645360 - RNA, 19 nt, Homo sapiens
cgacaaaugcugaauaacu

SEQ ID NO: 645361 - RNA, 19 nt, Homo sapiens
gagcucauguugccaaacu

SEQ ID NO: 645362 - RNA, 19 nt, Homo sapiens
ccaaagcuuuacauuucaa

SEQ ID NO: 645363 - RNA, 19 nt, Homo sapiens
ggauaagccaggaguguau

SEQ ID NO: 645364 - RNA, 19 nt, Homo sapiens
gcaguugaguaggcagaaa

SEQ ID NO: 645365 - RNA, 19 nt, Homo sapiens
guaaugauguauguaaugc

SEQ ID NO: 645366 - RNA, 19 nt, Homo sapiens
caggucagaauaauaagua

SEQ ID NO: 645367 - RNA, 19 nt, Homo sapiens
gacuuugaguggaagaauu

SEQ ID NO: 645368 - RNA, 19 nt, Homo sapiens
cagccuaccuugacuggau

SEQ ID NO: 645369 - RNA, 19 nt, Homo sapiens
uaccaaagauauccauagu

SEQ ID NO: 645370 - RNA, 19 nt, Homo sapiens
gcacuugugagacuugaga

SEQ ID NO: 645371 - RNA, 19 nt, Homo sapiens
caacauuuccuaaacuaag

SEQ ID NO: 645372 - RNA, 19 nt, Homo sapiens
gauguugucaugaaauuuc

SEQ ID NO: 645373 - RNA, 19 nt, Homo sapiens
cggauguugucaugaaauu

SEQ ID NO: 645374 - RNA, 19 nt, Homo sapiens
agaauaugcuggccacaca

SEQ ID NO: 645375 - RNA, 19 nt, Homo sapiens
gauaagccaggaguguaua

SEQ ID NO: 645376 - RNA, 19 nt, Homo sapiens
ugacauugcacuugugaga

SEQ ID NO: 645377 - RNA, 19 nt, Homo sapiens
aaacugaggcaagauggua

SEQ ID NO: 645378 - RNA, 19 nt, Homo sapiens
caauaaugcccaccacugu

SEQ ID NO: 645379 - RNA, 19 nt, Homo sapiens
acugagauaacaucacuua

SEQ ID NO: 645380 - RNA, 19 nt, Homo sapiens
uaacaauggagcaucaaug

SEQ ID NO: 645381 - RNA, 19 nt, Homo sapiens
guccuaauuuaacaucuug

SEQ ID NO: 645382 - RNA, 19 nt, Homo sapiens
caguuaaauucaccagcua

SEQ ID NO: 645383 - RNA, 19 nt, Homo sapiens
ucuggaaaccuggaaauaa

SEQ ID NO: 645384 - RNA, 19 nt, Homo sapiens
acacaggaauacaggacuu

SEQ ID NO: 645385 - RNA, 19 nt, Homo sapiens
uaaauucaccagcuacaca

SEQ ID NO: 645386 - RNA, 19 nt, Homo sapiens
uguaguauguuucauuguc

SEQ ID NO: 645387 - RNA, 19 nt, Homo sapiens
aguguggccugccggauaa

SEQ ID NO: 645388 - RNA, 19 nt, Homo sapiens
gcaccacauaguuauaaug

SEQ ID NO: 645389 - RNA, 19 nt, Homo sapiens
cagcugcuacccagaauau

SEQ ID NO: 645390 - RNA, 19 nt, Homo sapiens
uagcucuacuuguuuacuu

SEQ ID NO: 645391 - RNA, 19 nt, Homo sapiens
gcacguguaacuucgacuu

SEQ ID NO: 645392 - RNA, 19 nt, Homo sapiens
uuacgacaaaugcugaaua

SEQ ID NO: 645393 - RNA, 19 nt, Homo sapiens
guagugauccuggcaguca

SEQ ID NO: 645394 - RNA, 19 nt, Homo sapiens
guggaagaauugaaucucu

SEQ ID NO: 645395 - RNA, 19 nt, Homo sapiens
uaagaaaucaguucaucag

SEQ ID NO: 645396 - RNA, 19 nt, Homo sapiens
guauaggccagcacgugua

SEQ ID NO: 645397 - RNA, 19 nt, Homo sapiens
uacaggacuuugaguggaa

SEQ ID NO: 645398 - RNA, 19 nt, Homo sapiens
uggcucuacugcuuaugua

SEQ ID NO: 645399 - RNA, 19 nt, Homo sapiens
gcugcuacccagaauauuc

SEQ ID NO: 645400 - RNA, 19 nt, Homo sapiens
aacaauggagcaucaauga

SEQ ID NO: 645401 - RNA, 19 nt, Homo sapiens
gcucauguugccaaacuga

SEQ ID NO: 645402 - RNA, 19 nt, Homo sapiens
caacaaacugggaucuagu

SEQ ID NO: 645403 - RNA, 19 nt, Homo sapiens
uguaaugcaccacauaguu

SEQ ID NO: 645404 - RNA, 19 nt, Homo sapiens
gcagccugaucaauaacau

SEQ ID NO: 645405 - RNA, 19 nt, Homo sapiens
ucagucugcggcucaauaa

SEQ ID NO: 645406 - RNA, 19 nt, Homo sapiens
caccagcuacacaggaaua

SEQ ID NO: 645407 - RNA, 19 nt, Homo sapiens
ugucuuaaauuccaaagcu

SEQ ID NO: 645408 - RNA, 19 nt, Homo sapiens
caguguggccugccggaua

SEQ ID NO: 645409 - RNA, 19 nt, Homo sapiens
ugagauaacaucacuuacu

SEQ ID NO: 645410 - RNA, 19 nt, Homo sapiens
caagaugguagugguguga

SEQ ID NO: 645411 - RNA, 19 nt, Homo sapiens
ggccagcacguguaacuuc

SEQ ID NO: 645412 - RNA, 19 nt, Homo sapiens
aaggacaggucagaauaau

SEQ ID NO: 645413 - RNA, 19 nt, Homo sapiens
cuaagaaugagaguaagaa

SEQ ID NO: 645414 - RNA, 19 nt, Homo sapiens
gguauuuccacaacauuuc

SEQ ID NO: 645415 - RNA, 19 nt, Homo sapiens
gaagcuggccguggcaagu

SEQ ID NO: 645416 - RNA, 19 nt, Homo sapiens
cacuagaaauaacaaugga

SEQ ID NO: 645417 - RNA, 19 nt, Homo sapiens
aacuucgacuucaagauuu

SEQ ID NO: 645418 - RNA, 19 nt, Homo sapiens
ucugaauccauauguagua

SEQ ID NO: 645419 - RNA, 19 nt, Homo sapiens
auaaaucugcaacucauga

SEQ ID NO: 645420 - RNA, 19 nt, Homo sapiens
ggauugccacgucugguau

SEQ ID NO: 645421 - RNA, 19 nt, Homo sapiens
caaggccgcucauggauua

SEQ ID NO: 645422 - RNA, 19 nt, Homo sapiens
gcucuuggcugguguugug

SEQ ID NO: 645423 - RNA, 19 nt, Homo sapiens
ggaagcgguucaagagaug

SEQ ID NO: 645424 - RNA, 19 nt, Homo sapiens
ggucagaggucguggaaac

SEQ ID NO: 645425 - RNA, 19 nt, Homo sapiens
gggaagcgguucaagagau

SEQ ID NO: 645426 - RNA, 19 nt, Homo sapiens
ugucagagcugguguacuc

SEQ ID NO: 645427 - RNA, 19 nt, Homo sapiens
gcaggucgauucgccgauu

SEQ ID NO: 645428 - RNA, 19 nt, Homo sapiens
ggaccauccugcugcucua

SEQ ID NO: 645429 - RNA, 19 nt, Homo sapiens
ccacagcccuggcaaccau

SEQ ID NO: 645430 - RNA, 19 nt, Homo sapiens
ucacaaggccgcucaugga

SEQ ID NO: 645431 - RNA, 19 nt, Homo sapiens
gaaguuaagcaaccaagag

SEQ ID NO: 645432 - RNA, 19 nt, Homo sapiens
ggagaccaucgcagaguuu

SEQ ID NO: 645433 - RNA, 19 nt, Homo sapiens
gagccccucuucccuaaua

SEQ ID NO: 645434 - RNA, 19 nt, Homo sapiens
gcguggagguguucaugga

SEQ ID NO: 645435 - RNA, 19 nt, Homo sapiens
aaaucuacuucuacaguug

SEQ ID NO: 645436 - RNA, 19 nt, Homo sapiens
guucaccgguucuucaagu

SEQ ID NO: 645437 - RNA, 19 nt, Homo sapiens
gaaaaucuacuucuacagu

SEQ ID NO: 645438 - RNA, 19 nt, Homo sapiens
ggaaguuaagcaaccaaga

SEQ ID NO: 645439 - RNA, 19 nt, Homo sapiens
gccugagccuccugaguga

SEQ ID NO: 645440 - RNA, 19 nt, Homo sapiens
gcaaccaugagcaguccua

SEQ ID NO: 645441 - RNA, 19 nt, Homo sapiens
ccauccugcugcucuacua

SEQ ID NO: 645442 - RNA, 19 nt, Homo sapiens
guggaaacccuggcucuug

SEQ ID NO: 645443 - RNA, 19 nt, Homo sapiens
gugcgaacccuccagaaca

SEQ ID NO: 645444 - RNA, 19 nt, Homo sapiens
gguguacucugccucuaac

SEQ ID NO: 645445 - RNA, 19 nt, Homo sapiens
cugcugcgcucuccuuucu

SEQ ID NO: 645446 - RNA, 19 nt, Homo sapiens
gcguuggccuggucacaag

SEQ ID NO: 645447 - RNA, 19 nt, Homo sapiens
gcucaaugacgggauccua

SEQ ID NO: 645448 - RNA, 19 nt, Homo sapiens
gacggcagcagcagcauca

SEQ ID NO: 645449 - RNA, 19 nt, Homo sapiens
ugcuugugcugcucaauga

SEQ ID NO: 645450 - RNA, 19 nt, Homo sapiens
ggguuugggcccucaguug

SEQ ID NO: 645451 - RNA, 19 nt, Homo sapiens
aggagaccaucgcagaguu

SEQ ID NO: 645452 - RNA, 19 nt, Homo sapiens
acaaggccgcucauggauu

SEQ ID NO: 645453 - RNA, 19 nt, Homo sapiens
gugggaagcgguucaagag

SEQ ID NO: 645454 - RNA, 19 nt, Homo sapiens
ugacugcgcucuccuguga

SEQ ID NO: 645455 - RNA, 19 nt, Homo sapiens
gcucuuggcugguguugug

SEQ ID NO: 645456 - RNA, 19 nt, Homo sapiens
cauccucgguugagaguaa

SEQ ID NO: 645457 - RNA, 19 nt, Homo sapiens
ggaagcgguucaagagaug

SEQ ID NO: 645458 - RNA, 19 nt, Homo sapiens
ggucagaggucguggaaac

SEQ ID NO: 645459 - RNA, 19 nt, Homo sapiens
gggaagcgguucaagagau

SEQ ID NO: 645460 - RNA, 19 nt, Homo sapiens
ugucagagcugguguacuc

SEQ ID NO: 645461 - RNA, 19 nt, Homo sapiens
gcaggucgauucgccgauu

SEQ ID NO: 645462 - RNA, 19 nt, Homo sapiens
ggaccauccugcugcucua

SEQ ID NO: 645463 - RNA, 19 nt, Homo sapiens
ccacagcccuggcaaccau

SEQ ID NO: 645464 - RNA, 19 nt, Homo sapiens
gaaguuaagcaaccaagag

SEQ ID NO: 645465 - RNA, 19 nt, Homo sapiens
ugacagagccuggugaaca

SEQ ID NO: 645466 - RNA, 19 nt, Homo sapiens
ggagaccaucgcagaguuu

SEQ ID NO: 645467 - RNA, 19 nt, Homo sapiens
gcguggagguguucaugga

SEQ ID NO: 645468 - RNA, 19 nt, Homo sapiens
gacagagccuggugaacag

SEQ ID NO: 645469 - RNA, 19 nt, Homo sapiens
guucaccgguucuucaagu

SEQ ID NO: 645470 - RNA, 19 nt, Homo sapiens
ggaaguuaagcaaccaaga

SEQ ID NO: 645471 - RNA, 19 nt, Homo sapiens
gccugagccuccugaguga

SEQ ID NO: 645472 - RNA, 19 nt, Homo sapiens
gcaaccaugagcaguccua

SEQ ID NO: 645473 - RNA, 19 nt, Homo sapiens
ccauccugcugcucuacua

SEQ ID NO: 645474 - RNA, 19 nt, Homo sapiens
guggaaacccuggcucuug

SEQ ID NO: 645475 - RNA, 19 nt, Homo sapiens
gugcgaacccuccagaaca

SEQ ID NO: 645476 - RNA, 19 nt, Homo sapiens
gguguacucugccucuaac

SEQ ID NO: 645477 - RNA, 19 nt, Homo sapiens
cugcugcgcucuccuuucu

SEQ ID NO: 645478 - RNA, 19 nt, Homo sapiens
gcucaaugacgggauccua

SEQ ID NO: 645479 - RNA, 19 nt, Homo sapiens
gacggcagcagcagcauca

SEQ ID NO: 645480 - RNA, 19 nt, Homo sapiens
ugcuugugcugcucaauga

SEQ ID NO: 645481 - RNA, 19 nt, Homo sapiens
guugccagccucccuguga

SEQ ID NO: 645482 - RNA, 19 nt, Homo sapiens
acagaaagcggugacuuca

SEQ ID NO: 645483 - RNA, 19 nt, Homo sapiens
cacagaaagcggugacuuc

SEQ ID NO: 645484 - RNA, 19 nt, Homo sapiens
ccacagaaagcggugacuu

SEQ ID NO: 645485 - RNA, 19 nt, Homo sapiens
ggguuugggcccucaguug

SEQ ID NO: 645486 - RNA, 19 nt, Homo sapiens
aggagaccaucgcagaguu

SEQ ID NO: 645487 - RNA, 19 nt, Homo sapiens
gugggaagcgguucaagag

SEQ ID NO: 645488 - RNA, 19 nt, Homo sapiens
aggcuccucucccacagaa

SEQ ID NO: 645489 - RNA, 19 nt, Homo sapiens
guaacuggcuuguaugaua

SEQ ID NO: 645490 - RNA, 19 nt, Homo sapiens
ggacauacuuccuuuguga

SEQ ID NO: 645491 - RNA, 19 nt, Homo sapiens
gcaggagaauauuguauaa

SEQ ID NO: 645492 - RNA, 19 nt, Homo sapiens
agagagauguguaaagaua

SEQ ID NO: 645493 - RNA, 19 nt, Homo sapiens
caacacagauggcaguaug

SEQ ID NO: 645494 - RNA, 19 nt, Homo sapiens
gaaaugugcacaacuuuga

SEQ ID NO: 645495 - RNA, 19 nt, Homo sapiens
aaagagagauguguaaaga

SEQ ID NO: 645496 - RNA, 19 nt, Homo sapiens
ucugaaggcucuuaucuuu

SEQ ID NO: 645497 - RNA, 19 nt, Homo sapiens
ugacacaagugaucagauu

SEQ ID NO: 645498 - RNA, 19 nt, Homo sapiens
ggaauugcauuacaacaca

SEQ ID NO: 645499 - RNA, 19 nt, Homo sapiens
ggcccaaugugacaaauuu

SEQ ID NO: 645500 - RNA, 19 nt, Homo sapiens
gugaagauauggacuggaa

SEQ ID NO: 645501 - RNA, 19 nt, Homo sapiens
gaaugucuauggugacugu

SEQ ID NO: 645502 - RNA, 19 nt, Homo sapiens
uaacuggcuuguaugauau

SEQ ID NO: 645503 - RNA, 19 nt, Homo sapiens
cauaagugaugccaaaugu

SEQ ID NO: 645504 - RNA, 19 nt, Homo sapiens
gacaagagacuguauaugg

SEQ ID NO: 645505 - RNA, 19 nt, Homo sapiens
gaaagcagccauccagaca

SEQ ID NO: 645506 - RNA, 19 nt, Homo sapiens
gcugugaccuucaaugaca

SEQ ID NO: 645507 - RNA, 19 nt, Homo sapiens
caagugaucagauuauuuc

SEQ ID NO: 645508 - RNA, 19 nt, Homo sapiens
gaagauauggacuggaaga

SEQ ID NO: 645509 - RNA, 19 nt, Homo sapiens
gagaggccaugcagauuca

SEQ ID NO: 645510 - RNA, 19 nt, Homo sapiens
ccaaugcaauggacaauac

SEQ ID NO: 645511 - RNA, 19 nt, Homo sapiens
aagcuaaccuacaccauga

SEQ ID NO: 645512 - RNA, 19 nt, Homo sapiens
cuuagcaucugcaggauuu

SEQ ID NO: 645513 - RNA, 19 nt, Homo sapiens
uaagugaugccaaauguug

SEQ ID NO: 645514 - RNA, 19 nt, Homo sapiens
ggaaaugugcacaacuuug

SEQ ID NO: 645515 - RNA, 19 nt, Homo sapiens
cgacagguuuguuuaugug

SEQ ID NO: 645516 - RNA, 19 nt, Homo sapiens
gagcagugauggaauugca

SEQ ID NO: 645517 - RNA, 19 nt, Homo sapiens
ggauuugaccgacugauau

SEQ ID NO: 645518 - RNA, 19 nt, Homo sapiens
gaaacaggugagaggguua

SEQ ID NO: 645519 - RNA, 19 nt, Homo sapiens
gaagucuacugcugcaagu

SEQ ID NO: 645520 - RNA, 19 nt, Homo sapiens
aaggaaaugugcacaacuu

SEQ ID NO: 645521 - RNA, 19 nt, Homo sapiens
guggagcagugauggaauu

SEQ ID NO: 645522 - RNA, 19 nt, Homo sapiens
gcaauggacaauacaguuc

SEQ ID NO: 645523 - RNA, 19 nt, Homo sapiens
aagcagccauccagacauu

SEQ ID NO: 645524 - RNA, 19 nt, Homo sapiens
gugacuggccugaguuuaa

SEQ ID NO: 645525 - RNA, 19 nt, Homo sapiens
caugcuggcuccaucaaug

SEQ ID NO: 645526 - RNA, 19 nt, Homo sapiens
acagauggcaguaugcuuu

SEQ ID NO: 645527 - RNA, 19 nt, Homo sapiens
caacggauccaccuuagca

SEQ ID NO: 645528 - RNA, 19 nt, Homo sapiens
gcucuuaucuuuuguccaa

SEQ ID NO: 645529 - RNA, 19 nt, Homo sapiens
ggaauagacaaugauauca

SEQ ID NO: 645530 - RNA, 19 nt, Homo sapiens
gacacaagugaucagauua

SEQ ID NO: 645531 - RNA, 19 nt, Homo sapiens
gaccuucaaugacacaagu

SEQ ID NO: 645532 - RNA, 19 nt, Homo sapiens
gcugcucucuggacaugaa

SEQ ID NO: 645533 - RNA, 19 nt, Homo sapiens
uagaucagcagaagcguaa

SEQ ID NO: 645534 - RNA, 19 nt, Homo sapiens
ugaaggcucuuaucuuuug

SEQ ID NO: 645535 - RNA, 19 nt, Homo sapiens
gguggaauagacaaugaua

SEQ ID NO: 645536 - RNA, 19 nt, Homo sapiens
cacaagugaucagauuauu

SEQ ID NO: 645537 - RNA, 19 nt, Homo sapiens
ugauggaauugcauuacaa

SEQ ID NO: 645538 - RNA, 19 nt, Homo sapiens
ucaaugaaguggcuuucca

SEQ ID NO: 645539 - RNA, 19 nt, Homo sapiens
ggagaauauuguauaagcu

SEQ ID NO: 645540 - RNA, 19 nt, Homo sapiens
ggacacaguggagcaguga

SEQ ID NO: 645541 - RNA, 19 nt, Homo sapiens
ggccugaguuuaaguucug

SEQ ID NO: 645542 - RNA, 19 nt, Homo sapiens
agacauuucagaacacgua

SEQ ID NO: 645543 - RNA, 19 nt, Homo sapiens
gugauggaauugcauuaca

SEQ ID NO: 645544 - RNA, 19 nt, Homo sapiens
gcagugauggaauugcauu

SEQ ID NO: 645545 - RNA, 19 nt, Homo sapiens
aaaaccaccugccagauuu

SEQ ID NO: 645546 - RNA, 19 nt, Homo sapiens
caaagagagauguguaaag

SEQ ID NO: 645547 - RNA, 19 nt, Homo sapiens
ccaaagagagauguguaaa

SEQ ID NO: 645548 - RNA, 19 nt, Homo sapiens
auacuuccuuugugaauuc

SEQ ID NO: 645549 - RNA, 19 nt, Homo sapiens
gauuugaccgacugauauu

SEQ ID NO: 645550 - RNA, 19 nt, Homo sapiens
uaaugcaggcccaauguga

SEQ ID NO: 645551 - RNA, 19 nt, Homo sapiens
gaccucagacugcauaagu

SEQ ID NO: 645552 - RNA, 19 nt, Homo sapiens
gccgacagguuuguuuaug

SEQ ID NO: 645553 - RNA, 19 nt, Homo sapiens
cagccgacagguuuguuua

SEQ ID NO: 645554 - RNA, 19 nt, Homo sapiens
gauggcacaguuaagcuuu

SEQ ID NO: 645555 - RNA, 19 nt, Homo sapiens
cauacuuccuuugugaauu

SEQ ID NO: 645556 - RNA, 19 nt, Homo sapiens
ugauauuacuguggaaugu

SEQ ID NO: 645557 - RNA, 19 nt, Homo sapiens
ugacuggccugaguuuaag

SEQ ID NO: 645558 - RNA, 19 nt, Homo sapiens
gggacauacuuccuuugug

SEQ ID NO: 645559 - RNA, 19 nt, Homo sapiens
aagcuucccuguggccuuu

SEQ ID NO: 645560 - RNA, 19 nt, Homo sapiens
caagcaggagaauauugua

SEQ ID NO: 645561 - RNA, 19 nt, Homo sapiens
ccgacagguuuguuuaugu

SEQ ID NO: 645562 - RNA, 19 nt, Homo sapiens
gagagauguguaaagauau

SEQ ID NO: 645563 - RNA, 19 nt, Homo sapiens
gcaagcgggaccuccaaga

SEQ ID NO: 645564 - RNA, 19 nt, Homo sapiens
acacaagugaucagauuau

SEQ ID NO: 645565 - RNA, 19 nt, Homo sapiens
uagcugugaccuucaauga

SEQ ID NO: 645566 - RNA, 19 nt, Homo sapiens
cagugacgauggcacaguu

SEQ ID NO: 645567 - RNA, 19 nt, Homo sapiens
aggaggcgguggccauauu

SEQ ID NO: 645568 - RNA, 19 nt, Homo sapiens
gcacccucccuucagauga

SEQ ID NO: 645569 - RNA, 19 nt, Homo sapiens
cuagcacccucccuucaga

SEQ ID NO: 645570 - RNA, 19 nt, Homo sapiens
cuucugagauguucuuggu

SEQ ID NO: 645571 - RNA, 19 nt, Homo sapiens
agaacaagcuaaccuacac

SEQ ID NO: 645572 - RNA, 19 nt, Homo sapiens
gcguaagggcccagaguug

SEQ ID NO: 645573 - RNA, 19 nt, Homo sapiens
ccacaagcaggagaauauu

SEQ ID NO: 645574 - RNA, 19 nt, Homo sapiens
ucaaggaaaugugcacaac

SEQ ID NO: 645575 - RNA, 19 nt, Homo sapiens
uaccagguguuagcuguga

SEQ ID NO: 645576 - RNA, 19 nt, Homo sapiens
gcagccauccagacauuuc

SEQ ID NO: 645577 - RNA, 19 nt, Homo sapiens
uggaauagacaaugauauc

SEQ ID NO: 645578 - RNA, 19 nt, Homo sapiens
caguuaagcuuugggacau

SEQ ID NO: 645579 - RNA, 19 nt, Homo sapiens
gcaggcccaaugugacaaa

SEQ ID NO: 645580 - RNA, 19 nt, Homo sapiens
gugacaagagacuguauau

SEQ ID NO: 645581 - RNA, 19 nt, Homo sapiens
ugagaggccaugcagauuc

SEQ ID NO: 645582 - RNA, 19 nt, Homo sapiens
gccagaacaagcuaaccua

SEQ ID NO: 645583 - RNA, 19 nt, Homo sapiens
uaacuaugccacacugaag

SEQ ID NO: 645584 - RNA, 19 nt, Homo sapiens
ccucagacugcauaaguga

SEQ ID NO: 645585 - RNA, 19 nt, Homo sapiens
caagauguuccucccuuca

SEQ ID NO: 645586 - RNA, 19 nt, Homo sapiens
ccaugcagauucagugacu

SEQ ID NO: 645587 - RNA, 19 nt, Homo sapiens
ucucagcauccacagauaa

SEQ ID NO: 645588 - RNA, 19 nt, Homo sapiens
aggagaauauuguauaagc

SEQ ID NO: 645589 - RNA, 19 nt, Homo sapiens
gcaaagaccuucuaagaca

SEQ ID NO: 645590 - RNA, 19 nt, Homo sapiens
uaagauagguggauucgua

SEQ ID NO: 645591 - RNA, 19 nt, Homo sapiens
ggucaacucucuacugaua

SEQ ID NO: 645592 - RNA, 19 nt, Homo sapiens
gaaauaaaccgaauucuuc

SEQ ID NO: 645593 - RNA, 19 nt, Homo sapiens
gaaguucucccacaucuua

SEQ ID NO: 645594 - RNA, 19 nt, Homo sapiens
gaacuaacauuggaauuca

SEQ ID NO: 645595 - RNA, 19 nt, Homo sapiens
ucaguaagccucauuauuu

SEQ ID NO: 645596 - RNA, 19 nt, Homo sapiens
gcaagaauccugccuuuga

SEQ ID NO: 645597 - RNA, 19 nt, Homo sapiens
caacaagccuccagauuag

SEQ ID NO: 645598 - RNA, 19 nt, Homo sapiens
cuaaugcucuucuuaauga

SEQ ID NO: 645599 - RNA, 19 nt, Homo sapiens
gauuagaccuguaaguuug

SEQ ID NO: 645600 - RNA, 19 nt, Homo sapiens
ugaacgagcuacaucauuu

SEQ ID NO: 645601 - RNA, 19 nt, Homo sapiens
ggaaauauccuuacaaacu

SEQ ID NO: 645602 - RNA, 19 nt, Homo sapiens
ucacagaaguuaaugaaga

SEQ ID NO: 645603 - RNA, 19 nt, Homo sapiens
gcagaaauaugggaaaugu

SEQ ID NO: 645604 - RNA, 19 nt, Homo sapiens
gguaguagaucaugcagaa

SEQ ID NO: 645605 - RNA, 19 nt, Homo sapiens
ucaaggaguuggugaauga

SEQ ID NO: 645606 - RNA, 19 nt, Homo sapiens
gagcuuggcuugccugaug

SEQ ID NO: 645607 - RNA, 19 nt, Homo sapiens
ccacugcagucucuguuua

SEQ ID NO: 645608 - RNA, 19 nt, Homo sapiens
gcacaacuccggacacuug

SEQ ID NO: 645609 - RNA, 19 nt, Homo sapiens
gaaugcaucccuaauauau

SEQ ID NO: 645610 - RNA, 19 nt, Homo sapiens
acaacaagccuccagauua

SEQ ID NO: 645611 - RNA, 19 nt, Homo sapiens
ccagaaggcuugcaaaucu

SEQ ID NO: 645612 - RNA, 19 nt, Homo sapiens
gauccaacauguaaaugaa

SEQ ID NO: 645613 - RNA, 19 nt, Homo sapiens
cuagaaauauggucaaguu

SEQ ID NO: 645614 - RNA, 19 nt, Homo sapiens
guauaggacugccaaauca

SEQ ID NO: 645615 - RNA, 19 nt, Homo sapiens
ccagcaaacucuacagaaa

SEQ ID NO: 645616 - RNA, 19 nt, Homo sapiens
uauaacagguccuuccuuu

SEQ ID NO: 645617 - RNA, 19 nt, Homo sapiens
gagcaucugucuucaagug

SEQ ID NO: 645618 - RNA, 19 nt, Homo sapiens
ggacaaacaguaugaacaa

SEQ ID NO: 645619 - RNA, 19 nt, Homo sapiens
gaggacagaugcucuaaca

SEQ ID NO: 645620 - RNA, 19 nt, Homo sapiens
gaguggaacuguuauaagu

SEQ ID NO: 645621 - RNA, 19 nt, Homo sapiens
guagggaugucaaauuuca

SEQ ID NO: 645622 - RNA, 19 nt, Homo sapiens
guguagggaugucaaauuu

SEQ ID NO: 645623 - RNA, 19 nt, Homo sapiens
caagaauccugccuuugaa

SEQ ID NO: 645624 - RNA, 19 nt, Homo sapiens
aaagagauccaacauguaa

SEQ ID NO: 645625 - RNA, 19 nt, Homo sapiens
ugacaaauguugaagaaag

SEQ ID NO: 645626 - RNA, 19 nt, Homo sapiens
cagaaaugcucacugcaaa

SEQ ID NO: 645627 - RNA, 19 nt, Homo sapiens
guagucaguuguacaaaga

SEQ ID NO: 645628 - RNA, 19 nt, Homo sapiens
uaacagguccuuccuuuau

SEQ ID NO: 645629 - RNA, 19 nt, Homo sapiens
gcaacuagaacuaacauug

SEQ ID NO: 645630 - RNA, 19 nt, Homo sapiens
gagagaaauggcagaaaua

SEQ ID NO: 645631 - RNA, 19 nt, Homo sapiens
caaaagagauccaacaugu

SEQ ID NO: 645632 - RNA, 19 nt, Homo sapiens
gaagagugucuccuuguuu

SEQ ID NO: 645633 - RNA, 19 nt, Homo sapiens
cuacugauauuacaacuuc

SEQ ID NO: 645634 - RNA, 19 nt, Homo sapiens
gcauagguguuguugauca

SEQ ID NO: 645635 - RNA, 19 nt, Homo sapiens
caucgaaaguguuuggaaa

SEQ ID NO: 645636 - RNA, 19 nt, Homo sapiens
gacaaauguugaagaaaga

SEQ ID NO: 645637 - RNA, 19 nt, Homo sapiens
aaaggaauguuucugaaug

SEQ ID NO: 645638 - RNA, 19 nt, Homo sapiens
caacuaauaggugcaauuu

SEQ ID NO: 645639 - RNA, 19 nt, Homo sapiens
ugagagaaauggcagaaau

SEQ ID NO: 645640 - RNA, 19 nt, Homo sapiens
uagcauagguguuguugau

SEQ ID NO: 645641 - RNA, 19 nt, Homo sapiens
acacaaguuucgcaaauug

SEQ ID NO: 645642 - RNA, 19 nt, Homo sapiens
uugaagaccucgaagauga

SEQ ID NO: 645643 - RNA, 19 nt, Homo sapiens
ccaggagacuuucaucgaa

SEQ ID NO: 645644 - RNA, 19 nt, Homo sapiens
ggacagaugcucuaacagu

SEQ ID NO: 645645 - RNA, 19 nt, Homo sapiens
uaaagaacacugacucuau

SEQ ID NO: 645646 - RNA, 19 nt, Homo sapiens
ugaaugauaucaggaaguu

SEQ ID NO: 645647 - RNA, 19 nt, Homo sapiens
caguaagccucauuauuug

SEQ ID NO: 645648 - RNA, 19 nt, Homo sapiens
gggcucaaguccuuaaguu

SEQ ID NO: 645649 - RNA, 19 nt, Homo sapiens
uuaaauaguucccaaccuu

SEQ ID NO: 645650 - RNA, 19 nt, Homo sapiens
caggucaacucucuacuga

SEQ ID NO: 645651 - RNA, 19 nt, Homo sapiens
guuccaagguguugaaugu

SEQ ID NO: 645652 - RNA, 19 nt, Homo sapiens
gaagaugaaauuccacaau

SEQ ID NO: 645653 - RNA, 19 nt, Homo sapiens
gaucaaggcuguuuuccaa

SEQ ID NO: 645654 - RNA, 19 nt, Homo sapiens
gagcagaauucacacuagu

SEQ ID NO: 645655 - RNA, 19 nt, Homo sapiens
ggaaacaggagcaaaauaa

SEQ ID NO: 645656 - RNA, 19 nt, Homo sapiens
ucuccaggcuaacaaauuu

SEQ ID NO: 645657 - RNA, 19 nt, Homo sapiens
ggaguccacuagaaauaug

SEQ ID NO: 645658 - RNA, 19 nt, Homo sapiens
ucauauacgucuagaggaa

SEQ ID NO: 645659 - RNA, 19 nt, Homo sapiens
gauagguggauucguauuu

SEQ ID NO: 645660 - RNA, 19 nt, Homo sapiens
gaugauugcucacaaacag

SEQ ID NO: 645661 - RNA, 19 nt, Homo sapiens
caaagaccuucuaagacaa

SEQ ID NO: 645662 - RNA, 19 nt, Homo sapiens
ucaacucucuacugauauu

SEQ ID NO: 645663 - RNA, 19 nt, Homo sapiens
ucugauaggucaacaaaca

SEQ ID NO: 645664 - RNA, 19 nt, Homo sapiens
gaaagagacauugaacguu

SEQ ID NO: 645665 - RNA, 19 nt, Homo sapiens
aagcaaagaccuucuaaga

SEQ ID NO: 645666 - RNA, 19 nt, Homo sapiens
gcaaagucuuccauguuuc

SEQ ID NO: 645667 - RNA, 19 nt, Homo sapiens
cuaagaacauaguuucaug

SEQ ID NO: 645668 - RNA, 19 nt, Homo sapiens
aaagaacacugacucuauc

SEQ ID NO: 645669 - RNA, 19 nt, Homo sapiens
acaacgugcuguuaaagaa

SEQ ID NO: 645670 - RNA, 19 nt, Homo sapiens
ucccacaucuuacuauauu

SEQ ID NO: 645671 - RNA, 19 nt, Homo sapiens
ugaauaagauagguggauu

SEQ ID NO: 645672 - RNA, 19 nt, Homo sapiens
gcaagcaacuggucaaccu

SEQ ID NO: 645673 - RNA, 19 nt, Homo sapiens
ggccaaauauguguauaga

SEQ ID NO: 645674 - RNA, 19 nt, Homo sapiens
acacacaaguuucgcaaau

SEQ ID NO: 645675 - RNA, 19 nt, Homo sapiens
agcaaagucuuccauguuu

SEQ ID NO: 645676 - RNA, 19 nt, Homo sapiens
gcagaggcaacuagaacua

SEQ ID NO: 645677 - RNA, 19 nt, Homo sapiens
ggagauguaggcaaugauu

SEQ ID NO: 645678 - RNA, 19 nt, Homo sapiens
gcagaauucacacuaguug

SEQ ID NO: 645679 - RNA, 19 nt, Homo sapiens
acagguccuuccuuuauaa

SEQ ID NO: 645680 - RNA, 19 nt, Homo sapiens
uaacagugcagauauaaca

SEQ ID NO: 645681 - RNA, 19 nt, Homo sapiens
ccaagaguacagugaauuu

SEQ ID NO: 645682 - RNA, 19 nt, Homo sapiens
ugcagucucuguuuacuaa

SEQ ID NO: 645683 - RNA, 19 nt, Homo sapiens
cacagaaguuaaugaagaa

SEQ ID NO: 645684 - RNA, 19 nt, Homo sapiens
gaggaacugcuccguguuu

SEQ ID NO: 645685 - RNA, 19 nt, Homo sapiens
gaaugcaacaguuugaaga

SEQ ID NO: 645686 - RNA, 19 nt, Homo sapiens
gagagaggcaucugagaga

SEQ ID NO: 645687 - RNA, 19 nt, Homo sapiens
gacaaacaguaugaacaaa

SEQ ID NO: 645688 - RNA, 19 nt, Homo sapiens
gaacgagcuacaucauuug

SEQ ID NO: 645689 - RNA, 19 nt, Homo sapiens
gaacauacuuccacuacau

SEQ ID NO: 645690 - RNA, 19 nt, Homo sapiens
gcaaauguuucuucugcua

SEQ ID NO: 645691 - RNA, 19 nt, Homo sapiens
aaacaucucucaagccaaa

SEQ ID NO: 645692 - RNA, 19 nt, Homo sapiens
ccucauaccuguucuaguu

SEQ ID NO: 645693 - RNA, 19 nt, Homo sapiens
ugaauucgcuugcagauca

SEQ ID NO: 645694 - RNA, 19 nt, Homo sapiens
agacagcaauuaacaaaga

SEQ ID NO: 645695 - RNA, 19 nt, Homo sapiens
gcuaguguccugccucuua

SEQ ID NO: 645696 - RNA, 19 nt, Homo sapiens
gaaagucacauuuaugcaa

SEQ ID NO: 645697 - RNA, 19 nt, Homo sapiens
caucaauucuuucucauuc

SEQ ID NO: 645698 - RNA, 19 nt, Homo sapiens
ucaccucaguuuauuauug

SEQ ID NO: 645699 - RNA, 19 nt, Homo sapiens
uguauaagcuagaagaaga

SEQ ID NO: 645700 - RNA, 19 nt, Homo sapiens
gaacagacauaagggacau

SEQ ID NO: 645701 - RNA, 19 nt, Homo sapiens
gagguggcauuguguaaau

SEQ ID NO: 645702 - RNA, 19 nt, Homo sapiens
ggagaaaacaggaacaaua

SEQ ID NO: 645703 - RNA, 19 nt, Homo sapiens
auacaagccuuaccaacaa

SEQ ID NO: 645704 - RNA, 19 nt, Homo sapiens
gauacaagccuuaccaaca

SEQ ID NO: 645705 - RNA, 19 nt, Homo sapiens
ccacaguucuugaaaagua

SEQ ID NO: 645706 - RNA, 19 nt, Homo sapiens
gcaagaaaguuuuggaaau

SEQ ID NO: 645707 - RNA, 19 nt, Homo sapiens
ccuccugccucuuucaaua

SEQ ID NO: 645708 - RNA, 19 nt, Homo sapiens
uaguucaucuccacguuua

SEQ ID NO: 645709 - RNA, 19 nt, Homo sapiens
ggauaagaaagucacauuu

SEQ ID NO: 645710 - RNA, 19 nt, Homo sapiens
ucaguuacuuggcaucauu

SEQ ID NO: 645711 - RNA, 19 nt, Homo sapiens
gaguuaguguggcuggaua

SEQ ID NO: 645712 - RNA, 19 nt, Homo sapiens
ugagugccauuaagaauuc

SEQ ID NO: 645713 - RNA, 19 nt, Homo sapiens
gcagaucaguuuuguaaug

SEQ ID NO: 645714 - RNA, 19 nt, Homo sapiens
guguaaaucugagcuuuga

SEQ ID NO: 645715 - RNA, 19 nt, Homo sapiens
gauaccauguggcugagaa

SEQ ID NO: 645716 - RNA, 19 nt, Homo sapiens
acaaagaccagccagcuaa

SEQ ID NO: 645717 - RNA, 19 nt, Homo sapiens
uaguguggcuggauaagaa

SEQ ID NO: 645718 - RNA, 19 nt, Homo sapiens
gaaagguggaauugaaaug

SEQ ID NO: 645719 - RNA, 19 nt, Homo sapiens
aaagcgcacuugcugauau

SEQ ID NO: 645720 - RNA, 19 nt, Homo sapiens
cuggaaagguggaauugaa

SEQ ID NO: 645721 - RNA, 19 nt, Homo sapiens
ggagaagacaguaagaaca

SEQ ID NO: 645722 - RNA, 19 nt, Homo sapiens
cagcuaacccuacagaaga

SEQ ID NO: 645723 - RNA, 19 nt, Homo sapiens
acacuuugcuaucaggaaa

SEQ ID NO: 645724 - RNA, 19 nt, Homo sapiens
ucuacauccugaacuauuu

SEQ ID NO: 645725 - RNA, 19 nt, Homo sapiens
gaagauacaaagcgcacuu

SEQ ID NO: 645726 - RNA, 19 nt, Homo sapiens
ucagacagcaauuaacaaa

SEQ ID NO: 645727 - RNA, 19 nt, Homo sapiens
ccauuuaucugaagguucu

SEQ ID NO: 645728 - RNA, 19 nt, Homo sapiens
gacaguaagaacagacaua

SEQ ID NO: 645729 - RNA, 19 nt, Homo sapiens
gcaucagacuuagauacaa

SEQ ID NO: 645730 - RNA, 19 nt, Homo sapiens
gaaaacaggaacaauagaa

SEQ ID NO: 645731 - RNA, 19 nt, Homo sapiens
ggaaagguggaauugaaau

SEQ ID NO: 645732 - RNA, 19 nt, Homo sapiens
caucauuucaccucaguuu

SEQ ID NO: 645733 - RNA, 19 nt, Homo sapiens
cauuaagaauucugcauca

SEQ ID NO: 645734 - RNA, 19 nt, Homo sapiens
ccaaaggagaagacaguaa

SEQ ID NO: 645735 - RNA, 19 nt, Homo sapiens
agucacagcugaagacaag

SEQ ID NO: 645736 - RNA, 19 nt, Homo sapiens
gagaauuuccuggcuguug

SEQ ID NO: 645737 - RNA, 19 nt, Homo sapiens
caaaggagaagacaguaag

SEQ ID NO: 645738 - RNA, 19 nt, Homo sapiens
caagccuuaccaacaauua

SEQ ID NO: 645739 - RNA, 19 nt, Homo sapiens
caucagacuuagauacaag

SEQ ID NO: 645740 - RNA, 19 nt, Homo sapiens
ggaggauguuguuuaucga

SEQ ID NO: 645741 - RNA, 19 nt, Homo sapiens
gcuauucagaguuuaaguu

SEQ ID NO: 645742 - RNA, 19 nt, Homo sapiens
acaagaagugguacccaua

SEQ ID NO: 645743 - RNA, 19 nt, Homo sapiens
ucuggaggauguuguuuau

SEQ ID NO: 645744 - RNA, 19 nt, Homo sapiens
uuuauuggcuagucauaga

SEQ ID NO: 645745 - RNA, 19 nt, Homo sapiens
cauuucaccucaguuuauu

SEQ ID NO: 645746 - RNA, 19 nt, Homo sapiens
gagaagacaguaagaacag

SEQ ID NO: 645747 - RNA, 19 nt, Homo sapiens
caaagcgcacuugcugaua

SEQ ID NO: 645748 - RNA, 19 nt, Homo sapiens
gaagaguaugcccagcuuu

SEQ ID NO: 645749 - RNA, 19 nt, Homo sapiens
cuuauuaaccucucaacuu

SEQ ID NO: 645750 - RNA, 19 nt, Homo sapiens
agaagaguaugcccagcuu

SEQ ID NO: 645751 - RNA, 19 nt, Homo sapiens
agacauaagggacauuuua

SEQ ID NO: 645752 - RNA, 19 nt, Homo sapiens
gcacagucacagcugaaga

SEQ ID NO: 645753 - RNA, 19 nt, Homo sapiens
gaauaugcugagcuacauu

SEQ ID NO: 645754 - RNA, 19 nt, Homo sapiens
agaauuuccuggcuguugu

SEQ ID NO: 645755 - RNA, 19 nt, Homo sapiens
aaauguuucuucugcuaga

SEQ ID NO: 645756 - RNA, 19 nt, Homo sapiens
acaguaagaacagacauaa

SEQ ID NO: 645757 - RNA, 19 nt, Homo sapiens
ucauuucaccucaguuuau

SEQ ID NO: 645758 - RNA, 19 nt, Homo sapiens
caagaagugguacccauag

SEQ ID NO: 645759 - RNA, 19 nt, Homo sapiens
cagaauaugcugagcuaca

SEQ ID NO: 645760 - RNA, 19 nt, Homo sapiens
cuagucagaccagaacaua

SEQ ID NO: 645761 - RNA, 19 nt, Homo sapiens
ucuuagagguggcauugug

SEQ ID NO: 645762 - RNA, 19 nt, Homo sapiens
uagcaucaguggauaccau

SEQ ID NO: 645763 - RNA, 19 nt, Homo sapiens
agaauaugcugagcuacau

SEQ ID NO: 645764 - RNA, 19 nt, Homo sapiens
gaacagcaaaagacauuga

SEQ ID NO: 645765 - RNA, 19 nt, Homo sapiens
aagcgcacuugcugauauu

SEQ ID NO: 645766 - RNA, 19 nt, Homo sapiens
uggaggauguuguuuaucg

SEQ ID NO: 645767 - RNA, 19 nt, Homo sapiens
aaacaggaacaauagaaca

SEQ ID NO: 645768 - RNA, 19 nt, Homo sapiens
uagauuccuuacccaguga

SEQ ID NO: 645769 - RNA, 19 nt, Homo sapiens
gagaaaacaggaacaauag

SEQ ID NO: 645770 - RNA, 19 nt, Homo sapiens
uaauuugcuugucaucaca

SEQ ID NO: 645771 - RNA, 19 nt, Homo sapiens
uggcuguugugaaagaauu

SEQ ID NO: 645772 - RNA, 19 nt, Homo sapiens
uaaagcaucauaccaucau

SEQ ID NO: 645773 - RNA, 19 nt, Homo sapiens
cugaagacaagaaguggua

SEQ ID NO: 645774 - RNA, 19 nt, Homo sapiens
guucaucuccacguuuauu

SEQ ID NO: 645775 - RNA, 19 nt, Homo sapiens
uaccaacaauuacagaaac

SEQ ID NO: 645776 - RNA, 19 nt, Homo sapiens
ucacagcugaagacaagaa

SEQ ID NO: 645777 - RNA, 19 nt, Homo sapiens
guauaagcuagaagaagaa

SEQ ID NO: 645778 - RNA, 19 nt, Homo sapiens
cuguugcuauucagaguuu

SEQ ID NO: 645779 - RNA, 19 nt, Homo sapiens
ccacuacaucaguuacuug

SEQ ID NO: 645780 - RNA, 19 nt, Homo sapiens
cagaacauacuuccacuac

SEQ ID NO: 645781 - RNA, 19 nt, Homo sapiens
ucaauucuuucucauucuc

SEQ ID NO: 645782 - RNA, 19 nt, Homo sapiens
ggaaauuguguugcuuuua

SEQ ID NO: 645783 - RNA, 19 nt, Homo sapiens
cauuaaacacuaugacaca

SEQ ID NO: 645784 - RNA, 19 nt, Homo sapiens
acucauagcaucaguggau

SEQ ID NO: 645785 - RNA, 19 nt, Homo sapiens
cagcugaagacaagaagug

SEQ ID NO: 645786 - RNA, 19 nt, Homo sapiens
aguuuaaguuucaggagaa

SEQ ID NO: 645787 - RNA, 19 nt, Homo sapiens
ccagcuaacccuacagaag

SEQ ID NO: 645788 - RNA, 19 nt, Homo sapiens
aauaugcugagcuacauuu

SEQ ID NO: 645789 - RNA, 19 nt, Homo sapiens
uaacauaccugccgaagaa

SEQ ID NO: 645790 - RNA, 19 nt, Homo sapiens
cuacggagcucgaaucaaa

SEQ ID NO: 645791 - RNA, 19 nt, Homo sapiens
gcagggaucuucauuccaa

SEQ ID NO: 645792 - RNA, 19 nt, Homo sapiens
gcacugaguuggagguuau

SEQ ID NO: 645793 - RNA, 19 nt, Homo sapiens
gaacugagaauaaacaugu

SEQ ID NO: 645794 - RNA, 19 nt, Homo sapiens
gaucugggcugcauacaag

SEQ ID NO: 645795 - RNA, 19 nt, Homo sapiens
agacauccaugaacuugua

SEQ ID NO: 645796 - RNA, 19 nt, Homo sapiens
ucaaaucacacucucuuua

SEQ ID NO: 645797 - RNA, 19 nt, Homo sapiens
gcauacaagugacucaaga

SEQ ID NO: 645798 - RNA, 19 nt, Homo sapiens
gcuguucaccuucuacuua

SEQ ID NO: 645799 - RNA, 19 nt, Homo sapiens
gaaacugggcuaaugauuc

SEQ ID NO: 645800 - RNA, 19 nt, Homo sapiens
gaaaaugccuugaaacucu

SEQ ID NO: 645801 - RNA, 19 nt, Homo sapiens
caaagaaaaugccuugaaa

SEQ ID NO: 645802 - RNA, 19 nt, Homo sapiens
gcagaaacugggcuaauga

SEQ ID NO: 645803 - RNA, 19 nt, Homo sapiens
gacuugagguuauugagaa

SEQ ID NO: 645804 - RNA, 19 nt, Homo sapiens
aaacugggcuaaugauucu

SEQ ID NO: 645805 - RNA, 19 nt, Homo sapiens
aaacacgguucugaucuuu

SEQ ID NO: 645806 - RNA, 19 nt, Homo sapiens
ggcagaaacugggcuaaug

SEQ ID NO: 645807 - RNA, 19 nt, Homo sapiens
ucaaagguguggaaguguu

SEQ ID NO: 645808 - RNA, 19 nt, Homo sapiens
aggcagaacugagaauaaa

SEQ ID NO: 645809 - RNA, 19 nt, Homo sapiens
ccgagagacuguccuguga

SEQ ID NO: 645810 - RNA, 19 nt, Homo sapiens
ggaggaagccaucacaagu

SEQ ID NO: 645811 - RNA, 19 nt, Homo sapiens
gagcaguccucuuguacca

SEQ ID NO: 645812 - RNA, 19 nt, Homo sapiens
gcuaaguucuuucccucuu

SEQ ID NO: 645813 - RNA, 19 nt, Homo sapiens
ggucuuugauagauuacaa

SEQ ID NO: 645814 - RNA, 19 nt, Homo sapiens
ccaaaugucagaaggauca

SEQ ID NO: 645815 - RNA, 19 nt, Homo sapiens
gagcagggaucuucauucc

SEQ ID NO: 645816 - RNA, 19 nt, Homo sapiens
aaucaaagguguggaagug

SEQ ID NO: 645817 - RNA, 19 nt, Homo sapiens
gaugguugguccugauguu

SEQ ID NO: 645818 - RNA, 19 nt, Homo sapiens
caagugcacagacaaagaa

SEQ ID NO: 645819 - RNA, 19 nt, Homo sapiens
ccucgugucucucuuuguu

SEQ ID NO: 645820 - RNA, 19 nt, Homo sapiens
gagcugcgguccaccucaa

SEQ ID NO: 645821 - RNA, 19 nt, Homo sapiens
aggagaggcuugagaucua

SEQ ID NO: 645822 - RNA, 19 nt, Homo sapiens
ggacuugagguuauugaga

SEQ ID NO: 645823 - RNA, 19 nt, Homo sapiens
gcagaacugagaauaaaca

SEQ ID NO: 645824 - RNA, 19 nt, Homo sapiens
ggagaggauuauuguugau

SEQ ID NO: 645825 - RNA, 19 nt, Homo sapiens
caaaucacacucucuuuag

SEQ ID NO: 645826 - RNA, 19 nt, Homo sapiens
caggaaauaaggcgauuaa

SEQ ID NO: 645827 - RNA, 19 nt, Homo sapiens
gaaaaugcauccaccucaa

SEQ ID NO: 645828 - RNA, 19 nt, Homo sapiens
caaaacaggaaacuucuua

SEQ ID NO: 645829 - RNA, 19 nt, Homo sapiens
ggacauuccuaacauaccu

SEQ ID NO: 645830 - RNA, 19 nt, Homo sapiens
auaaggcgauuaacccuau

SEQ ID NO: 645831 - RNA, 19 nt, Homo sapiens
aaauaaggacuugagguua

SEQ ID NO: 645832 - RNA, 19 nt, Homo sapiens
gauccugcaucgaugaauc

SEQ ID NO: 645833 - RNA, 19 nt, Homo sapiens
ggagaggcuugagaucuag

SEQ ID NO: 645834 - RNA, 19 nt, Homo sapiens
gguugguccugauguuauu

SEQ ID NO: 645835 - RNA, 19 nt, Homo sapiens
aggagaggauuauuguuga

SEQ ID NO: 645836 - RNA, 19 nt, Homo sapiens
cacacucucuuuaggcaaa

SEQ ID NO: 645837 - RNA, 19 nt, Homo sapiens
gagagacuguccugugaac

SEQ ID NO: 645838 - RNA, 19 nt, Homo sapiens
gaggaagccaucacaagug

SEQ ID NO: 645839 - RNA, 19 nt, Homo sapiens
ugaaagcuuugauccucuu

SEQ ID NO: 645840 - RNA, 19 nt, Homo sapiens
gcggcgaccuucacaccuu

SEQ ID NO: 645841 - RNA, 19 nt, Homo sapiens
ggagauccugcaucgauga

SEQ ID NO: 645842 - RNA, 19 nt, Homo sapiens
aagauuugcuucuguugug

SEQ ID NO: 645843 - RNA, 19 nt, Homo sapiens
uaaggcagaacugagaaua

SEQ ID NO: 645844 - RNA, 19 nt, Homo sapiens
ggaaauaaggcgauuaacc

SEQ ID NO: 645845 - RNA, 19 nt, Homo sapiens
gcaggaaauaaggcgauua

SEQ ID NO: 645846 - RNA, 19 nt, Homo sapiens
uggaagggaauaugaguuu

SEQ ID NO: 645847 - RNA, 19 nt, Homo sapiens
ucaggucacccucaaauca

SEQ ID NO: 645848 - RNA, 19 nt, Homo sapiens
cgcggucuuugauagauua

SEQ ID NO: 645849 - RNA, 19 nt, Homo sapiens
ggaucuggcugcagugacu

SEQ ID NO: 645850 - RNA, 19 nt, Homo sapiens
aaggagaggauuauuguug

SEQ ID NO: 645851 - RNA, 19 nt, Homo sapiens
gcacauccagggcccacaa

SEQ ID NO: 645852 - RNA, 19 nt, Homo sapiens
ggcuugagaucuagagcuu

SEQ ID NO: 645853 - RNA, 19 nt, Homo sapiens
ugaguuggagguuaugaaa

SEQ ID NO: 645854 - RNA, 19 nt, Homo sapiens
gagaggauuauuguugauu

SEQ ID NO: 645855 - RNA, 19 nt, Homo sapiens
uuaaggagaggauuauugu

SEQ ID NO: 645856 - RNA, 19 nt, Homo sapiens
ccucuccucucugccauuu

SEQ ID NO: 645857 - RNA, 19 nt, Homo sapiens
gcaucccucagcacaauuu

SEQ ID NO: 645858 - RNA, 19 nt, Homo sapiens
cuaaguucuuucccucuug

SEQ ID NO: 645859 - RNA, 19 nt, Homo sapiens
ucccgugucugcugacuga

SEQ ID NO: 645860 - RNA, 19 nt, Homo sapiens
cuggagcaguccucuugua

SEQ ID NO: 645861 - RNA, 19 nt, Homo sapiens
ccaagugcacagacaaaga

SEQ ID NO: 645862 - RNA, 19 nt, Homo sapiens
ggauuauuguugauuccau

SEQ ID NO: 645863 - RNA, 19 nt, Homo sapiens
ucacugcucugcgauuugg

SEQ ID NO: 645864 - RNA, 19 nt, Homo sapiens
caucacaagugccaguuuu

SEQ ID NO: 645865 - RNA, 19 nt, Homo sapiens
aagcugcugugaucccauu

SEQ ID NO: 645866 - RNA, 19 nt, Homo sapiens
cuguucaccuucuacuuaa

SEQ ID NO: 645867 - RNA, 19 nt, Homo sapiens
guagugcuguucaccuucu

SEQ ID NO: 645868 - RNA, 19 nt, Homo sapiens
agaggauuauuguugauuc

SEQ ID NO: 645869 - RNA, 19 nt, Homo sapiens
uggagguuaugaaagcuuu

SEQ ID NO: 645870 - RNA, 19 nt, Homo sapiens
ugagggcauucaggaguaa

SEQ ID NO: 645871 - RNA, 19 nt, Homo sapiens
gaggagaggcuugagaucu

SEQ ID NO: 645872 - RNA, 19 nt, Homo sapiens
acauuuaaggagaggauua

SEQ ID NO: 645873 - RNA, 19 nt, Homo sapiens
auaguugccuuuggccuuu

SEQ ID NO: 645874 - RNA, 19 nt, Homo sapiens
gguuugggaugcacugagu

SEQ ID NO: 645875 - RNA, 19 nt, Homo sapiens
ccagacauccaugaacuug

SEQ ID NO: 645876 - RNA, 19 nt, Homo sapiens
ggagcagggaucuucauuc

SEQ ID NO: 645877 - RNA, 19 nt, Homo sapiens
aauccuacauggacaccaa

SEQ ID NO: 645878 - RNA, 19 nt, Homo sapiens
ggaucugggcugcauacaa

SEQ ID NO: 645879 - RNA, 19 nt, Homo sapiens
uugauuccauuuacucaug

SEQ ID NO: 645880 - RNA, 19 nt, Homo sapiens
aaacaggaaacuucuuaag

SEQ ID NO: 645881 - RNA, 19 nt, Homo sapiens
ggcaggaaauaaggcgauu

SEQ ID NO: 645882 - RNA, 19 nt, Homo sapiens
ccuguuggcucccgugucu

SEQ ID NO: 645883 - RNA, 19 nt, Homo sapiens
caagauuugcuucuguugu

SEQ ID NO: 645884 - RNA, 19 nt, Homo sapiens
ggaagggaauaugaguuuu

SEQ ID NO: 645885 - RNA, 19 nt, Homo sapiens
uggcaucccucagcacaau

SEQ ID NO: 645886 - RNA, 19 nt, Homo sapiens
uccgcuaccuccagauauu

SEQ ID NO: 645887 - RNA, 19 nt, Homo sapiens
ccucaaaucacacucucuu

SEQ ID NO: 645888 - RNA, 19 nt, Homo sapiens
uuucacugcucugcgauuu

SEQ ID NO: 645889 - RNA, 19 nt, Homo sapiens
gagcagagcugaacaaaug

SEQ ID NO: 645890 - RNA, 19 nt, Homo sapiens
gaacgggucuggcaacuaa

SEQ ID NO: 645891 - RNA, 19 nt, Homo sapiens
caauaguucucgaaaguua

SEQ ID NO: 645892 - RNA, 19 nt, Homo sapiens
gcaccaaguucccagcuua

SEQ ID NO: 645893 - RNA, 19 nt, Homo sapiens
gaacaaagaagaauccuau

SEQ ID NO: 645894 - RNA, 19 nt, Homo sapiens
ggagagacgucaucaguau

SEQ ID NO: 645895 - RNA, 19 nt, Homo sapiens
ggagaaacgucaauuguca

SEQ ID NO: 645896 - RNA, 19 nt, Homo sapiens
gaugagaagugucuuaaau

SEQ ID NO: 645897 - RNA, 19 nt, Homo sapiens
gaaggucgcugcuauugug

SEQ ID NO: 645898 - RNA, 19 nt, Homo sapiens
ggagugguccgguuaaaua

SEQ ID NO: 645899 - RNA, 19 nt, Homo sapiens
cgaaaucuguauucuguuu

SEQ ID NO: 645900 - RNA, 19 nt, Homo sapiens
gcaaugaugucgggauauu

SEQ ID NO: 645901 - RNA, 19 nt, Homo sapiens
ggagucagaucuucguaaa

SEQ ID NO: 645902 - RNA, 19 nt, Homo sapiens
ugaguuaccugacugguuu

SEQ ID NO: 645903 - RNA, 19 nt, Homo sapiens
gcgagaagcugguuucaag

SEQ ID NO: 645904 - RNA, 19 nt, Homo sapiens
uaacugagaacaugucuuu

SEQ ID NO: 645905 - RNA, 19 nt, Homo sapiens
gaagcauccugauaucuau

SEQ ID NO: 645906 - RNA, 19 nt, Homo sapiens
gaacugagggcucuguuug

SEQ ID NO: 645907 - RNA, 19 nt, Homo sapiens
gcagugaggagcaagauaa

SEQ ID NO: 645908 - RNA, 19 nt, Homo sapiens
ggacacagaauuauagaug

SEQ ID NO: 645909 - RNA, 19 nt, Homo sapiens
gcacauguauugacaacag

SEQ ID NO: 645910 - RNA, 19 nt, Homo sapiens
gaacacacaggauuucaga

SEQ ID NO: 645911 - RNA, 19 nt, Homo sapiens
ugacagugacucagaaaua

SEQ ID NO: 645912 - RNA, 19 nt, Homo sapiens
caacaucccgucauuaaau

SEQ ID NO: 645913 - RNA, 19 nt, Homo sapiens
caaggcauuugucuuugua

SEQ ID NO: 645914 - RNA, 19 nt, Homo sapiens
gcaagauaaugcucccaaa

SEQ ID NO: 645915 - RNA, 19 nt, Homo sapiens
cuguggaccuguugaauua

SEQ ID NO: 645916 - RNA, 19 nt, Homo sapiens
gaagccacuuugaauguga

SEQ ID NO: 645917 - RNA, 19 nt, Homo sapiens
gagccgauguguauagaga

SEQ ID NO: 645918 - RNA, 19 nt, Homo sapiens
gugagaagcugaaggaaag

SEQ ID NO: 645919 - RNA, 19 nt, Homo sapiens
gggcaucuaccaaagguua

SEQ ID NO: 645920 - RNA, 19 nt, Homo sapiens
gcuagcagcgaucaacuua

SEQ ID NO: 645921 - RNA, 19 nt, Homo sapiens
caaccuaaauucagccaau

SEQ ID NO: 645922 - RNA, 19 nt, Homo sapiens
gaagaugaagcaauauaug

SEQ ID NO: 645923 - RNA, 19 nt, Homo sapiens
gcagagcgaacgaagagua

SEQ ID NO: 645924 - RNA, 19 nt, Homo sapiens
gaugguucuucuccaguua

SEQ ID NO: 645925 - RNA, 19 nt, Homo sapiens
gagccgagccgauguguau

SEQ ID NO: 645926 - RNA, 19 nt, Homo sapiens
aaacgucaauugucauuuc

SEQ ID NO: 645927 - RNA, 19 nt, Homo sapiens
gaccgcauguccuacuuaa

SEQ ID NO: 645928 - RNA, 19 nt, Homo sapiens
ggaacgaguuggagaaagg

SEQ ID NO: 645929 - RNA, 19 nt, Homo sapiens
ucacgaaggagacauaauu

SEQ ID NO: 645930 - RNA, 19 nt, Homo sapiens
gaaguugguaucgaaauuu

SEQ ID NO: 645931 - RNA, 19 nt, Homo sapiens
caagaucaaugggacugua

SEQ ID NO: 645932 - RNA, 19 nt, Homo sapiens
uggaagggauggaugauga

SEQ ID NO: 645933 - RNA, 19 nt, Homo sapiens
caacaauaguucucgaaag

SEQ ID NO: 645934 - RNA, 19 nt, Homo sapiens
ggacagcuggugcaaauuc

SEQ ID NO: 645935 - RNA, 19 nt, Homo sapiens
gauauuuguugcuggcauu

SEQ ID NO: 645936 - RNA, 19 nt, Homo sapiens
gagaggagccggcugaaca

SEQ ID NO: 645937 - RNA, 19 nt, Homo sapiens
ggaucgaaauugcccagaa

SEQ ID NO: 645938 - RNA, 19 nt, Homo sapiens
cgaaagcuguggaccuguu

SEQ ID NO: 645939 - RNA, 19 nt, Homo sapiens
ggauaagcaugcacuacug

SEQ ID NO: 645940 - RNA, 19 nt, Homo sapiens
gcaggagggccuucaagaa

SEQ ID NO: 645941 - RNA, 19 nt, Homo sapiens
gacagugacucagaaauag

SEQ ID NO: 645942 - RNA, 19 nt, Homo sapiens
agacauaauucucaagauc

SEQ ID NO: 645943 - RNA, 19 nt, Homo sapiens
ggaugugcuucauucguuu

SEQ ID NO: 645944 - RNA, 19 nt, Homo sapiens
gcagucagauccuguuacu

SEQ ID NO: 645945 - RNA, 19 nt, Homo sapiens
ggaugguucuucuccaguu

SEQ ID NO: 645946 - RNA, 19 nt, Homo sapiens
gaucgaaauugcccagaag

SEQ ID NO: 645947 - RNA, 19 nt, Homo sapiens
agauaaugcucccaaauca

SEQ ID NO: 645948 - RNA, 19 nt, Homo sapiens
cagcuacaaucaaccuaaa

SEQ ID NO: 645949 - RNA, 19 nt, Homo sapiens
uuaccugacugguuucaaa

SEQ ID NO: 645950 - RNA, 19 nt, Homo sapiens
agaaaucccuaaaggugaa

SEQ ID NO: 645951 - RNA, 19 nt, Homo sapiens
gcaauauauggcccuaaua

SEQ ID NO: 645952 - RNA, 19 nt, Homo sapiens
agaaguugguaucgaaauu

SEQ ID NO: 645953 - RNA, 19 nt, Homo sapiens
gaagaagaaccugaggaaa

SEQ ID NO: 645954 - RNA, 19 nt, Homo sapiens
ucaaugggacuguaacuga

SEQ ID NO: 645955 - RNA, 19 nt, Homo sapiens
ccucaucagugacuuugaa

SEQ ID NO: 645956 - RNA, 19 nt, Homo sapiens
ucaagaaggagaccagauu

SEQ ID NO: 645957 - RNA, 19 nt, Homo sapiens
gcucgaaaauugauagaaa

SEQ ID NO: 645958 - RNA, 19 nt, Homo sapiens
cgucaauugucauuucuga

SEQ ID NO: 645959 - RNA, 19 nt, Homo sapiens
auuaauagcugccuucaag

SEQ ID NO: 645960 - RNA, 19 nt, Homo sapiens
ccagaagcauccugauauc

SEQ ID NO: 645961 - RNA, 19 nt, Homo sapiens
caagugagaagcugaagga

SEQ ID NO: 645962 - RNA, 19 nt, Homo sapiens
gauuaucauuccucaagug

SEQ ID NO: 645963 - RNA, 19 nt, Homo sapiens
gaggagagacgucaucagu

SEQ ID NO: 645964 - RNA, 19 nt, Homo sapiens
ggaccgaaaucuguauucu

SEQ ID NO: 645965 - RNA, 19 nt, Homo sapiens
gacacagaauuauagaugu

SEQ ID NO: 645966 - RNA, 19 nt, Homo sapiens
gggccaggguuacaagaga

SEQ ID NO: 645967 - RNA, 19 nt, Homo sapiens
uggagaagauggaucacaa

SEQ ID NO: 645968 - RNA, 19 nt, Homo sapiens
gcuacaaucaaccuaaauu

SEQ ID NO: 645969 - RNA, 19 nt, Homo sapiens
uauaagaagccacuuugaa

SEQ ID NO: 645970 - RNA, 19 nt, Homo sapiens
uggcaaugaugucgggaua

SEQ ID NO: 645971 - RNA, 19 nt, Homo sapiens
uaaaugacagugacucaga

SEQ ID NO: 645972 - RNA, 19 nt, Homo sapiens
gagcugauaugggaacagu

SEQ ID NO: 645973 - RNA, 19 nt, Homo sapiens
gcccagaagcauccugaua

SEQ ID NO: 645974 - RNA, 19 nt, Homo sapiens
acaaagaagaauccuauga

SEQ ID NO: 645975 - RNA, 19 nt, Homo sapiens
gaggagagcauaaggaaac

SEQ ID NO: 645976 - RNA, 19 nt, Homo sapiens
aacaauaguucucgaaagu

SEQ ID NO: 645977 - RNA, 19 nt, Homo sapiens
gcaaguuauugaacaggau

SEQ ID NO: 645978 - RNA, 19 nt, Homo sapiens
uaagaagccacuuugaaug

SEQ ID NO: 645979 - RNA, 19 nt, Homo sapiens
acaaaaggauuccaaaaga

SEQ ID NO: 645980 - RNA, 19 nt, Homo sapiens
uggacugucuauaucauaa

SEQ ID NO: 645981 - RNA, 19 nt, Homo sapiens
agucagauccuguuacuug

SEQ ID NO: 645982 - RNA, 19 nt, Homo sapiens
cuccaaauccuaugaauau

SEQ ID NO: 645983 - RNA, 19 nt, Homo sapiens
gcgccuacacugacaauga

SEQ ID NO: 645984 - RNA, 19 nt, Homo sapiens
gcuaaugaguuaccugacu

SEQ ID NO: 645985 - RNA, 19 nt, Homo sapiens
uccugaagaugaagcaaua

SEQ ID NO: 645986 - RNA, 19 nt, Homo sapiens
cgacacccacucccuuuaa

SEQ ID NO: 645987 - RNA, 19 nt, Homo sapiens
cagcagacccucaucaaca

SEQ ID NO: 645988 - RNA, 19 nt, Homo sapiens
ggcauuugucuuuguaaua

SEQ ID NO: 645989 - RNA, 19 nt, Homo sapiens
gcaagaagaagcugaaaua

SEQ ID NO: 645990 - RNA, 19 nt, Homo sapiens
gcacuacgcuggagaagau

SEQ ID NO: 645991 - RNA, 19 nt, Homo sapiens
ugaaauaccugcccuacaa

SEQ ID NO: 645992 - RNA, 19 nt, Homo sapiens
gagcugaucguaauguuua

SEQ ID NO: 645993 - RNA, 19 nt, Homo sapiens
agagaggccugcuuuguua

SEQ ID NO: 645994 - RNA, 19 nt, Homo sapiens
ggcaagaacucaaagauca

SEQ ID NO: 645995 - RNA, 19 nt, Homo sapiens
ggcaauggcuggauuccua

SEQ ID NO: 645996 - RNA, 19 nt, Homo sapiens
gaauacuucuuccugauug

SEQ ID NO: 645997 - RNA, 19 nt, Homo sapiens
gaagacggcugaggacaug

SEQ ID NO: 645998 - RNA, 19 nt, Homo sapiens
caccuuaacuuccagauug

SEQ ID NO: 645999 - RNA, 19 nt, Homo sapiens
gggaggagauucagaagca

SEQ ID NO: 646000 - RNA, 19 nt, Homo sapiens
acagguggcuggucauuga

SEQ ID NO: 646001 - RNA, 19 nt, Homo sapiens
cggcacaacuuacacaaga

SEQ ID NO: 646002 - RNA, 19 nt, Homo sapiens
gcuccaggaugcauucuga

SEQ ID NO: 646003 - RNA, 19 nt, Homo sapiens
gagagccacugguuugugu

SEQ ID NO: 646004 - RNA, 19 nt, Homo sapiens
gaaccugcccuuacugugu

SEQ ID NO: 646005 - RNA, 19 nt, Homo sapiens
ucacacagaugaaucacau

SEQ ID NO: 646006 - RNA, 19 nt, Homo sapiens
ucaccuacaucccuuucua

SEQ ID NO: 646007 - RNA, 19 nt, Homo sapiens
gaggcagaaugaacccaua

SEQ ID NO: 646008 - RNA, 19 nt, Homo sapiens
ugaccaugaucguccauaa

SEQ ID NO: 646009 - RNA, 19 nt, Homo sapiens
agaagaagcugaaauaccu

SEQ ID NO: 646010 - RNA, 19 nt, Homo sapiens
ggagcaaucugacccuucu

SEQ ID NO: 646011 - RNA, 19 nt, Homo sapiens
cuggauggcugcaacauga

SEQ ID NO: 646012 - RNA, 19 nt, Homo sapiens
aaagaucacugaggacuuc

SEQ ID NO: 646013 - RNA, 19 nt, Homo sapiens
ccaagcauggcauugaaua

SEQ ID NO: 646014 - RNA, 19 nt, Homo sapiens
guccugagguccaagauuc

SEQ ID NO: 646015 - RNA, 19 nt, Homo sapiens
ccaugggucuggccuguga

SEQ ID NO: 646016 - RNA, 19 nt, Homo sapiens
gaggagauucagaagcaua

SEQ ID NO: 646017 - RNA, 19 nt, Homo sapiens
auagggagcugaucguaau

SEQ ID NO: 646018 - RNA, 19 nt, Homo sapiens
cgaggccucucuuaagaug

SEQ ID NO: 646019 - RNA, 19 nt, Homo sapiens
ggacgccuaccuucacaaa

SEQ ID NO: 646020 - RNA, 19 nt, Homo sapiens
ugaaucacaucgucaugga

SEQ ID NO: 646021 - RNA, 19 nt, Homo sapiens
acaaucaccagcacgaaua

SEQ ID NO: 646022 - RNA, 19 nt, Homo sapiens
ccucgucucuugugacuca

SEQ ID NO: 646023 - RNA, 19 nt, Homo sapiens
ucauugaccgcaagguuua

SEQ ID NO: 646024 - RNA, 19 nt, Homo sapiens
gaucguaauguuuaucaug

SEQ ID NO: 646025 - RNA, 19 nt, Homo sapiens
gcaccaacaacucagaaug

SEQ ID NO: 646026 - RNA, 19 nt, Homo sapiens
uccaaaggcucuguuauca

SEQ ID NO: 646027 - RNA, 19 nt, Homo sapiens
acgccuaccuucacaaaug

SEQ ID NO: 646028 - RNA, 19 nt, Homo sapiens
gaaauaccugcccuacaau

SEQ ID NO: 646029 - RNA, 19 nt, Homo sapiens
ggagcugaucguaauguuu

SEQ ID NO: 646030 - RNA, 19 nt, Homo sapiens
gguccacccuuucauagag

SEQ ID NO: 646031 - RNA, 19 nt, Homo sapiens
ggaauucgugggcaaguuc

SEQ ID NO: 646032 - RNA, 19 nt, Homo sapiens
cccgaggccucucuuaaga

SEQ ID NO: 646033 - RNA, 19 nt, Homo sapiens
cgaauacuucuuccugauu

SEQ ID NO: 646034 - RNA, 19 nt, Homo sapiens
gauggcugcaacaugauua

SEQ ID NO: 646035 - RNA, 19 nt, Homo sapiens
gggagcugaucguaauguu

SEQ ID NO: 646036 - RNA, 19 nt, Homo sapiens
aaucugacccuucuccaaa

SEQ ID NO: 646037 - RNA, 19 nt, Homo sapiens
ccgcaagguuuacaacauc

SEQ ID NO: 646038 - RNA, 19 nt, Homo sapiens
uagagaggccugcuuuguu

SEQ ID NO: 646039 - RNA, 19 nt, Homo sapiens
ccgagaggcugguguaugc

SEQ ID NO: 646040 - RNA, 19 nt, Homo sapiens
caggagaagccgcuacuga

SEQ ID NO: 646041 - RNA, 19 nt, Homo sapiens
acaaggaucccgaugugaa

SEQ ID NO: 646042 - RNA, 19 nt, Homo sapiens
gaagggcaggcaccaacaa

SEQ ID NO: 646043 - RNA, 19 nt, Homo sapiens
ucauagagaggccugcuuu

SEQ ID NO: 646044 - RNA, 19 nt, Homo sapiens
ggugauggccagaggaaug

SEQ ID NO: 646045 - RNA, 19 nt, Homo sapiens
gcacaacuuacacaagauc

SEQ ID NO: 646046 - RNA, 19 nt, Homo sapiens
ggaagacggcugaggacau

SEQ ID NO: 646047 - RNA, 19 nt, Homo sapiens
cagaggcaguggccacguu

SEQ ID NO: 646048 - RNA, 19 nt, Homo sapiens
ccaugaucguccauaagaa

SEQ ID NO: 646049 - RNA, 19 nt, Homo sapiens
guccacaaauucgucauug

SEQ ID NO: 646050 - RNA, 19 nt, Homo sapiens
cauagggagcugaucguaa

SEQ ID NO: 646051 - RNA, 19 nt, Homo sapiens
uuuacaacaucaccaaaug

SEQ ID NO: 646052 - RNA, 19 nt, Homo sapiens
caucacggccuuuguccuu

SEQ ID NO: 646053 - RNA, 19 nt, Homo sapiens
cgccaagccuaacaucuuc

SEQ ID NO: 646054 - RNA, 19 nt, Homo sapiens
gcugggaggagauucagaa

SEQ ID NO: 646055 - RNA, 19 nt, Homo sapiens
cgccuaccuucacaaauga

SEQ ID NO: 646056 - RNA, 19 nt, Homo sapiens
uaacaucuuccacaaggau

SEQ ID NO: 646057 - RNA, 19 nt, Homo sapiens
auucgucauuggccacuua

SEQ ID NO: 646058 - RNA, 19 nt, Homo sapiens
caagaccaaccacguguuc

SEQ ID NO: 646059 - RNA, 19 nt, Homo sapiens
guacccgaggccucucuua

SEQ ID NO: 646060 - RNA, 19 nt, Homo sapiens
guggagcaguccuucuuca

SEQ ID NO: 646061 - RNA, 19 nt, Homo sapiens
gcuacuacauccgguucuu

SEQ ID NO: 646062 - RNA, 19 nt, Homo sapiens
ggugggaggaguaggagaa

SEQ ID NO: 646063 - RNA, 19 nt, Homo sapiens
uggagagcauugcaugguu

SEQ ID NO: 646064 - RNA, 19 nt, Homo sapiens
ugccauugguccacccuuu

SEQ ID NO: 646065 - RNA, 19 nt, Homo sapiens
gcauugaauaccaggagaa

SEQ ID NO: 646066 - RNA, 19 nt, Homo sapiens
uacauccgguucuucauca

SEQ ID NO: 646067 - RNA, 19 nt, Homo sapiens
ggauggcugcaacaugauu

SEQ ID NO: 646068 - RNA, 19 nt, Homo sapiens
cugaggacaugaaccuguu

SEQ ID NO: 646069 - RNA, 19 nt, Homo sapiens
cuaacccacuaaucaguuc

SEQ ID NO: 646070 - RNA, 19 nt, Homo sapiens
guugcagucuaacccacua

SEQ ID NO: 646071 - RNA, 19 nt, Homo sapiens
caggaugcauucugauagg

SEQ ID NO: 646072 - RNA, 19 nt, Homo sapiens
caaagaucacugaggacuu

SEQ ID NO: 646073 - RNA, 19 nt, Homo sapiens
cagucuaacccacuaauca

SEQ ID NO: 646074 - RNA, 19 nt, Homo sapiens
uuacuguguuuaaccuguu

SEQ ID NO: 646075 - RNA, 19 nt, Homo sapiens
gccaacugguggaaucauc

SEQ ID NO: 646076 - RNA, 19 nt, Homo sapiens
ggaagggcaggcaccaaca

SEQ ID NO: 646077 - RNA, 19 nt, Homo sapiens
aaccugcccuuacuguguu

SEQ ID NO: 646078 - RNA, 19 nt, Homo sapiens
uguccuaccuccacucucu

SEQ ID NO: 646079 - RNA, 19 nt, Homo sapiens
ccauguauuuccaguacca

SEQ ID NO: 646080 - RNA, 19 nt, Homo sapiens
cagcccacccuccagcuuu

SEQ ID NO: 646081 - RNA, 19 nt, Homo sapiens
ggaaugaugggcuuuuguu

SEQ ID NO: 646082 - RNA, 19 nt, Homo sapiens
ugagggcccugcuggacau

SEQ ID NO: 646083 - RNA, 19 nt, Homo sapiens
ucaguggacaccuuaacuu

SEQ ID NO: 646084 - RNA, 19 nt, Homo sapiens
aggaguaggagaagacaaa

SEQ ID NO: 646085 - RNA, 19 nt, Homo sapiens
ccaggaugcauucugauag

SEQ ID NO: 646086 - RNA, 19 nt, Homo sapiens
gcucugacccugggcuuuc

SEQ ID NO: 646087 - RNA, 19 nt, Homo sapiens
ccgcuuugguucuucagau

SEQ ID NO: 646088 - RNA, 19 nt, Homo sapiens
ggagcaguccuucuucaac

SEQ ID NO: 646089 - RNA, 19 nt, Homo sapiens
gcaggaagauguuggaaga

SEQ ID NO: 646090 - RNA, 19 nt, Homo sapiens
gaagcaagcuauccuggaa

SEQ ID NO: 646091 - RNA, 19 nt, Homo sapiens
gaagagaccaucaaguuug

SEQ ID NO: 646092 - RNA, 19 nt, Homo sapiens
gcgcauggguugugagauu

SEQ ID NO: 646093 - RNA, 19 nt, Homo sapiens
ccaaaucccuggagaagau

SEQ ID NO: 646094 - RNA, 19 nt, Homo sapiens
ggaagagaccaucaaguuu

SEQ ID NO: 646095 - RNA, 19 nt, Homo sapiens
ggaagaagcugaggcuaag

SEQ ID NO: 646096 - RNA, 19 nt, Homo sapiens
aaacauaaguaccgccaaa

SEQ ID NO: 646097 - RNA, 19 nt, Homo sapiens
gcaccauccucaccaagaa

SEQ ID NO: 646098 - RNA, 19 nt, Homo sapiens
caggagagcuggcugacaa

SEQ ID NO: 646099 - RNA, 19 nt, Homo sapiens
ggaccgagaucgagacaag

SEQ ID NO: 646100 - RNA, 19 nt, Homo sapiens
gcacaaagaacgagaacga

SEQ ID NO: 646101 - RNA, 19 nt, Homo sapiens
gguccucacucuugggaua

SEQ ID NO: 646102 - RNA, 19 nt, Homo sapiens
uaagaaggaugaagaggau

SEQ ID NO: 646103 - RNA, 19 nt, Homo sapiens
uaaaggaaguugagagucu

SEQ ID NO: 646104 - RNA, 19 nt, Homo sapiens
gcaagacuccgcaaacuuc

SEQ ID NO: 646105 - RNA, 19 nt, Homo sapiens
ggacaaggaccguaaacga

SEQ ID NO: 646106 - RNA, 19 nt, Homo sapiens
uacagacaguggaaucuua

SEQ ID NO: 646107 - RNA, 19 nt, Homo sapiens
gcagauaggaugauugaca

SEQ ID NO: 646108 - RNA, 19 nt, Homo sapiens
gcagucacguuucuaugga

SEQ ID NO: 646109 - RNA, 19 nt, Homo sapiens
gaagaugcuggccaacuuu

SEQ ID NO: 646110 - RNA, 19 nt, Homo sapiens
ggaugaacauggugauaag

SEQ ID NO: 646111 - RNA, 19 nt, Homo sapiens
ggaggucauugauaagugu

SEQ ID NO: 646112 - RNA, 19 nt, Homo sapiens
cguaaacgauccagcuuau

SEQ ID NO: 646113 - RNA, 19 nt, Homo sapiens
cggcaucguucaagggaua

SEQ ID NO: 646114 - RNA, 19 nt, Homo sapiens
gagaagauaaguuuguaug

SEQ ID NO: 646115 - RNA, 19 nt, Homo sapiens
aaacugcaguagcaucauu

SEQ ID NO: 646116 - RNA, 19 nt, Homo sapiens
gaucgucauuggucucaga

SEQ ID NO: 646117 - RNA, 19 nt, Homo sapiens
gauagaaagcggcaucguu

SEQ ID NO: 646118 - RNA, 19 nt, Homo sapiens
ucuuggaggucauugauaa

SEQ ID NO: 646119 - RNA, 19 nt, Homo sapiens
uuccaaaucugcagaaaga

SEQ ID NO: 646120 - RNA, 19 nt, Homo sapiens
gcuuaaggcccagccauua

SEQ ID NO: 646121 - RNA, 19 nt, Homo sapiens
gaagggcugcgacguguug

SEQ ID NO: 646122 - RNA, 19 nt, Homo sapiens
agaagaugcuggccaacuu

SEQ ID NO: 646123 - RNA, 19 nt, Homo sapiens
ggaacugcaugccauuaag

SEQ ID NO: 646124 - RNA, 19 nt, Homo sapiens
ggcagaggaugcuugaaga

SEQ ID NO: 646125 - RNA, 19 nt, Homo sapiens
gaaguugagagucuuuaga

SEQ ID NO: 646126 - RNA, 19 nt, Homo sapiens
cuccaaagcuggccugaug

SEQ ID NO: 646127 - RNA, 19 nt, Homo sapiens
gaacgggagaccaauggaa

SEQ ID NO: 646128 - RNA, 19 nt, Homo sapiens
gaucgaagagucagaccaa

SEQ ID NO: 646129 - RNA, 19 nt, Homo sapiens
agaggaugcuugaagaaga

SEQ ID NO: 646130 - RNA, 19 nt, Homo sapiens
gagaacgacggcacaaaga

SEQ ID NO: 646131 - RNA, 19 nt, Homo sapiens
guucugcccuucuuugcuu

SEQ ID NO: 646132 - RNA, 19 nt, Homo sapiens
gacccacccaucauuauuu

SEQ ID NO: 646133 - RNA, 19 nt, Homo sapiens
aaagaacgagaacgagaua

SEQ ID NO: 646134 - RNA, 19 nt, Homo sapiens
gccaucaccuuccucacaa

SEQ ID NO: 646135 - RNA, 19 nt, Homo sapiens
ugauugaugugcuggagaa

SEQ ID NO: 646136 - RNA, 19 nt, Homo sapiens
ucaaugaccggaaauuugu

SEQ ID NO: 646137 - RNA, 19 nt, Homo sapiens
acagagagcgggauagaga

SEQ ID NO: 646138 - RNA, 19 nt, Homo sapiens
caacuaugauauggccaaa

SEQ ID NO: 646139 - RNA, 19 nt, Homo sapiens
cagauaggaugauugacau

SEQ ID NO: 646140 - RNA, 19 nt, Homo sapiens
uuaccuggguggcaucaaa

SEQ ID NO: 646141 - RNA, 19 nt, Homo sapiens
ggagaccaauggaaaugag

SEQ ID NO: 646142 - RNA, 19 nt, Homo sapiens
ugaagaggaugaacauggu

SEQ ID NO: 646143 - RNA, 19 nt, Homo sapiens
agacaaggaugggcacaga

SEQ ID NO: 646144 - RNA, 19 nt, Homo sapiens
ggauugcacugggccauca

SEQ ID NO: 646145 - RNA, 19 nt, Homo sapiens
ccuaugugguucuggauga

SEQ ID NO: 646146 - RNA, 19 nt, Homo sapiens
gaucaccacacuucccaaa

SEQ ID NO: 646147 - RNA, 19 nt, Homo sapiens
acagaaucgugacaucauu

SEQ ID NO: 646148 - RNA, 19 nt, Homo sapiens
ggcagaagauccgggaaga

SEQ ID NO: 646149 - RNA, 19 nt, Homo sapiens
ggacucugcuguguucuac

SEQ ID NO: 646150 - RNA, 19 nt, Homo sapiens
aggaagagaccaucaaguu

SEQ ID NO: 646151 - RNA, 19 nt, Homo sapiens
gggaagagaaggauaagag

SEQ ID NO: 646152 - RNA, 19 nt, Homo sapiens
gaggaugcuugaagaagag

SEQ ID NO: 646153 - RNA, 19 nt, Homo sapiens
gcagaggaugcuugaagaa

SEQ ID NO: 646154 - RNA, 19 nt, Homo sapiens
cugagaagauaaguuugua

SEQ ID NO: 646155 - RNA, 19 nt, Homo sapiens
caaauuaccacagcuucuu

SEQ ID NO: 646156 - RNA, 19 nt, Homo sapiens
caaaucugcagaaagagaa

SEQ ID NO: 646157 - RNA, 19 nt, Homo sapiens
gacagggacuggcggaucu

SEQ ID NO: 646158 - RNA, 19 nt, Homo sapiens
gacaaggaccguaaacgau

SEQ ID NO: 646159 - RNA, 19 nt, Homo sapiens
gauuacauccaccgcauug

SEQ ID NO: 646160 - RNA, 19 nt, Homo sapiens
cgagagcagucacguuucu

SEQ ID NO: 646161 - RNA, 19 nt, Homo sapiens
cagaagauccgggaagaga

SEQ ID NO: 646162 - RNA, 19 nt, Homo sapiens
ccaaaucugcagaaagaga

SEQ ID NO: 646163 - RNA, 19 nt, Homo sapiens
caaagaacgagaacgagau

SEQ ID NO: 646164 - RNA, 19 nt, Homo sapiens
guugugagauugugauugc

SEQ ID NO: 646165 - RNA, 19 nt, Homo sapiens
gacagcagccuuccucauc

SEQ ID NO: 646166 - RNA, 19 nt, Homo sapiens
gaacgacggcacaaagaac

SEQ ID NO: 646167 - RNA, 19 nt, Homo sapiens
gaagauccgggaagagaag

SEQ ID NO: 646168 - RNA, 19 nt, Homo sapiens
ccaauggaaaugaggauga

SEQ ID NO: 646169 - RNA, 19 nt, Homo sapiens
uaaacgauccagcuuaucu

SEQ ID NO: 646170 - RNA, 19 nt, Homo sapiens
gagcaaauuaccacagcuu

SEQ ID NO: 646171 - RNA, 19 nt, Homo sapiens
ccaaguuccucucuaaagc

SEQ ID NO: 646172 - RNA, 19 nt, Homo sapiens
gaggaugaacauggugaua

SEQ ID NO: 646173 - RNA, 19 nt, Homo sapiens
uagcaucauugcccuagau

SEQ ID NO: 646174 - RNA, 19 nt, Homo sapiens
gagcgggaucggaauaaga

SEQ ID NO: 646175 - RNA, 19 nt, Homo sapiens
gaccugcugugguguacau

SEQ ID NO: 646176 - RNA, 19 nt, Homo sapiens
ugauugacaugggcuuuga

SEQ ID NO: 646177 - RNA, 19 nt, Homo sapiens
guuccucucuaaagcagaa

SEQ ID NO: 646178 - RNA, 19 nt, Homo sapiens
ggaugaagaggaugaacau

SEQ ID NO: 646179 - RNA, 19 nt, Homo sapiens
ugagugaaaucucuguuuu

SEQ ID NO: 646180 - RNA, 19 nt, Homo sapiens
agacuugacuguguaacug

SEQ ID NO: 646181 - RNA, 19 nt, Homo sapiens
gcccaguucugcccuucuu

SEQ ID NO: 646182 - RNA, 19 nt, Homo sapiens
guugggcgguucagacuca

SEQ ID NO: 646183 - RNA, 19 nt, Homo sapiens
gaacgagaacgagauaagg

SEQ ID NO: 646184 - RNA, 19 nt, Homo sapiens
gaccaucaaguuugggaaa

SEQ ID NO: 646185 - RNA, 19 nt, Homo sapiens
gcuacagaaucgugacauc

SEQ ID NO: 646186 - RNA, 19 nt, Homo sapiens
gaagaggcgaacccuggaa

SEQ ID NO: 646187 - RNA, 19 nt, Homo sapiens
gguaaaggaaguugagagu

SEQ ID NO: 646188 - RNA, 19 nt, Homo sapiens
aggcagggagagcaaauua

SEQ ID NO: 646189 - RNA, 19 nt, Homo sapiens
gaagaaagcugaaugaaaa

SEQ ID NO: 646190 - RNA, 19 nt, Homo sapiens
gaugucaacuuacagaaua

SEQ ID NO: 646191 - RNA, 19 nt, Homo sapiens
aggcauagaugucaacuua

SEQ ID NO: 646192 - RNA, 19 nt, Homo sapiens
ggaagaaagcugaaugaaa

SEQ ID NO: 646193 - RNA, 19 nt, Homo sapiens
guacuagucuuugugguaa

SEQ ID NO: 646194 - RNA, 19 nt, Homo sapiens
ccauauggccaaauaaaua

SEQ ID NO: 646195 - RNA, 19 nt, Homo sapiens
gcauccauauggccaaaua

SEQ ID NO: 646196 - RNA, 19 nt, Homo sapiens
ccaguuggauuuaugauau

SEQ ID NO: 646197 - RNA, 19 nt, Homo sapiens
ucaaagaccaguuggauuu

SEQ ID NO: 646198 - RNA, 19 nt, Homo sapiens
gaaagauggugcuaggaau

SEQ ID NO: 646199 - RNA, 19 nt, Homo sapiens
ccagauacauggaaagaug

SEQ ID NO: 646200 - RNA, 19 nt, Homo sapiens
cugaaugguucuuuaguua

SEQ ID NO: 646201 - RNA, 19 nt, Homo sapiens
gcauagaugucaacuuaca

SEQ ID NO: 646202 - RNA, 19 nt, Homo sapiens
gaauuuggcauccagagua

SEQ ID NO: 646203 - RNA, 19 nt, Homo sapiens
gagaaggagauaauagaua

SEQ ID NO: 646204 - RNA, 19 nt, Homo sapiens
ggaaagauggugcuaggaa

SEQ ID NO: 646205 - RNA, 19 nt, Homo sapiens
gcugaaugguucuuuaguu

SEQ ID NO: 646206 - RNA, 19 nt, Homo sapiens
ucagcagccucuuaacuaa

SEQ ID NO: 646207 - RNA, 19 nt, Homo sapiens
gcgguuucauggauauaua

SEQ ID NO: 646208 - RNA, 19 nt, Homo sapiens
agaacuaaguggcaaauuc

SEQ ID NO: 646209 - RNA, 19 nt, Homo sapiens
gcacaguguacuagucuuu

SEQ ID NO: 646210 - RNA, 19 nt, Homo sapiens
gccaguuucuuuaauaugu

SEQ ID NO: 646211 - RNA, 19 nt, Homo sapiens
gaaacuugguacuguuauc

SEQ ID NO: 646212 - RNA, 19 nt, Homo sapiens
aaagaaacuugguacuguu

SEQ ID NO: 646213 - RNA, 19 nt, Homo sapiens
ggagauaauagauacuuug

SEQ ID NO: 646214 - RNA, 19 nt, Homo sapiens
caaagaccaguuggauuua

SEQ ID NO: 646215 - RNA, 19 nt, Homo sapiens
ggaaggauggugugcgaaa

SEQ ID NO: 646216 - RNA, 19 nt, Homo sapiens
aagcaagauuugauccaua

SEQ ID NO: 646217 - RNA, 19 nt, Homo sapiens
agaaggagauaauagauac

SEQ ID NO: 646218 - RNA, 19 nt, Homo sapiens
auaaauccaugcuaugaga

SEQ ID NO: 646219 - RNA, 19 nt, Homo sapiens
gcuggugucauaguuauua

SEQ ID NO: 646220 - RNA, 19 nt, Homo sapiens
ccagggcugugccuacaaa

SEQ ID NO: 646221 - RNA, 19 nt, Homo sapiens
gauacuuugcucugaauuu

SEQ ID NO: 646222 - RNA, 19 nt, Homo sapiens
caagugagaaggagauaau

SEQ ID NO: 646223 - RNA, 19 nt, Homo sapiens
cauuugcucucauguucua

SEQ ID NO: 646224 - RNA, 19 nt, Homo sapiens
uggaauuucuggcuuucua

SEQ ID NO: 646225 - RNA, 19 nt, Homo sapiens
cacagaaagugguggaaga

SEQ ID NO: 646226 - RNA, 19 nt, Homo sapiens
aaagauggugcuaggaaua

SEQ ID NO: 646227 - RNA, 19 nt, Homo sapiens
gagcauccauauggccaaa

SEQ ID NO: 646228 - RNA, 19 nt, Homo sapiens
uaaccuagacccaauucaa

SEQ ID NO: 646229 - RNA, 19 nt, Homo sapiens
caacuuacagaauaacaug

SEQ ID NO: 646230 - RNA, 19 nt, Homo sapiens
agaaucagcagccucuuaa

SEQ ID NO: 646231 - RNA, 19 nt, Homo sapiens
uagaaucagcagccucuua

SEQ ID NO: 646232 - RNA, 19 nt, Homo sapiens
ugauggaauuucuggcuuu

SEQ ID NO: 646233 - RNA, 19 nt, Homo sapiens
uaauugcgguuucauggau

SEQ ID NO: 646234 - RNA, 19 nt, Homo sapiens
cuagauguauugauggaau

SEQ ID NO: 646235 - RNA, 19 nt, Homo sapiens
gaauuucuggcuuucuaaa

SEQ ID NO: 646236 - RNA, 19 nt, Homo sapiens
ggaauuucuggcuuucuaa

SEQ ID NO: 646237 - RNA, 19 nt, Homo sapiens
acaaggagcauccauaugg

SEQ ID NO: 646238 - RNA, 19 nt, Homo sapiens
ccacuuguagaauuuguaa

SEQ ID NO: 646239 - RNA, 19 nt, Homo sapiens
gugccaguuucuuuaauau

SEQ ID NO: 646240 - RNA, 19 nt, Homo sapiens
auacuuugcucugaauuug

SEQ ID NO: 646241 - RNA, 19 nt, Homo sapiens
uauagauacugcccaagug

SEQ ID NO: 646242 - RNA, 19 nt, Homo sapiens
agaaagugguggaagaaag

SEQ ID NO: 646243 - RNA, 19 nt, Homo sapiens
gagauugauguuacucauu

SEQ ID NO: 646244 - RNA, 19 nt, Homo sapiens
acacaaggagcauccauau

SEQ ID NO: 646245 - RNA, 19 nt, Homo sapiens
agugccaguuucuuuaaua

SEQ ID NO: 646246 - RNA, 19 nt, Homo sapiens
gugagaaggagauaauaga

SEQ ID NO: 646247 - RNA, 19 nt, Homo sapiens
gaacuaaguggcaaauucc

SEQ ID NO: 646248 - RNA, 19 nt, Homo sapiens
aaccagagauugauguuac

SEQ ID NO: 646249 - RNA, 19 nt, Homo sapiens
caagcaaacaucugucuag

SEQ ID NO: 646250 - RNA, 19 nt, Homo sapiens
aaagaccaguuggauuuau

SEQ ID NO: 646251 - RNA, 19 nt, Homo sapiens
ccaauucaaagaccaguug

SEQ ID NO: 646252 - RNA, 19 nt, Homo sapiens
aagaaacuugguacuguua

SEQ ID NO: 646253 - RNA, 19 nt, Homo sapiens
cuuccaaguuguaguguug

SEQ ID NO: 646254 - RNA, 19 nt, Homo sapiens
aagcaaacaucugucuaga

SEQ ID NO: 646255 - RNA, 19 nt, Homo sapiens
cagccaaagugccaguuuc

SEQ ID NO: 646256 - RNA, 19 nt, Homo sapiens
gcagccaaagugccaguuu

SEQ ID NO: 646257 - RNA, 19 nt, Homo sapiens
gcuaggaauaccacagaaa

SEQ ID NO: 646258 - RNA, 19 nt, Homo sapiens
auagauacuuugcucugaa

SEQ ID NO: 646259 - RNA, 19 nt, Homo sapiens
ccaccacuuuauuuauaga

SEQ ID NO: 646260 - RNA, 19 nt, Homo sapiens
ucaguucuguaugcacuuu

SEQ ID NO: 646261 - RNA, 19 nt, Homo sapiens
agcaagauuugauccauau

SEQ ID NO: 646262 - RNA, 19 nt, Homo sapiens
gauugauguuacucauuug

SEQ ID NO: 646263 - RNA, 19 nt, Homo sapiens
gauggaauuucuggcuuuc

SEQ ID NO: 646264 - RNA, 19 nt, Homo sapiens
cuuguugcauguaaugaaa

SEQ ID NO: 646265 - RNA, 19 nt, Homo sapiens
gaaagugguggaagaaagc

SEQ ID NO: 646266 - RNA, 19 nt, Homo sapiens
aauuuggcauccagaguaa

SEQ ID NO: 646267 - RNA, 19 nt, Homo sapiens
uagauacuuugcucugaau

SEQ ID NO: 646268 - RNA, 19 nt, Homo sapiens
aauagauacuuugcucuga

SEQ ID NO: 646269 - RNA, 19 nt, Homo sapiens
uuacucauuugcucucaug

SEQ ID NO: 646270 - RNA, 19 nt, Homo sapiens
aaaagaaacuugguacugu

SEQ ID NO: 646271 - RNA, 19 nt, Homo sapiens
agcagccucuuaacuaauu

SEQ ID NO: 646272 - RNA, 19 nt, Homo sapiens
ggugucauaguuauuagaa

SEQ ID NO: 646273 - RNA, 19 nt, Homo sapiens
uaacagcacaguguacuag

SEQ ID NO: 646274 - RNA, 19 nt, Homo sapiens
uuucuggcuuucuaaauga

SEQ ID NO: 646275 - RNA, 19 nt, Homo sapiens
gaacacaaggagcauccau

SEQ ID NO: 646276 - RNA, 19 nt, Homo sapiens
gaaaagaaacuugguacug

SEQ ID NO: 646277 - RNA, 19 nt, Homo sapiens
ggccaaauaaauacaugaa

SEQ ID NO: 646278 - RNA, 19 nt, Homo sapiens
guucuaacagcacagugua

SEQ ID NO: 646279 - RNA, 19 nt, Homo sapiens
aaaccagagauugauguua

SEQ ID NO: 646280 - RNA, 19 nt, Homo sapiens
guggaagaaagcugaauga

SEQ ID NO: 646281 - RNA, 19 nt, Homo sapiens
gaaggauggugugcgaaaa

SEQ ID NO: 646282 - RNA, 19 nt, Homo sapiens
aaagcaagauuugauccau

SEQ ID NO: 646283 - RNA, 19 nt, Homo sapiens
uuauuaaccuagacccaau

SEQ ID NO: 646284 - RNA, 19 nt, Homo sapiens
aguggcaaauuccaugaaa

SEQ ID NO: 646285 - RNA, 19 nt, Homo sapiens
ccaguuucuuuaauaugug

SEQ ID NO: 646286 - RNA, 19 nt, Homo sapiens
cucccuugcuggugucaua

SEQ ID NO: 646287 - RNA, 19 nt, Homo sapiens
ccccaccacuuuauuuaua

SEQ ID NO: 646288 - RNA, 19 nt, Homo sapiens
uguacuagucuuuguggua

SEQ ID NO: 646289 - RNA, 19 nt, Homo sapiens
ucacaaagcccauauaaua

SEQ ID NO: 646290 - RNA, 19 nt, Homo sapiens
ggaaaugucaagucuauua

SEQ ID NO: 646291 - RNA, 19 nt, Homo sapiens
caauuaagcuuucgaguau

SEQ ID NO: 646292 - RNA, 19 nt, Homo sapiens
gcacgaggaccuugaaaua

SEQ ID NO: 646293 - RNA, 19 nt, Homo sapiens
gagaucacauuuacaacua

SEQ ID NO: 646294 - RNA, 19 nt, Homo sapiens
ggacacagucuaacaaauu

SEQ ID NO: 646295 - RNA, 19 nt, Homo sapiens
ggaaauggacacagucuaa

SEQ ID NO: 646296 - RNA, 19 nt, Homo sapiens
gagaaagcauuuagcauca

SEQ ID NO: 646297 - RNA, 19 nt, Homo sapiens
gaaauaggagcacaucauu

SEQ ID NO: 646298 - RNA, 19 nt, Homo sapiens
ccauugagcuucuaggaaa

SEQ ID NO: 646299 - RNA, 19 nt, Homo sapiens
aauaggagcacaucauuua

SEQ ID NO: 646300 - RNA, 19 nt, Homo sapiens
cggcagaacuguauccauu

SEQ ID NO: 646301 - RNA, 19 nt, Homo sapiens
caaacacuauuccaacuau

SEQ ID NO: 646302 - RNA, 19 nt, Homo sapiens
auccuaagcucaucuauuu

SEQ ID NO: 646303 - RNA, 19 nt, Homo sapiens
gcugaaguguuaccuaaug

SEQ ID NO: 646304 - RNA, 19 nt, Homo sapiens
cagaggaguuuagauauga

SEQ ID NO: 646305 - RNA, 19 nt, Homo sapiens
aaagaaagggucuggauuu

SEQ ID NO: 646306 - RNA, 19 nt, Homo sapiens
gaaaagaccccuuaagguu

SEQ ID NO: 646307 - RNA, 19 nt, Homo sapiens
aagauguccuggagaaaua

SEQ ID NO: 646308 - RNA, 19 nt, Homo sapiens
uaggaaaugucaagucuau

SEQ ID NO: 646309 - RNA, 19 nt, Homo sapiens
gaugacaaguuugcauauu

SEQ ID NO: 646310 - RNA, 19 nt, Homo sapiens
ggacacggcagaacuguau

SEQ ID NO: 646311 - RNA, 19 nt, Homo sapiens
gcaaggauggucagaaguu

SEQ ID NO: 646312 - RNA, 19 nt, Homo sapiens
caacauacccauugagcuu

SEQ ID NO: 646313 - RNA, 19 nt, Homo sapiens
ggauuugacucucaguuca

SEQ ID NO: 646314 - RNA, 19 nt, Homo sapiens
ggcaagauguccuggagaa

SEQ ID NO: 646315 - RNA, 19 nt, Homo sapiens
ccagaggaguuuagauaug

SEQ ID NO: 646316 - RNA, 19 nt, Homo sapiens
gcaaacacuauuccaacua

SEQ ID NO: 646317 - RNA, 19 nt, Homo sapiens
aagcugaaguguuaccuaa

SEQ ID NO: 646318 - RNA, 19 nt, Homo sapiens
uauagaagaugguaagaag

SEQ ID NO: 646319 - RNA, 19 nt, Homo sapiens
ugacaugaaugaugagcuu

SEQ ID NO: 646320 - RNA, 19 nt, Homo sapiens
gaaagcauuuagcaucagu

SEQ ID NO: 646321 - RNA, 19 nt, Homo sapiens
ucacucaaauuguucucua

SEQ ID NO: 646322 - RNA, 19 nt, Homo sapiens
gguauucaguauccagauu

SEQ ID NO: 646323 - RNA, 19 nt, Homo sapiens
gauaagcccauaggacuaa

SEQ ID NO: 646324 - RNA, 19 nt, Homo sapiens
caaggauggucagaaguuu

SEQ ID NO: 646325 - RNA, 19 nt, Homo sapiens
gacacagucuaacaaauuc

SEQ ID NO: 646326 - RNA, 19 nt, Homo sapiens
aaauguaccuucacaccaa

SEQ ID NO: 646327 - RNA, 19 nt, Homo sapiens
acaauuaagcuuucgagua

SEQ ID NO: 646328 - RNA, 19 nt, Homo sapiens
ugacgaaauugaccguuug

SEQ ID NO: 646329 - RNA, 19 nt, Homo sapiens
gcgcuaauuucuauuugau

SEQ ID NO: 646330 - RNA, 19 nt, Homo sapiens
gugacgaaauugaccguuu

SEQ ID NO: 646331 - RNA, 19 nt, Homo sapiens
gcacaucauuuaggcuuuc

SEQ ID NO: 646332 - RNA, 19 nt, Homo sapiens
gaggaggauuugacucuca

SEQ ID NO: 646333 - RNA, 19 nt, Homo sapiens
cgacuguccucauauucaa

SEQ ID NO: 646334 - RNA, 19 nt, Homo sapiens
gcaacauggugacacuuuc

SEQ ID NO: 646335 - RNA, 19 nt, Homo sapiens
gaaaacacuucaaaagcaa

SEQ ID NO: 646336 - RNA, 19 nt, Homo sapiens
gcgaaagggagacuuggua

SEQ ID NO: 646337 - RNA, 19 nt, Homo sapiens
caucuuuccuccaguccua

SEQ ID NO: 646338 - RNA, 19 nt, Homo sapiens
uuacgacuguccucauauu

SEQ ID NO: 646339 - RNA, 19 nt, Homo sapiens
gaacaauuggacagccuaa

SEQ ID NO: 646340 - RNA, 19 nt, Homo sapiens
gcauuuagcaucagucagu

SEQ ID NO: 646341 - RNA, 19 nt, Homo sapiens
gaguuuagauaugaucguu

SEQ ID NO: 646342 - RNA, 19 nt, Homo sapiens
caaagugaaaucuuagaga

SEQ ID NO: 646343 - RNA, 19 nt, Homo sapiens
uagaagaugguaagaagaa

SEQ ID NO: 646344 - RNA, 19 nt, Homo sapiens
agccuaaucugccuagaaa

SEQ ID NO: 646345 - RNA, 19 nt, Homo sapiens
gaaaauggacaucaaaauc

SEQ ID NO: 646346 - RNA, 19 nt, Homo sapiens
ucaccucugcuaucaauuu

SEQ ID NO: 646347 - RNA, 19 nt, Homo sapiens
cggugagccuccauugaua

SEQ ID NO: 646348 - RNA, 19 nt, Homo sapiens
ggacaucaaaaucaacuua

SEQ ID NO: 646349 - RNA, 19 nt, Homo sapiens
gcaaauguccaggccgauu

SEQ ID NO: 646350 - RNA, 19 nt, Homo sapiens
ggacuacugugugcgaaag

SEQ ID NO: 646351 - RNA, 19 nt, Homo sapiens
gaaaugucaagucuauuag

SEQ ID NO: 646352 - RNA, 19 nt, Homo sapiens
ggcaauguauuaucuucug

SEQ ID NO: 646353 - RNA, 19 nt, Homo sapiens
gacauacucuuggaaagca

SEQ ID NO: 646354 - RNA, 19 nt, Homo sapiens
uauccaacauacccauuga

SEQ ID NO: 646355 - RNA, 19 nt, Homo sapiens
aaauugugcuggaaaugga

SEQ ID NO: 646356 - RNA, 19 nt, Homo sapiens
ugauaucaguccaguuugu

SEQ ID NO: 646357 - RNA, 19 nt, Homo sapiens
caagauguccuggagaaau

SEQ ID NO: 646358 - RNA, 19 nt, Homo sapiens
cacagaagaaggaaauuga

SEQ ID NO: 646359 - RNA, 19 nt, Homo sapiens
uggugacccugaaaucuuu

SEQ ID NO: 646360 - RNA, 19 nt, Homo sapiens
cgaggaccuugaaauagga

SEQ ID NO: 646361 - RNA, 19 nt, Homo sapiens
gguggaaaguacauaacau

SEQ ID NO: 646362 - RNA, 19 nt, Homo sapiens
gcaggaaaauggacaucaa

SEQ ID NO: 646363 - RNA, 19 nt, Homo sapiens
uagagaagcuaaaaggaaa

SEQ ID NO: 646364 - RNA, 19 nt, Homo sapiens
uacagccgcuuguuguuug

SEQ ID NO: 646365 - RNA, 19 nt, Homo sapiens
aaacuacagccgcuuguug

SEQ ID NO: 646366 - RNA, 19 nt, Homo sapiens
ggugagccuccauugauaa

SEQ ID NO: 646367 - RNA, 19 nt, Homo sapiens
guggaaaguacauaacauu

SEQ ID NO: 646368 - RNA, 19 nt, Homo sapiens
ucaguccaguuuguccuua

SEQ ID NO: 646369 - RNA, 19 nt, Homo sapiens
cuuuacgacuguccucaua

SEQ ID NO: 646370 - RNA, 19 nt, Homo sapiens
ccaguaccagcuagugaua

SEQ ID NO: 646371 - RNA, 19 nt, Homo sapiens
gaguuacacuggaugaaaa

SEQ ID NO: 646372 - RNA, 19 nt, Homo sapiens
aguaccagcuagugauaaa

SEQ ID NO: 646373 - RNA, 19 nt, Homo sapiens
ggcaaacacuauuccaacu

SEQ ID NO: 646374 - RNA, 19 nt, Homo sapiens
ugaaauaggagcacaucau

SEQ ID NO: 646375 - RNA, 19 nt, Homo sapiens
caacauggugacacuuuca

SEQ ID NO: 646376 - RNA, 19 nt, Homo sapiens
uaaaaugcuucucaucaga

SEQ ID NO: 646377 - RNA, 19 nt, Homo sapiens
gagcuucuaggaaauguca

SEQ ID NO: 646378 - RNA, 19 nt, Homo sapiens
gagcuucaccucugcuauc

SEQ ID NO: 646379 - RNA, 19 nt, Homo sapiens
gcacuguggaauuuaaauc

SEQ ID NO: 646380 - RNA, 19 nt, Homo sapiens
ggagugguccugaacuuac

SEQ ID NO: 646381 - RNA, 19 nt, Homo sapiens
ucuaggaaaugucaagucu

SEQ ID NO: 646382 - RNA, 19 nt, Homo sapiens
cuucaccucugcuaucaau

SEQ ID NO: 646383 - RNA, 19 nt, Homo sapiens
ucacagaagaaggaaauug

SEQ ID NO: 646384 - RNA, 19 nt, Homo sapiens
gggagaccacggugacauu

SEQ ID NO: 646385 - RNA, 19 nt, Homo sapiens
ccauccaccucaccagaga

SEQ ID NO: 646386 - RNA, 19 nt, Homo sapiens
guuguuugguauucaguau

SEQ ID NO: 646387 - RNA, 19 nt, Homo sapiens
cuacagccgcuuguuguuu

SEQ ID NO: 646388 - RNA, 19 nt, Homo sapiens
ccauaggacuaaacuacag

SEQ ID NO: 646389 - RNA, 19 nt, Homo sapiens
gcagaaaccgguaagaaga

SEQ ID NO: 646390 - RNA, 19 nt, Homo sapiens
gcauggagcggcguuaaua

SEQ ID NO: 646391 - RNA, 19 nt, Homo sapiens
ugucuaugcucuugauuaa

SEQ ID NO: 646392 - RNA, 19 nt, Homo sapiens
ucgcugcacuuccuguuua

SEQ ID NO: 646393 - RNA, 19 nt, Homo sapiens
acaccaagcucuccaagau

SEQ ID NO: 646394 - RNA, 19 nt, Homo sapiens
ggaguccgcagaaggguua

SEQ ID NO: 646395 - RNA, 19 nt, Homo sapiens
gagcggagacgcacugaga

SEQ ID NO: 646396 - RNA, 19 nt, Homo sapiens
ccacgaacccuuccucuuc

SEQ ID NO: 646397 - RNA, 19 nt, Homo sapiens
gcucaggacccaagaagga

SEQ ID NO: 646398 - RNA, 19 nt, Homo sapiens
gaacccaagggcucaaaga

SEQ ID NO: 646399 - RNA, 19 nt, Homo sapiens
ucugggcgcuggaguuaaa

SEQ ID NO: 646400 - RNA, 19 nt, Homo sapiens
gcacugagagcauuaacag

SEQ ID NO: 646401 - RNA, 19 nt, Homo sapiens
gagacgcacugagagcauu

SEQ ID NO: 646402 - RNA, 19 nt, Homo sapiens
ccucagcccuaucuccauu

SEQ ID NO: 646403 - RNA, 19 nt, Homo sapiens
gugcucagguguuuguuca

SEQ ID NO: 646404 - RNA, 19 nt, Homo sapiens
ggccaaggaugcacagucu

SEQ ID NO: 646405 - RNA, 19 nt, Homo sapiens
gcucagguguuuguucauc

SEQ ID NO: 646406 - RNA, 19 nt, Homo sapiens
gcacgugcaauguccuuug

SEQ ID NO: 646407 - RNA, 19 nt, Homo sapiens
aguagccgcuccaacauga

SEQ ID NO: 646408 - RNA, 19 nt, Homo sapiens
cgugcaauguccuuugauu

SEQ ID NO: 646409 - RNA, 19 nt, Homo sapiens
gugcaauguccuuugauuu

SEQ ID NO: 646410 - RNA, 19 nt, Homo sapiens
gccaguagccgcuccaaca

SEQ ID NO: 646411 - RNA, 19 nt, Homo sapiens
gccgucuucucuaauuaaa

SEQ ID NO: 646412 - RNA, 19 nt, Homo sapiens
gugucuaugcucuugauua

SEQ ID NO: 646413 - RNA, 19 nt, Homo sapiens
cacgugcaauguccuuuga

SEQ ID NO: 646414 - RNA, 19 nt, Homo sapiens
accaagcucuccaagauca

SEQ ID NO: 646415 - RNA, 19 nt, Homo sapiens
cuaccuaccaugccuguug

SEQ ID NO: 646416 - RNA, 19 nt, Homo sapiens
gaaccagacgcaggaagau

SEQ ID NO: 646417 - RNA, 19 nt, Homo sapiens
ggcagaaaccgguaagaag

SEQ ID NO: 646418 - RNA, 19 nt, Homo sapiens
ucuccaagaucaagacucu

SEQ ID NO: 646419 - RNA, 19 nt, Homo sapiens
gaaucguggugguuuuauu

SEQ ID NO: 646420 - RNA, 19 nt, Homo sapiens
gagcauuaacagcgcauuc

SEQ ID NO: 646421 - RNA, 19 nt, Homo sapiens
guauuuaaacuaccuacca

SEQ ID NO: 646422 - RNA, 19 nt, Homo sapiens
acgccgucuucucuaauua

SEQ ID NO: 646423 - RNA, 19 nt, Homo sapiens
gcgcauggagcggcguuaa

SEQ ID NO: 646424 - RNA, 19 nt, Homo sapiens
uuuagaaccucagcccuau

SEQ ID NO: 646425 - RNA, 19 nt, Homo sapiens
cggcagaaaccgguaagaa

SEQ ID NO: 646426 - RNA, 19 nt, Homo sapiens
gcagcuacgcacaccauca

SEQ ID NO: 646427 - RNA, 19 nt, Homo sapiens
ucccuguguuggaaaguuu

SEQ ID NO: 646428 - RNA, 19 nt, Homo sapiens
uaaaagcuuucccuguguu

SEQ ID NO: 646429 - RNA, 19 nt, Homo sapiens
gcccuuuguucuucgaauc

SEQ ID NO: 646430 - RNA, 19 nt, Homo sapiens
ccagucgagaagaggauua

SEQ ID NO: 646431 - RNA, 19 nt, Homo sapiens
agaaggagggacugucgaa

SEQ ID NO: 646432 - RNA, 19 nt, Homo sapiens
cgagaagaggauuaaagga

SEQ ID NO: 646433 - RNA, 19 nt, Homo sapiens
ucucuuuucuuccuucuuu

SEQ ID NO: 646434 - RNA, 19 nt, Homo sapiens
ucucuugucccuccauaug

SEQ ID NO: 646435 - RNA, 19 nt, Homo sapiens
gggcugcgcgucucauuuu

SEQ ID NO: 646436 - RNA, 19 nt, Homo sapiens
agucugggcgcuggaguua

SEQ ID NO: 646437 - RNA, 19 nt, Homo sapiens
agaaaccgguaagaagaca

SEQ ID NO: 646438 - RNA, 19 nt, Homo sapiens
agaaccagacgcaggaaga

SEQ ID NO: 646439 - RNA, 19 nt, Homo sapiens
ucaaggcugaacucaagaa

SEQ ID NO: 646440 - RNA, 19 nt, Homo sapiens
uggacgugcuggccaagga

SEQ ID NO: 646441 - RNA, 19 nt, Homo sapiens
agacgcacugagagcauua

SEQ ID NO: 646442 - RNA, 19 nt, Homo sapiens
ucaggaaaggcccuacuuc

SEQ ID NO: 646443 - RNA, 19 nt, Homo sapiens
cagugucuaugcucuugau

SEQ ID NO: 646444 - RNA, 19 nt, Homo sapiens
ucucucuugucccuccaua

SEQ ID NO: 646445 - RNA, 19 nt, Homo sapiens
uaucuccauuucccuaucu

SEQ ID NO: 646446 - RNA, 19 nt, Homo sapiens
ucagcccuaucuccauuuc

SEQ ID NO: 646447 - RNA, 19 nt, Homo sapiens
gacaccaagcucuccaaga

SEQ ID NO: 646448 - RNA, 19 nt, Homo sapiens
gaacagaucuuacaacuga

SEQ ID NO: 646449 - RNA, 19 nt, Homo sapiens
guucaaagcuguauuguuu

SEQ ID NO: 646450 - RNA, 19 nt, Homo sapiens
gcauaugucucucuuaauu

SEQ ID NO: 646451 - RNA, 19 nt, Homo sapiens
gaacuuuacuguagccuuu

SEQ ID NO: 646452 - RNA, 19 nt, Homo sapiens
gaguaggccucuuaauuua

SEQ ID NO: 646453 - RNA, 19 nt, Homo sapiens
aagcuuaccuguaucauua

SEQ ID NO: 646454 - RNA, 19 nt, Homo sapiens
ggaguaggccucuuaauuu

SEQ ID NO: 646455 - RNA, 19 nt, Homo sapiens
gagaagcccuauaaaugua

SEQ ID NO: 646456 - RNA, 19 nt, Homo sapiens
gaaaugucaucugcaaaua

SEQ ID NO: 646457 - RNA, 19 nt, Homo sapiens
gaaauugaguuaagucugu

SEQ ID NO: 646458 - RNA, 19 nt, Homo sapiens
gagagaagcccuauaaaug

SEQ ID NO: 646459 - RNA, 19 nt, Homo sapiens
ggccaagucuuucgacaua

SEQ ID NO: 646460 - RNA, 19 nt, Homo sapiens
gcacacaucuccugcaaca

SEQ ID NO: 646461 - RNA, 19 nt, Homo sapiens
guaggccucuuaauuuaua

SEQ ID NO: 646462 - RNA, 19 nt, Homo sapiens
uaagaaaccuacuaccauu

SEQ ID NO: 646463 - RNA, 19 nt, Homo sapiens
gcaaaacccugucuacuaa

SEQ ID NO: 646464 - RNA, 19 nt, Homo sapiens
acacaaggccuacuuuaua

SEQ ID NO: 646465 - RNA, 19 nt, Homo sapiens
guaaagaucccaugauuca

SEQ ID NO: 646466 - RNA, 19 nt, Homo sapiens
aaacacaggucauaucuca

SEQ ID NO: 646467 - RNA, 19 nt, Homo sapiens
uaccuaaucuguugaguuu

SEQ ID NO: 646468 - RNA, 19 nt, Homo sapiens
gagagaagcccuaugaaug

SEQ ID NO: 646469 - RNA, 19 nt, Homo sapiens
gagagaagccuuacaagug

SEQ ID NO: 646470 - RNA, 19 nt, Homo sapiens
cacaaggccuacuuuauaa

SEQ ID NO: 646471 - RNA, 19 nt, Homo sapiens
gcauugauguuugaacuuu

SEQ ID NO: 646472 - RNA, 19 nt, Homo sapiens
guagccauaugguaaauuu

SEQ ID NO: 646473 - RNA, 19 nt, Homo sapiens
ccacagaaccuaccacuug

SEQ ID NO: 646474 - RNA, 19 nt, Homo sapiens
uagcuuaccuacuaaugua

SEQ ID NO: 646475 - RNA, 19 nt, Homo sapiens
gaagaccucucccaagaca

SEQ ID NO: 646476 - RNA, 19 nt, Homo sapiens
gggaaaaccuuuauuaaga

SEQ ID NO: 646477 - RNA, 19 nt, Homo sapiens
acacugaacuuuacuguag

SEQ ID NO: 646478 - RNA, 19 nt, Homo sapiens
gaacaugauuguggaagug

SEQ ID NO: 646479 - RNA, 19 nt, Homo sapiens
gaaauacucacguuuaagu

SEQ ID NO: 646480 - RNA, 19 nt, Homo sapiens
caucugaagagucauauua

SEQ ID NO: 646481 - RNA, 19 nt, Homo sapiens
ggagagaagcccuauaaau

SEQ ID NO: 646482 - RNA, 19 nt, Homo sapiens
ggagagagacccagugguu

SEQ ID NO: 646483 - RNA, 19 nt, Homo sapiens
gaaauucguucagucuaga

SEQ ID NO: 646484 - RNA, 19 nt, Homo sapiens
caagugugguuucuacuga

SEQ ID NO: 646485 - RNA, 19 nt, Homo sapiens
ggaaguguguugcucuuuc

SEQ ID NO: 646486 - RNA, 19 nt, Homo sapiens
gacagaauccuuggaauuu

SEQ ID NO: 646487 - RNA, 19 nt, Homo sapiens
gaguuaagucuguggauua

SEQ ID NO: 646488 - RNA, 19 nt, Homo sapiens
ugucauaccuaaucuguug

SEQ ID NO: 646489 - RNA, 19 nt, Homo sapiens
cauagugacuccugcauau

SEQ ID NO: 646490 - RNA, 19 nt, Homo sapiens
caugaaauacucacguuua

SEQ ID NO: 646491 - RNA, 19 nt, Homo sapiens
gaauauuacuugucaucug

SEQ ID NO: 646492 - RNA, 19 nt, Homo sapiens
gaagaugagcccugaaugu

SEQ ID NO: 646493 - RNA, 19 nt, Homo sapiens
gaucuugccuucagaaugc

SEQ ID NO: 646494 - RNA, 19 nt, Homo sapiens
gcacauaggagaaccuuca

SEQ ID NO: 646495 - RNA, 19 nt, Homo sapiens
gaguugugcuacaccaaua

SEQ ID NO: 646496 - RNA, 19 nt, Homo sapiens
caccacgccuggcuaauuu

SEQ ID NO: 646497 - RNA, 19 nt, Homo sapiens
uaacacaaggccuacuuua

SEQ ID NO: 646498 - RNA, 19 nt, Homo sapiens
guucaugagugcaggagua

SEQ ID NO: 646499 - RNA, 19 nt, Homo sapiens
gcaucuuucuccuuaguuu

SEQ ID NO: 646500 - RNA, 19 nt, Homo sapiens
gaaacucaguggacucaca

SEQ ID NO: 646501 - RNA, 19 nt, Homo sapiens
gaagucaguuucuuugaac

SEQ ID NO: 646502 - RNA, 19 nt, Homo sapiens
gaaguguguugcucuuuca

SEQ ID NO: 646503 - RNA, 19 nt, Homo sapiens
gagcacacaucuccugcaa

SEQ ID NO: 646504 - RNA, 19 nt, Homo sapiens
caaggccuacuuuauaaua

SEQ ID NO: 646505 - RNA, 19 nt, Homo sapiens
gauccuccuugacuuauga

SEQ ID NO: 646506 - RNA, 19 nt, Homo sapiens
ccuuugacauuccauauaa

SEQ ID NO: 646507 - RNA, 19 nt, Homo sapiens
ucgcacaucuucuguauuc

SEQ ID NO: 646508 - RNA, 19 nt, Homo sapiens
cugcauaugucucucuuaa

SEQ ID NO: 646509 - RNA, 19 nt, Homo sapiens
ugaagucaguuucuuugaa

SEQ ID NO: 646510 - RNA, 19 nt, Homo sapiens
gaacaguuaguuuaggaaa

SEQ ID NO: 646511 - RNA, 19 nt, Homo sapiens
ugucagaacaguuaguuua

SEQ ID NO: 646512 - RNA, 19 nt, Homo sapiens
ggagagaagcccuaugaau

SEQ ID NO: 646513 - RNA, 19 nt, Homo sapiens
ggacuucaauaacaugagu

SEQ ID NO: 646514 - RNA, 19 nt, Homo sapiens
caauuuagcacuuuacuuc

SEQ ID NO: 646515 - RNA, 19 nt, Homo sapiens
gucauuaugugaugucauu

SEQ ID NO: 646516 - RNA, 19 nt, Homo sapiens
guaaggauacacauguuaa

SEQ ID NO: 646517 - RNA, 19 nt, Homo sapiens
gaguuaagcccuaugaaug

SEQ ID NO: 646518 - RNA, 19 nt, Homo sapiens
uaacaugaguggcagaucu

SEQ ID NO: 646519 - RNA, 19 nt, Homo sapiens
gcacuuuacuuccauuagg

SEQ ID NO: 646520 - RNA, 19 nt, Homo sapiens
cagcauuucuaguuccuuu

SEQ ID NO: 646521 - RNA, 19 nt, Homo sapiens
gcagugaguuuucauuuug

SEQ ID NO: 646522 - RNA, 19 nt, Homo sapiens
ugccucagcuucccuagua

SEQ ID NO: 646523 - RNA, 19 nt, Homo sapiens
uaguauagauccuccuuga

SEQ ID NO: 646524 - RNA, 19 nt, Homo sapiens
cgacagaauccuuggaauu

SEQ ID NO: 646525 - RNA, 19 nt, Homo sapiens
gaugagcccugaaugugau

SEQ ID NO: 646526 - RNA, 19 nt, Homo sapiens
ugucauggauuucuuagug

SEQ ID NO: 646527 - RNA, 19 nt, Homo sapiens
gagagagacccagugguua

SEQ ID NO: 646528 - RNA, 19 nt, Homo sapiens
ggcaaggucuucaaacaca

SEQ ID NO: 646529 - RNA, 19 nt, Homo sapiens
gaugguguguguucaagga

SEQ ID NO: 646530 - RNA, 19 nt, Homo sapiens
gucagggacugucuguaua

SEQ ID NO: 646531 - RNA, 19 nt, Homo sapiens
aaagcuguauuguuuggua

SEQ ID NO: 646532 - RNA, 19 nt, Homo sapiens
gaaccuugacccuuuaugu

SEQ ID NO: 646533 - RNA, 19 nt, Homo sapiens
ggaguuaagcccuaugaau

SEQ ID NO: 646534 - RNA, 19 nt, Homo sapiens
guaagucgaaccauccuaa

SEQ ID NO: 646535 - RNA, 19 nt, Homo sapiens
uauguugggucuuguaguu

SEQ ID NO: 646536 - RNA, 19 nt, Homo sapiens
aggaagaccucucccaaga

SEQ ID NO: 646537 - RNA, 19 nt, Homo sapiens
gaucaaccauaccaaagag

SEQ ID NO: 646538 - RNA, 19 nt, Homo sapiens
ggagagaagccuuacaagu

SEQ ID NO: 646539 - RNA, 19 nt, Homo sapiens
ggacaagugacacaaggaa

SEQ ID NO: 646540 - RNA, 19 nt, Homo sapiens
caacuauauuccaaaguca

SEQ ID NO: 646541 - RNA, 19 nt, Homo sapiens
guuauacacugaacuuuac

SEQ ID NO: 646542 - RNA, 19 nt, Homo sapiens
cgucaucauuguagccaua

SEQ ID NO: 646543 - RNA, 19 nt, Homo sapiens
cagaacaguuaguuuagga

SEQ ID NO: 646544 - RNA, 19 nt, Homo sapiens
ggagagugcagcccugauu

SEQ ID NO: 646545 - RNA, 19 nt, Homo sapiens
ggggaacuuucaacuauua

SEQ ID NO: 646546 - RNA, 19 nt, Homo sapiens
ccuacuaccauucaaauaa

SEQ ID NO: 646547 - RNA, 19 nt, Homo sapiens
guacaccuucuguuucuuu

SEQ ID NO: 646548 - RNA, 19 nt, Homo sapiens
ggacaucgccugcaagugu

SEQ ID NO: 646549 - RNA, 19 nt, Homo sapiens
gaacaucaucuccguguau

SEQ ID NO: 646550 - RNA, 19 nt, Homo sapiens
ggcaagaaguucgaaguga

SEQ ID NO: 646551 - RNA, 19 nt, Homo sapiens
gcugaagauuaacaugaaa

SEQ ID NO: 646552 - RNA, 19 nt, Homo sapiens
caacauggagcucuacaag

SEQ ID NO: 646553 - RNA, 19 nt, Homo sapiens
gcugcaagcccuuccacua

SEQ ID NO: 646554 - RNA, 19 nt, Homo sapiens
ggcaaaaccugcaaccaaa

SEQ ID NO: 646555 - RNA, 19 nt, Homo sapiens
ugacggguaucaccugcaa

SEQ ID NO: 646556 - RNA, 19 nt, Homo sapiens
gcaagcccuuccacuacga

SEQ ID NO: 646557 - RNA, 19 nt, Homo sapiens
ucaagccccucaagaagua

SEQ ID NO: 646558 - RNA, 19 nt, Homo sapiens
aacaucaucuccguguaua

SEQ ID NO: 646559 - RNA, 19 nt, Homo sapiens
ccgaguccauggccaucua

SEQ ID NO: 646560 - RNA, 19 nt, Homo sapiens
ugaacaucaucuccgugua

SEQ ID NO: 646561 - RNA, 19 nt, Homo sapiens
ccaaaccaccggccagugu

SEQ ID NO: 646562 - RNA, 19 nt, Homo sapiens
aggggaagcugaagauuaa

SEQ ID NO: 646563 - RNA, 19 nt, Homo sapiens
acgagugcguggccuguaa

SEQ ID NO: 646564 - RNA, 19 nt, Homo sapiens
aagcugaagauuaacauga

SEQ ID NO: 646565 - RNA, 19 nt, Homo sapiens
gcuucaacauggagcucua

SEQ ID NO: 646566 - RNA, 19 nt, Homo sapiens
gaagggcaagugcaagaag

SEQ ID NO: 646567 - RNA, 19 nt, Homo sapiens
gaagcugaagauuaacaug

SEQ ID NO: 646568 - RNA, 19 nt, Homo sapiens
gcuggcaguccgagaacua

SEQ ID NO: 646569 - RNA, 19 nt, Homo sapiens
agaagaagggcaagugcaa

SEQ ID NO: 646570 - RNA, 19 nt, Homo sapiens
gcaagugucccaaaaucaa

SEQ ID NO: 646571 - RNA, 19 nt, Homo sapiens
ccauggccaucuacaaguc

SEQ ID NO: 646572 - RNA, 19 nt, Homo sapiens
ugugggugcugcuggcaaa

SEQ ID NO: 646573 - RNA, 19 nt, Homo sapiens
ggucacggccacagacauc

SEQ ID NO: 646574 - RNA, 19 nt, Homo sapiens
agcugaagauuaacaugaa

SEQ ID NO: 646575 - RNA, 19 nt, Homo sapiens
ggaagcugaagauuaacau

SEQ ID NO: 646576 - RNA, 19 nt, Homo sapiens
gggcuacuaccgcgacaug

SEQ ID NO: 646577 - RNA, 19 nt, Homo sapiens
gcgcugccgcuucaacaug

SEQ ID NO: 646578 - RNA, 19 nt, Homo sapiens
aagaagggcaagugcaaga

SEQ ID NO: 646579 - RNA, 19 nt, Homo sapiens
caucaucuccguguauaag

SEQ ID NO: 646580 - RNA, 19 nt, Homo sapiens
gggaagcugaagauuaaca

SEQ ID NO: 646581 - RNA, 19 nt, Homo sapiens
ccucaacugucgccacaac

SEQ ID NO: 646582 - RNA, 19 nt, Homo sapiens
ucagccgccugcacacguu

SEQ ID NO: 646583 - RNA, 19 nt, Homo sapiens
gcgcacgacuucgacaacu

SEQ ID NO: 646584 - RNA, 19 nt, Homo sapiens
gcacaacgucacgcucaca

SEQ ID NO: 646585 - RNA, 19 nt, Homo sapiens
gcucgugccaccucugcaa

SEQ ID NO: 646586 - RNA, 19 nt, Homo sapiens
gcgcgacucguacuucuac

SEQ ID NO: 646587 - RNA, 19 nt, Homo sapiens
gagcucaaaucccaacuua

SEQ ID NO: 646588 - RNA, 19 nt, Homo sapiens
uguaagagcuguccacauu

SEQ ID NO: 646589 - RNA, 19 nt, Homo sapiens
agacagugcuggagacaua

SEQ ID NO: 646590 - RNA, 19 nt, Homo sapiens
acuaagaccugaacuauga

SEQ ID NO: 646591 - RNA, 19 nt, Homo sapiens
gaacuaagaccugaacuau

SEQ ID NO: 646592 - RNA, 19 nt, Homo sapiens
ggccuuaucucaacaacaa

SEQ ID NO: 646593 - RNA, 19 nt, Homo sapiens
uaagagcuguccacauuug

SEQ ID NO: 646594 - RNA, 19 nt, Homo sapiens
gaaauaggcaggaagaagu

SEQ ID NO: 646595 - RNA, 19 nt, Homo sapiens
gaagggacaucgaacuaag

SEQ ID NO: 646596 - RNA, 19 nt, Homo sapiens
gaaagaaagagagaaagaa

SEQ ID NO: 646597 - RNA, 19 nt, Homo sapiens
cacacuaccucucugauuu

SEQ ID NO: 646598 - RNA, 19 nt, Homo sapiens
gcaacacagugaggccuua

SEQ ID NO: 646599 - RNA, 19 nt, Homo sapiens
gggaagaauagaagaauuu

SEQ ID NO: 646600 - RNA, 19 nt, Homo sapiens
caccgucucuccuuuguuu

SEQ ID NO: 646601 - RNA, 19 nt, Homo sapiens
guggagaacugcccuuaug

SEQ ID NO: 646602 - RNA, 19 nt, Homo sapiens
ccacugggcaccaacauaa

SEQ ID NO: 646603 - RNA, 19 nt, Homo sapiens
gugcugcccuuaaccauga

SEQ ID NO: 646604 - RNA, 19 nt, Homo sapiens
gcaggaaacagacauagga

SEQ ID NO: 646605 - RNA, 19 nt, Homo sapiens
ggaagggacaucgaacuaa

SEQ ID NO: 646606 - RNA, 19 nt, Homo sapiens
gaggugagguguugaaagc

SEQ ID NO: 646607 - RNA, 19 nt, Homo sapiens
gaccugaacuaugagaaau

SEQ ID NO: 646608 - RNA, 19 nt, Homo sapiens
gcacagcaggugaucuuga

SEQ ID NO: 646609 - RNA, 19 nt, Homo sapiens
gagcacagcaggugaucuu

SEQ ID NO: 646610 - RNA, 19 nt, Homo sapiens
aaagagagagaaagaaaga

SEQ ID NO: 646611 - RNA, 19 nt, Homo sapiens
agaaagagagagaaagaaa

SEQ ID NO: 646612 - RNA, 19 nt, Homo sapiens
aaagaaagagagagaaaga

SEQ ID NO: 646613 - RNA, 19 nt, Homo sapiens
agaaagagagaaagaaaga

SEQ ID NO: 646614 - RNA, 19 nt, Homo sapiens
ccaaaugggaagaauagaa

SEQ ID NO: 646615 - RNA, 19 nt, Homo sapiens
gcuacacccuggacaagug

SEQ ID NO: 646616 - RNA, 19 nt, Homo sapiens
gaaagagagagaaagaaag

SEQ ID NO: 646617 - RNA, 19 nt, Homo sapiens
acacaacgccacugacuga

SEQ ID NO: 646618 - RNA, 19 nt, Homo sapiens
gccaggaguuugagacuag

SEQ ID NO: 646619 - RNA, 19 nt, Homo sapiens
aguuguaccugacucauuu

SEQ ID NO: 646620 - RNA, 19 nt, Homo sapiens
aaagagagagagagagaaa

SEQ ID NO: 646621 - RNA, 19 nt, Homo sapiens
ugaaagaaagagagaaaga

SEQ ID NO: 646622 - RNA, 19 nt, Homo sapiens
ggaagaauagaagaauuug

SEQ ID NO: 646623 - RNA, 19 nt, Homo sapiens
gucugugucucucaauuaa

SEQ ID NO: 646624 - RNA, 19 nt, Homo sapiens
gaggaggccuggagcuucu

SEQ ID NO: 646625 - RNA, 19 nt, Homo sapiens
aaagaaagagaaagagaga

SEQ ID NO: 646626 - RNA, 19 nt, Homo sapiens
gaaagaaagagagagaaag

SEQ ID NO: 646627 - RNA, 19 nt, Homo sapiens
gaaagagagaaagaaagaa

SEQ ID NO: 646628 - RNA, 19 nt, Homo sapiens
ggagaacugcccuuaugga

SEQ ID NO: 646629 - RNA, 19 nt, Homo sapiens
agagcuggcuguacaggaa

SEQ ID NO: 646630 - RNA, 19 nt, Homo sapiens
gcacuugguggcccuguug

SEQ ID NO: 646631 - RNA, 19 nt, Homo sapiens
aaagaaagaaagagagaga

SEQ ID NO: 646632 - RNA, 19 nt, Homo sapiens
gacccugucugaaagaaag

SEQ ID NO: 646633 - RNA, 19 nt, Homo sapiens
gaaagagagagagagagaa

SEQ ID NO: 646634 - RNA, 19 nt, Homo sapiens
cgaacuaagaccugaacua

SEQ ID NO: 646635 - RNA, 19 nt, Homo sapiens
ggagaagcauagggacuag

SEQ ID NO: 646636 - RNA, 19 nt, Homo sapiens
caaaugggaagaauagaag

SEQ ID NO: 646637 - RNA, 19 nt, Homo sapiens
agaaagaaagggaaagaug

SEQ ID NO: 646638 - RNA, 19 nt, Homo sapiens
gagaaagaaagaaagaaag

SEQ ID NO: 646639 - RNA, 19 nt, Homo sapiens
agagagagaaagaaagaaa

SEQ ID NO: 646640 - RNA, 19 nt, Homo sapiens
agaaagaaagagagagaaa

SEQ ID NO: 646641 - RNA, 19 nt, Homo sapiens
gagaaagaaagaaagaaag

SEQ ID NO: 646642 - RNA, 19 nt, Homo sapiens
guaagagcuguccacauuu

SEQ ID NO: 646643 - RNA, 19 nt, Homo sapiens
cgucugugucucucaauua

SEQ ID NO: 646644 - RNA, 19 nt, Homo sapiens
agaaagagaaagagagaga

SEQ ID NO: 646645 - RNA, 19 nt, Homo sapiens
ggaaagauggaaggaagga

SEQ ID NO: 646646 - RNA, 19 nt, Homo sapiens
gcucaaaucccaacuuagc

SEQ ID NO: 646647 - RNA, 19 nt, Homo sapiens
ggucacagucuaccucuuc

SEQ ID NO: 646648 - RNA, 19 nt, Homo sapiens
agagagagagagaaagaaa

SEQ ID NO: 646649 - RNA, 19 nt, Homo sapiens
ggccaggaguuugagacua

SEQ ID NO: 646650 - RNA, 19 nt, Homo sapiens
gagcuguccacauuuguau

SEQ ID NO: 646651 - RNA, 19 nt, Homo sapiens
gggcucagaccucauuuca

SEQ ID NO: 646652 - RNA, 19 nt, Homo sapiens
acaaggugcuggucacagu

SEQ ID NO: 646653 - RNA, 19 nt, Homo sapiens
agaaagagagagagagaga

SEQ ID NO: 646654 - RNA, 19 nt, Homo sapiens
uggaggaggugagguguug

SEQ ID NO: 646655 - RNA, 19 nt, Homo sapiens
gaaagaaagaaagaaagag

SEQ ID NO: 646656 - RNA, 19 nt, Homo sapiens
caacaaccacaaaaucuaa

SEQ ID NO: 646657 - RNA, 19 nt, Homo sapiens
ucacacuaccucucugauu

SEQ ID NO: 646658 - RNA, 19 nt, Homo sapiens
ugagaaauaggcaggaaga

SEQ ID NO: 646659 - RNA, 19 nt, Homo sapiens
guagugaccgucugcuuuc

SEQ ID NO: 646660 - RNA, 19 nt, Homo sapiens
ugggaagaauagaagaauu

SEQ ID NO: 646661 - RNA, 19 nt, Homo sapiens
agagagagagagagaaaga

SEQ ID NO: 646662 - RNA, 19 nt, Homo sapiens
gagagaaagaaagaaagaa

SEQ ID NO: 646663 - RNA, 19 nt, Homo sapiens
gagagaaagaaagaaagaa

SEQ ID NO: 646664 - RNA, 19 nt, Homo sapiens
ggagcuugcaguccaguga

SEQ ID NO: 646665 - RNA, 19 nt, Homo sapiens
aaagaaagaaagggaaaga

SEQ ID NO: 646666 - RNA, 19 nt, Homo sapiens
agaaagaaagaaagggaaa

SEQ ID NO: 646667 - RNA, 19 nt, Homo sapiens
gccuucuacuucugcuuua

SEQ ID NO: 646668 - RNA, 19 nt, Homo sapiens
agaaagaaagaaagagaga

SEQ ID NO: 646669 - RNA, 19 nt, Homo sapiens
cguagugaccgucugcuuu

SEQ ID NO: 646670 - RNA, 19 nt, Homo sapiens
ugugguggcucacgccuau

SEQ ID NO: 646671 - RNA, 19 nt, Homo sapiens
aaccaugacaccauuguaa

SEQ ID NO: 646672 - RNA, 19 nt, Homo sapiens
gggaggugcugcccuuaac

SEQ ID NO: 646673 - RNA, 19 nt, Homo sapiens
gguguaggccugggcgaua

SEQ ID NO: 646674 - RNA, 19 nt, Homo sapiens
ucaauuaaccacucgucaa

SEQ ID NO: 646675 - RNA, 19 nt, Homo sapiens
cucauucucuuucauguuc

SEQ ID NO: 646676 - RNA, 19 nt, Homo sapiens
aaagaaagggaaagaugga

SEQ ID NO: 646677 - RNA, 19 nt, Homo sapiens
gaaagaaagaaagggaaag

SEQ ID NO: 646678 - RNA, 19 nt, Homo sapiens
ccaaaauggucaggacuuu

SEQ ID NO: 646679 - RNA, 19 nt, Homo sapiens
agagagaaagaaagaaaga

SEQ ID NO: 646680 - RNA, 19 nt, Homo sapiens
agagagaaagaaagaaaga

SEQ ID NO: 646681 - RNA, 19 nt, Homo sapiens
uaugagaaauaggcaggaa

SEQ ID NO: 646682 - RNA, 19 nt, Homo sapiens
uagaagaauuugccccuaa

SEQ ID NO: 646683 - RNA, 19 nt, Homo sapiens
gcccgucucugagccuuga

SEQ ID NO: 646684 - RNA, 19 nt, Homo sapiens
aaagagaaagagagagaga

SEQ ID NO: 646685 - RNA, 19 nt, Homo sapiens
guuugaggcugcagugagu

SEQ ID NO: 646686 - RNA, 19 nt, Homo sapiens
uaaccaugacaccauugua

SEQ ID NO: 646687 - RNA, 19 nt, Homo sapiens
gagaauaacucacuaaauc

SEQ ID NO: 646688 - RNA, 19 nt, Homo sapiens
agacuuagcuucuaggaua

SEQ ID NO: 646689 - RNA, 19 nt, Homo sapiens
cugaauagcuuaaguauga

SEQ ID NO: 646690 - RNA, 19 nt, Homo sapiens
gaagaucgaugaguucuga

SEQ ID NO: 646691 - RNA, 19 nt, Homo sapiens
gcacuagacugcucuuaga

SEQ ID NO: 646692 - RNA, 19 nt, Homo sapiens
gaagugaugguucgcauua

SEQ ID NO: 646693 - RNA, 19 nt, Homo sapiens
ggugagaaauacuacuuua

SEQ ID NO: 646694 - RNA, 19 nt, Homo sapiens
gaaacuucgugaauacuuu

SEQ ID NO: 646695 - RNA, 19 nt, Homo sapiens
gaacauccacgcuauuuau

SEQ ID NO: 646696 - RNA, 19 nt, Homo sapiens
gcggagagcuguacagugu

SEQ ID NO: 646697 - RNA, 19 nt, Homo sapiens
gaaagugccuacagauaca

SEQ ID NO: 646698 - RNA, 19 nt, Homo sapiens
gcaucuauauugccucuuu

SEQ ID NO: 646699 - RNA, 19 nt, Homo sapiens
gaagaaagcuuguuuugca

SEQ ID NO: 646700 - RNA, 19 nt, Homo sapiens
gcugagauaucaauugguu

SEQ ID NO: 646701 - RNA, 19 nt, Homo sapiens
ggauaaauacuucugauga

SEQ ID NO: 646702 - RNA, 19 nt, Homo sapiens
uaucuuggauugauuggua

SEQ ID NO: 646703 - RNA, 19 nt, Homo sapiens
gaaauuuauugacgacaga

SEQ ID NO: 646704 - RNA, 19 nt, Homo sapiens
gaagacagaguauuugguu

SEQ ID NO: 646705 - RNA, 19 nt, Homo sapiens
gagcgaaaucaaauucuua

SEQ ID NO: 646706 - RNA, 19 nt, Homo sapiens
gacaagcgauugcguuuca

SEQ ID NO: 646707 - RNA, 19 nt, Homo sapiens
gaagucagguaucaagauc

SEQ ID NO: 646708 - RNA, 19 nt, Homo sapiens
ggaaagaccacgaauccaa

SEQ ID NO: 646709 - RNA, 19 nt, Homo sapiens
uaaaguacuugcagaggaa

SEQ ID NO: 646710 - RNA, 19 nt, Homo sapiens
gaaagaccacgaauccaaa

SEQ ID NO: 646711 - RNA, 19 nt, Homo sapiens
guucauggaugcauuaaca

SEQ ID NO: 646712 - RNA, 19 nt, Homo sapiens
gaagagcgaaaucaaauuc

SEQ ID NO: 646713 - RNA, 19 nt, Homo sapiens
guacagauaccucagauuc

SEQ ID NO: 646714 - RNA, 19 nt, Homo sapiens
gcaauccaguugugcuuga

SEQ ID NO: 646715 - RNA, 19 nt, Homo sapiens
caacaaugcuaggaaacaa

SEQ ID NO: 646716 - RNA, 19 nt, Homo sapiens
gagagcacauugaccagaa

SEQ ID NO: 646717 - RNA, 19 nt, Homo sapiens
gaagagaaacaacguguca

SEQ ID NO: 646718 - RNA, 19 nt, Homo sapiens
caaacaauauccugaagag

SEQ ID NO: 646719 - RNA, 19 nt, Homo sapiens
cuacauaagugcuucuugu

SEQ ID NO: 646720 - RNA, 19 nt, Homo sapiens
acaaaguccucagagaaua

SEQ ID NO: 646721 - RNA, 19 nt, Homo sapiens
gaggaccuauuucuaccua

SEQ ID NO: 646722 - RNA, 19 nt, Homo sapiens
gaagaaaccacugucucua

SEQ ID NO: 646723 - RNA, 19 nt, Homo sapiens
caaaccagacauaugcuua

SEQ ID NO: 646724 - RNA, 19 nt, Homo sapiens
ggaacauccacgcuauuua

SEQ ID NO: 646725 - RNA, 19 nt, Homo sapiens
uaagaagcccauuauugua

SEQ ID NO: 646726 - RNA, 19 nt, Homo sapiens
gaugugaggcguuggcuuu

SEQ ID NO: 646727 - RNA, 19 nt, Homo sapiens
cauccacgcuauuuauuau

SEQ ID NO: 646728 - RNA, 19 nt, Homo sapiens
agaggaagaucgaugaguu

SEQ ID NO: 646729 - RNA, 19 nt, Homo sapiens
gaacuaagcagguggucau

SEQ ID NO: 646730 - RNA, 19 nt, Homo sapiens
ccacaaaguccucagagaa

SEQ ID NO: 646731 - RNA, 19 nt, Homo sapiens
ucaagauccucgugccuaa

SEQ ID NO: 646732 - RNA, 19 nt, Homo sapiens
ggagagcuguacagugugu

SEQ ID NO: 646733 - RNA, 19 nt, Homo sapiens
gcuuaaguaugacuaucua

SEQ ID NO: 646734 - RNA, 19 nt, Homo sapiens
guauaaaggugagcacuag

SEQ ID NO: 646735 - RNA, 19 nt, Homo sapiens
cagaaagugccuacagaua

SEQ ID NO: 646736 - RNA, 19 nt, Homo sapiens
uuaagaagcccauuauugu

SEQ ID NO: 646737 - RNA, 19 nt, Homo sapiens
guacaucuccguucaugga

SEQ ID NO: 646738 - RNA, 19 nt, Homo sapiens
guuguggacuugacuuuau

SEQ ID NO: 646739 - RNA, 19 nt, Homo sapiens
gagauauuguggucaggaa

SEQ ID NO: 646740 - RNA, 19 nt, Homo sapiens
gcacauugaccagaacaaa

SEQ ID NO: 646741 - RNA, 19 nt, Homo sapiens
ccagaugccuauuauuagu

SEQ ID NO: 646742 - RNA, 19 nt, Homo sapiens
cuccagaugccuauuauua

SEQ ID NO: 646743 - RNA, 19 nt, Homo sapiens
gaacuaccuuauauucaac

SEQ ID NO: 646744 - RNA, 19 nt, Homo sapiens
ucuaggagcaucuauauug

SEQ ID NO: 646745 - RNA, 19 nt, Homo sapiens
ucagaaacuucgugaauac

SEQ ID NO: 646746 - RNA, 19 nt, Homo sapiens
caaaguccucagagaauaa

SEQ ID NO: 646747 - RNA, 19 nt, Homo sapiens
gccuacagauacagagaua

SEQ ID NO: 646748 - RNA, 19 nt, Homo sapiens
gcagauaugauugauguau

SEQ ID NO: 646749 - RNA, 19 nt, Homo sapiens
caauuuaagaagcccauua

SEQ ID NO: 646750 - RNA, 19 nt, Homo sapiens
uaggauucaugcugagaua

SEQ ID NO: 646751 - RNA, 19 nt, Homo sapiens
ggaaggcaauggguuucaa

SEQ ID NO: 646752 - RNA, 19 nt, Homo sapiens
caaccaacauacagacauc

SEQ ID NO: 646753 - RNA, 19 nt, Homo sapiens
gcuguuaacgggaaaggua

SEQ ID NO: 646754 - RNA, 19 nt, Homo sapiens
gaagaacacagcuccaucu

SEQ ID NO: 646755 - RNA, 19 nt, Homo sapiens
ucuaagaccucuccuaagg

SEQ ID NO: 646756 - RNA, 19 nt, Homo sapiens
agaaaccacugucucuaga

SEQ ID NO: 646757 - RNA, 19 nt, Homo sapiens
gacauaugcuuaggauuca

SEQ ID NO: 646758 - RNA, 19 nt, Homo sapiens
ccagacauaugcuuaggau

SEQ ID NO: 646759 - RNA, 19 nt, Homo sapiens
gauggcuguucuaccguua

SEQ ID NO: 646760 - RNA, 19 nt, Homo sapiens
gaagagaccagccuuuuga

SEQ ID NO: 646761 - RNA, 19 nt, Homo sapiens
gcacacuauuaaaugcaaa

SEQ ID NO: 646762 - RNA, 19 nt, Homo sapiens
ucacugaauagcuuaagua

SEQ ID NO: 646763 - RNA, 19 nt, Homo sapiens
agacauaugcuuaggauuc

SEQ ID NO: 646764 - RNA, 19 nt, Homo sapiens
ggaccuauuucuaccuaag

SEQ ID NO: 646765 - RNA, 19 nt, Homo sapiens
gggaacauccacgcuauuu

SEQ ID NO: 646766 - RNA, 19 nt, Homo sapiens
cuacagauacagagauauu

SEQ ID NO: 646767 - RNA, 19 nt, Homo sapiens
aaagguacaucuccguuca

SEQ ID NO: 646768 - RNA, 19 nt, Homo sapiens
agaaaagucuggaauaaug

SEQ ID NO: 646769 - RNA, 19 nt, Homo sapiens
ggucuaggagcaucuauau

SEQ ID NO: 646770 - RNA, 19 nt, Homo sapiens
gaaaagagaaagcacuaaa

SEQ ID NO: 646771 - RNA, 19 nt, Homo sapiens
gcagaaggagagcacauug

SEQ ID NO: 646772 - RNA, 19 nt, Homo sapiens
acagcagccucccgcuuua

SEQ ID NO: 646773 - RNA, 19 nt, Homo sapiens
uaaaauacguccaguucuu

SEQ ID NO: 646774 - RNA, 19 nt, Homo sapiens
ggcagaagcuaucagaaac

SEQ ID NO: 646775 - RNA, 19 nt, Homo sapiens
gccagaaguucaggaagaa

SEQ ID NO: 646776 - RNA, 19 nt, Homo sapiens
gaaggcaauggguuucaaa

SEQ ID NO: 646777 - RNA, 19 nt, Homo sapiens
ccucauuucuuccuucuag

SEQ ID NO: 646778 - RNA, 19 nt, Homo sapiens
cagaagcuaucagaaacuu

SEQ ID NO: 646779 - RNA, 19 nt, Homo sapiens
gaacugugaggaauacauc

SEQ ID NO: 646780 - RNA, 19 nt, Homo sapiens
ggaccuaccuuuucguuca

SEQ ID NO: 646781 - RNA, 19 nt, Homo sapiens
uugcagauaugauugaugu

SEQ ID NO: 646782 - RNA, 19 nt, Homo sapiens
gaaagcuuguuuugcagua

SEQ ID NO: 646783 - RNA, 19 nt, Homo sapiens
gacuuagcuucuaggauaa

SEQ ID NO: 646784 - RNA, 19 nt, Homo sapiens
gaaaccacugucucuagaa

SEQ ID NO: 646785 - RNA, 19 nt, Homo sapiens
uguccaaacgucauuauuu

SEQ ID NO: 646786 - RNA, 19 nt, Homo sapiens
agugugaggugcugaagaa

SEQ ID NO: 646787 - RNA, 19 nt, Homo sapiens
gagaauaacucacuaaauc

SEQ ID NO: 646788 - RNA, 19 nt, Homo sapiens
agacuuagcuucuaggaua

SEQ ID NO: 646789 - RNA, 19 nt, Homo sapiens
cugaauagcuuaaguauga

SEQ ID NO: 646790 - RNA, 19 nt, Homo sapiens
gaagaucgaugaguucuga

SEQ ID NO: 646791 - RNA, 19 nt, Homo sapiens
gcacuagacugcucuuaga

SEQ ID NO: 646792 - RNA, 19 nt, Homo sapiens
gaagugaugguucgcauua

SEQ ID NO: 646793 - RNA, 19 nt, Homo sapiens
ggugagaaauacuacuuua

SEQ ID NO: 646794 - RNA, 19 nt, Homo sapiens
gaaacuucgugaauacuuu

SEQ ID NO: 646795 - RNA, 19 nt, Homo sapiens
gaacauccacgcuauuuau

SEQ ID NO: 646796 - RNA, 19 nt, Homo sapiens
gcggagagcuguacagugu

SEQ ID NO: 646797 - RNA, 19 nt, Homo sapiens
gaaagugccuacagauaca

SEQ ID NO: 646798 - RNA, 19 nt, Homo sapiens
gcaucuauauugccucuuu

SEQ ID NO: 646799 - RNA, 19 nt, Homo sapiens
gaagaaagcuuguuuugca

SEQ ID NO: 646800 - RNA, 19 nt, Homo sapiens
gcugagauaucaauugguu

SEQ ID NO: 646801 - RNA, 19 nt, Homo sapiens
ggauaaauacuucugauga

SEQ ID NO: 646802 - RNA, 19 nt, Homo sapiens
uaucuuggauugauuggua

SEQ ID NO: 646803 - RNA, 19 nt, Homo sapiens
gaaauuuauugacgacaga

SEQ ID NO: 646804 - RNA, 19 nt, Homo sapiens
gaagacagaguauuugguu

SEQ ID NO: 646805 - RNA, 19 nt, Homo sapiens
gagcgaaaucaaauucuua

SEQ ID NO: 646806 - RNA, 19 nt, Homo sapiens
gacaagcgauugcguuuca

SEQ ID NO: 646807 - RNA, 19 nt, Homo sapiens
gaagucagguaucaagauc

SEQ ID NO: 646808 - RNA, 19 nt, Homo sapiens
ggaaagaccacgaauccaa

SEQ ID NO: 646809 - RNA, 19 nt, Homo sapiens
uaaaguacuugcagaggaa

SEQ ID NO: 646810 - RNA, 19 nt, Homo sapiens
gaaagaccacgaauccaaa

SEQ ID NO: 646811 - RNA, 19 nt, Homo sapiens
guucauggaugcauuaaca

SEQ ID NO: 646812 - RNA, 19 nt, Homo sapiens
guacgagguugaaaggauu

SEQ ID NO: 646813 - RNA, 19 nt, Homo sapiens
ggacccaacugaaacaaag

SEQ ID NO: 646814 - RNA, 19 nt, Homo sapiens
gaagagcgaaaucaaauuc

SEQ ID NO: 646815 - RNA, 19 nt, Homo sapiens
guacagauaccucagauuc

SEQ ID NO: 646816 - RNA, 19 nt, Homo sapiens
gcaauccaguugugcuuga

SEQ ID NO: 646817 - RNA, 19 nt, Homo sapiens
caacaaugcuaggaaacaa

SEQ ID NO: 646818 - RNA, 19 nt, Homo sapiens
gagagcacauugaccagaa

SEQ ID NO: 646819 - RNA, 19 nt, Homo sapiens
cuacauaagugcuucuugu

SEQ ID NO: 646820 - RNA, 19 nt, Homo sapiens
acaaaguccucagagaaua

SEQ ID NO: 646821 - RNA, 19 nt, Homo sapiens
gaagaaaccacugucucua

SEQ ID NO: 646822 - RNA, 19 nt, Homo sapiens
caaaccagacauaugcuua

SEQ ID NO: 646823 - RNA, 19 nt, Homo sapiens
ggaacauccacgcuauuua

SEQ ID NO: 646824 - RNA, 19 nt, Homo sapiens
uaagaagcccauuauugua

SEQ ID NO: 646825 - RNA, 19 nt, Homo sapiens
gaugugaggcguuggcuuu

SEQ ID NO: 646826 - RNA, 19 nt, Homo sapiens
cauccacgcuauuuauuau

SEQ ID NO: 646827 - RNA, 19 nt, Homo sapiens
agaggaagaucgaugaguu

SEQ ID NO: 646828 - RNA, 19 nt, Homo sapiens
ccacaaaguccucagagaa

SEQ ID NO: 646829 - RNA, 19 nt, Homo sapiens
ucaagauccucgugccuaa

SEQ ID NO: 646830 - RNA, 19 nt, Homo sapiens
ggagagcuguacagugugu

SEQ ID NO: 646831 - RNA, 19 nt, Homo sapiens
gcuuaaguaugacuaucua

SEQ ID NO: 646832 - RNA, 19 nt, Homo sapiens
guauaaaggugagcacuag

SEQ ID NO: 646833 - RNA, 19 nt, Homo sapiens
cagaaagugccuacagaua

SEQ ID NO: 646834 - RNA, 19 nt, Homo sapiens
uuaagaagcccauuauugu

SEQ ID NO: 646835 - RNA, 19 nt, Homo sapiens
guacaucuccguucaugga

SEQ ID NO: 646836 - RNA, 19 nt, Homo sapiens
guuguggacuugacuuuau

SEQ ID NO: 646837 - RNA, 19 nt, Homo sapiens
gagauauuguggucaggaa

SEQ ID NO: 646838 - RNA, 19 nt, Homo sapiens
gcacauugaccagaacaaa

SEQ ID NO: 646839 - RNA, 19 nt, Homo sapiens
ccagaugccuauuauuagu

SEQ ID NO: 646840 - RNA, 19 nt, Homo sapiens
cuccagaugccuauuauua

SEQ ID NO: 646841 - RNA, 19 nt, Homo sapiens
gaacuaccuuauauucaac

SEQ ID NO: 646842 - RNA, 19 nt, Homo sapiens
ucuaggagcaucuauauug

SEQ ID NO: 646843 - RNA, 19 nt, Homo sapiens
ucagaaacuucgugaauac

SEQ ID NO: 646844 - RNA, 19 nt, Homo sapiens
caaaguccucagagaauaa

SEQ ID NO: 646845 - RNA, 19 nt, Homo sapiens
gccuacagauacagagaua

SEQ ID NO: 646846 - RNA, 19 nt, Homo sapiens
gcagauaugauugauguau

SEQ ID NO: 646847 - RNA, 19 nt, Homo sapiens
caauuuaagaagcccauua

SEQ ID NO: 646848 - RNA, 19 nt, Homo sapiens
uaggauucaugcugagaua

SEQ ID NO: 646849 - RNA, 19 nt, Homo sapiens
caaccaacauacagacauc

SEQ ID NO: 646850 - RNA, 19 nt, Homo sapiens
gcuguuaacgggaaaggua

SEQ ID NO: 646851 - RNA, 19 nt, Homo sapiens
gaagaacacagcuccaucu

SEQ ID NO: 646852 - RNA, 19 nt, Homo sapiens
ucuaagaccucuccuaagg

SEQ ID NO: 646853 - RNA, 19 nt, Homo sapiens
agaaaccacugucucuaga

SEQ ID NO: 646854 - RNA, 19 nt, Homo sapiens
gacauaugcuuaggauuca

SEQ ID NO: 646855 - RNA, 19 nt, Homo sapiens
ccagacauaugcuuaggau

SEQ ID NO: 646856 - RNA, 19 nt, Homo sapiens
gauggcuguucuaccguua

SEQ ID NO: 646857 - RNA, 19 nt, Homo sapiens
gaagagaccagccuuuuga

SEQ ID NO: 646858 - RNA, 19 nt, Homo sapiens
gcacacuauuaaaugcaaa

SEQ ID NO: 646859 - RNA, 19 nt, Homo sapiens
ucacugaauagcuuaagua

SEQ ID NO: 646860 - RNA, 19 nt, Homo sapiens
agacauaugcuuaggauuc

SEQ ID NO: 646861 - RNA, 19 nt, Homo sapiens
gggaacauccacgcuauuu

SEQ ID NO: 646862 - RNA, 19 nt, Homo sapiens
cuacagauacagagauauu

SEQ ID NO: 646863 - RNA, 19 nt, Homo sapiens
aaagguacaucuccguuca

SEQ ID NO: 646864 - RNA, 19 nt, Homo sapiens
agaaaagucuggaauaaug

SEQ ID NO: 646865 - RNA, 19 nt, Homo sapiens
ggucuaggagcaucuauau

SEQ ID NO: 646866 - RNA, 19 nt, Homo sapiens
gaaaagagaaagcacuaaa

SEQ ID NO: 646867 - RNA, 19 nt, Homo sapiens
gcagaaggagagcacauug

SEQ ID NO: 646868 - RNA, 19 nt, Homo sapiens
uaaaauacguccaguucuu

SEQ ID NO: 646869 - RNA, 19 nt, Homo sapiens
ggcagaagcuaucagaaac

SEQ ID NO: 646870 - RNA, 19 nt, Homo sapiens
gccagaaguucaggaagaa

SEQ ID NO: 646871 - RNA, 19 nt, Homo sapiens
ccucauuucuuccuucuag

SEQ ID NO: 646872 - RNA, 19 nt, Homo sapiens
cagaagcuaucagaaacuu

SEQ ID NO: 646873 - RNA, 19 nt, Homo sapiens
gaacugugaggaauacauc

SEQ ID NO: 646874 - RNA, 19 nt, Homo sapiens
ggaccuaccuuuucguuca

SEQ ID NO: 646875 - RNA, 19 nt, Homo sapiens
uugcagauaugauugaugu

SEQ ID NO: 646876 - RNA, 19 nt, Homo sapiens
gaaagcuuguuuugcagua

SEQ ID NO: 646877 - RNA, 19 nt, Homo sapiens
gacuuagcuucuaggauaa

SEQ ID NO: 646878 - RNA, 19 nt, Homo sapiens
gaaaccacugucucuagaa

SEQ ID NO: 646879 - RNA, 19 nt, Homo sapiens
ggaauacauccacgacuuc

SEQ ID NO: 646880 - RNA, 19 nt, Homo sapiens
uguccaaacgucauuauuu

SEQ ID NO: 646881 - RNA, 19 nt, Homo sapiens
agugugaggugcugaagaa

SEQ ID NO: 646882 - RNA, 19 nt, Homo sapiens
gaacagcaccucgugaacu

SEQ ID NO: 646883 - RNA, 19 nt, Homo sapiens
uaucagaaacuucgugaau

SEQ ID NO: 646884 - RNA, 19 nt, Homo sapiens
gagcgagagcccugagaaa

SEQ ID NO: 646885 - RNA, 19 nt, Homo sapiens
cuaaggcacucgugauugg

SEQ ID NO: 646886 - RNA, 19 nt, Homo sapiens
cuucugagcuugcaaucau

SEQ ID NO: 646887 - RNA, 19 nt, Homo sapiens
gagaauaacucacuaaauc

SEQ ID NO: 646888 - RNA, 19 nt, Homo sapiens
agacuuagcuucuaggaua

SEQ ID NO: 646889 - RNA, 19 nt, Homo sapiens
cugaauagcuuaaguauga

SEQ ID NO: 646890 - RNA, 19 nt, Homo sapiens
gaagaucgaugaguucuga

SEQ ID NO: 646891 - RNA, 19 nt, Homo sapiens
gcacuagacugcucuuaga

SEQ ID NO: 646892 - RNA, 19 nt, Homo sapiens
gaagugaugguucgcauua

SEQ ID NO: 646893 - RNA, 19 nt, Homo sapiens
ggugagaaauacuacuuua

SEQ ID NO: 646894 - RNA, 19 nt, Homo sapiens
gaaacuucgugaauacuuu

SEQ ID NO: 646895 - RNA, 19 nt, Homo sapiens
gaacauccacgcuauuuau

SEQ ID NO: 646896 - RNA, 19 nt, Homo sapiens
gcggagagcuguacagugu

SEQ ID NO: 646897 - RNA, 19 nt, Homo sapiens
gaaagugccuacagauaca

SEQ ID NO: 646898 - RNA, 19 nt, Homo sapiens
ccgaggagcuguacgagua

SEQ ID NO: 646899 - RNA, 19 nt, Homo sapiens
gcaucuauauugccucuuu

SEQ ID NO: 646900 - RNA, 19 nt, Homo sapiens
gaagaaagcuuguuuugca

SEQ ID NO: 646901 - RNA, 19 nt, Homo sapiens
gcugagauaucaauugguu

SEQ ID NO: 646902 - RNA, 19 nt, Homo sapiens
ggauaaauacuucugauga

SEQ ID NO: 646903 - RNA, 19 nt, Homo sapiens
uaucuuggauugauuggua

SEQ ID NO: 646904 - RNA, 19 nt, Homo sapiens
gaaauuuauugacgacaga

SEQ ID NO: 646905 - RNA, 19 nt, Homo sapiens
gagcgaaaucaaauucuua

SEQ ID NO: 646906 - RNA, 19 nt, Homo sapiens
gacaagcgauugcguuuca

SEQ ID NO: 646907 - RNA, 19 nt, Homo sapiens
uaaaguacuugcagaggaa

SEQ ID NO: 646908 - RNA, 19 nt, Homo sapiens
guucauggaugcauuaaca

SEQ ID NO: 646909 - RNA, 19 nt, Homo sapiens
ggacccaacugaaacaaag

SEQ ID NO: 646910 - RNA, 19 nt, Homo sapiens
gaagagcgaaaucaaauuc

SEQ ID NO: 646911 - RNA, 19 nt, Homo sapiens
guacagauaccucagauuc

SEQ ID NO: 646912 - RNA, 19 nt, Homo sapiens
gcaauccaguugugcuuga

SEQ ID NO: 646913 - RNA, 19 nt, Homo sapiens
cuacauaagugcuucuugu

SEQ ID NO: 646914 - RNA, 19 nt, Homo sapiens
acaaaguccucagagaaua

SEQ ID NO: 646915 - RNA, 19 nt, Homo sapiens
gaagaaaccacugucucua

SEQ ID NO: 646916 - RNA, 19 nt, Homo sapiens
caaaccagacauaugcuua

SEQ ID NO: 646917 - RNA, 19 nt, Homo sapiens
ggaacauccacgcuauuua

SEQ ID NO: 646918 - RNA, 19 nt, Homo sapiens
uaagaagcccauuauugua

SEQ ID NO: 646919 - RNA, 19 nt, Homo sapiens
gaugugaggcguuggcuuu

SEQ ID NO: 646920 - RNA, 19 nt, Homo sapiens
cauccacgcuauuuauuau

SEQ ID NO: 646921 - RNA, 19 nt, Homo sapiens
agaggaagaucgaugaguu

SEQ ID NO: 646922 - RNA, 19 nt, Homo sapiens
ccacaaaguccucagagaa

SEQ ID NO: 646923 - RNA, 19 nt, Homo sapiens
ggagagcuguacagugugu

SEQ ID NO: 646924 - RNA, 19 nt, Homo sapiens
gcuuaaguaugacuaucua

SEQ ID NO: 646925 - RNA, 19 nt, Homo sapiens
guauaaaggugagcacuag

SEQ ID NO: 646926 - RNA, 19 nt, Homo sapiens
cagaaagugccuacagaua

SEQ ID NO: 646927 - RNA, 19 nt, Homo sapiens
guacaucuccguucaugga

SEQ ID NO: 646928 - RNA, 19 nt, Homo sapiens
uuaagaagcccauuauugu

SEQ ID NO: 646929 - RNA, 19 nt, Homo sapiens
guuguggacuugacuuuau

SEQ ID NO: 646930 - RNA, 19 nt, Homo sapiens
gagauauuguggucaggaa

SEQ ID NO: 646931 - RNA, 19 nt, Homo sapiens
ccagaugccuauuauuagu

SEQ ID NO: 646932 - RNA, 19 nt, Homo sapiens
cuccagaugccuauuauua

SEQ ID NO: 646933 - RNA, 19 nt, Homo sapiens
gaacuaccuuauauucaac

SEQ ID NO: 646934 - RNA, 19 nt, Homo sapiens
ucuaggagcaucuauauug

SEQ ID NO: 646935 - RNA, 19 nt, Homo sapiens
ucagaaacuucgugaauac

SEQ ID NO: 646936 - RNA, 19 nt, Homo sapiens
caaaguccucagagaauaa

SEQ ID NO: 646937 - RNA, 19 nt, Homo sapiens
gccuacagauacagagaua

SEQ ID NO: 646938 - RNA, 19 nt, Homo sapiens
gcagauaugauugauguau

SEQ ID NO: 646939 - RNA, 19 nt, Homo sapiens
caauuuaagaagcccauua

SEQ ID NO: 646940 - RNA, 19 nt, Homo sapiens
caaccaacauacagacauc

SEQ ID NO: 646941 - RNA, 19 nt, Homo sapiens
uaggauucaugcugagaua

SEQ ID NO: 646942 - RNA, 19 nt, Homo sapiens
agaaaccacugucucuaga

SEQ ID NO: 646943 - RNA, 19 nt, Homo sapiens
gacauaugcuuaggauuca

SEQ ID NO: 646944 - RNA, 19 nt, Homo sapiens
ccagacauaugcuuaggau

SEQ ID NO: 646945 - RNA, 19 nt, Homo sapiens
gauggcuguucuaccguua

SEQ ID NO: 646946 - RNA, 19 nt, Homo sapiens
gaagagaccagccuuuuga

SEQ ID NO: 646947 - RNA, 19 nt, Homo sapiens
gcacacuauuaaaugcaaa

SEQ ID NO: 646948 - RNA, 19 nt, Homo sapiens
ucacugaauagcuuaagua

SEQ ID NO: 646949 - RNA, 19 nt, Homo sapiens
agacauaugcuuaggauuc

SEQ ID NO: 646950 - RNA, 19 nt, Homo sapiens
gggaacauccacgcuauuu

SEQ ID NO: 646951 - RNA, 19 nt, Homo sapiens
cuacagauacagagauauu

SEQ ID NO: 646952 - RNA, 19 nt, Homo sapiens
gaguacaucuccguucaug

SEQ ID NO: 646953 - RNA, 19 nt, Homo sapiens
agaaaagucuggaauaaug

SEQ ID NO: 646954 - RNA, 19 nt, Homo sapiens
ggucuaggagcaucuauau

SEQ ID NO: 646955 - RNA, 19 nt, Homo sapiens
gaaaagagaaagcacuaaa

SEQ ID NO: 646956 - RNA, 19 nt, Homo sapiens
uaaaauacguccaguucuu

SEQ ID NO: 646957 - RNA, 19 nt, Homo sapiens
ggcagaagcuaucagaaac

SEQ ID NO: 646958 - RNA, 19 nt, Homo sapiens
ccucauuucuuccuucuag

SEQ ID NO: 646959 - RNA, 19 nt, Homo sapiens
cagaagcuaucagaaacuu

SEQ ID NO: 646960 - RNA, 19 nt, Homo sapiens
ggaccuaccuuuucguuca

SEQ ID NO: 646961 - RNA, 19 nt, Homo sapiens
uugcagauaugauugaugu

SEQ ID NO: 646962 - RNA, 19 nt, Homo sapiens
gaaagcuuguuuugcagua

SEQ ID NO: 646963 - RNA, 19 nt, Homo sapiens
gacuuagcuucuaggauaa

SEQ ID NO: 646964 - RNA, 19 nt, Homo sapiens
gaaaccacugucucuagaa

SEQ ID NO: 646965 - RNA, 19 nt, Homo sapiens
uguccaaacgucauuauuu

SEQ ID NO: 646966 - RNA, 19 nt, Homo sapiens
agugugaggugcugaagaa

SEQ ID NO: 646967 - RNA, 19 nt, Homo sapiens
uaucagaaacuucgugaau

SEQ ID NO: 646968 - RNA, 19 nt, Homo sapiens
cuucugagcuugcaaucau

SEQ ID NO: 646969 - RNA, 19 nt, Homo sapiens
cguuauguuucccaagaua

SEQ ID NO: 646970 - RNA, 19 nt, Homo sapiens
guagagacacagagugaug

SEQ ID NO: 646971 - RNA, 19 nt, Homo sapiens
guccaaacgucauuauuuu

SEQ ID NO: 646972 - RNA, 19 nt, Homo sapiens
gcgaugugguuugggcuaa

SEQ ID NO: 646973 - RNA, 19 nt, Homo sapiens
uuuaagaagcccauuauug

SEQ ID NO: 646974 - RNA, 19 nt, Homo sapiens
gaauguaugaagagcgaaa

SEQ ID NO: 646975 - RNA, 19 nt, Homo sapiens
agagugcccuguguggaua

SEQ ID NO: 646976 - RNA, 19 nt, Homo sapiens
ccaacgagagggaguguga

SEQ ID NO: 646977 - RNA, 19 nt, Homo sapiens
uggcagaagcuaucagaaa

SEQ ID NO: 646978 - RNA, 19 nt, Homo sapiens
uggauugauugguacagua

SEQ ID NO: 646979 - RNA, 19 nt, Homo sapiens
caaugggacaaccaacaua

SEQ ID NO: 646980 - RNA, 19 nt, Homo sapiens
guccaguucuuacccaguu

SEQ ID NO: 646981 - RNA, 19 nt, Homo sapiens
gcugcaacaugaagaugga

SEQ ID NO: 646982 - RNA, 19 nt, Homo sapiens
gaauaacucacuaaaucca

SEQ ID NO: 646983 - RNA, 19 nt, Homo sapiens
agacuccagaugccuauua

SEQ ID NO: 646984 - RNA, 19 nt, Homo sapiens
gauucaugcugagauauca

SEQ ID NO: 646985 - RNA, 19 nt, Homo sapiens
gggcugagcaggagaacau

SEQ ID NO: 646986 - RNA, 19 nt, Homo sapiens
gauaaugggaggagcaucu

SEQ ID NO: 646987 - RNA, 19 nt, Homo sapiens
uuaaggagcuugccucaua

SEQ ID NO: 646988 - RNA, 19 nt, Homo sapiens
uagaagagguucauccaua

SEQ ID NO: 646989 - RNA, 19 nt, Homo sapiens
ccagauggcuguucuucua

SEQ ID NO: 646990 - RNA, 19 nt, Homo sapiens
gcaagaacguuaggagaaa

SEQ ID NO: 646991 - RNA, 19 nt, Homo sapiens
uaaagcaucugccaaugaa

SEQ ID NO: 646992 - RNA, 19 nt, Homo sapiens
gaagaaagaggauggauuc

SEQ ID NO: 646993 - RNA, 19 nt, Homo sapiens
gaaaggguauagugguauu

SEQ ID NO: 646994 - RNA, 19 nt, Homo sapiens
guggaaagguuaugacaaa

SEQ ID NO: 646995 - RNA, 19 nt, Homo sapiens
gagcuugccucauacaaug

SEQ ID NO: 646996 - RNA, 19 nt, Homo sapiens
ucaacuagaucgacagaaa

SEQ ID NO: 646997 - RNA, 19 nt, Homo sapiens
ccaaaggccuggucucuca

SEQ ID NO: 646998 - RNA, 19 nt, Homo sapiens
gagcucagcccaagggaua

SEQ ID NO: 646999 - RNA, 19 nt, Homo sapiens
gauggcuguucuucuauua

SEQ ID NO: 647000 - RNA, 19 nt, Homo sapiens
aaacugacauggacuacaa

SEQ ID NO: 647001 - RNA, 19 nt, Homo sapiens
cucguucgcuguaauauua

SEQ ID NO: 647002 - RNA, 19 nt, Homo sapiens
gaacagacuggaauacaga

SEQ ID NO: 647003 - RNA, 19 nt, Homo sapiens
aagaugcacuucaccauaa

SEQ ID NO: 647004 - RNA, 19 nt, Homo sapiens
ccacuaaugucgcagaugu

SEQ ID NO: 647005 - RNA, 19 nt, Homo sapiens
agaaagaagugucuaugug

SEQ ID NO: 647006 - RNA, 19 nt, Homo sapiens
gcuguaauauuaaguugga

SEQ ID NO: 647007 - RNA, 19 nt, Homo sapiens
ggguauagugguauuaaua

SEQ ID NO: 647008 - RNA, 19 nt, Homo sapiens
guaaagcaucugccaauga

SEQ ID NO: 647009 - RNA, 19 nt, Homo sapiens
cccaagagguuaugauuca

SEQ ID NO: 647010 - RNA, 19 nt, Homo sapiens
ccgaaaggguauaguggua

SEQ ID NO: 647011 - RNA, 19 nt, Homo sapiens
gaaagguuaugacaaacag

SEQ ID NO: 647012 - RNA, 19 nt, Homo sapiens
ucaagaacuuugugaauac

SEQ ID NO: 647013 - RNA, 19 nt, Homo sapiens
gaauacagaacaagacuca

SEQ ID NO: 647014 - RNA, 19 nt, Homo sapiens
gaacuuccagaucuacaaa

SEQ ID NO: 647015 - RNA, 19 nt, Homo sapiens
gaauccauguuaaaguaug

SEQ ID NO: 647016 - RNA, 19 nt, Homo sapiens
gugaggcacuuaaggaaug

SEQ ID NO: 647017 - RNA, 19 nt, Homo sapiens
acagagacauuguagugaa

SEQ ID NO: 647018 - RNA, 19 nt, Homo sapiens
ggugggcaaagaaauauua

SEQ ID NO: 647019 - RNA, 19 nt, Homo sapiens
aaaggugggcaaagaaaua

SEQ ID NO: 647020 - RNA, 19 nt, Homo sapiens
ucuaagaacucuccuaaaa

SEQ ID NO: 647021 - RNA, 19 nt, Homo sapiens
caauuguacuggaagaaug

SEQ ID NO: 647022 - RNA, 19 nt, Homo sapiens
ggaacaggccaaugagaga

SEQ ID NO: 647023 - RNA, 19 nt, Homo sapiens
gcacugaauacagaaguaa

SEQ ID NO: 647024 - RNA, 19 nt, Homo sapiens
ccauaaggcuaacagaaag

SEQ ID NO: 647025 - RNA, 19 nt, Homo sapiens
gcacuuaaggaaugacaga

SEQ ID NO: 647026 - RNA, 19 nt, Homo sapiens
gaaaggugggcaaagaaau

SEQ ID NO: 647027 - RNA, 19 nt, Homo sapiens
gaaaggcagcuucaacucu

SEQ ID NO: 647028 - RNA, 19 nt, Homo sapiens
gguaaagcaucugccaaug

SEQ ID NO: 647029 - RNA, 19 nt, Homo sapiens
guuccaaucccgugucuuu

SEQ ID NO: 647030 - RNA, 19 nt, Homo sapiens
agacgcaacugaaacaaag

SEQ ID NO: 647031 - RNA, 19 nt, Homo sapiens
ccaaugagagagaguguga

SEQ ID NO: 647032 - RNA, 19 nt, Homo sapiens
cacaaagaauauggagaua

SEQ ID NO: 647033 - RNA, 19 nt, Homo sapiens
ggaaagguuaugacaaaca

SEQ ID NO: 647034 - RNA, 19 nt, Homo sapiens
gcauccauccugccucuuu

SEQ ID NO: 647035 - RNA, 19 nt, Homo sapiens
gagaaacuggacccuauug

SEQ ID NO: 647036 - RNA, 19 nt, Homo sapiens
gcugcuauuucgcacaauu

SEQ ID NO: 647037 - RNA, 19 nt, Homo sapiens
aaacaaugccagaagaaga

SEQ ID NO: 647038 - RNA, 19 nt, Homo sapiens
gauagaauccauguuaaag

SEQ ID NO: 647039 - RNA, 19 nt, Homo sapiens
agacaugcauaccucaguu

SEQ ID NO: 647040 - RNA, 19 nt, Homo sapiens
gaaacuggacccuauugca

SEQ ID NO: 647041 - RNA, 19 nt, Homo sapiens
gcagaaagaagugucuaug

SEQ ID NO: 647042 - RNA, 19 nt, Homo sapiens
cacagaaccuggugaagag

SEQ ID NO: 647043 - RNA, 19 nt, Homo sapiens
caagagguuaugauucaaa

SEQ ID NO: 647044 - RNA, 19 nt, Homo sapiens
aaaaugcacugaauacaga

SEQ ID NO: 647045 - RNA, 19 nt, Homo sapiens
ggauggauucacccagaua

SEQ ID NO: 647046 - RNA, 19 nt, Homo sapiens
gagacauuguagugaagaa

SEQ ID NO: 647047 - RNA, 19 nt, Homo sapiens
gagaaaggcagcuucaacu

SEQ ID NO: 647048 - RNA, 19 nt, Homo sapiens
acaaacaggaugacacuug

SEQ ID NO: 647049 - RNA, 19 nt, Homo sapiens
gagacgcaacugaaacaaa

SEQ ID NO: 647050 - RNA, 19 nt, Homo sapiens
gggcaaagaaauauuacug

SEQ ID NO: 647051 - RNA, 19 nt, Homo sapiens
ggacaacagacaugcauac

SEQ ID NO: 647052 - RNA, 19 nt, Homo sapiens
cagaugcacccacuaaugu

SEQ ID NO: 647053 - RNA, 19 nt, Homo sapiens
uugagaaacuggacccuau

SEQ ID NO: 647054 - RNA, 19 nt, Homo sapiens
acacaaagaauauggagau

SEQ ID NO: 647055 - RNA, 19 nt, Homo sapiens
ggagaaaggcagcuucaac

SEQ ID NO: 647056 - RNA, 19 nt, Homo sapiens
gcaauuguacuggaagaau

SEQ ID NO: 647057 - RNA, 19 nt, Homo sapiens
uauacgaccuuuggacaga

SEQ ID NO: 647058 - RNA, 19 nt, Homo sapiens
gaucucgugugggcuaaug

SEQ ID NO: 647059 - RNA, 19 nt, Homo sapiens
caucaagaacuuugugaau

SEQ ID NO: 647060 - RNA, 19 nt, Homo sapiens
ggcaaagaaauauuacuga

SEQ ID NO: 647061 - RNA, 19 nt, Homo sapiens
ugaaaggugggcaaagaaa

SEQ ID NO: 647062 - RNA, 19 nt, Homo sapiens
caaggugacagaagggaaa

SEQ ID NO: 647063 - RNA, 19 nt, Homo sapiens
acacagaaccuggugaaga

SEQ ID NO: 647064 - RNA, 19 nt, Homo sapiens
agacuggaauacagaacaa

SEQ ID NO: 647065 - RNA, 19 nt, Homo sapiens
gagcagcaccucaugaacu

SEQ ID NO: 647066 - RNA, 19 nt, Homo sapiens
ggagcuugccucauacaau

SEQ ID NO: 647067 - RNA, 19 nt, Homo sapiens
gguauagugguauuaauag

SEQ ID NO: 647068 - RNA, 19 nt, Homo sapiens
ugaagaaagaggauggauu

SEQ ID NO: 647069 - RNA, 19 nt, Homo sapiens
agugaaaggugggcaaaga

SEQ ID NO: 647070 - RNA, 19 nt, Homo sapiens
agaagagguucauccauac

SEQ ID NO: 647071 - RNA, 19 nt, Homo sapiens
caguaaguguggagagguu

SEQ ID NO: 647072 - RNA, 19 nt, Homo sapiens
cagaaagaagugucuaugu

SEQ ID NO: 647073 - RNA, 19 nt, Homo sapiens
ucagaugcacccacuaaug

SEQ ID NO: 647074 - RNA, 19 nt, Homo sapiens
gagguugaagcuauuguug

SEQ ID NO: 647075 - RNA, 19 nt, Homo sapiens
cccaggaguuugagguuga

SEQ ID NO: 647076 - RNA, 19 nt, Homo sapiens
ggguaaagcaucugccaau

SEQ ID NO: 647077 - RNA, 19 nt, Homo sapiens
gaagagguucauccauaca

SEQ ID NO: 647078 - RNA, 19 nt, Homo sapiens
gcauaccucaguuccaaga

SEQ ID NO: 647079 - RNA, 19 nt, Homo sapiens
ucagaaacuugagaaacug

SEQ ID NO: 647080 - RNA, 19 nt, Homo sapiens
cagagcagcaccucaugaa

SEQ ID NO: 647081 - RNA, 19 nt, Homo sapiens
agugugaggugcugaggaa

SEQ ID NO: 647082 - RNA, 19 nt, Homo sapiens
guuaauugcugggcgaaag

SEQ ID NO: 647083 - RNA, 19 nt, Homo sapiens
uaagaacucuccuaaaacu

SEQ ID NO: 647084 - RNA, 19 nt, Homo sapiens
ucaaacaaugccagaagaa

SEQ ID NO: 647085 - RNA, 19 nt, Homo sapiens
gguugaagcuauuguugac

SEQ ID NO: 647086 - RNA, 19 nt, Homo sapiens
ggacaccaucaagaacuuu

SEQ ID NO: 647087 - RNA, 19 nt, Homo sapiens
auaaaucacugcacuguua

SEQ ID NO: 647088 - RNA, 19 nt, Homo sapiens
ccaaaggucucacccauga

SEQ ID NO: 647089 - RNA, 19 nt, Homo sapiens
gaccagcucuucuucauug

SEQ ID NO: 647090 - RNA, 19 nt, Homo sapiens
ggacaaggaguaugaguuu

SEQ ID NO: 647091 - RNA, 19 nt, Homo sapiens
gcauccagcucucaguuaa

SEQ ID NO: 647092 - RNA, 19 nt, Homo sapiens
gaacagaaggcccaagaga

SEQ ID NO: 647093 - RNA, 19 nt, Homo sapiens
ugcaaagucuggucaauaa

SEQ ID NO: 647094 - RNA, 19 nt, Homo sapiens
gggagaacaucgcagauau

SEQ ID NO: 647095 - RNA, 19 nt, Homo sapiens
caacuucacugucuacaac

SEQ ID NO: 647096 - RNA, 19 nt, Homo sapiens
gcacuacgaugaguuccaa

SEQ ID NO: 647097 - RNA, 19 nt, Homo sapiens
gaugucagcuccauguaca

SEQ ID NO: 647098 - RNA, 19 nt, Homo sapiens
gcucaaugccuacuaucua

SEQ ID NO: 647099 - RNA, 19 nt, Homo sapiens
gggccaagcuccaguacau

SEQ ID NO: 647100 - RNA, 19 nt, Homo sapiens
agaagguccuggcagcaua

SEQ ID NO: 647101 - RNA, 19 nt, Homo sapiens
caaagucuggucaauaaau

SEQ ID NO: 647102 - RNA, 19 nt, Homo sapiens
caccuucgcuguguucuug

SEQ ID NO: 647103 - RNA, 19 nt, Homo sapiens
ggcaggagguggacaaguc

SEQ ID NO: 647104 - RNA, 19 nt, Homo sapiens
ucaaccggcugcuguacaa

SEQ ID NO: 647105 - RNA, 19 nt, Homo sapiens
uggaggagcuggacuggau

SEQ ID NO: 647106 - RNA, 19 nt, Homo sapiens
ccaggccaaucgccacuuu

SEQ ID NO: 647107 - RNA, 19 nt, Homo sapiens
uggaagacaucaaguacau

SEQ ID NO: 647108 - RNA, 19 nt, Homo sapiens
gcaaagucuggucaauaaa

SEQ ID NO: 647109 - RNA, 19 nt, Homo sapiens
ugacggcgcacuacgauga

SEQ ID NO: 647110 - RNA, 19 nt, Homo sapiens
ggagaacaucgcagauaug

SEQ ID NO: 647111 - RNA, 19 nt, Homo sapiens
ccuacuaucuacccaacaa

SEQ ID NO: 647112 - RNA, 19 nt, Homo sapiens
cccaagagauccugcaagu

SEQ ID NO: 647113 - RNA, 19 nt, Homo sapiens
caugaacccugcccacaag

SEQ ID NO: 647114 - RNA, 19 nt, Homo sapiens
gggcaucggcaccaucauu

SEQ ID NO: 647115 - RNA, 19 nt, Homo sapiens
gcucucaguuaagaagauu

SEQ ID NO: 647116 - RNA, 19 nt, Homo sapiens
gccaggacuucuacucguu

SEQ ID NO: 647117 - RNA, 19 nt, Homo sapiens
gggcugugagggaaauaua

SEQ ID NO: 647118 - RNA, 19 nt, Homo sapiens
gaacccugcccacaagugu

SEQ ID NO: 647119 - RNA, 19 nt, Homo sapiens
cauacaggguguucaugga

SEQ ID NO: 647120 - RNA, 19 nt, Homo sapiens
acgacaagcucaccuaugg

SEQ ID NO: 647121 - RNA, 19 nt, Homo sapiens
aaagucuggucaauaaauc

SEQ ID NO: 647122 - RNA, 19 nt, Homo sapiens
acaaggaguaugaguuuga

SEQ ID NO: 647123 - RNA, 19 nt, Homo sapiens
gacaaggaguaugaguuug

SEQ ID NO: 647124 - RNA, 19 nt, Homo sapiens
gccaagcuccaguacauga

SEQ ID NO: 647125 - RNA, 19 nt, Homo sapiens
uaaaucacugcacuguuaa

SEQ ID NO: 647126 - RNA, 19 nt, Homo sapiens
ggcagugugucccaguuug

SEQ ID NO: 647127 - RNA, 19 nt, Homo sapiens
caauaaaucacugcacugu

SEQ ID NO: 647128 - RNA, 19 nt, Homo sapiens
gggugaggcuggacuuugg

SEQ ID NO: 647129 - RNA, 19 nt, Homo sapiens
gcagugugucccaguuuga

SEQ ID NO: 647130 - RNA, 19 nt, Homo sapiens
gagaacaucgcagauaugg

SEQ ID NO: 647131 - RNA, 19 nt, Homo sapiens
gacccugacuucccacagu

SEQ ID NO: 647132 - RNA, 19 nt, Homo sapiens
ucagcuccauguacaacaa

SEQ ID NO: 647133 - RNA, 19 nt, Homo sapiens
acagaaggcccaagagauc

SEQ ID NO: 647134 - RNA, 19 nt, Homo sapiens
ccgaugcuguggacaagga

SEQ ID NO: 647135 - RNA, 19 nt, Homo sapiens
ggaggacuucucagaggaa

SEQ ID NO: 647136 - RNA, 19 nt, Homo sapiens
cgagaugucagcuccaugu

SEQ ID NO: 647137 - RNA, 19 nt, Homo sapiens
cugcaaagucuggucaaua

SEQ ID NO: 647138 - RNA, 19 nt, Homo sapiens
gagaugucagcuccaugua

SEQ ID NO: 647139 - RNA, 19 nt, Homo sapiens
uccaagaggucaaguacgu

SEQ ID NO: 647140 - RNA, 19 nt, Homo sapiens
gugcaucguccgucucuau

SEQ ID NO: 647141 - RNA, 19 nt, Homo sapiens
aguuugagguccaugagaa

SEQ ID NO: 647142 - RNA, 19 nt, Homo sapiens
gggcagugugucccaguuu

SEQ ID NO: 647143 - RNA, 19 nt, Homo sapiens
agaccuacuucaagaacau

SEQ ID NO: 647144 - RNA, 19 nt, Homo sapiens
ugcagcagcuaguggaaga

SEQ ID NO: 647145 - RNA, 19 nt, Homo sapiens
acaucacugugucagagua

SEQ ID NO: 647146 - RNA, 19 nt, Homo sapiens
ccaugaacccugcccacaa

SEQ ID NO: 647147 - RNA, 19 nt, Homo sapiens
caaggaguaugaguuugag

SEQ ID NO: 647148 - RNA, 19 nt, Homo sapiens
gcugcaaagucuggucaau

SEQ ID NO: 647149 - RNA, 19 nt, Homo sapiens
gugcagacgcuguggaaca

SEQ ID NO: 647150 - RNA, 19 nt, Homo sapiens
gcaucguccgucucuauga

SEQ ID NO: 647151 - RNA, 19 nt, Homo sapiens
ggcaucggcaccaucauug

SEQ ID NO: 647152 - RNA, 19 nt, Homo sapiens
uaguggaagacaucaagua

SEQ ID NO: 647153 - RNA, 19 nt, Homo sapiens
gcagcuaguggaagacauc

SEQ ID NO: 647154 - RNA, 19 nt, Homo sapiens
gcucuucuucauugccuuu

SEQ ID NO: 647155 - RNA, 19 nt, Homo sapiens
cggcucaaguacacacaug

SEQ ID NO: 647156 - RNA, 19 nt, Homo sapiens
ggcgcucaaugccuacuau

SEQ ID NO: 647157 - RNA, 19 nt, Homo sapiens
gggcagcugcagaagauca

SEQ ID NO: 647158 - RNA, 19 nt, Homo sapiens
ucacugugucagaguauga

SEQ ID NO: 647159 - RNA, 19 nt, Homo sapiens
gagaagguccuggcagcau

SEQ ID NO: 647160 - RNA, 19 nt, Homo sapiens
cagcauccagcucucaguu

SEQ ID NO: 647161 - RNA, 19 nt, Homo sapiens
cggcuaugcuggcccucaa

SEQ ID NO: 647162 - RNA, 19 nt, Homo sapiens
gcuaguggaagacaucaag

SEQ ID NO: 647163 - RNA, 19 nt, Homo sapiens
ucauugccuuugcccagaa

SEQ ID NO: 647164 - RNA, 19 nt, Homo sapiens
cuaccacgccuaucagaag

SEQ ID NO: 647165 - RNA, 19 nt, Homo sapiens
cgacgacaagcucaccuau

SEQ ID NO: 647166 - RNA, 19 nt, Homo sapiens
gacgacaagcucaccuaug

SEQ ID NO: 647167 - RNA, 19 nt, Homo sapiens
gcuacgucauccgcauuga

SEQ ID NO: 647168 - RNA, 19 nt, Homo sapiens
ugucccaguuugaggaguu

SEQ ID NO: 647169 - RNA, 19 nt, Homo sapiens
ggcggucgcaguccaucua

SEQ ID NO: 647170 - RNA, 19 nt, Homo sapiens
cacaugaccagcucuucuu

SEQ ID NO: 647171 - RNA, 19 nt, Homo sapiens
gccucaagcuggccuacca

SEQ ID NO: 647172 - RNA, 19 nt, Homo sapiens
ugcaggugcugacugacaa

SEQ ID NO: 647173 - RNA, 19 nt, Homo sapiens
ugaccagcucuucuucauu

SEQ ID NO: 647174 - RNA, 19 nt, Homo sapiens
ucccacagucucucaacua

SEQ ID NO: 647175 - RNA, 19 nt, Homo sapiens
ggaugaggacagugagaag

SEQ ID NO: 647176 - RNA, 19 nt, Homo sapiens
gaccuacggcgagauguca

SEQ ID NO: 647177 - RNA, 19 nt, Homo sapiens
gaagaaaucuggucuaauu

SEQ ID NO: 647178 - RNA, 19 nt, Homo sapiens
gaauggagcuuaucacuga

SEQ ID NO: 647179 - RNA, 19 nt, Homo sapiens
gcagaugccuucuucguua

SEQ ID NO: 647180 - RNA, 19 nt, Homo sapiens
caucauguaucgcauauua

SEQ ID NO: 647181 - RNA, 19 nt, Homo sapiens
caacaacuaugacgaauca

SEQ ID NO: 647182 - RNA, 19 nt, Homo sapiens
guuaugauguuuacccuua

SEQ ID NO: 647183 - RNA, 19 nt, Homo sapiens
aggcaaaucuucguuauua

SEQ ID NO: 647184 - RNA, 19 nt, Homo sapiens
gauauuccaucuucaaguu

SEQ ID NO: 647185 - RNA, 19 nt, Homo sapiens
gggaagaaaucuggucuaa

SEQ ID NO: 647186 - RNA, 19 nt, Homo sapiens
aaacagagaagaagacuuu

SEQ ID NO: 647187 - RNA, 19 nt, Homo sapiens
ugacucaucccaacauuua

SEQ ID NO: 647188 - RNA, 19 nt, Homo sapiens
ggccuuggcuuguaugauu

SEQ ID NO: 647189 - RNA, 19 nt, Homo sapiens
uaguagcccuucagucuua

SEQ ID NO: 647190 - RNA, 19 nt, Homo sapiens
ucacaaccauugcaucuug

SEQ ID NO: 647191 - RNA, 19 nt, Homo sapiens
ggaaacugcugcuuuagag

SEQ ID NO: 647192 - RNA, 19 nt, Homo sapiens
gauauggauuuacggcuuu

SEQ ID NO: 647193 - RNA, 19 nt, Homo sapiens
uaauucagguuacguggua

SEQ ID NO: 647194 - RNA, 19 nt, Homo sapiens
ugucuuagcugcaaggaaa

SEQ ID NO: 647195 - RNA, 19 nt, Homo sapiens
ggaaaacuguuaucugauu

SEQ ID NO: 647196 - RNA, 19 nt, Homo sapiens
gaacaaucaucuucuccau

SEQ ID NO: 647197 - RNA, 19 nt, Homo sapiens
ugaaggagcuguguuaagu

SEQ ID NO: 647198 - RNA, 19 nt, Homo sapiens
gauaagccacucauagaaa

SEQ ID NO: 647199 - RNA, 19 nt, Homo sapiens
gagauguucugauaaaugg

SEQ ID NO: 647200 - RNA, 19 nt, Homo sapiens
uaacaucugcuaucgagua

SEQ ID NO: 647201 - RNA, 19 nt, Homo sapiens
ggaggcaaaucuucguuau

SEQ ID NO: 647202 - RNA, 19 nt, Homo sapiens
ugucauggcuucaguacuu

SEQ ID NO: 647203 - RNA, 19 nt, Homo sapiens
uaauaacccugcagacuuc

SEQ ID NO: 647204 - RNA, 19 nt, Homo sapiens
gaauaucaaugggaucaug

SEQ ID NO: 647205 - RNA, 19 nt, Homo sapiens
acaaucaucuucuccauuc

SEQ ID NO: 647206 - RNA, 19 nt, Homo sapiens
gcaaaucuucguuauuaga

SEQ ID NO: 647207 - RNA, 19 nt, Homo sapiens
gaaaaccaguugagaaaga

SEQ ID NO: 647208 - RNA, 19 nt, Homo sapiens
gaaagaacccaagacauca

SEQ ID NO: 647209 - RNA, 19 nt, Homo sapiens
ccagaugucuuccaguaau

SEQ ID NO: 647210 - RNA, 19 nt, Homo sapiens
aguggaaacugcugcuuua

SEQ ID NO: 647211 - RNA, 19 nt, Homo sapiens
cgaagaauauuugguaaag

SEQ ID NO: 647212 - RNA, 19 nt, Homo sapiens
gacaaaagcugaauuacau

SEQ ID NO: 647213 - RNA, 19 nt, Homo sapiens
caacuccuccuucuacaaa

SEQ ID NO: 647214 - RNA, 19 nt, Homo sapiens
ggacaucauuaauggagau

SEQ ID NO: 647215 - RNA, 19 nt, Homo sapiens
gaaggcauuuacugaagga

SEQ ID NO: 647216 - RNA, 19 nt, Homo sapiens
ugaaagaacccaagacauc

SEQ ID NO: 647217 - RNA, 19 nt, Homo sapiens
ggagauguucugauaaaug

SEQ ID NO: 647218 - RNA, 19 nt, Homo sapiens
gaaaucacaacaaacugaa

SEQ ID NO: 647219 - RNA, 19 nt, Homo sapiens
gguuauaggugccauuuac

SEQ ID NO: 647220 - RNA, 19 nt, Homo sapiens
ggauaagccacucauagaa

SEQ ID NO: 647221 - RNA, 19 nt, Homo sapiens
gcacaugcuugguggucuu

SEQ ID NO: 647222 - RNA, 19 nt, Homo sapiens
cagagaagaagacuuuaaa

SEQ ID NO: 647223 - RNA, 19 nt, Homo sapiens
guauaggaauggagcuuau

SEQ ID NO: 647224 - RNA, 19 nt, Homo sapiens
agaguuaggucuggauaaa

SEQ ID NO: 647225 - RNA, 19 nt, Homo sapiens
aaggagcuguguuaaguuu

SEQ ID NO: 647226 - RNA, 19 nt, Homo sapiens
guuauuagaugucuuagcu

SEQ ID NO: 647227 - RNA, 19 nt, Homo sapiens
caugaaaccuggucucaac

SEQ ID NO: 647228 - RNA, 19 nt, Homo sapiens
gauccugagccuuugguua

SEQ ID NO: 647229 - RNA, 19 nt, Homo sapiens
cagguuacgugguacaaga

SEQ ID NO: 647230 - RNA, 19 nt, Homo sapiens
cuggagauguucugauaaa

SEQ ID NO: 647231 - RNA, 19 nt, Homo sapiens
aagaguggcuuucuaccuu

SEQ ID NO: 647232 - RNA, 19 nt, Homo sapiens
ccgcgacaguuuccaauga

SEQ ID NO: 647233 - RNA, 19 nt, Homo sapiens
gaccaucuguuuuguguuu

SEQ ID NO: 647234 - RNA, 19 nt, Homo sapiens
uaagaccgagcucuauuaa

SEQ ID NO: 647235 - RNA, 19 nt, Homo sapiens
aagaagcacuuugauugaa

SEQ ID NO: 647236 - RNA, 19 nt, Homo sapiens
ggcgaagaauauuugguaa

SEQ ID NO: 647237 - RNA, 19 nt, Homo sapiens
guacuggcgaagaauauuu

SEQ ID NO: 647238 - RNA, 19 nt, Homo sapiens
caacacuucucaugaccau

SEQ ID NO: 647239 - RNA, 19 nt, Homo sapiens
augaggauguuaccaagua

SEQ ID NO: 647240 - RNA, 19 nt, Homo sapiens
acaauugccuaccugaaau

SEQ ID NO: 647241 - RNA, 19 nt, Homo sapiens
uuacggcuuugcagcauaa

SEQ ID NO: 647242 - RNA, 19 nt, Homo sapiens
gagaagaagaagaagauca

SEQ ID NO: 647243 - RNA, 19 nt, Homo sapiens
uuaagaccgagcucuauua

SEQ ID NO: 647244 - RNA, 19 nt, Homo sapiens
ucacugauccuuccaucuu

SEQ ID NO: 647245 - RNA, 19 nt, Homo sapiens
cuccagaugucuuccagua

SEQ ID NO: 647246 - RNA, 19 nt, Homo sapiens
agaccgagcucuauuaagc

SEQ ID NO: 647247 - RNA, 19 nt, Homo sapiens
acuacagagugucaucuua

SEQ ID NO: 647248 - RNA, 19 nt, Homo sapiens
guagcaacacuucucauga

SEQ ID NO: 647249 - RNA, 19 nt, Homo sapiens
ggacuaguauaggaaugga

SEQ ID NO: 647250 - RNA, 19 nt, Homo sapiens
ccugagauccugagccuuu

SEQ ID NO: 647251 - RNA, 19 nt, Homo sapiens
gcaaggaaagauccaagug

SEQ ID NO: 647252 - RNA, 19 nt, Homo sapiens
gaaggagcuguguuaaguu

SEQ ID NO: 647253 - RNA, 19 nt, Homo sapiens
ccuucagucuuaauacuuu

SEQ ID NO: 647254 - RNA, 19 nt, Homo sapiens
augaauagguagguuagua

SEQ ID NO: 647255 - RNA, 19 nt, Homo sapiens
cacaauugccuaccugaaa

SEQ ID NO: 647256 - RNA, 19 nt, Homo sapiens
gcgaagaauauuugguaaa

SEQ ID NO: 647257 - RNA, 19 nt, Homo sapiens
uacagagugucaucuuauu

SEQ ID NO: 647258 - RNA, 19 nt, Homo sapiens
acugugaggccuauaauaa

SEQ ID NO: 647259 - RNA, 19 nt, Homo sapiens
gcauuuguuuccucaucuu

SEQ ID NO: 647260 - RNA, 19 nt, Homo sapiens
gaucauugucacagucgua

SEQ ID NO: 647261 - RNA, 19 nt, Homo sapiens
ugaauuacaucaacuuucc

SEQ ID NO: 647262 - RNA, 19 nt, Homo sapiens
ucauagagccuuccaagca

SEQ ID NO: 647263 - RNA, 19 nt, Homo sapiens
uugauagccucaccuuauu

SEQ ID NO: 647264 - RNA, 19 nt, Homo sapiens
guuaguagcccuucagucu

SEQ ID NO: 647265 - RNA, 19 nt, Homo sapiens
ccugacaaguuauuacugu

SEQ ID NO: 647266 - RNA, 19 nt, Homo sapiens
agaaaucacaacaaacuga

SEQ ID NO: 647267 - RNA, 19 nt, Homo sapiens
gcaggauaagccacucaua

SEQ ID NO: 647268 - RNA, 19 nt, Homo sapiens
ugaaucagcugguuaucac

SEQ ID NO: 647269 - RNA, 19 nt, Homo sapiens
cccaacauuuacauccuua

SEQ ID NO: 647270 - RNA, 19 nt, Homo sapiens
uaguuaaucuccucagaca

SEQ ID NO: 647271 - RNA, 19 nt, Homo sapiens
caacauguacuggcgaaga

SEQ ID NO: 647272 - RNA, 19 nt, Homo sapiens
uauaggugccauuuacuuu

SEQ ID NO: 647273 - RNA, 19 nt, Homo sapiens
ccaguaaugucgaaguuuu

SEQ ID NO: 647274 - RNA, 19 nt, Homo sapiens
gagaagaagacuuuaaagc

SEQ ID NO: 647275 - RNA, 19 nt, Homo sapiens
cagcagcaauuguuuuaaa

SEQ ID NO: 647276 - RNA, 19 nt, Homo sapiens
uggcgaagaauauuuggua

SEQ ID NO: 647277 - RNA, 19 nt, Homo sapiens
gaagugggauguuaaugaa

SEQ ID NO: 647278 - RNA, 19 nt, Homo sapiens
gaggucaucugcaauagua

SEQ ID NO: 647279 - RNA, 19 nt, Homo sapiens
ggaggaagcccacauauuc

SEQ ID NO: 647280 - RNA, 19 nt, Homo sapiens
gcccacauauucuauuaua

SEQ ID NO: 647281 - RNA, 19 nt, Homo sapiens
ggaaggcgcugguguugug

SEQ ID NO: 647282 - RNA, 19 nt, Homo sapiens
aagcaaagguuacauguga

SEQ ID NO: 647283 - RNA, 19 nt, Homo sapiens
gugaacauguuaagaguaa

SEQ ID NO: 647284 - RNA, 19 nt, Homo sapiens
ucaaacagguggaggaguu

SEQ ID NO: 647285 - RNA, 19 nt, Homo sapiens
gaggaggcauucuucuaaa

SEQ ID NO: 647286 - RNA, 19 nt, Homo sapiens
gaagugguccagaaacaaa

SEQ ID NO: 647287 - RNA, 19 nt, Homo sapiens
gaaaucaaguuccaguaac

SEQ ID NO: 647288 - RNA, 19 nt, Homo sapiens
gcaauaguauggcuaagac

SEQ ID NO: 647289 - RNA, 19 nt, Homo sapiens
gaucguaguguguuuaaau

SEQ ID NO: 647290 - RNA, 19 nt, Homo sapiens
cgaggaggcauucuucuaa

SEQ ID NO: 647291 - RNA, 19 nt, Homo sapiens
gggaagugguccagaaaca

SEQ ID NO: 647292 - RNA, 19 nt, Homo sapiens
ugaaaucaaguuccaguaa

SEQ ID NO: 647293 - RNA, 19 nt, Homo sapiens
aagcccacauauucuauua

SEQ ID NO: 647294 - RNA, 19 nt, Homo sapiens
gguuacaugugaguauuaa

SEQ ID NO: 647295 - RNA, 19 nt, Homo sapiens
ugaagugggauguuaauga

SEQ ID NO: 647296 - RNA, 19 nt, Homo sapiens
guaccgcacacuagucaua

SEQ ID NO: 647297 - RNA, 19 nt, Homo sapiens
ucaaagaccucagcaagac

SEQ ID NO: 647298 - RNA, 19 nt, Homo sapiens
uaacccaaaucuuguuuac

SEQ ID NO: 647299 - RNA, 19 nt, Homo sapiens
gcaaguaccgcacacuagu

SEQ ID NO: 647300 - RNA, 19 nt, Homo sapiens
cuccaagccuuucguggua

SEQ ID NO: 647301 - RNA, 19 nt, Homo sapiens
gaggaggagugccgcaagu

SEQ ID NO: 647302 - RNA, 19 nt, Homo sapiens
acacacacuugcugucaau

SEQ ID NO: 647303 - RNA, 19 nt, Homo sapiens
cugauucccuguggugaua

SEQ ID NO: 647304 - RNA, 19 nt, Homo sapiens
ggauguuaaugaaaucaag

SEQ ID NO: 647305 - RNA, 19 nt, Homo sapiens
cuauggaggucaucugcaa

SEQ ID NO: 647306 - RNA, 19 nt, Homo sapiens
guaggaaggcgcugguguu

SEQ ID NO: 647307 - RNA, 19 nt, Homo sapiens
gaagcccacauauucuauu

SEQ ID NO: 647308 - RNA, 19 nt, Homo sapiens
gaggaucguaguguguuua

SEQ ID NO: 647309 - RNA, 19 nt, Homo sapiens
gauaagccgaggaggcauu

SEQ ID NO: 647310 - RNA, 19 nt, Homo sapiens
ggaagugguccagaaacaa

SEQ ID NO: 647311 - RNA, 19 nt, Homo sapiens
guaacccaaaucuuguuua

SEQ ID NO: 647312 - RNA, 19 nt, Homo sapiens
ggaagcccacauauucuau

SEQ ID NO: 647313 - RNA, 19 nt, Homo sapiens
guggugauaccuauaaaga

SEQ ID NO: 647314 - RNA, 19 nt, Homo sapiens
gaggcauucuucuaaagca

SEQ ID NO: 647315 - RNA, 19 nt, Homo sapiens
cgugguaucugugaacaug

SEQ ID NO: 647316 - RNA, 19 nt, Homo sapiens
uguccucuuucuccuauuu

SEQ ID NO: 647317 - RNA, 19 nt, Homo sapiens
uacggagaguguacgauuu

SEQ ID NO: 647318 - RNA, 19 nt, Homo sapiens
cuacggagaguguacgauu

SEQ ID NO: 647319 - RNA, 19 nt, Homo sapiens
gucagugcauuucaaggaa

SEQ ID NO: 647320 - RNA, 19 nt, Homo sapiens
cacacuugcugucaauguu

SEQ ID NO: 647321 - RNA, 19 nt, Homo sapiens
gcugcgaccucucugucuu

SEQ ID NO: 647322 - RNA, 19 nt, Homo sapiens
gcaaagguuacaugugagu

SEQ ID NO: 647323 - RNA, 19 nt, Homo sapiens
aaauauucgugguaucugu

SEQ ID NO: 647324 - RNA, 19 nt, Homo sapiens
gcccugaggaggucaaaga

SEQ ID NO: 647325 - RNA, 19 nt, Homo sapiens
gcaguuugcccugaacaug

SEQ ID NO: 647326 - RNA, 19 nt, Homo sapiens
uaagaguaauuuggaugug

SEQ ID NO: 647327 - RNA, 19 nt, Homo sapiens
ccaguaacccaaaucuugu

SEQ ID NO: 647328 - RNA, 19 nt, Homo sapiens
uccaguaacccaaaucuug

SEQ ID NO: 647329 - RNA, 19 nt, Homo sapiens
caaguuccaguaacccaaa

SEQ ID NO: 647330 - RNA, 19 nt, Homo sapiens
gucaaagaccucagcaaga

SEQ ID NO: 647331 - RNA, 19 nt, Homo sapiens
gcuaugagcgggucaacag

SEQ ID NO: 647332 - RNA, 19 nt, Homo sapiens
agugggauguuaaugaaau

SEQ ID NO: 647333 - RNA, 19 nt, Homo sapiens
cggaggaagcccacauauu

SEQ ID NO: 647334 - RNA, 19 nt, Homo sapiens
ucaccacgcugggcaucuu

SEQ ID NO: 647335 - RNA, 19 nt, Homo sapiens
ccaccugccuuccauuuug

SEQ ID NO: 647336 - RNA, 19 nt, Homo sapiens
gaggaagcccacauauucu

SEQ ID NO: 647337 - RNA, 19 nt, Homo sapiens
aagguuacaugugaguauu

SEQ ID NO: 647338 - RNA, 19 nt, Homo sapiens
ggaucguaguguguuuaaa

SEQ ID NO: 647339 - RNA, 19 nt, Homo sapiens
agaggaucguaguguguuu

SEQ ID NO: 647340 - RNA, 19 nt, Homo sapiens
ucaaccuccuggacuacaa

SEQ ID NO: 647341 - RNA, 19 nt, Homo sapiens
ccgaggaggcauucuucua

SEQ ID NO: 647342 - RNA, 19 nt, Homo sapiens
caguuugcccugaacauga

SEQ ID NO: 647343 - RNA, 19 nt, Homo sapiens
ggucaucugcaauaguaug

SEQ ID NO: 647344 - RNA, 19 nt, Homo sapiens
aaagguuacaugugaguau

SEQ ID NO: 647345 - RNA, 19 nt, Homo sapiens
caaagguuacaugugagua

SEQ ID NO: 647346 - RNA, 19 nt, Homo sapiens
ugguaucugugaacauguu

SEQ ID NO: 647347 - RNA, 19 nt, Homo sapiens
acacuugcugucaauguuu

SEQ ID NO: 647348 - RNA, 19 nt, Homo sapiens
aauaaucacacacacacuu

SEQ ID NO: 647349 - RNA, 19 nt, Homo sapiens
ucaagacacuacggagagu

SEQ ID NO: 647350 - RNA, 19 nt, Homo sapiens
uaaagggugugcgcgucuu

SEQ ID NO: 647351 - RNA, 19 nt, Homo sapiens
gacgaccgcgugugcaaga

SEQ ID NO: 647352 - RNA, 19 nt, Homo sapiens
ccuguggugauaccuauaa

SEQ ID NO: 647353 - RNA, 19 nt, Homo sapiens
ggaagccccgucucuaaaa

SEQ ID NO: 647354 - RNA, 19 nt, Homo sapiens
ccgcaaguaccgcacacua

SEQ ID NO: 647355 - RNA, 19 nt, Homo sapiens
ggaggagugccgcaaguac

SEQ ID NO: 647356 - RNA, 19 nt, Homo sapiens
gaccgcgugugcaagaagu

SEQ ID NO: 647357 - RNA, 19 nt, Homo sapiens
gguaucugugaacauguua

SEQ ID NO: 647358 - RNA, 19 nt, Homo sapiens
cucuuucuccuauuucuua

SEQ ID NO: 647359 - RNA, 19 nt, Homo sapiens
cacacacacuugcugucaa

SEQ ID NO: 647360 - RNA, 19 nt, Homo sapiens
ggaggucaucugcaauagu

SEQ ID NO: 647361 - RNA, 19 nt, Homo sapiens
ccgagguguucuuucucua

SEQ ID NO: 647362 - RNA, 19 nt, Homo sapiens
acaagcggcagcuggugua

SEQ ID NO: 647363 - RNA, 19 nt, Homo sapiens
augaagguguuccguagga

SEQ ID NO: 647364 - RNA, 19 nt, Homo sapiens
gcgagcuauucaaccagaa

SEQ ID NO: 647365 - RNA, 19 nt, Homo sapiens
aaagaggaucguagugugu

SEQ ID NO: 647366 - RNA, 19 nt, Homo sapiens
gcgcagccaccaacaaggu

SEQ ID NO: 647367 - RNA, 19 nt, Homo sapiens
ucucugucuuccaguugua

SEQ ID NO: 647368 - RNA, 19 nt, Homo sapiens
ggauugugccugugaugag

SEQ ID NO: 647369 - RNA, 19 nt, Homo sapiens
ucaaggaacagccacaaaa

SEQ ID NO: 647370 - RNA, 19 nt, Homo sapiens
aggaagcccacauauucua

SEQ ID NO: 647371 - RNA, 19 nt, Homo sapiens
gaaucccgagguguucuuu

SEQ ID NO: 647372 - RNA, 19 nt, Homo sapiens
uggagcaguuugcccugaa

SEQ ID NO: 647373 - RNA, 19 nt, Homo sapiens
ggagcaguuugcccugaac

SEQ ID NO: 647374 - RNA, 19 nt, Homo sapiens
guucuucggcgagcuauuc

SEQ ID NO: 647375 - RNA, 19 nt, Homo sapiens
cuuguccucuuucuccuau

SEQ ID NO: 647376 - RNA, 19 nt, Homo sapiens
auaaagaggaucguagugu

SEQ ID NO: 647377 - RNA, 19 nt, Homo sapiens
ggacauuacugguguagaa

SEQ ID NO: 647378 - RNA, 19 nt, Homo sapiens
ggacuaagauaagcgauga

SEQ ID NO: 647379 - RNA, 19 nt, Homo sapiens
gauaagcgaugaugaugau

SEQ ID NO: 647380 - RNA, 19 nt, Homo sapiens
gaggaagacucaggacauu

SEQ ID NO: 647381 - RNA, 19 nt, Homo sapiens
uaaggaggcuucagcacuu

SEQ ID NO: 647382 - RNA, 19 nt, Homo sapiens
caccaugacugaucugaga

SEQ ID NO: 647383 - RNA, 19 nt, Homo sapiens
gagaagaaaggcuggugua

SEQ ID NO: 647384 - RNA, 19 nt, Homo sapiens
gcuuggaccucucgauuca

SEQ ID NO: 647385 - RNA, 19 nt, Homo sapiens
aagaaaggcugguguaagg

SEQ ID NO: 647386 - RNA, 19 nt, Homo sapiens
gaaucuaccgcccuucuga

SEQ ID NO: 647387 - RNA, 19 nt, Homo sapiens
gaagaaaggcugguguaag

SEQ ID NO: 647388 - RNA, 19 nt, Homo sapiens
uaagauaagcgaugaugau

SEQ ID NO: 647389 - RNA, 19 nt, Homo sapiens
gauucuaucuggugguauc

SEQ ID NO: 647390 - RNA, 19 nt, Homo sapiens
ggaagacucaggacauuac

SEQ ID NO: 647391 - RNA, 19 nt, Homo sapiens
ucaguuuccucaccuguag

SEQ ID NO: 647392 - RNA, 19 nt, Homo sapiens
uaccaucccugucccuuca

SEQ ID NO: 647393 - RNA, 19 nt, Homo sapiens
cuaaguccgucagauucua

SEQ ID NO: 647394 - RNA, 19 nt, Homo sapiens
aagcgaugaugaugaugaa

SEQ ID NO: 647395 - RNA, 19 nt, Homo sapiens
uaagcgaugaugaugauga

SEQ ID NO: 647396 - RNA, 19 nt, Homo sapiens
guugcaaggacuaagauaa

SEQ ID NO: 647397 - RNA, 19 nt, Homo sapiens
gaugaugaacacacuuugu

SEQ ID NO: 647398 - RNA, 19 nt, Homo sapiens
ucucuaaguccgucagauu

SEQ ID NO: 647399 - RNA, 19 nt, Homo sapiens
ggaccucucgauucacaau

SEQ ID NO: 647400 - RNA, 19 nt, Homo sapiens
gcgaugaugaugaugaaca

SEQ ID NO: 647401 - RNA, 19 nt, Homo sapiens
ggggacauaugguggaaaa

SEQ ID NO: 647402 - RNA, 19 nt, Homo sapiens
gcuggcuucuucacuguca

SEQ ID NO: 647403 - RNA, 19 nt, Homo sapiens
acaacucugucucuaaguc

SEQ ID NO: 647404 - RNA, 19 nt, Homo sapiens
ucaggacauuacuggugua

SEQ ID NO: 647405 - RNA, 19 nt, Homo sapiens
agaagaaaggcugguguaa

SEQ ID NO: 647406 - RNA, 19 nt, Homo sapiens
ccaaggcucagguacuuca

SEQ ID NO: 647407 - RNA, 19 nt, Homo sapiens
ggacuccucguagccaaga

SEQ ID NO: 647408 - RNA, 19 nt, Homo sapiens
ccucaccuguagagagaga

SEQ ID NO: 647409 - RNA, 19 nt, Homo sapiens
gcucucaggcacaauccaa

SEQ ID NO: 647410 - RNA, 19 nt, Homo sapiens
cuaccgcccuucugacaac

SEQ ID NO: 647411 - RNA, 19 nt, Homo sapiens
cauuacugguguagaaucu

SEQ ID NO: 647412 - RNA, 19 nt, Homo sapiens
uuccucaccuguagagaga

SEQ ID NO: 647413 - RNA, 19 nt, Homo sapiens
gcuccaagcccaggacgau

SEQ ID NO: 647414 - RNA, 19 nt, Homo sapiens
cuaagauaagcgaugauga

SEQ ID NO: 647415 - RNA, 19 nt, Homo sapiens
ggagaaggcugaacacaca

SEQ ID NO: 647416 - RNA, 19 nt, Homo sapiens
ccacauaggcucagucuuu

SEQ ID NO: 647417 - RNA, 19 nt, Homo sapiens
gaacagugaauaaaugguu

SEQ ID NO: 647418 - RNA, 19 nt, Homo sapiens
caauacagcugcaucuauc

SEQ ID NO: 647419 - RNA, 19 nt, Homo sapiens
gugguaaucugaauguuau

SEQ ID NO: 647420 - RNA, 19 nt, Homo sapiens
gaacacacagacucuuuga

SEQ ID NO: 647421 - RNA, 19 nt, Homo sapiens
gggagucacugcagggaaa

SEQ ID NO: 647422 - RNA, 19 nt, Homo sapiens
agacgggacuccagaaaga

SEQ ID NO: 647423 - RNA, 19 nt, Homo sapiens
gggaagauccagccacgua

SEQ ID NO: 647424 - RNA, 19 nt, Homo sapiens
gcaauacagcugcaucuau

SEQ ID NO: 647425 - RNA, 19 nt, Homo sapiens
ugggagaacuacaugcuaa

SEQ ID NO: 647426 - RNA, 19 nt, Homo sapiens
gcaggaagaggacuagaga

SEQ ID NO: 647427 - RNA, 19 nt, Homo sapiens
aauaccagcugcacuuuga

SEQ ID NO: 647428 - RNA, 19 nt, Homo sapiens
gaagaaugaccaugagaca

SEQ ID NO: 647429 - RNA, 19 nt, Homo sapiens
gaacuacaugcuaaauuuc

SEQ ID NO: 647430 - RNA, 19 nt, Homo sapiens
gagaacuacaugcuaaauu

SEQ ID NO: 647431 - RNA, 19 nt, Homo sapiens
ggucagagcccagcaacuu

SEQ ID NO: 647432 - RNA, 19 nt, Homo sapiens
ggacacuggcauuccauuu

SEQ ID NO: 647433 - RNA, 19 nt, Homo sapiens
gcagagggugggagaacua

SEQ ID NO: 647434 - RNA, 19 nt, Homo sapiens
ggccauggguggaucugaa

SEQ ID NO: 647435 - RNA, 19 nt, Homo sapiens
ggaucacacugcccagaau

SEQ ID NO: 647436 - RNA, 19 nt, Homo sapiens
ggugguaacagaaauguau

SEQ ID NO: 647437 - RNA, 19 nt, Homo sapiens
ucugaaagcugguguugag

SEQ ID NO: 647438 - RNA, 19 nt, Homo sapiens
cagcugcacuuugaaggaa

SEQ ID NO: 647439 - RNA, 19 nt, Homo sapiens
acacuggcauuccauuugu

SEQ ID NO: 647440 - RNA, 19 nt, Homo sapiens
agugaacagugaauaaaug

SEQ ID NO: 647441 - RNA, 19 nt, Homo sapiens
gaauaccagcugcacuuug

SEQ ID NO: 647442 - RNA, 19 nt, Homo sapiens
caacuuugugguaaucuga

SEQ ID NO: 647443 - RNA, 19 nt, Homo sapiens
gacacuggcauuccauuug

SEQ ID NO: 647444 - RNA, 19 nt, Homo sapiens
ugugguaaucugaauguua

SEQ ID NO: 647445 - RNA, 19 nt, Homo sapiens
gcagcagacucucccaaaa

SEQ ID NO: 647446 - RNA, 19 nt, Homo sapiens
gaucugaaagcugguguug

SEQ ID NO: 647447 - RNA, 19 nt, Homo sapiens
aaauacuagugaacaguga

SEQ ID NO: 647448 - RNA, 19 nt, Homo sapiens
ggagaacuacaugcuaaau

SEQ ID NO: 647449 - RNA, 19 nt, Homo sapiens
gagggacacuggcauucca

SEQ ID NO: 647450 - RNA, 19 nt, Homo sapiens
gaaauuauggggcuguuga

SEQ ID NO: 647451 - RNA, 19 nt, Homo sapiens
cgacagagcgagacuccau

SEQ ID NO: 647452 - RNA, 19 nt, Homo sapiens
acacacagacucuuugaag

SEQ ID NO: 647453 - RNA, 19 nt, Homo sapiens
gaagauccagccacguaca

SEQ ID NO: 647454 - RNA, 19 nt, Homo sapiens
ggaagguccaggcggaguu

SEQ ID NO: 647455 - RNA, 19 nt, Homo sapiens
gaaucugagcgaugucuuc

SEQ ID NO: 647456 - RNA, 19 nt, Homo sapiens
cuagugaacagugaauaaa

SEQ ID NO: 647457 - RNA, 19 nt, Homo sapiens
gguaaucugaauguuauug

SEQ ID NO: 647458 - RNA, 19 nt, Homo sapiens
aaagagggacacuggcauu

SEQ ID NO: 647459 - RNA, 19 nt, Homo sapiens
agaaugaccaugagacaca

SEQ ID NO: 647460 - RNA, 19 nt, Homo sapiens
ucacaggcgacauugagaa

SEQ ID NO: 647461 - RNA, 19 nt, Homo sapiens
gggagaacuacaugcuaaa

SEQ ID NO: 647462 - RNA, 19 nt, Homo sapiens
gggaucacacugcccagaa

SEQ ID NO: 647463 - RNA, 19 nt, Homo sapiens
gagcgagccagcagagcuu

SEQ ID NO: 647464 - RNA, 19 nt, Homo sapiens
ggucacaggcgacauugag

SEQ ID NO: 647465 - RNA, 19 nt, Homo sapiens
aagacuggcucagcaggaa

SEQ ID NO: 647466 - RNA, 19 nt, Homo sapiens
guaaauacuagugaacagu

SEQ ID NO: 647467 - RNA, 19 nt, Homo sapiens
gaccuucuacugccgucua

SEQ ID NO: 647468 - RNA, 19 nt, Homo sapiens
acuagugaacagugaauaa

SEQ ID NO: 647469 - RNA, 19 nt, Homo sapiens
ucuguugccagggaaauua

SEQ ID NO: 647470 - RNA, 19 nt, Homo sapiens
ugaacacacagacucuuug

SEQ ID NO: 647471 - RNA, 19 nt, Homo sapiens
gagacgggacuccagaaag

SEQ ID NO: 647472 - RNA, 19 nt, Homo sapiens
cugagcggauuaacaaagu

SEQ ID NO: 647473 - RNA, 19 nt, Homo sapiens
gccaggaaacacaacuuug

SEQ ID NO: 647474 - RNA, 19 nt, Homo sapiens
ugaauaccagcugcacuuu

SEQ ID NO: 647475 - RNA, 19 nt, Homo sapiens
ccagugagccagugaagcu

SEQ ID NO: 647476 - RNA, 19 nt, Homo sapiens
ugugguuccugguugaaga

SEQ ID NO: 647477 - RNA, 19 nt, Homo sapiens
gaucacacugcccagaauc

SEQ ID NO: 647478 - RNA, 19 nt, Homo sapiens
caccagccuugcaccugaa

SEQ ID NO: 647479 - RNA, 19 nt, Homo sapiens
cuacugccgucuagacacu

SEQ ID NO: 647480 - RNA, 19 nt, Homo sapiens
guaacagaaauguaugaca

SEQ ID NO: 647481 - RNA, 19 nt, Homo sapiens
ggcaauacagcugcaucua

SEQ ID NO: 647482 - RNA, 19 nt, Homo sapiens
cugaacacacagacucuuu

SEQ ID NO: 647483 - RNA, 19 nt, Homo sapiens
uagugugguuccugguuga

SEQ ID NO: 647484 - RNA, 19 nt, Homo sapiens
gaaaagcaagugaccaucu

SEQ ID NO: 647485 - RNA, 19 nt, Homo sapiens
cacauaggcucagucuuuu

SEQ ID NO: 647486 - RNA, 19 nt, Homo sapiens
gaagguccaggcggaguuc

SEQ ID NO: 647487 - RNA, 19 nt, Homo sapiens
uguaaauacuagugaacag

SEQ ID NO: 647488 - RNA, 19 nt, Homo sapiens
gagggugggagaacuacau

SEQ ID NO: 647489 - RNA, 19 nt, Homo sapiens
gccauggguggaucugaaa

SEQ ID NO: 647490 - RNA, 19 nt, Homo sapiens
ggcaggagaaggcugaaca

SEQ ID NO: 647491 - RNA, 19 nt, Homo sapiens
ccagcagagcuuccacuug

SEQ ID NO: 647492 - RNA, 19 nt, Homo sapiens
ccacguacagcgcggauac

SEQ ID NO: 647493 - RNA, 19 nt, Homo sapiens
cacccacccucucgguuca

SEQ ID NO: 647494 - RNA, 19 nt, Homo sapiens
ggaaagaaaugccugcuua

SEQ ID NO: 647495 - RNA, 19 nt, Homo sapiens
caagagagguuauagcaua

SEQ ID NO: 647496 - RNA, 19 nt, Homo sapiens
gcaaugaccuguauuugga

SEQ ID NO: 647497 - RNA, 19 nt, Homo sapiens
ggaaugcccuucuaaaugu

SEQ ID NO: 647498 - RNA, 19 nt, Homo sapiens
gagaugaguuguagcuaua

SEQ ID NO: 647499 - RNA, 19 nt, Homo sapiens
ggauucaucucaauagaaa

SEQ ID NO: 647500 - RNA, 19 nt, Homo sapiens
gaaccgagccuugauauug

SEQ ID NO: 647501 - RNA, 19 nt, Homo sapiens
gaaauggaauuaugaggau

SEQ ID NO: 647502 - RNA, 19 nt, Homo sapiens
caacucauguaacagauuu

SEQ ID NO: 647503 - RNA, 19 nt, Homo sapiens
aaacaaggcuucauauucu

SEQ ID NO: 647504 - RNA, 19 nt, Homo sapiens
gcacaugaauuaucacaag

SEQ ID NO: 647505 - RNA, 19 nt, Homo sapiens
ucuaagagaucaaguaaga

SEQ ID NO: 647506 - RNA, 19 nt, Homo sapiens
ugagucaucuucauacuuu

SEQ ID NO: 647507 - RNA, 19 nt, Homo sapiens
cagcagagucuaagaaaua

SEQ ID NO: 647508 - RNA, 19 nt, Homo sapiens
gacuugaacuuacuguaua

SEQ ID NO: 647509 - RNA, 19 nt, Homo sapiens
ggacaacuuucucucauuc

SEQ ID NO: 647510 - RNA, 19 nt, Homo sapiens
auaacacucugcacuauua

SEQ ID NO: 647511 - RNA, 19 nt, Homo sapiens
gauuggcuauagaguauua

SEQ ID NO: 647512 - RNA, 19 nt, Homo sapiens
gauaaacucugacacucuu

SEQ ID NO: 647513 - RNA, 19 nt, Homo sapiens
gaauuggcauugcgaaaga

SEQ ID NO: 647514 - RNA, 19 nt, Homo sapiens
gagcaaacaaggcuucaua

SEQ ID NO: 647515 - RNA, 19 nt, Homo sapiens
ccgcagggcuggugucuaa

SEQ ID NO: 647516 - RNA, 19 nt, Homo sapiens
acaccaagcacaugaauua

SEQ ID NO: 647517 - RNA, 19 nt, Homo sapiens
uaagauugcucuauugugu

SEQ ID NO: 647518 - RNA, 19 nt, Homo sapiens
aaacggaaguuauagaaga

SEQ ID NO: 647519 - RNA, 19 nt, Homo sapiens
gagaacucguuguaugaua

SEQ ID NO: 647520 - RNA, 19 nt, Homo sapiens
caagaaauauccagagaag

SEQ ID NO: 647521 - RNA, 19 nt, Homo sapiens
gaaaugaagcccagguuug

SEQ ID NO: 647522 - RNA, 19 nt, Homo sapiens
gcaauaugcuagguuuaaa

SEQ ID NO: 647523 - RNA, 19 nt, Homo sapiens
aagaaaugccugcuuauua

SEQ ID NO: 647524 - RNA, 19 nt, Homo sapiens
caagagagaacucguugua

SEQ ID NO: 647525 - RNA, 19 nt, Homo sapiens
cuaggaggcuuauauaaau

SEQ ID NO: 647526 - RNA, 19 nt, Homo sapiens
ccaagcacaugaauuauca

SEQ ID NO: 647527 - RNA, 19 nt, Homo sapiens
gacaugguauggaaguaua

SEQ ID NO: 647528 - RNA, 19 nt, Homo sapiens
gguagaaacuauuuaugga

SEQ ID NO: 647529 - RNA, 19 nt, Homo sapiens
caaacaaggcuucauauuc

SEQ ID NO: 647530 - RNA, 19 nt, Homo sapiens
ccugacagaugauguaauu

SEQ ID NO: 647531 - RNA, 19 nt, Homo sapiens
ugaaugcgaucacacugua

SEQ ID NO: 647532 - RNA, 19 nt, Homo sapiens
gcaaagaaguugggaaugc

SEQ ID NO: 647533 - RNA, 19 nt, Homo sapiens
cagauuuccugguauauga

SEQ ID NO: 647534 - RNA, 19 nt, Homo sapiens
cagauuggcuauagaguau

SEQ ID NO: 647535 - RNA, 19 nt, Homo sapiens
gaacugaaccgagccuuga

SEQ ID NO: 647536 - RNA, 19 nt, Homo sapiens
aguaaagucugcugaauga

SEQ ID NO: 647537 - RNA, 19 nt, Homo sapiens
caaguaagauacauguugu

SEQ ID NO: 647538 - RNA, 19 nt, Homo sapiens
guagcacccauuuaaauua

SEQ ID NO: 647539 - RNA, 19 nt, Homo sapiens
gcaaacaaggcuucauauu

SEQ ID NO: 647540 - RNA, 19 nt, Homo sapiens
gaaaugcgcuaugaaugca

SEQ ID NO: 647541 - RNA, 19 nt, Homo sapiens
ccaaaucacuggagacucu

SEQ ID NO: 647542 - RNA, 19 nt, Homo sapiens
gcagggcgaggacugauua

SEQ ID NO: 647543 - RNA, 19 nt, Homo sapiens
gcccgugucuuuaccagua

SEQ ID NO: 647544 - RNA, 19 nt, Homo sapiens
gagcaaguagagaagauua

SEQ ID NO: 647545 - RNA, 19 nt, Homo sapiens
caaaguuucuuacugaagu

SEQ ID NO: 647546 - RNA, 19 nt, Homo sapiens
gaucaucacugcccuacca

SEQ ID NO: 647547 - RNA, 19 nt, Homo sapiens
ccagguuuguuauuucaua

SEQ ID NO: 647548 - RNA, 19 nt, Homo sapiens
gcaaggauaaacuccauuu

SEQ ID NO: 647549 - RNA, 19 nt, Homo sapiens
ggacuugaacuuacuguau

SEQ ID NO: 647550 - RNA, 19 nt, Homo sapiens
uagaagcagugaugauauu

SEQ ID NO: 647551 - RNA, 19 nt, Homo sapiens
gcacugcucucaggcuuau

SEQ ID NO: 647552 - RNA, 19 nt, Homo sapiens
gagagaacucguuguauga

SEQ ID NO: 647553 - RNA, 19 nt, Homo sapiens
agagagaacucguuguaug

SEQ ID NO: 647554 - RNA, 19 nt, Homo sapiens
caaaucuccuggucccuuu

SEQ ID NO: 647555 - RNA, 19 nt, Homo sapiens
gcaacucaauaaaugcauu

SEQ ID NO: 647556 - RNA, 19 nt, Homo sapiens
gggaaugcccuucuaaaug

SEQ ID NO: 647557 - RNA, 19 nt, Homo sapiens
ggaaaugaagcccagguuu

SEQ ID NO: 647558 - RNA, 19 nt, Homo sapiens
ggauuuaucagucagcuuu

SEQ ID NO: 647559 - RNA, 19 nt, Homo sapiens
gaucugagaccgaggagaa

SEQ ID NO: 647560 - RNA, 19 nt, Homo sapiens
cgaaagacuugaaaacuaa

SEQ ID NO: 647561 - RNA, 19 nt, Homo sapiens
gcgaaagacuugaaaacua

SEQ ID NO: 647562 - RNA, 19 nt, Homo sapiens
agaaauauccagagaaguu

SEQ ID NO: 647563 - RNA, 19 nt, Homo sapiens
guauggaaguauaacauug

SEQ ID NO: 647564 - RNA, 19 nt, Homo sapiens
uuaaugacaugguauggaa

SEQ ID NO: 647565 - RNA, 19 nt, Homo sapiens
caugggagcucugguagaa

SEQ ID NO: 647566 - RNA, 19 nt, Homo sapiens
gcaauucauuucuggaagu

SEQ ID NO: 647567 - RNA, 19 nt, Homo sapiens
ccaguggauuguuaaguuu

SEQ ID NO: 647568 - RNA, 19 nt, Homo sapiens
acauaaaucucuugguaga

SEQ ID NO: 647569 - RNA, 19 nt, Homo sapiens
gugaugauauucagauugu

SEQ ID NO: 647570 - RNA, 19 nt, Homo sapiens
gaagaccgaauuccaguug

SEQ ID NO: 647571 - RNA, 19 nt, Homo sapiens
uaaauaagcagcacaagca

SEQ ID NO: 647572 - RNA, 19 nt, Homo sapiens
agacugcuuuguugagaua

SEQ ID NO: 647573 - RNA, 19 nt, Homo sapiens
agaaaugccugcuuauuac

SEQ ID NO: 647574 - RNA, 19 nt, Homo sapiens
agaaauauauccgucuuug

SEQ ID NO: 647575 - RNA, 19 nt, Homo sapiens
ugaaagagcaaguagagaa

SEQ ID NO: 647576 - RNA, 19 nt, Homo sapiens
gaauuccaguugcuuuaug

SEQ ID NO: 647577 - RNA, 19 nt, Homo sapiens
cauauuggauuguucuuca

SEQ ID NO: 647578 - RNA, 19 nt, Homo sapiens
guauaacacucugcacuau

SEQ ID NO: 647579 - RNA, 19 nt, Homo sapiens
gagcacugguuacagaaug

SEQ ID NO: 647580 - RNA, 19 nt, Homo sapiens
gagcaacucauguaacaga

SEQ ID NO: 647581 - RNA, 19 nt, Homo sapiens
ucaaaggauuuaucaguca

SEQ ID NO: 647582 - RNA, 19 nt, Homo sapiens
uagcauauaucuuggaaag

SEQ ID NO: 647583 - RNA, 19 nt, Homo sapiens
agagguaucugugaucaaa

SEQ ID NO: 647584 - RNA, 19 nt, Homo sapiens
gaaauauauccgucuuuga

SEQ ID NO: 647585 - RNA, 19 nt, Homo sapiens
guagaaauauauccgucuu

SEQ ID NO: 647586 - RNA, 19 nt, Homo sapiens
ccagugacuuaucuguaua

SEQ ID NO: 647587 - RNA, 19 nt, Homo sapiens
gucagcaacucaauaaaug

SEQ ID NO: 647588 - RNA, 19 nt, Homo sapiens
gaaagaaaugccugcuuau

SEQ ID NO: 647589 - RNA, 19 nt, Homo sapiens
gagaagauuuugacaauuc

SEQ ID NO: 647590 - RNA, 19 nt, Homo sapiens
gaggacauuugcagauuuc

SEQ ID NO: 647591 - RNA, 19 nt, Homo sapiens
uagagcaacucauguaaca

SEQ ID NO: 647592 - RNA, 19 nt, Homo sapiens
guuuacagaugaaugacua

SEQ ID NO: 647593 - RNA, 19 nt, Homo sapiens
ugguggaucugguuguuua

SEQ ID NO: 647594 - RNA, 19 nt, Homo sapiens
ggaaagaaaugccugcuua

SEQ ID NO: 647595 - RNA, 19 nt, Homo sapiens
caagagagguuauagcaua

SEQ ID NO: 647596 - RNA, 19 nt, Homo sapiens
cagcaaggguuccaaauua

SEQ ID NO: 647597 - RNA, 19 nt, Homo sapiens
gcaaugaccuguauuugga

SEQ ID NO: 647598 - RNA, 19 nt, Homo sapiens
ggaaugcccuucuaaaugu

SEQ ID NO: 647599 - RNA, 19 nt, Homo sapiens
gagaugaguuguagcuaua

SEQ ID NO: 647600 - RNA, 19 nt, Homo sapiens
ggauucaucucaauagaaa

SEQ ID NO: 647601 - RNA, 19 nt, Homo sapiens
gaaccgagccuugauauug

SEQ ID NO: 647602 - RNA, 19 nt, Homo sapiens
gaaauggaauuaugaggau

SEQ ID NO: 647603 - RNA, 19 nt, Homo sapiens
caacucauguaacagauuu

SEQ ID NO: 647604 - RNA, 19 nt, Homo sapiens
gcacaugaauuaucacaag

SEQ ID NO: 647605 - RNA, 19 nt, Homo sapiens
ugagucaucuucauacuuu

SEQ ID NO: 647606 - RNA, 19 nt, Homo sapiens
cagcagagucuaagaaaua

SEQ ID NO: 647607 - RNA, 19 nt, Homo sapiens
ggacaacuuucucucauuc

SEQ ID NO: 647608 - RNA, 19 nt, Homo sapiens
auaacacucugcacuauua

SEQ ID NO: 647609 - RNA, 19 nt, Homo sapiens
gauuggcuauagaguauua

SEQ ID NO: 647610 - RNA, 19 nt, Homo sapiens
aagcagaccuugaacauug

SEQ ID NO: 647611 - RNA, 19 nt, Homo sapiens
gauaaacucugacacucuu

SEQ ID NO: 647612 - RNA, 19 nt, Homo sapiens
gcucguggcuguaaggaaa

SEQ ID NO: 647613 - RNA, 19 nt, Homo sapiens
ccgcagggcuggugucuaa

SEQ ID NO: 647614 - RNA, 19 nt, Homo sapiens
acaccaagcacaugaauua

SEQ ID NO: 647615 - RNA, 19 nt, Homo sapiens
uaagauugcucuauugugu

SEQ ID NO: 647616 - RNA, 19 nt, Homo sapiens
aaacggaaguuauagaaga

SEQ ID NO: 647617 - RNA, 19 nt, Homo sapiens
gagaacucguuguaugaua

SEQ ID NO: 647618 - RNA, 19 nt, Homo sapiens
caagaaauauccagagaag

SEQ ID NO: 647619 - RNA, 19 nt, Homo sapiens
gaaaugaagcccagguuug

SEQ ID NO: 647620 - RNA, 19 nt, Homo sapiens
gcaauaugcuagguuuaaa

SEQ ID NO: 647621 - RNA, 19 nt, Homo sapiens
aagaaaugccugcuuauua

SEQ ID NO: 647622 - RNA, 19 nt, Homo sapiens
caagagagaacucguugua

SEQ ID NO: 647623 - RNA, 19 nt, Homo sapiens
cuaggaggcuuauauaaau

SEQ ID NO: 647624 - RNA, 19 nt, Homo sapiens
uaaauaagcagaccuugaa

SEQ ID NO: 647625 - RNA, 19 nt, Homo sapiens
ccaagcacaugaauuauca

SEQ ID NO: 647626 - RNA, 19 nt, Homo sapiens
gacaugguauggaaguaua

SEQ ID NO: 647627 - RNA, 19 nt, Homo sapiens
gguagaaacuauuuaugga

SEQ ID NO: 647628 - RNA, 19 nt, Homo sapiens
gcaaagaaguugggaaugc

SEQ ID NO: 647629 - RNA, 19 nt, Homo sapiens
cagauuuccugguauauga

SEQ ID NO: 647630 - RNA, 19 nt, Homo sapiens
cagauuggcuauagaguau

SEQ ID NO: 647631 - RNA, 19 nt, Homo sapiens
gaacugaaccgagccuuga

SEQ ID NO: 647632 - RNA, 19 nt, Homo sapiens
guagcacccauuuaaauua

SEQ ID NO: 647633 - RNA, 19 nt, Homo sapiens
gaaaugcgcuaugaaugca

SEQ ID NO: 647634 - RNA, 19 nt, Homo sapiens
ccaaaucacuggagacucu

SEQ ID NO: 647635 - RNA, 19 nt, Homo sapiens
gcagggcgaggacugauua

SEQ ID NO: 647636 - RNA, 19 nt, Homo sapiens
gagcaaguagagaagauua

SEQ ID NO: 647637 - RNA, 19 nt, Homo sapiens
caaaguuucuuacugaagu

SEQ ID NO: 647638 - RNA, 19 nt, Homo sapiens
gaucaucacugcccuacca

SEQ ID NO: 647639 - RNA, 19 nt, Homo sapiens
ccagguuuguuauuucaua

SEQ ID NO: 647640 - RNA, 19 nt, Homo sapiens
gcaaggauaaacuccauuu

SEQ ID NO: 647641 - RNA, 19 nt, Homo sapiens
gcacugcucucaggcuuau

SEQ ID NO: 647642 - RNA, 19 nt, Homo sapiens
gagagaacucguuguauga

SEQ ID NO: 647643 - RNA, 19 nt, Homo sapiens
agagagaacucguuguaug

SEQ ID NO: 647644 - RNA, 19 nt, Homo sapiens
caaaucuccuggucccuuu

SEQ ID NO: 647645 - RNA, 19 nt, Homo sapiens
gcaacucaauaaaugcauu

SEQ ID NO: 647646 - RNA, 19 nt, Homo sapiens
gggaaugcccuucuaaaug

SEQ ID NO: 647647 - RNA, 19 nt, Homo sapiens
ggaaaugaagcccagguuu

SEQ ID NO: 647648 - RNA, 19 nt, Homo sapiens
ggauuuaucagucagcuuu

SEQ ID NO: 647649 - RNA, 19 nt, Homo sapiens
gaucugagaccgaggagaa

SEQ ID NO: 647650 - RNA, 19 nt, Homo sapiens
agaaauauccagagaaguu

SEQ ID NO: 647651 - RNA, 19 nt, Homo sapiens
guauggaaguauaacauug

SEQ ID NO: 647652 - RNA, 19 nt, Homo sapiens
uuaaugacaugguauggaa

SEQ ID NO: 647653 - RNA, 19 nt, Homo sapiens
caugggagcucugguagaa

SEQ ID NO: 647654 - RNA, 19 nt, Homo sapiens
gcaauucauuucuggaagu

SEQ ID NO: 647655 - RNA, 19 nt, Homo sapiens
ccaguggauuguuaaguuu

SEQ ID NO: 647656 - RNA, 19 nt, Homo sapiens
gaagaccgaauuccaguug

SEQ ID NO: 647657 - RNA, 19 nt, Homo sapiens
agacugcuuuguugagaua

SEQ ID NO: 647658 - RNA, 19 nt, Homo sapiens
agaaaugccugcuuauuac

SEQ ID NO: 647659 - RNA, 19 nt, Homo sapiens
gcaaaacgcugcccagauc

SEQ ID NO: 647660 - RNA, 19 nt, Homo sapiens
caaauuaagaggaagcaaa

SEQ ID NO: 647661 - RNA, 19 nt, Homo sapiens
ugaaagagcaaguagagaa

SEQ ID NO: 647662 - RNA, 19 nt, Homo sapiens
gaauuccaguugcuuuaug

SEQ ID NO: 647663 - RNA, 19 nt, Homo sapiens
cauauuggauuguucuuca

SEQ ID NO: 647664 - RNA, 19 nt, Homo sapiens
guauaacacucugcacuau

SEQ ID NO: 647665 - RNA, 19 nt, Homo sapiens
gagcacugguuacagaaug

SEQ ID NO: 647666 - RNA, 19 nt, Homo sapiens
gagcaacucauguaacaga

SEQ ID NO: 647667 - RNA, 19 nt, Homo sapiens
ucaaaggauuuaucaguca

SEQ ID NO: 647668 - RNA, 19 nt, Homo sapiens
uagcauauaucuuggaaag

SEQ ID NO: 647669 - RNA, 19 nt, Homo sapiens
ccagugacuuaucuguaua

SEQ ID NO: 647670 - RNA, 19 nt, Homo sapiens
gucagcaacucaauaaaug

SEQ ID NO: 647671 - RNA, 19 nt, Homo sapiens
gaaagaaaugccugcuuau

SEQ ID NO: 647672 - RNA, 19 nt, Homo sapiens
gagaagauuuugacaauuc

SEQ ID NO: 647673 - RNA, 19 nt, Homo sapiens
gaggacauuugcagauuuc

SEQ ID NO: 647674 - RNA, 19 nt, Homo sapiens
uagagcaacucauguaaca

SEQ ID NO: 647675 - RNA, 19 nt, Homo sapiens
guuuacagaugaaugacua

SEQ ID NO: 647676 - RNA, 19 nt, Homo sapiens
ugguggaucugguuguuua

SEQ ID NO: 647677 - RNA, 19 nt, Homo sapiens
ccagagccauauuggauug

SEQ ID NO: 647678 - RNA, 19 nt, Homo sapiens
cagaugacaccuacuauug

SEQ ID NO: 647679 - RNA, 19 nt, Homo sapiens
gaaagccguuuuaaucuga

SEQ ID NO: 647680 - RNA, 19 nt, Homo sapiens
ggaacuugguguaaagaca

SEQ ID NO: 647681 - RNA, 19 nt, Homo sapiens
agaaccagcuccaucuuug

SEQ ID NO: 647682 - RNA, 19 nt, Homo sapiens
ugagaugaguuguagcuau

SEQ ID NO: 647683 - RNA, 19 nt, Homo sapiens
uacaggcucugauucaauu

SEQ ID NO: 647684 - RNA, 19 nt, Homo sapiens
gcagcagagucuaagaaau

SEQ ID NO: 647685 - RNA, 19 nt, Homo sapiens
gaaacuggauccugcuacu

SEQ ID NO: 647686 - RNA, 19 nt, Homo sapiens
ccacacugguuacuuggaa

SEQ ID NO: 647687 - RNA, 19 nt, Homo sapiens
gcuuugggccuuaacauuu

SEQ ID NO: 647688 - RNA, 19 nt, Homo sapiens
caauguugcuggcaugugu

SEQ ID NO: 647689 - RNA, 19 nt, Homo sapiens
acucauacauugucuuguu

SEQ ID NO: 647690 - RNA, 19 nt, Homo sapiens
gcaccucagucuaaucagu

SEQ ID NO: 647691 - RNA, 19 nt, Homo sapiens
cgauucaucacacacauua

SEQ ID NO: 647692 - RNA, 19 nt, Homo sapiens
gaaugcaauugguuugauc

SEQ ID NO: 647693 - RNA, 19 nt, Homo sapiens
gggaaugugugucuucgau

SEQ ID NO: 647694 - RNA, 19 nt, Homo sapiens
gaaaguggcagcaagauua

SEQ ID NO: 647695 - RNA, 19 nt, Homo sapiens
aaacagacauccugcuuua

SEQ ID NO: 647696 - RNA, 19 nt, Homo sapiens
gcaguuaucuauuucuuug

SEQ ID NO: 647697 - RNA, 19 nt, Homo sapiens
gaugguaucucacucugua

SEQ ID NO: 647698 - RNA, 19 nt, Homo sapiens
gggaagcuguucaaauuaa

SEQ ID NO: 647699 - RNA, 19 nt, Homo sapiens
gaacucggcucaagugauc

SEQ ID NO: 647700 - RNA, 19 nt, Homo sapiens
gcagaaagacugacuaaau

SEQ ID NO: 647701 - RNA, 19 nt, Homo sapiens
acaaggcuaugaacaaaua

SEQ ID NO: 647702 - RNA, 19 nt, Homo sapiens
ucaaagaaguucaguggaa

SEQ ID NO: 647703 - RNA, 19 nt, Homo sapiens
gaacagguuugcacuucuu

SEQ ID NO: 647704 - RNA, 19 nt, Homo sapiens
uaggcaagcucuccuuaua

SEQ ID NO: 647705 - RNA, 19 nt, Homo sapiens
uaaagugugcccauuaaua

SEQ ID NO: 647706 - RNA, 19 nt, Homo sapiens
aaagauaccugaagauuac

SEQ ID NO: 647707 - RNA, 19 nt, Homo sapiens
cagaaagacugacuaaauc

SEQ ID NO: 647708 - RNA, 19 nt, Homo sapiens
gcacuuagcccuugucuac

SEQ ID NO: 647709 - RNA, 19 nt, Homo sapiens
acauagagauggaagagua

SEQ ID NO: 647710 - RNA, 19 nt, Homo sapiens
gcucauuggucaaauauca

SEQ ID NO: 647711 - RNA, 19 nt, Homo sapiens
aaagagacuucaauucuga

SEQ ID NO: 647712 - RNA, 19 nt, Homo sapiens
gauguucucaguauuguua

SEQ ID NO: 647713 - RNA, 19 nt, Homo sapiens
gaagugcccugacagagau

SEQ ID NO: 647714 - RNA, 19 nt, Homo sapiens
gauaacaaauggagucauc

SEQ ID NO: 647715 - RNA, 19 nt, Homo sapiens
ucgggaagcuguucaaauu

SEQ ID NO: 647716 - RNA, 19 nt, Homo sapiens
gcagcaagauuaugguuca

SEQ ID NO: 647717 - RNA, 19 nt, Homo sapiens
caaagagacuucaauucug

SEQ ID NO: 647718 - RNA, 19 nt, Homo sapiens
ggcaauaggaggcagauua

SEQ ID NO: 647719 - RNA, 19 nt, Homo sapiens
ucacaaggcuaugaacaaa

SEQ ID NO: 647720 - RNA, 19 nt, Homo sapiens
gagcauaauuugcaucuac

SEQ ID NO: 647721 - RNA, 19 nt, Homo sapiens
gcaagauuaugguucaguu

SEQ ID NO: 647722 - RNA, 19 nt, Homo sapiens
uuaagaacauccucagaaa

SEQ ID NO: 647723 - RNA, 19 nt, Homo sapiens
ggaagcuguucaaauuaaa

SEQ ID NO: 647724 - RNA, 19 nt, Homo sapiens
ccagaaacuuugacuugaa

SEQ ID NO: 647725 - RNA, 19 nt, Homo sapiens
gaaguucaguggaauaaaa

SEQ ID NO: 647726 - RNA, 19 nt, Homo sapiens
cagcacaaaucuuauugaa

SEQ ID NO: 647727 - RNA, 19 nt, Homo sapiens
ccucagacguugcaauuga

SEQ ID NO: 647728 - RNA, 19 nt, Homo sapiens
ccuaaagugugcccauuaa

SEQ ID NO: 647729 - RNA, 19 nt, Homo sapiens
guuugcagaucaacuauaa

SEQ ID NO: 647730 - RNA, 19 nt, Homo sapiens
ggacuuggaccuauagaga

SEQ ID NO: 647731 - RNA, 19 nt, Homo sapiens
caagcucuccuuauaagua

SEQ ID NO: 647732 - RNA, 19 nt, Homo sapiens
ggauagauuuaggcucaua

SEQ ID NO: 647733 - RNA, 19 nt, Homo sapiens
gaucaacuauaagcacaaa

SEQ ID NO: 647734 - RNA, 19 nt, Homo sapiens
cagaaacuuugacuugaaa

SEQ ID NO: 647735 - RNA, 19 nt, Homo sapiens
aaacagaccuugaguucca

SEQ ID NO: 647736 - RNA, 19 nt, Homo sapiens
ccagauguuuccuaaagaa

SEQ ID NO: 647737 - RNA, 19 nt, Homo sapiens
ugauugaccucaccaguug

SEQ ID NO: 647738 - RNA, 19 nt, Homo sapiens
gcaauaggaggcagauuau

SEQ ID NO: 647739 - RNA, 19 nt, Homo sapiens
gauuaucucucagcccuuu

SEQ ID NO: 647740 - RNA, 19 nt, Homo sapiens
gcuuugaaaugcagaaguu

SEQ ID NO: 647741 - RNA, 19 nt, Homo sapiens
gcgagaagcagguccauga

SEQ ID NO: 647742 - RNA, 19 nt, Homo sapiens
gauguuuccuaaagaaguu

SEQ ID NO: 647743 - RNA, 19 nt, Homo sapiens
caugguacauuugaaguaa

SEQ ID NO: 647744 - RNA, 19 nt, Homo sapiens
caaagaaguucaguggaau

SEQ ID NO: 647745 - RNA, 19 nt, Homo sapiens
ugacuaugcuauuucaguu

SEQ ID NO: 647746 - RNA, 19 nt, Homo sapiens
gaaucuagugugaaaguuu

SEQ ID NO: 647747 - RNA, 19 nt, Homo sapiens
ucacaagucccucacauug

SEQ ID NO: 647748 - RNA, 19 nt, Homo sapiens
cauccugcuuuaacaauuu

SEQ ID NO: 647749 - RNA, 19 nt, Homo sapiens
cacaagagaaugagacuuu

SEQ ID NO: 647750 - RNA, 19 nt, Homo sapiens
cggcaacacuggaaacuuc

SEQ ID NO: 647751 - RNA, 19 nt, Homo sapiens
gaaaguaguaucauauagg

SEQ ID NO: 647752 - RNA, 19 nt, Homo sapiens
gaaaugcagaaguuuaugu

SEQ ID NO: 647753 - RNA, 19 nt, Homo sapiens
gcccuugucuacuaugauu

SEQ ID NO: 647754 - RNA, 19 nt, Homo sapiens
cagcaacucgccaagguua

SEQ ID NO: 647755 - RNA, 19 nt, Homo sapiens
aaaacaggcuccagauaua

SEQ ID NO: 647756 - RNA, 19 nt, Homo sapiens
gagcagcacaaaucuuauu

SEQ ID NO: 647757 - RNA, 19 nt, Homo sapiens
ucuaugauguucucaguau

SEQ ID NO: 647758 - RNA, 19 nt, Homo sapiens
aaauggagcugcuuauguc

SEQ ID NO: 647759 - RNA, 19 nt, Homo sapiens
guaauuacacugucuuauc

SEQ ID NO: 647760 - RNA, 19 nt, Homo sapiens
ggcaagcucuccuuauaag

SEQ ID NO: 647761 - RNA, 19 nt, Homo sapiens
aaccacgccuggcuaauuu

SEQ ID NO: 647762 - RNA, 19 nt, Homo sapiens
gaccuugaguuccaucaug

SEQ ID NO: 647763 - RNA, 19 nt, Homo sapiens
cuacagaagugcaggaucu

SEQ ID NO: 647764 - RNA, 19 nt, Homo sapiens
aaagugugcccauuaauau

SEQ ID NO: 647765 - RNA, 19 nt, Homo sapiens
gguuugcacuucuuggaaa

SEQ ID NO: 647766 - RNA, 19 nt, Homo sapiens
ggucuguucucccacuuga

SEQ ID NO: 647767 - RNA, 19 nt, Homo sapiens
caaccacgccuggcuaauu

SEQ ID NO: 647768 - RNA, 19 nt, Homo sapiens
ggagugcaguggugugauc

SEQ ID NO: 647769 - RNA, 19 nt, Homo sapiens
ugacaagugcuuugaaaug

SEQ ID NO: 647770 - RNA, 19 nt, Homo sapiens
agagauaacuuccaaaaga

SEQ ID NO: 647771 - RNA, 19 nt, Homo sapiens
ugaaauguuugcagaucaa

SEQ ID NO: 647772 - RNA, 19 nt, Homo sapiens
cugcuuaugucugcacuua

SEQ ID NO: 647773 - RNA, 19 nt, Homo sapiens
cuacaaagagacuucaauu

SEQ ID NO: 647774 - RNA, 19 nt, Homo sapiens
uggagcagcacaaaucuua

SEQ ID NO: 647775 - RNA, 19 nt, Homo sapiens
aaugacaagugcuuugaaa

SEQ ID NO: 647776 - RNA, 19 nt, Homo sapiens
gcacaaagaagagauaacu

SEQ ID NO: 647777 - RNA, 19 nt, Homo sapiens
uaaccaauguaaagaccuu

SEQ ID NO: 647778 - RNA, 19 nt, Homo sapiens
guuaugggcuggcaaguac

SEQ ID NO: 647779 - RNA, 19 nt, Homo sapiens
agagauggaagaguaauua

SEQ ID NO: 647780 - RNA, 19 nt, Homo sapiens
gauucgaguuguacauaga

SEQ ID NO: 647781 - RNA, 19 nt, Homo sapiens
guuuaugaaucuaguguga

SEQ ID NO: 647782 - RNA, 19 nt, Homo sapiens
ggaaggagugguaaaauuu

SEQ ID NO: 647783 - RNA, 19 nt, Homo sapiens
uccaucagcucucugcuuu

SEQ ID NO: 647784 - RNA, 19 nt, Homo sapiens
agcaggagcuacaggauuu

SEQ ID NO: 647785 - RNA, 19 nt, Homo sapiens
gggcagaaagacugacuaa

SEQ ID NO: 647786 - RNA, 19 nt, Homo sapiens
agaaguuuauguacaguug

SEQ ID NO: 647787 - RNA, 19 nt, Homo sapiens
gagcuucaguaaucaugug

SEQ ID NO: 647788 - RNA, 19 nt, Homo sapiens
gagcaggagcuacaggauu

SEQ ID NO: 647789 - RNA, 19 nt, Homo sapiens
ggaucucucuuuccucauc

SEQ ID NO: 647790 - RNA, 19 nt, Homo sapiens
acaaagagacuucaauucu

SEQ ID NO: 647791 - RNA, 19 nt, Homo sapiens
ugacagagauguguguucu

SEQ ID NO: 647792 - RNA, 19 nt, Homo sapiens
gacaagugcuuugaaaugc

SEQ ID NO: 647793 - RNA, 19 nt, Homo sapiens
gguaaugcaucugccauca

SEQ ID NO: 647794 - RNA, 19 nt, Homo sapiens
ggacagagcuggacaagca

SEQ ID NO: 647795 - RNA, 19 nt, Homo sapiens
guaccgaccucgagacuau

SEQ ID NO: 647796 - RNA, 19 nt, Homo sapiens
cgucaagccuguccgguua

SEQ ID NO: 647797 - RNA, 19 nt, Homo sapiens
gcuugaacauucugccuua

SEQ ID NO: 647798 - RNA, 19 nt, Homo sapiens
ccucgagacuauacgguua

SEQ ID NO: 647799 - RNA, 19 nt, Homo sapiens
caaagaggcacuugaggaa

SEQ ID NO: 647800 - RNA, 19 nt, Homo sapiens
gagcauccaugaccugaag

SEQ ID NO: 647801 - RNA, 19 nt, Homo sapiens
caacgacguccgcaagaaa

SEQ ID NO: 647802 - RNA, 19 nt, Homo sapiens
cccaaggucuccaaagcua

SEQ ID NO: 647803 - RNA, 19 nt, Homo sapiens
gagacuauacgguuaacuu

SEQ ID NO: 647804 - RNA, 19 nt, Homo sapiens
acacacaggguaacuggua

SEQ ID NO: 647805 - RNA, 19 nt, Homo sapiens
acaggacgaucucgacaga

SEQ ID NO: 647806 - RNA, 19 nt, Homo sapiens
agcggaagcucaccuuuga

SEQ ID NO: 647807 - RNA, 19 nt, Homo sapiens
caggguaacugguaugacu

SEQ ID NO: 647808 - RNA, 19 nt, Homo sapiens
ucaacgacguccgcaagaa

SEQ ID NO: 647809 - RNA, 19 nt, Homo sapiens
caagcacaguggcaagauc

SEQ ID NO: 647810 - RNA, 19 nt, Homo sapiens
uugggaagcucaucaacga

SEQ ID NO: 647811 - RNA, 19 nt, Homo sapiens
gaacuggaaggagcuguca

SEQ ID NO: 647812 - RNA, 19 nt, Homo sapiens
acuauacgguuaacuugga

SEQ ID NO: 647813 - RNA, 19 nt, Homo sapiens
aggacgaucucgacagaau

SEQ ID NO: 647814 - RNA, 19 nt, Homo sapiens
ucaagccuguccgguuaaa

SEQ ID NO: 647815 - RNA, 19 nt, Homo sapiens
ucgaacagacgaacuggaa

SEQ ID NO: 647816 - RNA, 19 nt, Homo sapiens
gcaagaaaaccaagaacga

SEQ ID NO: 647817 - RNA, 19 nt, Homo sapiens
agacuauacgguuaacuug

SEQ ID NO: 647818 - RNA, 19 nt, Homo sapiens
aagaggcacuugaggaaac

SEQ ID NO: 647819 - RNA, 19 nt, Homo sapiens
ccuccaaggcggacaguga

SEQ ID NO: 647820 - RNA, 19 nt, Homo sapiens
gaccugaagagccgcaaug

SEQ ID NO: 647821 - RNA, 19 nt, Homo sapiens
aaacacgacuugggaagcu

SEQ ID NO: 647822 - RNA, 19 nt, Homo sapiens
gacaagcacaguggcaaga

SEQ ID NO: 647823 - RNA, 19 nt, Homo sapiens
gagcaacauccggaacaug

SEQ ID NO: 647824 - RNA, 19 nt, Homo sapiens
ggacaggguggacgagacu

SEQ ID NO: 647825 - RNA, 19 nt, Homo sapiens
gagcgugacgagaaugaca

SEQ ID NO: 647826 - RNA, 19 nt, Homo sapiens
cgacuugggaagcucauca

SEQ ID NO: 647827 - RNA, 19 nt, Homo sapiens
cacacaggguaacugguau

SEQ ID NO: 647828 - RNA, 19 nt, Homo sapiens
aaagaggcacuugaggaaa

SEQ ID NO: 647829 - RNA, 19 nt, Homo sapiens
cacccaaggucuccaaagc

SEQ ID NO: 647830 - RNA, 19 nt, Homo sapiens
ggacgaucucgacagaauc

SEQ ID NO: 647831 - RNA, 19 nt, Homo sapiens
ccuggagcgugacgagaau

SEQ ID NO: 647832 - RNA, 19 nt, Homo sapiens
gccuggagcgugacgagaa

SEQ ID NO: 647833 - RNA, 19 nt, Homo sapiens
ggaaagguguugaaaguga

SEQ ID NO: 647834 - RNA, 19 nt, Homo sapiens
gaacaauaguaaagggaua

SEQ ID NO: 647835 - RNA, 19 nt, Homo sapiens
gaagauggcaagcuugaua

SEQ ID NO: 647836 - RNA, 19 nt, Homo sapiens
ggaaugagcccuuguguuc

SEQ ID NO: 647837 - RNA, 19 nt, Homo sapiens
caacauggcggacgugaua

SEQ ID NO: 647838 - RNA, 19 nt, Homo sapiens
ggacaaaacuccucucuau

SEQ ID NO: 647839 - RNA, 19 nt, Homo sapiens
gcauauaaguggucaaaca

SEQ ID NO: 647840 - RNA, 19 nt, Homo sapiens
gaaguuacauaaagcuguu

SEQ ID NO: 647841 - RNA, 19 nt, Homo sapiens
ugaaauguccauccacuua

SEQ ID NO: 647842 - RNA, 19 nt, Homo sapiens
gcacuuccaggacaacuua

SEQ ID NO: 647843 - RNA, 19 nt, Homo sapiens
gcaguaccaugcaggacua

SEQ ID NO: 647844 - RNA, 19 nt, Homo sapiens
gagaaugucuacacagaag

SEQ ID NO: 647845 - RNA, 19 nt, Homo sapiens
ccacugcccugcuccacua

SEQ ID NO: 647846 - RNA, 19 nt, Homo sapiens
caaauccaacuaucaagua

SEQ ID NO: 647847 - RNA, 19 nt, Homo sapiens
ggacuagcaucuggccuuu

SEQ ID NO: 647848 - RNA, 19 nt, Homo sapiens
uaaaucagcagucauugaa

SEQ ID NO: 647849 - RNA, 19 nt, Homo sapiens
ggucaaacaaguugcagua

SEQ ID NO: 647850 - RNA, 19 nt, Homo sapiens
aaacuccucucuauaguca

SEQ ID NO: 647851 - RNA, 19 nt, Homo sapiens
gaaagguguugaaagugau

SEQ ID NO: 647852 - RNA, 19 nt, Homo sapiens
ggacugaaggcaaagaaga

SEQ ID NO: 647853 - RNA, 19 nt, Homo sapiens
uaacgagaaugucuacaca

SEQ ID NO: 647854 - RNA, 19 nt, Homo sapiens
ggacuaauuauucccacua

SEQ ID NO: 647855 - RNA, 19 nt, Homo sapiens
gggaguaucugccaaacgu

SEQ ID NO: 647856 - RNA, 19 nt, Homo sapiens
gaaccauccucuucauaac

SEQ ID NO: 647857 - RNA, 19 nt, Homo sapiens
gaaauguccauccacuuau

SEQ ID NO: 647858 - RNA, 19 nt, Homo sapiens
caaacaaguugcaguacca

SEQ ID NO: 647859 - RNA, 19 nt, Homo sapiens
gaaagugaucgucgucaug

SEQ ID NO: 647860 - RNA, 19 nt, Homo sapiens
gagaaccauccucuucaua

SEQ ID NO: 647861 - RNA, 19 nt, Homo sapiens
gaugugaucagccgcauug

SEQ ID NO: 647862 - RNA, 19 nt, Homo sapiens
gauauaacgagaaugucua

SEQ ID NO: 647863 - RNA, 19 nt, Homo sapiens
ugggaaagguguugaaagu

SEQ ID NO: 647864 - RNA, 19 nt, Homo sapiens
cacagaagauggcaagcuu

SEQ ID NO: 647865 - RNA, 19 nt, Homo sapiens
aaagggauauaacgagaau

SEQ ID NO: 647866 - RNA, 19 nt, Homo sapiens
uggcugaugggacuaauua

SEQ ID NO: 647867 - RNA, 19 nt, Homo sapiens
acagaaggcucagcugguu

SEQ ID NO: 647868 - RNA, 19 nt, Homo sapiens
caacuuacauucggucaac

SEQ ID NO: 647869 - RNA, 19 nt, Homo sapiens
gcugaugggacuaauuauu

SEQ ID NO: 647870 - RNA, 19 nt, Homo sapiens
ugaccugguuaagaaguua

SEQ ID NO: 647871 - RNA, 19 nt, Homo sapiens
gcucagcccacaacucuug

SEQ ID NO: 647872 - RNA, 19 nt, Homo sapiens
agaaccauccucuucauaa

SEQ ID NO: 647873 - RNA, 19 nt, Homo sapiens
ccagcggacugaaggcaaa

SEQ ID NO: 647874 - RNA, 19 nt, Homo sapiens
uucaugaccugguuaagaa

SEQ ID NO: 647875 - RNA, 19 nt, Homo sapiens
uggcggacgugauaaaugu

SEQ ID NO: 647876 - RNA, 19 nt, Homo sapiens
uauaaguggucaaacaagu

SEQ ID NO: 647877 - RNA, 19 nt, Homo sapiens
gucaacuccuucaagcaua

SEQ ID NO: 647878 - RNA, 19 nt, Homo sapiens
cggcagugcuggugucugu

SEQ ID NO: 647879 - RNA, 19 nt, Homo sapiens
gauauaugguccaaaucca

SEQ ID NO: 647880 - RNA, 19 nt, Homo sapiens
cuugauauaugguccaaau

SEQ ID NO: 647881 - RNA, 19 nt, Homo sapiens
caauggaacaucagcaaug

SEQ ID NO: 647882 - RNA, 19 nt, Homo sapiens
ccuaccaccucaauauguu

SEQ ID NO: 647883 - RNA, 19 nt, Homo sapiens
gauccuucaugaccugguu

SEQ ID NO: 647884 - RNA, 19 nt, Homo sapiens
acgagaaugucuacacaga

SEQ ID NO: 647885 - RNA, 19 nt, Homo sapiens
ggauauaacgagaaugucu

SEQ ID NO: 647886 - RNA, 19 nt, Homo sapiens
ucaacuccuucaagcauau

SEQ ID NO: 647887 - RNA, 19 nt, Homo sapiens
gcaauaaaccuuuuguauc

SEQ ID NO: 647888 - RNA, 19 nt, Homo sapiens
gugguccgauccuucauga

SEQ ID NO: 647889 - RNA, 19 nt, Homo sapiens
ugauaaaugucagugugaa

SEQ ID NO: 647890 - RNA, 19 nt, Homo sapiens
cagaagauggcaagcuuga

SEQ ID NO: 647891 - RNA, 19 nt, Homo sapiens
ccacuuauccagacccaau

SEQ ID NO: 647892 - RNA, 19 nt, Homo sapiens
caucuggccuuuuaaauca

SEQ ID NO: 647893 - RNA, 19 nt, Homo sapiens
cauauaaguggucaaacaa

SEQ ID NO: 647894 - RNA, 19 nt, Homo sapiens
gaagaccuuucuagaaccu

SEQ ID NO: 647895 - RNA, 19 nt, Homo sapiens
guuccucacugcccagaug

SEQ ID NO: 647896 - RNA, 19 nt, Homo sapiens
gaugggaguaucugccaaa

SEQ ID NO: 647897 - RNA, 19 nt, Homo sapiens
caauaaaccuuuuguaucc

SEQ ID NO: 647898 - RNA, 19 nt, Homo sapiens
gauggcaagcuugauauau

SEQ ID NO: 647899 - RNA, 19 nt, Homo sapiens
uaaguggucaaacaaguug

SEQ ID NO: 647900 - RNA, 19 nt, Homo sapiens
gaaugucuacacagaagau

SEQ ID NO: 647901 - RNA, 19 nt, Homo sapiens
ugagaaccauccucuucau

SEQ ID NO: 647902 - RNA, 19 nt, Homo sapiens
gggagaaggccuuuauugc

SEQ ID NO: 647903 - RNA, 19 nt, Homo sapiens
gguccaaauccaacuauca

SEQ ID NO: 647904 - RNA, 19 nt, Homo sapiens
ugaaagugaucgucgucau

SEQ ID NO: 647905 - RNA, 19 nt, Homo sapiens
uuaaaucagcagucauuga

SEQ ID NO: 647906 - RNA, 19 nt, Homo sapiens
gacuaauuauucccacuag

SEQ ID NO: 647907 - RNA, 19 nt, Homo sapiens
ccaaauccaacuaucaagu

SEQ ID NO: 647908 - RNA, 19 nt, Homo sapiens
gugaucagccgcauugaca

SEQ ID NO: 647909 - RNA, 19 nt, Homo sapiens
gcguuccgcuaaucagaug

SEQ ID NO: 647910 - RNA, 19 nt, Homo sapiens
acuagcaucuggccuuuua

SEQ ID NO: 647911 - RNA, 19 nt, Homo sapiens
gaaugagcccuuguguuca

SEQ ID NO: 647912 - RNA, 19 nt, Homo sapiens
cgggagaaggccuuuauug

SEQ ID NO: 647913 - RNA, 19 nt, Homo sapiens
uacagcugcuccucccuuu

SEQ ID NO: 647914 - RNA, 19 nt, Homo sapiens
guccaaauccaacuaucaa

SEQ ID NO: 647915 - RNA, 19 nt, Homo sapiens
auggcaagcuugauauaug

SEQ ID NO: 647916 - RNA, 19 nt, Homo sapiens
aaauguccauccacuuauc

SEQ ID NO: 647917 - RNA, 19 nt, Homo sapiens
guaggcaagccaucugaga

SEQ ID NO: 647918 - RNA, 19 nt, Homo sapiens
cagcugcuccucccuuuca

SEQ ID NO: 647919 - RNA, 19 nt, Homo sapiens
uggcaagcuugauauaugg

SEQ ID NO: 647920 - RNA, 19 nt, Homo sapiens
gugauaaaugucaguguga

SEQ ID NO: 647921 - RNA, 19 nt, Homo sapiens
uaaagggauauaacgagaa

SEQ ID NO: 647922 - RNA, 19 nt, Homo sapiens
cugaugggacuaauuauuc

SEQ ID NO: 647923 - RNA, 19 nt, Homo sapiens
cgagaaugucuacacagaa

SEQ ID NO: 647924 - RNA, 19 nt, Homo sapiens
augcggagccuguucauug

SEQ ID NO: 647925 - RNA, 19 nt, Homo sapiens
cuaaucagaugggaguauc

SEQ ID NO: 647926 - RNA, 19 nt, Homo sapiens
ugcggagccuguucauuga

SEQ ID NO: 647927 - RNA, 19 nt, Homo sapiens
caaugcuucuggugaccuu

SEQ ID NO: 647928 - RNA, 19 nt, Homo sapiens
gcuggaacgucugagcaau

SEQ ID NO: 647929 - RNA, 19 nt, Homo sapiens
auccaacuaucaaguauuc

SEQ ID NO: 647930 - RNA, 19 nt, Homo sapiens
gacaaaacuccucucuaua

SEQ ID NO: 647931 - RNA, 19 nt, Homo sapiens
caagccaucugagaaccau

SEQ ID NO: 647932 - RNA, 19 nt, Homo sapiens
caaaacuccucucuauagu

SEQ ID NO: 647933 - RNA, 19 nt, Homo sapiens
gaaagaugcugccuugugu

SEQ ID NO: 647934 - RNA, 19 nt, Homo sapiens
gaaagaccaugaaagaugu

SEQ ID NO: 647935 - RNA, 19 nt, Homo sapiens
ugaaacagcugagagauuu

SEQ ID NO: 647936 - RNA, 19 nt, Homo sapiens
gcaaucaguuccaauguga

SEQ ID NO: 647937 - RNA, 19 nt, Homo sapiens
gaaugaacaucaaagagaa

SEQ ID NO: 647938 - RNA, 19 nt, Homo sapiens
gcaguaauuucgcuguaua

SEQ ID NO: 647939 - RNA, 19 nt, Homo sapiens
gagaucagauuauagagaa

SEQ ID NO: 647940 - RNA, 19 nt, Homo sapiens
gagcugagguucuugauag

SEQ ID NO: 647941 - RNA, 19 nt, Homo sapiens
gcaguuugaucacaagaaa

SEQ ID NO: 647942 - RNA, 19 nt, Homo sapiens
gaugauagcaacaauugua

SEQ ID NO: 647943 - RNA, 19 nt, Homo sapiens
uaacaagcauagacaaaug

SEQ ID NO: 647944 - RNA, 19 nt, Homo sapiens
ggagagaucagauuauaga

SEQ ID NO: 647945 - RNA, 19 nt, Homo sapiens
gaaggcggcuaccagugua

SEQ ID NO: 647946 - RNA, 19 nt, Homo sapiens
uaggagagaucagauuaua

SEQ ID NO: 647947 - RNA, 19 nt, Homo sapiens
acacgugcaucaucuuaua

SEQ ID NO: 647948 - RNA, 19 nt, Homo sapiens
agagagaccuugagaguca

SEQ ID NO: 647949 - RNA, 19 nt, Homo sapiens
gcacuaagaagaaucacuu

SEQ ID NO: 647950 - RNA, 19 nt, Homo sapiens
aguguuagcugcuguugua

SEQ ID NO: 647951 - RNA, 19 nt, Homo sapiens
gaacgaguaauugaaauga

SEQ ID NO: 647952 - RNA, 19 nt, Homo sapiens
gaagcaggaaugagaguaa

SEQ ID NO: 647953 - RNA, 19 nt, Homo sapiens
cauaggagagaucagauua

SEQ ID NO: 647954 - RNA, 19 nt, Homo sapiens
gaaacuagaagaucuuaag

SEQ ID NO: 647955 - RNA, 19 nt, Homo sapiens
gagaagagaaacuagaaga

SEQ ID NO: 647956 - RNA, 19 nt, Homo sapiens
gcuuuaaucuugacuccaa

SEQ ID NO: 647957 - RNA, 19 nt, Homo sapiens
ugaaagaccaugaaagaug

SEQ ID NO: 647958 - RNA, 19 nt, Homo sapiens
ggacagaaugaacaucaaa

SEQ ID NO: 647959 - RNA, 19 nt, Homo sapiens
guacacgugcaucaucuua

SEQ ID NO: 647960 - RNA, 19 nt, Homo sapiens
gaagagaaacuagaagauc

SEQ ID NO: 647961 - RNA, 19 nt, Homo sapiens
gcaccuggaacgaguaauu

SEQ ID NO: 647962 - RNA, 19 nt, Homo sapiens
gagaaacuagaagaucuua

SEQ ID NO: 647963 - RNA, 19 nt, Homo sapiens
ccaaugugaugaucuuauc

SEQ ID NO: 647964 - RNA, 19 nt, Homo sapiens
aaugaaagaccaugaaaga

SEQ ID NO: 647965 - RNA, 19 nt, Homo sapiens
ggaaggcggcuaccagugu

SEQ ID NO: 647966 - RNA, 19 nt, Homo sapiens
ugauuugccucauucagaa

SEQ ID NO: 647967 - RNA, 19 nt, Homo sapiens
caaggaauauacggaugaa

SEQ ID NO: 647968 - RNA, 19 nt, Homo sapiens
caauuguacuggacagaau

SEQ ID NO: 647969 - RNA, 19 nt, Homo sapiens
agaaugaacaucaaagaga

SEQ ID NO: 647970 - RNA, 19 nt, Homo sapiens
ucgaacggcuucauccuau

SEQ ID NO: 647971 - RNA, 19 nt, Homo sapiens
ggaacgaguaauugaaaug

SEQ ID NO: 647972 - RNA, 19 nt, Homo sapiens
gaugucauaggcaguaauu

SEQ ID NO: 647973 - RNA, 19 nt, Homo sapiens
ggcaaucaguuccaaugug

SEQ ID NO: 647974 - RNA, 19 nt, Homo sapiens
gagaugucauaggcaguaa

SEQ ID NO: 647975 - RNA, 19 nt, Homo sapiens
caccuccaaugcaauauau

SEQ ID NO: 647976 - RNA, 19 nt, Homo sapiens
aagagaaacuagaagaucu

SEQ ID NO: 647977 - RNA, 19 nt, Homo sapiens
gcacuuccaccaccuccaa

SEQ ID NO: 647978 - RNA, 19 nt, Homo sapiens
guuccaaugugaugaucuu

SEQ ID NO: 647979 - RNA, 19 nt, Homo sapiens
cuuaagagaaguuucacua

SEQ ID NO: 647980 - RNA, 19 nt, Homo sapiens
gaaugaaagaccaugaaag

SEQ ID NO: 647981 - RNA, 19 nt, Homo sapiens
ggucauaggagagaucaga

SEQ ID NO: 647982 - RNA, 19 nt, Homo sapiens
ugaaugaaagaccaugaaa

SEQ ID NO: 647983 - RNA, 19 nt, Homo sapiens
uugaugagaugaaugaaag

SEQ ID NO: 647984 - RNA, 19 nt, Homo sapiens
guacuggacagaaugaaca

SEQ ID NO: 647985 - RNA, 19 nt, Homo sapiens
ggaaagucagggcaucgaa

SEQ ID NO: 647986 - RNA, 19 nt, Homo sapiens
guuagcugcuguuguaugg

SEQ ID NO: 647987 - RNA, 19 nt, Homo sapiens
caauggaugcugaugauag

SEQ ID NO: 647988 - RNA, 19 nt, Homo sapiens
gugcaucaucuuauaaaug

SEQ ID NO: 647989 - RNA, 19 nt, Homo sapiens
aaggagcccugggaguaua

SEQ ID NO: 647990 - RNA, 19 nt, Homo sapiens
auaaggagcccugggagua

SEQ ID NO: 647991 - RNA, 19 nt, Homo sapiens
ccaccuccaaugcaauaua

SEQ ID NO: 647992 - RNA, 19 nt, Homo sapiens
guaauuucgcuguauaaca

SEQ ID NO: 647993 - RNA, 19 nt, Homo sapiens
ggcaguaauuucgcuguau

SEQ ID NO: 647994 - RNA, 19 nt, Homo sapiens
ugccuuguguguccuaauu

SEQ ID NO: 647995 - RNA, 19 nt, Homo sapiens
ucaaggaauauacggauga

SEQ ID NO: 647996 - RNA, 19 nt, Homo sapiens
ucacaagaaagaacugaga

SEQ ID NO: 647997 - RNA, 19 nt, Homo sapiens
agaaagaugcugccuugug

SEQ ID NO: 647998 - RNA, 19 nt, Homo sapiens
cuucuuugccugaugauuu

SEQ ID NO: 647999 - RNA, 19 nt, Homo sapiens
ugucauaggcaguaauuuc

SEQ ID NO: 648000 - RNA, 19 nt, Homo sapiens
gaugaaugaaagaccauga

SEQ ID NO: 648001 - RNA, 19 nt, Homo sapiens
ccuaauugaugagaugaau

SEQ ID NO: 648002 - RNA, 19 nt, Homo sapiens
gauaaccucaauaauagca

SEQ ID NO: 648003 - RNA, 19 nt, Homo sapiens
caccaccuccaaugcaaua

SEQ ID NO: 648004 - RNA, 19 nt, Homo sapiens
gauagcaacaauuguacug

SEQ ID NO: 648005 - RNA, 19 nt, Homo sapiens
aagcaggaaugagaguaaa

SEQ ID NO: 648006 - RNA, 19 nt, Homo sapiens
ugagaugucauaggcagua

SEQ ID NO: 648007 - RNA, 19 nt, Homo sapiens
gcuguuguaugggacauuc

SEQ ID NO: 648008 - RNA, 19 nt, Homo sapiens
acaagaaagaacugagaaa

SEQ ID NO: 648009 - RNA, 19 nt, Homo sapiens
gaucacaagaaagaacuga

SEQ ID NO: 648010 - RNA, 19 nt, Homo sapiens
ccuuguguguccuaauuga

SEQ ID NO: 648011 - RNA, 19 nt, Homo sapiens
uggcuucuuugccugauga

SEQ ID NO: 648012 - RNA, 19 nt, Homo sapiens
aaaagacaguuacaugaug

SEQ ID NO: 648013 - RNA, 19 nt, Homo sapiens
uaucauccgcccuuuggaa

SEQ ID NO: 648014 - RNA, 19 nt, Homo sapiens
cugaugauagcaacaauug

SEQ ID NO: 648015 - RNA, 19 nt, Homo sapiens
gcuugaaacagcugagaga

SEQ ID NO: 648016 - RNA, 19 nt, Homo sapiens
ggugaaccacagcaaguga

SEQ ID NO: 648017 - RNA, 19 nt, Homo sapiens
aggcaguaauuucgcugua

SEQ ID NO: 648018 - RNA, 19 nt, Homo sapiens
uguccuaauugaugagaug

SEQ ID NO: 648019 - RNA, 19 nt, Homo sapiens
gaacggcuucauccuaugc

SEQ ID NO: 648020 - RNA, 19 nt, Homo sapiens
cagauuauagagaaagaug

SEQ ID NO: 648021 - RNA, 19 nt, Homo sapiens
acagaaugaacaucaaaga

SEQ ID NO: 648022 - RNA, 19 nt, Homo sapiens
gcugaugauagcaacaauu

SEQ ID NO: 648023 - RNA, 19 nt, Homo sapiens
gaaccaauggaugcugaug

SEQ ID NO: 648024 - RNA, 19 nt, Homo sapiens
gaauugcuuggcuucuuug

SEQ ID NO: 648025 - RNA, 19 nt, Homo sapiens
gcugagagauuucaaaagc

SEQ ID NO: 648026 - RNA, 19 nt, Homo sapiens
agccagagcugagguucuu

SEQ ID NO: 648027 - RNA, 19 nt, Homo sapiens
cgaacggcuucauccuaug

SEQ ID NO: 648028 - RNA, 19 nt, Homo sapiens
ggacagucuuaagagaagu

SEQ ID NO: 648029 - RNA, 19 nt, Homo sapiens
gaucagauuauagagaaag

SEQ ID NO: 648030 - RNA, 19 nt, Homo sapiens
cuaugcaguuugaucacaa

SEQ ID NO: 648031 - RNA, 19 nt, Homo sapiens
uaaggagcccugggaguau

SEQ ID NO: 648032 - RNA, 19 nt, Homo sapiens
caagaaagaacugagaaaa

SEQ ID NO: 648033 - RNA, 19 nt, Homo sapiens
gagcauacuuguacaaaua

SEQ ID NO: 648034 - RNA, 19 nt, Homo sapiens
cuacuggaguuacuuauua

SEQ ID NO: 648035 - RNA, 19 nt, Homo sapiens
ggaccacagugacuuauuu

SEQ ID NO: 648036 - RNA, 19 nt, Homo sapiens
aaacagggcuuuacuaucu

SEQ ID NO: 648037 - RNA, 19 nt, Homo sapiens
ggacccagaugauguggua

SEQ ID NO: 648038 - RNA, 19 nt, Homo sapiens
caaggaaacuuacaaacug

SEQ ID NO: 648039 - RNA, 19 nt, Homo sapiens
cuaggcaucugcuguaaua

SEQ ID NO: 648040 - RNA, 19 nt, Homo sapiens
caacgcagagaaacuauua

SEQ ID NO: 648041 - RNA, 19 nt, Homo sapiens
gaaacuuacagccuauuua

SEQ ID NO: 648042 - RNA, 19 nt, Homo sapiens
gaagacggauuaucuagag

SEQ ID NO: 648043 - RNA, 19 nt, Homo sapiens
caucaaggcuggaaccuau

SEQ ID NO: 648044 - RNA, 19 nt, Homo sapiens
guucaugacuuuaacaaga

SEQ ID NO: 648045 - RNA, 19 nt, Homo sapiens
ggcaucugcuguaauaaua

SEQ ID NO: 648046 - RNA, 19 nt, Homo sapiens
aauaguacaugucaccuua

SEQ ID NO: 648047 - RNA, 19 nt, Homo sapiens
ggaauaaaguacaucaaag

SEQ ID NO: 648048 - RNA, 19 nt, Homo sapiens
gcaaacagggcuuuacuau

SEQ ID NO: 648049 - RNA, 19 nt, Homo sapiens
aaacaaauuugccguggaa

SEQ ID NO: 648050 - RNA, 19 nt, Homo sapiens
guacuacuguggaauaaag

SEQ ID NO: 648051 - RNA, 19 nt, Homo sapiens
caccuggguuucuuuauuu

SEQ ID NO: 648052 - RNA, 19 nt, Homo sapiens
ucaccuggguuucuuuauu

SEQ ID NO: 648053 - RNA, 19 nt, Homo sapiens
ccugcuaccuaguuuguua

SEQ ID NO: 648054 - RNA, 19 nt, Homo sapiens
ccacagugacuuauuugua

SEQ ID NO: 648055 - RNA, 19 nt, Homo sapiens
gcagagaaacuauuaaagg

SEQ ID NO: 648056 - RNA, 19 nt, Homo sapiens
gcacaugguuauuacugau

SEQ ID NO: 648057 - RNA, 19 nt, Homo sapiens
caagaaacuuacagccuau

SEQ ID NO: 648058 - RNA, 19 nt, Homo sapiens
caagaagacggauuaucua

SEQ ID NO: 648059 - RNA, 19 nt, Homo sapiens
gcaaggacccagaugaugu

SEQ ID NO: 648060 - RNA, 19 nt, Homo sapiens
cguggaaacuuuaauuugu

SEQ ID NO: 648061 - RNA, 19 nt, Homo sapiens
cagagaaacuauuaaaggu

SEQ ID NO: 648062 - RNA, 19 nt, Homo sapiens
ggagcauacuuguacaaau

SEQ ID NO: 648063 - RNA, 19 nt, Homo sapiens
ucugugcaauggaauauaa

SEQ ID NO: 648064 - RNA, 19 nt, Homo sapiens
gaucaccuggguuucuuua

SEQ ID NO: 648065 - RNA, 19 nt, Homo sapiens
cacagugacuuauuuguag

SEQ ID NO: 648066 - RNA, 19 nt, Homo sapiens
aguccuaucugauucauga

SEQ ID NO: 648067 - RNA, 19 nt, Homo sapiens
gcuugcagguguuauucua

SEQ ID NO: 648068 - RNA, 19 nt, Homo sapiens
cuuaagagaauccacauaa

SEQ ID NO: 648069 - RNA, 19 nt, Homo sapiens
caaagaagagccugguguu

SEQ ID NO: 648070 - RNA, 19 nt, Homo sapiens
ucaagaagacggauuaucu

SEQ ID NO: 648071 - RNA, 19 nt, Homo sapiens
ugaagaagaagaaguugaa

SEQ ID NO: 648072 - RNA, 19 nt, Homo sapiens
cagaugacguguacuacug

SEQ ID NO: 648073 - RNA, 19 nt, Homo sapiens
guuguuaguugcccugcua

SEQ ID NO: 648074 - RNA, 19 nt, Homo sapiens
gguuauuacugaucgcauu

SEQ ID NO: 648075 - RNA, 19 nt, Homo sapiens
cuggauaagugcuauguga

SEQ ID NO: 648076 - RNA, 19 nt, Homo sapiens
uaacuagacugcguguugu

SEQ ID NO: 648077 - RNA, 19 nt, Homo sapiens
gguaccaguuggccaaaga

SEQ ID NO: 648078 - RNA, 19 nt, Homo sapiens
gaaguguggugucuuuuau

SEQ ID NO: 648079 - RNA, 19 nt, Homo sapiens
gcuuuggacuagcauuuau

SEQ ID NO: 648080 - RNA, 19 nt, Homo sapiens
ugacaaggaaacuuacaaa

SEQ ID NO: 648081 - RNA, 19 nt, Homo sapiens
gucaugacaaggaaacuua

SEQ ID NO: 648082 - RNA, 19 nt, Homo sapiens
gcuaugugaucccucugaa

SEQ ID NO: 648083 - RNA, 19 nt, Homo sapiens
uagguaguaggaagaauua

SEQ ID NO: 648084 - RNA, 19 nt, Homo sapiens
cagccuauuuagaucuuaa

SEQ ID NO: 648085 - RNA, 19 nt, Homo sapiens
guaguaggaagaauuacaa

SEQ ID NO: 648086 - RNA, 19 nt, Homo sapiens
gaaaccuacuggaguuacu

SEQ ID NO: 648087 - RNA, 19 nt, Homo sapiens
agaaggaggccaagaagga

SEQ ID NO: 648088 - RNA, 19 nt, Homo sapiens
gaugaugugguaccaguug

SEQ ID NO: 648089 - RNA, 19 nt, Homo sapiens
gugaagccagcaauuguuu

SEQ ID NO: 648090 - RNA, 19 nt, Homo sapiens
aaacuuacagccuauuuag

SEQ ID NO: 648091 - RNA, 19 nt, Homo sapiens
uuaacuagacugcguguug

SEQ ID NO: 648092 - RNA, 19 nt, Homo sapiens
gagcacaugguuauuacug

SEQ ID NO: 648093 - RNA, 19 nt, Homo sapiens
ccucugaacacuuccauug

SEQ ID NO: 648094 - RNA, 19 nt, Homo sapiens
ggauaagugcuaugugauc

SEQ ID NO: 648095 - RNA, 19 nt, Homo sapiens
ucaaccagaugacguguac

SEQ ID NO: 648096 - RNA, 19 nt, Homo sapiens
ggaggagcauacuuguaca

SEQ ID NO: 648097 - RNA, 19 nt, Homo sapiens
cuaguuuguuagugcauuu

SEQ ID NO: 648098 - RNA, 19 nt, Homo sapiens
uuaaagguauucagaaacg

SEQ ID NO: 648099 - RNA, 19 nt, Homo sapiens
ucccagaguuugcagauag

SEQ ID NO: 648100 - RNA, 19 nt, Homo sapiens
gugcaugugcuuuggacua

SEQ ID NO: 648101 - RNA, 19 nt, Homo sapiens
acagggcuuuacuaucuuu

SEQ ID NO: 648102 - RNA, 19 nt, Homo sapiens
gcaacgcagagaaacuauu

SEQ ID NO: 648103 - RNA, 19 nt, Homo sapiens
uaaccuggauaagugcuau

SEQ ID NO: 648104 - RNA, 19 nt, Homo sapiens
aauuugccguggaaacuuu

SEQ ID NO: 648105 - RNA, 19 nt, Homo sapiens
gcaauucggcauuuugaaa

SEQ ID NO: 648106 - RNA, 19 nt, Homo sapiens
ucaaggcuggaaccuauuu

SEQ ID NO: 648107 - RNA, 19 nt, Homo sapiens
agaagagccugguguuggu

SEQ ID NO: 648108 - RNA, 19 nt, Homo sapiens
gauucuuuguggauacuau

SEQ ID NO: 648109 - RNA, 19 nt, Homo sapiens
gacggauuaucuagagaau

SEQ ID NO: 648110 - RNA, 19 nt, Homo sapiens
caaacagggcuuuacuauc

SEQ ID NO: 648111 - RNA, 19 nt, Homo sapiens
aaacgugaagccagcaauu

SEQ ID NO: 648112 - RNA, 19 nt, Homo sapiens
gaagaagaagaaguugaau

SEQ ID NO: 648113 - RNA, 19 nt, Homo sapiens
guguacuacuguggaauaa

SEQ ID NO: 648114 - RNA, 19 nt, Homo sapiens
gacguguacuacuguggaa

SEQ ID NO: 648115 - RNA, 19 nt, Homo sapiens
cauuugagcacacauuuua

SEQ ID NO: 648116 - RNA, 19 nt, Homo sapiens
gccguggaaacuuuaauuu

SEQ ID NO: 648117 - RNA, 19 nt, Homo sapiens
gaccacagugacuuauuug

SEQ ID NO: 648118 - RNA, 19 nt, Homo sapiens
gguaguaggaagaauuaca

SEQ ID NO: 648119 - RNA, 19 nt, Homo sapiens
cguguacuacuguggaaua

SEQ ID NO: 648120 - RNA, 19 nt, Homo sapiens
ccuauuugccucaguccua

SEQ ID NO: 648121 - RNA, 19 nt, Homo sapiens
acaaggaaacuuacaaacu

SEQ ID NO: 648122 - RNA, 19 nt, Homo sapiens
cagaaaccuacuggaguua

SEQ ID NO: 648123 - RNA, 19 nt, Homo sapiens
uaacccauaucugugcaau

SEQ ID NO: 648124 - RNA, 19 nt, Homo sapiens
caaggacccagaugaugug

SEQ ID NO: 648125 - RNA, 19 nt, Homo sapiens
caaauuugccguggaaacu

SEQ ID NO: 648126 - RNA, 19 nt, Homo sapiens
acgcagagaaacuauuaaa

SEQ ID NO: 648127 - RNA, 19 nt, Homo sapiens
ucuaggaggagcauacuug

SEQ ID NO: 648128 - RNA, 19 nt, Homo sapiens
uagugauccugccaacauu

SEQ ID NO: 648129 - RNA, 19 nt, Homo sapiens
ccagauucuuuguggauac

SEQ ID NO: 648130 - RNA, 19 nt, Homo sapiens
gaaacgugaagccagcaau

SEQ ID NO: 648131 - RNA, 19 nt, Homo sapiens
gagcuucccgaaccucuca

SEQ ID NO: 648132 - RNA, 19 nt, Homo sapiens
ggaaacuuacaaacugcaa

SEQ ID NO: 648133 - RNA, 19 nt, Homo sapiens
guaggaagcuuuauuagaa

SEQ ID NO: 648134 - RNA, 19 nt, Homo sapiens
gagaaagacuggcaagguu

SEQ ID NO: 648135 - RNA, 19 nt, Homo sapiens
gaaguuaaaugagugugua

SEQ ID NO: 648136 - RNA, 19 nt, Homo sapiens
gcaaugaaguuaaaugagu

SEQ ID NO: 648137 - RNA, 19 nt, Homo sapiens
gcaauaaagcuaugucuga

SEQ ID NO: 648138 - RNA, 19 nt, Homo sapiens
uagaggagguucugacuaa

SEQ ID NO: 648139 - RNA, 19 nt, Homo sapiens
gcaauucuaucucuaugau

SEQ ID NO: 648140 - RNA, 19 nt, Homo sapiens
ugagaaagcuugccagaag

SEQ ID NO: 648141 - RNA, 19 nt, Homo sapiens
gggcaggagucagcaauaa

SEQ ID NO: 648142 - RNA, 19 nt, Homo sapiens
gagaaagcuugccagaaga

SEQ ID NO: 648143 - RNA, 19 nt, Homo sapiens
gaggagguucugacuaaua

SEQ ID NO: 648144 - RNA, 19 nt, Homo sapiens
uggaagcaaugaaguuaaa

SEQ ID NO: 648145 - RNA, 19 nt, Homo sapiens
caauaaagcuaugucugau

SEQ ID NO: 648146 - RNA, 19 nt, Homo sapiens
ggagucagcaauaaagcua

SEQ ID NO: 648147 - RNA, 19 nt, Homo sapiens
gcuggaagcaaugaaguua

SEQ ID NO: 648148 - RNA, 19 nt, Homo sapiens
aggagguucugacuaauaa

SEQ ID NO: 648149 - RNA, 19 nt, Homo sapiens
gguaggaagcuuuauuaga

SEQ ID NO: 648150 - RNA, 19 nt, Homo sapiens
guaccuggaugaagcauac

SEQ ID NO: 648151 - RNA, 19 nt, Homo sapiens
gaagcaaugaaguuaaaug

SEQ ID NO: 648152 - RNA, 19 nt, Homo sapiens
ccaagggaaucaggcauga

SEQ ID NO: 648153 - RNA, 19 nt, Homo sapiens
gagcucuacuuacagaaca

SEQ ID NO: 648154 - RNA, 19 nt, Homo sapiens
aagccugagugguucuuua

SEQ ID NO: 648155 - RNA, 19 nt, Homo sapiens
gcaggagucagcaauaaag

SEQ ID NO: 648156 - RNA, 19 nt, Homo sapiens
gaacggcuggaagcaauga

SEQ ID NO: 648157 - RNA, 19 nt, Homo sapiens
gagguucugacuaauaaga

SEQ ID NO: 648158 - RNA, 19 nt, Homo sapiens
aaaauaagccugagugguu

SEQ ID NO: 648159 - RNA, 19 nt, Homo sapiens
agacuaugcuggccuaaaa

SEQ ID NO: 648160 - RNA, 19 nt, Homo sapiens
gguggcaauucuaucucua

SEQ ID NO: 648161 - RNA, 19 nt, Homo sapiens
ggaaucaggcaugaaguca

SEQ ID NO: 648162 - RNA, 19 nt, Homo sapiens
agaaagacuggcaagguuu

SEQ ID NO: 648163 - RNA, 19 nt, Homo sapiens
cuaauaagaagacgaccuu

SEQ ID NO: 648164 - RNA, 19 nt, Homo sapiens
ucaucaauaucaaccugaa

SEQ ID NO: 648165 - RNA, 19 nt, Homo sapiens
gcugagaggacgcgucuag

SEQ ID NO: 648166 - RNA, 19 nt, Homo sapiens
gaccuucuuugguggcaau

SEQ ID NO: 648167 - RNA, 19 nt, Homo sapiens
uugguaggaagcuuuauua

SEQ ID NO: 648168 - RNA, 19 nt, Homo sapiens
gaugaucuuagaguuguuu

SEQ ID NO: 648169 - RNA, 19 nt, Homo sapiens
ggcaggagucagcaauaaa

SEQ ID NO: 648170 - RNA, 19 nt, Homo sapiens
uaggaagcuuuauuagaag

SEQ ID NO: 648171 - RNA, 19 nt, Homo sapiens
uugaacggcuggaagcaau

SEQ ID NO: 648172 - RNA, 19 nt, Homo sapiens
agggucagcugaucuacga

SEQ ID NO: 648173 - RNA, 19 nt, Homo sapiens
uggcaauucuaucucuaug

SEQ ID NO: 648174 - RNA, 19 nt, Homo sapiens
gcaucuacagcaugagguu

SEQ ID NO: 648175 - RNA, 19 nt, Homo sapiens
agaagcuguugccggauga

SEQ ID NO: 648176 - RNA, 19 nt, Homo sapiens
aagcauacccagggaagaa

SEQ ID NO: 648177 - RNA, 19 nt, Homo sapiens
ugagaaagacuggcaaggu

SEQ ID NO: 648178 - RNA, 19 nt, Homo sapiens
gaagcauacccagggaaga

SEQ ID NO: 648179 - RNA, 19 nt, Homo sapiens
gcccugaggccugugacua

SEQ ID NO: 648180 - RNA, 19 nt, Homo sapiens
gggaaucaggcaugaaguc

SEQ ID NO: 648181 - RNA, 19 nt, Homo sapiens
gaaagcuugccagaagaug

SEQ ID NO: 648182 - RNA, 19 nt, Homo sapiens
aaagcuugccagaagauga

SEQ ID NO: 648183 - RNA, 19 nt, Homo sapiens
agucagcaauaaagcuaug

SEQ ID NO: 648184 - RNA, 19 nt, Homo sapiens
caugagguucugcccguuu

SEQ ID NO: 648185 - RNA, 19 nt, Homo sapiens
ccugaggccugugacuaug

SEQ ID NO: 648186 - RNA, 19 nt, Homo sapiens
ggaagcaaugaaguuaaau

SEQ ID NO: 648187 - RNA, 19 nt, Homo sapiens
ggcaauucuaucucuauga

SEQ ID NO: 648188 - RNA, 19 nt, Homo sapiens
cuagaggagguucugacua

SEQ ID NO: 648189 - RNA, 19 nt, Homo sapiens
ggaugaccccuaugagaaa

SEQ ID NO: 648190 - RNA, 19 nt, Homo sapiens
ugaaggaagaucccacagu

SEQ ID NO: 648191 - RNA, 19 nt, Homo sapiens
caucuggcccugguuugaa

SEQ ID NO: 648192 - RNA, 19 nt, Homo sapiens
caucaauaucaaccugaaa

SEQ ID NO: 648193 - RNA, 19 nt, Homo sapiens
ccucaucuggcccugguuu

SEQ ID NO: 648194 - RNA, 19 nt, Homo sapiens
ugagaggacgcgucuaguc

SEQ ID NO: 648195 - RNA, 19 nt, Homo sapiens
gaacaauugugaaugguuu

SEQ ID NO: 648196 - RNA, 19 nt, Homo sapiens
gaaaugaugucgcaaagca

SEQ ID NO: 648197 - RNA, 19 nt, Homo sapiens
caacagaugaucacaauaa

SEQ ID NO: 648198 - RNA, 19 nt, Homo sapiens
gaagggaaguguuuauuag

SEQ ID NO: 648199 - RNA, 19 nt, Homo sapiens
ggagaaaguugauaagcaa

SEQ ID NO: 648200 - RNA, 19 nt, Homo sapiens
gcaggaaucuaucagagaa

SEQ ID NO: 648201 - RNA, 19 nt, Homo sapiens
gauacagccucuucaauca

SEQ ID NO: 648202 - RNA, 19 nt, Homo sapiens
uaacaggccuggauaacau

SEQ ID NO: 648203 - RNA, 19 nt, Homo sapiens
gaaagucaccuagguuauu

SEQ ID NO: 648204 - RNA, 19 nt, Homo sapiens
gcacagugguuucuuagag

SEQ ID NO: 648205 - RNA, 19 nt, Homo sapiens
guagcuaccuugaugauuc

SEQ ID NO: 648206 - RNA, 19 nt, Homo sapiens
uuaauacacugcugaaaga

SEQ ID NO: 648207 - RNA, 19 nt, Homo sapiens
gaaacgaggacacaaugaa

SEQ ID NO: 648208 - RNA, 19 nt, Homo sapiens
caggagauguuucaugcua

SEQ ID NO: 648209 - RNA, 19 nt, Homo sapiens
gcaaacagaauacaaguag

SEQ ID NO: 648210 - RNA, 19 nt, Homo sapiens
ugaagggaaguguuuauua

SEQ ID NO: 648211 - RNA, 19 nt, Homo sapiens
ucaacacgcuucaaacuca

SEQ ID NO: 648212 - RNA, 19 nt, Homo sapiens
auacacugcugaaagauaa

SEQ ID NO: 648213 - RNA, 19 nt, Homo sapiens
ucagacgaguuuaauauug

SEQ ID NO: 648214 - RNA, 19 nt, Homo sapiens
guugucagauggagaguaa

SEQ ID NO: 648215 - RNA, 19 nt, Homo sapiens
gaauacaaguagcuaccuu

SEQ ID NO: 648216 - RNA, 19 nt, Homo sapiens
gagauacucuugcuaacag

SEQ ID NO: 648217 - RNA, 19 nt, Homo sapiens
aaagucaccuagguuauuu

SEQ ID NO: 648218 - RNA, 19 nt, Homo sapiens
gaaaguugauaagcaauac

SEQ ID NO: 648219 - RNA, 19 nt, Homo sapiens
ggucuaagcagcauuuaau

SEQ ID NO: 648220 - RNA, 19 nt, Homo sapiens
ccaauuagagcuccaguug

SEQ ID NO: 648221 - RNA, 19 nt, Homo sapiens
cuaagcagcauuuaauuga

SEQ ID NO: 648222 - RNA, 19 nt, Homo sapiens
cauagcaccauaaagguua

SEQ ID NO: 648223 - RNA, 19 nt, Homo sapiens
ggaaggagauaagguucga

SEQ ID NO: 648224 - RNA, 19 nt, Homo sapiens
gugaaugguuuguuuguag

SEQ ID NO: 648225 - RNA, 19 nt, Homo sapiens
ggaggcugaucccaaaguu

SEQ ID NO: 648226 - RNA, 19 nt, Homo sapiens
ugaguccucugcuaguuaa

SEQ ID NO: 648227 - RNA, 19 nt, Homo sapiens
ggagauguuucaugcuaca

SEQ ID NO: 648228 - RNA, 19 nt, Homo sapiens
gcaagcaggagauguuuca

SEQ ID NO: 648229 - RNA, 19 nt, Homo sapiens
ggauagguuuaaguucuuu

SEQ ID NO: 648230 - RNA, 19 nt, Homo sapiens
gaggacacaaugaaaugua

SEQ ID NO: 648231 - RNA, 19 nt, Homo sapiens
caauacaaaucgguaacaa

SEQ ID NO: 648232 - RNA, 19 nt, Homo sapiens
gaugaagaccauucguauu

SEQ ID NO: 648233 - RNA, 19 nt, Homo sapiens
gcuccucucuccaccaaau

SEQ ID NO: 648234 - RNA, 19 nt, Homo sapiens
agaaggagaaaguugauaa

SEQ ID NO: 648235 - RNA, 19 nt, Homo sapiens
gcaaacuacauacugcaaa

SEQ ID NO: 648236 - RNA, 19 nt, Homo sapiens
gguuuaaguucuuucuuuc

SEQ ID NO: 648237 - RNA, 19 nt, Homo sapiens
cagaugaucacaauaaaca

SEQ ID NO: 648238 - RNA, 19 nt, Homo sapiens
gcugacaucuggaguucau

SEQ ID NO: 648239 - RNA, 19 nt, Homo sapiens
uaaggaaggagauaagguu

SEQ ID NO: 648240 - RNA, 19 nt, Homo sapiens
guucauagcaccauaaagg

SEQ ID NO: 648241 - RNA, 19 nt, Homo sapiens
ccaaaagucucuccucaug

SEQ ID NO: 648242 - RNA, 19 nt, Homo sapiens
gugaagccguccagaagug

SEQ ID NO: 648243 - RNA, 19 nt, Homo sapiens
aaacgaggacacaaugaaa

SEQ ID NO: 648244 - RNA, 19 nt, Homo sapiens
gaagcgcuguuugccaguu

SEQ ID NO: 648245 - RNA, 19 nt, Homo sapiens
cagaaaugaugucgcaaag

SEQ ID NO: 648246 - RNA, 19 nt, Homo sapiens
gaacuggauagguuuaagu

SEQ ID NO: 648247 - RNA, 19 nt, Homo sapiens
gaggaacuggauagguuua

SEQ ID NO: 648248 - RNA, 19 nt, Homo sapiens
gaguaaauacaaggagaua

SEQ ID NO: 648249 - RNA, 19 nt, Homo sapiens
ggaguucauagcaccauaa

SEQ ID NO: 648250 - RNA, 19 nt, Homo sapiens
gaucaacacgcuucaaacu

SEQ ID NO: 648251 - RNA, 19 nt, Homo sapiens
augaagaccauucguauuu

SEQ ID NO: 648252 - RNA, 19 nt, Homo sapiens
caaacuacauacugcaaac

SEQ ID NO: 648253 - RNA, 19 nt, Homo sapiens
aauuagagcuccaguuguc

SEQ ID NO: 648254 - RNA, 19 nt, Homo sapiens
ggaacaauugugaaugguu

SEQ ID NO: 648255 - RNA, 19 nt, Homo sapiens
gaggagaaggagaaaguug

SEQ ID NO: 648256 - RNA, 19 nt, Homo sapiens
ucagagucuuuguagcuuu

SEQ ID NO: 648257 - RNA, 19 nt, Homo sapiens
cuaguuaagcucucugaaa

SEQ ID NO: 648258 - RNA, 19 nt, Homo sapiens
gagaaggagaaaguugaua

SEQ ID NO: 648259 - RNA, 19 nt, Homo sapiens
cagagucuuuguagcuuug

SEQ ID NO: 648260 - RNA, 19 nt, Homo sapiens
ggagauacucuugcuaaca

SEQ ID NO: 648261 - RNA, 19 nt, Homo sapiens
cagcugacaucuggaguuc

SEQ ID NO: 648262 - RNA, 19 nt, Homo sapiens
gaaaugaguccugcugcau

SEQ ID NO: 648263 - RNA, 19 nt, Homo sapiens
guaaauacaaggagauacu

SEQ ID NO: 648264 - RNA, 19 nt, Homo sapiens
gauggagaguaaauacaag

SEQ ID NO: 648265 - RNA, 19 nt, Homo sapiens
aggacacaaugaaauguaa

SEQ ID NO: 648266 - RNA, 19 nt, Homo sapiens
ucagaaaugaugucgcaaa

SEQ ID NO: 648267 - RNA, 19 nt, Homo sapiens
gaaggagaaaguugauaag

SEQ ID NO: 648268 - RNA, 19 nt, Homo sapiens
gugaugaagaccauucgua

SEQ ID NO: 648269 - RNA, 19 nt, Homo sapiens
ggaacuggauagguuuaag

SEQ ID NO: 648270 - RNA, 19 nt, Homo sapiens
augaggaacuggauagguu

SEQ ID NO: 648271 - RNA, 19 nt, Homo sapiens
aaggagauacucuugcuaa

SEQ ID NO: 648272 - RNA, 19 nt, Homo sapiens
ugaagaauaugugauacag

SEQ ID NO: 648273 - RNA, 19 nt, Homo sapiens
caagccaacuggucuaagc

SEQ ID NO: 648274 - RNA, 19 nt, Homo sapiens
uaguuaagcucucugaaaa

SEQ ID NO: 648275 - RNA, 19 nt, Homo sapiens
ucggcacagugguuucuua

SEQ ID NO: 648276 - RNA, 19 nt, Homo sapiens
aaaagucucuccucauguu

SEQ ID NO: 648277 - RNA, 19 nt, Homo sapiens
gccacuaagucaagcugaa

SEQ ID NO: 648278 - RNA, 19 nt, Homo sapiens
ggcggugucugcagugaug

SEQ ID NO: 648279 - RNA, 19 nt, Homo sapiens
ccaccaaauuaggauagaa

SEQ ID NO: 648280 - RNA, 19 nt, Homo sapiens
ugauacagccucuucaauc

SEQ ID NO: 648281 - RNA, 19 nt, Homo sapiens
gaaauguaaggaaggagau

SEQ ID NO: 648282 - RNA, 19 nt, Homo sapiens
ucagagaaggguuucagaa

SEQ ID NO: 648283 - RNA, 19 nt, Homo sapiens
aagcgcuguuugccaguua

SEQ ID NO: 648284 - RNA, 19 nt, Homo sapiens
uugaaagucaccuagguua

SEQ ID NO: 648285 - RNA, 19 nt, Homo sapiens
cugcagccaucagaaauga

SEQ ID NO: 648286 - RNA, 19 nt, Homo sapiens
ccaaagccacuaagucaag

SEQ ID NO: 648287 - RNA, 19 nt, Homo sapiens
ggagaaggagaaaguugau

SEQ ID NO: 648288 - RNA, 19 nt, Homo sapiens
gcagugaugaagaccauuc

SEQ ID NO: 648289 - RNA, 19 nt, Homo sapiens
cagacgaguuuaauauugc

SEQ ID NO: 648290 - RNA, 19 nt, Homo sapiens
uacagccucuucaaucaga

SEQ ID NO: 648291 - RNA, 19 nt, Homo sapiens
caacuggucuaagcagcau

SEQ ID NO: 648292 - RNA, 19 nt, Homo sapiens
guuaaugucccgcugaaca

SEQ ID NO: 648293 - RNA, 19 nt, Homo sapiens
aaccaaagccacuaaguca

SEQ ID NO: 648294 - RNA, 19 nt, Homo sapiens
ugaugaagaccauucguau

SEQ ID NO: 648295 - RNA, 19 nt, Homo sapiens
gaaauacucucaucacaga

SEQ ID NO: 648296 - RNA, 19 nt, Homo sapiens
gaccaacucuggcuuguua

SEQ ID NO: 648297 - RNA, 19 nt, Homo sapiens
gaagugaucuuuggucuug

SEQ ID NO: 648298 - RNA, 19 nt, Homo sapiens
gggaaggucuauccucuua

SEQ ID NO: 648299 - RNA, 19 nt, Homo sapiens
uuacagaccuugugaagaa

SEQ ID NO: 648300 - RNA, 19 nt, Homo sapiens
acagaaacauugcaacaua

SEQ ID NO: 648301 - RNA, 19 nt, Homo sapiens
cgaagacgauuucaacaaa

SEQ ID NO: 648302 - RNA, 19 nt, Homo sapiens
gaaagaacccacacucuau

SEQ ID NO: 648303 - RNA, 19 nt, Homo sapiens
gaacuuggaauuccuugua

SEQ ID NO: 648304 - RNA, 19 nt, Homo sapiens
ggaacacacucaaagaaga

SEQ ID NO: 648305 - RNA, 19 nt, Homo sapiens
gugcagaccucauguguug

SEQ ID NO: 648306 - RNA, 19 nt, Homo sapiens
ggccagagguugaaaguga

SEQ ID NO: 648307 - RNA, 19 nt, Homo sapiens
gaggagaguugaaagagaa

SEQ ID NO: 648308 - RNA, 19 nt, Homo sapiens
ggugaaacuuguugacuuu

SEQ ID NO: 648309 - RNA, 19 nt, Homo sapiens
gaacgugccuggugagucu

SEQ ID NO: 648310 - RNA, 19 nt, Homo sapiens
gaacccagaugccaccuau

SEQ ID NO: 648311 - RNA, 19 nt, Homo sapiens
uaaguuacgugucuacuau

SEQ ID NO: 648312 - RNA, 19 nt, Homo sapiens
caaguuagaauccagcuua

SEQ ID NO: 648313 - RNA, 19 nt, Homo sapiens
caaaagggcucaaagacua

SEQ ID NO: 648314 - RNA, 19 nt, Homo sapiens
gagccaaguuccauuguga

SEQ ID NO: 648315 - RNA, 19 nt, Homo sapiens
gaaaucaaacuggagauaa

SEQ ID NO: 648316 - RNA, 19 nt, Homo sapiens
ucacaaugauccagaaguu

SEQ ID NO: 648317 - RNA, 19 nt, Homo sapiens
gaaggucuauccucuuauc

SEQ ID NO: 648318 - RNA, 19 nt, Homo sapiens
ccaaaugaaaggcaaguua

SEQ ID NO: 648319 - RNA, 19 nt, Homo sapiens
gaugagaccagaagccaua

SEQ ID NO: 648320 - RNA, 19 nt, Homo sapiens
ccucuuauauaccaguuua

SEQ ID NO: 648321 - RNA, 19 nt, Homo sapiens
caacacauguaagaaagaa

SEQ ID NO: 648322 - RNA, 19 nt, Homo sapiens
uaagucauuuggagaauug

SEQ ID NO: 648323 - RNA, 19 nt, Homo sapiens
aaagagaacaggaguauau

SEQ ID NO: 648324 - RNA, 19 nt, Homo sapiens
ggauugagcagcagaaaga

SEQ ID NO: 648325 - RNA, 19 nt, Homo sapiens
ggagauaaauaugcuaaag

SEQ ID NO: 648326 - RNA, 19 nt, Homo sapiens
gaagagaggcgagaaagau

SEQ ID NO: 648327 - RNA, 19 nt, Homo sapiens
ugacaugcauccaaugaga

SEQ ID NO: 648328 - RNA, 19 nt, Homo sapiens
gcagucagguuuauuucau

SEQ ID NO: 648329 - RNA, 19 nt, Homo sapiens
caccaaggauguaguucua

SEQ ID NO: 648330 - RNA, 19 nt, Homo sapiens
guaaauacaagaagagguu

SEQ ID NO: 648331 - RNA, 19 nt, Homo sapiens
gauuguccaugaugaugua

SEQ ID NO: 648332 - RNA, 19 nt, Homo sapiens
uaagggaucagccaaauga

SEQ ID NO: 648333 - RNA, 19 nt, Homo sapiens
gcggagaaauacguucaua

SEQ ID NO: 648334 - RNA, 19 nt, Homo sapiens
gcagcagucagguuuauuu

SEQ ID NO: 648335 - RNA, 19 nt, Homo sapiens
ucacuuggaugguguguuc

SEQ ID NO: 648336 - RNA, 19 nt, Homo sapiens
uauaagggucgacauguua

SEQ ID NO: 648337 - RNA, 19 nt, Homo sapiens
uauauucgauccaaucaga

SEQ ID NO: 648338 - RNA, 19 nt, Homo sapiens
gcaagauccuacccggaaa

SEQ ID NO: 648339 - RNA, 19 nt, Homo sapiens
ggagagaaggcgcaaagaa

SEQ ID NO: 648340 - RNA, 19 nt, Homo sapiens
gaagaagagaggcgagaaa

SEQ ID NO: 648341 - RNA, 19 nt, Homo sapiens
gaagaguucuguggaaguc

SEQ ID NO: 648342 - RNA, 19 nt, Homo sapiens
ugacaucuguggugggauu

SEQ ID NO: 648343 - RNA, 19 nt, Homo sapiens
gcuuaaggaucauauagau

SEQ ID NO: 648344 - RNA, 19 nt, Homo sapiens
cagaaacauugcaacauau

SEQ ID NO: 648345 - RNA, 19 nt, Homo sapiens
ggaaacuggucacuuggau

SEQ ID NO: 648346 - RNA, 19 nt, Homo sapiens
ccaaagccauaucacaaau

SEQ ID NO: 648347 - RNA, 19 nt, Homo sapiens
cgacagagacauuuauugu

SEQ ID NO: 648348 - RNA, 19 nt, Homo sapiens
gaucguaccaggaagaaga

SEQ ID NO: 648349 - RNA, 19 nt, Homo sapiens
cuaaagaaauacucucauc

SEQ ID NO: 648350 - RNA, 19 nt, Homo sapiens
cagaugccaccuaugauua

SEQ ID NO: 648351 - RNA, 19 nt, Homo sapiens
agaaagaacccacacucua

SEQ ID NO: 648352 - RNA, 19 nt, Homo sapiens
ggagagaaggccauagaga

SEQ ID NO: 648353 - RNA, 19 nt, Homo sapiens
gaucagucuaugacauuua

SEQ ID NO: 648354 - RNA, 19 nt, Homo sapiens
gcucaguggucaaugugaa

SEQ ID NO: 648355 - RNA, 19 nt, Homo sapiens
gaucaucauccaagucuga

SEQ ID NO: 648356 - RNA, 19 nt, Homo sapiens
gcagugggcagcagaauag

SEQ ID NO: 648357 - RNA, 19 nt, Homo sapiens
gaaagagaacaggaguaua

SEQ ID NO: 648358 - RNA, 19 nt, Homo sapiens
ggugccuggugaagaauua

SEQ ID NO: 648359 - RNA, 19 nt, Homo sapiens
uuacagaagugaucuuugg

SEQ ID NO: 648360 - RNA, 19 nt, Homo sapiens
uguggaaacuggucacuug

SEQ ID NO: 648361 - RNA, 19 nt, Homo sapiens
gagagaaggccauagagau

SEQ ID NO: 648362 - RNA, 19 nt, Homo sapiens
guaaacacauauggaagga

SEQ ID NO: 648363 - RNA, 19 nt, Homo sapiens
gauccaguguagcaucaaa

SEQ ID NO: 648364 - RNA, 19 nt, Homo sapiens
gauucugugugcugccuua

SEQ ID NO: 648365 - RNA, 19 nt, Homo sapiens
guagcacacuccagaaaca

SEQ ID NO: 648366 - RNA, 19 nt, Homo sapiens
ugaccgcacuggccaaaga

SEQ ID NO: 648367 - RNA, 19 nt, Homo sapiens
uggcacaucuucacauuca

SEQ ID NO: 648368 - RNA, 19 nt, Homo sapiens
ucacaaauuuauggccuuu

SEQ ID NO: 648369 - RNA, 19 nt, Homo sapiens
ccagauuacuacagauuuc

SEQ ID NO: 648370 - RNA, 19 nt, Homo sapiens
gaaagaugaaacugaguau

SEQ ID NO: 648371 - RNA, 19 nt, Homo sapiens
ggaugucacugaggaugaa

SEQ ID NO: 648372 - RNA, 19 nt, Homo sapiens
ggcaggacuucucuucuga

SEQ ID NO: 648373 - RNA, 19 nt, Homo sapiens
ggaucagucuaugacauuu

SEQ ID NO: 648374 - RNA, 19 nt, Homo sapiens
gaaaggagcaagccaagcu

SEQ ID NO: 648375 - RNA, 19 nt, Homo sapiens
gcaaugacaagguguucuu

SEQ ID NO: 648376 - RNA, 19 nt, Homo sapiens
gcgagagguuccugugaga

SEQ ID NO: 648377 - RNA, 19 nt, Homo sapiens
gagagaaggcgcaaagaag

SEQ ID NO: 648378 - RNA, 19 nt, Homo sapiens
gaacagcgaaggagagaac

SEQ ID NO: 648379 - RNA, 19 nt, Homo sapiens
gaacgugaacagcgaagga

SEQ ID NO: 648380 - RNA, 19 nt, Homo sapiens
ggagaaauacguucauagg

SEQ ID NO: 648381 - RNA, 19 nt, Homo sapiens
gaggaaggccagagguuga

SEQ ID NO: 648382 - RNA, 19 nt, Homo sapiens
gcagcgucaucucugaauu

SEQ ID NO: 648383 - RNA, 19 nt, Homo sapiens
gaaaagaggagaguugaaa

SEQ ID NO: 648384 - RNA, 19 nt, Homo sapiens
gagacgggcagaagaagaa

SEQ ID NO: 648385 - RNA, 19 nt, Homo sapiens
gagaaggcgcaaagaagaa

SEQ ID NO: 648386 - RNA, 19 nt, Homo sapiens
gggagcaggaagaauauaa

SEQ ID NO: 648387 - RNA, 19 nt, Homo sapiens
ggagagccaaguuccauug

SEQ ID NO: 648388 - RNA, 19 nt, Homo sapiens
aagaugaaacugaguauga

SEQ ID NO: 648389 - RNA, 19 nt, Homo sapiens
ggaugaagaggaagaaauc

SEQ ID NO: 648390 - RNA, 19 nt, Homo sapiens
cuauaagggucgacauguu

SEQ ID NO: 648391 - RNA, 19 nt, Homo sapiens
uagcauauauucgauccaa

SEQ ID NO: 648392 - RNA, 19 nt, Homo sapiens
ugaagaggaagaaaucaaa

SEQ ID NO: 648393 - RNA, 19 nt, Homo sapiens
ugacauuuaucuaccaaca

SEQ ID NO: 648394 - RNA, 19 nt, Homo sapiens
ggagcaggaagaauauaaa

SEQ ID NO: 648395 - RNA, 19 nt, Homo sapiens
gaaauacucucaucacaga

SEQ ID NO: 648396 - RNA, 19 nt, Homo sapiens
gaccaacucuggcuuguua

SEQ ID NO: 648397 - RNA, 19 nt, Homo sapiens
gaagugaucuuuggucuug

SEQ ID NO: 648398 - RNA, 19 nt, Homo sapiens
gggaaggucuauccucuua

SEQ ID NO: 648399 - RNA, 19 nt, Homo sapiens
uuacagaccuugugaagaa

SEQ ID NO: 648400 - RNA, 19 nt, Homo sapiens
acagaaacauugcaacaua

SEQ ID NO: 648401 - RNA, 19 nt, Homo sapiens
cgaagacgauuucaacaaa

SEQ ID NO: 648402 - RNA, 19 nt, Homo sapiens
gaacuuggaauuccuugua

SEQ ID NO: 648403 - RNA, 19 nt, Homo sapiens
ggaacacacucaaagaaga

SEQ ID NO: 648404 - RNA, 19 nt, Homo sapiens
gugcagaccucauguguug

SEQ ID NO: 648405 - RNA, 19 nt, Homo sapiens
ggccagagguugaaaguga

SEQ ID NO: 648406 - RNA, 19 nt, Homo sapiens
gaggagaguugaaagagaa

SEQ ID NO: 648407 - RNA, 19 nt, Homo sapiens
ggugaaacuuguugacuuu

SEQ ID NO: 648408 - RNA, 19 nt, Homo sapiens
gaacgugccuggugagucu

SEQ ID NO: 648409 - RNA, 19 nt, Homo sapiens
gaacccagaugccaccuau

SEQ ID NO: 648410 - RNA, 19 nt, Homo sapiens
uaaguuacgugucuacuau

SEQ ID NO: 648411 - RNA, 19 nt, Homo sapiens
caaguuagaauccagcuua

SEQ ID NO: 648412 - RNA, 19 nt, Homo sapiens
caaaagggcucaaagacua

SEQ ID NO: 648413 - RNA, 19 nt, Homo sapiens
gagccaaguuccauuguga

SEQ ID NO: 648414 - RNA, 19 nt, Homo sapiens
gaaaucaaacuggagauaa

SEQ ID NO: 648415 - RNA, 19 nt, Homo sapiens
ucacaaugauccagaaguu

SEQ ID NO: 648416 - RNA, 19 nt, Homo sapiens
gaaggucuauccucuuauc

SEQ ID NO: 648417 - RNA, 19 nt, Homo sapiens
ccaaaugaaaggcaaguua

SEQ ID NO: 648418 - RNA, 19 nt, Homo sapiens
gaugagaccagaagccaua

SEQ ID NO: 648419 - RNA, 19 nt, Homo sapiens
ccucuuauauaccaguuua

SEQ ID NO: 648420 - RNA, 19 nt, Homo sapiens
uaagucauuuggagaauug

SEQ ID NO: 648421 - RNA, 19 nt, Homo sapiens
aaagagaacaggaguauau

SEQ ID NO: 648422 - RNA, 19 nt, Homo sapiens
ggauugagcagcagaaaga

SEQ ID NO: 648423 - RNA, 19 nt, Homo sapiens
ggagauaaauaugcuaaag

SEQ ID NO: 648424 - RNA, 19 nt, Homo sapiens
gcagacaggcagaguauug

SEQ ID NO: 648425 - RNA, 19 nt, Homo sapiens
gcaacaagaacaagcauau

SEQ ID NO: 648426 - RNA, 19 nt, Homo sapiens
gaagagaggcgagaaagau

SEQ ID NO: 648427 - RNA, 19 nt, Homo sapiens
ugacaugcauccaaugaga

SEQ ID NO: 648428 - RNA, 19 nt, Homo sapiens
gcagucagguuuauuucau

SEQ ID NO: 648429 - RNA, 19 nt, Homo sapiens
caccaaggauguaguucua

SEQ ID NO: 648430 - RNA, 19 nt, Homo sapiens
guaaauacaagaagagguu

SEQ ID NO: 648431 - RNA, 19 nt, Homo sapiens
gauuguccaugaugaugua

SEQ ID NO: 648432 - RNA, 19 nt, Homo sapiens
uaagggaucagccaaauga

SEQ ID NO: 648433 - RNA, 19 nt, Homo sapiens
gcggagaaauacguucaua

SEQ ID NO: 648434 - RNA, 19 nt, Homo sapiens
gcagcagucagguuuauuu

SEQ ID NO: 648435 - RNA, 19 nt, Homo sapiens
ucacuuggaugguguguuc

SEQ ID NO: 648436 - RNA, 19 nt, Homo sapiens
uauaagggucgacauguua

SEQ ID NO: 648437 - RNA, 19 nt, Homo sapiens
uauauucgauccaaucaga

SEQ ID NO: 648438 - RNA, 19 nt, Homo sapiens
gcaagauccuacccggaaa

SEQ ID NO: 648439 - RNA, 19 nt, Homo sapiens
ggagagaaggcgcaaagaa

SEQ ID NO: 648440 - RNA, 19 nt, Homo sapiens
gaagaagagaggcgagaaa

SEQ ID NO: 648441 - RNA, 19 nt, Homo sapiens
gaagaguucuguggaaguc

SEQ ID NO: 648442 - RNA, 19 nt, Homo sapiens
ugacaucuguggugggauu

SEQ ID NO: 648443 - RNA, 19 nt, Homo sapiens
gcuuaaggaucauauagau

SEQ ID NO: 648444 - RNA, 19 nt, Homo sapiens
cagaaacauugcaacauau

SEQ ID NO: 648445 - RNA, 19 nt, Homo sapiens
ggaaacuggucacuuggau

SEQ ID NO: 648446 - RNA, 19 nt, Homo sapiens
ccaaagccauaucacaaau

SEQ ID NO: 648447 - RNA, 19 nt, Homo sapiens
cgacagagacauuuauugu

SEQ ID NO: 648448 - RNA, 19 nt, Homo sapiens
gaucguaccaggaagaaga

SEQ ID NO: 648449 - RNA, 19 nt, Homo sapiens
cuaaagaaauacucucauc

SEQ ID NO: 648450 - RNA, 19 nt, Homo sapiens
cagaugccaccuaugauua

SEQ ID NO: 648451 - RNA, 19 nt, Homo sapiens
uggcaucucucaagaacaa

SEQ ID NO: 648452 - RNA, 19 nt, Homo sapiens
aagcauaucuccugucucu

SEQ ID NO: 648453 - RNA, 19 nt, Homo sapiens
ggagagaaggccauagaga

SEQ ID NO: 648454 - RNA, 19 nt, Homo sapiens
gaucagucuaugacauuua

SEQ ID NO: 648455 - RNA, 19 nt, Homo sapiens
gcucaguggucaaugugaa

SEQ ID NO: 648456 - RNA, 19 nt, Homo sapiens
gaucaucauccaagucuga

SEQ ID NO: 648457 - RNA, 19 nt, Homo sapiens
gcagugggcagcagaauag

SEQ ID NO: 648458 - RNA, 19 nt, Homo sapiens
gaaagagaacaggaguaua

SEQ ID NO: 648459 - RNA, 19 nt, Homo sapiens
ggugccuggugaagaauua

SEQ ID NO: 648460 - RNA, 19 nt, Homo sapiens
uuacagaagugaucuuugg

SEQ ID NO: 648461 - RNA, 19 nt, Homo sapiens
uguggaaacuggucacuug

SEQ ID NO: 648462 - RNA, 19 nt, Homo sapiens
gagagaaggccauagagau

SEQ ID NO: 648463 - RNA, 19 nt, Homo sapiens
guaaacacauauggaagga

SEQ ID NO: 648464 - RNA, 19 nt, Homo sapiens
gauucugugugcugccuua

SEQ ID NO: 648465 - RNA, 19 nt, Homo sapiens
guagcacacuccagaaaca

SEQ ID NO: 648466 - RNA, 19 nt, Homo sapiens
ugaccgcacuggccaaaga

SEQ ID NO: 648467 - RNA, 19 nt, Homo sapiens
uggcacaucuucacauuca

SEQ ID NO: 648468 - RNA, 19 nt, Homo sapiens
ucacaaauuuauggccuuu

SEQ ID NO: 648469 - RNA, 19 nt, Homo sapiens
ccagauuacuacagauuuc

SEQ ID NO: 648470 - RNA, 19 nt, Homo sapiens
ugacccuucucccaaauuu

SEQ ID NO: 648471 - RNA, 19 nt, Homo sapiens
gaaagaugaaacugaguau

SEQ ID NO: 648472 - RNA, 19 nt, Homo sapiens
ggaugucacugaggaugaa

SEQ ID NO: 648473 - RNA, 19 nt, Homo sapiens
ggcaggacuucucuucuga

SEQ ID NO: 648474 - RNA, 19 nt, Homo sapiens
ggaucagucuaugacauuu

SEQ ID NO: 648475 - RNA, 19 nt, Homo sapiens
gaaaggagcaagccaagcu

SEQ ID NO: 648476 - RNA, 19 nt, Homo sapiens
gcaaugacaagguguucuu

SEQ ID NO: 648477 - RNA, 19 nt, Homo sapiens
gcacaccaccaucuucguu

SEQ ID NO: 648478 - RNA, 19 nt, Homo sapiens
gagagaaggcgcaaagaag

SEQ ID NO: 648479 - RNA, 19 nt, Homo sapiens
gaacagcgaaggagagaac

SEQ ID NO: 648480 - RNA, 19 nt, Homo sapiens
gaacgugaacagcgaagga

SEQ ID NO: 648481 - RNA, 19 nt, Homo sapiens
ggagaaauacguucauagg

SEQ ID NO: 648482 - RNA, 19 nt, Homo sapiens
gaggaaggccagagguuga

SEQ ID NO: 648483 - RNA, 19 nt, Homo sapiens
gcagcgucaucucugaauu

SEQ ID NO: 648484 - RNA, 19 nt, Homo sapiens
gaaaagaggagaguugaaa

SEQ ID NO: 648485 - RNA, 19 nt, Homo sapiens
gagacgggcagaagaagaa

SEQ ID NO: 648486 - RNA, 19 nt, Homo sapiens
gagaaggcgcaaagaagaa

SEQ ID NO: 648487 - RNA, 19 nt, Homo sapiens
gggagcaggaagaauauaa

SEQ ID NO: 648488 - RNA, 19 nt, Homo sapiens
ggagagccaaguuccauug

SEQ ID NO: 648489 - RNA, 19 nt, Homo sapiens
aagaugaaacugaguauga

SEQ ID NO: 648490 - RNA, 19 nt, Homo sapiens
ggaugaagaggaagaaauc

SEQ ID NO: 648491 - RNA, 19 nt, Homo sapiens
cuauaagggucgacauguu

SEQ ID NO: 648492 - RNA, 19 nt, Homo sapiens
ugaagaggaagaaaucaaa

SEQ ID NO: 648493 - RNA, 19 nt, Homo sapiens
uagcauauauucgauccaa

SEQ ID NO: 648494 - RNA, 19 nt, Homo sapiens
ugacauuuaucuaccaaca

SEQ ID NO: 648495 - RNA, 19 nt, Homo sapiens
gaaauacucucaucacaga

SEQ ID NO: 648496 - RNA, 19 nt, Homo sapiens
gaccaacucuggcuuguua

SEQ ID NO: 648497 - RNA, 19 nt, Homo sapiens
gaagugaucuuuggucuug

SEQ ID NO: 648498 - RNA, 19 nt, Homo sapiens
gggaaggucuauccucuua

SEQ ID NO: 648499 - RNA, 19 nt, Homo sapiens
uuacagaccuugugaagaa

SEQ ID NO: 648500 - RNA, 19 nt, Homo sapiens
acagaaacauugcaacaua

SEQ ID NO: 648501 - RNA, 19 nt, Homo sapiens
cgaagacgauuucaacaaa

SEQ ID NO: 648502 - RNA, 19 nt, Homo sapiens
gaacuuggaauuccuugua

SEQ ID NO: 648503 - RNA, 19 nt, Homo sapiens
ggaacacacucaaagaaga

SEQ ID NO: 648504 - RNA, 19 nt, Homo sapiens
gugcagaccucauguguug

SEQ ID NO: 648505 - RNA, 19 nt, Homo sapiens
ggccagagguugaaaguga

SEQ ID NO: 648506 - RNA, 19 nt, Homo sapiens
gaggagaguugaaagagaa

SEQ ID NO: 648507 - RNA, 19 nt, Homo sapiens
ggugaaacuuguugacuuu

SEQ ID NO: 648508 - RNA, 19 nt, Homo sapiens
gaacgugccuggugagucu

SEQ ID NO: 648509 - RNA, 19 nt, Homo sapiens
gaacccagaugccaccuau

SEQ ID NO: 648510 - RNA, 19 nt, Homo sapiens
uaaguuacgugucuacuau

SEQ ID NO: 648511 - RNA, 19 nt, Homo sapiens
caaguuagaauccagcuua

SEQ ID NO: 648512 - RNA, 19 nt, Homo sapiens
caaaagggcucaaagacua

SEQ ID NO: 648513 - RNA, 19 nt, Homo sapiens
gagccaaguuccauuguga

SEQ ID NO: 648514 - RNA, 19 nt, Homo sapiens
gaaaucaaacuggagauaa

SEQ ID NO: 648515 - RNA, 19 nt, Homo sapiens
ucacaaugauccagaaguu

SEQ ID NO: 648516 - RNA, 19 nt, Homo sapiens
gaaggucuauccucuuauc

SEQ ID NO: 648517 - RNA, 19 nt, Homo sapiens
ccaaaugaaaggcaaguua

SEQ ID NO: 648518 - RNA, 19 nt, Homo sapiens
gaugagaccagaagccaua

SEQ ID NO: 648519 - RNA, 19 nt, Homo sapiens
ccucuuauauaccaguuua

SEQ ID NO: 648520 - RNA, 19 nt, Homo sapiens
uaagucauuuggagaauug

SEQ ID NO: 648521 - RNA, 19 nt, Homo sapiens
aaagagaacaggaguauau

SEQ ID NO: 648522 - RNA, 19 nt, Homo sapiens
ggauugagcagcagaaaga

SEQ ID NO: 648523 - RNA, 19 nt, Homo sapiens
ggagauaaauaugcuaaag

SEQ ID NO: 648524 - RNA, 19 nt, Homo sapiens
gcagacaggcagaguauug

SEQ ID NO: 648525 - RNA, 19 nt, Homo sapiens
gaagagaggcgagaaagau

SEQ ID NO: 648526 - RNA, 19 nt, Homo sapiens
ugacaugcauccaaugaga

SEQ ID NO: 648527 - RNA, 19 nt, Homo sapiens
gcagucagguuuauuucau

SEQ ID NO: 648528 - RNA, 19 nt, Homo sapiens
caccaaggauguaguucua

SEQ ID NO: 648529 - RNA, 19 nt, Homo sapiens
guaaauacaagaagagguu

SEQ ID NO: 648530 - RNA, 19 nt, Homo sapiens
gauuguccaugaugaugua

SEQ ID NO: 648531 - RNA, 19 nt, Homo sapiens
uaagggaucagccaaauga

SEQ ID NO: 648532 - RNA, 19 nt, Homo sapiens
gcggagaaauacguucaua

SEQ ID NO: 648533 - RNA, 19 nt, Homo sapiens
gcagcagucagguuuauuu

SEQ ID NO: 648534 - RNA, 19 nt, Homo sapiens
ucacuuggaugguguguuc

SEQ ID NO: 648535 - RNA, 19 nt, Homo sapiens
uauauucgauccaaucaga

SEQ ID NO: 648536 - RNA, 19 nt, Homo sapiens
uauaagggucgacauguua

SEQ ID NO: 648537 - RNA, 19 nt, Homo sapiens
gcaagauccuacccggaaa

SEQ ID NO: 648538 - RNA, 19 nt, Homo sapiens
ggagagaaggcgcaaagaa

SEQ ID NO: 648539 - RNA, 19 nt, Homo sapiens
gaagaagagaggcgagaaa

SEQ ID NO: 648540 - RNA, 19 nt, Homo sapiens
gaagaguucuguggaaguc

SEQ ID NO: 648541 - RNA, 19 nt, Homo sapiens
ugacaucuguggugggauu

SEQ ID NO: 648542 - RNA, 19 nt, Homo sapiens
gcuuaaggaucauauagau

SEQ ID NO: 648543 - RNA, 19 nt, Homo sapiens
cagaaacauugcaacauau

SEQ ID NO: 648544 - RNA, 19 nt, Homo sapiens
ggaaacuggucacuuggau

SEQ ID NO: 648545 - RNA, 19 nt, Homo sapiens
ccaaagccauaucacaaau

SEQ ID NO: 648546 - RNA, 19 nt, Homo sapiens
cgacagagacauuuauugu

SEQ ID NO: 648547 - RNA, 19 nt, Homo sapiens
gaucguaccaggaagaaga

SEQ ID NO: 648548 - RNA, 19 nt, Homo sapiens
cuaaagaaauacucucauc

SEQ ID NO: 648549 - RNA, 19 nt, Homo sapiens
cagaugccaccuaugauua

SEQ ID NO: 648550 - RNA, 19 nt, Homo sapiens
ggagagaaggccauagaga

SEQ ID NO: 648551 - RNA, 19 nt, Homo sapiens
gaucagucuaugacauuua

SEQ ID NO: 648552 - RNA, 19 nt, Homo sapiens
gcucaguggucaaugugaa

SEQ ID NO: 648553 - RNA, 19 nt, Homo sapiens
gaucaucauccaagucuga

SEQ ID NO: 648554 - RNA, 19 nt, Homo sapiens
gcagugggcagcagaauag

SEQ ID NO: 648555 - RNA, 19 nt, Homo sapiens
gaaagagaacaggaguaua

SEQ ID NO: 648556 - RNA, 19 nt, Homo sapiens
ggugccuggugaagaauua

SEQ ID NO: 648557 - RNA, 19 nt, Homo sapiens
uuacagaagugaucuuugg

SEQ ID NO: 648558 - RNA, 19 nt, Homo sapiens
uguggaaacuggucacuug

SEQ ID NO: 648559 - RNA, 19 nt, Homo sapiens
gagagaaggccauagagau

SEQ ID NO: 648560 - RNA, 19 nt, Homo sapiens
guaaacacauauggaagga

SEQ ID NO: 648561 - RNA, 19 nt, Homo sapiens
gauucugugugcugccuua

SEQ ID NO: 648562 - RNA, 19 nt, Homo sapiens
guagcacacuccagaaaca

SEQ ID NO: 648563 - RNA, 19 nt, Homo sapiens
ugaccgcacuggccaaaga

SEQ ID NO: 648564 - RNA, 19 nt, Homo sapiens
uggcacaucuucacauuca

SEQ ID NO: 648565 - RNA, 19 nt, Homo sapiens
ggaugucacugaggaugaa

SEQ ID NO: 648566 - RNA, 19 nt, Homo sapiens
ucacaaauuuauggccuuu

SEQ ID NO: 648567 - RNA, 19 nt, Homo sapiens
ccagauuacuacagauuuc

SEQ ID NO: 648568 - RNA, 19 nt, Homo sapiens
gaaagaugaaacugaguau

SEQ ID NO: 648569 - RNA, 19 nt, Homo sapiens
ggcaggacuucucuucuga

SEQ ID NO: 648570 - RNA, 19 nt, Homo sapiens
ggaucagucuaugacauuu

SEQ ID NO: 648571 - RNA, 19 nt, Homo sapiens
gaaaggagcaagccaagcu

SEQ ID NO: 648572 - RNA, 19 nt, Homo sapiens
gcaaugacaagguguucuu

SEQ ID NO: 648573 - RNA, 19 nt, Homo sapiens
gagagaaggcgcaaagaag

SEQ ID NO: 648574 - RNA, 19 nt, Homo sapiens
gaacagcgaaggagagaac

SEQ ID NO: 648575 - RNA, 19 nt, Homo sapiens
gaacgugaacagcgaagga

SEQ ID NO: 648576 - RNA, 19 nt, Homo sapiens
ggagaaauacguucauagg

SEQ ID NO: 648577 - RNA, 19 nt, Homo sapiens
ggaugaagaggaagaaauc

SEQ ID NO: 648578 - RNA, 19 nt, Homo sapiens
gaggaaggccagagguuga

SEQ ID NO: 648579 - RNA, 19 nt, Homo sapiens
gcagcgucaucucugaauu

SEQ ID NO: 648580 - RNA, 19 nt, Homo sapiens
gaaaagaggagaguugaaa

SEQ ID NO: 648581 - RNA, 19 nt, Homo sapiens
gagacgggcagaagaagaa

SEQ ID NO: 648582 - RNA, 19 nt, Homo sapiens
gagaaggcgcaaagaagaa

SEQ ID NO: 648583 - RNA, 19 nt, Homo sapiens
gggagcaggaagaauauaa

SEQ ID NO: 648584 - RNA, 19 nt, Homo sapiens
ggagagccaaguuccauug

SEQ ID NO: 648585 - RNA, 19 nt, Homo sapiens
aagaugaaacugaguauga

SEQ ID NO: 648586 - RNA, 19 nt, Homo sapiens
cuauaagggucgacauguu

SEQ ID NO: 648587 - RNA, 19 nt, Homo sapiens
uagcauauauucgauccaa

SEQ ID NO: 648588 - RNA, 19 nt, Homo sapiens
ugacauuuaucuaccaaca

SEQ ID NO: 648589 - RNA, 19 nt, Homo sapiens
ugaagaggaagaaaucaaa

SEQ ID NO: 648590 - RNA, 19 nt, Homo sapiens
ggagcaggaagaauauaaa

SEQ ID NO: 648591 - RNA, 19 nt, Homo sapiens
ggaagaagaggaggaagug

SEQ ID NO: 648592 - RNA, 19 nt, Homo sapiens
gcgagaaagaugaaacuga

SEQ ID NO: 648593 - RNA, 19 nt, Homo sapiens
gaaacuuguugacuuuggu

SEQ ID NO: 648594 - RNA, 19 nt, Homo sapiens
gguugaaagugaucuaugg

SEQ ID NO: 648595 - RNA, 19 nt, Homo sapiens
ggaaaggagagcagauuua

SEQ ID NO: 648596 - RNA, 19 nt, Homo sapiens
ucucaaggcucaucuguuu

SEQ ID NO: 648597 - RNA, 19 nt, Homo sapiens
gaauguaucuguuucuaag

SEQ ID NO: 648598 - RNA, 19 nt, Homo sapiens
gagagcagauuuacuaugc

SEQ ID NO: 648599 - RNA, 19 nt, Homo sapiens
ccacagauguaaugaaguc

SEQ ID NO: 648600 - RNA, 19 nt, Homo sapiens
gcucaucuguuuugaauuu

SEQ ID NO: 648601 - RNA, 19 nt, Homo sapiens
ugaccuagcucucaugucu

SEQ ID NO: 648602 - RNA, 19 nt, Homo sapiens
ucacaguuaccaagaauaa

SEQ ID NO: 648603 - RNA, 19 nt, Homo sapiens
gaguugcgauccauuacaa

SEQ ID NO: 648604 - RNA, 19 nt, Homo sapiens
aaggagagcagauuuacua

SEQ ID NO: 648605 - RNA, 19 nt, Homo sapiens
ugagagaggacaucaaaga

SEQ ID NO: 648606 - RNA, 19 nt, Homo sapiens
gaaaggagagcagauuuac

SEQ ID NO: 648607 - RNA, 19 nt, Homo sapiens
ccagaguugcgauccauua

SEQ ID NO: 648608 - RNA, 19 nt, Homo sapiens
gagugcagcugcuaauuuu

SEQ ID NO: 648609 - RNA, 19 nt, Homo sapiens
gagaagcagucugaugaca

SEQ ID NO: 648610 - RNA, 19 nt, Homo sapiens
gggaggagaagcagucuga

SEQ ID NO: 648611 - RNA, 19 nt, Homo sapiens
gauuuuggcuuuucuguug

SEQ ID NO: 648612 - RNA, 19 nt, Homo sapiens
ccaccagacucaccugcuu

SEQ ID NO: 648613 - RNA, 19 nt, Homo sapiens
caaagagugcagcugcuaa

SEQ ID NO: 648614 - RNA, 19 nt, Homo sapiens
gcgauccauuacaagauuu

SEQ ID NO: 648615 - RNA, 19 nt, Homo sapiens
ccgaauguaucuguuucua

SEQ ID NO: 648616 - RNA, 19 nt, Homo sapiens
gaaaaguguuccaagcaau

SEQ ID NO: 648617 - RNA, 19 nt, Homo sapiens
guaaugaaguccccgaaug

SEQ ID NO: 648618 - RNA, 19 nt, Homo sapiens
cgaauguaucuguuucuaa

SEQ ID NO: 648619 - RNA, 19 nt, Homo sapiens
gaggagaagcagucugaug

SEQ ID NO: 648620 - RNA, 19 nt, Homo sapiens
ggagagcagauuuacuaug

SEQ ID NO: 648621 - RNA, 19 nt, Homo sapiens
agagugcagcugcuaauuu

SEQ ID NO: 648622 - RNA, 19 nt, Homo sapiens
aaaguguuccaagcaauua

SEQ ID NO: 648623 - RNA, 19 nt, Homo sapiens
gagugcuuccucacaguua

SEQ ID NO: 648624 - RNA, 19 nt, Homo sapiens
ccucacaguuaccaagaau

SEQ ID NO: 648625 - RNA, 19 nt, Homo sapiens
aggagaagcagucugauga

SEQ ID NO: 648626 - RNA, 19 nt, Homo sapiens
cagggagaauaccagguuu

SEQ ID NO: 648627 - RNA, 19 nt, Homo sapiens
augcugggccugucaauaa

SEQ ID NO: 648628 - RNA, 19 nt, Homo sapiens
ggcacgagcccaccaugaa

SEQ ID NO: 648629 - RNA, 19 nt, Homo sapiens
ccaaagagugcagcugcua

SEQ ID NO: 648630 - RNA, 19 nt, Homo sapiens
gaaggaaaggagagcagau

SEQ ID NO: 648631 - RNA, 19 nt, Homo sapiens
gcacgagcccaccaugaag

SEQ ID NO: 648632 - RNA, 19 nt, Homo sapiens
ccuccaagcuccucugacu

SEQ ID NO: 648633 - RNA, 19 nt, Homo sapiens
ugcgauccauuacaagauu

SEQ ID NO: 648634 - RNA, 19 nt, Homo sapiens
aggcggcucugcccaaguu

SEQ ID NO: 648635 - RNA, 19 nt, Homo sapiens
ucugagagaggacaucaaa

SEQ ID NO: 648636 - RNA, 19 nt, Homo sapiens
ggagugcuuccucacaguu

SEQ ID NO: 648637 - RNA, 19 nt, Homo sapiens
gacuguggccuguagcaaa

SEQ ID NO: 648638 - RNA, 19 nt, Homo sapiens
ugcuggaacuguacacuga

SEQ ID NO: 648639 - RNA, 19 nt, Homo sapiens
ucagggagaauaccagguu

SEQ ID NO: 648640 - RNA, 19 nt, Homo sapiens
cgacagcggcuuggaagug

SEQ ID NO: 648641 - RNA, 19 nt, Homo sapiens
ucuccuaucccaucuguga

SEQ ID NO: 648642 - RNA, 19 nt, Homo sapiens
gagagaggacaucaaagag

SEQ ID NO: 648643 - RNA, 19 nt, Homo sapiens
ucuugaggguccauccuuu

SEQ ID NO: 648644 - RNA, 19 nt, Homo sapiens
gcuuggaagugcucuacca

SEQ ID NO: 648645 - RNA, 19 nt, Homo sapiens
ugaaaaguguuccaagcaa

SEQ ID NO: 648646 - RNA, 19 nt, Homo sapiens
cuccacagauguaaugaag

SEQ ID NO: 648647 - RNA, 19 nt, Homo sapiens
cuggaacuguacacugaaa

SEQ ID NO: 648648 - RNA, 19 nt, Homo sapiens
ggaaagccuggcccacaca

SEQ ID NO: 648649 - RNA, 19 nt, Homo sapiens
uccaagcuccucugacuga

SEQ ID NO: 648650 - RNA, 19 nt, Homo sapiens
agacuccacagauguaaug

SEQ ID NO: 648651 - RNA, 19 nt, Homo sapiens
acaguuaccaagaauaaag

SEQ ID NO: 648652 - RNA, 19 nt, Homo sapiens
aaagagugcagcugcuaau

SEQ ID NO: 648653 - RNA, 19 nt, Homo sapiens
ccaagcuccucugacugaa

SEQ ID NO: 648654 - RNA, 19 nt, Homo sapiens
aggaaaggagagcagauuu

SEQ ID NO: 648655 - RNA, 19 nt, Homo sapiens
agacucaccugcuuuucaa

SEQ ID NO: 648656 - RNA, 19 nt, Homo sapiens
caccagacucaccugcuuu

SEQ ID NO: 648657 - RNA, 19 nt, Homo sapiens
guugcgauccauuacaaga

SEQ ID NO: 648658 - RNA, 19 nt, Homo sapiens
gauaauagccuacuucuua

SEQ ID NO: 648659 - RNA, 19 nt, Homo sapiens
ggaaacagcuauucucaua

SEQ ID NO: 648660 - RNA, 19 nt, Homo sapiens
gaagcuacauugucuauuu

SEQ ID NO: 648661 - RNA, 19 nt, Homo sapiens
gguaggaucugaugaauuu

SEQ ID NO: 648662 - RNA, 19 nt, Homo sapiens
gaaaaucucugacuacaua

SEQ ID NO: 648663 - RNA, 19 nt, Homo sapiens
ggaacgaccugaagcuaua

SEQ ID NO: 648664 - RNA, 19 nt, Homo sapiens
caacuaacuucuucaacua

SEQ ID NO: 648665 - RNA, 19 nt, Homo sapiens
aaacgaagcacacagauua

SEQ ID NO: 648666 - RNA, 19 nt, Homo sapiens
uuaggaaucugcacuauuu

SEQ ID NO: 648667 - RNA, 19 nt, Homo sapiens
caaaguagaugacugcaau

SEQ ID NO: 648668 - RNA, 19 nt, Homo sapiens
gcaauuagccuuaaguugu

SEQ ID NO: 648669 - RNA, 19 nt, Homo sapiens
gcaucugccugguuacuua

SEQ ID NO: 648670 - RNA, 19 nt, Homo sapiens
guagaugacugcaauuaug

SEQ ID NO: 648671 - RNA, 19 nt, Homo sapiens
gaaauauccuugugaguac

SEQ ID NO: 648672 - RNA, 19 nt, Homo sapiens
ggucaagguuggagacuuu

SEQ ID NO: 648673 - RNA, 19 nt, Homo sapiens
gcgagaaguuaaagccuua

SEQ ID NO: 648674 - RNA, 19 nt, Homo sapiens
ucucaaauuuccaccauua

SEQ ID NO: 648675 - RNA, 19 nt, Homo sapiens
ccagagaaguggcaagaaa

SEQ ID NO: 648676 - RNA, 19 nt, Homo sapiens
gacaguagcuggaaugaca

SEQ ID NO: 648677 - RNA, 19 nt, Homo sapiens
gcaaugagaaguggaauuu

SEQ ID NO: 648678 - RNA, 19 nt, Homo sapiens
uagcaaaucuucuucugaa

SEQ ID NO: 648679 - RNA, 19 nt, Homo sapiens
gagaaccuccucuucaaua

SEQ ID NO: 648680 - RNA, 19 nt, Homo sapiens
acaaaugucucaguaauga

SEQ ID NO: 648681 - RNA, 19 nt, Homo sapiens
acaggaagcugccauaaug

SEQ ID NO: 648682 - RNA, 19 nt, Homo sapiens
gcagcaaucccuaauauau

SEQ ID NO: 648683 - RNA, 19 nt, Homo sapiens
aaauuuggcugaaagauga

SEQ ID NO: 648684 - RNA, 19 nt, Homo sapiens
agaaauaguugcaacgauu

SEQ ID NO: 648685 - RNA, 19 nt, Homo sapiens
gaaacgagagccggauuua

SEQ ID NO: 648686 - RNA, 19 nt, Homo sapiens
gaaguggaauuucaguguu

SEQ ID NO: 648687 - RNA, 19 nt, Homo sapiens
cacgauaucuaacugauuu

SEQ ID NO: 648688 - RNA, 19 nt, Homo sapiens
caacaagaauauccgcaaa

SEQ ID NO: 648689 - RNA, 19 nt, Homo sapiens
ccaaacugauuauagguaa

SEQ ID NO: 648690 - RNA, 19 nt, Homo sapiens
ggaccaaacuguauaugag

SEQ ID NO: 648691 - RNA, 19 nt, Homo sapiens
uaaacuaacugcuuucaag

SEQ ID NO: 648692 - RNA, 19 nt, Homo sapiens
gagaauugcugccuuggau

SEQ ID NO: 648693 - RNA, 19 nt, Homo sapiens
ggaaugggaguaccaguuu

SEQ ID NO: 648694 - RNA, 19 nt, Homo sapiens
uggaaacccuuaauucauu

SEQ ID NO: 648695 - RNA, 19 nt, Homo sapiens
acuaaucgauugcauauug

SEQ ID NO: 648696 - RNA, 19 nt, Homo sapiens
guacagaacacacuuaagu

SEQ ID NO: 648697 - RNA, 19 nt, Homo sapiens
gcggaaaguuugcucaaug

SEQ ID NO: 648698 - RNA, 19 nt, Homo sapiens
gcacguccuugccuucuug

SEQ ID NO: 648699 - RNA, 19 nt, Homo sapiens
gaaauuuggcugaaagaug

SEQ ID NO: 648700 - RNA, 19 nt, Homo sapiens
gaaagucauucccaucagu

SEQ ID NO: 648701 - RNA, 19 nt, Homo sapiens
uuaaucaucucacuugcua

SEQ ID NO: 648702 - RNA, 19 nt, Homo sapiens
uagcagcaaucccuaauau

SEQ ID NO: 648703 - RNA, 19 nt, Homo sapiens
gauaaugcuuccaguaaag

SEQ ID NO: 648704 - RNA, 19 nt, Homo sapiens
guugcugacuggaaaguua

SEQ ID NO: 648705 - RNA, 19 nt, Homo sapiens
gaagggaggacaucuggaa

SEQ ID NO: 648706 - RNA, 19 nt, Homo sapiens
cauaauggacauagugaua

SEQ ID NO: 648707 - RNA, 19 nt, Homo sapiens
gaacaggaagcugccauaa

SEQ ID NO: 648708 - RNA, 19 nt, Homo sapiens
gaacacagaagagucuaaa

SEQ ID NO: 648709 - RNA, 19 nt, Homo sapiens
cagcaaucccuaauauaua

SEQ ID NO: 648710 - RNA, 19 nt, Homo sapiens
agaaauauccuugugagua

SEQ ID NO: 648711 - RNA, 19 nt, Homo sapiens
cagagcagauucauggaaa

SEQ ID NO: 648712 - RNA, 19 nt, Homo sapiens
aaagauggaugaaauuugg

SEQ ID NO: 648713 - RNA, 19 nt, Homo sapiens
uggaaucugucacuaauga

SEQ ID NO: 648714 - RNA, 19 nt, Homo sapiens
guggaaaggugagguauau

SEQ ID NO: 648715 - RNA, 19 nt, Homo sapiens
gguaacaguuuaaucaucu

SEQ ID NO: 648716 - RNA, 19 nt, Homo sapiens
gaauaugccuguccaaaau

SEQ ID NO: 648717 - RNA, 19 nt, Homo sapiens
gaugaaauuuggcugaaag

SEQ ID NO: 648718 - RNA, 19 nt, Homo sapiens
gcaauuaugcuaucaagag

SEQ ID NO: 648719 - RNA, 19 nt, Homo sapiens
guaauuaucagcacuuuag

SEQ ID NO: 648720 - RNA, 19 nt, Homo sapiens
ggacauagugauaaagguu

SEQ ID NO: 648721 - RNA, 19 nt, Homo sapiens
gaucauuccuucccuggau

SEQ ID NO: 648722 - RNA, 19 nt, Homo sapiens
caaccauugugcuaauaaa

SEQ ID NO: 648723 - RNA, 19 nt, Homo sapiens
ccacuggaauucucaggaa

SEQ ID NO: 648724 - RNA, 19 nt, Homo sapiens
caaauggaaacccuuaauu

SEQ ID NO: 648725 - RNA, 19 nt, Homo sapiens
caauuagccuuaaguugug

SEQ ID NO: 648726 - RNA, 19 nt, Homo sapiens
ugauaaugcuuccaguaaa

SEQ ID NO: 648727 - RNA, 19 nt, Homo sapiens
ggaaacccuuaauucauuc

SEQ ID NO: 648728 - RNA, 19 nt, Homo sapiens
gcaauuauuccuuuaccaa

SEQ ID NO: 648729 - RNA, 19 nt, Homo sapiens
ccaaugggauagugacgaa

SEQ ID NO: 648730 - RNA, 19 nt, Homo sapiens
acaaguagcacaaacugua

SEQ ID NO: 648731 - RNA, 19 nt, Homo sapiens
gaaacagcuauucucauaa

SEQ ID NO: 648732 - RNA, 19 nt, Homo sapiens
gcaguggaguuucuucaca

SEQ ID NO: 648733 - RNA, 19 nt, Homo sapiens
gaaaagaaaaccucaaaga

SEQ ID NO: 648734 - RNA, 19 nt, Homo sapiens
ccauugugcuaauaaacua

SEQ ID NO: 648735 - RNA, 19 nt, Homo sapiens
uaucauagcaacaacguuu

SEQ ID NO: 648736 - RNA, 19 nt, Homo sapiens
gcagucaucagucagaauu

SEQ ID NO: 648737 - RNA, 19 nt, Homo sapiens
ugaagaagacauuguagaa

SEQ ID NO: 648738 - RNA, 19 nt, Homo sapiens
guuauggcauucaguaaga

SEQ ID NO: 648739 - RNA, 19 nt, Homo sapiens
gcuaauaaacuaacugcuu

SEQ ID NO: 648740 - RNA, 19 nt, Homo sapiens
ugaagcuucuccuuaugua

SEQ ID NO: 648741 - RNA, 19 nt, Homo sapiens
cagaacuccugucuuggua

SEQ ID NO: 648742 - RNA, 19 nt, Homo sapiens
guaacuguauuguucuaga

SEQ ID NO: 648743 - RNA, 19 nt, Homo sapiens
ggagagagucaggaccuua

SEQ ID NO: 648744 - RNA, 19 nt, Homo sapiens
gguuggagacuuuggguua

SEQ ID NO: 648745 - RNA, 19 nt, Homo sapiens
gugauaaugcuuccaguaa

SEQ ID NO: 648746 - RNA, 19 nt, Homo sapiens
ggaugaaauuuggcugaaa

SEQ ID NO: 648747 - RNA, 19 nt, Homo sapiens
cgagauaggcugucacuca

SEQ ID NO: 648748 - RNA, 19 nt, Homo sapiens
gaacaaaacauucaagaca

SEQ ID NO: 648749 - RNA, 19 nt, Homo sapiens
gagagagucaggaccuuaa

SEQ ID NO: 648750 - RNA, 19 nt, Homo sapiens
cagcuauucucauaaagug

SEQ ID NO: 648751 - RNA, 19 nt, Homo sapiens
gcaaccauugugcuaauaa

SEQ ID NO: 648752 - RNA, 19 nt, Homo sapiens
gaagauucuggcugugaua

SEQ ID NO: 648753 - RNA, 19 nt, Homo sapiens
uagcaaaccagagguauuu

SEQ ID NO: 648754 - RNA, 19 nt, Homo sapiens
gcacuccuuugaacuuugu

SEQ ID NO: 648755 - RNA, 19 nt, Homo sapiens
gcaacgauuuuguuuugua

SEQ ID NO: 648756 - RNA, 19 nt, Homo sapiens
ccacauuacaacaagaaua

SEQ ID NO: 648757 - RNA, 19 nt, Homo sapiens
ccaaugagaacacagaaga

SEQ ID NO: 648758 - RNA, 19 nt, Homo sapiens
gauaaaugcuggaagauua

SEQ ID NO: 648759 - RNA, 19 nt, Homo sapiens
caagaucugucaagaguaa

SEQ ID NO: 648760 - RNA, 19 nt, Homo sapiens
gauagaguguccuugguaa

SEQ ID NO: 648761 - RNA, 19 nt, Homo sapiens
gagccugcauuuacaagua

SEQ ID NO: 648762 - RNA, 19 nt, Homo sapiens
gauaucugccucaaacuua

SEQ ID NO: 648763 - RNA, 19 nt, Homo sapiens
ggaggaaauucgugauguu

SEQ ID NO: 648764 - RNA, 19 nt, Homo sapiens
ugacaacauugcaaucauu

SEQ ID NO: 648765 - RNA, 19 nt, Homo sapiens
ucugggagauguaugcuua

SEQ ID NO: 648766 - RNA, 19 nt, Homo sapiens
uaaaguaagugcuguuugg

SEQ ID NO: 648767 - RNA, 19 nt, Homo sapiens
gcauuuacucuauugcuua

SEQ ID NO: 648768 - RNA, 19 nt, Homo sapiens
ggaaauucgugauguuagu

SEQ ID NO: 648769 - RNA, 19 nt, Homo sapiens
ggagauguaugcuuacucu

SEQ ID NO: 648770 - RNA, 19 nt, Homo sapiens
ggucagaacucagauacug

SEQ ID NO: 648771 - RNA, 19 nt, Homo sapiens
gaggaaauucgugauguua

SEQ ID NO: 648772 - RNA, 19 nt, Homo sapiens
gggauacucaagauauuua

SEQ ID NO: 648773 - RNA, 19 nt, Homo sapiens
cauuaagguuuaugggaua

SEQ ID NO: 648774 - RNA, 19 nt, Homo sapiens
gcccgaagauucacuaugg

SEQ ID NO: 648775 - RNA, 19 nt, Homo sapiens
gaaauucgugauguuagua

SEQ ID NO: 648776 - RNA, 19 nt, Homo sapiens
gauguaugcuuacucucuu

SEQ ID NO: 648777 - RNA, 19 nt, Homo sapiens
guguuagacugaagauaaa

SEQ ID NO: 648778 - RNA, 19 nt, Homo sapiens
caagauauuuacucaugca

SEQ ID NO: 648779 - RNA, 19 nt, Homo sapiens
cugcagcaauuauucauga

SEQ ID NO: 648780 - RNA, 19 nt, Homo sapiens
gauaaaguaagugcuguuu

SEQ ID NO: 648781 - RNA, 19 nt, Homo sapiens
gacugaagauaaaguaagu

SEQ ID NO: 648782 - RNA, 19 nt, Homo sapiens
cugcuuaccuggacuuguu

SEQ ID NO: 648783 - RNA, 19 nt, Homo sapiens
agaguguccuugguaauaa

SEQ ID NO: 648784 - RNA, 19 nt, Homo sapiens
uagaguguccuugguaaua

SEQ ID NO: 648785 - RNA, 19 nt, Homo sapiens
uaagugcuguuugggcuaa

SEQ ID NO: 648786 - RNA, 19 nt, Homo sapiens
gcuggaagauuagacacuu

SEQ ID NO: 648787 - RNA, 19 nt, Homo sapiens
caucuuggcaggacuuauu

SEQ ID NO: 648788 - RNA, 19 nt, Homo sapiens
acucaugcauuuacucuau

SEQ ID NO: 648789 - RNA, 19 nt, Homo sapiens
guaagaggcaacagauaga

SEQ ID NO: 648790 - RNA, 19 nt, Homo sapiens
aaaagggaaugacugcuua

SEQ ID NO: 648791 - RNA, 19 nt, Homo sapiens
cucaagauauuuacucaug

SEQ ID NO: 648792 - RNA, 19 nt, Homo sapiens
gaguaagaggcaacagaua

SEQ ID NO: 648793 - RNA, 19 nt, Homo sapiens
caacuuugcaauaacagaa

SEQ ID NO: 648794 - RNA, 19 nt, Homo sapiens
cagcaauuauucaugacuu

SEQ ID NO: 648795 - RNA, 19 nt, Homo sapiens
gguggagccugcauuuaca

SEQ ID NO: 648796 - RNA, 19 nt, Homo sapiens
aaccuuggcaucuuuauuu

SEQ ID NO: 648797 - RNA, 19 nt, Homo sapiens
agaccaagaucugucaaga

SEQ ID NO: 648798 - RNA, 19 nt, Homo sapiens
caacagauagaguguccuu

SEQ ID NO: 648799 - RNA, 19 nt, Homo sapiens
gaugacaacauugcaauca

SEQ ID NO: 648800 - RNA, 19 nt, Homo sapiens
aguguuagacugaagauaa

SEQ ID NO: 648801 - RNA, 19 nt, Homo sapiens
uaguaaccuuggcaucuuu

SEQ ID NO: 648802 - RNA, 19 nt, Homo sapiens
gccucaaacuuaugugguu

SEQ ID NO: 648803 - RNA, 19 nt, Homo sapiens
gcaauuauucaugacuuug

SEQ ID NO: 648804 - RNA, 19 nt, Homo sapiens
uagugacccugcagcaauu

SEQ ID NO: 648805 - RNA, 19 nt, Homo sapiens
gaccucggcuugcaguagu

SEQ ID NO: 648806 - RNA, 19 nt, Homo sapiens
accaagaucugucaagagu

SEQ ID NO: 648807 - RNA, 19 nt, Homo sapiens
uaccaacuuugcaauaaca

SEQ ID NO: 648808 - RNA, 19 nt, Homo sapiens
uuaguaaccuuggcaucuu

SEQ ID NO: 648809 - RNA, 19 nt, Homo sapiens
cugaggauccugcaaauuc

SEQ ID NO: 648810 - RNA, 19 nt, Homo sapiens
ucaugcauuuacucuauug

SEQ ID NO: 648811 - RNA, 19 nt, Homo sapiens
uaugggauacucaagauau

SEQ ID NO: 648812 - RNA, 19 nt, Homo sapiens
auugauaaaugcuggaaga

SEQ ID NO: 648813 - RNA, 19 nt, Homo sapiens
gaaaagggaaugacugcuu

SEQ ID NO: 648814 - RNA, 19 nt, Homo sapiens
ugaggaggcugacauucgu

SEQ ID NO: 648815 - RNA, 19 nt, Homo sapiens
ucucuuaggccuuucauuc

SEQ ID NO: 648816 - RNA, 19 nt, Homo sapiens
ugauaaaugcuggaagauu

SEQ ID NO: 648817 - RNA, 19 nt, Homo sapiens
aaacgugccauugauaaau

SEQ ID NO: 648818 - RNA, 19 nt, Homo sapiens
gaggaugacaacauugcaa

SEQ ID NO: 648819 - RNA, 19 nt, Homo sapiens
ucgugaggaugacaacauu

SEQ ID NO: 648820 - RNA, 19 nt, Homo sapiens
agauagaguguccuuggua

SEQ ID NO: 648821 - RNA, 19 nt, Homo sapiens
ccuaguugcuguggaggaa

SEQ ID NO: 648822 - RNA, 19 nt, Homo sapiens
gauagugacccugcagcaa

SEQ ID NO: 648823 - RNA, 19 nt, Homo sapiens
ggcaaggagcuccgaguug

SEQ ID NO: 648824 - RNA, 19 nt, Homo sapiens
cagauagaguguccuuggu

SEQ ID NO: 648825 - RNA, 19 nt, Homo sapiens
accuuggcaucuuuauuua

SEQ ID NO: 648826 - RNA, 19 nt, Homo sapiens
uaaccuuggcaucuuuauu

SEQ ID NO: 648827 - RNA, 19 nt, Homo sapiens
cauuuaccguggagagaug

SEQ ID NO: 648828 - RNA, 19 nt, Homo sapiens
gaaaaucgccuucaauacc

SEQ ID NO: 648829 - RNA, 19 nt, Homo sapiens
uggaggaaauucgugaugu

SEQ ID NO: 648830 - RNA, 19 nt, Homo sapiens
gaguguccuugguaauaag

SEQ ID NO: 648831 - RNA, 19 nt, Homo sapiens
cgaguugccacccaggaaa

SEQ ID NO: 648832 - RNA, 19 nt, Homo sapiens
ugcccaagagcaccauuua

SEQ ID NO: 648833 - RNA, 19 nt, Homo sapiens
gcauuuacaaguacuucau

SEQ ID NO: 648834 - RNA, 19 nt, Homo sapiens
guugguggagccugcauuu

SEQ ID NO: 648835 - RNA, 19 nt, Homo sapiens
gcagcccgaagauucacua

SEQ ID NO: 648836 - RNA, 19 nt, Homo sapiens
uuuaugggauacucaagau

SEQ ID NO: 648837 - RNA, 19 nt, Homo sapiens
gagaccucuugcuggguuu

SEQ ID NO: 648838 - RNA, 19 nt, Homo sapiens
cuuacucucuuaggccuuu

SEQ ID NO: 648839 - RNA, 19 nt, Homo sapiens
aguaagaggcaacagauag

SEQ ID NO: 648840 - RNA, 19 nt, Homo sapiens
uggcaucuuuauuuaccaa

SEQ ID NO: 648841 - RNA, 19 nt, Homo sapiens
ugcauuuacucuauugcuu

SEQ ID NO: 648842 - RNA, 19 nt, Homo sapiens
ccaagaucugucaagagua

SEQ ID NO: 648843 - RNA, 19 nt, Homo sapiens
gguucgagaagaccuaguu

SEQ ID NO: 648844 - RNA, 19 nt, Homo sapiens
cuauuguuaugccuccaaa

SEQ ID NO: 648845 - RNA, 19 nt, Homo sapiens
gaccaagaucugucaagag

SEQ ID NO: 648846 - RNA, 19 nt, Homo sapiens
gcaucuuuauuuaccaacu

SEQ ID NO: 648847 - RNA, 19 nt, Homo sapiens
ccuaacuuccugccuguga

SEQ ID NO: 648848 - RNA, 19 nt, Homo sapiens
guuuaugggauacucaaga

SEQ ID NO: 648849 - RNA, 19 nt, Homo sapiens
ucuuaggccuuucauucau

SEQ ID NO: 648850 - RNA, 19 nt, Homo sapiens
agaguaagaggcaacagau

SEQ ID NO: 648851 - RNA, 19 nt, Homo sapiens
uuaccaacuuugcaauaac

SEQ ID NO: 648852 - RNA, 19 nt, Homo sapiens
uaguugcuguggaggaaau

SEQ ID NO: 648853 - RNA, 19 nt, Homo sapiens
auaucugccucaaacuuau

SEQ ID NO: 648854 - RNA, 19 nt, Homo sapiens
uaucugaugccccucaaua

SEQ ID NO: 648855 - RNA, 19 nt, Homo sapiens
gacccugcagcaauuauuc

SEQ ID NO: 648856 - RNA, 19 nt, Homo sapiens
ggaugacaacauugcaauc

SEQ ID NO: 648857 - RNA, 19 nt, Homo sapiens
ugacugaggaggcugacau

SEQ ID NO: 648858 - RNA, 19 nt, Homo sapiens
ugacagaaauguugcauaa

SEQ ID NO: 648859 - RNA, 19 nt, Homo sapiens
gacaaggccuagauauuua

SEQ ID NO: 648860 - RNA, 19 nt, Homo sapiens
ggacaaggccuagauauuu

SEQ ID NO: 648861 - RNA, 19 nt, Homo sapiens
gauuggaccucauagcuua

SEQ ID NO: 648862 - RNA, 19 nt, Homo sapiens
ggagaagacucaagaaaca

SEQ ID NO: 648863 - RNA, 19 nt, Homo sapiens
gauauuuacuggagggaua

SEQ ID NO: 648864 - RNA, 19 nt, Homo sapiens
ucacaggcauuuaaucauu

SEQ ID NO: 648865 - RNA, 19 nt, Homo sapiens
gcuaaagccuauaaacaga

SEQ ID NO: 648866 - RNA, 19 nt, Homo sapiens
gacaagcuacagauuauua

SEQ ID NO: 648867 - RNA, 19 nt, Homo sapiens
gaggacaagcuacagauua

SEQ ID NO: 648868 - RNA, 19 nt, Homo sapiens
acagaaauguugcauaaug

SEQ ID NO: 648869 - RNA, 19 nt, Homo sapiens
gagccuaaguccacauuau

SEQ ID NO: 648870 - RNA, 19 nt, Homo sapiens
agaguucuguggugaaaua

SEQ ID NO: 648871 - RNA, 19 nt, Homo sapiens
guuaagccauucuugauug

SEQ ID NO: 648872 - RNA, 19 nt, Homo sapiens
gaaacaguccaaagaauuc

SEQ ID NO: 648873 - RNA, 19 nt, Homo sapiens
ggagaguucuguggugaaa

SEQ ID NO: 648874 - RNA, 19 nt, Homo sapiens
caagaaacaguccaaagaa

SEQ ID NO: 648875 - RNA, 19 nt, Homo sapiens
uaccaucaauguuguguuu

SEQ ID NO: 648876 - RNA, 19 nt, Homo sapiens
guaagauguucaaagaaga

SEQ ID NO: 648877 - RNA, 19 nt, Homo sapiens
ccacugaagaagaauauaa

SEQ ID NO: 648878 - RNA, 19 nt, Homo sapiens
ggagggauaauuacacuug

SEQ ID NO: 648879 - RNA, 19 nt, Homo sapiens
ugaccgggauggcgcauuu

SEQ ID NO: 648880 - RNA, 19 nt, Homo sapiens
ucaagaaacaguccaaaga

SEQ ID NO: 648881 - RNA, 19 nt, Homo sapiens
gaaauagugggaaggauuc

SEQ ID NO: 648882 - RNA, 19 nt, Homo sapiens
guaaacaagugagaaccaa

SEQ ID NO: 648883 - RNA, 19 nt, Homo sapiens
ccaucaauguuguguuuau

SEQ ID NO: 648884 - RNA, 19 nt, Homo sapiens
aaucuacacuccaaagaau

SEQ ID NO: 648885 - RNA, 19 nt, Homo sapiens
cagguggacuguuuggauu

SEQ ID NO: 648886 - RNA, 19 nt, Homo sapiens
ggauguagguucuuuugaa

SEQ ID NO: 648887 - RNA, 19 nt, Homo sapiens
gggacaaggccuagauauu

SEQ ID NO: 648888 - RNA, 19 nt, Homo sapiens
caguaggucucaugcaguu

SEQ ID NO: 648889 - RNA, 19 nt, Homo sapiens
agaaacaguccaaagaauu

SEQ ID NO: 648890 - RNA, 19 nt, Homo sapiens
ugaaauagugggaaggauu

SEQ ID NO: 648891 - RNA, 19 nt, Homo sapiens
ggaaucccaucugucauca

SEQ ID NO: 648892 - RNA, 19 nt, Homo sapiens
aagaaacaguccaaagaau

SEQ ID NO: 648893 - RNA, 19 nt, Homo sapiens
ugaagugacagaaauguug

SEQ ID NO: 648894 - RNA, 19 nt, Homo sapiens
ccucauagcuuauuuuagu

SEQ ID NO: 648895 - RNA, 19 nt, Homo sapiens
ucgaugauauugaagacaa

SEQ ID NO: 648896 - RNA, 19 nt, Homo sapiens
guugaacuauuagcuuuga

SEQ ID NO: 648897 - RNA, 19 nt, Homo sapiens
ugaaagucgugauaucauc

SEQ ID NO: 648898 - RNA, 19 nt, Homo sapiens
uaauacacuugggcucuuu

SEQ ID NO: 648899 - RNA, 19 nt, Homo sapiens
aggacaagcuacagauuau

SEQ ID NO: 648900 - RNA, 19 nt, Homo sapiens
gauaucaucguugaacuau

SEQ ID NO: 648901 - RNA, 19 nt, Homo sapiens
aguaagauguucaaagaag

SEQ ID NO: 648902 - RNA, 19 nt, Homo sapiens
ugggaacccugagcuagua

SEQ ID NO: 648903 - RNA, 19 nt, Homo sapiens
ccagagaacagaaaacaua

SEQ ID NO: 648904 - RNA, 19 nt, Homo sapiens
guucuguggugaaauagug

SEQ ID NO: 648905 - RNA, 19 nt, Homo sapiens
ucaugcaguuguucucuga

SEQ ID NO: 648906 - RNA, 19 nt, Homo sapiens
cauaaugccaguuuacuca

SEQ ID NO: 648907 - RNA, 19 nt, Homo sapiens
cuacuaccaucaauguugu

SEQ ID NO: 648908 - RNA, 19 nt, Homo sapiens
uuauguaggucugauuuga

SEQ ID NO: 648909 - RNA, 19 nt, Homo sapiens
guucucauuuccuacuauu

SEQ ID NO: 648910 - RNA, 19 nt, Homo sapiens
gcccacagcaucuauggaa

SEQ ID NO: 648911 - RNA, 19 nt, Homo sapiens
gccuaaguccacauuauaa

SEQ ID NO: 648912 - RNA, 19 nt, Homo sapiens
caauggagaagacucaaga

SEQ ID NO: 648913 - RNA, 19 nt, Homo sapiens
caaauuagggaugauuaug

SEQ ID NO: 648914 - RNA, 19 nt, Homo sapiens
uaaaaccgcuacuuaauac

SEQ ID NO: 648915 - RNA, 19 nt, Homo sapiens
cacaggcauuuaaucauug

SEQ ID NO: 648916 - RNA, 19 nt, Homo sapiens
ucguugaacuauuagcuuu

SEQ ID NO: 648917 - RNA, 19 nt, Homo sapiens
gaagcuaaagccuauaaac

SEQ ID NO: 648918 - RNA, 19 nt, Homo sapiens
ugcaguuguucucugauua

SEQ ID NO: 648919 - RNA, 19 nt, Homo sapiens
ccaauuacguguauuuccu

SEQ ID NO: 648920 - RNA, 19 nt, Homo sapiens
ggacaagcuacagauuauu

SEQ ID NO: 648921 - RNA, 19 nt, Homo sapiens
gaacuauuagcuuugaagu

SEQ ID NO: 648922 - RNA, 19 nt, Homo sapiens
ggaacuccaucagggacaa

SEQ ID NO: 648923 - RNA, 19 nt, Homo sapiens
ucccaucugucaucaauuc

SEQ ID NO: 648924 - RNA, 19 nt, Homo sapiens
ucuagaacccuauaaauac

SEQ ID NO: 648925 - RNA, 19 nt, Homo sapiens
gucgugauaucaucguuga

SEQ ID NO: 648926 - RNA, 19 nt, Homo sapiens
agagggaaaguucucauuu

SEQ ID NO: 648927 - RNA, 19 nt, Homo sapiens
gauuuaaaaccgcuacuua

SEQ ID NO: 648928 - RNA, 19 nt, Homo sapiens
gagggauaauuacacuugu

SEQ ID NO: 648929 - RNA, 19 nt, Homo sapiens
gcgugaaagucgugauauc

SEQ ID NO: 648930 - RNA, 19 nt, Homo sapiens
ggucugauuugaaugucau

SEQ ID NO: 648931 - RNA, 19 nt, Homo sapiens
uaaucuacacuccaaagaa

SEQ ID NO: 648932 - RNA, 19 nt, Homo sapiens
ccaaauuagggaugauuau

SEQ ID NO: 648933 - RNA, 19 nt, Homo sapiens
acacuugucccacugaaga

SEQ ID NO: 648934 - RNA, 19 nt, Homo sapiens
ccagaugcagugaagcuuu

SEQ ID NO: 648935 - RNA, 19 nt, Homo sapiens
aaucccaucugucaucaau

SEQ ID NO: 648936 - RNA, 19 nt, Homo sapiens
ccagaaacaguaaauaggu

SEQ ID NO: 648937 - RNA, 19 nt, Homo sapiens
ugucaucaauucugccaau

SEQ ID NO: 648938 - RNA, 19 nt, Homo sapiens
cuagaacccuauaaauacu

SEQ ID NO: 648939 - RNA, 19 nt, Homo sapiens
gaauaucuugcgccagaga

SEQ ID NO: 648940 - RNA, 19 nt, Homo sapiens
guaggucugauuugaaugu

SEQ ID NO: 648941 - RNA, 19 nt, Homo sapiens
ugaauacacucguaauacc

SEQ ID NO: 648942 - RNA, 19 nt, Homo sapiens
ccuaaguccacauuauaaa

SEQ ID NO: 648943 - RNA, 19 nt, Homo sapiens
gcuuugaaguuuaaaucca

SEQ ID NO: 648944 - RNA, 19 nt, Homo sapiens
ccuacuaccaucaauguug

SEQ ID NO: 648945 - RNA, 19 nt, Homo sapiens
aagcuaaagccuauaaaca

SEQ ID NO: 648946 - RNA, 19 nt, Homo sapiens
cuacuauucaugcuauuug

SEQ ID NO: 648947 - RNA, 19 nt, Homo sapiens
aagcuauggugcugcagaa

SEQ ID NO: 648948 - RNA, 19 nt, Homo sapiens
uuuacuggagggauaauua

SEQ ID NO: 648949 - RNA, 19 nt, Homo sapiens
ugauaucaucguugaacua

SEQ ID NO: 648950 - RNA, 19 nt, Homo sapiens
uggcuuggagaaagucuua

SEQ ID NO: 648951 - RNA, 19 nt, Homo sapiens
caaacuuucacaggcauuu

SEQ ID NO: 648952 - RNA, 19 nt, Homo sapiens
uaaacaagugagaaccaaa

SEQ ID NO: 648953 - RNA, 19 nt, Homo sapiens
aacaguaaauaggugagua

SEQ ID NO: 648954 - RNA, 19 nt, Homo sapiens
ccacagcaucuauggaauc

SEQ ID NO: 648955 - RNA, 19 nt, Homo sapiens
gauguagguucuuuugaau

SEQ ID NO: 648956 - RNA, 19 nt, Homo sapiens
agccuaaguccacauuaua

SEQ ID NO: 648957 - RNA, 19 nt, Homo sapiens
uaaugccaguuuacucauc

SEQ ID NO: 648958 - RNA, 19 nt, Homo sapiens
uaaagaagauguugucuga

SEQ ID NO: 648959 - RNA, 19 nt, Homo sapiens
caacaugaccuucaccaaa

SEQ ID NO: 648960 - RNA, 19 nt, Homo sapiens
gcgcacguguuccaaauug

SEQ ID NO: 648961 - RNA, 19 nt, Homo sapiens
ugacacaguuugccgagaa

SEQ ID NO: 648962 - RNA, 19 nt, Homo sapiens
gcuggaagcucuggugcaa

SEQ ID NO: 648963 - RNA, 19 nt, Homo sapiens
gaacagcaucugacacagu

SEQ ID NO: 648964 - RNA, 19 nt, Homo sapiens
gcgagcggcuaaagaagau

SEQ ID NO: 648965 - RNA, 19 nt, Homo sapiens
ccaaggaccaggagauuca

SEQ ID NO: 648966 - RNA, 19 nt, Homo sapiens
gggcgcacguguuccaaau

SEQ ID NO: 648967 - RNA, 19 nt, Homo sapiens
aacagcaucugacacaguu

SEQ ID NO: 648968 - RNA, 19 nt, Homo sapiens
cggcauaguugggcccauu

SEQ ID NO: 648969 - RNA, 19 nt, Homo sapiens
ccagggagcagccaaucuu

SEQ ID NO: 648970 - RNA, 19 nt, Homo sapiens
ccaaggccaucaucaacag

SEQ ID NO: 648971 - RNA, 19 nt, Homo sapiens
gcacucacugucuccuauu

SEQ ID NO: 648972 - RNA, 19 nt, Homo sapiens
gcaagcacgcacucacugu

SEQ ID NO: 648973 - RNA, 19 nt, Homo sapiens
caucccagccugaccaaug

SEQ ID NO: 648974 - RNA, 19 nt, Homo sapiens
uggaagcucuggugcaaac

SEQ ID NO: 648975 - RNA, 19 nt, Homo sapiens
gagcgcgagcggcuaaaga

SEQ ID NO: 648976 - RNA, 19 nt, Homo sapiens
gcgccaaggccaucaucaa

SEQ ID NO: 648977 - RNA, 19 nt, Homo sapiens
cacucacugucuccuauuu

SEQ ID NO: 648978 - RNA, 19 nt, Homo sapiens
gcuugggcuuugccucuga

SEQ ID NO: 648979 - RNA, 19 nt, Homo sapiens
gagcuucucauuguguaga

SEQ ID NO: 648980 - RNA, 19 nt, Homo sapiens
aacaugaccuucaccaaaa

SEQ ID NO: 648981 - RNA, 19 nt, Homo sapiens
gcugcaggcggcauaguug

SEQ ID NO: 648982 - RNA, 19 nt, Homo sapiens
ccaccaagcgaaacuggau

SEQ ID NO: 648983 - RNA, 19 nt, Homo sapiens
cagcaucugacacaguuug

SEQ ID NO: 648984 - RNA, 19 nt, Homo sapiens
cacugucacucccaacaug

SEQ ID NO: 648985 - RNA, 19 nt, Homo sapiens
gcacugucacucccaacau

SEQ ID NO: 648986 - RNA, 19 nt, Homo sapiens
gaugccacccgcaaugugu

SEQ ID NO: 648987 - RNA, 19 nt, Homo sapiens
acagagcgcgagcggcuaa

SEQ ID NO: 648988 - RNA, 19 nt, Homo sapiens
uuacauuucuaagcgugaa

SEQ ID NO: 648989 - RNA, 19 nt, Homo sapiens
acagugggaggccgaguuu

SEQ ID NO: 648990 - RNA, 19 nt, Homo sapiens
gcccauucguccuggaaag

SEQ ID NO: 648991 - RNA, 19 nt, Homo sapiens
gccaaggccaucaucaaca

SEQ ID NO: 648992 - RNA, 19 nt, Homo sapiens
cgcacucacugucuccuau

SEQ ID NO: 648993 - RNA, 19 nt, Homo sapiens
aaaccaaggaccaggagau

SEQ ID NO: 648994 - RNA, 19 nt, Homo sapiens
cgcaauguguaccgcauca

SEQ ID NO: 648995 - RNA, 19 nt, Homo sapiens
gcaggacagcaacaacaag

SEQ ID NO: 648996 - RNA, 19 nt, Homo sapiens
gcacugcaggacagcaaca

SEQ ID NO: 648997 - RNA, 19 nt, Homo sapiens
gagcggcuaaagaagaugu

SEQ ID NO: 648998 - RNA, 19 nt, Homo sapiens
caauguguaccgcaucauc

SEQ ID NO: 648999 - RNA, 19 nt, Homo sapiens
gaaagaagcugccaagaua

SEQ ID NO: 649000 - RNA, 19 nt, Homo sapiens
caaaguaggugcuuaauaa

SEQ ID NO: 649001 - RNA, 19 nt, Homo sapiens
gcagugagaucaacagaga

SEQ ID NO: 649002 - RNA, 19 nt, Homo sapiens
gaagaacaaugcagugaga

SEQ ID NO: 649003 - RNA, 19 nt, Homo sapiens
ucaaauagcauucagagua

SEQ ID NO: 649004 - RNA, 19 nt, Homo sapiens
gagccaaggugaucauaaa

SEQ ID NO: 649005 - RNA, 19 nt, Homo sapiens
gaacaacauuccucucugu

SEQ ID NO: 649006 - RNA, 19 nt, Homo sapiens
caaauagcauucagaguau

SEQ ID NO: 649007 - RNA, 19 nt, Homo sapiens
gcgcaugucuuccagauug

SEQ ID NO: 649008 - RNA, 19 nt, Homo sapiens
gcaaccauaugaacugaaa

SEQ ID NO: 649009 - RNA, 19 nt, Homo sapiens
ggucuaccuucaacauuua

SEQ ID NO: 649010 - RNA, 19 nt, Homo sapiens
agacagagcugaaagaucu

SEQ ID NO: 649011 - RNA, 19 nt, Homo sapiens
gcagggauguuuauaucuu

SEQ ID NO: 649012 - RNA, 19 nt, Homo sapiens
gcacagagagaacaacauu

SEQ ID NO: 649013 - RNA, 19 nt, Homo sapiens
gaauaugaccuucaccaaa

SEQ ID NO: 649014 - RNA, 19 nt, Homo sapiens
gugcauugcuucuguaaau

SEQ ID NO: 649015 - RNA, 19 nt, Homo sapiens
gaacagcuaucggaucauc

SEQ ID NO: 649016 - RNA, 19 nt, Homo sapiens
caaagugcguuccuuaaag

SEQ ID NO: 649017 - RNA, 19 nt, Homo sapiens
gcagagagagacaaucaaa

SEQ ID NO: 649018 - RNA, 19 nt, Homo sapiens
gggcagggauguuuauauc

SEQ ID NO: 649019 - RNA, 19 nt, Homo sapiens
caacauuccucucugucaa

SEQ ID NO: 649020 - RNA, 19 nt, Homo sapiens
caagauagccaaagacaag

SEQ ID NO: 649021 - RNA, 19 nt, Homo sapiens
aaagugcguuccuuaaaga

SEQ ID NO: 649022 - RNA, 19 nt, Homo sapiens
caaguaaucauucccaaga

SEQ ID NO: 649023 - RNA, 19 nt, Homo sapiens
agacaaagugcguuccuua

SEQ ID NO: 649024 - RNA, 19 nt, Homo sapiens
gaacaaugcagugagauca

SEQ ID NO: 649025 - RNA, 19 nt, Homo sapiens
ccaagaaucugggcgugaa

SEQ ID NO: 649026 - RNA, 19 nt, Homo sapiens
guggacaacuggaagauuc

SEQ ID NO: 649027 - RNA, 19 nt, Homo sapiens
gcugaaagaucuccgaaaa

SEQ ID NO: 649028 - RNA, 19 nt, Homo sapiens
aaucauaccucagcucaug

SEQ ID NO: 649029 - RNA, 19 nt, Homo sapiens
caagauugaugagcuggaa

SEQ ID NO: 649030 - RNA, 19 nt, Homo sapiens
gacaaagugcguuccuuaa

SEQ ID NO: 649031 - RNA, 19 nt, Homo sapiens
uaccucagcucaugucaga

SEQ ID NO: 649032 - RNA, 19 nt, Homo sapiens
gcacaaucacaccgaauau

SEQ ID NO: 649033 - RNA, 19 nt, Homo sapiens
gaaaucuccucucgcuucu

SEQ ID NO: 649034 - RNA, 19 nt, Homo sapiens
gaucauaaacagcacaauc

SEQ ID NO: 649035 - RNA, 19 nt, Homo sapiens
gcuaucggaucaucagugu

SEQ ID NO: 649036 - RNA, 19 nt, Homo sapiens
gagcgcaugucuuccagau

SEQ ID NO: 649037 - RNA, 19 nt, Homo sapiens
cagggauguuuauaucuuu

SEQ ID NO: 649038 - RNA, 19 nt, Homo sapiens
ggucaccguuuccuacuuc

SEQ ID NO: 649039 - RNA, 19 nt, Homo sapiens
gaaauuccaggaggugaaa

SEQ ID NO: 649040 - RNA, 19 nt, Homo sapiens
ucuaugaugucacaaggaa

SEQ ID NO: 649041 - RNA, 19 nt, Homo sapiens
ugaaagaagcugccaagau

SEQ ID NO: 649042 - RNA, 19 nt, Homo sapiens
caacaucgagaggcuuuaa

SEQ ID NO: 649043 - RNA, 19 nt, Homo sapiens
acucaggaauccagaacua

SEQ ID NO: 649044 - RNA, 19 nt, Homo sapiens
gagaaugacaagcugaaga

SEQ ID NO: 649045 - RNA, 19 nt, Homo sapiens
cacaaugucuggcacaaag

SEQ ID NO: 649046 - RNA, 19 nt, Homo sapiens
uugaugagcuggaagaaca

SEQ ID NO: 649047 - RNA, 19 nt, Homo sapiens
acaaaguaggugcuuaaua

SEQ ID NO: 649048 - RNA, 19 nt, Homo sapiens
acaaagugcguuccuuaaa

SEQ ID NO: 649049 - RNA, 19 nt, Homo sapiens
acagagagaaggagaagaa

SEQ ID NO: 649050 - RNA, 19 nt, Homo sapiens
acaaucacaccgaauauga

SEQ ID NO: 649051 - RNA, 19 nt, Homo sapiens
cuacuucuaugaugucaca

SEQ ID NO: 649052 - RNA, 19 nt, Homo sapiens
ggaagaggcaguucuccau

SEQ ID NO: 649053 - RNA, 19 nt, Homo sapiens
cagccaacgugaagaagug

SEQ ID NO: 649054 - RNA, 19 nt, Homo sapiens
aaaucgagaccucaaguaa

SEQ ID NO: 649055 - RNA, 19 nt, Homo sapiens
aggaacagcuaucggauca

SEQ ID NO: 649056 - RNA, 19 nt, Homo sapiens
ggacggagccaaggugauc

SEQ ID NO: 649057 - RNA, 19 nt, Homo sapiens
gcacaaugucuggcacaaa

SEQ ID NO: 649058 - RNA, 19 nt, Homo sapiens
guaaaugcaggcgcaguuu

SEQ ID NO: 649059 - RNA, 19 nt, Homo sapiens
gaagauugacgaccugcau

SEQ ID NO: 649060 - RNA, 19 nt, Homo sapiens
aauaugaccuucaccaaaa

SEQ ID NO: 649061 - RNA, 19 nt, Homo sapiens
ggagccaaggugaucauaa

SEQ ID NO: 649062 - RNA, 19 nt, Homo sapiens
caaugucuggcacaaagua

SEQ ID NO: 649063 - RNA, 19 nt, Homo sapiens
ucucuggccuugugagguu

SEQ ID NO: 649064 - RNA, 19 nt, Homo sapiens
ccaaggugaucauaaacag

SEQ ID NO: 649065 - RNA, 19 nt, Homo sapiens
acuggaagauucugacuca

SEQ ID NO: 649066 - RNA, 19 nt, Homo sapiens
gcuagaggcggcagagaga

SEQ ID NO: 649067 - RNA, 19 nt, Homo sapiens
ugaaagaucuccgaaaaca

SEQ ID NO: 649068 - RNA, 19 nt, Homo sapiens
gccguccacucacuccuuu

SEQ ID NO: 649069 - RNA, 19 nt, Homo sapiens
gaagaacacgcagcugaag

SEQ ID NO: 649070 - RNA, 19 nt, Homo sapiens
ggagacagagcugaaagau

SEQ ID NO: 649071 - RNA, 19 nt, Homo sapiens
gaccggcuccgcaacaaga

SEQ ID NO: 649072 - RNA, 19 nt, Homo sapiens
cuaggacguucuucugugu

SEQ ID NO: 649073 - RNA, 19 nt, Homo sapiens
gcgcagccaacgugaagaa

SEQ ID NO: 649074 - RNA, 19 nt, Homo sapiens
gagcgcagccaacgugaag

SEQ ID NO: 649075 - RNA, 19 nt, Homo sapiens
cugccaagauagccaaaga

SEQ ID NO: 649076 - RNA, 19 nt, Homo sapiens
uaagggcuguugcaaccau

SEQ ID NO: 649077 - RNA, 19 nt, Homo sapiens
gaauccagaacuaggucua

SEQ ID NO: 649078 - RNA, 19 nt, Homo sapiens
caugucagagugcgaauau

SEQ ID NO: 649079 - RNA, 19 nt, Homo sapiens
gaaugacaagcugaagauu

SEQ ID NO: 649080 - RNA, 19 nt, Homo sapiens
acauugaggagagcaaaua

SEQ ID NO: 649081 - RNA, 19 nt, Homo sapiens
cgaauaugaccuucaccaa

SEQ ID NO: 649082 - RNA, 19 nt, Homo sapiens
ccuuaaagacagacauuga

SEQ ID NO: 649083 - RNA, 19 nt, Homo sapiens
uaaaugcaggcgcaguuug

SEQ ID NO: 649084 - RNA, 19 nt, Homo sapiens
cggcagagagagacaauca

SEQ ID NO: 649085 - RNA, 19 nt, Homo sapiens
caacagagagaaggagaag

SEQ ID NO: 649086 - RNA, 19 nt, Homo sapiens
ucgcuucucuggccuugug

SEQ ID NO: 649087 - RNA, 19 nt, Homo sapiens
aaagaucuccgaaaacaaa

SEQ ID NO: 649088 - RNA, 19 nt, Homo sapiens
acucaggcauccaguguca

SEQ ID NO: 649089 - RNA, 19 nt, Homo sapiens
gcugggcaccgauaacuag

SEQ ID NO: 649090 - RNA, 19 nt, Homo sapiens
ugucagagugcgaauaugu

SEQ ID NO: 649091 - RNA, 19 nt, Homo sapiens
agaagaacacgcagcugaa

SEQ ID NO: 649092 - RNA, 19 nt, Homo sapiens
gagagaaggagaagaacac

SEQ ID NO: 649093 - RNA, 19 nt, Homo sapiens
agacaagacgcaggagaaa

SEQ ID NO: 649094 - RNA, 19 nt, Homo sapiens
ucgagaggcuuuaaaacaa

SEQ ID NO: 649095 - RNA, 19 nt, Homo sapiens
aaacacgcauuuuguaauc

SEQ ID NO: 649096 - RNA, 19 nt, Homo sapiens
gugcuggacgggaagauug

SEQ ID NO: 649097 - RNA, 19 nt, Homo sapiens
aaugacaagcugaagauug

SEQ ID NO: 649098 - RNA, 19 nt, Homo sapiens
agaaugacaagcugaagau

SEQ ID NO: 649099 - RNA, 19 nt, Homo sapiens
uaaagaagcugcucgacua

SEQ ID NO: 649100 - RNA, 19 nt, Homo sapiens
gaacuugaauguguuagua

SEQ ID NO: 649101 - RNA, 19 nt, Homo sapiens
gcucaugucuuccaaauug

SEQ ID NO: 649102 - RNA, 19 nt, Homo sapiens
gaagagacacugaaacuga

SEQ ID NO: 649103 - RNA, 19 nt, Homo sapiens
gaucuucagucuccuuuaa

SEQ ID NO: 649104 - RNA, 19 nt, Homo sapiens
gaacagagggauucuuuga

SEQ ID NO: 649105 - RNA, 19 nt, Homo sapiens
gcaauaaccugaagacacu

SEQ ID NO: 649106 - RNA, 19 nt, Homo sapiens
gaaggaagaggaaauagaa

SEQ ID NO: 649107 - RNA, 19 nt, Homo sapiens
caaaggaaauaaugccaaa

SEQ ID NO: 649108 - RNA, 19 nt, Homo sapiens
ugacugaacuugaaugugu

SEQ ID NO: 649109 - RNA, 19 nt, Homo sapiens
caagaaauguguauaggau

SEQ ID NO: 649110 - RNA, 19 nt, Homo sapiens
gcaaaugccgccucuguuu

SEQ ID NO: 649111 - RNA, 19 nt, Homo sapiens
gaaguuauuccguagcaua

SEQ ID NO: 649112 - RNA, 19 nt, Homo sapiens
gaacuuaccaguacaccuu

SEQ ID NO: 649113 - RNA, 19 nt, Homo sapiens
gaaagaacaccugauguga

SEQ ID NO: 649114 - RNA, 19 nt, Homo sapiens
cgaaauagcagacggagaa

SEQ ID NO: 649115 - RNA, 19 nt, Homo sapiens
gaaaagcaacugcgaaaua

SEQ ID NO: 649116 - RNA, 19 nt, Homo sapiens
gcucaaaggcaauaauaaa

SEQ ID NO: 649117 - RNA, 19 nt, Homo sapiens
ucacauaguucagcaauca

SEQ ID NO: 649118 - RNA, 19 nt, Homo sapiens
ccagagaacuacaagaaca

SEQ ID NO: 649119 - RNA, 19 nt, Homo sapiens
caagagaagauggaacuua

SEQ ID NO: 649120 - RNA, 19 nt, Homo sapiens
cuaacagaauuacgagaua

SEQ ID NO: 649121 - RNA, 19 nt, Homo sapiens
caucaucuuucgaaauuug

SEQ ID NO: 649122 - RNA, 19 nt, Homo sapiens
gagcucaugucuuccaaau

SEQ ID NO: 649123 - RNA, 19 nt, Homo sapiens
ggaaauaaugccaaacuca

SEQ ID NO: 649124 - RNA, 19 nt, Homo sapiens
gaaugcagcuaaggaaagu

SEQ ID NO: 649125 - RNA, 19 nt, Homo sapiens
ugaacuggcuacccucaaa

SEQ ID NO: 649126 - RNA, 19 nt, Homo sapiens
caaauugacccaaacacaa

SEQ ID NO: 649127 - RNA, 19 nt, Homo sapiens
gaugaaagaacaccugaug

SEQ ID NO: 649128 - RNA, 19 nt, Homo sapiens
ccaaacaugacauuuacua

SEQ ID NO: 649129 - RNA, 19 nt, Homo sapiens
cgggacagaugaugaaaga

SEQ ID NO: 649130 - RNA, 19 nt, Homo sapiens
ugaaauaccuccggacaag

SEQ ID NO: 649131 - RNA, 19 nt, Homo sapiens
uacacugucucucuucaua

SEQ ID NO: 649132 - RNA, 19 nt, Homo sapiens
gcgggugacugaacuugaa

SEQ ID NO: 649133 - RNA, 19 nt, Homo sapiens
ggaguccacugccaaugug

SEQ ID NO: 649134 - RNA, 19 nt, Homo sapiens
gaggaaauagaaagguuaa

SEQ ID NO: 649135 - RNA, 19 nt, Homo sapiens
gaacuggaagagacacuga

SEQ ID NO: 649136 - RNA, 19 nt, Homo sapiens
caagaagcuuuucgcaaua

SEQ ID NO: 649137 - RNA, 19 nt, Homo sapiens
gacaauacaagaacuggaa

SEQ ID NO: 649138 - RNA, 19 nt, Homo sapiens
ccaagcaaaugcaguacau

SEQ ID NO: 649139 - RNA, 19 nt, Homo sapiens
caguacaccuucacaggaa

SEQ ID NO: 649140 - RNA, 19 nt, Homo sapiens
gcuaaggaaagugaaauuu

SEQ ID NO: 649141 - RNA, 19 nt, Homo sapiens
aagaacaccugaugugaca

SEQ ID NO: 649142 - RNA, 19 nt, Homo sapiens
ggacagaugaugaaagaac

SEQ ID NO: 649143 - RNA, 19 nt, Homo sapiens
caacgggacagaugaugaa

SEQ ID NO: 649144 - RNA, 19 nt, Homo sapiens
agcaucaucuuucgaaauu

SEQ ID NO: 649145 - RNA, 19 nt, Homo sapiens
gauacacugucucucuuca

SEQ ID NO: 649146 - RNA, 19 nt, Homo sapiens
gaaacugaaggaagaggaa

SEQ ID NO: 649147 - RNA, 19 nt, Homo sapiens
gcauugccauuuucacaua

SEQ ID NO: 649148 - RNA, 19 nt, Homo sapiens
gccaagggcugaaccaacu

SEQ ID NO: 649149 - RNA, 19 nt, Homo sapiens
ccuaagagaacuaauugaa

SEQ ID NO: 649150 - RNA, 19 nt, Homo sapiens
ugaaagaacaccugaugug

SEQ ID NO: 649151 - RNA, 19 nt, Homo sapiens
gacagaugaugaaagaaca

SEQ ID NO: 649152 - RNA, 19 nt, Homo sapiens
gcaucaagauugcacaaaa

SEQ ID NO: 649153 - RNA, 19 nt, Homo sapiens
gcuacuagaaugcagcuaa

SEQ ID NO: 649154 - RNA, 19 nt, Homo sapiens
gcauaagagcugaaacuuc

SEQ ID NO: 649155 - RNA, 19 nt, Homo sapiens
aagagacacugaaacugaa

SEQ ID NO: 649156 - RNA, 19 nt, Homo sapiens
ggagaaaagucagaaugaa

SEQ ID NO: 649157 - RNA, 19 nt, Homo sapiens
cacugaaacugaaggaaga

SEQ ID NO: 649158 - RNA, 19 nt, Homo sapiens
uggcuacccucaaaggaaa

SEQ ID NO: 649159 - RNA, 19 nt, Homo sapiens
gagcaucaucuuucgaaau

SEQ ID NO: 649160 - RNA, 19 nt, Homo sapiens
uaugacagcacaagaaaug

SEQ ID NO: 649161 - RNA, 19 nt, Homo sapiens
agaaugaacaagaagcuuu

SEQ ID NO: 649162 - RNA, 19 nt, Homo sapiens
aagaggaaauagaaagguu

SEQ ID NO: 649163 - RNA, 19 nt, Homo sapiens
gaaacaauggaaacagcaa

SEQ ID NO: 649164 - RNA, 19 nt, Homo sapiens
gauugggauucuccucuga

SEQ ID NO: 649165 - RNA, 19 nt, Homo sapiens
uggccaagcuacuagaaug

SEQ ID NO: 649166 - RNA, 19 nt, Homo sapiens
agaauuacgagauaacuug

SEQ ID NO: 649167 - RNA, 19 nt, Homo sapiens
gaaauucuggauggaaaga

SEQ ID NO: 649168 - RNA, 19 nt, Homo sapiens
gaaguagaaauucggaaca

SEQ ID NO: 649169 - RNA, 19 nt, Homo sapiens
aagagaagauggaacuuac

SEQ ID NO: 649170 - RNA, 19 nt, Homo sapiens
aaauugacccaaacacaaa

SEQ ID NO: 649171 - RNA, 19 nt, Homo sapiens
aauagcagacggagaaauu

SEQ ID NO: 649172 - RNA, 19 nt, Homo sapiens
aauucuggauggaaagaua

SEQ ID NO: 649173 - RNA, 19 nt, Homo sapiens
caguuuagauggcucaaag

SEQ ID NO: 649174 - RNA, 19 nt, Homo sapiens
acaagaagcuuuucgcaau

SEQ ID NO: 649175 - RNA, 19 nt, Homo sapiens
agauggaacuuaccaguac

SEQ ID NO: 649176 - RNA, 19 nt, Homo sapiens
gaaauagcagacggagaaa

SEQ ID NO: 649177 - RNA, 19 nt, Homo sapiens
guagaaauucggaacaaag

SEQ ID NO: 649178 - RNA, 19 nt, Homo sapiens
uaacucgaauaagcaaaug

SEQ ID NO: 649179 - RNA, 19 nt, Homo sapiens
guuaguagccaagcaaaug

SEQ ID NO: 649180 - RNA, 19 nt, Homo sapiens
gacccaaacacaaagaaga

SEQ ID NO: 649181 - RNA, 19 nt, Homo sapiens
acaacugucugacuuagag

SEQ ID NO: 649182 - RNA, 19 nt, Homo sapiens
ugaaggaagaggaaauaga

SEQ ID NO: 649183 - RNA, 19 nt, Homo sapiens
uggcagcauccuugaaaua

SEQ ID NO: 649184 - RNA, 19 nt, Homo sapiens
caauggaaacagcaacuug

SEQ ID NO: 649185 - RNA, 19 nt, Homo sapiens
guucagcaaucagcaaaca

SEQ ID NO: 649186 - RNA, 19 nt, Homo sapiens
ccaaauugacccaaacaca

SEQ ID NO: 649187 - RNA, 19 nt, Homo sapiens
aaagauacacugucucucu

SEQ ID NO: 649188 - RNA, 19 nt, Homo sapiens
gcagcuaaggaaagugaaa

SEQ ID NO: 649189 - RNA, 19 nt, Homo sapiens
acagagggauucuuugacu

SEQ ID NO: 649190 - RNA, 19 nt, Homo sapiens
ucagcaaucagcaaacauu

SEQ ID NO: 649191 - RNA, 19 nt, Homo sapiens
gcaucaucuuucgaaauuu

SEQ ID NO: 649192 - RNA, 19 nt, Homo sapiens
uuuaggcucugcaucaaga

SEQ ID NO: 649193 - RNA, 19 nt, Homo sapiens
ugaacuaacagaauuacga

SEQ ID NO: 649194 - RNA, 19 nt, Homo sapiens
ggauggaaagauauuugaa

SEQ ID NO: 649195 - RNA, 19 nt, Homo sapiens
caaagcauuuuaacucgaa

SEQ ID NO: 649196 - RNA, 19 nt, Homo sapiens
uagaaauucggaacaaaga

SEQ ID NO: 649197 - RNA, 19 nt, Homo sapiens
agaggaaauagaaagguua

SEQ ID NO: 649198 - RNA, 19 nt, Homo sapiens
ggaagaggaaauagaaagg

SEQ ID NO: 649199 - RNA, 19 nt, Homo sapiens
ggaacuaccuugaguauuc

SEQ ID NO: 649200 - RNA, 19 nt, Homo sapiens
ggaaagaucucugugaaga

SEQ ID NO: 649201 - RNA, 19 nt, Homo sapiens
cauacugacuguagaauua

SEQ ID NO: 649202 - RNA, 19 nt, Homo sapiens
caacauauauucuccuuuc

SEQ ID NO: 649203 - RNA, 19 nt, Homo sapiens
agacaaagaucaaaccaaa

SEQ ID NO: 649204 - RNA, 19 nt, Homo sapiens
ggaaacuacuggcaugaaa

SEQ ID NO: 649205 - RNA, 19 nt, Homo sapiens
ccaaagagaguggcaauua

SEQ ID NO: 649206 - RNA, 19 nt, Homo sapiens
gaacaaaacugaucagagu

SEQ ID NO: 649207 - RNA, 19 nt, Homo sapiens
caaagagaguggcaauuau

SEQ ID NO: 649208 - RNA, 19 nt, Homo sapiens
gggaagaaauauguacuaa

SEQ ID NO: 649209 - RNA, 19 nt, Homo sapiens
cauacuguguuacauguua

SEQ ID NO: 649210 - RNA, 19 nt, Homo sapiens
agacaacucuccuugcaaa

SEQ ID NO: 649211 - RNA, 19 nt, Homo sapiens
gcuuacagauuccaugaaa

SEQ ID NO: 649212 - RNA, 19 nt, Homo sapiens
ucuaaacgcuuacagauuc

SEQ ID NO: 649213 - RNA, 19 nt, Homo sapiens
uaaagaggaucauuucuac

SEQ ID NO: 649214 - RNA, 19 nt, Homo sapiens
cauauauucuccuuucgua

SEQ ID NO: 649215 - RNA, 19 nt, Homo sapiens
gcuacaauuugcccucaua

SEQ ID NO: 649216 - RNA, 19 nt, Homo sapiens
aaugacaacugcucacuuu

SEQ ID NO: 649217 - RNA, 19 nt, Homo sapiens
gagaauugccgacaaccua

SEQ ID NO: 649218 - RNA, 19 nt, Homo sapiens
gcagggaacuaccuugagu

SEQ ID NO: 649219 - RNA, 19 nt, Homo sapiens
ccuaggagcuguggaugua

SEQ ID NO: 649220 - RNA, 19 nt, Homo sapiens
aaggaaaucuucugccaaa

SEQ ID NO: 649221 - RNA, 19 nt, Homo sapiens
ucucacaggugccaaguuu

SEQ ID NO: 649222 - RNA, 19 nt, Homo sapiens
ggauguaauuacugaagaa

SEQ ID NO: 649223 - RNA, 19 nt, Homo sapiens
agaaggaguuugcucacua

SEQ ID NO: 649224 - RNA, 19 nt, Homo sapiens
uaugagaacugaggacauu

SEQ ID NO: 649225 - RNA, 19 nt, Homo sapiens
gaauggacacugacaucua

SEQ ID NO: 649226 - RNA, 19 nt, Homo sapiens
uaggaaagaucucugugaa

SEQ ID NO: 649227 - RNA, 19 nt, Homo sapiens
gguauaaagaggaucauuu

SEQ ID NO: 649228 - RNA, 19 nt, Homo sapiens
cagaguaaauucauuagca

SEQ ID NO: 649229 - RNA, 19 nt, Homo sapiens
gagaucaaacugagaggua

SEQ ID NO: 649230 - RNA, 19 nt, Homo sapiens
auacugcacucugcuguua

SEQ ID NO: 649231 - RNA, 19 nt, Homo sapiens
cucauaaucugcauaggua

SEQ ID NO: 649232 - RNA, 19 nt, Homo sapiens
ccaaaugcaaucacucuuu

SEQ ID NO: 649233 - RNA, 19 nt, Homo sapiens
guauaagacuuggaggaaa

SEQ ID NO: 649234 - RNA, 19 nt, Homo sapiens
uauaagacuuggaggaaau

SEQ ID NO: 649235 - RNA, 19 nt, Homo sapiens
caacucuccuugcaaaaua

SEQ ID NO: 649236 - RNA, 19 nt, Homo sapiens
gaaagaucucugugaagaa

SEQ ID NO: 649237 - RNA, 19 nt, Homo sapiens
gaaggaguuugcucacuac

SEQ ID NO: 649238 - RNA, 19 nt, Homo sapiens
uaaccaggauaaucuuugu

SEQ ID NO: 649239 - RNA, 19 nt, Homo sapiens
gagcuaaccaggauaaucu

SEQ ID NO: 649240 - RNA, 19 nt, Homo sapiens
guauaaagaggaucauuuc

SEQ ID NO: 649241 - RNA, 19 nt, Homo sapiens
aaagacaacucuccuugca

SEQ ID NO: 649242 - RNA, 19 nt, Homo sapiens
ggagucauguacacgguau

SEQ ID NO: 649243 - RNA, 19 nt, Homo sapiens
aaacugagagguauacaug

SEQ ID NO: 649244 - RNA, 19 nt, Homo sapiens
gaucaaacugagagguaua

SEQ ID NO: 649245 - RNA, 19 nt, Homo sapiens
gaacuaccuugaguauucu

SEQ ID NO: 649246 - RNA, 19 nt, Homo sapiens
gcauguggauuggaggaaa

SEQ ID NO: 649247 - RNA, 19 nt, Homo sapiens
aaagagaguggcaauuauu

SEQ ID NO: 649248 - RNA, 19 nt, Homo sapiens
gagcagggaacuaccuuga

SEQ ID NO: 649249 - RNA, 19 nt, Homo sapiens
gcauagguauaaagaggau

SEQ ID NO: 649250 - RNA, 19 nt, Homo sapiens
cugguuauauguaauguga

SEQ ID NO: 649251 - RNA, 19 nt, Homo sapiens
gaauugccgacaaccuaua

SEQ ID NO: 649252 - RNA, 19 nt, Homo sapiens
agauggugcuggugacuuu

SEQ ID NO: 649253 - RNA, 19 nt, Homo sapiens
guguuugcauuccugguua

SEQ ID NO: 649254 - RNA, 19 nt, Homo sapiens
gcuccggaauggacacuga

SEQ ID NO: 649255 - RNA, 19 nt, Homo sapiens
guaggaaagaucucuguga

SEQ ID NO: 649256 - RNA, 19 nt, Homo sapiens
gcauggguuucaacacguu

SEQ ID NO: 649257 - RNA, 19 nt, Homo sapiens
cauaaucugcauagguaua

SEQ ID NO: 649258 - RNA, 19 nt, Homo sapiens
ggaaaugcucugucuccuu

SEQ ID NO: 649259 - RNA, 19 nt, Homo sapiens
gauaacuucaggugggaua

SEQ ID NO: 649260 - RNA, 19 nt, Homo sapiens
ucacaggugccaaguuuau

SEQ ID NO: 649261 - RNA, 19 nt, Homo sapiens
gaccggcacuggcaugaag

SEQ ID NO: 649262 - RNA, 19 nt, Homo sapiens
ucucuuaagguaccaauaa

SEQ ID NO: 649263 - RNA, 19 nt, Homo sapiens
gguauaagacuuggaggaa

SEQ ID NO: 649264 - RNA, 19 nt, Homo sapiens
cuaguucuguguuuacuca

SEQ ID NO: 649265 - RNA, 19 nt, Homo sapiens
uaaaggaugacaguccaua

SEQ ID NO: 649266 - RNA, 19 nt, Homo sapiens
ucucagaguuccccaauuu

SEQ ID NO: 649267 - RNA, 19 nt, Homo sapiens
uguaguggcuguaggaaag

SEQ ID NO: 649268 - RNA, 19 nt, Homo sapiens
gacaguccuugcccaccua

SEQ ID NO: 649269 - RNA, 19 nt, Homo sapiens
guacacgguauaagacuug

SEQ ID NO: 649270 - RNA, 19 nt, Homo sapiens
gguaaaagaacaaaacuga

SEQ ID NO: 649271 - RNA, 19 nt, Homo sapiens
aauggaauaugagaacuga

SEQ ID NO: 649272 - RNA, 19 nt, Homo sapiens
ccaagaagggagagauaga

SEQ ID NO: 649273 - RNA, 19 nt, Homo sapiens
uuccacagcuugcuaguuc

SEQ ID NO: 649274 - RNA, 19 nt, Homo sapiens
ucacacauacugacuguag

SEQ ID NO: 649275 - RNA, 19 nt, Homo sapiens
gcacaguagaacagaaaug

SEQ ID NO: 649276 - RNA, 19 nt, Homo sapiens
gugccaaguuuaucugcuu

SEQ ID NO: 649277 - RNA, 19 nt, Homo sapiens
ccagagacgacuauccauu

SEQ ID NO: 649278 - RNA, 19 nt, Homo sapiens
gcuguuagaagcagaggaa

SEQ ID NO: 649279 - RNA, 19 nt, Homo sapiens
aaagaucucugugaagaac

SEQ ID NO: 649280 - RNA, 19 nt, Homo sapiens
caaucacucuuugguggaa

SEQ ID NO: 649281 - RNA, 19 nt, Homo sapiens
ugacaacugcucacuuuua

SEQ ID NO: 649282 - RNA, 19 nt, Homo sapiens
guucuguguuuacucaaug

SEQ ID NO: 649283 - RNA, 19 nt, Homo sapiens
aauggacacugacaucuag

SEQ ID NO: 649284 - RNA, 19 nt, Homo sapiens
guguguagccuguuccaaa

SEQ ID NO: 649285 - RNA, 19 nt, Homo sapiens
cagagacgacuauccauuc

SEQ ID NO: 649286 - RNA, 19 nt, Homo sapiens
gagaaggaguuugcucacu

SEQ ID NO: 649287 - RNA, 19 nt, Homo sapiens
auuauugugugccauguuu

SEQ ID NO: 649288 - RNA, 19 nt, Homo sapiens
ucauguacacgguauaaga

SEQ ID NO: 649289 - RNA, 19 nt, Homo sapiens
aaacuaagagaucaaacug

SEQ ID NO: 649290 - RNA, 19 nt, Homo sapiens
ggagcuguggauguaauua

SEQ ID NO: 649291 - RNA, 19 nt, Homo sapiens
aaguuuaucugcuuucaag

SEQ ID NO: 649292 - RNA, 19 nt, Homo sapiens
gacaaccuauagggacaaa

SEQ ID NO: 649293 - RNA, 19 nt, Homo sapiens
uguguuacauguuaugauc

SEQ ID NO: 649294 - RNA, 19 nt, Homo sapiens
caguagaacagaaaugaau

SEQ ID NO: 649295 - RNA, 19 nt, Homo sapiens
ccaaguuuaucugcuuuca

SEQ ID NO: 649296 - RNA, 19 nt, Homo sapiens
ggacugcuacaaccaucuu

SEQ ID NO: 649297 - RNA, 19 nt, Homo sapiens
gcuaaccaggauaaucuuu

SEQ ID NO: 649298 - RNA, 19 nt, Homo sapiens
ucaaaguccacagugauuu

SEQ ID NO: 649299 - RNA, 19 nt, Homo sapiens
gaggaugucuuauaucuua

SEQ ID NO: 649300 - RNA, 19 nt, Homo sapiens
ggaagaauguucaaaguuu

SEQ ID NO: 649301 - RNA, 19 nt, Homo sapiens
gcacagccauuuagauaua

SEQ ID NO: 649302 - RNA, 19 nt, Homo sapiens
gaaauuaaauccagugaga

SEQ ID NO: 649303 - RNA, 19 nt, Homo sapiens
ugacauggcuuauaucuuu

SEQ ID NO: 649304 - RNA, 19 nt, Homo sapiens
gaucagaauugccuuuaua

SEQ ID NO: 649305 - RNA, 19 nt, Homo sapiens
ggacguuccucuucucuua

SEQ ID NO: 649306 - RNA, 19 nt, Homo sapiens
gaaggucacuggaaauuga

SEQ ID NO: 649307 - RNA, 19 nt, Homo sapiens
gaacuucagucucuucuug

SEQ ID NO: 649308 - RNA, 19 nt, Homo sapiens
aaacacaucugcccaauga

SEQ ID NO: 649309 - RNA, 19 nt, Homo sapiens
gcaagccucuuaguacuua

SEQ ID NO: 649310 - RNA, 19 nt, Homo sapiens
gaagagaaacucaucauug

SEQ ID NO: 649311 - RNA, 19 nt, Homo sapiens
gaacgguggugacuagauu

SEQ ID NO: 649312 - RNA, 19 nt, Homo sapiens
ccaaagggcugaucagaau

SEQ ID NO: 649313 - RNA, 19 nt, Homo sapiens
ggccaaggcuuauuaaaug

SEQ ID NO: 649314 - RNA, 19 nt, Homo sapiens
gcaaacagaugaguguauu

SEQ ID NO: 649315 - RNA, 19 nt, Homo sapiens
ggaagaggaugcucaaauc

SEQ ID NO: 649316 - RNA, 19 nt, Homo sapiens
gaauugugguccauuguaa

SEQ ID NO: 649317 - RNA, 19 nt, Homo sapiens
caacacagaucuucacauc

SEQ ID NO: 649318 - RNA, 19 nt, Homo sapiens
gaaaagagccuuguugaua

SEQ ID NO: 649319 - RNA, 19 nt, Homo sapiens
gcucaaauccuuaaaguga

SEQ ID NO: 649320 - RNA, 19 nt, Homo sapiens
ggaaggagaagauauuaaa

SEQ ID NO: 649321 - RNA, 19 nt, Homo sapiens
guaguacccuuauuccuuu

SEQ ID NO: 649322 - RNA, 19 nt, Homo sapiens
gaaaugaagccauguuaau

SEQ ID NO: 649323 - RNA, 19 nt, Homo sapiens
gauauaacauccuucacuu

SEQ ID NO: 649324 - RNA, 19 nt, Homo sapiens
gaaaugucccgcugaauga

SEQ ID NO: 649325 - RNA, 19 nt, Homo sapiens
gaaauauguuacucucuug

SEQ ID NO: 649326 - RNA, 19 nt, Homo sapiens
gaagaucagcuaucagaaa

SEQ ID NO: 649327 - RNA, 19 nt, Homo sapiens
gucaauggcuugcaauaaa

SEQ ID NO: 649328 - RNA, 19 nt, Homo sapiens
ggaaauauuugauccugau

SEQ ID NO: 649329 - RNA, 19 nt, Homo sapiens
gagaggaugucuuauaucu

SEQ ID NO: 649330 - RNA, 19 nt, Homo sapiens
caaauguccugauaauguu

SEQ ID NO: 649331 - RNA, 19 nt, Homo sapiens
gaaaacagcuggaguuaca

SEQ ID NO: 649332 - RNA, 19 nt, Homo sapiens
aagagaaacucaucauuga

SEQ ID NO: 649333 - RNA, 19 nt, Homo sapiens
gaacagcacacauccaaau

SEQ ID NO: 649334 - RNA, 19 nt, Homo sapiens
gaagaauguucaaaguuuc

SEQ ID NO: 649335 - RNA, 19 nt, Homo sapiens
ggaauacuuuaguugauug

SEQ ID NO: 649336 - RNA, 19 nt, Homo sapiens
gcagugagcugugaugaca

SEQ ID NO: 649337 - RNA, 19 nt, Homo sapiens
ccaaauccaucagcaaauu

SEQ ID NO: 649338 - RNA, 19 nt, Homo sapiens
ucaguuugcucacuucuuu

SEQ ID NO: 649339 - RNA, 19 nt, Homo sapiens
gcacuagguuauaaagaga

SEQ ID NO: 649340 - RNA, 19 nt, Homo sapiens
cuaaagaacuucagucucu

SEQ ID NO: 649341 - RNA, 19 nt, Homo sapiens
gaggaggaauaugugauua

SEQ ID NO: 649342 - RNA, 19 nt, Homo sapiens
guagcugugugcuggauua

SEQ ID NO: 649343 - RNA, 19 nt, Homo sapiens
ugaaaucacugguaacaca

SEQ ID NO: 649344 - RNA, 19 nt, Homo sapiens
caacaaagcaacagaagau

SEQ ID NO: 649345 - RNA, 19 nt, Homo sapiens
ggaaaugaagccauguuaa

SEQ ID NO: 649346 - RNA, 19 nt, Homo sapiens
uaaccaugcuuacacacua

SEQ ID NO: 649347 - RNA, 19 nt, Homo sapiens
gcugugagaaguuguaaua

SEQ ID NO: 649348 - RNA, 19 nt, Homo sapiens
ggacaucauuuacgucaca

SEQ ID NO: 649349 - RNA, 19 nt, Homo sapiens
gaaagaccauguggacguu

SEQ ID NO: 649350 - RNA, 19 nt, Homo sapiens
gcugaagaguaaagaaauu

SEQ ID NO: 649351 - RNA, 19 nt, Homo sapiens
cagcagcacuagguuauaa

SEQ ID NO: 649352 - RNA, 19 nt, Homo sapiens
gugaugaguuggaacaauu

SEQ ID NO: 649353 - RNA, 19 nt, Homo sapiens
gaagcugacugcaucaaca

SEQ ID NO: 649354 - RNA, 19 nt, Homo sapiens
ugaaagcaaucguagcauu

SEQ ID NO: 649355 - RNA, 19 nt, Homo sapiens
gcacagugaugaguuggaa

SEQ ID NO: 649356 - RNA, 19 nt, Homo sapiens
gaggaaguaugcacauuuc

SEQ ID NO: 649357 - RNA, 19 nt, Homo sapiens
uuuggaagcugaagaguaa

SEQ ID NO: 649358 - RNA, 19 nt, Homo sapiens
gacuauggcuugaguagga

SEQ ID NO: 649359 - RNA, 19 nt, Homo sapiens
gaccucaauucuuccauaa

SEQ ID NO: 649360 - RNA, 19 nt, Homo sapiens
gaagaagaacugaaaucaa

SEQ ID NO: 649361 - RNA, 19 nt, Homo sapiens
gcuaauacuucucagacaa

SEQ ID NO: 649362 - RNA, 19 nt, Homo sapiens
caaacugcaucuauaggaa

SEQ ID NO: 649363 - RNA, 19 nt, Homo sapiens
uagcacagccauuuagaua

SEQ ID NO: 649364 - RNA, 19 nt, Homo sapiens
aggcaaaucuuccagacua

SEQ ID NO: 649365 - RNA, 19 nt, Homo sapiens
aagaagaacugaaaucaag

SEQ ID NO: 649366 - RNA, 19 nt, Homo sapiens
ucaaauguccugauaaugu

SEQ ID NO: 649367 - RNA, 19 nt, Homo sapiens
guaauuauguccgugaaau

SEQ ID NO: 649368 - RNA, 19 nt, Homo sapiens
ccaacaacaucaacacaga

SEQ ID NO: 649369 - RNA, 19 nt, Homo sapiens
gaggagcgguaccuuaugu

SEQ ID NO: 649370 - RNA, 19 nt, Homo sapiens
gcugugugcuggauuauuc

SEQ ID NO: 649371 - RNA, 19 nt, Homo sapiens
ugaaugauuugacucaguu

SEQ ID NO: 649372 - RNA, 19 nt, Homo sapiens
ggaagaagaacugaaauca

SEQ ID NO: 649373 - RNA, 19 nt, Homo sapiens
ggagcgguaccuuauguua

SEQ ID NO: 649374 - RNA, 19 nt, Homo sapiens
ucaugcgacuggagaaaua

SEQ ID NO: 649375 - RNA, 19 nt, Homo sapiens
ugagagcagugucgccaua

SEQ ID NO: 649376 - RNA, 19 nt, Homo sapiens
gaauggcuguuguucuguu

SEQ ID NO: 649377 - RNA, 19 nt, Homo sapiens
gaagaacugaaaucaagaa

SEQ ID NO: 649378 - RNA, 19 nt, Homo sapiens
gcuuauaucuuugggaguu

SEQ ID NO: 649379 - RNA, 19 nt, Homo sapiens
caagugguguguaaacuag

SEQ ID NO: 649380 - RNA, 19 nt, Homo sapiens
aaaggaagacugagagaaa

SEQ ID NO: 649381 - RNA, 19 nt, Homo sapiens
aaauggaagucaucaguug

SEQ ID NO: 649382 - RNA, 19 nt, Homo sapiens
uuacagugaugaguacaua

SEQ ID NO: 649383 - RNA, 19 nt, Homo sapiens
cagcacacauccaaauuca

SEQ ID NO: 649384 - RNA, 19 nt, Homo sapiens
guuagacugugaggaguua

SEQ ID NO: 649385 - RNA, 19 nt, Homo sapiens
ggaagagaaacucaucauu

SEQ ID NO: 649386 - RNA, 19 nt, Homo sapiens
caaaguaggagguugucua

SEQ ID NO: 649387 - RNA, 19 nt, Homo sapiens
gaagcaaacagaugagugu

SEQ ID NO: 649388 - RNA, 19 nt, Homo sapiens
guagugcucauucuucuuu

SEQ ID NO: 649389 - RNA, 19 nt, Homo sapiens
gaaagcaaucguagcauuc

SEQ ID NO: 649390 - RNA, 19 nt, Homo sapiens
gcaaacugcaucuauagga

SEQ ID NO: 649391 - RNA, 19 nt, Homo sapiens
gaaacuagaacugugagaa

SEQ ID NO: 649392 - RNA, 19 nt, Homo sapiens
ggaguuacuuuauguacgu

SEQ ID NO: 649393 - RNA, 19 nt, Homo sapiens
aggaauaugugauuaggaa

SEQ ID NO: 649394 - RNA, 19 nt, Homo sapiens
ggaggaggaauaugugauu

SEQ ID NO: 649395 - RNA, 19 nt, Homo sapiens
gaguuuaaguugucuacga

SEQ ID NO: 649396 - RNA, 19 nt, Homo sapiens
gugacuagauuagaugaaa

SEQ ID NO: 649397 - RNA, 19 nt, Homo sapiens
caacaaaccucagcaaacc

SEQ ID NO: 649398 - RNA, 19 nt, Homo sapiens
gagcccagguauccucauu

SEQ ID NO: 649399 - RNA, 19 nt, Homo sapiens
gaacauaacuccaguccaa

SEQ ID NO: 649400 - RNA, 19 nt, Homo sapiens
gaaaguagccuuccuaaug

SEQ ID NO: 649401 - RNA, 19 nt, Homo sapiens
ggaguuggcuugugccuua

SEQ ID NO: 649402 - RNA, 19 nt, Homo sapiens
gcaaauaccucacccuuca

SEQ ID NO: 649403 - RNA, 19 nt, Homo sapiens
ggacaagacuucugcuuug

SEQ ID NO: 649404 - RNA, 19 nt, Homo sapiens
ccaaauccauugaggaaua

SEQ ID NO: 649405 - RNA, 19 nt, Homo sapiens
gcucaucagugccucauua

SEQ ID NO: 649406 - RNA, 19 nt, Homo sapiens
ccaaaggccucuauagauu

SEQ ID NO: 649407 - RNA, 19 nt, Homo sapiens
ggauucaucuacuaguuua

SEQ ID NO: 649408 - RNA, 19 nt, Homo sapiens
gugagaaacuccugaauga

SEQ ID NO: 649409 - RNA, 19 nt, Homo sapiens
gagcaugacuuauucugaa

SEQ ID NO: 649410 - RNA, 19 nt, Homo sapiens
aaacuggacuuuaggagua

SEQ ID NO: 649411 - RNA, 19 nt, Homo sapiens
gcaaauaccaagauccaua

SEQ ID NO: 649412 - RNA, 19 nt, Homo sapiens
ggaaugaagcgcuuucuuu

SEQ ID NO: 649413 - RNA, 19 nt, Homo sapiens
acacauaccucuugcuuug

SEQ ID NO: 649414 - RNA, 19 nt, Homo sapiens
uuaaauagcuguccauaag

SEQ ID NO: 649415 - RNA, 19 nt, Homo sapiens
gaacuccugucaauauguu

SEQ ID NO: 649416 - RNA, 19 nt, Homo sapiens
gaacugugccuugaugaua

SEQ ID NO: 649417 - RNA, 19 nt, Homo sapiens
ggacaacaguaucuucaug

SEQ ID NO: 649418 - RNA, 19 nt, Homo sapiens
gaccaaagcagacaauauu

SEQ ID NO: 649419 - RNA, 19 nt, Homo sapiens
gcaggacaguucaaccuaa

SEQ ID NO: 649420 - RNA, 19 nt, Homo sapiens
ugaaagcacugcaguuguu

SEQ ID NO: 649421 - RNA, 19 nt, Homo sapiens
gaagauuucacuaaacgua

SEQ ID NO: 649422 - RNA, 19 nt, Homo sapiens
caucagugccucauuauuu

SEQ ID NO: 649423 - RNA, 19 nt, Homo sapiens
caacacccuuucuuccaua

SEQ ID NO: 649424 - RNA, 19 nt, Homo sapiens
gaaagaaguguuugcauca

SEQ ID NO: 649425 - RNA, 19 nt, Homo sapiens
cagcuggaaucucugaaua

SEQ ID NO: 649426 - RNA, 19 nt, Homo sapiens
cauggaagauuucacuaaa

SEQ ID NO: 649427 - RNA, 19 nt, Homo sapiens
uaacaaagaggaauacaug

SEQ ID NO: 649428 - RNA, 19 nt, Homo sapiens
ggacaguucaaccuaauaa

SEQ ID NO: 649429 - RNA, 19 nt, Homo sapiens
ugagaaguaugaacaagaa

SEQ ID NO: 649430 - RNA, 19 nt, Homo sapiens
guaaaugcuucagcuguaa

SEQ ID NO: 649431 - RNA, 19 nt, Homo sapiens
gcagaaagguccccucgua

SEQ ID NO: 649432 - RNA, 19 nt, Homo sapiens
caucaacucuuacuguguu

SEQ ID NO: 649433 - RNA, 19 nt, Homo sapiens
guaucacaguucacauuua

SEQ ID NO: 649434 - RNA, 19 nt, Homo sapiens
uaaagacucuauccauugu

SEQ ID NO: 649435 - RNA, 19 nt, Homo sapiens
gcuggaaucucugaauauu

SEQ ID NO: 649436 - RNA, 19 nt, Homo sapiens
ggagacagaaggaaauuga

SEQ ID NO: 649437 - RNA, 19 nt, Homo sapiens
ggaaggagacagaaggaaa

SEQ ID NO: 649438 - RNA, 19 nt, Homo sapiens
ggagcaauacaaagaauuu

SEQ ID NO: 649439 - RNA, 19 nt, Homo sapiens
gacaaaagcuguugcauca

SEQ ID NO: 649440 - RNA, 19 nt, Homo sapiens
gaaguaaaguaggaacugu

SEQ ID NO: 649441 - RNA, 19 nt, Homo sapiens
cagcaagccuccucucaga

SEQ ID NO: 649442 - RNA, 19 nt, Homo sapiens
gauauuaccaagucauuga

SEQ ID NO: 649443 - RNA, 19 nt, Homo sapiens
gaacacuauugccaccaaa

SEQ ID NO: 649444 - RNA, 19 nt, Homo sapiens
caaaguaccaggauucuuc

SEQ ID NO: 649445 - RNA, 19 nt, Homo sapiens
gaauguugcuacuucacaa

SEQ ID NO: 649446 - RNA, 19 nt, Homo sapiens
gaaggaucaugcugagaug

SEQ ID NO: 649447 - RNA, 19 nt, Homo sapiens
ugaaguggaucccagcaaa

SEQ ID NO: 649448 - RNA, 19 nt, Homo sapiens
uggaaucucugaauauuuc

SEQ ID NO: 649449 - RNA, 19 nt, Homo sapiens
aagaggaacugaagaagga

SEQ ID NO: 649450 - RNA, 19 nt, Homo sapiens
agaagcugcugcuggaaua

SEQ ID NO: 649451 - RNA, 19 nt, Homo sapiens
cuggagagguuauuuaaau

SEQ ID NO: 649452 - RNA, 19 nt, Homo sapiens
auaccaagauccauacaaa

SEQ ID NO: 649453 - RNA, 19 nt, Homo sapiens
aguaggaacuguuguguga

SEQ ID NO: 649454 - RNA, 19 nt, Homo sapiens
ggaguaauuucuauugaac

SEQ ID NO: 649455 - RNA, 19 nt, Homo sapiens
gaaagcacugcaguuguua

SEQ ID NO: 649456 - RNA, 19 nt, Homo sapiens
ggaagaaacugagcaaaau

SEQ ID NO: 649457 - RNA, 19 nt, Homo sapiens
gaccuucuauucggauuaa

SEQ ID NO: 649458 - RNA, 19 nt, Homo sapiens
gacaagacuucugcuuuga

SEQ ID NO: 649459 - RNA, 19 nt, Homo sapiens
cugaaaggcuccaucaaga

SEQ ID NO: 649460 - RNA, 19 nt, Homo sapiens
caaaagcuguugcaucaaa

SEQ ID NO: 649461 - RNA, 19 nt, Homo sapiens
gcauggaagauuucacuaa

SEQ ID NO: 649462 - RNA, 19 nt, Homo sapiens
ugacagugauuugcauaaa

SEQ ID NO: 649463 - RNA, 19 nt, Homo sapiens
gcugugagcuggcuuucug

SEQ ID NO: 649464 - RNA, 19 nt, Homo sapiens
gcaaauguucaucuaguga

SEQ ID NO: 649465 - RNA, 19 nt, Homo sapiens
caugaugucuugaucuuca

SEQ ID NO: 649466 - RNA, 19 nt, Homo sapiens
gaaaagugguauccaguga

SEQ ID NO: 649467 - RNA, 19 nt, Homo sapiens
gagaaacuccugaaugaag

SEQ ID NO: 649468 - RNA, 19 nt, Homo sapiens
gcuaauggcuguggaagag

SEQ ID NO: 649469 - RNA, 19 nt, Homo sapiens
ccaagcaugcugagaagua

SEQ ID NO: 649470 - RNA, 19 nt, Homo sapiens
ugaagaggauguggaagaa

SEQ ID NO: 649471 - RNA, 19 nt, Homo sapiens
gauagacacauaccucuug

SEQ ID NO: 649472 - RNA, 19 nt, Homo sapiens
aaaguagccuuccuaaugg

SEQ ID NO: 649473 - RNA, 19 nt, Homo sapiens
gggaguuuaucaaagcuuu

SEQ ID NO: 649474 - RNA, 19 nt, Homo sapiens
gaaggagacagaaggaaau

SEQ ID NO: 649475 - RNA, 19 nt, Homo sapiens
gaucaucaacucuuacugu

SEQ ID NO: 649476 - RNA, 19 nt, Homo sapiens
cagcaaauguucaucuagu

SEQ ID NO: 649477 - RNA, 19 nt, Homo sapiens
agagagcccuguucccaaa

SEQ ID NO: 649478 - RNA, 19 nt, Homo sapiens
ucucagagcaugacuuauu

SEQ ID NO: 649479 - RNA, 19 nt, Homo sapiens
caacacagacagcuacuuc

SEQ ID NO: 649480 - RNA, 19 nt, Homo sapiens
gaagacagcaggaagaaaa

SEQ ID NO: 649481 - RNA, 19 nt, Homo sapiens
ggugccagauagacacaua

SEQ ID NO: 649482 - RNA, 19 nt, Homo sapiens
gcacaggcgaguacaguau

SEQ ID NO: 649483 - RNA, 19 nt, Homo sapiens
aguaaaugcuucagcugua

SEQ ID NO: 649484 - RNA, 19 nt, Homo sapiens
cauaagccauccagaucaa

SEQ ID NO: 649485 - RNA, 19 nt, Homo sapiens
gccacacagugcuucuuua

SEQ ID NO: 649486 - RNA, 19 nt, Homo sapiens
gagcuggcuuucugcaaga

SEQ ID NO: 649487 - RNA, 19 nt, Homo sapiens
gcaagcaguuauugaugca

SEQ ID NO: 649488 - RNA, 19 nt, Homo sapiens
gccgagagcuuucaguuuu

SEQ ID NO: 649489 - RNA, 19 nt, Homo sapiens
gaucugggccgagagcuuu

SEQ ID NO: 649490 - RNA, 19 nt, Homo sapiens
gauacccucuuugcucgua

SEQ ID NO: 649491 - RNA, 19 nt, Homo sapiens
ccacauaccaucuucaucu

SEQ ID NO: 649492 - RNA, 19 nt, Homo sapiens
aauaauugaugcacaggaa

SEQ ID NO: 649493 - RNA, 19 nt, Homo sapiens
gccaaaggccucuauagau

SEQ ID NO: 649494 - RNA, 19 nt, Homo sapiens
caucaaaacuggacuuuag

SEQ ID NO: 649495 - RNA, 19 nt, Homo sapiens
agaaacuccugaaugaaga

SEQ ID NO: 649496 - RNA, 19 nt, Homo sapiens
guucuucguuuauggauca

SEQ ID NO: 649497 - RNA, 19 nt, Homo sapiens
agagacaaguggauggaaa

SEQ ID NO: 649498 - RNA, 19 nt, Homo sapiens
agaccaagcaucuaucuga

SEQ ID NO: 649499 - RNA, 19 nt, Homo sapiens
gaacauaacuccaguccaa

SEQ ID NO: 649500 - RNA, 19 nt, Homo sapiens
gaaaguagccuuccuaaug

SEQ ID NO: 649501 - RNA, 19 nt, Homo sapiens
ggaguuggcuugugccuua

SEQ ID NO: 649502 - RNA, 19 nt, Homo sapiens
gcaaauaccucacccuuca

SEQ ID NO: 649503 - RNA, 19 nt, Homo sapiens
ggacaagacuucugcuuug

SEQ ID NO: 649504 - RNA, 19 nt, Homo sapiens
ccaaauccauugaggaaua

SEQ ID NO: 649505 - RNA, 19 nt, Homo sapiens
gcucaucagugccucauua

SEQ ID NO: 649506 - RNA, 19 nt, Homo sapiens
ccaaaggccucuauagauu

SEQ ID NO: 649507 - RNA, 19 nt, Homo sapiens
gcagacagauuccaccaaa

SEQ ID NO: 649508 - RNA, 19 nt, Homo sapiens
ggauucaucuacuaguuua

SEQ ID NO: 649509 - RNA, 19 nt, Homo sapiens
gugagaaacuccugaauga

SEQ ID NO: 649510 - RNA, 19 nt, Homo sapiens
gagcaugacuuauucugaa

SEQ ID NO: 649511 - RNA, 19 nt, Homo sapiens
aaacuggacuuuaggagua

SEQ ID NO: 649512 - RNA, 19 nt, Homo sapiens
gcaaauaccaagauccaua

SEQ ID NO: 649513 - RNA, 19 nt, Homo sapiens
ggaaugaagcgcuuucuuu

SEQ ID NO: 649514 - RNA, 19 nt, Homo sapiens
acacauaccucuugcuuug

SEQ ID NO: 649515 - RNA, 19 nt, Homo sapiens
uuaaauagcuguccauaag

SEQ ID NO: 649516 - RNA, 19 nt, Homo sapiens
gaacuccugucaauauguu

SEQ ID NO: 649517 - RNA, 19 nt, Homo sapiens
gaacugugccuugaugaua

SEQ ID NO: 649518 - RNA, 19 nt, Homo sapiens
ggacaacaguaucuucaug

SEQ ID NO: 649519 - RNA, 19 nt, Homo sapiens
gaccaaagcagacaauauu

SEQ ID NO: 649520 - RNA, 19 nt, Homo sapiens
gcaggacaguucaaccuaa

SEQ ID NO: 649521 - RNA, 19 nt, Homo sapiens
ugaaagcacugcaguuguu

SEQ ID NO: 649522 - RNA, 19 nt, Homo sapiens
gaagauuucacuaaacgua

SEQ ID NO: 649523 - RNA, 19 nt, Homo sapiens
caucagugccucauuauuu

SEQ ID NO: 649524 - RNA, 19 nt, Homo sapiens
caacacccuuucuuccaua

SEQ ID NO: 649525 - RNA, 19 nt, Homo sapiens
gaaagaaguguuugcauca

SEQ ID NO: 649526 - RNA, 19 nt, Homo sapiens
cagcuggaaucucugaaua

SEQ ID NO: 649527 - RNA, 19 nt, Homo sapiens
cauggaagauuucacuaaa

SEQ ID NO: 649528 - RNA, 19 nt, Homo sapiens
uaacaaagaggaauacaug

SEQ ID NO: 649529 - RNA, 19 nt, Homo sapiens
ggacaguucaaccuaauaa

SEQ ID NO: 649530 - RNA, 19 nt, Homo sapiens
ugagaaguaugaacaagaa

SEQ ID NO: 649531 - RNA, 19 nt, Homo sapiens
guaaaugcuucagcuguaa

SEQ ID NO: 649532 - RNA, 19 nt, Homo sapiens
gcagaaagguccccucgua

SEQ ID NO: 649533 - RNA, 19 nt, Homo sapiens
caucaacucuuacuguguu

SEQ ID NO: 649534 - RNA, 19 nt, Homo sapiens
guaucacaguucacauuua

SEQ ID NO: 649535 - RNA, 19 nt, Homo sapiens
uaaagacucuauccauugu

SEQ ID NO: 649536 - RNA, 19 nt, Homo sapiens
gcuggaaucucugaauauu

SEQ ID NO: 649537 - RNA, 19 nt, Homo sapiens
ggagacagaaggaaauuga

SEQ ID NO: 649538 - RNA, 19 nt, Homo sapiens
ggaaggagacagaaggaaa

SEQ ID NO: 649539 - RNA, 19 nt, Homo sapiens
ggagcaauacaaagaauuu

SEQ ID NO: 649540 - RNA, 19 nt, Homo sapiens
gacaaaagcuguugcauca

SEQ ID NO: 649541 - RNA, 19 nt, Homo sapiens
gaaguaaaguaggaacugu

SEQ ID NO: 649542 - RNA, 19 nt, Homo sapiens
cagcaagccuccucucaga

SEQ ID NO: 649543 - RNA, 19 nt, Homo sapiens
gauauuaccaagucauuga

SEQ ID NO: 649544 - RNA, 19 nt, Homo sapiens
gaacacuauugccaccaaa

SEQ ID NO: 649545 - RNA, 19 nt, Homo sapiens
caaaguaccaggauucuuc

SEQ ID NO: 649546 - RNA, 19 nt, Homo sapiens
gaauguugcuacuucacaa

SEQ ID NO: 649547 - RNA, 19 nt, Homo sapiens
gaaggaucaugcugagaug

SEQ ID NO: 649548 - RNA, 19 nt, Homo sapiens
ugaaguggaucccagcaaa

SEQ ID NO: 649549 - RNA, 19 nt, Homo sapiens
uggaaucucugaauauuuc

SEQ ID NO: 649550 - RNA, 19 nt, Homo sapiens
aagaggaacugaagaagga

SEQ ID NO: 649551 - RNA, 19 nt, Homo sapiens
agaagcugcugcuggaaua

SEQ ID NO: 649552 - RNA, 19 nt, Homo sapiens
cuggagagguuauuuaaau

SEQ ID NO: 649553 - RNA, 19 nt, Homo sapiens
auaccaagauccauacaaa

SEQ ID NO: 649554 - RNA, 19 nt, Homo sapiens
aguaggaacuguuguguga

SEQ ID NO: 649555 - RNA, 19 nt, Homo sapiens
ggaguaauuucuauugaac

SEQ ID NO: 649556 - RNA, 19 nt, Homo sapiens
gaaagcacugcaguuguua

SEQ ID NO: 649557 - RNA, 19 nt, Homo sapiens
ggaagaaacugagcaaaau

SEQ ID NO: 649558 - RNA, 19 nt, Homo sapiens
gaccuucuauucggauuaa

SEQ ID NO: 649559 - RNA, 19 nt, Homo sapiens
gacaagacuucugcuuuga

SEQ ID NO: 649560 - RNA, 19 nt, Homo sapiens
cugaaaggcuccaucaaga

SEQ ID NO: 649561 - RNA, 19 nt, Homo sapiens
caaaagcuguugcaucaaa

SEQ ID NO: 649562 - RNA, 19 nt, Homo sapiens
gcauggaagauuucacuaa

SEQ ID NO: 649563 - RNA, 19 nt, Homo sapiens
ugacagugauuugcauaaa

SEQ ID NO: 649564 - RNA, 19 nt, Homo sapiens
gcugugagcuggcuuucug

SEQ ID NO: 649565 - RNA, 19 nt, Homo sapiens
gcaaauguucaucuaguga

SEQ ID NO: 649566 - RNA, 19 nt, Homo sapiens
caugaugucuugaucuuca

SEQ ID NO: 649567 - RNA, 19 nt, Homo sapiens
gaaaagugguauccaguga

SEQ ID NO: 649568 - RNA, 19 nt, Homo sapiens
gguguacgaugguaaagga

SEQ ID NO: 649569 - RNA, 19 nt, Homo sapiens
gagaaacuccugaaugaag

SEQ ID NO: 649570 - RNA, 19 nt, Homo sapiens
gcuaauggcuguggaagag

SEQ ID NO: 649571 - RNA, 19 nt, Homo sapiens
ccaagcaugcugagaagua

SEQ ID NO: 649572 - RNA, 19 nt, Homo sapiens
ugaagaggauguggaagaa

SEQ ID NO: 649573 - RNA, 19 nt, Homo sapiens
gauagacacauaccucuug

SEQ ID NO: 649574 - RNA, 19 nt, Homo sapiens
aaaguagccuuccuaaugg

SEQ ID NO: 649575 - RNA, 19 nt, Homo sapiens
gggaguuuaucaaagcuuu

SEQ ID NO: 649576 - RNA, 19 nt, Homo sapiens
gaaggagacagaaggaaau

SEQ ID NO: 649577 - RNA, 19 nt, Homo sapiens
gaucaucaacucuuacugu

SEQ ID NO: 649578 - RNA, 19 nt, Homo sapiens
cagcaaauguucaucuagu

SEQ ID NO: 649579 - RNA, 19 nt, Homo sapiens
agagagcccuguucccaaa

SEQ ID NO: 649580 - RNA, 19 nt, Homo sapiens
ucucagagcaugacuuauu

SEQ ID NO: 649581 - RNA, 19 nt, Homo sapiens
caacacagacagcuacuuc

SEQ ID NO: 649582 - RNA, 19 nt, Homo sapiens
gaagacagcaggaagaaaa

SEQ ID NO: 649583 - RNA, 19 nt, Homo sapiens
ggugccagauagacacaua

SEQ ID NO: 649584 - RNA, 19 nt, Homo sapiens
aguaaaugcuucagcugua

SEQ ID NO: 649585 - RNA, 19 nt, Homo sapiens
cauaagccauccagaucaa

SEQ ID NO: 649586 - RNA, 19 nt, Homo sapiens
gccacacagugcuucuuua

SEQ ID NO: 649587 - RNA, 19 nt, Homo sapiens
caacaaggagaaggagaua

SEQ ID NO: 649588 - RNA, 19 nt, Homo sapiens
gagcuggcuuucugcaaga

SEQ ID NO: 649589 - RNA, 19 nt, Homo sapiens
gcaagcaguuauugaugca

SEQ ID NO: 649590 - RNA, 19 nt, Homo sapiens
gccgagagcuuucaguuuu

SEQ ID NO: 649591 - RNA, 19 nt, Homo sapiens
gaucugggccgagagcuuu

SEQ ID NO: 649592 - RNA, 19 nt, Homo sapiens
gauacccucuuugcucgua

SEQ ID NO: 649593 - RNA, 19 nt, Homo sapiens
ccacauaccaucuucaucu

SEQ ID NO: 649594 - RNA, 19 nt, Homo sapiens
gacaggagcagcagacaga

SEQ ID NO: 649595 - RNA, 19 nt, Homo sapiens
aauaauugaugcacaggaa

SEQ ID NO: 649596 - RNA, 19 nt, Homo sapiens
gccaaaggccucuauagau

SEQ ID NO: 649597 - RNA, 19 nt, Homo sapiens
caucaaaacuggacuuuag

SEQ ID NO: 649598 - RNA, 19 nt, Homo sapiens
agaaacuccugaaugaaga

SEQ ID NO: 649599 - RNA, 19 nt, Homo sapiens
ugacggaucugaacacgua

SEQ ID NO: 649600 - RNA, 19 nt, Homo sapiens
gcaaggaugugcuggagaa

SEQ ID NO: 649601 - RNA, 19 nt, Homo sapiens
ggagauggaugacgaggaa

SEQ ID NO: 649602 - RNA, 19 nt, Homo sapiens
cuaccgagcugggcaguua

SEQ ID NO: 649603 - RNA, 19 nt, Homo sapiens
gaacacguaccucaacaaa

SEQ ID NO: 649604 - RNA, 19 nt, Homo sapiens
gcagaaggaugcucagaac

SEQ ID NO: 649605 - RNA, 19 nt, Homo sapiens
agaaguaccuggacgugaa

SEQ ID NO: 649606 - RNA, 19 nt, Homo sapiens
gaaccauguuugcagacuu

SEQ ID NO: 649607 - RNA, 19 nt, Homo sapiens
acaaagggaugacggaaca

SEQ ID NO: 649608 - RNA, 19 nt, Homo sapiens
agacuuggauuaugacauc

SEQ ID NO: 649609 - RNA, 19 nt, Homo sapiens
gguggaagcuggugugacu

SEQ ID NO: 649610 - RNA, 19 nt, Homo sapiens
ugacggaacacaccaagaa

SEQ ID NO: 649611 - RNA, 19 nt, Homo sapiens
uugcagacuuggauuauga

SEQ ID NO: 649612 - RNA, 19 nt, Homo sapiens
acacguaccucaacaaagc

SEQ ID NO: 649613 - RNA, 19 nt, Homo sapiens
gacauuguguugaagaaag

SEQ ID NO: 649614 - RNA, 19 nt, Homo sapiens
ccgcugagcuauacaaagg

SEQ ID NO: 649615 - RNA, 19 nt, Homo sapiens
ggaaggugacccugcagaa

SEQ ID NO: 649616 - RNA, 19 nt, Homo sapiens
caggaggaguucacagaug

SEQ ID NO: 649617 - RNA, 19 nt, Homo sapiens
gcaccggcaacuaugagua

SEQ ID NO: 649618 - RNA, 19 nt, Homo sapiens
gcaaugaugggcuugucaa

SEQ ID NO: 649619 - RNA, 19 nt, Homo sapiens
guacugucccugccucuau

SEQ ID NO: 649620 - RNA, 19 nt, Homo sapiens
gaggaauacagcugcauug

SEQ ID NO: 649621 - RNA, 19 nt, Homo sapiens
guaccuggacgugaaguuu

SEQ ID NO: 649622 - RNA, 19 nt, Homo sapiens
ggacauuguguugaagaaa

SEQ ID NO: 649623 - RNA, 19 nt, Homo sapiens
uguccaccauguccaagua

SEQ ID NO: 649624 - RNA, 19 nt, Homo sapiens
gagcgaggcuuuugugaag

SEQ ID NO: 649625 - RNA, 19 nt, Homo sapiens
gucaauggcaggucaauca

SEQ ID NO: 649626 - RNA, 19 nt, Homo sapiens
ugagaucaccggugucaau

SEQ ID NO: 649627 - RNA, 19 nt, Homo sapiens
gggccauccugugcaauga

SEQ ID NO: 649628 - RNA, 19 nt, Homo sapiens
gaugagaucaccgguguca

SEQ ID NO: 649629 - RNA, 19 nt, Homo sapiens
ugacaucgaagaggauaaa

SEQ ID NO: 649630 - RNA, 19 nt, Homo sapiens
gacacucgccucaccauca

SEQ ID NO: 649631 - RNA, 19 nt, Homo sapiens
ggagguggcgaagaugauu

SEQ ID NO: 649632 - RNA, 19 nt, Homo sapiens
ggacgugaaguuugaguac

SEQ ID NO: 649633 - RNA, 19 nt, Homo sapiens
acacucgccucaccaucaa

SEQ ID NO: 649634 - RNA, 19 nt, Homo sapiens
gaaggugacccugcagaag

SEQ ID NO: 649635 - RNA, 19 nt, Homo sapiens
gggccuguaucgaauaaac

SEQ ID NO: 649636 - RNA, 19 nt, Homo sapiens
gcacaccacauuggccuau

SEQ ID NO: 649637 - RNA, 19 nt, Homo sapiens
gccucaccaucaagaagua

SEQ ID NO: 649638 - RNA, 19 nt, Homo sapiens
aaccauguuugcagacuug

SEQ ID NO: 649639 - RNA, 19 nt, Homo sapiens
uacugucccugccucuaua

SEQ ID NO: 649640 - RNA, 19 nt, Homo sapiens
gccugaaggugaaggagau

SEQ ID NO: 649641 - RNA, 19 nt, Homo sapiens
ggcggacucugggaucuga

SEQ ID NO: 649642 - RNA, 19 nt, Homo sapiens
cguacugccugaaggugaa

SEQ ID NO: 649643 - RNA, 19 nt, Homo sapiens
ggacguguucuccgugauc

SEQ ID NO: 649644 - RNA, 19 nt, Homo sapiens
ggaccgcugagcuauacaa

SEQ ID NO: 649645 - RNA, 19 nt, Homo sapiens
gaccauccacuacaacaag

SEQ ID NO: 649646 - RNA, 19 nt, Homo sapiens
aggaugugcuggagaagau

SEQ ID NO: 649647 - RNA, 19 nt, Homo sapiens
cgaggaauacagcugcauu

SEQ ID NO: 649648 - RNA, 19 nt, Homo sapiens
ggaggugaccauccacuac

SEQ ID NO: 649649 - RNA, 19 nt, Homo sapiens
gggaggugaccauccacua

SEQ ID NO: 649650 - RNA, 19 nt, Homo sapiens
caauggcaggucaaucaaa

SEQ ID NO: 649651 - RNA, 19 nt, Homo sapiens
gaggugaccauccacuaca

SEQ ID NO: 649652 - RNA, 19 nt, Homo sapiens
ggaaccauguuugcagacu

SEQ ID NO: 649653 - RNA, 19 nt, Homo sapiens
gagaucaccggugucaaug

SEQ ID NO: 649654 - RNA, 19 nt, Homo sapiens
agauggaugacgaggaaua

SEQ ID NO: 649655 - RNA, 19 nt, Homo sapiens
caucgaagaggauaaacuc

SEQ ID NO: 649656 - RNA, 19 nt, Homo sapiens
aauggcaggucaaucaaag

SEQ ID NO: 649657 - RNA, 19 nt, Homo sapiens
cuauaucguccagguauuu

SEQ ID NO: 649658 - RNA, 19 nt, Homo sapiens
cagcugcgagcgaggcuuu

SEQ ID NO: 649659 - RNA, 19 nt, Homo sapiens
gccuuuauuuauucuguuc

SEQ ID NO: 649660 - RNA, 19 nt, Homo sapiens
ccaccauguccaaguacua

SEQ ID NO: 649661 - RNA, 19 nt, Homo sapiens
ggccuuuauuuauucuguu

SEQ ID NO: 649662 - RNA, 19 nt, Homo sapiens
ucuauaucguccagguauu

SEQ ID NO: 649663 - RNA, 19 nt, Homo sapiens
ccaacucucggaaccaugu

SEQ ID NO: 649664 - RNA, 19 nt, Homo sapiens
ggaggaggaggaggaggaa

SEQ ID NO: 649665 - RNA, 19 nt, Homo sapiens
gcucggccacuucucugaa

SEQ ID NO: 649666 - RNA, 19 nt, Homo sapiens
gaaguaccuggacgugaag

SEQ ID NO: 649667 - RNA, 19 nt, Homo sapiens
gcauucggcuucugaaaac

SEQ ID NO: 649668 - RNA, 19 nt, Homo sapiens
uggacauuguguugaagaa

SEQ ID NO: 649669 - RNA, 19 nt, Homo sapiens
cggcagguggguucaggua

SEQ ID NO: 649670 - RNA, 19 nt, Homo sapiens
guccagguauuugacaaca

SEQ ID NO: 649671 - RNA, 19 nt, Homo sapiens
gaaggugaaggagauggau

SEQ ID NO: 649672 - RNA, 19 nt, Homo sapiens
gcgaggcuuuugugaaguu

SEQ ID NO: 649673 - RNA, 19 nt, Homo sapiens
uggauuaugacaucgaaga

SEQ ID NO: 649674 - RNA, 19 nt, Homo sapiens
cccuggacauuguguugaa

SEQ ID NO: 649675 - RNA, 19 nt, Homo sapiens
ggaaucauccgguuuauuu

SEQ ID NO: 649676 - RNA, 19 nt, Homo sapiens
agaaggagcugaacgaaau

SEQ ID NO: 649677 - RNA, 19 nt, Homo sapiens
gaaggagccuaccaaagug

SEQ ID NO: 649678 - RNA, 19 nt, Homo sapiens
caagaagaccgacgugaaa

SEQ ID NO: 649679 - RNA, 19 nt, Homo sapiens
gagcagcaacgacaagaaa

SEQ ID NO: 649680 - RNA, 19 nt, Homo sapiens
gaaucauccgguuuauuua

SEQ ID NO: 649681 - RNA, 19 nt, Homo sapiens
ggaagaaggagcugaacga

SEQ ID NO: 649682 - RNA, 19 nt, Homo sapiens
ugaaagaggagaagaggaa

SEQ ID NO: 649683 - RNA, 19 nt, Homo sapiens
ggagaaggagccuaccaaa

SEQ ID NO: 649684 - RNA, 19 nt, Homo sapiens
cuacaucgccuaccucaug

SEQ ID NO: 649685 - RNA, 19 nt, Homo sapiens
agaaggagccuaccaaagu

SEQ ID NO: 649686 - RNA, 19 nt, Homo sapiens
gcagugaggaggaggagaa

SEQ ID NO: 649687 - RNA, 19 nt, Homo sapiens
gagcugaacgaaaucuuga

SEQ ID NO: 649688 - RNA, 19 nt, Homo sapiens
gaagaaggagcugaacgaa

SEQ ID NO: 649689 - RNA, 19 nt, Homo sapiens
ccacgagggcuacccguuu

SEQ ID NO: 649690 - RNA, 19 nt, Homo sapiens
auucagaagugcccaggua

SEQ ID NO: 649691 - RNA, 19 nt, Homo sapiens
ucaagaagaccgacgugaa

SEQ ID NO: 649692 - RNA, 19 nt, Homo sapiens
gaagaaaagcauuccauau

SEQ ID NO: 649693 - RNA, 19 nt, Homo sapiens
uuccauggcuggcucauug

SEQ ID NO: 649694 - RNA, 19 nt, Homo sapiens
ggagcugaacgaaaucuug

SEQ ID NO: 649695 - RNA, 19 nt, Homo sapiens
cgaaaugagucugguaggu

SEQ ID NO: 649696 - RNA, 19 nt, Homo sapiens
cacgagggcuacccguuug

SEQ ID NO: 649697 - RNA, 19 nt, Homo sapiens
gagaaggagccuaccaaag

SEQ ID NO: 649698 - RNA, 19 nt, Homo sapiens
gcugaacgaaaucuugaaa

SEQ ID NO: 649699 - RNA, 19 nt, Homo sapiens
gccuggaccacucccauua

SEQ ID NO: 649700 - RNA, 19 nt, Homo sapiens
aggcagagaucaagaagac

SEQ ID NO: 649701 - RNA, 19 nt, Homo sapiens
ggacucagagcaucaacag

SEQ ID NO: 649702 - RNA, 19 nt, Homo sapiens
gggagaaggagccuaccaa

SEQ ID NO: 649703 - RNA, 19 nt, Homo sapiens
agaaagucaucagguccua

SEQ ID NO: 649704 - RNA, 19 nt, Homo sapiens
gaagaccgacgugaaagag

SEQ ID NO: 649705 - RNA, 19 nt, Homo sapiens
acaccaaacucuccaaaau

SEQ ID NO: 649706 - RNA, 19 nt, Homo sapiens
ucaaggcagagaucaagaa

SEQ ID NO: 649707 - RNA, 19 nt, Homo sapiens
uuuggaaucauccgguuua

SEQ ID NO: 649708 - RNA, 19 nt, Homo sapiens
gugaggaggaggagaagga

SEQ ID NO: 649709 - RNA, 19 nt, Homo sapiens
cgacaccaaacucuccaaa

SEQ ID NO: 649710 - RNA, 19 nt, Homo sapiens
ggacuccuugcauuuggaa

SEQ ID NO: 649711 - RNA, 19 nt, Homo sapiens
aagaaggagcugaacgaaa

SEQ ID NO: 649712 - RNA, 19 nt, Homo sapiens
gggcgaaaugagucuggua

SEQ ID NO: 649713 - RNA, 19 nt, Homo sapiens
gguccuagacgugggagaa

SEQ ID NO: 649714 - RNA, 19 nt, Homo sapiens
ugaacgaaaucuugaaaag

SEQ ID NO: 649715 - RNA, 19 nt, Homo sapiens
gaaggagcugaacgaaauc

SEQ ID NO: 649716 - RNA, 19 nt, Homo sapiens
aaagucaucagguccuaga

SEQ ID NO: 649717 - RNA, 19 nt, Homo sapiens
ucauccgguuuauuuaugu

SEQ ID NO: 649718 - RNA, 19 nt, Homo sapiens
gcacagugagcagcaacga

SEQ ID NO: 649719 - RNA, 19 nt, Homo sapiens
gcaggacucagagcaucaa

SEQ ID NO: 649720 - RNA, 19 nt, Homo sapiens
ugaagaaaagcauuccaua

SEQ ID NO: 649721 - RNA, 19 nt, Homo sapiens
agaagaccgacgugaaaga

SEQ ID NO: 649722 - RNA, 19 nt, Homo sapiens
ucagaagugcccagguaga

SEQ ID NO: 649723 - RNA, 19 nt, Homo sapiens
gugggcgaauucagaagug

SEQ ID NO: 649724 - RNA, 19 nt, Homo sapiens
cggcgugggcgaauucaga

SEQ ID NO: 649725 - RNA, 19 nt, Homo sapiens
agaggaagaaggagcugaa

SEQ ID NO: 649726 - RNA, 19 nt, Homo sapiens
aagaggagaagaggaagaa

SEQ ID NO: 649727 - RNA, 19 nt, Homo sapiens
caagaaaccuauuggaauu

SEQ ID NO: 649728 - RNA, 19 nt, Homo sapiens
gaagauugccuaauacuuu

SEQ ID NO: 649729 - RNA, 19 nt, Homo sapiens
ggaaaucacuggagaucaa

SEQ ID NO: 649730 - RNA, 19 nt, Homo sapiens
uuaaguagcucuuugguaa

SEQ ID NO: 649731 - RNA, 19 nt, Homo sapiens
uuaauuagcuguugugaga

SEQ ID NO: 649732 - RNA, 19 nt, Homo sapiens
gaaggaagacuuauuaaca

SEQ ID NO: 649733 - RNA, 19 nt, Homo sapiens
guaagaggcugguggagaa

SEQ ID NO: 649734 - RNA, 19 nt, Homo sapiens
cgaugacgcugaacuagua

SEQ ID NO: 649735 - RNA, 19 nt, Homo sapiens
gaacaauaguacuugaaug

SEQ ID NO: 649736 - RNA, 19 nt, Homo sapiens
gaacaaaucauucacaaac

SEQ ID NO: 649737 - RNA, 19 nt, Homo sapiens
gcuaucaagugcuaaguuu

SEQ ID NO: 649738 - RNA, 19 nt, Homo sapiens
cgaagcagcugaucagaau

SEQ ID NO: 649739 - RNA, 19 nt, Homo sapiens
cagcacaacuuugacauaa

SEQ ID NO: 649740 - RNA, 19 nt, Homo sapiens
ggucugaaguccaaaguga

SEQ ID NO: 649741 - RNA, 19 nt, Homo sapiens
ggaauacugccauuuauau

SEQ ID NO: 649742 - RNA, 19 nt, Homo sapiens
gcuauaaacugcaauuucu

SEQ ID NO: 649743 - RNA, 19 nt, Homo sapiens
gcaagaaaccuauuggaau

SEQ ID NO: 649744 - RNA, 19 nt, Homo sapiens
gacauaagcucuacauugc

SEQ ID NO: 649745 - RNA, 19 nt, Homo sapiens
ccaguuuacucauggauuu

SEQ ID NO: 649746 - RNA, 19 nt, Homo sapiens
gaacuuguuugcacugcuu

SEQ ID NO: 649747 - RNA, 19 nt, Homo sapiens
gaucacugguuaagaaugu

SEQ ID NO: 649748 - RNA, 19 nt, Homo sapiens
caacaguaauucagcaaau

SEQ ID NO: 649749 - RNA, 19 nt, Homo sapiens
cagaggaaauuaauugaug

SEQ ID NO: 649750 - RNA, 19 nt, Homo sapiens
gaacuaguaaggcucagua

SEQ ID NO: 649751 - RNA, 19 nt, Homo sapiens
caacagcaaaccaacauuu

SEQ ID NO: 649752 - RNA, 19 nt, Homo sapiens
gaaagaggccuugccauca

SEQ ID NO: 649753 - RNA, 19 nt, Homo sapiens
ugacauaagcucuacauug

SEQ ID NO: 649754 - RNA, 19 nt, Homo sapiens
caaguucccuucuccuuuc

SEQ ID NO: 649755 - RNA, 19 nt, Homo sapiens
caaauuaaaggccgagaaa

SEQ ID NO: 649756 - RNA, 19 nt, Homo sapiens
gcaaugacaaugagaacaa

SEQ ID NO: 649757 - RNA, 19 nt, Homo sapiens
gcaaguucccuucuccuuu

SEQ ID NO: 649758 - RNA, 19 nt, Homo sapiens
gagaaacgaugggucugaa

SEQ ID NO: 649759 - RNA, 19 nt, Homo sapiens
acacagcuaucaagugcua

SEQ ID NO: 649760 - RNA, 19 nt, Homo sapiens
ugacacaauuguugcuaaa

SEQ ID NO: 649761 - RNA, 19 nt, Homo sapiens
gcauuugacuacuuuaucu

SEQ ID NO: 649762 - RNA, 19 nt, Homo sapiens
cugugaagauugccuaaua

SEQ ID NO: 649763 - RNA, 19 nt, Homo sapiens
guaugaugauuguugguaa

SEQ ID NO: 649764 - RNA, 19 nt, Homo sapiens
gcacaacuuugacauaagc

SEQ ID NO: 649765 - RNA, 19 nt, Homo sapiens
gauagugucugcacaacag

SEQ ID NO: 649766 - RNA, 19 nt, Homo sapiens
gguaaacaccaaagaaguu

SEQ ID NO: 649767 - RNA, 19 nt, Homo sapiens
uauuggaauucgagacuua

SEQ ID NO: 649768 - RNA, 19 nt, Homo sapiens
aaagaggccuugccaucaa

SEQ ID NO: 649769 - RNA, 19 nt, Homo sapiens
gugucuacaucuaguguua

SEQ ID NO: 649770 - RNA, 19 nt, Homo sapiens
gagacucaggccagaauua

SEQ ID NO: 649771 - RNA, 19 nt, Homo sapiens
ggaggaaacacagaauaaa

SEQ ID NO: 649772 - RNA, 19 nt, Homo sapiens
gcacugcuucuguuugaaa

SEQ ID NO: 649773 - RNA, 19 nt, Homo sapiens
uuauugcgaucacugguua

SEQ ID NO: 649774 - RNA, 19 nt, Homo sapiens
aaacagagccaacaacagu

SEQ ID NO: 649775 - RNA, 19 nt, Homo sapiens
uaagugugcuguugcuaug

SEQ ID NO: 649776 - RNA, 19 nt, Homo sapiens
gcagggcauuugacuacuu

SEQ ID NO: 649777 - RNA, 19 nt, Homo sapiens
gagaagaacaccaggaaag

SEQ ID NO: 649778 - RNA, 19 nt, Homo sapiens
ccaggugugucuacaucua

SEQ ID NO: 649779 - RNA, 19 nt, Homo sapiens
gcucgcagacugugcuaua

SEQ ID NO: 649780 - RNA, 19 nt, Homo sapiens
uauagucauugauggagua

SEQ ID NO: 649781 - RNA, 19 nt, Homo sapiens
gaagaauggcccaaguuuc

SEQ ID NO: 649782 - RNA, 19 nt, Homo sapiens
ggacuggcagaggaaauua

SEQ ID NO: 649783 - RNA, 19 nt, Homo sapiens
ucauggcucuuaauaaaca

SEQ ID NO: 649784 - RNA, 19 nt, Homo sapiens
aauuagcuguugugagaua

SEQ ID NO: 649785 - RNA, 19 nt, Homo sapiens
gaagacuuauuaacaacag

SEQ ID NO: 649786 - RNA, 19 nt, Homo sapiens
cuacaucuaguguuacuuu

SEQ ID NO: 649787 - RNA, 19 nt, Homo sapiens
gauuucagcacaacuuuga

SEQ ID NO: 649788 - RNA, 19 nt, Homo sapiens
uaaugaagcuuugcaucga

SEQ ID NO: 649789 - RNA, 19 nt, Homo sapiens
uggaguagaucaugaugga

SEQ ID NO: 649790 - RNA, 19 nt, Homo sapiens
acacaauuguugcuaaauc

SEQ ID NO: 649791 - RNA, 19 nt, Homo sapiens
gaauggcaaugacaaugag

SEQ ID NO: 649792 - RNA, 19 nt, Homo sapiens
cuaguaaggcucaguaaga

SEQ ID NO: 649793 - RNA, 19 nt, Homo sapiens
cacuggagaucaaauaugu

SEQ ID NO: 649794 - RNA, 19 nt, Homo sapiens
cacaauuguugcuaaauca

SEQ ID NO: 649795 - RNA, 19 nt, Homo sapiens
ugaaacagauaaaggaacu

SEQ ID NO: 649796 - RNA, 19 nt, Homo sapiens
ggcaagaaaccuauuggaa

SEQ ID NO: 649797 - RNA, 19 nt, Homo sapiens
caauaguacuugaaugaac

SEQ ID NO: 649798 - RNA, 19 nt, Homo sapiens
aacauuuggugaggaauua

SEQ ID NO: 649799 - RNA, 19 nt, Homo sapiens
caacauuuggugaggaauu

SEQ ID NO: 649800 - RNA, 19 nt, Homo sapiens
cagggcauuugacuacuuu

SEQ ID NO: 649801 - RNA, 19 nt, Homo sapiens
gggcaacauuuuaaaguuu

SEQ ID NO: 649802 - RNA, 19 nt, Homo sapiens
aaagaagaauggcccaagu

SEQ ID NO: 649803 - RNA, 19 nt, Homo sapiens
ucgcauugcugaaacacaa

SEQ ID NO: 649804 - RNA, 19 nt, Homo sapiens
ggagaagaacaccaggaaa

SEQ ID NO: 649805 - RNA, 19 nt, Homo sapiens
ccauaauguuucauguuug

SEQ ID NO: 649806 - RNA, 19 nt, Homo sapiens
gcaaauuaaaggccgagaa

SEQ ID NO: 649807 - RNA, 19 nt, Homo sapiens
aagaauggcccaaguuuca

SEQ ID NO: 649808 - RNA, 19 nt, Homo sapiens
gaggggagcucugugaaaa

SEQ ID NO: 649809 - RNA, 19 nt, Homo sapiens
gaaaucacuggagaucaaa

SEQ ID NO: 649810 - RNA, 19 nt, Homo sapiens
ugcgaucacugguuaagaa

SEQ ID NO: 649811 - RNA, 19 nt, Homo sapiens
gcacaacagcaaaccaaca

SEQ ID NO: 649812 - RNA, 19 nt, Homo sapiens
gaaacgaugggucugaagu

SEQ ID NO: 649813 - RNA, 19 nt, Homo sapiens
agaagaauggcccaaguuu

SEQ ID NO: 649814 - RNA, 19 nt, Homo sapiens
uagcuguugugagauauuu

SEQ ID NO: 649815 - RNA, 19 nt, Homo sapiens
gcagaggaaauuaauugau

SEQ ID NO: 649816 - RNA, 19 nt, Homo sapiens
gaacaccaggaaagacaga

SEQ ID NO: 649817 - RNA, 19 nt, Homo sapiens
acaaugagaacaacaggaa

SEQ ID NO: 649818 - RNA, 19 nt, Homo sapiens
cgaugggucugaaguccaa

SEQ ID NO: 649819 - RNA, 19 nt, Homo sapiens
uggcagaggaaauuaauug

SEQ ID NO: 649820 - RNA, 19 nt, Homo sapiens
gguaugaugauuguuggua

SEQ ID NO: 649821 - RNA, 19 nt, Homo sapiens
uggaggaaacacagaauaa

SEQ ID NO: 649822 - RNA, 19 nt, Homo sapiens
ugauucugcccaauuauuu

SEQ ID NO: 649823 - RNA, 19 nt, Homo sapiens
ccaaagugaaacagauaaa

SEQ ID NO: 649824 - RNA, 19 nt, Homo sapiens
uggaauacugccauuuaua

SEQ ID NO: 649825 - RNA, 19 nt, Homo sapiens
gcugaaacacaacagaaga

SEQ ID NO: 649826 - RNA, 19 nt, Homo sapiens
gagaacaacaggaaaugag

SEQ ID NO: 649827 - RNA, 19 nt, Homo sapiens
gaugguuccuuucauauua

SEQ ID NO: 649828 - RNA, 19 nt, Homo sapiens
caagaaaccuauuggaauu

SEQ ID NO: 649829 - RNA, 19 nt, Homo sapiens
gaagauugccuaauacuuu

SEQ ID NO: 649830 - RNA, 19 nt, Homo sapiens
gaauuaagauccugcagaa

SEQ ID NO: 649831 - RNA, 19 nt, Homo sapiens
ggaaaucacuggagaucaa

SEQ ID NO: 649832 - RNA, 19 nt, Homo sapiens
uuaaguagcucuuugguaa

SEQ ID NO: 649833 - RNA, 19 nt, Homo sapiens
ggucaagagugaucaagua

SEQ ID NO: 649834 - RNA, 19 nt, Homo sapiens
uuaauuagcuguugugaga

SEQ ID NO: 649835 - RNA, 19 nt, Homo sapiens
gaaggaagacuuauuaaca

SEQ ID NO: 649836 - RNA, 19 nt, Homo sapiens
guaagaggcugguggagaa

SEQ ID NO: 649837 - RNA, 19 nt, Homo sapiens
cgaugacgcugaacuagua

SEQ ID NO: 649838 - RNA, 19 nt, Homo sapiens
gaacaauaguacuugaaug

SEQ ID NO: 649839 - RNA, 19 nt, Homo sapiens
gaacaaaucauucacaaac

SEQ ID NO: 649840 - RNA, 19 nt, Homo sapiens
gcuaucaagugcuaaguuu

SEQ ID NO: 649841 - RNA, 19 nt, Homo sapiens
cgaagcagcugaucagaau

SEQ ID NO: 649842 - RNA, 19 nt, Homo sapiens
gaaguaaacauugguauug

SEQ ID NO: 649843 - RNA, 19 nt, Homo sapiens
ccaaagcaauggucaguga

SEQ ID NO: 649844 - RNA, 19 nt, Homo sapiens
cagcacaacuuugacauaa

SEQ ID NO: 649845 - RNA, 19 nt, Homo sapiens
ggucugaaguccaaaguga

SEQ ID NO: 649846 - RNA, 19 nt, Homo sapiens
ucacagauuuggagaagaa

SEQ ID NO: 649847 - RNA, 19 nt, Homo sapiens
ggaauacugccauuuauau

SEQ ID NO: 649848 - RNA, 19 nt, Homo sapiens
gaagagaagucaagaaaau

SEQ ID NO: 649849 - RNA, 19 nt, Homo sapiens
gcaagaaaccuauuggaau

SEQ ID NO: 649850 - RNA, 19 nt, Homo sapiens
ggagagagcagaaguuuua

SEQ ID NO: 649851 - RNA, 19 nt, Homo sapiens
gaagaugaaguaaacauug

SEQ ID NO: 649852 - RNA, 19 nt, Homo sapiens
gacauaagcucuacauugc

SEQ ID NO: 649853 - RNA, 19 nt, Homo sapiens
ccaguuuacucauggauuu

SEQ ID NO: 649854 - RNA, 19 nt, Homo sapiens
gaacuuguuugcacugcuu

SEQ ID NO: 649855 - RNA, 19 nt, Homo sapiens
gaucacugguuaagaaugu

SEQ ID NO: 649856 - RNA, 19 nt, Homo sapiens
caacaguaauucagcaaau

SEQ ID NO: 649857 - RNA, 19 nt, Homo sapiens
cagaggaaauuaauugaug

SEQ ID NO: 649858 - RNA, 19 nt, Homo sapiens
gaacuaguaaggcucagua

SEQ ID NO: 649859 - RNA, 19 nt, Homo sapiens
ggucagugaugguuccuuu

SEQ ID NO: 649860 - RNA, 19 nt, Homo sapiens
caacagcaaaccaacauuu

SEQ ID NO: 649861 - RNA, 19 nt, Homo sapiens
caagagugaucaaguaaag

SEQ ID NO: 649862 - RNA, 19 nt, Homo sapiens
gaaagaggccuugccauca

SEQ ID NO: 649863 - RNA, 19 nt, Homo sapiens
ugacauaagcucuacauug

SEQ ID NO: 649864 - RNA, 19 nt, Homo sapiens
gcaauaauacaacaagaug

SEQ ID NO: 649865 - RNA, 19 nt, Homo sapiens
caaauuaaaggccgagaaa

SEQ ID NO: 649866 - RNA, 19 nt, Homo sapiens
gcagaaggagaucauguaa

SEQ ID NO: 649867 - RNA, 19 nt, Homo sapiens
gcaaugacaaugagaacaa

SEQ ID NO: 649868 - RNA, 19 nt, Homo sapiens
gagaaacgaugggucugaa

SEQ ID NO: 649869 - RNA, 19 nt, Homo sapiens
acacagcuaucaagugcua

SEQ ID NO: 649870 - RNA, 19 nt, Homo sapiens
ugacacaauuguugcuaaa

SEQ ID NO: 649871 - RNA, 19 nt, Homo sapiens
gcauuugacuacuuuaucu

SEQ ID NO: 649872 - RNA, 19 nt, Homo sapiens
cugugaagauugccuaaua

SEQ ID NO: 649873 - RNA, 19 nt, Homo sapiens
agaaggagaucauguaaac

SEQ ID NO: 649874 - RNA, 19 nt, Homo sapiens
guaugaugauuguugguaa

SEQ ID NO: 649875 - RNA, 19 nt, Homo sapiens
gcacaacuuugacauaagc

SEQ ID NO: 649876 - RNA, 19 nt, Homo sapiens
gauagugucugcacaacag

SEQ ID NO: 649877 - RNA, 19 nt, Homo sapiens
gguaaacaccaaagaaguu

SEQ ID NO: 649878 - RNA, 19 nt, Homo sapiens
uauuggaauucgagacuua

SEQ ID NO: 649879 - RNA, 19 nt, Homo sapiens
aaagaggccuugccaucaa

SEQ ID NO: 649880 - RNA, 19 nt, Homo sapiens
gugucuacaucuaguguua

SEQ ID NO: 649881 - RNA, 19 nt, Homo sapiens
gagacucaggccagaauua

SEQ ID NO: 649882 - RNA, 19 nt, Homo sapiens
ggaggaaacacagaauaaa

SEQ ID NO: 649883 - RNA, 19 nt, Homo sapiens
gcauagaucuuugcuccau

SEQ ID NO: 649884 - RNA, 19 nt, Homo sapiens
guuuaucagucacagauuu

SEQ ID NO: 649885 - RNA, 19 nt, Homo sapiens
gcacugcuucuguuugaaa

SEQ ID NO: 649886 - RNA, 19 nt, Homo sapiens
uuauugcgaucacugguua

SEQ ID NO: 649887 - RNA, 19 nt, Homo sapiens
aaacagagccaacaacagu

SEQ ID NO: 649888 - RNA, 19 nt, Homo sapiens
uaagugugcuguugcuaug

SEQ ID NO: 649889 - RNA, 19 nt, Homo sapiens
gcagggcauuugacuacuu

SEQ ID NO: 649890 - RNA, 19 nt, Homo sapiens
gaauuugaagccaauacua

SEQ ID NO: 649891 - RNA, 19 nt, Homo sapiens
gaucauguaaacucacuuu

SEQ ID NO: 649892 - RNA, 19 nt, Homo sapiens
ccaggugugucuacaucua

SEQ ID NO: 649893 - RNA, 19 nt, Homo sapiens
uauagucauugauggagua

SEQ ID NO: 649894 - RNA, 19 nt, Homo sapiens
gaaaaugaaugggucaaga

SEQ ID NO: 649895 - RNA, 19 nt, Homo sapiens
ccaauacuauggauucucu

SEQ ID NO: 649896 - RNA, 19 nt, Homo sapiens
gaagaauggcccaaguuuc

SEQ ID NO: 649897 - RNA, 19 nt, Homo sapiens
ggacuggcagaggaaauua

SEQ ID NO: 649898 - RNA, 19 nt, Homo sapiens
gcagaaugcaauaauacaa

SEQ ID NO: 649899 - RNA, 19 nt, Homo sapiens
ucauggcucuuaauaaaca

SEQ ID NO: 649900 - RNA, 19 nt, Homo sapiens
aauuagcuguugugagaua

SEQ ID NO: 649901 - RNA, 19 nt, Homo sapiens
gaagacuuauuaacaacag

SEQ ID NO: 649902 - RNA, 19 nt, Homo sapiens
cuacaucuaguguuacuuu

SEQ ID NO: 649903 - RNA, 19 nt, Homo sapiens
caggaugacuguggaauca

SEQ ID NO: 649904 - RNA, 19 nt, Homo sapiens
gauuucagcacaacuuuga

SEQ ID NO: 649905 - RNA, 19 nt, Homo sapiens
uaaugaagcuuugcaucga

SEQ ID NO: 649906 - RNA, 19 nt, Homo sapiens
guagacaugccauuugcua

SEQ ID NO: 649907 - RNA, 19 nt, Homo sapiens
agugaugguuccuuucaua

SEQ ID NO: 649908 - RNA, 19 nt, Homo sapiens
uggaguagaucaugaugga

SEQ ID NO: 649909 - RNA, 19 nt, Homo sapiens
acacaauuguugcuaaauc

SEQ ID NO: 649910 - RNA, 19 nt, Homo sapiens
gaauggcaaugacaaugag

SEQ ID NO: 649911 - RNA, 19 nt, Homo sapiens
cuaguaaggcucaguaaga

SEQ ID NO: 649912 - RNA, 19 nt, Homo sapiens
gaaaccauucauagaagaa

SEQ ID NO: 649913 - RNA, 19 nt, Homo sapiens
cacuggagaucaaauaugu

SEQ ID NO: 649914 - RNA, 19 nt, Homo sapiens
cacaauuguugcuaaauca

SEQ ID NO: 649915 - RNA, 19 nt, Homo sapiens
ugaaacagauaaaggaacu

SEQ ID NO: 649916 - RNA, 19 nt, Homo sapiens
ggcaagaaaccuauuggaa

SEQ ID NO: 649917 - RNA, 19 nt, Homo sapiens
caauaguacuugaaugaac

SEQ ID NO: 649918 - RNA, 19 nt, Homo sapiens
aacauuuggugaggaauua

SEQ ID NO: 649919 - RNA, 19 nt, Homo sapiens
caacauuuggugaggaauu

SEQ ID NO: 649920 - RNA, 19 nt, Homo sapiens
cagggcauuugacuacuuu

SEQ ID NO: 649921 - RNA, 19 nt, Homo sapiens
uacuauggauucucuggua

SEQ ID NO: 649922 - RNA, 19 nt, Homo sapiens
gcuggugaugcaauuauua

SEQ ID NO: 649923 - RNA, 19 nt, Homo sapiens
cugaugaaccucaaauaaa

SEQ ID NO: 649924 - RNA, 19 nt, Homo sapiens
gggcaacauuuuaaaguuu

SEQ ID NO: 649925 - RNA, 19 nt, Homo sapiens
aaagaagaauggcccaagu

SEQ ID NO: 649926 - RNA, 19 nt, Homo sapiens
ucgcauugcugaaacacaa

SEQ ID NO: 649927 - RNA, 19 nt, Homo sapiens
caagaaaccuauuggaauu

SEQ ID NO: 649928 - RNA, 19 nt, Homo sapiens
gaagauugccuaauacuuu

SEQ ID NO: 649929 - RNA, 19 nt, Homo sapiens
ggaaaucacuggagaucaa

SEQ ID NO: 649930 - RNA, 19 nt, Homo sapiens
uuaaguagcucuuugguaa

SEQ ID NO: 649931 - RNA, 19 nt, Homo sapiens
uuaauuagcuguugugaga

SEQ ID NO: 649932 - RNA, 19 nt, Homo sapiens
gaaggaagacuuauuaaca

SEQ ID NO: 649933 - RNA, 19 nt, Homo sapiens
guaagaggcugguggagaa

SEQ ID NO: 649934 - RNA, 19 nt, Homo sapiens
gcaaggauauacccaguug

SEQ ID NO: 649935 - RNA, 19 nt, Homo sapiens
cgaugacgcugaacuagua

SEQ ID NO: 649936 - RNA, 19 nt, Homo sapiens
gaacaauaguacuugaaug

SEQ ID NO: 649937 - RNA, 19 nt, Homo sapiens
gaacaaaucauucacaaac

SEQ ID NO: 649938 - RNA, 19 nt, Homo sapiens
gcuaucaagugcuaaguuu

SEQ ID NO: 649939 - RNA, 19 nt, Homo sapiens
cgaagcagcugaucagaau

SEQ ID NO: 649940 - RNA, 19 nt, Homo sapiens
cagcacaacuuugacauaa

SEQ ID NO: 649941 - RNA, 19 nt, Homo sapiens
ggucugaaguccaaaguga

SEQ ID NO: 649942 - RNA, 19 nt, Homo sapiens
ggaauacugccauuuauau

SEQ ID NO: 649943 - RNA, 19 nt, Homo sapiens
gcuauaaacugcaauuucu

SEQ ID NO: 649944 - RNA, 19 nt, Homo sapiens
gcaagaaaccuauuggaau

SEQ ID NO: 649945 - RNA, 19 nt, Homo sapiens
gacauaagcucuacauugc

SEQ ID NO: 649946 - RNA, 19 nt, Homo sapiens
ccaguuuacucauggauuu

SEQ ID NO: 649947 - RNA, 19 nt, Homo sapiens
gaacuuguuugcacugcuu

SEQ ID NO: 649948 - RNA, 19 nt, Homo sapiens
gaucacugguuaagaaugu

SEQ ID NO: 649949 - RNA, 19 nt, Homo sapiens
caacaguaauucagcaaau

SEQ ID NO: 649950 - RNA, 19 nt, Homo sapiens
cagaggaaauuaauugaug

SEQ ID NO: 649951 - RNA, 19 nt, Homo sapiens
gaacuaguaaggcucagua

SEQ ID NO: 649952 - RNA, 19 nt, Homo sapiens
caacagcaaaccaacauuu

SEQ ID NO: 649953 - RNA, 19 nt, Homo sapiens
gaaagaggccuugccauca

SEQ ID NO: 649954 - RNA, 19 nt, Homo sapiens
ugacauaagcucuacauug

SEQ ID NO: 649955 - RNA, 19 nt, Homo sapiens
caaguucccuucuccuuuc

SEQ ID NO: 649956 - RNA, 19 nt, Homo sapiens
caaauuaaaggccgagaaa

SEQ ID NO: 649957 - RNA, 19 nt, Homo sapiens
gcaaugacaaugagaacaa

SEQ ID NO: 649958 - RNA, 19 nt, Homo sapiens
gcaaguucccuucuccuuu

SEQ ID NO: 649959 - RNA, 19 nt, Homo sapiens
gagaaacgaugggucugaa

SEQ ID NO: 649960 - RNA, 19 nt, Homo sapiens
acacagcuaucaagugcua

SEQ ID NO: 649961 - RNA, 19 nt, Homo sapiens
ugacacaauuguugcuaaa

SEQ ID NO: 649962 - RNA, 19 nt, Homo sapiens
gcauuugacuacuuuaucu

SEQ ID NO: 649963 - RNA, 19 nt, Homo sapiens
cugugaagauugccuaaua

SEQ ID NO: 649964 - RNA, 19 nt, Homo sapiens
guaugaugauuguugguaa

SEQ ID NO: 649965 - RNA, 19 nt, Homo sapiens
gcacaacuuugacauaagc

SEQ ID NO: 649966 - RNA, 19 nt, Homo sapiens
gauagugucugcacaacag

SEQ ID NO: 649967 - RNA, 19 nt, Homo sapiens
gguaaacaccaaagaaguu

SEQ ID NO: 649968 - RNA, 19 nt, Homo sapiens
uauuggaauucgagacuua

SEQ ID NO: 649969 - RNA, 19 nt, Homo sapiens
aaagaggccuugccaucaa

SEQ ID NO: 649970 - RNA, 19 nt, Homo sapiens
gugucuacaucuaguguua

SEQ ID NO: 649971 - RNA, 19 nt, Homo sapiens
gagacucaggccagaauua

SEQ ID NO: 649972 - RNA, 19 nt, Homo sapiens
ggaggaaacacagaauaaa

SEQ ID NO: 649973 - RNA, 19 nt, Homo sapiens
gcacugcuucuguuugaaa

SEQ ID NO: 649974 - RNA, 19 nt, Homo sapiens
uuauugcgaucacugguua

SEQ ID NO: 649975 - RNA, 19 nt, Homo sapiens
aaacagagccaacaacagu

SEQ ID NO: 649976 - RNA, 19 nt, Homo sapiens
uaagugugcuguugcuaug

SEQ ID NO: 649977 - RNA, 19 nt, Homo sapiens
gcagggcauuugacuacuu

SEQ ID NO: 649978 - RNA, 19 nt, Homo sapiens
gagaagaacaccaggaaag

SEQ ID NO: 649979 - RNA, 19 nt, Homo sapiens
ccaggugugucuacaucua

SEQ ID NO: 649980 - RNA, 19 nt, Homo sapiens
uauagucauugauggagua

SEQ ID NO: 649981 - RNA, 19 nt, Homo sapiens
gcucgcagacugugcuaua

SEQ ID NO: 649982 - RNA, 19 nt, Homo sapiens
gaagaauggcccaaguuuc

SEQ ID NO: 649983 - RNA, 19 nt, Homo sapiens
ggacuggcagaggaaauua

SEQ ID NO: 649984 - RNA, 19 nt, Homo sapiens
ucauggcucuuaauaaaca

SEQ ID NO: 649985 - RNA, 19 nt, Homo sapiens
aauuagcuguugugagaua

SEQ ID NO: 649986 - RNA, 19 nt, Homo sapiens
gaagacuuauuaacaacag

SEQ ID NO: 649987 - RNA, 19 nt, Homo sapiens
cuacaucuaguguuacuuu

SEQ ID NO: 649988 - RNA, 19 nt, Homo sapiens
gauuucagcacaacuuuga

SEQ ID NO: 649989 - RNA, 19 nt, Homo sapiens
uaaugaagcuuugcaucga

SEQ ID NO: 649990 - RNA, 19 nt, Homo sapiens
uggaguagaucaugaugga

SEQ ID NO: 649991 - RNA, 19 nt, Homo sapiens
acacaauuguugcuaaauc

SEQ ID NO: 649992 - RNA, 19 nt, Homo sapiens
gaauggcaaugacaaugag

SEQ ID NO: 649993 - RNA, 19 nt, Homo sapiens
cuaguaaggcucaguaaga

SEQ ID NO: 649994 - RNA, 19 nt, Homo sapiens
cacuggagaucaaauaugu

SEQ ID NO: 649995 - RNA, 19 nt, Homo sapiens
cacaauuguugcuaaauca

SEQ ID NO: 649996 - RNA, 19 nt, Homo sapiens
ugaaacagauaaaggaacu

SEQ ID NO: 649997 - RNA, 19 nt, Homo sapiens
ggcaagaaaccuauuggaa

SEQ ID NO: 649998 - RNA, 19 nt, Homo sapiens
caauaguacuugaaugaac

SEQ ID NO: 649999 - RNA, 19 nt, Homo sapiens
aacauuuggugaggaauua

SEQ ID NO: 650000 - RNA, 19 nt, Homo sapiens
caacauuuggugaggaauu

SEQ ID NO: 650001 - RNA, 19 nt, Homo sapiens
cagggcauuugacuacuuu

SEQ ID NO: 650002 - RNA, 19 nt, Homo sapiens
gggcaacauuuuaaaguuu

SEQ ID NO: 650003 - RNA, 19 nt, Homo sapiens
aaagaagaauggcccaagu

SEQ ID NO: 650004 - RNA, 19 nt, Homo sapiens
ucgcauugcugaaacacaa

SEQ ID NO: 650005 - RNA, 19 nt, Homo sapiens
ggagaagaacaccaggaaa

SEQ ID NO: 650006 - RNA, 19 nt, Homo sapiens
ccauaauguuucauguuug

SEQ ID NO: 650007 - RNA, 19 nt, Homo sapiens
gcaaauuaaaggccgagaa

SEQ ID NO: 650008 - RNA, 19 nt, Homo sapiens
aagaauggcccaaguuuca

SEQ ID NO: 650009 - RNA, 19 nt, Homo sapiens
gaggggagcucugugaaaa

SEQ ID NO: 650010 - RNA, 19 nt, Homo sapiens
gaaaucacuggagaucaaa

SEQ ID NO: 650011 - RNA, 19 nt, Homo sapiens
ugcgaucacugguuaagaa

SEQ ID NO: 650012 - RNA, 19 nt, Homo sapiens
gcacaacagcaaaccaaca

SEQ ID NO: 650013 - RNA, 19 nt, Homo sapiens
gaaacgaugggucugaagu

SEQ ID NO: 650014 - RNA, 19 nt, Homo sapiens
agaagaauggcccaaguuu

SEQ ID NO: 650015 - RNA, 19 nt, Homo sapiens
cugcaguccuacagagaua

SEQ ID NO: 650016 - RNA, 19 nt, Homo sapiens
uagcuguugugagauauuu

SEQ ID NO: 650017 - RNA, 19 nt, Homo sapiens
gaacaccaggaaagacaga

SEQ ID NO: 650018 - RNA, 19 nt, Homo sapiens
gcagaggaaauuaauugau

SEQ ID NO: 650019 - RNA, 19 nt, Homo sapiens
acaaugagaacaacaggaa

SEQ ID NO: 650020 - RNA, 19 nt, Homo sapiens
cgaugggucugaaguccaa

SEQ ID NO: 650021 - RNA, 19 nt, Homo sapiens
gagauacagcaaggauaua

SEQ ID NO: 650022 - RNA, 19 nt, Homo sapiens
uggcagaggaaauuaauug

SEQ ID NO: 650023 - RNA, 19 nt, Homo sapiens
gguaugaugauuguuggua

SEQ ID NO: 650024 - RNA, 19 nt, Homo sapiens
ugauucugcccaauuauuu

SEQ ID NO: 650025 - RNA, 19 nt, Homo sapiens
ccaaagugaaacagauaaa

SEQ ID NO: 650026 - RNA, 19 nt, Homo sapiens
uggaauacugccauuuaua

SEQ ID NO: 650027 - RNA, 19 nt, Homo sapiens
gaaccucagugcucuguua

SEQ ID NO: 650028 - RNA, 19 nt, Homo sapiens
uaacagaacugaauuugga

SEQ ID NO: 650029 - RNA, 19 nt, Homo sapiens
gaacauaacacaugccuau

SEQ ID NO: 650030 - RNA, 19 nt, Homo sapiens
gaaccugaaucccugaaug

SEQ ID NO: 650031 - RNA, 19 nt, Homo sapiens
ggagagcucugggcacauu

SEQ ID NO: 650032 - RNA, 19 nt, Homo sapiens
ggauagaaccacuaagaaa

SEQ ID NO: 650033 - RNA, 19 nt, Homo sapiens
ggacugaguucuugacaac

SEQ ID NO: 650034 - RNA, 19 nt, Homo sapiens
cuacauggccaucucauaa

SEQ ID NO: 650035 - RNA, 19 nt, Homo sapiens
gggaacagcucaccauguc

SEQ ID NO: 650036 - RNA, 19 nt, Homo sapiens
cugaaugacugcauggaua

SEQ ID NO: 650037 - RNA, 19 nt, Homo sapiens
guaacagaaugagaccuua

SEQ ID NO: 650038 - RNA, 19 nt, Homo sapiens
gaagguggagcaagaaaug

SEQ ID NO: 650039 - RNA, 19 nt, Homo sapiens
gauggaagguggagcaaag

SEQ ID NO: 650040 - RNA, 19 nt, Homo sapiens
gaaccuagaaacccaaaug

SEQ ID NO: 650041 - RNA, 19 nt, Homo sapiens
gaggaaccuuugcuucuau

SEQ ID NO: 650042 - RNA, 19 nt, Homo sapiens
ggagaaagaagaggauuug

SEQ ID NO: 650043 - RNA, 19 nt, Homo sapiens
gauuagcccucuugaugga

SEQ ID NO: 650044 - RNA, 19 nt, Homo sapiens
aaaguaccguuccaacaaa

SEQ ID NO: 650045 - RNA, 19 nt, Homo sapiens
gaagguggagcaaaggaaa

SEQ ID NO: 650046 - RNA, 19 nt, Homo sapiens
gggaaccacuggagcaugu

SEQ ID NO: 650047 - RNA, 19 nt, Homo sapiens
uucccaaacuccaauaaua

SEQ ID NO: 650048 - RNA, 19 nt, Homo sapiens
gaagugacauaugccaaca

SEQ ID NO: 650049 - RNA, 19 nt, Homo sapiens
acaauuagcugggcaugau

SEQ ID NO: 650050 - RNA, 19 nt, Homo sapiens
gcagggaccucugauugca

SEQ ID NO: 650051 - RNA, 19 nt, Homo sapiens
caaaaucuguuccgcugua

SEQ ID NO: 650052 - RNA, 19 nt, Homo sapiens
ggacuugcccauccuggaa

SEQ ID NO: 650053 - RNA, 19 nt, Homo sapiens
ggagaaaguuccugauccu

SEQ ID NO: 650054 - RNA, 19 nt, Homo sapiens
agaggaaccuuugcuucua

SEQ ID NO: 650055 - RNA, 19 nt, Homo sapiens
aaacccaaaugaagccaaa

SEQ ID NO: 650056 - RNA, 19 nt, Homo sapiens
gcagagagugugugugugu

SEQ ID NO: 650057 - RNA, 19 nt, Homo sapiens
ugauccagcuuuggucaua

SEQ ID NO: 650058 - RNA, 19 nt, Homo sapiens
gaaggaucacuuagagcua

SEQ ID NO: 650059 - RNA, 19 nt, Homo sapiens
cuguugagauccaagauuu

SEQ ID NO: 650060 - RNA, 19 nt, Homo sapiens
caucucagcucccuugcau

SEQ ID NO: 650061 - RNA, 19 nt, Homo sapiens
aggcagagcugggauugaa

SEQ ID NO: 650062 - RNA, 19 nt, Homo sapiens
caggugagcuacaaagucu

SEQ ID NO: 650063 - RNA, 19 nt, Homo sapiens
ggaggccacuguccauugg

SEQ ID NO: 650064 - RNA, 19 nt, Homo sapiens
ucacuuagagcuaggaguu

SEQ ID NO: 650065 - RNA, 19 nt, Homo sapiens
gagaggaaccuuugcuucu

SEQ ID NO: 650066 - RNA, 19 nt, Homo sapiens
gcauggauagaaccacuaa

SEQ ID NO: 650067 - RNA, 19 nt, Homo sapiens
caagaccccucacuacaaa

SEQ ID NO: 650068 - RNA, 19 nt, Homo sapiens
cagagaggcugagucacuu

SEQ ID NO: 650069 - RNA, 19 nt, Homo sapiens
uggauuagcccucuugaug

SEQ ID NO: 650070 - RNA, 19 nt, Homo sapiens
guggaaggaucacuuagag

SEQ ID NO: 650071 - RNA, 19 nt, Homo sapiens
gcugggagccucucaccaa

SEQ ID NO: 650072 - RNA, 19 nt, Homo sapiens
gauagaaccacuaagaaaa

SEQ ID NO: 650073 - RNA, 19 nt, Homo sapiens
ucccaaacuccaauaauaa

SEQ ID NO: 650074 - RNA, 19 nt, Homo sapiens
ggaauuagcaccccuagug

SEQ ID NO: 650075 - RNA, 19 nt, Homo sapiens
gguaacagaaugagaccuu

SEQ ID NO: 650076 - RNA, 19 nt, Homo sapiens
ggaagguggagcaaaggaa

SEQ ID NO: 650077 - RNA, 19 nt, Homo sapiens
aaccuuugcuucuauggaa

SEQ ID NO: 650078 - RNA, 19 nt, Homo sapiens
agaauguggucagaaguga

SEQ ID NO: 650079 - RNA, 19 nt, Homo sapiens
ggaagguggagcaagaaau

SEQ ID NO: 650080 - RNA, 19 nt, Homo sapiens
caacagaauguggucagaa

SEQ ID NO: 650081 - RNA, 19 nt, Homo sapiens
cagcauggacugaguucuu

SEQ ID NO: 650082 - RNA, 19 nt, Homo sapiens
gguggaaggaucacuuaga

SEQ ID NO: 650083 - RNA, 19 nt, Homo sapiens
cuagagggaugcucaugca

SEQ ID NO: 650084 - RNA, 19 nt, Homo sapiens
gagcugaguccagaaggaa

SEQ ID NO: 650085 - RNA, 19 nt, Homo sapiens
gaaccuuugcuucuaugga

SEQ ID NO: 650086 - RNA, 19 nt, Homo sapiens
gcugccggauggagaaaga

SEQ ID NO: 650087 - RNA, 19 nt, Homo sapiens
uaacagaaugagaccuuau

SEQ ID NO: 650088 - RNA, 19 nt, Homo sapiens
gaaggaccccuauagagaa

SEQ ID NO: 650089 - RNA, 19 nt, Homo sapiens
gcaggugagcuacaaaguc

SEQ ID NO: 650090 - RNA, 19 nt, Homo sapiens
cccaaacuccaauaauaaa

SEQ ID NO: 650091 - RNA, 19 nt, Homo sapiens
gagugugugugugugugua

SEQ ID NO: 650092 - RNA, 19 nt, Homo sapiens
aaccggagcugaagaccau

SEQ ID NO: 650093 - RNA, 19 nt, Homo sapiens
ccuagaaacccaaaugaag

SEQ ID NO: 650094 - RNA, 19 nt, Homo sapiens
gcucugggcacauucgaau

SEQ ID NO: 650095 - RNA, 19 nt, Homo sapiens
gcagugcuacggaguugga

SEQ ID NO: 650096 - RNA, 19 nt, Homo sapiens
agaaagaagaggauuugug

SEQ ID NO: 650097 - RNA, 19 nt, Homo sapiens
ccuguaaucccagcacuuu

SEQ ID NO: 650098 - RNA, 19 nt, Homo sapiens
acccugagguggaaaguuc

SEQ ID NO: 650099 - RNA, 19 nt, Homo sapiens
gcaagaccccucacuacaa

SEQ ID NO: 650100 - RNA, 19 nt, Homo sapiens
caagguggaaggaucacuu

SEQ ID NO: 650101 - RNA, 19 nt, Homo sapiens
gcugaguccagaaggaauu

SEQ ID NO: 650102 - RNA, 19 nt, Homo sapiens
gcauuugggcaccaucuca

SEQ ID NO: 650103 - RNA, 19 nt, Homo sapiens
ugagcugaguccagaagga

SEQ ID NO: 650104 - RNA, 19 nt, Homo sapiens
ccaccuacauggccaucuc

SEQ ID NO: 650105 - RNA, 19 nt, Homo sapiens
gggaagguggagcaagaaa

SEQ ID NO: 650106 - RNA, 19 nt, Homo sapiens
auucgaaucuucccaaacu

SEQ ID NO: 650107 - RNA, 19 nt, Homo sapiens
gguggagcaagaaaugaaa

SEQ ID NO: 650108 - RNA, 19 nt, Homo sapiens
cagaauguggucagaagug

SEQ ID NO: 650109 - RNA, 19 nt, Homo sapiens
guaacagaacugaauuugg

SEQ ID NO: 650110 - RNA, 19 nt, Homo sapiens
ucgaagacuuuggcagaga

SEQ ID NO: 650111 - RNA, 19 nt, Homo sapiens
ucuuuggucugcuuggauu

SEQ ID NO: 650112 - RNA, 19 nt, Homo sapiens
caaaagauguguggguauc

SEQ ID NO: 650113 - RNA, 19 nt, Homo sapiens
ccaguuccacuaccgaaga

SEQ ID NO: 650114 - RNA, 19 nt, Homo sapiens
aacagaauguggucagaag

SEQ ID NO: 650115 - RNA, 19 nt, Homo sapiens
cugcagggaccucugauug

SEQ ID NO: 650116 - RNA, 19 nt, Homo sapiens
gagcaaaggaaaauacaug

SEQ ID NO: 650117 - RNA, 19 nt, Homo sapiens
ccaccuaaggcacaaagug

SEQ ID NO: 650118 - RNA, 19 nt, Homo sapiens
gaaccacuggagcauguag

SEQ ID NO: 650119 - RNA, 19 nt, Homo sapiens
uggauagaaccacuaagaa

SEQ ID NO: 650120 - RNA, 19 nt, Homo sapiens
uggcagagagugugugugu

SEQ ID NO: 650121 - RNA, 19 nt, Homo sapiens
aagguggaaggaucacuua

SEQ ID NO: 650122 - RNA, 19 nt, Homo sapiens
gcuacaaagucugguucug

SEQ ID NO: 650123 - RNA, 19 nt, Homo sapiens
caggcuggguaacagaaug

SEQ ID NO: 650124 - RNA, 19 nt, Homo sapiens
acuuagagcuaggaguuug

SEQ ID NO: 650125 - RNA, 19 nt, Homo sapiens
guucagggaggaauuagca

SEQ ID NO: 650126 - RNA, 19 nt, Homo sapiens
acauggccaucucauaaag

SEQ ID NO: 650127 - RNA, 19 nt, Homo sapiens
gggaagagauggaauuauu

SEQ ID NO: 650128 - RNA, 19 nt, Homo sapiens
ggagcgagcuggugcauaa

SEQ ID NO: 650129 - RNA, 19 nt, Homo sapiens
ggaaacaguucuuuaaagu

SEQ ID NO: 650130 - RNA, 19 nt, Homo sapiens
gaagaaugguugccacugu

SEQ ID NO: 650131 - RNA, 19 nt, Homo sapiens
gagcagaguucuuguugug

SEQ ID NO: 650132 - RNA, 19 nt, Homo sapiens
caaaggcuguuaauaguag

SEQ ID NO: 650133 - RNA, 19 nt, Homo sapiens
uaagagaagugcaugugaa

SEQ ID NO: 650134 - RNA, 19 nt, Homo sapiens
gcaaaggcuguuaauagua

SEQ ID NO: 650135 - RNA, 19 nt, Homo sapiens
gcacuaguauuccuuagag

SEQ ID NO: 650136 - RNA, 19 nt, Homo sapiens
ggcaggagaugcugaauca

SEQ ID NO: 650137 - RNA, 19 nt, Homo sapiens
ggcaaaggcuguuaauagu

SEQ ID NO: 650138 - RNA, 19 nt, Homo sapiens
ugacagcuguagcaacuuu

SEQ ID NO: 650139 - RNA, 19 nt, Homo sapiens
gaugacagcuguagcaacu

SEQ ID NO: 650140 - RNA, 19 nt, Homo sapiens
ugaagaaccuggagaugau

SEQ ID NO: 650141 - RNA, 19 nt, Homo sapiens
uggaugaacuggugaagaa

SEQ ID NO: 650142 - RNA, 19 nt, Homo sapiens
guacuugucuuaauacacu

SEQ ID NO: 650143 - RNA, 19 nt, Homo sapiens
gcaggcauguguuggcaaa

SEQ ID NO: 650144 - RNA, 19 nt, Homo sapiens
ggguuaugcugcacuagua

SEQ ID NO: 650145 - RNA, 19 nt, Homo sapiens
gauguuaauuucucuguag

SEQ ID NO: 650146 - RNA, 19 nt, Homo sapiens
gaggaaacaguucuuuaaa

SEQ ID NO: 650147 - RNA, 19 nt, Homo sapiens
gagaagugcaugugaagaa

SEQ ID NO: 650148 - RNA, 19 nt, Homo sapiens
ccaagaacacaauucauuu

SEQ ID NO: 650149 - RNA, 19 nt, Homo sapiens
gauguccucuccacuuuau

SEQ ID NO: 650150 - RNA, 19 nt, Homo sapiens
acucuaaacugcucuaaug

SEQ ID NO: 650151 - RNA, 19 nt, Homo sapiens
gacaagauguuaauuucuc

SEQ ID NO: 650152 - RNA, 19 nt, Homo sapiens
ugagaugccugaccaguuc

SEQ ID NO: 650153 - RNA, 19 nt, Homo sapiens
gagcaaaccugagccugau

SEQ ID NO: 650154 - RNA, 19 nt, Homo sapiens
gcaacccucuuucaaacug

SEQ ID NO: 650155 - RNA, 19 nt, Homo sapiens
ccaaggggauuuauucuaa

SEQ ID NO: 650156 - RNA, 19 nt, Homo sapiens
caagagagccaucaacaag

SEQ ID NO: 650157 - RNA, 19 nt, Homo sapiens
ggaagagauggaauuauug

SEQ ID NO: 650158 - RNA, 19 nt, Homo sapiens
guagcaacuuugugucuga

SEQ ID NO: 650159 - RNA, 19 nt, Homo sapiens
gaagaugacagcuguagca

SEQ ID NO: 650160 - RNA, 19 nt, Homo sapiens
gguagacugugacuagguu

SEQ ID NO: 650161 - RNA, 19 nt, Homo sapiens
gcaacuuugugucugaaga

SEQ ID NO: 650162 - RNA, 19 nt, Homo sapiens
caacagcuugcuucucuuu

SEQ ID NO: 650163 - RNA, 19 nt, Homo sapiens
ccaacaagcccgucugaga

SEQ ID NO: 650164 - RNA, 19 nt, Homo sapiens
ugaagcagcucucccuaca

SEQ ID NO: 650165 - RNA, 19 nt, Homo sapiens
caacaagcccgucugagau

SEQ ID NO: 650166 - RNA, 19 nt, Homo sapiens
ucaacaaguccaagccuua

SEQ ID NO: 650167 - RNA, 19 nt, Homo sapiens
agaggaaacaguucuuuaa

SEQ ID NO: 650168 - RNA, 19 nt, Homo sapiens
caauaacuaguuccuauga

SEQ ID NO: 650169 - RNA, 19 nt, Homo sapiens
uaaaucaguccacggauga

SEQ ID NO: 650170 - RNA, 19 nt, Homo sapiens
ucuguagguuguaacuuua

SEQ ID NO: 650171 - RNA, 19 nt, Homo sapiens
uaauuucucuguagguugu

SEQ ID NO: 650172 - RNA, 19 nt, Homo sapiens
cuaaacugcucuaaugaag

SEQ ID NO: 650173 - RNA, 19 nt, Homo sapiens
ggagaagaaacucaagaga

SEQ ID NO: 650174 - RNA, 19 nt, Homo sapiens
ggaguaggcaggcaugugu

SEQ ID NO: 650175 - RNA, 19 nt, Homo sapiens
uagaggaaacaguucuuua

SEQ ID NO: 650176 - RNA, 19 nt, Homo sapiens
uggcaaaggcuguuaauag

SEQ ID NO: 650177 - RNA, 19 nt, Homo sapiens
ugcgacagcuggagaagaa

SEQ ID NO: 650178 - RNA, 19 nt, Homo sapiens
uaaggguuaugcugcacua

SEQ ID NO: 650179 - RNA, 19 nt, Homo sapiens
guuaauuucucuguagguu

SEQ ID NO: 650180 - RNA, 19 nt, Homo sapiens
aagcguguaugcugggaua

SEQ ID NO: 650181 - RNA, 19 nt, Homo sapiens
uggaauuauugcugacaua

SEQ ID NO: 650182 - RNA, 19 nt, Homo sapiens
ugacaaagccaacaacaac

SEQ ID NO: 650183 - RNA, 19 nt, Homo sapiens
guaggagggacuuauagaa

SEQ ID NO: 650184 - RNA, 19 nt, Homo sapiens
gcaauaacuaguuccuaug

SEQ ID NO: 650185 - RNA, 19 nt, Homo sapiens
gcagauuggcugauucauc

SEQ ID NO: 650186 - RNA, 19 nt, Homo sapiens
ucuuacacgucuacucuaa

SEQ ID NO: 650187 - RNA, 19 nt, Homo sapiens
gaagagauggaauuauugc

SEQ ID NO: 650188 - RNA, 19 nt, Homo sapiens
gacgggagacugaacuuga

SEQ ID NO: 650189 - RNA, 19 nt, Homo sapiens
gaggcaggcucagcuggaa

SEQ ID NO: 650190 - RNA, 19 nt, Homo sapiens
guuccgcucuguucugguu

SEQ ID NO: 650191 - RNA, 19 nt, Homo sapiens
agcaauaacuaguuccuau

SEQ ID NO: 650192 - RNA, 19 nt, Homo sapiens
gaugauguucccaguguug

SEQ ID NO: 650193 - RNA, 19 nt, Homo sapiens
acaaguccaagccuuauuu

SEQ ID NO: 650194 - RNA, 19 nt, Homo sapiens
gguugccacuguuauuaga

SEQ ID NO: 650195 - RNA, 19 nt, Homo sapiens
aagcagcucucccuacagu

SEQ ID NO: 650196 - RNA, 19 nt, Homo sapiens
gcagcucgagcaacugaaa

SEQ ID NO: 650197 - RNA, 19 nt, Homo sapiens
caacaaguccaagccuuau

SEQ ID NO: 650198 - RNA, 19 nt, Homo sapiens
aagcaacccucuuucaaac

SEQ ID NO: 650199 - RNA, 19 nt, Homo sapiens
aggaaacaguucuuuaaag

SEQ ID NO: 650200 - RNA, 19 nt, Homo sapiens
gaagugcaugugaagaaug

SEQ ID NO: 650201 - RNA, 19 nt, Homo sapiens
agauuguucuucuggguaa

SEQ ID NO: 650202 - RNA, 19 nt, Homo sapiens
acauggaacuggagaacau

SEQ ID NO: 650203 - RNA, 19 nt, Homo sapiens
cucuguagguuguaacuuu

SEQ ID NO: 650204 - RNA, 19 nt, Homo sapiens
aagaaugguugccacuguu

SEQ ID NO: 650205 - RNA, 19 nt, Homo sapiens
uccaagaacacaauucauu

SEQ ID NO: 650206 - RNA, 19 nt, Homo sapiens
aaagggaagagauggaauu

SEQ ID NO: 650207 - RNA, 19 nt, Homo sapiens
gaagaaaauuggcaaagcu

SEQ ID NO: 650208 - RNA, 19 nt, Homo sapiens
cuugagggcuaaagauugu

SEQ ID NO: 650209 - RNA, 19 nt, Homo sapiens
gaaguuucagugaccuuga

SEQ ID NO: 650210 - RNA, 19 nt, Homo sapiens
ggaggagccagccgaaauc

SEQ ID NO: 650211 - RNA, 19 nt, Homo sapiens
ugaggaugcucgucagaag

SEQ ID NO: 650212 - RNA, 19 nt, Homo sapiens
agagagccaucaacaaguc

SEQ ID NO: 650213 - RNA, 19 nt, Homo sapiens
gaaguuccgcucuguucug

SEQ ID NO: 650214 - RNA, 19 nt, Homo sapiens
uggcaaagcuguggaagac

SEQ ID NO: 650215 - RNA, 19 nt, Homo sapiens
gguaggagggacuuauaga

SEQ ID NO: 650216 - RNA, 19 nt, Homo sapiens
gaaagaaaacccacacaca

SEQ ID NO: 650217 - RNA, 19 nt, Homo sapiens
uggaagcaauaacuaguuc

SEQ ID NO: 650218 - RNA, 19 nt, Homo sapiens
cagagcagaguucuuguug

SEQ ID NO: 650219 - RNA, 19 nt, Homo sapiens
gcgagcuggugcauaagga

SEQ ID NO: 650220 - RNA, 19 nt, Homo sapiens
agaaugguugccacuguua

SEQ ID NO: 650221 - RNA, 19 nt, Homo sapiens
cccacgauaucuaaaugaa

SEQ ID NO: 650222 - RNA, 19 nt, Homo sapiens
guauaacggcauuguggaa

SEQ ID NO: 650223 - RNA, 19 nt, Homo sapiens
ggaugauguucccaguguu

SEQ ID NO: 650224 - RNA, 19 nt, Homo sapiens
gaccaacaagcccgucuga

SEQ ID NO: 650225 - RNA, 19 nt, Homo sapiens
cggaggccuuugaagauga

SEQ ID NO: 650226 - RNA, 19 nt, Homo sapiens
cuggagaaguuaaaucagu

SEQ ID NO: 650227 - RNA, 19 nt, Homo sapiens
gaagagaagucaagggaau

SEQ ID NO: 650228 - RNA, 19 nt, Homo sapiens
ggaaagaucaaaggaauuu

SEQ ID NO: 650229 - RNA, 19 nt, Homo sapiens
gaggaaagaucaaaggaau

SEQ ID NO: 650230 - RNA, 19 nt, Homo sapiens
caaaaucccuuuccaauga

SEQ ID NO: 650231 - RNA, 19 nt, Homo sapiens
aaagagccaugaucuaauu

SEQ ID NO: 650232 - RNA, 19 nt, Homo sapiens
ggacaucauuaccagaauu

SEQ ID NO: 650233 - RNA, 19 nt, Homo sapiens
ggaauucauuggcaacuuc

SEQ ID NO: 650234 - RNA, 19 nt, Homo sapiens
gaaaagagccaugaucuaa

SEQ ID NO: 650235 - RNA, 19 nt, Homo sapiens
ccacucaggucaugcaaga

SEQ ID NO: 650236 - RNA, 19 nt, Homo sapiens
ugaaugaagccgagagaua

SEQ ID NO: 650237 - RNA, 19 nt, Homo sapiens
acacaaaccuuagcgucua

SEQ ID NO: 650238 - RNA, 19 nt, Homo sapiens
gaagucaagggaauucauu

SEQ ID NO: 650239 - RNA, 19 nt, Homo sapiens
auacgccgauggaauauuu

SEQ ID NO: 650240 - RNA, 19 nt, Homo sapiens
gaauuguucgugacuauga

SEQ ID NO: 650241 - RNA, 19 nt, Homo sapiens
gaacagaaggcaucucaac

SEQ ID NO: 650242 - RNA, 19 nt, Homo sapiens
cagaaaccauggaggaaau

SEQ ID NO: 650243 - RNA, 19 nt, Homo sapiens
ccguacagcugaagaguug

SEQ ID NO: 650244 - RNA, 19 nt, Homo sapiens
ucaagaauguggaggaaag

SEQ ID NO: 650245 - RNA, 19 nt, Homo sapiens
gcagagagacccugaacuc

SEQ ID NO: 650246 - RNA, 19 nt, Homo sapiens
cagaauuguucgugacuau

SEQ ID NO: 650247 - RNA, 19 nt, Homo sapiens
gcagggauguucguuccaa

SEQ ID NO: 650248 - RNA, 19 nt, Homo sapiens
gcagaguucccuagagaga

SEQ ID NO: 650249 - RNA, 19 nt, Homo sapiens
gagcauggaagcagauguu

SEQ ID NO: 650250 - RNA, 19 nt, Homo sapiens
ggaggaaagaucaaaggaa

SEQ ID NO: 650251 - RNA, 19 nt, Homo sapiens
gagaagagguaccguuucc

SEQ ID NO: 650252 - RNA, 19 nt, Homo sapiens
guucgugacuaugauguuu

SEQ ID NO: 650253 - RNA, 19 nt, Homo sapiens
gaaugaagccgagagauac

SEQ ID NO: 650254 - RNA, 19 nt, Homo sapiens
gagccaugaucuaauucaa

SEQ ID NO: 650255 - RNA, 19 nt, Homo sapiens
cagaaggcaucucaacauc

SEQ ID NO: 650256 - RNA, 19 nt, Homo sapiens
gaugcucccuggacacuca

SEQ ID NO: 650257 - RNA, 19 nt, Homo sapiens
ucucauggcuuccacucaa

SEQ ID NO: 650258 - RNA, 19 nt, Homo sapiens
caacuuccuagaacuguuu

SEQ ID NO: 650259 - RNA, 19 nt, Homo sapiens
gcaacuuccuagaacuguu

SEQ ID NO: 650260 - RNA, 19 nt, Homo sapiens
uagacgaaguuaucagaga

SEQ ID NO: 650261 - RNA, 19 nt, Homo sapiens
gguaggaguuugcagugau

SEQ ID NO: 650262 - RNA, 19 nt, Homo sapiens
uggaauauuugaccucuuc

SEQ ID NO: 650263 - RNA, 19 nt, Homo sapiens
aguauacgccgauggaaua

SEQ ID NO: 650264 - RNA, 19 nt, Homo sapiens
gaauguggaggaaagauca

SEQ ID NO: 650265 - RNA, 19 nt, Homo sapiens
caacaucggacaucauuac

SEQ ID NO: 650266 - RNA, 19 nt, Homo sapiens
agagagacuugcacugaug

SEQ ID NO: 650267 - RNA, 19 nt, Homo sapiens
ggugguguuugaaggguaa

SEQ ID NO: 650268 - RNA, 19 nt, Homo sapiens
gaucucacccacaaauuca

SEQ ID NO: 650269 - RNA, 19 nt, Homo sapiens
uaaggaaggaugcagaguu

SEQ ID NO: 650270 - RNA, 19 nt, Homo sapiens
gaugaucucacccacaaau

SEQ ID NO: 650271 - RNA, 19 nt, Homo sapiens
guaggaguuugcagugaug

SEQ ID NO: 650272 - RNA, 19 nt, Homo sapiens
aaggaaggaugcagaguuc

SEQ ID NO: 650273 - RNA, 19 nt, Homo sapiens
gcucugaugauguuuacaa

SEQ ID NO: 650274 - RNA, 19 nt, Homo sapiens
gccaugaucuaauucaaaa

SEQ ID NO: 650275 - RNA, 19 nt, Homo sapiens
aaaggaauuugugaacaga

SEQ ID NO: 650276 - RNA, 19 nt, Homo sapiens
cuacguagacgaaguuauc

SEQ ID NO: 650277 - RNA, 19 nt, Homo sapiens
cuagagagacuugcacuga

SEQ ID NO: 650278 - RNA, 19 nt, Homo sapiens
gaacagaguggaagaaaag

SEQ ID NO: 650279 - RNA, 19 nt, Homo sapiens
agacgaaguuaucagagau

SEQ ID NO: 650280 - RNA, 19 nt, Homo sapiens
gggaauucauuggcaacuu

SEQ ID NO: 650281 - RNA, 19 nt, Homo sapiens
ccagaauuguucgugacua

SEQ ID NO: 650282 - RNA, 19 nt, Homo sapiens
uagagagacuugcacugau

SEQ ID NO: 650283 - RNA, 19 nt, Homo sapiens
augaugacauuccguauuc

SEQ ID NO: 650284 - RNA, 19 nt, Homo sapiens
cugaugauguuuacaagca

SEQ ID NO: 650285 - RNA, 19 nt, Homo sapiens
ccacaaauucaaagguuuc

SEQ ID NO: 650286 - RNA, 19 nt, Homo sapiens
gggaugaggaugaaaagua

SEQ ID NO: 650287 - RNA, 19 nt, Homo sapiens
caugaugacauuccguauu

SEQ ID NO: 650288 - RNA, 19 nt, Homo sapiens
gauacgaagcucucagaca

SEQ ID NO: 650289 - RNA, 19 nt, Homo sapiens
ggucaugcaagagcccuua

SEQ ID NO: 650290 - RNA, 19 nt, Homo sapiens
aaacagguaucccaaaauc

SEQ ID NO: 650291 - RNA, 19 nt, Homo sapiens
augcagaguucccuagaga

SEQ ID NO: 650292 - RNA, 19 nt, Homo sapiens
gcuggacaaccuacacaaa

SEQ ID NO: 650293 - RNA, 19 nt, Homo sapiens
agaaacagguaucccaaaa

SEQ ID NO: 650294 - RNA, 19 nt, Homo sapiens
gagguaccguuuccagaac

SEQ ID NO: 650295 - RNA, 19 nt, Homo sapiens
gacaucauuaccagaauug

SEQ ID NO: 650296 - RNA, 19 nt, Homo sapiens
ggaugaggaugaaaaguag

SEQ ID NO: 650297 - RNA, 19 nt, Homo sapiens
gaguauacgccgauggaau

SEQ ID NO: 650298 - RNA, 19 nt, Homo sapiens
ucagaaaccauggaggaaa

SEQ ID NO: 650299 - RNA, 19 nt, Homo sapiens
gaggguauacagccaagga

SEQ ID NO: 650300 - RNA, 19 nt, Homo sapiens
caucauuaccagaauuguu

SEQ ID NO: 650301 - RNA, 19 nt, Homo sapiens
cccacaaauucaaagguuu

SEQ ID NO: 650302 - RNA, 19 nt, Homo sapiens
gcaagagccgcaccaugca

SEQ ID NO: 650303 - RNA, 19 nt, Homo sapiens
gaacuguuuggaccugaug

SEQ ID NO: 650304 - RNA, 19 nt, Homo sapiens
gaaccaaguggacaaaaug

SEQ ID NO: 650305 - RNA, 19 nt, Homo sapiens
gccaaggaacugaauguca

SEQ ID NO: 650306 - RNA, 19 nt, Homo sapiens
cagaaacagguaucccaaa

SEQ ID NO: 650307 - RNA, 19 nt, Homo sapiens
aaaggaagcagggauguuc

SEQ ID NO: 650308 - RNA, 19 nt, Homo sapiens
gaugaaugaagccgagaga

SEQ ID NO: 650309 - RNA, 19 nt, Homo sapiens
gaugcagaguucccuagag

SEQ ID NO: 650310 - RNA, 19 nt, Homo sapiens
agagguaccguuuccagaa

SEQ ID NO: 650311 - RNA, 19 nt, Homo sapiens
gagcccuuaugcaagcaaa

SEQ ID NO: 650312 - RNA, 19 nt, Homo sapiens
acccacaaauucaaagguu

SEQ ID NO: 650313 - RNA, 19 nt, Homo sapiens
caaccuacacaaaccuuag

SEQ ID NO: 650314 - RNA, 19 nt, Homo sapiens
gugaacagaguggaagaaa

SEQ ID NO: 650315 - RNA, 19 nt, Homo sapiens
cagaguauacgccgaugga

SEQ ID NO: 650316 - RNA, 19 nt, Homo sapiens
gaggagggcgagagucaca

SEQ ID NO: 650317 - RNA, 19 nt, Homo sapiens
gaagaaaagagccaugauc

SEQ ID NO: 650318 - RNA, 19 nt, Homo sapiens
gagccucccucagaaacca

SEQ ID NO: 650319 - RNA, 19 nt, Homo sapiens
acagaaggcaucucaacau

SEQ ID NO: 650320 - RNA, 19 nt, Homo sapiens
uuacaagcacauaaaggaa

SEQ ID NO: 650321 - RNA, 19 nt, Homo sapiens
ggaugcagaguucccuaga

SEQ ID NO: 650322 - RNA, 19 nt, Homo sapiens
ggaagcagggauguucguu

SEQ ID NO: 650323 - RNA, 19 nt, Homo sapiens
uaaaggaagcagggauguu

SEQ ID NO: 650324 - RNA, 19 nt, Homo sapiens
aaacacaagauugacuuug

SEQ ID NO: 650325 - RNA, 19 nt, Homo sapiens
aaagcagccucagccucua

SEQ ID NO: 650326 - RNA, 19 nt, Homo sapiens
ucgugacuaugauguuuau

SEQ ID NO: 650327 - RNA, 19 nt, Homo sapiens
gcaaggcucugaccaguga

SEQ ID NO: 650328 - RNA, 19 nt, Homo sapiens
ggagauauccugacccuaa

SEQ ID NO: 650329 - RNA, 19 nt, Homo sapiens
gaaacaugguucuaauuug

SEQ ID NO: 650330 - RNA, 19 nt, Homo sapiens
agaagaagcuggauuugaa

SEQ ID NO: 650331 - RNA, 19 nt, Homo sapiens
gaacauguccauauuugaa

SEQ ID NO: 650332 - RNA, 19 nt, Homo sapiens
gaacacaagaggagaauga

SEQ ID NO: 650333 - RNA, 19 nt, Homo sapiens
agucagaccuccugcuuua

SEQ ID NO: 650334 - RNA, 19 nt, Homo sapiens
ggaaagagaagaccagaug

SEQ ID NO: 650335 - RNA, 19 nt, Homo sapiens
ggcccuugcugcuguauua

SEQ ID NO: 650336 - RNA, 19 nt, Homo sapiens
acucaaagcuguacccaaa

SEQ ID NO: 650337 - RNA, 19 nt, Homo sapiens
gaaagaaacgcguuaaagg

SEQ ID NO: 650338 - RNA, 19 nt, Homo sapiens
gaaggaccaucugcugaaa

SEQ ID NO: 650339 - RNA, 19 nt, Homo sapiens
acacaugcguauagacaua

SEQ ID NO: 650340 - RNA, 19 nt, Homo sapiens
ggccagaguccaaauauuu

SEQ ID NO: 650341 - RNA, 19 nt, Homo sapiens
uauaagaccuggaagaagu

SEQ ID NO: 650342 - RNA, 19 nt, Homo sapiens
guccagggcuuccuaaaug

SEQ ID NO: 650343 - RNA, 19 nt, Homo sapiens
gagauauccugacccuaaa

SEQ ID NO: 650344 - RNA, 19 nt, Homo sapiens
gagcugggauggagaagau

SEQ ID NO: 650345 - RNA, 19 nt, Homo sapiens
guacccaaaucaagaaaga

SEQ ID NO: 650346 - RNA, 19 nt, Homo sapiens
gaaggacagugugguguga

SEQ ID NO: 650347 - RNA, 19 nt, Homo sapiens
ggacuucucaggacauuga

SEQ ID NO: 650348 - RNA, 19 nt, Homo sapiens
aagaauaaguugugcagaa

SEQ ID NO: 650349 - RNA, 19 nt, Homo sapiens
ccacguguguguaugugua

SEQ ID NO: 650350 - RNA, 19 nt, Homo sapiens
agaaauggcucagaacguu

SEQ ID NO: 650351 - RNA, 19 nt, Homo sapiens
caucucagcuguauauucu

SEQ ID NO: 650352 - RNA, 19 nt, Homo sapiens
gaccagaugugcauagaag

SEQ ID NO: 650353 - RNA, 19 nt, Homo sapiens
ggacaggagucagccaguu

SEQ ID NO: 650354 - RNA, 19 nt, Homo sapiens
gcugguuacugaugaauau

SEQ ID NO: 650355 - RNA, 19 nt, Homo sapiens
acagagcgauucagcguuu

SEQ ID NO: 650356 - RNA, 19 nt, Homo sapiens
ggaccuguuuauaaauuga

SEQ ID NO: 650357 - RNA, 19 nt, Homo sapiens
aaacaugguucuaauuugg

SEQ ID NO: 650358 - RNA, 19 nt, Homo sapiens
ggucuccacucuuggguuu

SEQ ID NO: 650359 - RNA, 19 nt, Homo sapiens
gcuauaaucagccuauuug

SEQ ID NO: 650360 - RNA, 19 nt, Homo sapiens
caagcuggguccugaguga

SEQ ID NO: 650361 - RNA, 19 nt, Homo sapiens
gcaaguauaagaccuggaa

SEQ ID NO: 650362 - RNA, 19 nt, Homo sapiens
gugcacagccugaagauga

SEQ ID NO: 650363 - RNA, 19 nt, Homo sapiens
gaagaagcuggauuugaaa

SEQ ID NO: 650364 - RNA, 19 nt, Homo sapiens
gagaagaagcuggauuuga

SEQ ID NO: 650365 - RNA, 19 nt, Homo sapiens
cagacaagcugaagcagau

SEQ ID NO: 650366 - RNA, 19 nt, Homo sapiens
gaaaagaagagacagaaaa

SEQ ID NO: 650367 - RNA, 19 nt, Homo sapiens
agaauaaguugugcagaaa

SEQ ID NO: 650368 - RNA, 19 nt, Homo sapiens
ggaagaguauugcuuaacg

SEQ ID NO: 650369 - RNA, 19 nt, Homo sapiens
ccgaacauguccauauuug

SEQ ID NO: 650370 - RNA, 19 nt, Homo sapiens
ggaaagaaacgcguuaaag

SEQ ID NO: 650371 - RNA, 19 nt, Homo sapiens
uuacucauguucuuucuug

SEQ ID NO: 650372 - RNA, 19 nt, Homo sapiens
gagcagaacucaguaucca

SEQ ID NO: 650373 - RNA, 19 nt, Homo sapiens
gccagaguccaaauauuua

SEQ ID NO: 650374 - RNA, 19 nt, Homo sapiens
ucacaggccuagcucaugu

SEQ ID NO: 650375 - RNA, 19 nt, Homo sapiens
gcagguugacuuaauuuau

SEQ ID NO: 650376 - RNA, 19 nt, Homo sapiens
gagaaggugaggccaguaa

SEQ ID NO: 650377 - RNA, 19 nt, Homo sapiens
gcaggaagccaccauugga

SEQ ID NO: 650378 - RNA, 19 nt, Homo sapiens
uaacguuucuugucuggau

SEQ ID NO: 650379 - RNA, 19 nt, Homo sapiens
ccucagcccuguuugcuau

SEQ ID NO: 650380 - RNA, 19 nt, Homo sapiens
ccaagugugucuuauugau

SEQ ID NO: 650381 - RNA, 19 nt, Homo sapiens
acuauuggcuugaaacguu

SEQ ID NO: 650382 - RNA, 19 nt, Homo sapiens
ucacacacacagaaacaua

SEQ ID NO: 650383 - RNA, 19 nt, Homo sapiens
cgacccagcccugaucuua

SEQ ID NO: 650384 - RNA, 19 nt, Homo sapiens
gggauacaaugacccaugu

SEQ ID NO: 650385 - RNA, 19 nt, Homo sapiens
ccucgggaccuguuuauaa

SEQ ID NO: 650386 - RNA, 19 nt, Homo sapiens
ggaucugaguccaacauug

SEQ ID NO: 650387 - RNA, 19 nt, Homo sapiens
cacaggcccuaacauguuu

SEQ ID NO: 650388 - RNA, 19 nt, Homo sapiens
gugccugaauuccuccuua

SEQ ID NO: 650389 - RNA, 19 nt, Homo sapiens
cuugaaacguuauggauau

SEQ ID NO: 650390 - RNA, 19 nt, Homo sapiens
ucaaagcuguacccaaauc

SEQ ID NO: 650391 - RNA, 19 nt, Homo sapiens
cuuggugucuuucuuguuu

SEQ ID NO: 650392 - RNA, 19 nt, Homo sapiens
gcaauacaugcacuugaaa

SEQ ID NO: 650393 - RNA, 19 nt, Homo sapiens
ggacguuguuuaagaucug

SEQ ID NO: 650394 - RNA, 19 nt, Homo sapiens
gaaugggccuuugggacuu

SEQ ID NO: 650395 - RNA, 19 nt, Homo sapiens
ucacaggcccuaacauguu

SEQ ID NO: 650396 - RNA, 19 nt, Homo sapiens
gcccugaucuuagcugaga

SEQ ID NO: 650397 - RNA, 19 nt, Homo sapiens
uggccuacuugacuuauuu

SEQ ID NO: 650398 - RNA, 19 nt, Homo sapiens
ccaggacguuguuuaagau

SEQ ID NO: 650399 - RNA, 19 nt, Homo sapiens
ggagaagucccaccaggau

SEQ ID NO: 650400 - RNA, 19 nt, Homo sapiens
cagaccuccugcuuuauuu

SEQ ID NO: 650401 - RNA, 19 nt, Homo sapiens
caacaucuucuaccucuuc

SEQ ID NO: 650402 - RNA, 19 nt, Homo sapiens
gucauccucuccuauacua

SEQ ID NO: 650403 - RNA, 19 nt, Homo sapiens
ugaggaacauaaagcaaau

SEQ ID NO: 650404 - RNA, 19 nt, Homo sapiens
cgggaccuguuuauaaauu

SEQ ID NO: 650405 - RNA, 19 nt, Homo sapiens
gaaacguuauggauauggu

SEQ ID NO: 650406 - RNA, 19 nt, Homo sapiens
gcuugaaacguuauggaua

SEQ ID NO: 650407 - RNA, 19 nt, Homo sapiens
aagcagaauuggcaacuuc

SEQ ID NO: 650408 - RNA, 19 nt, Homo sapiens
gagaagaccagaugugcau

SEQ ID NO: 650409 - RNA, 19 nt, Homo sapiens
cccaggacguuguuuaaga

SEQ ID NO: 650410 - RNA, 19 nt, Homo sapiens
caaauacgcccuuuucuug

SEQ ID NO: 650411 - RNA, 19 nt, Homo sapiens
guucuaauuuggaguucaa

SEQ ID NO: 650412 - RNA, 19 nt, Homo sapiens
guccagagcagcagagauu

SEQ ID NO: 650413 - RNA, 19 nt, Homo sapiens
ccaguugguugcugugguu

SEQ ID NO: 650414 - RNA, 19 nt, Homo sapiens
caagugcacacacaucuau

SEQ ID NO: 650415 - RNA, 19 nt, Homo sapiens
gcaggccagaguccaaaua

SEQ ID NO: 650416 - RNA, 19 nt, Homo sapiens
guacgcccuucgucaagaa

SEQ ID NO: 650417 - RNA, 19 nt, Homo sapiens
ggaaguacaggaucugagu

SEQ ID NO: 650418 - RNA, 19 nt, Homo sapiens
ccuaugggcuuuucuguuu

SEQ ID NO: 650419 - RNA, 19 nt, Homo sapiens
acacaucuaugcagacaag

SEQ ID NO: 650420 - RNA, 19 nt, Homo sapiens
uggcugugcugguuacuga

SEQ ID NO: 650421 - RNA, 19 nt, Homo sapiens
ccaaaucaagaaagacaaa

SEQ ID NO: 650422 - RNA, 19 nt, Homo sapiens
gaagaugagaagcaaauac

SEQ ID NO: 650423 - RNA, 19 nt, Homo sapiens
gaagaggaagagcagagaa

SEQ ID NO: 650424 - RNA, 19 nt, Homo sapiens
gaaagagaagaccagaugu

SEQ ID NO: 650425 - RNA, 19 nt, Homo sapiens
auauagaaauggcucagaa

SEQ ID NO: 650426 - RNA, 19 nt, Homo sapiens
cuauuggcuugaaacguua

SEQ ID NO: 650427 - RNA, 19 nt, Homo sapiens
cagcugagaucacuuaaua

SEQ ID NO: 650428 - RNA, 19 nt, Homo sapiens
ggaggaugaugcaaauaaa

SEQ ID NO: 650429 - RNA, 19 nt, Homo sapiens
caacagcugagaucacuua

SEQ ID NO: 650430 - RNA, 19 nt, Homo sapiens
gaacagaauaucaaacaga

SEQ ID NO: 650431 - RNA, 19 nt, Homo sapiens
ucacagagcuaugaacaga

SEQ ID NO: 650432 - RNA, 19 nt, Homo sapiens
gaaagauggugagaaggaa

SEQ ID NO: 650433 - RNA, 19 nt, Homo sapiens
ggaagagcauuuuauguuu

SEQ ID NO: 650434 - RNA, 19 nt, Homo sapiens
ugacuuccaucucuucaaa

SEQ ID NO: 650435 - RNA, 19 nt, Homo sapiens
gcgagaggaugaacaacaa

SEQ ID NO: 650436 - RNA, 19 nt, Homo sapiens
gcugagaucacuuaauaaa

SEQ ID NO: 650437 - RNA, 19 nt, Homo sapiens
gggaggaugaugcaaauaa

SEQ ID NO: 650438 - RNA, 19 nt, Homo sapiens
gaacgagacaagaaucaga

SEQ ID NO: 650439 - RNA, 19 nt, Homo sapiens
caaguucgacgcuuugaaa

SEQ ID NO: 650440 - RNA, 19 nt, Homo sapiens
caaacagauuggcaccuuu

SEQ ID NO: 650441 - RNA, 19 nt, Homo sapiens
acagaaagauggugagaag

SEQ ID NO: 650442 - RNA, 19 nt, Homo sapiens
acaacaaguucgacgcuuu

SEQ ID NO: 650443 - RNA, 19 nt, Homo sapiens
cagaauaucaaacagauug

SEQ ID NO: 650444 - RNA, 19 nt, Homo sapiens
gguggcaaguggauuauuc

SEQ ID NO: 650445 - RNA, 19 nt, Homo sapiens
gagaucacuuaauaaaugg

SEQ ID NO: 650446 - RNA, 19 nt, Homo sapiens
ggagucuguuguucuguug

SEQ ID NO: 650447 - RNA, 19 nt, Homo sapiens
cauugaagcuggcgucauc

SEQ ID NO: 650448 - RNA, 19 nt, Homo sapiens
ucaaacagauuggcaccuu

SEQ ID NO: 650449 - RNA, 19 nt, Homo sapiens
gcuaugaacagaauaucaa

SEQ ID NO: 650450 - RNA, 19 nt, Homo sapiens
aaucagagcaguagcaaga

SEQ ID NO: 650451 - RNA, 19 nt, Homo sapiens
ggaccaugaucagaaugaa

SEQ ID NO: 650452 - RNA, 19 nt, Homo sapiens
gaagaaaacagcacacaga

SEQ ID NO: 650453 - RNA, 19 nt, Homo sapiens
acagagcuaugaacagaau

SEQ ID NO: 650454 - RNA, 19 nt, Homo sapiens
gacaagaaucagagcagua

SEQ ID NO: 650455 - RNA, 19 nt, Homo sapiens
aaacggaacgagacaagaa

SEQ ID NO: 650456 - RNA, 19 nt, Homo sapiens
gacaagaggaauuggaaga

SEQ ID NO: 650457 - RNA, 19 nt, Homo sapiens
gagcaguucuggagguuuu

SEQ ID NO: 650458 - RNA, 19 nt, Homo sapiens
caacaaguucgacgcuuug

SEQ ID NO: 650459 - RNA, 19 nt, Homo sapiens
gaaaacagcacacagaaag

SEQ ID NO: 650460 - RNA, 19 nt, Homo sapiens
ucagagcaguagcaagaga

SEQ ID NO: 650461 - RNA, 19 nt, Homo sapiens
gugggaggaugaugcaaau

SEQ ID NO: 650462 - RNA, 19 nt, Homo sapiens
ucaggaagacauuauuuca

SEQ ID NO: 650463 - RNA, 19 nt, Homo sapiens
uguggugucuguccgcuuu

SEQ ID NO: 650464 - RNA, 19 nt, Homo sapiens
uuugaaagaugaugacagu

SEQ ID NO: 650465 - RNA, 19 nt, Homo sapiens
agaaagauggugagaagga

SEQ ID NO: 650466 - RNA, 19 nt, Homo sapiens
gaaggaauuaaacccaugu

SEQ ID NO: 650467 - RNA, 19 nt, Homo sapiens
gcgguugaaugugccauga

SEQ ID NO: 650468 - RNA, 19 nt, Homo sapiens
aaacagauuggcaccuuug

SEQ ID NO: 650469 - RNA, 19 nt, Homo sapiens
cacagugacuuccaucucu

SEQ ID NO: 650470 - RNA, 19 nt, Homo sapiens
ucacaccgacagcaucaaa

SEQ ID NO: 650471 - RNA, 19 nt, Homo sapiens
aaugguggcaaguggauua

SEQ ID NO: 650472 - RNA, 19 nt, Homo sapiens
caagagaaaggcuguuguc

SEQ ID NO: 650473 - RNA, 19 nt, Homo sapiens
gcaagagaaaggcuguugu

SEQ ID NO: 650474 - RNA, 19 nt, Homo sapiens
cuaccucccaacaccauua

SEQ ID NO: 650475 - RNA, 19 nt, Homo sapiens
cggagucuguuguucuguu

SEQ ID NO: 650476 - RNA, 19 nt, Homo sapiens
caggaagacauuauuucaa

SEQ ID NO: 650477 - RNA, 19 nt, Homo sapiens
aaacagcacacagaaagau

SEQ ID NO: 650478 - RNA, 19 nt, Homo sapiens
gggaccaugaucagaauga

SEQ ID NO: 650479 - RNA, 19 nt, Homo sapiens
cgcagcagcuacaacaaca

SEQ ID NO: 650480 - RNA, 19 nt, Homo sapiens
gaauuggaagagcauuuua

SEQ ID NO: 650481 - RNA, 19 nt, Homo sapiens
ggaauuggaagagcauuuu

SEQ ID NO: 650482 - RNA, 19 nt, Homo sapiens
gcaguacaacuacacuuuu

SEQ ID NO: 650483 - RNA, 19 nt, Homo sapiens
gagaggaugaacaacaagu

SEQ ID NO: 650484 - RNA, 19 nt, Homo sapiens
acagugacuuccaucucuu

SEQ ID NO: 650485 - RNA, 19 nt, Homo sapiens
acacgcagcagcuacaaca

SEQ ID NO: 650486 - RNA, 19 nt, Homo sapiens
ggcgagaggaugaacaaca

SEQ ID NO: 650487 - RNA, 19 nt, Homo sapiens
caacaacagcugagaucac

SEQ ID NO: 650488 - RNA, 19 nt, Homo sapiens
ugcaguacaacuacacuuu

SEQ ID NO: 650489 - RNA, 19 nt, Homo sapiens
acaagaaucagagcaguag

SEQ ID NO: 650490 - RNA, 19 nt, Homo sapiens
gcggcgagaggaugaacaa

SEQ ID NO: 650491 - RNA, 19 nt, Homo sapiens
aacaacagcugagaucacu

SEQ ID NO: 650492 - RNA, 19 nt, Homo sapiens
ugaacagaauaucaaacag

SEQ ID NO: 650493 - RNA, 19 nt, Homo sapiens
aaagauggugagaaggaaa

SEQ ID NO: 650494 - RNA, 19 nt, Homo sapiens
ggaaagagauuagagauaa

SEQ ID NO: 650495 - RNA, 19 nt, Homo sapiens
gaaaggaagugaaugguuu

SEQ ID NO: 650496 - RNA, 19 nt, Homo sapiens
gaagaaagguggcguuuua

SEQ ID NO: 650497 - RNA, 19 nt, Homo sapiens
gcacugcccucucaccuua

SEQ ID NO: 650498 - RNA, 19 nt, Homo sapiens
gcauuaagcuuccaaauag

SEQ ID NO: 650499 - RNA, 19 nt, Homo sapiens
gaaaugugcuugcucaaug

SEQ ID NO: 650500 - RNA, 19 nt, Homo sapiens
gaaugugacuucaaaggua

SEQ ID NO: 650501 - RNA, 19 nt, Homo sapiens
gguaagaauucaucucaua

SEQ ID NO: 650502 - RNA, 19 nt, Homo sapiens
agacggagcugcuuaguaa

SEQ ID NO: 650503 - RNA, 19 nt, Homo sapiens
ucaaguaucucucucagua

SEQ ID NO: 650504 - RNA, 19 nt, Homo sapiens
ggaaagagcugagguugga

SEQ ID NO: 650505 - RNA, 19 nt, Homo sapiens
caguaugccucaaauauua

SEQ ID NO: 650506 - RNA, 19 nt, Homo sapiens
gagaaaccauccagaauau

SEQ ID NO: 650507 - RNA, 19 nt, Homo sapiens
ggagaaaccauccagaaua

SEQ ID NO: 650508 - RNA, 19 nt, Homo sapiens
gaagggcaguaaagauaua

SEQ ID NO: 650509 - RNA, 19 nt, Homo sapiens
gaaaguuaguggaauauuc

SEQ ID NO: 650510 - RNA, 19 nt, Homo sapiens
gaacagagcaaauguagug

SEQ ID NO: 650511 - RNA, 19 nt, Homo sapiens
gagguacaaugcaauauaa

SEQ ID NO: 650512 - RNA, 19 nt, Homo sapiens
guaaagcacuuauggauag

SEQ ID NO: 650513 - RNA, 19 nt, Homo sapiens
ggaagaccgugcaguauug

SEQ ID NO: 650514 - RNA, 19 nt, Homo sapiens
gcaagugcaucucaugaaa

SEQ ID NO: 650515 - RNA, 19 nt, Homo sapiens
gcaaugggcuucuggacuu

SEQ ID NO: 650516 - RNA, 19 nt, Homo sapiens
gcaaaugguugaucuaaag

SEQ ID NO: 650517 - RNA, 19 nt, Homo sapiens
ggagguaucucaaguaucu

SEQ ID NO: 650518 - RNA, 19 nt, Homo sapiens
ggacauuugugaagauauu

SEQ ID NO: 650519 - RNA, 19 nt, Homo sapiens
gaaacagaguucucccuaa

SEQ ID NO: 650520 - RNA, 19 nt, Homo sapiens
caaccugacugaauguuaa

SEQ ID NO: 650521 - RNA, 19 nt, Homo sapiens
ggacaaagcgugaaaauaa

SEQ ID NO: 650522 - RNA, 19 nt, Homo sapiens
ggagaagaauuacaaggaa

SEQ ID NO: 650523 - RNA, 19 nt, Homo sapiens
caucagagauugcuuuaau

SEQ ID NO: 650524 - RNA, 19 nt, Homo sapiens
gacaaucauucaacagaua

SEQ ID NO: 650525 - RNA, 19 nt, Homo sapiens
gggcauaucucuuuguuag

SEQ ID NO: 650526 - RNA, 19 nt, Homo sapiens
gagcaaauguagugauaga

SEQ ID NO: 650527 - RNA, 19 nt, Homo sapiens
guacuuaucucucucaucu

SEQ ID NO: 650528 - RNA, 19 nt, Homo sapiens
gaugacgacuccaguauug

SEQ ID NO: 650529 - RNA, 19 nt, Homo sapiens
ugacauagccucuucacua

SEQ ID NO: 650530 - RNA, 19 nt, Homo sapiens
aaacagaguucucccuaaa

SEQ ID NO: 650531 - RNA, 19 nt, Homo sapiens
gaagauauuucugaucaug

SEQ ID NO: 650532 - RNA, 19 nt, Homo sapiens
gaagauuguccuccacuua

SEQ ID NO: 650533 - RNA, 19 nt, Homo sapiens
ggaacugucuucaucauca

SEQ ID NO: 650534 - RNA, 19 nt, Homo sapiens
gcauaucucuuuguuagaa

SEQ ID NO: 650535 - RNA, 19 nt, Homo sapiens
uagaaugacuuucagguuu

SEQ ID NO: 650536 - RNA, 19 nt, Homo sapiens
ggugacaucuaucccuuua

SEQ ID NO: 650537 - RNA, 19 nt, Homo sapiens
ggaacugucugaaaugaau

SEQ ID NO: 650538 - RNA, 19 nt, Homo sapiens
ggaaagaagugagguuuag

SEQ ID NO: 650539 - RNA, 19 nt, Homo sapiens
gggcuuagaugacaaggaa

SEQ ID NO: 650540 - RNA, 19 nt, Homo sapiens
caagaacuccaaccuguua

SEQ ID NO: 650541 - RNA, 19 nt, Homo sapiens
gaacugaaaggauggcuaa

SEQ ID NO: 650542 - RNA, 19 nt, Homo sapiens
uaacuaagagucucaguaa

SEQ ID NO: 650543 - RNA, 19 nt, Homo sapiens
cccuaaagcugcugucuua

SEQ ID NO: 650544 - RNA, 19 nt, Homo sapiens
agacgaugcuuaucuguaa

SEQ ID NO: 650545 - RNA, 19 nt, Homo sapiens
gcaaggcacuauucuagau

SEQ ID NO: 650546 - RNA, 19 nt, Homo sapiens
ugacaucuaucccuuuauu

SEQ ID NO: 650547 - RNA, 19 nt, Homo sapiens
caaaugaucuccuugaaaa

SEQ ID NO: 650548 - RNA, 19 nt, Homo sapiens
guaauaaggacacuuugua

SEQ ID NO: 650549 - RNA, 19 nt, Homo sapiens
gcaaaugacaugaaguauu

SEQ ID NO: 650550 - RNA, 19 nt, Homo sapiens
ggaaauagcaagguuaaga

SEQ ID NO: 650551 - RNA, 19 nt, Homo sapiens
gagaagaauuacaaggaaa

SEQ ID NO: 650552 - RNA, 19 nt, Homo sapiens
agaaacaacugcaauacuu

SEQ ID NO: 650553 - RNA, 19 nt, Homo sapiens
gaaaccauccagaauauug

SEQ ID NO: 650554 - RNA, 19 nt, Homo sapiens
gagaagcucugacaaaugc

SEQ ID NO: 650555 - RNA, 19 nt, Homo sapiens
gagcuuauccgaaguguug

SEQ ID NO: 650556 - RNA, 19 nt, Homo sapiens
cagagcaaauguagugaua

SEQ ID NO: 650557 - RNA, 19 nt, Homo sapiens
gaagagcugugcaucaaag

SEQ ID NO: 650558 - RNA, 19 nt, Homo sapiens
guaaugaggacccugguua

SEQ ID NO: 650559 - RNA, 19 nt, Homo sapiens
gaaauggacauaaguaaca

SEQ ID NO: 650560 - RNA, 19 nt, Homo sapiens
gaaaggcaaugguggaaag

SEQ ID NO: 650561 - RNA, 19 nt, Homo sapiens
caaggcaucuccuaguauu

SEQ ID NO: 650562 - RNA, 19 nt, Homo sapiens
ggaugacucaggacaauua

SEQ ID NO: 650563 - RNA, 19 nt, Homo sapiens
gcaaauccaugcccuccuu

SEQ ID NO: 650564 - RNA, 19 nt, Homo sapiens
gaaaguggaagccugguaa

SEQ ID NO: 650565 - RNA, 19 nt, Homo sapiens
gugaagauauuucugauca

SEQ ID NO: 650566 - RNA, 19 nt, Homo sapiens
agacagaauucuucacauu

SEQ ID NO: 650567 - RNA, 19 nt, Homo sapiens
gaacaaauccuagagucuu

SEQ ID NO: 650568 - RNA, 19 nt, Homo sapiens
agaaggcuguccugcauua

SEQ ID NO: 650569 - RNA, 19 nt, Homo sapiens
uaacucaaaucaaggagaa

SEQ ID NO: 650570 - RNA, 19 nt, Homo sapiens
ggagagcuuucuuauacuu

SEQ ID NO: 650571 - RNA, 19 nt, Homo sapiens
gaggagguaucucaaguau

SEQ ID NO: 650572 - RNA, 19 nt, Homo sapiens
ugaaggacauggacucuga

SEQ ID NO: 650573 - RNA, 19 nt, Homo sapiens
gacagaauucuucacauua

SEQ ID NO: 650574 - RNA, 19 nt, Homo sapiens
uaacuaaugucaagucuac

SEQ ID NO: 650575 - RNA, 19 nt, Homo sapiens
caagugaacacgcaaauga

SEQ ID NO: 650576 - RNA, 19 nt, Homo sapiens
ggaagauauugaaugcuuu

SEQ ID NO: 650577 - RNA, 19 nt, Homo sapiens
ccaauuacauagaagagaa

SEQ ID NO: 650578 - RNA, 19 nt, Homo sapiens
gaacaaugaauacugagaa

SEQ ID NO: 650579 - RNA, 19 nt, Homo sapiens
gcuaagagauacagagcuu

SEQ ID NO: 650580 - RNA, 19 nt, Homo sapiens
gaccugcucucuccugaaa

SEQ ID NO: 650581 - RNA, 19 nt, Homo sapiens
caaauggagagcuuucuua

SEQ ID NO: 650582 - RNA, 19 nt, Homo sapiens
guggaaaguuaguggaaua

SEQ ID NO: 650583 - RNA, 19 nt, Homo sapiens
ggaggucaccaauuacaua

SEQ ID NO: 650584 - RNA, 19 nt, Homo sapiens
gcaacgacgucgaggaguu

SEQ ID NO: 650585 - RNA, 19 nt, Homo sapiens
gaaacaacugcaauacuuu

SEQ ID NO: 650586 - RNA, 19 nt, Homo sapiens
uuaguaagguugaagcuuu

SEQ ID NO: 650587 - RNA, 19 nt, Homo sapiens
ugagugacauucuuucuga

SEQ ID NO: 650588 - RNA, 19 nt, Homo sapiens
gaaagaggcaaaugguuga

SEQ ID NO: 650589 - RNA, 19 nt, Homo sapiens
gcaaacuguuccacuguug

SEQ ID NO: 650590 - RNA, 19 nt, Homo sapiens
gagcugagguuggaaagga

SEQ ID NO: 650591 - RNA, 19 nt, Homo sapiens
ggucaccaauuacauagaa

SEQ ID NO: 650592 - RNA, 19 nt, Homo sapiens
gggcuagacuacauaaaga

SEQ ID NO: 650593 - RNA, 19 nt, Homo sapiens
gcacugaugaugaagauga

SEQ ID NO: 650594 - RNA, 19 nt, Homo sapiens
gaacagacaccuuuuauua

SEQ ID NO: 650595 - RNA, 19 nt, Homo sapiens
gaauuuggcuucaagaaca

SEQ ID NO: 650596 - RNA, 19 nt, Homo sapiens
gaaccacgcuuccuaacug

SEQ ID NO: 650597 - RNA, 19 nt, Homo sapiens
caagucuucucaagucuua

SEQ ID NO: 650598 - RNA, 19 nt, Homo sapiens
gagaggagccaauuuaaga

SEQ ID NO: 650599 - RNA, 19 nt, Homo sapiens
gggaguagcuuuguggaaa

SEQ ID NO: 650600 - RNA, 19 nt, Homo sapiens
ggaucuagaugaugaugaa

SEQ ID NO: 650601 - RNA, 19 nt, Homo sapiens
gaaaugagaggagccaauu

SEQ ID NO: 650602 - RNA, 19 nt, Homo sapiens
gcgaagaccuugccagagu

SEQ ID NO: 650603 - RNA, 19 nt, Homo sapiens
guaagugacuaaccaagau

SEQ ID NO: 650604 - RNA, 19 nt, Homo sapiens
ucuagauucuugcuacuua

SEQ ID NO: 650605 - RNA, 19 nt, Homo sapiens
gcaccaagccugauagauc

SEQ ID NO: 650606 - RNA, 19 nt, Homo sapiens
ggcaggaucuagaugauga

SEQ ID NO: 650607 - RNA, 19 nt, Homo sapiens
gcacguccacuuuaucaaa

SEQ ID NO: 650608 - RNA, 19 nt, Homo sapiens
ggauuaaugugggaauuug

SEQ ID NO: 650609 - RNA, 19 nt, Homo sapiens
gagcugggaugugcuuuga

SEQ ID NO: 650610 - RNA, 19 nt, Homo sapiens
gcaggaccauugucaagau

SEQ ID NO: 650611 - RNA, 19 nt, Homo sapiens
gaucacagagccauucuug

SEQ ID NO: 650612 - RNA, 19 nt, Homo sapiens
ugacguggaugucuugguu

SEQ ID NO: 650613 - RNA, 19 nt, Homo sapiens
ggaggagaaucccgaguuc

SEQ ID NO: 650614 - RNA, 19 nt, Homo sapiens
gcagugacguggaugucuu

SEQ ID NO: 650615 - RNA, 19 nt, Homo sapiens
gaagaaauacuugagcaau

SEQ ID NO: 650616 - RNA, 19 nt, Homo sapiens
ccacuucccuggcaguuuc

SEQ ID NO: 650617 - RNA, 19 nt, Homo sapiens
aaugagaggagccaauuua

SEQ ID NO: 650618 - RNA, 19 nt, Homo sapiens
gcugggaugugcuuugaga

SEQ ID NO: 650619 - RNA, 19 nt, Homo sapiens
ugauagaucuguauauggu

SEQ ID NO: 650620 - RNA, 19 nt, Homo sapiens
gggcaagucucacagaaac

SEQ ID NO: 650621 - RNA, 19 nt, Homo sapiens
uguggaaacugauuugaug

SEQ ID NO: 650622 - RNA, 19 nt, Homo sapiens
cgucaagucuucucaaguc

SEQ ID NO: 650623 - RNA, 19 nt, Homo sapiens
ccugauagaucuguauaug

SEQ ID NO: 650624 - RNA, 19 nt, Homo sapiens
gaagaucacagagccauuc

SEQ ID NO: 650625 - RNA, 19 nt, Homo sapiens
uaaagucgucaaaguugua

SEQ ID NO: 650626 - RNA, 19 nt, Homo sapiens
guuaaagucgucaaaguug

SEQ ID NO: 650627 - RNA, 19 nt, Homo sapiens
ccagaggcuuugcgucuau

SEQ ID NO: 650628 - RNA, 19 nt, Homo sapiens
gguuaaagucgucaaaguu

SEQ ID NO: 650629 - RNA, 19 nt, Homo sapiens
ggaaguuaccagccuguga

SEQ ID NO: 650630 - RNA, 19 nt, Homo sapiens
cgacaccagccaaccauuu

SEQ ID NO: 650631 - RNA, 19 nt, Homo sapiens
cgaagaccuugccagaguu

SEQ ID NO: 650632 - RNA, 19 nt, Homo sapiens
caccaagccugauagaucu

SEQ ID NO: 650633 - RNA, 19 nt, Homo sapiens
ggaggaagagugcaaagag

SEQ ID NO: 650634 - RNA, 19 nt, Homo sapiens
caagaacacaaccuuagga

SEQ ID NO: 650635 - RNA, 19 nt, Homo sapiens
guagcuuuguggaaacuga

SEQ ID NO: 650636 - RNA, 19 nt, Homo sapiens
ucacagagccauucuuggu

SEQ ID NO: 650637 - RNA, 19 nt, Homo sapiens
ucaaggugguggccaagga

SEQ ID NO: 650638 - RNA, 19 nt, Homo sapiens
gggaagaugaggaggaaga

SEQ ID NO: 650639 - RNA, 19 nt, Homo sapiens
ugccagaguucaucaagga

SEQ ID NO: 650640 - RNA, 19 nt, Homo sapiens
gccagaggcuuugcgucua

SEQ ID NO: 650641 - RNA, 19 nt, Homo sapiens
uagaugaugaugaacauga

SEQ ID NO: 650642 - RNA, 19 nt, Homo sapiens
gcaguuucguggaggagau

SEQ ID NO: 650643 - RNA, 19 nt, Homo sapiens
ugggugggcuccuugcaaa

SEQ ID NO: 650644 - RNA, 19 nt, Homo sapiens
caaaguuguaagugacuaa

SEQ ID NO: 650645 - RNA, 19 nt, Homo sapiens
ggaguagcuuuguggaaac

SEQ ID NO: 650646 - RNA, 19 nt, Homo sapiens
gcuacagccuggcagaucu

SEQ ID NO: 650647 - RNA, 19 nt, Homo sapiens
ggaauuuggcuucaagaac

SEQ ID NO: 650648 - RNA, 19 nt, Homo sapiens
aaaggcaggaucuagauga

SEQ ID NO: 650649 - RNA, 19 nt, Homo sapiens
gcuugaggcuguggugaug

SEQ ID NO: 650650 - RNA, 19 nt, Homo sapiens
ucaaaguuguaagugacua

SEQ ID NO: 650651 - RNA, 19 nt, Homo sapiens
uuaaagucgucaaaguugu

SEQ ID NO: 650652 - RNA, 19 nt, Homo sapiens
gauagaucuguauauggua

SEQ ID NO: 650653 - RNA, 19 nt, Homo sapiens
gcaagucucacagaaacug

SEQ ID NO: 650654 - RNA, 19 nt, Homo sapiens
ccaaaggcaggaucuagau

SEQ ID NO: 650655 - RNA, 19 nt, Homo sapiens
aaggauggcuccaguacgu

SEQ ID NO: 650656 - RNA, 19 nt, Homo sapiens
cuucucaagucuuaggauu

SEQ ID NO: 650657 - RNA, 19 nt, Homo sapiens
gaugucgacccacaggauu

SEQ ID NO: 650658 - RNA, 19 nt, Homo sapiens
gggaauuuggcuucaagaa

SEQ ID NO: 650659 - RNA, 19 nt, Homo sapiens
uggcaggguuccucucaau

SEQ ID NO: 650660 - RNA, 19 nt, Homo sapiens
uaaaagaccucgggcaagu

SEQ ID NO: 650661 - RNA, 19 nt, Homo sapiens
gcagugccaaugcugauca

SEQ ID NO: 650662 - RNA, 19 nt, Homo sapiens
ggagccaauuuaagaagac

SEQ ID NO: 650663 - RNA, 19 nt, Homo sapiens
cuucaagaacacaaccuua

SEQ ID NO: 650664 - RNA, 19 nt, Homo sapiens
caagccugauagaucugua

SEQ ID NO: 650665 - RNA, 19 nt, Homo sapiens
uaacaucucgcacgugacu

SEQ ID NO: 650666 - RNA, 19 nt, Homo sapiens
gaugaugaugaacaugauu

SEQ ID NO: 650667 - RNA, 19 nt, Homo sapiens
gaagaccuugccagaguuc

SEQ ID NO: 650668 - RNA, 19 nt, Homo sapiens
gcacaugcgcaggaccauu

SEQ ID NO: 650669 - RNA, 19 nt, Homo sapiens
ccaaugacccucagaaccu

SEQ ID NO: 650670 - RNA, 19 nt, Homo sapiens
cacaugcgcaggaccauug

SEQ ID NO: 650671 - RNA, 19 nt, Homo sapiens
ccagggcagugacguggau

SEQ ID NO: 650672 - RNA, 19 nt, Homo sapiens
gguuucaucaggugguuaa

SEQ ID NO: 650673 - RNA, 19 nt, Homo sapiens
uaagugacuaaccaagauu

SEQ ID NO: 650674 - RNA, 19 nt, Homo sapiens
ucgucaaaguuguaaguga

SEQ ID NO: 650675 - RNA, 19 nt, Homo sapiens
gcccuggcauucccugauc

SEQ ID NO: 650676 - RNA, 19 nt, Homo sapiens
cccaaaagcugguggugaa

SEQ ID NO: 650677 - RNA, 19 nt, Homo sapiens
gcgcaggaccauugucaag

SEQ ID NO: 650678 - RNA, 19 nt, Homo sapiens
caaaggcaggaucuagaug

SEQ ID NO: 650679 - RNA, 19 nt, Homo sapiens
gaggagccaauuuaagaag

SEQ ID NO: 650680 - RNA, 19 nt, Homo sapiens
cagcuuccuucagguucua

SEQ ID NO: 650681 - RNA, 19 nt, Homo sapiens
gaugaugaacaugauuaug

SEQ ID NO: 650682 - RNA, 19 nt, Homo sapiens
ucuagaugaugaugaacau

SEQ ID NO: 650683 - RNA, 19 nt, Homo sapiens
gagggaggcgucaagucuu

SEQ ID NO: 650684 - RNA, 19 nt, Homo sapiens
ugguuaaagucgucaaagu

SEQ ID NO: 650685 - RNA, 19 nt, Homo sapiens
cccacaggauugucacaga

SEQ ID NO: 650686 - RNA, 19 nt, Homo sapiens
gugggaauuuggcuucaag

SEQ ID NO: 650687 - RNA, 19 nt, Homo sapiens
ugaagaaauacuugagcaa

SEQ ID NO: 650688 - RNA, 19 nt, Homo sapiens
ggaacagacaccuuuuauu

SEQ ID NO: 650689 - RNA, 19 nt, Homo sapiens
guggaugucuugguuuguc

SEQ ID NO: 650690 - RNA, 19 nt, Homo sapiens
gugacuaaccaagauuauu

SEQ ID NO: 650691 - RNA, 19 nt, Homo sapiens
uguaagugacuaaccaaga

SEQ ID NO: 650692 - RNA, 19 nt, Homo sapiens
cagcagcgcagugccaaug

SEQ ID NO: 650693 - RNA, 19 nt, Homo sapiens
ugagggaggcgucaagucu

SEQ ID NO: 650694 - RNA, 19 nt, Homo sapiens
gaagugagauucuacuauu

SEQ ID NO: 650695 - RNA, 19 nt, Homo sapiens
uaaugaagcugaaaccuuu

SEQ ID NO: 650696 - RNA, 19 nt, Homo sapiens
guaaacccaucuuuccuua

SEQ ID NO: 650697 - RNA, 19 nt, Homo sapiens
ggaauauccugcagaagaa

SEQ ID NO: 650698 - RNA, 19 nt, Homo sapiens
caucauagcuuuauuacuc

SEQ ID NO: 650699 - RNA, 19 nt, Homo sapiens
ugacagauuugaccaguuu

SEQ ID NO: 650700 - RNA, 19 nt, Homo sapiens
gaacagaaucauccuuaaa

SEQ ID NO: 650701 - RNA, 19 nt, Homo sapiens
caucugagcuacccggaua

SEQ ID NO: 650702 - RNA, 19 nt, Homo sapiens
gaaccauacuauuugcuuu

SEQ ID NO: 650703 - RNA, 19 nt, Homo sapiens
gaacuucugaucuagauuu

SEQ ID NO: 650704 - RNA, 19 nt, Homo sapiens
guaagccugucaaaucaua

SEQ ID NO: 650705 - RNA, 19 nt, Homo sapiens
ugagugaacuucugaucua

SEQ ID NO: 650706 - RNA, 19 nt, Homo sapiens
gauauagggcauaggauua

SEQ ID NO: 650707 - RNA, 19 nt, Homo sapiens
caacuuguuucacgcuaua

SEQ ID NO: 650708 - RNA, 19 nt, Homo sapiens
gcugaaaccuuuggccuaa

SEQ ID NO: 650709 - RNA, 19 nt, Homo sapiens
gaggcaaccugaccagaaa

SEQ ID NO: 650710 - RNA, 19 nt, Homo sapiens
ccaauugguuugcuauuug

SEQ ID NO: 650711 - RNA, 19 nt, Homo sapiens
gaauuuagccuguauguac

SEQ ID NO: 650712 - RNA, 19 nt, Homo sapiens
cagaagcugucauagaauu

SEQ ID NO: 650713 - RNA, 19 nt, Homo sapiens
agaaauucaugcuggcuua

SEQ ID NO: 650714 - RNA, 19 nt, Homo sapiens
gcaguaggcuugagugaac

SEQ ID NO: 650715 - RNA, 19 nt, Homo sapiens
aaacgaaagugccauuuua

SEQ ID NO: 650716 - RNA, 19 nt, Homo sapiens
gaauggaaauuguaaagcu

SEQ ID NO: 650717 - RNA, 19 nt, Homo sapiens
caacugggcuggucuuacu

SEQ ID NO: 650718 - RNA, 19 nt, Homo sapiens
gaacaucacaguacauuuu

SEQ ID NO: 650719 - RNA, 19 nt, Homo sapiens
aagcagaaccauacuauuu

SEQ ID NO: 650720 - RNA, 19 nt, Homo sapiens
guaccagcaucauagcuuu

SEQ ID NO: 650721 - RNA, 19 nt, Homo sapiens
acaagaggcuggucugaau

SEQ ID NO: 650722 - RNA, 19 nt, Homo sapiens
ugaccaugguugaacuuua

SEQ ID NO: 650723 - RNA, 19 nt, Homo sapiens
gaccaugguugaacuuuag

SEQ ID NO: 650724 - RNA, 19 nt, Homo sapiens
guugguaacugacaaagug

SEQ ID NO: 650725 - RNA, 19 nt, Homo sapiens
ggaagcagaaccauacuau

SEQ ID NO: 650726 - RNA, 19 nt, Homo sapiens
cucagaagcugucauagaa

SEQ ID NO: 650727 - RNA, 19 nt, Homo sapiens
cagcaucauagcuuuauua

SEQ ID NO: 650728 - RNA, 19 nt, Homo sapiens
gaauagccaguacagcaua

SEQ ID NO: 650729 - RNA, 19 nt, Homo sapiens
gguuuuagaucccauaaua

SEQ ID NO: 650730 - RNA, 19 nt, Homo sapiens
ggauauagggcauaggauu

SEQ ID NO: 650731 - RNA, 19 nt, Homo sapiens
gaaaguggaaacauugguu

SEQ ID NO: 650732 - RNA, 19 nt, Homo sapiens
ucaugaaaguggaaacauu

SEQ ID NO: 650733 - RNA, 19 nt, Homo sapiens
aagauuccaugucagauaa

SEQ ID NO: 650734 - RNA, 19 nt, Homo sapiens
gaaagugccauuuuaguaa

SEQ ID NO: 650735 - RNA, 19 nt, Homo sapiens
ucaaguacuuucugacuca

SEQ ID NO: 650736 - RNA, 19 nt, Homo sapiens
ugaacagaaucauccuuaa

SEQ ID NO: 650737 - RNA, 19 nt, Homo sapiens
gaucaacuauuugccugaa

SEQ ID NO: 650738 - RNA, 19 nt, Homo sapiens
ugagcuacccggauaauuu

SEQ ID NO: 650739 - RNA, 19 nt, Homo sapiens
gacaagaagacauuaguga

SEQ ID NO: 650740 - RNA, 19 nt, Homo sapiens
ggacgaauuccaacuuguu

SEQ ID NO: 650741 - RNA, 19 nt, Homo sapiens
uagcacauuucuucacaaa

SEQ ID NO: 650742 - RNA, 19 nt, Homo sapiens
cauuaaaccucagcuguga

SEQ ID NO: 650743 - RNA, 19 nt, Homo sapiens
caagaagacauuagugaga

SEQ ID NO: 650744 - RNA, 19 nt, Homo sapiens
caugcuggcuuaaauaauc

SEQ ID NO: 650745 - RNA, 19 nt, Homo sapiens
ccucagcugugacaugaaa

SEQ ID NO: 650746 - RNA, 19 nt, Homo sapiens
caauugguuugcuauuuga

SEQ ID NO: 650747 - RNA, 19 nt, Homo sapiens
acacuaagcugugaugaag

SEQ ID NO: 650748 - RNA, 19 nt, Homo sapiens
uacaaaugcugaagugaga

SEQ ID NO: 650749 - RNA, 19 nt, Homo sapiens
cuagcuggcuguccauauu

SEQ ID NO: 650750 - RNA, 19 nt, Homo sapiens
cauggaauauccugcagaa

SEQ ID NO: 650751 - RNA, 19 nt, Homo sapiens
ugacaaagaugugcuucga

SEQ ID NO: 650752 - RNA, 19 nt, Homo sapiens
augaagacauugcccauuu

SEQ ID NO: 650753 - RNA, 19 nt, Homo sapiens
cauacaaucucagaaacuu

SEQ ID NO: 650754 - RNA, 19 nt, Homo sapiens
gcugugacaugaaagacuu

SEQ ID NO: 650755 - RNA, 19 nt, Homo sapiens
ggaggcaaccugaccagaa

SEQ ID NO: 650756 - RNA, 19 nt, Homo sapiens
agaagacauuagugagaua

SEQ ID NO: 650757 - RNA, 19 nt, Homo sapiens
cagcauacaaucucagaaa

SEQ ID NO: 650758 - RNA, 19 nt, Homo sapiens
cacacuacacguauaaaua

SEQ ID NO: 650759 - RNA, 19 nt, Homo sapiens
guuuaaagauuaccugucu

SEQ ID NO: 650760 - RNA, 19 nt, Homo sapiens
ugaaaccuuuggccuaaga

SEQ ID NO: 650761 - RNA, 19 nt, Homo sapiens
aaagauuccaugucagaua

SEQ ID NO: 650762 - RNA, 19 nt, Homo sapiens
ggcauuauccaauugguuu

SEQ ID NO: 650763 - RNA, 19 nt, Homo sapiens
gaaggcacaccacugaaau

SEQ ID NO: 650764 - RNA, 19 nt, Homo sapiens
cuucugaucuagauuugaa

SEQ ID NO: 650765 - RNA, 19 nt, Homo sapiens
uaccaagccucugggauuu

SEQ ID NO: 650766 - RNA, 19 nt, Homo sapiens
aaugacagaugacaaagau

SEQ ID NO: 650767 - RNA, 19 nt, Homo sapiens
gauaaugaacagugagaga

SEQ ID NO: 650768 - RNA, 19 nt, Homo sapiens
gaagaaugacagaugacaa

SEQ ID NO: 650769 - RNA, 19 nt, Homo sapiens
gcagaaccauacuauuugc

SEQ ID NO: 650770 - RNA, 19 nt, Homo sapiens
gaagcagaaccauacuauu

SEQ ID NO: 650771 - RNA, 19 nt, Homo sapiens
gaaugacagaugacaaaga

SEQ ID NO: 650772 - RNA, 19 nt, Homo sapiens
acuaagcugugaugaagaa

SEQ ID NO: 650773 - RNA, 19 nt, Homo sapiens
gggcuggucuuacuuugca

SEQ ID NO: 650774 - RNA, 19 nt, Homo sapiens
acagaaucauccuuaaaug

SEQ ID NO: 650775 - RNA, 19 nt, Homo sapiens
gcaauugaagcucauuuua

SEQ ID NO: 650776 - RNA, 19 nt, Homo sapiens
acaaugcccuagaggaaga

SEQ ID NO: 650777 - RNA, 19 nt, Homo sapiens
caagaggcuggucugaaua

SEQ ID NO: 650778 - RNA, 19 nt, Homo sapiens
uuacuggaguucuuauuca

SEQ ID NO: 650779 - RNA, 19 nt, Homo sapiens
uaggauuacuugucucaga

SEQ ID NO: 650780 - RNA, 19 nt, Homo sapiens
gccuguauguacugcuuua

SEQ ID NO: 650781 - RNA, 19 nt, Homo sapiens
uggaauauccugcagaaga

SEQ ID NO: 650782 - RNA, 19 nt, Homo sapiens
uaacuguucaucuuuguug

SEQ ID NO: 650783 - RNA, 19 nt, Homo sapiens
ccaagaguaaguuauuuga

SEQ ID NO: 650784 - RNA, 19 nt, Homo sapiens
cuacaaugcccuagaggaa

SEQ ID NO: 650785 - RNA, 19 nt, Homo sapiens
gagauucuacuauuguuca

SEQ ID NO: 650786 - RNA, 19 nt, Homo sapiens
ggcauaggauuacuugucu

SEQ ID NO: 650787 - RNA, 19 nt, Homo sapiens
gaaggaggagccauagcuu

SEQ ID NO: 650788 - RNA, 19 nt, Homo sapiens
gagaucuccucaaagaagu

SEQ ID NO: 650789 - RNA, 19 nt, Homo sapiens
gaaauucaugcuggcuuaa

SEQ ID NO: 650790 - RNA, 19 nt, Homo sapiens
cagauugaagugagcuuua

SEQ ID NO: 650791 - RNA, 19 nt, Homo sapiens
cauaguauccuaagcaucu

SEQ ID NO: 650792 - RNA, 19 nt, Homo sapiens
ugacagaugacaaagaugu

SEQ ID NO: 650793 - RNA, 19 nt, Homo sapiens
caugaaaguggaaacauug

SEQ ID NO: 650794 - RNA, 19 nt, Homo sapiens
gaagauaaaucgugcacua

SEQ ID NO: 650795 - RNA, 19 nt, Homo sapiens
gauauugacugcaucuuua

SEQ ID NO: 650796 - RNA, 19 nt, Homo sapiens
uaaaugagcuccuuaaaca

SEQ ID NO: 650797 - RNA, 19 nt, Homo sapiens
gaggaaagcugaucaugaa

SEQ ID NO: 650798 - RNA, 19 nt, Homo sapiens
guagaaaccuucccaauuc

SEQ ID NO: 650799 - RNA, 19 nt, Homo sapiens
ggacaugaguuuauuccua

SEQ ID NO: 650800 - RNA, 19 nt, Homo sapiens
gcaacuggcucguucaauu

SEQ ID NO: 650801 - RNA, 19 nt, Homo sapiens
ugaaagagcuccaggauca

SEQ ID NO: 650802 - RNA, 19 nt, Homo sapiens
agaaagaugugcuaaauga

SEQ ID NO: 650803 - RNA, 19 nt, Homo sapiens
gagaagaguuaaaggcuaa

SEQ ID NO: 650804 - RNA, 19 nt, Homo sapiens
ugaaagagcuggagaucaa

SEQ ID NO: 650805 - RNA, 19 nt, Homo sapiens
ugaaagaaauggagaagaa

SEQ ID NO: 650806 - RNA, 19 nt, Homo sapiens
gaagagagccagauucgaa

SEQ ID NO: 650807 - RNA, 19 nt, Homo sapiens
gaugauggcuagacacaaa

SEQ ID NO: 650808 - RNA, 19 nt, Homo sapiens
ggauaaacauggacaucua

SEQ ID NO: 650809 - RNA, 19 nt, Homo sapiens
cuaugaagcuucuuaguaa

SEQ ID NO: 650810 - RNA, 19 nt, Homo sapiens
gcacuuguauaaagccaua

SEQ ID NO: 650811 - RNA, 19 nt, Homo sapiens
gcagaaauuuccaaacaug

SEQ ID NO: 650812 - RNA, 19 nt, Homo sapiens
caggagagauuuacugauu

SEQ ID NO: 650813 - RNA, 19 nt, Homo sapiens
gcuggagacugccaaguua

SEQ ID NO: 650814 - RNA, 19 nt, Homo sapiens
ggcaaagaaucuguuauua

SEQ ID NO: 650815 - RNA, 19 nt, Homo sapiens
gagaauagaaagcuacaua

SEQ ID NO: 650816 - RNA, 19 nt, Homo sapiens
guaaagaauugcagcagaa

SEQ ID NO: 650817 - RNA, 19 nt, Homo sapiens
gggaagaaguggccucaaa

SEQ ID NO: 650818 - RNA, 19 nt, Homo sapiens
gcaacaauaugcagcaaug

SEQ ID NO: 650819 - RNA, 19 nt, Homo sapiens
ggagagauuuacugauuug

SEQ ID NO: 650820 - RNA, 19 nt, Homo sapiens
ugaagaaagucaagagauu

SEQ ID NO: 650821 - RNA, 19 nt, Homo sapiens
caacuaugcacuuguauaa

SEQ ID NO: 650822 - RNA, 19 nt, Homo sapiens
uauagcaccuugcaaagua

SEQ ID NO: 650823 - RNA, 19 nt, Homo sapiens
gaaauaagcgcagcagcua

SEQ ID NO: 650824 - RNA, 19 nt, Homo sapiens
gaucaaguaucagaaagaa

SEQ ID NO: 650825 - RNA, 19 nt, Homo sapiens
gaaggagaauagaaagcua

SEQ ID NO: 650826 - RNA, 19 nt, Homo sapiens
gagauuuacugauuuggaa

SEQ ID NO: 650827 - RNA, 19 nt, Homo sapiens
uagaauauguggccuagaa

SEQ ID NO: 650828 - RNA, 19 nt, Homo sapiens
aaacaaaccuagcuaacug

SEQ ID NO: 650829 - RNA, 19 nt, Homo sapiens
ccaaggauauuccagauuc

SEQ ID NO: 650830 - RNA, 19 nt, Homo sapiens
gaugauggguuuccagaau

SEQ ID NO: 650831 - RNA, 19 nt, Homo sapiens
cagcuggaaucuaacaaua

SEQ ID NO: 650832 - RNA, 19 nt, Homo sapiens
ucucaucugugcuuucuua

SEQ ID NO: 650833 - RNA, 19 nt, Homo sapiens
aaacaggcaugguacauug

SEQ ID NO: 650834 - RNA, 19 nt, Homo sapiens
aagagaagaucaugaaaga

SEQ ID NO: 650835 - RNA, 19 nt, Homo sapiens
agaagaagcugaacauaag

SEQ ID NO: 650836 - RNA, 19 nt, Homo sapiens
ggaugaaaccaaugcuuua

SEQ ID NO: 650837 - RNA, 19 nt, Homo sapiens
gcagaagacuaugauguug

SEQ ID NO: 650838 - RNA, 19 nt, Homo sapiens
guauaaagccauaauguug

SEQ ID NO: 650839 - RNA, 19 nt, Homo sapiens
gaagugaccauuauacugu

SEQ ID NO: 650840 - RNA, 19 nt, Homo sapiens
gaaagauguucaagagcaa

SEQ ID NO: 650841 - RNA, 19 nt, Homo sapiens
uuagggagcuuaaagaaga

SEQ ID NO: 650842 - RNA, 19 nt, Homo sapiens
gaaaguggagaaccuauug

SEQ ID NO: 650843 - RNA, 19 nt, Homo sapiens
gaagaaagagauauuaugg

SEQ ID NO: 650844 - RNA, 19 nt, Homo sapiens
gcuaugaagcuucuuagua

SEQ ID NO: 650845 - RNA, 19 nt, Homo sapiens
gcagaagguuuaugcuaug

SEQ ID NO: 650846 - RNA, 19 nt, Homo sapiens
guuagaaaccugacauuaa

SEQ ID NO: 650847 - RNA, 19 nt, Homo sapiens
gaaacuaauaggacacuaa

SEQ ID NO: 650848 - RNA, 19 nt, Homo sapiens
gcagaagaaacaggaauua

SEQ ID NO: 650849 - RNA, 19 nt, Homo sapiens
ucaaauauccacugagaaa

SEQ ID NO: 650850 - RNA, 19 nt, Homo sapiens
gagauuaccuuacggaaaa

SEQ ID NO: 650851 - RNA, 19 nt, Homo sapiens
gcauugggauaacauaaga

SEQ ID NO: 650852 - RNA, 19 nt, Homo sapiens
gcacguguaugaagaugga

SEQ ID NO: 650853 - RNA, 19 nt, Homo sapiens
ggacauucuugccguauuc

SEQ ID NO: 650854 - RNA, 19 nt, Homo sapiens
guaaagacagugacauuga

SEQ ID NO: 650855 - RNA, 19 nt, Homo sapiens
gaaacuccgucucuaccaa

SEQ ID NO: 650856 - RNA, 19 nt, Homo sapiens
gauguaaacuagcuuugug

SEQ ID NO: 650857 - RNA, 19 nt, Homo sapiens
caagggacaugaguuuauu

SEQ ID NO: 650858 - RNA, 19 nt, Homo sapiens
caaacuugguaaagaauug

SEQ ID NO: 650859 - RNA, 19 nt, Homo sapiens
gccauaauguuggaguuua

SEQ ID NO: 650860 - RNA, 19 nt, Homo sapiens
cuaaagaaauuccaaggau

SEQ ID NO: 650861 - RNA, 19 nt, Homo sapiens
gagaucaccuugaccaaag

SEQ ID NO: 650862 - RNA, 19 nt, Homo sapiens
gacagcauccuuucuuuaa

SEQ ID NO: 650863 - RNA, 19 nt, Homo sapiens
agaagacuaugauguugua

SEQ ID NO: 650864 - RNA, 19 nt, Homo sapiens
ccucaaaggcacuuaauuu

SEQ ID NO: 650865 - RNA, 19 nt, Homo sapiens
gaauugaacugcagaugac

SEQ ID NO: 650866 - RNA, 19 nt, Homo sapiens
auauggagcuuaaaucuga

SEQ ID NO: 650867 - RNA, 19 nt, Homo sapiens
aaacucaagcugugaauaa

SEQ ID NO: 650868 - RNA, 19 nt, Homo sapiens
cgaagaagccaaaucagaa

SEQ ID NO: 650869 - RNA, 19 nt, Homo sapiens
gaaagcugaucaugaagca

SEQ ID NO: 650870 - RNA, 19 nt, Homo sapiens
ugacaaaggagauguagaa

SEQ ID NO: 650871 - RNA, 19 nt, Homo sapiens
acaacaugcucuuggauaa

SEQ ID NO: 650872 - RNA, 19 nt, Homo sapiens
ggaagaaagagauauuaug

SEQ ID NO: 650873 - RNA, 19 nt, Homo sapiens
gcucuuaggauguaaacua

SEQ ID NO: 650874 - RNA, 19 nt, Homo sapiens
gauuauagcaccuugcaaa

SEQ ID NO: 650875 - RNA, 19 nt, Homo sapiens
gaauagaaagcuacauaug

SEQ ID NO: 650876 - RNA, 19 nt, Homo sapiens
agaagcagcuauuaacaga

SEQ ID NO: 650877 - RNA, 19 nt, Homo sapiens
gaacauaaggccacaaagg

SEQ ID NO: 650878 - RNA, 19 nt, Homo sapiens
gugcaaaucuguuaauacu

SEQ ID NO: 650879 - RNA, 19 nt, Homo sapiens
ggauuuaccuacuauagag

SEQ ID NO: 650880 - RNA, 19 nt, Homo sapiens
caaaggagauguagaaacc

SEQ ID NO: 650881 - RNA, 19 nt, Homo sapiens
gguaaagacauuugugauu

SEQ ID NO: 650882 - RNA, 19 nt, Homo sapiens
cuaacugccuucuaugaaa

SEQ ID NO: 650883 - RNA, 19 nt, Homo sapiens
gcaaagaaucuguuauuac

SEQ ID NO: 650884 - RNA, 19 nt, Homo sapiens
ugaaaugcaggcacaaaua

SEQ ID NO: 650885 - RNA, 19 nt, Homo sapiens
acagaaagaugugcuaaau

SEQ ID NO: 650886 - RNA, 19 nt, Homo sapiens
gaugaaggcagaagacuau

SEQ ID NO: 650887 - RNA, 19 nt, Homo sapiens
gcauuaagacaguuagaaa

SEQ ID NO: 650888 - RNA, 19 nt, Homo sapiens
gauggaaguugcauguuca

SEQ ID NO: 650889 - RNA, 19 nt, Homo sapiens
gcaacuaugcacuuguaua

SEQ ID NO: 650890 - RNA, 19 nt, Homo sapiens
ccugagagacugauacaua

SEQ ID NO: 650891 - RNA, 19 nt, Homo sapiens
ccacaagggacaugaguuu

SEQ ID NO: 650892 - RNA, 19 nt, Homo sapiens
gaaaugcaggcacaaauag

SEQ ID NO: 650893 - RNA, 19 nt, Homo sapiens
gaaagaacugaaugaaaug

SEQ ID NO: 650894 - RNA, 19 nt, Homo sapiens
aaacuucacuguugccuuu

SEQ ID NO: 650895 - RNA, 19 nt, Homo sapiens
ggaccaaguuugccauuca

SEQ ID NO: 650896 - RNA, 19 nt, Homo sapiens
ggacaagcccaucuucgua

SEQ ID NO: 650897 - RNA, 19 nt, Homo sapiens
acagggaugugcaguauuu

SEQ ID NO: 650898 - RNA, 19 nt, Homo sapiens
ccacaaaacuucacuguug

SEQ ID NO: 650899 - RNA, 19 nt, Homo sapiens
gcagucuccuuccuucuug

SEQ ID NO: 650900 - RNA, 19 nt, Homo sapiens
gaggacaagcugacuauug

SEQ ID NO: 650901 - RNA, 19 nt, Homo sapiens
gauccucggugacgucuuc

SEQ ID NO: 650902 - RNA, 19 nt, Homo sapiens
cagcagagcuccccaaguu

SEQ ID NO: 650903 - RNA, 19 nt, Homo sapiens
caaguuugccauucaauau

SEQ ID NO: 650904 - RNA, 19 nt, Homo sapiens
cuacagggaugugcaguau

SEQ ID NO: 650905 - RNA, 19 nt, Homo sapiens
ccaaguuugccauucaaua

SEQ ID NO: 650906 - RNA, 19 nt, Homo sapiens
gacacuggcuccuccaauc

SEQ ID NO: 650907 - RNA, 19 nt, Homo sapiens
gaccaaguuugccauucaa

SEQ ID NO: 650908 - RNA, 19 nt, Homo sapiens
guaccucucucgaacuaca

SEQ ID NO: 650909 - RNA, 19 nt, Homo sapiens
gcucggaaaucccaaagcu

SEQ ID NO: 650910 - RNA, 19 nt, Homo sapiens
aauccacuauuuccauuga

SEQ ID NO: 650911 - RNA, 19 nt, Homo sapiens
ccgcaucccucuucaucga

SEQ ID NO: 650912 - RNA, 19 nt, Homo sapiens
gagcaggggcuauuggaua

SEQ ID NO: 650913 - RNA, 19 nt, Homo sapiens
cauccagacuacucgaaau

SEQ ID NO: 650914 - RNA, 19 nt, Homo sapiens
ggauauugggccucgguuu

SEQ ID NO: 650915 - RNA, 19 nt, Homo sapiens
aggacaagcugacuauugg

SEQ ID NO: 650916 - RNA, 19 nt, Homo sapiens
gcgaggacaagcugacuau

SEQ ID NO: 650917 - RNA, 19 nt, Homo sapiens
caggagaugccacuucuuc

SEQ ID NO: 650918 - RNA, 19 nt, Homo sapiens
gaaucaagggugcaucagu

SEQ ID NO: 650919 - RNA, 19 nt, Homo sapiens
cagugugcccugcugguua

SEQ ID NO: 650920 - RNA, 19 nt, Homo sapiens
gagaugccacuucuucagu

SEQ ID NO: 650921 - RNA, 19 nt, Homo sapiens
ucguaccucucucgaacua

SEQ ID NO: 650922 - RNA, 19 nt, Homo sapiens
gauuacgucauccagacua

SEQ ID NO: 650923 - RNA, 19 nt, Homo sapiens
gacuauugguggaaucaag

SEQ ID NO: 650924 - RNA, 19 nt, Homo sapiens
gagguccugcuacccagua

SEQ ID NO: 650925 - RNA, 19 nt, Homo sapiens
gccaaugggaccaaguuug

SEQ ID NO: 650926 - RNA, 19 nt, Homo sapiens
ggacccggcacacuacauc

SEQ ID NO: 650927 - RNA, 19 nt, Homo sapiens
gauauugggccucgguuuu

SEQ ID NO: 650928 - RNA, 19 nt, Homo sapiens
ggagaugccacuucuucag

SEQ ID NO: 650929 - RNA, 19 nt, Homo sapiens
gggcacgucccucaucaca

SEQ ID NO: 650930 - RNA, 19 nt, Homo sapiens
gggaccaaguuugccauuc

SEQ ID NO: 650931 - RNA, 19 nt, Homo sapiens
ccaaugggaccaaguuugc

SEQ ID NO: 650932 - RNA, 19 nt, Homo sapiens
gggacaagcccaucuucgu

SEQ ID NO: 650933 - RNA, 19 nt, Homo sapiens
uuacaccaccgauuugauc

SEQ ID NO: 650934 - RNA, 19 nt, Homo sapiens
gcugggaacgccuccacaa

SEQ ID NO: 650935 - RNA, 19 nt, Homo sapiens
gcugcugccucugcugaau

SEQ ID NO: 650936 - RNA, 19 nt, Homo sapiens
uggauaagccugucuucuc

SEQ ID NO: 650937 - RNA, 19 nt, Homo sapiens
ggccaaugggaccaaguuu

SEQ ID NO: 650938 - RNA, 19 nt, Homo sapiens
ccucacggcccaugauuac

SEQ ID NO: 650939 - RNA, 19 nt, Homo sapiens
gaacgccuccacaaaacuu

SEQ ID NO: 650940 - RNA, 19 nt, Homo sapiens
gcagucaugugcugaguua

SEQ ID NO: 650941 - RNA, 19 nt, Homo sapiens
gaaggcaucuaaagagaaa

SEQ ID NO: 650942 - RNA, 19 nt, Homo sapiens
gagaauggcccuugccuua

SEQ ID NO: 650943 - RNA, 19 nt, Homo sapiens
gaauguauguacuguauug

SEQ ID NO: 650944 - RNA, 19 nt, Homo sapiens
gcuauaagaucgaaguuug

SEQ ID NO: 650945 - RNA, 19 nt, Homo sapiens
gaaccugucaucuguauuu

SEQ ID NO: 650946 - RNA, 19 nt, Homo sapiens
gaaauauucauccagguua

SEQ ID NO: 650947 - RNA, 19 nt, Homo sapiens
gaauggcccuugccuuauu

SEQ ID NO: 650948 - RNA, 19 nt, Homo sapiens
ggauugugcuguaauaaga

SEQ ID NO: 650949 - RNA, 19 nt, Homo sapiens
gaucaaagcagacucauca

SEQ ID NO: 650950 - RNA, 19 nt, Homo sapiens
gaaguuaauuccacaccuu

SEQ ID NO: 650951 - RNA, 19 nt, Homo sapiens
gaagugauuugcgaauuga

SEQ ID NO: 650952 - RNA, 19 nt, Homo sapiens
gaacuuuguuuccuucugu

SEQ ID NO: 650953 - RNA, 19 nt, Homo sapiens
gagauggucuuggagaauu

SEQ ID NO: 650954 - RNA, 19 nt, Homo sapiens
guuaauggcuucuguuaca

SEQ ID NO: 650955 - RNA, 19 nt, Homo sapiens
ggacauagaaccucuuauc

SEQ ID NO: 650956 - RNA, 19 nt, Homo sapiens
acacagagauggucuugga

SEQ ID NO: 650957 - RNA, 19 nt, Homo sapiens
gaaaucuccuucugacauc

SEQ ID NO: 650958 - RNA, 19 nt, Homo sapiens
aggcacaacugguuugaua

SEQ ID NO: 650959 - RNA, 19 nt, Homo sapiens
gugaauguauguacuguau

SEQ ID NO: 650960 - RNA, 19 nt, Homo sapiens
gaugaaagacaauuugguu

SEQ ID NO: 650961 - RNA, 19 nt, Homo sapiens
ccgggaagcugauguaugu

SEQ ID NO: 650962 - RNA, 19 nt, Homo sapiens
ugaagugauuugcgaauug

SEQ ID NO: 650963 - RNA, 19 nt, Homo sapiens
ggagaauugugaauguaug

SEQ ID NO: 650964 - RNA, 19 nt, Homo sapiens
ccucaagaaugguaauuau

SEQ ID NO: 650965 - RNA, 19 nt, Homo sapiens
cagauaccaugguccagua

SEQ ID NO: 650966 - RNA, 19 nt, Homo sapiens
gauacugucccuuauuuga

SEQ ID NO: 650967 - RNA, 19 nt, Homo sapiens
ggauguggcugggcuucua

SEQ ID NO: 650968 - RNA, 19 nt, Homo sapiens
ggaaugucccugccuggua

SEQ ID NO: 650969 - RNA, 19 nt, Homo sapiens
gaucuuaggguuagaauac

SEQ ID NO: 650970 - RNA, 19 nt, Homo sapiens
ggagucugcugcucgaguu

SEQ ID NO: 650971 - RNA, 19 nt, Homo sapiens
gcaagaguguucagcaaac

SEQ ID NO: 650972 - RNA, 19 nt, Homo sapiens
uaauaccuccuguaacuaa

SEQ ID NO: 650973 - RNA, 19 nt, Homo sapiens
guagaaggcacaacugguu

SEQ ID NO: 650974 - RNA, 19 nt, Homo sapiens
uggcugggcuucuauccua

SEQ ID NO: 650975 - RNA, 19 nt, Homo sapiens
gggcaagaguguucagcaa

SEQ ID NO: 650976 - RNA, 19 nt, Homo sapiens
acauggaacucuucaacaa

SEQ ID NO: 650977 - RNA, 19 nt, Homo sapiens
caacuuugaugugcuuaug

SEQ ID NO: 650978 - RNA, 19 nt, Homo sapiens
uaaagccucugcaacaagu

SEQ ID NO: 650979 - RNA, 19 nt, Homo sapiens
caauggacgugcccaggaa

SEQ ID NO: 650980 - RNA, 19 nt, Homo sapiens
caagaugaaagacaauuug

SEQ ID NO: 650981 - RNA, 19 nt, Homo sapiens
uaugaagaguggagaaguu

SEQ ID NO: 650982 - RNA, 19 nt, Homo sapiens
aggauacugucccuuauuu

SEQ ID NO: 650983 - RNA, 19 nt, Homo sapiens
ucccuucuguugugaaaua

SEQ ID NO: 650984 - RNA, 19 nt, Homo sapiens
gcucaguucaguaccauaa

SEQ ID NO: 650985 - RNA, 19 nt, Homo sapiens
ggucauguuucccuucuag

SEQ ID NO: 650986 - RNA, 19 nt, Homo sapiens
caauuugguugcugagaug

SEQ ID NO: 650987 - RNA, 19 nt, Homo sapiens
uaauagagagguaaucaga

SEQ ID NO: 650988 - RNA, 19 nt, Homo sapiens
aaagagaugcugggacaua

SEQ ID NO: 650989 - RNA, 19 nt, Homo sapiens
ugacaucuuucccuucugu

SEQ ID NO: 650990 - RNA, 19 nt, Homo sapiens
gaaugguaauuaugaagag

SEQ ID NO: 650991 - RNA, 19 nt, Homo sapiens
gcuaaggccagcaagauug

SEQ ID NO: 650992 - RNA, 19 nt, Homo sapiens
cagagccgcuuugagcuaa

SEQ ID NO: 650993 - RNA, 19 nt, Homo sapiens
ucuacaagguuaucaggaa

SEQ ID NO: 650994 - RNA, 19 nt, Homo sapiens
auagagagguaaucagaug

SEQ ID NO: 650995 - RNA, 19 nt, Homo sapiens
ccuguuugcugaagugauu

SEQ ID NO: 650996 - RNA, 19 nt, Homo sapiens
gaagcucaguucaguacca

SEQ ID NO: 650997 - RNA, 19 nt, Homo sapiens
uuccacaccuuucgucuaa

SEQ ID NO: 650998 - RNA, 19 nt, Homo sapiens
gagguaaucagauggucua

SEQ ID NO: 650999 - RNA, 19 nt, Homo sapiens
aggccaaacugcuauaaga

SEQ ID NO: 651000 - RNA, 19 nt, Homo sapiens
gguguugccugaguccuuu

SEQ ID NO: 651001 - RNA, 19 nt, Homo sapiens
cgucuaagucucaguauug

SEQ ID NO: 651002 - RNA, 19 nt, Homo sapiens
ggaaugcuuuuggcuguua

SEQ ID NO: 651003 - RNA, 19 nt, Homo sapiens
gaaagacaauuugguugcu

SEQ ID NO: 651004 - RNA, 19 nt, Homo sapiens
agauuuaacucuacaaggu

SEQ ID NO: 651005 - RNA, 19 nt, Homo sapiens
cagagauggucuuggagaa

SEQ ID NO: 651006 - RNA, 19 nt, Homo sapiens
uaaccuugauauacacaga

SEQ ID NO: 651007 - RNA, 19 nt, Homo sapiens
uuuguuuccuucugucuua

SEQ ID NO: 651008 - RNA, 19 nt, Homo sapiens
gcacaacugguuugauagu

SEQ ID NO: 651009 - RNA, 19 nt, Homo sapiens
ggaagcugauguaugugau

SEQ ID NO: 651010 - RNA, 19 nt, Homo sapiens
gcaguuaauaccuccugua

SEQ ID NO: 651011 - RNA, 19 nt, Homo sapiens
gggauucugugacuacaag

SEQ ID NO: 651012 - RNA, 19 nt, Homo sapiens
uagggcagauuuaacucua

SEQ ID NO: 651013 - RNA, 19 nt, Homo sapiens
acaggaagcucaguucagu

SEQ ID NO: 651014 - RNA, 19 nt, Homo sapiens
ccacaccuuucgucuaagu

SEQ ID NO: 651015 - RNA, 19 nt, Homo sapiens
caguuaauggcuucuguua

SEQ ID NO: 651016 - RNA, 19 nt, Homo sapiens
ccucuuaucugggcaguca

SEQ ID NO: 651017 - RNA, 19 nt, Homo sapiens
gagaugcugggacauagaa

SEQ ID NO: 651018 - RNA, 19 nt, Homo sapiens
gauuuggccuguccucaag

SEQ ID NO: 651019 - RNA, 19 nt, Homo sapiens
gggaagcugauguauguga

SEQ ID NO: 651020 - RNA, 19 nt, Homo sapiens
uccaagugcucagaucuaa

SEQ ID NO: 651021 - RNA, 19 nt, Homo sapiens
uugcugagaugcaguuaau

SEQ ID NO: 651022 - RNA, 19 nt, Homo sapiens
gggcagauuuaacucuaca

SEQ ID NO: 651023 - RNA, 19 nt, Homo sapiens
uccuagagauggaguagaa

SEQ ID NO: 651024 - RNA, 19 nt, Homo sapiens
ucuaaagccucugcaacaa

SEQ ID NO: 651025 - RNA, 19 nt, Homo sapiens
caguuaauaccuccuguaa

SEQ ID NO: 651026 - RNA, 19 nt, Homo sapiens
ugacuugugugucccagau

SEQ ID NO: 651027 - RNA, 19 nt, Homo sapiens
gauggucuagggcagauuu

SEQ ID NO: 651028 - RNA, 19 nt, Homo sapiens
ucaguaccauaacuacaga

SEQ ID NO: 651029 - RNA, 19 nt, Homo sapiens
caagucaggugguggucau

SEQ ID NO: 651030 - RNA, 19 nt, Homo sapiens
caagugcucagaucuaaag

SEQ ID NO: 651031 - RNA, 19 nt, Homo sapiens
uguauguacuguauuguca

SEQ ID NO: 651032 - RNA, 19 nt, Homo sapiens
ugagcucuuucuccuguuu

SEQ ID NO: 651033 - RNA, 19 nt, Homo sapiens
ugaaaucuccuucugacau

SEQ ID NO: 651034 - RNA, 19 nt, Homo sapiens
gaagaguggagaaguuugg

SEQ ID NO: 651035 - RNA, 19 nt, Homo sapiens
ggauuuggccuguccucaa

SEQ ID NO: 651036 - RNA, 19 nt, Homo sapiens
cauguuucccuucuaguuu

SEQ ID NO: 651037 - RNA, 19 nt, Homo sapiens
uagaauacuugacccugau

SEQ ID NO: 651038 - RNA, 19 nt, Homo sapiens
gcuuuuggcuguuauuuug

SEQ ID NO: 651039 - RNA, 19 nt, Homo sapiens
acuacaagaugaaagacaa

SEQ ID NO: 651040 - RNA, 19 nt, Homo sapiens
gaaccuggguggccaugua

SEQ ID NO: 651041 - RNA, 19 nt, Homo sapiens
gggcaacugugucaaguau

SEQ ID NO: 651042 - RNA, 19 nt, Homo sapiens
cgagaggccuucagagaau

SEQ ID NO: 651043 - RNA, 19 nt, Homo sapiens
gcagauaugauugguguaa

SEQ ID NO: 651044 - RNA, 19 nt, Homo sapiens
gcagagacagcagauauga

SEQ ID NO: 651045 - RNA, 19 nt, Homo sapiens
ucagagaauucgacaagga

SEQ ID NO: 651046 - RNA, 19 nt, Homo sapiens
ucaaguauccacugagaaa

SEQ ID NO: 651047 - RNA, 19 nt, Homo sapiens
guaaaggaacugcgagaug

SEQ ID NO: 651048 - RNA, 19 nt, Homo sapiens
gaguggacuuugaagaguu

SEQ ID NO: 651049 - RNA, 19 nt, Homo sapiens
agagacagcagauaugauu

SEQ ID NO: 651050 - RNA, 19 nt, Homo sapiens
uaugauugguguaaaggaa

SEQ ID NO: 651051 - RNA, 19 nt, Homo sapiens
gaacugucccagcagauca

SEQ ID NO: 651052 - RNA, 19 nt, Homo sapiens
agacauagaggaaauuauc

SEQ ID NO: 651053 - RNA, 19 nt, Homo sapiens
gagaggccuucagagaauu

SEQ ID NO: 651054 - RNA, 19 nt, Homo sapiens
gaccagaggaaauugaaga

SEQ ID NO: 651055 - RNA, 19 nt, Homo sapiens
ugucaaguauccacugaga

SEQ ID NO: 651056 - RNA, 19 nt, Homo sapiens
gcaacugugucaaguaucc

SEQ ID NO: 651057 - RNA, 19 nt, Homo sapiens
gccgagagcccaggaugua

SEQ ID NO: 651058 - RNA, 19 nt, Homo sapiens
cgagacauagaggaaauua

SEQ ID NO: 651059 - RNA, 19 nt, Homo sapiens
gaagaguuuguccggauga

SEQ ID NO: 651060 - RNA, 19 nt, Homo sapiens
ggaagcuccugggucauca

SEQ ID NO: 651061 - RNA, 19 nt, Homo sapiens
ggacugccaagcucccaaa

SEQ ID NO: 651062 - RNA, 19 nt, Homo sapiens
gagaugcuuuccgagaguu

SEQ ID NO: 651063 - RNA, 19 nt, Homo sapiens
cagauaugauugguguaaa

SEQ ID NO: 651064 - RNA, 19 nt, Homo sapiens
gaggaaauuauccgagaug

SEQ ID NO: 651065 - RNA, 19 nt, Homo sapiens
cccagcagaucaacaugaa

SEQ ID NO: 651066 - RNA, 19 nt, Homo sapiens
cgaguggacuuugaagagu

SEQ ID NO: 651067 - RNA, 19 nt, Homo sapiens
ggaaauuauccgagaugug

SEQ ID NO: 651068 - RNA, 19 nt, Homo sapiens
ccaccgagauggagcucau

SEQ ID NO: 651069 - RNA, 19 nt, Homo sapiens
cgagaugcuuuccgagagu

SEQ ID NO: 651070 - RNA, 19 nt, Homo sapiens
ccgagaggccuucagagaa

SEQ ID NO: 651071 - RNA, 19 nt, Homo sapiens
gaguuuguccggaugaugu

SEQ ID NO: 651072 - RNA, 19 nt, Homo sapiens
uggcagagacagcagauau

SEQ ID NO: 651073 - RNA, 19 nt, Homo sapiens
ggauggacgaguggacuuu

SEQ ID NO: 651074 - RNA, 19 nt, Homo sapiens
gggaaauaagcaccaguga

SEQ ID NO: 651075 - RNA, 19 nt, Homo sapiens
agauaugauugguguaaag

SEQ ID NO: 651076 - RNA, 19 nt, Homo sapiens
cuacaugcccaccgagaug

SEQ ID NO: 651077 - RNA, 19 nt, Homo sapiens
aguggacuuugaagaguuu

SEQ ID NO: 651078 - RNA, 19 nt, Homo sapiens
gagcugcgagaggcuauga

SEQ ID NO: 651079 - RNA, 19 nt, Homo sapiens
gcuccgagaggccuucaga

SEQ ID NO: 651080 - RNA, 19 nt, Homo sapiens
gagaauucgacaaggacaa

SEQ ID NO: 651081 - RNA, 19 nt, Homo sapiens
gagaggcuaugaggaagcu

SEQ ID NO: 651082 - RNA, 19 nt, Homo sapiens
caauggugauggggaaaua

SEQ ID NO: 651083 - RNA, 19 nt, Homo sapiens
uccgagaguuugacaccaa

SEQ ID NO: 651084 - RNA, 19 nt, Homo sapiens
gcgaccagaggaaauugaa

SEQ ID NO: 651085 - RNA, 19 nt, Homo sapiens
ugugucaaguauccacuga

SEQ ID NO: 651086 - RNA, 19 nt, Homo sapiens
gagauguggaccucaaugg

SEQ ID NO: 651087 - RNA, 19 nt, Homo sapiens
acaccgagacauagaggaa

SEQ ID NO: 651088 - RNA, 19 nt, Homo sapiens
gagacagcagauaugauug

SEQ ID NO: 651089 - RNA, 19 nt, Homo sapiens
gcaacugcaugcgcaccau

SEQ ID NO: 651090 - RNA, 19 nt, Homo sapiens
ggaacugcgagaugcuuuc

SEQ ID NO: 651091 - RNA, 19 nt, Homo sapiens
ucacugcgaccagaggaaa

SEQ ID NO: 651092 - RNA, 19 nt, Homo sapiens
agaggaaauuauccgagau

SEQ ID NO: 651093 - RNA, 19 nt, Homo sapiens
gagacauagaggaaauuau

SEQ ID NO: 651094 - RNA, 19 nt, Homo sapiens
gacagcagauaugauuggu

SEQ ID NO: 651095 - RNA, 19 nt, Homo sapiens
caacuuaggaugggcaacu

SEQ ID NO: 651096 - RNA, 19 nt, Homo sapiens
ggcagagacagcagauaug

SEQ ID NO: 651097 - RNA, 19 nt, Homo sapiens
ccuaaacuccuggcagaga

SEQ ID NO: 651098 - RNA, 19 nt, Homo sapiens
gacgaguggacuuugaaga

SEQ ID NO: 651099 - RNA, 19 nt, Homo sapiens
ggacgaguggacuuugaag

SEQ ID NO: 651100 - RNA, 19 nt, Homo sapiens
gaugggcaacugugucaag

SEQ ID NO: 651101 - RNA, 19 nt, Homo sapiens
gaaccuggguggccaugua

SEQ ID NO: 651102 - RNA, 19 nt, Homo sapiens
agaaaucucucaaggaaga

SEQ ID NO: 651103 - RNA, 19 nt, Homo sapiens
gggcaacugugucaaguau

SEQ ID NO: 651104 - RNA, 19 nt, Homo sapiens
cgagaggccuucagagaau

SEQ ID NO: 651105 - RNA, 19 nt, Homo sapiens
gcagauaugauugguguaa

SEQ ID NO: 651106 - RNA, 19 nt, Homo sapiens
gcaagggcuucgcugagaa

SEQ ID NO: 651107 - RNA, 19 nt, Homo sapiens
gcagagacagcagauauga

SEQ ID NO: 651108 - RNA, 19 nt, Homo sapiens
ucagagaauucgacaagga

SEQ ID NO: 651109 - RNA, 19 nt, Homo sapiens
ucaaguauccacugagaaa

SEQ ID NO: 651110 - RNA, 19 nt, Homo sapiens
guaaaggaacugcgagaug

SEQ ID NO: 651111 - RNA, 19 nt, Homo sapiens
gaguggacuuugaagaguu

SEQ ID NO: 651112 - RNA, 19 nt, Homo sapiens
agagacagcagauaugauu

SEQ ID NO: 651113 - RNA, 19 nt, Homo sapiens
uaugauugguguaaaggaa

SEQ ID NO: 651114 - RNA, 19 nt, Homo sapiens
gaacugucccagcagauca

SEQ ID NO: 651115 - RNA, 19 nt, Homo sapiens
agacauagaggaaauuauc

SEQ ID NO: 651116 - RNA, 19 nt, Homo sapiens
gagaggccuucagagaauu

SEQ ID NO: 651117 - RNA, 19 nt, Homo sapiens
gaccagaggaaauugaaga

SEQ ID NO: 651118 - RNA, 19 nt, Homo sapiens
gaagaugugccaggaggaa

SEQ ID NO: 651119 - RNA, 19 nt, Homo sapiens
ugucaaguauccacugaga

SEQ ID NO: 651120 - RNA, 19 nt, Homo sapiens
gcaacugugucaaguaucc

SEQ ID NO: 651121 - RNA, 19 nt, Homo sapiens
gccgagagcccaggaugua

SEQ ID NO: 651122 - RNA, 19 nt, Homo sapiens
cgagacauagaggaaauua

SEQ ID NO: 651123 - RNA, 19 nt, Homo sapiens
ggaacagaccagcuacaug

SEQ ID NO: 651124 - RNA, 19 nt, Homo sapiens
gaagaguuuguccggauga

SEQ ID NO: 651125 - RNA, 19 nt, Homo sapiens
ggaagcuccugggucauca

SEQ ID NO: 651126 - RNA, 19 nt, Homo sapiens
ggacugccaagcucccaaa

SEQ ID NO: 651127 - RNA, 19 nt, Homo sapiens
gagaugcuuuccgagaguu

SEQ ID NO: 651128 - RNA, 19 nt, Homo sapiens
cagauaugauugguguaaa

SEQ ID NO: 651129 - RNA, 19 nt, Homo sapiens
gaggaaauuauccgagaug

SEQ ID NO: 651130 - RNA, 19 nt, Homo sapiens
cccagcagaucaacaugaa

SEQ ID NO: 651131 - RNA, 19 nt, Homo sapiens
cgaguggacuuugaagagu

SEQ ID NO: 651132 - RNA, 19 nt, Homo sapiens
ggaaauuauccgagaugug

SEQ ID NO: 651133 - RNA, 19 nt, Homo sapiens
ccaccgagauggagcucau

SEQ ID NO: 651134 - RNA, 19 nt, Homo sapiens
cgagaugcuuuccgagagu

SEQ ID NO: 651135 - RNA, 19 nt, Homo sapiens
ccgagaggccuucagagaa

SEQ ID NO: 651136 - RNA, 19 nt, Homo sapiens
cgcaagggcuucgcugaga

SEQ ID NO: 651137 - RNA, 19 nt, Homo sapiens
gaguuuguccggaugaugu

SEQ ID NO: 651138 - RNA, 19 nt, Homo sapiens
uggcagagacagcagauau

SEQ ID NO: 651139 - RNA, 19 nt, Homo sapiens
ggauggacgaguggacuuu

SEQ ID NO: 651140 - RNA, 19 nt, Homo sapiens
gggaaauaagcaccaguga

SEQ ID NO: 651141 - RNA, 19 nt, Homo sapiens
agauaugauugguguaaag

SEQ ID NO: 651142 - RNA, 19 nt, Homo sapiens
cuacaugcccaccgagaug

SEQ ID NO: 651143 - RNA, 19 nt, Homo sapiens
aguggacuuugaagaguuu

SEQ ID NO: 651144 - RNA, 19 nt, Homo sapiens
gagcugcgagaggcuauga

SEQ ID NO: 651145 - RNA, 19 nt, Homo sapiens
gcuccgagaggccuucaga

SEQ ID NO: 651146 - RNA, 19 nt, Homo sapiens
gagaauucgacaaggacaa

SEQ ID NO: 651147 - RNA, 19 nt, Homo sapiens
gagaggcuaugaggaagcu

SEQ ID NO: 651148 - RNA, 19 nt, Homo sapiens
caauggugauggggaaaua

SEQ ID NO: 651149 - RNA, 19 nt, Homo sapiens
uccgagaguuugacaccaa

SEQ ID NO: 651150 - RNA, 19 nt, Homo sapiens
gcgaccagaggaaauugaa

SEQ ID NO: 651151 - RNA, 19 nt, Homo sapiens
ugugucaaguauccacuga

SEQ ID NO: 651152 - RNA, 19 nt, Homo sapiens
gagauguggaccucaaugg

SEQ ID NO: 651153 - RNA, 19 nt, Homo sapiens
acaccgagacauagaggaa

SEQ ID NO: 651154 - RNA, 19 nt, Homo sapiens
gagacagcagauaugauug

SEQ ID NO: 651155 - RNA, 19 nt, Homo sapiens
gcaacugcaugcgcaccau

SEQ ID NO: 651156 - RNA, 19 nt, Homo sapiens
ucacugcgaccagaggaaa

SEQ ID NO: 651157 - RNA, 19 nt, Homo sapiens
ggaacugcgagaugcuuuc

SEQ ID NO: 651158 - RNA, 19 nt, Homo sapiens
agaggaaauuauccgagau

SEQ ID NO: 651159 - RNA, 19 nt, Homo sapiens
gagacauagaggaaauuau

SEQ ID NO: 651160 - RNA, 19 nt, Homo sapiens
caacuuaggaugggcaacu

SEQ ID NO: 651161 - RNA, 19 nt, Homo sapiens
gacagcagauaugauuggu

SEQ ID NO: 651162 - RNA, 19 nt, Homo sapiens
ggcagagacagcagauaug

SEQ ID NO: 651163 - RNA, 19 nt, Homo sapiens
ccuaaacuccuggcagaga

SEQ ID NO: 651164 - RNA, 19 nt, Homo sapiens
gaugggcaacugugucaag

SEQ ID NO: 651165 - RNA, 19 nt, Homo sapiens
gacgaguggacuuugaaga

SEQ ID NO: 651166 - RNA, 19 nt, Homo sapiens
ggacgaguggacuuugaag

SEQ ID NO: 651167 - RNA, 19 nt, Homo sapiens
gaauaaauguagccacuuu

SEQ ID NO: 651168 - RNA, 19 nt, Homo sapiens
gcaaaugcaguuuauugua

SEQ ID NO: 651169 - RNA, 19 nt, Homo sapiens
ggagagcauuccagcaguu

SEQ ID NO: 651170 - RNA, 19 nt, Homo sapiens
guacgaggccuacaacaug

SEQ ID NO: 651171 - RNA, 19 nt, Homo sapiens
caggacacacugaauaaua

SEQ ID NO: 651172 - RNA, 19 nt, Homo sapiens
aggacacacugaauaauaa

SEQ ID NO: 651173 - RNA, 19 nt, Homo sapiens
caaagaacaacaaguacuu

SEQ ID NO: 651174 - RNA, 19 nt, Homo sapiens
ccagcgcccuguccuauga

SEQ ID NO: 651175 - RNA, 19 nt, Homo sapiens
gagaggcaaaugcaguuua

SEQ ID NO: 651176 - RNA, 19 nt, Homo sapiens
cccaaggacuuuccaguga

SEQ ID NO: 651177 - RNA, 19 nt, Homo sapiens
gauaucauccaaagaacaa

SEQ ID NO: 651178 - RNA, 19 nt, Homo sapiens
uggaggaguuugaggauga

SEQ ID NO: 651179 - RNA, 19 nt, Homo sapiens
ucgcuucgccucccaauuu

SEQ ID NO: 651180 - RNA, 19 nt, Homo sapiens
gcuccaggcugaagacuac

SEQ ID NO: 651181 - RNA, 19 nt, Homo sapiens
ccaccacgcucaaccucuu

SEQ ID NO: 651182 - RNA, 19 nt, Homo sapiens
gggcuguucuccugcauca

SEQ ID NO: 651183 - RNA, 19 nt, Homo sapiens
ggaugacccucugcuagug

SEQ ID NO: 651184 - RNA, 19 nt, Homo sapiens
agaggcaaaugcaguuuau

SEQ ID NO: 651185 - RNA, 19 nt, Homo sapiens
gagcauuccagcaguucua

SEQ ID NO: 651186 - RNA, 19 nt, Homo sapiens
gagaauggcggagcgagaa

SEQ ID NO: 651187 - RNA, 19 nt, Homo sapiens
ccaagaaauuccugaacgu

SEQ ID NO: 651188 - RNA, 19 nt, Homo sapiens
agaaauuccugaacgucuu

SEQ ID NO: 651189 - RNA, 19 nt, Homo sapiens
uaauaauucucugggcaaa

SEQ ID NO: 651190 - RNA, 19 nt, Homo sapiens
ccaaggagcccgagcacau

SEQ ID NO: 651191 - RNA, 19 nt, Homo sapiens
ggaggaguuugaggaugaa

SEQ ID NO: 651192 - RNA, 19 nt, Homo sapiens
ggacuccacgccugaugaa

SEQ ID NO: 651193 - RNA, 19 nt, Homo sapiens
ccucugugcugcuaugcaa

SEQ ID NO: 651194 - RNA, 19 nt, Homo sapiens
ggacacacugaauaauaau

SEQ ID NO: 651195 - RNA, 19 nt, Homo sapiens
gcaguucuacaagcaguuu

SEQ ID NO: 651196 - RNA, 19 nt, Homo sapiens
gaaauuccugaacgucuuc

SEQ ID NO: 651197 - RNA, 19 nt, Homo sapiens
cagcacagccacccagaug

SEQ ID NO: 651198 - RNA, 19 nt, Homo sapiens
acacgcuggugguagauga

SEQ ID NO: 651199 - RNA, 19 nt, Homo sapiens
aaagugccauuuccugucu

SEQ ID NO: 651200 - RNA, 19 nt, Homo sapiens
caaguacacgcugguggua

SEQ ID NO: 651201 - RNA, 19 nt, Homo sapiens
gcagacaccaccgcaugaa

SEQ ID NO: 651202 - RNA, 19 nt, Homo sapiens
ccgagaugcugcagaugga

SEQ ID NO: 651203 - RNA, 19 nt, Homo sapiens
ggcaaaugcaguuuauugu

SEQ ID NO: 651204 - RNA, 19 nt, Homo sapiens
aggcaaaugcaguuuauug

SEQ ID NO: 651205 - RNA, 19 nt, Homo sapiens
cggcucaccgugcacuuua

SEQ ID NO: 651206 - RNA, 19 nt, Homo sapiens
guuugugccucgacacgaa

SEQ ID NO: 651207 - RNA, 19 nt, Homo sapiens
caccgucuaugacaacugu

SEQ ID NO: 651208 - RNA, 19 nt, Homo sapiens
agacuacagugacgagagu

SEQ ID NO: 651209 - RNA, 19 nt, Homo sapiens
ggagaggcaaaugcaguuu

SEQ ID NO: 651210 - RNA, 19 nt, Homo sapiens
gggagaggcaaaugcaguu

SEQ ID NO: 651211 - RNA, 19 nt, Homo sapiens
ucugaagacuccaccaaag

SEQ ID NO: 651212 - RNA, 19 nt, Homo sapiens
ggugguagaugagcaugca

SEQ ID NO: 651213 - RNA, 19 nt, Homo sapiens
agacgaacuugagcuggaa

SEQ ID NO: 651214 - RNA, 19 nt, Homo sapiens
ggaauaaauguagccacuu

SEQ ID NO: 651215 - RNA, 19 nt, Homo sapiens
gggcaaugacguccucugu

SEQ ID NO: 651216 - RNA, 19 nt, Homo sapiens
caaguacuuuggguucauc

SEQ ID NO: 651217 - RNA, 19 nt, Homo sapiens
auccaaagaacaacaagua

SEQ ID NO: 651218 - RNA, 19 nt, Homo sapiens
caguccagguucccuauca

SEQ ID NO: 651219 - RNA, 19 nt, Homo sapiens
gguacgaggccuacaacau

SEQ ID NO: 651220 - RNA, 19 nt, Homo sapiens
gacguccucugugcugcua

SEQ ID NO: 651221 - RNA, 19 nt, Homo sapiens
ccaggccgaugugcgacua

SEQ ID NO: 651222 - RNA, 19 nt, Homo sapiens
ccacgucuuugugucugaa

SEQ ID NO: 651223 - RNA, 19 nt, Homo sapiens
ccaaagaacaacaaguacu

SEQ ID NO: 651224 - RNA, 19 nt, Homo sapiens
gugucuuuccugccuauua

SEQ ID NO: 651225 - RNA, 19 nt, Homo sapiens
gcuguucuccugcaucauc

SEQ ID NO: 651226 - RNA, 19 nt, Homo sapiens
gaacccgacguccauuucu

SEQ ID NO: 651227 - RNA, 19 nt, Homo sapiens
ugaguguggcaucagcuua

SEQ ID NO: 651228 - RNA, 19 nt, Homo sapiens
acacgaagacgaacuugag

SEQ ID NO: 651229 - RNA, 19 nt, Homo sapiens
aguacacgcuggugguaga

SEQ ID NO: 651230 - RNA, 19 nt, Homo sapiens
cuccaucagugaagaggaa

SEQ ID NO: 651231 - RNA, 19 nt, Homo sapiens
ggcucaccgugcacuuuaa

SEQ ID NO: 651232 - RNA, 19 nt, Homo sapiens
caaggagcccgagcacaug

SEQ ID NO: 651233 - RNA, 19 nt, Homo sapiens
gacguccauuucuccaaga

SEQ ID NO: 651234 - RNA, 19 nt, Homo sapiens
gagagccggaugucaguca

SEQ ID NO: 651235 - RNA, 19 nt, Homo sapiens
gacacgaagacgaacuuga

SEQ ID NO: 651236 - RNA, 19 nt, Homo sapiens
ggccaucggagaggaauau

SEQ ID NO: 651237 - RNA, 19 nt, Homo sapiens
caacuauuaaagugccauu

SEQ ID NO: 651238 - RNA, 19 nt, Homo sapiens
aagaacaacaaguacuuug

SEQ ID NO: 651239 - RNA, 19 nt, Homo sapiens
acaucagccuggaggaguu

SEQ ID NO: 651240 - RNA, 19 nt, Homo sapiens
gagaccgaauccacuacca

SEQ ID NO: 651241 - RNA, 19 nt, Homo sapiens
agacaccaccgcaugaaca

SEQ ID NO: 651242 - RNA, 19 nt, Homo sapiens
ugucuuuccugccuauuac

SEQ ID NO: 651243 - RNA, 19 nt, Homo sapiens
ugaaguuccugggcucagu

SEQ ID NO: 651244 - RNA, 19 nt, Homo sapiens
caucggagaggaauaugag

SEQ ID NO: 651245 - RNA, 19 nt, Homo sapiens
gggugucuuuccugccuau

SEQ ID NO: 651246 - RNA, 19 nt, Homo sapiens
caaaugaggacaacagaua

SEQ ID NO: 651247 - RNA, 19 nt, Homo sapiens
gcaaagagcaagaaccaaa

SEQ ID NO: 651248 - RNA, 19 nt, Homo sapiens
gagcugaagcgcuacagua

SEQ ID NO: 651249 - RNA, 19 nt, Homo sapiens
gcacaagucaccuccaaau

SEQ ID NO: 651250 - RNA, 19 nt, Homo sapiens
gaagaaaucaacaccaaag

SEQ ID NO: 651251 - RNA, 19 nt, Homo sapiens
gucagcaacuucuucauga

SEQ ID NO: 651252 - RNA, 19 nt, Homo sapiens
acaagucaccuccaaauga

SEQ ID NO: 651253 - RNA, 19 nt, Homo sapiens
caaaggagaugcagaucac

SEQ ID NO: 651254 - RNA, 19 nt, Homo sapiens
gaacaaacgcccgucaaag

SEQ ID NO: 651255 - RNA, 19 nt, Homo sapiens
caagucaccuccaaaugag

SEQ ID NO: 651256 - RNA, 19 nt, Homo sapiens
ggaagaaaucaacaccaaa

SEQ ID NO: 651257 - RNA, 19 nt, Homo sapiens
caacagauaccaaaagaaa

SEQ ID NO: 651258 - RNA, 19 nt, Homo sapiens
gggcacaagucaccuccaa

SEQ ID NO: 651259 - RNA, 19 nt, Homo sapiens
gagaugcagaucaccauuu

SEQ ID NO: 651260 - RNA, 19 nt, Homo sapiens
uggaagaaaucaacaccaa

SEQ ID NO: 651261 - RNA, 19 nt, Homo sapiens
gaggacaacagauaccaaa

SEQ ID NO: 651262 - RNA, 19 nt, Homo sapiens
gaacacucuucgccaucuu

SEQ ID NO: 651263 - RNA, 19 nt, Homo sapiens
gguguucacugaccuccaa

SEQ ID NO: 651264 - RNA, 19 nt, Homo sapiens
gaacaauucccagaagaag

SEQ ID NO: 651265 - RNA, 19 nt, Homo sapiens
acaaagacaggaacaauuc

SEQ ID NO: 651266 - RNA, 19 nt, Homo sapiens
gagcaagaaccaaacaaag

SEQ ID NO: 651267 - RNA, 19 nt, Homo sapiens
ucacaaccgucagcaacuu

SEQ ID NO: 651268 - RNA, 19 nt, Homo sapiens
gacaacagauaccaaaaga

SEQ ID NO: 651269 - RNA, 19 nt, Homo sapiens
aaacaaagacaggaacaau

SEQ ID NO: 651270 - RNA, 19 nt, Homo sapiens
gcaagaaccaaacaaagac

SEQ ID NO: 651271 - RNA, 19 nt, Homo sapiens
ucagcaacuucuucaugaa

SEQ ID NO: 651272 - RNA, 19 nt, Homo sapiens
gauggaaggacucucacuu

SEQ ID NO: 651273 - RNA, 19 nt, Homo sapiens
agaugcagaucaccauuuc

SEQ ID NO: 651274 - RNA, 19 nt, Homo sapiens
ccuagaacgugcgccauga

SEQ ID NO: 651275 - RNA, 19 nt, Homo sapiens
ggagaugcagaucaccauu

SEQ ID NO: 651276 - RNA, 19 nt, Homo sapiens
agaacaaacgcccgucaaa

SEQ ID NO: 651277 - RNA, 19 nt, Homo sapiens
gagaacaaacgcccgucaa

SEQ ID NO: 651278 - RNA, 19 nt, Homo sapiens
acccggagcugacaaugga

SEQ ID NO: 651279 - RNA, 19 nt, Homo sapiens
gcaaacgcaaagagcaaga

SEQ ID NO: 651280 - RNA, 19 nt, Homo sapiens
ggagaaguggcaagacgau

SEQ ID NO: 651281 - RNA, 19 nt, Homo sapiens
ucaaaggagaugcagauca

SEQ ID NO: 651282 - RNA, 19 nt, Homo sapiens
acaaacgcccgucaaagga

SEQ ID NO: 651283 - RNA, 19 nt, Homo sapiens
gaccugcuccggaauccaa

SEQ ID NO: 651284 - RNA, 19 nt, Homo sapiens
cgggccagcuggaagaaau

SEQ ID NO: 651285 - RNA, 19 nt, Homo sapiens
aacaaagacaggaacaauu

SEQ ID NO: 651286 - RNA, 19 nt, Homo sapiens
agagcaagaaccaaacaaa

SEQ ID NO: 651287 - RNA, 19 nt, Homo sapiens
caaacaaagacaggaacaa

SEQ ID NO: 651288 - RNA, 19 nt, Homo sapiens
agcaagaaccaaacaaaga

SEQ ID NO: 651289 - RNA, 19 nt, Homo sapiens
cgucagcaacuucuucaug

SEQ ID NO: 651290 - RNA, 19 nt, Homo sapiens
cgucaaaggagaugcagau

SEQ ID NO: 651291 - RNA, 19 nt, Homo sapiens
caccaaagaccuagaacgu

SEQ ID NO: 651292 - RNA, 19 nt, Homo sapiens
gcccugauggacugaauga

SEQ ID NO: 651293 - RNA, 19 nt, Homo sapiens
caugauggaaggacucuca

SEQ ID NO: 651294 - RNA, 19 nt, Homo sapiens
gaaguggcaagacgaucug

SEQ ID NO: 651295 - RNA, 19 nt, Homo sapiens
gugcaaacgcaaagagcaa

SEQ ID NO: 651296 - RNA, 19 nt, Homo sapiens
ccucuacagucccuacaag

SEQ ID NO: 651297 - RNA, 19 nt, Homo sapiens
caagaaccaaacaaagaca

SEQ ID NO: 651298 - RNA, 19 nt, Homo sapiens
ccacaacgcgcagcagagu

SEQ ID NO: 651299 - RNA, 19 nt, Homo sapiens
cagcacguguaccaaagca

SEQ ID NO: 651300 - RNA, 19 nt, Homo sapiens
ucaccagcauggccucgau

SEQ ID NO: 651301 - RNA, 19 nt, Homo sapiens
ccaaaaccguggaguaaac

SEQ ID NO: 651302 - RNA, 19 nt, Homo sapiens
cugaagcgcuacaguaucc

SEQ ID NO: 651303 - RNA, 19 nt, Homo sapiens
aucgaugccucaccaaaga

SEQ ID NO: 651304 - RNA, 19 nt, Homo sapiens
acaauucccagaagaaguc

SEQ ID NO: 651305 - RNA, 19 nt, Homo sapiens
ccaaacaaagacaggaaca

SEQ ID NO: 651306 - RNA, 19 nt, Homo sapiens
caaagagcaagaaccaaac

SEQ ID NO: 651307 - RNA, 19 nt, Homo sapiens
caaacgcaaagagcaagaa

SEQ ID NO: 651308 - RNA, 19 nt, Homo sapiens
gagcugacaauggaaaguc

SEQ ID NO: 651309 - RNA, 19 nt, Homo sapiens
gaacccggagcugacaaug

SEQ ID NO: 651310 - RNA, 19 nt, Homo sapiens
guaccaaagcaugauggaa

SEQ ID NO: 651311 - RNA, 19 nt, Homo sapiens
aaaagacaccggauuccua

SEQ ID NO: 651312 - RNA, 19 nt, Homo sapiens
ggacaacagauaccaaaag

SEQ ID NO: 651313 - RNA, 19 nt, Homo sapiens
gggcccugauggacugaau

SEQ ID NO: 651314 - RNA, 19 nt, Homo sapiens
ccaaaugaggacaacagau

SEQ ID NO: 651315 - RNA, 19 nt, Homo sapiens
caugaacaaccucuacagu

SEQ ID NO: 651316 - RNA, 19 nt, Homo sapiens
gagcagcacuggugaauau

SEQ ID NO: 651317 - RNA, 19 nt, Homo sapiens
gaugauggcugguguuauu

SEQ ID NO: 651318 - RNA, 19 nt, Homo sapiens
uaucaugacucacgguuua

SEQ ID NO: 651319 - RNA, 19 nt, Homo sapiens
gaaggggacuuuuguauaa

SEQ ID NO: 651320 - RNA, 19 nt, Homo sapiens
aaaggaaacuggaaggaaa

SEQ ID NO: 651321 - RNA, 19 nt, Homo sapiens
ucaaugguguucuggcuua

SEQ ID NO: 651322 - RNA, 19 nt, Homo sapiens
gaagaggaaggcuuucuaa

SEQ ID NO: 651323 - RNA, 19 nt, Homo sapiens
gaggucgaauggucacaua

SEQ ID NO: 651324 - RNA, 19 nt, Homo sapiens
aaagugaagaugagcauua

SEQ ID NO: 651325 - RNA, 19 nt, Homo sapiens
gggagacggugcaagagaa

SEQ ID NO: 651326 - RNA, 19 nt, Homo sapiens
gaaucaaccacgagauaaa

SEQ ID NO: 651327 - RNA, 19 nt, Homo sapiens
gaaacacuacuugguauug

SEQ ID NO: 651328 - RNA, 19 nt, Homo sapiens
gagugacacccgccauuua

SEQ ID NO: 651329 - RNA, 19 nt, Homo sapiens
gugaaacacuacuugguau

SEQ ID NO: 651330 - RNA, 19 nt, Homo sapiens
gagauuuaaccacuuauga

SEQ ID NO: 651331 - RNA, 19 nt, Homo sapiens
ugggagauuuaaccacuua

SEQ ID NO: 651332 - RNA, 19 nt, Homo sapiens
gaaggauucaugagucuau

SEQ ID NO: 651333 - RNA, 19 nt, Homo sapiens
ggauucaugagucuauaua

SEQ ID NO: 651334 - RNA, 19 nt, Homo sapiens
ggacugguagcuucuauuc

SEQ ID NO: 651335 - RNA, 19 nt, Homo sapiens
aaacacuacuugguauuga

SEQ ID NO: 651336 - RNA, 19 nt, Homo sapiens
gcgagcaaauuccuacugu

SEQ ID NO: 651337 - RNA, 19 nt, Homo sapiens
caauccaacugaccuagug

SEQ ID NO: 651338 - RNA, 19 nt, Homo sapiens
ggagugacacccgccauuu

SEQ ID NO: 651339 - RNA, 19 nt, Homo sapiens
gucgaauggucacauauga

SEQ ID NO: 651340 - RNA, 19 nt, Homo sapiens
gcaaggagaagcagcucuu

SEQ ID NO: 651341 - RNA, 19 nt, Homo sapiens
ggaaggggacuuuuguaua

SEQ ID NO: 651342 - RNA, 19 nt, Homo sapiens
ggaggaauacgagggcuuu

SEQ ID NO: 651343 - RNA, 19 nt, Homo sapiens
uguucuggcuuacuuauga

SEQ ID NO: 651344 - RNA, 19 nt, Homo sapiens
gauucaggcuguucaaggu

SEQ ID NO: 651345 - RNA, 19 nt, Homo sapiens
gggaugauggcugguguua

SEQ ID NO: 651346 - RNA, 19 nt, Homo sapiens
ggucacauaugaacaucuc

SEQ ID NO: 651347 - RNA, 19 nt, Homo sapiens
ugguguacaucaugcauuu

SEQ ID NO: 651348 - RNA, 19 nt, Homo sapiens
gcacagcccuagggaucau

SEQ ID NO: 651349 - RNA, 19 nt, Homo sapiens
gugaauaugggagauuuaa

SEQ ID NO: 651350 - RNA, 19 nt, Homo sapiens
aaacucgacuccaaaugca

SEQ ID NO: 651351 - RNA, 19 nt, Homo sapiens
auacaccacuugaggacaa

SEQ ID NO: 651352 - RNA, 19 nt, Homo sapiens
ugaaucaaccacgagauaa

SEQ ID NO: 651353 - RNA, 19 nt, Homo sapiens
acugguagcuucuauucug

SEQ ID NO: 651354 - RNA, 19 nt, Homo sapiens
uuuauguucuggacuggua

SEQ ID NO: 651355 - RNA, 19 nt, Homo sapiens
ggagauuuaaccacuuaug

SEQ ID NO: 651356 - RNA, 19 nt, Homo sapiens
gguacccaauauacaaaga

SEQ ID NO: 651357 - RNA, 19 nt, Homo sapiens
ugaagaggaaggcuuucua

SEQ ID NO: 651358 - RNA, 19 nt, Homo sapiens
acucacgguuuaucaaguu

SEQ ID NO: 651359 - RNA, 19 nt, Homo sapiens
ggucgaauggucacauaug

SEQ ID NO: 651360 - RNA, 19 nt, Homo sapiens
ggugaauaugggagauuua

SEQ ID NO: 651361 - RNA, 19 nt, Homo sapiens
agagaugaguggagucagu

SEQ ID NO: 651362 - RNA, 19 nt, Homo sapiens
ucgacugacugcuugauuc

SEQ ID NO: 651363 - RNA, 19 nt, Homo sapiens
agaugcaaauggaaggaaa

SEQ ID NO: 651364 - RNA, 19 nt, Homo sapiens
ucaugagucuauauaaagg

SEQ ID NO: 651365 - RNA, 19 nt, Homo sapiens
gaacaccagccgaugucau

SEQ ID NO: 651366 - RNA, 19 nt, Homo sapiens
aagugaagaugagcauuau

SEQ ID NO: 651367 - RNA, 19 nt, Homo sapiens
aggacaauaucaugacuca

SEQ ID NO: 651368 - RNA, 19 nt, Homo sapiens
gaauaugggagauuuaacc

SEQ ID NO: 651369 - RNA, 19 nt, Homo sapiens
gcgauuucgugguguacau

SEQ ID NO: 651370 - RNA, 19 nt, Homo sapiens
cauugaagaggaaggcuuu

SEQ ID NO: 651371 - RNA, 19 nt, Homo sapiens
guucuggcuuacuuaugaa

SEQ ID NO: 651372 - RNA, 19 nt, Homo sapiens
guugggagacggugcaaga

SEQ ID NO: 651373 - RNA, 19 nt, Homo sapiens
caucuuggcugagaaugac

SEQ ID NO: 651374 - RNA, 19 nt, Homo sapiens
uggccgagcuagcaaccuu

SEQ ID NO: 651375 - RNA, 19 nt, Homo sapiens
cgacugacugcuugauuca

SEQ ID NO: 651376 - RNA, 19 nt, Homo sapiens
cccuagggaucauugaaga

SEQ ID NO: 651377 - RNA, 19 nt, Homo sapiens
ugaaacacuacuugguauu

SEQ ID NO: 651378 - RNA, 19 nt, Homo sapiens
ccaaaugcaaggagaagca

SEQ ID NO: 651379 - RNA, 19 nt, Homo sapiens
uggugaauaugggagauuu

SEQ ID NO: 651380 - RNA, 19 nt, Homo sapiens
aaucaucgacugacugcuu

SEQ ID NO: 651381 - RNA, 19 nt, Homo sapiens
cacgguuuaucaaguuuau

SEQ ID NO: 651382 - RNA, 19 nt, Homo sapiens
ccacuugaggacaauauca

SEQ ID NO: 651383 - RNA, 19 nt, Homo sapiens
ggagacggugcaagagaau

SEQ ID NO: 651384 - RNA, 19 nt, Homo sapiens
uccgagagguuguguuugg

SEQ ID NO: 651385 - RNA, 19 nt, Homo sapiens
aaggauucaugagucuaua

SEQ ID NO: 651386 - RNA, 19 nt, Homo sapiens
augaaucaaccacgagaua

SEQ ID NO: 651387 - RNA, 19 nt, Homo sapiens
ucacgguuuaucaaguuua

SEQ ID NO: 651388 - RNA, 19 nt, Homo sapiens
uauaaaucaucgacugacu

SEQ ID NO: 651389 - RNA, 19 nt, Homo sapiens
gacucacgguuuaucaagu

SEQ ID NO: 651390 - RNA, 19 nt, Homo sapiens
gaggaggaggagaggcuuu

SEQ ID NO: 651391 - RNA, 19 nt, Homo sapiens
cgaauggucacauaugaac

SEQ ID NO: 651392 - RNA, 19 nt, Homo sapiens
aacacuacuugguauugaa

SEQ ID NO: 651393 - RNA, 19 nt, Homo sapiens
aagaggaaggcuuucuaaa

SEQ ID NO: 651394 - RNA, 19 nt, Homo sapiens
gaugagcauuauccccuuu

SEQ ID NO: 651395 - RNA, 19 nt, Homo sapiens
gggaacaccagccgauguc

SEQ ID NO: 651396 - RNA, 19 nt, Homo sapiens
ccaucuuggcugagaauga

SEQ ID NO: 651397 - RNA, 19 nt, Homo sapiens
gacacccgccauuuacaga

SEQ ID NO: 651398 - RNA, 19 nt, Homo sapiens
uguauaaaucaucgacuga

SEQ ID NO: 651399 - RNA, 19 nt, Homo sapiens
caucaaaagcagaauaaug

SEQ ID NO: 651400 - RNA, 19 nt, Homo sapiens
ucuaaagcuuuggcaagga

SEQ ID NO: 651401 - RNA, 19 nt, Homo sapiens
gcagcacuggugaauaugg

SEQ ID NO: 651402 - RNA, 19 nt, Homo sapiens
agggaucauugaagaggaa

SEQ ID NO: 651403 - RNA, 19 nt, Homo sapiens
gacagaaccucuuggauga

SEQ ID NO: 651404 - RNA, 19 nt, Homo sapiens
ggaaugaauuggaugaaca

SEQ ID NO: 651405 - RNA, 19 nt, Homo sapiens
ccaagaaauugcugagaaa

SEQ ID NO: 651406 - RNA, 19 nt, Homo sapiens
gcuaagagcugugucaaca

SEQ ID NO: 651407 - RNA, 19 nt, Homo sapiens
ggcccuagcuacucacuuu

SEQ ID NO: 651408 - RNA, 19 nt, Homo sapiens
ccucuuggaugaucuugua

SEQ ID NO: 651409 - RNA, 19 nt, Homo sapiens
gcccuuuccucuaucauaa

SEQ ID NO: 651410 - RNA, 19 nt, Homo sapiens
gaaaaggcaccaaagcuua

SEQ ID NO: 651411 - RNA, 19 nt, Homo sapiens
uaaacaugguggacagaaa

SEQ ID NO: 651412 - RNA, 19 nt, Homo sapiens
gguccagccugaugaguga

SEQ ID NO: 651413 - RNA, 19 nt, Homo sapiens
uugaaggacuuauugcuaa

SEQ ID NO: 651414 - RNA, 19 nt, Homo sapiens
gauucuacuugucaaauug

SEQ ID NO: 651415 - RNA, 19 nt, Homo sapiens
ccacauacgauucuacuug

SEQ ID NO: 651416 - RNA, 19 nt, Homo sapiens
aaccugcucucaauaaauu

SEQ ID NO: 651417 - RNA, 19 nt, Homo sapiens
gcaggaaauugggaaugaa

SEQ ID NO: 651418 - RNA, 19 nt, Homo sapiens
ggcaggaaauugggaauga

SEQ ID NO: 651419 - RNA, 19 nt, Homo sapiens
caacacaucagauaacaca

SEQ ID NO: 651420 - RNA, 19 nt, Homo sapiens
caacaacgaaaucaauaug

SEQ ID NO: 651421 - RNA, 19 nt, Homo sapiens
uggcauccuuuaagaauga

SEQ ID NO: 651422 - RNA, 19 nt, Homo sapiens
cccaagaaauugcugagaa

SEQ ID NO: 651423 - RNA, 19 nt, Homo sapiens
ugagauaauugacgaccuu

SEQ ID NO: 651424 - RNA, 19 nt, Homo sapiens
caacagcagcagaaaauua

SEQ ID NO: 651425 - RNA, 19 nt, Homo sapiens
gaaugagggugccgaacca

SEQ ID NO: 651426 - RNA, 19 nt, Homo sapiens
gcagaaaauuauccaagaa

SEQ ID NO: 651427 - RNA, 19 nt, Homo sapiens
cgauucuacuugucaaauu

SEQ ID NO: 651428 - RNA, 19 nt, Homo sapiens
gaaugaauuggaugaacaa

SEQ ID NO: 651429 - RNA, 19 nt, Homo sapiens
ucagagcuuuguugcagaa

SEQ ID NO: 651430 - RNA, 19 nt, Homo sapiens
gcuuguggcuaucgugguu

SEQ ID NO: 651431 - RNA, 19 nt, Homo sapiens
ugacgaccuugccaaccua

SEQ ID NO: 651432 - RNA, 19 nt, Homo sapiens
cacauacgauucuacuugu

SEQ ID NO: 651433 - RNA, 19 nt, Homo sapiens
gaaaccaggcggguaaaca

SEQ ID NO: 651434 - RNA, 19 nt, Homo sapiens
caaaaccugcucucaauaa

SEQ ID NO: 651435 - RNA, 19 nt, Homo sapiens
cuacuucuggcauccuuua

SEQ ID NO: 651436 - RNA, 19 nt, Homo sapiens
ucuuguaacucgagagaga

SEQ ID NO: 651437 - RNA, 19 nt, Homo sapiens
uugaugcccuuuccucuau

SEQ ID NO: 651438 - RNA, 19 nt, Homo sapiens
cuucuggcauccuuuaaga

SEQ ID NO: 651439 - RNA, 19 nt, Homo sapiens
gaucuuguaacucgagaga

SEQ ID NO: 651440 - RNA, 19 nt, Homo sapiens
aagcuuaccgugacaauca

SEQ ID NO: 651441 - RNA, 19 nt, Homo sapiens
gcagugacaccuggcaaug

SEQ ID NO: 651442 - RNA, 19 nt, Homo sapiens
aaugaaaccaggcggguaa

SEQ ID NO: 651443 - RNA, 19 nt, Homo sapiens
cagaaccucuuggaugauc

SEQ ID NO: 651444 - RNA, 19 nt, Homo sapiens
ucagauaacacagcuugaa

SEQ ID NO: 651445 - RNA, 19 nt, Homo sapiens
uugcagaaccugaaggaaa

SEQ ID NO: 651446 - RNA, 19 nt, Homo sapiens
gcaaaaccugcucucaaua

SEQ ID NO: 651447 - RNA, 19 nt, Homo sapiens
gacagaaagucagccucuu

SEQ ID NO: 651448 - RNA, 19 nt, Homo sapiens
gggaaugaauuggaugaac

SEQ ID NO: 651449 - RNA, 19 nt, Homo sapiens
acagaaagucagccucuug

SEQ ID NO: 651450 - RNA, 19 nt, Homo sapiens
guaaacaugguggacagaa

SEQ ID NO: 651451 - RNA, 19 nt, Homo sapiens
guggagaacacagaugaaa

SEQ ID NO: 651452 - RNA, 19 nt, Homo sapiens
gcuacucacuuugcaaacu

SEQ ID NO: 651453 - RNA, 19 nt, Homo sapiens
gucaacacaucagauaaca

SEQ ID NO: 651454 - RNA, 19 nt, Homo sapiens
gaugcccuuuccucuauca

SEQ ID NO: 651455 - RNA, 19 nt, Homo sapiens
uagcuacucacuuugcaaa

SEQ ID NO: 651456 - RNA, 19 nt, Homo sapiens
gaaccucuuggaugaucuu

SEQ ID NO: 651457 - RNA, 19 nt, Homo sapiens
gaaggggaccgaagacaga

SEQ ID NO: 651458 - RNA, 19 nt, Homo sapiens
cagaaagucagccucuugu

SEQ ID NO: 651459 - RNA, 19 nt, Homo sapiens
ugucaaauugcccaagaaa

SEQ ID NO: 651460 - RNA, 19 nt, Homo sapiens
aaacaugguggacagaaag

SEQ ID NO: 651461 - RNA, 19 nt, Homo sapiens
cuacucacuuugcaaacuc

SEQ ID NO: 651462 - RNA, 19 nt, Homo sapiens
aaaccugcucucaauaaau

SEQ ID NO: 651463 - RNA, 19 nt, Homo sapiens
aaaaccugcucucaauaaa

SEQ ID NO: 651464 - RNA, 19 nt, Homo sapiens
cgcaaaaccugcucucaau

SEQ ID NO: 651465 - RNA, 19 nt, Homo sapiens
ugagaaaauucaacaacga

SEQ ID NO: 651466 - RNA, 19 nt, Homo sapiens
aaaccaggcggguaaacau

SEQ ID NO: 651467 - RNA, 19 nt, Homo sapiens
uaguggagaacacagauga

SEQ ID NO: 651468 - RNA, 19 nt, Homo sapiens
gacuacuucuggcauccuu

SEQ ID NO: 651469 - RNA, 19 nt, Homo sapiens
uuugaaggacuuauugcua

SEQ ID NO: 651470 - RNA, 19 nt, Homo sapiens
gagcuuuguugcagaaccu

SEQ ID NO: 651471 - RNA, 19 nt, Homo sapiens
cauacgauucuacuuguca

SEQ ID NO: 651472 - RNA, 19 nt, Homo sapiens
uugccaaccuaguggagaa

SEQ ID NO: 651473 - RNA, 19 nt, Homo sapiens
caggaaauugggaaugaau

SEQ ID NO: 651474 - RNA, 19 nt, Homo sapiens
caaagcuuaccgugacaau

SEQ ID NO: 651475 - RNA, 19 nt, Homo sapiens
ugcagaaccugaaggaaaa

SEQ ID NO: 651476 - RNA, 19 nt, Homo sapiens
ggaugaacaaaaugagaua

SEQ ID NO: 651477 - RNA, 19 nt, Homo sapiens
gagaaaauucaacaacgaa

SEQ ID NO: 651478 - RNA, 19 nt, Homo sapiens
gagaccaccagcagugaca

SEQ ID NO: 651479 - RNA, 19 nt, Homo sapiens
cagauaacacagcuugaag

SEQ ID NO: 651480 - RNA, 19 nt, Homo sapiens
gaaccaagguggagcacua

SEQ ID NO: 651481 - RNA, 19 nt, Homo sapiens
ggaagaaagugcugauugu

SEQ ID NO: 651482 - RNA, 19 nt, Homo sapiens
gaagguggguaaccaaguu

SEQ ID NO: 651483 - RNA, 19 nt, Homo sapiens
gagauaauguacaguguga

SEQ ID NO: 651484 - RNA, 19 nt, Homo sapiens
cuaaagauuugcaguuuga

SEQ ID NO: 651485 - RNA, 19 nt, Homo sapiens
cagaaugguuuccugauug

SEQ ID NO: 651486 - RNA, 19 nt, Homo sapiens
gcagcgaccauuucagaua

SEQ ID NO: 651487 - RNA, 19 nt, Homo sapiens
ggauccaguuugaagauuu

SEQ ID NO: 651488 - RNA, 19 nt, Homo sapiens
uguaagagaucccuucgaa

SEQ ID NO: 651489 - RNA, 19 nt, Homo sapiens
gaaggaagagucagugaau

SEQ ID NO: 651490 - RNA, 19 nt, Homo sapiens
gagaaaaggcuaaagauuu

SEQ ID NO: 651491 - RNA, 19 nt, Homo sapiens
gccaagcgccuauuucauu

SEQ ID NO: 651492 - RNA, 19 nt, Homo sapiens
cagaauccaugccugugua

SEQ ID NO: 651493 - RNA, 19 nt, Homo sapiens
gcuaaagauuugcaguuug

SEQ ID NO: 651494 - RNA, 19 nt, Homo sapiens
gugaauggcugcgguguga

SEQ ID NO: 651495 - RNA, 19 nt, Homo sapiens
ggcuaaagauuugcaguuu

SEQ ID NO: 651496 - RNA, 19 nt, Homo sapiens
gauaauguacagugugauu

SEQ ID NO: 651497 - RNA, 19 nt, Homo sapiens
uaaccaaguucaccagcaa

SEQ ID NO: 651498 - RNA, 19 nt, Homo sapiens
gaaauucagaagcgauuga

SEQ ID NO: 651499 - RNA, 19 nt, Homo sapiens
cgacaauuguggaggcaaa

SEQ ID NO: 651500 - RNA, 19 nt, Homo sapiens
gaagaaagugcugauuguu

SEQ ID NO: 651501 - RNA, 19 nt, Homo sapiens
gccuggaacucaucagaaa

SEQ ID NO: 651502 - RNA, 19 nt, Homo sapiens
uaagagaucccuucgaaag

SEQ ID NO: 651503 - RNA, 19 nt, Homo sapiens
ugaggaaguugccagaaga

SEQ ID NO: 651504 - RNA, 19 nt, Homo sapiens
ggaaguugccagaagagaa

SEQ ID NO: 651505 - RNA, 19 nt, Homo sapiens
ggaaacacagcaaggaaau

SEQ ID NO: 651506 - RNA, 19 nt, Homo sapiens
caaguucaccagcaauaaa

SEQ ID NO: 651507 - RNA, 19 nt, Homo sapiens
gcacaagacauacgauuuu

SEQ ID NO: 651508 - RNA, 19 nt, Homo sapiens
cuucagugaugcagaaauu

SEQ ID NO: 651509 - RNA, 19 nt, Homo sapiens
gcuaaacuaaugcauaaga

SEQ ID NO: 651510 - RNA, 19 nt, Homo sapiens
gggaugaugcccugaagaa

SEQ ID NO: 651511 - RNA, 19 nt, Homo sapiens
uuaaagacccagaugugua

SEQ ID NO: 651512 - RNA, 19 nt, Homo sapiens
ccaagcgccuauuucauuc

SEQ ID NO: 651513 - RNA, 19 nt, Homo sapiens
gaacagcacccaggacucu

SEQ ID NO: 651514 - RNA, 19 nt, Homo sapiens
ggaugucgcuggccuuugc

SEQ ID NO: 651515 - RNA, 19 nt, Homo sapiens
gauccaguuugaagauuuc

SEQ ID NO: 651516 - RNA, 19 nt, Homo sapiens
ucauucagcacaagacaua

SEQ ID NO: 651517 - RNA, 19 nt, Homo sapiens
agaaaaggcuaaagauuug

SEQ ID NO: 651518 - RNA, 19 nt, Homo sapiens
ggccuuugcucaccucaga

SEQ ID NO: 651519 - RNA, 19 nt, Homo sapiens
gaugaugcccugaagaauc

SEQ ID NO: 651520 - RNA, 19 nt, Homo sapiens
caucacagaauucagugua

SEQ ID NO: 651521 - RNA, 19 nt, Homo sapiens
gggaaacacagcaaggaaa

SEQ ID NO: 651522 - RNA, 19 nt, Homo sapiens
acagauggcuagaccuuca

SEQ ID NO: 651523 - RNA, 19 nt, Homo sapiens
caugguggcuagcaaguuc

SEQ ID NO: 651524 - RNA, 19 nt, Homo sapiens
ccaagguggagcacuauuu

SEQ ID NO: 651525 - RNA, 19 nt, Homo sapiens
ggaaacaagaaccucaguu

SEQ ID NO: 651526 - RNA, 19 nt, Homo sapiens
gaaguugccagaagagaag

SEQ ID NO: 651527 - RNA, 19 nt, Homo sapiens
ugacaaccaugccggaagu

SEQ ID NO: 651528 - RNA, 19 nt, Homo sapiens
gaaagugcugauuguucua

SEQ ID NO: 651529 - RNA, 19 nt, Homo sapiens
cagaauucaguguaguuua

SEQ ID NO: 651530 - RNA, 19 nt, Homo sapiens
ggcuagaccuucaguuugg

SEQ ID NO: 651531 - RNA, 19 nt, Homo sapiens
gcugauuguucuaaaugga

SEQ ID NO: 651532 - RNA, 19 nt, Homo sapiens
gugucaaugugaaaguuaa

SEQ ID NO: 651533 - RNA, 19 nt, Homo sapiens
gaguuucuguuccugacaa

SEQ ID NO: 651534 - RNA, 19 nt, Homo sapiens
ucacguugaccuuuaaaga

SEQ ID NO: 651535 - RNA, 19 nt, Homo sapiens
ucaucacguugaccuuuaa

SEQ ID NO: 651536 - RNA, 19 nt, Homo sapiens
cuagcaaguucaucacguu

SEQ ID NO: 651537 - RNA, 19 nt, Homo sapiens
gggcuaaccaggugaagau

SEQ ID NO: 651538 - RNA, 19 nt, Homo sapiens
gcauuaccguguauaacag

SEQ ID NO: 651539 - RNA, 19 nt, Homo sapiens
acacuccugucuccaaguu

SEQ ID NO: 651540 - RNA, 19 nt, Homo sapiens
gugaggaaguugccagaag

SEQ ID NO: 651541 - RNA, 19 nt, Homo sapiens
gaagcaucacacagcguua

SEQ ID NO: 651542 - RNA, 19 nt, Homo sapiens
guaccagaaaccagacuuu

SEQ ID NO: 651543 - RNA, 19 nt, Homo sapiens
ggcauuaccguguauaaca

SEQ ID NO: 651544 - RNA, 19 nt, Homo sapiens
gggauccaguuugaagauu

SEQ ID NO: 651545 - RNA, 19 nt, Homo sapiens
caagguggagcacuauuuc

SEQ ID NO: 651546 - RNA, 19 nt, Homo sapiens
ccacagauggcuagaccuu

SEQ ID NO: 651547 - RNA, 19 nt, Homo sapiens
agaaugguuuccugauugu

SEQ ID NO: 651548 - RNA, 19 nt, Homo sapiens
cagcgaccauuucagauac

SEQ ID NO: 651549 - RNA, 19 nt, Homo sapiens
ccaccauccuggaccaugu

SEQ ID NO: 651550 - RNA, 19 nt, Homo sapiens
gcugguccaugcuucugaa

SEQ ID NO: 651551 - RNA, 19 nt, Homo sapiens
ggagaaaaggcuaaagauu

SEQ ID NO: 651552 - RNA, 19 nt, Homo sapiens
guaagagaucccuucgaaa

SEQ ID NO: 651553 - RNA, 19 nt, Homo sapiens
aaacacagcaaggaaaugu

SEQ ID NO: 651554 - RNA, 19 nt, Homo sapiens
gaaacacagcaaggaaaug

SEQ ID NO: 651555 - RNA, 19 nt, Homo sapiens
ccucggcucucuuccuuca

SEQ ID NO: 651556 - RNA, 19 nt, Homo sapiens
gcaaguucaucacguugac

SEQ ID NO: 651557 - RNA, 19 nt, Homo sapiens
ccaaguucaccagcaauaa

SEQ ID NO: 651558 - RNA, 19 nt, Homo sapiens
gcaacacccaguggaagaa

SEQ ID NO: 651559 - RNA, 19 nt, Homo sapiens
ggaccgaauauuugucugu

SEQ ID NO: 651560 - RNA, 19 nt, Homo sapiens
ucacagaauucaguguagu

SEQ ID NO: 651561 - RNA, 19 nt, Homo sapiens
ccccaacuguuacaacuua

SEQ ID NO: 651562 - RNA, 19 nt, Homo sapiens
gugagauaauguacagugu

SEQ ID NO: 651563 - RNA, 19 nt, Homo sapiens
ugacaagaggaaacaagaa

SEQ ID NO: 651564 - RNA, 19 nt, Homo sapiens
gcuccuggcaucaucagaa

SEQ ID NO: 651565 - RNA, 19 nt, Homo sapiens
uucaucacguugaccuuua

SEQ ID NO: 651566 - RNA, 19 nt, Homo sapiens
uaaagacccagauguguac

SEQ ID NO: 651567 - RNA, 19 nt, Homo sapiens
cacaagacauacgauuuua

SEQ ID NO: 651568 - RNA, 19 nt, Homo sapiens
gacuaucccuccgggcauu

SEQ ID NO: 651569 - RNA, 19 nt, Homo sapiens
uggaagaaagugcugauug

SEQ ID NO: 651570 - RNA, 19 nt, Homo sapiens
ccgcagcgaccauuucaga

SEQ ID NO: 651571 - RNA, 19 nt, Homo sapiens
uaaaagaggcuggcauuga

SEQ ID NO: 651572 - RNA, 19 nt, Homo sapiens
cagaaauucagaagcgauu

SEQ ID NO: 651573 - RNA, 19 nt, Homo sapiens
ggacaguuuccugggauga

SEQ ID NO: 651574 - RNA, 19 nt, Homo sapiens
gcaagccgcagcgaccauu

SEQ ID NO: 651575 - RNA, 19 nt, Homo sapiens
cagcaucacagaauucagu

SEQ ID NO: 651576 - RNA, 19 nt, Homo sapiens
ggaccauggcccaggaaug

SEQ ID NO: 651577 - RNA, 19 nt, Homo sapiens
gcagggaggaagcaucaca

SEQ ID NO: 651578 - RNA, 19 nt, Homo sapiens
cuaaccaggugaagaucug

SEQ ID NO: 651579 - RNA, 19 nt, Homo sapiens
gcucuuuggguaccagaaa

SEQ ID NO: 651580 - RNA, 19 nt, Homo sapiens
gcaggucccuauuaucaua

SEQ ID NO: 651581 - RNA, 19 nt, Homo sapiens
gaagggaaguuaccuaaag

SEQ ID NO: 651582 - RNA, 19 nt, Homo sapiens
ucacugagcuuccucugaa

SEQ ID NO: 651583 - RNA, 19 nt, Homo sapiens
ggaaauuacuacaaucaag

SEQ ID NO: 651584 - RNA, 19 nt, Homo sapiens
gcaaguacaucucccuucu

SEQ ID NO: 651585 - RNA, 19 nt, Homo sapiens
gcacucagaagggaaguua

SEQ ID NO: 651586 - RNA, 19 nt, Homo sapiens
ugaaugugcugcgcaagua

SEQ ID NO: 651587 - RNA, 19 nt, Homo sapiens
caauguggcuccugugugu

SEQ ID NO: 651588 - RNA, 19 nt, Homo sapiens
uugcagagcugugauguuu

SEQ ID NO: 651589 - RNA, 19 nt, Homo sapiens
gggcaggucccuauuauca

SEQ ID NO: 651590 - RNA, 19 nt, Homo sapiens
gaacaaaggggaaaauaga

SEQ ID NO: 651591 - RNA, 19 nt, Homo sapiens
gagagacucguaagaaaga

SEQ ID NO: 651592 - RNA, 19 nt, Homo sapiens
gcaggaaauuacuacaauc

SEQ ID NO: 651593 - RNA, 19 nt, Homo sapiens
gccuggcacuggcuuauuu

SEQ ID NO: 651594 - RNA, 19 nt, Homo sapiens
ucaaucugguggugacuuu

SEQ ID NO: 651595 - RNA, 19 nt, Homo sapiens
ccaaggauaauaauagcua

SEQ ID NO: 651596 - RNA, 19 nt, Homo sapiens
guacaucucccuucuggau

SEQ ID NO: 651597 - RNA, 19 nt, Homo sapiens
uaccugagcucaaggagau

SEQ ID NO: 651598 - RNA, 19 nt, Homo sapiens
gaacauaaaagugcucuaa

SEQ ID NO: 651599 - RNA, 19 nt, Homo sapiens
gcucugugcucacgcuuca

SEQ ID NO: 651600 - RNA, 19 nt, Homo sapiens
gcagagcugugauguuuug

SEQ ID NO: 651601 - RNA, 19 nt, Homo sapiens
acugcuagcuucucaaguu

SEQ ID NO: 651602 - RNA, 19 nt, Homo sapiens
cagaagggaaguuaccuaa

SEQ ID NO: 651603 - RNA, 19 nt, Homo sapiens
aggagagacucguaagaaa

SEQ ID NO: 651604 - RNA, 19 nt, Homo sapiens
ggguguaccugcuuugcuu

SEQ ID NO: 651605 - RNA, 19 nt, Homo sapiens
agaagugaauggcaucaau

SEQ ID NO: 651606 - RNA, 19 nt, Homo sapiens
ggagagacucguaagaaag

SEQ ID NO: 651607 - RNA, 19 nt, Homo sapiens
guaaguggccacagcaauc

SEQ ID NO: 651608 - RNA, 19 nt, Homo sapiens
ggacuccucagaacgaaug

SEQ ID NO: 651609 - RNA, 19 nt, Homo sapiens
gaagugaauggcaucaauc

SEQ ID NO: 651610 - RNA, 19 nt, Homo sapiens
cuacacugcuagcuucuca

SEQ ID NO: 651611 - RNA, 19 nt, Homo sapiens
ucacauugcucuguaugca

SEQ ID NO: 651612 - RNA, 19 nt, Homo sapiens
gguggugacuuucgaugca

SEQ ID NO: 651613 - RNA, 19 nt, Homo sapiens
gcuagcuucucaaguucuu

SEQ ID NO: 651614 - RNA, 19 nt, Homo sapiens
gcaaaagggagcccaugua

SEQ ID NO: 651615 - RNA, 19 nt, Homo sapiens
ugcaggaaauuacuacaau

SEQ ID NO: 651616 - RNA, 19 nt, Homo sapiens
caaggagagacucguaaga

SEQ ID NO: 651617 - RNA, 19 nt, Homo sapiens
ugacgaugaagccauguuu

SEQ ID NO: 651618 - RNA, 19 nt, Homo sapiens
uagcgcacccugacgauga

SEQ ID NO: 651619 - RNA, 19 nt, Homo sapiens
caggaaauuacuacaauca

SEQ ID NO: 651620 - RNA, 19 nt, Homo sapiens
gcucaacagcaaagaagug

SEQ ID NO: 651621 - RNA, 19 nt, Homo sapiens
gcacuggguguaccugcuu

SEQ ID NO: 651622 - RNA, 19 nt, Homo sapiens
caaaccaccccaaggauaa

SEQ ID NO: 651623 - RNA, 19 nt, Homo sapiens
uugcuucucugcaggaaau

SEQ ID NO: 651624 - RNA, 19 nt, Homo sapiens
cauaaugacacaguagaug

SEQ ID NO: 651625 - RNA, 19 nt, Homo sapiens
ggauaauaauagcuacacu

SEQ ID NO: 651626 - RNA, 19 nt, Homo sapiens
guaccugcuuugcuucucu

SEQ ID NO: 651627 - RNA, 19 nt, Homo sapiens
aaggagagacucguaagaa

SEQ ID NO: 651628 - RNA, 19 nt, Homo sapiens
cugggcaggucccuauuau

SEQ ID NO: 651629 - RNA, 19 nt, Homo sapiens
ggcacuggcuuauuuaccu

SEQ ID NO: 651630 - RNA, 19 nt, Homo sapiens
ucagaagggaaguuaccua

SEQ ID NO: 651631 - RNA, 19 nt, Homo sapiens
cagagcacguggccagagu

SEQ ID NO: 651632 - RNA, 19 nt, Homo sapiens
acucuccaguguaaugauu

SEQ ID NO: 651633 - RNA, 19 nt, Homo sapiens
aaucaaggagagacucgua

SEQ ID NO: 651634 - RNA, 19 nt, Homo sapiens
gguuugggacuccucagaa

SEQ ID NO: 651635 - RNA, 19 nt, Homo sapiens
aaacaaaccaccccaagga

SEQ ID NO: 651636 - RNA, 19 nt, Homo sapiens
uguccaaacuccagcuucu

SEQ ID NO: 651637 - RNA, 19 nt, Homo sapiens
uuauuuaccugagcucaag

SEQ ID NO: 651638 - RNA, 19 nt, Homo sapiens
uaaguggccacagcaauca

SEQ ID NO: 651639 - RNA, 19 nt, Homo sapiens
agaagggaaguuaccuaaa

SEQ ID NO: 651640 - RNA, 19 nt, Homo sapiens
ccuugucucugcuucauac

SEQ ID NO: 651641 - RNA, 19 nt, Homo sapiens
gcaugcagugggacacaga

SEQ ID NO: 651642 - RNA, 19 nt, Homo sapiens
ggaacaaaggggaaaauag

SEQ ID NO: 651643 - RNA, 19 nt, Homo sapiens
ccucagaacgaaugaagag

SEQ ID NO: 651644 - RNA, 19 nt, Homo sapiens
uaccauagcuuuacgaaua

SEQ ID NO: 651645 - RNA, 19 nt, Homo sapiens
gcacuugccuucauaauuc

SEQ ID NO: 651646 - RNA, 19 nt, Homo sapiens
ggacacugcuuguuuauag

SEQ ID NO: 651647 - RNA, 19 nt, Homo sapiens
aauaagcgcuuuccuaauu

SEQ ID NO: 651648 - RNA, 19 nt, Homo sapiens
gaaagauaguguucaguug

SEQ ID NO: 651649 - RNA, 19 nt, Homo sapiens
guacuucagucaaggauuu

SEQ ID NO: 651650 - RNA, 19 nt, Homo sapiens
gaacugcuuuaccaaauau

SEQ ID NO: 651651 - RNA, 19 nt, Homo sapiens
gaguuacacuuaucccuua

SEQ ID NO: 651652 - RNA, 19 nt, Homo sapiens
ggacucugguucaauuuaa

SEQ ID NO: 651653 - RNA, 19 nt, Homo sapiens
caauaaaucuucagcuuca

SEQ ID NO: 651654 - RNA, 19 nt, Homo sapiens
ggaaacuguucucacuaua

SEQ ID NO: 651655 - RNA, 19 nt, Homo sapiens
agucaaggauuuccaguua

SEQ ID NO: 651656 - RNA, 19 nt, Homo sapiens
gaagaaaccagcucuaagu

SEQ ID NO: 651657 - RNA, 19 nt, Homo sapiens
aaagggaaauucaacauga

SEQ ID NO: 651658 - RNA, 19 nt, Homo sapiens
cacaaagaauucagguuua

SEQ ID NO: 651659 - RNA, 19 nt, Homo sapiens
gaaacuguucucacuauaa

SEQ ID NO: 651660 - RNA, 19 nt, Homo sapiens
ccacaaagaauucagguuu

SEQ ID NO: 651661 - RNA, 19 nt, Homo sapiens
uaucuuggguacucacuua

SEQ ID NO: 651662 - RNA, 19 nt, Homo sapiens
ggaaagauaguguucaguu

SEQ ID NO: 651663 - RNA, 19 nt, Homo sapiens
caaagucuaugaacagugu

SEQ ID NO: 651664 - RNA, 19 nt, Homo sapiens
cagagagacugaggaguua

SEQ ID NO: 651665 - RNA, 19 nt, Homo sapiens
gcagcuuucuuccgccuua

SEQ ID NO: 651666 - RNA, 19 nt, Homo sapiens
uagcagaugugagacuuua

SEQ ID NO: 651667 - RNA, 19 nt, Homo sapiens
ucacuuacccuucuuuauu

SEQ ID NO: 651668 - RNA, 19 nt, Homo sapiens
uaccaaauaucacuacuga

SEQ ID NO: 651669 - RNA, 19 nt, Homo sapiens
uaacauugcuggguggaaa

SEQ ID NO: 651670 - RNA, 19 nt, Homo sapiens
ccaaagagauaccggauac

SEQ ID NO: 651671 - RNA, 19 nt, Homo sapiens
gagaaagucuaccuuguac

SEQ ID NO: 651672 - RNA, 19 nt, Homo sapiens
ugaacugcuuuaccaaaua

SEQ ID NO: 651673 - RNA, 19 nt, Homo sapiens
ugaugaagcagauguauuu

SEQ ID NO: 651674 - RNA, 19 nt, Homo sapiens
gaauuggaagucacauaua

SEQ ID NO: 651675 - RNA, 19 nt, Homo sapiens
gcagauguauuuuaccuaa

SEQ ID NO: 651676 - RNA, 19 nt, Homo sapiens
gcaagcauuuacaagauuc

SEQ ID NO: 651677 - RNA, 19 nt, Homo sapiens
gguaaacacuggguaagau

SEQ ID NO: 651678 - RNA, 19 nt, Homo sapiens
cuacugaggaaauguauaa

SEQ ID NO: 651679 - RNA, 19 nt, Homo sapiens
cccuuaaacugguuacaua

SEQ ID NO: 651680 - RNA, 19 nt, Homo sapiens
uguggacacugcuuguuua

SEQ ID NO: 651681 - RNA, 19 nt, Homo sapiens
caaacaccauggaaacugu

SEQ ID NO: 651682 - RNA, 19 nt, Homo sapiens
aaauaucacuacugaggaa

SEQ ID NO: 651683 - RNA, 19 nt, Homo sapiens
cauagagaguuucaugaug

SEQ ID NO: 651684 - RNA, 19 nt, Homo sapiens
ucucaaaggccaaacuuaa

SEQ ID NO: 651685 - RNA, 19 nt, Homo sapiens
gaguuugucucugaugauu

SEQ ID NO: 651686 - RNA, 19 nt, Homo sapiens
ggugggagcuacgaaguug

SEQ ID NO: 651687 - RNA, 19 nt, Homo sapiens
gcagaacuugggaacauuu

SEQ ID NO: 651688 - RNA, 19 nt, Homo sapiens
gaacagugucaaauacuca

SEQ ID NO: 651689 - RNA, 19 nt, Homo sapiens
gcuccugguucacauggua

SEQ ID NO: 651690 - RNA, 19 nt, Homo sapiens
gcacuucugucugcuguag

SEQ ID NO: 651691 - RNA, 19 nt, Homo sapiens
uucagaugcugcuuaaaua

SEQ ID NO: 651692 - RNA, 19 nt, Homo sapiens
uugaucaccuucagcauuu

SEQ ID NO: 651693 - RNA, 19 nt, Homo sapiens
agagaaagucuaccuugua

SEQ ID NO: 651694 - RNA, 19 nt, Homo sapiens
gaaagagaaagucuaccuu

SEQ ID NO: 651695 - RNA, 19 nt, Homo sapiens
ucaaggauuuccaguuauc

SEQ ID NO: 651696 - RNA, 19 nt, Homo sapiens
aauggacucugguucaauu

SEQ ID NO: 651697 - RNA, 19 nt, Homo sapiens
guuugucucugaugauuga

SEQ ID NO: 651698 - RNA, 19 nt, Homo sapiens
uggaaacuguucucacuau

SEQ ID NO: 651699 - RNA, 19 nt, Homo sapiens
guuaauacaaugccagauu

SEQ ID NO: 651700 - RNA, 19 nt, Homo sapiens
uaaacugguuacauagaga

SEQ ID NO: 651701 - RNA, 19 nt, Homo sapiens
gccacucuacuccuuauua

SEQ ID NO: 651702 - RNA, 19 nt, Homo sapiens
ggcagucucuugaaguuuc

SEQ ID NO: 651703 - RNA, 19 nt, Homo sapiens
cgaauuggaagucacauau

SEQ ID NO: 651704 - RNA, 19 nt, Homo sapiens
cauguucacugcccacuuc

SEQ ID NO: 651705 - RNA, 19 nt, Homo sapiens
ggaagaaaccagcucuaag

SEQ ID NO: 651706 - RNA, 19 nt, Homo sapiens
ccaauggacucugguucaa

SEQ ID NO: 651707 - RNA, 19 nt, Homo sapiens
acacuuaucccuuaaucuu

SEQ ID NO: 651708 - RNA, 19 nt, Homo sapiens
ucugaacuuuccuagauaa

SEQ ID NO: 651709 - RNA, 19 nt, Homo sapiens
cccaauaaaucuucagcuu

SEQ ID NO: 651710 - RNA, 19 nt, Homo sapiens
caacaaucccaauaaaucu

SEQ ID NO: 651711 - RNA, 19 nt, Homo sapiens
gcucuaaguuuccuguuuu

SEQ ID NO: 651712 - RNA, 19 nt, Homo sapiens
guaaacacuggguaagauu

SEQ ID NO: 651713 - RNA, 19 nt, Homo sapiens
gagaugccagccucacuuu

SEQ ID NO: 651714 - RNA, 19 nt, Homo sapiens
gguguucuguggauacuca

SEQ ID NO: 651715 - RNA, 19 nt, Homo sapiens
uaugaacagugucaaauac

SEQ ID NO: 651716 - RNA, 19 nt, Homo sapiens
uguaugaacugcuuuacca

SEQ ID NO: 651717 - RNA, 19 nt, Homo sapiens
gcuuaaauacuucgguaaa

SEQ ID NO: 651718 - RNA, 19 nt, Homo sapiens
acaacaaucccaauaaauc

SEQ ID NO: 651719 - RNA, 19 nt, Homo sapiens
guuacaacaaucccaauaa

SEQ ID NO: 651720 - RNA, 19 nt, Homo sapiens
gagguacucuugaugucau

SEQ ID NO: 651721 - RNA, 19 nt, Homo sapiens
caucaacgagguacucuug

SEQ ID NO: 651722 - RNA, 19 nt, Homo sapiens
cauggaaacuguucucacu

SEQ ID NO: 651723 - RNA, 19 nt, Homo sapiens
ccagaacccuuacaaacac

SEQ ID NO: 651724 - RNA, 19 nt, Homo sapiens
acagagagacugaggaguu

SEQ ID NO: 651725 - RNA, 19 nt, Homo sapiens
auucauggcugcuaucuag

SEQ ID NO: 651726 - RNA, 19 nt, Homo sapiens
cuaugaacagugucaaaua

SEQ ID NO: 651727 - RNA, 19 nt, Homo sapiens
ucaaaggccaaacuuaaug

SEQ ID NO: 651728 - RNA, 19 nt, Homo sapiens
gacugaggaguuacacuua

SEQ ID NO: 651729 - RNA, 19 nt, Homo sapiens
agauaaagcugcgaaagag

SEQ ID NO: 651730 - RNA, 19 nt, Homo sapiens
gaauggacagagagacuga

SEQ ID NO: 651731 - RNA, 19 nt, Homo sapiens
ggagaugccagccucacuu

SEQ ID NO: 651732 - RNA, 19 nt, Homo sapiens
auaagcgcuuuccuaauuu

SEQ ID NO: 651733 - RNA, 19 nt, Homo sapiens
guucuguggauacucauua

SEQ ID NO: 651734 - RNA, 19 nt, Homo sapiens
cacuuacccuucuuuauuc

SEQ ID NO: 651735 - RNA, 19 nt, Homo sapiens
ccaguuaucuuggguacuc

SEQ ID NO: 651736 - RNA, 19 nt, Homo sapiens
gaagguucaaagucuauga

SEQ ID NO: 651737 - RNA, 19 nt, Homo sapiens
guaccagaacccuuacaaa

SEQ ID NO: 651738 - RNA, 19 nt, Homo sapiens
uaucugcucuuguuuacca

SEQ ID NO: 651739 - RNA, 19 nt, Homo sapiens
auucugaacuuuccuagau

SEQ ID NO: 651740 - RNA, 19 nt, Homo sapiens
ucuaugaacggaaguuaaa

SEQ ID NO: 651741 - RNA, 19 nt, Homo sapiens
gccagagggucgaauugga

SEQ ID NO: 651742 - RNA, 19 nt, Homo sapiens
ccuuugcucuucagacauu

SEQ ID NO: 651743 - RNA, 19 nt, Homo sapiens
auauucagaugcugcuuaa

SEQ ID NO: 651744 - RNA, 19 nt, Homo sapiens
ggaauggccuugaugaaga

SEQ ID NO: 651745 - RNA, 19 nt, Homo sapiens
aaaguucccugauucuuaa

SEQ ID NO: 651746 - RNA, 19 nt, Homo sapiens
uaaaguucccugauucuua

SEQ ID NO: 651747 - RNA, 19 nt, Homo sapiens
gaagaacucccgcacaaug

SEQ ID NO: 651748 - RNA, 19 nt, Homo sapiens
aagcaaaguuuccuucaaa

SEQ ID NO: 651749 - RNA, 19 nt, Homo sapiens
caaggucuccauucucuua

SEQ ID NO: 651750 - RNA, 19 nt, Homo sapiens
gaguaaaguucccugauuc

SEQ ID NO: 651751 - RNA, 19 nt, Homo sapiens
cugauuggcucuccuaauu

SEQ ID NO: 651752 - RNA, 19 nt, Homo sapiens
ucgaugagauugucacuga

SEQ ID NO: 651753 - RNA, 19 nt, Homo sapiens
agucauaacuccagcuaaa

SEQ ID NO: 651754 - RNA, 19 nt, Homo sapiens
ugacuccacugaucaagaa

SEQ ID NO: 651755 - RNA, 19 nt, Homo sapiens
ccaaaggccucuggcugua

SEQ ID NO: 651756 - RNA, 19 nt, Homo sapiens
agaguaaaguucccugauu

SEQ ID NO: 651757 - RNA, 19 nt, Homo sapiens
ggagauugccgacuucuuc

SEQ ID NO: 651758 - RNA, 19 nt, Homo sapiens
uguaaugucugcccuaugu

SEQ ID NO: 651759 - RNA, 19 nt, Homo sapiens
ggugauggccugcauguug

SEQ ID NO: 651760 - RNA, 19 nt, Homo sapiens
gcacaucgagcgacaguuc

SEQ ID NO: 651761 - RNA, 19 nt, Homo sapiens
cggaagaacucccgcacaa

SEQ ID NO: 651762 - RNA, 19 nt, Homo sapiens
caagcaaaguuuccuucaa

SEQ ID NO: 651763 - RNA, 19 nt, Homo sapiens
gauggugacuccacugauc

SEQ ID NO: 651764 - RNA, 19 nt, Homo sapiens
gacaacagcgucaucuuga

SEQ ID NO: 651765 - RNA, 19 nt, Homo sapiens
gaauggccuugaugaagau

SEQ ID NO: 651766 - RNA, 19 nt, Homo sapiens
agaggugaauggcuucuuu

SEQ ID NO: 651767 - RNA, 19 nt, Homo sapiens
gaagucauaacuccagcua

SEQ ID NO: 651768 - RNA, 19 nt, Homo sapiens
ggguccagcuucaggagua

SEQ ID NO: 651769 - RNA, 19 nt, Homo sapiens
ggaaaguacucuagaaaag

SEQ ID NO: 651770 - RNA, 19 nt, Homo sapiens
gcaggacugugcggagauu

SEQ ID NO: 651771 - RNA, 19 nt, Homo sapiens
cgacaacagcgucaucuug

SEQ ID NO: 651772 - RNA, 19 nt, Homo sapiens
gugcggagauugccgacuu

SEQ ID NO: 651773 - RNA, 19 nt, Homo sapiens
caaaguuuccuucaaaucu

SEQ ID NO: 651774 - RNA, 19 nt, Homo sapiens
gcaaaguuuccuucaaauc

SEQ ID NO: 651775 - RNA, 19 nt, Homo sapiens
gaggucaccauggcuguua

SEQ ID NO: 651776 - RNA, 19 nt, Homo sapiens
ccucaccacuggcuauuuc

SEQ ID NO: 651777 - RNA, 19 nt, Homo sapiens
cugagacccuguugacuga

SEQ ID NO: 651778 - RNA, 19 nt, Homo sapiens
gauuggcucuccuaauuuu

SEQ ID NO: 651779 - RNA, 19 nt, Homo sapiens
ccaauaagagggucaugga

SEQ ID NO: 651780 - RNA, 19 nt, Homo sapiens
ccgcugggcucaaggaaca

SEQ ID NO: 651781 - RNA, 19 nt, Homo sapiens
ccugacaccuggauuuauc

SEQ ID NO: 651782 - RNA, 19 nt, Homo sapiens
auaagagggucauggaugu

SEQ ID NO: 651783 - RNA, 19 nt, Homo sapiens
gguccgagucucccucuuu

SEQ ID NO: 651784 - RNA, 19 nt, Homo sapiens
gugauggccugcauguugu

SEQ ID NO: 651785 - RNA, 19 nt, Homo sapiens
agacaggaauggccuugau

SEQ ID NO: 651786 - RNA, 19 nt, Homo sapiens
ccuggaaaguacucuagaa

SEQ ID NO: 651787 - RNA, 19 nt, Homo sapiens
ccucaucugucagccuuaa

SEQ ID NO: 651788 - RNA, 19 nt, Homo sapiens
gaugagauugucacugaga

SEQ ID NO: 651789 - RNA, 19 nt, Homo sapiens
ggucauggaugugaucaac

SEQ ID NO: 651790 - RNA, 19 nt, Homo sapiens
gcaaggcagccaauaagag

SEQ ID NO: 651791 - RNA, 19 nt, Homo sapiens
aaaagucacuccaagcaaa

SEQ ID NO: 651792 - RNA, 19 nt, Homo sapiens
gugaagcugugggugaaga

SEQ ID NO: 651793 - RNA, 19 nt, Homo sapiens
ucaggugugcugccaguaa

SEQ ID NO: 651794 - RNA, 19 nt, Homo sapiens
guaaaguucccugauucuu

SEQ ID NO: 651795 - RNA, 19 nt, Homo sapiens
ggaagaacucccgcacaau

SEQ ID NO: 651796 - RNA, 19 nt, Homo sapiens
ucaguggcaggaagucaua

SEQ ID NO: 651797 - RNA, 19 nt, Homo sapiens
ccugauucuuaauguguaa

SEQ ID NO: 651798 - RNA, 19 nt, Homo sapiens
ucauggaugugaucaacuc

SEQ ID NO: 651799 - RNA, 19 nt, Homo sapiens
guccgagucucccucuuuc

SEQ ID NO: 651800 - RNA, 19 nt, Homo sapiens
aaaguuuccuucaaaucuc

SEQ ID NO: 651801 - RNA, 19 nt, Homo sapiens
guucccugauucuuaaugu

SEQ ID NO: 651802 - RNA, 19 nt, Homo sapiens
ugauuggcucuccuaauuu

SEQ ID NO: 651803 - RNA, 19 nt, Homo sapiens
cagauaagaguagccaaga

SEQ ID NO: 651804 - RNA, 19 nt, Homo sapiens
caagaggcgggucgugaug

SEQ ID NO: 651805 - RNA, 19 nt, Homo sapiens
uccagcacauuaaggugua

SEQ ID NO: 651806 - RNA, 19 nt, Homo sapiens
gaggugaauggcuucuuug

SEQ ID NO: 651807 - RNA, 19 nt, Homo sapiens
gcugguggacugccuggaa

SEQ ID NO: 651808 - RNA, 19 nt, Homo sapiens
cacagcaacucucuuuuga

SEQ ID NO: 651809 - RNA, 19 nt, Homo sapiens
gagauugccgacuucuuca

SEQ ID NO: 651810 - RNA, 19 nt, Homo sapiens
ucugucagccuuaauguca

SEQ ID NO: 651811 - RNA, 19 nt, Homo sapiens
acaggaauggccuugauga

SEQ ID NO: 651812 - RNA, 19 nt, Homo sapiens
cugguggacugccuggaaa

SEQ ID NO: 651813 - RNA, 19 nt, Homo sapiens
caggaauggccuugaugaa

SEQ ID NO: 651814 - RNA, 19 nt, Homo sapiens
ccaagcaaaguuuccuuca

SEQ ID NO: 651815 - RNA, 19 nt, Homo sapiens
cucaaggucuccauucucu

SEQ ID NO: 651816 - RNA, 19 nt, Homo sapiens
caggugugcugccaguaag

SEQ ID NO: 651817 - RNA, 19 nt, Homo sapiens
ccaagaggcgggucgugau

SEQ ID NO: 651818 - RNA, 19 nt, Homo sapiens
ggacguuccacgccaaagg

SEQ ID NO: 651819 - RNA, 19 nt, Homo sapiens
agcgacaguucuucaguga

SEQ ID NO: 651820 - RNA, 19 nt, Homo sapiens
gaaaagucacuccaagcaa

SEQ ID NO: 651821 - RNA, 19 nt, Homo sapiens
gucuccaguucucacguua

SEQ ID NO: 651822 - RNA, 19 nt, Homo sapiens
gaaaguacucuagaaaagu

SEQ ID NO: 651823 - RNA, 19 nt, Homo sapiens
cuggaaaguacucuagaaa

SEQ ID NO: 651824 - RNA, 19 nt, Homo sapiens
cggguuccauccguuuaaa

SEQ ID NO: 651825 - RNA, 19 nt, Homo sapiens
cuaaagcccucggguucca

SEQ ID NO: 651826 - RNA, 19 nt, Homo sapiens
gacaggaauggccuugaug

SEQ ID NO: 651827 - RNA, 19 nt, Homo sapiens
ucacugagacccuguugac

SEQ ID NO: 651828 - RNA, 19 nt, Homo sapiens
guggacugccuggaaagua

SEQ ID NO: 651829 - RNA, 19 nt, Homo sapiens
ccacagcaacucucuuuug

SEQ ID NO: 651830 - RNA, 19 nt, Homo sapiens
gccaggaccgcuacguguu

SEQ ID NO: 651831 - RNA, 19 nt, Homo sapiens
uaaugucugcccuaugugu

SEQ ID NO: 651832 - RNA, 19 nt, Homo sapiens
ggucaccauggcuguuauu

SEQ ID NO: 651833 - RNA, 19 nt, Homo sapiens
gcugauuggcucuccuaau

SEQ ID NO: 651834 - RNA, 19 nt, Homo sapiens
caauaagagggucauggau

SEQ ID NO: 651835 - RNA, 19 nt, Homo sapiens
ccaggaccgcuacguguuc

SEQ ID NO: 651836 - RNA, 19 nt, Homo sapiens
gagcagaccugaaggcuaa

SEQ ID NO: 651837 - RNA, 19 nt, Homo sapiens
gaacuuggaugauuauauc

SEQ ID NO: 651838 - RNA, 19 nt, Homo sapiens
gcagauagcucccaaagag

SEQ ID NO: 651839 - RNA, 19 nt, Homo sapiens
gcaaaugggaggaguguua

SEQ ID NO: 651840 - RNA, 19 nt, Homo sapiens
ggaaaugagugacuggaaa

SEQ ID NO: 651841 - RNA, 19 nt, Homo sapiens
gagcuucggucucguauug

SEQ ID NO: 651842 - RNA, 19 nt, Homo sapiens
ccagaaagcuccuugugaa

SEQ ID NO: 651843 - RNA, 19 nt, Homo sapiens
ggaaguauuuaaaggauga

SEQ ID NO: 651844 - RNA, 19 nt, Homo sapiens
ggagcaaguuggaguguuu

SEQ ID NO: 651845 - RNA, 19 nt, Homo sapiens
caaguuccuucuccucuua

SEQ ID NO: 651846 - RNA, 19 nt, Homo sapiens
caauaaacaucagcacuaa

SEQ ID NO: 651847 - RNA, 19 nt, Homo sapiens
ggaagugaauagagccuuu

SEQ ID NO: 651848 - RNA, 19 nt, Homo sapiens
ggcaagcagugauuuagua

SEQ ID NO: 651849 - RNA, 19 nt, Homo sapiens
gaauucauguugccgguuu

SEQ ID NO: 651850 - RNA, 19 nt, Homo sapiens
gaaaucagugugucucuuu

SEQ ID NO: 651851 - RNA, 19 nt, Homo sapiens
gagaagacuuagacccuuu

SEQ ID NO: 651852 - RNA, 19 nt, Homo sapiens
gcauagcugcuuccauuua

SEQ ID NO: 651853 - RNA, 19 nt, Homo sapiens
ggauucugcucauguguuu

SEQ ID NO: 651854 - RNA, 19 nt, Homo sapiens
gugaaggccucaagaaugu

SEQ ID NO: 651855 - RNA, 19 nt, Homo sapiens
aaacacagucauugucuua

SEQ ID NO: 651856 - RNA, 19 nt, Homo sapiens
gcaggaacauuguggaaag

SEQ ID NO: 651857 - RNA, 19 nt, Homo sapiens
gaaacacagucauugucuu

SEQ ID NO: 651858 - RNA, 19 nt, Homo sapiens
ggagaaagacccagagauc

SEQ ID NO: 651859 - RNA, 19 nt, Homo sapiens
gaccugaaggcuaaucuua

SEQ ID NO: 651860 - RNA, 19 nt, Homo sapiens
gauagaagcagggaaggua

SEQ ID NO: 651861 - RNA, 19 nt, Homo sapiens
ccugaaggcuaaucuuauu

SEQ ID NO: 651862 - RNA, 19 nt, Homo sapiens
gagcaugggcugccucuga

SEQ ID NO: 651863 - RNA, 19 nt, Homo sapiens
gugccaagccuaugaaauu

SEQ ID NO: 651864 - RNA, 19 nt, Homo sapiens
gcaguuugcucauaaagac

SEQ ID NO: 651865 - RNA, 19 nt, Homo sapiens
gaaugacccuaagcaaguu

SEQ ID NO: 651866 - RNA, 19 nt, Homo sapiens
caccuuccguuuauuaauu

SEQ ID NO: 651867 - RNA, 19 nt, Homo sapiens
ucaaugugcuggaauaugg

SEQ ID NO: 651868 - RNA, 19 nt, Homo sapiens
gcaaguuccuucuccucuu

SEQ ID NO: 651869 - RNA, 19 nt, Homo sapiens
gaacgcauuuuggauguua

SEQ ID NO: 651870 - RNA, 19 nt, Homo sapiens
cagaugcagugcuauaaga

SEQ ID NO: 651871 - RNA, 19 nt, Homo sapiens
gaagguagauaacuuuuag

SEQ ID NO: 651872 - RNA, 19 nt, Homo sapiens
caaccaccuugaaaccuuu

SEQ ID NO: 651873 - RNA, 19 nt, Homo sapiens
augcauagcugcuuccauu

SEQ ID NO: 651874 - RNA, 19 nt, Homo sapiens
caauaaauuugccacuuag

SEQ ID NO: 651875 - RNA, 19 nt, Homo sapiens
ggaccauucuugcaaccaa

SEQ ID NO: 651876 - RNA, 19 nt, Homo sapiens
gcaagcagugauuuaguaa

SEQ ID NO: 651877 - RNA, 19 nt, Homo sapiens
aaccauauguggauccuuu

SEQ ID NO: 651878 - RNA, 19 nt, Homo sapiens
gaaaugagugacuggaaau

SEQ ID NO: 651879 - RNA, 19 nt, Homo sapiens
ucaggcaccuuccguuuau

SEQ ID NO: 651880 - RNA, 19 nt, Homo sapiens
gaagugaauagagccuuua

SEQ ID NO: 651881 - RNA, 19 nt, Homo sapiens
gcuagcauuucaaccauau

SEQ ID NO: 651882 - RNA, 19 nt, Homo sapiens
cgauagagcaccaggcuaa

SEQ ID NO: 651883 - RNA, 19 nt, Homo sapiens
uggaaagacugcaucauuc

SEQ ID NO: 651884 - RNA, 19 nt, Homo sapiens
ucggagagguggcaugauu

SEQ ID NO: 651885 - RNA, 19 nt, Homo sapiens
gcagcaugauccucaaugu

SEQ ID NO: 651886 - RNA, 19 nt, Homo sapiens
gaccuauuauuuaccugua

SEQ ID NO: 651887 - RNA, 19 nt, Homo sapiens
caagagggaagcggaguua

SEQ ID NO: 651888 - RNA, 19 nt, Homo sapiens
cauagcugcuuccauuuau

SEQ ID NO: 651889 - RNA, 19 nt, Homo sapiens
gaugaaaacuaaacugaug

SEQ ID NO: 651890 - RNA, 19 nt, Homo sapiens
gagaacagguagaugaaaa

SEQ ID NO: 651891 - RNA, 19 nt, Homo sapiens
aaacagagcagaccugaag

SEQ ID NO: 651892 - RNA, 19 nt, Homo sapiens
guggaaagacugcaucauu

SEQ ID NO: 651893 - RNA, 19 nt, Homo sapiens
caauacagaauucauguug

SEQ ID NO: 651894 - RNA, 19 nt, Homo sapiens
aaccaaaugucaauacaga

SEQ ID NO: 651895 - RNA, 19 nt, Homo sapiens
gaaggccucaagaauguaa

SEQ ID NO: 651896 - RNA, 19 nt, Homo sapiens
ggaccuacaagaacaguga

SEQ ID NO: 651897 - RNA, 19 nt, Homo sapiens
gaaagcuccuugugaaagc

SEQ ID NO: 651898 - RNA, 19 nt, Homo sapiens
ugucuuagguguucuaugg

SEQ ID NO: 651899 - RNA, 19 nt, Homo sapiens
ccaaccaccuugaaaccuu

SEQ ID NO: 651900 - RNA, 19 nt, Homo sapiens
gaagccaaccaccuugaaa

SEQ ID NO: 651901 - RNA, 19 nt, Homo sapiens
gaugucucauucuguguuu

SEQ ID NO: 651902 - RNA, 19 nt, Homo sapiens
gcaaaauccuccagcuauu

SEQ ID NO: 651903 - RNA, 19 nt, Homo sapiens
gaccagaugcagugcuaua

SEQ ID NO: 651904 - RNA, 19 nt, Homo sapiens
acaauaaacaucagcacua

SEQ ID NO: 651905 - RNA, 19 nt, Homo sapiens
cagggaagguagauaacuu

SEQ ID NO: 651906 - RNA, 19 nt, Homo sapiens
ggaggaguguuagucuuug

SEQ ID NO: 651907 - RNA, 19 nt, Homo sapiens
gggaggaguguuagucuuu

SEQ ID NO: 651908 - RNA, 19 nt, Homo sapiens
uauaagaacagaacgcauu

SEQ ID NO: 651909 - RNA, 19 nt, Homo sapiens
gggcuacgaugacauguac

SEQ ID NO: 651910 - RNA, 19 nt, Homo sapiens
gaacagaacgcauuuugga

SEQ ID NO: 651911 - RNA, 19 nt, Homo sapiens
gaugacauguaccugugaa

SEQ ID NO: 651912 - RNA, 19 nt, Homo sapiens
aggcagaggugcagauuca

SEQ ID NO: 651913 - RNA, 19 nt, Homo sapiens
acagguagaugaaaacuaa

SEQ ID NO: 651914 - RNA, 19 nt, Homo sapiens
ggaaaagaaugaugguuca

SEQ ID NO: 651915 - RNA, 19 nt, Homo sapiens
gacuuuagaguuugaguuu

SEQ ID NO: 651916 - RNA, 19 nt, Homo sapiens
ggaagcggaguuauagcua

SEQ ID NO: 651917 - RNA, 19 nt, Homo sapiens
gugaauagagccuuuagga

SEQ ID NO: 651918 - RNA, 19 nt, Homo sapiens
gagaaagacccagagauca

SEQ ID NO: 651919 - RNA, 19 nt, Homo sapiens
uuuagaacaucucugcuuu

SEQ ID NO: 651920 - RNA, 19 nt, Homo sapiens
cuugaaaccuuuagaacau

SEQ ID NO: 651921 - RNA, 19 nt, Homo sapiens
ccaccuagcugcagauagc

SEQ ID NO: 651922 - RNA, 19 nt, Homo sapiens
ggaccuugaugugaggaaa

SEQ ID NO: 651923 - RNA, 19 nt, Homo sapiens
ccaaugauaagaagucaga

SEQ ID NO: 651924 - RNA, 19 nt, Homo sapiens
ucaaggcgguagucacuuc

SEQ ID NO: 651925 - RNA, 19 nt, Homo sapiens
gcaagggauucugcucaug

SEQ ID NO: 651926 - RNA, 19 nt, Homo sapiens
ggaaaaggcuaauguaagc

SEQ ID NO: 651927 - RNA, 19 nt, Homo sapiens
caucaaggacacugagaaa

SEQ ID NO: 651928 - RNA, 19 nt, Homo sapiens
caacaauaaagaccuguau

SEQ ID NO: 651929 - RNA, 19 nt, Homo sapiens
ugaaugacccuaagcaagu

SEQ ID NO: 651930 - RNA, 19 nt, Homo sapiens
gauagagaccaucagauag

SEQ ID NO: 651931 - RNA, 19 nt, Homo sapiens
ggaguguuagucuuuguuu

SEQ ID NO: 651932 - RNA, 19 nt, Homo sapiens
gguguggacucggcaagaa

SEQ ID NO: 651933 - RNA, 19 nt, Homo sapiens
ggaaagacugcaucauucu

SEQ ID NO: 651934 - RNA, 19 nt, Homo sapiens
ccauaggccacaagaauga

SEQ ID NO: 651935 - RNA, 19 nt, Homo sapiens
gcagugcuauaagaacaga

SEQ ID NO: 651936 - RNA, 19 nt, Homo sapiens
guaaaugacuggccaauaa

SEQ ID NO: 651937 - RNA, 19 nt, Homo sapiens
gcauagaagugaucaauaa

SEQ ID NO: 651938 - RNA, 19 nt, Homo sapiens
cgacauaacuuacgacaaa

SEQ ID NO: 651939 - RNA, 19 nt, Homo sapiens
gagcaaagcuuucccuaug

SEQ ID NO: 651940 - RNA, 19 nt, Homo sapiens
gacaugaucuuuaacagua

SEQ ID NO: 651941 - RNA, 19 nt, Homo sapiens
ggaagugacucaagaaguu

SEQ ID NO: 651942 - RNA, 19 nt, Homo sapiens
ggacagaaauuggaaauag

SEQ ID NO: 651943 - RNA, 19 nt, Homo sapiens
gaacaaaucacuauaaguc

SEQ ID NO: 651944 - RNA, 19 nt, Homo sapiens
acaaguagauccagaguuu

SEQ ID NO: 651945 - RNA, 19 nt, Homo sapiens
guacagaaguugaagugaa

SEQ ID NO: 651946 - RNA, 19 nt, Homo sapiens
caacugaaggcuauuguua

SEQ ID NO: 651947 - RNA, 19 nt, Homo sapiens
cagaagagguugaugaaga

SEQ ID NO: 651948 - RNA, 19 nt, Homo sapiens
ggaaauagaacgacuggaa

SEQ ID NO: 651949 - RNA, 19 nt, Homo sapiens
ugagguugaugccuuauua

SEQ ID NO: 651950 - RNA, 19 nt, Homo sapiens
agaaugcacuuuagaacua

SEQ ID NO: 651951 - RNA, 19 nt, Homo sapiens
gacaaaugaugauugauga

SEQ ID NO: 651952 - RNA, 19 nt, Homo sapiens
gagacucaguauucauuua

SEQ ID NO: 651953 - RNA, 19 nt, Homo sapiens
gaaagaaugugagcguaga

SEQ ID NO: 651954 - RNA, 19 nt, Homo sapiens
ugaaacaacugaaggcuau

SEQ ID NO: 651955 - RNA, 19 nt, Homo sapiens
uaacccaucuguucaagaa

SEQ ID NO: 651956 - RNA, 19 nt, Homo sapiens
caaccgaaauggagacuau

SEQ ID NO: 651957 - RNA, 19 nt, Homo sapiens
gaaacgacauaacuuacga

SEQ ID NO: 651958 - RNA, 19 nt, Homo sapiens
gaucaagaguguugcauag

SEQ ID NO: 651959 - RNA, 19 nt, Homo sapiens
gaaauagaacgacuggaaa

SEQ ID NO: 651960 - RNA, 19 nt, Homo sapiens
gauugaagccuuagagaaa

SEQ ID NO: 651961 - RNA, 19 nt, Homo sapiens
uaagagagaaccaaaugua

SEQ ID NO: 651962 - RNA, 19 nt, Homo sapiens
gauaagaaccauaacaugu

SEQ ID NO: 651963 - RNA, 19 nt, Homo sapiens
agaaggaacucuuugaugu

SEQ ID NO: 651964 - RNA, 19 nt, Homo sapiens
agaauaaacucuggguuaa

SEQ ID NO: 651965 - RNA, 19 nt, Homo sapiens
ccaaacagcuggagaugca

SEQ ID NO: 651966 - RNA, 19 nt, Homo sapiens
gcaagaaugcacuuuagaa

SEQ ID NO: 651967 - RNA, 19 nt, Homo sapiens
guacaagaauucugcaaag

SEQ ID NO: 651968 - RNA, 19 nt, Homo sapiens
ugaaggcuauuguuacuga

SEQ ID NO: 651969 - RNA, 19 nt, Homo sapiens
caagggaaacuaaaugaaa

SEQ ID NO: 651970 - RNA, 19 nt, Homo sapiens
ccacugggcuuuccugauc

SEQ ID NO: 651971 - RNA, 19 nt, Homo sapiens
acagauggguagaucauaa

SEQ ID NO: 651972 - RNA, 19 nt, Homo sapiens
uggaagaggugccguuuga

SEQ ID NO: 651973 - RNA, 19 nt, Homo sapiens
ucaagaguguugcauagaa

SEQ ID NO: 651974 - RNA, 19 nt, Homo sapiens
uggacaaucuguucaguuu

SEQ ID NO: 651975 - RNA, 19 nt, Homo sapiens
gacagaaauuggaaauaga

SEQ ID NO: 651976 - RNA, 19 nt, Homo sapiens
ggaagacuauaucuagauc

SEQ ID NO: 651977 - RNA, 19 nt, Homo sapiens
gggaacagauuacgugaag

SEQ ID NO: 651978 - RNA, 19 nt, Homo sapiens
uaauacaacuguucagcuu

SEQ ID NO: 651979 - RNA, 19 nt, Homo sapiens
uuuauuagcugcaagaaug

SEQ ID NO: 651980 - RNA, 19 nt, Homo sapiens
ggaccucagcuacaucaua

SEQ ID NO: 651981 - RNA, 19 nt, Homo sapiens
ccucuaacaugcaaacuga

SEQ ID NO: 651982 - RNA, 19 nt, Homo sapiens
guauggaacuaacaagaug

SEQ ID NO: 651983 - RNA, 19 nt, Homo sapiens
gacuauaucuagaucaugu

SEQ ID NO: 651984 - RNA, 19 nt, Homo sapiens
ccaaagacaacuaguauuc

SEQ ID NO: 651985 - RNA, 19 nt, Homo sapiens
agagaaacgacauaacuua

SEQ ID NO: 651986 - RNA, 19 nt, Homo sapiens
gagcagaagggaacagauu

SEQ ID NO: 651987 - RNA, 19 nt, Homo sapiens
ggaugcagauggagacaau

SEQ ID NO: 651988 - RNA, 19 nt, Homo sapiens
gaagauaagaaccauaaca

SEQ ID NO: 651989 - RNA, 19 nt, Homo sapiens
gcuaaucccuuggucaaug

SEQ ID NO: 651990 - RNA, 19 nt, Homo sapiens
gaaggaacucuuugauguu

SEQ ID NO: 651991 - RNA, 19 nt, Homo sapiens
gaaauggagacuauaagga

SEQ ID NO: 651992 - RNA, 19 nt, Homo sapiens
ggcugaagauuaugaagaa

SEQ ID NO: 651993 - RNA, 19 nt, Homo sapiens
gauccagaguuugcagaua

SEQ ID NO: 651994 - RNA, 19 nt, Homo sapiens
caacuaguauucaacaaac

SEQ ID NO: 651995 - RNA, 19 nt, Homo sapiens
caguaucuguugcaaauga

SEQ ID NO: 651996 - RNA, 19 nt, Homo sapiens
ggagacagauggguagauc

SEQ ID NO: 651997 - RNA, 19 nt, Homo sapiens
guauggauguccuaagaga

SEQ ID NO: 651998 - RNA, 19 nt, Homo sapiens
gaaguugaagugaaaucua

SEQ ID NO: 651999 - RNA, 19 nt, Homo sapiens
guuuggacaugaucuuuaa

SEQ ID NO: 652000 - RNA, 19 nt, Homo sapiens
uaaggaagacuauaucuag

SEQ ID NO: 652001 - RNA, 19 nt, Homo sapiens
uacagaaguugaagugaaa

SEQ ID NO: 652002 - RNA, 19 nt, Homo sapiens
gugaagauaagaaccauaa

SEQ ID NO: 652003 - RNA, 19 nt, Homo sapiens
gcuacagacucaaccgaaa

SEQ ID NO: 652004 - RNA, 19 nt, Homo sapiens
gacaaucuguucaguuuac

SEQ ID NO: 652005 - RNA, 19 nt, Homo sapiens
ggacaaucuguucaguuua

SEQ ID NO: 652006 - RNA, 19 nt, Homo sapiens
gaucagaacgcaccaccaa

SEQ ID NO: 652007 - RNA, 19 nt, Homo sapiens
ugacagaaacgacaaugaa

SEQ ID NO: 652008 - RNA, 19 nt, Homo sapiens
gaugaucucaggacagaaa

SEQ ID NO: 652009 - RNA, 19 nt, Homo sapiens
gauaggaauaguauggaua

SEQ ID NO: 652010 - RNA, 19 nt, Homo sapiens
gcaaagcuuucccuauggu

SEQ ID NO: 652011 - RNA, 19 nt, Homo sapiens
gaacuccagcuuuguugaa

SEQ ID NO: 652012 - RNA, 19 nt, Homo sapiens
aagcaagaaucaccaaaug

SEQ ID NO: 652013 - RNA, 19 nt, Homo sapiens
ccggaaaccuaccgugaaa

SEQ ID NO: 652014 - RNA, 19 nt, Homo sapiens
gaaauuggaaauagaacga

SEQ ID NO: 652015 - RNA, 19 nt, Homo sapiens
ccaaaccuccacaaucuaa

SEQ ID NO: 652016 - RNA, 19 nt, Homo sapiens
gaauaaacucuggguuaaa

SEQ ID NO: 652017 - RNA, 19 nt, Homo sapiens
cgacaaaugaugauugaug

SEQ ID NO: 652018 - RNA, 19 nt, Homo sapiens
gcuaauacccauuugaauc

SEQ ID NO: 652019 - RNA, 19 nt, Homo sapiens
gaccucagcuacaucauac

SEQ ID NO: 652020 - RNA, 19 nt, Homo sapiens
ggaccgauguagaaacaag

SEQ ID NO: 652021 - RNA, 19 nt, Homo sapiens
ugaauggaccgauguagaa

SEQ ID NO: 652022 - RNA, 19 nt, Homo sapiens
ugacaaacgcagauuagaa

SEQ ID NO: 652023 - RNA, 19 nt, Homo sapiens
aaaguuaacccaucuguuc

SEQ ID NO: 652024 - RNA, 19 nt, Homo sapiens
gaaugcacuuuagaacuau

SEQ ID NO: 652025 - RNA, 19 nt, Homo sapiens
ggucugaauuucuuaaggu

SEQ ID NO: 652026 - RNA, 19 nt, Homo sapiens
gcuaagaacauguauggau

SEQ ID NO: 652027 - RNA, 19 nt, Homo sapiens
gaagaggugccguuugauc

SEQ ID NO: 652028 - RNA, 19 nt, Homo sapiens
uaaggagacucaguauuca

SEQ ID NO: 652029 - RNA, 19 nt, Homo sapiens
ggagauugaaacuaaacua

SEQ ID NO: 652030 - RNA, 19 nt, Homo sapiens
gaagugggagaaagaaugu

SEQ ID NO: 652031 - RNA, 19 nt, Homo sapiens
aacaggaacuugaaacuca

SEQ ID NO: 652032 - RNA, 19 nt, Homo sapiens
gcaagggaaacuaaaugaa

SEQ ID NO: 652033 - RNA, 19 nt, Homo sapiens
aaagagacguauugcuaau

SEQ ID NO: 652034 - RNA, 19 nt, Homo sapiens
uagugucuaugguguauuu

SEQ ID NO: 652035 - RNA, 19 nt, Homo sapiens
gcagauaugauaacuguac

SEQ ID NO: 652036 - RNA, 19 nt, Homo sapiens
guaaaugacuggccaauaa

SEQ ID NO: 652037 - RNA, 19 nt, Homo sapiens
gcauagaagugaucaauaa

SEQ ID NO: 652038 - RNA, 19 nt, Homo sapiens
cgacauaacuuacgacaaa

SEQ ID NO: 652039 - RNA, 19 nt, Homo sapiens
gagcaaagcuuucccuaug

SEQ ID NO: 652040 - RNA, 19 nt, Homo sapiens
gacaugaucuuuaacagua

SEQ ID NO: 652041 - RNA, 19 nt, Homo sapiens
ggaagugacucaagaaguu

SEQ ID NO: 652042 - RNA, 19 nt, Homo sapiens
ggacagaaauuggaaauag

SEQ ID NO: 652043 - RNA, 19 nt, Homo sapiens
gaacaaaucacuauaaguc

SEQ ID NO: 652044 - RNA, 19 nt, Homo sapiens
acaaguagauccagaguuu

SEQ ID NO: 652045 - RNA, 19 nt, Homo sapiens
guacagaaguugaagugaa

SEQ ID NO: 652046 - RNA, 19 nt, Homo sapiens
caacugaaggcuauuguua

SEQ ID NO: 652047 - RNA, 19 nt, Homo sapiens
cagaagagguugaugaaga

SEQ ID NO: 652048 - RNA, 19 nt, Homo sapiens
caacacaccucucaaaguc

SEQ ID NO: 652049 - RNA, 19 nt, Homo sapiens
ggaaauagaacgacuggaa

SEQ ID NO: 652050 - RNA, 19 nt, Homo sapiens
ugagguugaugccuuauua

SEQ ID NO: 652051 - RNA, 19 nt, Homo sapiens
agaaugcacuuuagaacua

SEQ ID NO: 652052 - RNA, 19 nt, Homo sapiens
gacaaaugaugauugauga

SEQ ID NO: 652053 - RNA, 19 nt, Homo sapiens
gagacucaguauucauuua

SEQ ID NO: 652054 - RNA, 19 nt, Homo sapiens
gaaagaaugugagcguaga

SEQ ID NO: 652055 - RNA, 19 nt, Homo sapiens
ugaaacaacugaaggcuau

SEQ ID NO: 652056 - RNA, 19 nt, Homo sapiens
uaacccaucuguucaagaa

SEQ ID NO: 652057 - RNA, 19 nt, Homo sapiens
caaccgaaauggagacuau

SEQ ID NO: 652058 - RNA, 19 nt, Homo sapiens
gaaacgacauaacuuacga

SEQ ID NO: 652059 - RNA, 19 nt, Homo sapiens
gaucaagaguguugcauag

SEQ ID NO: 652060 - RNA, 19 nt, Homo sapiens
gaaauagaacgacuggaaa

SEQ ID NO: 652061 - RNA, 19 nt, Homo sapiens
gauugaagccuuagagaaa

SEQ ID NO: 652062 - RNA, 19 nt, Homo sapiens
uaagagagaaccaaaugua

SEQ ID NO: 652063 - RNA, 19 nt, Homo sapiens
gauaagaaccauaacaugu

SEQ ID NO: 652064 - RNA, 19 nt, Homo sapiens
agaaggaacucuuugaugu

SEQ ID NO: 652065 - RNA, 19 nt, Homo sapiens
agaauaaacucuggguuaa

SEQ ID NO: 652066 - RNA, 19 nt, Homo sapiens
ccaaacagcuggagaugca

SEQ ID NO: 652067 - RNA, 19 nt, Homo sapiens
gcaagaaugcacuuuagaa

SEQ ID NO: 652068 - RNA, 19 nt, Homo sapiens
guacaagaauucugcaaag

SEQ ID NO: 652069 - RNA, 19 nt, Homo sapiens
ugaaggcuauuguuacuga

SEQ ID NO: 652070 - RNA, 19 nt, Homo sapiens
caagggaaacuaaaugaaa

SEQ ID NO: 652071 - RNA, 19 nt, Homo sapiens
ccacugggcuuuccugauc

SEQ ID NO: 652072 - RNA, 19 nt, Homo sapiens
acagauggguagaucauaa

SEQ ID NO: 652073 - RNA, 19 nt, Homo sapiens
uggaagaggugccguuuga

SEQ ID NO: 652074 - RNA, 19 nt, Homo sapiens
ucaagaguguugcauagaa

SEQ ID NO: 652075 - RNA, 19 nt, Homo sapiens
uggacaaucuguucaguuu

SEQ ID NO: 652076 - RNA, 19 nt, Homo sapiens
guacaacacaccucucaaa

SEQ ID NO: 652077 - RNA, 19 nt, Homo sapiens
gacagaaauuggaaauaga

SEQ ID NO: 652078 - RNA, 19 nt, Homo sapiens
ggaagacuauaucuagauc

SEQ ID NO: 652079 - RNA, 19 nt, Homo sapiens
ggaggugguuccuacauuc

SEQ ID NO: 652080 - RNA, 19 nt, Homo sapiens
gggaacagauuacgugaag

SEQ ID NO: 652081 - RNA, 19 nt, Homo sapiens
uaauacaacuguucagcuu

SEQ ID NO: 652082 - RNA, 19 nt, Homo sapiens
uuuauuagcugcaagaaug

SEQ ID NO: 652083 - RNA, 19 nt, Homo sapiens
ggaccucagcuacaucaua

SEQ ID NO: 652084 - RNA, 19 nt, Homo sapiens
ccucuaacaugcaaacuga

SEQ ID NO: 652085 - RNA, 19 nt, Homo sapiens
guaacuauauugcucagau

SEQ ID NO: 652086 - RNA, 19 nt, Homo sapiens
guauggaacuaacaagaug

SEQ ID NO: 652087 - RNA, 19 nt, Homo sapiens
gacuauaucuagaucaugu

SEQ ID NO: 652088 - RNA, 19 nt, Homo sapiens
ccaaagacaacuaguauuc

SEQ ID NO: 652089 - RNA, 19 nt, Homo sapiens
aaacuuguaucgugucaga

SEQ ID NO: 652090 - RNA, 19 nt, Homo sapiens
agagaaacgacauaacuua

SEQ ID NO: 652091 - RNA, 19 nt, Homo sapiens
gagcagaagggaacagauu

SEQ ID NO: 652092 - RNA, 19 nt, Homo sapiens
ggaugcagauggagacaau

SEQ ID NO: 652093 - RNA, 19 nt, Homo sapiens
gaagauaagaaccauaaca

SEQ ID NO: 652094 - RNA, 19 nt, Homo sapiens
gcuaaucccuuggucaaug

SEQ ID NO: 652095 - RNA, 19 nt, Homo sapiens
gaaggaacucuuugauguu

SEQ ID NO: 652096 - RNA, 19 nt, Homo sapiens
gaaauggagacuauaagga

SEQ ID NO: 652097 - RNA, 19 nt, Homo sapiens
ggcugaagauuaugaagaa

SEQ ID NO: 652098 - RNA, 19 nt, Homo sapiens
gauccagaguuugcagaua

SEQ ID NO: 652099 - RNA, 19 nt, Homo sapiens
caacuaguauucaacaaac

SEQ ID NO: 652100 - RNA, 19 nt, Homo sapiens
caguaucuguugcaaauga

SEQ ID NO: 652101 - RNA, 19 nt, Homo sapiens
ggagacagauggguagauc

SEQ ID NO: 652102 - RNA, 19 nt, Homo sapiens
guauggauguccuaagaga

SEQ ID NO: 652103 - RNA, 19 nt, Homo sapiens
gaaguugaagugaaaucua

SEQ ID NO: 652104 - RNA, 19 nt, Homo sapiens
guuuggacaugaucuuuaa

SEQ ID NO: 652105 - RNA, 19 nt, Homo sapiens
uaaggaagacuauaucuag

SEQ ID NO: 652106 - RNA, 19 nt, Homo sapiens
uacagaaguugaagugaaa

SEQ ID NO: 652107 - RNA, 19 nt, Homo sapiens
gugaagauaagaaccauaa

SEQ ID NO: 652108 - RNA, 19 nt, Homo sapiens
gcuacagacucaaccgaaa

SEQ ID NO: 652109 - RNA, 19 nt, Homo sapiens
gacaaucuguucaguuuac

SEQ ID NO: 652110 - RNA, 19 nt, Homo sapiens
ggacaaucuguucaguuua

SEQ ID NO: 652111 - RNA, 19 nt, Homo sapiens
gaucagaacgcaccaccaa

SEQ ID NO: 652112 - RNA, 19 nt, Homo sapiens
ugacagaaacgacaaugaa

SEQ ID NO: 652113 - RNA, 19 nt, Homo sapiens
gaugaucucaggacagaaa

SEQ ID NO: 652114 - RNA, 19 nt, Homo sapiens
gauaggaauaguauggaua

SEQ ID NO: 652115 - RNA, 19 nt, Homo sapiens
gcaaagcuuucccuauggu

SEQ ID NO: 652116 - RNA, 19 nt, Homo sapiens
gaacuccagcuuuguugaa

SEQ ID NO: 652117 - RNA, 19 nt, Homo sapiens
aagcaagaaucaccaaaug

SEQ ID NO: 652118 - RNA, 19 nt, Homo sapiens
ccggaaaccuaccgugaaa

SEQ ID NO: 652119 - RNA, 19 nt, Homo sapiens
gggaggugguuccuacauu

SEQ ID NO: 652120 - RNA, 19 nt, Homo sapiens
gaaauuggaaauagaacga

SEQ ID NO: 652121 - RNA, 19 nt, Homo sapiens
ccaaaccuccacaaucuaa

SEQ ID NO: 652122 - RNA, 19 nt, Homo sapiens
cauaggcgcucuaacucuu

SEQ ID NO: 652123 - RNA, 19 nt, Homo sapiens
gaauaaacucuggguuaaa

SEQ ID NO: 652124 - RNA, 19 nt, Homo sapiens
cgacaaaugaugauugaug

SEQ ID NO: 652125 - RNA, 19 nt, Homo sapiens
gcuaauacccauuugaauc

SEQ ID NO: 652126 - RNA, 19 nt, Homo sapiens
gaccucagcuacaucauac

SEQ ID NO: 652127 - RNA, 19 nt, Homo sapiens
ggaccgauguagaaacaag

SEQ ID NO: 652128 - RNA, 19 nt, Homo sapiens
ugaauggaccgauguagaa

SEQ ID NO: 652129 - RNA, 19 nt, Homo sapiens
ugacaaacgcagauuagaa

SEQ ID NO: 652130 - RNA, 19 nt, Homo sapiens
aaaguuaacccaucuguuc

SEQ ID NO: 652131 - RNA, 19 nt, Homo sapiens
gaaugcacuuuagaacuau

SEQ ID NO: 652132 - RNA, 19 nt, Homo sapiens
ggucugaauuucuuaaggu

SEQ ID NO: 652133 - RNA, 19 nt, Homo sapiens
gcuaagaacauguauggau

SEQ ID NO: 652134 - RNA, 19 nt, Homo sapiens
gaagaggugccguuugauc

SEQ ID NO: 652135 - RNA, 19 nt, Homo sapiens
uaaggagacucaguauuca

SEQ ID NO: 652136 - RNA, 19 nt, Homo sapiens
gaaauagucuccacagaaa

SEQ ID NO: 652137 - RNA, 19 nt, Homo sapiens
gaaauggccucugaugaua

SEQ ID NO: 652138 - RNA, 19 nt, Homo sapiens
gaauaagagugcaguguaa

SEQ ID NO: 652139 - RNA, 19 nt, Homo sapiens
ggauagaacuucagaacaa

SEQ ID NO: 652140 - RNA, 19 nt, Homo sapiens
uagaacagcugguuaauga

SEQ ID NO: 652141 - RNA, 19 nt, Homo sapiens
gcuaugaccuuaucuaguu

SEQ ID NO: 652142 - RNA, 19 nt, Homo sapiens
ggaguaagaugaaagguau

SEQ ID NO: 652143 - RNA, 19 nt, Homo sapiens
ggaagaagcugaaauuuug

SEQ ID NO: 652144 - RNA, 19 nt, Homo sapiens
gaauaugccuggaagaaau

SEQ ID NO: 652145 - RNA, 19 nt, Homo sapiens
ccaaauugcuucaucugua

SEQ ID NO: 652146 - RNA, 19 nt, Homo sapiens
gaaucacacugaacucuuu

SEQ ID NO: 652147 - RNA, 19 nt, Homo sapiens
gaaaugacaguaaugcuaa

SEQ ID NO: 652148 - RNA, 19 nt, Homo sapiens
gaaacagccucuucucuag

SEQ ID NO: 652149 - RNA, 19 nt, Homo sapiens
gaagaagccaguaacagua

SEQ ID NO: 652150 - RNA, 19 nt, Homo sapiens
acacugaacucuuuaauag

SEQ ID NO: 652151 - RNA, 19 nt, Homo sapiens
gaacagcugguuaaugaaa

SEQ ID NO: 652152 - RNA, 19 nt, Homo sapiens
gaagggcuuucaucaagaa

SEQ ID NO: 652153 - RNA, 19 nt, Homo sapiens
caacacaacuaaagaacug

SEQ ID NO: 652154 - RNA, 19 nt, Homo sapiens
ggaaaugacaguaaugcua

SEQ ID NO: 652155 - RNA, 19 nt, Homo sapiens
gaagagaaauccaaaucag

SEQ ID NO: 652156 - RNA, 19 nt, Homo sapiens
gaaggcaucucacggaaag

SEQ ID NO: 652157 - RNA, 19 nt, Homo sapiens
gcccaaagcuggcucugaa

SEQ ID NO: 652158 - RNA, 19 nt, Homo sapiens
gcaaggaaguguccacaag

SEQ ID NO: 652159 - RNA, 19 nt, Homo sapiens
uugcuuaacuugcacuuua

SEQ ID NO: 652160 - RNA, 19 nt, Homo sapiens
gauuguagcugaagaaacu

SEQ ID NO: 652161 - RNA, 19 nt, Homo sapiens
gcagauacaguacuuaaau

SEQ ID NO: 652162 - RNA, 19 nt, Homo sapiens
gaacuucagaacaauauga

SEQ ID NO: 652163 - RNA, 19 nt, Homo sapiens
gagccaauugcuauuauua

SEQ ID NO: 652164 - RNA, 19 nt, Homo sapiens
gaaagugcaccaaauggaa

SEQ ID NO: 652165 - RNA, 19 nt, Homo sapiens
gaacucuaauccuugaaga

SEQ ID NO: 652166 - RNA, 19 nt, Homo sapiens
gagaagagaucagcagaag

SEQ ID NO: 652167 - RNA, 19 nt, Homo sapiens
gaugaaagguaugaauaug

SEQ ID NO: 652168 - RNA, 19 nt, Homo sapiens
ccaacuaugugcagauuau

SEQ ID NO: 652169 - RNA, 19 nt, Homo sapiens
gaaacacugcagauuagua

SEQ ID NO: 652170 - RNA, 19 nt, Homo sapiens
uuaaugaaauggccucuga

SEQ ID NO: 652171 - RNA, 19 nt, Homo sapiens
gaauggagccaauugcuau

SEQ ID NO: 652172 - RNA, 19 nt, Homo sapiens
ggaaaagacuaugaaagua

SEQ ID NO: 652173 - RNA, 19 nt, Homo sapiens
ggaagaagccaguaacagu

SEQ ID NO: 652174 - RNA, 19 nt, Homo sapiens
gaagagaucagcagaaggu

SEQ ID NO: 652175 - RNA, 19 nt, Homo sapiens
aaacaaggaugagaagaga

SEQ ID NO: 652176 - RNA, 19 nt, Homo sapiens
cauaagcaauucacacaga

SEQ ID NO: 652177 - RNA, 19 nt, Homo sapiens
caauagaacagcugguuaa

SEQ ID NO: 652178 - RNA, 19 nt, Homo sapiens
gucaaagucucuaguucua

SEQ ID NO: 652179 - RNA, 19 nt, Homo sapiens
gaagaaauuuuaccuagug

SEQ ID NO: 652180 - RNA, 19 nt, Homo sapiens
uaucagacuugcaggguaa

SEQ ID NO: 652181 - RNA, 19 nt, Homo sapiens
ugaaacagccucuucucua

SEQ ID NO: 652182 - RNA, 19 nt, Homo sapiens
caacaaaggcuaagucaac

SEQ ID NO: 652183 - RNA, 19 nt, Homo sapiens
aaacaacuguauggaguaa

SEQ ID NO: 652184 - RNA, 19 nt, Homo sapiens
aauaauaggcucauaguga

SEQ ID NO: 652185 - RNA, 19 nt, Homo sapiens
aaauagcacuuccuugaug

SEQ ID NO: 652186 - RNA, 19 nt, Homo sapiens
gaaauccaaaucagaagaa

SEQ ID NO: 652187 - RNA, 19 nt, Homo sapiens
aaugaaacacugcagauua

SEQ ID NO: 652188 - RNA, 19 nt, Homo sapiens
gaaauuacaagccauagag

SEQ ID NO: 652189 - RNA, 19 nt, Homo sapiens
caccaucuuuguaauauug

SEQ ID NO: 652190 - RNA, 19 nt, Homo sapiens
gaaacuaagccaaaagaua

SEQ ID NO: 652191 - RNA, 19 nt, Homo sapiens
aaacaaucuucuacaguga

SEQ ID NO: 652192 - RNA, 19 nt, Homo sapiens
ggagccaauugcuauuauu

SEQ ID NO: 652193 - RNA, 19 nt, Homo sapiens
caaaucagaagaaagcaaa

SEQ ID NO: 652194 - RNA, 19 nt, Homo sapiens
ugaaugaucaggcaacaaa

SEQ ID NO: 652195 - RNA, 19 nt, Homo sapiens
gaagagagaauacaguuuu

SEQ ID NO: 652196 - RNA, 19 nt, Homo sapiens
auaauaggcucauagugaa

SEQ ID NO: 652197 - RNA, 19 nt, Homo sapiens
ugaaauagucuccacagaa

SEQ ID NO: 652198 - RNA, 19 nt, Homo sapiens
gaugaggucugugaaucaa

SEQ ID NO: 652199 - RNA, 19 nt, Homo sapiens
ccaggaagaagcugaaauu

SEQ ID NO: 652200 - RNA, 19 nt, Homo sapiens
gcaucaaaguccaggaaga

SEQ ID NO: 652201 - RNA, 19 nt, Homo sapiens
aagaagggcuuucaucaag

SEQ ID NO: 652202 - RNA, 19 nt, Homo sapiens
ccagucauuucauuaaguu

SEQ ID NO: 652203 - RNA, 19 nt, Homo sapiens
gauaccaccaucuuuguaa

SEQ ID NO: 652204 - RNA, 19 nt, Homo sapiens
gauagaacuucagaacaau

SEQ ID NO: 652205 - RNA, 19 nt, Homo sapiens
acacagacaacacaacuaa

SEQ ID NO: 652206 - RNA, 19 nt, Homo sapiens
ugggaucacugaagagaaa

SEQ ID NO: 652207 - RNA, 19 nt, Homo sapiens
ggaagagagaauacaguuu

SEQ ID NO: 652208 - RNA, 19 nt, Homo sapiens
guuaaucugagcucuguua

SEQ ID NO: 652209 - RNA, 19 nt, Homo sapiens
gaagaaauugaaacgauca

SEQ ID NO: 652210 - RNA, 19 nt, Homo sapiens
caaauugcuucaucuguac

SEQ ID NO: 652211 - RNA, 19 nt, Homo sapiens
gaaucaaaugugagcaaua

SEQ ID NO: 652212 - RNA, 19 nt, Homo sapiens
aaauaugccugguagaauc

SEQ ID NO: 652213 - RNA, 19 nt, Homo sapiens
cagauacaguacuuaaaug

SEQ ID NO: 652214 - RNA, 19 nt, Homo sapiens
uuacuacucuuacugacuu

SEQ ID NO: 652215 - RNA, 19 nt, Homo sapiens
ugaaauggccucugaugau

SEQ ID NO: 652216 - RNA, 19 nt, Homo sapiens
guagaacuuggauuagaua

SEQ ID NO: 652217 - RNA, 19 nt, Homo sapiens
caaaauagaaucacacuga

SEQ ID NO: 652218 - RNA, 19 nt, Homo sapiens
gccaaaagauacugaauug

SEQ ID NO: 652219 - RNA, 19 nt, Homo sapiens
caguagaacuuggauuaga

SEQ ID NO: 652220 - RNA, 19 nt, Homo sapiens
aaucaaaugugagcaauag

SEQ ID NO: 652221 - RNA, 19 nt, Homo sapiens
gaauacaguuuucuagaga

SEQ ID NO: 652222 - RNA, 19 nt, Homo sapiens
aaagaaagcagccaaagca

SEQ ID NO: 652223 - RNA, 19 nt, Homo sapiens
cagcagauacaguacuuaa

SEQ ID NO: 652224 - RNA, 19 nt, Homo sapiens
ugauacagcagauacagua

SEQ ID NO: 652225 - RNA, 19 nt, Homo sapiens
ggauuagagauguauguaa

SEQ ID NO: 652226 - RNA, 19 nt, Homo sapiens
ccuagaaagugcaccaaau

SEQ ID NO: 652227 - RNA, 19 nt, Homo sapiens
uaacaguacccuagaaagu

SEQ ID NO: 652228 - RNA, 19 nt, Homo sapiens
gcaauuccagaucaacaaa

SEQ ID NO: 652229 - RNA, 19 nt, Homo sapiens
gaaaauaugccugguagaa

SEQ ID NO: 652230 - RNA, 19 nt, Homo sapiens
gauuacaucagcuugcuuu

SEQ ID NO: 652231 - RNA, 19 nt, Homo sapiens
caaagucucuaguucuaac

SEQ ID NO: 652232 - RNA, 19 nt, Homo sapiens
ggugaggauuagagaugua

SEQ ID NO: 652233 - RNA, 19 nt, Homo sapiens
gccaguacuuucugauguu

SEQ ID NO: 652234 - RNA, 19 nt, Homo sapiens
acaacuguauggaguaaga

SEQ ID NO: 652235 - RNA, 19 nt, Homo sapiens
gagucaaagucucuaguuc

SEQ ID NO: 652236 - RNA, 19 nt, Homo sapiens
gaacuggacugacggauga

SEQ ID NO: 652237 - RNA, 19 nt, Homo sapiens
gcauccaucuucugacaua

SEQ ID NO: 652238 - RNA, 19 nt, Homo sapiens
caacugaggucaugacaag

SEQ ID NO: 652239 - RNA, 19 nt, Homo sapiens
uagcaucucugucaucauu

SEQ ID NO: 652240 - RNA, 19 nt, Homo sapiens
gagcauguauguauuugga

SEQ ID NO: 652241 - RNA, 19 nt, Homo sapiens
caaguucugugacaacaaa

SEQ ID NO: 652242 - RNA, 19 nt, Homo sapiens
agaaggagcucuggaagaa

SEQ ID NO: 652243 - RNA, 19 nt, Homo sapiens
ccgcugagcuguaacaugu

SEQ ID NO: 652244 - RNA, 19 nt, Homo sapiens
ccagagaccuccuucaucu

SEQ ID NO: 652245 - RNA, 19 nt, Homo sapiens
ucaacucuaugcacaagua

SEQ ID NO: 652246 - RNA, 19 nt, Homo sapiens
ggaggguucauaugaguua

SEQ ID NO: 652247 - RNA, 19 nt, Homo sapiens
gagcauccaucuucugaca

SEQ ID NO: 652248 - RNA, 19 nt, Homo sapiens
ccguguugcuccaguauua

SEQ ID NO: 652249 - RNA, 19 nt, Homo sapiens
gagaaucuuccuuacagua

SEQ ID NO: 652250 - RNA, 19 nt, Homo sapiens
gcauguauguacucagguu

SEQ ID NO: 652251 - RNA, 19 nt, Homo sapiens
ggacucaagccucuucuau

SEQ ID NO: 652252 - RNA, 19 nt, Homo sapiens
ggaccguguugcuccagua

SEQ ID NO: 652253 - RNA, 19 nt, Homo sapiens
ucucaaaccuucuccuugu

SEQ ID NO: 652254 - RNA, 19 nt, Homo sapiens
acucaagccucuucuauca

SEQ ID NO: 652255 - RNA, 19 nt, Homo sapiens
ccaaguauauccugcugau

SEQ ID NO: 652256 - RNA, 19 nt, Homo sapiens
ccacauuuaucuaagaagu

SEQ ID NO: 652257 - RNA, 19 nt, Homo sapiens
gagagcauccaucuucuga

SEQ ID NO: 652258 - RNA, 19 nt, Homo sapiens
ggucaugggcuaaauguca

SEQ ID NO: 652259 - RNA, 19 nt, Homo sapiens
gaccaucgcuacaaguucu

SEQ ID NO: 652260 - RNA, 19 nt, Homo sapiens
ugaguggccuagacauuga

SEQ ID NO: 652261 - RNA, 19 nt, Homo sapiens
gaguggaggguucauauga

SEQ ID NO: 652262 - RNA, 19 nt, Homo sapiens
ggccugcacucuaccaaga

SEQ ID NO: 652263 - RNA, 19 nt, Homo sapiens
caagcgauccuaucuggaa

SEQ ID NO: 652264 - RNA, 19 nt, Homo sapiens
caagaucacccagcugaaa

SEQ ID NO: 652265 - RNA, 19 nt, Homo sapiens
gaaagggucaugggcuaaa

SEQ ID NO: 652266 - RNA, 19 nt, Homo sapiens
gagaaggagcucuggaaga

SEQ ID NO: 652267 - RNA, 19 nt, Homo sapiens
acacgagcauguauguauu

SEQ ID NO: 652268 - RNA, 19 nt, Homo sapiens
uaucugacaucucuugaca

SEQ ID NO: 652269 - RNA, 19 nt, Homo sapiens
aggagaugcugcaggauaa

SEQ ID NO: 652270 - RNA, 19 nt, Homo sapiens
caggagaugcugcaggaua

SEQ ID NO: 652271 - RNA, 19 nt, Homo sapiens
ucugacaucucuugacaug

SEQ ID NO: 652272 - RNA, 19 nt, Homo sapiens
caagaaacacaggaaggua

SEQ ID NO: 652273 - RNA, 19 nt, Homo sapiens
gcaucucugucaucauuca

SEQ ID NO: 652274 - RNA, 19 nt, Homo sapiens
uaaaugcugccaaugaguu

SEQ ID NO: 652275 - RNA, 19 nt, Homo sapiens
ccgagaaucuuccuuacag

SEQ ID NO: 652276 - RNA, 19 nt, Homo sapiens
ggaaagggucaugggcuaa

SEQ ID NO: 652277 - RNA, 19 nt, Homo sapiens
caccacauuuaucuaagaa

SEQ ID NO: 652278 - RNA, 19 nt, Homo sapiens
gcuguaacauguggacuuc

SEQ ID NO: 652279 - RNA, 19 nt, Homo sapiens
cagagaagcauguauguac

SEQ ID NO: 652280 - RNA, 19 nt, Homo sapiens
cauaucauccucaacucua

SEQ ID NO: 652281 - RNA, 19 nt, Homo sapiens
ggguucauaugaguuauug

SEQ ID NO: 652282 - RNA, 19 nt, Homo sapiens
acaccacauuuaucuaaga

SEQ ID NO: 652283 - RNA, 19 nt, Homo sapiens
gcuauagcgugcagacgau

SEQ ID NO: 652284 - RNA, 19 nt, Homo sapiens
caccuccgcugagcuguaa

SEQ ID NO: 652285 - RNA, 19 nt, Homo sapiens
aaauugagaacaacccuuu

SEQ ID NO: 652286 - RNA, 19 nt, Homo sapiens
ggucuauuguuaucugaca

SEQ ID NO: 652287 - RNA, 19 nt, Homo sapiens
ccaggaaaugcccacuuua

SEQ ID NO: 652288 - RNA, 19 nt, Homo sapiens
ucacccagcugaaaauuga

SEQ ID NO: 652289 - RNA, 19 nt, Homo sapiens
accaggaaaugcccacuuu

SEQ ID NO: 652290 - RNA, 19 nt, Homo sapiens
aaguauauccugcugauug

SEQ ID NO: 652291 - RNA, 19 nt, Homo sapiens
ggacucugugcacaccuua

SEQ ID NO: 652292 - RNA, 19 nt, Homo sapiens
gagcagaccaucgagaaca

SEQ ID NO: 652293 - RNA, 19 nt, Homo sapiens
aguauauccugcugauuga

SEQ ID NO: 652294 - RNA, 19 nt, Homo sapiens
ccagagaagcauguaugua

SEQ ID NO: 652295 - RNA, 19 nt, Homo sapiens
gcuacaaguucugugacaa

SEQ ID NO: 652296 - RNA, 19 nt, Homo sapiens
gggaguggaggguucauau

SEQ ID NO: 652297 - RNA, 19 nt, Homo sapiens
gacugcagagcaaagaaua

SEQ ID NO: 652298 - RNA, 19 nt, Homo sapiens
ucucacgucuccuccauag

SEQ ID NO: 652299 - RNA, 19 nt, Homo sapiens
aaggagcucuggaagaagu

SEQ ID NO: 652300 - RNA, 19 nt, Homo sapiens
ucaagccucuucuaucacu

SEQ ID NO: 652301 - RNA, 19 nt, Homo sapiens
caaagaauaccccgugauu

SEQ ID NO: 652302 - RNA, 19 nt, Homo sapiens
gggaugacguucggaaagg

SEQ ID NO: 652303 - RNA, 19 nt, Homo sapiens
ucugaggucugagggauga

SEQ ID NO: 652304 - RNA, 19 nt, Homo sapiens
gugaguggccuagacauug

SEQ ID NO: 652305 - RNA, 19 nt, Homo sapiens
gaggugggcucagcuaagc

SEQ ID NO: 652306 - RNA, 19 nt, Homo sapiens
gagaggugggcucagcuaa

SEQ ID NO: 652307 - RNA, 19 nt, Homo sapiens
acauacaacugaggucaug

SEQ ID NO: 652308 - RNA, 19 nt, Homo sapiens
ucuaaaugcugccaaugag

SEQ ID NO: 652309 - RNA, 19 nt, Homo sapiens
caggaaaugcccacuuuag

SEQ ID NO: 652310 - RNA, 19 nt, Homo sapiens
guggaggguucauaugagu

SEQ ID NO: 652311 - RNA, 19 nt, Homo sapiens
ggaguggaggguucauaug

SEQ ID NO: 652312 - RNA, 19 nt, Homo sapiens
guauguauuuggagagcau

SEQ ID NO: 652313 - RNA, 19 nt, Homo sapiens
gagcugagaaucugguuuu

SEQ ID NO: 652314 - RNA, 19 nt, Homo sapiens
gucccgagaaucuuccuua

SEQ ID NO: 652315 - RNA, 19 nt, Homo sapiens
cuaccagaaucacaagauc

SEQ ID NO: 652316 - RNA, 19 nt, Homo sapiens
cugaugagaacaaugcuuu

SEQ ID NO: 652317 - RNA, 19 nt, Homo sapiens
cguuaaggcugaugagaac

SEQ ID NO: 652318 - RNA, 19 nt, Homo sapiens
gcucagcuaagccacaaug

SEQ ID NO: 652319 - RNA, 19 nt, Homo sapiens
guuccuggccuucucuuug

SEQ ID NO: 652320 - RNA, 19 nt, Homo sapiens
gagggaugacguucggaaa

SEQ ID NO: 652321 - RNA, 19 nt, Homo sapiens
agaaacacaggaagguauu

SEQ ID NO: 652322 - RNA, 19 nt, Homo sapiens
gcgccucauucccaagaga

SEQ ID NO: 652323 - RNA, 19 nt, Homo sapiens
caccuggacuuaccuugca

SEQ ID NO: 652324 - RNA, 19 nt, Homo sapiens
ccugcacucuaccaagaaa

SEQ ID NO: 652325 - RNA, 19 nt, Homo sapiens
cgagaaucuuccuuacagu

SEQ ID NO: 652326 - RNA, 19 nt, Homo sapiens
gccaaugaguuucucuacu

SEQ ID NO: 652327 - RNA, 19 nt, Homo sapiens
gaaacacaggaagguauuc

SEQ ID NO: 652328 - RNA, 19 nt, Homo sapiens
aagaaacacaggaagguau

SEQ ID NO: 652329 - RNA, 19 nt, Homo sapiens
cuggagcucugaggucuga

SEQ ID NO: 652330 - RNA, 19 nt, Homo sapiens
ggagagcauccaucuucug

SEQ ID NO: 652331 - RNA, 19 nt, Homo sapiens
gcucccagccaccaggaaa

SEQ ID NO: 652332 - RNA, 19 nt, Homo sapiens
gagccagccaugccaggaa

SEQ ID NO: 652333 - RNA, 19 nt, Homo sapiens
ccacaggagcccacuggau

SEQ ID NO: 652334 - RNA, 19 nt, Homo sapiens
caauguguacuuugauagu

SEQ ID NO: 652335 - RNA, 19 nt, Homo sapiens
cacgagcauguauguauuu

SEQ ID NO: 652336 - RNA, 19 nt, Homo sapiens
gcaggugauuugauaauua

SEQ ID NO: 652337 - RNA, 19 nt, Homo sapiens
caccagagcuugcuguuua

SEQ ID NO: 652338 - RNA, 19 nt, Homo sapiens
ggaagucucuugcaaauuc

SEQ ID NO: 652339 - RNA, 19 nt, Homo sapiens
agacagaaaugaccucuua

SEQ ID NO: 652340 - RNA, 19 nt, Homo sapiens
ggagaaacauaugcauuua

SEQ ID NO: 652341 - RNA, 19 nt, Homo sapiens
ggaaauggaugaacugugu

SEQ ID NO: 652342 - RNA, 19 nt, Homo sapiens
gcaaauaugugaaaugucu

SEQ ID NO: 652343 - RNA, 19 nt, Homo sapiens
gaaaugcucucuuugaagu

SEQ ID NO: 652344 - RNA, 19 nt, Homo sapiens
gaacacaaauugaagaaag

SEQ ID NO: 652345 - RNA, 19 nt, Homo sapiens
gagagaggguggaucauaa

SEQ ID NO: 652346 - RNA, 19 nt, Homo sapiens
gauagcuucuggccaauua

SEQ ID NO: 652347 - RNA, 19 nt, Homo sapiens
caagggaguuacugcauua

SEQ ID NO: 652348 - RNA, 19 nt, Homo sapiens
gaaaggaacacaaauugaa

SEQ ID NO: 652349 - RNA, 19 nt, Homo sapiens
gaacagucaugcuggauau

SEQ ID NO: 652350 - RNA, 19 nt, Homo sapiens
gcuaaugcauguauuugua

SEQ ID NO: 652351 - RNA, 19 nt, Homo sapiens
guacaugguucuuaacuau

SEQ ID NO: 652352 - RNA, 19 nt, Homo sapiens
uggagaagcucuuugauuu

SEQ ID NO: 652353 - RNA, 19 nt, Homo sapiens
auaaagcacugccauauuu

SEQ ID NO: 652354 - RNA, 19 nt, Homo sapiens
gagaaagauuccuguguuu

SEQ ID NO: 652355 - RNA, 19 nt, Homo sapiens
ugaaauagcagauauggua

SEQ ID NO: 652356 - RNA, 19 nt, Homo sapiens
gagcaaagguaacucaugu

SEQ ID NO: 652357 - RNA, 19 nt, Homo sapiens
gagcacagguccaguucua

SEQ ID NO: 652358 - RNA, 19 nt, Homo sapiens
cuagauggcugaaauuuga

SEQ ID NO: 652359 - RNA, 19 nt, Homo sapiens
uuacagagauggagaagaa

SEQ ID NO: 652360 - RNA, 19 nt, Homo sapiens
gaaauguaaucaucccaaa

SEQ ID NO: 652361 - RNA, 19 nt, Homo sapiens
ggcaauugauagaguauua

SEQ ID NO: 652362 - RNA, 19 nt, Homo sapiens
caagaggcauuauacauau

SEQ ID NO: 652363 - RNA, 19 nt, Homo sapiens
caugaugguucuugcauua

SEQ ID NO: 652364 - RNA, 19 nt, Homo sapiens
gaaaggagcuggcuaucac

SEQ ID NO: 652365 - RNA, 19 nt, Homo sapiens
gcacaacaacuuagauaaa

SEQ ID NO: 652366 - RNA, 19 nt, Homo sapiens
uaacugggauugccuauuc

SEQ ID NO: 652367 - RNA, 19 nt, Homo sapiens
ugacuuaacuccagguauu

SEQ ID NO: 652368 - RNA, 19 nt, Homo sapiens
gaaguuaccugguccugau

SEQ ID NO: 652369 - RNA, 19 nt, Homo sapiens
uuucagggcuucucuauuu

SEQ ID NO: 652370 - RNA, 19 nt, Homo sapiens
gaagaugaaccaagaaaga

SEQ ID NO: 652371 - RNA, 19 nt, Homo sapiens
ggaaagaaacugcuagaug

SEQ ID NO: 652372 - RNA, 19 nt, Homo sapiens
cauccugccuuucaaauuu

SEQ ID NO: 652373 - RNA, 19 nt, Homo sapiens
gaugagagguuggaaaugu

SEQ ID NO: 652374 - RNA, 19 nt, Homo sapiens
ggagaagcucuuugauuua

SEQ ID NO: 652375 - RNA, 19 nt, Homo sapiens
gagaggagaaucaccuuua

SEQ ID NO: 652376 - RNA, 19 nt, Homo sapiens
ugaagaagcuguuguggau

SEQ ID NO: 652377 - RNA, 19 nt, Homo sapiens
ccaagaggcauuauacaua

SEQ ID NO: 652378 - RNA, 19 nt, Homo sapiens
uaugggaguuuccucauua

SEQ ID NO: 652379 - RNA, 19 nt, Homo sapiens
caacaaaucacagcuguaa

SEQ ID NO: 652380 - RNA, 19 nt, Homo sapiens
gcaaagguaacucauguuu

SEQ ID NO: 652381 - RNA, 19 nt, Homo sapiens
uagauaaacugaccagcua

SEQ ID NO: 652382 - RNA, 19 nt, Homo sapiens
gggaaucuccuucuuauga

SEQ ID NO: 652383 - RNA, 19 nt, Homo sapiens
uuuaugagcuuccauugua

SEQ ID NO: 652384 - RNA, 19 nt, Homo sapiens
guaauguccuccucuaaga

SEQ ID NO: 652385 - RNA, 19 nt, Homo sapiens
guggagaaauuaaagguaa

SEQ ID NO: 652386 - RNA, 19 nt, Homo sapiens
gguauuagacaacaugaua

SEQ ID NO: 652387 - RNA, 19 nt, Homo sapiens
gcacccauaccauuuauaa

SEQ ID NO: 652388 - RNA, 19 nt, Homo sapiens
gagaagcucuuugauuuag

SEQ ID NO: 652389 - RNA, 19 nt, Homo sapiens
gaagagacaucaucaucag

SEQ ID NO: 652390 - RNA, 19 nt, Homo sapiens
gaaucuccuucuuaugaua

SEQ ID NO: 652391 - RNA, 19 nt, Homo sapiens
gaagaacuagaaagucaua

SEQ ID NO: 652392 - RNA, 19 nt, Homo sapiens
gagagacagugacagauau

SEQ ID NO: 652393 - RNA, 19 nt, Homo sapiens
gaagaaaggagcuggcuau

SEQ ID NO: 652394 - RNA, 19 nt, Homo sapiens
caaugaaacucuagcacaa

SEQ ID NO: 652395 - RNA, 19 nt, Homo sapiens
uaaaguguguguauguuug

SEQ ID NO: 652396 - RNA, 19 nt, Homo sapiens
gaucauaguguuucuguga

SEQ ID NO: 652397 - RNA, 19 nt, Homo sapiens
gcgaggagcagaagaauga

SEQ ID NO: 652398 - RNA, 19 nt, Homo sapiens
uagcagauaugguauuaga

SEQ ID NO: 652399 - RNA, 19 nt, Homo sapiens
gguaacucauguuuaagua

SEQ ID NO: 652400 - RNA, 19 nt, Homo sapiens
ugagguacaugguucuuaa

SEQ ID NO: 652401 - RNA, 19 nt, Homo sapiens
gaccuuauauuccagaugu

SEQ ID NO: 652402 - RNA, 19 nt, Homo sapiens
gaucugacuacuccauuua

SEQ ID NO: 652403 - RNA, 19 nt, Homo sapiens
ccacggugcuuauuauugu

SEQ ID NO: 652404 - RNA, 19 nt, Homo sapiens
cguaucaugucacuauaua

SEQ ID NO: 652405 - RNA, 19 nt, Homo sapiens
gcucagauuucaacugugu

SEQ ID NO: 652406 - RNA, 19 nt, Homo sapiens
gaaugcuguuucaaucuaa

SEQ ID NO: 652407 - RNA, 19 nt, Homo sapiens
aaacugauuugacaagaga

SEQ ID NO: 652408 - RNA, 19 nt, Homo sapiens
ccauagagaugacuguaga

SEQ ID NO: 652409 - RNA, 19 nt, Homo sapiens
agaaggauguggagaaaug

SEQ ID NO: 652410 - RNA, 19 nt, Homo sapiens
caaaucacagcuguaauua

SEQ ID NO: 652411 - RNA, 19 nt, Homo sapiens
ugaagaugaugaugaagaa

SEQ ID NO: 652412 - RNA, 19 nt, Homo sapiens
gcucagcaguuuaacaugu

SEQ ID NO: 652413 - RNA, 19 nt, Homo sapiens
gaucuuaugccagaaagua

SEQ ID NO: 652414 - RNA, 19 nt, Homo sapiens
gcacaauggaagaaagaua

SEQ ID NO: 652415 - RNA, 19 nt, Homo sapiens
agagaaagauuccuguguu

SEQ ID NO: 652416 - RNA, 19 nt, Homo sapiens
gaaacuuggacaauaguaa

SEQ ID NO: 652417 - RNA, 19 nt, Homo sapiens
caugaucucuucacggaaa

SEQ ID NO: 652418 - RNA, 19 nt, Homo sapiens
aauaaaggaucaugaggaa

SEQ ID NO: 652419 - RNA, 19 nt, Homo sapiens
ucagaagggucuaugauca

SEQ ID NO: 652420 - RNA, 19 nt, Homo sapiens
aagaagaacuagaaaguca

SEQ ID NO: 652421 - RNA, 19 nt, Homo sapiens
agagaugacuguagaacaa

SEQ ID NO: 652422 - RNA, 19 nt, Homo sapiens
gaaccaagaggcauuauac

SEQ ID NO: 652423 - RNA, 19 nt, Homo sapiens
guaccauucucaucuuuau

SEQ ID NO: 652424 - RNA, 19 nt, Homo sapiens
cagaauaagugcaauagag

SEQ ID NO: 652425 - RNA, 19 nt, Homo sapiens
ugaagaggauguugaagau

SEQ ID NO: 652426 - RNA, 19 nt, Homo sapiens
ggacgggaaucuccuucuu

SEQ ID NO: 652427 - RNA, 19 nt, Homo sapiens
gcacauauugaacauuuga

SEQ ID NO: 652428 - RNA, 19 nt, Homo sapiens
caaagguaacucauguuua

SEQ ID NO: 652429 - RNA, 19 nt, Homo sapiens
auauguagcugucaucauu

SEQ ID NO: 652430 - RNA, 19 nt, Homo sapiens
gauauaaagcacugccaua

SEQ ID NO: 652431 - RNA, 19 nt, Homo sapiens
gaagcucuuugauuuagga

SEQ ID NO: 652432 - RNA, 19 nt, Homo sapiens
cugcagagauuaucaacuu

SEQ ID NO: 652433 - RNA, 19 nt, Homo sapiens
gcaagguugauaugaauuu

SEQ ID NO: 652434 - RNA, 19 nt, Homo sapiens
gacccucacuugcuugaaa

SEQ ID NO: 652435 - RNA, 19 nt, Homo sapiens
gugcaaauaugugaaaugu

SEQ ID NO: 652436 - RNA, 19 nt, Homo sapiens
gaaagaauguguagcaaau

SEQ ID NO: 652437 - RNA, 19 nt, Homo sapiens
gaucgcggauggauuauua

SEQ ID NO: 652438 - RNA, 19 nt, Homo sapiens
gaacaguccuccuggauau

SEQ ID NO: 652439 - RNA, 19 nt, Homo sapiens
gcauuugccucccuaauuu

SEQ ID NO: 652440 - RNA, 19 nt, Homo sapiens
gcucauaccuacaauguga

SEQ ID NO: 652441 - RNA, 19 nt, Homo sapiens
gcaaauagcauagaagaaa

SEQ ID NO: 652442 - RNA, 19 nt, Homo sapiens
aaagauaacuugcauagga

SEQ ID NO: 652443 - RNA, 19 nt, Homo sapiens
ccaaagauguucucagcua

SEQ ID NO: 652444 - RNA, 19 nt, Homo sapiens
gaucacagccgucauuauu

SEQ ID NO: 652445 - RNA, 19 nt, Homo sapiens
gaugaucgcggauggauua

SEQ ID NO: 652446 - RNA, 19 nt, Homo sapiens
gaugagaucuguaugaaag

SEQ ID NO: 652447 - RNA, 19 nt, Homo sapiens
gcaauugaauccuuguuug

SEQ ID NO: 652448 - RNA, 19 nt, Homo sapiens
ucacagccgucauuauuaa

SEQ ID NO: 652449 - RNA, 19 nt, Homo sapiens
gaacauaagcucaagaaag

SEQ ID NO: 652450 - RNA, 19 nt, Homo sapiens
gaccagugcuuguguuuga

SEQ ID NO: 652451 - RNA, 19 nt, Homo sapiens
guacaauucucaacauuca

SEQ ID NO: 652452 - RNA, 19 nt, Homo sapiens
ggagugaauugugaacaua

SEQ ID NO: 652453 - RNA, 19 nt, Homo sapiens
ugaagaagauguugaagau

SEQ ID NO: 652454 - RNA, 19 nt, Homo sapiens
gaagagaaacaaccucauu

SEQ ID NO: 652455 - RNA, 19 nt, Homo sapiens
ccagguggcugaaguuuga

SEQ ID NO: 652456 - RNA, 19 nt, Homo sapiens
gcaacugucuuguccauca

SEQ ID NO: 652457 - RNA, 19 nt, Homo sapiens
ggaauucaguucuuugauc

SEQ ID NO: 652458 - RNA, 19 nt, Homo sapiens
uuacagagcuggaugagau

SEQ ID NO: 652459 - RNA, 19 nt, Homo sapiens
ggagaugcauggagaguuc

SEQ ID NO: 652460 - RNA, 19 nt, Homo sapiens
ugacugggauugcuuauuc

SEQ ID NO: 652461 - RNA, 19 nt, Homo sapiens
gaacauaguccuguggauu

SEQ ID NO: 652462 - RNA, 19 nt, Homo sapiens
cauaggacuuucugucuuu

SEQ ID NO: 652463 - RNA, 19 nt, Homo sapiens
caaagauguucucagcuaa

SEQ ID NO: 652464 - RNA, 19 nt, Homo sapiens
aguugaagcuggaggauua

SEQ ID NO: 652465 - RNA, 19 nt, Homo sapiens
gcaaagcaccagccagauu

SEQ ID NO: 652466 - RNA, 19 nt, Homo sapiens
ugacaggccuuaugaucuu

SEQ ID NO: 652467 - RNA, 19 nt, Homo sapiens
gagacuagccugggcaaua

SEQ ID NO: 652468 - RNA, 19 nt, Homo sapiens
gcauaggacuuucugucuu

SEQ ID NO: 652469 - RNA, 19 nt, Homo sapiens
ugacggcuaucuuaaaguu

SEQ ID NO: 652470 - RNA, 19 nt, Homo sapiens
gcucuucucuguacuaucu

SEQ ID NO: 652471 - RNA, 19 nt, Homo sapiens
ggaacaguccuccuggaua

SEQ ID NO: 652472 - RNA, 19 nt, Homo sapiens
ggagcugccuuauuaaugg

SEQ ID NO: 652473 - RNA, 19 nt, Homo sapiens
gagaagaugcugaguggaa

SEQ ID NO: 652474 - RNA, 19 nt, Homo sapiens
uaagacccauuauuuccua

SEQ ID NO: 652475 - RNA, 19 nt, Homo sapiens
caaagcaccagccagauuu

SEQ ID NO: 652476 - RNA, 19 nt, Homo sapiens
ccaguucccuugucugcua

SEQ ID NO: 652477 - RNA, 19 nt, Homo sapiens
gcaauuaucccagcucuuc

SEQ ID NO: 652478 - RNA, 19 nt, Homo sapiens
ucccuugucugcuacauua

SEQ ID NO: 652479 - RNA, 19 nt, Homo sapiens
uaggaagggucaugugaaa

SEQ ID NO: 652480 - RNA, 19 nt, Homo sapiens
cacaauggacccucaauaa

SEQ ID NO: 652481 - RNA, 19 nt, Homo sapiens
gcagaucacagccgucauu

SEQ ID NO: 652482 - RNA, 19 nt, Homo sapiens
gccuauaugugcaaagaaa

SEQ ID NO: 652483 - RNA, 19 nt, Homo sapiens
caauggacccucaauaaau

SEQ ID NO: 652484 - RNA, 19 nt, Homo sapiens
gcagucugauccucauuug

SEQ ID NO: 652485 - RNA, 19 nt, Homo sapiens
gcaaagaaagaauguguag

SEQ ID NO: 652486 - RNA, 19 nt, Homo sapiens
caugggaguuucuucacua

SEQ ID NO: 652487 - RNA, 19 nt, Homo sapiens
ugaagaagcugugguggau

SEQ ID NO: 652488 - RNA, 19 nt, Homo sapiens
gugagugacuuugcuguuu

SEQ ID NO: 652489 - RNA, 19 nt, Homo sapiens
aagaauguguagcaaauga

SEQ ID NO: 652490 - RNA, 19 nt, Homo sapiens
gaacauaggaagggucaug

SEQ ID NO: 652491 - RNA, 19 nt, Homo sapiens
ggaaggaacauaagcucaa

SEQ ID NO: 652492 - RNA, 19 nt, Homo sapiens
ggaccgcuuuccuguguau

SEQ ID NO: 652493 - RNA, 19 nt, Homo sapiens
ucagagaccagaugaagaa

SEQ ID NO: 652494 - RNA, 19 nt, Homo sapiens
ggccagaaguuugagacua

SEQ ID NO: 652495 - RNA, 19 nt, Homo sapiens
ugagugagcugggaagugu

SEQ ID NO: 652496 - RNA, 19 nt, Homo sapiens
gaugaucucacgccugaaa

SEQ ID NO: 652497 - RNA, 19 nt, Homo sapiens
uaagugcaauugaauccuu

SEQ ID NO: 652498 - RNA, 19 nt, Homo sapiens
gccagaaguuugagacuag

SEQ ID NO: 652499 - RNA, 19 nt, Homo sapiens
gaagcuggaggauuacuug

SEQ ID NO: 652500 - RNA, 19 nt, Homo sapiens
gaauguguagcaaaugaaa

SEQ ID NO: 652501 - RNA, 19 nt, Homo sapiens
gaaggaacauaagcucaag

SEQ ID NO: 652502 - RNA, 19 nt, Homo sapiens
cgaggaagaugaagagcau

SEQ ID NO: 652503 - RNA, 19 nt, Homo sapiens
agacuagccugggcaauau

SEQ ID NO: 652504 - RNA, 19 nt, Homo sapiens
aacauaagcucaagaaagg

SEQ ID NO: 652505 - RNA, 19 nt, Homo sapiens
cagagaauccaaacaauca

SEQ ID NO: 652506 - RNA, 19 nt, Homo sapiens
acgcauaagugcaauugaa

SEQ ID NO: 652507 - RNA, 19 nt, Homo sapiens
gagaugcacucagcuuaca

SEQ ID NO: 652508 - RNA, 19 nt, Homo sapiens
ugggaucccuccauuagaa

SEQ ID NO: 652509 - RNA, 19 nt, Homo sapiens
ggucagcaguaccaugaga

SEQ ID NO: 652510 - RNA, 19 nt, Homo sapiens
ggacugugauagcugcaau

SEQ ID NO: 652511 - RNA, 19 nt, Homo sapiens
ggauaaacauggucaaacc

SEQ ID NO: 652512 - RNA, 19 nt, Homo sapiens
gaagcagucugauccucau

SEQ ID NO: 652513 - RNA, 19 nt, Homo sapiens
gaaguuugaagaagauguu

SEQ ID NO: 652514 - RNA, 19 nt, Homo sapiens
acaauggacccucaauaaa

SEQ ID NO: 652515 - RNA, 19 nt, Homo sapiens
caaauuacagaacauagga

SEQ ID NO: 652516 - RNA, 19 nt, Homo sapiens
caaauucugcaaagacuau

SEQ ID NO: 652517 - RNA, 19 nt, Homo sapiens
guucuucucucaggccuaa

SEQ ID NO: 652518 - RNA, 19 nt, Homo sapiens
gguagaccuucauuucaug

SEQ ID NO: 652519 - RNA, 19 nt, Homo sapiens
acauaguccuguggauuua

SEQ ID NO: 652520 - RNA, 19 nt, Homo sapiens
gaucagggugggaccagua

SEQ ID NO: 652521 - RNA, 19 nt, Homo sapiens
caaccucauucccauuguu

SEQ ID NO: 652522 - RNA, 19 nt, Homo sapiens
cuucaugacggcuaucuua

SEQ ID NO: 652523 - RNA, 19 nt, Homo sapiens
uaucccagcucuucucugu

SEQ ID NO: 652524 - RNA, 19 nt, Homo sapiens
aaugacagcaugaggguua

SEQ ID NO: 652525 - RNA, 19 nt, Homo sapiens
gcugaaguuugaagaagau

SEQ ID NO: 652526 - RNA, 19 nt, Homo sapiens
uuuaggagcugggaagauu

SEQ ID NO: 652527 - RNA, 19 nt, Homo sapiens
ggaggaagaggucauaguc

SEQ ID NO: 652528 - RNA, 19 nt, Homo sapiens
caugacggcuaucuuaaag

SEQ ID NO: 652529 - RNA, 19 nt, Homo sapiens
guacugugccugcauguca

SEQ ID NO: 652530 - RNA, 19 nt, Homo sapiens
uggcucacauucuuucaaa

SEQ ID NO: 652531 - RNA, 19 nt, Homo sapiens
ugaacagccucaagcuaga

SEQ ID NO: 652532 - RNA, 19 nt, Homo sapiens
ggaaaggucagcaguacca

SEQ ID NO: 652533 - RNA, 19 nt, Homo sapiens
gaugcugaguggaaggaaa

SEQ ID NO: 652534 - RNA, 19 nt, Homo sapiens
aaagaaagaauguguagca

SEQ ID NO: 652535 - RNA, 19 nt, Homo sapiens
aagaagaaguuggaugaug

SEQ ID NO: 652536 - RNA, 19 nt, Homo sapiens
gaagauggcucgcagauug

SEQ ID NO: 652537 - RNA, 19 nt, Homo sapiens
gaaaucaacgucuaacaua

SEQ ID NO: 652538 - RNA, 19 nt, Homo sapiens
aaagaaagcugaaaugcaa

SEQ ID NO: 652539 - RNA, 19 nt, Homo sapiens
gggaaagguuugaauguaa

SEQ ID NO: 652540 - RNA, 19 nt, Homo sapiens
ggaaagguuugaauguaaa

SEQ ID NO: 652541 - RNA, 19 nt, Homo sapiens
gagaacaugucgauugaug

SEQ ID NO: 652542 - RNA, 19 nt, Homo sapiens
caacacaacucagaacaug

SEQ ID NO: 652543 - RNA, 19 nt, Homo sapiens
gaaggucacucuaccaaag

SEQ ID NO: 652544 - RNA, 19 nt, Homo sapiens
gaaagaugcugggugguau

SEQ ID NO: 652545 - RNA, 19 nt, Homo sapiens
gcaaagccaucccaaacug

SEQ ID NO: 652546 - RNA, 19 nt, Homo sapiens
gagcaccaauguuuaucua

SEQ ID NO: 652547 - RNA, 19 nt, Homo sapiens
gaacaugucgauugaugaa

SEQ ID NO: 652548 - RNA, 19 nt, Homo sapiens
caagaacuccugaucauga

SEQ ID NO: 652549 - RNA, 19 nt, Homo sapiens
cagcaaauauuuagcacuu

SEQ ID NO: 652550 - RNA, 19 nt, Homo sapiens
cagagaacaugucgauuga

SEQ ID NO: 652551 - RNA, 19 nt, Homo sapiens
gaccaacauucagcaaaua

SEQ ID NO: 652552 - RNA, 19 nt, Homo sapiens
caaacagucuuccauuauc

SEQ ID NO: 652553 - RNA, 19 nt, Homo sapiens
guaauaauuugccuucauc

SEQ ID NO: 652554 - RNA, 19 nt, Homo sapiens
gcaccaauguuuaucuaca

SEQ ID NO: 652555 - RNA, 19 nt, Homo sapiens
guuccuacaucacaaguaa

SEQ ID NO: 652556 - RNA, 19 nt, Homo sapiens
caacuaagcauguuuaacu

SEQ ID NO: 652557 - RNA, 19 nt, Homo sapiens
gaacuacgggaacaauauu

SEQ ID NO: 652558 - RNA, 19 nt, Homo sapiens
gaugugucaugguaucuaa

SEQ ID NO: 652559 - RNA, 19 nt, Homo sapiens
gaaagaaagcugaaaugca

SEQ ID NO: 652560 - RNA, 19 nt, Homo sapiens
agaccaagguugcuucuga

SEQ ID NO: 652561 - RNA, 19 nt, Homo sapiens
aaacacaucuaaugcuugu

SEQ ID NO: 652562 - RNA, 19 nt, Homo sapiens
uaaaagagcaccaauguuu

SEQ ID NO: 652563 - RNA, 19 nt, Homo sapiens
ggacacccuucuucauaau

SEQ ID NO: 652564 - RNA, 19 nt, Homo sapiens
gcaaguuccuacaucacaa

SEQ ID NO: 652565 - RNA, 19 nt, Homo sapiens
gaaacuagaaugccagauc

SEQ ID NO: 652566 - RNA, 19 nt, Homo sapiens
ccagagaacaugucgauug

SEQ ID NO: 652567 - RNA, 19 nt, Homo sapiens
ggaacuacgggaacaauau

SEQ ID NO: 652568 - RNA, 19 nt, Homo sapiens
caggaaaucuggguauaug

SEQ ID NO: 652569 - RNA, 19 nt, Homo sapiens
cgaccaacauucagcaaau

SEQ ID NO: 652570 - RNA, 19 nt, Homo sapiens
agaaguagaucaaccucaa

SEQ ID NO: 652571 - RNA, 19 nt, Homo sapiens
ggaaaucaacgucuaacau

SEQ ID NO: 652572 - RNA, 19 nt, Homo sapiens
uaauggaaaucaacgucua

SEQ ID NO: 652573 - RNA, 19 nt, Homo sapiens
gauucaagauuuggaaaga

SEQ ID NO: 652574 - RNA, 19 nt, Homo sapiens
acagccaacuacaccauua

SEQ ID NO: 652575 - RNA, 19 nt, Homo sapiens
uaacccagaaggagaauuu

SEQ ID NO: 652576 - RNA, 19 nt, Homo sapiens
uaaugaagcuggagugacu

SEQ ID NO: 652577 - RNA, 19 nt, Homo sapiens
ccaaacagucuuccauuau

SEQ ID NO: 652578 - RNA, 19 nt, Homo sapiens
accaaacagucuuccauua

SEQ ID NO: 652579 - RNA, 19 nt, Homo sapiens
ugggaaagguuugaaugua

SEQ ID NO: 652580 - RNA, 19 nt, Homo sapiens
aaacagucuuccauuauca

SEQ ID NO: 652581 - RNA, 19 nt, Homo sapiens
ugguacugcuuucuaaaua

SEQ ID NO: 652582 - RNA, 19 nt, Homo sapiens
gaaaugguacaauucaaca

SEQ ID NO: 652583 - RNA, 19 nt, Homo sapiens
gcuaagcccauaccaagaa

SEQ ID NO: 652584 - RNA, 19 nt, Homo sapiens
agauaacacuggaagaguu

SEQ ID NO: 652585 - RNA, 19 nt, Homo sapiens
ggaaaucuggguauaugga

SEQ ID NO: 652586 - RNA, 19 nt, Homo sapiens
auccauagcuguauuaaca

SEQ ID NO: 652587 - RNA, 19 nt, Homo sapiens
ucacucaucuuugaaguag

SEQ ID NO: 652588 - RNA, 19 nt, Homo sapiens
caaguaagaaguagaucaa

SEQ ID NO: 652589 - RNA, 19 nt, Homo sapiens
uaggaauacuaacauggua

SEQ ID NO: 652590 - RNA, 19 nt, Homo sapiens
gcacuuaaugggaaagguu

SEQ ID NO: 652591 - RNA, 19 nt, Homo sapiens
ggaagaguuacuuuacuga

SEQ ID NO: 652592 - RNA, 19 nt, Homo sapiens
caccaaagcuuuucuggaa

SEQ ID NO: 652593 - RNA, 19 nt, Homo sapiens
agucagagcuucagaugca

SEQ ID NO: 652594 - RNA, 19 nt, Homo sapiens
guauauggauuuguaacug

SEQ ID NO: 652595 - RNA, 19 nt, Homo sapiens
aaggagaauuucagcguuu

SEQ ID NO: 652596 - RNA, 19 nt, Homo sapiens
acacaucuaaugcuuguaa

SEQ ID NO: 652597 - RNA, 19 nt, Homo sapiens
uaacacaagauuagacguu

SEQ ID NO: 652598 - RNA, 19 nt, Homo sapiens
gagaaggucacucuaccaa

SEQ ID NO: 652599 - RNA, 19 nt, Homo sapiens
cuggguauauggauuugua

SEQ ID NO: 652600 - RNA, 19 nt, Homo sapiens
aacacaagauuagacguua

SEQ ID NO: 652601 - RNA, 19 nt, Homo sapiens
gguugcuucugauuccuua

SEQ ID NO: 652602 - RNA, 19 nt, Homo sapiens
gauguaaacaagaaagaug

SEQ ID NO: 652603 - RNA, 19 nt, Homo sapiens
aaacuagaaugccagaucu

SEQ ID NO: 652604 - RNA, 19 nt, Homo sapiens
gaccaaacagucuuccauu

SEQ ID NO: 652605 - RNA, 19 nt, Homo sapiens
ccaggaacaaaucauuaua

SEQ ID NO: 652606 - RNA, 19 nt, Homo sapiens
aaagagcaccaauguuuau

SEQ ID NO: 652607 - RNA, 19 nt, Homo sapiens
ggaugacaguggugcacaa

SEQ ID NO: 652608 - RNA, 19 nt, Homo sapiens
guaucuaaauggaagaaca

SEQ ID NO: 652609 - RNA, 19 nt, Homo sapiens
aggacacccuucuucauaa

SEQ ID NO: 652610 - RNA, 19 nt, Homo sapiens
gaacuccugaucaugaaau

SEQ ID NO: 652611 - RNA, 19 nt, Homo sapiens
gaccaagguugcuucugau

SEQ ID NO: 652612 - RNA, 19 nt, Homo sapiens
gugacuacauguaacacaa

SEQ ID NO: 652613 - RNA, 19 nt, Homo sapiens
gaugcugggugguauacug

SEQ ID NO: 652614 - RNA, 19 nt, Homo sapiens
ucagcuggccaaccuauaa

SEQ ID NO: 652615 - RNA, 19 nt, Homo sapiens
uaaaaucccuuccgcuaug

SEQ ID NO: 652616 - RNA, 19 nt, Homo sapiens
uacaggaaaucuggguaua

SEQ ID NO: 652617 - RNA, 19 nt, Homo sapiens
ggcuauaccuccaccaaag

SEQ ID NO: 652618 - RNA, 19 nt, Homo sapiens
caccaauguuuaucuacaa

SEQ ID NO: 652619 - RNA, 19 nt, Homo sapiens
gcagcuggauguccuugca

SEQ ID NO: 652620 - RNA, 19 nt, Homo sapiens
ggaaagaaagcugaaaugc

SEQ ID NO: 652621 - RNA, 19 nt, Homo sapiens
guacugcuuucuaaauacu

SEQ ID NO: 652622 - RNA, 19 nt, Homo sapiens
aaucuggacucuaugaaag

SEQ ID NO: 652623 - RNA, 19 nt, Homo sapiens
cuacauguaacacaagauu

SEQ ID NO: 652624 - RNA, 19 nt, Homo sapiens
gaagaguuacuuuacugau

SEQ ID NO: 652625 - RNA, 19 nt, Homo sapiens
gaucaugaaauacaaggau

SEQ ID NO: 652626 - RNA, 19 nt, Homo sapiens
gaccagaaaccuccagcuu

SEQ ID NO: 652627 - RNA, 19 nt, Homo sapiens
cucaggaucucaacaagga

SEQ ID NO: 652628 - RNA, 19 nt, Homo sapiens
caaucuggacucuaugaaa

SEQ ID NO: 652629 - RNA, 19 nt, Homo sapiens
agaaagaugcuggguggua

SEQ ID NO: 652630 - RNA, 19 nt, Homo sapiens
gagaagauggcucgcagau

SEQ ID NO: 652631 - RNA, 19 nt, Homo sapiens
caagguugcuucugauucc

SEQ ID NO: 652632 - RNA, 19 nt, Homo sapiens
gacuacauguaacacaaga

SEQ ID NO: 652633 - RNA, 19 nt, Homo sapiens
uggaagaguuacuuuacug

SEQ ID NO: 652634 - RNA, 19 nt, Homo sapiens
cuccugaugugucauggua

SEQ ID NO: 652635 - RNA, 19 nt, Homo sapiens
ugaaugaucaggaugcaau

SEQ ID NO: 652636 - RNA, 19 nt, Homo sapiens
caaauaaguuggucaagua

SEQ ID NO: 652637 - RNA, 19 nt, Homo sapiens
caacuucgcugccaacuuu

SEQ ID NO: 652638 - RNA, 19 nt, Homo sapiens
gaaaguggcaugcaagaua

SEQ ID NO: 652639 - RNA, 19 nt, Homo sapiens
gaagacagcgccuugcuua

SEQ ID NO: 652640 - RNA, 19 nt, Homo sapiens
ggaaacuucucaccuauga

SEQ ID NO: 652641 - RNA, 19 nt, Homo sapiens
ggaaagagcaaauaaguug

SEQ ID NO: 652642 - RNA, 19 nt, Homo sapiens
gaagaacaccuguauauuc

SEQ ID NO: 652643 - RNA, 19 nt, Homo sapiens
uaaggaaacuucucaccua

SEQ ID NO: 652644 - RNA, 19 nt, Homo sapiens
gggaugacauugaguuuga

SEQ ID NO: 652645 - RNA, 19 nt, Homo sapiens
gaacaccuguauauucuca

SEQ ID NO: 652646 - RNA, 19 nt, Homo sapiens
gagaagaaauuugggauuc

SEQ ID NO: 652647 - RNA, 19 nt, Homo sapiens
gcaaauaaguuggucaagu

SEQ ID NO: 652648 - RNA, 19 nt, Homo sapiens
ugagugagauguuggauau

SEQ ID NO: 652649 - RNA, 19 nt, Homo sapiens
gaagaaauuugggauucaa

SEQ ID NO: 652650 - RNA, 19 nt, Homo sapiens
gugaauacacugauguuua

SEQ ID NO: 652651 - RNA, 19 nt, Homo sapiens
caaagaagaacaccuguau

SEQ ID NO: 652652 - RNA, 19 nt, Homo sapiens
gaauguaaaucaggccaaa

SEQ ID NO: 652653 - RNA, 19 nt, Homo sapiens
aaaguggcaugcaagauaa

SEQ ID NO: 652654 - RNA, 19 nt, Homo sapiens
acacaaaggugcccaucaa

SEQ ID NO: 652655 - RNA, 19 nt, Homo sapiens
aagaggacccgcaagauua

SEQ ID NO: 652656 - RNA, 19 nt, Homo sapiens
caagaggacccgcaagauu

SEQ ID NO: 652657 - RNA, 19 nt, Homo sapiens
agaaauaccuggacuacag

SEQ ID NO: 652658 - RNA, 19 nt, Homo sapiens
gagauaucauccgugaaua

SEQ ID NO: 652659 - RNA, 19 nt, Homo sapiens
ccaaugagauggcugacau

SEQ ID NO: 652660 - RNA, 19 nt, Homo sapiens
cagaaaugcugagagauau

SEQ ID NO: 652661 - RNA, 19 nt, Homo sapiens
uaacuugaauguugaagag

SEQ ID NO: 652662 - RNA, 19 nt, Homo sapiens
ccaaaugccaccuacaauu

SEQ ID NO: 652663 - RNA, 19 nt, Homo sapiens
gagauucauugcagagguu

SEQ ID NO: 652664 - RNA, 19 nt, Homo sapiens
ccaaugaccuggccaacag

SEQ ID NO: 652665 - RNA, 19 nt, Homo sapiens
ggaaggagauuuuggagau

SEQ ID NO: 652666 - RNA, 19 nt, Homo sapiens
aagaagaacaccuguauau

SEQ ID NO: 652667 - RNA, 19 nt, Homo sapiens
cgucagagcccuccagcua

SEQ ID NO: 652668 - RNA, 19 nt, Homo sapiens
ccacuggccuggcagaauc

SEQ ID NO: 652669 - RNA, 19 nt, Homo sapiens
cagauucccucagaccuuu

SEQ ID NO: 652670 - RNA, 19 nt, Homo sapiens
gagcugggaugacauugag

SEQ ID NO: 652671 - RNA, 19 nt, Homo sapiens
ccaaauggugucuaugauu

SEQ ID NO: 652672 - RNA, 19 nt, Homo sapiens
uaagucagccuuuaaaguc

SEQ ID NO: 652673 - RNA, 19 nt, Homo sapiens
cauugaacgugcaugcuuu

SEQ ID NO: 652674 - RNA, 19 nt, Homo sapiens
gaaaugcugagagauauca

SEQ ID NO: 652675 - RNA, 19 nt, Homo sapiens
gcccaaauggugucuauga

SEQ ID NO: 652676 - RNA, 19 nt, Homo sapiens
gcaugggaauuggagauga

SEQ ID NO: 652677 - RNA, 19 nt, Homo sapiens
agaugaaagugcugagauu

SEQ ID NO: 652678 - RNA, 19 nt, Homo sapiens
gaaauaccuggacuacaga

SEQ ID NO: 652679 - RNA, 19 nt, Homo sapiens
gaucuaaggaaacuucuca

SEQ ID NO: 652680 - RNA, 19 nt, Homo sapiens
cauugaaauugcaaaguga

SEQ ID NO: 652681 - RNA, 19 nt, Homo sapiens
ccuaugaguuuguaaagca

SEQ ID NO: 652682 - RNA, 19 nt, Homo sapiens
ggagaucuaaggaaacuuc

SEQ ID NO: 652683 - RNA, 19 nt, Homo sapiens
ggacccgcaagauuaauaa

SEQ ID NO: 652684 - RNA, 19 nt, Homo sapiens
gaaagugcugagauucauu

SEQ ID NO: 652685 - RNA, 19 nt, Homo sapiens
guccaaaugcugccuauga

SEQ ID NO: 652686 - RNA, 19 nt, Homo sapiens
acauugaaauugcaaagug

SEQ ID NO: 652687 - RNA, 19 nt, Homo sapiens
caacuuuggugccauuggu

SEQ ID NO: 652688 - RNA, 19 nt, Homo sapiens
gagcaaauaaguuggucaa

SEQ ID NO: 652689 - RNA, 19 nt, Homo sapiens
gccaacagcaggccuaaga

SEQ ID NO: 652690 - RNA, 19 nt, Homo sapiens
gauucugggugucaucuuc

SEQ ID NO: 652691 - RNA, 19 nt, Homo sapiens
cuacuaaagugggcccaaa

SEQ ID NO: 652692 - RNA, 19 nt, Homo sapiens
gaccugggaugaggaagga

SEQ ID NO: 652693 - RNA, 19 nt, Homo sapiens
aaagaagaacaccuguaua

SEQ ID NO: 652694 - RNA, 19 nt, Homo sapiens
caucaagcgcucagaaaug

SEQ ID NO: 652695 - RNA, 19 nt, Homo sapiens
agugagauguuggauauug

SEQ ID NO: 652696 - RNA, 19 nt, Homo sapiens
caggaaagagcaaauaagu

SEQ ID NO: 652697 - RNA, 19 nt, Homo sapiens
uggcagaacccagugauuu

SEQ ID NO: 652698 - RNA, 19 nt, Homo sapiens
uggcaugcaagauaaauuu

SEQ ID NO: 652699 - RNA, 19 nt, Homo sapiens
ccaugagacuagcaagaug

SEQ ID NO: 652700 - RNA, 19 nt, Homo sapiens
gcccaaaugccaccuacaa

SEQ ID NO: 652701 - RNA, 19 nt, Homo sapiens
cagaggcuccaccuacuaa

SEQ ID NO: 652702 - RNA, 19 nt, Homo sapiens
ggcaugcaagauaaauuua

SEQ ID NO: 652703 - RNA, 19 nt, Homo sapiens
ggagcugggaugacauuga

SEQ ID NO: 652704 - RNA, 19 nt, Homo sapiens
gcagaaauaccuggacuac

SEQ ID NO: 652705 - RNA, 19 nt, Homo sapiens
caacugaaagaaauugaca

SEQ ID NO: 652706 - RNA, 19 nt, Homo sapiens
gaaauuugggauucaacug

SEQ ID NO: 652707 - RNA, 19 nt, Homo sapiens
agagauaucauccgugaau

SEQ ID NO: 652708 - RNA, 19 nt, Homo sapiens
ggcagaacccagugauuug

SEQ ID NO: 652709 - RNA, 19 nt, Homo sapiens
ccagaaugccacuacuaaa

SEQ ID NO: 652710 - RNA, 19 nt, Homo sapiens
gacugaaaguggcaugcaa

SEQ ID NO: 652711 - RNA, 19 nt, Homo sapiens
gccacauccuguugacuga

SEQ ID NO: 652712 - RNA, 19 nt, Homo sapiens
guacagccagugccaacuu

SEQ ID NO: 652713 - RNA, 19 nt, Homo sapiens
aaggaaacuucucaccuau

SEQ ID NO: 652714 - RNA, 19 nt, Homo sapiens
ggccuaagucagccuuuaa

SEQ ID NO: 652715 - RNA, 19 nt, Homo sapiens
ggucuccucuuggugauuc

SEQ ID NO: 652716 - RNA, 19 nt, Homo sapiens
agaagaaauuugggauuca

SEQ ID NO: 652717 - RNA, 19 nt, Homo sapiens
gcaagaggacccgcaagau

SEQ ID NO: 652718 - RNA, 19 nt, Homo sapiens
agucugagauggccuucaa

SEQ ID NO: 652719 - RNA, 19 nt, Homo sapiens
ccaaaugcugccuaugauu

SEQ ID NO: 652720 - RNA, 19 nt, Homo sapiens
cacauccuguugacugaaa

SEQ ID NO: 652721 - RNA, 19 nt, Homo sapiens
ccagauaccaccagaaugc

SEQ ID NO: 652722 - RNA, 19 nt, Homo sapiens
ggccuuggaugcucuggau

SEQ ID NO: 652723 - RNA, 19 nt, Homo sapiens
gagacuagcaagaugaaag

SEQ ID NO: 652724 - RNA, 19 nt, Homo sapiens
gauaucauccgugaauaca

SEQ ID NO: 652725 - RNA, 19 nt, Homo sapiens
gacagcgccuugcuuaugc

SEQ ID NO: 652726 - RNA, 19 nt, Homo sapiens
cgacccagguaucucugaa

SEQ ID NO: 652727 - RNA, 19 nt, Homo sapiens
cagaaugccacuacuaaag

SEQ ID NO: 652728 - RNA, 19 nt, Homo sapiens
ccaaaaugcuaccuccaaa

SEQ ID NO: 652729 - RNA, 19 nt, Homo sapiens
ccaaggaugugcccaacac

SEQ ID NO: 652730 - RNA, 19 nt, Homo sapiens
ggccagauaccaccagaau

SEQ ID NO: 652731 - RNA, 19 nt, Homo sapiens
gguccagaauuccauuuac

SEQ ID NO: 652732 - RNA, 19 nt, Homo sapiens
caagaacccgcaugggaau

SEQ ID NO: 652733 - RNA, 19 nt, Homo sapiens
cauggaggcugcagaugag

SEQ ID NO: 652734 - RNA, 19 nt, Homo sapiens
gugcaugcuuuguccuaga

SEQ ID NO: 652735 - RNA, 19 nt, Homo sapiens
gaauuccauuuaccuucug

SEQ ID NO: 652736 - RNA, 19 nt, Homo sapiens
gaagagugguuuccaguga

SEQ ID NO: 652737 - RNA, 19 nt, Homo sapiens
gaagaaagucugcaccaaa

SEQ ID NO: 652738 - RNA, 19 nt, Homo sapiens
gacagugacucggaucuua

SEQ ID NO: 652739 - RNA, 19 nt, Homo sapiens
uaucuccguugcuauauua

SEQ ID NO: 652740 - RNA, 19 nt, Homo sapiens
ggaagaaagucugcaccaa

SEQ ID NO: 652741 - RNA, 19 nt, Homo sapiens
gaacucacuugcugaagag

SEQ ID NO: 652742 - RNA, 19 nt, Homo sapiens
gaagagagagaacgugugu

SEQ ID NO: 652743 - RNA, 19 nt, Homo sapiens
cagcagaauuuguguagug

SEQ ID NO: 652744 - RNA, 19 nt, Homo sapiens
gaaagucugcaccaaaugu

SEQ ID NO: 652745 - RNA, 19 nt, Homo sapiens
acaaagggcuccccaagua

SEQ ID NO: 652746 - RNA, 19 nt, Homo sapiens
acguuaugcuucagaauua

SEQ ID NO: 652747 - RNA, 19 nt, Homo sapiens
ugaacucacuugcugaaga

SEQ ID NO: 652748 - RNA, 19 nt, Homo sapiens
gaucugcagugagcaaaga

SEQ ID NO: 652749 - RNA, 19 nt, Homo sapiens
aagaaagucugcaccaaau

SEQ ID NO: 652750 - RNA, 19 nt, Homo sapiens
gggcaaaugcuucuggaaa

SEQ ID NO: 652751 - RNA, 19 nt, Homo sapiens
gacacagucucgcuuuguu

SEQ ID NO: 652752 - RNA, 19 nt, Homo sapiens
ggugaaaccugggucuguu

SEQ ID NO: 652753 - RNA, 19 nt, Homo sapiens
gcucgucgguguucugcaa

SEQ ID NO: 652754 - RNA, 19 nt, Homo sapiens
ggaaugaucaguggguuug

SEQ ID NO: 652755 - RNA, 19 nt, Homo sapiens
ccaaagugcugggauuaca

SEQ ID NO: 652756 - RNA, 19 nt, Homo sapiens
caaucuaccuggugaugau

SEQ ID NO: 652757 - RNA, 19 nt, Homo sapiens
caccacacccaguuaauuu

SEQ ID NO: 652758 - RNA, 19 nt, Homo sapiens
gaggaucgucugccuuauu

SEQ ID NO: 652759 - RNA, 19 nt, Homo sapiens
aaagagaggucuggaagag

SEQ ID NO: 652760 - RNA, 19 nt, Homo sapiens
gcaaagacugcaggaagaa

SEQ ID NO: 652761 - RNA, 19 nt, Homo sapiens
gaucgucugccuuauugaa

SEQ ID NO: 652762 - RNA, 19 nt, Homo sapiens
cagccugucuucagcuuga

SEQ ID NO: 652763 - RNA, 19 nt, Homo sapiens
cggaggaucgucugccuua

SEQ ID NO: 652764 - RNA, 19 nt, Homo sapiens
gcugguccgugcacaccua

SEQ ID NO: 652765 - RNA, 19 nt, Homo sapiens
ggcaaaugcuucuggaaaa

SEQ ID NO: 652766 - RNA, 19 nt, Homo sapiens
gaacuccuggucucaagug

SEQ ID NO: 652767 - RNA, 19 nt, Homo sapiens
aggaucgucugccuuauug

SEQ ID NO: 652768 - RNA, 19 nt, Homo sapiens
uguguaagaucugcaguga

SEQ ID NO: 652769 - RNA, 19 nt, Homo sapiens
ccucauggccugccugguu

SEQ ID NO: 652770 - RNA, 19 nt, Homo sapiens
caaagagaggucuggaaga

SEQ ID NO: 652771 - RNA, 19 nt, Homo sapiens
uaaguuugcgcgugucuug

SEQ ID NO: 652772 - RNA, 19 nt, Homo sapiens
ccaccacacccaguuaauu

SEQ ID NO: 652773 - RNA, 19 nt, Homo sapiens
ccagugacagugacaguga

SEQ ID NO: 652774 - RNA, 19 nt, Homo sapiens
gccaugaauucacuucucu

SEQ ID NO: 652775 - RNA, 19 nt, Homo sapiens
ggcuaucuccguugcuaua

SEQ ID NO: 652776 - RNA, 19 nt, Homo sapiens
gcagagcgagagcccagaa

SEQ ID NO: 652777 - RNA, 19 nt, Homo sapiens
ggcaaacaguaaagaaacu

SEQ ID NO: 652778 - RNA, 19 nt, Homo sapiens
agagagaacgugugugugu

SEQ ID NO: 652779 - RNA, 19 nt, Homo sapiens
ggaccggaaaggcgacaaa

SEQ ID NO: 652780 - RNA, 19 nt, Homo sapiens
gguuuggcuuggcaugaaa

SEQ ID NO: 652781 - RNA, 19 nt, Homo sapiens
guaggugggauuacagaug

SEQ ID NO: 652782 - RNA, 19 nt, Homo sapiens
ggccaugacucaacaaacc

SEQ ID NO: 652783 - RNA, 19 nt, Homo sapiens
gcagauuaggcuaccaaga

SEQ ID NO: 652784 - RNA, 19 nt, Homo sapiens
gagcagcguucaggugcau

SEQ ID NO: 652785 - RNA, 19 nt, Homo sapiens
cacguuaugcuucagaauu

SEQ ID NO: 652786 - RNA, 19 nt, Homo sapiens
agagagagaacgugugugu

SEQ ID NO: 652787 - RNA, 19 nt, Homo sapiens
uugaaaccaucuaauugga

SEQ ID NO: 652788 - RNA, 19 nt, Homo sapiens
gagaccagccgcaucuaca

SEQ ID NO: 652789 - RNA, 19 nt, Homo sapiens
caaagacugcaggaagaaa

SEQ ID NO: 652790 - RNA, 19 nt, Homo sapiens
gaacggccugucccagugu

SEQ ID NO: 652791 - RNA, 19 nt, Homo sapiens
agauuaggcuaccaagaca

SEQ ID NO: 652792 - RNA, 19 nt, Homo sapiens
ggaggaucgucugccuuau

SEQ ID NO: 652793 - RNA, 19 nt, Homo sapiens
gggaaugaucaguggguuu

SEQ ID NO: 652794 - RNA, 19 nt, Homo sapiens
cucauggccugccugguuu

SEQ ID NO: 652795 - RNA, 19 nt, Homo sapiens
ccaccgcacccaauccuau

SEQ ID NO: 652796 - RNA, 19 nt, Homo sapiens
uggcaagacuaaaugaaac

SEQ ID NO: 652797 - RNA, 19 nt, Homo sapiens
cagauuaggcuaccaagac

SEQ ID NO: 652798 - RNA, 19 nt, Homo sapiens
aauuggagauccgcagauu

SEQ ID NO: 652799 - RNA, 19 nt, Homo sapiens
gguggaugcuaugaacuca

SEQ ID NO: 652800 - RNA, 19 nt, Homo sapiens
cuguuuaguuucuuugguu

SEQ ID NO: 652801 - RNA, 19 nt, Homo sapiens
cuaucuccguugcuauauu

SEQ ID NO: 652802 - RNA, 19 nt, Homo sapiens
cguuaugcuucagaauuaa

SEQ ID NO: 652803 - RNA, 19 nt, Homo sapiens
ccucagccaugaauucacu

SEQ ID NO: 652804 - RNA, 19 nt, Homo sapiens
caagacuaaaugaaaccua

SEQ ID NO: 652805 - RNA, 19 nt, Homo sapiens
cuccguugcuauauuaaug

SEQ ID NO: 652806 - RNA, 19 nt, Homo sapiens
agacuucccuguggaggau

SEQ ID NO: 652807 - RNA, 19 nt, Homo sapiens
gggccugguucuacaaagg

SEQ ID NO: 652808 - RNA, 19 nt, Homo sapiens
gcuggcaaacaguaaagaa

SEQ ID NO: 652809 - RNA, 19 nt, Homo sapiens
acacuuguacgugcacuuu

SEQ ID NO: 652810 - RNA, 19 nt, Homo sapiens
gcgacaaacccuggaagga

SEQ ID NO: 652811 - RNA, 19 nt, Homo sapiens
gaugcuaugaacucacuug

SEQ ID NO: 652812 - RNA, 19 nt, Homo sapiens
gaguaggugggauuacaga

SEQ ID NO: 652813 - RNA, 19 nt, Homo sapiens
gggucuguuuaguuucuuu

SEQ ID NO: 652814 - RNA, 19 nt, Homo sapiens
uaauggcaagacuaaauga

SEQ ID NO: 652815 - RNA, 19 nt, Homo sapiens
uuaauggcaagacuaaaug

SEQ ID NO: 652816 - RNA, 19 nt, Homo sapiens
uaagaucugcagugagcaa

SEQ ID NO: 652817 - RNA, 19 nt, Homo sapiens
caaacaguaaagaaacuca

SEQ ID NO: 652818 - RNA, 19 nt, Homo sapiens
acaccuaccagacggagaa

SEQ ID NO: 652819 - RNA, 19 nt, Homo sapiens
accugggucuguuuaguuu

SEQ ID NO: 652820 - RNA, 19 nt, Homo sapiens
gagcggcuggagaccauga

SEQ ID NO: 652821 - RNA, 19 nt, Homo sapiens
caugaauucacuucucuuc

SEQ ID NO: 652822 - RNA, 19 nt, Homo sapiens
cugaguaggugggauuaca

SEQ ID NO: 652823 - RNA, 19 nt, Homo sapiens
ggugaugauuuuaaguuug

SEQ ID NO: 652824 - RNA, 19 nt, Homo sapiens
gaggacagacucccaucca

SEQ ID NO: 652825 - RNA, 19 nt, Homo sapiens
gcacguuaugcuucagaau

SEQ ID NO: 652826 - RNA, 19 nt, Homo sapiens
ggcacguuaugcuucagaa

SEQ ID NO: 652827 - RNA, 19 nt, Homo sapiens
gagguuuggcuuggcauga

SEQ ID NO: 652828 - RNA, 19 nt, Homo sapiens
uaugaacucacuugcugaa

SEQ ID NO: 652829 - RNA, 19 nt, Homo sapiens
ugacucaacaaaccagugu

SEQ ID NO: 652830 - RNA, 19 nt, Homo sapiens
gaagcucugguggaugcua

SEQ ID NO: 652831 - RNA, 19 nt, Homo sapiens
cggagaagcagaggaggaa

SEQ ID NO: 652832 - RNA, 19 nt, Homo sapiens
ugacacagucucgcuuugu

SEQ ID NO: 652833 - RNA, 19 nt, Homo sapiens
accaugaggcggaauguga

SEQ ID NO: 652834 - RNA, 19 nt, Homo sapiens
ccaaucuaccuggugauga

SEQ ID NO: 652835 - RNA, 19 nt, Homo sapiens
gaagggaaaucacagguuu

SEQ ID NO: 652836 - RNA, 19 nt, Homo sapiens
cgaggaagaucaacauaua

SEQ ID NO: 652837 - RNA, 19 nt, Homo sapiens
gaagagaaaccacccacua

SEQ ID NO: 652838 - RNA, 19 nt, Homo sapiens
aagauaagcugaaacaaca

SEQ ID NO: 652839 - RNA, 19 nt, Homo sapiens
ggaaaucacagguuuaaag

SEQ ID NO: 652840 - RNA, 19 nt, Homo sapiens
aaucacagguuuaaaggaa

SEQ ID NO: 652841 - RNA, 19 nt, Homo sapiens
gaagauaagcugaaacaac

SEQ ID NO: 652842 - RNA, 19 nt, Homo sapiens
ucaagugccugaccuggaa

SEQ ID NO: 652843 - RNA, 19 nt, Homo sapiens
aaaggaagauaagcugaaa

SEQ ID NO: 652844 - RNA, 19 nt, Homo sapiens
agaagcaggugaagggaaa

SEQ ID NO: 652845 - RNA, 19 nt, Homo sapiens
gaagagagaagaugaucag

SEQ ID NO: 652846 - RNA, 19 nt, Homo sapiens
cccaggaacugaaauagug

SEQ ID NO: 652847 - RNA, 19 nt, Homo sapiens
gaaaucacagguuuaaagg

SEQ ID NO: 652848 - RNA, 19 nt, Homo sapiens
aauaugaguuggcgaggaa

SEQ ID NO: 652849 - RNA, 19 nt, Homo sapiens
ucacagguuuaaaggaaga

SEQ ID NO: 652850 - RNA, 19 nt, Homo sapiens
gcagagcacuuuaaaaugc

SEQ ID NO: 652851 - RNA, 19 nt, Homo sapiens
ugaagagccuaaagaagag

SEQ ID NO: 652852 - RNA, 19 nt, Homo sapiens
uaaaggaagauaagcugaa

SEQ ID NO: 652853 - RNA, 19 nt, Homo sapiens
aagagaaaccacccacuaa

SEQ ID NO: 652854 - RNA, 19 nt, Homo sapiens
gcgaggaagaucaacauau

SEQ ID NO: 652855 - RNA, 19 nt, Homo sapiens
cgacuucagugugcauguu

SEQ ID NO: 652856 - RNA, 19 nt, Homo sapiens
gaucagaagagagaagaug

SEQ ID NO: 652857 - RNA, 19 nt, Homo sapiens
augaagagccuaaagaaga

SEQ ID NO: 652858 - RNA, 19 nt, Homo sapiens
agagaaaccacccacuaaa

SEQ ID NO: 652859 - RNA, 19 nt, Homo sapiens
cuacugagacgcagccuau

SEQ ID NO: 652860 - RNA, 19 nt, Homo sapiens
gagaaaccacccacuaaaa

SEQ ID NO: 652861 - RNA, 19 nt, Homo sapiens
ugaugaagagccuaaagaa

SEQ ID NO: 652862 - RNA, 19 nt, Homo sapiens
ccacugaugaagagccuaa

SEQ ID NO: 652863 - RNA, 19 nt, Homo sapiens
caacgcaggcaccgacuuc

SEQ ID NO: 652864 - RNA, 19 nt, Homo sapiens
gaugaagagccuaaagaag

SEQ ID NO: 652865 - RNA, 19 nt, Homo sapiens
gaggaagaucaacauauag

SEQ ID NO: 652866 - RNA, 19 nt, Homo sapiens
gcugaaacaacacaaacug

SEQ ID NO: 652867 - RNA, 19 nt, Homo sapiens
gggugcagcugagauucaa

SEQ ID NO: 652868 - RNA, 19 nt, Homo sapiens
ggaauccuacaccugauca

SEQ ID NO: 652869 - RNA, 19 nt, Homo sapiens
gaugugaaggugguacuga

SEQ ID NO: 652870 - RNA, 19 nt, Homo sapiens
caccugaucagaagagaga

SEQ ID NO: 652871 - RNA, 19 nt, Homo sapiens
ugaacccacugaugaagag

SEQ ID NO: 652872 - RNA, 19 nt, Homo sapiens
gauaagcugaaacaacaca

SEQ ID NO: 652873 - RNA, 19 nt, Homo sapiens
gaaggugguacugauguca

SEQ ID NO: 652874 - RNA, 19 nt, Homo sapiens
guuuuaagcuuuucuccaa

SEQ ID NO: 652875 - RNA, 19 nt, Homo sapiens
uaagcugaaacaacacaaa

SEQ ID NO: 652876 - RNA, 19 nt, Homo sapiens
cauguucacugggcaucuu

SEQ ID NO: 652877 - RNA, 19 nt, Homo sapiens
gcuugaacccacugaugaa

SEQ ID NO: 652878 - RNA, 19 nt, Homo sapiens
ggaagauaagcugaaacaa

SEQ ID NO: 652879 - RNA, 19 nt, Homo sapiens
ugaagggaaaucacagguu

SEQ ID NO: 652880 - RNA, 19 nt, Homo sapiens
aagcagagcacuuuaaaau

SEQ ID NO: 652881 - RNA, 19 nt, Homo sapiens
ggggaagauucuaccaaaa

SEQ ID NO: 652882 - RNA, 19 nt, Homo sapiens
ggaacugaaauagugaaau

SEQ ID NO: 652883 - RNA, 19 nt, Homo sapiens
agggaaaucacagguuuaa

SEQ ID NO: 652884 - RNA, 19 nt, Homo sapiens
ggcgaggaagaucaacaua

SEQ ID NO: 652885 - RNA, 19 nt, Homo sapiens
ccaggaacugaaauaguga

SEQ ID NO: 652886 - RNA, 19 nt, Homo sapiens
ugaaggugguacugauguc

SEQ ID NO: 652887 - RNA, 19 nt, Homo sapiens
gaagagccuaaagaagaga

SEQ ID NO: 652888 - RNA, 19 nt, Homo sapiens
ccucccaggaacugaaaua

SEQ ID NO: 652889 - RNA, 19 nt, Homo sapiens
cagguuuaaaggaagauaa

SEQ ID NO: 652890 - RNA, 19 nt, Homo sapiens
aagggaaaucacagguuua

SEQ ID NO: 652891 - RNA, 19 nt, Homo sapiens
gugaaggugguacugaugu

SEQ ID NO: 652892 - RNA, 19 nt, Homo sapiens
gaaaccacccacuaaaagu

SEQ ID NO: 652893 - RNA, 19 nt, Homo sapiens
gauaauaccuaaagaggaa

SEQ ID NO: 652894 - RNA, 19 nt, Homo sapiens
gaagagcaaccacaaguuu

SEQ ID NO: 652895 - RNA, 19 nt, Homo sapiens
gcaagcugguuuuauauua

SEQ ID NO: 652896 - RNA, 19 nt, Homo sapiens
ccugaggucuggauucuuu

SEQ ID NO: 652897 - RNA, 19 nt, Homo sapiens
ccacaaguuuaaaugaaga

SEQ ID NO: 652898 - RNA, 19 nt, Homo sapiens
cuaaagaggaacacuguaa

SEQ ID NO: 652899 - RNA, 19 nt, Homo sapiens
gaagauaauaccuaaagag

SEQ ID NO: 652900 - RNA, 19 nt, Homo sapiens
cauggaaggugaucugcaa

SEQ ID NO: 652901 - RNA, 19 nt, Homo sapiens
ggacacacacaaacacaga

SEQ ID NO: 652902 - RNA, 19 nt, Homo sapiens
caaccacaaguuuaaauga

SEQ ID NO: 652903 - RNA, 19 nt, Homo sapiens
uaaagaggaacacuguaaa

SEQ ID NO: 652904 - RNA, 19 nt, Homo sapiens
gaagacaagcugaaacaac

SEQ ID NO: 652905 - RNA, 19 nt, Homo sapiens
agaagcaggugaagagcaa

SEQ ID NO: 652906 - RNA, 19 nt, Homo sapiens
gggcaaggcgggauaagga

SEQ ID NO: 652907 - RNA, 19 nt, Homo sapiens
ucacugcgcaugcuccuuu

SEQ ID NO: 652908 - RNA, 19 nt, Homo sapiens
gcaaccacaaguuuaaaug

SEQ ID NO: 652909 - RNA, 19 nt, Homo sapiens
agaagaagaucaggauaca

SEQ ID NO: 652910 - RNA, 19 nt, Homo sapiens
uaaaugaagacaagcugaa

SEQ ID NO: 652911 - RNA, 19 nt, Homo sapiens
gcgucaaggugaagauaau

SEQ ID NO: 652912 - RNA, 19 nt, Homo sapiens
ggaaggugaucugcaagag

SEQ ID NO: 652913 - RNA, 19 nt, Homo sapiens
gagcaaccacaaguuuaaa

SEQ ID NO: 652914 - RNA, 19 nt, Homo sapiens
aagagcaaccacaaguuua

SEQ ID NO: 652915 - RNA, 19 nt, Homo sapiens
agagcaaccacaaguuuaa

SEQ ID NO: 652916 - RNA, 19 nt, Homo sapiens
gugaagauaauaccuaaag

SEQ ID NO: 652917 - RNA, 19 nt, Homo sapiens
gaaacaacgcaagcugguu

SEQ ID NO: 652918 - RNA, 19 nt, Homo sapiens
gaggaacacuguaaaaugc

SEQ ID NO: 652919 - RNA, 19 nt, Homo sapiens
gacagaagaagaucaggau

SEQ ID NO: 652920 - RNA, 19 nt, Homo sapiens
gaaccucacugcgcaugcu

SEQ ID NO: 652921 - RNA, 19 nt, Homo sapiens
gugaagagcaaccacaagu

SEQ ID NO: 652922 - RNA, 19 nt, Homo sapiens
gcagcagacagaagaagau

SEQ ID NO: 652923 - RNA, 19 nt, Homo sapiens
gcaagagcugcaucaguca

SEQ ID NO: 652924 - RNA, 19 nt, Homo sapiens
gcugaaagucgggauccua

SEQ ID NO: 652925 - RNA, 19 nt, Homo sapiens
ugaagagcaaccacaaguu

SEQ ID NO: 652926 - RNA, 19 nt, Homo sapiens
gccagaagcaggugaagag

SEQ ID NO: 652927 - RNA, 19 nt, Homo sapiens
cagaagaagaucaggauac

SEQ ID NO: 652928 - RNA, 19 nt, Homo sapiens
cgacauggaaggugaucug

SEQ ID NO: 652929 - RNA, 19 nt, Homo sapiens
gcagacagaagaagaucag

SEQ ID NO: 652930 - RNA, 19 nt, Homo sapiens
aacgcaagcugguuuuaua

SEQ ID NO: 652931 - RNA, 19 nt, Homo sapiens
gacagggcaaggcgggaua

SEQ ID NO: 652932 - RNA, 19 nt, Homo sapiens
aaaugaagacaagcugaaa

SEQ ID NO: 652933 - RNA, 19 nt, Homo sapiens
ccaccucagugcgcauguu

SEQ ID NO: 652934 - RNA, 19 nt, Homo sapiens
cgucaaggugaagauaaua

SEQ ID NO: 652935 - RNA, 19 nt, Homo sapiens
gagacacggcggacacaca

SEQ ID NO: 652936 - RNA, 19 nt, Homo sapiens
gaaagucgggauccuacac

SEQ ID NO: 652937 - RNA, 19 nt, Homo sapiens
acagaagaagaucaggaua

SEQ ID NO: 652938 - RNA, 19 nt, Homo sapiens
caauaaaguuuugcagcuu

SEQ ID NO: 652939 - RNA, 19 nt, Homo sapiens
ggcgucaaggugaagauaa

SEQ ID NO: 652940 - RNA, 19 nt, Homo sapiens
caagagcugcaucagucaa

SEQ ID NO: 652941 - RNA, 19 nt, Homo sapiens
caagcugguuuuauauuag

SEQ ID NO: 652942 - RNA, 19 nt, Homo sapiens
gagcugcaucagucaaaca

SEQ ID NO: 652943 - RNA, 19 nt, Homo sapiens
ggcagcagacagaagaaga

SEQ ID NO: 652944 - RNA, 19 nt, Homo sapiens
guuccggcgucaaggugaa

SEQ ID NO: 652945 - RNA, 19 nt, Homo sapiens
caccugggcagcagacaga

SEQ ID NO: 652946 - RNA, 19 nt, Homo sapiens
gauaauaccuaaagaggaa

SEQ ID NO: 652947 - RNA, 19 nt, Homo sapiens
gaagagcaaccacaaguuu

SEQ ID NO: 652948 - RNA, 19 nt, Homo sapiens
gcaagcugguuuuauauua

SEQ ID NO: 652949 - RNA, 19 nt, Homo sapiens
ccugaggucuggauucuuu

SEQ ID NO: 652950 - RNA, 19 nt, Homo sapiens
ggaaaugcgcgacauggaa

SEQ ID NO: 652951 - RNA, 19 nt, Homo sapiens
ccacaaguuuaaaugaaga

SEQ ID NO: 652952 - RNA, 19 nt, Homo sapiens
cuaaagaggaacacuguaa

SEQ ID NO: 652953 - RNA, 19 nt, Homo sapiens
gaagauaauaccuaaagag

SEQ ID NO: 652954 - RNA, 19 nt, Homo sapiens
cauggaaggugaucugcaa

SEQ ID NO: 652955 - RNA, 19 nt, Homo sapiens
ggacacacacaaacacaga

SEQ ID NO: 652956 - RNA, 19 nt, Homo sapiens
caaccacaaguuuaaauga

SEQ ID NO: 652957 - RNA, 19 nt, Homo sapiens
uaaagaggaacacuguaaa

SEQ ID NO: 652958 - RNA, 19 nt, Homo sapiens
gaagggaaaugcgcgacau

SEQ ID NO: 652959 - RNA, 19 nt, Homo sapiens
gaagacaagcugaaacaac

SEQ ID NO: 652960 - RNA, 19 nt, Homo sapiens
agaagcaggugaagagcaa

SEQ ID NO: 652961 - RNA, 19 nt, Homo sapiens
gcaaccacaaguuuaaaug

SEQ ID NO: 652962 - RNA, 19 nt, Homo sapiens
agaagaagaucaggauaca

SEQ ID NO: 652963 - RNA, 19 nt, Homo sapiens
uaaaugaagacaagcugaa

SEQ ID NO: 652964 - RNA, 19 nt, Homo sapiens
gcgucaaggugaagauaau

SEQ ID NO: 652965 - RNA, 19 nt, Homo sapiens
ggaaggugaucugcaagag

SEQ ID NO: 652966 - RNA, 19 nt, Homo sapiens
gagcaaccacaaguuuaaa

SEQ ID NO: 652967 - RNA, 19 nt, Homo sapiens
aagagcaaccacaaguuua

SEQ ID NO: 652968 - RNA, 19 nt, Homo sapiens
agagcaaccacaaguuuaa

SEQ ID NO: 652969 - RNA, 19 nt, Homo sapiens
gugaagauaauaccuaaag

SEQ ID NO: 652970 - RNA, 19 nt, Homo sapiens
gaaacaacgcaagcugguu

SEQ ID NO: 652971 - RNA, 19 nt, Homo sapiens
gaggaacacuguaaaaugc

SEQ ID NO: 652972 - RNA, 19 nt, Homo sapiens
gacagaagaagaucaggau

SEQ ID NO: 652973 - RNA, 19 nt, Homo sapiens
gugaagagcaaccacaagu

SEQ ID NO: 652974 - RNA, 19 nt, Homo sapiens
gcagcagacagaagaagau

SEQ ID NO: 652975 - RNA, 19 nt, Homo sapiens
gcaagagcugcaucaguca

SEQ ID NO: 652976 - RNA, 19 nt, Homo sapiens
gcugaaagucgggauccua

SEQ ID NO: 652977 - RNA, 19 nt, Homo sapiens
ugaagagcaaccacaaguu

SEQ ID NO: 652978 - RNA, 19 nt, Homo sapiens
gggaaaugcgcgacaugga

SEQ ID NO: 652979 - RNA, 19 nt, Homo sapiens
gccagaagcaggugaagag

SEQ ID NO: 652980 - RNA, 19 nt, Homo sapiens
cagaagaagaucaggauac

SEQ ID NO: 652981 - RNA, 19 nt, Homo sapiens
cgacauggaaggugaucug

SEQ ID NO: 652982 - RNA, 19 nt, Homo sapiens
gcagacagaagaagaucag

SEQ ID NO: 652983 - RNA, 19 nt, Homo sapiens
aacgcaagcugguuuuaua

SEQ ID NO: 652984 - RNA, 19 nt, Homo sapiens
aaaugaagacaagcugaaa

SEQ ID NO: 652985 - RNA, 19 nt, Homo sapiens
gaaagucgggauccuacac

SEQ ID NO: 652986 - RNA, 19 nt, Homo sapiens
gagacacggcggacacaca

SEQ ID NO: 652987 - RNA, 19 nt, Homo sapiens
cgucaaggugaagauaaua

SEQ ID NO: 652988 - RNA, 19 nt, Homo sapiens
acagaagaagaucaggaua

SEQ ID NO: 652989 - RNA, 19 nt, Homo sapiens
caauaaaguuuugcagcuu

SEQ ID NO: 652990 - RNA, 19 nt, Homo sapiens
ggcgucaaggugaagauaa

SEQ ID NO: 652991 - RNA, 19 nt, Homo sapiens
caagagcugcaucagucaa

SEQ ID NO: 652992 - RNA, 19 nt, Homo sapiens
caagcugguuuuauauuag

SEQ ID NO: 652993 - RNA, 19 nt, Homo sapiens
gagcugcaucagucaaaca

SEQ ID NO: 652994 - RNA, 19 nt, Homo sapiens
ggcagcagacagaagaaga

SEQ ID NO: 652995 - RNA, 19 nt, Homo sapiens
caccugggcagcagacaga

SEQ ID NO: 652996 - RNA, 19 nt, Homo sapiens
guuccggcgucaaggugaa

SEQ ID NO: 652997 - RNA, 19 nt, Homo sapiens
gauaauaccuaaagaggaa

SEQ ID NO: 652998 - RNA, 19 nt, Homo sapiens
gaagagcaaccacaaguuu

SEQ ID NO: 652999 - RNA, 19 nt, Homo sapiens
gcaagcugguuuuauauua

SEQ ID NO: 653000 - RNA, 19 nt, Homo sapiens
ccugaggucuggauucuuu

SEQ ID NO: 653001 - RNA, 19 nt, Homo sapiens
ccacaaguuuaaaugaaga

SEQ ID NO: 653002 - RNA, 19 nt, Homo sapiens
cuaaagaggaacacuguaa

SEQ ID NO: 653003 - RNA, 19 nt, Homo sapiens
gaagauaauaccuaaagag

SEQ ID NO: 653004 - RNA, 19 nt, Homo sapiens
cauggaaggugaucugcaa

SEQ ID NO: 653005 - RNA, 19 nt, Homo sapiens
caaccacaaguuuaaauga

SEQ ID NO: 653006 - RNA, 19 nt, Homo sapiens
gaagugugagugagaguga

SEQ ID NO: 653007 - RNA, 19 nt, Homo sapiens
uaaagaggaacacuguaaa

SEQ ID NO: 653008 - RNA, 19 nt, Homo sapiens
gaagacaagcugaaacaac

SEQ ID NO: 653009 - RNA, 19 nt, Homo sapiens
agaagcaggugaagagcaa

SEQ ID NO: 653010 - RNA, 19 nt, Homo sapiens
ggccauaacuagggaggaa

SEQ ID NO: 653011 - RNA, 19 nt, Homo sapiens
gcaaccacaaguuuaaaug

SEQ ID NO: 653012 - RNA, 19 nt, Homo sapiens
agaagaagaucaggauaca

SEQ ID NO: 653013 - RNA, 19 nt, Homo sapiens
gagugagagugaagaggaa

SEQ ID NO: 653014 - RNA, 19 nt, Homo sapiens
ggaguugaagugugaguga

SEQ ID NO: 653015 - RNA, 19 nt, Homo sapiens
uaaaugaagacaagcugaa

SEQ ID NO: 653016 - RNA, 19 nt, Homo sapiens
gcgucaaggugaagauaau

SEQ ID NO: 653017 - RNA, 19 nt, Homo sapiens
ggaaggugaucugcaagag

SEQ ID NO: 653018 - RNA, 19 nt, Homo sapiens
gagcaaccacaaguuuaaa

SEQ ID NO: 653019 - RNA, 19 nt, Homo sapiens
aagagcaaccacaaguuua

SEQ ID NO: 653020 - RNA, 19 nt, Homo sapiens
gaagucgucgucccucuca

SEQ ID NO: 653021 - RNA, 19 nt, Homo sapiens
agagcaaccacaaguuuaa

SEQ ID NO: 653022 - RNA, 19 nt, Homo sapiens
gugaagauaauaccuaaag

SEQ ID NO: 653023 - RNA, 19 nt, Homo sapiens
ugagaaggcccucgaaguc

SEQ ID NO: 653024 - RNA, 19 nt, Homo sapiens
gaaacaacgcaagcugguu

SEQ ID NO: 653025 - RNA, 19 nt, Homo sapiens
cgacacacacaaacacaga

SEQ ID NO: 653026 - RNA, 19 nt, Homo sapiens
acugggaguugaaguguga

SEQ ID NO: 653027 - RNA, 19 nt, Homo sapiens
gaggaacacuguaaaaugc

SEQ ID NO: 653028 - RNA, 19 nt, Homo sapiens
gacagaagaagaucaggau

SEQ ID NO: 653029 - RNA, 19 nt, Homo sapiens
caugagcgacacacacaaa

SEQ ID NO: 653030 - RNA, 19 nt, Homo sapiens
gugaagagcaaccacaagu

SEQ ID NO: 653031 - RNA, 19 nt, Homo sapiens
gcagcagacagaagaagau

SEQ ID NO: 653032 - RNA, 19 nt, Homo sapiens
gcaagagcugcaucaguca

SEQ ID NO: 653033 - RNA, 19 nt, Homo sapiens
gcugaaagucgggauccua

SEQ ID NO: 653034 - RNA, 19 nt, Homo sapiens
ugaagagcaaccacaaguu

SEQ ID NO: 653035 - RNA, 19 nt, Homo sapiens
gccagaagcaggugaagag

SEQ ID NO: 653036 - RNA, 19 nt, Homo sapiens
cagaagaagaucaggauac

SEQ ID NO: 653037 - RNA, 19 nt, Homo sapiens
cgacauggaaggugaucug

SEQ ID NO: 653038 - RNA, 19 nt, Homo sapiens
gcagacagaagaagaucag

SEQ ID NO: 653039 - RNA, 19 nt, Homo sapiens
aacgcaagcugguuuuaua

SEQ ID NO: 653040 - RNA, 19 nt, Homo sapiens
gugagaaggcccucgaagu

SEQ ID NO: 653041 - RNA, 19 nt, Homo sapiens
aaaugaagacaagcugaaa

SEQ ID NO: 653042 - RNA, 19 nt, Homo sapiens
cgucaaggugaagauaaua

SEQ ID NO: 653043 - RNA, 19 nt, Homo sapiens
gaaagucgggauccuacac

SEQ ID NO: 653044 - RNA, 19 nt, Homo sapiens
acagaagaagaucaggaua

SEQ ID NO: 653045 - RNA, 19 nt, Homo sapiens
caauaaaguuuugcagcuu

SEQ ID NO: 653046 - RNA, 19 nt, Homo sapiens
ggcgucaaggugaagauaa

SEQ ID NO: 653047 - RNA, 19 nt, Homo sapiens
caagagcugcaucagucaa

SEQ ID NO: 653048 - RNA, 19 nt, Homo sapiens
aggguuguguggucaguga

SEQ ID NO: 653049 - RNA, 19 nt, Homo sapiens
ggcaugagcgacacacaca

SEQ ID NO: 653050 - RNA, 19 nt, Homo sapiens
caagcugguuuuauauuag

SEQ ID NO: 653051 - RNA, 19 nt, Homo sapiens
ggaggguuguguggucagu

SEQ ID NO: 653052 - RNA, 19 nt, Homo sapiens
gagcugcaucagucaaaca

SEQ ID NO: 653053 - RNA, 19 nt, Homo sapiens
ggcagcagacagaagaaga

SEQ ID NO: 653054 - RNA, 19 nt, Homo sapiens
gcccauggaccuucuuguc

SEQ ID NO: 653055 - RNA, 19 nt, Homo sapiens
guuccggcgucaaggugaa

SEQ ID NO: 653056 - RNA, 19 nt, Homo sapiens
caccugggcagcagacaga

SEQ ID NO: 653057 - RNA, 19 nt, Homo sapiens
gaucgaagaacguaaagua

SEQ ID NO: 653058 - RNA, 19 nt, Homo sapiens
cgaagaacguaaaguagaa

SEQ ID NO: 653059 - RNA, 19 nt, Homo sapiens
gaacaccuccgaucgaaga

SEQ ID NO: 653060 - RNA, 19 nt, Homo sapiens
gaaggugauugccaggaaa

SEQ ID NO: 653061 - RNA, 19 nt, Homo sapiens
ugacucaaguucuucaguu

SEQ ID NO: 653062 - RNA, 19 nt, Homo sapiens
gagaagacuccaccuaauc

SEQ ID NO: 653063 - RNA, 19 nt, Homo sapiens
cuaagcaugcuaagacuaa

SEQ ID NO: 653064 - RNA, 19 nt, Homo sapiens
agagaagacuccaccuaau

SEQ ID NO: 653065 - RNA, 19 nt, Homo sapiens
ucucuucccuucauucuuc

SEQ ID NO: 653066 - RNA, 19 nt, Homo sapiens
aagagaagacuccaccuaa

SEQ ID NO: 653067 - RNA, 19 nt, Homo sapiens
ggaaauggaucuggaaaag

SEQ ID NO: 653068 - RNA, 19 nt, Homo sapiens
agaaggugauugccaggaa

SEQ ID NO: 653069 - RNA, 19 nt, Homo sapiens
aaagagaagacuccaccua

SEQ ID NO: 653070 - RNA, 19 nt, Homo sapiens
gcacgagugagaucaagau

SEQ ID NO: 653071 - RNA, 19 nt, Homo sapiens
gaugagugcacgagugaga

SEQ ID NO: 653072 - RNA, 19 nt, Homo sapiens
gcucucugcugacucaagu

SEQ ID NO: 653073 - RNA, 19 nt, Homo sapiens
ggacaagagagagaaggaa

SEQ ID NO: 653074 - RNA, 19 nt, Homo sapiens
gcgaugagugcacgaguga

SEQ ID NO: 653075 - RNA, 19 nt, Homo sapiens
uaaaguagaaggugauugc

SEQ ID NO: 653076 - RNA, 19 nt, Homo sapiens
agacuccaccuaauccuaa

SEQ ID NO: 653077 - RNA, 19 nt, Homo sapiens
gacucaaguucuucaguuc

SEQ ID NO: 653078 - RNA, 19 nt, Homo sapiens
uauugaaccuggacaagag

SEQ ID NO: 653079 - RNA, 19 nt, Homo sapiens
caagaggaaccaccaacug

SEQ ID NO: 653080 - RNA, 19 nt, Homo sapiens
ucgaagaacguaaaguaga

SEQ ID NO: 653081 - RNA, 19 nt, Homo sapiens
aagaggaaccaccaacuga

SEQ ID NO: 653082 - RNA, 19 nt, Homo sapiens
guucuucaguucacgaucu

SEQ ID NO: 653083 - RNA, 19 nt, Homo sapiens
uaagcaugcuaagacuaaa

SEQ ID NO: 653084 - RNA, 19 nt, Homo sapiens
caggcucucugcugacuca

SEQ ID NO: 653085 - RNA, 19 nt, Homo sapiens
gaggaaccaccaacugaca

SEQ ID NO: 653086 - RNA, 19 nt, Homo sapiens
ggaaccaccaacugacaau

SEQ ID NO: 653087 - RNA, 19 nt, Homo sapiens
gcaagaggaaccaccaacu

SEQ ID NO: 653088 - RNA, 19 nt, Homo sapiens
aggaacaccuccgaucgaa

SEQ ID NO: 653089 - RNA, 19 nt, Homo sapiens
ggauauugaaccuggacaa

SEQ ID NO: 653090 - RNA, 19 nt, Homo sapiens
gacuaaagaagcaggagau

SEQ ID NO: 653091 - RNA, 19 nt, Homo sapiens
gggcagccauaaguuaaaa

SEQ ID NO: 653092 - RNA, 19 nt, Homo sapiens
caggaaauggaucuggaaa

SEQ ID NO: 653093 - RNA, 19 nt, Homo sapiens
gaagaacguaaaguagaag

SEQ ID NO: 653094 - RNA, 19 nt, Homo sapiens
guucacgaucuucuaguug

SEQ ID NO: 653095 - RNA, 19 nt, Homo sapiens
auucguggcucccggugaa

SEQ ID NO: 653096 - RNA, 19 nt, Homo sapiens
cuaauccuaagcaugcuaa

SEQ ID NO: 653097 - RNA, 19 nt, Homo sapiens
gauauugaaccuggacaag

SEQ ID NO: 653098 - RNA, 19 nt, Homo sapiens
gaaauggaucuggaaaaga

SEQ ID NO: 653099 - RNA, 19 nt, Homo sapiens
gaaccaccaacugacaauc

SEQ ID NO: 653100 - RNA, 19 nt, Homo sapiens
ggaaagagacagagacaaa

SEQ ID NO: 653101 - RNA, 19 nt, Homo sapiens
aauaauaccucccuuagaa

SEQ ID NO: 653102 - RNA, 19 nt, Homo sapiens
ggacuuagcugggagaaag

SEQ ID NO: 653103 - RNA, 19 nt, Homo sapiens
ccgaguagcugagauuaua

SEQ ID NO: 653104 - RNA, 19 nt, Homo sapiens
gcacugggcuacuacuaug

SEQ ID NO: 653105 - RNA, 19 nt, Homo sapiens
cuaaagcgcuaccugcuaa

SEQ ID NO: 653106 - RNA, 19 nt, Homo sapiens
gaaaaugugugugugcuua

SEQ ID NO: 653107 - RNA, 19 nt, Homo sapiens
gggaggcagugauggguua

SEQ ID NO: 653108 - RNA, 19 nt, Homo sapiens
ggaaauaaccucacuaucc

SEQ ID NO: 653109 - RNA, 19 nt, Homo sapiens
agacaaagauccaggaaag

SEQ ID NO: 653110 - RNA, 19 nt, Homo sapiens
agacagcccuccaucuaaa

SEQ ID NO: 653111 - RNA, 19 nt, Homo sapiens
gcagucagcuugcgcuaca

SEQ ID NO: 653112 - RNA, 19 nt, Homo sapiens
ggagugagggauuaucuuu

SEQ ID NO: 653113 - RNA, 19 nt, Homo sapiens
gagcagagccuggcaccua

SEQ ID NO: 653114 - RNA, 19 nt, Homo sapiens
gggagacgcugcuacuaga

SEQ ID NO: 653115 - RNA, 19 nt, Homo sapiens
gcauuagauuucucauuug

SEQ ID NO: 653116 - RNA, 19 nt, Homo sapiens
agaagaaguuugacaagug

SEQ ID NO: 653117 - RNA, 19 nt, Homo sapiens
gacagagucucgcuauugu

SEQ ID NO: 653118 - RNA, 19 nt, Homo sapiens
gguacaaccuguucugcuu

SEQ ID NO: 653119 - RNA, 19 nt, Homo sapiens
ggacuaaguuuucuccauu

SEQ ID NO: 653120 - RNA, 19 nt, Homo sapiens
cagagaagcugcagaagac

SEQ ID NO: 653121 - RNA, 19 nt, Homo sapiens
ggaaauucagguacggaua

SEQ ID NO: 653122 - RNA, 19 nt, Homo sapiens
aaagagagagcuucuguug

SEQ ID NO: 653123 - RNA, 19 nt, Homo sapiens
acaacaauguggucacuau

SEQ ID NO: 653124 - RNA, 19 nt, Homo sapiens
gagaucguguuuccagaga

SEQ ID NO: 653125 - RNA, 19 nt, Homo sapiens
gaaguuuguugugaggauu

SEQ ID NO: 653126 - RNA, 19 nt, Homo sapiens
ugugugugcuuauguauga

SEQ ID NO: 653127 - RNA, 19 nt, Homo sapiens
gguggcagaugacaagaug

SEQ ID NO: 653128 - RNA, 19 nt, Homo sapiens
ccaaagugcugggauuaca

SEQ ID NO: 653129 - RNA, 19 nt, Homo sapiens
ccaaagugcugggauuaca

SEQ ID NO: 653130 - RNA, 19 nt, Homo sapiens
agacaggguuucaccaugu

SEQ ID NO: 653131 - RNA, 19 nt, Homo sapiens
ugaacugggucaugucuuc

SEQ ID NO: 653132 - RNA, 19 nt, Homo sapiens
gcgcuuugcuucacugagu

SEQ ID NO: 653133 - RNA, 19 nt, Homo sapiens
agagagagcuucuguugcu

SEQ ID NO: 653134 - RNA, 19 nt, Homo sapiens
gaaagagagagcuucuguu

SEQ ID NO: 653135 - RNA, 19 nt, Homo sapiens
ccaagaagaaguuugacaa

SEQ ID NO: 653136 - RNA, 19 nt, Homo sapiens
gagcaccucucgccauguc

SEQ ID NO: 653137 - RNA, 19 nt, Homo sapiens
gcaccgaagagcacagauu

SEQ ID NO: 653138 - RNA, 19 nt, Homo sapiens
gcuuuccucuuccugaauu

SEQ ID NO: 653139 - RNA, 19 nt, Homo sapiens
gaaauucagguacggauac

SEQ ID NO: 653140 - RNA, 19 nt, Homo sapiens
cuccaggacuucaauauuc

SEQ ID NO: 653141 - RNA, 19 nt, Homo sapiens
ccagagaagcugcagaaga

SEQ ID NO: 653142 - RNA, 19 nt, Homo sapiens
ggaggaggagaucguguuu

SEQ ID NO: 653143 - RNA, 19 nt, Homo sapiens
gagcauuagauuucucauu

SEQ ID NO: 653144 - RNA, 19 nt, Homo sapiens
acagacagcccuccaucua

SEQ ID NO: 653145 - RNA, 19 nt, Homo sapiens
gcuccaagaagaaguuuga

SEQ ID NO: 653146 - RNA, 19 nt, Homo sapiens
ucacugacuuccuggacaa

SEQ ID NO: 653147 - RNA, 19 nt, Homo sapiens
uguuaggcguguuacaaua

SEQ ID NO: 653148 - RNA, 19 nt, Homo sapiens
gcuaaagcgcuaccugcua

SEQ ID NO: 653149 - RNA, 19 nt, Homo sapiens
agacagaggaggaaagaga

SEQ ID NO: 653150 - RNA, 19 nt, Homo sapiens
ggaaugauuucagcucacu

SEQ ID NO: 653151 - RNA, 19 nt, Homo sapiens
guacaaccuguucugcuuu

SEQ ID NO: 653152 - RNA, 19 nt, Homo sapiens
gaucguguuuccagagaag

SEQ ID NO: 653153 - RNA, 19 nt, Homo sapiens
gacaggguuucaccauguu

SEQ ID NO: 653154 - RNA, 19 nt, Homo sapiens
ggacacacgccuccgauac

SEQ ID NO: 653155 - RNA, 19 nt, Homo sapiens
gaaagagacagagacaaag

SEQ ID NO: 653156 - RNA, 19 nt, Homo sapiens
gcuccaggacuucaauauu

SEQ ID NO: 653157 - RNA, 19 nt, Homo sapiens
gggcucaggaggagaguuu

SEQ ID NO: 653158 - RNA, 19 nt, Homo sapiens
ugugauggcucauguggau

SEQ ID NO: 653159 - RNA, 19 nt, Homo sapiens
caaaccagaggcuccauug

SEQ ID NO: 653160 - RNA, 19 nt, Homo sapiens
gcuaggguguggaggacuu

SEQ ID NO: 653161 - RNA, 19 nt, Homo sapiens
ggccacgcccaacuaauuu

SEQ ID NO: 653162 - RNA, 19 nt, Homo sapiens
ccaccacgcccagcuaauu

SEQ ID NO: 653163 - RNA, 19 nt, Homo sapiens
cagacagcccuccaucuaa

SEQ ID NO: 653164 - RNA, 19 nt, Homo sapiens
ccuccucucugcccuaaug

SEQ ID NO: 653165 - RNA, 19 nt, Homo sapiens
ccuuagaaguuuguuguga

SEQ ID NO: 653166 - RNA, 19 nt, Homo sapiens
auaccucccuuagaaguuu

SEQ ID NO: 653167 - RNA, 19 nt, Homo sapiens
ucucugagcauuagauuuc

SEQ ID NO: 653168 - RNA, 19 nt, Homo sapiens
agacagggcaggcacagaa

SEQ ID NO: 653169 - RNA, 19 nt, Homo sapiens
gagacaaagauccaggaaa

SEQ ID NO: 653170 - RNA, 19 nt, Homo sapiens
ggccagagaagcugcagaa

SEQ ID NO: 653171 - RNA, 19 nt, Homo sapiens
caggaaauaaccucacuau

SEQ ID NO: 653172 - RNA, 19 nt, Homo sapiens
guacggauacaacaaugug

SEQ ID NO: 653173 - RNA, 19 nt, Homo sapiens
caaaggcacagcggaagaa

SEQ ID NO: 653174 - RNA, 19 nt, Homo sapiens
uaauaauaccucccuuaga

SEQ ID NO: 653175 - RNA, 19 nt, Homo sapiens
ggaggagaguuuggagaag

SEQ ID NO: 653176 - RNA, 19 nt, Homo sapiens
ccagacagaguccuacaga

SEQ ID NO: 653177 - RNA, 19 nt, Homo sapiens
aagaagaaguuugacaagu

SEQ ID NO: 653178 - RNA, 19 nt, Homo sapiens
aaacuuugccucugaccuu

SEQ ID NO: 653179 - RNA, 19 nt, Homo sapiens
uggccaggcugcucuugaa

SEQ ID NO: 653180 - RNA, 19 nt, Homo sapiens
gcaucuacuuggcccugaa

SEQ ID NO: 653181 - RNA, 19 nt, Homo sapiens
gcagggagagacaaagauc

SEQ ID NO: 653182 - RNA, 19 nt, Homo sapiens
gaggaaagagacagagaca

SEQ ID NO: 653183 - RNA, 19 nt, Homo sapiens
cugaguagcugggauuaca

SEQ ID NO: 653184 - RNA, 19 nt, Homo sapiens
ggaaugguggcaaguacug

SEQ ID NO: 653185 - RNA, 19 nt, Homo sapiens
ccgaagagccaagcgcuuu

SEQ ID NO: 653186 - RNA, 19 nt, Homo sapiens
gauuucucauuugccaaua

SEQ ID NO: 653187 - RNA, 19 nt, Homo sapiens
acaaagauccaggaaagga

SEQ ID NO: 653188 - RNA, 19 nt, Homo sapiens
gccuucaucucccaaagug

SEQ ID NO: 653189 - RNA, 19 nt, Homo sapiens
gcaggaaauaaccucacua

SEQ ID NO: 653190 - RNA, 19 nt, Homo sapiens
caagaagaaguuugacaag

SEQ ID NO: 653191 - RNA, 19 nt, Homo sapiens
gguggugacucggcuagug

SEQ ID NO: 653192 - RNA, 19 nt, Homo sapiens
gaguagauuuguggagaca

SEQ ID NO: 653193 - RNA, 19 nt, Homo sapiens
caccacgcccagcuaauuu

SEQ ID NO: 653194 - RNA, 19 nt, Homo sapiens
guauaagugguguguguau

SEQ ID NO: 653195 - RNA, 19 nt, Homo sapiens
caggaccagugcaaacuca

SEQ ID NO: 653196 - RNA, 19 nt, Homo sapiens
uaugggcacugucucuuag

SEQ ID NO: 653197 - RNA, 19 nt, Homo sapiens
cuaugggcacugucucuua

SEQ ID NO: 653198 - RNA, 19 nt, Homo sapiens
guagauuuguggagacacu

SEQ ID NO: 653199 - RNA, 19 nt, Homo sapiens
ccaugucucugagcauuag

SEQ ID NO: 653200 - RNA, 19 nt, Homo sapiens
gauaucagcuuaccuauug

SEQ ID NO: 653201 - RNA, 19 nt, Homo sapiens
ggaaagagguaaacagaug

SEQ ID NO: 653202 - RNA, 19 nt, Homo sapiens
gcucuagccugacauauaa

SEQ ID NO: 653203 - RNA, 19 nt, Homo sapiens
cuaauaagguugaggauaa

SEQ ID NO: 653204 - RNA, 19 nt, Homo sapiens
ucacagggaucaacgaaua

SEQ ID NO: 653205 - RNA, 19 nt, Homo sapiens
gcaagaaccucaaagaaag

SEQ ID NO: 653206 - RNA, 19 nt, Homo sapiens
ggagugggauuauaacauu

SEQ ID NO: 653207 - RNA, 19 nt, Homo sapiens
guaaacagauggaggaaga

SEQ ID NO: 653208 - RNA, 19 nt, Homo sapiens
gaauuaaccucucaaagca

SEQ ID NO: 653209 - RNA, 19 nt, Homo sapiens
ugaaacaacuggugcauga

SEQ ID NO: 653210 - RNA, 19 nt, Homo sapiens
gcccaacacucaacuagua

SEQ ID NO: 653211 - RNA, 19 nt, Homo sapiens
gaaauugguucuaauaagg

SEQ ID NO: 653212 - RNA, 19 nt, Homo sapiens
gaaagugggcugugauaaa

SEQ ID NO: 653213 - RNA, 19 nt, Homo sapiens
gaauauaaccgaucccauu

SEQ ID NO: 653214 - RNA, 19 nt, Homo sapiens
gaaguuagaauuacagcua

SEQ ID NO: 653215 - RNA, 19 nt, Homo sapiens
gaaacucccacuuugaaua

SEQ ID NO: 653216 - RNA, 19 nt, Homo sapiens
gacaagaucauccaccuua

SEQ ID NO: 653217 - RNA, 19 nt, Homo sapiens
ucacaccgauggaccuuua

SEQ ID NO: 653218 - RNA, 19 nt, Homo sapiens
guuguaaacuaacagcuua

SEQ ID NO: 653219 - RNA, 19 nt, Homo sapiens
aaagaaagauggaaagauc

SEQ ID NO: 653220 - RNA, 19 nt, Homo sapiens
ugacagauacaaacaguua

SEQ ID NO: 653221 - RNA, 19 nt, Homo sapiens
guaaacagcugugguguag

SEQ ID NO: 653222 - RNA, 19 nt, Homo sapiens
gaagaaauggugcaaauag

SEQ ID NO: 653223 - RNA, 19 nt, Homo sapiens
gaaggcagguucaagaaag

SEQ ID NO: 653224 - RNA, 19 nt, Homo sapiens
uuaaaggauuggugucuua

SEQ ID NO: 653225 - RNA, 19 nt, Homo sapiens
uaucaucagucuagaauug

SEQ ID NO: 653226 - RNA, 19 nt, Homo sapiens
cuacaucuuugguuccuua

SEQ ID NO: 653227 - RNA, 19 nt, Homo sapiens
agagauaagugcaucauga

SEQ ID NO: 653228 - RNA, 19 nt, Homo sapiens
gauagcagccgcucuggua

SEQ ID NO: 653229 - RNA, 19 nt, Homo sapiens
gauguguucucaaaugauu

SEQ ID NO: 653230 - RNA, 19 nt, Homo sapiens
ugucauggcucccuuggua

SEQ ID NO: 653231 - RNA, 19 nt, Homo sapiens
caagagaucagcuguagaa

SEQ ID NO: 653232 - RNA, 19 nt, Homo sapiens
ucaacaaugugauacguaa

SEQ ID NO: 653233 - RNA, 19 nt, Homo sapiens
caacagacguccgacaaga

SEQ ID NO: 653234 - RNA, 19 nt, Homo sapiens
caaggagacuggagauguu

SEQ ID NO: 653235 - RNA, 19 nt, Homo sapiens
gaacacgccagugcaauaa

SEQ ID NO: 653236 - RNA, 19 nt, Homo sapiens
ccauagacauguccaaaga

SEQ ID NO: 653237 - RNA, 19 nt, Homo sapiens
gggaguagauguaaaguac

SEQ ID NO: 653238 - RNA, 19 nt, Homo sapiens
gaaagcauaugucgauggu

SEQ ID NO: 653239 - RNA, 19 nt, Homo sapiens
ggaaggccuugaugaucua

SEQ ID NO: 653240 - RNA, 19 nt, Homo sapiens
gaaauggugcaaauagauu

SEQ ID NO: 653241 - RNA, 19 nt, Homo sapiens
gauaagugcaucaugaauu

SEQ ID NO: 653242 - RNA, 19 nt, Homo sapiens
guaauaaucgcaaaggaaa

SEQ ID NO: 653243 - RNA, 19 nt, Homo sapiens
cagcgaaacucccacuuug

SEQ ID NO: 653244 - RNA, 19 nt, Homo sapiens
auagagaccuuuaagcaaa

SEQ ID NO: 653245 - RNA, 19 nt, Homo sapiens
gcaucugacugcaauaaug

SEQ ID NO: 653246 - RNA, 19 nt, Homo sapiens
ggcaagaaccucaaagaaa

SEQ ID NO: 653247 - RNA, 19 nt, Homo sapiens
caagaaagcauaugucgau

SEQ ID NO: 653248 - RNA, 19 nt, Homo sapiens
caaagcagaguauuacaaa

SEQ ID NO: 653249 - RNA, 19 nt, Homo sapiens
uggaagaaaucaccaaaga

SEQ ID NO: 653250 - RNA, 19 nt, Homo sapiens
ggagacaaguccauauucu

SEQ ID NO: 653251 - RNA, 19 nt, Homo sapiens
gagagcacguaccaauaaa

SEQ ID NO: 653252 - RNA, 19 nt, Homo sapiens
auaaugaacucgugcaaga

SEQ ID NO: 653253 - RNA, 19 nt, Homo sapiens
gaacucgacucgugauggu

SEQ ID NO: 653254 - RNA, 19 nt, Homo sapiens
gaaguuguacccugaauca

SEQ ID NO: 653255 - RNA, 19 nt, Homo sapiens
gcaaauuccagauaguaaa

SEQ ID NO: 653256 - RNA, 19 nt, Homo sapiens
ccaaugguuuacacuuuaa

SEQ ID NO: 653257 - RNA, 19 nt, Homo sapiens
gugcauaucagcugacuuu

SEQ ID NO: 653258 - RNA, 19 nt, Homo sapiens
ggucagagccugucaacug

SEQ ID NO: 653259 - RNA, 19 nt, Homo sapiens
gcuacaggccauuauauuu

SEQ ID NO: 653260 - RNA, 19 nt, Homo sapiens
gauaaucccuacuuuugua

SEQ ID NO: 653261 - RNA, 19 nt, Homo sapiens
aauuagagaugcaugcuuu

SEQ ID NO: 653262 - RNA, 19 nt, Homo sapiens
guugagguguccuuuguuu

SEQ ID NO: 653263 - RNA, 19 nt, Homo sapiens
ggauaaguguggugucugu

SEQ ID NO: 653264 - RNA, 19 nt, Homo sapiens
gggcugugauaaagaaauu

SEQ ID NO: 653265 - RNA, 19 nt, Homo sapiens
gcaaagagcacguccaaaa

SEQ ID NO: 653266 - RNA, 19 nt, Homo sapiens
ccugagcaguuguucuuua

SEQ ID NO: 653267 - RNA, 19 nt, Homo sapiens
cagcacaaaucuagaagga

SEQ ID NO: 653268 - RNA, 19 nt, Homo sapiens
ggauauggaacaaagaauu

SEQ ID NO: 653269 - RNA, 19 nt, Homo sapiens
guaauuggaagaacagaaa

SEQ ID NO: 653270 - RNA, 19 nt, Homo sapiens
gcauaugcuuguuuaaagu

SEQ ID NO: 653271 - RNA, 19 nt, Homo sapiens
caguucagcuucacaaaug

SEQ ID NO: 653272 - RNA, 19 nt, Homo sapiens
gcacgauacugcuccauac

SEQ ID NO: 653273 - RNA, 19 nt, Homo sapiens
gucaagaacugaaaagaua

SEQ ID NO: 653274 - RNA, 19 nt, Homo sapiens
ugagagcacguaccaauaa

SEQ ID NO: 653275 - RNA, 19 nt, Homo sapiens
gcauagagaccuuuaagca

SEQ ID NO: 653276 - RNA, 19 nt, Homo sapiens
gguuuacacuuuaacaaga

SEQ ID NO: 653277 - RNA, 19 nt, Homo sapiens
gaaagaucauugacaacag

SEQ ID NO: 653278 - RNA, 19 nt, Homo sapiens
ggaaagaucauugacaaca

SEQ ID NO: 653279 - RNA, 19 nt, Homo sapiens
cauauucugucaaauggaa

SEQ ID NO: 653280 - RNA, 19 nt, Homo sapiens
cauugaagaugacauugaa

SEQ ID NO: 653281 - RNA, 19 nt, Homo sapiens
guuguacccugaaucauga

SEQ ID NO: 653282 - RNA, 19 nt, Homo sapiens
gcagcugaaugaaacaaug

SEQ ID NO: 653283 - RNA, 19 nt, Homo sapiens
aagaauugcugcuacuuug

SEQ ID NO: 653284 - RNA, 19 nt, Homo sapiens
gaaguaagacugugagacu

SEQ ID NO: 653285 - RNA, 19 nt, Homo sapiens
caaagauccauauagcaua

SEQ ID NO: 653286 - RNA, 19 nt, Homo sapiens
gauauauccauuccuauga

SEQ ID NO: 653287 - RNA, 19 nt, Homo sapiens
uaaccgaucccauuaacaa

SEQ ID NO: 653288 - RNA, 19 nt, Homo sapiens
ccuauugccuucuauacuu

SEQ ID NO: 653289 - RNA, 19 nt, Homo sapiens
gaaccaauugugcauauca

SEQ ID NO: 653290 - RNA, 19 nt, Homo sapiens
caucuuugguuccuuauca

SEQ ID NO: 653291 - RNA, 19 nt, Homo sapiens
guaaugaugaaccauguuu

SEQ ID NO: 653292 - RNA, 19 nt, Homo sapiens
aaauauggaugccguagga

SEQ ID NO: 653293 - RNA, 19 nt, Homo sapiens
uggacaagcugguaaugaa

SEQ ID NO: 653294 - RNA, 19 nt, Homo sapiens
gcagcgaaacucccacuuu

SEQ ID NO: 653295 - RNA, 19 nt, Homo sapiens
uaacugugcuuauguuggu

SEQ ID NO: 653296 - RNA, 19 nt, Homo sapiens
gaagugcuacguauagaau

SEQ ID NO: 653297 - RNA, 19 nt, Homo sapiens
guacacuacugaugcuguu

SEQ ID NO: 653298 - RNA, 19 nt, Homo sapiens
agagagacauaauuagaga

SEQ ID NO: 653299 - RNA, 19 nt, Homo sapiens
aaggauuggugucuuagua

SEQ ID NO: 653300 - RNA, 19 nt, Homo sapiens
ggacugcacuacuccauga

SEQ ID NO: 653301 - RNA, 19 nt, Homo sapiens
ucaaugaaaucuaccauga

SEQ ID NO: 653302 - RNA, 19 nt, Homo sapiens
agaaagagaugcucggaaa

SEQ ID NO: 653303 - RNA, 19 nt, Homo sapiens
ggaaggagcacguacagaa

SEQ ID NO: 653304 - RNA, 19 nt, Homo sapiens
gcaggaaggugggcuguga

SEQ ID NO: 653305 - RNA, 19 nt, Homo sapiens
ccagacaccugcucauuca

SEQ ID NO: 653306 - RNA, 19 nt, Homo sapiens
ucagaucccuccaagaaga

SEQ ID NO: 653307 - RNA, 19 nt, Homo sapiens
caagaagcaugguuacauc

SEQ ID NO: 653308 - RNA, 19 nt, Homo sapiens
ggacaacagccacugcaaa

SEQ ID NO: 653309 - RNA, 19 nt, Homo sapiens
gaaaagaccagaaaccaaa

SEQ ID NO: 653310 - RNA, 19 nt, Homo sapiens
acaacaagcuguccugcaa

SEQ ID NO: 653311 - RNA, 19 nt, Homo sapiens
ggucccaguucaccaagua

SEQ ID NO: 653312 - RNA, 19 nt, Homo sapiens
gggccuaccuccagcagaa

SEQ ID NO: 653313 - RNA, 19 nt, Homo sapiens
caacgacauugacguguuc

SEQ ID NO: 653314 - RNA, 19 nt, Homo sapiens
gaacgagcaaugccgcuuu

SEQ ID NO: 653315 - RNA, 19 nt, Homo sapiens
cggaagaucucgucaaagg

SEQ ID NO: 653316 - RNA, 19 nt, Homo sapiens
caagaagagcuacguaguu

SEQ ID NO: 653317 - RNA, 19 nt, Homo sapiens
caacguggagggcaggaua

SEQ ID NO: 653318 - RNA, 19 nt, Homo sapiens
gacaggcaaguucaucuua

SEQ ID NO: 653319 - RNA, 19 nt, Homo sapiens
gaagcaugguuacaucaag

SEQ ID NO: 653320 - RNA, 19 nt, Homo sapiens
ggaagcacaacgacauuga

SEQ ID NO: 653321 - RNA, 19 nt, Homo sapiens
aagaagagcuacguaguuc

SEQ ID NO: 653322 - RNA, 19 nt, Homo sapiens
caggcaaguucaucuuaaa

SEQ ID NO: 653323 - RNA, 19 nt, Homo sapiens
gcaaugccgcuuugacuuc

SEQ ID NO: 653324 - RNA, 19 nt, Homo sapiens
gaagucuugucccgcuauu

SEQ ID NO: 653325 - RNA, 19 nt, Homo sapiens
ucucagaucccuccaagaa

SEQ ID NO: 653326 - RNA, 19 nt, Homo sapiens
acaggcaaguucaucuuaa

SEQ ID NO: 653327 - RNA, 19 nt, Homo sapiens
gcugcacccugaaccauga

SEQ ID NO: 653328 - RNA, 19 nt, Homo sapiens
gggagacgcugcagaccau

SEQ ID NO: 653329 - RNA, 19 nt, Homo sapiens
gaccagaaaccaaagaauc

SEQ ID NO: 653330 - RNA, 19 nt, Homo sapiens
ucacugacguacaaauaca

SEQ ID NO: 653331 - RNA, 19 nt, Homo sapiens
ggagagaugccaccuguac

SEQ ID NO: 653332 - RNA, 19 nt, Homo sapiens
agaaguaccugcugacacu

SEQ ID NO: 653333 - RNA, 19 nt, Homo sapiens
acaacaacguccuggaaga

SEQ ID NO: 653334 - RNA, 19 nt, Homo sapiens
gggaggugguguccaugaa

SEQ ID NO: 653335 - RNA, 19 nt, Homo sapiens
aaaccaaugccguagauga

SEQ ID NO: 653336 - RNA, 19 nt, Homo sapiens
cacagaggaucacccagaa

SEQ ID NO: 653337 - RNA, 19 nt, Homo sapiens
gaugagaugcggaagaaag

SEQ ID NO: 653338 - RNA, 19 nt, Homo sapiens
ugaagagaaugacguggau

SEQ ID NO: 653339 - RNA, 19 nt, Homo sapiens
gcaaggccgugugcaugug

SEQ ID NO: 653340 - RNA, 19 nt, Homo sapiens
gccgcuaccugcacuccua

SEQ ID NO: 653341 - RNA, 19 nt, Homo sapiens
agaaaccaaugccguagau

SEQ ID NO: 653342 - RNA, 19 nt, Homo sapiens
cgacaagucaauauucugu

SEQ ID NO: 653343 - RNA, 19 nt, Homo sapiens
acacgggccacgaugaaua

SEQ ID NO: 653344 - RNA, 19 nt, Homo sapiens
gaaaccaaagaauccaaga

SEQ ID NO: 653345 - RNA, 19 nt, Homo sapiens
acaacgacauugacguguu

SEQ ID NO: 653346 - RNA, 19 nt, Homo sapiens
gcaaguccuguaaccugua

SEQ ID NO: 653347 - RNA, 19 nt, Homo sapiens
acaagucaauauucuguag

SEQ ID NO: 653348 - RNA, 19 nt, Homo sapiens
ccaaggcgacaagucaaua

SEQ ID NO: 653349 - RNA, 19 nt, Homo sapiens
uccggaagaucucgucaaa

SEQ ID NO: 653350 - RNA, 19 nt, Homo sapiens
gacgacagcuucggcaucu

SEQ ID NO: 653351 - RNA, 19 nt, Homo sapiens
ugacaacaacguccuggaa

SEQ ID NO: 653352 - RNA, 19 nt, Homo sapiens
gcaagcaggaagacaagug

SEQ ID NO: 653353 - RNA, 19 nt, Homo sapiens
gcaccuggcaagcauuguu

SEQ ID NO: 653354 - RNA, 19 nt, Homo sapiens
gaaggagcacguacagaag

SEQ ID NO: 653355 - RNA, 19 nt, Homo sapiens
ggauggaggaggaggaguu

SEQ ID NO: 653356 - RNA, 19 nt, Homo sapiens
aagcaugguuacaucaaga

SEQ ID NO: 653357 - RNA, 19 nt, Homo sapiens
acaacaaccucaccaacgu

SEQ ID NO: 653358 - RNA, 19 nt, Homo sapiens
gacaacagccacugcaaag

SEQ ID NO: 653359 - RNA, 19 nt, Homo sapiens
ugacacucaugaacauugu

SEQ ID NO: 653360 - RNA, 19 nt, Homo sapiens
aagagaugcucggaaaguu

SEQ ID NO: 653361 - RNA, 19 nt, Homo sapiens
gaagagcuacguaguucag

SEQ ID NO: 653362 - RNA, 19 nt, Homo sapiens
ggaggaguucuucaucgaa

SEQ ID NO: 653363 - RNA, 19 nt, Homo sapiens
ucucacugacguacaaaua

SEQ ID NO: 653364 - RNA, 19 nt, Homo sapiens
ccaagaagcaugguuacau

SEQ ID NO: 653365 - RNA, 19 nt, Homo sapiens
gagcaaugccgcuuugacu

SEQ ID NO: 653366 - RNA, 19 nt, Homo sapiens
uugaugagaugcggaagaa

SEQ ID NO: 653367 - RNA, 19 nt, Homo sapiens
cacccaagaagcaugguua

SEQ ID NO: 653368 - RNA, 19 nt, Homo sapiens
ggaggaggaguucuucauc

SEQ ID NO: 653369 - RNA, 19 nt, Homo sapiens
gguacaccguggcuucugu

SEQ ID NO: 653370 - RNA, 19 nt, Homo sapiens
ggcaaguucaucuuaaaug

SEQ ID NO: 653371 - RNA, 19 nt, Homo sapiens
gaaagagaugcucggaaag

SEQ ID NO: 653372 - RNA, 19 nt, Homo sapiens
gagaugcggaagaaagaga

SEQ ID NO: 653373 - RNA, 19 nt, Homo sapiens
gaauccaagagcucauuga

SEQ ID NO: 653374 - RNA, 19 nt, Homo sapiens
ggcgacaagucaauauucu

SEQ ID NO: 653375 - RNA, 19 nt, Homo sapiens
gggucucacugacguacaa

SEQ ID NO: 653376 - RNA, 19 nt, Homo sapiens
gacaagucaauauucugua

SEQ ID NO: 653377 - RNA, 19 nt, Homo sapiens
aggagcacguacagaagua

SEQ ID NO: 653378 - RNA, 19 nt, Homo sapiens
caaggcgacaagucaauau

SEQ ID NO: 653379 - RNA, 19 nt, Homo sapiens
ccaagaagagcuacguagu

SEQ ID NO: 653380 - RNA, 19 nt, Homo sapiens
ccagcaagcaggaagacaa

SEQ ID NO: 653381 - RNA, 19 nt, Homo sapiens
guucaggacccgccagugu

SEQ ID NO: 653382 - RNA, 19 nt, Homo sapiens
ggaagucuugucccgcuau

SEQ ID NO: 653383 - RNA, 19 nt, Homo sapiens
gccagacaccugcucauuc

SEQ ID NO: 653384 - RNA, 19 nt, Homo sapiens
cgaccgagccccuaugaaa

SEQ ID NO: 653385 - RNA, 19 nt, Homo sapiens
cgacauugacguguucaug

SEQ ID NO: 653386 - RNA, 19 nt, Homo sapiens
cucagagccuggagaaugu

SEQ ID NO: 653387 - RNA, 19 nt, Homo sapiens
aaagagaugcucggaaagu

SEQ ID NO: 653388 - RNA, 19 nt, Homo sapiens
gaggcuggaccacaagaug

SEQ ID NO: 653389 - RNA, 19 nt, Homo sapiens
guacaaauacaugauccau

SEQ ID NO: 653390 - RNA, 19 nt, Homo sapiens
ggagacaggcaaguucauc

SEQ ID NO: 653391 - RNA, 19 nt, Homo sapiens
gugcagccauccugacaac

SEQ ID NO: 653392 - RNA, 19 nt, Homo sapiens
gagaugcucggaaaguucu

SEQ ID NO: 653393 - RNA, 19 nt, Homo sapiens
caaguccuguaaccuguac

SEQ ID NO: 653394 - RNA, 19 nt, Homo sapiens
caacaacguccuggaagag

SEQ ID NO: 653395 - RNA, 19 nt, Homo sapiens
gugcggccaucaccaagca

SEQ ID NO: 653396 - RNA, 19 nt, Homo sapiens
ggaggaggaggaguucuuc

SEQ ID NO: 653397 - RNA, 19 nt, Homo sapiens
aagucaauauucuguagga

SEQ ID NO: 653398 - RNA, 19 nt, Homo sapiens
agacacgggccacgaugaa

SEQ ID NO: 653399 - RNA, 19 nt, Homo sapiens
gaucauccuccugagcuau

SEQ ID NO: 653400 - RNA, 19 nt, Homo sapiens
ggacugcacuacuccauga

SEQ ID NO: 653401 - RNA, 19 nt, Homo sapiens
ucaaugaaaucuaccauga

SEQ ID NO: 653402 - RNA, 19 nt, Homo sapiens
ggaaggagcacguacagaa

SEQ ID NO: 653403 - RNA, 19 nt, Homo sapiens
gggccuaccuccagcagaa

SEQ ID NO: 653404 - RNA, 19 nt, Homo sapiens
gaacgagcaaugccgcuuu

SEQ ID NO: 653405 - RNA, 19 nt, Homo sapiens
gcaaugccgcuuugacuuc

SEQ ID NO: 653406 - RNA, 19 nt, Homo sapiens
gcugcacccugaaccauga

SEQ ID NO: 653407 - RNA, 19 nt, Homo sapiens
agaaguaccugcugacacu

SEQ ID NO: 653408 - RNA, 19 nt, Homo sapiens
gccgcuaccugcacuccua

SEQ ID NO: 653409 - RNA, 19 nt, Homo sapiens
gcaaggccgugugcaugug

SEQ ID NO: 653410 - RNA, 19 nt, Homo sapiens
acacgggccacgaugaaua

SEQ ID NO: 653411 - RNA, 19 nt, Homo sapiens
gaaggagcacguacagaag

SEQ ID NO: 653412 - RNA, 19 nt, Homo sapiens
ggauggaggaggaggaguu

SEQ ID NO: 653413 - RNA, 19 nt, Homo sapiens
ugacacucaugaacauugu

SEQ ID NO: 653414 - RNA, 19 nt, Homo sapiens
gagcaaugccgcuuugacu

SEQ ID NO: 653415 - RNA, 19 nt, Homo sapiens
ggaggaguucuucaucgaa

SEQ ID NO: 653416 - RNA, 19 nt, Homo sapiens
ggaggaggaguucuucauc

SEQ ID NO: 653417 - RNA, 19 nt, Homo sapiens
aggagcacguacagaagua

SEQ ID NO: 653418 - RNA, 19 nt, Homo sapiens
ccuguuaucccagcacuuu

SEQ ID NO: 653419 - RNA, 19 nt, Homo sapiens
gugugcaccuggcaaguuc

SEQ ID NO: 653420 - RNA, 19 nt, Homo sapiens
cucagagccuggagaaugu

SEQ ID NO: 653421 - RNA, 19 nt, Homo sapiens
gugcagccauccugacaac

SEQ ID NO: 653422 - RNA, 19 nt, Homo sapiens
agacacgggccacgaugaa

SEQ ID NO: 653423 - RNA, 19 nt, Homo sapiens
ggaggaggaggaguucuuc

SEQ ID NO: 653424 - RNA, 19 nt, Homo sapiens
gcuaccugcacuccuauga

SEQ ID NO: 653425 - RNA, 19 nt, Homo sapiens
gaucauccuccugagcuau

SEQ ID NO: 653426 - RNA, 19 nt, Homo sapiens
ucaucgaacccuuggagaa

SEQ ID NO: 653427 - RNA, 19 nt, Homo sapiens
ucacacggcaggacuuugg

SEQ ID NO: 653428 - RNA, 19 nt, Homo sapiens
aggaggaguucuucaucga

SEQ ID NO: 653429 - RNA, 19 nt, Homo sapiens
cgguggcucaugccuguua

SEQ ID NO: 653430 - RNA, 19 nt, Homo sapiens
uaccugcacuccuaugacu

SEQ ID NO: 653431 - RNA, 19 nt, Homo sapiens
caucgaacccuuggagaag

SEQ ID NO: 653432 - RNA, 19 nt, Homo sapiens
aacgagcaaugccgcuuug

SEQ ID NO: 653433 - RNA, 19 nt, Homo sapiens
augacugccugcuggauga

SEQ ID NO: 653434 - RNA, 19 nt, Homo sapiens
ucuacaaugucacggucuu

SEQ ID NO: 653435 - RNA, 19 nt, Homo sapiens
caggcaugcugcagacgau

SEQ ID NO: 653436 - RNA, 19 nt, Homo sapiens
ggaaauggaucuacuugua

SEQ ID NO: 653437 - RNA, 19 nt, Homo sapiens
gcagugauauagcauaaua

SEQ ID NO: 653438 - RNA, 19 nt, Homo sapiens
gcacauauauucuuaaugg

SEQ ID NO: 653439 - RNA, 19 nt, Homo sapiens
gcaaauggcuuccucuuuc

SEQ ID NO: 653440 - RNA, 19 nt, Homo sapiens
ggagaaaggaguacaaaua

SEQ ID NO: 653441 - RNA, 19 nt, Homo sapiens
cauagaagaugaugguuua

SEQ ID NO: 653442 - RNA, 19 nt, Homo sapiens
gcaguggucuaaagcauua

SEQ ID NO: 653443 - RNA, 19 nt, Homo sapiens
gaagggaaaugguguauca

SEQ ID NO: 653444 - RNA, 19 nt, Homo sapiens
cagcguaucuugccaguaa

SEQ ID NO: 653445 - RNA, 19 nt, Homo sapiens
ccagugagguguaucagua

SEQ ID NO: 653446 - RNA, 19 nt, Homo sapiens
ccaagaaggacuauaguua

SEQ ID NO: 653447 - RNA, 19 nt, Homo sapiens
gaauauggauguaaagaag

SEQ ID NO: 653448 - RNA, 19 nt, Homo sapiens
gagcagugauauagcauaa

SEQ ID NO: 653449 - RNA, 19 nt, Homo sapiens
gauggcacauauauucuua

SEQ ID NO: 653450 - RNA, 19 nt, Homo sapiens
gaaguacugugaaggcaaa

SEQ ID NO: 653451 - RNA, 19 nt, Homo sapiens
gaaccaggauucccacaug

SEQ ID NO: 653452 - RNA, 19 nt, Homo sapiens
caccacagcccaugaauua

SEQ ID NO: 653453 - RNA, 19 nt, Homo sapiens
gaaauggaucuacuuguaa

SEQ ID NO: 653454 - RNA, 19 nt, Homo sapiens
uaacuugugucucaugaaa

SEQ ID NO: 653455 - RNA, 19 nt, Homo sapiens
gcaaugcccuucgaccuaa

SEQ ID NO: 653456 - RNA, 19 nt, Homo sapiens
gaaggaaucuuucaaugcu

SEQ ID NO: 653457 - RNA, 19 nt, Homo sapiens
ugagagcugugauccuuua

SEQ ID NO: 653458 - RNA, 19 nt, Homo sapiens
uaaauacaccuacuucgua

SEQ ID NO: 653459 - RNA, 19 nt, Homo sapiens
gaaaggaguacaaauagga

SEQ ID NO: 653460 - RNA, 19 nt, Homo sapiens
ugaagugucugucccauga

SEQ ID NO: 653461 - RNA, 19 nt, Homo sapiens
cacaggaacuggaagcaua

SEQ ID NO: 653462 - RNA, 19 nt, Homo sapiens
caacuuccuuucuuuccua

SEQ ID NO: 653463 - RNA, 19 nt, Homo sapiens
ugaauuaggccacguguuu

SEQ ID NO: 653464 - RNA, 19 nt, Homo sapiens
gaacuggaagcauaagaaa

SEQ ID NO: 653465 - RNA, 19 nt, Homo sapiens
cagcaugggucauugaaga

SEQ ID NO: 653466 - RNA, 19 nt, Homo sapiens
guucagcucuucugugaga

SEQ ID NO: 653467 - RNA, 19 nt, Homo sapiens
gaacagggucccacagguu

SEQ ID NO: 653468 - RNA, 19 nt, Homo sapiens
gaauuggguuggcagagaa

SEQ ID NO: 653469 - RNA, 19 nt, Homo sapiens
gggcgaauguucuaaguca

SEQ ID NO: 653470 - RNA, 19 nt, Homo sapiens
gaacugcagcgccuccuuu

SEQ ID NO: 653471 - RNA, 19 nt, Homo sapiens
gagaaaggaguacaaauag

SEQ ID NO: 653472 - RNA, 19 nt, Homo sapiens
gcugugauccuuuaaagaa

SEQ ID NO: 653473 - RNA, 19 nt, Homo sapiens
aaauacaccuacuucguaa

SEQ ID NO: 653474 - RNA, 19 nt, Homo sapiens
gaauuaggccacguguuua

SEQ ID NO: 653475 - RNA, 19 nt, Homo sapiens
gagcugugauccuuuaaag

SEQ ID NO: 653476 - RNA, 19 nt, Homo sapiens
agagaagacugguagaaug

SEQ ID NO: 653477 - RNA, 19 nt, Homo sapiens
ugagaucacuugucuugug

SEQ ID NO: 653478 - RNA, 19 nt, Homo sapiens
ggaauauggauguaaagaa

SEQ ID NO: 653479 - RNA, 19 nt, Homo sapiens
ggaguugaaucaucagagu

SEQ ID NO: 653480 - RNA, 19 nt, Homo sapiens
gaaaaggaguugaaucauc

SEQ ID NO: 653481 - RNA, 19 nt, Homo sapiens
ucaagugcauuaaagucua

SEQ ID NO: 653482 - RNA, 19 nt, Homo sapiens
gagaaaggcucagcaacgu

SEQ ID NO: 653483 - RNA, 19 nt, Homo sapiens
guuuauggcugcuaugguu

SEQ ID NO: 653484 - RNA, 19 nt, Homo sapiens
caugagagcugugauccuu

SEQ ID NO: 653485 - RNA, 19 nt, Homo sapiens
caaaggcauuggcuacuuc

SEQ ID NO: 653486 - RNA, 19 nt, Homo sapiens
ggaaagcggagaccgaaga

SEQ ID NO: 653487 - RNA, 19 nt, Homo sapiens
gcugauggcacauauauuc

SEQ ID NO: 653488 - RNA, 19 nt, Homo sapiens
gaccaucucagucuuuauu

SEQ ID NO: 653489 - RNA, 19 nt, Homo sapiens
caggaacaauggcagcuuu

SEQ ID NO: 653490 - RNA, 19 nt, Homo sapiens
ggauaguuagugaggauua

SEQ ID NO: 653491 - RNA, 19 nt, Homo sapiens
gaacaaaaccgacagaaag

SEQ ID NO: 653492 - RNA, 19 nt, Homo sapiens
gcagugccaguuuacauuu

SEQ ID NO: 653493 - RNA, 19 nt, Homo sapiens
ggaacuggaagcauaagaa

SEQ ID NO: 653494 - RNA, 19 nt, Homo sapiens
uaacccugcuuugggaaua

SEQ ID NO: 653495 - RNA, 19 nt, Homo sapiens
gcucagcaacgugaaauaa

SEQ ID NO: 653496 - RNA, 19 nt, Homo sapiens
caagaaggacuauaguuag

SEQ ID NO: 653497 - RNA, 19 nt, Homo sapiens
gaaugucuguucagcucuu

SEQ ID NO: 653498 - RNA, 19 nt, Homo sapiens
gaaugcaguuaagugguuu

SEQ ID NO: 653499 - RNA, 19 nt, Homo sapiens
uaaagaagaagaaggaauc

SEQ ID NO: 653500 - RNA, 19 nt, Homo sapiens
gaacaauggcagcuuucuu

SEQ ID NO: 653501 - RNA, 19 nt, Homo sapiens
ccaccaacaucgaagugaa

SEQ ID NO: 653502 - RNA, 19 nt, Homo sapiens
ggagggaaguacugugaag

SEQ ID NO: 653503 - RNA, 19 nt, Homo sapiens
gaguacaaauaggaucuuu

SEQ ID NO: 653504 - RNA, 19 nt, Homo sapiens
agaaugcaguuaagugguu

SEQ ID NO: 653505 - RNA, 19 nt, Homo sapiens
gggaauguuugauggacaa

SEQ ID NO: 653506 - RNA, 19 nt, Homo sapiens
ugcagugccuacaugauua

SEQ ID NO: 653507 - RNA, 19 nt, Homo sapiens
agaagaugaugguuuacaa

SEQ ID NO: 653508 - RNA, 19 nt, Homo sapiens
cagaagcugcuccgucaua

SEQ ID NO: 653509 - RNA, 19 nt, Homo sapiens
gaaaaucaguacaaucaca

SEQ ID NO: 653510 - RNA, 19 nt, Homo sapiens
ucaguaaggugggauuaug

SEQ ID NO: 653511 - RNA, 19 nt, Homo sapiens
uaagugguguuagcuuuga

SEQ ID NO: 653512 - RNA, 19 nt, Homo sapiens
ggaguccaguacacgauga

SEQ ID NO: 653513 - RNA, 19 nt, Homo sapiens
gcacuaugacacagcaauu

SEQ ID NO: 653514 - RNA, 19 nt, Homo sapiens
acaccuacuucguaaagaa

SEQ ID NO: 653515 - RNA, 19 nt, Homo sapiens
gauaucaucacaauuccaa

SEQ ID NO: 653516 - RNA, 19 nt, Homo sapiens
gauaguuagugaggauuau

SEQ ID NO: 653517 - RNA, 19 nt, Homo sapiens
gcagagaagacugguagaa

SEQ ID NO: 653518 - RNA, 19 nt, Homo sapiens
ggagaagggaaauggugua

SEQ ID NO: 653519 - RNA, 19 nt, Homo sapiens
gaugaaacgccggaacaaa

SEQ ID NO: 653520 - RNA, 19 nt, Homo sapiens
ccuccaacuuccuuucuuu

SEQ ID NO: 653521 - RNA, 19 nt, Homo sapiens
ugaauuggguuggcagaga

SEQ ID NO: 653522 - RNA, 19 nt, Homo sapiens
gcagcuuucuugccaucaa

SEQ ID NO: 653523 - RNA, 19 nt, Homo sapiens
ccagacaugugauacucuu

SEQ ID NO: 653524 - RNA, 19 nt, Homo sapiens
gcagccagauuguacaaac

SEQ ID NO: 653525 - RNA, 19 nt, Homo sapiens
agaaagaagcgauuugugu

SEQ ID NO: 653526 - RNA, 19 nt, Homo sapiens
gugcaaggacaguguguaa

SEQ ID NO: 653527 - RNA, 19 nt, Homo sapiens
ggaagugcauauaaaauag

SEQ ID NO: 653528 - RNA, 19 nt, Homo sapiens
caacgugaaauaacgcaaa

SEQ ID NO: 653529 - RNA, 19 nt, Homo sapiens
ggagggauccagcguaucu

SEQ ID NO: 653530 - RNA, 19 nt, Homo sapiens
caaagaauggagggaagua

SEQ ID NO: 653531 - RNA, 19 nt, Homo sapiens
ugggauggcugauguugga

SEQ ID NO: 653532 - RNA, 19 nt, Homo sapiens
gcccuuccaacgaauaaua

SEQ ID NO: 653533 - RNA, 19 nt, Homo sapiens
gaaaugaaaaguaggagaa

SEQ ID NO: 653534 - RNA, 19 nt, Homo sapiens
uuuaagugguguuagcuuu

SEQ ID NO: 653535 - RNA, 19 nt, Homo sapiens
gguguugucuugagguaca

SEQ ID NO: 653536 - RNA, 19 nt, Homo sapiens
gagaacagauuaagaagua

SEQ ID NO: 653537 - RNA, 19 nt, Homo sapiens
gccaagagcuguagaaauu

SEQ ID NO: 653538 - RNA, 19 nt, Homo sapiens
gcagcauacuuucaaauua

SEQ ID NO: 653539 - RNA, 19 nt, Homo sapiens
cuacacagauacaggauua

SEQ ID NO: 653540 - RNA, 19 nt, Homo sapiens
gcacuuggacggacaauuu

SEQ ID NO: 653541 - RNA, 19 nt, Homo sapiens
ggacuuaguggauuauaua

SEQ ID NO: 653542 - RNA, 19 nt, Homo sapiens
ggagagaacagauuaagaa

SEQ ID NO: 653543 - RNA, 19 nt, Homo sapiens
ggaaugaauuuaucuagca

SEQ ID NO: 653544 - RNA, 19 nt, Homo sapiens
ggaguaauccuuagagaga

SEQ ID NO: 653545 - RNA, 19 nt, Homo sapiens
ccaaagcauucucuaaaga

SEQ ID NO: 653546 - RNA, 19 nt, Homo sapiens
ccagagagcagacuguaua

SEQ ID NO: 653547 - RNA, 19 nt, Homo sapiens
gcaggaaguugaaaccaau

SEQ ID NO: 653548 - RNA, 19 nt, Homo sapiens
gaagagaucccaguuagau

SEQ ID NO: 653549 - RNA, 19 nt, Homo sapiens
gaagcagcauacuuucaaa

SEQ ID NO: 653550 - RNA, 19 nt, Homo sapiens
guauaugguuugugaauca

SEQ ID NO: 653551 - RNA, 19 nt, Homo sapiens
gagagcagacuguauacua

SEQ ID NO: 653552 - RNA, 19 nt, Homo sapiens
ugagacaauucgagaagua

SEQ ID NO: 653553 - RNA, 19 nt, Homo sapiens
ucauuucggugacucuuua

SEQ ID NO: 653554 - RNA, 19 nt, Homo sapiens
caagaagagaucccaguua

SEQ ID NO: 653555 - RNA, 19 nt, Homo sapiens
aggcaaauguuaugcuaua

SEQ ID NO: 653556 - RNA, 19 nt, Homo sapiens
guaggcaaauguuaugcua

SEQ ID NO: 653557 - RNA, 19 nt, Homo sapiens
ggaaguugaaaccaauuua

SEQ ID NO: 653558 - RNA, 19 nt, Homo sapiens
uuaagcaacuaccagauuu

SEQ ID NO: 653559 - RNA, 19 nt, Homo sapiens
guacaagugucacagaaag

SEQ ID NO: 653560 - RNA, 19 nt, Homo sapiens
gagcguggaguaauccuua

SEQ ID NO: 653561 - RNA, 19 nt, Homo sapiens
ggaagacucugggcucuca

SEQ ID NO: 653562 - RNA, 19 nt, Homo sapiens
gaagauauugguaggcaaa

SEQ ID NO: 653563 - RNA, 19 nt, Homo sapiens
ggaagcagcauacuuucaa

SEQ ID NO: 653564 - RNA, 19 nt, Homo sapiens
gcgggacggucauuauauu

SEQ ID NO: 653565 - RNA, 19 nt, Homo sapiens
gaaaccaauuuacaagaag

SEQ ID NO: 653566 - RNA, 19 nt, Homo sapiens
cgagaaguauguaccaaau

SEQ ID NO: 653567 - RNA, 19 nt, Homo sapiens
gacuguauaugguuuguga

SEQ ID NO: 653568 - RNA, 19 nt, Homo sapiens
gaacgugagcguggaguaa

SEQ ID NO: 653569 - RNA, 19 nt, Homo sapiens
uguguuggcuucgugauua

SEQ ID NO: 653570 - RNA, 19 nt, Homo sapiens
gaauggaugcgacucugua

SEQ ID NO: 653571 - RNA, 19 nt, Homo sapiens
caauggaacagcacacuuu

SEQ ID NO: 653572 - RNA, 19 nt, Homo sapiens
aaacagauacgcaguaaca

SEQ ID NO: 653573 - RNA, 19 nt, Homo sapiens
uuaaacagauacgcaguaa

SEQ ID NO: 653574 - RNA, 19 nt, Homo sapiens
gagaaguauguaccaaaua

SEQ ID NO: 653575 - RNA, 19 nt, Homo sapiens
aagaagagaucccaguuag

SEQ ID NO: 653576 - RNA, 19 nt, Homo sapiens
guuggaagcagcauacuuu

SEQ ID NO: 653577 - RNA, 19 nt, Homo sapiens
gcacgagccagaaaucuuc

SEQ ID NO: 653578 - RNA, 19 nt, Homo sapiens
ggaagugagauucguguga

SEQ ID NO: 653579 - RNA, 19 nt, Homo sapiens
ggagguguuucccaugaug

SEQ ID NO: 653580 - RNA, 19 nt, Homo sapiens
gccauagcuuucagucuuu

SEQ ID NO: 653581 - RNA, 19 nt, Homo sapiens
uuagagagaugcaggaagu

SEQ ID NO: 653582 - RNA, 19 nt, Homo sapiens
gccaaagcauucucuaaag

SEQ ID NO: 653583 - RNA, 19 nt, Homo sapiens
caacugggaucgcucuuuu

SEQ ID NO: 653584 - RNA, 19 nt, Homo sapiens
uauaauaggaguccagcua

SEQ ID NO: 653585 - RNA, 19 nt, Homo sapiens
ugccauagcuuucagucuu

SEQ ID NO: 653586 - RNA, 19 nt, Homo sapiens
ggaaguagauacgaaaaug

SEQ ID NO: 653587 - RNA, 19 nt, Homo sapiens
gauugaugcuggaaguaga

SEQ ID NO: 653588 - RNA, 19 nt, Homo sapiens
guauuaauggucagucuuu

SEQ ID NO: 653589 - RNA, 19 nt, Homo sapiens
caacuccaauuugugaaga

SEQ ID NO: 653590 - RNA, 19 nt, Homo sapiens
ggaggaaugaauuuaucua

SEQ ID NO: 653591 - RNA, 19 nt, Homo sapiens
guucaacuccaauuuguga

SEQ ID NO: 653592 - RNA, 19 nt, Homo sapiens
cagcgagagucuucuaauc

SEQ ID NO: 653593 - RNA, 19 nt, Homo sapiens
gaauugaugcugugaaugc

SEQ ID NO: 653594 - RNA, 19 nt, Homo sapiens
agagcagacuguauacuau

SEQ ID NO: 653595 - RNA, 19 nt, Homo sapiens
guuggacucuggauugaug

SEQ ID NO: 653596 - RNA, 19 nt, Homo sapiens
ucugagaaauuauguugga

SEQ ID NO: 653597 - RNA, 19 nt, Homo sapiens
gaacagauuaagaaguaca

SEQ ID NO: 653598 - RNA, 19 nt, Homo sapiens
aagaauugaugcugugaau

SEQ ID NO: 653599 - RNA, 19 nt, Homo sapiens
uacaaucugucucaugguu

SEQ ID NO: 653600 - RNA, 19 nt, Homo sapiens
gauauugguaggcaaaugu

SEQ ID NO: 653601 - RNA, 19 nt, Homo sapiens
gggaugacaagaugccuuu

SEQ ID NO: 653602 - RNA, 19 nt, Homo sapiens
gagagaugcaggaaguuga

SEQ ID NO: 653603 - RNA, 19 nt, Homo sapiens
acucugggcucucaacaug

SEQ ID NO: 653604 - RNA, 19 nt, Homo sapiens
gauacgcaguaacaugugu

SEQ ID NO: 653605 - RNA, 19 nt, Homo sapiens
ggacggucauuauauuuug

SEQ ID NO: 653606 - RNA, 19 nt, Homo sapiens
gaaguugaaaccaauuuac

SEQ ID NO: 653607 - RNA, 19 nt, Homo sapiens
gggagaagcagagauugaa

SEQ ID NO: 653608 - RNA, 19 nt, Homo sapiens
ugugagggaugacaagaug

SEQ ID NO: 653609 - RNA, 19 nt, Homo sapiens
gcaacuaccagauuuuaaa

SEQ ID NO: 653610 - RNA, 19 nt, Homo sapiens
gggcacauccagauacaau

SEQ ID NO: 653611 - RNA, 19 nt, Homo sapiens
gagcagacuguauacuaug

SEQ ID NO: 653612 - RNA, 19 nt, Homo sapiens
cagauacgcaguaacaugu

SEQ ID NO: 653613 - RNA, 19 nt, Homo sapiens
gaugguucaacuccaauuu

SEQ ID NO: 653614 - RNA, 19 nt, Homo sapiens
gcaacugggaucgcucuuu

SEQ ID NO: 653615 - RNA, 19 nt, Homo sapiens
ugaugaauugcuugacuua

SEQ ID NO: 653616 - RNA, 19 nt, Homo sapiens
uaugggugcucaucucaau

SEQ ID NO: 653617 - RNA, 19 nt, Homo sapiens
ccaagaagagaucccaguu

SEQ ID NO: 653618 - RNA, 19 nt, Homo sapiens
ugugaaugcugagacaauu

SEQ ID NO: 653619 - RNA, 19 nt, Homo sapiens
uuucaacacuuccuacaca

SEQ ID NO: 653620 - RNA, 19 nt, Homo sapiens
uuuagaaaguggacucaga

SEQ ID NO: 653621 - RNA, 19 nt, Homo sapiens
ugccaaagcauucucuaaa

SEQ ID NO: 653622 - RNA, 19 nt, Homo sapiens
gaggaaugaauuuaucuag

SEQ ID NO: 653623 - RNA, 19 nt, Homo sapiens
gcucucaacaugcacaguu

SEQ ID NO: 653624 - RNA, 19 nt, Homo sapiens
ccaaguuguucugaauguu

SEQ ID NO: 653625 - RNA, 19 nt, Homo sapiens
caacacuuccuacacagau

SEQ ID NO: 653626 - RNA, 19 nt, Homo sapiens
ugaaacaagaguaacaugu

SEQ ID NO: 653627 - RNA, 19 nt, Homo sapiens
caaguuguucugaauguuc

SEQ ID NO: 653628 - RNA, 19 nt, Homo sapiens
uggcccagcucacuuguca

SEQ ID NO: 653629 - RNA, 19 nt, Homo sapiens
guggaguaauccuuagaga

SEQ ID NO: 653630 - RNA, 19 nt, Homo sapiens
uaaaacagagcuagagaaa

SEQ ID NO: 653631 - RNA, 19 nt, Homo sapiens
acacaaaggagaaauacca

SEQ ID NO: 653632 - RNA, 19 nt, Homo sapiens
caugaugaauugcuugacu

SEQ ID NO: 653633 - RNA, 19 nt, Homo sapiens
guaacauguuuagaaagug

SEQ ID NO: 653634 - RNA, 19 nt, Homo sapiens
gcucaucucaaugccuaua

SEQ ID NO: 653635 - RNA, 19 nt, Homo sapiens
cuacccaaguuguucugaa

SEQ ID NO: 653636 - RNA, 19 nt, Homo sapiens
ggaaagaacgggaaaguga

SEQ ID NO: 653637 - RNA, 19 nt, Homo sapiens
gcaccaaacugcuacuuau

SEQ ID NO: 653638 - RNA, 19 nt, Homo sapiens
gggaugaaguggagguuua

SEQ ID NO: 653639 - RNA, 19 nt, Homo sapiens
gaagggagauuucuauguc

SEQ ID NO: 653640 - RNA, 19 nt, Homo sapiens
gcaaagugauuggaaagaa

SEQ ID NO: 653641 - RNA, 19 nt, Homo sapiens
gcacuaaacccucagaaga

SEQ ID NO: 653642 - RNA, 19 nt, Homo sapiens
gaagagaccugcacuuucc

SEQ ID NO: 653643 - RNA, 19 nt, Homo sapiens
ugagaaggcguauuuauuu

SEQ ID NO: 653644 - RNA, 19 nt, Homo sapiens
ggaaagugauccaggagau

SEQ ID NO: 653645 - RNA, 19 nt, Homo sapiens
gaagccugcuccaaugaaa

SEQ ID NO: 653646 - RNA, 19 nt, Homo sapiens
ugaaggauguccaugaaga

SEQ ID NO: 653647 - RNA, 19 nt, Homo sapiens
agaauggccuggaagauga

SEQ ID NO: 653648 - RNA, 19 nt, Homo sapiens
gagagaagccugcuccaau

SEQ ID NO: 653649 - RNA, 19 nt, Homo sapiens
ggagauuucuaugucauug

SEQ ID NO: 653650 - RNA, 19 nt, Homo sapiens
ugaaggauccagacaguaa

SEQ ID NO: 653651 - RNA, 19 nt, Homo sapiens
cgacaaggcuggauauagc

SEQ ID NO: 653652 - RNA, 19 nt, Homo sapiens
cuacuuaugucccgcaaug

SEQ ID NO: 653653 - RNA, 19 nt, Homo sapiens
acagugagcucuucauucu

SEQ ID NO: 653654 - RNA, 19 nt, Homo sapiens
gaagcuaccuugaguuuuc

SEQ ID NO: 653655 - RNA, 19 nt, Homo sapiens
ggagccaacugcaucuuuc

SEQ ID NO: 653656 - RNA, 19 nt, Homo sapiens
ccauaaagaguucaagaaa

SEQ ID NO: 653657 - RNA, 19 nt, Homo sapiens
gaugccaccuacaaugaaa

SEQ ID NO: 653658 - RNA, 19 nt, Homo sapiens
ccuggaagaugaaucaaga

SEQ ID NO: 653659 - RNA, 19 nt, Homo sapiens
gagaauggccuggaagaug

SEQ ID NO: 653660 - RNA, 19 nt, Homo sapiens
ggauauagcacugaugaga

SEQ ID NO: 653661 - RNA, 19 nt, Homo sapiens
cauaaagaguucaagaaag

SEQ ID NO: 653662 - RNA, 19 nt, Homo sapiens
gaugagaaggcguauuuau

SEQ ID NO: 653663 - RNA, 19 nt, Homo sapiens
uggagaggcuacaaauuga

SEQ ID NO: 653664 - RNA, 19 nt, Homo sapiens
ggaaggugauaaugacaag

SEQ ID NO: 653665 - RNA, 19 nt, Homo sapiens
agagaagccugcuccaaug

SEQ ID NO: 653666 - RNA, 19 nt, Homo sapiens
gagcgacuucggccaguua

SEQ ID NO: 653667 - RNA, 19 nt, Homo sapiens
gaugaagggagauuucuau

SEQ ID NO: 653668 - RNA, 19 nt, Homo sapiens
gagaaggcguauuuauuuu

SEQ ID NO: 653669 - RNA, 19 nt, Homo sapiens
ggcagcuucuucaagguua

SEQ ID NO: 653670 - RNA, 19 nt, Homo sapiens
gacagagaauggccuggaa

SEQ ID NO: 653671 - RNA, 19 nt, Homo sapiens
gcugaaggauccagacagu

SEQ ID NO: 653672 - RNA, 19 nt, Homo sapiens
cgagagaacaucagcaaug

SEQ ID NO: 653673 - RNA, 19 nt, Homo sapiens
gugaagagaccugcacuuu

SEQ ID NO: 653674 - RNA, 19 nt, Homo sapiens
cagacuggaugugccuuua

SEQ ID NO: 653675 - RNA, 19 nt, Homo sapiens
ggugaggguucgaguggaa

SEQ ID NO: 653676 - RNA, 19 nt, Homo sapiens
gaaagaacgggaaagugau

SEQ ID NO: 653677 - RNA, 19 nt, Homo sapiens
gagagaacaucagcaaugc

SEQ ID NO: 653678 - RNA, 19 nt, Homo sapiens
gcccgaagcuaccuugagu

SEQ ID NO: 653679 - RNA, 19 nt, Homo sapiens
aaacguccauaaagaguuc

SEQ ID NO: 653680 - RNA, 19 nt, Homo sapiens
gucaccaucuucuuugaaa

SEQ ID NO: 653681 - RNA, 19 nt, Homo sapiens
gaaagugauccaggagauu

SEQ ID NO: 653682 - RNA, 19 nt, Homo sapiens
gcagagugagagacaaauu

SEQ ID NO: 653683 - RNA, 19 nt, Homo sapiens
gacuguggcugacuauauc

SEQ ID NO: 653684 - RNA, 19 nt, Homo sapiens
ucagaugugucuacagcuu

SEQ ID NO: 653685 - RNA, 19 nt, Homo sapiens
uggaugagaaggcguauuu

SEQ ID NO: 653686 - RNA, 19 nt, Homo sapiens
gaugugccuuuauccucua

SEQ ID NO: 653687 - RNA, 19 nt, Homo sapiens
ucagaugggcccaacauga

SEQ ID NO: 653688 - RNA, 19 nt, Homo sapiens
caaagugauuggaaagaac

SEQ ID NO: 653689 - RNA, 19 nt, Homo sapiens
ccaagcaccuagagacaag

SEQ ID NO: 653690 - RNA, 19 nt, Homo sapiens
gagaagccugcuccaauga

SEQ ID NO: 653691 - RNA, 19 nt, Homo sapiens
ugugaaggauguccaugaa

SEQ ID NO: 653692 - RNA, 19 nt, Homo sapiens
gaguggaaggugauaauga

SEQ ID NO: 653693 - RNA, 19 nt, Homo sapiens
ugaauaugcugccugugau

SEQ ID NO: 653694 - RNA, 19 nt, Homo sapiens
aaccuugucugguggauga

SEQ ID NO: 653695 - RNA, 19 nt, Homo sapiens
gagcagcuucggcagauug

SEQ ID NO: 653696 - RNA, 19 nt, Homo sapiens
auaaagaguucaagaaagc

SEQ ID NO: 653697 - RNA, 19 nt, Homo sapiens
ggauguccaugaagacucu

SEQ ID NO: 653698 - RNA, 19 nt, Homo sapiens
ggcccaacaugacagagaa

SEQ ID NO: 653699 - RNA, 19 nt, Homo sapiens
ccaaacugcuacuuauguc

SEQ ID NO: 653700 - RNA, 19 nt, Homo sapiens
aaacagugagcucuucauu

SEQ ID NO: 653701 - RNA, 19 nt, Homo sapiens
gugauaaugacaagaagaa

SEQ ID NO: 653702 - RNA, 19 nt, Homo sapiens
ccgaagcuaccuugaguuu

SEQ ID NO: 653703 - RNA, 19 nt, Homo sapiens
gcaaugaagaagcuaccaa

SEQ ID NO: 653704 - RNA, 19 nt, Homo sapiens
cccaaucucucucugaaca

SEQ ID NO: 653705 - RNA, 19 nt, Homo sapiens
ugacuguggcugacuauau

SEQ ID NO: 653706 - RNA, 19 nt, Homo sapiens
ggaugagaaggcguauuua

SEQ ID NO: 653707 - RNA, 19 nt, Homo sapiens
ggauggaggccuggaauca

SEQ ID NO: 653708 - RNA, 19 nt, Homo sapiens
aggcuuugcuggaguauca

SEQ ID NO: 653709 - RNA, 19 nt, Homo sapiens
cgagauacaauucuucauc

SEQ ID NO: 653710 - RNA, 19 nt, Homo sapiens
ccacuucgagauacaauuc

SEQ ID NO: 653711 - RNA, 19 nt, Homo sapiens
gcacuuuccgcaucuaugg

SEQ ID NO: 653712 - RNA, 19 nt, Homo sapiens
gugaugccaccuacaauga

SEQ ID NO: 653713 - RNA, 19 nt, Homo sapiens
uuggagaggcuacaaauug

SEQ ID NO: 653714 - RNA, 19 nt, Homo sapiens
uagagcagcuucgcuugga

SEQ ID NO: 653715 - RNA, 19 nt, Homo sapiens
agugagcucuucauucugu

SEQ ID NO: 653716 - RNA, 19 nt, Homo sapiens
ccaacugcaucuuucucaa

SEQ ID NO: 653717 - RNA, 19 nt, Homo sapiens
gaugaugaagggagauuuc

SEQ ID NO: 653718 - RNA, 19 nt, Homo sapiens
gacuggaugugccuuuauc

SEQ ID NO: 653719 - RNA, 19 nt, Homo sapiens
gagaggcuacaaauugaug

SEQ ID NO: 653720 - RNA, 19 nt, Homo sapiens
ccauugaguugggugaaga

SEQ ID NO: 653721 - RNA, 19 nt, Homo sapiens
ggugaccgccauugaguug

SEQ ID NO: 653722 - RNA, 19 nt, Homo sapiens
caaaggcagcuucuucaag

SEQ ID NO: 653723 - RNA, 19 nt, Homo sapiens
aguaaucccuacagccuau

SEQ ID NO: 653724 - RNA, 19 nt, Homo sapiens
gaaggauccagacaguaau

SEQ ID NO: 653725 - RNA, 19 nt, Homo sapiens
ccaggagauuguggauaaa

SEQ ID NO: 653726 - RNA, 19 nt, Homo sapiens
ugaagagaccugcacuuuc

SEQ ID NO: 653727 - RNA, 19 nt, Homo sapiens
gggagccaacugcaucuuu

SEQ ID NO: 653728 - RNA, 19 nt, Homo sapiens
ccaugcgacucgaaccuau

SEQ ID NO: 653729 - RNA, 19 nt, Homo sapiens
acaaauugaugagcagcuu

SEQ ID NO: 653730 - RNA, 19 nt, Homo sapiens
auaauaaggagaucacaga

SEQ ID NO: 653731 - RNA, 19 nt, Homo sapiens
caucucugcugggugauau

SEQ ID NO: 653732 - RNA, 19 nt, Homo sapiens
gcccgaggaucugagagaa

SEQ ID NO: 653733 - RNA, 19 nt, Homo sapiens
gaauaugcugccugugaug

SEQ ID NO: 653734 - RNA, 19 nt, Homo sapiens
gaaccagggguguguauga

SEQ ID NO: 653735 - RNA, 19 nt, Homo sapiens
ccagcugacuauaauaagg

SEQ ID NO: 653736 - RNA, 19 nt, Homo sapiens
ggaauuugauguuguguuu

SEQ ID NO: 653737 - RNA, 19 nt, Homo sapiens
uaaccgagaucaguauuua

SEQ ID NO: 653738 - RNA, 19 nt, Homo sapiens
guaaaggaauuugauguug

SEQ ID NO: 653739 - RNA, 19 nt, Homo sapiens
gcgacaagcugaccgaguu

SEQ ID NO: 653740 - RNA, 19 nt, Homo sapiens
cgagaucaguauuuaacua

SEQ ID NO: 653741 - RNA, 19 nt, Homo sapiens
gaaguucauucgcgauuuc

SEQ ID NO: 653742 - RNA, 19 nt, Homo sapiens
ggaaguucauucgcgauuu

SEQ ID NO: 653743 - RNA, 19 nt, Homo sapiens
ucaccaagcucuggaaguu

SEQ ID NO: 653744 - RNA, 19 nt, Homo sapiens
gaacucaggcucaagcaau

SEQ ID NO: 653745 - RNA, 19 nt, Homo sapiens
ccucagaaguaaaggaauu

SEQ ID NO: 653746 - RNA, 19 nt, Homo sapiens
gcuacaaccucaagaagag

SEQ ID NO: 653747 - RNA, 19 nt, Homo sapiens
gaaaccugcucuucuucga

SEQ ID NO: 653748 - RNA, 19 nt, Homo sapiens
gaaguaaaggaauuugaug

SEQ ID NO: 653749 - RNA, 19 nt, Homo sapiens
gaacacagagagggccuaa

SEQ ID NO: 653750 - RNA, 19 nt, Homo sapiens
ugaccgaguuccugcaaga

SEQ ID NO: 653751 - RNA, 19 nt, Homo sapiens
aaaggaauuugauguugug

SEQ ID NO: 653752 - RNA, 19 nt, Homo sapiens
gagagggccuaaccgagau

SEQ ID NO: 653753 - RNA, 19 nt, Homo sapiens
ggggagaccucagaaguaa

SEQ ID NO: 653754 - RNA, 19 nt, Homo sapiens
ccaaguaacuaggacuaca

SEQ ID NO: 653755 - RNA, 19 nt, Homo sapiens
ggagaccucagaaguaaag

SEQ ID NO: 653756 - RNA, 19 nt, Homo sapiens
gaccaacgccaucuucauc

SEQ ID NO: 653757 - RNA, 19 nt, Homo sapiens
cgccucagccuuccaagua

SEQ ID NO: 653758 - RNA, 19 nt, Homo sapiens
uggaggacgugcucuacuu

SEQ ID NO: 653759 - RNA, 19 nt, Homo sapiens
gccucagccuuccaaguaa

SEQ ID NO: 653760 - RNA, 19 nt, Homo sapiens
gaccucagaaguaaaggaa

SEQ ID NO: 653761 - RNA, 19 nt, Homo sapiens
gaccugggcuaugacaaca

SEQ ID NO: 653762 - RNA, 19 nt, Homo sapiens
ggccuaaccgagaucagua

SEQ ID NO: 653763 - RNA, 19 nt, Homo sapiens
uccgaaaccugcucuucuu

SEQ ID NO: 653764 - RNA, 19 nt, Homo sapiens
gcuucaacaucaucugcaa

SEQ ID NO: 653765 - RNA, 19 nt, Homo sapiens
gcgcgcucuucacuaguuu

SEQ ID NO: 653766 - RNA, 19 nt, Homo sapiens
cagaaguaaaggaauuuga

SEQ ID NO: 653767 - RNA, 19 nt, Homo sapiens
ggacgugcucuacuucaag

SEQ ID NO: 653768 - RNA, 19 nt, Homo sapiens
ggaggacgugcucuacuuc

SEQ ID NO: 653769 - RNA, 19 nt, Homo sapiens
caaguucgccuucccuaac

SEQ ID NO: 653770 - RNA, 19 nt, Homo sapiens
agaagcaccggcucaaguu

SEQ ID NO: 653771 - RNA, 19 nt, Homo sapiens
cagaagcaccggcucaagu

SEQ ID NO: 653772 - RNA, 19 nt, Homo sapiens
ccacaugcgcuuccacuac

SEQ ID NO: 653773 - RNA, 19 nt, Homo sapiens
gaagcaccggcucaaguuc

SEQ ID NO: 653774 - RNA, 19 nt, Homo sapiens
accaagcucuggaaguuca

SEQ ID NO: 653775 - RNA, 19 nt, Homo sapiens
cgagauccaguaccugaug

SEQ ID NO: 653776 - RNA, 19 nt, Homo sapiens
ggcuacaaccucaagaaga

SEQ ID NO: 653777 - RNA, 19 nt, Homo sapiens
ucaaguucgccuucccuaa

SEQ ID NO: 653778 - RNA, 19 nt, Homo sapiens
ggaacucaggcucaagcaa

SEQ ID NO: 653779 - RNA, 19 nt, Homo sapiens
caucaucugcaaccacaug

SEQ ID NO: 653780 - RNA, 19 nt, Homo sapiens
gccaagacugggcccauga

SEQ ID NO: 653781 - RNA, 19 nt, Homo sapiens
cgacuacccgaccuucuuc

SEQ ID NO: 653782 - RNA, 19 nt, Homo sapiens
ccaagacugggcccaugaa

SEQ ID NO: 653783 - RNA, 19 nt, Homo sapiens
ccugggaguccauggcuaa

SEQ ID NO: 653784 - RNA, 19 nt, Homo sapiens
cuaaccgagaucaguauuu

SEQ ID NO: 653785 - RNA, 19 nt, Homo sapiens
cggcuucaaugcccacuac

SEQ ID NO: 653786 - RNA, 19 nt, Homo sapiens
gcucaggcaguggguagaa

SEQ ID NO: 653787 - RNA, 19 nt, Homo sapiens
gggcuacaaccucaagaag

SEQ ID NO: 653788 - RNA, 19 nt, Homo sapiens
gagcgcaugcggaccaucu

SEQ ID NO: 653789 - RNA, 19 nt, Homo sapiens
gaggacgugcucuacuuca

SEQ ID NO: 653790 - RNA, 19 nt, Homo sapiens
ucuucgaccugggcuauga

SEQ ID NO: 653791 - RNA, 19 nt, Homo sapiens
gcacccugcucaacauccu

SEQ ID NO: 653792 - RNA, 19 nt, Homo sapiens
gcacacagauucacuuuaa

SEQ ID NO: 653793 - RNA, 19 nt, Homo sapiens
ugacaaagaucuugccuua

SEQ ID NO: 653794 - RNA, 19 nt, Homo sapiens
ugagucagcuguccuauaa

SEQ ID NO: 653795 - RNA, 19 nt, Homo sapiens
acaaagaucuugccuuaca

SEQ ID NO: 653796 - RNA, 19 nt, Homo sapiens
gaucuugccuuacagacuu

SEQ ID NO: 653797 - RNA, 19 nt, Homo sapiens
ugaauccuccuucguauua

SEQ ID NO: 653798 - RNA, 19 nt, Homo sapiens
gcaugaauccuccuucgua

SEQ ID NO: 653799 - RNA, 19 nt, Homo sapiens
aaauagggcuggaucuuau

SEQ ID NO: 653800 - RNA, 19 nt, Homo sapiens
ggaccgcccuauccaaaug

SEQ ID NO: 653801 - RNA, 19 nt, Homo sapiens
aaacagagauggggucuua

SEQ ID NO: 653802 - RNA, 19 nt, Homo sapiens
guacagacauauccacaag

SEQ ID NO: 653803 - RNA, 19 nt, Homo sapiens
ucaagaggaggauuuauaa

SEQ ID NO: 653804 - RNA, 19 nt, Homo sapiens
gcaaagacauuccccuuga

SEQ ID NO: 653805 - RNA, 19 nt, Homo sapiens
cccaauaacaauccaauua

SEQ ID NO: 653806 - RNA, 19 nt, Homo sapiens
ccaauguagucucacuuaa

SEQ ID NO: 653807 - RNA, 19 nt, Homo sapiens
gcauaggacuugcaaagac

SEQ ID NO: 653808 - RNA, 19 nt, Homo sapiens
ggacguggaccauuacugu

SEQ ID NO: 653809 - RNA, 19 nt, Homo sapiens
guaaaugcaugcuagaaaa

SEQ ID NO: 653810 - RNA, 19 nt, Homo sapiens
ccgaauaucuuccugugau

SEQ ID NO: 653811 - RNA, 19 nt, Homo sapiens
caauguagucucacuuaaa

SEQ ID NO: 653812 - RNA, 19 nt, Homo sapiens
ucauugcccuauccgaaua

SEQ ID NO: 653813 - RNA, 19 nt, Homo sapiens
ugcaggacguggaccauua

SEQ ID NO: 653814 - RNA, 19 nt, Homo sapiens
gccaauguagucucacuua

SEQ ID NO: 653815 - RNA, 19 nt, Homo sapiens
ccaccuucaugucuucuuu

SEQ ID NO: 653816 - RNA, 19 nt, Homo sapiens
ccugaguccugccaucuaa

SEQ ID NO: 653817 - RNA, 19 nt, Homo sapiens
gcaccuccauccuaugaag

SEQ ID NO: 653818 - RNA, 19 nt, Homo sapiens
gcuuugagauucuguaacu

SEQ ID NO: 653819 - RNA, 19 nt, Homo sapiens
ccaucuaacugugaucauu

SEQ ID NO: 653820 - RNA, 19 nt, Homo sapiens
agccacaguugccuuauuu

SEQ ID NO: 653821 - RNA, 19 nt, Homo sapiens
caugaauccuccuucguau

SEQ ID NO: 653822 - RNA, 19 nt, Homo sapiens
guaacugcagacuucauua

SEQ ID NO: 653823 - RNA, 19 nt, Homo sapiens
caagaggaggauuuauaaa

SEQ ID NO: 653824 - RNA, 19 nt, Homo sapiens
cauaggacuugcaaagaca

SEQ ID NO: 653825 - RNA, 19 nt, Homo sapiens
acaagaugaucgugaguca

SEQ ID NO: 653826 - RNA, 19 nt, Homo sapiens
cguaaaugcaugcuagaaa

SEQ ID NO: 653827 - RNA, 19 nt, Homo sapiens
gaccauuacugucccaacu

SEQ ID NO: 653828 - RNA, 19 nt, Homo sapiens
aauccuccuucguauuaua

SEQ ID NO: 653829 - RNA, 19 nt, Homo sapiens
gauggggucuuacuauguu

SEQ ID NO: 653830 - RNA, 19 nt, Homo sapiens
acagacauauccacaaggu

SEQ ID NO: 653831 - RNA, 19 nt, Homo sapiens
ucccgucccugaugacaaa

SEQ ID NO: 653832 - RNA, 19 nt, Homo sapiens
ccaauaacaauccaauuac

SEQ ID NO: 653833 - RNA, 19 nt, Homo sapiens
uucaagaggaggauuuaua

SEQ ID NO: 653834 - RNA, 19 nt, Homo sapiens
gcuauuaacacccaguaca

SEQ ID NO: 653835 - RNA, 19 nt, Homo sapiens
agaagccacaguugccuua

SEQ ID NO: 653836 - RNA, 19 nt, Homo sapiens
gggcccaccuucaugucuu

SEQ ID NO: 653837 - RNA, 19 nt, Homo sapiens
gaauccuccuucguauuau

SEQ ID NO: 653838 - RNA, 19 nt, Homo sapiens
gagauggggucuuacuaug

SEQ ID NO: 653839 - RNA, 19 nt, Homo sapiens
caucuaacugugaucauug

SEQ ID NO: 653840 - RNA, 19 nt, Homo sapiens
gugagucagcuguccuaua

SEQ ID NO: 653841 - RNA, 19 nt, Homo sapiens
ggucugaaauacuuuugaa

SEQ ID NO: 653842 - RNA, 19 nt, Homo sapiens
uaacugcagacuucauuag

SEQ ID NO: 653843 - RNA, 19 nt, Homo sapiens
aggcuuggcuuugagauuc

SEQ ID NO: 653844 - RNA, 19 nt, Homo sapiens
aagccacaguugccuuauu

SEQ ID NO: 653845 - RNA, 19 nt, Homo sapiens
cgaauaucuuccugugauc

SEQ ID NO: 653846 - RNA, 19 nt, Homo sapiens
gagcucuccugggcaccua

SEQ ID NO: 653847 - RNA, 19 nt, Homo sapiens
ggauugcaggcauaagcua

SEQ ID NO: 653848 - RNA, 19 nt, Homo sapiens
ccacaaggucguaaaugca

SEQ ID NO: 653849 - RNA, 19 nt, Homo sapiens
caauaacaauccaauuacc

SEQ ID NO: 653850 - RNA, 19 nt, Homo sapiens
augcugggccugaacauaa

SEQ ID NO: 653851 - RNA, 19 nt, Homo sapiens
uagcacacagauucacuuu

SEQ ID NO: 653852 - RNA, 19 nt, Homo sapiens
caaagaucuugccuuacag

SEQ ID NO: 653853 - RNA, 19 nt, Homo sapiens
gagcgcagggguccucuua

SEQ ID NO: 653854 - RNA, 19 nt, Homo sapiens
ccuuuagugccuaccauua

SEQ ID NO: 653855 - RNA, 19 nt, Homo sapiens
aaaauagggcuggaucuua

SEQ ID NO: 653856 - RNA, 19 nt, Homo sapiens
gugccuaccauuaucuuau

SEQ ID NO: 653857 - RNA, 19 nt, Homo sapiens
ccgcaccuccauccuauga

SEQ ID NO: 653858 - RNA, 19 nt, Homo sapiens
gaugggaagggcaugaauc

SEQ ID NO: 653859 - RNA, 19 nt, Homo sapiens
uuuacaggcuuggcuuuga

SEQ ID NO: 653860 - RNA, 19 nt, Homo sapiens
cauccgcaccuccauccua

SEQ ID NO: 653861 - RNA, 19 nt, Homo sapiens
gggcuauuaacacccagua

SEQ ID NO: 653862 - RNA, 19 nt, Homo sapiens
agugucaguuccacgguuu

SEQ ID NO: 653863 - RNA, 19 nt, Homo sapiens
ucgcaaaacuaacaaaucu

SEQ ID NO: 653864 - RNA, 19 nt, Homo sapiens
aaagaucuugccuuacaga

SEQ ID NO: 653865 - RNA, 19 nt, Homo sapiens
caaauguguuguccuuccu

SEQ ID NO: 653866 - RNA, 19 nt, Homo sapiens
gaucuucagugccccuuuc

SEQ ID NO: 653867 - RNA, 19 nt, Homo sapiens
cacacagauucacuuuaau

SEQ ID NO: 653868 - RNA, 19 nt, Homo sapiens
uguaacugcagacuucauu

SEQ ID NO: 653869 - RNA, 19 nt, Homo sapiens
gaauaucuuccugugaucu

SEQ ID NO: 653870 - RNA, 19 nt, Homo sapiens
uguccuuccugcaacaaga

SEQ ID NO: 653871 - RNA, 19 nt, Homo sapiens
auccaaauguguuguccuu

SEQ ID NO: 653872 - RNA, 19 nt, Homo sapiens
ucuuaucacugcccugucu

SEQ ID NO: 653873 - RNA, 19 nt, Homo sapiens
uccacaaggucguaaaugc

SEQ ID NO: 653874 - RNA, 19 nt, Homo sapiens
uuacaggcuuggcuuugag

SEQ ID NO: 653875 - RNA, 19 nt, Homo sapiens
cagcgcccauccccaauaa

SEQ ID NO: 653876 - RNA, 19 nt, Homo sapiens
auagcgggcugcugcuuca

SEQ ID NO: 653877 - RNA, 19 nt, Homo sapiens
gcacugcaguuacuauuua

SEQ ID NO: 653878 - RNA, 19 nt, Homo sapiens
gcaaugaacuuaccugcua

SEQ ID NO: 653879 - RNA, 19 nt, Homo sapiens
gcaaggauuuguaggguua

SEQ ID NO: 653880 - RNA, 19 nt, Homo sapiens
gaagaaagaaugugaguaa

SEQ ID NO: 653881 - RNA, 19 nt, Homo sapiens
ggacaagcaugaagaacua

SEQ ID NO: 653882 - RNA, 19 nt, Homo sapiens
gaacuuaccugcuagucuu

SEQ ID NO: 653883 - RNA, 19 nt, Homo sapiens
gaacaugcuuccagugauu

SEQ ID NO: 653884 - RNA, 19 nt, Homo sapiens
gaacaucggugucguugug

SEQ ID NO: 653885 - RNA, 19 nt, Homo sapiens
gaaccaaaguuuaagugaa

SEQ ID NO: 653886 - RNA, 19 nt, Homo sapiens
acacuuugcuuccuucuua

SEQ ID NO: 653887 - RNA, 19 nt, Homo sapiens
ccaaugagcuuuaaucucu

SEQ ID NO: 653888 - RNA, 19 nt, Homo sapiens
agaaggagcugauagacua

SEQ ID NO: 653889 - RNA, 19 nt, Homo sapiens
gcauugcuguuaccuauuu

SEQ ID NO: 653890 - RNA, 19 nt, Homo sapiens
gcagccaucuuaauacauu

SEQ ID NO: 653891 - RNA, 19 nt, Homo sapiens
gcucacaccuguaauccua

SEQ ID NO: 653892 - RNA, 19 nt, Homo sapiens
uuaauaagcccuugagaua

SEQ ID NO: 653893 - RNA, 19 nt, Homo sapiens
gagaagcuauugaaagaug

SEQ ID NO: 653894 - RNA, 19 nt, Homo sapiens
uagagaagcuauugaaaga

SEQ ID NO: 653895 - RNA, 19 nt, Homo sapiens
cuacaacuaucuuggauuu

SEQ ID NO: 653896 - RNA, 19 nt, Homo sapiens
gaaagaaugugaguaacug

SEQ ID NO: 653897 - RNA, 19 nt, Homo sapiens
ggagagauuuccugauuuc

SEQ ID NO: 653898 - RNA, 19 nt, Homo sapiens
uaagggagccugcaucuaa

SEQ ID NO: 653899 - RNA, 19 nt, Homo sapiens
guaaugccuucuuccuuua

SEQ ID NO: 653900 - RNA, 19 nt, Homo sapiens
gaagaggacuuuuggcaua

SEQ ID NO: 653901 - RNA, 19 nt, Homo sapiens
ugaaagaugccauuguuua

SEQ ID NO: 653902 - RNA, 19 nt, Homo sapiens
aaaggaaacuguugguaaa

SEQ ID NO: 653903 - RNA, 19 nt, Homo sapiens
cagaugauuucuuccuuua

SEQ ID NO: 653904 - RNA, 19 nt, Homo sapiens
gaggauguaagcaauauua

SEQ ID NO: 653905 - RNA, 19 nt, Homo sapiens
gcauugcuaugaccuaauu

SEQ ID NO: 653906 - RNA, 19 nt, Homo sapiens
acauagaucucuuuccuaa

SEQ ID NO: 653907 - RNA, 19 nt, Homo sapiens
gaagcuaacccacuuaaau

SEQ ID NO: 653908 - RNA, 19 nt, Homo sapiens
uaaaucagcuuagcccaaa

SEQ ID NO: 653909 - RNA, 19 nt, Homo sapiens
gauuauaacugguccuuca

SEQ ID NO: 653910 - RNA, 19 nt, Homo sapiens
ucaaacagauaccgguuaa

SEQ ID NO: 653911 - RNA, 19 nt, Homo sapiens
gaaagcauuuaucauguuc

SEQ ID NO: 653912 - RNA, 19 nt, Homo sapiens
gaaagaugccauuguuuau

SEQ ID NO: 653913 - RNA, 19 nt, Homo sapiens
caagguaucuuuccucucu

SEQ ID NO: 653914 - RNA, 19 nt, Homo sapiens
gagaauaagucgauuugag

SEQ ID NO: 653915 - RNA, 19 nt, Homo sapiens
ggaccucuguacuuucuaa

SEQ ID NO: 653916 - RNA, 19 nt, Homo sapiens
agacaaaucuccugugauc

SEQ ID NO: 653917 - RNA, 19 nt, Homo sapiens
gaaaccucaucucuacuaa

SEQ ID NO: 653918 - RNA, 19 nt, Homo sapiens
cguaaugccuucuuccuuu

SEQ ID NO: 653919 - RNA, 19 nt, Homo sapiens
gagacuauauuuagcaugu

SEQ ID NO: 653920 - RNA, 19 nt, Homo sapiens
ggccagauccaucauguua

SEQ ID NO: 653921 - RNA, 19 nt, Homo sapiens
guacaacaguuagcugaaa

SEQ ID NO: 653922 - RNA, 19 nt, Homo sapiens
ucaagacucugauaggauu

SEQ ID NO: 653923 - RNA, 19 nt, Homo sapiens
gugcugggcuuugaagaua

SEQ ID NO: 653924 - RNA, 19 nt, Homo sapiens
uaaaggaaacuguugguaa

SEQ ID NO: 653925 - RNA, 19 nt, Homo sapiens
uaaaggagauagaugaagu

SEQ ID NO: 653926 - RNA, 19 nt, Homo sapiens
ggauguggauguuaugaug

SEQ ID NO: 653927 - RNA, 19 nt, Homo sapiens
gaccaaagaacaaaucuga

SEQ ID NO: 653928 - RNA, 19 nt, Homo sapiens
ggacagccagggcaagaua

SEQ ID NO: 653929 - RNA, 19 nt, Homo sapiens
ccacauucaugaagauuau

SEQ ID NO: 653930 - RNA, 19 nt, Homo sapiens
ccaaagaacaaaucugaaa

SEQ ID NO: 653931 - RNA, 19 nt, Homo sapiens
ccaaagaaauacuugauac

SEQ ID NO: 653932 - RNA, 19 nt, Homo sapiens
gacagucucaugauuauaa

SEQ ID NO: 653933 - RNA, 19 nt, Homo sapiens
caaggaaucuguacaugag

SEQ ID NO: 653934 - RNA, 19 nt, Homo sapiens
gcacaggaauugcuugaac

SEQ ID NO: 653935 - RNA, 19 nt, Homo sapiens
gagcuuuaaucucuacuug

SEQ ID NO: 653936 - RNA, 19 nt, Homo sapiens
gugaugacauuuaccacua

SEQ ID NO: 653937 - RNA, 19 nt, Homo sapiens
aaucuaggguccagucaua

SEQ ID NO: 653938 - RNA, 19 nt, Homo sapiens
gcauguauagguuaaagua

SEQ ID NO: 653939 - RNA, 19 nt, Homo sapiens
gcaaaacugugucucaaaa

SEQ ID NO: 653940 - RNA, 19 nt, Homo sapiens
cugaaaggcucauugugua

SEQ ID NO: 653941 - RNA, 19 nt, Homo sapiens
gcaagaaggagcugauaga

SEQ ID NO: 653942 - RNA, 19 nt, Homo sapiens
gaagaauccagccaucgua

SEQ ID NO: 653943 - RNA, 19 nt, Homo sapiens
cagaaagcauuuaucaugu

SEQ ID NO: 653944 - RNA, 19 nt, Homo sapiens
ucagaaagcauuuaucaug

SEQ ID NO: 653945 - RNA, 19 nt, Homo sapiens
ccagaugauuucuuccuuu

SEQ ID NO: 653946 - RNA, 19 nt, Homo sapiens
ugaagacucuccaguagug

SEQ ID NO: 653947 - RNA, 19 nt, Homo sapiens
cgagauuucuugagguauu

SEQ ID NO: 653948 - RNA, 19 nt, Homo sapiens
acacuuagccuuacauuuc

SEQ ID NO: 653949 - RNA, 19 nt, Homo sapiens
gauaggauucaaacagaua

SEQ ID NO: 653950 - RNA, 19 nt, Homo sapiens
uaacacagccugauucaag

SEQ ID NO: 653951 - RNA, 19 nt, Homo sapiens
ggagacgccugaaagagau

SEQ ID NO: 653952 - RNA, 19 nt, Homo sapiens
uaacugguccuucaaguau

SEQ ID NO: 653953 - RNA, 19 nt, Homo sapiens
gccaggaaaugcauagcua

SEQ ID NO: 653954 - RNA, 19 nt, Homo sapiens
caaauacauugucaaccuu

SEQ ID NO: 653955 - RNA, 19 nt, Homo sapiens
aagcuaacccacuuaaaua

SEQ ID NO: 653956 - RNA, 19 nt, Homo sapiens
gaaggccacucucacaucu

SEQ ID NO: 653957 - RNA, 19 nt, Homo sapiens
gaacguucacaaagaguuu

SEQ ID NO: 653958 - RNA, 19 nt, Homo sapiens
cgcaguggcucaccuguaa

SEQ ID NO: 653959 - RNA, 19 nt, Homo sapiens
acuaagggcucuauguuug

SEQ ID NO: 653960 - RNA, 19 nt, Homo sapiens
gaguaugaguuauguuuag

SEQ ID NO: 653961 - RNA, 19 nt, Homo sapiens
gaacaaaucugaaaaucac

SEQ ID NO: 653962 - RNA, 19 nt, Homo sapiens
ugaagaaacagaagacuga

SEQ ID NO: 653963 - RNA, 19 nt, Homo sapiens
ggagagaugcagagacuau

SEQ ID NO: 653964 - RNA, 19 nt, Homo sapiens
gcagaggauguaagcaaua

SEQ ID NO: 653965 - RNA, 19 nt, Homo sapiens
gcuagggucugccugucua

SEQ ID NO: 653966 - RNA, 19 nt, Homo sapiens
uaauuuaggccucuuagaa

SEQ ID NO: 653967 - RNA, 19 nt, Homo sapiens
gcucagaaagcauuuauca

SEQ ID NO: 653968 - RNA, 19 nt, Homo sapiens
gauaagagacaacuggaau

SEQ ID NO: 653969 - RNA, 19 nt, Homo sapiens
caugauagggcaaggauuu

SEQ ID NO: 653970 - RNA, 19 nt, Homo sapiens
caucuaguuuccuaccaua

SEQ ID NO: 653971 - RNA, 19 nt, Homo sapiens
aaacauggguuccuacaac

SEQ ID NO: 653972 - RNA, 19 nt, Homo sapiens
gagccugcaucuaaauuuc

SEQ ID NO: 653973 - RNA, 19 nt, Homo sapiens
uauccuagguaucaucauu

SEQ ID NO: 653974 - RNA, 19 nt, Homo sapiens
uaagaaggagguuguggua

SEQ ID NO: 653975 - RNA, 19 nt, Homo sapiens
uauugcagcugaaguauuc

SEQ ID NO: 653976 - RNA, 19 nt, Homo sapiens
gucagcagcucauaccaaa

SEQ ID NO: 653977 - RNA, 19 nt, Homo sapiens
gaccuaugaugacuuguua

SEQ ID NO: 653978 - RNA, 19 nt, Homo sapiens
aaagcugucugaacuguua

SEQ ID NO: 653979 - RNA, 19 nt, Homo sapiens
ugauggaacuguguauuua

SEQ ID NO: 653980 - RNA, 19 nt, Homo sapiens
aaauaaagcugucugaacu

SEQ ID NO: 653981 - RNA, 19 nt, Homo sapiens
caaagacugccacugcaua

SEQ ID NO: 653982 - RNA, 19 nt, Homo sapiens
ccagaccuaugaugacuug

SEQ ID NO: 653983 - RNA, 19 nt, Homo sapiens
gggugucgcuccagaccua

SEQ ID NO: 653984 - RNA, 19 nt, Homo sapiens
gaacucaggacggugaaug

SEQ ID NO: 653985 - RNA, 19 nt, Homo sapiens
gggcuggucugauggaacu

SEQ ID NO: 653986 - RNA, 19 nt, Homo sapiens
gauggaacuguguauuuau

SEQ ID NO: 653987 - RNA, 19 nt, Homo sapiens
agacugccacugcauauga

SEQ ID NO: 653988 - RNA, 19 nt, Homo sapiens
cugauggaacuguguauuu

SEQ ID NO: 653989 - RNA, 19 nt, Homo sapiens
gauacucacgccagaagug

SEQ ID NO: 653990 - RNA, 19 nt, Homo sapiens
ggucugauggaacugugua

SEQ ID NO: 653991 - RNA, 19 nt, Homo sapiens
auaaagcugucugaacugu

SEQ ID NO: 653992 - RNA, 19 nt, Homo sapiens
ggugaauggcucucagaug

SEQ ID NO: 653993 - RNA, 19 nt, Homo sapiens
ccacgggaggugcaaguga

SEQ ID NO: 653994 - RNA, 19 nt, Homo sapiens
aaagacugccacugcauau

SEQ ID NO: 653995 - RNA, 19 nt, Homo sapiens
ccauggugcucauucaaaa

SEQ ID NO: 653996 - RNA, 19 nt, Homo sapiens
caaacaugcacgcgcagau

SEQ ID NO: 653997 - RNA, 19 nt, Homo sapiens
agaccuaugaugacuuguu

SEQ ID NO: 653998 - RNA, 19 nt, Homo sapiens
gaggugcaagugaccaugu

SEQ ID NO: 653999 - RNA, 19 nt, Homo sapiens
gaacagauuuacccauuug

SEQ ID NO: 654000 - RNA, 19 nt, Homo sapiens
ggaaggagcaaauguaauu

SEQ ID NO: 654001 - RNA, 19 nt, Homo sapiens
gaagauugcuuuggaagga

SEQ ID NO: 654002 - RNA, 19 nt, Homo sapiens
gcauuggacauucuaauua

SEQ ID NO: 654003 - RNA, 19 nt, Homo sapiens
gacaugauauugcugcuuu

SEQ ID NO: 654004 - RNA, 19 nt, Homo sapiens
gcacuaccuuagauuguuu

SEQ ID NO: 654005 - RNA, 19 nt, Homo sapiens
ggaacagauuuacccauuu

SEQ ID NO: 654006 - RNA, 19 nt, Homo sapiens
caaagaaccuguaaaaguu

SEQ ID NO: 654007 - RNA, 19 nt, Homo sapiens
uaacagggcccaauguaaa

SEQ ID NO: 654008 - RNA, 19 nt, Homo sapiens
gaaauccguuugccagaau

SEQ ID NO: 654009 - RNA, 19 nt, Homo sapiens
uaaggaagauugcuuugga

SEQ ID NO: 654010 - RNA, 19 nt, Homo sapiens
gaagaagaagcuaaauuug

SEQ ID NO: 654011 - RNA, 19 nt, Homo sapiens
gaaagcaggaaagaaauuu

SEQ ID NO: 654012 - RNA, 19 nt, Homo sapiens
ccacuuaauugguuagaau

SEQ ID NO: 654013 - RNA, 19 nt, Homo sapiens
gaauaugggcaccaaagaa

SEQ ID NO: 654014 - RNA, 19 nt, Homo sapiens
agacagugauguugcauug

SEQ ID NO: 654015 - RNA, 19 nt, Homo sapiens
agagcuacauuacagauuu

SEQ ID NO: 654016 - RNA, 19 nt, Homo sapiens
agaagaagcuaaauuuggu

SEQ ID NO: 654017 - RNA, 19 nt, Homo sapiens
aaaggaaguuuacaagaca

SEQ ID NO: 654018 - RNA, 19 nt, Homo sapiens
uggaacagauuuacccauu

SEQ ID NO: 654019 - RNA, 19 nt, Homo sapiens
guaacagggcccaauguaa

SEQ ID NO: 654020 - RNA, 19 nt, Homo sapiens
ucaauugaaugugcacaaa

SEQ ID NO: 654021 - RNA, 19 nt, Homo sapiens
uccaaaccuugcuguaaua

SEQ ID NO: 654022 - RNA, 19 nt, Homo sapiens
gauuuacccauuuguguuu

SEQ ID NO: 654023 - RNA, 19 nt, Homo sapiens
ucuaagagcuacauuacag

SEQ ID NO: 654024 - RNA, 19 nt, Homo sapiens
ugaaauccguuugccagaa

SEQ ID NO: 654025 - RNA, 19 nt, Homo sapiens
uguguaacaugccauuuga

SEQ ID NO: 654026 - RNA, 19 nt, Homo sapiens
gagcaacaagugaagaaga

SEQ ID NO: 654027 - RNA, 19 nt, Homo sapiens
acaaauguagucuguguuu

SEQ ID NO: 654028 - RNA, 19 nt, Homo sapiens
aaaccuagaauuacagcua

SEQ ID NO: 654029 - RNA, 19 nt, Homo sapiens
uaacugagcaccuuuuaaa

SEQ ID NO: 654030 - RNA, 19 nt, Homo sapiens
cgucuagucuauuuauugu

SEQ ID NO: 654031 - RNA, 19 nt, Homo sapiens
ugccagaauucacaaagaa

SEQ ID NO: 654032 - RNA, 19 nt, Homo sapiens
gugaagaagaagcuaaauu

SEQ ID NO: 654033 - RNA, 19 nt, Homo sapiens
uugaggaaauagacucuuu

SEQ ID NO: 654034 - RNA, 19 nt, Homo sapiens
caagugaagaagaagcuaa

SEQ ID NO: 654035 - RNA, 19 nt, Homo sapiens
acagugauguugcauugga

SEQ ID NO: 654036 - RNA, 19 nt, Homo sapiens
ugaaagcaggaaagaaauu

SEQ ID NO: 654037 - RNA, 19 nt, Homo sapiens
uuauaaacgugauguugga

SEQ ID NO: 654038 - RNA, 19 nt, Homo sapiens
aacaggaaguaucacagua

SEQ ID NO: 654039 - RNA, 19 nt, Homo sapiens
gaaaacuggaccaacaaua

SEQ ID NO: 654040 - RNA, 19 nt, Homo sapiens
ccacggaugugaucuucgu

SEQ ID NO: 654041 - RNA, 19 nt, Homo sapiens
ccaaagaaccuguaaaagu

SEQ ID NO: 654042 - RNA, 19 nt, Homo sapiens
caaaccuugcuguaauaua

SEQ ID NO: 654043 - RNA, 19 nt, Homo sapiens
uuugaaagcaggaaagaaa

SEQ ID NO: 654044 - RNA, 19 nt, Homo sapiens
cccagcgucuagucuauuu

SEQ ID NO: 654045 - RNA, 19 nt, Homo sapiens
caacaggaaguaucacagu

SEQ ID NO: 654046 - RNA, 19 nt, Homo sapiens
aaacuggaccaacaauaau

SEQ ID NO: 654047 - RNA, 19 nt, Homo sapiens
ggaacaacaaagcaaggaa

SEQ ID NO: 654048 - RNA, 19 nt, Homo sapiens
acaggaaguaucacaguaa

SEQ ID NO: 654049 - RNA, 19 nt, Homo sapiens
gcaccaaagaaccuguaaa

SEQ ID NO: 654050 - RNA, 19 nt, Homo sapiens
gaggaaauagacucuuuua

SEQ ID NO: 654051 - RNA, 19 nt, Homo sapiens
uguaaaggcuguugcuacu

SEQ ID NO: 654052 - RNA, 19 nt, Homo sapiens
ggaaguaucacaguaacag

SEQ ID NO: 654053 - RNA, 19 nt, Homo sapiens
uguaacaugccauuugaaa

SEQ ID NO: 654054 - RNA, 19 nt, Homo sapiens
agcaacaagugaagaagaa

SEQ ID NO: 654055 - RNA, 19 nt, Homo sapiens
cauuggacauucuaauuac

SEQ ID NO: 654056 - RNA, 19 nt, Homo sapiens
uaaaccugcugcacauugg

SEQ ID NO: 654057 - RNA, 19 nt, Homo sapiens
gcgucuagucuauuuauug

SEQ ID NO: 654058 - RNA, 19 nt, Homo sapiens
caauggaugcagacaguga

SEQ ID NO: 654059 - RNA, 19 nt, Homo sapiens
uuccaaaccuugcuguaau

SEQ ID NO: 654060 - RNA, 19 nt, Homo sapiens
gaacuucauccugcugugu

SEQ ID NO: 654061 - RNA, 19 nt, Homo sapiens
gcugcacauuggacucaaa

SEQ ID NO: 654062 - RNA, 19 nt, Homo sapiens
gagcuacauuacagauuuu

SEQ ID NO: 654063 - RNA, 19 nt, Homo sapiens
auagaccucaugccaguua

SEQ ID NO: 654064 - RNA, 19 nt, Homo sapiens
ggaugcagacagugauguu

SEQ ID NO: 654065 - RNA, 19 nt, Homo sapiens
cccaauggaugcagacagu

SEQ ID NO: 654066 - RNA, 19 nt, Homo sapiens
aagaagaagcuaaauuugg

SEQ ID NO: 654067 - RNA, 19 nt, Homo sapiens
aaggaagauugcuuuggaa

SEQ ID NO: 654068 - RNA, 19 nt, Homo sapiens
gugguggaaagcuaaauuu

SEQ ID NO: 654069 - RNA, 19 nt, Homo sapiens
uacaagacaugauauugcu

SEQ ID NO: 654070 - RNA, 19 nt, Homo sapiens
gaaguuuacaagacaugau

SEQ ID NO: 654071 - RNA, 19 nt, Homo sapiens
ggaaguuuacaagacauga

SEQ ID NO: 654072 - RNA, 19 nt, Homo sapiens
aaaacuggaccaacaauaa

SEQ ID NO: 654073 - RNA, 19 nt, Homo sapiens
uaaacgugauguuggaaaa

SEQ ID NO: 654074 - RNA, 19 nt, Homo sapiens
ugaauaugggcaccaaaga

SEQ ID NO: 654075 - RNA, 19 nt, Homo sapiens
cagauuuacccauuugugu

SEQ ID NO: 654076 - RNA, 19 nt, Homo sapiens
uguaagcuccagucccuuu

SEQ ID NO: 654077 - RNA, 19 nt, Homo sapiens
uuaaaccugcugcacauug

SEQ ID NO: 654078 - RNA, 19 nt, Homo sapiens
uaagagcuacauuacagau

SEQ ID NO: 654079 - RNA, 19 nt, Homo sapiens
cagcgucuagucuauuuau

SEQ ID NO: 654080 - RNA, 19 nt, Homo sapiens
aaagaacaauagaccucau

SEQ ID NO: 654081 - RNA, 19 nt, Homo sapiens
guguguaacaugccauuug

SEQ ID NO: 654082 - RNA, 19 nt, Homo sapiens
caauugaaugugcacaaau

SEQ ID NO: 654083 - RNA, 19 nt, Homo sapiens
aguaacagggcccaaugua

SEQ ID NO: 654084 - RNA, 19 nt, Homo sapiens
caggaaguaucacaguaac

SEQ ID NO: 654085 - RNA, 19 nt, Homo sapiens
ccagaauucacaaagaaca

SEQ ID NO: 654086 - RNA, 19 nt, Homo sapiens
caccaaagaaccuguaaaa

SEQ ID NO: 654087 - RNA, 19 nt, Homo sapiens
gggcaccaaagaaccugua

SEQ ID NO: 654088 - RNA, 19 nt, Homo sapiens
ugcacuaccuuagauuguu

SEQ ID NO: 654089 - RNA, 19 nt, Homo sapiens
aaaaggaaguuuacaagac

SEQ ID NO: 654090 - RNA, 19 nt, Homo sapiens
caaauguagucuguguuuu

SEQ ID NO: 654091 - RNA, 19 nt, Homo sapiens
uugccagaauucacaaaga

SEQ ID NO: 654092 - RNA, 19 nt, Homo sapiens
ccauuuguguuugaaagca

SEQ ID NO: 654093 - RNA, 19 nt, Homo sapiens
ugcauuggacauucuaauu

SEQ ID NO: 654094 - RNA, 19 nt, Homo sapiens
uuggaaggagcaaauguaa

SEQ ID NO: 654095 - RNA, 19 nt, Homo sapiens
cagaauucacaaagaacaa

SEQ ID NO: 654096 - RNA, 19 nt, Homo sapiens
uuacaagacaugauauugc

SEQ ID NO: 654097 - RNA, 19 nt, Homo sapiens
gaagauauauuccugcaua

SEQ ID NO: 654098 - RNA, 19 nt, Homo sapiens
gguagaagaugacagauua

SEQ ID NO: 654099 - RNA, 19 nt, Homo sapiens
agaaggagaugaagaaaua

SEQ ID NO: 654100 - RNA, 19 nt, Homo sapiens
ggacucaucuuugguuaaa

SEQ ID NO: 654101 - RNA, 19 nt, Homo sapiens
gaagaugacagauuauuga

SEQ ID NO: 654102 - RNA, 19 nt, Homo sapiens
cuacauaucugguggcauu

SEQ ID NO: 654103 - RNA, 19 nt, Homo sapiens
gauaacagccauccuauug

SEQ ID NO: 654104 - RNA, 19 nt, Homo sapiens
ggauuuaacuaucagaaug

SEQ ID NO: 654105 - RNA, 19 nt, Homo sapiens
uaacgaaacugugaaacuu

SEQ ID NO: 654106 - RNA, 19 nt, Homo sapiens
ccgaacagcugauucauau

SEQ ID NO: 654107 - RNA, 19 nt, Homo sapiens
uaacagccauccuauugaa

SEQ ID NO: 654108 - RNA, 19 nt, Homo sapiens
ggaugagccugcuaucaaa

SEQ ID NO: 654109 - RNA, 19 nt, Homo sapiens
ggacugaucaggaagauau

SEQ ID NO: 654110 - RNA, 19 nt, Homo sapiens
agaaaggaaugaacaugua

SEQ ID NO: 654111 - RNA, 19 nt, Homo sapiens
gaugagauauuugaugcua

SEQ ID NO: 654112 - RNA, 19 nt, Homo sapiens
gaauguaauugaccggaaa

SEQ ID NO: 654113 - RNA, 19 nt, Homo sapiens
ggagcgaccugagcuguaa

SEQ ID NO: 654114 - RNA, 19 nt, Homo sapiens
cgacuuggauuacagaaug

SEQ ID NO: 654115 - RNA, 19 nt, Homo sapiens
gacaugaacucgcccauca

SEQ ID NO: 654116 - RNA, 19 nt, Homo sapiens
ggauaaggacuuuaagaaa

SEQ ID NO: 654117 - RNA, 19 nt, Homo sapiens
gagacugcauugcuuauug

SEQ ID NO: 654118 - RNA, 19 nt, Homo sapiens
gaauugugcugauauugau

SEQ ID NO: 654119 - RNA, 19 nt, Homo sapiens
aaccaaggauuguaguuua

SEQ ID NO: 654120 - RNA, 19 nt, Homo sapiens
gaaccaaggauuguaguuu

SEQ ID NO: 654121 - RNA, 19 nt, Homo sapiens
ccagggaggauucuuaaua

SEQ ID NO: 654122 - RNA, 19 nt, Homo sapiens
cagaguagcuuuaucaaac

SEQ ID NO: 654123 - RNA, 19 nt, Homo sapiens
cugcagggcuuaauacauu

SEQ ID NO: 654124 - RNA, 19 nt, Homo sapiens
gggaaugguuaaacacaaa

SEQ ID NO: 654125 - RNA, 19 nt, Homo sapiens
gagcauaacgaaacuguga

SEQ ID NO: 654126 - RNA, 19 nt, Homo sapiens
ggacaaugaauguaguuaa

SEQ ID NO: 654127 - RNA, 19 nt, Homo sapiens
uguggaagcugaacaggua

SEQ ID NO: 654128 - RNA, 19 nt, Homo sapiens
gaggaucucugggaaaguu

SEQ ID NO: 654129 - RNA, 19 nt, Homo sapiens
gaaacaaggucaaaagaug

SEQ ID NO: 654130 - RNA, 19 nt, Homo sapiens
gaugaauugugcugauauu

SEQ ID NO: 654131 - RNA, 19 nt, Homo sapiens
cagggaggauucuuaauau

SEQ ID NO: 654132 - RNA, 19 nt, Homo sapiens
ugaaugagcccaauuauac

SEQ ID NO: 654133 - RNA, 19 nt, Homo sapiens
gagcuugacgccuuagaua

SEQ ID NO: 654134 - RNA, 19 nt, Homo sapiens
ggucauauguuggugaaga

SEQ ID NO: 654135 - RNA, 19 nt, Homo sapiens
gggugaauaugacuuugua

SEQ ID NO: 654136 - RNA, 19 nt, Homo sapiens
ucacauaguuggagucagu

SEQ ID NO: 654137 - RNA, 19 nt, Homo sapiens
ggaaauucauaaaggacaa

SEQ ID NO: 654138 - RNA, 19 nt, Homo sapiens
gaaaucuuguuacuaugga

SEQ ID NO: 654139 - RNA, 19 nt, Homo sapiens
ugaaggaguuauucugcua

SEQ ID NO: 654140 - RNA, 19 nt, Homo sapiens
ggcacuacuuuagauauua

SEQ ID NO: 654141 - RNA, 19 nt, Homo sapiens
gcacaccuguuaugucuac

SEQ ID NO: 654142 - RNA, 19 nt, Homo sapiens
uaaaauggcuggagagguu

SEQ ID NO: 654143 - RNA, 19 nt, Homo sapiens
aagcagauaugcaagaaga

SEQ ID NO: 654144 - RNA, 19 nt, Homo sapiens
gcuggugggucauauguug

SEQ ID NO: 654145 - RNA, 19 nt, Homo sapiens
cuacaggauuuaacuauca

SEQ ID NO: 654146 - RNA, 19 nt, Homo sapiens
ugagacugcuuccuugaaa

SEQ ID NO: 654147 - RNA, 19 nt, Homo sapiens
gggauaaggacuuuaagaa

SEQ ID NO: 654148 - RNA, 19 nt, Homo sapiens
uauaaggacuacuucaaug

SEQ ID NO: 654149 - RNA, 19 nt, Homo sapiens
cugcauaacucaaucugaa

SEQ ID NO: 654150 - RNA, 19 nt, Homo sapiens
gcgcuaugcugcuguaaca

SEQ ID NO: 654151 - RNA, 19 nt, Homo sapiens
gaaguggguucugcaagga

SEQ ID NO: 654152 - RNA, 19 nt, Homo sapiens
gcuaucaguugagggauuu

SEQ ID NO: 654153 - RNA, 19 nt, Homo sapiens
cagcaagcaugguaggaaa

SEQ ID NO: 654154 - RNA, 19 nt, Homo sapiens
gaaaggaaugaacauguau

SEQ ID NO: 654155 - RNA, 19 nt, Homo sapiens
gggaugagccugcuaucaa

SEQ ID NO: 654156 - RNA, 19 nt, Homo sapiens
cuggagagguuaaggcuuu

SEQ ID NO: 654157 - RNA, 19 nt, Homo sapiens
caacugggaagaacuuuau

SEQ ID NO: 654158 - RNA, 19 nt, Homo sapiens
gugaaugagcccaauuaua

SEQ ID NO: 654159 - RNA, 19 nt, Homo sapiens
gaacagcugauucauaugc

SEQ ID NO: 654160 - RNA, 19 nt, Homo sapiens
cuaauaaagcuaucaguug

SEQ ID NO: 654161 - RNA, 19 nt, Homo sapiens
uaaacaagcagauaugcaa

SEQ ID NO: 654162 - RNA, 19 nt, Homo sapiens
ggacauaaggcaacguuag

SEQ ID NO: 654163 - RNA, 19 nt, Homo sapiens
gggauucucucaacucucu

SEQ ID NO: 654164 - RNA, 19 nt, Homo sapiens
gugaugaauugugcugaua

SEQ ID NO: 654165 - RNA, 19 nt, Homo sapiens
ugagguugaugagauauuu

SEQ ID NO: 654166 - RNA, 19 nt, Homo sapiens
gauugaauaucugugugua

SEQ ID NO: 654167 - RNA, 19 nt, Homo sapiens
gcaaagcagagcaaggaaa

SEQ ID NO: 654168 - RNA, 19 nt, Homo sapiens
uagcugguaucacauaguu

SEQ ID NO: 654169 - RNA, 19 nt, Homo sapiens
ggacaacugggaagaacuu

SEQ ID NO: 654170 - RNA, 19 nt, Homo sapiens
ccaggagcuugacgccuua

SEQ ID NO: 654171 - RNA, 19 nt, Homo sapiens
ggugagacaauagaaauaa

SEQ ID NO: 654172 - RNA, 19 nt, Homo sapiens
gacaaugaauguaguuaac

SEQ ID NO: 654173 - RNA, 19 nt, Homo sapiens
ggaggcagcaagcauggua

SEQ ID NO: 654174 - RNA, 19 nt, Homo sapiens
cauuagcacuguagagguu

SEQ ID NO: 654175 - RNA, 19 nt, Homo sapiens
cuacuucaauguuccuuau

SEQ ID NO: 654176 - RNA, 19 nt, Homo sapiens
uaauugaccggaaaccaua

SEQ ID NO: 654177 - RNA, 19 nt, Homo sapiens
ucucauugguuguuccuaa

SEQ ID NO: 654178 - RNA, 19 nt, Homo sapiens
aaacaguuggcguuaauaa

SEQ ID NO: 654179 - RNA, 19 nt, Homo sapiens
gcuuaacgguauuucagaa

SEQ ID NO: 654180 - RNA, 19 nt, Homo sapiens
caaggauuguaguuuaguu

SEQ ID NO: 654181 - RNA, 19 nt, Homo sapiens
caagggugguguccauuuc

SEQ ID NO: 654182 - RNA, 19 nt, Homo sapiens
gaaggaguuauucugcuaa

SEQ ID NO: 654183 - RNA, 19 nt, Homo sapiens
caaugaauguaguuaacug

SEQ ID NO: 654184 - RNA, 19 nt, Homo sapiens
ggcucgagcuggaaucauu

SEQ ID NO: 654185 - RNA, 19 nt, Homo sapiens
caauguuccuuauccucua

SEQ ID NO: 654186 - RNA, 19 nt, Homo sapiens
gauggucccuaucacaauc

SEQ ID NO: 654187 - RNA, 19 nt, Homo sapiens
ggaccaaacaaaugggauu

SEQ ID NO: 654188 - RNA, 19 nt, Homo sapiens
uauagcagcugugaugaau

SEQ ID NO: 654189 - RNA, 19 nt, Homo sapiens
agacugcauugcuuauuga

SEQ ID NO: 654190 - RNA, 19 nt, Homo sapiens
guagcuuuaucaaacauga

SEQ ID NO: 654191 - RNA, 19 nt, Homo sapiens
uuggagagcugaaugacaa

SEQ ID NO: 654192 - RNA, 19 nt, Homo sapiens
ggucuuaguugucugaaaa

SEQ ID NO: 654193 - RNA, 19 nt, Homo sapiens
ugaauguaguuaacugguu

SEQ ID NO: 654194 - RNA, 19 nt, Homo sapiens
gaugaagaaauacaugcua

SEQ ID NO: 654195 - RNA, 19 nt, Homo sapiens
ugaauugugcugauauuga

SEQ ID NO: 654196 - RNA, 19 nt, Homo sapiens
uaaggcaacguuagaagaa

SEQ ID NO: 654197 - RNA, 19 nt, Homo sapiens
gaagacagauggauuuguu

SEQ ID NO: 654198 - RNA, 19 nt, Homo sapiens
gaagauaaagucuaccuua

SEQ ID NO: 654199 - RNA, 19 nt, Homo sapiens
ggagaaauaucuuaaugug

SEQ ID NO: 654200 - RNA, 19 nt, Homo sapiens
caaaucgggcuuaaucuua

SEQ ID NO: 654201 - RNA, 19 nt, Homo sapiens
uaaccucucuuucauauuc

SEQ ID NO: 654202 - RNA, 19 nt, Homo sapiens
ccacaggacuaauguaaau

SEQ ID NO: 654203 - RNA, 19 nt, Homo sapiens
ggguauaacuuuacauuag

SEQ ID NO: 654204 - RNA, 19 nt, Homo sapiens
cuucaucgcuuuauaguug

SEQ ID NO: 654205 - RNA, 19 nt, Homo sapiens
uaacaggauugacuacuau

SEQ ID NO: 654206 - RNA, 19 nt, Homo sapiens
ccauacagaagaucuauua

SEQ ID NO: 654207 - RNA, 19 nt, Homo sapiens
gauaaauugugccaaggaa

SEQ ID NO: 654208 - RNA, 19 nt, Homo sapiens
uaugugagcuaguaaaugu

SEQ ID NO: 654209 - RNA, 19 nt, Homo sapiens
uaaugugucucgcugguuu

SEQ ID NO: 654210 - RNA, 19 nt, Homo sapiens
cuaacaggauugacuacua

SEQ ID NO: 654211 - RNA, 19 nt, Homo sapiens
aaguugagauccaguuaua

SEQ ID NO: 654212 - RNA, 19 nt, Homo sapiens
ggcaacaucugucuagugu

SEQ ID NO: 654213 - RNA, 19 nt, Homo sapiens
gauaaagucuaccuuacag

SEQ ID NO: 654214 - RNA, 19 nt, Homo sapiens
aaacaaugguccaagucua

SEQ ID NO: 654215 - RNA, 19 nt, Homo sapiens
ggauauuuaugguaguuug

SEQ ID NO: 654216 - RNA, 19 nt, Homo sapiens
gaccacaggacuaauguaa

SEQ ID NO: 654217 - RNA, 19 nt, Homo sapiens
caagcaagccaacaaagaa

SEQ ID NO: 654218 - RNA, 19 nt, Homo sapiens
gcaaaucgggcuuaaucuu

SEQ ID NO: 654219 - RNA, 19 nt, Homo sapiens
uauagcagcucaucuaguc

SEQ ID NO: 654220 - RNA, 19 nt, Homo sapiens
guaaacuugugucugaaug

SEQ ID NO: 654221 - RNA, 19 nt, Homo sapiens
aguguaaacuugugucuga

SEQ ID NO: 654222 - RNA, 19 nt, Homo sapiens
gacaaacaaugguccaagu

SEQ ID NO: 654223 - RNA, 19 nt, Homo sapiens
guugagauccaguuauaaa

SEQ ID NO: 654224 - RNA, 19 nt, Homo sapiens
ggacuucaucgcuuuauag

SEQ ID NO: 654225 - RNA, 19 nt, Homo sapiens
guucagcagugguuagaau

SEQ ID NO: 654226 - RNA, 19 nt, Homo sapiens
guagaugggcacuccagua

SEQ ID NO: 654227 - RNA, 19 nt, Homo sapiens
gaugggcacuccaguaaaa

SEQ ID NO: 654228 - RNA, 19 nt, Homo sapiens
gcaagccaacaaagaauau

SEQ ID NO: 654229 - RNA, 19 nt, Homo sapiens
aaacuugugucugaauguu

SEQ ID NO: 654230 - RNA, 19 nt, Homo sapiens
uuugucacauucagcauua

SEQ ID NO: 654231 - RNA, 19 nt, Homo sapiens
gcagauauacuauuguacu

SEQ ID NO: 654232 - RNA, 19 nt, Homo sapiens
uagaugggcacuccaguaa

SEQ ID NO: 654233 - RNA, 19 nt, Homo sapiens
cagggucacucaaguagau

SEQ ID NO: 654234 - RNA, 19 nt, Homo sapiens
gaccugacaguucaagaaa

SEQ ID NO: 654235 - RNA, 19 nt, Homo sapiens
guccaagucuaacaggauu

SEQ ID NO: 654236 - RNA, 19 nt, Homo sapiens
caucaagaacagacuauau

SEQ ID NO: 654237 - RNA, 19 nt, Homo sapiens
cuuacaggguauaacuuua

SEQ ID NO: 654238 - RNA, 19 nt, Homo sapiens
gaauacagggucacucaag

SEQ ID NO: 654239 - RNA, 19 nt, Homo sapiens
ucaagcaagccaacaaaga

SEQ ID NO: 654240 - RNA, 19 nt, Homo sapiens
gguauaacuuuacauuagc

SEQ ID NO: 654241 - RNA, 19 nt, Homo sapiens
cagcucaucuagucaagca

SEQ ID NO: 654242 - RNA, 19 nt, Homo sapiens
cuauggacuucaucgcuuu

SEQ ID NO: 654243 - RNA, 19 nt, Homo sapiens
uaguugaccugacaguuca

SEQ ID NO: 654244 - RNA, 19 nt, Homo sapiens
guugacauauuuggcuauu

SEQ ID NO: 654245 - RNA, 19 nt, Homo sapiens
ugaguaaggggaauaaaua

SEQ ID NO: 654246 - RNA, 19 nt, Homo sapiens
gcugaaguuuugcaauuuu

SEQ ID NO: 654247 - RNA, 19 nt, Homo sapiens
caggguauaacuuuacauu

SEQ ID NO: 654248 - RNA, 19 nt, Homo sapiens
aagauaaagucuaccuuac

SEQ ID NO: 654249 - RNA, 19 nt, Homo sapiens
ugacauccacacacuguug

SEQ ID NO: 654250 - RNA, 19 nt, Homo sapiens
uagcugaaguuuugcaauu

SEQ ID NO: 654251 - RNA, 19 nt, Homo sapiens
acaaguugagauccaguua

SEQ ID NO: 654252 - RNA, 19 nt, Homo sapiens
uuaaacaaguugagaucca

SEQ ID NO: 654253 - RNA, 19 nt, Homo sapiens
uauacuaauucccacuaga

SEQ ID NO: 654254 - RNA, 19 nt, Homo sapiens
gcuaguaaaugugggaaaa

SEQ ID NO: 654255 - RNA, 19 nt, Homo sapiens
ugaccugacaguucaagaa

SEQ ID NO: 654256 - RNA, 19 nt, Homo sapiens
cgacagauuccaguucuuc

SEQ ID NO: 654257 - RNA, 19 nt, Homo sapiens
uagaauacagggucacuca

SEQ ID NO: 654258 - RNA, 19 nt, Homo sapiens
aacaaugguccaagucuaa

SEQ ID NO: 654259 - RNA, 19 nt, Homo sapiens
caauaaaaguugcaaaucg

SEQ ID NO: 654260 - RNA, 19 nt, Homo sapiens
uggacuucaucgcuuuaua

SEQ ID NO: 654261 - RNA, 19 nt, Homo sapiens
auacagggucacucaagua

SEQ ID NO: 654262 - RNA, 19 nt, Homo sapiens
cagcagugguuagaauaca

SEQ ID NO: 654263 - RNA, 19 nt, Homo sapiens
caaguugagauccaguuau

SEQ ID NO: 654264 - RNA, 19 nt, Homo sapiens
gcuauuaaacaaguugaga

SEQ ID NO: 654265 - RNA, 19 nt, Homo sapiens
gagcgacagauuccaguuc

SEQ ID NO: 654266 - RNA, 19 nt, Homo sapiens
auacuaauucccacuagaa

SEQ ID NO: 654267 - RNA, 19 nt, Homo sapiens
uacuauagcagcucaucua

SEQ ID NO: 654268 - RNA, 19 nt, Homo sapiens
uuccaguucuucagacaaa

SEQ ID NO: 654269 - RNA, 19 nt, Homo sapiens
ccuuacaggguauaacuuu

SEQ ID NO: 654270 - RNA, 19 nt, Homo sapiens
ggaagacagauggauuugu

SEQ ID NO: 654271 - RNA, 19 nt, Homo sapiens
gauuccaguucuucagaca

SEQ ID NO: 654272 - RNA, 19 nt, Homo sapiens
caaacaaugguccaagucu

SEQ ID NO: 654273 - RNA, 19 nt, Homo sapiens
ucaagaacagacuauauac

SEQ ID NO: 654274 - RNA, 19 nt, Homo sapiens
gggaagacagauggauuug

SEQ ID NO: 654275 - RNA, 19 nt, Homo sapiens
gcgacagauuccaguucuu

SEQ ID NO: 654276 - RNA, 19 nt, Homo sapiens
ggggaguacugcagaagaa

SEQ ID NO: 654277 - RNA, 19 nt, Homo sapiens
caagaacagacuauauacu

SEQ ID NO: 654278 - RNA, 19 nt, Homo sapiens
cuuuauaguugaccugaca

SEQ ID NO: 654279 - RNA, 19 nt, Homo sapiens
gacauccacacacuguuga

SEQ ID NO: 654280 - RNA, 19 nt, Homo sapiens
aauacagggucacucaagu

SEQ ID NO: 654281 - RNA, 19 nt, Homo sapiens
gguccaagucuaacaggau

SEQ ID NO: 654282 - RNA, 19 nt, Homo sapiens
ccgcagaguugucgcuacu

SEQ ID NO: 654283 - RNA, 19 nt, Homo sapiens
agggaagacagauggauuu

SEQ ID NO: 654284 - RNA, 19 nt, Homo sapiens
uugcaaaucgggcuuaauc

SEQ ID NO: 654285 - RNA, 19 nt, Homo sapiens
cuagaccacaggacuaaug

SEQ ID NO: 654286 - RNA, 19 nt, Homo sapiens
guccaugccauacagaaga

SEQ ID NO: 654287 - RNA, 19 nt, Homo sapiens
cuaguguugucuucaucaa

SEQ ID NO: 654288 - RNA, 19 nt, Homo sapiens
agauaaagucuaccuuaca

SEQ ID NO: 654289 - RNA, 19 nt, Homo sapiens
ccaagucuaacaggauuga

SEQ ID NO: 654290 - RNA, 19 nt, Homo sapiens
aggauugacuacuauagca

SEQ ID NO: 654291 - RNA, 19 nt, Homo sapiens
ucagggcgagcgacagauu

SEQ ID NO: 654292 - RNA, 19 nt, Homo sapiens
uccacacacuguugaagga

SEQ ID NO: 654293 - RNA, 19 nt, Homo sapiens
cagauuccaguucuucaga

SEQ ID NO: 654294 - RNA, 19 nt, Homo sapiens
gacagauggauuuguuuua

SEQ ID NO: 654295 - RNA, 19 nt, Homo sapiens
ucaggcaacaucugucuag

SEQ ID NO: 654296 - RNA, 19 nt, Homo sapiens
ugauaaauugugccaagga

SEQ ID NO: 654297 - RNA, 19 nt, Homo sapiens
gcagucaucucacuaguua

SEQ ID NO: 654298 - RNA, 19 nt, Homo sapiens
gaaaugauauucugcaaga

SEQ ID NO: 654299 - RNA, 19 nt, Homo sapiens
gaagguaguuaaugcagua

SEQ ID NO: 654300 - RNA, 19 nt, Homo sapiens
ccagagagaugucggauuu

SEQ ID NO: 654301 - RNA, 19 nt, Homo sapiens
caccaggacuugaugaaua

SEQ ID NO: 654302 - RNA, 19 nt, Homo sapiens
gauauuuccuguucacuug

SEQ ID NO: 654303 - RNA, 19 nt, Homo sapiens
acaauacacuguuaccuuu

SEQ ID NO: 654304 - RNA, 19 nt, Homo sapiens
gcaccacauuucuuauauu

SEQ ID NO: 654305 - RNA, 19 nt, Homo sapiens
gcauggauauuuccuguuc

SEQ ID NO: 654306 - RNA, 19 nt, Homo sapiens
caacaggugugauguccaa

SEQ ID NO: 654307 - RNA, 19 nt, Homo sapiens
ucaguuugcuguacaugua

SEQ ID NO: 654308 - RNA, 19 nt, Homo sapiens
uuacacaagugacaagaaa

SEQ ID NO: 654309 - RNA, 19 nt, Homo sapiens
guagaaaguagugguaaua

SEQ ID NO: 654310 - RNA, 19 nt, Homo sapiens
gaagagccuaugugcauuu

SEQ ID NO: 654311 - RNA, 19 nt, Homo sapiens
acuccaagcugcaggauuu

SEQ ID NO: 654312 - RNA, 19 nt, Homo sapiens
guacagaccacuuuaugga

SEQ ID NO: 654313 - RNA, 19 nt, Homo sapiens
ugucggaccuuguuucuau

SEQ ID NO: 654314 - RNA, 19 nt, Homo sapiens
aagaaaagccgcagaauua

SEQ ID NO: 654315 - RNA, 19 nt, Homo sapiens
guacagacagcauggauau

SEQ ID NO: 654316 - RNA, 19 nt, Homo sapiens
cagaggaacauccagcuua

SEQ ID NO: 654317 - RNA, 19 nt, Homo sapiens
auacacagauugcaaagga

SEQ ID NO: 654318 - RNA, 19 nt, Homo sapiens
agauaaggauugcacauug

SEQ ID NO: 654319 - RNA, 19 nt, Homo sapiens
gguaguuaaugcaguagaa

SEQ ID NO: 654320 - RNA, 19 nt, Homo sapiens
cagcagagacuuagggauu

SEQ ID NO: 654321 - RNA, 19 nt, Homo sapiens
gggcaccacauuucuuaua

SEQ ID NO: 654322 - RNA, 19 nt, Homo sapiens
gauaaggauugcacauugg

SEQ ID NO: 654323 - RNA, 19 nt, Homo sapiens
caaaagacaguaaagcuua

SEQ ID NO: 654324 - RNA, 19 nt, Homo sapiens
ggcccaagcugaacuucuu

SEQ ID NO: 654325 - RNA, 19 nt, Homo sapiens
gagauaaggauugcacauu

SEQ ID NO: 654326 - RNA, 19 nt, Homo sapiens
ucaaggguaaccagauuua

SEQ ID NO: 654327 - RNA, 19 nt, Homo sapiens
gcaguagaaaguaguggua

SEQ ID NO: 654328 - RNA, 19 nt, Homo sapiens
caaaagagaagguaguuaa

SEQ ID NO: 654329 - RNA, 19 nt, Homo sapiens
gggcaauugugguuggauu

SEQ ID NO: 654330 - RNA, 19 nt, Homo sapiens
gagugacaguucauuuaga

SEQ ID NO: 654331 - RNA, 19 nt, Homo sapiens
caauacacaaccagcaaua

SEQ ID NO: 654332 - RNA, 19 nt, Homo sapiens
gugugaagaugccuaaugu

SEQ ID NO: 654333 - RNA, 19 nt, Homo sapiens
ggcaccacauuucuuauau

SEQ ID NO: 654334 - RNA, 19 nt, Homo sapiens
agaaugcuuucaaggguaa

SEQ ID NO: 654335 - RNA, 19 nt, Homo sapiens
guuaauggaaucacagaaa

SEQ ID NO: 654336 - RNA, 19 nt, Homo sapiens
cuucaaggauccaucaguu

SEQ ID NO: 654337 - RNA, 19 nt, Homo sapiens
gcuuaugguuguaggauuc

SEQ ID NO: 654338 - RNA, 19 nt, Homo sapiens
acagacagcauggauauuu

SEQ ID NO: 654339 - RNA, 19 nt, Homo sapiens
gauugaguauccugugguu

SEQ ID NO: 654340 - RNA, 19 nt, Homo sapiens
gcaaaugcagcuucaacug

SEQ ID NO: 654341 - RNA, 19 nt, Homo sapiens
ggagugacaguucauuuag

SEQ ID NO: 654342 - RNA, 19 nt, Homo sapiens
gugaagagccuaugugcau

SEQ ID NO: 654343 - RNA, 19 nt, Homo sapiens
agaggaacauccagcuuau

SEQ ID NO: 654344 - RNA, 19 nt, Homo sapiens
acacaaccagcaauaauga

SEQ ID NO: 654345 - RNA, 19 nt, Homo sapiens
caagugacaagaaauguuc

SEQ ID NO: 654346 - RNA, 19 nt, Homo sapiens
ggugcaauauaagaaguuu

SEQ ID NO: 654347 - RNA, 19 nt, Homo sapiens
caacaggaguuugcaacag

SEQ ID NO: 654348 - RNA, 19 nt, Homo sapiens
guucauuugucuguuggua

SEQ ID NO: 654349 - RNA, 19 nt, Homo sapiens
ggauauuuccuguucacuu

SEQ ID NO: 654350 - RNA, 19 nt, Homo sapiens
gugcagcucagaaugcuuu

SEQ ID NO: 654351 - RNA, 19 nt, Homo sapiens
cuaaauaucuucggaugcu

SEQ ID NO: 654352 - RNA, 19 nt, Homo sapiens
ggccaccucuuccuagcaa

SEQ ID NO: 654353 - RNA, 19 nt, Homo sapiens
ugaagagccuaugugcauu

SEQ ID NO: 654354 - RNA, 19 nt, Homo sapiens
uuucaaggguaaccagauu

SEQ ID NO: 654355 - RNA, 19 nt, Homo sapiens
caagcugcaggauuucaua

SEQ ID NO: 654356 - RNA, 19 nt, Homo sapiens
cgucuauauuugucaguuu

SEQ ID NO: 654357 - RNA, 19 nt, Homo sapiens
gaacauccagcuuauacac

SEQ ID NO: 654358 - RNA, 19 nt, Homo sapiens
aagagaagguaguuaaugc

SEQ ID NO: 654359 - RNA, 19 nt, Homo sapiens
cgacccggaucucaacaau

SEQ ID NO: 654360 - RNA, 19 nt, Homo sapiens
agaaauaggccagcagaga

SEQ ID NO: 654361 - RNA, 19 nt, Homo sapiens
aaccauguuucauuccuuu

SEQ ID NO: 654362 - RNA, 19 nt, Homo sapiens
cagacagcauggauauuuc

SEQ ID NO: 654363 - RNA, 19 nt, Homo sapiens
gaggaacauccagcuuaua

SEQ ID NO: 654364 - RNA, 19 nt, Homo sapiens
ugacaguucauuuagauuc

SEQ ID NO: 654365 - RNA, 19 nt, Homo sapiens
aggagugacaguucauuua

SEQ ID NO: 654366 - RNA, 19 nt, Homo sapiens
guauucuucuucgucuaua

SEQ ID NO: 654367 - RNA, 19 nt, Homo sapiens
guuaaugcaguagaaagua

SEQ ID NO: 654368 - RNA, 19 nt, Homo sapiens
aaagagaagguaguuaaug

SEQ ID NO: 654369 - RNA, 19 nt, Homo sapiens
gccgagagccagagagaug

SEQ ID NO: 654370 - RNA, 19 nt, Homo sapiens
ggugugauguccaacaaaa

SEQ ID NO: 654371 - RNA, 19 nt, Homo sapiens
caggugugauguccaacaa

SEQ ID NO: 654372 - RNA, 19 nt, Homo sapiens
caucagcagucaucucacu

SEQ ID NO: 654373 - RNA, 19 nt, Homo sapiens
gacaguucauuuagauucu

SEQ ID NO: 654374 - RNA, 19 nt, Homo sapiens
uguagacauuccuguagaa

SEQ ID NO: 654375 - RNA, 19 nt, Homo sapiens
acacaagugacaagaaaug

SEQ ID NO: 654376 - RNA, 19 nt, Homo sapiens
uuaaugcaguagaaaguag

SEQ ID NO: 654377 - RNA, 19 nt, Homo sapiens
gugaagaugccuaauguac

SEQ ID NO: 654378 - RNA, 19 nt, Homo sapiens
gcugcaggauuucauaacu

SEQ ID NO: 654379 - RNA, 19 nt, Homo sapiens
ggugugaagaugccuaaug

SEQ ID NO: 654380 - RNA, 19 nt, Homo sapiens
gcagagacuuagggauuuu

SEQ ID NO: 654381 - RNA, 19 nt, Homo sapiens
ggacuugaugaauauaauc

SEQ ID NO: 654382 - RNA, 19 nt, Homo sapiens
caauugugguuggauuuca

SEQ ID NO: 654383 - RNA, 19 nt, Homo sapiens
ucauuugucuguugguaca

SEQ ID NO: 654384 - RNA, 19 nt, Homo sapiens
caagagcgguugauuuugg

SEQ ID NO: 654385 - RNA, 19 nt, Homo sapiens
ucucaacaaucccuucaag

SEQ ID NO: 654386 - RNA, 19 nt, Homo sapiens
cacaacaggugcuaguuuu

SEQ ID NO: 654387 - RNA, 19 nt, Homo sapiens
gcaauugugguuggauuuc

SEQ ID NO: 654388 - RNA, 19 nt, Homo sapiens
gucuauauuugucaguuug

SEQ ID NO: 654389 - RNA, 19 nt, Homo sapiens
gcaauaaugaaaccaacag

SEQ ID NO: 654390 - RNA, 19 nt, Homo sapiens
aagcuuauguacuacuugu

SEQ ID NO: 654391 - RNA, 19 nt, Homo sapiens
accaggacuugaugaauau

SEQ ID NO: 654392 - RNA, 19 nt, Homo sapiens
gauaaucauagcagcacuu

SEQ ID NO: 654393 - RNA, 19 nt, Homo sapiens
acaaccagcaauaaugaaa

SEQ ID NO: 654394 - RNA, 19 nt, Homo sapiens
gaaaagccgcagaauuaga

SEQ ID NO: 654395 - RNA, 19 nt, Homo sapiens
gagccuaugugcauuuugu

SEQ ID NO: 654396 - RNA, 19 nt, Homo sapiens
caaggguaaccagauuuaa

SEQ ID NO: 654397 - RNA, 19 nt, Homo sapiens
gcagucaucucacuaguua

SEQ ID NO: 654398 - RNA, 19 nt, Homo sapiens
ccagagagaugucggauuu

SEQ ID NO: 654399 - RNA, 19 nt, Homo sapiens
caccaggacuugaugaaua

SEQ ID NO: 654400 - RNA, 19 nt, Homo sapiens
gauauuuccuguucacuug

SEQ ID NO: 654401 - RNA, 19 nt, Homo sapiens
acaauacacuguuaccuuu

SEQ ID NO: 654402 - RNA, 19 nt, Homo sapiens
gcauggauauuuccuguuc

SEQ ID NO: 654403 - RNA, 19 nt, Homo sapiens
caacaggugugauguccaa

SEQ ID NO: 654404 - RNA, 19 nt, Homo sapiens
ucaguuugcuguacaugua

SEQ ID NO: 654405 - RNA, 19 nt, Homo sapiens
uuacacaagugacaagaaa

SEQ ID NO: 654406 - RNA, 19 nt, Homo sapiens
acuccaagcugcaggauuu

SEQ ID NO: 654407 - RNA, 19 nt, Homo sapiens
ugucggaccuuguuucuau

SEQ ID NO: 654408 - RNA, 19 nt, Homo sapiens
aagaaaagccgcagaauua

SEQ ID NO: 654409 - RNA, 19 nt, Homo sapiens
guacagacagcauggauau

SEQ ID NO: 654410 - RNA, 19 nt, Homo sapiens
cagaggaacauccagcuua

SEQ ID NO: 654411 - RNA, 19 nt, Homo sapiens
auacacagauugcaaagga

SEQ ID NO: 654412 - RNA, 19 nt, Homo sapiens
gugagugacaguucauuua

SEQ ID NO: 654413 - RNA, 19 nt, Homo sapiens
caaaagacaguaaagcuua

SEQ ID NO: 654414 - RNA, 19 nt, Homo sapiens
ggcccaagcugaacuucuu

SEQ ID NO: 654415 - RNA, 19 nt, Homo sapiens
ucaaggguaaccagauuua

SEQ ID NO: 654416 - RNA, 19 nt, Homo sapiens
gggcaauugugguuggauu

SEQ ID NO: 654417 - RNA, 19 nt, Homo sapiens
gagugacaguucauuuaga

SEQ ID NO: 654418 - RNA, 19 nt, Homo sapiens
caauacacaaccagcaaua

SEQ ID NO: 654419 - RNA, 19 nt, Homo sapiens
gugugaagaugccuaaugu

SEQ ID NO: 654420 - RNA, 19 nt, Homo sapiens
agaaugcuuucaaggguaa

SEQ ID NO: 654421 - RNA, 19 nt, Homo sapiens
cuucaaggauccaucaguu

SEQ ID NO: 654422 - RNA, 19 nt, Homo sapiens
acagacagcauggauauuu

SEQ ID NO: 654423 - RNA, 19 nt, Homo sapiens
gcaaaugcagcuucaacug

SEQ ID NO: 654424 - RNA, 19 nt, Homo sapiens
ggaugugagugacaguuca

SEQ ID NO: 654425 - RNA, 19 nt, Homo sapiens
agaggaacauccagcuuau

SEQ ID NO: 654426 - RNA, 19 nt, Homo sapiens
acacaaccagcaauaauga

SEQ ID NO: 654427 - RNA, 19 nt, Homo sapiens
caagugacaagaaauguuc

SEQ ID NO: 654428 - RNA, 19 nt, Homo sapiens
caacaggaguuugcaacag

SEQ ID NO: 654429 - RNA, 19 nt, Homo sapiens
ggauauuuccuguucacuu

SEQ ID NO: 654430 - RNA, 19 nt, Homo sapiens
gugcagcucagaaugcuuu

SEQ ID NO: 654431 - RNA, 19 nt, Homo sapiens
ggccaccucuuccuagcaa

SEQ ID NO: 654432 - RNA, 19 nt, Homo sapiens
uuucaaggguaaccagauu

SEQ ID NO: 654433 - RNA, 19 nt, Homo sapiens
caagcugcaggauuucaua

SEQ ID NO: 654434 - RNA, 19 nt, Homo sapiens
cgucuauauuugucaguuu

SEQ ID NO: 654435 - RNA, 19 nt, Homo sapiens
gaacauccagcuuauacac

SEQ ID NO: 654436 - RNA, 19 nt, Homo sapiens
cagacagcauggauauuuc

SEQ ID NO: 654437 - RNA, 19 nt, Homo sapiens
gaggaacauccagcuuaua

SEQ ID NO: 654438 - RNA, 19 nt, Homo sapiens
cgacccggaucucaacaau

SEQ ID NO: 654439 - RNA, 19 nt, Homo sapiens
ugacaguucauuuagauuc

SEQ ID NO: 654440 - RNA, 19 nt, Homo sapiens
guauucuucuucgucuaua

SEQ ID NO: 654441 - RNA, 19 nt, Homo sapiens
gccgagagccagagagaug

SEQ ID NO: 654442 - RNA, 19 nt, Homo sapiens
ggugugauguccaacaaaa

SEQ ID NO: 654443 - RNA, 19 nt, Homo sapiens
caggugugauguccaacaa

SEQ ID NO: 654444 - RNA, 19 nt, Homo sapiens
caucagcagucaucucacu

SEQ ID NO: 654445 - RNA, 19 nt, Homo sapiens
acacaagugacaagaaaug

SEQ ID NO: 654446 - RNA, 19 nt, Homo sapiens
gacaguucauuuagauucu

SEQ ID NO: 654447 - RNA, 19 nt, Homo sapiens
uguagacauuccuguagaa

SEQ ID NO: 654448 - RNA, 19 nt, Homo sapiens
gcugcaggauuucauaacu

SEQ ID NO: 654449 - RNA, 19 nt, Homo sapiens
gugaagaugccuaauguac

SEQ ID NO: 654450 - RNA, 19 nt, Homo sapiens
caauugugguuggauuuca

SEQ ID NO: 654451 - RNA, 19 nt, Homo sapiens
ggugugaagaugccuaaug

SEQ ID NO: 654452 - RNA, 19 nt, Homo sapiens
ggacuugaugaauauaauc

SEQ ID NO: 654453 - RNA, 19 nt, Homo sapiens
cacaacaggugcuaguuuu

SEQ ID NO: 654454 - RNA, 19 nt, Homo sapiens
gcaauugugguuggauuuc

SEQ ID NO: 654455 - RNA, 19 nt, Homo sapiens
gucuauauuugucaguuug

SEQ ID NO: 654456 - RNA, 19 nt, Homo sapiens
aagcuuauguacuacuugu

SEQ ID NO: 654457 - RNA, 19 nt, Homo sapiens
ucucaacaaucccuucaag

SEQ ID NO: 654458 - RNA, 19 nt, Homo sapiens
gcaauaaugaaaccaacag

SEQ ID NO: 654459 - RNA, 19 nt, Homo sapiens
gauaaucauagcagcacuu

SEQ ID NO: 654460 - RNA, 19 nt, Homo sapiens
gaaaagccgcagaauuaga

SEQ ID NO: 654461 - RNA, 19 nt, Homo sapiens
accaggacuugaugaauau

SEQ ID NO: 654462 - RNA, 19 nt, Homo sapiens
acaaccagcaauaaugaaa

SEQ ID NO: 654463 - RNA, 19 nt, Homo sapiens
caaggguaaccagauuuaa

SEQ ID NO: 654464 - RNA, 19 nt, Homo sapiens
ucaucucacuaguuauguu

SEQ ID NO: 654465 - RNA, 19 nt, Homo sapiens
agugacaguucauuuagau

SEQ ID NO: 654466 - RNA, 19 nt, Homo sapiens
gacaguaaagcuuauguac

SEQ ID NO: 654467 - RNA, 19 nt, Homo sapiens
agacaguaaagcuuaugua

SEQ ID NO: 654468 - RNA, 19 nt, Homo sapiens
gaaaccaacagaggaacau

SEQ ID NO: 654469 - RNA, 19 nt, Homo sapiens
gcuaaaaccaggaaaacuu

SEQ ID NO: 654470 - RNA, 19 nt, Homo sapiens
gaucucaacaaucccuuca

SEQ ID NO: 654471 - RNA, 19 nt, Homo sapiens
gaaggcccaacaggaguuu

SEQ ID NO: 654472 - RNA, 19 nt, Homo sapiens
gcccaagcugaacuucuua

SEQ ID NO: 654473 - RNA, 19 nt, Homo sapiens
gguaaccagauuuaagaau

SEQ ID NO: 654474 - RNA, 19 nt, Homo sapiens
ccagaccgcagcugcaaau

SEQ ID NO: 654475 - RNA, 19 nt, Homo sapiens
ggcaauugugguuggauuu

SEQ ID NO: 654476 - RNA, 19 nt, Homo sapiens
ggugacccacugaaaauua

SEQ ID NO: 654477 - RNA, 19 nt, Homo sapiens
ucaaggauccaucaguuac

SEQ ID NO: 654478 - RNA, 19 nt, Homo sapiens
aaaccucagucaacauggu

SEQ ID NO: 654479 - RNA, 19 nt, Homo sapiens
uggacuauaucgcacaaca

SEQ ID NO: 654480 - RNA, 19 nt, Homo sapiens
caaccaaaauauuccuguu

SEQ ID NO: 654481 - RNA, 19 nt, Homo sapiens
ugagugacaguucauuuag

SEQ ID NO: 654482 - RNA, 19 nt, Homo sapiens
auacacaaccagcaauaau

SEQ ID NO: 654483 - RNA, 19 nt, Homo sapiens
gcaaaggaacaugcauugg

SEQ ID NO: 654484 - RNA, 19 nt, Homo sapiens
ggaacauccagcuuauaca

SEQ ID NO: 654485 - RNA, 19 nt, Homo sapiens
cauggacuauaucgcacaa

SEQ ID NO: 654486 - RNA, 19 nt, Homo sapiens
cagcagucaucucacuagu

SEQ ID NO: 654487 - RNA, 19 nt, Homo sapiens
caggacuugaugaauauaa

SEQ ID NO: 654488 - RNA, 19 nt, Homo sapiens
uacacaaccagcaauaaug

SEQ ID NO: 654489 - RNA, 19 nt, Homo sapiens
acaagugacaagaaauguu

SEQ ID NO: 654490 - RNA, 19 nt, Homo sapiens
cuguagacauuccuguaga

SEQ ID NO: 654491 - RNA, 19 nt, Homo sapiens
ccaccucuuccuagcaauu

SEQ ID NO: 654492 - RNA, 19 nt, Homo sapiens
aaagaaaagccgcagaauu

SEQ ID NO: 654493 - RNA, 19 nt, Homo sapiens
gcuuauacacagauugcaa

SEQ ID NO: 654494 - RNA, 19 nt, Homo sapiens
aggguaaccagauuuaaga

SEQ ID NO: 654495 - RNA, 19 nt, Homo sapiens
ggauccaucaguuacacaa

SEQ ID NO: 654496 - RNA, 19 nt, Homo sapiens
cagcucagaaugcuuucaa

SEQ ID NO: 654497 - RNA, 19 nt, Homo sapiens
gcagcuaccugaaggaguu

SEQ ID NO: 654498 - RNA, 19 nt, Homo sapiens
ccgcguggauggccuauua

SEQ ID NO: 654499 - RNA, 19 nt, Homo sapiens
caagggagaagcuguguuu

SEQ ID NO: 654500 - RNA, 19 nt, Homo sapiens
agggagccaugaagcauua

SEQ ID NO: 654501 - RNA, 19 nt, Homo sapiens
ugaaggaguuccgggacua

SEQ ID NO: 654502 - RNA, 19 nt, Homo sapiens
caacuucuccauccacaug

SEQ ID NO: 654503 - RNA, 19 nt, Homo sapiens
gagcucagcaggugaaacu

SEQ ID NO: 654504 - RNA, 19 nt, Homo sapiens
gagggagccaugaagcauu

SEQ ID NO: 654505 - RNA, 19 nt, Homo sapiens
uggagauucuggacgcaaa

SEQ ID NO: 654506 - RNA, 19 nt, Homo sapiens
gcgcucgccaucuuuguga

SEQ ID NO: 654507 - RNA, 19 nt, Homo sapiens
caaucacccucucuacacu

SEQ ID NO: 654508 - RNA, 19 nt, Homo sapiens
ggagggagccaugaagcau

SEQ ID NO: 654509 - RNA, 19 nt, Homo sapiens
gcauuacgagguggagauu

SEQ ID NO: 654510 - RNA, 19 nt, Homo sapiens
gcaccgcagcuaccugaag

SEQ ID NO: 654511 - RNA, 19 nt, Homo sapiens
agacgcggaagaucccaua

SEQ ID NO: 654512 - RNA, 19 nt, Homo sapiens
gcaagucccugaaggauga

SEQ ID NO: 654513 - RNA, 19 nt, Homo sapiens
gcagcuaccugaaggaguu

SEQ ID NO: 654514 - RNA, 19 nt, Homo sapiens
ccgcguggauggccuauua

SEQ ID NO: 654515 - RNA, 19 nt, Homo sapiens
caagggagaagcuguguuu

SEQ ID NO: 654516 - RNA, 19 nt, Homo sapiens
ccacaaauaugacuuuacg

SEQ ID NO: 654517 - RNA, 19 nt, Homo sapiens
gcaccucgccugcaucugu

SEQ ID NO: 654518 - RNA, 19 nt, Homo sapiens
ggccacaaauaugacuuua

SEQ ID NO: 654519 - RNA, 19 nt, Homo sapiens
agggagccaugaagcauua

SEQ ID NO: 654520 - RNA, 19 nt, Homo sapiens
cgagugcccuucaucuaug

SEQ ID NO: 654521 - RNA, 19 nt, Homo sapiens
ucaucuaccugcucuucua

SEQ ID NO: 654522 - RNA, 19 nt, Homo sapiens
ugaaggaguuccgggacua

SEQ ID NO: 654523 - RNA, 19 nt, Homo sapiens
caacuucuccauccacaug

SEQ ID NO: 654524 - RNA, 19 nt, Homo sapiens
gcaccacggccacacugua

SEQ ID NO: 654525 - RNA, 19 nt, Homo sapiens
cuucaucuauggccacaaa

SEQ ID NO: 654526 - RNA, 19 nt, Homo sapiens
caucuauggccacaaauau

SEQ ID NO: 654527 - RNA, 19 nt, Homo sapiens
gagcucagcaggugaaacu

SEQ ID NO: 654528 - RNA, 19 nt, Homo sapiens
cugcaucugucacucauuc

SEQ ID NO: 654529 - RNA, 19 nt, Homo sapiens
ucuauggccacaaauauga

SEQ ID NO: 654530 - RNA, 19 nt, Homo sapiens
gagggagccaugaagcauu

SEQ ID NO: 654531 - RNA, 19 nt, Homo sapiens
ucaucuauggccacaaaua

SEQ ID NO: 654532 - RNA, 19 nt, Homo sapiens
ccugaaggaugaggauguu

SEQ ID NO: 654533 - RNA, 19 nt, Homo sapiens
uggagauucuggacgcaaa

SEQ ID NO: 654534 - RNA, 19 nt, Homo sapiens
ccgagugcccuucaucuau

SEQ ID NO: 654535 - RNA, 19 nt, Homo sapiens
agacccauccgcaguggua

SEQ ID NO: 654536 - RNA, 19 nt, Homo sapiens
ugacggucuuccuaacaga

SEQ ID NO: 654537 - RNA, 19 nt, Homo sapiens
gcgcucgccaucuuuguga

SEQ ID NO: 654538 - RNA, 19 nt, Homo sapiens
caaucacccucucuacacu

SEQ ID NO: 654539 - RNA, 19 nt, Homo sapiens
gcauuacgagguggagauu

SEQ ID NO: 654540 - RNA, 19 nt, Homo sapiens
ggagggagccaugaagcau

SEQ ID NO: 654541 - RNA, 19 nt, Homo sapiens
gaaggaugaggauguucug

SEQ ID NO: 654542 - RNA, 19 nt, Homo sapiens
ccauugcggagaucaagaa

SEQ ID NO: 654543 - RNA, 19 nt, Homo sapiens
gcaccgcagcuaccugaag

SEQ ID NO: 654544 - RNA, 19 nt, Homo sapiens
gugacggucuuccuaacag

SEQ ID NO: 654545 - RNA, 19 nt, Homo sapiens
gggcaagucccugaaggau

SEQ ID NO: 654546 - RNA, 19 nt, Homo sapiens
agacgcggaagaucccaua

SEQ ID NO: 654547 - RNA, 19 nt, Homo sapiens
ucuaccugcucuucuacuu

SEQ ID NO: 654548 - RNA, 19 nt, Homo sapiens
ucagcugggugacggucuu

SEQ ID NO: 654549 - RNA, 19 nt, Homo sapiens
ccacggccacacuguacuu

SEQ ID NO: 654550 - RNA, 19 nt, Homo sapiens
gaacuagauucccuaauua

SEQ ID NO: 654551 - RNA, 19 nt, Homo sapiens
gaaaugccgucucuacuaa

SEQ ID NO: 654552 - RNA, 19 nt, Homo sapiens
gaaauggucucccuuugaa

SEQ ID NO: 654553 - RNA, 19 nt, Homo sapiens
aaacagaaauuacccagua

SEQ ID NO: 654554 - RNA, 19 nt, Homo sapiens
gaauuaugcucuuauguga

SEQ ID NO: 654555 - RNA, 19 nt, Homo sapiens
ggaaguuucuugucuguga

SEQ ID NO: 654556 - RNA, 19 nt, Homo sapiens
gaaaugagcgauauaugaa

SEQ ID NO: 654557 - RNA, 19 nt, Homo sapiens
ggaagaugcuuaccauaug

SEQ ID NO: 654558 - RNA, 19 nt, Homo sapiens
ggaaaugagcgauauauga

SEQ ID NO: 654559 - RNA, 19 nt, Homo sapiens
ugaacuagauucccuaauu

SEQ ID NO: 654560 - RNA, 19 nt, Homo sapiens
ccucugaucuuguuucuaa

SEQ ID NO: 654561 - RNA, 19 nt, Homo sapiens
gauauaaccuauugacugu

SEQ ID NO: 654562 - RNA, 19 nt, Homo sapiens
gaaagaggcugugauacug

SEQ ID NO: 654563 - RNA, 19 nt, Homo sapiens
gcucuuaugugaaguaaau

SEQ ID NO: 654564 - RNA, 19 nt, Homo sapiens
gagaacaagcccuccauua

SEQ ID NO: 654565 - RNA, 19 nt, Homo sapiens
gaaaacagaugguuauuca

SEQ ID NO: 654566 - RNA, 19 nt, Homo sapiens
ggugguagguguguaauuu

SEQ ID NO: 654567 - RNA, 19 nt, Homo sapiens
gaacaagcccuccauuauc

SEQ ID NO: 654568 - RNA, 19 nt, Homo sapiens
ggauguguuucauacuuua

SEQ ID NO: 654569 - RNA, 19 nt, Homo sapiens
ggaugucccuggagauaaa

SEQ ID NO: 654570 - RNA, 19 nt, Homo sapiens
gaagaugcuuaccauaugu

SEQ ID NO: 654571 - RNA, 19 nt, Homo sapiens
gcugugauacugccuauua

SEQ ID NO: 654572 - RNA, 19 nt, Homo sapiens
acagugcucuuaauaguuu

SEQ ID NO: 654573 - RNA, 19 nt, Homo sapiens
gaaauacacaucucacuuc

SEQ ID NO: 654574 - RNA, 19 nt, Homo sapiens
ggaaauggucucccuuuga

SEQ ID NO: 654575 - RNA, 19 nt, Homo sapiens
gaggauguguuucauacuu

SEQ ID NO: 654576 - RNA, 19 nt, Homo sapiens
uaaauaaucugaggaugug

SEQ ID NO: 654577 - RNA, 19 nt, Homo sapiens
ucugggagcuacaaauaua

SEQ ID NO: 654578 - RNA, 19 nt, Homo sapiens
gauaaagccaagcaaagua

SEQ ID NO: 654579 - RNA, 19 nt, Homo sapiens
gggcaaaguguacagaaua

SEQ ID NO: 654580 - RNA, 19 nt, Homo sapiens
gaaugguggucuuugcaaa

SEQ ID NO: 654581 - RNA, 19 nt, Homo sapiens
gagcagcaauguuuaaacu

SEQ ID NO: 654582 - RNA, 19 nt, Homo sapiens
gaagccgcacguagaauua

SEQ ID NO: 654583 - RNA, 19 nt, Homo sapiens
gaaaaggccugaauuaugc

SEQ ID NO: 654584 - RNA, 19 nt, Homo sapiens
acagugaaauucuaucuug

SEQ ID NO: 654585 - RNA, 19 nt, Homo sapiens
caaggaagaugcuuaccau

SEQ ID NO: 654586 - RNA, 19 nt, Homo sapiens
cgauagaucuggcuagcaa

SEQ ID NO: 654587 - RNA, 19 nt, Homo sapiens
ccacacauauguuaucagu

SEQ ID NO: 654588 - RNA, 19 nt, Homo sapiens
ugaaauugauucucucugu

SEQ ID NO: 654589 - RNA, 19 nt, Homo sapiens
ggaaauacacaucucacuu

SEQ ID NO: 654590 - RNA, 19 nt, Homo sapiens
auacacaucucacuucaga

SEQ ID NO: 654591 - RNA, 19 nt, Homo sapiens
gcaaagcagcgcaagaaga

SEQ ID NO: 654592 - RNA, 19 nt, Homo sapiens
ugacguugcuggacuugaa

SEQ ID NO: 654593 - RNA, 19 nt, Homo sapiens
guaaugcgcaccuuugcua

SEQ ID NO: 654594 - RNA, 19 nt, Homo sapiens
gauuggguuugaaagauuu

SEQ ID NO: 654595 - RNA, 19 nt, Homo sapiens
ggcaaaguguacagaauau

SEQ ID NO: 654596 - RNA, 19 nt, Homo sapiens
ccaaagaagcacugaaaga

SEQ ID NO: 654597 - RNA, 19 nt, Homo sapiens
gacuguauucuguguauua

SEQ ID NO: 654598 - RNA, 19 nt, Homo sapiens
gggugucuguguacauaua

SEQ ID NO: 654599 - RNA, 19 nt, Homo sapiens
ugaaaugccgucucuacua

SEQ ID NO: 654600 - RNA, 19 nt, Homo sapiens
agacagugcucuuaauagu

SEQ ID NO: 654601 - RNA, 19 nt, Homo sapiens
ggaaggagaaucugaugau

SEQ ID NO: 654602 - RNA, 19 nt, Homo sapiens
cuacuuagccaaagcugua

SEQ ID NO: 654603 - RNA, 19 nt, Homo sapiens
gaaauggagugacguugcu

SEQ ID NO: 654604 - RNA, 19 nt, Homo sapiens
gaaggagaaucugaugauc

SEQ ID NO: 654605 - RNA, 19 nt, Homo sapiens
ccuauugacuguauucugu

SEQ ID NO: 654606 - RNA, 19 nt, Homo sapiens
ggaaaaggccugaauuaug

SEQ ID NO: 654607 - RNA, 19 nt, Homo sapiens
gaauugcauugucuauaca

SEQ ID NO: 654608 - RNA, 19 nt, Homo sapiens
ucaguguaaugcuuuauga

SEQ ID NO: 654609 - RNA, 19 nt, Homo sapiens
ggucuuguccuucaccuuu

SEQ ID NO: 654610 - RNA, 19 nt, Homo sapiens
ucacuucagaguuccauua

SEQ ID NO: 654611 - RNA, 19 nt, Homo sapiens
gagcugauccuaaccaucu

SEQ ID NO: 654612 - RNA, 19 nt, Homo sapiens
uccauuaucuucauugaug

SEQ ID NO: 654613 - RNA, 19 nt, Homo sapiens
uuugggaccuucuguguaa

SEQ ID NO: 654614 - RNA, 19 nt, Homo sapiens
gagagaguguugucuaaaa

SEQ ID NO: 654615 - RNA, 19 nt, Homo sapiens
guucugggagcuacaaaua

SEQ ID NO: 654616 - RNA, 19 nt, Homo sapiens
gccaacaacucaacauuuu

SEQ ID NO: 654617 - RNA, 19 nt, Homo sapiens
ccuauuaaauuuccucauc

SEQ ID NO: 654618 - RNA, 19 nt, Homo sapiens
ucaaggugccauuguuaua

SEQ ID NO: 654619 - RNA, 19 nt, Homo sapiens
gaaacuacagaaucaacuu

SEQ ID NO: 654620 - RNA, 19 nt, Homo sapiens
gccauuaggcgaagauuug

SEQ ID NO: 654621 - RNA, 19 nt, Homo sapiens
agaacaagcccuccauuau

SEQ ID NO: 654622 - RNA, 19 nt, Homo sapiens
caacagaagccaacaacuc

SEQ ID NO: 654623 - RNA, 19 nt, Homo sapiens
agaauugcauugucuauac

SEQ ID NO: 654624 - RNA, 19 nt, Homo sapiens
uggagagaguguugucuaa

SEQ ID NO: 654625 - RNA, 19 nt, Homo sapiens
gagcugagaucgcgcuacu

SEQ ID NO: 654626 - RNA, 19 nt, Homo sapiens
acucagggaugggcaauaa

SEQ ID NO: 654627 - RNA, 19 nt, Homo sapiens
ggccugaauuaugcucuua

SEQ ID NO: 654628 - RNA, 19 nt, Homo sapiens
gucaugaaauacuguaaug

SEQ ID NO: 654629 - RNA, 19 nt, Homo sapiens
uaacugucaugaaauacug

SEQ ID NO: 654630 - RNA, 19 nt, Homo sapiens
gcauuaauuguuuccagua

SEQ ID NO: 654631 - RNA, 19 nt, Homo sapiens
gaccacacauauguuauca

SEQ ID NO: 654632 - RNA, 19 nt, Homo sapiens
ugauuggguuugaaagauu

SEQ ID NO: 654633 - RNA, 19 nt, Homo sapiens
guucuggauucugccauua

SEQ ID NO: 654634 - RNA, 19 nt, Homo sapiens
uguagacaaugauggaauu

SEQ ID NO: 654635 - RNA, 19 nt, Homo sapiens
gaaagugaagccgcacgua

SEQ ID NO: 654636 - RNA, 19 nt, Homo sapiens
gcccuuaugcagccuguua

SEQ ID NO: 654637 - RNA, 19 nt, Homo sapiens
gcgaagauuugagaaacga

SEQ ID NO: 654638 - RNA, 19 nt, Homo sapiens
agccaaagcuguagcaaca

SEQ ID NO: 654639 - RNA, 19 nt, Homo sapiens
caaagaagcacugaaagag

SEQ ID NO: 654640 - RNA, 19 nt, Homo sapiens
gauauggggugucugugua

SEQ ID NO: 654641 - RNA, 19 nt, Homo sapiens
gaggaaaugagcgauauau

SEQ ID NO: 654642 - RNA, 19 nt, Homo sapiens
agacaaggcugggaacuac

SEQ ID NO: 654643 - RNA, 19 nt, Homo sapiens
cacagaagccagugaaaga

SEQ ID NO: 654644 - RNA, 19 nt, Homo sapiens
ggagagaguguugucuaaa

SEQ ID NO: 654645 - RNA, 19 nt, Homo sapiens
uggaucgcauuaauuguuu

SEQ ID NO: 654646 - RNA, 19 nt, Homo sapiens
gauccuaaccaucuuguag

SEQ ID NO: 654647 - RNA, 19 nt, Homo sapiens
gcacagaagccagugaaag

SEQ ID NO: 654648 - RNA, 19 nt, Homo sapiens
ugaauuaugcucuuaugug

SEQ ID NO: 654649 - RNA, 19 nt, Homo sapiens
gugaaauucuaucuugcaa

SEQ ID NO: 654650 - RNA, 19 nt, Homo sapiens
gaacagaugggacaauaaa

SEQ ID NO: 654651 - RNA, 19 nt, Homo sapiens
gggaacagaugggacaaua

SEQ ID NO: 654652 - RNA, 19 nt, Homo sapiens
cguaagcccuguacaugua

SEQ ID NO: 654653 - RNA, 19 nt, Homo sapiens
gagacucaguugaauaaug

SEQ ID NO: 654654 - RNA, 19 nt, Homo sapiens
gaaaugcuacgaccaacuu

SEQ ID NO: 654655 - RNA, 19 nt, Homo sapiens
gugcuucucucaccucuga

SEQ ID NO: 654656 - RNA, 19 nt, Homo sapiens
cagcaucacuaacaacuuc

SEQ ID NO: 654657 - RNA, 19 nt, Homo sapiens
aauaaagacuggagacuca

SEQ ID NO: 654658 - RNA, 19 nt, Homo sapiens
gagccaggguuuucuuuua

SEQ ID NO: 654659 - RNA, 19 nt, Homo sapiens
ggaacagaugggacaauaa

SEQ ID NO: 654660 - RNA, 19 nt, Homo sapiens
acuaacaacuucccauuca

SEQ ID NO: 654661 - RNA, 19 nt, Homo sapiens
ccugauggcugggaccuuu

SEQ ID NO: 654662 - RNA, 19 nt, Homo sapiens
ucaagauucuccucagcaa

SEQ ID NO: 654663 - RNA, 19 nt, Homo sapiens
gaaacaaaugguugaugga

SEQ ID NO: 654664 - RNA, 19 nt, Homo sapiens
acauuugagugcuuucgua

SEQ ID NO: 654665 - RNA, 19 nt, Homo sapiens
ccgcccagcugcucuucua

SEQ ID NO: 654666 - RNA, 19 nt, Homo sapiens
uggagacucaguugaauaa

SEQ ID NO: 654667 - RNA, 19 nt, Homo sapiens
gguugagucuccagucugu

SEQ ID NO: 654668 - RNA, 19 nt, Homo sapiens
agacucaguugaauaaugc

SEQ ID NO: 654669 - RNA, 19 nt, Homo sapiens
gcccgaaucuucacuucca

SEQ ID NO: 654670 - RNA, 19 nt, Homo sapiens
ggccagcucucagccauca

SEQ ID NO: 654671 - RNA, 19 nt, Homo sapiens
cauuguggcuggcucacuu

SEQ ID NO: 654672 - RNA, 19 nt, Homo sapiens
acagaugggacaauaaaga

SEQ ID NO: 654673 - RNA, 19 nt, Homo sapiens
ugagaaaugcuacgaccaa

SEQ ID NO: 654674 - RNA, 19 nt, Homo sapiens
ucacuaacaacuucccauu

SEQ ID NO: 654675 - RNA, 19 nt, Homo sapiens
guggcuggcucacuucuag

SEQ ID NO: 654676 - RNA, 19 nt, Homo sapiens
acacuauccugggcaaaug

SEQ ID NO: 654677 - RNA, 19 nt, Homo sapiens
uagagucucccaagccaaa

SEQ ID NO: 654678 - RNA, 19 nt, Homo sapiens
gucauuccguuuccacuca

SEQ ID NO: 654679 - RNA, 19 nt, Homo sapiens
ucgcuuuccucgcuugcua

SEQ ID NO: 654680 - RNA, 19 nt, Homo sapiens
gcuccaggccuccaaugug

SEQ ID NO: 654681 - RNA, 19 nt, Homo sapiens
caagauucuccucagcaaa

SEQ ID NO: 654682 - RNA, 19 nt, Homo sapiens
aaacaaaugguugauggau

SEQ ID NO: 654683 - RNA, 19 nt, Homo sapiens
ucuacagcaucacuaacaa

SEQ ID NO: 654684 - RNA, 19 nt, Homo sapiens
aaucuucacuuccauucag

SEQ ID NO: 654685 - RNA, 19 nt, Homo sapiens
agccaagccuccuccucua

SEQ ID NO: 654686 - RNA, 19 nt, Homo sapiens
cauuugagugcuuucguaa

SEQ ID NO: 654687 - RNA, 19 nt, Homo sapiens
ucucagccaucacagucuu

SEQ ID NO: 654688 - RNA, 19 nt, Homo sapiens
gcucacuucuaguaaagcu

SEQ ID NO: 654689 - RNA, 19 nt, Homo sapiens
cuggcucacuucuaguaaa

SEQ ID NO: 654690 - RNA, 19 nt, Homo sapiens
ggcuggcucacuucuagua

SEQ ID NO: 654691 - RNA, 19 nt, Homo sapiens
caagccuccuccucuagca

SEQ ID NO: 654692 - RNA, 19 nt, Homo sapiens
gcacuacagaggacagacu

SEQ ID NO: 654693 - RNA, 19 nt, Homo sapiens
uggcucacuucuaguaaag

SEQ ID NO: 654694 - RNA, 19 nt, Homo sapiens
ccaggcagccaccaacuac

SEQ ID NO: 654695 - RNA, 19 nt, Homo sapiens
gcucgugccgauucuuuua

SEQ ID NO: 654696 - RNA, 19 nt, Homo sapiens
ugcuggagcuaguggcauu

SEQ ID NO: 654697 - RNA, 19 nt, Homo sapiens
gaaguugacugucuugaua

SEQ ID NO: 654698 - RNA, 19 nt, Homo sapiens
cagaagaacugagcuauuu

SEQ ID NO: 654699 - RNA, 19 nt, Homo sapiens
gaaagaacaugaccaccuu

SEQ ID NO: 654700 - RNA, 19 nt, Homo sapiens
gaacuugaccugaaacuag

SEQ ID NO: 654701 - RNA, 19 nt, Homo sapiens
gaacaugaccaccuucgaa

SEQ ID NO: 654702 - RNA, 19 nt, Homo sapiens
gaagucaauucacagcaaa

SEQ ID NO: 654703 - RNA, 19 nt, Homo sapiens
gggaagaucucaggaaaca

SEQ ID NO: 654704 - RNA, 19 nt, Homo sapiens
aaauaugacuucacagaga

SEQ ID NO: 654705 - RNA, 19 nt, Homo sapiens
ggaagacgcgacagguaua

SEQ ID NO: 654706 - RNA, 19 nt, Homo sapiens
gagacauauugcaggauua

SEQ ID NO: 654707 - RNA, 19 nt, Homo sapiens
ggaguaaacaacagaagaa

SEQ ID NO: 654708 - RNA, 19 nt, Homo sapiens
ucacagagaggaauguuga

SEQ ID NO: 654709 - RNA, 19 nt, Homo sapiens
ggaaagggagaaucuuaug

SEQ ID NO: 654710 - RNA, 19 nt, Homo sapiens
caagacagaauguuugaga

SEQ ID NO: 654711 - RNA, 19 nt, Homo sapiens
caacagaagaacugagcua

SEQ ID NO: 654712 - RNA, 19 nt, Homo sapiens
guaaacaacagaagaacug

SEQ ID NO: 654713 - RNA, 19 nt, Homo sapiens
aaaugaacuugaccugaaa

SEQ ID NO: 654714 - RNA, 19 nt, Homo sapiens
gggagaaguugacugucuu

SEQ ID NO: 654715 - RNA, 19 nt, Homo sapiens
gaaaauaugacuucacaga

SEQ ID NO: 654716 - RNA, 19 nt, Homo sapiens
agagacauauugcaggauu

SEQ ID NO: 654717 - RNA, 19 nt, Homo sapiens
ggagggagaaguugacugu

SEQ ID NO: 654718 - RNA, 19 nt, Homo sapiens
ggaaacaucggagggagaa

SEQ ID NO: 654719 - RNA, 19 nt, Homo sapiens
gcaggauuauacacaugaa

SEQ ID NO: 654720 - RNA, 19 nt, Homo sapiens
gacagaauguuugagacaa

SEQ ID NO: 654721 - RNA, 19 nt, Homo sapiens
aaaaugaacuugaccugaa

SEQ ID NO: 654722 - RNA, 19 nt, Homo sapiens
cgggaaagggagaaucuua

SEQ ID NO: 654723 - RNA, 19 nt, Homo sapiens
cgauugagauugaacaacu

SEQ ID NO: 654724 - RNA, 19 nt, Homo sapiens
caacaccccuuuuaaaugg

SEQ ID NO: 654725 - RNA, 19 nt, Homo sapiens
gagcugaagccacaguuuc

SEQ ID NO: 654726 - RNA, 19 nt, Homo sapiens
gauugagauugaacaacuu

SEQ ID NO: 654727 - RNA, 19 nt, Homo sapiens
gaaagggagaaucuuaugg

SEQ ID NO: 654728 - RNA, 19 nt, Homo sapiens
gggaaagggagaaucuuau

SEQ ID NO: 654729 - RNA, 19 nt, Homo sapiens
aagcaaacuuuauggcaau

SEQ ID NO: 654730 - RNA, 19 nt, Homo sapiens
gaucaagccaagacagaau

SEQ ID NO: 654731 - RNA, 19 nt, Homo sapiens
cgacagguauaguucugau

SEQ ID NO: 654732 - RNA, 19 nt, Homo sapiens
cugggaagaucucaggaaa

SEQ ID NO: 654733 - RNA, 19 nt, Homo sapiens
agagaggaauguugaaguc

SEQ ID NO: 654734 - RNA, 19 nt, Homo sapiens
ggauuauacacaugaauuc

SEQ ID NO: 654735 - RNA, 19 nt, Homo sapiens
cggcagggaccagcaguua

SEQ ID NO: 654736 - RNA, 19 nt, Homo sapiens
cagaauguuugagacaaug

SEQ ID NO: 654737 - RNA, 19 nt, Homo sapiens
ggcagaauauaccaacagu

SEQ ID NO: 654738 - RNA, 19 nt, Homo sapiens
acagaauguuugagacaau

SEQ ID NO: 654739 - RNA, 19 nt, Homo sapiens
uguaugcguuccauugaug

SEQ ID NO: 654740 - RNA, 19 nt, Homo sapiens
ucugauagaagagacaaua

SEQ ID NO: 654741 - RNA, 19 nt, Homo sapiens
gccaagacagaauguuuga

SEQ ID NO: 654742 - RNA, 19 nt, Homo sapiens
ugacugucuugauaauuag

SEQ ID NO: 654743 - RNA, 19 nt, Homo sapiens
gcuguaugcguuccauuga

SEQ ID NO: 654744 - RNA, 19 nt, Homo sapiens
aaaagugggucuggaguaa

SEQ ID NO: 654745 - RNA, 19 nt, Homo sapiens
ggagaaguugacugucuug

SEQ ID NO: 654746 - RNA, 19 nt, Homo sapiens
gauagaagagacaauaagc

SEQ ID NO: 654747 - RNA, 19 nt, Homo sapiens
acagcggcauagagacaua

SEQ ID NO: 654748 - RNA, 19 nt, Homo sapiens
aagccaagacagaauguuu

SEQ ID NO: 654749 - RNA, 19 nt, Homo sapiens
acacuuuggccaaucguuu

SEQ ID NO: 654750 - RNA, 19 nt, Homo sapiens
ggaucaagccaagacagaa

SEQ ID NO: 654751 - RNA, 19 nt, Homo sapiens
gauacaacaccccuuuuaa

SEQ ID NO: 654752 - RNA, 19 nt, Homo sapiens
guuucucugugcuguguuu

SEQ ID NO: 654753 - RNA, 19 nt, Homo sapiens
ggucuggaauaaggaaaca

SEQ ID NO: 654754 - RNA, 19 nt, Homo sapiens
gcagggaccagcaguuacu

SEQ ID NO: 654755 - RNA, 19 nt, Homo sapiens
cauuacagcggcauagaga

SEQ ID NO: 654756 - RNA, 19 nt, Homo sapiens
uagaagagacaauaagcau

SEQ ID NO: 654757 - RNA, 19 nt, Homo sapiens
ugaccaccuucgaaacuca

SEQ ID NO: 654758 - RNA, 19 nt, Homo sapiens
acagaagaacugagcuauu

SEQ ID NO: 654759 - RNA, 19 nt, Homo sapiens
cagcccugaugcauacauu

SEQ ID NO: 654760 - RNA, 19 nt, Homo sapiens
ggagaaucuuaugggauca

SEQ ID NO: 654761 - RNA, 19 nt, Homo sapiens
acagcaaaaugaacacuuu

SEQ ID NO: 654762 - RNA, 19 nt, Homo sapiens
gaagacgcgacagguauag

SEQ ID NO: 654763 - RNA, 19 nt, Homo sapiens
gaugaaugcaagacugaca

SEQ ID NO: 654764 - RNA, 19 nt, Homo sapiens
caucggagggagaaguuga

SEQ ID NO: 654765 - RNA, 19 nt, Homo sapiens
acacccuggucuggaauaa

SEQ ID NO: 654766 - RNA, 19 nt, Homo sapiens
gguguuauugggaucugua

SEQ ID NO: 654767 - RNA, 19 nt, Homo sapiens
aaugaacacuuuggccaau

SEQ ID NO: 654768 - RNA, 19 nt, Homo sapiens
ggucuggaguaaacaacag

SEQ ID NO: 654769 - RNA, 19 nt, Homo sapiens
cuuaugggaucaguacgaa

SEQ ID NO: 654770 - RNA, 19 nt, Homo sapiens
ucaauucacagcaaaauga

SEQ ID NO: 654771 - RNA, 19 nt, Homo sapiens
agaagagacaauaagcauu

SEQ ID NO: 654772 - RNA, 19 nt, Homo sapiens
gacagguauaguucugaua

SEQ ID NO: 654773 - RNA, 19 nt, Homo sapiens
ucagcaaacuauguacaag

SEQ ID NO: 654774 - RNA, 19 nt, Homo sapiens
gcgggacucgcucauccua

SEQ ID NO: 654775 - RNA, 19 nt, Homo sapiens
uggaagacgcgacagguau

SEQ ID NO: 654776 - RNA, 19 nt, Homo sapiens
agggagaaguugacugucu

SEQ ID NO: 654777 - RNA, 19 nt, Homo sapiens
gagaggaauguugaaguca

SEQ ID NO: 654778 - RNA, 19 nt, Homo sapiens
gaucgucugauagaagaga

SEQ ID NO: 654779 - RNA, 19 nt, Homo sapiens
uaaacaacagaagaacuga

SEQ ID NO: 654780 - RNA, 19 nt, Homo sapiens
cagcaaacuauguacaagu

SEQ ID NO: 654781 - RNA, 19 nt, Homo sapiens
agacagaauguuugagaca

SEQ ID NO: 654782 - RNA, 19 nt, Homo sapiens
caguuucucugugcugugu

SEQ ID NO: 654783 - RNA, 19 nt, Homo sapiens
gugauggacucugugacau

SEQ ID NO: 654784 - RNA, 19 nt, Homo sapiens
agacgcgacagguauaguu

SEQ ID NO: 654785 - RNA, 19 nt, Homo sapiens
caaacuuuauggcaauacg

SEQ ID NO: 654786 - RNA, 19 nt, Homo sapiens
agacauauugcaggauuau

SEQ ID NO: 654787 - RNA, 19 nt, Homo sapiens
ugauacaacaccccuuuua

SEQ ID NO: 654788 - RNA, 19 nt, Homo sapiens
cucgacagcuggaaaauga

SEQ ID NO: 654789 - RNA, 19 nt, Homo sapiens
gacauauugcaggauuaua

SEQ ID NO: 654790 - RNA, 19 nt, Homo sapiens
caucuucagggacucuuga

SEQ ID NO: 654791 - RNA, 19 nt, Homo sapiens
cagagaggaauguugaagu

SEQ ID NO: 654792 - RNA, 19 nt, Homo sapiens
aacaugaccaccuucgaaa

SEQ ID NO: 654793 - RNA, 19 nt, Homo sapiens
acgaaaagauauugaguca

SEQ ID NO: 654794 - RNA, 19 nt, Homo sapiens
gaaucuuaugggaucagua

SEQ ID NO: 654795 - RNA, 19 nt, Homo sapiens
guacaaguuacagucauag

SEQ ID NO: 654796 - RNA, 19 nt, Homo sapiens
gaaaugaccuuuaaugaca

SEQ ID NO: 654797 - RNA, 19 nt, Homo sapiens
gaacuaaauuggaauguga

SEQ ID NO: 654798 - RNA, 19 nt, Homo sapiens
ggaauugacuuaaaucgaa

SEQ ID NO: 654799 - RNA, 19 nt, Homo sapiens
gcacagagcuucauaaccu

SEQ ID NO: 654800 - RNA, 19 nt, Homo sapiens
ggauauaggccuuaagaaa

SEQ ID NO: 654801 - RNA, 19 nt, Homo sapiens
gcaggagccuacaaauuug

SEQ ID NO: 654802 - RNA, 19 nt, Homo sapiens
gauauaggccuuaagaaau

SEQ ID NO: 654803 - RNA, 19 nt, Homo sapiens
gggcggagcugaagugaca

SEQ ID NO: 654804 - RNA, 19 nt, Homo sapiens
agaaucaucucuaagcaaa

SEQ ID NO: 654805 - RNA, 19 nt, Homo sapiens
caccuacucuuuccucuaa

SEQ ID NO: 654806 - RNA, 19 nt, Homo sapiens
gaaugugaaucugcaugua

SEQ ID NO: 654807 - RNA, 19 nt, Homo sapiens
gagcaggagccuacaaauu

SEQ ID NO: 654808 - RNA, 19 nt, Homo sapiens
gaguaucuauggugacuug

SEQ ID NO: 654809 - RNA, 19 nt, Homo sapiens
cuacagcuguggagcagua

SEQ ID NO: 654810 - RNA, 19 nt, Homo sapiens
gccauucgcugaacugaga

SEQ ID NO: 654811 - RNA, 19 nt, Homo sapiens
ucaaaucugugaagacugu

SEQ ID NO: 654812 - RNA, 19 nt, Homo sapiens
aaacagauauccagcuucu

SEQ ID NO: 654813 - RNA, 19 nt, Homo sapiens
gcacaggaauuuucuugaa

SEQ ID NO: 654814 - RNA, 19 nt, Homo sapiens
caauaugcuugccaucuug

SEQ ID NO: 654815 - RNA, 19 nt, Homo sapiens
gaagauggagaaagugaug

SEQ ID NO: 654816 - RNA, 19 nt, Homo sapiens
ggaaaugaccuuuaaugac

SEQ ID NO: 654817 - RNA, 19 nt, Homo sapiens
uuuaagagguggauguuug

SEQ ID NO: 654818 - RNA, 19 nt, Homo sapiens
gauguuugggauuguauua

SEQ ID NO: 654819 - RNA, 19 nt, Homo sapiens
cuaaacagauauccagcuu

SEQ ID NO: 654820 - RNA, 19 nt, Homo sapiens
uauggugacuuggaguuua

SEQ ID NO: 654821 - RNA, 19 nt, Homo sapiens
gcucaggaauggcccacaa

SEQ ID NO: 654822 - RNA, 19 nt, Homo sapiens
gaagcagggccucuaccua

SEQ ID NO: 654823 - RNA, 19 nt, Homo sapiens
cugagaagcugaguaucua

SEQ ID NO: 654824 - RNA, 19 nt, Homo sapiens
gaagacuguauuugcuaua

SEQ ID NO: 654825 - RNA, 19 nt, Homo sapiens
agcaggagccuacaaauuu

SEQ ID NO: 654826 - RNA, 19 nt, Homo sapiens
gcacaccuacccuaaggaa

SEQ ID NO: 654827 - RNA, 19 nt, Homo sapiens
gaacaaaagcuaaacagau

SEQ ID NO: 654828 - RNA, 19 nt, Homo sapiens
gagacaagaacaacuuaug

SEQ ID NO: 654829 - RNA, 19 nt, Homo sapiens
ugaagacuguauuugcuau

SEQ ID NO: 654830 - RNA, 19 nt, Homo sapiens
guuuguggaugauggaauu

SEQ ID NO: 654831 - RNA, 19 nt, Homo sapiens
agcaggaaaugaccuuuaa

SEQ ID NO: 654832 - RNA, 19 nt, Homo sapiens
caaaugagaaauucacaag

SEQ ID NO: 654833 - RNA, 19 nt, Homo sapiens
gcaaaugagaaauucacaa

SEQ ID NO: 654834 - RNA, 19 nt, Homo sapiens
ccaaucugaugagcaauau

SEQ ID NO: 654835 - RNA, 19 nt, Homo sapiens
gaugauggaauugacuuaa

SEQ ID NO: 654836 - RNA, 19 nt, Homo sapiens
aaagacaaguguaauagac

SEQ ID NO: 654837 - RNA, 19 nt, Homo sapiens
aaacugaagaucaugaaga

SEQ ID NO: 654838 - RNA, 19 nt, Homo sapiens
ccaguacgcaccacauuug

SEQ ID NO: 654839 - RNA, 19 nt, Homo sapiens
agaagcauauucccaaucu

SEQ ID NO: 654840 - RNA, 19 nt, Homo sapiens
uagcaggaaaugaccuuua

SEQ ID NO: 654841 - RNA, 19 nt, Homo sapiens
caagcugaauauuuaguag

SEQ ID NO: 654842 - RNA, 19 nt, Homo sapiens
cuacaaauuugagagaauc

SEQ ID NO: 654843 - RNA, 19 nt, Homo sapiens
ggaugauggaauugacuua

SEQ ID NO: 654844 - RNA, 19 nt, Homo sapiens
gaauggcccacaaaucugu

SEQ ID NO: 654845 - RNA, 19 nt, Homo sapiens
auauaggccuuaagaaauc

SEQ ID NO: 654846 - RNA, 19 nt, Homo sapiens
guauugcuuuggauuuguu

SEQ ID NO: 654847 - RNA, 19 nt, Homo sapiens
cacaagcgcacaggaauuu

SEQ ID NO: 654848 - RNA, 19 nt, Homo sapiens
gaacugagacaagaacaac

SEQ ID NO: 654849 - RNA, 19 nt, Homo sapiens
cgaacuaaauuggaaugug

SEQ ID NO: 654850 - RNA, 19 nt, Homo sapiens
caggaaaugaccuuuaaug

SEQ ID NO: 654851 - RNA, 19 nt, Homo sapiens
aacugaagaucaugaagaa

SEQ ID NO: 654852 - RNA, 19 nt, Homo sapiens
acuuggaguuuaugaauga

SEQ ID NO: 654853 - RNA, 19 nt, Homo sapiens
gcaccuacucuuuccucua

SEQ ID NO: 654854 - RNA, 19 nt, Homo sapiens
ggaaugugaaucugcaugu

SEQ ID NO: 654855 - RNA, 19 nt, Homo sapiens
cuaaggaagaggaguugua

SEQ ID NO: 654856 - RNA, 19 nt, Homo sapiens
gacuuggaguuuaugaaug

SEQ ID NO: 654857 - RNA, 19 nt, Homo sapiens
gugaugguauugcuuugga

SEQ ID NO: 654858 - RNA, 19 nt, Homo sapiens
uaacucuggugaggucauu

SEQ ID NO: 654859 - RNA, 19 nt, Homo sapiens
ucgcugaacugagacaaga

SEQ ID NO: 654860 - RNA, 19 nt, Homo sapiens
caucuugguugccagaauc

SEQ ID NO: 654861 - RNA, 19 nt, Homo sapiens
acagauauccagcuucuuc

SEQ ID NO: 654862 - RNA, 19 nt, Homo sapiens
gaagcugaguaucuauggu

SEQ ID NO: 654863 - RNA, 19 nt, Homo sapiens
gagaagcugaguaucuaug

SEQ ID NO: 654864 - RNA, 19 nt, Homo sapiens
ggagaagaaguucguaguc

SEQ ID NO: 654865 - RNA, 19 nt, Homo sapiens
aagcauauucccaaucuga

SEQ ID NO: 654866 - RNA, 19 nt, Homo sapiens
ggaauggcccacaaaucug

SEQ ID NO: 654867 - RNA, 19 nt, Homo sapiens
gaagaagcagggccucuac

SEQ ID NO: 654868 - RNA, 19 nt, Homo sapiens
ugacuuggaguuuaugaau

SEQ ID NO: 654869 - RNA, 19 nt, Homo sapiens
acaccuacccuaaggaaga

SEQ ID NO: 654870 - RNA, 19 nt, Homo sapiens
ugaagaucaugaagaagca

SEQ ID NO: 654871 - RNA, 19 nt, Homo sapiens
uuaugucccugaugccaaa

SEQ ID NO: 654872 - RNA, 19 nt, Homo sapiens
aggaaaugaccuuuaauga

SEQ ID NO: 654873 - RNA, 19 nt, Homo sapiens
gcaggaggcggcaguuucu

SEQ ID NO: 654874 - RNA, 19 nt, Homo sapiens
gugaagacuguauuugcua

SEQ ID NO: 654875 - RNA, 19 nt, Homo sapiens
uuacucaaaucugugaaga

SEQ ID NO: 654876 - RNA, 19 nt, Homo sapiens
gacucggucuugggugaua

SEQ ID NO: 654877 - RNA, 19 nt, Homo sapiens
ucacaagcgcacaggaauu

SEQ ID NO: 654878 - RNA, 19 nt, Homo sapiens
caaaauguccuaucugcaa

SEQ ID NO: 654879 - RNA, 19 nt, Homo sapiens
ccuacaaauuugagagaau

SEQ ID NO: 654880 - RNA, 19 nt, Homo sapiens
agacaagaacaacuuaugu

SEQ ID NO: 654881 - RNA, 19 nt, Homo sapiens
gcauauucccaaucugaug

SEQ ID NO: 654882 - RNA, 19 nt, Homo sapiens
cagggccucuaccuacaaa

SEQ ID NO: 654883 - RNA, 19 nt, Homo sapiens
agcaguauguucccucuga

SEQ ID NO: 654884 - RNA, 19 nt, Homo sapiens
gaugguauugcuuuggauu

SEQ ID NO: 654885 - RNA, 19 nt, Homo sapiens
cagccuaggagaagaaguu

SEQ ID NO: 654886 - RNA, 19 nt, Homo sapiens
gccagaaucagcugccauu

SEQ ID NO: 654887 - RNA, 19 nt, Homo sapiens
cauauucccaaucugauga

SEQ ID NO: 654888 - RNA, 19 nt, Homo sapiens
guggauguuugggauugua

SEQ ID NO: 654889 - RNA, 19 nt, Homo sapiens
ccucugagaagcugaguau

SEQ ID NO: 654890 - RNA, 19 nt, Homo sapiens
gguauugcuuuggauuugu

SEQ ID NO: 654891 - RNA, 19 nt, Homo sapiens
ugaagaagcagggccucua

SEQ ID NO: 654892 - RNA, 19 nt, Homo sapiens
cuucuucucuugugguugu

SEQ ID NO: 654893 - RNA, 19 nt, Homo sapiens
uucauaaccucuucaugga

SEQ ID NO: 654894 - RNA, 19 nt, Homo sapiens
caggaacugaaaucauuaa

SEQ ID NO: 654895 - RNA, 19 nt, Homo sapiens
gaccuuuaaugacacuaca

SEQ ID NO: 654896 - RNA, 19 nt, Homo sapiens
ggacagaaaucagaaauua

SEQ ID NO: 654897 - RNA, 19 nt, Homo sapiens
gaaauagacucuguagaua

SEQ ID NO: 654898 - RNA, 19 nt, Homo sapiens
ggcauaaccuuacauaaua

SEQ ID NO: 654899 - RNA, 19 nt, Homo sapiens
gaagaaggcauccaagaua

SEQ ID NO: 654900 - RNA, 19 nt, Homo sapiens
caacauccuucuauuagua

SEQ ID NO: 654901 - RNA, 19 nt, Homo sapiens
uaaaggaccagcaauaaua

SEQ ID NO: 654902 - RNA, 19 nt, Homo sapiens
aaacugggcuugucacauu

SEQ ID NO: 654903 - RNA, 19 nt, Homo sapiens
gaaugggaguacugaaaua

SEQ ID NO: 654904 - RNA, 19 nt, Homo sapiens
guagggagauagucacuuu

SEQ ID NO: 654905 - RNA, 19 nt, Homo sapiens
gaacguccuuggaaacuug

SEQ ID NO: 654906 - RNA, 19 nt, Homo sapiens
gaucacauauauugacuug

SEQ ID NO: 654907 - RNA, 19 nt, Homo sapiens
caccaugccuggcuaauuu

SEQ ID NO: 654908 - RNA, 19 nt, Homo sapiens
gcauagcccuuaacaaauc

SEQ ID NO: 654909 - RNA, 19 nt, Homo sapiens
guuaaccacucacuuagua

SEQ ID NO: 654910 - RNA, 19 nt, Homo sapiens
agacacaacuaaagcauuu

SEQ ID NO: 654911 - RNA, 19 nt, Homo sapiens
ggauaaaggaccagcaaua

SEQ ID NO: 654912 - RNA, 19 nt, Homo sapiens
gauaaaggaccagcaauaa

SEQ ID NO: 654913 - RNA, 19 nt, Homo sapiens
gagauugcauuaaagagaa

SEQ ID NO: 654914 - RNA, 19 nt, Homo sapiens
gaaguucuuucauuugaug

SEQ ID NO: 654915 - RNA, 19 nt, Homo sapiens
ucaaagaguuggagcagaa

SEQ ID NO: 654916 - RNA, 19 nt, Homo sapiens
ggagacggguuaccaaugu

SEQ ID NO: 654917 - RNA, 19 nt, Homo sapiens
ggagggagguaguagaaga

SEQ ID NO: 654918 - RNA, 19 nt, Homo sapiens
gaaaccugcucggaauuaa

SEQ ID NO: 654919 - RNA, 19 nt, Homo sapiens
gauguggugugguuuguuu

SEQ ID NO: 654920 - RNA, 19 nt, Homo sapiens
ggauguguauuuccauaaa

SEQ ID NO: 654921 - RNA, 19 nt, Homo sapiens
gaaagagccauuaaaguca

SEQ ID NO: 654922 - RNA, 19 nt, Homo sapiens
gcaauaauaccuuguaagu

SEQ ID NO: 654923 - RNA, 19 nt, Homo sapiens
guaaagggcugaucuucca

SEQ ID NO: 654924 - RNA, 19 nt, Homo sapiens
aagcauagcccuuaacaaa

SEQ ID NO: 654925 - RNA, 19 nt, Homo sapiens
gcuguuaaccacucacuua

SEQ ID NO: 654926 - RNA, 19 nt, Homo sapiens
gaccaggccuuccuagguu

SEQ ID NO: 654927 - RNA, 19 nt, Homo sapiens
ggaaauccaggguaauauu

SEQ ID NO: 654928 - RNA, 19 nt, Homo sapiens
ugcaaacucugaucacaua

SEQ ID NO: 654929 - RNA, 19 nt, Homo sapiens
gugaguaaauucauaagga

SEQ ID NO: 654930 - RNA, 19 nt, Homo sapiens
ugaaauagacucuguagau

SEQ ID NO: 654931 - RNA, 19 nt, Homo sapiens
cagagaugcucauugugua

SEQ ID NO: 654932 - RNA, 19 nt, Homo sapiens
gaagcaaauucuauucagu

SEQ ID NO: 654933 - RNA, 19 nt, Homo sapiens
gaaaccaacauccuucuau

SEQ ID NO: 654934 - RNA, 19 nt, Homo sapiens
gguaauuggucauggaaau

SEQ ID NO: 654935 - RNA, 19 nt, Homo sapiens
auagagagcuuucaguuca

SEQ ID NO: 654936 - RNA, 19 nt, Homo sapiens
caagagaaugagagaaaua

SEQ ID NO: 654937 - RNA, 19 nt, Homo sapiens
ggagcuguuuguguuaaua

SEQ ID NO: 654938 - RNA, 19 nt, Homo sapiens
cagcuugucucucaguauu

SEQ ID NO: 654939 - RNA, 19 nt, Homo sapiens
uagaguacaucuuuggaaa

SEQ ID NO: 654940 - RNA, 19 nt, Homo sapiens
ccugaaaucugaugaaugg

SEQ ID NO: 654941 - RNA, 19 nt, Homo sapiens
gcaacugcguaacugauga

SEQ ID NO: 654942 - RNA, 19 nt, Homo sapiens
aaaccaacauccuucuauu

SEQ ID NO: 654943 - RNA, 19 nt, Homo sapiens
gcaucucucuucuaaagga

SEQ ID NO: 654944 - RNA, 19 nt, Homo sapiens
gaggagcacccaucccaua

SEQ ID NO: 654945 - RNA, 19 nt, Homo sapiens
gaaaaucccuugcuauguc

SEQ ID NO: 654946 - RNA, 19 nt, Homo sapiens
gacagaagcauagcccuua

SEQ ID NO: 654947 - RNA, 19 nt, Homo sapiens
ugaaagagccauuaaaguc

SEQ ID NO: 654948 - RNA, 19 nt, Homo sapiens
cauaaugguucucuucugu

SEQ ID NO: 654949 - RNA, 19 nt, Homo sapiens
gaacuaggcauaaccuuac

SEQ ID NO: 654950 - RNA, 19 nt, Homo sapiens
gcuuucaguucauugauuu

SEQ ID NO: 654951 - RNA, 19 nt, Homo sapiens
ccagagaucucacuuuuga

SEQ ID NO: 654952 - RNA, 19 nt, Homo sapiens
gaacuucuccaagcacaaa

SEQ ID NO: 654953 - RNA, 19 nt, Homo sapiens
gcugaucgcugaccuggau

SEQ ID NO: 654954 - RNA, 19 nt, Homo sapiens
acaagaaacuggagaggau

SEQ ID NO: 654955 - RNA, 19 nt, Homo sapiens
gcauguaauucuuaaacug

SEQ ID NO: 654956 - RNA, 19 nt, Homo sapiens
aauaugagcuacugcaugu

SEQ ID NO: 654957 - RNA, 19 nt, Homo sapiens
cacaguaguuguaggauug

SEQ ID NO: 654958 - RNA, 19 nt, Homo sapiens
gcacauaaugguucucuuc

SEQ ID NO: 654959 - RNA, 19 nt, Homo sapiens
guacugaaauaccagagau

SEQ ID NO: 654960 - RNA, 19 nt, Homo sapiens
ccacaguaguuguaggauu

SEQ ID NO: 654961 - RNA, 19 nt, Homo sapiens
caaggcaggucauuggaau

SEQ ID NO: 654962 - RNA, 19 nt, Homo sapiens
cagcaauaauaccuuguaa

SEQ ID NO: 654963 - RNA, 19 nt, Homo sapiens
guacauguucuguuucauu

SEQ ID NO: 654964 - RNA, 19 nt, Homo sapiens
uaaagcauuugaccugaga

SEQ ID NO: 654965 - RNA, 19 nt, Homo sapiens
gaaauccaggguaauauuc

SEQ ID NO: 654966 - RNA, 19 nt, Homo sapiens
uaaaggauguguauuucca

SEQ ID NO: 654967 - RNA, 19 nt, Homo sapiens
aagcaucucucuucuaaag

SEQ ID NO: 654968 - RNA, 19 nt, Homo sapiens
gguuaccaaugucagguua

SEQ ID NO: 654969 - RNA, 19 nt, Homo sapiens
ccuuugagauugcauuaaa

SEQ ID NO: 654970 - RNA, 19 nt, Homo sapiens
ggaagcagacacaacuaaa

SEQ ID NO: 654971 - RNA, 19 nt, Homo sapiens
gggagauagucacuuuaaa

SEQ ID NO: 654972 - RNA, 19 nt, Homo sapiens
gguaauauucucuuucaga

SEQ ID NO: 654973 - RNA, 19 nt, Homo sapiens
gaguacaucuuuggaaauc

SEQ ID NO: 654974 - RNA, 19 nt, Homo sapiens
guucugaagugccuugaga

SEQ ID NO: 654975 - RNA, 19 nt, Homo sapiens
gaaaagguccucaagagaa

SEQ ID NO: 654976 - RNA, 19 nt, Homo sapiens
guaucacacuuuaaccaaa

SEQ ID NO: 654977 - RNA, 19 nt, Homo sapiens
uggagaggauucuaacaaa

SEQ ID NO: 654978 - RNA, 19 nt, Homo sapiens
uuaguaggcuucaggaaau

SEQ ID NO: 654979 - RNA, 19 nt, Homo sapiens
ugaagugccuugagaacau

SEQ ID NO: 654980 - RNA, 19 nt, Homo sapiens
gaaacacucauaccuguag

SEQ ID NO: 654981 - RNA, 19 nt, Homo sapiens
gcauuaaagagaagggaua

SEQ ID NO: 654982 - RNA, 19 nt, Homo sapiens
agaguaagguucaaacaca

SEQ ID NO: 654983 - RNA, 19 nt, Homo sapiens
gagcacccaucccauaaag

SEQ ID NO: 654984 - RNA, 19 nt, Homo sapiens
gcaaugaacccuguugaca

SEQ ID NO: 654985 - RNA, 19 nt, Homo sapiens
ggaguagccuuaaauaccu

SEQ ID NO: 654986 - RNA, 19 nt, Homo sapiens
gagauagucacuuuaaaca

SEQ ID NO: 654987 - RNA, 19 nt, Homo sapiens
uaaugguucucuucuguug

SEQ ID NO: 654988 - RNA, 19 nt, Homo sapiens
acucauaccuguaguugga

SEQ ID NO: 654989 - RNA, 19 nt, Homo sapiens
gaguaagguucaaacacaa

SEQ ID NO: 654990 - RNA, 19 nt, Homo sapiens
caaacucugaucacauaua

SEQ ID NO: 654991 - RNA, 19 nt, Homo sapiens
acaaaacccuucugaauug

SEQ ID NO: 654992 - RNA, 19 nt, Homo sapiens
ggauugaaauacagaacau

SEQ ID NO: 654993 - RNA, 19 nt, Homo sapiens
guguaaggcugccaggaaa

SEQ ID NO: 654994 - RNA, 19 nt, Homo sapiens
gcacaaaacccuucugaau

SEQ ID NO: 654995 - RNA, 19 nt, Homo sapiens
gaccugagacagaaucauu

SEQ ID NO: 654996 - RNA, 19 nt, Homo sapiens
gcaaaggaauggaagaaua

SEQ ID NO: 654997 - RNA, 19 nt, Homo sapiens
caaguagacucacuccuua

SEQ ID NO: 654998 - RNA, 19 nt, Homo sapiens
gaaacuggauauaaucuga

SEQ ID NO: 654999 - RNA, 19 nt, Homo sapiens
gaacaaugaugauucagau

SEQ ID NO: 655000 - RNA, 19 nt, Homo sapiens
gaaaagaggcuguuuguaa

SEQ ID NO: 655001 - RNA, 19 nt, Homo sapiens
aaacguauacucccucuua

SEQ ID NO: 655002 - RNA, 19 nt, Homo sapiens
ucagaaaccuaccagauga

SEQ ID NO: 655003 - RNA, 19 nt, Homo sapiens
gaaaggauuuagaacaaag

SEQ ID NO: 655004 - RNA, 19 nt, Homo sapiens
ugacugcuuucaacauaua

SEQ ID NO: 655005 - RNA, 19 nt, Homo sapiens
uuaccaauauugccaagua

SEQ ID NO: 655006 - RNA, 19 nt, Homo sapiens
ccacagaaguuccaaguac

SEQ ID NO: 655007 - RNA, 19 nt, Homo sapiens
gccagaguuugaauucuua

SEQ ID NO: 655008 - RNA, 19 nt, Homo sapiens
gaccaaagaacacuugauu

SEQ ID NO: 655009 - RNA, 19 nt, Homo sapiens
uauccuagcuacaauucua

SEQ ID NO: 655010 - RNA, 19 nt, Homo sapiens
cuggauaucuugucacauu

SEQ ID NO: 655011 - RNA, 19 nt, Homo sapiens
gauauaaucugagacaaac

SEQ ID NO: 655012 - RNA, 19 nt, Homo sapiens
ggauauaaucugagacaaa

SEQ ID NO: 655013 - RNA, 19 nt, Homo sapiens
ggacagugaacaaugauga

SEQ ID NO: 655014 - RNA, 19 nt, Homo sapiens
ucacagaacccuggaauga

SEQ ID NO: 655015 - RNA, 19 nt, Homo sapiens
gcaauacauuccagcuuuc

SEQ ID NO: 655016 - RNA, 19 nt, Homo sapiens
gagaagguccaguaucuug

SEQ ID NO: 655017 - RNA, 19 nt, Homo sapiens
caaaggaauggaagaauau

SEQ ID NO: 655018 - RNA, 19 nt, Homo sapiens
guagaagaauuuguaggaa

SEQ ID NO: 655019 - RNA, 19 nt, Homo sapiens
ggccagaguuugaauucuu

SEQ ID NO: 655020 - RNA, 19 nt, Homo sapiens
acacccaccuccacccuua

SEQ ID NO: 655021 - RNA, 19 nt, Homo sapiens
uuacuaacuugaccaaaga

SEQ ID NO: 655022 - RNA, 19 nt, Homo sapiens
guuauacucagaccaguua

SEQ ID NO: 655023 - RNA, 19 nt, Homo sapiens
aaagaacacuugauuuggu

SEQ ID NO: 655024 - RNA, 19 nt, Homo sapiens
gaucaaaguagcagucuuc

SEQ ID NO: 655025 - RNA, 19 nt, Homo sapiens
ggacuucuguuuuguuuug

SEQ ID NO: 655026 - RNA, 19 nt, Homo sapiens
gaacacuugauuugguuaa

SEQ ID NO: 655027 - RNA, 19 nt, Homo sapiens
gauauccgccuucacagaa

SEQ ID NO: 655028 - RNA, 19 nt, Homo sapiens
ugugacugcuuucaacaua

SEQ ID NO: 655029 - RNA, 19 nt, Homo sapiens
cagaugaaacuggauauaa

SEQ ID NO: 655030 - RNA, 19 nt, Homo sapiens
gcaccugguuauacucaga

SEQ ID NO: 655031 - RNA, 19 nt, Homo sapiens
gaacaagaaguagaagaau

SEQ ID NO: 655032 - RNA, 19 nt, Homo sapiens
gagcagccaccauauccua

SEQ ID NO: 655033 - RNA, 19 nt, Homo sapiens
gcccaaggauucuucauac

SEQ ID NO: 655034 - RNA, 19 nt, Homo sapiens
ccaaguagacucacuccuu

SEQ ID NO: 655035 - RNA, 19 nt, Homo sapiens
uggaagaaaugcuaaccaa

SEQ ID NO: 655036 - RNA, 19 nt, Homo sapiens
cauuccagcuuuccuuuga

SEQ ID NO: 655037 - RNA, 19 nt, Homo sapiens
uauacucccucuuaaggaa

SEQ ID NO: 655038 - RNA, 19 nt, Homo sapiens
ugaaaugccuguugaugac

SEQ ID NO: 655039 - RNA, 19 nt, Homo sapiens
gaagguccaguaucuugaa

SEQ ID NO: 655040 - RNA, 19 nt, Homo sapiens
agcaauacauuccagcuuu

SEQ ID NO: 655041 - RNA, 19 nt, Homo sapiens
gacaagaagcaauacauuc

SEQ ID NO: 655042 - RNA, 19 nt, Homo sapiens
aagaaaugcuaaccaagga

SEQ ID NO: 655043 - RNA, 19 nt, Homo sapiens
ugaacaagaaguagaagaa

SEQ ID NO: 655044 - RNA, 19 nt, Homo sapiens
gguccaguaucuugaacaa

SEQ ID NO: 655045 - RNA, 19 nt, Homo sapiens
ugacaagaagcaauacauu

SEQ ID NO: 655046 - RNA, 19 nt, Homo sapiens
aguggaagccuguuacuaa

SEQ ID NO: 655047 - RNA, 19 nt, Homo sapiens
gaauguguaccuucagaug

SEQ ID NO: 655048 - RNA, 19 nt, Homo sapiens
ggaauucuacugcgagauc

SEQ ID NO: 655049 - RNA, 19 nt, Homo sapiens
caaugaugauucagaucuu

SEQ ID NO: 655050 - RNA, 19 nt, Homo sapiens
cuacaugacugaaaguacu

SEQ ID NO: 655051 - RNA, 19 nt, Homo sapiens
cgagaucuagggcuccuua

SEQ ID NO: 655052 - RNA, 19 nt, Homo sapiens
gaugaaacuggauauaauc

SEQ ID NO: 655053 - RNA, 19 nt, Homo sapiens
acuauggaguuaccaauau

SEQ ID NO: 655054 - RNA, 19 nt, Homo sapiens
acgaaugaauguaauagga

SEQ ID NO: 655055 - RNA, 19 nt, Homo sapiens
uaaauggcgaggaaacgua

SEQ ID NO: 655056 - RNA, 19 nt, Homo sapiens
ucauacaugugcuggagaa

SEQ ID NO: 655057 - RNA, 19 nt, Homo sapiens
agccucagcuguaugguaa

SEQ ID NO: 655058 - RNA, 19 nt, Homo sapiens
gcaugaaccggcacaacuu

SEQ ID NO: 655059 - RNA, 19 nt, Homo sapiens
gggcuucuccuggugcuua

SEQ ID NO: 655060 - RNA, 19 nt, Homo sapiens
cuauggaguuaccaauauu

SEQ ID NO: 655061 - RNA, 19 nt, Homo sapiens
guaagaggaaacuccauug

SEQ ID NO: 655062 - RNA, 19 nt, Homo sapiens
aagaacacuugauuugguu

SEQ ID NO: 655063 - RNA, 19 nt, Homo sapiens
uggaauggguggccguuau

SEQ ID NO: 655064 - RNA, 19 nt, Homo sapiens
cgaaugaauguaauaggaa

SEQ ID NO: 655065 - RNA, 19 nt, Homo sapiens
gaaguagaagaauuuguag

SEQ ID NO: 655066 - RNA, 19 nt, Homo sapiens
gagccucagcuguauggua

SEQ ID NO: 655067 - RNA, 19 nt, Homo sapiens
ggauauccgccuucacaga

SEQ ID NO: 655068 - RNA, 19 nt, Homo sapiens
cggcacaacuuuccuugca

SEQ ID NO: 655069 - RNA, 19 nt, Homo sapiens
gagggaaacacacuucaca

SEQ ID NO: 655070 - RNA, 19 nt, Homo sapiens
aagaauguguaccuucaga

SEQ ID NO: 655071 - RNA, 19 nt, Homo sapiens
ccagugaccaucccaacaa

SEQ ID NO: 655072 - RNA, 19 nt, Homo sapiens
gaugguaaucguaguguuc

SEQ ID NO: 655073 - RNA, 19 nt, Homo sapiens
ucagacgaaugaauguaau

SEQ ID NO: 655074 - RNA, 19 nt, Homo sapiens
acaaaguggaagccuguua

SEQ ID NO: 655075 - RNA, 19 nt, Homo sapiens
gaggcuguuuguaagauuc

SEQ ID NO: 655076 - RNA, 19 nt, Homo sapiens
caacaaucaagaucaaagu

SEQ ID NO: 655077 - RNA, 19 nt, Homo sapiens
caggauauccgccuucaca

SEQ ID NO: 655078 - RNA, 19 nt, Homo sapiens
gcaaauacugccucauacu

SEQ ID NO: 655079 - RNA, 19 nt, Homo sapiens
caccauauccuagcuacaa

SEQ ID NO: 655080 - RNA, 19 nt, Homo sapiens
uuggauaaauggcgaggaa

SEQ ID NO: 655081 - RNA, 19 nt, Homo sapiens
uaucagaaaccuaccagau

SEQ ID NO: 655082 - RNA, 19 nt, Homo sapiens
aggaggcgauggcuacuau

SEQ ID NO: 655083 - RNA, 19 nt, Homo sapiens
caaauacugccucauacuc

SEQ ID NO: 655084 - RNA, 19 nt, Homo sapiens
gaauugcaaggccagaguu

SEQ ID NO: 655085 - RNA, 19 nt, Homo sapiens
cagcuuuccuuugauuuua

SEQ ID NO: 655086 - RNA, 19 nt, Homo sapiens
ggagaugguaaucguagug

SEQ ID NO: 655087 - RNA, 19 nt, Homo sapiens
gugacugcuuucaacauau

SEQ ID NO: 655088 - RNA, 19 nt, Homo sapiens
uggauaucuugucacauuu

SEQ ID NO: 655089 - RNA, 19 nt, Homo sapiens
cagacgaaugaauguaaua

SEQ ID NO: 655090 - RNA, 19 nt, Homo sapiens
caugaaccggcacaacuuu

SEQ ID NO: 655091 - RNA, 19 nt, Homo sapiens
ccaaguacuuaccguucau

SEQ ID NO: 655092 - RNA, 19 nt, Homo sapiens
cuuauuaugcaccugguua

SEQ ID NO: 655093 - RNA, 19 nt, Homo sapiens
uguaagaccagaauugcaa

SEQ ID NO: 655094 - RNA, 19 nt, Homo sapiens
uugaaaugccuguugauga

SEQ ID NO: 655095 - RNA, 19 nt, Homo sapiens
guggagaugugccgguaca

SEQ ID NO: 655096 - RNA, 19 nt, Homo sapiens
gcaaagagguggauucuaa

SEQ ID NO: 655097 - RNA, 19 nt, Homo sapiens
gaaguugcuuguuguuuga

SEQ ID NO: 655098 - RNA, 19 nt, Homo sapiens
gaacagaaagccauugaug

SEQ ID NO: 655099 - RNA, 19 nt, Homo sapiens
uaacuuggguggaggcaaa

SEQ ID NO: 655100 - RNA, 19 nt, Homo sapiens
uaaagaaguugcuuguugu

SEQ ID NO: 655101 - RNA, 19 nt, Homo sapiens
auaaagaaguugcuuguug

SEQ ID NO: 655102 - RNA, 19 nt, Homo sapiens
ucaauuacccaucacauaa

SEQ ID NO: 655103 - RNA, 19 nt, Homo sapiens
gaaccgaugugugcuuuag

SEQ ID NO: 655104 - RNA, 19 nt, Homo sapiens
ggacacaucccaauucaag

SEQ ID NO: 655105 - RNA, 19 nt, Homo sapiens
gccaggagccauaggaaua

SEQ ID NO: 655106 - RNA, 19 nt, Homo sapiens
gaagguagaggugaaaguu

SEQ ID NO: 655107 - RNA, 19 nt, Homo sapiens
agaaguugcuuguuguuug

SEQ ID NO: 655108 - RNA, 19 nt, Homo sapiens
uuuauuagcugcuugguau

SEQ ID NO: 655109 - RNA, 19 nt, Homo sapiens
gaugugugcuuuagggaau

SEQ ID NO: 655110 - RNA, 19 nt, Homo sapiens
ccaagaguguggcuacaga

SEQ ID NO: 655111 - RNA, 19 nt, Homo sapiens
gggagucaauuacccauca

SEQ ID NO: 655112 - RNA, 19 nt, Homo sapiens
ggagcaggcuguagacaac

SEQ ID NO: 655113 - RNA, 19 nt, Homo sapiens
gaaaacaaaccagaaagua

SEQ ID NO: 655114 - RNA, 19 nt, Homo sapiens
gcaaaacacuaauaaaagg

SEQ ID NO: 655115 - RNA, 19 nt, Homo sapiens
ggagagacggugucaggaa

SEQ ID NO: 655116 - RNA, 19 nt, Homo sapiens
gaaaccacucagccagaua

SEQ ID NO: 655117 - RNA, 19 nt, Homo sapiens
cugcagcccugucuacuug

SEQ ID NO: 655118 - RNA, 19 nt, Homo sapiens
cguagccucugcccuguaa

SEQ ID NO: 655119 - RNA, 19 nt, Homo sapiens
guucagaccaucuuggaaa

SEQ ID NO: 655120 - RNA, 19 nt, Homo sapiens
ucgagaaacugcaccuguu

SEQ ID NO: 655121 - RNA, 19 nt, Homo sapiens
ccacucagccagauaaaca

SEQ ID NO: 655122 - RNA, 19 nt, Homo sapiens
uuggaugacuuuaaugcua

SEQ ID NO: 655123 - RNA, 19 nt, Homo sapiens
gaauaucuguauguuggau

SEQ ID NO: 655124 - RNA, 19 nt, Homo sapiens
caauuacccaucacauaaa

SEQ ID NO: 655125 - RNA, 19 nt, Homo sapiens
aaacaaaccagaaaguaag

SEQ ID NO: 655126 - RNA, 19 nt, Homo sapiens
gucaauuacccaucacaua

SEQ ID NO: 655127 - RNA, 19 nt, Homo sapiens
ucaggaagguucagaccau

SEQ ID NO: 655128 - RNA, 19 nt, Homo sapiens
caaagagguggauucuaaa

SEQ ID NO: 655129 - RNA, 19 nt, Homo sapiens
cacaacagccgcaccacua

SEQ ID NO: 655130 - RNA, 19 nt, Homo sapiens
aaaccacucagccagauaa

SEQ ID NO: 655131 - RNA, 19 nt, Homo sapiens
auaccugacuuuagagaga

SEQ ID NO: 655132 - RNA, 19 nt, Homo sapiens
gaugaucgaagaguauuug

SEQ ID NO: 655133 - RNA, 19 nt, Homo sapiens
gaguguggcuacagaagag

SEQ ID NO: 655134 - RNA, 19 nt, Homo sapiens
cagcagcagcgacuucaaa

SEQ ID NO: 655135 - RNA, 19 nt, Homo sapiens
gggaaggccacccugugua

SEQ ID NO: 655136 - RNA, 19 nt, Homo sapiens
gaagauccccacacagaaa

SEQ ID NO: 655137 - RNA, 19 nt, Homo sapiens
gcccaugacccaucgagaa

SEQ ID NO: 655138 - RNA, 19 nt, Homo sapiens
guugcuaccucccuuuauc

SEQ ID NO: 655139 - RNA, 19 nt, Homo sapiens
uggaagccauccuggagaa

SEQ ID NO: 655140 - RNA, 19 nt, Homo sapiens
gcagcgaggaggcuauuuc

SEQ ID NO: 655141 - RNA, 19 nt, Homo sapiens
ccuguuagcugugguugug

SEQ ID NO: 655142 - RNA, 19 nt, Homo sapiens
gcuccgaccaggcuacauu

SEQ ID NO: 655143 - RNA, 19 nt, Homo sapiens
guagauggggagucaauua

SEQ ID NO: 655144 - RNA, 19 nt, Homo sapiens
gcuuguuguuugagaaguu

SEQ ID NO: 655145 - RNA, 19 nt, Homo sapiens
cggaaccgaugugugcuuu

SEQ ID NO: 655146 - RNA, 19 nt, Homo sapiens
cagcaaccuugaagcagau

SEQ ID NO: 655147 - RNA, 19 nt, Homo sapiens
aaaaguaccugaugaucga

SEQ ID NO: 655148 - RNA, 19 nt, Homo sapiens
ggaagguucagaccaucuu

SEQ ID NO: 655149 - RNA, 19 nt, Homo sapiens
guauguuggaugacuuuaa

SEQ ID NO: 655150 - RNA, 19 nt, Homo sapiens
gccauaggaauaucuguau

SEQ ID NO: 655151 - RNA, 19 nt, Homo sapiens
ggaaggccacccuguguac

SEQ ID NO: 655152 - RNA, 19 nt, Homo sapiens
ccauuccugugcuccauga

SEQ ID NO: 655153 - RNA, 19 nt, Homo sapiens
acagaaagccauugauguc

SEQ ID NO: 655154 - RNA, 19 nt, Homo sapiens
ggaaccgaugugugcuuua

SEQ ID NO: 655155 - RNA, 19 nt, Homo sapiens
caggucaaguccaggucua

SEQ ID NO: 655156 - RNA, 19 nt, Homo sapiens
ggaggcaaaacacuaauaa

SEQ ID NO: 655157 - RNA, 19 nt, Homo sapiens
uaaguugcaugcauuucag

SEQ ID NO: 655158 - RNA, 19 nt, Homo sapiens
cugagaagguagaggugaa

SEQ ID NO: 655159 - RNA, 19 nt, Homo sapiens
gguggauucuaaaccuguu

SEQ ID NO: 655160 - RNA, 19 nt, Homo sapiens
caucuccauuccggugaua

SEQ ID NO: 655161 - RNA, 19 nt, Homo sapiens
gaagguucagaccaucuug

SEQ ID NO: 655162 - RNA, 19 nt, Homo sapiens
agaaaccacucagccagau

SEQ ID NO: 655163 - RNA, 19 nt, Homo sapiens
aaaugugccaggagccaua

SEQ ID NO: 655164 - RNA, 19 nt, Homo sapiens
acacaucccaauucaagug

SEQ ID NO: 655165 - RNA, 19 nt, Homo sapiens
ccaggagccauaggaauau

SEQ ID NO: 655166 - RNA, 19 nt, Homo sapiens
caguugcuaccucccuuua

SEQ ID NO: 655167 - RNA, 19 nt, Homo sapiens
gcaugcauuucagagacuu

SEQ ID NO: 655168 - RNA, 19 nt, Homo sapiens
ggugcacccuuuccauguc

SEQ ID NO: 655169 - RNA, 19 nt, Homo sapiens
ccacagcagcagcgacuuc

SEQ ID NO: 655170 - RNA, 19 nt, Homo sapiens
cagcagacaagggcaagaa

SEQ ID NO: 655171 - RNA, 19 nt, Homo sapiens
caacuuugaaggcaagaag

SEQ ID NO: 655172 - RNA, 19 nt, Homo sapiens
gcaggcuguagacaacuuu

SEQ ID NO: 655173 - RNA, 19 nt, Homo sapiens
caagaguguggcuacagaa

SEQ ID NO: 655174 - RNA, 19 nt, Homo sapiens
ggaugacuuuaaugcuaca

SEQ ID NO: 655175 - RNA, 19 nt, Homo sapiens
uuaaguugcaugcauuuca

SEQ ID NO: 655176 - RNA, 19 nt, Homo sapiens
ucaaguccaggucuaugaa

SEQ ID NO: 655177 - RNA, 19 nt, Homo sapiens
gucaaguccaggucuauga

SEQ ID NO: 655178 - RNA, 19 nt, Homo sapiens
gagcugcuggcccuggauu

SEQ ID NO: 655179 - RNA, 19 nt, Homo sapiens
gaaggcaagaagacugaca

SEQ ID NO: 655180 - RNA, 19 nt, Homo sapiens
gaggcuauuuccagacacu

SEQ ID NO: 655181 - RNA, 19 nt, Homo sapiens
cuggacacaucccaauuca

SEQ ID NO: 655182 - RNA, 19 nt, Homo sapiens
cagaagauccccacacaga

SEQ ID NO: 655183 - RNA, 19 nt, Homo sapiens
cccaugacccaucgagaaa

SEQ ID NO: 655184 - RNA, 19 nt, Homo sapiens
ggaauaucuguauguugga

SEQ ID NO: 655185 - RNA, 19 nt, Homo sapiens
aaagaaguugcuuguuguu

SEQ ID NO: 655186 - RNA, 19 nt, Homo sapiens
ugacagacaccccugguaa

SEQ ID NO: 655187 - RNA, 19 nt, Homo sapiens
caucccaauucaagugauc

SEQ ID NO: 655188 - RNA, 19 nt, Homo sapiens
caugacccaucgagaaacu

SEQ ID NO: 655189 - RNA, 19 nt, Homo sapiens
auacacgagcagaacguua

SEQ ID NO: 655190 - RNA, 19 nt, Homo sapiens
auaucuguauguuggauga

SEQ ID NO: 655191 - RNA, 19 nt, Homo sapiens
gcaggugcacccuuuccau

SEQ ID NO: 655192 - RNA, 19 nt, Homo sapiens
augcagcgauuccgaacug

SEQ ID NO: 655193 - RNA, 19 nt, Homo sapiens
gcagacaagggcaagaaaa

SEQ ID NO: 655194 - RNA, 19 nt, Homo sapiens
gagacggugucaggaaggu

SEQ ID NO: 655195 - RNA, 19 nt, Homo sapiens
ucgaagaguauuugaccaa

SEQ ID NO: 655196 - RNA, 19 nt, Homo sapiens
uaaaggagcugguuccaaa

SEQ ID NO: 655197 - RNA, 19 nt, Homo sapiens
gaagaacucucaccguuga

SEQ ID NO: 655198 - RNA, 19 nt, Homo sapiens
ccacaaggauuauugauga

SEQ ID NO: 655199 - RNA, 19 nt, Homo sapiens
gaaagcagauucaauuagu

SEQ ID NO: 655200 - RNA, 19 nt, Homo sapiens
caucaaguaucuucaguuu

SEQ ID NO: 655201 - RNA, 19 nt, Homo sapiens
ucaauaaguuucuggauga

SEQ ID NO: 655202 - RNA, 19 nt, Homo sapiens
guaauuggcugugcucuug

SEQ ID NO: 655203 - RNA, 19 nt, Homo sapiens
gcagucaccuugggcauuu

SEQ ID NO: 655204 - RNA, 19 nt, Homo sapiens
caauuagucuucaaaccua

SEQ ID NO: 655205 - RNA, 19 nt, Homo sapiens
gcagaucagugacggagaa

SEQ ID NO: 655206 - RNA, 19 nt, Homo sapiens
uuaccacugugaacaauua

SEQ ID NO: 655207 - RNA, 19 nt, Homo sapiens
uaaggcaucuguaucaaau

SEQ ID NO: 655208 - RNA, 19 nt, Homo sapiens
gaucuagcauauuucacua

SEQ ID NO: 655209 - RNA, 19 nt, Homo sapiens
gaucagaaguuucaaucca

SEQ ID NO: 655210 - RNA, 19 nt, Homo sapiens
aggcaucuguaucaaauua

SEQ ID NO: 655211 - RNA, 19 nt, Homo sapiens
cugcuuaauugucaacuua

SEQ ID NO: 655212 - RNA, 19 nt, Homo sapiens
gaaauucuuuacugaagca

SEQ ID NO: 655213 - RNA, 19 nt, Homo sapiens
gagacucugcuuagaaaua

SEQ ID NO: 655214 - RNA, 19 nt, Homo sapiens
ggagaaagagaagaauuaa

SEQ ID NO: 655215 - RNA, 19 nt, Homo sapiens
ucagaaguuucaauccaua

SEQ ID NO: 655216 - RNA, 19 nt, Homo sapiens
gcaagaaucccuaaagcau

SEQ ID NO: 655217 - RNA, 19 nt, Homo sapiens
gcacacacauuuacuacac

SEQ ID NO: 655218 - RNA, 19 nt, Homo sapiens
gaagcagcacacacauuua

SEQ ID NO: 655219 - RNA, 19 nt, Homo sapiens
gcucaggguugaagcuuug

SEQ ID NO: 655220 - RNA, 19 nt, Homo sapiens
gaauucuugucuuguacua

SEQ ID NO: 655221 - RNA, 19 nt, Homo sapiens
ccaaaacucugcaacaaaa

SEQ ID NO: 655222 - RNA, 19 nt, Homo sapiens
ugaagcagcacacacauuu

SEQ ID NO: 655223 - RNA, 19 nt, Homo sapiens
gaaguuucaauccauagua

SEQ ID NO: 655224 - RNA, 19 nt, Homo sapiens
cggagaaagagaagaauua

SEQ ID NO: 655225 - RNA, 19 nt, Homo sapiens
guuagaugcugauauaaag

SEQ ID NO: 655226 - RNA, 19 nt, Homo sapiens
gguugaagcuuugagagaa

SEQ ID NO: 655227 - RNA, 19 nt, Homo sapiens
ucaaguaucuucaguuuug

SEQ ID NO: 655228 - RNA, 19 nt, Homo sapiens
gaaaugauccacaguaucc

SEQ ID NO: 655229 - RNA, 19 nt, Homo sapiens
ucaaaugcaucaauucucu

SEQ ID NO: 655230 - RNA, 19 nt, Homo sapiens
guggaugaauacauaguuu

SEQ ID NO: 655231 - RNA, 19 nt, Homo sapiens
gaucagugacggagaaaga

SEQ ID NO: 655232 - RNA, 19 nt, Homo sapiens
gagaaaaccaccuauaauu

SEQ ID NO: 655233 - RNA, 19 nt, Homo sapiens
gguauaaccacuuaguuga

SEQ ID NO: 655234 - RNA, 19 nt, Homo sapiens
ccacuuaguugacacugau

SEQ ID NO: 655235 - RNA, 19 nt, Homo sapiens
aggcgaagaucaacgcuaa

SEQ ID NO: 655236 - RNA, 19 nt, Homo sapiens
ugacaaggccaucaagcua

SEQ ID NO: 655237 - RNA, 19 nt, Homo sapiens
aagcaugccacaaggauua

SEQ ID NO: 655238 - RNA, 19 nt, Homo sapiens
cuaagagcauuuacacaau

SEQ ID NO: 655239 - RNA, 19 nt, Homo sapiens
aaagucugcuuaauuguca

SEQ ID NO: 655240 - RNA, 19 nt, Homo sapiens
gcagcacacacauuuacua

SEQ ID NO: 655241 - RNA, 19 nt, Homo sapiens
gaaaacaaacguucagcua

SEQ ID NO: 655242 - RNA, 19 nt, Homo sapiens
ccuaagagcauuuacacaa

SEQ ID NO: 655243 - RNA, 19 nt, Homo sapiens
gaaauccuucuggaaauga

SEQ ID NO: 655244 - RNA, 19 nt, Homo sapiens
gaauuaaaucugacugcaa

SEQ ID NO: 655245 - RNA, 19 nt, Homo sapiens
acaaggccaucaagcuauu

SEQ ID NO: 655246 - RNA, 19 nt, Homo sapiens
agacucugcuuagaaauau

SEQ ID NO: 655247 - RNA, 19 nt, Homo sapiens
gcucuacagugcauguuca

SEQ ID NO: 655248 - RNA, 19 nt, Homo sapiens
ugauaguuguuucagauga

SEQ ID NO: 655249 - RNA, 19 nt, Homo sapiens
ccacugugaacaauuauau

SEQ ID NO: 655250 - RNA, 19 nt, Homo sapiens
gcaagagaaagaaauccuu

SEQ ID NO: 655251 - RNA, 19 nt, Homo sapiens
uaaagauuccugugucuca

SEQ ID NO: 655252 - RNA, 19 nt, Homo sapiens
agauugaauucuugucuug

SEQ ID NO: 655253 - RNA, 19 nt, Homo sapiens
gccaguugaucagaaguuu

SEQ ID NO: 655254 - RNA, 19 nt, Homo sapiens
guugaagugucaguagaaa

SEQ ID NO: 655255 - RNA, 19 nt, Homo sapiens
ucacuauucuguggaugaa

SEQ ID NO: 655256 - RNA, 19 nt, Homo sapiens
ggaaaugauccacaguauc

SEQ ID NO: 655257 - RNA, 19 nt, Homo sapiens
caaaauagccaggacauga

SEQ ID NO: 655258 - RNA, 19 nt, Homo sapiens
gcagcaagaaucccuaaag

SEQ ID NO: 655259 - RNA, 19 nt, Homo sapiens
ugacggagaaagagaagaa

SEQ ID NO: 655260 - RNA, 19 nt, Homo sapiens
ggaugaauacauaguuugu

SEQ ID NO: 655261 - RNA, 19 nt, Homo sapiens
gacaaggccaucaagcuau

SEQ ID NO: 655262 - RNA, 19 nt, Homo sapiens
gauguaaagauuccugugu

SEQ ID NO: 655263 - RNA, 19 nt, Homo sapiens
gcauauuucacuauucugu

SEQ ID NO: 655264 - RNA, 19 nt, Homo sapiens
gauaguuguuucagaugag

SEQ ID NO: 655265 - RNA, 19 nt, Homo sapiens
cuucaaaccuaagagcauu

SEQ ID NO: 655266 - RNA, 19 nt, Homo sapiens
gcauuuacacaauacacaa

SEQ ID NO: 655267 - RNA, 19 nt, Homo sapiens
ucaaaccuaagagcauuua

SEQ ID NO: 655268 - RNA, 19 nt, Homo sapiens
gcagauucaauuagucuuc

SEQ ID NO: 655269 - RNA, 19 nt, Homo sapiens
cagcaagaaucccuaaagc

SEQ ID NO: 655270 - RNA, 19 nt, Homo sapiens
auuccugugucucauaaua

SEQ ID NO: 655271 - RNA, 19 nt, Homo sapiens
ugaagugucaguagaaaca

SEQ ID NO: 655272 - RNA, 19 nt, Homo sapiens
agauuccugugucucauaa

SEQ ID NO: 655273 - RNA, 19 nt, Homo sapiens
guuaaggcaucuguaucaa

SEQ ID NO: 655274 - RNA, 19 nt, Homo sapiens
uuuccaaaguugucucauu

SEQ ID NO: 655275 - RNA, 19 nt, Homo sapiens
uauaaccacuuaguugaca

SEQ ID NO: 655276 - RNA, 19 nt, Homo sapiens
uuccaaaguugucucauuc

SEQ ID NO: 655277 - RNA, 19 nt, Homo sapiens
cuaguucuuuguuagguau

SEQ ID NO: 655278 - RNA, 19 nt, Homo sapiens
uaaagucugcuuaauuguc

SEQ ID NO: 655279 - RNA, 19 nt, Homo sapiens
ugacacugauaguuguuuc

SEQ ID NO: 655280 - RNA, 19 nt, Homo sapiens
cagauucaauuagucuuca

SEQ ID NO: 655281 - RNA, 19 nt, Homo sapiens
gaugagguggucaauaagu

SEQ ID NO: 655282 - RNA, 19 nt, Homo sapiens
caaaugcaucaauucucua

SEQ ID NO: 655283 - RNA, 19 nt, Homo sapiens
caccuugggcauuuaguuu

SEQ ID NO: 655284 - RNA, 19 nt, Homo sapiens
ggaaucacgcagucaccuu

SEQ ID NO: 655285 - RNA, 19 nt, Homo sapiens
ggaucuagcauauuucacu

SEQ ID NO: 655286 - RNA, 19 nt, Homo sapiens
gcaauguuaaggcaucugu

SEQ ID NO: 655287 - RNA, 19 nt, Homo sapiens
ccaaaguugucucauucag

SEQ ID NO: 655288 - RNA, 19 nt, Homo sapiens
ugagguggucaauaaguuu

SEQ ID NO: 655289 - RNA, 19 nt, Homo sapiens
uaaagcaugccacaaggau

SEQ ID NO: 655290 - RNA, 19 nt, Homo sapiens
gugagaaaaccaccuauaa

SEQ ID NO: 655291 - RNA, 19 nt, Homo sapiens
uaagagaagauuagagacu

SEQ ID NO: 655292 - RNA, 19 nt, Homo sapiens
caauaaguuucuggaugau

SEQ ID NO: 655293 - RNA, 19 nt, Homo sapiens
ucucaccguugaaguguca

SEQ ID NO: 655294 - RNA, 19 nt, Homo sapiens
gaacucucaccguugaagu

SEQ ID NO: 655295 - RNA, 19 nt, Homo sapiens
uucuguggaugaauacaua

SEQ ID NO: 655296 - RNA, 19 nt, Homo sapiens
gaaccaggcugaucucuuu

SEQ ID NO: 655297 - RNA, 19 nt, Homo sapiens
gcaaagaucaugccaaguu

SEQ ID NO: 655298 - RNA, 19 nt, Homo sapiens
ggaaugagaagcuaaagaa

SEQ ID NO: 655299 - RNA, 19 nt, Homo sapiens
caaagaucaugccaaguuu

SEQ ID NO: 655300 - RNA, 19 nt, Homo sapiens
gaaccaaggagaugaagaa

SEQ ID NO: 655301 - RNA, 19 nt, Homo sapiens
gcacggagauagauacucu

SEQ ID NO: 655302 - RNA, 19 nt, Homo sapiens
agagaaaucuuccggaaug

SEQ ID NO: 655303 - RNA, 19 nt, Homo sapiens
ggaggcagcugaggaguug

SEQ ID NO: 655304 - RNA, 19 nt, Homo sapiens
ccaacgaacuguacgugaa

SEQ ID NO: 655305 - RNA, 19 nt, Homo sapiens
uagcugaggugccaacuau

SEQ ID NO: 655306 - RNA, 19 nt, Homo sapiens
gaauuuccguguggaugua

SEQ ID NO: 655307 - RNA, 19 nt, Homo sapiens
gcgagaccauccuggcuaa

SEQ ID NO: 655308 - RNA, 19 nt, Homo sapiens
gcaggaaguccaagguaaa

SEQ ID NO: 655309 - RNA, 19 nt, Homo sapiens
cuacugacuuucccgguaa

SEQ ID NO: 655310 - RNA, 19 nt, Homo sapiens
gaaaucuuccggaaugaga

SEQ ID NO: 655311 - RNA, 19 nt, Homo sapiens
gcaauguccauacuacuga

SEQ ID NO: 655312 - RNA, 19 nt, Homo sapiens
gagaaaucuuccggaauga

SEQ ID NO: 655313 - RNA, 19 nt, Homo sapiens
gaaggcacggagauagaua

SEQ ID NO: 655314 - RNA, 19 nt, Homo sapiens
gaagaaggcacggagauag

SEQ ID NO: 655315 - RNA, 19 nt, Homo sapiens
guccugguguacaauaaua

SEQ ID NO: 655316 - RNA, 19 nt, Homo sapiens
uggagaagguccuggugua

SEQ ID NO: 655317 - RNA, 19 nt, Homo sapiens
gaccagugcaugaugauau

SEQ ID NO: 655318 - RNA, 19 nt, Homo sapiens
ggaauugacgcagccauug

SEQ ID NO: 655319 - RNA, 19 nt, Homo sapiens
caagggcauuggcaaagau

SEQ ID NO: 655320 - RNA, 19 nt, Homo sapiens
caacuauggcuguggagaa

SEQ ID NO: 655321 - RNA, 19 nt, Homo sapiens
gguucgagaucauuauauc

SEQ ID NO: 655322 - RNA, 19 nt, Homo sapiens
ucaagggcauuggcaaaga

SEQ ID NO: 655323 - RNA, 19 nt, Homo sapiens
aaauugaccugcucaugca

SEQ ID NO: 655324 - RNA, 19 nt, Homo sapiens
guguauaccaggcauauga

SEQ ID NO: 655325 - RNA, 19 nt, Homo sapiens
ugaagaaggcacggagaua

SEQ ID NO: 655326 - RNA, 19 nt, Homo sapiens
agaagguccugguguacaa

SEQ ID NO: 655327 - RNA, 19 nt, Homo sapiens
guacgugaaccacaaagug

SEQ ID NO: 655328 - RNA, 19 nt, Homo sapiens
ugcaggaaguccaagguaa

SEQ ID NO: 655329 - RNA, 19 nt, Homo sapiens
gaaaccccgucucuauaaa

SEQ ID NO: 655330 - RNA, 19 nt, Homo sapiens
ccaggcauaugacauggau

SEQ ID NO: 655331 - RNA, 19 nt, Homo sapiens
gggaauugacgcagccauu

SEQ ID NO: 655332 - RNA, 19 nt, Homo sapiens
ugacuuucccgguaacuau

SEQ ID NO: 655333 - RNA, 19 nt, Homo sapiens
acacauggaugaaaacuca

SEQ ID NO: 655334 - RNA, 19 nt, Homo sapiens
ggaaccaggcugaucucuu

SEQ ID NO: 655335 - RNA, 19 nt, Homo sapiens
guaguacacauggaugaaa

SEQ ID NO: 655336 - RNA, 19 nt, Homo sapiens
uuauugaggugcaggaagu

SEQ ID NO: 655337 - RNA, 19 nt, Homo sapiens
gaagaauuuccguguggau

SEQ ID NO: 655338 - RNA, 19 nt, Homo sapiens
ccuguaaucccagcacuuu

SEQ ID NO: 655339 - RNA, 19 nt, Homo sapiens
gugcaggaaguccaaggua

SEQ ID NO: 655340 - RNA, 19 nt, Homo sapiens
augagaagcuaaagaaggu

SEQ ID NO: 655341 - RNA, 19 nt, Homo sapiens
gaaugagaagcuaaagaag

SEQ ID NO: 655342 - RNA, 19 nt, Homo sapiens
uguccauacuacugacuuu

SEQ ID NO: 655343 - RNA, 19 nt, Homo sapiens
gcucaugcacugugucaag

SEQ ID NO: 655344 - RNA, 19 nt, Homo sapiens
gagaagguccugguguaca

SEQ ID NO: 655345 - RNA, 19 nt, Homo sapiens
ggugaaaccccgucucuau

SEQ ID NO: 655346 - RNA, 19 nt, Homo sapiens
gggaggcagcugaggaguu

SEQ ID NO: 655347 - RNA, 19 nt, Homo sapiens
ggaaccaaggagaugaaga

SEQ ID NO: 655348 - RNA, 19 nt, Homo sapiens
gcugaggugccaacuaugg

SEQ ID NO: 655349 - RNA, 19 nt, Homo sapiens
ugaaaccccgucucuauaa

SEQ ID NO: 655350 - RNA, 19 nt, Homo sapiens
gagaccauccuggcuaaca

SEQ ID NO: 655351 - RNA, 19 nt, Homo sapiens
ggccaaggcgaguggauca

SEQ ID NO: 655352 - RNA, 19 nt, Homo sapiens
gugaaaccccgucucuaua

SEQ ID NO: 655353 - RNA, 19 nt, Homo sapiens
gauaccuucagcagagaaa

SEQ ID NO: 655354 - RNA, 19 nt, Homo sapiens
aagaaggcacggagauaga

SEQ ID NO: 655355 - RNA, 19 nt, Homo sapiens
gggcucauucccauucaug

SEQ ID NO: 655356 - RNA, 19 nt, Homo sapiens
ggagaagguccugguguac

SEQ ID NO: 655357 - RNA, 19 nt, Homo sapiens
gaauugacgcagccauugc

SEQ ID NO: 655358 - RNA, 19 nt, Homo sapiens
agaccauccuggcuaacau

SEQ ID NO: 655359 - RNA, 19 nt, Homo sapiens
cggguucgagaucauuaua

SEQ ID NO: 655360 - RNA, 19 nt, Homo sapiens
cagagaaaucuuccggaau

SEQ ID NO: 655361 - RNA, 19 nt, Homo sapiens
caacgaacuguacgugaac

SEQ ID NO: 655362 - RNA, 19 nt, Homo sapiens
cuauuccgguuaugaugau

SEQ ID NO: 655363 - RNA, 19 nt, Homo sapiens
gaccauccuggcuaacaug

SEQ ID NO: 655364 - RNA, 19 nt, Homo sapiens
ugucaagggcauuggcaaa

SEQ ID NO: 655365 - RNA, 19 nt, Homo sapiens
cgaccagugcaugaugaua

SEQ ID NO: 655366 - RNA, 19 nt, Homo sapiens
cugcuaaagauuccucuga

SEQ ID NO: 655367 - RNA, 19 nt, Homo sapiens
uaacaaaucuccuaagcaa

SEQ ID NO: 655368 - RNA, 19 nt, Homo sapiens
caaagaagguuauaaugga

SEQ ID NO: 655369 - RNA, 19 nt, Homo sapiens
gaaaugugauguuagagaa

SEQ ID NO: 655370 - RNA, 19 nt, Homo sapiens
ggaaagagcccuggaauau

SEQ ID NO: 655371 - RNA, 19 nt, Homo sapiens
ggaaagcauuuauacuuga

SEQ ID NO: 655372 - RNA, 19 nt, Homo sapiens
aaagagcccuggaauauga

SEQ ID NO: 655373 - RNA, 19 nt, Homo sapiens
gacaugagaugguggauga

SEQ ID NO: 655374 - RNA, 19 nt, Homo sapiens
ggagagaaaucuuacaagu

SEQ ID NO: 655375 - RNA, 19 nt, Homo sapiens
agagaaaccuuacaaaugu

SEQ ID NO: 655376 - RNA, 19 nt, Homo sapiens
cuacaaaugugaagaaugu

SEQ ID NO: 655377 - RNA, 19 nt, Homo sapiens
cuacaaaugugaagaaugu

SEQ ID NO: 655378 - RNA, 19 nt, Homo sapiens
gaagagaaaccuuacaaau

SEQ ID NO: 655379 - RNA, 19 nt, Homo sapiens
gcaaaguauuucaauguga

SEQ ID NO: 655380 - RNA, 19 nt, Homo sapiens
gcacaggaaagcauuuaua

SEQ ID NO: 655381 - RNA, 19 nt, Homo sapiens
aagcaacucucaacccuua

SEQ ID NO: 655382 - RNA, 19 nt, Homo sapiens
aaacagaccuaagauaaga

SEQ ID NO: 655383 - RNA, 19 nt, Homo sapiens
ucaaacagaccuaagauaa

SEQ ID NO: 655384 - RNA, 19 nt, Homo sapiens
guacaaauauuggcaaagu

SEQ ID NO: 655385 - RNA, 19 nt, Homo sapiens
gagagaaaucuuacaagua

SEQ ID NO: 655386 - RNA, 19 nt, Homo sapiens
gagaaacucuacaaaugug

SEQ ID NO: 655387 - RNA, 19 nt, Homo sapiens
cuagaaaugugaagaaugu

SEQ ID NO: 655388 - RNA, 19 nt, Homo sapiens
gcacagcagaauuuauaua

SEQ ID NO: 655389 - RNA, 19 nt, Homo sapiens
ccucaacccuuacuaauca

SEQ ID NO: 655390 - RNA, 19 nt, Homo sapiens
ggacuuaaccaguguuuca

SEQ ID NO: 655391 - RNA, 19 nt, Homo sapiens
ccagguauguguccucauu

SEQ ID NO: 655392 - RNA, 19 nt, Homo sapiens
gagcaaaguauuucaaugu

SEQ ID NO: 655393 - RNA, 19 nt, Homo sapiens
gagagaaguccuacaaaug

SEQ ID NO: 655394 - RNA, 19 nt, Homo sapiens
aguauaaggugaacaaaga

SEQ ID NO: 655395 - RNA, 19 nt, Homo sapiens
gagagcaacccuacaaaug

SEQ ID NO: 655396 - RNA, 19 nt, Homo sapiens
gauaauucauacuggagaa

SEQ ID NO: 655397 - RNA, 19 nt, Homo sapiens
caggaaagcauuuauacuu

SEQ ID NO: 655398 - RNA, 19 nt, Homo sapiens
gaaagagcccuggaauaug

SEQ ID NO: 655399 - RNA, 19 nt, Homo sapiens
gggaaagagcccuggaaua

SEQ ID NO: 655400 - RNA, 19 nt, Homo sapiens
gcucacaucuuacucaaaa

SEQ ID NO: 655401 - RNA, 19 nt, Homo sapiens
gaaaugggacuguugacau

SEQ ID NO: 655402 - RNA, 19 nt, Homo sapiens
agagagaaguccuacaaau

SEQ ID NO: 655403 - RNA, 19 nt, Homo sapiens
guaaaaguguggaugagua

SEQ ID NO: 655404 - RNA, 19 nt, Homo sapiens
cagauaagauaacucauac

SEQ ID NO: 655405 - RNA, 19 nt, Homo sapiens
ugaagaauguggcaaagca

SEQ ID NO: 655406 - RNA, 19 nt, Homo sapiens
gauaagauaacucauacug

SEQ ID NO: 655407 - RNA, 19 nt, Homo sapiens
gaaagcauuuauacuugag

SEQ ID NO: 655408 - RNA, 19 nt, Homo sapiens
aagcaauacugagaagaua

SEQ ID NO: 655409 - RNA, 19 nt, Homo sapiens
gaaaugugaagaaugugaa

SEQ ID NO: 655410 - RNA, 19 nt, Homo sapiens
ccacagauaagauaacuca

SEQ ID NO: 655411 - RNA, 19 nt, Homo sapiens
gacaugagaauuuacaguu

SEQ ID NO: 655412 - RNA, 19 nt, Homo sapiens
gaacaacguggccaagcuu

SEQ ID NO: 655413 - RNA, 19 nt, Homo sapiens
gaaaaucauucugcugaaa

SEQ ID NO: 655414 - RNA, 19 nt, Homo sapiens
aagagaaaccuuacaaaug

SEQ ID NO: 655415 - RNA, 19 nt, Homo sapiens
ggauguggccauagaauuc

SEQ ID NO: 655416 - RNA, 19 nt, Homo sapiens
gagcagggcauggaagauu

SEQ ID NO: 655417 - RNA, 19 nt, Homo sapiens
aggaaagcauuuauacuug

SEQ ID NO: 655418 - RNA, 19 nt, Homo sapiens
gagaaaccuuacaaaugug

SEQ ID NO: 655419 - RNA, 19 nt, Homo sapiens
ggagagcaacccuacaaau

SEQ ID NO: 655420 - RNA, 19 nt, Homo sapiens
ccucaacccuaacuaaaca

SEQ ID NO: 655421 - RNA, 19 nt, Homo sapiens
gcaauacugagaagauaug

SEQ ID NO: 655422 - RNA, 19 nt, Homo sapiens
uaaaugauugucacacuug

SEQ ID NO: 655423 - RNA, 19 nt, Homo sapiens
gagaggcgcuaaugcuuuu

SEQ ID NO: 655424 - RNA, 19 nt, Homo sapiens
cauaagagaauucauacug

SEQ ID NO: 655425 - RNA, 19 nt, Homo sapiens
agaaaaggcuguaaaagug

SEQ ID NO: 655426 - RNA, 19 nt, Homo sapiens
gguaagauaauucauacug

SEQ ID NO: 655427 - RNA, 19 nt, Homo sapiens
uugcacagcagaauuuaua

SEQ ID NO: 655428 - RNA, 19 nt, Homo sapiens
ucucaacccuuacuacaca

SEQ ID NO: 655429 - RNA, 19 nt, Homo sapiens
gaucaccugucuggaacaa

SEQ ID NO: 655430 - RNA, 19 nt, Homo sapiens
gagagaggcgcuaaugcuu

SEQ ID NO: 655431 - RNA, 19 nt, Homo sapiens
agagaaguccuacaaaugu

SEQ ID NO: 655432 - RNA, 19 nt, Homo sapiens
gauaagacauacugaaaag

SEQ ID NO: 655433 - RNA, 19 nt, Homo sapiens
ugaagaauguggcaaagcu

SEQ ID NO: 655434 - RNA, 19 nt, Homo sapiens
gaaacucuacaaaugugaa

SEQ ID NO: 655435 - RNA, 19 nt, Homo sapiens
uuuaaucgguccucaacuu

SEQ ID NO: 655436 - RNA, 19 nt, Homo sapiens
gcauuuaucauagagagaa

SEQ ID NO: 655437 - RNA, 19 nt, Homo sapiens
gauguuagagaacuacaga

SEQ ID NO: 655438 - RNA, 19 nt, Homo sapiens
gaccuaagauaagacauac

SEQ ID NO: 655439 - RNA, 19 nt, Homo sapiens
ccucgcaccucaccacaga

SEQ ID NO: 655440 - RNA, 19 nt, Homo sapiens
ggacauugcacagcagaau

SEQ ID NO: 655441 - RNA, 19 nt, Homo sapiens
auacugaagagaaaccuua

SEQ ID NO: 655442 - RNA, 19 nt, Homo sapiens
agaccuaagauaagacaua

SEQ ID NO: 655443 - RNA, 19 nt, Homo sapiens
caaacagaccuaagauaag

SEQ ID NO: 655444 - RNA, 19 nt, Homo sapiens
aaaguguggaugaguauaa

SEQ ID NO: 655445 - RNA, 19 nt, Homo sapiens
gcauuuauacuugagaaga

SEQ ID NO: 655446 - RNA, 19 nt, Homo sapiens
gagaaaucuuacaaguaug

SEQ ID NO: 655447 - RNA, 19 nt, Homo sapiens
acaaagaagguuauaaugg

SEQ ID NO: 655448 - RNA, 19 nt, Homo sapiens
gaaaauauggacaugagaa

SEQ ID NO: 655449 - RNA, 19 nt, Homo sapiens
uuagggauguggccauaga

SEQ ID NO: 655450 - RNA, 19 nt, Homo sapiens
ggagagaaacuacaaaccu

SEQ ID NO: 655451 - RNA, 19 nt, Homo sapiens
ugucuucacugcucugugu

SEQ ID NO: 655452 - RNA, 19 nt, Homo sapiens
ccucaccacagauaagaua

SEQ ID NO: 655453 - RNA, 19 nt, Homo sapiens
uauaacaaaucuccuaagc

SEQ ID NO: 655454 - RNA, 19 nt, Homo sapiens
aacaccugcucacaucuua

SEQ ID NO: 655455 - RNA, 19 nt, Homo sapiens
ggagauccacagcuaagau

SEQ ID NO: 655456 - RNA, 19 nt, Homo sapiens
gguccucaacccuaacuaa

SEQ ID NO: 655457 - RNA, 19 nt, Homo sapiens
guaaaacccuacaaaugug

SEQ ID NO: 655458 - RNA, 19 nt, Homo sapiens
gguccucaacccuuacuaa

SEQ ID NO: 655459 - RNA, 19 nt, Homo sapiens
cacacuugauuguagguaa

SEQ ID NO: 655460 - RNA, 19 nt, Homo sapiens
auacuggagagaaaucuua

SEQ ID NO: 655461 - RNA, 19 nt, Homo sapiens
ugaagagaaaccuuacaaa

SEQ ID NO: 655462 - RNA, 19 nt, Homo sapiens
gggauguggccauagaauu

SEQ ID NO: 655463 - RNA, 19 nt, Homo sapiens
ggacaugagaauuuacagu

SEQ ID NO: 655464 - RNA, 19 nt, Homo sapiens
ggaauaugaagcgacauga

SEQ ID NO: 655465 - RNA, 19 nt, Homo sapiens
caacccuaacuaaacauaa

SEQ ID NO: 655466 - RNA, 19 nt, Homo sapiens
gaagaauguggcaaagcuu

SEQ ID NO: 655467 - RNA, 19 nt, Homo sapiens
ucacaaagguguucgaaau

SEQ ID NO: 655468 - RNA, 19 nt, Homo sapiens
gaacaaccaagacuuuaaa

SEQ ID NO: 655469 - RNA, 19 nt, Homo sapiens
ggaagaauuucagaacauu

SEQ ID NO: 655470 - RNA, 19 nt, Homo sapiens
cagcagagcucacaaaggu

SEQ ID NO: 655471 - RNA, 19 nt, Homo sapiens
uaaugaagguggacaaaga

SEQ ID NO: 655472 - RNA, 19 nt, Homo sapiens
gaggaagaauuucagaaca

SEQ ID NO: 655473 - RNA, 19 nt, Homo sapiens
ggacaaagaccggcagaug

SEQ ID NO: 655474 - RNA, 19 nt, Homo sapiens
ggacugaauuccugauguc

SEQ ID NO: 655475 - RNA, 19 nt, Homo sapiens
gaaauccgcaccacugaug

SEQ ID NO: 655476 - RNA, 19 nt, Homo sapiens
gaacaacagaugauguaug

SEQ ID NO: 655477 - RNA, 19 nt, Homo sapiens
agacaaugcagccaucaua

SEQ ID NO: 655478 - RNA, 19 nt, Homo sapiens
gacaaugcagccaucauaa

SEQ ID NO: 655479 - RNA, 19 nt, Homo sapiens
cgagguagacccagagcua

SEQ ID NO: 655480 - RNA, 19 nt, Homo sapiens
caaugcagccaucauaaug

SEQ ID NO: 655481 - RNA, 19 nt, Homo sapiens
cugaauuccugaugucuga

SEQ ID NO: 655482 - RNA, 19 nt, Homo sapiens
ugaacaaccaagacuuuaa

SEQ ID NO: 655483 - RNA, 19 nt, Homo sapiens
ccacugaugaccucacuga

SEQ ID NO: 655484 - RNA, 19 nt, Homo sapiens
cggaacaacagaugaugua

SEQ ID NO: 655485 - RNA, 19 nt, Homo sapiens
ccuaggaccugaacaacca

SEQ ID NO: 655486 - RNA, 19 nt, Homo sapiens
gggacugaauuccugaugu

SEQ ID NO: 655487 - RNA, 19 nt, Homo sapiens
gaaaagagacagacaaugc

SEQ ID NO: 655488 - RNA, 19 nt, Homo sapiens
cagaggagcucaaaaugga

SEQ ID NO: 655489 - RNA, 19 nt, Homo sapiens
ggaggaagaauuucagaac

SEQ ID NO: 655490 - RNA, 19 nt, Homo sapiens
gaaauuccgcuuccgaaaa

SEQ ID NO: 655491 - RNA, 19 nt, Homo sapiens
uguccuacccuuuguguuu

SEQ ID NO: 655492 - RNA, 19 nt, Homo sapiens
aacaacagaugauguaugc

SEQ ID NO: 655493 - RNA, 19 nt, Homo sapiens
ggugcuggaggaagaauuu

SEQ ID NO: 655494 - RNA, 19 nt, Homo sapiens
gagguagacccagagcuaa

SEQ ID NO: 655495 - RNA, 19 nt, Homo sapiens
ccugaacaaccaagacuuu

SEQ ID NO: 655496 - RNA, 19 nt, Homo sapiens
gcagacagcagagcucaca

SEQ ID NO: 655497 - RNA, 19 nt, Homo sapiens
gcuacaaguacgugcauga

SEQ ID NO: 655498 - RNA, 19 nt, Homo sapiens
gcugcaagccggaacaaca

SEQ ID NO: 655499 - RNA, 19 nt, Homo sapiens
cagcccagguucgugguuu

SEQ ID NO: 655500 - RNA, 19 nt, Homo sapiens
aggaagaauuucagaacau

SEQ ID NO: 655501 - RNA, 19 nt, Homo sapiens
agacagcagagcucacaaa

SEQ ID NO: 655502 - RNA, 19 nt, Homo sapiens
cgaguguccuacccuuugu

SEQ ID NO: 655503 - RNA, 19 nt, Homo sapiens
ggaacaacagaugauguau

SEQ ID NO: 655504 - RNA, 19 nt, Homo sapiens
cugaacaaccaagacuuua

SEQ ID NO: 655505 - RNA, 19 nt, Homo sapiens
cauaaugaagguggacaaa

SEQ ID NO: 655506 - RNA, 19 nt, Homo sapiens
gguucgugguuuacagcua

SEQ ID NO: 655507 - RNA, 19 nt, Homo sapiens
acaaagaccggcagauggu

SEQ ID NO: 655508 - RNA, 19 nt, Homo sapiens
acaaugcagccaucauaau

SEQ ID NO: 655509 - RNA, 19 nt, Homo sapiens
ccgaguguccuacccuuug

SEQ ID NO: 655510 - RNA, 19 nt, Homo sapiens
gauguaugcagggaguaaa

SEQ ID NO: 655511 - RNA, 19 nt, Homo sapiens
guccuacccuuuguguuuc

SEQ ID NO: 655512 - RNA, 19 nt, Homo sapiens
acaaagguguucgaaaucc

SEQ ID NO: 655513 - RNA, 19 nt, Homo sapiens
gcucacaaagguguucgaa

SEQ ID NO: 655514 - RNA, 19 nt, Homo sapiens
gacagcagagcucacaaag

SEQ ID NO: 655515 - RNA, 19 nt, Homo sapiens
gaagggagacucuauuuaa

SEQ ID NO: 655516 - RNA, 19 nt, Homo sapiens
caagacagauugugaagau

SEQ ID NO: 655517 - RNA, 19 nt, Homo sapiens
gaccugagaugugugauuu

SEQ ID NO: 655518 - RNA, 19 nt, Homo sapiens
ggagugaagugguacaauc

SEQ ID NO: 655519 - RNA, 19 nt, Homo sapiens
gagaagggagacucuauuu

SEQ ID NO: 655520 - RNA, 19 nt, Homo sapiens
gagacucuauuuaagauuc

SEQ ID NO: 655521 - RNA, 19 nt, Homo sapiens
caccauacccagcuaauuu

SEQ ID NO: 655522 - RNA, 19 nt, Homo sapiens
gcacgcugcuggucaucaa

SEQ ID NO: 655523 - RNA, 19 nt, Homo sapiens
gggagacucuauuuaagau

SEQ ID NO: 655524 - RNA, 19 nt, Homo sapiens
ggaaccauuucaagacaga

SEQ ID NO: 655525 - RNA, 19 nt, Homo sapiens
ggucuuggguuccuguaug

SEQ ID NO: 655526 - RNA, 19 nt, Homo sapiens
gacagauugugaagauuga

SEQ ID NO: 655527 - RNA, 19 nt, Homo sapiens
caagugaggcugcggaaga

SEQ ID NO: 655528 - RNA, 19 nt, Homo sapiens
ggcuaagaaugcagacuuu

SEQ ID NO: 655529 - RNA, 19 nt, Homo sapiens
uucaguaucuucaagguuu

SEQ ID NO: 655530 - RNA, 19 nt, Homo sapiens
uuaaaaggcucccauguga

SEQ ID NO: 655531 - RNA, 19 nt, Homo sapiens
ccaaagugcugggaugaca

SEQ ID NO: 655532 - RNA, 19 nt, Homo sapiens
gagacggguucaccauguu

SEQ ID NO: 655533 - RNA, 19 nt, Homo sapiens
aagcuggagugaaguggua

SEQ ID NO: 655534 - RNA, 19 nt, Homo sapiens
agaagggagacucuauuua

SEQ ID NO: 655535 - RNA, 19 nt, Homo sapiens
gauguuccuuccagauugu

SEQ ID NO: 655536 - RNA, 19 nt, Homo sapiens
ugauguuccuuccagauug

SEQ ID NO: 655537 - RNA, 19 nt, Homo sapiens
ugucuuugcugcagucuuc

SEQ ID NO: 655538 - RNA, 19 nt, Homo sapiens
gaccagccacucaaaggaa

SEQ ID NO: 655539 - RNA, 19 nt, Homo sapiens
uaaaguaacagagcaucaa

SEQ ID NO: 655540 - RNA, 19 nt, Homo sapiens
agacagauugugaagauug

SEQ ID NO: 655541 - RNA, 19 nt, Homo sapiens
gggcuucgucuacuccuuu

SEQ ID NO: 655542 - RNA, 19 nt, Homo sapiens
gccaccaucuggaguuuua

SEQ ID NO: 655543 - RNA, 19 nt, Homo sapiens
gcccacagccuggugauga

SEQ ID NO: 655544 - RNA, 19 nt, Homo sapiens
gggcuaagaaugcagacuu

SEQ ID NO: 655545 - RNA, 19 nt, Homo sapiens
gaacuccuggccucaagug

SEQ ID NO: 655546 - RNA, 19 nt, Homo sapiens
agagacggguucaccaugu

SEQ ID NO: 655547 - RNA, 19 nt, Homo sapiens
gaaaauccuucagcuaaag

SEQ ID NO: 655548 - RNA, 19 nt, Homo sapiens
uagaaaauccuucagcuaa

SEQ ID NO: 655549 - RNA, 19 nt, Homo sapiens
uuaagauucccaaaccuaa

SEQ ID NO: 655550 - RNA, 19 nt, Homo sapiens
ccaguucucuguggaagca

SEQ ID NO: 655551 - RNA, 19 nt, Homo sapiens
ccaggagggucucgaacuc

SEQ ID NO: 655552 - RNA, 19 nt, Homo sapiens
cugaguagcugggauuaca

SEQ ID NO: 655553 - RNA, 19 nt, Homo sapiens
cagauugugaagauugaua

SEQ ID NO: 655554 - RNA, 19 nt, Homo sapiens
guauguguguguguauguu

SEQ ID NO: 655555 - RNA, 19 nt, Homo sapiens
caucaucacgggccaagug

SEQ ID NO: 655556 - RNA, 19 nt, Homo sapiens
cagccaccaucuggaguuu

SEQ ID NO: 655557 - RNA, 19 nt, Homo sapiens
gcaagccuggccaucugua

SEQ ID NO: 655558 - RNA, 19 nt, Homo sapiens
aaaguaacagagcaucaaa

SEQ ID NO: 655559 - RNA, 19 nt, Homo sapiens
ggaugacaggcaugaauca

SEQ ID NO: 655560 - RNA, 19 nt, Homo sapiens
aagggagacucuauuuaag

SEQ ID NO: 655561 - RNA, 19 nt, Homo sapiens
cuagacccgugaccugaga

SEQ ID NO: 655562 - RNA, 19 nt, Homo sapiens
agaaaauccuucagcuaaa

SEQ ID NO: 655563 - RNA, 19 nt, Homo sapiens
ggaauccgugugugugugu

SEQ ID NO: 655564 - RNA, 19 nt, Homo sapiens
ucuggucccuucaguaucu

SEQ ID NO: 655565 - RNA, 19 nt, Homo sapiens
ggauuacaggcgcguauca

SEQ ID NO: 655566 - RNA, 19 nt, Homo sapiens
ucccaaaccuaaugaucau

SEQ ID NO: 655567 - RNA, 19 nt, Homo sapiens
ggaugcacuuccuggucuu

SEQ ID NO: 655568 - RNA, 19 nt, Homo sapiens
ggagacucuauuuaagauu

SEQ ID NO: 655569 - RNA, 19 nt, Homo sapiens
ucaguaucuucaagguuug

SEQ ID NO: 655570 - RNA, 19 nt, Homo sapiens
caugugagucccugugaug

SEQ ID NO: 655571 - RNA, 19 nt, Homo sapiens
gggaugacaggcaugaauc

SEQ ID NO: 655572 - RNA, 19 nt, Homo sapiens
ugggaaccauuucaagaca

SEQ ID NO: 655573 - RNA, 19 nt, Homo sapiens
aagugaggcugcggaagaa

SEQ ID NO: 655574 - RNA, 19 nt, Homo sapiens
ugcccaagcuggagugaag

SEQ ID NO: 655575 - RNA, 19 nt, Homo sapiens
cuaaugaucaucugaaucc

SEQ ID NO: 655576 - RNA, 19 nt, Homo sapiens
uaagauucccaaaccuaau

SEQ ID NO: 655577 - RNA, 19 nt, Homo sapiens
caaaccuaaugaucaucug

SEQ ID NO: 655578 - RNA, 19 nt, Homo sapiens
ccguguguguguaugugua

SEQ ID NO: 655579 - RNA, 19 nt, Homo sapiens
gaacuuucuggucccuuca

SEQ ID NO: 655580 - RNA, 19 nt, Homo sapiens
guagagacggguucaccau

SEQ ID NO: 655581 - RNA, 19 nt, Homo sapiens
acaggcgcguaucaccaua

SEQ ID NO: 655582 - RNA, 19 nt, Homo sapiens
gagugaagugguacaaucu

SEQ ID NO: 655583 - RNA, 19 nt, Homo sapiens
uuuaagauucccaaaccua

SEQ ID NO: 655584 - RNA, 19 nt, Homo sapiens
uauuuaagauucccaaacc

SEQ ID NO: 655585 - RNA, 19 nt, Homo sapiens
uaucuucaagguuuggaaa

SEQ ID NO: 655586 - RNA, 19 nt, Homo sapiens
aaaccuaaugaucaucuga

SEQ ID NO: 655587 - RNA, 19 nt, Homo sapiens
gccguuggcuuuggauguc

SEQ ID NO: 655588 - RNA, 19 nt, Homo sapiens
ugaccugagaugugugauu

SEQ ID NO: 655589 - RNA, 19 nt, Homo sapiens
ugaccagccacucaaagga

SEQ ID NO: 655590 - RNA, 19 nt, Homo sapiens
ucaccauacccagcuaauu

SEQ ID NO: 655591 - RNA, 19 nt, Homo sapiens
ccaaaccuaaugaucaucu

SEQ ID NO: 655592 - RNA, 19 nt, Homo sapiens
agggagacucuauuuaaga

SEQ ID NO: 655593 - RNA, 19 nt, Homo sapiens
guacgugguggccaucauc

SEQ ID NO: 655594 - RNA, 19 nt, Homo sapiens
guguguguauguuucuuag

SEQ ID NO: 655595 - RNA, 19 nt, Homo sapiens
gcaaggagauuuacaguug

SEQ ID NO: 655596 - RNA, 19 nt, Homo sapiens
aaacuuggcuuccuucuaa

SEQ ID NO: 655597 - RNA, 19 nt, Homo sapiens
guaaagaucuggaaagaca

SEQ ID NO: 655598 - RNA, 19 nt, Homo sapiens
gaaugaggcuugcguuguu

SEQ ID NO: 655599 - RNA, 19 nt, Homo sapiens
gaacagaaggaaagccaua

SEQ ID NO: 655600 - RNA, 19 nt, Homo sapiens
caacucagcacaggaaaua

SEQ ID NO: 655601 - RNA, 19 nt, Homo sapiens
gcacaggaaauaaguagaa

SEQ ID NO: 655602 - RNA, 19 nt, Homo sapiens
uaauagugaugguugguuu

SEQ ID NO: 655603 - RNA, 19 nt, Homo sapiens
ggacagguguagggagaaa

SEQ ID NO: 655604 - RNA, 19 nt, Homo sapiens
aaaucaagcuggagucaug

SEQ ID NO: 655605 - RNA, 19 nt, Homo sapiens
ggccuaaauccucuuaaua

SEQ ID NO: 655606 - RNA, 19 nt, Homo sapiens
ccgagacucugcuugguaa

SEQ ID NO: 655607 - RNA, 19 nt, Homo sapiens
gggccuaaauccucuuaau

SEQ ID NO: 655608 - RNA, 19 nt, Homo sapiens
gaacacacacacagacaca

SEQ ID NO: 655609 - RNA, 19 nt, Homo sapiens
gaacacacacagacacaca

SEQ ID NO: 655610 - RNA, 19 nt, Homo sapiens
gcacccagauacagcaaca

SEQ ID NO: 655611 - RNA, 19 nt, Homo sapiens
cagacucgcucucccauca

SEQ ID NO: 655612 - RNA, 19 nt, Homo sapiens
caacggucacuauuuauuc

SEQ ID NO: 655613 - RNA, 19 nt, Homo sapiens
ugagauggcaccucccuuu

SEQ ID NO: 655614 - RNA, 19 nt, Homo sapiens
ggaaugaggcuugcguugu

SEQ ID NO: 655615 - RNA, 19 nt, Homo sapiens
gccuaaauccucuuaauag

SEQ ID NO: 655616 - RNA, 19 nt, Homo sapiens
ccuaaauccucuuaauagu

SEQ ID NO: 655617 - RNA, 19 nt, Homo sapiens
uggcaucugucucuugcua

SEQ ID NO: 655618 - RNA, 19 nt, Homo sapiens
uggagggugucuauaggua

SEQ ID NO: 655619 - RNA, 19 nt, Homo sapiens
gagaggaggaacagaagga

SEQ ID NO: 655620 - RNA, 19 nt, Homo sapiens
ggucacuauuuauucuuug

SEQ ID NO: 655621 - RNA, 19 nt, Homo sapiens
gagauuuacaguugggaaa

SEQ ID NO: 655622 - RNA, 19 nt, Homo sapiens
gagggugucuauagguaca

SEQ ID NO: 655623 - RNA, 19 nt, Homo sapiens
gcaagguccagguaaagau

SEQ ID NO: 655624 - RNA, 19 nt, Homo sapiens
cacaggaaauaaguagaaa

SEQ ID NO: 655625 - RNA, 19 nt, Homo sapiens
caacacacacacauacaca

SEQ ID NO: 655626 - RNA, 19 nt, Homo sapiens
ccaaaucaagaccaccuuu

SEQ ID NO: 655627 - RNA, 19 nt, Homo sapiens
ucaacggucacuauuuauu

SEQ ID NO: 655628 - RNA, 19 nt, Homo sapiens
acacacgugcgccuucaua

SEQ ID NO: 655629 - RNA, 19 nt, Homo sapiens
ggaaagacagaacguacag

SEQ ID NO: 655630 - RNA, 19 nt, Homo sapiens
ggaggguggcguggcuuua

SEQ ID NO: 655631 - RNA, 19 nt, Homo sapiens
caggaaauaaguagaaaca

SEQ ID NO: 655632 - RNA, 19 nt, Homo sapiens
uaaacuuggcuuccuucua

SEQ ID NO: 655633 - RNA, 19 nt, Homo sapiens
cuaaauccucuuaauagug

SEQ ID NO: 655634 - RNA, 19 nt, Homo sapiens
gauggcaccucccuuucag

SEQ ID NO: 655635 - RNA, 19 nt, Homo sapiens
acacacacagacacacaua

SEQ ID NO: 655636 - RNA, 19 nt, Homo sapiens
agguaaagaucuggaaaga

SEQ ID NO: 655637 - RNA, 19 nt, Homo sapiens
agagcuaauuguaguggaa

SEQ ID NO: 655638 - RNA, 19 nt, Homo sapiens
gaggaggaacagaaggaaa

SEQ ID NO: 655639 - RNA, 19 nt, Homo sapiens
cggucacuauuuauucuuu

SEQ ID NO: 655640 - RNA, 19 nt, Homo sapiens
aauacuggguggcuugguu

SEQ ID NO: 655641 - RNA, 19 nt, Homo sapiens
gagaacacacacagacaca

SEQ ID NO: 655642 - RNA, 19 nt, Homo sapiens
caucagcagccucuuguca

SEQ ID NO: 655643 - RNA, 19 nt, Homo sapiens
gcuggagggugucuauagg

SEQ ID NO: 655644 - RNA, 19 nt, Homo sapiens
gccugugccucucccuaaa

SEQ ID NO: 655645 - RNA, 19 nt, Homo sapiens
ccacaugcacacccugaga

SEQ ID NO: 655646 - RNA, 19 nt, Homo sapiens
uggcaaaggcugacaacug

SEQ ID NO: 655647 - RNA, 19 nt, Homo sapiens
gagauggcaccucccuuuc

SEQ ID NO: 655648 - RNA, 19 nt, Homo sapiens
cuaaagugcaaggagauuu

SEQ ID NO: 655649 - RNA, 19 nt, Homo sapiens
cuugcaagguccagguaaa

SEQ ID NO: 655650 - RNA, 19 nt, Homo sapiens
ccacucuccuggccugaca

SEQ ID NO: 655651 - RNA, 19 nt, Homo sapiens
ucccaucacuggcauagag

SEQ ID NO: 655652 - RNA, 19 nt, Homo sapiens
ccacacacagcuagaaguc

SEQ ID NO: 655653 - RNA, 19 nt, Homo sapiens
acacaacacacacacauac

SEQ ID NO: 655654 - RNA, 19 nt, Homo sapiens
cacacaacacacacacaua

SEQ ID NO: 655655 - RNA, 19 nt, Homo sapiens
aguggaagccugcaagguu

SEQ ID NO: 655656 - RNA, 19 nt, Homo sapiens
guggcuugguuuagagcua

SEQ ID NO: 655657 - RNA, 19 nt, Homo sapiens
cagcacaggaaauaaguag

SEQ ID NO: 655658 - RNA, 19 nt, Homo sapiens
acacacagacacacauaca

SEQ ID NO: 655659 - RNA, 19 nt, Homo sapiens
gaggguagugggcuaaguc

SEQ ID NO: 655660 - RNA, 19 nt, Homo sapiens
caagaaugggccacacaca

SEQ ID NO: 655661 - RNA, 19 nt, Homo sapiens
acacacacgugcgccuuca

SEQ ID NO: 655662 - RNA, 19 nt, Homo sapiens
gauuuacaguugggaaagg

SEQ ID NO: 655663 - RNA, 19 nt, Homo sapiens
caagguccagguaaagauc

SEQ ID NO: 655664 - RNA, 19 nt, Homo sapiens
cuggguggcuugguuuaga

SEQ ID NO: 655665 - RNA, 19 nt, Homo sapiens
cuccuggccugacaagaug

SEQ ID NO: 655666 - RNA, 19 nt, Homo sapiens
cccaugaugugagcaaaca

SEQ ID NO: 655667 - RNA, 19 nt, Homo sapiens
cagcuaaacuuggcuuccu

SEQ ID NO: 655668 - RNA, 19 nt, Homo sapiens
cagguggcccuccaacuca

SEQ ID NO: 655669 - RNA, 19 nt, Homo sapiens
ugggagaggaggaacagaa

SEQ ID NO: 655670 - RNA, 19 nt, Homo sapiens
acacacaacacacacacau

SEQ ID NO: 655671 - RNA, 19 nt, Homo sapiens
gaauaucguugguucaaua

SEQ ID NO: 655672 - RNA, 19 nt, Homo sapiens
gaauuggccuuacuacuuu

SEQ ID NO: 655673 - RNA, 19 nt, Homo sapiens
gcaaugcaguccucauaua

SEQ ID NO: 655674 - RNA, 19 nt, Homo sapiens
gggcagaaauuuacuguug

SEQ ID NO: 655675 - RNA, 19 nt, Homo sapiens
gagcugguuucccaaauaa

SEQ ID NO: 655676 - RNA, 19 nt, Homo sapiens
ggaauuggccuuacuacuu

SEQ ID NO: 655677 - RNA, 19 nt, Homo sapiens
caacaacacuaaaccugaa

SEQ ID NO: 655678 - RNA, 19 nt, Homo sapiens
gacaugcucuucaaccuuu

SEQ ID NO: 655679 - RNA, 19 nt, Homo sapiens
guaaaggagugucccaguu

SEQ ID NO: 655680 - RNA, 19 nt, Homo sapiens
uagcugaccuggcauuuga

SEQ ID NO: 655681 - RNA, 19 nt, Homo sapiens
gcaacagacucuuccacaa

SEQ ID NO: 655682 - RNA, 19 nt, Homo sapiens
ggacugauuggaacacuuu

SEQ ID NO: 655683 - RNA, 19 nt, Homo sapiens
gagaugagauaggaggaaa

SEQ ID NO: 655684 - RNA, 19 nt, Homo sapiens
augcaguccucauauauua

SEQ ID NO: 655685 - RNA, 19 nt, Homo sapiens
ccaggucuauuuccauauu

SEQ ID NO: 655686 - RNA, 19 nt, Homo sapiens
ugagcugguuucccaaaua

SEQ ID NO: 655687 - RNA, 19 nt, Homo sapiens
ccuggucacucccuuuaua

SEQ ID NO: 655688 - RNA, 19 nt, Homo sapiens
cguauucccuucucucuga

SEQ ID NO: 655689 - RNA, 19 nt, Homo sapiens
guauagagcggaaacaaga

SEQ ID NO: 655690 - RNA, 19 nt, Homo sapiens
gagagugaaccacguauug

SEQ ID NO: 655691 - RNA, 19 nt, Homo sapiens
gccauuugguuucaggaua

SEQ ID NO: 655692 - RNA, 19 nt, Homo sapiens
gguaacagcccgaauuauc

SEQ ID NO: 655693 - RNA, 19 nt, Homo sapiens
gaauauugggugcugcaua

SEQ ID NO: 655694 - RNA, 19 nt, Homo sapiens
gaaacacauacauuggaua

SEQ ID NO: 655695 - RNA, 19 nt, Homo sapiens
ccucuuuccuuuauucauu

SEQ ID NO: 655696 - RNA, 19 nt, Homo sapiens
caaaauaauugcugacaug

SEQ ID NO: 655697 - RNA, 19 nt, Homo sapiens
cagcaaugcaguccucaua

SEQ ID NO: 655698 - RNA, 19 nt, Homo sapiens
ucacuguacugcuuugaau

SEQ ID NO: 655699 - RNA, 19 nt, Homo sapiens
gaaccacguauuguuagua

SEQ ID NO: 655700 - RNA, 19 nt, Homo sapiens
guauuaaaccugugauuag

SEQ ID NO: 655701 - RNA, 19 nt, Homo sapiens
caccagcgguugucuaaca

SEQ ID NO: 655702 - RNA, 19 nt, Homo sapiens
gaaaugcaccagcgguugu

SEQ ID NO: 655703 - RNA, 19 nt, Homo sapiens
caagagagugaaccacgua

SEQ ID NO: 655704 - RNA, 19 nt, Homo sapiens
aaagcuagaugcucgaauc

SEQ ID NO: 655705 - RNA, 19 nt, Homo sapiens
uaaaggagugucccaguug

SEQ ID NO: 655706 - RNA, 19 nt, Homo sapiens
ccauuugguuucaggauau

SEQ ID NO: 655707 - RNA, 19 nt, Homo sapiens
ugaaacacauacauuggau

SEQ ID NO: 655708 - RNA, 19 nt, Homo sapiens
cgaagaagggcaaguagug

SEQ ID NO: 655709 - RNA, 19 nt, Homo sapiens
ugccaggucuauuuccaua

SEQ ID NO: 655710 - RNA, 19 nt, Homo sapiens
cugaagagaugagauagga

SEQ ID NO: 655711 - RNA, 19 nt, Homo sapiens
caacagacucuuccacaag

SEQ ID NO: 655712 - RNA, 19 nt, Homo sapiens
ggauaugggagguaaagga

SEQ ID NO: 655713 - RNA, 19 nt, Homo sapiens
ugaguugccugccauccaa

SEQ ID NO: 655714 - RNA, 19 nt, Homo sapiens
ucuauccucuuuccuuuau

SEQ ID NO: 655715 - RNA, 19 nt, Homo sapiens
gcauaugucccuucucuac

SEQ ID NO: 655716 - RNA, 19 nt, Homo sapiens
ccacguauuguuaguagaa

SEQ ID NO: 655717 - RNA, 19 nt, Homo sapiens
gaggagcagcgucgaagaa

SEQ ID NO: 655718 - RNA, 19 nt, Homo sapiens
ggcagaauguucccugaca

SEQ ID NO: 655719 - RNA, 19 nt, Homo sapiens
caaugcaguccucauauau

SEQ ID NO: 655720 - RNA, 19 nt, Homo sapiens
gaagaagggcaaguagugu

SEQ ID NO: 655721 - RNA, 19 nt, Homo sapiens
agccauuacugucuuguuu

SEQ ID NO: 655722 - RNA, 19 nt, Homo sapiens
uaucguugguucaauaaag

SEQ ID NO: 655723 - RNA, 19 nt, Homo sapiens
gggcagauguucaaaauac

SEQ ID NO: 655724 - RNA, 19 nt, Homo sapiens
gaugagauaggaggaaaga

SEQ ID NO: 655725 - RNA, 19 nt, Homo sapiens
guuagucuccugcauaugu

SEQ ID NO: 655726 - RNA, 19 nt, Homo sapiens
guguguaguugauaguuug

SEQ ID NO: 655727 - RNA, 19 nt, Homo sapiens
gcacguaaggcagaauguu

SEQ ID NO: 655728 - RNA, 19 nt, Homo sapiens
gaaacaagagagugaacca

SEQ ID NO: 655729 - RNA, 19 nt, Homo sapiens
uaccaauucuggacaaagu

SEQ ID NO: 655730 - RNA, 19 nt, Homo sapiens
ucugaaaggccacagguuu

SEQ ID NO: 655731 - RNA, 19 nt, Homo sapiens
uaucaguggcugccucuuu

SEQ ID NO: 655732 - RNA, 19 nt, Homo sapiens
gagugaaccacguauuguu

SEQ ID NO: 655733 - RNA, 19 nt, Homo sapiens
agugaaccacguauuguua

SEQ ID NO: 655734 - RNA, 19 nt, Homo sapiens
caggucuauuuccauauuu

SEQ ID NO: 655735 - RNA, 19 nt, Homo sapiens
cauuggauaugggagguaa

SEQ ID NO: 655736 - RNA, 19 nt, Homo sapiens
uauccucuuuccuuuauuc

SEQ ID NO: 655737 - RNA, 19 nt, Homo sapiens
uuucuauccucuuuccuuu

SEQ ID NO: 655738 - RNA, 19 nt, Homo sapiens
gguucagucuccucuuguu

SEQ ID NO: 655739 - RNA, 19 nt, Homo sapiens
gcaguccucauauauuauc

SEQ ID NO: 655740 - RNA, 19 nt, Homo sapiens
aauuaucggugacccauca

SEQ ID NO: 655741 - RNA, 19 nt, Homo sapiens
gguggaguguucugguuca

SEQ ID NO: 655742 - RNA, 19 nt, Homo sapiens
gccagcgggcagaaauuua

SEQ ID NO: 655743 - RNA, 19 nt, Homo sapiens
ccacuacaacaacacuaaa

SEQ ID NO: 655744 - RNA, 19 nt, Homo sapiens
ggagugauuuucuuuccuu

SEQ ID NO: 655745 - RNA, 19 nt, Homo sapiens
gugaaacacauacauugga

SEQ ID NO: 655746 - RNA, 19 nt, Homo sapiens
uguguguaguugauaguuu

SEQ ID NO: 655747 - RNA, 19 nt, Homo sapiens
guacugcuuugaauaucgu

SEQ ID NO: 655748 - RNA, 19 nt, Homo sapiens
cugcauaugucccuucucu

SEQ ID NO: 655749 - RNA, 19 nt, Homo sapiens
gccacugccaggucuauuu

SEQ ID NO: 655750 - RNA, 19 nt, Homo sapiens
ggccagcgggcagaaauuu

SEQ ID NO: 655751 - RNA, 19 nt, Homo sapiens
gccacuacaacaacacuaa

SEQ ID NO: 655752 - RNA, 19 nt, Homo sapiens
gaguauagagcggaaacaa

SEQ ID NO: 655753 - RNA, 19 nt, Homo sapiens
ggucacaauuaaacaugag

SEQ ID NO: 655754 - RNA, 19 nt, Homo sapiens
auuacugucuuguuucuug

SEQ ID NO: 655755 - RNA, 19 nt, Homo sapiens
ccauuacugucuuguuucu

SEQ ID NO: 655756 - RNA, 19 nt, Homo sapiens
guaauucuagcuguuguau

SEQ ID NO: 655757 - RNA, 19 nt, Homo sapiens
uaacauagaaaggaauugg

SEQ ID NO: 655758 - RNA, 19 nt, Homo sapiens
cagcgguugucuaacauag

SEQ ID NO: 655759 - RNA, 19 nt, Homo sapiens
acacuaaaccugaacuuuu

SEQ ID NO: 655760 - RNA, 19 nt, Homo sapiens
gguaccaauucuggacaaa

SEQ ID NO: 655761 - RNA, 19 nt, Homo sapiens
uaucagcgccaaugaagca

SEQ ID NO: 655762 - RNA, 19 nt, Homo sapiens
ugguuagucuccugcauau

SEQ ID NO: 655763 - RNA, 19 nt, Homo sapiens
ccucacccauucccuagug

SEQ ID NO: 655764 - RNA, 19 nt, Homo sapiens
cauuugguuucaggauaua

SEQ ID NO: 655765 - RNA, 19 nt, Homo sapiens
guaacagcccgaauuaucg

SEQ ID NO: 655766 - RNA, 19 nt, Homo sapiens
cgucgaagaagggcaagua

SEQ ID NO: 655767 - RNA, 19 nt, Homo sapiens
ucagucuccucuuguuuua

SEQ ID NO: 655768 - RNA, 19 nt, Homo sapiens
aauuaaacaugagcugguu

SEQ ID NO: 655769 - RNA, 19 nt, Homo sapiens
uauuaaaccugugauuagg

SEQ ID NO: 655770 - RNA, 19 nt, Homo sapiens
cuaccacccuuggaugaau

SEQ ID NO: 655771 - RNA, 19 nt, Homo sapiens
gagcaaaccuggagaagau

SEQ ID NO: 655772 - RNA, 19 nt, Homo sapiens
gaagucugaucaccaguuu

SEQ ID NO: 655773 - RNA, 19 nt, Homo sapiens
gacagaaucuacccaguga

SEQ ID NO: 655774 - RNA, 19 nt, Homo sapiens
caaaggugcuggaguuaau

SEQ ID NO: 655775 - RNA, 19 nt, Homo sapiens
gacaauaaguacaagcaaa

SEQ ID NO: 655776 - RNA, 19 nt, Homo sapiens
gggcacagcugcuauccaa

SEQ ID NO: 655777 - RNA, 19 nt, Homo sapiens
ggagaagauucacaauaga

SEQ ID NO: 655778 - RNA, 19 nt, Homo sapiens
gggaggaggugacaucaau

SEQ ID NO: 655779 - RNA, 19 nt, Homo sapiens
aagcugauaugaggaaaua

SEQ ID NO: 655780 - RNA, 19 nt, Homo sapiens
uggagaagauucacaauag

SEQ ID NO: 655781 - RNA, 19 nt, Homo sapiens
ggucuagggacaauaagua

SEQ ID NO: 655782 - RNA, 19 nt, Homo sapiens
gcagagacaaggccaguau

SEQ ID NO: 655783 - RNA, 19 nt, Homo sapiens
ggaaauaaagagugaacug

SEQ ID NO: 655784 - RNA, 19 nt, Homo sapiens
ggaguuaaucuuauucuag

SEQ ID NO: 655785 - RNA, 19 nt, Homo sapiens
ccggauggcuggagcuauu

SEQ ID NO: 655786 - RNA, 19 nt, Homo sapiens
gcugauaugaggaaauaaa

SEQ ID NO: 655787 - RNA, 19 nt, Homo sapiens
caauagacaggccaagaaa

SEQ ID NO: 655788 - RNA, 19 nt, Homo sapiens
gugcuggaguuaaucuuau

SEQ ID NO: 655789 - RNA, 19 nt, Homo sapiens
ggugcuggaguuaaucuua

SEQ ID NO: 655790 - RNA, 19 nt, Homo sapiens
uauguuagccgugcacuuu

SEQ ID NO: 655791 - RNA, 19 nt, Homo sapiens
ggaagucugaucaccaguu

SEQ ID NO: 655792 - RNA, 19 nt, Homo sapiens
gaggauuucucugaagcaa

SEQ ID NO: 655793 - RNA, 19 nt, Homo sapiens
gagacuaugugcuaaucca

SEQ ID NO: 655794 - RNA, 19 nt, Homo sapiens
guccucagacaauauguua

SEQ ID NO: 655795 - RNA, 19 nt, Homo sapiens
ugaggcaucuggacaugug

SEQ ID NO: 655796 - RNA, 19 nt, Homo sapiens
gauaugaggaaauaaagag

SEQ ID NO: 655797 - RNA, 19 nt, Homo sapiens
ccaggagccagcaacauuu

SEQ ID NO: 655798 - RNA, 19 nt, Homo sapiens
ggacaauaaguacaagcaa

SEQ ID NO: 655799 - RNA, 19 nt, Homo sapiens
gcuggagacuaugugcuaa

SEQ ID NO: 655800 - RNA, 19 nt, Homo sapiens
uguuacaucuugugggaaa

SEQ ID NO: 655801 - RNA, 19 nt, Homo sapiens
ccaaaggugcuggaguuaa

SEQ ID NO: 655802 - RNA, 19 nt, Homo sapiens
gcugcuggauucaauuaca

SEQ ID NO: 655803 - RNA, 19 nt, Homo sapiens
gcacagcugcuauccaacu

SEQ ID NO: 655804 - RNA, 19 nt, Homo sapiens
gcaagaucguccuggaacu

SEQ ID NO: 655805 - RNA, 19 nt, Homo sapiens
guacauggaggccaacaag

SEQ ID NO: 655806 - RNA, 19 nt, Homo sapiens
ugaggucuagggacaauaa

SEQ ID NO: 655807 - RNA, 19 nt, Homo sapiens
ucagagggagugugauuug

SEQ ID NO: 655808 - RNA, 19 nt, Homo sapiens
acaauagacaggccaagaa

SEQ ID NO: 655809 - RNA, 19 nt, Homo sapiens
ccaguuugcugaggucuag

SEQ ID NO: 655810 - RNA, 19 nt, Homo sapiens
gugaaguccuccugaaggu

SEQ ID NO: 655811 - RNA, 19 nt, Homo sapiens
uccaggaggcccauaagua

SEQ ID NO: 655812 - RNA, 19 nt, Homo sapiens
gucgauggguucucuaugg

SEQ ID NO: 655813 - RNA, 19 nt, Homo sapiens
gggagaagaacgucaacug

SEQ ID NO: 655814 - RNA, 19 nt, Homo sapiens
ccaggaggcccauaaguac

SEQ ID NO: 655815 - RNA, 19 nt, Homo sapiens
aaaugcuggugaaugcuuu

SEQ ID NO: 655816 - RNA, 19 nt, Homo sapiens
caaaugcuggugaaugcuu

SEQ ID NO: 655817 - RNA, 19 nt, Homo sapiens
gcugaggucuagggacaau

SEQ ID NO: 655818 - RNA, 19 nt, Homo sapiens
gauggucgauggguucucu

SEQ ID NO: 655819 - RNA, 19 nt, Homo sapiens
cuggagaagauucacaaua

SEQ ID NO: 655820 - RNA, 19 nt, Homo sapiens
gcaaaccuggagaagauuc

SEQ ID NO: 655821 - RNA, 19 nt, Homo sapiens
acauggaggccaacaagaa

SEQ ID NO: 655822 - RNA, 19 nt, Homo sapiens
gagcaaauucugccucacu

SEQ ID NO: 655823 - RNA, 19 nt, Homo sapiens
gauccuacugggagaagaa

SEQ ID NO: 655824 - RNA, 19 nt, Homo sapiens
augaggaaauaaagaguga

SEQ ID NO: 655825 - RNA, 19 nt, Homo sapiens
ugauuugccugauccucuu

SEQ ID NO: 655826 - RNA, 19 nt, Homo sapiens
acaagaacauaggcaagau

SEQ ID NO: 655827 - RNA, 19 nt, Homo sapiens
gcaaauucugccucacuuc

SEQ ID NO: 655828 - RNA, 19 nt, Homo sapiens
cggaaaaccucuacgugaa

SEQ ID NO: 655829 - RNA, 19 nt, Homo sapiens
cugaagcaacgcugaaauu

SEQ ID NO: 655830 - RNA, 19 nt, Homo sapiens
uaaagcugauaugaggaaa

SEQ ID NO: 655831 - RNA, 19 nt, Homo sapiens
gagaagauucacaauagac

SEQ ID NO: 655832 - RNA, 19 nt, Homo sapiens
agagacaaggccaguauga

SEQ ID NO: 655833 - RNA, 19 nt, Homo sapiens
caaauucugccucacuucu

SEQ ID NO: 655834 - RNA, 19 nt, Homo sapiens
ggagugugauuugccugau

SEQ ID NO: 655835 - RNA, 19 nt, Homo sapiens
uuaaagcugauaugaggaa

SEQ ID NO: 655836 - RNA, 19 nt, Homo sapiens
ggacuuaaugcagagacaa

SEQ ID NO: 655837 - RNA, 19 nt, Homo sapiens
ugaagcaacgcugaaauuc

SEQ ID NO: 655838 - RNA, 19 nt, Homo sapiens
uguuagccgugcacuuuga

SEQ ID NO: 655839 - RNA, 19 nt, Homo sapiens
uuccagcuguuacaucuug

SEQ ID NO: 655840 - RNA, 19 nt, Homo sapiens
gagugugauuugccugauc

SEQ ID NO: 655841 - RNA, 19 nt, Homo sapiens
ggaggccaacaagaacaua

SEQ ID NO: 655842 - RNA, 19 nt, Homo sapiens
gaggaggugacaucaaugg

SEQ ID NO: 655843 - RNA, 19 nt, Homo sapiens
ggaggcccauaaguacaug

SEQ ID NO: 655844 - RNA, 19 nt, Homo sapiens
gaaauccaggaggcccaua

SEQ ID NO: 655845 - RNA, 19 nt, Homo sapiens
caauaaguacaagcaaaug

SEQ ID NO: 655846 - RNA, 19 nt, Homo sapiens
ggcuggagacuaugugcua

SEQ ID NO: 655847 - RNA, 19 nt, Homo sapiens
uguucaggcuggagacuau

SEQ ID NO: 655848 - RNA, 19 nt, Homo sapiens
uccaggagccagcaacauu

SEQ ID NO: 655849 - RNA, 19 nt, Homo sapiens
cuagggacaauaaguacaa

SEQ ID NO: 655850 - RNA, 19 nt, Homo sapiens
gguucucuauggucugaug

SEQ ID NO: 655851 - RNA, 19 nt, Homo sapiens
cugcuggauucaauuacaa

SEQ ID NO: 655852 - RNA, 19 nt, Homo sapiens
caagaacauaggcaagauc

SEQ ID NO: 655853 - RNA, 19 nt, Homo sapiens
ggaggaggugacaucaaug

SEQ ID NO: 655854 - RNA, 19 nt, Homo sapiens
gaggaaauaaagagugaac

SEQ ID NO: 655855 - RNA, 19 nt, Homo sapiens
caucuugugggaaauguuc

SEQ ID NO: 655856 - RNA, 19 nt, Homo sapiens
cacaauagacaggccaaga

SEQ ID NO: 655857 - RNA, 19 nt, Homo sapiens
caagaucguccuggaacug

SEQ ID NO: 655858 - RNA, 19 nt, Homo sapiens
uuuaagcgaggaagucuga

SEQ ID NO: 655859 - RNA, 19 nt, Homo sapiens
gggacaauaaguacaagca

SEQ ID NO: 655860 - RNA, 19 nt, Homo sapiens
gagcaaaccuggagaagau

SEQ ID NO: 655861 - RNA, 19 nt, Homo sapiens
gaagucugaucaccaguuu

SEQ ID NO: 655862 - RNA, 19 nt, Homo sapiens
gacagaaucuacccaguga

SEQ ID NO: 655863 - RNA, 19 nt, Homo sapiens
caaaggugcuggaguuaau

SEQ ID NO: 655864 - RNA, 19 nt, Homo sapiens
gacaauaaguacaagcaaa

SEQ ID NO: 655865 - RNA, 19 nt, Homo sapiens
gggcacagcugcuauccaa

SEQ ID NO: 655866 - RNA, 19 nt, Homo sapiens
ggagaagauucacaauaga

SEQ ID NO: 655867 - RNA, 19 nt, Homo sapiens
gggaggaggugacaucaau

SEQ ID NO: 655868 - RNA, 19 nt, Homo sapiens
gaaauaaagagugaacuga

SEQ ID NO: 655869 - RNA, 19 nt, Homo sapiens
aagcugauaugaggaaaua

SEQ ID NO: 655870 - RNA, 19 nt, Homo sapiens
uggagaagauucacaauag

SEQ ID NO: 655871 - RNA, 19 nt, Homo sapiens
ggucuagggacaauaagua

SEQ ID NO: 655872 - RNA, 19 nt, Homo sapiens
gcagagacaaggccaguau

SEQ ID NO: 655873 - RNA, 19 nt, Homo sapiens
ggaaauaaagagugaacug

SEQ ID NO: 655874 - RNA, 19 nt, Homo sapiens
ggaguuaaucuuauucuag

SEQ ID NO: 655875 - RNA, 19 nt, Homo sapiens
ccggauggcuggagcuauu

SEQ ID NO: 655876 - RNA, 19 nt, Homo sapiens
gcugauaugaggaaauaaa

SEQ ID NO: 655877 - RNA, 19 nt, Homo sapiens
caauagacaggccaagaaa

SEQ ID NO: 655878 - RNA, 19 nt, Homo sapiens
uauguuagccgugcacuuu

SEQ ID NO: 655879 - RNA, 19 nt, Homo sapiens
gugcuggaguuaaucuuau

SEQ ID NO: 655880 - RNA, 19 nt, Homo sapiens
ggugcuggaguuaaucuua

SEQ ID NO: 655881 - RNA, 19 nt, Homo sapiens
ggaagucugaucaccaguu

SEQ ID NO: 655882 - RNA, 19 nt, Homo sapiens
gaggauuucucugaagcaa

SEQ ID NO: 655883 - RNA, 19 nt, Homo sapiens
gagacuaugugcuaaucca

SEQ ID NO: 655884 - RNA, 19 nt, Homo sapiens
ugaggcaucuggacaugug

SEQ ID NO: 655885 - RNA, 19 nt, Homo sapiens
gauaugaggaaauaaagag

SEQ ID NO: 655886 - RNA, 19 nt, Homo sapiens
ccaggagccagcaacauuu

SEQ ID NO: 655887 - RNA, 19 nt, Homo sapiens
ggacaauaaguacaagcaa

SEQ ID NO: 655888 - RNA, 19 nt, Homo sapiens
gcuggagacuaugugcuaa

SEQ ID NO: 655889 - RNA, 19 nt, Homo sapiens
uguuacaucuugugggaaa

SEQ ID NO: 655890 - RNA, 19 nt, Homo sapiens
ccaaaggugcuggaguuaa

SEQ ID NO: 655891 - RNA, 19 nt, Homo sapiens
gcugcuggauucaauuaca

SEQ ID NO: 655892 - RNA, 19 nt, Homo sapiens
gcacagcugcuauccaacu

SEQ ID NO: 655893 - RNA, 19 nt, Homo sapiens
gcaagaucguccuggaacu

SEQ ID NO: 655894 - RNA, 19 nt, Homo sapiens
guacauggaggccaacaag

SEQ ID NO: 655895 - RNA, 19 nt, Homo sapiens
ugaggucuagggacaauaa

SEQ ID NO: 655896 - RNA, 19 nt, Homo sapiens
gugaaguccuccugaaggu

SEQ ID NO: 655897 - RNA, 19 nt, Homo sapiens
acaauagacaggccaagaa

SEQ ID NO: 655898 - RNA, 19 nt, Homo sapiens
ccaguuugcugaggucuag

SEQ ID NO: 655899 - RNA, 19 nt, Homo sapiens
uccaggaggcccauaagua

SEQ ID NO: 655900 - RNA, 19 nt, Homo sapiens
gucgauggguucucuaugg

SEQ ID NO: 655901 - RNA, 19 nt, Homo sapiens
gggagaagaacgucaacug

SEQ ID NO: 655902 - RNA, 19 nt, Homo sapiens
ccaggaggcccauaaguac

SEQ ID NO: 655903 - RNA, 19 nt, Homo sapiens
aaaugcuggugaaugcuuu

SEQ ID NO: 655904 - RNA, 19 nt, Homo sapiens
caaaugcuggugaaugcuu

SEQ ID NO: 655905 - RNA, 19 nt, Homo sapiens
gcugaggucuagggacaau

SEQ ID NO: 655906 - RNA, 19 nt, Homo sapiens
gauggucgauggguucucu

SEQ ID NO: 655907 - RNA, 19 nt, Homo sapiens
cuggagaagauucacaaua

SEQ ID NO: 655908 - RNA, 19 nt, Homo sapiens
gcaaaccuggagaagauuc

SEQ ID NO: 655909 - RNA, 19 nt, Homo sapiens
acauggaggccaacaagaa

SEQ ID NO: 655910 - RNA, 19 nt, Homo sapiens
gagcaaauucugccucacu

SEQ ID NO: 655911 - RNA, 19 nt, Homo sapiens
gauccuacugggagaagaa

SEQ ID NO: 655912 - RNA, 19 nt, Homo sapiens
augaggaaauaaagaguga

SEQ ID NO: 655913 - RNA, 19 nt, Homo sapiens
acaagaacauaggcaagau

SEQ ID NO: 655914 - RNA, 19 nt, Homo sapiens
gcaaauucugccucacuuc

SEQ ID NO: 655915 - RNA, 19 nt, Homo sapiens
cugaagcaacgcugaaauu

SEQ ID NO: 655916 - RNA, 19 nt, Homo sapiens
cggaaaaccucuacgugaa

SEQ ID NO: 655917 - RNA, 19 nt, Homo sapiens
agagacaaggccaguauga

SEQ ID NO: 655918 - RNA, 19 nt, Homo sapiens
uaaagcugauaugaggaaa

SEQ ID NO: 655919 - RNA, 19 nt, Homo sapiens
gagaagauucacaauagac

SEQ ID NO: 655920 - RNA, 19 nt, Homo sapiens
caaauucugccucacuucu

SEQ ID NO: 655921 - RNA, 19 nt, Homo sapiens
uuaaagcugauaugaggaa

SEQ ID NO: 655922 - RNA, 19 nt, Homo sapiens
uguuagccgugcacuuuga

SEQ ID NO: 655923 - RNA, 19 nt, Homo sapiens
ggacuuaaugcagagacaa

SEQ ID NO: 655924 - RNA, 19 nt, Homo sapiens
ugaagcaacgcugaaauuc

SEQ ID NO: 655925 - RNA, 19 nt, Homo sapiens
uuccagcuguuacaucuug

SEQ ID NO: 655926 - RNA, 19 nt, Homo sapiens
ggaggccaacaagaacaua

SEQ ID NO: 655927 - RNA, 19 nt, Homo sapiens
gaggaggugacaucaaugg

SEQ ID NO: 655928 - RNA, 19 nt, Homo sapiens
ggaggcccauaaguacaug

SEQ ID NO: 655929 - RNA, 19 nt, Homo sapiens
gaaauccaggaggcccaua

SEQ ID NO: 655930 - RNA, 19 nt, Homo sapiens
caauaaguacaagcaaaug

SEQ ID NO: 655931 - RNA, 19 nt, Homo sapiens
uguucaggcuggagacuau

SEQ ID NO: 655932 - RNA, 19 nt, Homo sapiens
ggcuggagacuaugugcua

SEQ ID NO: 655933 - RNA, 19 nt, Homo sapiens
uccaggagccagcaacauu

SEQ ID NO: 655934 - RNA, 19 nt, Homo sapiens
cuagggacaauaaguacaa

SEQ ID NO: 655935 - RNA, 19 nt, Homo sapiens
gguucucuauggucugaug

SEQ ID NO: 655936 - RNA, 19 nt, Homo sapiens
cugcuggauucaauuacaa

SEQ ID NO: 655937 - RNA, 19 nt, Homo sapiens
caagaacauaggcaagauc

SEQ ID NO: 655938 - RNA, 19 nt, Homo sapiens
ggaggaggugacaucaaug

SEQ ID NO: 655939 - RNA, 19 nt, Homo sapiens
gaggaaauaaagagugaac

SEQ ID NO: 655940 - RNA, 19 nt, Homo sapiens
caucuugugggaaauguuc

SEQ ID NO: 655941 - RNA, 19 nt, Homo sapiens
cacaauagacaggccaaga

SEQ ID NO: 655942 - RNA, 19 nt, Homo sapiens
caagaucguccuggaacug

SEQ ID NO: 655943 - RNA, 19 nt, Homo sapiens
uuuaagcgaggaagucuga

SEQ ID NO: 655944 - RNA, 19 nt, Homo sapiens
gggacaauaaguacaagca

SEQ ID NO: 655945 - RNA, 19 nt, Homo sapiens
gaagaaagacuguauguga

SEQ ID NO: 655946 - RNA, 19 nt, Homo sapiens
caacacagaucgagaaugu

SEQ ID NO: 655947 - RNA, 19 nt, Homo sapiens
gaagaaacaagaagaauug

SEQ ID NO: 655948 - RNA, 19 nt, Homo sapiens
gagcagaaguaaacacaaa

SEQ ID NO: 655949 - RNA, 19 nt, Homo sapiens
gagcaaagcagaagaaaug

SEQ ID NO: 655950 - RNA, 19 nt, Homo sapiens
ugaagaagauccagaaguu

SEQ ID NO: 655951 - RNA, 19 nt, Homo sapiens
ggagaaacuugaccgcaaa

SEQ ID NO: 655952 - RNA, 19 nt, Homo sapiens
gaucagcccuuugguauuc

SEQ ID NO: 655953 - RNA, 19 nt, Homo sapiens
caaagagaaugaagcagaa

SEQ ID NO: 655954 - RNA, 19 nt, Homo sapiens
ggacaagucuaagaagaga

SEQ ID NO: 655955 - RNA, 19 nt, Homo sapiens
aaacauaaguccucuucuu

SEQ ID NO: 655956 - RNA, 19 nt, Homo sapiens
caaguucgguucccacuga

SEQ ID NO: 655957 - RNA, 19 nt, Homo sapiens
gaaacaagaagaauugaug

SEQ ID NO: 655958 - RNA, 19 nt, Homo sapiens
ggaaauccuucgccaacuu

SEQ ID NO: 655959 - RNA, 19 nt, Homo sapiens
uaacaacagugauucugaa

SEQ ID NO: 655960 - RNA, 19 nt, Homo sapiens
gagaugaacguguaaagaa

SEQ ID NO: 655961 - RNA, 19 nt, Homo sapiens
gaaagaagaaacagaagga

SEQ ID NO: 655962 - RNA, 19 nt, Homo sapiens
caucagagaucagcccuuu

SEQ ID NO: 655963 - RNA, 19 nt, Homo sapiens
acaauuaccugggaauaaa

SEQ ID NO: 655964 - RNA, 19 nt, Homo sapiens
guaaagaauggccuuaauu

SEQ ID NO: 655965 - RNA, 19 nt, Homo sapiens
caacagugauucugaagag

SEQ ID NO: 655966 - RNA, 19 nt, Homo sapiens
gaagagcaaagcagaagaa

SEQ ID NO: 655967 - RNA, 19 nt, Homo sapiens
guagugagagugagaguaa

SEQ ID NO: 655968 - RNA, 19 nt, Homo sapiens
uaaagucacuaacaaccaa

SEQ ID NO: 655969 - RNA, 19 nt, Homo sapiens
aaacauagcccagagaaga

SEQ ID NO: 655970 - RNA, 19 nt, Homo sapiens
ucgagaauguccuuuguuu

SEQ ID NO: 655971 - RNA, 19 nt, Homo sapiens
gaucgagaauguccuuugu

SEQ ID NO: 655972 - RNA, 19 nt, Homo sapiens
gagaucagcccuuugguau

SEQ ID NO: 655973 - RNA, 19 nt, Homo sapiens
uaugggagaugaacgugua

SEQ ID NO: 655974 - RNA, 19 nt, Homo sapiens
gaaugaagcagaaguagag

SEQ ID NO: 655975 - RNA, 19 nt, Homo sapiens
agagugagaguaacaauaa

SEQ ID NO: 655976 - RNA, 19 nt, Homo sapiens
gagagugagaguaacaaua

SEQ ID NO: 655977 - RNA, 19 nt, Homo sapiens
gaaagacuguaugugacaa

SEQ ID NO: 655978 - RNA, 19 nt, Homo sapiens
ucagaaagcaguagugaga

SEQ ID NO: 655979 - RNA, 19 nt, Homo sapiens
gcacugaaacgaaauguac

SEQ ID NO: 655980 - RNA, 19 nt, Homo sapiens
gaaaggagccccacgagaa

SEQ ID NO: 655981 - RNA, 19 nt, Homo sapiens
aagcagaaguagagaagaa

SEQ ID NO: 655982 - RNA, 19 nt, Homo sapiens
aaacuugaccgcaaacuga

SEQ ID NO: 655983 - RNA, 19 nt, Homo sapiens
gagaauguccuuuguuugg

SEQ ID NO: 655984 - RNA, 19 nt, Homo sapiens
ggagagaccgaauacaaau

SEQ ID NO: 655985 - RNA, 19 nt, Homo sapiens
gggcauaacaacagugauu

SEQ ID NO: 655986 - RNA, 19 nt, Homo sapiens
uaaguccucuucuuccuau

SEQ ID NO: 655987 - RNA, 19 nt, Homo sapiens
gcaaagggagacaaggaaa

SEQ ID NO: 655988 - RNA, 19 nt, Homo sapiens
gagaaggacaagucuaaga

SEQ ID NO: 655989 - RNA, 19 nt, Homo sapiens
gaagagaaggacaagucua

SEQ ID NO: 655990 - RNA, 19 nt, Homo sapiens
gacaauuaccugggaauaa

SEQ ID NO: 655991 - RNA, 19 nt, Homo sapiens
gagaagaaagacuguaugu

SEQ ID NO: 655992 - RNA, 19 nt, Homo sapiens
uaaagugacacaaagagaa

SEQ ID NO: 655993 - RNA, 19 nt, Homo sapiens
gaaaagcccagguucuuaa

SEQ ID NO: 655994 - RNA, 19 nt, Homo sapiens
uagaucgacuggagaagaa

SEQ ID NO: 655995 - RNA, 19 nt, Homo sapiens
aagaauggccuuaauuuca

SEQ ID NO: 655996 - RNA, 19 nt, Homo sapiens
gagugagaguaacaauaaa

SEQ ID NO: 655997 - RNA, 19 nt, Homo sapiens
cagaagagcagaaguaaac

SEQ ID NO: 655998 - RNA, 19 nt, Homo sapiens
gcaagugcagggugaagaa

SEQ ID NO: 655999 - RNA, 19 nt, Homo sapiens
gcuaauaggcgagaugaga

SEQ ID NO: 656000 - RNA, 19 nt, Homo sapiens
gaauggccuuaauuucaug

SEQ ID NO: 656001 - RNA, 19 nt, Homo sapiens
ggagaugaacguguaaaga

SEQ ID NO: 656002 - RNA, 19 nt, Homo sapiens
cagcgaacauccuggugaa

SEQ ID NO: 656003 - RNA, 19 nt, Homo sapiens
gaggaaaggagccggagaa

SEQ ID NO: 656004 - RNA, 19 nt, Homo sapiens
ucacuaacaaccaaacaaa

SEQ ID NO: 656005 - RNA, 19 nt, Homo sapiens
gaagaagauccagaaguug

SEQ ID NO: 656006 - RNA, 19 nt, Homo sapiens
acaaaugggucaugucaac

SEQ ID NO: 656007 - RNA, 19 nt, Homo sapiens
guauucagguucgaaaugu

SEQ ID NO: 656008 - RNA, 19 nt, Homo sapiens
agaauggccuuaauuucau

SEQ ID NO: 656009 - RNA, 19 nt, Homo sapiens
aagagaaggacaagucuaa

SEQ ID NO: 656010 - RNA, 19 nt, Homo sapiens
gaaacuucucaggaaauua

SEQ ID NO: 656011 - RNA, 19 nt, Homo sapiens
gaaauguacuggggagaaa

SEQ ID NO: 656012 - RNA, 19 nt, Homo sapiens
agagaaagaagaaacagaa

SEQ ID NO: 656013 - RNA, 19 nt, Homo sapiens
ggagguacacauacuaaag

SEQ ID NO: 656014 - RNA, 19 nt, Homo sapiens
caaagcagaagaaaugaca

SEQ ID NO: 656015 - RNA, 19 nt, Homo sapiens
gagaccgaauacaaauuug

SEQ ID NO: 656016 - RNA, 19 nt, Homo sapiens
cagaaggagagaccgaaua

SEQ ID NO: 656017 - RNA, 19 nt, Homo sapiens
caaagagaaagaagaaaca

SEQ ID NO: 656018 - RNA, 19 nt, Homo sapiens
ggccuuaauuucauguaug

SEQ ID NO: 656019 - RNA, 19 nt, Homo sapiens
uguaaagaauggccuuaau

SEQ ID NO: 656020 - RNA, 19 nt, Homo sapiens
ucacaaaugggucauguca

SEQ ID NO: 656021 - RNA, 19 nt, Homo sapiens
agagaccgaauacaaauuu

SEQ ID NO: 656022 - RNA, 19 nt, Homo sapiens
gaagaaacagaaggagaga

SEQ ID NO: 656023 - RNA, 19 nt, Homo sapiens
auacuaaagugacacaaag

SEQ ID NO: 656024 - RNA, 19 nt, Homo sapiens
ggaaaagcccagguucuua

SEQ ID NO: 656025 - RNA, 19 nt, Homo sapiens
gaaauccuucgccaacuuc

SEQ ID NO: 656026 - RNA, 19 nt, Homo sapiens
caacuucaugugcaagaaa

SEQ ID NO: 656027 - RNA, 19 nt, Homo sapiens
gaccgaauacaaauuugaa

SEQ ID NO: 656028 - RNA, 19 nt, Homo sapiens
gagagaccgaauacaaauu

SEQ ID NO: 656029 - RNA, 19 nt, Homo sapiens
agaugaacguguaaagaau

SEQ ID NO: 656030 - RNA, 19 nt, Homo sapiens
agacuuguauagaggagaa

SEQ ID NO: 656031 - RNA, 19 nt, Homo sapiens
gaagaaaugacagcagaag

SEQ ID NO: 656032 - RNA, 19 nt, Homo sapiens
gauaagaagaaacaagaag

SEQ ID NO: 656033 - RNA, 19 nt, Homo sapiens
gaugaacguguaaagaaug

SEQ ID NO: 656034 - RNA, 19 nt, Homo sapiens
aaggacaagucuaagaaga

SEQ ID NO: 656035 - RNA, 19 nt, Homo sapiens
aagaagauccagaaguuga

SEQ ID NO: 656036 - RNA, 19 nt, Homo sapiens
gaaacuugaccgcaaacug

SEQ ID NO: 656037 - RNA, 19 nt, Homo sapiens
ccagaacccauaaacauag

SEQ ID NO: 656038 - RNA, 19 nt, Homo sapiens
aaacuucucaggaaauuag

SEQ ID NO: 656039 - RNA, 19 nt, Homo sapiens
gacuguaugugacaauuac

SEQ ID NO: 656040 - RNA, 19 nt, Homo sapiens
gagguacacauacuaaagu

SEQ ID NO: 656041 - RNA, 19 nt, Homo sapiens
ggagaagccagccagaagu

SEQ ID NO: 656042 - RNA, 19 nt, Homo sapiens
ccauucugauucugacaaa

SEQ ID NO: 656043 - RNA, 19 nt, Homo sapiens
agaaggacaagucuaagaa

SEQ ID NO: 656044 - RNA, 19 nt, Homo sapiens
gagcuaauaggcgagauga

SEQ ID NO: 656045 - RNA, 19 nt, Homo sapiens
gaacagcccuuagucuuua

SEQ ID NO: 656046 - RNA, 19 nt, Homo sapiens
gaaacugccuuugcgauug

SEQ ID NO: 656047 - RNA, 19 nt, Homo sapiens
gcuaugacagcuacuauua

SEQ ID NO: 656048 - RNA, 19 nt, Homo sapiens
ccacgcaggugccaacuuu

SEQ ID NO: 656049 - RNA, 19 nt, Homo sapiens
ggaacagcccuuagucuuu

SEQ ID NO: 656050 - RNA, 19 nt, Homo sapiens
agaaagaacucacgacuac

SEQ ID NO: 656051 - RNA, 19 nt, Homo sapiens
uaaaggugcuggacaagug

SEQ ID NO: 656052 - RNA, 19 nt, Homo sapiens
cagcaggacuuacuacuca

SEQ ID NO: 656053 - RNA, 19 nt, Homo sapiens
ccgaggagcuguaccagaa

SEQ ID NO: 656054 - RNA, 19 nt, Homo sapiens
gaaccagcgcuacaucuuu

SEQ ID NO: 656055 - RNA, 19 nt, Homo sapiens
ggaagcagaugcacaacca

SEQ ID NO: 656056 - RNA, 19 nt, Homo sapiens
gcaagauccugugcacuga

SEQ ID NO: 656057 - RNA, 19 nt, Homo sapiens
ccagauggcagauuauauu

SEQ ID NO: 656058 - RNA, 19 nt, Homo sapiens
gagaagcaaucgcugaagu

SEQ ID NO: 656059 - RNA, 19 nt, Homo sapiens
gcuaagaggcgcuaacguu

SEQ ID NO: 656060 - RNA, 19 nt, Homo sapiens
cuaagaggcgcuaacguua

SEQ ID NO: 656061 - RNA, 19 nt, Homo sapiens
gcgcuaacguuacgcuguu

SEQ ID NO: 656062 - RNA, 19 nt, Homo sapiens
gaaaggaaccagcgcuaca

SEQ ID NO: 656063 - RNA, 19 nt, Homo sapiens
acagagauguuuggagaaa

SEQ ID NO: 656064 - RNA, 19 nt, Homo sapiens
gagacauucgcaucaaaua

SEQ ID NO: 656065 - RNA, 19 nt, Homo sapiens
agaaagaggugggcaagau

SEQ ID NO: 656066 - RNA, 19 nt, Homo sapiens
agauccagauggcagauua

SEQ ID NO: 656067 - RNA, 19 nt, Homo sapiens
agcaaucgcugaaguguga

SEQ ID NO: 656068 - RNA, 19 nt, Homo sapiens
aauacuagcuaacggcaaa

SEQ ID NO: 656069 - RNA, 19 nt, Homo sapiens
ucaaccagcucuccugcaa

SEQ ID NO: 656070 - RNA, 19 nt, Homo sapiens
gaggagcuguaccagaaga

SEQ ID NO: 656071 - RNA, 19 nt, Homo sapiens
gacauucgcaucaaauaug

SEQ ID NO: 656072 - RNA, 19 nt, Homo sapiens
gaccagagaccgccuacug

SEQ ID NO: 656073 - RNA, 19 nt, Homo sapiens
cugagagccugacuucuga

SEQ ID NO: 656074 - RNA, 19 nt, Homo sapiens
ggaggcgucugcuacuaca

SEQ ID NO: 656075 - RNA, 19 nt, Homo sapiens
ggaaccagcgcuacaucuu

SEQ ID NO: 656076 - RNA, 19 nt, Homo sapiens
gauggcagauuauauuucc

SEQ ID NO: 656077 - RNA, 19 nt, Homo sapiens
cagaaagaacucacgacua

SEQ ID NO: 656078 - RNA, 19 nt, Homo sapiens
gaaagaggugggcaagauc

SEQ ID NO: 656079 - RNA, 19 nt, Homo sapiens
aaacugccuuugcgauugu

SEQ ID NO: 656080 - RNA, 19 nt, Homo sapiens
ggccagaugcggcagguuu

SEQ ID NO: 656081 - RNA, 19 nt, Homo sapiens
guuacgcuguuuccgguuu

SEQ ID NO: 656082 - RNA, 19 nt, Homo sapiens
ggcccaaguugaagaagau

SEQ ID NO: 656083 - RNA, 19 nt, Homo sapiens
gugugucgcucgccugcua

SEQ ID NO: 656084 - RNA, 19 nt, Homo sapiens
gcgccacccuaucacgauu

SEQ ID NO: 656085 - RNA, 19 nt, Homo sapiens
aaccagcucuccugcaaau

SEQ ID NO: 656086 - RNA, 19 nt, Homo sapiens
gcaacgagacagccaaguc

SEQ ID NO: 656087 - RNA, 19 nt, Homo sapiens
gaagcaaucgcugaagugu

SEQ ID NO: 656088 - RNA, 19 nt, Homo sapiens
cagauggcagauuauauuu

SEQ ID NO: 656089 - RNA, 19 nt, Homo sapiens
ggugccaacuuucgagauc

SEQ ID NO: 656090 - RNA, 19 nt, Homo sapiens
agacagccaaguccuauug

SEQ ID NO: 656091 - RNA, 19 nt, Homo sapiens
ccgagacauucgcaucaaa

SEQ ID NO: 656092 - RNA, 19 nt, Homo sapiens
caaccgcagccgagacauu

SEQ ID NO: 656093 - RNA, 19 nt, Homo sapiens
gcaacagcccagcaugugu

SEQ ID NO: 656094 - RNA, 19 nt, Homo sapiens
ggaucaugcuaucaucagu

SEQ ID NO: 656095 - RNA, 19 nt, Homo sapiens
gagaaacugagaccaccuu

SEQ ID NO: 656096 - RNA, 19 nt, Homo sapiens
guacaugccagauccuaag

SEQ ID NO: 656097 - RNA, 19 nt, Homo sapiens
gacuacaguucaacaaggu

SEQ ID NO: 656098 - RNA, 19 nt, Homo sapiens
ugguaaaggugcuggacaa

SEQ ID NO: 656099 - RNA, 19 nt, Homo sapiens
aaccggagcuuggccaaug

SEQ ID NO: 656100 - RNA, 19 nt, Homo sapiens
agaaacugccuuugcgauu

SEQ ID NO: 656101 - RNA, 19 nt, Homo sapiens
ggaggacgcuggggaguau

SEQ ID NO: 656102 - RNA, 19 nt, Homo sapiens
gcagauuauauuuccaaga

SEQ ID NO: 656103 - RNA, 19 nt, Homo sapiens
ccacggaacagcccuuagu

SEQ ID NO: 656104 - RNA, 19 nt, Homo sapiens
guucugagagccugacuuc

SEQ ID NO: 656105 - RNA, 19 nt, Homo sapiens
caugucaucaggagagaaa

SEQ ID NO: 656106 - RNA, 19 nt, Homo sapiens
caugccagauccuaagcaa

SEQ ID NO: 656107 - RNA, 19 nt, Homo sapiens
caacaacagcagcaucucu

SEQ ID NO: 656108 - RNA, 19 nt, Homo sapiens
ccaaguugaagaagaugaa

SEQ ID NO: 656109 - RNA, 19 nt, Homo sapiens
ccacagaccaugucaucag

SEQ ID NO: 656110 - RNA, 19 nt, Homo sapiens
gugguggccuacugcaaga

SEQ ID NO: 656111 - RNA, 19 nt, Homo sapiens
ccagcucuccugcaaaugu

SEQ ID NO: 656112 - RNA, 19 nt, Homo sapiens
cggaacagcccuuagucuu

SEQ ID NO: 656113 - RNA, 19 nt, Homo sapiens
ggugguggagggcaaggua

SEQ ID NO: 656114 - RNA, 19 nt, Homo sapiens
gccgagacauucgcaucaa

SEQ ID NO: 656115 - RNA, 19 nt, Homo sapiens
gugugccgcucgaaaggaa

SEQ ID NO: 656116 - RNA, 19 nt, Homo sapiens
agacauucgcaucaaauau

SEQ ID NO: 656117 - RNA, 19 nt, Homo sapiens
gugagaagcaaucgcugaa

SEQ ID NO: 656118 - RNA, 19 nt, Homo sapiens
cgagacagccaaguccuau

SEQ ID NO: 656119 - RNA, 19 nt, Homo sapiens
cgagacauucgcaucaaau

SEQ ID NO: 656120 - RNA, 19 nt, Homo sapiens
cggcccaaguugaagaaga

SEQ ID NO: 656121 - RNA, 19 nt, Homo sapiens
ucugagagccugacuucug

SEQ ID NO: 656122 - RNA, 19 nt, Homo sapiens
ggucggguggcguugguaa

SEQ ID NO: 656123 - RNA, 19 nt, Homo sapiens
acaaccaccuccggcagaa

SEQ ID NO: 656124 - RNA, 19 nt, Homo sapiens
gaaagaacucacgacuaca

SEQ ID NO: 656125 - RNA, 19 nt, Homo sapiens
cgggacaggugggugagaa

SEQ ID NO: 656126 - RNA, 19 nt, Homo sapiens
guaaaggugcuggacaagu

SEQ ID NO: 656127 - RNA, 19 nt, Homo sapiens
ccacuccuguucuccuucu

SEQ ID NO: 656128 - RNA, 19 nt, Homo sapiens
caaccagcucuccugcaaa

SEQ ID NO: 656129 - RNA, 19 nt, Homo sapiens
ucaauggaggcgucugcua

SEQ ID NO: 656130 - RNA, 19 nt, Homo sapiens
gagacagccaaguccuauu

SEQ ID NO: 656131 - RNA, 19 nt, Homo sapiens
uaugacagcuacuauuacc

SEQ ID NO: 656132 - RNA, 19 nt, Homo sapiens
gaaacugagaccaccuucu

SEQ ID NO: 656133 - RNA, 19 nt, Homo sapiens
uauggcaacggcagaaaga

SEQ ID NO: 656134 - RNA, 19 nt, Homo sapiens
uaagaggcgcuaacguuac

SEQ ID NO: 656135 - RNA, 19 nt, Homo sapiens
ggucgugggcaucgucugu

SEQ ID NO: 656136 - RNA, 19 nt, Homo sapiens
acaggugggugagaagcaa

SEQ ID NO: 656137 - RNA, 19 nt, Homo sapiens
aaccagcgcuacaucuuuu

SEQ ID NO: 656138 - RNA, 19 nt, Homo sapiens
gauccagauggcagauuau

SEQ ID NO: 656139 - RNA, 19 nt, Homo sapiens
gaaccggagcuuggccaau

SEQ ID NO: 656140 - RNA, 19 nt, Homo sapiens
acucacgacuacaguucaa

SEQ ID NO: 656141 - RNA, 19 nt, Homo sapiens
aaagaacucacgacuacag

SEQ ID NO: 656142 - RNA, 19 nt, Homo sapiens
gaacagcccuuagucuuua

SEQ ID NO: 656143 - RNA, 19 nt, Homo sapiens
gcuaugacagcuacuauua

SEQ ID NO: 656144 - RNA, 19 nt, Homo sapiens
ccacgcaggugccaacuuu

SEQ ID NO: 656145 - RNA, 19 nt, Homo sapiens
gcaaguguccugugggaua

SEQ ID NO: 656146 - RNA, 19 nt, Homo sapiens
ggaacagcccuuagucuuu

SEQ ID NO: 656147 - RNA, 19 nt, Homo sapiens
agaaagaacucacgacuac

SEQ ID NO: 656148 - RNA, 19 nt, Homo sapiens
uaaaggugcuggacaagug

SEQ ID NO: 656149 - RNA, 19 nt, Homo sapiens
cagcaggacuuacuacuca

SEQ ID NO: 656150 - RNA, 19 nt, Homo sapiens
ccgaggagcuguaccagaa

SEQ ID NO: 656151 - RNA, 19 nt, Homo sapiens
gaaccagcgcuacaucuuu

SEQ ID NO: 656152 - RNA, 19 nt, Homo sapiens
ggaagcagaugcacaacca

SEQ ID NO: 656153 - RNA, 19 nt, Homo sapiens
gcaagauccugugcacuga

SEQ ID NO: 656154 - RNA, 19 nt, Homo sapiens
ccagauggcagauuauauu

SEQ ID NO: 656155 - RNA, 19 nt, Homo sapiens
gagaagcaaucgcugaagu

SEQ ID NO: 656156 - RNA, 19 nt, Homo sapiens
gcuaagaggcgcuaacguu

SEQ ID NO: 656157 - RNA, 19 nt, Homo sapiens
cuaagaggcgcuaacguua

SEQ ID NO: 656158 - RNA, 19 nt, Homo sapiens
gcgcuaacguuacgcuguu

SEQ ID NO: 656159 - RNA, 19 nt, Homo sapiens
gaaaggaaccagcgcuaca

SEQ ID NO: 656160 - RNA, 19 nt, Homo sapiens
gagacauucgcaucaaaua

SEQ ID NO: 656161 - RNA, 19 nt, Homo sapiens
agaaagaggugggcaagau

SEQ ID NO: 656162 - RNA, 19 nt, Homo sapiens
agauccagauggcagauua

SEQ ID NO: 656163 - RNA, 19 nt, Homo sapiens
agcaaucgcugaaguguga

SEQ ID NO: 656164 - RNA, 19 nt, Homo sapiens
aauacuagcuaacggcaaa

SEQ ID NO: 656165 - RNA, 19 nt, Homo sapiens
ucaaccagcucuccugcaa

SEQ ID NO: 656166 - RNA, 19 nt, Homo sapiens
gaggagcuguaccagaaga

SEQ ID NO: 656167 - RNA, 19 nt, Homo sapiens
gacauucgcaucaaauaug

SEQ ID NO: 656168 - RNA, 19 nt, Homo sapiens
gaccagagaccgccuacug

SEQ ID NO: 656169 - RNA, 19 nt, Homo sapiens
cugagagccugacuucuga

SEQ ID NO: 656170 - RNA, 19 nt, Homo sapiens
ggaggcgucugcuacuaca

SEQ ID NO: 656171 - RNA, 19 nt, Homo sapiens
ggaaccagcgcuacaucuu

SEQ ID NO: 656172 - RNA, 19 nt, Homo sapiens
gauggcagauuauauuucc

SEQ ID NO: 656173 - RNA, 19 nt, Homo sapiens
cagaaagaacucacgacua

SEQ ID NO: 656174 - RNA, 19 nt, Homo sapiens
gaaagaggugggcaagauc

SEQ ID NO: 656175 - RNA, 19 nt, Homo sapiens
ggccagaugcggcagguuu

SEQ ID NO: 656176 - RNA, 19 nt, Homo sapiens
guuacgcuguuuccgguuu

SEQ ID NO: 656177 - RNA, 19 nt, Homo sapiens
ggcccaaguugaagaagau

SEQ ID NO: 656178 - RNA, 19 nt, Homo sapiens
gugugucgcucgccugcua

SEQ ID NO: 656179 - RNA, 19 nt, Homo sapiens
gcgccacccuaucacgauu

SEQ ID NO: 656180 - RNA, 19 nt, Homo sapiens
gcaacgagacagccaaguc

SEQ ID NO: 656181 - RNA, 19 nt, Homo sapiens
gaagcaaucgcugaagugu

SEQ ID NO: 656182 - RNA, 19 nt, Homo sapiens
cagauggcagauuauauuu

SEQ ID NO: 656183 - RNA, 19 nt, Homo sapiens
ggugccaacuuucgagauc

SEQ ID NO: 656184 - RNA, 19 nt, Homo sapiens
agacagccaaguccuauug

SEQ ID NO: 656185 - RNA, 19 nt, Homo sapiens
ccgagacauucgcaucaaa

SEQ ID NO: 656186 - RNA, 19 nt, Homo sapiens
caaccgcagccgagacauu

SEQ ID NO: 656187 - RNA, 19 nt, Homo sapiens
gcaacagcccagcaugugu

SEQ ID NO: 656188 - RNA, 19 nt, Homo sapiens
ggaucaugcuaucaucagu

SEQ ID NO: 656189 - RNA, 19 nt, Homo sapiens
gagaaacugagaccaccuu

SEQ ID NO: 656190 - RNA, 19 nt, Homo sapiens
ccaaagccgaggagcugua

SEQ ID NO: 656191 - RNA, 19 nt, Homo sapiens
gacuacaguucaacaaggu

SEQ ID NO: 656192 - RNA, 19 nt, Homo sapiens
ugguaaaggugcuggacaa

SEQ ID NO: 656193 - RNA, 19 nt, Homo sapiens
aaccggagcuuggccaaug

SEQ ID NO: 656194 - RNA, 19 nt, Homo sapiens
ggaggacgcuggggaguau

SEQ ID NO: 656195 - RNA, 19 nt, Homo sapiens
gcagauuauauuuccaaga

SEQ ID NO: 656196 - RNA, 19 nt, Homo sapiens
ccacggaacagcccuuagu

SEQ ID NO: 656197 - RNA, 19 nt, Homo sapiens
guucugagagccugacuuc

SEQ ID NO: 656198 - RNA, 19 nt, Homo sapiens
caugucaucaggagagaaa

SEQ ID NO: 656199 - RNA, 19 nt, Homo sapiens
caacaacagcagcaucucu

SEQ ID NO: 656200 - RNA, 19 nt, Homo sapiens
ccaaguugaagaagaugaa

SEQ ID NO: 656201 - RNA, 19 nt, Homo sapiens
ccacagaccaugucaucag

SEQ ID NO: 656202 - RNA, 19 nt, Homo sapiens
gugguggccuacugcaaga

SEQ ID NO: 656203 - RNA, 19 nt, Homo sapiens
cggaacagcccuuagucuu

SEQ ID NO: 656204 - RNA, 19 nt, Homo sapiens
ggugguggagggcaaggua

SEQ ID NO: 656205 - RNA, 19 nt, Homo sapiens
aaccagcucuccugcaagu

SEQ ID NO: 656206 - RNA, 19 nt, Homo sapiens
gccgagacauucgcaucaa

SEQ ID NO: 656207 - RNA, 19 nt, Homo sapiens
gugugccgcucgaaaggaa

SEQ ID NO: 656208 - RNA, 19 nt, Homo sapiens
caaguguccugugggauac

SEQ ID NO: 656209 - RNA, 19 nt, Homo sapiens
agacauucgcaucaaauau

SEQ ID NO: 656210 - RNA, 19 nt, Homo sapiens
gugagaagcaaucgcugaa

SEQ ID NO: 656211 - RNA, 19 nt, Homo sapiens
cgagacagccaaguccuau

SEQ ID NO: 656212 - RNA, 19 nt, Homo sapiens
cgagacauucgcaucaaau

SEQ ID NO: 656213 - RNA, 19 nt, Homo sapiens
cggcccaaguugaagaaga

SEQ ID NO: 656214 - RNA, 19 nt, Homo sapiens
ucugagagccugacuucug

SEQ ID NO: 656215 - RNA, 19 nt, Homo sapiens
acaaccaccuccggcagaa

SEQ ID NO: 656216 - RNA, 19 nt, Homo sapiens
ggucggguggcguugguaa

SEQ ID NO: 656217 - RNA, 19 nt, Homo sapiens
gaaagaacucacgacuaca

SEQ ID NO: 656218 - RNA, 19 nt, Homo sapiens
guaaaggugcuggacaagu

SEQ ID NO: 656219 - RNA, 19 nt, Homo sapiens
cgggacaggugggugagaa

SEQ ID NO: 656220 - RNA, 19 nt, Homo sapiens
ccacuccuguucuccuucu

SEQ ID NO: 656221 - RNA, 19 nt, Homo sapiens
ggugucagcaguucgcaau

SEQ ID NO: 656222 - RNA, 19 nt, Homo sapiens
ucaauggaggcgucugcua

SEQ ID NO: 656223 - RNA, 19 nt, Homo sapiens
gagacagccaaguccuauu

SEQ ID NO: 656224 - RNA, 19 nt, Homo sapiens
uaugacagcuacuauuacc

SEQ ID NO: 656225 - RNA, 19 nt, Homo sapiens
gaaacugagaccaccuucu

SEQ ID NO: 656226 - RNA, 19 nt, Homo sapiens
uauggcaacggcagaaaga

SEQ ID NO: 656227 - RNA, 19 nt, Homo sapiens
uaagaggcgcuaacguuac

SEQ ID NO: 656228 - RNA, 19 nt, Homo sapiens
ggucgugggcaucgucugu

SEQ ID NO: 656229 - RNA, 19 nt, Homo sapiens
ccagcucuccugcaagugu

SEQ ID NO: 656230 - RNA, 19 nt, Homo sapiens
acaggugggugagaagcaa

SEQ ID NO: 656231 - RNA, 19 nt, Homo sapiens
gauccagauggcagauuau

SEQ ID NO: 656232 - RNA, 19 nt, Homo sapiens
gaaccggagcuuggccaau

SEQ ID NO: 656233 - RNA, 19 nt, Homo sapiens
aaccagcgcuacaucuuuu

SEQ ID NO: 656234 - RNA, 19 nt, Homo sapiens
acucacgacuacaguucaa

SEQ ID NO: 656235 - RNA, 19 nt, Homo sapiens
aaagaacucacgacuacag

SEQ ID NO: 656236 - RNA, 19 nt, Homo sapiens
gaacagcccuuagucuuua

SEQ ID NO: 656237 - RNA, 19 nt, Homo sapiens
gaaacugccuuugcgauug

SEQ ID NO: 656238 - RNA, 19 nt, Homo sapiens
gcuaugacagcuacuauua

SEQ ID NO: 656239 - RNA, 19 nt, Homo sapiens
ccacgcaggugccaacuuu

SEQ ID NO: 656240 - RNA, 19 nt, Homo sapiens
gcaccuuggauuugaauua

SEQ ID NO: 656241 - RNA, 19 nt, Homo sapiens
ggaacagcccuuagucuuu

SEQ ID NO: 656242 - RNA, 19 nt, Homo sapiens
agaaagaacucacgacuac

SEQ ID NO: 656243 - RNA, 19 nt, Homo sapiens
uaaaggugcuggacaagug

SEQ ID NO: 656244 - RNA, 19 nt, Homo sapiens
cagcaggacuuacuacuca

SEQ ID NO: 656245 - RNA, 19 nt, Homo sapiens
ccgaggagcuguaccagaa

SEQ ID NO: 656246 - RNA, 19 nt, Homo sapiens
gaaccagcgcuacaucuuu

SEQ ID NO: 656247 - RNA, 19 nt, Homo sapiens
ggaagcagaugcacaacca

SEQ ID NO: 656248 - RNA, 19 nt, Homo sapiens
gcaagauccugugcacuga

SEQ ID NO: 656249 - RNA, 19 nt, Homo sapiens
ccagauggcagauuauauu

SEQ ID NO: 656250 - RNA, 19 nt, Homo sapiens
gagaagcaaucgcugaagu

SEQ ID NO: 656251 - RNA, 19 nt, Homo sapiens
gcuaagaggcgcuaacguu

SEQ ID NO: 656252 - RNA, 19 nt, Homo sapiens
cuaagaggcgcuaacguua

SEQ ID NO: 656253 - RNA, 19 nt, Homo sapiens
gcgcuaacguuacgcuguu

SEQ ID NO: 656254 - RNA, 19 nt, Homo sapiens
caccuuggauuugaauuaa

SEQ ID NO: 656255 - RNA, 19 nt, Homo sapiens
gaaaggaaccagcgcuaca

SEQ ID NO: 656256 - RNA, 19 nt, Homo sapiens
acagagauguuuggagaaa

SEQ ID NO: 656257 - RNA, 19 nt, Homo sapiens
gagacauucgcaucaaaua

SEQ ID NO: 656258 - RNA, 19 nt, Homo sapiens
agaaagaggugggcaagau

SEQ ID NO: 656259 - RNA, 19 nt, Homo sapiens
agauccagauggcagauua

SEQ ID NO: 656260 - RNA, 19 nt, Homo sapiens
agcaaucgcugaaguguga

SEQ ID NO: 656261 - RNA, 19 nt, Homo sapiens
aauacuagcuaacggcaaa

SEQ ID NO: 656262 - RNA, 19 nt, Homo sapiens
ucaaccagcucuccugcaa

SEQ ID NO: 656263 - RNA, 19 nt, Homo sapiens
gaggagcuguaccagaaga

SEQ ID NO: 656264 - RNA, 19 nt, Homo sapiens
gacauucgcaucaaauaug

SEQ ID NO: 656265 - RNA, 19 nt, Homo sapiens
gcaaaagcaccuuggauuu

SEQ ID NO: 656266 - RNA, 19 nt, Homo sapiens
gaccagagaccgccuacug

SEQ ID NO: 656267 - RNA, 19 nt, Homo sapiens
cugagagccugacuucuga

SEQ ID NO: 656268 - RNA, 19 nt, Homo sapiens
ggaggcgucugcuacuaca

SEQ ID NO: 656269 - RNA, 19 nt, Homo sapiens
ggaaccagcgcuacaucuu

SEQ ID NO: 656270 - RNA, 19 nt, Homo sapiens
gauggcagauuauauuucc

SEQ ID NO: 656271 - RNA, 19 nt, Homo sapiens
cagaaagaacucacgacua

SEQ ID NO: 656272 - RNA, 19 nt, Homo sapiens
gaaagaggugggcaagauc

SEQ ID NO: 656273 - RNA, 19 nt, Homo sapiens
aaacugccuuugcgauugu

SEQ ID NO: 656274 - RNA, 19 nt, Homo sapiens
ggccagaugcggcagguuu

SEQ ID NO: 656275 - RNA, 19 nt, Homo sapiens
guuacgcuguuuccgguuu

SEQ ID NO: 656276 - RNA, 19 nt, Homo sapiens
ggcccaaguugaagaagau

SEQ ID NO: 656277 - RNA, 19 nt, Homo sapiens
gugugucgcucgccugcua

SEQ ID NO: 656278 - RNA, 19 nt, Homo sapiens
gcgccacccuaucacgauu

SEQ ID NO: 656279 - RNA, 19 nt, Homo sapiens
aaccagcucuccugcaaau

SEQ ID NO: 656280 - RNA, 19 nt, Homo sapiens
gcaacgagacagccaaguc

SEQ ID NO: 656281 - RNA, 19 nt, Homo sapiens
gaagcaaucgcugaagugu

SEQ ID NO: 656282 - RNA, 19 nt, Homo sapiens
cagauggcagauuauauuu

SEQ ID NO: 656283 - RNA, 19 nt, Homo sapiens
ggugccaacuuucgagauc

SEQ ID NO: 656284 - RNA, 19 nt, Homo sapiens
agacagccaaguccuauug

SEQ ID NO: 656285 - RNA, 19 nt, Homo sapiens
ccgagacauucgcaucaaa

SEQ ID NO: 656286 - RNA, 19 nt, Homo sapiens
caaccgcagccgagacauu

SEQ ID NO: 656287 - RNA, 19 nt, Homo sapiens
gcaacagcccagcaugugu

SEQ ID NO: 656288 - RNA, 19 nt, Homo sapiens
ggaucaugcuaucaucagu

SEQ ID NO: 656289 - RNA, 19 nt, Homo sapiens
gagaaacugagaccaccuu

SEQ ID NO: 656290 - RNA, 19 nt, Homo sapiens
guacaugccagauccuaag

SEQ ID NO: 656291 - RNA, 19 nt, Homo sapiens
gacuacaguucaacaaggu

SEQ ID NO: 656292 - RNA, 19 nt, Homo sapiens
ugguaaaggugcuggacaa

SEQ ID NO: 656293 - RNA, 19 nt, Homo sapiens
aaccggagcuuggccaaug

SEQ ID NO: 656294 - RNA, 19 nt, Homo sapiens
agaaacugccuuugcgauu

SEQ ID NO: 656295 - RNA, 19 nt, Homo sapiens
ggaggacgcuggggaguau

SEQ ID NO: 656296 - RNA, 19 nt, Homo sapiens
gcagauuauauuuccaaga

SEQ ID NO: 656297 - RNA, 19 nt, Homo sapiens
ccacggaacagcccuuagu

SEQ ID NO: 656298 - RNA, 19 nt, Homo sapiens
guucugagagccugacuuc

SEQ ID NO: 656299 - RNA, 19 nt, Homo sapiens
caugucaucaggagagaaa

SEQ ID NO: 656300 - RNA, 19 nt, Homo sapiens
aaaagcaccuuggauuuga

SEQ ID NO: 656301 - RNA, 19 nt, Homo sapiens
caugccagauccuaagcaa

SEQ ID NO: 656302 - RNA, 19 nt, Homo sapiens
ccaaguugaagaagaugaa

SEQ ID NO: 656303 - RNA, 19 nt, Homo sapiens
caacaacagcagcaucucu

SEQ ID NO: 656304 - RNA, 19 nt, Homo sapiens
ccacagaccaugucaucag

SEQ ID NO: 656305 - RNA, 19 nt, Homo sapiens
gugguggccuacugcaaga

SEQ ID NO: 656306 - RNA, 19 nt, Homo sapiens
aaagcaccuuggauuugaa

SEQ ID NO: 656307 - RNA, 19 nt, Homo sapiens
ccagcucuccugcaaaugu

SEQ ID NO: 656308 - RNA, 19 nt, Homo sapiens
cggaacagcccuuagucuu

SEQ ID NO: 656309 - RNA, 19 nt, Homo sapiens
ggugguggagggcaaggua

SEQ ID NO: 656310 - RNA, 19 nt, Homo sapiens
gccgagacauucgcaucaa

SEQ ID NO: 656311 - RNA, 19 nt, Homo sapiens
gugugccgcucgaaaggaa

SEQ ID NO: 656312 - RNA, 19 nt, Homo sapiens
agacauucgcaucaaauau

SEQ ID NO: 656313 - RNA, 19 nt, Homo sapiens
gugagaagcaaucgcugaa

SEQ ID NO: 656314 - RNA, 19 nt, Homo sapiens
cgagacagccaaguccuau

SEQ ID NO: 656315 - RNA, 19 nt, Homo sapiens
cgagacauucgcaucaaau

SEQ ID NO: 656316 - RNA, 19 nt, Homo sapiens
ccuuggauuugaauuaaag

SEQ ID NO: 656317 - RNA, 19 nt, Homo sapiens
cggcccaaguugaagaaga

SEQ ID NO: 656318 - RNA, 19 nt, Homo sapiens
ucugagagccugacuucug

SEQ ID NO: 656319 - RNA, 19 nt, Homo sapiens
ggucggguggcguugguaa

SEQ ID NO: 656320 - RNA, 19 nt, Homo sapiens
acaaccaccuccggcagaa

SEQ ID NO: 656321 - RNA, 19 nt, Homo sapiens
gaaagaacucacgacuaca

SEQ ID NO: 656322 - RNA, 19 nt, Homo sapiens
cgggacaggugggugagaa

SEQ ID NO: 656323 - RNA, 19 nt, Homo sapiens
guaaaggugcuggacaagu

SEQ ID NO: 656324 - RNA, 19 nt, Homo sapiens
ccacuccuguucuccuucu

SEQ ID NO: 656325 - RNA, 19 nt, Homo sapiens
caaccagcucuccugcaaa

SEQ ID NO: 656326 - RNA, 19 nt, Homo sapiens
ucaauggaggcgucugcua

SEQ ID NO: 656327 - RNA, 19 nt, Homo sapiens
gagacagccaaguccuauu

SEQ ID NO: 656328 - RNA, 19 nt, Homo sapiens
uaugacagcuacuauuacc

SEQ ID NO: 656329 - RNA, 19 nt, Homo sapiens
gaaacugagaccaccuucu

SEQ ID NO: 656330 - RNA, 19 nt, Homo sapiens
uauggcaacggcagaaaga

SEQ ID NO: 656331 - RNA, 19 nt, Homo sapiens
uaagaggcgcuaacguuac

SEQ ID NO: 656332 - RNA, 19 nt, Homo sapiens
ggucgugggcaucgucugu

SEQ ID NO: 656333 - RNA, 19 nt, Homo sapiens
acaggugggugagaagcaa

SEQ ID NO: 656334 - RNA, 19 nt, Homo sapiens
gauccagauggcagauuau

SEQ ID NO: 656335 - RNA, 19 nt, Homo sapiens
gaaccggagcuuggccaau

SEQ ID NO: 656336 - RNA, 19 nt, Homo sapiens
gaacagcccuuagucuuua

SEQ ID NO: 656337 - RNA, 19 nt, Homo sapiens
gcuaugacagcuacuauua

SEQ ID NO: 656338 - RNA, 19 nt, Homo sapiens
ccacgcaggugccaacuuu

SEQ ID NO: 656339 - RNA, 19 nt, Homo sapiens
gcaaguguccugugggaua

SEQ ID NO: 656340 - RNA, 19 nt, Homo sapiens
gcaccuuggauuugaauua

SEQ ID NO: 656341 - RNA, 19 nt, Homo sapiens
ggaacagcccuuagucuuu

SEQ ID NO: 656342 - RNA, 19 nt, Homo sapiens
agaaagaacucacgacuac

SEQ ID NO: 656343 - RNA, 19 nt, Homo sapiens
uaaaggugcuggacaagug

SEQ ID NO: 656344 - RNA, 19 nt, Homo sapiens
cagcaggacuuacuacuca

SEQ ID NO: 656345 - RNA, 19 nt, Homo sapiens
ccgaggagcuguaccagaa

SEQ ID NO: 656346 - RNA, 19 nt, Homo sapiens
gaaccagcgcuacaucuuu

SEQ ID NO: 656347 - RNA, 19 nt, Homo sapiens
ggaagcagaugcacaacca

SEQ ID NO: 656348 - RNA, 19 nt, Homo sapiens
gcaagauccugugcacuga

SEQ ID NO: 656349 - RNA, 19 nt, Homo sapiens
ccagauggcagauuauauu

SEQ ID NO: 656350 - RNA, 19 nt, Homo sapiens
gagaagcaaucgcugaagu

SEQ ID NO: 656351 - RNA, 19 nt, Homo sapiens
gcuaagaggcgcuaacguu

SEQ ID NO: 656352 - RNA, 19 nt, Homo sapiens
cuaagaggcgcuaacguua

SEQ ID NO: 656353 - RNA, 19 nt, Homo sapiens
gcgcuaacguuacgcuguu

SEQ ID NO: 656354 - RNA, 19 nt, Homo sapiens
caccuuggauuugaauuaa

SEQ ID NO: 656355 - RNA, 19 nt, Homo sapiens
gaaaggaaccagcgcuaca

SEQ ID NO: 656356 - RNA, 19 nt, Homo sapiens
gagacauucgcaucaaaua

SEQ ID NO: 656357 - RNA, 19 nt, Homo sapiens
agaaagaggugggcaagau

SEQ ID NO: 656358 - RNA, 19 nt, Homo sapiens
agauccagauggcagauua

SEQ ID NO: 656359 - RNA, 19 nt, Homo sapiens
agcaaucgcugaaguguga

SEQ ID NO: 656360 - RNA, 19 nt, Homo sapiens
aauacuagcuaacggcaaa

SEQ ID NO: 656361 - RNA, 19 nt, Homo sapiens
ucaaccagcucuccugcaa

SEQ ID NO: 656362 - RNA, 19 nt, Homo sapiens
gaggagcuguaccagaaga

SEQ ID NO: 656363 - RNA, 19 nt, Homo sapiens
gacauucgcaucaaauaug

SEQ ID NO: 656364 - RNA, 19 nt, Homo sapiens
gaccagagaccgccuacug

SEQ ID NO: 656365 - RNA, 19 nt, Homo sapiens
cugagagccugacuucuga

SEQ ID NO: 656366 - RNA, 19 nt, Homo sapiens
ggaggcgucugcuacuaca

SEQ ID NO: 656367 - RNA, 19 nt, Homo sapiens
ggaaccagcgcuacaucuu

SEQ ID NO: 656368 - RNA, 19 nt, Homo sapiens
gauggcagauuauauuucc

SEQ ID NO: 656369 - RNA, 19 nt, Homo sapiens
cagaaagaacucacgacua

SEQ ID NO: 656370 - RNA, 19 nt, Homo sapiens
gaaagaggugggcaagauc

SEQ ID NO: 656371 - RNA, 19 nt, Homo sapiens
ggccagaugcggcagguuu

SEQ ID NO: 656372 - RNA, 19 nt, Homo sapiens
guuacgcuguuuccgguuu

SEQ ID NO: 656373 - RNA, 19 nt, Homo sapiens
ggcccaaguugaagaagau

SEQ ID NO: 656374 - RNA, 19 nt, Homo sapiens
gugugucgcucgccugcua

SEQ ID NO: 656375 - RNA, 19 nt, Homo sapiens
gcgccacccuaucacgauu

SEQ ID NO: 656376 - RNA, 19 nt, Homo sapiens
gcaacgagacagccaaguc

SEQ ID NO: 656377 - RNA, 19 nt, Homo sapiens
gaagcaaucgcugaagugu

SEQ ID NO: 656378 - RNA, 19 nt, Homo sapiens
cagauggcagauuauauuu

SEQ ID NO: 656379 - RNA, 19 nt, Homo sapiens
ggugccaacuuucgagauc

SEQ ID NO: 656380 - RNA, 19 nt, Homo sapiens
agacagccaaguccuauug

SEQ ID NO: 656381 - RNA, 19 nt, Homo sapiens
ccgagacauucgcaucaaa

SEQ ID NO: 656382 - RNA, 19 nt, Homo sapiens
caaccgcagccgagacauu

SEQ ID NO: 656383 - RNA, 19 nt, Homo sapiens
gcaacagcccagcaugugu

SEQ ID NO: 656384 - RNA, 19 nt, Homo sapiens
ggaucaugcuaucaucagu

SEQ ID NO: 656385 - RNA, 19 nt, Homo sapiens
gagaaacugagaccaccuu

SEQ ID NO: 656386 - RNA, 19 nt, Homo sapiens
gacuacaguucaacaaggu

SEQ ID NO: 656387 - RNA, 19 nt, Homo sapiens
ugguaaaggugcuggacaa

SEQ ID NO: 656388 - RNA, 19 nt, Homo sapiens
aaccggagcuuggccaaug

SEQ ID NO: 656389 - RNA, 19 nt, Homo sapiens
ggaggacgcuggggaguau

SEQ ID NO: 656390 - RNA, 19 nt, Homo sapiens
gcagauuauauuuccaaga

SEQ ID NO: 656391 - RNA, 19 nt, Homo sapiens
ccacggaacagcccuuagu

SEQ ID NO: 656392 - RNA, 19 nt, Homo sapiens
guucugagagccugacuuc

SEQ ID NO: 656393 - RNA, 19 nt, Homo sapiens
caugucaucaggagagaaa

SEQ ID NO: 656394 - RNA, 19 nt, Homo sapiens
caacaacagcagcaucucu

SEQ ID NO: 656395 - RNA, 19 nt, Homo sapiens
ccaaguugaagaagaugaa

SEQ ID NO: 656396 - RNA, 19 nt, Homo sapiens
ccacagaccaugucaucag

SEQ ID NO: 656397 - RNA, 19 nt, Homo sapiens
gugguggccuacugcaaga

SEQ ID NO: 656398 - RNA, 19 nt, Homo sapiens
cggaacagcccuuagucuu

SEQ ID NO: 656399 - RNA, 19 nt, Homo sapiens
ggugguggagggcaaggua

SEQ ID NO: 656400 - RNA, 19 nt, Homo sapiens
aaccagcucuccugcaagu

SEQ ID NO: 656401 - RNA, 19 nt, Homo sapiens
gccgagacauucgcaucaa

SEQ ID NO: 656402 - RNA, 19 nt, Homo sapiens
gugugccgcucgaaaggaa

SEQ ID NO: 656403 - RNA, 19 nt, Homo sapiens
caaguguccugugggauac

SEQ ID NO: 656404 - RNA, 19 nt, Homo sapiens
agacauucgcaucaaauau

SEQ ID NO: 656405 - RNA, 19 nt, Homo sapiens
gugagaagcaaucgcugaa

SEQ ID NO: 656406 - RNA, 19 nt, Homo sapiens
cgagacagccaaguccuau

SEQ ID NO: 656407 - RNA, 19 nt, Homo sapiens
cgagacauucgcaucaaau

SEQ ID NO: 656408 - RNA, 19 nt, Homo sapiens
ccuuggauuugaauuaaag

SEQ ID NO: 656409 - RNA, 19 nt, Homo sapiens
cggcccaaguugaagaaga

SEQ ID NO: 656410 - RNA, 19 nt, Homo sapiens
ucugagagccugacuucug

SEQ ID NO: 656411 - RNA, 19 nt, Homo sapiens
ggucggguggcguugguaa

SEQ ID NO: 656412 - RNA, 19 nt, Homo sapiens
acaaccaccuccggcagaa

SEQ ID NO: 656413 - RNA, 19 nt, Homo sapiens
caacuucuccaagcaccuu

SEQ ID NO: 656414 - RNA, 19 nt, Homo sapiens
guaaaggugcuggacaagu

SEQ ID NO: 656415 - RNA, 19 nt, Homo sapiens
gaaagaacucacgacuaca

SEQ ID NO: 656416 - RNA, 19 nt, Homo sapiens
cgggacaggugggugagaa

SEQ ID NO: 656417 - RNA, 19 nt, Homo sapiens
ccacuccuguucuccuucu

SEQ ID NO: 656418 - RNA, 19 nt, Homo sapiens
ggugucagcaguucgcaau

SEQ ID NO: 656419 - RNA, 19 nt, Homo sapiens
ucaauggaggcgucugcua

SEQ ID NO: 656420 - RNA, 19 nt, Homo sapiens
gagacagccaaguccuauu

SEQ ID NO: 656421 - RNA, 19 nt, Homo sapiens
uaugacagcuacuauuacc

SEQ ID NO: 656422 - RNA, 19 nt, Homo sapiens
gaaacugagaccaccuucu

SEQ ID NO: 656423 - RNA, 19 nt, Homo sapiens
uauggcaacggcagaaaga

SEQ ID NO: 656424 - RNA, 19 nt, Homo sapiens
ggucgugggcaucgucugu

SEQ ID NO: 656425 - RNA, 19 nt, Homo sapiens
ccagcucuccugcaagugu

SEQ ID NO: 656426 - RNA, 19 nt, Homo sapiens
uaagaggcgcuaacguuac

SEQ ID NO: 656427 - RNA, 19 nt, Homo sapiens
acaggugggugagaagcaa

SEQ ID NO: 656428 - RNA, 19 nt, Homo sapiens
aaccagcgcuacaucuuuu

SEQ ID NO: 656429 - RNA, 19 nt, Homo sapiens
gauccagauggcagauuau

SEQ ID NO: 656430 - RNA, 19 nt, Homo sapiens
gaaccggagcuuggccaau

SEQ ID NO: 656431 - RNA, 19 nt, Homo sapiens
acucacgacuacaguucaa

SEQ ID NO: 656432 - RNA, 19 nt, Homo sapiens
aaagaacucacgacuacag

SEQ ID NO: 656433 - RNA, 19 nt, Homo sapiens
gaacagcccuuagucuuua

SEQ ID NO: 656434 - RNA, 19 nt, Homo sapiens
gaaacugccuuugcgauug

SEQ ID NO: 656435 - RNA, 19 nt, Homo sapiens
caaaguguccugugggaua

SEQ ID NO: 656436 - RNA, 19 nt, Homo sapiens
ggaacagcccuuagucuuu

SEQ ID NO: 656437 - RNA, 19 nt, Homo sapiens
agaaagaacucacgacuac

SEQ ID NO: 656438 - RNA, 19 nt, Homo sapiens
uaaaggugcuggacaagug

SEQ ID NO: 656439 - RNA, 19 nt, Homo sapiens
ccgaggagcuguaccagaa

SEQ ID NO: 656440 - RNA, 19 nt, Homo sapiens
gaaccagcgcuacaucuuu

SEQ ID NO: 656441 - RNA, 19 nt, Homo sapiens
gcaagauccugugcacuga

SEQ ID NO: 656442 - RNA, 19 nt, Homo sapiens
gagaagcaaucgcugaagu

SEQ ID NO: 656443 - RNA, 19 nt, Homo sapiens
gcuaagaggcgcuaacguu

SEQ ID NO: 656444 - RNA, 19 nt, Homo sapiens
cuaagaggcgcuaacguua

SEQ ID NO: 656445 - RNA, 19 nt, Homo sapiens
gcgcuaacguuacgcuguu

SEQ ID NO: 656446 - RNA, 19 nt, Homo sapiens
gaaaggaaccagcgcuaca

SEQ ID NO: 656447 - RNA, 19 nt, Homo sapiens
acagagauguuuggagaaa

SEQ ID NO: 656448 - RNA, 19 nt, Homo sapiens
gagacauucgcaucaaaua

SEQ ID NO: 656449 - RNA, 19 nt, Homo sapiens
agaaagaggugggcaagau

SEQ ID NO: 656450 - RNA, 19 nt, Homo sapiens
agcaaucgcugaaguguga

SEQ ID NO: 656451 - RNA, 19 nt, Homo sapiens
ucaaccagcucuccugcaa

SEQ ID NO: 656452 - RNA, 19 nt, Homo sapiens
gaggagcuguaccagaaga

SEQ ID NO: 656453 - RNA, 19 nt, Homo sapiens
gacauucgcaucaaauaug

SEQ ID NO: 656454 - RNA, 19 nt, Homo sapiens
ggaggcgucugcuacuaca

SEQ ID NO: 656455 - RNA, 19 nt, Homo sapiens
ggaaccagcgcuacaucuu

SEQ ID NO: 656456 - RNA, 19 nt, Homo sapiens
cagaaagaacucacgacua

SEQ ID NO: 656457 - RNA, 19 nt, Homo sapiens
gaaagaggugggcaagauc

SEQ ID NO: 656458 - RNA, 19 nt, Homo sapiens
aaacugccuuugcgauugu

SEQ ID NO: 656459 - RNA, 19 nt, Homo sapiens
ggccagaugcggcagguuu

SEQ ID NO: 656460 - RNA, 19 nt, Homo sapiens
ggcccaaguugaagaagau

SEQ ID NO: 656461 - RNA, 19 nt, Homo sapiens
guuacgcuguuuccgguuu

SEQ ID NO: 656462 - RNA, 19 nt, Homo sapiens
gugugucgcucgccugcua

SEQ ID NO: 656463 - RNA, 19 nt, Homo sapiens
aaccagcucuccugcaaau

SEQ ID NO: 656464 - RNA, 19 nt, Homo sapiens
gcaacgagacagccaaguc

SEQ ID NO: 656465 - RNA, 19 nt, Homo sapiens
gaagcaaucgcugaagugu

SEQ ID NO: 656466 - RNA, 19 nt, Homo sapiens
agacagccaaguccuauug

SEQ ID NO: 656467 - RNA, 19 nt, Homo sapiens
ccgagacauucgcaucaaa

SEQ ID NO: 656468 - RNA, 19 nt, Homo sapiens
caaccgcagccgagacauu

SEQ ID NO: 656469 - RNA, 19 nt, Homo sapiens
ccaaagccgaggagcugua

SEQ ID NO: 656470 - RNA, 19 nt, Homo sapiens
guacaugccagauccuaag

SEQ ID NO: 656471 - RNA, 19 nt, Homo sapiens
gacuacaguucaacaaggu

SEQ ID NO: 656472 - RNA, 19 nt, Homo sapiens
ugguaaaggugcuggacaa

SEQ ID NO: 656473 - RNA, 19 nt, Homo sapiens
agaaacugccuuugcgauu

SEQ ID NO: 656474 - RNA, 19 nt, Homo sapiens
ggaggacgcuggggaguau

SEQ ID NO: 656475 - RNA, 19 nt, Homo sapiens
ccacggaacagcccuuagu

SEQ ID NO: 656476 - RNA, 19 nt, Homo sapiens
caugccagauccuaagcaa

SEQ ID NO: 656477 - RNA, 19 nt, Homo sapiens
caacaacagcagcaucucu

SEQ ID NO: 656478 - RNA, 19 nt, Homo sapiens
ccaaguugaagaagaugaa

SEQ ID NO: 656479 - RNA, 19 nt, Homo sapiens
gugguggccuacugcaaga

SEQ ID NO: 656480 - RNA, 19 nt, Homo sapiens
ccagcucuccugcaaaugu

SEQ ID NO: 656481 - RNA, 19 nt, Homo sapiens
cggaacagcccuuagucuu

SEQ ID NO: 656482 - RNA, 19 nt, Homo sapiens
gccgagacauucgcaucaa

SEQ ID NO: 656483 - RNA, 19 nt, Homo sapiens
gugugccgcucgaaaggaa

SEQ ID NO: 656484 - RNA, 19 nt, Homo sapiens
ggugguggagggcaaggua

SEQ ID NO: 656485 - RNA, 19 nt, Homo sapiens
agacauucgcaucaaauau

SEQ ID NO: 656486 - RNA, 19 nt, Homo sapiens
gugagaagcaaucgcugaa

SEQ ID NO: 656487 - RNA, 19 nt, Homo sapiens
cgagacagccaaguccuau

SEQ ID NO: 656488 - RNA, 19 nt, Homo sapiens
cgagacauucgcaucaaau

SEQ ID NO: 656489 - RNA, 19 nt, Homo sapiens
cggcccaaguugaagaaga

SEQ ID NO: 656490 - RNA, 19 nt, Homo sapiens
gaaagaacucacgacuaca

SEQ ID NO: 656491 - RNA, 19 nt, Homo sapiens
cgggacaggugggugagaa

SEQ ID NO: 656492 - RNA, 19 nt, Homo sapiens
guaaaggugcuggacaagu

SEQ ID NO: 656493 - RNA, 19 nt, Homo sapiens
ggucggguggcguugguaa

SEQ ID NO: 656494 - RNA, 19 nt, Homo sapiens
ggugucagcaguucgcaau

SEQ ID NO: 656495 - RNA, 19 nt, Homo sapiens
caaccagcucuccugcaaa

SEQ ID NO: 656496 - RNA, 19 nt, Homo sapiens
ucaauggaggcgucugcua

SEQ ID NO: 656497 - RNA, 19 nt, Homo sapiens
gagacagccaaguccuauu

SEQ ID NO: 656498 - RNA, 19 nt, Homo sapiens
uauggcaacggcagaaaga

SEQ ID NO: 656499 - RNA, 19 nt, Homo sapiens
ggucgugggcaucgucugu

SEQ ID NO: 656500 - RNA, 19 nt, Homo sapiens
ugccagauccuaagcaaag

SEQ ID NO: 656501 - RNA, 19 nt, Homo sapiens
acaggugggugagaagcaa

SEQ ID NO: 656502 - RNA, 19 nt, Homo sapiens
uaagaggcgcuaacguuac

SEQ ID NO: 656503 - RNA, 19 nt, Homo sapiens
acucacgacuacaguucaa

SEQ ID NO: 656504 - RNA, 19 nt, Homo sapiens
aaagaacucacgacuacag

SEQ ID NO: 656505 - RNA, 19 nt, Homo sapiens
aaccagcgcuacaucuuuu

SEQ ID NO: 656506 - RNA, 19 nt, Homo sapiens
gaacagcccuuagucuuua

SEQ ID NO: 656507 - RNA, 19 nt, Homo sapiens
gaaacugccuuugcgauug

SEQ ID NO: 656508 - RNA, 19 nt, Homo sapiens
caaaguguccugugggaua

SEQ ID NO: 656509 - RNA, 19 nt, Homo sapiens
gcaccuuggauuugaauua

SEQ ID NO: 656510 - RNA, 19 nt, Homo sapiens
ggaacagcccuuagucuuu

SEQ ID NO: 656511 - RNA, 19 nt, Homo sapiens
agaaagaacucacgacuac

SEQ ID NO: 656512 - RNA, 19 nt, Homo sapiens
uaaaggugcuggacaagug

SEQ ID NO: 656513 - RNA, 19 nt, Homo sapiens
gaaccagcgcuacaucuuu

SEQ ID NO: 656514 - RNA, 19 nt, Homo sapiens
gcaagauccugugcacuga

SEQ ID NO: 656515 - RNA, 19 nt, Homo sapiens
gagaagcaaucgcugaagu

SEQ ID NO: 656516 - RNA, 19 nt, Homo sapiens
gcuaagaggcgcuaacguu

SEQ ID NO: 656517 - RNA, 19 nt, Homo sapiens
cuaagaggcgcuaacguua

SEQ ID NO: 656518 - RNA, 19 nt, Homo sapiens
caccuuggauuugaauuaa

SEQ ID NO: 656519 - RNA, 19 nt, Homo sapiens
gcgcuaacguuacgcuguu

SEQ ID NO: 656520 - RNA, 19 nt, Homo sapiens
gaaaggaaccagcgcuaca

SEQ ID NO: 656521 - RNA, 19 nt, Homo sapiens
acagagauguuuggagaaa

SEQ ID NO: 656522 - RNA, 19 nt, Homo sapiens
gagacauucgcaucaaaua

SEQ ID NO: 656523 - RNA, 19 nt, Homo sapiens
agaaagaggugggcaagau

SEQ ID NO: 656524 - RNA, 19 nt, Homo sapiens
agcaaucgcugaaguguga

SEQ ID NO: 656525 - RNA, 19 nt, Homo sapiens
ucaaccagcucuccugcaa

SEQ ID NO: 656526 - RNA, 19 nt, Homo sapiens
gacauucgcaucaaauaug

SEQ ID NO: 656527 - RNA, 19 nt, Homo sapiens
ggaggcgucugcuacuaca

SEQ ID NO: 656528 - RNA, 19 nt, Homo sapiens
ggaaccagcgcuacaucuu

SEQ ID NO: 656529 - RNA, 19 nt, Homo sapiens
cagaaagaacucacgacua

SEQ ID NO: 656530 - RNA, 19 nt, Homo sapiens
gaaagaggugggcaagauc

SEQ ID NO: 656531 - RNA, 19 nt, Homo sapiens
aaacugccuuugcgauugu

SEQ ID NO: 656532 - RNA, 19 nt, Homo sapiens
ggccagaugcggcagguuu

SEQ ID NO: 656533 - RNA, 19 nt, Homo sapiens
guuacgcuguuuccgguuu

SEQ ID NO: 656534 - RNA, 19 nt, Homo sapiens
ggcccaaguugaagaagau

SEQ ID NO: 656535 - RNA, 19 nt, Homo sapiens
gugugucgcucgccugcua

SEQ ID NO: 656536 - RNA, 19 nt, Homo sapiens
aaccagcucuccugcaaau

SEQ ID NO: 656537 - RNA, 19 nt, Homo sapiens
gcaacgagacagccaaguc

SEQ ID NO: 656538 - RNA, 19 nt, Homo sapiens
gaagcaaucgcugaagugu

SEQ ID NO: 656539 - RNA, 19 nt, Homo sapiens
agacagccaaguccuauug

SEQ ID NO: 656540 - RNA, 19 nt, Homo sapiens
ccgagacauucgcaucaaa

SEQ ID NO: 656541 - RNA, 19 nt, Homo sapiens
caaccgcagccgagacauu

SEQ ID NO: 656542 - RNA, 19 nt, Homo sapiens
guacaugccagauccuaag

SEQ ID NO: 656543 - RNA, 19 nt, Homo sapiens
gacuacaguucaacaaggu

SEQ ID NO: 656544 - RNA, 19 nt, Homo sapiens
ugguaaaggugcuggacaa

SEQ ID NO: 656545 - RNA, 19 nt, Homo sapiens
agaaacugccuuugcgauu

SEQ ID NO: 656546 - RNA, 19 nt, Homo sapiens
ggaggacgcuggggaguau

SEQ ID NO: 656547 - RNA, 19 nt, Homo sapiens
ccacggaacagcccuuagu

SEQ ID NO: 656548 - RNA, 19 nt, Homo sapiens
caugccagauccuaagcaa

SEQ ID NO: 656549 - RNA, 19 nt, Homo sapiens
caacaacagcagcaucucu

SEQ ID NO: 656550 - RNA, 19 nt, Homo sapiens
ccaaguugaagaagaugaa

SEQ ID NO: 656551 - RNA, 19 nt, Homo sapiens
ccagcucuccugcaaaugu

SEQ ID NO: 656552 - RNA, 19 nt, Homo sapiens
cggaacagcccuuagucuu

SEQ ID NO: 656553 - RNA, 19 nt, Homo sapiens
gccgagacauucgcaucaa

SEQ ID NO: 656554 - RNA, 19 nt, Homo sapiens
gugugccgcucgaaaggaa

SEQ ID NO: 656555 - RNA, 19 nt, Homo sapiens
ggugguggagggcaaggua

SEQ ID NO: 656556 - RNA, 19 nt, Homo sapiens
agacauucgcaucaaauau

SEQ ID NO: 656557 - RNA, 19 nt, Homo sapiens
gugagaagcaaucgcugaa

SEQ ID NO: 656558 - RNA, 19 nt, Homo sapiens
cgagacagccaaguccuau

SEQ ID NO: 656559 - RNA, 19 nt, Homo sapiens
cgagacauucgcaucaaau

SEQ ID NO: 656560 - RNA, 19 nt, Homo sapiens
ccuuggauuugaauuaaag

SEQ ID NO: 656561 - RNA, 19 nt, Homo sapiens
cggcccaaguugaagaaga

SEQ ID NO: 656562 - RNA, 19 nt, Homo sapiens
caacuucuccaagcaccuu

SEQ ID NO: 656563 - RNA, 19 nt, Homo sapiens
gaaagaacucacgacuaca

SEQ ID NO: 656564 - RNA, 19 nt, Homo sapiens
cgggacaggugggugagaa

SEQ ID NO: 656565 - RNA, 19 nt, Homo sapiens
guaaaggugcuggacaagu

SEQ ID NO: 656566 - RNA, 19 nt, Homo sapiens
ggucggguggcguugguaa

SEQ ID NO: 656567 - RNA, 19 nt, Homo sapiens
ggugucagcaguucgcaau

SEQ ID NO: 656568 - RNA, 19 nt, Homo sapiens
caaccagcucuccugcaaa

SEQ ID NO: 656569 - RNA, 19 nt, Homo sapiens
ucaauggaggcgucugcua

SEQ ID NO: 656570 - RNA, 19 nt, Homo sapiens
gagacagccaaguccuauu

SEQ ID NO: 656571 - RNA, 19 nt, Homo sapiens
uauggcaacggcagaaaga

SEQ ID NO: 656572 - RNA, 19 nt, Homo sapiens
ugccagauccuaagcaaag

SEQ ID NO: 656573 - RNA, 19 nt, Homo sapiens
acaggugggugagaagcaa

SEQ ID NO: 656574 - RNA, 19 nt, Homo sapiens
uaagaggcgcuaacguuac

SEQ ID NO: 656575 - RNA, 19 nt, Homo sapiens
acucacgacuacaguucaa

SEQ ID NO: 656576 - RNA, 19 nt, Homo sapiens
aaagaacucacgacuacag

SEQ ID NO: 656577 - RNA, 19 nt, Homo sapiens
aaccagcgcuacaucuuuu

SEQ ID NO: 656578 - RNA, 19 nt, Homo sapiens
gaucagaacuucgacuaua

SEQ ID NO: 656579 - RNA, 19 nt, Homo sapiens
gaagugaauucuggaacua

SEQ ID NO: 656580 - RNA, 19 nt, Homo sapiens
ccacaucucugauccugaa

SEQ ID NO: 656581 - RNA, 19 nt, Homo sapiens
ggacugauauucccaagcu

SEQ ID NO: 656582 - RNA, 19 nt, Homo sapiens
ggaacuauggaccacauua

SEQ ID NO: 656583 - RNA, 19 nt, Homo sapiens
ccacgcaaaucaagaccua

SEQ ID NO: 656584 - RNA, 19 nt, Homo sapiens
ugcaugagcuugcugcuuu

SEQ ID NO: 656585 - RNA, 19 nt, Homo sapiens
ccacgaacuuucuggauuc

SEQ ID NO: 656586 - RNA, 19 nt, Homo sapiens
cguggugccuucuagcuua

SEQ ID NO: 656587 - RNA, 19 nt, Homo sapiens
ccacgacccugccacuguu

SEQ ID NO: 656588 - RNA, 19 nt, Homo sapiens
ggacaacgcccaggucauc

SEQ ID NO: 656589 - RNA, 19 nt, Homo sapiens
gaagggacagggagucaga

SEQ ID NO: 656590 - RNA, 19 nt, Homo sapiens
ugacaucgccaaucaggaa

SEQ ID NO: 656591 - RNA, 19 nt, Homo sapiens
uguaugacaucgccaauca

SEQ ID NO: 656592 - RNA, 19 nt, Homo sapiens
gaacuauggaccacauuag

SEQ ID NO: 656593 - RNA, 19 nt, Homo sapiens
guucaaacugcuacugaua

SEQ ID NO: 656594 - RNA, 19 nt, Homo sapiens
guacugugggcaucgauuu

SEQ ID NO: 656595 - RNA, 19 nt, Homo sapiens
gaagcagccuuuucccauu

SEQ ID NO: 656596 - RNA, 19 nt, Homo sapiens
gaugaacgagucccuggaa

SEQ ID NO: 656597 - RNA, 19 nt, Homo sapiens
cgaccuugguuucgaguuc

SEQ ID NO: 656598 - RNA, 19 nt, Homo sapiens
cccacgaacuuucuggauu

SEQ ID NO: 656599 - RNA, 19 nt, Homo sapiens
ccugcaggcuggucucuga

SEQ ID NO: 656600 - RNA, 19 nt, Homo sapiens
aaucaugcauccugcuaga

SEQ ID NO: 656601 - RNA, 19 nt, Homo sapiens
ggguugggcaggacugaua

SEQ ID NO: 656602 - RNA, 19 nt, Homo sapiens
ggacugggccacgcaaauc

SEQ ID NO: 656603 - RNA, 19 nt, Homo sapiens
ugaagugaauucuggaacu

SEQ ID NO: 656604 - RNA, 19 nt, Homo sapiens
gcaagacuuccuuccuguu

SEQ ID NO: 656605 - RNA, 19 nt, Homo sapiens
cuguuuagcugguuguguu

SEQ ID NO: 656606 - RNA, 19 nt, Homo sapiens
cagaucagaacuucgacua

SEQ ID NO: 656607 - RNA, 19 nt, Homo sapiens
gcaugagcuugcugcuuuc

SEQ ID NO: 656608 - RNA, 19 nt, Homo sapiens
gcaucgauuucaaggucaa

SEQ ID NO: 656609 - RNA, 19 nt, Homo sapiens
cagcagaucagaacuucga

SEQ ID NO: 656610 - RNA, 19 nt, Homo sapiens
caagacuuccuuccuguuc

SEQ ID NO: 656611 - RNA, 19 nt, Homo sapiens
ucaugcauccugcuagaaa

SEQ ID NO: 656612 - RNA, 19 nt, Homo sapiens
caucucugauccugaagug

SEQ ID NO: 656613 - RNA, 19 nt, Homo sapiens
ggugacacgucccacucuu

SEQ ID NO: 656614 - RNA, 19 nt, Homo sapiens
ccaaucaugcauccugcua

SEQ ID NO: 656615 - RNA, 19 nt, Homo sapiens
ggcccuguuuagcuguuua

SEQ ID NO: 656616 - RNA, 19 nt, Homo sapiens
ucaaacugcuacugauagg

SEQ ID NO: 656617 - RNA, 19 nt, Homo sapiens
ggaggacgaacguguugug

SEQ ID NO: 656618 - RNA, 19 nt, Homo sapiens
ucucugauccugaagugaa

SEQ ID NO: 656619 - RNA, 19 nt, Homo sapiens
cagcauugaagcagccuuu

SEQ ID NO: 656620 - RNA, 19 nt, Homo sapiens
ugacacgucccacucuuuc

SEQ ID NO: 656621 - RNA, 19 nt, Homo sapiens
ucgacuauauguucaaacu

SEQ ID NO: 656622 - RNA, 19 nt, Homo sapiens
cuuccuuccuguuccgaua

SEQ ID NO: 656623 - RNA, 19 nt, Homo sapiens
gcagugugggcaagacuuc

SEQ ID NO: 656624 - RNA, 19 nt, Homo sapiens
ucagaacuucgacuauaug

SEQ ID NO: 656625 - RNA, 19 nt, Homo sapiens
cagggacacugacgugcau

SEQ ID NO: 656626 - RNA, 19 nt, Homo sapiens
ggaugcagcagaucagaac

SEQ ID NO: 656627 - RNA, 19 nt, Homo sapiens
cauccguggugccuucuag

SEQ ID NO: 656628 - RNA, 19 nt, Homo sapiens
ucuccaagcucagggcaau

SEQ ID NO: 656629 - RNA, 19 nt, Homo sapiens
gcuuucggccagaaguuaa

SEQ ID NO: 656630 - RNA, 19 nt, Homo sapiens
acauuagacugggcagaga

SEQ ID NO: 656631 - RNA, 19 nt, Homo sapiens
agugaauucuggaacuaug

SEQ ID NO: 656632 - RNA, 19 nt, Homo sapiens
gaaaagcagcauugaagca

SEQ ID NO: 656633 - RNA, 19 nt, Homo sapiens
gcgaaaagcagcauugaag

SEQ ID NO: 656634 - RNA, 19 nt, Homo sapiens
aucagaacuucgacuauau

SEQ ID NO: 656635 - RNA, 19 nt, Homo sapiens
gugacacgucccacucuuu

SEQ ID NO: 656636 - RNA, 19 nt, Homo sapiens
ggcuuucggccagaaguua

SEQ ID NO: 656637 - RNA, 19 nt, Homo sapiens
gggaugcagcagaucagaa

SEQ ID NO: 656638 - RNA, 19 nt, Homo sapiens
gagcgcuaccgcaccauca

SEQ ID NO: 656639 - RNA, 19 nt, Homo sapiens
ucgagcgccugguggaugu

SEQ ID NO: 656640 - RNA, 19 nt, Homo sapiens
gaugccagcugccacauau

SEQ ID NO: 656641 - RNA, 19 nt, Homo sapiens
ccuguaugauuuccuaaua

SEQ ID NO: 656642 - RNA, 19 nt, Homo sapiens
ccuggacggugucauauuu

SEQ ID NO: 656643 - RNA, 19 nt, Homo sapiens
gauggaacuugaugaguca

SEQ ID NO: 656644 - RNA, 19 nt, Homo sapiens
gguccuguaugauuuccua

SEQ ID NO: 656645 - RNA, 19 nt, Homo sapiens
caagaugcucugccacgua

SEQ ID NO: 656646 - RNA, 19 nt, Homo sapiens
ccgagacccuggcuuccua

SEQ ID NO: 656647 - RNA, 19 nt, Homo sapiens
agcaggagcucaagcaguu

SEQ ID NO: 656648 - RNA, 19 nt, Homo sapiens
aagaugcucugccacguau

SEQ ID NO: 656649 - RNA, 19 nt, Homo sapiens
ucagucggauggaacuuga

SEQ ID NO: 656650 - RNA, 19 nt, Homo sapiens
gacggugccucuagucaca

SEQ ID NO: 656651 - RNA, 19 nt, Homo sapiens
ggacccagaugaggauucu

SEQ ID NO: 656652 - RNA, 19 nt, Homo sapiens
gcucaucgcccaggccauu

SEQ ID NO: 656653 - RNA, 19 nt, Homo sapiens
ccacauaucgccuccuuac

SEQ ID NO: 656654 - RNA, 19 nt, Homo sapiens
gguucuugguccuguauga

SEQ ID NO: 656655 - RNA, 19 nt, Homo sapiens
uuugggaacugccugaaga

SEQ ID NO: 656656 - RNA, 19 nt, Homo sapiens
ucuugguccuguaugauuu

SEQ ID NO: 656657 - RNA, 19 nt, Homo sapiens
gcgccugccaccuccauaa

SEQ ID NO: 656658 - RNA, 19 nt, Homo sapiens
ccuccuggacggugucaua

SEQ ID NO: 656659 - RNA, 19 nt, Homo sapiens
gaugcucugccacguauuc

SEQ ID NO: 656660 - RNA, 19 nt, Homo sapiens
gcuccugucugccgaagcu

SEQ ID NO: 656661 - RNA, 19 nt, Homo sapiens
ugagaucaaugggcagagu

SEQ ID NO: 656662 - RNA, 19 nt, Homo sapiens
ccaccaagaggaucaaggu

SEQ ID NO: 656663 - RNA, 19 nt, Homo sapiens
gagacggugccucuaguca

SEQ ID NO: 656664 - RNA, 19 nt, Homo sapiens
gagggcagcaggagcucaa

SEQ ID NO: 656665 - RNA, 19 nt, Homo sapiens
gcucugccacguauucuac

SEQ ID NO: 656666 - RNA, 19 nt, Homo sapiens
cgaugccagcugccacaua

SEQ ID NO: 656667 - RNA, 19 nt, Homo sapiens
ggaccacuucuccaacagu

SEQ ID NO: 656668 - RNA, 19 nt, Homo sapiens
guucacagguucaauauuu

SEQ ID NO: 656669 - RNA, 19 nt, Homo sapiens
ugaagaagcuggaaaugaa

SEQ ID NO: 656670 - RNA, 19 nt, Homo sapiens
gcauuguacugcuguguua

SEQ ID NO: 656671 - RNA, 19 nt, Homo sapiens
guacauauacccuuaagaa

SEQ ID NO: 656672 - RNA, 19 nt, Homo sapiens
gacaaaugauccuuaaaga

SEQ ID NO: 656673 - RNA, 19 nt, Homo sapiens
gcaugcagguuucauauuc

SEQ ID NO: 656674 - RNA, 19 nt, Homo sapiens
cgagacaaaugauccuuaa

SEQ ID NO: 656675 - RNA, 19 nt, Homo sapiens
caaaugauccuuaaagaag

SEQ ID NO: 656676 - RNA, 19 nt, Homo sapiens
caaguuugguugccagaaa

SEQ ID NO: 656677 - RNA, 19 nt, Homo sapiens
ccaagagcguguccaggua

SEQ ID NO: 656678 - RNA, 19 nt, Homo sapiens
gagugguucugcauauuaa

SEQ ID NO: 656679 - RNA, 19 nt, Homo sapiens
guacaugucagaaaccauu

SEQ ID NO: 656680 - RNA, 19 nt, Homo sapiens
ucagaaaccauuagcauug

SEQ ID NO: 656681 - RNA, 19 nt, Homo sapiens
aaacagugcaguccucuuu

SEQ ID NO: 656682 - RNA, 19 nt, Homo sapiens
aggcauaagacacaaauua

SEQ ID NO: 656683 - RNA, 19 nt, Homo sapiens
gcaccaagcgcuucaucaa

SEQ ID NO: 656684 - RNA, 19 nt, Homo sapiens
guacugcuguguuauaugc

SEQ ID NO: 656685 - RNA, 19 nt, Homo sapiens
cgagugguucugcauauua

SEQ ID NO: 656686 - RNA, 19 nt, Homo sapiens
ccauguaauucuucaaugu

SEQ ID NO: 656687 - RNA, 19 nt, Homo sapiens
ggggaaaacucaugccuuu

SEQ ID NO: 656688 - RNA, 19 nt, Homo sapiens
gagggaggcuguggagaga

SEQ ID NO: 656689 - RNA, 19 nt, Homo sapiens
gugcaguccucuuucgaaa

SEQ ID NO: 656690 - RNA, 19 nt, Homo sapiens
gcaguacuaaagcaauaua

SEQ ID NO: 656691 - RNA, 19 nt, Homo sapiens
gagcuugguggacacauuu

SEQ ID NO: 656692 - RNA, 19 nt, Homo sapiens
gaggguagcggaugugugu

SEQ ID NO: 656693 - RNA, 19 nt, Homo sapiens
gcgagacaaaugauccuua

SEQ ID NO: 656694 - RNA, 19 nt, Homo sapiens
gcccuuuccucuguacaua

SEQ ID NO: 656695 - RNA, 19 nt, Homo sapiens
auacacagcuacagacaca

SEQ ID NO: 656696 - RNA, 19 nt, Homo sapiens
aaacucaugccuuuccuuu

SEQ ID NO: 656697 - RNA, 19 nt, Homo sapiens
ggaaaugaagccaaaguac

SEQ ID NO: 656698 - RNA, 19 nt, Homo sapiens
ggagagagcgcggagacaa

SEQ ID NO: 656699 - RNA, 19 nt, Homo sapiens
gggcaggagcggauuuaaa

SEQ ID NO: 656700 - RNA, 19 nt, Homo sapiens
guccauacgucacuauaca

SEQ ID NO: 656701 - RNA, 19 nt, Homo sapiens
gugaagaagcuggaaauga

SEQ ID NO: 656702 - RNA, 19 nt, Homo sapiens
ccuuuccucuguacauaua

SEQ ID NO: 656703 - RNA, 19 nt, Homo sapiens
cuauacaucugagcuuuau

SEQ ID NO: 656704 - RNA, 19 nt, Homo sapiens
ucccaacacugucagcaaa

SEQ ID NO: 656705 - RNA, 19 nt, Homo sapiens
gcgagaggguagcggaugu

SEQ ID NO: 656706 - RNA, 19 nt, Homo sapiens
caguguugcuccauuccua

SEQ ID NO: 656707 - RNA, 19 nt, Homo sapiens
gcgaggagaagaugguuau

SEQ ID NO: 656708 - RNA, 19 nt, Homo sapiens
gggaaaaccuucaaagcau

SEQ ID NO: 656709 - RNA, 19 nt, Homo sapiens
agacaaaugauccuuaaag

SEQ ID NO: 656710 - RNA, 19 nt, Homo sapiens
gcuauguacaugucagaaa

SEQ ID NO: 656711 - RNA, 19 nt, Homo sapiens
gagggcaggagcggauuua

SEQ ID NO: 656712 - RNA, 19 nt, Homo sapiens
augcaguacuaaagcaaua

SEQ ID NO: 656713 - RNA, 19 nt, Homo sapiens
gaggagaagaugguuauca

SEQ ID NO: 656714 - RNA, 19 nt, Homo sapiens
uaugaauacaugcgcaaua

SEQ ID NO: 656715 - RNA, 19 nt, Homo sapiens
gaagaagcuggaaaugaag

SEQ ID NO: 656716 - RNA, 19 nt, Homo sapiens
guuauaugcuauguacaug

SEQ ID NO: 656717 - RNA, 19 nt, Homo sapiens
cacuauacaucugagcuuu

SEQ ID NO: 656718 - RNA, 19 nt, Homo sapiens
uauaugcuauguacauguc

SEQ ID NO: 656719 - RNA, 19 nt, Homo sapiens
ugagcuugguggacacauu

SEQ ID NO: 656720 - RNA, 19 nt, Homo sapiens
ccaagcgcuucaucaagug

SEQ ID NO: 656721 - RNA, 19 nt, Homo sapiens
gcagguuucauauucuuuc

SEQ ID NO: 656722 - RNA, 19 nt, Homo sapiens
gcaauauauuugugauucc

SEQ ID NO: 656723 - RNA, 19 nt, Homo sapiens
caaaccaguugggagacuu

SEQ ID NO: 656724 - RNA, 19 nt, Homo sapiens
accaagcgcuucaucaagu

SEQ ID NO: 656725 - RNA, 19 nt, Homo sapiens
gcacugcgaggagaagaug

SEQ ID NO: 656726 - RNA, 19 nt, Homo sapiens
uguguuauaugcuauguac

SEQ ID NO: 656727 - RNA, 19 nt, Homo sapiens
gaaagguucacagguucaa

SEQ ID NO: 656728 - RNA, 19 nt, Homo sapiens
uuuccaagauccugugaug

SEQ ID NO: 656729 - RNA, 19 nt, Homo sapiens
aggagaagaugguuaucau

SEQ ID NO: 656730 - RNA, 19 nt, Homo sapiens
aagguucacagguucaaua

SEQ ID NO: 656731 - RNA, 19 nt, Homo sapiens
uggaaaugaagccaaagua

SEQ ID NO: 656732 - RNA, 19 nt, Homo sapiens
gucagaaaccauuagcauu

SEQ ID NO: 656733 - RNA, 19 nt, Homo sapiens
caugcgcccuuuccucugu

SEQ ID NO: 656734 - RNA, 19 nt, Homo sapiens
agacacacauucuguugac

SEQ ID NO: 656735 - RNA, 19 nt, Homo sapiens
caugugagguucccaacac

SEQ ID NO: 656736 - RNA, 19 nt, Homo sapiens
gagacaaaugauccuuaaa

SEQ ID NO: 656737 - RNA, 19 nt, Homo sapiens
guggacacauuucauugca

SEQ ID NO: 656738 - RNA, 19 nt, Homo sapiens
gaggaacaaugagcuuggu

SEQ ID NO: 656739 - RNA, 19 nt, Homo sapiens
ucacaggcauaagacacaa

SEQ ID NO: 656740 - RNA, 19 nt, Homo sapiens
ccgagugguucugcauauu

SEQ ID NO: 656741 - RNA, 19 nt, Homo sapiens
gaauacaugcgcaauacac

SEQ ID NO: 656742 - RNA, 19 nt, Homo sapiens
ggcaggagcggauuuaaaa

SEQ ID NO: 656743 - RNA, 19 nt, Homo sapiens
acauuucauugcaguguug

SEQ ID NO: 656744 - RNA, 19 nt, Homo sapiens
guuaucaucaccaccaaga

SEQ ID NO: 656745 - RNA, 19 nt, Homo sapiens
gugauggcgagacaaauga

SEQ ID NO: 656746 - RNA, 19 nt, Homo sapiens
cagguucaauauuuaaugc

SEQ ID NO: 656747 - RNA, 19 nt, Homo sapiens
cagaaaccauuagcauugc

SEQ ID NO: 656748 - RNA, 19 nt, Homo sapiens
cuauguacaugucagaaac

SEQ ID NO: 656749 - RNA, 19 nt, Homo sapiens
uuacacacccuaggaaaca

SEQ ID NO: 656750 - RNA, 19 nt, Homo sapiens
auacgucacuauacaucug

SEQ ID NO: 656751 - RNA, 19 nt, Homo sapiens
cuucaucacaggcugcuuu

SEQ ID NO: 656752 - RNA, 19 nt, Homo sapiens
gacccaagauccgcuacag

SEQ ID NO: 656753 - RNA, 19 nt, Homo sapiens
cucuguacauauacccuua

SEQ ID NO: 656754 - RNA, 19 nt, Homo sapiens
gagagagcgcggagacaag

SEQ ID NO: 656755 - RNA, 19 nt, Homo sapiens
acacacauucuguugacaa

SEQ ID NO: 656756 - RNA, 19 nt, Homo sapiens
cacauuucauugcaguguu

SEQ ID NO: 656757 - RNA, 19 nt, Homo sapiens
acuauacaucugagcuuua

SEQ ID NO: 656758 - RNA, 19 nt, Homo sapiens
cgaaagcuaagaugaccau

SEQ ID NO: 656759 - RNA, 19 nt, Homo sapiens
cccauguaauucuucaaug

SEQ ID NO: 656760 - RNA, 19 nt, Homo sapiens
caauacacagcuacagaca

SEQ ID NO: 656761 - RNA, 19 nt, Homo sapiens
caugcgcaauacacagcua

SEQ ID NO: 656762 - RNA, 19 nt, Homo sapiens
gagguucccaacacuguca

SEQ ID NO: 656763 - RNA, 19 nt, Homo sapiens
caugcagguuucauauucu

SEQ ID NO: 656764 - RNA, 19 nt, Homo sapiens
gaaaccauuagcauugcau

SEQ ID NO: 656765 - RNA, 19 nt, Homo sapiens
guugggagacuugugcaaa

SEQ ID NO: 656766 - RNA, 19 nt, Homo sapiens
augaauacaugcgcaauac

SEQ ID NO: 656767 - RNA, 19 nt, Homo sapiens
gguaugggugugcaagugu

SEQ ID NO: 656768 - RNA, 19 nt, Homo sapiens
gaacagggaugaagucuug

SEQ ID NO: 656769 - RNA, 19 nt, Homo sapiens
gaaaggaagggauuaaaua

SEQ ID NO: 656770 - RNA, 19 nt, Homo sapiens
gcacagcucuaguuacauu

SEQ ID NO: 656771 - RNA, 19 nt, Homo sapiens
caaggaagcugcggcauug

SEQ ID NO: 656772 - RNA, 19 nt, Homo sapiens
guauaucaguguugacuuu

SEQ ID NO: 656773 - RNA, 19 nt, Homo sapiens
uaaagacucugucaugcaa

SEQ ID NO: 656774 - RNA, 19 nt, Homo sapiens
gaagaaaggaagggauuaa

SEQ ID NO: 656775 - RNA, 19 nt, Homo sapiens
ccacauaacaauucuuuga

SEQ ID NO: 656776 - RNA, 19 nt, Homo sapiens
uagaugcccucacgaauau

SEQ ID NO: 656777 - RNA, 19 nt, Homo sapiens
uagcacagcucuaguuaca

SEQ ID NO: 656778 - RNA, 19 nt, Homo sapiens
gaagcaggccaaagaagaa

SEQ ID NO: 656779 - RNA, 19 nt, Homo sapiens
uaauagguccuuccacuuu

SEQ ID NO: 656780 - RNA, 19 nt, Homo sapiens
gggaugaagucuuggacaa

SEQ ID NO: 656781 - RNA, 19 nt, Homo sapiens
gaauacuaguggaauuguu

SEQ ID NO: 656782 - RNA, 19 nt, Homo sapiens
ucacgaauaugaagcuuag

SEQ ID NO: 656783 - RNA, 19 nt, Homo sapiens
ugaccauccuccagacaua

SEQ ID NO: 656784 - RNA, 19 nt, Homo sapiens
aggcugaaauugaacagua

SEQ ID NO: 656785 - RNA, 19 nt, Homo sapiens
uuaaaguaguccauucuug

SEQ ID NO: 656786 - RNA, 19 nt, Homo sapiens
uuagaugcccucacgaaua

SEQ ID NO: 656787 - RNA, 19 nt, Homo sapiens
gaaagaaccggaggcugaa

SEQ ID NO: 656788 - RNA, 19 nt, Homo sapiens
ccgcauaaauggauagaag

SEQ ID NO: 656789 - RNA, 19 nt, Homo sapiens
uggacaaccucuuggcuuu

SEQ ID NO: 656790 - RNA, 19 nt, Homo sapiens
gcagagggagaaagaauuc

SEQ ID NO: 656791 - RNA, 19 nt, Homo sapiens
gcagccagccuuaaaguag

SEQ ID NO: 656792 - RNA, 19 nt, Homo sapiens
gcucaagcaacauguauau

SEQ ID NO: 656793 - RNA, 19 nt, Homo sapiens
caugaaaacuaccgcauaa

SEQ ID NO: 656794 - RNA, 19 nt, Homo sapiens
gaagcagcagccagccuua

SEQ ID NO: 656795 - RNA, 19 nt, Homo sapiens
ucaagcaacauguauauca

SEQ ID NO: 656796 - RNA, 19 nt, Homo sapiens
ccucauauuucuuaggaau

SEQ ID NO: 656797 - RNA, 19 nt, Homo sapiens
gaugauagaauucaagaac

SEQ ID NO: 656798 - RNA, 19 nt, Homo sapiens
uuagaacagugaauacuag

SEQ ID NO: 656799 - RNA, 19 nt, Homo sapiens
guuagaacagugaauacua

SEQ ID NO: 656800 - RNA, 19 nt, Homo sapiens
ggaauuguuugggcugcuu

SEQ ID NO: 656801 - RNA, 19 nt, Homo sapiens
ggccagaaauccaugaaaa

SEQ ID NO: 656802 - RNA, 19 nt, Homo sapiens
agaaggagacccaggagaa

SEQ ID NO: 656803 - RNA, 19 nt, Homo sapiens
ccaaggaagcugcggcauu

SEQ ID NO: 656804 - RNA, 19 nt, Homo sapiens
ugaagcaggccaaagaaga

SEQ ID NO: 656805 - RNA, 19 nt, Homo sapiens
aguaguccauucuugcuaa

SEQ ID NO: 656806 - RNA, 19 nt, Homo sapiens
uaccucauauuucuuagga

SEQ ID NO: 656807 - RNA, 19 nt, Homo sapiens
gaaaacuaccgcauaaaug

SEQ ID NO: 656808 - RNA, 19 nt, Homo sapiens
agacauacuuccggcagaa

SEQ ID NO: 656809 - RNA, 19 nt, Homo sapiens
guaaagacucugucaugca

SEQ ID NO: 656810 - RNA, 19 nt, Homo sapiens
ugaagaaaggaagggauua

SEQ ID NO: 656811 - RNA, 19 nt, Homo sapiens
caagcaacauguauaucag

SEQ ID NO: 656812 - RNA, 19 nt, Homo sapiens
gcuguggaguggcauuuua

SEQ ID NO: 656813 - RNA, 19 nt, Homo sapiens
gagaguagcaaaucuagcu

SEQ ID NO: 656814 - RNA, 19 nt, Homo sapiens
gaguagcaaaucuagcuuu

SEQ ID NO: 656815 - RNA, 19 nt, Homo sapiens
agaaaggaagggauuaaau

SEQ ID NO: 656816 - RNA, 19 nt, Homo sapiens
uuacuugguguaucgauaa

SEQ ID NO: 656817 - RNA, 19 nt, Homo sapiens
gcagaacagggaugaaguc

SEQ ID NO: 656818 - RNA, 19 nt, Homo sapiens
gaaggagacccaggagaag

SEQ ID NO: 656819 - RNA, 19 nt, Homo sapiens
gcuuagcacagcucuaguu

SEQ ID NO: 656820 - RNA, 19 nt, Homo sapiens
acauguauaucaguguuga

SEQ ID NO: 656821 - RNA, 19 nt, Homo sapiens
cuugguguaucgauaauca

SEQ ID NO: 656822 - RNA, 19 nt, Homo sapiens
cagccagccuuaaaguagu

SEQ ID NO: 656823 - RNA, 19 nt, Homo sapiens
gcugaagcaggccaaagaa

SEQ ID NO: 656824 - RNA, 19 nt, Homo sapiens
gaugcccucacgaauauga

SEQ ID NO: 656825 - RNA, 19 nt, Homo sapiens
uaaauggauagaagagaga

SEQ ID NO: 656826 - RNA, 19 nt, Homo sapiens
gcauaaauggauagaagag

SEQ ID NO: 656827 - RNA, 19 nt, Homo sapiens
aaguaaagacucugucaug

SEQ ID NO: 656828 - RNA, 19 nt, Homo sapiens
agugaauacuaguggaauu

SEQ ID NO: 656829 - RNA, 19 nt, Homo sapiens
gugaauacuaguggaauug

SEQ ID NO: 656830 - RNA, 19 nt, Homo sapiens
guaguccauucuugcuaau

SEQ ID NO: 656831 - RNA, 19 nt, Homo sapiens
gccuuaaaguaguccauuc

SEQ ID NO: 656832 - RNA, 19 nt, Homo sapiens
ggcugaagcaggccaaaga

SEQ ID NO: 656833 - RNA, 19 nt, Homo sapiens
cgccauggcuagucagucu

SEQ ID NO: 656834 - RNA, 19 nt, Homo sapiens
gguguaucgauaaucauuu

SEQ ID NO: 656835 - RNA, 19 nt, Homo sapiens
cuuagcacagcucuaguua

SEQ ID NO: 656836 - RNA, 19 nt, Homo sapiens
uguauuacuugguguaucg

SEQ ID NO: 656837 - RNA, 19 nt, Homo sapiens
gcagcagccagccuuaaag

SEQ ID NO: 656838 - RNA, 19 nt, Homo sapiens
ccucuuggcuuuugucugu

SEQ ID NO: 656839 - RNA, 19 nt, Homo sapiens
ggucaggggcuuuaucuau

SEQ ID NO: 656840 - RNA, 19 nt, Homo sapiens
gcaacauguauaucagugu

SEQ ID NO: 656841 - RNA, 19 nt, Homo sapiens
gaauuguuugggcugcuuu

SEQ ID NO: 656842 - RNA, 19 nt, Homo sapiens
aagaaaggaagggauuaaa

SEQ ID NO: 656843 - RNA, 19 nt, Homo sapiens
cuaacacuuucuugaaggu

SEQ ID NO: 656844 - RNA, 19 nt, Homo sapiens
cccuaacacuuucuugaag

SEQ ID NO: 656845 - RNA, 19 nt, Homo sapiens
cagcucuaguuacauucuu

SEQ ID NO: 656846 - RNA, 19 nt, Homo sapiens
aaacuaccgcauaaaugga

SEQ ID NO: 656847 - RNA, 19 nt, Homo sapiens
gacaaccucuuggcuuuug

SEQ ID NO: 656848 - RNA, 19 nt, Homo sapiens
auuacuugguguaucgaua

SEQ ID NO: 656849 - RNA, 19 nt, Homo sapiens
gcucuaguuacauucuuau

SEQ ID NO: 656850 - RNA, 19 nt, Homo sapiens
cagcagccagccuuaaagu

SEQ ID NO: 656851 - RNA, 19 nt, Homo sapiens
ggcucaagcaacauguaua

SEQ ID NO: 656852 - RNA, 19 nt, Homo sapiens
agaauucaaggccaaggaa

SEQ ID NO: 656853 - RNA, 19 nt, Homo sapiens
agcucuaguuacauucuua

SEQ ID NO: 656854 - RNA, 19 nt, Homo sapiens
agaaauccaugaaaacuac

SEQ ID NO: 656855 - RNA, 19 nt, Homo sapiens
gaacacaaucucaaucguu

SEQ ID NO: 656856 - RNA, 19 nt, Homo sapiens
ggaacacaaucucaaucgu

SEQ ID NO: 656857 - RNA, 19 nt, Homo sapiens
gggagcaucucggggauua

SEQ ID NO: 656858 - RNA, 19 nt, Homo sapiens
uacaacaaguacaucaaug

SEQ ID NO: 656859 - RNA, 19 nt, Homo sapiens
caugcuacgugcucuuuag

SEQ ID NO: 656860 - RNA, 19 nt, Homo sapiens
uuucggagcguuucaaaga

SEQ ID NO: 656861 - RNA, 19 nt, Homo sapiens
gcucuuuagcuacuccuuu

SEQ ID NO: 656862 - RNA, 19 nt, Homo sapiens
gcaugcuacgugcucuuua

SEQ ID NO: 656863 - RNA, 19 nt, Homo sapiens
cuacaacaaguacaucaau

SEQ ID NO: 656864 - RNA, 19 nt, Homo sapiens
gaggaacacaaucucaauc

SEQ ID NO: 656865 - RNA, 19 nt, Homo sapiens
guuacuaccgguacuacaa

SEQ ID NO: 656866 - RNA, 19 nt, Homo sapiens
gagcguuucaaagagguua

SEQ ID NO: 656867 - RNA, 19 nt, Homo sapiens
ggcgucaguuggugagugu

SEQ ID NO: 656868 - RNA, 19 nt, Homo sapiens
cuucaguccuaguggcauu

SEQ ID NO: 656869 - RNA, 19 nt, Homo sapiens
ucucaaucguugcugaauc

SEQ ID NO: 656870 - RNA, 19 nt, Homo sapiens
gagguuacuaccgguacua

SEQ ID NO: 656871 - RNA, 19 nt, Homo sapiens
gcggacaccaggacuccaa

SEQ ID NO: 656872 - RNA, 19 nt, Homo sapiens
caguaccagugaaggacaa

SEQ ID NO: 656873 - RNA, 19 nt, Homo sapiens
ggcaugcuacgugcucuuu

SEQ ID NO: 656874 - RNA, 19 nt, Homo sapiens
agaaggaggugucagauuu

SEQ ID NO: 656875 - RNA, 19 nt, Homo sapiens
ggaaguggcuggccugaca

SEQ ID NO: 656876 - RNA, 19 nt, Homo sapiens
agacaaggcugcugcuauu

SEQ ID NO: 656877 - RNA, 19 nt, Homo sapiens
gaugaugacugucgcuaug

SEQ ID NO: 656878 - RNA, 19 nt, Homo sapiens
gagaggagcauacuacaug

SEQ ID NO: 656879 - RNA, 19 nt, Homo sapiens
ggacacacgcuccauugaa

SEQ ID NO: 656880 - RNA, 19 nt, Homo sapiens
gcaagagaaacaacagaaa

SEQ ID NO: 656881 - RNA, 19 nt, Homo sapiens
ggaggugucagauuucauu

SEQ ID NO: 656882 - RNA, 19 nt, Homo sapiens
caaggcugcugcuauuaga

SEQ ID NO: 656883 - RNA, 19 nt, Homo sapiens
ggugucagauuucauucaa

SEQ ID NO: 656884 - RNA, 19 nt, Homo sapiens
gaagaaacuacaagagcaa

SEQ ID NO: 656885 - RNA, 19 nt, Homo sapiens
guaaaaggauggagaagga

SEQ ID NO: 656886 - RNA, 19 nt, Homo sapiens
gcacagguggguauuuaau

SEQ ID NO: 656887 - RNA, 19 nt, Homo sapiens
caaagacgcagcccacaug

SEQ ID NO: 656888 - RNA, 19 nt, Homo sapiens
ugucagauuucauucaaga

SEQ ID NO: 656889 - RNA, 19 nt, Homo sapiens
uugaagaggcuaugaauga

SEQ ID NO: 656890 - RNA, 19 nt, Homo sapiens
gacacacgcuccauugaag

SEQ ID NO: 656891 - RNA, 19 nt, Homo sapiens
gagaaggaggugucagauu

SEQ ID NO: 656892 - RNA, 19 nt, Homo sapiens
gaagaggcuaugaaugaga

SEQ ID NO: 656893 - RNA, 19 nt, Homo sapiens
ccagaaggcugaggagaag

SEQ ID NO: 656894 - RNA, 19 nt, Homo sapiens
gagacaaggcugcugcuau

SEQ ID NO: 656895 - RNA, 19 nt, Homo sapiens
caagauggcggaccuacug

SEQ ID NO: 656896 - RNA, 19 nt, Homo sapiens
augcacagguggguauuua

SEQ ID NO: 656897 - RNA, 19 nt, Homo sapiens
gcaagggagcagccaaaga

SEQ ID NO: 656898 - RNA, 19 nt, Homo sapiens
gaaggaggugucagauuuc

SEQ ID NO: 656899 - RNA, 19 nt, Homo sapiens
agacgcagcccacaugcua

SEQ ID NO: 656900 - RNA, 19 nt, Homo sapiens
gcgacuacaaggacaagua

SEQ ID NO: 656901 - RNA, 19 nt, Homo sapiens
caagagaaacaacagaaag

SEQ ID NO: 656902 - RNA, 19 nt, Homo sapiens
gcuaugucaugaucuucaa

SEQ ID NO: 656903 - RNA, 19 nt, Homo sapiens
cguuggagcuuggauaugu

SEQ ID NO: 656904 - RNA, 19 nt, Homo sapiens
gacaaggcugcugcuauua

SEQ ID NO: 656905 - RNA, 19 nt, Homo sapiens
ugacauccuucuccuuugg

SEQ ID NO: 656906 - RNA, 19 nt, Homo sapiens
guggguauuuaaucuguau

SEQ ID NO: 656907 - RNA, 19 nt, Homo sapiens
gacugucgcuaugucauga

SEQ ID NO: 656908 - RNA, 19 nt, Homo sapiens
ccugacauccuucuccuuu

SEQ ID NO: 656909 - RNA, 19 nt, Homo sapiens
agaggagcauacuacauga

SEQ ID NO: 656910 - RNA, 19 nt, Homo sapiens
caagggagcagccaaagac

SEQ ID NO: 656911 - RNA, 19 nt, Homo sapiens
gagcaagagaaacaacaga

SEQ ID NO: 656912 - RNA, 19 nt, Homo sapiens
aaaguggaguuucguaaaa

SEQ ID NO: 656913 - RNA, 19 nt, Homo sapiens
gguggguauuuaaucugua

SEQ ID NO: 656914 - RNA, 19 nt, Homo sapiens
acagguggguauuuaaucu

SEQ ID NO: 656915 - RNA, 19 nt, Homo sapiens
gaucgagaggagcauacua

SEQ ID NO: 656916 - RNA, 19 nt, Homo sapiens
acagugggcagaucaagaa

SEQ ID NO: 656917 - RNA, 19 nt, Homo sapiens
uacaagagcaagagaaaca

SEQ ID NO: 656918 - RNA, 19 nt, Homo sapiens
caagaucgagaggagcaua

SEQ ID NO: 656919 - RNA, 19 nt, Homo sapiens
caagacagugggcagauca

SEQ ID NO: 656920 - RNA, 19 nt, Homo sapiens
acagguguuugauuuguca

SEQ ID NO: 656921 - RNA, 19 nt, Homo sapiens
ugaagaggcuaugaaugag

SEQ ID NO: 656922 - RNA, 19 nt, Homo sapiens
gagggacacacgcuccauu

SEQ ID NO: 656923 - RNA, 19 nt, Homo sapiens
gaaacuacaagagcaagag

SEQ ID NO: 656924 - RNA, 19 nt, Homo sapiens
ggaguuugcacccucagau

SEQ ID NO: 656925 - RNA, 19 nt, Homo sapiens
ugaaugcacagguggguau

SEQ ID NO: 656926 - RNA, 19 nt, Homo sapiens
aagaggcuaugaaugagau

SEQ ID NO: 656927 - RNA, 19 nt, Homo sapiens
uggcuggccugacauccuu

SEQ ID NO: 656928 - RNA, 19 nt, Homo sapiens
gacagugggcagaucaaga

SEQ ID NO: 656929 - RNA, 19 nt, Homo sapiens
gggacacacgcuccauuga

SEQ ID NO: 656930 - RNA, 19 nt, Homo sapiens
gugugcccguggccaauaa

SEQ ID NO: 656931 - RNA, 19 nt, Homo sapiens
acccucagaugaagagcua

SEQ ID NO: 656932 - RNA, 19 nt, Homo sapiens
caaguacagccaccucauc

SEQ ID NO: 656933 - RNA, 19 nt, Homo sapiens
ggagaaggaggugucagau

SEQ ID NO: 656934 - RNA, 19 nt, Homo sapiens
gugcguggcaugugugugu

SEQ ID NO: 656935 - RNA, 19 nt, Homo sapiens
ucaagacagugggcagauc

SEQ ID NO: 656936 - RNA, 19 nt, Homo sapiens
ggcuaugaaugagaucaga

SEQ ID NO: 656937 - RNA, 19 nt, Homo sapiens
ccauugaagaggcuaugaa

SEQ ID NO: 656938 - RNA, 19 nt, Homo sapiens
cccagaaggcugaggagaa

SEQ ID NO: 656939 - RNA, 19 nt, Homo sapiens
ggauaugugcguggcaugu

SEQ ID NO: 656940 - RNA, 19 nt, Homo sapiens
cauugaagaggcuaugaau

SEQ ID NO: 656941 - RNA, 19 nt, Homo sapiens
ccaaagacgcagcccacau

SEQ ID NO: 656942 - RNA, 19 nt, Homo sapiens
ucagauuucauucaagaca

SEQ ID NO: 656943 - RNA, 19 nt, Homo sapiens
aagagaaacaacagaaagu

SEQ ID NO: 656944 - RNA, 19 nt, Homo sapiens
gaguuugcacccucagaug

SEQ ID NO: 656945 - RNA, 19 nt, Homo sapiens
aaacuacaagagcaagaga

SEQ ID NO: 656946 - RNA, 19 nt, Homo sapiens
aaggaggugucagauuuca

SEQ ID NO: 656947 - RNA, 19 nt, Homo sapiens
uggagaaggaggugucaga

SEQ ID NO: 656948 - RNA, 19 nt, Homo sapiens
acaaggcugcugcuauuag

SEQ ID NO: 656949 - RNA, 19 nt, Homo sapiens
acuacaagagcaagagaaa

SEQ ID NO: 656950 - RNA, 19 nt, Homo sapiens
gaaauccuguagcguguaa

SEQ ID NO: 656951 - RNA, 19 nt, Homo sapiens
gaaauggcauggaaucacu

SEQ ID NO: 656952 - RNA, 19 nt, Homo sapiens
ggaaaacaaugcagugaaa

SEQ ID NO: 656953 - RNA, 19 nt, Homo sapiens
aaaauacgcucccuuuaaa

SEQ ID NO: 656954 - RNA, 19 nt, Homo sapiens
uuuaaacgguggauugaaa

SEQ ID NO: 656955 - RNA, 19 nt, Homo sapiens
gaaaguucuucauauuagg

SEQ ID NO: 656956 - RNA, 19 nt, Homo sapiens
ugaaggccauugugaagga

SEQ ID NO: 656957 - RNA, 19 nt, Homo sapiens
ggacagguuucugcuucaa

SEQ ID NO: 656958 - RNA, 19 nt, Homo sapiens
aagaggaaauggcauggaa

SEQ ID NO: 656959 - RNA, 19 nt, Homo sapiens
gcauuaugauccaguugug

SEQ ID NO: 656960 - RNA, 19 nt, Homo sapiens
aaacaaugcagugaaagaa

SEQ ID NO: 656961 - RNA, 19 nt, Homo sapiens
acaaugcagugaaagaaag

SEQ ID NO: 656962 - RNA, 19 nt, Homo sapiens
gaaggccauugugaaggaa

SEQ ID NO: 656963 - RNA, 19 nt, Homo sapiens
gauuugaaggccauuguga

SEQ ID NO: 656964 - RNA, 19 nt, Homo sapiens
gaggaaauggcauggaauc

SEQ ID NO: 656965 - RNA, 19 nt, Homo sapiens
gcgaagcugggacagguuu

SEQ ID NO: 656966 - RNA, 19 nt, Homo sapiens
cuucauauuaggacagaua

SEQ ID NO: 656967 - RNA, 19 nt, Homo sapiens
gggacagguuucugcuuca

SEQ ID NO: 656968 - RNA, 19 nt, Homo sapiens
gaagaggaaauggcaugga

SEQ ID NO: 656969 - RNA, 19 nt, Homo sapiens
gaaaccgacugcgggaaaa

SEQ ID NO: 656970 - RNA, 19 nt, Homo sapiens
uaggacagauaucauugca

SEQ ID NO: 656971 - RNA, 19 nt, Homo sapiens
acagguuucugcuucaaca

SEQ ID NO: 656972 - RNA, 19 nt, Homo sapiens
agaaaccgacugcgggaaa

SEQ ID NO: 656973 - RNA, 19 nt, Homo sapiens
ccucuccgcggucuucuuu

SEQ ID NO: 656974 - RNA, 19 nt, Homo sapiens
ggaaauggcauggaaucac

SEQ ID NO: 656975 - RNA, 19 nt, Homo sapiens
gcuucaacaccaagagaaa

SEQ ID NO: 656976 - RNA, 19 nt, Homo sapiens
aauccuguagcguguaaua

SEQ ID NO: 656977 - RNA, 19 nt, Homo sapiens
ggauugaaaaugacuuuga

SEQ ID NO: 656978 - RNA, 19 nt, Homo sapiens
aacaaugcagugaaagaaa

SEQ ID NO: 656979 - RNA, 19 nt, Homo sapiens
gaaauccuguagcguguaa

SEQ ID NO: 656980 - RNA, 19 nt, Homo sapiens
gaaauggcauggaaucacu

SEQ ID NO: 656981 - RNA, 19 nt, Homo sapiens
ggaaaacaaugcagugaaa

SEQ ID NO: 656982 - RNA, 19 nt, Homo sapiens
gcaagucaaaugaaacaaa

SEQ ID NO: 656983 - RNA, 19 nt, Homo sapiens
aaaauacgcucccuuuaaa

SEQ ID NO: 656984 - RNA, 19 nt, Homo sapiens
caagucaaaugaaacaaag

SEQ ID NO: 656985 - RNA, 19 nt, Homo sapiens
uuuaaacgguggauugaaa

SEQ ID NO: 656986 - RNA, 19 nt, Homo sapiens
gaaaguucuucauauuagg

SEQ ID NO: 656987 - RNA, 19 nt, Homo sapiens
ugaaggccauugugaagga

SEQ ID NO: 656988 - RNA, 19 nt, Homo sapiens
aagagcaagucaaaugaaa

SEQ ID NO: 656989 - RNA, 19 nt, Homo sapiens
gccaagagcaagucaaaug

SEQ ID NO: 656990 - RNA, 19 nt, Homo sapiens
aagaggaaauggcauggaa

SEQ ID NO: 656991 - RNA, 19 nt, Homo sapiens
gagcaagucaaaugaaaca

SEQ ID NO: 656992 - RNA, 19 nt, Homo sapiens
ccaagagcaagucaaauga

SEQ ID NO: 656993 - RNA, 19 nt, Homo sapiens
caagagcaagucaaaugaa

SEQ ID NO: 656994 - RNA, 19 nt, Homo sapiens
aaacaaugcagugaaagaa

SEQ ID NO: 656995 - RNA, 19 nt, Homo sapiens
acaaugcagugaaagaaag

SEQ ID NO: 656996 - RNA, 19 nt, Homo sapiens
gaaggccauugugaaggaa

SEQ ID NO: 656997 - RNA, 19 nt, Homo sapiens
gauuugaaggccauuguga

SEQ ID NO: 656998 - RNA, 19 nt, Homo sapiens
gaggaaauggcauggaauc

SEQ ID NO: 656999 - RNA, 19 nt, Homo sapiens
cuucauauuaggacagaua

SEQ ID NO: 657000 - RNA, 19 nt, Homo sapiens
gaagaggaaauggcaugga

SEQ ID NO: 657001 - RNA, 19 nt, Homo sapiens
uaggacagauaucauugca

SEQ ID NO: 657002 - RNA, 19 nt, Homo sapiens
ccucuccgcggucuucuuu

SEQ ID NO: 657003 - RNA, 19 nt, Homo sapiens
ggaaauggcauggaaucac

SEQ ID NO: 657004 - RNA, 19 nt, Homo sapiens
aauccuguagcguguaaua

SEQ ID NO: 657005 - RNA, 19 nt, Homo sapiens
ggauugaaaaugacuuuga

SEQ ID NO: 657006 - RNA, 19 nt, Homo sapiens
aacaaugcagugaaagaaa

SEQ ID NO: 657007 - RNA, 19 nt, Homo sapiens
ccaagaagcucuacauuga

SEQ ID NO: 657008 - RNA, 19 nt, Homo sapiens
gaaagaaggugcccacugu

SEQ ID NO: 657009 - RNA, 19 nt, Homo sapiens
cuaaagaccuugcaagaaa

SEQ ID NO: 657010 - RNA, 19 nt, Homo sapiens
gaaaagagaugcccugaaa

SEQ ID NO: 657011 - RNA, 19 nt, Homo sapiens
aaacaagacuccaguaugu

SEQ ID NO: 657012 - RNA, 19 nt, Homo sapiens
uaaugaagcuuaacccuau

SEQ ID NO: 657013 - RNA, 19 nt, Homo sapiens
aaacugagcucacagagau

SEQ ID NO: 657014 - RNA, 19 nt, Homo sapiens
uuauagcacuccuugauua

SEQ ID NO: 657015 - RNA, 19 nt, Homo sapiens
acagagauguguauuagaa

SEQ ID NO: 657016 - RNA, 19 nt, Homo sapiens
cacaauugcuuuaggguaa

SEQ ID NO: 657017 - RNA, 19 nt, Homo sapiens
caucaacacugaauugcaa

SEQ ID NO: 657018 - RNA, 19 nt, Homo sapiens
gcagcuggaucuccgguaa

SEQ ID NO: 657019 - RNA, 19 nt, Homo sapiens
cuaagcaacucuuucgaaa

SEQ ID NO: 657020 - RNA, 19 nt, Homo sapiens
gaagaaaucuaggcuccau

SEQ ID NO: 657021 - RNA, 19 nt, Homo sapiens
gccgggaccuucaacagua

SEQ ID NO: 657022 - RNA, 19 nt, Homo sapiens
gggaauaguagauuguuaa

SEQ ID NO: 657023 - RNA, 19 nt, Homo sapiens
gcacucagaauuugaugaa

SEQ ID NO: 657024 - RNA, 19 nt, Homo sapiens
gaacuucugcccucuaaag

SEQ ID NO: 657025 - RNA, 19 nt, Homo sapiens
uagaagauuugcacucaga

SEQ ID NO: 657026 - RNA, 19 nt, Homo sapiens
gaacccaguagguguauau

SEQ ID NO: 657027 - RNA, 19 nt, Homo sapiens
ucugguggcugugaaauaa

SEQ ID NO: 657028 - RNA, 19 nt, Homo sapiens
gauuugcacucagaauuug

SEQ ID NO: 657029 - RNA, 19 nt, Homo sapiens
ugccaagccauauauauua

SEQ ID NO: 657030 - RNA, 19 nt, Homo sapiens
gaaacugagcucacagaga

SEQ ID NO: 657031 - RNA, 19 nt, Homo sapiens
uaacugagacauaggguau

SEQ ID NO: 657032 - RNA, 19 nt, Homo sapiens
gcugugaaauaaugaauac

SEQ ID NO: 657033 - RNA, 19 nt, Homo sapiens
gaucaugguggccaauauu

SEQ ID NO: 657034 - RNA, 19 nt, Homo sapiens
uagcacuccuugauuaaga

SEQ ID NO: 657035 - RNA, 19 nt, Homo sapiens
gacauaggguauaacuguu

SEQ ID NO: 657036 - RNA, 19 nt, Homo sapiens
ggaucaugguggccaauau

SEQ ID NO: 657037 - RNA, 19 nt, Homo sapiens
aaucuaggcuccaucaaca

SEQ ID NO: 657038 - RNA, 19 nt, Homo sapiens
acacugaauugcaagaugu

SEQ ID NO: 657039 - RNA, 19 nt, Homo sapiens
uaaacaagacuccaguaug

SEQ ID NO: 657040 - RNA, 19 nt, Homo sapiens
gcuaagcaacucuuucgaa

SEQ ID NO: 657041 - RNA, 19 nt, Homo sapiens
agacauaggguauaacugu

SEQ ID NO: 657042 - RNA, 19 nt, Homo sapiens
gagaugcccugaaaaugaa

SEQ ID NO: 657043 - RNA, 19 nt, Homo sapiens
caagaaauaccgccaggau

SEQ ID NO: 657044 - RNA, 19 nt, Homo sapiens
gaagcacucucagcauugg

SEQ ID NO: 657045 - RNA, 19 nt, Homo sapiens
ccuagaagauuugcacuca

SEQ ID NO: 657046 - RNA, 19 nt, Homo sapiens
uccaguaugugaagguuaa

SEQ ID NO: 657047 - RNA, 19 nt, Homo sapiens
gugccaagccauauauauu

SEQ ID NO: 657048 - RNA, 19 nt, Homo sapiens
gugaagaugguguugcuaa

SEQ ID NO: 657049 - RNA, 19 nt, Homo sapiens
gccaagccauauauauuag

SEQ ID NO: 657050 - RNA, 19 nt, Homo sapiens
gcuuaacccuauguagaaa

SEQ ID NO: 657051 - RNA, 19 nt, Homo sapiens
ucucagcauuggauucaaa

SEQ ID NO: 657052 - RNA, 19 nt, Homo sapiens
ugacagucgugcucgaaga

SEQ ID NO: 657053 - RNA, 19 nt, Homo sapiens
uggaacuucugcccucuaa

SEQ ID NO: 657054 - RNA, 19 nt, Homo sapiens
ugccaaacuugcagcagua

SEQ ID NO: 657055 - RNA, 19 nt, Homo sapiens
uaccagauguaccuuggaa

SEQ ID NO: 657056 - RNA, 19 nt, Homo sapiens
gagccaucaaugagauuua

SEQ ID NO: 657057 - RNA, 19 nt, Homo sapiens
gguaagggagaaccuagaa

SEQ ID NO: 657058 - RNA, 19 nt, Homo sapiens
aagaagcucuacauugaca

SEQ ID NO: 657059 - RNA, 19 nt, Homo sapiens
gaagauuugcacucagaau

SEQ ID NO: 657060 - RNA, 19 nt, Homo sapiens
uugccuaccuagaagauuu

SEQ ID NO: 657061 - RNA, 19 nt, Homo sapiens
aauaguguauguccgauuc

SEQ ID NO: 657062 - RNA, 19 nt, Homo sapiens
uguccagucuguccaagaa

SEQ ID NO: 657063 - RNA, 19 nt, Homo sapiens
ucccgacccuauuccuuua

SEQ ID NO: 657064 - RNA, 19 nt, Homo sapiens
gaugcgaaguacuugaaca

SEQ ID NO: 657065 - RNA, 19 nt, Homo sapiens
gcguuccacuuaugccaaa

SEQ ID NO: 657066 - RNA, 19 nt, Homo sapiens
acugagacauaggguauaa

SEQ ID NO: 657067 - RNA, 19 nt, Homo sapiens
acaagacuccaguauguga

SEQ ID NO: 657068 - RNA, 19 nt, Homo sapiens
agggaauaguagauuguua

SEQ ID NO: 657069 - RNA, 19 nt, Homo sapiens
gacccuauuccuuuauuga

SEQ ID NO: 657070 - RNA, 19 nt, Homo sapiens
aagcuuaacccuauguaga

SEQ ID NO: 657071 - RNA, 19 nt, Homo sapiens
agagauguguauuagaauc

SEQ ID NO: 657072 - RNA, 19 nt, Homo sapiens
cccaguagguguauauuuu

SEQ ID NO: 657073 - RNA, 19 nt, Homo sapiens
gcaggaggacgaacagucu

SEQ ID NO: 657074 - RNA, 19 nt, Homo sapiens
gguggccaauauugaagaa

SEQ ID NO: 657075 - RNA, 19 nt, Homo sapiens
acucagaauuugaugaaca

SEQ ID NO: 657076 - RNA, 19 nt, Homo sapiens
aagcaggagccaugacuuu

SEQ ID NO: 657077 - RNA, 19 nt, Homo sapiens
gcauucucauucucugaug

SEQ ID NO: 657078 - RNA, 19 nt, Homo sapiens
uaaagaccuugcaagaaaa

SEQ ID NO: 657079 - RNA, 19 nt, Homo sapiens
caagaugugcagaggauca

SEQ ID NO: 657080 - RNA, 19 nt, Homo sapiens
agauuugcacucagaauuu

SEQ ID NO: 657081 - RNA, 19 nt, Homo sapiens
uauagcacuccuugauuaa

SEQ ID NO: 657082 - RNA, 19 nt, Homo sapiens
gagaaccuagaacccagua

SEQ ID NO: 657083 - RNA, 19 nt, Homo sapiens
ccagucuguccaagaaaua

SEQ ID NO: 657084 - RNA, 19 nt, Homo sapiens
ggccaauauugaagaagug

SEQ ID NO: 657085 - RNA, 19 nt, Homo sapiens
gaagcaggagccaugacuu

SEQ ID NO: 657086 - RNA, 19 nt, Homo sapiens
gcuuuaggguaagugaauu

SEQ ID NO: 657087 - RNA, 19 nt, Homo sapiens
cauaggguauaacuguugu

SEQ ID NO: 657088 - RNA, 19 nt, Homo sapiens
cuagaacccaguaggugua

SEQ ID NO: 657089 - RNA, 19 nt, Homo sapiens
ugaagaaguguuacaacga

SEQ ID NO: 657090 - RNA, 19 nt, Homo sapiens
caugguggccaauauugaa

SEQ ID NO: 657091 - RNA, 19 nt, Homo sapiens
ugaacagcauggaaagaag

SEQ ID NO: 657092 - RNA, 19 nt, Homo sapiens
agaauuugaugaacagcau

SEQ ID NO: 657093 - RNA, 19 nt, Homo sapiens
ggaucccuguaguuuguga

SEQ ID NO: 657094 - RNA, 19 nt, Homo sapiens
agccaucaaugagauuuaa

SEQ ID NO: 657095 - RNA, 19 nt, Homo sapiens
gauucaaaggcuaacaauu

SEQ ID NO: 657096 - RNA, 19 nt, Homo sapiens
cgacccuauuccuuuauug

SEQ ID NO: 657097 - RNA, 19 nt, Homo sapiens
aagcugccuucccuaagaa

SEQ ID NO: 657098 - RNA, 19 nt, Homo sapiens
uuaaacaagacuccaguau

SEQ ID NO: 657099 - RNA, 19 nt, Homo sapiens
uuggugacauuugugauuu

SEQ ID NO: 657100 - RNA, 19 nt, Homo sapiens
gaagcuuaacccuauguag

SEQ ID NO: 657101 - RNA, 19 nt, Homo sapiens
ucuaaagaccuugcaagaa

SEQ ID NO: 657102 - RNA, 19 nt, Homo sapiens
uuggaucccuguaguuugu

SEQ ID NO: 657103 - RNA, 19 nt, Homo sapiens
gccaggaugcgaaguacuu

SEQ ID NO: 657104 - RNA, 19 nt, Homo sapiens
guuggugacauuugugauu

SEQ ID NO: 657105 - RNA, 19 nt, Homo sapiens
uaggcuccaucaacacuga

SEQ ID NO: 657106 - RNA, 19 nt, Homo sapiens
ucucucauuuacuccuuaa

SEQ ID NO: 657107 - RNA, 19 nt, Homo sapiens
gaaacacgcuggagaagaa

SEQ ID NO: 657108 - RNA, 19 nt, Homo sapiens
gaagaagccuguaucuaaa

SEQ ID NO: 657109 - RNA, 19 nt, Homo sapiens
caacuaggcugagcaauga

SEQ ID NO: 657110 - RNA, 19 nt, Homo sapiens
agaagaagccuguaucuaa

SEQ ID NO: 657111 - RNA, 19 nt, Homo sapiens
ugaaggccaucuccaguua

SEQ ID NO: 657112 - RNA, 19 nt, Homo sapiens
gaaccggugugcucacuga

SEQ ID NO: 657113 - RNA, 19 nt, Homo sapiens
gccagaagcugaaccuuau

SEQ ID NO: 657114 - RNA, 19 nt, Homo sapiens
gcacugauaguuggcauua

SEQ ID NO: 657115 - RNA, 19 nt, Homo sapiens
gaauuugugugaguugauu

SEQ ID NO: 657116 - RNA, 19 nt, Homo sapiens
gaagaaucaugaauuugca

SEQ ID NO: 657117 - RNA, 19 nt, Homo sapiens
ugugugaguugauuuagua

SEQ ID NO: 657118 - RNA, 19 nt, Homo sapiens
gaccgugucugacuuagug

SEQ ID NO: 657119 - RNA, 19 nt, Homo sapiens
ggccagaagcugaaccuua

SEQ ID NO: 657120 - RNA, 19 nt, Homo sapiens
gaagcagggugaagucagu

SEQ ID NO: 657121 - RNA, 19 nt, Homo sapiens
gaaaauaaggcuuugguuu

SEQ ID NO: 657122 - RNA, 19 nt, Homo sapiens
ggaagaagaaguccaccaa

SEQ ID NO: 657123 - RNA, 19 nt, Homo sapiens
aagaagaaguccaccaaga

SEQ ID NO: 657124 - RNA, 19 nt, Homo sapiens
caaggcagguuccagacuu

SEQ ID NO: 657125 - RNA, 19 nt, Homo sapiens
auaagaagcugaaauccau

SEQ ID NO: 657126 - RNA, 19 nt, Homo sapiens
cauaaucaauccuaccaau

SEQ ID NO: 657127 - RNA, 19 nt, Homo sapiens
gcaucuaugugcaggaaau

SEQ ID NO: 657128 - RNA, 19 nt, Homo sapiens
gcauuacuguuguuaagca

SEQ ID NO: 657129 - RNA, 19 nt, Homo sapiens
uguggaagcuguccuggaa

SEQ ID NO: 657130 - RNA, 19 nt, Homo sapiens
ggagcuggcuggcaaugca

SEQ ID NO: 657131 - RNA, 19 nt, Homo sapiens
agaaccagcugcaccaugu

SEQ ID NO: 657132 - RNA, 19 nt, Homo sapiens
ucacaguccucuccaccaa

SEQ ID NO: 657133 - RNA, 19 nt, Homo sapiens
gaaagguggcaaggaguuu

SEQ ID NO: 657134 - RNA, 19 nt, Homo sapiens
uuaaugaaacccugauuga

SEQ ID NO: 657135 - RNA, 19 nt, Homo sapiens
gcuuugguuuccaguuuaa

SEQ ID NO: 657136 - RNA, 19 nt, Homo sapiens
ggcuuugguuuccaguuua

SEQ ID NO: 657137 - RNA, 19 nt, Homo sapiens
gcuuggcccuggcugauga

SEQ ID NO: 657138 - RNA, 19 nt, Homo sapiens
acaauguccucuuccauca

SEQ ID NO: 657139 - RNA, 19 nt, Homo sapiens
gauaagaagcugaaaucca

SEQ ID NO: 657140 - RNA, 19 nt, Homo sapiens
ggaaacacgcuggagaaga

SEQ ID NO: 657141 - RNA, 19 nt, Homo sapiens
ugaggaggauuaacugaag

SEQ ID NO: 657142 - RNA, 19 nt, Homo sapiens
ccaacuaggcugagcaaug

SEQ ID NO: 657143 - RNA, 19 nt, Homo sapiens
ccuaggagauuuuauaguu

SEQ ID NO: 657144 - RNA, 19 nt, Homo sapiens
gaaccagcugcaccaugua

SEQ ID NO: 657145 - RNA, 19 nt, Homo sapiens
gcagacaagugugaagaac

SEQ ID NO: 657146 - RNA, 19 nt, Homo sapiens
ccgaguugcuagcgaagaa

SEQ ID NO: 657147 - RNA, 19 nt, Homo sapiens
aauguccucuuccaucaaa

SEQ ID NO: 657148 - RNA, 19 nt, Homo sapiens
gugauccacuguaauaguc

SEQ ID NO: 657149 - RNA, 19 nt, Homo sapiens
uuaauaaggcaaagcagaa

SEQ ID NO: 657150 - RNA, 19 nt, Homo sapiens
aggcuuugguuuccaguuu

SEQ ID NO: 657151 - RNA, 19 nt, Homo sapiens
gaugauaagaagcugaaau

SEQ ID NO: 657152 - RNA, 19 nt, Homo sapiens
guguuguggugcuuuauug

SEQ ID NO: 657153 - RNA, 19 nt, Homo sapiens
cagaagaagccuguaucua

SEQ ID NO: 657154 - RNA, 19 nt, Homo sapiens
gaaucuguuguccuuaauu

SEQ ID NO: 657155 - RNA, 19 nt, Homo sapiens
ggcccuggcugaugauaag

SEQ ID NO: 657156 - RNA, 19 nt, Homo sapiens
uuugugauccacuguaaua

SEQ ID NO: 657157 - RNA, 19 nt, Homo sapiens
uaauuuagccggcuuugag

SEQ ID NO: 657158 - RNA, 19 nt, Homo sapiens
ccaagucuccaucccagaa

SEQ ID NO: 657159 - RNA, 19 nt, Homo sapiens
gcuaaaaggagucaccaua

SEQ ID NO: 657160 - RNA, 19 nt, Homo sapiens
cguguguuguggugcuuua

SEQ ID NO: 657161 - RNA, 19 nt, Homo sapiens
uauguuagcacugauaguu

SEQ ID NO: 657162 - RNA, 19 nt, Homo sapiens
acaguccucuccaccaaga

SEQ ID NO: 657163 - RNA, 19 nt, Homo sapiens
gaauuugcaacagaccuaa

SEQ ID NO: 657164 - RNA, 19 nt, Homo sapiens
aguguaaccuaggagauuu

SEQ ID NO: 657165 - RNA, 19 nt, Homo sapiens
uggcauuacuguuguuaag

SEQ ID NO: 657166 - RNA, 19 nt, Homo sapiens
gguuuccaguuuaauuguu

SEQ ID NO: 657167 - RNA, 19 nt, Homo sapiens
gcagcgagagacaacaaga

SEQ ID NO: 657168 - RNA, 19 nt, Homo sapiens
gcgagaguauaggcaucua

SEQ ID NO: 657169 - RNA, 19 nt, Homo sapiens
aagcugaaauccauugcau

SEQ ID NO: 657170 - RNA, 19 nt, Homo sapiens
gguggaggccauaaucaau

SEQ ID NO: 657171 - RNA, 19 nt, Homo sapiens
ugaaucagcugcuaaaagg

SEQ ID NO: 657172 - RNA, 19 nt, Homo sapiens
guuguggugcuuuauugua

SEQ ID NO: 657173 - RNA, 19 nt, Homo sapiens
uaggaaacacgcuggagaa

SEQ ID NO: 657174 - RNA, 19 nt, Homo sapiens
ccaagaagcagggugaagu

SEQ ID NO: 657175 - RNA, 19 nt, Homo sapiens
gugaggaggauuaacugaa

SEQ ID NO: 657176 - RNA, 19 nt, Homo sapiens
uagcuaaccgcuuccaugu

SEQ ID NO: 657177 - RNA, 19 nt, Homo sapiens
gcucaucuagggaaaauaa

SEQ ID NO: 657178 - RNA, 19 nt, Homo sapiens
ggccaucuccaguuacuuc

SEQ ID NO: 657179 - RNA, 19 nt, Homo sapiens
ugaauuugcaacagaccua

SEQ ID NO: 657180 - RNA, 19 nt, Homo sapiens
gggagaacagcgucuuuua

SEQ ID NO: 657181 - RNA, 19 nt, Homo sapiens
auaguuggcauuacuguug

SEQ ID NO: 657182 - RNA, 19 nt, Homo sapiens
aaaauccccuucacuccua

SEQ ID NO: 657183 - RNA, 19 nt, Homo sapiens
gcaaugcagcgagagacaa

SEQ ID NO: 657184 - RNA, 19 nt, Homo sapiens
cacagugaaaucaguaauu

SEQ ID NO: 657185 - RNA, 19 nt, Homo sapiens
agaagaaucaugaauuugc

SEQ ID NO: 657186 - RNA, 19 nt, Homo sapiens
gauaguuggcauuacuguu

SEQ ID NO: 657187 - RNA, 19 nt, Homo sapiens
gagguggaggccauaauca

SEQ ID NO: 657188 - RNA, 19 nt, Homo sapiens
ggaauuugugugaguugau

SEQ ID NO: 657189 - RNA, 19 nt, Homo sapiens
cagaagaaucaugaauuug

SEQ ID NO: 657190 - RNA, 19 nt, Homo sapiens
gacuuaguguaaccuagga

SEQ ID NO: 657191 - RNA, 19 nt, Homo sapiens
aaauaaggcuuugguuucc

SEQ ID NO: 657192 - RNA, 19 nt, Homo sapiens
ggugggaccccuuucauuu

SEQ ID NO: 657193 - RNA, 19 nt, Homo sapiens
caagcuggacgccaacuag

SEQ ID NO: 657194 - RNA, 19 nt, Homo sapiens
caagaagcagggugaaguc

SEQ ID NO: 657195 - RNA, 19 nt, Homo sapiens
guuggaagccaucaucaca

SEQ ID NO: 657196 - RNA, 19 nt, Homo sapiens
gauuuaauaaggcaaagca

SEQ ID NO: 657197 - RNA, 19 nt, Homo sapiens
agaaucuguuguccuuaau

SEQ ID NO: 657198 - RNA, 19 nt, Homo sapiens
ccaaugaugaagagcugaa

SEQ ID NO: 657199 - RNA, 19 nt, Homo sapiens
guaauuuagccggcuuuga

SEQ ID NO: 657200 - RNA, 19 nt, Homo sapiens
cagcgagagacaacaagaa

SEQ ID NO: 657201 - RNA, 19 nt, Homo sapiens
cagaagcugaaccuuauuc

SEQ ID NO: 657202 - RNA, 19 nt, Homo sapiens
gcagcggcaggaacgguuu

SEQ ID NO: 657203 - RNA, 19 nt, Homo sapiens
aguuugugauccacuguaa

SEQ ID NO: 657204 - RNA, 19 nt, Homo sapiens
ggugaggaggauuaacuga

SEQ ID NO: 657205 - RNA, 19 nt, Homo sapiens
agaaagguggcaaggaguu

SEQ ID NO: 657206 - RNA, 19 nt, Homo sapiens
cucagaagaaucaugaauu

SEQ ID NO: 657207 - RNA, 19 nt, Homo sapiens
gaaacacgcuggagaagaa

SEQ ID NO: 657208 - RNA, 19 nt, Homo sapiens
gaagaagccuguaucuaaa

SEQ ID NO: 657209 - RNA, 19 nt, Homo sapiens
caacuaggcugagcaauga

SEQ ID NO: 657210 - RNA, 19 nt, Homo sapiens
cuacaucgguggugaagua

SEQ ID NO: 657211 - RNA, 19 nt, Homo sapiens
agaagaagccuguaucuaa

SEQ ID NO: 657212 - RNA, 19 nt, Homo sapiens
ugaaggccaucuccaguua

SEQ ID NO: 657213 - RNA, 19 nt, Homo sapiens
gcacugauaguuggcauua

SEQ ID NO: 657214 - RNA, 19 nt, Homo sapiens
ggccagaaguugcaaguug

SEQ ID NO: 657215 - RNA, 19 nt, Homo sapiens
gacaaacacugacuucuac

SEQ ID NO: 657216 - RNA, 19 nt, Homo sapiens
gaauuugugugaguugauu

SEQ ID NO: 657217 - RNA, 19 nt, Homo sapiens
gaagaaucaugaauuugca

SEQ ID NO: 657218 - RNA, 19 nt, Homo sapiens
cgacaaacacugacuucua

SEQ ID NO: 657219 - RNA, 19 nt, Homo sapiens
ugugugaguugauuuagua

SEQ ID NO: 657220 - RNA, 19 nt, Homo sapiens
gaccgugucugacuuagug

SEQ ID NO: 657221 - RNA, 19 nt, Homo sapiens
gaagcagggugaagucagu

SEQ ID NO: 657222 - RNA, 19 nt, Homo sapiens
gaaaauaaggcuuugguuu

SEQ ID NO: 657223 - RNA, 19 nt, Homo sapiens
ggaagaagaaguccaccaa

SEQ ID NO: 657224 - RNA, 19 nt, Homo sapiens
aagaagaaguccaccaaga

SEQ ID NO: 657225 - RNA, 19 nt, Homo sapiens
auaagaagcugaaauccau

SEQ ID NO: 657226 - RNA, 19 nt, Homo sapiens
gcaucuaugugcaggaaau

SEQ ID NO: 657227 - RNA, 19 nt, Homo sapiens
gcauuacuguuguuaagca

SEQ ID NO: 657228 - RNA, 19 nt, Homo sapiens
uguggaagcuguccuggaa

SEQ ID NO: 657229 - RNA, 19 nt, Homo sapiens
gcccggaaauccaagaaga

SEQ ID NO: 657230 - RNA, 19 nt, Homo sapiens
ggagcuggcuggcaaugca

SEQ ID NO: 657231 - RNA, 19 nt, Homo sapiens
agaaccagcugcaccaugu

SEQ ID NO: 657232 - RNA, 19 nt, Homo sapiens
ucacaguccucuccaccaa

SEQ ID NO: 657233 - RNA, 19 nt, Homo sapiens
gaaagguggcaaggaguuu

SEQ ID NO: 657234 - RNA, 19 nt, Homo sapiens
ggaaauccaagaagaagca

SEQ ID NO: 657235 - RNA, 19 nt, Homo sapiens
uuaaugaaacccugauuga

SEQ ID NO: 657236 - RNA, 19 nt, Homo sapiens
gcuuugguuuccaguuuaa

SEQ ID NO: 657237 - RNA, 19 nt, Homo sapiens
ggcuuugguuuccaguuua

SEQ ID NO: 657238 - RNA, 19 nt, Homo sapiens
gcuuggcccuggcugauga

SEQ ID NO: 657239 - RNA, 19 nt, Homo sapiens
acaauguccucuuccauca

SEQ ID NO: 657240 - RNA, 19 nt, Homo sapiens
gauaagaagcugaaaucca

SEQ ID NO: 657241 - RNA, 19 nt, Homo sapiens
ggaaacacgcuggagaaga

SEQ ID NO: 657242 - RNA, 19 nt, Homo sapiens
ccaacuaggcugagcaaug

SEQ ID NO: 657243 - RNA, 19 nt, Homo sapiens
gccagaaguugcaaguugu

SEQ ID NO: 657244 - RNA, 19 nt, Homo sapiens
ccuaggagauuuuauaguu

SEQ ID NO: 657245 - RNA, 19 nt, Homo sapiens
gaagaagcagggugaaguc

SEQ ID NO: 657246 - RNA, 19 nt, Homo sapiens
caucgguggugaaguagga

SEQ ID NO: 657247 - RNA, 19 nt, Homo sapiens
gaaccagcugcaccaugua

SEQ ID NO: 657248 - RNA, 19 nt, Homo sapiens
gcagacaagugugaagaac

SEQ ID NO: 657249 - RNA, 19 nt, Homo sapiens
ccgaguugcuagcgaagaa

SEQ ID NO: 657250 - RNA, 19 nt, Homo sapiens
aauguccucuuccaucaaa

SEQ ID NO: 657251 - RNA, 19 nt, Homo sapiens
gugauccacuguaauaguc

SEQ ID NO: 657252 - RNA, 19 nt, Homo sapiens
uuaauaaggcaaagcagaa

SEQ ID NO: 657253 - RNA, 19 nt, Homo sapiens
aggcuuugguuuccaguuu

SEQ ID NO: 657254 - RNA, 19 nt, Homo sapiens
gaugauaagaagcugaaau

SEQ ID NO: 657255 - RNA, 19 nt, Homo sapiens
guguuguggugcuuuauug

SEQ ID NO: 657256 - RNA, 19 nt, Homo sapiens
cagaagaagccuguaucua

SEQ ID NO: 657257 - RNA, 19 nt, Homo sapiens
gaaucuguuguccuuaauu

SEQ ID NO: 657258 - RNA, 19 nt, Homo sapiens
ggcccuggcugaugauaag

SEQ ID NO: 657259 - RNA, 19 nt, Homo sapiens
uuugugauccacuguaaua

SEQ ID NO: 657260 - RNA, 19 nt, Homo sapiens
ccaagucuccaucccagaa

SEQ ID NO: 657261 - RNA, 19 nt, Homo sapiens
gcuaaaaggagucaccaua

SEQ ID NO: 657262 - RNA, 19 nt, Homo sapiens
cguguguuguggugcuuua

SEQ ID NO: 657263 - RNA, 19 nt, Homo sapiens
uauguuagcacugauaguu

SEQ ID NO: 657264 - RNA, 19 nt, Homo sapiens
acaguccucuccaccaaga

SEQ ID NO: 657265 - RNA, 19 nt, Homo sapiens
gcagcgagagacaacaaga

SEQ ID NO: 657266 - RNA, 19 nt, Homo sapiens
gaauuugcaacagaccuaa

SEQ ID NO: 657267 - RNA, 19 nt, Homo sapiens
aguguaaccuaggagauuu

SEQ ID NO: 657268 - RNA, 19 nt, Homo sapiens
uggcauuacuguuguuaag

SEQ ID NO: 657269 - RNA, 19 nt, Homo sapiens
gguuuccaguuuaauuguu

SEQ ID NO: 657270 - RNA, 19 nt, Homo sapiens
ccagaaguugcaaguugua

SEQ ID NO: 657271 - RNA, 19 nt, Homo sapiens
ugaaucagcugcuaaaagg

SEQ ID NO: 657272 - RNA, 19 nt, Homo sapiens
gcgagaguauaggcaucua

SEQ ID NO: 657273 - RNA, 19 nt, Homo sapiens
aagcugaaauccauugcau

SEQ ID NO: 657274 - RNA, 19 nt, Homo sapiens
guuguggugcuuuauugua

SEQ ID NO: 657275 - RNA, 19 nt, Homo sapiens
uaggaaacacgcuggagaa

SEQ ID NO: 657276 - RNA, 19 nt, Homo sapiens
gcucaucuagggaaaauaa

SEQ ID NO: 657277 - RNA, 19 nt, Homo sapiens
ggccaucuccaguuacuuc

SEQ ID NO: 657278 - RNA, 19 nt, Homo sapiens
gcaaugcagcgagagacaa

SEQ ID NO: 657279 - RNA, 19 nt, Homo sapiens
ugaauuugcaacagaccua

SEQ ID NO: 657280 - RNA, 19 nt, Homo sapiens
gggagaacagcgucuuuua

SEQ ID NO: 657281 - RNA, 19 nt, Homo sapiens
auaguuggcauuacuguug

SEQ ID NO: 657282 - RNA, 19 nt, Homo sapiens
aaaauccccuucacuccua

SEQ ID NO: 657283 - RNA, 19 nt, Homo sapiens
gaaguugcaaguuguacag

SEQ ID NO: 657284 - RNA, 19 nt, Homo sapiens
agaagaaucaugaauuugc

SEQ ID NO: 657285 - RNA, 19 nt, Homo sapiens
gauaguuggcauuacuguu

SEQ ID NO: 657286 - RNA, 19 nt, Homo sapiens
ggaauuugugugaguugau

SEQ ID NO: 657287 - RNA, 19 nt, Homo sapiens
cagaagaaucaugaauuug

SEQ ID NO: 657288 - RNA, 19 nt, Homo sapiens
gacuuaguguaaccuagga

SEQ ID NO: 657289 - RNA, 19 nt, Homo sapiens
aaauaaggcuuugguuucc

SEQ ID NO: 657290 - RNA, 19 nt, Homo sapiens
ggugggaccccuuucauuu

SEQ ID NO: 657291 - RNA, 19 nt, Homo sapiens
caagcuggacgccaacuag

SEQ ID NO: 657292 - RNA, 19 nt, Homo sapiens
cgaggagcgcggagagaaa

SEQ ID NO: 657293 - RNA, 19 nt, Homo sapiens
guuggaagccaucaucaca

SEQ ID NO: 657294 - RNA, 19 nt, Homo sapiens
gauuuaauaaggcaaagca

SEQ ID NO: 657295 - RNA, 19 nt, Homo sapiens
aaacacugacuucuacauc

SEQ ID NO: 657296 - RNA, 19 nt, Homo sapiens
ccaaugaugaagagcugaa

SEQ ID NO: 657297 - RNA, 19 nt, Homo sapiens
agaaucuguuguccuuaau

SEQ ID NO: 657298 - RNA, 19 nt, Homo sapiens
cagcgagagacaacaagaa

SEQ ID NO: 657299 - RNA, 19 nt, Homo sapiens
gcagcggcaggaacgguuu

SEQ ID NO: 657300 - RNA, 19 nt, Homo sapiens
aguuugugauccacuguaa

SEQ ID NO: 657301 - RNA, 19 nt, Homo sapiens
agaaagguggcaaggaguu

SEQ ID NO: 657302 - RNA, 19 nt, Homo sapiens
uugccucgaucgacaguga

SEQ ID NO: 657303 - RNA, 19 nt, Homo sapiens
gaaaguuggaagccaucau

SEQ ID NO: 657304 - RNA, 19 nt, Homo sapiens
cucagaagaaucaugaauu

SEQ ID NO: 657305 - RNA, 19 nt, Homo sapiens
aaaauaaggcuuugguuuc

SEQ ID NO: 657306 - RNA, 19 nt, Homo sapiens
ccagaagaagccuguaucu

SEQ ID NO: 657307 - RNA, 19 nt, Homo sapiens
gaaacacgcuggagaagaa

SEQ ID NO: 657308 - RNA, 19 nt, Homo sapiens
gaagaagccuguaucuaaa

SEQ ID NO: 657309 - RNA, 19 nt, Homo sapiens
caacuaggcugagcaauga

SEQ ID NO: 657310 - RNA, 19 nt, Homo sapiens
agaagaagccuguaucuaa

SEQ ID NO: 657311 - RNA, 19 nt, Homo sapiens
ugaaggccaucuccaguua

SEQ ID NO: 657312 - RNA, 19 nt, Homo sapiens
gccagaagcugaaccuuau

SEQ ID NO: 657313 - RNA, 19 nt, Homo sapiens
gcacugauaguuggcauua

SEQ ID NO: 657314 - RNA, 19 nt, Homo sapiens
gaauuugugugaguugauu

SEQ ID NO: 657315 - RNA, 19 nt, Homo sapiens
gaagaaucaugaauuugca

SEQ ID NO: 657316 - RNA, 19 nt, Homo sapiens
ugugugaguugauuuagua

SEQ ID NO: 657317 - RNA, 19 nt, Homo sapiens
gaccgugucugacuuagug

SEQ ID NO: 657318 - RNA, 19 nt, Homo sapiens
ggccagaagcugaaccuua

SEQ ID NO: 657319 - RNA, 19 nt, Homo sapiens
gaagcagggugaagucagu

SEQ ID NO: 657320 - RNA, 19 nt, Homo sapiens
gaaaauaaggcuuugguuu

SEQ ID NO: 657321 - RNA, 19 nt, Homo sapiens
ggaagaagaaguccaccaa

SEQ ID NO: 657322 - RNA, 19 nt, Homo sapiens
aagaagaaguccaccaaga

SEQ ID NO: 657323 - RNA, 19 nt, Homo sapiens
auaagaagcugaaauccau

SEQ ID NO: 657324 - RNA, 19 nt, Homo sapiens
cauaaucaauccuaccaau

SEQ ID NO: 657325 - RNA, 19 nt, Homo sapiens
gcaucuaugugcaggaaau

SEQ ID NO: 657326 - RNA, 19 nt, Homo sapiens
gcauuacuguuguuaagca

SEQ ID NO: 657327 - RNA, 19 nt, Homo sapiens
gcccggaaauccaagaaga

SEQ ID NO: 657328 - RNA, 19 nt, Homo sapiens
ggagcuggcuggcaaugca

SEQ ID NO: 657329 - RNA, 19 nt, Homo sapiens
agaaccagcugcaccaugu

SEQ ID NO: 657330 - RNA, 19 nt, Homo sapiens
ucacaguccucuccaccaa

SEQ ID NO: 657331 - RNA, 19 nt, Homo sapiens
gaaagguggcaaggaguuu

SEQ ID NO: 657332 - RNA, 19 nt, Homo sapiens
ggaaauccaagaagaagca

SEQ ID NO: 657333 - RNA, 19 nt, Homo sapiens
uuaaugaaacccugauuga

SEQ ID NO: 657334 - RNA, 19 nt, Homo sapiens
gcuuugguuuccaguuuaa

SEQ ID NO: 657335 - RNA, 19 nt, Homo sapiens
ggcuuugguuuccaguuua

SEQ ID NO: 657336 - RNA, 19 nt, Homo sapiens
gcuuggcccuggcugauga

SEQ ID NO: 657337 - RNA, 19 nt, Homo sapiens
acaauguccucuuccauca

SEQ ID NO: 657338 - RNA, 19 nt, Homo sapiens
gauaagaagcugaaaucca

SEQ ID NO: 657339 - RNA, 19 nt, Homo sapiens
ggaaacacgcuggagaaga

SEQ ID NO: 657340 - RNA, 19 nt, Homo sapiens
ccaacuaggcugagcaaug

SEQ ID NO: 657341 - RNA, 19 nt, Homo sapiens
ccuaggagauuuuauaguu

SEQ ID NO: 657342 - RNA, 19 nt, Homo sapiens
gaagaagcagggugaaguc

SEQ ID NO: 657343 - RNA, 19 nt, Homo sapiens
gaaccagcugcaccaugua

SEQ ID NO: 657344 - RNA, 19 nt, Homo sapiens
gcagacaagugugaagaac

SEQ ID NO: 657345 - RNA, 19 nt, Homo sapiens
ccgaguugcuagcgaagaa

SEQ ID NO: 657346 - RNA, 19 nt, Homo sapiens
aauguccucuuccaucaaa

SEQ ID NO: 657347 - RNA, 19 nt, Homo sapiens
gugauccacuguaauaguc

SEQ ID NO: 657348 - RNA, 19 nt, Homo sapiens
uuaauaaggcaaagcagaa

SEQ ID NO: 657349 - RNA, 19 nt, Homo sapiens
aggcuuugguuuccaguuu

SEQ ID NO: 657350 - RNA, 19 nt, Homo sapiens
gaugauaagaagcugaaau

SEQ ID NO: 657351 - RNA, 19 nt, Homo sapiens
guguuguggugcuuuauug

SEQ ID NO: 657352 - RNA, 19 nt, Homo sapiens
cagaagaagccuguaucua

SEQ ID NO: 657353 - RNA, 19 nt, Homo sapiens
gaaucuguuguccuuaauu

SEQ ID NO: 657354 - RNA, 19 nt, Homo sapiens
ggcccuggcugaugauaag

SEQ ID NO: 657355 - RNA, 19 nt, Homo sapiens
uuugugauccacuguaaua

SEQ ID NO: 657356 - RNA, 19 nt, Homo sapiens
uaauuuagccggcuuugag

SEQ ID NO: 657357 - RNA, 19 nt, Homo sapiens
ccaagucuccaucccagaa

SEQ ID NO: 657358 - RNA, 19 nt, Homo sapiens
gcuaaaaggagucaccaua

SEQ ID NO: 657359 - RNA, 19 nt, Homo sapiens
cguguguuguggugcuuua

SEQ ID NO: 657360 - RNA, 19 nt, Homo sapiens
uauguuagcacugauaguu

SEQ ID NO: 657361 - RNA, 19 nt, Homo sapiens
acaguccucuccaccaaga

SEQ ID NO: 657362 - RNA, 19 nt, Homo sapiens
gaauuugcaacagaccuaa

SEQ ID NO: 657363 - RNA, 19 nt, Homo sapiens
aguguaaccuaggagauuu

SEQ ID NO: 657364 - RNA, 19 nt, Homo sapiens
uggcauuacuguuguuaag

SEQ ID NO: 657365 - RNA, 19 nt, Homo sapiens
gguuuccaguuuaauuguu

SEQ ID NO: 657366 - RNA, 19 nt, Homo sapiens
gcagcgagagacaacaaga

SEQ ID NO: 657367 - RNA, 19 nt, Homo sapiens
gcgagaguauaggcaucua

SEQ ID NO: 657368 - RNA, 19 nt, Homo sapiens
aagcugaaauccauugcau

SEQ ID NO: 657369 - RNA, 19 nt, Homo sapiens
ugaaucagcugcuaaaagg

SEQ ID NO: 657370 - RNA, 19 nt, Homo sapiens
gguggaggccauaaucaau

SEQ ID NO: 657371 - RNA, 19 nt, Homo sapiens
guuguggugcuuuauugua

SEQ ID NO: 657372 - RNA, 19 nt, Homo sapiens
uaggaaacacgcuggagaa

SEQ ID NO: 657373 - RNA, 19 nt, Homo sapiens
gcucaucuagggaaaauaa

SEQ ID NO: 657374 - RNA, 19 nt, Homo sapiens
ggccaucuccaguuacuuc

SEQ ID NO: 657375 - RNA, 19 nt, Homo sapiens
ugaauuugcaacagaccua

SEQ ID NO: 657376 - RNA, 19 nt, Homo sapiens
gggagaacagcgucuuuua

SEQ ID NO: 657377 - RNA, 19 nt, Homo sapiens
auaguuggcauuacuguug

SEQ ID NO: 657378 - RNA, 19 nt, Homo sapiens
aaaauccccuucacuccua

SEQ ID NO: 657379 - RNA, 19 nt, Homo sapiens
cacagugaaaucaguaauu

SEQ ID NO: 657380 - RNA, 19 nt, Homo sapiens
gcaaugcagcgagagacaa

SEQ ID NO: 657381 - RNA, 19 nt, Homo sapiens
agaagaaucaugaauuugc

SEQ ID NO: 657382 - RNA, 19 nt, Homo sapiens
gauaguuggcauuacuguu

SEQ ID NO: 657383 - RNA, 19 nt, Homo sapiens
gagguggaggccauaauca

SEQ ID NO: 657384 - RNA, 19 nt, Homo sapiens
ggaauuugugugaguugau

SEQ ID NO: 657385 - RNA, 19 nt, Homo sapiens
cagaagaaucaugaauuug

SEQ ID NO: 657386 - RNA, 19 nt, Homo sapiens
gacuuaguguaaccuagga

SEQ ID NO: 657387 - RNA, 19 nt, Homo sapiens
aaauaaggcuuugguuucc

SEQ ID NO: 657388 - RNA, 19 nt, Homo sapiens
ggugggaccccuuucauuu

SEQ ID NO: 657389 - RNA, 19 nt, Homo sapiens
caagcuggacgccaacuag

SEQ ID NO: 657390 - RNA, 19 nt, Homo sapiens
cgaggagcgcggagagaaa

SEQ ID NO: 657391 - RNA, 19 nt, Homo sapiens
guuggaagccaucaucaca

SEQ ID NO: 657392 - RNA, 19 nt, Homo sapiens
gauuuaauaaggcaaagca

SEQ ID NO: 657393 - RNA, 19 nt, Homo sapiens
agaaucuguuguccuuaau

SEQ ID NO: 657394 - RNA, 19 nt, Homo sapiens
ccaaugaugaagagcugaa

SEQ ID NO: 657395 - RNA, 19 nt, Homo sapiens
cagcgagagacaacaagaa

SEQ ID NO: 657396 - RNA, 19 nt, Homo sapiens
guaauuuagccggcuuuga

SEQ ID NO: 657397 - RNA, 19 nt, Homo sapiens
cagaagcugaaccuuauuc

SEQ ID NO: 657398 - RNA, 19 nt, Homo sapiens
gcagcggcaggaacgguuu

SEQ ID NO: 657399 - RNA, 19 nt, Homo sapiens
aguuugugauccacuguaa

SEQ ID NO: 657400 - RNA, 19 nt, Homo sapiens
agaaagguggcaaggaguu

SEQ ID NO: 657401 - RNA, 19 nt, Homo sapiens
cucagaagaaucaugaauu

SEQ ID NO: 657402 - RNA, 19 nt, Homo sapiens
gaaaguuggaagccaucau

SEQ ID NO: 657403 - RNA, 19 nt, Homo sapiens
aaaauaaggcuuugguuuc

SEQ ID NO: 657404 - RNA, 19 nt, Homo sapiens
ccagaagaagccuguaucu

SEQ ID NO: 657405 - RNA, 19 nt, Homo sapiens
gggauccaaaggaaaguug

SEQ ID NO: 657406 - RNA, 19 nt, Homo sapiens
caccuucaguuuaaaagaa

SEQ ID NO: 657407 - RNA, 19 nt, Homo sapiens
ccaagaugcuucaaaguau

SEQ ID NO: 657408 - RNA, 19 nt, Homo sapiens
ggucaucacuaaccagauu

SEQ ID NO: 657409 - RNA, 19 nt, Homo sapiens
cgaguuggcugcagauuug

SEQ ID NO: 657410 - RNA, 19 nt, Homo sapiens
gaaauaauuaccucaguug

SEQ ID NO: 657411 - RNA, 19 nt, Homo sapiens
guacaggacuuggugauca

SEQ ID NO: 657412 - RNA, 19 nt, Homo sapiens
caagaugcuucaaaguauu

SEQ ID NO: 657413 - RNA, 19 nt, Homo sapiens
gccaagaugcuucaaagua

SEQ ID NO: 657414 - RNA, 19 nt, Homo sapiens
gcacucacuuguauucuac

SEQ ID NO: 657415 - RNA, 19 nt, Homo sapiens
guagauaauuugucaugca

SEQ ID NO: 657416 - RNA, 19 nt, Homo sapiens
caggagauuuggauaggaa

SEQ ID NO: 657417 - RNA, 19 nt, Homo sapiens
ggcacucacuuguauucua

SEQ ID NO: 657418 - RNA, 19 nt, Homo sapiens
ucacuaaccagauuuacuu

SEQ ID NO: 657419 - RNA, 19 nt, Homo sapiens
aauccgggcugcugauaaa

SEQ ID NO: 657420 - RNA, 19 nt, Homo sapiens
gcgccaagaugcuucaaag

SEQ ID NO: 657421 - RNA, 19 nt, Homo sapiens
cugaguagauaauuuguca

SEQ ID NO: 657422 - RNA, 19 nt, Homo sapiens
cuaaccagauuuacuugga

SEQ ID NO: 657423 - RNA, 19 nt, Homo sapiens
cacccaucauugugaaaua

SEQ ID NO: 657424 - RNA, 19 nt, Homo sapiens
gaguagauaauuugucaug

SEQ ID NO: 657425 - RNA, 19 nt, Homo sapiens
ccuacuacaccaaaguuua

SEQ ID NO: 657426 - RNA, 19 nt, Homo sapiens
ugaauaaauggaucuguga

SEQ ID NO: 657427 - RNA, 19 nt, Homo sapiens
ggaguacaugugaaagaaa

SEQ ID NO: 657428 - RNA, 19 nt, Homo sapiens
uggaguacaugugaaagaa

SEQ ID NO: 657429 - RNA, 19 nt, Homo sapiens
gagccacccaucauuguga

SEQ ID NO: 657430 - RNA, 19 nt, Homo sapiens
auaauuaccucaguuguac

SEQ ID NO: 657431 - RNA, 19 nt, Homo sapiens
gugaaauaauuaccucagu

SEQ ID NO: 657432 - RNA, 19 nt, Homo sapiens
gaguacaugugaaagaaaa

SEQ ID NO: 657433 - RNA, 19 nt, Homo sapiens
gggcuucaucguuuauaaa

SEQ ID NO: 657434 - RNA, 19 nt, Homo sapiens
uccaggcacucacuuguau

SEQ ID NO: 657435 - RNA, 19 nt, Homo sapiens
cagcaagccguguuagaug

SEQ ID NO: 657436 - RNA, 19 nt, Homo sapiens
gauuuguggugcguucuga

SEQ ID NO: 657437 - RNA, 19 nt, Homo sapiens
gaagcccuacuacaccaaa

SEQ ID NO: 657438 - RNA, 19 nt, Homo sapiens
caaaguuuaccaggagauu

SEQ ID NO: 657439 - RNA, 19 nt, Homo sapiens
gauccaggcacucacuugu

SEQ ID NO: 657440 - RNA, 19 nt, Homo sapiens
acccaucauugugaaauaa

SEQ ID NO: 657441 - RNA, 19 nt, Homo sapiens
ucacugagccacccaucau

SEQ ID NO: 657442 - RNA, 19 nt, Homo sapiens
aacuugauccugcuacuaa

SEQ ID NO: 657443 - RNA, 19 nt, Homo sapiens
gcgcaugcaaucagaaucu

SEQ ID NO: 657444 - RNA, 19 nt, Homo sapiens
ugggcuucaucguuuauaa

SEQ ID NO: 657445 - RNA, 19 nt, Homo sapiens
ccgaguuggcugcagauuu

SEQ ID NO: 657446 - RNA, 19 nt, Homo sapiens
ccaggagauuuggauagga

SEQ ID NO: 657447 - RNA, 19 nt, Homo sapiens
aaacuugauccugcuacua

SEQ ID NO: 657448 - RNA, 19 nt, Homo sapiens
ucaucacuaaccagauuua

SEQ ID NO: 657449 - RNA, 19 nt, Homo sapiens
ggagauuuggauaggaaug

SEQ ID NO: 657450 - RNA, 19 nt, Homo sapiens
uaaacuugauccugcuacu

SEQ ID NO: 657451 - RNA, 19 nt, Homo sapiens
cuacugcucaauaaacguu

SEQ ID NO: 657452 - RNA, 19 nt, Homo sapiens
ggauccaggcacucacuug

SEQ ID NO: 657453 - RNA, 19 nt, Homo sapiens
ucagcaagccguguuagau

SEQ ID NO: 657454 - RNA, 19 nt, Homo sapiens
cuacuacaccaaaguuuac

SEQ ID NO: 657455 - RNA, 19 nt, Homo sapiens
ccaugaagcccuacuacac

SEQ ID NO: 657456 - RNA, 19 nt, Homo sapiens
aaaguuuaccaggagauuu

SEQ ID NO: 657457 - RNA, 19 nt, Homo sapiens
gcccuacuacaccaaaguu

SEQ ID NO: 657458 - RNA, 19 nt, Homo sapiens
aauaaauggaucugugaga

SEQ ID NO: 657459 - RNA, 19 nt, Homo sapiens
aaguuuaccaggagauuug

SEQ ID NO: 657460 - RNA, 19 nt, Homo sapiens
caagacagcuggugccuua

SEQ ID NO: 657461 - RNA, 19 nt, Homo sapiens
gggcagaggugguuuauuu

SEQ ID NO: 657462 - RNA, 19 nt, Homo sapiens
cuacagagcuucccaagaa

SEQ ID NO: 657463 - RNA, 19 nt, Homo sapiens
gagcagagaucaagaggaa

SEQ ID NO: 657464 - RNA, 19 nt, Homo sapiens
caagaggcaucccaacuua

SEQ ID NO: 657465 - RNA, 19 nt, Homo sapiens
gaagacagaaguagugaua

SEQ ID NO: 657466 - RNA, 19 nt, Homo sapiens
gagagacacuuggccauua

SEQ ID NO: 657467 - RNA, 19 nt, Homo sapiens
ggagaaagcuagucaagag

SEQ ID NO: 657468 - RNA, 19 nt, Homo sapiens
ggaagaggcugaacauaag

SEQ ID NO: 657469 - RNA, 19 nt, Homo sapiens
gaagagggccugaagaaga

SEQ ID NO: 657470 - RNA, 19 nt, Homo sapiens
gaaagcaaguguucaucuu

SEQ ID NO: 657471 - RNA, 19 nt, Homo sapiens
agacagaaguagugauaua

SEQ ID NO: 657472 - RNA, 19 nt, Homo sapiens
ccucagaaauugucucuuu

SEQ ID NO: 657473 - RNA, 19 nt, Homo sapiens
gagauuugcuugaaagaug

SEQ ID NO: 657474 - RNA, 19 nt, Homo sapiens
ugaaagaccuagaugcauu

SEQ ID NO: 657475 - RNA, 19 nt, Homo sapiens
gaaacaaagggcaagauuu

SEQ ID NO: 657476 - RNA, 19 nt, Homo sapiens
gaagggccauuucugauuc

SEQ ID NO: 657477 - RNA, 19 nt, Homo sapiens
gaaagcagccuccaaacug

SEQ ID NO: 657478 - RNA, 19 nt, Homo sapiens
gcuggugccuuaagaauug

SEQ ID NO: 657479 - RNA, 19 nt, Homo sapiens
cauaagaccuugucagagu

SEQ ID NO: 657480 - RNA, 19 nt, Homo sapiens
cuugaaagaugcaucauuu

SEQ ID NO: 657481 - RNA, 19 nt, Homo sapiens
caagugaacugcacaaacu

SEQ ID NO: 657482 - RNA, 19 nt, Homo sapiens
gcaaccagcuaauauuuac

SEQ ID NO: 657483 - RNA, 19 nt, Homo sapiens
aagaagaaaugcagagauu

SEQ ID NO: 657484 - RNA, 19 nt, Homo sapiens
caucccaacuuacauauau

SEQ ID NO: 657485 - RNA, 19 nt, Homo sapiens
gaacuuaacagcagcagau

SEQ ID NO: 657486 - RNA, 19 nt, Homo sapiens
ggauucaccuacgcucuua

SEQ ID NO: 657487 - RNA, 19 nt, Homo sapiens
cagcauugcagaagaaaua

SEQ ID NO: 657488 - RNA, 19 nt, Homo sapiens
cagaggaccuugagaaugg

SEQ ID NO: 657489 - RNA, 19 nt, Homo sapiens
agaagcagcugccaagaga

SEQ ID NO: 657490 - RNA, 19 nt, Homo sapiens
gaaagaccuagaugcauuu

SEQ ID NO: 657491 - RNA, 19 nt, Homo sapiens
ggugggaauccaacaauua

SEQ ID NO: 657492 - RNA, 19 nt, Homo sapiens
gccgaucacuccgaaauaa

SEQ ID NO: 657493 - RNA, 19 nt, Homo sapiens
ggaaagagccugccuucag

SEQ ID NO: 657494 - RNA, 19 nt, Homo sapiens
gcaagaggcaucccaacuu

SEQ ID NO: 657495 - RNA, 19 nt, Homo sapiens
ggacaugccacgaaagguu

SEQ ID NO: 657496 - RNA, 19 nt, Homo sapiens
gaagaaagcaaguguucau

SEQ ID NO: 657497 - RNA, 19 nt, Homo sapiens
agaccuagaugcauuugaa

SEQ ID NO: 657498 - RNA, 19 nt, Homo sapiens
aaagcucccugcugcauaa

SEQ ID NO: 657499 - RNA, 19 nt, Homo sapiens
caagagaaggagacucaua

SEQ ID NO: 657500 - RNA, 19 nt, Homo sapiens
gagccugccuucagcaaga

SEQ ID NO: 657501 - RNA, 19 nt, Homo sapiens
uaagauggcagcccuagaa

SEQ ID NO: 657502 - RNA, 19 nt, Homo sapiens
gaacaacugguaaccuuca

SEQ ID NO: 657503 - RNA, 19 nt, Homo sapiens
ucaccaacaugaucauaga

SEQ ID NO: 657504 - RNA, 19 nt, Homo sapiens
gaucacccauauuuguuug

SEQ ID NO: 657505 - RNA, 19 nt, Homo sapiens
gagauuugcuccaggucuu

SEQ ID NO: 657506 - RNA, 19 nt, Homo sapiens
ugacccagauguuggauau

SEQ ID NO: 657507 - RNA, 19 nt, Homo sapiens
uaaaggcaguguucucauc

SEQ ID NO: 657508 - RNA, 19 nt, Homo sapiens
gaaagaagaaaugcagaga

SEQ ID NO: 657509 - RNA, 19 nt, Homo sapiens
ggccauuucugauucuuug

SEQ ID NO: 657510 - RNA, 19 nt, Homo sapiens
ggccgaggaugcucucauu

SEQ ID NO: 657511 - RNA, 19 nt, Homo sapiens
cuaaagagcccaguaagga

SEQ ID NO: 657512 - RNA, 19 nt, Homo sapiens
aggaagaggugggagauuu

SEQ ID NO: 657513 - RNA, 19 nt, Homo sapiens
aggaagaggcugaacauaa

SEQ ID NO: 657514 - RNA, 19 nt, Homo sapiens
cgaaauaaaggcaguguuc

SEQ ID NO: 657515 - RNA, 19 nt, Homo sapiens
gagacacuguggaagaaau

SEQ ID NO: 657516 - RNA, 19 nt, Homo sapiens
agagacacuuggccauuaa

SEQ ID NO: 657517 - RNA, 19 nt, Homo sapiens
cuacuagcauuccuguauu

SEQ ID NO: 657518 - RNA, 19 nt, Homo sapiens
caagaagacagaaguagug

SEQ ID NO: 657519 - RNA, 19 nt, Homo sapiens
acccagagguacugcaaua

SEQ ID NO: 657520 - RNA, 19 nt, Homo sapiens
gcgcuuccauugucagaau

SEQ ID NO: 657521 - RNA, 19 nt, Homo sapiens
gagcaccauggaugaaaua

SEQ ID NO: 657522 - RNA, 19 nt, Homo sapiens
ggagcaccauggaugaaau

SEQ ID NO: 657523 - RNA, 19 nt, Homo sapiens
ccaaaugacccagauguug

SEQ ID NO: 657524 - RNA, 19 nt, Homo sapiens
gaugaaagaccuagaugca

SEQ ID NO: 657525 - RNA, 19 nt, Homo sapiens
gaacucccauccagaacag

SEQ ID NO: 657526 - RNA, 19 nt, Homo sapiens
ccuaugagauuugcuugaa

SEQ ID NO: 657527 - RNA, 19 nt, Homo sapiens
cuugcuaguugcauaauaa

SEQ ID NO: 657528 - RNA, 19 nt, Homo sapiens
gcccagcgcuuccauuguc

SEQ ID NO: 657529 - RNA, 19 nt, Homo sapiens
ggugaagggccauuucuga

SEQ ID NO: 657530 - RNA, 19 nt, Homo sapiens
caacuggaaagaagaaaug

SEQ ID NO: 657531 - RNA, 19 nt, Homo sapiens
ccagcuugcuaguugcaua

SEQ ID NO: 657532 - RNA, 19 nt, Homo sapiens
cuaccaggauauugagaaa

SEQ ID NO: 657533 - RNA, 19 nt, Homo sapiens
uguggagccugaucucuuu

SEQ ID NO: 657534 - RNA, 19 nt, Homo sapiens
uagaagagggccugaagaa

SEQ ID NO: 657535 - RNA, 19 nt, Homo sapiens
cgaggaugcucucauugug

SEQ ID NO: 657536 - RNA, 19 nt, Homo sapiens
auaaacugcuggccucuga

SEQ ID NO: 657537 - RNA, 19 nt, Homo sapiens
uuacagaggcuacagcuau

SEQ ID NO: 657538 - RNA, 19 nt, Homo sapiens
auucaacgcuaccaggaua

SEQ ID NO: 657539 - RNA, 19 nt, Homo sapiens
ggaucacccauauuuguuu

SEQ ID NO: 657540 - RNA, 19 nt, Homo sapiens
ugagaaagaaucugaguca

SEQ ID NO: 657541 - RNA, 19 nt, Homo sapiens
ucuacucccuccucaguuu

SEQ ID NO: 657542 - RNA, 19 nt, Homo sapiens
ccucagauccugucuuuag

SEQ ID NO: 657543 - RNA, 19 nt, Homo sapiens
gaaacccgcugccgaugcu

SEQ ID NO: 657544 - RNA, 19 nt, Homo sapiens
ggaaagcagccuccaaacu

SEQ ID NO: 657545 - RNA, 19 nt, Homo sapiens
gguuuuaacugguauggua

SEQ ID NO: 657546 - RNA, 19 nt, Homo sapiens
gaagaggcugaacauaaga

SEQ ID NO: 657547 - RNA, 19 nt, Homo sapiens
uaaagagcccaguaaggaa

SEQ ID NO: 657548 - RNA, 19 nt, Homo sapiens
gagauacucaaauuugguu

SEQ ID NO: 657549 - RNA, 19 nt, Homo sapiens
ugccagggcucaucgcauu

SEQ ID NO: 657550 - RNA, 19 nt, Homo sapiens
gcuugcuaguugcauaaua

SEQ ID NO: 657551 - RNA, 19 nt, Homo sapiens
gacagcuggugccuuaaga

SEQ ID NO: 657552 - RNA, 19 nt, Homo sapiens
cgaaagguuuuaacuggua

SEQ ID NO: 657553 - RNA, 19 nt, Homo sapiens
ggcagaggugguuuauuua

SEQ ID NO: 657554 - RNA, 19 nt, Homo sapiens
uaggaaagcagccuccaaa

SEQ ID NO: 657555 - RNA, 19 nt, Homo sapiens
gaaauacuacaaggccauu

SEQ ID NO: 657556 - RNA, 19 nt, Homo sapiens
gagcaacuggaaagaagaa

SEQ ID NO: 657557 - RNA, 19 nt, Homo sapiens
caaagcucccugcugcaua

SEQ ID NO: 657558 - RNA, 19 nt, Homo sapiens
gcaagucugcuguccuuca

SEQ ID NO: 657559 - RNA, 19 nt, Homo sapiens
gcgauccgcugagccaaga

SEQ ID NO: 657560 - RNA, 19 nt, Homo sapiens
gauaagcacucagauauau

SEQ ID NO: 657561 - RNA, 19 nt, Homo sapiens
cagaaacaaucgccaaaua

SEQ ID NO: 657562 - RNA, 19 nt, Homo sapiens
ugagaagacugacagauuu

SEQ ID NO: 657563 - RNA, 19 nt, Homo sapiens
gugcaaccaugauguauaa

SEQ ID NO: 657564 - RNA, 19 nt, Homo sapiens
gaaaccugcuguauggaaa

SEQ ID NO: 657565 - RNA, 19 nt, Homo sapiens
gagcagaaguuaugauuuu

SEQ ID NO: 657566 - RNA, 19 nt, Homo sapiens
gagcaucuguucuacaugu

SEQ ID NO: 657567 - RNA, 19 nt, Homo sapiens
aaacauggcaucucaauau

SEQ ID NO: 657568 - RNA, 19 nt, Homo sapiens
guaguaccguuguguguuu

SEQ ID NO: 657569 - RNA, 19 nt, Homo sapiens
gaaacaaucgccaaauaug

SEQ ID NO: 657570 - RNA, 19 nt, Homo sapiens
gcaauguggaguugacuua

SEQ ID NO: 657571 - RNA, 19 nt, Homo sapiens
gcaaccaugauguauaaua

SEQ ID NO: 657572 - RNA, 19 nt, Homo sapiens
gaugauaagcacucagaua

SEQ ID NO: 657573 - RNA, 19 nt, Homo sapiens
cgaacagccugaaauguga

SEQ ID NO: 657574 - RNA, 19 nt, Homo sapiens
gaaaauggcagaaaugaaa

SEQ ID NO: 657575 - RNA, 19 nt, Homo sapiens
gaaauguucguucauguau

SEQ ID NO: 657576 - RNA, 19 nt, Homo sapiens
gaacaccaaggaauuagaa

SEQ ID NO: 657577 - RNA, 19 nt, Homo sapiens
gaucgcaaauacacuaaau

SEQ ID NO: 657578 - RNA, 19 nt, Homo sapiens
cgccaaauaugaaauaaug

SEQ ID NO: 657579 - RNA, 19 nt, Homo sapiens
ugaguaggcugguauuugu

SEQ ID NO: 657580 - RNA, 19 nt, Homo sapiens
gaagauugucuacauauag

SEQ ID NO: 657581 - RNA, 19 nt, Homo sapiens
gaagauggcaaaguagaaa

SEQ ID NO: 657582 - RNA, 19 nt, Homo sapiens
gauuaccucuuauucucua

SEQ ID NO: 657583 - RNA, 19 nt, Homo sapiens
caacagaaacagaaacaau

SEQ ID NO: 657584 - RNA, 19 nt, Homo sapiens
gaagugggcauugaagauu

SEQ ID NO: 657585 - RNA, 19 nt, Homo sapiens
ccaccuauccugauguuaa

SEQ ID NO: 657586 - RNA, 19 nt, Homo sapiens
caguuaaccuuacuuuaug

SEQ ID NO: 657587 - RNA, 19 nt, Homo sapiens
aacacuaucucuucuauga

SEQ ID NO: 657588 - RNA, 19 nt, Homo sapiens
ggaaacagagaacaaacuu

SEQ ID NO: 657589 - RNA, 19 nt, Homo sapiens
uaaccagccucaaauugug

SEQ ID NO: 657590 - RNA, 19 nt, Homo sapiens
guaagugccuauucagagu

SEQ ID NO: 657591 - RNA, 19 nt, Homo sapiens
aaugaaaccugcuguaugg

SEQ ID NO: 657592 - RNA, 19 nt, Homo sapiens
aaugagagaugugaacaaa

SEQ ID NO: 657593 - RNA, 19 nt, Homo sapiens
ugacuuagcuuggcauuuu

SEQ ID NO: 657594 - RNA, 19 nt, Homo sapiens
gaaacagagaacaaacuuu

SEQ ID NO: 657595 - RNA, 19 nt, Homo sapiens
gcuagaacaccaaggaauu

SEQ ID NO: 657596 - RNA, 19 nt, Homo sapiens
gcauguaguuaucuagauc

SEQ ID NO: 657597 - RNA, 19 nt, Homo sapiens
ccauguguaugcaaauauu

SEQ ID NO: 657598 - RNA, 19 nt, Homo sapiens
ggucuucugugcuaugaau

SEQ ID NO: 657599 - RNA, 19 nt, Homo sapiens
aaacagagaacaaacuuuc

SEQ ID NO: 657600 - RNA, 19 nt, Homo sapiens
aaaccuagccuuuaagcaa

SEQ ID NO: 657601 - RNA, 19 nt, Homo sapiens
gaaacuucaucuagucucu

SEQ ID NO: 657602 - RNA, 19 nt, Homo sapiens
ugaagcauguaguuaucua

SEQ ID NO: 657603 - RNA, 19 nt, Homo sapiens
aaacaaucgccaaauauga

SEQ ID NO: 657604 - RNA, 19 nt, Homo sapiens
gugagaagacugacagauu

SEQ ID NO: 657605 - RNA, 19 nt, Homo sapiens
aaacagcaggagauaauuu

SEQ ID NO: 657606 - RNA, 19 nt, Homo sapiens
ucaaacagcaggagauaau

SEQ ID NO: 657607 - RNA, 19 nt, Homo sapiens
ugacccaacuccaacaaug

SEQ ID NO: 657608 - RNA, 19 nt, Homo sapiens
uauaucagcguaaacauga

SEQ ID NO: 657609 - RNA, 19 nt, Homo sapiens
uuacagcgcagcauuuauu

SEQ ID NO: 657610 - RNA, 19 nt, Homo sapiens
aaagagaucacaggaauug

SEQ ID NO: 657611 - RNA, 19 nt, Homo sapiens
ugagaucgauauuguucuu

SEQ ID NO: 657612 - RNA, 19 nt, Homo sapiens
cuagaacaccaaggaauua

SEQ ID NO: 657613 - RNA, 19 nt, Homo sapiens
aaacuacuuucacuuaugg

SEQ ID NO: 657614 - RNA, 19 nt, Homo sapiens
guauuuaaccagccucaaa

SEQ ID NO: 657615 - RNA, 19 nt, Homo sapiens
aacugaagauggcaaagua

SEQ ID NO: 657616 - RNA, 19 nt, Homo sapiens
gcagucauccauucauaug

SEQ ID NO: 657617 - RNA, 19 nt, Homo sapiens
uuccauggcuuccagaauu

SEQ ID NO: 657618 - RNA, 19 nt, Homo sapiens
cuguaacccuugagauuaa

SEQ ID NO: 657619 - RNA, 19 nt, Homo sapiens
ugaauuuagugcuuguuga

SEQ ID NO: 657620 - RNA, 19 nt, Homo sapiens
ggauaugacccaacuccaa

SEQ ID NO: 657621 - RNA, 19 nt, Homo sapiens
ggaagugggcauugaagau

SEQ ID NO: 657622 - RNA, 19 nt, Homo sapiens
cuggguaauuucauguuua

SEQ ID NO: 657623 - RNA, 19 nt, Homo sapiens
ucauguaagugccuauuca

SEQ ID NO: 657624 - RNA, 19 nt, Homo sapiens
gaagauugcagucauccau

SEQ ID NO: 657625 - RNA, 19 nt, Homo sapiens
gaggaccugugaagcaugu

SEQ ID NO: 657626 - RNA, 19 nt, Homo sapiens
ugauaagcacucagauaua

SEQ ID NO: 657627 - RNA, 19 nt, Homo sapiens
uugaaacacuggaacuuug

SEQ ID NO: 657628 - RNA, 19 nt, Homo sapiens
ccuguaacccuugagauua

SEQ ID NO: 657629 - RNA, 19 nt, Homo sapiens
cauugaagauugucuacau

SEQ ID NO: 657630 - RNA, 19 nt, Homo sapiens
uuacuacuauggcacuuug

SEQ ID NO: 657631 - RNA, 19 nt, Homo sapiens
ggccaaaacuccauauaug

SEQ ID NO: 657632 - RNA, 19 nt, Homo sapiens
ugacagauuugguaaaaga

SEQ ID NO: 657633 - RNA, 19 nt, Homo sapiens
ugacucagagcagaaguua

SEQ ID NO: 657634 - RNA, 19 nt, Homo sapiens
gcacuucugaguaccauuc

SEQ ID NO: 657635 - RNA, 19 nt, Homo sapiens
aaaagcauauggaguguuu

SEQ ID NO: 657636 - RNA, 19 nt, Homo sapiens
ggaauuggacccaguacca

SEQ ID NO: 657637 - RNA, 19 nt, Homo sapiens
gaggucuucugugcuauga

SEQ ID NO: 657638 - RNA, 19 nt, Homo sapiens
gaauuuagugcuuguugau

SEQ ID NO: 657639 - RNA, 19 nt, Homo sapiens
ggaguuacagcugaucaaa

SEQ ID NO: 657640 - RNA, 19 nt, Homo sapiens
gagaagacugacagauuug

SEQ ID NO: 657641 - RNA, 19 nt, Homo sapiens
guaguaagccagaaaauau

SEQ ID NO: 657642 - RNA, 19 nt, Homo sapiens
aaagaagauugcagucauc

SEQ ID NO: 657643 - RNA, 19 nt, Homo sapiens
cuuccuacuuugaugauaa

SEQ ID NO: 657644 - RNA, 19 nt, Homo sapiens
agaaacaaucgccaaauau

SEQ ID NO: 657645 - RNA, 19 nt, Homo sapiens
cauggcaucucaauauuuu

SEQ ID NO: 657646 - RNA, 19 nt, Homo sapiens
gaccggagguacuucaaac

SEQ ID NO: 657647 - RNA, 19 nt, Homo sapiens
uaaagugacaauagugaga

SEQ ID NO: 657648 - RNA, 19 nt, Homo sapiens
agugaaagaacuagccuua

SEQ ID NO: 657649 - RNA, 19 nt, Homo sapiens
gaauuuguaaaccuaguga

SEQ ID NO: 657650 - RNA, 19 nt, Homo sapiens
uugcagucauccauucaua

SEQ ID NO: 657651 - RNA, 19 nt, Homo sapiens
aacuucaucuagucucuua

SEQ ID NO: 657652 - RNA, 19 nt, Homo sapiens
aggcugguauuuguaauuu

SEQ ID NO: 657653 - RNA, 19 nt, Homo sapiens
aaacugaggaaacagagaa

SEQ ID NO: 657654 - RNA, 19 nt, Homo sapiens
cagagcagaaguuaugauu

SEQ ID NO: 657655 - RNA, 19 nt, Homo sapiens
uuugaggucuucugugcua

SEQ ID NO: 657656 - RNA, 19 nt, Homo sapiens
cuuauucucuacaugcaaa

SEQ ID NO: 657657 - RNA, 19 nt, Homo sapiens
gaacagccugaaaugugaa

SEQ ID NO: 657658 - RNA, 19 nt, Homo sapiens
ugaaagaacuagccuuacc

SEQ ID NO: 657659 - RNA, 19 nt, Homo sapiens
aacauggcaucucaauauu

SEQ ID NO: 657660 - RNA, 19 nt, Homo sapiens
ggauauggguauacuauua

SEQ ID NO: 657661 - RNA, 19 nt, Homo sapiens
caaagcaguugaacagaaa

SEQ ID NO: 657662 - RNA, 19 nt, Homo sapiens
uaggacagcucuagcauuu

SEQ ID NO: 657663 - RNA, 19 nt, Homo sapiens
gcaaauguuuacagaaaug

SEQ ID NO: 657664 - RNA, 19 nt, Homo sapiens
gugcagauguuauuaaaug

SEQ ID NO: 657665 - RNA, 19 nt, Homo sapiens
guaggcaauuccuugauua

SEQ ID NO: 657666 - RNA, 19 nt, Homo sapiens
gcaacaagucagauaguua

SEQ ID NO: 657667 - RNA, 19 nt, Homo sapiens
ugacauagaugaugcaaag

SEQ ID NO: 657668 - RNA, 19 nt, Homo sapiens
caaaugccgugaaaguauu

SEQ ID NO: 657669 - RNA, 19 nt, Homo sapiens
gagauagaauugugauuuc

SEQ ID NO: 657670 - RNA, 19 nt, Homo sapiens
cauuugaccuggcaauuaa

SEQ ID NO: 657671 - RNA, 19 nt, Homo sapiens
ucuaggaacuuuacagauu

SEQ ID NO: 657672 - RNA, 19 nt, Homo sapiens
gagugcagauguuauuaaa

SEQ ID NO: 657673 - RNA, 19 nt, Homo sapiens
gaaaagugcuggaguaaca

SEQ ID NO: 657674 - RNA, 19 nt, Homo sapiens
ggacaaagcaguugaacag

SEQ ID NO: 657675 - RNA, 19 nt, Homo sapiens
gguaggcaauuccuugauu

SEQ ID NO: 657676 - RNA, 19 nt, Homo sapiens
gaugagaauuugaaacaag

SEQ ID NO: 657677 - RNA, 19 nt, Homo sapiens
cugcaaauguuuacagaaa

SEQ ID NO: 657678 - RNA, 19 nt, Homo sapiens
gaccagaaaugcagaacau

SEQ ID NO: 657679 - RNA, 19 nt, Homo sapiens
caagucagauaguuagaau

SEQ ID NO: 657680 - RNA, 19 nt, Homo sapiens
ugaagaaugugaauuagca

SEQ ID NO: 657681 - RNA, 19 nt, Homo sapiens
cauagaugaugcaaaggua

SEQ ID NO: 657682 - RNA, 19 nt, Homo sapiens
ucagauaguuagaaucgaa

SEQ ID NO: 657683 - RNA, 19 nt, Homo sapiens
ugauugaacugucuaggaa

SEQ ID NO: 657684 - RNA, 19 nt, Homo sapiens
aagcaccgcugcauggaua

SEQ ID NO: 657685 - RNA, 19 nt, Homo sapiens
cagugaagaaugugaauua

SEQ ID NO: 657686 - RNA, 19 nt, Homo sapiens
ccucgaaccugauauuugu

SEQ ID NO: 657687 - RNA, 19 nt, Homo sapiens
acaaagcaguugaacagaa

SEQ ID NO: 657688 - RNA, 19 nt, Homo sapiens
acaaaggucucagccaauu

SEQ ID NO: 657689 - RNA, 19 nt, Homo sapiens
ucaaaccagugaagaaugu

SEQ ID NO: 657690 - RNA, 19 nt, Homo sapiens
caaauccauugcuuagcua

SEQ ID NO: 657691 - RNA, 19 nt, Homo sapiens
ugaagcaagucggaaagua

SEQ ID NO: 657692 - RNA, 19 nt, Homo sapiens
gcaccuuguuucaggauau

SEQ ID NO: 657693 - RNA, 19 nt, Homo sapiens
guaaauaguucugaguucu

SEQ ID NO: 657694 - RNA, 19 nt, Homo sapiens
gaaacaagaaacagagugu

SEQ ID NO: 657695 - RNA, 19 nt, Homo sapiens
gaacugucuaggaacuuua

SEQ ID NO: 657696 - RNA, 19 nt, Homo sapiens
ccgaaguggucucauugua

SEQ ID NO: 657697 - RNA, 19 nt, Homo sapiens
gaggauauggguauacuau

SEQ ID NO: 657698 - RNA, 19 nt, Homo sapiens
gaccauccuuaacuugauu

SEQ ID NO: 657699 - RNA, 19 nt, Homo sapiens
ggaccauccuuaacuugau

SEQ ID NO: 657700 - RNA, 19 nt, Homo sapiens
caacaagucagauaguuag

SEQ ID NO: 657701 - RNA, 19 nt, Homo sapiens
aaucaggaauauuguggua

SEQ ID NO: 657702 - RNA, 19 nt, Homo sapiens
cuaggaacuuuacagauug

SEQ ID NO: 657703 - RNA, 19 nt, Homo sapiens
acacugagauagaauugug

SEQ ID NO: 657704 - RNA, 19 nt, Homo sapiens
gcacuuggacaaagcaguu

SEQ ID NO: 657705 - RNA, 19 nt, Homo sapiens
gaaaagaggauauggguau

SEQ ID NO: 657706 - RNA, 19 nt, Homo sapiens
ucaaaugccgugaaaguau

SEQ ID NO: 657707 - RNA, 19 nt, Homo sapiens
cugcaguucucucuucuuu

SEQ ID NO: 657708 - RNA, 19 nt, Homo sapiens
ggacagcucuagcauuuuc

SEQ ID NO: 657709 - RNA, 19 nt, Homo sapiens
guuccgaaguggucucauu

SEQ ID NO: 657710 - RNA, 19 nt, Homo sapiens
ggauaucuuucagcacuug

SEQ ID NO: 657711 - RNA, 19 nt, Homo sapiens
cuccaacaguuaaugauaa

SEQ ID NO: 657712 - RNA, 19 nt, Homo sapiens
uuaggaaucugcaaugagu

SEQ ID NO: 657713 - RNA, 19 nt, Homo sapiens
gcaguugaacagaaacaaa

SEQ ID NO: 657714 - RNA, 19 nt, Homo sapiens
gcaguucucucuucuuuuc

SEQ ID NO: 657715 - RNA, 19 nt, Homo sapiens
uguaauagguaggcaauuc

SEQ ID NO: 657716 - RNA, 19 nt, Homo sapiens
gaugaacuaugaguaacug

SEQ ID NO: 657717 - RNA, 19 nt, Homo sapiens
ggacauccuucagaguugu

SEQ ID NO: 657718 - RNA, 19 nt, Homo sapiens
ugaagaaccacuacaagga

SEQ ID NO: 657719 - RNA, 19 nt, Homo sapiens
uaacagcguacaauuacaa

SEQ ID NO: 657720 - RNA, 19 nt, Homo sapiens
gcaagugccaguaaaugau

SEQ ID NO: 657721 - RNA, 19 nt, Homo sapiens
ugaacugucuaggaacuuu

SEQ ID NO: 657722 - RNA, 19 nt, Homo sapiens
uaacuugauugaacugucu

SEQ ID NO: 657723 - RNA, 19 nt, Homo sapiens
gaacuaugaguaacugaag

SEQ ID NO: 657724 - RNA, 19 nt, Homo sapiens
gaucugaaacaauauugga

SEQ ID NO: 657725 - RNA, 19 nt, Homo sapiens
ucauuugaccuggcaauua

SEQ ID NO: 657726 - RNA, 19 nt, Homo sapiens
ucaaauccauugcuuagcu

SEQ ID NO: 657727 - RNA, 19 nt, Homo sapiens
cagaugagaauuugaaaca

SEQ ID NO: 657728 - RNA, 19 nt, Homo sapiens
gggcuaacaguacaucuga

SEQ ID NO: 657729 - RNA, 19 nt, Homo sapiens
ggucucagccaauuucuuc

SEQ ID NO: 657730 - RNA, 19 nt, Homo sapiens
gaagcaagucggaaaguac

SEQ ID NO: 657731 - RNA, 19 nt, Homo sapiens
guucugcaguucucucuuc

SEQ ID NO: 657732 - RNA, 19 nt, Homo sapiens
ucaguuggaccauccuuaa

SEQ ID NO: 657733 - RNA, 19 nt, Homo sapiens
gguguuaaaucuccuuggu

SEQ ID NO: 657734 - RNA, 19 nt, Homo sapiens
caagugccaguaaaugauu

SEQ ID NO: 657735 - RNA, 19 nt, Homo sapiens
guucugaguucugucaaau

SEQ ID NO: 657736 - RNA, 19 nt, Homo sapiens
ucaggaauauugugguaag

SEQ ID NO: 657737 - RNA, 19 nt, Homo sapiens
acaaaugcaucggaaguuc

SEQ ID NO: 657738 - RNA, 19 nt, Homo sapiens
cgugaaaguauuugcuaua

SEQ ID NO: 657739 - RNA, 19 nt, Homo sapiens
ucgcagauauggaguuugg

SEQ ID NO: 657740 - RNA, 19 nt, Homo sapiens
gcgcgcugcucucuucuag

SEQ ID NO: 657741 - RNA, 19 nt, Homo sapiens
cgagugcagauguuauuaa

SEQ ID NO: 657742 - RNA, 19 nt, Homo sapiens
ucucaugggcuacuucaaa

SEQ ID NO: 657743 - RNA, 19 nt, Homo sapiens
uuaaaucuccuugguguga

SEQ ID NO: 657744 - RNA, 19 nt, Homo sapiens
gucggaaaguacaaugaaa

SEQ ID NO: 657745 - RNA, 19 nt, Homo sapiens
ccagucauccuccaguuug

SEQ ID NO: 657746 - RNA, 19 nt, Homo sapiens
gcagauuuaauucaaguag

SEQ ID NO: 657747 - RNA, 19 nt, Homo sapiens
ccaauuucuucuccaguca

SEQ ID NO: 657748 - RNA, 19 nt, Homo sapiens
uguaaauaguucugaguuc

SEQ ID NO: 657749 - RNA, 19 nt, Homo sapiens
ggacaauuagcaacaaguc

SEQ ID NO: 657750 - RNA, 19 nt, Homo sapiens
guaucacucuggaagaaag

SEQ ID NO: 657751 - RNA, 19 nt, Homo sapiens
guuggaccauccuuaacuu

SEQ ID NO: 657752 - RNA, 19 nt, Homo sapiens
ggcaauuccuugauuacag

SEQ ID NO: 657753 - RNA, 19 nt, Homo sapiens
aaacaaaugcaucggaagu

SEQ ID NO: 657754 - RNA, 19 nt, Homo sapiens
caaaggucucagccaauuu

SEQ ID NO: 657755 - RNA, 19 nt, Homo sapiens
cgucgcagauauggaguuu

SEQ ID NO: 657756 - RNA, 19 nt, Homo sapiens
gucaaaugccgugaaagua

SEQ ID NO: 657757 - RNA, 19 nt, Homo sapiens
cagcuggcccugcaaaugu

SEQ ID NO: 657758 - RNA, 19 nt, Homo sapiens
gcaccaagacucgcuacga

SEQ ID NO: 657759 - RNA, 19 nt, Homo sapiens
ugcaaugagugauuacaug

SEQ ID NO: 657760 - RNA, 19 nt, Homo sapiens
ccgaggagcugaucucuaa

SEQ ID NO: 657761 - RNA, 19 nt, Homo sapiens
ucucuaagcuggcuaauga

SEQ ID NO: 657762 - RNA, 19 nt, Homo sapiens
gcagcccucuguccgauua

SEQ ID NO: 657763 - RNA, 19 nt, Homo sapiens
gcacacagccucccucuuc

SEQ ID NO: 657764 - RNA, 19 nt, Homo sapiens
ggacaugucuccauaaucc

SEQ ID NO: 657765 - RNA, 19 nt, Homo sapiens
ccagggacaugucuccaua

SEQ ID NO: 657766 - RNA, 19 nt, Homo sapiens
guggauagaugcagaaaca

SEQ ID NO: 657767 - RNA, 19 nt, Homo sapiens
ccacagaacucgggaccuu

SEQ ID NO: 657768 - RNA, 19 nt, Homo sapiens
gggcuacgcucggaucuug

SEQ ID NO: 657769 - RNA, 19 nt, Homo sapiens
gcacaagcuucaggucuuc

SEQ ID NO: 657770 - RNA, 19 nt, Homo sapiens
gaagacggccgaggacuau

SEQ ID NO: 657771 - RNA, 19 nt, Homo sapiens
uggagagccuggcccauaa

SEQ ID NO: 657772 - RNA, 19 nt, Homo sapiens
gccaugagcccaagaagug

SEQ ID NO: 657773 - RNA, 19 nt, Homo sapiens
ggcacaagcuucaggucuu

SEQ ID NO: 657774 - RNA, 19 nt, Homo sapiens
uaagcuggcuaaugacauc

SEQ ID NO: 657775 - RNA, 19 nt, Homo sapiens
ggcaggaucuucuacuucu

SEQ ID NO: 657776 - RNA, 19 nt, Homo sapiens
ggaccuggcuaagaaguac

SEQ ID NO: 657777 - RNA, 19 nt, Homo sapiens
ccucuuaucccauaucuuc

SEQ ID NO: 657778 - RNA, 19 nt, Homo sapiens
ccgcuucgcuccugugcuu

SEQ ID NO: 657779 - RNA, 19 nt, Homo sapiens
ccggguggaccauuacuua

SEQ ID NO: 657780 - RNA, 19 nt, Homo sapiens
uguaccggguggaccauua

SEQ ID NO: 657781 - RNA, 19 nt, Homo sapiens
ugaagacggccgaggacua

SEQ ID NO: 657782 - RNA, 19 nt, Homo sapiens
gcccgcaacaucaacagua

SEQ ID NO: 657783 - RNA, 19 nt, Homo sapiens
guguauugguggauagaug

SEQ ID NO: 657784 - RNA, 19 nt, Homo sapiens
cacccaggcauguggaaua

SEQ ID NO: 657785 - RNA, 19 nt, Homo sapiens
ggggaggggucacaguuuu

SEQ ID NO: 657786 - RNA, 19 nt, Homo sapiens
ugagaauggccgucuguug

SEQ ID NO: 657787 - RNA, 19 nt, Homo sapiens
cuucgcagguguccuagug

SEQ ID NO: 657788 - RNA, 19 nt, Homo sapiens
gaccggcagcucuguguau

SEQ ID NO: 657789 - RNA, 19 nt, Homo sapiens
ucucagacccggaguccaa

SEQ ID NO: 657790 - RNA, 19 nt, Homo sapiens
gugagcaggugcgcagaga

SEQ ID NO: 657791 - RNA, 19 nt, Homo sapiens
cccaagaaguggcccaucu

SEQ ID NO: 657792 - RNA, 19 nt, Homo sapiens
ugaggaguacggugucauu

SEQ ID NO: 657793 - RNA, 19 nt, Homo sapiens
gaaagagaccguggaugcu

SEQ ID NO: 657794 - RNA, 19 nt, Homo sapiens
cggcagcucuguguauugg

SEQ ID NO: 657795 - RNA, 19 nt, Homo sapiens
ugugguacauggacuacga

SEQ ID NO: 657796 - RNA, 19 nt, Homo sapiens
cuggagagccuggcccaua

SEQ ID NO: 657797 - RNA, 19 nt, Homo sapiens
gggagggcgugccuuucau

SEQ ID NO: 657798 - RNA, 19 nt, Homo sapiens
agaaacccuuuggccauga

SEQ ID NO: 657799 - RNA, 19 nt, Homo sapiens
gggaccuggcuaagaagua

SEQ ID NO: 657800 - RNA, 19 nt, Homo sapiens
uccguccucuuaucccaua

SEQ ID NO: 657801 - RNA, 19 nt, Homo sapiens
cgcccacuccguccucuua

SEQ ID NO: 657802 - RNA, 19 nt, Homo sapiens
uccauggccggaagaauuu

SEQ ID NO: 657803 - RNA, 19 nt, Homo sapiens
ggaagcacccaggcaugug

SEQ ID NO: 657804 - RNA, 19 nt, Homo sapiens
ggccgucuguuggacuuug

SEQ ID NO: 657805 - RNA, 19 nt, Homo sapiens
gcuacgcucggaucuuguu

SEQ ID NO: 657806 - RNA, 19 nt, Homo sapiens
ccauggagcugccccacaa

SEQ ID NO: 657807 - RNA, 19 nt, Homo sapiens
gaaacccuuuggccaugac

SEQ ID NO: 657808 - RNA, 19 nt, Homo sapiens
agggacaugucuccauaau

SEQ ID NO: 657809 - RNA, 19 nt, Homo sapiens
cagcuucuaugaggaguac

SEQ ID NO: 657810 - RNA, 19 nt, Homo sapiens
gcagcucgucuuccacauc

SEQ ID NO: 657811 - RNA, 19 nt, Homo sapiens
gcagcuggccacagaacuc

SEQ ID NO: 657812 - RNA, 19 nt, Homo sapiens
gcaggaucuucuacuucuc

SEQ ID NO: 657813 - RNA, 19 nt, Homo sapiens
uagccugccucucaucaac

SEQ ID NO: 657814 - RNA, 19 nt, Homo sapiens
caucaccacagagaacuug

SEQ ID NO: 657815 - RNA, 19 nt, Homo sapiens
ggagggcgugccuuucauc

SEQ ID NO: 657816 - RNA, 19 nt, Homo sapiens
caggaucuucuacuucuca

SEQ ID NO: 657817 - RNA, 19 nt, Homo sapiens
ccaggaaucuguauauauu

SEQ ID NO: 657818 - RNA, 19 nt, Homo sapiens
agaagaaccugaagaacua

SEQ ID NO: 657819 - RNA, 19 nt, Homo sapiens
ccaaagcgcucuaugacaa

SEQ ID NO: 657820 - RNA, 19 nt, Homo sapiens
cuaagagucuccauuuaaa

SEQ ID NO: 657821 - RNA, 19 nt, Homo sapiens
ggaaggaggaguuugagaa

SEQ ID NO: 657822 - RNA, 19 nt, Homo sapiens
ccaagcagcuggccuccuu

SEQ ID NO: 657823 - RNA, 19 nt, Homo sapiens
gcagccaggugacccacua

SEQ ID NO: 657824 - RNA, 19 nt, Homo sapiens
gcccaggaaucuguauaua

SEQ ID NO: 657825 - RNA, 19 nt, Homo sapiens
gagaagaaccugaagaacu

SEQ ID NO: 657826 - RNA, 19 nt, Homo sapiens
gggcauguaugauaagaag

SEQ ID NO: 657827 - RNA, 19 nt, Homo sapiens
ggucgacagugguguguau

SEQ ID NO: 657828 - RNA, 19 nt, Homo sapiens
ggaaccgccucaagaucuu

SEQ ID NO: 657829 - RNA, 19 nt, Homo sapiens
agaaggagcugcuggaaaa

SEQ ID NO: 657830 - RNA, 19 nt, Homo sapiens
ccgcaagggugacaucaug

SEQ ID NO: 657831 - RNA, 19 nt, Homo sapiens
gcaagagccagcuggaguu

SEQ ID NO: 657832 - RNA, 19 nt, Homo sapiens
ggauggaggacuaugacua

SEQ ID NO: 657833 - RNA, 19 nt, Homo sapiens
acuaagagucuccauuuaa

SEQ ID NO: 657834 - RNA, 19 nt, Homo sapiens
ccaaucauuugacuaagag

SEQ ID NO: 657835 - RNA, 19 nt, Homo sapiens
gaaggaggaguuugagaag

SEQ ID NO: 657836 - RNA, 19 nt, Homo sapiens
ggccacaggacaucuauga

SEQ ID NO: 657837 - RNA, 19 nt, Homo sapiens
ugacagggccagugcaguu

SEQ ID NO: 657838 - RNA, 19 nt, Homo sapiens
gcacagcaaguucgucauc

SEQ ID NO: 657839 - RNA, 19 nt, Homo sapiens
gccggcagcugcagaagau

SEQ ID NO: 657840 - RNA, 19 nt, Homo sapiens
gcaaugcugcccacacauc

SEQ ID NO: 657841 - RNA, 19 nt, Homo sapiens
gaucuuggugggcauguau

SEQ ID NO: 657842 - RNA, 19 nt, Homo sapiens
uccaaucauuugacuaaga

SEQ ID NO: 657843 - RNA, 19 nt, Homo sapiens
cagaugggcaguacgagaa

SEQ ID NO: 657844 - RNA, 19 nt, Homo sapiens
gugaggagaccuacgaugu

SEQ ID NO: 657845 - RNA, 19 nt, Homo sapiens
ggaggugucacggcccaua

SEQ ID NO: 657846 - RNA, 19 nt, Homo sapiens
ucccaggacucaccagaug

SEQ ID NO: 657847 - RNA, 19 nt, Homo sapiens
gggaaccgccucaagaucu

SEQ ID NO: 657848 - RNA, 19 nt, Homo sapiens
ccacagcacccagcaguuc

SEQ ID NO: 657849 - RNA, 19 nt, Homo sapiens
cagaaggagcugcuggaaa

SEQ ID NO: 657850 - RNA, 19 nt, Homo sapiens
gauggaggacuaugacuac

SEQ ID NO: 657851 - RNA, 19 nt, Homo sapiens
agacauccaccuucucgaa

SEQ ID NO: 657852 - RNA, 19 nt, Homo sapiens
agacggggcuggaguguga

SEQ ID NO: 657853 - RNA, 19 nt, Homo sapiens
gcaggacgaguacgacauc

SEQ ID NO: 657854 - RNA, 19 nt, Homo sapiens
aagcagacauccaccuucu

SEQ ID NO: 657855 - RNA, 19 nt, Homo sapiens
ccacgcagucuacgacguu

SEQ ID NO: 657856 - RNA, 19 nt, Homo sapiens
gccguggacgccuucuuua

SEQ ID NO: 657857 - RNA, 19 nt, Homo sapiens
uggugggcauguaugauaa

SEQ ID NO: 657858 - RNA, 19 nt, Homo sapiens
gcaaggccucuaccaaguc

SEQ ID NO: 657859 - RNA, 19 nt, Homo sapiens
gaagaaccugaagaacuau

SEQ ID NO: 657860 - RNA, 19 nt, Homo sapiens
ccagugcaguuuggugugu

SEQ ID NO: 657861 - RNA, 19 nt, Homo sapiens
gacagggccagugcaguuu

SEQ ID NO: 657862 - RNA, 19 nt, Homo sapiens
cccacaagcugguguucau

SEQ ID NO: 657863 - RNA, 19 nt, Homo sapiens
aggagaagaaccugaagaa

SEQ ID NO: 657864 - RNA, 19 nt, Homo sapiens
ccaagcagacauccaccuu

SEQ ID NO: 657865 - RNA, 19 nt, Homo sapiens
cgccuuaccaggagaagaa

SEQ ID NO: 657866 - RNA, 19 nt, Homo sapiens
cccaggaaucuguauauau

SEQ ID NO: 657867 - RNA, 19 nt, Homo sapiens
caaagcgcucuaugacaau

SEQ ID NO: 657868 - RNA, 19 nt, Homo sapiens
gcuggauggaggacuauga

SEQ ID NO: 657869 - RNA, 19 nt, Homo sapiens
gggcagggcuauguauacg

SEQ ID NO: 657870 - RNA, 19 nt, Homo sapiens
ggccaaagcgcucuaugac

SEQ ID NO: 657871 - RNA, 19 nt, Homo sapiens
ugaacgugcuggccaaagc

SEQ ID NO: 657872 - RNA, 19 nt, Homo sapiens
agagccagcuggaguugca

SEQ ID NO: 657873 - RNA, 19 nt, Homo sapiens
caagagccagcuggaguug

SEQ ID NO: 657874 - RNA, 19 nt, Homo sapiens
cggccgaggacguguauga

SEQ ID NO: 657875 - RNA, 19 nt, Homo sapiens
ccugggaaccgccucaaga

SEQ ID NO: 657876 - RNA, 19 nt, Homo sapiens
uuggugggcauguaugaua

SEQ ID NO: 657877 - RNA, 19 nt, Homo sapiens
gaaccugaagaacuauuuu

SEQ ID NO: 657878 - RNA, 19 nt, Homo sapiens
aaggaggaguuugagaaga

SEQ ID NO: 657879 - RNA, 19 nt, Homo sapiens
aaagcgcucuaugacaaug

SEQ ID NO: 657880 - RNA, 19 nt, Homo sapiens
gaccagcagcauccaguca

SEQ ID NO: 657881 - RNA, 19 nt, Homo sapiens
uggccaaagcgcucuauga

SEQ ID NO: 657882 - RNA, 19 nt, Homo sapiens
ugaggagaccuacgaugug

SEQ ID NO: 657883 - RNA, 19 nt, Homo sapiens
ucagcaaggccucuaccaa

SEQ ID NO: 657884 - RNA, 19 nt, Homo sapiens
cgccguggacgccuucuuu

SEQ ID NO: 657885 - RNA, 19 nt, Homo sapiens
gggaaggaggaguuugaga

SEQ ID NO: 657886 - RNA, 19 nt, Homo sapiens
ggagaagaaccugaagaac

SEQ ID NO: 657887 - RNA, 19 nt, Homo sapiens
agcaaggccucuaccaagu

SEQ ID NO: 657888 - RNA, 19 nt, Homo sapiens
gccaaagcgcucuaugaca

SEQ ID NO: 657889 - RNA, 19 nt, Homo sapiens
uugagaagacccagaagga

SEQ ID NO: 657890 - RNA, 19 nt, Homo sapiens
acccguugcuggaggugua

SEQ ID NO: 657891 - RNA, 19 nt, Homo sapiens
agaaccugaagaacuauuu

SEQ ID NO: 657892 - RNA, 19 nt, Homo sapiens
gcugaagcaguuugaacga

SEQ ID NO: 657893 - RNA, 19 nt, Homo sapiens
gugggcauguaugauaaga

SEQ ID NO: 657894 - RNA, 19 nt, Homo sapiens
ccaaccaccacgcagucua

SEQ ID NO: 657895 - RNA, 19 nt, Homo sapiens
gagcaaagaugaugugauu

SEQ ID NO: 657896 - RNA, 19 nt, Homo sapiens
gaaaggaugugcccgauau

SEQ ID NO: 657897 - RNA, 19 nt, Homo sapiens
ccacaaacaugaaauugaa

SEQ ID NO: 657898 - RNA, 19 nt, Homo sapiens
ggaggagccugcugaguuu

SEQ ID NO: 657899 - RNA, 19 nt, Homo sapiens
aaagacagcugguggguuu

SEQ ID NO: 657900 - RNA, 19 nt, Homo sapiens
gagcauggcggaacagaua

SEQ ID NO: 657901 - RNA, 19 nt, Homo sapiens
gaauggcgaugggauuaua

SEQ ID NO: 657902 - RNA, 19 nt, Homo sapiens
gaucagaccagcauucaaa

SEQ ID NO: 657903 - RNA, 19 nt, Homo sapiens
caacguggaugcuggcaaa

SEQ ID NO: 657904 - RNA, 19 nt, Homo sapiens
ggaccaagaucugugagaa

SEQ ID NO: 657905 - RNA, 19 nt, Homo sapiens
gaugaagccuccucuguag

SEQ ID NO: 657906 - RNA, 19 nt, Homo sapiens
ggagagaccauauauguca

SEQ ID NO: 657907 - RNA, 19 nt, Homo sapiens
gaaccuagaucugcugaag

SEQ ID NO: 657908 - RNA, 19 nt, Homo sapiens
ggacugacuucugcacuga

SEQ ID NO: 657909 - RNA, 19 nt, Homo sapiens
gcaaagaugaugugauugu

SEQ ID NO: 657910 - RNA, 19 nt, Homo sapiens
caauguaccugucuuugug

SEQ ID NO: 657911 - RNA, 19 nt, Homo sapiens
ccacgaaagucauuaccuu

SEQ ID NO: 657912 - RNA, 19 nt, Homo sapiens
uuccagaucuccaacguua

SEQ ID NO: 657913 - RNA, 19 nt, Homo sapiens
gaaagucauuaccuucauc

SEQ ID NO: 657914 - RNA, 19 nt, Homo sapiens
ggacaauggccgaggcuuu

SEQ ID NO: 657915 - RNA, 19 nt, Homo sapiens
gcggagagaccauauaugu

SEQ ID NO: 657916 - RNA, 19 nt, Homo sapiens
gaacccaccuggacugacu

SEQ ID NO: 657917 - RNA, 19 nt, Homo sapiens
guuguaaccuggagacaug

SEQ ID NO: 657918 - RNA, 19 nt, Homo sapiens
caaggccacuguacacuuc

SEQ ID NO: 657919 - RNA, 19 nt, Homo sapiens
ucaccaagauugacaugug

SEQ ID NO: 657920 - RNA, 19 nt, Homo sapiens
cgacuuggcuggucaugag

SEQ ID NO: 657921 - RNA, 19 nt, Homo sapiens
caaaagcucucugguugua

SEQ ID NO: 657922 - RNA, 19 nt, Homo sapiens
gggaauggcgaugggauua

SEQ ID NO: 657923 - RNA, 19 nt, Homo sapiens
ucaccaggcugccggaaga

SEQ ID NO: 657924 - RNA, 19 nt, Homo sapiens
gccaacauccugcaagaaa

SEQ ID NO: 657925 - RNA, 19 nt, Homo sapiens
gaaacgaguaggagacaau

SEQ ID NO: 657926 - RNA, 19 nt, Homo sapiens
uuccagcuguuucuaguua

SEQ ID NO: 657927 - RNA, 19 nt, Homo sapiens
ccaagccgcagcagauuaa

SEQ ID NO: 657928 - RNA, 19 nt, Homo sapiens
cugaguaccugcacauaga

SEQ ID NO: 657929 - RNA, 19 nt, Homo sapiens
ggaagggcauggugauggu

SEQ ID NO: 657930 - RNA, 19 nt, Homo sapiens
aagaaacccugaagcuguu

SEQ ID NO: 657931 - RNA, 19 nt, Homo sapiens
caacgacauucugggcuuu

SEQ ID NO: 657932 - RNA, 19 nt, Homo sapiens
gaaacucuuccgccacaaa

SEQ ID NO: 657933 - RNA, 19 nt, Homo sapiens
uuuauaagcugacgaaggu

SEQ ID NO: 657934 - RNA, 19 nt, Homo sapiens
gagaugaagccuccucugu

SEQ ID NO: 657935 - RNA, 19 nt, Homo sapiens
ggacugaucagaccagcau

SEQ ID NO: 657936 - RNA, 19 nt, Homo sapiens
cuuccucacucacacauuu

SEQ ID NO: 657937 - RNA, 19 nt, Homo sapiens
gaaguccacgaaagucauu

SEQ ID NO: 657938 - RNA, 19 nt, Homo sapiens
ggacugugcaggccagaga

SEQ ID NO: 657939 - RNA, 19 nt, Homo sapiens
aaggacacuuccaggguua

SEQ ID NO: 657940 - RNA, 19 nt, Homo sapiens
ggacugaccaucucucacu

SEQ ID NO: 657941 - RNA, 19 nt, Homo sapiens
gcaagcgcaugccugucaa

SEQ ID NO: 657942 - RNA, 19 nt, Homo sapiens
cuacaucagagcaguauga

SEQ ID NO: 657943 - RNA, 19 nt, Homo sapiens
uaacagggagaaaguagug

SEQ ID NO: 657944 - RNA, 19 nt, Homo sapiens
agaugaagccuccucugua

SEQ ID NO: 657945 - RNA, 19 nt, Homo sapiens
gagaccauauaugucauug

SEQ ID NO: 657946 - RNA, 19 nt, Homo sapiens
ggacaaggccacuguacac

SEQ ID NO: 657947 - RNA, 19 nt, Homo sapiens
cgaaagucauuaccuucau

SEQ ID NO: 657948 - RNA, 19 nt, Homo sapiens
gacaauggccgaggcuuug

SEQ ID NO: 657949 - RNA, 19 nt, Homo sapiens
caaagaugaugugauuguc

SEQ ID NO: 657950 - RNA, 19 nt, Homo sapiens
gcacuggcacucaauguac

SEQ ID NO: 657951 - RNA, 19 nt, Homo sapiens
gagaaguccacgaaaguca

SEQ ID NO: 657952 - RNA, 19 nt, Homo sapiens
ugacagugaaggcaaugua

SEQ ID NO: 657953 - RNA, 19 nt, Homo sapiens
gccacaaacaugaaauuga

SEQ ID NO: 657954 - RNA, 19 nt, Homo sapiens
ggaaacgaguaggagacaa

SEQ ID NO: 657955 - RNA, 19 nt, Homo sapiens
gguuaggacagagcauuua

SEQ ID NO: 657956 - RNA, 19 nt, Homo sapiens
uggagacaauccugcguuu

SEQ ID NO: 657957 - RNA, 19 nt, Homo sapiens
gacgagggaugcggagaga

SEQ ID NO: 657958 - RNA, 19 nt, Homo sapiens
agauucaggucaugccaaa

SEQ ID NO: 657959 - RNA, 19 nt, Homo sapiens
gguaacuuccuguccauug

SEQ ID NO: 657960 - RNA, 19 nt, Homo sapiens
ugagaggccugaucaagcu

SEQ ID NO: 657961 - RNA, 19 nt, Homo sapiens
ugaagagcauggcggaaca

SEQ ID NO: 657962 - RNA, 19 nt, Homo sapiens
guacacuuccgcuucauca

SEQ ID NO: 657963 - RNA, 19 nt, Homo sapiens
ugucacagccuccaacuuc

SEQ ID NO: 657964 - RNA, 19 nt, Homo sapiens
ugacgaagguagccagacu

SEQ ID NO: 657965 - RNA, 19 nt, Homo sapiens
ggaguuugaggccgagauu

SEQ ID NO: 657966 - RNA, 19 nt, Homo sapiens
ccuuugcgcugaagaagau

SEQ ID NO: 657967 - RNA, 19 nt, Homo sapiens
gcagagcaaagaugaugug

SEQ ID NO: 657968 - RNA, 19 nt, Homo sapiens
gaccagcauucaaaauaaa

SEQ ID NO: 657969 - RNA, 19 nt, Homo sapiens
caccaagauugacaugugu

SEQ ID NO: 657970 - RNA, 19 nt, Homo sapiens
ugaaggcaauguagugaac

SEQ ID NO: 657971 - RNA, 19 nt, Homo sapiens
aaaaugcagucgacgaaaa

SEQ ID NO: 657972 - RNA, 19 nt, Homo sapiens
uguagcaccuccuguugga

SEQ ID NO: 657973 - RNA, 19 nt, Homo sapiens
gagacaauccugcguuugc

SEQ ID NO: 657974 - RNA, 19 nt, Homo sapiens
gcccacagauucaggucau

SEQ ID NO: 657975 - RNA, 19 nt, Homo sapiens
ggccaccacuccaccagau

SEQ ID NO: 657976 - RNA, 19 nt, Homo sapiens
gagagaccauauaugucau

SEQ ID NO: 657977 - RNA, 19 nt, Homo sapiens
agaccagcauucaaaauaa

SEQ ID NO: 657978 - RNA, 19 nt, Homo sapiens
gucuaggacuugggcauuu

SEQ ID NO: 657979 - RNA, 19 nt, Homo sapiens
guaacuuccuguccauugc

SEQ ID NO: 657980 - RNA, 19 nt, Homo sapiens
ugaaaggaugugcccgaua

SEQ ID NO: 657981 - RNA, 19 nt, Homo sapiens
ggcacuggcacucaaugua

SEQ ID NO: 657982 - RNA, 19 nt, Homo sapiens
gagcuccagguuugaaaga

SEQ ID NO: 657983 - RNA, 19 nt, Homo sapiens
ggaauggcgaugggauuau

SEQ ID NO: 657984 - RNA, 19 nt, Homo sapiens
ccuuuaagcccacagauuc

SEQ ID NO: 657985 - RNA, 19 nt, Homo sapiens
acacugagaggccugauca

SEQ ID NO: 657986 - RNA, 19 nt, Homo sapiens
gaugcggagagaccauaua

SEQ ID NO: 657987 - RNA, 19 nt, Homo sapiens
ucaauguaccugucuuugu

SEQ ID NO: 657988 - RNA, 19 nt, Homo sapiens
uggcuggucaugagaagua

SEQ ID NO: 657989 - RNA, 19 nt, Homo sapiens
ugugagaaguccacgaaag

SEQ ID NO: 657990 - RNA, 19 nt, Homo sapiens
ggucugcucaggaucaugu

SEQ ID NO: 657991 - RNA, 19 nt, Homo sapiens
cagaugggacugaguaugg

SEQ ID NO: 657992 - RNA, 19 nt, Homo sapiens
aggaggagccugcugaguu

SEQ ID NO: 657993 - RNA, 19 nt, Homo sapiens
cacuuccgcuucaucaaga

SEQ ID NO: 657994 - RNA, 19 nt, Homo sapiens
gagcauggacaaggacugu

SEQ ID NO: 657995 - RNA, 19 nt, Homo sapiens
ucacagagcuggauaaaga

SEQ ID NO: 657996 - RNA, 19 nt, Homo sapiens
gaacauguaugguaguaaa

SEQ ID NO: 657997 - RNA, 19 nt, Homo sapiens
gcaaagauccuauagaaga

SEQ ID NO: 657998 - RNA, 19 nt, Homo sapiens
gaaaagaccaccuacauua

SEQ ID NO: 657999 - RNA, 19 nt, Homo sapiens
gaaggacaguggagaaguu

SEQ ID NO: 658000 - RNA, 19 nt, Homo sapiens
guuguucgguuguuucuua

SEQ ID NO: 658001 - RNA, 19 nt, Homo sapiens
gaucauccuuggccaguuu

SEQ ID NO: 658002 - RNA, 19 nt, Homo sapiens
gaaagacuccacagcagua

SEQ ID NO: 658003 - RNA, 19 nt, Homo sapiens
gauauaaacucuccagaac

SEQ ID NO: 658004 - RNA, 19 nt, Homo sapiens
caccugaccucgagccuua

SEQ ID NO: 658005 - RNA, 19 nt, Homo sapiens
agaagaagaucaucaagga

SEQ ID NO: 658006 - RNA, 19 nt, Homo sapiens
gagaacauguaugguagua

SEQ ID NO: 658007 - RNA, 19 nt, Homo sapiens
gaggagaacauguauggua

SEQ ID NO: 658008 - RNA, 19 nt, Homo sapiens
gaacaaccuuaucauccuu

SEQ ID NO: 658009 - RNA, 19 nt, Homo sapiens
ggucacgggucaaguugua

SEQ ID NO: 658010 - RNA, 19 nt, Homo sapiens
gagcacagauggaggaaag

SEQ ID NO: 658011 - RNA, 19 nt, Homo sapiens
caagggacuucucauguug

SEQ ID NO: 658012 - RNA, 19 nt, Homo sapiens
ggaaucagaagcucauaaa

SEQ ID NO: 658013 - RNA, 19 nt, Homo sapiens
ccaccuacauuaaacagaa

SEQ ID NO: 658014 - RNA, 19 nt, Homo sapiens
gaaaugggacgucuuccuu

SEQ ID NO: 658015 - RNA, 19 nt, Homo sapiens
gcgaggacauugagauuuc

SEQ ID NO: 658016 - RNA, 19 nt, Homo sapiens
gaacgagaccaacuucuuc

SEQ ID NO: 658017 - RNA, 19 nt, Homo sapiens
caaagaagaggaacggaaa

SEQ ID NO: 658018 - RNA, 19 nt, Homo sapiens
caaagauccuauagaagau

SEQ ID NO: 658019 - RNA, 19 nt, Homo sapiens
gaccagaaacugcuuguga

SEQ ID NO: 658020 - RNA, 19 nt, Homo sapiens
ccucgagccuuauuuguga

SEQ ID NO: 658021 - RNA, 19 nt, Homo sapiens
augcaaagauccuauagaa

SEQ ID NO: 658022 - RNA, 19 nt, Homo sapiens
acaagggacuucucauguu

SEQ ID NO: 658023 - RNA, 19 nt, Homo sapiens
caccauggcuggccucuca

SEQ ID NO: 658024 - RNA, 19 nt, Homo sapiens
ucaagaccaucucaggaaa

SEQ ID NO: 658025 - RNA, 19 nt, Homo sapiens
gaacaugcaaagauccuau

SEQ ID NO: 658026 - RNA, 19 nt, Homo sapiens
gaucaucaaggaccagaaa

SEQ ID NO: 658027 - RNA, 19 nt, Homo sapiens
gcgcugggauaucaaacuu

SEQ ID NO: 658028 - RNA, 19 nt, Homo sapiens
aaauaucaguggaucauuc

SEQ ID NO: 658029 - RNA, 19 nt, Homo sapiens
guccuuauuucuucacaaa

SEQ ID NO: 658030 - RNA, 19 nt, Homo sapiens
acaaggaggcgcugggaua

SEQ ID NO: 658031 - RNA, 19 nt, Homo sapiens
aaaaucaccucgaucaaaa

SEQ ID NO: 658032 - RNA, 19 nt, Homo sapiens
aaagaccaccuacauuaaa

SEQ ID NO: 658033 - RNA, 19 nt, Homo sapiens
aaucagaagcucauaaaga

SEQ ID NO: 658034 - RNA, 19 nt, Homo sapiens
ccaagcagaucaagaccau

SEQ ID NO: 658035 - RNA, 19 nt, Homo sapiens
ggaaucuggugcagcuuuc

SEQ ID NO: 658036 - RNA, 19 nt, Homo sapiens
ucaagaaccggaaucagaa

SEQ ID NO: 658037 - RNA, 19 nt, Homo sapiens
ucucugaggugcggaauga

SEQ ID NO: 658038 - RNA, 19 nt, Homo sapiens
guugaaagccuucuacgau

SEQ ID NO: 658039 - RNA, 19 nt, Homo sapiens
gaucacagagcuggauaaa

SEQ ID NO: 658040 - RNA, 19 nt, Homo sapiens
gagagagaguacaacaaca

SEQ ID NO: 658041 - RNA, 19 nt, Homo sapiens
ugacuggaguucuguaugg

SEQ ID NO: 658042 - RNA, 19 nt, Homo sapiens
aaugggacgucuuccuuaa

SEQ ID NO: 658043 - RNA, 19 nt, Homo sapiens
gcaaaaguguucuguugug

SEQ ID NO: 658044 - RNA, 19 nt, Homo sapiens
cagcaaaaguguucuguug

SEQ ID NO: 658045 - RNA, 19 nt, Homo sapiens
uaacaucugcaaacaagga

SEQ ID NO: 658046 - RNA, 19 nt, Homo sapiens
gaggaaaggccauuuuaaa

SEQ ID NO: 658047 - RNA, 19 nt, Homo sapiens
ccaccucggucaccagugu

SEQ ID NO: 658048 - RNA, 19 nt, Homo sapiens
ucacucagaaucagaagaa

SEQ ID NO: 658049 - RNA, 19 nt, Homo sapiens
ucaaugacaccaucagguu

SEQ ID NO: 658050 - RNA, 19 nt, Homo sapiens
gcacacggaagccaacuca

SEQ ID NO: 658051 - RNA, 19 nt, Homo sapiens
cgcaagacguucagagguu

SEQ ID NO: 658052 - RNA, 19 nt, Homo sapiens
cuuaacaucugcaaacaag

SEQ ID NO: 658053 - RNA, 19 nt, Homo sapiens
ugaagaagaagaucaucaa

SEQ ID NO: 658054 - RNA, 19 nt, Homo sapiens
cugggaaacuucacugaga

SEQ ID NO: 658055 - RNA, 19 nt, Homo sapiens
ugugagaacacccauauga

SEQ ID NO: 658056 - RNA, 19 nt, Homo sapiens
uauaaacucuccagaacac

SEQ ID NO: 658057 - RNA, 19 nt, Homo sapiens
uggaagaggucaccaugca

SEQ ID NO: 658058 - RNA, 19 nt, Homo sapiens
ggauaaagacuuggaagag

SEQ ID NO: 658059 - RNA, 19 nt, Homo sapiens
cagaagcucauaaagaugu

SEQ ID NO: 658060 - RNA, 19 nt, Homo sapiens
cauacgaggagaacaugua

SEQ ID NO: 658061 - RNA, 19 nt, Homo sapiens
accaagagcucaaugacau

SEQ ID NO: 658062 - RNA, 19 nt, Homo sapiens
caucguggcucuggucauc

SEQ ID NO: 658063 - RNA, 19 nt, Homo sapiens
auaaagaugucgaguccau

SEQ ID NO: 658064 - RNA, 19 nt, Homo sapiens
aucagaagcucauaaagau

SEQ ID NO: 658065 - RNA, 19 nt, Homo sapiens
aaaugggacgucuuccuua

SEQ ID NO: 658066 - RNA, 19 nt, Homo sapiens
gaagaucacagagcuggau

SEQ ID NO: 658067 - RNA, 19 nt, Homo sapiens
gaagaagaagaucaucaag

SEQ ID NO: 658068 - RNA, 19 nt, Homo sapiens
guaaauaucaguggaucau

SEQ ID NO: 658069 - RNA, 19 nt, Homo sapiens
ucucgaacaugcaaagauc

SEQ ID NO: 658070 - RNA, 19 nt, Homo sapiens
gauuccaguucacucagaa

SEQ ID NO: 658071 - RNA, 19 nt, Homo sapiens
ggacgucuuccuuaacauc

SEQ ID NO: 658072 - RNA, 19 nt, Homo sapiens
ucaaugacauccucaaccu

SEQ ID NO: 658073 - RNA, 19 nt, Homo sapiens
ucaugccgcucaccaagga

SEQ ID NO: 658074 - RNA, 19 nt, Homo sapiens
ggaugagugucuacaacgu

SEQ ID NO: 658075 - RNA, 19 nt, Homo sapiens
caucgucuaugccuacaag

SEQ ID NO: 658076 - RNA, 19 nt, Homo sapiens
gagaguccacgccaucuuc

SEQ ID NO: 658077 - RNA, 19 nt, Homo sapiens
gaucauggccagugcuuuu

SEQ ID NO: 658078 - RNA, 19 nt, Homo sapiens
gcagauccgcaacgaguca

SEQ ID NO: 658079 - RNA, 19 nt, Homo sapiens
gagaacaaacccagaugca

SEQ ID NO: 658080 - RNA, 19 nt, Homo sapiens
agauauaaacucuccagaa

SEQ ID NO: 658081 - RNA, 19 nt, Homo sapiens
agagcuggauaaagacuug

SEQ ID NO: 658082 - RNA, 19 nt, Homo sapiens
agaaucagaagaaagaaga

SEQ ID NO: 658083 - RNA, 19 nt, Homo sapiens
cuacaagggacuucucaug

SEQ ID NO: 658084 - RNA, 19 nt, Homo sapiens
ugaacgagaccaacuucuu

SEQ ID NO: 658085 - RNA, 19 nt, Homo sapiens
ggauccaggacuucaacua

SEQ ID NO: 658086 - RNA, 19 nt, Homo sapiens
gaauauggcagcaaaagug

SEQ ID NO: 658087 - RNA, 19 nt, Homo sapiens
ugaccugacuggaguucug

SEQ ID NO: 658088 - RNA, 19 nt, Homo sapiens
ugaacaaccuuaucauccu

SEQ ID NO: 658089 - RNA, 19 nt, Homo sapiens
caaggaggcgcugggauau

SEQ ID NO: 658090 - RNA, 19 nt, Homo sapiens
ggaggaaaggccauuuuaa

SEQ ID NO: 658091 - RNA, 19 nt, Homo sapiens
gcacucaacgacagcaagu

SEQ ID NO: 658092 - RNA, 19 nt, Homo sapiens
ccauacaugaacaaccuua

SEQ ID NO: 658093 - RNA, 19 nt, Homo sapiens
gagcagcugcggaagaucu

SEQ ID NO: 658094 - RNA, 19 nt, Homo sapiens
acauuaaacagaaccacua

SEQ ID NO: 658095 - RNA, 19 nt, Homo sapiens
ggaaggagcuacagucaga

SEQ ID NO: 658096 - RNA, 19 nt, Homo sapiens
ggaacaaguuuaccaaaga

SEQ ID NO: 658097 - RNA, 19 nt, Homo sapiens
gaaauuccgucuccucuuc

SEQ ID NO: 658098 - RNA, 19 nt, Homo sapiens
ggauggagaugcugacaga

SEQ ID NO: 658099 - RNA, 19 nt, Homo sapiens
gcuggucccuuauaaacua

SEQ ID NO: 658100 - RNA, 19 nt, Homo sapiens
uuaagaggauguuugauga

SEQ ID NO: 658101 - RNA, 19 nt, Homo sapiens
caauguacaugguggacua

SEQ ID NO: 658102 - RNA, 19 nt, Homo sapiens
gggagaauguuccugaaug

SEQ ID NO: 658103 - RNA, 19 nt, Homo sapiens
ucacgggucugccugauga

SEQ ID NO: 658104 - RNA, 19 nt, Homo sapiens
gcucagcgcuguccaaacu

SEQ ID NO: 658105 - RNA, 19 nt, Homo sapiens
cagaaagacuaaaggaaau

SEQ ID NO: 658106 - RNA, 19 nt, Homo sapiens
ucagaaagacuaaaggaaa

SEQ ID NO: 658107 - RNA, 19 nt, Homo sapiens
acaagcggaucaagaguaa

SEQ ID NO: 658108 - RNA, 19 nt, Homo sapiens
aguauccacuucaucauua

SEQ ID NO: 658109 - RNA, 19 nt, Homo sapiens
uagaggagguguuugaugu

SEQ ID NO: 658110 - RNA, 19 nt, Homo sapiens
gcaacagcauccaguuugu

SEQ ID NO: 658111 - RNA, 19 nt, Homo sapiens
gaacaaguuuaccaaagac

SEQ ID NO: 658112 - RNA, 19 nt, Homo sapiens
cgacaucgccaacacacua

SEQ ID NO: 658113 - RNA, 19 nt, Homo sapiens
gaagagacagggcuuucaa

SEQ ID NO: 658114 - RNA, 19 nt, Homo sapiens
caucggaggauucugguua

SEQ ID NO: 658115 - RNA, 19 nt, Homo sapiens
gggaacaaguuuaccaaag

SEQ ID NO: 658116 - RNA, 19 nt, Homo sapiens
gguguuugauguucuuuau

SEQ ID NO: 658117 - RNA, 19 nt, Homo sapiens
cgggaccucuuaauuacua

SEQ ID NO: 658118 - RNA, 19 nt, Homo sapiens
gcucagauguguaccuucu

SEQ ID NO: 658119 - RNA, 19 nt, Homo sapiens
gaacggugucucccugauu

SEQ ID NO: 658120 - RNA, 19 nt, Homo sapiens
gaaggccagccgaguauga

SEQ ID NO: 658121 - RNA, 19 nt, Homo sapiens
gugugcagauccuguuuaa

SEQ ID NO: 658122 - RNA, 19 nt, Homo sapiens
ggagguguuugauguucuu

SEQ ID NO: 658123 - RNA, 19 nt, Homo sapiens
ggagaauguuccugaaugc

SEQ ID NO: 658124 - RNA, 19 nt, Homo sapiens
gagacagggcuuucaagaa

SEQ ID NO: 658125 - RNA, 19 nt, Homo sapiens
gauguuugaugagcgaauu

SEQ ID NO: 658126 - RNA, 19 nt, Homo sapiens
gaggagguguuugauguuc

SEQ ID NO: 658127 - RNA, 19 nt, Homo sapiens
ggaaugcucggucagacaa

SEQ ID NO: 658128 - RNA, 19 nt, Homo sapiens
guauccacuucaucauuaa

SEQ ID NO: 658129 - RNA, 19 nt, Homo sapiens
gaugguagaggagguguuu

SEQ ID NO: 658130 - RNA, 19 nt, Homo sapiens
ucccgggaccucuuaauua

SEQ ID NO: 658131 - RNA, 19 nt, Homo sapiens
gcuccaacccuuugcagaa

SEQ ID NO: 658132 - RNA, 19 nt, Homo sapiens
cccaaagccugaugaagau

SEQ ID NO: 658133 - RNA, 19 nt, Homo sapiens
cauaguauccacuucauca

SEQ ID NO: 658134 - RNA, 19 nt, Homo sapiens
ucccaaagccugaugaaga

SEQ ID NO: 658135 - RNA, 19 nt, Homo sapiens
uccaaggacucaucccaaa

SEQ ID NO: 658136 - RNA, 19 nt, Homo sapiens
gaaagacuaaaggaaaugu

SEQ ID NO: 658137 - RNA, 19 nt, Homo sapiens
gcauccaguuugucaucaa

SEQ ID NO: 658138 - RNA, 19 nt, Homo sapiens
ucauuaagaggauguuuga

SEQ ID NO: 658139 - RNA, 19 nt, Homo sapiens
ggaccucacucagaaagac

SEQ ID NO: 658140 - RNA, 19 nt, Homo sapiens
aagaucaaguucacaguca

SEQ ID NO: 658141 - RNA, 19 nt, Homo sapiens
uccaggaccuuuucaauaa

SEQ ID NO: 658142 - RNA, 19 nt, Homo sapiens
ucacugagggagucaaaga

SEQ ID NO: 658143 - RNA, 19 nt, Homo sapiens
cagcaacagcauccaguuu

SEQ ID NO: 658144 - RNA, 19 nt, Homo sapiens
gggagcaggugaaggaacu

SEQ ID NO: 658145 - RNA, 19 nt, Homo sapiens
caaagccugaugaagauga

SEQ ID NO: 658146 - RNA, 19 nt, Homo sapiens
gccaagcuccggaagauuc

SEQ ID NO: 658147 - RNA, 19 nt, Homo sapiens
ccaaggugccagccaaaga

SEQ ID NO: 658148 - RNA, 19 nt, Homo sapiens
caucguggauagucaagag

SEQ ID NO: 658149 - RNA, 19 nt, Homo sapiens
aaucaggaccucacucaga

SEQ ID NO: 658150 - RNA, 19 nt, Homo sapiens
uggaggagcgccauaguau

SEQ ID NO: 658151 - RNA, 19 nt, Homo sapiens
uaaaggaaaccgaggacau

SEQ ID NO: 658152 - RNA, 19 nt, Homo sapiens
ggaacucuucaacgagaaa

SEQ ID NO: 658153 - RNA, 19 nt, Homo sapiens
ggacgagagccugaagaga

SEQ ID NO: 658154 - RNA, 19 nt, Homo sapiens
caaagagcccaucguggau

SEQ ID NO: 658155 - RNA, 19 nt, Homo sapiens
uggagaugcugacagacaa

SEQ ID NO: 658156 - RNA, 19 nt, Homo sapiens
ccaaagacaccacgaagcu

SEQ ID NO: 658157 - RNA, 19 nt, Homo sapiens
guagaggagguguuugaug

SEQ ID NO: 658158 - RNA, 19 nt, Homo sapiens
uacaagcggaucaagagua

SEQ ID NO: 658159 - RNA, 19 nt, Homo sapiens
ggagaugcugacagacaaa

SEQ ID NO: 658160 - RNA, 19 nt, Homo sapiens
caagacuucuccgacuguu

SEQ ID NO: 658161 - RNA, 19 nt, Homo sapiens
ccucauggccauccuggaa

SEQ ID NO: 658162 - RNA, 19 nt, Homo sapiens
gcacgaugagagcgccuuu

SEQ ID NO: 658163 - RNA, 19 nt, Homo sapiens
gccaaagacagcagcauuc

SEQ ID NO: 658164 - RNA, 19 nt, Homo sapiens
aaagagcccaucguggaua

SEQ ID NO: 658165 - RNA, 19 nt, Homo sapiens
ccauggccuugcuggguaa

SEQ ID NO: 658166 - RNA, 19 nt, Homo sapiens
accggaagauugccuguga

SEQ ID NO: 658167 - RNA, 19 nt, Homo sapiens
ggaaaccgaggacaucaac

SEQ ID NO: 658168 - RNA, 19 nt, Homo sapiens
gcaauggccaauguacaug

SEQ ID NO: 658169 - RNA, 19 nt, Homo sapiens
ccagaucucacucgugcaa

SEQ ID NO: 658170 - RNA, 19 nt, Homo sapiens
gcaaagacgagaucaucac

SEQ ID NO: 658171 - RNA, 19 nt, Homo sapiens
ucacagggaacaaguuuac

SEQ ID NO: 658172 - RNA, 19 nt, Homo sapiens
gugggccucucauccagaa

SEQ ID NO: 658173 - RNA, 19 nt, Homo sapiens
ugaaucaggaccucacuca

SEQ ID NO: 658174 - RNA, 19 nt, Homo sapiens
cuccaacccuuugcagaaa

SEQ ID NO: 658175 - RNA, 19 nt, Homo sapiens
guccgcauggucaucauua

SEQ ID NO: 658176 - RNA, 19 nt, Homo sapiens
ucaaggugccguacuccaa

SEQ ID NO: 658177 - RNA, 19 nt, Homo sapiens
gggcaucccggacaagauc

SEQ ID NO: 658178 - RNA, 19 nt, Homo sapiens
ugaagaugacgccaacaga

SEQ ID NO: 658179 - RNA, 19 nt, Homo sapiens
gacaucgccaacacacuaa

SEQ ID NO: 658180 - RNA, 19 nt, Homo sapiens
gccauaguauccacuucau

SEQ ID NO: 658181 - RNA, 19 nt, Homo sapiens
gugggacgccuucauaaag

SEQ ID NO: 658182 - RNA, 19 nt, Homo sapiens
cccgggaccucuuaauuac

SEQ ID NO: 658183 - RNA, 19 nt, Homo sapiens
ccucuaacccggauucagu

SEQ ID NO: 658184 - RNA, 19 nt, Homo sapiens
gauagucaagagagggauu

SEQ ID NO: 658185 - RNA, 19 nt, Homo sapiens
ucgccaagcuccggaagau

SEQ ID NO: 658186 - RNA, 19 nt, Homo sapiens
ccuggaacauggcucagau

SEQ ID NO: 658187 - RNA, 19 nt, Homo sapiens
gaggagcgccauaguaucc

SEQ ID NO: 658188 - RNA, 19 nt, Homo sapiens
aucaggaccucacucagaa

SEQ ID NO: 658189 - RNA, 19 nt, Homo sapiens
agaucucacucgugcaaug

SEQ ID NO: 658190 - RNA, 19 nt, Homo sapiens
ccaacccuuugcagaaauc

SEQ ID NO: 658191 - RNA, 19 nt, Homo sapiens
uaaccagcuccaacccuuu

SEQ ID NO: 658192 - RNA, 19 nt, Homo sapiens
agagacagggcuuucaaga

SEQ ID NO: 658193 - RNA, 19 nt, Homo sapiens
guacuccaaguuucugaug

SEQ ID NO: 658194 - RNA, 19 nt, Homo sapiens
aagcgggucucggaaggaa

SEQ ID NO: 658195 - RNA, 19 nt, Homo sapiens
ggaaggagcuacagucaga

SEQ ID NO: 658196 - RNA, 19 nt, Homo sapiens
ggaacaaguuuaccaaaga

SEQ ID NO: 658197 - RNA, 19 nt, Homo sapiens
gaaauuccgucuccucuuc

SEQ ID NO: 658198 - RNA, 19 nt, Homo sapiens
ggaacugccuccucacuug

SEQ ID NO: 658199 - RNA, 19 nt, Homo sapiens
ggauggagaugcugacaga

SEQ ID NO: 658200 - RNA, 19 nt, Homo sapiens
gcgaauggcuggcaaucuu

SEQ ID NO: 658201 - RNA, 19 nt, Homo sapiens
gcuggucccuuauaaacua

SEQ ID NO: 658202 - RNA, 19 nt, Homo sapiens
uuaagaggauguuugauga

SEQ ID NO: 658203 - RNA, 19 nt, Homo sapiens
caauguacaugguggacua

SEQ ID NO: 658204 - RNA, 19 nt, Homo sapiens
gggagaauguuccugaaug

SEQ ID NO: 658205 - RNA, 19 nt, Homo sapiens
ucacgggucugccugauga

SEQ ID NO: 658206 - RNA, 19 nt, Homo sapiens
gcucagcgcuguccaaacu

SEQ ID NO: 658207 - RNA, 19 nt, Homo sapiens
cagaaagacuaaaggaaau

SEQ ID NO: 658208 - RNA, 19 nt, Homo sapiens
ucagaaagacuaaaggaaa

SEQ ID NO: 658209 - RNA, 19 nt, Homo sapiens
acaagcggaucaagaguaa

SEQ ID NO: 658210 - RNA, 19 nt, Homo sapiens
aguauccacuucaucauua

SEQ ID NO: 658211 - RNA, 19 nt, Homo sapiens
uagaggagguguuugaugu

SEQ ID NO: 658212 - RNA, 19 nt, Homo sapiens
caucauggauagucaagga

SEQ ID NO: 658213 - RNA, 19 nt, Homo sapiens
gcaacagcauccaguuugu

SEQ ID NO: 658214 - RNA, 19 nt, Homo sapiens
gaacaaguuuaccaaagac

SEQ ID NO: 658215 - RNA, 19 nt, Homo sapiens
cgacaucgccaacacacua

SEQ ID NO: 658216 - RNA, 19 nt, Homo sapiens
gaagagacagggcuuucaa

SEQ ID NO: 658217 - RNA, 19 nt, Homo sapiens
caucggaggauucugguua

SEQ ID NO: 658218 - RNA, 19 nt, Homo sapiens
gggaacaaguuuaccaaag

SEQ ID NO: 658219 - RNA, 19 nt, Homo sapiens
gguguuugauguucuuuau

SEQ ID NO: 658220 - RNA, 19 nt, Homo sapiens
cgggaccucuuaauuacua

SEQ ID NO: 658221 - RNA, 19 nt, Homo sapiens
gcucagauguguaccuucu

SEQ ID NO: 658222 - RNA, 19 nt, Homo sapiens
gaacggugucucccugauu

SEQ ID NO: 658223 - RNA, 19 nt, Homo sapiens
gaaggccagccgaguauga

SEQ ID NO: 658224 - RNA, 19 nt, Homo sapiens
gugugcagauccuguuuaa

SEQ ID NO: 658225 - RNA, 19 nt, Homo sapiens
ggagguguuugauguucuu

SEQ ID NO: 658226 - RNA, 19 nt, Homo sapiens
ggagaauguuccugaaugc

SEQ ID NO: 658227 - RNA, 19 nt, Homo sapiens
gagacagggcuuucaagaa

SEQ ID NO: 658228 - RNA, 19 nt, Homo sapiens
gauguuugaugagcgaauu

SEQ ID NO: 658229 - RNA, 19 nt, Homo sapiens
gaggagguguuugauguuc

SEQ ID NO: 658230 - RNA, 19 nt, Homo sapiens
ggaaugcucggucagacaa

SEQ ID NO: 658231 - RNA, 19 nt, Homo sapiens
uuacugggauuacagaaca

SEQ ID NO: 658232 - RNA, 19 nt, Homo sapiens
guauccacuucaucauuaa

SEQ ID NO: 658233 - RNA, 19 nt, Homo sapiens
cgaauggcuggcaaucuua

SEQ ID NO: 658234 - RNA, 19 nt, Homo sapiens
gaugguagaggagguguuu

SEQ ID NO: 658235 - RNA, 19 nt, Homo sapiens
ucccgggaccucuuaauua

SEQ ID NO: 658236 - RNA, 19 nt, Homo sapiens
gcuccaacccuuugcagaa

SEQ ID NO: 658237 - RNA, 19 nt, Homo sapiens
cccaaagccugaugaagau

SEQ ID NO: 658238 - RNA, 19 nt, Homo sapiens
cauaguauccacuucauca

SEQ ID NO: 658239 - RNA, 19 nt, Homo sapiens
ucccaaagccugaugaaga

SEQ ID NO: 658240 - RNA, 19 nt, Homo sapiens
uccaaggacucaucccaaa

SEQ ID NO: 658241 - RNA, 19 nt, Homo sapiens
gaaagacuaaaggaaaugu

SEQ ID NO: 658242 - RNA, 19 nt, Homo sapiens
gcauccaguuugucaucaa

SEQ ID NO: 658243 - RNA, 19 nt, Homo sapiens
ucauuaagaggauguuuga

SEQ ID NO: 658244 - RNA, 19 nt, Homo sapiens
ggaccucacucagaaagac

SEQ ID NO: 658245 - RNA, 19 nt, Homo sapiens
aagaucaaguucacaguca

SEQ ID NO: 658246 - RNA, 19 nt, Homo sapiens
uccaggaccuuuucaauaa

SEQ ID NO: 658247 - RNA, 19 nt, Homo sapiens
ucacugagggagucaaaga

SEQ ID NO: 658248 - RNA, 19 nt, Homo sapiens
cagcaacagcauccaguuu

SEQ ID NO: 658249 - RNA, 19 nt, Homo sapiens
cauucucccggauuaauua

SEQ ID NO: 658250 - RNA, 19 nt, Homo sapiens
gggagcaggugaaggaacu

SEQ ID NO: 658251 - RNA, 19 nt, Homo sapiens
caaagccugaugaagauga

SEQ ID NO: 658252 - RNA, 19 nt, Homo sapiens
gccaagcuccggaagauuc

SEQ ID NO: 658253 - RNA, 19 nt, Homo sapiens
ccaaggugccagccaaaga

SEQ ID NO: 658254 - RNA, 19 nt, Homo sapiens
aaucaggaccucacucaga

SEQ ID NO: 658255 - RNA, 19 nt, Homo sapiens
uggaggagcgccauaguau

SEQ ID NO: 658256 - RNA, 19 nt, Homo sapiens
uaaaggaaaccgaggacau

SEQ ID NO: 658257 - RNA, 19 nt, Homo sapiens
ggaacucuucaacgagaaa

SEQ ID NO: 658258 - RNA, 19 nt, Homo sapiens
ggacgagagccugaagaga

SEQ ID NO: 658259 - RNA, 19 nt, Homo sapiens
uggagaugcugacagacaa

SEQ ID NO: 658260 - RNA, 19 nt, Homo sapiens
ccaaagacaccacgaagcu

SEQ ID NO: 658261 - RNA, 19 nt, Homo sapiens
guagaggagguguuugaug

SEQ ID NO: 658262 - RNA, 19 nt, Homo sapiens
gcacgaugagagcgccuuu

SEQ ID NO: 658263 - RNA, 19 nt, Homo sapiens
uacaagcggaucaagagua

SEQ ID NO: 658264 - RNA, 19 nt, Homo sapiens
ggagaugcugacagacaaa

SEQ ID NO: 658265 - RNA, 19 nt, Homo sapiens
caagacuucuccgacuguu

SEQ ID NO: 658266 - RNA, 19 nt, Homo sapiens
ccucauggccauccuggaa

SEQ ID NO: 658267 - RNA, 19 nt, Homo sapiens
gccaaagacagcagcauuc

SEQ ID NO: 658268 - RNA, 19 nt, Homo sapiens
accggaagauugccuguga

SEQ ID NO: 658269 - RNA, 19 nt, Homo sapiens
ccauggccuugcuggguaa

SEQ ID NO: 658270 - RNA, 19 nt, Homo sapiens
ggaaaccgaggacaucaac

SEQ ID NO: 658271 - RNA, 19 nt, Homo sapiens
gcaauggccaauguacaug

SEQ ID NO: 658272 - RNA, 19 nt, Homo sapiens
ccagaucucacucgugcaa

SEQ ID NO: 658273 - RNA, 19 nt, Homo sapiens
gcaaagacgagaucaucac

SEQ ID NO: 658274 - RNA, 19 nt, Homo sapiens
ucacagggaacaaguuuac

SEQ ID NO: 658275 - RNA, 19 nt, Homo sapiens
gugggccucucauccagaa

SEQ ID NO: 658276 - RNA, 19 nt, Homo sapiens
ugaaucaggaccucacuca

SEQ ID NO: 658277 - RNA, 19 nt, Homo sapiens
cuccaacccuuugcagaaa

SEQ ID NO: 658278 - RNA, 19 nt, Homo sapiens
guccgcauggucaucauua

SEQ ID NO: 658279 - RNA, 19 nt, Homo sapiens
ucaaggugccguacuccaa

SEQ ID NO: 658280 - RNA, 19 nt, Homo sapiens
gggcaucccggacaagauc

SEQ ID NO: 658281 - RNA, 19 nt, Homo sapiens
ugaagaugacgccaacaga

SEQ ID NO: 658282 - RNA, 19 nt, Homo sapiens
gacaucgccaacacacuaa

SEQ ID NO: 658283 - RNA, 19 nt, Homo sapiens
gccauaguauccacuucau

SEQ ID NO: 658284 - RNA, 19 nt, Homo sapiens
gugggacgccuucauaaag

SEQ ID NO: 658285 - RNA, 19 nt, Homo sapiens
cccgggaccucuuaauuac

SEQ ID NO: 658286 - RNA, 19 nt, Homo sapiens
ccucuaacccggauucagu

SEQ ID NO: 658287 - RNA, 19 nt, Homo sapiens
ucgccaagcuccggaagau

SEQ ID NO: 658288 - RNA, 19 nt, Homo sapiens
ccuggaacauggcucagau

SEQ ID NO: 658289 - RNA, 19 nt, Homo sapiens
gaggagcgccauaguaucc

SEQ ID NO: 658290 - RNA, 19 nt, Homo sapiens
aucaggaccucacucagaa

SEQ ID NO: 658291 - RNA, 19 nt, Homo sapiens
agaucucacucgugcaaug

SEQ ID NO: 658292 - RNA, 19 nt, Homo sapiens
ccaacccuuugcagaaauc

SEQ ID NO: 658293 - RNA, 19 nt, Homo sapiens
uaaccagcuccaacccuuu

SEQ ID NO: 658294 - RNA, 19 nt, Homo sapiens
agagacagggcuuucaaga

SEQ ID NO: 658295 - RNA, 19 nt, Homo sapiens
ggacaaguacuuuaugaua

SEQ ID NO: 658296 - RNA, 19 nt, Homo sapiens
gacaaguacuuuaugauag

SEQ ID NO: 658297 - RNA, 19 nt, Homo sapiens
gaagaagauccuugacauu

SEQ ID NO: 658298 - RNA, 19 nt, Homo sapiens
acgaaucacugcaguuuaa

SEQ ID NO: 658299 - RNA, 19 nt, Homo sapiens
ggacgaaucacugcaguuu

SEQ ID NO: 658300 - RNA, 19 nt, Homo sapiens
caagcagucugugcacaua

SEQ ID NO: 658301 - RNA, 19 nt, Homo sapiens
caggacaaguacuuuauga

SEQ ID NO: 658302 - RNA, 19 nt, Homo sapiens
gauauucagccgucuagaa

SEQ ID NO: 658303 - RNA, 19 nt, Homo sapiens
agaagaagauccuugacau

SEQ ID NO: 658304 - RNA, 19 nt, Homo sapiens
cgaaauccaagcaagcaua

SEQ ID NO: 658305 - RNA, 19 nt, Homo sapiens
gagugauuguggucuaauu

SEQ ID NO: 658306 - RNA, 19 nt, Homo sapiens
agacugcgcucagaaacuu

SEQ ID NO: 658307 - RNA, 19 nt, Homo sapiens
ggguugaccaguuaaagua

SEQ ID NO: 658308 - RNA, 19 nt, Homo sapiens
uuagaugggcacaauauuu

SEQ ID NO: 658309 - RNA, 19 nt, Homo sapiens
uaacuccucccuccagaaa

SEQ ID NO: 658310 - RNA, 19 nt, Homo sapiens
gggagugauuguggucuaa

SEQ ID NO: 658311 - RNA, 19 nt, Homo sapiens
gaaauguuugccugucuga

SEQ ID NO: 658312 - RNA, 19 nt, Homo sapiens
ggaugcugcugaccugugu

SEQ ID NO: 658313 - RNA, 19 nt, Homo sapiens
aagaagauccuugacauug

SEQ ID NO: 658314 - RNA, 19 nt, Homo sapiens
gaaauccaagcaagcauag

SEQ ID NO: 658315 - RNA, 19 nt, Homo sapiens
gacgaaucacugcaguuua

SEQ ID NO: 658316 - RNA, 19 nt, Homo sapiens
gcaagcauagaccagauau

SEQ ID NO: 658317 - RNA, 19 nt, Homo sapiens
aagcauagaccagauauuc

SEQ ID NO: 658318 - RNA, 19 nt, Homo sapiens
acaagcagguccacgagau

SEQ ID NO: 658319 - RNA, 19 nt, Homo sapiens
gggcuuuccaggacaagua

SEQ ID NO: 658320 - RNA, 19 nt, Homo sapiens
ggagagacagcgagaagag

SEQ ID NO: 658321 - RNA, 19 nt, Homo sapiens
gcacauaguagaaaacgaa

SEQ ID NO: 658322 - RNA, 19 nt, Homo sapiens
cgacauggauccccuguuc

SEQ ID NO: 658323 - RNA, 19 nt, Homo sapiens
acaaguacuuuaugauagg

SEQ ID NO: 658324 - RNA, 19 nt, Homo sapiens
cccagagacugaccuugaa

SEQ ID NO: 658325 - RNA, 19 nt, Homo sapiens
uagaacgucuggagauuuu

SEQ ID NO: 658326 - RNA, 19 nt, Homo sapiens
ucuagaacgucuggagauu

SEQ ID NO: 658327 - RNA, 19 nt, Homo sapiens
gcucagaaacuuccagcau

SEQ ID NO: 658328 - RNA, 19 nt, Homo sapiens
uccacgagauccagucuug

SEQ ID NO: 658329 - RNA, 19 nt, Homo sapiens
gcauagaccagauauucag

SEQ ID NO: 658330 - RNA, 19 nt, Homo sapiens
gaaccuucaccacuaacga

SEQ ID NO: 658331 - RNA, 19 nt, Homo sapiens
gcagucugugcacauagua

SEQ ID NO: 658332 - RNA, 19 nt, Homo sapiens
cagaagaagauccuugaca

SEQ ID NO: 658333 - RNA, 19 nt, Homo sapiens
gcacaauauuuuagaugga

SEQ ID NO: 658334 - RNA, 19 nt, Homo sapiens
guugaccaguuaaaguaug

SEQ ID NO: 658335 - RNA, 19 nt, Homo sapiens
uugccugucugaacuguga

SEQ ID NO: 658336 - RNA, 19 nt, Homo sapiens
ugacaccaccauaccaaug

SEQ ID NO: 658337 - RNA, 19 nt, Homo sapiens
agaagauccuugacauugc

SEQ ID NO: 658338 - RNA, 19 nt, Homo sapiens
gggagcagcaggagagaca

SEQ ID NO: 658339 - RNA, 19 nt, Homo sapiens
cuagaacgucuggagauuu

SEQ ID NO: 658340 - RNA, 19 nt, Homo sapiens
ugggagugauuguggucua

SEQ ID NO: 658341 - RNA, 19 nt, Homo sapiens
caaguguguguguguguga

SEQ ID NO: 658342 - RNA, 19 nt, Homo sapiens
gaaggggacucagaagaag

SEQ ID NO: 658343 - RNA, 19 nt, Homo sapiens
ccagauauucagccgucua

SEQ ID NO: 658344 - RNA, 19 nt, Homo sapiens
aagcaagcauagaccagau

SEQ ID NO: 658345 - RNA, 19 nt, Homo sapiens
ccaggacaaguacuuuaug

SEQ ID NO: 658346 - RNA, 19 nt, Homo sapiens
augcugggcuuguccaaca

SEQ ID NO: 658347 - RNA, 19 nt, Homo sapiens
ccaguuaaaguaugauguc

SEQ ID NO: 658348 - RNA, 19 nt, Homo sapiens
uugaccaguuaaaguauga

SEQ ID NO: 658349 - RNA, 19 nt, Homo sapiens
caaguacuuuaugauaggu

SEQ ID NO: 658350 - RNA, 19 nt, Homo sapiens
uagaugggcacaauauuuu

SEQ ID NO: 658351 - RNA, 19 nt, Homo sapiens
cgacucugacaccaccaua

SEQ ID NO: 658352 - RNA, 19 nt, Homo sapiens
ucccacagccugcaagugu

SEQ ID NO: 658353 - RNA, 19 nt, Homo sapiens
acccagagacugaccuuga

SEQ ID NO: 658354 - RNA, 19 nt, Homo sapiens
cugaggacccagagacuga

SEQ ID NO: 658355 - RNA, 19 nt, Homo sapiens
acuucggguugaccaguua

SEQ ID NO: 658356 - RNA, 19 nt, Homo sapiens
gugauuguggucuaauuuc

SEQ ID NO: 658357 - RNA, 19 nt, Homo sapiens
ccaacaugcugggcuuguc

SEQ ID NO: 658358 - RNA, 19 nt, Homo sapiens
ggacccagagacugaccuu

SEQ ID NO: 658359 - RNA, 19 nt, Homo sapiens
caggagagacagcgagaag

SEQ ID NO: 658360 - RNA, 19 nt, Homo sapiens
ggacaaguacuuuaugaua

SEQ ID NO: 658361 - RNA, 19 nt, Homo sapiens
ggacugauaggacaucuuu

SEQ ID NO: 658362 - RNA, 19 nt, Homo sapiens
gggagcagcugagccauuu

SEQ ID NO: 658363 - RNA, 19 nt, Homo sapiens
gacaaguacuuuaugauag

SEQ ID NO: 658364 - RNA, 19 nt, Homo sapiens
gaagaagauccuugacauu

SEQ ID NO: 658365 - RNA, 19 nt, Homo sapiens
acgaaucacugcaguuuaa

SEQ ID NO: 658366 - RNA, 19 nt, Homo sapiens
ggacgaaucacugcaguuu

SEQ ID NO: 658367 - RNA, 19 nt, Homo sapiens
caagcagucugugcacaua

SEQ ID NO: 658368 - RNA, 19 nt, Homo sapiens
caggacaaguacuuuauga

SEQ ID NO: 658369 - RNA, 19 nt, Homo sapiens
gauauucagccgucuagaa

SEQ ID NO: 658370 - RNA, 19 nt, Homo sapiens
agaagaagauccuugacau

SEQ ID NO: 658371 - RNA, 19 nt, Homo sapiens
cgaaauccaagcaagcaua

SEQ ID NO: 658372 - RNA, 19 nt, Homo sapiens
agacugcgcucagaaacuu

SEQ ID NO: 658373 - RNA, 19 nt, Homo sapiens
ggguugaccaguuaaagua

SEQ ID NO: 658374 - RNA, 19 nt, Homo sapiens
ugacagugguuggcuuuga

SEQ ID NO: 658375 - RNA, 19 nt, Homo sapiens
gcugagccauuuguucuug

SEQ ID NO: 658376 - RNA, 19 nt, Homo sapiens
uuagaugggcacaauauuu

SEQ ID NO: 658377 - RNA, 19 nt, Homo sapiens
uaacuccucccuccagaaa

SEQ ID NO: 658378 - RNA, 19 nt, Homo sapiens
ccaaggauccugccagaca

SEQ ID NO: 658379 - RNA, 19 nt, Homo sapiens
aagaagauccuugacauug

SEQ ID NO: 658380 - RNA, 19 nt, Homo sapiens
gaaauccaagcaagcauag

SEQ ID NO: 658381 - RNA, 19 nt, Homo sapiens
ccaguccucuaguuuggaa

SEQ ID NO: 658382 - RNA, 19 nt, Homo sapiens
gagccaguccucuaguuug

SEQ ID NO: 658383 - RNA, 19 nt, Homo sapiens
gacagugguuggcuuugau

SEQ ID NO: 658384 - RNA, 19 nt, Homo sapiens
gacgaaucacugcaguuua

SEQ ID NO: 658385 - RNA, 19 nt, Homo sapiens
gcaagcauagaccagauau

SEQ ID NO: 658386 - RNA, 19 nt, Homo sapiens
ccagacagcacacuuugga

SEQ ID NO: 658387 - RNA, 19 nt, Homo sapiens
acaagcagguccacgagau

SEQ ID NO: 658388 - RNA, 19 nt, Homo sapiens
aagcauagaccagauauuc

SEQ ID NO: 658389 - RNA, 19 nt, Homo sapiens
gggcuuuccaggacaagua

SEQ ID NO: 658390 - RNA, 19 nt, Homo sapiens
ggagagacagcgagaagag

SEQ ID NO: 658391 - RNA, 19 nt, Homo sapiens
gcacauaguagaaaacgaa

SEQ ID NO: 658392 - RNA, 19 nt, Homo sapiens
cgacauggauccccuguuc

SEQ ID NO: 658393 - RNA, 19 nt, Homo sapiens
acaaguacuuuaugauagg

SEQ ID NO: 658394 - RNA, 19 nt, Homo sapiens
cccagagacugaccuugaa

SEQ ID NO: 658395 - RNA, 19 nt, Homo sapiens
uagaacgucuggagauuuu

SEQ ID NO: 658396 - RNA, 19 nt, Homo sapiens
ucuagaacgucuggagauu

SEQ ID NO: 658397 - RNA, 19 nt, Homo sapiens
gcucagaaacuuccagcau

SEQ ID NO: 658398 - RNA, 19 nt, Homo sapiens
uccacgagauccagucuug

SEQ ID NO: 658399 - RNA, 19 nt, Homo sapiens
gagcagcugagccauuugu

SEQ ID NO: 658400 - RNA, 19 nt, Homo sapiens
gcauagaccagauauucag

SEQ ID NO: 658401 - RNA, 19 nt, Homo sapiens
gaaccuucaccacuaacga

SEQ ID NO: 658402 - RNA, 19 nt, Homo sapiens
gcagcugagccauuuguuc

SEQ ID NO: 658403 - RNA, 19 nt, Homo sapiens
cagaagaagauccuugaca

SEQ ID NO: 658404 - RNA, 19 nt, Homo sapiens
gcacaauauuuuagaugga

SEQ ID NO: 658405 - RNA, 19 nt, Homo sapiens
gcagucugugcacauagua

SEQ ID NO: 658406 - RNA, 19 nt, Homo sapiens
guugaccaguuaaaguaug

SEQ ID NO: 658407 - RNA, 19 nt, Homo sapiens
uaugauaggcacccaagga

SEQ ID NO: 658408 - RNA, 19 nt, Homo sapiens
ugacaccaccauaccaaug

SEQ ID NO: 658409 - RNA, 19 nt, Homo sapiens
ugagccauuuguucuugaa

SEQ ID NO: 658410 - RNA, 19 nt, Homo sapiens
cagcugagccauuuguucu

SEQ ID NO: 658411 - RNA, 19 nt, Homo sapiens
agaagauccuugacauugc

SEQ ID NO: 658412 - RNA, 19 nt, Homo sapiens
gggagcagcaggagagaca

SEQ ID NO: 658413 - RNA, 19 nt, Homo sapiens
cuagaacgucuggagauuu

SEQ ID NO: 658414 - RNA, 19 nt, Homo sapiens
gaaggggacucagaagaag

SEQ ID NO: 658415 - RNA, 19 nt, Homo sapiens
ccagauauucagccgucua

SEQ ID NO: 658416 - RNA, 19 nt, Homo sapiens
aagcaagcauagaccagau

SEQ ID NO: 658417 - RNA, 19 nt, Homo sapiens
gugguuggcuuugaugaac

SEQ ID NO: 658418 - RNA, 19 nt, Homo sapiens
acagcacacuuuggaggaa

SEQ ID NO: 658419 - RNA, 19 nt, Homo sapiens
ccaggacaaguacuuuaug

SEQ ID NO: 658420 - RNA, 19 nt, Homo sapiens
augcugggcuuguccaaca

SEQ ID NO: 658421 - RNA, 19 nt, Homo sapiens
ccaguuaaaguaugauguc

SEQ ID NO: 658422 - RNA, 19 nt, Homo sapiens
uugaccaguuaaaguauga

SEQ ID NO: 658423 - RNA, 19 nt, Homo sapiens
guccucuaguuuggaauaa

SEQ ID NO: 658424 - RNA, 19 nt, Homo sapiens
uagaugggcacaauauuuu

SEQ ID NO: 658425 - RNA, 19 nt, Homo sapiens
cgacucugacaccaccaua

SEQ ID NO: 658426 - RNA, 19 nt, Homo sapiens
ccucuaguuuggaauaaaa

SEQ ID NO: 658427 - RNA, 19 nt, Homo sapiens
acccagagacugaccuuga

SEQ ID NO: 658428 - RNA, 19 nt, Homo sapiens
cugaggacccagagacuga

SEQ ID NO: 658429 - RNA, 19 nt, Homo sapiens
acuucggguugaccaguua

SEQ ID NO: 658430 - RNA, 19 nt, Homo sapiens
ccaacaugcugggcuuguc

SEQ ID NO: 658431 - RNA, 19 nt, Homo sapiens
ggacccagagacugaccuu

SEQ ID NO: 658432 - RNA, 19 nt, Homo sapiens
caggagagacagcgagaag

SEQ ID NO: 658433 - RNA, 19 nt, Homo sapiens
gcacacgucucgccucuuu

SEQ ID NO: 658434 - RNA, 19 nt, Homo sapiens
aaaggugucugaagaauga

SEQ ID NO: 658435 - RNA, 19 nt, Homo sapiens
gcacuucucucuccuuuac

SEQ ID NO: 658436 - RNA, 19 nt, Homo sapiens
caacacagguggcgucauc

SEQ ID NO: 658437 - RNA, 19 nt, Homo sapiens
caacaugcauuccgagaag

SEQ ID NO: 658438 - RNA, 19 nt, Homo sapiens
gcaaaccagaaucuuauuu

SEQ ID NO: 658439 - RNA, 19 nt, Homo sapiens
aaagcaaaccagaaucuua

SEQ ID NO: 658440 - RNA, 19 nt, Homo sapiens
gaaucgaacucugcacuuc

SEQ ID NO: 658441 - RNA, 19 nt, Homo sapiens
gaccaagucacccugcuua

SEQ ID NO: 658442 - RNA, 19 nt, Homo sapiens
cugaaucccucuauaguga

SEQ ID NO: 658443 - RNA, 19 nt, Homo sapiens
ccaugaaccuggccaacaa

SEQ ID NO: 658444 - RNA, 19 nt, Homo sapiens
ccgagaagcugcuguccuu

SEQ ID NO: 658445 - RNA, 19 nt, Homo sapiens
ucaccaagcugcugcucaa

SEQ ID NO: 658446 - RNA, 19 nt, Homo sapiens
gcucgggcauggagaauuc

SEQ ID NO: 658447 - RNA, 19 nt, Homo sapiens
gaucgcaaccucuaguuug

SEQ ID NO: 658448 - RNA, 19 nt, Homo sapiens
cagcucaccuggcaacuuc

SEQ ID NO: 658449 - RNA, 19 nt, Homo sapiens
caggagaucugggaggauu

SEQ ID NO: 658450 - RNA, 19 nt, Homo sapiens
caacuucaaugccaaccau

SEQ ID NO: 658451 - RNA, 19 nt, Homo sapiens
gcucucagcuggugaagac

SEQ ID NO: 658452 - RNA, 19 nt, Homo sapiens
cagggcaacucaaagaaug

SEQ ID NO: 658453 - RNA, 19 nt, Homo sapiens
ggcaugguguuacugugua

SEQ ID NO: 658454 - RNA, 19 nt, Homo sapiens
ugucucaaauccaauaguu

SEQ ID NO: 658455 - RNA, 19 nt, Homo sapiens
caagguccaguuugaauga

SEQ ID NO: 658456 - RNA, 19 nt, Homo sapiens
gcaaaaggcggcugagauu

SEQ ID NO: 658457 - RNA, 19 nt, Homo sapiens
gcgcuuugcuucguuguuc

SEQ ID NO: 658458 - RNA, 19 nt, Homo sapiens
ccucugauuuguucuguuc

SEQ ID NO: 658459 - RNA, 19 nt, Homo sapiens
gaacuacugcaggcugauu

SEQ ID NO: 658460 - RNA, 19 nt, Homo sapiens
gggcucuggugcugaagaa

SEQ ID NO: 658461 - RNA, 19 nt, Homo sapiens
uaacgaggcccuaaauggu

SEQ ID NO: 658462 - RNA, 19 nt, Homo sapiens
gaggacagcagccgagugu

SEQ ID NO: 658463 - RNA, 19 nt, Homo sapiens
agacccggcucgcuccuuu

SEQ ID NO: 658464 - RNA, 19 nt, Homo sapiens
uuggcagagugaaauauua

SEQ ID NO: 658465 - RNA, 19 nt, Homo sapiens
guuccugucucaaauccaa

SEQ ID NO: 658466 - RNA, 19 nt, Homo sapiens
gcagggcaacucaaagaau

SEQ ID NO: 658467 - RNA, 19 nt, Homo sapiens
gcaccgggagcuccagauu

SEQ ID NO: 658468 - RNA, 19 nt, Homo sapiens
aagcaaaccagaaucuuau

SEQ ID NO: 658469 - RNA, 19 nt, Homo sapiens
gaacggugcaggagaucug

SEQ ID NO: 658470 - RNA, 19 nt, Homo sapiens
gcagaacauccaguacaaa

SEQ ID NO: 658471 - RNA, 19 nt, Homo sapiens
caacaucaccaagcugaau

SEQ ID NO: 658472 - RNA, 19 nt, Homo sapiens
gggaaaggcucgggcaaaa

SEQ ID NO: 658473 - RNA, 19 nt, Homo sapiens
cugcuggcauguccuauga

SEQ ID NO: 658474 - RNA, 19 nt, Homo sapiens
gcggaugcuugcugagaug

SEQ ID NO: 658475 - RNA, 19 nt, Homo sapiens
ccacccagccugagugaug

SEQ ID NO: 658476 - RNA, 19 nt, Homo sapiens
gagauuggcagagugaaau

SEQ ID NO: 658477 - RNA, 19 nt, Homo sapiens
gacccgacccuccuugcua

SEQ ID NO: 658478 - RNA, 19 nt, Homo sapiens
gaacucugcacuucucucu

SEQ ID NO: 658479 - RNA, 19 nt, Homo sapiens
gugaaggaccagacaguga

SEQ ID NO: 658480 - RNA, 19 nt, Homo sapiens
gaaucccucuauagugaca

SEQ ID NO: 658481 - RNA, 19 nt, Homo sapiens
ccacaucgcugggaaaauc

SEQ ID NO: 658482 - RNA, 19 nt, Homo sapiens
caagagcaccagcaacauc

SEQ ID NO: 658483 - RNA, 19 nt, Homo sapiens
caagucacccugcuuaagg

SEQ ID NO: 658484 - RNA, 19 nt, Homo sapiens
ccagcaaugucgcuucaag

SEQ ID NO: 658485 - RNA, 19 nt, Homo sapiens
ccugagccuucuuguaaau

SEQ ID NO: 658486 - RNA, 19 nt, Homo sapiens
ucagugccauguucgacuu

SEQ ID NO: 658487 - RNA, 19 nt, Homo sapiens
agacagugauguuccuaag

SEQ ID NO: 658488 - RNA, 19 nt, Homo sapiens
gggcuuccgugaccuuucu

SEQ ID NO: 658489 - RNA, 19 nt, Homo sapiens
ccaaugacaacaacaccuu

SEQ ID NO: 658490 - RNA, 19 nt, Homo sapiens
ggcgaacggugcaggagau

SEQ ID NO: 658491 - RNA, 19 nt, Homo sapiens
uacaaaaggugucugaaga

SEQ ID NO: 658492 - RNA, 19 nt, Homo sapiens
ucucaaauccaauaguuca

SEQ ID NO: 658493 - RNA, 19 nt, Homo sapiens
guucuguuccugucucaaa

SEQ ID NO: 658494 - RNA, 19 nt, Homo sapiens
gcugagauuggcagaguga

SEQ ID NO: 658495 - RNA, 19 nt, Homo sapiens
ucaagaagugucucucugu

SEQ ID NO: 658496 - RNA, 19 nt, Homo sapiens
cagcagaacauccaguaca

SEQ ID NO: 658497 - RNA, 19 nt, Homo sapiens
ugaauggcaugguguuacu

SEQ ID NO: 658498 - RNA, 19 nt, Homo sapiens
cugcacuucucucuccuuu

SEQ ID NO: 658499 - RNA, 19 nt, Homo sapiens
gaaggaccagacagugaug

SEQ ID NO: 658500 - RNA, 19 nt, Homo sapiens
gcugaauggcaugguguua

SEQ ID NO: 658501 - RNA, 19 nt, Homo sapiens
aucgagagaucuucaccua

SEQ ID NO: 658502 - RNA, 19 nt, Homo sapiens
caaaaggugucugaagaau

SEQ ID NO: 658503 - RNA, 19 nt, Homo sapiens
gcagagugaaauauuacug

SEQ ID NO: 658504 - RNA, 19 nt, Homo sapiens
gaaaagcaaaccagaaucu

SEQ ID NO: 658505 - RNA, 19 nt, Homo sapiens
cccaucaccuacuuacuuc

SEQ ID NO: 658506 - RNA, 19 nt, Homo sapiens
cggcagggcaacucaaaga

SEQ ID NO: 658507 - RNA, 19 nt, Homo sapiens
caaccucuaguuugaguca

SEQ ID NO: 658508 - RNA, 19 nt, Homo sapiens
agcagaacauccaguacaa

SEQ ID NO: 658509 - RNA, 19 nt, Homo sapiens
ugagauuggcagagugaaa

SEQ ID NO: 658510 - RNA, 19 nt, Homo sapiens
ucaacucccuggcgcuuac

SEQ ID NO: 658511 - RNA, 19 nt, Homo sapiens
ggaccagacagugauguuc

SEQ ID NO: 658512 - RNA, 19 nt, Homo sapiens
cggcugagauuggcagagu

SEQ ID NO: 658513 - RNA, 19 nt, Homo sapiens
gaugacggcuccccuucuu

SEQ ID NO: 658514 - RNA, 19 nt, Homo sapiens
caacgugaaggaccagaca

SEQ ID NO: 658515 - RNA, 19 nt, Homo sapiens
ugcgggaggugguagaguu

SEQ ID NO: 658516 - RNA, 19 nt, Homo sapiens
ggagaucugggaggauuuc

SEQ ID NO: 658517 - RNA, 19 nt, Homo sapiens
ucauaacgaggcccuaaau

SEQ ID NO: 658518 - RNA, 19 nt, Homo sapiens
ccagcaacaucaccaagcu

SEQ ID NO: 658519 - RNA, 19 nt, Homo sapiens
gcucuucccaugcaaagca

SEQ ID NO: 658520 - RNA, 19 nt, Homo sapiens
ugaaggaccagacagugau

SEQ ID NO: 658521 - RNA, 19 nt, Homo sapiens
gcgggaggugguagaguuu

SEQ ID NO: 658522 - RNA, 19 nt, Homo sapiens
gcuggcauguccuaugaac

SEQ ID NO: 658523 - RNA, 19 nt, Homo sapiens
cacccagccugagugauga

SEQ ID NO: 658524 - RNA, 19 nt, Homo sapiens
gcccugaaucccucuauag

SEQ ID NO: 658525 - RNA, 19 nt, Homo sapiens
ucucugcucuucccaugca

SEQ ID NO: 658526 - RNA, 19 nt, Homo sapiens
gcagcucaccuggcaacuu

SEQ ID NO: 658527 - RNA, 19 nt, Homo sapiens
gagaugcagagugccauga

SEQ ID NO: 658528 - RNA, 19 nt, Homo sapiens
cagcaaugucgcuucaaga

SEQ ID NO: 658529 - RNA, 19 nt, Homo sapiens
gucugaagaaugagaauug

SEQ ID NO: 658530 - RNA, 19 nt, Homo sapiens
gcaacaucaccaagcugaa

SEQ ID NO: 658531 - RNA, 19 nt, Homo sapiens
gcaccagcaacaucaccaa

SEQ ID NO: 658532 - RNA, 19 nt, Homo sapiens
gcaagagcaccagcaacau

SEQ ID NO: 658533 - RNA, 19 nt, Homo sapiens
gaauaugucuuucuccaau

SEQ ID NO: 658534 - RNA, 19 nt, Homo sapiens
caaagaagauagagacuca

SEQ ID NO: 658535 - RNA, 19 nt, Homo sapiens
gaccaagguuucuuucuuu

SEQ ID NO: 658536 - RNA, 19 nt, Homo sapiens
cuaccuaucugguuuauga

SEQ ID NO: 658537 - RNA, 19 nt, Homo sapiens
uaaccugucugccaucaaa

SEQ ID NO: 658538 - RNA, 19 nt, Homo sapiens
cagaagcuccucuacuuua

SEQ ID NO: 658539 - RNA, 19 nt, Homo sapiens
gcuuucagcuuccuguuaa

SEQ ID NO: 658540 - RNA, 19 nt, Homo sapiens
ccacuuagaucgaaauguc

SEQ ID NO: 658541 - RNA, 19 nt, Homo sapiens
caauuaugcuuucaugcaa

SEQ ID NO: 658542 - RNA, 19 nt, Homo sapiens
caaagaaagggaacaguug

SEQ ID NO: 658543 - RNA, 19 nt, Homo sapiens
guucuuaggguaaaucuuu

SEQ ID NO: 658544 - RNA, 19 nt, Homo sapiens
gcagaagcuccucuacuuu

SEQ ID NO: 658545 - RNA, 19 nt, Homo sapiens
ggagauacuggucaaagaa

SEQ ID NO: 658546 - RNA, 19 nt, Homo sapiens
gcaguccaauuucaagaau

SEQ ID NO: 658547 - RNA, 19 nt, Homo sapiens
cuaagaugcucccuucaug

SEQ ID NO: 658548 - RNA, 19 nt, Homo sapiens
gggaauagaaggaguguuc

SEQ ID NO: 658549 - RNA, 19 nt, Homo sapiens
ggaguguucuuaggguaaa

SEQ ID NO: 658550 - RNA, 19 nt, Homo sapiens
gucaccagcuauucauuaa

SEQ ID NO: 658551 - RNA, 19 nt, Homo sapiens
acaaggugcuguucacuuc

SEQ ID NO: 658552 - RNA, 19 nt, Homo sapiens
agaagcuccucuacuuuaa

SEQ ID NO: 658553 - RNA, 19 nt, Homo sapiens
cagaggccaugcuucguuu

SEQ ID NO: 658554 - RNA, 19 nt, Homo sapiens
ugcagaagcuccucuacuu

SEQ ID NO: 658555 - RNA, 19 nt, Homo sapiens
agaccaagguuucuuucuu

SEQ ID NO: 658556 - RNA, 19 nt, Homo sapiens
ggauguagcuaaggauugg

SEQ ID NO: 658557 - RNA, 19 nt, Homo sapiens
aaagggaacaguugacauu

SEQ ID NO: 658558 - RNA, 19 nt, Homo sapiens
gggccaggcaguccaauuu

SEQ ID NO: 658559 - RNA, 19 nt, Homo sapiens
cucaacagcuccaauuaug

SEQ ID NO: 658560 - RNA, 19 nt, Homo sapiens
gcuaaggauuggaaugaca

SEQ ID NO: 658561 - RNA, 19 nt, Homo sapiens
gggcccaauucuuacuaua

SEQ ID NO: 658562 - RNA, 19 nt, Homo sapiens
gguaggaugucagaaaugg

SEQ ID NO: 658563 - RNA, 19 nt, Homo sapiens
uggcacaaguggaucauug

SEQ ID NO: 658564 - RNA, 19 nt, Homo sapiens
ggccaugcuucguuucuug

SEQ ID NO: 658565 - RNA, 19 nt, Homo sapiens
ucaaagaaagggaacaguu

SEQ ID NO: 658566 - RNA, 19 nt, Homo sapiens
ggaauguacuucgcuuucu

SEQ ID NO: 658567 - RNA, 19 nt, Homo sapiens
cgagacuuaugcuacguaa

SEQ ID NO: 658568 - RNA, 19 nt, Homo sapiens
cgucaccagcuauucauua

SEQ ID NO: 658569 - RNA, 19 nt, Homo sapiens
gaauguacuucgcuuucuc

SEQ ID NO: 658570 - RNA, 19 nt, Homo sapiens
agacaccugugccagacua

SEQ ID NO: 658571 - RNA, 19 nt, Homo sapiens
caauuucugggcuuagaua

SEQ ID NO: 658572 - RNA, 19 nt, Homo sapiens
ugucagaaaugggaauaga

SEQ ID NO: 658573 - RNA, 19 nt, Homo sapiens
ucacugaccaucucucuca

SEQ ID NO: 658574 - RNA, 19 nt, Homo sapiens
ggcccaauucuuacuauaa

SEQ ID NO: 658575 - RNA, 19 nt, Homo sapiens
ccaggacaauaaugacaau

SEQ ID NO: 658576 - RNA, 19 nt, Homo sapiens
uggagauacuggucaaaga

SEQ ID NO: 658577 - RNA, 19 nt, Homo sapiens
aaagaaagggaacaguuga

SEQ ID NO: 658578 - RNA, 19 nt, Homo sapiens
accaagguuucuuucuuua

SEQ ID NO: 658579 - RNA, 19 nt, Homo sapiens
ccaauuaugcuuucaugca

SEQ ID NO: 658580 - RNA, 19 nt, Homo sapiens
gugccacccuucucggaaa

SEQ ID NO: 658581 - RNA, 19 nt, Homo sapiens
gcccaauucuuacuauaac

SEQ ID NO: 658582 - RNA, 19 nt, Homo sapiens
gccaggcaguccaauuuca

SEQ ID NO: 658583 - RNA, 19 nt, Homo sapiens
ggaccuggguuggcacaag

SEQ ID NO: 658584 - RNA, 19 nt, Homo sapiens
caccagcuauucauuaacu

SEQ ID NO: 658585 - RNA, 19 nt, Homo sapiens
accaagcugucucccauuu

SEQ ID NO: 658586 - RNA, 19 nt, Homo sapiens
uagcuaaggauuggaauga

SEQ ID NO: 658587 - RNA, 19 nt, Homo sapiens
gaaagggaacaguugacau

SEQ ID NO: 658588 - RNA, 19 nt, Homo sapiens
agacuuaugcuacguaaag

SEQ ID NO: 658589 - RNA, 19 nt, Homo sapiens
caugguagucgaugaaugu

SEQ ID NO: 658590 - RNA, 19 nt, Homo sapiens
uuacugccauggagagugu

SEQ ID NO: 658591 - RNA, 19 nt, Homo sapiens
gaccuggguuggcacaagu

SEQ ID NO: 658592 - RNA, 19 nt, Homo sapiens
caguccaauuucaagaaua

SEQ ID NO: 658593 - RNA, 19 nt, Homo sapiens
guuccaaccugugccuuau

SEQ ID NO: 658594 - RNA, 19 nt, Homo sapiens
cuucguuucuugccagauu

SEQ ID NO: 658595 - RNA, 19 nt, Homo sapiens
gggaauguacuucgcuuuc

SEQ ID NO: 658596 - RNA, 19 nt, Homo sapiens
uaugaccacuuagaucgaa

SEQ ID NO: 658597 - RNA, 19 nt, Homo sapiens
gaugucagaaaugggaaua

SEQ ID NO: 658598 - RNA, 19 nt, Homo sapiens
ccagaggccaugcuucguu

SEQ ID NO: 658599 - RNA, 19 nt, Homo sapiens
guggguaggaugucagaaa

SEQ ID NO: 658600 - RNA, 19 nt, Homo sapiens
cagcuccaauuaugcuuuc

SEQ ID NO: 658601 - RNA, 19 nt, Homo sapiens
caaccugugccuuauaucu

SEQ ID NO: 658602 - RNA, 19 nt, Homo sapiens
uggguaggaugucagaaau

SEQ ID NO: 658603 - RNA, 19 nt, Homo sapiens
uccaaccugugccuuauau

SEQ ID NO: 658604 - RNA, 19 nt, Homo sapiens
caacagcuccaauuaugcu

SEQ ID NO: 658605 - RNA, 19 nt, Homo sapiens
ggcuuucagcuuccuguua

SEQ ID NO: 658606 - RNA, 19 nt, Homo sapiens
uaagccagguaaaauguuu

SEQ ID NO: 658607 - RNA, 19 nt, Homo sapiens
agaaaugggaauagaagga

SEQ ID NO: 658608 - RNA, 19 nt, Homo sapiens
ucuccaauuucugggcuua

SEQ ID NO: 658609 - RNA, 19 nt, Homo sapiens
ucagaaaugggaauagaag

SEQ ID NO: 658610 - RNA, 19 nt, Homo sapiens
caagcugucucccauuucc

SEQ ID NO: 658611 - RNA, 19 nt, Homo sapiens
ucucaacagcuccaauuau

SEQ ID NO: 658612 - RNA, 19 nt, Homo sapiens
caagguuucuuucuuuacc

SEQ ID NO: 658613 - RNA, 19 nt, Homo sapiens
agauacuggucaaagaaga

SEQ ID NO: 658614 - RNA, 19 nt, Homo sapiens
gagauacuggucaaagaag

SEQ ID NO: 658615 - RNA, 19 nt, Homo sapiens
agacaugguagucgaugaa

SEQ ID NO: 658616 - RNA, 19 nt, Homo sapiens
ggcaguccaauuucaagaa

SEQ ID NO: 658617 - RNA, 19 nt, Homo sapiens
gguuauuccuggagauacu

SEQ ID NO: 658618 - RNA, 19 nt, Homo sapiens
guucaggagccucaugugu

SEQ ID NO: 658619 - RNA, 19 nt, Homo sapiens
gcucuaccaggacaauaau

SEQ ID NO: 658620 - RNA, 19 nt, Homo sapiens
ccaagggguucauggcaaa

SEQ ID NO: 658621 - RNA, 19 nt, Homo sapiens
gauacuggucaaagaagau

SEQ ID NO: 658622 - RNA, 19 nt, Homo sapiens
ugucugccaucaaagaaag

SEQ ID NO: 658623 - RNA, 19 nt, Homo sapiens
ccauuuccaugcucuacca

SEQ ID NO: 658624 - RNA, 19 nt, Homo sapiens
guuucuuucuuuacccaaa

SEQ ID NO: 658625 - RNA, 19 nt, Homo sapiens
ucucucaacagcuccaauu

SEQ ID NO: 658626 - RNA, 19 nt, Homo sapiens
ucagcuuccuguuaauucu

SEQ ID NO: 658627 - RNA, 19 nt, Homo sapiens
ucuaccaggacaauaauga

SEQ ID NO: 658628 - RNA, 19 nt, Homo sapiens
ccaggcaguccaauuucaa

SEQ ID NO: 658629 - RNA, 19 nt, Homo sapiens
aagacaugguagucgauga

SEQ ID NO: 658630 - RNA, 19 nt, Homo sapiens
gaucagugccacccuucuc

SEQ ID NO: 658631 - RNA, 19 nt, Homo sapiens
aaggugcuguucacuucaa

SEQ ID NO: 658632 - RNA, 19 nt, Homo sapiens
cagauuuggcuuucagcuu

SEQ ID NO: 658633 - RNA, 19 nt, Homo sapiens
caaagaaggucaucauuua

SEQ ID NO: 658634 - RNA, 19 nt, Homo sapiens
gaacuaagauuuccuuugg

SEQ ID NO: 658635 - RNA, 19 nt, Homo sapiens
gaaaugaccuccagggaau

SEQ ID NO: 658636 - RNA, 19 nt, Homo sapiens
caacagacuuuacagagua

SEQ ID NO: 658637 - RNA, 19 nt, Homo sapiens
guacaaaugucuacuacaa

SEQ ID NO: 658638 - RNA, 19 nt, Homo sapiens
gaaaggcacuaaugauguu

SEQ ID NO: 658639 - RNA, 19 nt, Homo sapiens
ggaauuaguuggcagagaa

SEQ ID NO: 658640 - RNA, 19 nt, Homo sapiens
gcuggaaagugauucauua

SEQ ID NO: 658641 - RNA, 19 nt, Homo sapiens
ggacaaguguaauaaauca

SEQ ID NO: 658642 - RNA, 19 nt, Homo sapiens
gauuugcacugcuuuauuu

SEQ ID NO: 658643 - RNA, 19 nt, Homo sapiens
gcaaagaaggucaucauuu

SEQ ID NO: 658644 - RNA, 19 nt, Homo sapiens
gaguuuacaucuagacaua

SEQ ID NO: 658645 - RNA, 19 nt, Homo sapiens
ggacaaaucuacuguucug

SEQ ID NO: 658646 - RNA, 19 nt, Homo sapiens
caaagaauucugagacuua

SEQ ID NO: 658647 - RNA, 19 nt, Homo sapiens
caacaagccugaaaguaau

SEQ ID NO: 658648 - RNA, 19 nt, Homo sapiens
aaagaagugugacuagaua

SEQ ID NO: 658649 - RNA, 19 nt, Homo sapiens
uaacucacaugccuucuaa

SEQ ID NO: 658650 - RNA, 19 nt, Homo sapiens
caacuugcaccuauaaaua

SEQ ID NO: 658651 - RNA, 19 nt, Homo sapiens
aaaccuacauuccuuagua

SEQ ID NO: 658652 - RNA, 19 nt, Homo sapiens
gcacacauaggccaucuua

SEQ ID NO: 658653 - RNA, 19 nt, Homo sapiens
cgacaggacuggaaaccua

SEQ ID NO: 658654 - RNA, 19 nt, Homo sapiens
guacuuacccuucuacaaa

SEQ ID NO: 658655 - RNA, 19 nt, Homo sapiens
gaugauaaccuaacacuau

SEQ ID NO: 658656 - RNA, 19 nt, Homo sapiens
cagaaaugauucaggguua

SEQ ID NO: 658657 - RNA, 19 nt, Homo sapiens
gaacaacggacacgcauga

SEQ ID NO: 658658 - RNA, 19 nt, Homo sapiens
agaaacaccuuccagcuuu

SEQ ID NO: 658659 - RNA, 19 nt, Homo sapiens
gaggacaaguguaauaaau

SEQ ID NO: 658660 - RNA, 19 nt, Homo sapiens
ggauuuggcuucagacuca

SEQ ID NO: 658661 - RNA, 19 nt, Homo sapiens
cuacaguccucuuaaauga

SEQ ID NO: 658662 - RNA, 19 nt, Homo sapiens
gacuagauaucaaucagua

SEQ ID NO: 658663 - RNA, 19 nt, Homo sapiens
ggaaaggcaaaucauguua

SEQ ID NO: 658664 - RNA, 19 nt, Homo sapiens
caacaaagcauaagacaag

SEQ ID NO: 658665 - RNA, 19 nt, Homo sapiens
ggagaggacaaguguaaua

SEQ ID NO: 658666 - RNA, 19 nt, Homo sapiens
ucaacaagccugaaaguaa

SEQ ID NO: 658667 - RNA, 19 nt, Homo sapiens
ggaaguuucuguuucuaga

SEQ ID NO: 658668 - RNA, 19 nt, Homo sapiens
gaauggaaguuucuguuuc

SEQ ID NO: 658669 - RNA, 19 nt, Homo sapiens
uggcaagucucacuagaua

SEQ ID NO: 658670 - RNA, 19 nt, Homo sapiens
caaaggagccaucuaccua

SEQ ID NO: 658671 - RNA, 19 nt, Homo sapiens
caugacagauggaagcaua

SEQ ID NO: 658672 - RNA, 19 nt, Homo sapiens
guaagaugccuuuggauaa

SEQ ID NO: 658673 - RNA, 19 nt, Homo sapiens
cuagaaagauggacaaauc

SEQ ID NO: 658674 - RNA, 19 nt, Homo sapiens
gauccaugcuuccugguaa

SEQ ID NO: 658675 - RNA, 19 nt, Homo sapiens
agccaaagcuguuaguuaa

SEQ ID NO: 658676 - RNA, 19 nt, Homo sapiens
gaggagaggacaaguguaa

SEQ ID NO: 658677 - RNA, 19 nt, Homo sapiens
caacaggauuuucaaguua

SEQ ID NO: 658678 - RNA, 19 nt, Homo sapiens
gaacaaaagaggauuagua

SEQ ID NO: 658679 - RNA, 19 nt, Homo sapiens
gcaacaagaagaacuaaga

SEQ ID NO: 658680 - RNA, 19 nt, Homo sapiens
gacgagaacuuggcauuga

SEQ ID NO: 658681 - RNA, 19 nt, Homo sapiens
cuagauaccuucaaucauc

SEQ ID NO: 658682 - RNA, 19 nt, Homo sapiens
gagcauauguacacagaca

SEQ ID NO: 658683 - RNA, 19 nt, Homo sapiens
guagagauuucccacauuc

SEQ ID NO: 658684 - RNA, 19 nt, Homo sapiens
ggccagaguuuauuguuug

SEQ ID NO: 658685 - RNA, 19 nt, Homo sapiens
aaaaugagcucgauuguug

SEQ ID NO: 658686 - RNA, 19 nt, Homo sapiens
ccaugaaacuugagcauuc

SEQ ID NO: 658687 - RNA, 19 nt, Homo sapiens
ccucuuugcugcuuuguuu

SEQ ID NO: 658688 - RNA, 19 nt, Homo sapiens
aaacaucucuacccaguca

SEQ ID NO: 658689 - RNA, 19 nt, Homo sapiens
ccagugaugucucaagcua

SEQ ID NO: 658690 - RNA, 19 nt, Homo sapiens
gagaagauggugcaaagaa

SEQ ID NO: 658691 - RNA, 19 nt, Homo sapiens
gaaagacgacgagaacuug

SEQ ID NO: 658692 - RNA, 19 nt, Homo sapiens
ugacagagaugacaguagu

SEQ ID NO: 658693 - RNA, 19 nt, Homo sapiens
acaaaugucuacuacaaga

SEQ ID NO: 658694 - RNA, 19 nt, Homo sapiens
cuacuuagguugacagcaa

SEQ ID NO: 658695 - RNA, 19 nt, Homo sapiens
caaauucucuauguacaga

SEQ ID NO: 658696 - RNA, 19 nt, Homo sapiens
uauuauagguuccugacua

SEQ ID NO: 658697 - RNA, 19 nt, Homo sapiens
ccaugaauaucaagaauag

SEQ ID NO: 658698 - RNA, 19 nt, Homo sapiens
ggauuuagcuaacaaaaga

SEQ ID NO: 658699 - RNA, 19 nt, Homo sapiens
gcauauacuuugucuuucu

SEQ ID NO: 658700 - RNA, 19 nt, Homo sapiens
ggacaggcagauaagauuu

SEQ ID NO: 658701 - RNA, 19 nt, Homo sapiens
uaagaugccuuuggauaau

SEQ ID NO: 658702 - RNA, 19 nt, Homo sapiens
cgcgagcgcucccgaauuu

SEQ ID NO: 658703 - RNA, 19 nt, Homo sapiens
caagaauaguugucagaau

SEQ ID NO: 658704 - RNA, 19 nt, Homo sapiens
ccagaaauauuugcucaau

SEQ ID NO: 658705 - RNA, 19 nt, Homo sapiens
agaaggucaucauuuagua

SEQ ID NO: 658706 - RNA, 19 nt, Homo sapiens
gaaacguagagaucaauuu

SEQ ID NO: 658707 - RNA, 19 nt, Homo sapiens
gaaaauguguaacagaguu

SEQ ID NO: 658708 - RNA, 19 nt, Homo sapiens
ccuaauaaguuccucugaa

SEQ ID NO: 658709 - RNA, 19 nt, Homo sapiens
uaauucaggugauaacuca

SEQ ID NO: 658710 - RNA, 19 nt, Homo sapiens
gauaaugauggaacaguaa

SEQ ID NO: 658711 - RNA, 19 nt, Homo sapiens
gccaaguuguuccuacuaa

SEQ ID NO: 658712 - RNA, 19 nt, Homo sapiens
gucucaagcuacaaauuua

SEQ ID NO: 658713 - RNA, 19 nt, Homo sapiens
gaaaggcaaaucauguuau

SEQ ID NO: 658714 - RNA, 19 nt, Homo sapiens
gaagauagaguuuguuuug

SEQ ID NO: 658715 - RNA, 19 nt, Homo sapiens
ggaaagugauucauuaacc

SEQ ID NO: 658716 - RNA, 19 nt, Homo sapiens
ggacaaagcgaaaagagua

SEQ ID NO: 658717 - RNA, 19 nt, Homo sapiens
cguaguauguuauguuguu

SEQ ID NO: 658718 - RNA, 19 nt, Homo sapiens
gagaggacaaguguaauaa

SEQ ID NO: 658719 - RNA, 19 nt, Homo sapiens
gaggaacaauagacccaaa

SEQ ID NO: 658720 - RNA, 19 nt, Homo sapiens
gaacauuuaccaucugauc

SEQ ID NO: 658721 - RNA, 19 nt, Homo sapiens
ucacaugccuucuaaacgu

SEQ ID NO: 658722 - RNA, 19 nt, Homo sapiens
ggugucagugucauuauua

SEQ ID NO: 658723 - RNA, 19 nt, Homo sapiens
ucacagggcaccacccaua

SEQ ID NO: 658724 - RNA, 19 nt, Homo sapiens
ggagccaucuaccuaugaa

SEQ ID NO: 658725 - RNA, 19 nt, Homo sapiens
agagaugacaguaguauuu

SEQ ID NO: 658726 - RNA, 19 nt, Homo sapiens
gcuaaaugaccauccagua

SEQ ID NO: 658727 - RNA, 19 nt, Homo sapiens
gcagucaugguaccuagua

SEQ ID NO: 658728 - RNA, 19 nt, Homo sapiens
caugagcacuuaaugcaau

SEQ ID NO: 658729 - RNA, 19 nt, Homo sapiens
ggaaaugugcacuguugaa

SEQ ID NO: 658730 - RNA, 19 nt, Homo sapiens
aaggaaaugugcacuguug

SEQ ID NO: 658731 - RNA, 19 nt, Homo sapiens
aaagaaacguagagaucaa

SEQ ID NO: 658732 - RNA, 19 nt, Homo sapiens
ugccuucacuacaacauua

SEQ ID NO: 658733 - RNA, 19 nt, Homo sapiens
gagcaaaguuauauuguga

SEQ ID NO: 658734 - RNA, 19 nt, Homo sapiens
ggaggaaacugaugacaga

SEQ ID NO: 658735 - RNA, 19 nt, Homo sapiens
caaagaagcaggcauguaa

SEQ ID NO: 658736 - RNA, 19 nt, Homo sapiens
gcacuuagauauauugcaa

SEQ ID NO: 658737 - RNA, 19 nt, Homo sapiens
gcagacaccuccaaugaga

SEQ ID NO: 658738 - RNA, 19 nt, Homo sapiens
ggaaacugaugacagauau

SEQ ID NO: 658739 - RNA, 19 nt, Homo sapiens
gaaggagacucugaugcua

SEQ ID NO: 658740 - RNA, 19 nt, Homo sapiens
ggacagcuaucaaccacuu

SEQ ID NO: 658741 - RNA, 19 nt, Homo sapiens
gaacccugaugcuaaauug

SEQ ID NO: 658742 - RNA, 19 nt, Homo sapiens
uagcaaagcucgacgacuu

SEQ ID NO: 658743 - RNA, 19 nt, Homo sapiens
guaaggugcugccgcauga

SEQ ID NO: 658744 - RNA, 19 nt, Homo sapiens
guuaagagauggcauucaa

SEQ ID NO: 658745 - RNA, 19 nt, Homo sapiens
gaaccggaagaucauauua

SEQ ID NO: 658746 - RNA, 19 nt, Homo sapiens
ccagcuagcucaggcaaua

SEQ ID NO: 658747 - RNA, 19 nt, Homo sapiens
gggaaauaccuuuagauaa

SEQ ID NO: 658748 - RNA, 19 nt, Homo sapiens
gcuaucaaccacuuaauaa

SEQ ID NO: 658749 - RNA, 19 nt, Homo sapiens
gcagaacgcggguguaaug

SEQ ID NO: 658750 - RNA, 19 nt, Homo sapiens
ccaaugagauauaguuaag

SEQ ID NO: 658751 - RNA, 19 nt, Homo sapiens
gaacgcggguguaaugucu

SEQ ID NO: 658752 - RNA, 19 nt, Homo sapiens
aaagcauucuccagaguua

SEQ ID NO: 658753 - RNA, 19 nt, Homo sapiens
ggagacuggccaauuauaa

SEQ ID NO: 658754 - RNA, 19 nt, Homo sapiens
ccaauauucugaaacaugu

SEQ ID NO: 658755 - RNA, 19 nt, Homo sapiens
uuucacagcugguaguuaa

SEQ ID NO: 658756 - RNA, 19 nt, Homo sapiens
ggaauaguuugaagcuaau

SEQ ID NO: 658757 - RNA, 19 nt, Homo sapiens
aggaauaguuugaagcuaa

SEQ ID NO: 658758 - RNA, 19 nt, Homo sapiens
gcaaagcauucuccagagu

SEQ ID NO: 658759 - RNA, 19 nt, Homo sapiens
gagauauaguuaagagaug

SEQ ID NO: 658760 - RNA, 19 nt, Homo sapiens
gcucagaguuuacaugcau

SEQ ID NO: 658761 - RNA, 19 nt, Homo sapiens
ggaaagcuggccuugcuaa

SEQ ID NO: 658762 - RNA, 19 nt, Homo sapiens
gccagaaauugcuuugaaa

SEQ ID NO: 658763 - RNA, 19 nt, Homo sapiens
caagaauacaucaacagua

SEQ ID NO: 658764 - RNA, 19 nt, Homo sapiens
cagaagaaccggaagauca

SEQ ID NO: 658765 - RNA, 19 nt, Homo sapiens
aagcuggccuugcuaacua

SEQ ID NO: 658766 - RNA, 19 nt, Homo sapiens
ugaaggacaaggaugaaua

SEQ ID NO: 658767 - RNA, 19 nt, Homo sapiens
cagaagcuguugugaagug

SEQ ID NO: 658768 - RNA, 19 nt, Homo sapiens
caugaugcuugguuaugua

SEQ ID NO: 658769 - RNA, 19 nt, Homo sapiens
uggcagaaaugguuguuga

SEQ ID NO: 658770 - RNA, 19 nt, Homo sapiens
gaugcuaguuauauaagug

SEQ ID NO: 658771 - RNA, 19 nt, Homo sapiens
gaagacacacuccugaaca

SEQ ID NO: 658772 - RNA, 19 nt, Homo sapiens
ucauaugcuuggaagauuu

SEQ ID NO: 658773 - RNA, 19 nt, Homo sapiens
ccaucaggcucagaguuua

SEQ ID NO: 658774 - RNA, 19 nt, Homo sapiens
cugaggaucuccaaguaaa

SEQ ID NO: 658775 - RNA, 19 nt, Homo sapiens
gagacucugaugcuaguua

SEQ ID NO: 658776 - RNA, 19 nt, Homo sapiens
uggauacgcuggucauaug

SEQ ID NO: 658777 - RNA, 19 nt, Homo sapiens
uuccacagcuuguuuauuc

SEQ ID NO: 658778 - RNA, 19 nt, Homo sapiens
ucaacagacugcugcuuug

SEQ ID NO: 658779 - RNA, 19 nt, Homo sapiens
gcagaguaguuuugaguaa

SEQ ID NO: 658780 - RNA, 19 nt, Homo sapiens
ccgaggaaauagugaggua

SEQ ID NO: 658781 - RNA, 19 nt, Homo sapiens
agaaaugguuguugaagca

SEQ ID NO: 658782 - RNA, 19 nt, Homo sapiens
ccugaacccugaugcuaaa

SEQ ID NO: 658783 - RNA, 19 nt, Homo sapiens
ucagugauauugcaaagca

SEQ ID NO: 658784 - RNA, 19 nt, Homo sapiens
gaaacugaugacagauaua

SEQ ID NO: 658785 - RNA, 19 nt, Homo sapiens
ugggaaauaccuuuagaua

SEQ ID NO: 658786 - RNA, 19 nt, Homo sapiens
uaccagcccuugaaccauu

SEQ ID NO: 658787 - RNA, 19 nt, Homo sapiens
gaagaaccggaagaucaua

SEQ ID NO: 658788 - RNA, 19 nt, Homo sapiens
caaauucacagcagaguag

SEQ ID NO: 658789 - RNA, 19 nt, Homo sapiens
cuuaauaacugagcaaagu

SEQ ID NO: 658790 - RNA, 19 nt, Homo sapiens
cauaaagaauauccugcaa

SEQ ID NO: 658791 - RNA, 19 nt, Homo sapiens
uggcagucaucauuucuaa

SEQ ID NO: 658792 - RNA, 19 nt, Homo sapiens
gcugcagccugggcacuua

SEQ ID NO: 658793 - RNA, 19 nt, Homo sapiens
guaaugucuuugcugagaa

SEQ ID NO: 658794 - RNA, 19 nt, Homo sapiens
aaacauacacccgagcuuu

SEQ ID NO: 658795 - RNA, 19 nt, Homo sapiens
ggacagauuggaagacaca

SEQ ID NO: 658796 - RNA, 19 nt, Homo sapiens
ggacccaguucgugcagau

SEQ ID NO: 658797 - RNA, 19 nt, Homo sapiens
ugccaguucugcuuucuuu

SEQ ID NO: 658798 - RNA, 19 nt, Homo sapiens
gcuguugcagucacaaaua

SEQ ID NO: 658799 - RNA, 19 nt, Homo sapiens
uguaaugucuuugcugaga

SEQ ID NO: 658800 - RNA, 19 nt, Homo sapiens
gagacuggccaauuauaau

SEQ ID NO: 658801 - RNA, 19 nt, Homo sapiens
agacaccuccaaugagaua

SEQ ID NO: 658802 - RNA, 19 nt, Homo sapiens
gcauaggauuuguucuaca

SEQ ID NO: 658803 - RNA, 19 nt, Homo sapiens
uugaauaugugaggaacua

SEQ ID NO: 658804 - RNA, 19 nt, Homo sapiens
ugagcaaaguuauauugug

SEQ ID NO: 658805 - RNA, 19 nt, Homo sapiens
caucaacaguauuaacagu

SEQ ID NO: 658806 - RNA, 19 nt, Homo sapiens
guacaugucaacagaaagu

SEQ ID NO: 658807 - RNA, 19 nt, Homo sapiens
ggaugaauacgugaagaaa

SEQ ID NO: 658808 - RNA, 19 nt, Homo sapiens
gaaggacaaggaugaauac

SEQ ID NO: 658809 - RNA, 19 nt, Homo sapiens
uuacuccucuuuaucacaa

SEQ ID NO: 658810 - RNA, 19 nt, Homo sapiens
gaacuauucauggucauuc

SEQ ID NO: 658811 - RNA, 19 nt, Homo sapiens
caguucugcuuucuuugua

SEQ ID NO: 658812 - RNA, 19 nt, Homo sapiens
gggagacuggccaauuaua

SEQ ID NO: 658813 - RNA, 19 nt, Homo sapiens
uaucuaaaguguuccuuac

SEQ ID NO: 658814 - RNA, 19 nt, Homo sapiens
ugaaggaggaaacugauga

SEQ ID NO: 658815 - RNA, 19 nt, Homo sapiens
uggccuugcuaacuauaua

SEQ ID NO: 658816 - RNA, 19 nt, Homo sapiens
cuaaaguguuccuuaccuu

SEQ ID NO: 658817 - RNA, 19 nt, Homo sapiens
cacccuaucuaaaguguuc

SEQ ID NO: 658818 - RNA, 19 nt, Homo sapiens
guaguauacacaagagaaa

SEQ ID NO: 658819 - RNA, 19 nt, Homo sapiens
gugaggaacuauucauggu

SEQ ID NO: 658820 - RNA, 19 nt, Homo sapiens
caucauuucuaagggugua

SEQ ID NO: 658821 - RNA, 19 nt, Homo sapiens
gcagucaucauuucuaagg

SEQ ID NO: 658822 - RNA, 19 nt, Homo sapiens
caaagcauucuccagaguu

SEQ ID NO: 658823 - RNA, 19 nt, Homo sapiens
agccagaaauugcuuugaa

SEQ ID NO: 658824 - RNA, 19 nt, Homo sapiens
ccugggcacuuagauauau

SEQ ID NO: 658825 - RNA, 19 nt, Homo sapiens
gaaccauuucuauaugaug

SEQ ID NO: 658826 - RNA, 19 nt, Homo sapiens
cuacuuaccagcccuugaa

SEQ ID NO: 658827 - RNA, 19 nt, Homo sapiens
gacguggucccaacaauuc

SEQ ID NO: 658828 - RNA, 19 nt, Homo sapiens
gucauaugcuuggaagauu

SEQ ID NO: 658829 - RNA, 19 nt, Homo sapiens
gauauacagggcacuugaa

SEQ ID NO: 658830 - RNA, 19 nt, Homo sapiens
ucaaccacuuaauaacuga

SEQ ID NO: 658831 - RNA, 19 nt, Homo sapiens
ugcaaguguucgagcaaua

SEQ ID NO: 658832 - RNA, 19 nt, Homo sapiens
aacaagugguggccuuaaa

SEQ ID NO: 658833 - RNA, 19 nt, Homo sapiens
gagcaaaguuauauuguga

SEQ ID NO: 658834 - RNA, 19 nt, Homo sapiens
ggaggaaacugaugacaga

SEQ ID NO: 658835 - RNA, 19 nt, Homo sapiens
caaagaagcaggcauguaa

SEQ ID NO: 658836 - RNA, 19 nt, Homo sapiens
gcacuuagauauauugcaa

SEQ ID NO: 658837 - RNA, 19 nt, Homo sapiens
gcagacaccuccaaugaga

SEQ ID NO: 658838 - RNA, 19 nt, Homo sapiens
ggaaacugaugacagauau

SEQ ID NO: 658839 - RNA, 19 nt, Homo sapiens
gaaggagacucugaugcua

SEQ ID NO: 658840 - RNA, 19 nt, Homo sapiens
ggacagcuaucaaccacuu

SEQ ID NO: 658841 - RNA, 19 nt, Homo sapiens
gaacccugaugcuaaauug

SEQ ID NO: 658842 - RNA, 19 nt, Homo sapiens
guuaagagauggcauucaa

SEQ ID NO: 658843 - RNA, 19 nt, Homo sapiens
gaaccggaagaucauauua

SEQ ID NO: 658844 - RNA, 19 nt, Homo sapiens
ccagcuagcucaggcaaua

SEQ ID NO: 658845 - RNA, 19 nt, Homo sapiens
gggaaauaccuuuagauaa

SEQ ID NO: 658846 - RNA, 19 nt, Homo sapiens
gcuaucaaccacuuaauaa

SEQ ID NO: 658847 - RNA, 19 nt, Homo sapiens
gcagaacgcggguguaaug

SEQ ID NO: 658848 - RNA, 19 nt, Homo sapiens
ccaaugagauauaguuaag

SEQ ID NO: 658849 - RNA, 19 nt, Homo sapiens
gaacgcggguguaaugucu

SEQ ID NO: 658850 - RNA, 19 nt, Homo sapiens
aaagcauucuccagaguua

SEQ ID NO: 658851 - RNA, 19 nt, Homo sapiens
ggagacuggccaauuauaa

SEQ ID NO: 658852 - RNA, 19 nt, Homo sapiens
ccaauauucugaaacaugu

SEQ ID NO: 658853 - RNA, 19 nt, Homo sapiens
uuucacagcugguaguuaa

SEQ ID NO: 658854 - RNA, 19 nt, Homo sapiens
ggaauaguuugaagcuaau

SEQ ID NO: 658855 - RNA, 19 nt, Homo sapiens
aggaauaguuugaagcuaa

SEQ ID NO: 658856 - RNA, 19 nt, Homo sapiens
gcaaagcauucuccagagu

SEQ ID NO: 658857 - RNA, 19 nt, Homo sapiens
gagauauaguuaagagaug

SEQ ID NO: 658858 - RNA, 19 nt, Homo sapiens
gcucagaguuuacaugcau

SEQ ID NO: 658859 - RNA, 19 nt, Homo sapiens
ggaaagcuggccuugcuaa

SEQ ID NO: 658860 - RNA, 19 nt, Homo sapiens
gccagaaauugcuuugaaa

SEQ ID NO: 658861 - RNA, 19 nt, Homo sapiens
cagaagaaccggaagauca

SEQ ID NO: 658862 - RNA, 19 nt, Homo sapiens
aagcuggccuugcuaacua

SEQ ID NO: 658863 - RNA, 19 nt, Homo sapiens
ugaaggacaaggaugaaua

SEQ ID NO: 658864 - RNA, 19 nt, Homo sapiens
cagaagcuguugugaagug

SEQ ID NO: 658865 - RNA, 19 nt, Homo sapiens
caugaugcuugguuaugua

SEQ ID NO: 658866 - RNA, 19 nt, Homo sapiens
uggcagaaaugguuguuga

SEQ ID NO: 658867 - RNA, 19 nt, Homo sapiens
gaugcuaguuauauaagug

SEQ ID NO: 658868 - RNA, 19 nt, Homo sapiens
gaagacacacuccugaaca

SEQ ID NO: 658869 - RNA, 19 nt, Homo sapiens
ucauaugcuuggaagauuu

SEQ ID NO: 658870 - RNA, 19 nt, Homo sapiens
ccaucaggcucagaguuua

SEQ ID NO: 658871 - RNA, 19 nt, Homo sapiens
cugaggaucuccaaguaaa

SEQ ID NO: 658872 - RNA, 19 nt, Homo sapiens
gagacucugaugcuaguua

SEQ ID NO: 658873 - RNA, 19 nt, Homo sapiens
acaguucaguaagguauua

SEQ ID NO: 658874 - RNA, 19 nt, Homo sapiens
ggacaguucaguaagguau

SEQ ID NO: 658875 - RNA, 19 nt, Homo sapiens
uggauacgcuggucauaug

SEQ ID NO: 658876 - RNA, 19 nt, Homo sapiens
uuccacagcuuguuuauuc

SEQ ID NO: 658877 - RNA, 19 nt, Homo sapiens
ucaacagacugcugcuuug

SEQ ID NO: 658878 - RNA, 19 nt, Homo sapiens
gcagaguaguuuugaguaa

SEQ ID NO: 658879 - RNA, 19 nt, Homo sapiens
agaaaugguuguugaagca

SEQ ID NO: 658880 - RNA, 19 nt, Homo sapiens
ccugaacccugaugcuaaa

SEQ ID NO: 658881 - RNA, 19 nt, Homo sapiens
ucagugauauugcaaagca

SEQ ID NO: 658882 - RNA, 19 nt, Homo sapiens
gaaacugaugacagauaua

SEQ ID NO: 658883 - RNA, 19 nt, Homo sapiens
ugggaaauaccuuuagaua

SEQ ID NO: 658884 - RNA, 19 nt, Homo sapiens
uaccagcccuugaaccauu

SEQ ID NO: 658885 - RNA, 19 nt, Homo sapiens
gaagaaccggaagaucaua

SEQ ID NO: 658886 - RNA, 19 nt, Homo sapiens
caaauucacagcagaguag

SEQ ID NO: 658887 - RNA, 19 nt, Homo sapiens
cuuaauaacugagcaaagu

SEQ ID NO: 658888 - RNA, 19 nt, Homo sapiens
cauaaagaauauccugcaa

SEQ ID NO: 658889 - RNA, 19 nt, Homo sapiens
uggcagucaucauuucuaa

SEQ ID NO: 658890 - RNA, 19 nt, Homo sapiens
gcugcagccugggcacuua

SEQ ID NO: 658891 - RNA, 19 nt, Homo sapiens
guaaugucuuugcugagaa

SEQ ID NO: 658892 - RNA, 19 nt, Homo sapiens
aaacauacacccgagcuuu

SEQ ID NO: 658893 - RNA, 19 nt, Homo sapiens
ggacccaguucgugcagau

SEQ ID NO: 658894 - RNA, 19 nt, Homo sapiens
ggacagauuggaagacaca

SEQ ID NO: 658895 - RNA, 19 nt, Homo sapiens
ugccaguucugcuuucuuu

SEQ ID NO: 658896 - RNA, 19 nt, Homo sapiens
gcuguugcagucacaaaua

SEQ ID NO: 658897 - RNA, 19 nt, Homo sapiens
agacaccuccaaugagaua

SEQ ID NO: 658898 - RNA, 19 nt, Homo sapiens
gcauaggauuuguucuaca

SEQ ID NO: 658899 - RNA, 19 nt, Homo sapiens
uugaauaugugaggaacua

SEQ ID NO: 658900 - RNA, 19 nt, Homo sapiens
gagacuggccaauuauaau

SEQ ID NO: 658901 - RNA, 19 nt, Homo sapiens
ugagcaaaguuauauugug

SEQ ID NO: 658902 - RNA, 19 nt, Homo sapiens
uguaaugucuuugcugaga

SEQ ID NO: 658903 - RNA, 19 nt, Homo sapiens
guacaugucaacagaaagu

SEQ ID NO: 658904 - RNA, 19 nt, Homo sapiens
ggaugaauacgugaagaaa

SEQ ID NO: 658905 - RNA, 19 nt, Homo sapiens
gaaggacaaggaugaauac

SEQ ID NO: 658906 - RNA, 19 nt, Homo sapiens
uuacuccucuuuaucacaa

SEQ ID NO: 658907 - RNA, 19 nt, Homo sapiens
gggagacuggccaauuaua

SEQ ID NO: 658908 - RNA, 19 nt, Homo sapiens
gaacuauucauggucauuc

SEQ ID NO: 658909 - RNA, 19 nt, Homo sapiens
caguucugcuuucuuugua

SEQ ID NO: 658910 - RNA, 19 nt, Homo sapiens
uaucuaaaguguuccuuac

SEQ ID NO: 658911 - RNA, 19 nt, Homo sapiens
ugaaggaggaaacugauga

SEQ ID NO: 658912 - RNA, 19 nt, Homo sapiens
uggccuugcuaacuauaua

SEQ ID NO: 658913 - RNA, 19 nt, Homo sapiens
cuaaaguguuccuuaccuu

SEQ ID NO: 658914 - RNA, 19 nt, Homo sapiens
cacccuaucuaaaguguuc

SEQ ID NO: 658915 - RNA, 19 nt, Homo sapiens
guaguauacacaagagaaa

SEQ ID NO: 658916 - RNA, 19 nt, Homo sapiens
gugaggaacuauucauggu

SEQ ID NO: 658917 - RNA, 19 nt, Homo sapiens
caucauuucuaagggugua

SEQ ID NO: 658918 - RNA, 19 nt, Homo sapiens
gcagucaucauuucuaagg

SEQ ID NO: 658919 - RNA, 19 nt, Homo sapiens
caaagcauucuccagaguu

SEQ ID NO: 658920 - RNA, 19 nt, Homo sapiens
agccagaaauugcuuugaa

SEQ ID NO: 658921 - RNA, 19 nt, Homo sapiens
ccugggcacuuagauauau

SEQ ID NO: 658922 - RNA, 19 nt, Homo sapiens
gaaccauuucuauaugaug

SEQ ID NO: 658923 - RNA, 19 nt, Homo sapiens
cuacuuaccagcccuugaa

SEQ ID NO: 658924 - RNA, 19 nt, Homo sapiens
gacguggucccaacaauuc

SEQ ID NO: 658925 - RNA, 19 nt, Homo sapiens
gucauaugcuuggaagauu

SEQ ID NO: 658926 - RNA, 19 nt, Homo sapiens
gauauacagggcacuugaa

SEQ ID NO: 658927 - RNA, 19 nt, Homo sapiens
ucaaccacuuaauaacuga

SEQ ID NO: 658928 - RNA, 19 nt, Homo sapiens
ugcaaguguucgagcaaua

SEQ ID NO: 658929 - RNA, 19 nt, Homo sapiens
agaguuagcacagacagua

SEQ ID NO: 658930 - RNA, 19 nt, Homo sapiens
ggucauaugcuuggaagau

SEQ ID NO: 658931 - RNA, 19 nt, Homo sapiens
cauaggauuuguucuacag

SEQ ID NO: 658932 - RNA, 19 nt, Homo sapiens
cgacauucuuccacagcuu

SEQ ID NO: 658933 - RNA, 19 nt, Homo sapiens
gagagaacauggaaauuua

SEQ ID NO: 658934 - RNA, 19 nt, Homo sapiens
gaggaugucucauugauua

SEQ ID NO: 658935 - RNA, 19 nt, Homo sapiens
caacuggacuggugaauuu

SEQ ID NO: 658936 - RNA, 19 nt, Homo sapiens
gcacaggugucguggaaua

SEQ ID NO: 658937 - RNA, 19 nt, Homo sapiens
gagaguauauugcugcuuu

SEQ ID NO: 658938 - RNA, 19 nt, Homo sapiens
gcaacaauaucaccaauuc

SEQ ID NO: 658939 - RNA, 19 nt, Homo sapiens
ggaggaggaugucucauug

SEQ ID NO: 658940 - RNA, 19 nt, Homo sapiens
ggagagaacauggaaauuu

SEQ ID NO: 658941 - RNA, 19 nt, Homo sapiens
ggaaauuuaugcugggaaa

SEQ ID NO: 658942 - RNA, 19 nt, Homo sapiens
gaggauaacugacuuaaaa

SEQ ID NO: 658943 - RNA, 19 nt, Homo sapiens
gaaaguaaagccucaggaa

SEQ ID NO: 658944 - RNA, 19 nt, Homo sapiens
ugaaggaacuugugcaaca

SEQ ID NO: 658945 - RNA, 19 nt, Homo sapiens
ggaaacaccagucuugaga

SEQ ID NO: 658946 - RNA, 19 nt, Homo sapiens
ccagccaacucucacauuu

SEQ ID NO: 658947 - RNA, 19 nt, Homo sapiens
gaaaugaaauggccaaaag

SEQ ID NO: 658948 - RNA, 19 nt, Homo sapiens
gcccaacugugaccgauuu

SEQ ID NO: 658949 - RNA, 19 nt, Homo sapiens
ugagaccucuuaaguucua

SEQ ID NO: 658950 - RNA, 19 nt, Homo sapiens
ucaaggauguaaaugaaga

SEQ ID NO: 658951 - RNA, 19 nt, Homo sapiens
uggagaagaugcugaauuc

SEQ ID NO: 658952 - RNA, 19 nt, Homo sapiens
cagaugggauggaaaugaa

SEQ ID NO: 658953 - RNA, 19 nt, Homo sapiens
ucucaaggauguaaaugaa

SEQ ID NO: 658954 - RNA, 19 nt, Homo sapiens
ugaagacccuggagaagau

SEQ ID NO: 658955 - RNA, 19 nt, Homo sapiens
uaucaccaauuccaaugua

SEQ ID NO: 658956 - RNA, 19 nt, Homo sapiens
ucugagaccucuuaaguuc

SEQ ID NO: 658957 - RNA, 19 nt, Homo sapiens
ugauuacguuccucaagua

SEQ ID NO: 658958 - RNA, 19 nt, Homo sapiens
caacugugaccgauuuaaa

SEQ ID NO: 658959 - RNA, 19 nt, Homo sapiens
gcagaaggcuuuacaaaac

SEQ ID NO: 658960 - RNA, 19 nt, Homo sapiens
guacuugucaccucgaauu

SEQ ID NO: 658961 - RNA, 19 nt, Homo sapiens
gcccguagauuucagcaau

SEQ ID NO: 658962 - RNA, 19 nt, Homo sapiens
ucacauuucaguccguuua

SEQ ID NO: 658963 - RNA, 19 nt, Homo sapiens
guacgugauucaaggguau

SEQ ID NO: 658964 - RNA, 19 nt, Homo sapiens
ucaguccguuuaucacuuu

SEQ ID NO: 658965 - RNA, 19 nt, Homo sapiens
cacaaauuauggugcagua

SEQ ID NO: 658966 - RNA, 19 nt, Homo sapiens
gaagcugcccguagauuuc

SEQ ID NO: 658967 - RNA, 19 nt, Homo sapiens
cugcugauguggaaagauu

SEQ ID NO: 658968 - RNA, 19 nt, Homo sapiens
ccaacaaggugcaguacgu

SEQ ID NO: 658969 - RNA, 19 nt, Homo sapiens
gcucccgccucauguuuga

SEQ ID NO: 658970 - RNA, 19 nt, Homo sapiens
gaaccgaauaucuccaaug

SEQ ID NO: 658971 - RNA, 19 nt, Homo sapiens
gaagccgccuggaaugucu

SEQ ID NO: 658972 - RNA, 19 nt, Homo sapiens
guuuaucacuuuaccaaca

SEQ ID NO: 658973 - RNA, 19 nt, Homo sapiens
cguggaauaugaugcagaa

SEQ ID NO: 658974 - RNA, 19 nt, Homo sapiens
uggcacaggugucguggaa

SEQ ID NO: 658975 - RNA, 19 nt, Homo sapiens
cagaacugccucccgauuu

SEQ ID NO: 658976 - RNA, 19 nt, Homo sapiens
ggaaagcucuaggaaacac

SEQ ID NO: 658977 - RNA, 19 nt, Homo sapiens
cagaggaacuggccaagcu

SEQ ID NO: 658978 - RNA, 19 nt, Homo sapiens
cugaaugucucuuacuugu

SEQ ID NO: 658979 - RNA, 19 nt, Homo sapiens
cugcugaaauccaacuuga

SEQ ID NO: 658980 - RNA, 19 nt, Homo sapiens
cagacugccuguccacaug

SEQ ID NO: 658981 - RNA, 19 nt, Homo sapiens
uuugaucacuuugggcuua

SEQ ID NO: 658982 - RNA, 19 nt, Homo sapiens
gagcaaguccuggccuuug

SEQ ID NO: 658983 - RNA, 19 nt, Homo sapiens
ggaggaugucucauugauu

SEQ ID NO: 658984 - RNA, 19 nt, Homo sapiens
ugaagcugcccguagauuu

SEQ ID NO: 658985 - RNA, 19 nt, Homo sapiens
gaacauggaaauuuaugcu

SEQ ID NO: 658986 - RNA, 19 nt, Homo sapiens
gcccacgccuuucuuccaa

SEQ ID NO: 658987 - RNA, 19 nt, Homo sapiens
uggaagaaauaaacucaca

SEQ ID NO: 658988 - RNA, 19 nt, Homo sapiens
caggugucguggaauauga

SEQ ID NO: 658989 - RNA, 19 nt, Homo sapiens
gagaacauggaaauuuaug

SEQ ID NO: 658990 - RNA, 19 nt, Homo sapiens
acauugaccugccucuguu

SEQ ID NO: 658991 - RNA, 19 nt, Homo sapiens
gagcucccgccucauguuu

SEQ ID NO: 658992 - RNA, 19 nt, Homo sapiens
gauucaaggguaucacaaa

SEQ ID NO: 658993 - RNA, 19 nt, Homo sapiens
aaguaaagccucaggaaug

SEQ ID NO: 658994 - RNA, 19 nt, Homo sapiens
ggaagaaauaaacucacaa

SEQ ID NO: 658995 - RNA, 19 nt, Homo sapiens
cuaggaaacaccagucuug

SEQ ID NO: 658996 - RNA, 19 nt, Homo sapiens
ccagaugggauggaaauga

SEQ ID NO: 658997 - RNA, 19 nt, Homo sapiens
ucacucugcugcugaugug

SEQ ID NO: 658998 - RNA, 19 nt, Homo sapiens
aaaugaagacccuggagaa

SEQ ID NO: 658999 - RNA, 19 nt, Homo sapiens
aaucuugccuccuggaauc

SEQ ID NO: 659000 - RNA, 19 nt, Homo sapiens
gauuuaaacugcacauacc

SEQ ID NO: 659001 - RNA, 19 nt, Homo sapiens
caggaaugcccacgccuuu

SEQ ID NO: 659002 - RNA, 19 nt, Homo sapiens
gaucacuuugggcuuauuu

SEQ ID NO: 659003 - RNA, 19 nt, Homo sapiens
gugcaacaauaucaccaau

SEQ ID NO: 659004 - RNA, 19 nt, Homo sapiens
uuaaacugcacauaccaua

SEQ ID NO: 659005 - RNA, 19 nt, Homo sapiens
ggaaugcccacgccuuucu

SEQ ID NO: 659006 - RNA, 19 nt, Homo sapiens
agccaacucucacauuuca

SEQ ID NO: 659007 - RNA, 19 nt, Homo sapiens
caaggugcaguacgugauu

SEQ ID NO: 659008 - RNA, 19 nt, Homo sapiens
caauaucaccaauuccaau

SEQ ID NO: 659009 - RNA, 19 nt, Homo sapiens
acauuaaagugggauauca

SEQ ID NO: 659010 - RNA, 19 nt, Homo sapiens
aaguuccaguggugauuua

SEQ ID NO: 659011 - RNA, 19 nt, Homo sapiens
guuugaauaccagacauua

SEQ ID NO: 659012 - RNA, 19 nt, Homo sapiens
caauggaaagcucuaggaa

SEQ ID NO: 659013 - RNA, 19 nt, Homo sapiens
gcccuccucucuguuaguu

SEQ ID NO: 659014 - RNA, 19 nt, Homo sapiens
ccaaugcucuccccuuuca

SEQ ID NO: 659015 - RNA, 19 nt, Homo sapiens
aaaccuuugucccucaguu

SEQ ID NO: 659016 - RNA, 19 nt, Homo sapiens
ucaaggguaucacaaaaga

SEQ ID NO: 659017 - RNA, 19 nt, Homo sapiens
gaggaggaugucucauuga

SEQ ID NO: 659018 - RNA, 19 nt, Homo sapiens
gggacuggaugcuacaaac

SEQ ID NO: 659019 - RNA, 19 nt, Homo sapiens
ggagcaaguccuggccuuu

SEQ ID NO: 659020 - RNA, 19 nt, Homo sapiens
ucagcaauauccccacaua

SEQ ID NO: 659021 - RNA, 19 nt, Homo sapiens
cccguagauuucagcaaua

SEQ ID NO: 659022 - RNA, 19 nt, Homo sapiens
uuaccgaucggacuaaguu

SEQ ID NO: 659023 - RNA, 19 nt, Homo sapiens
ccucagcuuugcagaaucu

SEQ ID NO: 659024 - RNA, 19 nt, Homo sapiens
ccagaacugccucccgauu

SEQ ID NO: 659025 - RNA, 19 nt, Homo sapiens
aaaguaaagccucaggaau

SEQ ID NO: 659026 - RNA, 19 nt, Homo sapiens
auggaaagcucuaggaaac

SEQ ID NO: 659027 - RNA, 19 nt, Homo sapiens
guccuggccuuugcaguug

SEQ ID NO: 659028 - RNA, 19 nt, Homo sapiens
uaccaacaguggacagcuu

SEQ ID NO: 659029 - RNA, 19 nt, Homo sapiens
uaaaauguccccagaagug

SEQ ID NO: 659030 - RNA, 19 nt, Homo sapiens
uuacguuccucaaguaugc

SEQ ID NO: 659031 - RNA, 19 nt, Homo sapiens
ccguagauuucagcaauau

SEQ ID NO: 659032 - RNA, 19 nt, Homo sapiens
gaaucuugccuccuggaau

SEQ ID NO: 659033 - RNA, 19 nt, Homo sapiens
gcacaugaccugacauuua

SEQ ID NO: 659034 - RNA, 19 nt, Homo sapiens
gaagaauacugaacgaauu

SEQ ID NO: 659035 - RNA, 19 nt, Homo sapiens
gagaaacacggaaauauua

SEQ ID NO: 659036 - RNA, 19 nt, Homo sapiens
cgagaagacuuugaaauaa

SEQ ID NO: 659037 - RNA, 19 nt, Homo sapiens
gaucgaggcucucugaaga

SEQ ID NO: 659038 - RNA, 19 nt, Homo sapiens
gaacgaauuuaugcaauga

SEQ ID NO: 659039 - RNA, 19 nt, Homo sapiens
ccaaggaaauguagaauca

SEQ ID NO: 659040 - RNA, 19 nt, Homo sapiens
ccgaagagcucgaggcuuu

SEQ ID NO: 659041 - RNA, 19 nt, Homo sapiens
gagcgaugcuguuugauga

SEQ ID NO: 659042 - RNA, 19 nt, Homo sapiens
gaaggcagcuuugacauca

SEQ ID NO: 659043 - RNA, 19 nt, Homo sapiens
uuacacagcuggugaaaga

SEQ ID NO: 659044 - RNA, 19 nt, Homo sapiens
ggaaucaggucgugcaugu

SEQ ID NO: 659045 - RNA, 19 nt, Homo sapiens
gaauugagauccaaaauga

SEQ ID NO: 659046 - RNA, 19 nt, Homo sapiens
cgagugggcuaaaccauuu

SEQ ID NO: 659047 - RNA, 19 nt, Homo sapiens
aaagagcgaugcuguuuga

SEQ ID NO: 659048 - RNA, 19 nt, Homo sapiens
gaaagcaaacuaaaggauu

SEQ ID NO: 659049 - RNA, 19 nt, Homo sapiens
gucagaggcuugugauuaa

SEQ ID NO: 659050 - RNA, 19 nt, Homo sapiens
gaagaagggcucuauguca

SEQ ID NO: 659051 - RNA, 19 nt, Homo sapiens
ugaaacggcugauccuuug

SEQ ID NO: 659052 - RNA, 19 nt, Homo sapiens
gaagaaaucgaacgcuuga

SEQ ID NO: 659053 - RNA, 19 nt, Homo sapiens
ggaaauguagaaucacuuu

SEQ ID NO: 659054 - RNA, 19 nt, Homo sapiens
ggaggugcaugauucagaa

SEQ ID NO: 659055 - RNA, 19 nt, Homo sapiens
ggacgugaauggucauauc

SEQ ID NO: 659056 - RNA, 19 nt, Homo sapiens
ucgagaagacuuugaaaua

SEQ ID NO: 659057 - RNA, 19 nt, Homo sapiens
guaagaagguacaccagau

SEQ ID NO: 659058 - RNA, 19 nt, Homo sapiens
ggugacggccucucucuua

SEQ ID NO: 659059 - RNA, 19 nt, Homo sapiens
agaaggaggugcaugauuc

SEQ ID NO: 659060 - RNA, 19 nt, Homo sapiens
cuauguggguggugauuua

SEQ ID NO: 659061 - RNA, 19 nt, Homo sapiens
ggcgagagaugcuuagaga

SEQ ID NO: 659062 - RNA, 19 nt, Homo sapiens
gaaguggguugggauucua

SEQ ID NO: 659063 - RNA, 19 nt, Homo sapiens
auagacagcuggaggauga

SEQ ID NO: 659064 - RNA, 19 nt, Homo sapiens
gaagcuaacugcugaaaau

SEQ ID NO: 659065 - RNA, 19 nt, Homo sapiens
aauccgagcuggagaagaa

SEQ ID NO: 659066 - RNA, 19 nt, Homo sapiens
guuugaagaugaaugauga

SEQ ID NO: 659067 - RNA, 19 nt, Homo sapiens
guaagucucagucuuugua

SEQ ID NO: 659068 - RNA, 19 nt, Homo sapiens
gccgagauauuccauguau

SEQ ID NO: 659069 - RNA, 19 nt, Homo sapiens
ggacggagcccaagauguc

SEQ ID NO: 659070 - RNA, 19 nt, Homo sapiens
gggcacaccugacuacauc

SEQ ID NO: 659071 - RNA, 19 nt, Homo sapiens
ugagguugcuguugucaaa

SEQ ID NO: 659072 - RNA, 19 nt, Homo sapiens
ccuaggaccuuaagagaau

SEQ ID NO: 659073 - RNA, 19 nt, Homo sapiens
aaaccgagauaaagaaauc

SEQ ID NO: 659074 - RNA, 19 nt, Homo sapiens
gagaugcucuauggagaaa

SEQ ID NO: 659075 - RNA, 19 nt, Homo sapiens
cgucagaggcuugugauua

SEQ ID NO: 659076 - RNA, 19 nt, Homo sapiens
gcuuagagacccagaauug

SEQ ID NO: 659077 - RNA, 19 nt, Homo sapiens
cacaugaccugacauuuag

SEQ ID NO: 659078 - RNA, 19 nt, Homo sapiens
gcuaugagauccagagaac

SEQ ID NO: 659079 - RNA, 19 nt, Homo sapiens
agaauggaauagaggauuu

SEQ ID NO: 659080 - RNA, 19 nt, Homo sapiens
gacuuuggaucauguuuga

SEQ ID NO: 659081 - RNA, 19 nt, Homo sapiens
gauuucaccucacccuuug

SEQ ID NO: 659082 - RNA, 19 nt, Homo sapiens
gcaagcucuuccuguauga

SEQ ID NO: 659083 - RNA, 19 nt, Homo sapiens
cauaugcagucgucuguga

SEQ ID NO: 659084 - RNA, 19 nt, Homo sapiens
uaaauacgaacgagaaaga

SEQ ID NO: 659085 - RNA, 19 nt, Homo sapiens
gaaaucgaacgcuugaaga

SEQ ID NO: 659086 - RNA, 19 nt, Homo sapiens
gaaauauuaccuccugguu

SEQ ID NO: 659087 - RNA, 19 nt, Homo sapiens
ugagaaacacggaaauauu

SEQ ID NO: 659088 - RNA, 19 nt, Homo sapiens
cacagaaaguucaaugaga

SEQ ID NO: 659089 - RNA, 19 nt, Homo sapiens
aaagcaaacuaaaggauuc

SEQ ID NO: 659090 - RNA, 19 nt, Homo sapiens
ucacggauguaucugaaga

SEQ ID NO: 659091 - RNA, 19 nt, Homo sapiens
cggaagauauggcgagguu

SEQ ID NO: 659092 - RNA, 19 nt, Homo sapiens
ggauuucaccucacccuuu

SEQ ID NO: 659093 - RNA, 19 nt, Homo sapiens
cgaagcagccacugggaua

SEQ ID NO: 659094 - RNA, 19 nt, Homo sapiens
caugaagugucaccaguau

SEQ ID NO: 659095 - RNA, 19 nt, Homo sapiens
acagaaaguucaaugagau

SEQ ID NO: 659096 - RNA, 19 nt, Homo sapiens
gcucaguccuggccucaga

SEQ ID NO: 659097 - RNA, 19 nt, Homo sapiens
caacacugcuccucuugca

SEQ ID NO: 659098 - RNA, 19 nt, Homo sapiens
ggcucaaacuuccagauuu

SEQ ID NO: 659099 - RNA, 19 nt, Homo sapiens
ggaggcaguagguacaaua

SEQ ID NO: 659100 - RNA, 19 nt, Homo sapiens
gauaaacucacagcucaaa

SEQ ID NO: 659101 - RNA, 19 nt, Homo sapiens
gaaagagcgaugcuguuug

SEQ ID NO: 659102 - RNA, 19 nt, Homo sapiens
ccuagaagcaccuuauauu

SEQ ID NO: 659103 - RNA, 19 nt, Homo sapiens
cagcaaauuugaagacaag

SEQ ID NO: 659104 - RNA, 19 nt, Homo sapiens
aaacuuuccuaggaccuua

SEQ ID NO: 659105 - RNA, 19 nt, Homo sapiens
gaaucacuuuguagauaug

SEQ ID NO: 659106 - RNA, 19 nt, Homo sapiens
acaaguacguggccgaguu

SEQ ID NO: 659107 - RNA, 19 nt, Homo sapiens
ggaaguggguugggauucu

SEQ ID NO: 659108 - RNA, 19 nt, Homo sapiens
gcucaaacuuccagauuuu

SEQ ID NO: 659109 - RNA, 19 nt, Homo sapiens
uguaugagaugcucuaugg

SEQ ID NO: 659110 - RNA, 19 nt, Homo sapiens
gaccugacauuuagaacca

SEQ ID NO: 659111 - RNA, 19 nt, Homo sapiens
ugaacgaauuuaugcaaug

SEQ ID NO: 659112 - RNA, 19 nt, Homo sapiens
gcgaugcuguuugaugaaa

SEQ ID NO: 659113 - RNA, 19 nt, Homo sapiens
gcaauucaaaccgagauaa

SEQ ID NO: 659114 - RNA, 19 nt, Homo sapiens
gccugcagauggaagcuua

SEQ ID NO: 659115 - RNA, 19 nt, Homo sapiens
caccuuauauuccugaugu

SEQ ID NO: 659116 - RNA, 19 nt, Homo sapiens
gcagaagacggcaguuuua

SEQ ID NO: 659117 - RNA, 19 nt, Homo sapiens
ggaacaagcccuacaucuc

SEQ ID NO: 659118 - RNA, 19 nt, Homo sapiens
gccaaaagcucaccaguuc

SEQ ID NO: 659119 - RNA, 19 nt, Homo sapiens
ugaagaaggaggugcauga

SEQ ID NO: 659120 - RNA, 19 nt, Homo sapiens
ggauuacauuugccauuca

SEQ ID NO: 659121 - RNA, 19 nt, Homo sapiens
acacucaacuccaucgaau

SEQ ID NO: 659122 - RNA, 19 nt, Homo sapiens
gugaaacggcugauccuuu

SEQ ID NO: 659123 - RNA, 19 nt, Homo sapiens
gcucaccaguucagcauca

SEQ ID NO: 659124 - RNA, 19 nt, Homo sapiens
ggaaagcaaacuaaaggau

SEQ ID NO: 659125 - RNA, 19 nt, Homo sapiens
gauaaauacgaacgagaaa

SEQ ID NO: 659126 - RNA, 19 nt, Homo sapiens
aucgaacgcuugaagaaua

SEQ ID NO: 659127 - RNA, 19 nt, Homo sapiens
uggaauagaggauuucaaa

SEQ ID NO: 659128 - RNA, 19 nt, Homo sapiens
cgagaaccaccuguacuua

SEQ ID NO: 659129 - RNA, 19 nt, Homo sapiens
caucggaacagccuacaaa

SEQ ID NO: 659130 - RNA, 19 nt, Homo sapiens
agaaagagcgaugcuguuu

SEQ ID NO: 659131 - RNA, 19 nt, Homo sapiens
ucgaacgcuugaagaauaa

SEQ ID NO: 659132 - RNA, 19 nt, Homo sapiens
gcugagaaacacggaaaua

SEQ ID NO: 659133 - RNA, 19 nt, Homo sapiens
gggcaaagcugugcacuug

SEQ ID NO: 659134 - RNA, 19 nt, Homo sapiens
uaacuuaaccagcacauuu

SEQ ID NO: 659135 - RNA, 19 nt, Homo sapiens
gaaaucaaaucccauuguc

SEQ ID NO: 659136 - RNA, 19 nt, Homo sapiens
aaagacagaucauuucaga

SEQ ID NO: 659137 - RNA, 19 nt, Homo sapiens
gcacauuucuccuguuuac

SEQ ID NO: 659138 - RNA, 19 nt, Homo sapiens
caggaucgcuuuguacuuu

SEQ ID NO: 659139 - RNA, 19 nt, Homo sapiens
cuaaauagcccuuggauca

SEQ ID NO: 659140 - RNA, 19 nt, Homo sapiens
caaccgaaauuugaaagaa

SEQ ID NO: 659141 - RNA, 19 nt, Homo sapiens
ggcagcaccuggagaagua

SEQ ID NO: 659142 - RNA, 19 nt, Homo sapiens
gaaguauccugacuacaag

SEQ ID NO: 659143 - RNA, 19 nt, Homo sapiens
cagcacauuucuccuguuu

SEQ ID NO: 659144 - RNA, 19 nt, Homo sapiens
caaaucccauugucaccua

SEQ ID NO: 659145 - RNA, 19 nt, Homo sapiens
ggagaaguauccugacuac

SEQ ID NO: 659146 - RNA, 19 nt, Homo sapiens
cagcagauccagcagguua

SEQ ID NO: 659147 - RNA, 19 nt, Homo sapiens
ggacuucaaccgaaauuug

SEQ ID NO: 659148 - RNA, 19 nt, Homo sapiens
cauggcagcuggucuuuau

SEQ ID NO: 659149 - RNA, 19 nt, Homo sapiens
gaacugcaccaucaaguca

SEQ ID NO: 659150 - RNA, 19 nt, Homo sapiens
caagagagccuagcagaga

SEQ ID NO: 659151 - RNA, 19 nt, Homo sapiens
gcaaggcccucuauuucuc

SEQ ID NO: 659152 - RNA, 19 nt, Homo sapiens
ucaccaggaucgcuuugua

SEQ ID NO: 659153 - RNA, 19 nt, Homo sapiens
agaagcagcccuacuauga

SEQ ID NO: 659154 - RNA, 19 nt, Homo sapiens
aaggagagguuucuaggaa

SEQ ID NO: 659155 - RNA, 19 nt, Homo sapiens
ucacugcacaagauauuua

SEQ ID NO: 659156 - RNA, 19 nt, Homo sapiens
gcacagccagccaaccuaa

SEQ ID NO: 659157 - RNA, 19 nt, Homo sapiens
ggaaaucaaaucccauugu

SEQ ID NO: 659158 - RNA, 19 nt, Homo sapiens
ggaaguccaugaccaacca

SEQ ID NO: 659159 - RNA, 19 nt, Homo sapiens
cgaaacagcagccacauca

SEQ ID NO: 659160 - RNA, 19 nt, Homo sapiens
agaaguauccugacuacaa

SEQ ID NO: 659161 - RNA, 19 nt, Homo sapiens
cagcuggccuuacccauuc

SEQ ID NO: 659162 - RNA, 19 nt, Homo sapiens
gcaaaccaguggaguaucc

SEQ ID NO: 659163 - RNA, 19 nt, Homo sapiens
gaagagcgauggggaguug

SEQ ID NO: 659164 - RNA, 19 nt, Homo sapiens
gaaggagagguuucuagga

SEQ ID NO: 659165 - RNA, 19 nt, Homo sapiens
ggagaagcagcccuacuau

SEQ ID NO: 659166 - RNA, 19 nt, Homo sapiens
ggaagccaaagaugucaaa

SEQ ID NO: 659167 - RNA, 19 nt, Homo sapiens
ucaccuaacucugaagauc

SEQ ID NO: 659168 - RNA, 19 nt, Homo sapiens
gaucaguuucacaaaguuu

SEQ ID NO: 659169 - RNA, 19 nt, Homo sapiens
uggaagagguugagaagac

SEQ ID NO: 659170 - RNA, 19 nt, Homo sapiens
ggaagaccuugucccaacu

SEQ ID NO: 659171 - RNA, 19 nt, Homo sapiens
gagaagcagcccuacuaug

SEQ ID NO: 659172 - RNA, 19 nt, Homo sapiens
ugauucagcagcagcauaa

SEQ ID NO: 659173 - RNA, 19 nt, Homo sapiens
gcacguguguguguuucau

SEQ ID NO: 659174 - RNA, 19 nt, Homo sapiens
aaaguuuguucccuaagga

SEQ ID NO: 659175 - RNA, 19 nt, Homo sapiens
ggaagagguugagaagacu

SEQ ID NO: 659176 - RNA, 19 nt, Homo sapiens
ugucucagguucugugugu

SEQ ID NO: 659177 - RNA, 19 nt, Homo sapiens
ucacaugcuuuguuuccau

SEQ ID NO: 659178 - RNA, 19 nt, Homo sapiens
guugguacuuggacuuguu

SEQ ID NO: 659179 - RNA, 19 nt, Homo sapiens
gcacuugcagauacauuca

SEQ ID NO: 659180 - RNA, 19 nt, Homo sapiens
gaaacagcagccacaucaa

SEQ ID NO: 659181 - RNA, 19 nt, Homo sapiens
aagagagccuagcagagaa

SEQ ID NO: 659182 - RNA, 19 nt, Homo sapiens
caagucagaggagaagaaa

SEQ ID NO: 659183 - RNA, 19 nt, Homo sapiens
gcacaagauauuuauugag

SEQ ID NO: 659184 - RNA, 19 nt, Homo sapiens
aggagaagcagcccuacua

SEQ ID NO: 659185 - RNA, 19 nt, Homo sapiens
agucagaggagaagaaaga

SEQ ID NO: 659186 - RNA, 19 nt, Homo sapiens
guaaacauagauagugcuu

SEQ ID NO: 659187 - RNA, 19 nt, Homo sapiens
ggaucgcuuuguacuuugu

SEQ ID NO: 659188 - RNA, 19 nt, Homo sapiens
cacaugcuuuguuuccauu

SEQ ID NO: 659189 - RNA, 19 nt, Homo sapiens
ccagccaaccuaagacuau

SEQ ID NO: 659190 - RNA, 19 nt, Homo sapiens
gaagcagcccuacuaugag

SEQ ID NO: 659191 - RNA, 19 nt, Homo sapiens
ccagcuggccuuacccauu

SEQ ID NO: 659192 - RNA, 19 nt, Homo sapiens
cagguuaacaugccuuaug

SEQ ID NO: 659193 - RNA, 19 nt, Homo sapiens
cugcaaggcccucuauuuc

SEQ ID NO: 659194 - RNA, 19 nt, Homo sapiens
ucugcaaggcccucuauuu

SEQ ID NO: 659195 - RNA, 19 nt, Homo sapiens
gccucuggcugcuguaugu

SEQ ID NO: 659196 - RNA, 19 nt, Homo sapiens
aagacuauguugguacuug

SEQ ID NO: 659197 - RNA, 19 nt, Homo sapiens
cugcaagccuucccagaca

SEQ ID NO: 659198 - RNA, 19 nt, Homo sapiens
ucaagucagaggagaagaa

SEQ ID NO: 659199 - RNA, 19 nt, Homo sapiens
aaauagcccuuggaucagu

SEQ ID NO: 659200 - RNA, 19 nt, Homo sapiens
gaucuaaauagcccuugga

SEQ ID NO: 659201 - RNA, 19 nt, Homo sapiens
cauugucaccuaacucuga

SEQ ID NO: 659202 - RNA, 19 nt, Homo sapiens
uguuucaucuguucauuca

SEQ ID NO: 659203 - RNA, 19 nt, Homo sapiens
uuucugugcuucucuuugu

SEQ ID NO: 659204 - RNA, 19 nt, Homo sapiens
gaccuugucccaacucgau

SEQ ID NO: 659205 - RNA, 19 nt, Homo sapiens
aaacagcagccacaucaag

SEQ ID NO: 659206 - RNA, 19 nt, Homo sapiens
cugaucaguuucacaaagu

SEQ ID NO: 659207 - RNA, 19 nt, Homo sapiens
gaaguggugccagccauag

SEQ ID NO: 659208 - RNA, 19 nt, Homo sapiens
cugcacaagauauuuauug

SEQ ID NO: 659209 - RNA, 19 nt, Homo sapiens
agaagcuguuguccaguga

SEQ ID NO: 659210 - RNA, 19 nt, Homo sapiens
gaguacaaggcccugauga

SEQ ID NO: 659211 - RNA, 19 nt, Homo sapiens
aauagcccuuggaucagua

SEQ ID NO: 659212 - RNA, 19 nt, Homo sapiens
ccucugaucaguuucacaa

SEQ ID NO: 659213 - RNA, 19 nt, Homo sapiens
gcccucuauuucucucuuu

SEQ ID NO: 659214 - RNA, 19 nt, Homo sapiens
ggggucacaugcuuuguuu

SEQ ID NO: 659215 - RNA, 19 nt, Homo sapiens
caacaccugcagccucaga

SEQ ID NO: 659216 - RNA, 19 nt, Homo sapiens
ugaucaguuucacaaaguu

SEQ ID NO: 659217 - RNA, 19 nt, Homo sapiens
ucugaucaguuucacaaag

SEQ ID NO: 659218 - RNA, 19 nt, Homo sapiens
cuuuauuccucccucauga

SEQ ID NO: 659219 - RNA, 19 nt, Homo sapiens
gcaagccuucccagacaug

SEQ ID NO: 659220 - RNA, 19 nt, Homo sapiens
cagccaaccuaagacuaug

SEQ ID NO: 659221 - RNA, 19 nt, Homo sapiens
aggagcagauugcaaagca

SEQ ID NO: 659222 - RNA, 19 nt, Homo sapiens
cugccaugcuguuugagaa

SEQ ID NO: 659223 - RNA, 19 nt, Homo sapiens
gacauaauaaagacagauc

SEQ ID NO: 659224 - RNA, 19 nt, Homo sapiens
gaacucuauggaagccaaa

SEQ ID NO: 659225 - RNA, 19 nt, Homo sapiens
accuaacucugaagaucua

SEQ ID NO: 659226 - RNA, 19 nt, Homo sapiens
aaggaaaucaaaucccauu

SEQ ID NO: 659227 - RNA, 19 nt, Homo sapiens
caggcacuguugcugaguu

SEQ ID NO: 659228 - RNA, 19 nt, Homo sapiens
cuaagacuauguugguacu

SEQ ID NO: 659229 - RNA, 19 nt, Homo sapiens
agaaguggugccagccaua

SEQ ID NO: 659230 - RNA, 19 nt, Homo sapiens
guguguguguuucaucugu

SEQ ID NO: 659231 - RNA, 19 nt, Homo sapiens
gauccagcagguuaacaug

SEQ ID NO: 659232 - RNA, 19 nt, Homo sapiens
cagcagcagcauaagauca

SEQ ID NO: 659233 - RNA, 19 nt, Homo sapiens
gcaaccagcugccugcuua

SEQ ID NO: 659234 - RNA, 19 nt, Homo sapiens
gaacaugaauccacagauc

SEQ ID NO: 659235 - RNA, 19 nt, Homo sapiens
gaaaugugcuuccucucuu

SEQ ID NO: 659236 - RNA, 19 nt, Homo sapiens
gcaaugugcuccugaucaa

SEQ ID NO: 659237 - RNA, 19 nt, Homo sapiens
cacauucacuuucaacuuu

SEQ ID NO: 659238 - RNA, 19 nt, Homo sapiens
cuaagaggcugaacaugaa

SEQ ID NO: 659239 - RNA, 19 nt, Homo sapiens
gcccaagucuccaucauga

SEQ ID NO: 659240 - RNA, 19 nt, Homo sapiens
cauggacuaugaagaauuu

SEQ ID NO: 659241 - RNA, 19 nt, Homo sapiens
cagaucaccugguuuguau

SEQ ID NO: 659242 - RNA, 19 nt, Homo sapiens
acacuuggcugugcuauga

SEQ ID NO: 659243 - RNA, 19 nt, Homo sapiens
uggcgaagcuggccgaauu

SEQ ID NO: 659244 - RNA, 19 nt, Homo sapiens
gugauuaauuggcuccaua

SEQ ID NO: 659245 - RNA, 19 nt, Homo sapiens
caaugaaggucagcaauuc

SEQ ID NO: 659246 - RNA, 19 nt, Homo sapiens
ggacaagcguaucuaagag

SEQ ID NO: 659247 - RNA, 19 nt, Homo sapiens
ggaccugguuccuucuuug

SEQ ID NO: 659248 - RNA, 19 nt, Homo sapiens
ggguugagcagcagaauaa

SEQ ID NO: 659249 - RNA, 19 nt, Homo sapiens
ccagacacauucacuuuca

SEQ ID NO: 659250 - RNA, 19 nt, Homo sapiens
gcacaugggcuuucuaugc

SEQ ID NO: 659251 - RNA, 19 nt, Homo sapiens
gcaacgaggcuaagaaucu

SEQ ID NO: 659252 - RNA, 19 nt, Homo sapiens
gcaccuggguccugaugga

SEQ ID NO: 659253 - RNA, 19 nt, Homo sapiens
gcugugcuaugaagugaaa

SEQ ID NO: 659254 - RNA, 19 nt, Homo sapiens
gggacaagcguaucuaaga

SEQ ID NO: 659255 - RNA, 19 nt, Homo sapiens
guacaagaguaagauuaug

SEQ ID NO: 659256 - RNA, 19 nt, Homo sapiens
ggagaacacacacgugaga

SEQ ID NO: 659257 - RNA, 19 nt, Homo sapiens
agaguaagauuaugcucaa

SEQ ID NO: 659258 - RNA, 19 nt, Homo sapiens
ucuaagaggcugaacauga

SEQ ID NO: 659259 - RNA, 19 nt, Homo sapiens
gagcggauguaucgagaca

SEQ ID NO: 659260 - RNA, 19 nt, Homo sapiens
aaacgaacccauccucuau

SEQ ID NO: 659261 - RNA, 19 nt, Homo sapiens
uccaagaaaugcaaacaga

SEQ ID NO: 659262 - RNA, 19 nt, Homo sapiens
gcgugacgaucauggacua

SEQ ID NO: 659263 - RNA, 19 nt, Homo sapiens
uuacaaguguuuccagauc

SEQ ID NO: 659264 - RNA, 19 nt, Homo sapiens
gaggccagguguauuucaa

SEQ ID NO: 659265 - RNA, 19 nt, Homo sapiens
ucucuuauguuccaagugu

SEQ ID NO: 659266 - RNA, 19 nt, Homo sapiens
gcggauguaucgagacaca

SEQ ID NO: 659267 - RNA, 19 nt, Homo sapiens
ggaugggccucagucucua

SEQ ID NO: 659268 - RNA, 19 nt, Homo sapiens
cacaugggcuuucuaugca

SEQ ID NO: 659269 - RNA, 19 nt, Homo sapiens
gcucacagacaccagcaaa

SEQ ID NO: 659270 - RNA, 19 nt, Homo sapiens
gagacacauucuacgacaa

SEQ ID NO: 659271 - RNA, 19 nt, Homo sapiens
gggccucagucucuaagga

SEQ ID NO: 659272 - RNA, 19 nt, Homo sapiens
acaaugaaggucagcaauu

SEQ ID NO: 659273 - RNA, 19 nt, Homo sapiens
guguacaagaguaagauua

SEQ ID NO: 659274 - RNA, 19 nt, Homo sapiens
agaccuacuugugcuauga

SEQ ID NO: 659275 - RNA, 19 nt, Homo sapiens
ccugauggauccagacaca

SEQ ID NO: 659276 - RNA, 19 nt, Homo sapiens
cacauucuacgacaacuuu

SEQ ID NO: 659277 - RNA, 19 nt, Homo sapiens
ugaauccacagaucagaaa

SEQ ID NO: 659278 - RNA, 19 nt, Homo sapiens
guacaaugaaggucagcaa

SEQ ID NO: 659279 - RNA, 19 nt, Homo sapiens
aaaugugcuuccucucuug

SEQ ID NO: 659280 - RNA, 19 nt, Homo sapiens
gcccugggauggacuagag

SEQ ID NO: 659281 - RNA, 19 nt, Homo sapiens
caugaccuacgaugaguuu

SEQ ID NO: 659282 - RNA, 19 nt, Homo sapiens
ccagcugccugcuuacaag

SEQ ID NO: 659283 - RNA, 19 nt, Homo sapiens
gcacagccaagcccugagu

SEQ ID NO: 659284 - RNA, 19 nt, Homo sapiens
ugauggauccagacacauu

SEQ ID NO: 659285 - RNA, 19 nt, Homo sapiens
auucaugccuugguacaaa

SEQ ID NO: 659286 - RNA, 19 nt, Homo sapiens
cgacaacuuugaaaacgaa

SEQ ID NO: 659287 - RNA, 19 nt, Homo sapiens
ugaccuacgaugaguuuga

SEQ ID NO: 659288 - RNA, 19 nt, Homo sapiens
cugcccgcaucuaugauua

SEQ ID NO: 659289 - RNA, 19 nt, Homo sapiens
ggacuaugaagaauuugca

SEQ ID NO: 659290 - RNA, 19 nt, Homo sapiens
caaguguacaagaguaaga

SEQ ID NO: 659291 - RNA, 19 nt, Homo sapiens
ucuacagggucacuugguu

SEQ ID NO: 659292 - RNA, 19 nt, Homo sapiens
cagcacaugggcuuucuau

SEQ ID NO: 659293 - RNA, 19 nt, Homo sapiens
gauccagacacauucacuu

SEQ ID NO: 659294 - RNA, 19 nt, Homo sapiens
gguacaaauucgaugaaaa

SEQ ID NO: 659295 - RNA, 19 nt, Homo sapiens
uacaaguguuuccagauca

SEQ ID NO: 659296 - RNA, 19 nt, Homo sapiens
gaccuacgaugaguuugag

SEQ ID NO: 659297 - RNA, 19 nt, Homo sapiens
acacauucacuuucaacuu

SEQ ID NO: 659298 - RNA, 19 nt, Homo sapiens
ucaguaccacgcagaaaug

SEQ ID NO: 659299 - RNA, 19 nt, Homo sapiens
cgaugaaaauuaugcauuc

SEQ ID NO: 659300 - RNA, 19 nt, Homo sapiens
gcugccugcuuacaagugu

SEQ ID NO: 659301 - RNA, 19 nt, Homo sapiens
gauuaauuggcuccauauu

SEQ ID NO: 659302 - RNA, 19 nt, Homo sapiens
ccagaauaguuuucaaugu

SEQ ID NO: 659303 - RNA, 19 nt, Homo sapiens
gaugggccucagucucuaa

SEQ ID NO: 659304 - RNA, 19 nt, Homo sapiens
cagacacauucacuuucaa

SEQ ID NO: 659305 - RNA, 19 nt, Homo sapiens
uaucuaagaggcugaacau

SEQ ID NO: 659306 - RNA, 19 nt, Homo sapiens
uuccaaguguacaagagua

SEQ ID NO: 659307 - RNA, 19 nt, Homo sapiens
ggacagggacaagcguauc

SEQ ID NO: 659308 - RNA, 19 nt, Homo sapiens
cagggacaagcguaucuaa

SEQ ID NO: 659309 - RNA, 19 nt, Homo sapiens
cagggucacuugguucauc

SEQ ID NO: 659310 - RNA, 19 nt, Homo sapiens
agcaauucaugccuuggua

SEQ ID NO: 659311 - RNA, 19 nt, Homo sapiens
augaagaauuugcauacug

SEQ ID NO: 659312 - RNA, 19 nt, Homo sapiens
gauggauccagacacauuc

SEQ ID NO: 659313 - RNA, 19 nt, Homo sapiens
gaguaagauuaugcucaau

SEQ ID NO: 659314 - RNA, 19 nt, Homo sapiens
gaaggaugggccucagucu

SEQ ID NO: 659315 - RNA, 19 nt, Homo sapiens
ucgcugcccgcaucuauga

SEQ ID NO: 659316 - RNA, 19 nt, Homo sapiens
ugguacaaauucgaugaaa

SEQ ID NO: 659317 - RNA, 19 nt, Homo sapiens
uggcugugcuaugaaguga

SEQ ID NO: 659318 - RNA, 19 nt, Homo sapiens
agaaaugugcuuccucucu

SEQ ID NO: 659319 - RNA, 19 nt, Homo sapiens
ggccucagucucuaaggaa

SEQ ID NO: 659320 - RNA, 19 nt, Homo sapiens
cuacuacuacugggaaaga

SEQ ID NO: 659321 - RNA, 19 nt, Homo sapiens
uggaccugguuccuucuuu

SEQ ID NO: 659322 - RNA, 19 nt, Homo sapiens
gaaucuucucuguggcuuu

SEQ ID NO: 659323 - RNA, 19 nt, Homo sapiens
acagacaccagcaaagcaa

SEQ ID NO: 659324 - RNA, 19 nt, Homo sapiens
gcugcccgcaucuaugauu

SEQ ID NO: 659325 - RNA, 19 nt, Homo sapiens
uggagcgccuggacaaugg

SEQ ID NO: 659326 - RNA, 19 nt, Homo sapiens
guggagcgccuggacaaug

SEQ ID NO: 659327 - RNA, 19 nt, Homo sapiens
gaaagucagugauuacauu

SEQ ID NO: 659328 - RNA, 19 nt, Homo sapiens
cuacaaugcugcuaaauuu

SEQ ID NO: 659329 - RNA, 19 nt, Homo sapiens
gcaacaaagugguccauuu

SEQ ID NO: 659330 - RNA, 19 nt, Homo sapiens
gcucacagcuccacgaaga

SEQ ID NO: 659331 - RNA, 19 nt, Homo sapiens
cagagaaagucagugauua

SEQ ID NO: 659332 - RNA, 19 nt, Homo sapiens
gaaagccaguggucaugaa

SEQ ID NO: 659333 - RNA, 19 nt, Homo sapiens
gagagacuauccagccuuu

SEQ ID NO: 659334 - RNA, 19 nt, Homo sapiens
gcacuuugacuuucuguuu

SEQ ID NO: 659335 - RNA, 19 nt, Homo sapiens
gacaagaaauuucaaaggu

SEQ ID NO: 659336 - RNA, 19 nt, Homo sapiens
gaauuuaacuugggaugug

SEQ ID NO: 659337 - RNA, 19 nt, Homo sapiens
gcgaagccauuguccguaa

SEQ ID NO: 659338 - RNA, 19 nt, Homo sapiens
cacaugaucuguuggauau

SEQ ID NO: 659339 - RNA, 19 nt, Homo sapiens
gagauacgaagacagaaua

SEQ ID NO: 659340 - RNA, 19 nt, Homo sapiens
gauuacauuucuccacuuu

SEQ ID NO: 659341 - RNA, 19 nt, Homo sapiens
ccaauucacuuccagaaca

SEQ ID NO: 659342 - RNA, 19 nt, Homo sapiens
gcaaaggauuauugugcaa

SEQ ID NO: 659343 - RNA, 19 nt, Homo sapiens
gcauguguaucgagucuau

SEQ ID NO: 659344 - RNA, 19 nt, Homo sapiens
gaggauguguuacgaaugg

SEQ ID NO: 659345 - RNA, 19 nt, Homo sapiens
cagugggucucgaguauuu

SEQ ID NO: 659346 - RNA, 19 nt, Homo sapiens
gcaggaagaaguagcuaaa

SEQ ID NO: 659347 - RNA, 19 nt, Homo sapiens
gaaacaggaagguguguau

SEQ ID NO: 659348 - RNA, 19 nt, Homo sapiens
ggucucgaguauuuguuua

SEQ ID NO: 659349 - RNA, 19 nt, Homo sapiens
caaauuauggucauuagug

SEQ ID NO: 659350 - RNA, 19 nt, Homo sapiens
gauuugagcauauugaaga

SEQ ID NO: 659351 - RNA, 19 nt, Homo sapiens
agacugccuugcaaguuua

SEQ ID NO: 659352 - RNA, 19 nt, Homo sapiens
caaaucggccuggauguuu

SEQ ID NO: 659353 - RNA, 19 nt, Homo sapiens
cuaaagcugcaaaggauua

SEQ ID NO: 659354 - RNA, 19 nt, Homo sapiens
gaagcuacagacaccaaua

SEQ ID NO: 659355 - RNA, 19 nt, Homo sapiens
ggguuucuccucuuuauuu

SEQ ID NO: 659356 - RNA, 19 nt, Homo sapiens
gaaagcagcgaagccauug

SEQ ID NO: 659357 - RNA, 19 nt, Homo sapiens
ccaguaggguguccucgaa

SEQ ID NO: 659358 - RNA, 19 nt, Homo sapiens
ccagagcauugccuuguug

SEQ ID NO: 659359 - RNA, 19 nt, Homo sapiens
caaacgagacccagacuuc

SEQ ID NO: 659360 - RNA, 19 nt, Homo sapiens
cgacagagauacgaagaca

SEQ ID NO: 659361 - RNA, 19 nt, Homo sapiens
aagacugccuugcaaguuu

SEQ ID NO: 659362 - RNA, 19 nt, Homo sapiens
ccacaugaucuguuggaua

SEQ ID NO: 659363 - RNA, 19 nt, Homo sapiens
agacuacaaugcugcuaaa

SEQ ID NO: 659364 - RNA, 19 nt, Homo sapiens
ccagagaaagucagugauu

SEQ ID NO: 659365 - RNA, 19 nt, Homo sapiens
gagcauguguaucgagucu

SEQ ID NO: 659366 - RNA, 19 nt, Homo sapiens
ugacucucaugcagaagua

SEQ ID NO: 659367 - RNA, 19 nt, Homo sapiens
acgagggacuggagacuuu

SEQ ID NO: 659368 - RNA, 19 nt, Homo sapiens
cgacucagauagcguacga

SEQ ID NO: 659369 - RNA, 19 nt, Homo sapiens
caauccacaugaucuguug

SEQ ID NO: 659370 - RNA, 19 nt, Homo sapiens
cuacaggacccgcuuucua

SEQ ID NO: 659371 - RNA, 19 nt, Homo sapiens
uacuaaagcugcaaaggau

SEQ ID NO: 659372 - RNA, 19 nt, Homo sapiens
gacccagacuucccucaau

SEQ ID NO: 659373 - RNA, 19 nt, Homo sapiens
gacagaauauuugccaaca

SEQ ID NO: 659374 - RNA, 19 nt, Homo sapiens
ucagauagcguacgaaguc

SEQ ID NO: 659375 - RNA, 19 nt, Homo sapiens
gagacuacaaugcugcuaa

SEQ ID NO: 659376 - RNA, 19 nt, Homo sapiens
aaacugagcauguguaucg

SEQ ID NO: 659377 - RNA, 19 nt, Homo sapiens
gaaagccagcagaaagcua

SEQ ID NO: 659378 - RNA, 19 nt, Homo sapiens
ucaggcaaaugagggauaa

SEQ ID NO: 659379 - RNA, 19 nt, Homo sapiens
gaaaccccgucucuacuaa

SEQ ID NO: 659380 - RNA, 19 nt, Homo sapiens
cuuaaagacugccuugcaa

SEQ ID NO: 659381 - RNA, 19 nt, Homo sapiens
caacaaagugguccauuuu

SEQ ID NO: 659382 - RNA, 19 nt, Homo sapiens
uaacuugggaugugauguu

SEQ ID NO: 659383 - RNA, 19 nt, Homo sapiens
caggguuucuccucuuuau

SEQ ID NO: 659384 - RNA, 19 nt, Homo sapiens
uauccagccuuucaugaau

SEQ ID NO: 659385 - RNA, 19 nt, Homo sapiens
cccuagacauuaaagauga

SEQ ID NO: 659386 - RNA, 19 nt, Homo sapiens
caaugcugcucgacagaga

SEQ ID NO: 659387 - RNA, 19 nt, Homo sapiens
agacaccucucuacauucu

SEQ ID NO: 659388 - RNA, 19 nt, Homo sapiens
ccagagacaagaaauuuca

SEQ ID NO: 659389 - RNA, 19 nt, Homo sapiens
gagacuauccagccuuuca

SEQ ID NO: 659390 - RNA, 19 nt, Homo sapiens
gaagguguguaugcuugga

SEQ ID NO: 659391 - RNA, 19 nt, Homo sapiens
gccaaauuauggucauuag

SEQ ID NO: 659392 - RNA, 19 nt, Homo sapiens
gagucuauguggccacguu

SEQ ID NO: 659393 - RNA, 19 nt, Homo sapiens
ggaaacaggaaggugugua

SEQ ID NO: 659394 - RNA, 19 nt, Homo sapiens
cugcacggcuggaaugaga

SEQ ID NO: 659395 - RNA, 19 nt, Homo sapiens
gcaauccacaugaucuguu

SEQ ID NO: 659396 - RNA, 19 nt, Homo sapiens
uaaccagagacaagaaauu

SEQ ID NO: 659397 - RNA, 19 nt, Homo sapiens
uccacaggcuuaaguauca

SEQ ID NO: 659398 - RNA, 19 nt, Homo sapiens
ucaccaaacugagcaugug

SEQ ID NO: 659399 - RNA, 19 nt, Homo sapiens
cauaauggcaauccacaug

SEQ ID NO: 659400 - RNA, 19 nt, Homo sapiens
gucauaauccgaaauaagu

SEQ ID NO: 659401 - RNA, 19 nt, Homo sapiens
ccgaggauguguuacgaau

SEQ ID NO: 659402 - RNA, 19 nt, Homo sapiens
acagagauacgaagacaga

SEQ ID NO: 659403 - RNA, 19 nt, Homo sapiens
ugaaagcagcgaagccauu

SEQ ID NO: 659404 - RNA, 19 nt, Homo sapiens
ggauuggcaucuccugucu

SEQ ID NO: 659405 - RNA, 19 nt, Homo sapiens
guugucauaauccgaaaua

SEQ ID NO: 659406 - RNA, 19 nt, Homo sapiens
gcugaccuccacaggcuua

SEQ ID NO: 659407 - RNA, 19 nt, Homo sapiens
ggacuguacgccucucaug

SEQ ID NO: 659408 - RNA, 19 nt, Homo sapiens
ccccaaaacuguaagcuuu

SEQ ID NO: 659409 - RNA, 19 nt, Homo sapiens
cgaagccauuguccguaaa

SEQ ID NO: 659410 - RNA, 19 nt, Homo sapiens
uugagcauauugaagauga

SEQ ID NO: 659411 - RNA, 19 nt, Homo sapiens
aaauaaguaugggcgacua

SEQ ID NO: 659412 - RNA, 19 nt, Homo sapiens
ucgagaccauccuggcuaa

SEQ ID NO: 659413 - RNA, 19 nt, Homo sapiens
cguuuccugucaacuauaa

SEQ ID NO: 659414 - RNA, 19 nt, Homo sapiens
uuacuaaagcugcaaagga

SEQ ID NO: 659415 - RNA, 19 nt, Homo sapiens
ggccacguuucuuggguuu

SEQ ID NO: 659416 - RNA, 19 nt, Homo sapiens
ggcacgaguuaccgacauu

SEQ ID NO: 659417 - RNA, 19 nt, Homo sapiens
cgacuaaccagagacaaga

SEQ ID NO: 659418 - RNA, 19 nt, Homo sapiens
uguuugagguguuucauag

SEQ ID NO: 659419 - RNA, 19 nt, Homo sapiens
gaugaaauccagcaaaaug

SEQ ID NO: 659420 - RNA, 19 nt, Homo sapiens
gagaaagucagugauuaca

SEQ ID NO: 659421 - RNA, 19 nt, Homo sapiens
aaccagagacaagaaauuu

SEQ ID NO: 659422 - RNA, 19 nt, Homo sapiens
cuacaaccacuaccuguuc

SEQ ID NO: 659423 - RNA, 19 nt, Homo sapiens
aaaucggccuggauguuug

SEQ ID NO: 659424 - RNA, 19 nt, Homo sapiens
uaauggcaauccacaugau

SEQ ID NO: 659425 - RNA, 19 nt, Homo sapiens
ggacugaaucccagagcau

SEQ ID NO: 659426 - RNA, 19 nt, Homo sapiens
aaagaugaaauccagcaaa

SEQ ID NO: 659427 - RNA, 19 nt, Homo sapiens
gaacaaaugugcuuucugu

SEQ ID NO: 659428 - RNA, 19 nt, Homo sapiens
gaacaggcguuuagagaaa

SEQ ID NO: 659429 - RNA, 19 nt, Homo sapiens
cuaaagggcuguuugguua

SEQ ID NO: 659430 - RNA, 19 nt, Homo sapiens
gcaaggaucuacugucauu

SEQ ID NO: 659431 - RNA, 19 nt, Homo sapiens
gagaauucaucuugaguua

SEQ ID NO: 659432 - RNA, 19 nt, Homo sapiens
aaacagagcugcagcaaug

SEQ ID NO: 659433 - RNA, 19 nt, Homo sapiens
gaccagggauguaauguuu

SEQ ID NO: 659434 - RNA, 19 nt, Homo sapiens
gaaagaaagcgaaguagaa

SEQ ID NO: 659435 - RNA, 19 nt, Homo sapiens
guaagaaccacucaaauaa

SEQ ID NO: 659436 - RNA, 19 nt, Homo sapiens
ggaaaggacuggaauugau

SEQ ID NO: 659437 - RNA, 19 nt, Homo sapiens
gaaaguauccagcugauga

SEQ ID NO: 659438 - RNA, 19 nt, Homo sapiens
caaaugugcuuucuguaaa

SEQ ID NO: 659439 - RNA, 19 nt, Homo sapiens
caagggauauggauuuauu

SEQ ID NO: 659440 - RNA, 19 nt, Homo sapiens
gauaacagcagcauaugua

SEQ ID NO: 659441 - RNA, 19 nt, Homo sapiens
gagagaaccuauugauaau

SEQ ID NO: 659442 - RNA, 19 nt, Homo sapiens
ggaaauacaagacagcuaa

SEQ ID NO: 659443 - RNA, 19 nt, Homo sapiens
gauuaaggaugaugugauu

SEQ ID NO: 659444 - RNA, 19 nt, Homo sapiens
ggaacaacuuaauggauuu

SEQ ID NO: 659445 - RNA, 19 nt, Homo sapiens
ugagagaaccuauugauaa

SEQ ID NO: 659446 - RNA, 19 nt, Homo sapiens
gaucuacugucauuuguau

SEQ ID NO: 659447 - RNA, 19 nt, Homo sapiens
gaauucaucuugaguuauc

SEQ ID NO: 659448 - RNA, 19 nt, Homo sapiens
ccaaaggaauugcuuaugu

SEQ ID NO: 659449 - RNA, 19 nt, Homo sapiens
ccucauagcaucaaauuaa

SEQ ID NO: 659450 - RNA, 19 nt, Homo sapiens
gcaggugguuugcugguaa

SEQ ID NO: 659451 - RNA, 19 nt, Homo sapiens
aggaauagcucuaggagaa

SEQ ID NO: 659452 - RNA, 19 nt, Homo sapiens
gaagauauagucccuuaug

SEQ ID NO: 659453 - RNA, 19 nt, Homo sapiens
gugguuacauuucacauuu

SEQ ID NO: 659454 - RNA, 19 nt, Homo sapiens
ccaacucucuaacauguuu

SEQ ID NO: 659455 - RNA, 19 nt, Homo sapiens
gauauagucccuuauguau

SEQ ID NO: 659456 - RNA, 19 nt, Homo sapiens
gaaaggacuggaauugauu

SEQ ID NO: 659457 - RNA, 19 nt, Homo sapiens
uguaugcaauuuccuguua

SEQ ID NO: 659458 - RNA, 19 nt, Homo sapiens
caaaggaauugcuuaugug

SEQ ID NO: 659459 - RNA, 19 nt, Homo sapiens
uguaagaaccacucaaaua

SEQ ID NO: 659460 - RNA, 19 nt, Homo sapiens
gaaaguuggucauguuacu

SEQ ID NO: 659461 - RNA, 19 nt, Homo sapiens
aagauuggguugccucaua

SEQ ID NO: 659462 - RNA, 19 nt, Homo sapiens
gaagcgaaguagagacaga

SEQ ID NO: 659463 - RNA, 19 nt, Homo sapiens
ugugagcucugaaauauau

SEQ ID NO: 659464 - RNA, 19 nt, Homo sapiens
gaugggauaccgagauuaa

SEQ ID NO: 659465 - RNA, 19 nt, Homo sapiens
caagggauuuggaagaguu

SEQ ID NO: 659466 - RNA, 19 nt, Homo sapiens
gaaaauggcagacgauauu

SEQ ID NO: 659467 - RNA, 19 nt, Homo sapiens
uggaacaacuuaauggauu

SEQ ID NO: 659468 - RNA, 19 nt, Homo sapiens
caagagcccugugagagaa

SEQ ID NO: 659469 - RNA, 19 nt, Homo sapiens
gacagaaauucaagacguu

SEQ ID NO: 659470 - RNA, 19 nt, Homo sapiens
gaaaugcagaaauagguuu

SEQ ID NO: 659471 - RNA, 19 nt, Homo sapiens
aggaagauauagucccuua

SEQ ID NO: 659472 - RNA, 19 nt, Homo sapiens
ccaaguagacgaugaagga

SEQ ID NO: 659473 - RNA, 19 nt, Homo sapiens
gaagaaguuggaugggaua

SEQ ID NO: 659474 - RNA, 19 nt, Homo sapiens
gaacggaagcgaaguagag

SEQ ID NO: 659475 - RNA, 19 nt, Homo sapiens
aauaguaaaucccacugua

SEQ ID NO: 659476 - RNA, 19 nt, Homo sapiens
gggaagugcuggaccuaug

SEQ ID NO: 659477 - RNA, 19 nt, Homo sapiens
caaagcagucugagaaaga

SEQ ID NO: 659478 - RNA, 19 nt, Homo sapiens
gcaaagcagucugagaaag

SEQ ID NO: 659479 - RNA, 19 nt, Homo sapiens
acaaaugugcuuucuguaa

SEQ ID NO: 659480 - RNA, 19 nt, Homo sapiens
ggaacaggcguuuagagaa

SEQ ID NO: 659481 - RNA, 19 nt, Homo sapiens
auaccgagauuaaggauga

SEQ ID NO: 659482 - RNA, 19 nt, Homo sapiens
acagcaagcucuacagaug

SEQ ID NO: 659483 - RNA, 19 nt, Homo sapiens
gggaacaacuggucgucuu

SEQ ID NO: 659484 - RNA, 19 nt, Homo sapiens
gagcagaagucguagucau

SEQ ID NO: 659485 - RNA, 19 nt, Homo sapiens
ucugugagcucugaaauau

SEQ ID NO: 659486 - RNA, 19 nt, Homo sapiens
ggaauugauuugggaacaa

SEQ ID NO: 659487 - RNA, 19 nt, Homo sapiens
caacuuaccacaaccuguu

SEQ ID NO: 659488 - RNA, 19 nt, Homo sapiens
ucaaacagaagaagaaguu

SEQ ID NO: 659489 - RNA, 19 nt, Homo sapiens
gaguggcucuuuggcauuu

SEQ ID NO: 659490 - RNA, 19 nt, Homo sapiens
ggaagaccaaugaaaguug

SEQ ID NO: 659491 - RNA, 19 nt, Homo sapiens
gcaggaagaccaaugaaag

SEQ ID NO: 659492 - RNA, 19 nt, Homo sapiens
gaaauaggaaaugcagaaa

SEQ ID NO: 659493 - RNA, 19 nt, Homo sapiens
gcugaugguugagcaguuu

SEQ ID NO: 659494 - RNA, 19 nt, Homo sapiens
acacagugguuacauuuca

SEQ ID NO: 659495 - RNA, 19 nt, Homo sapiens
gugaagugcccaucaauug

SEQ ID NO: 659496 - RNA, 19 nt, Homo sapiens
caagaaggaugagaacaag

SEQ ID NO: 659497 - RNA, 19 nt, Homo sapiens
gaacuggaaaggacuggaa

SEQ ID NO: 659498 - RNA, 19 nt, Homo sapiens
gcuaaagggcuguuugguu

SEQ ID NO: 659499 - RNA, 19 nt, Homo sapiens
gaaauacaagacagcuaaa

SEQ ID NO: 659500 - RNA, 19 nt, Homo sapiens
gaauagcucuaggagaaca

SEQ ID NO: 659501 - RNA, 19 nt, Homo sapiens
cgaaguagaagcaaagaga

SEQ ID NO: 659502 - RNA, 19 nt, Homo sapiens
uaguaaaucccacuguaua

SEQ ID NO: 659503 - RNA, 19 nt, Homo sapiens
gcacagcaagcucuacaga

SEQ ID NO: 659504 - RNA, 19 nt, Homo sapiens
gcagaagucguagucauga

SEQ ID NO: 659505 - RNA, 19 nt, Homo sapiens
ggaaaugcagaaauagguu

SEQ ID NO: 659506 - RNA, 19 nt, Homo sapiens
cgaaagagaagcaaaagua

SEQ ID NO: 659507 - RNA, 19 nt, Homo sapiens
auacaaaacuguucucuug

SEQ ID NO: 659508 - RNA, 19 nt, Homo sapiens
cagcaauggcaaacaauuu

SEQ ID NO: 659509 - RNA, 19 nt, Homo sapiens
gaaagaaauaggaaaugca

SEQ ID NO: 659510 - RNA, 19 nt, Homo sapiens
caucucaucuugcauucug

SEQ ID NO: 659511 - RNA, 19 nt, Homo sapiens
gacgaugaaggaagauaua

SEQ ID NO: 659512 - RNA, 19 nt, Homo sapiens
gaacuagcaggaagaccaa

SEQ ID NO: 659513 - RNA, 19 nt, Homo sapiens
ggaagugcuggaccuauga

SEQ ID NO: 659514 - RNA, 19 nt, Homo sapiens
gcagcuggcggcaagaauu

SEQ ID NO: 659515 - RNA, 19 nt, Homo sapiens
gugagagaaccuauugaua

SEQ ID NO: 659516 - RNA, 19 nt, Homo sapiens
caucuugcauucugaucaa

SEQ ID NO: 659517 - RNA, 19 nt, Homo sapiens
gcagcaauggcaaacaauu

SEQ ID NO: 659518 - RNA, 19 nt, Homo sapiens
cucagugccucuagcaaua

SEQ ID NO: 659519 - RNA, 19 nt, Homo sapiens
ggaaagguucgagauguga

SEQ ID NO: 659520 - RNA, 19 nt, Homo sapiens
gaaagagaagcaaaaguaa

SEQ ID NO: 659521 - RNA, 19 nt, Homo sapiens
caacggccaugaagaacgu

SEQ ID NO: 659522 - RNA, 19 nt, Homo sapiens
ggguacagguuugcagauu

SEQ ID NO: 659523 - RNA, 19 nt, Homo sapiens
gaacgaaagagaagcaaaa

SEQ ID NO: 659524 - RNA, 19 nt, Homo sapiens
cgagaugugaggaugauuu

SEQ ID NO: 659525 - RNA, 19 nt, Homo sapiens
uaggaaagguucgagaugu

SEQ ID NO: 659526 - RNA, 19 nt, Homo sapiens
gcaaaaguccauucagaaa

SEQ ID NO: 659527 - RNA, 19 nt, Homo sapiens
gaaugaaggugaaagguua

SEQ ID NO: 659528 - RNA, 19 nt, Homo sapiens
gaacuugcauccuguauug

SEQ ID NO: 659529 - RNA, 19 nt, Homo sapiens
gaaagaagcagagaauaua

SEQ ID NO: 659530 - RNA, 19 nt, Homo sapiens
gaaauuucaucuccuauug

SEQ ID NO: 659531 - RNA, 19 nt, Homo sapiens
gauagaaacugcuacaaga

SEQ ID NO: 659532 - RNA, 19 nt, Homo sapiens
guaaagagguccaacaaau

SEQ ID NO: 659533 - RNA, 19 nt, Homo sapiens
ugaaaugucucguguaauu

SEQ ID NO: 659534 - RNA, 19 nt, Homo sapiens
gaagaaaucacacaguuaa

SEQ ID NO: 659535 - RNA, 19 nt, Homo sapiens
ggaagaauguaaagagauu

SEQ ID NO: 659536 - RNA, 19 nt, Homo sapiens
gcugauacaucuucuuuaa

SEQ ID NO: 659537 - RNA, 19 nt, Homo sapiens
gaaagacuguauacaaaga

SEQ ID NO: 659538 - RNA, 19 nt, Homo sapiens
gguugcagcuuuagaaaua

SEQ ID NO: 659539 - RNA, 19 nt, Homo sapiens
gaaacugacugaugccaaa

SEQ ID NO: 659540 - RNA, 19 nt, Homo sapiens
gaaagggucuauccauguu

SEQ ID NO: 659541 - RNA, 19 nt, Homo sapiens
ccacauagauccagagaau

SEQ ID NO: 659542 - RNA, 19 nt, Homo sapiens
gaaagaggcuguuauucuc

SEQ ID NO: 659543 - RNA, 19 nt, Homo sapiens
gaaauuuggagacuucuua

SEQ ID NO: 659544 - RNA, 19 nt, Homo sapiens
gcuaggauuuggagaauaa

SEQ ID NO: 659545 - RNA, 19 nt, Homo sapiens
ucaaggagcaguuaaauaa

SEQ ID NO: 659546 - RNA, 19 nt, Homo sapiens
ucaaguaucugauuccaaa

SEQ ID NO: 659547 - RNA, 19 nt, Homo sapiens
gaaccucuaucgacaaguu

SEQ ID NO: 659548 - RNA, 19 nt, Homo sapiens
ggaacaaacucagguagaa

SEQ ID NO: 659549 - RNA, 19 nt, Homo sapiens
uaaaggaacucaagcugaa

SEQ ID NO: 659550 - RNA, 19 nt, Homo sapiens
ggaagaagcuauacaacag

SEQ ID NO: 659551 - RNA, 19 nt, Homo sapiens
aaaguaaacugacucacua

SEQ ID NO: 659552 - RNA, 19 nt, Homo sapiens
gauugaagauucugaaaug

SEQ ID NO: 659553 - RNA, 19 nt, Homo sapiens
gaauaaugcuuccaguaga

SEQ ID NO: 659554 - RNA, 19 nt, Homo sapiens
gcagagaauauacgaaaua

SEQ ID NO: 659555 - RNA, 19 nt, Homo sapiens
gaaaguggaagaagcuaua

SEQ ID NO: 659556 - RNA, 19 nt, Homo sapiens
aaaccaagaugaccuacua

SEQ ID NO: 659557 - RNA, 19 nt, Homo sapiens
gaacauugcagaaauugaa

SEQ ID NO: 659558 - RNA, 19 nt, Homo sapiens
ggugaaagguuaagagaga

SEQ ID NO: 659559 - RNA, 19 nt, Homo sapiens
ggagagugaucaccagauu

SEQ ID NO: 659560 - RNA, 19 nt, Homo sapiens
cuucaaagcucucaaaugu

SEQ ID NO: 659561 - RNA, 19 nt, Homo sapiens
gaaaguguauuaacgucuu

SEQ ID NO: 659562 - RNA, 19 nt, Homo sapiens
caaagaagccuauagacuu

SEQ ID NO: 659563 - RNA, 19 nt, Homo sapiens
gaucaaagcacucgauuuc

SEQ ID NO: 659564 - RNA, 19 nt, Homo sapiens
caagaaagacuguauacaa

SEQ ID NO: 659565 - RNA, 19 nt, Homo sapiens
gagaauaaguguguacaga

SEQ ID NO: 659566 - RNA, 19 nt, Homo sapiens
ggagacuucuuacaacauu

SEQ ID NO: 659567 - RNA, 19 nt, Homo sapiens
gaaagaagaauugcaagaa

SEQ ID NO: 659568 - RNA, 19 nt, Homo sapiens
gacaguaauucaaacagua

SEQ ID NO: 659569 - RNA, 19 nt, Homo sapiens
ucaaagcucucaaauguag

SEQ ID NO: 659570 - RNA, 19 nt, Homo sapiens
gaauaaagcaccagagugu

SEQ ID NO: 659571 - RNA, 19 nt, Homo sapiens
gcaaggccuucagaaauaa

SEQ ID NO: 659572 - RNA, 19 nt, Homo sapiens
gaaggaauuucaagaacau

SEQ ID NO: 659573 - RNA, 19 nt, Homo sapiens
ggaaagaggcuguuauucu

SEQ ID NO: 659574 - RNA, 19 nt, Homo sapiens
gaacuggaacaacaaauug

SEQ ID NO: 659575 - RNA, 19 nt, Homo sapiens
gaaacuaaacuucuugaug

SEQ ID NO: 659576 - RNA, 19 nt, Homo sapiens
gaauaaguguguacagauc

SEQ ID NO: 659577 - RNA, 19 nt, Homo sapiens
gcaacagaaugaaauggaa

SEQ ID NO: 659578 - RNA, 19 nt, Homo sapiens
uaaaggagaaggagcauaa

SEQ ID NO: 659579 - RNA, 19 nt, Homo sapiens
ugacaaggcugauacaucu

SEQ ID NO: 659580 - RNA, 19 nt, Homo sapiens
cgagagauauuagaagaaa

SEQ ID NO: 659581 - RNA, 19 nt, Homo sapiens
gagccaaacggaaauuaua

SEQ ID NO: 659582 - RNA, 19 nt, Homo sapiens
guguaaaccuggccacuaa

SEQ ID NO: 659583 - RNA, 19 nt, Homo sapiens
ggauggaucuguaguccuu

SEQ ID NO: 659584 - RNA, 19 nt, Homo sapiens
gaaagauagugaccuucaa

SEQ ID NO: 659585 - RNA, 19 nt, Homo sapiens
ccaguguucucaggaauua

SEQ ID NO: 659586 - RNA, 19 nt, Homo sapiens
aagcagaucuucagaggaa

SEQ ID NO: 659587 - RNA, 19 nt, Homo sapiens
ugcaaggccuucagaaaua

SEQ ID NO: 659588 - RNA, 19 nt, Homo sapiens
gcauauagauugcuguuuu

SEQ ID NO: 659589 - RNA, 19 nt, Homo sapiens
ggaaagcucacuaaucuuc

SEQ ID NO: 659590 - RNA, 19 nt, Homo sapiens
gaagugcgaccgaacauug

SEQ ID NO: 659591 - RNA, 19 nt, Homo sapiens
gaaggaacacuacagaaau

SEQ ID NO: 659592 - RNA, 19 nt, Homo sapiens
ccuaaagucucauauggaa

SEQ ID NO: 659593 - RNA, 19 nt, Homo sapiens
ucaaggauuugguugguaa

SEQ ID NO: 659594 - RNA, 19 nt, Homo sapiens
gaugaaacacucaauguau

SEQ ID NO: 659595 - RNA, 19 nt, Homo sapiens
guaaacugacucacuauuu

SEQ ID NO: 659596 - RNA, 19 nt, Homo sapiens
gaggaagaguaaugaaaug

SEQ ID NO: 659597 - RNA, 19 nt, Homo sapiens
gagauucaauuuacaccuu

SEQ ID NO: 659598 - RNA, 19 nt, Homo sapiens
gaaagaaaugguuagaaga

SEQ ID NO: 659599 - RNA, 19 nt, Homo sapiens
gaaagagguaucuguaaug

SEQ ID NO: 659600 - RNA, 19 nt, Homo sapiens
gaacuacguacucuugauu

SEQ ID NO: 659601 - RNA, 19 nt, Homo sapiens
ugacuuauuuguuccugua

SEQ ID NO: 659602 - RNA, 19 nt, Homo sapiens
caaacuguauuucccuauu

SEQ ID NO: 659603 - RNA, 19 nt, Homo sapiens
gaaaccaacaggcaagaaa

SEQ ID NO: 659604 - RNA, 19 nt, Homo sapiens
caaguuagaacaagacauu

SEQ ID NO: 659605 - RNA, 19 nt, Homo sapiens
gagcuugagacaucuaaua

SEQ ID NO: 659606 - RNA, 19 nt, Homo sapiens
caagauguaucacuagaca

SEQ ID NO: 659607 - RNA, 19 nt, Homo sapiens
ccucaauucuucaaucaaa

SEQ ID NO: 659608 - RNA, 19 nt, Homo sapiens
gaaacacaaaucauggaua

SEQ ID NO: 659609 - RNA, 19 nt, Homo sapiens
ccaguaauguacagaaaga

SEQ ID NO: 659610 - RNA, 19 nt, Homo sapiens
ugaauuacaugugcagaaa

SEQ ID NO: 659611 - RNA, 19 nt, Homo sapiens
caacgaauuucagaaccua

SEQ ID NO: 659612 - RNA, 19 nt, Homo sapiens
gaaguuacacaggaguuua

SEQ ID NO: 659613 - RNA, 19 nt, Homo sapiens
ucugaaaugucucguguaa

SEQ ID NO: 659614 - RNA, 19 nt, Homo sapiens
cgaaagaagcagagaauau

SEQ ID NO: 659615 - RNA, 19 nt, Homo sapiens
agaaagaaaugguuagaag

SEQ ID NO: 659616 - RNA, 19 nt, Homo sapiens
gaaugacacuagaagaaca

SEQ ID NO: 659617 - RNA, 19 nt, Homo sapiens
aagaagaaaucacacaguu

SEQ ID NO: 659618 - RNA, 19 nt, Homo sapiens
ggaacuggaacaacaaauu

SEQ ID NO: 659619 - RNA, 19 nt, Homo sapiens
ggaacuuucucuuucugaa

SEQ ID NO: 659620 - RNA, 19 nt, Homo sapiens
gaccgaacauugcagaaau

SEQ ID NO: 659621 - RNA, 19 nt, Homo sapiens
ugaucugucucaugaauuu

SEQ ID NO: 659622 - RNA, 19 nt, Homo sapiens
caguagaagucacagcaua

SEQ ID NO: 659623 - RNA, 19 nt, Homo sapiens
acaaugagcucuucaaagc

SEQ ID NO: 659624 - RNA, 19 nt, Homo sapiens
gaaaucacacaguuaacaa

SEQ ID NO: 659625 - RNA, 19 nt, Homo sapiens
uaaagagguccaacaaauu

SEQ ID NO: 659626 - RNA, 19 nt, Homo sapiens
caacuacacagaaggaauu

SEQ ID NO: 659627 - RNA, 19 nt, Homo sapiens
cauaaagacugcccaauaa

SEQ ID NO: 659628 - RNA, 19 nt, Homo sapiens
gaaagaaucacaaggauau

SEQ ID NO: 659629 - RNA, 19 nt, Homo sapiens
cggaauaucucgaugcaua

SEQ ID NO: 659630 - RNA, 19 nt, Homo sapiens
uaagacagauccaagguaa

SEQ ID NO: 659631 - RNA, 19 nt, Homo sapiens
gcacaaacaugaaaugacu

SEQ ID NO: 659632 - RNA, 19 nt, Homo sapiens
uaacagccaugcagaaaga

SEQ ID NO: 659633 - RNA, 19 nt, Homo sapiens
gaggagcucauauuuauuu

SEQ ID NO: 659634 - RNA, 19 nt, Homo sapiens
gacaauauguuaucagauc

SEQ ID NO: 659635 - RNA, 19 nt, Homo sapiens
ggagucaauuuauuucuga

SEQ ID NO: 659636 - RNA, 19 nt, Homo sapiens
caacaagucauccagcaua

SEQ ID NO: 659637 - RNA, 19 nt, Homo sapiens
aaagggaguuaugcaauua

SEQ ID NO: 659638 - RNA, 19 nt, Homo sapiens
caagucauccagcauaaua

SEQ ID NO: 659639 - RNA, 19 nt, Homo sapiens
gcagaaagaaucacaagga

SEQ ID NO: 659640 - RNA, 19 nt, Homo sapiens
ccaacgagauuccugaaga

SEQ ID NO: 659641 - RNA, 19 nt, Homo sapiens
caacgagauuccugaagaa

SEQ ID NO: 659642 - RNA, 19 nt, Homo sapiens
auaccuagaugucaaguaa

SEQ ID NO: 659643 - RNA, 19 nt, Homo sapiens
acacacagccuuucccaua

SEQ ID NO: 659644 - RNA, 19 nt, Homo sapiens
caucagaccuggccuccaa

SEQ ID NO: 659645 - RNA, 19 nt, Homo sapiens
acaugcagcuucagaauga

SEQ ID NO: 659646 - RNA, 19 nt, Homo sapiens
ccugaaacauugaaucuug

SEQ ID NO: 659647 - RNA, 19 nt, Homo sapiens
agaaugaagugucuauguu

SEQ ID NO: 659648 - RNA, 19 nt, Homo sapiens
gcacagguuucaccagcaa

SEQ ID NO: 659649 - RNA, 19 nt, Homo sapiens
ucagugaacuccagcauca

SEQ ID NO: 659650 - RNA, 19 nt, Homo sapiens
ucaccagaauuccagauaa

SEQ ID NO: 659651 - RNA, 19 nt, Homo sapiens
gaacucacccagacaaaca

SEQ ID NO: 659652 - RNA, 19 nt, Homo sapiens
gaucgaagguccaaaucuc

SEQ ID NO: 659653 - RNA, 19 nt, Homo sapiens
caccagaauuccagauaaa

SEQ ID NO: 659654 - RNA, 19 nt, Homo sapiens
gggaaacgcuuuggugcuu

SEQ ID NO: 659655 - RNA, 19 nt, Homo sapiens
gaccuggccuccaagaaga

SEQ ID NO: 659656 - RNA, 19 nt, Homo sapiens
gaaugaagugucuauguug

SEQ ID NO: 659657 - RNA, 19 nt, Homo sapiens
gagagcagcaagcggaaua

SEQ ID NO: 659658 - RNA, 19 nt, Homo sapiens
uagcauugcaugugaauaa

SEQ ID NO: 659659 - RNA, 19 nt, Homo sapiens
gguaccaguuacuuguuua

SEQ ID NO: 659660 - RNA, 19 nt, Homo sapiens
acauaaagacugcccaaua

SEQ ID NO: 659661 - RNA, 19 nt, Homo sapiens
agacaaacaugcagcuuca

SEQ ID NO: 659662 - RNA, 19 nt, Homo sapiens
gaagaacucacccagacaa

SEQ ID NO: 659663 - RNA, 19 nt, Homo sapiens
cagacaauauguuaucaga

SEQ ID NO: 659664 - RNA, 19 nt, Homo sapiens
cauaauaccaucacuacuu

SEQ ID NO: 659665 - RNA, 19 nt, Homo sapiens
ucacaaggauaucuaaguc

SEQ ID NO: 659666 - RNA, 19 nt, Homo sapiens
agccaugguuucauucuua

SEQ ID NO: 659667 - RNA, 19 nt, Homo sapiens
ggaaacgcuuuggugcuuu

SEQ ID NO: 659668 - RNA, 19 nt, Homo sapiens
uaccaugcguccuuucuuu

SEQ ID NO: 659669 - RNA, 19 nt, Homo sapiens
uaugaggaauccaagauga

SEQ ID NO: 659670 - RNA, 19 nt, Homo sapiens
ccauugauguccaaauaau

SEQ ID NO: 659671 - RNA, 19 nt, Homo sapiens
ugaagugucuauguugaaa

SEQ ID NO: 659672 - RNA, 19 nt, Homo sapiens
gaagagcuguagcguacca

SEQ ID NO: 659673 - RNA, 19 nt, Homo sapiens
gcucaccacucacagaaca

SEQ ID NO: 659674 - RNA, 19 nt, Homo sapiens
ggaauaucucgaugcauaa

SEQ ID NO: 659675 - RNA, 19 nt, Homo sapiens
cagaaagaaucacaaggau

SEQ ID NO: 659676 - RNA, 19 nt, Homo sapiens
ucacagaacagaccugaau

SEQ ID NO: 659677 - RNA, 19 nt, Homo sapiens
caccagaccucgccacauc

SEQ ID NO: 659678 - RNA, 19 nt, Homo sapiens
gcccggaacucaccagcuu

SEQ ID NO: 659679 - RNA, 19 nt, Homo sapiens
cgagauuccugaagaacug

SEQ ID NO: 659680 - RNA, 19 nt, Homo sapiens
gaaucacaaggauaucuaa

SEQ ID NO: 659681 - RNA, 19 nt, Homo sapiens
guaagacagauccaaggua

SEQ ID NO: 659682 - RNA, 19 nt, Homo sapiens
gugguggagucaauuuauu

SEQ ID NO: 659683 - RNA, 19 nt, Homo sapiens
aaagaaagcagaagaacuc

SEQ ID NO: 659684 - RNA, 19 nt, Homo sapiens
gcagccaacccagacaaua

SEQ ID NO: 659685 - RNA, 19 nt, Homo sapiens
ggacacaugauggagauga

SEQ ID NO: 659686 - RNA, 19 nt, Homo sapiens
cauugcaugugaauaagaa

SEQ ID NO: 659687 - RNA, 19 nt, Homo sapiens
ucagccagcucaccacuca

SEQ ID NO: 659688 - RNA, 19 nt, Homo sapiens
uaucuucucugcuacaucu

SEQ ID NO: 659689 - RNA, 19 nt, Homo sapiens
acaccaacguugugauuca

SEQ ID NO: 659690 - RNA, 19 nt, Homo sapiens
agaaagaaucacaaggaua

SEQ ID NO: 659691 - RNA, 19 nt, Homo sapiens
aaugaagugucuauguuga

SEQ ID NO: 659692 - RNA, 19 nt, Homo sapiens
ccacaucaccacucccauu

SEQ ID NO: 659693 - RNA, 19 nt, Homo sapiens
guugaaggcugcauugacu

SEQ ID NO: 659694 - RNA, 19 nt, Homo sapiens
uaaagacugcccaauaaca

SEQ ID NO: 659695 - RNA, 19 nt, Homo sapiens
auccauugauguccaaaua

SEQ ID NO: 659696 - RNA, 19 nt, Homo sapiens
ggaaaucuuuugacaucuu

SEQ ID NO: 659697 - RNA, 19 nt, Homo sapiens
guauauagccaugguuuca

SEQ ID NO: 659698 - RNA, 19 nt, Homo sapiens
auaauaccaucacuacuuc

SEQ ID NO: 659699 - RNA, 19 nt, Homo sapiens
gacagacaauauguuauca

SEQ ID NO: 659700 - RNA, 19 nt, Homo sapiens
uuugacaucuuaacucaug

SEQ ID NO: 659701 - RNA, 19 nt, Homo sapiens
ccaauggagcgacaaaugu

SEQ ID NO: 659702 - RNA, 19 nt, Homo sapiens
gaaacgcuuuggugcuuuu

SEQ ID NO: 659703 - RNA, 19 nt, Homo sapiens
aacaagucauccagcauaa

SEQ ID NO: 659704 - RNA, 19 nt, Homo sapiens
caauaacagccaugcagaa

SEQ ID NO: 659705 - RNA, 19 nt, Homo sapiens
ucaggaaggcucaggaaga

SEQ ID NO: 659706 - RNA, 19 nt, Homo sapiens
uggcccagcugaaacaguu

SEQ ID NO: 659707 - RNA, 19 nt, Homo sapiens
caaacaugcagcuucagaa

SEQ ID NO: 659708 - RNA, 19 nt, Homo sapiens
auauagccaugguuucauu

SEQ ID NO: 659709 - RNA, 19 nt, Homo sapiens
gggaguuaugcaauuaaua

SEQ ID NO: 659710 - RNA, 19 nt, Homo sapiens
cagcauaauaccaucacua

SEQ ID NO: 659711 - RNA, 19 nt, Homo sapiens
ggauaucuaaguccagaga

SEQ ID NO: 659712 - RNA, 19 nt, Homo sapiens
ugggugaugucauuggaaa

SEQ ID NO: 659713 - RNA, 19 nt, Homo sapiens
gcagaaccauccacaucac

SEQ ID NO: 659714 - RNA, 19 nt, Homo sapiens
ugacaccaacguugugauu

SEQ ID NO: 659715 - RNA, 19 nt, Homo sapiens
ccaguuuucuucuccauuu

SEQ ID NO: 659716 - RNA, 19 nt, Homo sapiens
caggaaggcucaggaagag

SEQ ID NO: 659717 - RNA, 19 nt, Homo sapiens
gccaugguuucauucuuau

SEQ ID NO: 659718 - RNA, 19 nt, Homo sapiens
aaacugaaccuuuucugua

SEQ ID NO: 659719 - RNA, 19 nt, Homo sapiens
aaaagggaguuaugcaauu

SEQ ID NO: 659720 - RNA, 19 nt, Homo sapiens
cagaaugaagugucuaugu

SEQ ID NO: 659721 - RNA, 19 nt, Homo sapiens
cagcagaaccauccacauc

SEQ ID NO: 659722 - RNA, 19 nt, Homo sapiens
gccaauggagcgacaaaug

SEQ ID NO: 659723 - RNA, 19 nt, Homo sapiens
cuggaagacuccucaguuc

SEQ ID NO: 659724 - RNA, 19 nt, Homo sapiens
uauaagauccauugauguc

SEQ ID NO: 659725 - RNA, 19 nt, Homo sapiens
gauaaacacacagccuuuc

SEQ ID NO: 659726 - RNA, 19 nt, Homo sapiens
gaggaauccaagaugaauu

SEQ ID NO: 659727 - RNA, 19 nt, Homo sapiens
gaaggcugcugucaguuua

SEQ ID NO: 659728 - RNA, 19 nt, Homo sapiens
cagaggagaugcugaagaa

SEQ ID NO: 659729 - RNA, 19 nt, Homo sapiens
ggaugugacuuaugaacuu

SEQ ID NO: 659730 - RNA, 19 nt, Homo sapiens
gaacaacaucucuuugaau

SEQ ID NO: 659731 - RNA, 19 nt, Homo sapiens
cacaauggcugaauuaucu

SEQ ID NO: 659732 - RNA, 19 nt, Homo sapiens
gaugugacuuaugaacuua

SEQ ID NO: 659733 - RNA, 19 nt, Homo sapiens
gugaaugagugcuucuuaa

SEQ ID NO: 659734 - RNA, 19 nt, Homo sapiens
aaacacaauggcugaauua

SEQ ID NO: 659735 - RNA, 19 nt, Homo sapiens
ggaaggcugcugucaguuu

SEQ ID NO: 659736 - RNA, 19 nt, Homo sapiens
ggucaggcauuucuauuag

SEQ ID NO: 659737 - RNA, 19 nt, Homo sapiens
ugaacaacaucucuuugaa

SEQ ID NO: 659738 - RNA, 19 nt, Homo sapiens
gagcacagcagcuuguuug

SEQ ID NO: 659739 - RNA, 19 nt, Homo sapiens
gacugugacuguaaucauu

SEQ ID NO: 659740 - RNA, 19 nt, Homo sapiens
gacccaagcucaacuaucg

SEQ ID NO: 659741 - RNA, 19 nt, Homo sapiens
gcugucaguuuacuuguga

SEQ ID NO: 659742 - RNA, 19 nt, Homo sapiens
gaacuucuaaagcauauca

SEQ ID NO: 659743 - RNA, 19 nt, Homo sapiens
uggcagaacuggagagugu

SEQ ID NO: 659744 - RNA, 19 nt, Homo sapiens
gcuguguccuuucagaauu

SEQ ID NO: 659745 - RNA, 19 nt, Homo sapiens
gaggagaugcugaagaaga

SEQ ID NO: 659746 - RNA, 19 nt, Homo sapiens
gcauuucuauuaggaguug

SEQ ID NO: 659747 - RNA, 19 nt, Homo sapiens
auucauggcugaugccuuu

SEQ ID NO: 659748 - RNA, 19 nt, Homo sapiens
gggucaggcauuucuauua

SEQ ID NO: 659749 - RNA, 19 nt, Homo sapiens
ggccauaaacugacuguga

SEQ ID NO: 659750 - RNA, 19 nt, Homo sapiens
caggaaggcugcugucagu

SEQ ID NO: 659751 - RNA, 19 nt, Homo sapiens
uaugagaaguccgaagaaa

SEQ ID NO: 659752 - RNA, 19 nt, Homo sapiens
gaggugagcagcaggaaau

SEQ ID NO: 659753 - RNA, 19 nt, Homo sapiens
gauuuggagugguaugaga

SEQ ID NO: 659754 - RNA, 19 nt, Homo sapiens
aaucauugcugaacaacau

SEQ ID NO: 659755 - RNA, 19 nt, Homo sapiens
gaaugagugcuucuuaauc

SEQ ID NO: 659756 - RNA, 19 nt, Homo sapiens
gaauuaucuuucuccaugu

SEQ ID NO: 659757 - RNA, 19 nt, Homo sapiens
gagugcuucuuaauccuaa

SEQ ID NO: 659758 - RNA, 19 nt, Homo sapiens
gguaugagaaguccgaaga

SEQ ID NO: 659759 - RNA, 19 nt, Homo sapiens
aacaacaucucuuugaauc

SEQ ID NO: 659760 - RNA, 19 nt, Homo sapiens
cccaagagacugcauggua

SEQ ID NO: 659761 - RNA, 19 nt, Homo sapiens
gacaagcucuacgcaggaa

SEQ ID NO: 659762 - RNA, 19 nt, Homo sapiens
aggagaugcugaagaagaa

SEQ ID NO: 659763 - RNA, 19 nt, Homo sapiens
cagccgcagucccugauuu

SEQ ID NO: 659764 - RNA, 19 nt, Homo sapiens
ugaaucacccaucugguuu

SEQ ID NO: 659765 - RNA, 19 nt, Homo sapiens
ucuaugaacucgacuuguc

SEQ ID NO: 659766 - RNA, 19 nt, Homo sapiens
gcagaggagaugcugaaga

SEQ ID NO: 659767 - RNA, 19 nt, Homo sapiens
augaacagcuuaagcacuu

SEQ ID NO: 659768 - RNA, 19 nt, Homo sapiens
gugaacuucuaaagcauau

SEQ ID NO: 659769 - RNA, 19 nt, Homo sapiens
gaaccacggcuugggaaga

SEQ ID NO: 659770 - RNA, 19 nt, Homo sapiens
uaauguggaugugacuuau

SEQ ID NO: 659771 - RNA, 19 nt, Homo sapiens
ucaggcauuucuauuagga

SEQ ID NO: 659772 - RNA, 19 nt, Homo sapiens
uguaaucauugcugaacaa

SEQ ID NO: 659773 - RNA, 19 nt, Homo sapiens
aggcaccagugacauuuaa

SEQ ID NO: 659774 - RNA, 19 nt, Homo sapiens
ccgcaacuguggagaagau

SEQ ID NO: 659775 - RNA, 19 nt, Homo sapiens
ccaccuggaggacuucuuu

SEQ ID NO: 659776 - RNA, 19 nt, Homo sapiens
ccaacaagcccuggcagaa

SEQ ID NO: 659777 - RNA, 19 nt, Homo sapiens
cuugugaacuucuaaagca

SEQ ID NO: 659778 - RNA, 19 nt, Homo sapiens
ggugcugggucaggcauuu

SEQ ID NO: 659779 - RNA, 19 nt, Homo sapiens
gggaagacuacauuugguu

SEQ ID NO: 659780 - RNA, 19 nt, Homo sapiens
cuauggaggugucccuuuc

SEQ ID NO: 659781 - RNA, 19 nt, Homo sapiens
ugaaugagugcuucuuaau

SEQ ID NO: 659782 - RNA, 19 nt, Homo sapiens
auaauguggaugugacuua

SEQ ID NO: 659783 - RNA, 19 nt, Homo sapiens
gaaucacccaucugguuug

SEQ ID NO: 659784 - RNA, 19 nt, Homo sapiens
uaaaggcuuccgcgaguga

SEQ ID NO: 659785 - RNA, 19 nt, Homo sapiens
cagauagaacuacuugaga

SEQ ID NO: 659786 - RNA, 19 nt, Homo sapiens
gcugugacugugacuguaa

SEQ ID NO: 659787 - RNA, 19 nt, Homo sapiens
ucccugauuuggaguggua

SEQ ID NO: 659788 - RNA, 19 nt, Homo sapiens
ccagauagaacuacuugag

SEQ ID NO: 659789 - RNA, 19 nt, Homo sapiens
gauagaacuacuugagaca

SEQ ID NO: 659790 - RNA, 19 nt, Homo sapiens
gcaccagugacauuuaaag

SEQ ID NO: 659791 - RNA, 19 nt, Homo sapiens
cugaacaacaucucuuuga

SEQ ID NO: 659792 - RNA, 19 nt, Homo sapiens
caucugguuuggagcuaga

SEQ ID NO: 659793 - RNA, 19 nt, Homo sapiens
gcaacuguggagaagauug

SEQ ID NO: 659794 - RNA, 19 nt, Homo sapiens
gcacagggacaccgcaacu

SEQ ID NO: 659795 - RNA, 19 nt, Homo sapiens
ugagaaguccgaagaaacu

SEQ ID NO: 659796 - RNA, 19 nt, Homo sapiens
caauggcugaauuaucuuu

SEQ ID NO: 659797 - RNA, 19 nt, Homo sapiens
ucagccaccuggaggacuu

SEQ ID NO: 659798 - RNA, 19 nt, Homo sapiens
aaugagugcuucuuaaucc

SEQ ID NO: 659799 - RNA, 19 nt, Homo sapiens
gcugaacaacaucucuuug

SEQ ID NO: 659800 - RNA, 19 nt, Homo sapiens
cugaaucacccaucugguu

SEQ ID NO: 659801 - RNA, 19 nt, Homo sapiens
acacaauggcugaauuauc

SEQ ID NO: 659802 - RNA, 19 nt, Homo sapiens
ccaggcaccagugacauuu

SEQ ID NO: 659803 - RNA, 19 nt, Homo sapiens
caacaagcccuggcagaac

SEQ ID NO: 659804 - RNA, 19 nt, Homo sapiens
auguggaugugacuuauga

SEQ ID NO: 659805 - RNA, 19 nt, Homo sapiens
aaaacacaauggcugaauu

SEQ ID NO: 659806 - RNA, 19 nt, Homo sapiens
uggagaagauugguuucga

SEQ ID NO: 659807 - RNA, 19 nt, Homo sapiens
guaccgcgagugcugauuc

SEQ ID NO: 659808 - RNA, 19 nt, Homo sapiens
cagcaggaaaugccaacaa

SEQ ID NO: 659809 - RNA, 19 nt, Homo sapiens
ccuaugaacagcuuaagca

SEQ ID NO: 659810 - RNA, 19 nt, Homo sapiens
aagcauaucauguaucaac

SEQ ID NO: 659811 - RNA, 19 nt, Homo sapiens
cuguguccuuucagaauuu

SEQ ID NO: 659812 - RNA, 19 nt, Homo sapiens
gcugcugucaguuuacuug

SEQ ID NO: 659813 - RNA, 19 nt, Homo sapiens
guaugagaaguccgaagaa

SEQ ID NO: 659814 - RNA, 19 nt, Homo sapiens
agugaaugagugcuucuua

SEQ ID NO: 659815 - RNA, 19 nt, Homo sapiens
acucacgccucccagauag

SEQ ID NO: 659816 - RNA, 19 nt, Homo sapiens
ugaacagcuuaagcacuuu

SEQ ID NO: 659817 - RNA, 19 nt, Homo sapiens
auuaggaguuggaaagcaa

SEQ ID NO: 659818 - RNA, 19 nt, Homo sapiens
caggcaccagugacauuua

SEQ ID NO: 659819 - RNA, 19 nt, Homo sapiens
ucaggcuccuccacucaug

SEQ ID NO: 659820 - RNA, 19 nt, Homo sapiens
ggcugugacugugacugua

SEQ ID NO: 659821 - RNA, 19 nt, Homo sapiens
ggugagagaggaagcaacu

SEQ ID NO: 659822 - RNA, 19 nt, Homo sapiens
ugagugcuucuuaauccua

SEQ ID NO: 659823 - RNA, 19 nt, Homo sapiens
ugugaacuucuaaagcaua

SEQ ID NO: 659824 - RNA, 19 nt, Homo sapiens
caacuguggagaagauugg

SEQ ID NO: 659825 - RNA, 19 nt, Homo sapiens
gaacagcuuaagcacuuuu

SEQ ID NO: 659826 - RNA, 19 nt, Homo sapiens
guuuacuugugaacuucua

SEQ ID NO: 659827 - RNA, 19 nt, Homo sapiens
gcaaggauaucaaugcuua

SEQ ID NO: 659828 - RNA, 19 nt, Homo sapiens
ggacguggcucccaacuuu

SEQ ID NO: 659829 - RNA, 19 nt, Homo sapiens
gcaaucaauuccauucaua

SEQ ID NO: 659830 - RNA, 19 nt, Homo sapiens
gaagagagaaugauugaaa

SEQ ID NO: 659831 - RNA, 19 nt, Homo sapiens
caagaggaauguuaaguug

SEQ ID NO: 659832 - RNA, 19 nt, Homo sapiens
ccaggaacuucuagaauaa

SEQ ID NO: 659833 - RNA, 19 nt, Homo sapiens
gaaaggagucuucaccaaa

SEQ ID NO: 659834 - RNA, 19 nt, Homo sapiens
cccaggaacuucuagaaua

SEQ ID NO: 659835 - RNA, 19 nt, Homo sapiens
gaugucagcugccaauugu

SEQ ID NO: 659836 - RNA, 19 nt, Homo sapiens
gcaggugugagcaauauua

SEQ ID NO: 659837 - RNA, 19 nt, Homo sapiens
gaagucauauuuguugaug

SEQ ID NO: 659838 - RNA, 19 nt, Homo sapiens
ggauaucaaugcuuacaau

SEQ ID NO: 659839 - RNA, 19 nt, Homo sapiens
gaaaauggcacuaaaaguu

SEQ ID NO: 659840 - RNA, 19 nt, Homo sapiens
cuauaccaauggcuuauua

SEQ ID NO: 659841 - RNA, 19 nt, Homo sapiens
ccaauggcuuauuaaauga

SEQ ID NO: 659842 - RNA, 19 nt, Homo sapiens
acacaggguuugcauuuau

SEQ ID NO: 659843 - RNA, 19 nt, Homo sapiens
gcacucugcugguucuguu

SEQ ID NO: 659844 - RNA, 19 nt, Homo sapiens
uaacccagaugcgcuuuaa

SEQ ID NO: 659845 - RNA, 19 nt, Homo sapiens
accaauggcuuauuaaaug

SEQ ID NO: 659846 - RNA, 19 nt, Homo sapiens
gcucccaucuggcaagaaa

SEQ ID NO: 659847 - RNA, 19 nt, Homo sapiens
cgaaaggagucuucaccaa

SEQ ID NO: 659848 - RNA, 19 nt, Homo sapiens
uaacccagaugcucuuuca

SEQ ID NO: 659849 - RNA, 19 nt, Homo sapiens
gcaggaacuuugaugagau

SEQ ID NO: 659850 - RNA, 19 nt, Homo sapiens
ucaacuuccucuguaaaua

SEQ ID NO: 659851 - RNA, 19 nt, Homo sapiens
caucagagaaugacuauca

SEQ ID NO: 659852 - RNA, 19 nt, Homo sapiens
ucacacaggguuugcauuu

SEQ ID NO: 659853 - RNA, 19 nt, Homo sapiens
caacuuccucuguaaauau

SEQ ID NO: 659854 - RNA, 19 nt, Homo sapiens
aaacucaaaucuuguugga

SEQ ID NO: 659855 - RNA, 19 nt, Homo sapiens
gaaaagggcaugccuguga

SEQ ID NO: 659856 - RNA, 19 nt, Homo sapiens
aaccaucccugaagaagaa

SEQ ID NO: 659857 - RNA, 19 nt, Homo sapiens
gaagcugucuauccucuac

SEQ ID NO: 659858 - RNA, 19 nt, Homo sapiens
ucaauuccauucauacauc

SEQ ID NO: 659859 - RNA, 19 nt, Homo sapiens
ggcaggaacuuugaugaga

SEQ ID NO: 659860 - RNA, 19 nt, Homo sapiens
guauaaagcccaggaacuu

SEQ ID NO: 659861 - RNA, 19 nt, Homo sapiens
caggaacuuugaugagauu

SEQ ID NO: 659862 - RNA, 19 nt, Homo sapiens
ccaagaggaauguuaaguu

SEQ ID NO: 659863 - RNA, 19 nt, Homo sapiens
gcaccagaauuugccaaga

SEQ ID NO: 659864 - RNA, 19 nt, Homo sapiens
gaagaguggcagaacuuga

SEQ ID NO: 659865 - RNA, 19 nt, Homo sapiens
cacacaggguuugcauuua

SEQ ID NO: 659866 - RNA, 19 nt, Homo sapiens
aaaggagucuucaccaaag

SEQ ID NO: 659867 - RNA, 19 nt, Homo sapiens
uagcaggugugagcaauau

SEQ ID NO: 659868 - RNA, 19 nt, Homo sapiens
cauauuuguugaugguuga

SEQ ID NO: 659869 - RNA, 19 nt, Homo sapiens
ggaugucagcugccaauug

SEQ ID NO: 659870 - RNA, 19 nt, Homo sapiens
uaaguugauugcccuuuca

SEQ ID NO: 659871 - RNA, 19 nt, Homo sapiens
cagagaaugacuaucaauu

SEQ ID NO: 659872 - RNA, 19 nt, Homo sapiens
cugcagggcuugugaccaa

SEQ ID NO: 659873 - RNA, 19 nt, Homo sapiens
gaaauaccuccgcuacaca

SEQ ID NO: 659874 - RNA, 19 nt, Homo sapiens
agaggaauguuaaguugau

SEQ ID NO: 659875 - RNA, 19 nt, Homo sapiens
cccagaugcucuuucauau

SEQ ID NO: 659876 - RNA, 19 nt, Homo sapiens
gaauaacccagaugcucuu

SEQ ID NO: 659877 - RNA, 19 nt, Homo sapiens
ggugugagcaauauuagug

SEQ ID NO: 659878 - RNA, 19 nt, Homo sapiens
gaggaauguuaaguugauu

SEQ ID NO: 659879 - RNA, 19 nt, Homo sapiens
ccuaguagauaagugaaga

SEQ ID NO: 659880 - RNA, 19 nt, Homo sapiens
ccagaugcucuuucauauu

SEQ ID NO: 659881 - RNA, 19 nt, Homo sapiens
gcucgugugguguuuguuu

SEQ ID NO: 659882 - RNA, 19 nt, Homo sapiens
gugaagagcccacagaaaa

SEQ ID NO: 659883 - RNA, 19 nt, Homo sapiens
gcugugagccagaggaugu

SEQ ID NO: 659884 - RNA, 19 nt, Homo sapiens
gaauuugccaagaggaaug

SEQ ID NO: 659885 - RNA, 19 nt, Homo sapiens
uaagugaagagcagggaaa

SEQ ID NO: 659886 - RNA, 19 nt, Homo sapiens
caccagaauuugccaagag

SEQ ID NO: 659887 - RNA, 19 nt, Homo sapiens
caauuccauucauacauca

SEQ ID NO: 659888 - RNA, 19 nt, Homo sapiens
caaccaucccugaagaaga

SEQ ID NO: 659889 - RNA, 19 nt, Homo sapiens
auaccuuccuaguagauaa

SEQ ID NO: 659890 - RNA, 19 nt, Homo sapiens
acccagaugcucuuucaua

SEQ ID NO: 659891 - RNA, 19 nt, Homo sapiens
ggagcaaggauaucaaugc

SEQ ID NO: 659892 - RNA, 19 nt, Homo sapiens
uuaaguugauugcccuuuc

SEQ ID NO: 659893 - RNA, 19 nt, Homo sapiens
uuagguugcuauaccaaug

SEQ ID NO: 659894 - RNA, 19 nt, Homo sapiens
agaaauaccuccgcuacac

SEQ ID NO: 659895 - RNA, 19 nt, Homo sapiens
ccacuggcaggaacuuuga

SEQ ID NO: 659896 - RNA, 19 nt, Homo sapiens
ggagcuugccauccuguug

SEQ ID NO: 659897 - RNA, 19 nt, Homo sapiens
guagcaggugugagcaaua

SEQ ID NO: 659898 - RNA, 19 nt, Homo sapiens
gagcucccaucuggcaaga

SEQ ID NO: 659899 - RNA, 19 nt, Homo sapiens
gcauuuaucagucuguuuu

SEQ ID NO: 659900 - RNA, 19 nt, Homo sapiens
cccagaugcgcuuuaauuu

SEQ ID NO: 659901 - RNA, 19 nt, Homo sapiens
gaggaugucagcugccaau

SEQ ID NO: 659902 - RNA, 19 nt, Homo sapiens
ugacagcucgugugguguu

SEQ ID NO: 659903 - RNA, 19 nt, Homo sapiens
gagcagggaaagagaccuu

SEQ ID NO: 659904 - RNA, 19 nt, Homo sapiens
acccagaugcgcuuuaauu

SEQ ID NO: 659905 - RNA, 19 nt, Homo sapiens
cagcucgugugguguuugu

SEQ ID NO: 659906 - RNA, 19 nt, Homo sapiens
gcaauauuagugccaugug

SEQ ID NO: 659907 - RNA, 19 nt, Homo sapiens
gcccaggaacuucuagaau

SEQ ID NO: 659908 - RNA, 19 nt, Homo sapiens
guucaacuuccucuguaaa

SEQ ID NO: 659909 - RNA, 19 nt, Homo sapiens
aagaguggcagaacuugaa

SEQ ID NO: 659910 - RNA, 19 nt, Homo sapiens
gguucuguuugaaauaugu

SEQ ID NO: 659911 - RNA, 19 nt, Homo sapiens
ucccaucuggcaagaaaua

SEQ ID NO: 659912 - RNA, 19 nt, Homo sapiens
cagggcuugugaccaauga

SEQ ID NO: 659913 - RNA, 19 nt, Homo sapiens
cagaauuugccaagaggaa

SEQ ID NO: 659914 - RNA, 19 nt, Homo sapiens
uaaagcccaggaacuucua

SEQ ID NO: 659915 - RNA, 19 nt, Homo sapiens
guugaugguugacaaagcu

SEQ ID NO: 659916 - RNA, 19 nt, Homo sapiens
agucauauuuguugauggu

SEQ ID NO: 659917 - RNA, 19 nt, Homo sapiens
gcugguucuguuugaaaua

SEQ ID NO: 659918 - RNA, 19 nt, Homo sapiens
ucuauccucuacccagcua

SEQ ID NO: 659919 - RNA, 19 nt, Homo sapiens
gugaagagcagggaaagag

SEQ ID NO: 659920 - RNA, 19 nt, Homo sapiens
cagcagagaaggaugaaaa

SEQ ID NO: 659921 - RNA, 19 nt, Homo sapiens
ccagaugcgcuuuaauuuu

SEQ ID NO: 659922 - RNA, 19 nt, Homo sapiens
cucuguaaauauccaagua

SEQ ID NO: 659923 - RNA, 19 nt, Homo sapiens
gacagcucgugugguguuu

SEQ ID NO: 659924 - RNA, 19 nt, Homo sapiens
uucuauaccuuccuaguag

SEQ ID NO: 659925 - RNA, 19 nt, Homo sapiens
cuucagcaaucaauuccau

SEQ ID NO: 659926 - RNA, 19 nt, Homo sapiens
ugaagagcagggaaagaga

SEQ ID NO: 659927 - RNA, 19 nt, Homo sapiens
acacagaucuuaacucuaa

SEQ ID NO: 659928 - RNA, 19 nt, Homo sapiens
gaucuuaacucuaaugaug

SEQ ID NO: 659929 - RNA, 19 nt, Homo sapiens
gaacuguuguauccuguua

SEQ ID NO: 659930 - RNA, 19 nt, Homo sapiens
ggacucaaguguaaaugua

SEQ ID NO: 659931 - RNA, 19 nt, Homo sapiens
gaccaaaccuaaauaaaga

SEQ ID NO: 659932 - RNA, 19 nt, Homo sapiens
caacugagaucaacaaugg

SEQ ID NO: 659933 - RNA, 19 nt, Homo sapiens
ggaacagacuaaagacaaa

SEQ ID NO: 659934 - RNA, 19 nt, Homo sapiens
uguaguaguuucaguguua

SEQ ID NO: 659935 - RNA, 19 nt, Homo sapiens
ggcaagagaugaguuaauu

SEQ ID NO: 659936 - RNA, 19 nt, Homo sapiens
guacacagaucuuaacucu

SEQ ID NO: 659937 - RNA, 19 nt, Homo sapiens
gugcauaguuacucaguuu

SEQ ID NO: 659938 - RNA, 19 nt, Homo sapiens
uagaguagauguggguuua

SEQ ID NO: 659939 - RNA, 19 nt, Homo sapiens
acacaaugaugucuguaua

SEQ ID NO: 659940 - RNA, 19 nt, Homo sapiens
gguaauaaguccuccaaca

SEQ ID NO: 659941 - RNA, 19 nt, Homo sapiens
gcaaguacacagaucuuaa

SEQ ID NO: 659942 - RNA, 19 nt, Homo sapiens
guuuaugacugccaaguuu

SEQ ID NO: 659943 - RNA, 19 nt, Homo sapiens
ugauguaacuggccuaaga

SEQ ID NO: 659944 - RNA, 19 nt, Homo sapiens
gaaauacagugaggagcuu

SEQ ID NO: 659945 - RNA, 19 nt, Homo sapiens
gcaccauucagacuuguua

SEQ ID NO: 659946 - RNA, 19 nt, Homo sapiens
aaugaaaggugaacuggaa

SEQ ID NO: 659947 - RNA, 19 nt, Homo sapiens
uuaggugacuguuuaagaa

SEQ ID NO: 659948 - RNA, 19 nt, Homo sapiens
caagaagguucgauugagu

SEQ ID NO: 659949 - RNA, 19 nt, Homo sapiens
caagaugaccaacgaagaa

SEQ ID NO: 659950 - RNA, 19 nt, Homo sapiens
gaaauuugugugcauaguu

SEQ ID NO: 659951 - RNA, 19 nt, Homo sapiens
ccagcuugaugaagaagua

SEQ ID NO: 659952 - RNA, 19 nt, Homo sapiens
cugagugccuggaaguuua

SEQ ID NO: 659953 - RNA, 19 nt, Homo sapiens
gcagugagugggaaaggua

SEQ ID NO: 659954 - RNA, 19 nt, Homo sapiens
ggagguagugguuacguaa

SEQ ID NO: 659955 - RNA, 19 nt, Homo sapiens
caguauaucuuaccuguac

SEQ ID NO: 659956 - RNA, 19 nt, Homo sapiens
gaaaggacggggaguguua

SEQ ID NO: 659957 - RNA, 19 nt, Homo sapiens
gagaggauacuguccagaa

SEQ ID NO: 659958 - RNA, 19 nt, Homo sapiens
gagaugaguuaauucuaag

SEQ ID NO: 659959 - RNA, 19 nt, Homo sapiens
ggugacuguuuaagaaauu

SEQ ID NO: 659960 - RNA, 19 nt, Homo sapiens
ggacguauugcacaacuug

SEQ ID NO: 659961 - RNA, 19 nt, Homo sapiens
gaacaagagaugcaagagu

SEQ ID NO: 659962 - RNA, 19 nt, Homo sapiens
ucaaaguuauggcaagaga

SEQ ID NO: 659963 - RNA, 19 nt, Homo sapiens
guacugaccaaaccuaaau

SEQ ID NO: 659964 - RNA, 19 nt, Homo sapiens
aaaggcgacucuccugauu

SEQ ID NO: 659965 - RNA, 19 nt, Homo sapiens
ucacacaccaaucaaauga

SEQ ID NO: 659966 - RNA, 19 nt, Homo sapiens
gcaacacaaccgaagauga

SEQ ID NO: 659967 - RNA, 19 nt, Homo sapiens
ccaaguaccagcaggacua

SEQ ID NO: 659968 - RNA, 19 nt, Homo sapiens
gcagaguaccauucuaguu

SEQ ID NO: 659969 - RNA, 19 nt, Homo sapiens
gauucaagaugaccaacga

SEQ ID NO: 659970 - RNA, 19 nt, Homo sapiens
gaguagauguggguuuaug

SEQ ID NO: 659971 - RNA, 19 nt, Homo sapiens
gaaaggcgacucuccugau

SEQ ID NO: 659972 - RNA, 19 nt, Homo sapiens
gaacugagugccuggaagu

SEQ ID NO: 659973 - RNA, 19 nt, Homo sapiens
gaacuggaacagacuaaag

SEQ ID NO: 659974 - RNA, 19 nt, Homo sapiens
agaguuggcuuuacagaag

SEQ ID NO: 659975 - RNA, 19 nt, Homo sapiens
gcgaagugucgaaugcuua

SEQ ID NO: 659976 - RNA, 19 nt, Homo sapiens
ccuaagagagucugaagaa

SEQ ID NO: 659977 - RNA, 19 nt, Homo sapiens
aagguucgauugagugaaa

SEQ ID NO: 659978 - RNA, 19 nt, Homo sapiens
cagaauggcuuggacucaa

SEQ ID NO: 659979 - RNA, 19 nt, Homo sapiens
uuacguaaaucaacucagu

SEQ ID NO: 659980 - RNA, 19 nt, Homo sapiens
ugacaaacggaccaaguaa

SEQ ID NO: 659981 - RNA, 19 nt, Homo sapiens
agucagaggccacaaguaa

SEQ ID NO: 659982 - RNA, 19 nt, Homo sapiens
ugaccaaaccuaaauaaag

SEQ ID NO: 659983 - RNA, 19 nt, Homo sapiens
guaugaaaguguagacucu

SEQ ID NO: 659984 - RNA, 19 nt, Homo sapiens
cgacucuccugauucaaga

SEQ ID NO: 659985 - RNA, 19 nt, Homo sapiens
guaagggcauucguacuca

SEQ ID NO: 659986 - RNA, 19 nt, Homo sapiens
gcagaggagguagugguua

SEQ ID NO: 659987 - RNA, 19 nt, Homo sapiens
aggaugaacugaaugacuu

SEQ ID NO: 659988 - RNA, 19 nt, Homo sapiens
ggaacaagcccaaaaugaa

SEQ ID NO: 659989 - RNA, 19 nt, Homo sapiens
ccaagaagguucgauugag

SEQ ID NO: 659990 - RNA, 19 nt, Homo sapiens
agaggauacuguccagaaa

SEQ ID NO: 659991 - RNA, 19 nt, Homo sapiens
cuaagagagucugaagaaa

SEQ ID NO: 659992 - RNA, 19 nt, Homo sapiens
caccauacaucugugcauu

SEQ ID NO: 659993 - RNA, 19 nt, Homo sapiens
auucagacuuguuagagua

SEQ ID NO: 659994 - RNA, 19 nt, Homo sapiens
uguguagggucaaguuauu

SEQ ID NO: 659995 - RNA, 19 nt, Homo sapiens
caauacuucugccgcuuug

SEQ ID NO: 659996 - RNA, 19 nt, Homo sapiens
gaaagcagugagugggaaa

SEQ ID NO: 659997 - RNA, 19 nt, Homo sapiens
guagaggguaugcagagua

SEQ ID NO: 659998 - RNA, 19 nt, Homo sapiens
gaaugcuuauccaggagaa

SEQ ID NO: 659999 - RNA, 19 nt, Homo sapiens
caagagaugaguuaauucu

SEQ ID NO: 660000 - RNA, 19 nt, Homo sapiens
gauacuguccagaaaauua

SEQ ID NO: 660001 - RNA, 19 nt, Homo sapiens
cagaguaccauucuaguuc

SEQ ID NO: 660002 - RNA, 19 nt, Homo sapiens
gcucugugacuccaguaua

SEQ ID NO: 660003 - RNA, 19 nt, Homo sapiens
uguauccuguuaaugcaua

SEQ ID NO: 660004 - RNA, 19 nt, Homo sapiens
cucuuuaggugacuguuua

SEQ ID NO: 660005 - RNA, 19 nt, Homo sapiens
guacucaugcuguuacugu

SEQ ID NO: 660006 - RNA, 19 nt, Homo sapiens
ccaggagaaucaagagcuu

SEQ ID NO: 660007 - RNA, 19 nt, Homo sapiens
guaacuggccuaagagagu

SEQ ID NO: 660008 - RNA, 19 nt, Homo sapiens
uugauggaguccuguagua

SEQ ID NO: 660009 - RNA, 19 nt, Homo sapiens
caacacaaccgaagaugac

SEQ ID NO: 660010 - RNA, 19 nt, Homo sapiens
acaaacggaccaaguaaug

SEQ ID NO: 660011 - RNA, 19 nt, Homo sapiens
guaguuucaguguuagaua

SEQ ID NO: 660012 - RNA, 19 nt, Homo sapiens
aaaguuggacucauugaug

SEQ ID NO: 660013 - RNA, 19 nt, Homo sapiens
acacaccaaucaaaugaca

SEQ ID NO: 660014 - RNA, 19 nt, Homo sapiens
caacagcucagaggagaga

SEQ ID NO: 660015 - RNA, 19 nt, Homo sapiens
gcaggacuacagcuucuga

SEQ ID NO: 660016 - RNA, 19 nt, Homo sapiens
ccagggacguauugcacaa

SEQ ID NO: 660017 - RNA, 19 nt, Homo sapiens
ggacgucugggucuggauu

SEQ ID NO: 660018 - RNA, 19 nt, Homo sapiens
gaguuggcuuuacagaaga

SEQ ID NO: 660019 - RNA, 19 nt, Homo sapiens
gacuaaagacaaacuggaa

SEQ ID NO: 660020 - RNA, 19 nt, Homo sapiens
caagagaugcaagagugua

SEQ ID NO: 660021 - RNA, 19 nt, Homo sapiens
cacaaugaugucuguauaa

SEQ ID NO: 660022 - RNA, 19 nt, Homo sapiens
ggaaagguaaucgaacugu

SEQ ID NO: 660023 - RNA, 19 nt, Homo sapiens
guaauaaguccuccaacag

SEQ ID NO: 660024 - RNA, 19 nt, Homo sapiens
gcaagagaugaguuaauuc

SEQ ID NO: 660025 - RNA, 19 nt, Homo sapiens
ggaaguuuacgccugauag

SEQ ID NO: 660026 - RNA, 19 nt, Homo sapiens
gagaugcaagaguguacua

SEQ ID NO: 660027 - RNA, 19 nt, Homo sapiens
acacagaucuuaacucuaa

SEQ ID NO: 660028 - RNA, 19 nt, Homo sapiens
gaucuuaacucuaaugaug

SEQ ID NO: 660029 - RNA, 19 nt, Homo sapiens
gagacucacugcauuauuu

SEQ ID NO: 660030 - RNA, 19 nt, Homo sapiens
gauauuagcugugaugaga

SEQ ID NO: 660031 - RNA, 19 nt, Homo sapiens
caacugagaucaacaaugg

SEQ ID NO: 660032 - RNA, 19 nt, Homo sapiens
gaauaugcaucgcucuuaa

SEQ ID NO: 660033 - RNA, 19 nt, Homo sapiens
gcgcauauauuuaaccauu

SEQ ID NO: 660034 - RNA, 19 nt, Homo sapiens
ggaacagacuaaagacaaa

SEQ ID NO: 660035 - RNA, 19 nt, Homo sapiens
acaaguagcgcauauauuu

SEQ ID NO: 660036 - RNA, 19 nt, Homo sapiens
ggcaagagaugaguuaauu

SEQ ID NO: 660037 - RNA, 19 nt, Homo sapiens
gggagaaacagaagucuua

SEQ ID NO: 660038 - RNA, 19 nt, Homo sapiens
guacacagaucuuaacucu

SEQ ID NO: 660039 - RNA, 19 nt, Homo sapiens
gaaccaacuuucaauaguc

SEQ ID NO: 660040 - RNA, 19 nt, Homo sapiens
guauugcacucuugauauu

SEQ ID NO: 660041 - RNA, 19 nt, Homo sapiens
aaacagaagucuuaagucu

SEQ ID NO: 660042 - RNA, 19 nt, Homo sapiens
caacuagauuguauaagga

SEQ ID NO: 660043 - RNA, 19 nt, Homo sapiens
gcaaguacacagaucuuaa

SEQ ID NO: 660044 - RNA, 19 nt, Homo sapiens
ggaauaugcaucgcucuua

SEQ ID NO: 660045 - RNA, 19 nt, Homo sapiens
ugauguaacuggccuaaga

SEQ ID NO: 660046 - RNA, 19 nt, Homo sapiens
caaguagcgcauauauuua

SEQ ID NO: 660047 - RNA, 19 nt, Homo sapiens
aaugaaaggugaacuggaa

SEQ ID NO: 660048 - RNA, 19 nt, Homo sapiens
caagaagguucgauugagu

SEQ ID NO: 660049 - RNA, 19 nt, Homo sapiens
caagaugaccaacgaagaa

SEQ ID NO: 660050 - RNA, 19 nt, Homo sapiens
guacaaguagcgcauauau

SEQ ID NO: 660051 - RNA, 19 nt, Homo sapiens
gcaucgcucuuaaccuuga

SEQ ID NO: 660052 - RNA, 19 nt, Homo sapiens
cugagugccuggaaguuua

SEQ ID NO: 660053 - RNA, 19 nt, Homo sapiens
aauaauagauguccguaca

SEQ ID NO: 660054 - RNA, 19 nt, Homo sapiens
caauaagacuguggacuuc

SEQ ID NO: 660055 - RNA, 19 nt, Homo sapiens
uguagacacuugagaaaug

SEQ ID NO: 660056 - RNA, 19 nt, Homo sapiens
gaaaauagagggagaaaca

SEQ ID NO: 660057 - RNA, 19 nt, Homo sapiens
ccagaugaaccuuguguuu

SEQ ID NO: 660058 - RNA, 19 nt, Homo sapiens
gagaugaguuaauucuaag

SEQ ID NO: 660059 - RNA, 19 nt, Homo sapiens
ccaauaagacuguggacuu

SEQ ID NO: 660060 - RNA, 19 nt, Homo sapiens
ccugauagguaaacaaauc

SEQ ID NO: 660061 - RNA, 19 nt, Homo sapiens
gaacaagagaugcaagagu

SEQ ID NO: 660062 - RNA, 19 nt, Homo sapiens
ucaaaguuauggcaagaga

SEQ ID NO: 660063 - RNA, 19 nt, Homo sapiens
ggacuauuccgaagaagug

SEQ ID NO: 660064 - RNA, 19 nt, Homo sapiens
uggagaggauucaagauga

SEQ ID NO: 660065 - RNA, 19 nt, Homo sapiens
uagaacauguagacacuug

SEQ ID NO: 660066 - RNA, 19 nt, Homo sapiens
gauucaagaugaccaacga

SEQ ID NO: 660067 - RNA, 19 nt, Homo sapiens
gagaaccaacuuucaauag

SEQ ID NO: 660068 - RNA, 19 nt, Homo sapiens
gaaguggccaccuccgaaa

SEQ ID NO: 660069 - RNA, 19 nt, Homo sapiens
acaccaagacucagacuuu

SEQ ID NO: 660070 - RNA, 19 nt, Homo sapiens
gaacugagugccuggaagu

SEQ ID NO: 660071 - RNA, 19 nt, Homo sapiens
gaacuggaacagacuaaag

SEQ ID NO: 660072 - RNA, 19 nt, Homo sapiens
ggacagccaaguacucguu

SEQ ID NO: 660073 - RNA, 19 nt, Homo sapiens
ccuaagagagucugaagaa

SEQ ID NO: 660074 - RNA, 19 nt, Homo sapiens
auagauguccguacaagua

SEQ ID NO: 660075 - RNA, 19 nt, Homo sapiens
ugagaaccaacuuucaaua

SEQ ID NO: 660076 - RNA, 19 nt, Homo sapiens
aagguucgauugagugaaa

SEQ ID NO: 660077 - RNA, 19 nt, Homo sapiens
gucaugagagaaucaaaua

SEQ ID NO: 660078 - RNA, 19 nt, Homo sapiens
gagcauagugacuuagaga

SEQ ID NO: 660079 - RNA, 19 nt, Homo sapiens
guagacacuugagaaaugu

SEQ ID NO: 660080 - RNA, 19 nt, Homo sapiens
auaaggauauuagcuguga

SEQ ID NO: 660081 - RNA, 19 nt, Homo sapiens
ucagacaguuugaaggaau

SEQ ID NO: 660082 - RNA, 19 nt, Homo sapiens
ggaacaagcccaaaaugaa

SEQ ID NO: 660083 - RNA, 19 nt, Homo sapiens
ccaagaagguucgauugag

SEQ ID NO: 660084 - RNA, 19 nt, Homo sapiens
cuaagagagucugaagaaa

SEQ ID NO: 660085 - RNA, 19 nt, Homo sapiens
ggagaaacagaagucuuaa

SEQ ID NO: 660086 - RNA, 19 nt, Homo sapiens
caagagaugaguuaauucu

SEQ ID NO: 660087 - RNA, 19 nt, Homo sapiens
agaaccaacuuucaauagu

SEQ ID NO: 660088 - RNA, 19 nt, Homo sapiens
caugauuguuguugaacuu

SEQ ID NO: 660089 - RNA, 19 nt, Homo sapiens
gcugagaaccaacuuucaa

SEQ ID NO: 660090 - RNA, 19 nt, Homo sapiens
gaaacagaagucuuaaguc

SEQ ID NO: 660091 - RNA, 19 nt, Homo sapiens
guaacuggccuaagagagu

SEQ ID NO: 660092 - RNA, 19 nt, Homo sapiens
ggugugguaucaaacuuca

SEQ ID NO: 660093 - RNA, 19 nt, Homo sapiens
uaauagauguccguacaag

SEQ ID NO: 660094 - RNA, 19 nt, Homo sapiens
acaugaaggugugguauca

SEQ ID NO: 660095 - RNA, 19 nt, Homo sapiens
acuguggacuucaugauug

SEQ ID NO: 660096 - RNA, 19 nt, Homo sapiens
augcaucgcucuuaaccuu

SEQ ID NO: 660097 - RNA, 19 nt, Homo sapiens
ggagaggauucaagaugac

SEQ ID NO: 660098 - RNA, 19 nt, Homo sapiens
gacuaaagacaaacuggaa

SEQ ID NO: 660099 - RNA, 19 nt, Homo sapiens
caagagaugcaagagugua

SEQ ID NO: 660100 - RNA, 19 nt, Homo sapiens
caaacaugaagguguggua

SEQ ID NO: 660101 - RNA, 19 nt, Homo sapiens
acugaggacuguacaaaca

SEQ ID NO: 660102 - RNA, 19 nt, Homo sapiens
ucaauagucaugagagaau

SEQ ID NO: 660103 - RNA, 19 nt, Homo sapiens
ccuugagcauagugacuua

SEQ ID NO: 660104 - RNA, 19 nt, Homo sapiens
gaaugaaaaccuagagauu

SEQ ID NO: 660105 - RNA, 19 nt, Homo sapiens
agaaacagaagucuuaagu

SEQ ID NO: 660106 - RNA, 19 nt, Homo sapiens
ggaaguuuacgccugauag

SEQ ID NO: 660107 - RNA, 19 nt, Homo sapiens
gagaugcaagaguguacua

SEQ ID NO: 660108 - RNA, 19 nt, Homo sapiens
gcaagagaugaguuaauuc

SEQ ID NO: 660109 - RNA, 19 nt, Homo sapiens
auuacuugcuugagccuua

SEQ ID NO: 660110 - RNA, 19 nt, Homo sapiens
ugaagcauauguacaagcu

SEQ ID NO: 660111 - RNA, 19 nt, Homo sapiens
gaacauguagacacuugag

SEQ ID NO: 660112 - RNA, 19 nt, Homo sapiens
aaccuuguguuucagcuuu

SEQ ID NO: 660113 - RNA, 19 nt, Homo sapiens
gggaaaacauccuuguaau

SEQ ID NO: 660114 - RNA, 19 nt, Homo sapiens
augaaggugugguaucaaa

SEQ ID NO: 660115 - RNA, 19 nt, Homo sapiens
ggcaaguacacagaucuua

SEQ ID NO: 660116 - RNA, 19 nt, Homo sapiens
guacucguuuccacaccaa

SEQ ID NO: 660117 - RNA, 19 nt, Homo sapiens
gaaggugugguaucaaacu

SEQ ID NO: 660118 - RNA, 19 nt, Homo sapiens
ugaggacuguacaaacaug

SEQ ID NO: 660119 - RNA, 19 nt, Homo sapiens
gcauagugacuuagagaca

SEQ ID NO: 660120 - RNA, 19 nt, Homo sapiens
cauguagacacuugagaaa

SEQ ID NO: 660121 - RNA, 19 nt, Homo sapiens
uaagagagucugaagaaaa

SEQ ID NO: 660122 - RNA, 19 nt, Homo sapiens
gagggcaaguacacagauc

SEQ ID NO: 660123 - RNA, 19 nt, Homo sapiens
gaggugaauuuugccuuua

SEQ ID NO: 660124 - RNA, 19 nt, Homo sapiens
uauggcaagagaugaguua

SEQ ID NO: 660125 - RNA, 19 nt, Homo sapiens
gcgacuagcaaccaaggaa

SEQ ID NO: 660126 - RNA, 19 nt, Homo sapiens
ggaaaacauccuuguaaug

SEQ ID NO: 660127 - RNA, 19 nt, Homo sapiens
acacagaucuuaacucuaa

SEQ ID NO: 660128 - RNA, 19 nt, Homo sapiens
gaucuuaacucuaaugaug

SEQ ID NO: 660129 - RNA, 19 nt, Homo sapiens
gagacucacugcauuauuu

SEQ ID NO: 660130 - RNA, 19 nt, Homo sapiens
gauauuagcugugaugaga

SEQ ID NO: 660131 - RNA, 19 nt, Homo sapiens
caacugagaucaacaaugg

SEQ ID NO: 660132 - RNA, 19 nt, Homo sapiens
gaauaugcaucgcucuuaa

SEQ ID NO: 660133 - RNA, 19 nt, Homo sapiens
gcgcauauauuuaaccauu

SEQ ID NO: 660134 - RNA, 19 nt, Homo sapiens
ggaacagacuaaagacaaa

SEQ ID NO: 660135 - RNA, 19 nt, Homo sapiens
acaaguagcgcauauauuu

SEQ ID NO: 660136 - RNA, 19 nt, Homo sapiens
ggcaagagaugaguuaauu

SEQ ID NO: 660137 - RNA, 19 nt, Homo sapiens
gggagaaacagaagucuua

SEQ ID NO: 660138 - RNA, 19 nt, Homo sapiens
guacacagaucuuaacucu

SEQ ID NO: 660139 - RNA, 19 nt, Homo sapiens
gaaccaacuuucaauaguc

SEQ ID NO: 660140 - RNA, 19 nt, Homo sapiens
guauugcacucuugauauu

SEQ ID NO: 660141 - RNA, 19 nt, Homo sapiens
aaacagaagucuuaagucu

SEQ ID NO: 660142 - RNA, 19 nt, Homo sapiens
caacuagauuguauaagga

SEQ ID NO: 660143 - RNA, 19 nt, Homo sapiens
gcaaguacacagaucuuaa

SEQ ID NO: 660144 - RNA, 19 nt, Homo sapiens
ggaauaugcaucgcucuua

SEQ ID NO: 660145 - RNA, 19 nt, Homo sapiens
ugauguaacuggccuaaga

SEQ ID NO: 660146 - RNA, 19 nt, Homo sapiens
caaguagcgcauauauuua

SEQ ID NO: 660147 - RNA, 19 nt, Homo sapiens
aaugaaaggugaacuggaa

SEQ ID NO: 660148 - RNA, 19 nt, Homo sapiens
caagaagguucgauugagu

SEQ ID NO: 660149 - RNA, 19 nt, Homo sapiens
guacaaguagcgcauauau

SEQ ID NO: 660150 - RNA, 19 nt, Homo sapiens
caagaugaccaacgaagaa

SEQ ID NO: 660151 - RNA, 19 nt, Homo sapiens
gcaucgcucuuaaccuuga

SEQ ID NO: 660152 - RNA, 19 nt, Homo sapiens
cugagugccuggaaguuua

SEQ ID NO: 660153 - RNA, 19 nt, Homo sapiens
aauaauagauguccguaca

SEQ ID NO: 660154 - RNA, 19 nt, Homo sapiens
caauaagacuguggacuuc

SEQ ID NO: 660155 - RNA, 19 nt, Homo sapiens
uguagacacuugagaaaug

SEQ ID NO: 660156 - RNA, 19 nt, Homo sapiens
gaaaggacggggaguguua

SEQ ID NO: 660157 - RNA, 19 nt, Homo sapiens
gaaaauagagggagaaaca

SEQ ID NO: 660158 - RNA, 19 nt, Homo sapiens
ccagaugaaccuuguguuu

SEQ ID NO: 660159 - RNA, 19 nt, Homo sapiens
gagaugaguuaauucuaag

SEQ ID NO: 660160 - RNA, 19 nt, Homo sapiens
ccaauaagacuguggacuu

SEQ ID NO: 660161 - RNA, 19 nt, Homo sapiens
ccugauagguaaacaaauc

SEQ ID NO: 660162 - RNA, 19 nt, Homo sapiens
gaacaagagaugcaagagu

SEQ ID NO: 660163 - RNA, 19 nt, Homo sapiens
ucaaaguuauggcaagaga

SEQ ID NO: 660164 - RNA, 19 nt, Homo sapiens
ggacuauuccgaagaagug

SEQ ID NO: 660165 - RNA, 19 nt, Homo sapiens
aaaggcgacucuccugauu

SEQ ID NO: 660166 - RNA, 19 nt, Homo sapiens
uagaacauguagacacuug

SEQ ID NO: 660167 - RNA, 19 nt, Homo sapiens
gauucaagaugaccaacga

SEQ ID NO: 660168 - RNA, 19 nt, Homo sapiens
gagaaccaacuuucaauag

SEQ ID NO: 660169 - RNA, 19 nt, Homo sapiens
gaaguggccaccuccgaaa

SEQ ID NO: 660170 - RNA, 19 nt, Homo sapiens
acaccaagacucagacuuu

SEQ ID NO: 660171 - RNA, 19 nt, Homo sapiens
gaacugagugccuggaagu

SEQ ID NO: 660172 - RNA, 19 nt, Homo sapiens
gaacuggaacagacuaaag

SEQ ID NO: 660173 - RNA, 19 nt, Homo sapiens
gaaaggcgacucuccugau

SEQ ID NO: 660174 - RNA, 19 nt, Homo sapiens
ggacagccaaguacucguu

SEQ ID NO: 660175 - RNA, 19 nt, Homo sapiens
ccuaagagagucugaagaa

SEQ ID NO: 660176 - RNA, 19 nt, Homo sapiens
auagauguccguacaagua

SEQ ID NO: 660177 - RNA, 19 nt, Homo sapiens
ugagaaccaacuuucaaua

SEQ ID NO: 660178 - RNA, 19 nt, Homo sapiens
aagguucgauugagugaaa

SEQ ID NO: 660179 - RNA, 19 nt, Homo sapiens
gucaugagagaaucaaaua

SEQ ID NO: 660180 - RNA, 19 nt, Homo sapiens
gagcauagugacuuagaga

SEQ ID NO: 660181 - RNA, 19 nt, Homo sapiens
cgacucuccugauucaaga

SEQ ID NO: 660182 - RNA, 19 nt, Homo sapiens
guagacacuugagaaaugu

SEQ ID NO: 660183 - RNA, 19 nt, Homo sapiens
auaaggauauuagcuguga

SEQ ID NO: 660184 - RNA, 19 nt, Homo sapiens
ucagacaguuugaaggaau

SEQ ID NO: 660185 - RNA, 19 nt, Homo sapiens
ggaacaagcccaaaaugaa

SEQ ID NO: 660186 - RNA, 19 nt, Homo sapiens
cuaagagagucugaagaaa

SEQ ID NO: 660187 - RNA, 19 nt, Homo sapiens
ccaagaagguucgauugag

SEQ ID NO: 660188 - RNA, 19 nt, Homo sapiens
ggagaaacagaagucuuaa

SEQ ID NO: 660189 - RNA, 19 nt, Homo sapiens
agaaccaacuuucaauagu

SEQ ID NO: 660190 - RNA, 19 nt, Homo sapiens
caugauuguuguugaacuu

SEQ ID NO: 660191 - RNA, 19 nt, Homo sapiens
caagagaugaguuaauucu

SEQ ID NO: 660192 - RNA, 19 nt, Homo sapiens
gcugagaaccaacuuucaa

SEQ ID NO: 660193 - RNA, 19 nt, Homo sapiens
gaaacagaagucuuaaguc

SEQ ID NO: 660194 - RNA, 19 nt, Homo sapiens
guaacuggccuaagagagu

SEQ ID NO: 660195 - RNA, 19 nt, Homo sapiens
ggugugguaucaaacuuca

SEQ ID NO: 660196 - RNA, 19 nt, Homo sapiens
uaauagauguccguacaag

SEQ ID NO: 660197 - RNA, 19 nt, Homo sapiens
acaugaaggugugguauca

SEQ ID NO: 660198 - RNA, 19 nt, Homo sapiens
acuguggacuucaugauug

SEQ ID NO: 660199 - RNA, 19 nt, Homo sapiens
augcaucgcucuuaaccuu

SEQ ID NO: 660200 - RNA, 19 nt, Homo sapiens
gacuaaagacaaacuggaa

SEQ ID NO: 660201 - RNA, 19 nt, Homo sapiens
caagagaugcaagagugua

SEQ ID NO: 660202 - RNA, 19 nt, Homo sapiens
caaacaugaagguguggua

SEQ ID NO: 660203 - RNA, 19 nt, Homo sapiens
acugaggacuguacaaaca

SEQ ID NO: 660204 - RNA, 19 nt, Homo sapiens
ucaauagucaugagagaau

SEQ ID NO: 660205 - RNA, 19 nt, Homo sapiens
ccuugagcauagugacuua

SEQ ID NO: 660206 - RNA, 19 nt, Homo sapiens
gaaugaaaaccuagagauu

SEQ ID NO: 660207 - RNA, 19 nt, Homo sapiens
gcaagagaugaguuaauuc

SEQ ID NO: 660208 - RNA, 19 nt, Homo sapiens
agaaacagaagucuuaagu

SEQ ID NO: 660209 - RNA, 19 nt, Homo sapiens
ggaaguuuacgccugauag

SEQ ID NO: 660210 - RNA, 19 nt, Homo sapiens
gagaugcaagaguguacua

SEQ ID NO: 660211 - RNA, 19 nt, Homo sapiens
auuacuugcuugagccuua

SEQ ID NO: 660212 - RNA, 19 nt, Homo sapiens
ugaagcauauguacaagcu

SEQ ID NO: 660213 - RNA, 19 nt, Homo sapiens
gaacauguagacacuugag

SEQ ID NO: 660214 - RNA, 19 nt, Homo sapiens
aaccuuguguuucagcuuu

SEQ ID NO: 660215 - RNA, 19 nt, Homo sapiens
gggaaaacauccuuguaau

SEQ ID NO: 660216 - RNA, 19 nt, Homo sapiens
augaaggugugguaucaaa

SEQ ID NO: 660217 - RNA, 19 nt, Homo sapiens
ggcaaguacacagaucuua

SEQ ID NO: 660218 - RNA, 19 nt, Homo sapiens
guacucguuuccacaccaa

SEQ ID NO: 660219 - RNA, 19 nt, Homo sapiens
gaaggugugguaucaaacu

SEQ ID NO: 660220 - RNA, 19 nt, Homo sapiens
ugaggacuguacaaacaug

SEQ ID NO: 660221 - RNA, 19 nt, Homo sapiens
gcauagugacuuagagaca

SEQ ID NO: 660222 - RNA, 19 nt, Homo sapiens
cauguagacacuugagaaa

SEQ ID NO: 660223 - RNA, 19 nt, Homo sapiens
uaagagagucugaagaaaa

SEQ ID NO: 660224 - RNA, 19 nt, Homo sapiens
gagggcaaguacacagauc

SEQ ID NO: 660225 - RNA, 19 nt, Homo sapiens
gaggugaauuuugccuuua

SEQ ID NO: 660226 - RNA, 19 nt, Homo sapiens
uauggcaagagaugaguua

SEQ ID NO: 660227 - RNA, 19 nt, Homo sapiens
ggaagaaacuaaagaacaa

SEQ ID NO: 660228 - RNA, 19 nt, Homo sapiens
gacacaagcucacgugaua

SEQ ID NO: 660229 - RNA, 19 nt, Homo sapiens
cgacagaaguguuugauga

SEQ ID NO: 660230 - RNA, 19 nt, Homo sapiens
gagagaaucugcaaaguca

SEQ ID NO: 660231 - RNA, 19 nt, Homo sapiens
ugauugagguccauauuua

SEQ ID NO: 660232 - RNA, 19 nt, Homo sapiens
agaagaagcugaauguaaa

SEQ ID NO: 660233 - RNA, 19 nt, Homo sapiens
auaaagagauggcuacuaa

SEQ ID NO: 660234 - RNA, 19 nt, Homo sapiens
gaccaugacuguugaggua

SEQ ID NO: 660235 - RNA, 19 nt, Homo sapiens
gaaggaggaugaaguggaa

SEQ ID NO: 660236 - RNA, 19 nt, Homo sapiens
caaacaaucuacagagaaa

SEQ ID NO: 660237 - RNA, 19 nt, Homo sapiens
guagaagguuccacuguaa

SEQ ID NO: 660238 - RNA, 19 nt, Homo sapiens
gaagacaaguaguagaaga

SEQ ID NO: 660239 - RNA, 19 nt, Homo sapiens
gguagaagguuccacugua

SEQ ID NO: 660240 - RNA, 19 nt, Homo sapiens
caaagugaguguagcaauu

SEQ ID NO: 660241 - RNA, 19 nt, Homo sapiens
caaaggaagucagcaguuu

SEQ ID NO: 660242 - RNA, 19 nt, Homo sapiens
gcaaaguagugaauauguu

SEQ ID NO: 660243 - RNA, 19 nt, Homo sapiens
gaaggaggaugcccaggaa

SEQ ID NO: 660244 - RNA, 19 nt, Homo sapiens
gacagaaccucuugaacaa

SEQ ID NO: 660245 - RNA, 19 nt, Homo sapiens
ccaccaagcuccuacagaa

SEQ ID NO: 660246 - RNA, 19 nt, Homo sapiens
gaagucagaugaagucgau

SEQ ID NO: 660247 - RNA, 19 nt, Homo sapiens
gagcacagccucugaaaug

SEQ ID NO: 660248 - RNA, 19 nt, Homo sapiens
gaaacaggaucaaccuuca

SEQ ID NO: 660249 - RNA, 19 nt, Homo sapiens
ucaagaggcugaccaguau

SEQ ID NO: 660250 - RNA, 19 nt, Homo sapiens
gaaacuguauccauucugu

SEQ ID NO: 660251 - RNA, 19 nt, Homo sapiens
gcaaagccacgcagaaauu

SEQ ID NO: 660252 - RNA, 19 nt, Homo sapiens
ggaaagugauaaagaagau

SEQ ID NO: 660253 - RNA, 19 nt, Homo sapiens
gaagcagcauccaaagaaa

SEQ ID NO: 660254 - RNA, 19 nt, Homo sapiens
aaacagagccuccuagaug

SEQ ID NO: 660255 - RNA, 19 nt, Homo sapiens
ggacaagcacauucugaua

SEQ ID NO: 660256 - RNA, 19 nt, Homo sapiens
ccacugagguguccaagga

SEQ ID NO: 660257 - RNA, 19 nt, Homo sapiens
ucacugaaguugcccuuaa

SEQ ID NO: 660258 - RNA, 19 nt, Homo sapiens
caacgaagaugacucugau

SEQ ID NO: 660259 - RNA, 19 nt, Homo sapiens
gaaauaagucagguucuuu

SEQ ID NO: 660260 - RNA, 19 nt, Homo sapiens
gagggcagcuaccauuauu

SEQ ID NO: 660261 - RNA, 19 nt, Homo sapiens
uaagucagguucuuuacaa

SEQ ID NO: 660262 - RNA, 19 nt, Homo sapiens
cuagagccauuuaacauuu

SEQ ID NO: 660263 - RNA, 19 nt, Homo sapiens
gcaguaaacuuguccaaaa

SEQ ID NO: 660264 - RNA, 19 nt, Homo sapiens
gaaaaggucuuaggagaaa

SEQ ID NO: 660265 - RNA, 19 nt, Homo sapiens
gaugguaguucaagucgaa

SEQ ID NO: 660266 - RNA, 19 nt, Homo sapiens
gaagaccaguauuucagaa

SEQ ID NO: 660267 - RNA, 19 nt, Homo sapiens
ccaguaugcugaugagaaa

SEQ ID NO: 660268 - RNA, 19 nt, Homo sapiens
gcagggaaguccacuaaag

SEQ ID NO: 660269 - RNA, 19 nt, Homo sapiens
ggaggagacacccgaaaua

SEQ ID NO: 660270 - RNA, 19 nt, Homo sapiens
cagaagaagcugaauguaa

SEQ ID NO: 660271 - RNA, 19 nt, Homo sapiens
ggaagacacucuagagcau

SEQ ID NO: 660272 - RNA, 19 nt, Homo sapiens
ggaaauccaugaggagaau

SEQ ID NO: 660273 - RNA, 19 nt, Homo sapiens
gagaaguaauugcagaaga

SEQ ID NO: 660274 - RNA, 19 nt, Homo sapiens
gauagauacuggauugugu

SEQ ID NO: 660275 - RNA, 19 nt, Homo sapiens
gaucaagguacaauucuuu

SEQ ID NO: 660276 - RNA, 19 nt, Homo sapiens
ggagaaagaaggagaggaa

SEQ ID NO: 660277 - RNA, 19 nt, Homo sapiens
gaagaaacagccaccgaaa

SEQ ID NO: 660278 - RNA, 19 nt, Homo sapiens
gaaagagacggauguagug

SEQ ID NO: 660279 - RNA, 19 nt, Homo sapiens
ggaggaagaagaagucauu

SEQ ID NO: 660280 - RNA, 19 nt, Homo sapiens
gauacuggauuguguuugu

SEQ ID NO: 660281 - RNA, 19 nt, Homo sapiens
gcaggauacuacaugcuuu

SEQ ID NO: 660282 - RNA, 19 nt, Homo sapiens
gagaucacgugucuggaaa

SEQ ID NO: 660283 - RNA, 19 nt, Homo sapiens
ggagacacccgaaauaauc

SEQ ID NO: 660284 - RNA, 19 nt, Homo sapiens
ggagaaacugccaacauuu

SEQ ID NO: 660285 - RNA, 19 nt, Homo sapiens
ggaaagagaaguaauugca

SEQ ID NO: 660286 - RNA, 19 nt, Homo sapiens
uaacauuccugaucaaggu

SEQ ID NO: 660287 - RNA, 19 nt, Homo sapiens
caagaccaaccuacaauuu

SEQ ID NO: 660288 - RNA, 19 nt, Homo sapiens
gcacagugaaucagauaaa

SEQ ID NO: 660289 - RNA, 19 nt, Homo sapiens
gaaaagaccaugacuguug

SEQ ID NO: 660290 - RNA, 19 nt, Homo sapiens
gaugaaacaccaauuacuu

SEQ ID NO: 660291 - RNA, 19 nt, Homo sapiens
gaagaaagagacggaugua

SEQ ID NO: 660292 - RNA, 19 nt, Homo sapiens
agaaguaauugcagaagaa

SEQ ID NO: 660293 - RNA, 19 nt, Homo sapiens
gagcaaagccacgcagaaa

SEQ ID NO: 660294 - RNA, 19 nt, Homo sapiens
ugaccuaaauggccagaaa

SEQ ID NO: 660295 - RNA, 19 nt, Homo sapiens
uggcguaccugacauagaa

SEQ ID NO: 660296 - RNA, 19 nt, Homo sapiens
caaagaaagcgaacccaaa

SEQ ID NO: 660297 - RNA, 19 nt, Homo sapiens
gaggcaaaguagugaauau

SEQ ID NO: 660298 - RNA, 19 nt, Homo sapiens
caacccaugugaaugaaga

SEQ ID NO: 660299 - RNA, 19 nt, Homo sapiens
aaauagaaguccaccaaga

SEQ ID NO: 660300 - RNA, 19 nt, Homo sapiens
gaggagacacccgaaauaa

SEQ ID NO: 660301 - RNA, 19 nt, Homo sapiens
acaagcacauucugauauu

SEQ ID NO: 660302 - RNA, 19 nt, Homo sapiens
agagagagaugguaguuca

SEQ ID NO: 660303 - RNA, 19 nt, Homo sapiens
gaagaagaagucauuguca

SEQ ID NO: 660304 - RNA, 19 nt, Homo sapiens
auuggucacuuuccuauua

SEQ ID NO: 660305 - RNA, 19 nt, Homo sapiens
gauguaguguugaaaguag

SEQ ID NO: 660306 - RNA, 19 nt, Homo sapiens
ccaggagggugaccuaaau

SEQ ID NO: 660307 - RNA, 19 nt, Homo sapiens
gagcgcgucuccuucauuc

SEQ ID NO: 660308 - RNA, 19 nt, Homo sapiens
ggauuguguuugugccaua

SEQ ID NO: 660309 - RNA, 19 nt, Homo sapiens
auagagaagucacuaguug

SEQ ID NO: 660310 - RNA, 19 nt, Homo sapiens
aggagaaacugccaacauu

SEQ ID NO: 660311 - RNA, 19 nt, Homo sapiens
gaaagacgagauuguggaa

SEQ ID NO: 660312 - RNA, 19 nt, Homo sapiens
gaagagaccacagaaaugg

SEQ ID NO: 660313 - RNA, 19 nt, Homo sapiens
uagcaagucugcagaaucu

SEQ ID NO: 660314 - RNA, 19 nt, Homo sapiens
agagauggcuacuaaguca

SEQ ID NO: 660315 - RNA, 19 nt, Homo sapiens
caacacauucauuuggaua

SEQ ID NO: 660316 - RNA, 19 nt, Homo sapiens
ugaaauaagucagguucuu

SEQ ID NO: 660317 - RNA, 19 nt, Homo sapiens
caggaugaaacaccaauua

SEQ ID NO: 660318 - RNA, 19 nt, Homo sapiens
caaaagagacuccgauaaa

SEQ ID NO: 660319 - RNA, 19 nt, Homo sapiens
ggaugaugcucuugaacug

SEQ ID NO: 660320 - RNA, 19 nt, Homo sapiens
gcagagagcagaggcagaa

SEQ ID NO: 660321 - RNA, 19 nt, Homo sapiens
ugacagaaccucuugaaca

SEQ ID NO: 660322 - RNA, 19 nt, Homo sapiens
gauaucugcuucagugaca

SEQ ID NO: 660323 - RNA, 19 nt, Homo sapiens
gggaggagaccaccagaaa

SEQ ID NO: 660324 - RNA, 19 nt, Homo sapiens
ggucagcuguccaccauca

SEQ ID NO: 660325 - RNA, 19 nt, Homo sapiens
agucagaacuuacagaauc

SEQ ID NO: 660326 - RNA, 19 nt, Homo sapiens
cgucgggucugaagaaaga

SEQ ID NO: 660327 - RNA, 19 nt, Homo sapiens
ggaagaaacuaaagaacaa

SEQ ID NO: 660328 - RNA, 19 nt, Homo sapiens
gacacaagcucacgugaua

SEQ ID NO: 660329 - RNA, 19 nt, Homo sapiens
cgacagaaguguuugauga

SEQ ID NO: 660330 - RNA, 19 nt, Homo sapiens
gagagaaucugcaaaguca

SEQ ID NO: 660331 - RNA, 19 nt, Homo sapiens
ugauugagguccauauuua

SEQ ID NO: 660332 - RNA, 19 nt, Homo sapiens
agaagaagcugaauguaaa

SEQ ID NO: 660333 - RNA, 19 nt, Homo sapiens
auaaagagauggcuacuaa

SEQ ID NO: 660334 - RNA, 19 nt, Homo sapiens
gaccaugacuguugaggua

SEQ ID NO: 660335 - RNA, 19 nt, Homo sapiens
gaaggaggaugaaguggaa

SEQ ID NO: 660336 - RNA, 19 nt, Homo sapiens
caaacaaucuacagagaaa

SEQ ID NO: 660337 - RNA, 19 nt, Homo sapiens
guagaagguuccacuguaa

SEQ ID NO: 660338 - RNA, 19 nt, Homo sapiens
gaagacaaguaguagaaga

SEQ ID NO: 660339 - RNA, 19 nt, Homo sapiens
gguagaagguuccacugua

SEQ ID NO: 660340 - RNA, 19 nt, Homo sapiens
caaagugaguguagcaauu

SEQ ID NO: 660341 - RNA, 19 nt, Homo sapiens
caaaggaagucagcaguuu

SEQ ID NO: 660342 - RNA, 19 nt, Homo sapiens
gcaaaguagugaauauguu

SEQ ID NO: 660343 - RNA, 19 nt, Homo sapiens
gaaggaggaugcccaggaa

SEQ ID NO: 660344 - RNA, 19 nt, Homo sapiens
gacagaaccucuugaacaa

SEQ ID NO: 660345 - RNA, 19 nt, Homo sapiens
gaagucagaugaagucgau

SEQ ID NO: 660346 - RNA, 19 nt, Homo sapiens
gagcacagccucugaaaug

SEQ ID NO: 660347 - RNA, 19 nt, Homo sapiens
gaaacaggaucaaccuuca

SEQ ID NO: 660348 - RNA, 19 nt, Homo sapiens
ucaagaggcugaccaguau

SEQ ID NO: 660349 - RNA, 19 nt, Homo sapiens
gaaacuguauccauucugu

SEQ ID NO: 660350 - RNA, 19 nt, Homo sapiens
gcaaagccacgcagaaauu

SEQ ID NO: 660351 - RNA, 19 nt, Homo sapiens
ggaaagugauaaagaagau

SEQ ID NO: 660352 - RNA, 19 nt, Homo sapiens
gaagcagcauccaaagaaa

SEQ ID NO: 660353 - RNA, 19 nt, Homo sapiens
aaacagagccuccuagaug

SEQ ID NO: 660354 - RNA, 19 nt, Homo sapiens
ggacaagcacauucugaua

SEQ ID NO: 660355 - RNA, 19 nt, Homo sapiens
ccacugagguguccaagga

SEQ ID NO: 660356 - RNA, 19 nt, Homo sapiens
ucacugaaguugcccuuaa

SEQ ID NO: 660357 - RNA, 19 nt, Homo sapiens
caacgaagaugacucugau

SEQ ID NO: 660358 - RNA, 19 nt, Homo sapiens
gaaauaagucagguucuuu

SEQ ID NO: 660359 - RNA, 19 nt, Homo sapiens
gagggcagcuaccauuauu

SEQ ID NO: 660360 - RNA, 19 nt, Homo sapiens
uaagucagguucuuuacaa

SEQ ID NO: 660361 - RNA, 19 nt, Homo sapiens
cuagagccauuuaacauuu

SEQ ID NO: 660362 - RNA, 19 nt, Homo sapiens
gcaguaaacuuguccaaaa

SEQ ID NO: 660363 - RNA, 19 nt, Homo sapiens
gaaaaggucuuaggagaaa

SEQ ID NO: 660364 - RNA, 19 nt, Homo sapiens
gaugguaguucaagucgaa

SEQ ID NO: 660365 - RNA, 19 nt, Homo sapiens
gaagaccaguauuucagaa

SEQ ID NO: 660366 - RNA, 19 nt, Homo sapiens
ccaguaugcugaugagaaa

SEQ ID NO: 660367 - RNA, 19 nt, Homo sapiens
gcagggaaguccacuaaag

SEQ ID NO: 660368 - RNA, 19 nt, Homo sapiens
ggaggagacacccgaaaua

SEQ ID NO: 660369 - RNA, 19 nt, Homo sapiens
cagaagaagcugaauguaa

SEQ ID NO: 660370 - RNA, 19 nt, Homo sapiens
ggaagacacucuagagcau

SEQ ID NO: 660371 - RNA, 19 nt, Homo sapiens
ggaaauccaugaggagaau

SEQ ID NO: 660372 - RNA, 19 nt, Homo sapiens
gagaaguaauugcagaaga

SEQ ID NO: 660373 - RNA, 19 nt, Homo sapiens
gauagauacuggauugugu

SEQ ID NO: 660374 - RNA, 19 nt, Homo sapiens
gaucaagguacaauucuuu

SEQ ID NO: 660375 - RNA, 19 nt, Homo sapiens
ggagaaagaaggagaggaa

SEQ ID NO: 660376 - RNA, 19 nt, Homo sapiens
gaagaaacagccaccgaaa

SEQ ID NO: 660377 - RNA, 19 nt, Homo sapiens
gaaagagacggauguagug

SEQ ID NO: 660378 - RNA, 19 nt, Homo sapiens
gauacuggauuguguuugu

SEQ ID NO: 660379 - RNA, 19 nt, Homo sapiens
gcaggauacuacaugcuuu

SEQ ID NO: 660380 - RNA, 19 nt, Homo sapiens
gagaucacgugucuggaaa

SEQ ID NO: 660381 - RNA, 19 nt, Homo sapiens
ggagacacccgaaauaauc

SEQ ID NO: 660382 - RNA, 19 nt, Homo sapiens
ggagaaacugccaacauuu

SEQ ID NO: 660383 - RNA, 19 nt, Homo sapiens
ggaaagagaaguaauugca

SEQ ID NO: 660384 - RNA, 19 nt, Homo sapiens
uaacauuccugaucaaggu

SEQ ID NO: 660385 - RNA, 19 nt, Homo sapiens
caagaccaaccuacaauuu

SEQ ID NO: 660386 - RNA, 19 nt, Homo sapiens
gcacagugaaucagauaaa

SEQ ID NO: 660387 - RNA, 19 nt, Homo sapiens
gaaaagaccaugacuguug

SEQ ID NO: 660388 - RNA, 19 nt, Homo sapiens
gaugaaacaccaauuacuu

SEQ ID NO: 660389 - RNA, 19 nt, Homo sapiens
gaagaaagagacggaugua

SEQ ID NO: 660390 - RNA, 19 nt, Homo sapiens
agaaguaauugcagaagaa

SEQ ID NO: 660391 - RNA, 19 nt, Homo sapiens
gagcaaagccacgcagaaa

SEQ ID NO: 660392 - RNA, 19 nt, Homo sapiens
uggcguaccugacauagaa

SEQ ID NO: 660393 - RNA, 19 nt, Homo sapiens
caaagaaagcgaacccaaa

SEQ ID NO: 660394 - RNA, 19 nt, Homo sapiens
gaggcaaaguagugaauau

SEQ ID NO: 660395 - RNA, 19 nt, Homo sapiens
caacccaugugaaugaaga

SEQ ID NO: 660396 - RNA, 19 nt, Homo sapiens
aaauagaaguccaccaaga

SEQ ID NO: 660397 - RNA, 19 nt, Homo sapiens
gaggagacacccgaaauaa

SEQ ID NO: 660398 - RNA, 19 nt, Homo sapiens
acaagcacauucugauauu

SEQ ID NO: 660399 - RNA, 19 nt, Homo sapiens
agagagagaugguaguuca

SEQ ID NO: 660400 - RNA, 19 nt, Homo sapiens
auuggucacuuuccuauua

SEQ ID NO: 660401 - RNA, 19 nt, Homo sapiens
gcugaucuccuguacagua

SEQ ID NO: 660402 - RNA, 19 nt, Homo sapiens
gauguaguguugaaaguag

SEQ ID NO: 660403 - RNA, 19 nt, Homo sapiens
ggauuguguuugugccaua

SEQ ID NO: 660404 - RNA, 19 nt, Homo sapiens
agagauggcuacuaaguca

SEQ ID NO: 660405 - RNA, 19 nt, Homo sapiens
auagagaagucacuaguug

SEQ ID NO: 660406 - RNA, 19 nt, Homo sapiens
aggagaaacugccaacauu

SEQ ID NO: 660407 - RNA, 19 nt, Homo sapiens
gaaagacgagauuguggaa

SEQ ID NO: 660408 - RNA, 19 nt, Homo sapiens
gaagagaccacagaaaugg

SEQ ID NO: 660409 - RNA, 19 nt, Homo sapiens
caucacaguuggacagaga

SEQ ID NO: 660410 - RNA, 19 nt, Homo sapiens
uagcaagucugcagaaucu

SEQ ID NO: 660411 - RNA, 19 nt, Homo sapiens
caacacauucauuuggaua

SEQ ID NO: 660412 - RNA, 19 nt, Homo sapiens
ugaaauaagucagguucuu

SEQ ID NO: 660413 - RNA, 19 nt, Homo sapiens
caggaugaaacaccaauua

SEQ ID NO: 660414 - RNA, 19 nt, Homo sapiens
ggaugaugcucuugaacug

SEQ ID NO: 660415 - RNA, 19 nt, Homo sapiens
gcagagagcagaggcagaa

SEQ ID NO: 660416 - RNA, 19 nt, Homo sapiens
caaaagagacuccgauaaa

SEQ ID NO: 660417 - RNA, 19 nt, Homo sapiens
ugacagaaccucuugaaca

SEQ ID NO: 660418 - RNA, 19 nt, Homo sapiens
gauaucugcuucagugaca

SEQ ID NO: 660419 - RNA, 19 nt, Homo sapiens
gggaggagaccaccagaaa

SEQ ID NO: 660420 - RNA, 19 nt, Homo sapiens
agucagaacuuacagaauc

SEQ ID NO: 660421 - RNA, 19 nt, Homo sapiens
cgucgggucugaagaaaga

SEQ ID NO: 660422 - RNA, 19 nt, Homo sapiens
gaaauggugucagcagucu

SEQ ID NO: 660423 - RNA, 19 nt, Homo sapiens
cagcuaccauuauugaaga

SEQ ID NO: 660424 - RNA, 19 nt, Homo sapiens
aagaugagcuggacaaggu

SEQ ID NO: 660425 - RNA, 19 nt, Homo sapiens
ggagaucacgugucuggaa

SEQ ID NO: 660426 - RNA, 19 nt, Homo sapiens
aaacggagguggaagaaac

SEQ ID NO: 660427 - RNA, 19 nt, Homo sapiens
ggacugaucuacuuucaca

SEQ ID NO: 660428 - RNA, 19 nt, Homo sapiens
caagaaagcccgucuggaa

SEQ ID NO: 660429 - RNA, 19 nt, Homo sapiens
gcauaaggcugagcugaga

SEQ ID NO: 660430 - RNA, 19 nt, Homo sapiens
gaaagcccgucuggaagaa

SEQ ID NO: 660431 - RNA, 19 nt, Homo sapiens
ccauggaagugcagaaaga

SEQ ID NO: 660432 - RNA, 19 nt, Homo sapiens
cugagggucugcuuuguuu

SEQ ID NO: 660433 - RNA, 19 nt, Homo sapiens
aggcuuggguguuguguuu

SEQ ID NO: 660434 - RNA, 19 nt, Homo sapiens
agaaaugucagauaggaaa

SEQ ID NO: 660435 - RNA, 19 nt, Homo sapiens
uuagaaaugucagauagga

SEQ ID NO: 660436 - RNA, 19 nt, Homo sapiens
ggaggagaguggccugagu

SEQ ID NO: 660437 - RNA, 19 nt, Homo sapiens
gaagggaggcuuggguguu

SEQ ID NO: 660438 - RNA, 19 nt, Homo sapiens
agaaguuccuggucugaau

SEQ ID NO: 660439 - RNA, 19 nt, Homo sapiens
cccaguagguucccagguu

SEQ ID NO: 660440 - RNA, 19 nt, Homo sapiens
ggucugcuuuguuuaccuu

SEQ ID NO: 660441 - RNA, 19 nt, Homo sapiens
ggacacaaucagccgagaa

SEQ ID NO: 660442 - RNA, 19 nt, Homo sapiens
gagaguggccugaguuacu

SEQ ID NO: 660443 - RNA, 19 nt, Homo sapiens
gaggagaguggccugaguu

SEQ ID NO: 660444 - RNA, 19 nt, Homo sapiens
uguuagaaaugucagauag

SEQ ID NO: 660445 - RNA, 19 nt, Homo sapiens
gaucuacuuucacauucuc

SEQ ID NO: 660446 - RNA, 19 nt, Homo sapiens
uguauaagcggucaucguu

SEQ ID NO: 660447 - RNA, 19 nt, Homo sapiens
ggucggacuucauuuugua

SEQ ID NO: 660448 - RNA, 19 nt, Homo sapiens
caaagucagccgcaaacga

SEQ ID NO: 660449 - RNA, 19 nt, Homo sapiens
ggacugggacgugaaccuu

SEQ ID NO: 660450 - RNA, 19 nt, Homo sapiens
gcgugcugcugguuaaugu

SEQ ID NO: 660451 - RNA, 19 nt, Homo sapiens
agaaagcccgucuggaaga

SEQ ID NO: 660452 - RNA, 19 nt, Homo sapiens
aagggaggcuuggguguug

SEQ ID NO: 660453 - RNA, 19 nt, Homo sapiens
cacaaucagccgagaaguu

SEQ ID NO: 660454 - RNA, 19 nt, Homo sapiens
agaguggccugaguuacuu

SEQ ID NO: 660455 - RNA, 19 nt, Homo sapiens
acaaucagccgagaaguuc

SEQ ID NO: 660456 - RNA, 19 nt, Homo sapiens
gagaaguuccuggucugaa

SEQ ID NO: 660457 - RNA, 19 nt, Homo sapiens
gaaguuccuggucugaauc

SEQ ID NO: 660458 - RNA, 19 nt, Homo sapiens
uuucucaucugcauuagag

SEQ ID NO: 660459 - RNA, 19 nt, Homo sapiens
guuaaugucccgcgucucu

SEQ ID NO: 660460 - RNA, 19 nt, Homo sapiens
gcugagcugagaccaguug

SEQ ID NO: 660461 - RNA, 19 nt, Homo sapiens
ucagacacacggacacaau

SEQ ID NO: 660462 - RNA, 19 nt, Homo sapiens
gaggcacagcgcaucauga

SEQ ID NO: 660463 - RNA, 19 nt, Homo sapiens
uuuccaaccucggagaauu

SEQ ID NO: 660464 - RNA, 19 nt, Homo sapiens
gagggucugcuuuguuuac

SEQ ID NO: 660465 - RNA, 19 nt, Homo sapiens
cugaucuacuuucacauuc

SEQ ID NO: 660466 - RNA, 19 nt, Homo sapiens
gacacaaucagccgagaag

SEQ ID NO: 660467 - RNA, 19 nt, Homo sapiens
acugaucuacuuucacauu

SEQ ID NO: 660468 - RNA, 19 nt, Homo sapiens
ggacuucauuuuguacugu

SEQ ID NO: 660469 - RNA, 19 nt, Homo sapiens
gacugggacgugaaccuuu

SEQ ID NO: 660470 - RNA, 19 nt, Homo sapiens
cgaaaaccguggagagaag

SEQ ID NO: 660471 - RNA, 19 nt, Homo sapiens
gcacauggcucaguaaaua

SEQ ID NO: 660472 - RNA, 19 nt, Homo sapiens
acacaaagcccuuauuuaa

SEQ ID NO: 660473 - RNA, 19 nt, Homo sapiens
guagaaagauuaagugaca

SEQ ID NO: 660474 - RNA, 19 nt, Homo sapiens
gaaggcacauggcucagua

SEQ ID NO: 660475 - RNA, 19 nt, Homo sapiens
gcacacaaagcccuuauuu

SEQ ID NO: 660476 - RNA, 19 nt, Homo sapiens
agaaggaguuugugacuuu

SEQ ID NO: 660477 - RNA, 19 nt, Homo sapiens
gaagacaccaagaguagaa

SEQ ID NO: 660478 - RNA, 19 nt, Homo sapiens
gcucucaugucuagugauu

SEQ ID NO: 660479 - RNA, 19 nt, Homo sapiens
gccaggaacucaccuuuca

SEQ ID NO: 660480 - RNA, 19 nt, Homo sapiens
caagaccagccaaugaaua

SEQ ID NO: 660481 - RNA, 19 nt, Homo sapiens
ccagagauuugaguucuug

SEQ ID NO: 660482 - RNA, 19 nt, Homo sapiens
ucucaugucuagugauuau

SEQ ID NO: 660483 - RNA, 19 nt, Homo sapiens
caccaagaguagaaagauu

SEQ ID NO: 660484 - RNA, 19 nt, Homo sapiens
cacacaaagcccuuauuua

SEQ ID NO: 660485 - RNA, 19 nt, Homo sapiens
aaacccugguagagcauua

SEQ ID NO: 660486 - RNA, 19 nt, Homo sapiens
acaaagcccuuauuuaacc

SEQ ID NO: 660487 - RNA, 19 nt, Homo sapiens
gaguagaaagauuaaguga

SEQ ID NO: 660488 - RNA, 19 nt, Homo sapiens
ccaagaguagaaagauuaa

SEQ ID NO: 660489 - RNA, 19 nt, Homo sapiens
gaacggugcagagccagaa

SEQ ID NO: 660490 - RNA, 19 nt, Homo sapiens
gaccagccaaugaauaaug

SEQ ID NO: 660491 - RNA, 19 nt, Homo sapiens
aagaccagccaaugaauaa

SEQ ID NO: 660492 - RNA, 19 nt, Homo sapiens
gcaagaccagccaaugaau

SEQ ID NO: 660493 - RNA, 19 nt, Homo sapiens
gccaaugaauaaugguaau

SEQ ID NO: 660494 - RNA, 19 nt, Homo sapiens
caggaacucaccuuucaaa

SEQ ID NO: 660495 - RNA, 19 nt, Homo sapiens
accaagaguagaaagauua

SEQ ID NO: 660496 - RNA, 19 nt, Homo sapiens
gugaagacaccaagaguag

SEQ ID NO: 660497 - RNA, 19 nt, Homo sapiens
gagauuugaguucuugaga

SEQ ID NO: 660498 - RNA, 19 nt, Homo sapiens
ggccagagauuugaguucu

SEQ ID NO: 660499 - RNA, 19 nt, Homo sapiens
cagaaggaguuugugacuu

SEQ ID NO: 660500 - RNA, 19 nt, Homo sapiens
aaagaaaggaagagacugu

SEQ ID NO: 660501 - RNA, 19 nt, Homo sapiens
gaacucugugugccacuga

SEQ ID NO: 660502 - RNA, 19 nt, Homo sapiens
gcucugugcccacggagaa

SEQ ID NO: 660503 - RNA, 19 nt, Homo sapiens
gcccuuauuuaaccuucaa

SEQ ID NO: 660504 - RNA, 19 nt, Homo sapiens
ggagaguccacacgucuag

SEQ ID NO: 660505 - RNA, 19 nt, Homo sapiens
cuucaaauuguccaaauga

SEQ ID NO: 660506 - RNA, 19 nt, Homo sapiens
gguagagcauuaaaauuuc

SEQ ID NO: 660507 - RNA, 19 nt, Homo sapiens
gcagagccagaaggaguuu

SEQ ID NO: 660508 - RNA, 19 nt, Homo sapiens
gaaggaguuugugacuuuu

SEQ ID NO: 660509 - RNA, 19 nt, Homo sapiens
aaaggaagagacuguggaa

SEQ ID NO: 660510 - RNA, 19 nt, Homo sapiens
gccagagauuugaguucuu

SEQ ID NO: 660511 - RNA, 19 nt, Homo sapiens
gcauuaaaauuuccuugca

SEQ ID NO: 660512 - RNA, 19 nt, Homo sapiens
ggaacucaccuuucaaacc

SEQ ID NO: 660513 - RNA, 19 nt, Homo sapiens
cagccaaugaauaauggua

SEQ ID NO: 660514 - RNA, 19 nt, Homo sapiens
gggccaggaacucaccuuu

SEQ ID NO: 660515 - RNA, 19 nt, Homo sapiens
uaccauuacugcagaacuc

SEQ ID NO: 660516 - RNA, 19 nt, Homo sapiens
cacaaagcccuuauuuaac

SEQ ID NO: 660517 - RNA, 19 nt, Homo sapiens
uugcaagaccagccaauga

SEQ ID NO: 660518 - RNA, 19 nt, Homo sapiens
ggcugccauucccgcauua

SEQ ID NO: 660519 - RNA, 19 nt, Homo sapiens
gacaccaagaguagaaaga

SEQ ID NO: 660520 - RNA, 19 nt, Homo sapiens
cuaggcaggccagagauuu

SEQ ID NO: 660521 - RNA, 19 nt, Homo sapiens
gaggcucucaugucuagug

SEQ ID NO: 660522 - RNA, 19 nt, Homo sapiens
acauggcucaguaaauauu

SEQ ID NO: 660523 - RNA, 19 nt, Homo sapiens
ugcaagaccagccaaugaa

SEQ ID NO: 660524 - RNA, 19 nt, Homo sapiens
cgucuaggcaggccagaga

SEQ ID NO: 660525 - RNA, 19 nt, Homo sapiens
cgcauuaacagccaacaau

SEQ ID NO: 660526 - RNA, 19 nt, Homo sapiens
guacuuaacaugucuguaa

SEQ ID NO: 660527 - RNA, 19 nt, Homo sapiens
ggaaguacauccaguaaac

SEQ ID NO: 660528 - RNA, 19 nt, Homo sapiens
guuaguaugugcagcugua

SEQ ID NO: 660529 - RNA, 19 nt, Homo sapiens
cuagaaaguugcaaaccaa

SEQ ID NO: 660530 - RNA, 19 nt, Homo sapiens
gaauguucaucaugucauc

SEQ ID NO: 660531 - RNA, 19 nt, Homo sapiens
guacauccaguaaacaaug

SEQ ID NO: 660532 - RNA, 19 nt, Homo sapiens
gugcagcuguaacacauuc

SEQ ID NO: 660533 - RNA, 19 nt, Homo sapiens
uaaacaaugccauguacau

SEQ ID NO: 660534 - RNA, 19 nt, Homo sapiens
ucaacuauguguacuuuug

SEQ ID NO: 660535 - RNA, 19 nt, Homo sapiens
caguaaacaaugccaugua

SEQ ID NO: 660536 - RNA, 19 nt, Homo sapiens
guagccacauaguguuuca

SEQ ID NO: 660537 - RNA, 19 nt, Homo sapiens
gaaguacauccaguaaaca

SEQ ID NO: 660538 - RNA, 19 nt, Homo sapiens
ucuagaaaguugcaaacca

SEQ ID NO: 660539 - RNA, 19 nt, Homo sapiens
guaaaaguauggaaguaca

SEQ ID NO: 660540 - RNA, 19 nt, Homo sapiens
gaauucaacuauguguacu

SEQ ID NO: 660541 - RNA, 19 nt, Homo sapiens
aguaaacaaugccauguac

SEQ ID NO: 660542 - RNA, 19 nt, Homo sapiens
caucaugucaucucauuuu

SEQ ID NO: 660543 - RNA, 19 nt, Homo sapiens
uuacccauuuccugcugua

SEQ ID NO: 660544 - RNA, 19 nt, Homo sapiens
cccauuuccugcuguaaca

SEQ ID NO: 660545 - RNA, 19 nt, Homo sapiens
cauuugcuguccagagugu

SEQ ID NO: 660546 - RNA, 19 nt, Homo sapiens
uucaucaugucaucucauu

SEQ ID NO: 660547 - RNA, 19 nt, Homo sapiens
gccacauaguguuucaaug

SEQ ID NO: 660548 - RNA, 19 nt, Homo sapiens
uuuaguagccacauagugu

SEQ ID NO: 660549 - RNA, 19 nt, Homo sapiens
cagcuguaacacauucuuu

SEQ ID NO: 660550 - RNA, 19 nt, Homo sapiens
agaauucaacuauguguac

SEQ ID NO: 660551 - RNA, 19 nt, Homo sapiens
cccauuugcuguccagagu

SEQ ID NO: 660552 - RNA, 19 nt, Homo sapiens
guaaacaaugccauguaca

SEQ ID NO: 660553 - RNA, 19 nt, Homo sapiens
uagaaaguugcaaaccaaa

SEQ ID NO: 660554 - RNA, 19 nt, Homo sapiens
gcagcuguaacacauucuu

SEQ ID NO: 660555 - RNA, 19 nt, Homo sapiens
gaaagcaacucuugaaauu

SEQ ID NO: 660556 - RNA, 19 nt, Homo sapiens
ggaaagauguggucugaga

SEQ ID NO: 660557 - RNA, 19 nt, Homo sapiens
aaagaaagcuuguuacugu

SEQ ID NO: 660558 - RNA, 19 nt, Homo sapiens
acaaauaucucuagacuca

SEQ ID NO: 660559 - RNA, 19 nt, Homo sapiens
gaauaaagguguggcagaa

SEQ ID NO: 660560 - RNA, 19 nt, Homo sapiens
ggaaagugcagaagaauug

SEQ ID NO: 660561 - RNA, 19 nt, Homo sapiens
caauaaagcgggaaguaua

SEQ ID NO: 660562 - RNA, 19 nt, Homo sapiens
ggacuuggaugaauugucu

SEQ ID NO: 660563 - RNA, 19 nt, Homo sapiens
gugguguccuuucaaauua

SEQ ID NO: 660564 - RNA, 19 nt, Homo sapiens
caacuuaucaagcauguuu

SEQ ID NO: 660565 - RNA, 19 nt, Homo sapiens
gaacaucgucugcuucaug

SEQ ID NO: 660566 - RNA, 19 nt, Homo sapiens
cuaaacagccaauuucuaa

SEQ ID NO: 660567 - RNA, 19 nt, Homo sapiens
ggaaauguucacuuugaua

SEQ ID NO: 660568 - RNA, 19 nt, Homo sapiens
gagcuggagugaucuuuau

SEQ ID NO: 660569 - RNA, 19 nt, Homo sapiens
aaacugacaucccauuuca

SEQ ID NO: 660570 - RNA, 19 nt, Homo sapiens
gaccagaucaaguucuuua

SEQ ID NO: 660571 - RNA, 19 nt, Homo sapiens
uaggauaauugcuggguua

SEQ ID NO: 660572 - RNA, 19 nt, Homo sapiens
ccucggaaauguucacuuu

SEQ ID NO: 660573 - RNA, 19 nt, Homo sapiens
auaaagguguggcagaaua

SEQ ID NO: 660574 - RNA, 19 nt, Homo sapiens
gcaaauaucaaugguguga

SEQ ID NO: 660575 - RNA, 19 nt, Homo sapiens
caaccuaaacagccaauuu

SEQ ID NO: 660576 - RNA, 19 nt, Homo sapiens
cagcagcaauggcaauuug

SEQ ID NO: 660577 - RNA, 19 nt, Homo sapiens
gaaaccugcuaacgauaga

SEQ ID NO: 660578 - RNA, 19 nt, Homo sapiens
gaagcaaagcugcagguuu

SEQ ID NO: 660579 - RNA, 19 nt, Homo sapiens
gaacaaugauucugaaaag

SEQ ID NO: 660580 - RNA, 19 nt, Homo sapiens
ggguuaagguucaugagaa

SEQ ID NO: 660581 - RNA, 19 nt, Homo sapiens
gaugaauugucuuuguuug

SEQ ID NO: 660582 - RNA, 19 nt, Homo sapiens
gaucaaguucuuuaaguga

SEQ ID NO: 660583 - RNA, 19 nt, Homo sapiens
ucacaaauaucucuagacu

SEQ ID NO: 660584 - RNA, 19 nt, Homo sapiens
ggugauguccuugcaaaua

SEQ ID NO: 660585 - RNA, 19 nt, Homo sapiens
gaggcgagcuggagugauc

SEQ ID NO: 660586 - RNA, 19 nt, Homo sapiens
gcgggaaguauaagauuua

SEQ ID NO: 660587 - RNA, 19 nt, Homo sapiens
gagggcaacuuaucaagca

SEQ ID NO: 660588 - RNA, 19 nt, Homo sapiens
gugauguccuugcaaauau

SEQ ID NO: 660589 - RNA, 19 nt, Homo sapiens
ggagucaaguaugaauaaa

SEQ ID NO: 660590 - RNA, 19 nt, Homo sapiens
ucggaaauguucacuuuga

SEQ ID NO: 660591 - RNA, 19 nt, Homo sapiens
cugcggaggcuuaauaaua

SEQ ID NO: 660592 - RNA, 19 nt, Homo sapiens
gaaagggaaguguccgaaa

SEQ ID NO: 660593 - RNA, 19 nt, Homo sapiens
ggaaucgauuauccaguga

SEQ ID NO: 660594 - RNA, 19 nt, Homo sapiens
ucucaaagaaagcuuguua

SEQ ID NO: 660595 - RNA, 19 nt, Homo sapiens
ugagaaccauggaaagaug

SEQ ID NO: 660596 - RNA, 19 nt, Homo sapiens
gaugggugcugcaaagauc

SEQ ID NO: 660597 - RNA, 19 nt, Homo sapiens
gugggaaagugcagaagaa

SEQ ID NO: 660598 - RNA, 19 nt, Homo sapiens
uagaaggauucaaaugcua

SEQ ID NO: 660599 - RNA, 19 nt, Homo sapiens
cagaucaaguucuuuaagu

SEQ ID NO: 660600 - RNA, 19 nt, Homo sapiens
cagcaauagugaccuuuau

SEQ ID NO: 660601 - RNA, 19 nt, Homo sapiens
aagcaaagcugcagguuuu

SEQ ID NO: 660602 - RNA, 19 nt, Homo sapiens
ugaauugucuuuguuugga

SEQ ID NO: 660603 - RNA, 19 nt, Homo sapiens
ggaugaauugucuuuguuu

SEQ ID NO: 660604 - RNA, 19 nt, Homo sapiens
uacaaaggcuccugcaaca

SEQ ID NO: 660605 - RNA, 19 nt, Homo sapiens
gacaauaaagcgggaagua

SEQ ID NO: 660606 - RNA, 19 nt, Homo sapiens
ggauugugguguccuuuca

SEQ ID NO: 660607 - RNA, 19 nt, Homo sapiens
gcaagcuggugauguccuu

SEQ ID NO: 660608 - RNA, 19 nt, Homo sapiens
cgaaagcaacucuugaaau

SEQ ID NO: 660609 - RNA, 19 nt, Homo sapiens
ggaaaccugcuaacgauag

SEQ ID NO: 660610 - RNA, 19 nt, Homo sapiens
gcugcaaagaucauaauaa

SEQ ID NO: 660611 - RNA, 19 nt, Homo sapiens
aaucuuagguuugcuuaug

SEQ ID NO: 660612 - RNA, 19 nt, Homo sapiens
guacagaugaugagugcuu

SEQ ID NO: 660613 - RNA, 19 nt, Homo sapiens
ccggaaaccugcuaacgau

SEQ ID NO: 660614 - RNA, 19 nt, Homo sapiens
ugagaugggugcugcaaag

SEQ ID NO: 660615 - RNA, 19 nt, Homo sapiens
caaaggcuccugcaacaca

SEQ ID NO: 660616 - RNA, 19 nt, Homo sapiens
gaugaugagugcuuuaucc

SEQ ID NO: 660617 - RNA, 19 nt, Homo sapiens
ucacugugcuggccugcaa

SEQ ID NO: 660618 - RNA, 19 nt, Homo sapiens
ggaaccggagcaucaguaa

SEQ ID NO: 660619 - RNA, 19 nt, Homo sapiens
aauaaagcgggaaguauaa

SEQ ID NO: 660620 - RNA, 19 nt, Homo sapiens
aaagggaaguguccgaaag

SEQ ID NO: 660621 - RNA, 19 nt, Homo sapiens
gggaaagugcagaagaauu

SEQ ID NO: 660622 - RNA, 19 nt, Homo sapiens
aaacauggacuuggaugaa

SEQ ID NO: 660623 - RNA, 19 nt, Homo sapiens
caucagcuguuucucacau

SEQ ID NO: 660624 - RNA, 19 nt, Homo sapiens
gcagacgaguacagaugau

SEQ ID NO: 660625 - RNA, 19 nt, Homo sapiens
uggaugaauugucuuuguu

SEQ ID NO: 660626 - RNA, 19 nt, Homo sapiens
gaaaagaacggagcuugaa

SEQ ID NO: 660627 - RNA, 19 nt, Homo sapiens
caaagaaagcuuguuacug

SEQ ID NO: 660628 - RNA, 19 nt, Homo sapiens
gaccaucagcuguuucuca

SEQ ID NO: 660629 - RNA, 19 nt, Homo sapiens
ugcggaggcuuaauaauag

SEQ ID NO: 660630 - RNA, 19 nt, Homo sapiens
cugaggaggucaucuucaa

SEQ ID NO: 660631 - RNA, 19 nt, Homo sapiens
ggaccggaaucgauuaucc

SEQ ID NO: 660632 - RNA, 19 nt, Homo sapiens
acacucaccggcagccuua

SEQ ID NO: 660633 - RNA, 19 nt, Homo sapiens
acauggacuuggaugaauu

SEQ ID NO: 660634 - RNA, 19 nt, Homo sapiens
acaggaacaucgucugcuu

SEQ ID NO: 660635 - RNA, 19 nt, Homo sapiens
cgagcuggagugaucuuua

SEQ ID NO: 660636 - RNA, 19 nt, Homo sapiens
gguguggcagaauauaaua

SEQ ID NO: 660637 - RNA, 19 nt, Homo sapiens
ccagugagagcagcuguaa

SEQ ID NO: 660638 - RNA, 19 nt, Homo sapiens
cgggaaguauaagauuuaa

SEQ ID NO: 660639 - RNA, 19 nt, Homo sapiens
ccuaaacagccaauuucua

SEQ ID NO: 660640 - RNA, 19 nt, Homo sapiens
acaagucguugaccugauc

SEQ ID NO: 660641 - RNA, 19 nt, Homo sapiens
gaucuuuauucacaauguc

SEQ ID NO: 660642 - RNA, 19 nt, Homo sapiens
agaucaaguucuuuaagug

SEQ ID NO: 660643 - RNA, 19 nt, Homo sapiens
gcagaagaauugcaaaacu

SEQ ID NO: 660644 - RNA, 19 nt, Homo sapiens
agugagagcagcuguaaga

SEQ ID NO: 660645 - RNA, 19 nt, Homo sapiens
gaaagauguggucugagau

SEQ ID NO: 660646 - RNA, 19 nt, Homo sapiens
uaaagguguggcagaauau

SEQ ID NO: 660647 - RNA, 19 nt, Homo sapiens
uggagucaaguaugaauaa

SEQ ID NO: 660648 - RNA, 19 nt, Homo sapiens
ugugguguccuuucaaauu

SEQ ID NO: 660649 - RNA, 19 nt, Homo sapiens
gcaauuuggcggacuucug

SEQ ID NO: 660650 - RNA, 19 nt, Homo sapiens
agucaaguaugaauaaagg

SEQ ID NO: 660651 - RNA, 19 nt, Homo sapiens
ucucuagacucacccagau

SEQ ID NO: 660652 - RNA, 19 nt, Homo sapiens
uaaagcgggaaguauaaga

SEQ ID NO: 660653 - RNA, 19 nt, Homo sapiens
aaccuguaauggcuuguaa

SEQ ID NO: 660654 - RNA, 19 nt, Homo sapiens
acagcaauagugaccuuua

SEQ ID NO: 660655 - RNA, 19 nt, Homo sapiens
gcaaauagcuccuuaaauu

SEQ ID NO: 660656 - RNA, 19 nt, Homo sapiens
ggaagagacuggaauauua

SEQ ID NO: 660657 - RNA, 19 nt, Homo sapiens
ggaacaaucacacaaauaa

SEQ ID NO: 660658 - RNA, 19 nt, Homo sapiens
aaaggaagcuguauaggaa

SEQ ID NO: 660659 - RNA, 19 nt, Homo sapiens
gaagagacuggaauauuaa

SEQ ID NO: 660660 - RNA, 19 nt, Homo sapiens
gaaaggaagcuguauagga

SEQ ID NO: 660661 - RNA, 19 nt, Homo sapiens
gcacagagaaguuuacaug

SEQ ID NO: 660662 - RNA, 19 nt, Homo sapiens
cauaguaucuacaaccuuu

SEQ ID NO: 660663 - RNA, 19 nt, Homo sapiens
gcccugauauugaaguaua

SEQ ID NO: 660664 - RNA, 19 nt, Homo sapiens
ggaagaaugugaugauggu

SEQ ID NO: 660665 - RNA, 19 nt, Homo sapiens
ugacaaaccuagacaucaa

SEQ ID NO: 660666 - RNA, 19 nt, Homo sapiens
caaguacccuuuccucuca

SEQ ID NO: 660667 - RNA, 19 nt, Homo sapiens
gaagaaauggcgaaguuug

SEQ ID NO: 660668 - RNA, 19 nt, Homo sapiens
caacaggcaugaugugaca

SEQ ID NO: 660669 - RNA, 19 nt, Homo sapiens
acagagaaguuuacaugaa

SEQ ID NO: 660670 - RNA, 19 nt, Homo sapiens
gcaucuagcagaaauugua

SEQ ID NO: 660671 - RNA, 19 nt, Homo sapiens
ggaaagggaaggaaaggaa

SEQ ID NO: 660672 - RNA, 19 nt, Homo sapiens
ggacuaagguuuucaaucu

SEQ ID NO: 660673 - RNA, 19 nt, Homo sapiens
ggaaggaaaggaagcugua

SEQ ID NO: 660674 - RNA, 19 nt, Homo sapiens
gcagaguccuuggaaacaa

SEQ ID NO: 660675 - RNA, 19 nt, Homo sapiens
ggucacaacugcccagagu

SEQ ID NO: 660676 - RNA, 19 nt, Homo sapiens
gggaagagacuggaauauu

SEQ ID NO: 660677 - RNA, 19 nt, Homo sapiens
gaaacugucacacugaaug

SEQ ID NO: 660678 - RNA, 19 nt, Homo sapiens
gcauuggcaucuagcagaa

SEQ ID NO: 660679 - RNA, 19 nt, Homo sapiens
gcaguccuaucaagguuug

SEQ ID NO: 660680 - RNA, 19 nt, Homo sapiens
ugaauauggugaaggcaaa

SEQ ID NO: 660681 - RNA, 19 nt, Homo sapiens
gcagaaauuguaagcuauu

SEQ ID NO: 660682 - RNA, 19 nt, Homo sapiens
aggaagaaauggcgaaguu

SEQ ID NO: 660683 - RNA, 19 nt, Homo sapiens
ugaaugacaucccagagau

SEQ ID NO: 660684 - RNA, 19 nt, Homo sapiens
gcgcggauccuuaucuuug

SEQ ID NO: 660685 - RNA, 19 nt, Homo sapiens
cagagaaguuuacaugaag

SEQ ID NO: 660686 - RNA, 19 nt, Homo sapiens
gcagaaaccaggucuaacu

SEQ ID NO: 660687 - RNA, 19 nt, Homo sapiens
caggaaacauugucuuuac

SEQ ID NO: 660688 - RNA, 19 nt, Homo sapiens
ccacagaaagauaagguaa

SEQ ID NO: 660689 - RNA, 19 nt, Homo sapiens
gaaauggcgaaguuuguau

SEQ ID NO: 660690 - RNA, 19 nt, Homo sapiens
ggacaucagaggaagaaau

SEQ ID NO: 660691 - RNA, 19 nt, Homo sapiens
cauagaagcaugagugaau

SEQ ID NO: 660692 - RNA, 19 nt, Homo sapiens
gagcaccgcaguccuauca

SEQ ID NO: 660693 - RNA, 19 nt, Homo sapiens
gaaaggaauggaagcacaa

SEQ ID NO: 660694 - RNA, 19 nt, Homo sapiens
ggagucacccagcauagaa

SEQ ID NO: 660695 - RNA, 19 nt, Homo sapiens
gagcccugauauugaagua

SEQ ID NO: 660696 - RNA, 19 nt, Homo sapiens
gauaacaacccuuuuggua

SEQ ID NO: 660697 - RNA, 19 nt, Homo sapiens
ggaagaaauggcgaaguuu

SEQ ID NO: 660698 - RNA, 19 nt, Homo sapiens
cuacaugacuacugcauac

SEQ ID NO: 660699 - RNA, 19 nt, Homo sapiens
gccacgaccuccaccuauu

SEQ ID NO: 660700 - RNA, 19 nt, Homo sapiens
gagaaguuuacaugaagua

SEQ ID NO: 660701 - RNA, 19 nt, Homo sapiens
ucaggaaacauugucuuua

SEQ ID NO: 660702 - RNA, 19 nt, Homo sapiens
gcaccgcaguccuaucaag

SEQ ID NO: 660703 - RNA, 19 nt, Homo sapiens
gaaguuuacaugaaguaga

SEQ ID NO: 660704 - RNA, 19 nt, Homo sapiens
gagcaacaauguggaaagg

SEQ ID NO: 660705 - RNA, 19 nt, Homo sapiens
uaaggaaauucaaguacuc

SEQ ID NO: 660706 - RNA, 19 nt, Homo sapiens
gaauguagguacuguuuuc

SEQ ID NO: 660707 - RNA, 19 nt, Homo sapiens
gcuccaaacuccacguagu

SEQ ID NO: 660708 - RNA, 19 nt, Homo sapiens
gaaauucaaguacucuagu

SEQ ID NO: 660709 - RNA, 19 nt, Homo sapiens
uaggaacaaucacacaaau

SEQ ID NO: 660710 - RNA, 19 nt, Homo sapiens
gaaacaauaaagcuuccuu

SEQ ID NO: 660711 - RNA, 19 nt, Homo sapiens
guaggagucacccagcaua

SEQ ID NO: 660712 - RNA, 19 nt, Homo sapiens
caccagaaccggaacauuc

SEQ ID NO: 660713 - RNA, 19 nt, Homo sapiens
cagguacucuaaggaaauu

SEQ ID NO: 660714 - RNA, 19 nt, Homo sapiens
gacaucagaggaagaaaug

SEQ ID NO: 660715 - RNA, 19 nt, Homo sapiens
gagaauuggaagaauguga

SEQ ID NO: 660716 - RNA, 19 nt, Homo sapiens
ugaaguagaagaaauccuu

SEQ ID NO: 660717 - RNA, 19 nt, Homo sapiens
ggaaauucaaguacucuag

SEQ ID NO: 660718 - RNA, 19 nt, Homo sapiens
ccuuaaauuuggaacacua

SEQ ID NO: 660719 - RNA, 19 nt, Homo sapiens
cagaaaccaggucuaacua

SEQ ID NO: 660720 - RNA, 19 nt, Homo sapiens
gaagcuguauaggaacaau

SEQ ID NO: 660721 - RNA, 19 nt, Homo sapiens
gaaagauaagguaaacaag

SEQ ID NO: 660722 - RNA, 19 nt, Homo sapiens
cuaaggaaauucaaguacu

SEQ ID NO: 660723 - RNA, 19 nt, Homo sapiens
caauucagguacucuaagg

SEQ ID NO: 660724 - RNA, 19 nt, Homo sapiens
gcggauccuuaucuuugaa

SEQ ID NO: 660725 - RNA, 19 nt, Homo sapiens
uuugagcccugauauugaa

SEQ ID NO: 660726 - RNA, 19 nt, Homo sapiens
ccaaaggaauaaaagacua

SEQ ID NO: 660727 - RNA, 19 nt, Homo sapiens
gcgccacacccauuuaaau

SEQ ID NO: 660728 - RNA, 19 nt, Homo sapiens
uguaagcuauuuggaaugu

SEQ ID NO: 660729 - RNA, 19 nt, Homo sapiens
guaucuacaaccuuuauga

SEQ ID NO: 660730 - RNA, 19 nt, Homo sapiens
cagaguccuuggaaacaau

SEQ ID NO: 660731 - RNA, 19 nt, Homo sapiens
ccagcagaguccuuggaaa

SEQ ID NO: 660732 - RNA, 19 nt, Homo sapiens
agaaauggcgaaguuugua

SEQ ID NO: 660733 - RNA, 19 nt, Homo sapiens
gaaggaaaggaagcuguau

SEQ ID NO: 660734 - RNA, 19 nt, Homo sapiens
caaacuccacguaguaaca

SEQ ID NO: 660735 - RNA, 19 nt, Homo sapiens
gccggcaaacguccaaaua

SEQ ID NO: 660736 - RNA, 19 nt, Homo sapiens
acagaaagauaagguaaac

SEQ ID NO: 660737 - RNA, 19 nt, Homo sapiens
gguagccacuucaaagacu

SEQ ID NO: 660738 - RNA, 19 nt, Homo sapiens
ugggagaauuggaagaaug

SEQ ID NO: 660739 - RNA, 19 nt, Homo sapiens
cagcuggucaggaaacauu

SEQ ID NO: 660740 - RNA, 19 nt, Homo sapiens
gacaaaccuagacaucaaa

SEQ ID NO: 660741 - RNA, 19 nt, Homo sapiens
uaacaacccuuuugguagu

SEQ ID NO: 660742 - RNA, 19 nt, Homo sapiens
cuaauucacucugggcaau

SEQ ID NO: 660743 - RNA, 19 nt, Homo sapiens
gugaaugacaucccagaga

SEQ ID NO: 660744 - RNA, 19 nt, Homo sapiens
uaauuugagcccugauauu

SEQ ID NO: 660745 - RNA, 19 nt, Homo sapiens
cuccaccuauucaaucuuu

SEQ ID NO: 660746 - RNA, 19 nt, Homo sapiens
gaagaaugugaugauggua

SEQ ID NO: 660747 - RNA, 19 nt, Homo sapiens
gggagaauuggaagaaugu

SEQ ID NO: 660748 - RNA, 19 nt, Homo sapiens
gaauguuacuaaaccuacu

SEQ ID NO: 660749 - RNA, 19 nt, Homo sapiens
cuacugcauuggcaucuag

SEQ ID NO: 660750 - RNA, 19 nt, Homo sapiens
ccgcaguccuaucaagguu

SEQ ID NO: 660751 - RNA, 19 nt, Homo sapiens
caaagauacauggguaaau

SEQ ID NO: 660752 - RNA, 19 nt, Homo sapiens
ucacaacugcccagagugu

SEQ ID NO: 660753 - RNA, 19 nt, Homo sapiens
gaauggaagcacaaaauga

SEQ ID NO: 660754 - RNA, 19 nt, Homo sapiens
gucaggaaacauugucuuu

SEQ ID NO: 660755 - RNA, 19 nt, Homo sapiens
gcaaggagaccaccacuuu

SEQ ID NO: 660756 - RNA, 19 nt, Homo sapiens
ggacuggaguauacuguug

SEQ ID NO: 660757 - RNA, 19 nt, Homo sapiens
ggaguauacuguugagaga

SEQ ID NO: 660758 - RNA, 19 nt, Homo sapiens
ccaauuaguugaagguguu

SEQ ID NO: 660759 - RNA, 19 nt, Homo sapiens
ccaaagagguucccaagac

SEQ ID NO: 660760 - RNA, 19 nt, Homo sapiens
ccacaagacuaacauaaaa

SEQ ID NO: 660761 - RNA, 19 nt, Homo sapiens
gaacgaggaacucaaucaa

SEQ ID NO: 660762 - RNA, 19 nt, Homo sapiens
caaagagguucccaagaca

SEQ ID NO: 660763 - RNA, 19 nt, Homo sapiens
gaacaaaaggcucuccaua

SEQ ID NO: 660764 - RNA, 19 nt, Homo sapiens
acaaaaggcucuccauaaa

SEQ ID NO: 660765 - RNA, 19 nt, Homo sapiens
gcucagcuguguggucaaa

SEQ ID NO: 660766 - RNA, 19 nt, Homo sapiens
caacuugucuaggcuauac

SEQ ID NO: 660767 - RNA, 19 nt, Homo sapiens
gaagguauuuuguagaugu

SEQ ID NO: 660768 - RNA, 19 nt, Homo sapiens
gaucaacauuuacaaucag

SEQ ID NO: 660769 - RNA, 19 nt, Homo sapiens
uugaagguguuaagagaaa

SEQ ID NO: 660770 - RNA, 19 nt, Homo sapiens
gggcaaggccagagacuuc

SEQ ID NO: 660771 - RNA, 19 nt, Homo sapiens
ggaauggagugggccaaca

SEQ ID NO: 660772 - RNA, 19 nt, Homo sapiens
gugaagauguccaggaaac

SEQ ID NO: 660773 - RNA, 19 nt, Homo sapiens
ccaacaggguguagaguac

SEQ ID NO: 660774 - RNA, 19 nt, Homo sapiens
ccagauaaauagccaacag

SEQ ID NO: 660775 - RNA, 19 nt, Homo sapiens
caacaaccacccaccaaca

SEQ ID NO: 660776 - RNA, 19 nt, Homo sapiens
cagguggacuggaguauac

SEQ ID NO: 660777 - RNA, 19 nt, Homo sapiens
gccaacaggguguagagua

SEQ ID NO: 660778 - RNA, 19 nt, Homo sapiens
gcaauggcuaguacuaugu

SEQ ID NO: 660779 - RNA, 19 nt, Homo sapiens
aguacuaugugucaacuug

SEQ ID NO: 660780 - RNA, 19 nt, Homo sapiens
agacaacucggaagggaaa

SEQ ID NO: 660781 - RNA, 19 nt, Homo sapiens
ggaauucuaccacaagacu

SEQ ID NO: 660782 - RNA, 19 nt, Homo sapiens
ucaaacaguagucuagaug

SEQ ID NO: 660783 - RNA, 19 nt, Homo sapiens
aaaaggcucuccauaaaag

SEQ ID NO: 660784 - RNA, 19 nt, Homo sapiens
caaaaggcucuccauaaaa

SEQ ID NO: 660785 - RNA, 19 nt, Homo sapiens
aaagggacccaucgaggaa

SEQ ID NO: 660786 - RNA, 19 nt, Homo sapiens
uggugaagauguccaggaa

SEQ ID NO: 660787 - RNA, 19 nt, Homo sapiens
aguugaagguguuaagaga

SEQ ID NO: 660788 - RNA, 19 nt, Homo sapiens
agauguugcugugaaggua

SEQ ID NO: 660789 - RNA, 19 nt, Homo sapiens
cgaacgaggaacucaauca

SEQ ID NO: 660790 - RNA, 19 nt, Homo sapiens
gucaaacaguagucuagau

SEQ ID NO: 660791 - RNA, 19 nt, Homo sapiens
gaagauguccaggaaacca

SEQ ID NO: 660792 - RNA, 19 nt, Homo sapiens
uaccacaagacuaacauaa

SEQ ID NO: 660793 - RNA, 19 nt, Homo sapiens
ggccucauccaauuaguug

SEQ ID NO: 660794 - RNA, 19 nt, Homo sapiens
gaauucuaccacaagacua

SEQ ID NO: 660795 - RNA, 19 nt, Homo sapiens
caaacaguagucuagaugu

SEQ ID NO: 660796 - RNA, 19 nt, Homo sapiens
ucagcuguguggucaaaca

SEQ ID NO: 660797 - RNA, 19 nt, Homo sapiens
acgaggaacucaaucaaaa

SEQ ID NO: 660798 - RNA, 19 nt, Homo sapiens
gucuagauguugcugugaa

SEQ ID NO: 660799 - RNA, 19 nt, Homo sapiens
acgcuggucuggugaagau

SEQ ID NO: 660800 - RNA, 19 nt, Homo sapiens
aaggaauucuaccacaaga

SEQ ID NO: 660801 - RNA, 19 nt, Homo sapiens
caaaggguaugccccaugu

SEQ ID NO: 660802 - RNA, 19 nt, Homo sapiens
caaggagaccaccacuuuc

SEQ ID NO: 660803 - RNA, 19 nt, Homo sapiens
ggucaaacaguagucuaga

SEQ ID NO: 660804 - RNA, 19 nt, Homo sapiens
gugaucaacauuuacaauc

SEQ ID NO: 660805 - RNA, 19 nt, Homo sapiens
caccaacaccaaagagguu

SEQ ID NO: 660806 - RNA, 19 nt, Homo sapiens
gugaagguauuuuguagau

SEQ ID NO: 660807 - RNA, 19 nt, Homo sapiens
aaaaggaauucuaccacaa

SEQ ID NO: 660808 - RNA, 19 nt, Homo sapiens
gcaaggccagagacuucaa

SEQ ID NO: 660809 - RNA, 19 nt, Homo sapiens
ccucauccaauuaguugaa

SEQ ID NO: 660810 - RNA, 19 nt, Homo sapiens
ggguguagaguacguuuua

SEQ ID NO: 660811 - RNA, 19 nt, Homo sapiens
ccaccacuuucuccagucu

SEQ ID NO: 660812 - RNA, 19 nt, Homo sapiens
guugaagguguuaagagaa

SEQ ID NO: 660813 - RNA, 19 nt, Homo sapiens
aacaaaaggcucuccauaa

SEQ ID NO: 660814 - RNA, 19 nt, Homo sapiens
cuaccacaagacuaacaua

SEQ ID NO: 660815 - RNA, 19 nt, Homo sapiens
aauucuaccacaagacuaa

SEQ ID NO: 660816 - RNA, 19 nt, Homo sapiens
aaaggaauucuaccacaag

SEQ ID NO: 660817 - RNA, 19 nt, Homo sapiens
gggccucauccaauuaguu

SEQ ID NO: 660818 - RNA, 19 nt, Homo sapiens
aaagagguucccaagacaa

SEQ ID NO: 660819 - RNA, 19 nt, Homo sapiens
accacaagacuaacauaaa

SEQ ID NO: 660820 - RNA, 19 nt, Homo sapiens
ccaaagauguggcuguaua

SEQ ID NO: 660821 - RNA, 19 nt, Homo sapiens
ggaccuggguuauuuauug

SEQ ID NO: 660822 - RNA, 19 nt, Homo sapiens
gagagaagguggaugucua

SEQ ID NO: 660823 - RNA, 19 nt, Homo sapiens
uuacuucccuuucauauga

SEQ ID NO: 660824 - RNA, 19 nt, Homo sapiens
ccaaggagaugaccaagug

SEQ ID NO: 660825 - RNA, 19 nt, Homo sapiens
gcaccgaagucaccaauag

SEQ ID NO: 660826 - RNA, 19 nt, Homo sapiens
caaggucucuggcuucuuc

SEQ ID NO: 660827 - RNA, 19 nt, Homo sapiens
ccagugaggugguuaagau

SEQ ID NO: 660828 - RNA, 19 nt, Homo sapiens
ggaccaagcggaucgacua

SEQ ID NO: 660829 - RNA, 19 nt, Homo sapiens
gaacauugcccgagacucu

SEQ ID NO: 660830 - RNA, 19 nt, Homo sapiens
gcgaggagccguccaucua

SEQ ID NO: 660831 - RNA, 19 nt, Homo sapiens
ccauugaaauugagaccua

SEQ ID NO: 660832 - RNA, 19 nt, Homo sapiens
gagggccacugucugauga

SEQ ID NO: 660833 - RNA, 19 nt, Homo sapiens
cgaggcagcuaaaggcauu

SEQ ID NO: 660834 - RNA, 19 nt, Homo sapiens
gaccuggguuauuuauuga

SEQ ID NO: 660835 - RNA, 19 nt, Homo sapiens
ccaugagccuggacgagua

SEQ ID NO: 660836 - RNA, 19 nt, Homo sapiens
gaacaucguggccgguuau

SEQ ID NO: 660837 - RNA, 19 nt, Homo sapiens
ugacuucauugaugccuuu

SEQ ID NO: 660838 - RNA, 19 nt, Homo sapiens
gaacagcuccgaggaagag

SEQ ID NO: 660839 - RNA, 19 nt, Homo sapiens
gccuggaccuggguuauuu

SEQ ID NO: 660840 - RNA, 19 nt, Homo sapiens
gcacggaggcuguggucuu

SEQ ID NO: 660841 - RNA, 19 nt, Homo sapiens
gugggagcaugaacaauga

SEQ ID NO: 660842 - RNA, 19 nt, Homo sapiens
caucaaggaauaccacauu

SEQ ID NO: 660843 - RNA, 19 nt, Homo sapiens
gauuggagaugguguuggu

SEQ ID NO: 660844 - RNA, 19 nt, Homo sapiens
ccuauaagcugugcaaggu

SEQ ID NO: 660845 - RNA, 19 nt, Homo sapiens
gggcaggucgcacugauug

SEQ ID NO: 660846 - RNA, 19 nt, Homo sapiens
ucuccaaccugagcccuua

SEQ ID NO: 660847 - RNA, 19 nt, Homo sapiens
ugaacaucguggccgguua

SEQ ID NO: 660848 - RNA, 19 nt, Homo sapiens
aagccaagaucgagcaguu

SEQ ID NO: 660849 - RNA, 19 nt, Homo sapiens
gaggagccguccaucuaca

SEQ ID NO: 660850 - RNA, 19 nt, Homo sapiens
ccuaugcccuugucuccaa

SEQ ID NO: 660851 - RNA, 19 nt, Homo sapiens
guucuuugaugcccacgaa

SEQ ID NO: 660852 - RNA, 19 nt, Homo sapiens
ggccggauaugcagaagca

SEQ ID NO: 660853 - RNA, 19 nt, Homo sapiens
ccggcuaccugaucgugua

SEQ ID NO: 660854 - RNA, 19 nt, Homo sapiens
gcugcucucuccggaguuu

SEQ ID NO: 660855 - RNA, 19 nt, Homo sapiens
ucccaaagauguggcugua

SEQ ID NO: 660856 - RNA, 19 nt, Homo sapiens
ccacaccuaugccgaaugc

SEQ ID NO: 660857 - RNA, 19 nt, Homo sapiens
caacacccaccucuacuag

SEQ ID NO: 660858 - RNA, 19 nt, Homo sapiens
gugaacagaucuacaaccu

SEQ ID NO: 660859 - RNA, 19 nt, Homo sapiens
ggacuccggcuaccugauc

SEQ ID NO: 660860 - RNA, 19 nt, Homo sapiens
gccaggugaucgagaagga

SEQ ID NO: 660861 - RNA, 19 nt, Homo sapiens
ccaagcggaucgacuacuc

SEQ ID NO: 660862 - RNA, 19 nt, Homo sapiens
gagcugagcauggcugaca

SEQ ID NO: 660863 - RNA, 19 nt, Homo sapiens
ccuggcagaugguguggaa

SEQ ID NO: 660864 - RNA, 19 nt, Homo sapiens
guccacgcccucuuccuua

SEQ ID NO: 660865 - RNA, 19 nt, Homo sapiens
ggacucagagggccuggau

SEQ ID NO: 660866 - RNA, 19 nt, Homo sapiens
gcuaccugaucguguaugu

SEQ ID NO: 660867 - RNA, 19 nt, Homo sapiens
gaccacaccuaugccgaau

SEQ ID NO: 660868 - RNA, 19 nt, Homo sapiens
ggugcuggcucugcgcaaa

SEQ ID NO: 660869 - RNA, 19 nt, Homo sapiens
ucaacacccaccucuacua

SEQ ID NO: 660870 - RNA, 19 nt, Homo sapiens
gguguuacuucccuuucau

SEQ ID NO: 660871 - RNA, 19 nt, Homo sapiens
gggagaaguggcagcgaaa

SEQ ID NO: 660872 - RNA, 19 nt, Homo sapiens
cccgagggcucucagaaca

SEQ ID NO: 660873 - RNA, 19 nt, Homo sapiens
gcaccaaccaggccuacuc

SEQ ID NO: 660874 - RNA, 19 nt, Homo sapiens
cuacucaucccaacaugga

SEQ ID NO: 660875 - RNA, 19 nt, Homo sapiens
ggaagcagugguccucauc

SEQ ID NO: 660876 - RNA, 19 nt, Homo sapiens
gggaagcagugguccucau

SEQ ID NO: 660877 - RNA, 19 nt, Homo sapiens
ggagguaggacugaacauc

SEQ ID NO: 660878 - RNA, 19 nt, Homo sapiens
cgccucaccuucccaguuc

SEQ ID NO: 660879 - RNA, 19 nt, Homo sapiens
gcagugccaguuccuguca

SEQ ID NO: 660880 - RNA, 19 nt, Homo sapiens
uggaggagcuggagaugcu

SEQ ID NO: 660881 - RNA, 19 nt, Homo sapiens
cgugggagcaugaacaaug

SEQ ID NO: 660882 - RNA, 19 nt, Homo sapiens
gcaggucgcacugauugga

SEQ ID NO: 660883 - RNA, 19 nt, Homo sapiens
ggacagugaggaggucuuc

SEQ ID NO: 660884 - RNA, 19 nt, Homo sapiens
ugagaacagcuccgaggaa

SEQ ID NO: 660885 - RNA, 19 nt, Homo sapiens
uggcccagcucuacaugau

SEQ ID NO: 660886 - RNA, 19 nt, Homo sapiens
gcagaggcuuuuccagugu

SEQ ID NO: 660887 - RNA, 19 nt, Homo sapiens
cgugugcuccucgguguua

SEQ ID NO: 660888 - RNA, 19 nt, Homo sapiens
gggcagcgggcaauacaca

SEQ ID NO: 660889 - RNA, 19 nt, Homo sapiens
gcccgagacucugagaaca

SEQ ID NO: 660890 - RNA, 19 nt, Homo sapiens
gcgaguacaaagcagaaga

SEQ ID NO: 660891 - RNA, 19 nt, Homo sapiens
ggcaaagcacggagcauca

SEQ ID NO: 660892 - RNA, 19 nt, Homo sapiens
uaccugaucguguauguca

SEQ ID NO: 660893 - RNA, 19 nt, Homo sapiens
cacggaggcuguggucuuc

SEQ ID NO: 660894 - RNA, 19 nt, Homo sapiens
ggagagaagguggaugucu

SEQ ID NO: 660895 - RNA, 19 nt, Homo sapiens
gagaugaccaaguggaacu

SEQ ID NO: 660896 - RNA, 19 nt, Homo sapiens
ugacauccgggcacuggaa

SEQ ID NO: 660897 - RNA, 19 nt, Homo sapiens
caagaucgagcaguucauc

SEQ ID NO: 660898 - RNA, 19 nt, Homo sapiens
caaagauguggcuguauac

SEQ ID NO: 660899 - RNA, 19 nt, Homo sapiens
gaaauugagaccuauuacc

SEQ ID NO: 660900 - RNA, 19 nt, Homo sapiens
gccaagaucgagcaguuca

SEQ ID NO: 660901 - RNA, 19 nt, Homo sapiens
gcaugggcgcagaggcuuu

SEQ ID NO: 660902 - RNA, 19 nt, Homo sapiens
cacauucugcugcccauga

SEQ ID NO: 660903 - RNA, 19 nt, Homo sapiens
ccucaacacccaccucuac

SEQ ID NO: 660904 - RNA, 19 nt, Homo sapiens
gcacuccagccucuuucug

SEQ ID NO: 660905 - RNA, 19 nt, Homo sapiens
gacgcacuccagccucuuu

SEQ ID NO: 660906 - RNA, 19 nt, Homo sapiens
ggcaauacacacacaaggu

SEQ ID NO: 660907 - RNA, 19 nt, Homo sapiens
gagccgaggcagcuaaagg

SEQ ID NO: 660908 - RNA, 19 nt, Homo sapiens
cauugaaauugagaccuau

SEQ ID NO: 660909 - RNA, 19 nt, Homo sapiens
gcagcgggcaauacacaca

SEQ ID NO: 660910 - RNA, 19 nt, Homo sapiens
gaguggcgcaugcagaaca

SEQ ID NO: 660911 - RNA, 19 nt, Homo sapiens
gcugggcauuggugucuac

SEQ ID NO: 660912 - RNA, 19 nt, Homo sapiens
gcagcagccaaacgucuuc

SEQ ID NO: 660913 - RNA, 19 nt, Homo sapiens
cgagggccacugucugaug

SEQ ID NO: 660914 - RNA, 19 nt, Homo sapiens
gggcaugcaagccaagauc

SEQ ID NO: 660915 - RNA, 19 nt, Homo sapiens
gcacagaaauagcaaaguu

SEQ ID NO: 660916 - RNA, 19 nt, Homo sapiens
ggaagaaguucgccaugga

SEQ ID NO: 660917 - RNA, 19 nt, Homo sapiens
gcaaaguucuugaaagucu

SEQ ID NO: 660918 - RNA, 19 nt, Homo sapiens
ggaagaagacgacuuggaa

SEQ ID NO: 660919 - RNA, 19 nt, Homo sapiens
ggaagaugaugaugaggaa

SEQ ID NO: 660920 - RNA, 19 nt, Homo sapiens
gccaacauauuaaaggaua

SEQ ID NO: 660921 - RNA, 19 nt, Homo sapiens
aaacagaccuggccaagag

SEQ ID NO: 660922 - RNA, 19 nt, Homo sapiens
gagcaaguuuauagaagaa

SEQ ID NO: 660923 - RNA, 19 nt, Homo sapiens
gcaguuugcuccggaauau

SEQ ID NO: 660924 - RNA, 19 nt, Homo sapiens
ccaaggacuucccugagua

SEQ ID NO: 660925 - RNA, 19 nt, Homo sapiens
ccuaaaugaugcaaacuuu

SEQ ID NO: 660926 - RNA, 19 nt, Homo sapiens
ggaggaagaugaugaugag

SEQ ID NO: 660927 - RNA, 19 nt, Homo sapiens
uagcaaaguucuugaaagu

SEQ ID NO: 660928 - RNA, 19 nt, Homo sapiens
gaaauuccaguccaaguau

SEQ ID NO: 660929 - RNA, 19 nt, Homo sapiens
ccaucaagauccuuaagaa

SEQ ID NO: 660930 - RNA, 19 nt, Homo sapiens
uaaugcagccugagaaauu

SEQ ID NO: 660931 - RNA, 19 nt, Homo sapiens
aaccaugaaugacugaaua

SEQ ID NO: 660932 - RNA, 19 nt, Homo sapiens
ggacgaggauucuucuaac

SEQ ID NO: 660933 - RNA, 19 nt, Homo sapiens
acacagugcugcuggaguu

SEQ ID NO: 660934 - RNA, 19 nt, Homo sapiens
gaguacaccuuugccauug

SEQ ID NO: 660935 - RNA, 19 nt, Homo sapiens
ugaagcagguccaggaguu

SEQ ID NO: 660936 - RNA, 19 nt, Homo sapiens
caaagcagauaauucuucu

SEQ ID NO: 660937 - RNA, 19 nt, Homo sapiens
uagaagaacaugccacaaa

SEQ ID NO: 660938 - RNA, 19 nt, Homo sapiens
uugaugaaguugugaauga

SEQ ID NO: 660939 - RNA, 19 nt, Homo sapiens
gagcauuugagcaaguuua

SEQ ID NO: 660940 - RNA, 19 nt, Homo sapiens
gaacaugccacaaaacuga

SEQ ID NO: 660941 - RNA, 19 nt, Homo sapiens
ugagcaaguuuauagaaga

SEQ ID NO: 660942 - RNA, 19 nt, Homo sapiens
cgaggauucuucuaacaga

SEQ ID NO: 660943 - RNA, 19 nt, Homo sapiens
gaaauagcaaaguucuuga

SEQ ID NO: 660944 - RNA, 19 nt, Homo sapiens
caagcguucuccuccaauu

SEQ ID NO: 660945 - RNA, 19 nt, Homo sapiens
gcaaguuuauagaagaaca

SEQ ID NO: 660946 - RNA, 19 nt, Homo sapiens
agauaauucuucuguguga

SEQ ID NO: 660947 - RNA, 19 nt, Homo sapiens
uuacagaggauacaucuau

SEQ ID NO: 660948 - RNA, 19 nt, Homo sapiens
ggacauugcaagcaguuug

SEQ ID NO: 660949 - RNA, 19 nt, Homo sapiens
gaacccaguuaaauuugag

SEQ ID NO: 660950 - RNA, 19 nt, Homo sapiens
acaacagccuggccaagaa

SEQ ID NO: 660951 - RNA, 19 nt, Homo sapiens
gcgaguuugucacugcuuu

SEQ ID NO: 660952 - RNA, 19 nt, Homo sapiens
gagucuugguccuaaauga

SEQ ID NO: 660953 - RNA, 19 nt, Homo sapiens
gccaaggacuucccugagu

SEQ ID NO: 660954 - RNA, 19 nt, Homo sapiens
cuaacaaccugagagaaga

SEQ ID NO: 660955 - RNA, 19 nt, Homo sapiens
gaauacugaauaaccauga

SEQ ID NO: 660956 - RNA, 19 nt, Homo sapiens
agaaauuccaguccaagua

SEQ ID NO: 660957 - RNA, 19 nt, Homo sapiens
gaaacagaccuggccaaga

SEQ ID NO: 660958 - RNA, 19 nt, Homo sapiens
ggacgacuuccguggguuu

SEQ ID NO: 660959 - RNA, 19 nt, Homo sapiens
ggacuucagcuuugauuac

SEQ ID NO: 660960 - RNA, 19 nt, Homo sapiens
ucaaggacuucgugcugaa

SEQ ID NO: 660961 - RNA, 19 nt, Homo sapiens
acaaauuucaccacacuuu

SEQ ID NO: 660962 - RNA, 19 nt, Homo sapiens
gccaagagguuugaugucu

SEQ ID NO: 660963 - RNA, 19 nt, Homo sapiens
gauaaagauccucccauuc

SEQ ID NO: 660964 - RNA, 19 nt, Homo sapiens
ucugauugcuuccuguuga

SEQ ID NO: 660965 - RNA, 19 nt, Homo sapiens
gacgaggauucuucuaaca

SEQ ID NO: 660966 - RNA, 19 nt, Homo sapiens
gcuaacaaccugagagaag

SEQ ID NO: 660967 - RNA, 19 nt, Homo sapiens
gccagcagguuugauguga

SEQ ID NO: 660968 - RNA, 19 nt, Homo sapiens
gcaacaaacgacaguaucu

SEQ ID NO: 660969 - RNA, 19 nt, Homo sapiens
ccugagagaagauuacaaa

SEQ ID NO: 660970 - RNA, 19 nt, Homo sapiens
agauuuggcuucugguaug

SEQ ID NO: 660971 - RNA, 19 nt, Homo sapiens
gaaauuguuggcguagauu

SEQ ID NO: 660972 - RNA, 19 nt, Homo sapiens
agaaauuguuggcguagau

SEQ ID NO: 660973 - RNA, 19 nt, Homo sapiens
ugaagccagucaucaaauc

SEQ ID NO: 660974 - RNA, 19 nt, Homo sapiens
ggacgagagugggaagaag

SEQ ID NO: 660975 - RNA, 19 nt, Homo sapiens
caccagaagucacgcuugu

SEQ ID NO: 660976 - RNA, 19 nt, Homo sapiens
gagaaauuguuggcguaga

SEQ ID NO: 660977 - RNA, 19 nt, Homo sapiens
caugaaugacugaauaguu

SEQ ID NO: 660978 - RNA, 19 nt, Homo sapiens
ggaccaaggaagagcuuug

SEQ ID NO: 660979 - RNA, 19 nt, Homo sapiens
agaacccaguuaaauuuga

SEQ ID NO: 660980 - RNA, 19 nt, Homo sapiens
ugaggaagaagacgacuug

SEQ ID NO: 660981 - RNA, 19 nt, Homo sapiens
gaagucacgcuuguguuga

SEQ ID NO: 660982 - RNA, 19 nt, Homo sapiens
gguccuaaaugaugcaaac

SEQ ID NO: 660983 - RNA, 19 nt, Homo sapiens
gaacccaggaagaaauugu

SEQ ID NO: 660984 - RNA, 19 nt, Homo sapiens
agaguaggcuguggcaaug

SEQ ID NO: 660985 - RNA, 19 nt, Homo sapiens
ucaaagcagauaauucuuc

SEQ ID NO: 660986 - RNA, 19 nt, Homo sapiens
cuacaacggcccacgagaa

SEQ ID NO: 660987 - RNA, 19 nt, Homo sapiens
gauccucccauuccuguug

SEQ ID NO: 660988 - RNA, 19 nt, Homo sapiens
gauaauucuucugugugaa

SEQ ID NO: 660989 - RNA, 19 nt, Homo sapiens
ucucaaagcagauaauucu

SEQ ID NO: 660990 - RNA, 19 nt, Homo sapiens
caacaagggacccgucaag

SEQ ID NO: 660991 - RNA, 19 nt, Homo sapiens
uuacaaauuucaccacacu

SEQ ID NO: 660992 - RNA, 19 nt, Homo sapiens
uacagaggauacaucuauu

SEQ ID NO: 660993 - RNA, 19 nt, Homo sapiens
agaagaacaugccacaaaa

SEQ ID NO: 660994 - RNA, 19 nt, Homo sapiens
ugaguacaccuuugccauu

SEQ ID NO: 660995 - RNA, 19 nt, Homo sapiens
gacuucagcuuugauuaca

SEQ ID NO: 660996 - RNA, 19 nt, Homo sapiens
guagauuuggcuucuggua

SEQ ID NO: 660997 - RNA, 19 nt, Homo sapiens
gaauaguuuaguccagauu

SEQ ID NO: 660998 - RNA, 19 nt, Homo sapiens
gcauuugagcaaguuuaua

SEQ ID NO: 660999 - RNA, 19 nt, Homo sapiens
ucaaggucguggugggaaa

SEQ ID NO: 661000 - RNA, 19 nt, Homo sapiens
ccagaacccaggaagaaau

SEQ ID NO: 661001 - RNA, 19 nt, Homo sapiens
cagcagguuugaugugagu

SEQ ID NO: 661002 - RNA, 19 nt, Homo sapiens
ugguauguguuucugauug

SEQ ID NO: 661003 - RNA, 19 nt, Homo sapiens
acagaggauacaucuauuu

SEQ ID NO: 661004 - RNA, 19 nt, Homo sapiens
ggacgaagaggacuaugcu

SEQ ID NO: 661005 - RNA, 19 nt, Homo sapiens
ccugaaggauggagacgau

SEQ ID NO: 661006 - RNA, 19 nt, Homo sapiens
aggaaggccuuaugacuac

SEQ ID NO: 661007 - RNA, 19 nt, Homo sapiens
agaagucacgcuuguguug

SEQ ID NO: 661008 - RNA, 19 nt, Homo sapiens
gaccaaggaagagcuuuga

SEQ ID NO: 661009 - RNA, 19 nt, Homo sapiens
cggacgaggauucuucuaa

SEQ ID NO: 661010 - RNA, 19 nt, Homo sapiens
ccauggagccagaggaguu

SEQ ID NO: 661011 - RNA, 19 nt, Homo sapiens
cuucagcuuugauuacaga

SEQ ID NO: 661012 - RNA, 19 nt, Homo sapiens
aauggagucuugguccuaa

SEQ ID NO: 661013 - RNA, 19 nt, Homo sapiens
ggaggaggaagaugaugau

SEQ ID NO: 661014 - RNA, 19 nt, Homo sapiens
ccagaagucacgcuugugu

SEQ ID NO: 661015 - RNA, 19 nt, Homo sapiens
gaacuaauuugacaggauu

SEQ ID NO: 661016 - RNA, 19 nt, Homo sapiens
ggacaaauguuuaggacuu

SEQ ID NO: 661017 - RNA, 19 nt, Homo sapiens
uaaccacacuuaccacuua

SEQ ID NO: 661018 - RNA, 19 nt, Homo sapiens
gaaacugcuucaagaauug

SEQ ID NO: 661019 - RNA, 19 nt, Homo sapiens
gaaacugcaugaccuuuau

SEQ ID NO: 661020 - RNA, 19 nt, Homo sapiens
ccauggagaucuuacauuu

SEQ ID NO: 661021 - RNA, 19 nt, Homo sapiens
gaagacaacuuugauccaa

SEQ ID NO: 661022 - RNA, 19 nt, Homo sapiens
gccaagaccuacuguauga

SEQ ID NO: 661023 - RNA, 19 nt, Homo sapiens
gaagauggacucuauuaug

SEQ ID NO: 661024 - RNA, 19 nt, Homo sapiens
gcguagaccuagaucuuua

SEQ ID NO: 661025 - RNA, 19 nt, Homo sapiens
gcagaaugaugaugaugaa

SEQ ID NO: 661026 - RNA, 19 nt, Homo sapiens
gauggacucuauuauguga

SEQ ID NO: 661027 - RNA, 19 nt, Homo sapiens
gcgcagaacugucguaaac

SEQ ID NO: 661028 - RNA, 19 nt, Homo sapiens
gcacgaagcuguggaucau

SEQ ID NO: 661029 - RNA, 19 nt, Homo sapiens
agaagaaacugaagaugga

SEQ ID NO: 661030 - RNA, 19 nt, Homo sapiens
gaaucuaguucccaucaug

SEQ ID NO: 661031 - RNA, 19 nt, Homo sapiens
agacacagauagaaacuug

SEQ ID NO: 661032 - RNA, 19 nt, Homo sapiens
ucaaagugauucugauuuc

SEQ ID NO: 661033 - RNA, 19 nt, Homo sapiens
gaacugucguaaacgcaaa

SEQ ID NO: 661034 - RNA, 19 nt, Homo sapiens
gcacugaccaugaaucuag

SEQ ID NO: 661035 - RNA, 19 nt, Homo sapiens
gaaaugagagacaucugaa

SEQ ID NO: 661036 - RNA, 19 nt, Homo sapiens
aaacgcaaauuggacauaa

SEQ ID NO: 661037 - RNA, 19 nt, Homo sapiens
ccaguaagcuuugucacuu

SEQ ID NO: 661038 - RNA, 19 nt, Homo sapiens
gcaugccuguugauucuuu

SEQ ID NO: 661039 - RNA, 19 nt, Homo sapiens
guaguaauguucagaaacu

SEQ ID NO: 661040 - RNA, 19 nt, Homo sapiens
ggaacuaauuugacaggau

SEQ ID NO: 661041 - RNA, 19 nt, Homo sapiens
caacuuugauccaaucgau

SEQ ID NO: 661042 - RNA, 19 nt, Homo sapiens
caaagaauagguuaacaug

SEQ ID NO: 661043 - RNA, 19 nt, Homo sapiens
aagauggacucuauuaugu

SEQ ID NO: 661044 - RNA, 19 nt, Homo sapiens
gcaagcacaauguaacaaa

SEQ ID NO: 661045 - RNA, 19 nt, Homo sapiens
ucacagaagauaaggagua

SEQ ID NO: 661046 - RNA, 19 nt, Homo sapiens
aauaauaccucugucauca

SEQ ID NO: 661047 - RNA, 19 nt, Homo sapiens
ccacagaagacaacuuuga

SEQ ID NO: 661048 - RNA, 19 nt, Homo sapiens
aagcuuacauggacaaaug

SEQ ID NO: 661049 - RNA, 19 nt, Homo sapiens
gaaagugagaagaaacuga

SEQ ID NO: 661050 - RNA, 19 nt, Homo sapiens
ucaauagcauguuaaguag

SEQ ID NO: 661051 - RNA, 19 nt, Homo sapiens
gaacucacuucagcagaau

SEQ ID NO: 661052 - RNA, 19 nt, Homo sapiens
gaaguaguaauguucagaa

SEQ ID NO: 661053 - RNA, 19 nt, Homo sapiens
ggaaagagaaagugagaag

SEQ ID NO: 661054 - RNA, 19 nt, Homo sapiens
gaacagcgugcuaaagcuu

SEQ ID NO: 661055 - RNA, 19 nt, Homo sapiens
ggacagauacuucuuucuc

SEQ ID NO: 661056 - RNA, 19 nt, Homo sapiens
aaagaccacugaaucuaga

SEQ ID NO: 661057 - RNA, 19 nt, Homo sapiens
aaagagaaagugagaagaa

SEQ ID NO: 661058 - RNA, 19 nt, Homo sapiens
gaucagaaaccauugaaac

SEQ ID NO: 661059 - RNA, 19 nt, Homo sapiens
gauaguacccaaagaacug

SEQ ID NO: 661060 - RNA, 19 nt, Homo sapiens
gagagcaagcacaauguaa

SEQ ID NO: 661061 - RNA, 19 nt, Homo sapiens
ugaaggugcuauagguuau

SEQ ID NO: 661062 - RNA, 19 nt, Homo sapiens
guuuaggacuucaagauca

SEQ ID NO: 661063 - RNA, 19 nt, Homo sapiens
gaagauaaggaguagauac

SEQ ID NO: 661064 - RNA, 19 nt, Homo sapiens
agaacucacuucagcagaa

SEQ ID NO: 661065 - RNA, 19 nt, Homo sapiens
ugacuuagaaggugcugua

SEQ ID NO: 661066 - RNA, 19 nt, Homo sapiens
uaagagagagcaagcacaa

SEQ ID NO: 661067 - RNA, 19 nt, Homo sapiens
ggaagucacagaagauaag

SEQ ID NO: 661068 - RNA, 19 nt, Homo sapiens
ccagaacccaguaagcuuu

SEQ ID NO: 661069 - RNA, 19 nt, Homo sapiens
gcaguuaaauucucauacc

SEQ ID NO: 661070 - RNA, 19 nt, Homo sapiens
aagagaaagugagaagaaa

SEQ ID NO: 661071 - RNA, 19 nt, Homo sapiens
ggccacagaagacaacuuu

SEQ ID NO: 661072 - RNA, 19 nt, Homo sapiens
aaccauuucugcaguuaaa

SEQ ID NO: 661073 - RNA, 19 nt, Homo sapiens
gugauggcaugaauucuuc

SEQ ID NO: 661074 - RNA, 19 nt, Homo sapiens
gaaaagaccacugaaucua

SEQ ID NO: 661075 - RNA, 19 nt, Homo sapiens
cugaagauggacucuauua

SEQ ID NO: 661076 - RNA, 19 nt, Homo sapiens
gaaagagaaagugagaaga

SEQ ID NO: 661077 - RNA, 19 nt, Homo sapiens
agaaacugcaugaccuuua

SEQ ID NO: 661078 - RNA, 19 nt, Homo sapiens
uaauaccucugucaucaag

SEQ ID NO: 661079 - RNA, 19 nt, Homo sapiens
gacagauacuucuuucucu

SEQ ID NO: 661080 - RNA, 19 nt, Homo sapiens
ccacugaaucuagaaauga

SEQ ID NO: 661081 - RNA, 19 nt, Homo sapiens
ugaugaaggugcuauaggu

SEQ ID NO: 661082 - RNA, 19 nt, Homo sapiens
ccucugucaucaagucuaa

SEQ ID NO: 661083 - RNA, 19 nt, Homo sapiens
uaaauucucauaccaccaa

SEQ ID NO: 661084 - RNA, 19 nt, Homo sapiens
ugaaacagaaacugcauga

SEQ ID NO: 661085 - RNA, 19 nt, Homo sapiens
caagcacaauguaacaaag

SEQ ID NO: 661086 - RNA, 19 nt, Homo sapiens
gugcuaaagcuuugcauau

SEQ ID NO: 661087 - RNA, 19 nt, Homo sapiens
caacacguauuucauaacc

SEQ ID NO: 661088 - RNA, 19 nt, Homo sapiens
auggagaucuuacauuuca

SEQ ID NO: 661089 - RNA, 19 nt, Homo sapiens
gaaccauuucugcaguuaa

SEQ ID NO: 661090 - RNA, 19 nt, Homo sapiens
gagcaagcacaauguaaca

SEQ ID NO: 661091 - RNA, 19 nt, Homo sapiens
cggcaugccuguugauucu

SEQ ID NO: 661092 - RNA, 19 nt, Homo sapiens
uaguucccaucaugacuua

SEQ ID NO: 661093 - RNA, 19 nt, Homo sapiens
agacaacuuugauccaauc

SEQ ID NO: 661094 - RNA, 19 nt, Homo sapiens
ccaguaagacuuuccaucu

SEQ ID NO: 661095 - RNA, 19 nt, Homo sapiens
gaaaacccaguaagacuuu

SEQ ID NO: 661096 - RNA, 19 nt, Homo sapiens
gacaaauguuuaggacuuc

SEQ ID NO: 661097 - RNA, 19 nt, Homo sapiens
gcacaauguaacaaagcua

SEQ ID NO: 661098 - RNA, 19 nt, Homo sapiens
gaagaugauguauguaacu

SEQ ID NO: 661099 - RNA, 19 nt, Homo sapiens
cagaagauaaggaguagau

SEQ ID NO: 661100 - RNA, 19 nt, Homo sapiens
ccugggaagucacagaaga

SEQ ID NO: 661101 - RNA, 19 nt, Homo sapiens
aaagugagaagaaacugaa

SEQ ID NO: 661102 - RNA, 19 nt, Homo sapiens
auuaagagaugaccaaggu

SEQ ID NO: 661103 - RNA, 19 nt, Homo sapiens
gggaagucacagaagauaa

SEQ ID NO: 661104 - RNA, 19 nt, Homo sapiens
gaaucuacuucugaaccuu

SEQ ID NO: 661105 - RNA, 19 nt, Homo sapiens
caguaagcuuugucacuug

SEQ ID NO: 661106 - RNA, 19 nt, Homo sapiens
uuauugcacugaccaugaa

SEQ ID NO: 661107 - RNA, 19 nt, Homo sapiens
gaugaaggugcuauagguu

SEQ ID NO: 661108 - RNA, 19 nt, Homo sapiens
caacagcaaggacuucaca

SEQ ID NO: 661109 - RNA, 19 nt, Homo sapiens
gaggccaucuugcuuuguc

SEQ ID NO: 661110 - RNA, 19 nt, Homo sapiens
agaaaugagagacaucuga

SEQ ID NO: 661111 - RNA, 19 nt, Homo sapiens
gagagagcaagcacaaugu

SEQ ID NO: 661112 - RNA, 19 nt, Homo sapiens
gcuaaagcuuugcauaucc

SEQ ID NO: 661113 - RNA, 19 nt, Homo sapiens
caacugcaccagaaucuac

SEQ ID NO: 661114 - RNA, 19 nt, Homo sapiens
cuuagaaggugcuguaggu

SEQ ID NO: 661115 - RNA, 19 nt, Homo sapiens
ccaaagcucugaauaguua

SEQ ID NO: 661116 - RNA, 19 nt, Homo sapiens
ugaagaaggugcauugaua

SEQ ID NO: 661117 - RNA, 19 nt, Homo sapiens
ucaaagagcugcccauguu

SEQ ID NO: 661118 - RNA, 19 nt, Homo sapiens
gaucagagauggccagguu

SEQ ID NO: 661119 - RNA, 19 nt, Homo sapiens
gaaggugcauugauacauu

SEQ ID NO: 661120 - RNA, 19 nt, Homo sapiens
gaagaggggucaagaguua

SEQ ID NO: 661121 - RNA, 19 nt, Homo sapiens
gcugaauguucuugaauua

SEQ ID NO: 661122 - RNA, 19 nt, Homo sapiens
uggaagagauggaaaguaa

SEQ ID NO: 661123 - RNA, 19 nt, Homo sapiens
gaacucccauagagaaauu

SEQ ID NO: 661124 - RNA, 19 nt, Homo sapiens
gaucaaagguaugguaaga

SEQ ID NO: 661125 - RNA, 19 nt, Homo sapiens
ccacagaauuucaagauau

SEQ ID NO: 661126 - RNA, 19 nt, Homo sapiens
gaauuuggcuucauacucu

SEQ ID NO: 661127 - RNA, 19 nt, Homo sapiens
gaagaacgagguuuauauu

SEQ ID NO: 661128 - RNA, 19 nt, Homo sapiens
gaucuucucuaacaagcua

SEQ ID NO: 661129 - RNA, 19 nt, Homo sapiens
guccuaacuuucugaauua

SEQ ID NO: 661130 - RNA, 19 nt, Homo sapiens
ggaagcccauuacuccaua

SEQ ID NO: 661131 - RNA, 19 nt, Homo sapiens
gagcaaacccuuacaaaca

SEQ ID NO: 661132 - RNA, 19 nt, Homo sapiens
uaacuuugcgggauauuua

SEQ ID NO: 661133 - RNA, 19 nt, Homo sapiens
uaaggugacugcagagaaa

SEQ ID NO: 661134 - RNA, 19 nt, Homo sapiens
guuagaaccuagauucaaa

SEQ ID NO: 661135 - RNA, 19 nt, Homo sapiens
ggaagaacgagguuuauau

SEQ ID NO: 661136 - RNA, 19 nt, Homo sapiens
guaagagagugauucagaa

SEQ ID NO: 661137 - RNA, 19 nt, Homo sapiens
gagaaaccaggaucuauuu

SEQ ID NO: 661138 - RNA, 19 nt, Homo sapiens
ggagaaaccaggaucuauu

SEQ ID NO: 661139 - RNA, 19 nt, Homo sapiens
guaacaagaugacauguac

SEQ ID NO: 661140 - RNA, 19 nt, Homo sapiens
gaaucacugucaaaucuga

SEQ ID NO: 661141 - RNA, 19 nt, Homo sapiens
gaucugauguagaccaaga

SEQ ID NO: 661142 - RNA, 19 nt, Homo sapiens
caaagaggaugcuuagucu

SEQ ID NO: 661143 - RNA, 19 nt, Homo sapiens
ucaaagguaugguaagaga

SEQ ID NO: 661144 - RNA, 19 nt, Homo sapiens
uuaauggacuuacgaaaug

SEQ ID NO: 661145 - RNA, 19 nt, Homo sapiens
ggaguucccucaguacuau

SEQ ID NO: 661146 - RNA, 19 nt, Homo sapiens
gugagaagcuggguaguga

SEQ ID NO: 661147 - RNA, 19 nt, Homo sapiens
cgauggagaugaauuuaga

SEQ ID NO: 661148 - RNA, 19 nt, Homo sapiens
gcaguguucugggugauaa

SEQ ID NO: 661149 - RNA, 19 nt, Homo sapiens
ugagguagaagacuaguua

SEQ ID NO: 661150 - RNA, 19 nt, Homo sapiens
gcaaacccuuacaaacauu

SEQ ID NO: 661151 - RNA, 19 nt, Homo sapiens
gaaccuagauucaaaaugg

SEQ ID NO: 661152 - RNA, 19 nt, Homo sapiens
gaaauuagacggauguaac

SEQ ID NO: 661153 - RNA, 19 nt, Homo sapiens
ccaccuucauucacacuua

SEQ ID NO: 661154 - RNA, 19 nt, Homo sapiens
gcacuuagacaaccuaugg

SEQ ID NO: 661155 - RNA, 19 nt, Homo sapiens
cuaaauuucugccaaguca

SEQ ID NO: 661156 - RNA, 19 nt, Homo sapiens
gaacgagguuuauauuuuc

SEQ ID NO: 661157 - RNA, 19 nt, Homo sapiens
gguaagagagugauucaga

SEQ ID NO: 661158 - RNA, 19 nt, Homo sapiens
ggucaaagaguuaguggaa

SEQ ID NO: 661159 - RNA, 19 nt, Homo sapiens
gaaggacuacuuugaaauc

SEQ ID NO: 661160 - RNA, 19 nt, Homo sapiens
ugaucaagcucagcagaua

SEQ ID NO: 661161 - RNA, 19 nt, Homo sapiens
aagaggaaauuguggauga

SEQ ID NO: 661162 - RNA, 19 nt, Homo sapiens
gagaagcucaggaggauga

SEQ ID NO: 661163 - RNA, 19 nt, Homo sapiens
ggaauaggagaaagcuuaa

SEQ ID NO: 661164 - RNA, 19 nt, Homo sapiens
gauacuggcucagaagaau

SEQ ID NO: 661165 - RNA, 19 nt, Homo sapiens
gcccaaagcucugaauagu

SEQ ID NO: 661166 - RNA, 19 nt, Homo sapiens
gaaauuaauggacuuacga

SEQ ID NO: 661167 - RNA, 19 nt, Homo sapiens
caggaaaucuuggacuuug

SEQ ID NO: 661168 - RNA, 19 nt, Homo sapiens
gccacagaauuucaagaua

SEQ ID NO: 661169 - RNA, 19 nt, Homo sapiens
gaggaugcuuagucuuaaa

SEQ ID NO: 661170 - RNA, 19 nt, Homo sapiens
aaauugaacuacagcuuga

SEQ ID NO: 661171 - RNA, 19 nt, Homo sapiens
uggaauaggagaaagcuua

SEQ ID NO: 661172 - RNA, 19 nt, Homo sapiens
gaugcaauuucuuaaggaa

SEQ ID NO: 661173 - RNA, 19 nt, Homo sapiens
cuaacaagcuaugggaauu

SEQ ID NO: 661174 - RNA, 19 nt, Homo sapiens
caagucaguucucuuugga

SEQ ID NO: 661175 - RNA, 19 nt, Homo sapiens
ucacauuccuaccaaccua

SEQ ID NO: 661176 - RNA, 19 nt, Homo sapiens
caaaucugauccaggaaau

SEQ ID NO: 661177 - RNA, 19 nt, Homo sapiens
ugaauauugucucuccuuu

SEQ ID NO: 661178 - RNA, 19 nt, Homo sapiens
guagaagccuuaugaaaau

SEQ ID NO: 661179 - RNA, 19 nt, Homo sapiens
aagaugagguagaagacua

SEQ ID NO: 661180 - RNA, 19 nt, Homo sapiens
aguccuaacuuucugaauu

SEQ ID NO: 661181 - RNA, 19 nt, Homo sapiens
uaaguucuauucagcuuuc

SEQ ID NO: 661182 - RNA, 19 nt, Homo sapiens
ggaugcaauuucuuaagga

SEQ ID NO: 661183 - RNA, 19 nt, Homo sapiens
gaauacaccauuugcuuuc

SEQ ID NO: 661184 - RNA, 19 nt, Homo sapiens
caaaugagugucuccagaa

SEQ ID NO: 661185 - RNA, 19 nt, Homo sapiens
ccagagugagcaaggauua

SEQ ID NO: 661186 - RNA, 19 nt, Homo sapiens
gggcacuugauauuuauua

SEQ ID NO: 661187 - RNA, 19 nt, Homo sapiens
ggaguggguagaagccuua

SEQ ID NO: 661188 - RNA, 19 nt, Homo sapiens
ucaguacuauuccuuacaa

SEQ ID NO: 661189 - RNA, 19 nt, Homo sapiens
uaacuacugcucaagauau

SEQ ID NO: 661190 - RNA, 19 nt, Homo sapiens
guuaguggaagcagaguua

SEQ ID NO: 661191 - RNA, 19 nt, Homo sapiens
uggaaucacugucaaaucu

SEQ ID NO: 661192 - RNA, 19 nt, Homo sapiens
ugcaugaacuccacucuga

SEQ ID NO: 661193 - RNA, 19 nt, Homo sapiens
ggaagagacccuagcauac

SEQ ID NO: 661194 - RNA, 19 nt, Homo sapiens
aaaccaggaucuauuugga

SEQ ID NO: 661195 - RNA, 19 nt, Homo sapiens
caaauugaggaaucacuuu

SEQ ID NO: 661196 - RNA, 19 nt, Homo sapiens
gaagcccauuacuccauaa

SEQ ID NO: 661197 - RNA, 19 nt, Homo sapiens
ucuaagacauucuguugga

SEQ ID NO: 661198 - RNA, 19 nt, Homo sapiens
cugaaggacuacuuugaaa

SEQ ID NO: 661199 - RNA, 19 nt, Homo sapiens
gaauaguggcuuugaauac

SEQ ID NO: 661200 - RNA, 19 nt, Homo sapiens
gcaaauugaggaaucacuu

SEQ ID NO: 661201 - RNA, 19 nt, Homo sapiens
gcucagaagaauuuaaguu

SEQ ID NO: 661202 - RNA, 19 nt, Homo sapiens
gugaaugcauguacuucuu

SEQ ID NO: 661203 - RNA, 19 nt, Homo sapiens
gaucaagcucagcagauaa

SEQ ID NO: 661204 - RNA, 19 nt, Homo sapiens
cuagcauacuugaauauug

SEQ ID NO: 661205 - RNA, 19 nt, Homo sapiens
gaggcuugguagcaaagua

SEQ ID NO: 661206 - RNA, 19 nt, Homo sapiens
aauacagacugcgguguua

SEQ ID NO: 661207 - RNA, 19 nt, Homo sapiens
gguagaagccuuaugaaaa

SEQ ID NO: 661208 - RNA, 19 nt, Homo sapiens
gaagcuggguagugaaugc

SEQ ID NO: 661209 - RNA, 19 nt, Homo sapiens
agacugcgguguuaauauc

SEQ ID NO: 661210 - RNA, 19 nt, Homo sapiens
gaagagacccuagcauacu

SEQ ID NO: 661211 - RNA, 19 nt, Homo sapiens
ugaauacaccauuugcuuu

SEQ ID NO: 661212 - RNA, 19 nt, Homo sapiens
ccagaauaguggcuuugaa

SEQ ID NO: 661213 - RNA, 19 nt, Homo sapiens
uacaguaguuccaguccua

SEQ ID NO: 661214 - RNA, 19 nt, Homo sapiens
cguagaagauauggaagaa

SEQ ID NO: 661215 - RNA, 19 nt, Homo sapiens
ucacaaagcuguaagaaag

SEQ ID NO: 661216 - RNA, 19 nt, Homo sapiens
gcauggagcucuacaggaa

SEQ ID NO: 661217 - RNA, 19 nt, Homo sapiens
ggacaccgcaucuggauug

SEQ ID NO: 661218 - RNA, 19 nt, Homo sapiens
gcaccuggccggaauaaug

SEQ ID NO: 661219 - RNA, 19 nt, Homo sapiens
ggagacggcaguccaguuu

SEQ ID NO: 661220 - RNA, 19 nt, Homo sapiens
agaagaagcuggagugcau

SEQ ID NO: 661221 - RNA, 19 nt, Homo sapiens
gcugugggcugugaacauu

SEQ ID NO: 661222 - RNA, 19 nt, Homo sapiens
gaaacuagcacagcagugu

SEQ ID NO: 661223 - RNA, 19 nt, Homo sapiens
ggaaaccacuaaagaagcu

SEQ ID NO: 661224 - RNA, 19 nt, Homo sapiens
ugaggagcauccacuauau

SEQ ID NO: 661225 - RNA, 19 nt, Homo sapiens
cccaugaacuaguuucuug

SEQ ID NO: 661226 - RNA, 19 nt, Homo sapiens
ggaauaauggagucacuuc

SEQ ID NO: 661227 - RNA, 19 nt, Homo sapiens
ucgaggaccuggagcaguu

SEQ ID NO: 661228 - RNA, 19 nt, Homo sapiens
gaaccuagugauugccaaa

SEQ ID NO: 661229 - RNA, 19 nt, Homo sapiens
aggccaagcucaagaggaa

SEQ ID NO: 661230 - RNA, 19 nt, Homo sapiens
gauggagaaccuagugauu

SEQ ID NO: 661231 - RNA, 19 nt, Homo sapiens
cacccgagaucuuccagaa

SEQ ID NO: 661232 - RNA, 19 nt, Homo sapiens
gcccugcucuccuguguag

SEQ ID NO: 661233 - RNA, 19 nt, Homo sapiens
ggugcaggcucagcgauga

SEQ ID NO: 661234 - RNA, 19 nt, Homo sapiens
gaagcuggagugcauagug

SEQ ID NO: 661235 - RNA, 19 nt, Homo sapiens
gaagaagcuggagugcaua

SEQ ID NO: 661236 - RNA, 19 nt, Homo sapiens
gagacacuccagagaaaga

SEQ ID NO: 661237 - RNA, 19 nt, Homo sapiens
gcugugcccugcgcagaaa

SEQ ID NO: 661238 - RNA, 19 nt, Homo sapiens
cuauaucucccagguguua

SEQ ID NO: 661239 - RNA, 19 nt, Homo sapiens
gguaugcuguuugcugaug

SEQ ID NO: 661240 - RNA, 19 nt, Homo sapiens
cugaggagcauccacuaua

SEQ ID NO: 661241 - RNA, 19 nt, Homo sapiens
ggugugcucuccagcucuu

SEQ ID NO: 661242 - RNA, 19 nt, Homo sapiens
gcugaaggcugcguaugag

SEQ ID NO: 661243 - RNA, 19 nt, Homo sapiens
gcagagucacaaagcugua

SEQ ID NO: 661244 - RNA, 19 nt, Homo sapiens
ccuccaagaugcugaaacu

SEQ ID NO: 661245 - RNA, 19 nt, Homo sapiens
auaagcagguggugguguu

SEQ ID NO: 661246 - RNA, 19 nt, Homo sapiens
gaugauggagaaccuagug

SEQ ID NO: 661247 - RNA, 19 nt, Homo sapiens
uaaagaagcuggggaaacu

SEQ ID NO: 661248 - RNA, 19 nt, Homo sapiens
cggaauaccugaggagcau

SEQ ID NO: 661249 - RNA, 19 nt, Homo sapiens
gcuacugccucacaucacu

SEQ ID NO: 661250 - RNA, 19 nt, Homo sapiens
gccaagaagggaagcuuug

SEQ ID NO: 661251 - RNA, 19 nt, Homo sapiens
gauccacaaugccguagac

SEQ ID NO: 661252 - RNA, 19 nt, Homo sapiens
guuacuagaagaaguggaa

SEQ ID NO: 661253 - RNA, 19 nt, Homo sapiens
ggacacaggaggcauacac

SEQ ID NO: 661254 - RNA, 19 nt, Homo sapiens
uuccucaccucacaucuga

SEQ ID NO: 661255 - RNA, 19 nt, Homo sapiens
ucgcagagccuccauugca

SEQ ID NO: 661256 - RNA, 19 nt, Homo sapiens
caaugucucuggguguauc

SEQ ID NO: 661257 - RNA, 19 nt, Homo sapiens
ggccaagaagggaagcuuu

SEQ ID NO: 661258 - RNA, 19 nt, Homo sapiens
gaagcugaaggcugcguau

SEQ ID NO: 661259 - RNA, 19 nt, Homo sapiens
agacggcaguccaguuucu

SEQ ID NO: 661260 - RNA, 19 nt, Homo sapiens
ucaccuuccucaccucaca

SEQ ID NO: 661261 - RNA, 19 nt, Homo sapiens
ucacgcugcucugcacaug

SEQ ID NO: 661262 - RNA, 19 nt, Homo sapiens
gggcuacugccucacauca

SEQ ID NO: 661263 - RNA, 19 nt, Homo sapiens
acacagcugccuccaagga

SEQ ID NO: 661264 - RNA, 19 nt, Homo sapiens
ggaaggccaagcucaagag

SEQ ID NO: 661265 - RNA, 19 nt, Homo sapiens
uguauacuccgaugaagga

SEQ ID NO: 661266 - RNA, 19 nt, Homo sapiens
ccacccagccuaaaauaaa

SEQ ID NO: 661267 - RNA, 19 nt, Homo sapiens
cucaaugucucugggugua

SEQ ID NO: 661268 - RNA, 19 nt, Homo sapiens
gucacaaagcuguaagaaa

SEQ ID NO: 661269 - RNA, 19 nt, Homo sapiens
uggagaaccuagugauugc

SEQ ID NO: 661270 - RNA, 19 nt, Homo sapiens
gcagaugauggagaaccua

SEQ ID NO: 661271 - RNA, 19 nt, Homo sapiens
aggccucccugcagaauca

SEQ ID NO: 661272 - RNA, 19 nt, Homo sapiens
gaggagcauccacuauauc

SEQ ID NO: 661273 - RNA, 19 nt, Homo sapiens
gcuaaccaccgcagcucaa

SEQ ID NO: 661274 - RNA, 19 nt, Homo sapiens
guggugguguuccuugcuu

SEQ ID NO: 661275 - RNA, 19 nt, Homo sapiens
ucucccagguguuacuaga

SEQ ID NO: 661276 - RNA, 19 nt, Homo sapiens
gccaaguaguacagcuaga

SEQ ID NO: 661277 - RNA, 19 nt, Homo sapiens
agaccgcgguggaggagau

SEQ ID NO: 661278 - RNA, 19 nt, Homo sapiens
acaaagcuguaagaaagag

SEQ ID NO: 661279 - RNA, 19 nt, Homo sapiens
caggaggcauacacggaau

SEQ ID NO: 661280 - RNA, 19 nt, Homo sapiens
uaaacacagcugccuccaa

SEQ ID NO: 661281 - RNA, 19 nt, Homo sapiens
cagagucacaaagcuguaa

SEQ ID NO: 661282 - RNA, 19 nt, Homo sapiens
cacaaagcuguaagaaaga

SEQ ID NO: 661283 - RNA, 19 nt, Homo sapiens
gggcaccuggccggaauaa

SEQ ID NO: 661284 - RNA, 19 nt, Homo sapiens
gguguuacuagaagaagug

SEQ ID NO: 661285 - RNA, 19 nt, Homo sapiens
ccagguguuacuagaagaa

SEQ ID NO: 661286 - RNA, 19 nt, Homo sapiens
cugggcaucuuaucuaggu

SEQ ID NO: 661287 - RNA, 19 nt, Homo sapiens
ccagccaggccaugcagaa

SEQ ID NO: 661288 - RNA, 19 nt, Homo sapiens
uccaagaugcugaaacuag

SEQ ID NO: 661289 - RNA, 19 nt, Homo sapiens
ugaagaagcucaagaguaa

SEQ ID NO: 661290 - RNA, 19 nt, Homo sapiens
gaagggaagcuuuguuuga

SEQ ID NO: 661291 - RNA, 19 nt, Homo sapiens
gaagaaguauggccaaguc

SEQ ID NO: 661292 - RNA, 19 nt, Homo sapiens
gaagaauaaugccuguaug

SEQ ID NO: 661293 - RNA, 19 nt, Homo sapiens
guaaacguguucccaucua

SEQ ID NO: 661294 - RNA, 19 nt, Homo sapiens
guuacugugugaagaauaa

SEQ ID NO: 661295 - RNA, 19 nt, Homo sapiens
gaaaauaaaucacccuaag

SEQ ID NO: 661296 - RNA, 19 nt, Homo sapiens
gaguuuggcuuaagcaaca

SEQ ID NO: 661297 - RNA, 19 nt, Homo sapiens
gcaauuccuuccuccugaa

SEQ ID NO: 661298 - RNA, 19 nt, Homo sapiens
gaucgaagcgcugcaagaa

SEQ ID NO: 661299 - RNA, 19 nt, Homo sapiens
aagggaagcuuuguuugaa

SEQ ID NO: 661300 - RNA, 19 nt, Homo sapiens
gcucaagaguaaacguguu

SEQ ID NO: 661301 - RNA, 19 nt, Homo sapiens
caaauugaagcauguacaa

SEQ ID NO: 661302 - RNA, 19 nt, Homo sapiens
ucgaagcgcugcaagaagu

SEQ ID NO: 661303 - RNA, 19 nt, Homo sapiens
gacacaaauugaagcaugu

SEQ ID NO: 661304 - RNA, 19 nt, Homo sapiens
caucuacucugccguggau

SEQ ID NO: 661305 - RNA, 19 nt, Homo sapiens
uaaacguguucccaucuau

SEQ ID NO: 661306 - RNA, 19 nt, Homo sapiens
aaauaaaucacccuaagug

SEQ ID NO: 661307 - RNA, 19 nt, Homo sapiens
ugaagaauaaugccuguau

SEQ ID NO: 661308 - RNA, 19 nt, Homo sapiens
aagaagggaagcuuuguuu

SEQ ID NO: 661309 - RNA, 19 nt, Homo sapiens
ggugagcagugugcaguga

SEQ ID NO: 661310 - RNA, 19 nt, Homo sapiens
gauguuacugugugaagaa

SEQ ID NO: 661311 - RNA, 19 nt, Homo sapiens
cuaagugacacaaauugaa

SEQ ID NO: 661312 - RNA, 19 nt, Homo sapiens
cacccuaagugacacaaau

SEQ ID NO: 661313 - RNA, 19 nt, Homo sapiens
gggaagcuuuguuugaaaa

SEQ ID NO: 661314 - RNA, 19 nt, Homo sapiens
aaacucuuguguaccuuug

SEQ ID NO: 661315 - RNA, 19 nt, Homo sapiens
cccgagcccuggacaucua

SEQ ID NO: 661316 - RNA, 19 nt, Homo sapiens
ccaucuaugagaagaagua

SEQ ID NO: 661317 - RNA, 19 nt, Homo sapiens
gaagaagcucaagaguaaa

SEQ ID NO: 661318 - RNA, 19 nt, Homo sapiens
uggcuuaagcaacagauaa

SEQ ID NO: 661319 - RNA, 19 nt, Homo sapiens
uauguggcauggcagaaug

SEQ ID NO: 661320 - RNA, 19 nt, Homo sapiens
caaacucuuguguaccuuu

SEQ ID NO: 661321 - RNA, 19 nt, Homo sapiens
guugauacgugugugaagu

SEQ ID NO: 661322 - RNA, 19 nt, Homo sapiens
cuccugaagugcuuaugaa

SEQ ID NO: 661323 - RNA, 19 nt, Homo sapiens
uaagugacacaaauugaag

SEQ ID NO: 661324 - RNA, 19 nt, Homo sapiens
agggaagcuuuguuugaaa

SEQ ID NO: 661325 - RNA, 19 nt, Homo sapiens
ggcuuaagcaacagauaaa

SEQ ID NO: 661326 - RNA, 19 nt, Homo sapiens
cauggcagaaugaaaauua

SEQ ID NO: 661327 - RNA, 19 nt, Homo sapiens
gggcaaggaucgggaagcu

SEQ ID NO: 661328 - RNA, 19 nt, Homo sapiens
ccuaagugacacaaauuga

SEQ ID NO: 661329 - RNA, 19 nt, Homo sapiens
gcagugugcagugaggaaa

SEQ ID NO: 661330 - RNA, 19 nt, Homo sapiens
ggaaaauaaaucacccuaa

SEQ ID NO: 661331 - RNA, 19 nt, Homo sapiens
gaaccuccugcaauuccuu

SEQ ID NO: 661332 - RNA, 19 nt, Homo sapiens
ggaucgggaagcuguguga

SEQ ID NO: 661333 - RNA, 19 nt, Homo sapiens
gugugugaaguaucuauuu

SEQ ID NO: 661334 - RNA, 19 nt, Homo sapiens
ucuaugagaagaaguaugg

SEQ ID NO: 661335 - RNA, 19 nt, Homo sapiens
cgguagaugucauuacaac

SEQ ID NO: 661336 - RNA, 19 nt, Homo sapiens
guagaugucauuacaaccu

SEQ ID NO: 661337 - RNA, 19 nt, Homo sapiens
guucccaucuaugagaaga

SEQ ID NO: 661338 - RNA, 19 nt, Homo sapiens
cgacgaguuucagaacgau

SEQ ID NO: 661339 - RNA, 19 nt, Homo sapiens
cgagaaggagcugaucgaa

SEQ ID NO: 661340 - RNA, 19 nt, Homo sapiens
cucgguagaugucauuaca

SEQ ID NO: 661341 - RNA, 19 nt, Homo sapiens
ugacgccggugagcagugu

SEQ ID NO: 661342 - RNA, 19 nt, Homo sapiens
acacaaauugaagcaugua

SEQ ID NO: 661343 - RNA, 19 nt, Homo sapiens
gcugaugcuaccucuguug

SEQ ID NO: 661344 - RNA, 19 nt, Homo sapiens
ccauucuccuccauacauc

SEQ ID NO: 661345 - RNA, 19 nt, Homo sapiens
gcucagcgauugccaaaua

SEQ ID NO: 661346 - RNA, 19 nt, Homo sapiens
cagaagagauggaugaaug

SEQ ID NO: 661347 - RNA, 19 nt, Homo sapiens
gcacuguggugaucccaua

SEQ ID NO: 661348 - RNA, 19 nt, Homo sapiens
caccaugccuggcuaauuu

SEQ ID NO: 661349 - RNA, 19 nt, Homo sapiens
gaacaaagacaguacaaag

SEQ ID NO: 661350 - RNA, 19 nt, Homo sapiens
guugauggcuuguuuguug

SEQ ID NO: 661351 - RNA, 19 nt, Homo sapiens
guaaaugguccuugauuaa

SEQ ID NO: 661352 - RNA, 19 nt, Homo sapiens
uguaaaugguccuugauua

SEQ ID NO: 661353 - RNA, 19 nt, Homo sapiens
gaaauugagcgcuuugaga

SEQ ID NO: 661354 - RNA, 19 nt, Homo sapiens
ccaaguagcugggauuaca

SEQ ID NO: 661355 - RNA, 19 nt, Homo sapiens
ggacagagagcaggaaaga

SEQ ID NO: 661356 - RNA, 19 nt, Homo sapiens
acacacagauggacagaga

SEQ ID NO: 661357 - RNA, 19 nt, Homo sapiens
ugaagugucuccagcagaa

SEQ ID NO: 661358 - RNA, 19 nt, Homo sapiens
gcgagaacgugaaggcauu

SEQ ID NO: 661359 - RNA, 19 nt, Homo sapiens
gguuguauguuuaguguga

SEQ ID NO: 661360 - RNA, 19 nt, Homo sapiens
ggagugcaauggcguaauc

SEQ ID NO: 661361 - RNA, 19 nt, Homo sapiens
agucaacccugcacucuuu

SEQ ID NO: 661362 - RNA, 19 nt, Homo sapiens
cagcugcccuguaaauguu

SEQ ID NO: 661363 - RNA, 19 nt, Homo sapiens
gcacacacacggacaggaa

SEQ ID NO: 661364 - RNA, 19 nt, Homo sapiens
gguccucccugacaccuuu

SEQ ID NO: 661365 - RNA, 19 nt, Homo sapiens
gauggauuguaguucauuu

SEQ ID NO: 661366 - RNA, 19 nt, Homo sapiens
ggccauucuuguaguuaua

SEQ ID NO: 661367 - RNA, 19 nt, Homo sapiens
gacaguacaaagcauauaa

SEQ ID NO: 661368 - RNA, 19 nt, Homo sapiens
gccaggaugugcagaacaa

SEQ ID NO: 661369 - RNA, 19 nt, Homo sapiens
ccaaagugcugggauuaca

SEQ ID NO: 661370 - RNA, 19 nt, Homo sapiens
gggagaaccugcccauggu

SEQ ID NO: 661371 - RNA, 19 nt, Homo sapiens
uuaaagggguuguauguuu

SEQ ID NO: 661372 - RNA, 19 nt, Homo sapiens
guggauggauuguaguuca

SEQ ID NO: 661373 - RNA, 19 nt, Homo sapiens
ggacuacaggcacguguga

SEQ ID NO: 661374 - RNA, 19 nt, Homo sapiens
cacugcagcugcccuguaa

SEQ ID NO: 661375 - RNA, 19 nt, Homo sapiens
cagcaggacuuaugguucu

SEQ ID NO: 661376 - RNA, 19 nt, Homo sapiens
ggguggacuuugaaauuga

SEQ ID NO: 661377 - RNA, 19 nt, Homo sapiens
gcagcugcccuguaaaugu

SEQ ID NO: 661378 - RNA, 19 nt, Homo sapiens
ggagaggccaccugccauu

SEQ ID NO: 661379 - RNA, 19 nt, Homo sapiens
cagcagaagagauggauga

SEQ ID NO: 661380 - RNA, 19 nt, Homo sapiens
cagccucucugcccaguau

SEQ ID NO: 661381 - RNA, 19 nt, Homo sapiens
caucgcaucugccuacuac

SEQ ID NO: 661382 - RNA, 19 nt, Homo sapiens
ggaaggacacacagaugga

SEQ ID NO: 661383 - RNA, 19 nt, Homo sapiens
aaagacaguacaaagcaua

SEQ ID NO: 661384 - RNA, 19 nt, Homo sapiens
caaagacaguacaaagcau

SEQ ID NO: 661385 - RNA, 19 nt, Homo sapiens
gugcagacccuggagcaua

SEQ ID NO: 661386 - RNA, 19 nt, Homo sapiens
gcuggacuguggaagaaug

SEQ ID NO: 661387 - RNA, 19 nt, Homo sapiens
caguguugauggcuuguuu

SEQ ID NO: 661388 - RNA, 19 nt, Homo sapiens
gcaguggccauucuuguag

SEQ ID NO: 661389 - RNA, 19 nt, Homo sapiens
ucauguggauggauuguag

SEQ ID NO: 661390 - RNA, 19 nt, Homo sapiens
cuccaucccucucucauug

SEQ ID NO: 661391 - RNA, 19 nt, Homo sapiens
ucaagaggccucagaacug

SEQ ID NO: 661392 - RNA, 19 nt, Homo sapiens
cguccggccuccauaaaug

SEQ ID NO: 661393 - RNA, 19 nt, Homo sapiens
ccagcgaucuuggaugugu

SEQ ID NO: 661394 - RNA, 19 nt, Homo sapiens
ggaggacaauggacaaaau

SEQ ID NO: 661395 - RNA, 19 nt, Homo sapiens
cagcugggcaggagaaguu

SEQ ID NO: 661396 - RNA, 19 nt, Homo sapiens
caucagacagucaccuuug

SEQ ID NO: 661397 - RNA, 19 nt, Homo sapiens
gcagguugggcacuagaaa

SEQ ID NO: 661398 - RNA, 19 nt, Homo sapiens
ggcagguucucguugcuau

SEQ ID NO: 661399 - RNA, 19 nt, Homo sapiens
gccaaggccucucccugau

SEQ ID NO: 661400 - RNA, 19 nt, Homo sapiens
gauggcuuguuuguuguuu

SEQ ID NO: 661401 - RNA, 19 nt, Homo sapiens
cagaggcccugccaagucu

SEQ ID NO: 661402 - RNA, 19 nt, Homo sapiens
ccaccuggacagugcauuu

SEQ ID NO: 661403 - RNA, 19 nt, Homo sapiens
caggauccgucacaguguu

SEQ ID NO: 661404 - RNA, 19 nt, Homo sapiens
cuucgggccuccaggauau

SEQ ID NO: 661405 - RNA, 19 nt, Homo sapiens
gaauggaaggacacacaga

SEQ ID NO: 661406 - RNA, 19 nt, Homo sapiens
gaagagauggaugaaugga

SEQ ID NO: 661407 - RNA, 19 nt, Homo sapiens
gauugccaaauaccaguua

SEQ ID NO: 661408 - RNA, 19 nt, Homo sapiens
gggagaugcaggccgagua

SEQ ID NO: 661409 - RNA, 19 nt, Homo sapiens
gauggaguuucacccuugu

SEQ ID NO: 661410 - RNA, 19 nt, Homo sapiens
cuuaggaccuuuguaaugg

SEQ ID NO: 661411 - RNA, 19 nt, Homo sapiens
ugccucagccucccaagua

SEQ ID NO: 661412 - RNA, 19 nt, Homo sapiens
ggugugguguccagcuguu

SEQ ID NO: 661413 - RNA, 19 nt, Homo sapiens
acaaagacaguacaaagca

SEQ ID NO: 661414 - RNA, 19 nt, Homo sapiens
ucgcuggacuguggaagaa

SEQ ID NO: 661415 - RNA, 19 nt, Homo sapiens
ucccagcgaucuuggaugu

SEQ ID NO: 661416 - RNA, 19 nt, Homo sapiens
ccuauagccuccagaucug

SEQ ID NO: 661417 - RNA, 19 nt, Homo sapiens
aaauugagcgcuuugagau

SEQ ID NO: 661418 - RNA, 19 nt, Homo sapiens
gagcaggaaagacuguuag

SEQ ID NO: 661419 - RNA, 19 nt, Homo sapiens
ccaggauggucucgaugau

SEQ ID NO: 661420 - RNA, 19 nt, Homo sapiens
ccacccgucucgugcuguu

SEQ ID NO: 661421 - RNA, 19 nt, Homo sapiens
ggcaggagaaguucaagug

SEQ ID NO: 661422 - RNA, 19 nt, Homo sapiens
gcauugggguccauuagga

SEQ ID NO: 661423 - RNA, 19 nt, Homo sapiens
ccaccaugccuggcuaauu

SEQ ID NO: 661424 - RNA, 19 nt, Homo sapiens
ugccaagucuagcauguuc

SEQ ID NO: 661425 - RNA, 19 nt, Homo sapiens
ggagaccuaauccaaaugg

SEQ ID NO: 661426 - RNA, 19 nt, Homo sapiens
auugagcgcuuugagauug

SEQ ID NO: 661427 - RNA, 19 nt, Homo sapiens
gcagccuucugaucaguac

SEQ ID NO: 661428 - RNA, 19 nt, Homo sapiens
gcuuuuagcucuugccaau

SEQ ID NO: 661429 - RNA, 19 nt, Homo sapiens
gagccuccuuccuguagca

SEQ ID NO: 661430 - RNA, 19 nt, Homo sapiens
gcagaagagauggaugaau

SEQ ID NO: 661431 - RNA, 19 nt, Homo sapiens
gccaggauggucucgauga

SEQ ID NO: 661432 - RNA, 19 nt, Homo sapiens
caccuggacagugcauuua

SEQ ID NO: 661433 - RNA, 19 nt, Homo sapiens
cagcucagcgauugccaaa

SEQ ID NO: 661434 - RNA, 19 nt, Homo sapiens
agacugcacagcuguccua

SEQ ID NO: 661435 - RNA, 19 nt, Homo sapiens
gcaaccuggacuugucaaa

SEQ ID NO: 661436 - RNA, 19 nt, Homo sapiens
uaaaaggccaguccauuug

SEQ ID NO: 661437 - RNA, 19 nt, Homo sapiens
gggccuccaggauauguuu

SEQ ID NO: 661438 - RNA, 19 nt, Homo sapiens
acagagagcaggaaagacu

SEQ ID NO: 661439 - RNA, 19 nt, Homo sapiens
ggacacacagauggacaga

SEQ ID NO: 661440 - RNA, 19 nt, Homo sapiens
ccagcuucccuaaguggua

SEQ ID NO: 661441 - RNA, 19 nt, Homo sapiens
agaaauaccccacacauuc

SEQ ID NO: 661442 - RNA, 19 nt, Homo sapiens
gaucaucacggccuuugac

SEQ ID NO: 661443 - RNA, 19 nt, Homo sapiens
gggguggacuuugaaauug

SEQ ID NO: 661444 - RNA, 19 nt, Homo sapiens
ggauggauuguaguucauu

SEQ ID NO: 661445 - RNA, 19 nt, Homo sapiens
ggaaagcccuggagaguca

SEQ ID NO: 661446 - RNA, 19 nt, Homo sapiens
cuaagaggcuggaacaugu

SEQ ID NO: 661447 - RNA, 19 nt, Homo sapiens
gaacuggaauaaagaugag

SEQ ID NO: 661448 - RNA, 19 nt, Homo sapiens
caagagaagcuucaaagug

SEQ ID NO: 661449 - RNA, 19 nt, Homo sapiens
ccaccaagcgggagaaauu

SEQ ID NO: 661450 - RNA, 19 nt, Homo sapiens
ggaacuggaauaaagauga

SEQ ID NO: 661451 - RNA, 19 nt, Homo sapiens
gaacauguccuggagaagu

SEQ ID NO: 661452 - RNA, 19 nt, Homo sapiens
ccaccaccuuugucugaua

SEQ ID NO: 661453 - RNA, 19 nt, Homo sapiens
cgggagaaauucaagagaa

SEQ ID NO: 661454 - RNA, 19 nt, Homo sapiens
ugacccagcccaacacuuu

SEQ ID NO: 661455 - RNA, 19 nt, Homo sapiens
gcagaggaguagcuugaag

SEQ ID NO: 661456 - RNA, 19 nt, Homo sapiens
ccacgcagccacucacaaa

SEQ ID NO: 661457 - RNA, 19 nt, Homo sapiens
cugaggaacuggaauaaag

SEQ ID NO: 661458 - RNA, 19 nt, Homo sapiens
caucugaggaacuggaaua

SEQ ID NO: 661459 - RNA, 19 nt, Homo sapiens
gggagaaauucaagagaag

SEQ ID NO: 661460 - RNA, 19 nt, Homo sapiens
gcuccucccucaacaucaa

SEQ ID NO: 661461 - RNA, 19 nt, Homo sapiens
cagcagaggaguagcuuga

SEQ ID NO: 661462 - RNA, 19 nt, Homo sapiens
gcccuagccuuccgccuau

SEQ ID NO: 661463 - RNA, 19 nt, Homo sapiens
cuggagaagucauugcauu

SEQ ID NO: 661464 - RNA, 19 nt, Homo sapiens
uggaacauguccuggagaa

SEQ ID NO: 661465 - RNA, 19 nt, Homo sapiens
gcauugcucugugcucaag

SEQ ID NO: 661466 - RNA, 19 nt, Homo sapiens
ccgaguagccuaucaggau

SEQ ID NO: 661467 - RNA, 19 nt, Homo sapiens
gagcccagccugcuuacug

SEQ ID NO: 661468 - RNA, 19 nt, Homo sapiens
ccugcaagcugcucuacau

SEQ ID NO: 661469 - RNA, 19 nt, Homo sapiens
caguagaguuggagcaagu

SEQ ID NO: 661470 - RNA, 19 nt, Homo sapiens
gccaccaaguuccgaguga

SEQ ID NO: 661471 - RNA, 19 nt, Homo sapiens
gagaagucauugcauugcu

SEQ ID NO: 661472 - RNA, 19 nt, Homo sapiens
gcucauguucccagaccua

SEQ ID NO: 661473 - RNA, 19 nt, Homo sapiens
ccagggacauucgggaaca

SEQ ID NO: 661474 - RNA, 19 nt, Homo sapiens
gagcuccucccucaacauc

SEQ ID NO: 661475 - RNA, 19 nt, Homo sapiens
ccuaagaggcuggaacaug

SEQ ID NO: 661476 - RNA, 19 nt, Homo sapiens
ugaggaacuggaauaaaga

SEQ ID NO: 661477 - RNA, 19 nt, Homo sapiens
uguaugacgugcccaaugc

SEQ ID NO: 661478 - RNA, 19 nt, Homo sapiens
cccaggacccacuguauga

SEQ ID NO: 661479 - RNA, 19 nt, Homo sapiens
ggacacacaagaguuaacu

SEQ ID NO: 661480 - RNA, 19 nt, Homo sapiens
aagcucgugucgccuaaga

SEQ ID NO: 661481 - RNA, 19 nt, Homo sapiens
gcccaggacccacuguaug

SEQ ID NO: 661482 - RNA, 19 nt, Homo sapiens
gaggaacuggaauaaagau

SEQ ID NO: 661483 - RNA, 19 nt, Homo sapiens
gcucugugccaccaaguuc

SEQ ID NO: 661484 - RNA, 19 nt, Homo sapiens
agaagcucgugucgccuaa

SEQ ID NO: 661485 - RNA, 19 nt, Homo sapiens
ggagccgccuugugcuucu

SEQ ID NO: 661486 - RNA, 19 nt, Homo sapiens
ggacauucgggaacagucu

SEQ ID NO: 661487 - RNA, 19 nt, Homo sapiens
cagcaccuccuccgaguag

SEQ ID NO: 661488 - RNA, 19 nt, Homo sapiens
uggagaggguggcuacuac

SEQ ID NO: 661489 - RNA, 19 nt, Homo sapiens
gugcgcguguccacagaga

SEQ ID NO: 661490 - RNA, 19 nt, Homo sapiens
ucaagagaagcuucaaagu

SEQ ID NO: 661491 - RNA, 19 nt, Homo sapiens
cgagugacccagcccaaca

SEQ ID NO: 661492 - RNA, 19 nt, Homo sapiens
gcuggaggccgaguacaug

SEQ ID NO: 661493 - RNA, 19 nt, Homo sapiens
ggagaagucauugcauugc

SEQ ID NO: 661494 - RNA, 19 nt, Homo sapiens
ccaccuuugucugauacuu

SEQ ID NO: 661495 - RNA, 19 nt, Homo sapiens
cccugagccugcugagaaa

SEQ ID NO: 661496 - RNA, 19 nt, Homo sapiens
gggcaccuggcgagagaaa

SEQ ID NO: 661497 - RNA, 19 nt, Homo sapiens
uggagaagucauugcauug

SEQ ID NO: 661498 - RNA, 19 nt, Homo sapiens
acccugagccugcugagaa

SEQ ID NO: 661499 - RNA, 19 nt, Homo sapiens
ccaagcgggagaaauucaa

SEQ ID NO: 661500 - RNA, 19 nt, Homo sapiens
gaucacaucugucaaauua

SEQ ID NO: 661501 - RNA, 19 nt, Homo sapiens
gaacguggcucucaaaguu

SEQ ID NO: 661502 - RNA, 19 nt, Homo sapiens
gaagagaucuguucagugu

SEQ ID NO: 661503 - RNA, 19 nt, Homo sapiens
gaaaggaaaucgacacuga

SEQ ID NO: 661504 - RNA, 19 nt, Homo sapiens
gcaugaagcugccagguua

SEQ ID NO: 661505 - RNA, 19 nt, Homo sapiens
gcaauucaguggacuauaa

SEQ ID NO: 661506 - RNA, 19 nt, Homo sapiens
gaacucaccuucugcuuug

SEQ ID NO: 661507 - RNA, 19 nt, Homo sapiens
gaagaaaucaugcaagaaa

SEQ ID NO: 661508 - RNA, 19 nt, Homo sapiens
ggugguagcucagcaaaua

SEQ ID NO: 661509 - RNA, 19 nt, Homo sapiens
gcaaauaaaugcccaaagg

SEQ ID NO: 661510 - RNA, 19 nt, Homo sapiens
aaagaaagaugaagaggaa

SEQ ID NO: 661511 - RNA, 19 nt, Homo sapiens
gaagauggccuuaaauauc

SEQ ID NO: 661512 - RNA, 19 nt, Homo sapiens
aaagaagacuccaaagaaa

SEQ ID NO: 661513 - RNA, 19 nt, Homo sapiens
caauaugccuccaacaauu

SEQ ID NO: 661514 - RNA, 19 nt, Homo sapiens
gcacuuauuugacuucuca

SEQ ID NO: 661515 - RNA, 19 nt, Homo sapiens
ccaaaggccauguuauuua

SEQ ID NO: 661516 - RNA, 19 nt, Homo sapiens
caaaggccauguuauuuau

SEQ ID NO: 661517 - RNA, 19 nt, Homo sapiens
gaaaggagaacuaguuaug

SEQ ID NO: 661518 - RNA, 19 nt, Homo sapiens
gacagacaaucuuaaauga

SEQ ID NO: 661519 - RNA, 19 nt, Homo sapiens
gcacacggccgauaauuga

SEQ ID NO: 661520 - RNA, 19 nt, Homo sapiens
ggaaggaaauauaaagcaa

SEQ ID NO: 661521 - RNA, 19 nt, Homo sapiens
gacaagaacagauagauuu

SEQ ID NO: 661522 - RNA, 19 nt, Homo sapiens
gcagagacaagaacagaua

SEQ ID NO: 661523 - RNA, 19 nt, Homo sapiens
gaggacuucuuuacugaua

SEQ ID NO: 661524 - RNA, 19 nt, Homo sapiens
gaacggcccucuucagucu

SEQ ID NO: 661525 - RNA, 19 nt, Homo sapiens
gcaugaagcucccaaagca

SEQ ID NO: 661526 - RNA, 19 nt, Homo sapiens
gcacaccaauaaaguuuga

SEQ ID NO: 661527 - RNA, 19 nt, Homo sapiens
gaacaccaggcacuuauuu

SEQ ID NO: 661528 - RNA, 19 nt, Homo sapiens
caacugagcccugggauuu

SEQ ID NO: 661529 - RNA, 19 nt, Homo sapiens
ggguugagauguagaguuu

SEQ ID NO: 661530 - RNA, 19 nt, Homo sapiens
gggcaaggcuacuuaggaa

SEQ ID NO: 661531 - RNA, 19 nt, Homo sapiens
gaacuugcguccagaugug

SEQ ID NO: 661532 - RNA, 19 nt, Homo sapiens
ggaaaguccucccauacga

SEQ ID NO: 661533 - RNA, 19 nt, Homo sapiens
gaagacagcaguccugaga

SEQ ID NO: 661534 - RNA, 19 nt, Homo sapiens
gaaagagacuuggauagag

SEQ ID NO: 661535 - RNA, 19 nt, Homo sapiens
uaagaaggauccagcauuc

SEQ ID NO: 661536 - RNA, 19 nt, Homo sapiens
gcacagaacaaagucguua

SEQ ID NO: 661537 - RNA, 19 nt, Homo sapiens
gcccacagaugaugaagaa

SEQ ID NO: 661538 - RNA, 19 nt, Homo sapiens
ucaagggucucuccagaaa

SEQ ID NO: 661539 - RNA, 19 nt, Homo sapiens
gagaagagaucuguucagu

SEQ ID NO: 661540 - RNA, 19 nt, Homo sapiens
gaagugagggugccagaaa

SEQ ID NO: 661541 - RNA, 19 nt, Homo sapiens
gauaggcaguuuaugaaug

SEQ ID NO: 661542 - RNA, 19 nt, Homo sapiens
guauaaagauaggcaguuu

SEQ ID NO: 661543 - RNA, 19 nt, Homo sapiens
gaggaaagcuaaagaaagc

SEQ ID NO: 661544 - RNA, 19 nt, Homo sapiens
cagcagauccuuaaacuga

SEQ ID NO: 661545 - RNA, 19 nt, Homo sapiens
caagaaaggagaacuaguu

SEQ ID NO: 661546 - RNA, 19 nt, Homo sapiens
aagaacagcucaugaaauc

SEQ ID NO: 661547 - RNA, 19 nt, Homo sapiens
agaggaagcugcauccaaa

SEQ ID NO: 661548 - RNA, 19 nt, Homo sapiens
caacagaggcuuuggugaa

SEQ ID NO: 661549 - RNA, 19 nt, Homo sapiens
gaagaguguuccugauugu

SEQ ID NO: 661550 - RNA, 19 nt, Homo sapiens
gaacaaagacgagucaagu

SEQ ID NO: 661551 - RNA, 19 nt, Homo sapiens
gcaggagaauaaugagaaa

SEQ ID NO: 661552 - RNA, 19 nt, Homo sapiens
ggacagaaucacuuauauu

SEQ ID NO: 661553 - RNA, 19 nt, Homo sapiens
caguacaucucccuccuua

SEQ ID NO: 661554 - RNA, 19 nt, Homo sapiens
gcagauccuuaaacugaaa

SEQ ID NO: 661555 - RNA, 19 nt, Homo sapiens
ccaagcagcuccucaccaa

SEQ ID NO: 661556 - RNA, 19 nt, Homo sapiens
gaacggaacggcccucuuc

SEQ ID NO: 661557 - RNA, 19 nt, Homo sapiens
acaggaaucugccaaauca

SEQ ID NO: 661558 - RNA, 19 nt, Homo sapiens
aaagauaggcaguuuauga

SEQ ID NO: 661559 - RNA, 19 nt, Homo sapiens
ggagugagcaugagauuuc

SEQ ID NO: 661560 - RNA, 19 nt, Homo sapiens
caaaccaggugaugaggaa

SEQ ID NO: 661561 - RNA, 19 nt, Homo sapiens
gccaggaacugagaucuuu

SEQ ID NO: 661562 - RNA, 19 nt, Homo sapiens
cucaaagccuucacuguua

SEQ ID NO: 661563 - RNA, 19 nt, Homo sapiens
agaagaaacugaggaaaga

SEQ ID NO: 661564 - RNA, 19 nt, Homo sapiens
gagaacagcaagaaagauu

SEQ ID NO: 661565 - RNA, 19 nt, Homo sapiens
agagaucuguucaguguuu

SEQ ID NO: 661566 - RNA, 19 nt, Homo sapiens
gcaucgagcugcuguuauc

SEQ ID NO: 661567 - RNA, 19 nt, Homo sapiens
gcaguauuguccaaauuau

SEQ ID NO: 661568 - RNA, 19 nt, Homo sapiens
ucaaagccuucacuguuaa

SEQ ID NO: 661569 - RNA, 19 nt, Homo sapiens
ucaggaggaugaagauauu

SEQ ID NO: 661570 - RNA, 19 nt, Homo sapiens
cagaaggaauuaugggaaa

SEQ ID NO: 661571 - RNA, 19 nt, Homo sapiens
gaaaguguauaaagauagg

SEQ ID NO: 661572 - RNA, 19 nt, Homo sapiens
aagaagaaaucaugcaaga

SEQ ID NO: 661573 - RNA, 19 nt, Homo sapiens
gcagaaacaccgcaguauu

SEQ ID NO: 661574 - RNA, 19 nt, Homo sapiens
gcuccauccucuccaauuu

SEQ ID NO: 661575 - RNA, 19 nt, Homo sapiens
cgaacgaggucccggugua

SEQ ID NO: 661576 - RNA, 19 nt, Homo sapiens
gcaacgagaggaaucauug

SEQ ID NO: 661577 - RNA, 19 nt, Homo sapiens
gcccugggauuuaugauga

SEQ ID NO: 661578 - RNA, 19 nt, Homo sapiens
acagauagauuuggaaugu

SEQ ID NO: 661579 - RNA, 19 nt, Homo sapiens
cuacuugccuucauucuuc

SEQ ID NO: 661580 - RNA, 19 nt, Homo sapiens
gaucaucacccggcaaauu

SEQ ID NO: 661581 - RNA, 19 nt, Homo sapiens
gaacucaggagaccauguu

SEQ ID NO: 661582 - RNA, 19 nt, Homo sapiens
gaacagauagauuuggaau

SEQ ID NO: 661583 - RNA, 19 nt, Homo sapiens
caucauacuuggagaggaa

SEQ ID NO: 661584 - RNA, 19 nt, Homo sapiens
cagaaacaccgcaguauug

SEQ ID NO: 661585 - RNA, 19 nt, Homo sapiens
gaguauggaucguguagau

SEQ ID NO: 661586 - RNA, 19 nt, Homo sapiens
gaagaguuaauacagagua

SEQ ID NO: 661587 - RNA, 19 nt, Homo sapiens
ucaaacagcaggaaaucua

SEQ ID NO: 661588 - RNA, 19 nt, Homo sapiens
ucacaucugucaaauuauc

SEQ ID NO: 661589 - RNA, 19 nt, Homo sapiens
agacagcaguccugagaaa

SEQ ID NO: 661590 - RNA, 19 nt, Homo sapiens
gauuuggaauguagaaguu

SEQ ID NO: 661591 - RNA, 19 nt, Homo sapiens
gaagaggguucuguuugug

SEQ ID NO: 661592 - RNA, 19 nt, Homo sapiens
gagcagaaacaccgcagua

SEQ ID NO: 661593 - RNA, 19 nt, Homo sapiens
aacaacagcuugaagaaga

SEQ ID NO: 661594 - RNA, 19 nt, Homo sapiens
uacauuaccucacaacaga

SEQ ID NO: 661595 - RNA, 19 nt, Homo sapiens
gaaaguaucccagcgaagu

SEQ ID NO: 661596 - RNA, 19 nt, Homo sapiens
uaacaagucuaccaaucau

SEQ ID NO: 661597 - RNA, 19 nt, Homo sapiens
ggugaggacuucuuuacug

SEQ ID NO: 661598 - RNA, 19 nt, Homo sapiens
caacaggaaucugccaaau

SEQ ID NO: 661599 - RNA, 19 nt, Homo sapiens
ugaagaggguucuguuugu

SEQ ID NO: 661600 - RNA, 19 nt, Homo sapiens
gaacaggccuuaugaccua

SEQ ID NO: 661601 - RNA, 19 nt, Homo sapiens
ggacggagaucuucaauau

SEQ ID NO: 661602 - RNA, 19 nt, Homo sapiens
gaaaggcacucauggguaa

SEQ ID NO: 661603 - RNA, 19 nt, Homo sapiens
gaaccaaagucuaaacuga

SEQ ID NO: 661604 - RNA, 19 nt, Homo sapiens
ggaaugagccugaauacaa

SEQ ID NO: 661605 - RNA, 19 nt, Homo sapiens
caagaaaggucuccuggaa

SEQ ID NO: 661606 - RNA, 19 nt, Homo sapiens
gaaugagccugaauacaau

SEQ ID NO: 661607 - RNA, 19 nt, Homo sapiens
gaucaucgauggccucuca

SEQ ID NO: 661608 - RNA, 19 nt, Homo sapiens
ucucuaagcugaagaagaa

SEQ ID NO: 661609 - RNA, 19 nt, Homo sapiens
gaaaggcagauguaaauga

SEQ ID NO: 661610 - RNA, 19 nt, Homo sapiens
gaaccucgaugagaucuug

SEQ ID NO: 661611 - RNA, 19 nt, Homo sapiens
ggaaaagacucaaaguaaa

SEQ ID NO: 661612 - RNA, 19 nt, Homo sapiens
ccaugaagguguacaaaga

SEQ ID NO: 661613 - RNA, 19 nt, Homo sapiens
ccaacgagauugcuggaaa

SEQ ID NO: 661614 - RNA, 19 nt, Homo sapiens
ggaaggacuuacccaguau

SEQ ID NO: 661615 - RNA, 19 nt, Homo sapiens
ggaaggaaaggcagaugua

SEQ ID NO: 661616 - RNA, 19 nt, Homo sapiens
acacacgucguucuaauua

SEQ ID NO: 661617 - RNA, 19 nt, Homo sapiens
ggagugagcaggagaagga

SEQ ID NO: 661618 - RNA, 19 nt, Homo sapiens
gcagugggcuguccauguc

SEQ ID NO: 661619 - RNA, 19 nt, Homo sapiens
gaacaugccagcaccaaca

SEQ ID NO: 661620 - RNA, 19 nt, Homo sapiens
acacgucguucuaauuaaa

SEQ ID NO: 661621 - RNA, 19 nt, Homo sapiens
cgagauugcuggaaaccaa

SEQ ID NO: 661622 - RNA, 19 nt, Homo sapiens
gaaaagcaguucccugaga

SEQ ID NO: 661623 - RNA, 19 nt, Homo sapiens
gaaggaaaggcagauguaa

SEQ ID NO: 661624 - RNA, 19 nt, Homo sapiens
ggacagcucugggcucagu

SEQ ID NO: 661625 - RNA, 19 nt, Homo sapiens
cugagugcguccucuauua

SEQ ID NO: 661626 - RNA, 19 nt, Homo sapiens
gaaucacgcucggaaacaa

SEQ ID NO: 661627 - RNA, 19 nt, Homo sapiens
ggugguauucugucauuua

SEQ ID NO: 661628 - RNA, 19 nt, Homo sapiens
uggaagagcucgacaagag

SEQ ID NO: 661629 - RNA, 19 nt, Homo sapiens
gaacuucuacuucaacuac

SEQ ID NO: 661630 - RNA, 19 nt, Homo sapiens
gcaaggugcgcgaguacua

SEQ ID NO: 661631 - RNA, 19 nt, Homo sapiens
aggaaggacuuacccagua

SEQ ID NO: 661632 - RNA, 19 nt, Homo sapiens
agcaagagaucaacaagaa

SEQ ID NO: 661633 - RNA, 19 nt, Homo sapiens
gcacaucagugaggucauc

SEQ ID NO: 661634 - RNA, 19 nt, Homo sapiens
cuaagaagaaugagaacua

SEQ ID NO: 661635 - RNA, 19 nt, Homo sapiens
aagcuaaucuuguacuuca

SEQ ID NO: 661636 - RNA, 19 nt, Homo sapiens
ggacagcgccaucacauac

SEQ ID NO: 661637 - RNA, 19 nt, Homo sapiens
agaaaggucuccuggaaca

SEQ ID NO: 661638 - RNA, 19 nt, Homo sapiens
cugaagaccucaccaagga

SEQ ID NO: 661639 - RNA, 19 nt, Homo sapiens
gggcuggaggccauaauua

SEQ ID NO: 661640 - RNA, 19 nt, Homo sapiens
cagcugacguccuguacaa

SEQ ID NO: 661641 - RNA, 19 nt, Homo sapiens
gaaaugaggaggagauggu

SEQ ID NO: 661642 - RNA, 19 nt, Homo sapiens
aggaggagcugauccagaa

SEQ ID NO: 661643 - RNA, 19 nt, Homo sapiens
gaucucugcuuaccguuca

SEQ ID NO: 661644 - RNA, 19 nt, Homo sapiens
agauguaaaugauguguug

SEQ ID NO: 661645 - RNA, 19 nt, Homo sapiens
gggaaaagacucaaaguaa

SEQ ID NO: 661646 - RNA, 19 nt, Homo sapiens
ggcagaaccucgaugagau

SEQ ID NO: 661647 - RNA, 19 nt, Homo sapiens
aaaggcagauguaaaugau

SEQ ID NO: 661648 - RNA, 19 nt, Homo sapiens
gcagagacccagugugcuu

SEQ ID NO: 661649 - RNA, 19 nt, Homo sapiens
gacagcgacuccagugcua

SEQ ID NO: 661650 - RNA, 19 nt, Homo sapiens
ugacuaagaagaaugagaa

SEQ ID NO: 661651 - RNA, 19 nt, Homo sapiens
gacagaagaagaaauggaa

SEQ ID NO: 661652 - RNA, 19 nt, Homo sapiens
guaaaugauguguugguuu

SEQ ID NO: 661653 - RNA, 19 nt, Homo sapiens
ggucuacccuacccucaug

SEQ ID NO: 661654 - RNA, 19 nt, Homo sapiens
acacaggcaugaaggguau

SEQ ID NO: 661655 - RNA, 19 nt, Homo sapiens
gcgcaccuaugacaugaug

SEQ ID NO: 661656 - RNA, 19 nt, Homo sapiens
ggacagaagaagaaaugga

SEQ ID NO: 661657 - RNA, 19 nt, Homo sapiens
caagaacuuuggccugauc

SEQ ID NO: 661658 - RNA, 19 nt, Homo sapiens
gcagaucucuaagcugaag

SEQ ID NO: 661659 - RNA, 19 nt, Homo sapiens
gcaucaaguucaucaacau

SEQ ID NO: 661660 - RNA, 19 nt, Homo sapiens
gcaccacucccgcgacuau

SEQ ID NO: 661661 - RNA, 19 nt, Homo sapiens
gaggguggcaugucuguga

SEQ ID NO: 661662 - RNA, 19 nt, Homo sapiens
ggaaacaauggaagcagaa

SEQ ID NO: 661663 - RNA, 19 nt, Homo sapiens
gcacucauggguaaauaug

SEQ ID NO: 661664 - RNA, 19 nt, Homo sapiens
ggaaacagccaagaaaggu

SEQ ID NO: 661665 - RNA, 19 nt, Homo sapiens
ugucuaaagccuuaacuaa

SEQ ID NO: 661666 - RNA, 19 nt, Homo sapiens
ccaagaagcaagagaucaa

SEQ ID NO: 661667 - RNA, 19 nt, Homo sapiens
guggugguauucugucauu

SEQ ID NO: 661668 - RNA, 19 nt, Homo sapiens
ccaccuacccgcaccugua

SEQ ID NO: 661669 - RNA, 19 nt, Homo sapiens
uuacaugccucugggaaug

SEQ ID NO: 661670 - RNA, 19 nt, Homo sapiens
ggaagucagagauggaguu

SEQ ID NO: 661671 - RNA, 19 nt, Homo sapiens
uccgaggacuggacuguuu

SEQ ID NO: 661672 - RNA, 19 nt, Homo sapiens
ucaaagagcagcaccacau

SEQ ID NO: 661673 - RNA, 19 nt, Homo sapiens
uuacacacgucguucuaau

SEQ ID NO: 661674 - RNA, 19 nt, Homo sapiens
ggugccaucucccaaggaa

SEQ ID NO: 661675 - RNA, 19 nt, Homo sapiens
gaaauggaaacagccaaga

SEQ ID NO: 661676 - RNA, 19 nt, Homo sapiens
auuacuaccugacuaagaa

SEQ ID NO: 661677 - RNA, 19 nt, Homo sapiens
gcaggguggugguauucug

SEQ ID NO: 661678 - RNA, 19 nt, Homo sapiens
agaaagaugagaaggagaa

SEQ ID NO: 661679 - RNA, 19 nt, Homo sapiens
gcaagagccagcagcaaca

SEQ ID NO: 661680 - RNA, 19 nt, Homo sapiens
acggagaucuucaauaugc

SEQ ID NO: 661681 - RNA, 19 nt, Homo sapiens
ugaguggcguggaccugua

SEQ ID NO: 661682 - RNA, 19 nt, Homo sapiens
ggccacgucuuguccuaug

SEQ ID NO: 661683 - RNA, 19 nt, Homo sapiens
gccaggaggagaaagauga

SEQ ID NO: 661684 - RNA, 19 nt, Homo sapiens
caacgagauugcuggaaac

SEQ ID NO: 661685 - RNA, 19 nt, Homo sapiens
gaugagaaggagaaggaaa

SEQ ID NO: 661686 - RNA, 19 nt, Homo sapiens
caacaugaacgggcuuaug

SEQ ID NO: 661687 - RNA, 19 nt, Homo sapiens
gcucauggaggccuuggaa

SEQ ID NO: 661688 - RNA, 19 nt, Homo sapiens
ggaaaggcagauguaaaug

SEQ ID NO: 661689 - RNA, 19 nt, Homo sapiens
agucagagauggaguucau

SEQ ID NO: 661690 - RNA, 19 nt, Homo sapiens
gcaccuaugacaugaugga

SEQ ID NO: 661691 - RNA, 19 nt, Homo sapiens
gcggaagcaucaccaaagg

SEQ ID NO: 661692 - RNA, 19 nt, Homo sapiens
ggaggaagaagaagaaagc

SEQ ID NO: 661693 - RNA, 19 nt, Homo sapiens
gaucugaagaccucaccaa

SEQ ID NO: 661694 - RNA, 19 nt, Homo sapiens
gaagaaugagaacuauaag

SEQ ID NO: 661695 - RNA, 19 nt, Homo sapiens
gaaggacuuacccaguauu

SEQ ID NO: 661696 - RNA, 19 nt, Homo sapiens
aggcagauguaaaugaugu

SEQ ID NO: 661697 - RNA, 19 nt, Homo sapiens
gcuggaggccauaauuaga

SEQ ID NO: 661698 - RNA, 19 nt, Homo sapiens
gaagcaagagaucaacaag

SEQ ID NO: 661699 - RNA, 19 nt, Homo sapiens
cggcagaccaucaucaaug

SEQ ID NO: 661700 - RNA, 19 nt, Homo sapiens
gaacacagauuccagaaca

SEQ ID NO: 661701 - RNA, 19 nt, Homo sapiens
caaggaaacugagagauuu

SEQ ID NO: 661702 - RNA, 19 nt, Homo sapiens
gaacaucgacuuugcagaa

SEQ ID NO: 661703 - RNA, 19 nt, Homo sapiens
cagaagaacugaacguauu

SEQ ID NO: 661704 - RNA, 19 nt, Homo sapiens
gaagagcagugaugguuuc

SEQ ID NO: 661705 - RNA, 19 nt, Homo sapiens
ggagaacacuaaagaaugg

SEQ ID NO: 661706 - RNA, 19 nt, Homo sapiens
aaccacagcuuguuacuuu

SEQ ID NO: 661707 - RNA, 19 nt, Homo sapiens
gaacugagccaccaugagu

SEQ ID NO: 661708 - RNA, 19 nt, Homo sapiens
gcagugaugguuuccaaua

SEQ ID NO: 661709 - RNA, 19 nt, Homo sapiens
uggaguggcugaccaagua

SEQ ID NO: 661710 - RNA, 19 nt, Homo sapiens
gcauagaccugccacucuu

SEQ ID NO: 661711 - RNA, 19 nt, Homo sapiens
gaaacaugaagucaagaua

SEQ ID NO: 661712 - RNA, 19 nt, Homo sapiens
gcucagcaguggauuucua

SEQ ID NO: 661713 - RNA, 19 nt, Homo sapiens
gaacuauucuagagugaag

SEQ ID NO: 661714 - RNA, 19 nt, Homo sapiens
gcugguggcuauucauauu

SEQ ID NO: 661715 - RNA, 19 nt, Homo sapiens
guacacauuuccugcagaa

SEQ ID NO: 661716 - RNA, 19 nt, Homo sapiens
ggagaugaucgaaauauug

SEQ ID NO: 661717 - RNA, 19 nt, Homo sapiens
gagaugaucgaaauauuga

SEQ ID NO: 661718 - RNA, 19 nt, Homo sapiens
gagcagugaugguuuccaa

SEQ ID NO: 661719 - RNA, 19 nt, Homo sapiens
uagaaguccugaaacauga

SEQ ID NO: 661720 - RNA, 19 nt, Homo sapiens
gaacguauuccaugaacga

SEQ ID NO: 661721 - RNA, 19 nt, Homo sapiens
agaagcaucucaacaggaa

SEQ ID NO: 661722 - RNA, 19 nt, Homo sapiens
agacguggcugguggcuau

SEQ ID NO: 661723 - RNA, 19 nt, Homo sapiens
acaaaguucuccugggauu

SEQ ID NO: 661724 - RNA, 19 nt, Homo sapiens
cuaccucucugcagaagaa

SEQ ID NO: 661725 - RNA, 19 nt, Homo sapiens
ucuaggagaugaucgaaau

SEQ ID NO: 661726 - RNA, 19 nt, Homo sapiens
gcagaagaacugaacguau

SEQ ID NO: 661727 - RNA, 19 nt, Homo sapiens
ucaaggaaacugagagauu

SEQ ID NO: 661728 - RNA, 19 nt, Homo sapiens
agaaguauauaccagaguu

SEQ ID NO: 661729 - RNA, 19 nt, Homo sapiens
cagacuagcuacucuugga

SEQ ID NO: 661730 - RNA, 19 nt, Homo sapiens
gcacauucagagccauaua

SEQ ID NO: 661731 - RNA, 19 nt, Homo sapiens
gaaugacacuuuuccagaa

SEQ ID NO: 661732 - RNA, 19 nt, Homo sapiens
ugacaaauaguucgaagga

SEQ ID NO: 661733 - RNA, 19 nt, Homo sapiens
caucgacuuugcagaagaa

SEQ ID NO: 661734 - RNA, 19 nt, Homo sapiens
gcaaucagaagagcaguga

SEQ ID NO: 661735 - RNA, 19 nt, Homo sapiens
caagccgugugaaauaaga

SEQ ID NO: 661736 - RNA, 19 nt, Homo sapiens
gcauccgacucucccauug

SEQ ID NO: 661737 - RNA, 19 nt, Homo sapiens
gaagugggcaaggaauuug

SEQ ID NO: 661738 - RNA, 19 nt, Homo sapiens
cagaaaugcuccaaaagaa

SEQ ID NO: 661739 - RNA, 19 nt, Homo sapiens
gaaacugagagauuugugu

SEQ ID NO: 661740 - RNA, 19 nt, Homo sapiens
gaucaaggaaacugagaga

SEQ ID NO: 661741 - RNA, 19 nt, Homo sapiens
ugagagauuugugucagaa

SEQ ID NO: 661742 - RNA, 19 nt, Homo sapiens
gccaaagaauggugcuuca

SEQ ID NO: 661743 - RNA, 19 nt, Homo sapiens
cagaagagcagugaugguu

SEQ ID NO: 661744 - RNA, 19 nt, Homo sapiens
uugcaacaauucacacuga

SEQ ID NO: 661745 - RNA, 19 nt, Homo sapiens
ccugaaacaugaagucaag

SEQ ID NO: 661746 - RNA, 19 nt, Homo sapiens
gcacacugucccaauucua

SEQ ID NO: 661747 - RNA, 19 nt, Homo sapiens
caggagaacacuaaagaau

SEQ ID NO: 661748 - RNA, 19 nt, Homo sapiens
gacaaauaguucgaaggaa

SEQ ID NO: 661749 - RNA, 19 nt, Homo sapiens
caaagaauggugcuucaag

SEQ ID NO: 661750 - RNA, 19 nt, Homo sapiens
cagugaugguuuccaauau

SEQ ID NO: 661751 - RNA, 19 nt, Homo sapiens
cuagaaguccugaaacaug

SEQ ID NO: 661752 - RNA, 19 nt, Homo sapiens
ggagaccacugaggaaucg

SEQ ID NO: 661753 - RNA, 19 nt, Homo sapiens
uugccgacauuacagauaa

SEQ ID NO: 661754 - RNA, 19 nt, Homo sapiens
ucagagccauauaagugaa

SEQ ID NO: 661755 - RNA, 19 nt, Homo sapiens
ugacucaucucugcuccuu

SEQ ID NO: 661756 - RNA, 19 nt, Homo sapiens
aaacaugaagucaagauag

SEQ ID NO: 661757 - RNA, 19 nt, Homo sapiens
ggauuugaaugacacuuuu

SEQ ID NO: 661758 - RNA, 19 nt, Homo sapiens
cccuuucugugucuaguua

SEQ ID NO: 661759 - RNA, 19 nt, Homo sapiens
caaaguucuccugggauua

SEQ ID NO: 661760 - RNA, 19 nt, Homo sapiens
ugaagugggcaaggaauuu

SEQ ID NO: 661761 - RNA, 19 nt, Homo sapiens
agauagggcuggguacaga

SEQ ID NO: 661762 - RNA, 19 nt, Homo sapiens
aggagaugaucgaaauauu

SEQ ID NO: 661763 - RNA, 19 nt, Homo sapiens
caaggagaccacugaggaa

SEQ ID NO: 661764 - RNA, 19 nt, Homo sapiens
gugcccagguggaguuaga

SEQ ID NO: 661765 - RNA, 19 nt, Homo sapiens
cacacugucccaauucuaa

SEQ ID NO: 661766 - RNA, 19 nt, Homo sapiens
gaaguauauaccagaguug

SEQ ID NO: 661767 - RNA, 19 nt, Homo sapiens
gcagaagaaguauauacca

SEQ ID NO: 661768 - RNA, 19 nt, Homo sapiens
cagaaguuccucuaucuag

SEQ ID NO: 661769 - RNA, 19 nt, Homo sapiens
ccagaaguuccucuaucua

SEQ ID NO: 661770 - RNA, 19 nt, Homo sapiens
gagccaccaugaguucuuc

SEQ ID NO: 661771 - RNA, 19 nt, Homo sapiens
cacauucagagccauauaa

SEQ ID NO: 661772 - RNA, 19 nt, Homo sapiens
agagugaagcccauaguga

SEQ ID NO: 661773 - RNA, 19 nt, Homo sapiens
gagaacugagccaccauga

SEQ ID NO: 661774 - RNA, 19 nt, Homo sapiens
guauauaccagaguuguca

SEQ ID NO: 661775 - RNA, 19 nt, Homo sapiens
gucaggagaacacuaaaga

SEQ ID NO: 661776 - RNA, 19 nt, Homo sapiens
caaauaguucgaaggaagu

SEQ ID NO: 661777 - RNA, 19 nt, Homo sapiens
ugucagaaaugcuccaaaa

SEQ ID NO: 661778 - RNA, 19 nt, Homo sapiens
guugucaggagaacacuaa

SEQ ID NO: 661779 - RNA, 19 nt, Homo sapiens
gagcgacagcggcaaaaua

SEQ ID NO: 661780 - RNA, 19 nt, Homo sapiens
gcugaccaaguacacauuu

SEQ ID NO: 661781 - RNA, 19 nt, Homo sapiens
gaugaucgaaauauugaag

SEQ ID NO: 661782 - RNA, 19 nt, Homo sapiens
agaagaagcaucucaacag

SEQ ID NO: 661783 - RNA, 19 nt, Homo sapiens
ugacaaauaagacagugau

SEQ ID NO: 661784 - RNA, 19 nt, Homo sapiens
ugaaguugaagcugugaaa

SEQ ID NO: 661785 - RNA, 19 nt, Homo sapiens
cgaaauauugaagagguuu

SEQ ID NO: 661786 - RNA, 19 nt, Homo sapiens
ggugagauuggaaacuuug

SEQ ID NO: 661787 - RNA, 19 nt, Homo sapiens
ugaaaaucgugaugaaguu

SEQ ID NO: 661788 - RNA, 19 nt, Homo sapiens
ggugaacugggcaacauug

SEQ ID NO: 661789 - RNA, 19 nt, Homo sapiens
ccacugaggaaucgaucaa

SEQ ID NO: 661790 - RNA, 19 nt, Homo sapiens
ugacuaucccuuucugugu

SEQ ID NO: 661791 - RNA, 19 nt, Homo sapiens
cuauucauauuccaugcuu

SEQ ID NO: 661792 - RNA, 19 nt, Homo sapiens
aaaucgugaugaaguugaa

SEQ ID NO: 661793 - RNA, 19 nt, Homo sapiens
auucagagccauauaagug

SEQ ID NO: 661794 - RNA, 19 nt, Homo sapiens
ugaggaaucgaucaaggaa

SEQ ID NO: 661795 - RNA, 19 nt, Homo sapiens
cauccaugccucucaguau

SEQ ID NO: 661796 - RNA, 19 nt, Homo sapiens
ccucgggcgucuacaaagu

SEQ ID NO: 661797 - RNA, 19 nt, Homo sapiens
uccagaaguuccucuaucu

SEQ ID NO: 661798 - RNA, 19 nt, Homo sapiens
cugaggcuguuauccagaa

SEQ ID NO: 661799 - RNA, 19 nt, Homo sapiens
gagauuggaaacuuugaag

SEQ ID NO: 661800 - RNA, 19 nt, Homo sapiens
ggaaagagcuccaaauuga

SEQ ID NO: 661801 - RNA, 19 nt, Homo sapiens
gaaauucucugugauuaag

SEQ ID NO: 661802 - RNA, 19 nt, Homo sapiens
gcuuaugguugaucaguua

SEQ ID NO: 661803 - RNA, 19 nt, Homo sapiens
ccaaagaaucggcaaauga

SEQ ID NO: 661804 - RNA, 19 nt, Homo sapiens
ccaaauugaaucaccuuua

SEQ ID NO: 661805 - RNA, 19 nt, Homo sapiens
gaaagagcuccaaauugaa

SEQ ID NO: 661806 - RNA, 19 nt, Homo sapiens
uacaaaggcuagaacacua

SEQ ID NO: 661807 - RNA, 19 nt, Homo sapiens
caaaugagagugguuagaa

SEQ ID NO: 661808 - RNA, 19 nt, Homo sapiens
ggaagcaguuucagagaac

SEQ ID NO: 661809 - RNA, 19 nt, Homo sapiens
caucaaagccuugguuuag

SEQ ID NO: 661810 - RNA, 19 nt, Homo sapiens
guaauccagugcccuacaa

SEQ ID NO: 661811 - RNA, 19 nt, Homo sapiens
cagcuuagaagugcuauaa

SEQ ID NO: 661812 - RNA, 19 nt, Homo sapiens
gcuuagaagugcuauaaaa

SEQ ID NO: 661813 - RNA, 19 nt, Homo sapiens
ggugauggaugccugucuu

SEQ ID NO: 661814 - RNA, 19 nt, Homo sapiens
caaagaaucggcaaaugag

SEQ ID NO: 661815 - RNA, 19 nt, Homo sapiens
uggaagcaguuucagagaa

SEQ ID NO: 661816 - RNA, 19 nt, Homo sapiens
aaggaaagagcuccaaauu

SEQ ID NO: 661817 - RNA, 19 nt, Homo sapiens
ucaaagccuugguuuagca

SEQ ID NO: 661818 - RNA, 19 nt, Homo sapiens
ucaaauaggagccgaugga

SEQ ID NO: 661819 - RNA, 19 nt, Homo sapiens
ucagagcccugguggaucu

SEQ ID NO: 661820 - RNA, 19 nt, Homo sapiens
gauggaugccugucuuaga

SEQ ID NO: 661821 - RNA, 19 nt, Homo sapiens
gcaaaugagagugguuaga

SEQ ID NO: 661822 - RNA, 19 nt, Homo sapiens
ggaugccugucuuagaugu

SEQ ID NO: 661823 - RNA, 19 nt, Homo sapiens
aagccuugguuuagcauuu

SEQ ID NO: 661824 - RNA, 19 nt, Homo sapiens
aaagagcuccaaauugaau

SEQ ID NO: 661825 - RNA, 19 nt, Homo sapiens
ccugguggaucuuguaauc

SEQ ID NO: 661826 - RNA, 19 nt, Homo sapiens
gcaugucccugugggugaa

SEQ ID NO: 661827 - RNA, 19 nt, Homo sapiens
aagauguucucccucaaga

SEQ ID NO: 661828 - RNA, 19 nt, Homo sapiens
aacaaucgcugcccucucu

SEQ ID NO: 661829 - RNA, 19 nt, Homo sapiens
ucaucaaagccuugguuua

SEQ ID NO: 661830 - RNA, 19 nt, Homo sapiens
cgauggaucugugguccuu

SEQ ID NO: 661831 - RNA, 19 nt, Homo sapiens
gcaugcuuaugguugauca

SEQ ID NO: 661832 - RNA, 19 nt, Homo sapiens
ucucugugauuaagaagau

SEQ ID NO: 661833 - RNA, 19 nt, Homo sapiens
aauaggagccgauggaucu

SEQ ID NO: 661834 - RNA, 19 nt, Homo sapiens
cggcaaaugagagugguua

SEQ ID NO: 661835 - RNA, 19 nt, Homo sapiens
guaaucauuccuuccacaa

SEQ ID NO: 661836 - RNA, 19 nt, Homo sapiens
guucagagcccugguggau

SEQ ID NO: 661837 - RNA, 19 nt, Homo sapiens
ucuuagaugucaagcugaa

SEQ ID NO: 661838 - RNA, 19 nt, Homo sapiens
aggaaagagcuccaaauug

SEQ ID NO: 661839 - RNA, 19 nt, Homo sapiens
gugauggaugccugucuua

SEQ ID NO: 661840 - RNA, 19 nt, Homo sapiens
aaacaaacaagaggacugu

SEQ ID NO: 661841 - RNA, 19 nt, Homo sapiens
cuaccucuguggugugugu

SEQ ID NO: 661842 - RNA, 19 nt, Homo sapiens
aaaugagagugguuagaag

SEQ ID NO: 661843 - RNA, 19 nt, Homo sapiens
aaaggaaagagcuccaaau

SEQ ID NO: 661844 - RNA, 19 nt, Homo sapiens
aaucauuccuuccacaacu

SEQ ID NO: 661845 - RNA, 19 nt, Homo sapiens
caagauguucucccucaag

SEQ ID NO: 661846 - RNA, 19 nt, Homo sapiens
uuccacaacugcugcaugu

SEQ ID NO: 661847 - RNA, 19 nt, Homo sapiens
cguggaagacggagaggaa

SEQ ID NO: 661848 - RNA, 19 nt, Homo sapiens
auggaugccugucuuagau

SEQ ID NO: 661849 - RNA, 19 nt, Homo sapiens
uccaaagaaucggcaaaug

SEQ ID NO: 661850 - RNA, 19 nt, Homo sapiens
cuacaaaggcuagaacacu

SEQ ID NO: 661851 - RNA, 19 nt, Homo sapiens
acaaacaagaggacugugu

SEQ ID NO: 661852 - RNA, 19 nt, Homo sapiens
caaauaggagccgauggau

SEQ ID NO: 661853 - RNA, 19 nt, Homo sapiens
gagcccugguggaucuugu

SEQ ID NO: 661854 - RNA, 19 nt, Homo sapiens
acaagauguucucccucaa

SEQ ID NO: 661855 - RNA, 19 nt, Homo sapiens
acacagcuuagaagugcua

SEQ ID NO: 661856 - RNA, 19 nt, Homo sapiens
gcgcacacagcuuagaagu

SEQ ID NO: 661857 - RNA, 19 nt, Homo sapiens
caagaaagaucacagauaa

SEQ ID NO: 661858 - RNA, 19 nt, Homo sapiens
gaauuaggaucaaugugua

SEQ ID NO: 661859 - RNA, 19 nt, Homo sapiens
aaagagagcuaacguguau

SEQ ID NO: 661860 - RNA, 19 nt, Homo sapiens
gaagaaaggcaaaccauug

SEQ ID NO: 661861 - RNA, 19 nt, Homo sapiens
gagcuaacguguauucuuc

SEQ ID NO: 661862 - RNA, 19 nt, Homo sapiens
uauaaacacuggcaauuug

SEQ ID NO: 661863 - RNA, 19 nt, Homo sapiens
ggaacgaugucgguuauug

SEQ ID NO: 661864 - RNA, 19 nt, Homo sapiens
gagggcagcauguuaauaa

SEQ ID NO: 661865 - RNA, 19 nt, Homo sapiens
gaaauggaccuauaucaag

SEQ ID NO: 661866 - RNA, 19 nt, Homo sapiens
aagaugcucuggaaucaua

SEQ ID NO: 661867 - RNA, 19 nt, Homo sapiens
gcuccauucucaucaauuu

SEQ ID NO: 661868 - RNA, 19 nt, Homo sapiens
gaacaagagcccagucaga

SEQ ID NO: 661869 - RNA, 19 nt, Homo sapiens
ccacagggcuaguaguaga

SEQ ID NO: 661870 - RNA, 19 nt, Homo sapiens
ugacaucugccaacaauuu

SEQ ID NO: 661871 - RNA, 19 nt, Homo sapiens
agacauccaucucuuaaug

SEQ ID NO: 661872 - RNA, 19 nt, Homo sapiens
gagcgaauucggacauaua

SEQ ID NO: 661873 - RNA, 19 nt, Homo sapiens
gcaggagggcagcauguua

SEQ ID NO: 661874 - RNA, 19 nt, Homo sapiens
caggauagcauaugaaguu

SEQ ID NO: 661875 - RNA, 19 nt, Homo sapiens
ggugacaucugccaacaau

SEQ ID NO: 661876 - RNA, 19 nt, Homo sapiens
cagaugagguggaugugaa

SEQ ID NO: 661877 - RNA, 19 nt, Homo sapiens
cgagaaauauuugacaugu

SEQ ID NO: 661878 - RNA, 19 nt, Homo sapiens
cagaaggcaugcugaguug

SEQ ID NO: 661879 - RNA, 19 nt, Homo sapiens
gacugaagcuuggaaauca

SEQ ID NO: 661880 - RNA, 19 nt, Homo sapiens
gcauaugaaguucgugaua

SEQ ID NO: 661881 - RNA, 19 nt, Homo sapiens
ggaagaaaggcaaaccauu

SEQ ID NO: 661882 - RNA, 19 nt, Homo sapiens
ucauaaagcacuacagaaa

SEQ ID NO: 661883 - RNA, 19 nt, Homo sapiens
gaacuugcacuggaagaaa

SEQ ID NO: 661884 - RNA, 19 nt, Homo sapiens
ggaugaacaccuuaaauca

SEQ ID NO: 661885 - RNA, 19 nt, Homo sapiens
ccaagaugcucuggaauca

SEQ ID NO: 661886 - RNA, 19 nt, Homo sapiens
aaauggaccuauaucaaga

SEQ ID NO: 661887 - RNA, 19 nt, Homo sapiens
ucaaucagcagaugaagaa

SEQ ID NO: 661888 - RNA, 19 nt, Homo sapiens
gcaacaaagugcuagaaaa

SEQ ID NO: 661889 - RNA, 19 nt, Homo sapiens
gacacaaggcugcaaguuu

SEQ ID NO: 661890 - RNA, 19 nt, Homo sapiens
acaccaagaugcucuggaa

SEQ ID NO: 661891 - RNA, 19 nt, Homo sapiens
guagaaugccaacaagaaa

SEQ ID NO: 661892 - RNA, 19 nt, Homo sapiens
ugagguggaugugaaauug

SEQ ID NO: 661893 - RNA, 19 nt, Homo sapiens
gaagaauuaggaucaaugu

SEQ ID NO: 661894 - RNA, 19 nt, Homo sapiens
caggagauauugccuucaa

SEQ ID NO: 661895 - RNA, 19 nt, Homo sapiens
acaagaaagaucacagaua

SEQ ID NO: 661896 - RNA, 19 nt, Homo sapiens
caacaagaaagaucacaga

SEQ ID NO: 661897 - RNA, 19 nt, Homo sapiens
caggaacgaugucgguuau

SEQ ID NO: 661898 - RNA, 19 nt, Homo sapiens
cuucaucuguuaaguaaga

SEQ ID NO: 661899 - RNA, 19 nt, Homo sapiens
gaacaagcaauugaagaau

SEQ ID NO: 661900 - RNA, 19 nt, Homo sapiens
acacaaggcugcaaguuuu

SEQ ID NO: 661901 - RNA, 19 nt, Homo sapiens
ugaaauggaccuauaucaa

SEQ ID NO: 661902 - RNA, 19 nt, Homo sapiens
gauagugccgucagacuug

SEQ ID NO: 661903 - RNA, 19 nt, Homo sapiens
gacaucugccaacaauuua

SEQ ID NO: 661904 - RNA, 19 nt, Homo sapiens
gagcaaugucugcagcaua

SEQ ID NO: 661905 - RNA, 19 nt, Homo sapiens
ggagauauugccuucaaga

SEQ ID NO: 661906 - RNA, 19 nt, Homo sapiens
ucucaucaauuuagacaga

SEQ ID NO: 661907 - RNA, 19 nt, Homo sapiens
caaaggagaaauaugacaa

SEQ ID NO: 661908 - RNA, 19 nt, Homo sapiens
gcucuggaaucauaaagca

SEQ ID NO: 661909 - RNA, 19 nt, Homo sapiens
uaaagagagcuaacgugua

SEQ ID NO: 661910 - RNA, 19 nt, Homo sapiens
ugaagaagccauugcugaa

SEQ ID NO: 661911 - RNA, 19 nt, Homo sapiens
gggccuggaucagcuaauu

SEQ ID NO: 661912 - RNA, 19 nt, Homo sapiens
gaacgaugucgguuauugu

SEQ ID NO: 661913 - RNA, 19 nt, Homo sapiens
gaaaggcaaaccauugauc

SEQ ID NO: 661914 - RNA, 19 nt, Homo sapiens
ugaacaagcaauugaagaa

SEQ ID NO: 661915 - RNA, 19 nt, Homo sapiens
ccaaacacuugagcaaugu

SEQ ID NO: 661916 - RNA, 19 nt, Homo sapiens
gaugaaucgucaccugugu

SEQ ID NO: 661917 - RNA, 19 nt, Homo sapiens
gaaagacaagcgucagcaa

SEQ ID NO: 661918 - RNA, 19 nt, Homo sapiens
ccaaggauuugcgaauaga

SEQ ID NO: 661919 - RNA, 19 nt, Homo sapiens
gaaaagcaguuacuagaac

SEQ ID NO: 661920 - RNA, 19 nt, Homo sapiens
guuccgaccucaguaaaga

SEQ ID NO: 661921 - RNA, 19 nt, Homo sapiens
guaguagaaugccaacaag

SEQ ID NO: 661922 - RNA, 19 nt, Homo sapiens
uuucuuagaugcugagaug

SEQ ID NO: 661923 - RNA, 19 nt, Homo sapiens
gcuauaaacacuggcaauu

SEQ ID NO: 661924 - RNA, 19 nt, Homo sapiens
ccaagaaacucaggagacu

SEQ ID NO: 661925 - RNA, 19 nt, Homo sapiens
gcagccauuuaccaagaaa

SEQ ID NO: 661926 - RNA, 19 nt, Homo sapiens
agaaauauauggagaaccu

SEQ ID NO: 661927 - RNA, 19 nt, Homo sapiens
gauagcauaugaaguucgu

SEQ ID NO: 661928 - RNA, 19 nt, Homo sapiens
ggagggcagcauguuaaua

SEQ ID NO: 661929 - RNA, 19 nt, Homo sapiens
caggagggcagcauguuaa

SEQ ID NO: 661930 - RNA, 19 nt, Homo sapiens
gcaauuugaaccucugaau

SEQ ID NO: 661931 - RNA, 19 nt, Homo sapiens
cagcauaucccugugaaug

SEQ ID NO: 661932 - RNA, 19 nt, Homo sapiens
aaucgucaccuguguguuu

SEQ ID NO: 661933 - RNA, 19 nt, Homo sapiens
gaaguaugagggugggauu

SEQ ID NO: 661934 - RNA, 19 nt, Homo sapiens
uauuugacauguaccagaa

SEQ ID NO: 661935 - RNA, 19 nt, Homo sapiens
ccaacaauuuacccgagaa

SEQ ID NO: 661936 - RNA, 19 nt, Homo sapiens
cuauaaacacuggcaauuu

SEQ ID NO: 661937 - RNA, 19 nt, Homo sapiens
uugcauucuucaucuguua

SEQ ID NO: 661938 - RNA, 19 nt, Homo sapiens
ugccaaaggagaaauauga

SEQ ID NO: 661939 - RNA, 19 nt, Homo sapiens
agaauuaggaucaaugugu

SEQ ID NO: 661940 - RNA, 19 nt, Homo sapiens
agcaaugucugcagcauau

SEQ ID NO: 661941 - RNA, 19 nt, Homo sapiens
guaccaaacacuugagcaa

SEQ ID NO: 661942 - RNA, 19 nt, Homo sapiens
cauaaagcacuacagaaau

SEQ ID NO: 661943 - RNA, 19 nt, Homo sapiens
gcuaacguguauucuucuu

SEQ ID NO: 661944 - RNA, 19 nt, Homo sapiens
cagagcgaauucggacaua

SEQ ID NO: 661945 - RNA, 19 nt, Homo sapiens
agacugaacaagcaauuga

SEQ ID NO: 661946 - RNA, 19 nt, Homo sapiens
ggagacugaacaagcaauu

SEQ ID NO: 661947 - RNA, 19 nt, Homo sapiens
uggagaaccugaguaagga

SEQ ID NO: 661948 - RNA, 19 nt, Homo sapiens
uauaauuucacccaggaua

SEQ ID NO: 661949 - RNA, 19 nt, Homo sapiens
gaggugacaucugccaaca

SEQ ID NO: 661950 - RNA, 19 nt, Homo sapiens
caauuuagacagauacauc

SEQ ID NO: 661951 - RNA, 19 nt, Homo sapiens
gacaagcgucagcaacaaa

SEQ ID NO: 661952 - RNA, 19 nt, Homo sapiens
agacaagcgucagcaacaa

SEQ ID NO: 661953 - RNA, 19 nt, Homo sapiens
cgucagacuuguccacauc

SEQ ID NO: 661954 - RNA, 19 nt, Homo sapiens
accaaacacuugagcaaug

SEQ ID NO: 661955 - RNA, 19 nt, Homo sapiens
uuagacauccaucucuuaa

SEQ ID NO: 661956 - RNA, 19 nt, Homo sapiens
caacaauuuacccgagaaa

SEQ ID NO: 661957 - RNA, 19 nt, Homo sapiens
gcacacaccucucacugua

SEQ ID NO: 661958 - RNA, 19 nt, Homo sapiens
gaaacuaugugcgggauga

SEQ ID NO: 661959 - RNA, 19 nt, Homo sapiens
gacccaaacuggaagaauu

SEQ ID NO: 661960 - RNA, 19 nt, Homo sapiens
cuaaggaguucgucuuuga

SEQ ID NO: 661961 - RNA, 19 nt, Homo sapiens
gagagugucuacugugaga

SEQ ID NO: 661962 - RNA, 19 nt, Homo sapiens
gagaaaggguaguucaaag

SEQ ID NO: 661963 - RNA, 19 nt, Homo sapiens
ggagaaaggguaguucaaa

SEQ ID NO: 661964 - RNA, 19 nt, Homo sapiens
gcacucagcccugcaccua

SEQ ID NO: 661965 - RNA, 19 nt, Homo sapiens
gggccugucucccuucuug

SEQ ID NO: 661966 - RNA, 19 nt, Homo sapiens
ggagcuggaaguacaagua

SEQ ID NO: 661967 - RNA, 19 nt, Homo sapiens
ugaucuaccugcacacuug

SEQ ID NO: 661968 - RNA, 19 nt, Homo sapiens
gcacuaaggaguucgucuu

SEQ ID NO: 661969 - RNA, 19 nt, Homo sapiens
ggccaccguuucugcgaua

SEQ ID NO: 661970 - RNA, 19 nt, Homo sapiens
gaaaggguaguucaaagag

SEQ ID NO: 661971 - RNA, 19 nt, Homo sapiens
ccacagcacgucacugaga

SEQ ID NO: 661972 - RNA, 19 nt, Homo sapiens
gcuggaaguacaaguauug

SEQ ID NO: 661973 - RNA, 19 nt, Homo sapiens
ccaggagagugucuacugu

SEQ ID NO: 661974 - RNA, 19 nt, Homo sapiens
ggcacuggcugaacuugga

SEQ ID NO: 661975 - RNA, 19 nt, Homo sapiens
cauccgugcugcuguugaa

SEQ ID NO: 661976 - RNA, 19 nt, Homo sapiens
gaagauuggcagcuaugga

SEQ ID NO: 661977 - RNA, 19 nt, Homo sapiens
gagcuggaaguacaaguau

SEQ ID NO: 661978 - RNA, 19 nt, Homo sapiens
gucauucccugcccuaauc

SEQ ID NO: 661979 - RNA, 19 nt, Homo sapiens
ccuaaucgcugccccauga

SEQ ID NO: 661980 - RNA, 19 nt, Homo sapiens
acacaccucucacuguaca

SEQ ID NO: 661981 - RNA, 19 nt, Homo sapiens
agaaaggguaguucaaaga

SEQ ID NO: 661982 - RNA, 19 nt, Homo sapiens
caggugcuaugucccaaga

SEQ ID NO: 661983 - RNA, 19 nt, Homo sapiens
gcgggaugaugcagucuuc

SEQ ID NO: 661984 - RNA, 19 nt, Homo sapiens
ccucaggugccuccaauug

SEQ ID NO: 661985 - RNA, 19 nt, Homo sapiens
ccagccuucuacacacaua

SEQ ID NO: 661986 - RNA, 19 nt, Homo sapiens
ggagggagaaaggguaguu

SEQ ID NO: 661987 - RNA, 19 nt, Homo sapiens
gcaccuacugcacuaagga

SEQ ID NO: 661988 - RNA, 19 nt, Homo sapiens
aggagagugucuacuguga

SEQ ID NO: 661989 - RNA, 19 nt, Homo sapiens
augaagggcuggaaacaag

SEQ ID NO: 661990 - RNA, 19 nt, Homo sapiens
ggucaugaagggcuggaaa

SEQ ID NO: 661991 - RNA, 19 nt, Homo sapiens
ucaggugccuccaauuggu

SEQ ID NO: 661992 - RNA, 19 nt, Homo sapiens
ucuggaagauuggcagcua

SEQ ID NO: 661993 - RNA, 19 nt, Homo sapiens
cuacugcacuaaggaguuc

SEQ ID NO: 661994 - RNA, 19 nt, Homo sapiens
gaagggcuggaaacaagug

SEQ ID NO: 661995 - RNA, 19 nt, Homo sapiens
gagucugucuugagaucug

SEQ ID NO: 661996 - RNA, 19 nt, Homo sapiens
gggagaaaggguaguucaa

SEQ ID NO: 661997 - RNA, 19 nt, Homo sapiens
acuacaaguuccuggagaa

SEQ ID NO: 661998 - RNA, 19 nt, Homo sapiens
ucucugggcuuugguuauc

SEQ ID NO: 661999 - RNA, 19 nt, Homo sapiens
gaauaccugcagcuucaau

SEQ ID NO: 662000 - RNA, 19 nt, Homo sapiens
aaccacagcacgucacuga

SEQ ID NO: 662001 - RNA, 19 nt, Homo sapiens
gcccagccuucuacacaca

SEQ ID NO: 662002 - RNA, 19 nt, Homo sapiens
aaaggguaguucaaagagu

SEQ ID NO: 662003 - RNA, 19 nt, Homo sapiens
gaacaggucuuggggucau

SEQ ID NO: 662004 - RNA, 19 nt, Homo sapiens
ggacuaugccaagaucuac

SEQ ID NO: 662005 - RNA, 19 nt, Homo sapiens
cuucauccgugcugcuguu

SEQ ID NO: 662006 - RNA, 19 nt, Homo sapiens
ugugcugccuggugccuuu

SEQ ID NO: 662007 - RNA, 19 nt, Homo sapiens
ugagagccaugaggguaug

SEQ ID NO: 662008 - RNA, 19 nt, Homo sapiens
acccggagcuggaaguaca

SEQ ID NO: 662009 - RNA, 19 nt, Homo sapiens
cacuaaggaguucgucuuu

SEQ ID NO: 662010 - RNA, 19 nt, Homo sapiens
gccacuacgucaucuacag

SEQ ID NO: 662011 - RNA, 19 nt, Homo sapiens
cagcccagccuucuacaca

SEQ ID NO: 662012 - RNA, 19 nt, Homo sapiens
ccucuggacuaugccaaga

SEQ ID NO: 662013 - RNA, 19 nt, Homo sapiens
caucugaaggacagcugua

SEQ ID NO: 662014 - RNA, 19 nt, Homo sapiens
gagugucuacugugagaau

SEQ ID NO: 662015 - RNA, 19 nt, Homo sapiens
gcgccucaagugcgaguuu

SEQ ID NO: 662016 - RNA, 19 nt, Homo sapiens
caugaagggcuggaaacaa

SEQ ID NO: 662017 - RNA, 19 nt, Homo sapiens
acccaaacuggaagaauuu

SEQ ID NO: 662018 - RNA, 19 nt, Homo sapiens
cuucuacacacauaaguau

SEQ ID NO: 662019 - RNA, 19 nt, Homo sapiens
cuggugcucugcccauuca

SEQ ID NO: 662020 - RNA, 19 nt, Homo sapiens
acuaaggaguucgucuuug

SEQ ID NO: 662021 - RNA, 19 nt, Homo sapiens
uggcuucgacuacaaguuc

SEQ ID NO: 662022 - RNA, 19 nt, Homo sapiens
cagcaugccaccucugagu

SEQ ID NO: 662023 - RNA, 19 nt, Homo sapiens
guucucugggcuuugguua

SEQ ID NO: 662024 - RNA, 19 nt, Homo sapiens
ggugcucugcccauucaaa

SEQ ID NO: 662025 - RNA, 19 nt, Homo sapiens
gaaacuaugugcgggauga

SEQ ID NO: 662026 - RNA, 19 nt, Homo sapiens
gagaaaggguaguucaaag

SEQ ID NO: 662027 - RNA, 19 nt, Homo sapiens
ggagaaaggguaguucaaa

SEQ ID NO: 662028 - RNA, 19 nt, Homo sapiens
gggccugucucccuucuug

SEQ ID NO: 662029 - RNA, 19 nt, Homo sapiens
ggagcuggaaguacaagua

SEQ ID NO: 662030 - RNA, 19 nt, Homo sapiens
ugaucuaccugcacacuug

SEQ ID NO: 662031 - RNA, 19 nt, Homo sapiens
ggccaccguuucugcgaua

SEQ ID NO: 662032 - RNA, 19 nt, Homo sapiens
gaaaggguaguucaaagag

SEQ ID NO: 662033 - RNA, 19 nt, Homo sapiens
gcuggaaguacaaguauug

SEQ ID NO: 662034 - RNA, 19 nt, Homo sapiens
ggcacuggcugaacuugga

SEQ ID NO: 662035 - RNA, 19 nt, Homo sapiens
cauccgugcugcuguugaa

SEQ ID NO: 662036 - RNA, 19 nt, Homo sapiens
gagcuggaaguacaaguau

SEQ ID NO: 662037 - RNA, 19 nt, Homo sapiens
gucauucccugcccuaauc

SEQ ID NO: 662038 - RNA, 19 nt, Homo sapiens
ccuaaucgcugccccauga

SEQ ID NO: 662039 - RNA, 19 nt, Homo sapiens
agaaaggguaguucaaaga

SEQ ID NO: 662040 - RNA, 19 nt, Homo sapiens
caggugcuaugucccaaga

SEQ ID NO: 662041 - RNA, 19 nt, Homo sapiens
gcgggaugaugcagucuuc

SEQ ID NO: 662042 - RNA, 19 nt, Homo sapiens
ccucaggugccuccaauug

SEQ ID NO: 662043 - RNA, 19 nt, Homo sapiens
ggagggagaaaggguaguu

SEQ ID NO: 662044 - RNA, 19 nt, Homo sapiens
augaagggcuggaaacaag

SEQ ID NO: 662045 - RNA, 19 nt, Homo sapiens
ggucaugaagggcuggaaa

SEQ ID NO: 662046 - RNA, 19 nt, Homo sapiens
ucaggugccuccaauuggu

SEQ ID NO: 662047 - RNA, 19 nt, Homo sapiens
gaagggcuggaaacaagug

SEQ ID NO: 662048 - RNA, 19 nt, Homo sapiens
gagucugucuugagaucug

SEQ ID NO: 662049 - RNA, 19 nt, Homo sapiens
gggagaaaggguaguucaa

SEQ ID NO: 662050 - RNA, 19 nt, Homo sapiens
acuacaaguuccuggagaa

SEQ ID NO: 662051 - RNA, 19 nt, Homo sapiens
ucucugggcuuugguuauc

SEQ ID NO: 662052 - RNA, 19 nt, Homo sapiens
uaugagagccaugagaguu

SEQ ID NO: 662053 - RNA, 19 nt, Homo sapiens
gaauaccugcagcuucaau

SEQ ID NO: 662054 - RNA, 19 nt, Homo sapiens
aaaggguaguucaaagagu

SEQ ID NO: 662055 - RNA, 19 nt, Homo sapiens
gaacaggucuuggggucau

SEQ ID NO: 662056 - RNA, 19 nt, Homo sapiens
ggacuaugccaagaucuac

SEQ ID NO: 662057 - RNA, 19 nt, Homo sapiens
cuucauccgugcugcuguu

SEQ ID NO: 662058 - RNA, 19 nt, Homo sapiens
acccggagcuggaaguaca

SEQ ID NO: 662059 - RNA, 19 nt, Homo sapiens
ccucuggacuaugccaaga

SEQ ID NO: 662060 - RNA, 19 nt, Homo sapiens
gcgccucaagugcgaguuu

SEQ ID NO: 662061 - RNA, 19 nt, Homo sapiens
gccacuacgucaucuacag

SEQ ID NO: 662062 - RNA, 19 nt, Homo sapiens
caugaagggcuggaaacaa

SEQ ID NO: 662063 - RNA, 19 nt, Homo sapiens
uggcuucgacuacaaguuc

SEQ ID NO: 662064 - RNA, 19 nt, Homo sapiens
guucucugggcuuugguua

SEQ ID NO: 662065 - RNA, 19 nt, Homo sapiens
gaacaacccuccagucaug

SEQ ID NO: 662066 - RNA, 19 nt, Homo sapiens
gggaagaucugcacuguga

SEQ ID NO: 662067 - RNA, 19 nt, Homo sapiens
gaagggaaauggucaagga

SEQ ID NO: 662068 - RNA, 19 nt, Homo sapiens
gcaaucuugugccauauuu

SEQ ID NO: 662069 - RNA, 19 nt, Homo sapiens
ucacccagcuggucucaua

SEQ ID NO: 662070 - RNA, 19 nt, Homo sapiens
caacacagcuggugaugag

SEQ ID NO: 662071 - RNA, 19 nt, Homo sapiens
ggaaaagucugcaaucuug

SEQ ID NO: 662072 - RNA, 19 nt, Homo sapiens
ccaggaaacaggaagauua

SEQ ID NO: 662073 - RNA, 19 nt, Homo sapiens
ucagggaccuuuccuauuc

SEQ ID NO: 662074 - RNA, 19 nt, Homo sapiens
gggcagcugugaacauuga

SEQ ID NO: 662075 - RNA, 19 nt, Homo sapiens
agacagcacuugugaagga

SEQ ID NO: 662076 - RNA, 19 nt, Homo sapiens
gggaacaccugaacuacug

SEQ ID NO: 662077 - RNA, 19 nt, Homo sapiens
gagggcagcugugaacauu

SEQ ID NO: 662078 - RNA, 19 nt, Homo sapiens
ucacauacuuuguuuagag

SEQ ID NO: 662079 - RNA, 19 nt, Homo sapiens
ggaaauggucaaggagaua

SEQ ID NO: 662080 - RNA, 19 nt, Homo sapiens
agacggaccugcugaaugg

SEQ ID NO: 662081 - RNA, 19 nt, Homo sapiens
cagcuggucucauacauag

SEQ ID NO: 662082 - RNA, 19 nt, Homo sapiens
guaggcagauuggugguuu

SEQ ID NO: 662083 - RNA, 19 nt, Homo sapiens
gaugaaggcagaagggaaa

SEQ ID NO: 662084 - RNA, 19 nt, Homo sapiens
caggguaaaucacauacuu

SEQ ID NO: 662085 - RNA, 19 nt, Homo sapiens
gaagguguccugcuacauc

SEQ ID NO: 662086 - RNA, 19 nt, Homo sapiens
guaccuggacuucaucgua

SEQ ID NO: 662087 - RNA, 19 nt, Homo sapiens
cagguggucucgcugauga

SEQ ID NO: 662088 - RNA, 19 nt, Homo sapiens
gacgugcccuuucagauca

SEQ ID NO: 662089 - RNA, 19 nt, Homo sapiens
gcgcugggcuugcugucuu

SEQ ID NO: 662090 - RNA, 19 nt, Homo sapiens
ggaaguccacgcugaugaa

SEQ ID NO: 662091 - RNA, 19 nt, Homo sapiens
gggaagacguggacaccau

SEQ ID NO: 662092 - RNA, 19 nt, Homo sapiens
gaaacaggaagauuagaca

SEQ ID NO: 662093 - RNA, 19 nt, Homo sapiens
ucugcaaucuugugccaua

SEQ ID NO: 662094 - RNA, 19 nt, Homo sapiens
gggaaauggucaaggagau

SEQ ID NO: 662095 - RNA, 19 nt, Homo sapiens
ccacgugcuucuuauuuua

SEQ ID NO: 662096 - RNA, 19 nt, Homo sapiens
gagaagacauuggccaacu

SEQ ID NO: 662097 - RNA, 19 nt, Homo sapiens
ucaguccagucgcuccuua

SEQ ID NO: 662098 - RNA, 19 nt, Homo sapiens
ccuauuugguccucaggua

SEQ ID NO: 662099 - RNA, 19 nt, Homo sapiens
agacauuggccaacucuuu

SEQ ID NO: 662100 - RNA, 19 nt, Homo sapiens
gauacaagacccuccugaa

SEQ ID NO: 662101 - RNA, 19 nt, Homo sapiens
ggagaugggagucuuucuu

SEQ ID NO: 662102 - RNA, 19 nt, Homo sapiens
aguacuugcugaagaauga

SEQ ID NO: 662103 - RNA, 19 nt, Homo sapiens
gagaugggagucuuucuuc

SEQ ID NO: 662104 - RNA, 19 nt, Homo sapiens
ggguaaaucacauacuuug

SEQ ID NO: 662105 - RNA, 19 nt, Homo sapiens
gaagauguaggcagauugg

SEQ ID NO: 662106 - RNA, 19 nt, Homo sapiens
gaagaucugcacugugaca

SEQ ID NO: 662107 - RNA, 19 nt, Homo sapiens
ggaacgaaaccaagaaggu

SEQ ID NO: 662108 - RNA, 19 nt, Homo sapiens
gggaucggccuccucauug

SEQ ID NO: 662109 - RNA, 19 nt, Homo sapiens
ggucugaacugcccaaccu

SEQ ID NO: 662110 - RNA, 19 nt, Homo sapiens
auacaagacccuccugaaa

SEQ ID NO: 662111 - RNA, 19 nt, Homo sapiens
ucauuggccugcuguacuu

SEQ ID NO: 662112 - RNA, 19 nt, Homo sapiens
gaggugaacccuuuucuuu

SEQ ID NO: 662113 - RNA, 19 nt, Homo sapiens
acaagacccuccugaaagg

SEQ ID NO: 662114 - RNA, 19 nt, Homo sapiens
cgcaucaccucgcacauug

SEQ ID NO: 662115 - RNA, 19 nt, Homo sapiens
ugacucagaccacaagaga

SEQ ID NO: 662116 - RNA, 19 nt, Homo sapiens
ggacccugguggaggaaga

SEQ ID NO: 662117 - RNA, 19 nt, Homo sapiens
cagcacuugugaaggauug

SEQ ID NO: 662118 - RNA, 19 nt, Homo sapiens
ccaugaaugccagcaguua

SEQ ID NO: 662119 - RNA, 19 nt, Homo sapiens
gcgcaucaccucgcacauu

SEQ ID NO: 662120 - RNA, 19 nt, Homo sapiens
gaggugguguccagcaaca

SEQ ID NO: 662121 - RNA, 19 nt, Homo sapiens
ggaagauguaggcagauug

SEQ ID NO: 662122 - RNA, 19 nt, Homo sapiens
caacuccggcuuccucuuc

SEQ ID NO: 662123 - RNA, 19 nt, Homo sapiens
gaagagguaaagcagacaa

SEQ ID NO: 662124 - RNA, 19 nt, Homo sapiens
gugaacaacccuccaguca

SEQ ID NO: 662125 - RNA, 19 nt, Homo sapiens
gagacggaccugcugaaug

SEQ ID NO: 662126 - RNA, 19 nt, Homo sapiens
cacauacuuuguuuagaga

SEQ ID NO: 662127 - RNA, 19 nt, Homo sapiens
uuuaguacuugcugaagaa

SEQ ID NO: 662128 - RNA, 19 nt, Homo sapiens
gcagacgugcccuuucaga

SEQ ID NO: 662129 - RNA, 19 nt, Homo sapiens
cgaguacggugaucagaac

SEQ ID NO: 662130 - RNA, 19 nt, Homo sapiens
gaugaaagggcucgcucaa

SEQ ID NO: 662131 - RNA, 19 nt, Homo sapiens
gguggaggaagaaaggaua

SEQ ID NO: 662132 - RNA, 19 nt, Homo sapiens
ccagcuggucucauacaua

SEQ ID NO: 662133 - RNA, 19 nt, Homo sapiens
ggaaacaggaagauuagac

SEQ ID NO: 662134 - RNA, 19 nt, Homo sapiens
ggucauccucuccaucuau

SEQ ID NO: 662135 - RNA, 19 nt, Homo sapiens
caucuccuaugucagguau

SEQ ID NO: 662136 - RNA, 19 nt, Homo sapiens
gacauuggccaacucuuuc

SEQ ID NO: 662137 - RNA, 19 nt, Homo sapiens
gagggcacgucuagaaucg

SEQ ID NO: 662138 - RNA, 19 nt, Homo sapiens
ggaucggccuccucauugg

SEQ ID NO: 662139 - RNA, 19 nt, Homo sapiens
ugccauauuugagggauuu

SEQ ID NO: 662140 - RNA, 19 nt, Homo sapiens
gcgaguacggugaucagaa

SEQ ID NO: 662141 - RNA, 19 nt, Homo sapiens
cgcuggagcuggugaacaa

SEQ ID NO: 662142 - RNA, 19 nt, Homo sapiens
gggaaguccacgcugauga

SEQ ID NO: 662143 - RNA, 19 nt, Homo sapiens
gcaacacagcuggugauga

SEQ ID NO: 662144 - RNA, 19 nt, Homo sapiens
ggaggaagaaaggauacaa

SEQ ID NO: 662145 - RNA, 19 nt, Homo sapiens
gccgagggcacgucuagaa

SEQ ID NO: 662146 - RNA, 19 nt, Homo sapiens
guacggugaucagaacagu

SEQ ID NO: 662147 - RNA, 19 nt, Homo sapiens
gcccagcgccaaacucuuc

SEQ ID NO: 662148 - RNA, 19 nt, Homo sapiens
gcugaauggacaucugaaa

SEQ ID NO: 662149 - RNA, 19 nt, Homo sapiens
gcaacauggaggccacuga

SEQ ID NO: 662150 - RNA, 19 nt, Homo sapiens
caccugaacuacugguaca

SEQ ID NO: 662151 - RNA, 19 nt, Homo sapiens
ggucggcaccgccaugaau

SEQ ID NO: 662152 - RNA, 19 nt, Homo sapiens
gaaggcagaagggaaaugg

SEQ ID NO: 662153 - RNA, 19 nt, Homo sapiens
gaagacauuggccaacucu

SEQ ID NO: 662154 - RNA, 19 nt, Homo sapiens
acugagccaugcagacauu

SEQ ID NO: 662155 - RNA, 19 nt, Homo sapiens
cgacgagacgugccacuuc

SEQ ID NO: 662156 - RNA, 19 nt, Homo sapiens
gaaauggucaaggagauac

SEQ ID NO: 662157 - RNA, 19 nt, Homo sapiens
caacuggggcagaauuuaa

SEQ ID NO: 662158 - RNA, 19 nt, Homo sapiens
ugccuacuguucugacauu

SEQ ID NO: 662159 - RNA, 19 nt, Homo sapiens
ccucaugccuacuguucug

SEQ ID NO: 662160 - RNA, 19 nt, Homo sapiens
ggaagaaaggauacaagac

SEQ ID NO: 662161 - RNA, 19 nt, Homo sapiens
aaucuugugccauauuuga

SEQ ID NO: 662162 - RNA, 19 nt, Homo sapiens
uccggaagguguccugcua

SEQ ID NO: 662163 - RNA, 19 nt, Homo sapiens
ccacugagccaugcagaca

SEQ ID NO: 662164 - RNA, 19 nt, Homo sapiens
uacaagacccuccugaaag

SEQ ID NO: 662165 - RNA, 19 nt, Homo sapiens
gaacaacccuccagucaug

SEQ ID NO: 662166 - RNA, 19 nt, Homo sapiens
gggaagaucugcacuguga

SEQ ID NO: 662167 - RNA, 19 nt, Homo sapiens
gaagggaaauggucaagga

SEQ ID NO: 662168 - RNA, 19 nt, Homo sapiens
gcaaucuugugccauauuu

SEQ ID NO: 662169 - RNA, 19 nt, Homo sapiens
ucacccagcuggucucaua

SEQ ID NO: 662170 - RNA, 19 nt, Homo sapiens
caacacagcuggugaugag

SEQ ID NO: 662171 - RNA, 19 nt, Homo sapiens
ggaaaagucugcaaucuug

SEQ ID NO: 662172 - RNA, 19 nt, Homo sapiens
ccaggaaacaggaagauua

SEQ ID NO: 662173 - RNA, 19 nt, Homo sapiens
ucagggaccuuuccuauuc

SEQ ID NO: 662174 - RNA, 19 nt, Homo sapiens
gggcagcugugaacauuga

SEQ ID NO: 662175 - RNA, 19 nt, Homo sapiens
agacagcacuugugaagga

SEQ ID NO: 662176 - RNA, 19 nt, Homo sapiens
gggaacaccugaacuacug

SEQ ID NO: 662177 - RNA, 19 nt, Homo sapiens
gagggcagcugugaacauu

SEQ ID NO: 662178 - RNA, 19 nt, Homo sapiens
ucacauacuuuguuuagag

SEQ ID NO: 662179 - RNA, 19 nt, Homo sapiens
ggaaauggucaaggagaua

SEQ ID NO: 662180 - RNA, 19 nt, Homo sapiens
agacggaccugcugaaugg

SEQ ID NO: 662181 - RNA, 19 nt, Homo sapiens
cagcuggucucauacauag

SEQ ID NO: 662182 - RNA, 19 nt, Homo sapiens
guaggcagauuggugguuu

SEQ ID NO: 662183 - RNA, 19 nt, Homo sapiens
gaugaaggcagaagggaaa

SEQ ID NO: 662184 - RNA, 19 nt, Homo sapiens
caggguaaaucacauacuu

SEQ ID NO: 662185 - RNA, 19 nt, Homo sapiens
gaagguguccugcuacauc

SEQ ID NO: 662186 - RNA, 19 nt, Homo sapiens
guaccuggacuucaucgua

SEQ ID NO: 662187 - RNA, 19 nt, Homo sapiens
cagguggucucgcugauga

SEQ ID NO: 662188 - RNA, 19 nt, Homo sapiens
gacgugcccuuucagauca

SEQ ID NO: 662189 - RNA, 19 nt, Homo sapiens
gcgcugggcuugcugucuu

SEQ ID NO: 662190 - RNA, 19 nt, Homo sapiens
ggaaguccacgcugaugaa

SEQ ID NO: 662191 - RNA, 19 nt, Homo sapiens
gggaagacguggacaccau

SEQ ID NO: 662192 - RNA, 19 nt, Homo sapiens
gaaacaggaagauuagaca

SEQ ID NO: 662193 - RNA, 19 nt, Homo sapiens
ucugcaaucuugugccaua

SEQ ID NO: 662194 - RNA, 19 nt, Homo sapiens
gggaaauggucaaggagau

SEQ ID NO: 662195 - RNA, 19 nt, Homo sapiens
ccacgugcuucuuauuuua

SEQ ID NO: 662196 - RNA, 19 nt, Homo sapiens
gagaagacauuggccaacu

SEQ ID NO: 662197 - RNA, 19 nt, Homo sapiens
ucaguccagucgcuccuua

SEQ ID NO: 662198 - RNA, 19 nt, Homo sapiens
ccuauuugguccucaggua

SEQ ID NO: 662199 - RNA, 19 nt, Homo sapiens
agacauuggccaacucuuu

SEQ ID NO: 662200 - RNA, 19 nt, Homo sapiens
gauacaagacccuccugaa

SEQ ID NO: 662201 - RNA, 19 nt, Homo sapiens
ggagaugggagucuuucuu

SEQ ID NO: 662202 - RNA, 19 nt, Homo sapiens
aguacuugcugaagaauga

SEQ ID NO: 662203 - RNA, 19 nt, Homo sapiens
gagaugggagucuuucuuc

SEQ ID NO: 662204 - RNA, 19 nt, Homo sapiens
ggguaaaucacauacuuug

SEQ ID NO: 662205 - RNA, 19 nt, Homo sapiens
gaagauguaggcagauugg

SEQ ID NO: 662206 - RNA, 19 nt, Homo sapiens
gaagaucugcacugugaca

SEQ ID NO: 662207 - RNA, 19 nt, Homo sapiens
ggaacgaaaccaagaaggu

SEQ ID NO: 662208 - RNA, 19 nt, Homo sapiens
gggaucggccuccucauug

SEQ ID NO: 662209 - RNA, 19 nt, Homo sapiens
ggucugaacugcccaaccu

SEQ ID NO: 662210 - RNA, 19 nt, Homo sapiens
auacaagacccuccugaaa

SEQ ID NO: 662211 - RNA, 19 nt, Homo sapiens
ucauuggccugcuguacuu

SEQ ID NO: 662212 - RNA, 19 nt, Homo sapiens
gaggugaacccuuuucuuu

SEQ ID NO: 662213 - RNA, 19 nt, Homo sapiens
acaagacccuccugaaagg

SEQ ID NO: 662214 - RNA, 19 nt, Homo sapiens
cgcaucaccucgcacauug

SEQ ID NO: 662215 - RNA, 19 nt, Homo sapiens
ugacucagaccacaagaga

SEQ ID NO: 662216 - RNA, 19 nt, Homo sapiens
ggacccugguggaggaaga

SEQ ID NO: 662217 - RNA, 19 nt, Homo sapiens
cagcacuugugaaggauug

SEQ ID NO: 662218 - RNA, 19 nt, Homo sapiens
ccaugaaugccagcaguua

SEQ ID NO: 662219 - RNA, 19 nt, Homo sapiens
gcgcaucaccucgcacauu

SEQ ID NO: 662220 - RNA, 19 nt, Homo sapiens
gaggugguguccagcaaca

SEQ ID NO: 662221 - RNA, 19 nt, Homo sapiens
ggaagauguaggcagauug

SEQ ID NO: 662222 - RNA, 19 nt, Homo sapiens
caacuccggcuuccucuuc

SEQ ID NO: 662223 - RNA, 19 nt, Homo sapiens
gugaacaacccuccaguca

SEQ ID NO: 662224 - RNA, 19 nt, Homo sapiens
gagacggaccugcugaaug

SEQ ID NO: 662225 - RNA, 19 nt, Homo sapiens
cacauacuuuguuuagaga

SEQ ID NO: 662226 - RNA, 19 nt, Homo sapiens
uuuaguacuugcugaagaa

SEQ ID NO: 662227 - RNA, 19 nt, Homo sapiens
gcagacgugcccuuucaga

SEQ ID NO: 662228 - RNA, 19 nt, Homo sapiens
cgaguacggugaucagaac

SEQ ID NO: 662229 - RNA, 19 nt, Homo sapiens
gaugaaagggcucgcucaa

SEQ ID NO: 662230 - RNA, 19 nt, Homo sapiens
gguggaggaagaaaggaua

SEQ ID NO: 662231 - RNA, 19 nt, Homo sapiens
ccagcuggucucauacaua

SEQ ID NO: 662232 - RNA, 19 nt, Homo sapiens
ggaaacaggaagauuagac

SEQ ID NO: 662233 - RNA, 19 nt, Homo sapiens
ggucauccucuccaucuau

SEQ ID NO: 662234 - RNA, 19 nt, Homo sapiens
caucuccuaugucagguau

SEQ ID NO: 662235 - RNA, 19 nt, Homo sapiens
gacauuggccaacucuuuc

SEQ ID NO: 662236 - RNA, 19 nt, Homo sapiens
gagggcacgucuagaaucg

SEQ ID NO: 662237 - RNA, 19 nt, Homo sapiens
ggaucggccuccucauugg

SEQ ID NO: 662238 - RNA, 19 nt, Homo sapiens
ugccauauuugagggauuu

SEQ ID NO: 662239 - RNA, 19 nt, Homo sapiens
gcgaguacggugaucagaa

SEQ ID NO: 662240 - RNA, 19 nt, Homo sapiens
cgcuggagcuggugaacaa

SEQ ID NO: 662241 - RNA, 19 nt, Homo sapiens
gggaaguccacgcugauga

SEQ ID NO: 662242 - RNA, 19 nt, Homo sapiens
gcaacacagcuggugauga

SEQ ID NO: 662243 - RNA, 19 nt, Homo sapiens
gccgagggcacgucuagaa

SEQ ID NO: 662244 - RNA, 19 nt, Homo sapiens
ggaggaagaaaggauacaa

SEQ ID NO: 662245 - RNA, 19 nt, Homo sapiens
guacggugaucagaacagu

SEQ ID NO: 662246 - RNA, 19 nt, Homo sapiens
gcccagcgccaaacucuuc

SEQ ID NO: 662247 - RNA, 19 nt, Homo sapiens
gcugaauggacaucugaaa

SEQ ID NO: 662248 - RNA, 19 nt, Homo sapiens
gcaacauggaggccacuga

SEQ ID NO: 662249 - RNA, 19 nt, Homo sapiens
caccugaacuacugguaca

SEQ ID NO: 662250 - RNA, 19 nt, Homo sapiens
ggucggcaccgccaugaau

SEQ ID NO: 662251 - RNA, 19 nt, Homo sapiens
gaaggcagaagggaaaugg

SEQ ID NO: 662252 - RNA, 19 nt, Homo sapiens
gaagacauuggccaacucu

SEQ ID NO: 662253 - RNA, 19 nt, Homo sapiens
acugagccaugcagacauu

SEQ ID NO: 662254 - RNA, 19 nt, Homo sapiens
cgacgagacgugccacuuc

SEQ ID NO: 662255 - RNA, 19 nt, Homo sapiens
gaaauggucaaggagauac

SEQ ID NO: 662256 - RNA, 19 nt, Homo sapiens
caacuggggcagaauuuaa

SEQ ID NO: 662257 - RNA, 19 nt, Homo sapiens
ugccuacuguucugacauu

SEQ ID NO: 662258 - RNA, 19 nt, Homo sapiens
ccucaugccuacuguucug

SEQ ID NO: 662259 - RNA, 19 nt, Homo sapiens
aaucuugugccauauuuga

SEQ ID NO: 662260 - RNA, 19 nt, Homo sapiens
ggaagaaaggauacaagac

SEQ ID NO: 662261 - RNA, 19 nt, Homo sapiens
uccggaagguguccugcua

SEQ ID NO: 662262 - RNA, 19 nt, Homo sapiens
ccacugagccaugcagaca

SEQ ID NO: 662263 - RNA, 19 nt, Homo sapiens
uacaagacccuccugaaag

SEQ ID NO: 662264 - RNA, 19 nt, Homo sapiens
gaacagucggcuggugaga

SEQ ID NO: 662265 - RNA, 19 nt, Homo sapiens
caaaucaggugcccaaaua

SEQ ID NO: 662266 - RNA, 19 nt, Homo sapiens
gaucagaacuguuaccaaa

SEQ ID NO: 662267 - RNA, 19 nt, Homo sapiens
gcaaagauguccacacugu

SEQ ID NO: 662268 - RNA, 19 nt, Homo sapiens
gaaaggacaucgggaacua

SEQ ID NO: 662269 - RNA, 19 nt, Homo sapiens
gcacagcugcuuccaaaua

SEQ ID NO: 662270 - RNA, 19 nt, Homo sapiens
ugagaagagucuacaauaa

SEQ ID NO: 662271 - RNA, 19 nt, Homo sapiens
ggugcaaccuguauauaua

SEQ ID NO: 662272 - RNA, 19 nt, Homo sapiens
caucggagcuguuauaauc

SEQ ID NO: 662273 - RNA, 19 nt, Homo sapiens
gagaagagucuacaauaaa

SEQ ID NO: 662274 - RNA, 19 nt, Homo sapiens
ugauggagcuggacuauga

SEQ ID NO: 662275 - RNA, 19 nt, Homo sapiens
ccagagcucuuuaacugua

SEQ ID NO: 662276 - RNA, 19 nt, Homo sapiens
gaucaaaggugggaaauac

SEQ ID NO: 662277 - RNA, 19 nt, Homo sapiens
gagcagaucuaccugaauc

SEQ ID NO: 662278 - RNA, 19 nt, Homo sapiens
ccaaauaggagaaaccaua

SEQ ID NO: 662279 - RNA, 19 nt, Homo sapiens
gcaaagguuuccugccaaa

SEQ ID NO: 662280 - RNA, 19 nt, Homo sapiens
gcaaggagaauuacuacaa

SEQ ID NO: 662281 - RNA, 19 nt, Homo sapiens
ggacacggccuccaccuuu

SEQ ID NO: 662282 - RNA, 19 nt, Homo sapiens
ucuggagucugaccaauua

SEQ ID NO: 662283 - RNA, 19 nt, Homo sapiens
ggacauggccggauucauc

SEQ ID NO: 662284 - RNA, 19 nt, Homo sapiens
gaacuggagcuguuuguug

SEQ ID NO: 662285 - RNA, 19 nt, Homo sapiens
gcgaggagguggagcacua

SEQ ID NO: 662286 - RNA, 19 nt, Homo sapiens
ucgaggauguccagaaaua

SEQ ID NO: 662287 - RNA, 19 nt, Homo sapiens
gccauuauuucuucaguuu

SEQ ID NO: 662288 - RNA, 19 nt, Homo sapiens
acacuggaauuacaaauga

SEQ ID NO: 662289 - RNA, 19 nt, Homo sapiens
ccucacaccugaaugaauu

SEQ ID NO: 662290 - RNA, 19 nt, Homo sapiens
ggagugaccugaacaucau

SEQ ID NO: 662291 - RNA, 19 nt, Homo sapiens
gaucccgacuguaauaaga

SEQ ID NO: 662292 - RNA, 19 nt, Homo sapiens
gaggaaaggcaucuugaaa

SEQ ID NO: 662293 - RNA, 19 nt, Homo sapiens
gcaacgagcugcgccuguu

SEQ ID NO: 662294 - RNA, 19 nt, Homo sapiens
gggagaauguggccgugua

SEQ ID NO: 662295 - RNA, 19 nt, Homo sapiens
ccacggugcuggagaaugu

SEQ ID NO: 662296 - RNA, 19 nt, Homo sapiens
uuacauaccuccugccaau

SEQ ID NO: 662297 - RNA, 19 nt, Homo sapiens
agacagcgcuuccacuuca

SEQ ID NO: 662298 - RNA, 19 nt, Homo sapiens
gaauuauacaugugccuua

SEQ ID NO: 662299 - RNA, 19 nt, Homo sapiens
gaaaaugugagcacuguua

SEQ ID NO: 662300 - RNA, 19 nt, Homo sapiens
caaauaggagaaaccauaa

SEQ ID NO: 662301 - RNA, 19 nt, Homo sapiens
caaagaaagcaccauuauu

SEQ ID NO: 662302 - RNA, 19 nt, Homo sapiens
cgacaacgagccuaucuuu

SEQ ID NO: 662303 - RNA, 19 nt, Homo sapiens
gaacagucuccuuucauga

SEQ ID NO: 662304 - RNA, 19 nt, Homo sapiens
cgacaucuuugacaaguuc

SEQ ID NO: 662305 - RNA, 19 nt, Homo sapiens
gcugugaagugaucuacaa

SEQ ID NO: 662306 - RNA, 19 nt, Homo sapiens
caacgagccuaucuuugug

SEQ ID NO: 662307 - RNA, 19 nt, Homo sapiens
cgaacagucuccuuucaug

SEQ ID NO: 662308 - RNA, 19 nt, Homo sapiens
ugaucgagcugaagaaugu

SEQ ID NO: 662309 - RNA, 19 nt, Homo sapiens
cuaccaggguuccaucuuu

SEQ ID NO: 662310 - RNA, 19 nt, Homo sapiens
gccaaugcaaggagaauua

SEQ ID NO: 662311 - RNA, 19 nt, Homo sapiens
gugaccaucuuggacauua

SEQ ID NO: 662312 - RNA, 19 nt, Homo sapiens
ccaaagaaagcaccauuau

SEQ ID NO: 662313 - RNA, 19 nt, Homo sapiens
gucaacagguggaauaugu

SEQ ID NO: 662314 - RNA, 19 nt, Homo sapiens
uggcaaagauucgugcuaa

SEQ ID NO: 662315 - RNA, 19 nt, Homo sapiens
acacaaaggucuugguucu

SEQ ID NO: 662316 - RNA, 19 nt, Homo sapiens
gaucauguaucagauugug

SEQ ID NO: 662317 - RNA, 19 nt, Homo sapiens
gcagagggagccugaaguu

SEQ ID NO: 662318 - RNA, 19 nt, Homo sapiens
gcacaguuguacuugaauc

SEQ ID NO: 662319 - RNA, 19 nt, Homo sapiens
gggaggcggugucagaaug

SEQ ID NO: 662320 - RNA, 19 nt, Homo sapiens
ccaacaaguccaacaguuu

SEQ ID NO: 662321 - RNA, 19 nt, Homo sapiens
ccaacagugugauuaccua

SEQ ID NO: 662322 - RNA, 19 nt, Homo sapiens
ggaaaagcguaucugaaaa

SEQ ID NO: 662323 - RNA, 19 nt, Homo sapiens
aaagauguccacacuguuu

SEQ ID NO: 662324 - RNA, 19 nt, Homo sapiens
caaggagaauuacuacaag

SEQ ID NO: 662325 - RNA, 19 nt, Homo sapiens
gaacaugucccaggagaag

SEQ ID NO: 662326 - RNA, 19 nt, Homo sapiens
uuucagagcucccauuaca

SEQ ID NO: 662327 - RNA, 19 nt, Homo sapiens
gaaauacucgcugagcauu

SEQ ID NO: 662328 - RNA, 19 nt, Homo sapiens
cguuagaccucuugauguu

SEQ ID NO: 662329 - RNA, 19 nt, Homo sapiens
cagccuagaugggcaguuu

SEQ ID NO: 662330 - RNA, 19 nt, Homo sapiens
ccacacucuucaacgguua

SEQ ID NO: 662331 - RNA, 19 nt, Homo sapiens
gcuuugaucccgacuguaa

SEQ ID NO: 662332 - RNA, 19 nt, Homo sapiens
caccaaauuugaggacuuu

SEQ ID NO: 662333 - RNA, 19 nt, Homo sapiens
gccaaagaaagcaccauua

SEQ ID NO: 662334 - RNA, 19 nt, Homo sapiens
caagacacccugauuugga

SEQ ID NO: 662335 - RNA, 19 nt, Homo sapiens
uaagggauccguuggaaau

SEQ ID NO: 662336 - RNA, 19 nt, Homo sapiens
ggaaaggaacggcuugcuu

SEQ ID NO: 662337 - RNA, 19 nt, Homo sapiens
caacaaguccaacaguuuc

SEQ ID NO: 662338 - RNA, 19 nt, Homo sapiens
acaacuaugucaccaacaa

SEQ ID NO: 662339 - RNA, 19 nt, Homo sapiens
cagaucauguaucagauug

SEQ ID NO: 662340 - RNA, 19 nt, Homo sapiens
ucuagucccuuuaaacguu

SEQ ID NO: 662341 - RNA, 19 nt, Homo sapiens
acaggaggaugaaaugaga

SEQ ID NO: 662342 - RNA, 19 nt, Homo sapiens
cgagagauccaugcaauga

SEQ ID NO: 662343 - RNA, 19 nt, Homo sapiens
gaaggacggcugugaugug

SEQ ID NO: 662344 - RNA, 19 nt, Homo sapiens
gcacacugcgcauguccua

SEQ ID NO: 662345 - RNA, 19 nt, Homo sapiens
aauacucgcugagcauuaa

SEQ ID NO: 662346 - RNA, 19 nt, Homo sapiens
gaggagcgcgugagcuauu

SEQ ID NO: 662347 - RNA, 19 nt, Homo sapiens
gcagaggaaaggcaucuug

SEQ ID NO: 662348 - RNA, 19 nt, Homo sapiens
uacaauggcugucccaaag

SEQ ID NO: 662349 - RNA, 19 nt, Homo sapiens
gugaagugaucuacaaugg

SEQ ID NO: 662350 - RNA, 19 nt, Homo sapiens
ugguggagcuggacuuuga

SEQ ID NO: 662351 - RNA, 19 nt, Homo sapiens
ccaaugggcgucugcugua

SEQ ID NO: 662352 - RNA, 19 nt, Homo sapiens
cgugggaccugggaccuua

SEQ ID NO: 662353 - RNA, 19 nt, Homo sapiens
guacuugaaucuggcaugu

SEQ ID NO: 662354 - RNA, 19 nt, Homo sapiens
ggaggcaccugugucaaca

SEQ ID NO: 662355 - RNA, 19 nt, Homo sapiens
ggaacggcuugcuucucua

SEQ ID NO: 662356 - RNA, 19 nt, Homo sapiens
caaguaaaaugcaaagaug

SEQ ID NO: 662357 - RNA, 19 nt, Homo sapiens
gcgaugcacugagcuuuca

SEQ ID NO: 662358 - RNA, 19 nt, Homo sapiens
uguccuaucugcaaagguu

SEQ ID NO: 662359 - RNA, 19 nt, Homo sapiens
gcccaucggagcuguuaua

SEQ ID NO: 662360 - RNA, 19 nt, Homo sapiens
ugaugacgcuggccaguuc

SEQ ID NO: 662361 - RNA, 19 nt, Homo sapiens
gaccagaacaaggcagaua

SEQ ID NO: 662362 - RNA, 19 nt, Homo sapiens
ggaauauguaucuguguga

SEQ ID NO: 662363 - RNA, 19 nt, Homo sapiens
gaugggaggcggugucaga

SEQ ID NO: 662364 - RNA, 19 nt, Homo sapiens
gcccagaucauguaucaga

SEQ ID NO: 662365 - RNA, 19 nt, Homo sapiens
acaccaaccucugcaaauu

SEQ ID NO: 662366 - RNA, 19 nt, Homo sapiens
ucugguagcugcagccaaa

SEQ ID NO: 662367 - RNA, 19 nt, Homo sapiens
gaggaggucugcaguaagc

SEQ ID NO: 662368 - RNA, 19 nt, Homo sapiens
caccuagacucucccugua

SEQ ID NO: 662369 - RNA, 19 nt, Homo sapiens
ccagaaauaaagucuaaga

SEQ ID NO: 662370 - RNA, 19 nt, Homo sapiens
cugaggaggucugcaguaa

SEQ ID NO: 662371 - RNA, 19 nt, Homo sapiens
ugcagggccuugugucuuu

SEQ ID NO: 662372 - RNA, 19 nt, Homo sapiens
gcacccagaguacaacaga

SEQ ID NO: 662373 - RNA, 19 nt, Homo sapiens
uagcugcagccaaaucaua

SEQ ID NO: 662374 - RNA, 19 nt, Homo sapiens
gcacacuguuuccagaacu

SEQ ID NO: 662375 - RNA, 19 nt, Homo sapiens
gacccuugcucgcuaacga

SEQ ID NO: 662376 - RNA, 19 nt, Homo sapiens
ggaucucucgucucuggua

SEQ ID NO: 662377 - RNA, 19 nt, Homo sapiens
gggaacucuugccucguuu

SEQ ID NO: 662378 - RNA, 19 nt, Homo sapiens
aaaccguccaggccaguua

SEQ ID NO: 662379 - RNA, 19 nt, Homo sapiens
gaucugcaacggguacuug

SEQ ID NO: 662380 - RNA, 19 nt, Homo sapiens
ggucugcaguaagcucuau

SEQ ID NO: 662381 - RNA, 19 nt, Homo sapiens
cuaacgaccucaugcucau

SEQ ID NO: 662382 - RNA, 19 nt, Homo sapiens
ugacccaaccuuaccaguu

SEQ ID NO: 662383 - RNA, 19 nt, Homo sapiens
ccuagacucucccuguaca

SEQ ID NO: 662384 - RNA, 19 nt, Homo sapiens
gaacgugucgguggugucu

SEQ ID NO: 662385 - RNA, 19 nt, Homo sapiens
cgcaggaucucucgucucu

SEQ ID NO: 662386 - RNA, 19 nt, Homo sapiens
gauccagaaauaaagucua

SEQ ID NO: 662387 - RNA, 19 nt, Homo sapiens
acagacccuugcucgcuaa

SEQ ID NO: 662388 - RNA, 19 nt, Homo sapiens
ggggaacucuugccucguu

SEQ ID NO: 662389 - RNA, 19 nt, Homo sapiens
gggaacccaugaaauugac

SEQ ID NO: 662390 - RNA, 19 nt, Homo sapiens
gcagggccuugugucuuuc

SEQ ID NO: 662391 - RNA, 19 nt, Homo sapiens
gcggagggcaagaccagaa

SEQ ID NO: 662392 - RNA, 19 nt, Homo sapiens
ucaucaaguuggacgaauc

SEQ ID NO: 662393 - RNA, 19 nt, Homo sapiens
uccccuagauccagaaaua

SEQ ID NO: 662394 - RNA, 19 nt, Homo sapiens
gacaccauccggagcauca

SEQ ID NO: 662395 - RNA, 19 nt, Homo sapiens
gguagcugcagccaaauca

SEQ ID NO: 662396 - RNA, 19 nt, Homo sapiens
accaaccucugcaaauuca

SEQ ID NO: 662397 - RNA, 19 nt, Homo sapiens
cuacaccaaccucugcaaa

SEQ ID NO: 662398 - RNA, 19 nt, Homo sapiens
gaacucuugccucguuucu

SEQ ID NO: 662399 - RNA, 19 nt, Homo sapiens
cccuagauccagaaauaaa

SEQ ID NO: 662400 - RNA, 19 nt, Homo sapiens
ccaaugccaccuagacucu

SEQ ID NO: 662401 - RNA, 19 nt, Homo sapiens
caccaaccucugcaaauuc

SEQ ID NO: 662402 - RNA, 19 nt, Homo sapiens
gaccucaugcucaucaagu

SEQ ID NO: 662403 - RNA, 19 nt, Homo sapiens
aggcggcacuggucaugga

SEQ ID NO: 662404 - RNA, 19 nt, Homo sapiens
gcucaucaaguuggacgaa

SEQ ID NO: 662405 - RNA, 19 nt, Homo sapiens
caaaccaaggguacagauc

SEQ ID NO: 662406 - RNA, 19 nt, Homo sapiens
guacuugcagggccuugug

SEQ ID NO: 662407 - RNA, 19 nt, Homo sapiens
gagggcaagaccagaagga

SEQ ID NO: 662408 - RNA, 19 nt, Homo sapiens
ugucagccgcacacuguuu

SEQ ID NO: 662409 - RNA, 19 nt, Homo sapiens
ucacaguacugguuaauua

SEQ ID NO: 662410 - RNA, 19 nt, Homo sapiens
ccacucaggucuguacuua

SEQ ID NO: 662411 - RNA, 19 nt, Homo sapiens
gagcagcggauuccaguuu

SEQ ID NO: 662412 - RNA, 19 nt, Homo sapiens
cagugaggaucuucaugua

SEQ ID NO: 662413 - RNA, 19 nt, Homo sapiens
acacucaguuucucucguu

SEQ ID NO: 662414 - RNA, 19 nt, Homo sapiens
cauaucagccggagaggaa

SEQ ID NO: 662415 - RNA, 19 nt, Homo sapiens
ggccugugcuucugcuuau

SEQ ID NO: 662416 - RNA, 19 nt, Homo sapiens
gcucgugauuggaaacuca

SEQ ID NO: 662417 - RNA, 19 nt, Homo sapiens
gaccucacaguacugguua

SEQ ID NO: 662418 - RNA, 19 nt, Homo sapiens
gcagugguucgguuuaaga

SEQ ID NO: 662419 - RNA, 19 nt, Homo sapiens
ucauguaccugcucuucug

SEQ ID NO: 662420 - RNA, 19 nt, Homo sapiens
ggccuggcaucuacgaaga

SEQ ID NO: 662421 - RNA, 19 nt, Homo sapiens
gcaggcagugguucgguuu

SEQ ID NO: 662422 - RNA, 19 nt, Homo sapiens
gcagcugguccuaacauau

SEQ ID NO: 662423 - RNA, 19 nt, Homo sapiens
aaacuuuauugcucacugu

SEQ ID NO: 662424 - RNA, 19 nt, Homo sapiens
gugguucgguuuaagagau

SEQ ID NO: 662425 - RNA, 19 nt, Homo sapiens
uguaccugcucuucuguuu

SEQ ID NO: 662426 - RNA, 19 nt, Homo sapiens
ggccuggugucuccucaug

SEQ ID NO: 662427 - RNA, 19 nt, Homo sapiens
gguuuaagagauggcauua

SEQ ID NO: 662428 - RNA, 19 nt, Homo sapiens
cacaguacugguuaauuaa

SEQ ID NO: 662429 - RNA, 19 nt, Homo sapiens
gugcagcucgugauuggaa

SEQ ID NO: 662430 - RNA, 19 nt, Homo sapiens
cagugcagcucgugauugg

SEQ ID NO: 662431 - RNA, 19 nt, Homo sapiens
uagggcagcuggccuggau

SEQ ID NO: 662432 - RNA, 19 nt, Homo sapiens
ucagugaggaucuucaugu

SEQ ID NO: 662433 - RNA, 19 nt, Homo sapiens
ggucccgguugcagacuug

SEQ ID NO: 662434 - RNA, 19 nt, Homo sapiens
cagcugguccuaacauauc

SEQ ID NO: 662435 - RNA, 19 nt, Homo sapiens
aggcagugguucgguuuaa

SEQ ID NO: 662436 - RNA, 19 nt, Homo sapiens
ugcaagcuguggguucuuu

SEQ ID NO: 662437 - RNA, 19 nt, Homo sapiens
gagcagcugguccuaacau

SEQ ID NO: 662438 - RNA, 19 nt, Homo sapiens
gaccauggccagauugacu

SEQ ID NO: 662439 - RNA, 19 nt, Homo sapiens
gcagcggauuccaguuucu

SEQ ID NO: 662440 - RNA, 19 nt, Homo sapiens
acucaggucuguacuuagg

SEQ ID NO: 662441 - RNA, 19 nt, Homo sapiens
cagcaucacagugcacuug

SEQ ID NO: 662442 - RNA, 19 nt, Homo sapiens
caguucugcugacacuuug

SEQ ID NO: 662443 - RNA, 19 nt, Homo sapiens
gcugcaagcuguggguucu

SEQ ID NO: 662444 - RNA, 19 nt, Homo sapiens
ggagaaccugggugacugu

SEQ ID NO: 662445 - RNA, 19 nt, Homo sapiens
gcagauaugaacccagcau

SEQ ID NO: 662446 - RNA, 19 nt, Homo sapiens
gcagaccauggccagauug

SEQ ID NO: 662447 - RNA, 19 nt, Homo sapiens
gacacuuuggcccgaaaua

SEQ ID NO: 662448 - RNA, 19 nt, Homo sapiens
cgaagcuucugugcgucua

SEQ ID NO: 662449 - RNA, 19 nt, Homo sapiens
cuagaugccacucccaaau

SEQ ID NO: 662450 - RNA, 19 nt, Homo sapiens
gccauggccuccgaagcuu

SEQ ID NO: 662451 - RNA, 19 nt, Homo sapiens
uaccugcucuucuguuugc

SEQ ID NO: 662452 - RNA, 19 nt, Homo sapiens
ugaccucacaguacugguu

SEQ ID NO: 662453 - RNA, 19 nt, Homo sapiens
guaccugcucuucuguuug

SEQ ID NO: 662454 - RNA, 19 nt, Homo sapiens
caguacugguuaauuaaac

SEQ ID NO: 662455 - RNA, 19 nt, Homo sapiens
gaugcuaguccgugaaggu

SEQ ID NO: 662456 - RNA, 19 nt, Homo sapiens
uggagcagcugguccuaac

SEQ ID NO: 662457 - RNA, 19 nt, Homo sapiens
ggaauugacuuuagaagaa

SEQ ID NO: 662458 - RNA, 19 nt, Homo sapiens
ggaaaugguucuauugaca

SEQ ID NO: 662459 - RNA, 19 nt, Homo sapiens
gaaagcaguuccuacacaa

SEQ ID NO: 662460 - RNA, 19 nt, Homo sapiens
ggauggauuuguugacuuu

SEQ ID NO: 662461 - RNA, 19 nt, Homo sapiens
gcaaacacuacaugaauuu

SEQ ID NO: 662462 - RNA, 19 nt, Homo sapiens
guacagaacauuuaugaug

SEQ ID NO: 662463 - RNA, 19 nt, Homo sapiens
gagacagacuccuccaaau

SEQ ID NO: 662464 - RNA, 19 nt, Homo sapiens
ucaacuugguguuccauaa

SEQ ID NO: 662465 - RNA, 19 nt, Homo sapiens
ugaaucagaaggccaauaa

SEQ ID NO: 662466 - RNA, 19 nt, Homo sapiens
gaaaugguucuauugacaa

SEQ ID NO: 662467 - RNA, 19 nt, Homo sapiens
guaugaugcugauggaaau

SEQ ID NO: 662468 - RNA, 19 nt, Homo sapiens
ggaagcagccagacaugga

SEQ ID NO: 662469 - RNA, 19 nt, Homo sapiens
cagaaggccaauaaacaua

SEQ ID NO: 662470 - RNA, 19 nt, Homo sapiens
gggaauggcaaaucuauag

SEQ ID NO: 662471 - RNA, 19 nt, Homo sapiens
ugauggaaaugguucuauu

SEQ ID NO: 662472 - RNA, 19 nt, Homo sapiens
ggaguuuauugcugcugua

SEQ ID NO: 662473 - RNA, 19 nt, Homo sapiens
gggaauugacuuuagaaga

SEQ ID NO: 662474 - RNA, 19 nt, Homo sapiens
gauggaaaugguucuauug

SEQ ID NO: 662475 - RNA, 19 nt, Homo sapiens
agaaagcaguuccuacaca

SEQ ID NO: 662476 - RNA, 19 nt, Homo sapiens
gaucagaaagcaguuccua

SEQ ID NO: 662477 - RNA, 19 nt, Homo sapiens
ugcaaacacuacaugaauu

SEQ ID NO: 662478 - RNA, 19 nt, Homo sapiens
ccaaugugcugagaguaau

SEQ ID NO: 662479 - RNA, 19 nt, Homo sapiens
gugcugagaguaaucugua

SEQ ID NO: 662480 - RNA, 19 nt, Homo sapiens
gagcuucgacuucuccaau

SEQ ID NO: 662481 - RNA, 19 nt, Homo sapiens
ucugaguccugaagaauuc

SEQ ID NO: 662482 - RNA, 19 nt, Homo sapiens
uauagcuggugaucagaaa

SEQ ID NO: 662483 - RNA, 19 nt, Homo sapiens
ucagaaagcaguuccuaca

SEQ ID NO: 662484 - RNA, 19 nt, Homo sapiens
gacagacuccuccaaaucu

SEQ ID NO: 662485 - RNA, 19 nt, Homo sapiens
uacaagagcuucgacuucu

SEQ ID NO: 662486 - RNA, 19 nt, Homo sapiens
acagaacauuuaugaugga

SEQ ID NO: 662487 - RNA, 19 nt, Homo sapiens
cuccaaaucuccugacaag

SEQ ID NO: 662488 - RNA, 19 nt, Homo sapiens
gcuguaugaugcugaugga

SEQ ID NO: 662489 - RNA, 19 nt, Homo sapiens
gaaucagaaggccaauaaa

SEQ ID NO: 662490 - RNA, 19 nt, Homo sapiens
ucagaaggccaauaaacau

SEQ ID NO: 662491 - RNA, 19 nt, Homo sapiens
auaauaccuuugacacgaa

SEQ ID NO: 662492 - RNA, 19 nt, Homo sapiens
agacagacuccuccaaauc

SEQ ID NO: 662493 - RNA, 19 nt, Homo sapiens
agccagacauggagacaga

SEQ ID NO: 662494 - RNA, 19 nt, Homo sapiens
uauugcugcuguaaaucua

SEQ ID NO: 662495 - RNA, 19 nt, Homo sapiens
cagaacauuuaugauggaa

SEQ ID NO: 662496 - RNA, 19 nt, Homo sapiens
uuacaagagcuucgacuuc

SEQ ID NO: 662497 - RNA, 19 nt, Homo sapiens
gcuucgacuucuccaaugu

SEQ ID NO: 662498 - RNA, 19 nt, Homo sapiens
ucaauggcauggcaaaaga

SEQ ID NO: 662499 - RNA, 19 nt, Homo sapiens
caacuugguguuccauaag

SEQ ID NO: 662500 - RNA, 19 nt, Homo sapiens
uguaugaugcugauggaaa

SEQ ID NO: 662501 - RNA, 19 nt, Homo sapiens
uaagcuguaugaugcugau

SEQ ID NO: 662502 - RNA, 19 nt, Homo sapiens
acacgaacaaggauggauu

SEQ ID NO: 662503 - RNA, 19 nt, Homo sapiens
cugcaaacacuacaugaau

SEQ ID NO: 662504 - RNA, 19 nt, Homo sapiens
aagagacccauguguggua

SEQ ID NO: 662505 - RNA, 19 nt, Homo sapiens
uccaaugugcugagaguaa

SEQ ID NO: 662506 - RNA, 19 nt, Homo sapiens
gcaguuccuacacaagaga

SEQ ID NO: 662507 - RNA, 19 nt, Homo sapiens
agaaggccaauaaacauau

SEQ ID NO: 662508 - RNA, 19 nt, Homo sapiens
uagggaaggugaaaaugaa

SEQ ID NO: 662509 - RNA, 19 nt, Homo sapiens
ugagaguaaucuguaaugg

SEQ ID NO: 662510 - RNA, 19 nt, Homo sapiens
aagcaguuccuacacaaga

SEQ ID NO: 662511 - RNA, 19 nt, Homo sapiens
ugguacagaacauuuauga

SEQ ID NO: 662512 - RNA, 19 nt, Homo sapiens
cacgaacaaggauggauuu

SEQ ID NO: 662513 - RNA, 19 nt, Homo sapiens
gugugguacagaacauuua

SEQ ID NO: 662514 - RNA, 19 nt, Homo sapiens
aaaaugaacuacuggacau

SEQ ID NO: 662515 - RNA, 19 nt, Homo sapiens
acccaugugugguacagaa

SEQ ID NO: 662516 - RNA, 19 nt, Homo sapiens
ggaaggugaaaaugaagua

SEQ ID NO: 662517 - RNA, 19 nt, Homo sapiens
gaguuuauugcugcuguaa

SEQ ID NO: 662518 - RNA, 19 nt, Homo sapiens
gauggggaauugacuuuag

SEQ ID NO: 662519 - RNA, 19 nt, Homo sapiens
cauccggccugcaaacacu

SEQ ID NO: 662520 - RNA, 19 nt, Homo sapiens
cuacacaagagacccaugu

SEQ ID NO: 662521 - RNA, 19 nt, Homo sapiens
cuguaaaucuaaucaugca

SEQ ID NO: 662522 - RNA, 19 nt, Homo sapiens
ugcuguaaaucuaaucaug

SEQ ID NO: 662523 - RNA, 19 nt, Homo sapiens
aagaauucaucaacuuggu

SEQ ID NO: 662524 - RNA, 19 nt, Homo sapiens
gcugagaguaaucuguaau

SEQ ID NO: 662525 - RNA, 19 nt, Homo sapiens
ucaauggccagcaaacucu

SEQ ID NO: 662526 - RNA, 19 nt, Homo sapiens
gaauggcaaaucuauagcu

SEQ ID NO: 662527 - RNA, 19 nt, Homo sapiens
gaaauugacuuuagugaug

SEQ ID NO: 662528 - RNA, 19 nt, Homo sapiens
gaagaaauccuacagcaua

SEQ ID NO: 662529 - RNA, 19 nt, Homo sapiens
gaacucuucuuguaaauca

SEQ ID NO: 662530 - RNA, 19 nt, Homo sapiens
gaauaaggcagcauaauga

SEQ ID NO: 662531 - RNA, 19 nt, Homo sapiens
gcaagucacucccuucuuc

SEQ ID NO: 662532 - RNA, 19 nt, Homo sapiens
ggagaagacugccucaaug

SEQ ID NO: 662533 - RNA, 19 nt, Homo sapiens
ggaugugccuuauauuaaa

SEQ ID NO: 662534 - RNA, 19 nt, Homo sapiens
gaaagaauaaggcagcaua

SEQ ID NO: 662535 - RNA, 19 nt, Homo sapiens
cagcggaccuccacaagua

SEQ ID NO: 662536 - RNA, 19 nt, Homo sapiens
guaaagacuuccuaaacaa

SEQ ID NO: 662537 - RNA, 19 nt, Homo sapiens
gaaccaacuccaacaauuu

SEQ ID NO: 662538 - RNA, 19 nt, Homo sapiens
ggacgcagguuuccuuuca

SEQ ID NO: 662539 - RNA, 19 nt, Homo sapiens
gaaaggaaaucucagaaaa

SEQ ID NO: 662540 - RNA, 19 nt, Homo sapiens
ggacuauccucuuuggaaa

SEQ ID NO: 662541 - RNA, 19 nt, Homo sapiens
ggacaucucagaacuuaaa

SEQ ID NO: 662542 - RNA, 19 nt, Homo sapiens
gcaccucacuucuuugaug

SEQ ID NO: 662543 - RNA, 19 nt, Homo sapiens
gagcagcgaaccagacuua

SEQ ID NO: 662544 - RNA, 19 nt, Homo sapiens
caacagugccguucacgua

SEQ ID NO: 662545 - RNA, 19 nt, Homo sapiens
gaucucaccuccucugguu

SEQ ID NO: 662546 - RNA, 19 nt, Homo sapiens
caggaugccuuaaauuuau

SEQ ID NO: 662547 - RNA, 19 nt, Homo sapiens
uaggacaucucagaacuua

SEQ ID NO: 662548 - RNA, 19 nt, Homo sapiens
ggaaaggaaaucucagaaa

SEQ ID NO: 662549 - RNA, 19 nt, Homo sapiens
gagcaaaugucaccaugca

SEQ ID NO: 662550 - RNA, 19 nt, Homo sapiens
guagaaagcguagagagua

SEQ ID NO: 662551 - RNA, 19 nt, Homo sapiens
gcaugucgcuggccucuca

SEQ ID NO: 662552 - RNA, 19 nt, Homo sapiens
gaaaggagugaguaucuga

SEQ ID NO: 662553 - RNA, 19 nt, Homo sapiens
ugacuuuagugaugacaua

SEQ ID NO: 662554 - RNA, 19 nt, Homo sapiens
ucaggaugccuuaaauuua

SEQ ID NO: 662555 - RNA, 19 nt, Homo sapiens
ggaaauuucuggacuaucc

SEQ ID NO: 662556 - RNA, 19 nt, Homo sapiens
uuccaagccuuauucauua

SEQ ID NO: 662557 - RNA, 19 nt, Homo sapiens
gucagcagcuugccucuuu

SEQ ID NO: 662558 - RNA, 19 nt, Homo sapiens
uguggcaucucaacucuua

SEQ ID NO: 662559 - RNA, 19 nt, Homo sapiens
ucacaucacucaagacgau

SEQ ID NO: 662560 - RNA, 19 nt, Homo sapiens
gaaaucagagggcaaguca

SEQ ID NO: 662561 - RNA, 19 nt, Homo sapiens
ucaaugagcgcaacacuga

SEQ ID NO: 662562 - RNA, 19 nt, Homo sapiens
gcacaucgcugggugaacu

SEQ ID NO: 662563 - RNA, 19 nt, Homo sapiens
ggagaacaaugaaagugau

SEQ ID NO: 662564 - RNA, 19 nt, Homo sapiens
gcuaaaggaacaaacagua

SEQ ID NO: 662565 - RNA, 19 nt, Homo sapiens
acaccuagcugcagacaau

SEQ ID NO: 662566 - RNA, 19 nt, Homo sapiens
gaaccucccuuuccccaua

SEQ ID NO: 662567 - RNA, 19 nt, Homo sapiens
ccaagcagcuaaaggaaca

SEQ ID NO: 662568 - RNA, 19 nt, Homo sapiens
ucgcugauguguacaguaa

SEQ ID NO: 662569 - RNA, 19 nt, Homo sapiens
ccacaggaaucgcugaugu

SEQ ID NO: 662570 - RNA, 19 nt, Homo sapiens
gaacugugccgaagaugug

SEQ ID NO: 662571 - RNA, 19 nt, Homo sapiens
ccaagccacugauaccauu

SEQ ID NO: 662572 - RNA, 19 nt, Homo sapiens
gagaagacugccucaauga

SEQ ID NO: 662573 - RNA, 19 nt, Homo sapiens
gugaugacauaucuuauuc

SEQ ID NO: 662574 - RNA, 19 nt, Homo sapiens
gcucagggccuuccaccua

SEQ ID NO: 662575 - RNA, 19 nt, Homo sapiens
caucucaacucuuauuaca

SEQ ID NO: 662576 - RNA, 19 nt, Homo sapiens
uggcucagcuccuucauga

SEQ ID NO: 662577 - RNA, 19 nt, Homo sapiens
ccagaaaguugccacaagu

SEQ ID NO: 662578 - RNA, 19 nt, Homo sapiens
gcucaggcuuccucuagaa

SEQ ID NO: 662579 - RNA, 19 nt, Homo sapiens
agaaccaacuccaacaauu

SEQ ID NO: 662580 - RNA, 19 nt, Homo sapiens
gaaguuaaccaagcagcua

SEQ ID NO: 662581 - RNA, 19 nt, Homo sapiens
gaauauggagcaaauguca

SEQ ID NO: 662582 - RNA, 19 nt, Homo sapiens
cugaauaccuugauuugga

SEQ ID NO: 662583 - RNA, 19 nt, Homo sapiens
uacagcaccucacuucuuu

SEQ ID NO: 662584 - RNA, 19 nt, Homo sapiens
caaugaaagugaugaccaa

SEQ ID NO: 662585 - RNA, 19 nt, Homo sapiens
gcacuacgaccucgacaug

SEQ ID NO: 662586 - RNA, 19 nt, Homo sapiens
gagcgaaacagaagccauu

SEQ ID NO: 662587 - RNA, 19 nt, Homo sapiens
gagaucaggucagugguau

SEQ ID NO: 662588 - RNA, 19 nt, Homo sapiens
gcagaagaacagaauauca

SEQ ID NO: 662589 - RNA, 19 nt, Homo sapiens
ggaaagagaaccaugaaaa

SEQ ID NO: 662590 - RNA, 19 nt, Homo sapiens
aagaaauccuacagcauaa

SEQ ID NO: 662591 - RNA, 19 nt, Homo sapiens
uaaccaagcagcuaaagga

SEQ ID NO: 662592 - RNA, 19 nt, Homo sapiens
gcauacagaccuugguuga

SEQ ID NO: 662593 - RNA, 19 nt, Homo sapiens
ggaugaaauugacuuuagu

SEQ ID NO: 662594 - RNA, 19 nt, Homo sapiens
gaucaggucagugguauug

SEQ ID NO: 662595 - RNA, 19 nt, Homo sapiens
gcaugaguauuugcuaaug

SEQ ID NO: 662596 - RNA, 19 nt, Homo sapiens
cagcauggcuaccuuggau

SEQ ID NO: 662597 - RNA, 19 nt, Homo sapiens
aguaaagacuuccuaaaca

SEQ ID NO: 662598 - RNA, 19 nt, Homo sapiens
uuaccaaggugacuucaga

SEQ ID NO: 662599 - RNA, 19 nt, Homo sapiens
ucaauugcaugaguauuug

SEQ ID NO: 662600 - RNA, 19 nt, Homo sapiens
gcaaggaagaauaauggaa

SEQ ID NO: 662601 - RNA, 19 nt, Homo sapiens
uggaugagauucuggaugu

SEQ ID NO: 662602 - RNA, 19 nt, Homo sapiens
gcuagcaaaggaaagaaua

SEQ ID NO: 662603 - RNA, 19 nt, Homo sapiens
gccugcaccugaugauuaa

SEQ ID NO: 662604 - RNA, 19 nt, Homo sapiens
auacagaccuugguugaau

SEQ ID NO: 662605 - RNA, 19 nt, Homo sapiens
ccagaacugugccgaagau

SEQ ID NO: 662606 - RNA, 19 nt, Homo sapiens
ggagcagccuagccuugaa

SEQ ID NO: 662607 - RNA, 19 nt, Homo sapiens
gaccuugguugaauaugga

SEQ ID NO: 662608 - RNA, 19 nt, Homo sapiens
aaaagcaucuugaacauug

SEQ ID NO: 662609 - RNA, 19 nt, Homo sapiens
gaaagucccaguggaaauc

SEQ ID NO: 662610 - RNA, 19 nt, Homo sapiens
gguugaauauggagcaaau

SEQ ID NO: 662611 - RNA, 19 nt, Homo sapiens
cagcgaaccagacuuagaa

SEQ ID NO: 662612 - RNA, 19 nt, Homo sapiens
gaaacacaccuuggcauca

SEQ ID NO: 662613 - RNA, 19 nt, Homo sapiens
uagaaagcguagagaguau

SEQ ID NO: 662614 - RNA, 19 nt, Homo sapiens
uggaugaaauugacuuuag

SEQ ID NO: 662615 - RNA, 19 nt, Homo sapiens
gaugacauaucuuauucag

SEQ ID NO: 662616 - RNA, 19 nt, Homo sapiens
gggagaagacugccucaau

SEQ ID NO: 662617 - RNA, 19 nt, Homo sapiens
gcaggucaguggccuaaac

SEQ ID NO: 662618 - RNA, 19 nt, Homo sapiens
gaguaaagacuuccuaaac

SEQ ID NO: 662619 - RNA, 19 nt, Homo sapiens
agaauaaggcagcauaaug

SEQ ID NO: 662620 - RNA, 19 nt, Homo sapiens
gaaagccugcaccugauga

SEQ ID NO: 662621 - RNA, 19 nt, Homo sapiens
cagaaagccugcaccugau

SEQ ID NO: 662622 - RNA, 19 nt, Homo sapiens
ccagaaagucccaguggaa

SEQ ID NO: 662623 - RNA, 19 nt, Homo sapiens
ucagucacaucacucaaga

SEQ ID NO: 662624 - RNA, 19 nt, Homo sapiens
gaagaaaggagugaguauc

SEQ ID NO: 662625 - RNA, 19 nt, Homo sapiens
cgacauggaugagauucug

SEQ ID NO: 662626 - RNA, 19 nt, Homo sapiens
ugggugaacuggagcacua

SEQ ID NO: 662627 - RNA, 19 nt, Homo sapiens
caaaguggcugaaaguuua

SEQ ID NO: 662628 - RNA, 19 nt, Homo sapiens
gaagaaaucuggcaagagu

SEQ ID NO: 662629 - RNA, 19 nt, Homo sapiens
cgacagacauuguuugaaa

SEQ ID NO: 662630 - RNA, 19 nt, Homo sapiens
gaauaugacccuuugauaa

SEQ ID NO: 662631 - RNA, 19 nt, Homo sapiens
ggacagaguuuccuuacga

SEQ ID NO: 662632 - RNA, 19 nt, Homo sapiens
ugaagaaccuuuccauuga

SEQ ID NO: 662633 - RNA, 19 nt, Homo sapiens
uuacaaagaugcaagauga

SEQ ID NO: 662634 - RNA, 19 nt, Homo sapiens
ggagggagauauacauuug

SEQ ID NO: 662635 - RNA, 19 nt, Homo sapiens
ggacccaguugaagcaaua

SEQ ID NO: 662636 - RNA, 19 nt, Homo sapiens
gaagacaucauuacaaaga

SEQ ID NO: 662637 - RNA, 19 nt, Homo sapiens
uuacagcccucucuucuuu

SEQ ID NO: 662638 - RNA, 19 nt, Homo sapiens
ggaauaugacccuuugaua

SEQ ID NO: 662639 - RNA, 19 nt, Homo sapiens
gaagugggaauucaucuuu

SEQ ID NO: 662640 - RNA, 19 nt, Homo sapiens
gcacagaucgacagacauu

SEQ ID NO: 662641 - RNA, 19 nt, Homo sapiens
ggcuggaacuggcagauua

SEQ ID NO: 662642 - RNA, 19 nt, Homo sapiens
gaacacaacagaaauggau

SEQ ID NO: 662643 - RNA, 19 nt, Homo sapiens
gaaagaaagaguccacaga

SEQ ID NO: 662644 - RNA, 19 nt, Homo sapiens
gcuaugagauaaccaguca

SEQ ID NO: 662645 - RNA, 19 nt, Homo sapiens
gcgaagaaguugcuuugug

SEQ ID NO: 662646 - RNA, 19 nt, Homo sapiens
ggagauauacauuugaaga

SEQ ID NO: 662647 - RNA, 19 nt, Homo sapiens
gaugaagagugacagcuau

SEQ ID NO: 662648 - RNA, 19 nt, Homo sapiens
ggacauccggaaacagaua

SEQ ID NO: 662649 - RNA, 19 nt, Homo sapiens
ccaaaguggcugaaaguuu

SEQ ID NO: 662650 - RNA, 19 nt, Homo sapiens
gcaagcagaagcacaaguu

SEQ ID NO: 662651 - RNA, 19 nt, Homo sapiens
uccaagaucuuaagaaaca

SEQ ID NO: 662652 - RNA, 19 nt, Homo sapiens
aagcacaaguuaagauuga

SEQ ID NO: 662653 - RNA, 19 nt, Homo sapiens
gaugcaagaugacaagaca

SEQ ID NO: 662654 - RNA, 19 nt, Homo sapiens
gaggagacuuggucacugu

SEQ ID NO: 662655 - RNA, 19 nt, Homo sapiens
uguccaagaucuuaagaaa

SEQ ID NO: 662656 - RNA, 19 nt, Homo sapiens
guacucagccaaccaauca

SEQ ID NO: 662657 - RNA, 19 nt, Homo sapiens
ggaacuggcagauuaugaa

SEQ ID NO: 662658 - RNA, 19 nt, Homo sapiens
gaagaaccuuuccauugag

SEQ ID NO: 662659 - RNA, 19 nt, Homo sapiens
aaagauggagggagauaua

SEQ ID NO: 662660 - RNA, 19 nt, Homo sapiens
gcgaagaagugggaauuca

SEQ ID NO: 662661 - RNA, 19 nt, Homo sapiens
ccaagaggguagaagaaau

SEQ ID NO: 662662 - RNA, 19 nt, Homo sapiens
caugaucguuuacugcaaa

SEQ ID NO: 662663 - RNA, 19 nt, Homo sapiens
ggaccaguuucuacgauuc

SEQ ID NO: 662664 - RNA, 19 nt, Homo sapiens
gaaagagugagggcaauga

SEQ ID NO: 662665 - RNA, 19 nt, Homo sapiens
acauagagaugagcaaaga

SEQ ID NO: 662666 - RNA, 19 nt, Homo sapiens
ggacauagagaugagcaaa

SEQ ID NO: 662667 - RNA, 19 nt, Homo sapiens
gaggacauccggaaacaga

SEQ ID NO: 662668 - RNA, 19 nt, Homo sapiens
ugcaguggcuuaugaagaa

SEQ ID NO: 662669 - RNA, 19 nt, Homo sapiens
uagaagaaaucuggcaaga

SEQ ID NO: 662670 - RNA, 19 nt, Homo sapiens
cuacaucuuuccaaucuca

SEQ ID NO: 662671 - RNA, 19 nt, Homo sapiens
gaagaagugggaauucauc

SEQ ID NO: 662672 - RNA, 19 nt, Homo sapiens
ucgaugagauauugaagga

SEQ ID NO: 662673 - RNA, 19 nt, Homo sapiens
gcauauaaaucauguuccu

SEQ ID NO: 662674 - RNA, 19 nt, Homo sapiens
gaagcacaaguuaagauug

SEQ ID NO: 662675 - RNA, 19 nt, Homo sapiens
caagcagaagcacaaguua

SEQ ID NO: 662676 - RNA, 19 nt, Homo sapiens
ggaauucaucuuuaugcaa

SEQ ID NO: 662677 - RNA, 19 nt, Homo sapiens
gagaaagagugagggcaau

SEQ ID NO: 662678 - RNA, 19 nt, Homo sapiens
ucagaacagucaagagcuu

SEQ ID NO: 662679 - RNA, 19 nt, Homo sapiens
uuagauacuuccagucuuc

SEQ ID NO: 662680 - RNA, 19 nt, Homo sapiens
ucaaaugcuuaccaggauu

SEQ ID NO: 662681 - RNA, 19 nt, Homo sapiens
ucuacaagcugaugaagag

SEQ ID NO: 662682 - RNA, 19 nt, Homo sapiens
agaaaucuggcaagaguuu

SEQ ID NO: 662683 - RNA, 19 nt, Homo sapiens
gggaccaguuucuacgauu

SEQ ID NO: 662684 - RNA, 19 nt, Homo sapiens
gaacugcugggaaccugaa

SEQ ID NO: 662685 - RNA, 19 nt, Homo sapiens
gucaaaugcuuaccaggau

SEQ ID NO: 662686 - RNA, 19 nt, Homo sapiens
acaagcugaugaagaguga

SEQ ID NO: 662687 - RNA, 19 nt, Homo sapiens
agacaagacagaaaggaaa

SEQ ID NO: 662688 - RNA, 19 nt, Homo sapiens
aagugggaauucaucuuua

SEQ ID NO: 662689 - RNA, 19 nt, Homo sapiens
ggcuacaucuuuccaaucu

SEQ ID NO: 662690 - RNA, 19 nt, Homo sapiens
gagacucggugggugaaug

SEQ ID NO: 662691 - RNA, 19 nt, Homo sapiens
gaacgcacagaucgacaga

SEQ ID NO: 662692 - RNA, 19 nt, Homo sapiens
gggaauucaucuuuaugca

SEQ ID NO: 662693 - RNA, 19 nt, Homo sapiens
gacauugugcaguggcuua

SEQ ID NO: 662694 - RNA, 19 nt, Homo sapiens
caagaggguagaagaaauc

SEQ ID NO: 662695 - RNA, 19 nt, Homo sapiens
gcagaagcacaaguuaaga

SEQ ID NO: 662696 - RNA, 19 nt, Homo sapiens
cagagggccuuugcgaaga

SEQ ID NO: 662697 - RNA, 19 nt, Homo sapiens
uaugagauaaccagucaaa

SEQ ID NO: 662698 - RNA, 19 nt, Homo sapiens
cagcgaagaaguugcuuug

SEQ ID NO: 662699 - RNA, 19 nt, Homo sapiens
uguaagaggacaaugcaaa

SEQ ID NO: 662700 - RNA, 19 nt, Homo sapiens
gauggcaccuuuuaucguu

SEQ ID NO: 662701 - RNA, 19 nt, Homo sapiens
augaagaaccuuuccauug

SEQ ID NO: 662702 - RNA, 19 nt, Homo sapiens
ucacagguacugacauugu

SEQ ID NO: 662703 - RNA, 19 nt, Homo sapiens
ucaaagauggagggagaua

SEQ ID NO: 662704 - RNA, 19 nt, Homo sapiens
gagauaaccagucaaaaug

SEQ ID NO: 662705 - RNA, 19 nt, Homo sapiens
gccaagaggguagaagaaa

SEQ ID NO: 662706 - RNA, 19 nt, Homo sapiens
uguggaauaugacccuuug

SEQ ID NO: 662707 - RNA, 19 nt, Homo sapiens
gaucgacagacauuguuug

SEQ ID NO: 662708 - RNA, 19 nt, Homo sapiens
ggacgagagcgcauaggau

SEQ ID NO: 662709 - RNA, 19 nt, Homo sapiens
agaaauggauauccgaaaa

SEQ ID NO: 662710 - RNA, 19 nt, Homo sapiens
ggaaaauuuuggauaguca

SEQ ID NO: 662711 - RNA, 19 nt, Homo sapiens
ucucuucuuuguacaguug

SEQ ID NO: 662712 - RNA, 19 nt, Homo sapiens
aagcagaagcacaaguuaa

SEQ ID NO: 662713 - RNA, 19 nt, Homo sapiens
ggcagauuaugaagcagaa

SEQ ID NO: 662714 - RNA, 19 nt, Homo sapiens
gaacuggcagauuaugaag

SEQ ID NO: 662715 - RNA, 19 nt, Homo sapiens
agggagauauacauuugaa

SEQ ID NO: 662716 - RNA, 19 nt, Homo sapiens
caaagaugcaagaugacaa

SEQ ID NO: 662717 - RNA, 19 nt, Homo sapiens
gcagaaaacuuagcaagac

SEQ ID NO: 662718 - RNA, 19 nt, Homo sapiens
agaggacaaugcaaaauaa

SEQ ID NO: 662719 - RNA, 19 nt, Homo sapiens
ccaacacuccacucgcuaa

SEQ ID NO: 662720 - RNA, 19 nt, Homo sapiens
ggauggcgcuuuuagauac

SEQ ID NO: 662721 - RNA, 19 nt, Homo sapiens
cggaacaauauguggaaua

SEQ ID NO: 662722 - RNA, 19 nt, Homo sapiens
uguauggcgugacugaaga

SEQ ID NO: 662723 - RNA, 19 nt, Homo sapiens
uaugccaucuaucucugua

SEQ ID NO: 662724 - RNA, 19 nt, Homo sapiens
acacuccacucgcuaagag

SEQ ID NO: 662725 - RNA, 19 nt, Homo sapiens
gaaacaaccccuacaggau

SEQ ID NO: 662726 - RNA, 19 nt, Homo sapiens
acgcacagaucgacagaca

SEQ ID NO: 662727 - RNA, 19 nt, Homo sapiens
gaauaaagcucuguaugua

SEQ ID NO: 662728 - RNA, 19 nt, Homo sapiens
gcugagagcuacauuauaa

SEQ ID NO: 662729 - RNA, 19 nt, Homo sapiens
uaaagaagcuccaaaccua

SEQ ID NO: 662730 - RNA, 19 nt, Homo sapiens
gaccagccauucuauauuu

SEQ ID NO: 662731 - RNA, 19 nt, Homo sapiens
uaaaggaaaugguaacuga

SEQ ID NO: 662732 - RNA, 19 nt, Homo sapiens
cgaaaugacuagcaaauau

SEQ ID NO: 662733 - RNA, 19 nt, Homo sapiens
gcgaagaaauggauaaaug

SEQ ID NO: 662734 - RNA, 19 nt, Homo sapiens
gcaaucaguuuggcaauuu

SEQ ID NO: 662735 - RNA, 19 nt, Homo sapiens
ucaagaaggugaacuaaau

SEQ ID NO: 662736 - RNA, 19 nt, Homo sapiens
ggagauaaaggacaauaua

SEQ ID NO: 662737 - RNA, 19 nt, Homo sapiens
gaagagggacaucaaguaa

SEQ ID NO: 662738 - RNA, 19 nt, Homo sapiens
gaccgucucuuucgaauga

SEQ ID NO: 662739 - RNA, 19 nt, Homo sapiens
guaaggaagucaaauuugu

SEQ ID NO: 662740 - RNA, 19 nt, Homo sapiens
gaaaugauacuuccuuugu

SEQ ID NO: 662741 - RNA, 19 nt, Homo sapiens
gcacaagcaacuaacuuua

SEQ ID NO: 662742 - RNA, 19 nt, Homo sapiens
gguacgacauucuauauug

SEQ ID NO: 662743 - RNA, 19 nt, Homo sapiens
uaaggagccugguucagua

SEQ ID NO: 662744 - RNA, 19 nt, Homo sapiens
uaccaaaucucaauugcua

SEQ ID NO: 662745 - RNA, 19 nt, Homo sapiens
ucaaggagaucauauucaa

SEQ ID NO: 662746 - RNA, 19 nt, Homo sapiens
gaaacaaucauaccaaauc

SEQ ID NO: 662747 - RNA, 19 nt, Homo sapiens
ggacacugauauacugaaa

SEQ ID NO: 662748 - RNA, 19 nt, Homo sapiens
gaaucaagcagcagaauug

SEQ ID NO: 662749 - RNA, 19 nt, Homo sapiens
gcauuuaucucccaugaca

SEQ ID NO: 662750 - RNA, 19 nt, Homo sapiens
ccacucguauuacuguuua

SEQ ID NO: 662751 - RNA, 19 nt, Homo sapiens
gaaggugaacuaaauauuc

SEQ ID NO: 662752 - RNA, 19 nt, Homo sapiens
gaugguggcacuucaauuu

SEQ ID NO: 662753 - RNA, 19 nt, Homo sapiens
caaggaauccauuguguuu

SEQ ID NO: 662754 - RNA, 19 nt, Homo sapiens
ccaaugaccuacaaaucaa

SEQ ID NO: 662755 - RNA, 19 nt, Homo sapiens
gaugaucccuauacacuuc

SEQ ID NO: 662756 - RNA, 19 nt, Homo sapiens
gaaaugguagauacaguuu

SEQ ID NO: 662757 - RNA, 19 nt, Homo sapiens
gaugauaacacuuaccaaa

SEQ ID NO: 662758 - RNA, 19 nt, Homo sapiens
gagaucauauucaacuuuc

SEQ ID NO: 662759 - RNA, 19 nt, Homo sapiens
gggaguauuugaugaguau

SEQ ID NO: 662760 - RNA, 19 nt, Homo sapiens
ccaaacuucuuguugacua

SEQ ID NO: 662761 - RNA, 19 nt, Homo sapiens
ccaggcagaugucauaguu

SEQ ID NO: 662762 - RNA, 19 nt, Homo sapiens
guaccaauauuucugcaau

SEQ ID NO: 662763 - RNA, 19 nt, Homo sapiens
caagaaggugaacuaaaua

SEQ ID NO: 662764 - RNA, 19 nt, Homo sapiens
gauaguacaguuagaaaug

SEQ ID NO: 662765 - RNA, 19 nt, Homo sapiens
gcucuucaguuggaaagua

SEQ ID NO: 662766 - RNA, 19 nt, Homo sapiens
gaucuggguaccaauauuu

SEQ ID NO: 662767 - RNA, 19 nt, Homo sapiens
gagacccugucaaauauga

SEQ ID NO: 662768 - RNA, 19 nt, Homo sapiens
gcaagguccucgauaaagg

SEQ ID NO: 662769 - RNA, 19 nt, Homo sapiens
ggaaaugguagauacaguu

SEQ ID NO: 662770 - RNA, 19 nt, Homo sapiens
gcagcagaauuguacuuga

SEQ ID NO: 662771 - RNA, 19 nt, Homo sapiens
gagcuuauuucaggaaugu

SEQ ID NO: 662772 - RNA, 19 nt, Homo sapiens
aaauacuucuggucugaua

SEQ ID NO: 662773 - RNA, 19 nt, Homo sapiens
ggagaucauauucaacuuu

SEQ ID NO: 662774 - RNA, 19 nt, Homo sapiens
cauaagggacacugauaua

SEQ ID NO: 662775 - RNA, 19 nt, Homo sapiens
cuaauaacuuggcuaccua

SEQ ID NO: 662776 - RNA, 19 nt, Homo sapiens
caaacuucuuguugacuaa

SEQ ID NO: 662777 - RNA, 19 nt, Homo sapiens
ggacuuacagcguucgaaa

SEQ ID NO: 662778 - RNA, 19 nt, Homo sapiens
ucagcaggcucuucaguug

SEQ ID NO: 662779 - RNA, 19 nt, Homo sapiens
cagcagaauuucaucuaga

SEQ ID NO: 662780 - RNA, 19 nt, Homo sapiens
ccaaacaaagagcuuauuu

SEQ ID NO: 662781 - RNA, 19 nt, Homo sapiens
guaguaaggaagucaaauu

SEQ ID NO: 662782 - RNA, 19 nt, Homo sapiens
ggagggucguuuacuguau

SEQ ID NO: 662783 - RNA, 19 nt, Homo sapiens
aaacacagcuaggcuaagu

SEQ ID NO: 662784 - RNA, 19 nt, Homo sapiens
uggagacccugucaaauau

SEQ ID NO: 662785 - RNA, 19 nt, Homo sapiens
cugcaaaccugccucaaga

SEQ ID NO: 662786 - RNA, 19 nt, Homo sapiens
gaaaugacuagcaaauauc

SEQ ID NO: 662787 - RNA, 19 nt, Homo sapiens
uaaagugugcuacaaauuc

SEQ ID NO: 662788 - RNA, 19 nt, Homo sapiens
cagcauuuaucucccauga

SEQ ID NO: 662789 - RNA, 19 nt, Homo sapiens
caauauuucugcaaucagu

SEQ ID NO: 662790 - RNA, 19 nt, Homo sapiens
caagaaugguguucagucu

SEQ ID NO: 662791 - RNA, 19 nt, Homo sapiens
cuggagacccugucaaaua

SEQ ID NO: 662792 - RNA, 19 nt, Homo sapiens
guacauuuaucccaaagag

SEQ ID NO: 662793 - RNA, 19 nt, Homo sapiens
ggaccagccauucuauauu

SEQ ID NO: 662794 - RNA, 19 nt, Homo sapiens
ccuauacacuucaauaugg

SEQ ID NO: 662795 - RNA, 19 nt, Homo sapiens
gaacccagcauuccugauc

SEQ ID NO: 662796 - RNA, 19 nt, Homo sapiens
auacggagaugaucccuau

SEQ ID NO: 662797 - RNA, 19 nt, Homo sapiens
guaccgcgcuaugcugaaa

SEQ ID NO: 662798 - RNA, 19 nt, Homo sapiens
ugaagagggacaucaagua

SEQ ID NO: 662799 - RNA, 19 nt, Homo sapiens
aaugauacuuccuuuguug

SEQ ID NO: 662800 - RNA, 19 nt, Homo sapiens
cagcagaauuguacuugau

SEQ ID NO: 662801 - RNA, 19 nt, Homo sapiens
cuucuggucugauaccuaa

SEQ ID NO: 662802 - RNA, 19 nt, Homo sapiens
guaacagccauuauagaaa

SEQ ID NO: 662803 - RNA, 19 nt, Homo sapiens
ucgaaacaaucauaccaaa

SEQ ID NO: 662804 - RNA, 19 nt, Homo sapiens
cauaguugcugaucuuuac

SEQ ID NO: 662805 - RNA, 19 nt, Homo sapiens
aaagugugcuacaaauuca

SEQ ID NO: 662806 - RNA, 19 nt, Homo sapiens
uuacagcguucgaaacaau

SEQ ID NO: 662807 - RNA, 19 nt, Homo sapiens
gaauaucccagcgaagaaa

SEQ ID NO: 662808 - RNA, 19 nt, Homo sapiens
acacugauauacugaaagu

SEQ ID NO: 662809 - RNA, 19 nt, Homo sapiens
uaacagauggggaagauua

SEQ ID NO: 662810 - RNA, 19 nt, Homo sapiens
gccaaggaauccauugugu

SEQ ID NO: 662811 - RNA, 19 nt, Homo sapiens
ucacugguaacuuugaaua

SEQ ID NO: 662812 - RNA, 19 nt, Homo sapiens
gcacagucauccacaccau

SEQ ID NO: 662813 - RNA, 19 nt, Homo sapiens
gagaugaucccuauacacu

SEQ ID NO: 662814 - RNA, 19 nt, Homo sapiens
ugucauaguugcugaucuu

SEQ ID NO: 662815 - RNA, 19 nt, Homo sapiens
agaauaaagcucuguaugu

SEQ ID NO: 662816 - RNA, 19 nt, Homo sapiens
gcaauuaaucccaguguac

SEQ ID NO: 662817 - RNA, 19 nt, Homo sapiens
agagggacaucaaguaaca

SEQ ID NO: 662818 - RNA, 19 nt, Homo sapiens
uguaacagccauuauagaa

SEQ ID NO: 662819 - RNA, 19 nt, Homo sapiens
aaacacuacugaagcaaca

SEQ ID NO: 662820 - RNA, 19 nt, Homo sapiens
gccucgagguaaaguauuu

SEQ ID NO: 662821 - RNA, 19 nt, Homo sapiens
gaacccauccaaaccugaa

SEQ ID NO: 662822 - RNA, 19 nt, Homo sapiens
ggacaucaaguaacauugg

SEQ ID NO: 662823 - RNA, 19 nt, Homo sapiens
aaauuuaccucguccuaca

SEQ ID NO: 662824 - RNA, 19 nt, Homo sapiens
caugagcucugaagauuuu

SEQ ID NO: 662825 - RNA, 19 nt, Homo sapiens
acaagauguuccacucgua

SEQ ID NO: 662826 - RNA, 19 nt, Homo sapiens
gagccugguucaguagaaa

SEQ ID NO: 662827 - RNA, 19 nt, Homo sapiens
gcaaggagccuguuaguuu

SEQ ID NO: 662828 - RNA, 19 nt, Homo sapiens
gagcaaagccuuauuuaaa

SEQ ID NO: 662829 - RNA, 19 nt, Homo sapiens
caaggagccuguuaguuua

SEQ ID NO: 662830 - RNA, 19 nt, Homo sapiens
cuucaaaccucuagaguua

SEQ ID NO: 662831 - RNA, 19 nt, Homo sapiens
gaacuaaggaugucaugua

SEQ ID NO: 662832 - RNA, 19 nt, Homo sapiens
gaacuuggaagauauuuga

SEQ ID NO: 662833 - RNA, 19 nt, Homo sapiens
ggaauucaaccuugucuaa

SEQ ID NO: 662834 - RNA, 19 nt, Homo sapiens
cauguacucucaucuaauu

SEQ ID NO: 662835 - RNA, 19 nt, Homo sapiens
gagagugucaccuccauua

SEQ ID NO: 662836 - RNA, 19 nt, Homo sapiens
caacgagaaucgcauggaa

SEQ ID NO: 662837 - RNA, 19 nt, Homo sapiens
cagaagaugugauuugcaa

SEQ ID NO: 662838 - RNA, 19 nt, Homo sapiens
gauggaacuuggaagauau

SEQ ID NO: 662839 - RNA, 19 nt, Homo sapiens
gagagcaaagccuuauuua

SEQ ID NO: 662840 - RNA, 19 nt, Homo sapiens
uaacagaagaugugauuug

SEQ ID NO: 662841 - RNA, 19 nt, Homo sapiens
ugauggaacuuggaagaua

SEQ ID NO: 662842 - RNA, 19 nt, Homo sapiens
ggaagagagcaaagccuua

SEQ ID NO: 662843 - RNA, 19 nt, Homo sapiens
gcugggaacuggugaaagu

SEQ ID NO: 662844 - RNA, 19 nt, Homo sapiens
guccuuacaucccaaauug

SEQ ID NO: 662845 - RNA, 19 nt, Homo sapiens
cuaaggaugucauguagau

SEQ ID NO: 662846 - RNA, 19 nt, Homo sapiens
gaagagagcaaagccuuau

SEQ ID NO: 662847 - RNA, 19 nt, Homo sapiens
ucaagcagaugagaauuau

SEQ ID NO: 662848 - RNA, 19 nt, Homo sapiens
uuaauggguuugaagcuuu

SEQ ID NO: 662849 - RNA, 19 nt, Homo sapiens
ccagagacuuuauccugaa

SEQ ID NO: 662850 - RNA, 19 nt, Homo sapiens
ccaccggcaucauugagua

SEQ ID NO: 662851 - RNA, 19 nt, Homo sapiens
agugucaccuccauuauuu

SEQ ID NO: 662852 - RNA, 19 nt, Homo sapiens
ucaagcagcucuggcaaga

SEQ ID NO: 662853 - RNA, 19 nt, Homo sapiens
ucaaaccucuagaguuaau

SEQ ID NO: 662854 - RNA, 19 nt, Homo sapiens
agacacaauucuacagcua

SEQ ID NO: 662855 - RNA, 19 nt, Homo sapiens
cuacagauacagacaauau

SEQ ID NO: 662856 - RNA, 19 nt, Homo sapiens
caucuacucucacuucaca

SEQ ID NO: 662857 - RNA, 19 nt, Homo sapiens
uaaggaaaaugcccagaua

SEQ ID NO: 662858 - RNA, 19 nt, Homo sapiens
ccaaauauuaccugacuga

SEQ ID NO: 662859 - RNA, 19 nt, Homo sapiens
gaaagacggaaguggauuc

SEQ ID NO: 662860 - RNA, 19 nt, Homo sapiens
gaaaaugcccagauaauca

SEQ ID NO: 662861 - RNA, 19 nt, Homo sapiens
acacaauucuacagcuaaa

SEQ ID NO: 662862 - RNA, 19 nt, Homo sapiens
ccuguuaguuuauagauca

SEQ ID NO: 662863 - RNA, 19 nt, Homo sapiens
gaguuuaccaacauacuuu

SEQ ID NO: 662864 - RNA, 19 nt, Homo sapiens
ggaagauauuugaguuuac

SEQ ID NO: 662865 - RNA, 19 nt, Homo sapiens
gaauucaaccuugucuaaa

SEQ ID NO: 662866 - RNA, 19 nt, Homo sapiens
aauauucgcuuuguguuug

SEQ ID NO: 662867 - RNA, 19 nt, Homo sapiens
gacuuuauccugaagcuuu

SEQ ID NO: 662868 - RNA, 19 nt, Homo sapiens
gagaaucgcauggaagaga

SEQ ID NO: 662869 - RNA, 19 nt, Homo sapiens
gauaaucagagaaguggaa

SEQ ID NO: 662870 - RNA, 19 nt, Homo sapiens
gauggacacgcuaaggaua

SEQ ID NO: 662871 - RNA, 19 nt, Homo sapiens
guaagcaaggagccuguua

SEQ ID NO: 662872 - RNA, 19 nt, Homo sapiens
caucccaaauuguguuuau

SEQ ID NO: 662873 - RNA, 19 nt, Homo sapiens
gcaagugcuucugacauca

SEQ ID NO: 662874 - RNA, 19 nt, Homo sapiens
uggauucacugcuuugaga

SEQ ID NO: 662875 - RNA, 19 nt, Homo sapiens
caucauugaguauccauuu

SEQ ID NO: 662876 - RNA, 19 nt, Homo sapiens
aauauuaccugacugacau

SEQ ID NO: 662877 - RNA, 19 nt, Homo sapiens
caauauucgcuuuguguuu

SEQ ID NO: 662878 - RNA, 19 nt, Homo sapiens
guuaauggguuugaagcuu

SEQ ID NO: 662879 - RNA, 19 nt, Homo sapiens
gaauguuaauggguuugaa

SEQ ID NO: 662880 - RNA, 19 nt, Homo sapiens
agaaagucaucuacucuca

SEQ ID NO: 662881 - RNA, 19 nt, Homo sapiens
acaaagagaaagucaucua

SEQ ID NO: 662882 - RNA, 19 nt, Homo sapiens
gucggacucugccaaauau

SEQ ID NO: 662883 - RNA, 19 nt, Homo sapiens
guaugugugugaacagaau

SEQ ID NO: 662884 - RNA, 19 nt, Homo sapiens
uauagaucaugccuucaaa

SEQ ID NO: 662885 - RNA, 19 nt, Homo sapiens
gagugucaccuccauuauu

SEQ ID NO: 662886 - RNA, 19 nt, Homo sapiens
gaagauauuugaguuuacc

SEQ ID NO: 662887 - RNA, 19 nt, Homo sapiens
cggacucugccaaauauua

SEQ ID NO: 662888 - RNA, 19 nt, Homo sapiens
aagcagcucuggcaagauc

SEQ ID NO: 662889 - RNA, 19 nt, Homo sapiens
gcaccuuuaucaagcagau

SEQ ID NO: 662890 - RNA, 19 nt, Homo sapiens
cagcuaaaccuaagggaau

SEQ ID NO: 662891 - RNA, 19 nt, Homo sapiens
ggagaucgagcgacagcuu

SEQ ID NO: 662892 - RNA, 19 nt, Homo sapiens
gaagaugugauuugcaaac

SEQ ID NO: 662893 - RNA, 19 nt, Homo sapiens
agagagcaaagccuuauuu

SEQ ID NO: 662894 - RNA, 19 nt, Homo sapiens
acucucaucuaauuagcua

SEQ ID NO: 662895 - RNA, 19 nt, Homo sapiens
agagcaaagccuuauuuaa

SEQ ID NO: 662896 - RNA, 19 nt, Homo sapiens
ggaaagacggaaguggauu

SEQ ID NO: 662897 - RNA, 19 nt, Homo sapiens
cuuggaagauauuugaguu

SEQ ID NO: 662898 - RNA, 19 nt, Homo sapiens
gacacaauucuacagcuaa

SEQ ID NO: 662899 - RNA, 19 nt, Homo sapiens
uccugaagcuuuaccaaga

SEQ ID NO: 662900 - RNA, 19 nt, Homo sapiens
uuacagcgacgaagacaga

SEQ ID NO: 662901 - RNA, 19 nt, Homo sapiens
ugucggacucugccaaaua

SEQ ID NO: 662902 - RNA, 19 nt, Homo sapiens
ggugauggaacuuggaaga

SEQ ID NO: 662903 - RNA, 19 nt, Homo sapiens
uacagacaauauucgcuuu

SEQ ID NO: 662904 - RNA, 19 nt, Homo sapiens
aagagaaagucaucuacuc

SEQ ID NO: 662905 - RNA, 19 nt, Homo sapiens
aaucauguacucucaucua

SEQ ID NO: 662906 - RNA, 19 nt, Homo sapiens
agagaugggugauggaacu

SEQ ID NO: 662907 - RNA, 19 nt, Homo sapiens
aauuagcuauuucccagaa

SEQ ID NO: 662908 - RNA, 19 nt, Homo sapiens
ggaacuuggaagauauuug

SEQ ID NO: 662909 - RNA, 19 nt, Homo sapiens
cauauucaccgccaugcaa

SEQ ID NO: 662910 - RNA, 19 nt, Homo sapiens
ucaaagacacaauucuaca

SEQ ID NO: 662911 - RNA, 19 nt, Homo sapiens
caaagagaaagucaucuac

SEQ ID NO: 662912 - RNA, 19 nt, Homo sapiens
acuuuauccugaagcuuua

SEQ ID NO: 662913 - RNA, 19 nt, Homo sapiens
ggacucugccaaauauuac

SEQ ID NO: 662914 - RNA, 19 nt, Homo sapiens
gcgauggacacgcuaagga

SEQ ID NO: 662915 - RNA, 19 nt, Homo sapiens
acagauacagacaauauuc

SEQ ID NO: 662916 - RNA, 19 nt, Homo sapiens
ucacaugugcuacagauac

SEQ ID NO: 662917 - RNA, 19 nt, Homo sapiens
aaagucaucuacucucacu

SEQ ID NO: 662918 - RNA, 19 nt, Homo sapiens
ccagauaaucagagaagug

SEQ ID NO: 662919 - RNA, 19 nt, Homo sapiens
ugcaagugcuucugacauc

SEQ ID NO: 662920 - RNA, 19 nt, Homo sapiens
agaauacacaggaccgaaa

SEQ ID NO: 662921 - RNA, 19 nt, Homo sapiens
ugguugcucugagugaaua

SEQ ID NO: 662922 - RNA, 19 nt, Homo sapiens
gcccaccaccggcaucauu

SEQ ID NO: 662923 - RNA, 19 nt, Homo sapiens
gaguuaauuugggugacuu

SEQ ID NO: 662924 - RNA, 19 nt, Homo sapiens
aagccacuuugauuuaguu

SEQ ID NO: 662925 - RNA, 19 nt, Homo sapiens
uuaaaaccaucaucaccua

SEQ ID NO: 662926 - RNA, 19 nt, Homo sapiens
ucauugaguauccauuuga

SEQ ID NO: 662927 - RNA, 19 nt, Homo sapiens
gagaagagauugaaagauu

SEQ ID NO: 662928 - RNA, 19 nt, Homo sapiens
gaacaucaauucacuauca

SEQ ID NO: 662929 - RNA, 19 nt, Homo sapiens
gaggagaccuugccuauuu

SEQ ID NO: 662930 - RNA, 19 nt, Homo sapiens
ggaauuugcugacccauuu

SEQ ID NO: 662931 - RNA, 19 nt, Homo sapiens
gaacagaaguuucaguaau

SEQ ID NO: 662932 - RNA, 19 nt, Homo sapiens
gaugagcucuuuaguauug

SEQ ID NO: 662933 - RNA, 19 nt, Homo sapiens
gaaagaauguuaagggaau

SEQ ID NO: 662934 - RNA, 19 nt, Homo sapiens
gcaaacagguucuggaguu

SEQ ID NO: 662935 - RNA, 19 nt, Homo sapiens
gcacagaaauuucacuuca

SEQ ID NO: 662936 - RNA, 19 nt, Homo sapiens
guacauagagcucuuuaua

SEQ ID NO: 662937 - RNA, 19 nt, Homo sapiens
ggaaaagccuucaaaagua

SEQ ID NO: 662938 - RNA, 19 nt, Homo sapiens
ggacucagcuaugcuaauu

SEQ ID NO: 662939 - RNA, 19 nt, Homo sapiens
caaauaugcugaguaauga

SEQ ID NO: 662940 - RNA, 19 nt, Homo sapiens
gaggauaugcugagauuua

SEQ ID NO: 662941 - RNA, 19 nt, Homo sapiens
gaaaggagaagauuuacaa

SEQ ID NO: 662942 - RNA, 19 nt, Homo sapiens
uagaacggcuucauuaauu

SEQ ID NO: 662943 - RNA, 19 nt, Homo sapiens
ggacauaugcaguguaauu

SEQ ID NO: 662944 - RNA, 19 nt, Homo sapiens
aaacagaguucguuauaug

SEQ ID NO: 662945 - RNA, 19 nt, Homo sapiens
guacauugcucgagccauu

SEQ ID NO: 662946 - RNA, 19 nt, Homo sapiens
guauugcccuuuauaauug

SEQ ID NO: 662947 - RNA, 19 nt, Homo sapiens
gaagaucaccaccuuuaaa

SEQ ID NO: 662948 - RNA, 19 nt, Homo sapiens
gaaauuuguucuccucuca

SEQ ID NO: 662949 - RNA, 19 nt, Homo sapiens
gaugacagcugguguugau

SEQ ID NO: 662950 - RNA, 19 nt, Homo sapiens
gaaaggauggcuguuuaua

SEQ ID NO: 662951 - RNA, 19 nt, Homo sapiens
acaauaacuuccacugaua

SEQ ID NO: 662952 - RNA, 19 nt, Homo sapiens
uauggaaacuucuuuguga

SEQ ID NO: 662953 - RNA, 19 nt, Homo sapiens
ggaacaccgucucauggua

SEQ ID NO: 662954 - RNA, 19 nt, Homo sapiens
gcgaggauaugcugagauu

SEQ ID NO: 662955 - RNA, 19 nt, Homo sapiens
gauauacuuucauccguuu

SEQ ID NO: 662956 - RNA, 19 nt, Homo sapiens
ggcaagauaucauagagaa

SEQ ID NO: 662957 - RNA, 19 nt, Homo sapiens
gggaaucauuaaaggaaua

SEQ ID NO: 662958 - RNA, 19 nt, Homo sapiens
gcaggaauuucuagacaga

SEQ ID NO: 662959 - RNA, 19 nt, Homo sapiens
uggaaaggauggcuguuua

SEQ ID NO: 662960 - RNA, 19 nt, Homo sapiens
gagaaagaauugagugaca

SEQ ID NO: 662961 - RNA, 19 nt, Homo sapiens
ccaaauaugcugaguaaug

SEQ ID NO: 662962 - RNA, 19 nt, Homo sapiens
gaacugguaaaucaaagua

SEQ ID NO: 662963 - RNA, 19 nt, Homo sapiens
uauauucucuuccuacuga

SEQ ID NO: 662964 - RNA, 19 nt, Homo sapiens
ggaugugggcuucguaaua

SEQ ID NO: 662965 - RNA, 19 nt, Homo sapiens
acauugagcuccucggaua

SEQ ID NO: 662966 - RNA, 19 nt, Homo sapiens
gagaagaacagaaguuuca

SEQ ID NO: 662967 - RNA, 19 nt, Homo sapiens
caacucaggccacaaauau

SEQ ID NO: 662968 - RNA, 19 nt, Homo sapiens
gagaaucccagccaaguuu

SEQ ID NO: 662969 - RNA, 19 nt, Homo sapiens
aggaugagcucuuuaguau

SEQ ID NO: 662970 - RNA, 19 nt, Homo sapiens
gcaaucaaguggaccuuuc

SEQ ID NO: 662971 - RNA, 19 nt, Homo sapiens
caggauaucugcccacuuc

SEQ ID NO: 662972 - RNA, 19 nt, Homo sapiens
uacaagaacuaaaggguuu

SEQ ID NO: 662973 - RNA, 19 nt, Homo sapiens
gaccagagauuguguacuc

SEQ ID NO: 662974 - RNA, 19 nt, Homo sapiens
agaacggcuucauuaauua

SEQ ID NO: 662975 - RNA, 19 nt, Homo sapiens
gaacagcagguuuguacuu

SEQ ID NO: 662976 - RNA, 19 nt, Homo sapiens
gcacugaugaugcaauuug

SEQ ID NO: 662977 - RNA, 19 nt, Homo sapiens
guucuggaguucuuaauga

SEQ ID NO: 662978 - RNA, 19 nt, Homo sapiens
gaagaagcaggacaucauu

SEQ ID NO: 662979 - RNA, 19 nt, Homo sapiens
caacugaggcaucuacuug

SEQ ID NO: 662980 - RNA, 19 nt, Homo sapiens
acauagagcucuuuauagu

SEQ ID NO: 662981 - RNA, 19 nt, Homo sapiens
gaccaucgaucguucuguu

SEQ ID NO: 662982 - RNA, 19 nt, Homo sapiens
gcauuaauugcuucucuua

SEQ ID NO: 662983 - RNA, 19 nt, Homo sapiens
uaaaggguuugcaggaauu

SEQ ID NO: 662984 - RNA, 19 nt, Homo sapiens
agagaucacugcaauugaa

SEQ ID NO: 662985 - RNA, 19 nt, Homo sapiens
gggacaagauggacaagga

SEQ ID NO: 662986 - RNA, 19 nt, Homo sapiens
acagguugcuucuccauuu

SEQ ID NO: 662987 - RNA, 19 nt, Homo sapiens
ggauggcuguuuauaugaa

SEQ ID NO: 662988 - RNA, 19 nt, Homo sapiens
ucuaugagcucgucaguag

SEQ ID NO: 662989 - RNA, 19 nt, Homo sapiens
gauagaaugcaugcucuua

SEQ ID NO: 662990 - RNA, 19 nt, Homo sapiens
cauuugggaugcaagcuua

SEQ ID NO: 662991 - RNA, 19 nt, Homo sapiens
gcacagaugagauuuccaa

SEQ ID NO: 662992 - RNA, 19 nt, Homo sapiens
ccaaauagcagugauugaa

SEQ ID NO: 662993 - RNA, 19 nt, Homo sapiens
gcagggugguuuagccaaa

SEQ ID NO: 662994 - RNA, 19 nt, Homo sapiens
aaggauggcuguuuauaug

SEQ ID NO: 662995 - RNA, 19 nt, Homo sapiens
uaagauauguugagaaucc

SEQ ID NO: 662996 - RNA, 19 nt, Homo sapiens
gcaacucaggccacaaaua

SEQ ID NO: 662997 - RNA, 19 nt, Homo sapiens
gauuuacucuggcgguauu

SEQ ID NO: 662998 - RNA, 19 nt, Homo sapiens
gggaggagauggagaagag

SEQ ID NO: 662999 - RNA, 19 nt, Homo sapiens
ugcgauagaugaauugaaa

SEQ ID NO: 663000 - RNA, 19 nt, Homo sapiens
ggucauuccugggcucuuu

SEQ ID NO: 663001 - RNA, 19 nt, Homo sapiens
gaugugggcuucguaauac

SEQ ID NO: 663002 - RNA, 19 nt, Homo sapiens
cagcagguuuguacuuuga

SEQ ID NO: 663003 - RNA, 19 nt, Homo sapiens
ccacugccauuucaucaau

SEQ ID NO: 663004 - RNA, 19 nt, Homo sapiens
gcaugucagauauggauua

SEQ ID NO: 663005 - RNA, 19 nt, Homo sapiens
acagagagaucacugcaau

SEQ ID NO: 663006 - RNA, 19 nt, Homo sapiens
gagauuguguacucuggaa

SEQ ID NO: 663007 - RNA, 19 nt, Homo sapiens
gaacaccgucucaugguau

SEQ ID NO: 663008 - RNA, 19 nt, Homo sapiens
cauguuaccuccgaagaaa

SEQ ID NO: 663009 - RNA, 19 nt, Homo sapiens
aaacaaggaucauauucca

SEQ ID NO: 663010 - RNA, 19 nt, Homo sapiens
acaugcagguguuagguua

SEQ ID NO: 663011 - RNA, 19 nt, Homo sapiens
gauccuauucuucaaauug

SEQ ID NO: 663012 - RNA, 19 nt, Homo sapiens
ugugaaaggagaagauuua

SEQ ID NO: 663013 - RNA, 19 nt, Homo sapiens
ucgccugacuuccuaauuu

SEQ ID NO: 663014 - RNA, 19 nt, Homo sapiens
gcaguguaauugcaugaug

SEQ ID NO: 663015 - RNA, 19 nt, Homo sapiens
gaaugaaauuggaguacca

SEQ ID NO: 663016 - RNA, 19 nt, Homo sapiens
gcugacccauuuaaacuug

SEQ ID NO: 663017 - RNA, 19 nt, Homo sapiens
caagaacugguaaaucaaa

SEQ ID NO: 663018 - RNA, 19 nt, Homo sapiens
uucaagaacugguaaauca

SEQ ID NO: 663019 - RNA, 19 nt, Homo sapiens
cuucaggccuuccaagaaa

SEQ ID NO: 663020 - RNA, 19 nt, Homo sapiens
gagauaaugccgcuguuga

SEQ ID NO: 663021 - RNA, 19 nt, Homo sapiens
gaucaccaccuuuaaagau

SEQ ID NO: 663022 - RNA, 19 nt, Homo sapiens
ggaaacauuugggaugcaa

SEQ ID NO: 663023 - RNA, 19 nt, Homo sapiens
gguagucccuauccaaauc

SEQ ID NO: 663024 - RNA, 19 nt, Homo sapiens
cagaugagauuuccaacca

SEQ ID NO: 663025 - RNA, 19 nt, Homo sapiens
ccgcuuaccuccuggauuc

SEQ ID NO: 663026 - RNA, 19 nt, Homo sapiens
caaauagcagugauugaaa

SEQ ID NO: 663027 - RNA, 19 nt, Homo sapiens
gagaagagauugaaagauu

SEQ ID NO: 663028 - RNA, 19 nt, Homo sapiens
gaacaucaauucacuauca

SEQ ID NO: 663029 - RNA, 19 nt, Homo sapiens
gaggagaccuugccuauuu

SEQ ID NO: 663030 - RNA, 19 nt, Homo sapiens
ggaauuugcugacccauuu

SEQ ID NO: 663031 - RNA, 19 nt, Homo sapiens
gaacagaaguuucaguaau

SEQ ID NO: 663032 - RNA, 19 nt, Homo sapiens
gaucuaagcuaacuucuug

SEQ ID NO: 663033 - RNA, 19 nt, Homo sapiens
gaugagcucuuuaguauug

SEQ ID NO: 663034 - RNA, 19 nt, Homo sapiens
gaaagaauguuaagggaau

SEQ ID NO: 663035 - RNA, 19 nt, Homo sapiens
gcaaacagguucuggaguu

SEQ ID NO: 663036 - RNA, 19 nt, Homo sapiens
gcacagaaauuucacuuca

SEQ ID NO: 663037 - RNA, 19 nt, Homo sapiens
guacauagagcucuuuaua

SEQ ID NO: 663038 - RNA, 19 nt, Homo sapiens
ggaaaagccuucaaaagua

SEQ ID NO: 663039 - RNA, 19 nt, Homo sapiens
ggacucagcuaugcuaauu

SEQ ID NO: 663040 - RNA, 19 nt, Homo sapiens
caaauaugcugaguaauga

SEQ ID NO: 663041 - RNA, 19 nt, Homo sapiens
gaaaggagaagauuuacaa

SEQ ID NO: 663042 - RNA, 19 nt, Homo sapiens
uagaacggcuucauuaauu

SEQ ID NO: 663043 - RNA, 19 nt, Homo sapiens
ggacauaugcaguguaauu

SEQ ID NO: 663044 - RNA, 19 nt, Homo sapiens
aaacagaguucguuauaug

SEQ ID NO: 663045 - RNA, 19 nt, Homo sapiens
guacauugcucgagccauu

SEQ ID NO: 663046 - RNA, 19 nt, Homo sapiens
guauugcccuuuauaauug

SEQ ID NO: 663047 - RNA, 19 nt, Homo sapiens
gaagaucaccaccuuuaaa

SEQ ID NO: 663048 - RNA, 19 nt, Homo sapiens
gaaauuuguucuccucuca

SEQ ID NO: 663049 - RNA, 19 nt, Homo sapiens
gaugacagcugguguugau

SEQ ID NO: 663050 - RNA, 19 nt, Homo sapiens
gaaaggauggcuguuuaua

SEQ ID NO: 663051 - RNA, 19 nt, Homo sapiens
acaauaacuuccacugaua

SEQ ID NO: 663052 - RNA, 19 nt, Homo sapiens
uauggaaacuucuuuguga

SEQ ID NO: 663053 - RNA, 19 nt, Homo sapiens
ggaacaccgucucauggua

SEQ ID NO: 663054 - RNA, 19 nt, Homo sapiens
gauauacuuucauccguuu

SEQ ID NO: 663055 - RNA, 19 nt, Homo sapiens
ggcaagauaucauagagaa

SEQ ID NO: 663056 - RNA, 19 nt, Homo sapiens
gggaaucauuaaaggaaua

SEQ ID NO: 663057 - RNA, 19 nt, Homo sapiens
gcaggaauuucuagacaga

SEQ ID NO: 663058 - RNA, 19 nt, Homo sapiens
uggaaaggauggcuguuua

SEQ ID NO: 663059 - RNA, 19 nt, Homo sapiens
gagaaagaauugagugaca

SEQ ID NO: 663060 - RNA, 19 nt, Homo sapiens
ccaaauaugcugaguaaug

SEQ ID NO: 663061 - RNA, 19 nt, Homo sapiens
gaacugguaaaucaaagua

SEQ ID NO: 663062 - RNA, 19 nt, Homo sapiens
uauauucucuuccuacuga

SEQ ID NO: 663063 - RNA, 19 nt, Homo sapiens
ggaugugggcuucguaaua

SEQ ID NO: 663064 - RNA, 19 nt, Homo sapiens
acauugagcuccucggaua

SEQ ID NO: 663065 - RNA, 19 nt, Homo sapiens
gagaagaacagaaguuuca

SEQ ID NO: 663066 - RNA, 19 nt, Homo sapiens
caacucaggccacaaauau

SEQ ID NO: 663067 - RNA, 19 nt, Homo sapiens
gagaaucccagccaaguuu

SEQ ID NO: 663068 - RNA, 19 nt, Homo sapiens
aggaugagcucuuuaguau

SEQ ID NO: 663069 - RNA, 19 nt, Homo sapiens
gcaaucaaguggaccuuuc

SEQ ID NO: 663070 - RNA, 19 nt, Homo sapiens
caggauaucugcccacuuc

SEQ ID NO: 663071 - RNA, 19 nt, Homo sapiens
uacaagaacuaaaggguuu

SEQ ID NO: 663072 - RNA, 19 nt, Homo sapiens
gaccagagauuguguacuc

SEQ ID NO: 663073 - RNA, 19 nt, Homo sapiens
agaacggcuucauuaauua

SEQ ID NO: 663074 - RNA, 19 nt, Homo sapiens
gaacagcagguuuguacuu

SEQ ID NO: 663075 - RNA, 19 nt, Homo sapiens
gcacugaugaugcaauuug

SEQ ID NO: 663076 - RNA, 19 nt, Homo sapiens
guucuggaguucuuaauga

SEQ ID NO: 663077 - RNA, 19 nt, Homo sapiens
caaauaaucccaccguuuc

SEQ ID NO: 663078 - RNA, 19 nt, Homo sapiens
gaagaagcaggacaucauu

SEQ ID NO: 663079 - RNA, 19 nt, Homo sapiens
caacugaggcaucuacuug

SEQ ID NO: 663080 - RNA, 19 nt, Homo sapiens
acauagagcucuuuauagu

SEQ ID NO: 663081 - RNA, 19 nt, Homo sapiens
gaccaucgaucguucuguu

SEQ ID NO: 663082 - RNA, 19 nt, Homo sapiens
gcauuaauugcuucucuua

SEQ ID NO: 663083 - RNA, 19 nt, Homo sapiens
uaaaggguuugcaggaauu

SEQ ID NO: 663084 - RNA, 19 nt, Homo sapiens
agagaucacugcaauugaa

SEQ ID NO: 663085 - RNA, 19 nt, Homo sapiens
gggacaagauggacaagga

SEQ ID NO: 663086 - RNA, 19 nt, Homo sapiens
acagguugcuucuccauuu

SEQ ID NO: 663087 - RNA, 19 nt, Homo sapiens
ggauggcuguuuauaugaa

SEQ ID NO: 663088 - RNA, 19 nt, Homo sapiens
ucuaugagcucgucaguag

SEQ ID NO: 663089 - RNA, 19 nt, Homo sapiens
gauagaaugcaugcucuua

SEQ ID NO: 663090 - RNA, 19 nt, Homo sapiens
cauuugggaugcaagcuua

SEQ ID NO: 663091 - RNA, 19 nt, Homo sapiens
gcacagaugagauuuccaa

SEQ ID NO: 663092 - RNA, 19 nt, Homo sapiens
ccaaauagcagugauugaa

SEQ ID NO: 663093 - RNA, 19 nt, Homo sapiens
gcagggugguuuagccaaa

SEQ ID NO: 663094 - RNA, 19 nt, Homo sapiens
aaggauggcuguuuauaug

SEQ ID NO: 663095 - RNA, 19 nt, Homo sapiens
uaagauauguugagaaucc

SEQ ID NO: 663096 - RNA, 19 nt, Homo sapiens
gagaugccgucuucuuugu

SEQ ID NO: 663097 - RNA, 19 nt, Homo sapiens
gcaacucaggccacaaaua

SEQ ID NO: 663098 - RNA, 19 nt, Homo sapiens
gauuuacucuggcgguauu

SEQ ID NO: 663099 - RNA, 19 nt, Homo sapiens
gggaggagauggagaagag

SEQ ID NO: 663100 - RNA, 19 nt, Homo sapiens
ugcgauagaugaauugaaa

SEQ ID NO: 663101 - RNA, 19 nt, Homo sapiens
ggucauuccugggcucuuu

SEQ ID NO: 663102 - RNA, 19 nt, Homo sapiens
ccaaauaaucccaccguuu

SEQ ID NO: 663103 - RNA, 19 nt, Homo sapiens
gaugugggcuucguaauac

SEQ ID NO: 663104 - RNA, 19 nt, Homo sapiens
cagcagguuuguacuuuga

SEQ ID NO: 663105 - RNA, 19 nt, Homo sapiens
ccacugccauuucaucaau

SEQ ID NO: 663106 - RNA, 19 nt, Homo sapiens
acagagagaucacugcaau

SEQ ID NO: 663107 - RNA, 19 nt, Homo sapiens
gagauuguguacucuggaa

SEQ ID NO: 663108 - RNA, 19 nt, Homo sapiens
gaacaccgucucaugguau

SEQ ID NO: 663109 - RNA, 19 nt, Homo sapiens
cauguuaccuccgaagaaa

SEQ ID NO: 663110 - RNA, 19 nt, Homo sapiens
aaacaaggaucauauucca

SEQ ID NO: 663111 - RNA, 19 nt, Homo sapiens
gcuaacuucuuggaucuuu

SEQ ID NO: 663112 - RNA, 19 nt, Homo sapiens
acaugcagguguuagguua

SEQ ID NO: 663113 - RNA, 19 nt, Homo sapiens
gauccuauucuucaaauug

SEQ ID NO: 663114 - RNA, 19 nt, Homo sapiens
gcaugucagauauggauua

SEQ ID NO: 663115 - RNA, 19 nt, Homo sapiens
ugugaaaggagaagauuua

SEQ ID NO: 663116 - RNA, 19 nt, Homo sapiens
gcaguguaauugcaugaug

SEQ ID NO: 663117 - RNA, 19 nt, Homo sapiens
gaaugaaauuggaguacca

SEQ ID NO: 663118 - RNA, 19 nt, Homo sapiens
gcugacccauuuaaacuug

SEQ ID NO: 663119 - RNA, 19 nt, Homo sapiens
caagaacugguaaaucaaa

SEQ ID NO: 663120 - RNA, 19 nt, Homo sapiens
uucaagaacugguaaauca

SEQ ID NO: 663121 - RNA, 19 nt, Homo sapiens
cuucaggccuuccaagaaa

SEQ ID NO: 663122 - RNA, 19 nt, Homo sapiens
gagauaaugccgcuguuga

SEQ ID NO: 663123 - RNA, 19 nt, Homo sapiens
gaucaccaccuuuaaagau

SEQ ID NO: 663124 - RNA, 19 nt, Homo sapiens
ggaaacauuugggaugcaa

SEQ ID NO: 663125 - RNA, 19 nt, Homo sapiens
gguagucccuauccaaauc

SEQ ID NO: 663126 - RNA, 19 nt, Homo sapiens
cagaugagauuuccaacca

SEQ ID NO: 663127 - RNA, 19 nt, Homo sapiens
gaauguagcuucucaguuc

SEQ ID NO: 663128 - RNA, 19 nt, Homo sapiens
gcaaacguguggaugcuua

SEQ ID NO: 663129 - RNA, 19 nt, Homo sapiens
gagcugaagucacuacuga

SEQ ID NO: 663130 - RNA, 19 nt, Homo sapiens
cuacaaauaugcuuccuuu

SEQ ID NO: 663131 - RNA, 19 nt, Homo sapiens
ggaagugugaggauuauua

SEQ ID NO: 663132 - RNA, 19 nt, Homo sapiens
gcacagagaucccgguaca

SEQ ID NO: 663133 - RNA, 19 nt, Homo sapiens
ggaaacagagacaguauuu

SEQ ID NO: 663134 - RNA, 19 nt, Homo sapiens
ccaaggagauguacagaau

SEQ ID NO: 663135 - RNA, 19 nt, Homo sapiens
gagguuagcagucaaguuu

SEQ ID NO: 663136 - RNA, 19 nt, Homo sapiens
cagggaagcucuuucuauu

SEQ ID NO: 663137 - RNA, 19 nt, Homo sapiens
gaugaucacuccguggaua

SEQ ID NO: 663138 - RNA, 19 nt, Homo sapiens
ggacaccgcuugggcuuug

SEQ ID NO: 663139 - RNA, 19 nt, Homo sapiens
acaggaagcugaucaauac

SEQ ID NO: 663140 - RNA, 19 nt, Homo sapiens
caucaggacuggucuuguu

SEQ ID NO: 663141 - RNA, 19 nt, Homo sapiens
gggccaagcuccacuguuc

SEQ ID NO: 663142 - RNA, 19 nt, Homo sapiens
uuacuaagauccuguggaa

SEQ ID NO: 663143 - RNA, 19 nt, Homo sapiens
ccagaagguuguuggcuuu

SEQ ID NO: 663144 - RNA, 19 nt, Homo sapiens
gaagugugaggauuauuaa

SEQ ID NO: 663145 - RNA, 19 nt, Homo sapiens
ggaagcugaucaauacaga

SEQ ID NO: 663146 - RNA, 19 nt, Homo sapiens
gacaggaagcugaucaaua

SEQ ID NO: 663147 - RNA, 19 nt, Homo sapiens
gauaaggugagaucaaauu

SEQ ID NO: 663148 - RNA, 19 nt, Homo sapiens
guaccaggcuaucagcaaa

SEQ ID NO: 663149 - RNA, 19 nt, Homo sapiens
guucgaggccucauugaua

SEQ ID NO: 663150 - RNA, 19 nt, Homo sapiens
gaagagcgucuaagcaaug

SEQ ID NO: 663151 - RNA, 19 nt, Homo sapiens
gcccaaggcugcuguguag

SEQ ID NO: 663152 - RNA, 19 nt, Homo sapiens
gccuuuaucuucaugauug

SEQ ID NO: 663153 - RNA, 19 nt, Homo sapiens
gcacaucugacauggcuaa

SEQ ID NO: 663154 - RNA, 19 nt, Homo sapiens
cuacugagcuaaagcaagu

SEQ ID NO: 663155 - RNA, 19 nt, Homo sapiens
ugaagcuacucccaguuua

SEQ ID NO: 663156 - RNA, 19 nt, Homo sapiens
gacaguauuuguaccaguu

SEQ ID NO: 663157 - RNA, 19 nt, Homo sapiens
acaauaaggugcuccacuu

SEQ ID NO: 663158 - RNA, 19 nt, Homo sapiens
gcagggaagcucuuucuau

SEQ ID NO: 663159 - RNA, 19 nt, Homo sapiens
guagauuacugcaagaaca

SEQ ID NO: 663160 - RNA, 19 nt, Homo sapiens
uaaagcaaguggguaaaug

SEQ ID NO: 663161 - RNA, 19 nt, Homo sapiens
gcaguuaucaccagcuuau

SEQ ID NO: 663162 - RNA, 19 nt, Homo sapiens
guacagagccauuuguuac

SEQ ID NO: 663163 - RNA, 19 nt, Homo sapiens
gauaauccacuguccaaga

SEQ ID NO: 663164 - RNA, 19 nt, Homo sapiens
caaauaugcuuccuuucag

SEQ ID NO: 663165 - RNA, 19 nt, Homo sapiens
aaacagagacaguauuugu

SEQ ID NO: 663166 - RNA, 19 nt, Homo sapiens
ucacaggccuccagcuuca

SEQ ID NO: 663167 - RNA, 19 nt, Homo sapiens
gaaacaggaagacaagaug

SEQ ID NO: 663168 - RNA, 19 nt, Homo sapiens
ccucggcucuuaccuuuga

SEQ ID NO: 663169 - RNA, 19 nt, Homo sapiens
gcauacaugugucccuuca

SEQ ID NO: 663170 - RNA, 19 nt, Homo sapiens
aauauuaugugucccuuug

SEQ ID NO: 663171 - RNA, 19 nt, Homo sapiens
gugcuccacuucuauaaug

SEQ ID NO: 663172 - RNA, 19 nt, Homo sapiens
uaauaucccuugcacaucu

SEQ ID NO: 663173 - RNA, 19 nt, Homo sapiens
ccaacuuccuggugaaaga

SEQ ID NO: 663174 - RNA, 19 nt, Homo sapiens
cuacgcagcugucuggaau

SEQ ID NO: 663175 - RNA, 19 nt, Homo sapiens
ucauuucucuucauugguu

SEQ ID NO: 663176 - RNA, 19 nt, Homo sapiens
uccacaacuuccuauauua

SEQ ID NO: 663177 - RNA, 19 nt, Homo sapiens
gaagguuguuggcuuugau

SEQ ID NO: 663178 - RNA, 19 nt, Homo sapiens
gagcucaagucacuguuag

SEQ ID NO: 663179 - RNA, 19 nt, Homo sapiens
gguacagagccauuuguua

SEQ ID NO: 663180 - RNA, 19 nt, Homo sapiens
ugggaaugcuuucauaaug

SEQ ID NO: 663181 - RNA, 19 nt, Homo sapiens
cauaggugguggagagaaa

SEQ ID NO: 663182 - RNA, 19 nt, Homo sapiens
gcaauggggauauauauuu

SEQ ID NO: 663183 - RNA, 19 nt, Homo sapiens
gacaaagucucccguugag

SEQ ID NO: 663184 - RNA, 19 nt, Homo sapiens
guggcucugucuacaaaua

SEQ ID NO: 663185 - RNA, 19 nt, Homo sapiens
ggagcucaagucacuguua

SEQ ID NO: 663186 - RNA, 19 nt, Homo sapiens
caucuuauguggacuuucu

SEQ ID NO: 663187 - RNA, 19 nt, Homo sapiens
agaaugggcucaaccucuu

SEQ ID NO: 663188 - RNA, 19 nt, Homo sapiens
ugacaaagucucccguuga

SEQ ID NO: 663189 - RNA, 19 nt, Homo sapiens
uggcugaucuauaucgaaa

SEQ ID NO: 663190 - RNA, 19 nt, Homo sapiens
acaaauaugcuuccuuuca

SEQ ID NO: 663191 - RNA, 19 nt, Homo sapiens
agaggaggcuucaccguau

SEQ ID NO: 663192 - RNA, 19 nt, Homo sapiens
gggcuuugguauugacuga

SEQ ID NO: 663193 - RNA, 19 nt, Homo sapiens
gcucucuccugcaaugauu

SEQ ID NO: 663194 - RNA, 19 nt, Homo sapiens
caucugacauggcuaagca

SEQ ID NO: 663195 - RNA, 19 nt, Homo sapiens
ggauagagaggcacacugu

SEQ ID NO: 663196 - RNA, 19 nt, Homo sapiens
uaaugaauguagcuucuca

SEQ ID NO: 663197 - RNA, 19 nt, Homo sapiens
cagagaaauugggacagua

SEQ ID NO: 663198 - RNA, 19 nt, Homo sapiens
cugacacgcucaucaacua

SEQ ID NO: 663199 - RNA, 19 nt, Homo sapiens
ccagaaauguuugcagaca

SEQ ID NO: 663200 - RNA, 19 nt, Homo sapiens
ccugggcucuuaugaauuc

SEQ ID NO: 663201 - RNA, 19 nt, Homo sapiens
auaauccacuguccaagaa

SEQ ID NO: 663202 - RNA, 19 nt, Homo sapiens
gaacgucaaccagucaguu

SEQ ID NO: 663203 - RNA, 19 nt, Homo sapiens
ggagcuggcugggcuagau

SEQ ID NO: 663204 - RNA, 19 nt, Homo sapiens
gaucagauuccagaaaugu

SEQ ID NO: 663205 - RNA, 19 nt, Homo sapiens
auaaggugcuccacuucua

SEQ ID NO: 663206 - RNA, 19 nt, Homo sapiens
acauauaggugcacaagag

SEQ ID NO: 663207 - RNA, 19 nt, Homo sapiens
gggacaguaacauaucuua

SEQ ID NO: 663208 - RNA, 19 nt, Homo sapiens
caggcuagcuuccagaaag

SEQ ID NO: 663209 - RNA, 19 nt, Homo sapiens
cuucuacccucggcucuua

SEQ ID NO: 663210 - RNA, 19 nt, Homo sapiens
guguagaucucuuucucuu

SEQ ID NO: 663211 - RNA, 19 nt, Homo sapiens
ucugaaggcugcugagugu

SEQ ID NO: 663212 - RNA, 19 nt, Homo sapiens
ggaccucucauuucucuuc

SEQ ID NO: 663213 - RNA, 19 nt, Homo sapiens
cauaaugaauguagcuucu

SEQ ID NO: 663214 - RNA, 19 nt, Homo sapiens
uauauuuacuggagaaugg

SEQ ID NO: 663215 - RNA, 19 nt, Homo sapiens
guagauuucuuuggagcuu

SEQ ID NO: 663216 - RNA, 19 nt, Homo sapiens
ugauugacgucuccuacaa

SEQ ID NO: 663217 - RNA, 19 nt, Homo sapiens
cugaguggcugacaguuau

SEQ ID NO: 663218 - RNA, 19 nt, Homo sapiens
uaucaucaguccagcuaug

SEQ ID NO: 663219 - RNA, 19 nt, Homo sapiens
ggacaguaacauaucuuau

SEQ ID NO: 663220 - RNA, 19 nt, Homo sapiens
ggaucagauuccagaaaug

SEQ ID NO: 663221 - RNA, 19 nt, Homo sapiens
ggugaaagaccaagggaau

SEQ ID NO: 663222 - RNA, 19 nt, Homo sapiens
ugaagagcgucuaagcaau

SEQ ID NO: 663223 - RNA, 19 nt, Homo sapiens
cuuuggagcuuucuacaug

SEQ ID NO: 663224 - RNA, 19 nt, Homo sapiens
ggaaacugaagaacagaga

SEQ ID NO: 663225 - RNA, 19 nt, Homo sapiens
cagggaaacugaagaacag

SEQ ID NO: 663226 - RNA, 19 nt, Homo sapiens
ucagauuccagaaauguuu

SEQ ID NO: 663227 - RNA, 19 nt, Homo sapiens
ccaauuaacuucuccauaa

SEQ ID NO: 663228 - RNA, 19 nt, Homo sapiens
gcacacaaaugcuauguau

SEQ ID NO: 663229 - RNA, 19 nt, Homo sapiens
gaacgaaagacacuaauga

SEQ ID NO: 663230 - RNA, 19 nt, Homo sapiens
ggaaggugcuuaucacaga

SEQ ID NO: 663231 - RNA, 19 nt, Homo sapiens
caacuugcaucaugauauu

SEQ ID NO: 663232 - RNA, 19 nt, Homo sapiens
gaagaaagcccagaacgaa

SEQ ID NO: 663233 - RNA, 19 nt, Homo sapiens
gagaagaggccgagaaaga

SEQ ID NO: 663234 - RNA, 19 nt, Homo sapiens
cggaugggcuguugugaua

SEQ ID NO: 663235 - RNA, 19 nt, Homo sapiens
gaaagacacuaaugagcau

SEQ ID NO: 663236 - RNA, 19 nt, Homo sapiens
cagcaugucuugaguuaga

SEQ ID NO: 663237 - RNA, 19 nt, Homo sapiens
gagaacuacugaacaccua

SEQ ID NO: 663238 - RNA, 19 nt, Homo sapiens
guagaaauccagaagcuuu

SEQ ID NO: 663239 - RNA, 19 nt, Homo sapiens
gaaaagcucuauuauccaa

SEQ ID NO: 663240 - RNA, 19 nt, Homo sapiens
ggaauccuguugcaaguuc

SEQ ID NO: 663241 - RNA, 19 nt, Homo sapiens
gcuaugaggcccaaauuau

SEQ ID NO: 663242 - RNA, 19 nt, Homo sapiens
accaaugacugcuuuagua

SEQ ID NO: 663243 - RNA, 19 nt, Homo sapiens
ggugauaugccaauugaaa

SEQ ID NO: 663244 - RNA, 19 nt, Homo sapiens
ggaguagaguauaaagugu

SEQ ID NO: 663245 - RNA, 19 nt, Homo sapiens
cuaaaccaaugacugcuuu

SEQ ID NO: 663246 - RNA, 19 nt, Homo sapiens
aaacaugguucacauaacu

SEQ ID NO: 663247 - RNA, 19 nt, Homo sapiens
aaagaacacugcuccaagu

SEQ ID NO: 663248 - RNA, 19 nt, Homo sapiens
uaaugagcaugccaaacua

SEQ ID NO: 663249 - RNA, 19 nt, Homo sapiens
gcauguugauuuugucuua

SEQ ID NO: 663250 - RNA, 19 nt, Homo sapiens
ccuaaugguuucuuguuug

SEQ ID NO: 663251 - RNA, 19 nt, Homo sapiens
gugcauggccugagcauug

SEQ ID NO: 663252 - RNA, 19 nt, Homo sapiens
gaaagauuccaacccaaug

SEQ ID NO: 663253 - RNA, 19 nt, Homo sapiens
uuucaggacuuccaagauu

SEQ ID NO: 663254 - RNA, 19 nt, Homo sapiens
agacaauucuagaacaaga

SEQ ID NO: 663255 - RNA, 19 nt, Homo sapiens
gcaccagcaugucuugagu

SEQ ID NO: 663256 - RNA, 19 nt, Homo sapiens
gaacuacugaacaccuaaa

SEQ ID NO: 663257 - RNA, 19 nt, Homo sapiens
gauauugaacgguuuaaag

SEQ ID NO: 663258 - RNA, 19 nt, Homo sapiens
acagucagaugucccuaaa

SEQ ID NO: 663259 - RNA, 19 nt, Homo sapiens
gggagaagaggccgagaaa

SEQ ID NO: 663260 - RNA, 19 nt, Homo sapiens
cagaagcuuuccagccaaa

SEQ ID NO: 663261 - RNA, 19 nt, Homo sapiens
uaaggcaugucuugguaga

SEQ ID NO: 663262 - RNA, 19 nt, Homo sapiens
gaaggugcuuaucacagau

SEQ ID NO: 663263 - RNA, 19 nt, Homo sapiens
caaguaauaauccggaaga

SEQ ID NO: 663264 - RNA, 19 nt, Homo sapiens
gcuguugugauaccacuua

SEQ ID NO: 663265 - RNA, 19 nt, Homo sapiens
gaaaauggaguagaguaua

SEQ ID NO: 663266 - RNA, 19 nt, Homo sapiens
gaauuuggaaggugcuuau

SEQ ID NO: 663267 - RNA, 19 nt, Homo sapiens
ccagaacgaaagacacuaa

SEQ ID NO: 663268 - RNA, 19 nt, Homo sapiens
ccauuugguuccucaguau

SEQ ID NO: 663269 - RNA, 19 nt, Homo sapiens
cacagauucuccacacuga

SEQ ID NO: 663270 - RNA, 19 nt, Homo sapiens
guaagcaggugguacuacu

SEQ ID NO: 663271 - RNA, 19 nt, Homo sapiens
accagcaugucuugaguua

SEQ ID NO: 663272 - RNA, 19 nt, Homo sapiens
auaacuagcuuguggaaac

SEQ ID NO: 663273 - RNA, 19 nt, Homo sapiens
cuaaugguuucuuguuugu

SEQ ID NO: 663274 - RNA, 19 nt, Homo sapiens
ggaggcugcucugcaugaa

SEQ ID NO: 663275 - RNA, 19 nt, Homo sapiens
gugaaugcauguugauuuu

SEQ ID NO: 663276 - RNA, 19 nt, Homo sapiens
ccaagauucagucacgaua

SEQ ID NO: 663277 - RNA, 19 nt, Homo sapiens
auucuuaaguugacgcuuu

SEQ ID NO: 663278 - RNA, 19 nt, Homo sapiens
gaaaccagcagguaaaaug

SEQ ID NO: 663279 - RNA, 19 nt, Homo sapiens
cuacugaacaccuaaagau

SEQ ID NO: 663280 - RNA, 19 nt, Homo sapiens
aggcaugucuugguagaaa

SEQ ID NO: 663281 - RNA, 19 nt, Homo sapiens
uccaguuucuucuguguuu

SEQ ID NO: 663282 - RNA, 19 nt, Homo sapiens
acugaacaccuaaagauuu

SEQ ID NO: 663283 - RNA, 19 nt, Homo sapiens
gaaagcccagaacgaaaga

SEQ ID NO: 663284 - RNA, 19 nt, Homo sapiens
auuaaggcaugucuuggua

SEQ ID NO: 663285 - RNA, 19 nt, Homo sapiens
cacacugaguuuaaaucua

SEQ ID NO: 663286 - RNA, 19 nt, Homo sapiens
ucagaugucccuaaaccaa

SEQ ID NO: 663287 - RNA, 19 nt, Homo sapiens
gaacuaaaagcacuccauu

SEQ ID NO: 663288 - RNA, 19 nt, Homo sapiens
ggaauuuggaaggugcuua

SEQ ID NO: 663289 - RNA, 19 nt, Homo sapiens
agaagaggccgagaaagaa

SEQ ID NO: 663290 - RNA, 19 nt, Homo sapiens
cuaaugagcaugccaaacu

SEQ ID NO: 663291 - RNA, 19 nt, Homo sapiens
gaaugcauguugauuuugu

SEQ ID NO: 663292 - RNA, 19 nt, Homo sapiens
caugcagacuggagguuug

SEQ ID NO: 663293 - RNA, 19 nt, Homo sapiens
gaacgguuuaaagccauua

SEQ ID NO: 663294 - RNA, 19 nt, Homo sapiens
caugauauugaacgguuua

SEQ ID NO: 663295 - RNA, 19 nt, Homo sapiens
guggaaaccagcagguaaa

SEQ ID NO: 663296 - RNA, 19 nt, Homo sapiens
guagauauuuccccagaga

SEQ ID NO: 663297 - RNA, 19 nt, Homo sapiens
cuagagaacuacugaacac

SEQ ID NO: 663298 - RNA, 19 nt, Homo sapiens
gcaggugguacuacuacaa

SEQ ID NO: 663299 - RNA, 19 nt, Homo sapiens
ccaacccaauggugauaug

SEQ ID NO: 663300 - RNA, 19 nt, Homo sapiens
uaaaagcacuccauuuggu

SEQ ID NO: 663301 - RNA, 19 nt, Homo sapiens
gccuccugcuguucucuua

SEQ ID NO: 663302 - RNA, 19 nt, Homo sapiens
gaaucuucuugcucaggaa

SEQ ID NO: 663303 - RNA, 19 nt, Homo sapiens
cccuaaugguuucuuguuu

SEQ ID NO: 663304 - RNA, 19 nt, Homo sapiens
ugaagaaagcccagaacga

SEQ ID NO: 663305 - RNA, 19 nt, Homo sapiens
ucacucuggucgacucuuc

SEQ ID NO: 663306 - RNA, 19 nt, Homo sapiens
ugugaaugcauguugauuu

SEQ ID NO: 663307 - RNA, 19 nt, Homo sapiens
gaagaggccgagaaagaac

SEQ ID NO: 663308 - RNA, 19 nt, Homo sapiens
gccauuaaggcaugucuug

SEQ ID NO: 663309 - RNA, 19 nt, Homo sapiens
gcucuauuauccaauuaac

SEQ ID NO: 663310 - RNA, 19 nt, Homo sapiens
aguagaguauaaaguguga

SEQ ID NO: 663311 - RNA, 19 nt, Homo sapiens
uccauuugguuccucagua

SEQ ID NO: 663312 - RNA, 19 nt, Homo sapiens
cuacuugaauuguggaaaa

SEQ ID NO: 663313 - RNA, 19 nt, Homo sapiens
caugaucccaguugaaauc

SEQ ID NO: 663314 - RNA, 19 nt, Homo sapiens
caacaacuugcaucaugau

SEQ ID NO: 663315 - RNA, 19 nt, Homo sapiens
caauggugauaugccaauu

SEQ ID NO: 663316 - RNA, 19 nt, Homo sapiens
gaguauaaagugugaaugc

SEQ ID NO: 663317 - RNA, 19 nt, Homo sapiens
ucuccacacugaguuuaaa

SEQ ID NO: 663318 - RNA, 19 nt, Homo sapiens
uaugaggcccaaauuaugu

SEQ ID NO: 663319 - RNA, 19 nt, Homo sapiens
cuaugaggcccaaauuaug

SEQ ID NO: 663320 - RNA, 19 nt, Homo sapiens
uggguacugugacugcuuu

SEQ ID NO: 663321 - RNA, 19 nt, Homo sapiens
ccaaugacugcuuuaguag

SEQ ID NO: 663322 - RNA, 19 nt, Homo sapiens
uggaguagaguauaaagug

SEQ ID NO: 663323 - RNA, 19 nt, Homo sapiens
auggugauaugccaauuga

SEQ ID NO: 663324 - RNA, 19 nt, Homo sapiens
agaaagauuccaacccaau

SEQ ID NO: 663325 - RNA, 19 nt, Homo sapiens
agaugucccuaaaccaaug

SEQ ID NO: 663326 - RNA, 19 nt, Homo sapiens
guaaaacaugguucacaua

SEQ ID NO: 663327 - RNA, 19 nt, Homo sapiens
caaagugucuuccuucuua

SEQ ID NO: 663328 - RNA, 19 nt, Homo sapiens
ugacaaaccuuucuacaua

SEQ ID NO: 663329 - RNA, 19 nt, Homo sapiens
ggaaucauuugccuuauua

SEQ ID NO: 663330 - RNA, 19 nt, Homo sapiens
gaugaaaucucacugcuaa

SEQ ID NO: 663331 - RNA, 19 nt, Homo sapiens
gaaaccaucugcauccaua

SEQ ID NO: 663332 - RNA, 19 nt, Homo sapiens
caagaugacuuuaacaaug

SEQ ID NO: 663333 - RNA, 19 nt, Homo sapiens
ugacaaaggucuauugaau

SEQ ID NO: 663334 - RNA, 19 nt, Homo sapiens
gaucgaaaguugcugguuu

SEQ ID NO: 663335 - RNA, 19 nt, Homo sapiens
gaagaggaauugacccuau

SEQ ID NO: 663336 - RNA, 19 nt, Homo sapiens
gaggaauuaucacgucuua

SEQ ID NO: 663337 - RNA, 19 nt, Homo sapiens
guuauugccuugguuauua

SEQ ID NO: 663338 - RNA, 19 nt, Homo sapiens
gcuacaagcuaugaaauaa

SEQ ID NO: 663339 - RNA, 19 nt, Homo sapiens
ggguaggucugcauuauaa

SEQ ID NO: 663340 - RNA, 19 nt, Homo sapiens
gcaauggguuugauaggaa

SEQ ID NO: 663341 - RNA, 19 nt, Homo sapiens
ggaauuuacucgagguauu

SEQ ID NO: 663342 - RNA, 19 nt, Homo sapiens
gaugaaugcuccaaggaaa

SEQ ID NO: 663343 - RNA, 19 nt, Homo sapiens
gacaaaccuuucuacauaa

SEQ ID NO: 663344 - RNA, 19 nt, Homo sapiens
caugaaagccacagaauuu

SEQ ID NO: 663345 - RNA, 19 nt, Homo sapiens
gaaaugaggaggagcgaaa

SEQ ID NO: 663346 - RNA, 19 nt, Homo sapiens
gcaacugcaucaauaaugu

SEQ ID NO: 663347 - RNA, 19 nt, Homo sapiens
caugguagaucaacaauuc

SEQ ID NO: 663348 - RNA, 19 nt, Homo sapiens
gaaaggauuugaggugguu

SEQ ID NO: 663349 - RNA, 19 nt, Homo sapiens
caccacagcuuucccauga

SEQ ID NO: 663350 - RNA, 19 nt, Homo sapiens
gaguacagcuucaagacaa

SEQ ID NO: 663351 - RNA, 19 nt, Homo sapiens
gcaauacgagcaauggaua

SEQ ID NO: 663352 - RNA, 19 nt, Homo sapiens
aaacagacaucagcauuug

SEQ ID NO: 663353 - RNA, 19 nt, Homo sapiens
aaccucaucucaaacauua

SEQ ID NO: 663354 - RNA, 19 nt, Homo sapiens
aaagagagcagacaagaaa

SEQ ID NO: 663355 - RNA, 19 nt, Homo sapiens
caaauuaacagcaaugaug

SEQ ID NO: 663356 - RNA, 19 nt, Homo sapiens
acaacaagccgcagaauuu

SEQ ID NO: 663357 - RNA, 19 nt, Homo sapiens
uauaaugccuuaccuagga

SEQ ID NO: 663358 - RNA, 19 nt, Homo sapiens
gugaagcaaucauuuaguu

SEQ ID NO: 663359 - RNA, 19 nt, Homo sapiens
gaaagagaauggaacaaaa

SEQ ID NO: 663360 - RNA, 19 nt, Homo sapiens
ggaaaucaguaggcagaaa

SEQ ID NO: 663361 - RNA, 19 nt, Homo sapiens
gaauauccaagaugacuuu

SEQ ID NO: 663362 - RNA, 19 nt, Homo sapiens
ugacaaaguggucuguuua

SEQ ID NO: 663363 - RNA, 19 nt, Homo sapiens
gaaagagacagccuccauu

SEQ ID NO: 663364 - RNA, 19 nt, Homo sapiens
ggacuuacacccugaacaa

SEQ ID NO: 663365 - RNA, 19 nt, Homo sapiens
ccaagaagcaccaaaccua

SEQ ID NO: 663366 - RNA, 19 nt, Homo sapiens
ggaauuaucacgucuuaca

SEQ ID NO: 663367 - RNA, 19 nt, Homo sapiens
ccuacugaaugauaacuua

SEQ ID NO: 663368 - RNA, 19 nt, Homo sapiens
ccacauggaaagcuaauaa

SEQ ID NO: 663369 - RNA, 19 nt, Homo sapiens
gaggguaggucugcauuau

SEQ ID NO: 663370 - RNA, 19 nt, Homo sapiens
gaauugacccuaucuugga

SEQ ID NO: 663371 - RNA, 19 nt, Homo sapiens
gaacaauacccaucauucu

SEQ ID NO: 663372 - RNA, 19 nt, Homo sapiens
caacgacacuauguuucua

SEQ ID NO: 663373 - RNA, 19 nt, Homo sapiens
cagcagugguucaacaauu

SEQ ID NO: 663374 - RNA, 19 nt, Homo sapiens
guucagggcuuaagaaagg

SEQ ID NO: 663375 - RNA, 19 nt, Homo sapiens
caaucacucucccagcaua

SEQ ID NO: 663376 - RNA, 19 nt, Homo sapiens
cagcggagaugauaagcuu

SEQ ID NO: 663377 - RNA, 19 nt, Homo sapiens
uaacagcaaugaugaucga

SEQ ID NO: 663378 - RNA, 19 nt, Homo sapiens
gugacaaaguggucuguuu

SEQ ID NO: 663379 - RNA, 19 nt, Homo sapiens
gcaccuuuaucuacaauag

SEQ ID NO: 663380 - RNA, 19 nt, Homo sapiens
gaaagccacagaauuuaug

SEQ ID NO: 663381 - RNA, 19 nt, Homo sapiens
gaauuuacucgagguauuu

SEQ ID NO: 663382 - RNA, 19 nt, Homo sapiens
gcuuauggcucugugauga

SEQ ID NO: 663383 - RNA, 19 nt, Homo sapiens
cuaauuuccuacugaauga

SEQ ID NO: 663384 - RNA, 19 nt, Homo sapiens
cauagugacugacugguau

SEQ ID NO: 663385 - RNA, 19 nt, Homo sapiens
ccacagaauuuauguugca

SEQ ID NO: 663386 - RNA, 19 nt, Homo sapiens
ucagggagauauuuacguu

SEQ ID NO: 663387 - RNA, 19 nt, Homo sapiens
uacagaauauccaagauga

SEQ ID NO: 663388 - RNA, 19 nt, Homo sapiens
ugucaaaccucaccaucaa

SEQ ID NO: 663389 - RNA, 19 nt, Homo sapiens
caaugaugaucgaaaguug

SEQ ID NO: 663390 - RNA, 19 nt, Homo sapiens
gacaaaggucuauugaauu

SEQ ID NO: 663391 - RNA, 19 nt, Homo sapiens
gagcagacaagaaagagaa

SEQ ID NO: 663392 - RNA, 19 nt, Homo sapiens
guucuuuguuccagauaua

SEQ ID NO: 663393 - RNA, 19 nt, Homo sapiens
gaugcagauuguugaaauu

SEQ ID NO: 663394 - RNA, 19 nt, Homo sapiens
gaauuuauguugcaauacg

SEQ ID NO: 663395 - RNA, 19 nt, Homo sapiens
gggcaacgacacuauguuu

SEQ ID NO: 663396 - RNA, 19 nt, Homo sapiens
uacaggagguuuaaaguuc

SEQ ID NO: 663397 - RNA, 19 nt, Homo sapiens
gagcccagcuacaccaaau

SEQ ID NO: 663398 - RNA, 19 nt, Homo sapiens
uaucuucugugguugaauu

SEQ ID NO: 663399 - RNA, 19 nt, Homo sapiens
gacaauggguauaauggau

SEQ ID NO: 663400 - RNA, 19 nt, Homo sapiens
gaaaucaguaggcagaaau

SEQ ID NO: 663401 - RNA, 19 nt, Homo sapiens
gaaccucaucucaaacauu

SEQ ID NO: 663402 - RNA, 19 nt, Homo sapiens
ggacagcaccuggagaaga

SEQ ID NO: 663403 - RNA, 19 nt, Homo sapiens
gcccagcuacaccaaauua

SEQ ID NO: 663404 - RNA, 19 nt, Homo sapiens
ugacagacuccuucaacua

SEQ ID NO: 663405 - RNA, 19 nt, Homo sapiens
ggaugcaccuuuaucuaca

SEQ ID NO: 663406 - RNA, 19 nt, Homo sapiens
cuauguauguaccagguua

SEQ ID NO: 663407 - RNA, 19 nt, Homo sapiens
gaaagugcaugucaaucac

SEQ ID NO: 663408 - RNA, 19 nt, Homo sapiens
gauugaugcuuucaguaga

SEQ ID NO: 663409 - RNA, 19 nt, Homo sapiens
gcaaugaugaucgaaaguu

SEQ ID NO: 663410 - RNA, 19 nt, Homo sapiens
ccacagcuuucccaugaau

SEQ ID NO: 663411 - RNA, 19 nt, Homo sapiens
uaaguuauugccuugguua

SEQ ID NO: 663412 - RNA, 19 nt, Homo sapiens
ccuggaagcuguaaaagua

SEQ ID NO: 663413 - RNA, 19 nt, Homo sapiens
ggagucaugcuauguaugu

SEQ ID NO: 663414 - RNA, 19 nt, Homo sapiens
aaagagacagccuccauuu

SEQ ID NO: 663415 - RNA, 19 nt, Homo sapiens
gcucagcagugguucaaca

SEQ ID NO: 663416 - RNA, 19 nt, Homo sapiens
caacugaagaucaugcuau

SEQ ID NO: 663417 - RNA, 19 nt, Homo sapiens
ggaaagagacagccuccau

SEQ ID NO: 663418 - RNA, 19 nt, Homo sapiens
gcaauugcuuacccacugu

SEQ ID NO: 663419 - RNA, 19 nt, Homo sapiens
aaaggcaaaugucauagug

SEQ ID NO: 663420 - RNA, 19 nt, Homo sapiens
gaaaugauaacugaagcuu

SEQ ID NO: 663421 - RNA, 19 nt, Homo sapiens
ggaccagugucaaggaaag

SEQ ID NO: 663422 - RNA, 19 nt, Homo sapiens
ugaaagugcaugucaauca

SEQ ID NO: 663423 - RNA, 19 nt, Homo sapiens
guagauauagcuugaaagu

SEQ ID NO: 663424 - RNA, 19 nt, Homo sapiens
gaugauuuaugccaaugug

SEQ ID NO: 663425 - RNA, 19 nt, Homo sapiens
gagcauugcagguccuauu

SEQ ID NO: 663426 - RNA, 19 nt, Homo sapiens
caaaguggucuguuuagug

SEQ ID NO: 663427 - RNA, 19 nt, Homo sapiens
gaacucaucuuugccagua

SEQ ID NO: 663428 - RNA, 19 nt, Homo sapiens
ggaaauaaaggcuguugua

SEQ ID NO: 663429 - RNA, 19 nt, Homo sapiens
aauaaaggcuguuguaaga

SEQ ID NO: 663430 - RNA, 19 nt, Homo sapiens
gaaauaaaggcuguuguaa

SEQ ID NO: 663431 - RNA, 19 nt, Homo sapiens
uaaaggcuguuguaagaga

SEQ ID NO: 663432 - RNA, 19 nt, Homo sapiens
gcagcgaacucaucuuugc

SEQ ID NO: 663433 - RNA, 19 nt, Homo sapiens
gcgcagaucacccagaaga

SEQ ID NO: 663434 - RNA, 19 nt, Homo sapiens
gcaccguguucaugaaucu

SEQ ID NO: 663435 - RNA, 19 nt, Homo sapiens
ggacaaaugcgacgaaccu

SEQ ID NO: 663436 - RNA, 19 nt, Homo sapiens
gagcugaaggcgcagauca

SEQ ID NO: 663437 - RNA, 19 nt, Homo sapiens
aaauaaaggcuguuguaag

SEQ ID NO: 663438 - RNA, 19 nt, Homo sapiens
ugagcaccguguucaugaa

SEQ ID NO: 663439 - RNA, 19 nt, Homo sapiens
gagaggcagcgaacucauc

SEQ ID NO: 663440 - RNA, 19 nt, Homo sapiens
aggcgcagaucacccagaa

SEQ ID NO: 663441 - RNA, 19 nt, Homo sapiens
aaaggcuguuguaagagaa

SEQ ID NO: 663442 - RNA, 19 nt, Homo sapiens
gagcaccguguucaugaau

SEQ ID NO: 663443 - RNA, 19 nt, Homo sapiens
aggcagcgaacucaucuuu

SEQ ID NO: 663444 - RNA, 19 nt, Homo sapiens
caccugaagcagcaaguga

SEQ ID NO: 663445 - RNA, 19 nt, Homo sapiens
gcgacgaaccucugagcau

SEQ ID NO: 663446 - RNA, 19 nt, Homo sapiens
gcaguuguauuucucauua

SEQ ID NO: 663447 - RNA, 19 nt, Homo sapiens
ggaaugcccugacagauaa

SEQ ID NO: 663448 - RNA, 19 nt, Homo sapiens
gaacugcccauucucauua

SEQ ID NO: 663449 - RNA, 19 nt, Homo sapiens
gaucuugacuacacuaauu

SEQ ID NO: 663450 - RNA, 19 nt, Homo sapiens
aaacugcacugaugaacua

SEQ ID NO: 663451 - RNA, 19 nt, Homo sapiens
uaaaugaaauccuggaaga

SEQ ID NO: 663452 - RNA, 19 nt, Homo sapiens
gcacauauuugacuacagu

SEQ ID NO: 663453 - RNA, 19 nt, Homo sapiens
ucagagagauugaaacaga

SEQ ID NO: 663454 - RNA, 19 nt, Homo sapiens
gagaacagcuggauaugca

SEQ ID NO: 663455 - RNA, 19 nt, Homo sapiens
gcacugaugaacuagauua

SEQ ID NO: 663456 - RNA, 19 nt, Homo sapiens
gcaguuggcuuuacgagau

SEQ ID NO: 663457 - RNA, 19 nt, Homo sapiens
uaaacgggcuguucuugaa

SEQ ID NO: 663458 - RNA, 19 nt, Homo sapiens
uaacagaucuugacuacac

SEQ ID NO: 663459 - RNA, 19 nt, Homo sapiens
gaaauugagacugccauua

SEQ ID NO: 663460 - RNA, 19 nt, Homo sapiens
caaauguucugcuucaugu

SEQ ID NO: 663461 - RNA, 19 nt, Homo sapiens
uaucuaaacugcacugaug

SEQ ID NO: 663462 - RNA, 19 nt, Homo sapiens
gaucggcuuucaaugcuuu

SEQ ID NO: 663463 - RNA, 19 nt, Homo sapiens
ggaaugugaugccuguaga

SEQ ID NO: 663464 - RNA, 19 nt, Homo sapiens
gaauaugcauuacuuuggu

SEQ ID NO: 663465 - RNA, 19 nt, Homo sapiens
gaaauucaaacucucaaga

SEQ ID NO: 663466 - RNA, 19 nt, Homo sapiens
ucauuacuguguccuauuu

SEQ ID NO: 663467 - RNA, 19 nt, Homo sapiens
uggguuugauucaguauua

SEQ ID NO: 663468 - RNA, 19 nt, Homo sapiens
acauagagcagcaacuuua

SEQ ID NO: 663469 - RNA, 19 nt, Homo sapiens
agacugccauuaaggagua

SEQ ID NO: 663470 - RNA, 19 nt, Homo sapiens
gaagaaaugaugcaggaau

SEQ ID NO: 663471 - RNA, 19 nt, Homo sapiens
gugcuaacauugaaacugu

SEQ ID NO: 663472 - RNA, 19 nt, Homo sapiens
guuccgagcuuguuaacug

SEQ ID NO: 663473 - RNA, 19 nt, Homo sapiens
aaauugagacugccauuaa

SEQ ID NO: 663474 - RNA, 19 nt, Homo sapiens
gaaagagcacaaagaaaca

SEQ ID NO: 663475 - RNA, 19 nt, Homo sapiens
aaacuguucucuuaguaga

SEQ ID NO: 663476 - RNA, 19 nt, Homo sapiens
gaacuuggguuugauucag

SEQ ID NO: 663477 - RNA, 19 nt, Homo sapiens
cuugggagauuuauacuau

SEQ ID NO: 663478 - RNA, 19 nt, Homo sapiens
ggaaucaccggacccagaa

SEQ ID NO: 663479 - RNA, 19 nt, Homo sapiens
ccauuacccuucuugcuau

SEQ ID NO: 663480 - RNA, 19 nt, Homo sapiens
cgacagcauuauucugaga

SEQ ID NO: 663481 - RNA, 19 nt, Homo sapiens
cagaccagguuauugaaga

SEQ ID NO: 663482 - RNA, 19 nt, Homo sapiens
uggaaugcccugacagaua

SEQ ID NO: 663483 - RNA, 19 nt, Homo sapiens
cauuugaacuuggguuuga

SEQ ID NO: 663484 - RNA, 19 nt, Homo sapiens
acagaaagagcacaaagaa

SEQ ID NO: 663485 - RNA, 19 nt, Homo sapiens
ccagguuauugaagaaauu

SEQ ID NO: 663486 - RNA, 19 nt, Homo sapiens
ugagagaacagcuggauau

SEQ ID NO: 663487 - RNA, 19 nt, Homo sapiens
gaauaaacgggcuguucuu

SEQ ID NO: 663488 - RNA, 19 nt, Homo sapiens
uaacuauuaccuaccagua

SEQ ID NO: 663489 - RNA, 19 nt, Homo sapiens
gaaacucagcacauuugaa

SEQ ID NO: 663490 - RNA, 19 nt, Homo sapiens
ugagagcuggcuaccauua

SEQ ID NO: 663491 - RNA, 19 nt, Homo sapiens
cgagcuuguuaacugauua

SEQ ID NO: 663492 - RNA, 19 nt, Homo sapiens
ucaauaucaugagcacuuu

SEQ ID NO: 663493 - RNA, 19 nt, Homo sapiens
aauggcagcucucagaaug

SEQ ID NO: 663494 - RNA, 19 nt, Homo sapiens
cagaauaugcauuacuuug

SEQ ID NO: 663495 - RNA, 19 nt, Homo sapiens
cagagagauugaaacagaa

SEQ ID NO: 663496 - RNA, 19 nt, Homo sapiens
acuauuaccuaccaguauu

SEQ ID NO: 663497 - RNA, 19 nt, Homo sapiens
gacaguaugcccauuuguu

SEQ ID NO: 663498 - RNA, 19 nt, Homo sapiens
agauacagcuacuuaugga

SEQ ID NO: 663499 - RNA, 19 nt, Homo sapiens
guagcuugcugcuuguuuc

SEQ ID NO: 663500 - RNA, 19 nt, Homo sapiens
cugaugaacuagauuaaag

SEQ ID NO: 663501 - RNA, 19 nt, Homo sapiens
acaguaugcccauuuguuu

SEQ ID NO: 663502 - RNA, 19 nt, Homo sapiens
gcacaaagaaacagcaaaa

SEQ ID NO: 663503 - RNA, 19 nt, Homo sapiens
cggcagaccagguuauuga

SEQ ID NO: 663504 - RNA, 19 nt, Homo sapiens
gacaguuugcucuuugaua

SEQ ID NO: 663505 - RNA, 19 nt, Homo sapiens
ugugagaauugucagugua

SEQ ID NO: 663506 - RNA, 19 nt, Homo sapiens
uuaaagccuugggagauuu

SEQ ID NO: 663507 - RNA, 19 nt, Homo sapiens
agaaagagcacaaagaaac

SEQ ID NO: 663508 - RNA, 19 nt, Homo sapiens
ugaaauccuggaagaaauu

SEQ ID NO: 663509 - RNA, 19 nt, Homo sapiens
ggacccagaagaugaugaa

SEQ ID NO: 663510 - RNA, 19 nt, Homo sapiens
gauuaaagccuugggagau

SEQ ID NO: 663511 - RNA, 19 nt, Homo sapiens
ucugagagcuggcuaccau

SEQ ID NO: 663512 - RNA, 19 nt, Homo sapiens
ggaagaaugagagaaguca

SEQ ID NO: 663513 - RNA, 19 nt, Homo sapiens
ggucuaguaccggcaguua

SEQ ID NO: 663514 - RNA, 19 nt, Homo sapiens
ccaguauuguucagagaga

SEQ ID NO: 663515 - RNA, 19 nt, Homo sapiens
uauagaaccaacggaaaua

SEQ ID NO: 663516 - RNA, 19 nt, Homo sapiens
uggaagucaucgcauacua

SEQ ID NO: 663517 - RNA, 19 nt, Homo sapiens
ggaaacucagcacauuuga

SEQ ID NO: 663518 - RNA, 19 nt, Homo sapiens
ggaagucaucgcauacuag

SEQ ID NO: 663519 - RNA, 19 nt, Homo sapiens
ccauuaaggaguacucuga

SEQ ID NO: 663520 - RNA, 19 nt, Homo sapiens
uuucaaauguucugcuuca

SEQ ID NO: 663521 - RNA, 19 nt, Homo sapiens
gguuuaauacuuagugcua

SEQ ID NO: 663522 - RNA, 19 nt, Homo sapiens
acaguuugcucuuugauac

SEQ ID NO: 663523 - RNA, 19 nt, Homo sapiens
gacagauaauuaugggaau

SEQ ID NO: 663524 - RNA, 19 nt, Homo sapiens
aaaguucuguguccuacau

SEQ ID NO: 663525 - RNA, 19 nt, Homo sapiens
gauaauuaugggaauguga

SEQ ID NO: 663526 - RNA, 19 nt, Homo sapiens
cagaaagagcacaaagaaa

SEQ ID NO: 663527 - RNA, 19 nt, Homo sapiens
ggauaugcacucaaucauc

SEQ ID NO: 663528 - RNA, 19 nt, Homo sapiens
gagagauugaaacagaaua

SEQ ID NO: 663529 - RNA, 19 nt, Homo sapiens
gaaauccuggaagaaauug

SEQ ID NO: 663530 - RNA, 19 nt, Homo sapiens
aaugaaauccuggaagaaa

SEQ ID NO: 663531 - RNA, 19 nt, Homo sapiens
aagaaaugaugcaggaauc

SEQ ID NO: 663532 - RNA, 19 nt, Homo sapiens
gugagaauugucaguguaa

SEQ ID NO: 663533 - RNA, 19 nt, Homo sapiens
agaccagguuauugaagaa

SEQ ID NO: 663534 - RNA, 19 nt, Homo sapiens
caucgucuccuguguuaau

SEQ ID NO: 663535 - RNA, 19 nt, Homo sapiens
ucaaauguucugcuucaug

SEQ ID NO: 663536 - RNA, 19 nt, Homo sapiens
gcacuugcuuacucugaac

SEQ ID NO: 663537 - RNA, 19 nt, Homo sapiens
gauuuggaaugcccugaca

SEQ ID NO: 663538 - RNA, 19 nt, Homo sapiens
gauucaguauuaacagauc

SEQ ID NO: 663539 - RNA, 19 nt, Homo sapiens
gggacgagauuuggaaugc

SEQ ID NO: 663540 - RNA, 19 nt, Homo sapiens
cggcaguuaugaagagaga

SEQ ID NO: 663541 - RNA, 19 nt, Homo sapiens
ucuccuguguuaaugauga

SEQ ID NO: 663542 - RNA, 19 nt, Homo sapiens
gaauugucaguguaacuau

SEQ ID NO: 663543 - RNA, 19 nt, Homo sapiens
guagauuaagagagaguaa

SEQ ID NO: 663544 - RNA, 19 nt, Homo sapiens
ggguuugauucaguauuaa

SEQ ID NO: 663545 - RNA, 19 nt, Homo sapiens
ccaugaaggaggacaguga

SEQ ID NO: 663546 - RNA, 19 nt, Homo sapiens
gaaccuagcucccgugaag

SEQ ID NO: 663547 - RNA, 19 nt, Homo sapiens
gaaggcaucuccaacauuc

SEQ ID NO: 663548 - RNA, 19 nt, Homo sapiens
gugaagaacuccuuuauca

SEQ ID NO: 663549 - RNA, 19 nt, Homo sapiens
gaaagucgcuguuguucuc

SEQ ID NO: 663550 - RNA, 19 nt, Homo sapiens
gaaggugccuacuuugcua

SEQ ID NO: 663551 - RNA, 19 nt, Homo sapiens
gggacgagcuggaguuuga

SEQ ID NO: 663552 - RNA, 19 nt, Homo sapiens
gaaagaagaggaagaguuc

SEQ ID NO: 663553 - RNA, 19 nt, Homo sapiens
gaaauaaucagcuucaagu

SEQ ID NO: 663554 - RNA, 19 nt, Homo sapiens
acacagaccuucaacaaca

SEQ ID NO: 663555 - RNA, 19 nt, Homo sapiens
cagauaaacucauccugaa

SEQ ID NO: 663556 - RNA, 19 nt, Homo sapiens
gaagugaagaacuccuuua

SEQ ID NO: 663557 - RNA, 19 nt, Homo sapiens
acacugagauccaugagaa

SEQ ID NO: 663558 - RNA, 19 nt, Homo sapiens
gaaaccagaugccucucaa

SEQ ID NO: 663559 - RNA, 19 nt, Homo sapiens
gaggaagaguucaaugaga

SEQ ID NO: 663560 - RNA, 19 nt, Homo sapiens
gaaggaggauaaugagaag

SEQ ID NO: 663561 - RNA, 19 nt, Homo sapiens
ugaacacagucauuccuua

SEQ ID NO: 663562 - RNA, 19 nt, Homo sapiens
gcucacagcagaucaggua

SEQ ID NO: 663563 - RNA, 19 nt, Homo sapiens
uuacaucccuucacucuca

SEQ ID NO: 663564 - RNA, 19 nt, Homo sapiens
gagucuggaugaagaguuu

SEQ ID NO: 663565 - RNA, 19 nt, Homo sapiens
cagcagaucagguaauuga

SEQ ID NO: 663566 - RNA, 19 nt, Homo sapiens
uuucaccgcucauuaugua

SEQ ID NO: 663567 - RNA, 19 nt, Homo sapiens
agaagaggauggaggagaa

SEQ ID NO: 663568 - RNA, 19 nt, Homo sapiens
aagaggagguucuggaaga

SEQ ID NO: 663569 - RNA, 19 nt, Homo sapiens
gccaggacccgcacagaua

SEQ ID NO: 663570 - RNA, 19 nt, Homo sapiens
ccuccgacauguauuuaaa

SEQ ID NO: 663571 - RNA, 19 nt, Homo sapiens
ucacugagcaagagucauu

SEQ ID NO: 663572 - RNA, 19 nt, Homo sapiens
uaccuaaccuugcccuuug

SEQ ID NO: 663573 - RNA, 19 nt, Homo sapiens
cuacuuugcuaacggacua

SEQ ID NO: 663574 - RNA, 19 nt, Homo sapiens
ugacacagaccuucaacaa

SEQ ID NO: 663575 - RNA, 19 nt, Homo sapiens
aggaagaguucaaugagaa

SEQ ID NO: 663576 - RNA, 19 nt, Homo sapiens
augagaaggugccuacuuu

SEQ ID NO: 663577 - RNA, 19 nt, Homo sapiens
ggaaggcaucuccaacauu

SEQ ID NO: 663578 - RNA, 19 nt, Homo sapiens
gauaaacucauccugaaag

SEQ ID NO: 663579 - RNA, 19 nt, Homo sapiens
caacaacugguccuaugaa

SEQ ID NO: 663580 - RNA, 19 nt, Homo sapiens
ugagauccaugagaaagaa

SEQ ID NO: 663581 - RNA, 19 nt, Homo sapiens
gaagaaccaguuacagauc

SEQ ID NO: 663582 - RNA, 19 nt, Homo sapiens
caagagucauuccaucaca

SEQ ID NO: 663583 - RNA, 19 nt, Homo sapiens
ugaaggaggauaaugagaa

SEQ ID NO: 663584 - RNA, 19 nt, Homo sapiens
gacaaacaguaucugaaca

SEQ ID NO: 663585 - RNA, 19 nt, Homo sapiens
ccaugaaggaggauaauga

SEQ ID NO: 663586 - RNA, 19 nt, Homo sapiens
gagcagcgagaacugauga

SEQ ID NO: 663587 - RNA, 19 nt, Homo sapiens
cacagcagaucagguaauu

SEQ ID NO: 663588 - RNA, 19 nt, Homo sapiens
gugaagaaccaguuacaga

SEQ ID NO: 663589 - RNA, 19 nt, Homo sapiens
ucacagggacugcaugaga

SEQ ID NO: 663590 - RNA, 19 nt, Homo sapiens
gaagaggaagaguucaaug

SEQ ID NO: 663591 - RNA, 19 nt, Homo sapiens
uaaccuccgacauguauuu

SEQ ID NO: 663592 - RNA, 19 nt, Homo sapiens
ggaggucacugagcaagag

SEQ ID NO: 663593 - RNA, 19 nt, Homo sapiens
gaacacagucauuccuuac

SEQ ID NO: 663594 - RNA, 19 nt, Homo sapiens
ggaagugaagaacuccuuu

SEQ ID NO: 663595 - RNA, 19 nt, Homo sapiens
ggagauugaggaaaugaug

SEQ ID NO: 663596 - RNA, 19 nt, Homo sapiens
gcugacaaacauucucuuu

SEQ ID NO: 663597 - RNA, 19 nt, Homo sapiens
cagagcagccggauagaga

SEQ ID NO: 663598 - RNA, 19 nt, Homo sapiens
agaaggaagugaagaacuc

SEQ ID NO: 663599 - RNA, 19 nt, Homo sapiens
ggacuacauuuuaaaagug

SEQ ID NO: 663600 - RNA, 19 nt, Homo sapiens
uugaggagauugaggaaau

SEQ ID NO: 663601 - RNA, 19 nt, Homo sapiens
gcuaacggacuacauuuua

SEQ ID NO: 663602 - RNA, 19 nt, Homo sapiens
aacaguaucugaacacagu

SEQ ID NO: 663603 - RNA, 19 nt, Homo sapiens
ccaggacccgcacagauaa

SEQ ID NO: 663604 - RNA, 19 nt, Homo sapiens
ucagguaauugaggagauu

SEQ ID NO: 663605 - RNA, 19 nt, Homo sapiens
aaacaucgaggcucugaau

SEQ ID NO: 663606 - RNA, 19 nt, Homo sapiens
acaauuacaucccuucacu

SEQ ID NO: 663607 - RNA, 19 nt, Homo sapiens
caacaacaacugguccuau

SEQ ID NO: 663608 - RNA, 19 nt, Homo sapiens
agaaagaagaggaagaguu

SEQ ID NO: 663609 - RNA, 19 nt, Homo sapiens
ggagggauccaaacaucga

SEQ ID NO: 663610 - RNA, 19 nt, Homo sapiens
caaacaguaucugaacaca

SEQ ID NO: 663611 - RNA, 19 nt, Homo sapiens
aacaacaacugguccuaug

SEQ ID NO: 663612 - RNA, 19 nt, Homo sapiens
ccgcacagauaaacucauc

SEQ ID NO: 663613 - RNA, 19 nt, Homo sapiens
gcaacugcucugacacuga

SEQ ID NO: 663614 - RNA, 19 nt, Homo sapiens
ugaagaaccaguuacagau

SEQ ID NO: 663615 - RNA, 19 nt, Homo sapiens
ggaaaccagaugccucuca

SEQ ID NO: 663616 - RNA, 19 nt, Homo sapiens
gcagcgagaacugaugaaa

SEQ ID NO: 663617 - RNA, 19 nt, Homo sapiens
uugaggaaaugaugcagaa

SEQ ID NO: 663618 - RNA, 19 nt, Homo sapiens
acacagucauuccuuacga

SEQ ID NO: 663619 - RNA, 19 nt, Homo sapiens
gaagaggauggaggagaaa

SEQ ID NO: 663620 - RNA, 19 nt, Homo sapiens
aagaggaagaguucaauga

SEQ ID NO: 663621 - RNA, 19 nt, Homo sapiens
aacauucucuuugccauga

SEQ ID NO: 663622 - RNA, 19 nt, Homo sapiens
gcagaugcugacaaacauu

SEQ ID NO: 663623 - RNA, 19 nt, Homo sapiens
gcagaaggagcagcgagaa

SEQ ID NO: 663624 - RNA, 19 nt, Homo sapiens
gaagggcugaggcacaugu

SEQ ID NO: 663625 - RNA, 19 nt, Homo sapiens
gaagaguucaaugagaaga

SEQ ID NO: 663626 - RNA, 19 nt, Homo sapiens
gguuugggaugcucugaca

SEQ ID NO: 663627 - RNA, 19 nt, Homo sapiens
uuaucacggugcuuauuga

SEQ ID NO: 663628 - RNA, 19 nt, Homo sapiens
cgaaauaaucagcuucaag

SEQ ID NO: 663629 - RNA, 19 nt, Homo sapiens
caucacagggacugcauga

SEQ ID NO: 663630 - RNA, 19 nt, Homo sapiens
uggaagaccugcagaugcu

SEQ ID NO: 663631 - RNA, 19 nt, Homo sapiens
gaaggagcagcgagaacug

SEQ ID NO: 663632 - RNA, 19 nt, Homo sapiens
cuaccuaaccuugcccuuu

SEQ ID NO: 663633 - RNA, 19 nt, Homo sapiens
gagaaggugccuacuuugc

SEQ ID NO: 663634 - RNA, 19 nt, Homo sapiens
cacagaccuucaacaacaa

SEQ ID NO: 663635 - RNA, 19 nt, Homo sapiens
ugacaaacaguaucugaac

SEQ ID NO: 663636 - RNA, 19 nt, Homo sapiens
ccaaacaucgaggcucuga

SEQ ID NO: 663637 - RNA, 19 nt, Homo sapiens
ccgcuuucaccgcucauua

SEQ ID NO: 663638 - RNA, 19 nt, Homo sapiens
cuaacggacuacauuuuaa

SEQ ID NO: 663639 - RNA, 19 nt, Homo sapiens
ccugaaagucgcuguuguu

SEQ ID NO: 663640 - RNA, 19 nt, Homo sapiens
gaggauggaggagaaacuu

SEQ ID NO: 663641 - RNA, 19 nt, Homo sapiens
gaggagauugaggaaauga

SEQ ID NO: 663642 - RNA, 19 nt, Homo sapiens
aauggcaacugcucugaca

SEQ ID NO: 663643 - RNA, 19 nt, Homo sapiens
uguaaccuccgacauguau

SEQ ID NO: 663644 - RNA, 19 nt, Homo sapiens
gaggaaaugaugcagaacu

SEQ ID NO: 663645 - RNA, 19 nt, Homo sapiens
ugaggagauugaggaaaug

SEQ ID NO: 663646 - RNA, 19 nt, Homo sapiens
gaaccuagcucccgugaag

SEQ ID NO: 663647 - RNA, 19 nt, Homo sapiens
ggacuaauuugcuucaaga

SEQ ID NO: 663648 - RNA, 19 nt, Homo sapiens
gaaagucgcuguuguucuc

SEQ ID NO: 663649 - RNA, 19 nt, Homo sapiens
ccucaggccuggagaguua

SEQ ID NO: 663650 - RNA, 19 nt, Homo sapiens
caucuaaacugaacugaga

SEQ ID NO: 663651 - RNA, 19 nt, Homo sapiens
ggaugaaucuauguuauug

SEQ ID NO: 663652 - RNA, 19 nt, Homo sapiens
gaaauccagcgagauauua

SEQ ID NO: 663653 - RNA, 19 nt, Homo sapiens
gaaauaaucagcuucaagu

SEQ ID NO: 663654 - RNA, 19 nt, Homo sapiens
ucaagaaacaccagaauuu

SEQ ID NO: 663655 - RNA, 19 nt, Homo sapiens
gaaagcaucuaaacugaac

SEQ ID NO: 663656 - RNA, 19 nt, Homo sapiens
ggugauauguuacacaaau

SEQ ID NO: 663657 - RNA, 19 nt, Homo sapiens
cagauaaacucauccugaa

SEQ ID NO: 663658 - RNA, 19 nt, Homo sapiens
gaaaagggaucugagaaaa

SEQ ID NO: 663659 - RNA, 19 nt, Homo sapiens
uaagaaagcaucuaaacug

SEQ ID NO: 663660 - RNA, 19 nt, Homo sapiens
ggaaauccagcgagauauu

SEQ ID NO: 663661 - RNA, 19 nt, Homo sapiens
aagaaagcaucuaaacuga

SEQ ID NO: 663662 - RNA, 19 nt, Homo sapiens
gagucuggaugaagaguuu

SEQ ID NO: 663663 - RNA, 19 nt, Homo sapiens
caccaugcccgacuaauuu

SEQ ID NO: 663664 - RNA, 19 nt, Homo sapiens
gauggaugaaucuauguua

SEQ ID NO: 663665 - RNA, 19 nt, Homo sapiens
gggcuacccuggacaaagu

SEQ ID NO: 663666 - RNA, 19 nt, Homo sapiens
cuacagauguuaggauaug

SEQ ID NO: 663667 - RNA, 19 nt, Homo sapiens
caugauggaugaaucuaug

SEQ ID NO: 663668 - RNA, 19 nt, Homo sapiens
cgagagcccuguaguccuu

SEQ ID NO: 663669 - RNA, 19 nt, Homo sapiens
gccaggacccgcacagaua

SEQ ID NO: 663670 - RNA, 19 nt, Homo sapiens
uaaguuaggcacaguaaga

SEQ ID NO: 663671 - RNA, 19 nt, Homo sapiens
guacguacauaugauaaag

SEQ ID NO: 663672 - RNA, 19 nt, Homo sapiens
gcagauuccugguaucacu

SEQ ID NO: 663673 - RNA, 19 nt, Homo sapiens
guaugcagauuccugguau

SEQ ID NO: 663674 - RNA, 19 nt, Homo sapiens
gaaugaagguuuuccuaga

SEQ ID NO: 663675 - RNA, 19 nt, Homo sapiens
ccaaagugcugggauuaca

SEQ ID NO: 663676 - RNA, 19 nt, Homo sapiens
gaguagagaugggaguuuc

SEQ ID NO: 663677 - RNA, 19 nt, Homo sapiens
aaggaugucuuaggcauuu

SEQ ID NO: 663678 - RNA, 19 nt, Homo sapiens
ccagcgagauauuagaaau

SEQ ID NO: 663679 - RNA, 19 nt, Homo sapiens
gauaaacucauccugaaag

SEQ ID NO: 663680 - RNA, 19 nt, Homo sapiens
uaggugauguggccuuuga

SEQ ID NO: 663681 - RNA, 19 nt, Homo sapiens
cagggucugucuaucuuaa

SEQ ID NO: 663682 - RNA, 19 nt, Homo sapiens
ccugguacuugcugucaua

SEQ ID NO: 663683 - RNA, 19 nt, Homo sapiens
gaagaaccaguuacagauc

SEQ ID NO: 663684 - RNA, 19 nt, Homo sapiens
gugaagaaccaguuacaga

SEQ ID NO: 663685 - RNA, 19 nt, Homo sapiens
ucuagggucuuaauaguag

SEQ ID NO: 663686 - RNA, 19 nt, Homo sapiens
gcuacuuucuagggucuua

SEQ ID NO: 663687 - RNA, 19 nt, Homo sapiens
aaguaaagguggaaacuag

SEQ ID NO: 663688 - RNA, 19 nt, Homo sapiens
cuaauuugcuucaagaaac

SEQ ID NO: 663689 - RNA, 19 nt, Homo sapiens
cuauauaugucccuuuaca

SEQ ID NO: 663690 - RNA, 19 nt, Homo sapiens
ccaccaugcccgacuaauu

SEQ ID NO: 663691 - RNA, 19 nt, Homo sapiens
ugucuuaggcauuuaguaa

SEQ ID NO: 663692 - RNA, 19 nt, Homo sapiens
guuuaugggcuauuacuuu

SEQ ID NO: 663693 - RNA, 19 nt, Homo sapiens
gaaggaugucuuaggcauu

SEQ ID NO: 663694 - RNA, 19 nt, Homo sapiens
gauguggccuuugaguaug

SEQ ID NO: 663695 - RNA, 19 nt, Homo sapiens
cucuauauaugucccuuua

SEQ ID NO: 663696 - RNA, 19 nt, Homo sapiens
uaauugcccucuccugcuu

SEQ ID NO: 663697 - RNA, 19 nt, Homo sapiens
ggacgaggaguaagaaguc

SEQ ID NO: 663698 - RNA, 19 nt, Homo sapiens
cuccugaccuggugauuug

SEQ ID NO: 663699 - RNA, 19 nt, Homo sapiens
ggacaaaguaaagguggaa

SEQ ID NO: 663700 - RNA, 19 nt, Homo sapiens
guuucugucuauagguuua

SEQ ID NO: 663701 - RNA, 19 nt, Homo sapiens
acauagugcugguuucugu

SEQ ID NO: 663702 - RNA, 19 nt, Homo sapiens
cacauaagaaagcaucuaa

SEQ ID NO: 663703 - RNA, 19 nt, Homo sapiens
ccaggacccgcacagauaa

SEQ ID NO: 663704 - RNA, 19 nt, Homo sapiens
gguggaaacuaggugaugu

SEQ ID NO: 663705 - RNA, 19 nt, Homo sapiens
ugauguggccuuugaguau

SEQ ID NO: 663706 - RNA, 19 nt, Homo sapiens
ccgcacagauaaacucauc

SEQ ID NO: 663707 - RNA, 19 nt, Homo sapiens
gaauuucaggagcacagua

SEQ ID NO: 663708 - RNA, 19 nt, Homo sapiens
ugaagaaccaguuacagau

SEQ ID NO: 663709 - RNA, 19 nt, Homo sapiens
caacagcucacagccaaau

SEQ ID NO: 663710 - RNA, 19 nt, Homo sapiens
ggagggacuagaaagagaa

SEQ ID NO: 663711 - RNA, 19 nt, Homo sapiens
ucaggagcacaguaaauuu

SEQ ID NO: 663712 - RNA, 19 nt, Homo sapiens
gagcagugcccugguacuu

SEQ ID NO: 663713 - RNA, 19 nt, Homo sapiens
gccaaauagagcaauuaua

SEQ ID NO: 663714 - RNA, 19 nt, Homo sapiens
cauaagaaagcaucuaaac

SEQ ID NO: 663715 - RNA, 19 nt, Homo sapiens
ccugaaaccgcugcuagua

SEQ ID NO: 663716 - RNA, 19 nt, Homo sapiens
cgaaauaaucagcuucaag

SEQ ID NO: 663717 - RNA, 19 nt, Homo sapiens
caagaaacaccagaauuuu

SEQ ID NO: 663718 - RNA, 19 nt, Homo sapiens
gguacuugcugucauagcu

SEQ ID NO: 663719 - RNA, 19 nt, Homo sapiens
uuuaugggcuauuacuuuc

SEQ ID NO: 663720 - RNA, 19 nt, Homo sapiens
gugcugguuucugucuaua

SEQ ID NO: 663721 - RNA, 19 nt, Homo sapiens
cagccaaauagagcaauua

SEQ ID NO: 663722 - RNA, 19 nt, Homo sapiens
gcacaguaagagacuaaca

SEQ ID NO: 663723 - RNA, 19 nt, Homo sapiens
uauaaguuaggcacaguaa

SEQ ID NO: 663724 - RNA, 19 nt, Homo sapiens
ccucccagguucaagcuau

SEQ ID NO: 663725 - RNA, 19 nt, Homo sapiens
gugauguggccuuugagua

SEQ ID NO: 663726 - RNA, 19 nt, Homo sapiens
aaaguaaagguggaaacua

SEQ ID NO: 663727 - RNA, 19 nt, Homo sapiens
ccacauaagaaagcaucua

SEQ ID NO: 663728 - RNA, 19 nt, Homo sapiens
cuggagaguuaucuacaga

SEQ ID NO: 663729 - RNA, 19 nt, Homo sapiens
caggagcacaguaaauuuc

SEQ ID NO: 663730 - RNA, 19 nt, Homo sapiens
ucaggagggacuagaaaga

SEQ ID NO: 663731 - RNA, 19 nt, Homo sapiens
gcuaguaccaaacccuaau

SEQ ID NO: 663732 - RNA, 19 nt, Homo sapiens
ccugaaagucgcuguuguu

SEQ ID NO: 663733 - RNA, 19 nt, Homo sapiens
acagccaaauagagcaauu

SEQ ID NO: 663734 - RNA, 19 nt, Homo sapiens
aggagggacuagaaagaga

SEQ ID NO: 663735 - RNA, 19 nt, Homo sapiens
uuucuagggucuuaauagu

SEQ ID NO: 663736 - RNA, 19 nt, Homo sapiens
aauugaaaccuuagaggaa

SEQ ID NO: 663737 - RNA, 19 nt, Homo sapiens
gcugguuucugucuauagg

SEQ ID NO: 663738 - RNA, 19 nt, Homo sapiens
caaaguaaagguggaaacu

SEQ ID NO: 663739 - RNA, 19 nt, Homo sapiens
agaaagcaucuaaacugaa

SEQ ID NO: 663740 - RNA, 19 nt, Homo sapiens
uggugagucuggaugaaga

SEQ ID NO: 663741 - RNA, 19 nt, Homo sapiens
cacaguaagagacuaacaa

SEQ ID NO: 663742 - RNA, 19 nt, Homo sapiens
guaaagguggaaacuaggu

SEQ ID NO: 663743 - RNA, 19 nt, Homo sapiens
ggaacuacaacgccaagac

SEQ ID NO: 663744 - RNA, 19 nt, Homo sapiens
auaaacucauccugaaagu

SEQ ID NO: 663745 - RNA, 19 nt, Homo sapiens
uagaaauaaaggccagaaa

SEQ ID NO: 663746 - RNA, 19 nt, Homo sapiens
gaaagaagaugaaaucaga

SEQ ID NO: 663747 - RNA, 19 nt, Homo sapiens
gcagagaaguuaaaugaaa

SEQ ID NO: 663748 - RNA, 19 nt, Homo sapiens
gcaaauagccaaagccaua

SEQ ID NO: 663749 - RNA, 19 nt, Homo sapiens
gcacucagaugaaaugauu

SEQ ID NO: 663750 - RNA, 19 nt, Homo sapiens
gcagaagacugaugcaauu

SEQ ID NO: 663751 - RNA, 19 nt, Homo sapiens
ggaaacagcuccuuggaau

SEQ ID NO: 663752 - RNA, 19 nt, Homo sapiens
ggauggaguuuccuuauaa

SEQ ID NO: 663753 - RNA, 19 nt, Homo sapiens
ugagagagcuggauugauu

SEQ ID NO: 663754 - RNA, 19 nt, Homo sapiens
gcauggagauuauuuguau

SEQ ID NO: 663755 - RNA, 19 nt, Homo sapiens
gaucaacgcugugaaguga

SEQ ID NO: 663756 - RNA, 19 nt, Homo sapiens
cgagugaauuugaaaguua

SEQ ID NO: 663757 - RNA, 19 nt, Homo sapiens
gagcuggauugauugauua

SEQ ID NO: 663758 - RNA, 19 nt, Homo sapiens
ggacaacuguaucaagauu

SEQ ID NO: 663759 - RNA, 19 nt, Homo sapiens
gaagaggcauggucuccua

SEQ ID NO: 663760 - RNA, 19 nt, Homo sapiens
ggagaaauauuacaaggau

SEQ ID NO: 663761 - RNA, 19 nt, Homo sapiens
gaacguguauuucaguguu

SEQ ID NO: 663762 - RNA, 19 nt, Homo sapiens
ggaaugcugugucugcuuu

SEQ ID NO: 663763 - RNA, 19 nt, Homo sapiens
gaagaaagaagaugaaauc

SEQ ID NO: 663764 - RNA, 19 nt, Homo sapiens
ccaaauugauggacauaaa

SEQ ID NO: 663765 - RNA, 19 nt, Homo sapiens
gaaggaaacucacuuagcu

SEQ ID NO: 663766 - RNA, 19 nt, Homo sapiens
ggucaagucuucaucauca

SEQ ID NO: 663767 - RNA, 19 nt, Homo sapiens
gagaauuccuuacuagaug

SEQ ID NO: 663768 - RNA, 19 nt, Homo sapiens
gaacuuaaaccagucagua

SEQ ID NO: 663769 - RNA, 19 nt, Homo sapiens
ucacucagcugauaggaaa

SEQ ID NO: 663770 - RNA, 19 nt, Homo sapiens
gggauggaguuuccuuaua

SEQ ID NO: 663771 - RNA, 19 nt, Homo sapiens
gcagagaagucuugcuuag

SEQ ID NO: 663772 - RNA, 19 nt, Homo sapiens
ucacggcguucguuaauuu

SEQ ID NO: 663773 - RNA, 19 nt, Homo sapiens
ccucagugcuuaauuacua

SEQ ID NO: 663774 - RNA, 19 nt, Homo sapiens
gugagaacgugcauaauga

SEQ ID NO: 663775 - RNA, 19 nt, Homo sapiens
gcaguuacauaccgaauag

SEQ ID NO: 663776 - RNA, 19 nt, Homo sapiens
ugacagagcucgaaacacu

SEQ ID NO: 663777 - RNA, 19 nt, Homo sapiens
gagcucauuucacgcauuu

SEQ ID NO: 663778 - RNA, 19 nt, Homo sapiens
gaaacucacuuagcugaau

SEQ ID NO: 663779 - RNA, 19 nt, Homo sapiens
gaacgcaucaguuucuauu

SEQ ID NO: 663780 - RNA, 19 nt, Homo sapiens
gcaacuuucucaugaccua

SEQ ID NO: 663781 - RNA, 19 nt, Homo sapiens
gcacucgcauuuccuaguu

SEQ ID NO: 663782 - RNA, 19 nt, Homo sapiens
gaccaaagguuaguugaug

SEQ ID NO: 663783 - RNA, 19 nt, Homo sapiens
agagaagucuugcuuaguu

SEQ ID NO: 663784 - RNA, 19 nt, Homo sapiens
uaaaggagcacuaugagaa

SEQ ID NO: 663785 - RNA, 19 nt, Homo sapiens
uaucaucuguccaccauuu

SEQ ID NO: 663786 - RNA, 19 nt, Homo sapiens
gaaugauuguggaugcaua

SEQ ID NO: 663787 - RNA, 19 nt, Homo sapiens
ugaauagccugaguuguaa

SEQ ID NO: 663788 - RNA, 19 nt, Homo sapiens
ccacauuucuucacucguu

SEQ ID NO: 663789 - RNA, 19 nt, Homo sapiens
gagauagggugauuucauc

SEQ ID NO: 663790 - RNA, 19 nt, Homo sapiens
ucagaccuauuguaucaua

SEQ ID NO: 663791 - RNA, 19 nt, Homo sapiens
cgucagaccuauuguauca

SEQ ID NO: 663792 - RNA, 19 nt, Homo sapiens
gauuguggaugcauaaaga

SEQ ID NO: 663793 - RNA, 19 nt, Homo sapiens
agugugugcuuuaguauua

SEQ ID NO: 663794 - RNA, 19 nt, Homo sapiens
gaaccuuaccuaaauaaug

SEQ ID NO: 663795 - RNA, 19 nt, Homo sapiens
ucacagaucuucucuugag

SEQ ID NO: 663796 - RNA, 19 nt, Homo sapiens
uagagaauuugcagacuaa

SEQ ID NO: 663797 - RNA, 19 nt, Homo sapiens
gcacuuuacagaugacuaa

SEQ ID NO: 663798 - RNA, 19 nt, Homo sapiens
caacagcaauugcguuucu

SEQ ID NO: 663799 - RNA, 19 nt, Homo sapiens
ugucugacuucaucaauaa

SEQ ID NO: 663800 - RNA, 19 nt, Homo sapiens
guagugcaggcauuuauua

SEQ ID NO: 663801 - RNA, 19 nt, Homo sapiens
cagcaggaguucaagauug

SEQ ID NO: 663802 - RNA, 19 nt, Homo sapiens
caggacaacuguaucaaga

SEQ ID NO: 663803 - RNA, 19 nt, Homo sapiens
uagcagagaaguuaaauga

SEQ ID NO: 663804 - RNA, 19 nt, Homo sapiens
gcagaagcaugaacugaag

SEQ ID NO: 663805 - RNA, 19 nt, Homo sapiens
gaaacagcuccuuggaaua

SEQ ID NO: 663806 - RNA, 19 nt, Homo sapiens
guggaugcauaaagaauaa

SEQ ID NO: 663807 - RNA, 19 nt, Homo sapiens
gaaaagaacuacguagaug

SEQ ID NO: 663808 - RNA, 19 nt, Homo sapiens
uguagucaguggagaaaua

SEQ ID NO: 663809 - RNA, 19 nt, Homo sapiens
auaaaugucucagcacuuu

SEQ ID NO: 663810 - RNA, 19 nt, Homo sapiens
ccacggcucugcacgagaa

SEQ ID NO: 663811 - RNA, 19 nt, Homo sapiens
aaagauaccugaacaagcu

SEQ ID NO: 663812 - RNA, 19 nt, Homo sapiens
ggauggaguucgagugaau

SEQ ID NO: 663813 - RNA, 19 nt, Homo sapiens
guauauuccucagugcuua

SEQ ID NO: 663814 - RNA, 19 nt, Homo sapiens
cugaauagccugaguugua

SEQ ID NO: 663815 - RNA, 19 nt, Homo sapiens
ugacuuagccaaauauguu

SEQ ID NO: 663816 - RNA, 19 nt, Homo sapiens
ggagcugguucaucucuga

SEQ ID NO: 663817 - RNA, 19 nt, Homo sapiens
ggaaguugcacccaucaaa

SEQ ID NO: 663818 - RNA, 19 nt, Homo sapiens
agaaacaccugaagugcuu

SEQ ID NO: 663819 - RNA, 19 nt, Homo sapiens
caaguuaccuggcaugacu

SEQ ID NO: 663820 - RNA, 19 nt, Homo sapiens
gugcugagauguguauauu

SEQ ID NO: 663821 - RNA, 19 nt, Homo sapiens
uaacagaccuaaguaaagg

SEQ ID NO: 663822 - RNA, 19 nt, Homo sapiens
gggagaauaugggagaauu

SEQ ID NO: 663823 - RNA, 19 nt, Homo sapiens
caaggugcauacuuaguga

SEQ ID NO: 663824 - RNA, 19 nt, Homo sapiens
gcacgcacgcuccgaauga

SEQ ID NO: 663825 - RNA, 19 nt, Homo sapiens
gaagucuacucaugaugga

SEQ ID NO: 663826 - RNA, 19 nt, Homo sapiens
ggaagccgauaccucauuc

SEQ ID NO: 663827 - RNA, 19 nt, Homo sapiens
uauaagaacucagaagcaa

SEQ ID NO: 663828 - RNA, 19 nt, Homo sapiens
caaagaaagugaggaccaa

SEQ ID NO: 663829 - RNA, 19 nt, Homo sapiens
cuacguagaugcucuuaag

SEQ ID NO: 663830 - RNA, 19 nt, Homo sapiens
ucaaagggcugaaaaucua

SEQ ID NO: 663831 - RNA, 19 nt, Homo sapiens
gaacacagggagaauaugg

SEQ ID NO: 663832 - RNA, 19 nt, Homo sapiens
acuguuagcugcugucuga

SEQ ID NO: 663833 - RNA, 19 nt, Homo sapiens
gauugaaugugcugcuuau

SEQ ID NO: 663834 - RNA, 19 nt, Homo sapiens
ggaguucgagugaauuuga

SEQ ID NO: 663835 - RNA, 19 nt, Homo sapiens
gaauacggauggaguucga

SEQ ID NO: 663836 - RNA, 19 nt, Homo sapiens
caagaggaagugaguaauu

SEQ ID NO: 663837 - RNA, 19 nt, Homo sapiens
cagugaccauccaacauua

SEQ ID NO: 663838 - RNA, 19 nt, Homo sapiens
ccaaagugguauaaugugu

SEQ ID NO: 663839 - RNA, 19 nt, Homo sapiens
gugcaggcauuuauuaaca

SEQ ID NO: 663840 - RNA, 19 nt, Homo sapiens
gcugugaagugaagcaaau

SEQ ID NO: 663841 - RNA, 19 nt, Homo sapiens
ccauggugcuggaugcaua

SEQ ID NO: 663842 - RNA, 19 nt, Homo sapiens
gcagcagguuguaagaaga

SEQ ID NO: 663843 - RNA, 19 nt, Homo sapiens
cucuaaggcugacaaguua

SEQ ID NO: 663844 - RNA, 19 nt, Homo sapiens
uuacuuaugugcugagaug

SEQ ID NO: 663845 - RNA, 19 nt, Homo sapiens
ggaugacucuuggcucuug

SEQ ID NO: 663846 - RNA, 19 nt, Homo sapiens
caacaaccaugacacagua

SEQ ID NO: 663847 - RNA, 19 nt, Homo sapiens
caucaaagauaacggauuu

SEQ ID NO: 663848 - RNA, 19 nt, Homo sapiens
aaagagaguucuaaaggua

SEQ ID NO: 663849 - RNA, 19 nt, Homo sapiens
ccucaaaccuccaggcaua

SEQ ID NO: 663850 - RNA, 19 nt, Homo sapiens
gauaacggauuugggauaa

SEQ ID NO: 663851 - RNA, 19 nt, Homo sapiens
gagcgacacugccagguuu

SEQ ID NO: 663852 - RNA, 19 nt, Homo sapiens
ccucccagcucauuuauaa

SEQ ID NO: 663853 - RNA, 19 nt, Homo sapiens
guacugcucucgugccauu

SEQ ID NO: 663854 - RNA, 19 nt, Homo sapiens
uauaagugcuccugugaaa

SEQ ID NO: 663855 - RNA, 19 nt, Homo sapiens
ucacagacauuggaauauu

SEQ ID NO: 663856 - RNA, 19 nt, Homo sapiens
caaacacucugacaguuau

SEQ ID NO: 663857 - RNA, 19 nt, Homo sapiens
gcaaacacauccgcaacaa

SEQ ID NO: 663858 - RNA, 19 nt, Homo sapiens
ggagagcucugccuagucu

SEQ ID NO: 663859 - RNA, 19 nt, Homo sapiens
gaggaucccaucaaagaua

SEQ ID NO: 663860 - RNA, 19 nt, Homo sapiens
ccaaacacucugacaguua

SEQ ID NO: 663861 - RNA, 19 nt, Homo sapiens
gaaaucaaacggacuguca

SEQ ID NO: 663862 - RNA, 19 nt, Homo sapiens
ugucaaaccuccagucuuc

SEQ ID NO: 663863 - RNA, 19 nt, Homo sapiens
ccucacagcucugaauuug

SEQ ID NO: 663864 - RNA, 19 nt, Homo sapiens
ggacgaugguggccacaau

SEQ ID NO: 663865 - RNA, 19 nt, Homo sapiens
gaaagaacccaagccagaa

SEQ ID NO: 663866 - RNA, 19 nt, Homo sapiens
agaauggacuggaagaaug

SEQ ID NO: 663867 - RNA, 19 nt, Homo sapiens
gguccuggcugcacauuuc

SEQ ID NO: 663868 - RNA, 19 nt, Homo sapiens
uaaagagaguucuaaaggu

SEQ ID NO: 663869 - RNA, 19 nt, Homo sapiens
cacagacauuggaauauuu

SEQ ID NO: 663870 - RNA, 19 nt, Homo sapiens
ggagaagacagaaggaaga

SEQ ID NO: 663871 - RNA, 19 nt, Homo sapiens
gagaacuaauugucacaga

SEQ ID NO: 663872 - RNA, 19 nt, Homo sapiens
gcucugaauuugcuucugu

SEQ ID NO: 663873 - RNA, 19 nt, Homo sapiens
gcauuugccuuagagaaga

SEQ ID NO: 663874 - RNA, 19 nt, Homo sapiens
ggagaaagaccacauuacu

SEQ ID NO: 663875 - RNA, 19 nt, Homo sapiens
ccacaaugaucacagucaa

SEQ ID NO: 663876 - RNA, 19 nt, Homo sapiens
gagaauugccugcacuaug

SEQ ID NO: 663877 - RNA, 19 nt, Homo sapiens
ggaugccacucgauucuuc

SEQ ID NO: 663878 - RNA, 19 nt, Homo sapiens
cuaaggagcggagaguuua

SEQ ID NO: 663879 - RNA, 19 nt, Homo sapiens
gcucagacuauauuucaaa

SEQ ID NO: 663880 - RNA, 19 nt, Homo sapiens
uaagugcuccugugaaaug

SEQ ID NO: 663881 - RNA, 19 nt, Homo sapiens
uuccagagcugcauauguu

SEQ ID NO: 663882 - RNA, 19 nt, Homo sapiens
gcggagaaagaccacauua

SEQ ID NO: 663883 - RNA, 19 nt, Homo sapiens
gagagccacaucagccuua

SEQ ID NO: 663884 - RNA, 19 nt, Homo sapiens
ggacaacagaggagacaga

SEQ ID NO: 663885 - RNA, 19 nt, Homo sapiens
ccacaguguugcugcauca

SEQ ID NO: 663886 - RNA, 19 nt, Homo sapiens
gagguacugugcacacugu

SEQ ID NO: 663887 - RNA, 19 nt, Homo sapiens
gcccaaagccgugcacuug

SEQ ID NO: 663888 - RNA, 19 nt, Homo sapiens
cugcauauguuugaucauu

SEQ ID NO: 663889 - RNA, 19 nt, Homo sapiens
uaacggauuugggauaaag

SEQ ID NO: 663890 - RNA, 19 nt, Homo sapiens
ccucuuggcuacacucaug

SEQ ID NO: 663891 - RNA, 19 nt, Homo sapiens
ucacagcucugaauuugcu

SEQ ID NO: 663892 - RNA, 19 nt, Homo sapiens
gcucucgaguucccacuga

SEQ ID NO: 663893 - RNA, 19 nt, Homo sapiens
gggaagcuuuggaguucaa

SEQ ID NO: 663894 - RNA, 19 nt, Homo sapiens
uggaggcucuggcuaaguu

SEQ ID NO: 663895 - RNA, 19 nt, Homo sapiens
gagaauggacuggaagaau

SEQ ID NO: 663896 - RNA, 19 nt, Homo sapiens
gcaacaaccaugacacagu

SEQ ID NO: 663897 - RNA, 19 nt, Homo sapiens
gagccacggucggacauug

SEQ ID NO: 663898 - RNA, 19 nt, Homo sapiens
cuacgugucccacaugaaa

SEQ ID NO: 663899 - RNA, 19 nt, Homo sapiens
gacccucccagcucauuua

SEQ ID NO: 663900 - RNA, 19 nt, Homo sapiens
agaauugccugcacuaugc

SEQ ID NO: 663901 - RNA, 19 nt, Homo sapiens
ccacuaaagagaguucuaa

SEQ ID NO: 663902 - RNA, 19 nt, Homo sapiens
ucucagggcccacuaaaga

SEQ ID NO: 663903 - RNA, 19 nt, Homo sapiens
cauccuagcaacaguauug

SEQ ID NO: 663904 - RNA, 19 nt, Homo sapiens
uagagagaauggacuggaa

SEQ ID NO: 663905 - RNA, 19 nt, Homo sapiens
gcacauuuccagaggacaa

SEQ ID NO: 663906 - RNA, 19 nt, Homo sapiens
guuguacccuggaguagug

SEQ ID NO: 663907 - RNA, 19 nt, Homo sapiens
gaccuuggccuugcugaaa

SEQ ID NO: 663908 - RNA, 19 nt, Homo sapiens
gagacgcauuugccuuaga

SEQ ID NO: 663909 - RNA, 19 nt, Homo sapiens
ggaguguggagacgcauuu

SEQ ID NO: 663910 - RNA, 19 nt, Homo sapiens
agccacagcuuacacaaau

SEQ ID NO: 663911 - RNA, 19 nt, Homo sapiens
gauaaagcccaaacacucu

SEQ ID NO: 663912 - RNA, 19 nt, Homo sapiens
ugagugucauugucaagaa

SEQ ID NO: 663913 - RNA, 19 nt, Homo sapiens
ucauguugcucagacuaua

SEQ ID NO: 663914 - RNA, 19 nt, Homo sapiens
gcagacaccagcucuccuu

SEQ ID NO: 663915 - RNA, 19 nt, Homo sapiens
gaauggacuggaagaaugu

SEQ ID NO: 663916 - RNA, 19 nt, Homo sapiens
uggagacgcauuugccuua

SEQ ID NO: 663917 - RNA, 19 nt, Homo sapiens
cuaaagagaguucuaaagg

SEQ ID NO: 663918 - RNA, 19 nt, Homo sapiens
gagcaaagugggcagaaca

SEQ ID NO: 663919 - RNA, 19 nt, Homo sapiens
gagcguccacauugaggua

SEQ ID NO: 663920 - RNA, 19 nt, Homo sapiens
gacgagagcaugacaaagg

SEQ ID NO: 663921 - RNA, 19 nt, Homo sapiens
ccaaguaaguccccuguug

SEQ ID NO: 663922 - RNA, 19 nt, Homo sapiens
caccagcaauucccaaagu

SEQ ID NO: 663923 - RNA, 19 nt, Homo sapiens
uagaccaugugccuaggua

SEQ ID NO: 663924 - RNA, 19 nt, Homo sapiens
gagaaagaccacauuacuc

SEQ ID NO: 663925 - RNA, 19 nt, Homo sapiens
acaagcagaugcgggacua

SEQ ID NO: 663926 - RNA, 19 nt, Homo sapiens
gcacuuggccaaccugaac

SEQ ID NO: 663927 - RNA, 19 nt, Homo sapiens
gggacgagagcaugacaaa

SEQ ID NO: 663928 - RNA, 19 nt, Homo sapiens
cauggagacuagagagaau

SEQ ID NO: 663929 - RNA, 19 nt, Homo sapiens
caaugucuccucugugguu

SEQ ID NO: 663930 - RNA, 19 nt, Homo sapiens
agccagacguccaaaguga

SEQ ID NO: 663931 - RNA, 19 nt, Homo sapiens
gcagaugcgggacuacaug

SEQ ID NO: 663932 - RNA, 19 nt, Homo sapiens
cguagcaucugcagugaca

SEQ ID NO: 663933 - RNA, 19 nt, Homo sapiens
ggagacagugccaggaguu

SEQ ID NO: 663934 - RNA, 19 nt, Homo sapiens
gcaaggggcucgucaugca

SEQ ID NO: 663935 - RNA, 19 nt, Homo sapiens
ggaucagccuggccacaca

SEQ ID NO: 663936 - RNA, 19 nt, Homo sapiens
gaugaaaguguguccuugu

SEQ ID NO: 663937 - RNA, 19 nt, Homo sapiens
acaagaagaggcacauuca

SEQ ID NO: 663938 - RNA, 19 nt, Homo sapiens
gagcggagaguuuaauagg

SEQ ID NO: 663939 - RNA, 19 nt, Homo sapiens
ccacacaaaggaucucuca

SEQ ID NO: 663940 - RNA, 19 nt, Homo sapiens
cugaggaucccaucaaaga

SEQ ID NO: 663941 - RNA, 19 nt, Homo sapiens
gagagaauggacuggaaga

SEQ ID NO: 663942 - RNA, 19 nt, Homo sapiens
ccagacguccaaagugaaa

SEQ ID NO: 663943 - RNA, 19 nt, Homo sapiens
ccaacagccugcgcaaaca

SEQ ID NO: 663944 - RNA, 19 nt, Homo sapiens
gcagaagccggaguugaug

SEQ ID NO: 663945 - RNA, 19 nt, Homo sapiens
ggagcgacacugccagguu

SEQ ID NO: 663946 - RNA, 19 nt, Homo sapiens
uaagaacacugcucaugaa

SEQ ID NO: 663947 - RNA, 19 nt, Homo sapiens
gaggcauccugaagcauua

SEQ ID NO: 663948 - RNA, 19 nt, Homo sapiens
gaauaaauguggccuuugc

SEQ ID NO: 663949 - RNA, 19 nt, Homo sapiens
caaacgaccucaucacagu

SEQ ID NO: 663950 - RNA, 19 nt, Homo sapiens
gaaggcggcugcagaacug

SEQ ID NO: 663951 - RNA, 19 nt, Homo sapiens
ggaacaaggagaucaugua

SEQ ID NO: 663952 - RNA, 19 nt, Homo sapiens
ugacugagccuaaaguuga

SEQ ID NO: 663953 - RNA, 19 nt, Homo sapiens
gcauuggagugaccuugua

SEQ ID NO: 663954 - RNA, 19 nt, Homo sapiens
gaacaucgucaagcucuuu

SEQ ID NO: 663955 - RNA, 19 nt, Homo sapiens
agacagaaagcauaacaua

SEQ ID NO: 663956 - RNA, 19 nt, Homo sapiens
ucagcaagcuccuggaaga

SEQ ID NO: 663957 - RNA, 19 nt, Homo sapiens
gaacaucaugcgccucgua

SEQ ID NO: 663958 - RNA, 19 nt, Homo sapiens
caucugaccuccuggacaa

SEQ ID NO: 663959 - RNA, 19 nt, Homo sapiens
ggacaucccuccucuaccu

SEQ ID NO: 663960 - RNA, 19 nt, Homo sapiens
gaagagccgggaucaggua

SEQ ID NO: 663961 - RNA, 19 nt, Homo sapiens
guggaucucuggagcauug

SEQ ID NO: 663962 - RNA, 19 nt, Homo sapiens
ccacagacagaaagcauaa

SEQ ID NO: 663963 - RNA, 19 nt, Homo sapiens
ugaagcugcuggcaucuga

SEQ ID NO: 663964 - RNA, 19 nt, Homo sapiens
gaacaaggagaucauguac

SEQ ID NO: 663965 - RNA, 19 nt, Homo sapiens
caggaugucgccagcauua

SEQ ID NO: 663966 - RNA, 19 nt, Homo sapiens
ggacaacaaccgcaucauc

SEQ ID NO: 663967 - RNA, 19 nt, Homo sapiens
acaaacaguucaagaaguc

SEQ ID NO: 663968 - RNA, 19 nt, Homo sapiens
uaucaagcguccuuaguca

SEQ ID NO: 663969 - RNA, 19 nt, Homo sapiens
gcagcagccugggaacuga

SEQ ID NO: 663970 - RNA, 19 nt, Homo sapiens
cccgggagcuggaugauga

SEQ ID NO: 663971 - RNA, 19 nt, Homo sapiens
uggaauaaauguggccuuu

SEQ ID NO: 663972 - RNA, 19 nt, Homo sapiens
gaagagccuuugccugacu

SEQ ID NO: 663973 - RNA, 19 nt, Homo sapiens
ucaagaaguggaauaaaug

SEQ ID NO: 663974 - RNA, 19 nt, Homo sapiens
uggcugaccuuucuaucuu

SEQ ID NO: 663975 - RNA, 19 nt, Homo sapiens
cuaagaacacugcucauga

SEQ ID NO: 663976 - RNA, 19 nt, Homo sapiens
ucuacaagcugacagacuu

SEQ ID NO: 663977 - RNA, 19 nt, Homo sapiens
ggaccugcuucuccacaug

SEQ ID NO: 663978 - RNA, 19 nt, Homo sapiens
cuucaagcguuucauguug

SEQ ID NO: 663979 - RNA, 19 nt, Homo sapiens
acagaaagcauaacauaca

SEQ ID NO: 663980 - RNA, 19 nt, Homo sapiens
caacaaccgcaucaucgaa

SEQ ID NO: 663981 - RNA, 19 nt, Homo sapiens
guaccugcaucccgacaug

SEQ ID NO: 663982 - RNA, 19 nt, Homo sapiens
gcacaugaggcauccugaa

SEQ ID NO: 663983 - RNA, 19 nt, Homo sapiens
uagagagccuccuguucuu

SEQ ID NO: 663984 - RNA, 19 nt, Homo sapiens
uucaagaagucuaggauga

SEQ ID NO: 663985 - RNA, 19 nt, Homo sapiens
ggagcuggaugaugaugag

SEQ ID NO: 663986 - RNA, 19 nt, Homo sapiens
gggaagaaacccacuaguc

SEQ ID NO: 663987 - RNA, 19 nt, Homo sapiens
ggcaggagcuaauguuucg

SEQ ID NO: 663988 - RNA, 19 nt, Homo sapiens
gaaguucgucucggucuau

SEQ ID NO: 663989 - RNA, 19 nt, Homo sapiens
gcuaagaacacugcucaug

SEQ ID NO: 663990 - RNA, 19 nt, Homo sapiens
gaacuucaucuacaaacag

SEQ ID NO: 663991 - RNA, 19 nt, Homo sapiens
gcaggcggauuacaacacu

SEQ ID NO: 663992 - RNA, 19 nt, Homo sapiens
gcagcgaguugucguccau

SEQ ID NO: 663993 - RNA, 19 nt, Homo sapiens
gcagagcacagccaauuac

SEQ ID NO: 663994 - RNA, 19 nt, Homo sapiens
caagaaguggaauaaaugu

SEQ ID NO: 663995 - RNA, 19 nt, Homo sapiens
ggaaagaguguggcagcaa

SEQ ID NO: 663996 - RNA, 19 nt, Homo sapiens
aggagugcgugcagaagua

SEQ ID NO: 663997 - RNA, 19 nt, Homo sapiens
gggcuucgaccaguucuuu

SEQ ID NO: 663998 - RNA, 19 nt, Homo sapiens
ggaugaugaugagaaguuc

SEQ ID NO: 663999 - RNA, 19 nt, Homo sapiens
gagagcugguugcugugaa

SEQ ID NO: 664000 - RNA, 19 nt, Homo sapiens
caaggaggcagggaagaaa

SEQ ID NO: 664001 - RNA, 19 nt, Homo sapiens
gaaguaucaagcguccuua

SEQ ID NO: 664002 - RNA, 19 nt, Homo sapiens
ucagguacaugaggacaga

SEQ ID NO: 664003 - RNA, 19 nt, Homo sapiens
ccacaacacgauagccauu

SEQ ID NO: 664004 - RNA, 19 nt, Homo sapiens
gcaagaucccaucccauca

SEQ ID NO: 664005 - RNA, 19 nt, Homo sapiens
gcaccaggccaccucuguu

SEQ ID NO: 664006 - RNA, 19 nt, Homo sapiens
uacaaacaguucaagaagu

SEQ ID NO: 664007 - RNA, 19 nt, Homo sapiens
cagauucagugcuguuugg

SEQ ID NO: 664008 - RNA, 19 nt, Homo sapiens
gcagggaagaaacccacua

SEQ ID NO: 664009 - RNA, 19 nt, Homo sapiens
agaagguacuggugaugga

SEQ ID NO: 664010 - RNA, 19 nt, Homo sapiens
caugaggcauccugaagca

SEQ ID NO: 664011 - RNA, 19 nt, Homo sapiens
aacauacacucgccaggaa

SEQ ID NO: 664012 - RNA, 19 nt, Homo sapiens
ggacgugccacagacagaa

SEQ ID NO: 664013 - RNA, 19 nt, Homo sapiens
ggaauaaauguggccuuug

SEQ ID NO: 664014 - RNA, 19 nt, Homo sapiens
gagagccuccuguucuuuc

SEQ ID NO: 664015 - RNA, 19 nt, Homo sapiens
gaucccaucccaucacauc

SEQ ID NO: 664016 - RNA, 19 nt, Homo sapiens
ugaggcauccugaagcauu

SEQ ID NO: 664017 - RNA, 19 nt, Homo sapiens
aaagacuccugcagguguu

SEQ ID NO: 664018 - RNA, 19 nt, Homo sapiens
cagauucacaagcuggaua

SEQ ID NO: 664019 - RNA, 19 nt, Homo sapiens
acagaagcauccagcagau

SEQ ID NO: 664020 - RNA, 19 nt, Homo sapiens
gugggagccugcugagugu

SEQ ID NO: 664021 - RNA, 19 nt, Homo sapiens
gaaauccggagagcugguu

SEQ ID NO: 664022 - RNA, 19 nt, Homo sapiens
ucgaacggcuaaauagagu

SEQ ID NO: 664023 - RNA, 19 nt, Homo sapiens
caucgaacggcuaaauaga

SEQ ID NO: 664024 - RNA, 19 nt, Homo sapiens
cuacaaacaguucaagaag

SEQ ID NO: 664025 - RNA, 19 nt, Homo sapiens
gcagauucagugcuguuug

SEQ ID NO: 664026 - RNA, 19 nt, Homo sapiens
gggcaggagcuaauguuuc

SEQ ID NO: 664027 - RNA, 19 nt, Homo sapiens
ucuaugggacugaggagua

SEQ ID NO: 664028 - RNA, 19 nt, Homo sapiens
gcuggaugaugaugagaag

SEQ ID NO: 664029 - RNA, 19 nt, Homo sapiens
ggcagaagguacuggugau

SEQ ID NO: 664030 - RNA, 19 nt, Homo sapiens
ggagagcugguugcuguga

SEQ ID NO: 664031 - RNA, 19 nt, Homo sapiens
guucuguggcugccuguaa

SEQ ID NO: 664032 - RNA, 19 nt, Homo sapiens
caccaggaguaccucuuug

SEQ ID NO: 664033 - RNA, 19 nt, Homo sapiens
ggagaacggcauugugcau

SEQ ID NO: 664034 - RNA, 19 nt, Homo sapiens
ugaaccaccugcgggagaa

SEQ ID NO: 664035 - RNA, 19 nt, Homo sapiens
caagcuggauaaggugaau

SEQ ID NO: 664036 - RNA, 19 nt, Homo sapiens
ucuacaaacaguucaagaa

SEQ ID NO: 664037 - RNA, 19 nt, Homo sapiens
gaagcauccagcagauuca

SEQ ID NO: 664038 - RNA, 19 nt, Homo sapiens
gccgggaucagguacauga

SEQ ID NO: 664039 - RNA, 19 nt, Homo sapiens
gcucagggcaggagaugca

SEQ ID NO: 664040 - RNA, 19 nt, Homo sapiens
gagccgggaucagguacau

SEQ ID NO: 664041 - RNA, 19 nt, Homo sapiens
ggccagugccagugucuug

SEQ ID NO: 664042 - RNA, 19 nt, Homo sapiens
acacacggcaagaggauga

SEQ ID NO: 664043 - RNA, 19 nt, Homo sapiens
guaucaagcguccuuaguc

SEQ ID NO: 664044 - RNA, 19 nt, Homo sapiens
gcuaccaggaggcuaagaa

SEQ ID NO: 664045 - RNA, 19 nt, Homo sapiens
acaccaggaguaccucuuu

SEQ ID NO: 664046 - RNA, 19 nt, Homo sapiens
gaagaaacauucaguagaa

SEQ ID NO: 664047 - RNA, 19 nt, Homo sapiens
gcacucagcugcucuacaa

SEQ ID NO: 664048 - RNA, 19 nt, Homo sapiens
gaaggauggugauuuguuu

SEQ ID NO: 664049 - RNA, 19 nt, Homo sapiens
gaacaaagaagaaacauuc

SEQ ID NO: 664050 - RNA, 19 nt, Homo sapiens
gcagaaccuucccugauua

SEQ ID NO: 664051 - RNA, 19 nt, Homo sapiens
gaggaggcguuuaagaaua

SEQ ID NO: 664052 - RNA, 19 nt, Homo sapiens
gaauggagguuaaagugaa

SEQ ID NO: 664053 - RNA, 19 nt, Homo sapiens
gcagggaaauguugauaau

SEQ ID NO: 664054 - RNA, 19 nt, Homo sapiens
uaaguuugcuguauaguga

SEQ ID NO: 664055 - RNA, 19 nt, Homo sapiens
gaaagaaggaagauuguug

SEQ ID NO: 664056 - RNA, 19 nt, Homo sapiens
caaaguugcuaccagugua

SEQ ID NO: 664057 - RNA, 19 nt, Homo sapiens
gaaaagccuugcauuauug

SEQ ID NO: 664058 - RNA, 19 nt, Homo sapiens
gggcuuauguuucaguuug

SEQ ID NO: 664059 - RNA, 19 nt, Homo sapiens
aaacaggguugaaugaguu

SEQ ID NO: 664060 - RNA, 19 nt, Homo sapiens
gcaaguccaucuauguugu

SEQ ID NO: 664061 - RNA, 19 nt, Homo sapiens
gaagauuguugguuggaau

SEQ ID NO: 664062 - RNA, 19 nt, Homo sapiens
gcagaagacuccuggaaac

SEQ ID NO: 664063 - RNA, 19 nt, Homo sapiens
aagcuaaguuugcuguaua

SEQ ID NO: 664064 - RNA, 19 nt, Homo sapiens
ugccaaagguucaacuuaa

SEQ ID NO: 664065 - RNA, 19 nt, Homo sapiens
gaagcaacaugcagagaag

SEQ ID NO: 664066 - RNA, 19 nt, Homo sapiens
guugaaggauggugauuug

SEQ ID NO: 664067 - RNA, 19 nt, Homo sapiens
ugauagaggcaaugcauua

SEQ ID NO: 664068 - RNA, 19 nt, Homo sapiens
ggagcaauguuggccuaua

SEQ ID NO: 664069 - RNA, 19 nt, Homo sapiens
agaauagaauggagguuaa

SEQ ID NO: 664070 - RNA, 19 nt, Homo sapiens
ggaauaugcgguuaaugaa

SEQ ID NO: 664071 - RNA, 19 nt, Homo sapiens
gcuccaaugucccagguuu

SEQ ID NO: 664072 - RNA, 19 nt, Homo sapiens
ucaacucccugccaagaaa

SEQ ID NO: 664073 - RNA, 19 nt, Homo sapiens
cagcugcucuacaaauuug

SEQ ID NO: 664074 - RNA, 19 nt, Homo sapiens
acagcaaucugcagaagaa

SEQ ID NO: 664075 - RNA, 19 nt, Homo sapiens
gcaagaaaucgcagggaaa

SEQ ID NO: 664076 - RNA, 19 nt, Homo sapiens
gaucuggauucucguuuca

SEQ ID NO: 664077 - RNA, 19 nt, Homo sapiens
gagcaauguuggccuauac

SEQ ID NO: 664078 - RNA, 19 nt, Homo sapiens
gaaguuguggcaggaauaa

SEQ ID NO: 664079 - RNA, 19 nt, Homo sapiens
gccaaagguucaacuuaau

SEQ ID NO: 664080 - RNA, 19 nt, Homo sapiens
gcaguaauuagaacaaaga

SEQ ID NO: 664081 - RNA, 19 nt, Homo sapiens
ggacagcaaucugcagaag

SEQ ID NO: 664082 - RNA, 19 nt, Homo sapiens
caccacaccuacugagauu

SEQ ID NO: 664083 - RNA, 19 nt, Homo sapiens
ccagaaagaacaagcagaa

SEQ ID NO: 664084 - RNA, 19 nt, Homo sapiens
gauggugauuuguuucaug

SEQ ID NO: 664085 - RNA, 19 nt, Homo sapiens
gaauucugcaucucucuuu

SEQ ID NO: 664086 - RNA, 19 nt, Homo sapiens
aaagugaggaggcguuuaa

SEQ ID NO: 664087 - RNA, 19 nt, Homo sapiens
ggaaaucacuaggaguucu

SEQ ID NO: 664088 - RNA, 19 nt, Homo sapiens
uaaggaauaugcgguuaau

SEQ ID NO: 664089 - RNA, 19 nt, Homo sapiens
gugaggaggcguuuaagaa

SEQ ID NO: 664090 - RNA, 19 nt, Homo sapiens
ggaagauuguugguuggaa

SEQ ID NO: 664091 - RNA, 19 nt, Homo sapiens
acagacagcucaccauuuu

SEQ ID NO: 664092 - RNA, 19 nt, Homo sapiens
gcaaagaauucugcaucuc

SEQ ID NO: 664093 - RNA, 19 nt, Homo sapiens
gcagagaaguaaaaugaga

SEQ ID NO: 664094 - RNA, 19 nt, Homo sapiens
gguuguaucucccacuuca

SEQ ID NO: 664095 - RNA, 19 nt, Homo sapiens
ugcagaaccuucccugauu

SEQ ID NO: 664096 - RNA, 19 nt, Homo sapiens
ggugauuuguuucaugguu

SEQ ID NO: 664097 - RNA, 19 nt, Homo sapiens
gggaaauguugauaauaag

SEQ ID NO: 664098 - RNA, 19 nt, Homo sapiens
aaauguagaugcaauucug

SEQ ID NO: 664099 - RNA, 19 nt, Homo sapiens
agaagcagcuguuucaacu

SEQ ID NO: 664100 - RNA, 19 nt, Homo sapiens
gaaagaacaagcagaagac

SEQ ID NO: 664101 - RNA, 19 nt, Homo sapiens
gugauuuguuucaugguuu

SEQ ID NO: 664102 - RNA, 19 nt, Homo sapiens
agaaaagccuugcauuauu

SEQ ID NO: 664103 - RNA, 19 nt, Homo sapiens
uaaugcacguucuaacaug

SEQ ID NO: 664104 - RNA, 19 nt, Homo sapiens
gaaugcuggugguuccuau

SEQ ID NO: 664105 - RNA, 19 nt, Homo sapiens
aagaauagaauggagguua

SEQ ID NO: 664106 - RNA, 19 nt, Homo sapiens
gaaagugaggaggcguuua

SEQ ID NO: 664107 - RNA, 19 nt, Homo sapiens
ugaaugaguuccagaaagc

SEQ ID NO: 664108 - RNA, 19 nt, Homo sapiens
gaagaucuggauucucguu

SEQ ID NO: 664109 - RNA, 19 nt, Homo sapiens
gaccaucccagaagaucua

SEQ ID NO: 664110 - RNA, 19 nt, Homo sapiens
caaagaagaaacauucagu

SEQ ID NO: 664111 - RNA, 19 nt, Homo sapiens
gagaaaagccuugcauuau

SEQ ID NO: 664112 - RNA, 19 nt, Homo sapiens
aggaauaugcgguuaauga

SEQ ID NO: 664113 - RNA, 19 nt, Homo sapiens
aauaaggaauaugcgguua

SEQ ID NO: 664114 - RNA, 19 nt, Homo sapiens
gaaaucgcagggaaauguu

SEQ ID NO: 664115 - RNA, 19 nt, Homo sapiens
gaauagaauggagguuaaa

SEQ ID NO: 664116 - RNA, 19 nt, Homo sapiens
gcaacaugcagagaaguaa

SEQ ID NO: 664117 - RNA, 19 nt, Homo sapiens
ggaagggaaagaaggaaga

SEQ ID NO: 664118 - RNA, 19 nt, Homo sapiens
ucuuaggcauucuaucuuu

SEQ ID NO: 664119 - RNA, 19 nt, Homo sapiens
gaaaacccaugcauuugug

SEQ ID NO: 664120 - RNA, 19 nt, Homo sapiens
caagaaaucgcagggaaau

SEQ ID NO: 664121 - RNA, 19 nt, Homo sapiens
ggaaagaaggaagauuguu

SEQ ID NO: 664122 - RNA, 19 nt, Homo sapiens
caucccagaagaucuauaa

SEQ ID NO: 664123 - RNA, 19 nt, Homo sapiens
gugccaaagguucaacuua

SEQ ID NO: 664124 - RNA, 19 nt, Homo sapiens
ggcaaagaauucugcaucu

SEQ ID NO: 664125 - RNA, 19 nt, Homo sapiens
gagguuaaagugaagauuc

SEQ ID NO: 664126 - RNA, 19 nt, Homo sapiens
auaccugccuuucuuucua

SEQ ID NO: 664127 - RNA, 19 nt, Homo sapiens
aaagcuaaguuugcuguau

SEQ ID NO: 664128 - RNA, 19 nt, Homo sapiens
aauaugcgguuaaugaagu

SEQ ID NO: 664129 - RNA, 19 nt, Homo sapiens
aagugaagauuccugaaga

SEQ ID NO: 664130 - RNA, 19 nt, Homo sapiens
agaaagaacaagcagaaga

SEQ ID NO: 664131 - RNA, 19 nt, Homo sapiens
caacaugcagagaaguaaa

SEQ ID NO: 664132 - RNA, 19 nt, Homo sapiens
gauuguugguuggaauaaa

SEQ ID NO: 664133 - RNA, 19 nt, Homo sapiens
caaagaauucugcaucucu

SEQ ID NO: 664134 - RNA, 19 nt, Homo sapiens
cuauuugcaugauuuccua

SEQ ID NO: 664135 - RNA, 19 nt, Homo sapiens
ugagaaaagccuugcauua

SEQ ID NO: 664136 - RNA, 19 nt, Homo sapiens
ccacaccuacugagauuau

SEQ ID NO: 664137 - RNA, 19 nt, Homo sapiens
gcaccacaccuacugagau

SEQ ID NO: 664138 - RNA, 19 nt, Homo sapiens
ggcagaagcagcuguuuca

SEQ ID NO: 664139 - RNA, 19 nt, Homo sapiens
gaaaucacuaggaguucuu

SEQ ID NO: 664140 - RNA, 19 nt, Homo sapiens
agaagaaacauucaguaga

SEQ ID NO: 664141 - RNA, 19 nt, Homo sapiens
guccaucuauguuguucuu

SEQ ID NO: 664142 - RNA, 19 nt, Homo sapiens
ccaaagguucaacuuaaug

SEQ ID NO: 664143 - RNA, 19 nt, Homo sapiens
cuuugacacuacacaauuu

SEQ ID NO: 664144 - RNA, 19 nt, Homo sapiens
gaaacauucaguagaacau

SEQ ID NO: 664145 - RNA, 19 nt, Homo sapiens
cauuauuguugggcuauuu

SEQ ID NO: 664146 - RNA, 19 nt, Homo sapiens
gcaaagagcuggacacagu

SEQ ID NO: 664147 - RNA, 19 nt, Homo sapiens
gcaaauggcucguguucuu

SEQ ID NO: 664148 - RNA, 19 nt, Homo sapiens
cgacggaacuccuccuuua

SEQ ID NO: 664149 - RNA, 19 nt, Homo sapiens
ggacuucaccaauggauua

SEQ ID NO: 664150 - RNA, 19 nt, Homo sapiens
ggagagguuuguugauuug

SEQ ID NO: 664151 - RNA, 19 nt, Homo sapiens
gcaguuccuuugcauguuu

SEQ ID NO: 664152 - RNA, 19 nt, Homo sapiens
cagaaugggugaccucaaa

SEQ ID NO: 664153 - RNA, 19 nt, Homo sapiens
acaauaaccucaaagaugu

SEQ ID NO: 664154 - RNA, 19 nt, Homo sapiens
gggagagguuuguugauuu

SEQ ID NO: 664155 - RNA, 19 nt, Homo sapiens
aggcagaggucauugauaa

SEQ ID NO: 664156 - RNA, 19 nt, Homo sapiens
gacagaagcgagagaauaa

SEQ ID NO: 664157 - RNA, 19 nt, Homo sapiens
gaauuccagucgugcauuu

SEQ ID NO: 664158 - RNA, 19 nt, Homo sapiens
gcaaccugcugaacaagaa

SEQ ID NO: 664159 - RNA, 19 nt, Homo sapiens
gagaagaggagaaguaugu

SEQ ID NO: 664160 - RNA, 19 nt, Homo sapiens
gaaggccuguggugagauu

SEQ ID NO: 664161 - RNA, 19 nt, Homo sapiens
ggacacaguaccagaguuu

SEQ ID NO: 664162 - RNA, 19 nt, Homo sapiens
caagaaagcugagauaucc

SEQ ID NO: 664163 - RNA, 19 nt, Homo sapiens
ucagauaccugggcaaaga

SEQ ID NO: 664164 - RNA, 19 nt, Homo sapiens
gaaggcuggugguauauca

SEQ ID NO: 664165 - RNA, 19 nt, Homo sapiens
gagaauaaaguucccugua

SEQ ID NO: 664166 - RNA, 19 nt, Homo sapiens
agagcaggauguugaguua

SEQ ID NO: 664167 - RNA, 19 nt, Homo sapiens
cgcggaagcucaaguauga

SEQ ID NO: 664168 - RNA, 19 nt, Homo sapiens
guccuaagcuguauuugug

SEQ ID NO: 664169 - RNA, 19 nt, Homo sapiens
gagcgucaguuucccaguu

SEQ ID NO: 664170 - RNA, 19 nt, Homo sapiens
cauagggacuucaccaaug

SEQ ID NO: 664171 - RNA, 19 nt, Homo sapiens
ugaagaaggccaaggauga

SEQ ID NO: 664172 - RNA, 19 nt, Homo sapiens
agaauaaaguucccuguag

SEQ ID NO: 664173 - RNA, 19 nt, Homo sapiens
gaagcgagagaauaaaguu

SEQ ID NO: 664174 - RNA, 19 nt, Homo sapiens
gaggagaccaucuaugaga

SEQ ID NO: 664175 - RNA, 19 nt, Homo sapiens
ggaagggacuauggcaguu

SEQ ID NO: 664176 - RNA, 19 nt, Homo sapiens
guaccagaguuuacagaga

SEQ ID NO: 664177 - RNA, 19 nt, Homo sapiens
cuggaaggcuggugguaua

SEQ ID NO: 664178 - RNA, 19 nt, Homo sapiens
gaccaucuuucauaacugu

SEQ ID NO: 664179 - RNA, 19 nt, Homo sapiens
cuggaagccuuacguauga

SEQ ID NO: 664180 - RNA, 19 nt, Homo sapiens
gguauuguccuaagcugua

SEQ ID NO: 664181 - RNA, 19 nt, Homo sapiens
cacaauaaccucaaagaug

SEQ ID NO: 664182 - RNA, 19 nt, Homo sapiens
ccagccaccucguacauga

SEQ ID NO: 664183 - RNA, 19 nt, Homo sapiens
aaauagagcaggauguuga

SEQ ID NO: 664184 - RNA, 19 nt, Homo sapiens
aagaggagaccaucuauga

SEQ ID NO: 664185 - RNA, 19 nt, Homo sapiens
gcagaggucauugauaaga

SEQ ID NO: 664186 - RNA, 19 nt, Homo sapiens
gccuuugguuugcgucuua

SEQ ID NO: 664187 - RNA, 19 nt, Homo sapiens
gcuuauaugucaggccuuu

SEQ ID NO: 664188 - RNA, 19 nt, Homo sapiens
cgggagagguuuguugauu

SEQ ID NO: 664189 - RNA, 19 nt, Homo sapiens
caucaucacuccuaaagcu

SEQ ID NO: 664190 - RNA, 19 nt, Homo sapiens
ccacacgugccuuugauuu

SEQ ID NO: 664191 - RNA, 19 nt, Homo sapiens
agacagaagcgagagaaua

SEQ ID NO: 664192 - RNA, 19 nt, Homo sapiens
gauauccugugcaccauag

SEQ ID NO: 664193 - RNA, 19 nt, Homo sapiens
gcagaacgaaggcaaguca

SEQ ID NO: 664194 - RNA, 19 nt, Homo sapiens
ccaugauccuggaacagua

SEQ ID NO: 664195 - RNA, 19 nt, Homo sapiens
gaagacagaagcgagagaa

SEQ ID NO: 664196 - RNA, 19 nt, Homo sapiens
gaacaaaagggaaaggaaa

SEQ ID NO: 664197 - RNA, 19 nt, Homo sapiens
cagaggucauugauaagaa

SEQ ID NO: 664198 - RNA, 19 nt, Homo sapiens
gcuggaagccuuacguaug

SEQ ID NO: 664199 - RNA, 19 nt, Homo sapiens
cauugucacuguuaguuga

SEQ ID NO: 664200 - RNA, 19 nt, Homo sapiens
caagucaucaucacuccua

SEQ ID NO: 664201 - RNA, 19 nt, Homo sapiens
ggaagaggagaccaucuau

SEQ ID NO: 664202 - RNA, 19 nt, Homo sapiens
caagcaauccucccacuuc

SEQ ID NO: 664203 - RNA, 19 nt, Homo sapiens
aagccaaagucguuucauu

SEQ ID NO: 664204 - RNA, 19 nt, Homo sapiens
ggguuucuguuguaucuug

SEQ ID NO: 664205 - RNA, 19 nt, Homo sapiens
gaggugauccggaagaauc

SEQ ID NO: 664206 - RNA, 19 nt, Homo sapiens
acagguggguacauuagaa

SEQ ID NO: 664207 - RNA, 19 nt, Homo sapiens
gagagcggguggugguaug

SEQ ID NO: 664208 - RNA, 19 nt, Homo sapiens
gaagaggagaccaucuaug

SEQ ID NO: 664209 - RNA, 19 nt, Homo sapiens
gacaucaacaccucuaaga

SEQ ID NO: 664210 - RNA, 19 nt, Homo sapiens
guggugguguccaacuaua

SEQ ID NO: 664211 - RNA, 19 nt, Homo sapiens
gauaaagaagugguucauu

SEQ ID NO: 664212 - RNA, 19 nt, Homo sapiens
ccaccggucucuuccuaau

SEQ ID NO: 664213 - RNA, 19 nt, Homo sapiens
ccaaagcaaggacgagauu

SEQ ID NO: 664214 - RNA, 19 nt, Homo sapiens
gaagaggagaaguauguca

SEQ ID NO: 664215 - RNA, 19 nt, Homo sapiens
ccaagaaagcugagauauc

SEQ ID NO: 664216 - RNA, 19 nt, Homo sapiens
gaaggcagaggucauugau

SEQ ID NO: 664217 - RNA, 19 nt, Homo sapiens
ggacgagauuggcuuugag

SEQ ID NO: 664218 - RNA, 19 nt, Homo sapiens
gagaccaucuaugagaaug

SEQ ID NO: 664219 - RNA, 19 nt, Homo sapiens
ggagaucauugggaacauc

SEQ ID NO: 664220 - RNA, 19 nt, Homo sapiens
gguuuagugucuucauguu

SEQ ID NO: 664221 - RNA, 19 nt, Homo sapiens
ccacaggugcccaagaaga

SEQ ID NO: 664222 - RNA, 19 nt, Homo sapiens
ggauugcaguggcgugauc

SEQ ID NO: 664223 - RNA, 19 nt, Homo sapiens
gaaugggugaccucaaaga

SEQ ID NO: 664224 - RNA, 19 nt, Homo sapiens
cagacagccuggagaagau

SEQ ID NO: 664225 - RNA, 19 nt, Homo sapiens
caaggugggugagucuuca

SEQ ID NO: 664226 - RNA, 19 nt, Homo sapiens
cuacaccauugccgaauuc

SEQ ID NO: 664227 - RNA, 19 nt, Homo sapiens
gcaggauguugaguuaauc

SEQ ID NO: 664228 - RNA, 19 nt, Homo sapiens
ggacagauugggccucaca

SEQ ID NO: 664229 - RNA, 19 nt, Homo sapiens
ugccacaggugcccaagaa

SEQ ID NO: 664230 - RNA, 19 nt, Homo sapiens
cauccacaauaaccucaaa

SEQ ID NO: 664231 - RNA, 19 nt, Homo sapiens
ccucauccaucaccaucaa

SEQ ID NO: 664232 - RNA, 19 nt, Homo sapiens
augaggagccugaguauga

SEQ ID NO: 664233 - RNA, 19 nt, Homo sapiens
ggucauugauaagaacuca

SEQ ID NO: 664234 - RNA, 19 nt, Homo sapiens
caaauggcucguguucuuu

SEQ ID NO: 664235 - RNA, 19 nt, Homo sapiens
uuugauugcuggcaucuug

SEQ ID NO: 664236 - RNA, 19 nt, Homo sapiens
gcugggugccuuccaacua

SEQ ID NO: 664237 - RNA, 19 nt, Homo sapiens
cagccaggguucagacuca

SEQ ID NO: 664238 - RNA, 19 nt, Homo sapiens
gcaaagaaggaugcugaug

SEQ ID NO: 664239 - RNA, 19 nt, Homo sapiens
guggaguacuacaccauug

SEQ ID NO: 664240 - RNA, 19 nt, Homo sapiens
cuguugagguggaguacua

SEQ ID NO: 664241 - RNA, 19 nt, Homo sapiens
cuagauugcaguacuaaug

SEQ ID NO: 664242 - RNA, 19 nt, Homo sapiens
ccuaauggcuggugguacu

SEQ ID NO: 664243 - RNA, 19 nt, Homo sapiens
guagugguuuagugucuuc

SEQ ID NO: 664244 - RNA, 19 nt, Homo sapiens
guucccaggugccagcaaa

SEQ ID NO: 664245 - RNA, 19 nt, Homo sapiens
ccuaagcuguauuugugaa

SEQ ID NO: 664246 - RNA, 19 nt, Homo sapiens
ggacgagccuucaaacuuu

SEQ ID NO: 664247 - RNA, 19 nt, Homo sapiens
gaagagggcucagaacuug

SEQ ID NO: 664248 - RNA, 19 nt, Homo sapiens
agaauaaacugcucucuaa

SEQ ID NO: 664249 - RNA, 19 nt, Homo sapiens
caaagaacauuaaggagaa

SEQ ID NO: 664250 - RNA, 19 nt, Homo sapiens
gaaaguguccagcggaaua

SEQ ID NO: 664251 - RNA, 19 nt, Homo sapiens
gcauagaucuugagaacau

SEQ ID NO: 664252 - RNA, 19 nt, Homo sapiens
cuaaggagcuggagcacua

SEQ ID NO: 664253 - RNA, 19 nt, Homo sapiens
guacaugaaugaucacaga

SEQ ID NO: 664254 - RNA, 19 nt, Homo sapiens
gaacaaccagcucgcauuu

SEQ ID NO: 664255 - RNA, 19 nt, Homo sapiens
acaaaggugucaucauuaa

SEQ ID NO: 664256 - RNA, 19 nt, Homo sapiens
gaccuuugguaaucauuua

SEQ ID NO: 664257 - RNA, 19 nt, Homo sapiens
ucagagagcucaagcaagu

SEQ ID NO: 664258 - RNA, 19 nt, Homo sapiens
ggccugagcucaucaacuu

SEQ ID NO: 664259 - RNA, 19 nt, Homo sapiens
ccgggaagcugcagacuuu

SEQ ID NO: 664260 - RNA, 19 nt, Homo sapiens
gaacaucaacaagaacuuu

SEQ ID NO: 664261 - RNA, 19 nt, Homo sapiens
gaagagacgggcagaguug

SEQ ID NO: 664262 - RNA, 19 nt, Homo sapiens
gaaccaagacaaccugcua

SEQ ID NO: 664263 - RNA, 19 nt, Homo sapiens
ucauguaccucuccaaguu

SEQ ID NO: 664264 - RNA, 19 nt, Homo sapiens
acaagaacuuugagcagua

SEQ ID NO: 664265 - RNA, 19 nt, Homo sapiens
gagucucccucccuuuaua

SEQ ID NO: 664266 - RNA, 19 nt, Homo sapiens
ucuaaaggccugucucaua

SEQ ID NO: 664267 - RNA, 19 nt, Homo sapiens
acaaccagcucgcauuuga

SEQ ID NO: 664268 - RNA, 19 nt, Homo sapiens
gaaguucuaugggaaguuc

SEQ ID NO: 664269 - RNA, 19 nt, Homo sapiens
ugacugcgaugaaggcaaa

SEQ ID NO: 664270 - RNA, 19 nt, Homo sapiens
gcacacgacuccugaacca

SEQ ID NO: 664271 - RNA, 19 nt, Homo sapiens
cggagaacaucaacaagaa

SEQ ID NO: 664272 - RNA, 19 nt, Homo sapiens
gaagaaacaggcauagauc

SEQ ID NO: 664273 - RNA, 19 nt, Homo sapiens
uaaagaagaaacaggcaua

SEQ ID NO: 664274 - RNA, 19 nt, Homo sapiens
ccaaagcccugugguacaa

SEQ ID NO: 664275 - RNA, 19 nt, Homo sapiens
gcucagaacuuggccaaca

SEQ ID NO: 664276 - RNA, 19 nt, Homo sapiens
gaaacaggcauagaucuug

SEQ ID NO: 664277 - RNA, 19 nt, Homo sapiens
gaaaucagaacaaagucaa

SEQ ID NO: 664278 - RNA, 19 nt, Homo sapiens
aaacaggcauagaucuuga

SEQ ID NO: 664279 - RNA, 19 nt, Homo sapiens
gugaagcauuuguauauca

SEQ ID NO: 664280 - RNA, 19 nt, Homo sapiens
cuaaaggccugucucauac

SEQ ID NO: 664281 - RNA, 19 nt, Homo sapiens
ucaaguccauggcgaauca

SEQ ID NO: 664282 - RNA, 19 nt, Homo sapiens
ccucucagccuccucuuua

SEQ ID NO: 664283 - RNA, 19 nt, Homo sapiens
gcuuucaucuucaaucaga

SEQ ID NO: 664284 - RNA, 19 nt, Homo sapiens
gaguugaaauccaugugaa

SEQ ID NO: 664285 - RNA, 19 nt, Homo sapiens
caccaagugucucauaguu

SEQ ID NO: 664286 - RNA, 19 nt, Homo sapiens
ccagauacuucaugcuguu

SEQ ID NO: 664287 - RNA, 19 nt, Homo sapiens
cugcaagccucacuucauu

SEQ ID NO: 664288 - RNA, 19 nt, Homo sapiens
gaauaaacugcucucuaaa

SEQ ID NO: 664289 - RNA, 19 nt, Homo sapiens
acacaaagaacauuaagga

SEQ ID NO: 664290 - RNA, 19 nt, Homo sapiens
caucaccgccaacuucaua

SEQ ID NO: 664291 - RNA, 19 nt, Homo sapiens
ugacacacuucugcucuaa

SEQ ID NO: 664292 - RNA, 19 nt, Homo sapiens
cgacacguguuacuucugu

SEQ ID NO: 664293 - RNA, 19 nt, Homo sapiens
ccacugugaugccugagaa

SEQ ID NO: 664294 - RNA, 19 nt, Homo sapiens
aagacaaccugcuauccua

SEQ ID NO: 664295 - RNA, 19 nt, Homo sapiens
ugucggaguuugaguuuga

SEQ ID NO: 664296 - RNA, 19 nt, Homo sapiens
gcauccacgugcaaaggua

SEQ ID NO: 664297 - RNA, 19 nt, Homo sapiens
acacacuucugcucuaaga

SEQ ID NO: 664298 - RNA, 19 nt, Homo sapiens
gaccucagcuuggccaaau

SEQ ID NO: 664299 - RNA, 19 nt, Homo sapiens
cccaucaggugaagcauuu

SEQ ID NO: 664300 - RNA, 19 nt, Homo sapiens
gacuuuaccugcauguaug

SEQ ID NO: 664301 - RNA, 19 nt, Homo sapiens
ggaagagacgggcagaguu

SEQ ID NO: 664302 - RNA, 19 nt, Homo sapiens
ucacuucauucacuguaaa

SEQ ID NO: 664303 - RNA, 19 nt, Homo sapiens
acagggaauuucacacaaa

SEQ ID NO: 664304 - RNA, 19 nt, Homo sapiens
gagagaaugacaugaacaa

SEQ ID NO: 664305 - RNA, 19 nt, Homo sapiens
cuacaccucuggccuuuca

SEQ ID NO: 664306 - RNA, 19 nt, Homo sapiens
uauagaaugucaaccaaag

SEQ ID NO: 664307 - RNA, 19 nt, Homo sapiens
cagaauaaacugcucucua

SEQ ID NO: 664308 - RNA, 19 nt, Homo sapiens
caacagggaauuucacaca

SEQ ID NO: 664309 - RNA, 19 nt, Homo sapiens
uaaggaagguggaaaucag

SEQ ID NO: 664310 - RNA, 19 nt, Homo sapiens
caacuuugacucuuugaau

SEQ ID NO: 664311 - RNA, 19 nt, Homo sapiens
ucaccgaccugaccacauc

SEQ ID NO: 664312 - RNA, 19 nt, Homo sapiens
gagaggaggaggcaacaug

SEQ ID NO: 664313 - RNA, 19 nt, Homo sapiens
ggaaaucagaacaaaguca

SEQ ID NO: 664314 - RNA, 19 nt, Homo sapiens
cggagaacgugaaccaaga

SEQ ID NO: 664315 - RNA, 19 nt, Homo sapiens
ggaguugaaauccauguga

SEQ ID NO: 664316 - RNA, 19 nt, Homo sapiens
uaugguauuugaugcugua

SEQ ID NO: 664317 - RNA, 19 nt, Homo sapiens
gaauuucacacaaagaaca

SEQ ID NO: 664318 - RNA, 19 nt, Homo sapiens
gggaauuucacacaaagaa

SEQ ID NO: 664319 - RNA, 19 nt, Homo sapiens
ggacugcacccacuauuuu

SEQ ID NO: 664320 - RNA, 19 nt, Homo sapiens
caacuacagcucauccuau

SEQ ID NO: 664321 - RNA, 19 nt, Homo sapiens
caccuugccuccauguuug

SEQ ID NO: 664322 - RNA, 19 nt, Homo sapiens
gcaggaacgccgugucuca

SEQ ID NO: 664323 - RNA, 19 nt, Homo sapiens
cccaucaccuccucugaaa

SEQ ID NO: 664324 - RNA, 19 nt, Homo sapiens
gaacgugaaccaagacaac

SEQ ID NO: 664325 - RNA, 19 nt, Homo sapiens
cuggaaggguucagaagaa

SEQ ID NO: 664326 - RNA, 19 nt, Homo sapiens
aagagucucccucccuuua

SEQ ID NO: 664327 - RNA, 19 nt, Homo sapiens
gcaagccucacuucauuca

SEQ ID NO: 664328 - RNA, 19 nt, Homo sapiens
ugaaugaucacagaccuaa

SEQ ID NO: 664329 - RNA, 19 nt, Homo sapiens
ccaggaaggagucagauau

SEQ ID NO: 664330 - RNA, 19 nt, Homo sapiens
gagaauccagugugacguu

SEQ ID NO: 664331 - RNA, 19 nt, Homo sapiens
ugaaauccaugugaaugug

SEQ ID NO: 664332 - RNA, 19 nt, Homo sapiens
uaucaguauucgccaacua

SEQ ID NO: 664333 - RNA, 19 nt, Homo sapiens
ucaccuugccuccauguuu

SEQ ID NO: 664334 - RNA, 19 nt, Homo sapiens
gagaaugacaugaacaaac

SEQ ID NO: 664335 - RNA, 19 nt, Homo sapiens
caucgaccauaucaguauu

SEQ ID NO: 664336 - RNA, 19 nt, Homo sapiens
gcaugucugugaccuuugg

SEQ ID NO: 664337 - RNA, 19 nt, Homo sapiens
cuucuuggcugacacacuu

SEQ ID NO: 664338 - RNA, 19 nt, Homo sapiens
cagcugaaguccuggucaa

SEQ ID NO: 664339 - RNA, 19 nt, Homo sapiens
agaaugacaugaacaaacg

SEQ ID NO: 664340 - RNA, 19 nt, Homo sapiens
gcugccauccuuagacuuu

SEQ ID NO: 664341 - RNA, 19 nt, Homo sapiens
ccaacuucauaaacagaaa

SEQ ID NO: 664342 - RNA, 19 nt, Homo sapiens
cggcauggauggugaagag

SEQ ID NO: 664343 - RNA, 19 nt, Homo sapiens
gugcuacacccacuucuug

SEQ ID NO: 664344 - RNA, 19 nt, Homo sapiens
ggucaaaccggagagaaug

SEQ ID NO: 664345 - RNA, 19 nt, Homo sapiens
ugacuuuaccugcauguau

SEQ ID NO: 664346 - RNA, 19 nt, Homo sapiens
gaacaugggucagaugaua

SEQ ID NO: 664347 - RNA, 19 nt, Homo sapiens
gcacauagauacuucaguu

SEQ ID NO: 664348 - RNA, 19 nt, Homo sapiens
gcacaaaucuuagaacaga

SEQ ID NO: 664349 - RNA, 19 nt, Homo sapiens
gcagagauaucuacuguau

SEQ ID NO: 664350 - RNA, 19 nt, Homo sapiens
gaacuuagcacacaucuau

SEQ ID NO: 664351 - RNA, 19 nt, Homo sapiens
gaggagaguuugaugaauu

SEQ ID NO: 664352 - RNA, 19 nt, Homo sapiens
uaaagaggcugauuccauu

SEQ ID NO: 664353 - RNA, 19 nt, Homo sapiens
gagaugaaguuaucaguau

SEQ ID NO: 664354 - RNA, 19 nt, Homo sapiens
gaggagcucuugcuuacua

SEQ ID NO: 664355 - RNA, 19 nt, Homo sapiens
gaagaaggaucugaugaug

SEQ ID NO: 664356 - RNA, 19 nt, Homo sapiens
gcacaaacuugguauugau

SEQ ID NO: 664357 - RNA, 19 nt, Homo sapiens
ugaauuggcacaaaucuua

SEQ ID NO: 664358 - RNA, 19 nt, Homo sapiens
ggagggagaugaaguuauc

SEQ ID NO: 664359 - RNA, 19 nt, Homo sapiens
gcaaaugagacuauucuuu

SEQ ID NO: 664360 - RNA, 19 nt, Homo sapiens
gaagaaguuugagaggaua

SEQ ID NO: 664361 - RNA, 19 nt, Homo sapiens
caaacaagaugaagaagag

SEQ ID NO: 664362 - RNA, 19 nt, Homo sapiens
gaacuugacuucgaucagu

SEQ ID NO: 664363 - RNA, 19 nt, Homo sapiens
gagaggaucugauaaugag

SEQ ID NO: 664364 - RNA, 19 nt, Homo sapiens
gaagacagcggucagauca

SEQ ID NO: 664365 - RNA, 19 nt, Homo sapiens
gaugaugaccuaccuauau

SEQ ID NO: 664366 - RNA, 19 nt, Homo sapiens
cuaauuauguugacugcua

SEQ ID NO: 664367 - RNA, 19 nt, Homo sapiens
gugcuagaguccaauauuu

SEQ ID NO: 664368 - RNA, 19 nt, Homo sapiens
gauagaggcucagaacaug

SEQ ID NO: 664369 - RNA, 19 nt, Homo sapiens
ccaaggcucuggaaaugaa

SEQ ID NO: 664370 - RNA, 19 nt, Homo sapiens
ggaugaggauaaacuuaaa

SEQ ID NO: 664371 - RNA, 19 nt, Homo sapiens
aaagaaaugugccucauca

SEQ ID NO: 664372 - RNA, 19 nt, Homo sapiens
gaagcaacagcagauauua

SEQ ID NO: 664373 - RNA, 19 nt, Homo sapiens
gcuaaaucauuccuacaaa

SEQ ID NO: 664374 - RNA, 19 nt, Homo sapiens
gagagaggaucugauaaug

SEQ ID NO: 664375 - RNA, 19 nt, Homo sapiens
acacacaacugcacauaug

SEQ ID NO: 664376 - RNA, 19 nt, Homo sapiens
gaccagccauccagaaaga

SEQ ID NO: 664377 - RNA, 19 nt, Homo sapiens
ggacgaacaacgaaagaaa

SEQ ID NO: 664378 - RNA, 19 nt, Homo sapiens
gaacuggagcuugcacaua

SEQ ID NO: 664379 - RNA, 19 nt, Homo sapiens
aaaguaaucugaaggaagu

SEQ ID NO: 664380 - RNA, 19 nt, Homo sapiens
gaaaugaugcaaagaaucu

SEQ ID NO: 664381 - RNA, 19 nt, Homo sapiens
ugaagaaggucacagaaca

SEQ ID NO: 664382 - RNA, 19 nt, Homo sapiens
gcagagcccuggaacucaa

SEQ ID NO: 664383 - RNA, 19 nt, Homo sapiens
ccagagggauccaacaaug

SEQ ID NO: 664384 - RNA, 19 nt, Homo sapiens
cuucaaguguggcaaguua

SEQ ID NO: 664385 - RNA, 19 nt, Homo sapiens
ggaaguucguuuaggaaug

SEQ ID NO: 664386 - RNA, 19 nt, Homo sapiens
gcagcauacucuucugauu

SEQ ID NO: 664387 - RNA, 19 nt, Homo sapiens
aaacccagaugcuaaauca

SEQ ID NO: 664388 - RNA, 19 nt, Homo sapiens
ggagaugaaguuaucagua

SEQ ID NO: 664389 - RNA, 19 nt, Homo sapiens
ccaaaacacugaaguugua

SEQ ID NO: 664390 - RNA, 19 nt, Homo sapiens
cagaugacuugcuuggaua

SEQ ID NO: 664391 - RNA, 19 nt, Homo sapiens
ggagagaggaucugauaau

SEQ ID NO: 664392 - RNA, 19 nt, Homo sapiens
aaacagccauccacacaga

SEQ ID NO: 664393 - RNA, 19 nt, Homo sapiens
gaaggucacagaacaguau

SEQ ID NO: 664394 - RNA, 19 nt, Homo sapiens
ucaggaagauuaugaccaa

SEQ ID NO: 664395 - RNA, 19 nt, Homo sapiens
uaccuaagccacauaauaa

SEQ ID NO: 664396 - RNA, 19 nt, Homo sapiens
agaaggaucugaugaugau

SEQ ID NO: 664397 - RNA, 19 nt, Homo sapiens
ucaaucagucuccaaauaa

SEQ ID NO: 664398 - RNA, 19 nt, Homo sapiens
ggaagcagcacguauagau

SEQ ID NO: 664399 - RNA, 19 nt, Homo sapiens
gauguuuagucaauuguga

SEQ ID NO: 664400 - RNA, 19 nt, Homo sapiens
gcaaacaagaugaagaaga

SEQ ID NO: 664401 - RNA, 19 nt, Homo sapiens
caacagcagauauuaguga

SEQ ID NO: 664402 - RNA, 19 nt, Homo sapiens
ggccaaggcucuggaaaug

SEQ ID NO: 664403 - RNA, 19 nt, Homo sapiens
gaacaacgaaagaaaugug

SEQ ID NO: 664404 - RNA, 19 nt, Homo sapiens
ugaccuaccuauauccaaa

SEQ ID NO: 664405 - RNA, 19 nt, Homo sapiens
ugaguaaagugggagauaa

SEQ ID NO: 664406 - RNA, 19 nt, Homo sapiens
acaaacaaguacucagaaa

SEQ ID NO: 664407 - RNA, 19 nt, Homo sapiens
gaaguucguuuaggaaugg

SEQ ID NO: 664408 - RNA, 19 nt, Homo sapiens
aagaaagcauugcguacua

SEQ ID NO: 664409 - RNA, 19 nt, Homo sapiens
gcauuuccuucaacaagaa

SEQ ID NO: 664410 - RNA, 19 nt, Homo sapiens
caacugcacauauggauug

SEQ ID NO: 664411 - RNA, 19 nt, Homo sapiens
ccagaugacuugcuuggau

SEQ ID NO: 664412 - RNA, 19 nt, Homo sapiens
uaaagaacaggaagagaaa

SEQ ID NO: 664413 - RNA, 19 nt, Homo sapiens
acacugaaguuguacucua

SEQ ID NO: 664414 - RNA, 19 nt, Homo sapiens
cagaaaugaugcaaagaau

SEQ ID NO: 664415 - RNA, 19 nt, Homo sapiens
gaaguuugagaggauauua

SEQ ID NO: 664416 - RNA, 19 nt, Homo sapiens
ugaauuccaugaagcagaa

SEQ ID NO: 664417 - RNA, 19 nt, Homo sapiens
ggauugaauuggcacaaau

SEQ ID NO: 664418 - RNA, 19 nt, Homo sapiens
cuaccuaagccacauaaua

SEQ ID NO: 664419 - RNA, 19 nt, Homo sapiens
cagcauacucuucugauuu

SEQ ID NO: 664420 - RNA, 19 nt, Homo sapiens
caaugaaucugugcaguca

SEQ ID NO: 664421 - RNA, 19 nt, Homo sapiens
ugauguauuugcccaagua

SEQ ID NO: 664422 - RNA, 19 nt, Homo sapiens
gcacauauggauugcuuug

SEQ ID NO: 664423 - RNA, 19 nt, Homo sapiens
aaacaaguacucagaaaug

SEQ ID NO: 664424 - RNA, 19 nt, Homo sapiens
uaagaagggaggagaguuu

SEQ ID NO: 664425 - RNA, 19 nt, Homo sapiens
ccagaugcuuggucuuuga

SEQ ID NO: 664426 - RNA, 19 nt, Homo sapiens
ccacacaguuugccucauc

SEQ ID NO: 664427 - RNA, 19 nt, Homo sapiens
ucagcuagcuagaucauuc

SEQ ID NO: 664428 - RNA, 19 nt, Homo sapiens
cuccaugcauuccauaaua

SEQ ID NO: 664429 - RNA, 19 nt, Homo sapiens
gcaacccuaugguauugaa

SEQ ID NO: 664430 - RNA, 19 nt, Homo sapiens
cucaaucagucuccaaaua

SEQ ID NO: 664431 - RNA, 19 nt, Homo sapiens
cugcagcgauguagauaaa

SEQ ID NO: 664432 - RNA, 19 nt, Homo sapiens
cgaaucagaucacgaaucg

SEQ ID NO: 664433 - RNA, 19 nt, Homo sapiens
uaaaauugcugaugaagga

SEQ ID NO: 664434 - RNA, 19 nt, Homo sapiens
ccaaagccauaauuucauc

SEQ ID NO: 664435 - RNA, 19 nt, Homo sapiens
gagaagaaggaucugauga

SEQ ID NO: 664436 - RNA, 19 nt, Homo sapiens
gcugaaggcuagacaugug

SEQ ID NO: 664437 - RNA, 19 nt, Homo sapiens
uuacaggaaugcaaacaga

SEQ ID NO: 664438 - RNA, 19 nt, Homo sapiens
cagcagauauuagugaugu

SEQ ID NO: 664439 - RNA, 19 nt, Homo sapiens
ucgugaagcucgugaugua

SEQ ID NO: 664440 - RNA, 19 nt, Homo sapiens
auacagaaguggaagcuau

SEQ ID NO: 664441 - RNA, 19 nt, Homo sapiens
ccaccuaucauaugugaaa

SEQ ID NO: 664442 - RNA, 19 nt, Homo sapiens
ucagauguuuagucaauug

SEQ ID NO: 664443 - RNA, 19 nt, Homo sapiens
ggucagaucaggacucaga

SEQ ID NO: 664444 - RNA, 19 nt, Homo sapiens
gaaaauggccccaaaccaa

SEQ ID NO: 664445 - RNA, 19 nt, Homo sapiens
caggcaguguucugacuua

SEQ ID NO: 664446 - RNA, 19 nt, Homo sapiens
ccagguggguucauauuua

SEQ ID NO: 664447 - RNA, 19 nt, Homo sapiens
agacagaccuuuccgaauu

SEQ ID NO: 664448 - RNA, 19 nt, Homo sapiens
gcacggagcucugccauuc

SEQ ID NO: 664449 - RNA, 19 nt, Homo sapiens
uaagugggcuggagaagaa

SEQ ID NO: 664450 - RNA, 19 nt, Homo sapiens
gagaaugguuggccacaaa

SEQ ID NO: 664451 - RNA, 19 nt, Homo sapiens
ggaccuugcugcuguguga

SEQ ID NO: 664452 - RNA, 19 nt, Homo sapiens
gaagcaguauuccagguuu

SEQ ID NO: 664453 - RNA, 19 nt, Homo sapiens
ccaagaagcuaggugguuu

SEQ ID NO: 664454 - RNA, 19 nt, Homo sapiens
uuacacagcuuugaagaaa

SEQ ID NO: 664455 - RNA, 19 nt, Homo sapiens
ggacacuggucuguaaauu

SEQ ID NO: 664456 - RNA, 19 nt, Homo sapiens
cacaaacaaugaccaagua

SEQ ID NO: 664457 - RNA, 19 nt, Homo sapiens
ggaggaagcugggcugugu

SEQ ID NO: 664458 - RNA, 19 nt, Homo sapiens
uaggagaccucaccaaaga

SEQ ID NO: 664459 - RNA, 19 nt, Homo sapiens
ggaaauggguguguuuagu

SEQ ID NO: 664460 - RNA, 19 nt, Homo sapiens
gcacagaguuucuuuaacc

SEQ ID NO: 664461 - RNA, 19 nt, Homo sapiens
gaccaggacugcaccaaga

SEQ ID NO: 664462 - RNA, 19 nt, Homo sapiens
ggagcgcucuuccaucuug

SEQ ID NO: 664463 - RNA, 19 nt, Homo sapiens
ggcauaaccuugacgaaga

SEQ ID NO: 664464 - RNA, 19 nt, Homo sapiens
gaccuguugugucauauaa

SEQ ID NO: 664465 - RNA, 19 nt, Homo sapiens
gagccaaacucuugaagca

SEQ ID NO: 664466 - RNA, 19 nt, Homo sapiens
gaggagcgcucuuccaucu

SEQ ID NO: 664467 - RNA, 19 nt, Homo sapiens
ggacagcucuggcccuucu

SEQ ID NO: 664468 - RNA, 19 nt, Homo sapiens
aaacauagucgcugucauu

SEQ ID NO: 664469 - RNA, 19 nt, Homo sapiens
ggguucauauuuacagaua

SEQ ID NO: 664470 - RNA, 19 nt, Homo sapiens
cagggacacuggucuguaa

SEQ ID NO: 664471 - RNA, 19 nt, Homo sapiens
gcacaugugucuuuuguug

SEQ ID NO: 664472 - RNA, 19 nt, Homo sapiens
gaacauucccaaauaucuu

SEQ ID NO: 664473 - RNA, 19 nt, Homo sapiens
acacuggucuguaaauugu

SEQ ID NO: 664474 - RNA, 19 nt, Homo sapiens
gaaauggguguguuuagug

SEQ ID NO: 664475 - RNA, 19 nt, Homo sapiens
gcccagcucuccacuuguu

SEQ ID NO: 664476 - RNA, 19 nt, Homo sapiens
gugccaagaugaccuguug

SEQ ID NO: 664477 - RNA, 19 nt, Homo sapiens
gaccagaacggcaggauga

SEQ ID NO: 664478 - RNA, 19 nt, Homo sapiens
cagcccagcucuccacuug

SEQ ID NO: 664479 - RNA, 19 nt, Homo sapiens
gaagagagagaaugauugg

SEQ ID NO: 664480 - RNA, 19 nt, Homo sapiens
gauaggaaauggguguguu

SEQ ID NO: 664481 - RNA, 19 nt, Homo sapiens
gagcugcgacugccacgua

SEQ ID NO: 664482 - RNA, 19 nt, Homo sapiens
gacccaggcuccaccaaga

SEQ ID NO: 664483 - RNA, 19 nt, Homo sapiens
ccuguugugucauauaauu

SEQ ID NO: 664484 - RNA, 19 nt, Homo sapiens
ggaugacugucuucccuau

SEQ ID NO: 664485 - RNA, 19 nt, Homo sapiens
guuaaaggaagcaguguuu

SEQ ID NO: 664486 - RNA, 19 nt, Homo sapiens
gaugguggaaggcagcuua

SEQ ID NO: 664487 - RNA, 19 nt, Homo sapiens
gcagaagugucaauaaacc

SEQ ID NO: 664488 - RNA, 19 nt, Homo sapiens
ugacgaagagagagaauga

SEQ ID NO: 664489 - RNA, 19 nt, Homo sapiens
cagaugagguugagaccau

SEQ ID NO: 664490 - RNA, 19 nt, Homo sapiens
uuaauaagccauucaagug

SEQ ID NO: 664491 - RNA, 19 nt, Homo sapiens
gacagaccuuuccgaauuc

SEQ ID NO: 664492 - RNA, 19 nt, Homo sapiens
gggcagccaugaugugcuu

SEQ ID NO: 664493 - RNA, 19 nt, Homo sapiens
augcagaagugucaauaaa

SEQ ID NO: 664494 - RNA, 19 nt, Homo sapiens
cagaagagcagcccaaugg

SEQ ID NO: 664495 - RNA, 19 nt, Homo sapiens
gcagugcaccucugagugu

SEQ ID NO: 664496 - RNA, 19 nt, Homo sapiens
uugcuuggcuuaacuugaa

SEQ ID NO: 664497 - RNA, 19 nt, Homo sapiens
guucgauucugccucugua

SEQ ID NO: 664498 - RNA, 19 nt, Homo sapiens
gcagagcuuagcauuuauu

SEQ ID NO: 664499 - RNA, 19 nt, Homo sapiens
agccagagcugcccacaga

SEQ ID NO: 664500 - RNA, 19 nt, Homo sapiens
ccaguugggcuguguuaaa

SEQ ID NO: 664501 - RNA, 19 nt, Homo sapiens
caaacaaugaccaaguauu

SEQ ID NO: 664502 - RNA, 19 nt, Homo sapiens
ucccaaauaucuugugaau

SEQ ID NO: 664503 - RNA, 19 nt, Homo sapiens
caacggcagccaaaccaaa

SEQ ID NO: 664504 - RNA, 19 nt, Homo sapiens
gaacccaggauaggaaaug

SEQ ID NO: 664505 - RNA, 19 nt, Homo sapiens
gcauaaccuugacgaagag

SEQ ID NO: 664506 - RNA, 19 nt, Homo sapiens
gcuccacccucaccacuag

SEQ ID NO: 664507 - RNA, 19 nt, Homo sapiens
cauagucgcugucauucag

SEQ ID NO: 664508 - RNA, 19 nt, Homo sapiens
ggagaccucaccaaagaga

SEQ ID NO: 664509 - RNA, 19 nt, Homo sapiens
ucacagcacagaugagguu

SEQ ID NO: 664510 - RNA, 19 nt, Homo sapiens
gcccaaagccuggcacaga

SEQ ID NO: 664511 - RNA, 19 nt, Homo sapiens
ggauaggcccauugagguu

SEQ ID NO: 664512 - RNA, 19 nt, Homo sapiens
guuaauaagccauucaagu

SEQ ID NO: 664513 - RNA, 19 nt, Homo sapiens
gaacacucgccgcaagaug

SEQ ID NO: 664514 - RNA, 19 nt, Homo sapiens
uggcacagaguuucuuuaa

SEQ ID NO: 664515 - RNA, 19 nt, Homo sapiens
caauaaaccacaaguucug

SEQ ID NO: 664516 - RNA, 19 nt, Homo sapiens
ugccaaggcuccauagcuu

SEQ ID NO: 664517 - RNA, 19 nt, Homo sapiens
ccacaaacaaugaccaagu

SEQ ID NO: 664518 - RNA, 19 nt, Homo sapiens
ggauugaaacaggaacuuu

SEQ ID NO: 664519 - RNA, 19 nt, Homo sapiens
ccacaugccagcaccguau

SEQ ID NO: 664520 - RNA, 19 nt, Homo sapiens
gacacuggucuguaaauug

SEQ ID NO: 664521 - RNA, 19 nt, Homo sapiens
cgaagagagagaaugauug

SEQ ID NO: 664522 - RNA, 19 nt, Homo sapiens
gcaccgaccagauguuucu

SEQ ID NO: 664523 - RNA, 19 nt, Homo sapiens
gucaauaaaccacaaguuc

SEQ ID NO: 664524 - RNA, 19 nt, Homo sapiens
ccucuccucuccucuccua

SEQ ID NO: 664525 - RNA, 19 nt, Homo sapiens
gcugugugauuggaacauu

SEQ ID NO: 664526 - RNA, 19 nt, Homo sapiens
gauaggcccauugagguuu

SEQ ID NO: 664527 - RNA, 19 nt, Homo sapiens
gcucggauaggcccauuga

SEQ ID NO: 664528 - RNA, 19 nt, Homo sapiens
ggcaguggcuggucuccau

SEQ ID NO: 664529 - RNA, 19 nt, Homo sapiens
cagcaccguauauggaaua

SEQ ID NO: 664530 - RNA, 19 nt, Homo sapiens
ccacuuguuccuuguguga

SEQ ID NO: 664531 - RNA, 19 nt, Homo sapiens
uggacacgcuccugcaaga

SEQ ID NO: 664532 - RNA, 19 nt, Homo sapiens
gcgacgcacaugugucuuu

SEQ ID NO: 664533 - RNA, 19 nt, Homo sapiens
ccaaggcuccauagcuuug

SEQ ID NO: 664534 - RNA, 19 nt, Homo sapiens
guugggcuguguuaaagga

SEQ ID NO: 664535 - RNA, 19 nt, Homo sapiens
gcaggcagugcaccucuga

SEQ ID NO: 664536 - RNA, 19 nt, Homo sapiens
acacagcuuugaagaaacu

SEQ ID NO: 664537 - RNA, 19 nt, Homo sapiens
gcccagggaggaagaagaa

SEQ ID NO: 664538 - RNA, 19 nt, Homo sapiens
gaaguugcccagggaggaa

SEQ ID NO: 664539 - RNA, 19 nt, Homo sapiens
cagaacggcaggaugagaa

SEQ ID NO: 664540 - RNA, 19 nt, Homo sapiens
gcgcaccgaccagauguuu

SEQ ID NO: 664541 - RNA, 19 nt, Homo sapiens
cuacuuugcuguguuugau

SEQ ID NO: 664542 - RNA, 19 nt, Homo sapiens
gcgccuacuuugcuguguu

SEQ ID NO: 664543 - RNA, 19 nt, Homo sapiens
ucagaacccaggauaggaa

SEQ ID NO: 664544 - RNA, 19 nt, Homo sapiens
guuccuggcugccgagagu

SEQ ID NO: 664545 - RNA, 19 nt, Homo sapiens
uggcuucuuugacgucgua

SEQ ID NO: 664546 - RNA, 19 nt, Homo sapiens
ggaaauagcugauuaugaa

SEQ ID NO: 664547 - RNA, 19 nt, Homo sapiens
gaacagaccuaacuaguga

SEQ ID NO: 664548 - RNA, 19 nt, Homo sapiens
gaacaacucugaagauaau

SEQ ID NO: 664549 - RNA, 19 nt, Homo sapiens
ucaaagagauaccauguua

SEQ ID NO: 664550 - RNA, 19 nt, Homo sapiens
gaaauauagucucugcuua

SEQ ID NO: 664551 - RNA, 19 nt, Homo sapiens
gcucauauaucucaucuuu

SEQ ID NO: 664552 - RNA, 19 nt, Homo sapiens
gaaaugggaucagaaguuu

SEQ ID NO: 664553 - RNA, 19 nt, Homo sapiens
gaaauuugcugcugauaug

SEQ ID NO: 664554 - RNA, 19 nt, Homo sapiens
gcagaaagcuauaagaauc

SEQ ID NO: 664555 - RNA, 19 nt, Homo sapiens
gaaagacaguggagacauu

SEQ ID NO: 664556 - RNA, 19 nt, Homo sapiens
gagcugacaugaagaguuu

SEQ ID NO: 664557 - RNA, 19 nt, Homo sapiens
cgaaauagcuuccgagauc

SEQ ID NO: 664558 - RNA, 19 nt, Homo sapiens
gaacaugccacuacuguaa

SEQ ID NO: 664559 - RNA, 19 nt, Homo sapiens
gaucagaaguuucagaaga

SEQ ID NO: 664560 - RNA, 19 nt, Homo sapiens
gaagugaagucucuuuaug

SEQ ID NO: 664561 - RNA, 19 nt, Homo sapiens
gagcagaguugauacuauu

SEQ ID NO: 664562 - RNA, 19 nt, Homo sapiens
ggaaagaguuagaagaaau

SEQ ID NO: 664563 - RNA, 19 nt, Homo sapiens
gagaggaaguguaaugauu

SEQ ID NO: 664564 - RNA, 19 nt, Homo sapiens
gaugaaaucugaacauaca

SEQ ID NO: 664565 - RNA, 19 nt, Homo sapiens
guacaacagugaacuagaa

SEQ ID NO: 664566 - RNA, 19 nt, Homo sapiens
ugaaggaacuggugauauu

SEQ ID NO: 664567 - RNA, 19 nt, Homo sapiens
gcaaugagaggaaguguaa

SEQ ID NO: 664568 - RNA, 19 nt, Homo sapiens
caaaccacauugaugaaua

SEQ ID NO: 664569 - RNA, 19 nt, Homo sapiens
agacaaagcuaacuuacaa

SEQ ID NO: 664570 - RNA, 19 nt, Homo sapiens
caaauacagugaagacaaa

SEQ ID NO: 664571 - RNA, 19 nt, Homo sapiens
caacaaaccacauugauga

SEQ ID NO: 664572 - RNA, 19 nt, Homo sapiens
gaaaccagguagugaaaga

SEQ ID NO: 664573 - RNA, 19 nt, Homo sapiens
caacuggaauuuaggcuuu

SEQ ID NO: 664574 - RNA, 19 nt, Homo sapiens
gaagaaguaucucaaacau

SEQ ID NO: 664575 - RNA, 19 nt, Homo sapiens
gcacauacacacagucuuu

SEQ ID NO: 664576 - RNA, 19 nt, Homo sapiens
gaagaaauacagucagaaa

SEQ ID NO: 664577 - RNA, 19 nt, Homo sapiens
guaaauaugcugcaguuaa

SEQ ID NO: 664578 - RNA, 19 nt, Homo sapiens
gaacuugaaucucuucgau

SEQ ID NO: 664579 - RNA, 19 nt, Homo sapiens
gaaagaaauugaagaacuc

SEQ ID NO: 664580 - RNA, 19 nt, Homo sapiens
gaacuagauuccagcagaa

SEQ ID NO: 664581 - RNA, 19 nt, Homo sapiens
caucuuuccuccugucuua

SEQ ID NO: 664582 - RNA, 19 nt, Homo sapiens
gcacuuugguuacacagaa

SEQ ID NO: 664583 - RNA, 19 nt, Homo sapiens
gcaauuagaacuuucagaa

SEQ ID NO: 664584 - RNA, 19 nt, Homo sapiens
gcaggaaacuguguccaaa

SEQ ID NO: 664585 - RNA, 19 nt, Homo sapiens
gaagagaaagauguuguua

SEQ ID NO: 664586 - RNA, 19 nt, Homo sapiens
gggaagacuuagaguuuaa

SEQ ID NO: 664587 - RNA, 19 nt, Homo sapiens
caaacuguguuguucuuaa

SEQ ID NO: 664588 - RNA, 19 nt, Homo sapiens
agaaguaucucaaacaugu

SEQ ID NO: 664589 - RNA, 19 nt, Homo sapiens
gaaaguagagcaaacaauc

SEQ ID NO: 664590 - RNA, 19 nt, Homo sapiens
cagcuaaccuggaauacuu

SEQ ID NO: 664591 - RNA, 19 nt, Homo sapiens
guuacuaucucaacaagaa

SEQ ID NO: 664592 - RNA, 19 nt, Homo sapiens
ggagaaagaaauugaagaa

SEQ ID NO: 664593 - RNA, 19 nt, Homo sapiens
gauccucugucuucaguaa

SEQ ID NO: 664594 - RNA, 19 nt, Homo sapiens
gaacagagcgagaccuugu

SEQ ID NO: 664595 - RNA, 19 nt, Homo sapiens
gcaaagaaagaacuagauu

SEQ ID NO: 664596 - RNA, 19 nt, Homo sapiens
gaaggaacuggugauauua

SEQ ID NO: 664597 - RNA, 19 nt, Homo sapiens
agcagaaacugaucacuua

SEQ ID NO: 664598 - RNA, 19 nt, Homo sapiens
gauagaagauuuggagcaa

SEQ ID NO: 664599 - RNA, 19 nt, Homo sapiens
gggagaaaaugaaaaguua

SEQ ID NO: 664600 - RNA, 19 nt, Homo sapiens
gaaauggaugcucaacaua

SEQ ID NO: 664601 - RNA, 19 nt, Homo sapiens
gauauguucuauucucuug

SEQ ID NO: 664602 - RNA, 19 nt, Homo sapiens
gaacaugaagcagagauaa

SEQ ID NO: 664603 - RNA, 19 nt, Homo sapiens
aagaagaggugaaagaguu

SEQ ID NO: 664604 - RNA, 19 nt, Homo sapiens
gcugauauguugaguuugu

SEQ ID NO: 664605 - RNA, 19 nt, Homo sapiens
gaguugaggugauuucaug

SEQ ID NO: 664606 - RNA, 19 nt, Homo sapiens
gaagaucuccuggcucgua

SEQ ID NO: 664607 - RNA, 19 nt, Homo sapiens
gagcagaaagcuauaagaa

SEQ ID NO: 664608 - RNA, 19 nt, Homo sapiens
ucacguauauuaccacaau

SEQ ID NO: 664609 - RNA, 19 nt, Homo sapiens
gagauuaagugccuucaag

SEQ ID NO: 664610 - RNA, 19 nt, Homo sapiens
gagaucaagugcgacauuu

SEQ ID NO: 664611 - RNA, 19 nt, Homo sapiens
ggaacuggugauauuauua

SEQ ID NO: 664612 - RNA, 19 nt, Homo sapiens
ugaaaguucucucugaaga

SEQ ID NO: 664613 - RNA, 19 nt, Homo sapiens
gagcuagcagguuuaaaua

SEQ ID NO: 664614 - RNA, 19 nt, Homo sapiens
aaucugagcuagcagguuu

SEQ ID NO: 664615 - RNA, 19 nt, Homo sapiens
gucaaacacuuagaagaua

SEQ ID NO: 664616 - RNA, 19 nt, Homo sapiens
gaaaagaaggaaacaguua

SEQ ID NO: 664617 - RNA, 19 nt, Homo sapiens
gaacuuucagaacaacuua

SEQ ID NO: 664618 - RNA, 19 nt, Homo sapiens
cagagaacaugaugaugaa

SEQ ID NO: 664619 - RNA, 19 nt, Homo sapiens
gaaggaagaacuugaaucu

SEQ ID NO: 664620 - RNA, 19 nt, Homo sapiens
gaaagauguuguuaauguc

SEQ ID NO: 664621 - RNA, 19 nt, Homo sapiens
gaagauaccuuaaaagaac

SEQ ID NO: 664622 - RNA, 19 nt, Homo sapiens
guugaaagcuauacaccaa

SEQ ID NO: 664623 - RNA, 19 nt, Homo sapiens
gauccaaacuguguuguuc

SEQ ID NO: 664624 - RNA, 19 nt, Homo sapiens
ccacauugaugaauaugga

SEQ ID NO: 664625 - RNA, 19 nt, Homo sapiens
ccaaagcaaugguagacaa

SEQ ID NO: 664626 - RNA, 19 nt, Homo sapiens
ugaaauggaugcucaacau

SEQ ID NO: 664627 - RNA, 19 nt, Homo sapiens
acacuuagaagauaccuua

SEQ ID NO: 664628 - RNA, 19 nt, Homo sapiens
gaugggagaugcacauaag

SEQ ID NO: 664629 - RNA, 19 nt, Homo sapiens
ugacaccucugcauauguu

SEQ ID NO: 664630 - RNA, 19 nt, Homo sapiens
gagagacuucuuccuguua

SEQ ID NO: 664631 - RNA, 19 nt, Homo sapiens
gagagaagucugcagcuaa

SEQ ID NO: 664632 - RNA, 19 nt, Homo sapiens
gcagucugaucuucuagaa

SEQ ID NO: 664633 - RNA, 19 nt, Homo sapiens
aaaugaaaguucucucuga

SEQ ID NO: 664634 - RNA, 19 nt, Homo sapiens
gaguugaugugccagauug

SEQ ID NO: 664635 - RNA, 19 nt, Homo sapiens
ugacagcacuacaggaaga

SEQ ID NO: 664636 - RNA, 19 nt, Homo sapiens
caagaaacccuacaagaag

SEQ ID NO: 664637 - RNA, 19 nt, Homo sapiens
gauggaggaucuuguucaa

SEQ ID NO: 664638 - RNA, 19 nt, Homo sapiens
uaagaagauuggaaaggaa

SEQ ID NO: 664639 - RNA, 19 nt, Homo sapiens
gaaauagcuuccgagauca

SEQ ID NO: 664640 - RNA, 19 nt, Homo sapiens
ugagggcgcuaaacaagaa

SEQ ID NO: 664641 - RNA, 19 nt, Homo sapiens
acaagaaacccuacaagaa

SEQ ID NO: 664642 - RNA, 19 nt, Homo sapiens
aauggaugcucaacauaua

SEQ ID NO: 664643 - RNA, 19 nt, Homo sapiens
uauagucucugcuuacgaa

SEQ ID NO: 664644 - RNA, 19 nt, Homo sapiens
uagaagaaauacagucaga

SEQ ID NO: 664645 - RNA, 19 nt, Homo sapiens
ugagcaaguucagaaguua

SEQ ID NO: 664646 - RNA, 19 nt, Homo sapiens
gaacaaagauccaaucaga

SEQ ID NO: 664647 - RNA, 19 nt, Homo sapiens
gaacaucaacuaccuauuu

SEQ ID NO: 664648 - RNA, 19 nt, Homo sapiens
ucacaccaaugaaguauua

SEQ ID NO: 664649 - RNA, 19 nt, Homo sapiens
gaagaugguuccaaguauu

SEQ ID NO: 664650 - RNA, 19 nt, Homo sapiens
ccaaucagaugaacaauau

SEQ ID NO: 664651 - RNA, 19 nt, Homo sapiens
ggauauaccuguguuuaaa

SEQ ID NO: 664652 - RNA, 19 nt, Homo sapiens
guaaggacuuucucuaauu

SEQ ID NO: 664653 - RNA, 19 nt, Homo sapiens
gaacgacugugacuauuca

SEQ ID NO: 664654 - RNA, 19 nt, Homo sapiens
gcacaagacucgugacauc

SEQ ID NO: 664655 - RNA, 19 nt, Homo sapiens
gaagaguccuggagcuaaa

SEQ ID NO: 664656 - RNA, 19 nt, Homo sapiens
aaauacagcuuucugguuu

SEQ ID NO: 664657 - RNA, 19 nt, Homo sapiens
guagauacuugaagagauu

SEQ ID NO: 664658 - RNA, 19 nt, Homo sapiens
gauucuaccuguuaacuuu

SEQ ID NO: 664659 - RNA, 19 nt, Homo sapiens
ucagaaccaugcaguguua

SEQ ID NO: 664660 - RNA, 19 nt, Homo sapiens
gcaacaauaugauguguca

SEQ ID NO: 664661 - RNA, 19 nt, Homo sapiens
uaaccuacauugaaucuga

SEQ ID NO: 664662 - RNA, 19 nt, Homo sapiens
guugguagcugguaacauu

SEQ ID NO: 664663 - RNA, 19 nt, Homo sapiens
gcagaaauccucagccauu

SEQ ID NO: 664664 - RNA, 19 nt, Homo sapiens
gcccauaaaugacuuaaau

SEQ ID NO: 664665 - RNA, 19 nt, Homo sapiens
guuaggagcucuucacaug

SEQ ID NO: 664666 - RNA, 19 nt, Homo sapiens
gaaauuggacuaccugaug

SEQ ID NO: 664667 - RNA, 19 nt, Homo sapiens
ggaagagacugaauuucug

SEQ ID NO: 664668 - RNA, 19 nt, Homo sapiens
guaucaaguugcuguauuu

SEQ ID NO: 664669 - RNA, 19 nt, Homo sapiens
gauccacccuccuguacua

SEQ ID NO: 664670 - RNA, 19 nt, Homo sapiens
gagauucuguuuaggaaga

SEQ ID NO: 664671 - RNA, 19 nt, Homo sapiens
gaagagauucuguuuagga

SEQ ID NO: 664672 - RNA, 19 nt, Homo sapiens
cugcaaaccuuaugucauu

SEQ ID NO: 664673 - RNA, 19 nt, Homo sapiens
ggaagcagcucuccaagac

SEQ ID NO: 664674 - RNA, 19 nt, Homo sapiens
uugaagagcuccagaaguu

SEQ ID NO: 664675 - RNA, 19 nt, Homo sapiens
ggaguuugcuagccagauu

SEQ ID NO: 664676 - RNA, 19 nt, Homo sapiens
guaaacaaacaaugccuua

SEQ ID NO: 664677 - RNA, 19 nt, Homo sapiens
ucaagugguuucauguuaa

SEQ ID NO: 664678 - RNA, 19 nt, Homo sapiens
uagaauacuuuccuccuaa

SEQ ID NO: 664679 - RNA, 19 nt, Homo sapiens
ucugagaaguuaacccuua

SEQ ID NO: 664680 - RNA, 19 nt, Homo sapiens
ccacagggcugccucagau

SEQ ID NO: 664681 - RNA, 19 nt, Homo sapiens
caagauggccaguaucauu

SEQ ID NO: 664682 - RNA, 19 nt, Homo sapiens
caagaggaauggucugaug

SEQ ID NO: 664683 - RNA, 19 nt, Homo sapiens
guagagagcaguagaaauc

SEQ ID NO: 664684 - RNA, 19 nt, Homo sapiens
gagggaagcauuucuaguu

SEQ ID NO: 664685 - RNA, 19 nt, Homo sapiens
gagaaacucccaggugaua

SEQ ID NO: 664686 - RNA, 19 nt, Homo sapiens
ccaccaagauuccugauca

SEQ ID NO: 664687 - RNA, 19 nt, Homo sapiens
gaacucaacaaccuucauu

SEQ ID NO: 664688 - RNA, 19 nt, Homo sapiens
caccacaccuaucuccuua

SEQ ID NO: 664689 - RNA, 19 nt, Homo sapiens
gaaaucuuguucuaacugu

SEQ ID NO: 664690 - RNA, 19 nt, Homo sapiens
ggaguuaagugcugcuugu

SEQ ID NO: 664691 - RNA, 19 nt, Homo sapiens
ggaugaaagugcaagaugu

SEQ ID NO: 664692 - RNA, 19 nt, Homo sapiens
uaacagcacagacuuuaaa

SEQ ID NO: 664693 - RNA, 19 nt, Homo sapiens
caagugguuucauguuaaa

SEQ ID NO: 664694 - RNA, 19 nt, Homo sapiens
ugaaauagcacaaucacaa

SEQ ID NO: 664695 - RNA, 19 nt, Homo sapiens
cuacauugauucugcauau

SEQ ID NO: 664696 - RNA, 19 nt, Homo sapiens
gaaacucccaggugauaaa

SEQ ID NO: 664697 - RNA, 19 nt, Homo sapiens
gcucagaguuuagugaaga

SEQ ID NO: 664698 - RNA, 19 nt, Homo sapiens
ggaagacgacaacuacaaa

SEQ ID NO: 664699 - RNA, 19 nt, Homo sapiens
gaagagcuccagaaguuug

SEQ ID NO: 664700 - RNA, 19 nt, Homo sapiens
aagcuacccucaagaguuu

SEQ ID NO: 664701 - RNA, 19 nt, Homo sapiens
ggacagcgcuaacuaaccu

SEQ ID NO: 664702 - RNA, 19 nt, Homo sapiens
caaaggcaauguuuacaag

SEQ ID NO: 664703 - RNA, 19 nt, Homo sapiens
acaaagugcucccaucuuc

SEQ ID NO: 664704 - RNA, 19 nt, Homo sapiens
caaaugcagucaccagcaa

SEQ ID NO: 664705 - RNA, 19 nt, Homo sapiens
gcacaagcauuuggaugau

SEQ ID NO: 664706 - RNA, 19 nt, Homo sapiens
gaacuuguaccauggacuu

SEQ ID NO: 664707 - RNA, 19 nt, Homo sapiens
ucacaugaaucacauccuu

SEQ ID NO: 664708 - RNA, 19 nt, Homo sapiens
aagcagcucuccaagacua

SEQ ID NO: 664709 - RNA, 19 nt, Homo sapiens
uaaggacuuucucuaauuc

SEQ ID NO: 664710 - RNA, 19 nt, Homo sapiens
gcaguuguguaaggacuuu

SEQ ID NO: 664711 - RNA, 19 nt, Homo sapiens
guauaaauccugugcauag

SEQ ID NO: 664712 - RNA, 19 nt, Homo sapiens
gaacauguuuugucauuca

SEQ ID NO: 664713 - RNA, 19 nt, Homo sapiens
acacucagcucucuaagca

SEQ ID NO: 664714 - RNA, 19 nt, Homo sapiens
gaaauagcacaaucacaau

SEQ ID NO: 664715 - RNA, 19 nt, Homo sapiens
gaaagugcaagauguggaa

SEQ ID NO: 664716 - RNA, 19 nt, Homo sapiens
ugaagaugguuccaaguau

SEQ ID NO: 664717 - RNA, 19 nt, Homo sapiens
agacuaccuuugagaaauu

SEQ ID NO: 664718 - RNA, 19 nt, Homo sapiens
ggaguaagaaggagaaaca

SEQ ID NO: 664719 - RNA, 19 nt, Homo sapiens
cacaguaucugcuccauag

SEQ ID NO: 664720 - RNA, 19 nt, Homo sapiens
ggccaaacaugggaguuaa

SEQ ID NO: 664721 - RNA, 19 nt, Homo sapiens
ggaagaguccuggagcuaa

SEQ ID NO: 664722 - RNA, 19 nt, Homo sapiens
cuagaauacuuuccuccua

SEQ ID NO: 664723 - RNA, 19 nt, Homo sapiens
ccaguaaaguguaauaggu

SEQ ID NO: 664724 - RNA, 19 nt, Homo sapiens
ucaacaaccuucauucucu

SEQ ID NO: 664725 - RNA, 19 nt, Homo sapiens
acaaacuccuaguccuuua

SEQ ID NO: 664726 - RNA, 19 nt, Homo sapiens
uuaccaagauggccaguau

SEQ ID NO: 664727 - RNA, 19 nt, Homo sapiens
uugaagggauuauuucuug

SEQ ID NO: 664728 - RNA, 19 nt, Homo sapiens
ugucuucgaugucuugaaa

SEQ ID NO: 664729 - RNA, 19 nt, Homo sapiens
ggaagacacucagcucucu

SEQ ID NO: 664730 - RNA, 19 nt, Homo sapiens
uaucuucucuucccucuuc

SEQ ID NO: 664731 - RNA, 19 nt, Homo sapiens
aauaugaugugucaguuga

SEQ ID NO: 664732 - RNA, 19 nt, Homo sapiens
cauaucaagugguuucaug

SEQ ID NO: 664733 - RNA, 19 nt, Homo sapiens
ggaaaugcuccaugaaaca

SEQ ID NO: 664734 - RNA, 19 nt, Homo sapiens
uugaagagauucuguuuag

SEQ ID NO: 664735 - RNA, 19 nt, Homo sapiens
caaccucugcauucaguua

SEQ ID NO: 664736 - RNA, 19 nt, Homo sapiens
gagugacccugaggccuua

SEQ ID NO: 664737 - RNA, 19 nt, Homo sapiens
ugacaucacacacuucauu

SEQ ID NO: 664738 - RNA, 19 nt, Homo sapiens
gacgacaacuacaaacugu

SEQ ID NO: 664739 - RNA, 19 nt, Homo sapiens
gaaaauagccaagaaacuu

SEQ ID NO: 664740 - RNA, 19 nt, Homo sapiens
gaccugaccacucaacaaa

SEQ ID NO: 664741 - RNA, 19 nt, Homo sapiens
gcggaaaugcuccaugaaa

SEQ ID NO: 664742 - RNA, 19 nt, Homo sapiens
ggccagagcugcgacuaug

SEQ ID NO: 664743 - RNA, 19 nt, Homo sapiens
ggacuucuccagacagguu

SEQ ID NO: 664744 - RNA, 19 nt, Homo sapiens
gagaguagggucaaacugu

SEQ ID NO: 664745 - RNA, 19 nt, Homo sapiens
gaguauaaauccugugcau

SEQ ID NO: 664746 - RNA, 19 nt, Homo sapiens
gaaaugacauggcuugauu

SEQ ID NO: 664747 - RNA, 19 nt, Homo sapiens
gaaauuugcuuaucgguau

SEQ ID NO: 664748 - RNA, 19 nt, Homo sapiens
gaacagcugguauaacaua

SEQ ID NO: 664749 - RNA, 19 nt, Homo sapiens
ugacauggcuugauuguuc

SEQ ID NO: 664750 - RNA, 19 nt, Homo sapiens
gaguagagauucacuuuua

SEQ ID NO: 664751 - RNA, 19 nt, Homo sapiens
uagauucucucucacauuu

SEQ ID NO: 664752 - RNA, 19 nt, Homo sapiens
ggaaacuucuugccuugaa

SEQ ID NO: 664753 - RNA, 19 nt, Homo sapiens
uuaaagagaugaacagugu

SEQ ID NO: 664754 - RNA, 19 nt, Homo sapiens
ggacagaggucagaucaag

SEQ ID NO: 664755 - RNA, 19 nt, Homo sapiens
caaaguacaucugcuguug

SEQ ID NO: 664756 - RNA, 19 nt, Homo sapiens
uaacagccaugcaacagaa

SEQ ID NO: 664757 - RNA, 19 nt, Homo sapiens
agaguucaguuucagauua

SEQ ID NO: 664758 - RNA, 19 nt, Homo sapiens
aaucgacacuguuuaguaa

SEQ ID NO: 664759 - RNA, 19 nt, Homo sapiens
gaagggaaguugagaacca

SEQ ID NO: 664760 - RNA, 19 nt, Homo sapiens
gaagugauagccaagauga

SEQ ID NO: 664761 - RNA, 19 nt, Homo sapiens
gaaggagaguguucagcaa

SEQ ID NO: 664762 - RNA, 19 nt, Homo sapiens
gaguucaguuucagauuaa

SEQ ID NO: 664763 - RNA, 19 nt, Homo sapiens
guagaaaucgacacuguuu

SEQ ID NO: 664764 - RNA, 19 nt, Homo sapiens
gcacuguuaucuucguuug

SEQ ID NO: 664765 - RNA, 19 nt, Homo sapiens
uggaacagcugguauaaca

SEQ ID NO: 664766 - RNA, 19 nt, Homo sapiens
gcguucagauuuccaguuu

SEQ ID NO: 664767 - RNA, 19 nt, Homo sapiens
aaccauagguguuauuaga

SEQ ID NO: 664768 - RNA, 19 nt, Homo sapiens
caaguuugcuaguagaaau

SEQ ID NO: 664769 - RNA, 19 nt, Homo sapiens
ggagaugggaguagagauu

SEQ ID NO: 664770 - RNA, 19 nt, Homo sapiens
gguacuaauuugucucuga

SEQ ID NO: 664771 - RNA, 19 nt, Homo sapiens
acacucagcuauaguuaau

SEQ ID NO: 664772 - RNA, 19 nt, Homo sapiens
cgagggcacuguuaucuuc

SEQ ID NO: 664773 - RNA, 19 nt, Homo sapiens
caaagaagaaggagagugu

SEQ ID NO: 664774 - RNA, 19 nt, Homo sapiens
uagccaagaugaaguugaa

SEQ ID NO: 664775 - RNA, 19 nt, Homo sapiens
cuagagauccuuaaagaga

SEQ ID NO: 664776 - RNA, 19 nt, Homo sapiens
gaauguaccaucuuguuuc

SEQ ID NO: 664777 - RNA, 19 nt, Homo sapiens
guacuaauuugucucugau

SEQ ID NO: 664778 - RNA, 19 nt, Homo sapiens
guauagauuucacaacaca

SEQ ID NO: 664779 - RNA, 19 nt, Homo sapiens
gcaauaaugaaagcacuaa

SEQ ID NO: 664780 - RNA, 19 nt, Homo sapiens
gggaguagagauucacuuu

SEQ ID NO: 664781 - RNA, 19 nt, Homo sapiens
ggccagggcguucagauuu

SEQ ID NO: 664782 - RNA, 19 nt, Homo sapiens
aaccugaaaugccaaauau

SEQ ID NO: 664783 - RNA, 19 nt, Homo sapiens
guucugacauguuucuaau

SEQ ID NO: 664784 - RNA, 19 nt, Homo sapiens
ggacuugcuauaaaugauu

SEQ ID NO: 664785 - RNA, 19 nt, Homo sapiens
ucagaaugcuguuuuguuu

SEQ ID NO: 664786 - RNA, 19 nt, Homo sapiens
cugcugaaauuccauaaug

SEQ ID NO: 664787 - RNA, 19 nt, Homo sapiens
guaucagacuccuaauaga

SEQ ID NO: 664788 - RNA, 19 nt, Homo sapiens
guuaagaacaauccaaaga

SEQ ID NO: 664789 - RNA, 19 nt, Homo sapiens
agacuuugguuaagaacaa

SEQ ID NO: 664790 - RNA, 19 nt, Homo sapiens
gaagauuugcgcucucgaa

SEQ ID NO: 664791 - RNA, 19 nt, Homo sapiens
ugacccugcugcccucaua

SEQ ID NO: 664792 - RNA, 19 nt, Homo sapiens
ugaacuugcugcucucaga

SEQ ID NO: 664793 - RNA, 19 nt, Homo sapiens
gaagcacugcagaagauuu

SEQ ID NO: 664794 - RNA, 19 nt, Homo sapiens
gggccaaguuugcuaguag

SEQ ID NO: 664795 - RNA, 19 nt, Homo sapiens
ggucagagcaagaugugaa

SEQ ID NO: 664796 - RNA, 19 nt, Homo sapiens
gcagacagauuuccuuacc

SEQ ID NO: 664797 - RNA, 19 nt, Homo sapiens
gauacacucagcuauaguu

SEQ ID NO: 664798 - RNA, 19 nt, Homo sapiens
gcaacgagggcacuguuau

SEQ ID NO: 664799 - RNA, 19 nt, Homo sapiens
aaagagaugaacaguguaa

SEQ ID NO: 664800 - RNA, 19 nt, Homo sapiens
cuguugaucugauuaaaga

SEQ ID NO: 664801 - RNA, 19 nt, Homo sapiens
aagaagagccucagcugaa

SEQ ID NO: 664802 - RNA, 19 nt, Homo sapiens
gcuugauuguucuguuuaa

SEQ ID NO: 664803 - RNA, 19 nt, Homo sapiens
acauaaaccauagguguua

SEQ ID NO: 664804 - RNA, 19 nt, Homo sapiens
gauggaacagcugguauaa

SEQ ID NO: 664805 - RNA, 19 nt, Homo sapiens
aaaccugaaaugccaaaua

SEQ ID NO: 664806 - RNA, 19 nt, Homo sapiens
uaaagaacgaagagagaaa

SEQ ID NO: 664807 - RNA, 19 nt, Homo sapiens
gagcucagauugccaaaau

SEQ ID NO: 664808 - RNA, 19 nt, Homo sapiens
cuuguuuccuuucaguuua

SEQ ID NO: 664809 - RNA, 19 nt, Homo sapiens
aaugaaagcacuaaguuug

SEQ ID NO: 664810 - RNA, 19 nt, Homo sapiens
ucagagagaguguuguuug

SEQ ID NO: 664811 - RNA, 19 nt, Homo sapiens
gaagaggucagagcaagau

SEQ ID NO: 664812 - RNA, 19 nt, Homo sapiens
aaauguaucagacuccuaa

SEQ ID NO: 664813 - RNA, 19 nt, Homo sapiens
ugcuagagauccuuaaaga

SEQ ID NO: 664814 - RNA, 19 nt, Homo sapiens
ugaaaugccaaauaugcua

SEQ ID NO: 664815 - RNA, 19 nt, Homo sapiens
ccauagguguuauuagaag

SEQ ID NO: 664816 - RNA, 19 nt, Homo sapiens
guaccaucuuguuuccuuu

SEQ ID NO: 664817 - RNA, 19 nt, Homo sapiens
ggcaugaaauauuugagau

SEQ ID NO: 664818 - RNA, 19 nt, Homo sapiens
uaguagaaaucgacacugu

SEQ ID NO: 664819 - RNA, 19 nt, Homo sapiens
gcuuaucgguaucgaagug

SEQ ID NO: 664820 - RNA, 19 nt, Homo sapiens
cagcaagacuaaggacaga

SEQ ID NO: 664821 - RNA, 19 nt, Homo sapiens
aaauuuguacuguggcuua

SEQ ID NO: 664822 - RNA, 19 nt, Homo sapiens
uggcuugauuguucuguuu

SEQ ID NO: 664823 - RNA, 19 nt, Homo sapiens
uuacgcaacauaaaccaua

SEQ ID NO: 664824 - RNA, 19 nt, Homo sapiens
uguguguucugacauguuu

SEQ ID NO: 664825 - RNA, 19 nt, Homo sapiens
guccaagaguucaguuuca

SEQ ID NO: 664826 - RNA, 19 nt, Homo sapiens
ggaaaugacauggcuugau

SEQ ID NO: 664827 - RNA, 19 nt, Homo sapiens
gaaguggagaacugccuuu

SEQ ID NO: 664828 - RNA, 19 nt, Homo sapiens
cagaauguaccaucuuguu

SEQ ID NO: 664829 - RNA, 19 nt, Homo sapiens
gccuugaacagaacuuaua

SEQ ID NO: 664830 - RNA, 19 nt, Homo sapiens
guuguuggcaugaaauauu

SEQ ID NO: 664831 - RNA, 19 nt, Homo sapiens
gcugguauaacauaaguug

SEQ ID NO: 664832 - RNA, 19 nt, Homo sapiens
aaaucgacacuguuuagua

SEQ ID NO: 664833 - RNA, 19 nt, Homo sapiens
guacaucugcuguugaucu

SEQ ID NO: 664834 - RNA, 19 nt, Homo sapiens
aggaagcacugcagaagau

SEQ ID NO: 664835 - RNA, 19 nt, Homo sapiens
gaggaagcacugcagaaga

SEQ ID NO: 664836 - RNA, 19 nt, Homo sapiens
gggaagaaagauguaguuu

SEQ ID NO: 664837 - RNA, 19 nt, Homo sapiens
gaauaggaaccagaugaug

SEQ ID NO: 664838 - RNA, 19 nt, Homo sapiens
acaaugagcugcgaaaaga

SEQ ID NO: 664839 - RNA, 19 nt, Homo sapiens
gaugaacaguguaaaacuu

SEQ ID NO: 664840 - RNA, 19 nt, Homo sapiens
gaagagccucagcugaaga

SEQ ID NO: 664841 - RNA, 19 nt, Homo sapiens
uauuagaaguggagaacug

SEQ ID NO: 664842 - RNA, 19 nt, Homo sapiens
ggaagaaagauguaguuuu

SEQ ID NO: 664843 - RNA, 19 nt, Homo sapiens
ugacagggaagaaagaugu

SEQ ID NO: 664844 - RNA, 19 nt, Homo sapiens
cagcugguauaacauaagu

SEQ ID NO: 664845 - RNA, 19 nt, Homo sapiens
gaaagcacuaaguuugguu

SEQ ID NO: 664846 - RNA, 19 nt, Homo sapiens
ggaaagaccuucucuccau

SEQ ID NO: 664847 - RNA, 19 nt, Homo sapiens
ccacaaaggugauccauac

SEQ ID NO: 664848 - RNA, 19 nt, Homo sapiens
gagcaggccucccacuaga

SEQ ID NO: 664849 - RNA, 19 nt, Homo sapiens
gcagucggcuucucuaugg

SEQ ID NO: 664850 - RNA, 19 nt, Homo sapiens
ugaccaagcuuuccuuucu

SEQ ID NO: 664851 - RNA, 19 nt, Homo sapiens
gaggagaucaggaguaaau

SEQ ID NO: 664852 - RNA, 19 nt, Homo sapiens
agagaugagugccuuguuu

SEQ ID NO: 664853 - RNA, 19 nt, Homo sapiens
uuagaagggugaagaguga

SEQ ID NO: 664854 - RNA, 19 nt, Homo sapiens
ccucacugcugaugacuuu

SEQ ID NO: 664855 - RNA, 19 nt, Homo sapiens
uagaagugcagcucuguua

SEQ ID NO: 664856 - RNA, 19 nt, Homo sapiens
ggugggccauguguacuua

SEQ ID NO: 664857 - RNA, 19 nt, Homo sapiens
uuuaggaucuguacauaga

SEQ ID NO: 664858 - RNA, 19 nt, Homo sapiens
uggaggagaucaggaguaa

SEQ ID NO: 664859 - RNA, 19 nt, Homo sapiens
ggucugggcuggguguuug

SEQ ID NO: 664860 - RNA, 19 nt, Homo sapiens
caucgggcgugacuucauu

SEQ ID NO: 664861 - RNA, 19 nt, Homo sapiens
caugauuccugguagcauu

SEQ ID NO: 664862 - RNA, 19 nt, Homo sapiens
gagcggcgagugacaggua

SEQ ID NO: 664863 - RNA, 19 nt, Homo sapiens
ucagugacaucagcgguaa

SEQ ID NO: 664864 - RNA, 19 nt, Homo sapiens
gagaugagugccuuguuug

SEQ ID NO: 664865 - RNA, 19 nt, Homo sapiens
gcccagcuguccaggaaga

SEQ ID NO: 664866 - RNA, 19 nt, Homo sapiens
ucccggaucugcuucuaaa

SEQ ID NO: 664867 - RNA, 19 nt, Homo sapiens
gguagcauuuggagacugu

SEQ ID NO: 664868 - RNA, 19 nt, Homo sapiens
ccauuagcauccaugauuc

SEQ ID NO: 664869 - RNA, 19 nt, Homo sapiens
ucccauaccugacgaacug

SEQ ID NO: 664870 - RNA, 19 nt, Homo sapiens
gagacugucgcucauguga

SEQ ID NO: 664871 - RNA, 19 nt, Homo sapiens
cagccacugugaccaaaug

SEQ ID NO: 664872 - RNA, 19 nt, Homo sapiens
cccauuagcauccaugauu

SEQ ID NO: 664873 - RNA, 19 nt, Homo sapiens
acagacacguguaccuaga

SEQ ID NO: 664874 - RNA, 19 nt, Homo sapiens
uaggaucuguacauagaga

SEQ ID NO: 664875 - RNA, 19 nt, Homo sapiens
gaccaagcuuuccuuucug

SEQ ID NO: 664876 - RNA, 19 nt, Homo sapiens
uacaugggcuccuucucuu

SEQ ID NO: 664877 - RNA, 19 nt, Homo sapiens
gggcagggcaagaccagaa

SEQ ID NO: 664878 - RNA, 19 nt, Homo sapiens
cagcagggaccgagugaug

SEQ ID NO: 664879 - RNA, 19 nt, Homo sapiens
ggccauguguacuuagauc

SEQ ID NO: 664880 - RNA, 19 nt, Homo sapiens
cacgcugccuccguaguua

SEQ ID NO: 664881 - RNA, 19 nt, Homo sapiens
cggaucugcuucuaaaugg

SEQ ID NO: 664882 - RNA, 19 nt, Homo sapiens
ccgggcagcucaagaagca

SEQ ID NO: 664883 - RNA, 19 nt, Homo sapiens
ccacgcugccuccguaguu

SEQ ID NO: 664884 - RNA, 19 nt, Homo sapiens
gaagugcagcucuguuagg

SEQ ID NO: 664885 - RNA, 19 nt, Homo sapiens
caccagugcccaccucuga

SEQ ID NO: 664886 - RNA, 19 nt, Homo sapiens
ccacugugcagccuggaaa

SEQ ID NO: 664887 - RNA, 19 nt, Homo sapiens
gaucuugaaucaggaagcu

SEQ ID NO: 664888 - RNA, 19 nt, Homo sapiens
gagagaugagugccuuguu

SEQ ID NO: 664889 - RNA, 19 nt, Homo sapiens
agucugaugugggcaggua

SEQ ID NO: 664890 - RNA, 19 nt, Homo sapiens
gcucaugugacguggauca

SEQ ID NO: 664891 - RNA, 19 nt, Homo sapiens
ggccucugcuccucuaucu

SEQ ID NO: 664892 - RNA, 19 nt, Homo sapiens
ugaccaagagcaaauccaa

SEQ ID NO: 664893 - RNA, 19 nt, Homo sapiens
cuacaugggcuccuucucu

SEQ ID NO: 664894 - RNA, 19 nt, Homo sapiens
guaccuagaagggauggaa

SEQ ID NO: 664895 - RNA, 19 nt, Homo sapiens
ggaucuguacauagagaaa

SEQ ID NO: 664896 - RNA, 19 nt, Homo sapiens
cgaccucacugcugaugac

SEQ ID NO: 664897 - RNA, 19 nt, Homo sapiens
gugaccaaaugcguagauu

SEQ ID NO: 664898 - RNA, 19 nt, Homo sapiens
caugaugccaggcuacaga

SEQ ID NO: 664899 - RNA, 19 nt, Homo sapiens
gccacaaaggugauccaua

SEQ ID NO: 664900 - RNA, 19 nt, Homo sapiens
gacgggacacccugacaga

SEQ ID NO: 664901 - RNA, 19 nt, Homo sapiens
ccagaccugccaccuguga

SEQ ID NO: 664902 - RNA, 19 nt, Homo sapiens
ggagagaugagugccuugu

SEQ ID NO: 664903 - RNA, 19 nt, Homo sapiens
cauguguacuuagaucugu

SEQ ID NO: 664904 - RNA, 19 nt, Homo sapiens
gcauccaugauuccuggua

SEQ ID NO: 664905 - RNA, 19 nt, Homo sapiens
ccucugcuccucuaucuca

SEQ ID NO: 664906 - RNA, 19 nt, Homo sapiens
caucagcgguaaggugagu

SEQ ID NO: 664907 - RNA, 19 nt, Homo sapiens
ccggaucugcuucuaaaug

SEQ ID NO: 664908 - RNA, 19 nt, Homo sapiens
uggagacugucgcucaugu

SEQ ID NO: 664909 - RNA, 19 nt, Homo sapiens
cggcuccagucuccuaugu

SEQ ID NO: 664910 - RNA, 19 nt, Homo sapiens
cauggcaggacuugucuga

SEQ ID NO: 664911 - RNA, 19 nt, Homo sapiens
caccugcccgugauuagaa

SEQ ID NO: 664912 - RNA, 19 nt, Homo sapiens
gcccagcuccgucaggaau

SEQ ID NO: 664913 - RNA, 19 nt, Homo sapiens
agaaccagcugcucuugcu

SEQ ID NO: 664914 - RNA, 19 nt, Homo sapiens
ggagucugagcccaucuug

SEQ ID NO: 664915 - RNA, 19 nt, Homo sapiens
ugucugcuguggaugacuu

SEQ ID NO: 664916 - RNA, 19 nt, Homo sapiens
gaucuguacauagagaaau

SEQ ID NO: 664917 - RNA, 19 nt, Homo sapiens
gugauuagaagggugaaga

SEQ ID NO: 664918 - RNA, 19 nt, Homo sapiens
ggccaccugcccgugauua

SEQ ID NO: 664919 - RNA, 19 nt, Homo sapiens
cuacugggaagucugaugu

SEQ ID NO: 664920 - RNA, 19 nt, Homo sapiens
ggucaggcgagggcaguuu

SEQ ID NO: 664921 - RNA, 19 nt, Homo sapiens
gaucucagggcuggcuuug

SEQ ID NO: 664922 - RNA, 19 nt, Homo sapiens
gggaggagacccugguuuu

SEQ ID NO: 664923 - RNA, 19 nt, Homo sapiens
cguguuguuugcucaggaa

SEQ ID NO: 664924 - RNA, 19 nt, Homo sapiens
aagugcagcucuguuagga

SEQ ID NO: 664925 - RNA, 19 nt, Homo sapiens
gugcccaccucugaucuca

SEQ ID NO: 664926 - RNA, 19 nt, Homo sapiens
agaggacgcuggccuucag

SEQ ID NO: 664927 - RNA, 19 nt, Homo sapiens
ggagggaaagaccuucucu

SEQ ID NO: 664928 - RNA, 19 nt, Homo sapiens
cagcuguccaggaagauug

SEQ ID NO: 664929 - RNA, 19 nt, Homo sapiens
agacacguguaccuagaag

SEQ ID NO: 664930 - RNA, 19 nt, Homo sapiens
caagugcuggccaucugaa

SEQ ID NO: 664931 - RNA, 19 nt, Homo sapiens
ggagaaaucuuuacauugu

SEQ ID NO: 664932 - RNA, 19 nt, Homo sapiens
gaggauagauuuauacuug

SEQ ID NO: 664933 - RNA, 19 nt, Homo sapiens
uaucagaggugccuucuua

SEQ ID NO: 664934 - RNA, 19 nt, Homo sapiens
gaaacucucugcacaaaga

SEQ ID NO: 664935 - RNA, 19 nt, Homo sapiens
gccaagacauugcuauuua

SEQ ID NO: 664936 - RNA, 19 nt, Homo sapiens
gcacaacauugcaagauaa

SEQ ID NO: 664937 - RNA, 19 nt, Homo sapiens
gaugagagcugcagagaug

SEQ ID NO: 664938 - RNA, 19 nt, Homo sapiens
ggaaauggcuuuagcuauc

SEQ ID NO: 664939 - RNA, 19 nt, Homo sapiens
aaacagagcucguggaugu

SEQ ID NO: 664940 - RNA, 19 nt, Homo sapiens
gcagagauguguuacagaa

SEQ ID NO: 664941 - RNA, 19 nt, Homo sapiens
gagagagccuugucuauug

SEQ ID NO: 664942 - RNA, 19 nt, Homo sapiens
gcaguauuguuguagauua

SEQ ID NO: 664943 - RNA, 19 nt, Homo sapiens
guacagaggaccagaauaa

SEQ ID NO: 664944 - RNA, 19 nt, Homo sapiens
caggaaaucuuacugauga

SEQ ID NO: 664945 - RNA, 19 nt, Homo sapiens
ccaaaggacuucaauuguu

SEQ ID NO: 664946 - RNA, 19 nt, Homo sapiens
gaaagaaggcauuacugua

SEQ ID NO: 664947 - RNA, 19 nt, Homo sapiens
ugaaugaucuuaaggaguu

SEQ ID NO: 664948 - RNA, 19 nt, Homo sapiens
cagauaagauuccuaguga

SEQ ID NO: 664949 - RNA, 19 nt, Homo sapiens
gaauauagaggugguaaua

SEQ ID NO: 664950 - RNA, 19 nt, Homo sapiens
caaaggacuucaauuguug

SEQ ID NO: 664951 - RNA, 19 nt, Homo sapiens
gaagaaggccugugaagga

SEQ ID NO: 664952 - RNA, 19 nt, Homo sapiens
cgacaguaauaaucacuua

SEQ ID NO: 664953 - RNA, 19 nt, Homo sapiens
ggaaugcaauuuucuguua

SEQ ID NO: 664954 - RNA, 19 nt, Homo sapiens
gaacaacacucagccaaag

SEQ ID NO: 664955 - RNA, 19 nt, Homo sapiens
cagaaagagucuacaauug

SEQ ID NO: 664956 - RNA, 19 nt, Homo sapiens
uagaagacaucauagguuu

SEQ ID NO: 664957 - RNA, 19 nt, Homo sapiens
ugaugaagcugcaaagauu

SEQ ID NO: 664958 - RNA, 19 nt, Homo sapiens
agacaaagcccauaucuug

SEQ ID NO: 664959 - RNA, 19 nt, Homo sapiens
aagcagcucuaguugauua

SEQ ID NO: 664960 - RNA, 19 nt, Homo sapiens
aaacaucuauccuacugua

SEQ ID NO: 664961 - RNA, 19 nt, Homo sapiens
caagauacuuacaauguug

SEQ ID NO: 664962 - RNA, 19 nt, Homo sapiens
gcucagcacuguuucauca

SEQ ID NO: 664963 - RNA, 19 nt, Homo sapiens
gaacauggcacaaguugau

SEQ ID NO: 664964 - RNA, 19 nt, Homo sapiens
caacaugaaugaucuuaag

SEQ ID NO: 664965 - RNA, 19 nt, Homo sapiens
ugagaaagauaccgaaguu

SEQ ID NO: 664966 - RNA, 19 nt, Homo sapiens
aaaggaaucuagagaaguu

SEQ ID NO: 664967 - RNA, 19 nt, Homo sapiens
ugagacaaguucaguguaa

SEQ ID NO: 664968 - RNA, 19 nt, Homo sapiens
ccaagacauugcuauuuaa

SEQ ID NO: 664969 - RNA, 19 nt, Homo sapiens
gaaacaggcagcaacauga

SEQ ID NO: 664970 - RNA, 19 nt, Homo sapiens
ggaucuauauuaccaagaa

SEQ ID NO: 664971 - RNA, 19 nt, Homo sapiens
ggugugaccuuggaauuaa

SEQ ID NO: 664972 - RNA, 19 nt, Homo sapiens
caaaggcucuuacccacuu

SEQ ID NO: 664973 - RNA, 19 nt, Homo sapiens
gaagugcuuuguuugcauu

SEQ ID NO: 664974 - RNA, 19 nt, Homo sapiens
cauuagaagugcuuuguuu

SEQ ID NO: 664975 - RNA, 19 nt, Homo sapiens
uaaugaaacucagcaauug

SEQ ID NO: 664976 - RNA, 19 nt, Homo sapiens
cagaagaccaagauacuua

SEQ ID NO: 664977 - RNA, 19 nt, Homo sapiens
gggaagcucucaagucugu

SEQ ID NO: 664978 - RNA, 19 nt, Homo sapiens
cagcaaagccuaugagaga

SEQ ID NO: 664979 - RNA, 19 nt, Homo sapiens
ggcgaggacuauacuauuu

SEQ ID NO: 664980 - RNA, 19 nt, Homo sapiens
cugcaagacuggauacaua

SEQ ID NO: 664981 - RNA, 19 nt, Homo sapiens
gaauaucauuaccaacuug

SEQ ID NO: 664982 - RNA, 19 nt, Homo sapiens
gaagaucaccaaguacuuu

SEQ ID NO: 664983 - RNA, 19 nt, Homo sapiens
ucacauaaaugcuaaggau

SEQ ID NO: 664984 - RNA, 19 nt, Homo sapiens
aaagaugacuaugagcuua

SEQ ID NO: 664985 - RNA, 19 nt, Homo sapiens
aagaauaucugaagcugaa

SEQ ID NO: 664986 - RNA, 19 nt, Homo sapiens
uguuauaccucacaaauga

SEQ ID NO: 664987 - RNA, 19 nt, Homo sapiens
ggacucaaaucauggaaag

SEQ ID NO: 664988 - RNA, 19 nt, Homo sapiens
ucaaaucaauccagucaga

SEQ ID NO: 664989 - RNA, 19 nt, Homo sapiens
gcacguugguaccuacuga

SEQ ID NO: 664990 - RNA, 19 nt, Homo sapiens
ccaagauacuuacaauguu

SEQ ID NO: 664991 - RNA, 19 nt, Homo sapiens
guuaggagaagcauacuua

SEQ ID NO: 664992 - RNA, 19 nt, Homo sapiens
gcucguggauguuauagga

SEQ ID NO: 664993 - RNA, 19 nt, Homo sapiens
ggaaagaaggcauuacugu

SEQ ID NO: 664994 - RNA, 19 nt, Homo sapiens
caggaaauguggcucauau

SEQ ID NO: 664995 - RNA, 19 nt, Homo sapiens
caacuuggauuaacauacu

SEQ ID NO: 664996 - RNA, 19 nt, Homo sapiens
gcacuguuaucugcuguuu

SEQ ID NO: 664997 - RNA, 19 nt, Homo sapiens
ggaaauguggcucauauuc

SEQ ID NO: 664998 - RNA, 19 nt, Homo sapiens
cugcaaagauuauggaaga

SEQ ID NO: 664999 - RNA, 19 nt, Homo sapiens
gggcagcaguauuguugua

SEQ ID NO: 665000 - RNA, 19 nt, Homo sapiens
aaacgaacaucuacaacug

SEQ ID NO: 665001 - RNA, 19 nt, Homo sapiens
acagugguauuggaaauua

SEQ ID NO: 665002 - RNA, 19 nt, Homo sapiens
guguggagcuugaagauau

SEQ ID NO: 665003 - RNA, 19 nt, Homo sapiens
ugaauuagaugacacugau

SEQ ID NO: 665004 - RNA, 19 nt, Homo sapiens
gggaagcaguucagcagaa

SEQ ID NO: 665005 - RNA, 19 nt, Homo sapiens
gaaggagcauuagguuaug

SEQ ID NO: 665006 - RNA, 19 nt, Homo sapiens
ggacuauacuauuugaaag

SEQ ID NO: 665007 - RNA, 19 nt, Homo sapiens
acagaaggguuaaaggaaa

SEQ ID NO: 665008 - RNA, 19 nt, Homo sapiens
guaaaagucugcaggguuu

SEQ ID NO: 665009 - RNA, 19 nt, Homo sapiens
acacuuauaugccaaagau

SEQ ID NO: 665010 - RNA, 19 nt, Homo sapiens
aagcagcacuuaaugaguu

SEQ ID NO: 665011 - RNA, 19 nt, Homo sapiens
gcauuggcuuuauucauga

SEQ ID NO: 665012 - RNA, 19 nt, Homo sapiens
cuacagaacuaaauaugca

SEQ ID NO: 665013 - RNA, 19 nt, Homo sapiens
guaaggaacaaucaaauuc

SEQ ID NO: 665014 - RNA, 19 nt, Homo sapiens
ggcagaagcccaagucaaa

SEQ ID NO: 665015 - RNA, 19 nt, Homo sapiens
gaaggccugugaaggaaug

SEQ ID NO: 665016 - RNA, 19 nt, Homo sapiens
uagcaaacuuguaugagaa

SEQ ID NO: 665017 - RNA, 19 nt, Homo sapiens
guaagacaguguuaaagca

SEQ ID NO: 665018 - RNA, 19 nt, Homo sapiens
gagcugcagagauguguua

SEQ ID NO: 665019 - RNA, 19 nt, Homo sapiens
gcacuaaagaccauucaga

SEQ ID NO: 665020 - RNA, 19 nt, Homo sapiens
gcaggaugcuacacuguca

SEQ ID NO: 665021 - RNA, 19 nt, Homo sapiens
gcagugagacucgacagua

SEQ ID NO: 665022 - RNA, 19 nt, Homo sapiens
gcaaauccuaggcaaauau

SEQ ID NO: 665023 - RNA, 19 nt, Homo sapiens
gaagagacaagaaaagaua

SEQ ID NO: 665024 - RNA, 19 nt, Homo sapiens
caaauuuccucaugagucu

SEQ ID NO: 665025 - RNA, 19 nt, Homo sapiens
gaucaccaaguacuuuaua

SEQ ID NO: 665026 - RNA, 19 nt, Homo sapiens
ucagccagccguuaucuua

SEQ ID NO: 665027 - RNA, 19 nt, Homo sapiens
caucauagguuuugcauug

SEQ ID NO: 665028 - RNA, 19 nt, Homo sapiens
gaagugaagacugcucuaa

SEQ ID NO: 665029 - RNA, 19 nt, Homo sapiens
gaaagaaggaaaacaagua

SEQ ID NO: 665030 - RNA, 19 nt, Homo sapiens
aagauuaugugccugcuuu

SEQ ID NO: 665031 - RNA, 19 nt, Homo sapiens
gaacacacauuucugauuu

SEQ ID NO: 665032 - RNA, 19 nt, Homo sapiens
ggaagaugcucacuacuuu

SEQ ID NO: 665033 - RNA, 19 nt, Homo sapiens
gagcauggcuugagaauca

SEQ ID NO: 665034 - RNA, 19 nt, Homo sapiens
gcacaguuauguuccaaua

SEQ ID NO: 665035 - RNA, 19 nt, Homo sapiens
uaaaugagauggcauguga

SEQ ID NO: 665036 - RNA, 19 nt, Homo sapiens
gaguggagcuuucugauuu

SEQ ID NO: 665037 - RNA, 19 nt, Homo sapiens
caacuuaacucucagauag

SEQ ID NO: 665038 - RNA, 19 nt, Homo sapiens
gaaguucacuguuagaaau

SEQ ID NO: 665039 - RNA, 19 nt, Homo sapiens
caacaucauugguuucuaa

SEQ ID NO: 665040 - RNA, 19 nt, Homo sapiens
gaauaaggcuucaccauac

SEQ ID NO: 665041 - RNA, 19 nt, Homo sapiens
ucaaagggaucugcauuua

SEQ ID NO: 665042 - RNA, 19 nt, Homo sapiens
gaaagggcuauuagaauua

SEQ ID NO: 665043 - RNA, 19 nt, Homo sapiens
gaagcaguguugaauguaa

SEQ ID NO: 665044 - RNA, 19 nt, Homo sapiens
gcagagaaguugcuguuau

SEQ ID NO: 665045 - RNA, 19 nt, Homo sapiens
gcacuucauuuaccaauau

SEQ ID NO: 665046 - RNA, 19 nt, Homo sapiens
gaagcacccuguaaccuuu

SEQ ID NO: 665047 - RNA, 19 nt, Homo sapiens
cugaagaacuugaagauuu

SEQ ID NO: 665048 - RNA, 19 nt, Homo sapiens
agaaagggcuauuagaauu

SEQ ID NO: 665049 - RNA, 19 nt, Homo sapiens
gaacaaacccaguaugcaa

SEQ ID NO: 665050 - RNA, 19 nt, Homo sapiens
guaaagcgcuauguaaaug

SEQ ID NO: 665051 - RNA, 19 nt, Homo sapiens
gcagaugacuugcuuacug

SEQ ID NO: 665052 - RNA, 19 nt, Homo sapiens
gaauuaagaugaguccauu

SEQ ID NO: 665053 - RNA, 19 nt, Homo sapiens
gcaaugugaugucaguaaa

SEQ ID NO: 665054 - RNA, 19 nt, Homo sapiens
aaacaaaugagcacaguua

SEQ ID NO: 665055 - RNA, 19 nt, Homo sapiens
gagauugucugaaguuuua

SEQ ID NO: 665056 - RNA, 19 nt, Homo sapiens
agaaguugcuguuauguuu

SEQ ID NO: 665057 - RNA, 19 nt, Homo sapiens
ggagaaauccucuuugugu

SEQ ID NO: 665058 - RNA, 19 nt, Homo sapiens
ugacagaacaaucaucuua

SEQ ID NO: 665059 - RNA, 19 nt, Homo sapiens
caaauucuguuuccaacuu

SEQ ID NO: 665060 - RNA, 19 nt, Homo sapiens
ucuaaaagcuccuaacuua

SEQ ID NO: 665061 - RNA, 19 nt, Homo sapiens
gaaauaggcuuuguuagcu

SEQ ID NO: 665062 - RNA, 19 nt, Homo sapiens
gauagcaacacuuaagaua

SEQ ID NO: 665063 - RNA, 19 nt, Homo sapiens
gaaauugagcagcgacaua

SEQ ID NO: 665064 - RNA, 19 nt, Homo sapiens
ggccagagaguaaauauuu

SEQ ID NO: 665065 - RNA, 19 nt, Homo sapiens
ccaguucaaugaugaguuu

SEQ ID NO: 665066 - RNA, 19 nt, Homo sapiens
cuacagcaaucugauauuu

SEQ ID NO: 665067 - RNA, 19 nt, Homo sapiens
gaaaucucaucuuaggaaa

SEQ ID NO: 665068 - RNA, 19 nt, Homo sapiens
caaauccacugccaauuca

SEQ ID NO: 665069 - RNA, 19 nt, Homo sapiens
gaccauagggagauaauuu

SEQ ID NO: 665070 - RNA, 19 nt, Homo sapiens
gauacacaguucauuauuc

SEQ ID NO: 665071 - RNA, 19 nt, Homo sapiens
caaagagcauggcuugaga

SEQ ID NO: 665072 - RNA, 19 nt, Homo sapiens
gcgaugcucuucuuggaaa

SEQ ID NO: 665073 - RNA, 19 nt, Homo sapiens
guuaagacaucacugaaau

SEQ ID NO: 665074 - RNA, 19 nt, Homo sapiens
cuaaggugcuuuauaaugu

SEQ ID NO: 665075 - RNA, 19 nt, Homo sapiens
guaaagcuguaaacugaga

SEQ ID NO: 665076 - RNA, 19 nt, Homo sapiens
gaacuuauggcaggucuaa

SEQ ID NO: 665077 - RNA, 19 nt, Homo sapiens
agaaagggcuauugcaaga

SEQ ID NO: 665078 - RNA, 19 nt, Homo sapiens
gcuccuaacuuauauccaa

SEQ ID NO: 665079 - RNA, 19 nt, Homo sapiens
uuagguagauugccuuaaa

SEQ ID NO: 665080 - RNA, 19 nt, Homo sapiens
gaaaugguagcuauucuau

SEQ ID NO: 665081 - RNA, 19 nt, Homo sapiens
gaggcuaguuucuuauuau

SEQ ID NO: 665082 - RNA, 19 nt, Homo sapiens
gaucaggugcgcuuuguaa

SEQ ID NO: 665083 - RNA, 19 nt, Homo sapiens
acuaauaacugauggcauu

SEQ ID NO: 665084 - RNA, 19 nt, Homo sapiens
gaugcugucuaucucauuu

SEQ ID NO: 665085 - RNA, 19 nt, Homo sapiens
uuagaacgcauuacuguua

SEQ ID NO: 665086 - RNA, 19 nt, Homo sapiens
gaguuggccucuucauaaa

SEQ ID NO: 665087 - RNA, 19 nt, Homo sapiens
uauaugcugugcuggaaua

SEQ ID NO: 665088 - RNA, 19 nt, Homo sapiens
uaacauuuauggcacaguu

SEQ ID NO: 665089 - RNA, 19 nt, Homo sapiens
gaaagcaugcaacaucauu

SEQ ID NO: 665090 - RNA, 19 nt, Homo sapiens
caagaaagcaugcaacauc

SEQ ID NO: 665091 - RNA, 19 nt, Homo sapiens
gagagauaaucacuccuuu

SEQ ID NO: 665092 - RNA, 19 nt, Homo sapiens
ggagcuuucugauuucuug

SEQ ID NO: 665093 - RNA, 19 nt, Homo sapiens
ccacugagacaauaaugua

SEQ ID NO: 665094 - RNA, 19 nt, Homo sapiens
guauaaggugugacuauua

SEQ ID NO: 665095 - RNA, 19 nt, Homo sapiens
gaauaaauaccauguccuu

SEQ ID NO: 665096 - RNA, 19 nt, Homo sapiens
gagaaagggcuauuagaau

SEQ ID NO: 665097 - RNA, 19 nt, Homo sapiens
caaaugagcacaguuaugu

SEQ ID NO: 665098 - RNA, 19 nt, Homo sapiens
gagggaacacuucuuauga

SEQ ID NO: 665099 - RNA, 19 nt, Homo sapiens
guaguuggauuugcccaua

SEQ ID NO: 665100 - RNA, 19 nt, Homo sapiens
ccauucaguugauucauuu

SEQ ID NO: 665101 - RNA, 19 nt, Homo sapiens
ugaggugcauuaacucuuu

SEQ ID NO: 665102 - RNA, 19 nt, Homo sapiens
caucagaccuacuguucuu

SEQ ID NO: 665103 - RNA, 19 nt, Homo sapiens
gcuaaacguuggugaaagu

SEQ ID NO: 665104 - RNA, 19 nt, Homo sapiens
uugagaggcuaguuucuua

SEQ ID NO: 665105 - RNA, 19 nt, Homo sapiens
gcuguaugaugccaacuaa

SEQ ID NO: 665106 - RNA, 19 nt, Homo sapiens
ugaguuggccucuucauaa

SEQ ID NO: 665107 - RNA, 19 nt, Homo sapiens
gaacuucaguaagcuuuca

SEQ ID NO: 665108 - RNA, 19 nt, Homo sapiens
ucacugaggguuuggguua

SEQ ID NO: 665109 - RNA, 19 nt, Homo sapiens
cuucauugcugguaauaaa

SEQ ID NO: 665110 - RNA, 19 nt, Homo sapiens
cagagaaguugcuguuaug

SEQ ID NO: 665111 - RNA, 19 nt, Homo sapiens
ugacuugcuuacuguauuu

SEQ ID NO: 665112 - RNA, 19 nt, Homo sapiens
uuacccagcuuaaucugua

SEQ ID NO: 665113 - RNA, 19 nt, Homo sapiens
ccacagauucauaaacuuu

SEQ ID NO: 665114 - RNA, 19 nt, Homo sapiens
uuagguaacuagagcagua

SEQ ID NO: 665115 - RNA, 19 nt, Homo sapiens
uaaauauccucucaguguu

SEQ ID NO: 665116 - RNA, 19 nt, Homo sapiens
guucuaaguuucaggcauu

SEQ ID NO: 665117 - RNA, 19 nt, Homo sapiens
gcaaucugauauuuggaaa

SEQ ID NO: 665118 - RNA, 19 nt, Homo sapiens
gaccuuugaugaaugugua

SEQ ID NO: 665119 - RNA, 19 nt, Homo sapiens
uuaccaauaucgccuauga

SEQ ID NO: 665120 - RNA, 19 nt, Homo sapiens
guuaaugccuauaaucugu

SEQ ID NO: 665121 - RNA, 19 nt, Homo sapiens
uagaaccacugagacaaua

SEQ ID NO: 665122 - RNA, 19 nt, Homo sapiens
uuguaaagcuguaaacuga

SEQ ID NO: 665123 - RNA, 19 nt, Homo sapiens
ggaacacacauuucugauu

SEQ ID NO: 665124 - RNA, 19 nt, Homo sapiens
caacuccucuuuucuaauu

SEQ ID NO: 665125 - RNA, 19 nt, Homo sapiens
gggaacacuucuuaugaga

SEQ ID NO: 665126 - RNA, 19 nt, Homo sapiens
gaccuacuguucuuguauu

SEQ ID NO: 665127 - RNA, 19 nt, Homo sapiens
gcuggaauauuguuaccaa

SEQ ID NO: 665128 - RNA, 19 nt, Homo sapiens
uaagagaagcacccuguaa

SEQ ID NO: 665129 - RNA, 19 nt, Homo sapiens
gguuugacauuacaugcua

SEQ ID NO: 665130 - RNA, 19 nt, Homo sapiens
gauaauaauaccugcugua

SEQ ID NO: 665131 - RNA, 19 nt, Homo sapiens
gagcuggacucaucugaua

SEQ ID NO: 665132 - RNA, 19 nt, Homo sapiens
gaacacagcacuauaguau

SEQ ID NO: 665133 - RNA, 19 nt, Homo sapiens
gaagaaagccuauuaucug

SEQ ID NO: 665134 - RNA, 19 nt, Homo sapiens
cgacaucacuucugacuau

SEQ ID NO: 665135 - RNA, 19 nt, Homo sapiens
caacuacagugucaauaaa

SEQ ID NO: 665136 - RNA, 19 nt, Homo sapiens
gcaagaaggaguucaguuu

SEQ ID NO: 665137 - RNA, 19 nt, Homo sapiens
gcaagaggcuuugagaaga

SEQ ID NO: 665138 - RNA, 19 nt, Homo sapiens
gggcagacuucaagacuuu

SEQ ID NO: 665139 - RNA, 19 nt, Homo sapiens
gccaugaacucuuugguuu

SEQ ID NO: 665140 - RNA, 19 nt, Homo sapiens
ucagagugcuccucauuaa

SEQ ID NO: 665141 - RNA, 19 nt, Homo sapiens
gaaauaccauggcaacaag

SEQ ID NO: 665142 - RNA, 19 nt, Homo sapiens
guacagagguaucuacaca

SEQ ID NO: 665143 - RNA, 19 nt, Homo sapiens
acacagcacuauaguauug

SEQ ID NO: 665144 - RNA, 19 nt, Homo sapiens
ggaaauccuuuguucugaa

SEQ ID NO: 665145 - RNA, 19 nt, Homo sapiens
caacaagcuuaaaggagua

SEQ ID NO: 665146 - RNA, 19 nt, Homo sapiens
gauaaaggauguuguuguc

SEQ ID NO: 665147 - RNA, 19 nt, Homo sapiens
gaagauaaaggauguuguu

SEQ ID NO: 665148 - RNA, 19 nt, Homo sapiens
uaacuggccucucuccaaa

SEQ ID NO: 665149 - RNA, 19 nt, Homo sapiens
ugaagagccuuggcaauaa

SEQ ID NO: 665150 - RNA, 19 nt, Homo sapiens
ucuagaagcuguauggaaa

SEQ ID NO: 665151 - RNA, 19 nt, Homo sapiens
gaucaggacuucuaugcau

SEQ ID NO: 665152 - RNA, 19 nt, Homo sapiens
ggaacuaccugagccagaa

SEQ ID NO: 665153 - RNA, 19 nt, Homo sapiens
gaaauccuuuguucugaau

SEQ ID NO: 665154 - RNA, 19 nt, Homo sapiens
gagagggucuaugaacuuu

SEQ ID NO: 665155 - RNA, 19 nt, Homo sapiens
cggaauaacuuagccauga

SEQ ID NO: 665156 - RNA, 19 nt, Homo sapiens
agacuaaacucuuguacug

SEQ ID NO: 665157 - RNA, 19 nt, Homo sapiens
ggaaggagaugugguuucu

SEQ ID NO: 665158 - RNA, 19 nt, Homo sapiens
ggacaucuguucuuuagcu

SEQ ID NO: 665159 - RNA, 19 nt, Homo sapiens
uaaaggauguuguugucaa

SEQ ID NO: 665160 - RNA, 19 nt, Homo sapiens
ggaaguugcuccgauggaa

SEQ ID NO: 665161 - RNA, 19 nt, Homo sapiens
gggagaagauaaaggaugu

SEQ ID NO: 665162 - RNA, 19 nt, Homo sapiens
gaccggaaauccuuuguuc

SEQ ID NO: 665163 - RNA, 19 nt, Homo sapiens
caacaugccgaacccauuu

SEQ ID NO: 665164 - RNA, 19 nt, Homo sapiens
ggagaaacccuugaacuuc

SEQ ID NO: 665165 - RNA, 19 nt, Homo sapiens
aagaaagccuauuaucuga

SEQ ID NO: 665166 - RNA, 19 nt, Homo sapiens
gaagagccuuggcaauaag

SEQ ID NO: 665167 - RNA, 19 nt, Homo sapiens
ccagugggcucaaucacaa

SEQ ID NO: 665168 - RNA, 19 nt, Homo sapiens
caaucaaaccucagacuaa

SEQ ID NO: 665169 - RNA, 19 nt, Homo sapiens
ugaagugguugcauuauag

SEQ ID NO: 665170 - RNA, 19 nt, Homo sapiens
ggaaaccuccugcgguaaa

SEQ ID NO: 665171 - RNA, 19 nt, Homo sapiens
aaucaaaccucagacuaaa

SEQ ID NO: 665172 - RNA, 19 nt, Homo sapiens
caaagcuccugugagguua

SEQ ID NO: 665173 - RNA, 19 nt, Homo sapiens
guaauugacuccucagcau

SEQ ID NO: 665174 - RNA, 19 nt, Homo sapiens
acagagguaucuacacaaa

SEQ ID NO: 665175 - RNA, 19 nt, Homo sapiens
gauauuaguucagcuacug

SEQ ID NO: 665176 - RNA, 19 nt, Homo sapiens
gccacgauauuucaacauu

SEQ ID NO: 665177 - RNA, 19 nt, Homo sapiens
uagcugccaugaacucuuu

SEQ ID NO: 665178 - RNA, 19 nt, Homo sapiens
ccaacuacagugucaauaa

SEQ ID NO: 665179 - RNA, 19 nt, Homo sapiens
cacaugaagucuccuaguu

SEQ ID NO: 665180 - RNA, 19 nt, Homo sapiens
gacugaagauacagaagaa

SEQ ID NO: 665181 - RNA, 19 nt, Homo sapiens
gcccauaacuggccucucu

SEQ ID NO: 665182 - RNA, 19 nt, Homo sapiens
cucaaaggaugacgugaua

SEQ ID NO: 665183 - RNA, 19 nt, Homo sapiens
gcacagaagaugaagaaag

SEQ ID NO: 665184 - RNA, 19 nt, Homo sapiens
gaagcuguauggaaauucu

SEQ ID NO: 665185 - RNA, 19 nt, Homo sapiens
caagaggcuuugagaagau

SEQ ID NO: 665186 - RNA, 19 nt, Homo sapiens
gcaggaacacagcacuaua

SEQ ID NO: 665187 - RNA, 19 nt, Homo sapiens
gaacccauuuccugucauc

SEQ ID NO: 665188 - RNA, 19 nt, Homo sapiens
caugaagucuccuaguuuc

SEQ ID NO: 665189 - RNA, 19 nt, Homo sapiens
gcgaaucgguggccaugau

SEQ ID NO: 665190 - RNA, 19 nt, Homo sapiens
uauaagcccaugcugaaua

SEQ ID NO: 665191 - RNA, 19 nt, Homo sapiens
gagggucuaugaacuuugu

SEQ ID NO: 665192 - RNA, 19 nt, Homo sapiens
guggacaucuguucuuuag

SEQ ID NO: 665193 - RNA, 19 nt, Homo sapiens
gcuggcaccucauaucuca

SEQ ID NO: 665194 - RNA, 19 nt, Homo sapiens
gagguuagccuacuacucu

SEQ ID NO: 665195 - RNA, 19 nt, Homo sapiens
ucaugcaccugaccaacua

SEQ ID NO: 665196 - RNA, 19 nt, Homo sapiens
guauggaaauucugaccaa

SEQ ID NO: 665197 - RNA, 19 nt, Homo sapiens
gaagaagaacuaguagaug

SEQ ID NO: 665198 - RNA, 19 nt, Homo sapiens
gguauaaccggaauaacuu

SEQ ID NO: 665199 - RNA, 19 nt, Homo sapiens
ggaacacagcacuauagua

SEQ ID NO: 665200 - RNA, 19 nt, Homo sapiens
ggaugggcuuccaaucaaa

SEQ ID NO: 665201 - RNA, 19 nt, Homo sapiens
gcaugucacugcacagaag

SEQ ID NO: 665202 - RNA, 19 nt, Homo sapiens
ggauuuaccucuuuucaga

SEQ ID NO: 665203 - RNA, 19 nt, Homo sapiens
caucagaagcuaaaccauu

SEQ ID NO: 665204 - RNA, 19 nt, Homo sapiens
acuaguagaugguuuggaa

SEQ ID NO: 665205 - RNA, 19 nt, Homo sapiens
uugaagugguugcauuaua

SEQ ID NO: 665206 - RNA, 19 nt, Homo sapiens
ggaccacgcccaaauccaa

SEQ ID NO: 665207 - RNA, 19 nt, Homo sapiens
ggcauuggcauccagguua

SEQ ID NO: 665208 - RNA, 19 nt, Homo sapiens
gaaacccaguuccucaaag

SEQ ID NO: 665209 - RNA, 19 nt, Homo sapiens
ugagauggaagaugaguuu

SEQ ID NO: 665210 - RNA, 19 nt, Homo sapiens
gcauccagguuauucacaa

SEQ ID NO: 665211 - RNA, 19 nt, Homo sapiens
gcauuggcauccagguuau

SEQ ID NO: 665212 - RNA, 19 nt, Homo sapiens
caaaagagccucccuguca

SEQ ID NO: 665213 - RNA, 19 nt, Homo sapiens
gauaaucccaguagcuguu

SEQ ID NO: 665214 - RNA, 19 nt, Homo sapiens
ggugugagagggucuauga

SEQ ID NO: 665215 - RNA, 19 nt, Homo sapiens
cuucugagguccuuauuuc

SEQ ID NO: 665216 - RNA, 19 nt, Homo sapiens
uuauagagauggguauuug

SEQ ID NO: 665217 - RNA, 19 nt, Homo sapiens
gcaaaucagagacuagcaa

SEQ ID NO: 665218 - RNA, 19 nt, Homo sapiens
gagcagccacgauauuuca

SEQ ID NO: 665219 - RNA, 19 nt, Homo sapiens
gauggaagaugagcacagu

SEQ ID NO: 665220 - RNA, 19 nt, Homo sapiens
ggaauaacuuagccaugag

SEQ ID NO: 665221 - RNA, 19 nt, Homo sapiens
auaagcccaugcugaauaa

SEQ ID NO: 665222 - RNA, 19 nt, Homo sapiens
gaccacggcugucauugca

SEQ ID NO: 665223 - RNA, 19 nt, Homo sapiens
acuaaacucuuguacugaa

SEQ ID NO: 665224 - RNA, 19 nt, Homo sapiens
aaaggauguuguugucaaa

SEQ ID NO: 665225 - RNA, 19 nt, Homo sapiens
ggcggaaccugucacguau

SEQ ID NO: 665226 - RNA, 19 nt, Homo sapiens
gagagcaucagaagcuaaa

SEQ ID NO: 665227 - RNA, 19 nt, Homo sapiens
gaccagcccucaucuacag

SEQ ID NO: 665228 - RNA, 19 nt, Homo sapiens
gaucccaucuccacucucu

SEQ ID NO: 665229 - RNA, 19 nt, Homo sapiens
ugagguccuuauuuccuua

SEQ ID NO: 665230 - RNA, 19 nt, Homo sapiens
ggaguugucucugauucug

SEQ ID NO: 665231 - RNA, 19 nt, Homo sapiens
gaaacuauccaaugacaua

SEQ ID NO: 665232 - RNA, 19 nt, Homo sapiens
caacaaagcagucccuuaa

SEQ ID NO: 665233 - RNA, 19 nt, Homo sapiens
gaagauaggcuuagagaga

SEQ ID NO: 665234 - RNA, 19 nt, Homo sapiens
ccaaacaagucagauaaua

SEQ ID NO: 665235 - RNA, 19 nt, Homo sapiens
gcaguucacuuacguguug

SEQ ID NO: 665236 - RNA, 19 nt, Homo sapiens
agacagagguugcaggaua

SEQ ID NO: 665237 - RNA, 19 nt, Homo sapiens
gcaguggaaucacaacuuu

SEQ ID NO: 665238 - RNA, 19 nt, Homo sapiens
ggaggaagccguagugaaa

SEQ ID NO: 665239 - RNA, 19 nt, Homo sapiens
guaaauaacuuagcaccuu

SEQ ID NO: 665240 - RNA, 19 nt, Homo sapiens
gcaccuaagucuauauuca

SEQ ID NO: 665241 - RNA, 19 nt, Homo sapiens
ucacuuacguguugaugua

SEQ ID NO: 665242 - RNA, 19 nt, Homo sapiens
gagagaaggcggcuuagua

SEQ ID NO: 665243 - RNA, 19 nt, Homo sapiens
ggugagugcuccauaguuu

SEQ ID NO: 665244 - RNA, 19 nt, Homo sapiens
guacaaccauuauaucugu

SEQ ID NO: 665245 - RNA, 19 nt, Homo sapiens
ggauagagcuacagguguu

SEQ ID NO: 665246 - RNA, 19 nt, Homo sapiens
gaaggcggcuuaguauuga

SEQ ID NO: 665247 - RNA, 19 nt, Homo sapiens
ccacagaaaucccucaaau

SEQ ID NO: 665248 - RNA, 19 nt, Homo sapiens
gcaaauugauguucuaacu

SEQ ID NO: 665249 - RNA, 19 nt, Homo sapiens
ggaaagcuauauuuguaug

SEQ ID NO: 665250 - RNA, 19 nt, Homo sapiens
ucagugcaguucauucuua

SEQ ID NO: 665251 - RNA, 19 nt, Homo sapiens
ggaagucgcucucuaagac

SEQ ID NO: 665252 - RNA, 19 nt, Homo sapiens
agaaaucccucaaauuguu

SEQ ID NO: 665253 - RNA, 19 nt, Homo sapiens
ggacuuauaauuucuguug

SEQ ID NO: 665254 - RNA, 19 nt, Homo sapiens
uggaauagcugcugcaaug

SEQ ID NO: 665255 - RNA, 19 nt, Homo sapiens
uuacaaagcuaguaguaga

SEQ ID NO: 665256 - RNA, 19 nt, Homo sapiens
ugaagggacuuauaauuuc

SEQ ID NO: 665257 - RNA, 19 nt, Homo sapiens
gaagucuugugaauuugua

SEQ ID NO: 665258 - RNA, 19 nt, Homo sapiens
cagaauaagcuaacucuaa

SEQ ID NO: 665259 - RNA, 19 nt, Homo sapiens
uguaaacucucauaacuga

SEQ ID NO: 665260 - RNA, 19 nt, Homo sapiens
gagcccacauucaacauuu

SEQ ID NO: 665261 - RNA, 19 nt, Homo sapiens
gcaauuaaguuguuaugac

SEQ ID NO: 665262 - RNA, 19 nt, Homo sapiens
cagcagaacuguaggaagu

SEQ ID NO: 665263 - RNA, 19 nt, Homo sapiens
ggauuaagcccuucgaaga

SEQ ID NO: 665264 - RNA, 19 nt, Homo sapiens
gacaugaacuccaacagau

SEQ ID NO: 665265 - RNA, 19 nt, Homo sapiens
ggaauaacuucaaauacag

SEQ ID NO: 665266 - RNA, 19 nt, Homo sapiens
gcacuaaaguagccgaauc

SEQ ID NO: 665267 - RNA, 19 nt, Homo sapiens
acagaaaucccucaaauug

SEQ ID NO: 665268 - RNA, 19 nt, Homo sapiens
gaauagcugcugcaaugua

SEQ ID NO: 665269 - RNA, 19 nt, Homo sapiens
ugaaaggccuagguauuaa

SEQ ID NO: 665270 - RNA, 19 nt, Homo sapiens
cuacagguguucaguaaga

SEQ ID NO: 665271 - RNA, 19 nt, Homo sapiens
uaaauaggacuuucccuuu

SEQ ID NO: 665272 - RNA, 19 nt, Homo sapiens
gaucauauaccaaaguguu

SEQ ID NO: 665273 - RNA, 19 nt, Homo sapiens
ggauugaagggacuuauaa

SEQ ID NO: 665274 - RNA, 19 nt, Homo sapiens
uaaaguauguuugguguuc

SEQ ID NO: 665275 - RNA, 19 nt, Homo sapiens
ucucauaacugaauugcuu

SEQ ID NO: 665276 - RNA, 19 nt, Homo sapiens
uggcagaauuuaucucuuu

SEQ ID NO: 665277 - RNA, 19 nt, Homo sapiens
gggcauuuguuaugaagaa

SEQ ID NO: 665278 - RNA, 19 nt, Homo sapiens
uuuaauggcugugguauuu

SEQ ID NO: 665279 - RNA, 19 nt, Homo sapiens
gcuguuacuuauucagaua

SEQ ID NO: 665280 - RNA, 19 nt, Homo sapiens
cagguuaaaugaagucuug

SEQ ID NO: 665281 - RNA, 19 nt, Homo sapiens
ggacaugaacuccaacaga

SEQ ID NO: 665282 - RNA, 19 nt, Homo sapiens
acaaagcagucccuuaaga

SEQ ID NO: 665283 - RNA, 19 nt, Homo sapiens
gaaaaggacuauauaugug

SEQ ID NO: 665284 - RNA, 19 nt, Homo sapiens
gagaaccagucaaggcaaa

SEQ ID NO: 665285 - RNA, 19 nt, Homo sapiens
ggauaaugauucuuguguu

SEQ ID NO: 665286 - RNA, 19 nt, Homo sapiens
gcaacaaagcagucccuua

SEQ ID NO: 665287 - RNA, 19 nt, Homo sapiens
uaauuaaagucccugaaga

SEQ ID NO: 665288 - RNA, 19 nt, Homo sapiens
gcaauguagucuugugugu

SEQ ID NO: 665289 - RNA, 19 nt, Homo sapiens
gaaaguccacacacagauu

SEQ ID NO: 665290 - RNA, 19 nt, Homo sapiens
gaaaauaaaccucuugaga

SEQ ID NO: 665291 - RNA, 19 nt, Homo sapiens
gaagggacuuauaauuucu

SEQ ID NO: 665292 - RNA, 19 nt, Homo sapiens
cuaaagcccugccugcuau

SEQ ID NO: 665293 - RNA, 19 nt, Homo sapiens
gaugugcagucuaauuguu

SEQ ID NO: 665294 - RNA, 19 nt, Homo sapiens
acacacagauugauuacau

SEQ ID NO: 665295 - RNA, 19 nt, Homo sapiens
gcagaagcagcgucagaua

SEQ ID NO: 665296 - RNA, 19 nt, Homo sapiens
caguuuagguuauaacaga

SEQ ID NO: 665297 - RNA, 19 nt, Homo sapiens
gaauugagcaguggaauca

SEQ ID NO: 665298 - RNA, 19 nt, Homo sapiens
aaaauuagcuccuggaaug

SEQ ID NO: 665299 - RNA, 19 nt, Homo sapiens
guaggaagucgcucucuaa

SEQ ID NO: 665300 - RNA, 19 nt, Homo sapiens
uaaagucccugaagaucau

SEQ ID NO: 665301 - RNA, 19 nt, Homo sapiens
gaaccauugcuuacuauau

SEQ ID NO: 665302 - RNA, 19 nt, Homo sapiens
ggacaguucugcaauucca

SEQ ID NO: 665303 - RNA, 19 nt, Homo sapiens
uauauaaacugggaccaaa

SEQ ID NO: 665304 - RNA, 19 nt, Homo sapiens
guagcaaauugauguucua

SEQ ID NO: 665305 - RNA, 19 nt, Homo sapiens
cuauugauuucucugcuua

SEQ ID NO: 665306 - RNA, 19 nt, Homo sapiens
gcaggugcacuacguauga

SEQ ID NO: 665307 - RNA, 19 nt, Homo sapiens
uggaaugacugaaauaagu

SEQ ID NO: 665308 - RNA, 19 nt, Homo sapiens
cuaacaaccuuucuauagu

SEQ ID NO: 665309 - RNA, 19 nt, Homo sapiens
guaagcauguauacacugu

SEQ ID NO: 665310 - RNA, 19 nt, Homo sapiens
cauccaaaccuacuuuaaa

SEQ ID NO: 665311 - RNA, 19 nt, Homo sapiens
aauccacucucaugucuuu

SEQ ID NO: 665312 - RNA, 19 nt, Homo sapiens
cuuaguaacugaacugaau

SEQ ID NO: 665313 - RNA, 19 nt, Homo sapiens
gaagcuacugcacagguua

SEQ ID NO: 665314 - RNA, 19 nt, Homo sapiens
uacagaagaugaagaagau

SEQ ID NO: 665315 - RNA, 19 nt, Homo sapiens
cuacaaagacccagaguuc

SEQ ID NO: 665316 - RNA, 19 nt, Homo sapiens
gauuaagcccuucgaagaa

SEQ ID NO: 665317 - RNA, 19 nt, Homo sapiens
cauuguagccugucaacua

SEQ ID NO: 665318 - RNA, 19 nt, Homo sapiens
uauauucacuguguccuuu

SEQ ID NO: 665319 - RNA, 19 nt, Homo sapiens
aaagucacauguuucaguu

SEQ ID NO: 665320 - RNA, 19 nt, Homo sapiens
ugagcaagauuguguuuua

SEQ ID NO: 665321 - RNA, 19 nt, Homo sapiens
uaauggcugugguauuuga

SEQ ID NO: 665322 - RNA, 19 nt, Homo sapiens
caaaccaggaauuucuuua

SEQ ID NO: 665323 - RNA, 19 nt, Homo sapiens
ggaaaaggacuauauaugu

SEQ ID NO: 665324 - RNA, 19 nt, Homo sapiens
cagaaucucuucggucaug

SEQ ID NO: 665325 - RNA, 19 nt, Homo sapiens
uugaaaggccuagguauua

SEQ ID NO: 665326 - RNA, 19 nt, Homo sapiens
ccaucucucugaauuaaug

SEQ ID NO: 665327 - RNA, 19 nt, Homo sapiens
cuacaaugguugcugaugu

SEQ ID NO: 665328 - RNA, 19 nt, Homo sapiens
gcccaaacaagucagauaa

SEQ ID NO: 665329 - RNA, 19 nt, Homo sapiens
aauguagucuuguguguga

SEQ ID NO: 665330 - RNA, 19 nt, Homo sapiens
gucgugauguuuguaguua

SEQ ID NO: 665331 - RNA, 19 nt, Homo sapiens
gaaacuauccaaugacaua

SEQ ID NO: 665332 - RNA, 19 nt, Homo sapiens
caacaaagcagucccuuaa

SEQ ID NO: 665333 - RNA, 19 nt, Homo sapiens
gaagauaggcuuagagaga

SEQ ID NO: 665334 - RNA, 19 nt, Homo sapiens
ccaaacaagucagauaaua

SEQ ID NO: 665335 - RNA, 19 nt, Homo sapiens
gcaguucacuuacguguug

SEQ ID NO: 665336 - RNA, 19 nt, Homo sapiens
agacagagguugcaggaua

SEQ ID NO: 665337 - RNA, 19 nt, Homo sapiens
gcaguggaaucacaacuuu

SEQ ID NO: 665338 - RNA, 19 nt, Homo sapiens
ggaggaagccguagugaaa

SEQ ID NO: 665339 - RNA, 19 nt, Homo sapiens
guaaauaacuuagcaccuu

SEQ ID NO: 665340 - RNA, 19 nt, Homo sapiens
gcaccuaagucuauauuca

SEQ ID NO: 665341 - RNA, 19 nt, Homo sapiens
ucacuuacguguugaugua

SEQ ID NO: 665342 - RNA, 19 nt, Homo sapiens
gagagaaggcggcuuagua

SEQ ID NO: 665343 - RNA, 19 nt, Homo sapiens
ggugagugcuccauaguuu

SEQ ID NO: 665344 - RNA, 19 nt, Homo sapiens
guacaaccauuauaucugu

SEQ ID NO: 665345 - RNA, 19 nt, Homo sapiens
ggauagagcuacagguguu

SEQ ID NO: 665346 - RNA, 19 nt, Homo sapiens
gaaggcggcuuaguauuga

SEQ ID NO: 665347 - RNA, 19 nt, Homo sapiens
ccacagaaaucccucaaau

SEQ ID NO: 665348 - RNA, 19 nt, Homo sapiens
gcaaauugauguucuaacu

SEQ ID NO: 665349 - RNA, 19 nt, Homo sapiens
ggaaagcuauauuuguaug

SEQ ID NO: 665350 - RNA, 19 nt, Homo sapiens
ucagugcaguucauucuua

SEQ ID NO: 665351 - RNA, 19 nt, Homo sapiens
ggaagucgcucucuaagac

SEQ ID NO: 665352 - RNA, 19 nt, Homo sapiens
agaaaucccucaaauuguu

SEQ ID NO: 665353 - RNA, 19 nt, Homo sapiens
ggacuuauaauuucuguug

SEQ ID NO: 665354 - RNA, 19 nt, Homo sapiens
uggaauagcugcugcaaug

SEQ ID NO: 665355 - RNA, 19 nt, Homo sapiens
uuacaaagcuaguaguaga

SEQ ID NO: 665356 - RNA, 19 nt, Homo sapiens
ugaagggacuuauaauuuc

SEQ ID NO: 665357 - RNA, 19 nt, Homo sapiens
gaagucuugugaauuugua

SEQ ID NO: 665358 - RNA, 19 nt, Homo sapiens
cagaauaagcuaacucuaa

SEQ ID NO: 665359 - RNA, 19 nt, Homo sapiens
uguaaacucucauaacuga

SEQ ID NO: 665360 - RNA, 19 nt, Homo sapiens
gagcccacauucaacauuu

SEQ ID NO: 665361 - RNA, 19 nt, Homo sapiens
gcaauuaaguuguuaugac

SEQ ID NO: 665362 - RNA, 19 nt, Homo sapiens
cagcagaacuguaggaagu

SEQ ID NO: 665363 - RNA, 19 nt, Homo sapiens
ggauuaagcccuucgaaga

SEQ ID NO: 665364 - RNA, 19 nt, Homo sapiens
gacaugaacuccaacagau

SEQ ID NO: 665365 - RNA, 19 nt, Homo sapiens
ggaauaacuucaaauacag

SEQ ID NO: 665366 - RNA, 19 nt, Homo sapiens
gcacuaaaguagccgaauc

SEQ ID NO: 665367 - RNA, 19 nt, Homo sapiens
acagaaaucccucaaauug

SEQ ID NO: 665368 - RNA, 19 nt, Homo sapiens
gaauagcugcugcaaugua

SEQ ID NO: 665369 - RNA, 19 nt, Homo sapiens
ugaaaggccuagguauuaa

SEQ ID NO: 665370 - RNA, 19 nt, Homo sapiens
cuacagguguucaguaaga

SEQ ID NO: 665371 - RNA, 19 nt, Homo sapiens
uaaauaggacuuucccuuu

SEQ ID NO: 665372 - RNA, 19 nt, Homo sapiens
gaucauauaccaaaguguu

SEQ ID NO: 665373 - RNA, 19 nt, Homo sapiens
ggauugaagggacuuauaa

SEQ ID NO: 665374 - RNA, 19 nt, Homo sapiens
uaaaguauguuugguguuc

SEQ ID NO: 665375 - RNA, 19 nt, Homo sapiens
ucucauaacugaauugcuu

SEQ ID NO: 665376 - RNA, 19 nt, Homo sapiens
uggcagaauuuaucucuuu

SEQ ID NO: 665377 - RNA, 19 nt, Homo sapiens
gggcauuuguuaugaagaa

SEQ ID NO: 665378 - RNA, 19 nt, Homo sapiens
uuuaauggcugugguauuu

SEQ ID NO: 665379 - RNA, 19 nt, Homo sapiens
gcuguuacuuauucagaua

SEQ ID NO: 665380 - RNA, 19 nt, Homo sapiens
cagguuaaaugaagucuug

SEQ ID NO: 665381 - RNA, 19 nt, Homo sapiens
ggacaugaacuccaacaga

SEQ ID NO: 665382 - RNA, 19 nt, Homo sapiens
acaaagcagucccuuaaga

SEQ ID NO: 665383 - RNA, 19 nt, Homo sapiens
gaaaaggacuauauaugug

SEQ ID NO: 665384 - RNA, 19 nt, Homo sapiens
gagaaccagucaaggcaaa

SEQ ID NO: 665385 - RNA, 19 nt, Homo sapiens
ggauaaugauucuuguguu

SEQ ID NO: 665386 - RNA, 19 nt, Homo sapiens
gcaacaaagcagucccuua

SEQ ID NO: 665387 - RNA, 19 nt, Homo sapiens
uaauuaaagucccugaaga

SEQ ID NO: 665388 - RNA, 19 nt, Homo sapiens
gcaauguagucuugugugu

SEQ ID NO: 665389 - RNA, 19 nt, Homo sapiens
gaaaguccacacacagauu

SEQ ID NO: 665390 - RNA, 19 nt, Homo sapiens
gaaaauaaaccucuugaga

SEQ ID NO: 665391 - RNA, 19 nt, Homo sapiens
gaagggacuuauaauuucu

SEQ ID NO: 665392 - RNA, 19 nt, Homo sapiens
gaugugcagucuaauuguu

SEQ ID NO: 665393 - RNA, 19 nt, Homo sapiens
acacacagauugauuacau

SEQ ID NO: 665394 - RNA, 19 nt, Homo sapiens
gcagaagcagcgucagaua

SEQ ID NO: 665395 - RNA, 19 nt, Homo sapiens
caguuuagguuauaacaga

SEQ ID NO: 665396 - RNA, 19 nt, Homo sapiens
gaauugagcaguggaauca

SEQ ID NO: 665397 - RNA, 19 nt, Homo sapiens
aaaauuagcuccuggaaug

SEQ ID NO: 665398 - RNA, 19 nt, Homo sapiens
guaggaagucgcucucuaa

SEQ ID NO: 665399 - RNA, 19 nt, Homo sapiens
uaaagucccugaagaucau

SEQ ID NO: 665400 - RNA, 19 nt, Homo sapiens
gaaccauugcuuacuauau

SEQ ID NO: 665401 - RNA, 19 nt, Homo sapiens
ggacaguucugcaauucca

SEQ ID NO: 665402 - RNA, 19 nt, Homo sapiens
uauauaaacugggaccaaa

SEQ ID NO: 665403 - RNA, 19 nt, Homo sapiens
guagcaaauugauguucua

SEQ ID NO: 665404 - RNA, 19 nt, Homo sapiens
cuauugauuucucugcuua

SEQ ID NO: 665405 - RNA, 19 nt, Homo sapiens
gcaggugcacuacguauga

SEQ ID NO: 665406 - RNA, 19 nt, Homo sapiens
uggaaugacugaaauaagu

SEQ ID NO: 665407 - RNA, 19 nt, Homo sapiens
cuaacaaccuuucuauagu

SEQ ID NO: 665408 - RNA, 19 nt, Homo sapiens
guaagcauguauacacugu

SEQ ID NO: 665409 - RNA, 19 nt, Homo sapiens
cauccaaaccuacuuuaaa

SEQ ID NO: 665410 - RNA, 19 nt, Homo sapiens
aauccacucucaugucuuu

SEQ ID NO: 665411 - RNA, 19 nt, Homo sapiens
cuuaguaacugaacugaau

SEQ ID NO: 665412 - RNA, 19 nt, Homo sapiens
gauuaagcccuucgaagaa

SEQ ID NO: 665413 - RNA, 19 nt, Homo sapiens
gaagcuacugcacagguua

SEQ ID NO: 665414 - RNA, 19 nt, Homo sapiens
uacagaagaugaagaagau

SEQ ID NO: 665415 - RNA, 19 nt, Homo sapiens
cuacaaagacccagaguuc

SEQ ID NO: 665416 - RNA, 19 nt, Homo sapiens
cauuguagccugucaacua

SEQ ID NO: 665417 - RNA, 19 nt, Homo sapiens
uauauucacuguguccuuu

SEQ ID NO: 665418 - RNA, 19 nt, Homo sapiens
aaagucacauguuucaguu

SEQ ID NO: 665419 - RNA, 19 nt, Homo sapiens
ugagcaagauuguguuuua

SEQ ID NO: 665420 - RNA, 19 nt, Homo sapiens
uaauggcugugguauuuga

SEQ ID NO: 665421 - RNA, 19 nt, Homo sapiens
caaaccaggaauuucuuua

SEQ ID NO: 665422 - RNA, 19 nt, Homo sapiens
ggaaaaggacuauauaugu

SEQ ID NO: 665423 - RNA, 19 nt, Homo sapiens
cagaaucucuucggucaug

SEQ ID NO: 665424 - RNA, 19 nt, Homo sapiens
uugaaaggccuagguauua

SEQ ID NO: 665425 - RNA, 19 nt, Homo sapiens
ccaucucucugaauuaaug

SEQ ID NO: 665426 - RNA, 19 nt, Homo sapiens
cuacaaugguugcugaugu

SEQ ID NO: 665427 - RNA, 19 nt, Homo sapiens
gcccaaacaagucagauaa

SEQ ID NO: 665428 - RNA, 19 nt, Homo sapiens
aauguagucuuguguguga

SEQ ID NO: 665429 - RNA, 19 nt, Homo sapiens
gucgugauguuuguaguua

SEQ ID NO: 665430 - RNA, 19 nt, Homo sapiens
gacuaccucuucucuguga

SEQ ID NO: 665431 - RNA, 19 nt, Homo sapiens
gagaagaacuuuggcuuua

SEQ ID NO: 665432 - RNA, 19 nt, Homo sapiens
gaacagagaugcagaagag

SEQ ID NO: 665433 - RNA, 19 nt, Homo sapiens
ggaccaaacuuaaccaaga

SEQ ID NO: 665434 - RNA, 19 nt, Homo sapiens
gaagauauguggaagaaag

SEQ ID NO: 665435 - RNA, 19 nt, Homo sapiens
acaaauagguccucuguga

SEQ ID NO: 665436 - RNA, 19 nt, Homo sapiens
ggagagagauacacagaga

SEQ ID NO: 665437 - RNA, 19 nt, Homo sapiens
gaccagaaaucuuuaugaa

SEQ ID NO: 665438 - RNA, 19 nt, Homo sapiens
gaagacaacuauggugauu

SEQ ID NO: 665439 - RNA, 19 nt, Homo sapiens
ccucagagcuggagccuuu

SEQ ID NO: 665440 - RNA, 19 nt, Homo sapiens
ugaaucaacugucccuaua

SEQ ID NO: 665441 - RNA, 19 nt, Homo sapiens
gacaggagaggaagaauua

SEQ ID NO: 665442 - RNA, 19 nt, Homo sapiens
caaacaacaugcagagauu

SEQ ID NO: 665443 - RNA, 19 nt, Homo sapiens
acaaauauguccucuguga

SEQ ID NO: 665444 - RNA, 19 nt, Homo sapiens
agaaaggccuccugaauug

SEQ ID NO: 665445 - RNA, 19 nt, Homo sapiens
ugagacaucugaggaaaua

SEQ ID NO: 665446 - RNA, 19 nt, Homo sapiens
gcagguagaucuagguuca

SEQ ID NO: 665447 - RNA, 19 nt, Homo sapiens
gaagaacccugaaucaacu

SEQ ID NO: 665448 - RNA, 19 nt, Homo sapiens
uaacugaaauccagcuuga

SEQ ID NO: 665449 - RNA, 19 nt, Homo sapiens
cagaagaggugccacugua

SEQ ID NO: 665450 - RNA, 19 nt, Homo sapiens
acaaauagguccucuguca

SEQ ID NO: 665451 - RNA, 19 nt, Homo sapiens
acaaauagguccucuguca

SEQ ID NO: 665452 - RNA, 19 nt, Homo sapiens
acaaauagguccucuguca

SEQ ID NO: 665453 - RNA, 19 nt, Homo sapiens
acaaauagguccucuguca

SEQ ID NO: 665454 - RNA, 19 nt, Homo sapiens
gcacauaccuacccagcau

SEQ ID NO: 665455 - RNA, 19 nt, Homo sapiens
caaggcugguuucuucuua

SEQ ID NO: 665456 - RNA, 19 nt, Homo sapiens
gagagaaccucacagaucu

SEQ ID NO: 665457 - RNA, 19 nt, Homo sapiens
ugaccucugugauaaauaa

SEQ ID NO: 665458 - RNA, 19 nt, Homo sapiens
gaacucagggcguuagaaa

SEQ ID NO: 665459 - RNA, 19 nt, Homo sapiens
ugacugggauguugaagaa

SEQ ID NO: 665460 - RNA, 19 nt, Homo sapiens
ggucagccauuaugcauau

SEQ ID NO: 665461 - RNA, 19 nt, Homo sapiens
ccucugaucuugagccuuu

SEQ ID NO: 665462 - RNA, 19 nt, Homo sapiens
acaaauauguccucuguca

SEQ ID NO: 665463 - RNA, 19 nt, Homo sapiens
gagcccacaucucagguua

SEQ ID NO: 665464 - RNA, 19 nt, Homo sapiens
ggacaaaucaaacagaugu

SEQ ID NO: 665465 - RNA, 19 nt, Homo sapiens
gauuagagcccuuguuaga

SEQ ID NO: 665466 - RNA, 19 nt, Homo sapiens
gagagaaacugagaaacug

SEQ ID NO: 665467 - RNA, 19 nt, Homo sapiens
ggaggcagacuguggauaa

SEQ ID NO: 665468 - RNA, 19 nt, Homo sapiens
gaccaaacuuaaccaagaa

SEQ ID NO: 665469 - RNA, 19 nt, Homo sapiens
ggagagagaaacugagaaa

SEQ ID NO: 665470 - RNA, 19 nt, Homo sapiens
cagaaaggccuccugaauu

SEQ ID NO: 665471 - RNA, 19 nt, Homo sapiens
gaaagugcaaguccugaaa

SEQ ID NO: 665472 - RNA, 19 nt, Homo sapiens
caacagguacccuagauga

SEQ ID NO: 665473 - RNA, 19 nt, Homo sapiens
caacuauggugauucugaa

SEQ ID NO: 665474 - RNA, 19 nt, Homo sapiens
gaagagaggaucccagcaa

SEQ ID NO: 665475 - RNA, 19 nt, Homo sapiens
ccucaggacuucccucauu

SEQ ID NO: 665476 - RNA, 19 nt, Homo sapiens
ccgcaaggcugguuucuuc

SEQ ID NO: 665477 - RNA, 19 nt, Homo sapiens
gagaaacugcuaccagaaa

SEQ ID NO: 665478 - RNA, 19 nt, Homo sapiens
ggaccucccuaucucaaga

SEQ ID NO: 665479 - RNA, 19 nt, Homo sapiens
uagaagauauguggaagaa

SEQ ID NO: 665480 - RNA, 19 nt, Homo sapiens
ugaaucaauugucccuaua

SEQ ID NO: 665481 - RNA, 19 nt, Homo sapiens
uagagaagcuguccucaag

SEQ ID NO: 665482 - RNA, 19 nt, Homo sapiens
gaccacgaauuagaagaua

SEQ ID NO: 665483 - RNA, 19 nt, Homo sapiens
ggaagaggaugucgugacu

SEQ ID NO: 665484 - RNA, 19 nt, Homo sapiens
ggaagaaggucagcaacca

SEQ ID NO: 665485 - RNA, 19 nt, Homo sapiens
gcuauugacugggauguug

SEQ ID NO: 665486 - RNA, 19 nt, Homo sapiens
gaucuggaccuacaagcua

SEQ ID NO: 665487 - RNA, 19 nt, Homo sapiens
gaagagacacccagaguac

SEQ ID NO: 665488 - RNA, 19 nt, Homo sapiens
caagacuccugaaacaguu

SEQ ID NO: 665489 - RNA, 19 nt, Homo sapiens
cggaaguccuccagaauga

SEQ ID NO: 665490 - RNA, 19 nt, Homo sapiens
ggaaauacaagagaaacaa

SEQ ID NO: 665491 - RNA, 19 nt, Homo sapiens
gagcuuggcccuucccauu

SEQ ID NO: 665492 - RNA, 19 nt, Homo sapiens
caagagagaaccucacaga

SEQ ID NO: 665493 - RNA, 19 nt, Homo sapiens
cgauacagaugacgaggaa

SEQ ID NO: 665494 - RNA, 19 nt, Homo sapiens
ggaaguagauuuucuuucu

SEQ ID NO: 665495 - RNA, 19 nt, Homo sapiens
gaaagaacucagggcguua

SEQ ID NO: 665496 - RNA, 19 nt, Homo sapiens
gagaaggugcccaaaguga

SEQ ID NO: 665497 - RNA, 19 nt, Homo sapiens
gagacaagaaucugacaaa

SEQ ID NO: 665498 - RNA, 19 nt, Homo sapiens
ggagagagaacaacaugug

SEQ ID NO: 665499 - RNA, 19 nt, Homo sapiens
aagauuagagcccuuguua

SEQ ID NO: 665500 - RNA, 19 nt, Homo sapiens
gaagagcucccaguggaaa

SEQ ID NO: 665501 - RNA, 19 nt, Homo sapiens
ugaaggagagggacaauga

SEQ ID NO: 665502 - RNA, 19 nt, Homo sapiens
cagaugggagagauuauua

SEQ ID NO: 665503 - RNA, 19 nt, Homo sapiens
ccacauaucaggcuacuag

SEQ ID NO: 665504 - RNA, 19 nt, Homo sapiens
gacaacagguacccuagau

SEQ ID NO: 665505 - RNA, 19 nt, Homo sapiens
ggaugucucucugcccuuu

SEQ ID NO: 665506 - RNA, 19 nt, Homo sapiens
gaagggaugcuuggaguga

SEQ ID NO: 665507 - RNA, 19 nt, Homo sapiens
ggaccagaaaucuuuauga

SEQ ID NO: 665508 - RNA, 19 nt, Homo sapiens
ccacagaccagccuauuuc

SEQ ID NO: 665509 - RNA, 19 nt, Homo sapiens
gaauuccaaucuccuguca

SEQ ID NO: 665510 - RNA, 19 nt, Homo sapiens
acuaggagcaggacaaaua

SEQ ID NO: 665511 - RNA, 19 nt, Homo sapiens
acuaggagcaggacaaaua

SEQ ID NO: 665512 - RNA, 19 nt, Homo sapiens
acuaggagcaggacaaaua

SEQ ID NO: 665513 - RNA, 19 nt, Homo sapiens
aaagagauagggagaguuu

SEQ ID NO: 665514 - RNA, 19 nt, Homo sapiens
ccuaacagccucaguaguu

SEQ ID NO: 665515 - RNA, 19 nt, Homo sapiens
gagccagccugcuauaugg

SEQ ID NO: 665516 - RNA, 19 nt, Homo sapiens
aaagagagccagccugcua

SEQ ID NO: 665517 - RNA, 19 nt, Homo sapiens
gaaacaggacagagaacaa

SEQ ID NO: 665518 - RNA, 19 nt, Homo sapiens
acacacaaguggagaagga

SEQ ID NO: 665519 - RNA, 19 nt, Homo sapiens
ggugggaccagaaaucuuu

SEQ ID NO: 665520 - RNA, 19 nt, Homo sapiens
agacagagcaauccaguga

SEQ ID NO: 665521 - RNA, 19 nt, Homo sapiens
ugucaagacuccugaaaca

SEQ ID NO: 665522 - RNA, 19 nt, Homo sapiens
gaucuuccauggaguaggu

SEQ ID NO: 665523 - RNA, 19 nt, Homo sapiens
gaagaggugccacuguaga

SEQ ID NO: 665524 - RNA, 19 nt, Homo sapiens
gcccugcccuuuccaucua

SEQ ID NO: 665525 - RNA, 19 nt, Homo sapiens
cagcucccauugaccauaa

SEQ ID NO: 665526 - RNA, 19 nt, Homo sapiens
gauagauccucugucaaga

SEQ ID NO: 665527 - RNA, 19 nt, Homo sapiens
gaagaccccugaaacaguu

SEQ ID NO: 665528 - RNA, 19 nt, Homo sapiens
gcagacccuuccaagcaaa

SEQ ID NO: 665529 - RNA, 19 nt, Homo sapiens
gaagguagaaauugagaca

SEQ ID NO: 665530 - RNA, 19 nt, Homo sapiens
caaggacucugaagacaac

SEQ ID NO: 665531 - RNA, 19 nt, Homo sapiens
gaaaagaaaugcucaauug

SEQ ID NO: 665532 - RNA, 19 nt, Homo sapiens
ggaagaagcuuggagaaga

SEQ ID NO: 665533 - RNA, 19 nt, Homo sapiens
ccaaggaucuuaucuauag

SEQ ID NO: 665534 - RNA, 19 nt, Homo sapiens
gaaaugaagccaacaggua

SEQ ID NO: 665535 - RNA, 19 nt, Homo sapiens
gaagaagcuuggagaagaa

SEQ ID NO: 665536 - RNA, 19 nt, Homo sapiens
gaacuuagacagcuuguug

SEQ ID NO: 665537 - RNA, 19 nt, Homo sapiens
gaaggacauuucccuguuu

SEQ ID NO: 665538 - RNA, 19 nt, Homo sapiens
gcaaagaguuauauucuac

SEQ ID NO: 665539 - RNA, 19 nt, Homo sapiens
caaaguaccugcuacaaag

SEQ ID NO: 665540 - RNA, 19 nt, Homo sapiens
ggacucagacgucuacuaa

SEQ ID NO: 665541 - RNA, 19 nt, Homo sapiens
gagaaacacuaucgggaaa

SEQ ID NO: 665542 - RNA, 19 nt, Homo sapiens
ggaggugugugcagacuuu

SEQ ID NO: 665543 - RNA, 19 nt, Homo sapiens
uaaagcagcugucacacuu

SEQ ID NO: 665544 - RNA, 19 nt, Homo sapiens
gaaaagcccuguauucaau

SEQ ID NO: 665545 - RNA, 19 nt, Homo sapiens
acacagauauuaagccauu

SEQ ID NO: 665546 - RNA, 19 nt, Homo sapiens
gaaugucccuguuauacug

SEQ ID NO: 665547 - RNA, 19 nt, Homo sapiens
gagcagaaugucccuguua

SEQ ID NO: 665548 - RNA, 19 nt, Homo sapiens
gagaagugauucccgaaga

SEQ ID NO: 665549 - RNA, 19 nt, Homo sapiens
ccugagcucuuccuaagua

SEQ ID NO: 665550 - RNA, 19 nt, Homo sapiens
gggccauccuaacuuauua

SEQ ID NO: 665551 - RNA, 19 nt, Homo sapiens
caaaccaccuuagugagua

SEQ ID NO: 665552 - RNA, 19 nt, Homo sapiens
gaaacacuaucgggaaaug

SEQ ID NO: 665553 - RNA, 19 nt, Homo sapiens
gcaacaggguaauaagaga

SEQ ID NO: 665554 - RNA, 19 nt, Homo sapiens
gugcagacuuuauuaaugu

SEQ ID NO: 665555 - RNA, 19 nt, Homo sapiens
ccuauuuccuguuaacaua

SEQ ID NO: 665556 - RNA, 19 nt, Homo sapiens
ugaguaacccuaagaauug

SEQ ID NO: 665557 - RNA, 19 nt, Homo sapiens
gaaccaaaccaccuuagug

SEQ ID NO: 665558 - RNA, 19 nt, Homo sapiens
gaaggaggcagaagggaaa

SEQ ID NO: 665559 - RNA, 19 nt, Homo sapiens
caaauaggaucugcaguca

SEQ ID NO: 665560 - RNA, 19 nt, Homo sapiens
gacaagaccugcaguaagc

SEQ ID NO: 665561 - RNA, 19 nt, Homo sapiens
gaaaugcucaauugaagga

SEQ ID NO: 665562 - RNA, 19 nt, Homo sapiens
gagaagaugcagaggaauu

SEQ ID NO: 665563 - RNA, 19 nt, Homo sapiens
gcagaaugucccuguuaua

SEQ ID NO: 665564 - RNA, 19 nt, Homo sapiens
gaaccugagcucuuccuaa

SEQ ID NO: 665565 - RNA, 19 nt, Homo sapiens
gaaacgaguggaugacuau

SEQ ID NO: 665566 - RNA, 19 nt, Homo sapiens
ggaaguagaagagcagaaa

SEQ ID NO: 665567 - RNA, 19 nt, Homo sapiens
caacaguggugauuuacuc

SEQ ID NO: 665568 - RNA, 19 nt, Homo sapiens
ggagacaauuacaaacaug

SEQ ID NO: 665569 - RNA, 19 nt, Homo sapiens
ggaaauggaagagaaauca

SEQ ID NO: 665570 - RNA, 19 nt, Homo sapiens
ugaauucagucaagaacuu

SEQ ID NO: 665571 - RNA, 19 nt, Homo sapiens
aauaggaucugcagucaug

SEQ ID NO: 665572 - RNA, 19 nt, Homo sapiens
gugaguaacccuaagaauu

SEQ ID NO: 665573 - RNA, 19 nt, Homo sapiens
gagcagcgcuuaaauuccu

SEQ ID NO: 665574 - RNA, 19 nt, Homo sapiens
uaaauaggcagaaggaaga

SEQ ID NO: 665575 - RNA, 19 nt, Homo sapiens
caucugcugugauugcuuu

SEQ ID NO: 665576 - RNA, 19 nt, Homo sapiens
ugaaggacauuucccuguu

SEQ ID NO: 665577 - RNA, 19 nt, Homo sapiens
caaaggaugagcuuaguau

SEQ ID NO: 665578 - RNA, 19 nt, Homo sapiens
gagaauugcagcugaguau

SEQ ID NO: 665579 - RNA, 19 nt, Homo sapiens
gcauaguguucuguuguuu

SEQ ID NO: 665580 - RNA, 19 nt, Homo sapiens
ucaaagagcagcgcuuaaa

SEQ ID NO: 665581 - RNA, 19 nt, Homo sapiens
uaagaaguacugcuacaaa

SEQ ID NO: 665582 - RNA, 19 nt, Homo sapiens
gauucucucuucuggcuuu

SEQ ID NO: 665583 - RNA, 19 nt, Homo sapiens
gagcagaaacuacaucaag

SEQ ID NO: 665584 - RNA, 19 nt, Homo sapiens
ccuaagaauugacacaaau

SEQ ID NO: 665585 - RNA, 19 nt, Homo sapiens
gaguaacccuaagaauuga

SEQ ID NO: 665586 - RNA, 19 nt, Homo sapiens
ucacaacccugaagcacau

SEQ ID NO: 665587 - RNA, 19 nt, Homo sapiens
gaucagcaccaacguugaa

SEQ ID NO: 665588 - RNA, 19 nt, Homo sapiens
gaauucagucaagaacuua

SEQ ID NO: 665589 - RNA, 19 nt, Homo sapiens
aaagagcagcgcuuaaauu

SEQ ID NO: 665590 - RNA, 19 nt, Homo sapiens
ggagauaaauaggcagaag

SEQ ID NO: 665591 - RNA, 19 nt, Homo sapiens
gaaagagauuaaagaagcu

SEQ ID NO: 665592 - RNA, 19 nt, Homo sapiens
uuaggaagcucagaguuga

SEQ ID NO: 665593 - RNA, 19 nt, Homo sapiens
aagaacgacugcaacacua

SEQ ID NO: 665594 - RNA, 19 nt, Homo sapiens
gaagaaaagcccuguauuc

SEQ ID NO: 665595 - RNA, 19 nt, Homo sapiens
gggaggccauguugaacuu

SEQ ID NO: 665596 - RNA, 19 nt, Homo sapiens
cagcuuacacagauauuaa

SEQ ID NO: 665597 - RNA, 19 nt, Homo sapiens
gcucagaguugaagaaaau

SEQ ID NO: 665598 - RNA, 19 nt, Homo sapiens
aaacaucacaccuuuagga

SEQ ID NO: 665599 - RNA, 19 nt, Homo sapiens
aagaaaugcucaauugaag

SEQ ID NO: 665600 - RNA, 19 nt, Homo sapiens
caccaacguugaacagcua

SEQ ID NO: 665601 - RNA, 19 nt, Homo sapiens
agaaacgaguggaugacua

SEQ ID NO: 665602 - RNA, 19 nt, Homo sapiens
caugagacuuucccgagaa

SEQ ID NO: 665603 - RNA, 19 nt, Homo sapiens
gggagacaauuacaaacau

SEQ ID NO: 665604 - RNA, 19 nt, Homo sapiens
gguccucagucaagauuau

SEQ ID NO: 665605 - RNA, 19 nt, Homo sapiens
ggaugagcuuaguauagaa

SEQ ID NO: 665606 - RNA, 19 nt, Homo sapiens
aggaugagcuuaguauaga

SEQ ID NO: 665607 - RNA, 19 nt, Homo sapiens
cgacugcaacacuacuuua

SEQ ID NO: 665608 - RNA, 19 nt, Homo sapiens
guauaaagcagcugucaca

SEQ ID NO: 665609 - RNA, 19 nt, Homo sapiens
ugaugaugcuacagaauau

SEQ ID NO: 665610 - RNA, 19 nt, Homo sapiens
gcagaggaauuuuacaaug

SEQ ID NO: 665611 - RNA, 19 nt, Homo sapiens
ugucagauguggucaguag

SEQ ID NO: 665612 - RNA, 19 nt, Homo sapiens
guuauaagaaguacugcua

SEQ ID NO: 665613 - RNA, 19 nt, Homo sapiens
gcgaagcgaggaugaguga

SEQ ID NO: 665614 - RNA, 19 nt, Homo sapiens
cagcacugauuauccagaa

SEQ ID NO: 665615 - RNA, 19 nt, Homo sapiens
agauguugcuggagauaaa

SEQ ID NO: 665616 - RNA, 19 nt, Homo sapiens
caaagauguugcuggagau

SEQ ID NO: 665617 - RNA, 19 nt, Homo sapiens
aggagaagaugcagaggaa

SEQ ID NO: 665618 - RNA, 19 nt, Homo sapiens
cauaguguucuguuguuua

SEQ ID NO: 665619 - RNA, 19 nt, Homo sapiens
agaagugauucccgaagaa

SEQ ID NO: 665620 - RNA, 19 nt, Homo sapiens
gaacgcgaagcgaggauga

SEQ ID NO: 665621 - RNA, 19 nt, Homo sapiens
ugaagaaacgaguggauga

SEQ ID NO: 665622 - RNA, 19 nt, Homo sapiens
ugaguaugcucgaaauagu

SEQ ID NO: 665623 - RNA, 19 nt, Homo sapiens
gagacuuucccgagaauug

SEQ ID NO: 665624 - RNA, 19 nt, Homo sapiens
acaaaguaccugcuacaaa

SEQ ID NO: 665625 - RNA, 19 nt, Homo sapiens
gcaguaagcaaagaguuau

SEQ ID NO: 665626 - RNA, 19 nt, Homo sapiens
gaagcucagaguugaagaa

SEQ ID NO: 665627 - RNA, 19 nt, Homo sapiens
gcagcugucacacuucaaa

SEQ ID NO: 665628 - RNA, 19 nt, Homo sapiens
ugaaucccaucaggaaauu

SEQ ID NO: 665629 - RNA, 19 nt, Homo sapiens
cuacaaaacuccuacuguu

SEQ ID NO: 665630 - RNA, 19 nt, Homo sapiens
aaaaggaacugcauaccaa

SEQ ID NO: 665631 - RNA, 19 nt, Homo sapiens
gcacaaggcaucugucuua

SEQ ID NO: 665632 - RNA, 19 nt, Homo sapiens
guaauugacuguucuguaa

SEQ ID NO: 665633 - RNA, 19 nt, Homo sapiens
gaagagagcuagcgcaaca

SEQ ID NO: 665634 - RNA, 19 nt, Homo sapiens
ugacuguucuguaaaguua

SEQ ID NO: 665635 - RNA, 19 nt, Homo sapiens
gcaaacugcuuacaaagga

SEQ ID NO: 665636 - RNA, 19 nt, Homo sapiens
gagcgaaucuggcaaagga

SEQ ID NO: 665637 - RNA, 19 nt, Homo sapiens
gaaagugaauggugacugu

SEQ ID NO: 665638 - RNA, 19 nt, Homo sapiens
gcagaugccucuccuuguu

SEQ ID NO: 665639 - RNA, 19 nt, Homo sapiens
caaggcaucugucuuauuc

SEQ ID NO: 665640 - RNA, 19 nt, Homo sapiens
guaacuggcuagcuuauau

SEQ ID NO: 665641 - RNA, 19 nt, Homo sapiens
gaaaugguauuccacagau

SEQ ID NO: 665642 - RNA, 19 nt, Homo sapiens
gagagcaacaguuuacuua

SEQ ID NO: 665643 - RNA, 19 nt, Homo sapiens
ugagguugaucgaguauua

SEQ ID NO: 665644 - RNA, 19 nt, Homo sapiens
gagcaacaguuuacuuaau

SEQ ID NO: 665645 - RNA, 19 nt, Homo sapiens
gcgggaaccuguuuacaaa

SEQ ID NO: 665646 - RNA, 19 nt, Homo sapiens
ggauucagcccaaugguua

SEQ ID NO: 665647 - RNA, 19 nt, Homo sapiens
gaaauucuguacccaaagu

SEQ ID NO: 665648 - RNA, 19 nt, Homo sapiens
cagaaaagcuguccgauuu

SEQ ID NO: 665649 - RNA, 19 nt, Homo sapiens
aaacgagcaugcuaaauau

SEQ ID NO: 665650 - RNA, 19 nt, Homo sapiens
guacgcaauugaaauggua

SEQ ID NO: 665651 - RNA, 19 nt, Homo sapiens
gacuauacgucuuaacaaa

SEQ ID NO: 665652 - RNA, 19 nt, Homo sapiens
gcaggcggcuuuagucguu

SEQ ID NO: 665653 - RNA, 19 nt, Homo sapiens
ugagugacuuuguucauaa

SEQ ID NO: 665654 - RNA, 19 nt, Homo sapiens
agacucuucuguugauuua

SEQ ID NO: 665655 - RNA, 19 nt, Homo sapiens
gaucuguccuguuggugua

SEQ ID NO: 665656 - RNA, 19 nt, Homo sapiens
guaauggacuagugcaguu

SEQ ID NO: 665657 - RNA, 19 nt, Homo sapiens
gcaagccuguggagaaguu

SEQ ID NO: 665658 - RNA, 19 nt, Homo sapiens
caauguaacuggcuagcuu

SEQ ID NO: 665659 - RNA, 19 nt, Homo sapiens
guacagaaauuauccuaac

SEQ ID NO: 665660 - RNA, 19 nt, Homo sapiens
ggagauaacgccucggaaa

SEQ ID NO: 665661 - RNA, 19 nt, Homo sapiens
uuacaaaccuggacagcuu

SEQ ID NO: 665662 - RNA, 19 nt, Homo sapiens
gcaggcuucuuguuuauuc

SEQ ID NO: 665663 - RNA, 19 nt, Homo sapiens
ggaaggaggugacguucag

SEQ ID NO: 665664 - RNA, 19 nt, Homo sapiens
uaaauuacuugacgguuca

SEQ ID NO: 665665 - RNA, 19 nt, Homo sapiens
guccuucucugaacaguuu

SEQ ID NO: 665666 - RNA, 19 nt, Homo sapiens
caacuguaauugacuguuc

SEQ ID NO: 665667 - RNA, 19 nt, Homo sapiens
gaaugaaaauguucuguga

SEQ ID NO: 665668 - RNA, 19 nt, Homo sapiens
aaagauacuuguugugugu

SEQ ID NO: 665669 - RNA, 19 nt, Homo sapiens
gcgagaagcccuacaagug

SEQ ID NO: 665670 - RNA, 19 nt, Homo sapiens
cuggcuagcuuauauauau

SEQ ID NO: 665671 - RNA, 19 nt, Homo sapiens
gguaauauuucugagaguu

SEQ ID NO: 665672 - RNA, 19 nt, Homo sapiens
aacaagacgugguggauuu

SEQ ID NO: 665673 - RNA, 19 nt, Homo sapiens
gaacaagacgugguggauu

SEQ ID NO: 665674 - RNA, 19 nt, Homo sapiens
agacguacauuccaaagga

SEQ ID NO: 665675 - RNA, 19 nt, Homo sapiens
ggacauccucaacaucuuu

SEQ ID NO: 665676 - RNA, 19 nt, Homo sapiens
gcaagagcagcacagauuu

SEQ ID NO: 665677 - RNA, 19 nt, Homo sapiens
ggauucuacuuguuacuga

SEQ ID NO: 665678 - RNA, 19 nt, Homo sapiens
gagagaccauucuaacaca

SEQ ID NO: 665679 - RNA, 19 nt, Homo sapiens
ggcaagagcagcacagauu

SEQ ID NO: 665680 - RNA, 19 nt, Homo sapiens
gaauguccaugcagauaca

SEQ ID NO: 665681 - RNA, 19 nt, Homo sapiens
aaaaugaucuguccuguug

SEQ ID NO: 665682 - RNA, 19 nt, Homo sapiens
gcgcuggaguggaaacuga

SEQ ID NO: 665683 - RNA, 19 nt, Homo sapiens
gcaguacccucacgauguc

SEQ ID NO: 665684 - RNA, 19 nt, Homo sapiens
gcuagcaugccuaagaaua

SEQ ID NO: 665685 - RNA, 19 nt, Homo sapiens
ccucaugccgcuagauuua

SEQ ID NO: 665686 - RNA, 19 nt, Homo sapiens
ggacguggccuucgacaag

SEQ ID NO: 665687 - RNA, 19 nt, Homo sapiens
guaaugcaaaugcgaguuu

SEQ ID NO: 665688 - RNA, 19 nt, Homo sapiens
gauauucuuacaccagaua

SEQ ID NO: 665689 - RNA, 19 nt, Homo sapiens
uucaaacgaugcaauguaa

SEQ ID NO: 665690 - RNA, 19 nt, Homo sapiens
uuaauacgguaauggacua

SEQ ID NO: 665691 - RNA, 19 nt, Homo sapiens
cgagcaugcuaaauauauu

SEQ ID NO: 665692 - RNA, 19 nt, Homo sapiens
ccaugcagauacaguuaaa

SEQ ID NO: 665693 - RNA, 19 nt, Homo sapiens
gagugacuuuguucauaaa

SEQ ID NO: 665694 - RNA, 19 nt, Homo sapiens
caggaugagugacuuuguu

SEQ ID NO: 665695 - RNA, 19 nt, Homo sapiens
gaccacggcugccacaucu

SEQ ID NO: 665696 - RNA, 19 nt, Homo sapiens
ugaaggcgcacaugaagaa

SEQ ID NO: 665697 - RNA, 19 nt, Homo sapiens
uaagaaaucagaagacucu

SEQ ID NO: 665698 - RNA, 19 nt, Homo sapiens
gcaacaguuuacuuaauac

SEQ ID NO: 665699 - RNA, 19 nt, Homo sapiens
ucugcaaacugcuuacaaa

SEQ ID NO: 665700 - RNA, 19 nt, Homo sapiens
caucguccauagucccaua

SEQ ID NO: 665701 - RNA, 19 nt, Homo sapiens
agacagugccucugagaaa

SEQ ID NO: 665702 - RNA, 19 nt, Homo sapiens
acagugggcuucugauaca

SEQ ID NO: 665703 - RNA, 19 nt, Homo sapiens
gcaaaagcuuuacuagguu

SEQ ID NO: 665704 - RNA, 19 nt, Homo sapiens
uaacuggcuagcuuauaua

SEQ ID NO: 665705 - RNA, 19 nt, Homo sapiens
aaaacgagcaugcuaaaua

SEQ ID NO: 665706 - RNA, 19 nt, Homo sapiens
gcaguguacgcaauugaaa

SEQ ID NO: 665707 - RNA, 19 nt, Homo sapiens
cagaaauuauccuaaccuu

SEQ ID NO: 665708 - RNA, 19 nt, Homo sapiens
aaaggcaggaaauggauua

SEQ ID NO: 665709 - RNA, 19 nt, Homo sapiens
guaacggccauuagcagua

SEQ ID NO: 665710 - RNA, 19 nt, Homo sapiens
gucauugcauuuccacauu

SEQ ID NO: 665711 - RNA, 19 nt, Homo sapiens
gucacaagaugggagauaa

SEQ ID NO: 665712 - RNA, 19 nt, Homo sapiens
gaagggcaaccugaagauu

SEQ ID NO: 665713 - RNA, 19 nt, Homo sapiens
gaauggugacuguuaggaa

SEQ ID NO: 665714 - RNA, 19 nt, Homo sapiens
gcagauacaguuaaacaac

SEQ ID NO: 665715 - RNA, 19 nt, Homo sapiens
caauugaaaugguauucca

SEQ ID NO: 665716 - RNA, 19 nt, Homo sapiens
gauaacgccucggaaagag

SEQ ID NO: 665717 - RNA, 19 nt, Homo sapiens
gaaugucagggacuaguga

SEQ ID NO: 665718 - RNA, 19 nt, Homo sapiens
ggcaggaaauggauuaaaa

SEQ ID NO: 665719 - RNA, 19 nt, Homo sapiens
caaacugcuuacaaaggaa

SEQ ID NO: 665720 - RNA, 19 nt, Homo sapiens
agagcuagcgcaacacuaa

SEQ ID NO: 665721 - RNA, 19 nt, Homo sapiens
cagaugccucuccuuguua

SEQ ID NO: 665722 - RNA, 19 nt, Homo sapiens
cuagcaugccuaagaauaa

SEQ ID NO: 665723 - RNA, 19 nt, Homo sapiens
ccgcuagcaugccuaagaa

SEQ ID NO: 665724 - RNA, 19 nt, Homo sapiens
cgagaagcccuacaagugu

SEQ ID NO: 665725 - RNA, 19 nt, Homo sapiens
ggagcguugucauugcauu

SEQ ID NO: 665726 - RNA, 19 nt, Homo sapiens
ccacugaguccucccgauu

SEQ ID NO: 665727 - RNA, 19 nt, Homo sapiens
caagggagagaccauucua

SEQ ID NO: 665728 - RNA, 19 nt, Homo sapiens
caucagaagcaauuugguu

SEQ ID NO: 665729 - RNA, 19 nt, Homo sapiens
ggacaccaagcaguucuuu

SEQ ID NO: 665730 - RNA, 19 nt, Homo sapiens
auauaccucuuccucagua

SEQ ID NO: 665731 - RNA, 19 nt, Homo sapiens
gaacaaaugucuacucuaa

SEQ ID NO: 665732 - RNA, 19 nt, Homo sapiens
gaaaugagcuaugaacuaa

SEQ ID NO: 665733 - RNA, 19 nt, Homo sapiens
ggaagaaacuccaagaaga

SEQ ID NO: 665734 - RNA, 19 nt, Homo sapiens
caagaagaauugcagaaua

SEQ ID NO: 665735 - RNA, 19 nt, Homo sapiens
caaagaggaugucagcaua

SEQ ID NO: 665736 - RNA, 19 nt, Homo sapiens
gaucagggcuugacucaug

SEQ ID NO: 665737 - RNA, 19 nt, Homo sapiens
gcaagacgauggacacauu

SEQ ID NO: 665738 - RNA, 19 nt, Homo sapiens
caaaugaaauguugcuuga

SEQ ID NO: 665739 - RNA, 19 nt, Homo sapiens
gcagauaccuuccagagau

SEQ ID NO: 665740 - RNA, 19 nt, Homo sapiens
gagauuaagucaccaauag

SEQ ID NO: 665741 - RNA, 19 nt, Homo sapiens
ggagagaugcuuaguguaa

SEQ ID NO: 665742 - RNA, 19 nt, Homo sapiens
caaacaaugugugcaauuu

SEQ ID NO: 665743 - RNA, 19 nt, Homo sapiens
ccacacagcugccaugguu

SEQ ID NO: 665744 - RNA, 19 nt, Homo sapiens
cacaauacuugccacauua

SEQ ID NO: 665745 - RNA, 19 nt, Homo sapiens
gagguuggcuggucacuga

SEQ ID NO: 665746 - RNA, 19 nt, Homo sapiens
gaagagacaucgaaucaac

SEQ ID NO: 665747 - RNA, 19 nt, Homo sapiens
aagaagaucucauaaagga

SEQ ID NO: 665748 - RNA, 19 nt, Homo sapiens
caaauaagcauccucaaau

SEQ ID NO: 665749 - RNA, 19 nt, Homo sapiens
agagcgagaucaugacuua

SEQ ID NO: 665750 - RNA, 19 nt, Homo sapiens
gagaaagcauggaggaaga

SEQ ID NO: 665751 - RNA, 19 nt, Homo sapiens
ucacaauacuugccacauu

SEQ ID NO: 665752 - RNA, 19 nt, Homo sapiens
caagucauuugcucuaauu

SEQ ID NO: 665753 - RNA, 19 nt, Homo sapiens
acaaaugucuacucuaaga

SEQ ID NO: 665754 - RNA, 19 nt, Homo sapiens
ccuauaaugucuccacuuu

SEQ ID NO: 665755 - RNA, 19 nt, Homo sapiens
ccaggaacauacagauuaa

SEQ ID NO: 665756 - RNA, 19 nt, Homo sapiens
gagaaaugcugcaccaaag

SEQ ID NO: 665757 - RNA, 19 nt, Homo sapiens
aaagcaagaugguacaauu

SEQ ID NO: 665758 - RNA, 19 nt, Homo sapiens
acacagauaugaagaaagu

SEQ ID NO: 665759 - RNA, 19 nt, Homo sapiens
ggaucaccuucuuauaaua

SEQ ID NO: 665760 - RNA, 19 nt, Homo sapiens
caaugaagcuacuaugcaa

SEQ ID NO: 665761 - RNA, 19 nt, Homo sapiens
gcccaugacugaagaguug

SEQ ID NO: 665762 - RNA, 19 nt, Homo sapiens
gaacaggagacacagauau

SEQ ID NO: 665763 - RNA, 19 nt, Homo sapiens
ggaaggggcucagguguua

SEQ ID NO: 665764 - RNA, 19 nt, Homo sapiens
gugcaagccuuaauggaaa

SEQ ID NO: 665765 - RNA, 19 nt, Homo sapiens
gaacaagagaguaucauuc

SEQ ID NO: 665766 - RNA, 19 nt, Homo sapiens
ugaagcaaaugaaauguug

SEQ ID NO: 665767 - RNA, 19 nt, Homo sapiens
gcucaggagucgucucaaa

SEQ ID NO: 665768 - RNA, 19 nt, Homo sapiens
guauguaucggaagaauaa

SEQ ID NO: 665769 - RNA, 19 nt, Homo sapiens
gggcuugacucaugauaga

SEQ ID NO: 665770 - RNA, 19 nt, Homo sapiens
ggacaggauuaacuucaga

SEQ ID NO: 665771 - RNA, 19 nt, Homo sapiens
gacaucgaaucaaccaaua

SEQ ID NO: 665772 - RNA, 19 nt, Homo sapiens
gaacggagucggcucaaug

SEQ ID NO: 665773 - RNA, 19 nt, Homo sapiens
ggagaaggaucgccucaag

SEQ ID NO: 665774 - RNA, 19 nt, Homo sapiens
ggaggaaucuugguguaug

SEQ ID NO: 665775 - RNA, 19 nt, Homo sapiens
uauaaugucuccacuuugu

SEQ ID NO: 665776 - RNA, 19 nt, Homo sapiens
caccggaacuccuauaaug

SEQ ID NO: 665777 - RNA, 19 nt, Homo sapiens
gaagaaacuccaagaagau

SEQ ID NO: 665778 - RNA, 19 nt, Homo sapiens
ggaaacauaaccaggaauu

SEQ ID NO: 665779 - RNA, 19 nt, Homo sapiens
ugagagaagugcaaaggaa

SEQ ID NO: 665780 - RNA, 19 nt, Homo sapiens
uagaaggacuaguagauga

SEQ ID NO: 665781 - RNA, 19 nt, Homo sapiens
gaaguuggugcaagccuua

SEQ ID NO: 665782 - RNA, 19 nt, Homo sapiens
gcaguugcuucaggaauuu

SEQ ID NO: 665783 - RNA, 19 nt, Homo sapiens
acaagacaccugugaguua

SEQ ID NO: 665784 - RNA, 19 nt, Homo sapiens
gagggaagaugaaggagau

SEQ ID NO: 665785 - RNA, 19 nt, Homo sapiens
gauauggucugaaguacuc

SEQ ID NO: 665786 - RNA, 19 nt, Homo sapiens
acacugcucugcaaacuug

SEQ ID NO: 665787 - RNA, 19 nt, Homo sapiens
gggaugaucucugugaaga

SEQ ID NO: 665788 - RNA, 19 nt, Homo sapiens
uugaagcgcuuucuauuga

SEQ ID NO: 665789 - RNA, 19 nt, Homo sapiens
uaggaucaccuucuuauaa

SEQ ID NO: 665790 - RNA, 19 nt, Homo sapiens
uaagcauccucaaaucuuu

SEQ ID NO: 665791 - RNA, 19 nt, Homo sapiens
ggagcgggcuauagaugaa

SEQ ID NO: 665792 - RNA, 19 nt, Homo sapiens
caagacaccugugaguuau

SEQ ID NO: 665793 - RNA, 19 nt, Homo sapiens
caagugugcuuucaugcuu

SEQ ID NO: 665794 - RNA, 19 nt, Homo sapiens
gacuacagcucccagaaga

SEQ ID NO: 665795 - RNA, 19 nt, Homo sapiens
uuacagacgucucuucaug

SEQ ID NO: 665796 - RNA, 19 nt, Homo sapiens
gcagggaacgugagacuga

SEQ ID NO: 665797 - RNA, 19 nt, Homo sapiens
aaacagaggccaccaacaa

SEQ ID NO: 665798 - RNA, 19 nt, Homo sapiens
uaggagagaugcuuagugu

SEQ ID NO: 665799 - RNA, 19 nt, Homo sapiens
agagggaccugcaggauga

SEQ ID NO: 665800 - RNA, 19 nt, Homo sapiens
caacaguuucuuuguagua

SEQ ID NO: 665801 - RNA, 19 nt, Homo sapiens
ucucaacaguuucuuugua

SEQ ID NO: 665802 - RNA, 19 nt, Homo sapiens
ccaaauaagcauccucaaa

SEQ ID NO: 665803 - RNA, 19 nt, Homo sapiens
gaguaucauucagcaguua

SEQ ID NO: 665804 - RNA, 19 nt, Homo sapiens
guggaacaguuaucuacua

SEQ ID NO: 665805 - RNA, 19 nt, Homo sapiens
gcagccaacuugaaauaca

SEQ ID NO: 665806 - RNA, 19 nt, Homo sapiens
gaggaaucuugguguauga

SEQ ID NO: 665807 - RNA, 19 nt, Homo sapiens
gcaaucucaucuccuaaau

SEQ ID NO: 665808 - RNA, 19 nt, Homo sapiens
ggaggaggcugcacaccau

SEQ ID NO: 665809 - RNA, 19 nt, Homo sapiens
gaacaaagaaguggaggau

SEQ ID NO: 665810 - RNA, 19 nt, Homo sapiens
gaagaaauggaaaccaaau

SEQ ID NO: 665811 - RNA, 19 nt, Homo sapiens
ugaaaugagcuaugaacua

SEQ ID NO: 665812 - RNA, 19 nt, Homo sapiens
gcucuuagcaugauuaaag

SEQ ID NO: 665813 - RNA, 19 nt, Homo sapiens
cauuagggcauuuguauuu

SEQ ID NO: 665814 - RNA, 19 nt, Homo sapiens
guaguaggaucaccuucuu

SEQ ID NO: 665815 - RNA, 19 nt, Homo sapiens
ugucaaaccucagaacuug

SEQ ID NO: 665816 - RNA, 19 nt, Homo sapiens
ucacugaugguuauaauga

SEQ ID NO: 665817 - RNA, 19 nt, Homo sapiens
aauaagaagagcccaaaua

SEQ ID NO: 665818 - RNA, 19 nt, Homo sapiens
ggaacaagagaguaucauu

SEQ ID NO: 665819 - RNA, 19 nt, Homo sapiens
gaacaguuaucuacuaccu

SEQ ID NO: 665820 - RNA, 19 nt, Homo sapiens
ucacaugagaccacuauaa

SEQ ID NO: 665821 - RNA, 19 nt, Homo sapiens
cagcauggguguaaucaca

SEQ ID NO: 665822 - RNA, 19 nt, Homo sapiens
gaagauguaacuagcaugu

SEQ ID NO: 665823 - RNA, 19 nt, Homo sapiens
caagaagauuggaaugcuu

SEQ ID NO: 665824 - RNA, 19 nt, Homo sapiens
gaagauacaagcacugagu

SEQ ID NO: 665825 - RNA, 19 nt, Homo sapiens
gguugauccugaagacaua

SEQ ID NO: 665826 - RNA, 19 nt, Homo sapiens
gauggaacuuucugcucua

SEQ ID NO: 665827 - RNA, 19 nt, Homo sapiens
agacgucucuucaugauag

SEQ ID NO: 665828 - RNA, 19 nt, Homo sapiens
aagaagaaauggaaaccaa

SEQ ID NO: 665829 - RNA, 19 nt, Homo sapiens
gaagaauugcagaauaaga

SEQ ID NO: 665830 - RNA, 19 nt, Homo sapiens
uggcaaagcuucgagaaau

SEQ ID NO: 665831 - RNA, 19 nt, Homo sapiens
gaaagugaaugaucaguua

SEQ ID NO: 665832 - RNA, 19 nt, Homo sapiens
gaacuaaaccuuaagauga

SEQ ID NO: 665833 - RNA, 19 nt, Homo sapiens
gaacagaacaguaaugaaa

SEQ ID NO: 665834 - RNA, 19 nt, Homo sapiens
gaagaacuaugaugagaaa

SEQ ID NO: 665835 - RNA, 19 nt, Homo sapiens
ggaaagacauaaagaagaa

SEQ ID NO: 665836 - RNA, 19 nt, Homo sapiens
gauauacaguccaauguua

SEQ ID NO: 665837 - RNA, 19 nt, Homo sapiens
aaagaaagcucucugaaau

SEQ ID NO: 665838 - RNA, 19 nt, Homo sapiens
caagaaaucucauuggaau

SEQ ID NO: 665839 - RNA, 19 nt, Homo sapiens
guaggaagaucuagagaaa

SEQ ID NO: 665840 - RNA, 19 nt, Homo sapiens
caucugaagucguuaauuu

SEQ ID NO: 665841 - RNA, 19 nt, Homo sapiens
caaagucaauggauaugua

SEQ ID NO: 665842 - RNA, 19 nt, Homo sapiens
gaaagcaaauuaacuaguc

SEQ ID NO: 665843 - RNA, 19 nt, Homo sapiens
gagcagaguucauaaauac

SEQ ID NO: 665844 - RNA, 19 nt, Homo sapiens
gaacaacacagucuauuau

SEQ ID NO: 665845 - RNA, 19 nt, Homo sapiens
gaauuuggguguauaccua

SEQ ID NO: 665846 - RNA, 19 nt, Homo sapiens
ugagaaagcaacaguauua

SEQ ID NO: 665847 - RNA, 19 nt, Homo sapiens
gcuagaggcuacuauauug

SEQ ID NO: 665848 - RNA, 19 nt, Homo sapiens
cacaggaacuuuagaaauu

SEQ ID NO: 665849 - RNA, 19 nt, Homo sapiens
agaauuaucugcccuaaga

SEQ ID NO: 665850 - RNA, 19 nt, Homo sapiens
gcagaaagagauaaacuaa

SEQ ID NO: 665851 - RNA, 19 nt, Homo sapiens
gaacuuugcauuaaacuug

SEQ ID NO: 665852 - RNA, 19 nt, Homo sapiens
gauuucagaugcuucauaa

SEQ ID NO: 665853 - RNA, 19 nt, Homo sapiens
gaaagucaguguuuaggau

SEQ ID NO: 665854 - RNA, 19 nt, Homo sapiens
gcacauaaaugcccaucau

SEQ ID NO: 665855 - RNA, 19 nt, Homo sapiens
gaaguuaacccuuucugaa

SEQ ID NO: 665856 - RNA, 19 nt, Homo sapiens
ugacucaucucaucagaaa

SEQ ID NO: 665857 - RNA, 19 nt, Homo sapiens
gaacagaaauuugggacau

SEQ ID NO: 665858 - RNA, 19 nt, Homo sapiens
gaggagacaucuucgagaa

SEQ ID NO: 665859 - RNA, 19 nt, Homo sapiens
gagcuaaaguggcacaguu

SEQ ID NO: 665860 - RNA, 19 nt, Homo sapiens
gagaaagaguggagcuauu

SEQ ID NO: 665861 - RNA, 19 nt, Homo sapiens
gaacuucuuucuauugaca

SEQ ID NO: 665862 - RNA, 19 nt, Homo sapiens
uaaucgagaucgugagaua

SEQ ID NO: 665863 - RNA, 19 nt, Homo sapiens
gagccaagaucaugccauu

SEQ ID NO: 665864 - RNA, 19 nt, Homo sapiens
gaauaauggcuuucaauga

SEQ ID NO: 665865 - RNA, 19 nt, Homo sapiens
ggagaaagcagcucaguuc

SEQ ID NO: 665866 - RNA, 19 nt, Homo sapiens
uagcagaggucuugguaaa

SEQ ID NO: 665867 - RNA, 19 nt, Homo sapiens
caaagaacucgaugaagua

SEQ ID NO: 665868 - RNA, 19 nt, Homo sapiens
gagagacuccaacauauaa

SEQ ID NO: 665869 - RNA, 19 nt, Homo sapiens
gugaugaacuccuuguaaa

SEQ ID NO: 665870 - RNA, 19 nt, Homo sapiens
gaacuuaugccagaaagaa

SEQ ID NO: 665871 - RNA, 19 nt, Homo sapiens
ggucuagucuucuuauaau

SEQ ID NO: 665872 - RNA, 19 nt, Homo sapiens
acaaagaacucgaugaagu

SEQ ID NO: 665873 - RNA, 19 nt, Homo sapiens
uaaugaagcucaggaagaa

SEQ ID NO: 665874 - RNA, 19 nt, Homo sapiens
gaacuaugaugagaaagau

SEQ ID NO: 665875 - RNA, 19 nt, Homo sapiens
caaauuaacuagucaaagc

SEQ ID NO: 665876 - RNA, 19 nt, Homo sapiens
gaagaauuaucugcccuaa

SEQ ID NO: 665877 - RNA, 19 nt, Homo sapiens
gcgaagaucuugcucuaca

SEQ ID NO: 665878 - RNA, 19 nt, Homo sapiens
ggagugcugucccauagaa

SEQ ID NO: 665879 - RNA, 19 nt, Homo sapiens
gaagauauacaguccaaug

SEQ ID NO: 665880 - RNA, 19 nt, Homo sapiens
cuucuaagccuguguguua

SEQ ID NO: 665881 - RNA, 19 nt, Homo sapiens
aaagcuauaugcagaguuu

SEQ ID NO: 665882 - RNA, 19 nt, Homo sapiens
acagaaauccagcuacuua

SEQ ID NO: 665883 - RNA, 19 nt, Homo sapiens
gaaauucaagagcacauaa

SEQ ID NO: 665884 - RNA, 19 nt, Homo sapiens
acagaagacugcaagauga

SEQ ID NO: 665885 - RNA, 19 nt, Homo sapiens
ugacauguguuaaucauca

SEQ ID NO: 665886 - RNA, 19 nt, Homo sapiens
cuagagagacuccaacaua

SEQ ID NO: 665887 - RNA, 19 nt, Homo sapiens
gagacuagaacauggaaua

SEQ ID NO: 665888 - RNA, 19 nt, Homo sapiens
aggcagaucucaacugaaa

SEQ ID NO: 665889 - RNA, 19 nt, Homo sapiens
ugagagacauacaguuaaa

SEQ ID NO: 665890 - RNA, 19 nt, Homo sapiens
uaaaugcccaucaugcuua

SEQ ID NO: 665891 - RNA, 19 nt, Homo sapiens
gaaaugaagagcagaguuc

SEQ ID NO: 665892 - RNA, 19 nt, Homo sapiens
uaagaugacuucacaggau

SEQ ID NO: 665893 - RNA, 19 nt, Homo sapiens
gaugugggcugguuugcuu

SEQ ID NO: 665894 - RNA, 19 nt, Homo sapiens
gcuaugcugucaugcuuaa

SEQ ID NO: 665895 - RNA, 19 nt, Homo sapiens
aaaggcagaucucaacuga

SEQ ID NO: 665896 - RNA, 19 nt, Homo sapiens
gacuggaacuucuuucuau

SEQ ID NO: 665897 - RNA, 19 nt, Homo sapiens
gaagagcagaguucauaaa

SEQ ID NO: 665898 - RNA, 19 nt, Homo sapiens
gaacuugcguuaucugacu

SEQ ID NO: 665899 - RNA, 19 nt, Homo sapiens
ugaaauagaucaguuagca

SEQ ID NO: 665900 - RNA, 19 nt, Homo sapiens
caauggauauguacuuuca

SEQ ID NO: 665901 - RNA, 19 nt, Homo sapiens
gcugagacaucaagaagau

SEQ ID NO: 665902 - RNA, 19 nt, Homo sapiens
cagcgaagaucuugcucua

SEQ ID NO: 665903 - RNA, 19 nt, Homo sapiens
ugaugcagcucacaaagaa

SEQ ID NO: 665904 - RNA, 19 nt, Homo sapiens
caauuuagguugacuuucu

SEQ ID NO: 665905 - RNA, 19 nt, Homo sapiens
gaacauggacacaaauucu

SEQ ID NO: 665906 - RNA, 19 nt, Homo sapiens
ucucagaucucaucaaugg

SEQ ID NO: 665907 - RNA, 19 nt, Homo sapiens
caucagaucacaagagaaa

SEQ ID NO: 665908 - RNA, 19 nt, Homo sapiens
gaagaagaacgagauuauu

SEQ ID NO: 665909 - RNA, 19 nt, Homo sapiens
gaggagugcugucccauag

SEQ ID NO: 665910 - RNA, 19 nt, Homo sapiens
aguagcagcuugauuuaaa

SEQ ID NO: 665911 - RNA, 19 nt, Homo sapiens
ugaaagagcaggagaguuc

SEQ ID NO: 665912 - RNA, 19 nt, Homo sapiens
aagaagagcugagacauca

SEQ ID NO: 665913 - RNA, 19 nt, Homo sapiens
uagagagacuccaacauau

SEQ ID NO: 665914 - RNA, 19 nt, Homo sapiens
ugaacaacacagucuauua

SEQ ID NO: 665915 - RNA, 19 nt, Homo sapiens
ggagacaucuucgagaaag

SEQ ID NO: 665916 - RNA, 19 nt, Homo sapiens
gccuguguguuauaauuua

SEQ ID NO: 665917 - RNA, 19 nt, Homo sapiens
cgagaaggauacagaaauc

SEQ ID NO: 665918 - RNA, 19 nt, Homo sapiens
agagcagaguucauaaaua

SEQ ID NO: 665919 - RNA, 19 nt, Homo sapiens
ugaaagguauagaagaaga

SEQ ID NO: 665920 - RNA, 19 nt, Homo sapiens
aaugagagacauacaguua

SEQ ID NO: 665921 - RNA, 19 nt, Homo sapiens
agaaagaguggagcuauua

SEQ ID NO: 665922 - RNA, 19 nt, Homo sapiens
gcucaaaugaagauaauga

SEQ ID NO: 665923 - RNA, 19 nt, Homo sapiens
uaagaaagagcuagagaga

SEQ ID NO: 665924 - RNA, 19 nt, Homo sapiens
ucugaaagguauagaagaa

SEQ ID NO: 665925 - RNA, 19 nt, Homo sapiens
gccaugauauguguaugua

SEQ ID NO: 665926 - RNA, 19 nt, Homo sapiens
ugaaagauacgaacgagaa

SEQ ID NO: 665927 - RNA, 19 nt, Homo sapiens
agaaaggaauccacccaaa

SEQ ID NO: 665928 - RNA, 19 nt, Homo sapiens
gagacuccaacauauaaua

SEQ ID NO: 665929 - RNA, 19 nt, Homo sapiens
agaaagagcuagagagacu

SEQ ID NO: 665930 - RNA, 19 nt, Homo sapiens
uagaaacuguuguucauca

SEQ ID NO: 665931 - RNA, 19 nt, Homo sapiens
gaagaaagguguucacaaa

SEQ ID NO: 665932 - RNA, 19 nt, Homo sapiens
gaacaggucucacaaguau

SEQ ID NO: 665933 - RNA, 19 nt, Homo sapiens
gcacgaggaucuucaaaug

SEQ ID NO: 665934 - RNA, 19 nt, Homo sapiens
gcagccaccuuauuucaua

SEQ ID NO: 665935 - RNA, 19 nt, Homo sapiens
guacauaggcuaauuaaug

SEQ ID NO: 665936 - RNA, 19 nt, Homo sapiens
caagaugaauggcuaauau

SEQ ID NO: 665937 - RNA, 19 nt, Homo sapiens
ggacacgggugccuaugua

SEQ ID NO: 665938 - RNA, 19 nt, Homo sapiens
uagcaaagcucuaccauuc

SEQ ID NO: 665939 - RNA, 19 nt, Homo sapiens
caaaugauguuguguuuag

SEQ ID NO: 665940 - RNA, 19 nt, Homo sapiens
ggacuucuuugcauaugua

SEQ ID NO: 665941 - RNA, 19 nt, Homo sapiens
gaaaucggguggagaugaa

SEQ ID NO: 665942 - RNA, 19 nt, Homo sapiens
gagaauggcuacaaguuuc

SEQ ID NO: 665943 - RNA, 19 nt, Homo sapiens
gaacuggaaugacaagauc

SEQ ID NO: 665944 - RNA, 19 nt, Homo sapiens
ccaaacagcugccagaauc

SEQ ID NO: 665945 - RNA, 19 nt, Homo sapiens
ggacacaugggccuucuua

SEQ ID NO: 665946 - RNA, 19 nt, Homo sapiens
gaaacaccaucucagaguu

SEQ ID NO: 665947 - RNA, 19 nt, Homo sapiens
cagaagagcuugccuaagg

SEQ ID NO: 665948 - RNA, 19 nt, Homo sapiens
gagaaagcaugaccaaaca

SEQ ID NO: 665949 - RNA, 19 nt, Homo sapiens
ggaaacaagucaucguauc

SEQ ID NO: 665950 - RNA, 19 nt, Homo sapiens
gagcucacaucgugucuga

SEQ ID NO: 665951 - RNA, 19 nt, Homo sapiens
aaugaaagcugcucaaagu

SEQ ID NO: 665952 - RNA, 19 nt, Homo sapiens
gauccuggguucuguuuau

SEQ ID NO: 665953 - RNA, 19 nt, Homo sapiens
gagcugcacucuuaacauc

SEQ ID NO: 665954 - RNA, 19 nt, Homo sapiens
ggagauggcaggcagauug

SEQ ID NO: 665955 - RNA, 19 nt, Homo sapiens
uggagcauaucauuacuua

SEQ ID NO: 665956 - RNA, 19 nt, Homo sapiens
gagaugcccucgagugugu

SEQ ID NO: 665957 - RNA, 19 nt, Homo sapiens
gaugauuacuauugcugua

SEQ ID NO: 665958 - RNA, 19 nt, Homo sapiens
cuugacagcucuucucuuu

SEQ ID NO: 665959 - RNA, 19 nt, Homo sapiens
gagcauaucauuacuuauc

SEQ ID NO: 665960 - RNA, 19 nt, Homo sapiens
gcugugaggugcucgugua

SEQ ID NO: 665961 - RNA, 19 nt, Homo sapiens
caagaaagaaccaaaggaa

SEQ ID NO: 665962 - RNA, 19 nt, Homo sapiens
ugaggagacugaagaagaa

SEQ ID NO: 665963 - RNA, 19 nt, Homo sapiens
ggccaacccuuuaaagaau

SEQ ID NO: 665964 - RNA, 19 nt, Homo sapiens
gaaacaagucaucguauca

SEQ ID NO: 665965 - RNA, 19 nt, Homo sapiens
gaugauauuuaccuugaug

SEQ ID NO: 665966 - RNA, 19 nt, Homo sapiens
gagcuuccaggguuuaaua

SEQ ID NO: 665967 - RNA, 19 nt, Homo sapiens
cagcacaacuucauauaag

SEQ ID NO: 665968 - RNA, 19 nt, Homo sapiens
gcagcacaacuucauauaa

SEQ ID NO: 665969 - RNA, 19 nt, Homo sapiens
acacagcccuuccacaguu

SEQ ID NO: 665970 - RNA, 19 nt, Homo sapiens
ggaaaggugugccauaagc

SEQ ID NO: 665971 - RNA, 19 nt, Homo sapiens
ggagaaagaaauacaaaca

SEQ ID NO: 665972 - RNA, 19 nt, Homo sapiens
ugacagcucuucucuuugg

SEQ ID NO: 665973 - RNA, 19 nt, Homo sapiens
guuccagacuguagaauau

SEQ ID NO: 665974 - RNA, 19 nt, Homo sapiens
gcaaagcucuaccauucca

SEQ ID NO: 665975 - RNA, 19 nt, Homo sapiens
ccaaagagaaagugauuga

SEQ ID NO: 665976 - RNA, 19 nt, Homo sapiens
gaggaagaaugagagcuuu

SEQ ID NO: 665977 - RNA, 19 nt, Homo sapiens
gcacaacuucauauaagaa

SEQ ID NO: 665978 - RNA, 19 nt, Homo sapiens
cgaaagagagaaagcauga

SEQ ID NO: 665979 - RNA, 19 nt, Homo sapiens
guguuuaacugagcuuaua

SEQ ID NO: 665980 - RNA, 19 nt, Homo sapiens
cacaggagcucgaagaauc

SEQ ID NO: 665981 - RNA, 19 nt, Homo sapiens
gauggcagcuaucaguguu

SEQ ID NO: 665982 - RNA, 19 nt, Homo sapiens
gcaagaugaauggcuaaua

SEQ ID NO: 665983 - RNA, 19 nt, Homo sapiens
acaaggaagucagcucuuu

SEQ ID NO: 665984 - RNA, 19 nt, Homo sapiens
gccaacccuuuaaagaaua

SEQ ID NO: 665985 - RNA, 19 nt, Homo sapiens
gcagagacaauguugaaau

SEQ ID NO: 665986 - RNA, 19 nt, Homo sapiens
ccagagaaguucaaaauug

SEQ ID NO: 665987 - RNA, 19 nt, Homo sapiens
aagacaagaugccaaagaa

SEQ ID NO: 665988 - RNA, 19 nt, Homo sapiens
gaaguugcagcucuuuauu

SEQ ID NO: 665989 - RNA, 19 nt, Homo sapiens
ucagugaaguugagaagga

SEQ ID NO: 665990 - RNA, 19 nt, Homo sapiens
gcucuucccuccaauuaca

SEQ ID NO: 665991 - RNA, 19 nt, Homo sapiens
ggacuuauagacaauccua

SEQ ID NO: 665992 - RNA, 19 nt, Homo sapiens
agaaaacccuggacuuaua

SEQ ID NO: 665993 - RNA, 19 nt, Homo sapiens
ccuaggacagcuacaauua

SEQ ID NO: 665994 - RNA, 19 nt, Homo sapiens
gaucagagucucacaugga

SEQ ID NO: 665995 - RNA, 19 nt, Homo sapiens
gcagaagacacaugugaug

SEQ ID NO: 665996 - RNA, 19 nt, Homo sapiens
caaaggagauuggaugacu

SEQ ID NO: 665997 - RNA, 19 nt, Homo sapiens
cagucuaagucucguauuu

SEQ ID NO: 665998 - RNA, 19 nt, Homo sapiens
gcagaaaacccuggacuua

SEQ ID NO: 665999 - RNA, 19 nt, Homo sapiens
caaaccggcagcuaaagua

SEQ ID NO: 666000 - RNA, 19 nt, Homo sapiens
gcagcaggauggcagcuau

SEQ ID NO: 666001 - RNA, 19 nt, Homo sapiens
aaaaugggauguccuaaaa

SEQ ID NO: 666002 - RNA, 19 nt, Homo sapiens
gaagcugccugugcacguu

SEQ ID NO: 666003 - RNA, 19 nt, Homo sapiens
ggaccuggaugaccugucu

SEQ ID NO: 666004 - RNA, 19 nt, Homo sapiens
gaaagaaccaaaggaaaca

SEQ ID NO: 666005 - RNA, 19 nt, Homo sapiens
gcucuaccauuccaucaau

SEQ ID NO: 666006 - RNA, 19 nt, Homo sapiens
cccaaaugauguuguguuu

SEQ ID NO: 666007 - RNA, 19 nt, Homo sapiens
gacaagaugccaaagaaau

SEQ ID NO: 666008 - RNA, 19 nt, Homo sapiens
gaaggagaaagaaauacaa

SEQ ID NO: 666009 - RNA, 19 nt, Homo sapiens
cacaugaaguugggugaua

SEQ ID NO: 666010 - RNA, 19 nt, Homo sapiens
gcagugcaguggaucuuca

SEQ ID NO: 666011 - RNA, 19 nt, Homo sapiens
guccugagauccaaagaga

SEQ ID NO: 666012 - RNA, 19 nt, Homo sapiens
ugucucaaaccaugaauua

SEQ ID NO: 666013 - RNA, 19 nt, Homo sapiens
ugacauuuguucuuucugu

SEQ ID NO: 666014 - RNA, 19 nt, Homo sapiens
cagagacaauguugaaauc

SEQ ID NO: 666015 - RNA, 19 nt, Homo sapiens
gaaggugggucuuaaaaca

SEQ ID NO: 666016 - RNA, 19 nt, Homo sapiens
ccacagagaagugauagaa

SEQ ID NO: 666017 - RNA, 19 nt, Homo sapiens
gcagcucccaugauccuua

SEQ ID NO: 666018 - RNA, 19 nt, Homo sapiens
ccauaaaccuggcccucuu

SEQ ID NO: 666019 - RNA, 19 nt, Homo sapiens
ggccugggaucccuccuuu

SEQ ID NO: 666020 - RNA, 19 nt, Homo sapiens
ggaaaccguccaaaugaug

SEQ ID NO: 666021 - RNA, 19 nt, Homo sapiens
gaaagguguucacaaaaga

SEQ ID NO: 666022 - RNA, 19 nt, Homo sapiens
acaauuacaccaucagaaa

SEQ ID NO: 666023 - RNA, 19 nt, Homo sapiens
gcaggcagauugggcucua

SEQ ID NO: 666024 - RNA, 19 nt, Homo sapiens
ugagagcuuuguguguuua

SEQ ID NO: 666025 - RNA, 19 nt, Homo sapiens
aaccagggcugucuucaga

SEQ ID NO: 666026 - RNA, 19 nt, Homo sapiens
gacguuacccucucccuuu

SEQ ID NO: 666027 - RNA, 19 nt, Homo sapiens
caaaugcuuccuugaaaga

SEQ ID NO: 666028 - RNA, 19 nt, Homo sapiens
aaugagagcuuuguguguu

SEQ ID NO: 666029 - RNA, 19 nt, Homo sapiens
ccaugcagccaccuuauuu

SEQ ID NO: 666030 - RNA, 19 nt, Homo sapiens
aaauaaugcugaucuagag

SEQ ID NO: 666031 - RNA, 19 nt, Homo sapiens
gaaagaggauuauacagaa

SEQ ID NO: 666032 - RNA, 19 nt, Homo sapiens
ggacaaaucuucaggacuu

SEQ ID NO: 666033 - RNA, 19 nt, Homo sapiens
gaacugacauuugaugaaa

SEQ ID NO: 666034 - RNA, 19 nt, Homo sapiens
caaaguaacuacagacuau

SEQ ID NO: 666035 - RNA, 19 nt, Homo sapiens
uaaagaagccagcuaauuu

SEQ ID NO: 666036 - RNA, 19 nt, Homo sapiens
gggcucagcuggcaaagua

SEQ ID NO: 666037 - RNA, 19 nt, Homo sapiens
gcaagaggauauugacaaa

SEQ ID NO: 666038 - RNA, 19 nt, Homo sapiens
ugacauagauccuacagaa

SEQ ID NO: 666039 - RNA, 19 nt, Homo sapiens
gaucauggcaucugcuuua

SEQ ID NO: 666040 - RNA, 19 nt, Homo sapiens
uaacuaaccugcacauugu

SEQ ID NO: 666041 - RNA, 19 nt, Homo sapiens
gaaaucacacccugagaua

SEQ ID NO: 666042 - RNA, 19 nt, Homo sapiens
gagaaaggaugaauauauc

SEQ ID NO: 666043 - RNA, 19 nt, Homo sapiens
guaguuaccuagauuguga

SEQ ID NO: 666044 - RNA, 19 nt, Homo sapiens
gaaacuagcagagcuuuaa

SEQ ID NO: 666045 - RNA, 19 nt, Homo sapiens
ggaagaaacugagaauaag

SEQ ID NO: 666046 - RNA, 19 nt, Homo sapiens
ggaaauugaaggaugcuua

SEQ ID NO: 666047 - RNA, 19 nt, Homo sapiens
gaggaaagaaagaggauua

SEQ ID NO: 666048 - RNA, 19 nt, Homo sapiens
caagacaacugaaagcaau

SEQ ID NO: 666049 - RNA, 19 nt, Homo sapiens
ccaaagaagucaggacaaa

SEQ ID NO: 666050 - RNA, 19 nt, Homo sapiens
ccuagaaucacuucaauua

SEQ ID NO: 666051 - RNA, 19 nt, Homo sapiens
uagaagaguuacagaauga

SEQ ID NO: 666052 - RNA, 19 nt, Homo sapiens
gaaaaucagugucaaaugu

SEQ ID NO: 666053 - RNA, 19 nt, Homo sapiens
gaagagcaguugaggaaag

SEQ ID NO: 666054 - RNA, 19 nt, Homo sapiens
gaacuaaguccaccucuca

SEQ ID NO: 666055 - RNA, 19 nt, Homo sapiens
gaaaguugauaucucugaa

SEQ ID NO: 666056 - RNA, 19 nt, Homo sapiens
gaagaagagccuuguguga

SEQ ID NO: 666057 - RNA, 19 nt, Homo sapiens
gaccgaagaucaguuuaaa

SEQ ID NO: 666058 - RNA, 19 nt, Homo sapiens
uaaggaugcugcaauguga

SEQ ID NO: 666059 - RNA, 19 nt, Homo sapiens
ugacuuaugccuccuguua

SEQ ID NO: 666060 - RNA, 19 nt, Homo sapiens
gauauaagaccgaagauca

SEQ ID NO: 666061 - RNA, 19 nt, Homo sapiens
gaaagaaagaggauuauac

SEQ ID NO: 666062 - RNA, 19 nt, Homo sapiens
ugacauaccuacugaucuu

SEQ ID NO: 666063 - RNA, 19 nt, Homo sapiens
gggaaauaguaaagaagua

SEQ ID NO: 666064 - RNA, 19 nt, Homo sapiens
gaauaaauuucuggugaug

SEQ ID NO: 666065 - RNA, 19 nt, Homo sapiens
agagagaaguugcagcuaa

SEQ ID NO: 666066 - RNA, 19 nt, Homo sapiens
caaagcagcagccaaagaa

SEQ ID NO: 666067 - RNA, 19 nt, Homo sapiens
gaagcucaguuuucuuuua

SEQ ID NO: 666068 - RNA, 19 nt, Homo sapiens
uuaaagaucuccaggaagu

SEQ ID NO: 666069 - RNA, 19 nt, Homo sapiens
gauacaguuugcagaaauu

SEQ ID NO: 666070 - RNA, 19 nt, Homo sapiens
ggaaagaaagaggauuaua

SEQ ID NO: 666071 - RNA, 19 nt, Homo sapiens
guaacuaaccugcacauug

SEQ ID NO: 666072 - RNA, 19 nt, Homo sapiens
gaaggaugcuuauggaaaa

SEQ ID NO: 666073 - RNA, 19 nt, Homo sapiens
ucaaauccaugcuaaagau

SEQ ID NO: 666074 - RNA, 19 nt, Homo sapiens
ggaugaauauaucaccauu

SEQ ID NO: 666075 - RNA, 19 nt, Homo sapiens
gaaacaagauugcauuccu

SEQ ID NO: 666076 - RNA, 19 nt, Homo sapiens
ucaagaggauucugcaaug

SEQ ID NO: 666077 - RNA, 19 nt, Homo sapiens
gagaaucccauugagaaua

SEQ ID NO: 666078 - RNA, 19 nt, Homo sapiens
gcauuaaagggcaguauuu

SEQ ID NO: 666079 - RNA, 19 nt, Homo sapiens
gaugaagauuuaccuacaa

SEQ ID NO: 666080 - RNA, 19 nt, Homo sapiens
ugaagcagauggaauuuua

SEQ ID NO: 666081 - RNA, 19 nt, Homo sapiens
gagauacaguuugcagaaa

SEQ ID NO: 666082 - RNA, 19 nt, Homo sapiens
gggauauccuccuuaguga

SEQ ID NO: 666083 - RNA, 19 nt, Homo sapiens
acaagaaauuggagacaaa

SEQ ID NO: 666084 - RNA, 19 nt, Homo sapiens
uacagaagcugagaauaaa

SEQ ID NO: 666085 - RNA, 19 nt, Homo sapiens
auacagaagcugagaauaa

SEQ ID NO: 666086 - RNA, 19 nt, Homo sapiens
gcacaccagauuaauauug

SEQ ID NO: 666087 - RNA, 19 nt, Homo sapiens
uaacagccgagguguauuu

SEQ ID NO: 666088 - RNA, 19 nt, Homo sapiens
ucagcuaucugucuaccua

SEQ ID NO: 666089 - RNA, 19 nt, Homo sapiens
gcaaaguaacuacagacua

SEQ ID NO: 666090 - RNA, 19 nt, Homo sapiens
gaaugaggaagaagaacua

SEQ ID NO: 666091 - RNA, 19 nt, Homo sapiens
gaaccgccaucuucugaca

SEQ ID NO: 666092 - RNA, 19 nt, Homo sapiens
ggaguuaccgcaauccaaa

SEQ ID NO: 666093 - RNA, 19 nt, Homo sapiens
agaaugugcuggaauccua

SEQ ID NO: 666094 - RNA, 19 nt, Homo sapiens
ggcaagcaguggaauaaga

SEQ ID NO: 666095 - RNA, 19 nt, Homo sapiens
gacuuuacguuucuugauu

SEQ ID NO: 666096 - RNA, 19 nt, Homo sapiens
gaaauugaaggaugcuuau

SEQ ID NO: 666097 - RNA, 19 nt, Homo sapiens
gaagaccccuugugaaaga

SEQ ID NO: 666098 - RNA, 19 nt, Homo sapiens
gcagacauccugagacugu

SEQ ID NO: 666099 - RNA, 19 nt, Homo sapiens
ugauguaccuggaauuguu

SEQ ID NO: 666100 - RNA, 19 nt, Homo sapiens
cuacagaagaugaagauuu

SEQ ID NO: 666101 - RNA, 19 nt, Homo sapiens
ggacugcuagaauuucaua

SEQ ID NO: 666102 - RNA, 19 nt, Homo sapiens
caaagucaagcaaggauuu

SEQ ID NO: 666103 - RNA, 19 nt, Homo sapiens
gaaaaggaaugucucaauc

SEQ ID NO: 666104 - RNA, 19 nt, Homo sapiens
ggaccucaauacccaguga

SEQ ID NO: 666105 - RNA, 19 nt, Homo sapiens
gaauaucucccuugauuac

SEQ ID NO: 666106 - RNA, 19 nt, Homo sapiens
gaagaacaccaguuauaag

SEQ ID NO: 666107 - RNA, 19 nt, Homo sapiens
gaagauuuaccuacaacuu

SEQ ID NO: 666108 - RNA, 19 nt, Homo sapiens
cauucaagcuggcaauuau

SEQ ID NO: 666109 - RNA, 19 nt, Homo sapiens
ggaguacaauauaaaugug

SEQ ID NO: 666110 - RNA, 19 nt, Homo sapiens
gcagucagcguauugaaau

SEQ ID NO: 666111 - RNA, 19 nt, Homo sapiens
ggagcaaguuauagaaagu

SEQ ID NO: 666112 - RNA, 19 nt, Homo sapiens
ugaagaacaccaguuauaa

SEQ ID NO: 666113 - RNA, 19 nt, Homo sapiens
gaagaugaagauuuaccua

SEQ ID NO: 666114 - RNA, 19 nt, Homo sapiens
gcauauuucuuaggauguu

SEQ ID NO: 666115 - RNA, 19 nt, Homo sapiens
uaugugcucuucaauauag

SEQ ID NO: 666116 - RNA, 19 nt, Homo sapiens
gaaggaagaaacugagaau

SEQ ID NO: 666117 - RNA, 19 nt, Homo sapiens
ggaaaggcuugcucgucaa

SEQ ID NO: 666118 - RNA, 19 nt, Homo sapiens
ucuauagccuggaugaauu

SEQ ID NO: 666119 - RNA, 19 nt, Homo sapiens
gaggaaagaacaagcaaau

SEQ ID NO: 666120 - RNA, 19 nt, Homo sapiens
caacugaacaaacaggaaa

SEQ ID NO: 666121 - RNA, 19 nt, Homo sapiens
gauguuauccugcuaucaa

SEQ ID NO: 666122 - RNA, 19 nt, Homo sapiens
gaaggagaaucccauugag

SEQ ID NO: 666123 - RNA, 19 nt, Homo sapiens
ucuaucaucugcuucauau

SEQ ID NO: 666124 - RNA, 19 nt, Homo sapiens
ccagaauggugaggaaauu

SEQ ID NO: 666125 - RNA, 19 nt, Homo sapiens
uaucaaagcagcagccaaa

SEQ ID NO: 666126 - RNA, 19 nt, Homo sapiens
gcucuucaauauagugcua

SEQ ID NO: 666127 - RNA, 19 nt, Homo sapiens
ugcaagauuucccaguuua

SEQ ID NO: 666128 - RNA, 19 nt, Homo sapiens
aagagcaacuuucuaugaa

SEQ ID NO: 666129 - RNA, 19 nt, Homo sapiens
gaaaucauacagaggaugu

SEQ ID NO: 666130 - RNA, 19 nt, Homo sapiens
aggaagaaacugagaauaa

SEQ ID NO: 666131 - RNA, 19 nt, Homo sapiens
gcaagauccugaugaaauu

SEQ ID NO: 666132 - RNA, 19 nt, Homo sapiens
caagagauguguuaaagga

SEQ ID NO: 666133 - RNA, 19 nt, Homo sapiens
caaaguaacuccggacauu

SEQ ID NO: 666134 - RNA, 19 nt, Homo sapiens
ggaagagggugauuuagau

SEQ ID NO: 666135 - RNA, 19 nt, Homo sapiens
gaaaggagagcccgucauu

SEQ ID NO: 666136 - RNA, 19 nt, Homo sapiens
ggaggaagaggaccuauuu

SEQ ID NO: 666137 - RNA, 19 nt, Homo sapiens
ggacggucgugauggauaa

SEQ ID NO: 666138 - RNA, 19 nt, Homo sapiens
aagagaagauugagaagaa

SEQ ID NO: 666139 - RNA, 19 nt, Homo sapiens
aaacugaaguggcgaauag

SEQ ID NO: 666140 - RNA, 19 nt, Homo sapiens
caagaaggcgguuaaagaa

SEQ ID NO: 666141 - RNA, 19 nt, Homo sapiens
gaagaggaccuauuugaca

SEQ ID NO: 666142 - RNA, 19 nt, Homo sapiens
ugagggcgcugaucagaaa

SEQ ID NO: 666143 - RNA, 19 nt, Homo sapiens
uggagaaccugcagaauau

SEQ ID NO: 666144 - RNA, 19 nt, Homo sapiens
acaaaucggucuagaguca

SEQ ID NO: 666145 - RNA, 19 nt, Homo sapiens
gaaagcguguggcaaugga

SEQ ID NO: 666146 - RNA, 19 nt, Homo sapiens
ucaagaaggcgguuaaaga

SEQ ID NO: 666147 - RNA, 19 nt, Homo sapiens
uuaaaggacugaagaugga

SEQ ID NO: 666148 - RNA, 19 nt, Homo sapiens
ggaggaaguuugauuuuga

SEQ ID NO: 666149 - RNA, 19 nt, Homo sapiens
gaggaaggcacagaagaua

SEQ ID NO: 666150 - RNA, 19 nt, Homo sapiens
agaaggcgguuaaagaaga

SEQ ID NO: 666151 - RNA, 19 nt, Homo sapiens
gccaagagauguguuaaag

SEQ ID NO: 666152 - RNA, 19 nt, Homo sapiens
ugaaauuggcaucgaguua

SEQ ID NO: 666153 - RNA, 19 nt, Homo sapiens
gaagagaagauugagaaga

SEQ ID NO: 666154 - RNA, 19 nt, Homo sapiens
gaagagggugauuuagauu

SEQ ID NO: 666155 - RNA, 19 nt, Homo sapiens
acaagcagguccaaagaga

SEQ ID NO: 666156 - RNA, 19 nt, Homo sapiens
ggucuagagucaccaaauc

SEQ ID NO: 666157 - RNA, 19 nt, Homo sapiens
cugaagacauuaagaagga

SEQ ID NO: 666158 - RNA, 19 nt, Homo sapiens
caucagccaucuccacaga

SEQ ID NO: 666159 - RNA, 19 nt, Homo sapiens
ggaaggcacagaagauaau

SEQ ID NO: 666160 - RNA, 19 nt, Homo sapiens
ggcaagauccugaugaaau

SEQ ID NO: 666161 - RNA, 19 nt, Homo sapiens
ccacagaacugagcugcau

SEQ ID NO: 666162 - RNA, 19 nt, Homo sapiens
gggccaaagugguaacgaa

SEQ ID NO: 666163 - RNA, 19 nt, Homo sapiens
uaagaacacuuuggaaacu

SEQ ID NO: 666164 - RNA, 19 nt, Homo sapiens
caacaagagcguccugaug

SEQ ID NO: 666165 - RNA, 19 nt, Homo sapiens
gaaauuggcaucgaguuag

SEQ ID NO: 666166 - RNA, 19 nt, Homo sapiens
gaaacugaaguggcgaaua

SEQ ID NO: 666167 - RNA, 19 nt, Homo sapiens
caagaagucagccaagaga

SEQ ID NO: 666168 - RNA, 19 nt, Homo sapiens
gaagacgggaggaaguuug

SEQ ID NO: 666169 - RNA, 19 nt, Homo sapiens
guagcucaauacaauguga

SEQ ID NO: 666170 - RNA, 19 nt, Homo sapiens
gacaagaggcugagugaag

SEQ ID NO: 666171 - RNA, 19 nt, Homo sapiens
gacgagaugaugccuauug

SEQ ID NO: 666172 - RNA, 19 nt, Homo sapiens
gaacgggagauccgcgaaa

SEQ ID NO: 666173 - RNA, 19 nt, Homo sapiens
aaagagagaagcuccaaga

SEQ ID NO: 666174 - RNA, 19 nt, Homo sapiens
guaaaucugagccaguaaa

SEQ ID NO: 666175 - RNA, 19 nt, Homo sapiens
cuggagaaccugcagaaua

SEQ ID NO: 666176 - RNA, 19 nt, Homo sapiens
ggaggaaggcacagaagau

SEQ ID NO: 666177 - RNA, 19 nt, Homo sapiens
caucuugucguuugauaaa

SEQ ID NO: 666178 - RNA, 19 nt, Homo sapiens
aaaugagccugcugggaaa

SEQ ID NO: 666179 - RNA, 19 nt, Homo sapiens
gcaaagaagacgggaggaa

SEQ ID NO: 666180 - RNA, 19 nt, Homo sapiens
ggacaugagugugcuagac

SEQ ID NO: 666181 - RNA, 19 nt, Homo sapiens
gaagucagccaagagaugu

SEQ ID NO: 666182 - RNA, 19 nt, Homo sapiens
cgugauggauaaaucgaaa

SEQ ID NO: 666183 - RNA, 19 nt, Homo sapiens
gcaaguaugggaagguugu

SEQ ID NO: 666184 - RNA, 19 nt, Homo sapiens
agagggugauuuagauuug

SEQ ID NO: 666185 - RNA, 19 nt, Homo sapiens
ggcauuccauuuuccauua

SEQ ID NO: 666186 - RNA, 19 nt, Homo sapiens
ggcauuccauuuuccauua

SEQ ID NO: 666187 - RNA, 19 nt, Homo sapiens
ucaauacaaugugaacuca

SEQ ID NO: 666188 - RNA, 19 nt, Homo sapiens
ccagagauagcaaagaaga

SEQ ID NO: 666189 - RNA, 19 nt, Homo sapiens
gggcagcacuauggagaug

SEQ ID NO: 666190 - RNA, 19 nt, Homo sapiens
gacgaaugaucuccguaga

SEQ ID NO: 666191 - RNA, 19 nt, Homo sapiens
agccagagauagcaaagaa

SEQ ID NO: 666192 - RNA, 19 nt, Homo sapiens
gcgagaggacggacuguga

SEQ ID NO: 666193 - RNA, 19 nt, Homo sapiens
cagacgcacuguugaaucu

SEQ ID NO: 666194 - RNA, 19 nt, Homo sapiens
ccgacgagaugaugccuau

SEQ ID NO: 666195 - RNA, 19 nt, Homo sapiens
ccacaagcagguccaaaga

SEQ ID NO: 666196 - RNA, 19 nt, Homo sapiens
gccagaaaaugagaaaaua

SEQ ID NO: 666197 - RNA, 19 nt, Homo sapiens
gaaggcgguuaaagaagag

SEQ ID NO: 666198 - RNA, 19 nt, Homo sapiens
uaaauguguucuuguucug

SEQ ID NO: 666199 - RNA, 19 nt, Homo sapiens
caagucagaaagcaaagaa

SEQ ID NO: 666200 - RNA, 19 nt, Homo sapiens
cuacaaaucggucuagagu

SEQ ID NO: 666201 - RNA, 19 nt, Homo sapiens
cagcaaguaugggaagguu

SEQ ID NO: 666202 - RNA, 19 nt, Homo sapiens
ucaagaaccuuuucagcaa

SEQ ID NO: 666203 - RNA, 19 nt, Homo sapiens
cuacggaucucaagaaccu

SEQ ID NO: 666204 - RNA, 19 nt, Homo sapiens
ccuguuagcgguagugaaa

SEQ ID NO: 666205 - RNA, 19 nt, Homo sapiens
ccgauaucgugcagacuuu

SEQ ID NO: 666206 - RNA, 19 nt, Homo sapiens
gaucgcaagucagaaagca

SEQ ID NO: 666207 - RNA, 19 nt, Homo sapiens
uaagaaggaagagaagauu

SEQ ID NO: 666208 - RNA, 19 nt, Homo sapiens
gcaagaagucagccaagag

SEQ ID NO: 666209 - RNA, 19 nt, Homo sapiens
ggaggaggaaggcacagaa

SEQ ID NO: 666210 - RNA, 19 nt, Homo sapiens
aaauuggcaucgaguuaga

SEQ ID NO: 666211 - RNA, 19 nt, Homo sapiens
gggaaacuuguaaaucuga

SEQ ID NO: 666212 - RNA, 19 nt, Homo sapiens
gagucaggaucgcaaguca

SEQ ID NO: 666213 - RNA, 19 nt, Homo sapiens
agaaggaagagaagauuga

SEQ ID NO: 666214 - RNA, 19 nt, Homo sapiens
gcgcuacggaucucaagaa

SEQ ID NO: 666215 - RNA, 19 nt, Homo sapiens
cggaagagggugauuuaga

SEQ ID NO: 666216 - RNA, 19 nt, Homo sapiens
uaacgaggcauuccauuuu

SEQ ID NO: 666217 - RNA, 19 nt, Homo sapiens
uuaacgaggcauuccauuu

SEQ ID NO: 666218 - RNA, 19 nt, Homo sapiens
uaacgaggcauuccauuuu

SEQ ID NO: 666219 - RNA, 19 nt, Homo sapiens
uuaacgaggcauuccauuu

SEQ ID NO: 666220 - RNA, 19 nt, Homo sapiens
aaggagagcccgucauuag

SEQ ID NO: 666221 - RNA, 19 nt, Homo sapiens
gaaaagagugcgaagugaa

SEQ ID NO: 666222 - RNA, 19 nt, Homo sapiens
ggaagaggaccuauuugac

SEQ ID NO: 666223 - RNA, 19 nt, Homo sapiens
gauuuaagaacacuuugga

SEQ ID NO: 666224 - RNA, 19 nt, Homo sapiens
ggaagcaagucuggagaac

SEQ ID NO: 666225 - RNA, 19 nt, Homo sapiens
gggcagacgcacuguugaa

SEQ ID NO: 666226 - RNA, 19 nt, Homo sapiens
gaaacccggaccuacaaau

SEQ ID NO: 666227 - RNA, 19 nt, Homo sapiens
gagcugaaacccggaccua

SEQ ID NO: 666228 - RNA, 19 nt, Homo sapiens
gagcugcauggacgaauga

SEQ ID NO: 666229 - RNA, 19 nt, Homo sapiens
gaaagcuugcggaggaaga

SEQ ID NO: 666230 - RNA, 19 nt, Homo sapiens
caggaucgcaagucagaaa

SEQ ID NO: 666231 - RNA, 19 nt, Homo sapiens
ucagagaacucaugaaaua

SEQ ID NO: 666232 - RNA, 19 nt, Homo sapiens
ggagagaaauccuauauau

SEQ ID NO: 666233 - RNA, 19 nt, Homo sapiens
gguaaaggcuucacuauga

SEQ ID NO: 666234 - RNA, 19 nt, Homo sapiens
gggaagagcaugcuuauua

SEQ ID NO: 666235 - RNA, 19 nt, Homo sapiens
cagcauaccuugcaucaua

SEQ ID NO: 666236 - RNA, 19 nt, Homo sapiens
gaacaucaacgaacucaua

SEQ ID NO: 666237 - RNA, 19 nt, Homo sapiens
caucagagauuucacagua

SEQ ID NO: 666238 - RNA, 19 nt, Homo sapiens
ggaaagcguuugucaagaa

SEQ ID NO: 666239 - RNA, 19 nt, Homo sapiens
gaacaucagcgaacucaua

SEQ ID NO: 666240 - RNA, 19 nt, Homo sapiens
aaacagagcuugcuuuaca

SEQ ID NO: 666241 - RNA, 19 nt, Homo sapiens
gggaaaggcuucaccauga

SEQ ID NO: 666242 - RNA, 19 nt, Homo sapiens
cagaaaggcuucaacauga

SEQ ID NO: 666243 - RNA, 19 nt, Homo sapiens
gaaacgcuaucucauugua

SEQ ID NO: 666244 - RNA, 19 nt, Homo sapiens
gcagauauauuucauacug

SEQ ID NO: 666245 - RNA, 19 nt, Homo sapiens
gcagcuaaauucucuguaa

SEQ ID NO: 666246 - RNA, 19 nt, Homo sapiens
gaagagccgucuaauuguu

SEQ ID NO: 666247 - RNA, 19 nt, Homo sapiens
ggaaacagagcuugcuuua

SEQ ID NO: 666248 - RNA, 19 nt, Homo sapiens
ggagagaaaccauauauau

SEQ ID NO: 666249 - RNA, 19 nt, Homo sapiens
ggaaaagucuucacuauga

SEQ ID NO: 666250 - RNA, 19 nt, Homo sapiens
ucagagaaaucauacagua

SEQ ID NO: 666251 - RNA, 19 nt, Homo sapiens
ggaagagcaugcuuauuau

SEQ ID NO: 666252 - RNA, 19 nt, Homo sapiens
ucacaaaucuaaacucaug

SEQ ID NO: 666253 - RNA, 19 nt, Homo sapiens
ggaaaaggcuucaccauga

SEQ ID NO: 666254 - RNA, 19 nt, Homo sapiens
ggaaaggcuucaccacaaa

SEQ ID NO: 666255 - RNA, 19 nt, Homo sapiens
cgaccacgcucgacuaauu

SEQ ID NO: 666256 - RNA, 19 nt, Homo sapiens
gaagagacaagaaguaaau

SEQ ID NO: 666257 - RNA, 19 nt, Homo sapiens
gggaaaggcuucaccacaa

SEQ ID NO: 666258 - RNA, 19 nt, Homo sapiens
guacaucagcgaaaucaua

SEQ ID NO: 666259 - RNA, 19 nt, Homo sapiens
gcuaaauucucuguaagua

SEQ ID NO: 666260 - RNA, 19 nt, Homo sapiens
ugaagaguguggaacaaua

SEQ ID NO: 666261 - RNA, 19 nt, Homo sapiens
gaacauaaugcauuuggaa

SEQ ID NO: 666262 - RNA, 19 nt, Homo sapiens
gacccuaucucuucaguga

SEQ ID NO: 666263 - RNA, 19 nt, Homo sapiens
gaagaaagacccuaucucu

SEQ ID NO: 666264 - RNA, 19 nt, Homo sapiens
ucaaugaacuuacacauac

SEQ ID NO: 666265 - RNA, 19 nt, Homo sapiens
ucagagauuucacaguaua

SEQ ID NO: 666266 - RNA, 19 nt, Homo sapiens
guacaucagcgaacucaua

SEQ ID NO: 666267 - RNA, 19 nt, Homo sapiens
guacaucagcgaacucaua

SEQ ID NO: 666268 - RNA, 19 nt, Homo sapiens
gagagaagcccuacacaug

SEQ ID NO: 666269 - RNA, 19 nt, Homo sapiens
caucauacaucaacgaaau

SEQ ID NO: 666270 - RNA, 19 nt, Homo sapiens
gacaagaaguaaaugaaga

SEQ ID NO: 666271 - RNA, 19 nt, Homo sapiens
gaaaguccaggcuaaauga

SEQ ID NO: 666272 - RNA, 19 nt, Homo sapiens
gaacaaaagcugugaaauu

SEQ ID NO: 666273 - RNA, 19 nt, Homo sapiens
gaacaauaccaugaacaua

SEQ ID NO: 666274 - RNA, 19 nt, Homo sapiens
ucaggaaauucaugaagua

SEQ ID NO: 666275 - RNA, 19 nt, Homo sapiens
ggagagaaacccuuuguau

SEQ ID NO: 666276 - RNA, 19 nt, Homo sapiens
gaagaggcuuugccaagga

SEQ ID NO: 666277 - RNA, 19 nt, Homo sapiens
ggagagaaacccuuuaugu

SEQ ID NO: 666278 - RNA, 19 nt, Homo sapiens
ggagagaaaccguacauau

SEQ ID NO: 666279 - RNA, 19 nt, Homo sapiens
ggagagaaacccuacauau

SEQ ID NO: 666280 - RNA, 19 nt, Homo sapiens
gaagagcaugcuuauuaua

SEQ ID NO: 666281 - RNA, 19 nt, Homo sapiens
ggagagaaacccuacauau

SEQ ID NO: 666282 - RNA, 19 nt, Homo sapiens
gagccaagauugcgccauu

SEQ ID NO: 666283 - RNA, 19 nt, Homo sapiens
ggugauuaauuaccucaua

SEQ ID NO: 666284 - RNA, 19 nt, Homo sapiens
ugccuucggugauuaauua

SEQ ID NO: 666285 - RNA, 19 nt, Homo sapiens
guacaucagagaaaucaua

SEQ ID NO: 666286 - RNA, 19 nt, Homo sapiens
gaaaucucauuguacauca

SEQ ID NO: 666287 - RNA, 19 nt, Homo sapiens
guacaucagcaaauucaua

SEQ ID NO: 666288 - RNA, 19 nt, Homo sapiens
gagagaaaccguacauaug

SEQ ID NO: 666289 - RNA, 19 nt, Homo sapiens
gagagaaacccuacauaug

SEQ ID NO: 666290 - RNA, 19 nt, Homo sapiens
gagagaaacccuacauaug

SEQ ID NO: 666291 - RNA, 19 nt, Homo sapiens
gaagagccgucugauugaa

SEQ ID NO: 666292 - RNA, 19 nt, Homo sapiens
caaauuacccuuaagaucu

SEQ ID NO: 666293 - RNA, 19 nt, Homo sapiens
caucauuacuucauacaga

SEQ ID NO: 666294 - RNA, 19 nt, Homo sapiens
gaauagcggacugauguua

SEQ ID NO: 666295 - RNA, 19 nt, Homo sapiens
gagaacucaugaaauagaa

SEQ ID NO: 666296 - RNA, 19 nt, Homo sapiens
ggaaauacugccucucaaa

SEQ ID NO: 666297 - RNA, 19 nt, Homo sapiens
cagaugcacucuccaaguu

SEQ ID NO: 666298 - RNA, 19 nt, Homo sapiens
gcagaaaagucuugaaaau

SEQ ID NO: 666299 - RNA, 19 nt, Homo sapiens
cuuaagaucuauccaaguu

SEQ ID NO: 666300 - RNA, 19 nt, Homo sapiens
guacgcaagcuuugagaua

SEQ ID NO: 666301 - RNA, 19 nt, Homo sapiens
gugccaaucugguguuauu

SEQ ID NO: 666302 - RNA, 19 nt, Homo sapiens
ucacuaggaugaaugcuau

SEQ ID NO: 666303 - RNA, 19 nt, Homo sapiens
gggcuguucuuaucacuga

SEQ ID NO: 666304 - RNA, 19 nt, Homo sapiens
guaaagcgggcuguucuua

SEQ ID NO: 666305 - RNA, 19 nt, Homo sapiens
gaaacaaacccugacaaug

SEQ ID NO: 666306 - RNA, 19 nt, Homo sapiens
gaaaucauacaguagagaa

SEQ ID NO: 666307 - RNA, 19 nt, Homo sapiens
ccaugaacauaaugcauuu

SEQ ID NO: 666308 - RNA, 19 nt, Homo sapiens
uaaagaugcugugacuauu

SEQ ID NO: 666309 - RNA, 19 nt, Homo sapiens
ggaaacaaacccugacaau

SEQ ID NO: 666310 - RNA, 19 nt, Homo sapiens
gagagaaacccuuuguaug

SEQ ID NO: 666311 - RNA, 19 nt, Homo sapiens
gagagaaacccuuuaugug

SEQ ID NO: 666312 - RNA, 19 nt, Homo sapiens
gcaaauuacccuuaagauc

SEQ ID NO: 666313 - RNA, 19 nt, Homo sapiens
gauacaugcugccucauca

SEQ ID NO: 666314 - RNA, 19 nt, Homo sapiens
gaacuuacacauacuagca

SEQ ID NO: 666315 - RNA, 19 nt, Homo sapiens
gaaaagccuucuccucaaa

SEQ ID NO: 666316 - RNA, 19 nt, Homo sapiens
gagaaacccuacauaugca

SEQ ID NO: 666317 - RNA, 19 nt, Homo sapiens
gagaaacccuacauaugca

SEQ ID NO: 666318 - RNA, 19 nt, Homo sapiens
caucagagaacucaugaaa

SEQ ID NO: 666319 - RNA, 19 nt, Homo sapiens
gcucugaauucuuugaugu

SEQ ID NO: 666320 - RNA, 19 nt, Homo sapiens
uaagaucuauccaaguugu

SEQ ID NO: 666321 - RNA, 19 nt, Homo sapiens
guacaccagcgaacucaua

SEQ ID NO: 666322 - RNA, 19 nt, Homo sapiens
gaagagccguaugaucgaa

SEQ ID NO: 666323 - RNA, 19 nt, Homo sapiens
gaaaggcacagucgaaucu

SEQ ID NO: 666324 - RNA, 19 nt, Homo sapiens
cuaaguagcugggauuaca

SEQ ID NO: 666325 - RNA, 19 nt, Homo sapiens
cuugauaucuauucuguga

SEQ ID NO: 666326 - RNA, 19 nt, Homo sapiens
caagguggguggaucacuu

SEQ ID NO: 666327 - RNA, 19 nt, Homo sapiens
acaguuggcagauauauuu

SEQ ID NO: 666328 - RNA, 19 nt, Homo sapiens
gacugaaguuucuaaauag

SEQ ID NO: 666329 - RNA, 19 nt, Homo sapiens
gaucgaacaucaacgaacu

SEQ ID NO: 666330 - RNA, 19 nt, Homo sapiens
gagagaagcccuacaucug

SEQ ID NO: 666331 - RNA, 19 nt, Homo sapiens
gcaauacuguguuguaaua

SEQ ID NO: 666332 - RNA, 19 nt, Homo sapiens
agaaauggcugauaguuua

SEQ ID NO: 666333 - RNA, 19 nt, Homo sapiens
ugaaagaacuggaagaauu

SEQ ID NO: 666334 - RNA, 19 nt, Homo sapiens
ggaaggagauacaaucauu

SEQ ID NO: 666335 - RNA, 19 nt, Homo sapiens
ggaauuaugugcugcugua

SEQ ID NO: 666336 - RNA, 19 nt, Homo sapiens
caucaaagcugacagagaa

SEQ ID NO: 666337 - RNA, 19 nt, Homo sapiens
caaagaagaggccaauuua

SEQ ID NO: 666338 - RNA, 19 nt, Homo sapiens
agaaagggcuuaugacaaa

SEQ ID NO: 666339 - RNA, 19 nt, Homo sapiens
ugaaaucccuguucuuaaa

SEQ ID NO: 666340 - RNA, 19 nt, Homo sapiens
gaacagacuaagaugauua

SEQ ID NO: 666341 - RNA, 19 nt, Homo sapiens
uaaagagcguucaagaaua

SEQ ID NO: 666342 - RNA, 19 nt, Homo sapiens
gcgaagaauuggaagauaa

SEQ ID NO: 666343 - RNA, 19 nt, Homo sapiens
aaagagcguucaagaauaa

SEQ ID NO: 666344 - RNA, 19 nt, Homo sapiens
gcugauaguuuaggaguua

SEQ ID NO: 666345 - RNA, 19 nt, Homo sapiens
gaugaaaucccuguucuua

SEQ ID NO: 666346 - RNA, 19 nt, Homo sapiens
gaacaaggaguaccagaaa

SEQ ID NO: 666347 - RNA, 19 nt, Homo sapiens
gaaacacaguucauauaga

SEQ ID NO: 666348 - RNA, 19 nt, Homo sapiens
guaaagaagugucugaauc

SEQ ID NO: 666349 - RNA, 19 nt, Homo sapiens
ggaagaagaagaugaagaa

SEQ ID NO: 666350 - RNA, 19 nt, Homo sapiens
guaccuaccucugcacaua

SEQ ID NO: 666351 - RNA, 19 nt, Homo sapiens
aaaggaaucucaaaggaaa

SEQ ID NO: 666352 - RNA, 19 nt, Homo sapiens
guauuucccugcaagauaa

SEQ ID NO: 666353 - RNA, 19 nt, Homo sapiens
ggaagaagaggaagaagaa

SEQ ID NO: 666354 - RNA, 19 nt, Homo sapiens
gaaggaaacacaguucaua

SEQ ID NO: 666355 - RNA, 19 nt, Homo sapiens
gaacaugacccucaguaug

SEQ ID NO: 666356 - RNA, 19 nt, Homo sapiens
gaauaugacucugaugaug

SEQ ID NO: 666357 - RNA, 19 nt, Homo sapiens
caagccagguccuaacaua

SEQ ID NO: 666358 - RNA, 19 nt, Homo sapiens
gaaagaacuggaagaauug

SEQ ID NO: 666359 - RNA, 19 nt, Homo sapiens
gagcaaaggcuauuauugu

SEQ ID NO: 666360 - RNA, 19 nt, Homo sapiens
ugauguggcugcuacuuua

SEQ ID NO: 666361 - RNA, 19 nt, Homo sapiens
guaaagaaaugagcucaga

SEQ ID NO: 666362 - RNA, 19 nt, Homo sapiens
ggaagcaggucaggugaaa

SEQ ID NO: 666363 - RNA, 19 nt, Homo sapiens
gaaaagaccuggagaaaac

SEQ ID NO: 666364 - RNA, 19 nt, Homo sapiens
ugaacgagaugcacaagaa

SEQ ID NO: 666365 - RNA, 19 nt, Homo sapiens
ccaaagaagaggccaauuu

SEQ ID NO: 666366 - RNA, 19 nt, Homo sapiens
gaagaggaagaacguauaa

SEQ ID NO: 666367 - RNA, 19 nt, Homo sapiens
gaauucaccucaaaagaua

SEQ ID NO: 666368 - RNA, 19 nt, Homo sapiens
gacacuaaaugcuaucaaa

SEQ ID NO: 666369 - RNA, 19 nt, Homo sapiens
caaaggcuauuauuguaga

SEQ ID NO: 666370 - RNA, 19 nt, Homo sapiens
agaagaagaugaagaaagu

SEQ ID NO: 666371 - RNA, 19 nt, Homo sapiens
gcaagaagcucuggcuaag

SEQ ID NO: 666372 - RNA, 19 nt, Homo sapiens
gaagaaagggcuuaugaca

SEQ ID NO: 666373 - RNA, 19 nt, Homo sapiens
gaagagagaagaggaagaa

SEQ ID NO: 666374 - RNA, 19 nt, Homo sapiens
ugagaaaccaagaaacuua

SEQ ID NO: 666375 - RNA, 19 nt, Homo sapiens
gaacuggaguaaaugcaau

SEQ ID NO: 666376 - RNA, 19 nt, Homo sapiens
gagaugaaaugcagaagag

SEQ ID NO: 666377 - RNA, 19 nt, Homo sapiens
guagaagggcccauuguaa

SEQ ID NO: 666378 - RNA, 19 nt, Homo sapiens
ugccuuggcugcagaaaua

SEQ ID NO: 666379 - RNA, 19 nt, Homo sapiens
uaaaugcaauacuguguug

SEQ ID NO: 666380 - RNA, 19 nt, Homo sapiens
gggaagcuauggccaguga

SEQ ID NO: 666381 - RNA, 19 nt, Homo sapiens
cacagcagcuagaaaguaa

SEQ ID NO: 666382 - RNA, 19 nt, Homo sapiens
ggacuuugaugaagaugau

SEQ ID NO: 666383 - RNA, 19 nt, Homo sapiens
aagagugacuggcagcuua

SEQ ID NO: 666384 - RNA, 19 nt, Homo sapiens
cuacagauauucuuguuag

SEQ ID NO: 666385 - RNA, 19 nt, Homo sapiens
uaaagaagaggaacgauug

SEQ ID NO: 666386 - RNA, 19 nt, Homo sapiens
cuacuuggcugcuguuuua

SEQ ID NO: 666387 - RNA, 19 nt, Homo sapiens
caagaaacuuacacugguu

SEQ ID NO: 666388 - RNA, 19 nt, Homo sapiens
ggacuuaaguauggaagga

SEQ ID NO: 666389 - RNA, 19 nt, Homo sapiens
ggaaacacaguucauauag

SEQ ID NO: 666390 - RNA, 19 nt, Homo sapiens
caaagugacuguugauacu

SEQ ID NO: 666391 - RNA, 19 nt, Homo sapiens
gcagugaagccaacagaaa

SEQ ID NO: 666392 - RNA, 19 nt, Homo sapiens
caggaaugcuaauuauuga

SEQ ID NO: 666393 - RNA, 19 nt, Homo sapiens
agaagugucugaaucaaug

SEQ ID NO: 666394 - RNA, 19 nt, Homo sapiens
caucuacacuggguucuuu

SEQ ID NO: 666395 - RNA, 19 nt, Homo sapiens
gcaccaaggaugacauuga

SEQ ID NO: 666396 - RNA, 19 nt, Homo sapiens
gcuagaaaguaaagaagug

SEQ ID NO: 666397 - RNA, 19 nt, Homo sapiens
aagaugauauccugaaaga

SEQ ID NO: 666398 - RNA, 19 nt, Homo sapiens
gaaggaaggagauacaauc

SEQ ID NO: 666399 - RNA, 19 nt, Homo sapiens
ccaggaaugcuaauuauug

SEQ ID NO: 666400 - RNA, 19 nt, Homo sapiens
gaagaggccaauuuaugaa

SEQ ID NO: 666401 - RNA, 19 nt, Homo sapiens
gaagaagaaagacagaaga

SEQ ID NO: 666402 - RNA, 19 nt, Homo sapiens
ggaugaggauaacaguaaa

SEQ ID NO: 666403 - RNA, 19 nt, Homo sapiens
gaaacagaaacaagaagaa

SEQ ID NO: 666404 - RNA, 19 nt, Homo sapiens
gcacaagaaauggcugaua

SEQ ID NO: 666405 - RNA, 19 nt, Homo sapiens
ccaccaauguuccucuuga

SEQ ID NO: 666406 - RNA, 19 nt, Homo sapiens
caaugugccuguucacuca

SEQ ID NO: 666407 - RNA, 19 nt, Homo sapiens
gaagugcccuaugcaggaa

SEQ ID NO: 666408 - RNA, 19 nt, Homo sapiens
guaaagaagaggaacgauu

SEQ ID NO: 666409 - RNA, 19 nt, Homo sapiens
ggagugaugaugaugauga

SEQ ID NO: 666410 - RNA, 19 nt, Homo sapiens
ggacacugauggacuuaag

SEQ ID NO: 666411 - RNA, 19 nt, Homo sapiens
agacguauuuggacacuga

SEQ ID NO: 666412 - RNA, 19 nt, Homo sapiens
gaauugauccaugaguuaa

SEQ ID NO: 666413 - RNA, 19 nt, Homo sapiens
gugaagaaccaguaugaaa

SEQ ID NO: 666414 - RNA, 19 nt, Homo sapiens
ccuauuaucugcguacuug

SEQ ID NO: 666415 - RNA, 19 nt, Homo sapiens
ugaagaaagugaagaagag

SEQ ID NO: 666416 - RNA, 19 nt, Homo sapiens
cacaagaaauggcugauag

SEQ ID NO: 666417 - RNA, 19 nt, Homo sapiens
ugaauugauccaugaguua

SEQ ID NO: 666418 - RNA, 19 nt, Homo sapiens
gaagaugaaaucccuguuc

SEQ ID NO: 666419 - RNA, 19 nt, Homo sapiens
gauucgaggccuccuguua

SEQ ID NO: 666420 - RNA, 19 nt, Homo sapiens
uaaagaagugucugaauca

SEQ ID NO: 666421 - RNA, 19 nt, Homo sapiens
agaagaggccaauuuauga

SEQ ID NO: 666422 - RNA, 19 nt, Homo sapiens
uaaagaggaagaagaaaga

SEQ ID NO: 666423 - RNA, 19 nt, Homo sapiens
uuaaagagcguucaagaau

SEQ ID NO: 666424 - RNA, 19 nt, Homo sapiens
gcaggacuuugaugaagau

SEQ ID NO: 666425 - RNA, 19 nt, Homo sapiens
caagaaacagaaacaagaa

SEQ ID NO: 666426 - RNA, 19 nt, Homo sapiens
gaacgagaugcacaagaaa

SEQ ID NO: 666427 - RNA, 19 nt, Homo sapiens
ccuuguggcuuauaaagaa

SEQ ID NO: 666428 - RNA, 19 nt, Homo sapiens
ggaacaaggaguaccagaa

SEQ ID NO: 666429 - RNA, 19 nt, Homo sapiens
gaugauauccugaaagaac

SEQ ID NO: 666430 - RNA, 19 nt, Homo sapiens
gcacaggugauggagguua

SEQ ID NO: 666431 - RNA, 19 nt, Homo sapiens
cagcaggucuuccagcuua

SEQ ID NO: 666432 - RNA, 19 nt, Homo sapiens
uuacacagcugacuacuga

SEQ ID NO: 666433 - RNA, 19 nt, Homo sapiens
ugaaggagauggugaagga

SEQ ID NO: 666434 - RNA, 19 nt, Homo sapiens
guagagcacuggcagaguu

SEQ ID NO: 666435 - RNA, 19 nt, Homo sapiens
gaaaggugguacaggaaga

SEQ ID NO: 666436 - RNA, 19 nt, Homo sapiens
agaaggugcucaaguguuu

SEQ ID NO: 666437 - RNA, 19 nt, Homo sapiens
uuaagacgcugcuggauga

SEQ ID NO: 666438 - RNA, 19 nt, Homo sapiens
ucgcuuaucucacccuaua

SEQ ID NO: 666439 - RNA, 19 nt, Homo sapiens
gcacucgucaacaugauua

SEQ ID NO: 666440 - RNA, 19 nt, Homo sapiens
cagacacgcucauguaugu

SEQ ID NO: 666441 - RNA, 19 nt, Homo sapiens
gguacacacugcaggauga

SEQ ID NO: 666442 - RNA, 19 nt, Homo sapiens
uggaagagauacuacugua

SEQ ID NO: 666443 - RNA, 19 nt, Homo sapiens
cagagaagcaggcuguaua

SEQ ID NO: 666444 - RNA, 19 nt, Homo sapiens
uaccagagauccaguacuu

SEQ ID NO: 666445 - RNA, 19 nt, Homo sapiens
ccacaggccuggcacuuca

SEQ ID NO: 666446 - RNA, 19 nt, Homo sapiens
auaagaaccuggcucagaa

SEQ ID NO: 666447 - RNA, 19 nt, Homo sapiens
aaggagcaguuccgaauuu

SEQ ID NO: 666448 - RNA, 19 nt, Homo sapiens
cuacuaugaucccaacauu

SEQ ID NO: 666449 - RNA, 19 nt, Homo sapiens
gaagcuggcagaggagaua

SEQ ID NO: 666450 - RNA, 19 nt, Homo sapiens
ucaugagccugcccacuuu

SEQ ID NO: 666451 - RNA, 19 nt, Homo sapiens
ugaaacagauccacaagac

SEQ ID NO: 666452 - RNA, 19 nt, Homo sapiens
aagaagaucugccgagagu

SEQ ID NO: 666453 - RNA, 19 nt, Homo sapiens
ccagugcucuucacaucaa

SEQ ID NO: 666454 - RNA, 19 nt, Homo sapiens
gcuggagcccuucagaaua

SEQ ID NO: 666455 - RNA, 19 nt, Homo sapiens
ggacugcuuugccgauauc

SEQ ID NO: 666456 - RNA, 19 nt, Homo sapiens
aaacagauccacaagacaa

SEQ ID NO: 666457 - RNA, 19 nt, Homo sapiens
gaaggagcaguuccgaauu

SEQ ID NO: 666458 - RNA, 19 nt, Homo sapiens
ucagcaaccucuaugacaa

SEQ ID NO: 666459 - RNA, 19 nt, Homo sapiens
gccacuauccugucaauga

SEQ ID NO: 666460 - RNA, 19 nt, Homo sapiens
gucagaaggugcucaagug

SEQ ID NO: 666461 - RNA, 19 nt, Homo sapiens
ccagagauccaguacuuug

SEQ ID NO: 666462 - RNA, 19 nt, Homo sapiens
ggacuucacuguggagaac

SEQ ID NO: 666463 - RNA, 19 nt, Homo sapiens
gacgucaacuauucugaug

SEQ ID NO: 666464 - RNA, 19 nt, Homo sapiens
ggccauuguucacaucuug

SEQ ID NO: 666465 - RNA, 19 nt, Homo sapiens
ggccagugcucuucacauc

SEQ ID NO: 666466 - RNA, 19 nt, Homo sapiens
cagauuuguuccuguguga

SEQ ID NO: 666467 - RNA, 19 nt, Homo sapiens
ugcaccagcucuacuauga

SEQ ID NO: 666468 - RNA, 19 nt, Homo sapiens
gcaccagccuuggacuuca

SEQ ID NO: 666469 - RNA, 19 nt, Homo sapiens
gagcaguuccgaauuuaca

SEQ ID NO: 666470 - RNA, 19 nt, Homo sapiens
gaucccaacauugagaaua

SEQ ID NO: 666471 - RNA, 19 nt, Homo sapiens
cgucaacuauucugaugug

SEQ ID NO: 666472 - RNA, 19 nt, Homo sapiens
gcagauaugguacgacucu

SEQ ID NO: 666473 - RNA, 19 nt, Homo sapiens
uggcuugucuugucaguca

SEQ ID NO: 666474 - RNA, 19 nt, Homo sapiens
guaugucuaugagauguug

SEQ ID NO: 666475 - RNA, 19 nt, Homo sapiens
aggcaucccuggccacuau

SEQ ID NO: 666476 - RNA, 19 nt, Homo sapiens
uguuagagcugcugacagu

SEQ ID NO: 666477 - RNA, 19 nt, Homo sapiens
caugugcuguggcagauau

SEQ ID NO: 666478 - RNA, 19 nt, Homo sapiens
ucagaauacugucauuguc

SEQ ID NO: 666479 - RNA, 19 nt, Homo sapiens
ggccuccuguggcuucuuu

SEQ ID NO: 666480 - RNA, 19 nt, Homo sapiens
ucucagacacgcucaugua

SEQ ID NO: 666481 - RNA, 19 nt, Homo sapiens
ugaacacacuccugaaacu

SEQ ID NO: 666482 - RNA, 19 nt, Homo sapiens
acuaugaucccaacauuga

SEQ ID NO: 666483 - RNA, 19 nt, Homo sapiens
guugaaugaugcccagguu

SEQ ID NO: 666484 - RNA, 19 nt, Homo sapiens
ccaguucccuucugaugag

SEQ ID NO: 666485 - RNA, 19 nt, Homo sapiens
gugacucccuccacacaga

SEQ ID NO: 666486 - RNA, 19 nt, Homo sapiens
ccacaucuuugcucaugag

SEQ ID NO: 666487 - RNA, 19 nt, Homo sapiens
cauuggagcucugucugaa

SEQ ID NO: 666488 - RNA, 19 nt, Homo sapiens
gcagagaagcaggcuguau

SEQ ID NO: 666489 - RNA, 19 nt, Homo sapiens
ccacuauccugucaaugag

SEQ ID NO: 666490 - RNA, 19 nt, Homo sapiens
caccagcucuacuaugauc

SEQ ID NO: 666491 - RNA, 19 nt, Homo sapiens
gaagcggaagccagauuug

SEQ ID NO: 666492 - RNA, 19 nt, Homo sapiens
guccacaucuuugcucaug

SEQ ID NO: 666493 - RNA, 19 nt, Homo sapiens
gccgagagugcaaguauga

SEQ ID NO: 666494 - RNA, 19 nt, Homo sapiens
aggagcaguuccgaauuua

SEQ ID NO: 666495 - RNA, 19 nt, Homo sapiens
gaaacagauccacaagaca

SEQ ID NO: 666496 - RNA, 19 nt, Homo sapiens
gagaccaccagcucccuaa

SEQ ID NO: 666497 - RNA, 19 nt, Homo sapiens
gagcagcaccagccuugga

SEQ ID NO: 666498 - RNA, 19 nt, Homo sapiens
ggugugcgcuaucuuugag

SEQ ID NO: 666499 - RNA, 19 nt, Homo sapiens
cccaggaugugcugaugaa

SEQ ID NO: 666500 - RNA, 19 nt, Homo sapiens
ucccuaugcugccaacauu

SEQ ID NO: 666501 - RNA, 19 nt, Homo sapiens
agaaggagcaguuccgaau

SEQ ID NO: 666502 - RNA, 19 nt, Homo sapiens
gacccucacugcugucucu

SEQ ID NO: 666503 - RNA, 19 nt, Homo sapiens
cagauuacacagcugacua

SEQ ID NO: 666504 - RNA, 19 nt, Homo sapiens
aggaugugcugaugaaaca

SEQ ID NO: 666505 - RNA, 19 nt, Homo sapiens
gcucccagguuggaagaga

SEQ ID NO: 666506 - RNA, 19 nt, Homo sapiens
caccaccaccuaacugaaa

SEQ ID NO: 666507 - RNA, 19 nt, Homo sapiens
gcggaagccagauuuguuc

SEQ ID NO: 666508 - RNA, 19 nt, Homo sapiens
ugaagcggaagccagauuu

SEQ ID NO: 666509 - RNA, 19 nt, Homo sapiens
gagcaaaugguugaaugau

SEQ ID NO: 666510 - RNA, 19 nt, Homo sapiens
cagaggagauacccaaucc

SEQ ID NO: 666511 - RNA, 19 nt, Homo sapiens
gcagaggagauacccaauc

SEQ ID NO: 666512 - RNA, 19 nt, Homo sapiens
aauaagaaccuggcucaga

SEQ ID NO: 666513 - RNA, 19 nt, Homo sapiens
aucccaacauugagaauaa

SEQ ID NO: 666514 - RNA, 19 nt, Homo sapiens
gggaaaggugguacaggaa

SEQ ID NO: 666515 - RNA, 19 nt, Homo sapiens
uuugagaagucuguuaaga

SEQ ID NO: 666516 - RNA, 19 nt, Homo sapiens
gaccucccauggcaucugu

SEQ ID NO: 666517 - RNA, 19 nt, Homo sapiens
gcccagagguacgugaaca

SEQ ID NO: 666518 - RNA, 19 nt, Homo sapiens
cuggagcccuucagaauac

SEQ ID NO: 666519 - RNA, 19 nt, Homo sapiens
acaagaggcgggugaagga

SEQ ID NO: 666520 - RNA, 19 nt, Homo sapiens
agacgcugcuggaugacuu

SEQ ID NO: 666521 - RNA, 19 nt, Homo sapiens
uuggagcucugucugaaug

SEQ ID NO: 666522 - RNA, 19 nt, Homo sapiens
cuccuaagagcaccaauuu

SEQ ID NO: 666523 - RNA, 19 nt, Homo sapiens
ggcaggcagugcagaaugg

SEQ ID NO: 666524 - RNA, 19 nt, Homo sapiens
gaacacacuccugaaacuc

SEQ ID NO: 666525 - RNA, 19 nt, Homo sapiens
gaacaagaggcgggugaag

SEQ ID NO: 666526 - RNA, 19 nt, Homo sapiens
ugaaugaugcccagguugu

SEQ ID NO: 666527 - RNA, 19 nt, Homo sapiens
cugagcaaaugguugaaug

SEQ ID NO: 666528 - RNA, 19 nt, Homo sapiens
gaauuuacaggguggacau

SEQ ID NO: 666529 - RNA, 19 nt, Homo sapiens
ugaggcaccuacugucaag

SEQ ID NO: 666530 - RNA, 19 nt, Homo sapiens
gaugugcugaugaaacaga

SEQ ID NO: 666531 - RNA, 19 nt, Homo sapiens
gaagaaagcuccugauugg

SEQ ID NO: 666532 - RNA, 19 nt, Homo sapiens
gcaauaagcuguggccaau

SEQ ID NO: 666533 - RNA, 19 nt, Homo sapiens
ggacacaagucuccaaagu

SEQ ID NO: 666534 - RNA, 19 nt, Homo sapiens
gaaauacgacuucuucuca

SEQ ID NO: 666535 - RNA, 19 nt, Homo sapiens
ccuguaaccuguuuauuaa

SEQ ID NO: 666536 - RNA, 19 nt, Homo sapiens
ggaagaaagcuccugauug

SEQ ID NO: 666537 - RNA, 19 nt, Homo sapiens
ggccaccacugcuguuaua

SEQ ID NO: 666538 - RNA, 19 nt, Homo sapiens
ugacagaagucccggaaga

SEQ ID NO: 666539 - RNA, 19 nt, Homo sapiens
ucacaucucuauucgcaaa

SEQ ID NO: 666540 - RNA, 19 nt, Homo sapiens
gcacagggaguuccaaaug

SEQ ID NO: 666541 - RNA, 19 nt, Homo sapiens
ccaaagggaugugguguga

SEQ ID NO: 666542 - RNA, 19 nt, Homo sapiens
guaaauagaagcccgcaaa

SEQ ID NO: 666543 - RNA, 19 nt, Homo sapiens
caagacauaucacagaaca

SEQ ID NO: 666544 - RNA, 19 nt, Homo sapiens
aaacacagcccuugaaauc

SEQ ID NO: 666545 - RNA, 19 nt, Homo sapiens
gagcuucuguggcuugaga

SEQ ID NO: 666546 - RNA, 19 nt, Homo sapiens
gcucguagcugugauugug

SEQ ID NO: 666547 - RNA, 19 nt, Homo sapiens
gaaugccacuccuguguuc

SEQ ID NO: 666548 - RNA, 19 nt, Homo sapiens
ggauucaaccucauagaaa

SEQ ID NO: 666549 - RNA, 19 nt, Homo sapiens
gcucugaugucccuccuau

SEQ ID NO: 666550 - RNA, 19 nt, Homo sapiens
cgcaaacuguacagauuua

SEQ ID NO: 666551 - RNA, 19 nt, Homo sapiens
gcaagucacuagucauggu

SEQ ID NO: 666552 - RNA, 19 nt, Homo sapiens
gugcugugcccauuuauaa

SEQ ID NO: 666553 - RNA, 19 nt, Homo sapiens
gaaggcagguuuuauuuca

SEQ ID NO: 666554 - RNA, 19 nt, Homo sapiens
cuuacgagcucaucucuug

SEQ ID NO: 666555 - RNA, 19 nt, Homo sapiens
gggaugagaccaggugaua

SEQ ID NO: 666556 - RNA, 19 nt, Homo sapiens
cacaugaccugcucucaau

SEQ ID NO: 666557 - RNA, 19 nt, Homo sapiens
ccagaacaaucagcccaua

SEQ ID NO: 666558 - RNA, 19 nt, Homo sapiens
gagcaggagucgggcauug

SEQ ID NO: 666559 - RNA, 19 nt, Homo sapiens
cugcagaccuugcuugguu

SEQ ID NO: 666560 - RNA, 19 nt, Homo sapiens
ccucuugccuguaaauaga

SEQ ID NO: 666561 - RNA, 19 nt, Homo sapiens
gaacaagaagggcagaaca

SEQ ID NO: 666562 - RNA, 19 nt, Homo sapiens
guaaacacagcccuugaaa

SEQ ID NO: 666563 - RNA, 19 nt, Homo sapiens
ccugugcugugcccauuua

SEQ ID NO: 666564 - RNA, 19 nt, Homo sapiens
cacagggaguuccaaauga

SEQ ID NO: 666565 - RNA, 19 nt, Homo sapiens
ccucuuugcugccuucuug

SEQ ID NO: 666566 - RNA, 19 nt, Homo sapiens
ggcaaaugcauguaaauau

SEQ ID NO: 666567 - RNA, 19 nt, Homo sapiens
ucucuucucuguguccuua

SEQ ID NO: 666568 - RNA, 19 nt, Homo sapiens
gggcaggaauagucaagga

SEQ ID NO: 666569 - RNA, 19 nt, Homo sapiens
cccuguaaccuguuuauua

SEQ ID NO: 666570 - RNA, 19 nt, Homo sapiens
ucucaaugcuggagggaaa

SEQ ID NO: 666571 - RNA, 19 nt, Homo sapiens
caaugcaagucacuaguca

SEQ ID NO: 666572 - RNA, 19 nt, Homo sapiens
uauccagccucaacucuga

SEQ ID NO: 666573 - RNA, 19 nt, Homo sapiens
aggcagauguccaggcuuu

SEQ ID NO: 666574 - RNA, 19 nt, Homo sapiens
gcacuggcuucucuucucu

SEQ ID NO: 666575 - RNA, 19 nt, Homo sapiens
acacagcccuugaaaucau

SEQ ID NO: 666576 - RNA, 19 nt, Homo sapiens
gagccucuuucaaauuaau

SEQ ID NO: 666577 - RNA, 19 nt, Homo sapiens
ugaaggaacugguuuuguu

SEQ ID NO: 666578 - RNA, 19 nt, Homo sapiens
gaaucgagccagaacaauc

SEQ ID NO: 666579 - RNA, 19 nt, Homo sapiens
ggaagagcccagccagaga

SEQ ID NO: 666580 - RNA, 19 nt, Homo sapiens
uguugaaucucuccucuug

SEQ ID NO: 666581 - RNA, 19 nt, Homo sapiens
gguaaacacagcccuugaa

SEQ ID NO: 666582 - RNA, 19 nt, Homo sapiens
gccaguagcgccucaguug

SEQ ID NO: 666583 - RNA, 19 nt, Homo sapiens
cccagaggcuugugaggaa

SEQ ID NO: 666584 - RNA, 19 nt, Homo sapiens
aaagggauguggugugagu

SEQ ID NO: 666585 - RNA, 19 nt, Homo sapiens
gggguuacuuccuuuguua

SEQ ID NO: 666586 - RNA, 19 nt, Homo sapiens
gaugagaccaggugauagu

SEQ ID NO: 666587 - RNA, 19 nt, Homo sapiens
ccaaauacacccacacucu

SEQ ID NO: 666588 - RNA, 19 nt, Homo sapiens
ccagacacguacugcaaug

SEQ ID NO: 666589 - RNA, 19 nt, Homo sapiens
acccagacuucauuucuuu

SEQ ID NO: 666590 - RNA, 19 nt, Homo sapiens
ucacacugcucaucuaucg

SEQ ID NO: 666591 - RNA, 19 nt, Homo sapiens
ccuccuuucucucaucuuu

SEQ ID NO: 666592 - RNA, 19 nt, Homo sapiens
cagcaacugaccaccuuua

SEQ ID NO: 666593 - RNA, 19 nt, Homo sapiens
gauucaaccucauagaaac

SEQ ID NO: 666594 - RNA, 19 nt, Homo sapiens
aaccauaccuguccugagu

SEQ ID NO: 666595 - RNA, 19 nt, Homo sapiens
ccugggaguugccaucuga

SEQ ID NO: 666596 - RNA, 19 nt, Homo sapiens
uuacuuccuuuguuaccua

SEQ ID NO: 666597 - RNA, 19 nt, Homo sapiens
cugcucagcugccucagaa

SEQ ID NO: 666598 - RNA, 19 nt, Homo sapiens
uauauugggucacaucucu

SEQ ID NO: 666599 - RNA, 19 nt, Homo sapiens
gcagauguccaggcuuuau

SEQ ID NO: 666600 - RNA, 19 nt, Homo sapiens
gcaaguagggcuauuucca

SEQ ID NO: 666601 - RNA, 19 nt, Homo sapiens
guugggagaccuaaucuug

SEQ ID NO: 666602 - RNA, 19 nt, Homo sapiens
ccacaugaccugcucucaa

SEQ ID NO: 666603 - RNA, 19 nt, Homo sapiens
cacauugucuccagcuuuc

SEQ ID NO: 666604 - RNA, 19 nt, Homo sapiens
gaauguuuauccucaugca

SEQ ID NO: 666605 - RNA, 19 nt, Homo sapiens
gaacacacgcguccuucca

SEQ ID NO: 666606 - RNA, 19 nt, Homo sapiens
acacugcucaucuaucgua

SEQ ID NO: 666607 - RNA, 19 nt, Homo sapiens
gggcuucuuuucccuuuua

SEQ ID NO: 666608 - RNA, 19 nt, Homo sapiens
gcagugaccagucuguauc

SEQ ID NO: 666609 - RNA, 19 nt, Homo sapiens
uggcuucucuucucugugu

SEQ ID NO: 666610 - RNA, 19 nt, Homo sapiens
ugagaaaccagggaggaua

SEQ ID NO: 666611 - RNA, 19 nt, Homo sapiens
gcugugcccauuuauaaga

SEQ ID NO: 666612 - RNA, 19 nt, Homo sapiens
uggcaaaugcauguaaaua

SEQ ID NO: 666613 - RNA, 19 nt, Homo sapiens
caacuacaacccuggacuu

SEQ ID NO: 666614 - RNA, 19 nt, Homo sapiens
guccuuagcauuugagaga

SEQ ID NO: 666615 - RNA, 19 nt, Homo sapiens
gggguuggcuucugauuug

SEQ ID NO: 666616 - RNA, 19 nt, Homo sapiens
guucuucucugcccucucu

SEQ ID NO: 666617 - RNA, 19 nt, Homo sapiens
gcgcuucagcccagaugua

SEQ ID NO: 666618 - RNA, 19 nt, Homo sapiens
ugaacuggaugaccucuac

SEQ ID NO: 666619 - RNA, 19 nt, Homo sapiens
caacugaccaccuuuagcu

SEQ ID NO: 666620 - RNA, 19 nt, Homo sapiens
ucagcugggucuagcagaa

SEQ ID NO: 666621 - RNA, 19 nt, Homo sapiens
aauaagcuguggccaaugg

SEQ ID NO: 666622 - RNA, 19 nt, Homo sapiens
gugaguccuuucuccugua

SEQ ID NO: 666623 - RNA, 19 nt, Homo sapiens
cccgcaaacuguacagauu

SEQ ID NO: 666624 - RNA, 19 nt, Homo sapiens
aauagaagcccgcaaacug

SEQ ID NO: 666625 - RNA, 19 nt, Homo sapiens
caaaugagagggagcuucu

SEQ ID NO: 666626 - RNA, 19 nt, Homo sapiens
ccacaucccagauucaagu

SEQ ID NO: 666627 - RNA, 19 nt, Homo sapiens
agaacaaucagcccauauu

SEQ ID NO: 666628 - RNA, 19 nt, Homo sapiens
gcaaugcaagucacuaguc

SEQ ID NO: 666629 - RNA, 19 nt, Homo sapiens
caagaauguuuauccucau

SEQ ID NO: 666630 - RNA, 19 nt, Homo sapiens
ucugaugucccuccuauga

SEQ ID NO: 666631 - RNA, 19 nt, Homo sapiens
gggcagcucucuugaaaua

SEQ ID NO: 666632 - RNA, 19 nt, Homo sapiens
uaaauuagauccacaguga

SEQ ID NO: 666633 - RNA, 19 nt, Homo sapiens
ggaaggaacuagacaauca

SEQ ID NO: 666634 - RNA, 19 nt, Homo sapiens
gaagugaugucauaagguu

SEQ ID NO: 666635 - RNA, 19 nt, Homo sapiens
gaccaucacugccuguuua

SEQ ID NO: 666636 - RNA, 19 nt, Homo sapiens
gaucuucucuucuaaguga

SEQ ID NO: 666637 - RNA, 19 nt, Homo sapiens
gaaauuggguguuuaaugc

SEQ ID NO: 666638 - RNA, 19 nt, Homo sapiens
gaaacucacuucucaguca

SEQ ID NO: 666639 - RNA, 19 nt, Homo sapiens
gaauggaccuuugaguuaa

SEQ ID NO: 666640 - RNA, 19 nt, Homo sapiens
gauauccacucucuucuuu

SEQ ID NO: 666641 - RNA, 19 nt, Homo sapiens
uuacaaagauggacaauuc

SEQ ID NO: 666642 - RNA, 19 nt, Homo sapiens
gaacaaaccucagacuaag

SEQ ID NO: 666643 - RNA, 19 nt, Homo sapiens
ggaacaaaccucagacuaa

SEQ ID NO: 666644 - RNA, 19 nt, Homo sapiens
gguccaagcuguauaguau

SEQ ID NO: 666645 - RNA, 19 nt, Homo sapiens
gaacauuuauccauacauc

SEQ ID NO: 666646 - RNA, 19 nt, Homo sapiens
gaugcaugcuuuccuauuu

SEQ ID NO: 666647 - RNA, 19 nt, Homo sapiens
gcagcucucuugaaauauu

SEQ ID NO: 666648 - RNA, 19 nt, Homo sapiens
cgagugaucuucucuucua

SEQ ID NO: 666649 - RNA, 19 nt, Homo sapiens
gggaaagccuugccagauu

SEQ ID NO: 666650 - RNA, 19 nt, Homo sapiens
guucagcgauuguuuacua

SEQ ID NO: 666651 - RNA, 19 nt, Homo sapiens
gaagaaggaugaagaagac

SEQ ID NO: 666652 - RNA, 19 nt, Homo sapiens
ugaguuaaauccaguguuu

SEQ ID NO: 666653 - RNA, 19 nt, Homo sapiens
gaaaguaggaugaagcuau

SEQ ID NO: 666654 - RNA, 19 nt, Homo sapiens
ucaaugagguccaucaaug

SEQ ID NO: 666655 - RNA, 19 nt, Homo sapiens
aaaguaggaugaagcuaua

SEQ ID NO: 666656 - RNA, 19 nt, Homo sapiens
ggaaguacauuaucuacag

SEQ ID NO: 666657 - RNA, 19 nt, Homo sapiens
gcagguacgugggcaagua

SEQ ID NO: 666658 - RNA, 19 nt, Homo sapiens
aagcagagguguuuccuuu

SEQ ID NO: 666659 - RNA, 19 nt, Homo sapiens
uuacagaacuuuccaucaa

SEQ ID NO: 666660 - RNA, 19 nt, Homo sapiens
gaagcacucugguucucua

SEQ ID NO: 666661 - RNA, 19 nt, Homo sapiens
guuaugcucuagaaguuua

SEQ ID NO: 666662 - RNA, 19 nt, Homo sapiens
gaacgugaccuccaggaaa

SEQ ID NO: 666663 - RNA, 19 nt, Homo sapiens
agacaucacucagaaauga

SEQ ID NO: 666664 - RNA, 19 nt, Homo sapiens
gcagccaccuuuccaagaa

SEQ ID NO: 666665 - RNA, 19 nt, Homo sapiens
gaagcccacucauuuaugu

SEQ ID NO: 666666 - RNA, 19 nt, Homo sapiens
uaaauaaacaggugcauga

SEQ ID NO: 666667 - RNA, 19 nt, Homo sapiens
ggaaagccuugccagauuc

SEQ ID NO: 666668 - RNA, 19 nt, Homo sapiens
gguaacagaguuuaaauga

SEQ ID NO: 666669 - RNA, 19 nt, Homo sapiens
agaauggaccuuugaguua

SEQ ID NO: 666670 - RNA, 19 nt, Homo sapiens
gaagaagaaggaugaagaa

SEQ ID NO: 666671 - RNA, 19 nt, Homo sapiens
gccaagauguuuaaagugu

SEQ ID NO: 666672 - RNA, 19 nt, Homo sapiens
ccacuuccuucucaucuuu

SEQ ID NO: 666673 - RNA, 19 nt, Homo sapiens
ggaugaaauuggguguuua

SEQ ID NO: 666674 - RNA, 19 nt, Homo sapiens
uguaauaccucaccaguuc

SEQ ID NO: 666675 - RNA, 19 nt, Homo sapiens
ugagagguguuuaauguga

SEQ ID NO: 666676 - RNA, 19 nt, Homo sapiens
gcaaguauauucugcucau

SEQ ID NO: 666677 - RNA, 19 nt, Homo sapiens
gcaaaccacucagcaaagu

SEQ ID NO: 666678 - RNA, 19 nt, Homo sapiens
caagauguuuaaaguguga

SEQ ID NO: 666679 - RNA, 19 nt, Homo sapiens
gguuacagaugcaugcuuu

SEQ ID NO: 666680 - RNA, 19 nt, Homo sapiens
gcaggaagcagagguguuu

SEQ ID NO: 666681 - RNA, 19 nt, Homo sapiens
ggacuucugagcagcuuua

SEQ ID NO: 666682 - RNA, 19 nt, Homo sapiens
gcagggaaguacauuaucu

SEQ ID NO: 666683 - RNA, 19 nt, Homo sapiens
ggacaauucuuggauacug

SEQ ID NO: 666684 - RNA, 19 nt, Homo sapiens
cagaguuaauccacuuaua

SEQ ID NO: 666685 - RNA, 19 nt, Homo sapiens
gaagaagaccucuggaucu

SEQ ID NO: 666686 - RNA, 19 nt, Homo sapiens
uauggaagcccacucauuu

SEQ ID NO: 666687 - RNA, 19 nt, Homo sapiens
gcagagguguuuccuuucu

SEQ ID NO: 666688 - RNA, 19 nt, Homo sapiens
gaugaaauuggguguuuaa

SEQ ID NO: 666689 - RNA, 19 nt, Homo sapiens
gacaaaguccguccucauu

SEQ ID NO: 666690 - RNA, 19 nt, Homo sapiens
gcacaaagaacauuuaucc

SEQ ID NO: 666691 - RNA, 19 nt, Homo sapiens
caacgcaaagcaagaagua

SEQ ID NO: 666692 - RNA, 19 nt, Homo sapiens
gccauaaacugccuaagca

SEQ ID NO: 666693 - RNA, 19 nt, Homo sapiens
gaggacauguaaauuagau

SEQ ID NO: 666694 - RNA, 19 nt, Homo sapiens
gauaugugauguuguuaag

SEQ ID NO: 666695 - RNA, 19 nt, Homo sapiens
gaaagauuguuccccauuu

SEQ ID NO: 666696 - RNA, 19 nt, Homo sapiens
caaggaagcuauucuacac

SEQ ID NO: 666697 - RNA, 19 nt, Homo sapiens
gcuggaagaggaauaaauu

SEQ ID NO: 666698 - RNA, 19 nt, Homo sapiens
cuaaggccauuguugauau

SEQ ID NO: 666699 - RNA, 19 nt, Homo sapiens
gugaggacauguaaauuag

SEQ ID NO: 666700 - RNA, 19 nt, Homo sapiens
caauaugguucccaagugu

SEQ ID NO: 666701 - RNA, 19 nt, Homo sapiens
cagaugacccugugaauca

SEQ ID NO: 666702 - RNA, 19 nt, Homo sapiens
gaugaacugcuugguauuu

SEQ ID NO: 666703 - RNA, 19 nt, Homo sapiens
ugugaggacauguaaauua

SEQ ID NO: 666704 - RNA, 19 nt, Homo sapiens
acugagagguguuuaaugu

SEQ ID NO: 666705 - RNA, 19 nt, Homo sapiens
gugccaagauguuuaaagu

SEQ ID NO: 666706 - RNA, 19 nt, Homo sapiens
agccacaugugacuauuua

SEQ ID NO: 666707 - RNA, 19 nt, Homo sapiens
uguguacacuguucaauau

SEQ ID NO: 666708 - RNA, 19 nt, Homo sapiens
caggugggaugcagaggua

SEQ ID NO: 666709 - RNA, 19 nt, Homo sapiens
gauacugucuuggcagcua

SEQ ID NO: 666710 - RNA, 19 nt, Homo sapiens
gaucaucacacuccucuuc

SEQ ID NO: 666711 - RNA, 19 nt, Homo sapiens
ggaagaggaauaaauuaca

SEQ ID NO: 666712 - RNA, 19 nt, Homo sapiens
ccacaugugacuauuuaaa

SEQ ID NO: 666713 - RNA, 19 nt, Homo sapiens
gaaguacauuaucuacagu

SEQ ID NO: 666714 - RNA, 19 nt, Homo sapiens
caagaaggcaucuacaaca

SEQ ID NO: 666715 - RNA, 19 nt, Homo sapiens
gcagggacucuuucuguga

SEQ ID NO: 666716 - RNA, 19 nt, Homo sapiens
gcagggagggagaaaggua

SEQ ID NO: 666717 - RNA, 19 nt, Homo sapiens
acagaugcaugcuuuccua

SEQ ID NO: 666718 - RNA, 19 nt, Homo sapiens
gcaaagcacaaagaacauu

SEQ ID NO: 666719 - RNA, 19 nt, Homo sapiens
agaagaagaagaagaagaa

SEQ ID NO: 666720 - RNA, 19 nt, Homo sapiens
gauggacaauucacuccuu

SEQ ID NO: 666721 - RNA, 19 nt, Homo sapiens
ggauaugugauguuguuaa

SEQ ID NO: 666722 - RNA, 19 nt, Homo sapiens
gcagagguaacagaguuua

SEQ ID NO: 666723 - RNA, 19 nt, Homo sapiens
uaacacacacacacacaaa

SEQ ID NO: 666724 - RNA, 19 nt, Homo sapiens
ucaauaugguucccaagug

SEQ ID NO: 666725 - RNA, 19 nt, Homo sapiens
gaacuagacaaucaucagu

SEQ ID NO: 666726 - RNA, 19 nt, Homo sapiens
caaagcacaaagaacauuu

SEQ ID NO: 666727 - RNA, 19 nt, Homo sapiens
agaagaagaagaaggauga

SEQ ID NO: 666728 - RNA, 19 nt, Homo sapiens
ucaauggcuucuuaaagga

SEQ ID NO: 666729 - RNA, 19 nt, Homo sapiens
acucagacaucacucagaa

SEQ ID NO: 666730 - RNA, 19 nt, Homo sapiens
uccaagcuguauaguauuu

SEQ ID NO: 666731 - RNA, 19 nt, Homo sapiens
gaacacaccugccaaguua

SEQ ID NO: 666732 - RNA, 19 nt, Homo sapiens
gaaaguagcugacuauuau

SEQ ID NO: 666733 - RNA, 19 nt, Homo sapiens
uaagagagcugcuuccuuu

SEQ ID NO: 666734 - RNA, 19 nt, Homo sapiens
uagcagagcugaugguuua

SEQ ID NO: 666735 - RNA, 19 nt, Homo sapiens
gcaaagauguccugccaaa

SEQ ID NO: 666736 - RNA, 19 nt, Homo sapiens
ggaaggaauuggccaguuu

SEQ ID NO: 666737 - RNA, 19 nt, Homo sapiens
ggaaaguagcugacuauua

SEQ ID NO: 666738 - RNA, 19 nt, Homo sapiens
gagaggagcugaugaugga

SEQ ID NO: 666739 - RNA, 19 nt, Homo sapiens
ucacacaacugcuuagaaa

SEQ ID NO: 666740 - RNA, 19 nt, Homo sapiens
gaagcaagcugccaugauc

SEQ ID NO: 666741 - RNA, 19 nt, Homo sapiens
gcaauaaaguucugagaca

SEQ ID NO: 666742 - RNA, 19 nt, Homo sapiens
gaaggaaaguagcugacua

SEQ ID NO: 666743 - RNA, 19 nt, Homo sapiens
cagcagagaaggugaauua

SEQ ID NO: 666744 - RNA, 19 nt, Homo sapiens
cagagaaggugaauuaguu

SEQ ID NO: 666745 - RNA, 19 nt, Homo sapiens
gcugaugccugcuugauuu

SEQ ID NO: 666746 - RNA, 19 nt, Homo sapiens
ggaaacaaacggaaauaaa

SEQ ID NO: 666747 - RNA, 19 nt, Homo sapiens
ucaaacagcccgugaaauu

SEQ ID NO: 666748 - RNA, 19 nt, Homo sapiens
ugaaugggaucucuuuaaa

SEQ ID NO: 666749 - RNA, 19 nt, Homo sapiens
gcaaauaugcauucaguug

SEQ ID NO: 666750 - RNA, 19 nt, Homo sapiens
gaacugagagagauuguga

SEQ ID NO: 666751 - RNA, 19 nt, Homo sapiens
uaaacaaggucacagcauu

SEQ ID NO: 666752 - RNA, 19 nt, Homo sapiens
caaguugacuauccuuauu

SEQ ID NO: 666753 - RNA, 19 nt, Homo sapiens
agaaauggauugaaggaaa

SEQ ID NO: 666754 - RNA, 19 nt, Homo sapiens
gaagagggaagucauuuga

SEQ ID NO: 666755 - RNA, 19 nt, Homo sapiens
caacaugugugaaagaaca

SEQ ID NO: 666756 - RNA, 19 nt, Homo sapiens
ggcaaauucucuacucuuu

SEQ ID NO: 666757 - RNA, 19 nt, Homo sapiens
cuaaugaacucccaagaug

SEQ ID NO: 666758 - RNA, 19 nt, Homo sapiens
gaaacaaacggaaauaaag

SEQ ID NO: 666759 - RNA, 19 nt, Homo sapiens
gaacucugaugaucugaau

SEQ ID NO: 666760 - RNA, 19 nt, Homo sapiens
ugaacuaccucaaagagaa

SEQ ID NO: 666761 - RNA, 19 nt, Homo sapiens
gaaauggauugaaggaaag

SEQ ID NO: 666762 - RNA, 19 nt, Homo sapiens
gcacugaccaggcuuauca

SEQ ID NO: 666763 - RNA, 19 nt, Homo sapiens
ggacuuagcacauuaaugc

SEQ ID NO: 666764 - RNA, 19 nt, Homo sapiens
caaacagcccgugaaauua

SEQ ID NO: 666765 - RNA, 19 nt, Homo sapiens
ccaaagcacucauccaagu

SEQ ID NO: 666766 - RNA, 19 nt, Homo sapiens
acagugagcuucauuaugg

SEQ ID NO: 666767 - RNA, 19 nt, Homo sapiens
ggaggccuuuggugucuua

SEQ ID NO: 666768 - RNA, 19 nt, Homo sapiens
ugagagagauugugacauc

SEQ ID NO: 666769 - RNA, 19 nt, Homo sapiens
caggagaaaucaaagcaaa

SEQ ID NO: 666770 - RNA, 19 nt, Homo sapiens
ccagggacuuagcacauua

SEQ ID NO: 666771 - RNA, 19 nt, Homo sapiens
aguaacaucuggcaaauau

SEQ ID NO: 666772 - RNA, 19 nt, Homo sapiens
ucucaaagguccaagcaaa

SEQ ID NO: 666773 - RNA, 19 nt, Homo sapiens
ggagaaaucaaagcaaauu

SEQ ID NO: 666774 - RNA, 19 nt, Homo sapiens
caacugagccucccuagca

SEQ ID NO: 666775 - RNA, 19 nt, Homo sapiens
gaaggcugcugcacaaugg

SEQ ID NO: 666776 - RNA, 19 nt, Homo sapiens
aggauuugcuguaucuuua

SEQ ID NO: 666777 - RNA, 19 nt, Homo sapiens
gagcaaaguuuaggagaag

SEQ ID NO: 666778 - RNA, 19 nt, Homo sapiens
gaauuggccaguuugcaua

SEQ ID NO: 666779 - RNA, 19 nt, Homo sapiens
guuagccaaucgauuuaua

SEQ ID NO: 666780 - RNA, 19 nt, Homo sapiens
gaauacacaagucaagaaa

SEQ ID NO: 666781 - RNA, 19 nt, Homo sapiens
ugacaucuauacuugaaga

SEQ ID NO: 666782 - RNA, 19 nt, Homo sapiens
gggauuuguuugccucuuu

SEQ ID NO: 666783 - RNA, 19 nt, Homo sapiens
ugcuguaucuuuacuguua

SEQ ID NO: 666784 - RNA, 19 nt, Homo sapiens
gcauacaccucccugucuu

SEQ ID NO: 666785 - RNA, 19 nt, Homo sapiens
gacgagaccugcucacucu

SEQ ID NO: 666786 - RNA, 19 nt, Homo sapiens
caccacagcugaagacauc

SEQ ID NO: 666787 - RNA, 19 nt, Homo sapiens
aaugggaucucuuuaaauc

SEQ ID NO: 666788 - RNA, 19 nt, Homo sapiens
cagaagaacugagagagau

SEQ ID NO: 666789 - RNA, 19 nt, Homo sapiens
uuaguuagccaaucgauuu

SEQ ID NO: 666790 - RNA, 19 nt, Homo sapiens
gagaagagggaagucauuu

SEQ ID NO: 666791 - RNA, 19 nt, Homo sapiens
uuaccugucuugaaacuga

SEQ ID NO: 666792 - RNA, 19 nt, Homo sapiens
ggagauauuuccgcuucuu

SEQ ID NO: 666793 - RNA, 19 nt, Homo sapiens
cauccaaguucuagagcua

SEQ ID NO: 666794 - RNA, 19 nt, Homo sapiens
ggaagcagauuggguaaaa

SEQ ID NO: 666795 - RNA, 19 nt, Homo sapiens
acaccucccugucuucaaa

SEQ ID NO: 666796 - RNA, 19 nt, Homo sapiens
ugucguaucuucccuaaag

SEQ ID NO: 666797 - RNA, 19 nt, Homo sapiens
ucacauuuguccuuucuuc

SEQ ID NO: 666798 - RNA, 19 nt, Homo sapiens
gagauggaacuaauuuguu

SEQ ID NO: 666799 - RNA, 19 nt, Homo sapiens
ccaaaguggaugagaauga

SEQ ID NO: 666800 - RNA, 19 nt, Homo sapiens
ggagaagagggaagucauu

SEQ ID NO: 666801 - RNA, 19 nt, Homo sapiens
uggcagaugugguucaaga

SEQ ID NO: 666802 - RNA, 19 nt, Homo sapiens
gugaaugggaucucuuuaa

SEQ ID NO: 666803 - RNA, 19 nt, Homo sapiens
agacguggcugacaucaag

SEQ ID NO: 666804 - RNA, 19 nt, Homo sapiens
gaguugaaauuggcuguga

SEQ ID NO: 666805 - RNA, 19 nt, Homo sapiens
gcuuagaaauggauugaag

SEQ ID NO: 666806 - RNA, 19 nt, Homo sapiens
cugaagacaucgaacaguu

SEQ ID NO: 666807 - RNA, 19 nt, Homo sapiens
cagaacaggagaaaucaaa

SEQ ID NO: 666808 - RNA, 19 nt, Homo sapiens
ucacaaagacccagacagu

SEQ ID NO: 666809 - RNA, 19 nt, Homo sapiens
gaagaacugagagagauug

SEQ ID NO: 666810 - RNA, 19 nt, Homo sapiens
caagcugccaugauccuua

SEQ ID NO: 666811 - RNA, 19 nt, Homo sapiens
ucucuacucuuuccuuguu

SEQ ID NO: 666812 - RNA, 19 nt, Homo sapiens
gggacaucauucugacuuu

SEQ ID NO: 666813 - RNA, 19 nt, Homo sapiens
ggaaggcugcugcacaaug

SEQ ID NO: 666814 - RNA, 19 nt, Homo sapiens
gcagagaaggugaauuagu

SEQ ID NO: 666815 - RNA, 19 nt, Homo sapiens
ggaaaagacuucuguuugc

SEQ ID NO: 666816 - RNA, 19 nt, Homo sapiens
uugguuaccugucuugaaa

SEQ ID NO: 666817 - RNA, 19 nt, Homo sapiens
gaagaauacacaagucaag

SEQ ID NO: 666818 - RNA, 19 nt, Homo sapiens
gcuuguggaucacuuuaug

SEQ ID NO: 666819 - RNA, 19 nt, Homo sapiens
uuugucagcuacuugguua

SEQ ID NO: 666820 - RNA, 19 nt, Homo sapiens
gggaaacaaacggaaauaa

SEQ ID NO: 666821 - RNA, 19 nt, Homo sapiens
augcuaaccugcuuccuuu

SEQ ID NO: 666822 - RNA, 19 nt, Homo sapiens
ggaauuggccaguuugcau

SEQ ID NO: 666823 - RNA, 19 nt, Homo sapiens
gaaggaauuggccaguuug

SEQ ID NO: 666824 - RNA, 19 nt, Homo sapiens
uggcaaauaugcauucagu

SEQ ID NO: 666825 - RNA, 19 nt, Homo sapiens
gguugaggaucuucacgaa

SEQ ID NO: 666826 - RNA, 19 nt, Homo sapiens
gauccuuaaugaacugguu

SEQ ID NO: 666827 - RNA, 19 nt, Homo sapiens
guuacuugguuaucugaaa

SEQ ID NO: 666828 - RNA, 19 nt, Homo sapiens
caaauucucuacucuuucc

SEQ ID NO: 666829 - RNA, 19 nt, Homo sapiens
ugagaguccugaaauccaa

SEQ ID NO: 666830 - RNA, 19 nt, Homo sapiens
uucaggaacuucagcagua

SEQ ID NO: 666831 - RNA, 19 nt, Homo sapiens
ggaaguaguucucuuugua

SEQ ID NO: 666832 - RNA, 19 nt, Homo sapiens
gaucaacccucccuaaauu

SEQ ID NO: 666833 - RNA, 19 nt, Homo sapiens
gcacagaugucaaggugua

SEQ ID NO: 666834 - RNA, 19 nt, Homo sapiens
gaaagucucugaggaaguu

SEQ ID NO: 666835 - RNA, 19 nt, Homo sapiens
gagaagauguaauccuuaa

SEQ ID NO: 666836 - RNA, 19 nt, Homo sapiens
gaugguaacucccaauuug

SEQ ID NO: 666837 - RNA, 19 nt, Homo sapiens
ggcaauagcucuagggaaa

SEQ ID NO: 666838 - RNA, 19 nt, Homo sapiens
ggaccugccuuucccauuu

SEQ ID NO: 666839 - RNA, 19 nt, Homo sapiens
gaaggucugugaucaggua

SEQ ID NO: 666840 - RNA, 19 nt, Homo sapiens
gauagaaggugaagaccaa

SEQ ID NO: 666841 - RNA, 19 nt, Homo sapiens
guauugaucugccucgaua

SEQ ID NO: 666842 - RNA, 19 nt, Homo sapiens
gcagggauguggucauuga

SEQ ID NO: 666843 - RNA, 19 nt, Homo sapiens
cagcagagaucaauauugu

SEQ ID NO: 666844 - RNA, 19 nt, Homo sapiens
gaacuucguugugucauug

SEQ ID NO: 666845 - RNA, 19 nt, Homo sapiens
gagcgacucugcagauuug

SEQ ID NO: 666846 - RNA, 19 nt, Homo sapiens
cacaagagcucuccauaga

SEQ ID NO: 666847 - RNA, 19 nt, Homo sapiens
guacaucuaugaggaguuu

SEQ ID NO: 666848 - RNA, 19 nt, Homo sapiens
ggaggucccugaggagaua

SEQ ID NO: 666849 - RNA, 19 nt, Homo sapiens
gcagcgagcuuuggauuau

SEQ ID NO: 666850 - RNA, 19 nt, Homo sapiens
ggagauguauggucacuuc

SEQ ID NO: 666851 - RNA, 19 nt, Homo sapiens
caucugacauggccacuaa

SEQ ID NO: 666852 - RNA, 19 nt, Homo sapiens
gagcgugacuuucgacaga

SEQ ID NO: 666853 - RNA, 19 nt, Homo sapiens
cagaagaccacaauguuua

SEQ ID NO: 666854 - RNA, 19 nt, Homo sapiens
ggaaacccuuguagaaguu

SEQ ID NO: 666855 - RNA, 19 nt, Homo sapiens
gcagaagaccacaauguuu

SEQ ID NO: 666856 - RNA, 19 nt, Homo sapiens
gccaaugacucaaauccua

SEQ ID NO: 666857 - RNA, 19 nt, Homo sapiens
ggaaagagauucgauaucc

SEQ ID NO: 666858 - RNA, 19 nt, Homo sapiens
gggagaagauguaauccuu

SEQ ID NO: 666859 - RNA, 19 nt, Homo sapiens
ggccagauaugauuaugaa

SEQ ID NO: 666860 - RNA, 19 nt, Homo sapiens
cuuaggagaugcuguagua

SEQ ID NO: 666861 - RNA, 19 nt, Homo sapiens
gaagauguaauccuuaaug

SEQ ID NO: 666862 - RNA, 19 nt, Homo sapiens
caagagcucuccauagaag

SEQ ID NO: 666863 - RNA, 19 nt, Homo sapiens
ggagaagacuggaaaacua

SEQ ID NO: 666864 - RNA, 19 nt, Homo sapiens
ccuuauagauccuuccaua

SEQ ID NO: 666865 - RNA, 19 nt, Homo sapiens
gcuccucacuuagccauua

SEQ ID NO: 666866 - RNA, 19 nt, Homo sapiens
gcaagcugguccauaaguu

SEQ ID NO: 666867 - RNA, 19 nt, Homo sapiens
ucucagagcuuaacuacau

SEQ ID NO: 666868 - RNA, 19 nt, Homo sapiens
ggaguucccugaggagauu

SEQ ID NO: 666869 - RNA, 19 nt, Homo sapiens
gaaagguguugaggaagaa

SEQ ID NO: 666870 - RNA, 19 nt, Homo sapiens
caacacacaggaucccuua

SEQ ID NO: 666871 - RNA, 19 nt, Homo sapiens
gaaauacuacgaugacugu

SEQ ID NO: 666872 - RNA, 19 nt, Homo sapiens
ucaagaacucgaugaaaua

SEQ ID NO: 666873 - RNA, 19 nt, Homo sapiens
gucaagaacucgaugaaau

SEQ ID NO: 666874 - RNA, 19 nt, Homo sapiens
ccaagaaauuuguccuuau

SEQ ID NO: 666875 - RNA, 19 nt, Homo sapiens
gagauaaucagguucuauu

SEQ ID NO: 666876 - RNA, 19 nt, Homo sapiens
uaaaggaaaugccgcuuca

SEQ ID NO: 666877 - RNA, 19 nt, Homo sapiens
caauuuggcuucagugauc

SEQ ID NO: 666878 - RNA, 19 nt, Homo sapiens
ggaagguacaauugacuua

SEQ ID NO: 666879 - RNA, 19 nt, Homo sapiens
gagauucgauauccaguca

SEQ ID NO: 666880 - RNA, 19 nt, Homo sapiens
ugaaagguguugaggaaga

SEQ ID NO: 666881 - RNA, 19 nt, Homo sapiens
agaacucgaugaaauacua

SEQ ID NO: 666882 - RNA, 19 nt, Homo sapiens
gaaagugggccuccucugu

SEQ ID NO: 666883 - RNA, 19 nt, Homo sapiens
uaucugaaaugucuggaaa

SEQ ID NO: 666884 - RNA, 19 nt, Homo sapiens
gguggucccugaagugauu

SEQ ID NO: 666885 - RNA, 19 nt, Homo sapiens
gugagugaauucuugagua

SEQ ID NO: 666886 - RNA, 19 nt, Homo sapiens
gcugugggcuucugucuuc

SEQ ID NO: 666887 - RNA, 19 nt, Homo sapiens
ggucacuucucagguauaa

SEQ ID NO: 666888 - RNA, 19 nt, Homo sapiens
uggcugaacuggagaaaga

SEQ ID NO: 666889 - RNA, 19 nt, Homo sapiens
ggagaagauguaauccuua

SEQ ID NO: 666890 - RNA, 19 nt, Homo sapiens
guaguucucuuuguaugaa

SEQ ID NO: 666891 - RNA, 19 nt, Homo sapiens
ggucugugaucagguauuu

SEQ ID NO: 666892 - RNA, 19 nt, Homo sapiens
cuacaagacagggaaauua

SEQ ID NO: 666893 - RNA, 19 nt, Homo sapiens
ggaacuucguugugucauu

SEQ ID NO: 666894 - RNA, 19 nt, Homo sapiens
ggaguucucuguggagguu

SEQ ID NO: 666895 - RNA, 19 nt, Homo sapiens
ccaggaaacccuuguagaa

SEQ ID NO: 666896 - RNA, 19 nt, Homo sapiens
gcagagaacccacgaggau

SEQ ID NO: 666897 - RNA, 19 nt, Homo sapiens
gaagagugccaacaugaau

SEQ ID NO: 666898 - RNA, 19 nt, Homo sapiens
gaucauuguuggcaucugu

SEQ ID NO: 666899 - RNA, 19 nt, Homo sapiens
cccaagaaauuuguccuua

SEQ ID NO: 666900 - RNA, 19 nt, Homo sapiens
ccauuagacuugaauagga

SEQ ID NO: 666901 - RNA, 19 nt, Homo sapiens
uauggucacuucucaggua

SEQ ID NO: 666902 - RNA, 19 nt, Homo sapiens
uagagcagcugaagucugu

SEQ ID NO: 666903 - RNA, 19 nt, Homo sapiens
ggaagaggguauugaucug

SEQ ID NO: 666904 - RNA, 19 nt, Homo sapiens
gggacagacuggccaaaga

SEQ ID NO: 666905 - RNA, 19 nt, Homo sapiens
gaaguaguucucuuuguau

SEQ ID NO: 666906 - RNA, 19 nt, Homo sapiens
ugaggaaguuugccagcua

SEQ ID NO: 666907 - RNA, 19 nt, Homo sapiens
ggccucagauaacccauuu

SEQ ID NO: 666908 - RNA, 19 nt, Homo sapiens
ccauggagguacuuucuga

SEQ ID NO: 666909 - RNA, 19 nt, Homo sapiens
gagagcagcguccgaaaga

SEQ ID NO: 666910 - RNA, 19 nt, Homo sapiens
ucaaugaucuggccaugca

SEQ ID NO: 666911 - RNA, 19 nt, Homo sapiens
cgaucaaucuguuaucuca

SEQ ID NO: 666912 - RNA, 19 nt, Homo sapiens
gcacaagagcucuccauag

SEQ ID NO: 666913 - RNA, 19 nt, Homo sapiens
ggaugagucugucaacaag

SEQ ID NO: 666914 - RNA, 19 nt, Homo sapiens
gaggagaaacuggaaauug

SEQ ID NO: 666915 - RNA, 19 nt, Homo sapiens
gcuaugauaucaguaagau

SEQ ID NO: 666916 - RNA, 19 nt, Homo sapiens
guacuucccugcucaacuc

SEQ ID NO: 666917 - RNA, 19 nt, Homo sapiens
gaaagagauucgauaucca

SEQ ID NO: 666918 - RNA, 19 nt, Homo sapiens
gccacugccucaucucuuu

SEQ ID NO: 666919 - RNA, 19 nt, Homo sapiens
aggagaugcuguaguagua

SEQ ID NO: 666920 - RNA, 19 nt, Homo sapiens
uauagauccuuccauauca

SEQ ID NO: 666921 - RNA, 19 nt, Homo sapiens
cugaggagauaaauuagaa

SEQ ID NO: 666922 - RNA, 19 nt, Homo sapiens
acacguggcugaagaacau

SEQ ID NO: 666923 - RNA, 19 nt, Homo sapiens
gauguauggucacuucuca

SEQ ID NO: 666924 - RNA, 19 nt, Homo sapiens
caacagauggcacagaugu

SEQ ID NO: 666925 - RNA, 19 nt, Homo sapiens
gauacaagcaaagguuuaa

SEQ ID NO: 666926 - RNA, 19 nt, Homo sapiens
gcagccaggccucagauaa

SEQ ID NO: 666927 - RNA, 19 nt, Homo sapiens
gaaccucagaucauuguug

SEQ ID NO: 666928 - RNA, 19 nt, Homo sapiens
caacaugaaugggcuacug

SEQ ID NO: 666929 - RNA, 19 nt, Homo sapiens
guggugagaucgaggagaa

SEQ ID NO: 666930 - RNA, 19 nt, Homo sapiens
gcagagaucaauauuguac

SEQ ID NO: 666931 - RNA, 19 nt, Homo sapiens
gcccaaggcugaagauuua

SEQ ID NO: 666932 - RNA, 19 nt, Homo sapiens
gaagauggguucauauugu

SEQ ID NO: 666933 - RNA, 19 nt, Homo sapiens
gcagaaguauguugaauau

SEQ ID NO: 666934 - RNA, 19 nt, Homo sapiens
ugaggacgcugaugaaaua

SEQ ID NO: 666935 - RNA, 19 nt, Homo sapiens
gaaguacuaucaucagaaa

SEQ ID NO: 666936 - RNA, 19 nt, Homo sapiens
ccagagguauacagaauua

SEQ ID NO: 666937 - RNA, 19 nt, Homo sapiens
uaacggaaaugaacuauuc

SEQ ID NO: 666938 - RNA, 19 nt, Homo sapiens
gcaagaagaagaagaguaa

SEQ ID NO: 666939 - RNA, 19 nt, Homo sapiens
ggagaaagaccuagaaaga

SEQ ID NO: 666940 - RNA, 19 nt, Homo sapiens
ggauuaaacucucgauaga

SEQ ID NO: 666941 - RNA, 19 nt, Homo sapiens
gcagauagguuagacagaa

SEQ ID NO: 666942 - RNA, 19 nt, Homo sapiens
gcuggaagcucuugauuau

SEQ ID NO: 666943 - RNA, 19 nt, Homo sapiens
ugucagaauugucguauua

SEQ ID NO: 666944 - RNA, 19 nt, Homo sapiens
gaagguuccuguagugauu

SEQ ID NO: 666945 - RNA, 19 nt, Homo sapiens
ggagacagaugcuggaaga

SEQ ID NO: 666946 - RNA, 19 nt, Homo sapiens
agaaagaccuagaaagaaa

SEQ ID NO: 666947 - RNA, 19 nt, Homo sapiens
ggaguagccuuuggagaua

SEQ ID NO: 666948 - RNA, 19 nt, Homo sapiens
ccaaauauauucaguccuu

SEQ ID NO: 666949 - RNA, 19 nt, Homo sapiens
gaacagcuauauuguccuu

SEQ ID NO: 666950 - RNA, 19 nt, Homo sapiens
ggacgcugaugaaauaauu

SEQ ID NO: 666951 - RNA, 19 nt, Homo sapiens
agaaagaucuucaucaaca

SEQ ID NO: 666952 - RNA, 19 nt, Homo sapiens
caagggaacuggagacaau

SEQ ID NO: 666953 - RNA, 19 nt, Homo sapiens
ggagggaaguacaaagauu

SEQ ID NO: 666954 - RNA, 19 nt, Homo sapiens
aagaagaacugaaugaaga

SEQ ID NO: 666955 - RNA, 19 nt, Homo sapiens
gggcagaaguugaauauac

SEQ ID NO: 666956 - RNA, 19 nt, Homo sapiens
uauagcagauccauucuuu

SEQ ID NO: 666957 - RNA, 19 nt, Homo sapiens
uggaagcucuugauuauga

SEQ ID NO: 666958 - RNA, 19 nt, Homo sapiens
uaacaaggcaguagauuug

SEQ ID NO: 666959 - RNA, 19 nt, Homo sapiens
ugaaugacauggaugacua

SEQ ID NO: 666960 - RNA, 19 nt, Homo sapiens
gaaagacaaugcauuccau

SEQ ID NO: 666961 - RNA, 19 nt, Homo sapiens
uuacaaggaugccaagaaa

SEQ ID NO: 666962 - RNA, 19 nt, Homo sapiens
ggagaagguuccuguagug

SEQ ID NO: 666963 - RNA, 19 nt, Homo sapiens
ccaagaagauuccgauaag

SEQ ID NO: 666964 - RNA, 19 nt, Homo sapiens
gaucaaggaggcagauuaa

SEQ ID NO: 666965 - RNA, 19 nt, Homo sapiens
gcagauccauucuuugcuu

SEQ ID NO: 666966 - RNA, 19 nt, Homo sapiens
gcuggaagauggguucaua

SEQ ID NO: 666967 - RNA, 19 nt, Homo sapiens
ggaaguacaaagauuauug

SEQ ID NO: 666968 - RNA, 19 nt, Homo sapiens
gagggaaguacaaagauua

SEQ ID NO: 666969 - RNA, 19 nt, Homo sapiens
ggauacaugucuugucaga

SEQ ID NO: 666970 - RNA, 19 nt, Homo sapiens
gaagaaccaugaucagcau

SEQ ID NO: 666971 - RNA, 19 nt, Homo sapiens
gacagaaaguggaagagaa

SEQ ID NO: 666972 - RNA, 19 nt, Homo sapiens
gaaauaugcgcaugauuca

SEQ ID NO: 666973 - RNA, 19 nt, Homo sapiens
gaacugaaugugcaacuug

SEQ ID NO: 666974 - RNA, 19 nt, Homo sapiens
gaaauuuguuccacaggau

SEQ ID NO: 666975 - RNA, 19 nt, Homo sapiens
ggaagaggauauagcagau

SEQ ID NO: 666976 - RNA, 19 nt, Homo sapiens
gaucaguacagauaucuuu

SEQ ID NO: 666977 - RNA, 19 nt, Homo sapiens
gcaacaugcagauagguua

SEQ ID NO: 666978 - RNA, 19 nt, Homo sapiens
gguccaggcuaauaaaguu

SEQ ID NO: 666979 - RNA, 19 nt, Homo sapiens
gcagaaacagugcugauga

SEQ ID NO: 666980 - RNA, 19 nt, Homo sapiens
ugaagcauaugacauucua

SEQ ID NO: 666981 - RNA, 19 nt, Homo sapiens
gaaacagugcugaugauga

SEQ ID NO: 666982 - RNA, 19 nt, Homo sapiens
gaagugauggagacaauga

SEQ ID NO: 666983 - RNA, 19 nt, Homo sapiens
gagacucuuugcugaaauu

SEQ ID NO: 666984 - RNA, 19 nt, Homo sapiens
gaaagacuugugaagcaua

SEQ ID NO: 666985 - RNA, 19 nt, Homo sapiens
caagaaagacaaugcauuc

SEQ ID NO: 666986 - RNA, 19 nt, Homo sapiens
gcuacucccuguugugauu

SEQ ID NO: 666987 - RNA, 19 nt, Homo sapiens
gcugugaacuguguccuaa

SEQ ID NO: 666988 - RNA, 19 nt, Homo sapiens
gagaaagaccuagaaagaa

SEQ ID NO: 666989 - RNA, 19 nt, Homo sapiens
ggaaauaaggagggaagua

SEQ ID NO: 666990 - RNA, 19 nt, Homo sapiens
ggaagaaguacuaucauca

SEQ ID NO: 666991 - RNA, 19 nt, Homo sapiens
gaucuucaagcuuuaauga

SEQ ID NO: 666992 - RNA, 19 nt, Homo sapiens
ggaagauggguucauauug

SEQ ID NO: 666993 - RNA, 19 nt, Homo sapiens
gaagaagaagaguaaaguu

SEQ ID NO: 666994 - RNA, 19 nt, Homo sapiens
caaugaggaugaugaagau

SEQ ID NO: 666995 - RNA, 19 nt, Homo sapiens
gacaaccgcuacagaggaa

SEQ ID NO: 666996 - RNA, 19 nt, Homo sapiens
gaaagaucuucaucaacau

SEQ ID NO: 666997 - RNA, 19 nt, Homo sapiens
gugaaagacuugugaagca

SEQ ID NO: 666998 - RNA, 19 nt, Homo sapiens
auacaugucuugucagaau

SEQ ID NO: 666999 - RNA, 19 nt, Homo sapiens
uaaggaaccagugaaauuu

SEQ ID NO: 667000 - RNA, 19 nt, Homo sapiens
guaagaagaaccaugauca

SEQ ID NO: 667001 - RNA, 19 nt, Homo sapiens
gaagaagaacugaaugaag

SEQ ID NO: 667002 - RNA, 19 nt, Homo sapiens
uauaugaaguacugcauug

SEQ ID NO: 667003 - RNA, 19 nt, Homo sapiens
ggaaaccucuuuuauaagu

SEQ ID NO: 667004 - RNA, 19 nt, Homo sapiens
ccggaaaccucuuuuauaa

SEQ ID NO: 667005 - RNA, 19 nt, Homo sapiens
ucagauacccuucaugaga

SEQ ID NO: 667006 - RNA, 19 nt, Homo sapiens
gaaagaguuccuagagaga

SEQ ID NO: 667007 - RNA, 19 nt, Homo sapiens
gcagauauggccauggaaa

SEQ ID NO: 667008 - RNA, 19 nt, Homo sapiens
uggaagagcugaaugacau

SEQ ID NO: 667009 - RNA, 19 nt, Homo sapiens
gaagggagugguaauggaa

SEQ ID NO: 667010 - RNA, 19 nt, Homo sapiens
caaccuaccagcugaaaga

SEQ ID NO: 667011 - RNA, 19 nt, Homo sapiens
cgauagaguacauaaagua

SEQ ID NO: 667012 - RNA, 19 nt, Homo sapiens
caagaagauuccgauaaga

SEQ ID NO: 667013 - RNA, 19 nt, Homo sapiens
gggaagugauggagacaau

SEQ ID NO: 667014 - RNA, 19 nt, Homo sapiens
uaagucaacggcagaagua

SEQ ID NO: 667015 - RNA, 19 nt, Homo sapiens
gcuauauuguccuuucuau

SEQ ID NO: 667016 - RNA, 19 nt, Homo sapiens
gaggaacugaccaaugaua

SEQ ID NO: 667017 - RNA, 19 nt, Homo sapiens
aaacagugcugaugaugag

SEQ ID NO: 667018 - RNA, 19 nt, Homo sapiens
gaagaacugaaugaagaua

SEQ ID NO: 667019 - RNA, 19 nt, Homo sapiens
gcuauucuguuuccuucaa

SEQ ID NO: 667020 - RNA, 19 nt, Homo sapiens
cugugggacuuaauaaaua

SEQ ID NO: 667021 - RNA, 19 nt, Homo sapiens
uaaaggagaacagcuauau

SEQ ID NO: 667022 - RNA, 19 nt, Homo sapiens
gcggaaagcagaacucaug

SEQ ID NO: 667023 - RNA, 19 nt, Homo sapiens
caugugaccugugcucaaa

SEQ ID NO: 667024 - RNA, 19 nt, Homo sapiens
gaaauaauucagugugaca

SEQ ID NO: 667025 - RNA, 19 nt, Homo sapiens
augaggaacugaccaauga

SEQ ID NO: 667026 - RNA, 19 nt, Homo sapiens
cgacgaaaccgaccacuuc

SEQ ID NO: 667027 - RNA, 19 nt, Homo sapiens
gcaguagauuugccugugu

SEQ ID NO: 667028 - RNA, 19 nt, Homo sapiens
uuaaggaaccagugaaauu

SEQ ID NO: 667029 - RNA, 19 nt, Homo sapiens
cagauccauucuuugcuua

SEQ ID NO: 667030 - RNA, 19 nt, Homo sapiens
gacccucgcuuugcuagaa

SEQ ID NO: 667031 - RNA, 19 nt, Homo sapiens
gcacaaagcuggauucaug

SEQ ID NO: 667032 - RNA, 19 nt, Homo sapiens
gaaaugcccucuucagauu

SEQ ID NO: 667033 - RNA, 19 nt, Homo sapiens
ggaauuugcuuguuacuug

SEQ ID NO: 667034 - RNA, 19 nt, Homo sapiens
gaggacagcuuugaaguuu

SEQ ID NO: 667035 - RNA, 19 nt, Homo sapiens
gaaauuugguggaucuguu

SEQ ID NO: 667036 - RNA, 19 nt, Homo sapiens
gccauacccucuugccuua

SEQ ID NO: 667037 - RNA, 19 nt, Homo sapiens
gcacacagccucuauagca

SEQ ID NO: 667038 - RNA, 19 nt, Homo sapiens
ccacaaacccugccucuga

SEQ ID NO: 667039 - RNA, 19 nt, Homo sapiens
ggagaugcuuccuucugua

SEQ ID NO: 667040 - RNA, 19 nt, Homo sapiens
gaacugcacacgccaaaga

SEQ ID NO: 667041 - RNA, 19 nt, Homo sapiens
caauugggcuggcuuagga

SEQ ID NO: 667042 - RNA, 19 nt, Homo sapiens
ccgaugagauguccaguug

SEQ ID NO: 667043 - RNA, 19 nt, Homo sapiens
ggaaaugcccucuucagau

SEQ ID NO: 667044 - RNA, 19 nt, Homo sapiens
agucugaccuucuagcaua

SEQ ID NO: 667045 - RNA, 19 nt, Homo sapiens
ccagaaccauuuggccuua

SEQ ID NO: 667046 - RNA, 19 nt, Homo sapiens
ugaccagucugaucaaaga

SEQ ID NO: 667047 - RNA, 19 nt, Homo sapiens
cuaacuaacuuccaaaugg

SEQ ID NO: 667048 - RNA, 19 nt, Homo sapiens
gcacaggaguugaccacau

SEQ ID NO: 667049 - RNA, 19 nt, Homo sapiens
uuaaggagcuggcagaaag

SEQ ID NO: 667050 - RNA, 19 nt, Homo sapiens
acaagaaggucgguguuaa

SEQ ID NO: 667051 - RNA, 19 nt, Homo sapiens
gacaggaaaugcccucuuc

SEQ ID NO: 667052 - RNA, 19 nt, Homo sapiens
uaaauaaagcuuccugguu

SEQ ID NO: 667053 - RNA, 19 nt, Homo sapiens
aaacaaacccuaacuaacu

SEQ ID NO: 667054 - RNA, 19 nt, Homo sapiens
aaagcuuccugguucaaua

SEQ ID NO: 667055 - RNA, 19 nt, Homo sapiens
gccuuuagcugguuucaug

SEQ ID NO: 667056 - RNA, 19 nt, Homo sapiens
gcacaucacccaccucaag

SEQ ID NO: 667057 - RNA, 19 nt, Homo sapiens
guagaaauuugguggaucu

SEQ ID NO: 667058 - RNA, 19 nt, Homo sapiens
ggccuuaauuccaauguga

SEQ ID NO: 667059 - RNA, 19 nt, Homo sapiens
gggagaugcuuccuucugu

SEQ ID NO: 667060 - RNA, 19 nt, Homo sapiens
gcucuagucucucaggaau

SEQ ID NO: 667061 - RNA, 19 nt, Homo sapiens
caagaaggucgguguuaaa

SEQ ID NO: 667062 - RNA, 19 nt, Homo sapiens
ucuagucucucaggaauuu

SEQ ID NO: 667063 - RNA, 19 nt, Homo sapiens
gaaguguggcgaccagaaa

SEQ ID NO: 667064 - RNA, 19 nt, Homo sapiens
gauagcacauaggcuguuu

SEQ ID NO: 667065 - RNA, 19 nt, Homo sapiens
ggaggcaugucuacuugug

SEQ ID NO: 667066 - RNA, 19 nt, Homo sapiens
ggacagcuuugaaguuugc

SEQ ID NO: 667067 - RNA, 19 nt, Homo sapiens
ucacagccuugcccacaaa

SEQ ID NO: 667068 - RNA, 19 nt, Homo sapiens
gcacauggugacagguaua

SEQ ID NO: 667069 - RNA, 19 nt, Homo sapiens
gacaagaaggucgguguua

SEQ ID NO: 667070 - RNA, 19 nt, Homo sapiens
cacaggaguugaccacauu

SEQ ID NO: 667071 - RNA, 19 nt, Homo sapiens
gaauuugcuuguuacuugu

SEQ ID NO: 667072 - RNA, 19 nt, Homo sapiens
gcucuccucucaagguuug

SEQ ID NO: 667073 - RNA, 19 nt, Homo sapiens
guuagggccucccguguug

SEQ ID NO: 667074 - RNA, 19 nt, Homo sapiens
cagcacaccugccucaaca

SEQ ID NO: 667075 - RNA, 19 nt, Homo sapiens
gagaugcuuccuucuguaa

SEQ ID NO: 667076 - RNA, 19 nt, Homo sapiens
gcagauagagaagaacuga

SEQ ID NO: 667077 - RNA, 19 nt, Homo sapiens
gaccacauuuggccauuuc

SEQ ID NO: 667078 - RNA, 19 nt, Homo sapiens
ccacgcccuugucagcuua

SEQ ID NO: 667079 - RNA, 19 nt, Homo sapiens
guguagggauggcacgaua

SEQ ID NO: 667080 - RNA, 19 nt, Homo sapiens
cucaggaauuugcuuguua

SEQ ID NO: 667081 - RNA, 19 nt, Homo sapiens
gaauuuguacacugaaaga

SEQ ID NO: 667082 - RNA, 19 nt, Homo sapiens
guacagauuuucauucuca

SEQ ID NO: 667083 - RNA, 19 nt, Homo sapiens
caaaacaaacccuaacuaa

SEQ ID NO: 667084 - RNA, 19 nt, Homo sapiens
ccagggcgcuuagggagaa

SEQ ID NO: 667085 - RNA, 19 nt, Homo sapiens
uagcgaauguggcgucuuc

SEQ ID NO: 667086 - RNA, 19 nt, Homo sapiens
gaaaaggacagcucacuau

SEQ ID NO: 667087 - RNA, 19 nt, Homo sapiens
gggaaugccugccugaaaa

SEQ ID NO: 667088 - RNA, 19 nt, Homo sapiens
ggccacagccuugccauuu

SEQ ID NO: 667089 - RNA, 19 nt, Homo sapiens
gagggagguucgccuagga

SEQ ID NO: 667090 - RNA, 19 nt, Homo sapiens
ugggugaccugcccucaaa

SEQ ID NO: 667091 - RNA, 19 nt, Homo sapiens
ccacaugggcucugcucua

SEQ ID NO: 667092 - RNA, 19 nt, Homo sapiens
gauggcagcccuucucugu

SEQ ID NO: 667093 - RNA, 19 nt, Homo sapiens
cagaggaguuccagcuuca

SEQ ID NO: 667094 - RNA, 19 nt, Homo sapiens
gugaauuuguacacugaaa

SEQ ID NO: 667095 - RNA, 19 nt, Homo sapiens
gaccagacguacagauuuu

SEQ ID NO: 667096 - RNA, 19 nt, Homo sapiens
ggcaguggcaggagccuua

SEQ ID NO: 667097 - RNA, 19 nt, Homo sapiens
gugaugguccuaagugaaa

SEQ ID NO: 667098 - RNA, 19 nt, Homo sapiens
caagugaagauggcugaua

SEQ ID NO: 667099 - RNA, 19 nt, Homo sapiens
ucacucagguucacuucug

SEQ ID NO: 667100 - RNA, 19 nt, Homo sapiens
ccucugucaugccucuuua

SEQ ID NO: 667101 - RNA, 19 nt, Homo sapiens
gaugcuuccuucuguaaca

SEQ ID NO: 667102 - RNA, 19 nt, Homo sapiens
ggacuccaccaccgauuug

SEQ ID NO: 667103 - RNA, 19 nt, Homo sapiens
aggauagucugaccuucua

SEQ ID NO: 667104 - RNA, 19 nt, Homo sapiens
cacaugggcucugcucuau

SEQ ID NO: 667105 - RNA, 19 nt, Homo sapiens
gaaaagagacgcugcuaca

SEQ ID NO: 667106 - RNA, 19 nt, Homo sapiens
gaccuacacuuuucucuug

SEQ ID NO: 667107 - RNA, 19 nt, Homo sapiens
uguaacaccagaaccauuu

SEQ ID NO: 667108 - RNA, 19 nt, Homo sapiens
gauaggauagucugaccuu

SEQ ID NO: 667109 - RNA, 19 nt, Homo sapiens
aacaaacccuaacuaacuu

SEQ ID NO: 667110 - RNA, 19 nt, Homo sapiens
gcaggagccuuacuuuugu

SEQ ID NO: 667111 - RNA, 19 nt, Homo sapiens
caugggcucugcucuaugg

SEQ ID NO: 667112 - RNA, 19 nt, Homo sapiens
cagcuucuuucacucaguu

SEQ ID NO: 667113 - RNA, 19 nt, Homo sapiens
gaaggucgguguuaaaagg

SEQ ID NO: 667114 - RNA, 19 nt, Homo sapiens
ucaaagaccucagcaucag

SEQ ID NO: 667115 - RNA, 19 nt, Homo sapiens
ggaaguguggcgaccagaa

SEQ ID NO: 667116 - RNA, 19 nt, Homo sapiens
ugaccagacguacagauuu

SEQ ID NO: 667117 - RNA, 19 nt, Homo sapiens
ccggaggcaugucuacuug

SEQ ID NO: 667118 - RNA, 19 nt, Homo sapiens
gaaccauuuggccuuaauu

SEQ ID NO: 667119 - RNA, 19 nt, Homo sapiens
agucaaggaccuacacuuu

SEQ ID NO: 667120 - RNA, 19 nt, Homo sapiens
ggacggcgaguuggacauu

SEQ ID NO: 667121 - RNA, 19 nt, Homo sapiens
ccaaagaagaugagucaag

SEQ ID NO: 667122 - RNA, 19 nt, Homo sapiens
ucccugagcuggauguugu

SEQ ID NO: 667123 - RNA, 19 nt, Homo sapiens
gcucugccuuggugucaug

SEQ ID NO: 667124 - RNA, 19 nt, Homo sapiens
gcacuuuuguagucacuuu

SEQ ID NO: 667125 - RNA, 19 nt, Homo sapiens
cguguuggguagaaauuug

SEQ ID NO: 667126 - RNA, 19 nt, Homo sapiens
cuuugaaguuugcgucuuu

SEQ ID NO: 667127 - RNA, 19 nt, Homo sapiens
caaccgagcaccagcaucu

SEQ ID NO: 667128 - RNA, 19 nt, Homo sapiens
gguucaaguucccaauaug

SEQ ID NO: 667129 - RNA, 19 nt, Homo sapiens
ucacccaccucaagacaag

SEQ ID NO: 667130 - RNA, 19 nt, Homo sapiens
ggcgacagauagcacauag

SEQ ID NO: 667131 - RNA, 19 nt, Homo sapiens
gagaagaacuguagucaug

SEQ ID NO: 667132 - RNA, 19 nt, Homo sapiens
gcacagauguaagauaauu

SEQ ID NO: 667133 - RNA, 19 nt, Homo sapiens
caacaaaggucuacaaacu

SEQ ID NO: 667134 - RNA, 19 nt, Homo sapiens
gcagguauuugaagaguuu

SEQ ID NO: 667135 - RNA, 19 nt, Homo sapiens
gagauucuaugaagacuuu

SEQ ID NO: 667136 - RNA, 19 nt, Homo sapiens
gugcacagauguaagauaa

SEQ ID NO: 667137 - RNA, 19 nt, Homo sapiens
gaacaagccucaguauauc

SEQ ID NO: 667138 - RNA, 19 nt, Homo sapiens
gaauacagcccucugcuuu

SEQ ID NO: 667139 - RNA, 19 nt, Homo sapiens
ggucaagucucuuaaggaa

SEQ ID NO: 667140 - RNA, 19 nt, Homo sapiens
cgacaagucuucuacucua

SEQ ID NO: 667141 - RNA, 19 nt, Homo sapiens
gaaagggaccgccaugaaa

SEQ ID NO: 667142 - RNA, 19 nt, Homo sapiens
gaagaacuguagucaugaa

SEQ ID NO: 667143 - RNA, 19 nt, Homo sapiens
gaaauaauguaccauagac

SEQ ID NO: 667144 - RNA, 19 nt, Homo sapiens
gcacacagguuuggguuug

SEQ ID NO: 667145 - RNA, 19 nt, Homo sapiens
ggaguuagcauaucaugaa

SEQ ID NO: 667146 - RNA, 19 nt, Homo sapiens
gaacuguagucaugaagug

SEQ ID NO: 667147 - RNA, 19 nt, Homo sapiens
ggaguuugcuggcaucaga

SEQ ID NO: 667148 - RNA, 19 nt, Homo sapiens
cagaugagcugugaaaugu

SEQ ID NO: 667149 - RNA, 19 nt, Homo sapiens
ggacagcccacgaaaggua

SEQ ID NO: 667150 - RNA, 19 nt, Homo sapiens
gcagaacguuccacaaagu

SEQ ID NO: 667151 - RNA, 19 nt, Homo sapiens
gaauaaaacuggcaggaaa

SEQ ID NO: 667152 - RNA, 19 nt, Homo sapiens
uaaggaagauuuacagaag

SEQ ID NO: 667153 - RNA, 19 nt, Homo sapiens
guacauaucagaagcaaau

SEQ ID NO: 667154 - RNA, 19 nt, Homo sapiens
ggagucagguguccguuug

SEQ ID NO: 667155 - RNA, 19 nt, Homo sapiens
gaacaacaaaggucuacaa

SEQ ID NO: 667156 - RNA, 19 nt, Homo sapiens
agaaagcugugaaugguuu

SEQ ID NO: 667157 - RNA, 19 nt, Homo sapiens
caaguugccuggagaagau

SEQ ID NO: 667158 - RNA, 19 nt, Homo sapiens
gagaacaagccucaguaua

SEQ ID NO: 667159 - RNA, 19 nt, Homo sapiens
ggaaagggaccgccaugaa

SEQ ID NO: 667160 - RNA, 19 nt, Homo sapiens
cgcgauaccuucccaagua

SEQ ID NO: 667161 - RNA, 19 nt, Homo sapiens
ucacuucucguaaccauua

SEQ ID NO: 667162 - RNA, 19 nt, Homo sapiens
gcaccuguuugauagcuuu

SEQ ID NO: 667163 - RNA, 19 nt, Homo sapiens
gcagaugacugggcccauu

SEQ ID NO: 667164 - RNA, 19 nt, Homo sapiens
ccaugaagcuuacguccaa

SEQ ID NO: 667165 - RNA, 19 nt, Homo sapiens
gaagagcuccgcccaguca

SEQ ID NO: 667166 - RNA, 19 nt, Homo sapiens
gcagggcuaccaaaucaua

SEQ ID NO: 667167 - RNA, 19 nt, Homo sapiens
gaagauggugugcagauga

SEQ ID NO: 667168 - RNA, 19 nt, Homo sapiens
caccagacccgacagaaua

SEQ ID NO: 667169 - RNA, 19 nt, Homo sapiens
agaacaagccucaguauau

SEQ ID NO: 667170 - RNA, 19 nt, Homo sapiens
gggcagaacguuccacaaa

SEQ ID NO: 667171 - RNA, 19 nt, Homo sapiens
gggcagugaugaugagcua

SEQ ID NO: 667172 - RNA, 19 nt, Homo sapiens
caacaguggugcagguaug

SEQ ID NO: 667173 - RNA, 19 nt, Homo sapiens
ggaaggagaagaacuguag

SEQ ID NO: 667174 - RNA, 19 nt, Homo sapiens
gcgagcaccuguuugauag

SEQ ID NO: 667175 - RNA, 19 nt, Homo sapiens
caaguauccuuaugaaucu

SEQ ID NO: 667176 - RNA, 19 nt, Homo sapiens
ggacuucacuucucguaac

SEQ ID NO: 667177 - RNA, 19 nt, Homo sapiens
ccaaguauccuuaugaauc

SEQ ID NO: 667178 - RNA, 19 nt, Homo sapiens
gaaauaaaccgagccucaa

SEQ ID NO: 667179 - RNA, 19 nt, Homo sapiens
gcagcgagcaccuguuuga

SEQ ID NO: 667180 - RNA, 19 nt, Homo sapiens
gaaguggaccgccuacuca

SEQ ID NO: 667181 - RNA, 19 nt, Homo sapiens
gaaacguacugggaucgaa

SEQ ID NO: 667182 - RNA, 19 nt, Homo sapiens
gaaugcagccuuugagauc

SEQ ID NO: 667183 - RNA, 19 nt, Homo sapiens
gaguccagcugcucucuga

SEQ ID NO: 667184 - RNA, 19 nt, Homo sapiens
caucaagcuuggagacauu

SEQ ID NO: 667185 - RNA, 19 nt, Homo sapiens
uggaacagcuaaagggaaa

SEQ ID NO: 667186 - RNA, 19 nt, Homo sapiens
augaaaggcuugcagauga

SEQ ID NO: 667187 - RNA, 19 nt, Homo sapiens
gaugacagcccagcaggua

SEQ ID NO: 667188 - RNA, 19 nt, Homo sapiens
ccauugacaucaugcagaa

SEQ ID NO: 667189 - RNA, 19 nt, Homo sapiens
aagugacgcugaaggauaa

SEQ ID NO: 667190 - RNA, 19 nt, Homo sapiens
cuacgucggcuaugguuua

SEQ ID NO: 667191 - RNA, 19 nt, Homo sapiens
gaacuguggguuaagaaug

SEQ ID NO: 667192 - RNA, 19 nt, Homo sapiens
uaacuucccugcugagaac

SEQ ID NO: 667193 - RNA, 19 nt, Homo sapiens
gagagucacagucgaaaga

SEQ ID NO: 667194 - RNA, 19 nt, Homo sapiens
ugagaaagcugugaauggu

SEQ ID NO: 667195 - RNA, 19 nt, Homo sapiens
cauagacucucaccaacug

SEQ ID NO: 667196 - RNA, 19 nt, Homo sapiens
cuacaucaaccgcaacuuu

SEQ ID NO: 667197 - RNA, 19 nt, Homo sapiens
gacuucagcuuaauugagu

SEQ ID NO: 667198 - RNA, 19 nt, Homo sapiens
gaccaguauuggcugagua

SEQ ID NO: 667199 - RNA, 19 nt, Homo sapiens
ggagagcaaccguuacaug

SEQ ID NO: 667200 - RNA, 19 nt, Homo sapiens
acaaagugguggugcagaa

SEQ ID NO: 667201 - RNA, 19 nt, Homo sapiens
gcugaucuauuuaccaagu

SEQ ID NO: 667202 - RNA, 19 nt, Homo sapiens
gauauguggcgacuaaaga

SEQ ID NO: 667203 - RNA, 19 nt, Homo sapiens
gcuuugaacccgaaacgua

SEQ ID NO: 667204 - RNA, 19 nt, Homo sapiens
gauaguaacggacaaagag

SEQ ID NO: 667205 - RNA, 19 nt, Homo sapiens
acgaacggcuggaggagua

SEQ ID NO: 667206 - RNA, 19 nt, Homo sapiens
aaagugacgcugaaggaua

SEQ ID NO: 667207 - RNA, 19 nt, Homo sapiens
gaauauggcggagcuacaa

SEQ ID NO: 667208 - RNA, 19 nt, Homo sapiens
gaacgcccuucccauccaa

SEQ ID NO: 667209 - RNA, 19 nt, Homo sapiens
ccaucaaucugucauucaa

SEQ ID NO: 667210 - RNA, 19 nt, Homo sapiens
gaagauuuacagaaggaaa

SEQ ID NO: 667211 - RNA, 19 nt, Homo sapiens
gggcagcgagcaccuguuu

SEQ ID NO: 667212 - RNA, 19 nt, Homo sapiens
gguuugagguggccuuugu

SEQ ID NO: 667213 - RNA, 19 nt, Homo sapiens
aaagguaucuguggaccaa

SEQ ID NO: 667214 - RNA, 19 nt, Homo sapiens
aagcuuacguccaacagaa

SEQ ID NO: 667215 - RNA, 19 nt, Homo sapiens
cuaugacgcucaaguguuc

SEQ ID NO: 667216 - RNA, 19 nt, Homo sapiens
guuacaugcugucccauug

SEQ ID NO: 667217 - RNA, 19 nt, Homo sapiens
gaauugguguggauuuggu

SEQ ID NO: 667218 - RNA, 19 nt, Homo sapiens
ccaacuguauauaccugua

SEQ ID NO: 667219 - RNA, 19 nt, Homo sapiens
cacaggcgauggccauuga

SEQ ID NO: 667220 - RNA, 19 nt, Homo sapiens
gcauguccuucuugaacuu

SEQ ID NO: 667221 - RNA, 19 nt, Homo sapiens
ccaagcagcggaugauaga

SEQ ID NO: 667222 - RNA, 19 nt, Homo sapiens
uuuccuugcugaucuauuu

SEQ ID NO: 667223 - RNA, 19 nt, Homo sapiens
ggugaacuguggguuaaga

SEQ ID NO: 667224 - RNA, 19 nt, Homo sapiens
ggaugugacccuugaccua

SEQ ID NO: 667225 - RNA, 19 nt, Homo sapiens
ccaaacagccacuccuaug

SEQ ID NO: 667226 - RNA, 19 nt, Homo sapiens
gcaguagcccacucuauag

SEQ ID NO: 667227 - RNA, 19 nt, Homo sapiens
caugggagagcaaccguua

SEQ ID NO: 667228 - RNA, 19 nt, Homo sapiens
ggaugucuauguuaauguc

SEQ ID NO: 667229 - RNA, 19 nt, Homo sapiens
caggaugucuauguuaaug

SEQ ID NO: 667230 - RNA, 19 nt, Homo sapiens
gcaagaugagaacaacaaa

SEQ ID NO: 667231 - RNA, 19 nt, Homo sapiens
ggacuuagcuucauaacua

SEQ ID NO: 667232 - RNA, 19 nt, Homo sapiens
gaaccgaccuccaaacuuu

SEQ ID NO: 667233 - RNA, 19 nt, Homo sapiens
gaaaggacauggugaagau

SEQ ID NO: 667234 - RNA, 19 nt, Homo sapiens
caagauaccgggaagauua

SEQ ID NO: 667235 - RNA, 19 nt, Homo sapiens
gaggauggcucacaacuug

SEQ ID NO: 667236 - RNA, 19 nt, Homo sapiens
uggcaaagcugcaguauug

SEQ ID NO: 667237 - RNA, 19 nt, Homo sapiens
gcacaagauuccuaauuug

SEQ ID NO: 667238 - RNA, 19 nt, Homo sapiens
ucaagaggcuggagaguuu

SEQ ID NO: 667239 - RNA, 19 nt, Homo sapiens
uaagagagaugauguauac

SEQ ID NO: 667240 - RNA, 19 nt, Homo sapiens
ggucuuaccuucccagauu

SEQ ID NO: 667241 - RNA, 19 nt, Homo sapiens
agaaagagguuaagcaaga

SEQ ID NO: 667242 - RNA, 19 nt, Homo sapiens
ggcacaagauuccuaauuu

SEQ ID NO: 667243 - RNA, 19 nt, Homo sapiens
gaaaugugcuucacuucga

SEQ ID NO: 667244 - RNA, 19 nt, Homo sapiens
gagaaggaauucaaugaga

SEQ ID NO: 667245 - RNA, 19 nt, Homo sapiens
gaggaggacugcuguuuau

SEQ ID NO: 667246 - RNA, 19 nt, Homo sapiens
gacaugcgcuucaaugaga

SEQ ID NO: 667247 - RNA, 19 nt, Homo sapiens
gcacggacaucaaccuuuc

SEQ ID NO: 667248 - RNA, 19 nt, Homo sapiens
gcaccgaguuugucuugaa

SEQ ID NO: 667249 - RNA, 19 nt, Homo sapiens
gagaguuuaugaucacuuu

SEQ ID NO: 667250 - RNA, 19 nt, Homo sapiens
gcauuccgcuguagugaaa

SEQ ID NO: 667251 - RNA, 19 nt, Homo sapiens
gauucuaucucuucugauu

SEQ ID NO: 667252 - RNA, 19 nt, Homo sapiens
gaacaauccuggacuuggu

SEQ ID NO: 667253 - RNA, 19 nt, Homo sapiens
gaaagagguuaagcaagaa

SEQ ID NO: 667254 - RNA, 19 nt, Homo sapiens
cguuaaugcugaagaaaua

SEQ ID NO: 667255 - RNA, 19 nt, Homo sapiens
gaaaauggcuucugagucu

SEQ ID NO: 667256 - RNA, 19 nt, Homo sapiens
guagauuccugucugacua

SEQ ID NO: 667257 - RNA, 19 nt, Homo sapiens
gggauucuaucucuucuga

SEQ ID NO: 667258 - RNA, 19 nt, Homo sapiens
ggaagaggcugaggagaca

SEQ ID NO: 667259 - RNA, 19 nt, Homo sapiens
uggcagagguugcagauga

SEQ ID NO: 667260 - RNA, 19 nt, Homo sapiens
gagcugaugccaccucuuu

SEQ ID NO: 667261 - RNA, 19 nt, Homo sapiens
ccaacugccuuccauguga

SEQ ID NO: 667262 - RNA, 19 nt, Homo sapiens
ccagaaaugugcuucacuu

SEQ ID NO: 667263 - RNA, 19 nt, Homo sapiens
gaagaaagccaugacuguu

SEQ ID NO: 667264 - RNA, 19 nt, Homo sapiens
ugaaauaaccgacccauca

SEQ ID NO: 667265 - RNA, 19 nt, Homo sapiens
gaagcaagguuugucaaca

SEQ ID NO: 667266 - RNA, 19 nt, Homo sapiens
guugaugaguggaauauug

SEQ ID NO: 667267 - RNA, 19 nt, Homo sapiens
ugaagucucugaaagugaa

SEQ ID NO: 667268 - RNA, 19 nt, Homo sapiens
aaucagaacuguggaaaug

SEQ ID NO: 667269 - RNA, 19 nt, Homo sapiens
gcagcugccuuggaucuuu

SEQ ID NO: 667270 - RNA, 19 nt, Homo sapiens
cagcugaguuucuuaagga

SEQ ID NO: 667271 - RNA, 19 nt, Homo sapiens
ucacugcgcugucuguaug

SEQ ID NO: 667272 - RNA, 19 nt, Homo sapiens
ucaaagcugugaggcauuu

SEQ ID NO: 667273 - RNA, 19 nt, Homo sapiens
gggaaggacaacacaguua

SEQ ID NO: 667274 - RNA, 19 nt, Homo sapiens
ccaccgagaccuucuauga

SEQ ID NO: 667275 - RNA, 19 nt, Homo sapiens
gaaggagaccugaagacaa

SEQ ID NO: 667276 - RNA, 19 nt, Homo sapiens
ccaagagagucaaaucuag

SEQ ID NO: 667277 - RNA, 19 nt, Homo sapiens
gagagaugauguauacaca

SEQ ID NO: 667278 - RNA, 19 nt, Homo sapiens
ccgaguuugucuugaaaua

SEQ ID NO: 667279 - RNA, 19 nt, Homo sapiens
gccagaagcagcugaguuu

SEQ ID NO: 667280 - RNA, 19 nt, Homo sapiens
uaugaucacuuucccuuau

SEQ ID NO: 667281 - RNA, 19 nt, Homo sapiens
acaaagaggcaccgaguuu

SEQ ID NO: 667282 - RNA, 19 nt, Homo sapiens
gugcugugcuccuguagaa

SEQ ID NO: 667283 - RNA, 19 nt, Homo sapiens
gaaauauggaauucccuuu

SEQ ID NO: 667284 - RNA, 19 nt, Homo sapiens
gaaggacaacacaguuauu

SEQ ID NO: 667285 - RNA, 19 nt, Homo sapiens
ucacuuucccuuaugguua

SEQ ID NO: 667286 - RNA, 19 nt, Homo sapiens
ggaaggacaacacaguuau

SEQ ID NO: 667287 - RNA, 19 nt, Homo sapiens
gugcggagucuaccaauuu

SEQ ID NO: 667288 - RNA, 19 nt, Homo sapiens
ucacagagaaagagguuaa

SEQ ID NO: 667289 - RNA, 19 nt, Homo sapiens
guaugaucuuccagacuua

SEQ ID NO: 667290 - RNA, 19 nt, Homo sapiens
uguaugaucuuccagacuu

SEQ ID NO: 667291 - RNA, 19 nt, Homo sapiens
caacacaguuauugaccau

SEQ ID NO: 667292 - RNA, 19 nt, Homo sapiens
agagugggaucaccauuga

SEQ ID NO: 667293 - RNA, 19 nt, Homo sapiens
ucaagacagugcuggcaaa

SEQ ID NO: 667294 - RNA, 19 nt, Homo sapiens
gcugaagucucugaaagug

SEQ ID NO: 667295 - RNA, 19 nt, Homo sapiens
ggaagugguccaagugaga

SEQ ID NO: 667296 - RNA, 19 nt, Homo sapiens
gccagaaagucauuagcaa

SEQ ID NO: 667297 - RNA, 19 nt, Homo sapiens
agaagcagcugccuuggau

SEQ ID NO: 667298 - RNA, 19 nt, Homo sapiens
ucaacuaccugcacuuugg

SEQ ID NO: 667299 - RNA, 19 nt, Homo sapiens
ccuaggacuuagcuucaua

SEQ ID NO: 667300 - RNA, 19 nt, Homo sapiens
gaaagucauuagcaagcau

SEQ ID NO: 667301 - RNA, 19 nt, Homo sapiens
gguggaggauggagaggaa

SEQ ID NO: 667302 - RNA, 19 nt, Homo sapiens
aauauggaauucccuuuga

SEQ ID NO: 667303 - RNA, 19 nt, Homo sapiens
gaaauaaccgacccaucau

SEQ ID NO: 667304 - RNA, 19 nt, Homo sapiens
aagaaacggcaacgaguua

SEQ ID NO: 667305 - RNA, 19 nt, Homo sapiens
ucaaugagauuuucacaga

SEQ ID NO: 667306 - RNA, 19 nt, Homo sapiens
gagaugauguauacacacu

SEQ ID NO: 667307 - RNA, 19 nt, Homo sapiens
caacauugcagaaagaagu

SEQ ID NO: 667308 - RNA, 19 nt, Homo sapiens
gaauuuggaggcuuuaauc

SEQ ID NO: 667309 - RNA, 19 nt, Homo sapiens
aaacgggaguucucacugu

SEQ ID NO: 667310 - RNA, 19 nt, Homo sapiens
agacaagccuggccaagca

SEQ ID NO: 667311 - RNA, 19 nt, Homo sapiens
guagaaaggacauggugaa

SEQ ID NO: 667312 - RNA, 19 nt, Homo sapiens
uauacacacuggaugaaga

SEQ ID NO: 667313 - RNA, 19 nt, Homo sapiens
gguugcagaugaauacaug

SEQ ID NO: 667314 - RNA, 19 nt, Homo sapiens
gcuggagaguuuaugauca

SEQ ID NO: 667315 - RNA, 19 nt, Homo sapiens
ugaaugguacccucuauga

SEQ ID NO: 667316 - RNA, 19 nt, Homo sapiens
gguugaauuuggaggcuuu

SEQ ID NO: 667317 - RNA, 19 nt, Homo sapiens
gcagaugaauacauguuuu

SEQ ID NO: 667318 - RNA, 19 nt, Homo sapiens
ggaggaagaacaagaagca

SEQ ID NO: 667319 - RNA, 19 nt, Homo sapiens
ggaaggagaccugaagaca

SEQ ID NO: 667320 - RNA, 19 nt, Homo sapiens
gagagugggaucaccauug

SEQ ID NO: 667321 - RNA, 19 nt, Homo sapiens
gaagagcucgagcggaaau

SEQ ID NO: 667322 - RNA, 19 nt, Homo sapiens
caagagagucaaaucuaga

SEQ ID NO: 667323 - RNA, 19 nt, Homo sapiens
caaccuuucuacuccuuau

SEQ ID NO: 667324 - RNA, 19 nt, Homo sapiens
ccaagguuguuccuccaaa

SEQ ID NO: 667325 - RNA, 19 nt, Homo sapiens
uagauacauugccuacauu

SEQ ID NO: 667326 - RNA, 19 nt, Homo sapiens
uggaagacauccuuugcuu

SEQ ID NO: 667327 - RNA, 19 nt, Homo sapiens
ugagaacaauccuggacuu

SEQ ID NO: 667328 - RNA, 19 nt, Homo sapiens
cagcacagcagacauggaa

SEQ ID NO: 667329 - RNA, 19 nt, Homo sapiens
gcuguagauuccugucuga

SEQ ID NO: 667330 - RNA, 19 nt, Homo sapiens
ggucuucauuaccugcuuu

SEQ ID NO: 667331 - RNA, 19 nt, Homo sapiens
caaaugagcuuacaacuga

SEQ ID NO: 667332 - RNA, 19 nt, Homo sapiens
guucaaagguuucgagaua

SEQ ID NO: 667333 - RNA, 19 nt, Homo sapiens
gaacaaggcgugauccuaa

SEQ ID NO: 667334 - RNA, 19 nt, Homo sapiens
ccacagggcugaauauuuc

SEQ ID NO: 667335 - RNA, 19 nt, Homo sapiens
ccaaauugcucaacccuuu

SEQ ID NO: 667336 - RNA, 19 nt, Homo sapiens
ggacaaaacugguggcaua

SEQ ID NO: 667337 - RNA, 19 nt, Homo sapiens
ccauguaccucaaauugua

SEQ ID NO: 667338 - RNA, 19 nt, Homo sapiens
ggagucacauucaacaauu

SEQ ID NO: 667339 - RNA, 19 nt, Homo sapiens
ucagagaauuugugaauga

SEQ ID NO: 667340 - RNA, 19 nt, Homo sapiens
gaagaaaggcauacgaaga

SEQ ID NO: 667341 - RNA, 19 nt, Homo sapiens
ccaagaagacagagaauuu

SEQ ID NO: 667342 - RNA, 19 nt, Homo sapiens
gaaagaaucagaggugaaa

SEQ ID NO: 667343 - RNA, 19 nt, Homo sapiens
ccuacaagcuggaauuaaa

SEQ ID NO: 667344 - RNA, 19 nt, Homo sapiens
cauauugauuccucaguua

SEQ ID NO: 667345 - RNA, 19 nt, Homo sapiens
gaacggauuugaaacacau

SEQ ID NO: 667346 - RNA, 19 nt, Homo sapiens
aaagagaaccuacccagua

SEQ ID NO: 667347 - RNA, 19 nt, Homo sapiens
gaauacaacauccucguaa

SEQ ID NO: 667348 - RNA, 19 nt, Homo sapiens
ugagagaauuugucagaaa

SEQ ID NO: 667349 - RNA, 19 nt, Homo sapiens
aaacuuauuucccagugua

SEQ ID NO: 667350 - RNA, 19 nt, Homo sapiens
gaaggaagucugucuuaga

SEQ ID NO: 667351 - RNA, 19 nt, Homo sapiens
aaacaucacuguauuuguc

SEQ ID NO: 667352 - RNA, 19 nt, Homo sapiens
ggaagaggcaagaaauaaa

SEQ ID NO: 667353 - RNA, 19 nt, Homo sapiens
aaacgcaguuguacagaaa

SEQ ID NO: 667354 - RNA, 19 nt, Homo sapiens
gguguuggauugaagauug

SEQ ID NO: 667355 - RNA, 19 nt, Homo sapiens
ggaagucugucuuagagau

SEQ ID NO: 667356 - RNA, 19 nt, Homo sapiens
guaguucuccucauucuaa

SEQ ID NO: 667357 - RNA, 19 nt, Homo sapiens
caauagaacagaaacauga

SEQ ID NO: 667358 - RNA, 19 nt, Homo sapiens
gaugacagguuucuacuac

SEQ ID NO: 667359 - RNA, 19 nt, Homo sapiens
caacauccucguaaacuuu

SEQ ID NO: 667360 - RNA, 19 nt, Homo sapiens
gcacagcgccaaggaauau

SEQ ID NO: 667361 - RNA, 19 nt, Homo sapiens
acacagacccugaaacuga

SEQ ID NO: 667362 - RNA, 19 nt, Homo sapiens
gaacagugccaauagaaca

SEQ ID NO: 667363 - RNA, 19 nt, Homo sapiens
aagaggcacuuuccaauga

SEQ ID NO: 667364 - RNA, 19 nt, Homo sapiens
uaugaaaucugccugugaa

SEQ ID NO: 667365 - RNA, 19 nt, Homo sapiens
gaagaggcacuuuccaaug

SEQ ID NO: 667366 - RNA, 19 nt, Homo sapiens
ggauaugguuagccuuuau

SEQ ID NO: 667367 - RNA, 19 nt, Homo sapiens
ggaaauggaauacaacauc

SEQ ID NO: 667368 - RNA, 19 nt, Homo sapiens
ccagaacccuugcuuccaa

SEQ ID NO: 667369 - RNA, 19 nt, Homo sapiens
gcuaagacauuggcuggaa

SEQ ID NO: 667370 - RNA, 19 nt, Homo sapiens
ugacaaauggauaugguua

SEQ ID NO: 667371 - RNA, 19 nt, Homo sapiens
uaauagcaguuacucuuga

SEQ ID NO: 667372 - RNA, 19 nt, Homo sapiens
gcaauuacccauggucuga

SEQ ID NO: 667373 - RNA, 19 nt, Homo sapiens
gcaggaccuucugaucaua

SEQ ID NO: 667374 - RNA, 19 nt, Homo sapiens
gggcuacucccaagaaauu

SEQ ID NO: 667375 - RNA, 19 nt, Homo sapiens
gaaaauagaccagaucuug

SEQ ID NO: 667376 - RNA, 19 nt, Homo sapiens
ggaauacaacauccucgua

SEQ ID NO: 667377 - RNA, 19 nt, Homo sapiens
gagaugaugagguuauuga

SEQ ID NO: 667378 - RNA, 19 nt, Homo sapiens
uaaacgcaguuguacagaa

SEQ ID NO: 667379 - RNA, 19 nt, Homo sapiens
gaacccuugcuuccaaaua

SEQ ID NO: 667380 - RNA, 19 nt, Homo sapiens
gaagucugucuuagagaua

SEQ ID NO: 667381 - RNA, 19 nt, Homo sapiens
ggagaacggauuugaaaca

SEQ ID NO: 667382 - RNA, 19 nt, Homo sapiens
gaaccauuauugcucuuag

SEQ ID NO: 667383 - RNA, 19 nt, Homo sapiens
uagcugaccuaucugauuc

SEQ ID NO: 667384 - RNA, 19 nt, Homo sapiens
gaagaggcaagaaauaaag

SEQ ID NO: 667385 - RNA, 19 nt, Homo sapiens
gcucacaccuguaccugau

SEQ ID NO: 667386 - RNA, 19 nt, Homo sapiens
ucagugcccugccaaaugu

SEQ ID NO: 667387 - RNA, 19 nt, Homo sapiens
gcucggaauauuaucuuua

SEQ ID NO: 667388 - RNA, 19 nt, Homo sapiens
ucagaacagugccaauaga

SEQ ID NO: 667389 - RNA, 19 nt, Homo sapiens
gcagacaauuacacaaugg

SEQ ID NO: 667390 - RNA, 19 nt, Homo sapiens
gagucacauucaacaauuu

SEQ ID NO: 667391 - RNA, 19 nt, Homo sapiens
gcuaaaccauguaccucaa

SEQ ID NO: 667392 - RNA, 19 nt, Homo sapiens
gcaggaagaggcaagaaau

SEQ ID NO: 667393 - RNA, 19 nt, Homo sapiens
ucagaacuguuuaauagca

SEQ ID NO: 667394 - RNA, 19 nt, Homo sapiens
ccaggagcucggaauauua

SEQ ID NO: 667395 - RNA, 19 nt, Homo sapiens
caacugauuccacuccaaa

SEQ ID NO: 667396 - RNA, 19 nt, Homo sapiens
gaugaugagguuauugaaa

SEQ ID NO: 667397 - RNA, 19 nt, Homo sapiens
gauaugguuagccuuuaua

SEQ ID NO: 667398 - RNA, 19 nt, Homo sapiens
gaaccugaacuagaagaaa

SEQ ID NO: 667399 - RNA, 19 nt, Homo sapiens
gaaguggaccucgauuaga

SEQ ID NO: 667400 - RNA, 19 nt, Homo sapiens
cuacugaggaaauggaaua

SEQ ID NO: 667401 - RNA, 19 nt, Homo sapiens
gagcaaagacugaaaauag

SEQ ID NO: 667402 - RNA, 19 nt, Homo sapiens
gaacagaaacaugaagucu

SEQ ID NO: 667403 - RNA, 19 nt, Homo sapiens
gagagaauuugucagaaaa

SEQ ID NO: 667404 - RNA, 19 nt, Homo sapiens
caaaacugguggcauaauu

SEQ ID NO: 667405 - RNA, 19 nt, Homo sapiens
gaaccagggagaacggauu

SEQ ID NO: 667406 - RNA, 19 nt, Homo sapiens
aacccuugcuuccaaauaa

SEQ ID NO: 667407 - RNA, 19 nt, Homo sapiens
gcacaaaugagcuuacaac

SEQ ID NO: 667408 - RNA, 19 nt, Homo sapiens
ugaccuaucugauucuucu

SEQ ID NO: 667409 - RNA, 19 nt, Homo sapiens
gaacuagaagaaagagaau

SEQ ID NO: 667410 - RNA, 19 nt, Homo sapiens
gaaaagggaauucaaacaa

SEQ ID NO: 667411 - RNA, 19 nt, Homo sapiens
gccaaggaauauauuaaag

SEQ ID NO: 667412 - RNA, 19 nt, Homo sapiens
guuuauagcagcacaaaug

SEQ ID NO: 667413 - RNA, 19 nt, Homo sapiens
aagaaaggcauacgaagaa

SEQ ID NO: 667414 - RNA, 19 nt, Homo sapiens
gagcacagcgccaaggaau

SEQ ID NO: 667415 - RNA, 19 nt, Homo sapiens
uuagaggaguuucuucaga

SEQ ID NO: 667416 - RNA, 19 nt, Homo sapiens
ucauauugauuccucaguu

SEQ ID NO: 667417 - RNA, 19 nt, Homo sapiens
uaacacagacccugaaacu

SEQ ID NO: 667418 - RNA, 19 nt, Homo sapiens
ugauuccacuccaaagaaa

SEQ ID NO: 667419 - RNA, 19 nt, Homo sapiens
caggaagaggcaagaaaua

SEQ ID NO: 667420 - RNA, 19 nt, Homo sapiens
cugaauauuucuagagaug

SEQ ID NO: 667421 - RNA, 19 nt, Homo sapiens
aacaggagaugaugagguu

SEQ ID NO: 667422 - RNA, 19 nt, Homo sapiens
cagaaacaucacuguauuu

SEQ ID NO: 667423 - RNA, 19 nt, Homo sapiens
gcaauugcaguugaauauu

SEQ ID NO: 667424 - RNA, 19 nt, Homo sapiens
gcgccaaggaauauauuaa

SEQ ID NO: 667425 - RNA, 19 nt, Homo sapiens
gaaacaucacuguauuugu

SEQ ID NO: 667426 - RNA, 19 nt, Homo sapiens
ggcaggaccuucugaucau

SEQ ID NO: 667427 - RNA, 19 nt, Homo sapiens
gaccaucuacugaaccauu

SEQ ID NO: 667428 - RNA, 19 nt, Homo sapiens
cugaggaaauggaauacaa

SEQ ID NO: 667429 - RNA, 19 nt, Homo sapiens
ccaaugagagaauuuguca

SEQ ID NO: 667430 - RNA, 19 nt, Homo sapiens
gaagaaguggaccucgauu

SEQ ID NO: 667431 - RNA, 19 nt, Homo sapiens
gggcaugucucucuucuua

SEQ ID NO: 667432 - RNA, 19 nt, Homo sapiens
gaaccugggcguccacaua

SEQ ID NO: 667433 - RNA, 19 nt, Homo sapiens
ugacgggccucuuggauga

SEQ ID NO: 667434 - RNA, 19 nt, Homo sapiens
gaccugcgcuucaacaauc

SEQ ID NO: 667435 - RNA, 19 nt, Homo sapiens
ggacaugacgggccucuug

SEQ ID NO: 667436 - RNA, 19 nt, Homo sapiens
ccauugcccugcucaguuu

SEQ ID NO: 667437 - RNA, 19 nt, Homo sapiens
gacagcagaucgugaggaa

SEQ ID NO: 667438 - RNA, 19 nt, Homo sapiens
ggccuuuccucucccuuua

SEQ ID NO: 667439 - RNA, 19 nt, Homo sapiens
ggacaagaagacaguggua

SEQ ID NO: 667440 - RNA, 19 nt, Homo sapiens
gcacugaaaccucacaagu

SEQ ID NO: 667441 - RNA, 19 nt, Homo sapiens
ccucaauucuguuaaguca

SEQ ID NO: 667442 - RNA, 19 nt, Homo sapiens
cacaaguccucucagcuuu

SEQ ID NO: 667443 - RNA, 19 nt, Homo sapiens
gcucaaugcuguuuucuug

SEQ ID NO: 667444 - RNA, 19 nt, Homo sapiens
gaguuccugucuucuguuu

SEQ ID NO: 667445 - RNA, 19 nt, Homo sapiens
ucagcugucucucuccuuu

SEQ ID NO: 667446 - RNA, 19 nt, Homo sapiens
ggacaacuuccgcuacuuc

SEQ ID NO: 667447 - RNA, 19 nt, Homo sapiens
ggaaagaggaggcgcuuac

SEQ ID NO: 667448 - RNA, 19 nt, Homo sapiens
ggacuacuucagccuauga

SEQ ID NO: 667449 - RNA, 19 nt, Homo sapiens
ccacguuggucacccuuau

SEQ ID NO: 667450 - RNA, 19 nt, Homo sapiens
gggcuccucucuccuuuca

SEQ ID NO: 667451 - RNA, 19 nt, Homo sapiens
auaauuggcugaucaucug

SEQ ID NO: 667452 - RNA, 19 nt, Homo sapiens
gaggacaacuuccgcuacu

SEQ ID NO: 667453 - RNA, 19 nt, Homo sapiens
ucacaaguccucucagcuu

SEQ ID NO: 667454 - RNA, 19 nt, Homo sapiens
ccugcagucucuuuaggua

SEQ ID NO: 667455 - RNA, 19 nt, Homo sapiens
gaaguaaggacagcagauc

SEQ ID NO: 667456 - RNA, 19 nt, Homo sapiens
uaagucacccuguggaguu

SEQ ID NO: 667457 - RNA, 19 nt, Homo sapiens
ccucucagcuuugccuuug

SEQ ID NO: 667458 - RNA, 19 nt, Homo sapiens
gcuugagggugcugcuaaa

SEQ ID NO: 667459 - RNA, 19 nt, Homo sapiens
ggccugcaccugcgucuaa

SEQ ID NO: 667460 - RNA, 19 nt, Homo sapiens
guugugagcugagagagau

SEQ ID NO: 667461 - RNA, 19 nt, Homo sapiens
ucccugcacuugcuccaua

SEQ ID NO: 667462 - RNA, 19 nt, Homo sapiens
gaggaagagguaccuguga

SEQ ID NO: 667463 - RNA, 19 nt, Homo sapiens
gagagcaugcaggcuguua

SEQ ID NO: 667464 - RNA, 19 nt, Homo sapiens
aagcacugguuacugguuu

SEQ ID NO: 667465 - RNA, 19 nt, Homo sapiens
caacuuccgcuacuuccuu

SEQ ID NO: 667466 - RNA, 19 nt, Homo sapiens
guagcucgcacaugcauug

SEQ ID NO: 667467 - RNA, 19 nt, Homo sapiens
gcaccugcgucuaacuuuu

SEQ ID NO: 667468 - RNA, 19 nt, Homo sapiens
acaugugccuggaaguuga

SEQ ID NO: 667469 - RNA, 19 nt, Homo sapiens
cuacuucagccuaugauga

SEQ ID NO: 667470 - RNA, 19 nt, Homo sapiens
caucucaccagcacugaaa

SEQ ID NO: 667471 - RNA, 19 nt, Homo sapiens
ccuggaaguugaauuugug

SEQ ID NO: 667472 - RNA, 19 nt, Homo sapiens
gcggacuacuucagccuau

SEQ ID NO: 667473 - RNA, 19 nt, Homo sapiens
gugccuggaaguugaauuu

SEQ ID NO: 667474 - RNA, 19 nt, Homo sapiens
ugcacuugcuccauaauug

SEQ ID NO: 667475 - RNA, 19 nt, Homo sapiens
ggaccugcgcuucaacaau

SEQ ID NO: 667476 - RNA, 19 nt, Homo sapiens
gccuggaaguugaauuugu

SEQ ID NO: 667477 - RNA, 19 nt, Homo sapiens
ggucaucaagguacacaug

SEQ ID NO: 667478 - RNA, 19 nt, Homo sapiens
gcuuugggauuccaguugu

SEQ ID NO: 667479 - RNA, 19 nt, Homo sapiens
ggacagagggcggaaugca

SEQ ID NO: 667480 - RNA, 19 nt, Homo sapiens
gcacuugcuccauaauugg

SEQ ID NO: 667481 - RNA, 19 nt, Homo sapiens
cuacuuccuugcccagaug

SEQ ID NO: 667482 - RNA, 19 nt, Homo sapiens
gaacccucaauucuguuaa

SEQ ID NO: 667483 - RNA, 19 nt, Homo sapiens
ggacagaggccugcuucag

SEQ ID NO: 667484 - RNA, 19 nt, Homo sapiens
aggcugagcugcguacugu

SEQ ID NO: 667485 - RNA, 19 nt, Homo sapiens
cagccacacuguugcaucu

SEQ ID NO: 667486 - RNA, 19 nt, Homo sapiens
gcaugucucucuucuuacc

SEQ ID NO: 667487 - RNA, 19 nt, Homo sapiens
ucucucuccuuugcaauuu

SEQ ID NO: 667488 - RNA, 19 nt, Homo sapiens
gaugcccucucuugggaau

SEQ ID NO: 667489 - RNA, 19 nt, Homo sapiens
cugcccaccucaagaaguu

SEQ ID NO: 667490 - RNA, 19 nt, Homo sapiens
gagcaugcaggcuguuauc

SEQ ID NO: 667491 - RNA, 19 nt, Homo sapiens
gucgagagccagccaauag

SEQ ID NO: 667492 - RNA, 19 nt, Homo sapiens
gcuagacuggguugccuuu

SEQ ID NO: 667493 - RNA, 19 nt, Homo sapiens
ccgcguagaagcugaguug

SEQ ID NO: 667494 - RNA, 19 nt, Homo sapiens
gagagccagccaauagaug

SEQ ID NO: 667495 - RNA, 19 nt, Homo sapiens
gcacucacgccucuuacgu

SEQ ID NO: 667496 - RNA, 19 nt, Homo sapiens
caucaaugaggagaaguuu

SEQ ID NO: 667497 - RNA, 19 nt, Homo sapiens
gcuacuuccuugcccagau

SEQ ID NO: 667498 - RNA, 19 nt, Homo sapiens
ggauggcgaggacaacuuc

SEQ ID NO: 667499 - RNA, 19 nt, Homo sapiens
gccugcggcuccacuaugu

SEQ ID NO: 667500 - RNA, 19 nt, Homo sapiens
ugcagucgcugaaguaagg

SEQ ID NO: 667501 - RNA, 19 nt, Homo sapiens
gcucugcacacaugaucuu

SEQ ID NO: 667502 - RNA, 19 nt, Homo sapiens
ccagcaacccgccuucuag

SEQ ID NO: 667503 - RNA, 19 nt, Homo sapiens
cuccauaauuggcugauca

SEQ ID NO: 667504 - RNA, 19 nt, Homo sapiens
uggaguuccugucuucugu

SEQ ID NO: 667505 - RNA, 19 nt, Homo sapiens
ggaugucaggccuccauug

SEQ ID NO: 667506 - RNA, 19 nt, Homo sapiens
gaaguagcucugggugaga

SEQ ID NO: 667507 - RNA, 19 nt, Homo sapiens
ccuucccgcugcucaguuu

SEQ ID NO: 667508 - RNA, 19 nt, Homo sapiens
cgcagccgguugcuaguga

SEQ ID NO: 667509 - RNA, 19 nt, Homo sapiens
gcaggugcaagaaggugaa

SEQ ID NO: 667510 - RNA, 19 nt, Homo sapiens
gagggcggaaugcagauga

SEQ ID NO: 667511 - RNA, 19 nt, Homo sapiens
ucaucaagguacacaugug

SEQ ID NO: 667512 - RNA, 19 nt, Homo sapiens
gcucaguuuggcugcauuu

SEQ ID NO: 667513 - RNA, 19 nt, Homo sapiens
cauaauuggcugaucaucu

SEQ ID NO: 667514 - RNA, 19 nt, Homo sapiens
ucaaugaggagaaguuugc

SEQ ID NO: 667515 - RNA, 19 nt, Homo sapiens
gcguggaccugcgcuucaa

SEQ ID NO: 667516 - RNA, 19 nt, Homo sapiens
ggugcaagaaggugaaauc

SEQ ID NO: 667517 - RNA, 19 nt, Homo sapiens
cagcagaucgugaggaaaa

SEQ ID NO: 667518 - RNA, 19 nt, Homo sapiens
gcccagacagagacgcuuu

SEQ ID NO: 667519 - RNA, 19 nt, Homo sapiens
uuggucacccuuauccuua

SEQ ID NO: 667520 - RNA, 19 nt, Homo sapiens
gcaccaugcacacgcuugu

SEQ ID NO: 667521 - RNA, 19 nt, Homo sapiens
caucagcagccacacuguu

SEQ ID NO: 667522 - RNA, 19 nt, Homo sapiens
gcgcgcaggcuguuguugu

SEQ ID NO: 667523 - RNA, 19 nt, Homo sapiens
ucucagcuuugccuuugga

SEQ ID NO: 667524 - RNA, 19 nt, Homo sapiens
cggcuuccaccuuuacuga

SEQ ID NO: 667525 - RNA, 19 nt, Homo sapiens
gagcuucaagggagguguu

SEQ ID NO: 667526 - RNA, 19 nt, Homo sapiens
ggucacccuuauccuuauc

SEQ ID NO: 667527 - RNA, 19 nt, Homo sapiens
acacaugugccuggaaguu

SEQ ID NO: 667528 - RNA, 19 nt, Homo sapiens
gggccuuuccucucccuuu

SEQ ID NO: 667529 - RNA, 19 nt, Homo sapiens
caaguccucucagcuuugc

SEQ ID NO: 667530 - RNA, 19 nt, Homo sapiens
cgagagccagccaauagau

SEQ ID NO: 667531 - RNA, 19 nt, Homo sapiens
gaauagggcugaauaaaug

SEQ ID NO: 667532 - RNA, 19 nt, Homo sapiens
gcauuaagcucacaugaaa

SEQ ID NO: 667533 - RNA, 19 nt, Homo sapiens
gcuccuagcuuaccucaua

SEQ ID NO: 667534 - RNA, 19 nt, Homo sapiens
caacacugcuauuauacua

SEQ ID NO: 667535 - RNA, 19 nt, Homo sapiens
caagaugccuuugcaaauu

SEQ ID NO: 667536 - RNA, 19 nt, Homo sapiens
gacagaaggugaaggaauu

SEQ ID NO: 667537 - RNA, 19 nt, Homo sapiens
ggacaaagccaccaauguu

SEQ ID NO: 667538 - RNA, 19 nt, Homo sapiens
gaaauacuccgaugaugaa

SEQ ID NO: 667539 - RNA, 19 nt, Homo sapiens
aaagguaacuggaauguau

SEQ ID NO: 667540 - RNA, 19 nt, Homo sapiens
gaaagaaagcaaagaagaa

SEQ ID NO: 667541 - RNA, 19 nt, Homo sapiens
caacugaagaguccauuua

SEQ ID NO: 667542 - RNA, 19 nt, Homo sapiens
gcaauaugguuccaauaga

SEQ ID NO: 667543 - RNA, 19 nt, Homo sapiens
ggacuugguuugccuaugu

SEQ ID NO: 667544 - RNA, 19 nt, Homo sapiens
ggaaauacuccgaugauga

SEQ ID NO: 667545 - RNA, 19 nt, Homo sapiens
cagcagccaucacugaaua

SEQ ID NO: 667546 - RNA, 19 nt, Homo sapiens
ggagaagaguuuauaaguc

SEQ ID NO: 667547 - RNA, 19 nt, Homo sapiens
gcucuaugguuuccuuuaa

SEQ ID NO: 667548 - RNA, 19 nt, Homo sapiens
guaauuauccugugcagaa

SEQ ID NO: 667549 - RNA, 19 nt, Homo sapiens
ggaauagggcugaauaaau

SEQ ID NO: 667550 - RNA, 19 nt, Homo sapiens
ccagagaacacauuuauga

SEQ ID NO: 667551 - RNA, 19 nt, Homo sapiens
gaacuuaugaacaugcuuu

SEQ ID NO: 667552 - RNA, 19 nt, Homo sapiens
ggaaaaugcuaaucaacua

SEQ ID NO: 667553 - RNA, 19 nt, Homo sapiens
gaacaauuuccagaacuua

SEQ ID NO: 667554 - RNA, 19 nt, Homo sapiens
agaagacucuccagaaaga

SEQ ID NO: 667555 - RNA, 19 nt, Homo sapiens
uaggugagcugagugauaa

SEQ ID NO: 667556 - RNA, 19 nt, Homo sapiens
gaagaacaaagacaaguau

SEQ ID NO: 667557 - RNA, 19 nt, Homo sapiens
gcagaacuaggaagaaauu

SEQ ID NO: 667558 - RNA, 19 nt, Homo sapiens
ccaccaauguuguuaugaa

SEQ ID NO: 667559 - RNA, 19 nt, Homo sapiens
gaucacagaauacagauau

SEQ ID NO: 667560 - RNA, 19 nt, Homo sapiens
auucagagaucgagucuaa

SEQ ID NO: 667561 - RNA, 19 nt, Homo sapiens
ucccaaaggugaauucaaa

SEQ ID NO: 667562 - RNA, 19 nt, Homo sapiens
gcaagagcacuucagauga

SEQ ID NO: 667563 - RNA, 19 nt, Homo sapiens
acaccucagucuucaguua

SEQ ID NO: 667564 - RNA, 19 nt, Homo sapiens
gaagcagauugaaugaaga

SEQ ID NO: 667565 - RNA, 19 nt, Homo sapiens
caagagcacuucagaugag

SEQ ID NO: 667566 - RNA, 19 nt, Homo sapiens
uaaauuaggugagcugagu

SEQ ID NO: 667567 - RNA, 19 nt, Homo sapiens
cagauacagugaaagauau

SEQ ID NO: 667568 - RNA, 19 nt, Homo sapiens
ucagauacagugaaagaua

SEQ ID NO: 667569 - RNA, 19 nt, Homo sapiens
caaagaagaacaaagacaa

SEQ ID NO: 667570 - RNA, 19 nt, Homo sapiens
gugcagaacuaggaagaaa

SEQ ID NO: 667571 - RNA, 19 nt, Homo sapiens
auacagauaugguccagaa

SEQ ID NO: 667572 - RNA, 19 nt, Homo sapiens
caacuacccuuucuuuuau

SEQ ID NO: 667573 - RNA, 19 nt, Homo sapiens
caguuucccuucccaagua

SEQ ID NO: 667574 - RNA, 19 nt, Homo sapiens
gaggaaagauagagaagac

SEQ ID NO: 667575 - RNA, 19 nt, Homo sapiens
gauuuacgaucccuggaaa

SEQ ID NO: 667576 - RNA, 19 nt, Homo sapiens
gcagauugaaugaagaauu

SEQ ID NO: 667577 - RNA, 19 nt, Homo sapiens
ucagaccuguuugaucuua

SEQ ID NO: 667578 - RNA, 19 nt, Homo sapiens
gaucagagcguguuguuac

SEQ ID NO: 667579 - RNA, 19 nt, Homo sapiens
caagaucacagaauacaga

SEQ ID NO: 667580 - RNA, 19 nt, Homo sapiens
cgaaagaaagcaaagaaga

SEQ ID NO: 667581 - RNA, 19 nt, Homo sapiens
ccagaaaucagucagcaaa

SEQ ID NO: 667582 - RNA, 19 nt, Homo sapiens
gaguaugaauuucucuaug

SEQ ID NO: 667583 - RNA, 19 nt, Homo sapiens
aagaugccuuugcaaauuu

SEQ ID NO: 667584 - RNA, 19 nt, Homo sapiens
cggaggauuugcugacuuu

SEQ ID NO: 667585 - RNA, 19 nt, Homo sapiens
aaaggugaauucaaagaug

SEQ ID NO: 667586 - RNA, 19 nt, Homo sapiens
ccaauagaggaguuaaaua

SEQ ID NO: 667587 - RNA, 19 nt, Homo sapiens
caggacugcucuaugguuu

SEQ ID NO: 667588 - RNA, 19 nt, Homo sapiens
caauaugguuccaauagag

SEQ ID NO: 667589 - RNA, 19 nt, Homo sapiens
ggcaagagcacuucagaug

SEQ ID NO: 667590 - RNA, 19 nt, Homo sapiens
ccacacaccucagucuuca

SEQ ID NO: 667591 - RNA, 19 nt, Homo sapiens
acaacucaauguuugcuuu

SEQ ID NO: 667592 - RNA, 19 nt, Homo sapiens
aaucaaagguaacuggaau

SEQ ID NO: 667593 - RNA, 19 nt, Homo sapiens
ggaucgccuugucauaauu

SEQ ID NO: 667594 - RNA, 19 nt, Homo sapiens
gacaaagccaccaauguug

SEQ ID NO: 667595 - RNA, 19 nt, Homo sapiens
gcaaagaagaacaaagaca

SEQ ID NO: 667596 - RNA, 19 nt, Homo sapiens
agaagcagauugaaugaag

SEQ ID NO: 667597 - RNA, 19 nt, Homo sapiens
ugaacaauuuccagaacuu

SEQ ID NO: 667598 - RNA, 19 nt, Homo sapiens
gagcaugcccaaugugaug

SEQ ID NO: 667599 - RNA, 19 nt, Homo sapiens
aagcaaagaagaacaaaga

SEQ ID NO: 667600 - RNA, 19 nt, Homo sapiens
caugacaucuucccagagu

SEQ ID NO: 667601 - RNA, 19 nt, Homo sapiens
cuucagaccuguuugaucu

SEQ ID NO: 667602 - RNA, 19 nt, Homo sapiens
gagaggcaacgaacgauga

SEQ ID NO: 667603 - RNA, 19 nt, Homo sapiens
gaagagcgaaagaaagcaa

SEQ ID NO: 667604 - RNA, 19 nt, Homo sapiens
gaaggugaaggaauugguu

SEQ ID NO: 667605 - RNA, 19 nt, Homo sapiens
guaaacaucagccuagaca

SEQ ID NO: 667606 - RNA, 19 nt, Homo sapiens
ugaccuuguugaucuguuu

SEQ ID NO: 667607 - RNA, 19 nt, Homo sapiens
ugguaaggaucaagguaua

SEQ ID NO: 667608 - RNA, 19 nt, Homo sapiens
uacgaucccuggaaaauua

SEQ ID NO: 667609 - RNA, 19 nt, Homo sapiens
caugucuucugcuguaauu

SEQ ID NO: 667610 - RNA, 19 nt, Homo sapiens
cagauaugguccagaaauc

SEQ ID NO: 667611 - RNA, 19 nt, Homo sapiens
gcacagcaaauccuuccaa

SEQ ID NO: 667612 - RNA, 19 nt, Homo sapiens
gcuuuggucacgaauguua

SEQ ID NO: 667613 - RNA, 19 nt, Homo sapiens
caagagugcuuuuccauuc

SEQ ID NO: 667614 - RNA, 19 nt, Homo sapiens
ucccaugucuucugcugua

SEQ ID NO: 667615 - RNA, 19 nt, Homo sapiens
aaucaacuacccuuucuuu

SEQ ID NO: 667616 - RNA, 19 nt, Homo sapiens
caucagccuagacaacuua

SEQ ID NO: 667617 - RNA, 19 nt, Homo sapiens
gaaagcaaagaagaacaaa

SEQ ID NO: 667618 - RNA, 19 nt, Homo sapiens
guaaggaucaagguauaaa

SEQ ID NO: 667619 - RNA, 19 nt, Homo sapiens
ucaacuacccuuucuuuua

SEQ ID NO: 667620 - RNA, 19 nt, Homo sapiens
caacauagccaugacuucu

SEQ ID NO: 667621 - RNA, 19 nt, Homo sapiens
aaggugaauucaaagauga

SEQ ID NO: 667622 - RNA, 19 nt, Homo sapiens
caaaaccucuuuaagcaau

SEQ ID NO: 667623 - RNA, 19 nt, Homo sapiens
ugaaugugaugacucaaag

SEQ ID NO: 667624 - RNA, 19 nt, Homo sapiens
cuaugaaugugaugacuca

SEQ ID NO: 667625 - RNA, 19 nt, Homo sapiens
caaguaacagcaacaagug

SEQ ID NO: 667626 - RNA, 19 nt, Homo sapiens
ccaaguaacagcaacaagu

SEQ ID NO: 667627 - RNA, 19 nt, Homo sapiens
gacacaagcgcacagcaaa

SEQ ID NO: 667628 - RNA, 19 nt, Homo sapiens
uguuacaacucaauguuug

SEQ ID NO: 667629 - RNA, 19 nt, Homo sapiens
ugccaaggcuacauuuaug

SEQ ID NO: 667630 - RNA, 19 nt, Homo sapiens
ccacagagaccaccacaac

SEQ ID NO: 667631 - RNA, 19 nt, Homo sapiens
guaaauacccuaccucuua

SEQ ID NO: 667632 - RNA, 19 nt, Homo sapiens
gaacuagacuuaugacugu

SEQ ID NO: 667633 - RNA, 19 nt, Homo sapiens
gaaaggaccacauugcuua

SEQ ID NO: 667634 - RNA, 19 nt, Homo sapiens
caagagccaugaauauaua

SEQ ID NO: 667635 - RNA, 19 nt, Homo sapiens
gaacuucccuuaccucugu

SEQ ID NO: 667636 - RNA, 19 nt, Homo sapiens
ccaaaggcaucaaauuuaa

SEQ ID NO: 667637 - RNA, 19 nt, Homo sapiens
ccacauugcuuacuugaaa

SEQ ID NO: 667638 - RNA, 19 nt, Homo sapiens
ggacaaauuucaccaggaa

SEQ ID NO: 667639 - RNA, 19 nt, Homo sapiens
gaacaaagauuuacuuccu

SEQ ID NO: 667640 - RNA, 19 nt, Homo sapiens
guaauggaguggacuuaua

SEQ ID NO: 667641 - RNA, 19 nt, Homo sapiens
ggaugagacuguccaagua

SEQ ID NO: 667642 - RNA, 19 nt, Homo sapiens
aaacugaccuucuuuaauc

SEQ ID NO: 667643 - RNA, 19 nt, Homo sapiens
gaacaugggcucuuuaauc

SEQ ID NO: 667644 - RNA, 19 nt, Homo sapiens
gaacagagcuaaguaugag

SEQ ID NO: 667645 - RNA, 19 nt, Homo sapiens
ggacagugaucaucuuguu

SEQ ID NO: 667646 - RNA, 19 nt, Homo sapiens
ggaauucuccaaucauaua

SEQ ID NO: 667647 - RNA, 19 nt, Homo sapiens
gcagggagauguauuucuu

SEQ ID NO: 667648 - RNA, 19 nt, Homo sapiens
gaugagaacuagacuuaug

SEQ ID NO: 667649 - RNA, 19 nt, Homo sapiens
ggaguggacuuauaucaug

SEQ ID NO: 667650 - RNA, 19 nt, Homo sapiens
gcccauaacuugaaggaaa

SEQ ID NO: 667651 - RNA, 19 nt, Homo sapiens
ggaagaaucucacuugacu

SEQ ID NO: 667652 - RNA, 19 nt, Homo sapiens
gaagaugccagccugauuu

SEQ ID NO: 667653 - RNA, 19 nt, Homo sapiens
aauacgagauggcaauuua

SEQ ID NO: 667654 - RNA, 19 nt, Homo sapiens
cauccaaggugucugauaa

SEQ ID NO: 667655 - RNA, 19 nt, Homo sapiens
gaagguggacuuucucauu

SEQ ID NO: 667656 - RNA, 19 nt, Homo sapiens
gacaagagccaugaauaua

SEQ ID NO: 667657 - RNA, 19 nt, Homo sapiens
gcaacgagguucccuugga

SEQ ID NO: 667658 - RNA, 19 nt, Homo sapiens
caacaacuggcaaagaaua

SEQ ID NO: 667659 - RNA, 19 nt, Homo sapiens
ucacagaaguggaugucua

SEQ ID NO: 667660 - RNA, 19 nt, Homo sapiens
gggccuggcugccuacuuu

SEQ ID NO: 667661 - RNA, 19 nt, Homo sapiens
gcacugggaucuugugagu

SEQ ID NO: 667662 - RNA, 19 nt, Homo sapiens
acaaugcucuucuugguuu

SEQ ID NO: 667663 - RNA, 19 nt, Homo sapiens
ggaaggacauggcuuuuaa

SEQ ID NO: 667664 - RNA, 19 nt, Homo sapiens
gcacagacaacgaggauga

SEQ ID NO: 667665 - RNA, 19 nt, Homo sapiens
gaaaacaaccaaagugaua

SEQ ID NO: 667666 - RNA, 19 nt, Homo sapiens
ccaagccagugauauuuaa

SEQ ID NO: 667667 - RNA, 19 nt, Homo sapiens
uggaaaggcucagaguuua

SEQ ID NO: 667668 - RNA, 19 nt, Homo sapiens
gaagcacaguucaaaguuc

SEQ ID NO: 667669 - RNA, 19 nt, Homo sapiens
uaagcacucuaauggauaa

SEQ ID NO: 667670 - RNA, 19 nt, Homo sapiens
gagucuaccuuuccaaguu

SEQ ID NO: 667671 - RNA, 19 nt, Homo sapiens
gcccaaaggcaucaaauuu

SEQ ID NO: 667672 - RNA, 19 nt, Homo sapiens
gagaggaggugggaacaga

SEQ ID NO: 667673 - RNA, 19 nt, Homo sapiens
cauaaccucuauucucaaa

SEQ ID NO: 667674 - RNA, 19 nt, Homo sapiens
ggaagaagagggagaagga

SEQ ID NO: 667675 - RNA, 19 nt, Homo sapiens
aaggagggcuggaaacaaa

SEQ ID NO: 667676 - RNA, 19 nt, Homo sapiens
ggaccacauugcuuacuug

SEQ ID NO: 667677 - RNA, 19 nt, Homo sapiens
ggaagacagcggcgaguuu

SEQ ID NO: 667678 - RNA, 19 nt, Homo sapiens
ucagugggcugcugcugua

SEQ ID NO: 667679 - RNA, 19 nt, Homo sapiens
ggaacagagcuaaguauga

SEQ ID NO: 667680 - RNA, 19 nt, Homo sapiens
caaggugucugauaacucu

SEQ ID NO: 667681 - RNA, 19 nt, Homo sapiens
ggacaucuggccuuucauu

SEQ ID NO: 667682 - RNA, 19 nt, Homo sapiens
ucacgaacaugggcucuuu

SEQ ID NO: 667683 - RNA, 19 nt, Homo sapiens
gaccugggauccuuugaga

SEQ ID NO: 667684 - RNA, 19 nt, Homo sapiens
acaagggacucuaaccaaa

SEQ ID NO: 667685 - RNA, 19 nt, Homo sapiens
ucacggaauucuccaauca

SEQ ID NO: 667686 - RNA, 19 nt, Homo sapiens
uauaagcacucuaauggau

SEQ ID NO: 667687 - RNA, 19 nt, Homo sapiens
cccaaaggcaucaaauuua

SEQ ID NO: 667688 - RNA, 19 nt, Homo sapiens
uauaaagagugaagacaga

SEQ ID NO: 667689 - RNA, 19 nt, Homo sapiens
gaaucugacuggcauuauc

SEQ ID NO: 667690 - RNA, 19 nt, Homo sapiens
gaggagcacuuugagauca

SEQ ID NO: 667691 - RNA, 19 nt, Homo sapiens
agaaagagcacaugacgaa

SEQ ID NO: 667692 - RNA, 19 nt, Homo sapiens
uaaagcagcucaggaugug

SEQ ID NO: 667693 - RNA, 19 nt, Homo sapiens
gcacucuaauggauaacaa

SEQ ID NO: 667694 - RNA, 19 nt, Homo sapiens
gaaucucacuugacuagag

SEQ ID NO: 667695 - RNA, 19 nt, Homo sapiens
ggagagugaugcugagaag

SEQ ID NO: 667696 - RNA, 19 nt, Homo sapiens
cagauacgauagcuccuuu

SEQ ID NO: 667697 - RNA, 19 nt, Homo sapiens
aagguggacuuucucauuu

SEQ ID NO: 667698 - RNA, 19 nt, Homo sapiens
ccacaaugcucuucuuggu

SEQ ID NO: 667699 - RNA, 19 nt, Homo sapiens
uaaauacccuaccucuuag

SEQ ID NO: 667700 - RNA, 19 nt, Homo sapiens
ggacagccacccuuucuuc

SEQ ID NO: 667701 - RNA, 19 nt, Homo sapiens
ggcauuaucuccagcuuag

SEQ ID NO: 667702 - RNA, 19 nt, Homo sapiens
ccaagaagcagaaacacuu

SEQ ID NO: 667703 - RNA, 19 nt, Homo sapiens
gaaaggcuucuguuacuuc

SEQ ID NO: 667704 - RNA, 19 nt, Homo sapiens
cuaauauucuugucuguuc

SEQ ID NO: 667705 - RNA, 19 nt, Homo sapiens
aaagcaauauuccaaagga

SEQ ID NO: 667706 - RNA, 19 nt, Homo sapiens
ggaagccggaggaccuuua

SEQ ID NO: 667707 - RNA, 19 nt, Homo sapiens
gaaguugcccuuugacuac

SEQ ID NO: 667708 - RNA, 19 nt, Homo sapiens
agaaggaagucaauuacga

SEQ ID NO: 667709 - RNA, 19 nt, Homo sapiens
ggacgacacaucugaggaa

SEQ ID NO: 667710 - RNA, 19 nt, Homo sapiens
caggacaucuggccuuuca

SEQ ID NO: 667711 - RNA, 19 nt, Homo sapiens
uaaccucuauucucaaagu

SEQ ID NO: 667712 - RNA, 19 nt, Homo sapiens
gaagacgacacgcuuugaa

SEQ ID NO: 667713 - RNA, 19 nt, Homo sapiens
gcuagaagcacaguucaaa

SEQ ID NO: 667714 - RNA, 19 nt, Homo sapiens
ccaaggagcaccacuuugu

SEQ ID NO: 667715 - RNA, 19 nt, Homo sapiens
ggcaaagaauaaccuguug

SEQ ID NO: 667716 - RNA, 19 nt, Homo sapiens
gaaaggcucagaguuuaga

SEQ ID NO: 667717 - RNA, 19 nt, Homo sapiens
ccgaguagcugggauuaug

SEQ ID NO: 667718 - RNA, 19 nt, Homo sapiens
ccacuugccuacccucaau

SEQ ID NO: 667719 - RNA, 19 nt, Homo sapiens
ucagagcccucaugcuguu

SEQ ID NO: 667720 - RNA, 19 nt, Homo sapiens
caucuggccuuucauugug

SEQ ID NO: 667721 - RNA, 19 nt, Homo sapiens
gaacgaggccuuggagagu

SEQ ID NO: 667722 - RNA, 19 nt, Homo sapiens
gaccugcgauugauaaacu

SEQ ID NO: 667723 - RNA, 19 nt, Homo sapiens
cauggucacugcauuagga

SEQ ID NO: 667724 - RNA, 19 nt, Homo sapiens
gugaguagcacuguucaua

SEQ ID NO: 667725 - RNA, 19 nt, Homo sapiens
gccaagccagugauauuua

SEQ ID NO: 667726 - RNA, 19 nt, Homo sapiens
ggacaaugaggaagaggaa

SEQ ID NO: 667727 - RNA, 19 nt, Homo sapiens
guucaguccuuucuugugu

SEQ ID NO: 667728 - RNA, 19 nt, Homo sapiens
ccaaagugcugggauuaca

SEQ ID NO: 667729 - RNA, 19 nt, Homo sapiens
uguaaaggcuggagacaag

SEQ ID NO: 667730 - RNA, 19 nt, Homo sapiens
ucacgaggaacaaagauuu

SEQ ID NO: 667731 - RNA, 19 nt, Homo sapiens
gaacuucccuuaccucugu

SEQ ID NO: 667732 - RNA, 19 nt, Homo sapiens
gaacagagcuaaguaugag

SEQ ID NO: 667733 - RNA, 19 nt, Homo sapiens
ggaauucuccaaucauaua

SEQ ID NO: 667734 - RNA, 19 nt, Homo sapiens
auagagaccuugcuaagua

SEQ ID NO: 667735 - RNA, 19 nt, Homo sapiens
gcacauagggacaguguaa

SEQ ID NO: 667736 - RNA, 19 nt, Homo sapiens
gcagagggauuuauaaagg

SEQ ID NO: 667737 - RNA, 19 nt, Homo sapiens
gcgcacaucuuguacuuug

SEQ ID NO: 667738 - RNA, 19 nt, Homo sapiens
uguaguagcugguucugua

SEQ ID NO: 667739 - RNA, 19 nt, Homo sapiens
caacaacuggcaaagaaua

SEQ ID NO: 667740 - RNA, 19 nt, Homo sapiens
acaaugcucuucuugguuu

SEQ ID NO: 667741 - RNA, 19 nt, Homo sapiens
gacccaaaguuuauacuga

SEQ ID NO: 667742 - RNA, 19 nt, Homo sapiens
ccaagccagugauauuuaa

SEQ ID NO: 667743 - RNA, 19 nt, Homo sapiens
uggaaaggcucagaguuua

SEQ ID NO: 667744 - RNA, 19 nt, Homo sapiens
gaaauaagagaauccacaa

SEQ ID NO: 667745 - RNA, 19 nt, Homo sapiens
gcacugaaacugaugauag

SEQ ID NO: 667746 - RNA, 19 nt, Homo sapiens
ucaaagcgcacaucuugua

SEQ ID NO: 667747 - RNA, 19 nt, Homo sapiens
cgaaggaaguaacguucua

SEQ ID NO: 667748 - RNA, 19 nt, Homo sapiens
ggaagaagagggagaagga

SEQ ID NO: 667749 - RNA, 19 nt, Homo sapiens
aaggagggcuggaaacaaa

SEQ ID NO: 667750 - RNA, 19 nt, Homo sapiens
ggaacagagcuaaguauga

SEQ ID NO: 667751 - RNA, 19 nt, Homo sapiens
acaagggacucuaaccaaa

SEQ ID NO: 667752 - RNA, 19 nt, Homo sapiens
ucacggaauucuccaauca

SEQ ID NO: 667753 - RNA, 19 nt, Homo sapiens
aaacgguggugcucacgua

SEQ ID NO: 667754 - RNA, 19 nt, Homo sapiens
guaaauccaccuuugagaa

SEQ ID NO: 667755 - RNA, 19 nt, Homo sapiens
gcacaucaaauacgaaauc

SEQ ID NO: 667756 - RNA, 19 nt, Homo sapiens
gugguaaacugacgcauuc

SEQ ID NO: 667757 - RNA, 19 nt, Homo sapiens
ccacaaugcucuucuuggu

SEQ ID NO: 667758 - RNA, 19 nt, Homo sapiens
aaucaaagcgcacaucuug

SEQ ID NO: 667759 - RNA, 19 nt, Homo sapiens
gaauuuaggcgaaggaagu

SEQ ID NO: 667760 - RNA, 19 nt, Homo sapiens
ccaagaagcagaaacacuu

SEQ ID NO: 667761 - RNA, 19 nt, Homo sapiens
gaaaggcuucuguuacuuc

SEQ ID NO: 667762 - RNA, 19 nt, Homo sapiens
ggacagccacccuuucuuc

SEQ ID NO: 667763 - RNA, 19 nt, Homo sapiens
ccagcuggcacaucaaaua

SEQ ID NO: 667764 - RNA, 19 nt, Homo sapiens
gcaagacccaaaguuuaua

SEQ ID NO: 667765 - RNA, 19 nt, Homo sapiens
gaagacgacacgcuuugaa

SEQ ID NO: 667766 - RNA, 19 nt, Homo sapiens
aguccuaacuuucugaauu

SEQ ID NO: 667767 - RNA, 19 nt, Homo sapiens
gcaaaucacaaaucaaguc

SEQ ID NO: 667768 - RNA, 19 nt, Homo sapiens
ggcaaagaauaaccuguug

SEQ ID NO: 667769 - RNA, 19 nt, Homo sapiens
gaaaggcucagaguuuaga

SEQ ID NO: 667770 - RNA, 19 nt, Homo sapiens
uagagaccuugcuaaguaa

SEQ ID NO: 667771 - RNA, 19 nt, Homo sapiens
guauaaaccagacaauuca

SEQ ID NO: 667772 - RNA, 19 nt, Homo sapiens
gccaagccagugauauuua

SEQ ID NO: 667773 - RNA, 19 nt, Homo sapiens
ggacaaugaggaagaggaa

SEQ ID NO: 667774 - RNA, 19 nt, Homo sapiens
acacuaacagcacucuuua

SEQ ID NO: 667775 - RNA, 19 nt, Homo sapiens
uaagagaauccacaauaga

SEQ ID NO: 667776 - RNA, 19 nt, Homo sapiens
cagaaggaaacaaauauug

SEQ ID NO: 667777 - RNA, 19 nt, Homo sapiens
ggaugucccugcgggcuuu

SEQ ID NO: 667778 - RNA, 19 nt, Homo sapiens
ccaacgagcccauggaugu

SEQ ID NO: 667779 - RNA, 19 nt, Homo sapiens
ggagaaggagggcuggaaa

SEQ ID NO: 667780 - RNA, 19 nt, Homo sapiens
caccguaguuccaguccua

SEQ ID NO: 667781 - RNA, 19 nt, Homo sapiens
ggucaugguuaaggaaaga

SEQ ID NO: 667782 - RNA, 19 nt, Homo sapiens
uuagguaucuugucaaacu

SEQ ID NO: 667783 - RNA, 19 nt, Homo sapiens
acggaauucuccaaucaua

SEQ ID NO: 667784 - RNA, 19 nt, Homo sapiens
gcagcuguuucaccuucua

SEQ ID NO: 667785 - RNA, 19 nt, Homo sapiens
gaccaucggcuuuagguau

SEQ ID NO: 667786 - RNA, 19 nt, Homo sapiens
guccuaacuuucugaauuc

SEQ ID NO: 667787 - RNA, 19 nt, Homo sapiens
gcaauggguccggcuguuu

SEQ ID NO: 667788 - RNA, 19 nt, Homo sapiens
gacauuauggacacacuaa

SEQ ID NO: 667789 - RNA, 19 nt, Homo sapiens
auaagagaauccacaauag

SEQ ID NO: 667790 - RNA, 19 nt, Homo sapiens
uaaauccaccuuugagaau

SEQ ID NO: 667791 - RNA, 19 nt, Homo sapiens
gccaguacuuguuccaguu

SEQ ID NO: 667792 - RNA, 19 nt, Homo sapiens
gaaggagggcuggaaacaa

SEQ ID NO: 667793 - RNA, 19 nt, Homo sapiens
aaucacaaaucaagucauc

SEQ ID NO: 667794 - RNA, 19 nt, Homo sapiens
uaaaggccaugggaacuuc

SEQ ID NO: 667795 - RNA, 19 nt, Homo sapiens
guagccgaguggacaauga

SEQ ID NO: 667796 - RNA, 19 nt, Homo sapiens
gcagcuugccgcucuagaa

SEQ ID NO: 667797 - RNA, 19 nt, Homo sapiens
gaaugcaagacccaaaguu

SEQ ID NO: 667798 - RNA, 19 nt, Homo sapiens
aauccaccuuugagaauuu

SEQ ID NO: 667799 - RNA, 19 nt, Homo sapiens
ucaaagacaugcaaaucac

SEQ ID NO: 667800 - RNA, 19 nt, Homo sapiens
uaccagaaggaaacaaaua

SEQ ID NO: 667801 - RNA, 19 nt, Homo sapiens
cguauaaaccagacaauuc

SEQ ID NO: 667802 - RNA, 19 nt, Homo sapiens
gaaauccggacguauaaac

SEQ ID NO: 667803 - RNA, 19 nt, Homo sapiens
gcacaagggacucuaacca

SEQ ID NO: 667804 - RNA, 19 nt, Homo sapiens
ucacaaaucaagucaucuu

SEQ ID NO: 667805 - RNA, 19 nt, Homo sapiens
ccagaaggaaacaaauauu

SEQ ID NO: 667806 - RNA, 19 nt, Homo sapiens
cuaacuuucugaauucugu

SEQ ID NO: 667807 - RNA, 19 nt, Homo sapiens
caauagagaccuugcuaag

SEQ ID NO: 667808 - RNA, 19 nt, Homo sapiens
guacuuugaugcccauagg

SEQ ID NO: 667809 - RNA, 19 nt, Homo sapiens
ggacguauaaaccagacaa

SEQ ID NO: 667810 - RNA, 19 nt, Homo sapiens
acacauuuaccacuguaua

SEQ ID NO: 667811 - RNA, 19 nt, Homo sapiens
acaugcaaaucacaaauca

SEQ ID NO: 667812 - RNA, 19 nt, Homo sapiens
gaaaauaccagaaggaaac

SEQ ID NO: 667813 - RNA, 19 nt, Homo sapiens
gcuggcacaucaaauacga

SEQ ID NO: 667814 - RNA, 19 nt, Homo sapiens
ggccaagccagugauauuu

SEQ ID NO: 667815 - RNA, 19 nt, Homo sapiens
ggacauuauggacacacua

SEQ ID NO: 667816 - RNA, 19 nt, Homo sapiens
cacguaugaugggacauua

SEQ ID NO: 667817 - RNA, 19 nt, Homo sapiens
gaaggaaguaacguucuau

SEQ ID NO: 667818 - RNA, 19 nt, Homo sapiens
gcacaucuuguacuuugau

SEQ ID NO: 667819 - RNA, 19 nt, Homo sapiens
augcaagacccaaaguuua

SEQ ID NO: 667820 - RNA, 19 nt, Homo sapiens
ggaaaggcucagaguuuag

SEQ ID NO: 667821 - RNA, 19 nt, Homo sapiens
ccacucaacccaagaagca

SEQ ID NO: 667822 - RNA, 19 nt, Homo sapiens
gaaucaaagcgcacaucuu

SEQ ID NO: 667823 - RNA, 19 nt, Homo sapiens
cgguggugcucacguauga

SEQ ID NO: 667824 - RNA, 19 nt, Homo sapiens
gggaacagagcuaaguaug

SEQ ID NO: 667825 - RNA, 19 nt, Homo sapiens
aaaggguggucuccagaau

SEQ ID NO: 667826 - RNA, 19 nt, Homo sapiens
ggcuuuagguaucuuguca

SEQ ID NO: 667827 - RNA, 19 nt, Homo sapiens
uuggaaaggcucagaguuu

SEQ ID NO: 667828 - RNA, 19 nt, Homo sapiens
ucuguuacuucacggaauu

SEQ ID NO: 667829 - RNA, 19 nt, Homo sapiens
uguguuggcuguggaaaga

SEQ ID NO: 667830 - RNA, 19 nt, Homo sapiens
ucauugcagcuauuuguaa

SEQ ID NO: 667831 - RNA, 19 nt, Homo sapiens
gaacagagcuaaguaugag

SEQ ID NO: 667832 - RNA, 19 nt, Homo sapiens
ggaauucuccaaucauaua

SEQ ID NO: 667833 - RNA, 19 nt, Homo sapiens
aaagaaugguggaaagaua

SEQ ID NO: 667834 - RNA, 19 nt, Homo sapiens
ggucagaaguucaagauca

SEQ ID NO: 667835 - RNA, 19 nt, Homo sapiens
caacaacuggcaaagaaua

SEQ ID NO: 667836 - RNA, 19 nt, Homo sapiens
gaaaccuugucucuacuaa

SEQ ID NO: 667837 - RNA, 19 nt, Homo sapiens
acaaugcucuucuugguuu

SEQ ID NO: 667838 - RNA, 19 nt, Homo sapiens
gaagcagugucuuugagaa

SEQ ID NO: 667839 - RNA, 19 nt, Homo sapiens
ccaagccagugauauuuaa

SEQ ID NO: 667840 - RNA, 19 nt, Homo sapiens
uggaaaggcucagaguuua

SEQ ID NO: 667841 - RNA, 19 nt, Homo sapiens
ggugaaaccuugucucuac

SEQ ID NO: 667842 - RNA, 19 nt, Homo sapiens
ggaagaagagggagaagga

SEQ ID NO: 667843 - RNA, 19 nt, Homo sapiens
aaggagggcuggaaacaaa

SEQ ID NO: 667844 - RNA, 19 nt, Homo sapiens
ggaacagagcuaaguauga

SEQ ID NO: 667845 - RNA, 19 nt, Homo sapiens
acaagggacucuaaccaaa

SEQ ID NO: 667846 - RNA, 19 nt, Homo sapiens
ucacggaauucuccaauca

SEQ ID NO: 667847 - RNA, 19 nt, Homo sapiens
ccacaaugcucuucuuggu

SEQ ID NO: 667848 - RNA, 19 nt, Homo sapiens
ccaagaagcagaaacacuu

SEQ ID NO: 667849 - RNA, 19 nt, Homo sapiens
gaaaggcuucuguuacuuc

SEQ ID NO: 667850 - RNA, 19 nt, Homo sapiens
ggacagccacccuuucuuc

SEQ ID NO: 667851 - RNA, 19 nt, Homo sapiens
gagaagcagugucuuugag

SEQ ID NO: 667852 - RNA, 19 nt, Homo sapiens
gaagacgacacgcuuugaa

SEQ ID NO: 667853 - RNA, 19 nt, Homo sapiens
ggcaaagaauaaccuguug

SEQ ID NO: 667854 - RNA, 19 nt, Homo sapiens
gaaaggcucagaguuuaga

SEQ ID NO: 667855 - RNA, 19 nt, Homo sapiens
acacacagccgaagucaga

SEQ ID NO: 667856 - RNA, 19 nt, Homo sapiens
gccaagccagugauauuua

SEQ ID NO: 667857 - RNA, 19 nt, Homo sapiens
ggacaaugaggaagaggaa

SEQ ID NO: 667858 - RNA, 19 nt, Homo sapiens
ugagaggcgugaauucaug

SEQ ID NO: 667859 - RNA, 19 nt, Homo sapiens
gggagaaucacuugaacuu

SEQ ID NO: 667860 - RNA, 19 nt, Homo sapiens
uuacaaaugcggagacuga

SEQ ID NO: 667861 - RNA, 19 nt, Homo sapiens
ggaugucccugcgggcuuu

SEQ ID NO: 667862 - RNA, 19 nt, Homo sapiens
ccaacgagcccauggaugu

SEQ ID NO: 667863 - RNA, 19 nt, Homo sapiens
ggagaaggagggcuggaaa

SEQ ID NO: 667864 - RNA, 19 nt, Homo sapiens
uuagguaucuugucaaacu

SEQ ID NO: 667865 - RNA, 19 nt, Homo sapiens
acggaauucuccaaucaua

SEQ ID NO: 667866 - RNA, 19 nt, Homo sapiens
gcagcuguuucaccuucua

SEQ ID NO: 667867 - RNA, 19 nt, Homo sapiens
gaccaucggcuuuagguau

SEQ ID NO: 667868 - RNA, 19 nt, Homo sapiens
guaaauggugcuacccaaa

SEQ ID NO: 667869 - RNA, 19 nt, Homo sapiens
gcaauggguccggcuguuu

SEQ ID NO: 667870 - RNA, 19 nt, Homo sapiens
gcggguagaucacuuuagg

SEQ ID NO: 667871 - RNA, 19 nt, Homo sapiens
gccaguacuuguuccaguu

SEQ ID NO: 667872 - RNA, 19 nt, Homo sapiens
gaaggagggcuggaaacaa

SEQ ID NO: 667873 - RNA, 19 nt, Homo sapiens
cgagaggauuugauagcuu

SEQ ID NO: 667874 - RNA, 19 nt, Homo sapiens
guagccgaguggacaauga

SEQ ID NO: 667875 - RNA, 19 nt, Homo sapiens
gcagcuugccgcucuagaa

SEQ ID NO: 667876 - RNA, 19 nt, Homo sapiens
gcaccugucaucccagcua

SEQ ID NO: 667877 - RNA, 19 nt, Homo sapiens
caggacaucugcauauaac

SEQ ID NO: 667878 - RNA, 19 nt, Homo sapiens
gcacaagggacucuaacca

SEQ ID NO: 667879 - RNA, 19 nt, Homo sapiens
aaauggugcuacccaaaug

SEQ ID NO: 667880 - RNA, 19 nt, Homo sapiens
uaaauggugcuacccaaau

SEQ ID NO: 667881 - RNA, 19 nt, Homo sapiens
uaccuggaguacaagauaa

SEQ ID NO: 667882 - RNA, 19 nt, Homo sapiens
ggccaagccagugauauuu

SEQ ID NO: 667883 - RNA, 19 nt, Homo sapiens
gacccauccuggaaucaga

SEQ ID NO: 667884 - RNA, 19 nt, Homo sapiens
gaacccgaccugggcaauu

SEQ ID NO: 667885 - RNA, 19 nt, Homo sapiens
ggaaaggcucagaguuuag

SEQ ID NO: 667886 - RNA, 19 nt, Homo sapiens
ccacucaacccaagaagca

SEQ ID NO: 667887 - RNA, 19 nt, Homo sapiens
ggagaaucacuugaacuug

SEQ ID NO: 667888 - RNA, 19 nt, Homo sapiens
ggugggagaaucacuugaa

SEQ ID NO: 667889 - RNA, 19 nt, Homo sapiens
acacacacacgccaccuuu

SEQ ID NO: 667890 - RNA, 19 nt, Homo sapiens
gggaacagagcuaaguaug

SEQ ID NO: 667891 - RNA, 19 nt, Homo sapiens
aaaggguggucuccagaau

SEQ ID NO: 667892 - RNA, 19 nt, Homo sapiens
ggcuuuagguaucuuguca

SEQ ID NO: 667893 - RNA, 19 nt, Homo sapiens
uuggaaaggcucagaguuu

SEQ ID NO: 667894 - RNA, 19 nt, Homo sapiens
ucuguuacuucacggaauu

SEQ ID NO: 667895 - RNA, 19 nt, Homo sapiens
uguguuggcuguggaaaga

SEQ ID NO: 667896 - RNA, 19 nt, Homo sapiens
uguaaucccagaacuuuga

SEQ ID NO: 667897 - RNA, 19 nt, Homo sapiens
gggcuguccucagaaugaa

SEQ ID NO: 667898 - RNA, 19 nt, Homo sapiens
gauaacacacacacacaca

SEQ ID NO: 667899 - RNA, 19 nt, Homo sapiens
caaaggguggucuccagaa

SEQ ID NO: 667900 - RNA, 19 nt, Homo sapiens
ccuguaaucccagaacuuu

SEQ ID NO: 667901 - RNA, 19 nt, Homo sapiens
gaaugguggaaagauauuu

SEQ ID NO: 667902 - RNA, 19 nt, Homo sapiens
ccaagguggugggaacaga

SEQ ID NO: 667903 - RNA, 19 nt, Homo sapiens
gaggacagccacccuuucu

SEQ ID NO: 667904 - RNA, 19 nt, Homo sapiens
caaggccaagccagugaua

SEQ ID NO: 667905 - RNA, 19 nt, Homo sapiens
cuuuagguaucuugucaaa

SEQ ID NO: 667906 - RNA, 19 nt, Homo sapiens
ugagaagcagugucuuuga

SEQ ID NO: 667907 - RNA, 19 nt, Homo sapiens
gccagugauauuuaaagua

SEQ ID NO: 667908 - RNA, 19 nt, Homo sapiens
gaccuuuaaucuguuggaa

SEQ ID NO: 667909 - RNA, 19 nt, Homo sapiens
gcagcagcuugccgcucua

SEQ ID NO: 667910 - RNA, 19 nt, Homo sapiens
gcugaagacgacacgcuuu

SEQ ID NO: 667911 - RNA, 19 nt, Homo sapiens
uaaagaaugguggaaagau

SEQ ID NO: 667912 - RNA, 19 nt, Homo sapiens
augcggagacugagguuua

SEQ ID NO: 667913 - RNA, 19 nt, Homo sapiens
uaacacacacacacacaca

SEQ ID NO: 667914 - RNA, 19 nt, Homo sapiens
aaaggcuucuguuacuuca

SEQ ID NO: 667915 - RNA, 19 nt, Homo sapiens
gaggugggagaaucacuug

SEQ ID NO: 667916 - RNA, 19 nt, Homo sapiens
aaauggaguaccuggagua

SEQ ID NO: 667917 - RNA, 19 nt, Homo sapiens
ggacaucugcauauaacac

SEQ ID NO: 667918 - RNA, 19 nt, Homo sapiens
ccugacaacuugcugaaaa

SEQ ID NO: 667919 - RNA, 19 nt, Homo sapiens
uggcaaagaauaaccuguu

SEQ ID NO: 667920 - RNA, 19 nt, Homo sapiens
ccugaaggaugcuguacca

SEQ ID NO: 667921 - RNA, 19 nt, Homo sapiens
ggagggcuggaaacaaaug

SEQ ID NO: 667922 - RNA, 19 nt, Homo sapiens
gcuugccgcucuagaaggu

SEQ ID NO: 667923 - RNA, 19 nt, Homo sapiens
gggagccccugcacacuuu

SEQ ID NO: 667924 - RNA, 19 nt, Homo sapiens
caacauggugaaaccuugu

SEQ ID NO: 667925 - RNA, 19 nt, Homo sapiens
cagccgaagucagaaaaua

SEQ ID NO: 667926 - RNA, 19 nt, Homo sapiens
agacgacacgcuuugaaga

SEQ ID NO: 667927 - RNA, 19 nt, Homo sapiens
gcaaagauuccccgaagug

SEQ ID NO: 667928 - RNA, 19 nt, Homo sapiens
caagggacucuaaccaaag

SEQ ID NO: 667929 - RNA, 19 nt, Homo sapiens
cacaagggacucuaaccaa

SEQ ID NO: 667930 - RNA, 19 nt, Homo sapiens
acaaugaggaagaggaaga

SEQ ID NO: 667931 - RNA, 19 nt, Homo sapiens
gaaguuuccugaacauuaa

SEQ ID NO: 667932 - RNA, 19 nt, Homo sapiens
ggucgaagcucucuggaua

SEQ ID NO: 667933 - RNA, 19 nt, Homo sapiens
guauagggcucaaggaaua

SEQ ID NO: 667934 - RNA, 19 nt, Homo sapiens
caagaaugcugacaaggua

SEQ ID NO: 667935 - RNA, 19 nt, Homo sapiens
ggaauaagcgcaaauaaau

SEQ ID NO: 667936 - RNA, 19 nt, Homo sapiens
gagcagaguuauaagaauu

SEQ ID NO: 667937 - RNA, 19 nt, Homo sapiens
ucgcagagcuggaugauaa

SEQ ID NO: 667938 - RNA, 19 nt, Homo sapiens
ugagugagcuugugauuga

SEQ ID NO: 667939 - RNA, 19 nt, Homo sapiens
gagaguggcugcuuucaga

SEQ ID NO: 667940 - RNA, 19 nt, Homo sapiens
uagaaagccuggagucaua

SEQ ID NO: 667941 - RNA, 19 nt, Homo sapiens
gaaagauagucaaggagaa

SEQ ID NO: 667942 - RNA, 19 nt, Homo sapiens
ggagacggcuguagcacaa

SEQ ID NO: 667943 - RNA, 19 nt, Homo sapiens
cgaaguuuccugaacauua

SEQ ID NO: 667944 - RNA, 19 nt, Homo sapiens
ugagaaagauagucaagga

SEQ ID NO: 667945 - RNA, 19 nt, Homo sapiens
acacaaagccuauuaucaa

SEQ ID NO: 667946 - RNA, 19 nt, Homo sapiens
gaagcucucuggauaacau

SEQ ID NO: 667947 - RNA, 19 nt, Homo sapiens
gaagacgcccuugacuuua

SEQ ID NO: 667948 - RNA, 19 nt, Homo sapiens
caaagccuauuaucaacaa

SEQ ID NO: 667949 - RNA, 19 nt, Homo sapiens
gagaaugacggaaguagaa

SEQ ID NO: 667950 - RNA, 19 nt, Homo sapiens
auaaaggacuguuugaaga

SEQ ID NO: 667951 - RNA, 19 nt, Homo sapiens
gaacagcaaggacagaaga

SEQ ID NO: 667952 - RNA, 19 nt, Homo sapiens
uaccuuugcuggaaugaua

SEQ ID NO: 667953 - RNA, 19 nt, Homo sapiens
caacggaugcccugaagaa

SEQ ID NO: 667954 - RNA, 19 nt, Homo sapiens
ugucaacgccaauaaauuu

SEQ ID NO: 667955 - RNA, 19 nt, Homo sapiens
ugaauuaagugccaugcuu

SEQ ID NO: 667956 - RNA, 19 nt, Homo sapiens
gaauuaagugccaugcuuu

SEQ ID NO: 667957 - RNA, 19 nt, Homo sapiens
agaagacgcccuugacuuu

SEQ ID NO: 667958 - RNA, 19 nt, Homo sapiens
caauacagaucccuacaag

SEQ ID NO: 667959 - RNA, 19 nt, Homo sapiens
ucagaaauuucagugauga

SEQ ID NO: 667960 - RNA, 19 nt, Homo sapiens
caaggaauaagcgcaaaua

SEQ ID NO: 667961 - RNA, 19 nt, Homo sapiens
uaucauaguggucauauug

SEQ ID NO: 667962 - RNA, 19 nt, Homo sapiens
ggagucauagauaaguuua

SEQ ID NO: 667963 - RNA, 19 nt, Homo sapiens
gaaagccgagaguucgaua

SEQ ID NO: 667964 - RNA, 19 nt, Homo sapiens
gaaguugaaccaagugugu

SEQ ID NO: 667965 - RNA, 19 nt, Homo sapiens
ccaauugguucgaaguuuc

SEQ ID NO: 667966 - RNA, 19 nt, Homo sapiens
uaagagcauuuccgacaug

SEQ ID NO: 667967 - RNA, 19 nt, Homo sapiens
gcacaaggaucugcaucuc

SEQ ID NO: 667968 - RNA, 19 nt, Homo sapiens
gcuugccgcuucacaggua

SEQ ID NO: 667969 - RNA, 19 nt, Homo sapiens
gagaagacgcccuugacuu

SEQ ID NO: 667970 - RNA, 19 nt, Homo sapiens
caagcccgcacucugauua

SEQ ID NO: 667971 - RNA, 19 nt, Homo sapiens
gaaaauaaaggacuguuug

SEQ ID NO: 667972 - RNA, 19 nt, Homo sapiens
gcacaaccucucagaagug

SEQ ID NO: 667973 - RNA, 19 nt, Homo sapiens
ugaagcagcaguugccuuu

SEQ ID NO: 667974 - RNA, 19 nt, Homo sapiens
ggacaaaacugaggauuac

SEQ ID NO: 667975 - RNA, 19 nt, Homo sapiens
gcggcaaauuuauaucuau

SEQ ID NO: 667976 - RNA, 19 nt, Homo sapiens
gaagagagaguggcugcuu

SEQ ID NO: 667977 - RNA, 19 nt, Homo sapiens
agaagcaguuguuggaaga

SEQ ID NO: 667978 - RNA, 19 nt, Homo sapiens
gugacugucuuuggaaauu

SEQ ID NO: 667979 - RNA, 19 nt, Homo sapiens
ugugggcgcuaauuuacua

SEQ ID NO: 667980 - RNA, 19 nt, Homo sapiens
gccugggacuuaccaauug

SEQ ID NO: 667981 - RNA, 19 nt, Homo sapiens
gaagugcgcauggaguuug

SEQ ID NO: 667982 - RNA, 19 nt, Homo sapiens
caagugaaacagcgaauuc

SEQ ID NO: 667983 - RNA, 19 nt, Homo sapiens
caacgccaauaaauuucuu

SEQ ID NO: 667984 - RNA, 19 nt, Homo sapiens
uacuggagcugaugaacaa

SEQ ID NO: 667985 - RNA, 19 nt, Homo sapiens
cgauaugauucuugggaaa

SEQ ID NO: 667986 - RNA, 19 nt, Homo sapiens
acaaaugacagacguguug

SEQ ID NO: 667987 - RNA, 19 nt, Homo sapiens
cauaguggucauauugaua

SEQ ID NO: 667988 - RNA, 19 nt, Homo sapiens
gacacaaagccuauuauca

SEQ ID NO: 667989 - RNA, 19 nt, Homo sapiens
uugggaaacuagagaauga

SEQ ID NO: 667990 - RNA, 19 nt, Homo sapiens
guagggcccucaggaacaa

SEQ ID NO: 667991 - RNA, 19 nt, Homo sapiens
ugacagacguguuguugac

SEQ ID NO: 667992 - RNA, 19 nt, Homo sapiens
ccacaucucccagcgauug

SEQ ID NO: 667993 - RNA, 19 nt, Homo sapiens
acaaggagaggcugaagaa

SEQ ID NO: 667994 - RNA, 19 nt, Homo sapiens
gccgagaguucgauaugau

SEQ ID NO: 667995 - RNA, 19 nt, Homo sapiens
ugacugucuuuggaaauuu

SEQ ID NO: 667996 - RNA, 19 nt, Homo sapiens
gcacucugauuaccuuugc

SEQ ID NO: 667997 - RNA, 19 nt, Homo sapiens
ggcacaaccucucagaagu

SEQ ID NO: 667998 - RNA, 19 nt, Homo sapiens
ggaaaguguggaagagaga

SEQ ID NO: 667999 - RNA, 19 nt, Homo sapiens
gccguguacuguaucauug

SEQ ID NO: 668000 - RNA, 19 nt, Homo sapiens
cagcaaggacagaagauug

SEQ ID NO: 668001 - RNA, 19 nt, Homo sapiens
aagagagaguggcugcuuu

SEQ ID NO: 668002 - RNA, 19 nt, Homo sapiens
aggaauaagcgcaaauaaa

SEQ ID NO: 668003 - RNA, 19 nt, Homo sapiens
uaaguuuacuagugacaca

SEQ ID NO: 668004 - RNA, 19 nt, Homo sapiens
caagacaggcucacucucu

SEQ ID NO: 668005 - RNA, 19 nt, Homo sapiens
cugauuaccuuugcuggaa

SEQ ID NO: 668006 - RNA, 19 nt, Homo sapiens
uauggcgagucccacuuua

SEQ ID NO: 668007 - RNA, 19 nt, Homo sapiens
ggaagugcgcauggaguuu

SEQ ID NO: 668008 - RNA, 19 nt, Homo sapiens
gcaagugaaacagcgaauu

SEQ ID NO: 668009 - RNA, 19 nt, Homo sapiens
uugcuggaaugauaccaua

SEQ ID NO: 668010 - RNA, 19 nt, Homo sapiens
ggacuccacguucuaucuu

SEQ ID NO: 668011 - RNA, 19 nt, Homo sapiens
ccaagaaugcugacaaggu

SEQ ID NO: 668012 - RNA, 19 nt, Homo sapiens
ggaucugcaucuccaaugg

SEQ ID NO: 668013 - RNA, 19 nt, Homo sapiens
gaauuacacccuugugacu

SEQ ID NO: 668014 - RNA, 19 nt, Homo sapiens
ggagacggcagaugucaag

SEQ ID NO: 668015 - RNA, 19 nt, Homo sapiens
gggaugagaaagauaguca

SEQ ID NO: 668016 - RNA, 19 nt, Homo sapiens
cagcaacccuuccucuacu

SEQ ID NO: 668017 - RNA, 19 nt, Homo sapiens
agagugaaguggcggacaa

SEQ ID NO: 668018 - RNA, 19 nt, Homo sapiens
gacugucuuuggaaauuug

SEQ ID NO: 668019 - RNA, 19 nt, Homo sapiens
ugagcagaguuauaagaau

SEQ ID NO: 668020 - RNA, 19 nt, Homo sapiens
gauuaccuuugcuggaaug

SEQ ID NO: 668021 - RNA, 19 nt, Homo sapiens
gagugcagccaccaccuuu

SEQ ID NO: 668022 - RNA, 19 nt, Homo sapiens
caagaaagcgagccaagcu

SEQ ID NO: 668023 - RNA, 19 nt, Homo sapiens
ucauaguggucauauugau

SEQ ID NO: 668024 - RNA, 19 nt, Homo sapiens
guaucauaguggucauauu

SEQ ID NO: 668025 - RNA, 19 nt, Homo sapiens
aggagaggcugaagaacau

SEQ ID NO: 668026 - RNA, 19 nt, Homo sapiens
cacaaagccuauuaucaac

SEQ ID NO: 668027 - RNA, 19 nt, Homo sapiens
gauugaaagccgagaguuc

SEQ ID NO: 668028 - RNA, 19 nt, Homo sapiens
aaagauagucaaggagaaa

SEQ ID NO: 668029 - RNA, 19 nt, Homo sapiens
ucucagagcuuccccaugu

SEQ ID NO: 668030 - RNA, 19 nt, Homo sapiens
gguauagggcucaaggaau

SEQ ID NO: 668031 - RNA, 19 nt, Homo sapiens
ggaaagaacucguaaugga

SEQ ID NO: 668032 - RNA, 19 nt, Homo sapiens
guaaggagcuccagaaaga

SEQ ID NO: 668033 - RNA, 19 nt, Homo sapiens
gaccauugcuugcauguua

SEQ ID NO: 668034 - RNA, 19 nt, Homo sapiens
gaaaaugacugauguacua

SEQ ID NO: 668035 - RNA, 19 nt, Homo sapiens
gaagugcaaugacaauuau

SEQ ID NO: 668036 - RNA, 19 nt, Homo sapiens
aaacaggaguuguagauaa

SEQ ID NO: 668037 - RNA, 19 nt, Homo sapiens
ggaauagucuggucaagug

SEQ ID NO: 668038 - RNA, 19 nt, Homo sapiens
gcaaugauuugugagauaa

SEQ ID NO: 668039 - RNA, 19 nt, Homo sapiens
ugaagaaggugacugaauu

SEQ ID NO: 668040 - RNA, 19 nt, Homo sapiens
gaaacuacacccucaguaa

SEQ ID NO: 668041 - RNA, 19 nt, Homo sapiens
guauaaagaugcacauguu

SEQ ID NO: 668042 - RNA, 19 nt, Homo sapiens
aaacuagccuggaauaaug

SEQ ID NO: 668043 - RNA, 19 nt, Homo sapiens
gggaagacuuuguguuaaa

SEQ ID NO: 668044 - RNA, 19 nt, Homo sapiens
agaaagaacuucaagaaca

SEQ ID NO: 668045 - RNA, 19 nt, Homo sapiens
caaaugaagugcaaugaca

SEQ ID NO: 668046 - RNA, 19 nt, Homo sapiens
acacuuagauugauaggaa

SEQ ID NO: 668047 - RNA, 19 nt, Homo sapiens
gaaacacucuuugacauuc

SEQ ID NO: 668048 - RNA, 19 nt, Homo sapiens
gaaagaacuucaagaacag

SEQ ID NO: 668049 - RNA, 19 nt, Homo sapiens
gagggaauaacauguaaua

SEQ ID NO: 668050 - RNA, 19 nt, Homo sapiens
gaaacuagccuggaauaau

SEQ ID NO: 668051 - RNA, 19 nt, Homo sapiens
gcauuagucuuuucaguua

SEQ ID NO: 668052 - RNA, 19 nt, Homo sapiens
gaagaaggugacugaauuu

SEQ ID NO: 668053 - RNA, 19 nt, Homo sapiens
agaagaaucugaaucugaa

SEQ ID NO: 668054 - RNA, 19 nt, Homo sapiens
caugaaagccuuccagaaa

SEQ ID NO: 668055 - RNA, 19 nt, Homo sapiens
ggcaaugauuugugagaua

SEQ ID NO: 668056 - RNA, 19 nt, Homo sapiens
gaaggugacugaauuuuga

SEQ ID NO: 668057 - RNA, 19 nt, Homo sapiens
acaaauaccuggagaaagg

SEQ ID NO: 668058 - RNA, 19 nt, Homo sapiens
uaacaugaaucuugaguac

SEQ ID NO: 668059 - RNA, 19 nt, Homo sapiens
ggaauaaugccaccagaga

SEQ ID NO: 668060 - RNA, 19 nt, Homo sapiens
uccuaaagcucaauuguuu

SEQ ID NO: 668061 - RNA, 19 nt, Homo sapiens
gggcuuucauggcaaauuu

SEQ ID NO: 668062 - RNA, 19 nt, Homo sapiens
gguauacaauugauccauu

SEQ ID NO: 668063 - RNA, 19 nt, Homo sapiens
gaaauguuggguuuaguuu

SEQ ID NO: 668064 - RNA, 19 nt, Homo sapiens
caauacagcccucuacuug

SEQ ID NO: 668065 - RNA, 19 nt, Homo sapiens
ggagaaagguuuugaagau

SEQ ID NO: 668066 - RNA, 19 nt, Homo sapiens
cagaauacacuuagauuga

SEQ ID NO: 668067 - RNA, 19 nt, Homo sapiens
uacaggagcuauagauuug

SEQ ID NO: 668068 - RNA, 19 nt, Homo sapiens
cagaauauguucggaauca

SEQ ID NO: 668069 - RNA, 19 nt, Homo sapiens
uggcuucguucucuuaaua

SEQ ID NO: 668070 - RNA, 19 nt, Homo sapiens
ugaagugcaaugacaauua

SEQ ID NO: 668071 - RNA, 19 nt, Homo sapiens
ccagaaagaacuucaagaa

SEQ ID NO: 668072 - RNA, 19 nt, Homo sapiens
gaaucuagauauagcuuag

SEQ ID NO: 668073 - RNA, 19 nt, Homo sapiens
gcaaacaggaguuguagau

SEQ ID NO: 668074 - RNA, 19 nt, Homo sapiens
ggaagcaguagcuaaguuu

SEQ ID NO: 668075 - RNA, 19 nt, Homo sapiens
guagcuaaguuucuugaug

SEQ ID NO: 668076 - RNA, 19 nt, Homo sapiens
gauaaaaugucaugucuca

SEQ ID NO: 668077 - RNA, 19 nt, Homo sapiens
gaagaagaaucugaaucug

SEQ ID NO: 668078 - RNA, 19 nt, Homo sapiens
ugacaacauucauuucaug

SEQ ID NO: 668079 - RNA, 19 nt, Homo sapiens
guauugcuaugacaacauu

SEQ ID NO: 668080 - RNA, 19 nt, Homo sapiens
ggaaagucagcauggauaa

SEQ ID NO: 668081 - RNA, 19 nt, Homo sapiens
gcagaaacacucuuugaca

SEQ ID NO: 668082 - RNA, 19 nt, Homo sapiens
guaauggaguuugaguaaa

SEQ ID NO: 668083 - RNA, 19 nt, Homo sapiens
ggaaauguuggguuuaguu

SEQ ID NO: 668084 - RNA, 19 nt, Homo sapiens
ugaaaccgguacugauuug

SEQ ID NO: 668085 - RNA, 19 nt, Homo sapiens
uaauggaguuugaguaaag

SEQ ID NO: 668086 - RNA, 19 nt, Homo sapiens
gcacagaauacacuuagau

SEQ ID NO: 668087 - RNA, 19 nt, Homo sapiens
gcuaauggaacacuuaaug

SEQ ID NO: 668088 - RNA, 19 nt, Homo sapiens
cagaaacacucuuugacau

SEQ ID NO: 668089 - RNA, 19 nt, Homo sapiens
cuacaggagcuauagauuu

SEQ ID NO: 668090 - RNA, 19 nt, Homo sapiens
gaagugguauaaagaugca

SEQ ID NO: 668091 - RNA, 19 nt, Homo sapiens
gugaagcucuuuaaaucau

SEQ ID NO: 668092 - RNA, 19 nt, Homo sapiens
gagcugacucuguuacuga

SEQ ID NO: 668093 - RNA, 19 nt, Homo sapiens
gcaauacagcccucuacuu

SEQ ID NO: 668094 - RNA, 19 nt, Homo sapiens
uaaucaggcgcuacaaaua

SEQ ID NO: 668095 - RNA, 19 nt, Homo sapiens
ggaaaucgccccuuuugaa

SEQ ID NO: 668096 - RNA, 19 nt, Homo sapiens
gaagaagaaaguugagcuu

SEQ ID NO: 668097 - RNA, 19 nt, Homo sapiens
gugguacacuggcagauga

SEQ ID NO: 668098 - RNA, 19 nt, Homo sapiens
gcuucguucucuuaauaua

SEQ ID NO: 668099 - RNA, 19 nt, Homo sapiens
gagaagccauggagaacag

SEQ ID NO: 668100 - RNA, 19 nt, Homo sapiens
ucuucuaccuccuguauuu

SEQ ID NO: 668101 - RNA, 19 nt, Homo sapiens
aaacuacacccucaguaaa

SEQ ID NO: 668102 - RNA, 19 nt, Homo sapiens
ggaaucuagauauagcuua

SEQ ID NO: 668103 - RNA, 19 nt, Homo sapiens
cguaauggaguuugaguaa

SEQ ID NO: 668104 - RNA, 19 nt, Homo sapiens
gauaggaaagaacucguaa

SEQ ID NO: 668105 - RNA, 19 nt, Homo sapiens
aacaggaguuguagauaaa

SEQ ID NO: 668106 - RNA, 19 nt, Homo sapiens
gagaggaacaagcuagcua

SEQ ID NO: 668107 - RNA, 19 nt, Homo sapiens
uaacaaaugaagugcaaug

SEQ ID NO: 668108 - RNA, 19 nt, Homo sapiens
uuaaggccuuccacaauga

SEQ ID NO: 668109 - RNA, 19 nt, Homo sapiens
uaacugaaaccgguacuga

SEQ ID NO: 668110 - RNA, 19 nt, Homo sapiens
gccucuggcuauuaacaua

SEQ ID NO: 668111 - RNA, 19 nt, Homo sapiens
ggacuggcuucguucucuu

SEQ ID NO: 668112 - RNA, 19 nt, Homo sapiens
caaacaggaguuguagaua

SEQ ID NO: 668113 - RNA, 19 nt, Homo sapiens
gaacuucaagaacagaugu

SEQ ID NO: 668114 - RNA, 19 nt, Homo sapiens
gccaugagccaaauacuuc

SEQ ID NO: 668115 - RNA, 19 nt, Homo sapiens
gcuuagaguauuugcuaua

SEQ ID NO: 668116 - RNA, 19 nt, Homo sapiens
uaugguugcuggaaauguu

SEQ ID NO: 668117 - RNA, 19 nt, Homo sapiens
uaagggcuuucauggcaaa

SEQ ID NO: 668118 - RNA, 19 nt, Homo sapiens
cugugaagcucuuuaaauc

SEQ ID NO: 668119 - RNA, 19 nt, Homo sapiens
gcugugaagcucuuuaaau

SEQ ID NO: 668120 - RNA, 19 nt, Homo sapiens
gugaaacuagccuggaaua

SEQ ID NO: 668121 - RNA, 19 nt, Homo sapiens
auacuggacuggcuucguu

SEQ ID NO: 668122 - RNA, 19 nt, Homo sapiens
ugaagaagaaucugaaucu

SEQ ID NO: 668123 - RNA, 19 nt, Homo sapiens
cuacaaauaccuggagaaa

SEQ ID NO: 668124 - RNA, 19 nt, Homo sapiens
caccagagacugaguggaa

SEQ ID NO: 668125 - RNA, 19 nt, Homo sapiens
cuauuaacauacccuaguu

SEQ ID NO: 668126 - RNA, 19 nt, Homo sapiens
cuaauugggaaucuagaua

SEQ ID NO: 668127 - RNA, 19 nt, Homo sapiens
uaggaaagaacucguaaug

SEQ ID NO: 668128 - RNA, 19 nt, Homo sapiens
uugcuugcauguuaacuuu

SEQ ID NO: 668129 - RNA, 19 nt, Homo sapiens
uuuaaggccuuccacaaug

SEQ ID NO: 668130 - RNA, 19 nt, Homo sapiens
caggagcuauagauuugaa

SEQ ID NO: 668131 - RNA, 19 nt, Homo sapiens
gcaagaaauucagguauua

SEQ ID NO: 668132 - RNA, 19 nt, Homo sapiens
gagaguagauguucaagaa

SEQ ID NO: 668133 - RNA, 19 nt, Homo sapiens
ggacauugcuuuucaaaua

SEQ ID NO: 668134 - RNA, 19 nt, Homo sapiens
ugaagaagcuggacacaaa

SEQ ID NO: 668135 - RNA, 19 nt, Homo sapiens
ggaaauagcauaucugaga

SEQ ID NO: 668136 - RNA, 19 nt, Homo sapiens
gagaaugcuugaaguauuu

SEQ ID NO: 668137 - RNA, 19 nt, Homo sapiens
uagaagagcugauaauguu

SEQ ID NO: 668138 - RNA, 19 nt, Homo sapiens
caaguuggcuuauccagaa

SEQ ID NO: 668139 - RNA, 19 nt, Homo sapiens
gaagaaaggcgaagguuga

SEQ ID NO: 668140 - RNA, 19 nt, Homo sapiens
ccacuugucuuccuggaua

SEQ ID NO: 668141 - RNA, 19 nt, Homo sapiens
ggaguuguaucccgcauuu

SEQ ID NO: 668142 - RNA, 19 nt, Homo sapiens
gcaagaaguucaaggagau

SEQ ID NO: 668143 - RNA, 19 nt, Homo sapiens
gcauacagauggaacagaa

SEQ ID NO: 668144 - RNA, 19 nt, Homo sapiens
gaugacaguuugaauguug

SEQ ID NO: 668145 - RNA, 19 nt, Homo sapiens
ugaagaugcuuaugacaaa

SEQ ID NO: 668146 - RNA, 19 nt, Homo sapiens
ggaugaagcuggcauugau

SEQ ID NO: 668147 - RNA, 19 nt, Homo sapiens
uaaaugaacuacugaaguc

SEQ ID NO: 668148 - RNA, 19 nt, Homo sapiens
ucuaauaucuuccauguca

SEQ ID NO: 668149 - RNA, 19 nt, Homo sapiens
gcucugaaaugcaacaaug

SEQ ID NO: 668150 - RNA, 19 nt, Homo sapiens
gcacuguuguuaauagaga

SEQ ID NO: 668151 - RNA, 19 nt, Homo sapiens
gaaaagagaugaugauggu

SEQ ID NO: 668152 - RNA, 19 nt, Homo sapiens
agacaucuuugguuucuaa

SEQ ID NO: 668153 - RNA, 19 nt, Homo sapiens
ugagaaugcuugaaguauu

SEQ ID NO: 668154 - RNA, 19 nt, Homo sapiens
gaagaaagagagaggaaga

SEQ ID NO: 668155 - RNA, 19 nt, Homo sapiens
ugaaugcacuguuguuaau

SEQ ID NO: 668156 - RNA, 19 nt, Homo sapiens
ugagagacuuacaugcuua

SEQ ID NO: 668157 - RNA, 19 nt, Homo sapiens
gaaaagauggauucaguua

SEQ ID NO: 668158 - RNA, 19 nt, Homo sapiens
gaucacagggucuauggua

SEQ ID NO: 668159 - RNA, 19 nt, Homo sapiens
agacuuacaugcuuauuuc

SEQ ID NO: 668160 - RNA, 19 nt, Homo sapiens
gccagaaguucgagaagaa

SEQ ID NO: 668161 - RNA, 19 nt, Homo sapiens
gaagaggagugucgguagu

SEQ ID NO: 668162 - RNA, 19 nt, Homo sapiens
ucacuaauuuccauacaug

SEQ ID NO: 668163 - RNA, 19 nt, Homo sapiens
gggacuagcaugcuuguuu

SEQ ID NO: 668164 - RNA, 19 nt, Homo sapiens
gcuauucugagcuuauuua

SEQ ID NO: 668165 - RNA, 19 nt, Homo sapiens
gaguagauguucaagaaag

SEQ ID NO: 668166 - RNA, 19 nt, Homo sapiens
caacccggcugcucagaug

SEQ ID NO: 668167 - RNA, 19 nt, Homo sapiens
uuucagagguugauuuaug

SEQ ID NO: 668168 - RNA, 19 nt, Homo sapiens
gaaguucgagaagaauaua

SEQ ID NO: 668169 - RNA, 19 nt, Homo sapiens
ucugagacaucuuugguuu

SEQ ID NO: 668170 - RNA, 19 nt, Homo sapiens
gcaauauuccauccaaaga

SEQ ID NO: 668171 - RNA, 19 nt, Homo sapiens
ggauggaucugagagacuu

SEQ ID NO: 668172 - RNA, 19 nt, Homo sapiens
gcaugaaccugcugaagcu

SEQ ID NO: 668173 - RNA, 19 nt, Homo sapiens
gcagaccauccuguuauua

SEQ ID NO: 668174 - RNA, 19 nt, Homo sapiens
uaaggucacucagcucuau

SEQ ID NO: 668175 - RNA, 19 nt, Homo sapiens
aagcuuccaucaaguauug

SEQ ID NO: 668176 - RNA, 19 nt, Homo sapiens
aaacuucucuaugcgauug

SEQ ID NO: 668177 - RNA, 19 nt, Homo sapiens
aggaagggcugcuggugua

SEQ ID NO: 668178 - RNA, 19 nt, Homo sapiens
ggacuagcaugcuuguuuu

SEQ ID NO: 668179 - RNA, 19 nt, Homo sapiens
aaagagaugaugaugguaa

SEQ ID NO: 668180 - RNA, 19 nt, Homo sapiens
ucagugaaauuaaccaaag

SEQ ID NO: 668181 - RNA, 19 nt, Homo sapiens
gaagagcuacgaagacgau

SEQ ID NO: 668182 - RNA, 19 nt, Homo sapiens
ggucaaagacaaucaucaa

SEQ ID NO: 668183 - RNA, 19 nt, Homo sapiens
ggaagaaagaagaaagaga

SEQ ID NO: 668184 - RNA, 19 nt, Homo sapiens
gagacuuacaugcuuauuu

SEQ ID NO: 668185 - RNA, 19 nt, Homo sapiens
ucugugggcugucauaguu

SEQ ID NO: 668186 - RNA, 19 nt, Homo sapiens
cuauuucuaucuccacuuu

SEQ ID NO: 668187 - RNA, 19 nt, Homo sapiens
uuacagcauuucagaguau

SEQ ID NO: 668188 - RNA, 19 nt, Homo sapiens
cauagaaguuguaggucaa

SEQ ID NO: 668189 - RNA, 19 nt, Homo sapiens
guggaaggguucacugaug

SEQ ID NO: 668190 - RNA, 19 nt, Homo sapiens
gccagggccuugccaaugu

SEQ ID NO: 668191 - RNA, 19 nt, Homo sapiens
gagaggcgcagguaguuga

SEQ ID NO: 668192 - RNA, 19 nt, Homo sapiens
ucaaagacaaucaucaaug

SEQ ID NO: 668193 - RNA, 19 nt, Homo sapiens
gggcugucauaguuaauug

SEQ ID NO: 668194 - RNA, 19 nt, Homo sapiens
ggagcagagugacccuuug

SEQ ID NO: 668195 - RNA, 19 nt, Homo sapiens
gagaugaugaugguaauau

SEQ ID NO: 668196 - RNA, 19 nt, Homo sapiens
uggaaggguucacugauga

SEQ ID NO: 668197 - RNA, 19 nt, Homo sapiens
cagaccauccuguuauuaa

SEQ ID NO: 668198 - RNA, 19 nt, Homo sapiens
gaagagcugauaauguugu

SEQ ID NO: 668199 - RNA, 19 nt, Homo sapiens
acacaaagcagcagaccaa

SEQ ID NO: 668200 - RNA, 19 nt, Homo sapiens
gaccuuccucucucaguua

SEQ ID NO: 668201 - RNA, 19 nt, Homo sapiens
gguaaggcagcuucuguuu

SEQ ID NO: 668202 - RNA, 19 nt, Homo sapiens
gcuaauggccccaaccuua

SEQ ID NO: 668203 - RNA, 19 nt, Homo sapiens
ccucauuuaucucuucuau

SEQ ID NO: 668204 - RNA, 19 nt, Homo sapiens
gccaagaagagcacaguuu

SEQ ID NO: 668205 - RNA, 19 nt, Homo sapiens
cuaagcuccuucuuucauu

SEQ ID NO: 668206 - RNA, 19 nt, Homo sapiens
ucaggcuucucuacaguuu

SEQ ID NO: 668207 - RNA, 19 nt, Homo sapiens
ccauugcacuuuacuuaca

SEQ ID NO: 668208 - RNA, 19 nt, Homo sapiens
gaucugagagacuuacaug

SEQ ID NO: 668209 - RNA, 19 nt, Homo sapiens
gucgguaguucuugcagua

SEQ ID NO: 668210 - RNA, 19 nt, Homo sapiens
gaacagaaaagauggauuc

SEQ ID NO: 668211 - RNA, 19 nt, Homo sapiens
gcaacaaugcauacagaug

SEQ ID NO: 668212 - RNA, 19 nt, Homo sapiens
guauuggaguuacuacuag

SEQ ID NO: 668213 - RNA, 19 nt, Homo sapiens
acagcaagcuuccaucaag

SEQ ID NO: 668214 - RNA, 19 nt, Homo sapiens
uggcaucucagugaaauua

SEQ ID NO: 668215 - RNA, 19 nt, Homo sapiens
acccugagguguauaagaa

SEQ ID NO: 668216 - RNA, 19 nt, Homo sapiens
ucucuacaguuuagccuuu

SEQ ID NO: 668217 - RNA, 19 nt, Homo sapiens
acagaggaaugccugaaga

SEQ ID NO: 668218 - RNA, 19 nt, Homo sapiens
aaccauugcacuuuacuua

SEQ ID NO: 668219 - RNA, 19 nt, Homo sapiens
gaaagagagaggaagaaag

SEQ ID NO: 668220 - RNA, 19 nt, Homo sapiens
gucagugauugaacaaauu

SEQ ID NO: 668221 - RNA, 19 nt, Homo sapiens
aauacuuacuugccuguuu

SEQ ID NO: 668222 - RNA, 19 nt, Homo sapiens
gaauguugcacuuccaaug

SEQ ID NO: 668223 - RNA, 19 nt, Homo sapiens
uaucugagacugaggagaa

SEQ ID NO: 668224 - RNA, 19 nt, Homo sapiens
gaaugacacuuuuaagaca

SEQ ID NO: 668225 - RNA, 19 nt, Homo sapiens
ucucuucuaugucuaguau

SEQ ID NO: 668226 - RNA, 19 nt, Homo sapiens
gaaugcacuguuguuaaua

SEQ ID NO: 668227 - RNA, 19 nt, Homo sapiens
gcagaugcgcagaccguuu

SEQ ID NO: 668228 - RNA, 19 nt, Homo sapiens
uuaugugguuggauuguuu

SEQ ID NO: 668229 - RNA, 19 nt, Homo sapiens
ugaaugugccgcuggcuuu

SEQ ID NO: 668230 - RNA, 19 nt, Homo sapiens
uggaaaggcucucuaugag

SEQ ID NO: 668231 - RNA, 19 nt, Homo sapiens
gaacacagaugaauaaaug

SEQ ID NO: 668232 - RNA, 19 nt, Homo sapiens
aaacacagcuuggaauuua

SEQ ID NO: 668233 - RNA, 19 nt, Homo sapiens
gaagaaggcugaguuuauu

SEQ ID NO: 668234 - RNA, 19 nt, Homo sapiens
gggaaucacugcagguuua

SEQ ID NO: 668235 - RNA, 19 nt, Homo sapiens
uaacccagcucuucuaauu

SEQ ID NO: 668236 - RNA, 19 nt, Homo sapiens
guaauaaacuggccaagau

SEQ ID NO: 668237 - RNA, 19 nt, Homo sapiens
guaaauagguuuccaggau

SEQ ID NO: 668238 - RNA, 19 nt, Homo sapiens
gaucacagaugaauucuca

SEQ ID NO: 668239 - RNA, 19 nt, Homo sapiens
gcauugacuuugccacuua

SEQ ID NO: 668240 - RNA, 19 nt, Homo sapiens
gggauaaacuuaaggaaga

SEQ ID NO: 668241 - RNA, 19 nt, Homo sapiens
ggaagaaacacaaaccuuu

SEQ ID NO: 668242 - RNA, 19 nt, Homo sapiens
ggaagaaggcugaguuuau

SEQ ID NO: 668243 - RNA, 19 nt, Homo sapiens
gcagugagcugugaucaug

SEQ ID NO: 668244 - RNA, 19 nt, Homo sapiens
gacaauauaccucaaagua

SEQ ID NO: 668245 - RNA, 19 nt, Homo sapiens
caacacaaccuuugaauuc

SEQ ID NO: 668246 - RNA, 19 nt, Homo sapiens
caagaaggaggaauuauuu

SEQ ID NO: 668247 - RNA, 19 nt, Homo sapiens
caaauacucuuucuucuac

SEQ ID NO: 668248 - RNA, 19 nt, Homo sapiens
gggagaagcuacaagaaga

SEQ ID NO: 668249 - RNA, 19 nt, Homo sapiens
gaaaagacauaaaggauga

SEQ ID NO: 668250 - RNA, 19 nt, Homo sapiens
gugcugaucucacugcaua

SEQ ID NO: 668251 - RNA, 19 nt, Homo sapiens
caaaagagcucuccaggaa

SEQ ID NO: 668252 - RNA, 19 nt, Homo sapiens
ccagauaucucaggaaaga

SEQ ID NO: 668253 - RNA, 19 nt, Homo sapiens
caacaucucucucacuauc

SEQ ID NO: 668254 - RNA, 19 nt, Homo sapiens
caucugagguggcuuauuc

SEQ ID NO: 668255 - RNA, 19 nt, Homo sapiens
gagauaaacugaagugcau

SEQ ID NO: 668256 - RNA, 19 nt, Homo sapiens
gaugaagacuugguagaaa

SEQ ID NO: 668257 - RNA, 19 nt, Homo sapiens
gaacuuaagagauuugaga

SEQ ID NO: 668258 - RNA, 19 nt, Homo sapiens
gcaguaauaagcaaguuua

SEQ ID NO: 668259 - RNA, 19 nt, Homo sapiens
gggaagccauagaaauuaa

SEQ ID NO: 668260 - RNA, 19 nt, Homo sapiens
ucacuucucuagacuauga

SEQ ID NO: 668261 - RNA, 19 nt, Homo sapiens
gaaagaaaaucucaaggaa

SEQ ID NO: 668262 - RNA, 19 nt, Homo sapiens
ccaagauacuaaaggcuua

SEQ ID NO: 668263 - RNA, 19 nt, Homo sapiens
aaacucaccugccuucuug

SEQ ID NO: 668264 - RNA, 19 nt, Homo sapiens
ugaggcaucucuaucuaua

SEQ ID NO: 668265 - RNA, 19 nt, Homo sapiens
caacauuacugcacaccaa

SEQ ID NO: 668266 - RNA, 19 nt, Homo sapiens
ggaaagggauaugagagaa

SEQ ID NO: 668267 - RNA, 19 nt, Homo sapiens
gaauaugaaugucuuaagg

SEQ ID NO: 668268 - RNA, 19 nt, Homo sapiens
caauauaccucaaaguaag

SEQ ID NO: 668269 - RNA, 19 nt, Homo sapiens
cuagccagcuuacaguuua

SEQ ID NO: 668270 - RNA, 19 nt, Homo sapiens
gacaucagcuggcaauugu

SEQ ID NO: 668271 - RNA, 19 nt, Homo sapiens
ggagugagcagaaaggaaa

SEQ ID NO: 668272 - RNA, 19 nt, Homo sapiens
caugacgccuggcuaauuu

SEQ ID NO: 668273 - RNA, 19 nt, Homo sapiens
gaacaaugaaggauuugaa

SEQ ID NO: 668274 - RNA, 19 nt, Homo sapiens
gcagacauuucagccauaa

SEQ ID NO: 668275 - RNA, 19 nt, Homo sapiens
gcuuugaguuguugaauga

SEQ ID NO: 668276 - RNA, 19 nt, Homo sapiens
gcuguacucuuaaauuguu

SEQ ID NO: 668277 - RNA, 19 nt, Homo sapiens
gcaagaauaagaaaggaaa

SEQ ID NO: 668278 - RNA, 19 nt, Homo sapiens
gaugaauucucaaacugaa

SEQ ID NO: 668279 - RNA, 19 nt, Homo sapiens
aaggagagaucacagauga

SEQ ID NO: 668280 - RNA, 19 nt, Homo sapiens
ggagacccgugucgacaaa

SEQ ID NO: 668281 - RNA, 19 nt, Homo sapiens
gaacagacccaggaagaug

SEQ ID NO: 668282 - RNA, 19 nt, Homo sapiens
gcacagagaaacaauuuag

SEQ ID NO: 668283 - RNA, 19 nt, Homo sapiens
gaacuauaaugacuguauc

SEQ ID NO: 668284 - RNA, 19 nt, Homo sapiens
ggccagauaucucaggaaa

SEQ ID NO: 668285 - RNA, 19 nt, Homo sapiens
gaaccuugauuugucugua

SEQ ID NO: 668286 - RNA, 19 nt, Homo sapiens
aaagguaccugucaagcaa

SEQ ID NO: 668287 - RNA, 19 nt, Homo sapiens
gaacauugugguagagaaa

SEQ ID NO: 668288 - RNA, 19 nt, Homo sapiens
agaaagauguuccugugaa

SEQ ID NO: 668289 - RNA, 19 nt, Homo sapiens
gaugauccauuccuucugu

SEQ ID NO: 668290 - RNA, 19 nt, Homo sapiens
ggaaagaugagggcaguaa

SEQ ID NO: 668291 - RNA, 19 nt, Homo sapiens
acuaaaggcuuacuauuca

SEQ ID NO: 668292 - RNA, 19 nt, Homo sapiens
gaaagauguuccugugaag

SEQ ID NO: 668293 - RNA, 19 nt, Homo sapiens
gcucauaccuguuaauucc

SEQ ID NO: 668294 - RNA, 19 nt, Homo sapiens
ucagugagcuaaacuucuu

SEQ ID NO: 668295 - RNA, 19 nt, Homo sapiens
gaaauaaucagcuguaucc

SEQ ID NO: 668296 - RNA, 19 nt, Homo sapiens
gaaaugaggcaucucuauc

SEQ ID NO: 668297 - RNA, 19 nt, Homo sapiens
ccaaauacucuuucuucua

SEQ ID NO: 668298 - RNA, 19 nt, Homo sapiens
ggauauauugagagcauua

SEQ ID NO: 668299 - RNA, 19 nt, Homo sapiens
caucuaggcuggagugcaa

SEQ ID NO: 668300 - RNA, 19 nt, Homo sapiens
ucaccugccuucuugcuuu

SEQ ID NO: 668301 - RNA, 19 nt, Homo sapiens
gagguaagaaugagaagaa

SEQ ID NO: 668302 - RNA, 19 nt, Homo sapiens
gaucaaaacuaaccuuuca

SEQ ID NO: 668303 - RNA, 19 nt, Homo sapiens
gaauugcuaggucaugaua

SEQ ID NO: 668304 - RNA, 19 nt, Homo sapiens
gcagaccgcuguggcauca

SEQ ID NO: 668305 - RNA, 19 nt, Homo sapiens
gagcagaaaggaaauagga

SEQ ID NO: 668306 - RNA, 19 nt, Homo sapiens
ggagugcaaugguuugauc

SEQ ID NO: 668307 - RNA, 19 nt, Homo sapiens
ugagguggcuuauucuuca

SEQ ID NO: 668308 - RNA, 19 nt, Homo sapiens
ccacaagaaggaggaauua

SEQ ID NO: 668309 - RNA, 19 nt, Homo sapiens
acacuuaggcugcccauuu

SEQ ID NO: 668310 - RNA, 19 nt, Homo sapiens
ugagagaacuugagagaac

SEQ ID NO: 668311 - RNA, 19 nt, Homo sapiens
ggacaucagcuggcaauug

SEQ ID NO: 668312 - RNA, 19 nt, Homo sapiens
caggaacacagaugaauaa

SEQ ID NO: 668313 - RNA, 19 nt, Homo sapiens
ccauagaaauuaacaggau

SEQ ID NO: 668314 - RNA, 19 nt, Homo sapiens
gcaaugguuugaucucagu

SEQ ID NO: 668315 - RNA, 19 nt, Homo sapiens
cuucuuaccuauuuacuga

SEQ ID NO: 668316 - RNA, 19 nt, Homo sapiens
gaacuuaguguagagcaaa

SEQ ID NO: 668317 - RNA, 19 nt, Homo sapiens
gcagguuuaucacaagaga

SEQ ID NO: 668318 - RNA, 19 nt, Homo sapiens
gaaugucgucucucaacua

SEQ ID NO: 668319 - RNA, 19 nt, Homo sapiens
caacaccucaggaacuuaa

SEQ ID NO: 668320 - RNA, 19 nt, Homo sapiens
gacaacaccucaggaacuu

SEQ ID NO: 668321 - RNA, 19 nt, Homo sapiens
uucaugaacuggaauguaa

SEQ ID NO: 668322 - RNA, 19 nt, Homo sapiens
gaaauaggaccagcuuuua

SEQ ID NO: 668323 - RNA, 19 nt, Homo sapiens
aagcuguacucuuaaauug

SEQ ID NO: 668324 - RNA, 19 nt, Homo sapiens
ggagugggauaaacuuaag

SEQ ID NO: 668325 - RNA, 19 nt, Homo sapiens
caaugaaggauuugaaaga

SEQ ID NO: 668326 - RNA, 19 nt, Homo sapiens
ugugaacaaugaaggauuu

SEQ ID NO: 668327 - RNA, 19 nt, Homo sapiens
gcagaaccuugauuugucu

SEQ ID NO: 668328 - RNA, 19 nt, Homo sapiens
gaacuuuagagcaggagua

SEQ ID NO: 668329 - RNA, 19 nt, Homo sapiens
uaagagauuugagaacuuc

SEQ ID NO: 668330 - RNA, 19 nt, Homo sapiens
gaggugaccaguacagaaa

SEQ ID NO: 668331 - RNA, 19 nt, Homo sapiens
gaacaacucuuggaauuua

SEQ ID NO: 668332 - RNA, 19 nt, Homo sapiens
ggaagagcauucaguagua

SEQ ID NO: 668333 - RNA, 19 nt, Homo sapiens
gaucauagcacaaaguaua

SEQ ID NO: 668334 - RNA, 19 nt, Homo sapiens
ucaaguggcucccaugaua

SEQ ID NO: 668335 - RNA, 19 nt, Homo sapiens
ggacaaagaauacaugaaa

SEQ ID NO: 668336 - RNA, 19 nt, Homo sapiens
gggaagaccuggcuuguga

SEQ ID NO: 668337 - RNA, 19 nt, Homo sapiens
ggaugaagaugaacaaguu

SEQ ID NO: 668338 - RNA, 19 nt, Homo sapiens
ggagaaacuucccaauaaa

SEQ ID NO: 668339 - RNA, 19 nt, Homo sapiens
gaaacaggcugaagauaca

SEQ ID NO: 668340 - RNA, 19 nt, Homo sapiens
ggaagaaagugcccguaaa

SEQ ID NO: 668341 - RNA, 19 nt, Homo sapiens
gaagagauuugaagaaguc

SEQ ID NO: 668342 - RNA, 19 nt, Homo sapiens
cagcauauguuucuucauu

SEQ ID NO: 668343 - RNA, 19 nt, Homo sapiens
gcacaaauguuaucuaagc

SEQ ID NO: 668344 - RNA, 19 nt, Homo sapiens
gcauuugucuacuugcuua

SEQ ID NO: 668345 - RNA, 19 nt, Homo sapiens
caaaggaaguggucauuca

SEQ ID NO: 668346 - RNA, 19 nt, Homo sapiens
ggaaagagcagggaccaua

SEQ ID NO: 668347 - RNA, 19 nt, Homo sapiens
caaugucagugcuuuauuu

SEQ ID NO: 668348 - RNA, 19 nt, Homo sapiens
gauugaaccugaucaguau

SEQ ID NO: 668349 - RNA, 19 nt, Homo sapiens
acaauuaacuggugauuuc

SEQ ID NO: 668350 - RNA, 19 nt, Homo sapiens
ccacagaguucuccaagga

SEQ ID NO: 668351 - RNA, 19 nt, Homo sapiens
caaagccgcuacaucauga

SEQ ID NO: 668352 - RNA, 19 nt, Homo sapiens
gaaagaacaccgagaacuu

SEQ ID NO: 668353 - RNA, 19 nt, Homo sapiens
caagauuacugccguauuc

SEQ ID NO: 668354 - RNA, 19 nt, Homo sapiens
ggacagaugaugacauuga

SEQ ID NO: 668355 - RNA, 19 nt, Homo sapiens
gcagggacauugugagaga

SEQ ID NO: 668356 - RNA, 19 nt, Homo sapiens
gaauuggcauuagggaaua

SEQ ID NO: 668357 - RNA, 19 nt, Homo sapiens
gaagugcccuauccuggaa

SEQ ID NO: 668358 - RNA, 19 nt, Homo sapiens
gaucagcuuuccaaacuug

SEQ ID NO: 668359 - RNA, 19 nt, Homo sapiens
cagaaaccauacaaugaua

SEQ ID NO: 668360 - RNA, 19 nt, Homo sapiens
gcagcagucuuucugauau

SEQ ID NO: 668361 - RNA, 19 nt, Homo sapiens
gagaaaagcuagccauuga

SEQ ID NO: 668362 - RNA, 19 nt, Homo sapiens
uaagaauccuggugacaaa

SEQ ID NO: 668363 - RNA, 19 nt, Homo sapiens
gcacugcacuguagggaau

SEQ ID NO: 668364 - RNA, 19 nt, Homo sapiens
ggaccauaguguuaaauga

SEQ ID NO: 668365 - RNA, 19 nt, Homo sapiens
uagacgggcuggucaauuu

SEQ ID NO: 668366 - RNA, 19 nt, Homo sapiens
gagaagcuccuuugccuuu

SEQ ID NO: 668367 - RNA, 19 nt, Homo sapiens
gcauagcccagcaagauua

SEQ ID NO: 668368 - RNA, 19 nt, Homo sapiens
caagacagccucccuuuau

SEQ ID NO: 668369 - RNA, 19 nt, Homo sapiens
ucagacagguggucauaaa

SEQ ID NO: 668370 - RNA, 19 nt, Homo sapiens
guaauguucucaauaguca

SEQ ID NO: 668371 - RNA, 19 nt, Homo sapiens
gaacauaggacugcuaauc

SEQ ID NO: 668372 - RNA, 19 nt, Homo sapiens
gaaacucuuuguucagaug

SEQ ID NO: 668373 - RNA, 19 nt, Homo sapiens
gaagacguccugagcauug

SEQ ID NO: 668374 - RNA, 19 nt, Homo sapiens
ccagaaacauggcaaaaua

SEQ ID NO: 668375 - RNA, 19 nt, Homo sapiens
gaaacaaaccagcugaaga

SEQ ID NO: 668376 - RNA, 19 nt, Homo sapiens
ggaucaauauucacuaugu

SEQ ID NO: 668377 - RNA, 19 nt, Homo sapiens
agacagaaaucuagcucua

SEQ ID NO: 668378 - RNA, 19 nt, Homo sapiens
ggccgaggcuuauaugcua

SEQ ID NO: 668379 - RNA, 19 nt, Homo sapiens
caaaccagcugaagaggau

SEQ ID NO: 668380 - RNA, 19 nt, Homo sapiens
gaagauugaugacguuaac

SEQ ID NO: 668381 - RNA, 19 nt, Homo sapiens
ucagaaagguuaacaaugc

SEQ ID NO: 668382 - RNA, 19 nt, Homo sapiens
caaacaaugucagugcuuu

SEQ ID NO: 668383 - RNA, 19 nt, Homo sapiens
gcucacagcugcuauuaac

SEQ ID NO: 668384 - RNA, 19 nt, Homo sapiens
gcaguaccuuuccaauuug

SEQ ID NO: 668385 - RNA, 19 nt, Homo sapiens
ggaaaugacucaaaaguag

SEQ ID NO: 668386 - RNA, 19 nt, Homo sapiens
gcagacagaauacaacuga

SEQ ID NO: 668387 - RNA, 19 nt, Homo sapiens
gcagucacaucaucgcauu

SEQ ID NO: 668388 - RNA, 19 nt, Homo sapiens
gauacuacuuguaccugua

SEQ ID NO: 668389 - RNA, 19 nt, Homo sapiens
ggauagcauugcagugaaa

SEQ ID NO: 668390 - RNA, 19 nt, Homo sapiens
ggaguaaucaaacaaagaa

SEQ ID NO: 668391 - RNA, 19 nt, Homo sapiens
gaaaggagagcacaagaag

SEQ ID NO: 668392 - RNA, 19 nt, Homo sapiens
gaaagugcccguaaaggau

SEQ ID NO: 668393 - RNA, 19 nt, Homo sapiens
agcaguaccuuuccaauuu

SEQ ID NO: 668394 - RNA, 19 nt, Homo sapiens
gcucagcacuguggaaguu

SEQ ID NO: 668395 - RNA, 19 nt, Homo sapiens
cagcaaagccgcuacauca

SEQ ID NO: 668396 - RNA, 19 nt, Homo sapiens
cuggaaguaugaaauguua

SEQ ID NO: 668397 - RNA, 19 nt, Homo sapiens
caacguggcccuucagaga

SEQ ID NO: 668398 - RNA, 19 nt, Homo sapiens
gaucaagugcuaaggguuu

SEQ ID NO: 668399 - RNA, 19 nt, Homo sapiens
gaggaaggagagauuguua

SEQ ID NO: 668400 - RNA, 19 nt, Homo sapiens
gaugucaagugcagaaugu

SEQ ID NO: 668401 - RNA, 19 nt, Homo sapiens
gugguacuguggauaauuu

SEQ ID NO: 668402 - RNA, 19 nt, Homo sapiens
gugccaaccugaagagauu

SEQ ID NO: 668403 - RNA, 19 nt, Homo sapiens
gcauauagaaagacagaaa

SEQ ID NO: 668404 - RNA, 19 nt, Homo sapiens
gcagguuagucaccaaaga

SEQ ID NO: 668405 - RNA, 19 nt, Homo sapiens
gcaguagccuaacgucugu

SEQ ID NO: 668406 - RNA, 19 nt, Homo sapiens
gaagaaagugcccguaaag

SEQ ID NO: 668407 - RNA, 19 nt, Homo sapiens
cauuaucucugcaguguga

SEQ ID NO: 668408 - RNA, 19 nt, Homo sapiens
gacauuaucucugcagugu

SEQ ID NO: 668409 - RNA, 19 nt, Homo sapiens
cagaaacucuuuguucaga

SEQ ID NO: 668410 - RNA, 19 nt, Homo sapiens
ccacagaaaccauacaaug

SEQ ID NO: 668411 - RNA, 19 nt, Homo sapiens
cgagaacucugugcuguga

SEQ ID NO: 668412 - RNA, 19 nt, Homo sapiens
cgaggaggaugaagaugaa

SEQ ID NO: 668413 - RNA, 19 nt, Homo sapiens
cauugaaccuacugaauau

SEQ ID NO: 668414 - RNA, 19 nt, Homo sapiens
caaacuugcagacagaaua

SEQ ID NO: 668415 - RNA, 19 nt, Homo sapiens
gcaaagccgcuacaucaug

SEQ ID NO: 668416 - RNA, 19 nt, Homo sapiens
guaguauuauuguggguaa

SEQ ID NO: 668417 - RNA, 19 nt, Homo sapiens
gauccaacauucauagaag

SEQ ID NO: 668418 - RNA, 19 nt, Homo sapiens
acaaguugcacaaauguua

SEQ ID NO: 668419 - RNA, 19 nt, Homo sapiens
gauguguccugcuccauug

SEQ ID NO: 668420 - RNA, 19 nt, Homo sapiens
ggcauacucacuuugauua

SEQ ID NO: 668421 - RNA, 19 nt, Homo sapiens
cagaucagcuuuccaaacu

SEQ ID NO: 668422 - RNA, 19 nt, Homo sapiens
gcacaucccaacugcauug

SEQ ID NO: 668423 - RNA, 19 nt, Homo sapiens
caccuaaggcuguugaaua

SEQ ID NO: 668424 - RNA, 19 nt, Homo sapiens
gaagagcauucaguaguag

SEQ ID NO: 668425 - RNA, 19 nt, Homo sapiens
ugaagaugguagaaaugua

SEQ ID NO: 668426 - RNA, 19 nt, Homo sapiens
acaaguuucugcuguuuga

SEQ ID NO: 668427 - RNA, 19 nt, Homo sapiens
cagcaggccugugaacaaa

SEQ ID NO: 668428 - RNA, 19 nt, Homo sapiens
gcuguggcaucaaguacua

SEQ ID NO: 668429 - RNA, 19 nt, Homo sapiens
uggaagguauuaucugaaa

SEQ ID NO: 668430 - RNA, 19 nt, Homo sapiens
guaaggacacuacagcaaa

SEQ ID NO: 668431 - RNA, 19 nt, Homo sapiens
gaagagagauuuaagacuu

SEQ ID NO: 668432 - RNA, 19 nt, Homo sapiens
guacaucagucucuucaua

SEQ ID NO: 668433 - RNA, 19 nt, Homo sapiens
gcacaggcauugaaacuga

SEQ ID NO: 668434 - RNA, 19 nt, Homo sapiens
gcucagugcuauuuauaua

SEQ ID NO: 668435 - RNA, 19 nt, Homo sapiens
caagucauauugcuucuaa

SEQ ID NO: 668436 - RNA, 19 nt, Homo sapiens
gggaagaaaugagagauaa

SEQ ID NO: 668437 - RNA, 19 nt, Homo sapiens
ggaaguuggagaagaauua

SEQ ID NO: 668438 - RNA, 19 nt, Homo sapiens
gaaggcaguuguaaagaau

SEQ ID NO: 668439 - RNA, 19 nt, Homo sapiens
guaagaaggaaaccaaaua

SEQ ID NO: 668440 - RNA, 19 nt, Homo sapiens
gcaagaaagcguaagauug

SEQ ID NO: 668441 - RNA, 19 nt, Homo sapiens
gaacuaaugaugacuaauc

SEQ ID NO: 668442 - RNA, 19 nt, Homo sapiens
ucucagagcuuuacgaugu

SEQ ID NO: 668443 - RNA, 19 nt, Homo sapiens
ggaaagauaugaugaugcu

SEQ ID NO: 668444 - RNA, 19 nt, Homo sapiens
uaacaggcaugagauuuga

SEQ ID NO: 668445 - RNA, 19 nt, Homo sapiens
gcaguaugcugaaguuaag

SEQ ID NO: 668446 - RNA, 19 nt, Homo sapiens
gcgaaggucucagagcuuu

SEQ ID NO: 668447 - RNA, 19 nt, Homo sapiens
gaaguaagaaggaaaccaa

SEQ ID NO: 668448 - RNA, 19 nt, Homo sapiens
gacauuagauuucacaacu

SEQ ID NO: 668449 - RNA, 19 nt, Homo sapiens
gaaggaaaccaaauauucu

SEQ ID NO: 668450 - RNA, 19 nt, Homo sapiens
gaacaacagaaauaugaga

SEQ ID NO: 668451 - RNA, 19 nt, Homo sapiens
cuuauuggccuguaacuua

SEQ ID NO: 668452 - RNA, 19 nt, Homo sapiens
uuucacaacugcacaauug

SEQ ID NO: 668453 - RNA, 19 nt, Homo sapiens
gagcuuuguuuggacuuua

SEQ ID NO: 668454 - RNA, 19 nt, Homo sapiens
gcagaacuuuacaucaaug

SEQ ID NO: 668455 - RNA, 19 nt, Homo sapiens
agaaggcaguuguaaagaa

SEQ ID NO: 668456 - RNA, 19 nt, Homo sapiens
gcagaucacccagucuuaa

SEQ ID NO: 668457 - RNA, 19 nt, Homo sapiens
gcaugaacuugcagaacuu

SEQ ID NO: 668458 - RNA, 19 nt, Homo sapiens
uaacacugcugcaagaaag

SEQ ID NO: 668459 - RNA, 19 nt, Homo sapiens
gaaauagugagcaaauugu

SEQ ID NO: 668460 - RNA, 19 nt, Homo sapiens
uaugagagcuuuguuugga

SEQ ID NO: 668461 - RNA, 19 nt, Homo sapiens
acagaaauaugagagcuuu

SEQ ID NO: 668462 - RNA, 19 nt, Homo sapiens
caagaagccuggcaugaac

SEQ ID NO: 668463 - RNA, 19 nt, Homo sapiens
gcugggagaugauauuugg

SEQ ID NO: 668464 - RNA, 19 nt, Homo sapiens
gaaugaguaucuggaacaa

SEQ ID NO: 668465 - RNA, 19 nt, Homo sapiens
caagaaagcguaagauugc

SEQ ID NO: 668466 - RNA, 19 nt, Homo sapiens
gggaugacuuggcauuguu

SEQ ID NO: 668467 - RNA, 19 nt, Homo sapiens
caagaaauagugagcaaau

SEQ ID NO: 668468 - RNA, 19 nt, Homo sapiens
uaagaaggcaguuguaaag

SEQ ID NO: 668469 - RNA, 19 nt, Homo sapiens
uugcagaacuuuacaucaa

SEQ ID NO: 668470 - RNA, 19 nt, Homo sapiens
uugaagccauggaaagaua

SEQ ID NO: 668471 - RNA, 19 nt, Homo sapiens
ucacagagucaagcgauua

SEQ ID NO: 668472 - RNA, 19 nt, Homo sapiens
cuucuaagcugggagauga

SEQ ID NO: 668473 - RNA, 19 nt, Homo sapiens
gaaguuggagaagaauuaa

SEQ ID NO: 668474 - RNA, 19 nt, Homo sapiens
ccaagaagccuggcaugaa

SEQ ID NO: 668475 - RNA, 19 nt, Homo sapiens
augaguaucuggaacaauu

SEQ ID NO: 668476 - RNA, 19 nt, Homo sapiens
ggaagaaaugagagauaaa

SEQ ID NO: 668477 - RNA, 19 nt, Homo sapiens
agaaggaaaccaaauauuc

SEQ ID NO: 668478 - RNA, 19 nt, Homo sapiens
uugggcagcuagucaaaua

SEQ ID NO: 668479 - RNA, 19 nt, Homo sapiens
ggugaugauugcagcacua

SEQ ID NO: 668480 - RNA, 19 nt, Homo sapiens
gaaauaugagagcuuuguu

SEQ ID NO: 668481 - RNA, 19 nt, Homo sapiens
caaugaacaugacuaugca

SEQ ID NO: 668482 - RNA, 19 nt, Homo sapiens
gcgauuaacaggcaugaga

SEQ ID NO: 668483 - RNA, 19 nt, Homo sapiens
agaaauagugagcaaauug

SEQ ID NO: 668484 - RNA, 19 nt, Homo sapiens
gaacaugacuaugcaaaag

SEQ ID NO: 668485 - RNA, 19 nt, Homo sapiens
gaaacugaacaacagaaau

SEQ ID NO: 668486 - RNA, 19 nt, Homo sapiens
ggcaugaacuugcagaacu

SEQ ID NO: 668487 - RNA, 19 nt, Homo sapiens
gaaaauggagagaagaaaa

SEQ ID NO: 668488 - RNA, 19 nt, Homo sapiens
gaagauggcgaaggucuca

SEQ ID NO: 668489 - RNA, 19 nt, Homo sapiens
acaagaagauccaacuaac

SEQ ID NO: 668490 - RNA, 19 nt, Homo sapiens
gggcagcuagucaaauaaa

SEQ ID NO: 668491 - RNA, 19 nt, Homo sapiens
gaggaacuaaugaugacua

SEQ ID NO: 668492 - RNA, 19 nt, Homo sapiens
uucgggagcugaaugagua

SEQ ID NO: 668493 - RNA, 19 nt, Homo sapiens
uguggaaguuggagaagaa

SEQ ID NO: 668494 - RNA, 19 nt, Homo sapiens
gauaugaugaugcuauaca

SEQ ID NO: 668495 - RNA, 19 nt, Homo sapiens
caacugcacaauugaacuu

SEQ ID NO: 668496 - RNA, 19 nt, Homo sapiens
cgaugucacuugggaagaa

SEQ ID NO: 668497 - RNA, 19 nt, Homo sapiens
gcauugaaacugaacaaca

SEQ ID NO: 668498 - RNA, 19 nt, Homo sapiens
gaacuuuacaucaaugaac

SEQ ID NO: 668499 - RNA, 19 nt, Homo sapiens
uacaagaagauccaacuaa

SEQ ID NO: 668500 - RNA, 19 nt, Homo sapiens
cugaacaacagaaauauga

SEQ ID NO: 668501 - RNA, 19 nt, Homo sapiens
gauugcagcacuagacuau

SEQ ID NO: 668502 - RNA, 19 nt, Homo sapiens
cugcacaauugaacuuauu

SEQ ID NO: 668503 - RNA, 19 nt, Homo sapiens
gaugucacuugggaagaaa

SEQ ID NO: 668504 - RNA, 19 nt, Homo sapiens
cauauugcuucuaauccaa

SEQ ID NO: 668505 - RNA, 19 nt, Homo sapiens
caagaagauccaacuaaca

SEQ ID NO: 668506 - RNA, 19 nt, Homo sapiens
guuaagaaggcaguuguaa

SEQ ID NO: 668507 - RNA, 19 nt, Homo sapiens
gagcaaauuguggaaguug

SEQ ID NO: 668508 - RNA, 19 nt, Homo sapiens
gaacuugcagaacuuuaca

SEQ ID NO: 668509 - RNA, 19 nt, Homo sapiens
ugaugaugcuauacagcua

SEQ ID NO: 668510 - RNA, 19 nt, Homo sapiens
ugaacuuauuggccuguaa

SEQ ID NO: 668511 - RNA, 19 nt, Homo sapiens
gcagcuagucaaauaaaca

SEQ ID NO: 668512 - RNA, 19 nt, Homo sapiens
cauugaaacugaacaacag

SEQ ID NO: 668513 - RNA, 19 nt, Homo sapiens
ucaaugaacaugacuaugc

SEQ ID NO: 668514 - RNA, 19 nt, Homo sapiens
gaaauccauggaagagaga

SEQ ID NO: 668515 - RNA, 19 nt, Homo sapiens
uuaagaaggcaguuguaaa

SEQ ID NO: 668516 - RNA, 19 nt, Homo sapiens
uaaacagagcuuaucaguu

SEQ ID NO: 668517 - RNA, 19 nt, Homo sapiens
gcaaauuguggaaguugga

SEQ ID NO: 668518 - RNA, 19 nt, Homo sapiens
gagaagaaaacucaagaaa

SEQ ID NO: 668519 - RNA, 19 nt, Homo sapiens
uuauuggccuguaacuuau

SEQ ID NO: 668520 - RNA, 19 nt, Homo sapiens
ggaaaccaaauauucucuu

SEQ ID NO: 668521 - RNA, 19 nt, Homo sapiens
caacaugaaauaugcuagu

SEQ ID NO: 668522 - RNA, 19 nt, Homo sapiens
guaagauugccauucgaaa

SEQ ID NO: 668523 - RNA, 19 nt, Homo sapiens
gauuaacaggcaugagauu

SEQ ID NO: 668524 - RNA, 19 nt, Homo sapiens
uuggaaacauugcagauca

SEQ ID NO: 668525 - RNA, 19 nt, Homo sapiens
ucgaagacauguuggaaac

SEQ ID NO: 668526 - RNA, 19 nt, Homo sapiens
acacaaccacuuauacugu

SEQ ID NO: 668527 - RNA, 19 nt, Homo sapiens
caucaaugaacaugacuau

SEQ ID NO: 668528 - RNA, 19 nt, Homo sapiens
gugagcaaauuguggaagu

SEQ ID NO: 668529 - RNA, 19 nt, Homo sapiens
ucacaacugcacaauugaa

SEQ ID NO: 668530 - RNA, 19 nt, Homo sapiens
gacaacaugaaauaugcua

SEQ ID NO: 668531 - RNA, 19 nt, Homo sapiens
guagaaagcugccuuauag

SEQ ID NO: 668532 - RNA, 19 nt, Homo sapiens
gaaaugaucacaugacuuu

SEQ ID NO: 668533 - RNA, 19 nt, Homo sapiens
gagguuaacugacaucuuu

SEQ ID NO: 668534 - RNA, 19 nt, Homo sapiens
gccgaaaccucaugaguua

SEQ ID NO: 668535 - RNA, 19 nt, Homo sapiens
gagcaaugauacaggauua

SEQ ID NO: 668536 - RNA, 19 nt, Homo sapiens
ggaacucccugauucuaua

SEQ ID NO: 668537 - RNA, 19 nt, Homo sapiens
gaacaucucucuuugaacu

SEQ ID NO: 668538 - RNA, 19 nt, Homo sapiens
ggaaauugcccucuuauga

SEQ ID NO: 668539 - RNA, 19 nt, Homo sapiens
ccagaaagcagucaaguua

SEQ ID NO: 668540 - RNA, 19 nt, Homo sapiens
cagauagucucuuagguua

SEQ ID NO: 668541 - RNA, 19 nt, Homo sapiens
ccagaauucuuaacagaua

SEQ ID NO: 668542 - RNA, 19 nt, Homo sapiens
aggaauaucuugcucuuua

SEQ ID NO: 668543 - RNA, 19 nt, Homo sapiens
gcacgugacacuuaaauaa

SEQ ID NO: 668544 - RNA, 19 nt, Homo sapiens
aagcaaggauucucacuua

SEQ ID NO: 668545 - RNA, 19 nt, Homo sapiens
gaagauacauggaaauugc

SEQ ID NO: 668546 - RNA, 19 nt, Homo sapiens
ugucugagcuuccaucuuu

SEQ ID NO: 668547 - RNA, 19 nt, Homo sapiens
guucacagcuuuauacuuc

SEQ ID NO: 668548 - RNA, 19 nt, Homo sapiens
ggaaacgcauucuaguaaa

SEQ ID NO: 668549 - RNA, 19 nt, Homo sapiens
caaggauucucacuuauga

SEQ ID NO: 668550 - RNA, 19 nt, Homo sapiens
gaaaauaucccucuuaaug

SEQ ID NO: 668551 - RNA, 19 nt, Homo sapiens
guuaacagcugugauauau

SEQ ID NO: 668552 - RNA, 19 nt, Homo sapiens
gaauagggaucucaugcuu

SEQ ID NO: 668553 - RNA, 19 nt, Homo sapiens
gaucaacacaguuucauuu

SEQ ID NO: 668554 - RNA, 19 nt, Homo sapiens
gagcauacuuguaccuuug

SEQ ID NO: 668555 - RNA, 19 nt, Homo sapiens
gaaaucuuauuccuucuug

SEQ ID NO: 668556 - RNA, 19 nt, Homo sapiens
ggaauaucuugcucuuuaa

SEQ ID NO: 668557 - RNA, 19 nt, Homo sapiens
cacaaaugcuucucuguaa

SEQ ID NO: 668558 - RNA, 19 nt, Homo sapiens
gaacuuaccugaggaacuc

SEQ ID NO: 668559 - RNA, 19 nt, Homo sapiens
gauagucucuuagguuauu

SEQ ID NO: 668560 - RNA, 19 nt, Homo sapiens
gcuagcuacuucuuuguua

SEQ ID NO: 668561 - RNA, 19 nt, Homo sapiens
cagaacaucucucuuugaa

SEQ ID NO: 668562 - RNA, 19 nt, Homo sapiens
guuagaggauugagaauga

SEQ ID NO: 668563 - RNA, 19 nt, Homo sapiens
gaauaccucuugaaaucuu

SEQ ID NO: 668564 - RNA, 19 nt, Homo sapiens
ggacuaugauaaugaguug

SEQ ID NO: 668565 - RNA, 19 nt, Homo sapiens
agaaagaaaugaucacaug

SEQ ID NO: 668566 - RNA, 19 nt, Homo sapiens
ccacauaucuccucuacca

SEQ ID NO: 668567 - RNA, 19 nt, Homo sapiens
gcaaggcagaggaauaaua

SEQ ID NO: 668568 - RNA, 19 nt, Homo sapiens
gaaagcugccuuauaguug

SEQ ID NO: 668569 - RNA, 19 nt, Homo sapiens
gcauaauucucucauaaca

SEQ ID NO: 668570 - RNA, 19 nt, Homo sapiens
aauaagcacugucuaaguu

SEQ ID NO: 668571 - RNA, 19 nt, Homo sapiens
cuuaacagauagucucuua

SEQ ID NO: 668572 - RNA, 19 nt, Homo sapiens
gcauccagcuccuauucua

SEQ ID NO: 668573 - RNA, 19 nt, Homo sapiens
cauggaaauugcccucuua

SEQ ID NO: 668574 - RNA, 19 nt, Homo sapiens
uaagcacugucuaaguuua

SEQ ID NO: 668575 - RNA, 19 nt, Homo sapiens
ccagaugguugguuugauu

SEQ ID NO: 668576 - RNA, 19 nt, Homo sapiens
gauaggagauguggaagau

SEQ ID NO: 668577 - RNA, 19 nt, Homo sapiens
gcagaacuguuguagaaag

SEQ ID NO: 668578 - RNA, 19 nt, Homo sapiens
gauuugaucugcucucugu

SEQ ID NO: 668579 - RNA, 19 nt, Homo sapiens
ggauacacuugcaauaaug

SEQ ID NO: 668580 - RNA, 19 nt, Homo sapiens
gcaggaacuuuagaagaaa

SEQ ID NO: 668581 - RNA, 19 nt, Homo sapiens
agacauuccuuucugcuuu

SEQ ID NO: 668582 - RNA, 19 nt, Homo sapiens
gagccaguuucaaagguua

SEQ ID NO: 668583 - RNA, 19 nt, Homo sapiens
gcacgguucucaccuguca

SEQ ID NO: 668584 - RNA, 19 nt, Homo sapiens
gaaccuaagucucuucacu

SEQ ID NO: 668585 - RNA, 19 nt, Homo sapiens
uugcagaacuguuguagaa

SEQ ID NO: 668586 - RNA, 19 nt, Homo sapiens
ugaguggacuucauccuuu

SEQ ID NO: 668587 - RNA, 19 nt, Homo sapiens
gcccaugguucauuuggua

SEQ ID NO: 668588 - RNA, 19 nt, Homo sapiens
ucaauaaaaugcccuguua

SEQ ID NO: 668589 - RNA, 19 nt, Homo sapiens
gaguauugcuaugucuuua

SEQ ID NO: 668590 - RNA, 19 nt, Homo sapiens
ggaaucccuucuagaauca

SEQ ID NO: 668591 - RNA, 19 nt, Homo sapiens
gaaagaaaugaucacauga

SEQ ID NO: 668592 - RNA, 19 nt, Homo sapiens
cauuugguaucccuauuua

SEQ ID NO: 668593 - RNA, 19 nt, Homo sapiens
agugagaccuguaaauauu

SEQ ID NO: 668594 - RNA, 19 nt, Homo sapiens
aagaagaccuagaaauguu

SEQ ID NO: 668595 - RNA, 19 nt, Homo sapiens
gggccuuucucuuugauaa

SEQ ID NO: 668596 - RNA, 19 nt, Homo sapiens
ggauugauguucacagcuu

SEQ ID NO: 668597 - RNA, 19 nt, Homo sapiens
gcaaucguguaccugauga

SEQ ID NO: 668598 - RNA, 19 nt, Homo sapiens
cuagggaacuacucauuga

SEQ ID NO: 668599 - RNA, 19 nt, Homo sapiens
gaaauugcuuggccagucu

SEQ ID NO: 668600 - RNA, 19 nt, Homo sapiens
gugagaagauacauggaaa

SEQ ID NO: 668601 - RNA, 19 nt, Homo sapiens
gaagaccuagaaauguuua

SEQ ID NO: 668602 - RNA, 19 nt, Homo sapiens
caacaugagacauuccuuu

SEQ ID NO: 668603 - RNA, 19 nt, Homo sapiens
cgaggaaucccuucuagaa

SEQ ID NO: 668604 - RNA, 19 nt, Homo sapiens
guucaguucuuugagauuu

SEQ ID NO: 668605 - RNA, 19 nt, Homo sapiens
guaccuggcuagcuacuuc

SEQ ID NO: 668606 - RNA, 19 nt, Homo sapiens
gagaagauacauggaaauu

SEQ ID NO: 668607 - RNA, 19 nt, Homo sapiens
gguacucccugcccuuaaa

SEQ ID NO: 668608 - RNA, 19 nt, Homo sapiens
ucacagggcucaggguuau

SEQ ID NO: 668609 - RNA, 19 nt, Homo sapiens
ugacaaagcauaauucucu

SEQ ID NO: 668610 - RNA, 19 nt, Homo sapiens
gagggugagugaguuagua

SEQ ID NO: 668611 - RNA, 19 nt, Homo sapiens
gaaaauagagcaucucaga

SEQ ID NO: 668612 - RNA, 19 nt, Homo sapiens
gaaauaagcacugucuaag

SEQ ID NO: 668613 - RNA, 19 nt, Homo sapiens
gaaggaggaaguugugcua

SEQ ID NO: 668614 - RNA, 19 nt, Homo sapiens
gagagaacaauaccuaaga

SEQ ID NO: 668615 - RNA, 19 nt, Homo sapiens
ucuaagagguuaacugaca

SEQ ID NO: 668616 - RNA, 19 nt, Homo sapiens
ggucuaagagguuaacuga

SEQ ID NO: 668617 - RNA, 19 nt, Homo sapiens
ucagugagaccuguaaaua

SEQ ID NO: 668618 - RNA, 19 nt, Homo sapiens
gcacacacgagcauacuug

SEQ ID NO: 668619 - RNA, 19 nt, Homo sapiens
agaaauaagcacugucuaa

SEQ ID NO: 668620 - RNA, 19 nt, Homo sapiens
gaacucacacugauacaca

SEQ ID NO: 668621 - RNA, 19 nt, Homo sapiens
gcaaggauucucacuuaug

SEQ ID NO: 668622 - RNA, 19 nt, Homo sapiens
uaaggaauaucuugcucuu

SEQ ID NO: 668623 - RNA, 19 nt, Homo sapiens
gagcaggaacuuuagaaga

SEQ ID NO: 668624 - RNA, 19 nt, Homo sapiens
gaauugccauggaaggaau

SEQ ID NO: 668625 - RNA, 19 nt, Homo sapiens
caacacaguuucauuugac

SEQ ID NO: 668626 - RNA, 19 nt, Homo sapiens
uuacggaaauacacaaaug

SEQ ID NO: 668627 - RNA, 19 nt, Homo sapiens
caaggcagaggaauaauau

SEQ ID NO: 668628 - RNA, 19 nt, Homo sapiens
ugagugaguuaguacauau

SEQ ID NO: 668629 - RNA, 19 nt, Homo sapiens
gccagaacaucucucuuug

SEQ ID NO: 668630 - RNA, 19 nt, Homo sapiens
guuauggucuaagagguua

SEQ ID NO: 668631 - RNA, 19 nt, Homo sapiens
gaaaucccgucucuacuaa

SEQ ID NO: 668632 - RNA, 19 nt, Homo sapiens
gcaauucaguucucucauu

SEQ ID NO: 668633 - RNA, 19 nt, Homo sapiens
gaacuuggaugauaauaac

SEQ ID NO: 668634 - RNA, 19 nt, Homo sapiens
caaacaaugucacgaggua

SEQ ID NO: 668635 - RNA, 19 nt, Homo sapiens
gguagaacuuggaugauaa

SEQ ID NO: 668636 - RNA, 19 nt, Homo sapiens
gagaagaucagcaagauga

SEQ ID NO: 668637 - RNA, 19 nt, Homo sapiens
gcucagagucccuguauuu

SEQ ID NO: 668638 - RNA, 19 nt, Homo sapiens
ucacuuaccuggagucaga

SEQ ID NO: 668639 - RNA, 19 nt, Homo sapiens
gagccacuguagaucauua

SEQ ID NO: 668640 - RNA, 19 nt, Homo sapiens
caauucaguucucucauuu

SEQ ID NO: 668641 - RNA, 19 nt, Homo sapiens
gagcaugugucgggaaauu

SEQ ID NO: 668642 - RNA, 19 nt, Homo sapiens
cagcaggccuugucucuga

SEQ ID NO: 668643 - RNA, 19 nt, Homo sapiens
gaacaugaccgccaaguac

SEQ ID NO: 668644 - RNA, 19 nt, Homo sapiens
gccugaagcuugccaauga

SEQ ID NO: 668645 - RNA, 19 nt, Homo sapiens
gcacagagaagccauguca

SEQ ID NO: 668646 - RNA, 19 nt, Homo sapiens
ugaagaugcuggacaguga

SEQ ID NO: 668647 - RNA, 19 nt, Homo sapiens
ggaggacgcuggacaaggu

SEQ ID NO: 668648 - RNA, 19 nt, Homo sapiens
ccacagccauagacaacua

SEQ ID NO: 668649 - RNA, 19 nt, Homo sapiens
ggagucagagaacuaguua

SEQ ID NO: 668650 - RNA, 19 nt, Homo sapiens
gaaagccagucuagacaag

SEQ ID NO: 668651 - RNA, 19 nt, Homo sapiens
gagcuucggucugcuguga

SEQ ID NO: 668652 - RNA, 19 nt, Homo sapiens
agacggcgcugucagagaa

SEQ ID NO: 668653 - RNA, 19 nt, Homo sapiens
ggagaugugucaggcacua

SEQ ID NO: 668654 - RNA, 19 nt, Homo sapiens
ggacagcugugggcaagga

SEQ ID NO: 668655 - RNA, 19 nt, Homo sapiens
ugaacgcucugacgucuga

SEQ ID NO: 668656 - RNA, 19 nt, Homo sapiens
gcaagaugaaggccaauga

SEQ ID NO: 668657 - RNA, 19 nt, Homo sapiens
gcagagagcgagcgcauca

SEQ ID NO: 668658 - RNA, 19 nt, Homo sapiens
gagcauguuauucuuguuu

SEQ ID NO: 668659 - RNA, 19 nt, Homo sapiens
cauuaaaguuccuccuuga

SEQ ID NO: 668660 - RNA, 19 nt, Homo sapiens
gcgagcaggugcagacguu

SEQ ID NO: 668661 - RNA, 19 nt, Homo sapiens
ggacaugcgugggcgcuau

SEQ ID NO: 668662 - RNA, 19 nt, Homo sapiens
ggagaaagccagucuagac

SEQ ID NO: 668663 - RNA, 19 nt, Homo sapiens
ucacacaguuagcagaaga

SEQ ID NO: 668664 - RNA, 19 nt, Homo sapiens
gcacaugugaaguuuguau

SEQ ID NO: 668665 - RNA, 19 nt, Homo sapiens
ugugaaguuuguauccuua

SEQ ID NO: 668666 - RNA, 19 nt, Homo sapiens
cagcgggacuccugucuuc

SEQ ID NO: 668667 - RNA, 19 nt, Homo sapiens
agaaaucccgucucuacua

SEQ ID NO: 668668 - RNA, 19 nt, Homo sapiens
ugaccaacguggagaaauc

SEQ ID NO: 668669 - RNA, 19 nt, Homo sapiens
cagaagagccaggauuuga

SEQ ID NO: 668670 - RNA, 19 nt, Homo sapiens
aaagguagaacuuggauga

SEQ ID NO: 668671 - RNA, 19 nt, Homo sapiens
gaucucuccgccuuaguua

SEQ ID NO: 668672 - RNA, 19 nt, Homo sapiens
gcuggaggcugagaaggaa

SEQ ID NO: 668673 - RNA, 19 nt, Homo sapiens
gcaggagaauugcuugaac

SEQ ID NO: 668674 - RNA, 19 nt, Homo sapiens
ccaggacccuucagaugug

SEQ ID NO: 668675 - RNA, 19 nt, Homo sapiens
uuaagcacaugugaaguuu

SEQ ID NO: 668676 - RNA, 19 nt, Homo sapiens
agguagaacuuggaugaua

SEQ ID NO: 668677 - RNA, 19 nt, Homo sapiens
gaugaaggccaaugagaca

SEQ ID NO: 668678 - RNA, 19 nt, Homo sapiens
gagaaagccagucuagaca

SEQ ID NO: 668679 - RNA, 19 nt, Homo sapiens
uagaggagcugcgguugga

SEQ ID NO: 668680 - RNA, 19 nt, Homo sapiens
aagcacaugugaaguuugu

SEQ ID NO: 668681 - RNA, 19 nt, Homo sapiens
ggauuugaacccagacauu

SEQ ID NO: 668682 - RNA, 19 nt, Homo sapiens
cacuguagaucauuaaagu

SEQ ID NO: 668683 - RNA, 19 nt, Homo sapiens
uagaagcgguuaucuccau

SEQ ID NO: 668684 - RNA, 19 nt, Homo sapiens
caugauaacucugugacau

SEQ ID NO: 668685 - RNA, 19 nt, Homo sapiens
agggagguauagucacuua

SEQ ID NO: 668686 - RNA, 19 nt, Homo sapiens
gaugagccacuguagauca

SEQ ID NO: 668687 - RNA, 19 nt, Homo sapiens
gaagcugcaggaacaagaa

SEQ ID NO: 668688 - RNA, 19 nt, Homo sapiens
gcagaagagccaggauuug

SEQ ID NO: 668689 - RNA, 19 nt, Homo sapiens
gagagaacgggacgaacuu

SEQ ID NO: 668690 - RNA, 19 nt, Homo sapiens
gagcuccggcgucagauga

SEQ ID NO: 668691 - RNA, 19 nt, Homo sapiens
ggagauggagcggcagaaa

SEQ ID NO: 668692 - RNA, 19 nt, Homo sapiens
caggacaaguuggaucuga

SEQ ID NO: 668693 - RNA, 19 nt, Homo sapiens
gguggagcauguuauucuu

SEQ ID NO: 668694 - RNA, 19 nt, Homo sapiens
gaagcgguuaucuccauuu

SEQ ID NO: 668695 - RNA, 19 nt, Homo sapiens
uggagaggcuucccagcaa

SEQ ID NO: 668696 - RNA, 19 nt, Homo sapiens
ggaagcugcaggaacaaga

SEQ ID NO: 668697 - RNA, 19 nt, Homo sapiens
gcucagggagguauaguca

SEQ ID NO: 668698 - RNA, 19 nt, Homo sapiens
ugauaacucugugacauag

SEQ ID NO: 668699 - RNA, 19 nt, Homo sapiens
agucagagaacuaguuaaa

SEQ ID NO: 668700 - RNA, 19 nt, Homo sapiens
gacuucggcuucccagaga

SEQ ID NO: 668701 - RNA, 19 nt, Homo sapiens
ucaacaaggaccucacuga

SEQ ID NO: 668702 - RNA, 19 nt, Homo sapiens
auaacucugugacauagaa

SEQ ID NO: 668703 - RNA, 19 nt, Homo sapiens
gaaggccaaugagacaaag

SEQ ID NO: 668704 - RNA, 19 nt, Homo sapiens
gaagcuggcacuccuagag

SEQ ID NO: 668705 - RNA, 19 nt, Homo sapiens
gagaacuaguuaaaaggua

SEQ ID NO: 668706 - RNA, 19 nt, Homo sapiens
ccagaccagugcccugaau

SEQ ID NO: 668707 - RNA, 19 nt, Homo sapiens
caacagccccagcaccuua

SEQ ID NO: 668708 - RNA, 19 nt, Homo sapiens
gccaggacccuucagaugu

SEQ ID NO: 668709 - RNA, 19 nt, Homo sapiens
gaugugucaggcacuauuu

SEQ ID NO: 668710 - RNA, 19 nt, Homo sapiens
ggagcauguuauucuuguu

SEQ ID NO: 668711 - RNA, 19 nt, Homo sapiens
ggaggacccuucuuuugga

SEQ ID NO: 668712 - RNA, 19 nt, Homo sapiens
gaagagccaggauuugaac

SEQ ID NO: 668713 - RNA, 19 nt, Homo sapiens
ggucacacaguuagcagaa

SEQ ID NO: 668714 - RNA, 19 nt, Homo sapiens
gcgguuaucuccauuuugu

SEQ ID NO: 668715 - RNA, 19 nt, Homo sapiens
ucagagaacuaguuaaaag

SEQ ID NO: 668716 - RNA, 19 nt, Homo sapiens
aagagcaugugucgggaaa

SEQ ID NO: 668717 - RNA, 19 nt, Homo sapiens
ugaacaugaccgccaagua

SEQ ID NO: 668718 - RNA, 19 nt, Homo sapiens
gcaccuguaaucccagcua

SEQ ID NO: 668719 - RNA, 19 nt, Homo sapiens
agacugugguggagcaugu

SEQ ID NO: 668720 - RNA, 19 nt, Homo sapiens
gauuugaacccagacauuc

SEQ ID NO: 668721 - RNA, 19 nt, Homo sapiens
uuaaaguuccuccuugaga

SEQ ID NO: 668722 - RNA, 19 nt, Homo sapiens
ggagaagaucagcaagaug

SEQ ID NO: 668723 - RNA, 19 nt, Homo sapiens
gcagaagcuggcacuccua

SEQ ID NO: 668724 - RNA, 19 nt, Homo sapiens
agaaggaagagcugaguga

SEQ ID NO: 668725 - RNA, 19 nt, Homo sapiens
ucgcccagcuggaggaaga

SEQ ID NO: 668726 - RNA, 19 nt, Homo sapiens
agagaagccaugucacuug

SEQ ID NO: 668727 - RNA, 19 nt, Homo sapiens
uuucuaaccagacccauuu

SEQ ID NO: 668728 - RNA, 19 nt, Homo sapiens
uguaaucccagcacuuuga

SEQ ID NO: 668729 - RNA, 19 nt, Homo sapiens
cuaagugccagauaccauu

SEQ ID NO: 668730 - RNA, 19 nt, Homo sapiens
caacagcacccgggacaag

SEQ ID NO: 668731 - RNA, 19 nt, Homo sapiens
gcacaaacuucaauucuug

SEQ ID NO: 668732 - RNA, 19 nt, Homo sapiens
gcccaaaguuuauaugaua

SEQ ID NO: 668733 - RNA, 19 nt, Homo sapiens
gcaaacuccuucuccguua

SEQ ID NO: 668734 - RNA, 19 nt, Homo sapiens
gagcacaacuacagcauuu

SEQ ID NO: 668735 - RNA, 19 nt, Homo sapiens
caacacagcagaccugaua

SEQ ID NO: 668736 - RNA, 19 nt, Homo sapiens
gcauauagcuggagcauac

SEQ ID NO: 668737 - RNA, 19 nt, Homo sapiens
ccacaaaccauucucaaua

SEQ ID NO: 668738 - RNA, 19 nt, Homo sapiens
ccaaacagcaguucauaua

SEQ ID NO: 668739 - RNA, 19 nt, Homo sapiens
gcuaacacauaaacacaua

SEQ ID NO: 668740 - RNA, 19 nt, Homo sapiens
ugccagagcugaaauaauu

SEQ ID NO: 668741 - RNA, 19 nt, Homo sapiens
cgaaaugguugcugagaaa

SEQ ID NO: 668742 - RNA, 19 nt, Homo sapiens
ccacaagcauaccuauuaa

SEQ ID NO: 668743 - RNA, 19 nt, Homo sapiens
cagagcagcugaaaucuug

SEQ ID NO: 668744 - RNA, 19 nt, Homo sapiens
cacaaaccauucucaauaa

SEQ ID NO: 668745 - RNA, 19 nt, Homo sapiens
cugauuaacugacgagaua

SEQ ID NO: 668746 - RNA, 19 nt, Homo sapiens
gcugaaaucuugccaucaa

SEQ ID NO: 668747 - RNA, 19 nt, Homo sapiens
gcccauggcuggcaccuuu

SEQ ID NO: 668748 - RNA, 19 nt, Homo sapiens
caagacugccuuucuauuu

SEQ ID NO: 668749 - RNA, 19 nt, Homo sapiens
gaccaaauuucaacaagga

SEQ ID NO: 668750 - RNA, 19 nt, Homo sapiens
ucuaagcucucuccucuaa

SEQ ID NO: 668751 - RNA, 19 nt, Homo sapiens
gagcagagcagcugaaauc

SEQ ID NO: 668752 - RNA, 19 nt, Homo sapiens
gagcauaccucuuaaaccu

SEQ ID NO: 668753 - RNA, 19 nt, Homo sapiens
aagacugccuuucuauuua

SEQ ID NO: 668754 - RNA, 19 nt, Homo sapiens
ggacacggauugugacagu

SEQ ID NO: 668755 - RNA, 19 nt, Homo sapiens
guagggaagucugcacaua

SEQ ID NO: 668756 - RNA, 19 nt, Homo sapiens
gaucugcuguccucccuuu

SEQ ID NO: 668757 - RNA, 19 nt, Homo sapiens
ugacagagucuauaauuga

SEQ ID NO: 668758 - RNA, 19 nt, Homo sapiens
gcagaaacacuaagucuca

SEQ ID NO: 668759 - RNA, 19 nt, Homo sapiens
cacaagaaauagccacuuu

SEQ ID NO: 668760 - RNA, 19 nt, Homo sapiens
ucacagauccuucucuuga

SEQ ID NO: 668761 - RNA, 19 nt, Homo sapiens
gaaauaauuccacuucauc

SEQ ID NO: 668762 - RNA, 19 nt, Homo sapiens
aaagggaacuucaacacuu

SEQ ID NO: 668763 - RNA, 19 nt, Homo sapiens
aagcauaccuauuaagaga

SEQ ID NO: 668764 - RNA, 19 nt, Homo sapiens
gagaggauuuucaggauua

SEQ ID NO: 668765 - RNA, 19 nt, Homo sapiens
uaacugacgagauauauga

SEQ ID NO: 668766 - RNA, 19 nt, Homo sapiens
gaagucugcacauaacuaa

SEQ ID NO: 668767 - RNA, 19 nt, Homo sapiens
ggaaugagcagagugcaaa

SEQ ID NO: 668768 - RNA, 19 nt, Homo sapiens
gcacgcacuuccugagcua

SEQ ID NO: 668769 - RNA, 19 nt, Homo sapiens
ccauucagcccaaaguuua

SEQ ID NO: 668770 - RNA, 19 nt, Homo sapiens
aauaagagguugggugaaa

SEQ ID NO: 668771 - RNA, 19 nt, Homo sapiens
gggcuagcuuguucuaauu

SEQ ID NO: 668772 - RNA, 19 nt, Homo sapiens
gcagugagcggagauugua

SEQ ID NO: 668773 - RNA, 19 nt, Homo sapiens
caagaagccucugggaaga

SEQ ID NO: 668774 - RNA, 19 nt, Homo sapiens
caacugauaaugcaaaugu

SEQ ID NO: 668775 - RNA, 19 nt, Homo sapiens
gaacauguagcaucaucuu

SEQ ID NO: 668776 - RNA, 19 nt, Homo sapiens
gcagaaaugggaagagcua

SEQ ID NO: 668777 - RNA, 19 nt, Homo sapiens
ccacacggcuagacucuuc

SEQ ID NO: 668778 - RNA, 19 nt, Homo sapiens
caacaaggaacucaaggaa

SEQ ID NO: 668779 - RNA, 19 nt, Homo sapiens
ggacaacaagagcgaaauu

SEQ ID NO: 668780 - RNA, 19 nt, Homo sapiens
gggccaaacuuacuaccuu

SEQ ID NO: 668781 - RNA, 19 nt, Homo sapiens
uaaaagcacucuagagcua

SEQ ID NO: 668782 - RNA, 19 nt, Homo sapiens
gauuugcagucuccaugua

SEQ ID NO: 668783 - RNA, 19 nt, Homo sapiens
gaggaagacuuuaccaacu

SEQ ID NO: 668784 - RNA, 19 nt, Homo sapiens
cauaacuucccaacauuua

SEQ ID NO: 668785 - RNA, 19 nt, Homo sapiens
ugagggauuuguuuccuaa

SEQ ID NO: 668786 - RNA, 19 nt, Homo sapiens
ggaauaguagugucauuug

SEQ ID NO: 668787 - RNA, 19 nt, Homo sapiens
caggauuauuggaggauua

SEQ ID NO: 668788 - RNA, 19 nt, Homo sapiens
gcugaaagcuuuugaguca

SEQ ID NO: 668789 - RNA, 19 nt, Homo sapiens
ggaagucugcacauaacua

SEQ ID NO: 668790 - RNA, 19 nt, Homo sapiens
gcagugaugaugggaguua

SEQ ID NO: 668791 - RNA, 19 nt, Homo sapiens
gcaguuugguuucaacaca

SEQ ID NO: 668792 - RNA, 19 nt, Homo sapiens
cgauaagguugcagaaaug

SEQ ID NO: 668793 - RNA, 19 nt, Homo sapiens
cuugguaggugcaggaaua

SEQ ID NO: 668794 - RNA, 19 nt, Homo sapiens
agagcgaaauucugucuaa

SEQ ID NO: 668795 - RNA, 19 nt, Homo sapiens
gaaggggcguucagcuuua

SEQ ID NO: 668796 - RNA, 19 nt, Homo sapiens
gcaggcaccuccagaaagg

SEQ ID NO: 668797 - RNA, 19 nt, Homo sapiens
gccgaaaccugucuugcaa

SEQ ID NO: 668798 - RNA, 19 nt, Homo sapiens
aaacuugucuguucauguc

SEQ ID NO: 668799 - RNA, 19 nt, Homo sapiens
gagcgaaauucugucuaaa

SEQ ID NO: 668800 - RNA, 19 nt, Homo sapiens
cgaaaccugucuugcaaug

SEQ ID NO: 668801 - RNA, 19 nt, Homo sapiens
guacagauuugaguguuca

SEQ ID NO: 668802 - RNA, 19 nt, Homo sapiens
ggcauaacuucccaacauu

SEQ ID NO: 668803 - RNA, 19 nt, Homo sapiens
guucaugucccaaggcaua

SEQ ID NO: 668804 - RNA, 19 nt, Homo sapiens
ggaccaaggaucugugcua

SEQ ID NO: 668805 - RNA, 19 nt, Homo sapiens
gaauaguagugucauuugg

SEQ ID NO: 668806 - RNA, 19 nt, Homo sapiens
ucauauaccugccugagau

SEQ ID NO: 668807 - RNA, 19 nt, Homo sapiens
gaaacucaagucucccuaa

SEQ ID NO: 668808 - RNA, 19 nt, Homo sapiens
uaucuuccauggaugcuuu

SEQ ID NO: 668809 - RNA, 19 nt, Homo sapiens
gcauaacuucccaacauuu

SEQ ID NO: 668810 - RNA, 19 nt, Homo sapiens
guucauauggaccaaauuu

SEQ ID NO: 668811 - RNA, 19 nt, Homo sapiens
uaagcucucuccucuaaca

SEQ ID NO: 668812 - RNA, 19 nt, Homo sapiens
cugagaaacuugucuguuc

SEQ ID NO: 668813 - RNA, 19 nt, Homo sapiens
gagcggccaucucggauca

SEQ ID NO: 668814 - RNA, 19 nt, Homo sapiens
ggaaggauacuuaacaaac

SEQ ID NO: 668815 - RNA, 19 nt, Homo sapiens
gguaggugcaggaauagua

SEQ ID NO: 668816 - RNA, 19 nt, Homo sapiens
gaaggauacuuaacaaacc

SEQ ID NO: 668817 - RNA, 19 nt, Homo sapiens
gagaaaagacguaaaccua

SEQ ID NO: 668818 - RNA, 19 nt, Homo sapiens
gaauacuggucaucuuucu

SEQ ID NO: 668819 - RNA, 19 nt, Homo sapiens
gaagagaaggccuccaagu

SEQ ID NO: 668820 - RNA, 19 nt, Homo sapiens
gcacaacuacagcauuuua

SEQ ID NO: 668821 - RNA, 19 nt, Homo sapiens
gagcaacugauaaugcaaa

SEQ ID NO: 668822 - RNA, 19 nt, Homo sapiens
uuccauggaugcuuuaauu

SEQ ID NO: 668823 - RNA, 19 nt, Homo sapiens
guucacagauccuucucuu

SEQ ID NO: 668824 - RNA, 19 nt, Homo sapiens
ugagaaacuugucuguuca

SEQ ID NO: 668825 - RNA, 19 nt, Homo sapiens
ucaggugaguccagguuaa

SEQ ID NO: 668826 - RNA, 19 nt, Homo sapiens
cagcagaaacguugguaaa

SEQ ID NO: 668827 - RNA, 19 nt, Homo sapiens
gauauaugauuccaguucu

SEQ ID NO: 668828 - RNA, 19 nt, Homo sapiens
gauuaacugacgagauaua

SEQ ID NO: 668829 - RNA, 19 nt, Homo sapiens
caccuuaucuugcaauuuu

SEQ ID NO: 668830 - RNA, 19 nt, Homo sapiens
ggugacggaaggauacuua

SEQ ID NO: 668831 - RNA, 19 nt, Homo sapiens
gaagaacgguguugacuua

SEQ ID NO: 668832 - RNA, 19 nt, Homo sapiens
ccagaaagcucuugaguuu

SEQ ID NO: 668833 - RNA, 19 nt, Homo sapiens
ggagauugcuggacauaua

SEQ ID NO: 668834 - RNA, 19 nt, Homo sapiens
ggaggcggcuauaauaaua

SEQ ID NO: 668835 - RNA, 19 nt, Homo sapiens
gagauaagcuaggagauuu

SEQ ID NO: 668836 - RNA, 19 nt, Homo sapiens
guaauuacgucauucagaa

SEQ ID NO: 668837 - RNA, 19 nt, Homo sapiens
ggucagaguuuccauguga

SEQ ID NO: 668838 - RNA, 19 nt, Homo sapiens
gcagugaccuuuauaagag

SEQ ID NO: 668839 - RNA, 19 nt, Homo sapiens
ggucuugcuucuauaaaua

SEQ ID NO: 668840 - RNA, 19 nt, Homo sapiens
ggaagaucgucaugcauaa

SEQ ID NO: 668841 - RNA, 19 nt, Homo sapiens
ggaggaggcggcuauaaua

SEQ ID NO: 668842 - RNA, 19 nt, Homo sapiens
agaaagcucuugaguuuau

SEQ ID NO: 668843 - RNA, 19 nt, Homo sapiens
gcaaucacgugguucagaa

SEQ ID NO: 668844 - RNA, 19 nt, Homo sapiens
gaacucugcuaaugaagug

SEQ ID NO: 668845 - RNA, 19 nt, Homo sapiens
gaccagacacucccuauuu

SEQ ID NO: 668846 - RNA, 19 nt, Homo sapiens
caucuagucucaaguauag

SEQ ID NO: 668847 - RNA, 19 nt, Homo sapiens
cagcaggcaugccagguua

SEQ ID NO: 668848 - RNA, 19 nt, Homo sapiens
ggaggagggugaugugaug

SEQ ID NO: 668849 - RNA, 19 nt, Homo sapiens
acaaaccuguguaugcuua

SEQ ID NO: 668850 - RNA, 19 nt, Homo sapiens
gagaaguacuacaugaaga

SEQ ID NO: 668851 - RNA, 19 nt, Homo sapiens
uggccaagcuggagaagua

SEQ ID NO: 668852 - RNA, 19 nt, Homo sapiens
gcgagauucuuucuaaaug

SEQ ID NO: 668853 - RNA, 19 nt, Homo sapiens
gguguagacuuugcauaua

SEQ ID NO: 668854 - RNA, 19 nt, Homo sapiens
gagacuauauuaugcugaa

SEQ ID NO: 668855 - RNA, 19 nt, Homo sapiens
ggacagguauuugccuuau

SEQ ID NO: 668856 - RNA, 19 nt, Homo sapiens
gauauggaaugucugaugu

SEQ ID NO: 668857 - RNA, 19 nt, Homo sapiens
gaaugguucugagggcuua

SEQ ID NO: 668858 - RNA, 19 nt, Homo sapiens
gaacaaggguacguuugau

SEQ ID NO: 668859 - RNA, 19 nt, Homo sapiens
guacaugggaggccacaua

SEQ ID NO: 668860 - RNA, 19 nt, Homo sapiens
ggaacuagauggccauguc

SEQ ID NO: 668861 - RNA, 19 nt, Homo sapiens
ucacauggauccucuucaa

SEQ ID NO: 668862 - RNA, 19 nt, Homo sapiens
cauggagccucuucaguuu

SEQ ID NO: 668863 - RNA, 19 nt, Homo sapiens
gaagaacaaggguacguuu

SEQ ID NO: 668864 - RNA, 19 nt, Homo sapiens
gaauggcaaucacgugguu

SEQ ID NO: 668865 - RNA, 19 nt, Homo sapiens
gcauggagccucuucaguu

SEQ ID NO: 668866 - RNA, 19 nt, Homo sapiens
aaacaucgauggccuacug

SEQ ID NO: 668867 - RNA, 19 nt, Homo sapiens
gaaucaacauaaacacguu

SEQ ID NO: 668868 - RNA, 19 nt, Homo sapiens
caagcaauguuguggagaa

SEQ ID NO: 668869 - RNA, 19 nt, Homo sapiens
gcaauguuguggagaagug

SEQ ID NO: 668870 - RNA, 19 nt, Homo sapiens
ggauaacauucaugcagaa

SEQ ID NO: 668871 - RNA, 19 nt, Homo sapiens
cagcauggguccagauuca

SEQ ID NO: 668872 - RNA, 19 nt, Homo sapiens
ccaaacuggugcccuugua

SEQ ID NO: 668873 - RNA, 19 nt, Homo sapiens
gaaugagcguugcaugugu

SEQ ID NO: 668874 - RNA, 19 nt, Homo sapiens
ugacuacaauucucaacaa

SEQ ID NO: 668875 - RNA, 19 nt, Homo sapiens
ucuauaauguacccuagua

SEQ ID NO: 668876 - RNA, 19 nt, Homo sapiens
caugggaggccacauauuu

SEQ ID NO: 668877 - RNA, 19 nt, Homo sapiens
ggagauaagcuaggagauu

SEQ ID NO: 668878 - RNA, 19 nt, Homo sapiens
auagcgagauucuuucuaa

SEQ ID NO: 668879 - RNA, 19 nt, Homo sapiens
cugagaaguuugaauugua

SEQ ID NO: 668880 - RNA, 19 nt, Homo sapiens
ucgcaacucuucguaagua

SEQ ID NO: 668881 - RNA, 19 nt, Homo sapiens
gcagaaauccgaggcaaug

SEQ ID NO: 668882 - RNA, 19 nt, Homo sapiens
gaauucugcccuugcauuu

SEQ ID NO: 668883 - RNA, 19 nt, Homo sapiens
ccaagccuguggaggauuu

SEQ ID NO: 668884 - RNA, 19 nt, Homo sapiens
gaauauuccugggugauca

SEQ ID NO: 668885 - RNA, 19 nt, Homo sapiens
gaacaucagaucauucagu

SEQ ID NO: 668886 - RNA, 19 nt, Homo sapiens
cagaagaugaacuguauuu

SEQ ID NO: 668887 - RNA, 19 nt, Homo sapiens
ccaacuacgugguccagaa

SEQ ID NO: 668888 - RNA, 19 nt, Homo sapiens
gcacacagagcagcuugua

SEQ ID NO: 668889 - RNA, 19 nt, Homo sapiens
ugaagugugugaaagauca

SEQ ID NO: 668890 - RNA, 19 nt, Homo sapiens
ggcaacaacucucugaaca

SEQ ID NO: 668891 - RNA, 19 nt, Homo sapiens
gaggaggcggcuauaauaa

SEQ ID NO: 668892 - RNA, 19 nt, Homo sapiens
uggaaugucugaugucaug

SEQ ID NO: 668893 - RNA, 19 nt, Homo sapiens
uggauccucuucaagcuua

SEQ ID NO: 668894 - RNA, 19 nt, Homo sapiens
gcaacuaauucagcuaauc

SEQ ID NO: 668895 - RNA, 19 nt, Homo sapiens
cagcaaagauggaccaaaa

SEQ ID NO: 668896 - RNA, 19 nt, Homo sapiens
uaacaaaccuguguaugcu

SEQ ID NO: 668897 - RNA, 19 nt, Homo sapiens
gcucuugaguuuauuccuu

SEQ ID NO: 668898 - RNA, 19 nt, Homo sapiens
ggucguagcauauaguguu

SEQ ID NO: 668899 - RNA, 19 nt, Homo sapiens
guguagacuuugcauauau

SEQ ID NO: 668900 - RNA, 19 nt, Homo sapiens
gaaauccaucuucauccua

SEQ ID NO: 668901 - RNA, 19 nt, Homo sapiens
cggaagaucgucaugcaua

SEQ ID NO: 668902 - RNA, 19 nt, Homo sapiens
gagauugcuggacauauaa

SEQ ID NO: 668903 - RNA, 19 nt, Homo sapiens
gaauggcaguggaagauac

SEQ ID NO: 668904 - RNA, 19 nt, Homo sapiens
augcagacgucaaagauuu

SEQ ID NO: 668905 - RNA, 19 nt, Homo sapiens
uaacauucaugcagaacau

SEQ ID NO: 668906 - RNA, 19 nt, Homo sapiens
auacagaacuuuggaaucu

SEQ ID NO: 668907 - RNA, 19 nt, Homo sapiens
ggaaugagcguugcaugug

SEQ ID NO: 668908 - RNA, 19 nt, Homo sapiens
ccuuauggcugccgaguga

SEQ ID NO: 668909 - RNA, 19 nt, Homo sapiens
caacuaauucagcuaauca

SEQ ID NO: 668910 - RNA, 19 nt, Homo sapiens
gcacacuuguaaccauaug

SEQ ID NO: 668911 - RNA, 19 nt, Homo sapiens
aagcacacuuguaaccaua

SEQ ID NO: 668912 - RNA, 19 nt, Homo sapiens
ccucucaccuuguaaagug

SEQ ID NO: 668913 - RNA, 19 nt, Homo sapiens
uaauugcccugcuguuuua

SEQ ID NO: 668914 - RNA, 19 nt, Homo sapiens
agugguugcuccaggauua

SEQ ID NO: 668915 - RNA, 19 nt, Homo sapiens
ggcgauuccugucuaagaa

SEQ ID NO: 668916 - RNA, 19 nt, Homo sapiens
uauacuugguguagacuuu

SEQ ID NO: 668917 - RNA, 19 nt, Homo sapiens
ggaccaguaugccaacuac

SEQ ID NO: 668918 - RNA, 19 nt, Homo sapiens
gaggcaauguacuuguauu

SEQ ID NO: 668919 - RNA, 19 nt, Homo sapiens
ccgaggcaauguacuugua

SEQ ID NO: 668920 - RNA, 19 nt, Homo sapiens
gaaagcucuugaguuuauu

SEQ ID NO: 668921 - RNA, 19 nt, Homo sapiens
auguauggcugccguguua

SEQ ID NO: 668922 - RNA, 19 nt, Homo sapiens
gcagcagugaccuuuauaa

SEQ ID NO: 668923 - RNA, 19 nt, Homo sapiens
gaaacaucacccucaagaa

SEQ ID NO: 668924 - RNA, 19 nt, Homo sapiens
cgagauucuuucuaaaugu

SEQ ID NO: 668925 - RNA, 19 nt, Homo sapiens
guucacuguuguaucuaua

SEQ ID NO: 668926 - RNA, 19 nt, Homo sapiens
gcaugccucucccuaguca

SEQ ID NO: 668927 - RNA, 19 nt, Homo sapiens
gaacagugaggucaauucu

SEQ ID NO: 668928 - RNA, 19 nt, Homo sapiens
guaauuucaaccagaagua

SEQ ID NO: 668929 - RNA, 19 nt, Homo sapiens
ugagaaguuugaauuguag

SEQ ID NO: 668930 - RNA, 19 nt, Homo sapiens
ggauacuuguacauaggua

SEQ ID NO: 668931 - RNA, 19 nt, Homo sapiens
gcaaagaucuauaucagaa

SEQ ID NO: 668932 - RNA, 19 nt, Homo sapiens
ugaagacucugaucauuua

SEQ ID NO: 668933 - RNA, 19 nt, Homo sapiens
gagcauagccauagugaua

SEQ ID NO: 668934 - RNA, 19 nt, Homo sapiens
ggagaaauauggaacuuga

SEQ ID NO: 668935 - RNA, 19 nt, Homo sapiens
gaacgaaugcuagagauua

SEQ ID NO: 668936 - RNA, 19 nt, Homo sapiens
gaacuugauuggcguguuu

SEQ ID NO: 668937 - RNA, 19 nt, Homo sapiens
ggucaccaauuaauaguua

SEQ ID NO: 668938 - RNA, 19 nt, Homo sapiens
gaacuagagcuauccaaua

SEQ ID NO: 668939 - RNA, 19 nt, Homo sapiens
gagaauaagugauagugaa

SEQ ID NO: 668940 - RNA, 19 nt, Homo sapiens
gauccuagcucugcuguaa

SEQ ID NO: 668941 - RNA, 19 nt, Homo sapiens
gaaacagcauuauuagaug

SEQ ID NO: 668942 - RNA, 19 nt, Homo sapiens
cuucaaagcucaacauuau

SEQ ID NO: 668943 - RNA, 19 nt, Homo sapiens
gaggaaagaugacugaauc

SEQ ID NO: 668944 - RNA, 19 nt, Homo sapiens
gaacccaaauggaaccaaa

SEQ ID NO: 668945 - RNA, 19 nt, Homo sapiens
ggacaaacacugaacaaug

SEQ ID NO: 668946 - RNA, 19 nt, Homo sapiens
cgacugaauuagaagaaua

SEQ ID NO: 668947 - RNA, 19 nt, Homo sapiens
caggacaacuuucaauaaa

SEQ ID NO: 668948 - RNA, 19 nt, Homo sapiens
uuacagagcucaggagaaa

SEQ ID NO: 668949 - RNA, 19 nt, Homo sapiens
gaagagaguccacaaggaa

SEQ ID NO: 668950 - RNA, 19 nt, Homo sapiens
gaaaugaggaacuggauga

SEQ ID NO: 668951 - RNA, 19 nt, Homo sapiens
ggaaacagcaccacuuaga

SEQ ID NO: 668952 - RNA, 19 nt, Homo sapiens
caaaggaccacaaaccaua

SEQ ID NO: 668953 - RNA, 19 nt, Homo sapiens
gagaagaacuaaaacagua

SEQ ID NO: 668954 - RNA, 19 nt, Homo sapiens
gauaggcgaucucaacaug

SEQ ID NO: 668955 - RNA, 19 nt, Homo sapiens
ccaaagaaguacagaaaca

SEQ ID NO: 668956 - RNA, 19 nt, Homo sapiens
aagcagagaugaauacgaa

SEQ ID NO: 668957 - RNA, 19 nt, Homo sapiens
gcauggaucacaaaucuuu

SEQ ID NO: 668958 - RNA, 19 nt, Homo sapiens
aaaggaaguuuagcugaua

SEQ ID NO: 668959 - RNA, 19 nt, Homo sapiens
agauggagaucguuuaauu

SEQ ID NO: 668960 - RNA, 19 nt, Homo sapiens
guagauacguguaguagca

SEQ ID NO: 668961 - RNA, 19 nt, Homo sapiens
gugaugauguugagauuga

SEQ ID NO: 668962 - RNA, 19 nt, Homo sapiens
cagacaagcccaucaagua

SEQ ID NO: 668963 - RNA, 19 nt, Homo sapiens
ggaaccaaacauucauuua

SEQ ID NO: 668964 - RNA, 19 nt, Homo sapiens
gcauagugauguuucuuug

SEQ ID NO: 668965 - RNA, 19 nt, Homo sapiens
ggaagaggauuuggaaugg

SEQ ID NO: 668966 - RNA, 19 nt, Homo sapiens
gacaaacacugaacaaugc

SEQ ID NO: 668967 - RNA, 19 nt, Homo sapiens
gaucgaccaucaaggcaaa

SEQ ID NO: 668968 - RNA, 19 nt, Homo sapiens
gaccauuauucuccagaua

SEQ ID NO: 668969 - RNA, 19 nt, Homo sapiens
gaacaaguaaugucaucaa

SEQ ID NO: 668970 - RNA, 19 nt, Homo sapiens
gcaaaggucaaagagaaua

SEQ ID NO: 668971 - RNA, 19 nt, Homo sapiens
gaagaauaaugacuguaca

SEQ ID NO: 668972 - RNA, 19 nt, Homo sapiens
gagaaggcauagugauguu

SEQ ID NO: 668973 - RNA, 19 nt, Homo sapiens
gaagaaagagaggaauauu

SEQ ID NO: 668974 - RNA, 19 nt, Homo sapiens
gauagccaguucagugauu

SEQ ID NO: 668975 - RNA, 19 nt, Homo sapiens
ggcaaaugcugaucuggaa

SEQ ID NO: 668976 - RNA, 19 nt, Homo sapiens
gcacuaugaccggacauua

SEQ ID NO: 668977 - RNA, 19 nt, Homo sapiens
gaagauuccaggauuucua

SEQ ID NO: 668978 - RNA, 19 nt, Homo sapiens
aaucaucucuggaaaguuc

SEQ ID NO: 668979 - RNA, 19 nt, Homo sapiens
gaccggacauuauaauaca

SEQ ID NO: 668980 - RNA, 19 nt, Homo sapiens
gaauugguguaguaucaga

SEQ ID NO: 668981 - RNA, 19 nt, Homo sapiens
ugacugugaugauggaauu

SEQ ID NO: 668982 - RNA, 19 nt, Homo sapiens
ggagauauaccgcgaauac

SEQ ID NO: 668983 - RNA, 19 nt, Homo sapiens
uagaccaggugaugaagua

SEQ ID NO: 668984 - RNA, 19 nt, Homo sapiens
aaguuuagcugauacugua

SEQ ID NO: 668985 - RNA, 19 nt, Homo sapiens
ggaaguguaccucgagauu

SEQ ID NO: 668986 - RNA, 19 nt, Homo sapiens
ucagcgaucuuauucaaug

SEQ ID NO: 668987 - RNA, 19 nt, Homo sapiens
ucgaguagauguuauagga

SEQ ID NO: 668988 - RNA, 19 nt, Homo sapiens
ggucaaagagaauaaguga

SEQ ID NO: 668989 - RNA, 19 nt, Homo sapiens
ggaucaagcucguguucga

SEQ ID NO: 668990 - RNA, 19 nt, Homo sapiens
caccaaagccucauaaauc

SEQ ID NO: 668991 - RNA, 19 nt, Homo sapiens
agaggaauauucacaguau

SEQ ID NO: 668992 - RNA, 19 nt, Homo sapiens
ugaggucgaugccuucauu

SEQ ID NO: 668993 - RNA, 19 nt, Homo sapiens
ggaguggcccagauacuuu

SEQ ID NO: 668994 - RNA, 19 nt, Homo sapiens
aaacaaaaguggcaagaaa

SEQ ID NO: 668995 - RNA, 19 nt, Homo sapiens
cgagggacccgcacuauga

SEQ ID NO: 668996 - RNA, 19 nt, Homo sapiens
ugauggaauugguguagua

SEQ ID NO: 668997 - RNA, 19 nt, Homo sapiens
gaagaugggaggccaagga

SEQ ID NO: 668998 - RNA, 19 nt, Homo sapiens
ccucauaaaucaaagaaag

SEQ ID NO: 668999 - RNA, 19 nt, Homo sapiens
gaaauauggaacuugauug

SEQ ID NO: 669000 - RNA, 19 nt, Homo sapiens
cgaagagaguccacaagga

SEQ ID NO: 669001 - RNA, 19 nt, Homo sapiens
uugcaaaggucaaagagaa

SEQ ID NO: 669002 - RNA, 19 nt, Homo sapiens
ccacauugguacaaacuuc

SEQ ID NO: 669003 - RNA, 19 nt, Homo sapiens
ggaaguguacaacaucauu

SEQ ID NO: 669004 - RNA, 19 nt, Homo sapiens
gauacuguaggacaucuua

SEQ ID NO: 669005 - RNA, 19 nt, Homo sapiens
uguaguagcacaacccuua

SEQ ID NO: 669006 - RNA, 19 nt, Homo sapiens
ggaagaaagagaggaauau

SEQ ID NO: 669007 - RNA, 19 nt, Homo sapiens
gggaagaaagagaggaaua

SEQ ID NO: 669008 - RNA, 19 nt, Homo sapiens
gagaucagaauagaagaua

SEQ ID NO: 669009 - RNA, 19 nt, Homo sapiens
gaggaaguguacaacauca

SEQ ID NO: 669010 - RNA, 19 nt, Homo sapiens
agaauggaauggaagacua

SEQ ID NO: 669011 - RNA, 19 nt, Homo sapiens
ggucggcuuugugcauuua

SEQ ID NO: 669012 - RNA, 19 nt, Homo sapiens
caaagccucauaaaucaaa

SEQ ID NO: 669013 - RNA, 19 nt, Homo sapiens
ccaaucaucucuggaaagu

SEQ ID NO: 669014 - RNA, 19 nt, Homo sapiens
gucgaugccuucauuaaug

SEQ ID NO: 669015 - RNA, 19 nt, Homo sapiens
agacagggauugugaagca

SEQ ID NO: 669016 - RNA, 19 nt, Homo sapiens
caugaguccuggaauguug

SEQ ID NO: 669017 - RNA, 19 nt, Homo sapiens
ucuguuaccucucccauga

SEQ ID NO: 669018 - RNA, 19 nt, Homo sapiens
acagagcucaggagaaaua

SEQ ID NO: 669019 - RNA, 19 nt, Homo sapiens
gcaaggagccacauuugag

SEQ ID NO: 669020 - RNA, 19 nt, Homo sapiens
ggucugcaauucuguuuua

SEQ ID NO: 669021 - RNA, 19 nt, Homo sapiens
guauuagaauggaauggaa

SEQ ID NO: 669022 - RNA, 19 nt, Homo sapiens
aaucagcgaucuuauucaa

SEQ ID NO: 669023 - RNA, 19 nt, Homo sapiens
gaaaaucagcgaucuuauu

SEQ ID NO: 669024 - RNA, 19 nt, Homo sapiens
ucauaggcauuccaaagaa

SEQ ID NO: 669025 - RNA, 19 nt, Homo sapiens
aacuagagcuauccaauau

SEQ ID NO: 669026 - RNA, 19 nt, Homo sapiens
aaggagcacuguccaaaga

SEQ ID NO: 669027 - RNA, 19 nt, Homo sapiens
ucaggacaacuuucaauaa

SEQ ID NO: 669028 - RNA, 19 nt, Homo sapiens
gugaugaaguauuagaaug

SEQ ID NO: 669029 - RNA, 19 nt, Homo sapiens
ggaguccacuacccauaga

SEQ ID NO: 669030 - RNA, 19 nt, Homo sapiens
gagagaaggcauagugaug

SEQ ID NO: 669031 - RNA, 19 nt, Homo sapiens
ggaaggagcugcuuacaaa

SEQ ID NO: 669032 - RNA, 19 nt, Homo sapiens
gaaggaggcugaagaguug

SEQ ID NO: 669033 - RNA, 19 nt, Homo sapiens
ucaaugaccugaacuauga

SEQ ID NO: 669034 - RNA, 19 nt, Homo sapiens
ccauggagcugucuuauug

SEQ ID NO: 669035 - RNA, 19 nt, Homo sapiens
ggacugcccugcacaccua

SEQ ID NO: 669036 - RNA, 19 nt, Homo sapiens
gaagaucguuuccuauaca

SEQ ID NO: 669037 - RNA, 19 nt, Homo sapiens
gauaagaguuccuguccaa

SEQ ID NO: 669038 - RNA, 19 nt, Homo sapiens
gaaagcagcuguggagaca

SEQ ID NO: 669039 - RNA, 19 nt, Homo sapiens
gaacuucagugaugacagu

SEQ ID NO: 669040 - RNA, 19 nt, Homo sapiens
gaccugaacuaugaagaua

SEQ ID NO: 669041 - RNA, 19 nt, Homo sapiens
ggagaaggcucacaguuac

SEQ ID NO: 669042 - RNA, 19 nt, Homo sapiens
caacaaagcugcagauacc

SEQ ID NO: 669043 - RNA, 19 nt, Homo sapiens
uggcagagcuggccuguga

SEQ ID NO: 669044 - RNA, 19 nt, Homo sapiens
gguaaucucugggauguga

SEQ ID NO: 669045 - RNA, 19 nt, Homo sapiens
gacauucucucaacucaga

SEQ ID NO: 669046 - RNA, 19 nt, Homo sapiens
cgacucaaguaucuuauug

SEQ ID NO: 669047 - RNA, 19 nt, Homo sapiens
acacauaccugcuccuuuc

SEQ ID NO: 669048 - RNA, 19 nt, Homo sapiens
caggaacgcuucaacauca

SEQ ID NO: 669049 - RNA, 19 nt, Homo sapiens
aagcuucccugaaucauaa

SEQ ID NO: 669050 - RNA, 19 nt, Homo sapiens
gcugucagauaguugauuu

SEQ ID NO: 669051 - RNA, 19 nt, Homo sapiens
ggagaugccuggagauguc

SEQ ID NO: 669052 - RNA, 19 nt, Homo sapiens
ccaagaagguggcaucaag

SEQ ID NO: 669053 - RNA, 19 nt, Homo sapiens
ggaagggccugagccuaaa

SEQ ID NO: 669054 - RNA, 19 nt, Homo sapiens
caacugcucugcucuggau

SEQ ID NO: 669055 - RNA, 19 nt, Homo sapiens
gcccaaggcugucagauag

SEQ ID NO: 669056 - RNA, 19 nt, Homo sapiens
aauaauaccucucagaaag

SEQ ID NO: 669057 - RNA, 19 nt, Homo sapiens
aagauaaacuccaggaaga

SEQ ID NO: 669058 - RNA, 19 nt, Homo sapiens
ggccugugauggcuacuua

SEQ ID NO: 669059 - RNA, 19 nt, Homo sapiens
gaccaucccugaggaagaa

SEQ ID NO: 669060 - RNA, 19 nt, Homo sapiens
ugaagaaacuggguaaaca

SEQ ID NO: 669061 - RNA, 19 nt, Homo sapiens
gaucguuuccuauacagua

SEQ ID NO: 669062 - RNA, 19 nt, Homo sapiens
gcucugcucuggaugcuau

SEQ ID NO: 669063 - RNA, 19 nt, Homo sapiens
gaagagauggauaagaguu

SEQ ID NO: 669064 - RNA, 19 nt, Homo sapiens
gcuagaagccucauaacug

SEQ ID NO: 669065 - RNA, 19 nt, Homo sapiens
ccgaggaucacuugaaaua

SEQ ID NO: 669066 - RNA, 19 nt, Homo sapiens
gugaaaaucugguacaaaa

SEQ ID NO: 669067 - RNA, 19 nt, Homo sapiens
acacuguggugguuuauga

SEQ ID NO: 669068 - RNA, 19 nt, Homo sapiens
gaaugcugcugcacaagga

SEQ ID NO: 669069 - RNA, 19 nt, Homo sapiens
cuagaagccucauaacugu

SEQ ID NO: 669070 - RNA, 19 nt, Homo sapiens
gcagugacauucucucaac

SEQ ID NO: 669071 - RNA, 19 nt, Homo sapiens
ggaggguacugcucucuuc

SEQ ID NO: 669072 - RNA, 19 nt, Homo sapiens
gcagauaccacgccagugu

SEQ ID NO: 669073 - RNA, 19 nt, Homo sapiens
uggagaaggcucacaguua

SEQ ID NO: 669074 - RNA, 19 nt, Homo sapiens
gaacgaauucucuuugucu

SEQ ID NO: 669075 - RNA, 19 nt, Homo sapiens
cuacucagcuacuccauca

SEQ ID NO: 669076 - RNA, 19 nt, Homo sapiens
gcuacuccaucaucaaaga

SEQ ID NO: 669077 - RNA, 19 nt, Homo sapiens
ccugaacuaugaagauaaa

SEQ ID NO: 669078 - RNA, 19 nt, Homo sapiens
ccuccaagguuagauuuaa

SEQ ID NO: 669079 - RNA, 19 nt, Homo sapiens
caccgaggaucacuugaaa

SEQ ID NO: 669080 - RNA, 19 nt, Homo sapiens
ccaagcaacagcagucuuu

SEQ ID NO: 669081 - RNA, 19 nt, Homo sapiens
gcucacaguuaccuaagga

SEQ ID NO: 669082 - RNA, 19 nt, Homo sapiens
ucacuuugcuucuccaaca

SEQ ID NO: 669083 - RNA, 19 nt, Homo sapiens
gaugcuagaagccucauaa

SEQ ID NO: 669084 - RNA, 19 nt, Homo sapiens
guccugaacccucacaaua

SEQ ID NO: 669085 - RNA, 19 nt, Homo sapiens
gaggaucacuugaaauagc

SEQ ID NO: 669086 - RNA, 19 nt, Homo sapiens
aggaagaacugacugacaa

SEQ ID NO: 669087 - RNA, 19 nt, Homo sapiens
guggacaguuguaaaucua

SEQ ID NO: 669088 - RNA, 19 nt, Homo sapiens
ggaacgaauucucuuuguc

SEQ ID NO: 669089 - RNA, 19 nt, Homo sapiens
caauaauaccucucagaaa

SEQ ID NO: 669090 - RNA, 19 nt, Homo sapiens
ucaauaauaccucucagaa

SEQ ID NO: 669091 - RNA, 19 nt, Homo sapiens
ucccagcuaugcccaguua

SEQ ID NO: 669092 - RNA, 19 nt, Homo sapiens
aagaggcgcuauagacuug

SEQ ID NO: 669093 - RNA, 19 nt, Homo sapiens
uaugagagcugccaguucu

SEQ ID NO: 669094 - RNA, 19 nt, Homo sapiens
gcaccgaggaucacuugaa

SEQ ID NO: 669095 - RNA, 19 nt, Homo sapiens
gaggaagucugcccuacag

SEQ ID NO: 669096 - RNA, 19 nt, Homo sapiens
ggacaggaacgcuucaaca

SEQ ID NO: 669097 - RNA, 19 nt, Homo sapiens
gcggaaugcugcugcacaa

SEQ ID NO: 669098 - RNA, 19 nt, Homo sapiens
gcacagaggagcaauuucg

SEQ ID NO: 669099 - RNA, 19 nt, Homo sapiens
gcucaagcauacacacugu

SEQ ID NO: 669100 - RNA, 19 nt, Homo sapiens
ccauagcaccuucuacaaa

SEQ ID NO: 669101 - RNA, 19 nt, Homo sapiens
uaacuuggaggaauuugaa

SEQ ID NO: 669102 - RNA, 19 nt, Homo sapiens
ccaaggcugucagauaguu

SEQ ID NO: 669103 - RNA, 19 nt, Homo sapiens
ugacugaccgcgacauuga

SEQ ID NO: 669104 - RNA, 19 nt, Homo sapiens
ucuccaagcuucccugaau

SEQ ID NO: 669105 - RNA, 19 nt, Homo sapiens
ggauacaccuggcuuucca

SEQ ID NO: 669106 - RNA, 19 nt, Homo sapiens
gaacggcgagcugcauuug

SEQ ID NO: 669107 - RNA, 19 nt, Homo sapiens
gagccaauuucagcaguga

SEQ ID NO: 669108 - RNA, 19 nt, Homo sapiens
ucucaucgcuucccuagag

SEQ ID NO: 669109 - RNA, 19 nt, Homo sapiens
gaagguggcaucaagacau

SEQ ID NO: 669110 - RNA, 19 nt, Homo sapiens
caagcuucccugaaucaua

SEQ ID NO: 669111 - RNA, 19 nt, Homo sapiens
gcagacaccugagauagcu

SEQ ID NO: 669112 - RNA, 19 nt, Homo sapiens
gcuucaacaucaucuguga

SEQ ID NO: 669113 - RNA, 19 nt, Homo sapiens
ggccgacacuggacaggaa

SEQ ID NO: 669114 - RNA, 19 nt, Homo sapiens
gccuacagcuucuauaguc

SEQ ID NO: 669115 - RNA, 19 nt, Homo sapiens
gacuguggcuggaaauauc

SEQ ID NO: 669116 - RNA, 19 nt, Homo sapiens
caacagcagucuuuucuuc

SEQ ID NO: 669117 - RNA, 19 nt, Homo sapiens
ccucauaacuguucuaccu

SEQ ID NO: 669118 - RNA, 19 nt, Homo sapiens
ggagcaauuucgagccaau

SEQ ID NO: 669119 - RNA, 19 nt, Homo sapiens
ggacuguggcuggaaauau

SEQ ID NO: 669120 - RNA, 19 nt, Homo sapiens
caaacgagagccugcagaa

SEQ ID NO: 669121 - RNA, 19 nt, Homo sapiens
acaguaacauugccuucaa

SEQ ID NO: 669122 - RNA, 19 nt, Homo sapiens
gcucugcuaccacgacuuu

SEQ ID NO: 669123 - RNA, 19 nt, Homo sapiens
uggccaagcuucugaucaa

SEQ ID NO: 669124 - RNA, 19 nt, Homo sapiens
uugaagagauggauaagag

SEQ ID NO: 669125 - RNA, 19 nt, Homo sapiens
cauagcaccuucuacaaac

SEQ ID NO: 669126 - RNA, 19 nt, Homo sapiens
gcagcagguucuguucuug

SEQ ID NO: 669127 - RNA, 19 nt, Homo sapiens
gaacuaugaagauaaacuc

SEQ ID NO: 669128 - RNA, 19 nt, Homo sapiens
agaaggaggcugaagaguu

SEQ ID NO: 669129 - RNA, 19 nt, Homo sapiens
ggaacacugccgucgcuuu

SEQ ID NO: 669130 - RNA, 19 nt, Homo sapiens
caauagccaccuugucuug

SEQ ID NO: 669131 - RNA, 19 nt, Homo sapiens
gaagauaggcagucaaaug

SEQ ID NO: 669132 - RNA, 19 nt, Homo sapiens
ucacaggaaugcauaauug

SEQ ID NO: 669133 - RNA, 19 nt, Homo sapiens
ggacggcaguguuugauga

SEQ ID NO: 669134 - RNA, 19 nt, Homo sapiens
gagaguugcucaaagaaug

SEQ ID NO: 669135 - RNA, 19 nt, Homo sapiens
ucagagaguugcucaaaga

SEQ ID NO: 669136 - RNA, 19 nt, Homo sapiens
gcagguaaagagauuauaa

SEQ ID NO: 669137 - RNA, 19 nt, Homo sapiens
ccugugagcuucugacuug

SEQ ID NO: 669138 - RNA, 19 nt, Homo sapiens
gaacaugggccaccucaca

SEQ ID NO: 669139 - RNA, 19 nt, Homo sapiens
gagaaaggcugggccaagu

SEQ ID NO: 669140 - RNA, 19 nt, Homo sapiens
cugcuggacuuguucuuua

SEQ ID NO: 669141 - RNA, 19 nt, Homo sapiens
caagagauuuccacagaag

SEQ ID NO: 669142 - RNA, 19 nt, Homo sapiens
gauaggcagucaaaugcuu

SEQ ID NO: 669143 - RNA, 19 nt, Homo sapiens
aacaagagauuuccacaga

SEQ ID NO: 669144 - RNA, 19 nt, Homo sapiens
ggaagggcguggacaugga

SEQ ID NO: 669145 - RNA, 19 nt, Homo sapiens
gcccagagcacagcaauaa

SEQ ID NO: 669146 - RNA, 19 nt, Homo sapiens
gaagaagaaggacaaguuc

SEQ ID NO: 669147 - RNA, 19 nt, Homo sapiens
ccgaacaggugauuacguu

SEQ ID NO: 669148 - RNA, 19 nt, Homo sapiens
ucgcagagaucaacuucaa

SEQ ID NO: 669149 - RNA, 19 nt, Homo sapiens
uuacucaccuugcuggaaa

SEQ ID NO: 669150 - RNA, 19 nt, Homo sapiens
agaaggguccagaagauua

SEQ ID NO: 669151 - RNA, 19 nt, Homo sapiens
ugguaaagcuggcaguuga

SEQ ID NO: 669152 - RNA, 19 nt, Homo sapiens
gagccaaggcccugagaaa

SEQ ID NO: 669153 - RNA, 19 nt, Homo sapiens
ugaagaagaaggacaaguu

SEQ ID NO: 669154 - RNA, 19 nt, Homo sapiens
caguuuggcuucaaugaug

SEQ ID NO: 669155 - RNA, 19 nt, Homo sapiens
gcagaugacagccaacuuc

SEQ ID NO: 669156 - RNA, 19 nt, Homo sapiens
ccaaguggaacuaugcaua

SEQ ID NO: 669157 - RNA, 19 nt, Homo sapiens
cuagaaggguccagaagau

SEQ ID NO: 669158 - RNA, 19 nt, Homo sapiens
gcagagaucaacuucaaca

SEQ ID NO: 669159 - RNA, 19 nt, Homo sapiens
caacaucaaugccccguuu

SEQ ID NO: 669160 - RNA, 19 nt, Homo sapiens
ugacccaccuguuccagaa

SEQ ID NO: 669161 - RNA, 19 nt, Homo sapiens
gaaggguccagaagauuau

SEQ ID NO: 669162 - RNA, 19 nt, Homo sapiens
ucacggccaugucguccua

SEQ ID NO: 669163 - RNA, 19 nt, Homo sapiens
ccaacgcgguggugcagaa

SEQ ID NO: 669164 - RNA, 19 nt, Homo sapiens
ggaugaagauaggcaguca

SEQ ID NO: 669165 - RNA, 19 nt, Homo sapiens
gacaaaggacggacagaug

SEQ ID NO: 669166 - RNA, 19 nt, Homo sapiens
gaaaggcugggccaaguuc

SEQ ID NO: 669167 - RNA, 19 nt, Homo sapiens
cagugggacucagguguua

SEQ ID NO: 669168 - RNA, 19 nt, Homo sapiens
cuucaaauauccaaacaca

SEQ ID NO: 669169 - RNA, 19 nt, Homo sapiens
gcucaacacgauggacuua

SEQ ID NO: 669170 - RNA, 19 nt, Homo sapiens
gcucuccgguggacacaga

SEQ ID NO: 669171 - RNA, 19 nt, Homo sapiens
uuaaguacaccuggaauaa

SEQ ID NO: 669172 - RNA, 19 nt, Homo sapiens
guaaggcucagaaccagaa

SEQ ID NO: 669173 - RNA, 19 nt, Homo sapiens
cagggcagguaaagagauu

SEQ ID NO: 669174 - RNA, 19 nt, Homo sapiens
gaagaacauguuugaugga

SEQ ID NO: 669175 - RNA, 19 nt, Homo sapiens
gcucgaagacugguuucua

SEQ ID NO: 669176 - RNA, 19 nt, Homo sapiens
gaaaggucauacgcuguca

SEQ ID NO: 669177 - RNA, 19 nt, Homo sapiens
agacugguuucuagcacua

SEQ ID NO: 669178 - RNA, 19 nt, Homo sapiens
ucaagggccuggguuggaa

SEQ ID NO: 669179 - RNA, 19 nt, Homo sapiens
acaagagauuuccacagaa

SEQ ID NO: 669180 - RNA, 19 nt, Homo sapiens
gaagaaggacaaguucauc

SEQ ID NO: 669181 - RNA, 19 nt, Homo sapiens
gaacaggugauuacguuuu

SEQ ID NO: 669182 - RNA, 19 nt, Homo sapiens
guuaauggaugaagaugac

SEQ ID NO: 669183 - RNA, 19 nt, Homo sapiens
guacaccuggaauaacuuu

SEQ ID NO: 669184 - RNA, 19 nt, Homo sapiens
uaaaucuuccacugaauga

SEQ ID NO: 669185 - RNA, 19 nt, Homo sapiens
gcagagaccagggcaguca

SEQ ID NO: 669186 - RNA, 19 nt, Homo sapiens
gagccaggaugaagauagg

SEQ ID NO: 669187 - RNA, 19 nt, Homo sapiens
ucuuaaagcugcauauacu

SEQ ID NO: 669188 - RNA, 19 nt, Homo sapiens
cugcauauacuccaagaaa

SEQ ID NO: 669189 - RNA, 19 nt, Homo sapiens
uaaauggcccagugugaug

SEQ ID NO: 669190 - RNA, 19 nt, Homo sapiens
gagacgaaccgcaggaaca

SEQ ID NO: 669191 - RNA, 19 nt, Homo sapiens
acaagcugcuggacaagga

SEQ ID NO: 669192 - RNA, 19 nt, Homo sapiens
gugagcuucugacuuguga

SEQ ID NO: 669193 - RNA, 19 nt, Homo sapiens
ggaguuaauggaugaagau

SEQ ID NO: 669194 - RNA, 19 nt, Homo sapiens
ccuuggagcuggcacugaa

SEQ ID NO: 669195 - RNA, 19 nt, Homo sapiens
guaaagcuggcaguugaaa

SEQ ID NO: 669196 - RNA, 19 nt, Homo sapiens
cuucaaugaugaggaguuu

SEQ ID NO: 669197 - RNA, 19 nt, Homo sapiens
uaccagauccagcagauga

SEQ ID NO: 669198 - RNA, 19 nt, Homo sapiens
gaccuggccuucucugacu

SEQ ID NO: 669199 - RNA, 19 nt, Homo sapiens
gcacugcugcacacaaaca

SEQ ID NO: 669200 - RNA, 19 nt, Homo sapiens
guccugcacuggcugaaug

SEQ ID NO: 669201 - RNA, 19 nt, Homo sapiens
ugacucacaggaaugcaua

SEQ ID NO: 669202 - RNA, 19 nt, Homo sapiens
ggacuuacugcuggacuug

SEQ ID NO: 669203 - RNA, 19 nt, Homo sapiens
gcaagauuugacugccuua

SEQ ID NO: 669204 - RNA, 19 nt, Homo sapiens
uaauugacccuugcagcua

SEQ ID NO: 669205 - RNA, 19 nt, Homo sapiens
gacguggguuccagugugu

SEQ ID NO: 669206 - RNA, 19 nt, Homo sapiens
cugaagaacauguuugaug

SEQ ID NO: 669207 - RNA, 19 nt, Homo sapiens
uugacaagcugcuggacaa

SEQ ID NO: 669208 - RNA, 19 nt, Homo sapiens
ccagaggcuuguggaguug

SEQ ID NO: 669209 - RNA, 19 nt, Homo sapiens
ggaucaguuuggcuucaau

SEQ ID NO: 669210 - RNA, 19 nt, Homo sapiens
cagccaacuucguggauca

SEQ ID NO: 669211 - RNA, 19 nt, Homo sapiens
cagccucccugacaacaca

SEQ ID NO: 669212 - RNA, 19 nt, Homo sapiens
ggagagcugccucgucagu

SEQ ID NO: 669213 - RNA, 19 nt, Homo sapiens
gagcuucugacuugugaug

SEQ ID NO: 669214 - RNA, 19 nt, Homo sapiens
acagaaggagccaagcuuu

SEQ ID NO: 669215 - RNA, 19 nt, Homo sapiens
cauguggacggcaguguuu

SEQ ID NO: 669216 - RNA, 19 nt, Homo sapiens
ugcaggaguuaauggauga

SEQ ID NO: 669217 - RNA, 19 nt, Homo sapiens
gacucucugugacauaguu

SEQ ID NO: 669218 - RNA, 19 nt, Homo sapiens
ucacgauguucuggaaguu

SEQ ID NO: 669219 - RNA, 19 nt, Homo sapiens
gucaaaugcuucucagacu

SEQ ID NO: 669220 - RNA, 19 nt, Homo sapiens
ugcacuggcugaaugaaga

SEQ ID NO: 669221 - RNA, 19 nt, Homo sapiens
ucaucagccugguguugaa

SEQ ID NO: 669222 - RNA, 19 nt, Homo sapiens
ucaacacgauggacuuacu

SEQ ID NO: 669223 - RNA, 19 nt, Homo sapiens
acaaacacacccagcauca

SEQ ID NO: 669224 - RNA, 19 nt, Homo sapiens
ccuugcagcuacccaauag

SEQ ID NO: 669225 - RNA, 19 nt, Homo sapiens
aaucuuccacugaaugaaa

SEQ ID NO: 669226 - RNA, 19 nt, Homo sapiens
aagguccgcuucaaauauc

SEQ ID NO: 669227 - RNA, 19 nt, Homo sapiens
ccacgucccauguugacaa

SEQ ID NO: 669228 - RNA, 19 nt, Homo sapiens
uguggagggugacucagaa

SEQ ID NO: 669229 - RNA, 19 nt, Homo sapiens
gcaccucagcgcuuaugga

SEQ ID NO: 669230 - RNA, 19 nt, Homo sapiens
gcaguugaaaccaguugga

SEQ ID NO: 669231 - RNA, 19 nt, Homo sapiens
gcauauaccuucacaguuc

SEQ ID NO: 669232 - RNA, 19 nt, Homo sapiens
gaaagagagcccaagaaua

SEQ ID NO: 669233 - RNA, 19 nt, Homo sapiens
gagaacccuuugaauauuu

SEQ ID NO: 669234 - RNA, 19 nt, Homo sapiens
gauaaagcaugccgaaaug

SEQ ID NO: 669235 - RNA, 19 nt, Homo sapiens
aaagagagcccaagaauau

SEQ ID NO: 669236 - RNA, 19 nt, Homo sapiens
ggaaacgcaugcaagcuaa

SEQ ID NO: 669237 - RNA, 19 nt, Homo sapiens
guaacaggcuuuaauuuag

SEQ ID NO: 669238 - RNA, 19 nt, Homo sapiens
guucguagcuugauugaau

SEQ ID NO: 669239 - RNA, 19 nt, Homo sapiens
cagcuugucuugcaucuaa

SEQ ID NO: 669240 - RNA, 19 nt, Homo sapiens
ggaguugucagaagucuua

SEQ ID NO: 669241 - RNA, 19 nt, Homo sapiens
gaauacaugcgaaauauga

SEQ ID NO: 669242 - RNA, 19 nt, Homo sapiens
caggaugacucaauguuaa

SEQ ID NO: 669243 - RNA, 19 nt, Homo sapiens
ucacagggaccacaaauaa

SEQ ID NO: 669244 - RNA, 19 nt, Homo sapiens
gcaggaugacucaauguua

SEQ ID NO: 669245 - RNA, 19 nt, Homo sapiens
gauauucagucaaggcauu

SEQ ID NO: 669246 - RNA, 19 nt, Homo sapiens
uuagagaacccuuugaaua

SEQ ID NO: 669247 - RNA, 19 nt, Homo sapiens
aguaagaaguugucaguaa

SEQ ID NO: 669248 - RNA, 19 nt, Homo sapiens
gaacaggaguauaacaaac

SEQ ID NO: 669249 - RNA, 19 nt, Homo sapiens
caacagcagagccauauuu

SEQ ID NO: 669250 - RNA, 19 nt, Homo sapiens
caguaugaguggaauauaa

SEQ ID NO: 669251 - RNA, 19 nt, Homo sapiens
gagaagggauauguuguga

SEQ ID NO: 669252 - RNA, 19 nt, Homo sapiens
guaaagcuuugugcaauga

SEQ ID NO: 669253 - RNA, 19 nt, Homo sapiens
uaacaaacuuaccacaaug

SEQ ID NO: 669254 - RNA, 19 nt, Homo sapiens
ucaacuagaucaagacaug

SEQ ID NO: 669255 - RNA, 19 nt, Homo sapiens
gauaaucuguaccucauca

SEQ ID NO: 669256 - RNA, 19 nt, Homo sapiens
gcccaagaauauuagauuu

SEQ ID NO: 669257 - RNA, 19 nt, Homo sapiens
gaaagagaacgacaacaug

SEQ ID NO: 669258 - RNA, 19 nt, Homo sapiens
ccacacucaugcuuacaua

SEQ ID NO: 669259 - RNA, 19 nt, Homo sapiens
gaaaccacacauaaucuuu

SEQ ID NO: 669260 - RNA, 19 nt, Homo sapiens
caaagaaugaggaaucaaa

SEQ ID NO: 669261 - RNA, 19 nt, Homo sapiens
gagaaugggagaagggaua

SEQ ID NO: 669262 - RNA, 19 nt, Homo sapiens
uagagaacccuuugaauau

SEQ ID NO: 669263 - RNA, 19 nt, Homo sapiens
gaucgagucaucaacagua

SEQ ID NO: 669264 - RNA, 19 nt, Homo sapiens
gugcuucuguguccaguuu

SEQ ID NO: 669265 - RNA, 19 nt, Homo sapiens
aaacagagaccuggagaaa

SEQ ID NO: 669266 - RNA, 19 nt, Homo sapiens
ccuguuaucuccuuguuug

SEQ ID NO: 669267 - RNA, 19 nt, Homo sapiens
caaccaccauuucagcuau

SEQ ID NO: 669268 - RNA, 19 nt, Homo sapiens
ugacucuccugaaauugua

SEQ ID NO: 669269 - RNA, 19 nt, Homo sapiens
agagaacccuuugaauauu

SEQ ID NO: 669270 - RNA, 19 nt, Homo sapiens
gcacuuuguaaacagauua

SEQ ID NO: 669271 - RNA, 19 nt, Homo sapiens
caaguuggagugugaauug

SEQ ID NO: 669272 - RNA, 19 nt, Homo sapiens
gcaacacaguaaagcuuug

SEQ ID NO: 669273 - RNA, 19 nt, Homo sapiens
uaaugaagcaacacaguaa

SEQ ID NO: 669274 - RNA, 19 nt, Homo sapiens
gaaagggagaauucaaaga

SEQ ID NO: 669275 - RNA, 19 nt, Homo sapiens
acacuugccuauccagaaa

SEQ ID NO: 669276 - RNA, 19 nt, Homo sapiens
gagcauauaccuucacagu

SEQ ID NO: 669277 - RNA, 19 nt, Homo sapiens
uggaauacaugcgaaauau

SEQ ID NO: 669278 - RNA, 19 nt, Homo sapiens
aaucaaagcacaaucaaga

SEQ ID NO: 669279 - RNA, 19 nt, Homo sapiens
agagagcccaagaauauua

SEQ ID NO: 669280 - RNA, 19 nt, Homo sapiens
guaagaaguugucaguaac

SEQ ID NO: 669281 - RNA, 19 nt, Homo sapiens
cgagaaaccacacauaauc

SEQ ID NO: 669282 - RNA, 19 nt, Homo sapiens
ugggauuacugacucauaa

SEQ ID NO: 669283 - RNA, 19 nt, Homo sapiens
caucaacaguauuccuuug

SEQ ID NO: 669284 - RNA, 19 nt, Homo sapiens
aaagggagaauucaaagaa

SEQ ID NO: 669285 - RNA, 19 nt, Homo sapiens
caagacauguuaaccuuuu

SEQ ID NO: 669286 - RNA, 19 nt, Homo sapiens
gcagucauuuugaguuaua

SEQ ID NO: 669287 - RNA, 19 nt, Homo sapiens
ccaaagcaaccauuaaaca

SEQ ID NO: 669288 - RNA, 19 nt, Homo sapiens
aauagcagguguuaaagga

SEQ ID NO: 669289 - RNA, 19 nt, Homo sapiens
gaacgacaacaugaucaaa

SEQ ID NO: 669290 - RNA, 19 nt, Homo sapiens
aaagagaacgacaacauga

SEQ ID NO: 669291 - RNA, 19 nt, Homo sapiens
gaugaacagauacaagaaa

SEQ ID NO: 669292 - RNA, 19 nt, Homo sapiens
auaagaaaguacuggauga

SEQ ID NO: 669293 - RNA, 19 nt, Homo sapiens
uaacaggcuuuaauuuagg

SEQ ID NO: 669294 - RNA, 19 nt, Homo sapiens
aggcagugcuugcuugaaa

SEQ ID NO: 669295 - RNA, 19 nt, Homo sapiens
guacugacgcugcacuuug

SEQ ID NO: 669296 - RNA, 19 nt, Homo sapiens
gagaugaguuugcuguacu

SEQ ID NO: 669297 - RNA, 19 nt, Homo sapiens
gcaaaagccaaccaaauaa

SEQ ID NO: 669298 - RNA, 19 nt, Homo sapiens
caguaaagcuuugugcaau

SEQ ID NO: 669299 - RNA, 19 nt, Homo sapiens
agaaaguacuggaugaaca

SEQ ID NO: 669300 - RNA, 19 nt, Homo sapiens
cuggugacaugauaaauau

SEQ ID NO: 669301 - RNA, 19 nt, Homo sapiens
gcugagccaucaaggucua

SEQ ID NO: 669302 - RNA, 19 nt, Homo sapiens
aguacuggaugaacagaua

SEQ ID NO: 669303 - RNA, 19 nt, Homo sapiens
gugcucuggugacaugaua

SEQ ID NO: 669304 - RNA, 19 nt, Homo sapiens
cuacgacgcuccccaagua

SEQ ID NO: 669305 - RNA, 19 nt, Homo sapiens
ggaccacaaauaagaaaga

SEQ ID NO: 669306 - RNA, 19 nt, Homo sapiens
gaagcagaagaaggaauua

SEQ ID NO: 669307 - RNA, 19 nt, Homo sapiens
gcuuggaacuugagaggau

SEQ ID NO: 669308 - RNA, 19 nt, Homo sapiens
aaacagugcucuggugaca

SEQ ID NO: 669309 - RNA, 19 nt, Homo sapiens
ggagaagggauauguugug

SEQ ID NO: 669310 - RNA, 19 nt, Homo sapiens
auaaccaggucagaaauuu

SEQ ID NO: 669311 - RNA, 19 nt, Homo sapiens
uagagaagcagaagaagga

SEQ ID NO: 669312 - RNA, 19 nt, Homo sapiens
ggaaaggaaacgcaugcaa

SEQ ID NO: 669313 - RNA, 19 nt, Homo sapiens
caagaaagggagaauucaa

SEQ ID NO: 669314 - RNA, 19 nt, Homo sapiens
uaaauaggaggacaucaau

SEQ ID NO: 669315 - RNA, 19 nt, Homo sapiens
caaagcaaccauuaaacau

SEQ ID NO: 669316 - RNA, 19 nt, Homo sapiens
aagacaaguuggaguguga

SEQ ID NO: 669317 - RNA, 19 nt, Homo sapiens
gacuuuacaggaugaauuu

SEQ ID NO: 669318 - RNA, 19 nt, Homo sapiens
cccaaugcaagaagaauua

SEQ ID NO: 669319 - RNA, 19 nt, Homo sapiens
acagugcucuggugacaug

SEQ ID NO: 669320 - RNA, 19 nt, Homo sapiens
cuaaauaggaggacaucaa

SEQ ID NO: 669321 - RNA, 19 nt, Homo sapiens
aaggaaacacugcaacuuu

SEQ ID NO: 669322 - RNA, 19 nt, Homo sapiens
gaugaugacaauuuacuuc

SEQ ID NO: 669323 - RNA, 19 nt, Homo sapiens
cagaauucauuacaaagca

SEQ ID NO: 669324 - RNA, 19 nt, Homo sapiens
cuaaugaagcaacacagua

SEQ ID NO: 669325 - RNA, 19 nt, Homo sapiens
ugcaagaguuggaagcaaa

SEQ ID NO: 669326 - RNA, 19 nt, Homo sapiens
ugauaaagcaugccgaaau

SEQ ID NO: 669327 - RNA, 19 nt, Homo sapiens
ggaaucaaagcacaaucaa

SEQ ID NO: 669328 - RNA, 19 nt, Homo sapiens
agaaagagagcccaagaau

SEQ ID NO: 669329 - RNA, 19 nt, Homo sapiens
gaaacuuagagaacccuuu

SEQ ID NO: 669330 - RNA, 19 nt, Homo sapiens
agacuuugaucaguguuaa

SEQ ID NO: 669331 - RNA, 19 nt, Homo sapiens
gcacuggccucuuaaauug

SEQ ID NO: 669332 - RNA, 19 nt, Homo sapiens
gagcacggauugugaauaa

SEQ ID NO: 669333 - RNA, 19 nt, Homo sapiens
gaacugagacuccuauugu

SEQ ID NO: 669334 - RNA, 19 nt, Homo sapiens
gaaaguaguucucuauugc

SEQ ID NO: 669335 - RNA, 19 nt, Homo sapiens
gcuaaggccugaaggauga

SEQ ID NO: 669336 - RNA, 19 nt, Homo sapiens
ggaggaaggucagagcuaa

SEQ ID NO: 669337 - RNA, 19 nt, Homo sapiens
gaagaggccuuggagaaau

SEQ ID NO: 669338 - RNA, 19 nt, Homo sapiens
uaacaugccuccuccuaga

SEQ ID NO: 669339 - RNA, 19 nt, Homo sapiens
gcacuuacgacccacguua

SEQ ID NO: 669340 - RNA, 19 nt, Homo sapiens
gggaauggaugagaauauu

SEQ ID NO: 669341 - RNA, 19 nt, Homo sapiens
gcacacaguaccuggauuu

SEQ ID NO: 669342 - RNA, 19 nt, Homo sapiens
agacuccuauuguggauua

SEQ ID NO: 669343 - RNA, 19 nt, Homo sapiens
ggacacgcauauauguuug

SEQ ID NO: 669344 - RNA, 19 nt, Homo sapiens
ggaagaggccuuggagaaa

SEQ ID NO: 669345 - RNA, 19 nt, Homo sapiens
ggucaggaguucaagauca

SEQ ID NO: 669346 - RNA, 19 nt, Homo sapiens
acgcauauauguuugguuu

SEQ ID NO: 669347 - RNA, 19 nt, Homo sapiens
cugcaggaguucuggauua

SEQ ID NO: 669348 - RNA, 19 nt, Homo sapiens
ccugaaggaugaugaggua

SEQ ID NO: 669349 - RNA, 19 nt, Homo sapiens
guugcucacucccguaaua

SEQ ID NO: 669350 - RNA, 19 nt, Homo sapiens
acaacugccucacgaauga

SEQ ID NO: 669351 - RNA, 19 nt, Homo sapiens
gaauggaugagaauauuug

SEQ ID NO: 669352 - RNA, 19 nt, Homo sapiens
gaauaaagccucacaugcu

SEQ ID NO: 669353 - RNA, 19 nt, Homo sapiens
guacaaauaacguuacuag

SEQ ID NO: 669354 - RNA, 19 nt, Homo sapiens
ugaggaaugucagaaguuu

SEQ ID NO: 669355 - RNA, 19 nt, Homo sapiens
cugcagaugucaugaggua

SEQ ID NO: 669356 - RNA, 19 nt, Homo sapiens
acaaauaacguuacuagga

SEQ ID NO: 669357 - RNA, 19 nt, Homo sapiens
gaacaaaggccccaucaga

SEQ ID NO: 669358 - RNA, 19 nt, Homo sapiens
uaagacccacucacaauaa

SEQ ID NO: 669359 - RNA, 19 nt, Homo sapiens
gaccacaggcugcaccaua

SEQ ID NO: 669360 - RNA, 19 nt, Homo sapiens
ucacugacuuccucaccua

SEQ ID NO: 669361 - RNA, 19 nt, Homo sapiens
gaaaugggacuggaauugu

SEQ ID NO: 669362 - RNA, 19 nt, Homo sapiens
agaaugaacuuguguccau

SEQ ID NO: 669363 - RNA, 19 nt, Homo sapiens
gggcuugguucauucauuc

SEQ ID NO: 669364 - RNA, 19 nt, Homo sapiens
acaagaaugugcugucugu

SEQ ID NO: 669365 - RNA, 19 nt, Homo sapiens
ggaauggaugagaauauuu

SEQ ID NO: 669366 - RNA, 19 nt, Homo sapiens
ugaccaacauucuuaaucu

SEQ ID NO: 669367 - RNA, 19 nt, Homo sapiens
gauuauaggacacgcauau

SEQ ID NO: 669368 - RNA, 19 nt, Homo sapiens
gcugcuggcuucagucaug

SEQ ID NO: 669369 - RNA, 19 nt, Homo sapiens
gccgagcccuguugcacua

SEQ ID NO: 669370 - RNA, 19 nt, Homo sapiens
ugaaggagaugagcuacga

SEQ ID NO: 669371 - RNA, 19 nt, Homo sapiens
ggagagaguggcugaguuc

SEQ ID NO: 669372 - RNA, 19 nt, Homo sapiens
gggucuagcuuuccuucuu

SEQ ID NO: 669373 - RNA, 19 nt, Homo sapiens
cguaguagauuccggaaag

SEQ ID NO: 669374 - RNA, 19 nt, Homo sapiens
gcagcuagcagacagugaa

SEQ ID NO: 669375 - RNA, 19 nt, Homo sapiens
ggcacuggccucuuaaauu

SEQ ID NO: 669376 - RNA, 19 nt, Homo sapiens
cauaagacccacucacaau

SEQ ID NO: 669377 - RNA, 19 nt, Homo sapiens
gcaucaaccucucuguucu

SEQ ID NO: 669378 - RNA, 19 nt, Homo sapiens
ccagguacaaauaacguua

SEQ ID NO: 669379 - RNA, 19 nt, Homo sapiens
ggucuagcuuuccuucuuc

SEQ ID NO: 669380 - RNA, 19 nt, Homo sapiens
gcaccugcccauccagaaa

SEQ ID NO: 669381 - RNA, 19 nt, Homo sapiens
gcacggauugugaauaaag

SEQ ID NO: 669382 - RNA, 19 nt, Homo sapiens
ggaaaccgccauccucuac

SEQ ID NO: 669383 - RNA, 19 nt, Homo sapiens
ccggaaaggugaaggagau

SEQ ID NO: 669384 - RNA, 19 nt, Homo sapiens
gcggaucgccugcaucuca

SEQ ID NO: 669385 - RNA, 19 nt, Homo sapiens
cgaccuaccucgcacuuac

SEQ ID NO: 669386 - RNA, 19 nt, Homo sapiens
ggagaaaugggacuggaau

SEQ ID NO: 669387 - RNA, 19 nt, Homo sapiens
gcaggagaauggagugaac

SEQ ID NO: 669388 - RNA, 19 nt, Homo sapiens
gaaaccccgucucuacuaa

SEQ ID NO: 669389 - RNA, 19 nt, Homo sapiens
aguaugagguccugauugu

SEQ ID NO: 669390 - RNA, 19 nt, Homo sapiens
gggcugcuccugcgacaaa

SEQ ID NO: 669391 - RNA, 19 nt, Homo sapiens
ccaggaaggaggagaaaga

SEQ ID NO: 669392 - RNA, 19 nt, Homo sapiens
gguuauaggacgugauuau

SEQ ID NO: 669393 - RNA, 19 nt, Homo sapiens
guauguauccaggguuaua

SEQ ID NO: 669394 - RNA, 19 nt, Homo sapiens
gaccaacauucuuaaucug

SEQ ID NO: 669395 - RNA, 19 nt, Homo sapiens
gccgugaccaacauucuua

SEQ ID NO: 669396 - RNA, 19 nt, Homo sapiens
gcuaccagauccgcuuuga

SEQ ID NO: 669397 - RNA, 19 nt, Homo sapiens
ugagguacccuuuguguca

SEQ ID NO: 669398 - RNA, 19 nt, Homo sapiens
gcgggaggaucacaaaguc

SEQ ID NO: 669399 - RNA, 19 nt, Homo sapiens
ggacauuuggcuuccagaa

SEQ ID NO: 669400 - RNA, 19 nt, Homo sapiens
gcaugggcuugguucauuc

SEQ ID NO: 669401 - RNA, 19 nt, Homo sapiens
cauccaagauuccuuacag

SEQ ID NO: 669402 - RNA, 19 nt, Homo sapiens
agagaucacugcagauguc

SEQ ID NO: 669403 - RNA, 19 nt, Homo sapiens
gggauccgcuucguaguag

SEQ ID NO: 669404 - RNA, 19 nt, Homo sapiens
agaccucagucaccauuga

SEQ ID NO: 669405 - RNA, 19 nt, Homo sapiens
uaccagauccgcuuugaga

SEQ ID NO: 669406 - RNA, 19 nt, Homo sapiens
gaucacugcagaugucaug

SEQ ID NO: 669407 - RNA, 19 nt, Homo sapiens
gacauuuggcuuccagaaa

SEQ ID NO: 669408 - RNA, 19 nt, Homo sapiens
cuguauguauccaggguua

SEQ ID NO: 669409 - RNA, 19 nt, Homo sapiens
cuuaaucuguccucuagug

SEQ ID NO: 669410 - RNA, 19 nt, Homo sapiens
auaagacccacucacaaua

SEQ ID NO: 669411 - RNA, 19 nt, Homo sapiens
caggaguucuggauuaguc

SEQ ID NO: 669412 - RNA, 19 nt, Homo sapiens
gagaaaugggacuggaauu

SEQ ID NO: 669413 - RNA, 19 nt, Homo sapiens
gucaugagguacccuuugu

SEQ ID NO: 669414 - RNA, 19 nt, Homo sapiens
cacaguaccuggauuuuga

SEQ ID NO: 669415 - RNA, 19 nt, Homo sapiens
aaagaacaggcugggauua

SEQ ID NO: 669416 - RNA, 19 nt, Homo sapiens
ggagcacggauugugaaua

SEQ ID NO: 669417 - RNA, 19 nt, Homo sapiens
gagcgcaucgcccaugaga

SEQ ID NO: 669418 - RNA, 19 nt, Homo sapiens
ccaucuuccuggccucuuu

SEQ ID NO: 669419 - RNA, 19 nt, Homo sapiens
ccacucaggugccccagua

SEQ ID NO: 669420 - RNA, 19 nt, Homo sapiens
ucgagaccauccuggcuaa

SEQ ID NO: 669421 - RNA, 19 nt, Homo sapiens
aagacccacucacaauaaa

SEQ ID NO: 669422 - RNA, 19 nt, Homo sapiens
accacaggcugcaccauaa

SEQ ID NO: 669423 - RNA, 19 nt, Homo sapiens
gcgcaucgcccaugagaac

SEQ ID NO: 669424 - RNA, 19 nt, Homo sapiens
cggcauccaagauuccuua

SEQ ID NO: 669425 - RNA, 19 nt, Homo sapiens
gaucacaaagucaggagau

SEQ ID NO: 669426 - RNA, 19 nt, Homo sapiens
guaccuggauuuugaugaa

SEQ ID NO: 669427 - RNA, 19 nt, Homo sapiens
gauccugggcuccauguuc

SEQ ID NO: 669428 - RNA, 19 nt, Homo sapiens
ggaaaggugaaggagauga

SEQ ID NO: 669429 - RNA, 19 nt, Homo sapiens
ccaccaagauuguauuccu

SEQ ID NO: 669430 - RNA, 19 nt, Homo sapiens
uugaacgccugcagagauu

SEQ ID NO: 669431 - RNA, 19 nt, Homo sapiens
caaaugagcucacuuauua

SEQ ID NO: 669432 - RNA, 19 nt, Homo sapiens
gcaaugcagucaauuauua

SEQ ID NO: 669433 - RNA, 19 nt, Homo sapiens
gaucagaguuucauaguuu

SEQ ID NO: 669434 - RNA, 19 nt, Homo sapiens
gaacugaaauguccuguga

SEQ ID NO: 669435 - RNA, 19 nt, Homo sapiens
ggaaaucccugcuaaugaa

SEQ ID NO: 669436 - RNA, 19 nt, Homo sapiens
gauguaagcuccaguaaga

SEQ ID NO: 669437 - RNA, 19 nt, Homo sapiens
gaaaguaacucugaaagug

SEQ ID NO: 669438 - RNA, 19 nt, Homo sapiens
ggaaaucacuuuauacauc

SEQ ID NO: 669439 - RNA, 19 nt, Homo sapiens
ggaaugaccucaggacuuu

SEQ ID NO: 669440 - RNA, 19 nt, Homo sapiens
ggagaaauccuaagagaaa

SEQ ID NO: 669441 - RNA, 19 nt, Homo sapiens
guaaauacacucacagaua

SEQ ID NO: 669442 - RNA, 19 nt, Homo sapiens
gcacgugacuggaaacuau

SEQ ID NO: 669443 - RNA, 19 nt, Homo sapiens
ccagugagcucucuagaaa

SEQ ID NO: 669444 - RNA, 19 nt, Homo sapiens
acaaagagcuggauagguu

SEQ ID NO: 669445 - RNA, 19 nt, Homo sapiens
gaacaggugugauucugaa

SEQ ID NO: 669446 - RNA, 19 nt, Homo sapiens
gaagagaccugcuuauugc

SEQ ID NO: 669447 - RNA, 19 nt, Homo sapiens
uaaaggaacugaaugaauc

SEQ ID NO: 669448 - RNA, 19 nt, Homo sapiens
gaaaugcuauucucaaguc

SEQ ID NO: 669449 - RNA, 19 nt, Homo sapiens
cgacuuggcuggacgguuu

SEQ ID NO: 669450 - RNA, 19 nt, Homo sapiens
gcagaaugcucucgcagaa

SEQ ID NO: 669451 - RNA, 19 nt, Homo sapiens
gagacaagauugaugauuc

SEQ ID NO: 669452 - RNA, 19 nt, Homo sapiens
gaaccgaggugccaaugga

SEQ ID NO: 669453 - RNA, 19 nt, Homo sapiens
ggaagagaccugcuuauug

SEQ ID NO: 669454 - RNA, 19 nt, Homo sapiens
ggucaaauccuacaagaaa

SEQ ID NO: 669455 - RNA, 19 nt, Homo sapiens
gaagagacaagauugauga

SEQ ID NO: 669456 - RNA, 19 nt, Homo sapiens
caagggagccgaaauagaa

SEQ ID NO: 669457 - RNA, 19 nt, Homo sapiens
ugauagacuucuuggauua

SEQ ID NO: 669458 - RNA, 19 nt, Homo sapiens
gaaaagacgucaaguacaa

SEQ ID NO: 669459 - RNA, 19 nt, Homo sapiens
guaaaguaguuaagcauug

SEQ ID NO: 669460 - RNA, 19 nt, Homo sapiens
gcacuauaguugaguuuga

SEQ ID NO: 669461 - RNA, 19 nt, Homo sapiens
cgacacaccuguagacguu

SEQ ID NO: 669462 - RNA, 19 nt, Homo sapiens
cagaggaaaucaugauaaa

SEQ ID NO: 669463 - RNA, 19 nt, Homo sapiens
gaagagaacagcugaagau

SEQ ID NO: 669464 - RNA, 19 nt, Homo sapiens
cuucauagaugcauacaaa

SEQ ID NO: 669465 - RNA, 19 nt, Homo sapiens
gcaaagcucuacuggaaag

SEQ ID NO: 669466 - RNA, 19 nt, Homo sapiens
auagaaaucuugccacaaa

SEQ ID NO: 669467 - RNA, 19 nt, Homo sapiens
gaaggaauaagaagacaaa

SEQ ID NO: 669468 - RNA, 19 nt, Homo sapiens
gaacuaaucaccuguccaa

SEQ ID NO: 669469 - RNA, 19 nt, Homo sapiens
gaagaaaccaaaccaccua

SEQ ID NO: 669470 - RNA, 19 nt, Homo sapiens
guaaaggcaaugucuauuu

SEQ ID NO: 669471 - RNA, 19 nt, Homo sapiens
gaaguuaccaacagcagua

SEQ ID NO: 669472 - RNA, 19 nt, Homo sapiens
caacagaaguuaccaacag

SEQ ID NO: 669473 - RNA, 19 nt, Homo sapiens
gaaugaauccaaccuuaaa

SEQ ID NO: 669474 - RNA, 19 nt, Homo sapiens
gaauagagagugaugaaga

SEQ ID NO: 669475 - RNA, 19 nt, Homo sapiens
guucagugcuguacauuug

SEQ ID NO: 669476 - RNA, 19 nt, Homo sapiens
ggaaaggaauggaaaauau

SEQ ID NO: 669477 - RNA, 19 nt, Homo sapiens
ucacagauauguacagcaa

SEQ ID NO: 669478 - RNA, 19 nt, Homo sapiens
ggaaacacauggucacucu

SEQ ID NO: 669479 - RNA, 19 nt, Homo sapiens
gauggaaagugauggcauu

SEQ ID NO: 669480 - RNA, 19 nt, Homo sapiens
caauauugguguagauuug

SEQ ID NO: 669481 - RNA, 19 nt, Homo sapiens
guacugcauuuacaauuug

SEQ ID NO: 669482 - RNA, 19 nt, Homo sapiens
cauaugugcugucuauuau

SEQ ID NO: 669483 - RNA, 19 nt, Homo sapiens
uaaaggcaaugucuauuuc

SEQ ID NO: 669484 - RNA, 19 nt, Homo sapiens
ggaauaagaagacaaaugg

SEQ ID NO: 669485 - RNA, 19 nt, Homo sapiens
ccacagacauccucuccaa

SEQ ID NO: 669486 - RNA, 19 nt, Homo sapiens
ggaaagacccgcagaaugc

SEQ ID NO: 669487 - RNA, 19 nt, Homo sapiens
gaaauagcauaagagcauu

SEQ ID NO: 669488 - RNA, 19 nt, Homo sapiens
gaagaacucaugaccauca

SEQ ID NO: 669489 - RNA, 19 nt, Homo sapiens
agaagacccugaacugaaa

SEQ ID NO: 669490 - RNA, 19 nt, Homo sapiens
ggacacuccuaucaacuau

SEQ ID NO: 669491 - RNA, 19 nt, Homo sapiens
cgacauggguggaagacaa

SEQ ID NO: 669492 - RNA, 19 nt, Homo sapiens
gagguaguuuguuuguaua

SEQ ID NO: 669493 - RNA, 19 nt, Homo sapiens
ugagguaguuuguuuguau

SEQ ID NO: 669494 - RNA, 19 nt, Homo sapiens
ccauaugugcugucuauua

SEQ ID NO: 669495 - RNA, 19 nt, Homo sapiens
gaaacuuuggucauuguua

SEQ ID NO: 669496 - RNA, 19 nt, Homo sapiens
uuucagggauuguaaagua

SEQ ID NO: 669497 - RNA, 19 nt, Homo sapiens
aaacuaugcuucccacaga

SEQ ID NO: 669498 - RNA, 19 nt, Homo sapiens
ccagugaaauuuccuaauc

SEQ ID NO: 669499 - RNA, 19 nt, Homo sapiens
gcagaggaaaucaugauaa

SEQ ID NO: 669500 - RNA, 19 nt, Homo sapiens
caagacaacauucaauuug

SEQ ID NO: 669501 - RNA, 19 nt, Homo sapiens
gcucagaauuuguuagcaa

SEQ ID NO: 669502 - RNA, 19 nt, Homo sapiens
aaggaaagguggugucaaa

SEQ ID NO: 669503 - RNA, 19 nt, Homo sapiens
ggacaaguuuggugaagca

SEQ ID NO: 669504 - RNA, 19 nt, Homo sapiens
ggacuuuguguucauguua

SEQ ID NO: 669505 - RNA, 19 nt, Homo sapiens
gaaacaagacaacauucaa

SEQ ID NO: 669506 - RNA, 19 nt, Homo sapiens
gaaauaaaggaacugaaug

SEQ ID NO: 669507 - RNA, 19 nt, Homo sapiens
agagagugaugaagaaauu

SEQ ID NO: 669508 - RNA, 19 nt, Homo sapiens
aacaagagcuaccacauug

SEQ ID NO: 669509 - RNA, 19 nt, Homo sapiens
acaaacacauccaaaugaa

SEQ ID NO: 669510 - RNA, 19 nt, Homo sapiens
gaaaacagccugcucagaa

SEQ ID NO: 669511 - RNA, 19 nt, Homo sapiens
gagcugcacggaaggaaua

SEQ ID NO: 669512 - RNA, 19 nt, Homo sapiens
gcagauaugaugaaacuuc

SEQ ID NO: 669513 - RNA, 19 nt, Homo sapiens
cugaaugaauccaaccuua

SEQ ID NO: 669514 - RNA, 19 nt, Homo sapiens
gaaaggaggcaaaccaaag

SEQ ID NO: 669515 - RNA, 19 nt, Homo sapiens
gacgagugcuuucugauuc

SEQ ID NO: 669516 - RNA, 19 nt, Homo sapiens
caagaaaacuccaguagga

SEQ ID NO: 669517 - RNA, 19 nt, Homo sapiens
ugagcucacuuauuacaaa

SEQ ID NO: 669518 - RNA, 19 nt, Homo sapiens
uuugaacucuugaaccuua

SEQ ID NO: 669519 - RNA, 19 nt, Homo sapiens
acugaaauguccugugaua

SEQ ID NO: 669520 - RNA, 19 nt, Homo sapiens
gcacuuugauauacugcaa

SEQ ID NO: 669521 - RNA, 19 nt, Homo sapiens
ucacaggcuugauguauuc

SEQ ID NO: 669522 - RNA, 19 nt, Homo sapiens
guacuaggaaaucacuuua

SEQ ID NO: 669523 - RNA, 19 nt, Homo sapiens
ugaguugacauacaaguua

SEQ ID NO: 669524 - RNA, 19 nt, Homo sapiens
caagaaacacagaaaucua

SEQ ID NO: 669525 - RNA, 19 nt, Homo sapiens
uaccauaugugcugucuau

SEQ ID NO: 669526 - RNA, 19 nt, Homo sapiens
guggagaaauccuaagaga

SEQ ID NO: 669527 - RNA, 19 nt, Homo sapiens
ucuaaggacugcacuauag

SEQ ID NO: 669528 - RNA, 19 nt, Homo sapiens
uuugaagucugccguauuu

SEQ ID NO: 669529 - RNA, 19 nt, Homo sapiens
cguacugcauuuacaauuu

SEQ ID NO: 669530 - RNA, 19 nt, Homo sapiens
ugaaggguauccaugugua

SEQ ID NO: 669531 - RNA, 19 nt, Homo sapiens
cagagaaacucaucuauaa

SEQ ID NO: 669532 - RNA, 19 nt, Homo sapiens
uaaaggaacuucagcauga

SEQ ID NO: 669533 - RNA, 19 nt, Homo sapiens
gaccacagcuccuuucaaa

SEQ ID NO: 669534 - RNA, 19 nt, Homo sapiens
uuacuuaccugcuugaaua

SEQ ID NO: 669535 - RNA, 19 nt, Homo sapiens
guacauggcuccugagguu

SEQ ID NO: 669536 - RNA, 19 nt, Homo sapiens
gaaagggacucucagugaa

SEQ ID NO: 669537 - RNA, 19 nt, Homo sapiens
guggagaccucgcagauua

SEQ ID NO: 669538 - RNA, 19 nt, Homo sapiens
gaagaacagucgaaagaug

SEQ ID NO: 669539 - RNA, 19 nt, Homo sapiens
ccaaauagcuagucaugga

SEQ ID NO: 669540 - RNA, 19 nt, Homo sapiens
gaacagugauauaccaaug

SEQ ID NO: 669541 - RNA, 19 nt, Homo sapiens
aaacaaaguuggugaccua

SEQ ID NO: 669542 - RNA, 19 nt, Homo sapiens
uaggaaaucugccuuauug

SEQ ID NO: 669543 - RNA, 19 nt, Homo sapiens
guuccuacguuguguauua

SEQ ID NO: 669544 - RNA, 19 nt, Homo sapiens
gcagagaaacucaucuaua

SEQ ID NO: 669545 - RNA, 19 nt, Homo sapiens
gcaagaaacuuacagaaaa

SEQ ID NO: 669546 - RNA, 19 nt, Homo sapiens
aaucauggaucaagagaua

SEQ ID NO: 669547 - RNA, 19 nt, Homo sapiens
gaacgaacgauauaaauuc

SEQ ID NO: 669548 - RNA, 19 nt, Homo sapiens
ggugaugccuuugggauua

SEQ ID NO: 669549 - RNA, 19 nt, Homo sapiens
ucacugaauuguuguguaa

SEQ ID NO: 669550 - RNA, 19 nt, Homo sapiens
gagcaugcaucuuuaaaca

SEQ ID NO: 669551 - RNA, 19 nt, Homo sapiens
gaaguuaucagaucaacaa

SEQ ID NO: 669552 - RNA, 19 nt, Homo sapiens
gaucuuggcuacugucaug

SEQ ID NO: 669553 - RNA, 19 nt, Homo sapiens
gaccgaagauauuguuuau

SEQ ID NO: 669554 - RNA, 19 nt, Homo sapiens
ucagaccacucaugugaua

SEQ ID NO: 669555 - RNA, 19 nt, Homo sapiens
gagcauaggaacagugaua

SEQ ID NO: 669556 - RNA, 19 nt, Homo sapiens
cauauuaaguggcuuguug

SEQ ID NO: 669557 - RNA, 19 nt, Homo sapiens
ccacagagaucucaaacca

SEQ ID NO: 669558 - RNA, 19 nt, Homo sapiens
acagagcucuuuggcauua

SEQ ID NO: 669559 - RNA, 19 nt, Homo sapiens
guacaugguucuccaagau

SEQ ID NO: 669560 - RNA, 19 nt, Homo sapiens
agagaaacaucaccuuauu

SEQ ID NO: 669561 - RNA, 19 nt, Homo sapiens
gaacaagcagugauuugaa

SEQ ID NO: 669562 - RNA, 19 nt, Homo sapiens
uaucucaguuguagguuua

SEQ ID NO: 669563 - RNA, 19 nt, Homo sapiens
uuaaacagcucaggaagaa

SEQ ID NO: 669564 - RNA, 19 nt, Homo sapiens
ucaguuaucaccuguguua

SEQ ID NO: 669565 - RNA, 19 nt, Homo sapiens
cgauauaaauucugcauca

SEQ ID NO: 669566 - RNA, 19 nt, Homo sapiens
gcacagacaguuuaaauac

SEQ ID NO: 669567 - RNA, 19 nt, Homo sapiens
guaacugcaugcauuauuc

SEQ ID NO: 669568 - RNA, 19 nt, Homo sapiens
uaauugugcuguagaaaug

SEQ ID NO: 669569 - RNA, 19 nt, Homo sapiens
ggaacacacagacaccuua

SEQ ID NO: 669570 - RNA, 19 nt, Homo sapiens
uaauaucccuccaggaaug

SEQ ID NO: 669571 - RNA, 19 nt, Homo sapiens
gaagaaauagcuuaagaag

SEQ ID NO: 669572 - RNA, 19 nt, Homo sapiens
uccaagaucugcaguggua

SEQ ID NO: 669573 - RNA, 19 nt, Homo sapiens
guacuuccuuagugaguuu

SEQ ID NO: 669574 - RNA, 19 nt, Homo sapiens
guagcuggguacauauuaa

SEQ ID NO: 669575 - RNA, 19 nt, Homo sapiens
ucugacaguucaccaaaua

SEQ ID NO: 669576 - RNA, 19 nt, Homo sapiens
caaaguuggugaccuaaag

SEQ ID NO: 669577 - RNA, 19 nt, Homo sapiens
ggaagaaauagcuuaagaa

SEQ ID NO: 669578 - RNA, 19 nt, Homo sapiens
gauuacagcuugaguucug

SEQ ID NO: 669579 - RNA, 19 nt, Homo sapiens
cagaaaagcugaaucgauu

SEQ ID NO: 669580 - RNA, 19 nt, Homo sapiens
gaacuucucccaccaagca

SEQ ID NO: 669581 - RNA, 19 nt, Homo sapiens
gagcagaaucuuacaucua

SEQ ID NO: 669582 - RNA, 19 nt, Homo sapiens
ugaauaaugguucugguua

SEQ ID NO: 669583 - RNA, 19 nt, Homo sapiens
gugaauaaauguaccuuag

SEQ ID NO: 669584 - RNA, 19 nt, Homo sapiens
cuacaaguuuccaaagauu

SEQ ID NO: 669585 - RNA, 19 nt, Homo sapiens
gagaaacaucaccuuauuu

SEQ ID NO: 669586 - RNA, 19 nt, Homo sapiens
cgaaagggacucucaguga

SEQ ID NO: 669587 - RNA, 19 nt, Homo sapiens
gguuauacuuccauuauca

SEQ ID NO: 669588 - RNA, 19 nt, Homo sapiens
ggaagugauuggccuaaag

SEQ ID NO: 669589 - RNA, 19 nt, Homo sapiens
gcauuauucuugaaacuag

SEQ ID NO: 669590 - RNA, 19 nt, Homo sapiens
guaugaaauuccaguaguu

SEQ ID NO: 669591 - RNA, 19 nt, Homo sapiens
ggagaaugcaggcaguuaa

SEQ ID NO: 669592 - RNA, 19 nt, Homo sapiens
aaacaacuguguauuggau

SEQ ID NO: 669593 - RNA, 19 nt, Homo sapiens
caaagaacaagcagugauu

SEQ ID NO: 669594 - RNA, 19 nt, Homo sapiens
gaugaaaucaacaguguga

SEQ ID NO: 669595 - RNA, 19 nt, Homo sapiens
uggagcagcugguguugua

SEQ ID NO: 669596 - RNA, 19 nt, Homo sapiens
gggcagcacagacaguuua

SEQ ID NO: 669597 - RNA, 19 nt, Homo sapiens
guuaucagaucaacaagga

SEQ ID NO: 669598 - RNA, 19 nt, Homo sapiens
ugacacggaugacuuuguu

SEQ ID NO: 669599 - RNA, 19 nt, Homo sapiens
caccaucccuuccagauau

SEQ ID NO: 669600 - RNA, 19 nt, Homo sapiens
ccagagaaacaucaccuua

SEQ ID NO: 669601 - RNA, 19 nt, Homo sapiens
ccagguacuuccuuaguga

SEQ ID NO: 669602 - RNA, 19 nt, Homo sapiens
aaucugaacucuuugacaa

SEQ ID NO: 669603 - RNA, 19 nt, Homo sapiens
gaaacaaaaucauggauca

SEQ ID NO: 669604 - RNA, 19 nt, Homo sapiens
ccaggcaguuugauauuug

SEQ ID NO: 669605 - RNA, 19 nt, Homo sapiens
ggaaaucugccuuauugga

SEQ ID NO: 669606 - RNA, 19 nt, Homo sapiens
ccucaagacuuaaggaugu

SEQ ID NO: 669607 - RNA, 19 nt, Homo sapiens
uaucaaggcuaauuaagag

SEQ ID NO: 669608 - RNA, 19 nt, Homo sapiens
cauagacccuuuccagaau

SEQ ID NO: 669609 - RNA, 19 nt, Homo sapiens
ucuaugauguucaggaauu

SEQ ID NO: 669610 - RNA, 19 nt, Homo sapiens
caucugcuguguccuugua

SEQ ID NO: 669611 - RNA, 19 nt, Homo sapiens
gcagacgugcuucaaauga

SEQ ID NO: 669612 - RNA, 19 nt, Homo sapiens
ucacaaauacugcuuggaa

SEQ ID NO: 669613 - RNA, 19 nt, Homo sapiens
ggagguagcuauuaaaagu

SEQ ID NO: 669614 - RNA, 19 nt, Homo sapiens
aaucugagcaugcaucuuu

SEQ ID NO: 669615 - RNA, 19 nt, Homo sapiens
cagcugguguuguacauga

SEQ ID NO: 669616 - RNA, 19 nt, Homo sapiens
gcagagcaaggcaguguuu

SEQ ID NO: 669617 - RNA, 19 nt, Homo sapiens
gcauaggaacagugauaua

SEQ ID NO: 669618 - RNA, 19 nt, Homo sapiens
ggucuuuaauacaguguuu

SEQ ID NO: 669619 - RNA, 19 nt, Homo sapiens
uugcugagguguaaaggua

SEQ ID NO: 669620 - RNA, 19 nt, Homo sapiens
aggaaacuguagcuucuua

SEQ ID NO: 669621 - RNA, 19 nt, Homo sapiens
ggaauuaucagcgcauaga

SEQ ID NO: 669622 - RNA, 19 nt, Homo sapiens
gcucguuaccuacauagua

SEQ ID NO: 669623 - RNA, 19 nt, Homo sapiens
gugaaacagugaagucuca

SEQ ID NO: 669624 - RNA, 19 nt, Homo sapiens
ggaaugagccacgggaaug

SEQ ID NO: 669625 - RNA, 19 nt, Homo sapiens
guuuggacuuggugaauaa

SEQ ID NO: 669626 - RNA, 19 nt, Homo sapiens
ugaaugugaugcugauguu

SEQ ID NO: 669627 - RNA, 19 nt, Homo sapiens
gaacaagaacaaccucagu

SEQ ID NO: 669628 - RNA, 19 nt, Homo sapiens
cacaaauacugcuuggaaa

SEQ ID NO: 669629 - RNA, 19 nt, Homo sapiens
ccaggaaacuguagcuucu

SEQ ID NO: 669630 - RNA, 19 nt, Homo sapiens
ggaaagacuccuauauguc

SEQ ID NO: 669631 - RNA, 19 nt, Homo sapiens
gaacaaguuucaugaagaa

SEQ ID NO: 669632 - RNA, 19 nt, Homo sapiens
uaacuuagauggagaagaa

SEQ ID NO: 669633 - RNA, 19 nt, Homo sapiens
guaaucaacuggcauauga

SEQ ID NO: 669634 - RNA, 19 nt, Homo sapiens
caaguggagucuauaaaua

SEQ ID NO: 669635 - RNA, 19 nt, Homo sapiens
gaaaguaucacaagauuug

SEQ ID NO: 669636 - RNA, 19 nt, Homo sapiens
gcaaaucacuagaagagaa

SEQ ID NO: 669637 - RNA, 19 nt, Homo sapiens
gguaagagauugcaguuug

SEQ ID NO: 669638 - RNA, 19 nt, Homo sapiens
gacacaaguugaagauuua

SEQ ID NO: 669639 - RNA, 19 nt, Homo sapiens
gaaaagagauggaaccaaa

SEQ ID NO: 669640 - RNA, 19 nt, Homo sapiens
ggagaacauucgaauaauu

SEQ ID NO: 669641 - RNA, 19 nt, Homo sapiens
gcaaagaaaucaauaacca

SEQ ID NO: 669642 - RNA, 19 nt, Homo sapiens
gaagaagaaaguccuguua

SEQ ID NO: 669643 - RNA, 19 nt, Homo sapiens
gcagagaaauuacggauag

SEQ ID NO: 669644 - RNA, 19 nt, Homo sapiens
ggaaauugaucaagagaau

SEQ ID NO: 669645 - RNA, 19 nt, Homo sapiens
caagcaagguuaaaucaaa

SEQ ID NO: 669646 - RNA, 19 nt, Homo sapiens
ugagagagauuucugauau

SEQ ID NO: 669647 - RNA, 19 nt, Homo sapiens
gaaaagccauccaaagaua

SEQ ID NO: 669648 - RNA, 19 nt, Homo sapiens
gaaugcaacugcuagacua

SEQ ID NO: 669649 - RNA, 19 nt, Homo sapiens
acaaugaacugacugcuaa

SEQ ID NO: 669650 - RNA, 19 nt, Homo sapiens
aaagauaaauuccgaguga

SEQ ID NO: 669651 - RNA, 19 nt, Homo sapiens
gaagaaaguccuguuaauu

SEQ ID NO: 669652 - RNA, 19 nt, Homo sapiens
gacaggaguuauuaaagua

SEQ ID NO: 669653 - RNA, 19 nt, Homo sapiens
gaacaaguggagucuauaa

SEQ ID NO: 669654 - RNA, 19 nt, Homo sapiens
gaacuagaacuggcuaaua

SEQ ID NO: 669655 - RNA, 19 nt, Homo sapiens
ccuuguaccuuuauacuua

SEQ ID NO: 669656 - RNA, 19 nt, Homo sapiens
gagacaaaguaaucaauga

SEQ ID NO: 669657 - RNA, 19 nt, Homo sapiens
uaacuaugcuggaaaugaa

SEQ ID NO: 669658 - RNA, 19 nt, Homo sapiens
agagaaaucuugacuuaga

SEQ ID NO: 669659 - RNA, 19 nt, Homo sapiens
agacacaaguugaagauuu

SEQ ID NO: 669660 - RNA, 19 nt, Homo sapiens
acaaacggcuugggauuua

SEQ ID NO: 669661 - RNA, 19 nt, Homo sapiens
ugagaucgcucuaaggaaa

SEQ ID NO: 669662 - RNA, 19 nt, Homo sapiens
gaaaacaucuccuuaaaag

SEQ ID NO: 669663 - RNA, 19 nt, Homo sapiens
uaacaaagcaguugaauac

SEQ ID NO: 669664 - RNA, 19 nt, Homo sapiens
gaaguagagucccucagaa

SEQ ID NO: 669665 - RNA, 19 nt, Homo sapiens
ugaagaagcuacaggauca
